United States Patent 7,888,497 (BIOINFORMATICALLY DETECTABLE GROUP OF NOVEL REGULATORY OLIGONUCLEOTIDES AND USES THEREOF) - sequence listing, part 147

SEQ ID NO: 6233922 - DNA, 19 bp, Homo sapiens
gacctgcccccgctctgcc

SEQ ID NO: 6233923 - DNA, 23 bp, Homo sapiens
gacctgccccggacctacctccc

SEQ ID NO: 6233924 - DNA, 16 bp, Homo sapiens
gacctgcccctgccgc

SEQ ID NO: 6233925 - DNA, 23 bp, Homo sapiens
gacctgccctctctgcgctgagg

SEQ ID NO: 6233926 - DNA, 13 bp, Homo sapiens
gacctgcctagca

SEQ ID NO: 6233927 - DNA, 13 bp, Homo sapiens
gacctgcctcctg

SEQ ID NO: 6233928 - DNA, 18 bp, Homo sapiens
gacctgcctctcacacac

SEQ ID NO: 6233929 - DNA, 18 bp, Homo sapiens
gacctgcctgcataggag

SEQ ID NO: 6233930 - DNA, 20 bp, Homo sapiens
gacctgcgcaaagggcgggc

SEQ ID NO: 6233931 - DNA, 22 bp, Homo sapiens
gacctgcgcaaagggcgggcct

SEQ ID NO: 6233932 - DNA, 18 bp, Homo sapiens
gacctgcgggtcctcagc

SEQ ID NO: 6233933 - DNA, 21 bp, Homo sapiens
gacctgcgggtcctcagctgc

SEQ ID NO: 6233934 - DNA, 15 bp, Homo sapiens
gacctgctaggccag

SEQ ID NO: 6233935 - DNA, 17 bp, Homo sapiens
gacctgctaggccagag

SEQ ID NO: 6233936 - DNA, 19 bp, Homo sapiens
gacctgctaggccagagcc

SEQ ID NO: 6233937 - DNA, 21 bp, Homo sapiens
gacctgctaggccagagccca

SEQ ID NO: 6233938 - DNA, 17 bp, Homo sapiens
gacctgctccagatcct

SEQ ID NO: 6233939 - DNA, 17 bp, Homo sapiens
gacctgctccgccagga

SEQ ID NO: 6233940 - DNA, 19 bp, Homo sapiens
gacctgctccgccaggaaa

SEQ ID NO: 6233941 - DNA, 21 bp, Homo sapiens
gacctgctccgctgctccttg

SEQ ID NO: 6233942 - DNA, 15 bp, Homo sapiens
gacctgctcctgccc

SEQ ID NO: 6233943 - DNA, 16 bp, Homo sapiens
gacctgctcctgccca

SEQ ID NO: 6233944 - DNA, 11 bp, Homo sapiens
gacctgctgag

SEQ ID NO: 6233945 - DNA, 15 bp, Homo sapiens
gacctgctgctcagt

SEQ ID NO: 6233946 - DNA, 22 bp, Homo sapiens
gacctgctgctccatggatgca

SEQ ID NO: 6233947 - DNA, 20 bp, Homo sapiens
gacctgcttagctgccttga

SEQ ID NO: 6233948 - DNA, 17 bp, Homo sapiens
gacctgctttttgaaat

SEQ ID NO: 6233949 - DNA, 18 bp, Homo sapiens
gacctgctttttgaaatg

SEQ ID NO: 6233950 - DNA, 19 bp, Homo sapiens
gacctgctttttgaaatga

SEQ ID NO: 6233951 - DNA, 22 bp, Homo sapiens
gacctggaactgtagggccagg

SEQ ID NO: 6233952 - DNA, 20 bp, Homo sapiens
gacctggaagaacaggcctc

SEQ ID NO: 6233953 - DNA, 18 bp, Homo sapiens
gacctggacacaggcctg

SEQ ID NO: 6233954 - DNA, 18 bp, Homo sapiens
gacctggactagggcctc

SEQ ID NO: 6233955 - DNA, 13 bp, Homo sapiens
gacctggagcccc

SEQ ID NO: 6233956 - DNA, 14 bp, Homo sapiens
gacctggagcccct

SEQ ID NO: 6233957 - DNA, 17 bp, Homo sapiens
gacctggagctgccagc

SEQ ID NO: 6233958 - DNA, 19 bp, Homo sapiens
gacctggagcttcagccag

SEQ ID NO: 6233959 - DNA, 15 bp, Homo sapiens
gacctggaggggaga

SEQ ID NO: 6233960 - DNA, 19 bp, Homo sapiens
gacctggaggggagaggtc

SEQ ID NO: 6233961 - DNA, 21 bp, Homo sapiens
gacctggaggggagaggtcag

SEQ ID NO: 6233962 - DNA, 20 bp, Homo sapiens
gacctggatagttaagggct

SEQ ID NO: 6233963 - DNA, 15 bp, Homo sapiens
gacctggcagctctg

SEQ ID NO: 6233964 - DNA, 11 bp, Homo sapiens
gacctggcagt

SEQ ID NO: 6233965 - DNA, 16 bp, Homo sapiens
gacctggcctctgcca

SEQ ID NO: 6233966 - DNA, 15 bp, Homo sapiens
gacctggcctgtctg

SEQ ID NO: 6233967 - DNA, 17 bp, Homo sapiens
gacctggcgtgctcaga

SEQ ID NO: 6233968 - DNA, 15 bp, Homo sapiens
gacctggctaatgga

SEQ ID NO: 6233969 - DNA, 15 bp, Homo sapiens
gacctggctctcaga

SEQ ID NO: 6233970 - DNA, 11 bp, Homo sapiens
gacctggctgc

SEQ ID NO: 6233971 - DNA, 21 bp, Homo sapiens
gacctggctgcccctcacctt

SEQ ID NO: 6233972 - DNA, 15 bp, Homo sapiens
gacctggctgggcct

SEQ ID NO: 6233973 - DNA, 16 bp, Homo sapiens
gacctggctgggcctg

SEQ ID NO: 6233974 - DNA, 19 bp, Homo sapiens
gacctggctgggcctgggc

SEQ ID NO: 6233975 - DNA, 20 bp, Homo sapiens
gacctggctgggcctgggct

SEQ ID NO: 6233976 - DNA, 22 bp, Homo sapiens
gacctgggacaagcaggccgcc

SEQ ID NO: 6233977 - DNA, 22 bp, Homo sapiens
gacctgggccaaaagggcagcc

SEQ ID NO: 6233978 - DNA, 21 bp, Homo sapiens
gacctgggcccacagagcctg

SEQ ID NO: 6233979 - DNA, 14 bp, Homo sapiens
gacctgggccctgg

SEQ ID NO: 6233980 - DNA, 16 bp, Homo sapiens
gacctgggccctggtt

SEQ ID NO: 6233981 - DNA, 23 bp, Homo sapiens
gacctgggctcttggccgtggca

SEQ ID NO: 6233982 - DNA, 11 bp, Homo sapiens
gacctgggggt

SEQ ID NO: 6233983 - DNA, 17 bp, Homo sapiens
gacctggggtcccccct

SEQ ID NO: 6233984 - DNA, 18 bp, Homo sapiens
gacctggggtcccccctc

SEQ ID NO: 6233985 - DNA, 17 bp, Homo sapiens
gacctggggtgggcaca

SEQ ID NO: 6233986 - DNA, 21 bp, Homo sapiens
gacctggggtgggcacaggga

SEQ ID NO: 6233987 - DNA, 15 bp, Homo sapiens
gacctggggtgggga

SEQ ID NO: 6233988 - DNA, 19 bp, Homo sapiens
gacctggggtggggaggca

SEQ ID NO: 6233989 - DNA, 20 bp, Homo sapiens
gacctggggtggggaggcag

SEQ ID NO: 6233990 - DNA, 20 bp, Homo sapiens
gacctggtacactctgattt

SEQ ID NO: 6233991 - DNA, 21 bp, Homo sapiens
gacctggtaccctcctggctc

SEQ ID NO: 6233992 - DNA, 23 bp, Homo sapiens
gacctggtaccctcctggctctt

SEQ ID NO: 6233993 - DNA, 13 bp, Homo sapiens
gacctggtcaggg

SEQ ID NO: 6233994 - DNA, 17 bp, Homo sapiens
gacctggtccacagggc

SEQ ID NO: 6233995 - DNA, 19 bp, Homo sapiens
gacctggtccacagggcac

SEQ ID NO: 6233996 - DNA, 13 bp, Homo sapiens
gacctggtctggt

SEQ ID NO: 6233997 - DNA, 16 bp, Homo sapiens
gacctggtctggtcag

SEQ ID NO: 6233998 - DNA, 21 bp, Homo sapiens
gacctggtctggtcaggcaat

SEQ ID NO: 6233999 - DNA, 16 bp, Homo sapiens
gacctggtgcccctgc

SEQ ID NO: 6234000 - DNA, 14 bp, Homo sapiens
gacctggtgctcta

SEQ ID NO: 6234001 - DNA, 15 bp, Homo sapiens
gacctggtgggagca

SEQ ID NO: 6234002 - DNA, 20 bp, Homo sapiens
gacctggtgtgcggaggcag

SEQ ID NO: 6234003 - DNA, 22 bp, Homo sapiens
gacctggtgtgcggaggcagga

SEQ ID NO: 6234004 - DNA, 18 bp, Homo sapiens
gacctggttaaacaaacc

SEQ ID NO: 6234005 - DNA, 16 bp, Homo sapiens
gacctggttcccactg

SEQ ID NO: 6234006 - DNA, 18 bp, Homo sapiens
gacctggttcccactgag

SEQ ID NO: 6234007 - DNA, 15 bp, Homo sapiens
gacctggttgtccag

SEQ ID NO: 6234008 - DNA, 19 bp, Homo sapiens
gacctggtttgaatggaga

SEQ ID NO: 6234009 - DNA, 19 bp, Homo sapiens
gacctgtatttaagcaaat

SEQ ID NO: 6234010 - DNA, 15 bp, Homo sapiens
gacctgtcagaataa

SEQ ID NO: 6234011 - DNA, 20 bp, Homo sapiens
gacctgtcatgcccccctca

SEQ ID NO: 6234012 - DNA, 21 bp, Homo sapiens
gacctgtcatgcccccctcaa

SEQ ID NO: 6234013 - DNA, 10 bp, Homo sapiens
gacctgtcca

SEQ ID NO: 6234014 - DNA, 13 bp, Homo sapiens
gacctgtccccca

SEQ ID NO: 6234015 - DNA, 15 bp, Homo sapiens
gacctgtcccccact

SEQ ID NO: 6234016 - DNA, 18 bp, Homo sapiens
gacctgtcccccactctc

SEQ ID NO: 6234017 - DNA, 15 bp, Homo sapiens
gacctgtcctgtctt

SEQ ID NO: 6234018 - DNA, 18 bp, Homo sapiens
gacctgtcctgtctttga

SEQ ID NO: 6234019 - DNA, 15 bp, Homo sapiens
gacctgtctcctggc

SEQ ID NO: 6234020 - DNA, 17 bp, Homo sapiens
gacctgtcttccaagga

SEQ ID NO: 6234021 - DNA, 18 bp, Homo sapiens
gacctgtgacctggtctg

SEQ ID NO: 6234022 - DNA, 16 bp, Homo sapiens
gacctgtgagcccagc

SEQ ID NO: 6234023 - DNA, 19 bp, Homo sapiens
gacctgtgagcccagctgg

SEQ ID NO: 6234024 - DNA, 20 bp, Homo sapiens
gacctgtgctagttttacag

SEQ ID NO: 6234025 - DNA, 18 bp, Homo sapiens
gacctgttaaaattatac

SEQ ID NO: 6234026 - DNA, 18 bp, Homo sapiens
gacctgttagcagacagg

SEQ ID NO: 6234027 - DNA, 19 bp, Homo sapiens
gacctgttcagaaggatgg

SEQ ID NO: 6234028 - DNA, 16 bp, Homo sapiens
gacctgttggcctgtg

SEQ ID NO: 6234029 - DNA, 20 bp, Homo sapiens
gacctgttggcctgtgggcc

SEQ ID NO: 6234030 - DNA, 17 bp, Homo sapiens
gacctgtttatgagatg

SEQ ID NO: 6234031 - DNA, 14 bp, Homo sapiens
gacctgtttctctt

SEQ ID NO: 6234032 - DNA, 21 bp, Homo sapiens
gacctgttttgcttttgtaac

SEQ ID NO: 6234033 - DNA, 22 bp, Homo sapiens
gacctgttttgcttttgtaact

SEQ ID NO: 6234034 - DNA, 15 bp, Homo sapiens
gaccttaatttatat

SEQ ID NO: 6234035 - DNA, 14 bp, Homo sapiens
gaccttacaaccac

SEQ ID NO: 6234036 - DNA, 16 bp, Homo sapiens
gaccttacaaccacat

SEQ ID NO: 6234037 - DNA, 22 bp, Homo sapiens
gaccttacaaccacatttctgg

SEQ ID NO: 6234038 - DNA, 18 bp, Homo sapiens
gaccttacgatcaggcac

SEQ ID NO: 6234039 - DNA, 19 bp, Homo sapiens
gaccttacgatcaggcaca

SEQ ID NO: 6234040 - DNA, 22 bp, Homo sapiens
gaccttactcctctttccttcc

SEQ ID NO: 6234041 - DNA, 12 bp, Homo sapiens
gcagactggagg

SEQ ID NO: 6234042 - DNA, 14 bp, Homo sapiens
gcagactggagggg

SEQ ID NO: 6234043 - DNA, 11 bp, Homo sapiens
gcagactggcg

SEQ ID NO: 6234044 - DNA, 19 bp, Homo sapiens
gcagactggtttgcagtga

SEQ ID NO: 6234045 - DNA, 12 bp, Homo sapiens
gcagactgtgaa

SEQ ID NO: 6234046 - DNA, 14 bp, Homo sapiens
gcagactgtggctg

SEQ ID NO: 6234047 - DNA, 23 bp, Homo sapiens
gcagactgtgtaaaatgtaatgc

SEQ ID NO: 6234048 - DNA, 16 bp, Homo sapiens
gcagacttcccagcta

SEQ ID NO: 6234049 - DNA, 18 bp, Homo sapiens
gcagacttcccagctagg

SEQ ID NO: 6234050 - DNA, 23 bp, Homo sapiens
gcagagaaagaaagggaaactgg

SEQ ID NO: 6234051 - DNA, 15 bp, Homo sapiens
gcagagaaagaagag

SEQ ID NO: 6234052 - DNA, 16 bp, Homo sapiens
gcagagaaagaagaga

SEQ ID NO: 6234053 - DNA, 23 bp, Homo sapiens
gcagagaaagaagagacaggagg

SEQ ID NO: 6234054 - DNA, 23 bp, Homo sapiens
gcagagaacagaactggaggcag

SEQ ID NO: 6234055 - DNA, 16 bp, Homo sapiens
gcagagaactcataaa

SEQ ID NO: 6234056 - DNA, 17 bp, Homo sapiens
gcagagaactcataaag

SEQ ID NO: 6234057 - DNA, 18 bp, Homo sapiens
gcagagaactgtctttca

SEQ ID NO: 6234058 - DNA, 22 bp, Homo sapiens
gcagagaagcatcctccacatc

SEQ ID NO: 6234059 - DNA, 14 bp, Homo sapiens
gcagagaagctgga

SEQ ID NO: 6234060 - DNA, 14 bp, Homo sapiens
gcagagaaggcctc

SEQ ID NO: 6234061 - DNA, 15 bp, Homo sapiens
gcagagaaggcctct

SEQ ID NO: 6234062 - DNA, 21 bp, Homo sapiens
gcagagaagtgacggttccta

SEQ ID NO: 6234063 - DNA, 14 bp, Homo sapiens
gcagagaagttcct

SEQ ID NO: 6234064 - DNA, 23 bp, Homo sapiens
gcagagaatataacatgaaatga

SEQ ID NO: 6234065 - DNA, 20 bp, Homo sapiens
gcagagaatcatacttagca

SEQ ID NO: 6234066 - DNA, 19 bp, Homo sapiens
gcagagaatgaaagggccc

SEQ ID NO: 6234067 - DNA, 23 bp, Homo sapiens
gcagagaatgaaagggcccagag

SEQ ID NO: 6234068 - DNA, 15 bp, Homo sapiens
gcagagacagagagg

SEQ ID NO: 6234069 - DNA, 17 bp, Homo sapiens
gcagagacaggacctga

SEQ ID NO: 6234070 - DNA, 15 bp, Homo sapiens
gcagagaccaccgcg

SEQ ID NO: 6234071 - DNA, 17 bp, Homo sapiens
gcagagaccatccctga

SEQ ID NO: 6234072 - DNA, 21 bp, Homo sapiens
gcagagaccatccctgaaggc

SEQ ID NO: 6234073 - DNA, 16 bp, Homo sapiens
gcagagaccccaggat

SEQ ID NO: 6234074 - DNA, 14 bp, Homo sapiens
gcagagaccttgcg

SEQ ID NO: 6234075 - DNA, 12 bp, Homo sapiens
gcagagagaagc

SEQ ID NO: 6234076 - DNA, 22 bp, Homo sapiens
gcagagagcaggacaggagaca

SEQ ID NO: 6234077 - DNA, 18 bp, Homo sapiens
gcagagagccaaatctga

SEQ ID NO: 6234078 - DNA, 20 bp, Homo sapiens
gcagagagccaaatctgacc

SEQ ID NO: 6234079 - DNA, 15 bp, Homo sapiens
gcagagagccatttt

SEQ ID NO: 6234080 - DNA, 18 bp, Homo sapiens
gcagagagccctgggtga

SEQ ID NO: 6234081 - DNA, 19 bp, Homo sapiens
gcagagagcggtctcaggc

SEQ ID NO: 6234082 - DNA, 20 bp, Homo sapiens
gcagagaggaccccactgga

SEQ ID NO: 6234083 - DNA, 15 bp, Homo sapiens
gcagagagggaacta

SEQ ID NO: 6234084 - DNA, 18 bp, Homo sapiens
gcagagaggtggagaact

SEQ ID NO: 6234085 - DNA, 19 bp, Homo sapiens
gcagagaggtggagaactg

SEQ ID NO: 6234086 - DNA, 22 bp, Homo sapiens
gcagagaggtggagaactggga

SEQ ID NO: 6234087 - DNA, 21 bp, Homo sapiens
gcagagaggtttgcagtccca

SEQ ID NO: 6234088 - DNA, 19 bp, Homo sapiens
gcagagagtacagactgca

SEQ ID NO: 6234089 - DNA, 14 bp, Homo sapiens
gcagagataaataa

SEQ ID NO: 6234090 - DNA, 18 bp, Homo sapiens
gcagagatatttcttcag

SEQ ID NO: 6234091 - DNA, 18 bp, Homo sapiens
gcagagatcgacagacag

SEQ ID NO: 6234092 - DNA, 19 bp, Homo sapiens
gcagagatgtgcccccacc

SEQ ID NO: 6234093 - DNA, 18 bp, Homo sapiens
gcagagattgggggggct

SEQ ID NO: 6234094 - DNA, 16 bp, Homo sapiens
gcagagatttctcatt

SEQ ID NO: 6234095 - DNA, 19 bp, Homo sapiens
gcagagcaaatgagggagg

SEQ ID NO: 6234096 - DNA, 16 bp, Homo sapiens
gcagagcaagtctgca

SEQ ID NO: 6234097 - DNA, 13 bp, Homo sapiens
gcagagcaataac

SEQ ID NO: 6234098 - DNA, 14 bp, Homo sapiens
gcagagcaataaca

SEQ ID NO: 6234099 - DNA, 16 bp, Homo sapiens
gcagagcaataacact

SEQ ID NO: 6234100 - DNA, 20 bp, Homo sapiens
gcagagcaattccaggctga

SEQ ID NO: 6234101 - DNA, 19 bp, Homo sapiens
gcagagcaccttagacagt

SEQ ID NO: 6234102 - DNA, 22 bp, Homo sapiens
gcagagcaccttagacagtccc

SEQ ID NO: 6234103 - DNA, 23 bp, Homo sapiens
gcagagcaccttagacagtccct

SEQ ID NO: 6234104 - DNA, 22 bp, Homo sapiens
gcagagcacctttgcacaggat

SEQ ID NO: 6234105 - DNA, 17 bp, Homo sapiens
gcagagccaaggccacc

SEQ ID NO: 6234106 - DNA, 14 bp, Homo sapiens
gcagagccagggca

SEQ ID NO: 6234107 - DNA, 15 bp, Homo sapiens
gcagagccagggcag

SEQ ID NO: 6234108 - DNA, 18 bp, Homo sapiens
gcagagccagtcttcctc

SEQ ID NO: 6234109 - DNA, 17 bp, Homo sapiens
gcagagccatccaccct

SEQ ID NO: 6234110 - DNA, 16 bp, Homo sapiens
gcagagccatgggcct

SEQ ID NO: 6234111 - DNA, 17 bp, Homo sapiens
gcagagccatgggcctg

SEQ ID NO: 6234112 - DNA, 16 bp, Homo sapiens
gcagagcccaccagcc

SEQ ID NO: 6234113 - DNA, 23 bp, Homo sapiens
gcagagcccaccagccagccctg

SEQ ID NO: 6234114 - DNA, 15 bp, Homo sapiens
gcagagcccccagga

SEQ ID NO: 6234115 - DNA, 14 bp, Homo sapiens
gcagagccccggag

SEQ ID NO: 6234116 - DNA, 15 bp, Homo sapiens
gcagagccccggagc

SEQ ID NO: 6234117 - DNA, 17 bp, Homo sapiens
gcagagccccggagcac

SEQ ID NO: 6234118 - DNA, 15 bp, Homo sapiens
gcagagcccgcccac

SEQ ID NO: 6234119 - DNA, 19 bp, Homo sapiens
gcagagcccggagctccgg

SEQ ID NO: 6234120 - DNA, 20 bp, Homo sapiens
gcagagcccggagctccggc

SEQ ID NO: 6234121 - DNA, 23 bp, Homo sapiens
gcagagcccggccccacctccct

SEQ ID NO: 6234122 - DNA, 15 bp, Homo sapiens
gcagagccctccagg

SEQ ID NO: 6234123 - DNA, 23 bp, Homo sapiens
gcagagccctccaggcctgcagg

SEQ ID NO: 6234124 - DNA, 13 bp, Homo sapiens
gcagagccctgct

SEQ ID NO: 6234125 - DNA, 15 bp, Homo sapiens
gcagagccctgctcc

SEQ ID NO: 6234126 - DNA, 16 bp, Homo sapiens
gcagagccgttcctgg

SEQ ID NO: 6234127 - DNA, 20 bp, Homo sapiens
gcagagccgttcctgggact

SEQ ID NO: 6234128 - DNA, 10 bp, Homo sapiens
gcagagccta

SEQ ID NO: 6234129 - DNA, 13 bp, Homo sapiens
gcagagcctcctg

SEQ ID NO: 6234130 - DNA, 14 bp, Homo sapiens
gcagagcctcctgg

SEQ ID NO: 6234131 - DNA, 13 bp, Homo sapiens
gcagagcctgagt

SEQ ID NO: 6234132 - DNA, 14 bp, Homo sapiens
gcagagcctgcagg

SEQ ID NO: 6234133 - DNA, 14 bp, Homo sapiens
gcagagcctggggt

SEQ ID NO: 6234134 - DNA, 19 bp, Homo sapiens
gcagagcctgtccccgcct

SEQ ID NO: 6234135 - DNA, 20 bp, Homo sapiens
gcagagcctttttacctggc

SEQ ID NO: 6234136 - DNA, 18 bp, Homo sapiens
gcagagcgcagcccccac

SEQ ID NO: 6234137 - DNA, 16 bp, Homo sapiens
gcagagcgggagggag

SEQ ID NO: 6234138 - DNA, 19 bp, Homo sapiens
gcagagcggggaggtgcct

SEQ ID NO: 6234139 - DNA, 22 bp, Homo sapiens
gcagagcggggtcccctctgtg

SEQ ID NO: 6234140 - DNA, 12 bp, Homo sapiens
gcagagctcaga

SEQ ID NO: 6234141 - DNA, 15 bp, Homo sapiens
gcagagctcagagga

SEQ ID NO: 6234142 - DNA, 17 bp, Homo sapiens
gcagagctctacaggcc

SEQ ID NO: 6234143 - DNA, 19 bp, Homo sapiens
gcagagctctcccctcctg

SEQ ID NO: 6234144 - DNA, 14 bp, Homo sapiens
gcagagctctgccg

SEQ ID NO: 6234145 - DNA, 21 bp, Homo sapiens
gcagagctgcacttggcctca

SEQ ID NO: 6234146 - DNA, 23 bp, Homo sapiens
gcagagctgcacttggcctcagc

SEQ ID NO: 6234147 - DNA, 19 bp, Homo sapiens
gcagagctggagcccccag

SEQ ID NO: 6234148 - DNA, 12 bp, Homo sapiens
gcagagctggtg

SEQ ID NO: 6234149 - DNA, 14 bp, Homo sapiens
gcagagcttctcct

SEQ ID NO: 6234150 - DNA, 17 bp, Homo sapiens
gcagagcttggactgga

SEQ ID NO: 6234151 - DNA, 16 bp, Homo sapiens
gcagagcttgtagccc

SEQ ID NO: 6234152 - DNA, 20 bp, Homo sapiens
gcagagcttgtagccctgga

SEQ ID NO: 6234153 - DNA, 23 bp, Homo sapiens
gcagagcttgtagccctggatgg

SEQ ID NO: 6234154 - DNA, 23 bp, Homo sapiens
gcagagcttgtggtggggcagga

SEQ ID NO: 6234155 - DNA, 15 bp, Homo sapiens
gcagagcttttcaga

SEQ ID NO: 6234156 - DNA, 14 bp, Homo sapiens
gcagaggaaagcaa

SEQ ID NO: 6234157 - DNA, 16 bp, Homo sapiens
gcagaggaagcccagc

SEQ ID NO: 6234158 - DNA, 11 bp, Homo sapiens
gcagaggaagg

SEQ ID NO: 6234159 - DNA, 14 bp, Homo sapiens
gcagaggaaggaaa

SEQ ID NO: 6234160 - DNA, 20 bp, Homo sapiens
gcagaggaatttggctgctt

SEQ ID NO: 6234161 - DNA, 16 bp, Homo sapiens
gcagaggaccacagtg

SEQ ID NO: 6234162 - DNA, 21 bp, Homo sapiens
gcagaggaccacagtgggtgg

SEQ ID NO: 6234163 - DNA, 16 bp, Homo sapiens
gcagaggaccagggcc

SEQ ID NO: 6234164 - DNA, 17 bp, Homo sapiens
gcagaggaccagggcct

SEQ ID NO: 6234165 - DNA, 13 bp, Homo sapiens
gcagaggacgcac

SEQ ID NO: 6234166 - DNA, 21 bp, Homo sapiens
gcagaggagaacttgctgcct

SEQ ID NO: 6234167 - DNA, 17 bp, Homo sapiens
gcagaggagccacctgg

SEQ ID NO: 6234168 - DNA, 12 bp, Homo sapiens
gcagaggagccc

SEQ ID NO: 6234169 - DNA, 15 bp, Homo sapiens
gcagaggagcccagt

SEQ ID NO: 6234170 - DNA, 17 bp, Homo sapiens
gcagaggagcccagtgg

SEQ ID NO: 6234171 - DNA, 18 bp, Homo sapiens
gcagaggagcccagtggg

SEQ ID NO: 6234172 - DNA, 21 bp, Homo sapiens
gcagaggagcccagtgggctg

SEQ ID NO: 6234173 - DNA, 12 bp, Homo sapiens
gcagaggagggg

SEQ ID NO: 6234174 - DNA, 17 bp, Homo sapiens
gcagaggaggtaagagg

SEQ ID NO: 6234175 - DNA, 20 bp, Homo sapiens
gcagaggaggtgagagtggg

SEQ ID NO: 6234176 - DNA, 18 bp, Homo sapiens
gcagaggagtccagggcg

SEQ ID NO: 6234177 - DNA, 23 bp, Homo sapiens
gcagaggatgttctggacctccc

SEQ ID NO: 6234178 - DNA, 18 bp, Homo sapiens
gcagaggattgaggctta

SEQ ID NO: 6234179 - DNA, 12 bp, Homo sapiens
gcagaggcactg

SEQ ID NO: 6234180 - DNA, 15 bp, Homo sapiens
gcagaggcagcagga

SEQ ID NO: 6234181 - DNA, 12 bp, Homo sapiens
gcagaggcagcg

SEQ ID NO: 6234182 - DNA, 21 bp, Homo sapiens
gcagaggcaggaccagaaggc

SEQ ID NO: 6234183 - DNA, 14 bp, Homo sapiens
gcagaggcaggctg

SEQ ID NO: 6234184 - DNA, 12 bp, Homo sapiens
gcagaggcaggg

SEQ ID NO: 6234185 - DNA, 18 bp, Homo sapiens
gcagaggcagtacctggg

SEQ ID NO: 6234186 - DNA, 15 bp, Homo sapiens
gcagaggccacagga

SEQ ID NO: 6234187 - DNA, 12 bp, Homo sapiens
gcagaggccaga

SEQ ID NO: 6234188 - DNA, 20 bp, Homo sapiens
gcagaggcccaggctgccgt

SEQ ID NO: 6234189 - DNA, 21 bp, Homo sapiens
gcagaggcccgaggcaccgga

SEQ ID NO: 6234190 - DNA, 12 bp, Homo sapiens
gcagaggccctg

SEQ ID NO: 6234191 - DNA, 17 bp, Homo sapiens
gcagaggccctgccccc

SEQ ID NO: 6234192 - DNA, 18 bp, Homo sapiens
gcagaggccctgccccca

SEQ ID NO: 6234193 - DNA, 21 bp, Homo sapiens
gcagaggccctgcccccaccc

SEQ ID NO: 6234194 - DNA, 18 bp, Homo sapiens
gcagaggcggaaaccttg

SEQ ID NO: 6234195 - DNA, 22 bp, Homo sapiens
gcagaggcggaaaccttgcagc

SEQ ID NO: 6234196 - DNA, 19 bp, Homo sapiens
gcagaggcggctctggttc

SEQ ID NO: 6234197 - DNA, 23 bp, Homo sapiens
gcagaggcgtactacccagctct

SEQ ID NO: 6234198 - DNA, 22 bp, Homo sapiens
gcagaggctggaggcagggcct

SEQ ID NO: 6234199 - DNA, 13 bp, Homo sapiens
gcagaggctggca

SEQ ID NO: 6234200 - DNA, 17 bp, Homo sapiens
gcagaggctggcctcag

SEQ ID NO: 6234201 - DNA, 19 bp, Homo sapiens
gcagaggctggcctcagac

SEQ ID NO: 6234202 - DNA, 15 bp, Homo sapiens
gcagaggctgtggct

SEQ ID NO: 6234203 - DNA, 24 bp, Homo sapiens
gcagaggcttccgtgtcctctccc

SEQ ID NO: 6234204 - DNA, 18 bp, Homo sapiens
gcagaggcttttccagtg

SEQ ID NO: 6234205 - DNA, 19 bp, Homo sapiens
gcagaggcttttccagtgt

SEQ ID NO: 6234206 - DNA, 22 bp, Homo sapiens
gcagagggaatgttccctgcac

SEQ ID NO: 6234207 - DNA, 12 bp, Homo sapiens
gcagagggacaa

SEQ ID NO: 6234208 - DNA, 18 bp, Homo sapiens
gcagagggacaaccagaa

SEQ ID NO: 6234209 - DNA, 17 bp, Homo sapiens
gcagagggatgaaatgc

SEQ ID NO: 6234210 - DNA, 18 bp, Homo sapiens
gcagagggcaagggaggg

SEQ ID NO: 6234211 - DNA, 14 bp, Homo sapiens
gcagagggcacaga

SEQ ID NO: 6234212 - DNA, 22 bp, Homo sapiens
gcagagggcgccaccaccacct

SEQ ID NO: 6234213 - DNA, 23 bp, Homo sapiens
gcagagggctggaggcccaggct

SEQ ID NO: 6234214 - DNA, 15 bp, Homo sapiens
gcagagggctttcag

SEQ ID NO: 6234215 - DNA, 18 bp, Homo sapiens
gcagaggggagcttgagg

SEQ ID NO: 6234216 - DNA, 22 bp, Homo sapiens
gcagaggggagcttgagggaca

SEQ ID NO: 6234217 - DNA, 23 bp, Homo sapiens
gcagaggggagcttgagggacaa

SEQ ID NO: 6234218 - DNA, 15 bp, Homo sapiens
gcagaggggcagagg

SEQ ID NO: 6234219 - DNA, 16 bp, Homo sapiens
gcagaggggcagccgc

SEQ ID NO: 6234220 - DNA, 23 bp, Homo sapiens
gaccttagaaatcattgtagaaa

SEQ ID NO: 6234221 - DNA, 12 bp, Homo sapiens
gaccttagcgtt

SEQ ID NO: 6234222 - DNA, 13 bp, Homo sapiens
gaccttaggcctt

SEQ ID NO: 6234223 - DNA, 16 bp, Homo sapiens
gaccttaggccttcct

SEQ ID NO: 6234224 - DNA, 17 bp, Homo sapiens
gaccttcacccagagct

SEQ ID NO: 6234225 - DNA, 20 bp, Homo sapiens
gaccttcacccagagctgcc

SEQ ID NO: 6234226 - DNA, 21 bp, Homo sapiens
gaccttcacccagagctgcct

SEQ ID NO: 6234227 - DNA, 22 bp, Homo sapiens
gaccttcactctaagatgttat

SEQ ID NO: 6234228 - DNA, 18 bp, Homo sapiens
gaccttcagagccagccg

SEQ ID NO: 6234229 - DNA, 13 bp, Homo sapiens
gaccttcagctca

SEQ ID NO: 6234230 - DNA, 18 bp, Homo sapiens
gaccttcagggagagctg

SEQ ID NO: 6234231 - DNA, 16 bp, Homo sapiens
gaccttcatttcatgt

SEQ ID NO: 6234232 - DNA, 18 bp, Homo sapiens
gaccttccaagagcctga

SEQ ID NO: 6234233 - DNA, 15 bp, Homo sapiens
gaccttccagagccc

SEQ ID NO: 6234234 - DNA, 22 bp, Homo sapiens
gaccttccataatgctactgtc

SEQ ID NO: 6234235 - DNA, 10 bp, Homo sapiens
gaccttcccc

SEQ ID NO: 6234236 - DNA, 19 bp, Homo sapiens
gaccttccccaaaggatgg

SEQ ID NO: 6234237 - DNA, 23 bp, Homo sapiens
gaccttccctccgccttctccca

SEQ ID NO: 6234238 - DNA, 12 bp, Homo sapiens
gaccttcctcat

SEQ ID NO: 6234239 - DNA, 23 bp, Homo sapiens
gaccttcctcatccaccccatcc

SEQ ID NO: 6234240 - DNA, 16 bp, Homo sapiens
gaccttcctcgcagag

SEQ ID NO: 6234241 - DNA, 22 bp, Homo sapiens
gaccttcctcgcagagaggcca

SEQ ID NO: 6234242 - DNA, 12 bp, Homo sapiens
gaccttcctctg

SEQ ID NO: 6234243 - DNA, 23 bp, Homo sapiens
gaccttcctgccaccagtcactg

SEQ ID NO: 6234244 - DNA, 15 bp, Homo sapiens
gaccttcggcagtgg

SEQ ID NO: 6234245 - DNA, 17 bp, Homo sapiens
gaccttcggcagtggct

SEQ ID NO: 6234246 - DNA, 18 bp, Homo sapiens
gaccttcggcagtggctg

SEQ ID NO: 6234247 - DNA, 19 bp, Homo sapiens
gaccttcggcagtggctgg

SEQ ID NO: 6234248 - DNA, 21 bp, Homo sapiens
gaccttcggcagtggctgggg

SEQ ID NO: 6234249 - DNA, 15 bp, Homo sapiens
gaccttctaggaagc

SEQ ID NO: 6234250 - DNA, 23 bp, Homo sapiens
gaccttctaggacgccacccagc

SEQ ID NO: 6234251 - DNA, 23 bp, Homo sapiens
gaccttctagtgagcctgggcca

SEQ ID NO: 6234252 - DNA, 16 bp, Homo sapiens
gaccttctatcctctg

SEQ ID NO: 6234253 - DNA, 17 bp, Homo sapiens
gaccttctatcctctgt

SEQ ID NO: 6234254 - DNA, 18 bp, Homo sapiens
gaccttctatcctctgta

SEQ ID NO: 6234255 - DNA, 18 bp, Homo sapiens
gaccttctccaaatgaga

SEQ ID NO: 6234256 - DNA, 24 bp, Homo sapiens
gaccttctccagggacagaagcag

SEQ ID NO: 6234257 - DNA, 15 bp, Homo sapiens
gaccttctccctagc

SEQ ID NO: 6234258 - DNA, 16 bp, Homo sapiens
gaccttctccttcacc

SEQ ID NO: 6234259 - DNA, 18 bp, Homo sapiens
gaccttctcttagattat

SEQ ID NO: 6234260 - DNA, 17 bp, Homo sapiens
gaccttctgagaggggc

SEQ ID NO: 6234261 - DNA, 14 bp, Homo sapiens
gaccttctgtcgtc

SEQ ID NO: 6234262 - DNA, 22 bp, Homo sapiens
gaccttctgtcgtccccagacc

SEQ ID NO: 6234263 - DNA, 14 bp, Homo sapiens
gaccttcttccaca

SEQ ID NO: 6234264 - DNA, 23 bp, Homo sapiens
gaccttgaactgggtacttgtgg

SEQ ID NO: 6234265 - DNA, 15 bp, Homo sapiens
gaccttgagggtggg

SEQ ID NO: 6234266 - DNA, 23 bp, Homo sapiens
gaccttgagggtgggccagcata

SEQ ID NO: 6234267 - DNA, 20 bp, Homo sapiens
gaccttgagttaacaggaca

SEQ ID NO: 6234268 - DNA, 15 bp, Homo sapiens
gaccttgatgagctg

SEQ ID NO: 6234269 - DNA, 22 bp, Homo sapiens
gaccttgcaacctcaccttcct

SEQ ID NO: 6234270 - DNA, 15 bp, Homo sapiens
gaccttggagagctc

SEQ ID NO: 6234271 - DNA, 18 bp, Homo sapiens
gaccttggatcagtggtc

SEQ ID NO: 6234272 - DNA, 12 bp, Homo sapiens
gaccttggtctg

SEQ ID NO: 6234273 - DNA, 16 bp, Homo sapiens
gaccttgtaatgtaac

SEQ ID NO: 6234274 - DNA, 18 bp, Homo sapiens
gaccttgtaatgtaactg

SEQ ID NO: 6234275 - DNA, 18 bp, Homo sapiens
gaccttgtagtgagccga

SEQ ID NO: 6234276 - DNA, 18 bp, Homo sapiens
gaccttgtattgaagtta

SEQ ID NO: 6234277 - DNA, 17 bp, Homo sapiens
gaccttgtgaacatcag

SEQ ID NO: 6234278 - DNA, 13 bp, Homo sapiens
gaccttgtgatct

SEQ ID NO: 6234279 - DNA, 16 bp, Homo sapiens
gaccttgttacttctg

SEQ ID NO: 6234280 - DNA, 20 bp, Homo sapiens
gaccttgttgttgttaaata

SEQ ID NO: 6234281 - DNA, 12 bp, Homo sapiens
gacctttaaaaa

SEQ ID NO: 6234282 - DNA, 16 bp, Homo sapiens
gacctttaaaaagcag

SEQ ID NO: 6234283 - DNA, 19 bp, Homo sapiens
gacctttatttattaaact

SEQ ID NO: 6234284 - DNA, 22 bp, Homo sapiens
gacctttatttattaaacttca

SEQ ID NO: 6234285 - DNA, 13 bp, Homo sapiens
gacctttccacca

SEQ ID NO: 6234286 - DNA, 13 bp, Homo sapiens
gacctttgacctc

SEQ ID NO: 6234287 - DNA, 23 bp, Homo sapiens
gacctttgatgaattcttcctct

SEQ ID NO: 6234288 - DNA, 16 bp, Homo sapiens
gacctttgcccacaca

SEQ ID NO: 6234289 - DNA, 18 bp, Homo sapiens
gacctttgggtctacaag

SEQ ID NO: 6234290 - DNA, 17 bp, Homo sapiens
gacctttgggttctttc

SEQ ID NO: 6234291 - DNA, 19 bp, Homo sapiens
gacctttgggttctttctg

SEQ ID NO: 6234292 - DNA, 20 bp, Homo sapiens
gacctttgggttctttctgg

SEQ ID NO: 6234293 - DNA, 13 bp, Homo sapiens
gaccttttaaagt

SEQ ID NO: 6234294 - DNA, 14 bp, Homo sapiens
gaccttttaaagtg

SEQ ID NO: 6234295 - DNA, 20 bp, Homo sapiens
gaccttttaaagtgtttcag

SEQ ID NO: 6234296 - DNA, 15 bp, Homo sapiens
gaccttttcccttgc

SEQ ID NO: 6234297 - DNA, 17 bp, Homo sapiens
gaccttttcccttgctg

SEQ ID NO: 6234298 - DNA, 17 bp, Homo sapiens
gaccttttcttcatttt

SEQ ID NO: 6234299 - DNA, 12 bp, Homo sapiens
gaccttttcttt

SEQ ID NO: 6234300 - DNA, 18 bp, Homo sapiens
gaccttttggcctttgta

SEQ ID NO: 6234301 - DNA, 19 bp, Homo sapiens
gaccttttggtcttcagcc

SEQ ID NO: 6234302 - DNA, 18 bp, Homo sapiens
gaccttttgtaagacatt

SEQ ID NO: 6234303 - DNA, 14 bp, Homo sapiens
gacgaaagagtcat

SEQ ID NO: 6234304 - DNA, 19 bp, Homo sapiens
gacgaactggctacagtac

SEQ ID NO: 6234305 - DNA, 21 bp, Homo sapiens
gacgaacttccatggccctca

SEQ ID NO: 6234306 - DNA, 16 bp, Homo sapiens
gacgaagaagagccac

SEQ ID NO: 6234307 - DNA, 18 bp, Homo sapiens
gacgaagaagagccacag

SEQ ID NO: 6234308 - DNA, 22 bp, Homo sapiens
gacgaagcggagagagccaaga

SEQ ID NO: 6234309 - DNA, 15 bp, Homo sapiens
gacgaagggttggac

SEQ ID NO: 6234310 - DNA, 16 bp, Homo sapiens
gacgaaggtcctaagg

SEQ ID NO: 6234311 - DNA, 16 bp, Homo sapiens
gacgaattccactcgt

SEQ ID NO: 6234312 - DNA, 13 bp, Homo sapiens
gacgacccggggc

SEQ ID NO: 6234313 - DNA, 17 bp, Homo sapiens
gacgactgcaaagccag

SEQ ID NO: 6234314 - DNA, 19 bp, Homo sapiens
gacgagacaacagcacaca

SEQ ID NO: 6234315 - DNA, 20 bp, Homo sapiens
gacgagacaacagcacacag

SEQ ID NO: 6234316 - DNA, 21 bp, Homo sapiens
gacgagacccccatccagcct

SEQ ID NO: 6234317 - DNA, 22 bp, Homo sapiens
gacgagacccccatccagcctc

SEQ ID NO: 6234318 - DNA, 23 bp, Homo sapiens
gacgagacccccatccagcctcc

SEQ ID NO: 6234319 - DNA, 14 bp, Homo sapiens
gacgagactcctcg

SEQ ID NO: 6234320 - DNA, 18 bp, Homo sapiens
gacgagcagagcgcagcc

SEQ ID NO: 6234321 - DNA, 13 bp, Homo sapiens
gacgaggcagggg

SEQ ID NO: 6234322 - DNA, 15 bp, Homo sapiens
gacgaggcaggggct

SEQ ID NO: 6234323 - DNA, 20 bp, Homo sapiens
gacgaggcaggggctctgct

SEQ ID NO: 6234324 - DNA, 14 bp, Homo sapiens
gacgagtgagctac

SEQ ID NO: 6234325 - DNA, 17 bp, Homo sapiens
gacgatacagcttggca

SEQ ID NO: 6234326 - DNA, 23 bp, Homo sapiens
gacgatccccatggaacagccct

SEQ ID NO: 6234327 - DNA, 15 bp, Homo sapiens
gacgatctttgaata

SEQ ID NO: 6234328 - DNA, 20 bp, Homo sapiens
gacgatggggggctgatggc

SEQ ID NO: 6234329 - DNA, 19 bp, Homo sapiens
gacgcaagaggtttcagca

SEQ ID NO: 6234330 - DNA, 19 bp, Homo sapiens
gacgcaagggcctgatggg

SEQ ID NO: 6234331 - DNA, 16 bp, Homo sapiens
gacgcaaggtgtgctc

SEQ ID NO: 6234332 - DNA, 19 bp, Homo sapiens
gacgcaaggtgtgctctga

SEQ ID NO: 6234333 - DNA, 16 bp, Homo sapiens
gacgcacacagctgag

SEQ ID NO: 6234334 - DNA, 19 bp, Homo sapiens
gacgcacacagctgagcac

SEQ ID NO: 6234335 - DNA, 14 bp, Homo sapiens
gacgcacacagctt

SEQ ID NO: 6234336 - DNA, 17 bp, Homo sapiens
gacgcaccgccgccacc

SEQ ID NO: 6234337 - DNA, 20 bp, Homo sapiens
gacgcaccgccgccaccagc

SEQ ID NO: 6234338 - DNA, 12 bp, Homo sapiens
gacgcaccgcct

SEQ ID NO: 6234339 - DNA, 18 bp, Homo sapiens
gacgcacgctcgctgcca

SEQ ID NO: 6234340 - DNA, 12 bp, Homo sapiens
gacgcactgagc

SEQ ID NO: 6234341 - DNA, 15 bp, Homo sapiens
gacgcactgagcaac

SEQ ID NO: 6234342 - DNA, 14 bp, Homo sapiens
gacgcagacagagg

SEQ ID NO: 6234343 - DNA, 20 bp, Homo sapiens
gacgcagacagaggggatgg

SEQ ID NO: 6234344 - DNA, 14 bp, Homo sapiens
gacgcagcagctgg

SEQ ID NO: 6234345 - DNA, 19 bp, Homo sapiens
gacgcagcaggaggccagg

SEQ ID NO: 6234346 - DNA, 15 bp, Homo sapiens
gacgcagccacacag

SEQ ID NO: 6234347 - DNA, 16 bp, Homo sapiens
gacgcagccctggggg

SEQ ID NO: 6234348 - DNA, 13 bp, Homo sapiens
gacgcagcctgag

SEQ ID NO: 6234349 - DNA, 14 bp, Homo sapiens
gacgcagcctgaga

SEQ ID NO: 6234350 - DNA, 16 bp, Homo sapiens
gacgcaggaatggaaa

SEQ ID NO: 6234351 - DNA, 18 bp, Homo sapiens
gacgcaggcccctctcct

SEQ ID NO: 6234352 - DNA, 20 bp, Homo sapiens
gacgcaggcccctctcctcc

SEQ ID NO: 6234353 - DNA, 17 bp, Homo sapiens
gacgcaggccctgtcca

SEQ ID NO: 6234354 - DNA, 12 bp, Homo sapiens
gacgcagggaga

SEQ ID NO: 6234355 - DNA, 23 bp, Homo sapiens
gacgcagggagaccctgggagag

SEQ ID NO: 6234356 - DNA, 12 bp, Homo sapiens
gacgcatgcagg

SEQ ID NO: 6234357 - DNA, 21 bp, Homo sapiens
gacgccaacttctcccacccc

SEQ ID NO: 6234358 - DNA, 15 bp, Homo sapiens
gacgccaataataaa

SEQ ID NO: 6234359 - DNA, 14 bp, Homo sapiens
gacgccacagccca

SEQ ID NO: 6234360 - DNA, 22 bp, Homo sapiens
gacgccacagcccagccacgga

SEQ ID NO: 6234361 - DNA, 23 bp, Homo sapiens
gacgccacagcccagccacggac

SEQ ID NO: 6234362 - DNA, 20 bp, Homo sapiens
gacgccactccctgggacac

SEQ ID NO: 6234363 - DNA, 18 bp, Homo sapiens
gacgccaggcaccacagc

SEQ ID NO: 6234364 - DNA, 14 bp, Homo sapiens
gacgccagggtatg

SEQ ID NO: 6234365 - DNA, 18 bp, Homo sapiens
gacgccatcccagcccca

SEQ ID NO: 6234366 - DNA, 11 bp, Homo sapiens
gacgcccagcc

SEQ ID NO: 6234367 - DNA, 21 bp, Homo sapiens
gacgcccagccccatccctgt

SEQ ID NO: 6234368 - DNA, 14 bp, Homo sapiens
gacgcccagccccc

SEQ ID NO: 6234369 - DNA, 20 bp, Homo sapiens
gacgcccagcccccaccccc

SEQ ID NO: 6234370 - DNA, 11 bp, Homo sapiens
gacgcccagct

SEQ ID NO: 6234371 - DNA, 13 bp, Homo sapiens
gacgcccagctcc

SEQ ID NO: 6234372 - DNA, 14 bp, Homo sapiens
gacgcccagctccg

SEQ ID NO: 6234373 - DNA, 13 bp, Homo sapiens
gacgcccctccgg

SEQ ID NO: 6234374 - DNA, 11 bp, Homo sapiens
gacgccctgcg

SEQ ID NO: 6234375 - DNA, 14 bp, Homo sapiens
gacgccgagggcag

SEQ ID NO: 6234376 - DNA, 22 bp, Homo sapiens
gacgccggggacagaggcctgc

SEQ ID NO: 6234377 - DNA, 12 bp, Homo sapiens
gacgcctctgga

SEQ ID NO: 6234378 - DNA, 19 bp, Homo sapiens
gacgcctgagacagcacca

SEQ ID NO: 6234379 - DNA, 17 bp, Homo sapiens
gacgcctgagctcactc

SEQ ID NO: 6234380 - DNA, 23 bp, Homo sapiens
gacgcctgatggtgctgctcagg

SEQ ID NO: 6234381 - DNA, 22 bp, Homo sapiens
gacgcctgccctccccagagca

SEQ ID NO: 6234382 - DNA, 15 bp, Homo sapiens
gacgcctgccctgcc

SEQ ID NO: 6234383 - DNA, 18 bp, Homo sapiens
gacgcctgcttttgcaaa

SEQ ID NO: 6234384 - DNA, 12 bp, Homo sapiens
gacgcctggctc

SEQ ID NO: 6234385 - DNA, 21 bp, Homo sapiens
gacgcctgggggtgccaggac

SEQ ID NO: 6234386 - DNA, 22 bp, Homo sapiens
gacgcctgttgttttggctcaa

SEQ ID NO: 6234387 - DNA, 24 bp, Homo sapiens
gacgccttcatctgggacaaaact

SEQ ID NO: 6234388 - DNA, 17 bp, Homo sapiens
gacgccttccaggtcag

SEQ ID NO: 6234389 - DNA, 17 bp, Homo sapiens
gacgcgagaggctctga

SEQ ID NO: 6234390 - DNA, 18 bp, Homo sapiens
gacgcgagggccccacgt

SEQ ID NO: 6234391 - DNA, 17 bp, Homo sapiens
gacgcggcaggcttctc

SEQ ID NO: 6234392 - DNA, 18 bp, Homo sapiens
gacgcgggctgtgcctta

SEQ ID NO: 6234393 - DNA, 24 bp, Homo sapiens
gacgctactaacctgacatcacca

SEQ ID NO: 6234394 - DNA, 13 bp, Homo sapiens
gacgctcagcccc

SEQ ID NO: 6234395 - DNA, 16 bp, Homo sapiens
gacgctcagccccagg

SEQ ID NO: 6234396 - DNA, 20 bp, Homo sapiens
gacgctcccctgagaggttt

SEQ ID NO: 6234397 - DNA, 15 bp, Homo sapiens
gacgctctctggcct

SEQ ID NO: 6234398 - DNA, 17 bp, Homo sapiens
gacgctctctggccttc

SEQ ID NO: 6234399 - DNA, 22 bp, Homo sapiens
gcagaggggcagccgctaggag

SEQ ID NO: 6234400 - DNA, 19 bp, Homo sapiens
gcagaggggcaggccctgc

SEQ ID NO: 6234401 - DNA, 18 bp, Homo sapiens
gcagaggggccaggccca

SEQ ID NO: 6234402 - DNA, 18 bp, Homo sapiens
gcagaggggctttctgga

SEQ ID NO: 6234403 - DNA, 21 bp, Homo sapiens
gcagaggtaaaagtgtgagca

SEQ ID NO: 6234404 - DNA, 23 bp, Homo sapiens
gcagaggtaaaagtgtgagcagt

SEQ ID NO: 6234405 - DNA, 17 bp, Homo sapiens
gcagaggtaccctgggt

SEQ ID NO: 6234406 - DNA, 19 bp, Homo sapiens
gcagaggtaccctgggtgt

SEQ ID NO: 6234407 - DNA, 21 bp, Homo sapiens
gcagaggtccacaacacacag

SEQ ID NO: 6234408 - DNA, 14 bp, Homo sapiens
gcagaggtcccagc

SEQ ID NO: 6234409 - DNA, 17 bp, Homo sapiens
gcagaggtcccagcccc

SEQ ID NO: 6234410 - DNA, 22 bp, Homo sapiens
gcagaggtcccagccccaggcc

SEQ ID NO: 6234411 - DNA, 17 bp, Homo sapiens
gcagaggtcccctgagg

SEQ ID NO: 6234412 - DNA, 16 bp, Homo sapiens
gcagaggtctgtgctg

SEQ ID NO: 6234413 - DNA, 21 bp, Homo sapiens
gcagaggtgagaactcagaag

SEQ ID NO: 6234414 - DNA, 16 bp, Homo sapiens
gcagaggtgagcagag

SEQ ID NO: 6234415 - DNA, 18 bp, Homo sapiens
gcagaggtgagcagagga

SEQ ID NO: 6234416 - DNA, 13 bp, Homo sapiens
gcagaggtgcaag

SEQ ID NO: 6234417 - DNA, 15 bp, Homo sapiens
gcagaggtggccaga

SEQ ID NO: 6234418 - DNA, 23 bp, Homo sapiens
gcagaggtggccagagctgggag

SEQ ID NO: 6234419 - DNA, 15 bp, Homo sapiens
gcagaggtggggtgc

SEQ ID NO: 6234420 - DNA, 11 bp, Homo sapiens
gcagaggtggt

SEQ ID NO: 6234421 - DNA, 16 bp, Homo sapiens
gcagaggttttaatgt

SEQ ID NO: 6234422 - DNA, 21 bp, Homo sapiens
gcagaggttttaatgtctgtt

SEQ ID NO: 6234423 - DNA, 22 bp, Homo sapiens
gcagaggttttaatgtctgttt

SEQ ID NO: 6234424 - DNA, 23 bp, Homo sapiens
gcagaggttttaatgtctgttta

SEQ ID NO: 6234425 - DNA, 15 bp, Homo sapiens
gcagagtaaaattac

SEQ ID NO: 6234426 - DNA, 19 bp, Homo sapiens
gcagagtatacaagtgttt

SEQ ID NO: 6234427 - DNA, 16 bp, Homo sapiens
gcagagtataggatgg

SEQ ID NO: 6234428 - DNA, 13 bp, Homo sapiens
gcagagtcacacg

SEQ ID NO: 6234429 - DNA, 12 bp, Homo sapiens
gcagagtcagca

SEQ ID NO: 6234430 - DNA, 13 bp, Homo sapiens
gcagagtcctgcc

SEQ ID NO: 6234431 - DNA, 19 bp, Homo sapiens
gcagagtcgttggagactg

SEQ ID NO: 6234432 - DNA, 21 bp, Homo sapiens
gcagagtcgttggagactgaa

SEQ ID NO: 6234433 - DNA, 22 bp, Homo sapiens
gcagagtcgttggagactgaag

SEQ ID NO: 6234434 - DNA, 12 bp, Homo sapiens
gcagagtctggg

SEQ ID NO: 6234435 - DNA, 15 bp, Homo sapiens
gcagagtcttgctac

SEQ ID NO: 6234436 - DNA, 20 bp, Homo sapiens
gcagagtgagcaagggggcc

SEQ ID NO: 6234437 - DNA, 19 bp, Homo sapiens
gcagagtgaggatgtgttt

SEQ ID NO: 6234438 - DNA, 17 bp, Homo sapiens
gcagagtgcacagctgt

SEQ ID NO: 6234439 - DNA, 18 bp, Homo sapiens
gcagagtgcacagctgtc

SEQ ID NO: 6234440 - DNA, 16 bp, Homo sapiens
gcagagtgcagaggcg

SEQ ID NO: 6234441 - DNA, 14 bp, Homo sapiens
gcagagtgctggca

SEQ ID NO: 6234442 - DNA, 14 bp, Homo sapiens
gcagagtggagccc

SEQ ID NO: 6234443 - DNA, 16 bp, Homo sapiens
gcagagtggagcccag

SEQ ID NO: 6234444 - DNA, 22 bp, Homo sapiens
gcagagtggagcccagggtgct

SEQ ID NO: 6234445 - DNA, 17 bp, Homo sapiens
gcagagttacagttctg

SEQ ID NO: 6234446 - DNA, 15 bp, Homo sapiens
gcagagttcagactt

SEQ ID NO: 6234447 - DNA, 12 bp, Homo sapiens
gcagagttctgt

SEQ ID NO: 6234448 - DNA, 15 bp, Homo sapiens
gcagagttctttgca

SEQ ID NO: 6234449 - DNA, 16 bp, Homo sapiens
gcagagttgaagacag

SEQ ID NO: 6234450 - DNA, 20 bp, Homo sapiens
gcagagttgaagacagagct

SEQ ID NO: 6234451 - DNA, 14 bp, Homo sapiens
gcagagttgaccag

SEQ ID NO: 6234452 - DNA, 14 bp, Homo sapiens
gcagagttgtctta

SEQ ID NO: 6234453 - DNA, 12 bp, Homo sapiens
gcagagttttca

SEQ ID NO: 6234454 - DNA, 19 bp, Homo sapiens
gcagagttttcattaaatc

SEQ ID NO: 6234455 - DNA, 14 bp, Homo sapiens
gcagataaaatatt

SEQ ID NO: 6234456 - DNA, 22 bp, Homo sapiens
gcagataaacagaaatgctctg

SEQ ID NO: 6234457 - DNA, 15 bp, Homo sapiens
gcagataaagacagc

SEQ ID NO: 6234458 - DNA, 15 bp, Homo sapiens
gcagataactgctgt

SEQ ID NO: 6234459 - DNA, 13 bp, Homo sapiens
gcagataactttt

SEQ ID NO: 6234460 - DNA, 14 bp, Homo sapiens
gcagataacttttt

SEQ ID NO: 6234461 - DNA, 20 bp, Homo sapiens
gcagataaggccgagcccac

SEQ ID NO: 6234462 - DNA, 16 bp, Homo sapiens
gcagataatcagcctc

SEQ ID NO: 6234463 - DNA, 19 bp, Homo sapiens
gcagataatcagcctctta

SEQ ID NO: 6234464 - DNA, 17 bp, Homo sapiens
gcagatacactgctctc

SEQ ID NO: 6234465 - DNA, 22 bp, Homo sapiens
gcagatactactgaccagacaa

SEQ ID NO: 6234466 - DNA, 15 bp, Homo sapiens
gcagatactgtctct

SEQ ID NO: 6234467 - DNA, 19 bp, Homo sapiens
gcagatagaatttggccca

SEQ ID NO: 6234468 - DNA, 21 bp, Homo sapiens
gcagatagaatttggcccaga

SEQ ID NO: 6234469 - DNA, 16 bp, Homo sapiens
gcagatagcccaggag

SEQ ID NO: 6234470 - DNA, 18 bp, Homo sapiens
gcagatagcccaggagca

SEQ ID NO: 6234471 - DNA, 19 bp, Homo sapiens
gcagatagcccaggagcaa

SEQ ID NO: 6234472 - DNA, 20 bp, Homo sapiens
gcagatagcccaggagcaac

SEQ ID NO: 6234473 - DNA, 17 bp, Homo sapiens
gcagatatagcattaat

SEQ ID NO: 6234474 - DNA, 17 bp, Homo sapiens
gcagatatgtattactt

SEQ ID NO: 6234475 - DNA, 22 bp, Homo sapiens
gcagatattctctagtcatttg

SEQ ID NO: 6234476 - DNA, 20 bp, Homo sapiens
gcagatcacttgagctcagg

SEQ ID NO: 6234477 - DNA, 22 bp, Homo sapiens
gcagatcatccgtctgtgtggg

SEQ ID NO: 6234478 - DNA, 15 bp, Homo sapiens
gcagatccacctgca

SEQ ID NO: 6234479 - DNA, 17 bp, Homo sapiens
gcagatccacctgcaca

SEQ ID NO: 6234480 - DNA, 19 bp, Homo sapiens
gcagatccacctgcacaaa

SEQ ID NO: 6234481 - DNA, 15 bp, Homo sapiens
gcagatccaggacta

SEQ ID NO: 6234482 - DNA, 21 bp, Homo sapiens
gcagatcgctcactgttgtga

SEQ ID NO: 6234483 - DNA, 15 bp, Homo sapiens
gcagatctagccagg

SEQ ID NO: 6234484 - DNA, 22 bp, Homo sapiens
gcagatctagccaggcctcccg

SEQ ID NO: 6234485 - DNA, 14 bp, Homo sapiens
gcagatctgtgccc

SEQ ID NO: 6234486 - DNA, 20 bp, Homo sapiens
gcagatcttccgtggtcaga

SEQ ID NO: 6234487 - DNA, 23 bp, Homo sapiens
gcagatcttccgtggtcagagtg

SEQ ID NO: 6234488 - DNA, 16 bp, Homo sapiens
gcagatcttggactca

SEQ ID NO: 6234489 - DNA, 14 bp, Homo sapiens
gcagatcttttctt

SEQ ID NO: 6234490 - DNA, 17 bp, Homo sapiens
gcagatcttttctttaa

SEQ ID NO: 6234491 - DNA, 12 bp, Homo sapiens
gcagatgacaag

SEQ ID NO: 6234492 - DNA, 13 bp, Homo sapiens
gcagatgacagag

SEQ ID NO: 6234493 - DNA, 14 bp, Homo sapiens
gcagatgactgaga

SEQ ID NO: 6234494 - DNA, 22 bp, Homo sapiens
gcagatgagcagtcacactgtt

SEQ ID NO: 6234495 - DNA, 13 bp, Homo sapiens
gcagatgagggct

SEQ ID NO: 6234496 - DNA, 17 bp, Homo sapiens
gcagatgaggggccact

SEQ ID NO: 6234497 - DNA, 22 bp, Homo sapiens
gcagatgaggggccactgaccc

SEQ ID NO: 6234498 - DNA, 19 bp, Homo sapiens
gcagatgaggttgctagag

SEQ ID NO: 6234499 - DNA, 17 bp, Homo sapiens
gcagatgagtcctcggt

SEQ ID NO: 6234500 - DNA, 13 bp, Homo sapiens
gcagatgatccat

SEQ ID NO: 6234501 - DNA, 18 bp, Homo sapiens
gcagatgatgctttggaa

SEQ ID NO: 6234502 - DNA, 17 bp, Homo sapiens
gcagatgcaaagaggca

SEQ ID NO: 6234503 - DNA, 22 bp, Homo sapiens
gcagatgcaaagaggcaagagg

SEQ ID NO: 6234504 - DNA, 13 bp, Homo sapiens
gcagatgcaatga

SEQ ID NO: 6234505 - DNA, 13 bp, Homo sapiens
gcagatgcacatg

SEQ ID NO: 6234506 - DNA, 18 bp, Homo sapiens
gcagatgcacatgttgga

SEQ ID NO: 6234507 - DNA, 14 bp, Homo sapiens
gcagatgccaccct

SEQ ID NO: 6234508 - DNA, 13 bp, Homo sapiens
gcagatgccagtg

SEQ ID NO: 6234509 - DNA, 15 bp, Homo sapiens
gcagatgccagtgaa

SEQ ID NO: 6234510 - DNA, 20 bp, Homo sapiens
gcagatgcccttgctgggcc

SEQ ID NO: 6234511 - DNA, 22 bp, Homo sapiens
gcagatgcccttgctgggcctg

SEQ ID NO: 6234512 - DNA, 17 bp, Homo sapiens
gcagatgcctgcagtgc

SEQ ID NO: 6234513 - DNA, 13 bp, Homo sapiens
gcagatgcctggg

SEQ ID NO: 6234514 - DNA, 23 bp, Homo sapiens
gcagatgcgtagcatttgctgca

SEQ ID NO: 6234515 - DNA, 18 bp, Homo sapiens
gcagatgctgctgaagag

SEQ ID NO: 6234516 - DNA, 22 bp, Homo sapiens
gcagatgctgtcactggcagag

SEQ ID NO: 6234517 - DNA, 13 bp, Homo sapiens
gcagatgctttgc

SEQ ID NO: 6234518 - DNA, 22 bp, Homo sapiens
gcagatgctttgcccaggcttc

SEQ ID NO: 6234519 - DNA, 15 bp, Homo sapiens
gcagatggaaagaaa

SEQ ID NO: 6234520 - DNA, 15 bp, Homo sapiens
gcagatggaaagagg

SEQ ID NO: 6234521 - DNA, 13 bp, Homo sapiens
gcagatggagacc

SEQ ID NO: 6234522 - DNA, 16 bp, Homo sapiens
gcagatggcagatgca

SEQ ID NO: 6234523 - DNA, 18 bp, Homo sapiens
gcagatggcagatgcaca

SEQ ID NO: 6234524 - DNA, 17 bp, Homo sapiens
gcagatggcagggctga

SEQ ID NO: 6234525 - DNA, 22 bp, Homo sapiens
gcagatggcggtgatcagcaga

SEQ ID NO: 6234526 - DNA, 15 bp, Homo sapiens
gcagatgggcggacg

SEQ ID NO: 6234527 - DNA, 16 bp, Homo sapiens
gcagatggtctgagtt

SEQ ID NO: 6234528 - DNA, 15 bp, Homo sapiens
gcagatgtaggaggg

SEQ ID NO: 6234529 - DNA, 20 bp, Homo sapiens
gcagatgtcccccactgcta

SEQ ID NO: 6234530 - DNA, 21 bp, Homo sapiens
gcagatgtcttccctgggctg

SEQ ID NO: 6234531 - DNA, 17 bp, Homo sapiens
gcagatgtgcagcagat

SEQ ID NO: 6234532 - DNA, 22 bp, Homo sapiens
gcagatgtgcagcagattggaa

SEQ ID NO: 6234533 - DNA, 14 bp, Homo sapiens
gcagatgtggtgat

SEQ ID NO: 6234534 - DNA, 18 bp, Homo sapiens
gcagatgttagatatttt

SEQ ID NO: 6234535 - DNA, 20 bp, Homo sapiens
gcagatgttagatatttttc

SEQ ID NO: 6234536 - DNA, 13 bp, Homo sapiens
gcagattattcac

SEQ ID NO: 6234537 - DNA, 17 bp, Homo sapiens
gcagattcagaaatgag

SEQ ID NO: 6234538 - DNA, 21 bp, Homo sapiens
gcagattcagaaatgaggcca

SEQ ID NO: 6234539 - DNA, 19 bp, Homo sapiens
gcagattcatttttctttc

SEQ ID NO: 6234540 - DNA, 18 bp, Homo sapiens
gcagattcctgggcctgt

SEQ ID NO: 6234541 - DNA, 21 bp, Homo sapiens
gcagattcctgggcctgtccc

SEQ ID NO: 6234542 - DNA, 15 bp, Homo sapiens
gcagattctagcaca

SEQ ID NO: 6234543 - DNA, 14 bp, Homo sapiens
gcagattctgagca

SEQ ID NO: 6234544 - DNA, 15 bp, Homo sapiens
gcagattctgagcaa

SEQ ID NO: 6234545 - DNA, 18 bp, Homo sapiens
gcagattctgagcaaagg

SEQ ID NO: 6234546 - DNA, 19 bp, Homo sapiens
gcagattctgagcaaaggc

SEQ ID NO: 6234547 - DNA, 17 bp, Homo sapiens
gcagattgaaaaggaca

SEQ ID NO: 6234548 - DNA, 13 bp, Homo sapiens
gcagattgaatat

SEQ ID NO: 6234549 - DNA, 19 bp, Homo sapiens
gcagattgggctggctctg

SEQ ID NO: 6234550 - DNA, 19 bp, Homo sapiens
gcagattggttcatgcctg

SEQ ID NO: 6234551 - DNA, 16 bp, Homo sapiens
gcagatttcagatgta

SEQ ID NO: 6234552 - DNA, 13 bp, Homo sapiens
gcagatttctgcc

SEQ ID NO: 6234553 - DNA, 22 bp, Homo sapiens
gcagatttgtggggacctcagc

SEQ ID NO: 6234554 - DNA, 20 bp, Homo sapiens
gcagattttaggaaatgaat

SEQ ID NO: 6234555 - DNA, 20 bp, Homo sapiens
gcagattttcctaaggccac

SEQ ID NO: 6234556 - DNA, 14 bp, Homo sapiens
gcagattttcttaa

SEQ ID NO: 6234557 - DNA, 23 bp, Homo sapiens
gcagatttttatattagttgctt

SEQ ID NO: 6234558 - DNA, 21 bp, Homo sapiens
gcagcaaaaccaaactgggtc

SEQ ID NO: 6234559 - DNA, 16 bp, Homo sapiens
gcagcaacaataaata

SEQ ID NO: 6234560 - DNA, 18 bp, Homo sapiens
gcagcaacacccaagtcc

SEQ ID NO: 6234561 - DNA, 15 bp, Homo sapiens
gcagcaacagcagag

SEQ ID NO: 6234562 - DNA, 16 bp, Homo sapiens
gcagcaacaggaccag

SEQ ID NO: 6234563 - DNA, 20 bp, Homo sapiens
gcagcaacaggaccaggagc

SEQ ID NO: 6234564 - DNA, 19 bp, Homo sapiens
gcagcaaccagagcactgt

SEQ ID NO: 6234565 - DNA, 16 bp, Homo sapiens
gcagcaacgtttttaa

SEQ ID NO: 6234566 - DNA, 11 bp, Homo sapiens
gcagcaactcc

SEQ ID NO: 6234567 - DNA, 14 bp, Homo sapiens
gcagcaactcccac

SEQ ID NO: 6234568 - DNA, 16 bp, Homo sapiens
gcagcaactcccacga

SEQ ID NO: 6234569 - DNA, 14 bp, Homo sapiens
gcagcaactgaaaa

SEQ ID NO: 6234570 - DNA, 15 bp, Homo sapiens
gcagcaacttgtcct

SEQ ID NO: 6234571 - DNA, 15 bp, Homo sapiens
gcagcaagaaaaaaa

SEQ ID NO: 6234572 - DNA, 21 bp, Homo sapiens
gcagcaaggcccgagcagctg

SEQ ID NO: 6234573 - DNA, 16 bp, Homo sapiens
gcagcaaggctgctgc

SEQ ID NO: 6234574 - DNA, 18 bp, Homo sapiens
gcagcaagggacctgctc

SEQ ID NO: 6234575 - DNA, 17 bp, Homo sapiens
gcagcaaggtcttgctc

SEQ ID NO: 6234576 - DNA, 12 bp, Homo sapiens
gcagcaataaag

SEQ ID NO: 6234577 - DNA, 23 bp, Homo sapiens
gcagcaataaagcagcgtttcta

SEQ ID NO: 6234578 - DNA, 13 bp, Homo sapiens
gacgctctgctgt

SEQ ID NO: 6234579 - DNA, 22 bp, Homo sapiens
gacgctctgctgtgggcacagg

SEQ ID NO: 6234580 - DNA, 13 bp, Homo sapiens
gacgctgaataaa

SEQ ID NO: 6234581 - DNA, 16 bp, Homo sapiens
gacgctgaataaatgt

SEQ ID NO: 6234582 - DNA, 23 bp, Homo sapiens
gacgctgcacttgacaccaacca

SEQ ID NO: 6234583 - DNA, 18 bp, Homo sapiens
gacgctgccgctgccgct

SEQ ID NO: 6234584 - DNA, 19 bp, Homo sapiens
gacgctggagatgcaaggt

SEQ ID NO: 6234585 - DNA, 12 bp, Homo sapiens
gacgctggctcc

SEQ ID NO: 6234586 - DNA, 20 bp, Homo sapiens
gacgctgtgattggcaggag

SEQ ID NO: 6234587 - DNA, 19 bp, Homo sapiens
gacgcttaacctttccgct

SEQ ID NO: 6234588 - DNA, 18 bp, Homo sapiens
gacgcttcacaggacagg

SEQ ID NO: 6234589 - DNA, 20 bp, Homo sapiens
gacgcttccagaccacctgc

SEQ ID NO: 6234590 - DNA, 21 bp, Homo sapiens
gacgcttccagaccacctgcc

SEQ ID NO: 6234591 - DNA, 23 bp, Homo sapiens
gacgcttccagaccacctgccag

SEQ ID NO: 6234592 - DNA, 13 bp, Homo sapiens
gacgcttgctctg

SEQ ID NO: 6234593 - DNA, 13 bp, Homo sapiens
gacgctttgtctg

SEQ ID NO: 6234594 - DNA, 21 bp, Homo sapiens
gacggaaacaacgttgctatt

SEQ ID NO: 6234595 - DNA, 15 bp, Homo sapiens
gacggaagtaaatta

SEQ ID NO: 6234596 - DNA, 14 bp, Homo sapiens
gacggaagtggcct

SEQ ID NO: 6234597 - DNA, 18 bp, Homo sapiens
gacggagcactgtgcagc

SEQ ID NO: 6234598 - DNA, 22 bp, Homo sapiens
gacggagcactgtgcagccggg

SEQ ID NO: 6234599 - DNA, 12 bp, Homo sapiens
gacggaggaggg

SEQ ID NO: 6234600 - DNA, 17 bp, Homo sapiens
gacggaggaggggaagg

SEQ ID NO: 6234601 - DNA, 21 bp, Homo sapiens
gacggaggttgcagtgagccg

SEQ ID NO: 6234602 - DNA, 21 bp, Homo sapiens
gacggagtcccaccttggctg

SEQ ID NO: 6234603 - DNA, 15 bp, Homo sapiens
gacggagtgggggga

SEQ ID NO: 6234604 - DNA, 21 bp, Homo sapiens
gacggagtggggggacagaga

SEQ ID NO: 6234605 - DNA, 23 bp, Homo sapiens
gacggataggcaggaacatacag

SEQ ID NO: 6234606 - DNA, 21 bp, Homo sapiens
gacggatgcccattcctgcct

SEQ ID NO: 6234607 - DNA, 23 bp, Homo sapiens
gacggatgcccattcctgcctgg

SEQ ID NO: 6234608 - DNA, 14 bp, Homo sapiens
gacggatggaagga

SEQ ID NO: 6234609 - DNA, 18 bp, Homo sapiens
gacggatggaaggagaga

SEQ ID NO: 6234610 - DNA, 20 bp, Homo sapiens
gacggattccttggcagccg

SEQ ID NO: 6234611 - DNA, 19 bp, Homo sapiens
gacggcacgcacttgcctg

SEQ ID NO: 6234612 - DNA, 22 bp, Homo sapiens
gacggcacggtcttccctcttc

SEQ ID NO: 6234613 - DNA, 19 bp, Homo sapiens
gacggcagaaaacagagcc

SEQ ID NO: 6234614 - DNA, 23 bp, Homo sapiens
gacggcagaaaacagagcctgcc

SEQ ID NO: 6234615 - DNA, 12 bp, Homo sapiens
gacggcagcccc

SEQ ID NO: 6234616 - DNA, 18 bp, Homo sapiens
gacggcagccccatcctt

SEQ ID NO: 6234617 - DNA, 17 bp, Homo sapiens
gacggccaatggtgctt

SEQ ID NO: 6234618 - DNA, 17 bp, Homo sapiens
gacggccaggctccctg

SEQ ID NO: 6234619 - DNA, 21 bp, Homo sapiens
gacggccaggctccctgacca

SEQ ID NO: 6234620 - DNA, 13 bp, Homo sapiens
gacggccctgctg

SEQ ID NO: 6234621 - DNA, 21 bp, Homo sapiens
gacggccggccggacctctga

SEQ ID NO: 6234622 - DNA, 11 bp, Homo sapiens
gacggcctcca

SEQ ID NO: 6234623 - DNA, 23 bp, Homo sapiens
gacggcctgatgctccctcccct

SEQ ID NO: 6234624 - DNA, 13 bp, Homo sapiens
gacggcggccagg

SEQ ID NO: 6234625 - DNA, 14 bp, Homo sapiens
gacggcggccaggc

SEQ ID NO: 6234626 - DNA, 18 bp, Homo sapiens
gacggcggccaggcacag

SEQ ID NO: 6234627 - DNA, 21 bp, Homo sapiens
gacggcggccaggcacagggc

SEQ ID NO: 6234628 - DNA, 13 bp, Homo sapiens
gacggctgagcat

SEQ ID NO: 6234629 - DNA, 12 bp, Homo sapiens
gacggctggacc

SEQ ID NO: 6234630 - DNA, 16 bp, Homo sapiens
gacggctggacctgca

SEQ ID NO: 6234631 - DNA, 13 bp, Homo sapiens
gacggctgggcac

SEQ ID NO: 6234632 - DNA, 11 bp, Homo sapiens
gacggctgggg

SEQ ID NO: 6234633 - DNA, 18 bp, Homo sapiens
gacggctggggacccacc

SEQ ID NO: 6234634 - DNA, 14 bp, Homo sapiens
gacggctgtggacc

SEQ ID NO: 6234635 - DNA, 22 bp, Homo sapiens
gacggctgtggaccgtggacag

SEQ ID NO: 6234636 - DNA, 23 bp, Homo sapiens
gacggctgtggaccgtggacagg

SEQ ID NO: 6234637 - DNA, 19 bp, Homo sapiens
gacggctgtgtatttctgt

SEQ ID NO: 6234638 - DNA, 18 bp, Homo sapiens
gacgggaatgcctaggtc

SEQ ID NO: 6234639 - DNA, 13 bp, Homo sapiens
gacgggaccctgc

SEQ ID NO: 6234640 - DNA, 20 bp, Homo sapiens
gacgggagcattggcccctg

SEQ ID NO: 6234641 - DNA, 15 bp, Homo sapiens
gacgggagcctcctc

SEQ ID NO: 6234642 - DNA, 17 bp, Homo sapiens
gacgggagcctcctctg

SEQ ID NO: 6234643 - DNA, 20 bp, Homo sapiens
gacgggaggccccagctctg

SEQ ID NO: 6234644 - DNA, 17 bp, Homo sapiens
gacgggaggcctcagtt

SEQ ID NO: 6234645 - DNA, 18 bp, Homo sapiens
gacgggaggcctcagttc

SEQ ID NO: 6234646 - DNA, 20 bp, Homo sapiens
gacgggaggggaaaggctgc

SEQ ID NO: 6234647 - DNA, 17 bp, Homo sapiens
gacgggaggggaggcat

SEQ ID NO: 6234648 - DNA, 18 bp, Homo sapiens
gacgggaggggaggcatt

SEQ ID NO: 6234649 - DNA, 15 bp, Homo sapiens
gacgggatgctcttt

SEQ ID NO: 6234650 - DNA, 18 bp, Homo sapiens
gacgggcaagaagctgct

SEQ ID NO: 6234651 - DNA, 15 bp, Homo sapiens
gacgggcacagacac

SEQ ID NO: 6234652 - DNA, 19 bp, Homo sapiens
gacgggccacacgtggctg

SEQ ID NO: 6234653 - DNA, 19 bp, Homo sapiens
gacgggccgcaggagggag

SEQ ID NO: 6234654 - DNA, 23 bp, Homo sapiens
gacgggcggtcctactgctgtga

SEQ ID NO: 6234655 - DNA, 13 bp, Homo sapiens
gacgggctgtccg

SEQ ID NO: 6234656 - DNA, 20 bp, Homo sapiens
gacgggctgtccgtgtgcct

SEQ ID NO: 6234657 - DNA, 22 bp, Homo sapiens
gacggggatggttccccaggag

SEQ ID NO: 6234658 - DNA, 13 bp, Homo sapiens
gacggggcagagc

SEQ ID NO: 6234659 - DNA, 13 bp, Homo sapiens
gacggggctcagc

SEQ ID NO: 6234660 - DNA, 17 bp, Homo sapiens
gacggggctcccctgga

SEQ ID NO: 6234661 - DNA, 23 bp, Homo sapiens
gacggggctcccctggacagagg

SEQ ID NO: 6234662 - DNA, 17 bp, Homo sapiens
gacgggggctgcttctc

SEQ ID NO: 6234663 - DNA, 17 bp, Homo sapiens
gacggggtttcatcatg

SEQ ID NO: 6234664 - DNA, 17 bp, Homo sapiens
gacgggtattgttggga

SEQ ID NO: 6234665 - DNA, 15 bp, Homo sapiens
gacgggttcaccatg

SEQ ID NO: 6234666 - DNA, 21 bp, Homo sapiens
gacgggttgaaagacatcaat

SEQ ID NO: 6234667 - DNA, 19 bp, Homo sapiens
gacgggttggggccgggca

SEQ ID NO: 6234668 - DNA, 22 bp, Homo sapiens
gacggtcagtttggtgtcaaca

SEQ ID NO: 6234669 - DNA, 23 bp, Homo sapiens
gacggtcctttaggcagcctgcc

SEQ ID NO: 6234670 - DNA, 16 bp, Homo sapiens
gacggtctgtgcccga

SEQ ID NO: 6234671 - DNA, 24 bp, Homo sapiens
gacggtgacaaagatggctcagag

SEQ ID NO: 6234672 - DNA, 13 bp, Homo sapiens
gacggtgccaagg

SEQ ID NO: 6234673 - DNA, 20 bp, Homo sapiens
gacggtgccaagggccccag

SEQ ID NO: 6234674 - DNA, 17 bp, Homo sapiens
gacggtgctcactccca

SEQ ID NO: 6234675 - DNA, 17 bp, Homo sapiens
gacggtgctccaggcag

SEQ ID NO: 6234676 - DNA, 19 bp, Homo sapiens
gacggtgttaattttgcta

SEQ ID NO: 6234677 - DNA, 18 bp, Homo sapiens
gacggttaacttgtatat

SEQ ID NO: 6234678 - DNA, 20 bp, Homo sapiens
gacggttaacttgtatattc

SEQ ID NO: 6234679 - DNA, 18 bp, Homo sapiens
gacggttcaccagcctct

SEQ ID NO: 6234680 - DNA, 19 bp, Homo sapiens
gacggttcaccagcctctc

SEQ ID NO: 6234681 - DNA, 11 bp, Homo sapiens
gacggttccta

SEQ ID NO: 6234682 - DNA, 21 bp, Homo sapiens
gacggttcctacacaggacag

SEQ ID NO: 6234683 - DNA, 14 bp, Homo sapiens
gacggttgtaagca

SEQ ID NO: 6234684 - DNA, 21 bp, Homo sapiens
gacggtttcaaaccaggattt

SEQ ID NO: 6234685 - DNA, 15 bp, Homo sapiens
gacggtttccaggga

SEQ ID NO: 6234686 - DNA, 22 bp, Homo sapiens
gacggtttccagggaggggccg

SEQ ID NO: 6234687 - DNA, 12 bp, Homo sapiens
gacgtaaaattt

SEQ ID NO: 6234688 - DNA, 22 bp, Homo sapiens
gacgtacaagtagttctgtatt

SEQ ID NO: 6234689 - DNA, 15 bp, Homo sapiens
gacgtacttgcagtt

SEQ ID NO: 6234690 - DNA, 12 bp, Homo sapiens
gacgtagagttg

SEQ ID NO: 6234691 - DNA, 12 bp, Homo sapiens
gacgtagctgca

SEQ ID NO: 6234692 - DNA, 20 bp, Homo sapiens
gacgtaggaacggtaaattt

SEQ ID NO: 6234693 - DNA, 14 bp, Homo sapiens
gacgtattatctgt

SEQ ID NO: 6234694 - DNA, 19 bp, Homo sapiens
gacgtatttataataggta

SEQ ID NO: 6234695 - DNA, 16 bp, Homo sapiens
gacgtcacgctccctg

SEQ ID NO: 6234696 - DNA, 13 bp, Homo sapiens
gacgtcagcctct

SEQ ID NO: 6234697 - DNA, 22 bp, Homo sapiens
gacgtcagcctcttaccttccc

SEQ ID NO: 6234698 - DNA, 19 bp, Homo sapiens
gacgtcatcggaggctggg

SEQ ID NO: 6234699 - DNA, 21 bp, Homo sapiens
gacgtcatcggaggctgggcc

SEQ ID NO: 6234700 - DNA, 23 bp, Homo sapiens
gacgtcatcggaggctgggcccc

SEQ ID NO: 6234701 - DNA, 19 bp, Homo sapiens
gacgtccaccctgcagcca

SEQ ID NO: 6234702 - DNA, 23 bp, Homo sapiens
gacgtccaccctgcagccaggac

SEQ ID NO: 6234703 - DNA, 22 bp, Homo sapiens
gacgtccctccacgttcacccc

SEQ ID NO: 6234704 - DNA, 14 bp, Homo sapiens
gacgtcccttggat

SEQ ID NO: 6234705 - DNA, 18 bp, Homo sapiens
gacgtcccttttttctct

SEQ ID NO: 6234706 - DNA, 18 bp, Homo sapiens
gacgtcctgccacctggg

SEQ ID NO: 6234707 - DNA, 23 bp, Homo sapiens
gacgtccttccatatccctgccc

SEQ ID NO: 6234708 - DNA, 20 bp, Homo sapiens
gacgtcgctgtccgtcctgc

SEQ ID NO: 6234709 - DNA, 20 bp, Homo sapiens
gacgtctccccttctctgcc

SEQ ID NO: 6234710 - DNA, 13 bp, Homo sapiens
gacgtctgccacc

SEQ ID NO: 6234711 - DNA, 23 bp, Homo sapiens
gacgtctgccaccagcgccccca

SEQ ID NO: 6234712 - DNA, 16 bp, Homo sapiens
gacgtctggccctggc

SEQ ID NO: 6234713 - DNA, 17 bp, Homo sapiens
gacgtctggggtgtggg

SEQ ID NO: 6234714 - DNA, 20 bp, Homo sapiens
gacgtctggggtgtggggat

SEQ ID NO: 6234715 - DNA, 17 bp, Homo sapiens
gacgtctgggtggccct

SEQ ID NO: 6234716 - DNA, 20 bp, Homo sapiens
gacgtcttaggtggcagggc

SEQ ID NO: 6234717 - DNA, 19 bp, Homo sapiens
gacgtgaaatacttcgatg

SEQ ID NO: 6234718 - DNA, 18 bp, Homo sapiens
gacgtgaatgtctcagcg

SEQ ID NO: 6234719 - DNA, 19 bp, Homo sapiens
gacgtgaatgtctcagcga

SEQ ID NO: 6234720 - DNA, 19 bp, Homo sapiens
gacgtgaccaattgccctg

SEQ ID NO: 6234721 - DNA, 21 bp, Homo sapiens
gacgtgaccaattgccctgcc

SEQ ID NO: 6234722 - DNA, 15 bp, Homo sapiens
gacgtgagtggggag

SEQ ID NO: 6234723 - DNA, 21 bp, Homo sapiens
gacgtgcacaaaccttctttt

SEQ ID NO: 6234724 - DNA, 11 bp, Homo sapiens
gacgtgcactg

SEQ ID NO: 6234725 - DNA, 15 bp, Homo sapiens
gacgtggactcctct

SEQ ID NO: 6234726 - DNA, 16 bp, Homo sapiens
gacgtggcacctcctc

SEQ ID NO: 6234727 - DNA, 17 bp, Homo sapiens
gacgtggtagtcacttg

SEQ ID NO: 6234728 - DNA, 20 bp, Homo sapiens
gacgtggtcagggcagggct

SEQ ID NO: 6234729 - DNA, 21 bp, Homo sapiens
gacgtggtctagaccagggct

SEQ ID NO: 6234730 - DNA, 22 bp, Homo sapiens
gacgtggtctagaccagggctg

SEQ ID NO: 6234731 - DNA, 15 bp, Homo sapiens
gacgtgtcaggtggt

SEQ ID NO: 6234732 - DNA, 17 bp, Homo sapiens
gacgtgtgtaaatatgt

SEQ ID NO: 6234733 - DNA, 20 bp, Homo sapiens
gacgtgttacccactgccat

SEQ ID NO: 6234734 - DNA, 22 bp, Homo sapiens
gacgtgttacccactgccatgc

SEQ ID NO: 6234735 - DNA, 14 bp, Homo sapiens
gacgtgttatgact

SEQ ID NO: 6234736 - DNA, 14 bp, Homo sapiens
gacgttaggccagg

SEQ ID NO: 6234737 - DNA, 15 bp, Homo sapiens
gacgttaggccaggc

SEQ ID NO: 6234738 - DNA, 19 bp, Homo sapiens
gacgttaggccaggcctta

SEQ ID NO: 6234739 - DNA, 18 bp, Homo sapiens
gacgttaggcccgggccc

SEQ ID NO: 6234740 - DNA, 12 bp, Homo sapiens
gacgttccagcc

SEQ ID NO: 6234741 - DNA, 13 bp, Homo sapiens
gacgttccagccg

SEQ ID NO: 6234742 - DNA, 13 bp, Homo sapiens
gacgttgcctgag

SEQ ID NO: 6234743 - DNA, 17 bp, Homo sapiens
gacgttgctgagccagc

SEQ ID NO: 6234744 - DNA, 19 bp, Homo sapiens
gacgttgctgagccagctg

SEQ ID NO: 6234745 - DNA, 21 bp, Homo sapiens
gacgttgctgagccagctgca

SEQ ID NO: 6234746 - DNA, 16 bp, Homo sapiens
gacgttggtcccaagt

SEQ ID NO: 6234747 - DNA, 21 bp, Homo sapiens
gacgttgttgtcattgtccag

SEQ ID NO: 6234748 - DNA, 18 bp, Homo sapiens
gacgtttacaagcccccc

SEQ ID NO: 6234749 - DNA, 12 bp, Homo sapiens
gacgtttctcat

SEQ ID NO: 6234750 - DNA, 23 bp, Homo sapiens
gacgtttctcatttgtttttctc

SEQ ID NO: 6234751 - DNA, 13 bp, Homo sapiens
gacgtttctgggc

SEQ ID NO: 6234752 - DNA, 17 bp, Homo sapiens
gacgtttgcggcagtgt

SEQ ID NO: 6234753 - DNA, 23 bp, Homo sapiens
gacgttttctccgcattggaaga

SEQ ID NO: 6234754 - DNA, 19 bp, Homo sapiens
gacgtttttgtgctgtggg

SEQ ID NO: 6234755 - DNA, 15 bp, Homo sapiens
gcagcaatttaaatg

SEQ ID NO: 6234756 - DNA, 16 bp, Homo sapiens
gcagcaatttaaatgt

SEQ ID NO: 6234757 - DNA, 17 bp, Homo sapiens
gcagcaatttaaatgtt

SEQ ID NO: 6234758 - DNA, 20 bp, Homo sapiens
gcagcacaaacattgctgcc

SEQ ID NO: 6234759 - DNA, 23 bp, Homo sapiens
gcagcacaaggaatttccctgtg

SEQ ID NO: 6234760 - DNA, 11 bp, Homo sapiens
gcagcacaatt

SEQ ID NO: 6234761 - DNA, 18 bp, Homo sapiens
gcagcacaattctgtccc

SEQ ID NO: 6234762 - DNA, 16 bp, Homo sapiens
gcagcacacctcagcc

SEQ ID NO: 6234763 - DNA, 19 bp, Homo sapiens
gcagcacacctcagcccca

SEQ ID NO: 6234764 - DNA, 13 bp, Homo sapiens
gcagcacacctct

SEQ ID NO: 6234765 - DNA, 16 bp, Homo sapiens
gcagcacacctctggg

SEQ ID NO: 6234766 - DNA, 14 bp, Homo sapiens
gcagcacagagagg

SEQ ID NO: 6234767 - DNA, 15 bp, Homo sapiens
gcagcacagcccagg

SEQ ID NO: 6234768 - DNA, 16 bp, Homo sapiens
gcagcacagcccaggg

SEQ ID NO: 6234769 - DNA, 14 bp, Homo sapiens
gcagcacagctact

SEQ ID NO: 6234770 - DNA, 13 bp, Homo sapiens
gcagcacaggagg

SEQ ID NO: 6234771 - DNA, 17 bp, Homo sapiens
gcagcacatgcgggctc

SEQ ID NO: 6234772 - DNA, 19 bp, Homo sapiens
gcagcacatggtgttgtat

SEQ ID NO: 6234773 - DNA, 16 bp, Homo sapiens
gcagcacattgccctg

SEQ ID NO: 6234774 - DNA, 17 bp, Homo sapiens
gcagcaccaaccacagc

SEQ ID NO: 6234775 - DNA, 13 bp, Homo sapiens
gcagcaccacact

SEQ ID NO: 6234776 - DNA, 18 bp, Homo sapiens
gcagcaccagcctgagcc

SEQ ID NO: 6234777 - DNA, 21 bp, Homo sapiens
gcagcaccagcctgagccaca

SEQ ID NO: 6234778 - DNA, 14 bp, Homo sapiens
gcagcacccaccca

SEQ ID NO: 6234779 - DNA, 16 bp, Homo sapiens
gcagcacccactcagc

SEQ ID NO: 6234780 - DNA, 18 bp, Homo sapiens
gcagcacccactcagcca

SEQ ID NO: 6234781 - DNA, 12 bp, Homo sapiens
gcagcaccctcc

SEQ ID NO: 6234782 - DNA, 17 bp, Homo sapiens
gcagcaccctgcagagc

SEQ ID NO: 6234783 - DNA, 20 bp, Homo sapiens
gcagcaccgaggggcctttg

SEQ ID NO: 6234784 - DNA, 16 bp, Homo sapiens
gcagcaccgcctcttc

SEQ ID NO: 6234785 - DNA, 19 bp, Homo sapiens
gcagcaccgcctcttcccg

SEQ ID NO: 6234786 - DNA, 17 bp, Homo sapiens
gcagcaccgttctgtgc

SEQ ID NO: 6234787 - DNA, 19 bp, Homo sapiens
gcagcaccgttctgtgcac

SEQ ID NO: 6234788 - DNA, 14 bp, Homo sapiens
gcagcacctccagg

SEQ ID NO: 6234789 - DNA, 19 bp, Homo sapiens
gcagcacctccaggcctgt

SEQ ID NO: 6234790 - DNA, 17 bp, Homo sapiens
gcagcacctcctcagcc

SEQ ID NO: 6234791 - DNA, 16 bp, Homo sapiens
gcagcacctctcagga

SEQ ID NO: 6234792 - DNA, 18 bp, Homo sapiens
gcagcacctggagcccac

SEQ ID NO: 6234793 - DNA, 17 bp, Homo sapiens
gcagcacctttctctga

SEQ ID NO: 6234794 - DNA, 23 bp, Homo sapiens
gcagcacgcatgtccctccaagg

SEQ ID NO: 6234795 - DNA, 14 bp, Homo sapiens
gcagcacgcctctc

SEQ ID NO: 6234796 - DNA, 20 bp, Homo sapiens
gcagcacggcccggcccctc

SEQ ID NO: 6234797 - DNA, 18 bp, Homo sapiens
gcagcactcacacaggac

SEQ ID NO: 6234798 - DNA, 20 bp, Homo sapiens
gcagcactccccagagctgt

SEQ ID NO: 6234799 - DNA, 21 bp, Homo sapiens
gcagcactccccagagctgtg

SEQ ID NO: 6234800 - DNA, 23 bp, Homo sapiens
gcagcactccccagagctgtgcc

SEQ ID NO: 6234801 - DNA, 18 bp, Homo sapiens
gcagcactcccgctgcac

SEQ ID NO: 6234802 - DNA, 23 bp, Homo sapiens
gcagcactcccgctgcacacaga

SEQ ID NO: 6234803 - DNA, 16 bp, Homo sapiens
gcagcactgaaatatc

SEQ ID NO: 6234804 - DNA, 13 bp, Homo sapiens
gcagcactgctgc

SEQ ID NO: 6234805 - DNA, 14 bp, Homo sapiens
gcagcactgctgcc

SEQ ID NO: 6234806 - DNA, 20 bp, Homo sapiens
gcagcactgctgcctcagct

SEQ ID NO: 6234807 - DNA, 21 bp, Homo sapiens
gcagcactgctgcctcagctc

SEQ ID NO: 6234808 - DNA, 19 bp, Homo sapiens
gcagcactgggaagctgga

SEQ ID NO: 6234809 - DNA, 13 bp, Homo sapiens
gcagcactggggt

SEQ ID NO: 6234810 - DNA, 23 bp, Homo sapiens
gcagcacttagacctgccagcca

SEQ ID NO: 6234811 - DNA, 19 bp, Homo sapiens
gcagcactttaaccctctc

SEQ ID NO: 6234812 - DNA, 12 bp, Homo sapiens
gcagcagaagcc

SEQ ID NO: 6234813 - DNA, 13 bp, Homo sapiens
gcagcagaagcca

SEQ ID NO: 6234814 - DNA, 12 bp, Homo sapiens
gcagcagaaggg

SEQ ID NO: 6234815 - DNA, 22 bp, Homo sapiens
gcagcagaagggggtggtgtct

SEQ ID NO: 6234816 - DNA, 17 bp, Homo sapiens
gcagcagacacatgcca

SEQ ID NO: 6234817 - DNA, 16 bp, Homo sapiens
gcagcagagagagaga

SEQ ID NO: 6234818 - DNA, 23 bp, Homo sapiens
gcagcagagagagagagagagaa

SEQ ID NO: 6234819 - DNA, 20 bp, Homo sapiens
gcagcagagagagaggacag

SEQ ID NO: 6234820 - DNA, 15 bp, Homo sapiens
gcagcagaggagctg

SEQ ID NO: 6234821 - DNA, 12 bp, Homo sapiens
gcagcagaggca

SEQ ID NO: 6234822 - DNA, 23 bp, Homo sapiens
gcagcagaggcaggaccagaagg

SEQ ID NO: 6234823 - DNA, 20 bp, Homo sapiens
gcagcagattttaggaaatg

SEQ ID NO: 6234824 - DNA, 16 bp, Homo sapiens
gcagcagcaagtacaa

SEQ ID NO: 6234825 - DNA, 20 bp, Homo sapiens
gcagcagcaagtacaaaagg

SEQ ID NO: 6234826 - DNA, 13 bp, Homo sapiens
gcagcagcaccaa

SEQ ID NO: 6234827 - DNA, 15 bp, Homo sapiens
gcagcagcaccaacc

SEQ ID NO: 6234828 - DNA, 12 bp, Homo sapiens
gcagcagcacct

SEQ ID NO: 6234829 - DNA, 22 bp, Homo sapiens
gcagcagcacctttctctgaga

SEQ ID NO: 6234830 - DNA, 12 bp, Homo sapiens
gcagcagccacc

SEQ ID NO: 6234831 - DNA, 13 bp, Homo sapiens
gcagcagccagca

SEQ ID NO: 6234832 - DNA, 16 bp, Homo sapiens
gcagcagccagcacca

SEQ ID NO: 6234833 - DNA, 13 bp, Homo sapiens
gcagcagccagcc

SEQ ID NO: 6234834 - DNA, 19 bp, Homo sapiens
gcagcagccagccctgcct

SEQ ID NO: 6234835 - DNA, 12 bp, Homo sapiens
gcagcagccagg

SEQ ID NO: 6234836 - DNA, 16 bp, Homo sapiens
gcagcagccagggacc

SEQ ID NO: 6234837 - DNA, 14 bp, Homo sapiens
gcagcagcccagct

SEQ ID NO: 6234838 - DNA, 15 bp, Homo sapiens
gcagcagcccagctt

SEQ ID NO: 6234839 - DNA, 19 bp, Homo sapiens
gcagcagccccccttgccc

SEQ ID NO: 6234840 - DNA, 14 bp, Homo sapiens
gcagcagcctgcac

SEQ ID NO: 6234841 - DNA, 20 bp, Homo sapiens
gcagcagcgctcggcccgga

SEQ ID NO: 6234842 - DNA, 12 bp, Homo sapiens
gcagcagctagg

SEQ ID NO: 6234843 - DNA, 13 bp, Homo sapiens
gcagcagcttgct

SEQ ID NO: 6234844 - DNA, 16 bp, Homo sapiens
gcagcaggaaggaaca

SEQ ID NO: 6234845 - DNA, 21 bp, Homo sapiens
gcagcaggaaggaacaaagac

SEQ ID NO: 6234846 - DNA, 21 bp, Homo sapiens
gcagcaggaatatatgtgtgc

SEQ ID NO: 6234847 - DNA, 18 bp, Homo sapiens
gcagcaggactgtcccct

SEQ ID NO: 6234848 - DNA, 17 bp, Homo sapiens
gcagcaggactgtggga

SEQ ID NO: 6234849 - DNA, 15 bp, Homo sapiens
gcagcaggaggagtg

SEQ ID NO: 6234850 - DNA, 16 bp, Homo sapiens
gcagcaggaggccagg

SEQ ID NO: 6234851 - DNA, 17 bp, Homo sapiens
gcagcaggaggctagca

SEQ ID NO: 6234852 - DNA, 21 bp, Homo sapiens
gcagcaggaggctttctgggc

SEQ ID NO: 6234853 - DNA, 17 bp, Homo sapiens
gcagcaggagggactct

SEQ ID NO: 6234854 - DNA, 18 bp, Homo sapiens
gcagcaggagggactctg

SEQ ID NO: 6234855 - DNA, 19 bp, Homo sapiens
gcagcaggaggggggaggg

SEQ ID NO: 6234856 - DNA, 17 bp, Homo sapiens
gcagcaggatgggctga

SEQ ID NO: 6234857 - DNA, 13 bp, Homo sapiens
gcagcaggcagag

SEQ ID NO: 6234858 - DNA, 18 bp, Homo sapiens
gcagcaggcagaggagag

SEQ ID NO: 6234859 - DNA, 13 bp, Homo sapiens
gcagcaggcagct

SEQ ID NO: 6234860 - DNA, 14 bp, Homo sapiens
gcagcaggcctctg

SEQ ID NO: 6234861 - DNA, 17 bp, Homo sapiens
gcagcaggcctctggga

SEQ ID NO: 6234862 - DNA, 23 bp, Homo sapiens
gcagcaggcctctggttgcctcc

SEQ ID NO: 6234863 - DNA, 17 bp, Homo sapiens
gcagcaggctcaggcac

SEQ ID NO: 6234864 - DNA, 18 bp, Homo sapiens
gcagcaggctcaggcaca

SEQ ID NO: 6234865 - DNA, 20 bp, Homo sapiens
gcagcagggagggcttctgc

SEQ ID NO: 6234866 - DNA, 17 bp, Homo sapiens
gcagcagggatgccctg

SEQ ID NO: 6234867 - DNA, 19 bp, Homo sapiens
gcagcagggctaccctgag

SEQ ID NO: 6234868 - DNA, 14 bp, Homo sapiens
gcagcagggctggg

SEQ ID NO: 6234869 - DNA, 17 bp, Homo sapiens
gcagcagggctgggcct

SEQ ID NO: 6234870 - DNA, 15 bp, Homo sapiens
gcagcaggggaaaga

SEQ ID NO: 6234871 - DNA, 18 bp, Homo sapiens
gcagcaggggaaagatta

SEQ ID NO: 6234872 - DNA, 15 bp, Homo sapiens
gcagcaggggctgct

SEQ ID NO: 6234873 - DNA, 21 bp, Homo sapiens
gcagcaggtgcaagagacaga

SEQ ID NO: 6234874 - DNA, 12 bp, Homo sapiens
gcagcaggtgct

SEQ ID NO: 6234875 - DNA, 18 bp, Homo sapiens
gcagcaggtgctgctacc

SEQ ID NO: 6234876 - DNA, 22 bp, Homo sapiens
gcagcaggtgctgctaccctcc

SEQ ID NO: 6234877 - DNA, 16 bp, Homo sapiens
gcagcagtaccatccc

SEQ ID NO: 6234878 - DNA, 21 bp, Homo sapiens
gcagcagtaccatcccactga

SEQ ID NO: 6234879 - DNA, 19 bp, Homo sapiens
gcagcagtcgcccaagcag

SEQ ID NO: 6234880 - DNA, 21 bp, Homo sapiens
gcagcagtgaaaacaagtgct

SEQ ID NO: 6234881 - DNA, 12 bp, Homo sapiens
gcagcagtgggg

SEQ ID NO: 6234882 - DNA, 15 bp, Homo sapiens
gcagcagtggggtga

SEQ ID NO: 6234883 - DNA, 20 bp, Homo sapiens
gcagcagtgtccagagaccc

SEQ ID NO: 6234884 - DNA, 18 bp, Homo sapiens
gcagcagttccatgaaga

SEQ ID NO: 6234885 - DNA, 13 bp, Homo sapiens
gcagcagttgagg

SEQ ID NO: 6234886 - DNA, 20 bp, Homo sapiens
gcagcagttggatcttttga

SEQ ID NO: 6234887 - DNA, 14 bp, Homo sapiens
gcagcatacaaaaa

SEQ ID NO: 6234888 - DNA, 23 bp, Homo sapiens
gcagcatacaaaaatatattaaa

SEQ ID NO: 6234889 - DNA, 17 bp, Homo sapiens
gcagcatattcaggaag

SEQ ID NO: 6234890 - DNA, 19 bp, Homo sapiens
gcagcatattcaggaagct

SEQ ID NO: 6234891 - DNA, 23 bp, Homo sapiens
gcagcatattcaggaagctcagg

SEQ ID NO: 6234892 - DNA, 14 bp, Homo sapiens
gcagcatcaaccta

SEQ ID NO: 6234893 - DNA, 18 bp, Homo sapiens
gcagcatccaccccaccc

SEQ ID NO: 6234894 - DNA, 16 bp, Homo sapiens
gcagcatcccagcctt

SEQ ID NO: 6234895 - DNA, 17 bp, Homo sapiens
gcagcatctgctccatc

SEQ ID NO: 6234896 - DNA, 21 bp, Homo sapiens
gcagcatcttcaaacatgtac

SEQ ID NO: 6234897 - DNA, 15 bp, Homo sapiens
gcagcatgaattcca

SEQ ID NO: 6234898 - DNA, 13 bp, Homo sapiens
gcagcatgagact

SEQ ID NO: 6234899 - DNA, 22 bp, Homo sapiens
gcagcatgcaaacttggatcag

SEQ ID NO: 6234900 - DNA, 22 bp, Homo sapiens
gcagcatgcccagattcccaga

SEQ ID NO: 6234901 - DNA, 22 bp, Homo sapiens
gcagcatgttgctgaggagtga

SEQ ID NO: 6234902 - DNA, 23 bp, Homo sapiens
gcagcattctggaggggagagct

SEQ ID NO: 6234903 - DNA, 13 bp, Homo sapiens
gcagcattgaagt

SEQ ID NO: 6234904 - DNA, 14 bp, Homo sapiens
gcagcattgaagta

SEQ ID NO: 6234905 - DNA, 19 bp, Homo sapiens
gcagcatttactatgcaca

SEQ ID NO: 6234906 - DNA, 11 bp, Homo sapiens
gcagcatttga

SEQ ID NO: 6234907 - DNA, 15 bp, Homo sapiens
gcagcatttgataat

SEQ ID NO: 6234908 - DNA, 18 bp, Homo sapiens
gcagcatttgataatgat

SEQ ID NO: 6234909 - DNA, 13 bp, Homo sapiens
gcagccaaagaca

SEQ ID NO: 6234910 - DNA, 16 bp, Homo sapiens
gcagccaaaggggagc

SEQ ID NO: 6234911 - DNA, 17 bp, Homo sapiens
gcagccaaaggggagcc

SEQ ID NO: 6234912 - DNA, 14 bp, Homo sapiens
gcagccaacctaag

SEQ ID NO: 6234913 - DNA, 14 bp, Homo sapiens
gcagccaagcaaat

SEQ ID NO: 6234914 - DNA, 12 bp, Homo sapiens
gcagccaaggcc

SEQ ID NO: 6234915 - DNA, 21 bp, Homo sapiens
gcagccaaggccgaagctctg

SEQ ID NO: 6234916 - DNA, 15 bp, Homo sapiens
gcagccaaggccgcc

SEQ ID NO: 6234917 - DNA, 12 bp, Homo sapiens
gcagccaaggtg

SEQ ID NO: 6234918 - DNA, 15 bp, Homo sapiens
gcagccacaccactg

SEQ ID NO: 6234919 - DNA, 19 bp, Homo sapiens
gcagccacaccgctggctc

SEQ ID NO: 6234920 - DNA, 15 bp, Homo sapiens
gcagccacacctagg

SEQ ID NO: 6234921 - DNA, 20 bp, Homo sapiens
gcagccacacttctcaggac

SEQ ID NO: 6234922 - DNA, 22 bp, Homo sapiens
gcagccacacttctcaggacac

SEQ ID NO: 6234923 - DNA, 15 bp, Homo sapiens
gcagccacaggactg

SEQ ID NO: 6234924 - DNA, 16 bp, Homo sapiens
gcagccacaggactga

SEQ ID NO: 6234925 - DNA, 23 bp, Homo sapiens
gcagccacaggactgagccctct

SEQ ID NO: 6234926 - DNA, 15 bp, Homo sapiens
gcagccacagggaag

SEQ ID NO: 6234927 - DNA, 15 bp, Homo sapiens
gcagccaccagggag

SEQ ID NO: 6234928 - DNA, 12 bp, Homo sapiens
gcagccaccagt

SEQ ID NO: 6234929 - DNA, 11 bp, Homo sapiens
gcagccaccca

SEQ ID NO: 6234930 - DNA, 22 bp, Homo sapiens
gcagccacccaagcctgctggc

SEQ ID NO: 6234931 - DNA, 15 bp, Homo sapiens
gcagccaccctgagg

SEQ ID NO: 6234932 - DNA, 17 bp, Homo sapiens
gcagccaccctgaggag

SEQ ID NO: 6234933 - DNA, 22 bp, Homo sapiens
gcagccacgaacacgcatgcct

SEQ ID NO: 6234934 - DNA, 21 bp, Homo sapiens
gcagccacgattggagaatac

SEQ ID NO: 6234935 - DNA, 20 bp, Homo sapiens
gacgtttttgtgctgtgggc

SEQ ID NO: 6234936 - DNA, 13 bp, Homo sapiens
gactaaaaatgca

SEQ ID NO: 6234937 - DNA, 21 bp, Homo sapiens
gactaaaagatataagtgctg

SEQ ID NO: 6234938 - DNA, 11 bp, Homo sapiens
gactaaaatgt

SEQ ID NO: 6234939 - DNA, 15 bp, Homo sapiens
gactaaactacatta

SEQ ID NO: 6234940 - DNA, 17 bp, Homo sapiens
gactaaactatctgtat

SEQ ID NO: 6234941 - DNA, 15 bp, Homo sapiens
gactaaagccaggaa

SEQ ID NO: 6234942 - DNA, 16 bp, Homo sapiens
gactaaagccaggaac

SEQ ID NO: 6234943 - DNA, 23 bp, Homo sapiens
gactaaagccaggaacagggacc

SEQ ID NO: 6234944 - DNA, 19 bp, Homo sapiens
gactaaaggatccagagag

SEQ ID NO: 6234945 - DNA, 20 bp, Homo sapiens
gactaaaggatccagagagc

SEQ ID NO: 6234946 - DNA, 12 bp, Homo sapiens
gactaaatgaaa

SEQ ID NO: 6234947 - DNA, 18 bp, Homo sapiens
gactaaatgatctctgaa

SEQ ID NO: 6234948 - DNA, 18 bp, Homo sapiens
gactaacaaaggcagctg

SEQ ID NO: 6234949 - DNA, 20 bp, Homo sapiens
gactaacaaaggcagctgtg

SEQ ID NO: 6234950 - DNA, 24 bp, Homo sapiens
gactaacaaaggcagctgtgtctg

SEQ ID NO: 6234951 - DNA, 13 bp, Homo sapiens
gactaacaagaat

SEQ ID NO: 6234952 - DNA, 14 bp, Homo sapiens
gactaacactcaga

SEQ ID NO: 6234953 - DNA, 21 bp, Homo sapiens
gactaacactcagaagcctgg

SEQ ID NO: 6234954 - DNA, 17 bp, Homo sapiens
gactaacctatctatga

SEQ ID NO: 6234955 - DNA, 18 bp, Homo sapiens
gactaaccttgagtcaga

SEQ ID NO: 6234956 - DNA, 20 bp, Homo sapiens
gactaacgaacgttttaaag

SEQ ID NO: 6234957 - DNA, 16 bp, Homo sapiens
gactaactatgcaata

SEQ ID NO: 6234958 - DNA, 23 bp, Homo sapiens
gactaacttgtctttggaccctg

SEQ ID NO: 6234959 - DNA, 19 bp, Homo sapiens
gactaagaattttgtttta

SEQ ID NO: 6234960 - DNA, 23 bp, Homo sapiens
gactaagagaagttgtaaagtat

SEQ ID NO: 6234961 - DNA, 20 bp, Homo sapiens
gactaagcagcccagaagcc

SEQ ID NO: 6234962 - DNA, 22 bp, Homo sapiens
gactaagccaagctgtgttcat

SEQ ID NO: 6234963 - DNA, 23 bp, Homo sapiens
gactaaggaactaaaacttgagg

SEQ ID NO: 6234964 - DNA, 18 bp, Homo sapiens
gactaagggaagaactct

SEQ ID NO: 6234965 - DNA, 21 bp, Homo sapiens
gactaaggggcagctcctgac

SEQ ID NO: 6234966 - DNA, 22 bp, Homo sapiens
gactaagtacttgctctctgag

SEQ ID NO: 6234967 - DNA, 22 bp, Homo sapiens
gactaatagaaaagtatgttct

SEQ ID NO: 6234968 - DNA, 22 bp, Homo sapiens
gactaatgaatgcaaaaagata

SEQ ID NO: 6234969 - DNA, 16 bp, Homo sapiens
gactaatgctttctgt

SEQ ID NO: 6234970 - DNA, 16 bp, Homo sapiens
gactaatggcatgaga

SEQ ID NO: 6234971 - DNA, 20 bp, Homo sapiens
gactaatggcatgagaaata

SEQ ID NO: 6234972 - DNA, 16 bp, Homo sapiens
gactaattaaaatctg

SEQ ID NO: 6234973 - DNA, 18 bp, Homo sapiens
gactaattaaaatctgga

SEQ ID NO: 6234974 - DNA, 12 bp, Homo sapiens
gactaattcttg

SEQ ID NO: 6234975 - DNA, 18 bp, Homo sapiens
gactaattcttgcatatt

SEQ ID NO: 6234976 - DNA, 19 bp, Homo sapiens
gactaattgtataacaggt

SEQ ID NO: 6234977 - DNA, 20 bp, Homo sapiens
gactaattgtataacaggtt

SEQ ID NO: 6234978 - DNA, 21 bp, Homo sapiens
gactaattgtataacaggtta

SEQ ID NO: 6234979 - DNA, 22 bp, Homo sapiens
gactaatttcaaaatgcttttt

SEQ ID NO: 6234980 - DNA, 15 bp, Homo sapiens
gactaattttacatg

SEQ ID NO: 6234981 - DNA, 22 bp, Homo sapiens
gactaattttttaaatatttga

SEQ ID NO: 6234982 - DNA, 15 bp, Homo sapiens
gactacaaaaatgaa

SEQ ID NO: 6234983 - DNA, 17 bp, Homo sapiens
gactacaaaataaaact

SEQ ID NO: 6234984 - DNA, 18 bp, Homo sapiens
gactacacccaagcctga

SEQ ID NO: 6234985 - DNA, 16 bp, Homo sapiens
gactacagccagaagc

SEQ ID NO: 6234986 - DNA, 19 bp, Homo sapiens
gactacagctggggtgcag

SEQ ID NO: 6234987 - DNA, 14 bp, Homo sapiens
gactacaggcgtga

SEQ ID NO: 6234988 - DNA, 21 bp, Homo sapiens
gactacaggtgtgagtcacca

SEQ ID NO: 6234989 - DNA, 18 bp, Homo sapiens
gactacagtcaggaaagg

SEQ ID NO: 6234990 - DNA, 17 bp, Homo sapiens
gactacattttgctctg

SEQ ID NO: 6234991 - DNA, 20 bp, Homo sapiens
gactaccagctaactccagt

SEQ ID NO: 6234992 - DNA, 15 bp, Homo sapiens
gactaccccagtccc

SEQ ID NO: 6234993 - DNA, 14 bp, Homo sapiens
gactaccgcaggcc

SEQ ID NO: 6234994 - DNA, 16 bp, Homo sapiens
gactaccgcaggcccg

SEQ ID NO: 6234995 - DNA, 19 bp, Homo sapiens
gactaccgcaggcccggac

SEQ ID NO: 6234996 - DNA, 15 bp, Homo sapiens
gactaccgtgccagc

SEQ ID NO: 6234997 - DNA, 16 bp, Homo sapiens
gactaccgtgccagca

SEQ ID NO: 6234998 - DNA, 19 bp, Homo sapiens
gactaccgtgccagcagcg

SEQ ID NO: 6234999 - DNA, 15 bp, Homo sapiens
gactacctcagaaca

SEQ ID NO: 6235000 - DNA, 15 bp, Homo sapiens
gactactaaggcctt

SEQ ID NO: 6235001 - DNA, 15 bp, Homo sapiens
gactactactctgcc

SEQ ID NO: 6235002 - DNA, 23 bp, Homo sapiens
gactactgggcaaagagtgtaga

SEQ ID NO: 6235003 - DNA, 13 bp, Homo sapiens
gactacttagcat

SEQ ID NO: 6235004 - DNA, 14 bp, Homo sapiens
gactagaaaatctg

SEQ ID NO: 6235005 - DNA, 15 bp, Homo sapiens
gactagaacctggag

SEQ ID NO: 6235006 - DNA, 23 bp, Homo sapiens
gactagaactcctgtcttctttc

SEQ ID NO: 6235007 - DNA, 12 bp, Homo sapiens
gactagaattct

SEQ ID NO: 6235008 - DNA, 14 bp, Homo sapiens
gactagacaaataa

SEQ ID NO: 6235009 - DNA, 16 bp, Homo sapiens
gactagacgttcattt

SEQ ID NO: 6235010 - DNA, 18 bp, Homo sapiens
gactagactactcaatat

SEQ ID NO: 6235011 - DNA, 14 bp, Homo sapiens
gactagaggccagg

SEQ ID NO: 6235012 - DNA, 20 bp, Homo sapiens
gactagagggacctctccca

SEQ ID NO: 6235013 - DNA, 23 bp, Homo sapiens
gactagagggacctctcccaggg

SEQ ID NO: 6235014 - DNA, 19 bp, Homo sapiens
gactagatactactttctc

SEQ ID NO: 6235015 - DNA, 21 bp, Homo sapiens
gactagatgatggatgccaat

SEQ ID NO: 6235016 - DNA, 14 bp, Homo sapiens
gactagatttcaag

SEQ ID NO: 6235017 - DNA, 11 bp, Homo sapiens
gactagcagct

SEQ ID NO: 6235018 - DNA, 17 bp, Homo sapiens
gactagccactcctgcc

SEQ ID NO: 6235019 - DNA, 22 bp, Homo sapiens
gactagccagccaggaagatga

SEQ ID NO: 6235020 - DNA, 12 bp, Homo sapiens
gactaggagacc

SEQ ID NO: 6235021 - DNA, 15 bp, Homo sapiens
gactaggaggttccg

SEQ ID NO: 6235022 - DNA, 22 bp, Homo sapiens
gactaggatattgaatgtgaaa

SEQ ID NO: 6235023 - DNA, 15 bp, Homo sapiens
gactaggcatgtcag

SEQ ID NO: 6235024 - DNA, 23 bp, Homo sapiens
gactaggccttgcggctcctcag

SEQ ID NO: 6235025 - DNA, 18 bp, Homo sapiens
gactagggtcctcaggca

SEQ ID NO: 6235026 - DNA, 16 bp, Homo sapiens
gactagggtcctgggg

SEQ ID NO: 6235027 - DNA, 17 bp, Homo sapiens
gactaggtcaatttttt

SEQ ID NO: 6235028 - DNA, 14 bp, Homo sapiens
gactagtacaaatt

SEQ ID NO: 6235029 - DNA, 17 bp, Homo sapiens
gactagtacaaattata

SEQ ID NO: 6235030 - DNA, 13 bp, Homo sapiens
gactagtatcaag

SEQ ID NO: 6235031 - DNA, 15 bp, Homo sapiens
gactagtcacctggg

SEQ ID NO: 6235032 - DNA, 19 bp, Homo sapiens
gactagtgccgtagggagt

SEQ ID NO: 6235033 - DNA, 12 bp, Homo sapiens
gactagtgctga

SEQ ID NO: 6235034 - DNA, 18 bp, Homo sapiens
gactagtgctgaagctta

SEQ ID NO: 6235035 - DNA, 16 bp, Homo sapiens
gactataaaaactgcc

SEQ ID NO: 6235036 - DNA, 15 bp, Homo sapiens
gactataaacattaa

SEQ ID NO: 6235037 - DNA, 16 bp, Homo sapiens
gactataaacattaaa

SEQ ID NO: 6235038 - DNA, 19 bp, Homo sapiens
gactataccaactgggcct

SEQ ID NO: 6235039 - DNA, 16 bp, Homo sapiens
gactatagcagggctg

SEQ ID NO: 6235040 - DNA, 16 bp, Homo sapiens
gactatatagagatgt

SEQ ID NO: 6235041 - DNA, 20 bp, Homo sapiens
gactatatagagatgttttt

SEQ ID NO: 6235042 - DNA, 23 bp, Homo sapiens
gactatatagagatgtttttaaa

SEQ ID NO: 6235043 - DNA, 23 bp, Homo sapiens
gactatattttcccttattactg

SEQ ID NO: 6235044 - DNA, 23 bp, Homo sapiens
gactatcacacactttctcttca

SEQ ID NO: 6235045 - DNA, 14 bp, Homo sapiens
gactatcacataca

SEQ ID NO: 6235046 - DNA, 16 bp, Homo sapiens
gactatcacatacaat

SEQ ID NO: 6235047 - DNA, 18 bp, Homo sapiens
gactatcacatacaattt

SEQ ID NO: 6235048 - DNA, 13 bp, Homo sapiens
gactatcagccca

SEQ ID NO: 6235049 - DNA, 13 bp, Homo sapiens
gactatcaggtaa

SEQ ID NO: 6235050 - DNA, 16 bp, Homo sapiens
gactatctacaaaaat

SEQ ID NO: 6235051 - DNA, 13 bp, Homo sapiens
gactatctcccct

SEQ ID NO: 6235052 - DNA, 15 bp, Homo sapiens
gactatctcccctgt

SEQ ID NO: 6235053 - DNA, 15 bp, Homo sapiens
gactatgaaaagcta

SEQ ID NO: 6235054 - DNA, 16 bp, Homo sapiens
gactatgaatgggcaa

SEQ ID NO: 6235055 - DNA, 21 bp, Homo sapiens
gactatgaatgggcaaaactg

SEQ ID NO: 6235056 - DNA, 22 bp, Homo sapiens
gactatgcagaggcctggggga

SEQ ID NO: 6235057 - DNA, 22 bp, Homo sapiens
gactatgcagcttggagacagg

SEQ ID NO: 6235058 - DNA, 18 bp, Homo sapiens
gactatgccgtcttctgc

SEQ ID NO: 6235059 - DNA, 19 bp, Homo sapiens
gactatgccgtcttctgcc

SEQ ID NO: 6235060 - DNA, 15 bp, Homo sapiens
gactatggaatgtca

SEQ ID NO: 6235061 - DNA, 12 bp, Homo sapiens
gactatggagcc

SEQ ID NO: 6235062 - DNA, 20 bp, Homo sapiens
gactatggagcctggcacag

SEQ ID NO: 6235063 - DNA, 19 bp, Homo sapiens
gactatgtgtcatgatttc

SEQ ID NO: 6235064 - DNA, 13 bp, Homo sapiens
gactattacatat

SEQ ID NO: 6235065 - DNA, 15 bp, Homo sapiens
gactattatgttgtt

SEQ ID NO: 6235066 - DNA, 21 bp, Homo sapiens
gactattatgttgttagagaa

SEQ ID NO: 6235067 - DNA, 22 bp, Homo sapiens
gactattcatcaagaatgagga

SEQ ID NO: 6235068 - DNA, 19 bp, Homo sapiens
gactattccttttctgtat

SEQ ID NO: 6235069 - DNA, 17 bp, Homo sapiens
gactattgtgccaactg

SEQ ID NO: 6235070 - DNA, 21 bp, Homo sapiens
gactatttaaacttataaatc

SEQ ID NO: 6235071 - DNA, 23 bp, Homo sapiens
gactatttaaacttataaatcat

SEQ ID NO: 6235072 - DNA, 13 bp, Homo sapiens
gactatttaagta

SEQ ID NO: 6235073 - DNA, 16 bp, Homo sapiens
gactatttaagtacta

SEQ ID NO: 6235074 - DNA, 12 bp, Homo sapiens
gactatttacca

SEQ ID NO: 6235075 - DNA, 18 bp, Homo sapiens
gactatttataactaata

SEQ ID NO: 6235076 - DNA, 19 bp, Homo sapiens
gactatttcaaaatgtcca

SEQ ID NO: 6235077 - DNA, 23 bp, Homo sapiens
gactatttcaccatgttgccaat

SEQ ID NO: 6235078 - DNA, 19 bp, Homo sapiens
gactatttgacccccacaa

SEQ ID NO: 6235079 - DNA, 14 bp, Homo sapiens
gactatttgctaat

SEQ ID NO: 6235080 - DNA, 13 bp, Homo sapiens
gactatttttgtt

SEQ ID NO: 6235081 - DNA, 19 bp, Homo sapiens
gactattttttaataaaag

SEQ ID NO: 6235082 - DNA, 13 bp, Homo sapiens
gactcaaaacact

SEQ ID NO: 6235083 - DNA, 18 bp, Homo sapiens
gactcaaaacctggagat

SEQ ID NO: 6235084 - DNA, 14 bp, Homo sapiens
gactcaaaccaaat

SEQ ID NO: 6235085 - DNA, 12 bp, Homo sapiens
gactcaaagatg

SEQ ID NO: 6235086 - DNA, 22 bp, Homo sapiens
gactcaaatgctcagaccagct

SEQ ID NO: 6235087 - DNA, 23 bp, Homo sapiens
gactcaaatgttctaagtttcta

SEQ ID NO: 6235088 - DNA, 18 bp, Homo sapiens
gactcaagaagtgaagaa

SEQ ID NO: 6235089 - DNA, 19 bp, Homo sapiens
gactcaagaagtgaagaat

SEQ ID NO: 6235090 - DNA, 22 bp, Homo sapiens
gactcaagagacaccccttcct

SEQ ID NO: 6235091 - DNA, 23 bp, Homo sapiens
gactcaagaggaatctgtttctc

SEQ ID NO: 6235092 - DNA, 18 bp, Homo sapiens
gactcaagattcccagga

SEQ ID NO: 6235093 - DNA, 19 bp, Homo sapiens
gactcaagattcccaggag

SEQ ID NO: 6235094 - DNA, 22 bp, Homo sapiens
gactcaagattcccaggagttc

SEQ ID NO: 6235095 - DNA, 19 bp, Homo sapiens
gactcaaggaagaataatt

SEQ ID NO: 6235096 - DNA, 19 bp, Homo sapiens
gactcaagtacccattctg

SEQ ID NO: 6235097 - DNA, 18 bp, Homo sapiens
gactcaagtttttacaaa

SEQ ID NO: 6235098 - DNA, 20 bp, Homo sapiens
gactcaagtttttacaaaat

SEQ ID NO: 6235099 - DNA, 15 bp, Homo sapiens
gactcaataaaagaa

SEQ ID NO: 6235100 - DNA, 15 bp, Homo sapiens
gactcaataaaatca

SEQ ID NO: 6235101 - DNA, 17 bp, Homo sapiens
gactcaataaaatcatg

SEQ ID NO: 6235102 - DNA, 20 bp, Homo sapiens
gactcaatgtccccctcacc

SEQ ID NO: 6235103 - DNA, 17 bp, Homo sapiens
gactcaatttctcccca

SEQ ID NO: 6235104 - DNA, 16 bp, Homo sapiens
gactcacacttgtaat

SEQ ID NO: 6235105 - DNA, 23 bp, Homo sapiens
gactcaccctcataccatctgct

SEQ ID NO: 6235106 - DNA, 15 bp, Homo sapiens
gactcacctccccca

SEQ ID NO: 6235107 - DNA, 14 bp, Homo sapiens
gactcacctctgcc

SEQ ID NO: 6235108 - DNA, 15 bp, Homo sapiens
gactcacctctgcct

SEQ ID NO: 6235109 - DNA, 18 bp, Homo sapiens
gactcacctctgcctcaa

SEQ ID NO: 6235110 - DNA, 16 bp, Homo sapiens
gactcacctgaaagtt

SEQ ID NO: 6235111 - DNA, 14 bp, Homo sapiens
gactcacctgcgca

SEQ ID NO: 6235112 - DNA, 21 bp, Homo sapiens
gactcacggctgcacctgcag

SEQ ID NO: 6235113 - DNA, 14 bp, Homo sapiens
gcagccactattgt

SEQ ID NO: 6235114 - DNA, 22 bp, Homo sapiens
gcagccagacccagagccctct

SEQ ID NO: 6235115 - DNA, 11 bp, Homo sapiens
gcagccagagc

SEQ ID NO: 6235116 - DNA, 12 bp, Homo sapiens
gcagccagagct

SEQ ID NO: 6235117 - DNA, 16 bp, Homo sapiens
gcagccagagctgtgc

SEQ ID NO: 6235118 - DNA, 21 bp, Homo sapiens
gcagccagccaaacacacaga

SEQ ID NO: 6235119 - DNA, 15 bp, Homo sapiens
gcagccagccagtct

SEQ ID NO: 6235120 - DNA, 20 bp, Homo sapiens
gcagccagccagtcttgcct

SEQ ID NO: 6235121 - DNA, 23 bp, Homo sapiens
gcagccagccagtcttgcctagg

SEQ ID NO: 6235122 - DNA, 15 bp, Homo sapiens
gcagccagccctgcc

SEQ ID NO: 6235123 - DNA, 16 bp, Homo sapiens
gcagccagccctgcct

SEQ ID NO: 6235124 - DNA, 18 bp, Homo sapiens
gcagccagccctgcctgg

SEQ ID NO: 6235125 - DNA, 20 bp, Homo sapiens
gcagccagccctgcctggag

SEQ ID NO: 6235126 - DNA, 19 bp, Homo sapiens
gcagccagccggtgcctgg

SEQ ID NO: 6235127 - DNA, 23 bp, Homo sapiens
gcagccagccgtgagtgcagacc

SEQ ID NO: 6235128 - DNA, 20 bp, Homo sapiens
gcagccagctacaggcttga

SEQ ID NO: 6235129 - DNA, 15 bp, Homo sapiens
gcagccagctcctgg

SEQ ID NO: 6235130 - DNA, 15 bp, Homo sapiens
gcagccagctctcag

SEQ ID NO: 6235131 - DNA, 16 bp, Homo sapiens
gcagccagctctcagc

SEQ ID NO: 6235132 - DNA, 12 bp, Homo sapiens
gcagccaggaca

SEQ ID NO: 6235133 - DNA, 13 bp, Homo sapiens
gcagccaggacac

SEQ ID NO: 6235134 - DNA, 13 bp, Homo sapiens
gcagccaggaccc

SEQ ID NO: 6235135 - DNA, 12 bp, Homo sapiens
gcagccaggaga

SEQ ID NO: 6235136 - DNA, 21 bp, Homo sapiens
gcagccaggagagcttagggt

SEQ ID NO: 6235137 - DNA, 17 bp, Homo sapiens
gcagccaggaggagagg

SEQ ID NO: 6235138 - DNA, 13 bp, Homo sapiens
gcagccaggaggg

SEQ ID NO: 6235139 - DNA, 17 bp, Homo sapiens
gcagccaggagggacct

SEQ ID NO: 6235140 - DNA, 13 bp, Homo sapiens
gcagccaggcctc

SEQ ID NO: 6235141 - DNA, 20 bp, Homo sapiens
gcagccaggcctcgcctgcc

SEQ ID NO: 6235142 - DNA, 21 bp, Homo sapiens
gcagccaggcctcgcctgccc

SEQ ID NO: 6235143 - DNA, 22 bp, Homo sapiens
gcagccaggcctcgcctgccct

SEQ ID NO: 6235144 - DNA, 12 bp, Homo sapiens
gcagccaggctg

SEQ ID NO: 6235145 - DNA, 13 bp, Homo sapiens
gcagccaggctgc

SEQ ID NO: 6235146 - DNA, 15 bp, Homo sapiens
gcagccaggctgggc

SEQ ID NO: 6235147 - DNA, 17 bp, Homo sapiens
gcagccaggctgggccg

SEQ ID NO: 6235148 - DNA, 14 bp, Homo sapiens
gcagccagggaccc

SEQ ID NO: 6235149 - DNA, 15 bp, Homo sapiens
gcagccagggagagc

SEQ ID NO: 6235150 - DNA, 16 bp, Homo sapiens
gcagccagggagagcc

SEQ ID NO: 6235151 - DNA, 17 bp, Homo sapiens
gcagccagggagagccc

SEQ ID NO: 6235152 - DNA, 15 bp, Homo sapiens
gcagccagggctggg

SEQ ID NO: 6235153 - DNA, 21 bp, Homo sapiens
gcagccaggggctgctcatca

SEQ ID NO: 6235154 - DNA, 13 bp, Homo sapiens
gcagccagtctca

SEQ ID NO: 6235155 - DNA, 17 bp, Homo sapiens
gcagccagtctcagaga

SEQ ID NO: 6235156 - DNA, 20 bp, Homo sapiens
gcagccagtctcagagacca

SEQ ID NO: 6235157 - DNA, 21 bp, Homo sapiens
gcagccagtctcagagaccag

SEQ ID NO: 6235158 - DNA, 22 bp, Homo sapiens
gcagccagtctcagagaccagc

SEQ ID NO: 6235159 - DNA, 23 bp, Homo sapiens
gcagccagtctcagagaccagca

SEQ ID NO: 6235160 - DNA, 18 bp, Homo sapiens
gcagccagtgccctgagc

SEQ ID NO: 6235161 - DNA, 19 bp, Homo sapiens
gcagccagtgccctgagcc

SEQ ID NO: 6235162 - DNA, 13 bp, Homo sapiens
gcagccagttcaa

SEQ ID NO: 6235163 - DNA, 13 bp, Homo sapiens
gcagccatatatg

SEQ ID NO: 6235164 - DNA, 12 bp, Homo sapiens
gcagccatccca

SEQ ID NO: 6235165 - DNA, 19 bp, Homo sapiens
gcagccatcccgcttagcc

SEQ ID NO: 6235166 - DNA, 23 bp, Homo sapiens
gcagccatcccgcttagcctgcc

SEQ ID NO: 6235167 - DNA, 17 bp, Homo sapiens
gcagccatgcctcatgc

SEQ ID NO: 6235168 - DNA, 21 bp, Homo sapiens
gcagccattggcctctgtctc

SEQ ID NO: 6235169 - DNA, 19 bp, Homo sapiens
gcagcccaaaacccagggc

SEQ ID NO: 6235170 - DNA, 12 bp, Homo sapiens
gcagcccaaagg

SEQ ID NO: 6235171 - DNA, 17 bp, Homo sapiens
gcagcccaacagcactt

SEQ ID NO: 6235172 - DNA, 13 bp, Homo sapiens
gcagcccaaggac

SEQ ID NO: 6235173 - DNA, 14 bp, Homo sapiens
gcagcccaaggaca

SEQ ID NO: 6235174 - DNA, 15 bp, Homo sapiens
gcagcccaaggacag

SEQ ID NO: 6235175 - DNA, 20 bp, Homo sapiens
gcagcccaaggacagttcag

SEQ ID NO: 6235176 - DNA, 23 bp, Homo sapiens
gcagcccaaggacagttcagaga

SEQ ID NO: 6235177 - DNA, 13 bp, Homo sapiens
gcagcccacagag

SEQ ID NO: 6235178 - DNA, 16 bp, Homo sapiens
gcagcccacagaggac

SEQ ID NO: 6235179 - DNA, 18 bp, Homo sapiens
gcagcccaccagacgtca

SEQ ID NO: 6235180 - DNA, 15 bp, Homo sapiens
gcagcccaccaggag

SEQ ID NO: 6235181 - DNA, 17 bp, Homo sapiens
gcagcccaccaggagca

SEQ ID NO: 6235182 - DNA, 16 bp, Homo sapiens
gcagcccacccagcag

SEQ ID NO: 6235183 - DNA, 13 bp, Homo sapiens
gcagcccacctgc

SEQ ID NO: 6235184 - DNA, 15 bp, Homo sapiens
gcagcccacctgctg

SEQ ID NO: 6235185 - DNA, 16 bp, Homo sapiens
gcagcccacctgctgc

SEQ ID NO: 6235186 - DNA, 20 bp, Homo sapiens
gcagcccacctgctgcccgt

SEQ ID NO: 6235187 - DNA, 13 bp, Homo sapiens
gcagcccactgca

SEQ ID NO: 6235188 - DNA, 15 bp, Homo sapiens
gcagcccagagagac

SEQ ID NO: 6235189 - DNA, 22 bp, Homo sapiens
gcagcccagagagaccctgcca

SEQ ID NO: 6235190 - DNA, 18 bp, Homo sapiens
gcagcccagcagtgtgga

SEQ ID NO: 6235191 - DNA, 14 bp, Homo sapiens
gcagcccagcctct

SEQ ID NO: 6235192 - DNA, 19 bp, Homo sapiens
gcagcccagcttcctggtg

SEQ ID NO: 6235193 - DNA, 13 bp, Homo sapiens
gcagcccaggcca

SEQ ID NO: 6235194 - DNA, 20 bp, Homo sapiens
gcagcccagggcacttcaga

SEQ ID NO: 6235195 - DNA, 13 bp, Homo sapiens
gcagcccatgccc

SEQ ID NO: 6235196 - DNA, 18 bp, Homo sapiens
gcagcccatgcccacctg

SEQ ID NO: 6235197 - DNA, 22 bp, Homo sapiens
gcagcccatgcccacctgccca

SEQ ID NO: 6235198 - DNA, 22 bp, Homo sapiens
gcagcccatggcctctggccag

SEQ ID NO: 6235199 - DNA, 13 bp, Homo sapiens
gcagcccattccc

SEQ ID NO: 6235200 - DNA, 18 bp, Homo sapiens
gcagcccatttctccaga

SEQ ID NO: 6235201 - DNA, 21 bp, Homo sapiens
gcagcccatttctccagaacc

SEQ ID NO: 6235202 - DNA, 22 bp, Homo sapiens
gcagcccatttctccagaaccc

SEQ ID NO: 6235203 - DNA, 22 bp, Homo sapiens
gcagccccacaccagggccagc

SEQ ID NO: 6235204 - DNA, 19 bp, Homo sapiens
gcagccccacttcaccccc

SEQ ID NO: 6235205 - DNA, 16 bp, Homo sapiens
gcagccccagaagaaa

SEQ ID NO: 6235206 - DNA, 13 bp, Homo sapiens
gcagccccagaga

SEQ ID NO: 6235207 - DNA, 20 bp, Homo sapiens
gcagccccagggcctgcgga

SEQ ID NO: 6235208 - DNA, 17 bp, Homo sapiens
gcagccccatctgtgca

SEQ ID NO: 6235209 - DNA, 18 bp, Homo sapiens
gcagccccattctgcctg

SEQ ID NO: 6235210 - DNA, 21 bp, Homo sapiens
gcagccccattctgcctgccc

SEQ ID NO: 6235211 - DNA, 13 bp, Homo sapiens
gcagcccccaaag

SEQ ID NO: 6235212 - DNA, 14 bp, Homo sapiens
gcagcccccaaaga

SEQ ID NO: 6235213 - DNA, 23 bp, Homo sapiens
gcagcccccaaagagctgtggct

SEQ ID NO: 6235214 - DNA, 19 bp, Homo sapiens
gcagcccccacccccaagg

SEQ ID NO: 6235215 - DNA, 15 bp, Homo sapiens
gcagcccccactgac

SEQ ID NO: 6235216 - DNA, 16 bp, Homo sapiens
gcagcccccactgacc

SEQ ID NO: 6235217 - DNA, 22 bp, Homo sapiens
gcagcccccactgacctgccca

SEQ ID NO: 6235218 - DNA, 16 bp, Homo sapiens
gcagccccccagcact

SEQ ID NO: 6235219 - DNA, 14 bp, Homo sapiens
gcagccccccttgc

SEQ ID NO: 6235220 - DNA, 16 bp, Homo sapiens
gcagcccccgcgccct

SEQ ID NO: 6235221 - DNA, 18 bp, Homo sapiens
gcagcccccgcgccctcc

SEQ ID NO: 6235222 - DNA, 21 bp, Homo sapiens
gcagcccccgcgccctccctc

SEQ ID NO: 6235223 - DNA, 15 bp, Homo sapiens
gcagccccctcctga

SEQ ID NO: 6235224 - DNA, 17 bp, Homo sapiens
gcagccccctcctgacc

SEQ ID NO: 6235225 - DNA, 15 bp, Homo sapiens
gcagccccctgcttc

SEQ ID NO: 6235226 - DNA, 15 bp, Homo sapiens
gcagccccctgtggc

SEQ ID NO: 6235227 - DNA, 20 bp, Homo sapiens
gcagccccgcgaccacccct

SEQ ID NO: 6235228 - DNA, 23 bp, Homo sapiens
gcagccccgcgaccacccctgtg

SEQ ID NO: 6235229 - DNA, 17 bp, Homo sapiens
gcagccccgtctgccca

SEQ ID NO: 6235230 - DNA, 18 bp, Homo sapiens
gcagccccgttttgggga

SEQ ID NO: 6235231 - DNA, 19 bp, Homo sapiens
gcagcccctcgaggcctac

SEQ ID NO: 6235232 - DNA, 18 bp, Homo sapiens
gcagcccctgagagcctg

SEQ ID NO: 6235233 - DNA, 15 bp, Homo sapiens
gcagcccctgctgga

SEQ ID NO: 6235234 - DNA, 20 bp, Homo sapiens
gcagcccctgttctggcaga

SEQ ID NO: 6235235 - DNA, 19 bp, Homo sapiens
gcagccccttctggccggt

SEQ ID NO: 6235236 - DNA, 22 bp, Homo sapiens
gcagccccttctggccggtgct

SEQ ID NO: 6235237 - DNA, 17 bp, Homo sapiens
gcagcccgaagcccagt

SEQ ID NO: 6235238 - DNA, 18 bp, Homo sapiens
gcagcccgaagcccagtt

SEQ ID NO: 6235239 - DNA, 21 bp, Homo sapiens
gcagcccgaagcccagtttcc

SEQ ID NO: 6235240 - DNA, 17 bp, Homo sapiens
gcagcccgatgtccctg

SEQ ID NO: 6235241 - DNA, 23 bp, Homo sapiens
gcagcccgatgtccctgtcccct

SEQ ID NO: 6235242 - DNA, 19 bp, Homo sapiens
gcagcccgcatcagctgct

SEQ ID NO: 6235243 - DNA, 23 bp, Homo sapiens
gcagcccgcctgccgtgcatggc

SEQ ID NO: 6235244 - DNA, 22 bp, Homo sapiens
gcagcccgccttggctttctcc

SEQ ID NO: 6235245 - DNA, 18 bp, Homo sapiens
gcagcccgctaggctcgc

SEQ ID NO: 6235246 - DNA, 22 bp, Homo sapiens
gcagcccgtcctctctcttggg

SEQ ID NO: 6235247 - DNA, 15 bp, Homo sapiens
gcagcccgtgaagca

SEQ ID NO: 6235248 - DNA, 20 bp, Homo sapiens
gcagcccgtgaagcagtgcc

SEQ ID NO: 6235249 - DNA, 15 bp, Homo sapiens
gcagcccgtgtggcc

SEQ ID NO: 6235250 - DNA, 17 bp, Homo sapiens
gcagcccgtgtggcccc

SEQ ID NO: 6235251 - DNA, 22 bp, Homo sapiens
gcagccctaaggatctctcagg

SEQ ID NO: 6235252 - DNA, 24 bp, Homo sapiens
gcagccctaaggatctctcaggag

SEQ ID NO: 6235253 - DNA, 17 bp, Homo sapiens
gcagccctagagcctgc

SEQ ID NO: 6235254 - DNA, 19 bp, Homo sapiens
gcagccctagagcctgcct

SEQ ID NO: 6235255 - DNA, 14 bp, Homo sapiens
gcagccctagtggg

SEQ ID NO: 6235256 - DNA, 20 bp, Homo sapiens
gcagccctagtgggagccca

SEQ ID NO: 6235257 - DNA, 21 bp, Homo sapiens
gcagccctagtgggagcccag

SEQ ID NO: 6235258 - DNA, 13 bp, Homo sapiens
gcagccctcacct

SEQ ID NO: 6235259 - DNA, 23 bp, Homo sapiens
gcagccctcacctctgaggacag

SEQ ID NO: 6235260 - DNA, 22 bp, Homo sapiens
gcagccctccacttctggtata

SEQ ID NO: 6235261 - DNA, 22 bp, Homo sapiens
gcagccctccatggtcctgtct

SEQ ID NO: 6235262 - DNA, 23 bp, Homo sapiens
gcagccctccatggtcctgtctg

SEQ ID NO: 6235263 - DNA, 18 bp, Homo sapiens
gcagccctcctcaccccg

SEQ ID NO: 6235264 - DNA, 10 bp, Homo sapiens
gcagccctct

SEQ ID NO: 6235265 - DNA, 13 bp, Homo sapiens
gcagccctctcca

SEQ ID NO: 6235266 - DNA, 16 bp, Homo sapiens
gcagccctctccaccc

SEQ ID NO: 6235267 - DNA, 18 bp, Homo sapiens
gcagccctctccacccag

SEQ ID NO: 6235268 - DNA, 20 bp, Homo sapiens
gcagccctctccacccagag

SEQ ID NO: 6235269 - DNA, 12 bp, Homo sapiens
gcagccctctgc

SEQ ID NO: 6235270 - DNA, 13 bp, Homo sapiens
gcagccctctgcc

SEQ ID NO: 6235271 - DNA, 13 bp, Homo sapiens
gcagccctgcaga

SEQ ID NO: 6235272 - DNA, 15 bp, Homo sapiens
gcagccctgcagagg

SEQ ID NO: 6235273 - DNA, 13 bp, Homo sapiens
gcagccctgccag

SEQ ID NO: 6235274 - DNA, 14 bp, Homo sapiens
gcagccctgctttg

SEQ ID NO: 6235275 - DNA, 16 bp, Homo sapiens
gcagccctggagtcat

SEQ ID NO: 6235276 - DNA, 18 bp, Homo sapiens
gcagccctggagtcatgc

SEQ ID NO: 6235277 - DNA, 20 bp, Homo sapiens
gcagccctggatggtggcca

SEQ ID NO: 6235278 - DNA, 21 bp, Homo sapiens
gcagccctggcctgtggagag

SEQ ID NO: 6235279 - DNA, 17 bp, Homo sapiens
gcagccctgggggccag

SEQ ID NO: 6235280 - DNA, 19 bp, Homo sapiens
gcagccctgggggccagct

SEQ ID NO: 6235281 - DNA, 21 bp, Homo sapiens
gcagcccttcctcctgaagcc

SEQ ID NO: 6235282 - DNA, 15 bp, Homo sapiens
gcagcccttgggcag

SEQ ID NO: 6235283 - DNA, 21 bp, Homo sapiens
gcagcccttgtgtgtgccctg

SEQ ID NO: 6235284 - DNA, 13 bp, Homo sapiens
gcagccctttggg

SEQ ID NO: 6235285 - DNA, 15 bp, Homo sapiens
gcagccgagccccag

SEQ ID NO: 6235286 - DNA, 17 bp, Homo sapiens
gcagccgagccccagga

SEQ ID NO: 6235287 - DNA, 18 bp, Homo sapiens
gcagccgaggcctggcca

SEQ ID NO: 6235288 - DNA, 21 bp, Homo sapiens
gcagccgaggcctggccaatg

SEQ ID NO: 6235289 - DNA, 19 bp, Homo sapiens
gcagccgaggtccctgctg

SEQ ID NO: 6235290 - DNA, 22 bp, Homo sapiens
gcagccgaggtccctgctgcca

SEQ ID NO: 6235291 - DNA, 21 bp, Homo sapiens
gactcactggcagccccagca

SEQ ID NO: 6235292 - DNA, 23 bp, Homo sapiens
gactcactggcagccccagcacc

SEQ ID NO: 6235293 - DNA, 23 bp, Homo sapiens
gactcacttacatcttctgtgaa

SEQ ID NO: 6235294 - DNA, 20 bp, Homo sapiens
gactcacttgatgtttcctg

SEQ ID NO: 6235295 - DNA, 17 bp, Homo sapiens
gactcagaaagccaaca

SEQ ID NO: 6235296 - DNA, 13 bp, Homo sapiens
gactcagaagcct

SEQ ID NO: 6235297 - DNA, 11 bp, Homo sapiens
gactcagagaa

SEQ ID NO: 6235298 - DNA, 19 bp, Homo sapiens
gactcagaggacccacctg

SEQ ID NO: 6235299 - DNA, 23 bp, Homo sapiens
gactcagagggaaggctctctgg

SEQ ID NO: 6235300 - DNA, 18 bp, Homo sapiens
gactcagatgaggacaga

SEQ ID NO: 6235301 - DNA, 23 bp, Homo sapiens
gactcagcactgttttcatcaca

SEQ ID NO: 6235302 - DNA, 15 bp, Homo sapiens
gactcagcagagtga

SEQ ID NO: 6235303 - DNA, 14 bp, Homo sapiens
gactcagcagtgac

SEQ ID NO: 6235304 - DNA, 11 bp, Homo sapiens
gactcagccca

SEQ ID NO: 6235305 - DNA, 13 bp, Homo sapiens
gactcagcctctg

SEQ ID NO: 6235306 - DNA, 16 bp, Homo sapiens
gactcagcctctgctg

SEQ ID NO: 6235307 - DNA, 18 bp, Homo sapiens
gactcagcctctgctgga

SEQ ID NO: 6235308 - DNA, 15 bp, Homo sapiens
gactcagccttcaga

SEQ ID NO: 6235309 - DNA, 20 bp, Homo sapiens
gactcagccttcagacagag

SEQ ID NO: 6235310 - DNA, 19 bp, Homo sapiens
gactcagccttcctcctca

SEQ ID NO: 6235311 - DNA, 15 bp, Homo sapiens
gactcagcgctcctc

SEQ ID NO: 6235312 - DNA, 19 bp, Homo sapiens
gactcagcgctcctcctgt

SEQ ID NO: 6235313 - DNA, 23 bp, Homo sapiens
gactcagcgctcctcctgtgtga

SEQ ID NO: 6235314 - DNA, 22 bp, Homo sapiens
gactcagctctgacattctgat

SEQ ID NO: 6235315 - DNA, 15 bp, Homo sapiens
gactcaggatccagt

SEQ ID NO: 6235316 - DNA, 17 bp, Homo sapiens
gactcaggatccagtcc

SEQ ID NO: 6235317 - DNA, 22 bp, Homo sapiens
gactcaggatccagtgacatga

SEQ ID NO: 6235318 - DNA, 16 bp, Homo sapiens
gactcaggatgcccag

SEQ ID NO: 6235319 - DNA, 23 bp, Homo sapiens
gactcaggatttaaaaactggaa

SEQ ID NO: 6235320 - DNA, 22 bp, Homo sapiens
gactcaggcccccacctggctc

SEQ ID NO: 6235321 - DNA, 20 bp, Homo sapiens
gactcaggcctgccaatgcc

SEQ ID NO: 6235322 - DNA, 18 bp, Homo sapiens
gactcagggaccggtgct

SEQ ID NO: 6235323 - DNA, 22 bp, Homo sapiens
gactcagggaccggtgctgcag

SEQ ID NO: 6235324 - DNA, 23 bp, Homo sapiens
gactcagggaccggtgctgcagg

SEQ ID NO: 6235325 - DNA, 19 bp, Homo sapiens
gactcagggacctaagcca

SEQ ID NO: 6235326 - DNA, 12 bp, Homo sapiens
gactcagggcag

SEQ ID NO: 6235327 - DNA, 20 bp, Homo sapiens
gactcagggccatgcctgcc

SEQ ID NO: 6235328 - DNA, 20 bp, Homo sapiens
gactcagggccccagcacta

SEQ ID NO: 6235329 - DNA, 22 bp, Homo sapiens
gactcaggtctgtaactgccca

SEQ ID NO: 6235330 - DNA, 23 bp, Homo sapiens
gactcaggtctgtaactgcccag

SEQ ID NO: 6235331 - DNA, 20 bp, Homo sapiens
gactcaggtgggccctctga

SEQ ID NO: 6235332 - DNA, 23 bp, Homo sapiens
gactcaggtggtgtccttcttcc

SEQ ID NO: 6235333 - DNA, 21 bp, Homo sapiens
gactcaggttgtagtaaagaa

SEQ ID NO: 6235334 - DNA, 15 bp, Homo sapiens
gactcaggttgtctg

SEQ ID NO: 6235335 - DNA, 16 bp, Homo sapiens
gactcaggttgtctgt

SEQ ID NO: 6235336 - DNA, 18 bp, Homo sapiens
gactcagtgaccagtgcc

SEQ ID NO: 6235337 - DNA, 15 bp, Homo sapiens
gactcagtgagctgg

SEQ ID NO: 6235338 - DNA, 19 bp, Homo sapiens
gactcagtgcagggacagc

SEQ ID NO: 6235339 - DNA, 22 bp, Homo sapiens
gactcagtgcagggacagcctg

SEQ ID NO: 6235340 - DNA, 18 bp, Homo sapiens
gactcagtgtattttaaa

SEQ ID NO: 6235341 - DNA, 15 bp, Homo sapiens
gactcagtttgtcag

SEQ ID NO: 6235342 - DNA, 16 bp, Homo sapiens
gactcagttttttgta

SEQ ID NO: 6235343 - DNA, 21 bp, Homo sapiens
gactcatatcccctatttaac

SEQ ID NO: 6235344 - DNA, 22 bp, Homo sapiens
gactcatcaatcaaataagtat

SEQ ID NO: 6235345 - DNA, 13 bp, Homo sapiens
gactcatccgcct

SEQ ID NO: 6235346 - DNA, 16 bp, Homo sapiens
gactcatccgcctggc

SEQ ID NO: 6235347 - DNA, 18 bp, Homo sapiens
gactcatccgcctggccc

SEQ ID NO: 6235348 - DNA, 13 bp, Homo sapiens
gactcatccttgc

SEQ ID NO: 6235349 - DNA, 14 bp, Homo sapiens
gactcatccttgcc

SEQ ID NO: 6235350 - DNA, 15 bp, Homo sapiens
gactcatccttgccc

SEQ ID NO: 6235351 - DNA, 17 bp, Homo sapiens
gactcatctttccctcc

SEQ ID NO: 6235352 - DNA, 18 bp, Homo sapiens
gactcatctttccctcct

SEQ ID NO: 6235353 - DNA, 19 bp, Homo sapiens
gactcatctttccctcctt

SEQ ID NO: 6235354 - DNA, 18 bp, Homo sapiens
gactcatgaggaggggcc

SEQ ID NO: 6235355 - DNA, 15 bp, Homo sapiens
gactcatggcagctg

SEQ ID NO: 6235356 - DNA, 13 bp, Homo sapiens
gactcattctgaa

SEQ ID NO: 6235357 - DNA, 21 bp, Homo sapiens
gactcattgcttcacaaccca

SEQ ID NO: 6235358 - DNA, 22 bp, Homo sapiens
gactcattgtagaaaggaagcc

SEQ ID NO: 6235359 - DNA, 18 bp, Homo sapiens
gactcatttcacagcctt

SEQ ID NO: 6235360 - DNA, 15 bp, Homo sapiens
gactccaaagaaatg

SEQ ID NO: 6235361 - DNA, 16 bp, Homo sapiens
gactccaaagaaatgt

SEQ ID NO: 6235362 - DNA, 18 bp, Homo sapiens
gactccaaagaaatgtaa

SEQ ID NO: 6235363 - DNA, 17 bp, Homo sapiens
gactccaaagctgttcc

SEQ ID NO: 6235364 - DNA, 19 bp, Homo sapiens
gactccaaagctgttccat

SEQ ID NO: 6235365 - DNA, 22 bp, Homo sapiens
gactccaagagggaatggtcaa

SEQ ID NO: 6235366 - DNA, 16 bp, Homo sapiens
gactccaagccctggg

SEQ ID NO: 6235367 - DNA, 17 bp, Homo sapiens
gactccaagccctgggg

SEQ ID NO: 6235368 - DNA, 21 bp, Homo sapiens
gactccaagccctggggcagg

SEQ ID NO: 6235369 - DNA, 19 bp, Homo sapiens
gactccaatggggccagca

SEQ ID NO: 6235370 - DNA, 22 bp, Homo sapiens
gactccaatggggccagcactg

SEQ ID NO: 6235371 - DNA, 19 bp, Homo sapiens
gactccacgatcctgccac

SEQ ID NO: 6235372 - DNA, 20 bp, Homo sapiens
gactccacgatcctgccacc

SEQ ID NO: 6235373 - DNA, 16 bp, Homo sapiens
gactccactggacaga

SEQ ID NO: 6235374 - DNA, 19 bp, Homo sapiens
gactccagaatctgctgtt

SEQ ID NO: 6235375 - DNA, 16 bp, Homo sapiens
gactccagactctctg

SEQ ID NO: 6235376 - DNA, 18 bp, Homo sapiens
gactccagagtctgagcc

SEQ ID NO: 6235377 - DNA, 19 bp, Homo sapiens
gactccagagtctgagccc

SEQ ID NO: 6235378 - DNA, 20 bp, Homo sapiens
gactccagagtctgagcccc

SEQ ID NO: 6235379 - DNA, 15 bp, Homo sapiens
gactccagcacgttt

SEQ ID NO: 6235380 - DNA, 19 bp, Homo sapiens
gactccagcacgttttctg

SEQ ID NO: 6235381 - DNA, 10 bp, Homo sapiens
gactccagcc

SEQ ID NO: 6235382 - DNA, 19 bp, Homo sapiens
gactccagccagcgcctcc

SEQ ID NO: 6235383 - DNA, 17 bp, Homo sapiens
gactccagcccctggac

SEQ ID NO: 6235384 - DNA, 19 bp, Homo sapiens
gactccagcccctggaccc

SEQ ID NO: 6235385 - DNA, 21 bp, Homo sapiens
gactccagcgcctgccctccc

SEQ ID NO: 6235386 - DNA, 14 bp, Homo sapiens
gactccagctgtga

SEQ ID NO: 6235387 - DNA, 15 bp, Homo sapiens
gactccaggaagaag

SEQ ID NO: 6235388 - DNA, 10 bp, Homo sapiens
gactccaggc

SEQ ID NO: 6235389 - DNA, 15 bp, Homo sapiens
gactccaggcagcag

SEQ ID NO: 6235390 - DNA, 20 bp, Homo sapiens
gactccaggcagcagacaca

SEQ ID NO: 6235391 - DNA, 17 bp, Homo sapiens
gactccaggccagctcc

SEQ ID NO: 6235392 - DNA, 15 bp, Homo sapiens
gactccaggcctgac

SEQ ID NO: 6235393 - DNA, 16 bp, Homo sapiens
gactccaggcctgacc

SEQ ID NO: 6235394 - DNA, 18 bp, Homo sapiens
gactccaggcctgaccag

SEQ ID NO: 6235395 - DNA, 12 bp, Homo sapiens
gactccaggctt

SEQ ID NO: 6235396 - DNA, 13 bp, Homo sapiens
gactccaggggct

SEQ ID NO: 6235397 - DNA, 16 bp, Homo sapiens
gactccatagctcctt

SEQ ID NO: 6235398 - DNA, 20 bp, Homo sapiens
gactccatatcccgggagca

SEQ ID NO: 6235399 - DNA, 21 bp, Homo sapiens
gactccatatcccgggagcag

SEQ ID NO: 6235400 - DNA, 21 bp, Homo sapiens
gactccatctctcatcctcca

SEQ ID NO: 6235401 - DNA, 16 bp, Homo sapiens
gactccatctcttctg

SEQ ID NO: 6235402 - DNA, 15 bp, Homo sapiens
gactccatggccctt

SEQ ID NO: 6235403 - DNA, 15 bp, Homo sapiens
gactccatttctttc

SEQ ID NO: 6235404 - DNA, 21 bp, Homo sapiens
gactcccaagtttccatagca

SEQ ID NO: 6235405 - DNA, 15 bp, Homo sapiens
gactcccagaacctc

SEQ ID NO: 6235406 - DNA, 16 bp, Homo sapiens
gactcccagcagagcc

SEQ ID NO: 6235407 - DNA, 20 bp, Homo sapiens
gactcccaggctggagagca

SEQ ID NO: 6235408 - DNA, 13 bp, Homo sapiens
gactcccatgaag

SEQ ID NO: 6235409 - DNA, 15 bp, Homo sapiens
gactcccatgaagcc

SEQ ID NO: 6235410 - DNA, 16 bp, Homo sapiens
gactcccatgaagcct

SEQ ID NO: 6235411 - DNA, 21 bp, Homo sapiens
gactcccatgaagccttttga

SEQ ID NO: 6235412 - DNA, 13 bp, Homo sapiens
gactcccattcct

SEQ ID NO: 6235413 - DNA, 14 bp, Homo sapiens
gactccccagccca

SEQ ID NO: 6235414 - DNA, 15 bp, Homo sapiens
gactccccaggccag

SEQ ID NO: 6235415 - DNA, 16 bp, Homo sapiens
gactccccaggccagg

SEQ ID NO: 6235416 - DNA, 13 bp, Homo sapiens
gactccccctccc

SEQ ID NO: 6235417 - DNA, 14 bp, Homo sapiens
gactccccctcccc

SEQ ID NO: 6235418 - DNA, 15 bp, Homo sapiens
gactccccctccccg

SEQ ID NO: 6235419 - DNA, 20 bp, Homo sapiens
gactccccctccccggcatc

SEQ ID NO: 6235420 - DNA, 15 bp, Homo sapiens
gactcccgccccggg

SEQ ID NO: 6235421 - DNA, 20 bp, Homo sapiens
gactcccgccccgggctggc

SEQ ID NO: 6235422 - DNA, 22 bp, Homo sapiens
gactcccgccccgggctggccc

SEQ ID NO: 6235423 - DNA, 19 bp, Homo sapiens
gactcccggagcctgtgca

SEQ ID NO: 6235424 - DNA, 23 bp, Homo sapiens
gactcccgggccacgccccagcc

SEQ ID NO: 6235425 - DNA, 13 bp, Homo sapiens
gactccctcccca

SEQ ID NO: 6235426 - DNA, 16 bp, Homo sapiens
gactccctccccaccc

SEQ ID NO: 6235427 - DNA, 14 bp, Homo sapiens
gactccctccccag

SEQ ID NO: 6235428 - DNA, 16 bp, Homo sapiens
gactccctccccagat

SEQ ID NO: 6235429 - DNA, 14 bp, Homo sapiens
gactccctcccctg

SEQ ID NO: 6235430 - DNA, 19 bp, Homo sapiens
gactccctcctcacctctg

SEQ ID NO: 6235431 - DNA, 17 bp, Homo sapiens
gactccctgagtctgga

SEQ ID NO: 6235432 - DNA, 19 bp, Homo sapiens
gactccctgagtctggacc

SEQ ID NO: 6235433 - DNA, 14 bp, Homo sapiens
gactccctgggagc

SEQ ID NO: 6235434 - DNA, 22 bp, Homo sapiens
gactcccttaaaatagaaataa

SEQ ID NO: 6235435 - DNA, 17 bp, Homo sapiens
gactccgagaacaacag

SEQ ID NO: 6235436 - DNA, 15 bp, Homo sapiens
gactccgccctcctc

SEQ ID NO: 6235437 - DNA, 18 bp, Homo sapiens
gactccgcctgaggccag

SEQ ID NO: 6235438 - DNA, 14 bp, Homo sapiens
gactccggaggact

SEQ ID NO: 6235439 - DNA, 15 bp, Homo sapiens
gactccggaggactg

SEQ ID NO: 6235440 - DNA, 23 bp, Homo sapiens
gactccggaggactgagccccca

SEQ ID NO: 6235441 - DNA, 14 bp, Homo sapiens
gactccggcctgta

SEQ ID NO: 6235442 - DNA, 16 bp, Homo sapiens
gactccggctgtgctg

SEQ ID NO: 6235443 - DNA, 19 bp, Homo sapiens
gactccgggaccattgacc

SEQ ID NO: 6235444 - DNA, 18 bp, Homo sapiens
gactccggggccccactg

SEQ ID NO: 6235445 - DNA, 21 bp, Homo sapiens
gactccggggccccactggct

SEQ ID NO: 6235446 - DNA, 22 bp, Homo sapiens
gactccggggccccactggctg

SEQ ID NO: 6235447 - DNA, 17 bp, Homo sapiens
gactccgttggccactc

SEQ ID NO: 6235448 - DNA, 16 bp, Homo sapiens
gactcctacctgccct

SEQ ID NO: 6235449 - DNA, 17 bp, Homo sapiens
gactcctaggcaggaca

SEQ ID NO: 6235450 - DNA, 19 bp, Homo sapiens
gactcctaggcaggacatg

SEQ ID NO: 6235451 - DNA, 15 bp, Homo sapiens
gactcctatgatctc

SEQ ID NO: 6235452 - DNA, 15 bp, Homo sapiens
gactcctcagcaccc

SEQ ID NO: 6235453 - DNA, 21 bp, Homo sapiens
gactcctcagcacccctccag

SEQ ID NO: 6235454 - DNA, 19 bp, Homo sapiens
gactcctcagtccctcttc

SEQ ID NO: 6235455 - DNA, 11 bp, Homo sapiens
gactcctccca

SEQ ID NO: 6235456 - DNA, 20 bp, Homo sapiens
gactcctccccaccctcctg

SEQ ID NO: 6235457 - DNA, 22 bp, Homo sapiens
gactcctccctgggggtggggc

SEQ ID NO: 6235458 - DNA, 14 bp, Homo sapiens
gactcctcccttcc

SEQ ID NO: 6235459 - DNA, 19 bp, Homo sapiens
gactcctcccttccccact

SEQ ID NO: 6235460 - DNA, 15 bp, Homo sapiens
gactcctcggcctgg

SEQ ID NO: 6235461 - DNA, 20 bp, Homo sapiens
gactcctcggcctggctcct

SEQ ID NO: 6235462 - DNA, 13 bp, Homo sapiens
gactcctctggct

SEQ ID NO: 6235463 - DNA, 20 bp, Homo sapiens
gactcctctggctttcccag

SEQ ID NO: 6235464 - DNA, 13 bp, Homo sapiens
gactcctctgggc

SEQ ID NO: 6235465 - DNA, 18 bp, Homo sapiens
gactcctctgggcctggg

SEQ ID NO: 6235466 - DNA, 14 bp, Homo sapiens
gactcctctgtcca

SEQ ID NO: 6235467 - DNA, 21 bp, Homo sapiens
gactcctgaggacagctgtcc

SEQ ID NO: 6235468 - DNA, 18 bp, Homo sapiens
gactcctgattgctctgg

SEQ ID NO: 6235469 - DNA, 14 bp, Homo sapiens
gcagccgcagagaa

SEQ ID NO: 6235470 - DNA, 16 bp, Homo sapiens
gcagccgcagagaaat

SEQ ID NO: 6235471 - DNA, 14 bp, Homo sapiens
gcagccgccagctg

SEQ ID NO: 6235472 - DNA, 14 bp, Homo sapiens
gcagccgccgccgc

SEQ ID NO: 6235473 - DNA, 15 bp, Homo sapiens
gcagccgccgccgcc

SEQ ID NO: 6235474 - DNA, 20 bp, Homo sapiens
gcagccgccgccgcccacgc

SEQ ID NO: 6235475 - DNA, 14 bp, Homo sapiens
gcagccgcctccct

SEQ ID NO: 6235476 - DNA, 19 bp, Homo sapiens
gcagccgccttcacagcag

SEQ ID NO: 6235477 - DNA, 16 bp, Homo sapiens
gcagccgccttccttg

SEQ ID NO: 6235478 - DNA, 20 bp, Homo sapiens
gcagccgccttccttgacct

SEQ ID NO: 6235479 - DNA, 15 bp, Homo sapiens
gcagccgcgctctgc

SEQ ID NO: 6235480 - DNA, 19 bp, Homo sapiens
gcagccgcgctctgcccct

SEQ ID NO: 6235481 - DNA, 21 bp, Homo sapiens
gcagccgcgctctgcccctcc

SEQ ID NO: 6235482 - DNA, 17 bp, Homo sapiens
gcagccgctaggagaga

SEQ ID NO: 6235483 - DNA, 18 bp, Homo sapiens
gcagccggagggaggcac

SEQ ID NO: 6235484 - DNA, 13 bp, Homo sapiens
gcagccggggagc

SEQ ID NO: 6235485 - DNA, 22 bp, Homo sapiens
gcagccggggagctgaggggca

SEQ ID NO: 6235486 - DNA, 17 bp, Homo sapiens
gcagccgtcccaggcca

SEQ ID NO: 6235487 - DNA, 14 bp, Homo sapiens
gcagccgtgcagga

SEQ ID NO: 6235488 - DNA, 17 bp, Homo sapiens
gcagccgtgcaggactc

SEQ ID NO: 6235489 - DNA, 23 bp, Homo sapiens
gcagcctaagaagaaggccagag

SEQ ID NO: 6235490 - DNA, 19 bp, Homo sapiens
gcagcctagtaggagctga

SEQ ID NO: 6235491 - DNA, 20 bp, Homo sapiens
gcagcctatgggggctctcg

SEQ ID NO: 6235492 - DNA, 22 bp, Homo sapiens
gcagcctatgggggctctcgga

SEQ ID NO: 6235493 - DNA, 21 bp, Homo sapiens
gcagcctcaaaacgggtcagt

SEQ ID NO: 6235494 - DNA, 14 bp, Homo sapiens
gcagcctcaacctc

SEQ ID NO: 6235495 - DNA, 21 bp, Homo sapiens
gcagcctcaacctcctgggct

SEQ ID NO: 6235496 - DNA, 21 bp, Homo sapiens
gcagcctcaacctcctgggtt

SEQ ID NO: 6235497 - DNA, 15 bp, Homo sapiens
gcagcctcagagaca

SEQ ID NO: 6235498 - DNA, 23 bp, Homo sapiens
gcagcctcagagacatcagccct

SEQ ID NO: 6235499 - DNA, 14 bp, Homo sapiens
gcagcctcagaggc

SEQ ID NO: 6235500 - DNA, 18 bp, Homo sapiens
gcagcctcagaggcccct

SEQ ID NO: 6235501 - DNA, 15 bp, Homo sapiens
gcagcctcaggactg

SEQ ID NO: 6235502 - DNA, 16 bp, Homo sapiens
gcagcctcagggcttc

SEQ ID NO: 6235503 - DNA, 22 bp, Homo sapiens
gcagcctcatactcctgggctc

SEQ ID NO: 6235504 - DNA, 21 bp, Homo sapiens
gcagcctcattctgaggcctg

SEQ ID NO: 6235505 - DNA, 17 bp, Homo sapiens
gcagcctccaacacaag

SEQ ID NO: 6235506 - DNA, 15 bp, Homo sapiens
gcagcctccaagaaa

SEQ ID NO: 6235507 - DNA, 21 bp, Homo sapiens
gcagcctccaccttgctcttc

SEQ ID NO: 6235508 - DNA, 16 bp, Homo sapiens
gcagcctccagagcca

SEQ ID NO: 6235509 - DNA, 21 bp, Homo sapiens
gcagcctccagagccagcctg

SEQ ID NO: 6235510 - DNA, 14 bp, Homo sapiens
gcagcctccagggc

SEQ ID NO: 6235511 - DNA, 15 bp, Homo sapiens
gcagcctccagggcc

SEQ ID NO: 6235512 - DNA, 16 bp, Homo sapiens
gcagcctccagggccc

SEQ ID NO: 6235513 - DNA, 15 bp, Homo sapiens
gcagcctccagtctg

SEQ ID NO: 6235514 - DNA, 17 bp, Homo sapiens
gcagcctccagtctgct

SEQ ID NO: 6235515 - DNA, 22 bp, Homo sapiens
gcagcctccagtctgctctcag

SEQ ID NO: 6235516 - DNA, 19 bp, Homo sapiens
gcagcctccagtgctggct

SEQ ID NO: 6235517 - DNA, 15 bp, Homo sapiens
gcagcctccagtggg

SEQ ID NO: 6235518 - DNA, 20 bp, Homo sapiens
gcagcctcccatccagggcc

SEQ ID NO: 6235519 - DNA, 21 bp, Homo sapiens
gcagcctcccatccagggccc

SEQ ID NO: 6235520 - DNA, 13 bp, Homo sapiens
gcagcctccccca

SEQ ID NO: 6235521 - DNA, 14 bp, Homo sapiens
gcagcctccctccg

SEQ ID NO: 6235522 - DNA, 14 bp, Homo sapiens
gcagcctccctctg

SEQ ID NO: 6235523 - DNA, 17 bp, Homo sapiens
gcagcctccctgtcact

SEQ ID NO: 6235524 - DNA, 17 bp, Homo sapiens
gcagcctccgcttccct

SEQ ID NO: 6235525 - DNA, 23 bp, Homo sapiens
gcagcctccgtcatccatgccct

SEQ ID NO: 6235526 - DNA, 18 bp, Homo sapiens
gcagcctcctcctgacca

SEQ ID NO: 6235527 - DNA, 12 bp, Homo sapiens
gcagcctccttt

SEQ ID NO: 6235528 - DNA, 14 bp, Homo sapiens
gcagcctcctttgt

SEQ ID NO: 6235529 - DNA, 18 bp, Homo sapiens
gcagcctcgaactcctgg

SEQ ID NO: 6235530 - DNA, 21 bp, Homo sapiens
gcagcctcgacctccctggct

SEQ ID NO: 6235531 - DNA, 14 bp, Homo sapiens
gcagcctcgcacag

SEQ ID NO: 6235532 - DNA, 16 bp, Homo sapiens
gcagcctcgcacaggc

SEQ ID NO: 6235533 - DNA, 18 bp, Homo sapiens
gcagcctcgcacaggccc

SEQ ID NO: 6235534 - DNA, 21 bp, Homo sapiens
gcagcctcgcacaggccctag

SEQ ID NO: 6235535 - DNA, 22 bp, Homo sapiens
gcagcctcgcacaggccctagc

SEQ ID NO: 6235536 - DNA, 22 bp, Homo sapiens
gcagcctcgcggtcttgggcac

SEQ ID NO: 6235537 - DNA, 16 bp, Homo sapiens
gcagcctcgtggagct

SEQ ID NO: 6235538 - DNA, 23 bp, Homo sapiens
gcagcctcgttaggacaaggctg

SEQ ID NO: 6235539 - DNA, 20 bp, Homo sapiens
gcagcctctcagtgccctcc

SEQ ID NO: 6235540 - DNA, 19 bp, Homo sapiens
gcagcctctccgactctgc

SEQ ID NO: 6235541 - DNA, 15 bp, Homo sapiens
gcagcctctctgcta

SEQ ID NO: 6235542 - DNA, 20 bp, Homo sapiens
gcagcctctctggctggtct

SEQ ID NO: 6235543 - DNA, 21 bp, Homo sapiens
gcagcctctctggctggtctt

SEQ ID NO: 6235544 - DNA, 23 bp, Homo sapiens
gcagcctctctggctggtcttca

SEQ ID NO: 6235545 - DNA, 11 bp, Homo sapiens
gcagcctctgc

SEQ ID NO: 6235546 - DNA, 15 bp, Homo sapiens
gcagcctctggacag

SEQ ID NO: 6235547 - DNA, 18 bp, Homo sapiens
gcagcctctggacagcca

SEQ ID NO: 6235548 - DNA, 15 bp, Homo sapiens
gcagcctctgggggg

SEQ ID NO: 6235549 - DNA, 19 bp, Homo sapiens
gcagcctctgtcaggcctt

SEQ ID NO: 6235550 - DNA, 13 bp, Homo sapiens
gcagcctcttgaa

SEQ ID NO: 6235551 - DNA, 14 bp, Homo sapiens
gcagcctcttgaat

SEQ ID NO: 6235552 - DNA, 12 bp, Homo sapiens
gcagcctgaccc

SEQ ID NO: 6235553 - DNA, 12 bp, Homo sapiens
gcagcctgagaa

SEQ ID NO: 6235554 - DNA, 19 bp, Homo sapiens
gcagcctgagagctggccc

SEQ ID NO: 6235555 - DNA, 16 bp, Homo sapiens
gcagcctgagctccac

SEQ ID NO: 6235556 - DNA, 19 bp, Homo sapiens
gcagcctgagctccaccct

SEQ ID NO: 6235557 - DNA, 13 bp, Homo sapiens
gcagcctgagtcc

SEQ ID NO: 6235558 - DNA, 23 bp, Homo sapiens
gcagcctgatggccaagggggtg

SEQ ID NO: 6235559 - DNA, 18 bp, Homo sapiens
gcagcctgcacctgcccc

SEQ ID NO: 6235560 - DNA, 13 bp, Homo sapiens
gcagcctgcagga

SEQ ID NO: 6235561 - DNA, 16 bp, Homo sapiens
gcagcctgcaggacct

SEQ ID NO: 6235562 - DNA, 12 bp, Homo sapiens
gcagcctgccag

SEQ ID NO: 6235563 - DNA, 12 bp, Homo sapiens
gcagcctgcccc

SEQ ID NO: 6235564 - DNA, 14 bp, Homo sapiens
gcagcctgcctgga

SEQ ID NO: 6235565 - DNA, 15 bp, Homo sapiens
gcagcctgcctggag

SEQ ID NO: 6235566 - DNA, 16 bp, Homo sapiens
gcagcctgcctggagt

SEQ ID NO: 6235567 - DNA, 13 bp, Homo sapiens
gcagcctgcgtgg

SEQ ID NO: 6235568 - DNA, 21 bp, Homo sapiens
gcagcctgctctagtgggaca

SEQ ID NO: 6235569 - DNA, 15 bp, Homo sapiens
gcagcctgctctgga

SEQ ID NO: 6235570 - DNA, 12 bp, Homo sapiens
gcagcctgctgg

SEQ ID NO: 6235571 - DNA, 13 bp, Homo sapiens
gcagcctgctggg

SEQ ID NO: 6235572 - DNA, 14 bp, Homo sapiens
gcagcctgctgggg

SEQ ID NO: 6235573 - DNA, 23 bp, Homo sapiens
gcagcctgcttcccacctccctg

SEQ ID NO: 6235574 - DNA, 20 bp, Homo sapiens
gcagcctgctttggcctttc

SEQ ID NO: 6235575 - DNA, 21 bp, Homo sapiens
gcagcctgctttggcctttcc

SEQ ID NO: 6235576 - DNA, 20 bp, Homo sapiens
gcagcctggagacccacccc

SEQ ID NO: 6235577 - DNA, 18 bp, Homo sapiens
gcagcctggagacttcct

SEQ ID NO: 6235578 - DNA, 19 bp, Homo sapiens
gcagcctggagacttccta

SEQ ID NO: 6235579 - DNA, 12 bp, Homo sapiens
gcagcctggctc

SEQ ID NO: 6235580 - DNA, 19 bp, Homo sapiens
gcagcctggctcccaggac

SEQ ID NO: 6235581 - DNA, 20 bp, Homo sapiens
gcagcctggctcccaggaca

SEQ ID NO: 6235582 - DNA, 19 bp, Homo sapiens
gcagcctggctcccctggg

SEQ ID NO: 6235583 - DNA, 13 bp, Homo sapiens
gcagcctggctgg

SEQ ID NO: 6235584 - DNA, 17 bp, Homo sapiens
gcagcctggggctggcc

SEQ ID NO: 6235585 - DNA, 11 bp, Homo sapiens
gcagcctgggt

SEQ ID NO: 6235586 - DNA, 14 bp, Homo sapiens
gcagcctgggtctg

SEQ ID NO: 6235587 - DNA, 22 bp, Homo sapiens
gcagcctggtagaattgggaag

SEQ ID NO: 6235588 - DNA, 22 bp, Homo sapiens
gcagcctgtatgtggtgtgggg

SEQ ID NO: 6235589 - DNA, 15 bp, Homo sapiens
gcagcctgtgaggga

SEQ ID NO: 6235590 - DNA, 22 bp, Homo sapiens
gcagcctgtgagggagtgcaga

SEQ ID NO: 6235591 - DNA, 14 bp, Homo sapiens
gcagcctgtggcat

SEQ ID NO: 6235592 - DNA, 13 bp, Homo sapiens
gcagcctgtggct

SEQ ID NO: 6235593 - DNA, 17 bp, Homo sapiens
gcagcctgtgggagaag

SEQ ID NO: 6235594 - DNA, 18 bp, Homo sapiens
gcagcctgtgggagaagg

SEQ ID NO: 6235595 - DNA, 16 bp, Homo sapiens
gcagccttcttttcaa

SEQ ID NO: 6235596 - DNA, 19 bp, Homo sapiens
gcagccttgcgctgtccca

SEQ ID NO: 6235597 - DNA, 16 bp, Homo sapiens
gcagccttggggaacc

SEQ ID NO: 6235598 - DNA, 14 bp, Homo sapiens
gcagccttggggca

SEQ ID NO: 6235599 - DNA, 21 bp, Homo sapiens
gcagccttgggggggctgcct

SEQ ID NO: 6235600 - DNA, 15 bp, Homo sapiens
gcagcctttccagcc

SEQ ID NO: 6235601 - DNA, 17 bp, Homo sapiens
gcagcctttccagcctc

SEQ ID NO: 6235602 - DNA, 20 bp, Homo sapiens
gcagccttttctggtccctc

SEQ ID NO: 6235603 - DNA, 21 bp, Homo sapiens
gcagccttttctggtccctct

SEQ ID NO: 6235604 - DNA, 20 bp, Homo sapiens
gcagcctttttcaccatggc

SEQ ID NO: 6235605 - DNA, 18 bp, Homo sapiens
gcagcgaattcagaaaga

SEQ ID NO: 6235606 - DNA, 13 bp, Homo sapiens
gcagcgaccaccc

SEQ ID NO: 6235607 - DNA, 15 bp, Homo sapiens
gcagcgacccttggt

SEQ ID NO: 6235608 - DNA, 16 bp, Homo sapiens
gcagcgacccttggtg

SEQ ID NO: 6235609 - DNA, 17 bp, Homo sapiens
gcagcgaccgccccctc

SEQ ID NO: 6235610 - DNA, 18 bp, Homo sapiens
gcagcgaccgccccctcc

SEQ ID NO: 6235611 - DNA, 22 bp, Homo sapiens
gcagcgaccgccccctcctcta

SEQ ID NO: 6235612 - DNA, 15 bp, Homo sapiens
gcagcgactgtttca

SEQ ID NO: 6235613 - DNA, 15 bp, Homo sapiens
gcagcgagcctgcta

SEQ ID NO: 6235614 - DNA, 22 bp, Homo sapiens
gcagcgagctatgatcgcgcca

SEQ ID NO: 6235615 - DNA, 14 bp, Homo sapiens
gcagcgaggctggg

SEQ ID NO: 6235616 - DNA, 21 bp, Homo sapiens
gcagcgagggcggagccggcc

SEQ ID NO: 6235617 - DNA, 14 bp, Homo sapiens
gcagcgaggtccac

SEQ ID NO: 6235618 - DNA, 24 bp, Homo sapiens
gcagcgagttgtggaaagcctctg

SEQ ID NO: 6235619 - DNA, 16 bp, Homo sapiens
gcagcgcagagcgggc

SEQ ID NO: 6235620 - DNA, 23 bp, Homo sapiens
gcagcgcagccgagccccaggag

SEQ ID NO: 6235621 - DNA, 18 bp, Homo sapiens
gcagcgcagccgccgggc

SEQ ID NO: 6235622 - DNA, 18 bp, Homo sapiens
gcagcgcagggctggcac

SEQ ID NO: 6235623 - DNA, 20 bp, Homo sapiens
gcagcgcattgttttgcatc

SEQ ID NO: 6235624 - DNA, 14 bp, Homo sapiens
gcagcgccactgtc

SEQ ID NO: 6235625 - DNA, 22 bp, Homo sapiens
gcagcgccagggctcagatggg

SEQ ID NO: 6235626 - DNA, 18 bp, Homo sapiens
gcagcgcccaggcctgct

SEQ ID NO: 6235627 - DNA, 23 bp, Homo sapiens
gcagcgcccaggcctgctggcat

SEQ ID NO: 6235628 - DNA, 23 bp, Homo sapiens
gcagcgccccaccacgtcgggct

SEQ ID NO: 6235629 - DNA, 12 bp, Homo sapiens
gcagcgccccca

SEQ ID NO: 6235630 - DNA, 19 bp, Homo sapiens
gcagcgcccttcctctcca

SEQ ID NO: 6235631 - DNA, 21 bp, Homo sapiens
gcagcgcccttcctctccacc

SEQ ID NO: 6235632 - DNA, 18 bp, Homo sapiens
gcagcgccgtgtcctctc

SEQ ID NO: 6235633 - DNA, 19 bp, Homo sapiens
gcagcgcctccaccctgcc

SEQ ID NO: 6235634 - DNA, 22 bp, Homo sapiens
gcagcgcctccaccctgccctg

SEQ ID NO: 6235635 - DNA, 13 bp, Homo sapiens
gcagcgcctcccg

SEQ ID NO: 6235636 - DNA, 13 bp, Homo sapiens
gcagcgcctccct

SEQ ID NO: 6235637 - DNA, 21 bp, Homo sapiens
gcagcgcctgtcccctcacag

SEQ ID NO: 6235638 - DNA, 16 bp, Homo sapiens
gcagcgcgcaggcctg

SEQ ID NO: 6235639 - DNA, 21 bp, Homo sapiens
gcagcgcggatttctctttct

SEQ ID NO: 6235640 - DNA, 14 bp, Homo sapiens
gcagcgcgtgcaca

SEQ ID NO: 6235641 - DNA, 19 bp, Homo sapiens
gcagcggaagggactctgg

SEQ ID NO: 6235642 - DNA, 23 bp, Homo sapiens
gcagcggaagggactctgggctg

SEQ ID NO: 6235643 - DNA, 21 bp, Homo sapiens
gcagcggattgctctggagca

SEQ ID NO: 6235644 - DNA, 17 bp, Homo sapiens
gcagcggcagcagcagc

SEQ ID NO: 6235645 - DNA, 14 bp, Homo sapiens
gcagcggccccgca

SEQ ID NO: 6235646 - DNA, 19 bp, Homo sapiens
gcagcggccccgcacccct

SEQ ID NO: 6235647 - DNA, 15 bp, Homo sapiens
gactcctgcaggcag

SEQ ID NO: 6235648 - DNA, 19 bp, Homo sapiens
gactcctgcaggcagccag

SEQ ID NO: 6235649 - DNA, 21 bp, Homo sapiens
gactcctgcaggcagccaggc

SEQ ID NO: 6235650 - DNA, 13 bp, Homo sapiens
gactcctgccctg

SEQ ID NO: 6235651 - DNA, 11 bp, Homo sapiens
gactcctgctc

SEQ ID NO: 6235652 - DNA, 13 bp, Homo sapiens
gactcctgctggt

SEQ ID NO: 6235653 - DNA, 20 bp, Homo sapiens
gactcctggactccggagga

SEQ ID NO: 6235654 - DNA, 12 bp, Homo sapiens
gactcctggcag

SEQ ID NO: 6235655 - DNA, 14 bp, Homo sapiens
gactcctggcaggg

SEQ ID NO: 6235656 - DNA, 17 bp, Homo sapiens
gactcctggcttcatgt

SEQ ID NO: 6235657 - DNA, 22 bp, Homo sapiens
gactcctggtctgaaaatgttg

SEQ ID NO: 6235658 - DNA, 14 bp, Homo sapiens
gactcctggtctgt

SEQ ID NO: 6235659 - DNA, 20 bp, Homo sapiens
gactccttatctctttccac

SEQ ID NO: 6235660 - DNA, 15 bp, Homo sapiens
gactccttccttgaa

SEQ ID NO: 6235661 - DNA, 12 bp, Homo sapiens
gactccttctcc

SEQ ID NO: 6235662 - DNA, 14 bp, Homo sapiens
gactccttggtgct

SEQ ID NO: 6235663 - DNA, 15 bp, Homo sapiens
gactcgaaactgaca

SEQ ID NO: 6235664 - DNA, 15 bp, Homo sapiens
gactcgacaaaggcc

SEQ ID NO: 6235665 - DNA, 15 bp, Homo sapiens
gactcgagagggctg

SEQ ID NO: 6235666 - DNA, 18 bp, Homo sapiens
gactcgagagggctgagc

SEQ ID NO: 6235667 - DNA, 24 bp, Homo sapiens
gactcgagagggctgagcccctcc

SEQ ID NO: 6235668 - DNA, 16 bp, Homo sapiens
gactcgagtgtttaaa

SEQ ID NO: 6235669 - DNA, 20 bp, Homo sapiens
gactcgatttaaactccagc

SEQ ID NO: 6235670 - DNA, 18 bp, Homo sapiens
gactcgcgacaatgcaaa

SEQ ID NO: 6235671 - DNA, 15 bp, Homo sapiens
gactcgcgagagggt

SEQ ID NO: 6235672 - DNA, 17 bp, Homo sapiens
gactcgcgagagggtgc

SEQ ID NO: 6235673 - DNA, 14 bp, Homo sapiens
gactcgcttgtaaa

SEQ ID NO: 6235674 - DNA, 16 bp, Homo sapiens
gactcggaatctattt

SEQ ID NO: 6235675 - DNA, 20 bp, Homo sapiens
gactcggagactatggcctc

SEQ ID NO: 6235676 - DNA, 21 bp, Homo sapiens
gactcggagactatggcctcg

SEQ ID NO: 6235677 - DNA, 19 bp, Homo sapiens
gactcggccactgtgtctc

SEQ ID NO: 6235678 - DNA, 14 bp, Homo sapiens
gactcgggagctgc

SEQ ID NO: 6235679 - DNA, 15 bp, Homo sapiens
gactcgggagctgca

SEQ ID NO: 6235680 - DNA, 17 bp, Homo sapiens
gactcgggagctgcaca

SEQ ID NO: 6235681 - DNA, 18 bp, Homo sapiens
gactcgggctcctgtgcc

SEQ ID NO: 6235682 - DNA, 20 bp, Homo sapiens
gactcgggctcctgtgccct

SEQ ID NO: 6235683 - DNA, 15 bp, Homo sapiens
gactcgggggctggt

SEQ ID NO: 6235684 - DNA, 19 bp, Homo sapiens
gactcggtttctccaaact

SEQ ID NO: 6235685 - DNA, 19 bp, Homo sapiens
gactcgtaaagctgctagg

SEQ ID NO: 6235686 - DNA, 19 bp, Homo sapiens
gactcgttctcgtgaccca

SEQ ID NO: 6235687 - DNA, 20 bp, Homo sapiens
gactctaaacacacaagtag

SEQ ID NO: 6235688 - DNA, 22 bp, Homo sapiens
gactctaaacaggaacttgaat

SEQ ID NO: 6235689 - DNA, 13 bp, Homo sapiens
gactctaaagaaa

SEQ ID NO: 6235690 - DNA, 14 bp, Homo sapiens
gactctaaagacca

SEQ ID NO: 6235691 - DNA, 18 bp, Homo sapiens
gactctaaatagcccaga

SEQ ID NO: 6235692 - DNA, 22 bp, Homo sapiens
gactctaaatagcccagatccc

SEQ ID NO: 6235693 - DNA, 18 bp, Homo sapiens
gactctaaatatttcatg

SEQ ID NO: 6235694 - DNA, 12 bp, Homo sapiens
gactctaaatgc

SEQ ID NO: 6235695 - DNA, 15 bp, Homo sapiens
gactctaagaaagaa

SEQ ID NO: 6235696 - DNA, 16 bp, Homo sapiens
gactctaagaaagaac

SEQ ID NO: 6235697 - DNA, 20 bp, Homo sapiens
gactctaagctcagtgctct

SEQ ID NO: 6235698 - DNA, 14 bp, Homo sapiens
gactctaagctgtg

SEQ ID NO: 6235699 - DNA, 19 bp, Homo sapiens
gactctaagctgtgtgcag

SEQ ID NO: 6235700 - DNA, 16 bp, Homo sapiens
gactctacactgtgaa

SEQ ID NO: 6235701 - DNA, 21 bp, Homo sapiens
gactctacagaggccatgggc

SEQ ID NO: 6235702 - DNA, 14 bp, Homo sapiens
gactctaccagact

SEQ ID NO: 6235703 - DNA, 21 bp, Homo sapiens
gactctacctgcaagatttca

SEQ ID NO: 6235704 - DNA, 18 bp, Homo sapiens
gactctactcccagcgct

SEQ ID NO: 6235705 - DNA, 21 bp, Homo sapiens
gactctagaagctcaggttcc

SEQ ID NO: 6235706 - DNA, 19 bp, Homo sapiens
gactctagagtccaaggtt

SEQ ID NO: 6235707 - DNA, 19 bp, Homo sapiens
gactctaggtgcccttgga

SEQ ID NO: 6235708 - DNA, 16 bp, Homo sapiens
gactctaggttataca

SEQ ID NO: 6235709 - DNA, 17 bp, Homo sapiens
gactctaggttatacaa

SEQ ID NO: 6235710 - DNA, 14 bp, Homo sapiens
gactctagtattta

SEQ ID NO: 6235711 - DNA, 18 bp, Homo sapiens
gactctattctttaactc

SEQ ID NO: 6235712 - DNA, 14 bp, Homo sapiens
gactctcaaatctt

SEQ ID NO: 6235713 - DNA, 15 bp, Homo sapiens
gactctcagcccaga

SEQ ID NO: 6235714 - DNA, 17 bp, Homo sapiens
gactctcagcccagaag

SEQ ID NO: 6235715 - DNA, 21 bp, Homo sapiens
gactctcagcccagaagaaaa

SEQ ID NO: 6235716 - DNA, 16 bp, Homo sapiens
gactctcagtctctga

SEQ ID NO: 6235717 - DNA, 16 bp, Homo sapiens
gactctccactgacct

SEQ ID NO: 6235718 - DNA, 23 bp, Homo sapiens
gactctccaggcaccgcctgccc

SEQ ID NO: 6235719 - DNA, 13 bp, Homo sapiens
gactctcctcctc

SEQ ID NO: 6235720 - DNA, 18 bp, Homo sapiens
gactctcctgcctcagcc

SEQ ID NO: 6235721 - DNA, 21 bp, Homo sapiens
gactctcgtgatatgctgctt

SEQ ID NO: 6235722 - DNA, 23 bp, Homo sapiens
gactctcgtgatatgctgcttgt

SEQ ID NO: 6235723 - DNA, 21 bp, Homo sapiens
gactctcgtgcatttcaactt

SEQ ID NO: 6235724 - DNA, 18 bp, Homo sapiens
gactctctaacagggcag

SEQ ID NO: 6235725 - DNA, 19 bp, Homo sapiens
gactctctccatcagaagg

SEQ ID NO: 6235726 - DNA, 20 bp, Homo sapiens
gactctctcctctctctccc

SEQ ID NO: 6235727 - DNA, 23 bp, Homo sapiens
gactctctcctctctctccctcc

SEQ ID NO: 6235728 - DNA, 20 bp, Homo sapiens
gactctctgagctggggagg

SEQ ID NO: 6235729 - DNA, 13 bp, Homo sapiens
gactctctgcctg

SEQ ID NO: 6235730 - DNA, 14 bp, Homo sapiens
gactctctgcctgc

SEQ ID NO: 6235731 - DNA, 15 bp, Homo sapiens
gactctctgcctgct

SEQ ID NO: 6235732 - DNA, 21 bp, Homo sapiens
gactctctgcctgcttcctgg

SEQ ID NO: 6235733 - DNA, 14 bp, Homo sapiens
gactctctgtgacc

SEQ ID NO: 6235734 - DNA, 15 bp, Homo sapiens
gactctgaaaaacat

SEQ ID NO: 6235735 - DNA, 15 bp, Homo sapiens
gactctgaaaaggaa

SEQ ID NO: 6235736 - DNA, 19 bp, Homo sapiens
gactctgaaatatcccggg

SEQ ID NO: 6235737 - DNA, 15 bp, Homo sapiens
gactctgaaatctga

SEQ ID NO: 6235738 - DNA, 18 bp, Homo sapiens
gactctgaaatctgaaga

SEQ ID NO: 6235739 - DNA, 17 bp, Homo sapiens
gactctgaactggagct

SEQ ID NO: 6235740 - DNA, 18 bp, Homo sapiens
gactctgaactggagctg

SEQ ID NO: 6235741 - DNA, 23 bp, Homo sapiens
gactctgacctcttggccacaga

SEQ ID NO: 6235742 - DNA, 20 bp, Homo sapiens
gactctgagaaaatgcgaga

SEQ ID NO: 6235743 - DNA, 15 bp, Homo sapiens
gactctgagatgtgg

SEQ ID NO: 6235744 - DNA, 17 bp, Homo sapiens
gactctgagcgggaggc

SEQ ID NO: 6235745 - DNA, 19 bp, Homo sapiens
gactctgagctgctaggaa

SEQ ID NO: 6235746 - DNA, 18 bp, Homo sapiens
gactctgagtccactgct

SEQ ID NO: 6235747 - DNA, 20 bp, Homo sapiens
gactctgatcccatattctt

SEQ ID NO: 6235748 - DNA, 23 bp, Homo sapiens
gactctgatctctgtagtggccc

SEQ ID NO: 6235749 - DNA, 13 bp, Homo sapiens
gactctgatggaa

SEQ ID NO: 6235750 - DNA, 21 bp, Homo sapiens
gactctgatggaatgtgccac

SEQ ID NO: 6235751 - DNA, 24 bp, Homo sapiens
gactctgatggaatgtgccacctg

SEQ ID NO: 6235752 - DNA, 22 bp, Homo sapiens
gactctgcaagtgtctggagcg

SEQ ID NO: 6235753 - DNA, 23 bp, Homo sapiens
gactctgcagatagtgcctctgc

SEQ ID NO: 6235754 - DNA, 17 bp, Homo sapiens
gactctgccagggtggg

SEQ ID NO: 6235755 - DNA, 13 bp, Homo sapiens
gactctgccccct

SEQ ID NO: 6235756 - DNA, 14 bp, Homo sapiens
gactctgccccctg

SEQ ID NO: 6235757 - DNA, 16 bp, Homo sapiens
gactctgccccctgct

SEQ ID NO: 6235758 - DNA, 19 bp, Homo sapiens
gactctgccccctgctggc

SEQ ID NO: 6235759 - DNA, 13 bp, Homo sapiens
gactctgcccctt

SEQ ID NO: 6235760 - DNA, 17 bp, Homo sapiens
gactctgccccttctgt

SEQ ID NO: 6235761 - DNA, 12 bp, Homo sapiens
gactctgcctcc

SEQ ID NO: 6235762 - DNA, 17 bp, Homo sapiens
gactctgccttaatttt

SEQ ID NO: 6235763 - DNA, 20 bp, Homo sapiens
gactctgccttaatttttga

SEQ ID NO: 6235764 - DNA, 22 bp, Homo sapiens
gactctgccttaatttttgaaa

SEQ ID NO: 6235765 - DNA, 15 bp, Homo sapiens
gactctgccttccag

SEQ ID NO: 6235766 - DNA, 22 bp, Homo sapiens
gactctgccttttttcacagcc

SEQ ID NO: 6235767 - DNA, 14 bp, Homo sapiens
gactctgctagact

SEQ ID NO: 6235768 - DNA, 22 bp, Homo sapiens
gactctgctctcctcgggccct

SEQ ID NO: 6235769 - DNA, 19 bp, Homo sapiens
gactctgctgctcatggga

SEQ ID NO: 6235770 - DNA, 14 bp, Homo sapiens
gactctgcttggct

SEQ ID NO: 6235771 - DNA, 21 bp, Homo sapiens
gactctggaaccatcctctgt

SEQ ID NO: 6235772 - DNA, 17 bp, Homo sapiens
gactctggaagcccccc

SEQ ID NO: 6235773 - DNA, 12 bp, Homo sapiens
gactctggacca

SEQ ID NO: 6235774 - DNA, 18 bp, Homo sapiens
gactctggaccatgctga

SEQ ID NO: 6235775 - DNA, 16 bp, Homo sapiens
gactctggactgggaa

SEQ ID NO: 6235776 - DNA, 18 bp, Homo sapiens
gactctggaggtcatctg

SEQ ID NO: 6235777 - DNA, 20 bp, Homo sapiens
gactctggaggtcatctggc

SEQ ID NO: 6235778 - DNA, 21 bp, Homo sapiens
gactctggaggtcatctggcg

SEQ ID NO: 6235779 - DNA, 19 bp, Homo sapiens
gactctggcacagtgatgc

SEQ ID NO: 6235780 - DNA, 20 bp, Homo sapiens
gactctggcacagtgatgcc

SEQ ID NO: 6235781 - DNA, 13 bp, Homo sapiens
gactctggcactt

SEQ ID NO: 6235782 - DNA, 13 bp, Homo sapiens
gactctggccctg

SEQ ID NO: 6235783 - DNA, 16 bp, Homo sapiens
gactctggctgccaag

SEQ ID NO: 6235784 - DNA, 17 bp, Homo sapiens
gactctggcttggccta

SEQ ID NO: 6235785 - DNA, 12 bp, Homo sapiens
gactctgggcag

SEQ ID NO: 6235786 - DNA, 20 bp, Homo sapiens
gactctgggctatggacaca

SEQ ID NO: 6235787 - DNA, 22 bp, Homo sapiens
gactctgggggtggacatctga

SEQ ID NO: 6235788 - DNA, 16 bp, Homo sapiens
gactctggggtgcagc

SEQ ID NO: 6235789 - DNA, 17 bp, Homo sapiens
gactctggggtgcagct

SEQ ID NO: 6235790 - DNA, 20 bp, Homo sapiens
gactctggggtgcagcttca

SEQ ID NO: 6235791 - DNA, 22 bp, Homo sapiens
gactctggggtgcagcttcacc

SEQ ID NO: 6235792 - DNA, 14 bp, Homo sapiens
gactctgggtcctt

SEQ ID NO: 6235793 - DNA, 16 bp, Homo sapiens
gactctgggttcgttg

SEQ ID NO: 6235794 - DNA, 18 bp, Homo sapiens
gactctggtgcctccaga

SEQ ID NO: 6235795 - DNA, 17 bp, Homo sapiens
gactctggtggctgcca

SEQ ID NO: 6235796 - DNA, 22 bp, Homo sapiens
gactctgtaaccacctctctgt

SEQ ID NO: 6235797 - DNA, 24 bp, Homo sapiens
gactctgtcctgaaggcctgaggt

SEQ ID NO: 6235798 - DNA, 16 bp, Homo sapiens
gactctgtctcaaaaa

SEQ ID NO: 6235799 - DNA, 15 bp, Homo sapiens
gactctgtctggcca

SEQ ID NO: 6235800 - DNA, 16 bp, Homo sapiens
gactctgtgctgagca

SEQ ID NO: 6235801 - DNA, 21 bp, Homo sapiens
gactctgtgctggccagcgag

SEQ ID NO: 6235802 - DNA, 18 bp, Homo sapiens
gactctgtggggccttgg

SEQ ID NO: 6235803 - DNA, 19 bp, Homo sapiens
gactctgtgtggctgtgca

SEQ ID NO: 6235804 - DNA, 21 bp, Homo sapiens
gactctgtgtggctgtgcaat

SEQ ID NO: 6235805 - DNA, 21 bp, Homo sapiens
gactcttaagaagactgcatt

SEQ ID NO: 6235806 - DNA, 15 bp, Homo sapiens
gactcttacttttta

SEQ ID NO: 6235807 - DNA, 19 bp, Homo sapiens
gactcttatttatagaatt

SEQ ID NO: 6235808 - DNA, 14 bp, Homo sapiens
gactcttcactcca

SEQ ID NO: 6235809 - DNA, 20 bp, Homo sapiens
gactcttcactccaaaaaga

SEQ ID NO: 6235810 - DNA, 17 bp, Homo sapiens
gactcttccaccagagc

SEQ ID NO: 6235811 - DNA, 22 bp, Homo sapiens
gactcttccaccagagcagggg

SEQ ID NO: 6235812 - DNA, 23 bp, Homo sapiens
gactcttccaccagagcaggggc

SEQ ID NO: 6235813 - DNA, 10 bp, Homo sapiens
gactcttccc

SEQ ID NO: 6235814 - DNA, 14 bp, Homo sapiens
gactcttcccctcc

SEQ ID NO: 6235815 - DNA, 20 bp, Homo sapiens
gactcttccctctcgctccc

SEQ ID NO: 6235816 - DNA, 15 bp, Homo sapiens
gactcttccctggga

SEQ ID NO: 6235817 - DNA, 12 bp, Homo sapiens
gactcttcctgc

SEQ ID NO: 6235818 - DNA, 22 bp, Homo sapiens
gactcttctaaaaatgaagatg

SEQ ID NO: 6235819 - DNA, 19 bp, Homo sapiens
gactcttctcggctcaggc

SEQ ID NO: 6235820 - DNA, 20 bp, Homo sapiens
gactcttctcggctcaggct

SEQ ID NO: 6235821 - DNA, 14 bp, Homo sapiens
gactcttctctcaa

SEQ ID NO: 6235822 - DNA, 17 bp, Homo sapiens
gactcttctctcaacct

SEQ ID NO: 6235823 - DNA, 22 bp, Homo sapiens
gactcttgagccctcctggaat

SEQ ID NO: 6235824 - DNA, 14 bp, Homo sapiens
gactcttgcctttc

SEQ ID NO: 6235825 - DNA, 13 bp, Homo sapiens
gcagcggcgtcag

SEQ ID NO: 6235826 - DNA, 12 bp, Homo sapiens
gcagcggctcct

SEQ ID NO: 6235827 - DNA, 14 bp, Homo sapiens
gcagcggctcctgc

SEQ ID NO: 6235828 - DNA, 15 bp, Homo sapiens
gcagcggctcctgca

SEQ ID NO: 6235829 - DNA, 15 bp, Homo sapiens
gcagcggctctggtc

SEQ ID NO: 6235830 - DNA, 14 bp, Homo sapiens
gcagcgggccaggc

SEQ ID NO: 6235831 - DNA, 18 bp, Homo sapiens
gcagcgggccaggcccgc

SEQ ID NO: 6235832 - DNA, 13 bp, Homo sapiens
gcagcgggcggag

SEQ ID NO: 6235833 - DNA, 14 bp, Homo sapiens
gcagcgggcggagg

SEQ ID NO: 6235834 - DNA, 21 bp, Homo sapiens
gcagcggggcgaagcccaggc

SEQ ID NO: 6235835 - DNA, 13 bp, Homo sapiens
gcagcggggctgg

SEQ ID NO: 6235836 - DNA, 17 bp, Homo sapiens
gcagcggggctggccat

SEQ ID NO: 6235837 - DNA, 16 bp, Homo sapiens
gcagcgggggcggccc

SEQ ID NO: 6235838 - DNA, 21 bp, Homo sapiens
gcagcgggggcggcccagcct

SEQ ID NO: 6235839 - DNA, 18 bp, Homo sapiens
gcagcggtggaaggagcc

SEQ ID NO: 6235840 - DNA, 19 bp, Homo sapiens
gcagcggtggaaggagcct

SEQ ID NO: 6235841 - DNA, 20 bp, Homo sapiens
gcagcggtggaaggagcctg

SEQ ID NO: 6235842 - DNA, 21 bp, Homo sapiens
gcagcgtcccccgccgcgcca

SEQ ID NO: 6235843 - DNA, 16 bp, Homo sapiens
gcagcgtgcaggagca

SEQ ID NO: 6235844 - DNA, 15 bp, Homo sapiens
gcagcgtgccgagcc

SEQ ID NO: 6235845 - DNA, 18 bp, Homo sapiens
gcagcgtgccgagccagc

SEQ ID NO: 6235846 - DNA, 16 bp, Homo sapiens
gcagcgtgtgtgccac

SEQ ID NO: 6235847 - DNA, 23 bp, Homo sapiens
gcagctaacatgagtatcatcag

SEQ ID NO: 6235848 - DNA, 22 bp, Homo sapiens
gcagctaactccgagagcagtg

SEQ ID NO: 6235849 - DNA, 21 bp, Homo sapiens
gcagctaagatagaaagctgg

SEQ ID NO: 6235850 - DNA, 17 bp, Homo sapiens
gcagctaaggggcagga

SEQ ID NO: 6235851 - DNA, 11 bp, Homo sapiens
gcagctaccac

SEQ ID NO: 6235852 - DNA, 14 bp, Homo sapiens
gcagctagactgga

SEQ ID NO: 6235853 - DNA, 19 bp, Homo sapiens
gcagctagactggagtgag

SEQ ID NO: 6235854 - DNA, 22 bp, Homo sapiens
gcagctagactggagtgaggct

SEQ ID NO: 6235855 - DNA, 14 bp, Homo sapiens
gcagctaggactga

SEQ ID NO: 6235856 - DNA, 21 bp, Homo sapiens
gcagctaggactgaggagtgg

SEQ ID NO: 6235857 - DNA, 20 bp, Homo sapiens
gcagctagtcctagtgaacc

SEQ ID NO: 6235858 - DNA, 12 bp, Homo sapiens
gcagctagtgcc

SEQ ID NO: 6235859 - DNA, 14 bp, Homo sapiens
gcagctagtgcctt

SEQ ID NO: 6235860 - DNA, 19 bp, Homo sapiens
gcagctatgcgcaatgtgg

SEQ ID NO: 6235861 - DNA, 21 bp, Homo sapiens
gcagctatgcgcaatgtggca

SEQ ID NO: 6235862 - DNA, 14 bp, Homo sapiens
gcagctatggacaa

SEQ ID NO: 6235863 - DNA, 18 bp, Homo sapiens
gcagctattcacacacac

SEQ ID NO: 6235864 - DNA, 17 bp, Homo sapiens
gcagctatttcagcctc

SEQ ID NO: 6235865 - DNA, 17 bp, Homo sapiens
gcagctcaaaggcacag

SEQ ID NO: 6235866 - DNA, 18 bp, Homo sapiens
gcagctcaacctaccctg

SEQ ID NO: 6235867 - DNA, 17 bp, Homo sapiens
gcagctcaactttctgt

SEQ ID NO: 6235868 - DNA, 16 bp, Homo sapiens
gcagctcaagagatcc

SEQ ID NO: 6235869 - DNA, 17 bp, Homo sapiens
gcagctcaagggctggc

SEQ ID NO: 6235870 - DNA, 18 bp, Homo sapiens
gcagctcaagggctggca

SEQ ID NO: 6235871 - DNA, 19 bp, Homo sapiens
gcagctcaagggctggcac

SEQ ID NO: 6235872 - DNA, 19 bp, Homo sapiens
gcagctcacccctgggcag

SEQ ID NO: 6235873 - DNA, 15 bp, Homo sapiens
gcagctcacctctcc

SEQ ID NO: 6235874 - DNA, 21 bp, Homo sapiens
gcagctcacctctcccttgga

SEQ ID NO: 6235875 - DNA, 14 bp, Homo sapiens
gcagctcagagagg

SEQ ID NO: 6235876 - DNA, 16 bp, Homo sapiens
gcagctcaggcgcagc

SEQ ID NO: 6235877 - DNA, 13 bp, Homo sapiens
gcagctccaacct

SEQ ID NO: 6235878 - DNA, 17 bp, Homo sapiens
gcagctccaacctggag

SEQ ID NO: 6235879 - DNA, 23 bp, Homo sapiens
gcagctccaacctggaggctgga

SEQ ID NO: 6235880 - DNA, 20 bp, Homo sapiens
gcagctccaccactgtgcac

SEQ ID NO: 6235881 - DNA, 13 bp, Homo sapiens
gcagctccagctg

SEQ ID NO: 6235882 - DNA, 15 bp, Homo sapiens
gcagctcccattcta

SEQ ID NO: 6235883 - DNA, 12 bp, Homo sapiens
gcagctccccag

SEQ ID NO: 6235884 - DNA, 20 bp, Homo sapiens
gcagctccccaggagctcag

SEQ ID NO: 6235885 - DNA, 13 bp, Homo sapiens
gcagctccctcct

SEQ ID NO: 6235886 - DNA, 16 bp, Homo sapiens
gcagctccctcctcag

SEQ ID NO: 6235887 - DNA, 14 bp, Homo sapiens
gcagctccctcctg

SEQ ID NO: 6235888 - DNA, 16 bp, Homo sapiens
gcagctccgcctggca

SEQ ID NO: 6235889 - DNA, 20 bp, Homo sapiens
gcagctccgcctggcaccca

SEQ ID NO: 6235890 - DNA, 13 bp, Homo sapiens
gcagctcctcagc

SEQ ID NO: 6235891 - DNA, 14 bp, Homo sapiens
gcagctcctccctg

SEQ ID NO: 6235892 - DNA, 20 bp, Homo sapiens
gcagctcctccctgtgcccc

SEQ ID NO: 6235893 - DNA, 14 bp, Homo sapiens
gcagctcctctcct

SEQ ID NO: 6235894 - DNA, 17 bp, Homo sapiens
gcagctcctctccttgg

SEQ ID NO: 6235895 - DNA, 20 bp, Homo sapiens
gcagctcctctgtctcgagc

SEQ ID NO: 6235896 - DNA, 14 bp, Homo sapiens
gcagctctccagtc

SEQ ID NO: 6235897 - DNA, 15 bp, Homo sapiens
gcagctctccagtca

SEQ ID NO: 6235898 - DNA, 15 bp, Homo sapiens
gcagctctccccttc

SEQ ID NO: 6235899 - DNA, 21 bp, Homo sapiens
gcagctctgagccagattaca

SEQ ID NO: 6235900 - DNA, 14 bp, Homo sapiens
gcagctctgccttc

SEQ ID NO: 6235901 - DNA, 23 bp, Homo sapiens
gcagctcttcctggacaggccag

SEQ ID NO: 6235902 - DNA, 22 bp, Homo sapiens
gcagctcttctggagtttctct

SEQ ID NO: 6235903 - DNA, 22 bp, Homo sapiens
gcagctcttctgggcagagcct

SEQ ID NO: 6235904 - DNA, 16 bp, Homo sapiens
gcagctcttgcccttc

SEQ ID NO: 6235905 - DNA, 13 bp, Homo sapiens
gcagctcttgcta

SEQ ID NO: 6235906 - DNA, 18 bp, Homo sapiens
gcagctgaaatatgctgg

SEQ ID NO: 6235907 - DNA, 19 bp, Homo sapiens
gcagctgaaatatgctggc

SEQ ID NO: 6235908 - DNA, 21 bp, Homo sapiens
gcagctgaagcctggacgcag

SEQ ID NO: 6235909 - DNA, 21 bp, Homo sapiens
gcagctgaataacctgcacag

SEQ ID NO: 6235910 - DNA, 20 bp, Homo sapiens
gcagctgagaaaatgagtga

SEQ ID NO: 6235911 - DNA, 14 bp, Homo sapiens
gcagctgagagccc

SEQ ID NO: 6235912 - DNA, 23 bp, Homo sapiens
gcagctgagagccctgctgtggg

SEQ ID NO: 6235913 - DNA, 14 bp, Homo sapiens
gcagctgagcaggg

SEQ ID NO: 6235914 - DNA, 19 bp, Homo sapiens
gcagctgagcagggccggg

SEQ ID NO: 6235915 - DNA, 17 bp, Homo sapiens
gcagctgagcctgagcc

SEQ ID NO: 6235916 - DNA, 19 bp, Homo sapiens
gcagctgaggccccagggc

SEQ ID NO: 6235917 - DNA, 21 bp, Homo sapiens
gcagctgatgttggaagagaa

SEQ ID NO: 6235918 - DNA, 18 bp, Homo sapiens
gcagctgattttaacaat

SEQ ID NO: 6235919 - DNA, 16 bp, Homo sapiens
gcagctgcaccatcac

SEQ ID NO: 6235920 - DNA, 14 bp, Homo sapiens
gcagctgccagaga

SEQ ID NO: 6235921 - DNA, 12 bp, Homo sapiens
gcagctgcccct

SEQ ID NO: 6235922 - DNA, 20 bp, Homo sapiens
gcagctgcccctcctggagc

SEQ ID NO: 6235923 - DNA, 16 bp, Homo sapiens
gcagctgcccctggca

SEQ ID NO: 6235924 - DNA, 17 bp, Homo sapiens
gcagctgcccctggcac

SEQ ID NO: 6235925 - DNA, 22 bp, Homo sapiens
gcagctgcccctggcacctgtg

SEQ ID NO: 6235926 - DNA, 17 bp, Homo sapiens
gcagctgcctcccctcc

SEQ ID NO: 6235927 - DNA, 12 bp, Homo sapiens
gcagctgcctct

SEQ ID NO: 6235928 - DNA, 15 bp, Homo sapiens
gcagctgcctggggc

SEQ ID NO: 6235929 - DNA, 16 bp, Homo sapiens
gcagctgcctggggcc

SEQ ID NO: 6235930 - DNA, 19 bp, Homo sapiens
gcagctgcgggtctgaagg

SEQ ID NO: 6235931 - DNA, 22 bp, Homo sapiens
gcagctgcggtccacccaggag

SEQ ID NO: 6235932 - DNA, 14 bp, Homo sapiens
gcagctgctcccca

SEQ ID NO: 6235933 - DNA, 22 bp, Homo sapiens
gcagctgctccccaggccaccc

SEQ ID NO: 6235934 - DNA, 11 bp, Homo sapiens
gcagctgctgc

SEQ ID NO: 6235935 - DNA, 12 bp, Homo sapiens
gcagctgctgcc

SEQ ID NO: 6235936 - DNA, 15 bp, Homo sapiens
gcagctgctgccact

SEQ ID NO: 6235937 - DNA, 22 bp, Homo sapiens
gcagctgctgccactctgctgc

SEQ ID NO: 6235938 - DNA, 12 bp, Homo sapiens
gcagctgctgtg

SEQ ID NO: 6235939 - DNA, 20 bp, Homo sapiens
gcagctgcttttgtctatgg

SEQ ID NO: 6235940 - DNA, 17 bp, Homo sapiens
gcagctggaatgtgcca

SEQ ID NO: 6235941 - DNA, 12 bp, Homo sapiens
gcagctggacag

SEQ ID NO: 6235942 - DNA, 15 bp, Homo sapiens
gcagctggacagagg

SEQ ID NO: 6235943 - DNA, 17 bp, Homo sapiens
gcagctggacagagggg

SEQ ID NO: 6235944 - DNA, 16 bp, Homo sapiens
gcagctggactctgca

SEQ ID NO: 6235945 - DNA, 12 bp, Homo sapiens
gcagctggcact

SEQ ID NO: 6235946 - DNA, 12 bp, Homo sapiens
gcagctggcaga

SEQ ID NO: 6235947 - DNA, 18 bp, Homo sapiens
gcagctggcaggagagag

SEQ ID NO: 6235948 - DNA, 23 bp, Homo sapiens
gcagctggcaggagtggggtggt

SEQ ID NO: 6235949 - DNA, 23 bp, Homo sapiens
gcagctggcccactgctggctgc

SEQ ID NO: 6235950 - DNA, 16 bp, Homo sapiens
gcagctggcccccagc

SEQ ID NO: 6235951 - DNA, 19 bp, Homo sapiens
gcagctggcccccagccct

SEQ ID NO: 6235952 - DNA, 13 bp, Homo sapiens
gcagctggctctc

SEQ ID NO: 6235953 - DNA, 22 bp, Homo sapiens
gcagctgggacccctcccaacc

SEQ ID NO: 6235954 - DNA, 20 bp, Homo sapiens
gcagctgggatttgaaccag

SEQ ID NO: 6235955 - DNA, 16 bp, Homo sapiens
gcagctgggcccaacc

SEQ ID NO: 6235956 - DNA, 22 bp, Homo sapiens
gcagctgggcccacagccccca

SEQ ID NO: 6235957 - DNA, 18 bp, Homo sapiens
gcagctgggccccaccta

SEQ ID NO: 6235958 - DNA, 18 bp, Homo sapiens
gcagctgggccccatgct

SEQ ID NO: 6235959 - DNA, 21 bp, Homo sapiens
gcagctgggccccatgctctg

SEQ ID NO: 6235960 - DNA, 19 bp, Homo sapiens
gcagctgggccggccagcc

SEQ ID NO: 6235961 - DNA, 21 bp, Homo sapiens
gcagctgggcttggcctggag

SEQ ID NO: 6235962 - DNA, 18 bp, Homo sapiens
gcagctggggagcagctg

SEQ ID NO: 6235963 - DNA, 19 bp, Homo sapiens
gcagctgggtgcagaagct

SEQ ID NO: 6235964 - DNA, 21 bp, Homo sapiens
gcagctggtcagtctttgctc

SEQ ID NO: 6235965 - DNA, 23 bp, Homo sapiens
gcagctggtcagtctttgctcag

SEQ ID NO: 6235966 - DNA, 15 bp, Homo sapiens
gcagctggtgcccca

SEQ ID NO: 6235967 - DNA, 23 bp, Homo sapiens
gcagctggtgccccacctgcctg

SEQ ID NO: 6235968 - DNA, 14 bp, Homo sapiens
gcagctggtgtggg

SEQ ID NO: 6235969 - DNA, 19 bp, Homo sapiens
gcagctggttctgcaatga

SEQ ID NO: 6235970 - DNA, 18 bp, Homo sapiens
gcagctgtagctcccgag

SEQ ID NO: 6235971 - DNA, 20 bp, Homo sapiens
gcagctgtcatggaaaagcc

SEQ ID NO: 6235972 - DNA, 23 bp, Homo sapiens
gcagctgtcatggaaaagcccag

SEQ ID NO: 6235973 - DNA, 20 bp, Homo sapiens
gcagctgtcccctctccctg

SEQ ID NO: 6235974 - DNA, 15 bp, Homo sapiens
gcagctgtcctgaac

SEQ ID NO: 6235975 - DNA, 23 bp, Homo sapiens
gcagctgtgagtgcgtgtgtgtg

SEQ ID NO: 6235976 - DNA, 11 bp, Homo sapiens
gcagctgtgat

SEQ ID NO: 6235977 - DNA, 14 bp, Homo sapiens
gcagctgttagagt

SEQ ID NO: 6235978 - DNA, 20 bp, Homo sapiens
gcagctgttgtctcttctcc

SEQ ID NO: 6235979 - DNA, 21 bp, Homo sapiens
gcagctgttttagttaaattt

SEQ ID NO: 6235980 - DNA, 18 bp, Homo sapiens
gcagctgttttcaaagcc

SEQ ID NO: 6235981 - DNA, 19 bp, Homo sapiens
gcagctgttttcaaagccc

SEQ ID NO: 6235982 - DNA, 17 bp, Homo sapiens
gcagcttagggccctgg

SEQ ID NO: 6235983 - DNA, 13 bp, Homo sapiens
gcagcttcaaaac

SEQ ID NO: 6235984 - DNA, 17 bp, Homo sapiens
gcagcttcaagtgcctt

SEQ ID NO: 6235985 - DNA, 19 bp, Homo sapiens
gcagcttcacccaccaggc

SEQ ID NO: 6235986 - DNA, 18 bp, Homo sapiens
gcagcttcaggtgagcca

SEQ ID NO: 6235987 - DNA, 19 bp, Homo sapiens
gcagcttcagtctctgcag

SEQ ID NO: 6235988 - DNA, 13 bp, Homo sapiens
gcagcttcagttg

SEQ ID NO: 6235989 - DNA, 18 bp, Homo sapiens
gcagcttcatcaattttt

SEQ ID NO: 6235990 - DNA, 23 bp, Homo sapiens
gcagcttcatcaatttttataca

SEQ ID NO: 6235991 - DNA, 13 bp, Homo sapiens
gcagcttcctgtc

SEQ ID NO: 6235992 - DNA, 16 bp, Homo sapiens
gcagcttccttccaag

SEQ ID NO: 6235993 - DNA, 14 bp, Homo sapiens
gcagcttcgaggac

SEQ ID NO: 6235994 - DNA, 21 bp, Homo sapiens
gcagcttcgaggacaggaaag

SEQ ID NO: 6235995 - DNA, 19 bp, Homo sapiens
gcagcttcggtgtgcagat

SEQ ID NO: 6235996 - DNA, 17 bp, Homo sapiens
gcagcttctaagagcga

SEQ ID NO: 6235997 - DNA, 20 bp, Homo sapiens
gcagcttctgccacttccca

SEQ ID NO: 6235998 - DNA, 16 bp, Homo sapiens
gcagcttctgttggca

SEQ ID NO: 6235999 - DNA, 16 bp, Homo sapiens
gcagcttcttgggctg

SEQ ID NO: 6236000 - DNA, 21 bp, Homo sapiens
gcagcttgacattatgtttta

SEQ ID NO: 6236001 - DNA, 15 bp, Homo sapiens
gcagcttgagagggc

SEQ ID NO: 6236002 - DNA, 13 bp, Homo sapiens
gcagcttgcagtc

SEQ ID NO: 6236003 - DNA, 14 bp, Homo sapiens
gcagcttgccccgg

SEQ ID NO: 6236004 - DNA, 13 bp, Homo sapiens
gactcttgctcct

SEQ ID NO: 6236005 - DNA, 12 bp, Homo sapiens
gactcttgctct

SEQ ID NO: 6236006 - DNA, 21 bp, Homo sapiens
gactctttaataaattgctta

SEQ ID NO: 6236007 - DNA, 23 bp, Homo sapiens
gactctttatttttctctttctc

SEQ ID NO: 6236008 - DNA, 13 bp, Homo sapiens
gactctttcaaag

SEQ ID NO: 6236009 - DNA, 14 bp, Homo sapiens
gactctttcaaaga

SEQ ID NO: 6236010 - DNA, 16 bp, Homo sapiens
gactctttcaaagaaa

SEQ ID NO: 6236011 - DNA, 19 bp, Homo sapiens
gactctttcctaaagccaa

SEQ ID NO: 6236012 - DNA, 19 bp, Homo sapiens
gactctttctgaaggaaga

SEQ ID NO: 6236013 - DNA, 21 bp, Homo sapiens
gactctttctgaaggaagaga

SEQ ID NO: 6236014 - DNA, 21 bp, Homo sapiens
gactctttctgagtgccttct

SEQ ID NO: 6236015 - DNA, 19 bp, Homo sapiens
gactctttgcaacagcact

SEQ ID NO: 6236016 - DNA, 13 bp, Homo sapiens
gactctttgctgt

SEQ ID NO: 6236017 - DNA, 19 bp, Homo sapiens
gactctttggtggctttgc

SEQ ID NO: 6236018 - DNA, 20 bp, Homo sapiens
gactctttggtggctttgca

SEQ ID NO: 6236019 - DNA, 19 bp, Homo sapiens
gactctttttagggccagg

SEQ ID NO: 6236020 - DNA, 20 bp, Homo sapiens
gactctttttagggccaggc

SEQ ID NO: 6236021 - DNA, 22 bp, Homo sapiens
gactctttttagggccaggcag

SEQ ID NO: 6236022 - DNA, 20 bp, Homo sapiens
gactctttttttgagtgaca

SEQ ID NO: 6236023 - DNA, 22 bp, Homo sapiens
gactgaaaaaaaaaaagaagaa

SEQ ID NO: 6236024 - DNA, 17 bp, Homo sapiens
gactgaaaacctctcct

SEQ ID NO: 6236025 - DNA, 18 bp, Homo sapiens
gactgaaaacctctcctc

SEQ ID NO: 6236026 - DNA, 17 bp, Homo sapiens
gactgaaacgccttgca

SEQ ID NO: 6236027 - DNA, 15 bp, Homo sapiens
gactgaaagaaacta

SEQ ID NO: 6236028 - DNA, 23 bp, Homo sapiens
gactgaaagaaactaagatttat

SEQ ID NO: 6236029 - DNA, 14 bp, Homo sapiens
gactgaaagaagaa

SEQ ID NO: 6236030 - DNA, 14 bp, Homo sapiens
gactgaaagcagca

SEQ ID NO: 6236031 - DNA, 18 bp, Homo sapiens
gactgaaagcagcagcta

SEQ ID NO: 6236032 - DNA, 19 bp, Homo sapiens
gactgaaatggcttctatg

SEQ ID NO: 6236033 - DNA, 17 bp, Homo sapiens
gactgaaattactttaa

SEQ ID NO: 6236034 - DNA, 21 bp, Homo sapiens
gactgaaattactttaacatt

SEQ ID NO: 6236035 - DNA, 13 bp, Homo sapiens
gactgaaatttag

SEQ ID NO: 6236036 - DNA, 21 bp, Homo sapiens
gactgaacattagttgcacta

SEQ ID NO: 6236037 - DNA, 19 bp, Homo sapiens
gactgaagaagatgagcct

SEQ ID NO: 6236038 - DNA, 21 bp, Homo sapiens
gactgaagcgaacatcttcat

SEQ ID NO: 6236039 - DNA, 19 bp, Homo sapiens
gactgaagtaataactgat

SEQ ID NO: 6236040 - DNA, 22 bp, Homo sapiens
gactgaatgctgttaatatttc

SEQ ID NO: 6236041 - DNA, 12 bp, Homo sapiens
gactgaatgttt

SEQ ID NO: 6236042 - DNA, 16 bp, Homo sapiens
gactgaatgttttatt

SEQ ID NO: 6236043 - DNA, 17 bp, Homo sapiens
gactgaatgttttattt

SEQ ID NO: 6236044 - DNA, 19 bp, Homo sapiens
gactgaatgttttatttat

SEQ ID NO: 6236045 - DNA, 12 bp, Homo sapiens
gactgaattcca

SEQ ID NO: 6236046 - DNA, 22 bp, Homo sapiens
gactgaatttaactactaagaa

SEQ ID NO: 6236047 - DNA, 14 bp, Homo sapiens
gactgaatttctat

SEQ ID NO: 6236048 - DNA, 16 bp, Homo sapiens
gactgaatttcttttg

SEQ ID NO: 6236049 - DNA, 17 bp, Homo sapiens
gactgaatttgggcctc

SEQ ID NO: 6236050 - DNA, 15 bp, Homo sapiens
gactgacacaggcca

SEQ ID NO: 6236051 - DNA, 17 bp, Homo sapiens
gactgacacaggccagc

SEQ ID NO: 6236052 - DNA, 19 bp, Homo sapiens
gactgacacaggccagccc

SEQ ID NO: 6236053 - DNA, 23 bp, Homo sapiens
gactgacacaggccagccccatc

SEQ ID NO: 6236054 - DNA, 16 bp, Homo sapiens
gactgacacctcactg

SEQ ID NO: 6236055 - DNA, 17 bp, Homo sapiens
gactgacacctcactga

SEQ ID NO: 6236056 - DNA, 14 bp, Homo sapiens
gactgacagcatgt

SEQ ID NO: 6236057 - DNA, 18 bp, Homo sapiens
gactgaccaaagactgca

SEQ ID NO: 6236058 - DNA, 22 bp, Homo sapiens
gactgaccaaagactgcagaac

SEQ ID NO: 6236059 - DNA, 13 bp, Homo sapiens
gactgaccagcag

SEQ ID NO: 6236060 - DNA, 15 bp, Homo sapiens
gactgaccagcagct

SEQ ID NO: 6236061 - DNA, 15 bp, Homo sapiens
gactgacccaaaatg

SEQ ID NO: 6236062 - DNA, 16 bp, Homo sapiens
gactgacccccatctg

SEQ ID NO: 6236063 - DNA, 21 bp, Homo sapiens
gactgacccccatctgagctg

SEQ ID NO: 6236064 - DNA, 15 bp, Homo sapiens
gactgaccctgagga

SEQ ID NO: 6236065 - DNA, 19 bp, Homo sapiens
gactgaccctgaggaggcc

SEQ ID NO: 6236066 - DNA, 23 bp, Homo sapiens
gactgaccctgaggaggccgctt

SEQ ID NO: 6236067 - DNA, 16 bp, Homo sapiens
gactgacctgcccctg

SEQ ID NO: 6236068 - DNA, 15 bp, Homo sapiens
gactgacctggtcca

SEQ ID NO: 6236069 - DNA, 22 bp, Homo sapiens
gactgacctggtccacagggca

SEQ ID NO: 6236070 - DNA, 23 bp, Homo sapiens
gactgacctggtccacagggcac

SEQ ID NO: 6236071 - DNA, 19 bp, Homo sapiens
gactgaccttgatgagctg

SEQ ID NO: 6236072 - DNA, 19 bp, Homo sapiens
gactgaccttgatgtcttg

SEQ ID NO: 6236073 - DNA, 14 bp, Homo sapiens
gactgactgaggca

SEQ ID NO: 6236074 - DNA, 12 bp, Homo sapiens
gactgactgtgt

SEQ ID NO: 6236075 - DNA, 15 bp, Homo sapiens
gactgagaaccgtga

SEQ ID NO: 6236076 - DNA, 17 bp, Homo sapiens
gactgagcaccctctgg

SEQ ID NO: 6236077 - DNA, 14 bp, Homo sapiens
gactgagcacctgc

SEQ ID NO: 6236078 - DNA, 16 bp, Homo sapiens
gactgagcacctgctt

SEQ ID NO: 6236079 - DNA, 16 bp, Homo sapiens
gactgagcagccgcca

SEQ ID NO: 6236080 - DNA, 13 bp, Homo sapiens
gactgagccctct

SEQ ID NO: 6236081 - DNA, 23 bp, Homo sapiens
gactgagccctctcactccagcc

SEQ ID NO: 6236082 - DNA, 22 bp, Homo sapiens
gactgagcggccgcagagactg

SEQ ID NO: 6236083 - DNA, 19 bp, Homo sapiens
gactgagctctccaggcca

SEQ ID NO: 6236084 - DNA, 15 bp, Homo sapiens
gactgagggactctg

SEQ ID NO: 6236085 - DNA, 17 bp, Homo sapiens
gactgagggcagtgccc

SEQ ID NO: 6236086 - DNA, 14 bp, Homo sapiens
gactgaggtgcctg

SEQ ID NO: 6236087 - DNA, 16 bp, Homo sapiens
gactgaggtgcctgct

SEQ ID NO: 6236088 - DNA, 23 bp, Homo sapiens
gactgaggtgcctgctcaggtgc

SEQ ID NO: 6236089 - DNA, 19 bp, Homo sapiens
gactgagtaagaaatgctg

SEQ ID NO: 6236090 - DNA, 23 bp, Homo sapiens
gactgagtacgttgtgcatttgg

SEQ ID NO: 6236091 - DNA, 15 bp, Homo sapiens
gactgagtcagatgg

SEQ ID NO: 6236092 - DNA, 15 bp, Homo sapiens
gactgagtgggaagc

SEQ ID NO: 6236093 - DNA, 16 bp, Homo sapiens
gactgagtgggaagcc

SEQ ID NO: 6236094 - DNA, 17 bp, Homo sapiens
gactgagtgggaagccc

SEQ ID NO: 6236095 - DNA, 19 bp, Homo sapiens
gactgagtgtgggagtgca

SEQ ID NO: 6236096 - DNA, 23 bp, Homo sapiens
gactgatagcttacactgaggac

SEQ ID NO: 6236097 - DNA, 20 bp, Homo sapiens
gactgatcctgaacaagaaa

SEQ ID NO: 6236098 - DNA, 21 bp, Homo sapiens
gactgatcctgaacaagaaag

SEQ ID NO: 6236099 - DNA, 22 bp, Homo sapiens
gactgatcctgaacaagaaaga

SEQ ID NO: 6236100 - DNA, 16 bp, Homo sapiens
gactgatctcgatgca

SEQ ID NO: 6236101 - DNA, 14 bp, Homo sapiens
gactgatggccagg

SEQ ID NO: 6236102 - DNA, 17 bp, Homo sapiens
gactgatggccaggcaa

SEQ ID NO: 6236103 - DNA, 16 bp, Homo sapiens
gactgatggttgcttt

SEQ ID NO: 6236104 - DNA, 18 bp, Homo sapiens
gactgatggtttggaaaa

SEQ ID NO: 6236105 - DNA, 19 bp, Homo sapiens
gactgatggtttggaaaat

SEQ ID NO: 6236106 - DNA, 17 bp, Homo sapiens
gactgatgtcatcttga

SEQ ID NO: 6236107 - DNA, 17 bp, Homo sapiens
gactgatgtctcctaag

SEQ ID NO: 6236108 - DNA, 20 bp, Homo sapiens
gactgatgttaggctgggcc

SEQ ID NO: 6236109 - DNA, 23 bp, Homo sapiens
gactgatgttcatgatagaaaga

SEQ ID NO: 6236110 - DNA, 16 bp, Homo sapiens
gactgattctgtggct

SEQ ID NO: 6236111 - DNA, 20 bp, Homo sapiens
gactgattctgttgtgttca

SEQ ID NO: 6236112 - DNA, 14 bp, Homo sapiens
gactgattggcctg

SEQ ID NO: 6236113 - DNA, 16 bp, Homo sapiens
gactgattgttttaaa

SEQ ID NO: 6236114 - DNA, 13 bp, Homo sapiens
gactgatttcaaa

SEQ ID NO: 6236115 - DNA, 13 bp, Homo sapiens
gactgatttgtgg

SEQ ID NO: 6236116 - DNA, 13 bp, Homo sapiens
gactgattttaat

SEQ ID NO: 6236117 - DNA, 15 bp, Homo sapiens
gactgcaaacttttt

SEQ ID NO: 6236118 - DNA, 23 bp, Homo sapiens
gactgcaaagccagtgctgtctg

SEQ ID NO: 6236119 - DNA, 21 bp, Homo sapiens
gactgcaacttctgtcccttg

SEQ ID NO: 6236120 - DNA, 24 bp, Homo sapiens
gactgcacacagctaggcatgcct

SEQ ID NO: 6236121 - DNA, 16 bp, Homo sapiens
gactgcacaggagaat

SEQ ID NO: 6236122 - DNA, 15 bp, Homo sapiens
gactgcacccaggag

SEQ ID NO: 6236123 - DNA, 16 bp, Homo sapiens
gactgcacccaggagg

SEQ ID NO: 6236124 - DNA, 17 bp, Homo sapiens
gactgcacccaggaggg

SEQ ID NO: 6236125 - DNA, 13 bp, Homo sapiens
gactgcaccttgt

SEQ ID NO: 6236126 - DNA, 20 bp, Homo sapiens
gactgcagacattctcaaag

SEQ ID NO: 6236127 - DNA, 12 bp, Homo sapiens
gactgcagagga

SEQ ID NO: 6236128 - DNA, 14 bp, Homo sapiens
gactgcagagggct

SEQ ID NO: 6236129 - DNA, 16 bp, Homo sapiens
gactgcagaggggaaa

SEQ ID NO: 6236130 - DNA, 20 bp, Homo sapiens
gactgcagccactgattctc

SEQ ID NO: 6236131 - DNA, 15 bp, Homo sapiens
gactgcagctgctga

SEQ ID NO: 6236132 - DNA, 19 bp, Homo sapiens
gactgcaggtgggctgggc

SEQ ID NO: 6236133 - DNA, 20 bp, Homo sapiens
gactgcaggtgggctgggcc

SEQ ID NO: 6236134 - DNA, 22 bp, Homo sapiens
gactgcaggttggaccccagag

SEQ ID NO: 6236135 - DNA, 16 bp, Homo sapiens
gactgcagtgtggagt

SEQ ID NO: 6236136 - DNA, 20 bp, Homo sapiens
gactgcatggggaggcagca

SEQ ID NO: 6236137 - DNA, 20 bp, Homo sapiens
gactgcatttaaatttgatt

SEQ ID NO: 6236138 - DNA, 12 bp, Homo sapiens
gactgcatttgt

SEQ ID NO: 6236139 - DNA, 20 bp, Homo sapiens
gactgcattttactgtacag

SEQ ID NO: 6236140 - DNA, 20 bp, Homo sapiens
gactgccaagactgctgtgg

SEQ ID NO: 6236141 - DNA, 14 bp, Homo sapiens
gactgccaagcagc

SEQ ID NO: 6236142 - DNA, 13 bp, Homo sapiens
gactgccaagcca

SEQ ID NO: 6236143 - DNA, 14 bp, Homo sapiens
gactgccaagccag

SEQ ID NO: 6236144 - DNA, 16 bp, Homo sapiens
gactgccaagccagat

SEQ ID NO: 6236145 - DNA, 19 bp, Homo sapiens
gactgccacaaggaagaaa

SEQ ID NO: 6236146 - DNA, 13 bp, Homo sapiens
gactgccacctcc

SEQ ID NO: 6236147 - DNA, 14 bp, Homo sapiens
gactgcccaccctg

SEQ ID NO: 6236148 - DNA, 19 bp, Homo sapiens
gactgcccaccctgggcct

SEQ ID NO: 6236149 - DNA, 22 bp, Homo sapiens
gactgcccaccctgggcctccc

SEQ ID NO: 6236150 - DNA, 20 bp, Homo sapiens
gactgcccagaaagtggggg

SEQ ID NO: 6236151 - DNA, 11 bp, Homo sapiens
gactgcccagc

SEQ ID NO: 6236152 - DNA, 22 bp, Homo sapiens
gactgcccagccactccaagcc

SEQ ID NO: 6236153 - DNA, 14 bp, Homo sapiens
gactgccccagcca

SEQ ID NO: 6236154 - DNA, 14 bp, Homo sapiens
gactgcccccagaa

SEQ ID NO: 6236155 - DNA, 15 bp, Homo sapiens
gactgccccgtgcag

SEQ ID NO: 6236156 - DNA, 23 bp, Homo sapiens
gactgcccctgctgtgctgctca

SEQ ID NO: 6236157 - DNA, 17 bp, Homo sapiens
gactgccctcttactgt

SEQ ID NO: 6236158 - DNA, 19 bp, Homo sapiens
gactgccgaccgaggctgg

SEQ ID NO: 6236159 - DNA, 13 bp, Homo sapiens
gactgcctctgcc

SEQ ID NO: 6236160 - DNA, 14 bp, Homo sapiens
gactgcctgtctgc

SEQ ID NO: 6236161 - DNA, 16 bp, Homo sapiens
gactgccttgcctcct

SEQ ID NO: 6236162 - DNA, 17 bp, Homo sapiens
gactgccttgcctcctc

SEQ ID NO: 6236163 - DNA, 24 bp, Homo sapiens
gactgcgccacggcactccagcct

SEQ ID NO: 6236164 - DNA, 20 bp, Homo sapiens
gactgcgctgctttttcaaa

SEQ ID NO: 6236165 - DNA, 16 bp, Homo sapiens
gactgcggagcagcct

SEQ ID NO: 6236166 - DNA, 15 bp, Homo sapiens
gactgcggaggaagg

SEQ ID NO: 6236167 - DNA, 16 bp, Homo sapiens
gactgcgggagccaga

SEQ ID NO: 6236168 - DNA, 19 bp, Homo sapiens
gactgcgggagccagactg

SEQ ID NO: 6236169 - DNA, 15 bp, Homo sapiens
gactgcgttctgcaa

SEQ ID NO: 6236170 - DNA, 21 bp, Homo sapiens
gactgctacctctgagaagac

SEQ ID NO: 6236171 - DNA, 16 bp, Homo sapiens
gactgctagtgttctg

SEQ ID NO: 6236172 - DNA, 20 bp, Homo sapiens
gactgctagtgttctgtcta

SEQ ID NO: 6236173 - DNA, 17 bp, Homo sapiens
gactgctatcagtctct

SEQ ID NO: 6236174 - DNA, 19 bp, Homo sapiens
gactgctcagaacttgctg

SEQ ID NO: 6236175 - DNA, 15 bp, Homo sapiens
gactgctcaggcctc

SEQ ID NO: 6236176 - DNA, 16 bp, Homo sapiens
gactgctcaggctccc

SEQ ID NO: 6236177 - DNA, 18 bp, Homo sapiens
gactgctcaggctcccca

SEQ ID NO: 6236178 - DNA, 22 bp, Homo sapiens
gactgctcaggctccccaagac

SEQ ID NO: 6236179 - DNA, 15 bp, Homo sapiens
gactgctccccagcc

SEQ ID NO: 6236180 - DNA, 19 bp, Homo sapiens
gactgctccccagccctgg

SEQ ID NO: 6236181 - DNA, 21 bp, Homo sapiens
gactgctccccagccctggct

SEQ ID NO: 6236182 - DNA, 15 bp, Homo sapiens
gcagcttgctgcacc

SEQ ID NO: 6236183 - DNA, 12 bp, Homo sapiens
gcagcttgctgg

SEQ ID NO: 6236184 - DNA, 21 bp, Homo sapiens
gcagcttggagaactccgctg

SEQ ID NO: 6236185 - DNA, 22 bp, Homo sapiens
gcagcttggctgagccccctct

SEQ ID NO: 6236186 - DNA, 18 bp, Homo sapiens
gcagcttgggctggcggg

SEQ ID NO: 6236187 - DNA, 19 bp, Homo sapiens
gcagcttgggctggcgggc

SEQ ID NO: 6236188 - DNA, 15 bp, Homo sapiens
gcagcttggggagag

SEQ ID NO: 6236189 - DNA, 19 bp, Homo sapiens
gcagctttaaactcaggga

SEQ ID NO: 6236190 - DNA, 22 bp, Homo sapiens
gcagctttaaactcagggacag

SEQ ID NO: 6236191 - DNA, 22 bp, Homo sapiens
gcagctttaaccattaaaactg

SEQ ID NO: 6236192 - DNA, 14 bp, Homo sapiens
gcagctttctagaa

SEQ ID NO: 6236193 - DNA, 13 bp, Homo sapiens
gcagctttgctca

SEQ ID NO: 6236194 - DNA, 18 bp, Homo sapiens
gcagctttggctgcacgt

SEQ ID NO: 6236195 - DNA, 22 bp, Homo sapiens
gcagctttggctgcacgtcacc

SEQ ID NO: 6236196 - DNA, 12 bp, Homo sapiens
gcagctttggga

SEQ ID NO: 6236197 - DNA, 15 bp, Homo sapiens
gcagctttgggatcc

SEQ ID NO: 6236198 - DNA, 16 bp, Homo sapiens
gcagcttttaaaagat

SEQ ID NO: 6236199 - DNA, 22 bp, Homo sapiens
gcagcttttggtctccttgggc

SEQ ID NO: 6236200 - DNA, 17 bp, Homo sapiens
gcagctttttctgtgga

SEQ ID NO: 6236201 - DNA, 21 bp, Homo sapiens
gcagctttttctgtggaggac

SEQ ID NO: 6236202 - DNA, 22 bp, Homo sapiens
gcaggaaaaggctaagaaaaag

SEQ ID NO: 6236203 - DNA, 18 bp, Homo sapiens
gcaggaaaaggctgcagc

SEQ ID NO: 6236204 - DNA, 23 bp, Homo sapiens
gcaggaaaaggtgatatccattc

SEQ ID NO: 6236205 - DNA, 14 bp, Homo sapiens
gcaggaaagccaca

SEQ ID NO: 6236206 - DNA, 15 bp, Homo sapiens
gcaggaaagccacat

SEQ ID NO: 6236207 - DNA, 14 bp, Homo sapiens
gcaggaacagagac

SEQ ID NO: 6236208 - DNA, 16 bp, Homo sapiens
gcaggaacagagactc

SEQ ID NO: 6236209 - DNA, 19 bp, Homo sapiens
gcaggaacagagactctgg

SEQ ID NO: 6236210 - DNA, 16 bp, Homo sapiens
gcaggaacatacagac

SEQ ID NO: 6236211 - DNA, 19 bp, Homo sapiens
gcaggaacccatctaaacc

SEQ ID NO: 6236212 - DNA, 22 bp, Homo sapiens
gcaggaaccgaggactccaggg

SEQ ID NO: 6236213 - DNA, 15 bp, Homo sapiens
gcaggaacgagcact

SEQ ID NO: 6236214 - DNA, 16 bp, Homo sapiens
gcaggaacgagcactg

SEQ ID NO: 6236215 - DNA, 19 bp, Homo sapiens
gcaggaacgagcactggcc

SEQ ID NO: 6236216 - DNA, 21 bp, Homo sapiens
gcaggaacgagcactggccag

SEQ ID NO: 6236217 - DNA, 22 bp, Homo sapiens
gcaggaacggtggaggcagagg

SEQ ID NO: 6236218 - DNA, 14 bp, Homo sapiens
gcaggaactcccag

SEQ ID NO: 6236219 - DNA, 16 bp, Homo sapiens
gcaggaactctggacc

SEQ ID NO: 6236220 - DNA, 19 bp, Homo sapiens
gcaggaacttctagctcat

SEQ ID NO: 6236221 - DNA, 20 bp, Homo sapiens
gcaggaacttctagctcatt

SEQ ID NO: 6236222 - DNA, 14 bp, Homo sapiens
gcaggaagagagag

SEQ ID NO: 6236223 - DNA, 21 bp, Homo sapiens
gcaggaagagagagagagagg

SEQ ID NO: 6236224 - DNA, 22 bp, Homo sapiens
gcaggaagagagagagagaggt

SEQ ID NO: 6236225 - DNA, 18 bp, Homo sapiens
gcaggaagagatgctcta

SEQ ID NO: 6236226 - DNA, 16 bp, Homo sapiens
gcaggaagaggcccac

SEQ ID NO: 6236227 - DNA, 17 bp, Homo sapiens
gcaggaagaggcccact

SEQ ID NO: 6236228 - DNA, 22 bp, Homo sapiens
gcaggaagatgtatgctttgaa

SEQ ID NO: 6236229 - DNA, 17 bp, Homo sapiens
gcaggaagcaaggccag

SEQ ID NO: 6236230 - DNA, 20 bp, Homo sapiens
gcaggaagcaaggccagccc

SEQ ID NO: 6236231 - DNA, 20 bp, Homo sapiens
gcaggaagccaggctgagtg

SEQ ID NO: 6236232 - DNA, 18 bp, Homo sapiens
gcaggaagctcagactgg

SEQ ID NO: 6236233 - DNA, 16 bp, Homo sapiens
gcaggaagctgctccg

SEQ ID NO: 6236234 - DNA, 16 bp, Homo sapiens
gcaggaagctgtgaga

SEQ ID NO: 6236235 - DNA, 12 bp, Homo sapiens
gcaggaaggaaa

SEQ ID NO: 6236236 - DNA, 13 bp, Homo sapiens
gcaggaaggaaaa

SEQ ID NO: 6236237 - DNA, 18 bp, Homo sapiens
gcaggaaggaacaaagac

SEQ ID NO: 6236238 - DNA, 23 bp, Homo sapiens
gcaggaaggacaggaagctggca

SEQ ID NO: 6236239 - DNA, 21 bp, Homo sapiens
gcaggaaggagcggcgccctg

SEQ ID NO: 6236240 - DNA, 20 bp, Homo sapiens
gcaggaaggagctgcctgga

SEQ ID NO: 6236241 - DNA, 17 bp, Homo sapiens
gcaggaaggcgggggat

SEQ ID NO: 6236242 - DNA, 11 bp, Homo sapiens
gcaggaaggct

SEQ ID NO: 6236243 - DNA, 20 bp, Homo sapiens
gcaggaaggctgagaggaga

SEQ ID NO: 6236244 - DNA, 14 bp, Homo sapiens
gcaggaaggtctca

SEQ ID NO: 6236245 - DNA, 23 bp, Homo sapiens
gcaggaaggtctcatgcctgaga

SEQ ID NO: 6236246 - DNA, 14 bp, Homo sapiens
gcaggaagtccctg

SEQ ID NO: 6236247 - DNA, 15 bp, Homo sapiens
gcaggaagtccctga

SEQ ID NO: 6236248 - DNA, 16 bp, Homo sapiens
gcaggaagtccctgag

SEQ ID NO: 6236249 - DNA, 17 bp, Homo sapiens
gcaggaagtccctgaga

SEQ ID NO: 6236250 - DNA, 15 bp, Homo sapiens
gcaggaataaagact

SEQ ID NO: 6236251 - DNA, 16 bp, Homo sapiens
gcaggaataaagactt

SEQ ID NO: 6236252 - DNA, 20 bp, Homo sapiens
gcaggaatcacccctctgcc

SEQ ID NO: 6236253 - DNA, 24 bp, Homo sapiens
gcaggaatcacccctctgcccctg

SEQ ID NO: 6236254 - DNA, 17 bp, Homo sapiens
gcaggaatgaaaacatt

SEQ ID NO: 6236255 - DNA, 22 bp, Homo sapiens
gcaggaatgcggttgggaggca

SEQ ID NO: 6236256 - DNA, 13 bp, Homo sapiens
gcaggaatggggg

SEQ ID NO: 6236257 - DNA, 14 bp, Homo sapiens
gcaggaatgggggt

SEQ ID NO: 6236258 - DNA, 18 bp, Homo sapiens
gcaggaatgggggtcaga

SEQ ID NO: 6236259 - DNA, 17 bp, Homo sapiens
gcaggaatgtgtggcag

SEQ ID NO: 6236260 - DNA, 19 bp, Homo sapiens
gcaggaattggtggcagat

SEQ ID NO: 6236261 - DNA, 18 bp, Homo sapiens
gcaggacaacgaggaagc

SEQ ID NO: 6236262 - DNA, 17 bp, Homo sapiens
gcaggacacatcccggc

SEQ ID NO: 6236263 - DNA, 14 bp, Homo sapiens
gcaggacactgcag

SEQ ID NO: 6236264 - DNA, 16 bp, Homo sapiens
gcaggacagccagcag

SEQ ID NO: 6236265 - DNA, 17 bp, Homo sapiens
gcaggacagccagcagc

SEQ ID NO: 6236266 - DNA, 14 bp, Homo sapiens
gcaggacagctcct

SEQ ID NO: 6236267 - DNA, 20 bp, Homo sapiens
gcaggacagctcctggacca

SEQ ID NO: 6236268 - DNA, 15 bp, Homo sapiens
gcaggacagctcttg

SEQ ID NO: 6236269 - DNA, 15 bp, Homo sapiens
gcaggacaggagaca

SEQ ID NO: 6236270 - DNA, 15 bp, Homo sapiens
gcaggacatgtgctc

SEQ ID NO: 6236271 - DNA, 23 bp, Homo sapiens
gcaggaccagaaggcaatcaaga

SEQ ID NO: 6236272 - DNA, 14 bp, Homo sapiens
gcaggaccagccca

SEQ ID NO: 6236273 - DNA, 16 bp, Homo sapiens
gcaggaccagcccacg

SEQ ID NO: 6236274 - DNA, 12 bp, Homo sapiens
gcaggaccagga

SEQ ID NO: 6236275 - DNA, 14 bp, Homo sapiens
gcaggaccaggact

SEQ ID NO: 6236276 - DNA, 13 bp, Homo sapiens
gcaggaccctgct

SEQ ID NO: 6236277 - DNA, 21 bp, Homo sapiens
gcaggaccctgtcaggattgc

SEQ ID NO: 6236278 - DNA, 17 bp, Homo sapiens
gcaggaccctgtcctgc

SEQ ID NO: 6236279 - DNA, 18 bp, Homo sapiens
gcaggacccttaggaatc

SEQ ID NO: 6236280 - DNA, 21 bp, Homo sapiens
gcaggacctagctgttgtaaa

SEQ ID NO: 6236281 - DNA, 22 bp, Homo sapiens
gcaggacctcagagtccaggcc

SEQ ID NO: 6236282 - DNA, 23 bp, Homo sapiens
gcaggacctcagagtccaggccc

SEQ ID NO: 6236283 - DNA, 16 bp, Homo sapiens
gcaggacctcccttcc

SEQ ID NO: 6236284 - DNA, 18 bp, Homo sapiens
gcaggacctcccttccga

SEQ ID NO: 6236285 - DNA, 20 bp, Homo sapiens
gcaggacctctgaaaccctg

SEQ ID NO: 6236286 - DNA, 16 bp, Homo sapiens
gcaggacctgcctagc

SEQ ID NO: 6236287 - DNA, 17 bp, Homo sapiens
gcaggacctgcctagca

SEQ ID NO: 6236288 - DNA, 13 bp, Homo sapiens
gcaggacctggca

SEQ ID NO: 6236289 - DNA, 14 bp, Homo sapiens
gcaggacctggcat

SEQ ID NO: 6236290 - DNA, 18 bp, Homo sapiens
gcaggacctgggacagga

SEQ ID NO: 6236291 - DNA, 18 bp, Homo sapiens
gcaggacctgtgctttga

SEQ ID NO: 6236292 - DNA, 16 bp, Homo sapiens
gcaggaccttgggcac

SEQ ID NO: 6236293 - DNA, 17 bp, Homo sapiens
gcaggaccttgggcaca

SEQ ID NO: 6236294 - DNA, 17 bp, Homo sapiens
gcaggacgttagactgt

SEQ ID NO: 6236295 - DNA, 11 bp, Homo sapiens
gcaggactccc

SEQ ID NO: 6236296 - DNA, 12 bp, Homo sapiens
gcaggactccca

SEQ ID NO: 6236297 - DNA, 16 bp, Homo sapiens
gcaggactcctggcag

SEQ ID NO: 6236298 - DNA, 20 bp, Homo sapiens
gcaggactcctggcagggcc

SEQ ID NO: 6236299 - DNA, 13 bp, Homo sapiens
gcaggactctagc

SEQ ID NO: 6236300 - DNA, 14 bp, Homo sapiens
gcaggactctatcc

SEQ ID NO: 6236301 - DNA, 20 bp, Homo sapiens
gcaggactgaggacaggccc

SEQ ID NO: 6236302 - DNA, 13 bp, Homo sapiens
gcaggactgatgt

SEQ ID NO: 6236303 - DNA, 14 bp, Homo sapiens
gcaggactgatgtc

SEQ ID NO: 6236304 - DNA, 18 bp, Homo sapiens
gcaggactgcagagcaga

SEQ ID NO: 6236305 - DNA, 20 bp, Homo sapiens
gcaggactgcagagcagatg

SEQ ID NO: 6236306 - DNA, 18 bp, Homo sapiens
gcaggactgtccccttga

SEQ ID NO: 6236307 - DNA, 16 bp, Homo sapiens
gcaggactgtgcctcc

SEQ ID NO: 6236308 - DNA, 17 bp, Homo sapiens
gcaggactgtgcctcca

SEQ ID NO: 6236309 - DNA, 22 bp, Homo sapiens
gcaggacttccccggagggctg

SEQ ID NO: 6236310 - DNA, 19 bp, Homo sapiens
gcaggactttgaggcaagt

SEQ ID NO: 6236311 - DNA, 23 bp, Homo sapiens
gcaggagaatcactgcagcccag

SEQ ID NO: 6236312 - DNA, 20 bp, Homo sapiens
gcaggagagactgagcagcc

SEQ ID NO: 6236313 - DNA, 11 bp, Homo sapiens
gcaggagagag

SEQ ID NO: 6236314 - DNA, 15 bp, Homo sapiens
gcaggagagagagag

SEQ ID NO: 6236315 - DNA, 20 bp, Homo sapiens
gcaggagagagagagagaaa

SEQ ID NO: 6236316 - DNA, 15 bp, Homo sapiens
gcaggagagcttccc

SEQ ID NO: 6236317 - DNA, 13 bp, Homo sapiens
gcaggagaggctg

SEQ ID NO: 6236318 - DNA, 14 bp, Homo sapiens
gcaggagaggctgg

SEQ ID NO: 6236319 - DNA, 23 bp, Homo sapiens
gcaggagaggctgggctgggtgg

SEQ ID NO: 6236320 - DNA, 20 bp, Homo sapiens
gcaggagagtgtgtgggcag

SEQ ID NO: 6236321 - DNA, 21 bp, Homo sapiens
gcaggagagtgtgtgggcagg

SEQ ID NO: 6236322 - DNA, 22 bp, Homo sapiens
gcaggagagtgtgtgggcaggg

SEQ ID NO: 6236323 - DNA, 23 bp, Homo sapiens
gcaggagattgagaaggagagaa

SEQ ID NO: 6236324 - DNA, 13 bp, Homo sapiens
gcaggagcaaggc

SEQ ID NO: 6236325 - DNA, 19 bp, Homo sapiens
gcaggagcaaggctgccct

SEQ ID NO: 6236326 - DNA, 16 bp, Homo sapiens
gcaggagcacacccag

SEQ ID NO: 6236327 - DNA, 17 bp, Homo sapiens
gcaggagcacacccagc

SEQ ID NO: 6236328 - DNA, 14 bp, Homo sapiens
gcaggagcagctgt

SEQ ID NO: 6236329 - DNA, 15 bp, Homo sapiens
gcaggagcaggaaca

SEQ ID NO: 6236330 - DNA, 17 bp, Homo sapiens
gcaggagcaggaacaga

SEQ ID NO: 6236331 - DNA, 14 bp, Homo sapiens
gcaggagccccgcc

SEQ ID NO: 6236332 - DNA, 16 bp, Homo sapiens
gcaggagcctagagga

SEQ ID NO: 6236333 - DNA, 13 bp, Homo sapiens
gcaggagcctccc

SEQ ID NO: 6236334 - DNA, 15 bp, Homo sapiens
gcaggagcctccctg

SEQ ID NO: 6236335 - DNA, 17 bp, Homo sapiens
gcaggagcctccctgca

SEQ ID NO: 6236336 - DNA, 21 bp, Homo sapiens
gcaggagcctcgtgtcctgct

SEQ ID NO: 6236337 - DNA, 22 bp, Homo sapiens
gcaggagcctcgtgtcctgcta

SEQ ID NO: 6236338 - DNA, 14 bp, Homo sapiens
gcaggagccttcct

SEQ ID NO: 6236339 - DNA, 22 bp, Homo sapiens
gcaggagccttcctttctcctg

SEQ ID NO: 6236340 - DNA, 23 bp, Homo sapiens
gcaggagccttcctttctcctgc

SEQ ID NO: 6236341 - DNA, 21 bp, Homo sapiens
gcaggagcggcagatggggag

SEQ ID NO: 6236342 - DNA, 15 bp, Homo sapiens
gcaggagctactgag

SEQ ID NO: 6236343 - DNA, 19 bp, Homo sapiens
gcaggagctactgagaaca

SEQ ID NO: 6236344 - DNA, 16 bp, Homo sapiens
gcaggagctcagatga

SEQ ID NO: 6236345 - DNA, 18 bp, Homo sapiens
gcaggagctcagatgaag

SEQ ID NO: 6236346 - DNA, 17 bp, Homo sapiens
gcaggagcttgggtctc

SEQ ID NO: 6236347 - DNA, 19 bp, Homo sapiens
gcaggaggaaaaggcttgg

SEQ ID NO: 6236348 - DNA, 22 bp, Homo sapiens
gcaggaggacagagtgccctgg

SEQ ID NO: 6236349 - DNA, 15 bp, Homo sapiens
gcaggaggagctgcc

SEQ ID NO: 6236350 - DNA, 20 bp, Homo sapiens
gcaggaggaggtgccaacag

SEQ ID NO: 6236351 - DNA, 23 bp, Homo sapiens
gcaggaggattgcttgagcccag

SEQ ID NO: 6236352 - DNA, 13 bp, Homo sapiens
gcaggaggcacag

SEQ ID NO: 6236353 - DNA, 15 bp, Homo sapiens
gcaggaggcagggct

SEQ ID NO: 6236354 - DNA, 12 bp, Homo sapiens
gcaggaggccaa

SEQ ID NO: 6236355 - DNA, 14 bp, Homo sapiens
gcaggaggccaggc

SEQ ID NO: 6236356 - DNA, 16 bp, Homo sapiens
gcaggaggccattcca

SEQ ID NO: 6236357 - DNA, 17 bp, Homo sapiens
gcaggaggccccaggct

SEQ ID NO: 6236358 - DNA, 19 bp, Homo sapiens
gcaggaggcccctggccca

SEQ ID NO: 6236359 - DNA, 13 bp, Homo sapiens
gcaggaggcctgg

SEQ ID NO: 6236360 - DNA, 14 bp, Homo sapiens
gcaggaggcctggc

SEQ ID NO: 6236361 - DNA, 23 bp, Homo sapiens
gactgctcccggcccgcctgccc

SEQ ID NO: 6236362 - DNA, 14 bp, Homo sapiens
gactgctcctgagc

SEQ ID NO: 6236363 - DNA, 22 bp, Homo sapiens
gactgctcctgagcccccagct

SEQ ID NO: 6236364 - DNA, 14 bp, Homo sapiens
gactgctcctgggc

SEQ ID NO: 6236365 - DNA, 16 bp, Homo sapiens
gactgctgacccacca

SEQ ID NO: 6236366 - DNA, 15 bp, Homo sapiens
gactgctgctcccca

SEQ ID NO: 6236367 - DNA, 19 bp, Homo sapiens
gactgctgctccccacccc

SEQ ID NO: 6236368 - DNA, 15 bp, Homo sapiens
gactgctgctctccc

SEQ ID NO: 6236369 - DNA, 19 bp, Homo sapiens
gactgctgctgcctggcca

SEQ ID NO: 6236370 - DNA, 19 bp, Homo sapiens
gactgctggacataaatca

SEQ ID NO: 6236371 - DNA, 15 bp, Homo sapiens
gactgctggctcacg

SEQ ID NO: 6236372 - DNA, 16 bp, Homo sapiens
gactgctggtttgtag

SEQ ID NO: 6236373 - DNA, 20 bp, Homo sapiens
gactgctgtgaaatggagaa

SEQ ID NO: 6236374 - DNA, 21 bp, Homo sapiens
gactgctgtgaacatgcctcc

SEQ ID NO: 6236375 - DNA, 22 bp, Homo sapiens
gactgctgtgaacatgcctcct

SEQ ID NO: 6236376 - DNA, 12 bp, Homo sapiens
gactgctgtggc

SEQ ID NO: 6236377 - DNA, 17 bp, Homo sapiens
gactgctgtggccagga

SEQ ID NO: 6236378 - DNA, 19 bp, Homo sapiens
gactgctgtggccaggagg

SEQ ID NO: 6236379 - DNA, 20 bp, Homo sapiens
gactgctgtggccaggaggt

SEQ ID NO: 6236380 - DNA, 20 bp, Homo sapiens
gactgcttcacggactcttt

SEQ ID NO: 6236381 - DNA, 20 bp, Homo sapiens
gactgcttgccctaagcaga

SEQ ID NO: 6236382 - DNA, 15 bp, Homo sapiens
gactgcttggccaga

SEQ ID NO: 6236383 - DNA, 15 bp, Homo sapiens
gactgcttggggtgg

SEQ ID NO: 6236384 - DNA, 17 bp, Homo sapiens
gactgctttcagtgcct

SEQ ID NO: 6236385 - DNA, 21 bp, Homo sapiens
gactgctttcagtgcctgctg

SEQ ID NO: 6236386 - DNA, 21 bp, Homo sapiens
gactggaagctaatttgcatt

SEQ ID NO: 6236387 - DNA, 13 bp, Homo sapiens
gactggaagttca

SEQ ID NO: 6236388 - DNA, 17 bp, Homo sapiens
gactggaagttgtggat

SEQ ID NO: 6236389 - DNA, 12 bp, Homo sapiens
gactggacagcc

SEQ ID NO: 6236390 - DNA, 15 bp, Homo sapiens
gactggacagccagg

SEQ ID NO: 6236391 - DNA, 22 bp, Homo sapiens
gactggacatttaacttttcta

SEQ ID NO: 6236392 - DNA, 14 bp, Homo sapiens
gactggacccccag

SEQ ID NO: 6236393 - DNA, 18 bp, Homo sapiens
gactggacctggtggcta

SEQ ID NO: 6236394 - DNA, 22 bp, Homo sapiens
gactggagaaaacccctcccac

SEQ ID NO: 6236395 - DNA, 20 bp, Homo sapiens
gactggagaccgcttcaccc

SEQ ID NO: 6236396 - DNA, 23 bp, Homo sapiens
gactggagaccgcttcacccctg

SEQ ID NO: 6236397 - DNA, 16 bp, Homo sapiens
gactggagcccgaggg

SEQ ID NO: 6236398 - DNA, 22 bp, Homo sapiens
gactggagcccgagggcctgac

SEQ ID NO: 6236399 - DNA, 15 bp, Homo sapiens
gactggaggcccctg

SEQ ID NO: 6236400 - DNA, 15 bp, Homo sapiens
gactggaggctgggt

SEQ ID NO: 6236401 - DNA, 17 bp, Homo sapiens
gactggaggtgggcatg

SEQ ID NO: 6236402 - DNA, 18 bp, Homo sapiens
gactggaggtgggcatgc

SEQ ID NO: 6236403 - DNA, 18 bp, Homo sapiens
gactggagtcagatgagc

SEQ ID NO: 6236404 - DNA, 15 bp, Homo sapiens
gactggagtccctgt

SEQ ID NO: 6236405 - DNA, 15 bp, Homo sapiens
gactggagtgaggct

SEQ ID NO: 6236406 - DNA, 20 bp, Homo sapiens
gactggagtgaggcttccag

SEQ ID NO: 6236407 - DNA, 21 bp, Homo sapiens
gactggagtgaggcttccagg

SEQ ID NO: 6236408 - DNA, 20 bp, Homo sapiens
gactggatttgcagaagttt

SEQ ID NO: 6236409 - DNA, 18 bp, Homo sapiens
gactggcaaaggaccagc

SEQ ID NO: 6236410 - DNA, 14 bp, Homo sapiens
gactggcaagagct

SEQ ID NO: 6236411 - DNA, 18 bp, Homo sapiens
gactggcaagaggcctca

SEQ ID NO: 6236412 - DNA, 14 bp, Homo sapiens
gactggcacagttt

SEQ ID NO: 6236413 - DNA, 14 bp, Homo sapiens
gactggcaccaaca

SEQ ID NO: 6236414 - DNA, 19 bp, Homo sapiens
gactggcagactcaagggg

SEQ ID NO: 6236415 - DNA, 13 bp, Homo sapiens
gactggcagccag

SEQ ID NO: 6236416 - DNA, 16 bp, Homo sapiens
gactggcagccaggga

SEQ ID NO: 6236417 - DNA, 11 bp, Homo sapiens
gactggcaggc

SEQ ID NO: 6236418 - DNA, 14 bp, Homo sapiens
gactggcaggtgca

SEQ ID NO: 6236419 - DNA, 16 bp, Homo sapiens
gactggcagtaaccta

SEQ ID NO: 6236420 - DNA, 24 bp, Homo sapiens
gactggcatactatgtggatgtga

SEQ ID NO: 6236421 - DNA, 13 bp, Homo sapiens
gactggccagagg

SEQ ID NO: 6236422 - DNA, 20 bp, Homo sapiens
gactggccagcgtaaatgac

SEQ ID NO: 6236423 - DNA, 19 bp, Homo sapiens
gactggccagttgcccaga

SEQ ID NO: 6236424 - DNA, 21 bp, Homo sapiens
gactggccagttgcccagagc

SEQ ID NO: 6236425 - DNA, 18 bp, Homo sapiens
gactggccatgcaagtgg

SEQ ID NO: 6236426 - DNA, 20 bp, Homo sapiens
gactggccatttttctgggg

SEQ ID NO: 6236427 - DNA, 14 bp, Homo sapiens
gactggcccacccc

SEQ ID NO: 6236428 - DNA, 15 bp, Homo sapiens
gactggcccacccct

SEQ ID NO: 6236429 - DNA, 19 bp, Homo sapiens
gactggcccacccctcttc

SEQ ID NO: 6236430 - DNA, 21 bp, Homo sapiens
gactggcccacccctcttccc

SEQ ID NO: 6236431 - DNA, 21 bp, Homo sapiens
gactggcccctgacccaggga

SEQ ID NO: 6236432 - DNA, 19 bp, Homo sapiens
gactggcccttgcccaact

SEQ ID NO: 6236433 - DNA, 14 bp, Homo sapiens
gactggccgggcag

SEQ ID NO: 6236434 - DNA, 18 bp, Homo sapiens
gactggccgtggctccag

SEQ ID NO: 6236435 - DNA, 18 bp, Homo sapiens
gactggcggggggcccat

SEQ ID NO: 6236436 - DNA, 17 bp, Homo sapiens
gactggcgttcacctcc

SEQ ID NO: 6236437 - DNA, 20 bp, Homo sapiens
gactggcgttcacctccctg

SEQ ID NO: 6236438 - DNA, 18 bp, Homo sapiens
gactggctagtgtggaag

SEQ ID NO: 6236439 - DNA, 11 bp, Homo sapiens
gactggctcct

SEQ ID NO: 6236440 - DNA, 12 bp, Homo sapiens
gactggctgcac

SEQ ID NO: 6236441 - DNA, 16 bp, Homo sapiens
gactggctgcacagcc

SEQ ID NO: 6236442 - DNA, 17 bp, Homo sapiens
gactggctggctgcagt

SEQ ID NO: 6236443 - DNA, 15 bp, Homo sapiens
gactggctgtctgcc

SEQ ID NO: 6236444 - DNA, 19 bp, Homo sapiens
gactggctgtctgcctgta

SEQ ID NO: 6236445 - DNA, 23 bp, Homo sapiens
gactggctgtgtaaccttgggtg

SEQ ID NO: 6236446 - DNA, 16 bp, Homo sapiens
gactggcttggccaca

SEQ ID NO: 6236447 - DNA, 10 bp, Homo sapiens
gactggcttt

SEQ ID NO: 6236448 - DNA, 14 bp, Homo sapiens
gactggctttcctc

SEQ ID NO: 6236449 - DNA, 21 bp, Homo sapiens
gactggcttttattaatgcac

SEQ ID NO: 6236450 - DNA, 23 bp, Homo sapiens
gactgggaagataggctctgcac

SEQ ID NO: 6236451 - DNA, 22 bp, Homo sapiens
gactgggaagggggcaggcccc

SEQ ID NO: 6236452 - DNA, 14 bp, Homo sapiens
gactgggaccgtgc

SEQ ID NO: 6236453 - DNA, 22 bp, Homo sapiens
gactgggagcccccagcctgtc

SEQ ID NO: 6236454 - DNA, 18 bp, Homo sapiens
gactgggagccgcagcag

SEQ ID NO: 6236455 - DNA, 15 bp, Homo sapiens
gactgggagggccca

SEQ ID NO: 6236456 - DNA, 13 bp, Homo sapiens
gactgggaggtag

SEQ ID NO: 6236457 - DNA, 18 bp, Homo sapiens
gactgggagtcagagccc

SEQ ID NO: 6236458 - DNA, 23 bp, Homo sapiens
gactgggcacccctgcctcctgc

SEQ ID NO: 6236459 - DNA, 17 bp, Homo sapiens
gactgggcactggggcc

SEQ ID NO: 6236460 - DNA, 13 bp, Homo sapiens
gactgggcccagg

SEQ ID NO: 6236461 - DNA, 20 bp, Homo sapiens
gactgggccccacatggctt

SEQ ID NO: 6236462 - DNA, 15 bp, Homo sapiens
gactgggccctgtcc

SEQ ID NO: 6236463 - DNA, 16 bp, Homo sapiens
gactgggccctgtcca

SEQ ID NO: 6236464 - DNA, 20 bp, Homo sapiens
gactgggcctaggccaggag

SEQ ID NO: 6236465 - DNA, 12 bp, Homo sapiens
gactgggcctcc

SEQ ID NO: 6236466 - DNA, 17 bp, Homo sapiens
gactgggctctggctct

SEQ ID NO: 6236467 - DNA, 13 bp, Homo sapiens
gactgggctggct

SEQ ID NO: 6236468 - DNA, 22 bp, Homo sapiens
gactgggctggctgccttctgc

SEQ ID NO: 6236469 - DNA, 13 bp, Homo sapiens
gactgggctgggt

SEQ ID NO: 6236470 - DNA, 13 bp, Homo sapiens
gactggggcaggg

SEQ ID NO: 6236471 - DNA, 14 bp, Homo sapiens
gactggggcagggt

SEQ ID NO: 6236472 - DNA, 17 bp, Homo sapiens
gactgggggcctctgcc

SEQ ID NO: 6236473 - DNA, 14 bp, Homo sapiens
gactggggggcttg

SEQ ID NO: 6236474 - DNA, 14 bp, Homo sapiens
gactggggtaggaa

SEQ ID NO: 6236475 - DNA, 15 bp, Homo sapiens
gactggggtgggagg

SEQ ID NO: 6236476 - DNA, 16 bp, Homo sapiens
gactggggtgggaggt

SEQ ID NO: 6236477 - DNA, 21 bp, Homo sapiens
gactgggtaggaaagaggaag

SEQ ID NO: 6236478 - DNA, 20 bp, Homo sapiens
gactgggtctgacctggtgg

SEQ ID NO: 6236479 - DNA, 19 bp, Homo sapiens
gactgggtgggccccacag

SEQ ID NO: 6236480 - DNA, 22 bp, Homo sapiens
gactgggttccccacagtgaca

SEQ ID NO: 6236481 - DNA, 23 bp, Homo sapiens
gactgggttccccacagtgacag

SEQ ID NO: 6236482 - DNA, 14 bp, Homo sapiens
gactgggtttctag

SEQ ID NO: 6236483 - DNA, 23 bp, Homo sapiens
gactgggtttggaccccagctgg

SEQ ID NO: 6236484 - DNA, 22 bp, Homo sapiens
gactggtaggaggaggcatgga

SEQ ID NO: 6236485 - DNA, 23 bp, Homo sapiens
gactggtaggaggaggcatggaa

SEQ ID NO: 6236486 - DNA, 20 bp, Homo sapiens
gactggtcaccttgcactcc

SEQ ID NO: 6236487 - DNA, 21 bp, Homo sapiens
gactggtcaccttgcactcct

SEQ ID NO: 6236488 - DNA, 13 bp, Homo sapiens
gactggtccagct

SEQ ID NO: 6236489 - DNA, 14 bp, Homo sapiens
gactggtccagctc

SEQ ID NO: 6236490 - DNA, 16 bp, Homo sapiens
gactggtccagctctg

SEQ ID NO: 6236491 - DNA, 19 bp, Homo sapiens
gactggtccagctctgaca

SEQ ID NO: 6236492 - DNA, 13 bp, Homo sapiens
gactggtccaggc

SEQ ID NO: 6236493 - DNA, 15 bp, Homo sapiens
gactggtcctgtgtg

SEQ ID NO: 6236494 - DNA, 16 bp, Homo sapiens
gactggtctcgaactc

SEQ ID NO: 6236495 - DNA, 17 bp, Homo sapiens
gactggtgagcagactg

SEQ ID NO: 6236496 - DNA, 10 bp, Homo sapiens
gactggtgcc

SEQ ID NO: 6236497 - DNA, 18 bp, Homo sapiens
gactggtgcgacccccca

SEQ ID NO: 6236498 - DNA, 22 bp, Homo sapiens
gactggtgcgaccccccacccc

SEQ ID NO: 6236499 - DNA, 20 bp, Homo sapiens
gactggtgctataggctgga

SEQ ID NO: 6236500 - DNA, 22 bp, Homo sapiens
gactggtgctataggctggaga

SEQ ID NO: 6236501 - DNA, 22 bp, Homo sapiens
gactggtgggggttctggcagg

SEQ ID NO: 6236502 - DNA, 23 bp, Homo sapiens
gactggtgggggttctggcagga

SEQ ID NO: 6236503 - DNA, 15 bp, Homo sapiens
gactggttctgaggc

SEQ ID NO: 6236504 - DNA, 17 bp, Homo sapiens
gactggttctgaggcca

SEQ ID NO: 6236505 - DNA, 15 bp, Homo sapiens
gactggttgtcagaa

SEQ ID NO: 6236506 - DNA, 20 bp, Homo sapiens
gactggttgtcagaatggaa

SEQ ID NO: 6236507 - DNA, 19 bp, Homo sapiens
gactggtttacaggccctg

SEQ ID NO: 6236508 - DNA, 14 bp, Homo sapiens
gactggttttctgc

SEQ ID NO: 6236509 - DNA, 16 bp, Homo sapiens
gactggttttctgcca

SEQ ID NO: 6236510 - DNA, 14 bp, Homo sapiens
gactgtaacttttt

SEQ ID NO: 6236511 - DNA, 20 bp, Homo sapiens
gactgtaactttttttcagt

SEQ ID NO: 6236512 - DNA, 22 bp, Homo sapiens
gactgtaagatgttgttttagg

SEQ ID NO: 6236513 - DNA, 12 bp, Homo sapiens
gactgtaagccc

SEQ ID NO: 6236514 - DNA, 21 bp, Homo sapiens
gactgtaagccctttggggac

SEQ ID NO: 6236515 - DNA, 13 bp, Homo sapiens
gactgtaagttgg

SEQ ID NO: 6236516 - DNA, 23 bp, Homo sapiens
gactgtacacactttatttactt

SEQ ID NO: 6236517 - DNA, 11 bp, Homo sapiens
gactgtacata

SEQ ID NO: 6236518 - DNA, 19 bp, Homo sapiens
gactgtacataattgcatg

SEQ ID NO: 6236519 - DNA, 23 bp, Homo sapiens
gactgtaccatggtttgatatgt

SEQ ID NO: 6236520 - DNA, 22 bp, Homo sapiens
gactgtacctgtaggaaacaga

SEQ ID NO: 6236521 - DNA, 18 bp, Homo sapiens
gactgtactcctcccagg

SEQ ID NO: 6236522 - DNA, 23 bp, Homo sapiens
gactgtactcctcccaggcgccc

SEQ ID NO: 6236523 - DNA, 20 bp, Homo sapiens
gactgtagatatgtattctt

SEQ ID NO: 6236524 - DNA, 21 bp, Homo sapiens
gactgtagattgcttctgtag

SEQ ID NO: 6236525 - DNA, 14 bp, Homo sapiens
gactgtagccacag

SEQ ID NO: 6236526 - DNA, 15 bp, Homo sapiens
gactgtagccacagc

SEQ ID NO: 6236527 - DNA, 21 bp, Homo sapiens
gactgtagccacagctgctgt

SEQ ID NO: 6236528 - DNA, 20 bp, Homo sapiens
gactgtaggcgcccctgggg

SEQ ID NO: 6236529 - DNA, 18 bp, Homo sapiens
gactgtataggtagatcc

SEQ ID NO: 6236530 - DNA, 14 bp, Homo sapiens
gactgtatctgtgt

SEQ ID NO: 6236531 - DNA, 15 bp, Homo sapiens
gactgtatctgtgta

SEQ ID NO: 6236532 - DNA, 22 bp, Homo sapiens
gactgtattatacatgggtagc

SEQ ID NO: 6236533 - DNA, 15 bp, Homo sapiens
gactgtatttctgtg

SEQ ID NO: 6236534 - DNA, 16 bp, Homo sapiens
gactgtatttgtgact

SEQ ID NO: 6236535 - DNA, 15 bp, Homo sapiens
gactgtcaaatgaac

SEQ ID NO: 6236536 - DNA, 16 bp, Homo sapiens
gactgtcaaatgaact

SEQ ID NO: 6236537 - DNA, 22 bp, Homo sapiens
gactgtcaaatgaacttttaca

SEQ ID NO: 6236538 - DNA, 22 bp, Homo sapiens
gactgtcaagtacaagcaagac

SEQ ID NO: 6236539 - DNA, 17 bp, Homo sapiens
gcaggaggcctggcctt

SEQ ID NO: 6236540 - DNA, 16 bp, Homo sapiens
gcaggaggcctgggag

SEQ ID NO: 6236541 - DNA, 19 bp, Homo sapiens
gcaggaggcctgggagggc

SEQ ID NO: 6236542 - DNA, 20 bp, Homo sapiens
gcaggaggctttctgggctc

SEQ ID NO: 6236543 - DNA, 20 bp, Homo sapiens
gcaggaggctttgggtggct

SEQ ID NO: 6236544 - DNA, 20 bp, Homo sapiens
gcaggagggaggcggggagg

SEQ ID NO: 6236545 - DNA, 13 bp, Homo sapiens
gcaggagggcact

SEQ ID NO: 6236546 - DNA, 14 bp, Homo sapiens
gcaggagggcagtg

SEQ ID NO: 6236547 - DNA, 17 bp, Homo sapiens
gcaggagggcatgtgca

SEQ ID NO: 6236548 - DNA, 18 bp, Homo sapiens
gcaggagggccctacctg

SEQ ID NO: 6236549 - DNA, 18 bp, Homo sapiens
gcaggaggggggagggaa

SEQ ID NO: 6236550 - DNA, 18 bp, Homo sapiens
gcaggaggggggctgggt

SEQ ID NO: 6236551 - DNA, 13 bp, Homo sapiens
gcaggagggtggc

SEQ ID NO: 6236552 - DNA, 17 bp, Homo sapiens
gcaggagggtggcactt

SEQ ID NO: 6236553 - DNA, 16 bp, Homo sapiens
gcaggaggtgggtgag

SEQ ID NO: 6236554 - DNA, 17 bp, Homo sapiens
gcaggagtaataaattt

SEQ ID NO: 6236555 - DNA, 16 bp, Homo sapiens
gcaggagtagctgagc

SEQ ID NO: 6236556 - DNA, 18 bp, Homo sapiens
gcaggagtagctgagctc

SEQ ID NO: 6236557 - DNA, 13 bp, Homo sapiens
gcaggagtctctg

SEQ ID NO: 6236558 - DNA, 16 bp, Homo sapiens
gcaggagtctctgcca

SEQ ID NO: 6236559 - DNA, 18 bp, Homo sapiens
gcaggagtctctgccacc

SEQ ID NO: 6236560 - DNA, 20 bp, Homo sapiens
gcaggagtctctgccaccca

SEQ ID NO: 6236561 - DNA, 21 bp, Homo sapiens
gcaggagtctctgccacccac

SEQ ID NO: 6236562 - DNA, 22 bp, Homo sapiens
gcaggagtctctgccacccact

SEQ ID NO: 6236563 - DNA, 16 bp, Homo sapiens
gcaggagtgccaggac

SEQ ID NO: 6236564 - DNA, 17 bp, Homo sapiens
gcaggagtgctgccctc

SEQ ID NO: 6236565 - DNA, 19 bp, Homo sapiens
gcaggagtggtgcagacag

SEQ ID NO: 6236566 - DNA, 17 bp, Homo sapiens
gcaggagtgtcctgccc

SEQ ID NO: 6236567 - DNA, 15 bp, Homo sapiens
gcaggagttcctttc

SEQ ID NO: 6236568 - DNA, 17 bp, Homo sapiens
gcaggagttcctttccc

SEQ ID NO: 6236569 - DNA, 23 bp, Homo sapiens
gcaggagttgggggcaggtcagg

SEQ ID NO: 6236570 - DNA, 19 bp, Homo sapiens
gcaggatagctcttcctcc

SEQ ID NO: 6236571 - DNA, 22 bp, Homo sapiens
gcaggatagctcttcctcccca

SEQ ID NO: 6236572 - DNA, 19 bp, Homo sapiens
gcaggatccctcctgagct

SEQ ID NO: 6236573 - DNA, 17 bp, Homo sapiens
gcaggatccgctgccac

SEQ ID NO: 6236574 - DNA, 19 bp, Homo sapiens
gcaggatccgctgccacca

SEQ ID NO: 6236575 - DNA, 22 bp, Homo sapiens
gcaggatcggcttcctcagggg

SEQ ID NO: 6236576 - DNA, 19 bp, Homo sapiens
gcaggatctcaagccagcc

SEQ ID NO: 6236577 - DNA, 20 bp, Homo sapiens
gcaggatctcaagccagccc

SEQ ID NO: 6236578 - DNA, 17 bp, Homo sapiens
gcaggatctcaccaggc

SEQ ID NO: 6236579 - DNA, 18 bp, Homo sapiens
gcaggatctcaccaggca

SEQ ID NO: 6236580 - DNA, 19 bp, Homo sapiens
gcaggatctcaccaggcag

SEQ ID NO: 6236581 - DNA, 20 bp, Homo sapiens
gcaggatctcaccaggcagc

SEQ ID NO: 6236582 - DNA, 13 bp, Homo sapiens
gcaggatctgtct

SEQ ID NO: 6236583 - DNA, 16 bp, Homo sapiens
gcaggatctgtctgtg

SEQ ID NO: 6236584 - DNA, 17 bp, Homo sapiens
gcaggatgccctgttgg

SEQ ID NO: 6236585 - DNA, 19 bp, Homo sapiens
gcaggatgcgctgggacgg

SEQ ID NO: 6236586 - DNA, 16 bp, Homo sapiens
gcaggatggcctggcc

SEQ ID NO: 6236587 - DNA, 23 bp, Homo sapiens
gcaggatggcctttccttccctc

SEQ ID NO: 6236588 - DNA, 14 bp, Homo sapiens
gcaggatgggggag

SEQ ID NO: 6236589 - DNA, 18 bp, Homo sapiens
gcaggatgggggagaggg

SEQ ID NO: 6236590 - DNA, 21 bp, Homo sapiens
gcaggatgttggcttggggca

SEQ ID NO: 6236591 - DNA, 16 bp, Homo sapiens
gcaggattcccttctg

SEQ ID NO: 6236592 - DNA, 23 bp, Homo sapiens
gcaggattcttcccgctccccac

SEQ ID NO: 6236593 - DNA, 21 bp, Homo sapiens
gcaggattgattatgcagaat

SEQ ID NO: 6236594 - DNA, 21 bp, Homo sapiens
gcaggattggcaactcttcag

SEQ ID NO: 6236595 - DNA, 20 bp, Homo sapiens
gcaggattggggaagagagc

SEQ ID NO: 6236596 - DNA, 20 bp, Homo sapiens
gcaggcaaaaaagggacagc

SEQ ID NO: 6236597 - DNA, 23 bp, Homo sapiens
gcaggcaaagtgagactgacacc

SEQ ID NO: 6236598 - DNA, 22 bp, Homo sapiens
gcaggcaagacaccttcccagc

SEQ ID NO: 6236599 - DNA, 23 bp, Homo sapiens
gcaggcaagacaccttcccagct

SEQ ID NO: 6236600 - DNA, 23 bp, Homo sapiens
gcaggcaagagaattgaaatgag

SEQ ID NO: 6236601 - DNA, 21 bp, Homo sapiens
gcaggcacagaggaggtcagc

SEQ ID NO: 6236602 - DNA, 18 bp, Homo sapiens
gcaggcacagcacaggga

SEQ ID NO: 6236603 - DNA, 15 bp, Homo sapiens
gcaggcacatggagg

SEQ ID NO: 6236604 - DNA, 10 bp, Homo sapiens
gcaggcacca

SEQ ID NO: 6236605 - DNA, 19 bp, Homo sapiens
gcaggcaccaacaactcag

SEQ ID NO: 6236606 - DNA, 23 bp, Homo sapiens
gcaggcaccgccacgtcccagca

SEQ ID NO: 6236607 - DNA, 20 bp, Homo sapiens
gcaggcaccgggctggctgc

SEQ ID NO: 6236608 - DNA, 20 bp, Homo sapiens
gcaggcacctagcaattcca

SEQ ID NO: 6236609 - DNA, 16 bp, Homo sapiens
gcaggcacggcccgca

SEQ ID NO: 6236610 - DNA, 20 bp, Homo sapiens
gcaggcacggcccgcagcct

SEQ ID NO: 6236611 - DNA, 17 bp, Homo sapiens
gcaggcactgaagctgc

SEQ ID NO: 6236612 - DNA, 20 bp, Homo sapiens
gcaggcagactacacaggat

SEQ ID NO: 6236613 - DNA, 22 bp, Homo sapiens
gcaggcagagctcagcacagcc

SEQ ID NO: 6236614 - DNA, 15 bp, Homo sapiens
gcaggcagaggagag

SEQ ID NO: 6236615 - DNA, 15 bp, Homo sapiens
gcaggcagaggccca

SEQ ID NO: 6236616 - DNA, 16 bp, Homo sapiens
gcaggcagatcacctg

SEQ ID NO: 6236617 - DNA, 18 bp, Homo sapiens
gcaggcagatcacctgag

SEQ ID NO: 6236618 - DNA, 21 bp, Homo sapiens
gcaggcagccagcatctgggc

SEQ ID NO: 6236619 - DNA, 15 bp, Homo sapiens
gcaggcagcctgcag

SEQ ID NO: 6236620 - DNA, 14 bp, Homo sapiens
gcaggcagccttga

SEQ ID NO: 6236621 - DNA, 18 bp, Homo sapiens
gcaggcagcgcagggctg

SEQ ID NO: 6236622 - DNA, 16 bp, Homo sapiens
gcaggcagcgccaagc

SEQ ID NO: 6236623 - DNA, 22 bp, Homo sapiens
gcaggcagcgccaagcaacctg

SEQ ID NO: 6236624 - DNA, 14 bp, Homo sapiens
gcaggcagcgcctg

SEQ ID NO: 6236625 - DNA, 17 bp, Homo sapiens
gcaggcagcgcctgtcc

SEQ ID NO: 6236626 - DNA, 20 bp, Homo sapiens
gcaggcagcgcctgtcccct

SEQ ID NO: 6236627 - DNA, 18 bp, Homo sapiens
gcaggcagctaggcaggg

SEQ ID NO: 6236628 - DNA, 21 bp, Homo sapiens
gcaggcagctaggcagggagg

SEQ ID NO: 6236629 - DNA, 22 bp, Homo sapiens
gcaggcagcttctactcctgcc

SEQ ID NO: 6236630 - DNA, 14 bp, Homo sapiens
gcaggcaggcagcc

SEQ ID NO: 6236631 - DNA, 17 bp, Homo sapiens
gcaggcaggctcccagg

SEQ ID NO: 6236632 - DNA, 12 bp, Homo sapiens
gcaggcagggct

SEQ ID NO: 6236633 - DNA, 14 bp, Homo sapiens
gcaggcagggctct

SEQ ID NO: 6236634 - DNA, 20 bp, Homo sapiens
gcaggcagggctctcctggc

SEQ ID NO: 6236635 - DNA, 19 bp, Homo sapiens
gcaggcagggctgggccag

SEQ ID NO: 6236636 - DNA, 19 bp, Homo sapiens
gcaggcaggggcatctgtc

SEQ ID NO: 6236637 - DNA, 17 bp, Homo sapiens
gcaggcaggggcttggc

SEQ ID NO: 6236638 - DNA, 21 bp, Homo sapiens
gcaggcaggggcttggctgcc

SEQ ID NO: 6236639 - DNA, 16 bp, Homo sapiens
gcaggcaggtggactg

SEQ ID NO: 6236640 - DNA, 23 bp, Homo sapiens
gcaggcaggtggactgactgtgt

SEQ ID NO: 6236641 - DNA, 13 bp, Homo sapiens
gcaggcagtgtct

SEQ ID NO: 6236642 - DNA, 17 bp, Homo sapiens
gcaggcagttctagaag

SEQ ID NO: 6236643 - DNA, 23 bp, Homo sapiens
gcaggcatcggggagccgggagc

SEQ ID NO: 6236644 - DNA, 14 bp, Homo sapiens
gcaggcatctgatt

SEQ ID NO: 6236645 - DNA, 20 bp, Homo sapiens
gcaggcatgcatgtgcttgt

SEQ ID NO: 6236646 - DNA, 19 bp, Homo sapiens
gcaggcatgcttctcaccg

SEQ ID NO: 6236647 - DNA, 20 bp, Homo sapiens
gcaggcatgcttctcaccgt

SEQ ID NO: 6236648 - DNA, 16 bp, Homo sapiens
gcaggcatggccctgg

SEQ ID NO: 6236649 - DNA, 20 bp, Homo sapiens
gcaggcatggctggtgcctg

SEQ ID NO: 6236650 - DNA, 16 bp, Homo sapiens
gcaggcatgtcctgga

SEQ ID NO: 6236651 - DNA, 18 bp, Homo sapiens
gcaggcattgaggaagag

SEQ ID NO: 6236652 - DNA, 17 bp, Homo sapiens
gcaggcattgctttgcc

SEQ ID NO: 6236653 - DNA, 13 bp, Homo sapiens
gcaggcatttctg

SEQ ID NO: 6236654 - DNA, 21 bp, Homo sapiens
gcaggcatttgctaaggcagc

SEQ ID NO: 6236655 - DNA, 24 bp, Homo sapiens
gcaggccaagagcagaggcagcga

SEQ ID NO: 6236656 - DNA, 23 bp, Homo sapiens
gcaggccacacttcaaactactt

SEQ ID NO: 6236657 - DNA, 19 bp, Homo sapiens
gcaggccacccgggctgcc

SEQ ID NO: 6236658 - DNA, 22 bp, Homo sapiens
gcaggccacctggctctcacct

SEQ ID NO: 6236659 - DNA, 17 bp, Homo sapiens
gcaggccactagtgaca

SEQ ID NO: 6236660 - DNA, 16 bp, Homo sapiens
gcaggccagagaaagc

SEQ ID NO: 6236661 - DNA, 18 bp, Homo sapiens
gcaggccagatggcccct

SEQ ID NO: 6236662 - DNA, 21 bp, Homo sapiens
gcaggccagcccggacctctg

SEQ ID NO: 6236663 - DNA, 21 bp, Homo sapiens
gcaggccagcttcgtgctgga

SEQ ID NO: 6236664 - DNA, 14 bp, Homo sapiens
gcaggccaggccag

SEQ ID NO: 6236665 - DNA, 15 bp, Homo sapiens
gcaggccaggccagc

SEQ ID NO: 6236666 - DNA, 14 bp, Homo sapiens
gcaggccaggctgc

SEQ ID NO: 6236667 - DNA, 14 bp, Homo sapiens
gcaggcccaatgct

SEQ ID NO: 6236668 - DNA, 15 bp, Homo sapiens
gcaggcccaatgctg

SEQ ID NO: 6236669 - DNA, 17 bp, Homo sapiens
gcaggcccaatgctgct

SEQ ID NO: 6236670 - DNA, 11 bp, Homo sapiens
gcaggcccacc

SEQ ID NO: 6236671 - DNA, 20 bp, Homo sapiens
gcaggcccaccctgcttggc

SEQ ID NO: 6236672 - DNA, 12 bp, Homo sapiens
gcaggcccacct

SEQ ID NO: 6236673 - DNA, 17 bp, Homo sapiens
gcaggcccactccccag

SEQ ID NO: 6236674 - DNA, 23 bp, Homo sapiens
gcaggcccactccccagccccag

SEQ ID NO: 6236675 - DNA, 14 bp, Homo sapiens
gcaggcccagcatg

SEQ ID NO: 6236676 - DNA, 16 bp, Homo sapiens
gcaggcccagcatgca

SEQ ID NO: 6236677 - DNA, 18 bp, Homo sapiens
gcaggcccagcatgcagg

SEQ ID NO: 6236678 - DNA, 22 bp, Homo sapiens
gcaggcccagcatgcaggtggt

SEQ ID NO: 6236679 - DNA, 13 bp, Homo sapiens
gcaggcccagcct

SEQ ID NO: 6236680 - DNA, 14 bp, Homo sapiens
gcaggcccagcctc

SEQ ID NO: 6236681 - DNA, 19 bp, Homo sapiens
gcaggcccagcctctgccc

SEQ ID NO: 6236682 - DNA, 13 bp, Homo sapiens
gcaggcccagctg

SEQ ID NO: 6236683 - DNA, 15 bp, Homo sapiens
gcaggcccaggagaa

SEQ ID NO: 6236684 - DNA, 18 bp, Homo sapiens
gcaggcccaggcaggccc

SEQ ID NO: 6236685 - DNA, 21 bp, Homo sapiens
gcaggcccaggcaggcccagc

SEQ ID NO: 6236686 - DNA, 22 bp, Homo sapiens
gcaggcccatgggaggctggag

SEQ ID NO: 6236687 - DNA, 16 bp, Homo sapiens
gcaggccccctaggat

SEQ ID NO: 6236688 - DNA, 16 bp, Homo sapiens
gcaggccccgccccct

SEQ ID NO: 6236689 - DNA, 17 bp, Homo sapiens
gcaggccccgccccctc

SEQ ID NO: 6236690 - DNA, 15 bp, Homo sapiens
gcaggcccctctcct

SEQ ID NO: 6236691 - DNA, 18 bp, Homo sapiens
gcaggcccctctcctccg

SEQ ID NO: 6236692 - DNA, 15 bp, Homo sapiens
gcaggcccgacagag

SEQ ID NO: 6236693 - DNA, 18 bp, Homo sapiens
gcaggcccgacagagaga

SEQ ID NO: 6236694 - DNA, 23 bp, Homo sapiens
gcaggccctccgcgggggacagg

SEQ ID NO: 6236695 - DNA, 21 bp, Homo sapiens
gcaggccctgcactgtcctgc

SEQ ID NO: 6236696 - DNA, 13 bp, Homo sapiens
gcaggccctgcag

SEQ ID NO: 6236697 - DNA, 21 bp, Homo sapiens
gcaggccctgcccagccagcc

SEQ ID NO: 6236698 - DNA, 14 bp, Homo sapiens
gcaggccctggcct

SEQ ID NO: 6236699 - DNA, 15 bp, Homo sapiens
gcaggccctggcctc

SEQ ID NO: 6236700 - DNA, 16 bp, Homo sapiens
gcaggccctggcctcc

SEQ ID NO: 6236701 - DNA, 15 bp, Homo sapiens
gcaggccctgggcct

SEQ ID NO: 6236702 - DNA, 22 bp, Homo sapiens
gcaggccctgggcctccacctc

SEQ ID NO: 6236703 - DNA, 18 bp, Homo sapiens
gcaggccctggtggagag

SEQ ID NO: 6236704 - DNA, 15 bp, Homo sapiens
gcaggccctgtccag

SEQ ID NO: 6236705 - DNA, 13 bp, Homo sapiens
gcaggcccttccc

SEQ ID NO: 6236706 - DNA, 20 bp, Homo sapiens
gcaggccggaaccacagggc

SEQ ID NO: 6236707 - DNA, 21 bp, Homo sapiens
gcaggccggaaccacagggcc

SEQ ID NO: 6236708 - DNA, 23 bp, Homo sapiens
gcaggccggaaccacagggccag

SEQ ID NO: 6236709 - DNA, 19 bp, Homo sapiens
gcaggccgtgacgtctggg

SEQ ID NO: 6236710 - DNA, 12 bp, Homo sapiens
gcaggcctagga

SEQ ID NO: 6236711 - DNA, 19 bp, Homo sapiens
gcaggcctaggacctcagg

SEQ ID NO: 6236712 - DNA, 13 bp, Homo sapiens
gcaggcctaggtg

SEQ ID NO: 6236713 - DNA, 22 bp, Homo sapiens
gcaggcctccaacgcccctgtg

SEQ ID NO: 6236714 - DNA, 16 bp, Homo sapiens
gcaggcctcccaagct

SEQ ID NO: 6236715 - DNA, 16 bp, Homo sapiens
gcaggcctccctgaaa

SEQ ID NO: 6236716 - DNA, 13 bp, Homo sapiens
gactgtcagctga

SEQ ID NO: 6236717 - DNA, 15 bp, Homo sapiens
gactgtcagggaggg

SEQ ID NO: 6236718 - DNA, 16 bp, Homo sapiens
gactgtcagggagggc

SEQ ID NO: 6236719 - DNA, 17 bp, Homo sapiens
gactgtcagggagggcc

SEQ ID NO: 6236720 - DNA, 22 bp, Homo sapiens
gactgtcagggagggccaggga

SEQ ID NO: 6236721 - DNA, 15 bp, Homo sapiens
gactgtcatagaaat

SEQ ID NO: 6236722 - DNA, 17 bp, Homo sapiens
gactgtcattgcccctc

SEQ ID NO: 6236723 - DNA, 14 bp, Homo sapiens
gactgtccagggaa

SEQ ID NO: 6236724 - DNA, 23 bp, Homo sapiens
gactgtcccaccgggagcctccc

SEQ ID NO: 6236725 - DNA, 16 bp, Homo sapiens
gactgtcctagccagg

SEQ ID NO: 6236726 - DNA, 17 bp, Homo sapiens
gactgtcctcccacaga

SEQ ID NO: 6236727 - DNA, 22 bp, Homo sapiens
gactgtcctcccacagacctgc

SEQ ID NO: 6236728 - DNA, 19 bp, Homo sapiens
gactgtcctctcccctcca

SEQ ID NO: 6236729 - DNA, 19 bp, Homo sapiens
gactgtcctgaggagccct

SEQ ID NO: 6236730 - DNA, 20 bp, Homo sapiens
gactgtcctgaggagccctg

SEQ ID NO: 6236731 - DNA, 13 bp, Homo sapiens
gactgtcgccaca

SEQ ID NO: 6236732 - DNA, 22 bp, Homo sapiens
gactgtcgccacacgcctctgt

SEQ ID NO: 6236733 - DNA, 22 bp, Homo sapiens
gactgtcggagaggctgtctgg

SEQ ID NO: 6236734 - DNA, 17 bp, Homo sapiens
gactgtcgtgtttacaa

SEQ ID NO: 6236735 - DNA, 21 bp, Homo sapiens
gactgtctagccactccctcc

SEQ ID NO: 6236736 - DNA, 23 bp, Homo sapiens
gactgtctcaagagggcactggt

SEQ ID NO: 6236737 - DNA, 15 bp, Homo sapiens
gactgtctggggagc

SEQ ID NO: 6236738 - DNA, 21 bp, Homo sapiens
gactgtcttcaaccctgccct

SEQ ID NO: 6236739 - DNA, 18 bp, Homo sapiens
gactgtcttccctctcta

SEQ ID NO: 6236740 - DNA, 15 bp, Homo sapiens
gactgtcttgagaaa

SEQ ID NO: 6236741 - DNA, 21 bp, Homo sapiens
gactgtgaacttgactgggtg

SEQ ID NO: 6236742 - DNA, 15 bp, Homo sapiens
gactgtgaatttcaa

SEQ ID NO: 6236743 - DNA, 15 bp, Homo sapiens
gactgtgaattttgg

SEQ ID NO: 6236744 - DNA, 23 bp, Homo sapiens
gactgtgacagactttggacagt

SEQ ID NO: 6236745 - DNA, 18 bp, Homo sapiens
gactgtgacaggcagcag

SEQ ID NO: 6236746 - DNA, 19 bp, Homo sapiens
gactgtgacaggcagcaga

SEQ ID NO: 6236747 - DNA, 20 bp, Homo sapiens
gactgtgacaggcagcagag

SEQ ID NO: 6236748 - DNA, 15 bp, Homo sapiens
gactgtgaccaaagc

SEQ ID NO: 6236749 - DNA, 16 bp, Homo sapiens
gactgtgaccaaagca

SEQ ID NO: 6236750 - DNA, 21 bp, Homo sapiens
gactgtgaccaaagcatttct

SEQ ID NO: 6236751 - DNA, 21 bp, Homo sapiens
gactgtgagcgagcctggcag

SEQ ID NO: 6236752 - DNA, 19 bp, Homo sapiens
gactgtgatgccacacaga

SEQ ID NO: 6236753 - DNA, 15 bp, Homo sapiens
gactgtgattcagaa

SEQ ID NO: 6236754 - DNA, 12 bp, Homo sapiens
gactgtgattta

SEQ ID NO: 6236755 - DNA, 17 bp, Homo sapiens
gactgtgatttatttgg

SEQ ID NO: 6236756 - DNA, 18 bp, Homo sapiens
gactgtgatttatttgga

SEQ ID NO: 6236757 - DNA, 21 bp, Homo sapiens
gactgtgatttatttggagtg

SEQ ID NO: 6236758 - DNA, 19 bp, Homo sapiens
gactgtgatttgaatccag

SEQ ID NO: 6236759 - DNA, 14 bp, Homo sapiens
gactgtgccagagg

SEQ ID NO: 6236760 - DNA, 19 bp, Homo sapiens
gactgtgcccaagtgggtc

SEQ ID NO: 6236761 - DNA, 17 bp, Homo sapiens
gactgtggaaatgccaa

SEQ ID NO: 6236762 - DNA, 12 bp, Homo sapiens
gactgtggaggg

SEQ ID NO: 6236763 - DNA, 21 bp, Homo sapiens
gactgtggaggggagctgctg

SEQ ID NO: 6236764 - DNA, 22 bp, Homo sapiens
gactgtggaggggagctgctgg

SEQ ID NO: 6236765 - DNA, 21 bp, Homo sapiens
gactgtggcaaacaaaaccaa

SEQ ID NO: 6236766 - DNA, 21 bp, Homo sapiens
gactgtggcacttgcctgggt

SEQ ID NO: 6236767 - DNA, 22 bp, Homo sapiens
gactgtggccatatatgctgta

SEQ ID NO: 6236768 - DNA, 17 bp, Homo sapiens
gactgtggccctgtctg

SEQ ID NO: 6236769 - DNA, 15 bp, Homo sapiens
gactgtgggactcag

SEQ ID NO: 6236770 - DNA, 22 bp, Homo sapiens
gactgtggggtttttaatctct

SEQ ID NO: 6236771 - DNA, 19 bp, Homo sapiens
gactgtgggtccctgcgtc

SEQ ID NO: 6236772 - DNA, 19 bp, Homo sapiens
gactgtgggtttgtggggg

SEQ ID NO: 6236773 - DNA, 18 bp, Homo sapiens
gactgtggtaggggcagg

SEQ ID NO: 6236774 - DNA, 20 bp, Homo sapiens
gactgtggtgacttctgctg

SEQ ID NO: 6236775 - DNA, 23 bp, Homo sapiens
gactgtgtccccccaaaattcat

SEQ ID NO: 6236776 - DNA, 22 bp, Homo sapiens
gactgtgtgctcaggagccctg

SEQ ID NO: 6236777 - DNA, 18 bp, Homo sapiens
gactgtgtgtgccctctg

SEQ ID NO: 6236778 - DNA, 21 bp, Homo sapiens
gactgtgtgttgccacaggac

SEQ ID NO: 6236779 - DNA, 20 bp, Homo sapiens
gactgtgtttaactgctgca

SEQ ID NO: 6236780 - DNA, 22 bp, Homo sapiens
gactgtgtttaactgctgcagg

SEQ ID NO: 6236781 - DNA, 22 bp, Homo sapiens
gactgttagaaaatggacactg

SEQ ID NO: 6236782 - DNA, 14 bp, Homo sapiens
gactgttcaagagc

SEQ ID NO: 6236783 - DNA, 19 bp, Homo sapiens
gactgttcaagagcacact

SEQ ID NO: 6236784 - DNA, 23 bp, Homo sapiens
gactgttcaagagcacacttggc

SEQ ID NO: 6236785 - DNA, 21 bp, Homo sapiens
gactgttccaggccctccagt

SEQ ID NO: 6236786 - DNA, 16 bp, Homo sapiens
gactgttccctccaag

SEQ ID NO: 6236787 - DNA, 17 bp, Homo sapiens
gactgttccctccaagg

SEQ ID NO: 6236788 - DNA, 22 bp, Homo sapiens
gactgttccctccaaggtcctc

SEQ ID NO: 6236789 - DNA, 14 bp, Homo sapiens
gactgttcctgtct

SEQ ID NO: 6236790 - DNA, 21 bp, Homo sapiens
gactgttccttatttctctct

SEQ ID NO: 6236791 - DNA, 21 bp, Homo sapiens
gactgttcttggtaactgatt

SEQ ID NO: 6236792 - DNA, 11 bp, Homo sapiens
gactgttcttt

SEQ ID NO: 6236793 - DNA, 16 bp, Homo sapiens
gactgttgggacagcc

SEQ ID NO: 6236794 - DNA, 21 bp, Homo sapiens
gactgttggggtgggtataaa

SEQ ID NO: 6236795 - DNA, 14 bp, Homo sapiens
gactgttgtagcat

SEQ ID NO: 6236796 - DNA, 14 bp, Homo sapiens
gactgttgtccctg

SEQ ID NO: 6236797 - DNA, 13 bp, Homo sapiens
gactgttgtgatc

SEQ ID NO: 6236798 - DNA, 14 bp, Homo sapiens
gactgttgtgatct

SEQ ID NO: 6236799 - DNA, 22 bp, Homo sapiens
gactgttgtgatcttgcattca

SEQ ID NO: 6236800 - DNA, 14 bp, Homo sapiens
gactgtttatttaa

SEQ ID NO: 6236801 - DNA, 16 bp, Homo sapiens
gactgtttatttaagg

SEQ ID NO: 6236802 - DNA, 17 bp, Homo sapiens
gactgtttatttaagga

SEQ ID NO: 6236803 - DNA, 13 bp, Homo sapiens
gactgtttcaaac

SEQ ID NO: 6236804 - DNA, 17 bp, Homo sapiens
gactgtttcattcactg

SEQ ID NO: 6236805 - DNA, 20 bp, Homo sapiens
gactgtttcattcactgtgc

SEQ ID NO: 6236806 - DNA, 13 bp, Homo sapiens
gactgtttggaaa

SEQ ID NO: 6236807 - DNA, 16 bp, Homo sapiens
gactgttttctcttga

SEQ ID NO: 6236808 - DNA, 17 bp, Homo sapiens
gactgtttttacccata

SEQ ID NO: 6236809 - DNA, 14 bp, Homo sapiens
gactgttttttcct

SEQ ID NO: 6236810 - DNA, 16 bp, Homo sapiens
gacttaaaaaaaccat

SEQ ID NO: 6236811 - DNA, 20 bp, Homo sapiens
gacttaaaattggaaatgtc

SEQ ID NO: 6236812 - DNA, 23 bp, Homo sapiens
gacttaaactgctgaattcacct

SEQ ID NO: 6236813 - DNA, 14 bp, Homo sapiens
gacttaaaggacag

SEQ ID NO: 6236814 - DNA, 12 bp, Homo sapiens
gacttaacaggc

SEQ ID NO: 6236815 - DNA, 20 bp, Homo sapiens
gacttaaccttgaaatggaa

SEQ ID NO: 6236816 - DNA, 14 bp, Homo sapiens
gacttaacggctcc

SEQ ID NO: 6236817 - DNA, 15 bp, Homo sapiens
gacttaactggccca

SEQ ID NO: 6236818 - DNA, 15 bp, Homo sapiens
gacttaactttaact

SEQ ID NO: 6236819 - DNA, 22 bp, Homo sapiens
gacttaactttaacttttgaaa

SEQ ID NO: 6236820 - DNA, 18 bp, Homo sapiens
gacttaagaaagcaaaac

SEQ ID NO: 6236821 - DNA, 15 bp, Homo sapiens
gacttaagacaaatg

SEQ ID NO: 6236822 - DNA, 22 bp, Homo sapiens
gacttaagcatctggctctaat

SEQ ID NO: 6236823 - DNA, 16 bp, Homo sapiens
gacttaaggagaaata

SEQ ID NO: 6236824 - DNA, 16 bp, Homo sapiens
gacttaatagacattt

SEQ ID NO: 6236825 - DNA, 19 bp, Homo sapiens
gacttaatcatatcaactt

SEQ ID NO: 6236826 - DNA, 16 bp, Homo sapiens
gacttacaaccttgtc

SEQ ID NO: 6236827 - DNA, 14 bp, Homo sapiens
gacttacaatttgc

SEQ ID NO: 6236828 - DNA, 18 bp, Homo sapiens
gacttacagcaaatcctt

SEQ ID NO: 6236829 - DNA, 18 bp, Homo sapiens
gacttacaggctaaaatt

SEQ ID NO: 6236830 - DNA, 18 bp, Homo sapiens
gacttacatgattcattt

SEQ ID NO: 6236831 - DNA, 16 bp, Homo sapiens
gacttacgccctgttc

SEQ ID NO: 6236832 - DNA, 23 bp, Homo sapiens
gacttacgccctgttcccttcct

SEQ ID NO: 6236833 - DNA, 17 bp, Homo sapiens
gacttactaataaaatg

SEQ ID NO: 6236834 - DNA, 12 bp, Homo sapiens
gacttactctaa

SEQ ID NO: 6236835 - DNA, 13 bp, Homo sapiens
gacttactgcagt

SEQ ID NO: 6236836 - DNA, 13 bp, Homo sapiens
gacttactgcctg

SEQ ID NO: 6236837 - DNA, 17 bp, Homo sapiens
gacttactgcctgacct

SEQ ID NO: 6236838 - DNA, 21 bp, Homo sapiens
gacttactgcctgaccttgga

SEQ ID NO: 6236839 - DNA, 13 bp, Homo sapiens
gacttactgggtg

SEQ ID NO: 6236840 - DNA, 12 bp, Homo sapiens
gacttactgtac

SEQ ID NO: 6236841 - DNA, 15 bp, Homo sapiens
gacttactgtacatg

SEQ ID NO: 6236842 - DNA, 15 bp, Homo sapiens
gacttactgtttctt

SEQ ID NO: 6236843 - DNA, 23 bp, Homo sapiens
gacttacttgcattgctggacta

SEQ ID NO: 6236844 - DNA, 17 bp, Homo sapiens
gacttagaaacaatgtt

SEQ ID NO: 6236845 - DNA, 13 bp, Homo sapiens
gacttagaaactg

SEQ ID NO: 6236846 - DNA, 18 bp, Homo sapiens
gacttagaaagcaggggc

SEQ ID NO: 6236847 - DNA, 13 bp, Homo sapiens
gacttagaagcat

SEQ ID NO: 6236848 - DNA, 16 bp, Homo sapiens
gacttagaagcatcag

SEQ ID NO: 6236849 - DNA, 18 bp, Homo sapiens
gacttagaatagtgccta

SEQ ID NO: 6236850 - DNA, 20 bp, Homo sapiens
gacttagaatccctgtgtta

SEQ ID NO: 6236851 - DNA, 21 bp, Homo sapiens
gacttagaatccctgtgttaa

SEQ ID NO: 6236852 - DNA, 19 bp, Homo sapiens
gacttagacctatactgaa

SEQ ID NO: 6236853 - DNA, 13 bp, Homo sapiens
gacttagagctgg

SEQ ID NO: 6236854 - DNA, 17 bp, Homo sapiens
gacttagatattaaaat

SEQ ID NO: 6236855 - DNA, 19 bp, Homo sapiens
gacttagatattaaaattt

SEQ ID NO: 6236856 - DNA, 17 bp, Homo sapiens
gacttagatctgagccc

SEQ ID NO: 6236857 - DNA, 15 bp, Homo sapiens
gacttagattcatta

SEQ ID NO: 6236858 - DNA, 16 bp, Homo sapiens
gacttagcccgtcacc

SEQ ID NO: 6236859 - DNA, 17 bp, Homo sapiens
gacttagcctaaacaac

SEQ ID NO: 6236860 - DNA, 21 bp, Homo sapiens
gacttagcgtcaagacatttg

SEQ ID NO: 6236861 - DNA, 16 bp, Homo sapiens
gacttagtaacttttt

SEQ ID NO: 6236862 - DNA, 22 bp, Homo sapiens
gacttagttgcgttacaccctt

SEQ ID NO: 6236863 - DNA, 14 bp, Homo sapiens
gacttagtttttat

SEQ ID NO: 6236864 - DNA, 17 bp, Homo sapiens
gacttatagtacatgat

SEQ ID NO: 6236865 - DNA, 18 bp, Homo sapiens
gacttatagtacatgata

SEQ ID NO: 6236866 - DNA, 20 bp, Homo sapiens
gacttatggcatgactcttc

SEQ ID NO: 6236867 - DNA, 13 bp, Homo sapiens
gacttatgggccc

SEQ ID NO: 6236868 - DNA, 15 bp, Homo sapiens
gacttattacaattt

SEQ ID NO: 6236869 - DNA, 17 bp, Homo sapiens
gacttattatgcataaa

SEQ ID NO: 6236870 - DNA, 16 bp, Homo sapiens
gacttatttatataaa

SEQ ID NO: 6236871 - DNA, 17 bp, Homo sapiens
gacttatttctgctctg

SEQ ID NO: 6236872 - DNA, 18 bp, Homo sapiens
gacttatttctgctctgg

SEQ ID NO: 6236873 - DNA, 12 bp, Homo sapiens
gacttatttctt

SEQ ID NO: 6236874 - DNA, 17 bp, Homo sapiens
gacttatttcttcaaat

SEQ ID NO: 6236875 - DNA, 18 bp, Homo sapiens
gacttatttcttcaaatc

SEQ ID NO: 6236876 - DNA, 17 bp, Homo sapiens
gacttattttgtcttat

SEQ ID NO: 6236877 - DNA, 21 bp, Homo sapiens
gacttattttgtcttattctt

SEQ ID NO: 6236878 - DNA, 20 bp, Homo sapiens
gacttcaaaaggaatgaact

SEQ ID NO: 6236879 - DNA, 16 bp, Homo sapiens
gacttcaaaaggtgat

SEQ ID NO: 6236880 - DNA, 19 bp, Homo sapiens
gacttcaaaaggtgattaa

SEQ ID NO: 6236881 - DNA, 19 bp, Homo sapiens
gacttcaaaatattgagca

SEQ ID NO: 6236882 - DNA, 18 bp, Homo sapiens
gacttcaactgcccagca

SEQ ID NO: 6236883 - DNA, 14 bp, Homo sapiens
gacttcaatcctga

SEQ ID NO: 6236884 - DNA, 18 bp, Homo sapiens
gacttcaatttcccaccc

SEQ ID NO: 6236885 - DNA, 20 bp, Homo sapiens
gacttcaatttcccacccat

SEQ ID NO: 6236886 - DNA, 13 bp, Homo sapiens
gacttcacactgc

SEQ ID NO: 6236887 - DNA, 14 bp, Homo sapiens
gacttcacactgca

SEQ ID NO: 6236888 - DNA, 22 bp, Homo sapiens
gacttcacactgcaagagcctt

SEQ ID NO: 6236889 - DNA, 21 bp, Homo sapiens
gacttcacagcgtctgctcat

SEQ ID NO: 6236890 - DNA, 13 bp, Homo sapiens
gacttcaccaaat

SEQ ID NO: 6236891 - DNA, 22 bp, Homo sapiens
gacttcacgaagtgttgcatgg

SEQ ID NO: 6236892 - DNA, 15 bp, Homo sapiens
gacttcactgcagcc

SEQ ID NO: 6236893 - DNA, 18 bp, Homo sapiens
gacttcactgcagccttt

SEQ ID NO: 6236894 - DNA, 21 bp, Homo sapiens
gcaggcctccctgaaacactg

SEQ ID NO: 6236895 - DNA, 20 bp, Homo sapiens
gcaggcctccctgcctcagc

SEQ ID NO: 6236896 - DNA, 23 bp, Homo sapiens
gcaggcctcgaaaaccatcacat

SEQ ID NO: 6236897 - DNA, 12 bp, Homo sapiens
gcaggcctctgg

SEQ ID NO: 6236898 - DNA, 13 bp, Homo sapiens
gcaggcctctggg

SEQ ID NO: 6236899 - DNA, 14 bp, Homo sapiens
gcaggcctctggga

SEQ ID NO: 6236900 - DNA, 15 bp, Homo sapiens
gcaggcctctgggac

SEQ ID NO: 6236901 - DNA, 19 bp, Homo sapiens
gcaggcctctgggacccac

SEQ ID NO: 6236902 - DNA, 19 bp, Homo sapiens
gcaggcctctggttgcctc

SEQ ID NO: 6236903 - DNA, 21 bp, Homo sapiens
gcaggcctgacccacggggca

SEQ ID NO: 6236904 - DNA, 22 bp, Homo sapiens
gcaggcctgacccacggggcag

SEQ ID NO: 6236905 - DNA, 15 bp, Homo sapiens
gcaggcctgagaatg

SEQ ID NO: 6236906 - DNA, 22 bp, Homo sapiens
gcaggcctgagaatgagtggga

SEQ ID NO: 6236907 - DNA, 13 bp, Homo sapiens
gcaggcctgggac

SEQ ID NO: 6236908 - DNA, 14 bp, Homo sapiens
gcaggcctgggacc

SEQ ID NO: 6236909 - DNA, 19 bp, Homo sapiens
gcaggcctgtccctgggag

SEQ ID NO: 6236910 - DNA, 18 bp, Homo sapiens
gcaggccttgctggggtc

SEQ ID NO: 6236911 - DNA, 19 bp, Homo sapiens
gcaggccttgctggggtcc

SEQ ID NO: 6236912 - DNA, 22 bp, Homo sapiens
gcaggccttgctggggtccagg

SEQ ID NO: 6236913 - DNA, 19 bp, Homo sapiens
gcaggcgaccgggcctccc

SEQ ID NO: 6236914 - DNA, 22 bp, Homo sapiens
gcaggcgcatgagtatctgtgg

SEQ ID NO: 6236915 - DNA, 21 bp, Homo sapiens
gcaggcgcgcaccgcccaacc

SEQ ID NO: 6236916 - DNA, 23 bp, Homo sapiens
gcaggcgcggcggctctgcccac

SEQ ID NO: 6236917 - DNA, 13 bp, Homo sapiens
gcaggcggccagg

SEQ ID NO: 6236918 - DNA, 22 bp, Homo sapiens
gcaggcggcctttgttgctcag

SEQ ID NO: 6236919 - DNA, 15 bp, Homo sapiens
gcaggcggctcctcc

SEQ ID NO: 6236920 - DNA, 16 bp, Homo sapiens
gcaggcggctcctcct

SEQ ID NO: 6236921 - DNA, 24 bp, Homo sapiens
gcaggcgggactatcaggagtcca

SEQ ID NO: 6236922 - DNA, 14 bp, Homo sapiens
gcaggcggggctcc

SEQ ID NO: 6236923 - DNA, 15 bp, Homo sapiens
gcaggcggggctcct

SEQ ID NO: 6236924 - DNA, 22 bp, Homo sapiens
gcaggcggggctcctcctgaag

SEQ ID NO: 6236925 - DNA, 22 bp, Homo sapiens
gcaggcgggggtttgagccctg

SEQ ID NO: 6236926 - DNA, 17 bp, Homo sapiens
gcaggcggtatccagag

SEQ ID NO: 6236927 - DNA, 22 bp, Homo sapiens
gcaggcggtccccatccccacc

SEQ ID NO: 6236928 - DNA, 23 bp, Homo sapiens
gcaggcggtccccatccccacca

SEQ ID NO: 6236929 - DNA, 24 bp, Homo sapiens
gcaggcggtccccatccccaccag

SEQ ID NO: 6236930 - DNA, 15 bp, Homo sapiens
gcaggcgtgtggcag

SEQ ID NO: 6236931 - DNA, 16 bp, Homo sapiens
gcaggcgtgtggcagc

SEQ ID NO: 6236932 - DNA, 18 bp, Homo sapiens
gcaggcgtgtggcagcca

SEQ ID NO: 6236933 - DNA, 19 bp, Homo sapiens
gcaggcgtgtggcagccac

SEQ ID NO: 6236934 - DNA, 21 bp, Homo sapiens
gcaggcgtgtggcagccacac

SEQ ID NO: 6236935 - DNA, 20 bp, Homo sapiens
gcaggctaaggcgtggagct

SEQ ID NO: 6236936 - DNA, 16 bp, Homo sapiens
gcaggctactctgccc

SEQ ID NO: 6236937 - DNA, 16 bp, Homo sapiens
gcaggctagaacctgg

SEQ ID NO: 6236938 - DNA, 18 bp, Homo sapiens
gcaggctcactgccaggc

SEQ ID NO: 6236939 - DNA, 14 bp, Homo sapiens
gcaggctccatgca

SEQ ID NO: 6236940 - DNA, 17 bp, Homo sapiens
gcaggctccatgcacct

SEQ ID NO: 6236941 - DNA, 18 bp, Homo sapiens
gcaggctccatgcacctc

SEQ ID NO: 6236942 - DNA, 22 bp, Homo sapiens
gcaggctcccagggacacctgg

SEQ ID NO: 6236943 - DNA, 14 bp, Homo sapiens
gcaggctcccctga

SEQ ID NO: 6236944 - DNA, 15 bp, Homo sapiens
gcaggctcctcagcc

SEQ ID NO: 6236945 - DNA, 22 bp, Homo sapiens
gcaggctcctggctgtgcccag

SEQ ID NO: 6236946 - DNA, 23 bp, Homo sapiens
gcaggctcctggctgtgcccagc

SEQ ID NO: 6236947 - DNA, 12 bp, Homo sapiens
gcaggctctcag

SEQ ID NO: 6236948 - DNA, 15 bp, Homo sapiens
gcaggctctcaggcc

SEQ ID NO: 6236949 - DNA, 16 bp, Homo sapiens
gcaggctctcaggcca

SEQ ID NO: 6236950 - DNA, 18 bp, Homo sapiens
gcaggctctcaggccagc

SEQ ID NO: 6236951 - DNA, 20 bp, Homo sapiens
gcaggctctcaggccagctg

SEQ ID NO: 6236952 - DNA, 14 bp, Homo sapiens
gcaggctctctcct

SEQ ID NO: 6236953 - DNA, 19 bp, Homo sapiens
gcaggctctctcctctctc

SEQ ID NO: 6236954 - DNA, 11 bp, Homo sapiens
gcaggctctgg

SEQ ID NO: 6236955 - DNA, 15 bp, Homo sapiens
gcaggctctgggctc

SEQ ID NO: 6236956 - DNA, 18 bp, Homo sapiens
gcaggctctgggctcagg

SEQ ID NO: 6236957 - DNA, 21 bp, Homo sapiens
gcaggctctgggctcagggct

SEQ ID NO: 6236958 - DNA, 16 bp, Homo sapiens
gcaggctgagccactc

SEQ ID NO: 6236959 - DNA, 13 bp, Homo sapiens
gcaggctgaggca

SEQ ID NO: 6236960 - DNA, 22 bp, Homo sapiens
gcaggctgagggtcgtgggaaa

SEQ ID NO: 6236961 - DNA, 23 bp, Homo sapiens
gcaggctgagggtcgtgggaaag

SEQ ID NO: 6236962 - DNA, 15 bp, Homo sapiens
gcaggctgaggtggg

SEQ ID NO: 6236963 - DNA, 16 bp, Homo sapiens
gcaggctgagtccaga

SEQ ID NO: 6236964 - DNA, 19 bp, Homo sapiens
gcaggctgagtgcatttgg

SEQ ID NO: 6236965 - DNA, 16 bp, Homo sapiens
gcaggctgcagagccc

SEQ ID NO: 6236966 - DNA, 16 bp, Homo sapiens
gcaggctgcaggaggg

SEQ ID NO: 6236967 - DNA, 12 bp, Homo sapiens
gcaggctggaga

SEQ ID NO: 6236968 - DNA, 14 bp, Homo sapiens
gcaggctggagtta

SEQ ID NO: 6236969 - DNA, 18 bp, Homo sapiens
gcaggctggcaccgcctt

SEQ ID NO: 6236970 - DNA, 19 bp, Homo sapiens
gcaggctggcaccgccttc

SEQ ID NO: 6236971 - DNA, 22 bp, Homo sapiens
gcaggctggcagctctccagtc

SEQ ID NO: 6236972 - DNA, 14 bp, Homo sapiens
gcaggctggccagc

SEQ ID NO: 6236973 - DNA, 16 bp, Homo sapiens
gcaggctggccagccg

SEQ ID NO: 6236974 - DNA, 20 bp, Homo sapiens
gcaggctggccagccgctct

SEQ ID NO: 6236975 - DNA, 22 bp, Homo sapiens
gcaggctggccagtccaggctg

SEQ ID NO: 6236976 - DNA, 14 bp, Homo sapiens
gcaggctggccctg

SEQ ID NO: 6236977 - DNA, 15 bp, Homo sapiens
gcaggctggccctgc

SEQ ID NO: 6236978 - DNA, 21 bp, Homo sapiens
gcaggctggccctgccctggt

SEQ ID NO: 6236979 - DNA, 15 bp, Homo sapiens
gcaggctggctgttg

SEQ ID NO: 6236980 - DNA, 14 bp, Homo sapiens
gcaggctgggccat

SEQ ID NO: 6236981 - DNA, 15 bp, Homo sapiens
gcaggctgggccatg

SEQ ID NO: 6236982 - DNA, 21 bp, Homo sapiens
gcaggctgtggggtggagcac

SEQ ID NO: 6236983 - DNA, 15 bp, Homo sapiens
gcaggcttggggaaa

SEQ ID NO: 6236984 - DNA, 13 bp, Homo sapiens
gcaggcttgtggc

SEQ ID NO: 6236985 - DNA, 17 bp, Homo sapiens
gcaggctttgtgagaga

SEQ ID NO: 6236986 - DNA, 21 bp, Homo sapiens
gcagggaaaattatttgcata

SEQ ID NO: 6236987 - DNA, 16 bp, Homo sapiens
gcagggaaagctccac

SEQ ID NO: 6236988 - DNA, 22 bp, Homo sapiens
gcagggaaaggctctgaaagcc

SEQ ID NO: 6236989 - DNA, 23 bp, Homo sapiens
gcagggaaagggatggtcaggcc

SEQ ID NO: 6236990 - DNA, 18 bp, Homo sapiens
gcagggaacatggggagg

SEQ ID NO: 6236991 - DNA, 21 bp, Homo sapiens
gcagggaagaggggtgcagag

SEQ ID NO: 6236992 - DNA, 18 bp, Homo sapiens
gcagggaagccccacatg

SEQ ID NO: 6236993 - DNA, 23 bp, Homo sapiens
gcagggaagccccacatgtccag

SEQ ID NO: 6236994 - DNA, 12 bp, Homo sapiens
gcagggaagctt

SEQ ID NO: 6236995 - DNA, 13 bp, Homo sapiens
gcagggaaggaca

SEQ ID NO: 6236996 - DNA, 19 bp, Homo sapiens
gcagggaaggacaggaccc

SEQ ID NO: 6236997 - DNA, 19 bp, Homo sapiens
gcagggaaggtgaagatga

SEQ ID NO: 6236998 - DNA, 20 bp, Homo sapiens
gcagggaaggtgaagatgaa

SEQ ID NO: 6236999 - DNA, 19 bp, Homo sapiens
gcagggaagtgcagagctt

SEQ ID NO: 6237000 - DNA, 17 bp, Homo sapiens
gcagggaatgcagcagg

SEQ ID NO: 6237001 - DNA, 22 bp, Homo sapiens
gcagggaatgcagcaggaagga

SEQ ID NO: 6237002 - DNA, 15 bp, Homo sapiens
gcagggaatgcctgg

SEQ ID NO: 6237003 - DNA, 16 bp, Homo sapiens
gcagggaatgcctgga

SEQ ID NO: 6237004 - DNA, 22 bp, Homo sapiens
gcagggaattttcattggatgc

SEQ ID NO: 6237005 - DNA, 14 bp, Homo sapiens
gcagggacaaagag

SEQ ID NO: 6237006 - DNA, 15 bp, Homo sapiens
gcagggacaaagagg

SEQ ID NO: 6237007 - DNA, 21 bp, Homo sapiens
gcagggacaaagaggccttta

SEQ ID NO: 6237008 - DNA, 22 bp, Homo sapiens
gcagggacaccccccgcccccc

SEQ ID NO: 6237009 - DNA, 22 bp, Homo sapiens
gcagggacacgggcagcctggc

SEQ ID NO: 6237010 - DNA, 15 bp, Homo sapiens
gcagggacagggccg

SEQ ID NO: 6237011 - DNA, 19 bp, Homo sapiens
gcagggacatggggcaagc

SEQ ID NO: 6237012 - DNA, 22 bp, Homo sapiens
gcagggacccggggtctcctgg

SEQ ID NO: 6237013 - DNA, 16 bp, Homo sapiens
gcagggaccggcagag

SEQ ID NO: 6237014 - DNA, 16 bp, Homo sapiens
gcagggacctgagagc

SEQ ID NO: 6237015 - DNA, 19 bp, Homo sapiens
gcagggacttgcctccact

SEQ ID NO: 6237016 - DNA, 12 bp, Homo sapiens
gcagggagaagg

SEQ ID NO: 6237017 - DNA, 13 bp, Homo sapiens
gcagggagaaggg

SEQ ID NO: 6237018 - DNA, 19 bp, Homo sapiens
gcagggagacatctgcacc

SEQ ID NO: 6237019 - DNA, 13 bp, Homo sapiens
gcagggagagagt

SEQ ID NO: 6237020 - DNA, 21 bp, Homo sapiens
gcagggagcaccacggccaga

SEQ ID NO: 6237021 - DNA, 19 bp, Homo sapiens
gcagggagcggccggccag

SEQ ID NO: 6237022 - DNA, 16 bp, Homo sapiens
gcagggagctgggccc

SEQ ID NO: 6237023 - DNA, 16 bp, Homo sapiens
gcagggagctgggctt

SEQ ID NO: 6237024 - DNA, 15 bp, Homo sapiens
gcagggaggatgcca

SEQ ID NO: 6237025 - DNA, 21 bp, Homo sapiens
gcagggaggatgccacagccc

SEQ ID NO: 6237026 - DNA, 23 bp, Homo sapiens
gcagggaggatgccacagcccca

SEQ ID NO: 6237027 - DNA, 12 bp, Homo sapiens
gcagggaggcaa

SEQ ID NO: 6237028 - DNA, 22 bp, Homo sapiens
gcagggaggctctgtgtgttaa

SEQ ID NO: 6237029 - DNA, 13 bp, Homo sapiens
gcagggaggggac

SEQ ID NO: 6237030 - DNA, 15 bp, Homo sapiens
gcagggaggggacta

SEQ ID NO: 6237031 - DNA, 14 bp, Homo sapiens
gcagggaggggctg

SEQ ID NO: 6237032 - DNA, 17 bp, Homo sapiens
gcagggaggggctgggg

SEQ ID NO: 6237033 - DNA, 13 bp, Homo sapiens
gcagggagggggc

SEQ ID NO: 6237034 - DNA, 17 bp, Homo sapiens
gcagggagggggctggg

SEQ ID NO: 6237035 - DNA, 16 bp, Homo sapiens
gcagggagtgatgatt

SEQ ID NO: 6237036 - DNA, 23 bp, Homo sapiens
gcagggatccccaggaggcctgg

SEQ ID NO: 6237037 - DNA, 14 bp, Homo sapiens
gcagggatctgccc

SEQ ID NO: 6237038 - DNA, 19 bp, Homo sapiens
gcagggatgatggcagagc

SEQ ID NO: 6237039 - DNA, 20 bp, Homo sapiens
gcagggatgatggcagagcc

SEQ ID NO: 6237040 - DNA, 23 bp, Homo sapiens
gcagggatgccctggaggtggct

SEQ ID NO: 6237041 - DNA, 21 bp, Homo sapiens
gcagggatgggggtggctggg

SEQ ID NO: 6237042 - DNA, 22 bp, Homo sapiens
gcagggatgtgggttccacaga

SEQ ID NO: 6237043 - DNA, 15 bp, Homo sapiens
gcagggatttgagga

SEQ ID NO: 6237044 - DNA, 12 bp, Homo sapiens
gcagggcacaga

SEQ ID NO: 6237045 - DNA, 13 bp, Homo sapiens
gcagggcacaggg

SEQ ID NO: 6237046 - DNA, 14 bp, Homo sapiens
gcagggcacagggc

SEQ ID NO: 6237047 - DNA, 16 bp, Homo sapiens
gcagggcacggggacc

SEQ ID NO: 6237048 - DNA, 18 bp, Homo sapiens
gcagggcactctgttccc

SEQ ID NO: 6237049 - DNA, 22 bp, Homo sapiens
gcagggcactctgttcccctcc

SEQ ID NO: 6237050 - DNA, 18 bp, Homo sapiens
gcagggcagcctgtcacc

SEQ ID NO: 6237051 - DNA, 15 bp, Homo sapiens
gcagggcagcctgtg

SEQ ID NO: 6237052 - DNA, 18 bp, Homo sapiens
gcagggcaggaaggggaa

SEQ ID NO: 6237053 - DNA, 21 bp, Homo sapiens
gcagggcaggaccagcccacg

SEQ ID NO: 6237054 - DNA, 18 bp, Homo sapiens
gcagggcaggcagagctc

SEQ ID NO: 6237055 - DNA, 14 bp, Homo sapiens
gcagggcaggcccc

SEQ ID NO: 6237056 - DNA, 13 bp, Homo sapiens
gcagggcagtcat

SEQ ID NO: 6237057 - DNA, 21 bp, Homo sapiens
gcagggcatctcctgtgcatg

SEQ ID NO: 6237058 - DNA, 22 bp, Homo sapiens
gcagggcatctcctgtgcatgg

SEQ ID NO: 6237059 - DNA, 18 bp, Homo sapiens
gcagggccaaagcacagc

SEQ ID NO: 6237060 - DNA, 19 bp, Homo sapiens
gcagggccaaagcacagct

SEQ ID NO: 6237061 - DNA, 20 bp, Homo sapiens
gcagggccaaagcacagctg

SEQ ID NO: 6237062 - DNA, 19 bp, Homo sapiens
gcagggccaacccttctcc

SEQ ID NO: 6237063 - DNA, 20 bp, Homo sapiens
gcagggccacctgcaggacc

SEQ ID NO: 6237064 - DNA, 19 bp, Homo sapiens
gcagggccaggactgagcc

SEQ ID NO: 6237065 - DNA, 12 bp, Homo sapiens
gcagggccaggc

SEQ ID NO: 6237066 - DNA, 17 bp, Homo sapiens
gcagggccaggcctctg

SEQ ID NO: 6237067 - DNA, 21 bp, Homo sapiens
gcagggccaggcctctgctgg

SEQ ID NO: 6237068 - DNA, 13 bp, Homo sapiens
gcagggccaggct

SEQ ID NO: 6237069 - DNA, 12 bp, Homo sapiens
gcagggccaggg

SEQ ID NO: 6237070 - DNA, 14 bp, Homo sapiens
gcagggccagggca

SEQ ID NO: 6237071 - DNA, 11 bp, Homo sapiens
gacttcactgt

SEQ ID NO: 6237072 - DNA, 21 bp, Homo sapiens
gacttcagaacatgctggata

SEQ ID NO: 6237073 - DNA, 22 bp, Homo sapiens
gacttcagactctctcctctct

SEQ ID NO: 6237074 - DNA, 12 bp, Homo sapiens
gacttcagattt

SEQ ID NO: 6237075 - DNA, 15 bp, Homo sapiens
gacttcagctgcctg

SEQ ID NO: 6237076 - DNA, 17 bp, Homo sapiens
gacttcagctgcctgaa

SEQ ID NO: 6237077 - DNA, 20 bp, Homo sapiens
gacttcaggggctgcccgct

SEQ ID NO: 6237078 - DNA, 21 bp, Homo sapiens
gacttcagtatgttgtcaaag

SEQ ID NO: 6237079 - DNA, 16 bp, Homo sapiens
gacttcagtcttgcct

SEQ ID NO: 6237080 - DNA, 19 bp, Homo sapiens
gacttcagtgaaattttca

SEQ ID NO: 6237081 - DNA, 12 bp, Homo sapiens
gacttcatccca

SEQ ID NO: 6237082 - DNA, 20 bp, Homo sapiens
gacttcatccctctggggct

SEQ ID NO: 6237083 - DNA, 12 bp, Homo sapiens
gacttcatttgt

SEQ ID NO: 6237084 - DNA, 15 bp, Homo sapiens
gacttcattttatat

SEQ ID NO: 6237085 - DNA, 16 bp, Homo sapiens
gacttcattttatatt

SEQ ID NO: 6237086 - DNA, 17 bp, Homo sapiens
gacttcattttatattt

SEQ ID NO: 6237087 - DNA, 12 bp, Homo sapiens
gacttccaaaga

SEQ ID NO: 6237088 - DNA, 15 bp, Homo sapiens
gacttccaaagaatg

SEQ ID NO: 6237089 - DNA, 16 bp, Homo sapiens
gacttccaaagaatgt

SEQ ID NO: 6237090 - DNA, 20 bp, Homo sapiens
gacttccaaatcctggaagg

SEQ ID NO: 6237091 - DNA, 21 bp, Homo sapiens
gacttcccagctggcagcgcc

SEQ ID NO: 6237092 - DNA, 21 bp, Homo sapiens
gacttccccaagcctggcagg

SEQ ID NO: 6237093 - DNA, 17 bp, Homo sapiens
gacttccccaatatctt

SEQ ID NO: 6237094 - DNA, 22 bp, Homo sapiens
gacttccccgcattccaggctc

SEQ ID NO: 6237095 - DNA, 20 bp, Homo sapiens
gacttccccggagggctgcg

SEQ ID NO: 6237096 - DNA, 15 bp, Homo sapiens
gacttcccctgcctc

SEQ ID NO: 6237097 - DNA, 20 bp, Homo sapiens
gacttccctggaggagaagt

SEQ ID NO: 6237098 - DNA, 15 bp, Homo sapiens
gacttccctggtcac

SEQ ID NO: 6237099 - DNA, 16 bp, Homo sapiens
gacttccgctccctgg

SEQ ID NO: 6237100 - DNA, 22 bp, Homo sapiens
gacttcctagggatctgaaatc

SEQ ID NO: 6237101 - DNA, 18 bp, Homo sapiens
gacttcctattaatttat

SEQ ID NO: 6237102 - DNA, 20 bp, Homo sapiens
gacttcctccaatccccact

SEQ ID NO: 6237103 - DNA, 23 bp, Homo sapiens
gacttcctccaatccccactcct

SEQ ID NO: 6237104 - DNA, 17 bp, Homo sapiens
gacttcctctctacccc

SEQ ID NO: 6237105 - DNA, 12 bp, Homo sapiens
gacttcctctgg

SEQ ID NO: 6237106 - DNA, 14 bp, Homo sapiens
gacttcctctggct

SEQ ID NO: 6237107 - DNA, 19 bp, Homo sapiens
gacttcctgactctcacct

SEQ ID NO: 6237108 - DNA, 21 bp, Homo sapiens
gacttcctgattggtttctct

SEQ ID NO: 6237109 - DNA, 22 bp, Homo sapiens
gacttcctgattggtttctctt

SEQ ID NO: 6237110 - DNA, 15 bp, Homo sapiens
gacttccttgagaca

SEQ ID NO: 6237111 - DNA, 16 bp, Homo sapiens
gacttccttgctctcc

SEQ ID NO: 6237112 - DNA, 17 bp, Homo sapiens
gacttccttgctctccc

SEQ ID NO: 6237113 - DNA, 21 bp, Homo sapiens
gacttccttgtgtcagggcag

SEQ ID NO: 6237114 - DNA, 16 bp, Homo sapiens
gacttcgactcaggat

SEQ ID NO: 6237115 - DNA, 18 bp, Homo sapiens
gacttcgactgtgacctg

SEQ ID NO: 6237116 - DNA, 15 bp, Homo sapiens
gacttcgcagaggca

SEQ ID NO: 6237117 - DNA, 16 bp, Homo sapiens
gacttcgctattccca

SEQ ID NO: 6237118 - DNA, 19 bp, Homo sapiens
gacttcgctattcccaggc

SEQ ID NO: 6237119 - DNA, 14 bp, Homo sapiens
gacttctaaaataa

SEQ ID NO: 6237120 - DNA, 19 bp, Homo sapiens
gacttctaaaataaatgtt

SEQ ID NO: 6237121 - DNA, 20 bp, Homo sapiens
gacttctaaaataaatgttt

SEQ ID NO: 6237122 - DNA, 20 bp, Homo sapiens
gacttctaggaggatgctgt

SEQ ID NO: 6237123 - DNA, 19 bp, Homo sapiens
gacttctatcctgttaaca

SEQ ID NO: 6237124 - DNA, 19 bp, Homo sapiens
gacttctattttttaaaga

SEQ ID NO: 6237125 - DNA, 17 bp, Homo sapiens
gacttctcaaagagaat

SEQ ID NO: 6237126 - DNA, 15 bp, Homo sapiens
gacttctcaccagca

SEQ ID NO: 6237127 - DNA, 14 bp, Homo sapiens
gacttctcacttcc

SEQ ID NO: 6237128 - DNA, 16 bp, Homo sapiens
gacttctcacttccta

SEQ ID NO: 6237129 - DNA, 18 bp, Homo sapiens
gacttctccaggcagagg

SEQ ID NO: 6237130 - DNA, 12 bp, Homo sapiens
gacttctccccc

SEQ ID NO: 6237131 - DNA, 22 bp, Homo sapiens
gacttctcccccgccctgcccc

SEQ ID NO: 6237132 - DNA, 21 bp, Homo sapiens
gacttctctaatagaaaagtc

SEQ ID NO: 6237133 - DNA, 13 bp, Homo sapiens
gacttctctgaat

SEQ ID NO: 6237134 - DNA, 23 bp, Homo sapiens
gacttctctgtcctctgctttgc

SEQ ID NO: 6237135 - DNA, 14 bp, Homo sapiens
gacttctctttctt

SEQ ID NO: 6237136 - DNA, 12 bp, Homo sapiens
gacttctgagat

SEQ ID NO: 6237137 - DNA, 15 bp, Homo sapiens
gacttctgcccaaat

SEQ ID NO: 6237138 - DNA, 17 bp, Homo sapiens
gacttctgcctggagac

SEQ ID NO: 6237139 - DNA, 19 bp, Homo sapiens
gacttctgctgaaggacag

SEQ ID NO: 6237140 - DNA, 16 bp, Homo sapiens
gacttctggaaggctg

SEQ ID NO: 6237141 - DNA, 14 bp, Homo sapiens
gacttctggcctag

SEQ ID NO: 6237142 - DNA, 15 bp, Homo sapiens
gacttctgggtctcc

SEQ ID NO: 6237143 - DNA, 16 bp, Homo sapiens
gacttctggtgctgct

SEQ ID NO: 6237144 - DNA, 17 bp, Homo sapiens
gacttctgttttcaatc

SEQ ID NO: 6237145 - DNA, 23 bp, Homo sapiens
gacttctgttttcaatctcgtat

SEQ ID NO: 6237146 - DNA, 20 bp, Homo sapiens
gacttcttacacataaagca

SEQ ID NO: 6237147 - DNA, 17 bp, Homo sapiens
gacttcttacccaaagc

SEQ ID NO: 6237148 - DNA, 18 bp, Homo sapiens
gacttcttacccaaagca

SEQ ID NO: 6237149 - DNA, 20 bp, Homo sapiens
gacttcttacccaaagcaca

SEQ ID NO: 6237150 - DNA, 18 bp, Homo sapiens
gacttcttccctaaaatg

SEQ ID NO: 6237151 - DNA, 19 bp, Homo sapiens
gacttcttcggaggtggca

SEQ ID NO: 6237152 - DNA, 15 bp, Homo sapiens
gacttcttgcttcag

SEQ ID NO: 6237153 - DNA, 22 bp, Homo sapiens
gacttcttggtttggggagaaa

SEQ ID NO: 6237154 - DNA, 15 bp, Homo sapiens
gacttcttgttcatg

SEQ ID NO: 6237155 - DNA, 18 bp, Homo sapiens
gacttctttactaacact

SEQ ID NO: 6237156 - DNA, 19 bp, Homo sapiens
gacttctttactaacactg

SEQ ID NO: 6237157 - DNA, 22 bp, Homo sapiens
gacttctttcaaattgagagaa

SEQ ID NO: 6237158 - DNA, 23 bp, Homo sapiens
gacttctttggtgttctggcctc

SEQ ID NO: 6237159 - DNA, 17 bp, Homo sapiens
gacttgaaaagagacag

SEQ ID NO: 6237160 - DNA, 21 bp, Homo sapiens
gacttgaaaagagacaggcag

SEQ ID NO: 6237161 - DNA, 22 bp, Homo sapiens
gacttgaaaagagacaggcagg

SEQ ID NO: 6237162 - DNA, 16 bp, Homo sapiens
gacttgaaagcatcca

SEQ ID NO: 6237163 - DNA, 19 bp, Homo sapiens
gacttgaaagcatccatgt

SEQ ID NO: 6237164 - DNA, 16 bp, Homo sapiens
gacttgaagacttaca

SEQ ID NO: 6237165 - DNA, 18 bp, Homo sapiens
gacttgaaggagtttaaa

SEQ ID NO: 6237166 - DNA, 15 bp, Homo sapiens
gacttgaagttgtta

SEQ ID NO: 6237167 - DNA, 21 bp, Homo sapiens
gacttgaatattcctggactt

SEQ ID NO: 6237168 - DNA, 15 bp, Homo sapiens
gacttgaatgctgcc

SEQ ID NO: 6237169 - DNA, 14 bp, Homo sapiens
gacttgaatgtaca

SEQ ID NO: 6237170 - DNA, 19 bp, Homo sapiens
gacttgaatgtacaaagat

SEQ ID NO: 6237171 - DNA, 21 bp, Homo sapiens
gacttgaattcaaagcatgtc

SEQ ID NO: 6237172 - DNA, 19 bp, Homo sapiens
gacttgaattttcccactg

SEQ ID NO: 6237173 - DNA, 18 bp, Homo sapiens
gacttgacagaacactgt

SEQ ID NO: 6237174 - DNA, 13 bp, Homo sapiens
gacttgaccccga

SEQ ID NO: 6237175 - DNA, 15 bp, Homo sapiens
gacttgaccctttcc

SEQ ID NO: 6237176 - DNA, 22 bp, Homo sapiens
gacttgaccctttcctccccca

SEQ ID NO: 6237177 - DNA, 23 bp, Homo sapiens
gacttgacgcagccccccacgct

SEQ ID NO: 6237178 - DNA, 22 bp, Homo sapiens
gacttgagaagtctaattcaca

SEQ ID NO: 6237179 - DNA, 12 bp, Homo sapiens
gacttgagccac

SEQ ID NO: 6237180 - DNA, 20 bp, Homo sapiens
gacttgagccactccttcct

SEQ ID NO: 6237181 - DNA, 19 bp, Homo sapiens
gacttgaggattttgagta

SEQ ID NO: 6237182 - DNA, 17 bp, Homo sapiens
gacttgagtctattttt

SEQ ID NO: 6237183 - DNA, 23 bp, Homo sapiens
gacttgagtgttcctttttaaat

SEQ ID NO: 6237184 - DNA, 17 bp, Homo sapiens
gacttgatgaataaaca

SEQ ID NO: 6237185 - DNA, 20 bp, Homo sapiens
gacttgatgttccttccaga

SEQ ID NO: 6237186 - DNA, 15 bp, Homo sapiens
gacttgattgtactt

SEQ ID NO: 6237187 - DNA, 15 bp, Homo sapiens
gacttgcacatctct

SEQ ID NO: 6237188 - DNA, 15 bp, Homo sapiens
gacttgcagttagac

SEQ ID NO: 6237189 - DNA, 22 bp, Homo sapiens
gacttgccaacaccacagaaat

SEQ ID NO: 6237190 - DNA, 14 bp, Homo sapiens
gacttgccactgcc

SEQ ID NO: 6237191 - DNA, 15 bp, Homo sapiens
gacttgccactgcca

SEQ ID NO: 6237192 - DNA, 16 bp, Homo sapiens
gacttgccatgaaggc

SEQ ID NO: 6237193 - DNA, 23 bp, Homo sapiens
gacttgccatgtgactctggctt

SEQ ID NO: 6237194 - DNA, 23 bp, Homo sapiens
gacttgccgtcccctaaggaaat

SEQ ID NO: 6237195 - DNA, 16 bp, Homo sapiens
gacttgcctccgtgtc

SEQ ID NO: 6237196 - DNA, 18 bp, Homo sapiens
gacttgcggccacagcac

SEQ ID NO: 6237197 - DNA, 23 bp, Homo sapiens
gacttgctaaagcactttgcact

SEQ ID NO: 6237198 - DNA, 14 bp, Homo sapiens
gacttgctccctct

SEQ ID NO: 6237199 - DNA, 22 bp, Homo sapiens
gacttgctgtccaggcagctcc

SEQ ID NO: 6237200 - DNA, 21 bp, Homo sapiens
gacttgctgtgtgaccctggg

SEQ ID NO: 6237201 - DNA, 20 bp, Homo sapiens
gacttgctgttttgttctgt

SEQ ID NO: 6237202 - DNA, 22 bp, Homo sapiens
gacttgctgttttgttctgtgg

SEQ ID NO: 6237203 - DNA, 12 bp, Homo sapiens
gacttgcttcct

SEQ ID NO: 6237204 - DNA, 13 bp, Homo sapiens
gacttgcttcctg

SEQ ID NO: 6237205 - DNA, 15 bp, Homo sapiens
gacttgcttcttgtg

SEQ ID NO: 6237206 - DNA, 11 bp, Homo sapiens
gacttgcttta

SEQ ID NO: 6237207 - DNA, 18 bp, Homo sapiens
gacttggaagaggaggag

SEQ ID NO: 6237208 - DNA, 20 bp, Homo sapiens
gacttggagaatactgccaa

SEQ ID NO: 6237209 - DNA, 21 bp, Homo sapiens
gacttggagaatactgccaaa

SEQ ID NO: 6237210 - DNA, 21 bp, Homo sapiens
gacttggagagaatcatgctg

SEQ ID NO: 6237211 - DNA, 20 bp, Homo sapiens
gacttggagagagattcaga

SEQ ID NO: 6237212 - DNA, 14 bp, Homo sapiens
gacttggagagcaa

SEQ ID NO: 6237213 - DNA, 19 bp, Homo sapiens
gacttggagagcaaaggcc

SEQ ID NO: 6237214 - DNA, 20 bp, Homo sapiens
gacttggagagcaaaggccc

SEQ ID NO: 6237215 - DNA, 22 bp, Homo sapiens
gacttggagagcaaaggcccat

SEQ ID NO: 6237216 - DNA, 23 bp, Homo sapiens
gacttggagagcaaaggcccatg

SEQ ID NO: 6237217 - DNA, 16 bp, Homo sapiens
gacttggagctgtcct

SEQ ID NO: 6237218 - DNA, 16 bp, Homo sapiens
gacttggagggtctgg

SEQ ID NO: 6237219 - DNA, 19 bp, Homo sapiens
gacttggagggtctggggg

SEQ ID NO: 6237220 - DNA, 21 bp, Homo sapiens
gacttggagggttggtcctct

SEQ ID NO: 6237221 - DNA, 23 bp, Homo sapiens
gacttggataggagcttccagat

SEQ ID NO: 6237222 - DNA, 20 bp, Homo sapiens
gacttggatcccaaagcaag

SEQ ID NO: 6237223 - DNA, 13 bp, Homo sapiens
gacttggatgagg

SEQ ID NO: 6237224 - DNA, 19 bp, Homo sapiens
gacttggcaacagaagcag

SEQ ID NO: 6237225 - DNA, 14 bp, Homo sapiens
gacttggcaggtgc

SEQ ID NO: 6237226 - DNA, 16 bp, Homo sapiens
gacttggcccaggaaa

SEQ ID NO: 6237227 - DNA, 15 bp, Homo sapiens
gacttggcccctgcc

SEQ ID NO: 6237228 - DNA, 18 bp, Homo sapiens
gacttggccgcttcccta

SEQ ID NO: 6237229 - DNA, 22 bp, Homo sapiens
gacttggccgcttccctaccca

SEQ ID NO: 6237230 - DNA, 11 bp, Homo sapiens
gacttggctgt

SEQ ID NO: 6237231 - DNA, 16 bp, Homo sapiens
gacttggctgtccttc

SEQ ID NO: 6237232 - DNA, 20 bp, Homo sapiens
gacttggctgtccttcccct

SEQ ID NO: 6237233 - DNA, 20 bp, Homo sapiens
gacttgggagagggagcaag

SEQ ID NO: 6237234 - DNA, 17 bp, Homo sapiens
gacttgggatctgcaag

SEQ ID NO: 6237235 - DNA, 14 bp, Homo sapiens
gacttgggcacccc

SEQ ID NO: 6237236 - DNA, 16 bp, Homo sapiens
gacttggggaccagag

SEQ ID NO: 6237237 - DNA, 19 bp, Homo sapiens
gacttgggggcagagcagc

SEQ ID NO: 6237238 - DNA, 16 bp, Homo sapiens
gacttggggtcaggaa

SEQ ID NO: 6237239 - DNA, 20 bp, Homo sapiens
gacttgggtctcatttagaa

SEQ ID NO: 6237240 - DNA, 20 bp, Homo sapiens
gacttggtaagatgactctg

SEQ ID NO: 6237241 - DNA, 16 bp, Homo sapiens
gacttggtacagttgc

SEQ ID NO: 6237242 - DNA, 16 bp, Homo sapiens
gacttggtcaccagct

SEQ ID NO: 6237243 - DNA, 14 bp, Homo sapiens
gacttggtctgatt

SEQ ID NO: 6237244 - DNA, 22 bp, Homo sapiens
gacttggtcttttttctgggtc

SEQ ID NO: 6237245 - DNA, 21 bp, Homo sapiens
gacttggtggcttttccttga

SEQ ID NO: 6237246 - DNA, 17 bp, Homo sapiens
gacttggttctgaagcc

SEQ ID NO: 6237247 - DNA, 17 bp, Homo sapiens
gacttggttggtagggt

SEQ ID NO: 6237248 - DNA, 22 bp, Homo sapiens
gcagggccatctgactgccaag

SEQ ID NO: 6237249 - DNA, 24 bp, Homo sapiens
gcagggccatctgactgccaagcc

SEQ ID NO: 6237250 - DNA, 13 bp, Homo sapiens
gcagggccatggc

SEQ ID NO: 6237251 - DNA, 16 bp, Homo sapiens
gcagggccatggctca

SEQ ID NO: 6237252 - DNA, 22 bp, Homo sapiens
gcagggccatggctcagggtgg

SEQ ID NO: 6237253 - DNA, 13 bp, Homo sapiens
gcagggcccacct

SEQ ID NO: 6237254 - DNA, 22 bp, Homo sapiens
gcagggcccaccttggaccctg

SEQ ID NO: 6237255 - DNA, 20 bp, Homo sapiens
gcagggcccacgtgtatagt

SEQ ID NO: 6237256 - DNA, 17 bp, Homo sapiens
gcagggcccagggaggt

SEQ ID NO: 6237257 - DNA, 20 bp, Homo sapiens
gcagggcccagggaggtggc

SEQ ID NO: 6237258 - DNA, 20 bp, Homo sapiens
gcagggcccccaataaacca

SEQ ID NO: 6237259 - DNA, 22 bp, Homo sapiens
gcagggcccccaataaaccagt

SEQ ID NO: 6237260 - DNA, 17 bp, Homo sapiens
gcagggcccccactgga

SEQ ID NO: 6237261 - DNA, 13 bp, Homo sapiens
gcagggccctcag

SEQ ID NO: 6237262 - DNA, 14 bp, Homo sapiens
gcagggccctgggg

SEQ ID NO: 6237263 - DNA, 16 bp, Homo sapiens
gcagggccctgtggct

SEQ ID NO: 6237264 - DNA, 16 bp, Homo sapiens
gcagggcccttatgga

SEQ ID NO: 6237265 - DNA, 13 bp, Homo sapiens
gcagggccgcagg

SEQ ID NO: 6237266 - DNA, 14 bp, Homo sapiens
gcagggccgcaggg

SEQ ID NO: 6237267 - DNA, 15 bp, Homo sapiens
gcagggccgccaggg

SEQ ID NO: 6237268 - DNA, 21 bp, Homo sapiens
gcagggccgcccgggcccaga

SEQ ID NO: 6237269 - DNA, 17 bp, Homo sapiens
gcagggcctagctgcta

SEQ ID NO: 6237270 - DNA, 21 bp, Homo sapiens
gcagggcctagctgctacaaa

SEQ ID NO: 6237271 - DNA, 12 bp, Homo sapiens
gcagggcctctg

SEQ ID NO: 6237272 - DNA, 16 bp, Homo sapiens
gcagggcctggcatag

SEQ ID NO: 6237273 - DNA, 13 bp, Homo sapiens
gcagggcctggcc

SEQ ID NO: 6237274 - DNA, 15 bp, Homo sapiens
gcagggcctggcctg

SEQ ID NO: 6237275 - DNA, 17 bp, Homo sapiens
gcagggcctgggcctca

SEQ ID NO: 6237276 - DNA, 19 bp, Homo sapiens
gcagggcctgggcctcatg

SEQ ID NO: 6237277 - DNA, 13 bp, Homo sapiens
gcagggcgagctg

SEQ ID NO: 6237278 - DNA, 14 bp, Homo sapiens
gcagggcgagctgc

SEQ ID NO: 6237279 - DNA, 19 bp, Homo sapiens
gcagggcgagctgcaggaa

SEQ ID NO: 6237280 - DNA, 21 bp, Homo sapiens
gcagggcgccaagtctggcac

SEQ ID NO: 6237281 - DNA, 17 bp, Homo sapiens
gcagggcgcccagcgcc

SEQ ID NO: 6237282 - DNA, 21 bp, Homo sapiens
gcagggcgctccggcagaggc

SEQ ID NO: 6237283 - DNA, 21 bp, Homo sapiens
gcagggcggccagtgcagtga

SEQ ID NO: 6237284 - DNA, 22 bp, Homo sapiens
gcagggcggctgccgactcccc

SEQ ID NO: 6237285 - DNA, 22 bp, Homo sapiens
gcagggcgggcagagggctgga

SEQ ID NO: 6237286 - DNA, 18 bp, Homo sapiens
gcagggcgggccaggaga

SEQ ID NO: 6237287 - DNA, 14 bp, Homo sapiens
gcagggcggggctg

SEQ ID NO: 6237288 - DNA, 18 bp, Homo sapiens
gcagggcggtctcactcc

SEQ ID NO: 6237289 - DNA, 17 bp, Homo sapiens
gcagggctaaataaaga

SEQ ID NO: 6237290 - DNA, 17 bp, Homo sapiens
gcagggctaccctgagc

SEQ ID NO: 6237291 - DNA, 16 bp, Homo sapiens
gcagggctcacactcc

SEQ ID NO: 6237292 - DNA, 19 bp, Homo sapiens
gcagggctcacactcctgg

SEQ ID NO: 6237293 - DNA, 12 bp, Homo sapiens
gcagggctcagc

SEQ ID NO: 6237294 - DNA, 21 bp, Homo sapiens
gcagggctcagcggggacagc

SEQ ID NO: 6237295 - DNA, 17 bp, Homo sapiens
gcagggctcccacagag

SEQ ID NO: 6237296 - DNA, 13 bp, Homo sapiens
gcagggctcccat

SEQ ID NO: 6237297 - DNA, 21 bp, Homo sapiens
gcagggctcctccctggagct

SEQ ID NO: 6237298 - DNA, 23 bp, Homo sapiens
gcagggctcctccctggagctag

SEQ ID NO: 6237299 - DNA, 16 bp, Homo sapiens
gcagggctctcccgtg

SEQ ID NO: 6237300 - DNA, 18 bp, Homo sapiens
gcagggctctcctggctt

SEQ ID NO: 6237301 - DNA, 23 bp, Homo sapiens
gcagggctctctttccttcttgc

SEQ ID NO: 6237302 - DNA, 19 bp, Homo sapiens
gcagggctgcagagggaga

SEQ ID NO: 6237303 - DNA, 12 bp, Homo sapiens
gcagggctgctg

SEQ ID NO: 6237304 - DNA, 13 bp, Homo sapiens
gcagggctgctgt

SEQ ID NO: 6237305 - DNA, 23 bp, Homo sapiens
gcagggctggaatgggagacctg

SEQ ID NO: 6237306 - DNA, 13 bp, Homo sapiens
gcagggctgggcc

SEQ ID NO: 6237307 - DNA, 11 bp, Homo sapiens
gcagggctggt

SEQ ID NO: 6237308 - DNA, 20 bp, Homo sapiens
gcagggctggtcacctccca

SEQ ID NO: 6237309 - DNA, 13 bp, Homo sapiens
gcagggctggtct

SEQ ID NO: 6237310 - DNA, 16 bp, Homo sapiens
gcagggctggtttgtt

SEQ ID NO: 6237311 - DNA, 14 bp, Homo sapiens
gcagggctgtgcac

SEQ ID NO: 6237312 - DNA, 14 bp, Homo sapiens
gcagggcttctcct

SEQ ID NO: 6237313 - DNA, 21 bp, Homo sapiens
gcaggggaagcaggacccagt

SEQ ID NO: 6237314 - DNA, 20 bp, Homo sapiens
gcaggggaattttctctcca

SEQ ID NO: 6237315 - DNA, 21 bp, Homo sapiens
gcaggggaattttctctccat

SEQ ID NO: 6237316 - DNA, 22 bp, Homo sapiens
gcaggggacctggagctgccag

SEQ ID NO: 6237317 - DNA, 23 bp, Homo sapiens
gcaggggacctggagctgccagc

SEQ ID NO: 6237318 - DNA, 16 bp, Homo sapiens
gcaggggactgggcca

SEQ ID NO: 6237319 - DNA, 17 bp, Homo sapiens
gcaggggactgtctcag

SEQ ID NO: 6237320 - DNA, 14 bp, Homo sapiens
gcaggggagaagcg

SEQ ID NO: 6237321 - DNA, 20 bp, Homo sapiens
gcaggggagccagggtagag

SEQ ID NO: 6237322 - DNA, 14 bp, Homo sapiens
gcaggggagcttgg

SEQ ID NO: 6237323 - DNA, 16 bp, Homo sapiens
gcaggggagcttggga

SEQ ID NO: 6237324 - DNA, 18 bp, Homo sapiens
gcaggggagcttgggact

SEQ ID NO: 6237325 - DNA, 15 bp, Homo sapiens
gcaggggaggccatc

SEQ ID NO: 6237326 - DNA, 21 bp, Homo sapiens
gcaggggagggtcagccaggg

SEQ ID NO: 6237327 - DNA, 13 bp, Homo sapiens
gcaggggagtctg

SEQ ID NO: 6237328 - DNA, 15 bp, Homo sapiens
gcaggggcaccttcc

SEQ ID NO: 6237329 - DNA, 20 bp, Homo sapiens
gcaggggcagaaggaggaag

SEQ ID NO: 6237330 - DNA, 12 bp, Homo sapiens
gcaggggcagga

SEQ ID NO: 6237331 - DNA, 21 bp, Homo sapiens
gcaggggcaggagaggctggg

SEQ ID NO: 6237332 - DNA, 18 bp, Homo sapiens
gcaggggcaggagggagg

SEQ ID NO: 6237333 - DNA, 15 bp, Homo sapiens
gcaggggcaggcgca

SEQ ID NO: 6237334 - DNA, 16 bp, Homo sapiens
gcaggggccaagcagg

SEQ ID NO: 6237335 - DNA, 18 bp, Homo sapiens
gcaggggccaagcaggca

SEQ ID NO: 6237336 - DNA, 17 bp, Homo sapiens
gcaggggcccacttggg

SEQ ID NO: 6237337 - DNA, 23 bp, Homo sapiens
gcaggggcccacttggggccttc

SEQ ID NO: 6237338 - DNA, 13 bp, Homo sapiens
gcaggggcccctc

SEQ ID NO: 6237339 - DNA, 18 bp, Homo sapiens
gcaggggcccctcctctg

SEQ ID NO: 6237340 - DNA, 22 bp, Homo sapiens
gcaggggcccctcctctgtgct

SEQ ID NO: 6237341 - DNA, 14 bp, Homo sapiens
gcaggggcccctgg

SEQ ID NO: 6237342 - DNA, 18 bp, Homo sapiens
gcaggggcccctggggac

SEQ ID NO: 6237343 - DNA, 16 bp, Homo sapiens
gcaggggccctgagcc

SEQ ID NO: 6237344 - DNA, 19 bp, Homo sapiens
gcaggggccctgcagctct

SEQ ID NO: 6237345 - DNA, 20 bp, Homo sapiens
gcaggggccctgcagctctc

SEQ ID NO: 6237346 - DNA, 22 bp, Homo sapiens
gcaggggccgcttcgccatgtg

SEQ ID NO: 6237347 - DNA, 14 bp, Homo sapiens
gcaggggcctggag

SEQ ID NO: 6237348 - DNA, 15 bp, Homo sapiens
gcaggggcctggagg

SEQ ID NO: 6237349 - DNA, 13 bp, Homo sapiens
gcaggggcctggg

SEQ ID NO: 6237350 - DNA, 15 bp, Homo sapiens
gcaggggcctgggcc

SEQ ID NO: 6237351 - DNA, 13 bp, Homo sapiens
gcaggggctccag

SEQ ID NO: 6237352 - DNA, 16 bp, Homo sapiens
gcaggggctctggaga

SEQ ID NO: 6237353 - DNA, 17 bp, Homo sapiens
gcaggggctctggagag

SEQ ID NO: 6237354 - DNA, 15 bp, Homo sapiens
gcaggggctgctggg

SEQ ID NO: 6237355 - DNA, 16 bp, Homo sapiens
gcaggggctgctgggg

SEQ ID NO: 6237356 - DNA, 14 bp, Homo sapiens
gcaggggctgggca

SEQ ID NO: 6237357 - DNA, 14 bp, Homo sapiens
gcaggggcttccca

SEQ ID NO: 6237358 - DNA, 15 bp, Homo sapiens
gcaggggcttggctg

SEQ ID NO: 6237359 - DNA, 20 bp, Homo sapiens
gcaggggcttgttgcaggct

SEQ ID NO: 6237360 - DNA, 19 bp, Homo sapiens
gcagggggacagcagggac

SEQ ID NO: 6237361 - DNA, 22 bp, Homo sapiens
gcagggggccccgccagggctg

SEQ ID NO: 6237362 - DNA, 17 bp, Homo sapiens
gcaggggggctgtgcca

SEQ ID NO: 6237363 - DNA, 18 bp, Homo sapiens
gcaggggggctgtgccaa

SEQ ID NO: 6237364 - DNA, 13 bp, Homo sapiens
gcaggggggttgg

SEQ ID NO: 6237365 - DNA, 20 bp, Homo sapiens
gcagggggtatgcagagctt

SEQ ID NO: 6237366 - DNA, 16 bp, Homo sapiens
gcagggggtgaggggc

SEQ ID NO: 6237367 - DNA, 21 bp, Homo sapiens
gcaggggtcgcgatgatgggc

SEQ ID NO: 6237368 - DNA, 15 bp, Homo sapiens
gcaggggtgagagca

SEQ ID NO: 6237369 - DNA, 18 bp, Homo sapiens
gcaggggtgctgtggaca

SEQ ID NO: 6237370 - DNA, 15 bp, Homo sapiens
gcaggggtgggagag

SEQ ID NO: 6237371 - DNA, 20 bp, Homo sapiens
gcaggggtgggggtggaggc

SEQ ID NO: 6237372 - DNA, 21 bp, Homo sapiens
gcaggggtgggggtggaggct

SEQ ID NO: 6237373 - DNA, 13 bp, Homo sapiens
gcaggggtggtgg

SEQ ID NO: 6237374 - DNA, 13 bp, Homo sapiens
gcagggtaccctt

SEQ ID NO: 6237375 - DNA, 23 bp, Homo sapiens
gcagggtaccctttggggagcag

SEQ ID NO: 6237376 - DNA, 14 bp, Homo sapiens
gcagggtagagagg

SEQ ID NO: 6237377 - DNA, 14 bp, Homo sapiens
gcagggtcaggaga

SEQ ID NO: 6237378 - DNA, 17 bp, Homo sapiens
gcagggtcagtggaagc

SEQ ID NO: 6237379 - DNA, 15 bp, Homo sapiens
gcagggtccacagct

SEQ ID NO: 6237380 - DNA, 17 bp, Homo sapiens
gcagggtccacagctgg

SEQ ID NO: 6237381 - DNA, 15 bp, Homo sapiens
gcagggtccacgcct

SEQ ID NO: 6237382 - DNA, 16 bp, Homo sapiens
gcagggtccacgcctc

SEQ ID NO: 6237383 - DNA, 21 bp, Homo sapiens
gcagggtcccatttctcactg

SEQ ID NO: 6237384 - DNA, 14 bp, Homo sapiens
gcagggtccctcca

SEQ ID NO: 6237385 - DNA, 17 bp, Homo sapiens
gcagggtccctccagca

SEQ ID NO: 6237386 - DNA, 19 bp, Homo sapiens
gcagggtcctagaaattcc

SEQ ID NO: 6237387 - DNA, 21 bp, Homo sapiens
gcagggtcctcttctgggcct

SEQ ID NO: 6237388 - DNA, 19 bp, Homo sapiens
gcagggtctcactctgttg

SEQ ID NO: 6237389 - DNA, 14 bp, Homo sapiens
gcagggtctctgct

SEQ ID NO: 6237390 - DNA, 18 bp, Homo sapiens
gcagggtctctgctccag

SEQ ID NO: 6237391 - DNA, 20 bp, Homo sapiens
gcagggtctctgctccagca

SEQ ID NO: 6237392 - DNA, 20 bp, Homo sapiens
gcagggtctgggcaggactc

SEQ ID NO: 6237393 - DNA, 15 bp, Homo sapiens
gcagggtctgggctg

SEQ ID NO: 6237394 - DNA, 16 bp, Homo sapiens
gcagggtctgggctgg

SEQ ID NO: 6237395 - DNA, 21 bp, Homo sapiens
gcagggtctgggctgggcacc

SEQ ID NO: 6237396 - DNA, 19 bp, Homo sapiens
gcagggtctgtttggactg

SEQ ID NO: 6237397 - DNA, 21 bp, Homo sapiens
gcagggtctgtttggactgca

SEQ ID NO: 6237398 - DNA, 19 bp, Homo sapiens
gcagggtgacgcctgagac

SEQ ID NO: 6237399 - DNA, 13 bp, Homo sapiens
gcagggtgcagga

SEQ ID NO: 6237400 - DNA, 23 bp, Homo sapiens
gcagggtgggagccgggaccctc

SEQ ID NO: 6237401 - DNA, 18 bp, Homo sapiens
gcagggtgggcagcctat

SEQ ID NO: 6237402 - DNA, 21 bp, Homo sapiens
gcagggtggggtaaggaggag

SEQ ID NO: 6237403 - DNA, 17 bp, Homo sapiens
gcagggtggggtctggg

SEQ ID NO: 6237404 - DNA, 22 bp, Homo sapiens
gcagggtgggtgagctctcagg

SEQ ID NO: 6237405 - DNA, 19 bp, Homo sapiens
gcagggtggtgctgggact

SEQ ID NO: 6237406 - DNA, 23 bp, Homo sapiens
gcagggtgtctgccccctcctga

SEQ ID NO: 6237407 - DNA, 14 bp, Homo sapiens
gcagggtgttggga

SEQ ID NO: 6237408 - DNA, 18 bp, Homo sapiens
gcagggttacacaaaaat

SEQ ID NO: 6237409 - DNA, 13 bp, Homo sapiens
gcagggttctaga

SEQ ID NO: 6237410 - DNA, 17 bp, Homo sapiens
gcagggttctagaaggg

SEQ ID NO: 6237411 - DNA, 18 bp, Homo sapiens
gcagggttctagaagggg

SEQ ID NO: 6237412 - DNA, 15 bp, Homo sapiens
gcagggtttgagcac

SEQ ID NO: 6237413 - DNA, 16 bp, Homo sapiens
gcagggtttgagcaca

SEQ ID NO: 6237414 - DNA, 15 bp, Homo sapiens
gcaggtaaacagttc

SEQ ID NO: 6237415 - DNA, 20 bp, Homo sapiens
gcaggtaagagctgatgtga

SEQ ID NO: 6237416 - DNA, 19 bp, Homo sapiens
gcaggtaataataaaggtt

SEQ ID NO: 6237417 - DNA, 19 bp, Homo sapiens
gcaggtactgtctgcttct

SEQ ID NO: 6237418 - DNA, 18 bp, Homo sapiens
gcaggtacttcctcctga

SEQ ID NO: 6237419 - DNA, 19 bp, Homo sapiens
gcaggtagccagggggact

SEQ ID NO: 6237420 - DNA, 22 bp, Homo sapiens
gcaggtagttggtgaacagaga

SEQ ID NO: 6237421 - DNA, 17 bp, Homo sapiens
gcaggtatttagaagca

SEQ ID NO: 6237422 - DNA, 19 bp, Homo sapiens
gcaggtatttagaagcaga

SEQ ID NO: 6237423 - DNA, 21 bp, Homo sapiens
gcaggtatttagaagcagagg

SEQ ID NO: 6237424 - DNA, 22 bp, Homo sapiens
gcaggtatttagaagcagaggg

SEQ ID NO: 6237425 - DNA, 19 bp, Homo sapiens
gcaggtatttcagaaggag

SEQ ID NO: 6237426 - DNA, 23 bp, Homo sapiens
gacttgtacagttgactggcttt

SEQ ID NO: 6237427 - DNA, 22 bp, Homo sapiens
gacttgtaggaatctgccttcc

SEQ ID NO: 6237428 - DNA, 16 bp, Homo sapiens
gacttgtataagtaga

SEQ ID NO: 6237429 - DNA, 23 bp, Homo sapiens
gacttgtatagcatgaaataaaa

SEQ ID NO: 6237430 - DNA, 21 bp, Homo sapiens
gacttgtatattctattttac

SEQ ID NO: 6237431 - DNA, 18 bp, Homo sapiens
gacttgtcccgggacacc

SEQ ID NO: 6237432 - DNA, 12 bp, Homo sapiens
gacttgtctgcc

SEQ ID NO: 6237433 - DNA, 17 bp, Homo sapiens
gacttgtctgcctcctg

SEQ ID NO: 6237434 - DNA, 22 bp, Homo sapiens
gacttgtctgcctcctgctttg

SEQ ID NO: 6237435 - DNA, 10 bp, Homo sapiens
gacttgtgcc

SEQ ID NO: 6237436 - DNA, 12 bp, Homo sapiens
gacttgtgccag

SEQ ID NO: 6237437 - DNA, 15 bp, Homo sapiens
gacttgtgcctcttg

SEQ ID NO: 6237438 - DNA, 23 bp, Homo sapiens
gacttgtgcgccggcgccccgga

SEQ ID NO: 6237439 - DNA, 18 bp, Homo sapiens
gacttgtgtcccatgatc

SEQ ID NO: 6237440 - DNA, 16 bp, Homo sapiens
gacttgtgtctctgtg

SEQ ID NO: 6237441 - DNA, 17 bp, Homo sapiens
gacttgtgtgcatggaa

SEQ ID NO: 6237442 - DNA, 19 bp, Homo sapiens
gacttgtttagagagcctg

SEQ ID NO: 6237443 - DNA, 14 bp, Homo sapiens
gacttgtttcctgt

SEQ ID NO: 6237444 - DNA, 22 bp, Homo sapiens
gacttgtttgtcttccattcca

SEQ ID NO: 6237445 - DNA, 13 bp, Homo sapiens
gacttgtttgtgc

SEQ ID NO: 6237446 - DNA, 20 bp, Homo sapiens
gacttgttttaattttagag

SEQ ID NO: 6237447 - DNA, 15 bp, Homo sapiens
gacttgtttttgcac

SEQ ID NO: 6237448 - DNA, 18 bp, Homo sapiens
gacttgtttttgcacatg

SEQ ID NO: 6237449 - DNA, 22 bp, Homo sapiens
gactttaaagatgattgttctt

SEQ ID NO: 6237450 - DNA, 18 bp, Homo sapiens
gactttaacataagctat

SEQ ID NO: 6237451 - DNA, 22 bp, Homo sapiens
gactttaagaagcgaacaaaaa

SEQ ID NO: 6237452 - DNA, 17 bp, Homo sapiens
gactttaattcttctct

SEQ ID NO: 6237453 - DNA, 12 bp, Homo sapiens
gactttaattta

SEQ ID NO: 6237454 - DNA, 17 bp, Homo sapiens
gactttacaaacctttg

SEQ ID NO: 6237455 - DNA, 19 bp, Homo sapiens
gactttagaaagctgacat

SEQ ID NO: 6237456 - DNA, 17 bp, Homo sapiens
gactttagaaataaatg

SEQ ID NO: 6237457 - DNA, 22 bp, Homo sapiens
gactttagcctacctaacccag

SEQ ID NO: 6237458 - DNA, 15 bp, Homo sapiens
gactttagctttctg

SEQ ID NO: 6237459 - DNA, 17 bp, Homo sapiens
gactttagcttttcctt

SEQ ID NO: 6237460 - DNA, 13 bp, Homo sapiens
gactttagggact

SEQ ID NO: 6237461 - DNA, 14 bp, Homo sapiens
gactttagtgaaag

SEQ ID NO: 6237462 - DNA, 15 bp, Homo sapiens
gactttagtgccctg

SEQ ID NO: 6237463 - DNA, 16 bp, Homo sapiens
gactttagtgccctgc

SEQ ID NO: 6237464 - DNA, 15 bp, Homo sapiens
gactttatacagaac

SEQ ID NO: 6237465 - DNA, 16 bp, Homo sapiens
gactttatacagaact

SEQ ID NO: 6237466 - DNA, 21 bp, Homo sapiens
gactttatctaatacctctgt

SEQ ID NO: 6237467 - DNA, 17 bp, Homo sapiens
gactttatctcctgctc

SEQ ID NO: 6237468 - DNA, 15 bp, Homo sapiens
gactttatgcaataa

SEQ ID NO: 6237469 - DNA, 13 bp, Homo sapiens
gactttattattt

SEQ ID NO: 6237470 - DNA, 15 bp, Homo sapiens
gactttatttaattt

SEQ ID NO: 6237471 - DNA, 18 bp, Homo sapiens
gactttatttaatttcat

SEQ ID NO: 6237472 - DNA, 14 bp, Homo sapiens
gactttatttattt

SEQ ID NO: 6237473 - DNA, 17 bp, Homo sapiens
gactttatttatttcta

SEQ ID NO: 6237474 - DNA, 21 bp, Homo sapiens
gactttatttatttctagttc

SEQ ID NO: 6237475 - DNA, 19 bp, Homo sapiens
gactttattttctggtaga

SEQ ID NO: 6237476 - DNA, 14 bp, Homo sapiens
gactttatttttct

SEQ ID NO: 6237477 - DNA, 16 bp, Homo sapiens
gactttcaaaatatat

SEQ ID NO: 6237478 - DNA, 21 bp, Homo sapiens
gactttcaaagtggatgcaat

SEQ ID NO: 6237479 - DNA, 16 bp, Homo sapiens
gactttcacaccatta

SEQ ID NO: 6237480 - DNA, 12 bp, Homo sapiens
gactttcaggta

SEQ ID NO: 6237481 - DNA, 15 bp, Homo sapiens
gactttcattggaaa

SEQ ID NO: 6237482 - DNA, 16 bp, Homo sapiens
gactttccaccccctc

SEQ ID NO: 6237483 - DNA, 17 bp, Homo sapiens
gactttccaccccctcc

SEQ ID NO: 6237484 - DNA, 15 bp, Homo sapiens
gactttccagaatga

SEQ ID NO: 6237485 - DNA, 16 bp, Homo sapiens
gactttcccaaatgta

SEQ ID NO: 6237486 - DNA, 14 bp, Homo sapiens
gactttcccaccca

SEQ ID NO: 6237487 - DNA, 17 bp, Homo sapiens
gactttcccacccagga

SEQ ID NO: 6237488 - DNA, 11 bp, Homo sapiens
gactttcccca

SEQ ID NO: 6237489 - DNA, 12 bp, Homo sapiens
gactttccccac

SEQ ID NO: 6237490 - DNA, 18 bp, Homo sapiens
gactttccccaccagatg

SEQ ID NO: 6237491 - DNA, 20 bp, Homo sapiens
gactttccccaccagatgct

SEQ ID NO: 6237492 - DNA, 16 bp, Homo sapiens
gactttcctaaatgtt

SEQ ID NO: 6237493 - DNA, 22 bp, Homo sapiens
gactttccttccctctcctgct

SEQ ID NO: 6237494 - DNA, 19 bp, Homo sapiens
gactttcggagttgggggt

SEQ ID NO: 6237495 - DNA, 15 bp, Homo sapiens
gactttctcctggcc

SEQ ID NO: 6237496 - DNA, 13 bp, Homo sapiens
gactttctctaat

SEQ ID NO: 6237497 - DNA, 20 bp, Homo sapiens
gactttctctaataataaat

SEQ ID NO: 6237498 - DNA, 12 bp, Homo sapiens
gactttctgtga

SEQ ID NO: 6237499 - DNA, 19 bp, Homo sapiens
gactttctgtgtaccactg

SEQ ID NO: 6237500 - DNA, 11 bp, Homo sapiens
gactttctgtt

SEQ ID NO: 6237501 - DNA, 17 bp, Homo sapiens
gactttcttctaaatga

SEQ ID NO: 6237502 - DNA, 23 bp, Homo sapiens
gactttcttttttgatatagaag

SEQ ID NO: 6237503 - DNA, 13 bp, Homo sapiens
gactttgaattta

SEQ ID NO: 6237504 - DNA, 23 bp, Homo sapiens
gactttgaatttatataaagtat

SEQ ID NO: 6237505 - DNA, 17 bp, Homo sapiens
gactttgacaattactc

SEQ ID NO: 6237506 - DNA, 19 bp, Homo sapiens
gactttgatactaccaggg

SEQ ID NO: 6237507 - DNA, 12 bp, Homo sapiens
gactttgatcca

SEQ ID NO: 6237508 - DNA, 15 bp, Homo sapiens
gactttgatccttgg

SEQ ID NO: 6237509 - DNA, 17 bp, Homo sapiens
gactttgatccttggaa

SEQ ID NO: 6237510 - DNA, 18 bp, Homo sapiens
gactttgatccttggaaa

SEQ ID NO: 6237511 - DNA, 14 bp, Homo sapiens
gactttgcacctgc

SEQ ID NO: 6237512 - DNA, 18 bp, Homo sapiens
gactttgcaggagttcct

SEQ ID NO: 6237513 - DNA, 19 bp, Homo sapiens
gactttgcccccttgccca

SEQ ID NO: 6237514 - DNA, 12 bp, Homo sapiens
gactttgctgtt

SEQ ID NO: 6237515 - DNA, 21 bp, Homo sapiens
gactttgctgttactgcttct

SEQ ID NO: 6237516 - DNA, 15 bp, Homo sapiens
gactttgcttagtat

SEQ ID NO: 6237517 - DNA, 12 bp, Homo sapiens
gactttgcttgc

SEQ ID NO: 6237518 - DNA, 17 bp, Homo sapiens
gactttgcttgctttga

SEQ ID NO: 6237519 - DNA, 14 bp, Homo sapiens
gactttggaaagac

SEQ ID NO: 6237520 - DNA, 14 bp, Homo sapiens
gactttggaattct

SEQ ID NO: 6237521 - DNA, 16 bp, Homo sapiens
gactttggctgcatgc

SEQ ID NO: 6237522 - DNA, 21 bp, Homo sapiens
gactttggggacaccctcctg

SEQ ID NO: 6237523 - DNA, 18 bp, Homo sapiens
gactttggttctctccag

SEQ ID NO: 6237524 - DNA, 15 bp, Homo sapiens
gactttgtagatcct

SEQ ID NO: 6237525 - DNA, 16 bp, Homo sapiens
gactttgtcacttatt

SEQ ID NO: 6237526 - DNA, 15 bp, Homo sapiens
gactttgttacactg

SEQ ID NO: 6237527 - DNA, 22 bp, Homo sapiens
gactttgttagtttctccaagc

SEQ ID NO: 6237528 - DNA, 17 bp, Homo sapiens
gactttgtttttaaaat

SEQ ID NO: 6237529 - DNA, 15 bp, Homo sapiens
gacttttaaacaaaa

SEQ ID NO: 6237530 - DNA, 14 bp, Homo sapiens
gacttttacagatt

SEQ ID NO: 6237531 - DNA, 20 bp, Homo sapiens
gacttttacagcttttctct

SEQ ID NO: 6237532 - DNA, 18 bp, Homo sapiens
gacttttagcattcgttt

SEQ ID NO: 6237533 - DNA, 15 bp, Homo sapiens
gacttttccaagccc

SEQ ID NO: 6237534 - DNA, 17 bp, Homo sapiens
gacttttccaagccctt

SEQ ID NO: 6237535 - DNA, 17 bp, Homo sapiens
gacttttccaatatgtg

SEQ ID NO: 6237536 - DNA, 13 bp, Homo sapiens
gacttttccccat

SEQ ID NO: 6237537 - DNA, 18 bp, Homo sapiens
gacttttcgttaacattg

SEQ ID NO: 6237538 - DNA, 19 bp, Homo sapiens
gacttttcgttaacattga

SEQ ID NO: 6237539 - DNA, 22 bp, Homo sapiens
gacttttcttaacaacctggcc

SEQ ID NO: 6237540 - DNA, 14 bp, Homo sapiens
gacttttcttaagt

SEQ ID NO: 6237541 - DNA, 15 bp, Homo sapiens
gacttttgaaaaaaa

SEQ ID NO: 6237542 - DNA, 18 bp, Homo sapiens
gacttttgaaaagaggtg

SEQ ID NO: 6237543 - DNA, 16 bp, Homo sapiens
gacttttgaagaacaa

SEQ ID NO: 6237544 - DNA, 23 bp, Homo sapiens
gacttttgatagttctataagaa

SEQ ID NO: 6237545 - DNA, 18 bp, Homo sapiens
gacttttggccccagcgc

SEQ ID NO: 6237546 - DNA, 17 bp, Homo sapiens
gacttttggtagagaag

SEQ ID NO: 6237547 - DNA, 18 bp, Homo sapiens
gacttttggtagagaagg

SEQ ID NO: 6237548 - DNA, 17 bp, Homo sapiens
gacttttgtaaaatcaa

SEQ ID NO: 6237549 - DNA, 18 bp, Homo sapiens
gacttttgtaaaatcaaa

SEQ ID NO: 6237550 - DNA, 20 bp, Homo sapiens
gacttttgtacatctggctt

SEQ ID NO: 6237551 - DNA, 23 bp, Homo sapiens
gactttttaaaaaatgctgggtt

SEQ ID NO: 6237552 - DNA, 18 bp, Homo sapiens
gactttttaaaatataag

SEQ ID NO: 6237553 - DNA, 23 bp, Homo sapiens
gactttttaaaattctgagtgat

SEQ ID NO: 6237554 - DNA, 19 bp, Homo sapiens
gactttttagccagtgact

SEQ ID NO: 6237555 - DNA, 13 bp, Homo sapiens
gactttttataaa

SEQ ID NO: 6237556 - DNA, 20 bp, Homo sapiens
gactttttggaattcagcag

SEQ ID NO: 6237557 - DNA, 21 bp, Homo sapiens
gactttttggtggatgtaaat

SEQ ID NO: 6237558 - DNA, 14 bp, Homo sapiens
gacttttttaaact

SEQ ID NO: 6237559 - DNA, 19 bp, Homo sapiens
gacttttttgtacataaat

SEQ ID NO: 6237560 - DNA, 13 bp, Homo sapiens
gactttttttgta

SEQ ID NO: 6237561 - DNA, 17 bp, Homo sapiens
gactttttttgtatgtg

SEQ ID NO: 6237562 - DNA, 19 bp, Homo sapiens
gactttttttttttataat

SEQ ID NO: 6237563 - DNA, 10 bp, Homo sapiens
gagaaaaaaa

SEQ ID NO: 6237564 - DNA, 15 bp, Homo sapiens
gagaaaaaaaaacac

SEQ ID NO: 6237565 - DNA, 13 bp, Homo sapiens
gagaaaaaaaaag

SEQ ID NO: 6237566 - DNA, 13 bp, Homo sapiens
gagaaaaaaaacc

SEQ ID NO: 6237567 - DNA, 19 bp, Homo sapiens
gagaaaaaaaaccttgtaa

SEQ ID NO: 6237568 - DNA, 20 bp, Homo sapiens
gagaaaaaaaaccttgtaaa

SEQ ID NO: 6237569 - DNA, 13 bp, Homo sapiens
gagaaaaaaacag

SEQ ID NO: 6237570 - DNA, 15 bp, Homo sapiens
gagaaaaaaacagca

SEQ ID NO: 6237571 - DNA, 13 bp, Homo sapiens
gagaaaaaaatat

SEQ ID NO: 6237572 - DNA, 23 bp, Homo sapiens
gagaaaaaaatcaaccctgcaat

SEQ ID NO: 6237573 - DNA, 13 bp, Homo sapiens
gagaaaaaattaa

SEQ ID NO: 6237574 - DNA, 14 bp, Homo sapiens
gagaaaaagaagaa

SEQ ID NO: 6237575 - DNA, 12 bp, Homo sapiens
gagaaaaagacc

SEQ ID NO: 6237576 - DNA, 16 bp, Homo sapiens
gagaaaaagagagagc

SEQ ID NO: 6237577 - DNA, 18 bp, Homo sapiens
gagaaaaagagagagcag

SEQ ID NO: 6237578 - DNA, 13 bp, Homo sapiens
gagaaaaagatat

SEQ ID NO: 6237579 - DNA, 15 bp, Homo sapiens
gagaaaaagccctct

SEQ ID NO: 6237580 - DNA, 17 bp, Homo sapiens
gagaaaaagctcctgtc

SEQ ID NO: 6237581 - DNA, 16 bp, Homo sapiens
gagaaaaaggtgccat

SEQ ID NO: 6237582 - DNA, 14 bp, Homo sapiens
gagaaaaataaatg

SEQ ID NO: 6237583 - DNA, 22 bp, Homo sapiens
gagaaaaatattcaagtaacac

SEQ ID NO: 6237584 - DNA, 14 bp, Homo sapiens
gagaaaacactttc

SEQ ID NO: 6237585 - DNA, 15 bp, Homo sapiens
gagaaaacagaccta

SEQ ID NO: 6237586 - DNA, 18 bp, Homo sapiens
gagaaaaccttaaaagta

SEQ ID NO: 6237587 - DNA, 21 bp, Homo sapiens
gagaaaactcttctgaggatc

SEQ ID NO: 6237588 - DNA, 23 bp, Homo sapiens
gagaaaactgaccatcagtatat

SEQ ID NO: 6237589 - DNA, 16 bp, Homo sapiens
gagaaaacttatttga

SEQ ID NO: 6237590 - DNA, 15 bp, Homo sapiens
gagaaaacttgcctt

SEQ ID NO: 6237591 - DNA, 9 bp, Homo sapiens
gagaaaaga

SEQ ID NO: 6237592 - DNA, 10 bp, Homo sapiens
gagaaaagaa

SEQ ID NO: 6237593 - DNA, 11 bp, Homo sapiens
gagaaaagaaa

SEQ ID NO: 6237594 - DNA, 20 bp, Homo sapiens
gagaaaagaaaaaaaaagaa

SEQ ID NO: 6237595 - DNA, 23 bp, Homo sapiens
gagaaaagaaaaatatgagagaa

SEQ ID NO: 6237596 - DNA, 24 bp, Homo sapiens
gagaaaagaaaaatatgagagaac

SEQ ID NO: 6237597 - DNA, 18 bp, Homo sapiens
gagaaaagacagggtggg

SEQ ID NO: 6237598 - DNA, 16 bp, Homo sapiens
gagaaaagagtgagaa

SEQ ID NO: 6237599 - DNA, 18 bp, Homo sapiens
gagaaaagcacacttgta

SEQ ID NO: 6237600 - DNA, 13 bp, Homo sapiens
gagaaaagcactt

SEQ ID NO: 6237601 - DNA, 12 bp, Homo sapiens
gagaaaagccag

SEQ ID NO: 6237602 - DNA, 18 bp, Homo sapiens
gagaaaaggctggagaga

SEQ ID NO: 6237603 - DNA, 22 bp, Homo sapiens
gagaaaagtcaggtgcagtccc

SEQ ID NO: 6237604 - DNA, 14 bp, Homo sapiens
gagaaaataaaaag

SEQ ID NO: 6237605 - DNA, 16 bp, Homo sapiens
gagaaaataaaaagtt

SEQ ID NO: 6237606 - DNA, 18 bp, Homo sapiens
gagaaaatataaggactt

SEQ ID NO: 6237607 - DNA, 19 bp, Homo sapiens
gagaaaatatatgtatttt

SEQ ID NO: 6237608 - DNA, 17 bp, Homo sapiens
gcaggtcacactggggg

SEQ ID NO: 6237609 - DNA, 13 bp, Homo sapiens
gcaggtcacagaa

SEQ ID NO: 6237610 - DNA, 21 bp, Homo sapiens
gcaggtcactgaaacttcaag

SEQ ID NO: 6237611 - DNA, 17 bp, Homo sapiens
gcaggtcactgtcactg

SEQ ID NO: 6237612 - DNA, 21 bp, Homo sapiens
gcaggtcactgtcactgccga

SEQ ID NO: 6237613 - DNA, 12 bp, Homo sapiens
gcaggtcagccc

SEQ ID NO: 6237614 - DNA, 13 bp, Homo sapiens
gcaggtcagccca

SEQ ID NO: 6237615 - DNA, 15 bp, Homo sapiens
gcaggtcagcccatg

SEQ ID NO: 6237616 - DNA, 19 bp, Homo sapiens
gcaggtcatggagcagccc

SEQ ID NO: 6237617 - DNA, 23 bp, Homo sapiens
gcaggtcatggagcagcccccaa

SEQ ID NO: 6237618 - DNA, 18 bp, Homo sapiens
gcaggtccagctctgtgg

SEQ ID NO: 6237619 - DNA, 22 bp, Homo sapiens
gcaggtccagggtttgagttca

SEQ ID NO: 6237620 - DNA, 14 bp, Homo sapiens
gcaggtccccagac

SEQ ID NO: 6237621 - DNA, 10 bp, Homo sapiens
gcaggtccct

SEQ ID NO: 6237622 - DNA, 13 bp, Homo sapiens
gcaggtccctaat

SEQ ID NO: 6237623 - DNA, 15 bp, Homo sapiens
gcaggtcctgcccat

SEQ ID NO: 6237624 - DNA, 16 bp, Homo sapiens
gcaggtcctgcccatg

SEQ ID NO: 6237625 - DNA, 21 bp, Homo sapiens
gcaggtcctggggaggctgag

SEQ ID NO: 6237626 - DNA, 18 bp, Homo sapiens
gcaggtctcagcccggga

SEQ ID NO: 6237627 - DNA, 18 bp, Homo sapiens
gcaggtctccacctgcac

SEQ ID NO: 6237628 - DNA, 17 bp, Homo sapiens
gcaggtctcctctggga

SEQ ID NO: 6237629 - DNA, 13 bp, Homo sapiens
gcaggtctctggc

SEQ ID NO: 6237630 - DNA, 21 bp, Homo sapiens
gcaggtctctggcagagaagg

SEQ ID NO: 6237631 - DNA, 15 bp, Homo sapiens
gcaggtctcttctgg

SEQ ID NO: 6237632 - DNA, 22 bp, Homo sapiens
gcaggtctgcaagggcccagag

SEQ ID NO: 6237633 - DNA, 23 bp, Homo sapiens
gcaggtctgcaagggcccagagt

SEQ ID NO: 6237634 - DNA, 13 bp, Homo sapiens
gcaggtctgcagg

SEQ ID NO: 6237635 - DNA, 14 bp, Homo sapiens
gcaggtctttaaat

SEQ ID NO: 6237636 - DNA, 15 bp, Homo sapiens
gcaggtgacagtgag

SEQ ID NO: 6237637 - DNA, 16 bp, Homo sapiens
gcaggtgacagtgagg

SEQ ID NO: 6237638 - DNA, 17 bp, Homo sapiens
gcaggtgaccagaatga

SEQ ID NO: 6237639 - DNA, 18 bp, Homo sapiens
gcaggtgaccagaatgag

SEQ ID NO: 6237640 - DNA, 16 bp, Homo sapiens
gcaggtgaccgcccgc

SEQ ID NO: 6237641 - DNA, 18 bp, Homo sapiens
gcaggtgagaacccagag

SEQ ID NO: 6237642 - DNA, 17 bp, Homo sapiens
gcaggtgagcagacagg

SEQ ID NO: 6237643 - DNA, 15 bp, Homo sapiens
gcaggtgaggaaaca

SEQ ID NO: 6237644 - DNA, 23 bp, Homo sapiens
gcaggtgatctgctgcagagcag

SEQ ID NO: 6237645 - DNA, 18 bp, Homo sapiens
gcaggtgattggaccagg

SEQ ID NO: 6237646 - DNA, 17 bp, Homo sapiens
gcaggtgccaggaactc

SEQ ID NO: 6237647 - DNA, 19 bp, Homo sapiens
gcaggtgccagggcccacc

SEQ ID NO: 6237648 - DNA, 22 bp, Homo sapiens
gcaggtgccagggcccacccca

SEQ ID NO: 6237649 - DNA, 16 bp, Homo sapiens
gcaggtgccatgcctg

SEQ ID NO: 6237650 - DNA, 20 bp, Homo sapiens
gcaggtgccatgcctgctcc

SEQ ID NO: 6237651 - DNA, 22 bp, Homo sapiens
gcaggtgccatgcctgctccct

SEQ ID NO: 6237652 - DNA, 16 bp, Homo sapiens
gcaggtgcccccaggt

SEQ ID NO: 6237653 - DNA, 19 bp, Homo sapiens
gcaggtgcccccaggtgag

SEQ ID NO: 6237654 - DNA, 13 bp, Homo sapiens
gcaggtgcctcca

SEQ ID NO: 6237655 - DNA, 14 bp, Homo sapiens
gcaggtgcctggct

SEQ ID NO: 6237656 - DNA, 21 bp, Homo sapiens
gcaggtgcctgttgaatctga

SEQ ID NO: 6237657 - DNA, 9 bp, Homo sapiens
gcaggtgct

SEQ ID NO: 6237658 - DNA, 15 bp, Homo sapiens
gcaggtgctcatgct

SEQ ID NO: 6237659 - DNA, 15 bp, Homo sapiens
gcaggtgctgccttg

SEQ ID NO: 6237660 - DNA, 15 bp, Homo sapiens
gcaggtgctgctacc

SEQ ID NO: 6237661 - DNA, 22 bp, Homo sapiens
gcaggtgcttttggcagagacc

SEQ ID NO: 6237662 - DNA, 17 bp, Homo sapiens
gcaggtggactgactgt

SEQ ID NO: 6237663 - DNA, 21 bp, Homo sapiens
gcaggtggatctatttcatgt

SEQ ID NO: 6237664 - DNA, 16 bp, Homo sapiens
gcaggtggatctcctt

SEQ ID NO: 6237665 - DNA, 19 bp, Homo sapiens
gcaggtggatctccttgag

SEQ ID NO: 6237666 - DNA, 21 bp, Homo sapiens
gcaggtggccaagttcctcta

SEQ ID NO: 6237667 - DNA, 18 bp, Homo sapiens
gcaggtggccagggctcc

SEQ ID NO: 6237668 - DNA, 18 bp, Homo sapiens
gcaggtggccgcccctga

SEQ ID NO: 6237669 - DNA, 15 bp, Homo sapiens
gcaggtggcctctgc

SEQ ID NO: 6237670 - DNA, 16 bp, Homo sapiens
gcaggtggcctctgct

SEQ ID NO: 6237671 - DNA, 18 bp, Homo sapiens
gcaggtggcctctgctgg

SEQ ID NO: 6237672 - DNA, 19 bp, Homo sapiens
gcaggtggcctctgctggt

SEQ ID NO: 6237673 - DNA, 20 bp, Homo sapiens
gcaggtggcctctgctggtc

SEQ ID NO: 6237674 - DNA, 22 bp, Homo sapiens
gcaggtggcctctgctggtctc

SEQ ID NO: 6237675 - DNA, 12 bp, Homo sapiens
gcaggtgggcac

SEQ ID NO: 6237676 - DNA, 15 bp, Homo sapiens
gcaggtgggctgcct

SEQ ID NO: 6237677 - DNA, 17 bp, Homo sapiens
gcaggtgggctgcctgc

SEQ ID NO: 6237678 - DNA, 22 bp, Homo sapiens
gcaggtgggctgggcccaccca

SEQ ID NO: 6237679 - DNA, 21 bp, Homo sapiens
gcaggtggggagactgggctg

SEQ ID NO: 6237680 - DNA, 19 bp, Homo sapiens
gcaggtgggggctgcgtcc

SEQ ID NO: 6237681 - DNA, 19 bp, Homo sapiens
gcaggtgggggtgggctgc

SEQ ID NO: 6237682 - DNA, 19 bp, Homo sapiens
gcaggtgggtgctgccctg

SEQ ID NO: 6237683 - DNA, 16 bp, Homo sapiens
gcaggtggtcctgaga

SEQ ID NO: 6237684 - DNA, 20 bp, Homo sapiens
gcaggtggtggcactgagcc

SEQ ID NO: 6237685 - DNA, 23 bp, Homo sapiens
gcaggtggtggcactgagccccc

SEQ ID NO: 6237686 - DNA, 13 bp, Homo sapiens
gcaggtgtcatat

SEQ ID NO: 6237687 - DNA, 15 bp, Homo sapiens
gcaggtgtcctttcc

SEQ ID NO: 6237688 - DNA, 20 bp, Homo sapiens
gcaggtgtcctttcccctct

SEQ ID NO: 6237689 - DNA, 13 bp, Homo sapiens
gcaggtgtcttgg

SEQ ID NO: 6237690 - DNA, 22 bp, Homo sapiens
gcaggtgtcttggacccacctg

SEQ ID NO: 6237691 - DNA, 17 bp, Homo sapiens
gcaggtgtgggctccca

SEQ ID NO: 6237692 - DNA, 19 bp, Homo sapiens
gcaggtgtggtggctcatg

SEQ ID NO: 6237693 - DNA, 21 bp, Homo sapiens
gcaggtgtggtggctcatggc

SEQ ID NO: 6237694 - DNA, 17 bp, Homo sapiens
gcaggtgtgtgtggacc

SEQ ID NO: 6237695 - DNA, 15 bp, Homo sapiens
gcaggtgttctgctg

SEQ ID NO: 6237696 - DNA, 20 bp, Homo sapiens
gcaggtgttgggacctgctg

SEQ ID NO: 6237697 - DNA, 19 bp, Homo sapiens
gcaggtgtttctttcctgt

SEQ ID NO: 6237698 - DNA, 21 bp, Homo sapiens
gcaggtgtttggcacccaaat

SEQ ID NO: 6237699 - DNA, 15 bp, Homo sapiens
gcaggttaaatgttt

SEQ ID NO: 6237700 - DNA, 18 bp, Homo sapiens
gcaggttaaatgttttgt

SEQ ID NO: 6237701 - DNA, 19 bp, Homo sapiens
gcaggttaaatgttttgta

SEQ ID NO: 6237702 - DNA, 13 bp, Homo sapiens
gcaggttagagaa

SEQ ID NO: 6237703 - DNA, 22 bp, Homo sapiens
gcaggttatgtcagcagctctg

SEQ ID NO: 6237704 - DNA, 13 bp, Homo sapiens
gcaggttcccaag

SEQ ID NO: 6237705 - DNA, 12 bp, Homo sapiens
gcaggttcccac

SEQ ID NO: 6237706 - DNA, 14 bp, Homo sapiens
gcaggttccccaag

SEQ ID NO: 6237707 - DNA, 23 bp, Homo sapiens
gcaggttccccaagggccctggc

SEQ ID NO: 6237708 - DNA, 15 bp, Homo sapiens
gcaggttcctggggc

SEQ ID NO: 6237709 - DNA, 16 bp, Homo sapiens
gcaggttcctggggcc

SEQ ID NO: 6237710 - DNA, 18 bp, Homo sapiens
gcaggttcctggggccgc

SEQ ID NO: 6237711 - DNA, 15 bp, Homo sapiens
gcaggttctctcctg

SEQ ID NO: 6237712 - DNA, 18 bp, Homo sapiens
gcaggttctctcctgtga

SEQ ID NO: 6237713 - DNA, 19 bp, Homo sapiens
gcaggttctgcctgctttg

SEQ ID NO: 6237714 - DNA, 22 bp, Homo sapiens
gcaggttcttcttcctgaagct

SEQ ID NO: 6237715 - DNA, 14 bp, Homo sapiens
gcaggttcttgatg

SEQ ID NO: 6237716 - DNA, 23 bp, Homo sapiens
gcaggttcttgttggtgcacagc

SEQ ID NO: 6237717 - DNA, 16 bp, Homo sapiens
gcaggttgaagccatg

SEQ ID NO: 6237718 - DNA, 22 bp, Homo sapiens
gcaggttgaggggctcctggaa

SEQ ID NO: 6237719 - DNA, 17 bp, Homo sapiens
gcaggttgataaatcat

SEQ ID NO: 6237720 - DNA, 16 bp, Homo sapiens
gcaggttgatcagtga

SEQ ID NO: 6237721 - DNA, 16 bp, Homo sapiens
gcaggttggaaggggc

SEQ ID NO: 6237722 - DNA, 22 bp, Homo sapiens
gcaggttgggccatactggcct

SEQ ID NO: 6237723 - DNA, 17 bp, Homo sapiens
gcaggtttcatttctta

SEQ ID NO: 6237724 - DNA, 15 bp, Homo sapiens
gcaggtttgaccagg

SEQ ID NO: 6237725 - DNA, 17 bp, Homo sapiens
gcaggtttgaccaggaa

SEQ ID NO: 6237726 - DNA, 15 bp, Homo sapiens
gcagtaaaataaaaa

SEQ ID NO: 6237727 - DNA, 16 bp, Homo sapiens
gcagtaaactttctct

SEQ ID NO: 6237728 - DNA, 14 bp, Homo sapiens
gcagtaaagagaaa

SEQ ID NO: 6237729 - DNA, 18 bp, Homo sapiens
gcagtaaatacttgcagt

SEQ ID NO: 6237730 - DNA, 22 bp, Homo sapiens
gcagtaaatacttgcagttgtg

SEQ ID NO: 6237731 - DNA, 23 bp, Homo sapiens
gcagtaacatgcaacaaaaatgt

SEQ ID NO: 6237732 - DNA, 16 bp, Homo sapiens
gcagtaatctccaggg

SEQ ID NO: 6237733 - DNA, 23 bp, Homo sapiens
gcagtaatctgtcagtgtttgta

SEQ ID NO: 6237734 - DNA, 23 bp, Homo sapiens
gcagtaattcccatctgctttat

SEQ ID NO: 6237735 - DNA, 19 bp, Homo sapiens
gcagtacaaatgtttttca

SEQ ID NO: 6237736 - DNA, 21 bp, Homo sapiens
gcagtacatacgtctgccagg

SEQ ID NO: 6237737 - DNA, 16 bp, Homo sapiens
gcagtacatcttgtgc

SEQ ID NO: 6237738 - DNA, 13 bp, Homo sapiens
gcagtacatggga

SEQ ID NO: 6237739 - DNA, 23 bp, Homo sapiens
gcagtacatgggtgactatctcc

SEQ ID NO: 6237740 - DNA, 14 bp, Homo sapiens
gcagtaccatccca

SEQ ID NO: 6237741 - DNA, 18 bp, Homo sapiens
gcagtaccatcccactga

SEQ ID NO: 6237742 - DNA, 20 bp, Homo sapiens
gcagtaccatcccactgata

SEQ ID NO: 6237743 - DNA, 23 bp, Homo sapiens
gcagtacctataaagtaaagcta

SEQ ID NO: 6237744 - DNA, 15 bp, Homo sapiens
gcagtacctgagggt

SEQ ID NO: 6237745 - DNA, 21 bp, Homo sapiens
gcagtactaacatttatttga

SEQ ID NO: 6237746 - DNA, 18 bp, Homo sapiens
gcagtactcctccctggg

SEQ ID NO: 6237747 - DNA, 14 bp, Homo sapiens
gcagtacttgctca

SEQ ID NO: 6237748 - DNA, 17 bp, Homo sapiens
gcagtacttttgttgta

SEQ ID NO: 6237749 - DNA, 18 bp, Homo sapiens
gcagtagaaggtgccgtg

SEQ ID NO: 6237750 - DNA, 23 bp, Homo sapiens
gcagtagaaggtgccgtgagcag

SEQ ID NO: 6237751 - DNA, 13 bp, Homo sapiens
gcagtagacattt

SEQ ID NO: 6237752 - DNA, 19 bp, Homo sapiens
gcagtagacattttaacaa

SEQ ID NO: 6237753 - DNA, 21 bp, Homo sapiens
gcagtagacattttaacaaga

SEQ ID NO: 6237754 - DNA, 21 bp, Homo sapiens
gcagtagaggctatggacagg

SEQ ID NO: 6237755 - DNA, 18 bp, Homo sapiens
gcagtagagtcatctcca

SEQ ID NO: 6237756 - DNA, 18 bp, Homo sapiens
gcagtagatgtgcttctg

SEQ ID NO: 6237757 - DNA, 20 bp, Homo sapiens
gcagtagattttctttaaaa

SEQ ID NO: 6237758 - DNA, 22 bp, Homo sapiens
gcagtaggaacccagctctcag

SEQ ID NO: 6237759 - DNA, 12 bp, Homo sapiens
gcagtagtctct

SEQ ID NO: 6237760 - DNA, 14 bp, Homo sapiens
gcagtagtgccaaa

SEQ ID NO: 6237761 - DNA, 21 bp, Homo sapiens
gcagtagtgccaaaaggcccc

SEQ ID NO: 6237762 - DNA, 16 bp, Homo sapiens
gcagtagttttcaaaa

SEQ ID NO: 6237763 - DNA, 20 bp, Homo sapiens
gcagtataaagaataggact

SEQ ID NO: 6237764 - DNA, 20 bp, Homo sapiens
gcagtatataataactttat

SEQ ID NO: 6237765 - DNA, 21 bp, Homo sapiens
gcagtatataataactttatt

SEQ ID NO: 6237766 - DNA, 17 bp, Homo sapiens
gcagtatatcacagagc

SEQ ID NO: 6237767 - DNA, 12 bp, Homo sapiens
gcagtatcatga

SEQ ID NO: 6237768 - DNA, 15 bp, Homo sapiens
gcagtatctcttgct

SEQ ID NO: 6237769 - DNA, 13 bp, Homo sapiens
gcagtatgaatga

SEQ ID NO: 6237770 - DNA, 17 bp, Homo sapiens
gcagtatgatggcagga

SEQ ID NO: 6237771 - DNA, 20 bp, Homo sapiens
gcagtatggcggaggccatg

SEQ ID NO: 6237772 - DNA, 13 bp, Homo sapiens
gcagtatggtaca

SEQ ID NO: 6237773 - DNA, 17 bp, Homo sapiens
gcagtatgtacaggctg

SEQ ID NO: 6237774 - DNA, 12 bp, Homo sapiens
gcagtatgtgat

SEQ ID NO: 6237775 - DNA, 16 bp, Homo sapiens
gcagtatgtgatggac

SEQ ID NO: 6237776 - DNA, 13 bp, Homo sapiens
gcagtattgagca

SEQ ID NO: 6237777 - DNA, 16 bp, Homo sapiens
gcagtattttattaaa

SEQ ID NO: 6237778 - DNA, 13 bp, Homo sapiens
gcagtattttctg

SEQ ID NO: 6237779 - DNA, 23 bp, Homo sapiens
gcagtattttgtgtcctccagga

SEQ ID NO: 6237780 - DNA, 19 bp, Homo sapiens
gcagtcaacagttcaaaga

SEQ ID NO: 6237781 - DNA, 21 bp, Homo sapiens
gcagtcaacagttcaaagaag

SEQ ID NO: 6237782 - DNA, 20 bp, Homo sapiens
gcagtcacactgctgggaag

SEQ ID NO: 6237783 - DNA, 20 bp, Homo sapiens
gcagtcacactgttactcca

SEQ ID NO: 6237784 - DNA, 13 bp, Homo sapiens
gcagtcacaggcc

SEQ ID NO: 6237785 - DNA, 12 bp, Homo sapiens
gcagtcaccacc

SEQ ID NO: 6237786 - DNA, 11 bp, Homo sapiens
gagaaaatcat

SEQ ID NO: 6237787 - DNA, 16 bp, Homo sapiens
gagaaaatcatcaaga

SEQ ID NO: 6237788 - DNA, 18 bp, Homo sapiens
gagaaaatcatcaagaag

SEQ ID NO: 6237789 - DNA, 15 bp, Homo sapiens
gagaaaatccaggtc

SEQ ID NO: 6237790 - DNA, 17 bp, Homo sapiens
gagaaaatccaggtcat

SEQ ID NO: 6237791 - DNA, 18 bp, Homo sapiens
gagaaaatctgcatgttt

SEQ ID NO: 6237792 - DNA, 18 bp, Homo sapiens
gagaaaatgaatggacaa

SEQ ID NO: 6237793 - DNA, 19 bp, Homo sapiens
gagaaaatgaatggacaaa

SEQ ID NO: 6237794 - DNA, 16 bp, Homo sapiens
gagaaaatgaatttgg

SEQ ID NO: 6237795 - DNA, 16 bp, Homo sapiens
gagaaaatgcaggaga

SEQ ID NO: 6237796 - DNA, 18 bp, Homo sapiens
gagaaaatgtaaaggagg

SEQ ID NO: 6237797 - DNA, 19 bp, Homo sapiens
gagaaaatgtaaaggaggg

SEQ ID NO: 6237798 - DNA, 12 bp, Homo sapiens
gagaaaattgaa

SEQ ID NO: 6237799 - DNA, 14 bp, Homo sapiens
gagaaaattgaatt

SEQ ID NO: 6237800 - DNA, 19 bp, Homo sapiens
gagaaaattgaatttaaca

SEQ ID NO: 6237801 - DNA, 22 bp, Homo sapiens
gagaaaattggaactctactca

SEQ ID NO: 6237802 - DNA, 23 bp, Homo sapiens
gagaaacaagacaagctcctccc

SEQ ID NO: 6237803 - DNA, 19 bp, Homo sapiens
gagaaacactgaaaagaag

SEQ ID NO: 6237804 - DNA, 14 bp, Homo sapiens
gagaaacagagaca

SEQ ID NO: 6237805 - DNA, 17 bp, Homo sapiens
gagaaacagctcagcca

SEQ ID NO: 6237806 - DNA, 19 bp, Homo sapiens
gagaaacagctcagccagt

SEQ ID NO: 6237807 - DNA, 17 bp, Homo sapiens
gagaaacaggctctgag

SEQ ID NO: 6237808 - DNA, 17 bp, Homo sapiens
gagaaacagttggtaac

SEQ ID NO: 6237809 - DNA, 19 bp, Homo sapiens
gagaaacagttggtaactt

SEQ ID NO: 6237810 - DNA, 20 bp, Homo sapiens
gagaaacattctttcctaaa

SEQ ID NO: 6237811 - DNA, 19 bp, Homo sapiens
gagaaaccagcttccttca

SEQ ID NO: 6237812 - DNA, 12 bp, Homo sapiens
gagaaacccaga

SEQ ID NO: 6237813 - DNA, 13 bp, Homo sapiens
gagaaacccagag

SEQ ID NO: 6237814 - DNA, 15 bp, Homo sapiens
gagaaacccagagat

SEQ ID NO: 6237815 - DNA, 20 bp, Homo sapiens
gagaaaccctaaaaagagaa

SEQ ID NO: 6237816 - DNA, 12 bp, Homo sapiens
gagaaaccctgt

SEQ ID NO: 6237817 - DNA, 22 bp, Homo sapiens
gagaaacctgcatgaaagcatt

SEQ ID NO: 6237818 - DNA, 21 bp, Homo sapiens
gagaaacctgccaaggagcat

SEQ ID NO: 6237819 - DNA, 16 bp, Homo sapiens
gagaaacctgtatctt

SEQ ID NO: 6237820 - DNA, 19 bp, Homo sapiens
gagaaaccttcactccaga

SEQ ID NO: 6237821 - DNA, 18 bp, Homo sapiens
gagaaacggtcctttgtt

SEQ ID NO: 6237822 - DNA, 15 bp, Homo sapiens
gagaaactccaaagt

SEQ ID NO: 6237823 - DNA, 16 bp, Homo sapiens
gagaaactctagactg

SEQ ID NO: 6237824 - DNA, 17 bp, Homo sapiens
gagaaactcttgagatc

SEQ ID NO: 6237825 - DNA, 11 bp, Homo sapiens
gagaaactgag

SEQ ID NO: 6237826 - DNA, 18 bp, Homo sapiens
gagaaactgctgcagatt

SEQ ID NO: 6237827 - DNA, 14 bp, Homo sapiens
gagaaacttcaaag

SEQ ID NO: 6237828 - DNA, 11 bp, Homo sapiens
gagaaacttcc

SEQ ID NO: 6237829 - DNA, 15 bp, Homo sapiens
gagaaactttataca

SEQ ID NO: 6237830 - DNA, 17 bp, Homo sapiens
gagaaactttatacatt

SEQ ID NO: 6237831 - DNA, 22 bp, Homo sapiens
gagaaagaaaaggcaaaagact

SEQ ID NO: 6237832 - DNA, 14 bp, Homo sapiens
gagaaagaaagtac

SEQ ID NO: 6237833 - DNA, 18 bp, Homo sapiens
gagaaagaaagtacccag

SEQ ID NO: 6237834 - DNA, 15 bp, Homo sapiens
gagaaagaatttagt

SEQ ID NO: 6237835 - DNA, 14 bp, Homo sapiens
gagaaagacaaaat

SEQ ID NO: 6237836 - DNA, 15 bp, Homo sapiens
gagaaagactgatta

SEQ ID NO: 6237837 - DNA, 16 bp, Homo sapiens
gagaaagagacagaga

SEQ ID NO: 6237838 - DNA, 11 bp, Homo sapiens
gagaaagagag

SEQ ID NO: 6237839 - DNA, 15 bp, Homo sapiens
gagaaagagagaagc

SEQ ID NO: 6237840 - DNA, 19 bp, Homo sapiens
gagaaagagagaagccagc

SEQ ID NO: 6237841 - DNA, 15 bp, Homo sapiens
gagaaagagagagag

SEQ ID NO: 6237842 - DNA, 18 bp, Homo sapiens
gagaaagagcacttaaga

SEQ ID NO: 6237843 - DNA, 19 bp, Homo sapiens
gagaaagagcacttaagag

SEQ ID NO: 6237844 - DNA, 15 bp, Homo sapiens
gagaaagagctgcct

SEQ ID NO: 6237845 - DNA, 14 bp, Homo sapiens
gagaaagaggccag

SEQ ID NO: 6237846 - DNA, 14 bp, Homo sapiens
gagaaagcaaaata

SEQ ID NO: 6237847 - DNA, 15 bp, Homo sapiens
gagaaagcccacctg

SEQ ID NO: 6237848 - DNA, 16 bp, Homo sapiens
gagaaagcccacctgg

SEQ ID NO: 6237849 - DNA, 17 bp, Homo sapiens
gagaaagcccacctggg

SEQ ID NO: 6237850 - DNA, 20 bp, Homo sapiens
gagaaagcccacctgggctg

SEQ ID NO: 6237851 - DNA, 22 bp, Homo sapiens
gagaaagctaaaatggtggtct

SEQ ID NO: 6237852 - DNA, 13 bp, Homo sapiens
gagaaagctgact

SEQ ID NO: 6237853 - DNA, 22 bp, Homo sapiens
gagaaagctgacttggctggtg

SEQ ID NO: 6237854 - DNA, 18 bp, Homo sapiens
gagaaagcttaatatatt

SEQ ID NO: 6237855 - DNA, 18 bp, Homo sapiens
gagaaagcttttattcct

SEQ ID NO: 6237856 - DNA, 12 bp, Homo sapiens
gagaaaggaaaa

SEQ ID NO: 6237857 - DNA, 15 bp, Homo sapiens
gagaaaggaaaaatt

SEQ ID NO: 6237858 - DNA, 20 bp, Homo sapiens
gagaaaggaggagacagagg

SEQ ID NO: 6237859 - DNA, 19 bp, Homo sapiens
gagaaaggcacatattgga

SEQ ID NO: 6237860 - DNA, 20 bp, Homo sapiens
gagaaagggattgctgaggc

SEQ ID NO: 6237861 - DNA, 12 bp, Homo sapiens
gagaaaggtgag

SEQ ID NO: 6237862 - DNA, 16 bp, Homo sapiens
gagaaagtaacacaaa

SEQ ID NO: 6237863 - DNA, 21 bp, Homo sapiens
gagaaagtactcagaggctga

SEQ ID NO: 6237864 - DNA, 23 bp, Homo sapiens
gagaaagtacttctccaccctgc

SEQ ID NO: 6237865 - DNA, 16 bp, Homo sapiens
gagaaagtactttctg

SEQ ID NO: 6237866 - DNA, 17 bp, Homo sapiens
gagaaagtaggccgctg

SEQ ID NO: 6237867 - DNA, 14 bp, Homo sapiens
gagaaatacaaaaa

SEQ ID NO: 6237868 - DNA, 15 bp, Homo sapiens
gagaaatacaaaaat

SEQ ID NO: 6237869 - DNA, 18 bp, Homo sapiens
gagaaatacagtgcttta

SEQ ID NO: 6237870 - DNA, 14 bp, Homo sapiens
gagaaatagacttt

SEQ ID NO: 6237871 - DNA, 15 bp, Homo sapiens
gagaaatagactttg

SEQ ID NO: 6237872 - DNA, 21 bp, Homo sapiens
gagaaatagctgtatagatga

SEQ ID NO: 6237873 - DNA, 17 bp, Homo sapiens
gagaaatcacaggggcg

SEQ ID NO: 6237874 - DNA, 12 bp, Homo sapiens
gagaaatcaggc

SEQ ID NO: 6237875 - DNA, 23 bp, Homo sapiens
gagaaatcttaagtcataatgaa

SEQ ID NO: 6237876 - DNA, 11 bp, Homo sapiens
gagaaatgaaa

SEQ ID NO: 6237877 - DNA, 21 bp, Homo sapiens
gagaaatgaaaaaatatatat

SEQ ID NO: 6237878 - DNA, 14 bp, Homo sapiens
gagaaatgaaaaca

SEQ ID NO: 6237879 - DNA, 15 bp, Homo sapiens
gagaaatgaagcaga

SEQ ID NO: 6237880 - DNA, 21 bp, Homo sapiens
gagaaatgaagcagaggaagg

SEQ ID NO: 6237881 - DNA, 19 bp, Homo sapiens
gagaaatgaatgctgagac

SEQ ID NO: 6237882 - DNA, 21 bp, Homo sapiens
gagaaatgatgtgaaagataa

SEQ ID NO: 6237883 - DNA, 13 bp, Homo sapiens
gagaaatgattgt

SEQ ID NO: 6237884 - DNA, 22 bp, Homo sapiens
gagaaatgcaataactctggga

SEQ ID NO: 6237885 - DNA, 13 bp, Homo sapiens
gagaaatgcccca

SEQ ID NO: 6237886 - DNA, 13 bp, Homo sapiens
gagaaatgggact

SEQ ID NO: 6237887 - DNA, 21 bp, Homo sapiens
gagaaatggtccgctttcctg

SEQ ID NO: 6237888 - DNA, 17 bp, Homo sapiens
gagaaatgtaatgcgat

SEQ ID NO: 6237889 - DNA, 14 bp, Homo sapiens
gagaaatgtcataa

SEQ ID NO: 6237890 - DNA, 18 bp, Homo sapiens
gagaaattacaggttcct

SEQ ID NO: 6237891 - DNA, 19 bp, Homo sapiens
gagaaattacaggttcctt

SEQ ID NO: 6237892 - DNA, 18 bp, Homo sapiens
gagaaattatagttaggc

SEQ ID NO: 6237893 - DNA, 14 bp, Homo sapiens
gagaaattctgtgg

SEQ ID NO: 6237894 - DNA, 14 bp, Homo sapiens
gagaaattctgtta

SEQ ID NO: 6237895 - DNA, 16 bp, Homo sapiens
gagaaattctgttaaa

SEQ ID NO: 6237896 - DNA, 20 bp, Homo sapiens
gagaaattctgttaaaatct

SEQ ID NO: 6237897 - DNA, 14 bp, Homo sapiens
gagaaattgacaga

SEQ ID NO: 6237898 - DNA, 11 bp, Homo sapiens
gagaaattggg

SEQ ID NO: 6237899 - DNA, 15 bp, Homo sapiens
gagaaatttacaaaa

SEQ ID NO: 6237900 - DNA, 21 bp, Homo sapiens
gagaaatttgtggttgcatgt

SEQ ID NO: 6237901 - DNA, 19 bp, Homo sapiens
gagaaatttttatttttga

SEQ ID NO: 6237902 - DNA, 18 bp, Homo sapiens
gagaaatttttttccaga

SEQ ID NO: 6237903 - DNA, 17 bp, Homo sapiens
gagaacaaacagatcga

SEQ ID NO: 6237904 - DNA, 15 bp, Homo sapiens
gagaacaaagagtga

SEQ ID NO: 6237905 - DNA, 12 bp, Homo sapiens
gagaacaaagct

SEQ ID NO: 6237906 - DNA, 14 bp, Homo sapiens
gagaacaaagctgt

SEQ ID NO: 6237907 - DNA, 12 bp, Homo sapiens
gagaacaaatat

SEQ ID NO: 6237908 - DNA, 15 bp, Homo sapiens
gagaacaaatattca

SEQ ID NO: 6237909 - DNA, 17 bp, Homo sapiens
gagaacaagtcacagct

SEQ ID NO: 6237910 - DNA, 22 bp, Homo sapiens
gagaacaagtcacagctgcagc

SEQ ID NO: 6237911 - DNA, 17 bp, Homo sapiens
gagaacaagttgttaaa

SEQ ID NO: 6237912 - DNA, 22 bp, Homo sapiens
gagaacacaagccacgcctgcg

SEQ ID NO: 6237913 - DNA, 14 bp, Homo sapiens
gagaacagaaaaca

SEQ ID NO: 6237914 - DNA, 20 bp, Homo sapiens
gagaacagatctccaaagct

SEQ ID NO: 6237915 - DNA, 13 bp, Homo sapiens
gagaacaggacta

SEQ ID NO: 6237916 - DNA, 13 bp, Homo sapiens
gagaacagtagga

SEQ ID NO: 6237917 - DNA, 20 bp, Homo sapiens
gagaacagtattgggcagga

SEQ ID NO: 6237918 - DNA, 17 bp, Homo sapiens
gagaacagtggttgcct

SEQ ID NO: 6237919 - DNA, 19 bp, Homo sapiens
gagaacagtggttgcctgg

SEQ ID NO: 6237920 - DNA, 23 bp, Homo sapiens
gagaacagtggttgcctgggggc

SEQ ID NO: 6237921 - DNA, 22 bp, Homo sapiens
gagaacagttgagagagaatct

SEQ ID NO: 6237922 - DNA, 18 bp, Homo sapiens
gagaacattaggccccag

SEQ ID NO: 6237923 - DNA, 11 bp, Homo sapiens
gagaaccaaaa

SEQ ID NO: 6237924 - DNA, 16 bp, Homo sapiens
gagaaccaaaagatgc

SEQ ID NO: 6237925 - DNA, 13 bp, Homo sapiens
gagaaccaaatct

SEQ ID NO: 6237926 - DNA, 14 bp, Homo sapiens
gagaaccaaccagg

SEQ ID NO: 6237927 - DNA, 18 bp, Homo sapiens
gagaaccaaccagggaag

SEQ ID NO: 6237928 - DNA, 21 bp, Homo sapiens
gagaaccagtctcctcactct

SEQ ID NO: 6237929 - DNA, 14 bp, Homo sapiens
gagaaccagtgcag

SEQ ID NO: 6237930 - DNA, 14 bp, Homo sapiens
gagaaccataggac

SEQ ID NO: 6237931 - DNA, 16 bp, Homo sapiens
gagaacccagtttccc

SEQ ID NO: 6237932 - DNA, 19 bp, Homo sapiens
gagaacctaactgtatctt

SEQ ID NO: 6237933 - DNA, 18 bp, Homo sapiens
gagaacctaagtttcagt

SEQ ID NO: 6237934 - DNA, 17 bp, Homo sapiens
gagaacctcagattctt

SEQ ID NO: 6237935 - DNA, 21 bp, Homo sapiens
gagaacctcaggtacggagaa

SEQ ID NO: 6237936 - DNA, 13 bp, Homo sapiens
gagaacctggcct

SEQ ID NO: 6237937 - DNA, 15 bp, Homo sapiens
gagaacctggccttc

SEQ ID NO: 6237938 - DNA, 20 bp, Homo sapiens
gagaacgggcgtcaggggtg

SEQ ID NO: 6237939 - DNA, 23 bp, Homo sapiens
gagaacggtgaccgcctcctgct

SEQ ID NO: 6237940 - DNA, 20 bp, Homo sapiens
gagaactagtggtggctctg

SEQ ID NO: 6237941 - DNA, 18 bp, Homo sapiens
gagaactccagctggtgc

SEQ ID NO: 6237942 - DNA, 15 bp, Homo sapiens
gagaactcctgactg

SEQ ID NO: 6237943 - DNA, 20 bp, Homo sapiens
gagaactcgaagcccttcca

SEQ ID NO: 6237944 - DNA, 22 bp, Homo sapiens
gagaactctctccctggtctct

SEQ ID NO: 6237945 - DNA, 20 bp, Homo sapiens
gagaactgacaaaggagcct

SEQ ID NO: 6237946 - DNA, 14 bp, Homo sapiens
gagaactgaggagc

SEQ ID NO: 6237947 - DNA, 13 bp, Homo sapiens
gagaactgcagac

SEQ ID NO: 6237948 - DNA, 18 bp, Homo sapiens
gagaactgcatatgtttc

SEQ ID NO: 6237949 - DNA, 17 bp, Homo sapiens
gagaactgcttctaaga

SEQ ID NO: 6237950 - DNA, 14 bp, Homo sapiens
gagaactggttctt

SEQ ID NO: 6237951 - DNA, 19 bp, Homo sapiens
gagaactgtcaccctgagg

SEQ ID NO: 6237952 - DNA, 19 bp, Homo sapiens
gagaactgtgaatatgtgt

SEQ ID NO: 6237953 - DNA, 14 bp, Homo sapiens
gagaactgtgctct

SEQ ID NO: 6237954 - DNA, 20 bp, Homo sapiens
gagaacttatggccacagcc

SEQ ID NO: 6237955 - DNA, 17 bp, Homo sapiens
gagaacttgaacaaagt

SEQ ID NO: 6237956 - DNA, 15 bp, Homo sapiens
gagaactttattttg

SEQ ID NO: 6237957 - DNA, 17 bp, Homo sapiens
gagaactttcatttttt

SEQ ID NO: 6237958 - DNA, 17 bp, Homo sapiens
gagaactttccattttg

SEQ ID NO: 6237959 - DNA, 21 bp, Homo sapiens
gagaactttcggagcctgcct

SEQ ID NO: 6237960 - DNA, 14 bp, Homo sapiens
gagaagaaaacatt

SEQ ID NO: 6237961 - DNA, 22 bp, Homo sapiens
gagaagaaagaggtgaccccag

SEQ ID NO: 6237962 - DNA, 20 bp, Homo sapiens
gagaagaaaggtgagtttga

SEQ ID NO: 6237963 - DNA, 16 bp, Homo sapiens
gagaagaaagtgaaag

SEQ ID NO: 6237964 - DNA, 20 bp, Homo sapiens
gagaagaaatagcagagcct

SEQ ID NO: 6237965 - DNA, 21 bp, Homo sapiens
gagaagaaatgttataaagta

SEQ ID NO: 6237966 - DNA, 17 bp, Homo sapiens
gagaagaagctgaggat

SEQ ID NO: 6237967 - DNA, 17 bp, Homo sapiens
gcagtcaccacccagcc

SEQ ID NO: 6237968 - DNA, 20 bp, Homo sapiens
gcagtcaccacccagccctt

SEQ ID NO: 6237969 - DNA, 13 bp, Homo sapiens
gcagtcacctctt

SEQ ID NO: 6237970 - DNA, 20 bp, Homo sapiens
gcagtcacgtgaggcccctg

SEQ ID NO: 6237971 - DNA, 21 bp, Homo sapiens
gcagtcacgtgaggcccctgt

SEQ ID NO: 6237972 - DNA, 24 bp, Homo sapiens
gcagtcacgtggaggagcagtgca

SEQ ID NO: 6237973 - DNA, 13 bp, Homo sapiens
gcagtcactgaat

SEQ ID NO: 6237974 - DNA, 23 bp, Homo sapiens
gcagtcactggaggttgaagcca

SEQ ID NO: 6237975 - DNA, 16 bp, Homo sapiens
gcagtcactgggagag

SEQ ID NO: 6237976 - DNA, 21 bp, Homo sapiens
gcagtcacttcggccagagct

SEQ ID NO: 6237977 - DNA, 20 bp, Homo sapiens
gcagtcagcggagaggaccc

SEQ ID NO: 6237978 - DNA, 16 bp, Homo sapiens
gcagtcagggcccaga

SEQ ID NO: 6237979 - DNA, 22 bp, Homo sapiens
gcagtcatcaacaatgattaat

SEQ ID NO: 6237980 - DNA, 14 bp, Homo sapiens
gcagtcatctactt

SEQ ID NO: 6237981 - DNA, 18 bp, Homo sapiens
gcagtccacttctgacag

SEQ ID NO: 6237982 - DNA, 13 bp, Homo sapiens
gcagtccagaata

SEQ ID NO: 6237983 - DNA, 16 bp, Homo sapiens
gcagtccagccagctc

SEQ ID NO: 6237984 - DNA, 18 bp, Homo sapiens
gcagtccaggcctctctc

SEQ ID NO: 6237985 - DNA, 22 bp, Homo sapiens
gcagtccaggcctctctctgct

SEQ ID NO: 6237986 - DNA, 15 bp, Homo sapiens
gcagtccagtgagaa

SEQ ID NO: 6237987 - DNA, 13 bp, Homo sapiens
gcagtccatgcat

SEQ ID NO: 6237988 - DNA, 16 bp, Homo sapiens
gcagtccatttctacc

SEQ ID NO: 6237989 - DNA, 22 bp, Homo sapiens
gcagtcccagtattctcagagc

SEQ ID NO: 6237990 - DNA, 16 bp, Homo sapiens
gcagtccccagccctt

SEQ ID NO: 6237991 - DNA, 19 bp, Homo sapiens
gcagtccccagcccttctg

SEQ ID NO: 6237992 - DNA, 13 bp, Homo sapiens
gcagtcccgggag

SEQ ID NO: 6237993 - DNA, 17 bp, Homo sapiens
gcagtcccgtggagggt

SEQ ID NO: 6237994 - DNA, 23 bp, Homo sapiens
gcagtcccgtggagggtagggga

SEQ ID NO: 6237995 - DNA, 15 bp, Homo sapiens
gcagtccctggagaa

SEQ ID NO: 6237996 - DNA, 12 bp, Homo sapiens
gcagtccgcagt

SEQ ID NO: 6237997 - DNA, 17 bp, Homo sapiens
gcagtcctcccacccta

SEQ ID NO: 6237998 - DNA, 22 bp, Homo sapiens
gcagtcctgagtgggtgttgca

SEQ ID NO: 6237999 - DNA, 20 bp, Homo sapiens
gcagtcctggaagccagctt

SEQ ID NO: 6238000 - DNA, 13 bp, Homo sapiens
gcagtcctggagc

SEQ ID NO: 6238001 - DNA, 13 bp, Homo sapiens
gcagtcctggagg

SEQ ID NO: 6238002 - DNA, 11 bp, Homo sapiens
gcagtcctggg

SEQ ID NO: 6238003 - DNA, 13 bp, Homo sapiens
gcagtcctgggcc

SEQ ID NO: 6238004 - DNA, 20 bp, Homo sapiens
gcagtcctgggccccctggg

SEQ ID NO: 6238005 - DNA, 16 bp, Homo sapiens
gcagtcctggtggggc

SEQ ID NO: 6238006 - DNA, 14 bp, Homo sapiens
gcagtcctgtgtga

SEQ ID NO: 6238007 - DNA, 15 bp, Homo sapiens
gcagtcgcctgcctg

SEQ ID NO: 6238008 - DNA, 16 bp, Homo sapiens
gcagtcgcctgcctgc

SEQ ID NO: 6238009 - DNA, 19 bp, Homo sapiens
gcagtcgcctgcctgcagc

SEQ ID NO: 6238010 - DNA, 20 bp, Homo sapiens
gcagtcgcctgcctgcagca

SEQ ID NO: 6238011 - DNA, 14 bp, Homo sapiens
gcagtcgctgcagg

SEQ ID NO: 6238012 - DNA, 14 bp, Homo sapiens
gcagtcgcttgcca

SEQ ID NO: 6238013 - DNA, 21 bp, Homo sapiens
gcagtcgcttgccaaagcaga

SEQ ID NO: 6238014 - DNA, 13 bp, Homo sapiens
gcagtcgtcagcc

SEQ ID NO: 6238015 - DNA, 18 bp, Homo sapiens
gcagtcgtcagcctccct

SEQ ID NO: 6238016 - DNA, 19 bp, Homo sapiens
gcagtcgtcagcctccctg

SEQ ID NO: 6238017 - DNA, 13 bp, Homo sapiens
gcagtcgtgcctg

SEQ ID NO: 6238018 - DNA, 19 bp, Homo sapiens
gcagtctaaaacttcaaaa

SEQ ID NO: 6238019 - DNA, 22 bp, Homo sapiens
gcagtctaaacagagtccggga

SEQ ID NO: 6238020 - DNA, 17 bp, Homo sapiens
gcagtctaagtgtaaat

SEQ ID NO: 6238021 - DNA, 15 bp, Homo sapiens
gcagtctacttctgt

SEQ ID NO: 6238022 - DNA, 20 bp, Homo sapiens
gcagtctacttctgtgtctg

SEQ ID NO: 6238023 - DNA, 22 bp, Homo sapiens
gcagtctacttctgtgtctgtc

SEQ ID NO: 6238024 - DNA, 14 bp, Homo sapiens
gcagtctagtcctg

SEQ ID NO: 6238025 - DNA, 20 bp, Homo sapiens
gcagtctatatgtttgtata

SEQ ID NO: 6238026 - DNA, 12 bp, Homo sapiens
gcagtctcagaa

SEQ ID NO: 6238027 - DNA, 15 bp, Homo sapiens
gcagtctccccttcc

SEQ ID NO: 6238028 - DNA, 18 bp, Homo sapiens
gcagtctccccttcctgg

SEQ ID NO: 6238029 - DNA, 21 bp, Homo sapiens
gcagtctccccttcctggcac

SEQ ID NO: 6238030 - DNA, 16 bp, Homo sapiens
gcagtctccgctcccg

SEQ ID NO: 6238031 - DNA, 21 bp, Homo sapiens
gcagtctcctctttaaaacaa

SEQ ID NO: 6238032 - DNA, 22 bp, Homo sapiens
gcagtctcctctttaaaacaaa

SEQ ID NO: 6238033 - DNA, 18 bp, Homo sapiens
gcagtctccttcagcacg

SEQ ID NO: 6238034 - DNA, 22 bp, Homo sapiens
gcagtctctataccaataaagt

SEQ ID NO: 6238035 - DNA, 23 bp, Homo sapiens
gcagtctctataccaataaagtg

SEQ ID NO: 6238036 - DNA, 19 bp, Homo sapiens
gcagtctcttagaatttgt

SEQ ID NO: 6238037 - DNA, 13 bp, Homo sapiens
gcagtctgaaccc

SEQ ID NO: 6238038 - DNA, 22 bp, Homo sapiens
gcagtctgaacccttgtgcttg

SEQ ID NO: 6238039 - DNA, 13 bp, Homo sapiens
gcagtctgaagga

SEQ ID NO: 6238040 - DNA, 14 bp, Homo sapiens
gcagtctgcctgga

SEQ ID NO: 6238041 - DNA, 13 bp, Homo sapiens
gcagtctgctctg

SEQ ID NO: 6238042 - DNA, 16 bp, Homo sapiens
gcagtctgctctgctg

SEQ ID NO: 6238043 - DNA, 12 bp, Homo sapiens
gcagtctggagg

SEQ ID NO: 6238044 - DNA, 16 bp, Homo sapiens
gcagtctggcctgggc

SEQ ID NO: 6238045 - DNA, 18 bp, Homo sapiens
gcagtctggcctgggcga

SEQ ID NO: 6238046 - DNA, 17 bp, Homo sapiens
gcagtcttatgcttcca

SEQ ID NO: 6238047 - DNA, 19 bp, Homo sapiens
gcagtcttatgcttccaga

SEQ ID NO: 6238048 - DNA, 22 bp, Homo sapiens
gcagtcttatgcttccagaaac

SEQ ID NO: 6238049 - DNA, 17 bp, Homo sapiens
gcagtcttctctctggc

SEQ ID NO: 6238050 - DNA, 19 bp, Homo sapiens
gcagtcttctctctggctc

SEQ ID NO: 6238051 - DNA, 15 bp, Homo sapiens
gcagtcttctgggct

SEQ ID NO: 6238052 - DNA, 12 bp, Homo sapiens
gcagtcttgctc

SEQ ID NO: 6238053 - DNA, 14 bp, Homo sapiens
gcagtcttgctctg

SEQ ID NO: 6238054 - DNA, 13 bp, Homo sapiens
gcagtctttcccc

SEQ ID NO: 6238055 - DNA, 14 bp, Homo sapiens
gcagtcttttgctg

SEQ ID NO: 6238056 - DNA, 15 bp, Homo sapiens
gcagtcttttgctgt

SEQ ID NO: 6238057 - DNA, 21 bp, Homo sapiens
gcagtgaagatgtgtaaataa

SEQ ID NO: 6238058 - DNA, 14 bp, Homo sapiens
gcagtgaattgtga

SEQ ID NO: 6238059 - DNA, 21 bp, Homo sapiens
gcagtgaattgtgaccaagtt

SEQ ID NO: 6238060 - DNA, 15 bp, Homo sapiens
gcagtgaccgcttcc

SEQ ID NO: 6238061 - DNA, 16 bp, Homo sapiens
gcagtgacgtgagtgg

SEQ ID NO: 6238062 - DNA, 15 bp, Homo sapiens
gcagtgactccccag

SEQ ID NO: 6238063 - DNA, 20 bp, Homo sapiens
gcagtgactcgacaaaggcc

SEQ ID NO: 6238064 - DNA, 18 bp, Homo sapiens
gcagtgactggcaggtgc

SEQ ID NO: 6238065 - DNA, 22 bp, Homo sapiens
gcagtgactgtggccatggtcc

SEQ ID NO: 6238066 - DNA, 21 bp, Homo sapiens
gcagtgagaaaaagctcctgt

SEQ ID NO: 6238067 - DNA, 22 bp, Homo sapiens
gcagtgagaaaaagctcctgtc

SEQ ID NO: 6238068 - DNA, 14 bp, Homo sapiens
gcagtgagatgtca

SEQ ID NO: 6238069 - DNA, 15 bp, Homo sapiens
gcagtgagcactgaa

SEQ ID NO: 6238070 - DNA, 21 bp, Homo sapiens
gcagtgagcagggttcctgtg

SEQ ID NO: 6238071 - DNA, 20 bp, Homo sapiens
gcagtgagccaagattgcgc

SEQ ID NO: 6238072 - DNA, 20 bp, Homo sapiens
gcagtgagccgagattgcac

SEQ ID NO: 6238073 - DNA, 23 bp, Homo sapiens
gcagtgagccgagattgcaccac

SEQ ID NO: 6238074 - DNA, 14 bp, Homo sapiens
gcagtgagcggaga

SEQ ID NO: 6238075 - DNA, 16 bp, Homo sapiens
gcagtgagctgagatc

SEQ ID NO: 6238076 - DNA, 16 bp, Homo sapiens
gcagtgagcttctatt

SEQ ID NO: 6238077 - DNA, 21 bp, Homo sapiens
gcagtgaggggccctccatgc

SEQ ID NO: 6238078 - DNA, 23 bp, Homo sapiens
gcagtgaggggccctccatgcgc

SEQ ID NO: 6238079 - DNA, 20 bp, Homo sapiens
gcagtgagtgagcctggctc

SEQ ID NO: 6238080 - DNA, 21 bp, Homo sapiens
gcagtgagtgagcctggctct

SEQ ID NO: 6238081 - DNA, 14 bp, Homo sapiens
gcagtgagtgccat

SEQ ID NO: 6238082 - DNA, 19 bp, Homo sapiens
gcagtgatctcagggcaga

SEQ ID NO: 6238083 - DNA, 14 bp, Homo sapiens
gcagtgatggcgcg

SEQ ID NO: 6238084 - DNA, 16 bp, Homo sapiens
gcagtgatgtttgcca

SEQ ID NO: 6238085 - DNA, 22 bp, Homo sapiens
gcagtgattaaggtctctcttt

SEQ ID NO: 6238086 - DNA, 18 bp, Homo sapiens
gcagtgattcagcaggcc

SEQ ID NO: 6238087 - DNA, 15 bp, Homo sapiens
gcagtgattctctct

SEQ ID NO: 6238088 - DNA, 16 bp, Homo sapiens
gcagtgattctgtttg

SEQ ID NO: 6238089 - DNA, 20 bp, Homo sapiens
gcagtgattgaagtatctgt

SEQ ID NO: 6238090 - DNA, 22 bp, Homo sapiens
gcagtgcaagagactctggcct

SEQ ID NO: 6238091 - DNA, 20 bp, Homo sapiens
gcagtgcacatctgacccag

SEQ ID NO: 6238092 - DNA, 19 bp, Homo sapiens
gcagtgcaccccctaaaga

SEQ ID NO: 6238093 - DNA, 15 bp, Homo sapiens
gcagtgcacgcggct

SEQ ID NO: 6238094 - DNA, 16 bp, Homo sapiens
gcagtgcagcaaccag

SEQ ID NO: 6238095 - DNA, 15 bp, Homo sapiens
gcagtgcatgcatgt

SEQ ID NO: 6238096 - DNA, 16 bp, Homo sapiens
gcagtgcatgcatgtt

SEQ ID NO: 6238097 - DNA, 13 bp, Homo sapiens
gcagtgcatgtga

SEQ ID NO: 6238098 - DNA, 14 bp, Homo sapiens
gcagtgccacagcc

SEQ ID NO: 6238099 - DNA, 16 bp, Homo sapiens
gcagtgccacagcctg

SEQ ID NO: 6238100 - DNA, 18 bp, Homo sapiens
gcagtgccacagcctgct

SEQ ID NO: 6238101 - DNA, 19 bp, Homo sapiens
gcagtgccacagcctgctg

SEQ ID NO: 6238102 - DNA, 13 bp, Homo sapiens
gcagtgccagcca

SEQ ID NO: 6238103 - DNA, 14 bp, Homo sapiens
gcagtgccagccaa

SEQ ID NO: 6238104 - DNA, 12 bp, Homo sapiens
gcagtgccagct

SEQ ID NO: 6238105 - DNA, 14 bp, Homo sapiens
gcagtgccagctcc

SEQ ID NO: 6238106 - DNA, 22 bp, Homo sapiens
gcagtgcccagtgatggcatta

SEQ ID NO: 6238107 - DNA, 13 bp, Homo sapiens
gcagtgccccagg

SEQ ID NO: 6238108 - DNA, 13 bp, Homo sapiens
gcagtgcccggct

SEQ ID NO: 6238109 - DNA, 15 bp, Homo sapiens
gcagtgccctctgga

SEQ ID NO: 6238110 - DNA, 21 bp, Homo sapiens
gcagtgccctctggacagctt

SEQ ID NO: 6238111 - DNA, 22 bp, Homo sapiens
gcagtgccctgccccagtcagc

SEQ ID NO: 6238112 - DNA, 23 bp, Homo sapiens
gcagtgccctgccccagtcagcc

SEQ ID NO: 6238113 - DNA, 16 bp, Homo sapiens
gcagtgccttccataa

SEQ ID NO: 6238114 - DNA, 13 bp, Homo sapiens
gcagtgccttgca

SEQ ID NO: 6238115 - DNA, 15 bp, Homo sapiens
gcagtgcctttcccc

SEQ ID NO: 6238116 - DNA, 22 bp, Homo sapiens
gcagtgcgcgtgcacgtggaga

SEQ ID NO: 6238117 - DNA, 22 bp, Homo sapiens
gcagtgctagtgagctgggcat

SEQ ID NO: 6238118 - DNA, 19 bp, Homo sapiens
gcagtgctcgctgttgctg

SEQ ID NO: 6238119 - DNA, 14 bp, Homo sapiens
gcagtgctgggacc

SEQ ID NO: 6238120 - DNA, 18 bp, Homo sapiens
gcagtgctgggaccagag

SEQ ID NO: 6238121 - DNA, 22 bp, Homo sapiens
gcagtgctgggaccagagccag

SEQ ID NO: 6238122 - DNA, 12 bp, Homo sapiens
gcagtgctgggc

SEQ ID NO: 6238123 - DNA, 16 bp, Homo sapiens
gcagtgctggttctcc

SEQ ID NO: 6238124 - DNA, 16 bp, Homo sapiens
gcagtgcttctctaca

SEQ ID NO: 6238125 - DNA, 16 bp, Homo sapiens
gcagtgcttggcccag

SEQ ID NO: 6238126 - DNA, 21 bp, Homo sapiens
gcagtggaaaaatcagaagca

SEQ ID NO: 6238127 - DNA, 22 bp, Homo sapiens
gcagtggaaaaatcagaagcac

SEQ ID NO: 6238128 - DNA, 16 bp, Homo sapiens
gcagtggacggagagc

SEQ ID NO: 6238129 - DNA, 17 bp, Homo sapiens
gcagtggacggagagcc

SEQ ID NO: 6238130 - DNA, 13 bp, Homo sapiens
gcagtggagcaga

SEQ ID NO: 6238131 - DNA, 17 bp, Homo sapiens
gcagtggaggctgctgt

SEQ ID NO: 6238132 - DNA, 18 bp, Homo sapiens
gcagtggaggctgctgtg

SEQ ID NO: 6238133 - DNA, 18 bp, Homo sapiens
gcagtggaggtagaatga

SEQ ID NO: 6238134 - DNA, 14 bp, Homo sapiens
gcagtggaggtggg

SEQ ID NO: 6238135 - DNA, 15 bp, Homo sapiens
gcagtggcaaaatat

SEQ ID NO: 6238136 - DNA, 14 bp, Homo sapiens
gcagtggcaggacc

SEQ ID NO: 6238137 - DNA, 16 bp, Homo sapiens
gcagtggcaggggagc

SEQ ID NO: 6238138 - DNA, 18 bp, Homo sapiens
gcagtggcaggggagcag

SEQ ID NO: 6238139 - DNA, 18 bp, Homo sapiens
gcagtggccaagcctgct

SEQ ID NO: 6238140 - DNA, 13 bp, Homo sapiens
gcagtggccaggc

SEQ ID NO: 6238141 - DNA, 18 bp, Homo sapiens
gcagtggccaggcaggga

SEQ ID NO: 6238142 - DNA, 18 bp, Homo sapiens
gcagtggccatcatcctc

SEQ ID NO: 6238143 - DNA, 22 bp, Homo sapiens
gcagtggccgcaagcgcaggga

SEQ ID NO: 6238144 - DNA, 23 bp, Homo sapiens
gcagtggccgcaagcgcagggag

SEQ ID NO: 6238145 - DNA, 20 bp, Homo sapiens
gcagtggcctgatctctgct

SEQ ID NO: 6238146 - DNA, 23 bp, Homo sapiens
gagaagaatagaggtcctcatgg

SEQ ID NO: 6238147 - DNA, 22 bp, Homo sapiens
gagaagacaaactccggcactg

SEQ ID NO: 6238148 - DNA, 14 bp, Homo sapiens
gagaagacactgca

SEQ ID NO: 6238149 - DNA, 15 bp, Homo sapiens
gagaagacactgcag

SEQ ID NO: 6238150 - DNA, 14 bp, Homo sapiens
gagaagacccctgc

SEQ ID NO: 6238151 - DNA, 18 bp, Homo sapiens
gagaagacccctgcccaa

SEQ ID NO: 6238152 - DNA, 12 bp, Homo sapiens
gagaagagaaag

SEQ ID NO: 6238153 - DNA, 17 bp, Homo sapiens
gagaagagaacctcaaa

SEQ ID NO: 6238154 - DNA, 14 bp, Homo sapiens
gagaagagaatgca

SEQ ID NO: 6238155 - DNA, 15 bp, Homo sapiens
gagaagagccccact

SEQ ID NO: 6238156 - DNA, 13 bp, Homo sapiens
gagaagagccctg

SEQ ID NO: 6238157 - DNA, 14 bp, Homo sapiens
gagaagagccctgg

SEQ ID NO: 6238158 - DNA, 15 bp, Homo sapiens
gagaagagcttgcac

SEQ ID NO: 6238159 - DNA, 20 bp, Homo sapiens
gagaagagggaaaacagaaa

SEQ ID NO: 6238160 - DNA, 14 bp, Homo sapiens
gagaagagggcctg

SEQ ID NO: 6238161 - DNA, 15 bp, Homo sapiens
gagaagagggcctgt

SEQ ID NO: 6238162 - DNA, 21 bp, Homo sapiens
gagaagaggggtataggacaa

SEQ ID NO: 6238163 - DNA, 13 bp, Homo sapiens
gagaagagtattt

SEQ ID NO: 6238164 - DNA, 15 bp, Homo sapiens
gagaagataaggtct

SEQ ID NO: 6238165 - DNA, 22 bp, Homo sapiens
gagaagataattgttgaaattt

SEQ ID NO: 6238166 - DNA, 20 bp, Homo sapiens
gagaagatcggaacagctcc

SEQ ID NO: 6238167 - DNA, 15 bp, Homo sapiens
gagaagatgaaattt

SEQ ID NO: 6238168 - DNA, 10 bp, Homo sapiens
gagaagatgg

SEQ ID NO: 6238169 - DNA, 18 bp, Homo sapiens
gagaagatggcactgtcc

SEQ ID NO: 6238170 - DNA, 19 bp, Homo sapiens
gagaagatggcactgtcca

SEQ ID NO: 6238171 - DNA, 20 bp, Homo sapiens
gagaagatttcagagctgag

SEQ ID NO: 6238172 - DNA, 21 bp, Homo sapiens
gagaagatttcagagctgagg

SEQ ID NO: 6238173 - DNA, 14 bp, Homo sapiens
gagaagattttata

SEQ ID NO: 6238174 - DNA, 19 bp, Homo sapiens
gagaagcaaaatctttttt

SEQ ID NO: 6238175 - DNA, 14 bp, Homo sapiens
gagaagcaggcaga

SEQ ID NO: 6238176 - DNA, 18 bp, Homo sapiens
gagaagcagtgagccgca

SEQ ID NO: 6238177 - DNA, 13 bp, Homo sapiens
gagaagcatgaaa

SEQ ID NO: 6238178 - DNA, 14 bp, Homo sapiens
gagaagccaagcct

SEQ ID NO: 6238179 - DNA, 20 bp, Homo sapiens
gagaagccaagggacacagg

SEQ ID NO: 6238180 - DNA, 13 bp, Homo sapiens
gagaagccacagg

SEQ ID NO: 6238181 - DNA, 18 bp, Homo sapiens
gagaagccacaggcctga

SEQ ID NO: 6238182 - DNA, 22 bp, Homo sapiens
gagaagccacaggcctgagatt

SEQ ID NO: 6238183 - DNA, 13 bp, Homo sapiens
gagaagccagcca

SEQ ID NO: 6238184 - DNA, 15 bp, Homo sapiens
gagaagccagccaca

SEQ ID NO: 6238185 - DNA, 16 bp, Homo sapiens
gagaagccagcttgtt

SEQ ID NO: 6238186 - DNA, 20 bp, Homo sapiens
gagaagccagcttgtttaca

SEQ ID NO: 6238187 - DNA, 12 bp, Homo sapiens
gagaagccagga

SEQ ID NO: 6238188 - DNA, 21 bp, Homo sapiens
gagaagccccttccccatggg

SEQ ID NO: 6238189 - DNA, 22 bp, Homo sapiens
gagaagccccttccccatggga

SEQ ID NO: 6238190 - DNA, 21 bp, Homo sapiens
gagaagcctcagtccctccct

SEQ ID NO: 6238191 - DNA, 19 bp, Homo sapiens
gagaagccttcaagctctg

SEQ ID NO: 6238192 - DNA, 22 bp, Homo sapiens
gagaagccttcaagctctgagg

SEQ ID NO: 6238193 - DNA, 13 bp, Homo sapiens
gagaagccttcag

SEQ ID NO: 6238194 - DNA, 14 bp, Homo sapiens
gagaagccttcagc

SEQ ID NO: 6238195 - DNA, 20 bp, Homo sapiens
gagaagcgctgccctgtgag

SEQ ID NO: 6238196 - DNA, 21 bp, Homo sapiens
gagaagcgtatgttttttatt

SEQ ID NO: 6238197 - DNA, 22 bp, Homo sapiens
gagaagctcctctccccagccc

SEQ ID NO: 6238198 - DNA, 13 bp, Homo sapiens
gagaagctcctgc

SEQ ID NO: 6238199 - DNA, 14 bp, Homo sapiens
gagaagctcctgct

SEQ ID NO: 6238200 - DNA, 15 bp, Homo sapiens
gagaagctcctgcta

SEQ ID NO: 6238201 - DNA, 18 bp, Homo sapiens
gagaagctctcgagggaa

SEQ ID NO: 6238202 - DNA, 20 bp, Homo sapiens
gagaagctctcgagggaagc

SEQ ID NO: 6238203 - DNA, 12 bp, Homo sapiens
gagaagctcttc

SEQ ID NO: 6238204 - DNA, 12 bp, Homo sapiens
gagaagctgaga

SEQ ID NO: 6238205 - DNA, 14 bp, Homo sapiens
gagaagctgagaag

SEQ ID NO: 6238206 - DNA, 15 bp, Homo sapiens
gagaagctgagaaga

SEQ ID NO: 6238207 - DNA, 17 bp, Homo sapiens
gagaagctgagaagaag

SEQ ID NO: 6238208 - DNA, 13 bp, Homo sapiens
gagaagctgaggc

SEQ ID NO: 6238209 - DNA, 15 bp, Homo sapiens
gagaagctgaggcct

SEQ ID NO: 6238210 - DNA, 23 bp, Homo sapiens
gagaagctgatgctttgcttcaa

SEQ ID NO: 6238211 - DNA, 12 bp, Homo sapiens
gagaagctgcag

SEQ ID NO: 6238212 - DNA, 22 bp, Homo sapiens
gagaagctgctcaacttgcaaa

SEQ ID NO: 6238213 - DNA, 20 bp, Homo sapiens
gagaagctggtctagactgt

SEQ ID NO: 6238214 - DNA, 21 bp, Homo sapiens
gagaagcttctaattagatca

SEQ ID NO: 6238215 - DNA, 17 bp, Homo sapiens
gagaagctttgccctcc

SEQ ID NO: 6238216 - DNA, 22 bp, Homo sapiens
gagaagcttttgaataaaaact

SEQ ID NO: 6238217 - DNA, 18 bp, Homo sapiens
gagaaggaaaaggctggc

SEQ ID NO: 6238218 - DNA, 13 bp, Homo sapiens
gagaaggaacagg

SEQ ID NO: 6238219 - DNA, 20 bp, Homo sapiens
gagaaggacccggaggggcc

SEQ ID NO: 6238220 - DNA, 23 bp, Homo sapiens
gagaaggacccggaggggcctgg

SEQ ID NO: 6238221 - DNA, 14 bp, Homo sapiens
gagaaggagagaaa

SEQ ID NO: 6238222 - DNA, 22 bp, Homo sapiens
gagaaggagagggagtacaaag

SEQ ID NO: 6238223 - DNA, 12 bp, Homo sapiens
gagaaggaggag

SEQ ID NO: 6238224 - DNA, 15 bp, Homo sapiens
gagaaggagtgccat

SEQ ID NO: 6238225 - DNA, 22 bp, Homo sapiens
gagaaggatgtccgttccagga

SEQ ID NO: 6238226 - DNA, 16 bp, Homo sapiens
gagaaggcagccacca

SEQ ID NO: 6238227 - DNA, 23 bp, Homo sapiens
gagaaggcaggaatgtgtggcag

SEQ ID NO: 6238228 - DNA, 18 bp, Homo sapiens
gagaaggcatgagaaaga

SEQ ID NO: 6238229 - DNA, 18 bp, Homo sapiens
gagaaggccccagggcag

SEQ ID NO: 6238230 - DNA, 20 bp, Homo sapiens
gagaaggccccagggcagcg

SEQ ID NO: 6238231 - DNA, 20 bp, Homo sapiens
gagaaggcctcccctgagga

SEQ ID NO: 6238232 - DNA, 12 bp, Homo sapiens
gagaaggcctgc

SEQ ID NO: 6238233 - DNA, 22 bp, Homo sapiens
gagaaggcctgccccccttccc

SEQ ID NO: 6238234 - DNA, 19 bp, Homo sapiens
gagaaggcctggtcagcag

SEQ ID NO: 6238235 - DNA, 12 bp, Homo sapiens
gagaaggcctta

SEQ ID NO: 6238236 - DNA, 16 bp, Homo sapiens
gagaaggctcagcctt

SEQ ID NO: 6238237 - DNA, 17 bp, Homo sapiens
gagaaggctggagaagg

SEQ ID NO: 6238238 - DNA, 15 bp, Homo sapiens
gagaagggcaggaga

SEQ ID NO: 6238239 - DNA, 21 bp, Homo sapiens
gagaagggcaggggtgtcctg

SEQ ID NO: 6238240 - DNA, 16 bp, Homo sapiens
gagaagggccagccct

SEQ ID NO: 6238241 - DNA, 20 bp, Homo sapiens
gagaagggctcagagaggac

SEQ ID NO: 6238242 - DNA, 16 bp, Homo sapiens
gagaagggcttttctt

SEQ ID NO: 6238243 - DNA, 18 bp, Homo sapiens
gagaaggggacttctctt

SEQ ID NO: 6238244 - DNA, 15 bp, Homo sapiens
gagaaggggaggagg

SEQ ID NO: 6238245 - DNA, 23 bp, Homo sapiens
gagaaggggcgggaatattgttt

SEQ ID NO: 6238246 - DNA, 20 bp, Homo sapiens
gagaaggggctttgtgacca

SEQ ID NO: 6238247 - DNA, 21 bp, Homo sapiens
gagaagggggacgtttctgga

SEQ ID NO: 6238248 - DNA, 19 bp, Homo sapiens
gagaagggggattggaggg

SEQ ID NO: 6238249 - DNA, 20 bp, Homo sapiens
gagaagggggctctgcccca

SEQ ID NO: 6238250 - DNA, 21 bp, Homo sapiens
gagaagggggctctgccccag

SEQ ID NO: 6238251 - DNA, 12 bp, Homo sapiens
gagaagggggtg

SEQ ID NO: 6238252 - DNA, 23 bp, Homo sapiens
gagaagggggtgacagtcctcca

SEQ ID NO: 6238253 - DNA, 23 bp, Homo sapiens
gagaagggtggatgacagggcag

SEQ ID NO: 6238254 - DNA, 20 bp, Homo sapiens
gagaagggttagacaagcct

SEQ ID NO: 6238255 - DNA, 21 bp, Homo sapiens
gagaagggttcagcccaacat

SEQ ID NO: 6238256 - DNA, 20 bp, Homo sapiens
gagaagggttctgccctgcc

SEQ ID NO: 6238257 - DNA, 15 bp, Homo sapiens
gagaaggtccttaat

SEQ ID NO: 6238258 - DNA, 16 bp, Homo sapiens
gagaaggtctccaagg

SEQ ID NO: 6238259 - DNA, 16 bp, Homo sapiens
gagaaggtctgtggtg

SEQ ID NO: 6238260 - DNA, 17 bp, Homo sapiens
gagaaggtgcctgccat

SEQ ID NO: 6238261 - DNA, 14 bp, Homo sapiens
gagaaggtgcttgg

SEQ ID NO: 6238262 - DNA, 20 bp, Homo sapiens
gagaaggttctgagctgtcc

SEQ ID NO: 6238263 - DNA, 21 bp, Homo sapiens
gagaagtaaattattttatgt

SEQ ID NO: 6238264 - DNA, 21 bp, Homo sapiens
gagaagtatccaattatgtga

SEQ ID NO: 6238265 - DNA, 23 bp, Homo sapiens
gagaagtatccaattatgtgaca

SEQ ID NO: 6238266 - DNA, 15 bp, Homo sapiens
gagaagtcacagggc

SEQ ID NO: 6238267 - DNA, 16 bp, Homo sapiens
gagaagtcacagggca

SEQ ID NO: 6238268 - DNA, 22 bp, Homo sapiens
gagaagtcactcacactggcca

SEQ ID NO: 6238269 - DNA, 21 bp, Homo sapiens
gagaagtcagttggagaaaat

SEQ ID NO: 6238270 - DNA, 22 bp, Homo sapiens
gagaagtctcagctaagctcac

SEQ ID NO: 6238271 - DNA, 18 bp, Homo sapiens
gagaagtcttctatttat

SEQ ID NO: 6238272 - DNA, 20 bp, Homo sapiens
gagaagtcttctatttattt

SEQ ID NO: 6238273 - DNA, 17 bp, Homo sapiens
gagaagtgaatgctggg

SEQ ID NO: 6238274 - DNA, 19 bp, Homo sapiens
gagaagtgacagggaagct

SEQ ID NO: 6238275 - DNA, 23 bp, Homo sapiens
gagaagtgacagggaagctacag

SEQ ID NO: 6238276 - DNA, 18 bp, Homo sapiens
gagaagtgacggttccta

SEQ ID NO: 6238277 - DNA, 15 bp, Homo sapiens
gagaagtgcccctgc

SEQ ID NO: 6238278 - DNA, 16 bp, Homo sapiens
gagaagtgcccctgct

SEQ ID NO: 6238279 - DNA, 20 bp, Homo sapiens
gagaagtgcccctgctgcct

SEQ ID NO: 6238280 - DNA, 15 bp, Homo sapiens
gagaagtgccttctc

SEQ ID NO: 6238281 - DNA, 15 bp, Homo sapiens
gagaagtgctccctg

SEQ ID NO: 6238282 - DNA, 12 bp, Homo sapiens
gagaagtgcttt

SEQ ID NO: 6238283 - DNA, 22 bp, Homo sapiens
gagaagtggggaccccacccct

SEQ ID NO: 6238284 - DNA, 14 bp, Homo sapiens
gagaagtgtgttct

SEQ ID NO: 6238285 - DNA, 23 bp, Homo sapiens
gagaagttaagcagcctttctgt

SEQ ID NO: 6238286 - DNA, 22 bp, Homo sapiens
gagaagttccttaggttttctt

SEQ ID NO: 6238287 - DNA, 17 bp, Homo sapiens
gagaagttctcaaagtt

SEQ ID NO: 6238288 - DNA, 18 bp, Homo sapiens
gagaagttctcaaagtta

SEQ ID NO: 6238289 - DNA, 20 bp, Homo sapiens
gagaagtttgtagccaggta

SEQ ID NO: 6238290 - DNA, 17 bp, Homo sapiens
gagaagttttgtacaga

SEQ ID NO: 6238291 - DNA, 20 bp, Homo sapiens
gagaataaaattcctatctc

SEQ ID NO: 6238292 - DNA, 18 bp, Homo sapiens
gagaataagaataataat

SEQ ID NO: 6238293 - DNA, 22 bp, Homo sapiens
gagaataagagaaagaaaatga

SEQ ID NO: 6238294 - DNA, 18 bp, Homo sapiens
gagaataattgtgtacaa

SEQ ID NO: 6238295 - DNA, 15 bp, Homo sapiens
gagaataatttttgt

SEQ ID NO: 6238296 - DNA, 23 bp, Homo sapiens
gagaatacaagatattatgtata

SEQ ID NO: 6238297 - DNA, 23 bp, Homo sapiens
gagaatacacatataaaaacaat

SEQ ID NO: 6238298 - DNA, 16 bp, Homo sapiens
gagaatactgccaaaa

SEQ ID NO: 6238299 - DNA, 16 bp, Homo sapiens
gagaatagagctgcca

SEQ ID NO: 6238300 - DNA, 18 bp, Homo sapiens
gagaatagagctgccact

SEQ ID NO: 6238301 - DNA, 20 bp, Homo sapiens
gagaatagagctgccactgg

SEQ ID NO: 6238302 - DNA, 24 bp, Homo sapiens
gagaatagcagagagccaaatctg

SEQ ID NO: 6238303 - DNA, 20 bp, Homo sapiens
gagaatagctttatcttggt

SEQ ID NO: 6238304 - DNA, 18 bp, Homo sapiens
gagaataggcagccccca

SEQ ID NO: 6238305 - DNA, 13 bp, Homo sapiens
gagaatataaaca

SEQ ID NO: 6238306 - DNA, 20 bp, Homo sapiens
gagaatataacatgaaatga

SEQ ID NO: 6238307 - DNA, 19 bp, Homo sapiens
gagaatatgtatgcctgca

SEQ ID NO: 6238308 - DNA, 16 bp, Homo sapiens
gagaatattcaaaatt

SEQ ID NO: 6238309 - DNA, 16 bp, Homo sapiens
gagaatatttcaaatg

SEQ ID NO: 6238310 - DNA, 13 bp, Homo sapiens
gagaatcaaagat

SEQ ID NO: 6238311 - DNA, 15 bp, Homo sapiens
gagaatcacaggctg

SEQ ID NO: 6238312 - DNA, 22 bp, Homo sapiens
gagaatcactgctccaggcctg

SEQ ID NO: 6238313 - DNA, 22 bp, Homo sapiens
gagaatcacttaagcctggaag

SEQ ID NO: 6238314 - DNA, 14 bp, Homo sapiens
gagaatcacttgaa

SEQ ID NO: 6238315 - DNA, 20 bp, Homo sapiens
gagaatcagatcatttcaaa

SEQ ID NO: 6238316 - DNA, 15 bp, Homo sapiens
gagaatcaggttgca

SEQ ID NO: 6238317 - DNA, 15 bp, Homo sapiens
gagaatcatgtttct

SEQ ID NO: 6238318 - DNA, 17 bp, Homo sapiens
gagaatcatgtttcttt

SEQ ID NO: 6238319 - DNA, 21 bp, Homo sapiens
gagaatccaagggttgagagc

SEQ ID NO: 6238320 - DNA, 17 bp, Homo sapiens
gagaatccacataaaag

SEQ ID NO: 6238321 - DNA, 17 bp, Homo sapiens
gagaatcgcttgaaccg

SEQ ID NO: 6238322 - DNA, 22 bp, Homo sapiens
gagaatctatatttaacaagat

SEQ ID NO: 6238323 - DNA, 17 bp, Homo sapiens
gcagtggcctggatgca

SEQ ID NO: 6238324 - DNA, 12 bp, Homo sapiens
gcagtggcctta

SEQ ID NO: 6238325 - DNA, 20 bp, Homo sapiens
gcagtggcgaaatccctgct

SEQ ID NO: 6238326 - DNA, 21 bp, Homo sapiens
gcagtggcgcaatctcgcctt

SEQ ID NO: 6238327 - DNA, 16 bp, Homo sapiens
gcagtggctcacgcct

SEQ ID NO: 6238328 - DNA, 16 bp, Homo sapiens
gcagtggctctcagag

SEQ ID NO: 6238329 - DNA, 17 bp, Homo sapiens
gcagtggctctcagagc

SEQ ID NO: 6238330 - DNA, 19 bp, Homo sapiens
gcagtggctggtccagggc

SEQ ID NO: 6238331 - DNA, 20 bp, Homo sapiens
gcagtggctggtccagggct

SEQ ID NO: 6238332 - DNA, 13 bp, Homo sapiens
gcagtggctgtga

SEQ ID NO: 6238333 - DNA, 16 bp, Homo sapiens
gcagtggctgtgaagg

SEQ ID NO: 6238334 - DNA, 15 bp, Homo sapiens
gcagtggcttttcat

SEQ ID NO: 6238335 - DNA, 21 bp, Homo sapiens
gcagtgggacagggcatggcc

SEQ ID NO: 6238336 - DNA, 18 bp, Homo sapiens
gcagtgggagctgcctgt

SEQ ID NO: 6238337 - DNA, 12 bp, Homo sapiens
gcagtgggcagg

SEQ ID NO: 6238338 - DNA, 17 bp, Homo sapiens
gcagtgggcaggtggcc

SEQ ID NO: 6238339 - DNA, 19 bp, Homo sapiens
gcagtgggccctggctctg

SEQ ID NO: 6238340 - DNA, 16 bp, Homo sapiens
gcagtgggcctggcca

SEQ ID NO: 6238341 - DNA, 17 bp, Homo sapiens
gcagtgggcctggccag

SEQ ID NO: 6238342 - DNA, 15 bp, Homo sapiens
gcagtggggctgggg

SEQ ID NO: 6238343 - DNA, 17 bp, Homo sapiens
gcagtggggtcaagctg

SEQ ID NO: 6238344 - DNA, 19 bp, Homo sapiens
gcagtggggtcaagctgag

SEQ ID NO: 6238345 - DNA, 18 bp, Homo sapiens
gcagtgggtcccacttcc

SEQ ID NO: 6238346 - DNA, 19 bp, Homo sapiens
gcagtgggtcccacttccc

SEQ ID NO: 6238347 - DNA, 22 bp, Homo sapiens
gcagtgggtcccacttcccctc

SEQ ID NO: 6238348 - DNA, 16 bp, Homo sapiens
gcagtgggtgggagct

SEQ ID NO: 6238349 - DNA, 14 bp, Homo sapiens
gcagtggtgcgatc

SEQ ID NO: 6238350 - DNA, 18 bp, Homo sapiens
gcagtggtgcgatctggg

SEQ ID NO: 6238351 - DNA, 19 bp, Homo sapiens
gcagtggtggttttctgtt

SEQ ID NO: 6238352 - DNA, 18 bp, Homo sapiens
gcagtggtgtggagaagc

SEQ ID NO: 6238353 - DNA, 14 bp, Homo sapiens
gcagtgtagatttt

SEQ ID NO: 6238354 - DNA, 17 bp, Homo sapiens
gcagtgtagttttcctt

SEQ ID NO: 6238355 - DNA, 15 bp, Homo sapiens
gcagtgtccagagac

SEQ ID NO: 6238356 - DNA, 20 bp, Homo sapiens
gcagtgtccagagacccctc

SEQ ID NO: 6238357 - DNA, 19 bp, Homo sapiens
gcagtgtccattatctgct

SEQ ID NO: 6238358 - DNA, 19 bp, Homo sapiens
gcagtgtcccctgccccag

SEQ ID NO: 6238359 - DNA, 20 bp, Homo sapiens
gcagtgtcccctgccccaga

SEQ ID NO: 6238360 - DNA, 21 bp, Homo sapiens
gcagtgtcccctgccccagag

SEQ ID NO: 6238361 - DNA, 17 bp, Homo sapiens
gcagtgtcgccgtccct

SEQ ID NO: 6238362 - DNA, 15 bp, Homo sapiens
gcagtgtctgtcagc

SEQ ID NO: 6238363 - DNA, 18 bp, Homo sapiens
gcagtgtctgtgttttga

SEQ ID NO: 6238364 - DNA, 16 bp, Homo sapiens
gcagtgtcttaaggag

SEQ ID NO: 6238365 - DNA, 23 bp, Homo sapiens
gcagtgtcttaaggagactggta

SEQ ID NO: 6238366 - DNA, 14 bp, Homo sapiens
gcagtgtcttccat

SEQ ID NO: 6238367 - DNA, 16 bp, Homo sapiens
gcagtgtcttccataa

SEQ ID NO: 6238368 - DNA, 20 bp, Homo sapiens
gcagtgtcttccataatgta

SEQ ID NO: 6238369 - DNA, 12 bp, Homo sapiens
gcagtgtgaaaa

SEQ ID NO: 6238370 - DNA, 13 bp, Homo sapiens
gcagtgtgaggac

SEQ ID NO: 6238371 - DNA, 21 bp, Homo sapiens
gcagtgtgaggccagggcaga

SEQ ID NO: 6238372 - DNA, 18 bp, Homo sapiens
gcagtgtgagggtgcagg

SEQ ID NO: 6238373 - DNA, 20 bp, Homo sapiens
gcagtgtgcactaaggggcc

SEQ ID NO: 6238374 - DNA, 14 bp, Homo sapiens
gcagtgtgcagtgg

SEQ ID NO: 6238375 - DNA, 12 bp, Homo sapiens
gcagtgtggagt

SEQ ID NO: 6238376 - DNA, 16 bp, Homo sapiens
gcagtgtggccaggct

SEQ ID NO: 6238377 - DNA, 17 bp, Homo sapiens
gcagtgtggccaggctg

SEQ ID NO: 6238378 - DNA, 18 bp, Homo sapiens
gcagtgtggcctcttggc

SEQ ID NO: 6238379 - DNA, 15 bp, Homo sapiens
gcagtgtggggaggg

SEQ ID NO: 6238380 - DNA, 20 bp, Homo sapiens
gcagtgtggttatgttccca

SEQ ID NO: 6238381 - DNA, 20 bp, Homo sapiens
gcagtgtgtcacactgagct

SEQ ID NO: 6238382 - DNA, 22 bp, Homo sapiens
gcagtgtgtccttggggcacag

SEQ ID NO: 6238383 - DNA, 16 bp, Homo sapiens
gcagtgtgtctcctgc

SEQ ID NO: 6238384 - DNA, 14 bp, Homo sapiens
gcagtgttaagata

SEQ ID NO: 6238385 - DNA, 18 bp, Homo sapiens
gcagtgttacttgcaggt

SEQ ID NO: 6238386 - DNA, 19 bp, Homo sapiens
gcagtgttcctcaccaata

SEQ ID NO: 6238387 - DNA, 17 bp, Homo sapiens
gcagtgttcgcttggct

SEQ ID NO: 6238388 - DNA, 19 bp, Homo sapiens
gcagtgttctctctgaatg

SEQ ID NO: 6238389 - DNA, 15 bp, Homo sapiens
gcagtgttgcgtttt

SEQ ID NO: 6238390 - DNA, 18 bp, Homo sapiens
gcagtgttgcgtttttcc

SEQ ID NO: 6238391 - DNA, 19 bp, Homo sapiens
gcagtgttgctcagctcct

SEQ ID NO: 6238392 - DNA, 22 bp, Homo sapiens
gcagtgtttcccgccttgggct

SEQ ID NO: 6238393 - DNA, 13 bp, Homo sapiens
gcagtgtttgtat

SEQ ID NO: 6238394 - DNA, 15 bp, Homo sapiens
gcagtgttttgcaag

SEQ ID NO: 6238395 - DNA, 14 bp, Homo sapiens
gcagttaacatctg

SEQ ID NO: 6238396 - DNA, 23 bp, Homo sapiens
gcagttaagccccctcctcaccc

SEQ ID NO: 6238397 - DNA, 21 bp, Homo sapiens
gcagttaatggggtagaggag

SEQ ID NO: 6238398 - DNA, 13 bp, Homo sapiens
gcagttacaaatt

SEQ ID NO: 6238399 - DNA, 20 bp, Homo sapiens
gcagttacaaattataatgt

SEQ ID NO: 6238400 - DNA, 21 bp, Homo sapiens
gcagttacatgcatacttcaa

SEQ ID NO: 6238401 - DNA, 22 bp, Homo sapiens
gcagttacattctgctcccagc

SEQ ID NO: 6238402 - DNA, 20 bp, Homo sapiens
gcagttaccacagcaactga

SEQ ID NO: 6238403 - DNA, 20 bp, Homo sapiens
gcagttactccctacactga

SEQ ID NO: 6238404 - DNA, 22 bp, Homo sapiens
gcagttactccctacactgatg

SEQ ID NO: 6238405 - DNA, 23 bp, Homo sapiens
gcagttactccctacactgatgc

SEQ ID NO: 6238406 - DNA, 17 bp, Homo sapiens
gcagttagactcaaaga

SEQ ID NO: 6238407 - DNA, 15 bp, Homo sapiens
gcagttagagcagcc

SEQ ID NO: 6238408 - DNA, 18 bp, Homo sapiens
gcagttagagcagcctcg

SEQ ID NO: 6238409 - DNA, 18 bp, Homo sapiens
gcagttagcacagaggat

SEQ ID NO: 6238410 - DNA, 22 bp, Homo sapiens
gcagttagccccagaaaatgaa

SEQ ID NO: 6238411 - DNA, 17 bp, Homo sapiens
gcagttagctgaagaat

SEQ ID NO: 6238412 - DNA, 18 bp, Homo sapiens
gcagttataacagatgtg

SEQ ID NO: 6238413 - DNA, 14 bp, Homo sapiens
gcagttatagaaaa

SEQ ID NO: 6238414 - DNA, 20 bp, Homo sapiens
gcagttatggtgatgactta

SEQ ID NO: 6238415 - DNA, 22 bp, Homo sapiens
gcagttatgtgacctcacgtgc

SEQ ID NO: 6238416 - DNA, 23 bp, Homo sapiens
gcagttatgtgacctcacgtgca

SEQ ID NO: 6238417 - DNA, 20 bp, Homo sapiens
gcagttatttaccagaagtt

SEQ ID NO: 6238418 - DNA, 20 bp, Homo sapiens
gcagttcacaaaaaaatgtt

SEQ ID NO: 6238419 - DNA, 14 bp, Homo sapiens
gcagttcacttcct

SEQ ID NO: 6238420 - DNA, 21 bp, Homo sapiens
gcagttcagaatggcagtcct

SEQ ID NO: 6238421 - DNA, 18 bp, Homo sapiens
gcagttcagagctgccct

SEQ ID NO: 6238422 - DNA, 16 bp, Homo sapiens
gcagttcatactgaat

SEQ ID NO: 6238423 - DNA, 23 bp, Homo sapiens
gcagttcattctaccaagctgtc

SEQ ID NO: 6238424 - DNA, 15 bp, Homo sapiens
gcagttccatcaggt

SEQ ID NO: 6238425 - DNA, 19 bp, Homo sapiens
gcagttccatgaagacacg

SEQ ID NO: 6238426 - DNA, 19 bp, Homo sapiens
gcagttcccctggagcccc

SEQ ID NO: 6238427 - DNA, 12 bp, Homo sapiens
gcagttcctggc

SEQ ID NO: 6238428 - DNA, 17 bp, Homo sapiens
gcagttcctgtcccaca

SEQ ID NO: 6238429 - DNA, 18 bp, Homo sapiens
gcagttcgaccagccagg

SEQ ID NO: 6238430 - DNA, 19 bp, Homo sapiens
gcagttcgcagccaccctg

SEQ ID NO: 6238431 - DNA, 20 bp, Homo sapiens
gcagttcgcagccaccctga

SEQ ID NO: 6238432 - DNA, 16 bp, Homo sapiens
gcagttctagtttgca

SEQ ID NO: 6238433 - DNA, 18 bp, Homo sapiens
gcagttctcactcctagg

SEQ ID NO: 6238434 - DNA, 15 bp, Homo sapiens
gcagttctcccaggg

SEQ ID NO: 6238435 - DNA, 21 bp, Homo sapiens
gcagttctcctgcctcagcct

SEQ ID NO: 6238436 - DNA, 15 bp, Homo sapiens
gcagttctctcgaat

SEQ ID NO: 6238437 - DNA, 13 bp, Homo sapiens
gcagttctctgcc

SEQ ID NO: 6238438 - DNA, 14 bp, Homo sapiens
gcagttctgaagaa

SEQ ID NO: 6238439 - DNA, 15 bp, Homo sapiens
gcagttctgatgctt

SEQ ID NO: 6238440 - DNA, 19 bp, Homo sapiens
gcagttctgcaaatagaaa

SEQ ID NO: 6238441 - DNA, 19 bp, Homo sapiens
gcagttctgggtgctccct

SEQ ID NO: 6238442 - DNA, 16 bp, Homo sapiens
gcagttcttaacccag

SEQ ID NO: 6238443 - DNA, 15 bp, Homo sapiens
gcagttgaacagact

SEQ ID NO: 6238444 - DNA, 15 bp, Homo sapiens
gcagttgaacagagg

SEQ ID NO: 6238445 - DNA, 22 bp, Homo sapiens
gcagttgacaggtacttggagg

SEQ ID NO: 6238446 - DNA, 16 bp, Homo sapiens
gcagttgactttctcc

SEQ ID NO: 6238447 - DNA, 18 bp, Homo sapiens
gcagttgataagaggaat

SEQ ID NO: 6238448 - DNA, 16 bp, Homo sapiens
gcagttgcaataaact

SEQ ID NO: 6238449 - DNA, 12 bp, Homo sapiens
gcagttgcagtg

SEQ ID NO: 6238450 - DNA, 13 bp, Homo sapiens
gcagttgcttgtg

SEQ ID NO: 6238451 - DNA, 16 bp, Homo sapiens
gcagttggcagaaagg

SEQ ID NO: 6238452 - DNA, 15 bp, Homo sapiens
gcagttgggagtgag

SEQ ID NO: 6238453 - DNA, 21 bp, Homo sapiens
gcagttggggccctcttgcca

SEQ ID NO: 6238454 - DNA, 14 bp, Homo sapiens
gcagttgtgatttc

SEQ ID NO: 6238455 - DNA, 13 bp, Homo sapiens
gcagttgttaagt

SEQ ID NO: 6238456 - DNA, 18 bp, Homo sapiens
gcagttgttgaggggagg

SEQ ID NO: 6238457 - DNA, 18 bp, Homo sapiens
gcagtttaagatgacact

SEQ ID NO: 6238458 - DNA, 13 bp, Homo sapiens
gcagtttacagta

SEQ ID NO: 6238459 - DNA, 15 bp, Homo sapiens
gcagtttacagtatt

SEQ ID NO: 6238460 - DNA, 16 bp, Homo sapiens
gcagtttacagtattt

SEQ ID NO: 6238461 - DNA, 15 bp, Homo sapiens
gcagtttatcattca

SEQ ID NO: 6238462 - DNA, 13 bp, Homo sapiens
gcagtttattata

SEQ ID NO: 6238463 - DNA, 17 bp, Homo sapiens
gcagtttcaataaagtt

SEQ ID NO: 6238464 - DNA, 20 bp, Homo sapiens
gcagtttcaataaagtttga

SEQ ID NO: 6238465 - DNA, 12 bp, Homo sapiens
gcagtttcagat

SEQ ID NO: 6238466 - DNA, 17 bp, Homo sapiens
gcagtttcagataaatc

SEQ ID NO: 6238467 - DNA, 21 bp, Homo sapiens
gcagtttcagataaatcatgg

SEQ ID NO: 6238468 - DNA, 14 bp, Homo sapiens
gcagtttccagaga

SEQ ID NO: 6238469 - DNA, 12 bp, Homo sapiens
gcagtttcccag

SEQ ID NO: 6238470 - DNA, 12 bp, Homo sapiens
gcagtttcctca

SEQ ID NO: 6238471 - DNA, 16 bp, Homo sapiens
gcagtttcctcagtga

SEQ ID NO: 6238472 - DNA, 14 bp, Homo sapiens
gcagtttcctggaa

SEQ ID NO: 6238473 - DNA, 15 bp, Homo sapiens
gcagtttcctggaaa

SEQ ID NO: 6238474 - DNA, 16 bp, Homo sapiens
gcagtttctgtcctgc

SEQ ID NO: 6238475 - DNA, 17 bp, Homo sapiens
gcagtttcttcatctca

SEQ ID NO: 6238476 - DNA, 18 bp, Homo sapiens
gcagtttgaaattctgaa

SEQ ID NO: 6238477 - DNA, 21 bp, Homo sapiens
gcagtttgaaattctgaattt

SEQ ID NO: 6238478 - DNA, 17 bp, Homo sapiens
gcagtttgagcttgctg

SEQ ID NO: 6238479 - DNA, 19 bp, Homo sapiens
gcagtttgagcttgctgga

SEQ ID NO: 6238480 - DNA, 16 bp, Homo sapiens
gcagtttgcctctgca

SEQ ID NO: 6238481 - DNA, 22 bp, Homo sapiens
gcagtttggccctggagccagg

SEQ ID NO: 6238482 - DNA, 20 bp, Homo sapiens
gcagtttggtatgaaacaaa

SEQ ID NO: 6238483 - DNA, 16 bp, Homo sapiens
gcagttttgaaacctt

SEQ ID NO: 6238484 - DNA, 20 bp, Homo sapiens
gcagttttgacatcagccag

SEQ ID NO: 6238485 - DNA, 11 bp, Homo sapiens
gcagtttttaa

SEQ ID NO: 6238486 - DNA, 19 bp, Homo sapiens
gcagtttttataatagatt

SEQ ID NO: 6238487 - DNA, 23 bp, Homo sapiens
gcagtttttcaggagcgcaagat

SEQ ID NO: 6238488 - DNA, 14 bp, Homo sapiens
gcagtttttgaaag

SEQ ID NO: 6238489 - DNA, 20 bp, Homo sapiens
gcagtttttgaaagacaaaa

SEQ ID NO: 6238490 - DNA, 18 bp, Homo sapiens
gcataaaaattgaattcg

SEQ ID NO: 6238491 - DNA, 17 bp, Homo sapiens
gcataaaacctaaaggt

SEQ ID NO: 6238492 - DNA, 15 bp, Homo sapiens
gcataaaattggatt

SEQ ID NO: 6238493 - DNA, 15 bp, Homo sapiens
gcataaacaacagta

SEQ ID NO: 6238494 - DNA, 18 bp, Homo sapiens
gcataaaccaatgagctg

SEQ ID NO: 6238495 - DNA, 15 bp, Homo sapiens
gcataaacttcatct

SEQ ID NO: 6238496 - DNA, 16 bp, Homo sapiens
gcataaacttcatctt

SEQ ID NO: 6238497 - DNA, 19 bp, Homo sapiens
gcataaacttcatcttcaa

SEQ ID NO: 6238498 - DNA, 12 bp, Homo sapiens
gcataaagggcc

SEQ ID NO: 6238499 - DNA, 18 bp, Homo sapiens
gcataaataaaactgaat

SEQ ID NO: 6238500 - DNA, 15 bp, Homo sapiens
gcataaatatgcagt

SEQ ID NO: 6238501 - DNA, 14 bp, Homo sapiens
gcataaatctgaag

SEQ ID NO: 6238502 - DNA, 18 bp, Homo sapiens
gagaatctcaagattcta

SEQ ID NO: 6238503 - DNA, 14 bp, Homo sapiens
gagaatctcttggg

SEQ ID NO: 6238504 - DNA, 14 bp, Homo sapiens
gagaatctgagggc

SEQ ID NO: 6238505 - DNA, 17 bp, Homo sapiens
gagaatctggctcctgt

SEQ ID NO: 6238506 - DNA, 18 bp, Homo sapiens
gagaatctggctcctgtt

SEQ ID NO: 6238507 - DNA, 22 bp, Homo sapiens
gagaatctggctcctgtttcca

SEQ ID NO: 6238508 - DNA, 14 bp, Homo sapiens
gagaatctgggggt

SEQ ID NO: 6238509 - DNA, 15 bp, Homo sapiens
gagaatctgggggtg

SEQ ID NO: 6238510 - DNA, 20 bp, Homo sapiens
gagaatcttaaggtctaact

SEQ ID NO: 6238511 - DNA, 13 bp, Homo sapiens
gagaatctttatt

SEQ ID NO: 6238512 - DNA, 15 bp, Homo sapiens
gagaatgaaagggcc

SEQ ID NO: 6238513 - DNA, 18 bp, Homo sapiens
gagaatgaccctgtcaag

SEQ ID NO: 6238514 - DNA, 14 bp, Homo sapiens
gagaatgagaaatg

SEQ ID NO: 6238515 - DNA, 20 bp, Homo sapiens
gagaatgagaagggaaggcc

SEQ ID NO: 6238516 - DNA, 17 bp, Homo sapiens
gagaatgagagacacac

SEQ ID NO: 6238517 - DNA, 20 bp, Homo sapiens
gagaatgagagacacactga

SEQ ID NO: 6238518 - DNA, 18 bp, Homo sapiens
gagaatgagagcgacaca

SEQ ID NO: 6238519 - DNA, 23 bp, Homo sapiens
gagaatgatagtaataggataca

SEQ ID NO: 6238520 - DNA, 23 bp, Homo sapiens
gagaatgcacaaacagaggccgc

SEQ ID NO: 6238521 - DNA, 20 bp, Homo sapiens
gagaatgcccttctccttat

SEQ ID NO: 6238522 - DNA, 23 bp, Homo sapiens
gagaatgctaatggttgggttga

SEQ ID NO: 6238523 - DNA, 17 bp, Homo sapiens
gagaatgctggcaaagg

SEQ ID NO: 6238524 - DNA, 15 bp, Homo sapiens
gagaatggaaaacag

SEQ ID NO: 6238525 - DNA, 22 bp, Homo sapiens
gagaatggaaaccacaactttt

SEQ ID NO: 6238526 - DNA, 18 bp, Homo sapiens
gagaatggcatggcagga

SEQ ID NO: 6238527 - DNA, 17 bp, Homo sapiens
gagaatggcctgagaca

SEQ ID NO: 6238528 - DNA, 20 bp, Homo sapiens
gagaatggcctggagcaggc

SEQ ID NO: 6238529 - DNA, 13 bp, Homo sapiens
gagaatggctctg

SEQ ID NO: 6238530 - DNA, 18 bp, Homo sapiens
gagaatgggacgaggaca

SEQ ID NO: 6238531 - DNA, 19 bp, Homo sapiens
gagaatgggacgaggacat

SEQ ID NO: 6238532 - DNA, 16 bp, Homo sapiens
gagaatgggtttactc

SEQ ID NO: 6238533 - DNA, 17 bp, Homo sapiens
gagaatggtgctgttta

SEQ ID NO: 6238534 - DNA, 20 bp, Homo sapiens
gagaatggtgtgaacccggg

SEQ ID NO: 6238535 - DNA, 21 bp, Homo sapiens
gagaatggtgtgaacccggga

SEQ ID NO: 6238536 - DNA, 15 bp, Homo sapiens
gagaatgtaagaact

SEQ ID NO: 6238537 - DNA, 14 bp, Homo sapiens
gagaatgtatttcc

SEQ ID NO: 6238538 - DNA, 17 bp, Homo sapiens
gagaatgtgcagtgtct

SEQ ID NO: 6238539 - DNA, 16 bp, Homo sapiens
gagaatgtgccatgta

SEQ ID NO: 6238540 - DNA, 19 bp, Homo sapiens
gagaatgtgccatgtataa

SEQ ID NO: 6238541 - DNA, 18 bp, Homo sapiens
gagaatgttaccagactt

SEQ ID NO: 6238542 - DNA, 17 bp, Homo sapiens
gagaatgttatagtgaa

SEQ ID NO: 6238543 - DNA, 12 bp, Homo sapiens
gagaattaaaat

SEQ ID NO: 6238544 - DNA, 23 bp, Homo sapiens
gagaattaagttttaaataaacc

SEQ ID NO: 6238545 - DNA, 15 bp, Homo sapiens
gagaattacagaaaa

SEQ ID NO: 6238546 - DNA, 21 bp, Homo sapiens
gagaattacagaaaatttgca

SEQ ID NO: 6238547 - DNA, 22 bp, Homo sapiens
gagaattattacatctttatta

SEQ ID NO: 6238548 - DNA, 22 bp, Homo sapiens
gagaattccagttgtatttgaa

SEQ ID NO: 6238549 - DNA, 13 bp, Homo sapiens
gagaattgcctct

SEQ ID NO: 6238550 - DNA, 18 bp, Homo sapiens
gagaattgcttgaaccca

SEQ ID NO: 6238551 - DNA, 16 bp, Homo sapiens
gagaattgtagataat

SEQ ID NO: 6238552 - DNA, 15 bp, Homo sapiens
gagaattgtatcatt

SEQ ID NO: 6238553 - DNA, 18 bp, Homo sapiens
gagaattgtatgtcatgt

SEQ ID NO: 6238554 - DNA, 18 bp, Homo sapiens
gagaatttaatttttaaa

SEQ ID NO: 6238555 - DNA, 20 bp, Homo sapiens
gagaatttctactgagcgag

SEQ ID NO: 6238556 - DNA, 21 bp, Homo sapiens
gagaatttgtgtggatattta

SEQ ID NO: 6238557 - DNA, 16 bp, Homo sapiens
gagaattttaaattat

SEQ ID NO: 6238558 - DNA, 15 bp, Homo sapiens
gagaattttgtttca

SEQ ID NO: 6238559 - DNA, 15 bp, Homo sapiens
gagacaaaaattatc

SEQ ID NO: 6238560 - DNA, 20 bp, Homo sapiens
gagacaaaaattatctattt

SEQ ID NO: 6238561 - DNA, 18 bp, Homo sapiens
gagacaaaatatttccca

SEQ ID NO: 6238562 - DNA, 17 bp, Homo sapiens
gagacaaacagcccttc

SEQ ID NO: 6238563 - DNA, 16 bp, Homo sapiens
gagacaaagcaggagt

SEQ ID NO: 6238564 - DNA, 19 bp, Homo sapiens
gagacaaagcaggagtgga

SEQ ID NO: 6238565 - DNA, 11 bp, Homo sapiens
gagacaaagct

SEQ ID NO: 6238566 - DNA, 15 bp, Homo sapiens
gagacaaatctttaa

SEQ ID NO: 6238567 - DNA, 18 bp, Homo sapiens
gagacaaatctttaagaa

SEQ ID NO: 6238568 - DNA, 22 bp, Homo sapiens
gagacaacacacacacacacaa

SEQ ID NO: 6238569 - DNA, 16 bp, Homo sapiens
gagacaacagcacaca

SEQ ID NO: 6238570 - DNA, 20 bp, Homo sapiens
gagacaacagcacacaggca

SEQ ID NO: 6238571 - DNA, 21 bp, Homo sapiens
gagacaactatcaattcttga

SEQ ID NO: 6238572 - DNA, 22 bp, Homo sapiens
gagacaactggacaagatttcc

SEQ ID NO: 6238573 - DNA, 14 bp, Homo sapiens
gagacaacttgctc

SEQ ID NO: 6238574 - DNA, 15 bp, Homo sapiens
gagacaagagggaat

SEQ ID NO: 6238575 - DNA, 23 bp, Homo sapiens
gagacaagagggaatagtataga

SEQ ID NO: 6238576 - DNA, 15 bp, Homo sapiens
gagacaagccctggc

SEQ ID NO: 6238577 - DNA, 19 bp, Homo sapiens
gagacaagccctggcaaca

SEQ ID NO: 6238578 - DNA, 16 bp, Homo sapiens
gagacaataaaacatt

SEQ ID NO: 6238579 - DNA, 16 bp, Homo sapiens
gagacaataaacagct

SEQ ID NO: 6238580 - DNA, 17 bp, Homo sapiens
gagacaatcacagctcc

SEQ ID NO: 6238581 - DNA, 19 bp, Homo sapiens
gagacaatcacagctcctc

SEQ ID NO: 6238582 - DNA, 14 bp, Homo sapiens
gagacaatctaaaa

SEQ ID NO: 6238583 - DNA, 14 bp, Homo sapiens
gagacaatgtctgc

SEQ ID NO: 6238584 - DNA, 22 bp, Homo sapiens
gagacaatgtctgcagccctga

SEQ ID NO: 6238585 - DNA, 16 bp, Homo sapiens
gagacaatgttttctt

SEQ ID NO: 6238586 - DNA, 13 bp, Homo sapiens
gagacaattacaa

SEQ ID NO: 6238587 - DNA, 20 bp, Homo sapiens
gagacacaacaactcctagg

SEQ ID NO: 6238588 - DNA, 17 bp, Homo sapiens
gagacacaagccttcgg

SEQ ID NO: 6238589 - DNA, 23 bp, Homo sapiens
gagacacacaattcattggctcc

SEQ ID NO: 6238590 - DNA, 11 bp, Homo sapiens
gagacacagat

SEQ ID NO: 6238591 - DNA, 18 bp, Homo sapiens
gagacacaggatgaagca

SEQ ID NO: 6238592 - DNA, 18 bp, Homo sapiens
gagacacatacagagtgg

SEQ ID NO: 6238593 - DNA, 15 bp, Homo sapiens
gagacacattgcctt

SEQ ID NO: 6238594 - DNA, 16 bp, Homo sapiens
gagacaccatcctgag

SEQ ID NO: 6238595 - DNA, 21 bp, Homo sapiens
gagacaccctaactcttgctc

SEQ ID NO: 6238596 - DNA, 18 bp, Homo sapiens
gagacaccctctgggggt

SEQ ID NO: 6238597 - DNA, 22 bp, Homo sapiens
gagacaccctctgggggtcctc

SEQ ID NO: 6238598 - DNA, 13 bp, Homo sapiens
gagacacctcaga

SEQ ID NO: 6238599 - DNA, 21 bp, Homo sapiens
gagacacctcagagccccgca

SEQ ID NO: 6238600 - DNA, 13 bp, Homo sapiens
gagacacctgcac

SEQ ID NO: 6238601 - DNA, 15 bp, Homo sapiens
gagacacctgcacct

SEQ ID NO: 6238602 - DNA, 17 bp, Homo sapiens
gagacacctgcacctcc

SEQ ID NO: 6238603 - DNA, 19 bp, Homo sapiens
gagacacgacagcacacac

SEQ ID NO: 6238604 - DNA, 22 bp, Homo sapiens
gagacacgacagcacacacagt

SEQ ID NO: 6238605 - DNA, 16 bp, Homo sapiens
gagacacggagcccag

SEQ ID NO: 6238606 - DNA, 21 bp, Homo sapiens
gagacactcagaccagagaag

SEQ ID NO: 6238607 - DNA, 15 bp, Homo sapiens
gagacactcccaggg

SEQ ID NO: 6238608 - DNA, 18 bp, Homo sapiens
gagacactgagccagtct

SEQ ID NO: 6238609 - DNA, 14 bp, Homo sapiens
gagacactggtctc

SEQ ID NO: 6238610 - DNA, 20 bp, Homo sapiens
gagacactggtctcagagga

SEQ ID NO: 6238611 - DNA, 14 bp, Homo sapiens
gagacactgtctct

SEQ ID NO: 6238612 - DNA, 16 bp, Homo sapiens
gagacactgttgataa

SEQ ID NO: 6238613 - DNA, 18 bp, Homo sapiens
gagacagaaacagagaga

SEQ ID NO: 6238614 - DNA, 21 bp, Homo sapiens
gagacagaaagcctccgctgg

SEQ ID NO: 6238615 - DNA, 15 bp, Homo sapiens
gagacagaagcctgg

SEQ ID NO: 6238616 - DNA, 16 bp, Homo sapiens
gagacagaatgtatct

SEQ ID NO: 6238617 - DNA, 20 bp, Homo sapiens
gagacagaatgtatctgtga

SEQ ID NO: 6238618 - DNA, 21 bp, Homo sapiens
gagacagaatgtatctgtgaa

SEQ ID NO: 6238619 - DNA, 13 bp, Homo sapiens
gagacagaccact

SEQ ID NO: 6238620 - DNA, 21 bp, Homo sapiens
gagacagaccacttgccacgc

SEQ ID NO: 6238621 - DNA, 19 bp, Homo sapiens
gagacagaccccttggctt

SEQ ID NO: 6238622 - DNA, 15 bp, Homo sapiens
gagacagaggaaagg

SEQ ID NO: 6238623 - DNA, 17 bp, Homo sapiens
gagacagagtctcgctc

SEQ ID NO: 6238624 - DNA, 18 bp, Homo sapiens
gagacagagtcttggtct

SEQ ID NO: 6238625 - DNA, 18 bp, Homo sapiens
gagacagagtgctgaggg

SEQ ID NO: 6238626 - DNA, 17 bp, Homo sapiens
gagacagatgctggtgg

SEQ ID NO: 6238627 - DNA, 12 bp, Homo sapiens
gagacagcaagt

SEQ ID NO: 6238628 - DNA, 19 bp, Homo sapiens
gagacagcaattgtagaca

SEQ ID NO: 6238629 - DNA, 13 bp, Homo sapiens
gagacagcacagg

SEQ ID NO: 6238630 - DNA, 16 bp, Homo sapiens
gagacagcacaggcag

SEQ ID NO: 6238631 - DNA, 22 bp, Homo sapiens
gagacagcacaggcagccccac

SEQ ID NO: 6238632 - DNA, 11 bp, Homo sapiens
gagacagcagc

SEQ ID NO: 6238633 - DNA, 14 bp, Homo sapiens
gagacagcagcctg

SEQ ID NO: 6238634 - DNA, 15 bp, Homo sapiens
gagacagcagcctgt

SEQ ID NO: 6238635 - DNA, 17 bp, Homo sapiens
gagacagcagcctgtat

SEQ ID NO: 6238636 - DNA, 18 bp, Homo sapiens
gagacagcagcctgtatg

SEQ ID NO: 6238637 - DNA, 20 bp, Homo sapiens
gagacagcagtttccagaga

SEQ ID NO: 6238638 - DNA, 22 bp, Homo sapiens
gagacagcagtttccagagagt

SEQ ID NO: 6238639 - DNA, 12 bp, Homo sapiens
gagacagccagg

SEQ ID NO: 6238640 - DNA, 23 bp, Homo sapiens
gagacagccaggtggcacctgca

SEQ ID NO: 6238641 - DNA, 15 bp, Homo sapiens
gagacagccccagag

SEQ ID NO: 6238642 - DNA, 18 bp, Homo sapiens
gagacagccccagagcag

SEQ ID NO: 6238643 - DNA, 14 bp, Homo sapiens
gagacagcccgggc

SEQ ID NO: 6238644 - DNA, 20 bp, Homo sapiens
gagacagcccgggctctgcc

SEQ ID NO: 6238645 - DNA, 22 bp, Homo sapiens
gagacagcccgggctctgcctc

SEQ ID NO: 6238646 - DNA, 24 bp, Homo sapiens
gagacagcccgggctctgcctccc

SEQ ID NO: 6238647 - DNA, 14 bp, Homo sapiens
gagacagccctgcc

SEQ ID NO: 6238648 - DNA, 17 bp, Homo sapiens
gagacagccctgcctat

SEQ ID NO: 6238649 - DNA, 18 bp, Homo sapiens
gagacagcgcgagtagca

SEQ ID NO: 6238650 - DNA, 17 bp, Homo sapiens
gagacagcggtcccagg

SEQ ID NO: 6238651 - DNA, 13 bp, Homo sapiens
gagacagctctgc

SEQ ID NO: 6238652 - DNA, 15 bp, Homo sapiens
gagacagcttctctg

SEQ ID NO: 6238653 - DNA, 16 bp, Homo sapiens
gagacagcttctctgc

SEQ ID NO: 6238654 - DNA, 16 bp, Homo sapiens
gagacaggaagcctca

SEQ ID NO: 6238655 - DNA, 19 bp, Homo sapiens
gagacaggacagaatgtgt

SEQ ID NO: 6238656 - DNA, 16 bp, Homo sapiens
gagacaggacctgact

SEQ ID NO: 6238657 - DNA, 16 bp, Homo sapiens
gagacaggagcctagc

SEQ ID NO: 6238658 - DNA, 12 bp, Homo sapiens
gagacaggcaga

SEQ ID NO: 6238659 - DNA, 13 bp, Homo sapiens
gagacaggcagcc

SEQ ID NO: 6238660 - DNA, 21 bp, Homo sapiens
gagacaggcctttccctgccg

SEQ ID NO: 6238661 - DNA, 23 bp, Homo sapiens
gagacagggcccgggcccaggca

SEQ ID NO: 6238662 - DNA, 17 bp, Homo sapiens
gagacagggctgctccc

SEQ ID NO: 6238663 - DNA, 12 bp, Homo sapiens
gagacagggtct

SEQ ID NO: 6238664 - DNA, 13 bp, Homo sapiens
gagacagggtctc

SEQ ID NO: 6238665 - DNA, 19 bp, Homo sapiens
gagacagggtctcgctctg

SEQ ID NO: 6238666 - DNA, 12 bp, Homo sapiens
gagacagggttt

SEQ ID NO: 6238667 - DNA, 22 bp, Homo sapiens
gagacaggtgcctaacctggga

SEQ ID NO: 6238668 - DNA, 19 bp, Homo sapiens
gagacaggtgcctggggct

SEQ ID NO: 6238669 - DNA, 23 bp, Homo sapiens
gagacaggtgcctggggctggct

SEQ ID NO: 6238670 - DNA, 13 bp, Homo sapiens
gagacagtccagt

SEQ ID NO: 6238671 - DNA, 17 bp, Homo sapiens
gagacagtcctttccca

SEQ ID NO: 6238672 - DNA, 15 bp, Homo sapiens
gagacagtgggaaat

SEQ ID NO: 6238673 - DNA, 16 bp, Homo sapiens
gagacagtgggaaata

SEQ ID NO: 6238674 - DNA, 13 bp, Homo sapiens
gagacagtggggg

SEQ ID NO: 6238675 - DNA, 12 bp, Homo sapiens
gagacagtgttt

SEQ ID NO: 6238676 - DNA, 13 bp, Homo sapiens
gagacagtgtttc

SEQ ID NO: 6238677 - DNA, 17 bp, Homo sapiens
gagacagttatttatag

SEQ ID NO: 6238678 - DNA, 15 bp, Homo sapiens
gagacagttctctgt

SEQ ID NO: 6238679 - DNA, 17 bp, Homo sapiens
gagacagttgagagcgg

SEQ ID NO: 6238680 - DNA, 21 bp, Homo sapiens
gagacagtttcttagcttttt

SEQ ID NO: 6238681 - DNA, 14 bp, Homo sapiens
gcataaatgggaac

SEQ ID NO: 6238682 - DNA, 23 bp, Homo sapiens
gcataacaaaggcaagactctgc

SEQ ID NO: 6238683 - DNA, 16 bp, Homo sapiens
gcataacaaattctga

SEQ ID NO: 6238684 - DNA, 17 bp, Homo sapiens
gcataacaattcctcta

SEQ ID NO: 6238685 - DNA, 13 bp, Homo sapiens
gcataacacacta

SEQ ID NO: 6238686 - DNA, 23 bp, Homo sapiens
gcataacaccaatcccagggctg

SEQ ID NO: 6238687 - DNA, 16 bp, Homo sapiens
gcataactaaaattaa

SEQ ID NO: 6238688 - DNA, 16 bp, Homo sapiens
gcataactaggattat

SEQ ID NO: 6238689 - DNA, 14 bp, Homo sapiens
gcataactgacaaa

SEQ ID NO: 6238690 - DNA, 15 bp, Homo sapiens
gcataactgacaaat

SEQ ID NO: 6238691 - DNA, 15 bp, Homo sapiens
gcataactgtagctc

SEQ ID NO: 6238692 - DNA, 13 bp, Homo sapiens
gcataagaaatgt

SEQ ID NO: 6238693 - DNA, 16 bp, Homo sapiens
gcataagattaaagga

SEQ ID NO: 6238694 - DNA, 22 bp, Homo sapiens
gcataagcctcaggcctggccc

SEQ ID NO: 6238695 - DNA, 13 bp, Homo sapiens
gcataagcttttt

SEQ ID NO: 6238696 - DNA, 22 bp, Homo sapiens
gcataagtcctctagtgaatgt

SEQ ID NO: 6238697 - DNA, 16 bp, Homo sapiens
gcataagtggacccag

SEQ ID NO: 6238698 - DNA, 11 bp, Homo sapiens
gcataataaat

SEQ ID NO: 6238699 - DNA, 18 bp, Homo sapiens
gcataataagctaaagag

SEQ ID NO: 6238700 - DNA, 19 bp, Homo sapiens
gcataatactaatttattg

SEQ ID NO: 6238701 - DNA, 20 bp, Homo sapiens
gcataatactaatttattgc

SEQ ID NO: 6238702 - DNA, 16 bp, Homo sapiens
gcataatagtcaattt

SEQ ID NO: 6238703 - DNA, 14 bp, Homo sapiens
gcataatctgaaaa

SEQ ID NO: 6238704 - DNA, 17 bp, Homo sapiens
gcataatctgaaaacat

SEQ ID NO: 6238705 - DNA, 12 bp, Homo sapiens
gcataatgcttt

SEQ ID NO: 6238706 - DNA, 20 bp, Homo sapiens
gcataatgctttggaaaaat

SEQ ID NO: 6238707 - DNA, 16 bp, Homo sapiens
gcataatttaaaaata

SEQ ID NO: 6238708 - DNA, 17 bp, Homo sapiens
gcataatttaaaaatat

SEQ ID NO: 6238709 - DNA, 15 bp, Homo sapiens
gcataatttgtctta

SEQ ID NO: 6238710 - DNA, 16 bp, Homo sapiens
gcatacaaaatattta

SEQ ID NO: 6238711 - DNA, 22 bp, Homo sapiens
gcatacaataaaagagctttat

SEQ ID NO: 6238712 - DNA, 23 bp, Homo sapiens
gcatacacacacacacacagcca

SEQ ID NO: 6238713 - DNA, 17 bp, Homo sapiens
gcatacacacatgccct

SEQ ID NO: 6238714 - DNA, 21 bp, Homo sapiens
gcatacacatgcactcagtgt

SEQ ID NO: 6238715 - DNA, 17 bp, Homo sapiens
gcatacaccaaacattt

SEQ ID NO: 6238716 - DNA, 20 bp, Homo sapiens
gcatacaccaaacatttctg

SEQ ID NO: 6238717 - DNA, 21 bp, Homo sapiens
gcatacaccaaacatttctgt

SEQ ID NO: 6238718 - DNA, 23 bp, Homo sapiens
gcatacaccactgcaaaatgtct

SEQ ID NO: 6238719 - DNA, 15 bp, Homo sapiens
gcatacactgtagtt

SEQ ID NO: 6238720 - DNA, 15 bp, Homo sapiens
gcatacagatattct

SEQ ID NO: 6238721 - DNA, 20 bp, Homo sapiens
gcatacatgaataaaaataa

SEQ ID NO: 6238722 - DNA, 14 bp, Homo sapiens
gcataccacttgaa

SEQ ID NO: 6238723 - DNA, 15 bp, Homo sapiens
gcataccacttttgt

SEQ ID NO: 6238724 - DNA, 16 bp, Homo sapiens
gcataccacttttgtt

SEQ ID NO: 6238725 - DNA, 16 bp, Homo sapiens
gcataccagttcttgc

SEQ ID NO: 6238726 - DNA, 21 bp, Homo sapiens
gcataccagttcttgcaataa

SEQ ID NO: 6238727 - DNA, 22 bp, Homo sapiens
gcatacccagtgtctaccttca

SEQ ID NO: 6238728 - DNA, 14 bp, Homo sapiens
gcataccttgtgca

SEQ ID NO: 6238729 - DNA, 13 bp, Homo sapiens
gcatacctttatt

SEQ ID NO: 6238730 - DNA, 20 bp, Homo sapiens
gcatacctttattgtgatct

SEQ ID NO: 6238731 - DNA, 16 bp, Homo sapiens
gcatacgtacacattt

SEQ ID NO: 6238732 - DNA, 21 bp, Homo sapiens
gcatactattaaacatgctgt

SEQ ID NO: 6238733 - DNA, 15 bp, Homo sapiens
gcatactctccagga

SEQ ID NO: 6238734 - DNA, 18 bp, Homo sapiens
gcatactgagaatataca

SEQ ID NO: 6238735 - DNA, 14 bp, Homo sapiens
gcatactgatgaga

SEQ ID NO: 6238736 - DNA, 19 bp, Homo sapiens
gcatactgatgagacaaca

SEQ ID NO: 6238737 - DNA, 21 bp, Homo sapiens
gcatactgatgagacaacaca

SEQ ID NO: 6238738 - DNA, 22 bp, Homo sapiens
gcatactgccttgtttaatggt

SEQ ID NO: 6238739 - DNA, 22 bp, Homo sapiens
gcatactgccttgtttaatgtt

SEQ ID NO: 6238740 - DNA, 12 bp, Homo sapiens
gcatactgtgta

SEQ ID NO: 6238741 - DNA, 19 bp, Homo sapiens
gcatactgtgtatgtttta

SEQ ID NO: 6238742 - DNA, 17 bp, Homo sapiens
gcatactgttgatacaa

SEQ ID NO: 6238743 - DNA, 21 bp, Homo sapiens
gcatacttacctagtgaaact

SEQ ID NO: 6238744 - DNA, 18 bp, Homo sapiens
gcatacttcaaaagtatt

SEQ ID NO: 6238745 - DNA, 13 bp, Homo sapiens
gcatacttctaaa

SEQ ID NO: 6238746 - DNA, 14 bp, Homo sapiens
gcatacttttcaaa

SEQ ID NO: 6238747 - DNA, 23 bp, Homo sapiens
gcatagaaggaggagagggaaaa

SEQ ID NO: 6238748 - DNA, 18 bp, Homo sapiens
gcatagaatagcgacagg

SEQ ID NO: 6238749 - DNA, 14 bp, Homo sapiens
gcatagactgaggt

SEQ ID NO: 6238750 - DNA, 12 bp, Homo sapiens
gcatagagcaat

SEQ ID NO: 6238751 - DNA, 14 bp, Homo sapiens
gcatagagcaatta

SEQ ID NO: 6238752 - DNA, 15 bp, Homo sapiens
gcatagagccctggc

SEQ ID NO: 6238753 - DNA, 20 bp, Homo sapiens
gcatagagccctggccagcc

SEQ ID NO: 6238754 - DNA, 16 bp, Homo sapiens
gcatagaggcttctcc

SEQ ID NO: 6238755 - DNA, 19 bp, Homo sapiens
gcatagagggagaggaagc

SEQ ID NO: 6238756 - DNA, 14 bp, Homo sapiens
gcatagaggttttg

SEQ ID NO: 6238757 - DNA, 20 bp, Homo sapiens
gcatagagtaggtactccat

SEQ ID NO: 6238758 - DNA, 19 bp, Homo sapiens
gcatagataatattgtttg

SEQ ID NO: 6238759 - DNA, 16 bp, Homo sapiens
gcatagatgcaggtga

SEQ ID NO: 6238760 - DNA, 19 bp, Homo sapiens
gcatagcacccgtggtgca

SEQ ID NO: 6238761 - DNA, 22 bp, Homo sapiens
gcatagcacccgtggtgcatgg

SEQ ID NO: 6238762 - DNA, 19 bp, Homo sapiens
gcatagcagaggggccagg

SEQ ID NO: 6238763 - DNA, 20 bp, Homo sapiens
gcatagcagtatatgttaat

SEQ ID NO: 6238764 - DNA, 22 bp, Homo sapiens
gcatagcccagacacagaagag

SEQ ID NO: 6238765 - DNA, 14 bp, Homo sapiens
gcatagcctgcctg

SEQ ID NO: 6238766 - DNA, 16 bp, Homo sapiens
gcatagcgaaataaaa

SEQ ID NO: 6238767 - DNA, 18 bp, Homo sapiens
gcatagctacgtggcact

SEQ ID NO: 6238768 - DNA, 17 bp, Homo sapiens
gcatagcttgcacaaca

SEQ ID NO: 6238769 - DNA, 15 bp, Homo sapiens
gcataggaaaagaat

SEQ ID NO: 6238770 - DNA, 19 bp, Homo sapiens
gcataggaagaaaatgtca

SEQ ID NO: 6238771 - DNA, 19 bp, Homo sapiens
gcataggacctttccacca

SEQ ID NO: 6238772 - DNA, 14 bp, Homo sapiens
gcataggcccagcc

SEQ ID NO: 6238773 - DNA, 22 bp, Homo sapiens
gcataggcctgctttgtctcct

SEQ ID NO: 6238774 - DNA, 17 bp, Homo sapiens
gcataggcctgggtgct

SEQ ID NO: 6238775 - DNA, 23 bp, Homo sapiens
gcataggcctgggtgctggctgc

SEQ ID NO: 6238776 - DNA, 12 bp, Homo sapiens
gcataggctcct

SEQ ID NO: 6238777 - DNA, 18 bp, Homo sapiens
gcataggctccttcctgt

SEQ ID NO: 6238778 - DNA, 19 bp, Homo sapiens
gcataggctccttcctgtg

SEQ ID NO: 6238779 - DNA, 14 bp, Homo sapiens
gcataggctgggga

SEQ ID NO: 6238780 - DNA, 12 bp, Homo sapiens
gcatagggggga

SEQ ID NO: 6238781 - DNA, 14 bp, Homo sapiens
gcataggggggagg

SEQ ID NO: 6238782 - DNA, 15 bp, Homo sapiens
gcataggtatgctta

SEQ ID NO: 6238783 - DNA, 20 bp, Homo sapiens
gcataggtctctttgctttc

SEQ ID NO: 6238784 - DNA, 22 bp, Homo sapiens
gcatagtattccattgtgtgag

SEQ ID NO: 6238785 - DNA, 17 bp, Homo sapiens
gcatagtcactgtctca

SEQ ID NO: 6238786 - DNA, 15 bp, Homo sapiens
gcatagtcagtgtcg

SEQ ID NO: 6238787 - DNA, 16 bp, Homo sapiens
gcatagtccccagagc

SEQ ID NO: 6238788 - DNA, 21 bp, Homo sapiens
gcatagttctgcaataacagt

SEQ ID NO: 6238789 - DNA, 18 bp, Homo sapiens
gcatagttgtagacaaag

SEQ ID NO: 6238790 - DNA, 12 bp, Homo sapiens
gcatagtttctt

SEQ ID NO: 6238791 - DNA, 15 bp, Homo sapiens
gcatataaaatggca

SEQ ID NO: 6238792 - DNA, 12 bp, Homo sapiens
gcatataaaatt

SEQ ID NO: 6238793 - DNA, 18 bp, Homo sapiens
gcatataaaggttatgaa

SEQ ID NO: 6238794 - DNA, 21 bp, Homo sapiens
gcatataaaggttatgaaaca

SEQ ID NO: 6238795 - DNA, 12 bp, Homo sapiens
gcatataaatat

SEQ ID NO: 6238796 - DNA, 11 bp, Homo sapiens
gcatataaatg

SEQ ID NO: 6238797 - DNA, 19 bp, Homo sapiens
gcatataaatgtttatatt

SEQ ID NO: 6238798 - DNA, 23 bp, Homo sapiens
gcatataagggaagtagttatca

SEQ ID NO: 6238799 - DNA, 14 bp, Homo sapiens
gcatatacagtgaa

SEQ ID NO: 6238800 - DNA, 12 bp, Homo sapiens
gcatatactggt

SEQ ID NO: 6238801 - DNA, 14 bp, Homo sapiens
gcatatagaaaaca

SEQ ID NO: 6238802 - DNA, 15 bp, Homo sapiens
gcatatagaatatat

SEQ ID NO: 6238803 - DNA, 14 bp, Homo sapiens
gcatatagacacac

SEQ ID NO: 6238804 - DNA, 18 bp, Homo sapiens
gcatatagacacacatac

SEQ ID NO: 6238805 - DNA, 16 bp, Homo sapiens
gcatatagattgtcct

SEQ ID NO: 6238806 - DNA, 22 bp, Homo sapiens
gcatatagatttagttttgtaa

SEQ ID NO: 6238807 - DNA, 18 bp, Homo sapiens
gcatatagttaaactgag

SEQ ID NO: 6238808 - DNA, 14 bp, Homo sapiens
gcatatataaaaca

SEQ ID NO: 6238809 - DNA, 16 bp, Homo sapiens
gcatatataaaacaaa

SEQ ID NO: 6238810 - DNA, 19 bp, Homo sapiens
gcatatatataaaatacac

SEQ ID NO: 6238811 - DNA, 14 bp, Homo sapiens
gcatatatatatgt

SEQ ID NO: 6238812 - DNA, 18 bp, Homo sapiens
gcatatatatatgtgtgt

SEQ ID NO: 6238813 - DNA, 21 bp, Homo sapiens
gcatatattaaagcatcagga

SEQ ID NO: 6238814 - DNA, 15 bp, Homo sapiens
gcatatatttttata

SEQ ID NO: 6238815 - DNA, 19 bp, Homo sapiens
gcatatcacccttccctgc

SEQ ID NO: 6238816 - DNA, 17 bp, Homo sapiens
gcatatcattaaacaaa

SEQ ID NO: 6238817 - DNA, 18 bp, Homo sapiens
gcatatcattaaacaaat

SEQ ID NO: 6238818 - DNA, 17 bp, Homo sapiens
gcatatccattgtggaa

SEQ ID NO: 6238819 - DNA, 15 bp, Homo sapiens
gcatatcctgagcca

SEQ ID NO: 6238820 - DNA, 16 bp, Homo sapiens
gcatatcgctgggctc

SEQ ID NO: 6238821 - DNA, 22 bp, Homo sapiens
gcatatctctagtccctgtgtt

SEQ ID NO: 6238822 - DNA, 16 bp, Homo sapiens
gcatatctgcctttat

SEQ ID NO: 6238823 - DNA, 18 bp, Homo sapiens
gcatatctgcctttattg

SEQ ID NO: 6238824 - DNA, 21 bp, Homo sapiens
gcatatctgcctttattgtgt

SEQ ID NO: 6238825 - DNA, 22 bp, Homo sapiens
gcatatctgcctttattgtgtt

SEQ ID NO: 6238826 - DNA, 17 bp, Homo sapiens
gcatatctggtatatgt

SEQ ID NO: 6238827 - DNA, 17 bp, Homo sapiens
gcatatgacaaatgttt

SEQ ID NO: 6238828 - DNA, 23 bp, Homo sapiens
gcatatgagcctgccctcactcc

SEQ ID NO: 6238829 - DNA, 19 bp, Homo sapiens
gcatatgaggaattaaaga

SEQ ID NO: 6238830 - DNA, 15 bp, Homo sapiens
gcatatgcatgccag

SEQ ID NO: 6238831 - DNA, 16 bp, Homo sapiens
gcatatgcatgccagg

SEQ ID NO: 6238832 - DNA, 17 bp, Homo sapiens
gcatatgcatgccaggc

SEQ ID NO: 6238833 - DNA, 22 bp, Homo sapiens
gcatatggagaacatgttttat

SEQ ID NO: 6238834 - DNA, 20 bp, Homo sapiens
gcatatggcaacgttcatgt

SEQ ID NO: 6238835 - DNA, 22 bp, Homo sapiens
gcatatggcaacgttcatgttc

SEQ ID NO: 6238836 - DNA, 18 bp, Homo sapiens
gcatatggtcctagacaa

SEQ ID NO: 6238837 - DNA, 15 bp, Homo sapiens
gcatatgtacacaga

SEQ ID NO: 6238838 - DNA, 13 bp, Homo sapiens
gcatatgtgtgtg

SEQ ID NO: 6238839 - DNA, 15 bp, Homo sapiens
gcatatgtgttactt

SEQ ID NO: 6238840 - DNA, 19 bp, Homo sapiens
gcatatgttccatgcctgg

SEQ ID NO: 6238841 - DNA, 21 bp, Homo sapiens
gcatatgttccatgcctggcc

SEQ ID NO: 6238842 - DNA, 14 bp, Homo sapiens
gcatatgttgaata

SEQ ID NO: 6238843 - DNA, 17 bp, Homo sapiens
gcatatgttgaatactt

SEQ ID NO: 6238844 - DNA, 19 bp, Homo sapiens
gcatatgttgaatactttt

SEQ ID NO: 6238845 - DNA, 20 bp, Homo sapiens
gcatatgttgaatacttttt

SEQ ID NO: 6238846 - DNA, 21 bp, Homo sapiens
gcatatgtttcgctgatatat

SEQ ID NO: 6238847 - DNA, 21 bp, Homo sapiens
gcatatgttttccacataaat

SEQ ID NO: 6238848 - DNA, 14 bp, Homo sapiens
gcatattaaagaaa

SEQ ID NO: 6238849 - DNA, 12 bp, Homo sapiens
gcatattaaagg

SEQ ID NO: 6238850 - DNA, 13 bp, Homo sapiens
gcatattaaaggc

SEQ ID NO: 6238851 - DNA, 15 bp, Homo sapiens
gcatattaaaggctt

SEQ ID NO: 6238852 - DNA, 16 bp, Homo sapiens
gcatattataaaggat

SEQ ID NO: 6238853 - DNA, 15 bp, Homo sapiens
gcatattcaggaagc

SEQ ID NO: 6238854 - DNA, 17 bp, Homo sapiens
gcatattcaggaagctc

SEQ ID NO: 6238855 - DNA, 21 bp, Homo sapiens
gcatattccctgcacacacat

SEQ ID NO: 6238856 - DNA, 15 bp, Homo sapiens
gcatattcctttcta

SEQ ID NO: 6238857 - DNA, 21 bp, Homo sapiens
gcatattctagtaataaagac

SEQ ID NO: 6238858 - DNA, 15 bp, Homo sapiens
gcatattgtacactt

SEQ ID NO: 6238859 - DNA, 16 bp, Homo sapiens
gcatattgtacacttt

SEQ ID NO: 6238860 - DNA, 22 bp, Homo sapiens
gagacagtttcttagcttttta

SEQ ID NO: 6238861 - DNA, 19 bp, Homo sapiens
gagacataaatgttcactt

SEQ ID NO: 6238862 - DNA, 15 bp, Homo sapiens
gagacatgaatacta

SEQ ID NO: 6238863 - DNA, 21 bp, Homo sapiens
gagacatggaccagcatctgg

SEQ ID NO: 6238864 - DNA, 18 bp, Homo sapiens
gagacatgtaccttgacc

SEQ ID NO: 6238865 - DNA, 14 bp, Homo sapiens
gagacatgtgacat

SEQ ID NO: 6238866 - DNA, 21 bp, Homo sapiens
gagacattagaaaaaaatgaa

SEQ ID NO: 6238867 - DNA, 15 bp, Homo sapiens
gagacattgcctcca

SEQ ID NO: 6238868 - DNA, 23 bp, Homo sapiens
gagacattgcctccacctctcct

SEQ ID NO: 6238869 - DNA, 14 bp, Homo sapiens
gagacatttcaaaa

SEQ ID NO: 6238870 - DNA, 14 bp, Homo sapiens
gagacattttcata

SEQ ID NO: 6238871 - DNA, 21 bp, Homo sapiens
gagacattttccgcccactcc

SEQ ID NO: 6238872 - DNA, 15 bp, Homo sapiens
gagaccaacctgacc

SEQ ID NO: 6238873 - DNA, 19 bp, Homo sapiens
gagaccaacctgggcaaca

SEQ ID NO: 6238874 - DNA, 23 bp, Homo sapiens
gagaccaagactctgaaatctca

SEQ ID NO: 6238875 - DNA, 19 bp, Homo sapiens
gagaccaagccggtgccca

SEQ ID NO: 6238876 - DNA, 18 bp, Homo sapiens
gagaccaaggcgggagca

SEQ ID NO: 6238877 - DNA, 18 bp, Homo sapiens
gagaccaagtcctggcta

SEQ ID NO: 6238878 - DNA, 22 bp, Homo sapiens
gagaccacagtttacctcaggt

SEQ ID NO: 6238879 - DNA, 23 bp, Homo sapiens
gagaccacccaacctcaccctcc

SEQ ID NO: 6238880 - DNA, 21 bp, Homo sapiens
gagaccacccccgagcttgcc

SEQ ID NO: 6238881 - DNA, 23 bp, Homo sapiens
gagaccacccccgagcttgcctc

SEQ ID NO: 6238882 - DNA, 18 bp, Homo sapiens
gagaccaccgcgcccctc

SEQ ID NO: 6238883 - DNA, 12 bp, Homo sapiens
gagaccacctct

SEQ ID NO: 6238884 - DNA, 15 bp, Homo sapiens
gagaccacttcctta

SEQ ID NO: 6238885 - DNA, 20 bp, Homo sapiens
gagaccagaacagcatggcc

SEQ ID NO: 6238886 - DNA, 22 bp, Homo sapiens
gagaccagaacagcatggcccg

SEQ ID NO: 6238887 - DNA, 15 bp, Homo sapiens
gagaccagaagaaaa

SEQ ID NO: 6238888 - DNA, 17 bp, Homo sapiens
gagaccagaagaaaaga

SEQ ID NO: 6238889 - DNA, 20 bp, Homo sapiens
gagaccagaagtgaatggga

SEQ ID NO: 6238890 - DNA, 15 bp, Homo sapiens
gagaccagccaacct

SEQ ID NO: 6238891 - DNA, 16 bp, Homo sapiens
gagaccagcctggcca

SEQ ID NO: 6238892 - DNA, 19 bp, Homo sapiens
gagaccagcctgggcagca

SEQ ID NO: 6238893 - DNA, 15 bp, Homo sapiens
gagaccagcctttct

SEQ ID NO: 6238894 - DNA, 12 bp, Homo sapiens
gagaccagctca

SEQ ID NO: 6238895 - DNA, 14 bp, Homo sapiens
gagaccagctcaga

SEQ ID NO: 6238896 - DNA, 15 bp, Homo sapiens
gagaccagctcagag

SEQ ID NO: 6238897 - DNA, 13 bp, Homo sapiens
gagaccaggactc

SEQ ID NO: 6238898 - DNA, 15 bp, Homo sapiens
gagaccaggactctg

SEQ ID NO: 6238899 - DNA, 19 bp, Homo sapiens
gagaccaggactctgcctt

SEQ ID NO: 6238900 - DNA, 14 bp, Homo sapiens
gagaccaggcaaag

SEQ ID NO: 6238901 - DNA, 15 bp, Homo sapiens
gagaccaggccctgg

SEQ ID NO: 6238902 - DNA, 18 bp, Homo sapiens
gagaccaggccctggcta

SEQ ID NO: 6238903 - DNA, 14 bp, Homo sapiens
gagaccaggctggg

SEQ ID NO: 6238904 - DNA, 16 bp, Homo sapiens
gagaccagggagcctt

SEQ ID NO: 6238905 - DNA, 12 bp, Homo sapiens
gagaccaggggc

SEQ ID NO: 6238906 - DNA, 15 bp, Homo sapiens
gagaccagggtggcc

SEQ ID NO: 6238907 - DNA, 19 bp, Homo sapiens
gagaccagggtggccacac

SEQ ID NO: 6238908 - DNA, 22 bp, Homo sapiens
gagaccagtggtctggaaacag

SEQ ID NO: 6238909 - DNA, 22 bp, Homo sapiens
gagaccagtgtatcaggtcagg

SEQ ID NO: 6238910 - DNA, 23 bp, Homo sapiens
gagaccagtgtatcaggtcaggg

SEQ ID NO: 6238911 - DNA, 23 bp, Homo sapiens
gagaccagttgaataaaagtgca

SEQ ID NO: 6238912 - DNA, 18 bp, Homo sapiens
gagaccatccctgaaggc

SEQ ID NO: 6238913 - DNA, 18 bp, Homo sapiens
gagaccatcctggcccct

SEQ ID NO: 6238914 - DNA, 22 bp, Homo sapiens
gagacccaaagcggtccctgtc

SEQ ID NO: 6238915 - DNA, 17 bp, Homo sapiens
gagacccaaaggaagaa

SEQ ID NO: 6238916 - DNA, 21 bp, Homo sapiens
gagacccaaattataagggcc

SEQ ID NO: 6238917 - DNA, 24 bp, Homo sapiens
gagacccaaattataagggccctg

SEQ ID NO: 6238918 - DNA, 17 bp, Homo sapiens
gagacccaacagcagtg

SEQ ID NO: 6238919 - DNA, 14 bp, Homo sapiens
gagacccaaggagg

SEQ ID NO: 6238920 - DNA, 19 bp, Homo sapiens
gagacccaccatccttcca

SEQ ID NO: 6238921 - DNA, 21 bp, Homo sapiens
gagacccaccatccttccatc

SEQ ID NO: 6238922 - DNA, 20 bp, Homo sapiens
gagacccaccccacctgcag

SEQ ID NO: 6238923 - DNA, 13 bp, Homo sapiens
gagacccacctga

SEQ ID NO: 6238924 - DNA, 16 bp, Homo sapiens
gagacccacctgaggc

SEQ ID NO: 6238925 - DNA, 16 bp, Homo sapiens
gagacccagccccttc

SEQ ID NO: 6238926 - DNA, 17 bp, Homo sapiens
gagacccagccccttcc

SEQ ID NO: 6238927 - DNA, 22 bp, Homo sapiens
gagacccagccccttcccctgg

SEQ ID NO: 6238928 - DNA, 18 bp, Homo sapiens
gagacccagccctcatcc

SEQ ID NO: 6238929 - DNA, 12 bp, Homo sapiens
gagacccaggac

SEQ ID NO: 6238930 - DNA, 14 bp, Homo sapiens
gagacccaggcctg

SEQ ID NO: 6238931 - DNA, 18 bp, Homo sapiens
gagacccaggcctgtggc

SEQ ID NO: 6238932 - DNA, 18 bp, Homo sapiens
gagaccccaccagcctca

SEQ ID NO: 6238933 - DNA, 20 bp, Homo sapiens
gagaccccaccgccaccgtg

SEQ ID NO: 6238934 - DNA, 12 bp, Homo sapiens
gagacccccaca

SEQ ID NO: 6238935 - DNA, 13 bp, Homo sapiens
gagacccccaggc

SEQ ID NO: 6238936 - DNA, 15 bp, Homo sapiens
gagacccccatccag

SEQ ID NO: 6238937 - DNA, 21 bp, Homo sapiens
gagacccccatccagcctcca

SEQ ID NO: 6238938 - DNA, 13 bp, Homo sapiens
gagaccccgcacc

SEQ ID NO: 6238939 - DNA, 18 bp, Homo sapiens
gagaccccgcacccggct

SEQ ID NO: 6238940 - DNA, 19 bp, Homo sapiens
gagacccctcccctcccac

SEQ ID NO: 6238941 - DNA, 13 bp, Homo sapiens
gagacccctggcc

SEQ ID NO: 6238942 - DNA, 13 bp, Homo sapiens
gagacccctgtct

SEQ ID NO: 6238943 - DNA, 12 bp, Homo sapiens
gagaccccttcc

SEQ ID NO: 6238944 - DNA, 14 bp, Homo sapiens
gagaccccttcctt

SEQ ID NO: 6238945 - DNA, 18 bp, Homo sapiens
gagacccctttaaactgt

SEQ ID NO: 6238946 - DNA, 23 bp, Homo sapiens
gagaccctccccacagtgccacc

SEQ ID NO: 6238947 - DNA, 17 bp, Homo sapiens
gagaccctcgccacggg

SEQ ID NO: 6238948 - DNA, 13 bp, Homo sapiens
gagaccctcttct

SEQ ID NO: 6238949 - DNA, 17 bp, Homo sapiens
gagaccctgaactcaga

SEQ ID NO: 6238950 - DNA, 18 bp, Homo sapiens
gagaccctggaattcagc

SEQ ID NO: 6238951 - DNA, 18 bp, Homo sapiens
gagaccctgggagagtga

SEQ ID NO: 6238952 - DNA, 21 bp, Homo sapiens
gagaccctgtctcaaaaaaag

SEQ ID NO: 6238953 - DNA, 19 bp, Homo sapiens
gagacccttgcattagaaa

SEQ ID NO: 6238954 - DNA, 16 bp, Homo sapiens
gagacccttttctcag

SEQ ID NO: 6238955 - DNA, 23 bp, Homo sapiens
gagaccgagtgtggagctgcttc

SEQ ID NO: 6238956 - DNA, 21 bp, Homo sapiens
gagaccgcttcacccctgcac

SEQ ID NO: 6238957 - DNA, 17 bp, Homo sapiens
gagaccggaattgagag

SEQ ID NO: 6238958 - DNA, 20 bp, Homo sapiens
gagaccggaattgagaggtg

SEQ ID NO: 6238959 - DNA, 17 bp, Homo sapiens
gagaccggcctgccagg

SEQ ID NO: 6238960 - DNA, 21 bp, Homo sapiens
gagaccggcctgccaggagga

SEQ ID NO: 6238961 - DNA, 20 bp, Homo sapiens
gagaccgggccctgggttcc

SEQ ID NO: 6238962 - DNA, 20 bp, Homo sapiens
gagaccggggtatcctgggg

SEQ ID NO: 6238963 - DNA, 22 bp, Homo sapiens
gagaccgtcctcacccctgtcc

SEQ ID NO: 6238964 - DNA, 20 bp, Homo sapiens
gagaccgtgaagatactttg

SEQ ID NO: 6238965 - DNA, 17 bp, Homo sapiens
gagacctacctcaggtt

SEQ ID NO: 6238966 - DNA, 23 bp, Homo sapiens
gagacctacctcaggttgctggt

SEQ ID NO: 6238967 - DNA, 15 bp, Homo sapiens
gagacctcaagccct

SEQ ID NO: 6238968 - DNA, 17 bp, Homo sapiens
gagacctcaagccctga

SEQ ID NO: 6238969 - DNA, 18 bp, Homo sapiens
gagacctcagaagtaaag

SEQ ID NO: 6238970 - DNA, 13 bp, Homo sapiens
gagacctcagcca

SEQ ID NO: 6238971 - DNA, 16 bp, Homo sapiens
gagacctcagggatgg

SEQ ID NO: 6238972 - DNA, 18 bp, Homo sapiens
gagacctcatcagccttg

SEQ ID NO: 6238973 - DNA, 18 bp, Homo sapiens
gagacctcatcaggatga

SEQ ID NO: 6238974 - DNA, 19 bp, Homo sapiens
gagacctcatcaggatgaa

SEQ ID NO: 6238975 - DNA, 21 bp, Homo sapiens
gagacctcatcaggatgaacc

SEQ ID NO: 6238976 - DNA, 16 bp, Homo sapiens
gagacctcatcctgct

SEQ ID NO: 6238977 - DNA, 21 bp, Homo sapiens
gagacctcatcctgctctttt

SEQ ID NO: 6238978 - DNA, 14 bp, Homo sapiens
gagacctcccccag

SEQ ID NO: 6238979 - DNA, 18 bp, Homo sapiens
gagacctcccccagggag

SEQ ID NO: 6238980 - DNA, 23 bp, Homo sapiens
gagacctccctgttcaaggcccc

SEQ ID NO: 6238981 - DNA, 15 bp, Homo sapiens
gagacctcctgcctc

SEQ ID NO: 6238982 - DNA, 19 bp, Homo sapiens
gagacctgaaggacctccc

SEQ ID NO: 6238983 - DNA, 15 bp, Homo sapiens
gagacctgaagtgtg

SEQ ID NO: 6238984 - DNA, 18 bp, Homo sapiens
gagacctgacaagcactg

SEQ ID NO: 6238985 - DNA, 21 bp, Homo sapiens
gagacctgaccagtcagatgg

SEQ ID NO: 6238986 - DNA, 11 bp, Homo sapiens
gagacctgccc

SEQ ID NO: 6238987 - DNA, 12 bp, Homo sapiens
gagacctgcccc

SEQ ID NO: 6238988 - DNA, 16 bp, Homo sapiens
gagacctgccctctct

SEQ ID NO: 6238989 - DNA, 13 bp, Homo sapiens
gagacctgctcca

SEQ ID NO: 6238990 - DNA, 18 bp, Homo sapiens
gagacctgctccagatcc

SEQ ID NO: 6238991 - DNA, 16 bp, Homo sapiens
gagacctggaaccaga

SEQ ID NO: 6238992 - DNA, 13 bp, Homo sapiens
gagacctgtgtga

SEQ ID NO: 6238993 - DNA, 18 bp, Homo sapiens
gagaccttacccctggct

SEQ ID NO: 6238994 - DNA, 17 bp, Homo sapiens
gagaccttcaaatgcga

SEQ ID NO: 6238995 - DNA, 13 bp, Homo sapiens
gagaccttctctt

SEQ ID NO: 6238996 - DNA, 22 bp, Homo sapiens
gagaccttgctttgagactcct

SEQ ID NO: 6238997 - DNA, 17 bp, Homo sapiens
gagaccttggctgctca

SEQ ID NO: 6238998 - DNA, 15 bp, Homo sapiens
gagacctttcctctc

SEQ ID NO: 6238999 - DNA, 15 bp, Homo sapiens
gagacctttgcccac

SEQ ID NO: 6239000 - DNA, 17 bp, Homo sapiens
gagacctttgcccacac

SEQ ID NO: 6239001 - DNA, 18 bp, Homo sapiens
gagacctttgcccacaca

SEQ ID NO: 6239002 - DNA, 23 bp, Homo sapiens
gagaccttttctctcccatacca

SEQ ID NO: 6239003 - DNA, 23 bp, Homo sapiens
gagacgaagtgaaaacaaatcta

SEQ ID NO: 6239004 - DNA, 17 bp, Homo sapiens
gagacgaggcaggggct

SEQ ID NO: 6239005 - DNA, 14 bp, Homo sapiens
gagacgaggcattc

SEQ ID NO: 6239006 - DNA, 19 bp, Homo sapiens
gagacgcaagggagaagaa

SEQ ID NO: 6239007 - DNA, 21 bp, Homo sapiens
gagacgcacacagctgagcac

SEQ ID NO: 6239008 - DNA, 19 bp, Homo sapiens
gagacgcagccctgggggc

SEQ ID NO: 6239009 - DNA, 21 bp, Homo sapiens
gagacgccacggagggctggg

SEQ ID NO: 6239010 - DNA, 13 bp, Homo sapiens
gagacgcccagcc

SEQ ID NO: 6239011 - DNA, 21 bp, Homo sapiens
gagacgcccagccccatccct

SEQ ID NO: 6239012 - DNA, 22 bp, Homo sapiens
gagacgcccagccccatccctg

SEQ ID NO: 6239013 - DNA, 13 bp, Homo sapiens
gagacgctgtgat

SEQ ID NO: 6239014 - DNA, 14 bp, Homo sapiens
gagacggagtccca

SEQ ID NO: 6239015 - DNA, 19 bp, Homo sapiens
gagacggagtcccaccttg

SEQ ID NO: 6239016 - DNA, 21 bp, Homo sapiens
gagacggcagaaaacagagcc

SEQ ID NO: 6239017 - DNA, 22 bp, Homo sapiens
gagacggcagaaaacagagcct

SEQ ID NO: 6239018 - DNA, 19 bp, Homo sapiens
gagacggcagccccatcct

SEQ ID NO: 6239019 - DNA, 18 bp, Homo sapiens
gagacggccctgctgggg

SEQ ID NO: 6239020 - DNA, 22 bp, Homo sapiens
gagacggcgattttcgggctga

SEQ ID NO: 6239021 - DNA, 16 bp, Homo sapiens
gagacgggaccgggcc

SEQ ID NO: 6239022 - DNA, 23 bp, Homo sapiens
gagacgggactgcggaggaagga

SEQ ID NO: 6239023 - DNA, 16 bp, Homo sapiens
gagacgggccctggtg

SEQ ID NO: 6239024 - DNA, 22 bp, Homo sapiens
gagacggggtctccctgtgtta

SEQ ID NO: 6239025 - DNA, 22 bp, Homo sapiens
gagacggtgtcttgttctgtca

SEQ ID NO: 6239026 - DNA, 17 bp, Homo sapiens
gagacggtttccaggga

SEQ ID NO: 6239027 - DNA, 15 bp, Homo sapiens
gagacgtggtgggac

SEQ ID NO: 6239028 - DNA, 22 bp, Homo sapiens
gagacgtttttggaagagtagt

SEQ ID NO: 6239029 - DNA, 22 bp, Homo sapiens
gagactaacttattttgattgt

SEQ ID NO: 6239030 - DNA, 14 bp, Homo sapiens
gagactaagccctg

SEQ ID NO: 6239031 - DNA, 19 bp, Homo sapiens
gagactaatgttggacaga

SEQ ID NO: 6239032 - DNA, 13 bp, Homo sapiens
gagactactctgc

SEQ ID NO: 6239033 - DNA, 16 bp, Homo sapiens
gagactagacaaataa

SEQ ID NO: 6239034 - DNA, 22 bp, Homo sapiens
gagactatggagcctggcacag

SEQ ID NO: 6239035 - DNA, 14 bp, Homo sapiens
gagactatgtgtca

SEQ ID NO: 6239036 - DNA, 15 bp, Homo sapiens
gagactatgtgtcat

SEQ ID NO: 6239037 - DNA, 17 bp, Homo sapiens
gcatattgtacactttt

SEQ ID NO: 6239038 - DNA, 18 bp, Homo sapiens
gcatattgtacacttttt

SEQ ID NO: 6239039 - DNA, 20 bp, Homo sapiens
gcatattgtacacttttttg

SEQ ID NO: 6239040 - DNA, 15 bp, Homo sapiens
gcatattgttattat

SEQ ID NO: 6239041 - DNA, 18 bp, Homo sapiens
gcatattgttggcacaga

SEQ ID NO: 6239042 - DNA, 19 bp, Homo sapiens
gcatatttataaaaataaa

SEQ ID NO: 6239043 - DNA, 16 bp, Homo sapiens
gcatatttataagaga

SEQ ID NO: 6239044 - DNA, 21 bp, Homo sapiens
gcatatttatccaaaatgtgt

SEQ ID NO: 6239045 - DNA, 14 bp, Homo sapiens
gcatatttccaata

SEQ ID NO: 6239046 - DNA, 18 bp, Homo sapiens
gcatatttccaataacta

SEQ ID NO: 6239047 - DNA, 21 bp, Homo sapiens
gcatatttctatgttgtaata

SEQ ID NO: 6239048 - DNA, 12 bp, Homo sapiens
gcatatttctgt

SEQ ID NO: 6239049 - DNA, 22 bp, Homo sapiens
gcatatttctgtatatttgtca

SEQ ID NO: 6239050 - DNA, 23 bp, Homo sapiens
gcatatttctgtatatttgtcat

SEQ ID NO: 6239051 - DNA, 20 bp, Homo sapiens
gcatatttgccaataaagct

SEQ ID NO: 6239052 - DNA, 22 bp, Homo sapiens
gcatatttgccaataaagcttt

SEQ ID NO: 6239053 - DNA, 14 bp, Homo sapiens
gcatatttgtatag

SEQ ID NO: 6239054 - DNA, 18 bp, Homo sapiens
gcatatttgtatagttgc

SEQ ID NO: 6239055 - DNA, 15 bp, Homo sapiens
gcatattttgagaaa

SEQ ID NO: 6239056 - DNA, 18 bp, Homo sapiens
gcatattttgagaaactg

SEQ ID NO: 6239057 - DNA, 20 bp, Homo sapiens
gcatattttgagaaactgct

SEQ ID NO: 6239058 - DNA, 13 bp, Homo sapiens
gcatattttgctg

SEQ ID NO: 6239059 - DNA, 14 bp, Homo sapiens
gcatatttttcaca

SEQ ID NO: 6239060 - DNA, 19 bp, Homo sapiens
gcatatttttctaaagaaa

SEQ ID NO: 6239061 - DNA, 13 bp, Homo sapiens
gcatatttttgca

SEQ ID NO: 6239062 - DNA, 20 bp, Homo sapiens
gcatatttttgcacagtgga

SEQ ID NO: 6239063 - DNA, 15 bp, Homo sapiens
gcatattttttttct

SEQ ID NO: 6239064 - DNA, 13 bp, Homo sapiens
gcatcaaaagaca

SEQ ID NO: 6239065 - DNA, 17 bp, Homo sapiens
gcatcaaaagacaattc

SEQ ID NO: 6239066 - DNA, 22 bp, Homo sapiens
gcatcaaaagacaattctttat

SEQ ID NO: 6239067 - DNA, 14 bp, Homo sapiens
gcatcaaaatacaa

SEQ ID NO: 6239068 - DNA, 16 bp, Homo sapiens
gcatcaaacatgaaaa

SEQ ID NO: 6239069 - DNA, 18 bp, Homo sapiens
gcatcaaacatgaaaaca

SEQ ID NO: 6239070 - DNA, 19 bp, Homo sapiens
gcatcaaacatgaaaacat

SEQ ID NO: 6239071 - DNA, 23 bp, Homo sapiens
gcatcaaaggagattctttgaga

SEQ ID NO: 6239072 - DNA, 18 bp, Homo sapiens
gcatcaacctaggagcag

SEQ ID NO: 6239073 - DNA, 21 bp, Homo sapiens
gcatcaagacttcaatcctga

SEQ ID NO: 6239074 - DNA, 20 bp, Homo sapiens
gcatcaagggagacaccagt

SEQ ID NO: 6239075 - DNA, 21 bp, Homo sapiens
gcatcaagggagacaccagtg

SEQ ID NO: 6239076 - DNA, 18 bp, Homo sapiens
gcatcaaggggtcactta

SEQ ID NO: 6239077 - DNA, 22 bp, Homo sapiens
gcatcaaggggtcacttacaga

SEQ ID NO: 6239078 - DNA, 19 bp, Homo sapiens
gcatcaatacaaccagccc

SEQ ID NO: 6239079 - DNA, 17 bp, Homo sapiens
gcatcaatcctgtgtgg

SEQ ID NO: 6239080 - DNA, 17 bp, Homo sapiens
gcatcacactcaaggac

SEQ ID NO: 6239081 - DNA, 20 bp, Homo sapiens
gcatcacacttatattttat

SEQ ID NO: 6239082 - DNA, 17 bp, Homo sapiens
gcatcacagggcagagc

SEQ ID NO: 6239083 - DNA, 21 bp, Homo sapiens
gcatcacagggcagagccggg

SEQ ID NO: 6239084 - DNA, 18 bp, Homo sapiens
gcatcaccaccacacccc

SEQ ID NO: 6239085 - DNA, 13 bp, Homo sapiens
gcatcacctcagg

SEQ ID NO: 6239086 - DNA, 14 bp, Homo sapiens
gcatcacctgcctg

SEQ ID NO: 6239087 - DNA, 16 bp, Homo sapiens
gcatcacctgcctgtt

SEQ ID NO: 6239088 - DNA, 22 bp, Homo sapiens
gcatcaccttcctaatcaccgc

SEQ ID NO: 6239089 - DNA, 20 bp, Homo sapiens
gcatcactccccaaggaaga

SEQ ID NO: 6239090 - DNA, 15 bp, Homo sapiens
gcatcactgatggga

SEQ ID NO: 6239091 - DNA, 12 bp, Homo sapiens
gcatcactgcct

SEQ ID NO: 6239092 - DNA, 13 bp, Homo sapiens
gcatcactgcctt

SEQ ID NO: 6239093 - DNA, 17 bp, Homo sapiens
gcatcactgccttggcc

SEQ ID NO: 6239094 - DNA, 17 bp, Homo sapiens
gcatcactgggtgttga

SEQ ID NO: 6239095 - DNA, 22 bp, Homo sapiens
gcatcactgggtgttgatctta

SEQ ID NO: 6239096 - DNA, 20 bp, Homo sapiens
gcatcacttaaaacacgttt

SEQ ID NO: 6239097 - DNA, 23 bp, Homo sapiens
gcatcacttaacggaccaaagca

SEQ ID NO: 6239098 - DNA, 10 bp, Homo sapiens
gcatcagaaa

SEQ ID NO: 6239099 - DNA, 18 bp, Homo sapiens
gcatcagaaagggagggc

SEQ ID NO: 6239100 - DNA, 13 bp, Homo sapiens
gcatcagaaatgt

SEQ ID NO: 6239101 - DNA, 16 bp, Homo sapiens
gcatcagcctctggcc

SEQ ID NO: 6239102 - DNA, 14 bp, Homo sapiens
gcatcagcgtggca

SEQ ID NO: 6239103 - DNA, 18 bp, Homo sapiens
gcatcagctttccctggc

SEQ ID NO: 6239104 - DNA, 21 bp, Homo sapiens
gcatcagctttccctggctca

SEQ ID NO: 6239105 - DNA, 22 bp, Homo sapiens
gcatcagctttccctggctcag

SEQ ID NO: 6239106 - DNA, 21 bp, Homo sapiens
gcatcaggagctgctcaggct

SEQ ID NO: 6239107 - DNA, 15 bp, Homo sapiens
gcatcaggcactggt

SEQ ID NO: 6239108 - DNA, 13 bp, Homo sapiens
gcatcaggccagg

SEQ ID NO: 6239109 - DNA, 15 bp, Homo sapiens
gcatcaggccaggcc

SEQ ID NO: 6239110 - DNA, 17 bp, Homo sapiens
gcatcaggccaggccct

SEQ ID NO: 6239111 - DNA, 17 bp, Homo sapiens
gcatcaggcctgaaccc

SEQ ID NO: 6239112 - DNA, 20 bp, Homo sapiens
gcatcaggctaagaccctgt

SEQ ID NO: 6239113 - DNA, 20 bp, Homo sapiens
gcatcagggcctttctcctc

SEQ ID NO: 6239114 - DNA, 18 bp, Homo sapiens
gcatcagggggaagaagc

SEQ ID NO: 6239115 - DNA, 20 bp, Homo sapiens
gcatcagggggaagaagcag

SEQ ID NO: 6239116 - DNA, 19 bp, Homo sapiens
gcatcagtccctatgtatt

SEQ ID NO: 6239117 - DNA, 15 bp, Homo sapiens
gcatcagttctacgg

SEQ ID NO: 6239118 - DNA, 21 bp, Homo sapiens
gcatcagtttaggccttggct

SEQ ID NO: 6239119 - DNA, 20 bp, Homo sapiens
gcatcatccattctctctgc

SEQ ID NO: 6239120 - DNA, 23 bp, Homo sapiens
gcatcatccattctctctgccca

SEQ ID NO: 6239121 - DNA, 15 bp, Homo sapiens
gcatcatctcagctc

SEQ ID NO: 6239122 - DNA, 12 bp, Homo sapiens
gcatcatgcctc

SEQ ID NO: 6239123 - DNA, 16 bp, Homo sapiens
gcatcatgcctctgag

SEQ ID NO: 6239124 - DNA, 18 bp, Homo sapiens
gcatcatgcctctgaggc

SEQ ID NO: 6239125 - DNA, 19 bp, Homo sapiens
gcatcatgtctctttgcca

SEQ ID NO: 6239126 - DNA, 19 bp, Homo sapiens
gcatcattataagctatga

SEQ ID NO: 6239127 - DNA, 23 bp, Homo sapiens
gcatcattgtaaattatttcata

SEQ ID NO: 6239128 - DNA, 21 bp, Homo sapiens
gcatcattgtccccatgcaac

SEQ ID NO: 6239129 - DNA, 14 bp, Homo sapiens
gcatcatttaactg

SEQ ID NO: 6239130 - DNA, 17 bp, Homo sapiens
gcatcattttcacctcc

SEQ ID NO: 6239131 - DNA, 20 bp, Homo sapiens
gcatcattttgcattcaaat

SEQ ID NO: 6239132 - DNA, 17 bp, Homo sapiens
gcatccaaaagcaggaa

SEQ ID NO: 6239133 - DNA, 19 bp, Homo sapiens
gcatccaaaagcaggaacc

SEQ ID NO: 6239134 - DNA, 20 bp, Homo sapiens
gcatccaaaggctcctgaga

SEQ ID NO: 6239135 - DNA, 18 bp, Homo sapiens
gcatccaaatggctgctt

SEQ ID NO: 6239136 - DNA, 15 bp, Homo sapiens
gcatccaatctcaag

SEQ ID NO: 6239137 - DNA, 12 bp, Homo sapiens
gcatccacctcc

SEQ ID NO: 6239138 - DNA, 18 bp, Homo sapiens
gcatccaccttcctgccc

SEQ ID NO: 6239139 - DNA, 15 bp, Homo sapiens
gcatccaccttggct

SEQ ID NO: 6239140 - DNA, 20 bp, Homo sapiens
gcatccaccttggctctgcc

SEQ ID NO: 6239141 - DNA, 21 bp, Homo sapiens
gcatccaccttggctctgcca

SEQ ID NO: 6239142 - DNA, 19 bp, Homo sapiens
gcatccacgtagggggcag

SEQ ID NO: 6239143 - DNA, 15 bp, Homo sapiens
gcatccacttcagga

SEQ ID NO: 6239144 - DNA, 22 bp, Homo sapiens
gcatccacttctttcagcagac

SEQ ID NO: 6239145 - DNA, 13 bp, Homo sapiens
gcatccagacagt

SEQ ID NO: 6239146 - DNA, 13 bp, Homo sapiens
gcatccagcagca

SEQ ID NO: 6239147 - DNA, 14 bp, Homo sapiens
gcatccagcagcag

SEQ ID NO: 6239148 - DNA, 19 bp, Homo sapiens
gcatccagcagcagcactt

SEQ ID NO: 6239149 - DNA, 20 bp, Homo sapiens
gcatccagcagtctctgcct

SEQ ID NO: 6239150 - DNA, 11 bp, Homo sapiens
gcatccagcct

SEQ ID NO: 6239151 - DNA, 15 bp, Homo sapiens
gcatccagcctgtgt

SEQ ID NO: 6239152 - DNA, 16 bp, Homo sapiens
gcatccagcctgtgtg

SEQ ID NO: 6239153 - DNA, 17 bp, Homo sapiens
gcatccagcctgtgtgt

SEQ ID NO: 6239154 - DNA, 18 bp, Homo sapiens
gcatccaggccagggctc

SEQ ID NO: 6239155 - DNA, 16 bp, Homo sapiens
gcatccaggcctgagg

SEQ ID NO: 6239156 - DNA, 17 bp, Homo sapiens
gcatccaggcctgaggc

SEQ ID NO: 6239157 - DNA, 13 bp, Homo sapiens
gcatccaggctgg

SEQ ID NO: 6239158 - DNA, 18 bp, Homo sapiens
gcatccagtatcttgaag

SEQ ID NO: 6239159 - DNA, 12 bp, Homo sapiens
gcatccatacca

SEQ ID NO: 6239160 - DNA, 22 bp, Homo sapiens
gcatccatgcggccggcctggg

SEQ ID NO: 6239161 - DNA, 21 bp, Homo sapiens
gcatccatggggtctctcaca

SEQ ID NO: 6239162 - DNA, 23 bp, Homo sapiens
gcatccatggggtctctcacaga

SEQ ID NO: 6239163 - DNA, 12 bp, Homo sapiens
gcatccattcct

SEQ ID NO: 6239164 - DNA, 16 bp, Homo sapiens
gcatccattcctcagg

SEQ ID NO: 6239165 - DNA, 21 bp, Homo sapiens
gcatccattcctcagggacag

SEQ ID NO: 6239166 - DNA, 14 bp, Homo sapiens
gcatcccacagcca

SEQ ID NO: 6239167 - DNA, 17 bp, Homo sapiens
gcatcccacgttctgtt

SEQ ID NO: 6239168 - DNA, 15 bp, Homo sapiens
gcatcccagcacctg

SEQ ID NO: 6239169 - DNA, 22 bp, Homo sapiens
gcatcccagcacctgcctcctc

SEQ ID NO: 6239170 - DNA, 12 bp, Homo sapiens
gcatcccagcct

SEQ ID NO: 6239171 - DNA, 13 bp, Homo sapiens
gcatcccagcctc

SEQ ID NO: 6239172 - DNA, 14 bp, Homo sapiens
gcatcccagcctca

SEQ ID NO: 6239173 - DNA, 15 bp, Homo sapiens
gcatcccagcctcag

SEQ ID NO: 6239174 - DNA, 19 bp, Homo sapiens
gcatcccagcctcagaagc

SEQ ID NO: 6239175 - DNA, 23 bp, Homo sapiens
gcatcccagtggcctcaaccctc

SEQ ID NO: 6239176 - DNA, 17 bp, Homo sapiens
gcatcccatctctccca

SEQ ID NO: 6239177 - DNA, 18 bp, Homo sapiens
gcatcccatctctcccac

SEQ ID NO: 6239178 - DNA, 18 bp, Homo sapiens
gcatccccagccccctgg

SEQ ID NO: 6239179 - DNA, 17 bp, Homo sapiens
gcatcccccctgctcag

SEQ ID NO: 6239180 - DNA, 16 bp, Homo sapiens
gcatccccctcctctc

SEQ ID NO: 6239181 - DNA, 13 bp, Homo sapiens
gcatcccctgcct

SEQ ID NO: 6239182 - DNA, 15 bp, Homo sapiens
gcatcccctgcctcc

SEQ ID NO: 6239183 - DNA, 16 bp, Homo sapiens
gcatccccttccagct

SEQ ID NO: 6239184 - DNA, 19 bp, Homo sapiens
gcatcccgatacctcagcc

SEQ ID NO: 6239185 - DNA, 22 bp, Homo sapiens
gcatcccggaggaaatctgcag

SEQ ID NO: 6239186 - DNA, 13 bp, Homo sapiens
gcatcccggctga

SEQ ID NO: 6239187 - DNA, 17 bp, Homo sapiens
gcatcccggctgaccct

SEQ ID NO: 6239188 - DNA, 18 bp, Homo sapiens
gcatcccggctgaccctg

SEQ ID NO: 6239189 - DNA, 21 bp, Homo sapiens
gcatccctaccgacccagggt

SEQ ID NO: 6239190 - DNA, 15 bp, Homo sapiens
gcatccctgggcctt

SEQ ID NO: 6239191 - DNA, 14 bp, Homo sapiens
gcatccctgtgagc

SEQ ID NO: 6239192 - DNA, 22 bp, Homo sapiens
gcatccctgtgtccactgagac

SEQ ID NO: 6239193 - DNA, 14 bp, Homo sapiens
gcatcccttcccac

SEQ ID NO: 6239194 - DNA, 23 bp, Homo sapiens
gcatcccttcccacatgcctgcg

SEQ ID NO: 6239195 - DNA, 22 bp, Homo sapiens
gcatcccttgaccaggcctggg

SEQ ID NO: 6239196 - DNA, 20 bp, Homo sapiens
gcatcccttggcccctctct

SEQ ID NO: 6239197 - DNA, 22 bp, Homo sapiens
gcatcccttggcccctctctgt

SEQ ID NO: 6239198 - DNA, 16 bp, Homo sapiens
gcatccgaccaggttg

SEQ ID NO: 6239199 - DNA, 17 bp, Homo sapiens
gcatccgagcccctgtt

SEQ ID NO: 6239200 - DNA, 16 bp, Homo sapiens
gcatccgcagcccagg

SEQ ID NO: 6239201 - DNA, 15 bp, Homo sapiens
gcatccgcaggtgct

SEQ ID NO: 6239202 - DNA, 18 bp, Homo sapiens
gcatccgcaggtgctggt

SEQ ID NO: 6239203 - DNA, 17 bp, Homo sapiens
gcatccgtagttccctg

SEQ ID NO: 6239204 - DNA, 18 bp, Homo sapiens
gcatccgtagttccctga

SEQ ID NO: 6239205 - DNA, 15 bp, Homo sapiens
gcatccgtctcccct

SEQ ID NO: 6239206 - DNA, 17 bp, Homo sapiens
gcatccgtgaggcaggg

SEQ ID NO: 6239207 - DNA, 23 bp, Homo sapiens
gcatccgtgtatttggctgggct

SEQ ID NO: 6239208 - DNA, 21 bp, Homo sapiens
gcatcctatcgatctggaaag

SEQ ID NO: 6239209 - DNA, 14 bp, Homo sapiens
gcatcctatgctta

SEQ ID NO: 6239210 - DNA, 18 bp, Homo sapiens
gcatcctatgcttaataa

SEQ ID NO: 6239211 - DNA, 21 bp, Homo sapiens
gcatcctatgcttaataaaag

SEQ ID NO: 6239212 - DNA, 21 bp, Homo sapiens
gcatcctcactgggctcactg

SEQ ID NO: 6239213 - DNA, 19 bp, Homo sapiens
gcatcctcagccccagggc

SEQ ID NO: 6239214 - DNA, 20 bp, Homo sapiens
gcatcctcagttcctgcagc

SEQ ID NO: 6239215 - DNA, 13 bp, Homo sapiens
gagactatttaaa

SEQ ID NO: 6239216 - DNA, 18 bp, Homo sapiens
gagactcaaagagactcc

SEQ ID NO: 6239217 - DNA, 18 bp, Homo sapiens
gagactcacctctgcctc

SEQ ID NO: 6239218 - DNA, 19 bp, Homo sapiens
gagactcacctctgcctca

SEQ ID NO: 6239219 - DNA, 13 bp, Homo sapiens
gagactcagacag

SEQ ID NO: 6239220 - DNA, 14 bp, Homo sapiens
gagactcagcctct

SEQ ID NO: 6239221 - DNA, 15 bp, Homo sapiens
gagactcagcctctg

SEQ ID NO: 6239222 - DNA, 21 bp, Homo sapiens
gagactcagcctctgctggag

SEQ ID NO: 6239223 - DNA, 19 bp, Homo sapiens
gagactcagcgctcctcct

SEQ ID NO: 6239224 - DNA, 16 bp, Homo sapiens
gagactcaggcccaca

SEQ ID NO: 6239225 - DNA, 13 bp, Homo sapiens
gagactcagtgca

SEQ ID NO: 6239226 - DNA, 15 bp, Homo sapiens
gagactcagtgcaga

SEQ ID NO: 6239227 - DNA, 16 bp, Homo sapiens
gagactcagtgcagat

SEQ ID NO: 6239228 - DNA, 21 bp, Homo sapiens
gagactccactcaggtgcaca

SEQ ID NO: 6239229 - DNA, 20 bp, Homo sapiens
gagactccagaatctgctgt

SEQ ID NO: 6239230 - DNA, 19 bp, Homo sapiens
gagactccagacctgaggc

SEQ ID NO: 6239231 - DNA, 15 bp, Homo sapiens
gagactccatagttt

SEQ ID NO: 6239232 - DNA, 14 bp, Homo sapiens
gagactccatctca

SEQ ID NO: 6239233 - DNA, 15 bp, Homo sapiens
gagactcccaggagt

SEQ ID NO: 6239234 - DNA, 20 bp, Homo sapiens
gagactcccatgaagccttt

SEQ ID NO: 6239235 - DNA, 14 bp, Homo sapiens
gagactcctcagca

SEQ ID NO: 6239236 - DNA, 20 bp, Homo sapiens
gagactcctgcaggcagcca

SEQ ID NO: 6239237 - DNA, 14 bp, Homo sapiens
gagactcctggtct

SEQ ID NO: 6239238 - DNA, 15 bp, Homo sapiens
gagactcctggtctg

SEQ ID NO: 6239239 - DNA, 18 bp, Homo sapiens
gagactcgactctgtgcc

SEQ ID NO: 6239240 - DNA, 14 bp, Homo sapiens
gagactcgagaact

SEQ ID NO: 6239241 - DNA, 17 bp, Homo sapiens
gagactcgagaactttc

SEQ ID NO: 6239242 - DNA, 21 bp, Homo sapiens
gagactcgcgacaatgcaaac

SEQ ID NO: 6239243 - DNA, 18 bp, Homo sapiens
gagactcgctcactccca

SEQ ID NO: 6239244 - DNA, 22 bp, Homo sapiens
gagactctattttaatgtatat

SEQ ID NO: 6239245 - DNA, 23 bp, Homo sapiens
gagactctccctgacggtggaat

SEQ ID NO: 6239246 - DNA, 16 bp, Homo sapiens
gagactctcttaggga

SEQ ID NO: 6239247 - DNA, 15 bp, Homo sapiens
gagactctgaggtgt

SEQ ID NO: 6239248 - DNA, 14 bp, Homo sapiens
gagactctgtctca

SEQ ID NO: 6239249 - DNA, 20 bp, Homo sapiens
gagactctgtgatctaagca

SEQ ID NO: 6239250 - DNA, 23 bp, Homo sapiens
gagactctgtggggccttggttc

SEQ ID NO: 6239251 - DNA, 17 bp, Homo sapiens
gagactgaaagaaacta

SEQ ID NO: 6239252 - DNA, 21 bp, Homo sapiens
gagactgacccattcacattt

SEQ ID NO: 6239253 - DNA, 21 bp, Homo sapiens
gagactgagatcactgactct

SEQ ID NO: 6239254 - DNA, 22 bp, Homo sapiens
gagactgaggcttagagagagg

SEQ ID NO: 6239255 - DNA, 14 bp, Homo sapiens
gagactgagggaga

SEQ ID NO: 6239256 - DNA, 18 bp, Homo sapiens
gagactgatggggtcgct

SEQ ID NO: 6239257 - DNA, 17 bp, Homo sapiens
gagactgcaagctgctt

SEQ ID NO: 6239258 - DNA, 18 bp, Homo sapiens
gagactgcaagctgcttg

SEQ ID NO: 6239259 - DNA, 16 bp, Homo sapiens
gagactgcagaggagc

SEQ ID NO: 6239260 - DNA, 20 bp, Homo sapiens
gagactgcaggtgggctggg

SEQ ID NO: 6239261 - DNA, 11 bp, Homo sapiens
gagactgccca

SEQ ID NO: 6239262 - DNA, 13 bp, Homo sapiens
gagactgcccacc

SEQ ID NO: 6239263 - DNA, 20 bp, Homo sapiens
gagactgcccaccctgggcc

SEQ ID NO: 6239264 - DNA, 21 bp, Homo sapiens
gagactgcccaccctgggcct

SEQ ID NO: 6239265 - DNA, 22 bp, Homo sapiens
gagactgcccaccctgggcctc

SEQ ID NO: 6239266 - DNA, 15 bp, Homo sapiens
gagactgcccagcta

SEQ ID NO: 6239267 - DNA, 13 bp, Homo sapiens
gagactgccctgc

SEQ ID NO: 6239268 - DNA, 18 bp, Homo sapiens
gagactgccctgcccagg

SEQ ID NO: 6239269 - DNA, 12 bp, Homo sapiens
gagactgccctt

SEQ ID NO: 6239270 - DNA, 23 bp, Homo sapiens
gagactgcgggatggtcctgggg

SEQ ID NO: 6239271 - DNA, 17 bp, Homo sapiens
gagactgcgttctgcaa

SEQ ID NO: 6239272 - DNA, 19 bp, Homo sapiens
gagactgctcctgagcccc

SEQ ID NO: 6239273 - DNA, 17 bp, Homo sapiens
gagactgcttcccatcc

SEQ ID NO: 6239274 - DNA, 22 bp, Homo sapiens
gagactgcttcccatcctaccc

SEQ ID NO: 6239275 - DNA, 15 bp, Homo sapiens
gagactgcttgacaa

SEQ ID NO: 6239276 - DNA, 18 bp, Homo sapiens
gagactggaaaaggtgga

SEQ ID NO: 6239277 - DNA, 11 bp, Homo sapiens
gagactggagc

SEQ ID NO: 6239278 - DNA, 17 bp, Homo sapiens
gagactggcagccaggg

SEQ ID NO: 6239279 - DNA, 13 bp, Homo sapiens
gagactggcaggc

SEQ ID NO: 6239280 - DNA, 14 bp, Homo sapiens
gagactggcaggcg

SEQ ID NO: 6239281 - DNA, 15 bp, Homo sapiens
gagactggcaggcgg

SEQ ID NO: 6239282 - DNA, 20 bp, Homo sapiens
gagactggccagaggcagct

SEQ ID NO: 6239283 - DNA, 21 bp, Homo sapiens
gagactgggaagataggctct

SEQ ID NO: 6239284 - DNA, 22 bp, Homo sapiens
gagactgggcacccctgcctcc

SEQ ID NO: 6239285 - DNA, 23 bp, Homo sapiens
gagactgggcacccctgcctcct

SEQ ID NO: 6239286 - DNA, 22 bp, Homo sapiens
gagactgggcctaggccaggag

SEQ ID NO: 6239287 - DNA, 14 bp, Homo sapiens
gagactgggctctg

SEQ ID NO: 6239288 - DNA, 19 bp, Homo sapiens
gagactgggctctggctct

SEQ ID NO: 6239289 - DNA, 18 bp, Homo sapiens
gagactggggggcttgaa

SEQ ID NO: 6239290 - DNA, 19 bp, Homo sapiens
gagactggggtggcctcaa

SEQ ID NO: 6239291 - DNA, 14 bp, Homo sapiens
gagactggtaggag

SEQ ID NO: 6239292 - DNA, 23 bp, Homo sapiens
gagactggttagtgatgcagtta

SEQ ID NO: 6239293 - DNA, 22 bp, Homo sapiens
gagactgtacataattgcatga

SEQ ID NO: 6239294 - DNA, 12 bp, Homo sapiens
gagactgtccac

SEQ ID NO: 6239295 - DNA, 13 bp, Homo sapiens
gagactgtccctg

SEQ ID NO: 6239296 - DNA, 22 bp, Homo sapiens
gagactgtccctgaaacctagt

SEQ ID NO: 6239297 - DNA, 21 bp, Homo sapiens
gagactgtctcaaaaaaacaa

SEQ ID NO: 6239298 - DNA, 23 bp, Homo sapiens
gagactgtctcaagagggcactg

SEQ ID NO: 6239299 - DNA, 21 bp, Homo sapiens
gagactgtgaggcggcagctg

SEQ ID NO: 6239300 - DNA, 15 bp, Homo sapiens
gagactgtgccatgg

SEQ ID NO: 6239301 - DNA, 22 bp, Homo sapiens
gagactgtgccatggtgagaaa

SEQ ID NO: 6239302 - DNA, 23 bp, Homo sapiens
gagactgtgccatggtgagaaaa

SEQ ID NO: 6239303 - DNA, 12 bp, Homo sapiens
gagactgtgctg

SEQ ID NO: 6239304 - DNA, 13 bp, Homo sapiens
gagactgtgctgt

SEQ ID NO: 6239305 - DNA, 20 bp, Homo sapiens
gagactgtggagactgctcc

SEQ ID NO: 6239306 - DNA, 21 bp, Homo sapiens
gagactgtggagactgctcct

SEQ ID NO: 6239307 - DNA, 11 bp, Homo sapiens
gagactgtggt

SEQ ID NO: 6239308 - DNA, 15 bp, Homo sapiens
gagactgtggtaggg

SEQ ID NO: 6239309 - DNA, 19 bp, Homo sapiens
gagactgtggtttttgtgt

SEQ ID NO: 6239310 - DNA, 19 bp, Homo sapiens
gagactgtgtgtgccctct

SEQ ID NO: 6239311 - DNA, 16 bp, Homo sapiens
gagactgtttgaatgt

SEQ ID NO: 6239312 - DNA, 14 bp, Homo sapiens
gagactgtttggaa

SEQ ID NO: 6239313 - DNA, 19 bp, Homo sapiens
gagacttaatagacatttt

SEQ ID NO: 6239314 - DNA, 14 bp, Homo sapiens
gagacttaggccag

SEQ ID NO: 6239315 - DNA, 17 bp, Homo sapiens
gagacttaggccagagg

SEQ ID NO: 6239316 - DNA, 21 bp, Homo sapiens
gagacttagggcaccaggggt

SEQ ID NO: 6239317 - DNA, 23 bp, Homo sapiens
gagacttcaggttgttctgtata

SEQ ID NO: 6239318 - DNA, 14 bp, Homo sapiens
gagacttccgtcac

SEQ ID NO: 6239319 - DNA, 21 bp, Homo sapiens
gagacttcctattaatttatt

SEQ ID NO: 6239320 - DNA, 14 bp, Homo sapiens
gagacttcctctgg

SEQ ID NO: 6239321 - DNA, 13 bp, Homo sapiens
gagacttctctgt

SEQ ID NO: 6239322 - DNA, 19 bp, Homo sapiens
gagacttgagtctattttt

SEQ ID NO: 6239323 - DNA, 13 bp, Homo sapiens
gagacttgagtga

SEQ ID NO: 6239324 - DNA, 21 bp, Homo sapiens
gagacttgcagttagactcaa

SEQ ID NO: 6239325 - DNA, 13 bp, Homo sapiens
gagacttgccttc

SEQ ID NO: 6239326 - DNA, 22 bp, Homo sapiens
gagacttggccataaagataat

SEQ ID NO: 6239327 - DNA, 13 bp, Homo sapiens
gagacttgggaat

SEQ ID NO: 6239328 - DNA, 21 bp, Homo sapiens
gagacttgtgctcaaggaatc

SEQ ID NO: 6239329 - DNA, 14 bp, Homo sapiens
gagactttaaaagc

SEQ ID NO: 6239330 - DNA, 19 bp, Homo sapiens
gagactttacaaacctttg

SEQ ID NO: 6239331 - DNA, 12 bp, Homo sapiens
gagactttcagt

SEQ ID NO: 6239332 - DNA, 19 bp, Homo sapiens
gagactttccgactgcttt

SEQ ID NO: 6239333 - DNA, 13 bp, Homo sapiens
gagactttcttct

SEQ ID NO: 6239334 - DNA, 21 bp, Homo sapiens
gagactttgatactaccaggg

SEQ ID NO: 6239335 - DNA, 14 bp, Homo sapiens
gagactttgatgtc

SEQ ID NO: 6239336 - DNA, 14 bp, Homo sapiens
gagactttgctgtt

SEQ ID NO: 6239337 - DNA, 17 bp, Homo sapiens
gagactttgctgttact

SEQ ID NO: 6239338 - DNA, 16 bp, Homo sapiens
gagacttttttctagt

SEQ ID NO: 6239339 - DNA, 11 bp, Homo sapiens
gagagaaaaaa

SEQ ID NO: 6239340 - DNA, 20 bp, Homo sapiens
gagagaaaaagagagagcag

SEQ ID NO: 6239341 - DNA, 18 bp, Homo sapiens
gagagaaaacagacctaa

SEQ ID NO: 6239342 - DNA, 13 bp, Homo sapiens
gagagaaaactta

SEQ ID NO: 6239343 - DNA, 18 bp, Homo sapiens
gagagaaaagctggacct

SEQ ID NO: 6239344 - DNA, 16 bp, Homo sapiens
gagagaaaataaaaag

SEQ ID NO: 6239345 - DNA, 17 bp, Homo sapiens
gagagaaaataaaaagt

SEQ ID NO: 6239346 - DNA, 18 bp, Homo sapiens
gagagaaaataaaaagtt

SEQ ID NO: 6239347 - DNA, 21 bp, Homo sapiens
gagagaaaataaaaagttaaa

SEQ ID NO: 6239348 - DNA, 15 bp, Homo sapiens
gagagaaagaagata

SEQ ID NO: 6239349 - DNA, 21 bp, Homo sapiens
gagagaaagccaggcaggtag

SEQ ID NO: 6239350 - DNA, 17 bp, Homo sapiens
gagagaaagtgggtgag

SEQ ID NO: 6239351 - DNA, 20 bp, Homo sapiens
gagagaaagtgggtgagatg

SEQ ID NO: 6239352 - DNA, 21 bp, Homo sapiens
gagagaaataagtgccctctc

SEQ ID NO: 6239353 - DNA, 17 bp, Homo sapiens
gagagaaatcaggcctg

SEQ ID NO: 6239354 - DNA, 22 bp, Homo sapiens
gagagaacaacaggcaggggcc

SEQ ID NO: 6239355 - DNA, 15 bp, Homo sapiens
gagagaacagggatg

SEQ ID NO: 6239356 - DNA, 20 bp, Homo sapiens
gagagaacctaactgtatct

SEQ ID NO: 6239357 - DNA, 12 bp, Homo sapiens
gagagaagccag

SEQ ID NO: 6239358 - DNA, 17 bp, Homo sapiens
gagagaagccagccaca

SEQ ID NO: 6239359 - DNA, 14 bp, Homo sapiens
gagagaagctcttc

SEQ ID NO: 6239360 - DNA, 9 bp, Homo sapiens
gagagaagg

SEQ ID NO: 6239361 - DNA, 21 bp, Homo sapiens
gagagaaggggcccaagagag

SEQ ID NO: 6239362 - DNA, 13 bp, Homo sapiens
gagagaagtgccc

SEQ ID NO: 6239363 - DNA, 11 bp, Homo sapiens
gagagaataaa

SEQ ID NO: 6239364 - DNA, 18 bp, Homo sapiens
gagagaatagagctgcca

SEQ ID NO: 6239365 - DNA, 22 bp, Homo sapiens
gagagaatagagctgccactgg

SEQ ID NO: 6239366 - DNA, 16 bp, Homo sapiens
gagagaatatttcaaa

SEQ ID NO: 6239367 - DNA, 19 bp, Homo sapiens
gagagaatatttcaaatga

SEQ ID NO: 6239368 - DNA, 14 bp, Homo sapiens
gagagaatctgcct

SEQ ID NO: 6239369 - DNA, 16 bp, Homo sapiens
gagagaatggatcctc

SEQ ID NO: 6239370 - DNA, 15 bp, Homo sapiens
gagagaattctgttc

SEQ ID NO: 6239371 - DNA, 16 bp, Homo sapiens
gagagaattggctcaa

SEQ ID NO: 6239372 - DNA, 18 bp, Homo sapiens
gagagacaacttgctcct

SEQ ID NO: 6239373 - DNA, 13 bp, Homo sapiens
gagagacaagaag

SEQ ID NO: 6239374 - DNA, 17 bp, Homo sapiens
gagagacaagaagcaaa

SEQ ID NO: 6239375 - DNA, 19 bp, Homo sapiens
gagagacacaagtggcctt

SEQ ID NO: 6239376 - DNA, 18 bp, Homo sapiens
gagagacacagcgtccct

SEQ ID NO: 6239377 - DNA, 18 bp, Homo sapiens
gagagacactcccaggga

SEQ ID NO: 6239378 - DNA, 16 bp, Homo sapiens
gagagacactggtggg

SEQ ID NO: 6239379 - DNA, 18 bp, Homo sapiens
gagagacactggtgggga

SEQ ID NO: 6239380 - DNA, 12 bp, Homo sapiens
gagagacagcac

SEQ ID NO: 6239381 - DNA, 13 bp, Homo sapiens
gagagacaggcag

SEQ ID NO: 6239382 - DNA, 19 bp, Homo sapiens
gagagacaggcagctcgga

SEQ ID NO: 6239383 - DNA, 16 bp, Homo sapiens
gagagaccagcctttc

SEQ ID NO: 6239384 - DNA, 14 bp, Homo sapiens
gagagaccaggcaa

SEQ ID NO: 6239385 - DNA, 14 bp, Homo sapiens
gagagacccaagga

SEQ ID NO: 6239386 - DNA, 13 bp, Homo sapiens
gagagaccctcac

SEQ ID NO: 6239387 - DNA, 23 bp, Homo sapiens
gagagaccctcactgctggggag

SEQ ID NO: 6239388 - DNA, 14 bp, Homo sapiens
gagagaccctgcaa

SEQ ID NO: 6239389 - DNA, 16 bp, Homo sapiens
gagagaccctggcctc

SEQ ID NO: 6239390 - DNA, 17 bp, Homo sapiens
gagagacctgtgtgaac

SEQ ID NO: 6239391 - DNA, 21 bp, Homo sapiens
gagagacgccactccctggga

SEQ ID NO: 6239392 - DNA, 13 bp, Homo sapiens
gagagacgggccc

SEQ ID NO: 6239393 - DNA, 19 bp, Homo sapiens
gagagacgtgtacatagtg

SEQ ID NO: 6239394 - DNA, 20 bp, Homo sapiens
gagagacgtgtacatagtgt

SEQ ID NO: 6239395 - DNA, 15 bp, Homo sapiens
gcatcctccaagaat

SEQ ID NO: 6239396 - DNA, 19 bp, Homo sapiens
gcatcctccaagaatctat

SEQ ID NO: 6239397 - DNA, 18 bp, Homo sapiens
gcatcctccacaatagca

SEQ ID NO: 6239398 - DNA, 16 bp, Homo sapiens
gcatcctccccaccag

SEQ ID NO: 6239399 - DNA, 19 bp, Homo sapiens
gcatcctccccaccagagc

SEQ ID NO: 6239400 - DNA, 20 bp, Homo sapiens
gcatcctccccaccagagct

SEQ ID NO: 6239401 - DNA, 23 bp, Homo sapiens
gcatcctccccaccagagctgcc

SEQ ID NO: 6239402 - DNA, 15 bp, Homo sapiens
gcatcctccggagag

SEQ ID NO: 6239403 - DNA, 18 bp, Homo sapiens
gcatcctcctcagccccc

SEQ ID NO: 6239404 - DNA, 20 bp, Homo sapiens
gcatcctcctcagcccccag

SEQ ID NO: 6239405 - DNA, 17 bp, Homo sapiens
gcatcctcctcccaact

SEQ ID NO: 6239406 - DNA, 15 bp, Homo sapiens
gcatcctcctcctgg

SEQ ID NO: 6239407 - DNA, 12 bp, Homo sapiens
gcatcctctccc

SEQ ID NO: 6239408 - DNA, 16 bp, Homo sapiens
gcatcctctcccccac

SEQ ID NO: 6239409 - DNA, 15 bp, Homo sapiens
gcatcctctgctggt

SEQ ID NO: 6239410 - DNA, 20 bp, Homo sapiens
gcatcctctggagccagccg

SEQ ID NO: 6239411 - DNA, 13 bp, Homo sapiens
gcatcctgaggcc

SEQ ID NO: 6239412 - DNA, 12 bp, Homo sapiens
gcatcctgcctg

SEQ ID NO: 6239413 - DNA, 14 bp, Homo sapiens
gcatcctgcctggg

SEQ ID NO: 6239414 - DNA, 16 bp, Homo sapiens
gcatcctgcctgggtg

SEQ ID NO: 6239415 - DNA, 21 bp, Homo sapiens
gcatcctgccttagagccagg

SEQ ID NO: 6239416 - DNA, 14 bp, Homo sapiens
gcatcctgctgctt

SEQ ID NO: 6239417 - DNA, 14 bp, Homo sapiens
gcatcctgcttcct

SEQ ID NO: 6239418 - DNA, 16 bp, Homo sapiens
gcatcctgcttcctag

SEQ ID NO: 6239419 - DNA, 13 bp, Homo sapiens
gcatcctggaaat

SEQ ID NO: 6239420 - DNA, 14 bp, Homo sapiens
gcatcctggaaatt

SEQ ID NO: 6239421 - DNA, 22 bp, Homo sapiens
gcatcctggaaatttgtgtgct

SEQ ID NO: 6239422 - DNA, 11 bp, Homo sapiens
gcatcctgtga

SEQ ID NO: 6239423 - DNA, 22 bp, Homo sapiens
gcatccttaagtatcagaaagc

SEQ ID NO: 6239424 - DNA, 16 bp, Homo sapiens
gcatccttcccagcag

SEQ ID NO: 6239425 - DNA, 17 bp, Homo sapiens
gcatccttcccagcaga

SEQ ID NO: 6239426 - DNA, 13 bp, Homo sapiens
gcatccttcctat

SEQ ID NO: 6239427 - DNA, 16 bp, Homo sapiens
gcatccttcctataac

SEQ ID NO: 6239428 - DNA, 19 bp, Homo sapiens
gcatccttcctataacttg

SEQ ID NO: 6239429 - DNA, 16 bp, Homo sapiens
gcatccttcctgggga

SEQ ID NO: 6239430 - DNA, 15 bp, Homo sapiens
gcatccttgtaatac

SEQ ID NO: 6239431 - DNA, 17 bp, Homo sapiens
gcatccttgtcttttga

SEQ ID NO: 6239432 - DNA, 18 bp, Homo sapiens
gcatccttgtcttttgag

SEQ ID NO: 6239433 - DNA, 20 bp, Homo sapiens
gcatccttttctgcagaggg

SEQ ID NO: 6239434 - DNA, 18 bp, Homo sapiens
gcatcgcaccattctgac

SEQ ID NO: 6239435 - DNA, 23 bp, Homo sapiens
gcatcgctgttctgggcatggca

SEQ ID NO: 6239436 - DNA, 23 bp, Homo sapiens
gcatcggactaaactatctgtat

SEQ ID NO: 6239437 - DNA, 22 bp, Homo sapiens
gcatcggcagctgaaccctgct

SEQ ID NO: 6239438 - DNA, 17 bp, Homo sapiens
gcatcgggaaagaagaa

SEQ ID NO: 6239439 - DNA, 20 bp, Homo sapiens
gcatcgggagcacccagagc

SEQ ID NO: 6239440 - DNA, 22 bp, Homo sapiens
gcatcggggccatttggccggc

SEQ ID NO: 6239441 - DNA, 15 bp, Homo sapiens
gcatcggggtggccc

SEQ ID NO: 6239442 - DNA, 16 bp, Homo sapiens
gcatcggtcatgtgtg

SEQ ID NO: 6239443 - DNA, 22 bp, Homo sapiens
gcatcgtagaagagatgtggca

SEQ ID NO: 6239444 - DNA, 16 bp, Homo sapiens
gcatcgttgcatttta

SEQ ID NO: 6239445 - DNA, 12 bp, Homo sapiens
gcatctaaactt

SEQ ID NO: 6239446 - DNA, 15 bp, Homo sapiens
gcatctaaactttaa

SEQ ID NO: 6239447 - DNA, 21 bp, Homo sapiens
gcatctaagacattcaccaac

SEQ ID NO: 6239448 - DNA, 20 bp, Homo sapiens
gcatctaattcttattttta

SEQ ID NO: 6239449 - DNA, 14 bp, Homo sapiens
gcatctacacagcc

SEQ ID NO: 6239450 - DNA, 17 bp, Homo sapiens
gcatctacacagcctgg

SEQ ID NO: 6239451 - DNA, 16 bp, Homo sapiens
gcatctactctaaaga

SEQ ID NO: 6239452 - DNA, 21 bp, Homo sapiens
gcatctactctaaagaaaaat

SEQ ID NO: 6239453 - DNA, 21 bp, Homo sapiens
gcatctacttgccagaaccaa

SEQ ID NO: 6239454 - DNA, 23 bp, Homo sapiens
gcatctagaggcttccttcattt

SEQ ID NO: 6239455 - DNA, 18 bp, Homo sapiens
gcatctagccagaggctg

SEQ ID NO: 6239456 - DNA, 21 bp, Homo sapiens
gcatctagtttccctggtgcc

SEQ ID NO: 6239457 - DNA, 23 bp, Homo sapiens
gcatctatacgtaatttaaacaa

SEQ ID NO: 6239458 - DNA, 20 bp, Homo sapiens
gcatctatcgagtttgcaat

SEQ ID NO: 6239459 - DNA, 23 bp, Homo sapiens
gcatctattctttgtaccatctg

SEQ ID NO: 6239460 - DNA, 21 bp, Homo sapiens
gcatctcaaaacagagggctg

SEQ ID NO: 6239461 - DNA, 22 bp, Homo sapiens
gcatctcaaaacagagggctgc

SEQ ID NO: 6239462 - DNA, 14 bp, Homo sapiens
gcatctcaaatgtt

SEQ ID NO: 6239463 - DNA, 16 bp, Homo sapiens
gcatctcaaatgtttt

SEQ ID NO: 6239464 - DNA, 14 bp, Homo sapiens
gcatctcaatggaa

SEQ ID NO: 6239465 - DNA, 23 bp, Homo sapiens
gcatctcaatggaaacatcactg

SEQ ID NO: 6239466 - DNA, 16 bp, Homo sapiens
gcatctcacggaaccg

SEQ ID NO: 6239467 - DNA, 13 bp, Homo sapiens
gcatctcagagtc

SEQ ID NO: 6239468 - DNA, 12 bp, Homo sapiens
gcatctcagccc

SEQ ID NO: 6239469 - DNA, 13 bp, Homo sapiens
gcatctcagccca

SEQ ID NO: 6239470 - DNA, 14 bp, Homo sapiens
gcatctcagcccac

SEQ ID NO: 6239471 - DNA, 22 bp, Homo sapiens
gcatctcagctcatcttcactg

SEQ ID NO: 6239472 - DNA, 17 bp, Homo sapiens
gcatctcagtatgaatt

SEQ ID NO: 6239473 - DNA, 22 bp, Homo sapiens
gcatctcagtggtgtgtgaagt

SEQ ID NO: 6239474 - DNA, 17 bp, Homo sapiens
gcatctccaagcagctt

SEQ ID NO: 6239475 - DNA, 19 bp, Homo sapiens
gcatctccaagcagcttag

SEQ ID NO: 6239476 - DNA, 14 bp, Homo sapiens
gcatctccaggaag

SEQ ID NO: 6239477 - DNA, 16 bp, Homo sapiens
gcatctccaggaaggc

SEQ ID NO: 6239478 - DNA, 12 bp, Homo sapiens
gcatctccagtg

SEQ ID NO: 6239479 - DNA, 21 bp, Homo sapiens
gcatctcccagataatgtgaa

SEQ ID NO: 6239480 - DNA, 12 bp, Homo sapiens
gcatctccccca

SEQ ID NO: 6239481 - DNA, 21 bp, Homo sapiens
gcatctcccccaccctgtgcc

SEQ ID NO: 6239482 - DNA, 17 bp, Homo sapiens
gcatctcccctagctca

SEQ ID NO: 6239483 - DNA, 21 bp, Homo sapiens
gcatctcccctagctcaccag

SEQ ID NO: 6239484 - DNA, 17 bp, Homo sapiens
gcatctccctcactgaa

SEQ ID NO: 6239485 - DNA, 17 bp, Homo sapiens
gcatctccctgaccttc

SEQ ID NO: 6239486 - DNA, 19 bp, Homo sapiens
gcatctcctcccgcccttc

SEQ ID NO: 6239487 - DNA, 19 bp, Homo sapiens
gcatctcgtgccagggcag

SEQ ID NO: 6239488 - DNA, 22 bp, Homo sapiens
gcatctctaccttctccccagc

SEQ ID NO: 6239489 - DNA, 21 bp, Homo sapiens
gcatctctccccatatataaa

SEQ ID NO: 6239490 - DNA, 22 bp, Homo sapiens
gcatctctccccatatataaat

SEQ ID NO: 6239491 - DNA, 12 bp, Homo sapiens
gcatctctctgg

SEQ ID NO: 6239492 - DNA, 19 bp, Homo sapiens
gcatctctctgggatgcag

SEQ ID NO: 6239493 - DNA, 19 bp, Homo sapiens
gcatctctgagtgtctctg

SEQ ID NO: 6239494 - DNA, 21 bp, Homo sapiens
gcatctctgagtgtctctgcc

SEQ ID NO: 6239495 - DNA, 11 bp, Homo sapiens
gcatctctggg

SEQ ID NO: 6239496 - DNA, 14 bp, Homo sapiens
gcatctctgggctg

SEQ ID NO: 6239497 - DNA, 20 bp, Homo sapiens
gcatctctgggctggatgag

SEQ ID NO: 6239498 - DNA, 20 bp, Homo sapiens
gcatctctgtcccattccct

SEQ ID NO: 6239499 - DNA, 17 bp, Homo sapiens
gcatctcttccccagag

SEQ ID NO: 6239500 - DNA, 21 bp, Homo sapiens
gcatctcttcttccctgtcag

SEQ ID NO: 6239501 - DNA, 23 bp, Homo sapiens
gcatctcttcttccctgtcagcc

SEQ ID NO: 6239502 - DNA, 16 bp, Homo sapiens
gcatctcttgaggcca

SEQ ID NO: 6239503 - DNA, 21 bp, Homo sapiens
gcatctcttgaggccaggagt

SEQ ID NO: 6239504 - DNA, 21 bp, Homo sapiens
gcatctcttgtgtaccagctg

SEQ ID NO: 6239505 - DNA, 22 bp, Homo sapiens
gcatctctttagatccaaaata

SEQ ID NO: 6239506 - DNA, 14 bp, Homo sapiens
gcatctgaaaacaa

SEQ ID NO: 6239507 - DNA, 16 bp, Homo sapiens
gcatctgaaaattgat

SEQ ID NO: 6239508 - DNA, 20 bp, Homo sapiens
gcatctgaaataggaaacaa

SEQ ID NO: 6239509 - DNA, 20 bp, Homo sapiens
gcatctgaatgaaaataact

SEQ ID NO: 6239510 - DNA, 22 bp, Homo sapiens
gcatctgaatgaaaataactga

SEQ ID NO: 6239511 - DNA, 16 bp, Homo sapiens
gcatctgacaggtgaa

SEQ ID NO: 6239512 - DNA, 15 bp, Homo sapiens
gcatctgaccccggg

SEQ ID NO: 6239513 - DNA, 20 bp, Homo sapiens
gcatctgacctctaccttca

SEQ ID NO: 6239514 - DNA, 17 bp, Homo sapiens
gcatctgactcacaaga

SEQ ID NO: 6239515 - DNA, 18 bp, Homo sapiens
gcatctgagtccagctcc

SEQ ID NO: 6239516 - DNA, 15 bp, Homo sapiens
gcatctgataaagtt

SEQ ID NO: 6239517 - DNA, 22 bp, Homo sapiens
gcatctgattgagtcagtgttt

SEQ ID NO: 6239518 - DNA, 15 bp, Homo sapiens
gcatctgatttgcat

SEQ ID NO: 6239519 - DNA, 21 bp, Homo sapiens
gcatctgatttgcatattcat

SEQ ID NO: 6239520 - DNA, 17 bp, Homo sapiens
gcatctgcaacaaaaag

SEQ ID NO: 6239521 - DNA, 18 bp, Homo sapiens
gcatctgcccctccccca

SEQ ID NO: 6239522 - DNA, 12 bp, Homo sapiens
gcatctgcctgg

SEQ ID NO: 6239523 - DNA, 14 bp, Homo sapiens
gcatctgctctgag

SEQ ID NO: 6239524 - DNA, 18 bp, Homo sapiens
gcatctgctctgagacgg

SEQ ID NO: 6239525 - DNA, 14 bp, Homo sapiens
gcatctgctcttct

SEQ ID NO: 6239526 - DNA, 13 bp, Homo sapiens
gcatctgctttta

SEQ ID NO: 6239527 - DNA, 19 bp, Homo sapiens
gcatctggcacgtggccag

SEQ ID NO: 6239528 - DNA, 18 bp, Homo sapiens
gcatctggccctgctgcc

SEQ ID NO: 6239529 - DNA, 19 bp, Homo sapiens
gcatctggcctatgaccct

SEQ ID NO: 6239530 - DNA, 20 bp, Homo sapiens
gcatctggcctatgaccctg

SEQ ID NO: 6239531 - DNA, 15 bp, Homo sapiens
gcatctggcctggcc

SEQ ID NO: 6239532 - DNA, 17 bp, Homo sapiens
gcatctggcctggccag

SEQ ID NO: 6239533 - DNA, 18 bp, Homo sapiens
gcatctggcctggccagt

SEQ ID NO: 6239534 - DNA, 12 bp, Homo sapiens
gcatctggcctt

SEQ ID NO: 6239535 - DNA, 21 bp, Homo sapiens
gcatctggctaaggcatcatt

SEQ ID NO: 6239536 - DNA, 22 bp, Homo sapiens
gcatctggctgtctagaatgtg

SEQ ID NO: 6239537 - DNA, 22 bp, Homo sapiens
gcatctgggccttggcctggag

SEQ ID NO: 6239538 - DNA, 17 bp, Homo sapiens
gcatctgggtagctgta

SEQ ID NO: 6239539 - DNA, 19 bp, Homo sapiens
gcatctggtcttgtttcca

SEQ ID NO: 6239540 - DNA, 21 bp, Homo sapiens
gcatctgtataagtaagaaaa

SEQ ID NO: 6239541 - DNA, 22 bp, Homo sapiens
gcatctgtataagtaagaaaat

SEQ ID NO: 6239542 - DNA, 18 bp, Homo sapiens
gcatctgtcccactggga

SEQ ID NO: 6239543 - DNA, 19 bp, Homo sapiens
gcatctgtcccactgggac

SEQ ID NO: 6239544 - DNA, 20 bp, Homo sapiens
gcatctgtcccactgggaca

SEQ ID NO: 6239545 - DNA, 18 bp, Homo sapiens
gcatctgtctgaatggtg

SEQ ID NO: 6239546 - DNA, 17 bp, Homo sapiens
gcatctgtctgctctgc

SEQ ID NO: 6239547 - DNA, 15 bp, Homo sapiens
gcatctgtctgtcct

SEQ ID NO: 6239548 - DNA, 16 bp, Homo sapiens
gcatctgtctgtctgt

SEQ ID NO: 6239549 - DNA, 19 bp, Homo sapiens
gcatctgtctgtctgtggg

SEQ ID NO: 6239550 - DNA, 20 bp, Homo sapiens
gcatctgtctgtctgtgggc

SEQ ID NO: 6239551 - DNA, 17 bp, Homo sapiens
gcatctgtggcctgggg

SEQ ID NO: 6239552 - DNA, 19 bp, Homo sapiens
gcatctgtggcctggggcc

SEQ ID NO: 6239553 - DNA, 12 bp, Homo sapiens
gcatctgtgtgc

SEQ ID NO: 6239554 - DNA, 17 bp, Homo sapiens
gcatctgttagcagagt

SEQ ID NO: 6239555 - DNA, 18 bp, Homo sapiens
gcatctgttagcagagtc

SEQ ID NO: 6239556 - DNA, 19 bp, Homo sapiens
gcatctgttagcagagtct

SEQ ID NO: 6239557 - DNA, 16 bp, Homo sapiens
gcatcttactgaaggt

SEQ ID NO: 6239558 - DNA, 16 bp, Homo sapiens
gcatcttatagcactt

SEQ ID NO: 6239559 - DNA, 22 bp, Homo sapiens
gcatcttatagcactttgaaat

SEQ ID NO: 6239560 - DNA, 13 bp, Homo sapiens
gcatcttcctctg

SEQ ID NO: 6239561 - DNA, 13 bp, Homo sapiens
gcatcttctccat

SEQ ID NO: 6239562 - DNA, 15 bp, Homo sapiens
gcatcttctggcttg

SEQ ID NO: 6239563 - DNA, 15 bp, Homo sapiens
gcatcttgcctccag

SEQ ID NO: 6239564 - DNA, 17 bp, Homo sapiens
gcatcttgcctccaggt

SEQ ID NO: 6239565 - DNA, 22 bp, Homo sapiens
gcatcttgctctgtggccttgg

SEQ ID NO: 6239566 - DNA, 20 bp, Homo sapiens
gcatcttgtggctttgcaac

SEQ ID NO: 6239567 - DNA, 18 bp, Homo sapiens
gcatctttcatagttctg

SEQ ID NO: 6239568 - DNA, 13 bp, Homo sapiens
gcatctttccctg

SEQ ID NO: 6239569 - DNA, 20 bp, Homo sapiens
gcatctttgaatacaaagaa

SEQ ID NO: 6239570 - DNA, 16 bp, Homo sapiens
gcatctttggggaggt

SEQ ID NO: 6239571 - DNA, 21 bp, Homo sapiens
gcatcttttccatcctgaggt

SEQ ID NO: 6239572 - DNA, 23 bp, Homo sapiens
gcatcttttctagagacacattg

SEQ ID NO: 6239573 - DNA, 16 bp, Homo sapiens
gcatcttttgtattaa

SEQ ID NO: 6239574 - DNA, 19 bp, Homo sapiens
gcatcttttgtattaagaa

SEQ ID NO: 6239575 - DNA, 22 bp, Homo sapiens
gcatgaaactaggcttctgtaa

SEQ ID NO: 6239576 - DNA, 15 bp, Homo sapiens
gcatgaaagagaaag

SEQ ID NO: 6239577 - DNA, 20 bp, Homo sapiens
gcatgaaaggtaatctgaaa

SEQ ID NO: 6239578 - DNA, 18 bp, Homo sapiens
gcatgaaatgaacacaaa

SEQ ID NO: 6239579 - DNA, 20 bp, Homo sapiens
gcatgaaatgaatgtctgag

SEQ ID NO: 6239580 - DNA, 14 bp, Homo sapiens
gcatgaaatgtgaa

SEQ ID NO: 6239581 - DNA, 22 bp, Homo sapiens
gcatgaaatgtgaatttttatt

SEQ ID NO: 6239582 - DNA, 12 bp, Homo sapiens
gcatgaaatttt

SEQ ID NO: 6239583 - DNA, 17 bp, Homo sapiens
gcatgaacaagttttaa

SEQ ID NO: 6239584 - DNA, 21 bp, Homo sapiens
gcatgaacaatgggagcacat

SEQ ID NO: 6239585 - DNA, 21 bp, Homo sapiens
gcatgaacagctaattgtacc

SEQ ID NO: 6239586 - DNA, 19 bp, Homo sapiens
gcatgaacagggtccctgg

SEQ ID NO: 6239587 - DNA, 23 bp, Homo sapiens
gcatgaacgtggattgtatttaa

SEQ ID NO: 6239588 - DNA, 22 bp, Homo sapiens
gcatgaagagaagcaattttgg

SEQ ID NO: 6239589 - DNA, 18 bp, Homo sapiens
gcatgaagtaatatgcac

SEQ ID NO: 6239590 - DNA, 20 bp, Homo sapiens
gcatgaagtaatatgcacac

SEQ ID NO: 6239591 - DNA, 21 bp, Homo sapiens
gcatgaagtaatatgcacaca

SEQ ID NO: 6239592 - DNA, 18 bp, Homo sapiens
gcatgaataacatttaaa

SEQ ID NO: 6239593 - DNA, 21 bp, Homo sapiens
gcatgaataacatttaaattc

SEQ ID NO: 6239594 - DNA, 13 bp, Homo sapiens
gcatgaatatttc

SEQ ID NO: 6239595 - DNA, 14 bp, Homo sapiens
gcatgaatcactgt

SEQ ID NO: 6239596 - DNA, 21 bp, Homo sapiens
gcatgaattactgtatataaa

SEQ ID NO: 6239597 - DNA, 18 bp, Homo sapiens
gcatgaattggaactgca

SEQ ID NO: 6239598 - DNA, 15 bp, Homo sapiens
gcatgaatttgtaat

SEQ ID NO: 6239599 - DNA, 18 bp, Homo sapiens
gcatgacaaaaataacac

SEQ ID NO: 6239600 - DNA, 19 bp, Homo sapiens
gcatgacaaaaattatttt

SEQ ID NO: 6239601 - DNA, 15 bp, Homo sapiens
gcatgacaaaagtga

SEQ ID NO: 6239602 - DNA, 15 bp, Homo sapiens
gcatgacaagcccca

SEQ ID NO: 6239603 - DNA, 13 bp, Homo sapiens
gcatgacaaggtg

SEQ ID NO: 6239604 - DNA, 21 bp, Homo sapiens
gcatgacacgaatattgctga

SEQ ID NO: 6239605 - DNA, 18 bp, Homo sapiens
gcatgacagaaaatatgt

SEQ ID NO: 6239606 - DNA, 13 bp, Homo sapiens
gcatgacagcctc

SEQ ID NO: 6239607 - DNA, 14 bp, Homo sapiens
gcatgacagcctgc

SEQ ID NO: 6239608 - DNA, 16 bp, Homo sapiens
gcatgacagcctgcag

SEQ ID NO: 6239609 - DNA, 20 bp, Homo sapiens
gcatgacataacagtgcagg

SEQ ID NO: 6239610 - DNA, 14 bp, Homo sapiens
gcatgacatttctt

SEQ ID NO: 6239611 - DNA, 11 bp, Homo sapiens
gcatgaccaaa

SEQ ID NO: 6239612 - DNA, 21 bp, Homo sapiens
gcatgaccacccctctcgcct

SEQ ID NO: 6239613 - DNA, 17 bp, Homo sapiens
gcatgacccagtgaaga

SEQ ID NO: 6239614 - DNA, 22 bp, Homo sapiens
gcatgacccagtgaagatgcag

SEQ ID NO: 6239615 - DNA, 15 bp, Homo sapiens
gcatgaccctggagc

SEQ ID NO: 6239616 - DNA, 21 bp, Homo sapiens
gcatgacctaccaggacagaa

SEQ ID NO: 6239617 - DNA, 22 bp, Homo sapiens
gcatgacctaccaggacagaac

SEQ ID NO: 6239618 - DNA, 17 bp, Homo sapiens
gcatgacctcagtcagg

SEQ ID NO: 6239619 - DNA, 17 bp, Homo sapiens
gcatgacctgtgaccag

SEQ ID NO: 6239620 - DNA, 19 bp, Homo sapiens
gcatgaccttttggccttt

SEQ ID NO: 6239621 - DNA, 19 bp, Homo sapiens
gcatgactatgtatttttc

SEQ ID NO: 6239622 - DNA, 15 bp, Homo sapiens
gcatgactggacagc

SEQ ID NO: 6239623 - DNA, 14 bp, Homo sapiens
gcatgactgtcgcc

SEQ ID NO: 6239624 - DNA, 22 bp, Homo sapiens
gcatgacttgtgtgtgatgaga

SEQ ID NO: 6239625 - DNA, 14 bp, Homo sapiens
gcatgagaaataca

SEQ ID NO: 6239626 - DNA, 20 bp, Homo sapiens
gcatgagacattgacaccag

SEQ ID NO: 6239627 - DNA, 15 bp, Homo sapiens
gcatgagactttctg

SEQ ID NO: 6239628 - DNA, 15 bp, Homo sapiens
gcatgagaggaggca

SEQ ID NO: 6239629 - DNA, 20 bp, Homo sapiens
gcatgagatagctggtgtta

SEQ ID NO: 6239630 - DNA, 20 bp, Homo sapiens
gcatgagccactgagcctgg

SEQ ID NO: 6239631 - DNA, 21 bp, Homo sapiens
gcatgagccactgagcctggc

SEQ ID NO: 6239632 - DNA, 20 bp, Homo sapiens
gcatgagccactgtgcctgg

SEQ ID NO: 6239633 - DNA, 11 bp, Homo sapiens
gcatgagctga

SEQ ID NO: 6239634 - DNA, 20 bp, Homo sapiens
gcatgagctgatcagcctgt

SEQ ID NO: 6239635 - DNA, 13 bp, Homo sapiens
gcatgagctgctg

SEQ ID NO: 6239636 - DNA, 16 bp, Homo sapiens
gcatgagctgctgtgc

SEQ ID NO: 6239637 - DNA, 13 bp, Homo sapiens
gcatgagctggca

SEQ ID NO: 6239638 - DNA, 21 bp, Homo sapiens
gcatgagctggcaaccagcca

SEQ ID NO: 6239639 - DNA, 22 bp, Homo sapiens
gcatgagctggcaaccagccag

SEQ ID NO: 6239640 - DNA, 23 bp, Homo sapiens
gcatgagctggcaaccagccagc

SEQ ID NO: 6239641 - DNA, 13 bp, Homo sapiens
gcatgaggccccg

SEQ ID NO: 6239642 - DNA, 20 bp, Homo sapiens
gcatgaggccccgaggctcg

SEQ ID NO: 6239643 - DNA, 21 bp, Homo sapiens
gcatgaggccccgaggctcga

SEQ ID NO: 6239644 - DNA, 19 bp, Homo sapiens
gcatgaggggttcctcccc

SEQ ID NO: 6239645 - DNA, 18 bp, Homo sapiens
gcatgagtatctgtggga

SEQ ID NO: 6239646 - DNA, 15 bp, Homo sapiens
gcatgagttatctga

SEQ ID NO: 6239647 - DNA, 21 bp, Homo sapiens
gcatgagttatctgatttttt

SEQ ID NO: 6239648 - DNA, 16 bp, Homo sapiens
gcatgagttctgcaca

SEQ ID NO: 6239649 - DNA, 23 bp, Homo sapiens
gcatgagttctgcacatacagat

SEQ ID NO: 6239650 - DNA, 21 bp, Homo sapiens
gcatgataagccgaggaggca

SEQ ID NO: 6239651 - DNA, 23 bp, Homo sapiens
gcatgatagacacatatgagggg

SEQ ID NO: 6239652 - DNA, 15 bp, Homo sapiens
gcatgatatcttcaa

SEQ ID NO: 6239653 - DNA, 12 bp, Homo sapiens
gcatgatattgt

SEQ ID NO: 6239654 - DNA, 20 bp, Homo sapiens
gcatgatcatagctcactgc

SEQ ID NO: 6239655 - DNA, 18 bp, Homo sapiens
gcatgatccaagcaagac

SEQ ID NO: 6239656 - DNA, 23 bp, Homo sapiens
gcatgatccaagcaagactgagg

SEQ ID NO: 6239657 - DNA, 16 bp, Homo sapiens
gcatgatcttgttaat

SEQ ID NO: 6239658 - DNA, 21 bp, Homo sapiens
gcatgatcttgttaatgcatt

SEQ ID NO: 6239659 - DNA, 19 bp, Homo sapiens
gcatgatcttgttactgtg

SEQ ID NO: 6239660 - DNA, 19 bp, Homo sapiens
gcatgatgaaactgtcata

SEQ ID NO: 6239661 - DNA, 21 bp, Homo sapiens
gcatgatgccctcccctcagc

SEQ ID NO: 6239662 - DNA, 19 bp, Homo sapiens
gcatgatgggaaaatattt

SEQ ID NO: 6239663 - DNA, 20 bp, Homo sapiens
gcatgatgggaaaatatttc

SEQ ID NO: 6239664 - DNA, 17 bp, Homo sapiens
gcatgatgggaggtgtg

SEQ ID NO: 6239665 - DNA, 18 bp, Homo sapiens
gcatgatgggccgagcca

SEQ ID NO: 6239666 - DNA, 19 bp, Homo sapiens
gcatgatgtttccctctcc

SEQ ID NO: 6239667 - DNA, 14 bp, Homo sapiens
gcatgattctttaa

SEQ ID NO: 6239668 - DNA, 17 bp, Homo sapiens
gcatgatttactcttag

SEQ ID NO: 6239669 - DNA, 13 bp, Homo sapiens
gcatgatttgaaa

SEQ ID NO: 6239670 - DNA, 20 bp, Homo sapiens
gcatgattttaagaggcttt

SEQ ID NO: 6239671 - DNA, 13 bp, Homo sapiens
gcatgattttata

SEQ ID NO: 6239672 - DNA, 18 bp, Homo sapiens
gcatgcaaaagaaagcaa

SEQ ID NO: 6239673 - DNA, 22 bp, Homo sapiens
gcatgcaaaatatacactcatc

SEQ ID NO: 6239674 - DNA, 16 bp, Homo sapiens
gcatgcaaaccaggag

SEQ ID NO: 6239675 - DNA, 12 bp, Homo sapiens
gcatgcaactaa

SEQ ID NO: 6239676 - DNA, 14 bp, Homo sapiens
gcatgcaagctcag

SEQ ID NO: 6239677 - DNA, 15 bp, Homo sapiens
gcatgcaagctcagg

SEQ ID NO: 6239678 - DNA, 19 bp, Homo sapiens
gcatgcaagcttggtcaaa

SEQ ID NO: 6239679 - DNA, 21 bp, Homo sapiens
gcatgcaagcttggtcaaact

SEQ ID NO: 6239680 - DNA, 17 bp, Homo sapiens
gcatgcaataatgtgca

SEQ ID NO: 6239681 - DNA, 15 bp, Homo sapiens
gcatgcacactgaga

SEQ ID NO: 6239682 - DNA, 15 bp, Homo sapiens
gcatgcacagctgct

SEQ ID NO: 6239683 - DNA, 20 bp, Homo sapiens
gcatgcaccagtgccgcctg

SEQ ID NO: 6239684 - DNA, 23 bp, Homo sapiens
gcatgcactgttccccctgtgca

SEQ ID NO: 6239685 - DNA, 17 bp, Homo sapiens
gcatgcagcaacaccca

SEQ ID NO: 6239686 - DNA, 19 bp, Homo sapiens
gcatgcagcaacacccaag

SEQ ID NO: 6239687 - DNA, 20 bp, Homo sapiens
gcatgcagcaacacccaagt

SEQ ID NO: 6239688 - DNA, 15 bp, Homo sapiens
gcatgcagcagcttg

SEQ ID NO: 6239689 - DNA, 17 bp, Homo sapiens
gcatgcagcagcttgct

SEQ ID NO: 6239690 - DNA, 17 bp, Homo sapiens
gcatgcagctgcctggg

SEQ ID NO: 6239691 - DNA, 18 bp, Homo sapiens
gcatgcagctgcctgggg

SEQ ID NO: 6239692 - DNA, 20 bp, Homo sapiens
gcatgcagctgcctggggcc

SEQ ID NO: 6239693 - DNA, 17 bp, Homo sapiens
gcatgcagctttgcaaa

SEQ ID NO: 6239694 - DNA, 17 bp, Homo sapiens
gcatgcaggctgtgttt

SEQ ID NO: 6239695 - DNA, 21 bp, Homo sapiens
gcatgcagggcccccacagga

SEQ ID NO: 6239696 - DNA, 23 bp, Homo sapiens
gcatgcagggcccccacaggagc

SEQ ID NO: 6239697 - DNA, 12 bp, Homo sapiens
gcatgcagtgtt

SEQ ID NO: 6239698 - DNA, 16 bp, Homo sapiens
gcatgcatgccctctc

SEQ ID NO: 6239699 - DNA, 14 bp, Homo sapiens
gcatgcatggagga

SEQ ID NO: 6239700 - DNA, 18 bp, Homo sapiens
gcatgcatggaggactct

SEQ ID NO: 6239701 - DNA, 20 bp, Homo sapiens
gcatgcatgggaggaattca

SEQ ID NO: 6239702 - DNA, 23 bp, Homo sapiens
gcatgccaacgcagttcatgtac

SEQ ID NO: 6239703 - DNA, 20 bp, Homo sapiens
gcatgccacgccccgtgtct

SEQ ID NO: 6239704 - DNA, 15 bp, Homo sapiens
gcatgccagagcctg

SEQ ID NO: 6239705 - DNA, 13 bp, Homo sapiens
gcatgccaggacc

SEQ ID NO: 6239706 - DNA, 14 bp, Homo sapiens
gcatgccatgtctg

SEQ ID NO: 6239707 - DNA, 18 bp, Homo sapiens
gcatgccccctcgtgcca

SEQ ID NO: 6239708 - DNA, 19 bp, Homo sapiens
gcatgccccctcgtgccag

SEQ ID NO: 6239709 - DNA, 16 bp, Homo sapiens
gcatgccccggccacc

SEQ ID NO: 6239710 - DNA, 18 bp, Homo sapiens
gcatgccccggccacctc

SEQ ID NO: 6239711 - DNA, 21 bp, Homo sapiens
gcatgccccggccacctctgc

SEQ ID NO: 6239712 - DNA, 23 bp, Homo sapiens
gcatgccccggccacctctgcgg

SEQ ID NO: 6239713 - DNA, 18 bp, Homo sapiens
gcatgccccttggctgga

SEQ ID NO: 6239714 - DNA, 19 bp, Homo sapiens
gcatgccctccccacttcc

SEQ ID NO: 6239715 - DNA, 15 bp, Homo sapiens
gcatgccctctcagg

SEQ ID NO: 6239716 - DNA, 20 bp, Homo sapiens
gcatgccctgagctctctga

SEQ ID NO: 6239717 - DNA, 19 bp, Homo sapiens
gcatgccgagtgccccaga

SEQ ID NO: 6239718 - DNA, 12 bp, Homo sapiens
gcatgcctcagc

SEQ ID NO: 6239719 - DNA, 22 bp, Homo sapiens
gcatgcctcagccagccctgga

SEQ ID NO: 6239720 - DNA, 17 bp, Homo sapiens
gcatgcctcccaggcca

SEQ ID NO: 6239721 - DNA, 18 bp, Homo sapiens
gcatgcctcccaggccac

SEQ ID NO: 6239722 - DNA, 22 bp, Homo sapiens
gcatgcctgagagacatggctt

SEQ ID NO: 6239723 - DNA, 14 bp, Homo sapiens
gcatgcctggatgg

SEQ ID NO: 6239724 - DNA, 15 bp, Homo sapiens
gcatgcctggatggg

SEQ ID NO: 6239725 - DNA, 17 bp, Homo sapiens
gcatgcctggatggggc

SEQ ID NO: 6239726 - DNA, 17 bp, Homo sapiens
gcatgcctggcccctcc

SEQ ID NO: 6239727 - DNA, 14 bp, Homo sapiens
gcatgcctggcctg

SEQ ID NO: 6239728 - DNA, 23 bp, Homo sapiens
gcatgcctgggaatcctgctgcc

SEQ ID NO: 6239729 - DNA, 21 bp, Homo sapiens
gcatgcctgtagtctcagcta

SEQ ID NO: 6239730 - DNA, 21 bp, Homo sapiens
gcatgccttccagcaccctgc

SEQ ID NO: 6239731 - DNA, 15 bp, Homo sapiens
gcatgcgcagaggcc

SEQ ID NO: 6239732 - DNA, 16 bp, Homo sapiens
gcatgcggcccagccc

SEQ ID NO: 6239733 - DNA, 15 bp, Homo sapiens
gcatgctagtgttgt

SEQ ID NO: 6239734 - DNA, 21 bp, Homo sapiens
gcatgctagtgttgtatttct

SEQ ID NO: 6239735 - DNA, 16 bp, Homo sapiens
gcatgctcagcccttc

SEQ ID NO: 6239736 - DNA, 17 bp, Homo sapiens
gcatgctcagcccttcc

SEQ ID NO: 6239737 - DNA, 15 bp, Homo sapiens
gcatgctcagtattg

SEQ ID NO: 6239738 - DNA, 15 bp, Homo sapiens
gcatgctcagtgcct

SEQ ID NO: 6239739 - DNA, 17 bp, Homo sapiens
gcatgctcccagcattt

SEQ ID NO: 6239740 - DNA, 19 bp, Homo sapiens
gcatgctccctcatgcaga

SEQ ID NO: 6239741 - DNA, 14 bp, Homo sapiens
gcatgctcctctgc

SEQ ID NO: 6239742 - DNA, 16 bp, Homo sapiens
gcatgctcctctgcct

SEQ ID NO: 6239743 - DNA, 18 bp, Homo sapiens
gcatgctcctctgcctgt

SEQ ID NO: 6239744 - DNA, 20 bp, Homo sapiens
gcatgctctggaagcctgga

SEQ ID NO: 6239745 - DNA, 21 bp, Homo sapiens
gcatgctcttacccacactac

SEQ ID NO: 6239746 - DNA, 13 bp, Homo sapiens
gcatgctgaaaca

SEQ ID NO: 6239747 - DNA, 16 bp, Homo sapiens
gcatgctgataatcat

SEQ ID NO: 6239748 - DNA, 20 bp, Homo sapiens
gcatgctgataatcattttg

SEQ ID NO: 6239749 - DNA, 19 bp, Homo sapiens
gagagactcccatgaagcc

SEQ ID NO: 6239750 - DNA, 20 bp, Homo sapiens
gagagactcccatgaagcct

SEQ ID NO: 6239751 - DNA, 16 bp, Homo sapiens
gagagacttggaagag

SEQ ID NO: 6239752 - DNA, 16 bp, Homo sapiens
gagagacttggatgag

SEQ ID NO: 6239753 - DNA, 10 bp, Homo sapiens
gagagagaaa

SEQ ID NO: 6239754 - DNA, 14 bp, Homo sapiens
gagagagaaagaat

SEQ ID NO: 6239755 - DNA, 11 bp, Homo sapiens
gagagagaaat

SEQ ID NO: 6239756 - DNA, 20 bp, Homo sapiens
gagagagaaattctgttaaa

SEQ ID NO: 6239757 - DNA, 15 bp, Homo sapiens
gagagagaagcaggc

SEQ ID NO: 6239758 - DNA, 14 bp, Homo sapiens
gagagagaatcaga

SEQ ID NO: 6239759 - DNA, 15 bp, Homo sapiens
gagagagaatcagac

SEQ ID NO: 6239760 - DNA, 10 bp, Homo sapiens
gagagagaca

SEQ ID NO: 6239761 - DNA, 13 bp, Homo sapiens
gagagagagaaag

SEQ ID NO: 6239762 - DNA, 15 bp, Homo sapiens
gagagagagaagggg

SEQ ID NO: 6239763 - DNA, 14 bp, Homo sapiens
gagagagagagaag

SEQ ID NO: 6239764 - DNA, 15 bp, Homo sapiens
gagagagagagaagg

SEQ ID NO: 6239765 - DNA, 14 bp, Homo sapiens
gagagagagagagg

SEQ ID NO: 6239766 - DNA, 15 bp, Homo sapiens
gagagagagagaggt

SEQ ID NO: 6239767 - DNA, 13 bp, Homo sapiens
gagagagagaggt

SEQ ID NO: 6239768 - DNA, 15 bp, Homo sapiens
gagagagaggctgcc

SEQ ID NO: 6239769 - DNA, 14 bp, Homo sapiens
gagagagaggttct

SEQ ID NO: 6239770 - DNA, 16 bp, Homo sapiens
gagagagagtgtgtgt

SEQ ID NO: 6239771 - DNA, 19 bp, Homo sapiens
gagagagatctagaaagtg

SEQ ID NO: 6239772 - DNA, 17 bp, Homo sapiens
gagagagatgctgctcc

SEQ ID NO: 6239773 - DNA, 15 bp, Homo sapiens
gagagagatgtgtaa

SEQ ID NO: 6239774 - DNA, 15 bp, Homo sapiens
gagagagcaaggaag

SEQ ID NO: 6239775 - DNA, 14 bp, Homo sapiens
gagagagcaatctt

SEQ ID NO: 6239776 - DNA, 19 bp, Homo sapiens
gagagagcaatcttgctgt

SEQ ID NO: 6239777 - DNA, 22 bp, Homo sapiens
gagagagcaatcttgctgtgaa

SEQ ID NO: 6239778 - DNA, 14 bp, Homo sapiens
gagagagcagccag

SEQ ID NO: 6239779 - DNA, 12 bp, Homo sapiens
gagagagccaag

SEQ ID NO: 6239780 - DNA, 13 bp, Homo sapiens
gagagagccagga

SEQ ID NO: 6239781 - DNA, 20 bp, Homo sapiens
gagagagcgcgggagagagt

SEQ ID NO: 6239782 - DNA, 13 bp, Homo sapiens
gagagagctggag

SEQ ID NO: 6239783 - DNA, 22 bp, Homo sapiens
gagagaggaaggagattccaca

SEQ ID NO: 6239784 - DNA, 12 bp, Homo sapiens
gagagaggacct

SEQ ID NO: 6239785 - DNA, 20 bp, Homo sapiens
gagagaggacctccatgccc

SEQ ID NO: 6239786 - DNA, 13 bp, Homo sapiens
gagagaggaggag

SEQ ID NO: 6239787 - DNA, 18 bp, Homo sapiens
gagagaggatgcagaggg

SEQ ID NO: 6239788 - DNA, 18 bp, Homo sapiens
gagagaggcaatggctcc

SEQ ID NO: 6239789 - DNA, 15 bp, Homo sapiens
gagagaggcagagag

SEQ ID NO: 6239790 - DNA, 16 bp, Homo sapiens
gagagaggcgtcctgg

SEQ ID NO: 6239791 - DNA, 18 bp, Homo sapiens
gagagaggctaaaatgtt

SEQ ID NO: 6239792 - DNA, 14 bp, Homo sapiens
gagagaggctgcct

SEQ ID NO: 6239793 - DNA, 23 bp, Homo sapiens
gagagagggactcaagggaaagg

SEQ ID NO: 6239794 - DNA, 20 bp, Homo sapiens
gagagagggcgcccagccca

SEQ ID NO: 6239795 - DNA, 23 bp, Homo sapiens
gagagagggcgcccagcccaggc

SEQ ID NO: 6239796 - DNA, 12 bp, Homo sapiens
gagagaggggaa

SEQ ID NO: 6239797 - DNA, 20 bp, Homo sapiens
gagagaggtatttaactgca

SEQ ID NO: 6239798 - DNA, 16 bp, Homo sapiens
gagagaggtgggcagc

SEQ ID NO: 6239799 - DNA, 17 bp, Homo sapiens
gagagaggttgaaaaac

SEQ ID NO: 6239800 - DNA, 23 bp, Homo sapiens
gagagagtcttttaactttagaa

SEQ ID NO: 6239801 - DNA, 14 bp, Homo sapiens
gagagagtgagaga

SEQ ID NO: 6239802 - DNA, 16 bp, Homo sapiens
gagagagtgagagaga

SEQ ID NO: 6239803 - DNA, 14 bp, Homo sapiens
gagagagtggtaaa

SEQ ID NO: 6239804 - DNA, 17 bp, Homo sapiens
gagagagtggtaaaaaa

SEQ ID NO: 6239805 - DNA, 13 bp, Homo sapiens
gagagagtgtgga

SEQ ID NO: 6239806 - DNA, 16 bp, Homo sapiens
gagagagttgaaccta

SEQ ID NO: 6239807 - DNA, 21 bp, Homo sapiens
gagagagttgttttaataact

SEQ ID NO: 6239808 - DNA, 14 bp, Homo sapiens
gagagagtttatca

SEQ ID NO: 6239809 - DNA, 16 bp, Homo sapiens
gagagataatgaggca

SEQ ID NO: 6239810 - DNA, 18 bp, Homo sapiens
gagagataatgaggcaac

SEQ ID NO: 6239811 - DNA, 17 bp, Homo sapiens
gagagataccttgaaaa

SEQ ID NO: 6239812 - DNA, 18 bp, Homo sapiens
gagagatagcctgtggcc

SEQ ID NO: 6239813 - DNA, 14 bp, Homo sapiens
gagagatcaaagat

SEQ ID NO: 6239814 - DNA, 15 bp, Homo sapiens
gagagatcaaagatg

SEQ ID NO: 6239815 - DNA, 16 bp, Homo sapiens
gagagatctccaactc

SEQ ID NO: 6239816 - DNA, 20 bp, Homo sapiens
gagagatgggccaggcagag

SEQ ID NO: 6239817 - DNA, 16 bp, Homo sapiens
gagagatgtctgttct

SEQ ID NO: 6239818 - DNA, 12 bp, Homo sapiens
gagagatgtgtg

SEQ ID NO: 6239819 - DNA, 14 bp, Homo sapiens
gagagattctccat

SEQ ID NO: 6239820 - DNA, 23 bp, Homo sapiens
gagagattggccagcaaaaactg

SEQ ID NO: 6239821 - DNA, 18 bp, Homo sapiens
gagagcaaacataggaat

SEQ ID NO: 6239822 - DNA, 14 bp, Homo sapiens
gagagcaacaagta

SEQ ID NO: 6239823 - DNA, 15 bp, Homo sapiens
gagagcaacatttta

SEQ ID NO: 6239824 - DNA, 17 bp, Homo sapiens
gagagcaactctgagat

SEQ ID NO: 6239825 - DNA, 20 bp, Homo sapiens
gagagcaactctgagatcta

SEQ ID NO: 6239826 - DNA, 13 bp, Homo sapiens
gagagcacaaaga

SEQ ID NO: 6239827 - DNA, 18 bp, Homo sapiens
gagagcacaaagataacg

SEQ ID NO: 6239828 - DNA, 20 bp, Homo sapiens
gagagcacagtgatcaccag

SEQ ID NO: 6239829 - DNA, 22 bp, Homo sapiens
gagagcactagaagtggtttcc

SEQ ID NO: 6239830 - DNA, 15 bp, Homo sapiens
gagagcactgcctct

SEQ ID NO: 6239831 - DNA, 20 bp, Homo sapiens
gagagcactgcctctatgcc

SEQ ID NO: 6239832 - DNA, 14 bp, Homo sapiens
gagagcagaaataa

SEQ ID NO: 6239833 - DNA, 21 bp, Homo sapiens
gagagcagagaagtacaggtc

SEQ ID NO: 6239834 - DNA, 14 bp, Homo sapiens
gagagcagagaata

SEQ ID NO: 6239835 - DNA, 12 bp, Homo sapiens
gagagcagaggg

SEQ ID NO: 6239836 - DNA, 14 bp, Homo sapiens
gagagcagcactcc

SEQ ID NO: 6239837 - DNA, 17 bp, Homo sapiens
gagagcagcgcccaggc

SEQ ID NO: 6239838 - DNA, 21 bp, Homo sapiens
gagagcagctccctttctcag

SEQ ID NO: 6239839 - DNA, 14 bp, Homo sapiens
gagagcagctggct

SEQ ID NO: 6239840 - DNA, 22 bp, Homo sapiens
gagagcagcttctgccacttcc

SEQ ID NO: 6239841 - DNA, 23 bp, Homo sapiens
gagagcagctttaaactcaggga

SEQ ID NO: 6239842 - DNA, 12 bp, Homo sapiens
gagagcaggcag

SEQ ID NO: 6239843 - DNA, 13 bp, Homo sapiens
gagagcaggctgg

SEQ ID NO: 6239844 - DNA, 14 bp, Homo sapiens
gagagcaggctggc

SEQ ID NO: 6239845 - DNA, 16 bp, Homo sapiens
gagagcagggctgggc

SEQ ID NO: 6239846 - DNA, 13 bp, Homo sapiens
gagagcaggggag

SEQ ID NO: 6239847 - DNA, 18 bp, Homo sapiens
gagagcaggggagcttgg

SEQ ID NO: 6239848 - DNA, 13 bp, Homo sapiens
gagagcagtgctt

SEQ ID NO: 6239849 - DNA, 18 bp, Homo sapiens
gagagcatcggcctaggg

SEQ ID NO: 6239850 - DNA, 18 bp, Homo sapiens
gagagcatctgctctgag

SEQ ID NO: 6239851 - DNA, 19 bp, Homo sapiens
gagagcatctgctctgaga

SEQ ID NO: 6239852 - DNA, 15 bp, Homo sapiens
gagagccaaacagag

SEQ ID NO: 6239853 - DNA, 15 bp, Homo sapiens
gagagccaaatctga

SEQ ID NO: 6239854 - DNA, 16 bp, Homo sapiens
gagagccaccaagagg

SEQ ID NO: 6239855 - DNA, 15 bp, Homo sapiens
gagagccactgggcc

SEQ ID NO: 6239856 - DNA, 19 bp, Homo sapiens
gagagccactgggcccctg

SEQ ID NO: 6239857 - DNA, 22 bp, Homo sapiens
gagagccagagaagtgacaggg

SEQ ID NO: 6239858 - DNA, 19 bp, Homo sapiens
gagagccagatgcctcccc

SEQ ID NO: 6239859 - DNA, 14 bp, Homo sapiens
gagagccagcagca

SEQ ID NO: 6239860 - DNA, 13 bp, Homo sapiens
gagagccagccct

SEQ ID NO: 6239861 - DNA, 14 bp, Homo sapiens
gagagccagccctc

SEQ ID NO: 6239862 - DNA, 12 bp, Homo sapiens
gagagccagctt

SEQ ID NO: 6239863 - DNA, 14 bp, Homo sapiens
gagagccaggatgc

SEQ ID NO: 6239864 - DNA, 16 bp, Homo sapiens
gagagccaggatgccc

SEQ ID NO: 6239865 - DNA, 19 bp, Homo sapiens
gagagccaggatgcccaga

SEQ ID NO: 6239866 - DNA, 12 bp, Homo sapiens
gagagccaggct

SEQ ID NO: 6239867 - DNA, 23 bp, Homo sapiens
gagagcccaagttatctttccct

SEQ ID NO: 6239868 - DNA, 10 bp, Homo sapiens
gagagcccag

SEQ ID NO: 6239869 - DNA, 14 bp, Homo sapiens
gagagcccagaggt

SEQ ID NO: 6239870 - DNA, 15 bp, Homo sapiens
gagagcccaggagct

SEQ ID NO: 6239871 - DNA, 20 bp, Homo sapiens
gagagcccaggagctcccct

SEQ ID NO: 6239872 - DNA, 23 bp, Homo sapiens
gagagccccacccctgaactggc

SEQ ID NO: 6239873 - DNA, 13 bp, Homo sapiens
gagagccccagct

SEQ ID NO: 6239874 - DNA, 14 bp, Homo sapiens
gagagccccatggt

SEQ ID NO: 6239875 - DNA, 23 bp, Homo sapiens
gagagcccgaggaggtgtctcag

SEQ ID NO: 6239876 - DNA, 18 bp, Homo sapiens
gagagcccgcgtgctgga

SEQ ID NO: 6239877 - DNA, 18 bp, Homo sapiens
gagagccctctgctgctt

SEQ ID NO: 6239878 - DNA, 19 bp, Homo sapiens
gagagccctgaggcctaga

SEQ ID NO: 6239879 - DNA, 19 bp, Homo sapiens
gagagccctgctgtgggag

SEQ ID NO: 6239880 - DNA, 11 bp, Homo sapiens
gagagccctgg

SEQ ID NO: 6239881 - DNA, 14 bp, Homo sapiens
gagagcccttccca

SEQ ID NO: 6239882 - DNA, 19 bp, Homo sapiens
gagagcccttcccagggca

SEQ ID NO: 6239883 - DNA, 20 bp, Homo sapiens
gagagcccttcccagggcac

SEQ ID NO: 6239884 - DNA, 19 bp, Homo sapiens
gagagccgtggtccctgag

SEQ ID NO: 6239885 - DNA, 23 bp, Homo sapiens
gagagcctccctgcagccaccag

SEQ ID NO: 6239886 - DNA, 19 bp, Homo sapiens
gagagcctcttagtgattg

SEQ ID NO: 6239887 - DNA, 21 bp, Homo sapiens
gagagcctgctcccccacccc

SEQ ID NO: 6239888 - DNA, 23 bp, Homo sapiens
gagagcctgctcccccaccccct

SEQ ID NO: 6239889 - DNA, 13 bp, Homo sapiens
gagagcctggggg

SEQ ID NO: 6239890 - DNA, 19 bp, Homo sapiens
gagagcctggtgctgctgc

SEQ ID NO: 6239891 - DNA, 20 bp, Homo sapiens
gagagcctgtcaccagagct

SEQ ID NO: 6239892 - DNA, 21 bp, Homo sapiens
gagagcctgtcaccagagctt

SEQ ID NO: 6239893 - DNA, 22 bp, Homo sapiens
gagagcctgtggaggggcttgg

SEQ ID NO: 6239894 - DNA, 18 bp, Homo sapiens
gagagccttaatggatgc

SEQ ID NO: 6239895 - DNA, 21 bp, Homo sapiens
gagagccttggcgagggcagc

SEQ ID NO: 6239896 - DNA, 14 bp, Homo sapiens
gagagccttgggag

SEQ ID NO: 6239897 - DNA, 18 bp, Homo sapiens
gagagccttgggagccac

SEQ ID NO: 6239898 - DNA, 20 bp, Homo sapiens
gagagcctttggtgaataac

SEQ ID NO: 6239899 - DNA, 22 bp, Homo sapiens
gagagcgaccagcaggctcctc

SEQ ID NO: 6239900 - DNA, 15 bp, Homo sapiens
gagagcgagaccctg

SEQ ID NO: 6239901 - DNA, 14 bp, Homo sapiens
gagagcgaggaggc

SEQ ID NO: 6239902 - DNA, 16 bp, Homo sapiens
gagagcgcctgcccct

SEQ ID NO: 6239903 - DNA, 15 bp, Homo sapiens
gagagcgcgggagag

SEQ ID NO: 6239904 - DNA, 17 bp, Homo sapiens
gagagcggctggagaaa

SEQ ID NO: 6239905 - DNA, 21 bp, Homo sapiens
gagagcgtgctccagcctggc

SEQ ID NO: 6239906 - DNA, 23 bp, Homo sapiens
gagagcgtgctccagcctggctc

SEQ ID NO: 6239907 - DNA, 19 bp, Homo sapiens
gagagctagaacccggcag

SEQ ID NO: 6239908 - DNA, 20 bp, Homo sapiens
gagagctagaacccggcagg

SEQ ID NO: 6239909 - DNA, 16 bp, Homo sapiens
gagagctagaacctgg

SEQ ID NO: 6239910 - DNA, 19 bp, Homo sapiens
gagagctagaacctggagg

SEQ ID NO: 6239911 - DNA, 13 bp, Homo sapiens
gagagctaggagc

SEQ ID NO: 6239912 - DNA, 14 bp, Homo sapiens
gagagctaggagca

SEQ ID NO: 6239913 - DNA, 13 bp, Homo sapiens
gagagctcaccat

SEQ ID NO: 6239914 - DNA, 19 bp, Homo sapiens
gagagctcagtacagggca

SEQ ID NO: 6239915 - DNA, 21 bp, Homo sapiens
gagagctctctcttctctgtt

SEQ ID NO: 6239916 - DNA, 11 bp, Homo sapiens
gagagctctta

SEQ ID NO: 6239917 - DNA, 18 bp, Homo sapiens
gagagctcttagttttta

SEQ ID NO: 6239918 - DNA, 12 bp, Homo sapiens
gagagctgctga

SEQ ID NO: 6239919 - DNA, 22 bp, Homo sapiens
gagagctggagtctgggctcct

SEQ ID NO: 6239920 - DNA, 12 bp, Homo sapiens
gagagctggccc

SEQ ID NO: 6239921 - DNA, 13 bp, Homo sapiens
gagagctgggact

SEQ ID NO: 6239922 - DNA, 18 bp, Homo sapiens
gagagctgggactcagtt

SEQ ID NO: 6239923 - DNA, 23 bp, Homo sapiens
gagagctgggcagacaggtggga

SEQ ID NO: 6239924 - DNA, 23 bp, Homo sapiens
gagagctggtgactttggggaca

SEQ ID NO: 6239925 - DNA, 21 bp, Homo sapiens
gagagctgtattaagtgactg

SEQ ID NO: 6239926 - DNA, 19 bp, Homo sapiens
gagagctgtcttcctgtgt

SEQ ID NO: 6239927 - DNA, 11 bp, Homo sapiens
gagagctgttc

SEQ ID NO: 6239928 - DNA, 12 bp, Homo sapiens
gagagctgttcc

SEQ ID NO: 6239929 - DNA, 18 bp, Homo sapiens
gagagctgttcccaaatt

SEQ ID NO: 6239930 - DNA, 19 bp, Homo sapiens
gagagcttcaggccccagg

SEQ ID NO: 6239931 - DNA, 21 bp, Homo sapiens
gcatgctgcccagccactcca

SEQ ID NO: 6239932 - DNA, 12 bp, Homo sapiens
gcatgctgcctg

SEQ ID NO: 6239933 - DNA, 15 bp, Homo sapiens
gcatgctgcctgcct

SEQ ID NO: 6239934 - DNA, 16 bp, Homo sapiens
gcatgctgcctgcctc

SEQ ID NO: 6239935 - DNA, 17 bp, Homo sapiens
gcatgctgcctgcctcc

SEQ ID NO: 6239936 - DNA, 21 bp, Homo sapiens
gcatgctgcctgcctccggcc

SEQ ID NO: 6239937 - DNA, 14 bp, Homo sapiens
gcatgctgctttaa

SEQ ID NO: 6239938 - DNA, 19 bp, Homo sapiens
gcatgctggagtacccagc

SEQ ID NO: 6239939 - DNA, 20 bp, Homo sapiens
gcatgctggagtacccagcc

SEQ ID NO: 6239940 - DNA, 24 bp, Homo sapiens
gcatgctggcctcccaataaagct

SEQ ID NO: 6239941 - DNA, 21 bp, Homo sapiens
gcatgctggcctgtggcaggc

SEQ ID NO: 6239942 - DNA, 15 bp, Homo sapiens
gcatgctggggcaag

SEQ ID NO: 6239943 - DNA, 17 bp, Homo sapiens
gcatgctggtgagccaa

SEQ ID NO: 6239944 - DNA, 18 bp, Homo sapiens
gcatgctgtagctgcagc

SEQ ID NO: 6239945 - DNA, 16 bp, Homo sapiens
gcatgcttattagcag

SEQ ID NO: 6239946 - DNA, 13 bp, Homo sapiens
gcatgcttcccag

SEQ ID NO: 6239947 - DNA, 14 bp, Homo sapiens
gcatgcttcccaga

SEQ ID NO: 6239948 - DNA, 15 bp, Homo sapiens
gcatgcttcccagag

SEQ ID NO: 6239949 - DNA, 19 bp, Homo sapiens
gcatgcttcccagagggag

SEQ ID NO: 6239950 - DNA, 20 bp, Homo sapiens
gcatgcttcccagagggagc

SEQ ID NO: 6239951 - DNA, 18 bp, Homo sapiens
gcatgcttccctgcagct

SEQ ID NO: 6239952 - DNA, 14 bp, Homo sapiens
gcatgcttcctttc

SEQ ID NO: 6239953 - DNA, 22 bp, Homo sapiens
gcatgcttgggctgacccagca

SEQ ID NO: 6239954 - DNA, 23 bp, Homo sapiens
gcatgctttgagaccagaagaaa

SEQ ID NO: 6239955 - DNA, 12 bp, Homo sapiens
gcatggaaaaat

SEQ ID NO: 6239956 - DNA, 16 bp, Homo sapiens
gcatggaaaatcagtg

SEQ ID NO: 6239957 - DNA, 20 bp, Homo sapiens
gcatggaaagatggggagct

SEQ ID NO: 6239958 - DNA, 13 bp, Homo sapiens
gcatggaaatcag

SEQ ID NO: 6239959 - DNA, 16 bp, Homo sapiens
gcatggaaatcagcca

SEQ ID NO: 6239960 - DNA, 11 bp, Homo sapiens
gcatggaaatt

SEQ ID NO: 6239961 - DNA, 23 bp, Homo sapiens
gcatggaaatttaaagcaggttc

SEQ ID NO: 6239962 - DNA, 17 bp, Homo sapiens
gcatggaacaaagcatg

SEQ ID NO: 6239963 - DNA, 16 bp, Homo sapiens
gcatggaacacttcga

SEQ ID NO: 6239964 - DNA, 14 bp, Homo sapiens
gcatggaaggggct

SEQ ID NO: 6239965 - DNA, 18 bp, Homo sapiens
gcatggaaggggcttctg

SEQ ID NO: 6239966 - DNA, 11 bp, Homo sapiens
gcatggaagtt

SEQ ID NO: 6239967 - DNA, 13 bp, Homo sapiens
gcatggaatttgt

SEQ ID NO: 6239968 - DNA, 14 bp, Homo sapiens
gcatggacagggcc

SEQ ID NO: 6239969 - DNA, 20 bp, Homo sapiens
gcatggagaagggttctgcc

SEQ ID NO: 6239970 - DNA, 15 bp, Homo sapiens
gcatggagaataaac

SEQ ID NO: 6239971 - DNA, 19 bp, Homo sapiens
gcatggagaatgcaccata

SEQ ID NO: 6239972 - DNA, 15 bp, Homo sapiens
gcatggagaatggga

SEQ ID NO: 6239973 - DNA, 13 bp, Homo sapiens
gcatggagacagc

SEQ ID NO: 6239974 - DNA, 16 bp, Homo sapiens
gcatggagacagcagt

SEQ ID NO: 6239975 - DNA, 16 bp, Homo sapiens
gcatggagactctgag

SEQ ID NO: 6239976 - DNA, 19 bp, Homo sapiens
gcatggagactctgagagc

SEQ ID NO: 6239977 - DNA, 21 bp, Homo sapiens
gcatggagagcctcttagtga

SEQ ID NO: 6239978 - DNA, 16 bp, Homo sapiens
gcatggaggccctcct

SEQ ID NO: 6239979 - DNA, 17 bp, Homo sapiens
gcatggagtgtgtattg

SEQ ID NO: 6239980 - DNA, 23 bp, Homo sapiens
gcatggagtgtgtattgttccca

SEQ ID NO: 6239981 - DNA, 15 bp, Homo sapiens
gcatggatgcatttc

SEQ ID NO: 6239982 - DNA, 18 bp, Homo sapiens
gcatggatgcatttcaaa

SEQ ID NO: 6239983 - DNA, 22 bp, Homo sapiens
gcatggatgcatttcaaatgtt

SEQ ID NO: 6239984 - DNA, 21 bp, Homo sapiens
gcatggatgttttagccattg

SEQ ID NO: 6239985 - DNA, 14 bp, Homo sapiens
gcatggatttctgt

SEQ ID NO: 6239986 - DNA, 16 bp, Homo sapiens
gcatggatttctttga

SEQ ID NO: 6239987 - DNA, 20 bp, Homo sapiens
gcatggcaaatcaggggcca

SEQ ID NO: 6239988 - DNA, 20 bp, Homo sapiens
gcatggcaaggactgcaggg

SEQ ID NO: 6239989 - DNA, 21 bp, Homo sapiens
gcatggcaagtcacatgcgta

SEQ ID NO: 6239990 - DNA, 15 bp, Homo sapiens
gcatggcaattctgg

SEQ ID NO: 6239991 - DNA, 14 bp, Homo sapiens
gcatggcactgacc

SEQ ID NO: 6239992 - DNA, 20 bp, Homo sapiens
gcatggcacttgcatctgtg

SEQ ID NO: 6239993 - DNA, 11 bp, Homo sapiens
gcatggcagct

SEQ ID NO: 6239994 - DNA, 14 bp, Homo sapiens
gcatggcagctggg

SEQ ID NO: 6239995 - DNA, 16 bp, Homo sapiens
gcatggcagctgggcc

SEQ ID NO: 6239996 - DNA, 20 bp, Homo sapiens
gcatggcagctgggcccaca

SEQ ID NO: 6239997 - DNA, 16 bp, Homo sapiens
gcatggcagggccagg

SEQ ID NO: 6239998 - DNA, 17 bp, Homo sapiens
gcatggcagggccaggc

SEQ ID NO: 6239999 - DNA, 14 bp, Homo sapiens
gcatggcagggcct

SEQ ID NO: 6240000 - DNA, 18 bp, Homo sapiens
gcatggcagggcctcatc

SEQ ID NO: 6240001 - DNA, 18 bp, Homo sapiens
gcatggcagggggctgct

SEQ ID NO: 6240002 - DNA, 19 bp, Homo sapiens
gcatggcagggggctgctg

SEQ ID NO: 6240003 - DNA, 21 bp, Homo sapiens
gcatggcagggggctgctgct

SEQ ID NO: 6240004 - DNA, 18 bp, Homo sapiens
gcatggcatatttttcac

SEQ ID NO: 6240005 - DNA, 18 bp, Homo sapiens
gcatggcatcacctccac

SEQ ID NO: 6240006 - DNA, 16 bp, Homo sapiens
gcatggccacagccac

SEQ ID NO: 6240007 - DNA, 14 bp, Homo sapiens
gcatggcccagcct

SEQ ID NO: 6240008 - DNA, 21 bp, Homo sapiens
gcatggccctgctgcccctcc

SEQ ID NO: 6240009 - DNA, 20 bp, Homo sapiens
gcatggccgcaacttcccag

SEQ ID NO: 6240010 - DNA, 23 bp, Homo sapiens
gcatggccgcaacttcccaggcc

SEQ ID NO: 6240011 - DNA, 15 bp, Homo sapiens
gcatggcctcccagc

SEQ ID NO: 6240012 - DNA, 17 bp, Homo sapiens
gcatggcctcccagcca

SEQ ID NO: 6240013 - DNA, 22 bp, Homo sapiens
gcatggcggcacacatctgtaa

SEQ ID NO: 6240014 - DNA, 15 bp, Homo sapiens
gcatggctattttat

SEQ ID NO: 6240015 - DNA, 22 bp, Homo sapiens
gcatggctcagatcggccacag

SEQ ID NO: 6240016 - DNA, 14 bp, Homo sapiens
gcatggctccagtc

SEQ ID NO: 6240017 - DNA, 15 bp, Homo sapiens
gcatggctccagtct

SEQ ID NO: 6240018 - DNA, 14 bp, Homo sapiens
gcatggctggggac

SEQ ID NO: 6240019 - DNA, 17 bp, Homo sapiens
gcatggctggtgcctga

SEQ ID NO: 6240020 - DNA, 13 bp, Homo sapiens
gcatggctgtctg

SEQ ID NO: 6240021 - DNA, 14 bp, Homo sapiens
gcatggctgtctgc

SEQ ID NO: 6240022 - DNA, 15 bp, Homo sapiens
gcatggctgtctgca

SEQ ID NO: 6240023 - DNA, 21 bp, Homo sapiens
gcatggcttggggagcagagt

SEQ ID NO: 6240024 - DNA, 21 bp, Homo sapiens
gcatgggaaatagcggccctg

SEQ ID NO: 6240025 - DNA, 22 bp, Homo sapiens
gcatgggaatacaaaaggtttg

SEQ ID NO: 6240026 - DNA, 13 bp, Homo sapiens
gcatgggaatgaa

SEQ ID NO: 6240027 - DNA, 14 bp, Homo sapiens
gcatgggagggagg

SEQ ID NO: 6240028 - DNA, 19 bp, Homo sapiens
gcatgggagggagggagag

SEQ ID NO: 6240029 - DNA, 21 bp, Homo sapiens
gcatgggagggagggagaggt

SEQ ID NO: 6240030 - DNA, 15 bp, Homo sapiens
gcatgggcattgcag

SEQ ID NO: 6240031 - DNA, 17 bp, Homo sapiens
gcatgggcattgcagcc

SEQ ID NO: 6240032 - DNA, 18 bp, Homo sapiens
gcatgggcattgcagcct

SEQ ID NO: 6240033 - DNA, 12 bp, Homo sapiens
gcatgggcctct

SEQ ID NO: 6240034 - DNA, 16 bp, Homo sapiens
gcatgggcctctctgg

SEQ ID NO: 6240035 - DNA, 18 bp, Homo sapiens
gcatgggcctctctgggg

SEQ ID NO: 6240036 - DNA, 19 bp, Homo sapiens
gcatgggcctctctggggg

SEQ ID NO: 6240037 - DNA, 14 bp, Homo sapiens
gcatggggagggga

SEQ ID NO: 6240038 - DNA, 16 bp, Homo sapiens
gcatggggaggggaga

SEQ ID NO: 6240039 - DNA, 21 bp, Homo sapiens
gcatggggaggggagagaagg

SEQ ID NO: 6240040 - DNA, 17 bp, Homo sapiens
gcatggggattgcagag

SEQ ID NO: 6240041 - DNA, 20 bp, Homo sapiens
gcatggggattgcagagtga

SEQ ID NO: 6240042 - DNA, 18 bp, Homo sapiens
gcatggggcagaggcttc

SEQ ID NO: 6240043 - DNA, 15 bp, Homo sapiens
gcatggggcatgtcc

SEQ ID NO: 6240044 - DNA, 13 bp, Homo sapiens
gcatggggccagg

SEQ ID NO: 6240045 - DNA, 13 bp, Homo sapiens
gcatggggcccct

SEQ ID NO: 6240046 - DNA, 14 bp, Homo sapiens
gcatggggcccctg

SEQ ID NO: 6240047 - DNA, 21 bp, Homo sapiens
gcatggggcgctcccactcag

SEQ ID NO: 6240048 - DNA, 17 bp, Homo sapiens
gcatggggcgggtccta

SEQ ID NO: 6240049 - DNA, 22 bp, Homo sapiens
gcatggggcgggtcctagctgt

SEQ ID NO: 6240050 - DNA, 14 bp, Homo sapiens
gcatgggggaggct

SEQ ID NO: 6240051 - DNA, 16 bp, Homo sapiens
gcatgggggaggctct

SEQ ID NO: 6240052 - DNA, 17 bp, Homo sapiens
gcatgggggaggctctg

SEQ ID NO: 6240053 - DNA, 18 bp, Homo sapiens
gcatgggggaggctctga

SEQ ID NO: 6240054 - DNA, 19 bp, Homo sapiens
gcatgggggaggctctgaa

SEQ ID NO: 6240055 - DNA, 21 bp, Homo sapiens
gcatgggggcaccgggctcca

SEQ ID NO: 6240056 - DNA, 15 bp, Homo sapiens
gcatgggggcccaaa

SEQ ID NO: 6240057 - DNA, 18 bp, Homo sapiens
gcatgggggcccaaaggg

SEQ ID NO: 6240058 - DNA, 21 bp, Homo sapiens
gcatgggggctgccagcgtct

SEQ ID NO: 6240059 - DNA, 14 bp, Homo sapiens
gcatggggtcagcc

SEQ ID NO: 6240060 - DNA, 19 bp, Homo sapiens
gcatggggtcagccccaag

SEQ ID NO: 6240061 - DNA, 18 bp, Homo sapiens
gcatgggtcagggtgtga

SEQ ID NO: 6240062 - DNA, 15 bp, Homo sapiens
gcatgggtccagaag

SEQ ID NO: 6240063 - DNA, 17 bp, Homo sapiens
gcatgggtccagggcct

SEQ ID NO: 6240064 - DNA, 16 bp, Homo sapiens
gcatgggtcgggagag

SEQ ID NO: 6240065 - DNA, 23 bp, Homo sapiens
gcatgggtcgggagaggggacgc

SEQ ID NO: 6240066 - DNA, 15 bp, Homo sapiens
gcatgggtggagggt

SEQ ID NO: 6240067 - DNA, 18 bp, Homo sapiens
gcatggtaccagccctgg

SEQ ID NO: 6240068 - DNA, 19 bp, Homo sapiens
gcatggtaccagccctggg

SEQ ID NO: 6240069 - DNA, 23 bp, Homo sapiens
gcatggtaccagccctggggctg

SEQ ID NO: 6240070 - DNA, 19 bp, Homo sapiens
gcatggtataattgaaact

SEQ ID NO: 6240071 - DNA, 22 bp, Homo sapiens
gcatggtatttgagacattcca

SEQ ID NO: 6240072 - DNA, 14 bp, Homo sapiens
gcatggtcaagcct

SEQ ID NO: 6240073 - DNA, 15 bp, Homo sapiens
gcatggtcaagcctc

SEQ ID NO: 6240074 - DNA, 23 bp, Homo sapiens
gcatggtcccacatccctgggcc

SEQ ID NO: 6240075 - DNA, 14 bp, Homo sapiens
gcatggtcctgtgc

SEQ ID NO: 6240076 - DNA, 15 bp, Homo sapiens
gcatggtcctgtgcc

SEQ ID NO: 6240077 - DNA, 16 bp, Homo sapiens
gcatggtcctgtgccc

SEQ ID NO: 6240078 - DNA, 18 bp, Homo sapiens
gcatggtcctgtgccccg

SEQ ID NO: 6240079 - DNA, 16 bp, Homo sapiens
gcatggtgcagggaga

SEQ ID NO: 6240080 - DNA, 13 bp, Homo sapiens
gcatggtgcagtt

SEQ ID NO: 6240081 - DNA, 14 bp, Homo sapiens
gcatggtgcatgcc

SEQ ID NO: 6240082 - DNA, 17 bp, Homo sapiens
gcatggtgccccaggac

SEQ ID NO: 6240083 - DNA, 21 bp, Homo sapiens
gcatggtgccccaggaccagc

SEQ ID NO: 6240084 - DNA, 15 bp, Homo sapiens
gcatggtggcaggcg

SEQ ID NO: 6240085 - DNA, 13 bp, Homo sapiens
gcatggtggcatg

SEQ ID NO: 6240086 - DNA, 16 bp, Homo sapiens
gcatggtggctcatgc

SEQ ID NO: 6240087 - DNA, 17 bp, Homo sapiens
gcatggtggctcatgcc

SEQ ID NO: 6240088 - DNA, 21 bp, Homo sapiens
gcatggtggctcatgcctgta

SEQ ID NO: 6240089 - DNA, 13 bp, Homo sapiens
gcatggtggttgg

SEQ ID NO: 6240090 - DNA, 20 bp, Homo sapiens
gcatggtggttgggacccag

SEQ ID NO: 6240091 - DNA, 16 bp, Homo sapiens
gcatggtgttctcctg

SEQ ID NO: 6240092 - DNA, 17 bp, Homo sapiens
gcatggtgttctcctgc

SEQ ID NO: 6240093 - DNA, 13 bp, Homo sapiens
gagcagagagagc

SEQ ID NO: 6240094 - DNA, 17 bp, Homo sapiens
gagcagagagcaaagga

SEQ ID NO: 6240095 - DNA, 19 bp, Homo sapiens
gagcagagagcaaaggaga

SEQ ID NO: 6240096 - DNA, 22 bp, Homo sapiens
gagcagagatcacaccactgca

SEQ ID NO: 6240097 - DNA, 18 bp, Homo sapiens
gagcagagcaagtctgca

SEQ ID NO: 6240098 - DNA, 22 bp, Homo sapiens
gagcagagcccggagctccggc

SEQ ID NO: 6240099 - DNA, 11 bp, Homo sapiens
gagcagagcct

SEQ ID NO: 6240100 - DNA, 15 bp, Homo sapiens
gagcagagcctacag

SEQ ID NO: 6240101 - DNA, 20 bp, Homo sapiens
gagcagagcgcagcccccac

SEQ ID NO: 6240102 - DNA, 20 bp, Homo sapiens
gagcagagctgatggagaag

SEQ ID NO: 6240103 - DNA, 18 bp, Homo sapiens
gagcagaggctccacagg

SEQ ID NO: 6240104 - DNA, 18 bp, Homo sapiens
gagcagagggcaggggtg

SEQ ID NO: 6240105 - DNA, 16 bp, Homo sapiens
gagcagaggggcagag

SEQ ID NO: 6240106 - DNA, 19 bp, Homo sapiens
gagcagagtataggatgga

SEQ ID NO: 6240107 - DNA, 11 bp, Homo sapiens
gagcagagtct

SEQ ID NO: 6240108 - DNA, 13 bp, Homo sapiens
gagcagagtctgg

SEQ ID NO: 6240109 - DNA, 21 bp, Homo sapiens
gagcagatactgtctttgtgc

SEQ ID NO: 6240110 - DNA, 21 bp, Homo sapiens
gagcagatcgtgccgtggagc

SEQ ID NO: 6240111 - DNA, 18 bp, Homo sapiens
gagcagatgcagagagcc

SEQ ID NO: 6240112 - DNA, 19 bp, Homo sapiens
gagcagatgcagagagcca

SEQ ID NO: 6240113 - DNA, 21 bp, Homo sapiens
gagcagatggatccacgtgct

SEQ ID NO: 6240114 - DNA, 18 bp, Homo sapiens
gagcagatggcagatgca

SEQ ID NO: 6240115 - DNA, 17 bp, Homo sapiens
gagcagcaagaagcagc

SEQ ID NO: 6240116 - DNA, 21 bp, Homo sapiens
gagcagcaaggtcttgctctc

SEQ ID NO: 6240117 - DNA, 15 bp, Homo sapiens
gagcagcacctcctc

SEQ ID NO: 6240118 - DNA, 22 bp, Homo sapiens
gccaacttgagggcccagagca

SEQ ID NO: 6240119 - DNA, 15 bp, Homo sapiens
gccaacttgccatgt

SEQ ID NO: 6240120 - DNA, 13 bp, Homo sapiens
gccaacttgtaaa

SEQ ID NO: 6240121 - DNA, 17 bp, Homo sapiens
gccaacttgtctctgta

SEQ ID NO: 6240122 - DNA, 18 bp, Homo sapiens
gccaacttgtctctgtag

SEQ ID NO: 6240123 - DNA, 16 bp, Homo sapiens
gccaactttccagact

SEQ ID NO: 6240124 - DNA, 21 bp, Homo sapiens
gccaactttccccacgttaaa

SEQ ID NO: 6240125 - DNA, 15 bp, Homo sapiens
gccaacttttctaga

SEQ ID NO: 6240126 - DNA, 22 bp, Homo sapiens
gccaagaaacactgcctgccct

SEQ ID NO: 6240127 - DNA, 15 bp, Homo sapiens
gccaagaaacgtctt

SEQ ID NO: 6240128 - DNA, 21 bp, Homo sapiens
gccaagaaacgtcttctaaac

SEQ ID NO: 6240129 - DNA, 18 bp, Homo sapiens
gccaagaactgaaaacat

SEQ ID NO: 6240130 - DNA, 16 bp, Homo sapiens
gccaagaagtgaggcc

SEQ ID NO: 6240131 - DNA, 18 bp, Homo sapiens
gccaagaagtgaggcctg

SEQ ID NO: 6240132 - DNA, 19 bp, Homo sapiens
gccaagaagtgaggcctgg

SEQ ID NO: 6240133 - DNA, 19 bp, Homo sapiens
gccaagaatatagttatta

SEQ ID NO: 6240134 - DNA, 19 bp, Homo sapiens
gccaagaatattgcaaaat

SEQ ID NO: 6240135 - DNA, 12 bp, Homo sapiens
gccaagaatgta

SEQ ID NO: 6240136 - DNA, 23 bp, Homo sapiens
gccaagacaaatcaacagaagca

SEQ ID NO: 6240137 - DNA, 18 bp, Homo sapiens
gccaagacagtggcagca

SEQ ID NO: 6240138 - DNA, 20 bp, Homo sapiens
gccaagaccatttcacagaa

SEQ ID NO: 6240139 - DNA, 17 bp, Homo sapiens
gccaagaccccagcttc

SEQ ID NO: 6240140 - DNA, 15 bp, Homo sapiens
gccaagacggaggag

SEQ ID NO: 6240141 - DNA, 21 bp, Homo sapiens
gccaagactcattgctggagg

SEQ ID NO: 6240142 - DNA, 12 bp, Homo sapiens
gccaagacttgg

SEQ ID NO: 6240143 - DNA, 22 bp, Homo sapiens
gccaagacttggcaacagaagc

SEQ ID NO: 6240144 - DNA, 14 bp, Homo sapiens
gccaagagagcctc

SEQ ID NO: 6240145 - DNA, 16 bp, Homo sapiens
gccaagagatctgtgt

SEQ ID NO: 6240146 - DNA, 18 bp, Homo sapiens
gccaagagatctgtgtgg

SEQ ID NO: 6240147 - DNA, 22 bp, Homo sapiens
gccaagagatctgtgtggctcc

SEQ ID NO: 6240148 - DNA, 15 bp, Homo sapiens
gccaagatcacagtg

SEQ ID NO: 6240149 - DNA, 18 bp, Homo sapiens
gccaagatcgcaccactg

SEQ ID NO: 6240150 - DNA, 19 bp, Homo sapiens
gccaagatcgcaccactgc

SEQ ID NO: 6240151 - DNA, 18 bp, Homo sapiens
gccaagatgtacttctct

SEQ ID NO: 6240152 - DNA, 16 bp, Homo sapiens
gccaagattgtccttt

SEQ ID NO: 6240153 - DNA, 15 bp, Homo sapiens
gccaagattttcctc

SEQ ID NO: 6240154 - DNA, 23 bp, Homo sapiens
gccaagattttcctcttgtgatt

SEQ ID NO: 6240155 - DNA, 20 bp, Homo sapiens
gccaagcaacctgggtccaa

SEQ ID NO: 6240156 - DNA, 22 bp, Homo sapiens
gccaagcacctagcctcgctct

SEQ ID NO: 6240157 - DNA, 23 bp, Homo sapiens
gccaagcactgtgctcagggcta

SEQ ID NO: 6240158 - DNA, 22 bp, Homo sapiens
gccaagcatttaatgtagccat

SEQ ID NO: 6240159 - DNA, 12 bp, Homo sapiens
gccaagccagat

SEQ ID NO: 6240160 - DNA, 15 bp, Homo sapiens
gccaagccagattct

SEQ ID NO: 6240161 - DNA, 13 bp, Homo sapiens
gccaagccagctg

SEQ ID NO: 6240162 - DNA, 18 bp, Homo sapiens
gccaagccagctgcctag

SEQ ID NO: 6240163 - DNA, 12 bp, Homo sapiens
gccaagccaggg

SEQ ID NO: 6240164 - DNA, 21 bp, Homo sapiens
gccaagccatgggtagcctgg

SEQ ID NO: 6240165 - DNA, 16 bp, Homo sapiens
gccaagcccacctgca

SEQ ID NO: 6240166 - DNA, 12 bp, Homo sapiens
gccaagccctcc

SEQ ID NO: 6240167 - DNA, 14 bp, Homo sapiens
gccaagccctggcc

SEQ ID NO: 6240168 - DNA, 17 bp, Homo sapiens
gccaagccctttgctgt

SEQ ID NO: 6240169 - DNA, 21 bp, Homo sapiens
gccaagccggcccaacccaac

SEQ ID NO: 6240170 - DNA, 14 bp, Homo sapiens
gccaagcctgactt

SEQ ID NO: 6240171 - DNA, 19 bp, Homo sapiens
gccaagcctgctgtgtcct

SEQ ID NO: 6240172 - DNA, 21 bp, Homo sapiens
gccaagcgagaatgcaggccc

SEQ ID NO: 6240173 - DNA, 18 bp, Homo sapiens
gccaagctaatctgcctg

SEQ ID NO: 6240174 - DNA, 20 bp, Homo sapiens
gccaagctcaggaccaggca

SEQ ID NO: 6240175 - DNA, 19 bp, Homo sapiens
gccaagctccctggagccc

SEQ ID NO: 6240176 - DNA, 14 bp, Homo sapiens
gccaagctgaagct

SEQ ID NO: 6240177 - DNA, 15 bp, Homo sapiens
gccaagctgaagcta

SEQ ID NO: 6240178 - DNA, 16 bp, Homo sapiens
gccaagctgaagctac

SEQ ID NO: 6240179 - DNA, 14 bp, Homo sapiens
gccaagctgaggtg

SEQ ID NO: 6240180 - DNA, 15 bp, Homo sapiens
gccaagctgaggtgc

SEQ ID NO: 6240181 - DNA, 21 bp, Homo sapiens
gccaagctgaggtgcccagga

SEQ ID NO: 6240182 - DNA, 23 bp, Homo sapiens
gccaagctgaggtgcccaggaga

SEQ ID NO: 6240183 - DNA, 15 bp, Homo sapiens
gccaagctgcacaat

SEQ ID NO: 6240184 - DNA, 14 bp, Homo sapiens
gccaagctggcaca

SEQ ID NO: 6240185 - DNA, 15 bp, Homo sapiens
gccaagctgtgttca

SEQ ID NO: 6240186 - DNA, 14 bp, Homo sapiens
gccaagcttcctgt

SEQ ID NO: 6240187 - DNA, 17 bp, Homo sapiens
gccaagcttcctgtgcc

SEQ ID NO: 6240188 - DNA, 23 bp, Homo sapiens
gccaagcttcctgtgccctcacc

SEQ ID NO: 6240189 - DNA, 19 bp, Homo sapiens
gccaagctttgaggctctg

SEQ ID NO: 6240190 - DNA, 21 bp, Homo sapiens
gccaagctttgaggctctgtc

SEQ ID NO: 6240191 - DNA, 22 bp, Homo sapiens
gccaaggaaaggcatgtacaaa

SEQ ID NO: 6240192 - DNA, 16 bp, Homo sapiens
gccaaggacactgatg

SEQ ID NO: 6240193 - DNA, 13 bp, Homo sapiens
gccaaggacccag

SEQ ID NO: 6240194 - DNA, 18 bp, Homo sapiens
gccaaggacccaggcgct

SEQ ID NO: 6240195 - DNA, 18 bp, Homo sapiens
gccaaggactgactgaga

SEQ ID NO: 6240196 - DNA, 24 bp, Homo sapiens
gccaaggactgactgagacacgat

SEQ ID NO: 6240197 - DNA, 17 bp, Homo sapiens
gccaaggactgccgacc

SEQ ID NO: 6240198 - DNA, 20 bp, Homo sapiens
gccaaggagctgctatagcc

SEQ ID NO: 6240199 - DNA, 21 bp, Homo sapiens
gccaaggagctgctatagcct

SEQ ID NO: 6240200 - DNA, 23 bp, Homo sapiens
gccaaggagctgctatagcctgg

SEQ ID NO: 6240201 - DNA, 19 bp, Homo sapiens
gccaaggaggcctggggag

SEQ ID NO: 6240202 - DNA, 23 bp, Homo sapiens
gccaaggagggtggatcacctga

SEQ ID NO: 6240203 - DNA, 14 bp, Homo sapiens
gccaaggagtcaga

SEQ ID NO: 6240204 - DNA, 17 bp, Homo sapiens
gccaaggagtcagatgg

SEQ ID NO: 6240205 - DNA, 16 bp, Homo sapiens
gccaaggcagagggga

SEQ ID NO: 6240206 - DNA, 10 bp, Homo sapiens
gccaaggcca

SEQ ID NO: 6240207 - DNA, 11 bp, Homo sapiens
gccaaggccaa

SEQ ID NO: 6240208 - DNA, 20 bp, Homo sapiens
gccaaggccaaaagaagttt

SEQ ID NO: 6240209 - DNA, 19 bp, Homo sapiens
gccaaggccaaaggaagca

SEQ ID NO: 6240210 - DNA, 11 bp, Homo sapiens
gccaaggccac

SEQ ID NO: 6240211 - DNA, 23 bp, Homo sapiens
gccaaggcccaactaacagtcaa

SEQ ID NO: 6240212 - DNA, 18 bp, Homo sapiens
gccaaggccgaagctctg

SEQ ID NO: 6240213 - DNA, 15 bp, Homo sapiens
gccaaggcctcagga

SEQ ID NO: 6240214 - DNA, 22 bp, Homo sapiens
gccaaggctatgaagggacagc

SEQ ID NO: 6240215 - DNA, 15 bp, Homo sapiens
gccaaggctctcccc

SEQ ID NO: 6240216 - DNA, 19 bp, Homo sapiens
gccaaggctggagtgcagt

SEQ ID NO: 6240217 - DNA, 18 bp, Homo sapiens
gccaagggaaaggggtgc

SEQ ID NO: 6240218 - DNA, 18 bp, Homo sapiens
gccaagggacacaggaga

SEQ ID NO: 6240219 - DNA, 14 bp, Homo sapiens
gccaagggaccagg

SEQ ID NO: 6240220 - DNA, 14 bp, Homo sapiens
gccaagggagggaa

SEQ ID NO: 6240221 - DNA, 21 bp, Homo sapiens
gccaagggagggaagggccac

SEQ ID NO: 6240222 - DNA, 21 bp, Homo sapiens
gccaagggatggacatcttgt

SEQ ID NO: 6240223 - DNA, 22 bp, Homo sapiens
gccaagggcaacagatcagtaa

SEQ ID NO: 6240224 - DNA, 19 bp, Homo sapiens
gccaagggcataaattatt

SEQ ID NO: 6240225 - DNA, 15 bp, Homo sapiens
gccaagggccccagg

SEQ ID NO: 6240226 - DNA, 21 bp, Homo sapiens
gccaagggccccaggggcagc

SEQ ID NO: 6240227 - DNA, 16 bp, Homo sapiens
gccaagggctaggctc

SEQ ID NO: 6240228 - DNA, 16 bp, Homo sapiens
gccaagggctttgttt

SEQ ID NO: 6240229 - DNA, 20 bp, Homo sapiens
gccaaggggccagctgcccc

SEQ ID NO: 6240230 - DNA, 22 bp, Homo sapiens
gccaaggggctgcgctagcagc

SEQ ID NO: 6240231 - DNA, 23 bp, Homo sapiens
gccaaggggctgcgctagcagcc

SEQ ID NO: 6240232 - DNA, 18 bp, Homo sapiens
gccaaggggcttcaggtc

SEQ ID NO: 6240233 - DNA, 17 bp, Homo sapiens
gccaagggggacctcgg

SEQ ID NO: 6240234 - DNA, 20 bp, Homo sapiens
gccaagggggacctcgggct

SEQ ID NO: 6240235 - DNA, 17 bp, Homo sapiens
gccaagggggtgactgg

SEQ ID NO: 6240236 - DNA, 20 bp, Homo sapiens
gccaagggggtgactggaag

SEQ ID NO: 6240237 - DNA, 18 bp, Homo sapiens
gccaaggggtctgctcct

SEQ ID NO: 6240238 - DNA, 23 bp, Homo sapiens
gccaaggggtgggcctgtgaatc

SEQ ID NO: 6240239 - DNA, 16 bp, Homo sapiens
gccaaggtcctgctca

SEQ ID NO: 6240240 - DNA, 16 bp, Homo sapiens
gccaaggtctgagcca

SEQ ID NO: 6240241 - DNA, 22 bp, Homo sapiens
gccaaggtctgagccacagcag

SEQ ID NO: 6240242 - DNA, 21 bp, Homo sapiens
gccaaggtgcatatagaaaac

SEQ ID NO: 6240243 - DNA, 22 bp, Homo sapiens
gccaaggtgcatatagaaaaca

SEQ ID NO: 6240244 - DNA, 16 bp, Homo sapiens
gccaaggtggagggaa

SEQ ID NO: 6240245 - DNA, 15 bp, Homo sapiens
gccaaggtgggagga

SEQ ID NO: 6240246 - DNA, 23 bp, Homo sapiens
gccaaggtgggaggattgcttga

SEQ ID NO: 6240247 - DNA, 18 bp, Homo sapiens
gccaaggtgtccagggtc

SEQ ID NO: 6240248 - DNA, 13 bp, Homo sapiens
gccaaggtgtcct

SEQ ID NO: 6240249 - DNA, 23 bp, Homo sapiens
gccaaggtgtcctacagaaaaac

SEQ ID NO: 6240250 - DNA, 20 bp, Homo sapiens
gccaagtaaacagggtacct

SEQ ID NO: 6240251 - DNA, 22 bp, Homo sapiens
gccaagtaacaatgcatgcttt

SEQ ID NO: 6240252 - DNA, 12 bp, Homo sapiens
gccaagtccaga

SEQ ID NO: 6240253 - DNA, 15 bp, Homo sapiens
gccaagtccaggtcc

SEQ ID NO: 6240254 - DNA, 17 bp, Homo sapiens
gccaagtccaggtcctg

SEQ ID NO: 6240255 - DNA, 18 bp, Homo sapiens
gccaagtccaggtcctgg

SEQ ID NO: 6240256 - DNA, 19 bp, Homo sapiens
gccaagtccaggtcctggt

SEQ ID NO: 6240257 - DNA, 21 bp, Homo sapiens
gccaagtccgcagaagccctg

SEQ ID NO: 6240258 - DNA, 22 bp, Homo sapiens
gccaagtcctcctagaactcca

SEQ ID NO: 6240259 - DNA, 13 bp, Homo sapiens
gccaagtcctgcc

SEQ ID NO: 6240260 - DNA, 17 bp, Homo sapiens
gccaagtcctgcctttg

SEQ ID NO: 6240261 - DNA, 22 bp, Homo sapiens
gccaagtctaatgaagagaaaa

SEQ ID NO: 6240262 - DNA, 13 bp, Homo sapiens
gccaagtgaagaa

SEQ ID NO: 6240263 - DNA, 15 bp, Homo sapiens
gccaagtgcaggctg

SEQ ID NO: 6240264 - DNA, 12 bp, Homo sapiens
gccaagtgccta

SEQ ID NO: 6240265 - DNA, 15 bp, Homo sapiens
gccaagtgccttccg

SEQ ID NO: 6240266 - DNA, 19 bp, Homo sapiens
gccaagtgcgtgccgtgtg

SEQ ID NO: 6240267 - DNA, 13 bp, Homo sapiens
gccaagtggccac

SEQ ID NO: 6240268 - DNA, 15 bp, Homo sapiens
gccaagtggtccagc

SEQ ID NO: 6240269 - DNA, 13 bp, Homo sapiens
gccaagtgtcctg

SEQ ID NO: 6240270 - DNA, 15 bp, Homo sapiens
gccaagtgtcctgct

SEQ ID NO: 6240271 - DNA, 22 bp, Homo sapiens
gccaagtgtgaccccactgcca

SEQ ID NO: 6240272 - DNA, 16 bp, Homo sapiens
gccaagttagctattg

SEQ ID NO: 6240273 - DNA, 22 bp, Homo sapiens
gccaagttagctattgggagca

SEQ ID NO: 6240274 - DNA, 14 bp, Homo sapiens
gccaagttatattg

SEQ ID NO: 6240275 - DNA, 22 bp, Homo sapiens
gccaagttatgcagctgttctg

SEQ ID NO: 6240276 - DNA, 15 bp, Homo sapiens
gccaagttgctgtca

SEQ ID NO: 6240277 - DNA, 20 bp, Homo sapiens
gccaagttgctgtcactgtt

SEQ ID NO: 6240278 - DNA, 20 bp, Homo sapiens
gccaagtttatatacaatta

SEQ ID NO: 6240279 - DNA, 14 bp, Homo sapiens
gccaagtttttcag

SEQ ID NO: 6240280 - DNA, 17 bp, Homo sapiens
gccaagtttttcagaaa

SEQ ID NO: 6240281 - DNA, 11 bp, Homo sapiens
gccaataaaaa

SEQ ID NO: 6240282 - DNA, 16 bp, Homo sapiens
gccaataaacctgtaa

SEQ ID NO: 6240283 - DNA, 16 bp, Homo sapiens
gccaataaagaaatta

SEQ ID NO: 6240284 - DNA, 13 bp, Homo sapiens
gccaataaccaag

SEQ ID NO: 6240285 - DNA, 22 bp, Homo sapiens
gccaataataaaaaacaagaaa

SEQ ID NO: 6240286 - DNA, 23 bp, Homo sapiens
gccaataccctactgtggggaga

SEQ ID NO: 6240287 - DNA, 23 bp, Homo sapiens
gccaatactgagtgcctgcagca

SEQ ID NO: 6240288 - DNA, 16 bp, Homo sapiens
gccaatagtgtcatcc

SEQ ID NO: 6240289 - DNA, 20 bp, Homo sapiens
gccaatatcccttactttaa

SEQ ID NO: 6240290 - DNA, 13 bp, Homo sapiens
gccaatatcctaa

SEQ ID NO: 6240291 - DNA, 19 bp, Homo sapiens
gccaatatcctaataaaaa

SEQ ID NO: 6240292 - DNA, 23 bp, Homo sapiens
gccaatatgtattgtaaacatgt

SEQ ID NO: 6240293 - DNA, 22 bp, Homo sapiens
gccaatattagtaggatttttg

SEQ ID NO: 6240294 - DNA, 15 bp, Homo sapiens
gccaatcagaagcta

SEQ ID NO: 6240295 - DNA, 19 bp, Homo sapiens
gagcagcacctcctcagcc

SEQ ID NO: 6240296 - DNA, 14 bp, Homo sapiens
gagcagcactgggg

SEQ ID NO: 6240297 - DNA, 22 bp, Homo sapiens
gagcagcagcacctttctctga

SEQ ID NO: 6240298 - DNA, 14 bp, Homo sapiens
gagcagcagctgag

SEQ ID NO: 6240299 - DNA, 17 bp, Homo sapiens
gagcagcagctgaggcc

SEQ ID NO: 6240300 - DNA, 16 bp, Homo sapiens
gagcagcagcttgggg

SEQ ID NO: 6240301 - DNA, 17 bp, Homo sapiens
gagcagcaggcctctgg

SEQ ID NO: 6240302 - DNA, 18 bp, Homo sapiens
gagcagcaggcctctggg

SEQ ID NO: 6240303 - DNA, 17 bp, Homo sapiens
gagcagcagtgaaaaca

SEQ ID NO: 6240304 - DNA, 21 bp, Homo sapiens
gagcagcattcccagggacct

SEQ ID NO: 6240305 - DNA, 17 bp, Homo sapiens
gagcagccaaggccgcc

SEQ ID NO: 6240306 - DNA, 22 bp, Homo sapiens
gagcagccaaggccgccagcgt

SEQ ID NO: 6240307 - DNA, 22 bp, Homo sapiens
gagcagccacattcctgatgct

SEQ ID NO: 6240308 - DNA, 12 bp, Homo sapiens
gagcagccagag

SEQ ID NO: 6240309 - DNA, 13 bp, Homo sapiens
gagcagccagagc

SEQ ID NO: 6240310 - DNA, 14 bp, Homo sapiens
gagcagccagagct

SEQ ID NO: 6240311 - DNA, 16 bp, Homo sapiens
gagcagccagagctgt

SEQ ID NO: 6240312 - DNA, 14 bp, Homo sapiens
gagcagccaggacc

SEQ ID NO: 6240313 - DNA, 15 bp, Homo sapiens
gagcagcccacccag

SEQ ID NO: 6240314 - DNA, 19 bp, Homo sapiens
gagcagcccacccagcaga

SEQ ID NO: 6240315 - DNA, 21 bp, Homo sapiens
gagcagcccacccagcagaaa

SEQ ID NO: 6240316 - DNA, 17 bp, Homo sapiens
gagcagcccacctgctg

SEQ ID NO: 6240317 - DNA, 16 bp, Homo sapiens
gagcagcccagcacaa

SEQ ID NO: 6240318 - DNA, 18 bp, Homo sapiens
gagcagcccagcacaacc

SEQ ID NO: 6240319 - DNA, 12 bp, Homo sapiens
gagcagcccagg

SEQ ID NO: 6240320 - DNA, 12 bp, Homo sapiens
gagcagccccca

SEQ ID NO: 6240321 - DNA, 19 bp, Homo sapiens
gagcagcccctcccagata

SEQ ID NO: 6240322 - DNA, 12 bp, Homo sapiens
gagcagccctgg

SEQ ID NO: 6240323 - DNA, 13 bp, Homo sapiens
gagcagccctggc

SEQ ID NO: 6240324 - DNA, 15 bp, Homo sapiens
gagcagccgccagct

SEQ ID NO: 6240325 - DNA, 12 bp, Homo sapiens
gagcagcctcca

SEQ ID NO: 6240326 - DNA, 17 bp, Homo sapiens
gagcagcctccaagaaa

SEQ ID NO: 6240327 - DNA, 17 bp, Homo sapiens
gagcagcctccagtgct

SEQ ID NO: 6240328 - DNA, 18 bp, Homo sapiens
gagcagcctccagtgctg

SEQ ID NO: 6240329 - DNA, 23 bp, Homo sapiens
gagcagcctccagtgctggctgc

SEQ ID NO: 6240330 - DNA, 17 bp, Homo sapiens
gagcagcctcgaggctg

SEQ ID NO: 6240331 - DNA, 19 bp, Homo sapiens
gagcagcctcgaggctggt

SEQ ID NO: 6240332 - DNA, 16 bp, Homo sapiens
gagcagcctcgtggag

SEQ ID NO: 6240333 - DNA, 21 bp, Homo sapiens
gagcagcctctgccaggcctg

SEQ ID NO: 6240334 - DNA, 22 bp, Homo sapiens
gagcagcctctgccaggcctgt

SEQ ID NO: 6240335 - DNA, 14 bp, Homo sapiens
gagcagcctgatgg

SEQ ID NO: 6240336 - DNA, 16 bp, Homo sapiens
gagcagcctgatggcc

SEQ ID NO: 6240337 - DNA, 19 bp, Homo sapiens
gagcagcctgatggccaag

SEQ ID NO: 6240338 - DNA, 12 bp, Homo sapiens
gagcagcctggc

SEQ ID NO: 6240339 - DNA, 14 bp, Homo sapiens
gagcagcgagcctg

SEQ ID NO: 6240340 - DNA, 17 bp, Homo sapiens
gagcagcgagcctgcta

SEQ ID NO: 6240341 - DNA, 14 bp, Homo sapiens
gagcagcgcccagg

SEQ ID NO: 6240342 - DNA, 16 bp, Homo sapiens
gagcagcgcccaggcc

SEQ ID NO: 6240343 - DNA, 21 bp, Homo sapiens
gagcagcggattgctctggag

SEQ ID NO: 6240344 - DNA, 15 bp, Homo sapiens
gagcagcggctctgg

SEQ ID NO: 6240345 - DNA, 15 bp, Homo sapiens
gagcagctactgtaa

SEQ ID NO: 6240346 - DNA, 15 bp, Homo sapiens
gagcagctagctgct

SEQ ID NO: 6240347 - DNA, 17 bp, Homo sapiens
gagcagctagctgcttt

SEQ ID NO: 6240348 - DNA, 18 bp, Homo sapiens
gagcagctagctgctttt

SEQ ID NO: 6240349 - DNA, 19 bp, Homo sapiens
gagcagctattttaagcca

SEQ ID NO: 6240350 - DNA, 21 bp, Homo sapiens
gagcagctccaccactgtgca

SEQ ID NO: 6240351 - DNA, 16 bp, Homo sapiens
gagcagctccctttct

SEQ ID NO: 6240352 - DNA, 20 bp, Homo sapiens
gagcagctgaataacctgca

SEQ ID NO: 6240353 - DNA, 19 bp, Homo sapiens
gagcagctgagatgtggac

SEQ ID NO: 6240354 - DNA, 14 bp, Homo sapiens
gagcagctgagcag

SEQ ID NO: 6240355 - DNA, 20 bp, Homo sapiens
gagcagctgagcagggccgg

SEQ ID NO: 6240356 - DNA, 11 bp, Homo sapiens
gagcagctggc

SEQ ID NO: 6240357 - DNA, 17 bp, Homo sapiens
gagcagctggcactgac

SEQ ID NO: 6240358 - DNA, 19 bp, Homo sapiens
gagcagctggcactgacag

SEQ ID NO: 6240359 - DNA, 17 bp, Homo sapiens
gagcagctggctctcca

SEQ ID NO: 6240360 - DNA, 20 bp, Homo sapiens
gagcagctgggcactgggcc

SEQ ID NO: 6240361 - DNA, 23 bp, Homo sapiens
gagcagcttccttctgggactgg

SEQ ID NO: 6240362 - DNA, 20 bp, Homo sapiens
gagcagcttcggtgtgcaga

SEQ ID NO: 6240363 - DNA, 17 bp, Homo sapiens
gagcagctttaaactca

SEQ ID NO: 6240364 - DNA, 18 bp, Homo sapiens
gagcagcttttggtctcc

SEQ ID NO: 6240365 - DNA, 21 bp, Homo sapiens
gagcagcttttggtctccttg

SEQ ID NO: 6240366 - DNA, 24 bp, Homo sapiens
gagcagcttttggtctccttgggc

SEQ ID NO: 6240367 - DNA, 12 bp, Homo sapiens
gagcaggaacag

SEQ ID NO: 6240368 - DNA, 16 bp, Homo sapiens
gagcaggaacagagac

SEQ ID NO: 6240369 - DNA, 18 bp, Homo sapiens
gagcaggaacagagactc

SEQ ID NO: 6240370 - DNA, 21 bp, Homo sapiens
gagcaggaacagagactctgg

SEQ ID NO: 6240371 - DNA, 12 bp, Homo sapiens
gagcaggaaccg

SEQ ID NO: 6240372 - DNA, 22 bp, Homo sapiens
gagcaggaagcgagcagaggct

SEQ ID NO: 6240373 - DNA, 16 bp, Homo sapiens
gagcaggaaggacagg

SEQ ID NO: 6240374 - DNA, 14 bp, Homo sapiens
gagcaggaaggcct

SEQ ID NO: 6240375 - DNA, 16 bp, Homo sapiens
gagcaggacagccagc

SEQ ID NO: 6240376 - DNA, 13 bp, Homo sapiens
gagcaggacctcc

SEQ ID NO: 6240377 - DNA, 22 bp, Homo sapiens
gagcaggacctctgaaaccctg

SEQ ID NO: 6240378 - DNA, 22 bp, Homo sapiens
gagcaggacctgggacaggaaa

SEQ ID NO: 6240379 - DNA, 19 bp, Homo sapiens
gagcaggactaacaactgg

SEQ ID NO: 6240380 - DNA, 18 bp, Homo sapiens
gagcaggagattgagaag

SEQ ID NO: 6240381 - DNA, 22 bp, Homo sapiens
gagcaggagattgagaaggaga

SEQ ID NO: 6240382 - DNA, 23 bp, Homo sapiens
gagcaggagattgagaaggagag

SEQ ID NO: 6240383 - DNA, 15 bp, Homo sapiens
gagcaggagcagaaa

SEQ ID NO: 6240384 - DNA, 20 bp, Homo sapiens
gagcaggagccccgccacag

SEQ ID NO: 6240385 - DNA, 24 bp, Homo sapiens
gagcaggaggaggaaaggtagccc

SEQ ID NO: 6240386 - DNA, 21 bp, Homo sapiens
gagcaggaggcccctggccca

SEQ ID NO: 6240387 - DNA, 20 bp, Homo sapiens
gagcaggaggcctaggaggg

SEQ ID NO: 6240388 - DNA, 16 bp, Homo sapiens
gagcaggaggtgcctg

SEQ ID NO: 6240389 - DNA, 22 bp, Homo sapiens
gagcaggcaaaaaagggacagc

SEQ ID NO: 6240390 - DNA, 21 bp, Homo sapiens
gagcaggcacgggtggtcccc

SEQ ID NO: 6240391 - DNA, 20 bp, Homo sapiens
gagcaggcaggggcttggct

SEQ ID NO: 6240392 - DNA, 23 bp, Homo sapiens
gagcaggcaggggcttggctgcc

SEQ ID NO: 6240393 - DNA, 14 bp, Homo sapiens
gagcaggcagtggg

SEQ ID NO: 6240394 - DNA, 15 bp, Homo sapiens
gagcaggccacgctc

SEQ ID NO: 6240395 - DNA, 17 bp, Homo sapiens
gagcaggccagcccgga

SEQ ID NO: 6240396 - DNA, 20 bp, Homo sapiens
gagcaggcccgacagagaga

SEQ ID NO: 6240397 - DNA, 22 bp, Homo sapiens
gagcaggcccgacagagagatg

SEQ ID NO: 6240398 - DNA, 20 bp, Homo sapiens
gagcaggccctgggcctcca

SEQ ID NO: 6240399 - DNA, 18 bp, Homo sapiens
gagcaggccggaaccaca

SEQ ID NO: 6240400 - DNA, 17 bp, Homo sapiens
gagcaggcggggaggag

SEQ ID NO: 6240401 - DNA, 18 bp, Homo sapiens
gagcaggcggtgggcacc

SEQ ID NO: 6240402 - DNA, 22 bp, Homo sapiens
gagcaggcggtgggcacccacc

SEQ ID NO: 6240403 - DNA, 21 bp, Homo sapiens
gagcaggctactgtcagctcc

SEQ ID NO: 6240404 - DNA, 16 bp, Homo sapiens
gagcaggctcagactc

SEQ ID NO: 6240405 - DNA, 22 bp, Homo sapiens
gagcaggctggcagctctccag

SEQ ID NO: 6240406 - DNA, 21 bp, Homo sapiens
gagcaggcttgtggcagcctg

SEQ ID NO: 6240407 - DNA, 17 bp, Homo sapiens
gagcaggctttgtgaga

SEQ ID NO: 6240408 - DNA, 23 bp, Homo sapiens
gagcaggctttgtgagagaggac

SEQ ID NO: 6240409 - DNA, 18 bp, Homo sapiens
gagcagggaaggcctgac

SEQ ID NO: 6240410 - DNA, 15 bp, Homo sapiens
gagcagggagagctc

SEQ ID NO: 6240411 - DNA, 18 bp, Homo sapiens
gagcagggagagctcacc

SEQ ID NO: 6240412 - DNA, 22 bp, Homo sapiens
gagcagggattaacctctgcac

SEQ ID NO: 6240413 - DNA, 15 bp, Homo sapiens
gagcagggcaggccc

SEQ ID NO: 6240414 - DNA, 15 bp, Homo sapiens
gagcagggcatagga

SEQ ID NO: 6240415 - DNA, 18 bp, Homo sapiens
gagcagggccctcagagg

SEQ ID NO: 6240416 - DNA, 17 bp, Homo sapiens
gagcagggcggctgccg

SEQ ID NO: 6240417 - DNA, 14 bp, Homo sapiens
gagcaggggaagca

SEQ ID NO: 6240418 - DNA, 19 bp, Homo sapiens
gagcaggggcattgctgat

SEQ ID NO: 6240419 - DNA, 15 bp, Homo sapiens
gagcaggggcgtgga

SEQ ID NO: 6240420 - DNA, 14 bp, Homo sapiens
gagcaggggctgct

SEQ ID NO: 6240421 - DNA, 17 bp, Homo sapiens
gagcaggggctgctggg

SEQ ID NO: 6240422 - DNA, 20 bp, Homo sapiens
gagcagggggacctaggctc

SEQ ID NO: 6240423 - DNA, 20 bp, Homo sapiens
gagcaggggtccttggtgtg

SEQ ID NO: 6240424 - DNA, 18 bp, Homo sapiens
gagcaggggtctgagcca

SEQ ID NO: 6240425 - DNA, 14 bp, Homo sapiens
gagcaggggttggt

SEQ ID NO: 6240426 - DNA, 12 bp, Homo sapiens
gagcagggtcca

SEQ ID NO: 6240427 - DNA, 15 bp, Homo sapiens
gagcagggtccacag

SEQ ID NO: 6240428 - DNA, 16 bp, Homo sapiens
gagcagggtccacagc

SEQ ID NO: 6240429 - DNA, 19 bp, Homo sapiens
gagcagggtccacagctgg

SEQ ID NO: 6240430 - DNA, 15 bp, Homo sapiens
gagcagggtctctct

SEQ ID NO: 6240431 - DNA, 11 bp, Homo sapiens
gagcagggtga

SEQ ID NO: 6240432 - DNA, 12 bp, Homo sapiens
gagcagggtgac

SEQ ID NO: 6240433 - DNA, 14 bp, Homo sapiens
gagcagggtggggt

SEQ ID NO: 6240434 - DNA, 21 bp, Homo sapiens
gagcagggtggggtctgggag

SEQ ID NO: 6240435 - DNA, 20 bp, Homo sapiens
gagcaggtacatttctgatt

SEQ ID NO: 6240436 - DNA, 14 bp, Homo sapiens
gagcaggtctctgg

SEQ ID NO: 6240437 - DNA, 16 bp, Homo sapiens
gagcaggtctctggca

SEQ ID NO: 6240438 - DNA, 19 bp, Homo sapiens
gagcaggtctctggcagag

SEQ ID NO: 6240439 - DNA, 20 bp, Homo sapiens
gagcaggtctctggcagaga

SEQ ID NO: 6240440 - DNA, 13 bp, Homo sapiens
gagcaggtctgca

SEQ ID NO: 6240441 - DNA, 17 bp, Homo sapiens
gagcaggtctgcaggcc

SEQ ID NO: 6240442 - DNA, 19 bp, Homo sapiens
gagcaggtctgcaggccac

SEQ ID NO: 6240443 - DNA, 20 bp, Homo sapiens
gagcaggtctgcaggccacc

SEQ ID NO: 6240444 - DNA, 17 bp, Homo sapiens
gagcaggtgcccccagg

SEQ ID NO: 6240445 - DNA, 12 bp, Homo sapiens
gagcagtcacaa

SEQ ID NO: 6240446 - DNA, 15 bp, Homo sapiens
gagcagtcagagtcc

SEQ ID NO: 6240447 - DNA, 18 bp, Homo sapiens
gagcagtcagagtccagt

SEQ ID NO: 6240448 - DNA, 20 bp, Homo sapiens
gagcagtcagggtgggaaga

SEQ ID NO: 6240449 - DNA, 13 bp, Homo sapiens
gagcagtccagag

SEQ ID NO: 6240450 - DNA, 15 bp, Homo sapiens
gagcagtctacttct

SEQ ID NO: 6240451 - DNA, 21 bp, Homo sapiens
gagcagtgaatgattcagtgt

SEQ ID NO: 6240452 - DNA, 20 bp, Homo sapiens
gagcagtgatattctttgtt

SEQ ID NO: 6240453 - DNA, 16 bp, Homo sapiens
gagcagtgcaggcaca

SEQ ID NO: 6240454 - DNA, 21 bp, Homo sapiens
gagcagtgcttttggcgggga

SEQ ID NO: 6240455 - DNA, 21 bp, Homo sapiens
gagcagtggccgcaagcgcag

SEQ ID NO: 6240456 - DNA, 14 bp, Homo sapiens
gagcagtgggcagg

SEQ ID NO: 6240457 - DNA, 18 bp, Homo sapiens
gagcagtgggcaggtggc

SEQ ID NO: 6240458 - DNA, 19 bp, Homo sapiens
gagcagtgggccctggctc

SEQ ID NO: 6240459 - DNA, 15 bp, Homo sapiens
gagcagtgggcctgg

SEQ ID NO: 6240460 - DNA, 17 bp, Homo sapiens
gagcagtgtcttccata

SEQ ID NO: 6240461 - DNA, 23 bp, Homo sapiens
gagcagtgtgtctcctgcatgca

SEQ ID NO: 6240462 - DNA, 22 bp, Homo sapiens
gagcagtgttgcgtttttcctt

SEQ ID NO: 6240463 - DNA, 16 bp, Homo sapiens
gagcagttcagagtgg

SEQ ID NO: 6240464 - DNA, 16 bp, Homo sapiens
gagcagttcccaagga

SEQ ID NO: 6240465 - DNA, 20 bp, Homo sapiens
gagcagttggccaagcagaa

SEQ ID NO: 6240466 - DNA, 14 bp, Homo sapiens
gagcagttggcctg

SEQ ID NO: 6240467 - DNA, 17 bp, Homo sapiens
gagcagtttctgtcctg

SEQ ID NO: 6240468 - DNA, 13 bp, Homo sapiens
gagcagtttgcca

SEQ ID NO: 6240469 - DNA, 14 bp, Homo sapiens
gagcagtttgccac

SEQ ID NO: 6240470 - DNA, 20 bp, Homo sapiens
gagcagtttggggcaggggg

SEQ ID NO: 6240471 - DNA, 20 bp, Homo sapiens
gagcagttttccaggaggcc

SEQ ID NO: 6240472 - DNA, 18 bp, Homo sapiens
gagcagtttttaaaatag

SEQ ID NO: 6240473 - DNA, 13 bp, Homo sapiens
gccaatccctggc

SEQ ID NO: 6240474 - DNA, 18 bp, Homo sapiens
gccaatcggctacccctc

SEQ ID NO: 6240475 - DNA, 17 bp, Homo sapiens
gccaatctaaaatggca

SEQ ID NO: 6240476 - DNA, 17 bp, Homo sapiens
gccaatctccaggctcc

SEQ ID NO: 6240477 - DNA, 14 bp, Homo sapiens
gccaatctggccct

SEQ ID NO: 6240478 - DNA, 17 bp, Homo sapiens
gccaatctgtacaaaat

SEQ ID NO: 6240479 - DNA, 21 bp, Homo sapiens
gccaatcttgttttaagcaaa

SEQ ID NO: 6240480 - DNA, 23 bp, Homo sapiens
gccaatcttgttttaagcaaatg

SEQ ID NO: 6240481 - DNA, 22 bp, Homo sapiens
gccaatctttcctactttctat

SEQ ID NO: 6240482 - DNA, 15 bp, Homo sapiens
gccaatgaacatctc

SEQ ID NO: 6240483 - DNA, 19 bp, Homo sapiens
gccaatgaggtctgaaatg

SEQ ID NO: 6240484 - DNA, 16 bp, Homo sapiens
gccaatgcacggcctc

SEQ ID NO: 6240485 - DNA, 19 bp, Homo sapiens
gccaatggaaacctcacgc

SEQ ID NO: 6240486 - DNA, 13 bp, Homo sapiens
gccaatggaacct

SEQ ID NO: 6240487 - DNA, 17 bp, Homo sapiens
gccaatggaacctcctt

SEQ ID NO: 6240488 - DNA, 19 bp, Homo sapiens
gccaatggagaaaatgaat

SEQ ID NO: 6240489 - DNA, 21 bp, Homo sapiens
gccaatggagactgtctcaag

SEQ ID NO: 6240490 - DNA, 18 bp, Homo sapiens
gccaatggcccggcccct

SEQ ID NO: 6240491 - DNA, 23 bp, Homo sapiens
gccaatggcccggcccctcctga

SEQ ID NO: 6240492 - DNA, 15 bp, Homo sapiens
gccaatgggctagag

SEQ ID NO: 6240493 - DNA, 20 bp, Homo sapiens
gccaatgtcagcatcaagcc

SEQ ID NO: 6240494 - DNA, 16 bp, Homo sapiens
gccaatgtctcctccc

SEQ ID NO: 6240495 - DNA, 21 bp, Homo sapiens
gccaatgtgactaccgtgcca

SEQ ID NO: 6240496 - DNA, 18 bp, Homo sapiens
gccaatgtgggctgcccc

SEQ ID NO: 6240497 - DNA, 21 bp, Homo sapiens
gccaatgttatgccagctcca

SEQ ID NO: 6240498 - DNA, 19 bp, Homo sapiens
gccaatgttttccacccat

SEQ ID NO: 6240499 - DNA, 18 bp, Homo sapiens
gccaattaaaatatatat

SEQ ID NO: 6240500 - DNA, 23 bp, Homo sapiens
gccaattaaaatatatataaata

SEQ ID NO: 6240501 - DNA, 14 bp, Homo sapiens
gccaattagacttg

SEQ ID NO: 6240502 - DNA, 14 bp, Homo sapiens
gccaattatgttaa

SEQ ID NO: 6240503 - DNA, 19 bp, Homo sapiens
gccaattatgttaaactag

SEQ ID NO: 6240504 - DNA, 20 bp, Homo sapiens
gccaattatgttaaactagc

SEQ ID NO: 6240505 - DNA, 19 bp, Homo sapiens
gccaattgaataggatcaa

SEQ ID NO: 6240506 - DNA, 20 bp, Homo sapiens
gccaattgctaccgagaagg

SEQ ID NO: 6240507 - DNA, 20 bp, Homo sapiens
gccaatttctcttaagtact

SEQ ID NO: 6240508 - DNA, 15 bp, Homo sapiens
gccaatttttctgca

SEQ ID NO: 6240509 - DNA, 16 bp, Homo sapiens
gccaatttttctgcac

SEQ ID NO: 6240510 - DNA, 23 bp, Homo sapiens
gccaatttttgccttcattacct

SEQ ID NO: 6240511 - DNA, 19 bp, Homo sapiens
gccacaaaaatagagaaaa

SEQ ID NO: 6240512 - DNA, 22 bp, Homo sapiens
gccacaaaactctgtcaggcat

SEQ ID NO: 6240513 - DNA, 14 bp, Homo sapiens
gccacaaacctgcc

SEQ ID NO: 6240514 - DNA, 20 bp, Homo sapiens
gccacaaatcaaagcaaggg

SEQ ID NO: 6240515 - DNA, 19 bp, Homo sapiens
gccacaacctgaaagacaa

SEQ ID NO: 6240516 - DNA, 20 bp, Homo sapiens
gccacaactcctacatgatg

SEQ ID NO: 6240517 - DNA, 19 bp, Homo sapiens
gccacaactgctgtggccc

SEQ ID NO: 6240518 - DNA, 14 bp, Homo sapiens
gccacaagaaattt

SEQ ID NO: 6240519 - DNA, 19 bp, Homo sapiens
gccacaagctgcactgtga

SEQ ID NO: 6240520 - DNA, 20 bp, Homo sapiens
gccacaaggacgctggctac

SEQ ID NO: 6240521 - DNA, 17 bp, Homo sapiens
gccacaaggacttcctg

SEQ ID NO: 6240522 - DNA, 21 bp, Homo sapiens
gccacaaggacttcctgtcca

SEQ ID NO: 6240523 - DNA, 20 bp, Homo sapiens
gccacaaggtggtgcttctg

SEQ ID NO: 6240524 - DNA, 14 bp, Homo sapiens
gccacaatcactaa

SEQ ID NO: 6240525 - DNA, 24 bp, Homo sapiens
gccacaatcactaaatatctagtg

SEQ ID NO: 6240526 - DNA, 16 bp, Homo sapiens
gccacaatcctcccca

SEQ ID NO: 6240527 - DNA, 18 bp, Homo sapiens
gccacaatcctccccacc

SEQ ID NO: 6240528 - DNA, 19 bp, Homo sapiens
gccacaatcctccccacca

SEQ ID NO: 6240529 - DNA, 21 bp, Homo sapiens
gccacaatgaacatccctttt

SEQ ID NO: 6240530 - DNA, 14 bp, Homo sapiens
gccacaatgtgata

SEQ ID NO: 6240531 - DNA, 10 bp, Homo sapiens
gccacacaca

SEQ ID NO: 6240532 - DNA, 16 bp, Homo sapiens
gccacacacacagaaa

SEQ ID NO: 6240533 - DNA, 17 bp, Homo sapiens
gccacacacacagaaaa

SEQ ID NO: 6240534 - DNA, 18 bp, Homo sapiens
gccacacacacagaaaat

SEQ ID NO: 6240535 - DNA, 22 bp, Homo sapiens
gccacacacacagaaaatatac

SEQ ID NO: 6240536 - DNA, 22 bp, Homo sapiens
gccacacactgagttgcacata

SEQ ID NO: 6240537 - DNA, 14 bp, Homo sapiens
gccacacagaccac

SEQ ID NO: 6240538 - DNA, 20 bp, Homo sapiens
gccacacagaccaccatcca

SEQ ID NO: 6240539 - DNA, 12 bp, Homo sapiens
gccacacagagc

SEQ ID NO: 6240540 - DNA, 14 bp, Homo sapiens
gccacacagagcct

SEQ ID NO: 6240541 - DNA, 14 bp, Homo sapiens
gccacacagcagcg

SEQ ID NO: 6240542 - DNA, 13 bp, Homo sapiens
gccacacagccca

SEQ ID NO: 6240543 - DNA, 16 bp, Homo sapiens
gccacacagcccagaa

SEQ ID NO: 6240544 - DNA, 20 bp, Homo sapiens
gccacacagcccagaaggcc

SEQ ID NO: 6240545 - DNA, 13 bp, Homo sapiens
gccacacaggcag

SEQ ID NO: 6240546 - DNA, 15 bp, Homo sapiens
gccacacagtatttt

SEQ ID NO: 6240547 - DNA, 16 bp, Homo sapiens
gccacacagtggccgg

SEQ ID NO: 6240548 - DNA, 18 bp, Homo sapiens
gccacacagtggccgggg

SEQ ID NO: 6240549 - DNA, 19 bp, Homo sapiens
gccacacagtggccggggc

SEQ ID NO: 6240550 - DNA, 22 bp, Homo sapiens
gccacacagtgggccggcccca

SEQ ID NO: 6240551 - DNA, 23 bp, Homo sapiens
gccacacagtgggccggccccag

SEQ ID NO: 6240552 - DNA, 14 bp, Homo sapiens
gccacacatgggca

SEQ ID NO: 6240553 - DNA, 15 bp, Homo sapiens
gccacaccaagctgt

SEQ ID NO: 6240554 - DNA, 22 bp, Homo sapiens
gccacaccaagctgtgccaccc

SEQ ID NO: 6240555 - DNA, 14 bp, Homo sapiens
gccacaccactgcc

SEQ ID NO: 6240556 - DNA, 16 bp, Homo sapiens
gccacaccaggataga

SEQ ID NO: 6240557 - DNA, 18 bp, Homo sapiens
gccacacccagagtagcc

SEQ ID NO: 6240558 - DNA, 12 bp, Homo sapiens
gccacacccagg

SEQ ID NO: 6240559 - DNA, 23 bp, Homo sapiens
gccacacccaggggaaggccctg

SEQ ID NO: 6240560 - DNA, 14 bp, Homo sapiens
gccacaccccagac

SEQ ID NO: 6240561 - DNA, 18 bp, Homo sapiens
gccacaccccagactcca

SEQ ID NO: 6240562 - DNA, 23 bp, Homo sapiens
gccacaccccagactccaggccc

SEQ ID NO: 6240563 - DNA, 22 bp, Homo sapiens
gccacacccggctccccctgct

SEQ ID NO: 6240564 - DNA, 16 bp, Homo sapiens
gccacaccctcccccg

SEQ ID NO: 6240565 - DNA, 18 bp, Homo sapiens
gccacaccgctggctccg

SEQ ID NO: 6240566 - DNA, 14 bp, Homo sapiens
gccacacctgagcc

SEQ ID NO: 6240567 - DNA, 21 bp, Homo sapiens
gccacacctggactgaccctg

SEQ ID NO: 6240568 - DNA, 19 bp, Homo sapiens
gccacacgcactggtgcca

SEQ ID NO: 6240569 - DNA, 16 bp, Homo sapiens
gccacacgcaggcggc

SEQ ID NO: 6240570 - DNA, 22 bp, Homo sapiens
gccacacgcatgggcattgcag

SEQ ID NO: 6240571 - DNA, 15 bp, Homo sapiens
gccacacgcctctgt

SEQ ID NO: 6240572 - DNA, 16 bp, Homo sapiens
gccacacgctcactcc

SEQ ID NO: 6240573 - DNA, 15 bp, Homo sapiens
gccacacgctgccca

SEQ ID NO: 6240574 - DNA, 16 bp, Homo sapiens
gccacacggaagcaag

SEQ ID NO: 6240575 - DNA, 20 bp, Homo sapiens
gccacacggagaggccactg

SEQ ID NO: 6240576 - DNA, 13 bp, Homo sapiens
gccacactcagca

SEQ ID NO: 6240577 - DNA, 15 bp, Homo sapiens
gccacactcagtccc

SEQ ID NO: 6240578 - DNA, 17 bp, Homo sapiens
gccacactcagtccccc

SEQ ID NO: 6240579 - DNA, 19 bp, Homo sapiens
gccacactcagtcccccac

SEQ ID NO: 6240580 - DNA, 12 bp, Homo sapiens
gccacactgatg

SEQ ID NO: 6240581 - DNA, 21 bp, Homo sapiens
gccacactggccggcccacgt

SEQ ID NO: 6240582 - DNA, 13 bp, Homo sapiens
gccacactgggct

SEQ ID NO: 6240583 - DNA, 15 bp, Homo sapiens
gccacactgggctca

SEQ ID NO: 6240584 - DNA, 12 bp, Homo sapiens
gccacactgggg

SEQ ID NO: 6240585 - DNA, 17 bp, Homo sapiens
gccacactgtgacacac

SEQ ID NO: 6240586 - DNA, 23 bp, Homo sapiens
gccacacttcaggctcttctcct

SEQ ID NO: 6240587 - DNA, 18 bp, Homo sapiens
gccacacttgaacctaat

SEQ ID NO: 6240588 - DNA, 20 bp, Homo sapiens
gccacacttgtgtgccacag

SEQ ID NO: 6240589 - DNA, 16 bp, Homo sapiens
gccacactttgaaggt

SEQ ID NO: 6240590 - DNA, 20 bp, Homo sapiens
gccacagaaagctccttcca

SEQ ID NO: 6240591 - DNA, 15 bp, Homo sapiens
gccacagacaactca

SEQ ID NO: 6240592 - DNA, 20 bp, Homo sapiens
gccacagaccacctgcttct

SEQ ID NO: 6240593 - DNA, 21 bp, Homo sapiens
gccacagaccacctgcttctg

SEQ ID NO: 6240594 - DNA, 16 bp, Homo sapiens
gccacagacccctggg

SEQ ID NO: 6240595 - DNA, 13 bp, Homo sapiens
gccacagagaaag

SEQ ID NO: 6240596 - DNA, 15 bp, Homo sapiens
gccacagagaacctg

SEQ ID NO: 6240597 - DNA, 20 bp, Homo sapiens
gccacagagaataagctgaa

SEQ ID NO: 6240598 - DNA, 17 bp, Homo sapiens
gccacagcactcggcct

SEQ ID NO: 6240599 - DNA, 16 bp, Homo sapiens
gccacagcagcatttt

SEQ ID NO: 6240600 - DNA, 16 bp, Homo sapiens
gccacagcagcctctg

SEQ ID NO: 6240601 - DNA, 14 bp, Homo sapiens
gccacagccaagcc

SEQ ID NO: 6240602 - DNA, 18 bp, Homo sapiens
gccacagccaagcccacc

SEQ ID NO: 6240603 - DNA, 12 bp, Homo sapiens
gccacagccacc

SEQ ID NO: 6240604 - DNA, 22 bp, Homo sapiens
gccacagccacctccaccccca

SEQ ID NO: 6240605 - DNA, 12 bp, Homo sapiens
gccacagccaga

SEQ ID NO: 6240606 - DNA, 13 bp, Homo sapiens
gccacagccagcc

SEQ ID NO: 6240607 - DNA, 16 bp, Homo sapiens
gccacagccagggctc

SEQ ID NO: 6240608 - DNA, 15 bp, Homo sapiens
gccacagccccacag

SEQ ID NO: 6240609 - DNA, 16 bp, Homo sapiens
gccacagccccacagc

SEQ ID NO: 6240610 - DNA, 18 bp, Homo sapiens
gccacagcccccttgccc

SEQ ID NO: 6240611 - DNA, 21 bp, Homo sapiens
gccacagcccctggcactgca

SEQ ID NO: 6240612 - DNA, 21 bp, Homo sapiens
gccacagccctgtcagcatga

SEQ ID NO: 6240613 - DNA, 13 bp, Homo sapiens
gccacagccgcct

SEQ ID NO: 6240614 - DNA, 15 bp, Homo sapiens
gccacagcctcccca

SEQ ID NO: 6240615 - DNA, 18 bp, Homo sapiens
gccacagcctgctggcag

SEQ ID NO: 6240616 - DNA, 13 bp, Homo sapiens
gccacagccttcc

SEQ ID NO: 6240617 - DNA, 15 bp, Homo sapiens
gccacagccttccct

SEQ ID NO: 6240618 - DNA, 19 bp, Homo sapiens
gccacagccttccctctgc

SEQ ID NO: 6240619 - DNA, 23 bp, Homo sapiens
gccacagccttccctctgcattg

SEQ ID NO: 6240620 - DNA, 23 bp, Homo sapiens
gccacagccttcggacagacata

SEQ ID NO: 6240621 - DNA, 16 bp, Homo sapiens
gccacagcgccagcct

SEQ ID NO: 6240622 - DNA, 22 bp, Homo sapiens
gccacagcgtgctggcgacact

SEQ ID NO: 6240623 - DNA, 18 bp, Homo sapiens
gccacagctgctggagaa

SEQ ID NO: 6240624 - DNA, 16 bp, Homo sapiens
gccacagctgctgttc

SEQ ID NO: 6240625 - DNA, 21 bp, Homo sapiens
gccacaggaaggaggggagag

SEQ ID NO: 6240626 - DNA, 11 bp, Homo sapiens
gccacaggacc

SEQ ID NO: 6240627 - DNA, 12 bp, Homo sapiens
gccacaggacca

SEQ ID NO: 6240628 - DNA, 17 bp, Homo sapiens
gccacaggaccacctcc

SEQ ID NO: 6240629 - DNA, 12 bp, Homo sapiens
gccacaggaccc

SEQ ID NO: 6240630 - DNA, 16 bp, Homo sapiens
gccacaggactgagcc

SEQ ID NO: 6240631 - DNA, 15 bp, Homo sapiens
gccacaggagccctg

SEQ ID NO: 6240632 - DNA, 17 bp, Homo sapiens
gccacaggagccctgct

SEQ ID NO: 6240633 - DNA, 20 bp, Homo sapiens
gccacaggcaggtcacagaa

SEQ ID NO: 6240634 - DNA, 18 bp, Homo sapiens
gccacaggccaaatcctt

SEQ ID NO: 6240635 - DNA, 12 bp, Homo sapiens
gccacaggcctc

SEQ ID NO: 6240636 - DNA, 23 bp, Homo sapiens
gccacaggcctgagatttcatct

SEQ ID NO: 6240637 - DNA, 14 bp, Homo sapiens
gccacaggcctggc

SEQ ID NO: 6240638 - DNA, 15 bp, Homo sapiens
gccacagggagctcc

SEQ ID NO: 6240639 - DNA, 16 bp, Homo sapiens
gccacagggtctgcct

SEQ ID NO: 6240640 - DNA, 17 bp, Homo sapiens
gccacagggtctgcctc

SEQ ID NO: 6240641 - DNA, 18 bp, Homo sapiens
gccacagtagtcttgatg

SEQ ID NO: 6240642 - DNA, 22 bp, Homo sapiens
gccacagtatggatgggtggat

SEQ ID NO: 6240643 - DNA, 17 bp, Homo sapiens
gccacagtctccccaga

SEQ ID NO: 6240644 - DNA, 19 bp, Homo sapiens
gccacagtctccccagata

SEQ ID NO: 6240645 - DNA, 20 bp, Homo sapiens
gccacagtgggatgaaccag

SEQ ID NO: 6240646 - DNA, 22 bp, Homo sapiens
gccacagtggggcccatggccc

SEQ ID NO: 6240647 - DNA, 19 bp, Homo sapiens
gccacagtggggctgcagg

SEQ ID NO: 6240648 - DNA, 23 bp, Homo sapiens
gccacagtggggctgcaggcagg

SEQ ID NO: 6240649 - DNA, 23 bp, Homo sapiens
gccacagtggtactctgtgtctg

SEQ ID NO: 6240650 - DNA, 20 bp, Homo sapiens
gccacagtgtcactggtcag

SEQ ID NO: 6240651 - DNA, 21 bp, Homo sapiens
gagcataataaatggatgagg

SEQ ID NO: 6240652 - DNA, 17 bp, Homo sapiens
gagcataatttaaaaat

SEQ ID NO: 6240653 - DNA, 15 bp, Homo sapiens
gagcatacccagtgt

SEQ ID NO: 6240654 - DNA, 18 bp, Homo sapiens
gagcatagaagccacatc

SEQ ID NO: 6240655 - DNA, 16 bp, Homo sapiens
gagcatagtccaaaaa

SEQ ID NO: 6240656 - DNA, 14 bp, Homo sapiens
gagcatatactggt

SEQ ID NO: 6240657 - DNA, 23 bp, Homo sapiens
gagcatatctggtatatgtcatt

SEQ ID NO: 6240658 - DNA, 22 bp, Homo sapiens
gagcatatttgccaataaagct

SEQ ID NO: 6240659 - DNA, 12 bp, Homo sapiens
gagcatcacaga

SEQ ID NO: 6240660 - DNA, 17 bp, Homo sapiens
gagcatcactagtgaca

SEQ ID NO: 6240661 - DNA, 20 bp, Homo sapiens
gagcatcagctgtctgtcat

SEQ ID NO: 6240662 - DNA, 13 bp, Homo sapiens
gagcatcaggcca

SEQ ID NO: 6240663 - DNA, 15 bp, Homo sapiens
gagcatcaggccagg

SEQ ID NO: 6240664 - DNA, 16 bp, Homo sapiens
gagcatcaggccaggc

SEQ ID NO: 6240665 - DNA, 21 bp, Homo sapiens
gagcatcaggctaagaccctg

SEQ ID NO: 6240666 - DNA, 17 bp, Homo sapiens
gagcatcatgcctctga

SEQ ID NO: 6240667 - DNA, 20 bp, Homo sapiens
gagcatcatgcctctgaggc

SEQ ID NO: 6240668 - DNA, 14 bp, Homo sapiens
gagcatccacctcc

SEQ ID NO: 6240669 - DNA, 19 bp, Homo sapiens
gagcatcccggaggaaatc

SEQ ID NO: 6240670 - DNA, 20 bp, Homo sapiens
gagcatcccggaggaaatct

SEQ ID NO: 6240671 - DNA, 21 bp, Homo sapiens
gagcatccctaattcttcata

SEQ ID NO: 6240672 - DNA, 22 bp, Homo sapiens
gagcatcctgagccccgccctc

SEQ ID NO: 6240673 - DNA, 14 bp, Homo sapiens
gagcatcctgcaag

SEQ ID NO: 6240674 - DNA, 15 bp, Homo sapiens
gagcatcgtgaccct

SEQ ID NO: 6240675 - DNA, 23 bp, Homo sapiens
gagcatctccagcattctcagcc

SEQ ID NO: 6240676 - DNA, 13 bp, Homo sapiens
gagcatctgactc

SEQ ID NO: 6240677 - DNA, 16 bp, Homo sapiens
gagcatctgccccagg

SEQ ID NO: 6240678 - DNA, 13 bp, Homo sapiens
gagcatctgctct

SEQ ID NO: 6240679 - DNA, 15 bp, Homo sapiens
gagcatctgctctga

SEQ ID NO: 6240680 - DNA, 21 bp, Homo sapiens
gagcatctggattctgcctaa

SEQ ID NO: 6240681 - DNA, 22 bp, Homo sapiens
gagcatctggctgtttagcaga

SEQ ID NO: 6240682 - DNA, 18 bp, Homo sapiens
gagcatctgtcccactgg

SEQ ID NO: 6240683 - DNA, 23 bp, Homo sapiens
gagcatgatgggaatagggagac

SEQ ID NO: 6240684 - DNA, 17 bp, Homo sapiens
gagcatgatttgaaaaa

SEQ ID NO: 6240685 - DNA, 16 bp, Homo sapiens
gagcatgcacagctgc

SEQ ID NO: 6240686 - DNA, 18 bp, Homo sapiens
gagcatgcacagctgctt

SEQ ID NO: 6240687 - DNA, 14 bp, Homo sapiens
gagcatgcacatgc

SEQ ID NO: 6240688 - DNA, 18 bp, Homo sapiens
gagcatgcccaaatataa

SEQ ID NO: 6240689 - DNA, 22 bp, Homo sapiens
gagcatgcccaaatataacatg

SEQ ID NO: 6240690 - DNA, 22 bp, Homo sapiens
gagcatgcttccctgcagctga

SEQ ID NO: 6240691 - DNA, 16 bp, Homo sapiens
gagcatggagacagca

SEQ ID NO: 6240692 - DNA, 18 bp, Homo sapiens
gagcatggagacagcagt

SEQ ID NO: 6240693 - DNA, 15 bp, Homo sapiens
gagcatggagctggc

SEQ ID NO: 6240694 - DNA, 16 bp, Homo sapiens
gagcatggatgcattt

SEQ ID NO: 6240695 - DNA, 18 bp, Homo sapiens
gagcatggatgcatttca

SEQ ID NO: 6240696 - DNA, 20 bp, Homo sapiens
gagcatggccgcaacttccc

SEQ ID NO: 6240697 - DNA, 17 bp, Homo sapiens
gagcatgggcctggcca

SEQ ID NO: 6240698 - DNA, 13 bp, Homo sapiens
gagcatggggcca

SEQ ID NO: 6240699 - DNA, 17 bp, Homo sapiens
gagcatggggccaggaa

SEQ ID NO: 6240700 - DNA, 17 bp, Homo sapiens
gagcatgggggctgcca

SEQ ID NO: 6240701 - DNA, 20 bp, Homo sapiens
gagcatgggggctgccagcg

SEQ ID NO: 6240702 - DNA, 13 bp, Homo sapiens
gagcatgggtgtg

SEQ ID NO: 6240703 - DNA, 17 bp, Homo sapiens
gagcatgggttcatcct

SEQ ID NO: 6240704 - DNA, 20 bp, Homo sapiens
gagcatggtgttttcattcc

SEQ ID NO: 6240705 - DNA, 19 bp, Homo sapiens
gagcatgtaaaagcggaaa

SEQ ID NO: 6240706 - DNA, 12 bp, Homo sapiens
gagcatgtaagt

SEQ ID NO: 6240707 - DNA, 19 bp, Homo sapiens
gagcatgtttcacagtggc

SEQ ID NO: 6240708 - DNA, 18 bp, Homo sapiens
gagcatgttttgtataca

SEQ ID NO: 6240709 - DNA, 12 bp, Homo sapiens
gagcattaaaat

SEQ ID NO: 6240710 - DNA, 18 bp, Homo sapiens
gagcattaaaataactat

SEQ ID NO: 6240711 - DNA, 18 bp, Homo sapiens
gagcattaactaaatgct

SEQ ID NO: 6240712 - DNA, 21 bp, Homo sapiens
gagcattaactaaatgctcat

SEQ ID NO: 6240713 - DNA, 20 bp, Homo sapiens
gagcattacgtgagccaggt

SEQ ID NO: 6240714 - DNA, 20 bp, Homo sapiens
gagcattagaatggaggaaa

SEQ ID NO: 6240715 - DNA, 14 bp, Homo sapiens
gagcattagctggc

SEQ ID NO: 6240716 - DNA, 13 bp, Homo sapiens
gagcattccagtc

SEQ ID NO: 6240717 - DNA, 15 bp, Homo sapiens
gagcattctgcctgc

SEQ ID NO: 6240718 - DNA, 17 bp, Homo sapiens
gagcattgccattccct

SEQ ID NO: 6240719 - DNA, 13 bp, Homo sapiens
gagcattggcccc

SEQ ID NO: 6240720 - DNA, 22 bp, Homo sapiens
gagcattgtcaccgcaggtgct

SEQ ID NO: 6240721 - DNA, 19 bp, Homo sapiens
gagcattgtggctgtcagc

SEQ ID NO: 6240722 - DNA, 19 bp, Homo sapiens
gagcatttatgtagacatt

SEQ ID NO: 6240723 - DNA, 19 bp, Homo sapiens
gagcatttctcatcagtag

SEQ ID NO: 6240724 - DNA, 17 bp, Homo sapiens
gagcatttggcagagtc

SEQ ID NO: 6240725 - DNA, 17 bp, Homo sapiens
gagcatttggtacacac

SEQ ID NO: 6240726 - DNA, 20 bp, Homo sapiens
gagcattttgataccagaag

SEQ ID NO: 6240727 - DNA, 14 bp, Homo sapiens
gagcattttgtgtc

SEQ ID NO: 6240728 - DNA, 15 bp, Homo sapiens
gagcatttttcagag

SEQ ID NO: 6240729 - DNA, 18 bp, Homo sapiens
gagcatttttcagagttt

SEQ ID NO: 6240730 - DNA, 21 bp, Homo sapiens
gagcatttttcagagttttct

SEQ ID NO: 6240731 - DNA, 18 bp, Homo sapiens
gagcatttttttattcag

SEQ ID NO: 6240732 - DNA, 21 bp, Homo sapiens
gagcatttttttattcagcag

SEQ ID NO: 6240733 - DNA, 20 bp, Homo sapiens
gagccaaaatgactttgaac

SEQ ID NO: 6240734 - DNA, 18 bp, Homo sapiens
gagccaaacagagcccag

SEQ ID NO: 6240735 - DNA, 15 bp, Homo sapiens
gagccaaagccagag

SEQ ID NO: 6240736 - DNA, 22 bp, Homo sapiens
gagccaaagcttatgtgacatg

SEQ ID NO: 6240737 - DNA, 21 bp, Homo sapiens
gagccaacaagaccgccccag

SEQ ID NO: 6240738 - DNA, 14 bp, Homo sapiens
gagccaacctcggc

SEQ ID NO: 6240739 - DNA, 19 bp, Homo sapiens
gagccaacctcggcttgtg

SEQ ID NO: 6240740 - DNA, 22 bp, Homo sapiens
gagccaacctcggcttgtgggc

SEQ ID NO: 6240741 - DNA, 16 bp, Homo sapiens
gagccaacctggactt

SEQ ID NO: 6240742 - DNA, 20 bp, Homo sapiens
gagccaacctggacttcctg

SEQ ID NO: 6240743 - DNA, 23 bp, Homo sapiens
gagccaacctggacttcctgtca

SEQ ID NO: 6240744 - DNA, 22 bp, Homo sapiens
gagccaaccttaaacctcttct

SEQ ID NO: 6240745 - DNA, 16 bp, Homo sapiens
gagccaaccttgctct

SEQ ID NO: 6240746 - DNA, 19 bp, Homo sapiens
gagccaactctaacaggca

SEQ ID NO: 6240747 - DNA, 14 bp, Homo sapiens
gagccaactgattt

SEQ ID NO: 6240748 - DNA, 21 bp, Homo sapiens
gagccaactgattttgtatgt

SEQ ID NO: 6240749 - DNA, 14 bp, Homo sapiens
gagccaactgctgc

SEQ ID NO: 6240750 - DNA, 11 bp, Homo sapiens
gagccaagacg

SEQ ID NO: 6240751 - DNA, 18 bp, Homo sapiens
gagccaagacggaggagg

SEQ ID NO: 6240752 - DNA, 13 bp, Homo sapiens
gagccaagcactg

SEQ ID NO: 6240753 - DNA, 20 bp, Homo sapiens
gagccaagccttaaactgta

SEQ ID NO: 6240754 - DNA, 15 bp, Homo sapiens
gagccaagctgcaca

SEQ ID NO: 6240755 - DNA, 16 bp, Homo sapiens
gagccaaggaggcctg

SEQ ID NO: 6240756 - DNA, 11 bp, Homo sapiens
gagccaaggcc

SEQ ID NO: 6240757 - DNA, 17 bp, Homo sapiens
gagccaagggatggaca

SEQ ID NO: 6240758 - DNA, 19 bp, Homo sapiens
gagccaagggatggacatc

SEQ ID NO: 6240759 - DNA, 18 bp, Homo sapiens
gagccaagggggcagagg

SEQ ID NO: 6240760 - DNA, 20 bp, Homo sapiens
gagccaaggggtctgctcct

SEQ ID NO: 6240761 - DNA, 23 bp, Homo sapiens
gagccaagggttcagagactcag

SEQ ID NO: 6240762 - DNA, 14 bp, Homo sapiens
gagccaagtccaga

SEQ ID NO: 6240763 - DNA, 14 bp, Homo sapiens
gagccaagtggtcc

SEQ ID NO: 6240764 - DNA, 21 bp, Homo sapiens
gagccaagtggtccagcgtca

SEQ ID NO: 6240765 - DNA, 18 bp, Homo sapiens
gagccaataaagctcaca

SEQ ID NO: 6240766 - DNA, 19 bp, Homo sapiens
gagccaataaagctcacac

SEQ ID NO: 6240767 - DNA, 19 bp, Homo sapiens
gagccaatactgagtgcct

SEQ ID NO: 6240768 - DNA, 20 bp, Homo sapiens
gagccaatactgagtgcctg

SEQ ID NO: 6240769 - DNA, 21 bp, Homo sapiens
gagccaatactgagtgcctgc

SEQ ID NO: 6240770 - DNA, 20 bp, Homo sapiens
gagccaatgaacagctcctc

SEQ ID NO: 6240771 - DNA, 22 bp, Homo sapiens
gagccaatggcccggcccctcc

SEQ ID NO: 6240772 - DNA, 15 bp, Homo sapiens
gagccacaagctgca

SEQ ID NO: 6240773 - DNA, 18 bp, Homo sapiens
gagccacaagctgcactg

SEQ ID NO: 6240774 - DNA, 23 bp, Homo sapiens
gagccacaagctgcactgtgaac

SEQ ID NO: 6240775 - DNA, 13 bp, Homo sapiens
gagccacacagag

SEQ ID NO: 6240776 - DNA, 16 bp, Homo sapiens
gagccacagcagcatt

SEQ ID NO: 6240777 - DNA, 20 bp, Homo sapiens
gagccacagcagcattttta

SEQ ID NO: 6240778 - DNA, 13 bp, Homo sapiens
gagccacaggcag

SEQ ID NO: 6240779 - DNA, 14 bp, Homo sapiens
gagccacaggcaga

SEQ ID NO: 6240780 - DNA, 20 bp, Homo sapiens
gagccacaggcaggggtgag

SEQ ID NO: 6240781 - DNA, 15 bp, Homo sapiens
gagccacagtcactg

SEQ ID NO: 6240782 - DNA, 17 bp, Homo sapiens
gagccacagtcactgga

SEQ ID NO: 6240783 - DNA, 14 bp, Homo sapiens
gagccacagtgggg

SEQ ID NO: 6240784 - DNA, 19 bp, Homo sapiens
gagccacagtggggcccat

SEQ ID NO: 6240785 - DNA, 20 bp, Homo sapiens
gagccacagtggggcccatg

SEQ ID NO: 6240786 - DNA, 19 bp, Homo sapiens
gagccaccacacccagcct

SEQ ID NO: 6240787 - DNA, 14 bp, Homo sapiens
gagccaccacacct

SEQ ID NO: 6240788 - DNA, 20 bp, Homo sapiens
gagccaccagggcactgtct

SEQ ID NO: 6240789 - DNA, 13 bp, Homo sapiens
gagccaccagttc

SEQ ID NO: 6240790 - DNA, 14 bp, Homo sapiens
gagccaccatgccc

SEQ ID NO: 6240791 - DNA, 21 bp, Homo sapiens
gagccaccgcgagggcctgcg

SEQ ID NO: 6240792 - DNA, 20 bp, Homo sapiens
gagccaccgtgcctggccag

SEQ ID NO: 6240793 - DNA, 11 bp, Homo sapiens
gagccacctgc

SEQ ID NO: 6240794 - DNA, 18 bp, Homo sapiens
gagccacctgcaagatgg

SEQ ID NO: 6240795 - DNA, 20 bp, Homo sapiens
gagccacctgcaagatggac

SEQ ID NO: 6240796 - DNA, 13 bp, Homo sapiens
gagccacctgccc

SEQ ID NO: 6240797 - DNA, 23 bp, Homo sapiens
gagccacctggatctatccctgc

SEQ ID NO: 6240798 - DNA, 12 bp, Homo sapiens
gagccacctggc

SEQ ID NO: 6240799 - DNA, 18 bp, Homo sapiens
gagccacctgggctggga

SEQ ID NO: 6240800 - DNA, 20 bp, Homo sapiens
gagccacctgggctgggaga

SEQ ID NO: 6240801 - DNA, 21 bp, Homo sapiens
gagccacctgggctgggagaa

SEQ ID NO: 6240802 - DNA, 20 bp, Homo sapiens
gagccacctgtcccacctca

SEQ ID NO: 6240803 - DNA, 20 bp, Homo sapiens
gagccacctttactctgctc

SEQ ID NO: 6240804 - DNA, 15 bp, Homo sapiens
gagccactccggccc

SEQ ID NO: 6240805 - DNA, 15 bp, Homo sapiens
gagccactccttcct

SEQ ID NO: 6240806 - DNA, 21 bp, Homo sapiens
gagccactctatgagttggac

SEQ ID NO: 6240807 - DNA, 12 bp, Homo sapiens
gagccactctgt

SEQ ID NO: 6240808 - DNA, 16 bp, Homo sapiens
gagccactgagcctgg

SEQ ID NO: 6240809 - DNA, 17 bp, Homo sapiens
gagccactgagcctggc

SEQ ID NO: 6240810 - DNA, 18 bp, Homo sapiens
gagccactgcaccgggcc

SEQ ID NO: 6240811 - DNA, 19 bp, Homo sapiens
gagccactgcaccgggcca

SEQ ID NO: 6240812 - DNA, 20 bp, Homo sapiens
gagccactgcaccgggccac

SEQ ID NO: 6240813 - DNA, 15 bp, Homo sapiens
gagccactgcacctg

SEQ ID NO: 6240814 - DNA, 13 bp, Homo sapiens
gagccactgccac

SEQ ID NO: 6240815 - DNA, 14 bp, Homo sapiens
gagccactgccact

SEQ ID NO: 6240816 - DNA, 22 bp, Homo sapiens
gagccactgccactccagtcct

SEQ ID NO: 6240817 - DNA, 21 bp, Homo sapiens
gagccactgcgcccggcccaa

SEQ ID NO: 6240818 - DNA, 20 bp, Homo sapiens
gagccactgggcccctgtcc

SEQ ID NO: 6240819 - DNA, 21 bp, Homo sapiens
gagccactgggcccctgtccc

SEQ ID NO: 6240820 - DNA, 21 bp, Homo sapiens
gagccactggggtgggagggg

SEQ ID NO: 6240821 - DNA, 14 bp, Homo sapiens
gagccacttctccc

SEQ ID NO: 6240822 - DNA, 15 bp, Homo sapiens
gagccacttctcccc

SEQ ID NO: 6240823 - DNA, 16 bp, Homo sapiens
gagccacttctcccca

SEQ ID NO: 6240824 - DNA, 22 bp, Homo sapiens
gagccagaaatgggcagttctc

SEQ ID NO: 6240825 - DNA, 22 bp, Homo sapiens
gagccagaagtaaagtttattt

SEQ ID NO: 6240826 - DNA, 19 bp, Homo sapiens
gagccagactgtccaggga

SEQ ID NO: 6240827 - DNA, 17 bp, Homo sapiens
gagccagagaagtgaca

SEQ ID NO: 6240828 - DNA, 13 bp, Homo sapiens
gagccagagggag

SEQ ID NO: 6240829 - DNA, 12 bp, Homo sapiens
gccacagttgtt

SEQ ID NO: 6240830 - DNA, 15 bp, Homo sapiens
gccacatacaggtgc

SEQ ID NO: 6240831 - DNA, 16 bp, Homo sapiens
gccacatacctctctg

SEQ ID NO: 6240832 - DNA, 15 bp, Homo sapiens
gccacatcaaagagg

SEQ ID NO: 6240833 - DNA, 13 bp, Homo sapiens
gccacatcagccc

SEQ ID NO: 6240834 - DNA, 23 bp, Homo sapiens
gccacatcatctttatctcctgg

SEQ ID NO: 6240835 - DNA, 17 bp, Homo sapiens
gccacatcattctgtgt

SEQ ID NO: 6240836 - DNA, 15 bp, Homo sapiens
gccacatccccaagc

SEQ ID NO: 6240837 - DNA, 18 bp, Homo sapiens
gccacatccccaagccca

SEQ ID NO: 6240838 - DNA, 18 bp, Homo sapiens
gccacatccccgctggct

SEQ ID NO: 6240839 - DNA, 15 bp, Homo sapiens
gccacatctgtgtct

SEQ ID NO: 6240840 - DNA, 14 bp, Homo sapiens
gccacatcttgaaa

SEQ ID NO: 6240841 - DNA, 20 bp, Homo sapiens
gccacatcttgaaaatgcca

SEQ ID NO: 6240842 - DNA, 21 bp, Homo sapiens
gccacatcttgaaaatgccac

SEQ ID NO: 6240843 - DNA, 20 bp, Homo sapiens
gccacatgagtcccagtggg

SEQ ID NO: 6240844 - DNA, 15 bp, Homo sapiens
gccacatgccccagg

SEQ ID NO: 6240845 - DNA, 13 bp, Homo sapiens
gccacatggagcc

SEQ ID NO: 6240846 - DNA, 21 bp, Homo sapiens
gccacatggagccccctctgc

SEQ ID NO: 6240847 - DNA, 22 bp, Homo sapiens
gccacatggcttcctcctgcgc

SEQ ID NO: 6240848 - DNA, 17 bp, Homo sapiens
gccacatggtgtctccc

SEQ ID NO: 6240849 - DNA, 23 bp, Homo sapiens
gccacatggtgtctcccaacatg

SEQ ID NO: 6240850 - DNA, 18 bp, Homo sapiens
gccacatggtgtggccat

SEQ ID NO: 6240851 - DNA, 14 bp, Homo sapiens
gccacattagaact

SEQ ID NO: 6240852 - DNA, 20 bp, Homo sapiens
gccacattcctgatgcttct

SEQ ID NO: 6240853 - DNA, 21 bp, Homo sapiens
gccacattgacagtggtgggc

SEQ ID NO: 6240854 - DNA, 19 bp, Homo sapiens
gccacattgatttttctat

SEQ ID NO: 6240855 - DNA, 21 bp, Homo sapiens
gccacatttctgatcagaggt

SEQ ID NO: 6240856 - DNA, 19 bp, Homo sapiens
gccacatttggaatacttt

SEQ ID NO: 6240857 - DNA, 22 bp, Homo sapiens
gccacatttggaatactttttg

SEQ ID NO: 6240858 - DNA, 16 bp, Homo sapiens
gccacattttcagcca

SEQ ID NO: 6240859 - DNA, 17 bp, Homo sapiens
gccacattttcagccaa

SEQ ID NO: 6240860 - DNA, 15 bp, Homo sapiens
gccaccaaagctgcc

SEQ ID NO: 6240861 - DNA, 21 bp, Homo sapiens
gccaccaacagccactcagaa

SEQ ID NO: 6240862 - DNA, 19 bp, Homo sapiens
gccaccaacatactcccat

SEQ ID NO: 6240863 - DNA, 22 bp, Homo sapiens
gccaccaacatactcccatctg

SEQ ID NO: 6240864 - DNA, 12 bp, Homo sapiens
gccaccaactct

SEQ ID NO: 6240865 - DNA, 22 bp, Homo sapiens
gccaccaactcttgcaggtctc

SEQ ID NO: 6240866 - DNA, 19 bp, Homo sapiens
gccaccaactggccctctt

SEQ ID NO: 6240867 - DNA, 19 bp, Homo sapiens
gccaccaagctcacacctg

SEQ ID NO: 6240868 - DNA, 15 bp, Homo sapiens
gccaccaagggcctc

SEQ ID NO: 6240869 - DNA, 13 bp, Homo sapiens
gccaccaataaaa

SEQ ID NO: 6240870 - DNA, 20 bp, Homo sapiens
gccaccacacccagcctctg

SEQ ID NO: 6240871 - DNA, 17 bp, Homo sapiens
gccaccaccacgcagcc

SEQ ID NO: 6240872 - DNA, 20 bp, Homo sapiens
gccaccacccaacctgtcct

SEQ ID NO: 6240873 - DNA, 15 bp, Homo sapiens
gccaccacccacccc

SEQ ID NO: 6240874 - DNA, 13 bp, Homo sapiens
gccaccacccctc

SEQ ID NO: 6240875 - DNA, 18 bp, Homo sapiens
gccaccacccctccctct

SEQ ID NO: 6240876 - DNA, 19 bp, Homo sapiens
gccaccacccctccctctg

SEQ ID NO: 6240877 - DNA, 21 bp, Homo sapiens
gccaccacccctccctctgct

SEQ ID NO: 6240878 - DNA, 15 bp, Homo sapiens
gccaccaccctgtct

SEQ ID NO: 6240879 - DNA, 18 bp, Homo sapiens
gccaccaccggggcactg

SEQ ID NO: 6240880 - DNA, 17 bp, Homo sapiens
gccaccacgcctagcct

SEQ ID NO: 6240881 - DNA, 21 bp, Homo sapiens
gccaccacgtctgccaggccc

SEQ ID NO: 6240882 - DNA, 16 bp, Homo sapiens
gccaccactagagctg

SEQ ID NO: 6240883 - DNA, 13 bp, Homo sapiens
gccaccactcctg

SEQ ID NO: 6240884 - DNA, 21 bp, Homo sapiens
gccaccagacttggcctccag

SEQ ID NO: 6240885 - DNA, 12 bp, Homo sapiens
gccaccagagac

SEQ ID NO: 6240886 - DNA, 14 bp, Homo sapiens
gccaccagccatcc

SEQ ID NO: 6240887 - DNA, 14 bp, Homo sapiens
gccaccagcccctc

SEQ ID NO: 6240888 - DNA, 20 bp, Homo sapiens
gccaccagcgcccccactcc

SEQ ID NO: 6240889 - DNA, 21 bp, Homo sapiens
gccaccagcgcccccactcct

SEQ ID NO: 6240890 - DNA, 20 bp, Homo sapiens
gccaccagctccactggcct

SEQ ID NO: 6240891 - DNA, 23 bp, Homo sapiens
gccaccagcttccctctgcctga

SEQ ID NO: 6240892 - DNA, 16 bp, Homo sapiens
gccaccaggaagcaca

SEQ ID NO: 6240893 - DNA, 12 bp, Homo sapiens
gccaccaggatg

SEQ ID NO: 6240894 - DNA, 12 bp, Homo sapiens
gccaccaggcca

SEQ ID NO: 6240895 - DNA, 13 bp, Homo sapiens
gccaccaggctgg

SEQ ID NO: 6240896 - DNA, 16 bp, Homo sapiens
gccaccaggctggcgc

SEQ ID NO: 6240897 - DNA, 14 bp, Homo sapiens
gccaccagggagct

SEQ ID NO: 6240898 - DNA, 20 bp, Homo sapiens
gccaccagggagcttcctgg

SEQ ID NO: 6240899 - DNA, 16 bp, Homo sapiens
gccaccaggtcatctc

SEQ ID NO: 6240900 - DNA, 21 bp, Homo sapiens
gccaccaggtgcctttcaaat

SEQ ID NO: 6240901 - DNA, 11 bp, Homo sapiens
gccaccagttc

SEQ ID NO: 6240902 - DNA, 19 bp, Homo sapiens
gccaccagttctcatgggt

SEQ ID NO: 6240903 - DNA, 22 bp, Homo sapiens
gccaccatattcagtgctgtgg

SEQ ID NO: 6240904 - DNA, 12 bp, Homo sapiens
gccaccatccct

SEQ ID NO: 6240905 - DNA, 14 bp, Homo sapiens
gccaccatccctga

SEQ ID NO: 6240906 - DNA, 15 bp, Homo sapiens
gccaccatcctgctg

SEQ ID NO: 6240907 - DNA, 16 bp, Homo sapiens
gccaccatgcccagct

SEQ ID NO: 6240908 - DNA, 17 bp, Homo sapiens
gccaccatggccagcca

SEQ ID NO: 6240909 - DNA, 22 bp, Homo sapiens
gccaccatgtattcatccagag

SEQ ID NO: 6240910 - DNA, 22 bp, Homo sapiens
gccaccattcctggaaaccaca

SEQ ID NO: 6240911 - DNA, 16 bp, Homo sapiens
gccacccaacagcacc

SEQ ID NO: 6240912 - DNA, 19 bp, Homo sapiens
gccacccaagcctgctggc

SEQ ID NO: 6240913 - DNA, 21 bp, Homo sapiens
gccacccaccagggctcagct

SEQ ID NO: 6240914 - DNA, 14 bp, Homo sapiens
gccacccacccttc

SEQ ID NO: 6240915 - DNA, 16 bp, Homo sapiens
gccacccacctccctg

SEQ ID NO: 6240916 - DNA, 14 bp, Homo sapiens
gccacccactcagg

SEQ ID NO: 6240917 - DNA, 22 bp, Homo sapiens
gccacccactgtggggcaagcc

SEQ ID NO: 6240918 - DNA, 15 bp, Homo sapiens
gccacccagccccag

SEQ ID NO: 6240919 - DNA, 15 bp, Homo sapiens
gccacccaggaggca

SEQ ID NO: 6240920 - DNA, 16 bp, Homo sapiens
gccacccaggaggcag

SEQ ID NO: 6240921 - DNA, 13 bp, Homo sapiens
gccacccaggatc

SEQ ID NO: 6240922 - DNA, 22 bp, Homo sapiens
gccacccaggcaggccctgcct

SEQ ID NO: 6240923 - DNA, 16 bp, Homo sapiens
gccaccccaaacccca

SEQ ID NO: 6240924 - DNA, 19 bp, Homo sapiens
gccaccccaaaccccagcc

SEQ ID NO: 6240925 - DNA, 22 bp, Homo sapiens
gccaccccaaaccccagcccca

SEQ ID NO: 6240926 - DNA, 23 bp, Homo sapiens
gccaccccaaaccccagccccaa

SEQ ID NO: 6240927 - DNA, 13 bp, Homo sapiens
gccaccccaaccc

SEQ ID NO: 6240928 - DNA, 17 bp, Homo sapiens
gccaccccaacctctgt

SEQ ID NO: 6240929 - DNA, 14 bp, Homo sapiens
gccaccccactcta

SEQ ID NO: 6240930 - DNA, 20 bp, Homo sapiens
gccaccccactctacctcct

SEQ ID NO: 6240931 - DNA, 12 bp, Homo sapiens
gccaccccactg

SEQ ID NO: 6240932 - DNA, 14 bp, Homo sapiens
gccaccccactgag

SEQ ID NO: 6240933 - DNA, 22 bp, Homo sapiens
gccaccccagagtgggagaggc

SEQ ID NO: 6240934 - DNA, 23 bp, Homo sapiens
gccaccccagcctggccacgcag

SEQ ID NO: 6240935 - DNA, 18 bp, Homo sapiens
gccacccccagccctggc

SEQ ID NO: 6240936 - DNA, 13 bp, Homo sapiens
gccacccccaggc

SEQ ID NO: 6240937 - DNA, 16 bp, Homo sapiens
gccacccccagttcct

SEQ ID NO: 6240938 - DNA, 22 bp, Homo sapiens
gccacccccatcttccacctgt

SEQ ID NO: 6240939 - DNA, 18 bp, Homo sapiens
gccacccccgctggagga

SEQ ID NO: 6240940 - DNA, 16 bp, Homo sapiens
gccaccccgagggctg

SEQ ID NO: 6240941 - DNA, 17 bp, Homo sapiens
gccaccccgagggctga

SEQ ID NO: 6240942 - DNA, 18 bp, Homo sapiens
gccaccccgggctctctg

SEQ ID NO: 6240943 - DNA, 22 bp, Homo sapiens
gccacccctcctctagctctgg

SEQ ID NO: 6240944 - DNA, 15 bp, Homo sapiens
gccacccctccttcc

SEQ ID NO: 6240945 - DNA, 13 bp, Homo sapiens
gccacccctgcca

SEQ ID NO: 6240946 - DNA, 12 bp, Homo sapiens
gccaccccttcc

SEQ ID NO: 6240947 - DNA, 15 bp, Homo sapiens
gccaccccttcctcc

SEQ ID NO: 6240948 - DNA, 15 bp, Homo sapiens
gccaccccttgctct

SEQ ID NO: 6240949 - DNA, 10 bp, Homo sapiens
gccacccgcc

SEQ ID NO: 6240950 - DNA, 19 bp, Homo sapiens
gccacccggatctccaggc

SEQ ID NO: 6240951 - DNA, 20 bp, Homo sapiens
gccacccggatctccaggcc

SEQ ID NO: 6240952 - DNA, 23 bp, Homo sapiens
gccacccggatctccaggcccag

SEQ ID NO: 6240953 - DNA, 13 bp, Homo sapiens
gccacccgggctg

SEQ ID NO: 6240954 - DNA, 17 bp, Homo sapiens
gccacccgggctgcctg

SEQ ID NO: 6240955 - DNA, 21 bp, Homo sapiens
gccacccgtggggtgctgccc

SEQ ID NO: 6240956 - DNA, 18 bp, Homo sapiens
gccacccgttctgctggc

SEQ ID NO: 6240957 - DNA, 20 bp, Homo sapiens
gccaccctaactgagctgcc

SEQ ID NO: 6240958 - DNA, 19 bp, Homo sapiens
gccaccctacctgttcagt

SEQ ID NO: 6240959 - DNA, 21 bp, Homo sapiens
gccaccctcacacacacagct

SEQ ID NO: 6240960 - DNA, 23 bp, Homo sapiens
gccaccctcaccgcggctggatg

SEQ ID NO: 6240961 - DNA, 16 bp, Homo sapiens
gccaccctcatgctgt

SEQ ID NO: 6240962 - DNA, 18 bp, Homo sapiens
gccaccctcccagctctg

SEQ ID NO: 6240963 - DNA, 18 bp, Homo sapiens
gccaccctccttcccgcc

SEQ ID NO: 6240964 - DNA, 17 bp, Homo sapiens
gccaccctctccatgcc

SEQ ID NO: 6240965 - DNA, 20 bp, Homo sapiens
gccaccctctgcagggcagc

SEQ ID NO: 6240966 - DNA, 12 bp, Homo sapiens
gccaccctctgg

SEQ ID NO: 6240967 - DNA, 16 bp, Homo sapiens
gccaccctctgggagt

SEQ ID NO: 6240968 - DNA, 18 bp, Homo sapiens
gccaccctgaggcctctg

SEQ ID NO: 6240969 - DNA, 15 bp, Homo sapiens
gccaccctgccatgg

SEQ ID NO: 6240970 - DNA, 13 bp, Homo sapiens
gccaccctgcccc

SEQ ID NO: 6240971 - DNA, 14 bp, Homo sapiens
gccaccctgcccct

SEQ ID NO: 6240972 - DNA, 13 bp, Homo sapiens
gccaccctgctgc

SEQ ID NO: 6240973 - DNA, 13 bp, Homo sapiens
gccaccctgggct

SEQ ID NO: 6240974 - DNA, 21 bp, Homo sapiens
gccaccctgggctctgtgggc

SEQ ID NO: 6240975 - DNA, 21 bp, Homo sapiens
gccacccttccctgcctccag

SEQ ID NO: 6240976 - DNA, 23 bp, Homo sapiens
gccacccttccctgcctccagct

SEQ ID NO: 6240977 - DNA, 14 bp, Homo sapiens
gccacccttggcct

SEQ ID NO: 6240978 - DNA, 18 bp, Homo sapiens
gccacccttggcctgtcc

SEQ ID NO: 6240979 - DNA, 16 bp, Homo sapiens
gccacccttggtctca

SEQ ID NO: 6240980 - DNA, 20 bp, Homo sapiens
gccacccttggtctcatgcc

SEQ ID NO: 6240981 - DNA, 21 bp, Homo sapiens
gccacccttggtctcatgccc

SEQ ID NO: 6240982 - DNA, 22 bp, Homo sapiens
gccacccttggtctcatgcccc

SEQ ID NO: 6240983 - DNA, 17 bp, Homo sapiens
gccaccctttctggcac

SEQ ID NO: 6240984 - DNA, 19 bp, Homo sapiens
gccaccgactgcccagcca

SEQ ID NO: 6240985 - DNA, 16 bp, Homo sapiens
gccaccgcagctgctg

SEQ ID NO: 6240986 - DNA, 18 bp, Homo sapiens
gccaccgcagctgctgcc

SEQ ID NO: 6240987 - DNA, 23 bp, Homo sapiens
gccaccgcagctgctgccactct

SEQ ID NO: 6240988 - DNA, 21 bp, Homo sapiens
gccaccgccagaggacaagga

SEQ ID NO: 6240989 - DNA, 16 bp, Homo sapiens
gccaccgcctcctaca

SEQ ID NO: 6240990 - DNA, 20 bp, Homo sapiens
gccaccgcgagggcctgcgt

SEQ ID NO: 6240991 - DNA, 15 bp, Homo sapiens
gccaccgcgcccagc

SEQ ID NO: 6240992 - DNA, 16 bp, Homo sapiens
gccaccgcgcccagcc

SEQ ID NO: 6240993 - DNA, 22 bp, Homo sapiens
gccaccgcgggtgtgggaaagc

SEQ ID NO: 6240994 - DNA, 15 bp, Homo sapiens
gccaccgctgccttt

SEQ ID NO: 6240995 - DNA, 18 bp, Homo sapiens
gccaccgggacagacctg

SEQ ID NO: 6240996 - DNA, 19 bp, Homo sapiens
gccaccgggacagacctgg

SEQ ID NO: 6240997 - DNA, 16 bp, Homo sapiens
gccaccgggcagcctg

SEQ ID NO: 6240998 - DNA, 22 bp, Homo sapiens
gccaccgggcatgtctgcctgg

SEQ ID NO: 6240999 - DNA, 19 bp, Homo sapiens
gccaccgggggtggctctg

SEQ ID NO: 6241000 - DNA, 20 bp, Homo sapiens
gccaccgggggtggctctgt

SEQ ID NO: 6241001 - DNA, 15 bp, Homo sapiens
gccaccggtgggcag

SEQ ID NO: 6241002 - DNA, 18 bp, Homo sapiens
gccaccggtgggcagtgg

SEQ ID NO: 6241003 - DNA, 19 bp, Homo sapiens
gccaccgtccctctgcaga

SEQ ID NO: 6241004 - DNA, 24 bp, Homo sapiens
gccaccgtttcttcctgccagcag

SEQ ID NO: 6241005 - DNA, 20 bp, Homo sapiens
gccacctagaaaggggccca

SEQ ID NO: 6241006 - DNA, 22 bp, Homo sapiens
gccacctagaaaggggcccatt

SEQ ID NO: 6241007 - DNA, 20 bp, Homo sapiens
gagccagatgcaggacagga

SEQ ID NO: 6241008 - DNA, 16 bp, Homo sapiens
gagccagatgcctccc

SEQ ID NO: 6241009 - DNA, 19 bp, Homo sapiens
gagccagattaggcctgga

SEQ ID NO: 6241010 - DNA, 20 bp, Homo sapiens
gagccagattaggcctggag

SEQ ID NO: 6241011 - DNA, 22 bp, Homo sapiens
gagccagcaagaggaaggggtg

SEQ ID NO: 6241012 - DNA, 22 bp, Homo sapiens
gagccagcagacattgtcagca

SEQ ID NO: 6241013 - DNA, 23 bp, Homo sapiens
gagccagcagacattgtcagcaa

SEQ ID NO: 6241014 - DNA, 14 bp, Homo sapiens
gagccagcagggca

SEQ ID NO: 6241015 - DNA, 20 bp, Homo sapiens
gagccagcagggcgggccag

SEQ ID NO: 6241016 - DNA, 14 bp, Homo sapiens
gagccagccctccc

SEQ ID NO: 6241017 - DNA, 15 bp, Homo sapiens
gagccagccctccct

SEQ ID NO: 6241018 - DNA, 16 bp, Homo sapiens
gagccagccctccctg

SEQ ID NO: 6241019 - DNA, 14 bp, Homo sapiens
gagccagccgagca

SEQ ID NO: 6241020 - DNA, 18 bp, Homo sapiens
gagccagcctgcttccca

SEQ ID NO: 6241021 - DNA, 19 bp, Homo sapiens
gagccagcctgcttcccac

SEQ ID NO: 6241022 - DNA, 20 bp, Homo sapiens
gagccagcctggctctgccc

SEQ ID NO: 6241023 - DNA, 19 bp, Homo sapiens
gagccagcggctccaactc

SEQ ID NO: 6241024 - DNA, 22 bp, Homo sapiens
gagccagctaaggggtggggct

SEQ ID NO: 6241025 - DNA, 18 bp, Homo sapiens
gagccagctccctctatt

SEQ ID NO: 6241026 - DNA, 13 bp, Homo sapiens
gagccagctgctt

SEQ ID NO: 6241027 - DNA, 20 bp, Homo sapiens
gagccagctgctttttgtga

SEQ ID NO: 6241028 - DNA, 20 bp, Homo sapiens
gagccagcttggggccacca

SEQ ID NO: 6241029 - DNA, 16 bp, Homo sapiens
gagccaggactcccag

SEQ ID NO: 6241030 - DNA, 13 bp, Homo sapiens
gagccaggagaag

SEQ ID NO: 6241031 - DNA, 21 bp, Homo sapiens
gagccaggagaagctcagctg

SEQ ID NO: 6241032 - DNA, 12 bp, Homo sapiens
gagccaggagcc

SEQ ID NO: 6241033 - DNA, 13 bp, Homo sapiens
gagccaggagcct

SEQ ID NO: 6241034 - DNA, 14 bp, Homo sapiens
gagccaggagcctc

SEQ ID NO: 6241035 - DNA, 11 bp, Homo sapiens
gagccaggagt

SEQ ID NO: 6241036 - DNA, 15 bp, Homo sapiens
gagccaggagtaaga

SEQ ID NO: 6241037 - DNA, 17 bp, Homo sapiens
gagccaggatgcccaga

SEQ ID NO: 6241038 - DNA, 13 bp, Homo sapiens
gagccaggcccca

SEQ ID NO: 6241039 - DNA, 16 bp, Homo sapiens
gagccaggccccaccc

SEQ ID NO: 6241040 - DNA, 21 bp, Homo sapiens
gagccaggcctgggtctgtgt

SEQ ID NO: 6241041 - DNA, 19 bp, Homo sapiens
gagccaggctctgcctgga

SEQ ID NO: 6241042 - DNA, 18 bp, Homo sapiens
gagccaggcttggatgga

SEQ ID NO: 6241043 - DNA, 20 bp, Homo sapiens
gagccagggaacagccccag

SEQ ID NO: 6241044 - DNA, 11 bp, Homo sapiens
gagccagggca

SEQ ID NO: 6241045 - DNA, 15 bp, Homo sapiens
gagccagggcagagg

SEQ ID NO: 6241046 - DNA, 15 bp, Homo sapiens
gagccagggcagggc

SEQ ID NO: 6241047 - DNA, 23 bp, Homo sapiens
gagccaggggtgtcccagtccca

SEQ ID NO: 6241048 - DNA, 22 bp, Homo sapiens
gagccagggtctccagaaagcc

SEQ ID NO: 6241049 - DNA, 19 bp, Homo sapiens
gagccaggttgtcgggccc

SEQ ID NO: 6241050 - DNA, 13 bp, Homo sapiens
gagccagtcccag

SEQ ID NO: 6241051 - DNA, 19 bp, Homo sapiens
gagccagtctagttcctga

SEQ ID NO: 6241052 - DNA, 23 bp, Homo sapiens
gagccagtctttgaactgcagca

SEQ ID NO: 6241053 - DNA, 23 bp, Homo sapiens
gagccagtggaacagcgggagac

SEQ ID NO: 6241054 - DNA, 22 bp, Homo sapiens
gagccagtgtgcccaaaagcca

SEQ ID NO: 6241055 - DNA, 19 bp, Homo sapiens
gagccagttcagtacctgg

SEQ ID NO: 6241056 - DNA, 16 bp, Homo sapiens
gagccagttctggggc

SEQ ID NO: 6241057 - DNA, 17 bp, Homo sapiens
gagccagttctggggcc

SEQ ID NO: 6241058 - DNA, 17 bp, Homo sapiens
gagccagtttgccggat

SEQ ID NO: 6241059 - DNA, 16 bp, Homo sapiens
gagccatcaccctcac

SEQ ID NO: 6241060 - DNA, 22 bp, Homo sapiens
gagccatcacctaggactgact

SEQ ID NO: 6241061 - DNA, 18 bp, Homo sapiens
gagccatcactagaagaa

SEQ ID NO: 6241062 - DNA, 13 bp, Homo sapiens
gagccatccaccc

SEQ ID NO: 6241063 - DNA, 17 bp, Homo sapiens
gagccatccaccctgag

SEQ ID NO: 6241064 - DNA, 22 bp, Homo sapiens
gagccatccaccctgaggagtg

SEQ ID NO: 6241065 - DNA, 21 bp, Homo sapiens
gagccatcccttcggagccaa

SEQ ID NO: 6241066 - DNA, 23 bp, Homo sapiens
gagccatcccttcggagccaaca

SEQ ID NO: 6241067 - DNA, 17 bp, Homo sapiens
gagccatcttggcaggg

SEQ ID NO: 6241068 - DNA, 15 bp, Homo sapiens
gagccatgaagcatt

SEQ ID NO: 6241069 - DNA, 16 bp, Homo sapiens
gagccatgaagcatta

SEQ ID NO: 6241070 - DNA, 18 bp, Homo sapiens
gagccatgaggagcgtgg

SEQ ID NO: 6241071 - DNA, 22 bp, Homo sapiens
gagccatgaggagcgtggactc

SEQ ID NO: 6241072 - DNA, 20 bp, Homo sapiens
gagccatgagtatgccactg

SEQ ID NO: 6241073 - DNA, 19 bp, Homo sapiens
gagccatgattttctaaaa

SEQ ID NO: 6241074 - DNA, 14 bp, Homo sapiens
gagccatgcctccc

SEQ ID NO: 6241075 - DNA, 17 bp, Homo sapiens
gagccatgctacagtta

SEQ ID NO: 6241076 - DNA, 14 bp, Homo sapiens
gagccatgctctta

SEQ ID NO: 6241077 - DNA, 14 bp, Homo sapiens
gagccatgctggga

SEQ ID NO: 6241078 - DNA, 18 bp, Homo sapiens
gagccatggaaggtgcca

SEQ ID NO: 6241079 - DNA, 19 bp, Homo sapiens
gagccatggaaggtgccag

SEQ ID NO: 6241080 - DNA, 16 bp, Homo sapiens
gagccatggcggcccc

SEQ ID NO: 6241081 - DNA, 14 bp, Homo sapiens
gagccatgggcctg

SEQ ID NO: 6241082 - DNA, 21 bp, Homo sapiens
gagccatgtagaagctgcatc

SEQ ID NO: 6241083 - DNA, 22 bp, Homo sapiens
gagccatgtctacaaaagcaaa

SEQ ID NO: 6241084 - DNA, 22 bp, Homo sapiens
gagccatgtcttctccctggaa

SEQ ID NO: 6241085 - DNA, 19 bp, Homo sapiens
gagccatgtgtcatgtaat

SEQ ID NO: 6241086 - DNA, 17 bp, Homo sapiens
gagccattcccttggaa

SEQ ID NO: 6241087 - DNA, 18 bp, Homo sapiens
gagccattctggcacttt

SEQ ID NO: 6241088 - DNA, 20 bp, Homo sapiens
gagccattgaacagctgtga

SEQ ID NO: 6241089 - DNA, 15 bp, Homo sapiens
gagccattgtccctc

SEQ ID NO: 6241090 - DNA, 17 bp, Homo sapiens
gagccatttaaagacca

SEQ ID NO: 6241091 - DNA, 19 bp, Homo sapiens
gagccatttaaagaccaat

SEQ ID NO: 6241092 - DNA, 22 bp, Homo sapiens
gagccatttgtcccaagtgcca

SEQ ID NO: 6241093 - DNA, 15 bp, Homo sapiens
gagccattttggtaa

SEQ ID NO: 6241094 - DNA, 17 bp, Homo sapiens
gagcccaaacaccctcc

SEQ ID NO: 6241095 - DNA, 17 bp, Homo sapiens
gagcccaaccaggccct

SEQ ID NO: 6241096 - DNA, 18 bp, Homo sapiens
gagcccaaccaggccctg

SEQ ID NO: 6241097 - DNA, 17 bp, Homo sapiens
gagcccaagctaagcca

SEQ ID NO: 6241098 - DNA, 19 bp, Homo sapiens
gagcccaagctaagccatc

SEQ ID NO: 6241099 - DNA, 14 bp, Homo sapiens
gagcccaagggaat

SEQ ID NO: 6241100 - DNA, 20 bp, Homo sapiens
gagcccaagttatctttccc

SEQ ID NO: 6241101 - DNA, 18 bp, Homo sapiens
gagcccaatcactgccta

SEQ ID NO: 6241102 - DNA, 20 bp, Homo sapiens
gagcccaatgcatagagccc

SEQ ID NO: 6241103 - DNA, 22 bp, Homo sapiens
gagcccaatgcatagagccctg

SEQ ID NO: 6241104 - DNA, 22 bp, Homo sapiens
gagcccacaccatctggcccag

SEQ ID NO: 6241105 - DNA, 15 bp, Homo sapiens
gagcccacactgcca

SEQ ID NO: 6241106 - DNA, 16 bp, Homo sapiens
gagcccacactgccac

SEQ ID NO: 6241107 - DNA, 20 bp, Homo sapiens
gagcccacagcgagcctgtg

SEQ ID NO: 6241108 - DNA, 23 bp, Homo sapiens
gagcccaccagccagccctggcc

SEQ ID NO: 6241109 - DNA, 11 bp, Homo sapiens
gagcccaccca

SEQ ID NO: 6241110 - DNA, 20 bp, Homo sapiens
gagcccacgacactgcagcc

SEQ ID NO: 6241111 - DNA, 23 bp, Homo sapiens
gagcccacgcccgactagcaggc

SEQ ID NO: 6241112 - DNA, 18 bp, Homo sapiens
gagcccacggctaagagg

SEQ ID NO: 6241113 - DNA, 21 bp, Homo sapiens
gagcccacggctaagaggctg

SEQ ID NO: 6241114 - DNA, 22 bp, Homo sapiens
gagcccacggctaagaggctgc

SEQ ID NO: 6241115 - DNA, 23 bp, Homo sapiens
gagcccacggctaagaggctgct

SEQ ID NO: 6241116 - DNA, 19 bp, Homo sapiens
gagcccactgcccaccccc

SEQ ID NO: 6241117 - DNA, 23 bp, Homo sapiens
gagcccactgcccaccccctcaa

SEQ ID NO: 6241118 - DNA, 15 bp, Homo sapiens
gagcccagaaaaaag

SEQ ID NO: 6241119 - DNA, 13 bp, Homo sapiens
gagcccagccacc

SEQ ID NO: 6241120 - DNA, 21 bp, Homo sapiens
gagcccagccacctcccaagg

SEQ ID NO: 6241121 - DNA, 22 bp, Homo sapiens
gagcccagccacctcccaagga

SEQ ID NO: 6241122 - DNA, 23 bp, Homo sapiens
gagcccagccacctcccaaggac

SEQ ID NO: 6241123 - DNA, 13 bp, Homo sapiens
gagcccagcccag

SEQ ID NO: 6241124 - DNA, 16 bp, Homo sapiens
gagcccagcccaggag

SEQ ID NO: 6241125 - DNA, 15 bp, Homo sapiens
gagcccagccctccc

SEQ ID NO: 6241126 - DNA, 17 bp, Homo sapiens
gagcccagccctgttct

SEQ ID NO: 6241127 - DNA, 18 bp, Homo sapiens
gagcccagccctgttctg

SEQ ID NO: 6241128 - DNA, 20 bp, Homo sapiens
gagcccagccctgttctggg

SEQ ID NO: 6241129 - DNA, 16 bp, Homo sapiens
gagcccagcctgggag

SEQ ID NO: 6241130 - DNA, 18 bp, Homo sapiens
gagcccagcggcccaaga

SEQ ID NO: 6241131 - DNA, 18 bp, Homo sapiens
gagcccagcgtcagaagt

SEQ ID NO: 6241132 - DNA, 21 bp, Homo sapiens
gagcccagctacattcctcag

SEQ ID NO: 6241133 - DNA, 12 bp, Homo sapiens
gagcccagctcc

SEQ ID NO: 6241134 - DNA, 14 bp, Homo sapiens
gagcccagctccaa

SEQ ID NO: 6241135 - DNA, 21 bp, Homo sapiens
gagcccagctctgaaaccagt

SEQ ID NO: 6241136 - DNA, 12 bp, Homo sapiens
gagcccagctgc

SEQ ID NO: 6241137 - DNA, 14 bp, Homo sapiens
gagcccagctgcct

SEQ ID NO: 6241138 - DNA, 21 bp, Homo sapiens
gagcccagctgcctggagagg

SEQ ID NO: 6241139 - DNA, 21 bp, Homo sapiens
gagcccagctgggtcaggcag

SEQ ID NO: 6241140 - DNA, 12 bp, Homo sapiens
gagcccaggaag

SEQ ID NO: 6241141 - DNA, 17 bp, Homo sapiens
gagcccaggagctcccc

SEQ ID NO: 6241142 - DNA, 21 bp, Homo sapiens
gagcccaggagctcccctccc

SEQ ID NO: 6241143 - DNA, 21 bp, Homo sapiens
gagcccaggagtcccactcca

SEQ ID NO: 6241144 - DNA, 16 bp, Homo sapiens
gagcccaggccaggac

SEQ ID NO: 6241145 - DNA, 17 bp, Homo sapiens
gagcccaggccaggact

SEQ ID NO: 6241146 - DNA, 12 bp, Homo sapiens
gagcccaggcct

SEQ ID NO: 6241147 - DNA, 14 bp, Homo sapiens
gagcccaggcctgg

SEQ ID NO: 6241148 - DNA, 15 bp, Homo sapiens
gagcccaggcctggc

SEQ ID NO: 6241149 - DNA, 16 bp, Homo sapiens
gagcccaggcctggcc

SEQ ID NO: 6241150 - DNA, 15 bp, Homo sapiens
gagcccaggcgggag

SEQ ID NO: 6241151 - DNA, 15 bp, Homo sapiens
gagcccagggaggcc

SEQ ID NO: 6241152 - DNA, 17 bp, Homo sapiens
gagcccagggaggccga

SEQ ID NO: 6241153 - DNA, 20 bp, Homo sapiens
gagcccagggaggccgaagc

SEQ ID NO: 6241154 - DNA, 12 bp, Homo sapiens
gagcccagggga

SEQ ID NO: 6241155 - DNA, 20 bp, Homo sapiens
gagcccagtgaagcctctga

SEQ ID NO: 6241156 - DNA, 13 bp, Homo sapiens
gagcccatactca

SEQ ID NO: 6241157 - DNA, 18 bp, Homo sapiens
gagcccatactcagcctg

SEQ ID NO: 6241158 - DNA, 19 bp, Homo sapiens
gagcccatactcagcctgc

SEQ ID NO: 6241159 - DNA, 20 bp, Homo sapiens
gagcccatactcagcctgct

SEQ ID NO: 6241160 - DNA, 22 bp, Homo sapiens
gagcccatgctcaaccactgtg

SEQ ID NO: 6241161 - DNA, 23 bp, Homo sapiens
gagcccatgctcaaccactgtgg

SEQ ID NO: 6241162 - DNA, 18 bp, Homo sapiens
gagcccatgttctgcccc

SEQ ID NO: 6241163 - DNA, 21 bp, Homo sapiens
gagcccatgttctgcccccag

SEQ ID NO: 6241164 - DNA, 23 bp, Homo sapiens
gagcccatgttctgcccccagcc

SEQ ID NO: 6241165 - DNA, 15 bp, Homo sapiens
gagcccattaatctt

SEQ ID NO: 6241166 - DNA, 17 bp, Homo sapiens
gagcccattaatcttga

SEQ ID NO: 6241167 - DNA, 23 bp, Homo sapiens
gagccccaacaacttttccctca

SEQ ID NO: 6241168 - DNA, 13 bp, Homo sapiens
gagccccaagtcc

SEQ ID NO: 6241169 - DNA, 21 bp, Homo sapiens
gagccccaagtcctgaagagg

SEQ ID NO: 6241170 - DNA, 14 bp, Homo sapiens
gagccccacacgga

SEQ ID NO: 6241171 - DNA, 12 bp, Homo sapiens
gagccccacact

SEQ ID NO: 6241172 - DNA, 20 bp, Homo sapiens
gagccccacagccccatctg

SEQ ID NO: 6241173 - DNA, 16 bp, Homo sapiens
gagccccaccctcaga

SEQ ID NO: 6241174 - DNA, 12 bp, Homo sapiens
gagccccactct

SEQ ID NO: 6241175 - DNA, 13 bp, Homo sapiens
gagccccactctc

SEQ ID NO: 6241176 - DNA, 17 bp, Homo sapiens
gagccccactctcagag

SEQ ID NO: 6241177 - DNA, 18 bp, Homo sapiens
gagccccactctcagagg

SEQ ID NO: 6241178 - DNA, 23 bp, Homo sapiens
gagccccagaaccccaactccca

SEQ ID NO: 6241179 - DNA, 13 bp, Homo sapiens
gagccccagccag

SEQ ID NO: 6241180 - DNA, 13 bp, Homo sapiens
gagccccagcccc

SEQ ID NO: 6241181 - DNA, 14 bp, Homo sapiens
gagccccagcccca

SEQ ID NO: 6241182 - DNA, 16 bp, Homo sapiens
gagccccagccccaat

SEQ ID NO: 6241183 - DNA, 11 bp, Homo sapiens
gagccccagct

SEQ ID NO: 6241184 - DNA, 13 bp, Homo sapiens
gagccccagctga

SEQ ID NO: 6241185 - DNA, 21 bp, Homo sapiens
gccacctagactctccctgta

SEQ ID NO: 6241186 - DNA, 19 bp, Homo sapiens
gccacctatctcgtgggag

SEQ ID NO: 6241187 - DNA, 12 bp, Homo sapiens
gccacctatgcc

SEQ ID NO: 6241188 - DNA, 20 bp, Homo sapiens
gccacctatgcctgtggtga

SEQ ID NO: 6241189 - DNA, 23 bp, Homo sapiens
gccacctcagaccccggggtgag

SEQ ID NO: 6241190 - DNA, 20 bp, Homo sapiens
gccacctcagtctcacctgc

SEQ ID NO: 6241191 - DNA, 21 bp, Homo sapiens
gccacctcagtctcacctgcc

SEQ ID NO: 6241192 - DNA, 14 bp, Homo sapiens
gccacctccacacc

SEQ ID NO: 6241193 - DNA, 19 bp, Homo sapiens
gccacctccacccccaaga

SEQ ID NO: 6241194 - DNA, 15 bp, Homo sapiens
gccacctcccaagga

SEQ ID NO: 6241195 - DNA, 16 bp, Homo sapiens
gccacctcccaaggac

SEQ ID NO: 6241196 - DNA, 17 bp, Homo sapiens
gccacctcccaaggact

SEQ ID NO: 6241197 - DNA, 13 bp, Homo sapiens
gccacctcccacc

SEQ ID NO: 6241198 - DNA, 20 bp, Homo sapiens
gccacctcccaccccactcc

SEQ ID NO: 6241199 - DNA, 21 bp, Homo sapiens
gccacctcccaccccactcca

SEQ ID NO: 6241200 - DNA, 16 bp, Homo sapiens
gccacctcccactcct

SEQ ID NO: 6241201 - DNA, 17 bp, Homo sapiens
gccacctcccactcctg

SEQ ID NO: 6241202 - DNA, 20 bp, Homo sapiens
gccacctcccactcctgctg

SEQ ID NO: 6241203 - DNA, 22 bp, Homo sapiens
gccacctcccactcctgctgca

SEQ ID NO: 6241204 - DNA, 20 bp, Homo sapiens
gccacctccccactccagca

SEQ ID NO: 6241205 - DNA, 17 bp, Homo sapiens
gccacctccccaggccg

SEQ ID NO: 6241206 - DNA, 13 bp, Homo sapiens
gccacctccctct

SEQ ID NO: 6241207 - DNA, 20 bp, Homo sapiens
gccacctccctgacccgtct

SEQ ID NO: 6241208 - DNA, 15 bp, Homo sapiens
gccacctccgccaga

SEQ ID NO: 6241209 - DNA, 17 bp, Homo sapiens
gccacctccgccagacc

SEQ ID NO: 6241210 - DNA, 12 bp, Homo sapiens
gccacctcctcc

SEQ ID NO: 6241211 - DNA, 15 bp, Homo sapiens
gccacctcctccccc

SEQ ID NO: 6241212 - DNA, 15 bp, Homo sapiens
gccacctcctcgtcc

SEQ ID NO: 6241213 - DNA, 13 bp, Homo sapiens
gccacctccttgg

SEQ ID NO: 6241214 - DNA, 17 bp, Homo sapiens
gccacctccttggcacc

SEQ ID NO: 6241215 - DNA, 21 bp, Homo sapiens
gccacctctaacagcaccaaa

SEQ ID NO: 6241216 - DNA, 22 bp, Homo sapiens
gccacctctccaagggcttctg

SEQ ID NO: 6241217 - DNA, 15 bp, Homo sapiens
gccacctctcccagc

SEQ ID NO: 6241218 - DNA, 18 bp, Homo sapiens
gccacctctcccagccct

SEQ ID NO: 6241219 - DNA, 22 bp, Homo sapiens
gccacctctcccagccctcagc

SEQ ID NO: 6241220 - DNA, 21 bp, Homo sapiens
gccacctctgcggaccccagc

SEQ ID NO: 6241221 - DNA, 19 bp, Homo sapiens
gccacctgaggtgggccca

SEQ ID NO: 6241222 - DNA, 21 bp, Homo sapiens
gccacctgaggtgggcccagg

SEQ ID NO: 6241223 - DNA, 22 bp, Homo sapiens
gccacctgaggtgggcccagga

SEQ ID NO: 6241224 - DNA, 23 bp, Homo sapiens
gccacctgaggtgggcccaggac

SEQ ID NO: 6241225 - DNA, 21 bp, Homo sapiens
gccacctgagttcctgaggtg

SEQ ID NO: 6241226 - DNA, 12 bp, Homo sapiens
gccacctgcaag

SEQ ID NO: 6241227 - DNA, 18 bp, Homo sapiens
gccacctgcaagatggac

SEQ ID NO: 6241228 - DNA, 12 bp, Homo sapiens
gccacctgcagg

SEQ ID NO: 6241229 - DNA, 13 bp, Homo sapiens
gccacctgcagga

SEQ ID NO: 6241230 - DNA, 22 bp, Homo sapiens
gccacctgccacccccaggtct

SEQ ID NO: 6241231 - DNA, 13 bp, Homo sapiens
gccacctgccagg

SEQ ID NO: 6241232 - DNA, 21 bp, Homo sapiens
gccacctgccaggcctccctc

SEQ ID NO: 6241233 - DNA, 13 bp, Homo sapiens
gccacctgccccc

SEQ ID NO: 6241234 - DNA, 13 bp, Homo sapiens
gccacctgccttc

SEQ ID NO: 6241235 - DNA, 23 bp, Homo sapiens
gccacctggaagccgcgcggccg

SEQ ID NO: 6241236 - DNA, 14 bp, Homo sapiens
gccacctggacccc

SEQ ID NO: 6241237 - DNA, 15 bp, Homo sapiens
gccacctggacccct

SEQ ID NO: 6241238 - DNA, 22 bp, Homo sapiens
gccacctggcagggctcacact

SEQ ID NO: 6241239 - DNA, 20 bp, Homo sapiens
gccacctggcattccttctg

SEQ ID NO: 6241240 - DNA, 20 bp, Homo sapiens
gccacctggctctcacctct

SEQ ID NO: 6241241 - DNA, 21 bp, Homo sapiens
gccacctgtagccatctgcac

SEQ ID NO: 6241242 - DNA, 16 bp, Homo sapiens
gccacctgtccggccc

SEQ ID NO: 6241243 - DNA, 20 bp, Homo sapiens
gccacctgtccggcccagtg

SEQ ID NO: 6241244 - DNA, 22 bp, Homo sapiens
gccacctgtccggcccagtgcc

SEQ ID NO: 6241245 - DNA, 12 bp, Homo sapiens
gccacctgtctg

SEQ ID NO: 6241246 - DNA, 18 bp, Homo sapiens
gccacctgtcttctctcc

SEQ ID NO: 6241247 - DNA, 14 bp, Homo sapiens
gccaccttcccacc

SEQ ID NO: 6241248 - DNA, 17 bp, Homo sapiens
gccaccttcccacccct

SEQ ID NO: 6241249 - DNA, 20 bp, Homo sapiens
gccaccttgattttcttctt

SEQ ID NO: 6241250 - DNA, 20 bp, Homo sapiens
gccaccttgggtctgtgtca

SEQ ID NO: 6241251 - DNA, 12 bp, Homo sapiens
gccacctttcct

SEQ ID NO: 6241252 - DNA, 15 bp, Homo sapiens
gccacctttgtgcag

SEQ ID NO: 6241253 - DNA, 17 bp, Homo sapiens
gccacgaacagcccgcc

SEQ ID NO: 6241254 - DNA, 19 bp, Homo sapiens
gccacgaacagcccgccag

SEQ ID NO: 6241255 - DNA, 17 bp, Homo sapiens
gccacgaccagcccctt

SEQ ID NO: 6241256 - DNA, 18 bp, Homo sapiens
gccacgaccagccccttc

SEQ ID NO: 6241257 - DNA, 13 bp, Homo sapiens
gccacgaggtggt

SEQ ID NO: 6241258 - DNA, 23 bp, Homo sapiens
gccacgaggtggtagctctgagc

SEQ ID NO: 6241259 - DNA, 16 bp, Homo sapiens
gccacgattggagaat

SEQ ID NO: 6241260 - DNA, 21 bp, Homo sapiens
gccacgattggagaatacttt

SEQ ID NO: 6241261 - DNA, 16 bp, Homo sapiens
gccacgcactgggcca

SEQ ID NO: 6241262 - DNA, 17 bp, Homo sapiens
gccacgcactgggccac

SEQ ID NO: 6241263 - DNA, 13 bp, Homo sapiens
gccacgcagccag

SEQ ID NO: 6241264 - DNA, 20 bp, Homo sapiens
gccacgcaggccacccgggc

SEQ ID NO: 6241265 - DNA, 13 bp, Homo sapiens
gccacgcagggcc

SEQ ID NO: 6241266 - DNA, 23 bp, Homo sapiens
gccacgcaggggctctgagcccg

SEQ ID NO: 6241267 - DNA, 18 bp, Homo sapiens
gccacgcagtgcctggag

SEQ ID NO: 6241268 - DNA, 17 bp, Homo sapiens
gccacgcattttgcact

SEQ ID NO: 6241269 - DNA, 12 bp, Homo sapiens
gccacgccccag

SEQ ID NO: 6241270 - DNA, 17 bp, Homo sapiens
gccacgccccagcccga

SEQ ID NO: 6241271 - DNA, 22 bp, Homo sapiens
gccacgcctgcgatggtgctgc

SEQ ID NO: 6241272 - DNA, 23 bp, Homo sapiens
gccacgcctgcgatggtgctgca

SEQ ID NO: 6241273 - DNA, 16 bp, Homo sapiens
gccacgcgctctgcat

SEQ ID NO: 6241274 - DNA, 22 bp, Homo sapiens
gccacgcgctctgcatgctcct

SEQ ID NO: 6241275 - DNA, 13 bp, Homo sapiens
gccacgctcagtg

SEQ ID NO: 6241276 - DNA, 17 bp, Homo sapiens
gccacgctcagtgcccg

SEQ ID NO: 6241277 - DNA, 14 bp, Homo sapiens
gccacgctcctctg

SEQ ID NO: 6241278 - DNA, 19 bp, Homo sapiens
gccacgctcctctgttcag

SEQ ID NO: 6241279 - DNA, 20 bp, Homo sapiens
gccacgctcctctgtttgtt

SEQ ID NO: 6241280 - DNA, 13 bp, Homo sapiens
gccacgctggcct

SEQ ID NO: 6241281 - DNA, 18 bp, Homo sapiens
gccacgctgtcctctcga

SEQ ID NO: 6241282 - DNA, 22 bp, Homo sapiens
gccacggaggagggatgctgct

SEQ ID NO: 6241283 - DNA, 19 bp, Homo sapiens
gccacggataccgccacgg

SEQ ID NO: 6241284 - DNA, 14 bp, Homo sapiens
gccacggcagccac

SEQ ID NO: 6241285 - DNA, 19 bp, Homo sapiens
gccacggcagccaccctgc

SEQ ID NO: 6241286 - DNA, 20 bp, Homo sapiens
gccacggcagccaccctgcc

SEQ ID NO: 6241287 - DNA, 13 bp, Homo sapiens
gccacggccaccc

SEQ ID NO: 6241288 - DNA, 15 bp, Homo sapiens
gccacggccaccctc

SEQ ID NO: 6241289 - DNA, 17 bp, Homo sapiens
gccacggccaccctcct

SEQ ID NO: 6241290 - DNA, 16 bp, Homo sapiens
gccacggccaggccag

SEQ ID NO: 6241291 - DNA, 18 bp, Homo sapiens
gccacggccaggccagag

SEQ ID NO: 6241292 - DNA, 14 bp, Homo sapiens
gccacggccccggg

SEQ ID NO: 6241293 - DNA, 13 bp, Homo sapiens
gccacggcctggc

SEQ ID NO: 6241294 - DNA, 17 bp, Homo sapiens
gccacggcctggctggt

SEQ ID NO: 6241295 - DNA, 15 bp, Homo sapiens
gccacggcctgggag

SEQ ID NO: 6241296 - DNA, 12 bp, Homo sapiens
gccacgggggag

SEQ ID NO: 6241297 - DNA, 21 bp, Homo sapiens
gccacgggggaggccgaggca

SEQ ID NO: 6241298 - DNA, 23 bp, Homo sapiens
gccacgggggaggccgaggcagg

SEQ ID NO: 6241299 - DNA, 22 bp, Homo sapiens
gccacggtggacttagctctga

SEQ ID NO: 6241300 - DNA, 19 bp, Homo sapiens
gccacggtttatcctcttg

SEQ ID NO: 6241301 - DNA, 17 bp, Homo sapiens
gccacgtatagtcctag

SEQ ID NO: 6241302 - DNA, 18 bp, Homo sapiens
gccacgtcccaccccacc

SEQ ID NO: 6241303 - DNA, 21 bp, Homo sapiens
gccacgtcccaccccacctct

SEQ ID NO: 6241304 - DNA, 14 bp, Homo sapiens
gccacgtcccgctg

SEQ ID NO: 6241305 - DNA, 16 bp, Homo sapiens
gccacgtctgtgctct

SEQ ID NO: 6241306 - DNA, 21 bp, Homo sapiens
gccacgtgccttaggaatact

SEQ ID NO: 6241307 - DNA, 15 bp, Homo sapiens
gccacgtgctggaga

SEQ ID NO: 6241308 - DNA, 16 bp, Homo sapiens
gccacgtgctggagag

SEQ ID NO: 6241309 - DNA, 17 bp, Homo sapiens
gccacgtgctggagagt

SEQ ID NO: 6241310 - DNA, 14 bp, Homo sapiens
gccacgtggccgct

SEQ ID NO: 6241311 - DNA, 18 bp, Homo sapiens
gccacgtggtcactgtgc

SEQ ID NO: 6241312 - DNA, 24 bp, Homo sapiens
gccacgtggtcactgtgcactgcc

SEQ ID NO: 6241313 - DNA, 20 bp, Homo sapiens
gccacgtggtggcccagctc

SEQ ID NO: 6241314 - DNA, 22 bp, Homo sapiens
gccacgtggtggcccagctcct

SEQ ID NO: 6241315 - DNA, 17 bp, Homo sapiens
gccacgtgtgctgtggc

SEQ ID NO: 6241316 - DNA, 21 bp, Homo sapiens
gccacgttactcccctggctg

SEQ ID NO: 6241317 - DNA, 15 bp, Homo sapiens
gccacgttccacagt

SEQ ID NO: 6241318 - DNA, 16 bp, Homo sapiens
gccacgttccttactg

SEQ ID NO: 6241319 - DNA, 21 bp, Homo sapiens
gccacgttccttactgcagaa

SEQ ID NO: 6241320 - DNA, 14 bp, Homo sapiens
gccactaaaatcca

SEQ ID NO: 6241321 - DNA, 20 bp, Homo sapiens
gccactaaagcttcagactc

SEQ ID NO: 6241322 - DNA, 16 bp, Homo sapiens
gccactaacttctaaa

SEQ ID NO: 6241323 - DNA, 15 bp, Homo sapiens
gccactaagcagagg

SEQ ID NO: 6241324 - DNA, 17 bp, Homo sapiens
gccactaagcagaggag

SEQ ID NO: 6241325 - DNA, 14 bp, Homo sapiens
gccactaaggtcag

SEQ ID NO: 6241326 - DNA, 19 bp, Homo sapiens
gccactacactccagcctg

SEQ ID NO: 6241327 - DNA, 21 bp, Homo sapiens
gccactacactccagcctgag

SEQ ID NO: 6241328 - DNA, 23 bp, Homo sapiens
gccactacactccagcctgagca

SEQ ID NO: 6241329 - DNA, 16 bp, Homo sapiens
gccactacctcctttc

SEQ ID NO: 6241330 - DNA, 23 bp, Homo sapiens
gccactaccttctgacctcccca

SEQ ID NO: 6241331 - DNA, 14 bp, Homo sapiens
gccactaggctggg

SEQ ID NO: 6241332 - DNA, 20 bp, Homo sapiens
gccactaggctgggtgccca

SEQ ID NO: 6241333 - DNA, 22 bp, Homo sapiens
gccactaggctgggtgcccaca

SEQ ID NO: 6241334 - DNA, 16 bp, Homo sapiens
gccactaggtgtcccc

SEQ ID NO: 6241335 - DNA, 17 bp, Homo sapiens
gccactaggtgtcccca

SEQ ID NO: 6241336 - DNA, 23 bp, Homo sapiens
gccactagtgacagtttcttttg

SEQ ID NO: 6241337 - DNA, 14 bp, Homo sapiens
gccactatgagctt

SEQ ID NO: 6241338 - DNA, 17 bp, Homo sapiens
gccactcacacagccag

SEQ ID NO: 6241339 - DNA, 19 bp, Homo sapiens
gccactcacccttcctggc

SEQ ID NO: 6241340 - DNA, 21 bp, Homo sapiens
gccactcacccttcctggccc

SEQ ID NO: 6241341 - DNA, 22 bp, Homo sapiens
gccactcacccttcctggccca

SEQ ID NO: 6241342 - DNA, 14 bp, Homo sapiens
gccactcactaggc

SEQ ID NO: 6241343 - DNA, 18 bp, Homo sapiens
gccactcactaggccccc

SEQ ID NO: 6241344 - DNA, 23 bp, Homo sapiens
gccactcactaggcccccacttg

SEQ ID NO: 6241345 - DNA, 13 bp, Homo sapiens
gccactcagaggc

SEQ ID NO: 6241346 - DNA, 19 bp, Homo sapiens
gccactcagaggcccccag

SEQ ID NO: 6241347 - DNA, 18 bp, Homo sapiens
gccactcagccatttccc

SEQ ID NO: 6241348 - DNA, 14 bp, Homo sapiens
gccactcatttcat

SEQ ID NO: 6241349 - DNA, 12 bp, Homo sapiens
gccactccaaac

SEQ ID NO: 6241350 - DNA, 13 bp, Homo sapiens
gccactccaagcc

SEQ ID NO: 6241351 - DNA, 15 bp, Homo sapiens
gccactccaagcccc

SEQ ID NO: 6241352 - DNA, 17 bp, Homo sapiens
gccactccaagccccct

SEQ ID NO: 6241353 - DNA, 22 bp, Homo sapiens
gccactccaagccccctggcag

SEQ ID NO: 6241354 - DNA, 16 bp, Homo sapiens
gccactccacaaatga

SEQ ID NO: 6241355 - DNA, 17 bp, Homo sapiens
gccactccacaaatgat

SEQ ID NO: 6241356 - DNA, 14 bp, Homo sapiens
gccactccagtcct

SEQ ID NO: 6241357 - DNA, 18 bp, Homo sapiens
gccactccagtcctgcca

SEQ ID NO: 6241358 - DNA, 18 bp, Homo sapiens
gccactcccgggccaaga

SEQ ID NO: 6241359 - DNA, 22 bp, Homo sapiens
gccactccctacccaatgtctc

SEQ ID NO: 6241360 - DNA, 13 bp, Homo sapiens
gccactccctccc

SEQ ID NO: 6241361 - DNA, 15 bp, Homo sapiens
gccactccctcccag

SEQ ID NO: 6241362 - DNA, 14 bp, Homo sapiens
gccactccctgagc

SEQ ID NO: 6241363 - DNA, 12 bp, Homo sapiens
gagccccaggca

SEQ ID NO: 6241364 - DNA, 18 bp, Homo sapiens
gagccccaggcctctgtg

SEQ ID NO: 6241365 - DNA, 11 bp, Homo sapiens
gagccccaggg

SEQ ID NO: 6241366 - DNA, 18 bp, Homo sapiens
gagccccaggggggcctc

SEQ ID NO: 6241367 - DNA, 12 bp, Homo sapiens
gagccccagtgc

SEQ ID NO: 6241368 - DNA, 14 bp, Homo sapiens
gagccccagtgcca

SEQ ID NO: 6241369 - DNA, 18 bp, Homo sapiens
gagccccagtgctggaag

SEQ ID NO: 6241370 - DNA, 17 bp, Homo sapiens
gagccccatcgcctggg

SEQ ID NO: 6241371 - DNA, 20 bp, Homo sapiens
gagcccccaacacaggcaag

SEQ ID NO: 6241372 - DNA, 12 bp, Homo sapiens
gagcccccaagc

SEQ ID NO: 6241373 - DNA, 17 bp, Homo sapiens
gagcccccaccagcagc

SEQ ID NO: 6241374 - DNA, 23 bp, Homo sapiens
gagcccccaccagcagcacaatt

SEQ ID NO: 6241375 - DNA, 22 bp, Homo sapiens
gagcccccaccggaactgggct

SEQ ID NO: 6241376 - DNA, 17 bp, Homo sapiens
gagcccccacgctggcc

SEQ ID NO: 6241377 - DNA, 22 bp, Homo sapiens
gagcccccagatagagctgggt

SEQ ID NO: 6241378 - DNA, 13 bp, Homo sapiens
gagcccccagcag

SEQ ID NO: 6241379 - DNA, 15 bp, Homo sapiens
gagcccccagccctg

SEQ ID NO: 6241380 - DNA, 14 bp, Homo sapiens
gagcccccagcctg

SEQ ID NO: 6241381 - DNA, 15 bp, Homo sapiens
gagcccccagcctgt

SEQ ID NO: 6241382 - DNA, 16 bp, Homo sapiens
gagcccccagcctgtc

SEQ ID NO: 6241383 - DNA, 17 bp, Homo sapiens
gagcccccagcctgtca

SEQ ID NO: 6241384 - DNA, 20 bp, Homo sapiens
gagcccccagcttccagcag

SEQ ID NO: 6241385 - DNA, 13 bp, Homo sapiens
gagccccccacaa

SEQ ID NO: 6241386 - DNA, 20 bp, Homo sapiens
gagccccccgtgtggcttac

SEQ ID NO: 6241387 - DNA, 17 bp, Homo sapiens
gagccccccgtgttcac

SEQ ID NO: 6241388 - DNA, 18 bp, Homo sapiens
gagccccccgtgttcaca

SEQ ID NO: 6241389 - DNA, 14 bp, Homo sapiens
gagcccccctagca

SEQ ID NO: 6241390 - DNA, 23 bp, Homo sapiens
gagcccccctagcaatacaggga

SEQ ID NO: 6241391 - DNA, 14 bp, Homo sapiens
gagccccctctgcc

SEQ ID NO: 6241392 - DNA, 14 bp, Homo sapiens
gagccccctgcacc

SEQ ID NO: 6241393 - DNA, 21 bp, Homo sapiens
gagccccctgcacccacccct

SEQ ID NO: 6241394 - DNA, 13 bp, Homo sapiens
gagccccctggat

SEQ ID NO: 6241395 - DNA, 17 bp, Homo sapiens
gagccccctggcggcag

SEQ ID NO: 6241396 - DNA, 18 bp, Homo sapiens
gagccccctggcggcagg

SEQ ID NO: 6241397 - DNA, 14 bp, Homo sapiens
gagccccctgtcct

SEQ ID NO: 6241398 - DNA, 22 bp, Homo sapiens
gagccccctgtccttcccacgg

SEQ ID NO: 6241399 - DNA, 16 bp, Homo sapiens
gagccccctgtgccca

SEQ ID NO: 6241400 - DNA, 13 bp, Homo sapiens
gagcccccttcct

SEQ ID NO: 6241401 - DNA, 18 bp, Homo sapiens
gagccccgcagacctccc

SEQ ID NO: 6241402 - DNA, 15 bp, Homo sapiens
gagccccgccctctt

SEQ ID NO: 6241403 - DNA, 17 bp, Homo sapiens
gagccccgccctcttcc

SEQ ID NO: 6241404 - DNA, 20 bp, Homo sapiens
gagccccgccctcttcctga

SEQ ID NO: 6241405 - DNA, 13 bp, Homo sapiens
gagccccggagca

SEQ ID NO: 6241406 - DNA, 17 bp, Homo sapiens
gagcccctaccccacac

SEQ ID NO: 6241407 - DNA, 14 bp, Homo sapiens
gagcccctactgtg

SEQ ID NO: 6241408 - DNA, 17 bp, Homo sapiens
gagcccctactgtgggc

SEQ ID NO: 6241409 - DNA, 15 bp, Homo sapiens
gagcccctccccagc

SEQ ID NO: 6241410 - DNA, 15 bp, Homo sapiens
gagcccctccctgct

SEQ ID NO: 6241411 - DNA, 20 bp, Homo sapiens
gagcccctcctccagcccct

SEQ ID NO: 6241412 - DNA, 14 bp, Homo sapiens
gagcccctcctctc

SEQ ID NO: 6241413 - DNA, 18 bp, Homo sapiens
gagcccctcctctcctcg

SEQ ID NO: 6241414 - DNA, 22 bp, Homo sapiens
gagcccctcctctcctcgtccg

SEQ ID NO: 6241415 - DNA, 12 bp, Homo sapiens
gagcccctcctg

SEQ ID NO: 6241416 - DNA, 13 bp, Homo sapiens
gagcccctccttc

SEQ ID NO: 6241417 - DNA, 22 bp, Homo sapiens
gagcccctccttctcccctgcc

SEQ ID NO: 6241418 - DNA, 15 bp, Homo sapiens
gagcccctcggctct

SEQ ID NO: 6241419 - DNA, 23 bp, Homo sapiens
gagcccctgagtccgcctgcgcc

SEQ ID NO: 6241420 - DNA, 23 bp, Homo sapiens
gagcccctgcccacgcccttgga

SEQ ID NO: 6241421 - DNA, 18 bp, Homo sapiens
gagcccctggacatgcct

SEQ ID NO: 6241422 - DNA, 22 bp, Homo sapiens
gagcccctggacatgcctgtcc

SEQ ID NO: 6241423 - DNA, 13 bp, Homo sapiens
gagcccctgggga

SEQ ID NO: 6241424 - DNA, 12 bp, Homo sapiens
gagcccctggtc

SEQ ID NO: 6241425 - DNA, 20 bp, Homo sapiens
gagcccctggtcctgagggt

SEQ ID NO: 6241426 - DNA, 20 bp, Homo sapiens
gagcccctgtgtgggagggc

SEQ ID NO: 6241427 - DNA, 21 bp, Homo sapiens
gagcccctgtgtgggagggcg

SEQ ID NO: 6241428 - DNA, 13 bp, Homo sapiens
gagccccttcctt

SEQ ID NO: 6241429 - DNA, 23 bp, Homo sapiens
gagccccttcgggagcagggctg

SEQ ID NO: 6241430 - DNA, 21 bp, Homo sapiens
gagccccttctgctcagctct

SEQ ID NO: 6241431 - DNA, 14 bp, Homo sapiens
gagcccgaagctct

SEQ ID NO: 6241432 - DNA, 15 bp, Homo sapiens
gagcccgaggaggtg

SEQ ID NO: 6241433 - DNA, 20 bp, Homo sapiens
gagcccgaggaggtgtctca

SEQ ID NO: 6241434 - DNA, 24 bp, Homo sapiens
gagcccgaggaggtgtctcaggct

SEQ ID NO: 6241435 - DNA, 22 bp, Homo sapiens
gagcccgatattctccctgacc

SEQ ID NO: 6241436 - DNA, 24 bp, Homo sapiens
gagcccgatggggaacagtgttgg

SEQ ID NO: 6241437 - DNA, 17 bp, Homo sapiens
gagcccgcacccccacc

SEQ ID NO: 6241438 - DNA, 14 bp, Homo sapiens
gagcccgcagccca

SEQ ID NO: 6241439 - DNA, 14 bp, Homo sapiens
gagcccgcagggcc

SEQ ID NO: 6241440 - DNA, 20 bp, Homo sapiens
gagcccgcagggccatgcag

SEQ ID NO: 6241441 - DNA, 21 bp, Homo sapiens
gagcccgcagggccatgcaga

SEQ ID NO: 6241442 - DNA, 15 bp, Homo sapiens
gagcccgcccacctg

SEQ ID NO: 6241443 - DNA, 22 bp, Homo sapiens
gagcccgccgtctgcaggggcc

SEQ ID NO: 6241444 - DNA, 20 bp, Homo sapiens
gagcccgcctgcgcccccca

SEQ ID NO: 6241445 - DNA, 16 bp, Homo sapiens
gagcccgcttcaagct

SEQ ID NO: 6241446 - DNA, 19 bp, Homo sapiens
gagcccgcttttgttcttc

SEQ ID NO: 6241447 - DNA, 17 bp, Homo sapiens
gagcccggccccacctc

SEQ ID NO: 6241448 - DNA, 17 bp, Homo sapiens
gagcccggcgcccctgc

SEQ ID NO: 6241449 - DNA, 22 bp, Homo sapiens
gagcccgggagctgctgccctg

SEQ ID NO: 6241450 - DNA, 14 bp, Homo sapiens
gagcccgggctgcc

SEQ ID NO: 6241451 - DNA, 20 bp, Homo sapiens
gagcccgggctgcctgggct

SEQ ID NO: 6241452 - DNA, 23 bp, Homo sapiens
gagcccggggcagagctcagagg

SEQ ID NO: 6241453 - DNA, 15 bp, Homo sapiens
gagcccgtcagcgtg

SEQ ID NO: 6241454 - DNA, 19 bp, Homo sapiens
gagcccgtcagcgtggggg

SEQ ID NO: 6241455 - DNA, 19 bp, Homo sapiens
gagcccgtcaggccacagc

SEQ ID NO: 6241456 - DNA, 20 bp, Homo sapiens
gagcccgtcgcgctggacag

SEQ ID NO: 6241457 - DNA, 18 bp, Homo sapiens
gagcccgtgccaccccca

SEQ ID NO: 6241458 - DNA, 16 bp, Homo sapiens
gagccctaaccccttc

SEQ ID NO: 6241459 - DNA, 18 bp, Homo sapiens
gagccctaaccccttcca

SEQ ID NO: 6241460 - DNA, 20 bp, Homo sapiens
gagccctaaccccttccaga

SEQ ID NO: 6241461 - DNA, 17 bp, Homo sapiens
gagccctactccctgca

SEQ ID NO: 6241462 - DNA, 21 bp, Homo sapiens
gagccctactgaagggaacag

SEQ ID NO: 6241463 - DNA, 14 bp, Homo sapiens
gagccctagccctg

SEQ ID NO: 6241464 - DNA, 15 bp, Homo sapiens
gagccctagccctgc

SEQ ID NO: 6241465 - DNA, 15 bp, Homo sapiens
gagccctcaaagtga

SEQ ID NO: 6241466 - DNA, 16 bp, Homo sapiens
gagccctcaggctccc

SEQ ID NO: 6241467 - DNA, 18 bp, Homo sapiens
gagccctcaggctcccca

SEQ ID NO: 6241468 - DNA, 19 bp, Homo sapiens
gagccctcaggctccccag

SEQ ID NO: 6241469 - DNA, 12 bp, Homo sapiens
gagccctccaca

SEQ ID NO: 6241470 - DNA, 23 bp, Homo sapiens
gagccctccacgtcagtgccatc

SEQ ID NO: 6241471 - DNA, 14 bp, Homo sapiens
gagccctccaggcc

SEQ ID NO: 6241472 - DNA, 16 bp, Homo sapiens
gagccctccaggcctg

SEQ ID NO: 6241473 - DNA, 20 bp, Homo sapiens
gagccctccctcttcccagc

SEQ ID NO: 6241474 - DNA, 21 bp, Homo sapiens
gagccctccctcttcccagca

SEQ ID NO: 6241475 - DNA, 15 bp, Homo sapiens
gagccctccgccttc

SEQ ID NO: 6241476 - DNA, 12 bp, Homo sapiens
gagccctcctga

SEQ ID NO: 6241477 - DNA, 17 bp, Homo sapiens
gagccctcctgagggcc

SEQ ID NO: 6241478 - DNA, 21 bp, Homo sapiens
gagccctcctggaatggagct

SEQ ID NO: 6241479 - DNA, 21 bp, Homo sapiens
gagccctccttcttgccctga

SEQ ID NO: 6241480 - DNA, 14 bp, Homo sapiens
gagccctctcactc

SEQ ID NO: 6241481 - DNA, 18 bp, Homo sapiens
gagccctctcactccagc

SEQ ID NO: 6241482 - DNA, 16 bp, Homo sapiens
gagccctctcctccct

SEQ ID NO: 6241483 - DNA, 14 bp, Homo sapiens
gagccctctgagcc

SEQ ID NO: 6241484 - DNA, 15 bp, Homo sapiens
gagccctcttgccca

SEQ ID NO: 6241485 - DNA, 20 bp, Homo sapiens
gagccctgactcctggactc

SEQ ID NO: 6241486 - DNA, 13 bp, Homo sapiens
gagccctgagccc

SEQ ID NO: 6241487 - DNA, 18 bp, Homo sapiens
gagccctgagcctggcag

SEQ ID NO: 6241488 - DNA, 13 bp, Homo sapiens
gagccctgagctc

SEQ ID NO: 6241489 - DNA, 15 bp, Homo sapiens
gagccctgagctcag

SEQ ID NO: 6241490 - DNA, 19 bp, Homo sapiens
gagccctgagctcaggctg

SEQ ID NO: 6241491 - DNA, 20 bp, Homo sapiens
gagccctgaggggctgggct

SEQ ID NO: 6241492 - DNA, 15 bp, Homo sapiens
gagccctgcagtcac

SEQ ID NO: 6241493 - DNA, 12 bp, Homo sapiens
gagccctgccct

SEQ ID NO: 6241494 - DNA, 13 bp, Homo sapiens
gagccctgccctc

SEQ ID NO: 6241495 - DNA, 19 bp, Homo sapiens
gagccctgccctcactcca

SEQ ID NO: 6241496 - DNA, 23 bp, Homo sapiens
gagccctgccctcactccactcc

SEQ ID NO: 6241497 - DNA, 24 bp, Homo sapiens
gagccctgccctcactccactccc

SEQ ID NO: 6241498 - DNA, 21 bp, Homo sapiens
gagccctgccgaggtgtggct

SEQ ID NO: 6241499 - DNA, 14 bp, Homo sapiens
gagccctgctcttc

SEQ ID NO: 6241500 - DNA, 15 bp, Homo sapiens
gagccctgctcttct

SEQ ID NO: 6241501 - DNA, 21 bp, Homo sapiens
gagccctgctcttctctcccc

SEQ ID NO: 6241502 - DNA, 13 bp, Homo sapiens
gagccctggaccc

SEQ ID NO: 6241503 - DNA, 15 bp, Homo sapiens
gagccctggacccca

SEQ ID NO: 6241504 - DNA, 20 bp, Homo sapiens
gagccctggaccttgggcct

SEQ ID NO: 6241505 - DNA, 18 bp, Homo sapiens
gagccctggccagccctt

SEQ ID NO: 6241506 - DNA, 20 bp, Homo sapiens
gagccctggcccgcaagagg

SEQ ID NO: 6241507 - DNA, 14 bp, Homo sapiens
gagccctggctctg

SEQ ID NO: 6241508 - DNA, 21 bp, Homo sapiens
gagccctggctctgcccctca

SEQ ID NO: 6241509 - DNA, 17 bp, Homo sapiens
gagccctggctgggttc

SEQ ID NO: 6241510 - DNA, 12 bp, Homo sapiens
gagccctgggag

SEQ ID NO: 6241511 - DNA, 16 bp, Homo sapiens
gagccctgggccaggg

SEQ ID NO: 6241512 - DNA, 13 bp, Homo sapiens
gagccctgggtga

SEQ ID NO: 6241513 - DNA, 15 bp, Homo sapiens
gagccctggtggcag

SEQ ID NO: 6241514 - DNA, 16 bp, Homo sapiens
gagccctggtggcagt

SEQ ID NO: 6241515 - DNA, 17 bp, Homo sapiens
gagccctggtggcagtg

SEQ ID NO: 6241516 - DNA, 19 bp, Homo sapiens
gagccctgtacccacccca

SEQ ID NO: 6241517 - DNA, 20 bp, Homo sapiens
gagccctgtacccaccccag

SEQ ID NO: 6241518 - DNA, 22 bp, Homo sapiens
gagccctgtacccaccccagca

SEQ ID NO: 6241519 - DNA, 12 bp, Homo sapiens
gagccctgtctc

SEQ ID NO: 6241520 - DNA, 20 bp, Homo sapiens
gagccctgtggccgccacct

SEQ ID NO: 6241521 - DNA, 18 bp, Homo sapiens
gagccctgttcctccctc

SEQ ID NO: 6241522 - DNA, 13 bp, Homo sapiens
gagcccttagcct

SEQ ID NO: 6241523 - DNA, 19 bp, Homo sapiens
gagcccttcactgccatga

SEQ ID NO: 6241524 - DNA, 21 bp, Homo sapiens
gagcccttctatacccaccca

SEQ ID NO: 6241525 - DNA, 18 bp, Homo sapiens
gagcccttgactgtacag

SEQ ID NO: 6241526 - DNA, 21 bp, Homo sapiens
gagcccttgactgtacagaga

SEQ ID NO: 6241527 - DNA, 17 bp, Homo sapiens
gagcccttgcctcccca

SEQ ID NO: 6241528 - DNA, 12 bp, Homo sapiens
gagcccttggcc

SEQ ID NO: 6241529 - DNA, 13 bp, Homo sapiens
gagccgacaatgc

SEQ ID NO: 6241530 - DNA, 22 bp, Homo sapiens
gagccgagatcacgccactgca

SEQ ID NO: 6241531 - DNA, 21 bp, Homo sapiens
gagccgagattgcaccactgc

SEQ ID NO: 6241532 - DNA, 20 bp, Homo sapiens
gagccgagattgcgccactg

SEQ ID NO: 6241533 - DNA, 16 bp, Homo sapiens
gagccgagctctcctg

SEQ ID NO: 6241534 - DNA, 21 bp, Homo sapiens
gagccgagctctcctgggcca

SEQ ID NO: 6241535 - DNA, 22 bp, Homo sapiens
gagccgagctctcctgggccag

SEQ ID NO: 6241536 - DNA, 17 bp, Homo sapiens
gagccgaggggagagag

SEQ ID NO: 6241537 - DNA, 22 bp, Homo sapiens
gagccgattgtcctatctccag

SEQ ID NO: 6241538 - DNA, 13 bp, Homo sapiens
gagccgcaccctg

SEQ ID NO: 6241539 - DNA, 18 bp, Homo sapiens
gagccgcaccctggctgg

SEQ ID NO: 6241540 - DNA, 13 bp, Homo sapiens
gagccgcagagaa

SEQ ID NO: 6241541 - DNA, 15 bp, Homo sapiens
gagccgcagaggccc

SEQ ID NO: 6241542 - DNA, 16 bp, Homo sapiens
gccactccctgagctt

SEQ ID NO: 6241543 - DNA, 12 bp, Homo sapiens
gccactcctccc

SEQ ID NO: 6241544 - DNA, 17 bp, Homo sapiens
gccactcctctgactca

SEQ ID NO: 6241545 - DNA, 23 bp, Homo sapiens
gccactcctctgactcagggctc

SEQ ID NO: 6241546 - DNA, 18 bp, Homo sapiens
gccactcctgccaggccg

SEQ ID NO: 6241547 - DNA, 15 bp, Homo sapiens
gccactcctgggccc

SEQ ID NO: 6241548 - DNA, 17 bp, Homo sapiens
gccactcctgggcccca

SEQ ID NO: 6241549 - DNA, 18 bp, Homo sapiens
gccactcctgggccccag

SEQ ID NO: 6241550 - DNA, 13 bp, Homo sapiens
gccactcctgtcc

SEQ ID NO: 6241551 - DNA, 14 bp, Homo sapiens
gccactccttcctg

SEQ ID NO: 6241552 - DNA, 17 bp, Homo sapiens
gccactccttcctgccc

SEQ ID NO: 6241553 - DNA, 18 bp, Homo sapiens
gccactccttcctgcccc

SEQ ID NO: 6241554 - DNA, 19 bp, Homo sapiens
gccactcgcagtcgcagga

SEQ ID NO: 6241555 - DNA, 14 bp, Homo sapiens
gccactcgccttct

SEQ ID NO: 6241556 - DNA, 23 bp, Homo sapiens
gccactcgggaggctgagacagg

SEQ ID NO: 6241557 - DNA, 21 bp, Homo sapiens
gccactctatgagttggactt

SEQ ID NO: 6241558 - DNA, 16 bp, Homo sapiens
gccactctcagagact

SEQ ID NO: 6241559 - DNA, 21 bp, Homo sapiens
gccactctcagagactcccag

SEQ ID NO: 6241560 - DNA, 22 bp, Homo sapiens
gccactctcagagactcccagg

SEQ ID NO: 6241561 - DNA, 14 bp, Homo sapiens
gccactctccccat

SEQ ID NO: 6241562 - DNA, 23 bp, Homo sapiens
gccactctcccctccctcttcct

SEQ ID NO: 6241563 - DNA, 13 bp, Homo sapiens
gccactctcctga

SEQ ID NO: 6241564 - DNA, 15 bp, Homo sapiens
gccactctcctgagg

SEQ ID NO: 6241565 - DNA, 16 bp, Homo sapiens
gccactctcctgagga

SEQ ID NO: 6241566 - DNA, 17 bp, Homo sapiens
gccactctcctgaggag

SEQ ID NO: 6241567 - DNA, 22 bp, Homo sapiens
gccactctcctgaggagcagcc

SEQ ID NO: 6241568 - DNA, 18 bp, Homo sapiens
gccactctcttccctttc

SEQ ID NO: 6241569 - DNA, 13 bp, Homo sapiens
gccactctgcctc

SEQ ID NO: 6241570 - DNA, 14 bp, Homo sapiens
gccactctgcctct

SEQ ID NO: 6241571 - DNA, 21 bp, Homo sapiens
gccactctgcctctgcctgca

SEQ ID NO: 6241572 - DNA, 15 bp, Homo sapiens
gccactctgctgcct

SEQ ID NO: 6241573 - DNA, 13 bp, Homo sapiens
gccactctgggca

SEQ ID NO: 6241574 - DNA, 23 bp, Homo sapiens
gccactctgttcctggctcagcc

SEQ ID NO: 6241575 - DNA, 17 bp, Homo sapiens
gccactctgtttgctca

SEQ ID NO: 6241576 - DNA, 15 bp, Homo sapiens
gccactgaaaagctt

SEQ ID NO: 6241577 - DNA, 17 bp, Homo sapiens
gccactgaaaagctttc

SEQ ID NO: 6241578 - DNA, 15 bp, Homo sapiens
gccactgaagctggg

SEQ ID NO: 6241579 - DNA, 22 bp, Homo sapiens
gccactgaatattatcatttct

SEQ ID NO: 6241580 - DNA, 18 bp, Homo sapiens
gccactgacccacctgcg

SEQ ID NO: 6241581 - DNA, 14 bp, Homo sapiens
gccactgacctcac

SEQ ID NO: 6241582 - DNA, 16 bp, Homo sapiens
gccactgacctcccac

SEQ ID NO: 6241583 - DNA, 14 bp, Homo sapiens
gccactgagcctgg

SEQ ID NO: 6241584 - DNA, 17 bp, Homo sapiens
gccactgagcctggccc

SEQ ID NO: 6241585 - DNA, 12 bp, Homo sapiens
gccactgagctg

SEQ ID NO: 6241586 - DNA, 18 bp, Homo sapiens
gccactgagctggctgac

SEQ ID NO: 6241587 - DNA, 12 bp, Homo sapiens
gccactgaggag

SEQ ID NO: 6241588 - DNA, 16 bp, Homo sapiens
gccactgaggagacag

SEQ ID NO: 6241589 - DNA, 17 bp, Homo sapiens
gccactgcaacccatga

SEQ ID NO: 6241590 - DNA, 16 bp, Homo sapiens
gccactgcacagagct

SEQ ID NO: 6241591 - DNA, 14 bp, Homo sapiens
gccactgcacctga

SEQ ID NO: 6241592 - DNA, 19 bp, Homo sapiens
gccactgcacctgcccagc

SEQ ID NO: 6241593 - DNA, 21 bp, Homo sapiens
gccactgcactatagcctagg

SEQ ID NO: 6241594 - DNA, 22 bp, Homo sapiens
gccactgcactccagcctgggt

SEQ ID NO: 6241595 - DNA, 15 bp, Homo sapiens
gccactgcactccgg

SEQ ID NO: 6241596 - DNA, 19 bp, Homo sapiens
gccactgcataccaacctg

SEQ ID NO: 6241597 - DNA, 21 bp, Homo sapiens
gccactgccaagcttcctgtg

SEQ ID NO: 6241598 - DNA, 15 bp, Homo sapiens
gccactgccactcca

SEQ ID NO: 6241599 - DNA, 20 bp, Homo sapiens
gccactgccactccagtcct

SEQ ID NO: 6241600 - DNA, 22 bp, Homo sapiens
gccactgccactccagtcctgc

SEQ ID NO: 6241601 - DNA, 13 bp, Homo sapiens
gccactgccaggc

SEQ ID NO: 6241602 - DNA, 17 bp, Homo sapiens
gccactgccaggcacct

SEQ ID NO: 6241603 - DNA, 23 bp, Homo sapiens
gccactgccataacttgtttgta

SEQ ID NO: 6241604 - DNA, 18 bp, Homo sapiens
gccactgcccaaagccat

SEQ ID NO: 6241605 - DNA, 13 bp, Homo sapiens
gccactgcccccc

SEQ ID NO: 6241606 - DNA, 22 bp, Homo sapiens
gccactgccccccgaggctgct

SEQ ID NO: 6241607 - DNA, 16 bp, Homo sapiens
gccactgcccgagctg

SEQ ID NO: 6241608 - DNA, 17 bp, Homo sapiens
gccactgcccgagctgg

SEQ ID NO: 6241609 - DNA, 21 bp, Homo sapiens
gccactgcccgagctggtgca

SEQ ID NO: 6241610 - DNA, 16 bp, Homo sapiens
gccactgccctctcca

SEQ ID NO: 6241611 - DNA, 21 bp, Homo sapiens
gccactgccctctccacaccc

SEQ ID NO: 6241612 - DNA, 13 bp, Homo sapiens
gccactgcctgca

SEQ ID NO: 6241613 - DNA, 18 bp, Homo sapiens
gccactgccttcgcttct

SEQ ID NO: 6241614 - DNA, 21 bp, Homo sapiens
gccactgctccctaagccagc

SEQ ID NO: 6241615 - DNA, 20 bp, Homo sapiens
gccactgctttccagcctgg

SEQ ID NO: 6241616 - DNA, 21 bp, Homo sapiens
gccactggaaatgcatgactt

SEQ ID NO: 6241617 - DNA, 12 bp, Homo sapiens
gccactggaagg

SEQ ID NO: 6241618 - DNA, 13 bp, Homo sapiens
gccactggagggg

SEQ ID NO: 6241619 - DNA, 22 bp, Homo sapiens
gccactggagtgtgcgtggtgg

SEQ ID NO: 6241620 - DNA, 15 bp, Homo sapiens
gccactggatcctgc

SEQ ID NO: 6241621 - DNA, 18 bp, Homo sapiens
gccactggatcctgctgc

SEQ ID NO: 6241622 - DNA, 21 bp, Homo sapiens
gccactggatcctgctgcttt

SEQ ID NO: 6241623 - DNA, 15 bp, Homo sapiens
gccactggcacttgc

SEQ ID NO: 6241624 - DNA, 20 bp, Homo sapiens
gccactggcacttgcctgct

SEQ ID NO: 6241625 - DNA, 21 bp, Homo sapiens
gccactggcacttgcctgctg

SEQ ID NO: 6241626 - DNA, 20 bp, Homo sapiens
gccactggcatcgcagcttc

SEQ ID NO: 6241627 - DNA, 16 bp, Homo sapiens
gccactggccatctcc

SEQ ID NO: 6241628 - DNA, 20 bp, Homo sapiens
gccactggctgtgcctcccc

SEQ ID NO: 6241629 - DNA, 16 bp, Homo sapiens
gccactgggacagctg

SEQ ID NO: 6241630 - DNA, 17 bp, Homo sapiens
gccactgggacagctgg

SEQ ID NO: 6241631 - DNA, 21 bp, Homo sapiens
gccactgggacagctggctgg

SEQ ID NO: 6241632 - DNA, 22 bp, Homo sapiens
gccactgggattcatggctttg

SEQ ID NO: 6241633 - DNA, 16 bp, Homo sapiens
gccactgggcacctgc

SEQ ID NO: 6241634 - DNA, 13 bp, Homo sapiens
gccactgggcccc

SEQ ID NO: 6241635 - DNA, 19 bp, Homo sapiens
gccactgggccccattctc

SEQ ID NO: 6241636 - DNA, 23 bp, Homo sapiens
gccactgggccccattctccctc

SEQ ID NO: 6241637 - DNA, 14 bp, Homo sapiens
gccactgggcccct

SEQ ID NO: 6241638 - DNA, 16 bp, Homo sapiens
gccactgggcccctgt

SEQ ID NO: 6241639 - DNA, 19 bp, Homo sapiens
gccactgggccctgagcca

SEQ ID NO: 6241640 - DNA, 15 bp, Homo sapiens
gccactgggctctgg

SEQ ID NO: 6241641 - DNA, 16 bp, Homo sapiens
gccactgggctctgga

SEQ ID NO: 6241642 - DNA, 22 bp, Homo sapiens
gccactgggctctggacctcag

SEQ ID NO: 6241643 - DNA, 23 bp, Homo sapiens
gccactggggactttatttattt

SEQ ID NO: 6241644 - DNA, 19 bp, Homo sapiens
gccactggggctcagagcc

SEQ ID NO: 6241645 - DNA, 21 bp, Homo sapiens
gccactggggtgccttcactg

SEQ ID NO: 6241646 - DNA, 19 bp, Homo sapiens
gccactggggtgggagggg

SEQ ID NO: 6241647 - DNA, 21 bp, Homo sapiens
gccactggggtgggagggggc

SEQ ID NO: 6241648 - DNA, 17 bp, Homo sapiens
gccactgggtctcactc

SEQ ID NO: 6241649 - DNA, 23 bp, Homo sapiens
gccactggtgttaagatatattt

SEQ ID NO: 6241650 - DNA, 19 bp, Homo sapiens
gccactggtttctcagaat

SEQ ID NO: 6241651 - DNA, 20 bp, Homo sapiens
gccactggtttctcagaatc

SEQ ID NO: 6241652 - DNA, 15 bp, Homo sapiens
gccactgtactccag

SEQ ID NO: 6241653 - DNA, 15 bp, Homo sapiens
gccactgtcacaggc

SEQ ID NO: 6241654 - DNA, 17 bp, Homo sapiens
gccactgtcacaggcat

SEQ ID NO: 6241655 - DNA, 15 bp, Homo sapiens
gccactgtccctgtc

SEQ ID NO: 6241656 - DNA, 14 bp, Homo sapiens
gccactgtgcttgg

SEQ ID NO: 6241657 - DNA, 14 bp, Homo sapiens
gccactgtggccag

SEQ ID NO: 6241658 - DNA, 15 bp, Homo sapiens
gccactgtggccaga

SEQ ID NO: 6241659 - DNA, 12 bp, Homo sapiens
gccactgtgggt

SEQ ID NO: 6241660 - DNA, 13 bp, Homo sapiens
gccactgtgggtg

SEQ ID NO: 6241661 - DNA, 17 bp, Homo sapiens
gccactgtgtctctgtt

SEQ ID NO: 6241662 - DNA, 19 bp, Homo sapiens
gccactgtgtctctgtttc

SEQ ID NO: 6241663 - DNA, 21 bp, Homo sapiens
gccactgtgtctctgtttcct

SEQ ID NO: 6241664 - DNA, 12 bp, Homo sapiens
gccactgtgtgc

SEQ ID NO: 6241665 - DNA, 14 bp, Homo sapiens
gccactgtgtgcct

SEQ ID NO: 6241666 - DNA, 16 bp, Homo sapiens
gccactgtgtgccttc

SEQ ID NO: 6241667 - DNA, 17 bp, Homo sapiens
gccactgtgtgccttct

SEQ ID NO: 6241668 - DNA, 20 bp, Homo sapiens
gccactgtgtttctgtgctc

SEQ ID NO: 6241669 - DNA, 24 bp, Homo sapiens
gccactgttcagcggagctgactg

SEQ ID NO: 6241670 - DNA, 21 bp, Homo sapiens
gccactgttttgaatctcata

SEQ ID NO: 6241671 - DNA, 13 bp, Homo sapiens
gccacttcaaccc

SEQ ID NO: 6241672 - DNA, 18 bp, Homo sapiens
gccacttcattccagcag

SEQ ID NO: 6241673 - DNA, 14 bp, Homo sapiens
gccacttccaggag

SEQ ID NO: 6241674 - DNA, 20 bp, Homo sapiens
gccacttcctttgtgtttat

SEQ ID NO: 6241675 - DNA, 21 bp, Homo sapiens
gccacttctgcgggctccctc

SEQ ID NO: 6241676 - DNA, 23 bp, Homo sapiens
gccacttctgcgggctccctcct

SEQ ID NO: 6241677 - DNA, 15 bp, Homo sapiens
gccacttctggcttc

SEQ ID NO: 6241678 - DNA, 14 bp, Homo sapiens
gccacttctgggtg

SEQ ID NO: 6241679 - DNA, 20 bp, Homo sapiens
gccacttctgggtggggcag

SEQ ID NO: 6241680 - DNA, 15 bp, Homo sapiens
gccacttctgtccat

SEQ ID NO: 6241681 - DNA, 21 bp, Homo sapiens
gccacttcttaaaggcctgga

SEQ ID NO: 6241682 - DNA, 22 bp, Homo sapiens
gccacttcttaaaggcctggaa

SEQ ID NO: 6241683 - DNA, 21 bp, Homo sapiens
gccacttgaacaaaatctgtt

SEQ ID NO: 6241684 - DNA, 22 bp, Homo sapiens
gccacttgaacaaaatctgttg

SEQ ID NO: 6241685 - DNA, 23 bp, Homo sapiens
gccacttgacattccttgtcacc

SEQ ID NO: 6241686 - DNA, 15 bp, Homo sapiens
gccacttggcccaga

SEQ ID NO: 6241687 - DNA, 14 bp, Homo sapiens
gccacttggcctca

SEQ ID NO: 6241688 - DNA, 15 bp, Homo sapiens
gccacttgggaatga

SEQ ID NO: 6241689 - DNA, 19 bp, Homo sapiens
gccactttaagagagaaat

SEQ ID NO: 6241690 - DNA, 22 bp, Homo sapiens
gccactttaagagagaaatctg

SEQ ID NO: 6241691 - DNA, 23 bp, Homo sapiens
gccactttacccacctagaacac

SEQ ID NO: 6241692 - DNA, 19 bp, Homo sapiens
gccactttcagagccccca

SEQ ID NO: 6241693 - DNA, 23 bp, Homo sapiens
gccactttcagagcccccagccc

SEQ ID NO: 6241694 - DNA, 13 bp, Homo sapiens
gccactttccaag

SEQ ID NO: 6241695 - DNA, 19 bp, Homo sapiens
gccactttcgggagggtgg

SEQ ID NO: 6241696 - DNA, 21 bp, Homo sapiens
gccactttcgggagggtggat

SEQ ID NO: 6241697 - DNA, 17 bp, Homo sapiens
gccactttgcagacctg

SEQ ID NO: 6241698 - DNA, 18 bp, Homo sapiens
gccactttgcagacctgg

SEQ ID NO: 6241699 - DNA, 20 bp, Homo sapiens
gccactttgcagacctggga

SEQ ID NO: 6241700 - DNA, 14 bp, Homo sapiens
gccactttggctga

SEQ ID NO: 6241701 - DNA, 16 bp, Homo sapiens
gccactttggcttctc

SEQ ID NO: 6241702 - DNA, 19 bp, Homo sapiens
gccacttttagctactgct

SEQ ID NO: 6241703 - DNA, 20 bp, Homo sapiens
gccacttttagctactgcta

SEQ ID NO: 6241704 - DNA, 10 bp, Homo sapiens
gccagaaaaa

SEQ ID NO: 6241705 - DNA, 21 bp, Homo sapiens
gccagaaaaaaaaaataaaac

SEQ ID NO: 6241706 - DNA, 15 bp, Homo sapiens
gccagaaaaggcagc

SEQ ID NO: 6241707 - DNA, 19 bp, Homo sapiens
gccagaaaaggcagccaga

SEQ ID NO: 6241708 - DNA, 21 bp, Homo sapiens
gccagaaaaggcagccagatc

SEQ ID NO: 6241709 - DNA, 22 bp, Homo sapiens
gccagaaacgcagattgggctg

SEQ ID NO: 6241710 - DNA, 13 bp, Homo sapiens
gccagaaagcact

SEQ ID NO: 6241711 - DNA, 17 bp, Homo sapiens
gccagaaagtcccccct

SEQ ID NO: 6241712 - DNA, 23 bp, Homo sapiens
gccagaaatgggcagttctccca

SEQ ID NO: 6241713 - DNA, 16 bp, Homo sapiens
gccagaagagaattca

SEQ ID NO: 6241714 - DNA, 17 bp, Homo sapiens
gccagaagatcccctca

SEQ ID NO: 6241715 - DNA, 19 bp, Homo sapiens
gccagaagatcccctcagg

SEQ ID NO: 6241716 - DNA, 19 bp, Homo sapiens
gccagaagcctctgcctcc

SEQ ID NO: 6241717 - DNA, 14 bp, Homo sapiens
gccagaagctactg

SEQ ID NO: 6241718 - DNA, 14 bp, Homo sapiens
gccagaaggagggc

SEQ ID NO: 6241719 - DNA, 17 bp, Homo sapiens
gagccgcagaggcccga

SEQ ID NO: 6241720 - DNA, 18 bp, Homo sapiens
gagccgcagggcctgcta

SEQ ID NO: 6241721 - DNA, 22 bp, Homo sapiens
gagccgccaccgggcatgtctg

SEQ ID NO: 6241722 - DNA, 22 bp, Homo sapiens
gagccgccactcccgggccaag

SEQ ID NO: 6241723 - DNA, 23 bp, Homo sapiens
gagccgccactcccgggccaaga

SEQ ID NO: 6241724 - DNA, 18 bp, Homo sapiens
gagccgccccgtgtcccc

SEQ ID NO: 6241725 - DNA, 21 bp, Homo sapiens
gagccgccccgtgtcccccca

SEQ ID NO: 6241726 - DNA, 22 bp, Homo sapiens
gagccgccccgtgtccccccag

SEQ ID NO: 6241727 - DNA, 22 bp, Homo sapiens
gagccgccgcgcctggcctaga

SEQ ID NO: 6241728 - DNA, 18 bp, Homo sapiens
gagccgcctcggagtgtg

SEQ ID NO: 6241729 - DNA, 21 bp, Homo sapiens
gagccgcctcggagtgtggcc

SEQ ID NO: 6241730 - DNA, 24 bp, Homo sapiens
gagccgcctcggagtgtggcctgg

SEQ ID NO: 6241731 - DNA, 17 bp, Homo sapiens
gagccgcctctggttcc

SEQ ID NO: 6241732 - DNA, 23 bp, Homo sapiens
gagccgcctctggttccactcag

SEQ ID NO: 6241733 - DNA, 20 bp, Homo sapiens
gagccgctgtgagcccctgg

SEQ ID NO: 6241734 - DNA, 17 bp, Homo sapiens
gagccgcttccccagct

SEQ ID NO: 6241735 - DNA, 22 bp, Homo sapiens
gagccggaccaagatgggcaca

SEQ ID NO: 6241736 - DNA, 23 bp, Homo sapiens
gagccggaccaagatgggcacat

SEQ ID NO: 6241737 - DNA, 12 bp, Homo sapiens
gagccggagcct

SEQ ID NO: 6241738 - DNA, 16 bp, Homo sapiens
gagccggcactgcatg

SEQ ID NO: 6241739 - DNA, 23 bp, Homo sapiens
gagccggccccaggctcgtggac

SEQ ID NO: 6241740 - DNA, 18 bp, Homo sapiens
gagccggcggcctctcga

SEQ ID NO: 6241741 - DNA, 16 bp, Homo sapiens
gagccgggcccctggg

SEQ ID NO: 6241742 - DNA, 14 bp, Homo sapiens
gagccgggccgcag

SEQ ID NO: 6241743 - DNA, 19 bp, Homo sapiens
gagccgggcctcccaccgc

SEQ ID NO: 6241744 - DNA, 20 bp, Homo sapiens
gagccggggactcccaggct

SEQ ID NO: 6241745 - DNA, 22 bp, Homo sapiens
gagccggggagtttctttcctg

SEQ ID NO: 6241746 - DNA, 19 bp, Homo sapiens
gagccggggcactttcaga

SEQ ID NO: 6241747 - DNA, 20 bp, Homo sapiens
gagccggggtggggtggctg

SEQ ID NO: 6241748 - DNA, 20 bp, Homo sapiens
gagccgggtggatcgcctga

SEQ ID NO: 6241749 - DNA, 17 bp, Homo sapiens
gagccggtaactgtcct

SEQ ID NO: 6241750 - DNA, 22 bp, Homo sapiens
gagccggtaactgtcctgtcct

SEQ ID NO: 6241751 - DNA, 17 bp, Homo sapiens
gagccggtttgggagag

SEQ ID NO: 6241752 - DNA, 16 bp, Homo sapiens
gagccgtcagcctgtg

SEQ ID NO: 6241753 - DNA, 22 bp, Homo sapiens
gagccgtgacctccaggaaggg

SEQ ID NO: 6241754 - DNA, 19 bp, Homo sapiens
gagccgtggtccctgagga

SEQ ID NO: 6241755 - DNA, 13 bp, Homo sapiens
gagccgtggtcct

SEQ ID NO: 6241756 - DNA, 17 bp, Homo sapiens
gagccgtggtcctttgg

SEQ ID NO: 6241757 - DNA, 13 bp, Homo sapiens
gagccgttcctgg

SEQ ID NO: 6241758 - DNA, 14 bp, Homo sapiens
gagccgttcctggg

SEQ ID NO: 6241759 - DNA, 15 bp, Homo sapiens
gagccgttcctggga

SEQ ID NO: 6241760 - DNA, 17 bp, Homo sapiens
gagccgttgctaatgcc

SEQ ID NO: 6241761 - DNA, 15 bp, Homo sapiens
gagcctaaatctaat

SEQ ID NO: 6241762 - DNA, 15 bp, Homo sapiens
gagcctacccacccc

SEQ ID NO: 6241763 - DNA, 17 bp, Homo sapiens
gagcctacccaccccca

SEQ ID NO: 6241764 - DNA, 13 bp, Homo sapiens
gagcctacctctg

SEQ ID NO: 6241765 - DNA, 16 bp, Homo sapiens
gagcctacctctgtct

SEQ ID NO: 6241766 - DNA, 21 bp, Homo sapiens
gagcctacctctgtctgagac

SEQ ID NO: 6241767 - DNA, 19 bp, Homo sapiens
gagcctaccttcaccacct

SEQ ID NO: 6241768 - DNA, 20 bp, Homo sapiens
gagcctaccttcaccaccta

SEQ ID NO: 6241769 - DNA, 22 bp, Homo sapiens
gagcctactgtctccttcccac

SEQ ID NO: 6241770 - DNA, 20 bp, Homo sapiens
gagcctagaacatccctggg

SEQ ID NO: 6241771 - DNA, 21 bp, Homo sapiens
gagcctagaacatccctgggc

SEQ ID NO: 6241772 - DNA, 15 bp, Homo sapiens
gagcctagaagctgg

SEQ ID NO: 6241773 - DNA, 15 bp, Homo sapiens
gagcctagaggagga

SEQ ID NO: 6241774 - DNA, 17 bp, Homo sapiens
gagcctagaggaggaaa

SEQ ID NO: 6241775 - DNA, 13 bp, Homo sapiens
gagcctagccacc

SEQ ID NO: 6241776 - DNA, 16 bp, Homo sapiens
gagcctagccacctcc

SEQ ID NO: 6241777 - DNA, 20 bp, Homo sapiens
gagcctagccacctcccacc

SEQ ID NO: 6241778 - DNA, 18 bp, Homo sapiens
gagcctagcggagcccag

SEQ ID NO: 6241779 - DNA, 15 bp, Homo sapiens
gagcctagctcctgc

SEQ ID NO: 6241780 - DNA, 19 bp, Homo sapiens
gagcctaggaccactcagc

SEQ ID NO: 6241781 - DNA, 21 bp, Homo sapiens
gagcctaggaccactcagccc

SEQ ID NO: 6241782 - DNA, 15 bp, Homo sapiens
gagcctaggccaggt

SEQ ID NO: 6241783 - DNA, 15 bp, Homo sapiens
gagcctcacagcagt

SEQ ID NO: 6241784 - DNA, 14 bp, Homo sapiens
gagcctcactgggg

SEQ ID NO: 6241785 - DNA, 23 bp, Homo sapiens
gagcctcactggggcagacaata

SEQ ID NO: 6241786 - DNA, 21 bp, Homo sapiens
gagcctcagaccccaggtcag

SEQ ID NO: 6241787 - DNA, 14 bp, Homo sapiens
gagcctcagcagca

SEQ ID NO: 6241788 - DNA, 22 bp, Homo sapiens
gagcctcagcagcaaatgccac

SEQ ID NO: 6241789 - DNA, 13 bp, Homo sapiens
gagcctcagcatc

SEQ ID NO: 6241790 - DNA, 14 bp, Homo sapiens
gagcctcagcatcc

SEQ ID NO: 6241791 - DNA, 20 bp, Homo sapiens
gagcctcagcatcctggcac

SEQ ID NO: 6241792 - DNA, 13 bp, Homo sapiens
gagcctcagcttc

SEQ ID NO: 6241793 - DNA, 19 bp, Homo sapiens
gagcctcagtctccctccc

SEQ ID NO: 6241794 - DNA, 18 bp, Homo sapiens
gagcctcatccagcctca

SEQ ID NO: 6241795 - DNA, 18 bp, Homo sapiens
gagcctcatccgaggcag

SEQ ID NO: 6241796 - DNA, 19 bp, Homo sapiens
gagcctcatccgaggcagg

SEQ ID NO: 6241797 - DNA, 17 bp, Homo sapiens
gagcctcatgttctctt

SEQ ID NO: 6241798 - DNA, 18 bp, Homo sapiens
gagcctccaggttcctca

SEQ ID NO: 6241799 - DNA, 17 bp, Homo sapiens
gagcctcccaaggagaa

SEQ ID NO: 6241800 - DNA, 21 bp, Homo sapiens
gagcctcccaccagagccggg

SEQ ID NO: 6241801 - DNA, 11 bp, Homo sapiens
gagcctcccca

SEQ ID NO: 6241802 - DNA, 13 bp, Homo sapiens
gagcctccccctc

SEQ ID NO: 6241803 - DNA, 11 bp, Homo sapiens
gagcctccctc

SEQ ID NO: 6241804 - DNA, 21 bp, Homo sapiens
gagcctccctcaattccccct

SEQ ID NO: 6241805 - DNA, 13 bp, Homo sapiens
gagcctccctgca

SEQ ID NO: 6241806 - DNA, 21 bp, Homo sapiens
gagcctccctgcagccaccag

SEQ ID NO: 6241807 - DNA, 24 bp, Homo sapiens
gagcctccctgcagccaccagact

SEQ ID NO: 6241808 - DNA, 16 bp, Homo sapiens
gagcctcctagggctt

SEQ ID NO: 6241809 - DNA, 14 bp, Homo sapiens
gagcctcctcaggg

SEQ ID NO: 6241810 - DNA, 22 bp, Homo sapiens
gagcctcctgaagttgctgctg

SEQ ID NO: 6241811 - DNA, 13 bp, Homo sapiens
gagcctcctgccc

SEQ ID NO: 6241812 - DNA, 13 bp, Homo sapiens
gagcctcctggga

SEQ ID NO: 6241813 - DNA, 21 bp, Homo sapiens
gagcctcctgtgcctggcccc

SEQ ID NO: 6241814 - DNA, 19 bp, Homo sapiens
gagcctcgcaacccgtgcc

SEQ ID NO: 6241815 - DNA, 17 bp, Homo sapiens
gagcctcgcccctccag

SEQ ID NO: 6241816 - DNA, 22 bp, Homo sapiens
gagcctcgcccctccagtgttg

SEQ ID NO: 6241817 - DNA, 20 bp, Homo sapiens
gagcctcggccctagcattg

SEQ ID NO: 6241818 - DNA, 18 bp, Homo sapiens
gagcctcggtggccatgc

SEQ ID NO: 6241819 - DNA, 16 bp, Homo sapiens
gagcctcgtccaaggc

SEQ ID NO: 6241820 - DNA, 22 bp, Homo sapiens
gagcctcgtccctccctcactg

SEQ ID NO: 6241821 - DNA, 20 bp, Homo sapiens
gagcctcgtgtcctgctagc

SEQ ID NO: 6241822 - DNA, 12 bp, Homo sapiens
gagcctctgcct

SEQ ID NO: 6241823 - DNA, 16 bp, Homo sapiens
gagcctctgcgcctct

SEQ ID NO: 6241824 - DNA, 19 bp, Homo sapiens
gagcctctgcgcctctcca

SEQ ID NO: 6241825 - DNA, 16 bp, Homo sapiens
gagcctctgctcccca

SEQ ID NO: 6241826 - DNA, 17 bp, Homo sapiens
gagcctctgctccccag

SEQ ID NO: 6241827 - DNA, 14 bp, Homo sapiens
gagcctctggcccc

SEQ ID NO: 6241828 - DNA, 14 bp, Homo sapiens
gagcctctggcttc

SEQ ID NO: 6241829 - DNA, 20 bp, Homo sapiens
gagcctcttgtggaccccgc

SEQ ID NO: 6241830 - DNA, 21 bp, Homo sapiens
gagcctcttttcaattatttc

SEQ ID NO: 6241831 - DNA, 18 bp, Homo sapiens
gagcctctttttccttct

SEQ ID NO: 6241832 - DNA, 20 bp, Homo sapiens
gagcctctttttccttcttc

SEQ ID NO: 6241833 - DNA, 21 bp, Homo sapiens
gagcctctttttccttcttca

SEQ ID NO: 6241834 - DNA, 17 bp, Homo sapiens
gagcctgaaatcatctt

SEQ ID NO: 6241835 - DNA, 21 bp, Homo sapiens
gagcctgaaccgtgtgctcct

SEQ ID NO: 6241836 - DNA, 17 bp, Homo sapiens
gagcctgaactgagccc

SEQ ID NO: 6241837 - DNA, 16 bp, Homo sapiens
gagcctgaagggtgcc

SEQ ID NO: 6241838 - DNA, 15 bp, Homo sapiens
gagcctgacagccag

SEQ ID NO: 6241839 - DNA, 15 bp, Homo sapiens
gagcctgacctgaga

SEQ ID NO: 6241840 - DNA, 22 bp, Homo sapiens
gagcctgacgctcagccccagg

SEQ ID NO: 6241841 - DNA, 19 bp, Homo sapiens
gagcctgagactggaaaag

SEQ ID NO: 6241842 - DNA, 16 bp, Homo sapiens
gagcctgagccttaga

SEQ ID NO: 6241843 - DNA, 16 bp, Homo sapiens
gagcctgaggcaggag

SEQ ID NO: 6241844 - DNA, 17 bp, Homo sapiens
gagcctgaggcaggaga

SEQ ID NO: 6241845 - DNA, 22 bp, Homo sapiens
gagcctgatggtatactactgc

SEQ ID NO: 6241846 - DNA, 13 bp, Homo sapiens
gagcctgcaggat

SEQ ID NO: 6241847 - DNA, 22 bp, Homo sapiens
gagcctgcaggcaggtgggggc

SEQ ID NO: 6241848 - DNA, 18 bp, Homo sapiens
gagcctgcagggtgacct

SEQ ID NO: 6241849 - DNA, 14 bp, Homo sapiens
gagcctgcatctgt

SEQ ID NO: 6241850 - DNA, 23 bp, Homo sapiens
gagcctgcatttcctcgcagcct

SEQ ID NO: 6241851 - DNA, 12 bp, Homo sapiens
gagcctgcccag

SEQ ID NO: 6241852 - DNA, 21 bp, Homo sapiens
gagcctgcccagttggaggag

SEQ ID NO: 6241853 - DNA, 18 bp, Homo sapiens
gagcctgccccagcgctg

SEQ ID NO: 6241854 - DNA, 20 bp, Homo sapiens
gagcctgccccagctgggct

SEQ ID NO: 6241855 - DNA, 21 bp, Homo sapiens
gagcctgccccagctgggctg

SEQ ID NO: 6241856 - DNA, 13 bp, Homo sapiens
gagcctgccgagc

SEQ ID NO: 6241857 - DNA, 18 bp, Homo sapiens
gagcctgccgagcaaccg

SEQ ID NO: 6241858 - DNA, 19 bp, Homo sapiens
gagcctgccgcccccgcct

SEQ ID NO: 6241859 - DNA, 23 bp, Homo sapiens
gagcctgccgcccccgcctgggc

SEQ ID NO: 6241860 - DNA, 19 bp, Homo sapiens
gagcctgcctaaccaggcc

SEQ ID NO: 6241861 - DNA, 21 bp, Homo sapiens
gagcctgcctaaccaggccca

SEQ ID NO: 6241862 - DNA, 13 bp, Homo sapiens
gagcctgcctgga

SEQ ID NO: 6241863 - DNA, 16 bp, Homo sapiens
gagcctgcctggagcg

SEQ ID NO: 6241864 - DNA, 21 bp, Homo sapiens
gagcctgcggctgctggcaca

SEQ ID NO: 6241865 - DNA, 18 bp, Homo sapiens
gagcctgcgtggcctggg

SEQ ID NO: 6241866 - DNA, 22 bp, Homo sapiens
gagcctgctaaggaacaatgcc

SEQ ID NO: 6241867 - DNA, 18 bp, Homo sapiens
gagcctgctcccccaccc

SEQ ID NO: 6241868 - DNA, 11 bp, Homo sapiens
gagcctgctgg

SEQ ID NO: 6241869 - DNA, 16 bp, Homo sapiens
gagcctgctggaagcc

SEQ ID NO: 6241870 - DNA, 20 bp, Homo sapiens
gagcctgctggaagcccagc

SEQ ID NO: 6241871 - DNA, 15 bp, Homo sapiens
gagcctgctggcacc

SEQ ID NO: 6241872 - DNA, 15 bp, Homo sapiens
gagcctggaagcact

SEQ ID NO: 6241873 - DNA, 10 bp, Homo sapiens
gagcctggag

SEQ ID NO: 6241874 - DNA, 13 bp, Homo sapiens
gagcctggagaag

SEQ ID NO: 6241875 - DNA, 14 bp, Homo sapiens
gagcctggagcccc

SEQ ID NO: 6241876 - DNA, 15 bp, Homo sapiens
gagcctggagcccct

SEQ ID NO: 6241877 - DNA, 12 bp, Homo sapiens
gagcctggcaag

SEQ ID NO: 6241878 - DNA, 15 bp, Homo sapiens
gagcctggcaagaat

SEQ ID NO: 6241879 - DNA, 23 bp, Homo sapiens
gagcctggcaaggcattcctcat

SEQ ID NO: 6241880 - DNA, 18 bp, Homo sapiens
gagcctggcacaggactg

SEQ ID NO: 6241881 - DNA, 19 bp, Homo sapiens
gagcctggcacaggactga

SEQ ID NO: 6241882 - DNA, 22 bp, Homo sapiens
gagcctggcaggtgccccgtgg

SEQ ID NO: 6241883 - DNA, 13 bp, Homo sapiens
gagcctggccagg

SEQ ID NO: 6241884 - DNA, 21 bp, Homo sapiens
gagcctggccaggcagggaga

SEQ ID NO: 6241885 - DNA, 17 bp, Homo sapiens
gagcctggcccatagaa

SEQ ID NO: 6241886 - DNA, 15 bp, Homo sapiens
gagcctggccccagg

SEQ ID NO: 6241887 - DNA, 11 bp, Homo sapiens
gagcctggctt

SEQ ID NO: 6241888 - DNA, 13 bp, Homo sapiens
gagcctggctttg

SEQ ID NO: 6241889 - DNA, 14 bp, Homo sapiens
gagcctgggcagca

SEQ ID NO: 6241890 - DNA, 13 bp, Homo sapiens
gagcctggggctc

SEQ ID NO: 6241891 - DNA, 15 bp, Homo sapiens
gagcctggggctcta

SEQ ID NO: 6241892 - DNA, 18 bp, Homo sapiens
gagcctgggggctcctca

SEQ ID NO: 6241893 - DNA, 14 bp, Homo sapiens
gagcctggtagaga

SEQ ID NO: 6241894 - DNA, 19 bp, Homo sapiens
gagcctggtcccacgaggg

SEQ ID NO: 6241895 - DNA, 12 bp, Homo sapiens
gagcctggtgcc

SEQ ID NO: 6241896 - DNA, 14 bp, Homo sapiens
gagcctggtgccct

SEQ ID NO: 6241897 - DNA, 15 bp, Homo sapiens
gccagaaggagggca

SEQ ID NO: 6241898 - DNA, 16 bp, Homo sapiens
gccagaaggagggcag

SEQ ID NO: 6241899 - DNA, 21 bp, Homo sapiens
gccagaaggggcacgcctgcc

SEQ ID NO: 6241900 - DNA, 23 bp, Homo sapiens
gccagaaggggcacgcctgccca

SEQ ID NO: 6241901 - DNA, 18 bp, Homo sapiens
gccagaaggggctgcttg

SEQ ID NO: 6241902 - DNA, 18 bp, Homo sapiens
gccagaagggggccatga

SEQ ID NO: 6241903 - DNA, 14 bp, Homo sapiens
gccagaagtaactt

SEQ ID NO: 6241904 - DNA, 14 bp, Homo sapiens
gccagaagtaccag

SEQ ID NO: 6241905 - DNA, 22 bp, Homo sapiens
gccagaagtcaaggcttagacc

SEQ ID NO: 6241906 - DNA, 23 bp, Homo sapiens
gccagaagtcaaggcttagaccc

SEQ ID NO: 6241907 - DNA, 17 bp, Homo sapiens
gccagaatataatgtgc

SEQ ID NO: 6241908 - DNA, 15 bp, Homo sapiens
gccagaatcagcaca

SEQ ID NO: 6241909 - DNA, 20 bp, Homo sapiens
gccagaatcagcacagataa

SEQ ID NO: 6241910 - DNA, 18 bp, Homo sapiens
gccagaatctagagcaaa

SEQ ID NO: 6241911 - DNA, 19 bp, Homo sapiens
gccagaatctagagcaaag

SEQ ID NO: 6241912 - DNA, 17 bp, Homo sapiens
gccagaatggctgtcct

SEQ ID NO: 6241913 - DNA, 18 bp, Homo sapiens
gccagacaaaatttgaga

SEQ ID NO: 6241914 - DNA, 21 bp, Homo sapiens
gccagacaaaatttgagaata

SEQ ID NO: 6241915 - DNA, 22 bp, Homo sapiens
gccagacaaataggagtgagtg

SEQ ID NO: 6241916 - DNA, 15 bp, Homo sapiens
gccagacacaggccg

SEQ ID NO: 6241917 - DNA, 13 bp, Homo sapiens
gccagacactctg

SEQ ID NO: 6241918 - DNA, 20 bp, Homo sapiens
gccagacactgcgccccgcc

SEQ ID NO: 6241919 - DNA, 14 bp, Homo sapiens
gccagacagagatc

SEQ ID NO: 6241920 - DNA, 21 bp, Homo sapiens
gccagacagccccaagcttct

SEQ ID NO: 6241921 - DNA, 13 bp, Homo sapiens
gccagacatggac

SEQ ID NO: 6241922 - DNA, 18 bp, Homo sapiens
gccagacatggacctcca

SEQ ID NO: 6241923 - DNA, 14 bp, Homo sapiens
gccagacatgtggt

SEQ ID NO: 6241924 - DNA, 23 bp, Homo sapiens
gccagaccaacgttactcagggc

SEQ ID NO: 6241925 - DNA, 15 bp, Homo sapiens
gccagaccacagcag

SEQ ID NO: 6241926 - DNA, 19 bp, Homo sapiens
gccagaccacgcccctgcc

SEQ ID NO: 6241927 - DNA, 13 bp, Homo sapiens
gccagaccatgga

SEQ ID NO: 6241928 - DNA, 16 bp, Homo sapiens
gccagaccatggacac

SEQ ID NO: 6241929 - DNA, 14 bp, Homo sapiens
gccagacccactga

SEQ ID NO: 6241930 - DNA, 18 bp, Homo sapiens
gccagaccccgtggctct

SEQ ID NO: 6241931 - DNA, 22 bp, Homo sapiens
gccagaccccgtggctctggga

SEQ ID NO: 6241932 - DNA, 15 bp, Homo sapiens
gccagacctagcagg

SEQ ID NO: 6241933 - DNA, 19 bp, Homo sapiens
gccagacctagcaggctgt

SEQ ID NO: 6241934 - DNA, 21 bp, Homo sapiens
gccagacctgcagacgcccag

SEQ ID NO: 6241935 - DNA, 13 bp, Homo sapiens
gccagacctgcat

SEQ ID NO: 6241936 - DNA, 20 bp, Homo sapiens
gccagacgtggtggctcaca

SEQ ID NO: 6241937 - DNA, 12 bp, Homo sapiens
gccagactccct

SEQ ID NO: 6241938 - DNA, 19 bp, Homo sapiens
gccagactggcacagtttt

SEQ ID NO: 6241939 - DNA, 20 bp, Homo sapiens
gccagactggctgcacagcc

SEQ ID NO: 6241940 - DNA, 14 bp, Homo sapiens
gccagactgtccag

SEQ ID NO: 6241941 - DNA, 16 bp, Homo sapiens
gccagactgtccaggg

SEQ ID NO: 6241942 - DNA, 21 bp, Homo sapiens
gccagacttctaaaataaatg

SEQ ID NO: 6241943 - DNA, 22 bp, Homo sapiens
gccagagaaagttggtgctgct

SEQ ID NO: 6241944 - DNA, 11 bp, Homo sapiens
gccagagaagt

SEQ ID NO: 6241945 - DNA, 19 bp, Homo sapiens
gccagagaagtctggtcag

SEQ ID NO: 6241946 - DNA, 14 bp, Homo sapiens
gccagagaagtgac

SEQ ID NO: 6241947 - DNA, 19 bp, Homo sapiens
gccagagaagtgacaggga

SEQ ID NO: 6241948 - DNA, 20 bp, Homo sapiens
gccagagaatagatcagtat

SEQ ID NO: 6241949 - DNA, 15 bp, Homo sapiens
gccagagacaaggtc

SEQ ID NO: 6241950 - DNA, 17 bp, Homo sapiens
gccagagacacaagcct

SEQ ID NO: 6241951 - DNA, 12 bp, Homo sapiens
gccagagagcag

SEQ ID NO: 6241952 - DNA, 13 bp, Homo sapiens
gccagagagcagg

SEQ ID NO: 6241953 - DNA, 21 bp, Homo sapiens
gccagagagcaggggagcttg

SEQ ID NO: 6241954 - DNA, 22 bp, Homo sapiens
gccagagagcaggggagcttgg

SEQ ID NO: 6241955 - DNA, 23 bp, Homo sapiens
gccagagagcaggggagcttggg

SEQ ID NO: 6241956 - DNA, 19 bp, Homo sapiens
gccagagaggagcacctga

SEQ ID NO: 6241957 - DNA, 23 bp, Homo sapiens
gccagagaggagcacctgaaccc

SEQ ID NO: 6241958 - DNA, 22 bp, Homo sapiens
gccagagagggaaaaggcaggt

SEQ ID NO: 6241959 - DNA, 24 bp, Homo sapiens
gccagagagggcccagctgtagcc

SEQ ID NO: 6241960 - DNA, 13 bp, Homo sapiens
gccagagatccaa

SEQ ID NO: 6241961 - DNA, 16 bp, Homo sapiens
gccagagatccaaaag

SEQ ID NO: 6241962 - DNA, 23 bp, Homo sapiens
gccagagatccaaaagaagcccc

SEQ ID NO: 6241963 - DNA, 16 bp, Homo sapiens
gccagagatgcaatat

SEQ ID NO: 6241964 - DNA, 15 bp, Homo sapiens
gccagagcacctcag

SEQ ID NO: 6241965 - DNA, 16 bp, Homo sapiens
gccagagcacctcagg

SEQ ID NO: 6241966 - DNA, 18 bp, Homo sapiens
gccagagcacctcaggac

SEQ ID NO: 6241967 - DNA, 19 bp, Homo sapiens
gccagagcacctcaggacc

SEQ ID NO: 6241968 - DNA, 15 bp, Homo sapiens
gccagagcagctcca

SEQ ID NO: 6241969 - DNA, 19 bp, Homo sapiens
gccagagcaggagcccctg

SEQ ID NO: 6241970 - DNA, 12 bp, Homo sapiens
gccagagccaaa

SEQ ID NO: 6241971 - DNA, 23 bp, Homo sapiens
gccagagccaacctggacttcct

SEQ ID NO: 6241972 - DNA, 15 bp, Homo sapiens
gccagagcccactcc

SEQ ID NO: 6241973 - DNA, 16 bp, Homo sapiens
gccagagcccactcca

SEQ ID NO: 6241974 - DNA, 23 bp, Homo sapiens
gccagagcccactccatctggta

SEQ ID NO: 6241975 - DNA, 18 bp, Homo sapiens
gccagagccccaagcagg

SEQ ID NO: 6241976 - DNA, 23 bp, Homo sapiens
gccagagcccttcactgccatga

SEQ ID NO: 6241977 - DNA, 17 bp, Homo sapiens
gccagagccgcaccctg

SEQ ID NO: 6241978 - DNA, 21 bp, Homo sapiens
gccagagccgcaccctggctg

SEQ ID NO: 6241979 - DNA, 18 bp, Homo sapiens
gccagagcctctggcccc

SEQ ID NO: 6241980 - DNA, 21 bp, Homo sapiens
gccagagcctctggcccctca

SEQ ID NO: 6241981 - DNA, 15 bp, Homo sapiens
gccagagcctggggc

SEQ ID NO: 6241982 - DNA, 19 bp, Homo sapiens
gccagagcctggggcatcc

SEQ ID NO: 6241983 - DNA, 19 bp, Homo sapiens
gccagagcctggggctcta

SEQ ID NO: 6241984 - DNA, 19 bp, Homo sapiens
gccagagctagggctgctg

SEQ ID NO: 6241985 - DNA, 20 bp, Homo sapiens
gccagagctagggctgctgc

SEQ ID NO: 6241986 - DNA, 14 bp, Homo sapiens
gccagagctcccag

SEQ ID NO: 6241987 - DNA, 11 bp, Homo sapiens
gccagagctga

SEQ ID NO: 6241988 - DNA, 17 bp, Homo sapiens
gccagagctgaagagtt

SEQ ID NO: 6241989 - DNA, 15 bp, Homo sapiens
gccagagctggaagg

SEQ ID NO: 6241990 - DNA, 21 bp, Homo sapiens
gccagagctgggtggggacag

SEQ ID NO: 6241991 - DNA, 16 bp, Homo sapiens
gccagagctgtgcctg

SEQ ID NO: 6241992 - DNA, 14 bp, Homo sapiens
gccagaggaactgt

SEQ ID NO: 6241993 - DNA, 23 bp, Homo sapiens
gccagaggaactgtccagagagc

SEQ ID NO: 6241994 - DNA, 16 bp, Homo sapiens
gccagaggaagggagg

SEQ ID NO: 6241995 - DNA, 22 bp, Homo sapiens
gccagaggaagggaggcctgag

SEQ ID NO: 6241996 - DNA, 20 bp, Homo sapiens
gccagaggaatcctggcagc

SEQ ID NO: 6241997 - DNA, 19 bp, Homo sapiens
gccagaggaatgatgggct

SEQ ID NO: 6241998 - DNA, 12 bp, Homo sapiens
gccagaggacaa

SEQ ID NO: 6241999 - DNA, 13 bp, Homo sapiens
gccagaggacaag

SEQ ID NO: 6242000 - DNA, 22 bp, Homo sapiens
gccagaggagagctgctgggcc

SEQ ID NO: 6242001 - DNA, 16 bp, Homo sapiens
gccagaggagggcaga

SEQ ID NO: 6242002 - DNA, 13 bp, Homo sapiens
gccagaggcacct

SEQ ID NO: 6242003 - DNA, 11 bp, Homo sapiens
gccagaggcag

SEQ ID NO: 6242004 - DNA, 13 bp, Homo sapiens
gccagaggccaga

SEQ ID NO: 6242005 - DNA, 14 bp, Homo sapiens
gccagaggccagga

SEQ ID NO: 6242006 - DNA, 16 bp, Homo sapiens
gccagaggccaggatg

SEQ ID NO: 6242007 - DNA, 20 bp, Homo sapiens
gccagaggccaggatgcctg

SEQ ID NO: 6242008 - DNA, 18 bp, Homo sapiens
gccagaggcccccagccc

SEQ ID NO: 6242009 - DNA, 20 bp, Homo sapiens
gccagaggcccccagcccag

SEQ ID NO: 6242010 - DNA, 13 bp, Homo sapiens
gccagaggccctg

SEQ ID NO: 6242011 - DNA, 18 bp, Homo sapiens
gccagaggccctggaggg

SEQ ID NO: 6242012 - DNA, 21 bp, Homo sapiens
gccagaggcctggtgccctgg

SEQ ID NO: 6242013 - DNA, 13 bp, Homo sapiens
gccagaggctgga

SEQ ID NO: 6242014 - DNA, 16 bp, Homo sapiens
gccagaggctgggagt

SEQ ID NO: 6242015 - DNA, 18 bp, Homo sapiens
gccagagggagtgacaga

SEQ ID NO: 6242016 - DNA, 19 bp, Homo sapiens
gccagagggagtgacagag

SEQ ID NO: 6242017 - DNA, 21 bp, Homo sapiens
gccagagggagtgacagaggc

SEQ ID NO: 6242018 - DNA, 18 bp, Homo sapiens
gccagagggccagcaggc

SEQ ID NO: 6242019 - DNA, 20 bp, Homo sapiens
gccagagggccagcaggctc

SEQ ID NO: 6242020 - DNA, 16 bp, Homo sapiens
gccagagggcccctca

SEQ ID NO: 6242021 - DNA, 15 bp, Homo sapiens
gccagagggcttgtg

SEQ ID NO: 6242022 - DNA, 13 bp, Homo sapiens
gccagaggtgctt

SEQ ID NO: 6242023 - DNA, 21 bp, Homo sapiens
gccagagtcaacaaattaaat

SEQ ID NO: 6242024 - DNA, 13 bp, Homo sapiens
gccagagtcacct

SEQ ID NO: 6242025 - DNA, 19 bp, Homo sapiens
gccagagtcaccttttctg

SEQ ID NO: 6242026 - DNA, 16 bp, Homo sapiens
gccagagtggccacgg

SEQ ID NO: 6242027 - DNA, 18 bp, Homo sapiens
gccagagtggcctggcca

SEQ ID NO: 6242028 - DNA, 19 bp, Homo sapiens
gccagagtggcctggccag

SEQ ID NO: 6242029 - DNA, 22 bp, Homo sapiens
gccagagtggcctggccaggag

SEQ ID NO: 6242030 - DNA, 23 bp, Homo sapiens
gccagagtggcctggccaggagc

SEQ ID NO: 6242031 - DNA, 13 bp, Homo sapiens
gccagagtgtcct

SEQ ID NO: 6242032 - DNA, 15 bp, Homo sapiens
gccagagtgtcctgc

SEQ ID NO: 6242033 - DNA, 16 bp, Homo sapiens
gccagagtgtcctgct

SEQ ID NO: 6242034 - DNA, 21 bp, Homo sapiens
gccagagttattagtgccaag

SEQ ID NO: 6242035 - DNA, 24 bp, Homo sapiens
gccagagttcctgcggagtgaaga

SEQ ID NO: 6242036 - DNA, 16 bp, Homo sapiens
gccagagttgttctca

SEQ ID NO: 6242037 - DNA, 17 bp, Homo sapiens
gccagagtttgcctccc

SEQ ID NO: 6242038 - DNA, 15 bp, Homo sapiens
gccagagtttttaaa

SEQ ID NO: 6242039 - DNA, 20 bp, Homo sapiens
gccagagtttttaaagcctt

SEQ ID NO: 6242040 - DNA, 16 bp, Homo sapiens
gccagataaaatgttc

SEQ ID NO: 6242041 - DNA, 13 bp, Homo sapiens
gccagatccaccc

SEQ ID NO: 6242042 - DNA, 20 bp, Homo sapiens
gccagatccagcctggggtc

SEQ ID NO: 6242043 - DNA, 17 bp, Homo sapiens
gccagatccccagggca

SEQ ID NO: 6242044 - DNA, 13 bp, Homo sapiens
gccagatctgtta

SEQ ID NO: 6242045 - DNA, 16 bp, Homo sapiens
gccagatgatcaactc

SEQ ID NO: 6242046 - DNA, 21 bp, Homo sapiens
gccagatgcacatccctggaa

SEQ ID NO: 6242047 - DNA, 14 bp, Homo sapiens
gccagatgcaccag

SEQ ID NO: 6242048 - DNA, 16 bp, Homo sapiens
gccagatgcaccagcc

SEQ ID NO: 6242049 - DNA, 17 bp, Homo sapiens
gccagatgcaccagccc

SEQ ID NO: 6242050 - DNA, 18 bp, Homo sapiens
gccagatgcaggacagga

SEQ ID NO: 6242051 - DNA, 21 bp, Homo sapiens
gccagatgcaggacaggaggc

SEQ ID NO: 6242052 - DNA, 20 bp, Homo sapiens
gccagatgcctccccaagac

SEQ ID NO: 6242053 - DNA, 17 bp, Homo sapiens
gccagatgctagagcct

SEQ ID NO: 6242054 - DNA, 11 bp, Homo sapiens
gccagatgctg

SEQ ID NO: 6242055 - DNA, 12 bp, Homo sapiens
gccagatgctga

SEQ ID NO: 6242056 - DNA, 15 bp, Homo sapiens
gccagatgctgatgt

SEQ ID NO: 6242057 - DNA, 17 bp, Homo sapiens
gccagatgctgatgttc

SEQ ID NO: 6242058 - DNA, 20 bp, Homo sapiens
gccagatgctgatgttcagt

SEQ ID NO: 6242059 - DNA, 24 bp, Homo sapiens
gccagatgctgatgttcagtgtaa

SEQ ID NO: 6242060 - DNA, 12 bp, Homo sapiens
gccagatgctgc

SEQ ID NO: 6242061 - DNA, 15 bp, Homo sapiens
gccagatgctgcaga

SEQ ID NO: 6242062 - DNA, 17 bp, Homo sapiens
gccagatgctgggcagg

SEQ ID NO: 6242063 - DNA, 22 bp, Homo sapiens
gccagatggactccagcctgcc

SEQ ID NO: 6242064 - DNA, 15 bp, Homo sapiens
gccagatggcccgga

SEQ ID NO: 6242065 - DNA, 19 bp, Homo sapiens
gccagatgtcgctgggtcc

SEQ ID NO: 6242066 - DNA, 17 bp, Homo sapiens
gccagatgtgggctcag

SEQ ID NO: 6242067 - DNA, 20 bp, Homo sapiens
gccagatgtgggctcagatc

SEQ ID NO: 6242068 - DNA, 22 bp, Homo sapiens
gccagatgtgggctcagatcct

SEQ ID NO: 6242069 - DNA, 18 bp, Homo sapiens
gccagatgttgttcctgg

SEQ ID NO: 6242070 - DNA, 18 bp, Homo sapiens
gccagattctgcctctct

SEQ ID NO: 6242071 - DNA, 19 bp, Homo sapiens
gccagattctgcctctctg

SEQ ID NO: 6242072 - DNA, 20 bp, Homo sapiens
gccagattctgcctctctgg

SEQ ID NO: 6242073 - DNA, 17 bp, Homo sapiens
gccagattctttcctga

SEQ ID NO: 6242074 - DNA, 19 bp, Homo sapiens
gccagattctttcctgagg

SEQ ID NO: 6242075 - DNA, 16 bp, Homo sapiens
gagcctggtgctgctg

SEQ ID NO: 6242076 - DNA, 18 bp, Homo sapiens
gagcctgtcaccagagct

SEQ ID NO: 6242077 - DNA, 11 bp, Homo sapiens
gagcctgtcca

SEQ ID NO: 6242078 - DNA, 12 bp, Homo sapiens
gagcctgtccaa

SEQ ID NO: 6242079 - DNA, 22 bp, Homo sapiens
gagcctgtccaatttctgctgt

SEQ ID NO: 6242080 - DNA, 12 bp, Homo sapiens
gagcctgtcctg

SEQ ID NO: 6242081 - DNA, 11 bp, Homo sapiens
gagcctgtctc

SEQ ID NO: 6242082 - DNA, 16 bp, Homo sapiens
gagcctgtgaacccag

SEQ ID NO: 6242083 - DNA, 20 bp, Homo sapiens
gagcctgtgaacccaggaca

SEQ ID NO: 6242084 - DNA, 23 bp, Homo sapiens
gagcctgtgacataccccctccc

SEQ ID NO: 6242085 - DNA, 16 bp, Homo sapiens
gagcctgtgaccttgg

SEQ ID NO: 6242086 - DNA, 12 bp, Homo sapiens
gagcctgtgcag

SEQ ID NO: 6242087 - DNA, 14 bp, Homo sapiens
gagcctgtgcagcc

SEQ ID NO: 6242088 - DNA, 15 bp, Homo sapiens
gagcctgtggccagc

SEQ ID NO: 6242089 - DNA, 18 bp, Homo sapiens
gagcctgtggccagcagc

SEQ ID NO: 6242090 - DNA, 14 bp, Homo sapiens
gagcctgtgtaaca

SEQ ID NO: 6242091 - DNA, 15 bp, Homo sapiens
gagcctgtgtcctga

SEQ ID NO: 6242092 - DNA, 18 bp, Homo sapiens
gagcctgtgtcctgaaga

SEQ ID NO: 6242093 - DNA, 23 bp, Homo sapiens
gagccttaacttcttaaaccatt

SEQ ID NO: 6242094 - DNA, 17 bp, Homo sapiens
gagccttagcagccctg

SEQ ID NO: 6242095 - DNA, 11 bp, Homo sapiens
gagccttagct

SEQ ID NO: 6242096 - DNA, 13 bp, Homo sapiens
gagccttcaagtg

SEQ ID NO: 6242097 - DNA, 17 bp, Homo sapiens
gagccttcaagtgccaa

SEQ ID NO: 6242098 - DNA, 21 bp, Homo sapiens
gagccttcaattgtagatgaa

SEQ ID NO: 6242099 - DNA, 20 bp, Homo sapiens
gagccttcacaaccagccac

SEQ ID NO: 6242100 - DNA, 17 bp, Homo sapiens
gagccttcagccttaat

SEQ ID NO: 6242101 - DNA, 15 bp, Homo sapiens
gagccttcagtcagg

SEQ ID NO: 6242102 - DNA, 13 bp, Homo sapiens
gagccttccaccg

SEQ ID NO: 6242103 - DNA, 19 bp, Homo sapiens
gagccttccaccggcactc

SEQ ID NO: 6242104 - DNA, 21 bp, Homo sapiens
gagccttccaccggcactcat

SEQ ID NO: 6242105 - DNA, 14 bp, Homo sapiens
gagccttccagggg

SEQ ID NO: 6242106 - DNA, 23 bp, Homo sapiens
gagccttccaggggtgggacacc

SEQ ID NO: 6242107 - DNA, 20 bp, Homo sapiens
gagccttcctttctcctgcc

SEQ ID NO: 6242108 - DNA, 23 bp, Homo sapiens
gagccttctgccaccagcccctc

SEQ ID NO: 6242109 - DNA, 19 bp, Homo sapiens
gagccttgaactttgacct

SEQ ID NO: 6242110 - DNA, 22 bp, Homo sapiens
gagccttgaactttgacctctg

SEQ ID NO: 6242111 - DNA, 22 bp, Homo sapiens
gagccttgacaatgttgtcctc

SEQ ID NO: 6242112 - DNA, 13 bp, Homo sapiens
gagccttgctgcc

SEQ ID NO: 6242113 - DNA, 16 bp, Homo sapiens
gagccttgctgccaag

SEQ ID NO: 6242114 - DNA, 14 bp, Homo sapiens
gagccttgctgggc

SEQ ID NO: 6242115 - DNA, 15 bp, Homo sapiens
gagccttggaggaca

SEQ ID NO: 6242116 - DNA, 13 bp, Homo sapiens
gagccttggcgag

SEQ ID NO: 6242117 - DNA, 17 bp, Homo sapiens
gagccttgggagccact

SEQ ID NO: 6242118 - DNA, 22 bp, Homo sapiens
gagccttgggagccactgccac

SEQ ID NO: 6242119 - DNA, 23 bp, Homo sapiens
gagccttgtcagtgtgtcagttt

SEQ ID NO: 6242120 - DNA, 21 bp, Homo sapiens
gagcctttctccagcccatgc

SEQ ID NO: 6242121 - DNA, 17 bp, Homo sapiens
gagcctttggggggcca

SEQ ID NO: 6242122 - DNA, 18 bp, Homo sapiens
gagcctttggggggccac

SEQ ID NO: 6242123 - DNA, 18 bp, Homo sapiens
gagcctttggttctggcc

SEQ ID NO: 6242124 - DNA, 13 bp, Homo sapiens
gagcgaaactccg

SEQ ID NO: 6242125 - DNA, 21 bp, Homo sapiens
gagcgaagccttctgcagcag

SEQ ID NO: 6242126 - DNA, 13 bp, Homo sapiens
gagcgacacagac

SEQ ID NO: 6242127 - DNA, 15 bp, Homo sapiens
gagcgacagagcagt

SEQ ID NO: 6242128 - DNA, 15 bp, Homo sapiens
gagcgacagtgagac

SEQ ID NO: 6242129 - DNA, 14 bp, Homo sapiens
gagcgaccagcagg

SEQ ID NO: 6242130 - DNA, 17 bp, Homo sapiens
gagcgaccagcaggctc

SEQ ID NO: 6242131 - DNA, 20 bp, Homo sapiens
gagcgaccctggctctgcca

SEQ ID NO: 6242132 - DNA, 16 bp, Homo sapiens
gagcgacggctcctcc

SEQ ID NO: 6242133 - DNA, 17 bp, Homo sapiens
gagcgacggctcctccc

SEQ ID NO: 6242134 - DNA, 22 bp, Homo sapiens
gagcgacggctcctccccgatc

SEQ ID NO: 6242135 - DNA, 19 bp, Homo sapiens
gagcgagaaccaggctgct

SEQ ID NO: 6242136 - DNA, 20 bp, Homo sapiens
gagcgagagatcaaagatga

SEQ ID NO: 6242137 - DNA, 23 bp, Homo sapiens
gagcgagagggaggcaggtggac

SEQ ID NO: 6242138 - DNA, 17 bp, Homo sapiens
gagcgagcctggcaggt

SEQ ID NO: 6242139 - DNA, 15 bp, Homo sapiens
gagcgaggaaaggat

SEQ ID NO: 6242140 - DNA, 13 bp, Homo sapiens
gagcgaggaggcg

SEQ ID NO: 6242141 - DNA, 23 bp, Homo sapiens
gagcgagtggagtctgccaccca

SEQ ID NO: 6242142 - DNA, 21 bp, Homo sapiens
gagcgagtggatgctgtgcta

SEQ ID NO: 6242143 - DNA, 15 bp, Homo sapiens
gagcgatccagggga

SEQ ID NO: 6242144 - DNA, 19 bp, Homo sapiens
gagcgcaagccacagcctg

SEQ ID NO: 6242145 - DNA, 22 bp, Homo sapiens
gagcgcaagccacagcctgtct

SEQ ID NO: 6242146 - DNA, 12 bp, Homo sapiens
gagcgcagcccg

SEQ ID NO: 6242147 - DNA, 19 bp, Homo sapiens
gagcgcagcgcctccaccc

SEQ ID NO: 6242148 - DNA, 13 bp, Homo sapiens
gagcgcagctgca

SEQ ID NO: 6242149 - DNA, 14 bp, Homo sapiens
gagcgcagctgcat

SEQ ID NO: 6242150 - DNA, 22 bp, Homo sapiens
gagcgcaggcagcgcagggctg

SEQ ID NO: 6242151 - DNA, 15 bp, Homo sapiens
gagcgcatggcaagt

SEQ ID NO: 6242152 - DNA, 14 bp, Homo sapiens
gagcgccaggaagc

SEQ ID NO: 6242153 - DNA, 15 bp, Homo sapiens
gagcgccaggaagcc

SEQ ID NO: 6242154 - DNA, 17 bp, Homo sapiens
gagcgccaggaagccag

SEQ ID NO: 6242155 - DNA, 21 bp, Homo sapiens
gagcgccaggaagccagagcc

SEQ ID NO: 6242156 - DNA, 21 bp, Homo sapiens
gagcgcccactagacccactg

SEQ ID NO: 6242157 - DNA, 19 bp, Homo sapiens
gagcgcccccgagccctga

SEQ ID NO: 6242158 - DNA, 23 bp, Homo sapiens
gagcgcccccgagccctgactcc

SEQ ID NO: 6242159 - DNA, 21 bp, Homo sapiens
gagcgcccgccgtctgctccg

SEQ ID NO: 6242160 - DNA, 17 bp, Homo sapiens
gagcgcccgcgcccgcg

SEQ ID NO: 6242161 - DNA, 16 bp, Homo sapiens
gagcgccctgcagacc

SEQ ID NO: 6242162 - DNA, 19 bp, Homo sapiens
gagcgccctgcagaccctg

SEQ ID NO: 6242163 - DNA, 17 bp, Homo sapiens
gagcgccctgcagggcc

SEQ ID NO: 6242164 - DNA, 23 bp, Homo sapiens
gagcgcctcttcctctgggcagc

SEQ ID NO: 6242165 - DNA, 13 bp, Homo sapiens
gagcgcctgcccc

SEQ ID NO: 6242166 - DNA, 18 bp, Homo sapiens
gagcgcctgcccctccca

SEQ ID NO: 6242167 - DNA, 20 bp, Homo sapiens
gagcgcctgcgttcccagac

SEQ ID NO: 6242168 - DNA, 13 bp, Homo sapiens
gagcgcgggagag

SEQ ID NO: 6242169 - DNA, 16 bp, Homo sapiens
gagcgcgtgccttccc

SEQ ID NO: 6242170 - DNA, 21 bp, Homo sapiens
gagcgcttctgcagcctcggc

SEQ ID NO: 6242171 - DNA, 15 bp, Homo sapiens
gagcggaaagcagct

SEQ ID NO: 6242172 - DNA, 14 bp, Homo sapiens
gagcggaggctcgg

SEQ ID NO: 6242173 - DNA, 16 bp, Homo sapiens
gagcggattgcaaagc

SEQ ID NO: 6242174 - DNA, 15 bp, Homo sapiens
gagcggcaccctggt

SEQ ID NO: 6242175 - DNA, 18 bp, Homo sapiens
gagcggccgcagagactg

SEQ ID NO: 6242176 - DNA, 18 bp, Homo sapiens
gagcggccgcctgtcctt

SEQ ID NO: 6242177 - DNA, 15 bp, Homo sapiens
gagcggcgccctgga

SEQ ID NO: 6242178 - DNA, 13 bp, Homo sapiens
gagcggctggaga

SEQ ID NO: 6242179 - DNA, 14 bp, Homo sapiens
gagcggctggagaa

SEQ ID NO: 6242180 - DNA, 12 bp, Homo sapiens
gagcgggaggca

SEQ ID NO: 6242181 - DNA, 14 bp, Homo sapiens
gagcgggaggcaga

SEQ ID NO: 6242182 - DNA, 16 bp, Homo sapiens
gagcgggaggcagagt

SEQ ID NO: 6242183 - DNA, 17 bp, Homo sapiens
gagcgggaggcagcgcc

SEQ ID NO: 6242184 - DNA, 14 bp, Homo sapiens
gagcgggagggagt

SEQ ID NO: 6242185 - DNA, 19 bp, Homo sapiens
gagcgggcccgccaccctt

SEQ ID NO: 6242186 - DNA, 21 bp, Homo sapiens
gagcgggctcgaagaaaataa

SEQ ID NO: 6242187 - DNA, 16 bp, Homo sapiens
gagcggggaggtgcct

SEQ ID NO: 6242188 - DNA, 18 bp, Homo sapiens
gagcggggctgggaggaa

SEQ ID NO: 6242189 - DNA, 20 bp, Homo sapiens
gagcggggctgggaggaagg

SEQ ID NO: 6242190 - DNA, 20 bp, Homo sapiens
gagcgggggctaactggccc

SEQ ID NO: 6242191 - DNA, 21 bp, Homo sapiens
gagcgggggctaactggcccc

SEQ ID NO: 6242192 - DNA, 18 bp, Homo sapiens
gagcggggtcccctctgt

SEQ ID NO: 6242193 - DNA, 17 bp, Homo sapiens
gagcgggtctgctccca

SEQ ID NO: 6242194 - DNA, 22 bp, Homo sapiens
gagcggtctcaggctggtggga

SEQ ID NO: 6242195 - DNA, 13 bp, Homo sapiens
gagcggtggcccc

SEQ ID NO: 6242196 - DNA, 14 bp, Homo sapiens
gagcggtggccctg

SEQ ID NO: 6242197 - DNA, 20 bp, Homo sapiens
gagcgtacgatggaggccta

SEQ ID NO: 6242198 - DNA, 18 bp, Homo sapiens
gagcgtcaaagaaaatgc

SEQ ID NO: 6242199 - DNA, 18 bp, Homo sapiens
gagcgtcactgcccacca

SEQ ID NO: 6242200 - DNA, 13 bp, Homo sapiens
gagcgtgaaggac

SEQ ID NO: 6242201 - DNA, 19 bp, Homo sapiens
gagcgtgagctgagcaggc

SEQ ID NO: 6242202 - DNA, 13 bp, Homo sapiens
gagcgtgcgcact

SEQ ID NO: 6242203 - DNA, 21 bp, Homo sapiens
gagcgtgcgcactgcatggga

SEQ ID NO: 6242204 - DNA, 14 bp, Homo sapiens
gagcgtgcgtctgt

SEQ ID NO: 6242205 - DNA, 20 bp, Homo sapiens
gagcgtgctccagcctggct

SEQ ID NO: 6242206 - DNA, 21 bp, Homo sapiens
gagcgtgctccagcctggctc

SEQ ID NO: 6242207 - DNA, 19 bp, Homo sapiens
gagcgtggaagggggagga

SEQ ID NO: 6242208 - DNA, 20 bp, Homo sapiens
gagcgtggaagggggaggag

SEQ ID NO: 6242209 - DNA, 12 bp, Homo sapiens
gagcgtggactc

SEQ ID NO: 6242210 - DNA, 14 bp, Homo sapiens
gagcgtgggctcag

SEQ ID NO: 6242211 - DNA, 18 bp, Homo sapiens
gagcgtgtactaccccag

SEQ ID NO: 6242212 - DNA, 21 bp, Homo sapiens
gagcgtgtagcgtcctgagga

SEQ ID NO: 6242213 - DNA, 22 bp, Homo sapiens
gagcgtgtagcgtcctgaggaa

SEQ ID NO: 6242214 - DNA, 12 bp, Homo sapiens
gagcgtgtccta

SEQ ID NO: 6242215 - DNA, 16 bp, Homo sapiens
gagcgttactgtagac

SEQ ID NO: 6242216 - DNA, 16 bp, Homo sapiens
gagcgttcccagcagg

SEQ ID NO: 6242217 - DNA, 15 bp, Homo sapiens
gagcgtttaaagtac

SEQ ID NO: 6242218 - DNA, 16 bp, Homo sapiens
gagcgtttaaagtact

SEQ ID NO: 6242219 - DNA, 19 bp, Homo sapiens
gagcgtttaaagtactgag

SEQ ID NO: 6242220 - DNA, 15 bp, Homo sapiens
gagcgtttgctgtgc

SEQ ID NO: 6242221 - DNA, 20 bp, Homo sapiens
gagctaaactccttcctggc

SEQ ID NO: 6242222 - DNA, 19 bp, Homo sapiens
gagctaacactggccccta

SEQ ID NO: 6242223 - DNA, 18 bp, Homo sapiens
gagctaaggaagacacag

SEQ ID NO: 6242224 - DNA, 13 bp, Homo sapiens
gagctaaggccag

SEQ ID NO: 6242225 - DNA, 14 bp, Homo sapiens
gagctaaggctcta

SEQ ID NO: 6242226 - DNA, 18 bp, Homo sapiens
gagctaagggtgggtgct

SEQ ID NO: 6242227 - DNA, 22 bp, Homo sapiens
gagctaagggtgggtgctcaga

SEQ ID NO: 6242228 - DNA, 15 bp, Homo sapiens
gagctaagtcaccca

SEQ ID NO: 6242229 - DNA, 16 bp, Homo sapiens
gagctaagtcacccag

SEQ ID NO: 6242230 - DNA, 14 bp, Homo sapiens
gagctacaaagcat

SEQ ID NO: 6242231 - DNA, 15 bp, Homo sapiens
gagctacagccagcg

SEQ ID NO: 6242232 - DNA, 15 bp, Homo sapiens
gagctacataattta

SEQ ID NO: 6242233 - DNA, 14 bp, Homo sapiens
gagctacctgtgtg

SEQ ID NO: 6242234 - DNA, 22 bp, Homo sapiens
gagctacctgtgtggacaggac

SEQ ID NO: 6242235 - DNA, 14 bp, Homo sapiens
gagctactgagaac

SEQ ID NO: 6242236 - DNA, 19 bp, Homo sapiens
gagctagaaaaataaaatg

SEQ ID NO: 6242237 - DNA, 19 bp, Homo sapiens
gagctagaacctggagagc

SEQ ID NO: 6242238 - DNA, 18 bp, Homo sapiens
gagctagagaggggcctc

SEQ ID NO: 6242239 - DNA, 19 bp, Homo sapiens
gagctagcagaagacaagg

SEQ ID NO: 6242240 - DNA, 23 bp, Homo sapiens
gagctagcagaagacaaggcatg

SEQ ID NO: 6242241 - DNA, 15 bp, Homo sapiens
gagctagcagcaggg

SEQ ID NO: 6242242 - DNA, 23 bp, Homo sapiens
gagctagcgctgccgcaccccag

SEQ ID NO: 6242243 - DNA, 20 bp, Homo sapiens
gagctagctagcgcaccgcc

SEQ ID NO: 6242244 - DNA, 19 bp, Homo sapiens
gagctaggaaccctggagg

SEQ ID NO: 6242245 - DNA, 20 bp, Homo sapiens
gagctaggcatggtggcaca

SEQ ID NO: 6242246 - DNA, 22 bp, Homo sapiens
gagctagggctgctgcttctgc

SEQ ID NO: 6242247 - DNA, 13 bp, Homo sapiens
gagctagggtccc

SEQ ID NO: 6242248 - DNA, 20 bp, Homo sapiens
gagctagttggttgaatttt

SEQ ID NO: 6242249 - DNA, 13 bp, Homo sapiens
gagctataacatt

SEQ ID NO: 6242250 - DNA, 16 bp, Homo sapiens
gagctatagtgaagaa

SEQ ID NO: 6242251 - DNA, 13 bp, Homo sapiens
gagctatgactta

SEQ ID NO: 6242252 - DNA, 20 bp, Homo sapiens
gagctatgattatgccactg

SEQ ID NO: 6242253 - DNA, 23 bp, Homo sapiens
gagctatgatttttttttccaaa

SEQ ID NO: 6242254 - DNA, 20 bp, Homo sapiens
gccagattctttcctgaggc

SEQ ID NO: 6242255 - DNA, 16 bp, Homo sapiens
gccagatttcactctc

SEQ ID NO: 6242256 - DNA, 16 bp, Homo sapiens
gccagatttgtctttt

SEQ ID NO: 6242257 - DNA, 23 bp, Homo sapiens
gccagattttttaaaatttatat

SEQ ID NO: 6242258 - DNA, 18 bp, Homo sapiens
gccagcaaaccaggactc

SEQ ID NO: 6242259 - DNA, 14 bp, Homo sapiens
gccagcaaagcccc

SEQ ID NO: 6242260 - DNA, 23 bp, Homo sapiens
gccagcaaagccccatgctggag

SEQ ID NO: 6242261 - DNA, 16 bp, Homo sapiens
gccagcaaagcctcca

SEQ ID NO: 6242262 - DNA, 19 bp, Homo sapiens
gccagcaaagcctccagca

SEQ ID NO: 6242263 - DNA, 16 bp, Homo sapiens
gccagcaaataaatac

SEQ ID NO: 6242264 - DNA, 17 bp, Homo sapiens
gccagcaacacagagca

SEQ ID NO: 6242265 - DNA, 15 bp, Homo sapiens
gccagcaacattggc

SEQ ID NO: 6242266 - DNA, 14 bp, Homo sapiens
gccagcaaggcagg

SEQ ID NO: 6242267 - DNA, 22 bp, Homo sapiens
gccagcaataaaaactgtctgt

SEQ ID NO: 6242268 - DNA, 13 bp, Homo sapiens
gccagcaatgaca

SEQ ID NO: 6242269 - DNA, 22 bp, Homo sapiens
gccagcacacagggcagtgagg

SEQ ID NO: 6242270 - DNA, 15 bp, Homo sapiens
gccagcacaggggcc

SEQ ID NO: 6242271 - DNA, 21 bp, Homo sapiens
gccagcacagtaggtcccggc

SEQ ID NO: 6242272 - DNA, 12 bp, Homo sapiens
gccagcaccaag

SEQ ID NO: 6242273 - DNA, 14 bp, Homo sapiens
gccagcaccacagc

SEQ ID NO: 6242274 - DNA, 16 bp, Homo sapiens
gccagcaccacagccg

SEQ ID NO: 6242275 - DNA, 13 bp, Homo sapiens
gccagcaccacct

SEQ ID NO: 6242276 - DNA, 20 bp, Homo sapiens
gccagcaccacctacacagg

SEQ ID NO: 6242277 - DNA, 22 bp, Homo sapiens
gccagcacccacctggtactga

SEQ ID NO: 6242278 - DNA, 15 bp, Homo sapiens
gccagcaccctctcc

SEQ ID NO: 6242279 - DNA, 17 bp, Homo sapiens
gccagcaccctctcctg

SEQ ID NO: 6242280 - DNA, 18 bp, Homo sapiens
gccagcaccctctcctgg

SEQ ID NO: 6242281 - DNA, 19 bp, Homo sapiens
gccagcaccctctcctggg

SEQ ID NO: 6242282 - DNA, 21 bp, Homo sapiens
gccagcaccctctcctggggg

SEQ ID NO: 6242283 - DNA, 14 bp, Homo sapiens
gccagcacgcctgg

SEQ ID NO: 6242284 - DNA, 20 bp, Homo sapiens
gccagcactagtaaaggagg

SEQ ID NO: 6242285 - DNA, 23 bp, Homo sapiens
gccagcactcgctagcagtggca

SEQ ID NO: 6242286 - DNA, 21 bp, Homo sapiens
gccagcactggaggggcccac

SEQ ID NO: 6242287 - DNA, 21 bp, Homo sapiens
gccagcagaacatgtgggagg

SEQ ID NO: 6242288 - DNA, 22 bp, Homo sapiens
gccagcagaagcagggtaccct

SEQ ID NO: 6242289 - DNA, 13 bp, Homo sapiens
gccagcagacatt

SEQ ID NO: 6242290 - DNA, 16 bp, Homo sapiens
gccagcagacattgtc

SEQ ID NO: 6242291 - DNA, 17 bp, Homo sapiens
gccagcagacattgtca

SEQ ID NO: 6242292 - DNA, 11 bp, Homo sapiens
gccagcagagc

SEQ ID NO: 6242293 - DNA, 14 bp, Homo sapiens
gccagcagagccag

SEQ ID NO: 6242294 - DNA, 18 bp, Homo sapiens
gccagcagaggtcagagg

SEQ ID NO: 6242295 - DNA, 12 bp, Homo sapiens
gccagcagcaga

SEQ ID NO: 6242296 - DNA, 17 bp, Homo sapiens
gccagcagcaggatggg

SEQ ID NO: 6242297 - DNA, 12 bp, Homo sapiens
gccagcagccag

SEQ ID NO: 6242298 - DNA, 21 bp, Homo sapiens
gccagcagccagctctcagcc

SEQ ID NO: 6242299 - DNA, 23 bp, Homo sapiens
gccagcagccagctctcagccaa

SEQ ID NO: 6242300 - DNA, 22 bp, Homo sapiens
gccagcagccccgtctgcccac

SEQ ID NO: 6242301 - DNA, 15 bp, Homo sapiens
gccagcagcctcgca

SEQ ID NO: 6242302 - DNA, 23 bp, Homo sapiens
gccagcagcctcgcacaggccct

SEQ ID NO: 6242303 - DNA, 20 bp, Homo sapiens
gccagcagcctctgatctgt

SEQ ID NO: 6242304 - DNA, 12 bp, Homo sapiens
gccagcagctga

SEQ ID NO: 6242305 - DNA, 17 bp, Homo sapiens
gccagcagctgatgctg

SEQ ID NO: 6242306 - DNA, 22 bp, Homo sapiens
gccagcagctgatgctgtacta

SEQ ID NO: 6242307 - DNA, 19 bp, Homo sapiens
gccagcagctgtcagaaca

SEQ ID NO: 6242308 - DNA, 12 bp, Homo sapiens
gccagcaggaat

SEQ ID NO: 6242309 - DNA, 14 bp, Homo sapiens
gccagcaggaataa

SEQ ID NO: 6242310 - DNA, 17 bp, Homo sapiens
gccagcaggaataaaga

SEQ ID NO: 6242311 - DNA, 19 bp, Homo sapiens
gccagcaggaataaagact

SEQ ID NO: 6242312 - DNA, 20 bp, Homo sapiens
gccagcaggaataaagactt

SEQ ID NO: 6242313 - DNA, 17 bp, Homo sapiens
gccagcaggcagcgcct

SEQ ID NO: 6242314 - DNA, 15 bp, Homo sapiens
gccagcaggcgggct

SEQ ID NO: 6242315 - DNA, 19 bp, Homo sapiens
gccagcaggcgggctcctt

SEQ ID NO: 6242316 - DNA, 14 bp, Homo sapiens
gccagcaggctcct

SEQ ID NO: 6242317 - DNA, 22 bp, Homo sapiens
gccagcaggctcctggctgtgc

SEQ ID NO: 6242318 - DNA, 17 bp, Homo sapiens
gccagcaggctctcagg

SEQ ID NO: 6242319 - DNA, 20 bp, Homo sapiens
gccagcaggctctcaggcca

SEQ ID NO: 6242320 - DNA, 23 bp, Homo sapiens
gccagcaggctctcaggccagct

SEQ ID NO: 6242321 - DNA, 21 bp, Homo sapiens
gccagcagggcgggccaggag

SEQ ID NO: 6242322 - DNA, 22 bp, Homo sapiens
gccagcagggcgggccaggaga

SEQ ID NO: 6242323 - DNA, 17 bp, Homo sapiens
gccagcagggctgtgat

SEQ ID NO: 6242324 - DNA, 18 bp, Homo sapiens
gccagcaggttctctcct

SEQ ID NO: 6242325 - DNA, 22 bp, Homo sapiens
gccagcaggttctctcctgtga

SEQ ID NO: 6242326 - DNA, 23 bp, Homo sapiens
gccagcaggttctctcctgtgag

SEQ ID NO: 6242327 - DNA, 19 bp, Homo sapiens
gccagcagttactgtgaat

SEQ ID NO: 6242328 - DNA, 14 bp, Homo sapiens
gccagcagttcaga

SEQ ID NO: 6242329 - DNA, 15 bp, Homo sapiens
gccagcatagggggg

SEQ ID NO: 6242330 - DNA, 15 bp, Homo sapiens
gccagcatctgggcc

SEQ ID NO: 6242331 - DNA, 20 bp, Homo sapiens
gccagcattccagacttcaa

SEQ ID NO: 6242332 - DNA, 17 bp, Homo sapiens
gccagcatttcctcagt

SEQ ID NO: 6242333 - DNA, 21 bp, Homo sapiens
gccagcattttcacattttgc

SEQ ID NO: 6242334 - DNA, 19 bp, Homo sapiens
gccagccaagctctgcagt

SEQ ID NO: 6242335 - DNA, 21 bp, Homo sapiens
gccagccaagctctgcagtcc

SEQ ID NO: 6242336 - DNA, 19 bp, Homo sapiens
gccagccaatttcccggag

SEQ ID NO: 6242337 - DNA, 13 bp, Homo sapiens
gccagccacacca

SEQ ID NO: 6242338 - DNA, 21 bp, Homo sapiens
gccagccacagacccctggga

SEQ ID NO: 6242339 - DNA, 14 bp, Homo sapiens
gccagccacaggac

SEQ ID NO: 6242340 - DNA, 15 bp, Homo sapiens
gccagccacaggacc

SEQ ID NO: 6242341 - DNA, 17 bp, Homo sapiens
gccagccacccctgcca

SEQ ID NO: 6242342 - DNA, 23 bp, Homo sapiens
gccagccaccctaactgagctgc

SEQ ID NO: 6242343 - DNA, 16 bp, Homo sapiens
gccagccagccactct

SEQ ID NO: 6242344 - DNA, 15 bp, Homo sapiens
gccagccaggccctg

SEQ ID NO: 6242345 - DNA, 22 bp, Homo sapiens
gccagccagtcttgcctaggcc

SEQ ID NO: 6242346 - DNA, 22 bp, Homo sapiens
gccagccagtgacctgaggaag

SEQ ID NO: 6242347 - DNA, 17 bp, Homo sapiens
gccagccatcacaaggg

SEQ ID NO: 6242348 - DNA, 13 bp, Homo sapiens
gccagccatgtct

SEQ ID NO: 6242349 - DNA, 22 bp, Homo sapiens
gccagccatttttcagtagcag

SEQ ID NO: 6242350 - DNA, 19 bp, Homo sapiens
gccagcccaaaccttgggc

SEQ ID NO: 6242351 - DNA, 13 bp, Homo sapiens
gccagcccaaagc

SEQ ID NO: 6242352 - DNA, 17 bp, Homo sapiens
gccagcccaaagctgga

SEQ ID NO: 6242353 - DNA, 15 bp, Homo sapiens
gccagcccaccccct

SEQ ID NO: 6242354 - DNA, 12 bp, Homo sapiens
gccagcccactg

SEQ ID NO: 6242355 - DNA, 21 bp, Homo sapiens
gccagcccactgcctcctgcc

SEQ ID NO: 6242356 - DNA, 19 bp, Homo sapiens
gccagcccactgggccctg

SEQ ID NO: 6242357 - DNA, 13 bp, Homo sapiens
gccagcccagaac

SEQ ID NO: 6242358 - DNA, 16 bp, Homo sapiens
gccagcccagatggct

SEQ ID NO: 6242359 - DNA, 14 bp, Homo sapiens
gccagcccagccag

SEQ ID NO: 6242360 - DNA, 13 bp, Homo sapiens
gccagcccagccc

SEQ ID NO: 6242361 - DNA, 12 bp, Homo sapiens
gccagcccagct

SEQ ID NO: 6242362 - DNA, 13 bp, Homo sapiens
gccagcccagctg

SEQ ID NO: 6242363 - DNA, 16 bp, Homo sapiens
gccagcccagctggcc

SEQ ID NO: 6242364 - DNA, 13 bp, Homo sapiens
gccagcccaggat

SEQ ID NO: 6242365 - DNA, 19 bp, Homo sapiens
gccagcccatggcccccaa

SEQ ID NO: 6242366 - DNA, 18 bp, Homo sapiens
gccagccccacacagcta

SEQ ID NO: 6242367 - DNA, 16 bp, Homo sapiens
gccagccccacagccc

SEQ ID NO: 6242368 - DNA, 22 bp, Homo sapiens
gccagccccacccccagccagg

SEQ ID NO: 6242369 - DNA, 23 bp, Homo sapiens
gccagccccacccccagccaggc

SEQ ID NO: 6242370 - DNA, 19 bp, Homo sapiens
gccagccccatcttggtcc

SEQ ID NO: 6242371 - DNA, 15 bp, Homo sapiens
gccagcccccccacc

SEQ ID NO: 6242372 - DNA, 20 bp, Homo sapiens
gccagcccccccacccaccc

SEQ ID NO: 6242373 - DNA, 14 bp, Homo sapiens
gccagccccctcca

SEQ ID NO: 6242374 - DNA, 16 bp, Homo sapiens
gccagccccctccagc

SEQ ID NO: 6242375 - DNA, 17 bp, Homo sapiens
gccagccccctccagct

SEQ ID NO: 6242376 - DNA, 22 bp, Homo sapiens
gccagccccctccagctcatga

SEQ ID NO: 6242377 - DNA, 12 bp, Homo sapiens
gccagcccctcc

SEQ ID NO: 6242378 - DNA, 13 bp, Homo sapiens
gccagcccctcca

SEQ ID NO: 6242379 - DNA, 18 bp, Homo sapiens
gccagcccctccccgcct

SEQ ID NO: 6242380 - DNA, 11 bp, Homo sapiens
gccagcccctg

SEQ ID NO: 6242381 - DNA, 14 bp, Homo sapiens
gccagcccctgcca

SEQ ID NO: 6242382 - DNA, 14 bp, Homo sapiens
gccagcccctggcc

SEQ ID NO: 6242383 - DNA, 18 bp, Homo sapiens
gccagcccctggggccca

SEQ ID NO: 6242384 - DNA, 21 bp, Homo sapiens
gccagcccctggggcccagcc

SEQ ID NO: 6242385 - DNA, 20 bp, Homo sapiens
gccagccccttagacagagg

SEQ ID NO: 6242386 - DNA, 22 bp, Homo sapiens
gccagccccttagacagaggcc

SEQ ID NO: 6242387 - DNA, 22 bp, Homo sapiens
gccagcccggccgctccaccag

SEQ ID NO: 6242388 - DNA, 22 bp, Homo sapiens
gccagccctacatcttcagctc

SEQ ID NO: 6242389 - DNA, 14 bp, Homo sapiens
gccagccctccctg

SEQ ID NO: 6242390 - DNA, 15 bp, Homo sapiens
gccagccctccctgg

SEQ ID NO: 6242391 - DNA, 22 bp, Homo sapiens
gccagccctccctggctgtgag

SEQ ID NO: 6242392 - DNA, 15 bp, Homo sapiens
gccagccctccctgt

SEQ ID NO: 6242393 - DNA, 15 bp, Homo sapiens
gccagccctcttctg

SEQ ID NO: 6242394 - DNA, 16 bp, Homo sapiens
gccagccctcttctga

SEQ ID NO: 6242395 - DNA, 12 bp, Homo sapiens
gccagccctgca

SEQ ID NO: 6242396 - DNA, 13 bp, Homo sapiens
gccagccctgcct

SEQ ID NO: 6242397 - DNA, 16 bp, Homo sapiens
gccagccctgcctgga

SEQ ID NO: 6242398 - DNA, 23 bp, Homo sapiens
gccagccctgcctggaggacctg

SEQ ID NO: 6242399 - DNA, 12 bp, Homo sapiens
gccagccctgga

SEQ ID NO: 6242400 - DNA, 16 bp, Homo sapiens
gccagccctggaggct

SEQ ID NO: 6242401 - DNA, 18 bp, Homo sapiens
gccagccctggaggctgg

SEQ ID NO: 6242402 - DNA, 14 bp, Homo sapiens
gccagccctggccc

SEQ ID NO: 6242403 - DNA, 16 bp, Homo sapiens
gccagccctggcccac

SEQ ID NO: 6242404 - DNA, 17 bp, Homo sapiens
gccagccctggcccacc

SEQ ID NO: 6242405 - DNA, 18 bp, Homo sapiens
gccagccctggcttccaa

SEQ ID NO: 6242406 - DNA, 16 bp, Homo sapiens
gccagcccttcccagg

SEQ ID NO: 6242407 - DNA, 19 bp, Homo sapiens
gccagcccttcccaggcca

SEQ ID NO: 6242408 - DNA, 20 bp, Homo sapiens
gccagcccttccctggcccc

SEQ ID NO: 6242409 - DNA, 21 bp, Homo sapiens
gccagcccttcctctcactcc

SEQ ID NO: 6242410 - DNA, 19 bp, Homo sapiens
gccagcccttgctctacct

SEQ ID NO: 6242411 - DNA, 22 bp, Homo sapiens
gccagcccttgctctacctggc

SEQ ID NO: 6242412 - DNA, 15 bp, Homo sapiens
gccagccgaccctcc

SEQ ID NO: 6242413 - DNA, 20 bp, Homo sapiens
gccagccgaccctcctggcc

SEQ ID NO: 6242414 - DNA, 21 bp, Homo sapiens
gccagccgaccctcctggcct

SEQ ID NO: 6242415 - DNA, 18 bp, Homo sapiens
gccagccgccctgggctg

SEQ ID NO: 6242416 - DNA, 19 bp, Homo sapiens
gccagccgccctgggctgt

SEQ ID NO: 6242417 - DNA, 19 bp, Homo sapiens
gccagccgcgcatcagact

SEQ ID NO: 6242418 - DNA, 16 bp, Homo sapiens
gccagccgctctcctg

SEQ ID NO: 6242419 - DNA, 17 bp, Homo sapiens
gccagccgctctcctgc

SEQ ID NO: 6242420 - DNA, 15 bp, Homo sapiens
gccagccgtggccag

SEQ ID NO: 6242421 - DNA, 18 bp, Homo sapiens
gccagcctacactgccag

SEQ ID NO: 6242422 - DNA, 16 bp, Homo sapiens
gccagcctagcccttg

SEQ ID NO: 6242423 - DNA, 13 bp, Homo sapiens
gccagcctcagct

SEQ ID NO: 6242424 - DNA, 15 bp, Homo sapiens
gccagcctcagctca

SEQ ID NO: 6242425 - DNA, 18 bp, Homo sapiens
gccagcctcagctcagcc

SEQ ID NO: 6242426 - DNA, 16 bp, Homo sapiens
gccagcctcagtgcca

SEQ ID NO: 6242427 - DNA, 18 bp, Homo sapiens
gccagcctcagtgccact

SEQ ID NO: 6242428 - DNA, 23 bp, Homo sapiens
gccagcctcagtgccacttgaca

SEQ ID NO: 6242429 - DNA, 21 bp, Homo sapiens
gccagcctccccacatatggc

SEQ ID NO: 6242430 - DNA, 20 bp, Homo sapiens
gccagcctccgagagggaga

SEQ ID NO: 6242431 - DNA, 12 bp, Homo sapiens
gccagcctcctc

SEQ ID NO: 6242432 - DNA, 14 bp, Homo sapiens
gagctatgcacacc

SEQ ID NO: 6242433 - DNA, 23 bp, Homo sapiens
gagctatgcacaccaaattgctg

SEQ ID NO: 6242434 - DNA, 14 bp, Homo sapiens
gagctatgtattaa

SEQ ID NO: 6242435 - DNA, 14 bp, Homo sapiens
gagctattaaaact

SEQ ID NO: 6242436 - DNA, 20 bp, Homo sapiens
gagctattaaaactcagcct

SEQ ID NO: 6242437 - DNA, 13 bp, Homo sapiens
gagctatttccat

SEQ ID NO: 6242438 - DNA, 18 bp, Homo sapiens
gagctatttccattccag

SEQ ID NO: 6242439 - DNA, 16 bp, Homo sapiens
gagctattttaaacca

SEQ ID NO: 6242440 - DNA, 21 bp, Homo sapiens
gagctattttagaaagctaaa

SEQ ID NO: 6242441 - DNA, 18 bp, Homo sapiens
gagctcaacggtctggca

SEQ ID NO: 6242442 - DNA, 22 bp, Homo sapiens
gagctcaacggtctggcagggc

SEQ ID NO: 6242443 - DNA, 20 bp, Homo sapiens
gagctcaagcccttggggag

SEQ ID NO: 6242444 - DNA, 14 bp, Homo sapiens
gagctcacaaggca

SEQ ID NO: 6242445 - DNA, 18 bp, Homo sapiens
gagctcacaaggcagcaa

SEQ ID NO: 6242446 - DNA, 22 bp, Homo sapiens
gagctcacaaggcagcaaggcc

SEQ ID NO: 6242447 - DNA, 23 bp, Homo sapiens
gagctcacaaggcagcaaggccc

SEQ ID NO: 6242448 - DNA, 14 bp, Homo sapiens
gagctcacaccgca

SEQ ID NO: 6242449 - DNA, 18 bp, Homo sapiens
gagctcacagtacaatgt

SEQ ID NO: 6242450 - DNA, 16 bp, Homo sapiens
gagctcacccaaggtc

SEQ ID NO: 6242451 - DNA, 23 bp, Homo sapiens
gagctcaccctgcccgctcccaa

SEQ ID NO: 6242452 - DNA, 23 bp, Homo sapiens
gagctcagaaaatatccctcctg

SEQ ID NO: 6242453 - DNA, 14 bp, Homo sapiens
gagctcagaccccc

SEQ ID NO: 6242454 - DNA, 15 bp, Homo sapiens
gagctcagaccccca

SEQ ID NO: 6242455 - DNA, 20 bp, Homo sapiens
gagctcagacccccactctc

SEQ ID NO: 6242456 - DNA, 21 bp, Homo sapiens
gagctcagacccccactctca

SEQ ID NO: 6242457 - DNA, 19 bp, Homo sapiens
gagctcagaggacggggag

SEQ ID NO: 6242458 - DNA, 17 bp, Homo sapiens
gagctcagaggagtctg

SEQ ID NO: 6242459 - DNA, 19 bp, Homo sapiens
gagctcagcacagcctcac

SEQ ID NO: 6242460 - DNA, 17 bp, Homo sapiens
gagctcagcctgcctgg

SEQ ID NO: 6242461 - DNA, 13 bp, Homo sapiens
gagctcagcgtgg

SEQ ID NO: 6242462 - DNA, 23 bp, Homo sapiens
gagctcaggaaccgaggcaggga

SEQ ID NO: 6242463 - DNA, 14 bp, Homo sapiens
gagctcaggacact

SEQ ID NO: 6242464 - DNA, 17 bp, Homo sapiens
gagctcaggagaaggcc

SEQ ID NO: 6242465 - DNA, 12 bp, Homo sapiens
gagctcaggatg

SEQ ID NO: 6242466 - DNA, 18 bp, Homo sapiens
gagctcaggatggctcag

SEQ ID NO: 6242467 - DNA, 15 bp, Homo sapiens
gagctcaggctgagc

SEQ ID NO: 6242468 - DNA, 17 bp, Homo sapiens
gagctcaggctgagccc

SEQ ID NO: 6242469 - DNA, 18 bp, Homo sapiens
gagctcaggctgagccca

SEQ ID NO: 6242470 - DNA, 19 bp, Homo sapiens
gagctcaggctgagcccag

SEQ ID NO: 6242471 - DNA, 23 bp, Homo sapiens
gagctcaggctgagcccagccac

SEQ ID NO: 6242472 - DNA, 12 bp, Homo sapiens
gagctcagggct

SEQ ID NO: 6242473 - DNA, 17 bp, Homo sapiens
gagctcagggctggatt

SEQ ID NO: 6242474 - DNA, 22 bp, Homo sapiens
gagctcagggctggattggcag

SEQ ID NO: 6242475 - DNA, 18 bp, Homo sapiens
gagctcagggtttcggaa

SEQ ID NO: 6242476 - DNA, 17 bp, Homo sapiens
gagctcaggtggggagt

SEQ ID NO: 6242477 - DNA, 17 bp, Homo sapiens
gagctcagtacagggca

SEQ ID NO: 6242478 - DNA, 19 bp, Homo sapiens
gagctcagtacagggcagg

SEQ ID NO: 6242479 - DNA, 17 bp, Homo sapiens
gagctcatcccccctgc

SEQ ID NO: 6242480 - DNA, 20 bp, Homo sapiens
gagctcatccctctcaccca

SEQ ID NO: 6242481 - DNA, 14 bp, Homo sapiens
gagctcatgagggc

SEQ ID NO: 6242482 - DNA, 15 bp, Homo sapiens
gagctcatgtagcaa

SEQ ID NO: 6242483 - DNA, 19 bp, Homo sapiens
gagctccaactcagaaggg

SEQ ID NO: 6242484 - DNA, 18 bp, Homo sapiens
gagctccaccctcccctc

SEQ ID NO: 6242485 - DNA, 15 bp, Homo sapiens
gagctccacctctgg

SEQ ID NO: 6242486 - DNA, 17 bp, Homo sapiens
gagctccagacccccag

SEQ ID NO: 6242487 - DNA, 19 bp, Homo sapiens
gagctccagacccccagca

SEQ ID NO: 6242488 - DNA, 19 bp, Homo sapiens
gagctccagctcctttggg

SEQ ID NO: 6242489 - DNA, 20 bp, Homo sapiens
gagctccagctcctttgggc

SEQ ID NO: 6242490 - DNA, 14 bp, Homo sapiens
gagctccaggatgg

SEQ ID NO: 6242491 - DNA, 16 bp, Homo sapiens
gagctccagtgtcctg

SEQ ID NO: 6242492 - DNA, 18 bp, Homo sapiens
gagctccatacacacgct

SEQ ID NO: 6242493 - DNA, 15 bp, Homo sapiens
gagctcccacctccc

SEQ ID NO: 6242494 - DNA, 19 bp, Homo sapiens
gagctcccacctcccttcc

SEQ ID NO: 6242495 - DNA, 23 bp, Homo sapiens
gagctcccacctcccttcccacc

SEQ ID NO: 6242496 - DNA, 14 bp, Homo sapiens
gagctcccaggacg

SEQ ID NO: 6242497 - DNA, 20 bp, Homo sapiens
gagctcccaggacgcaggga

SEQ ID NO: 6242498 - DNA, 20 bp, Homo sapiens
gagctcccaggtgcagccag

SEQ ID NO: 6242499 - DNA, 21 bp, Homo sapiens
gagctcccaggtgcagccaga

SEQ ID NO: 6242500 - DNA, 22 bp, Homo sapiens
gagctcccaggtgcagccagag

SEQ ID NO: 6242501 - DNA, 23 bp, Homo sapiens
gagctccccaatccaacccatgc

SEQ ID NO: 6242502 - DNA, 14 bp, Homo sapiens
gagctccccagatc

SEQ ID NO: 6242503 - DNA, 21 bp, Homo sapiens
gagctcccccgtggtgcctgc

SEQ ID NO: 6242504 - DNA, 18 bp, Homo sapiens
gagctcccctccacagct

SEQ ID NO: 6242505 - DNA, 17 bp, Homo sapiens
gagctcccctccccaac

SEQ ID NO: 6242506 - DNA, 19 bp, Homo sapiens
gagctcccctggagccagc

SEQ ID NO: 6242507 - DNA, 15 bp, Homo sapiens
gagctccctttttga

SEQ ID NO: 6242508 - DNA, 15 bp, Homo sapiens
gagctccgatgcccg

SEQ ID NO: 6242509 - DNA, 22 bp, Homo sapiens
gagctccgctaagacctcccca

SEQ ID NO: 6242510 - DNA, 23 bp, Homo sapiens
gagctccgctaagacctccccac

SEQ ID NO: 6242511 - DNA, 18 bp, Homo sapiens
gagctcctccctccagct

SEQ ID NO: 6242512 - DNA, 19 bp, Homo sapiens
gagctcctccctccagctg

SEQ ID NO: 6242513 - DNA, 23 bp, Homo sapiens
gagctcctccctctcaacaccca

SEQ ID NO: 6242514 - DNA, 21 bp, Homo sapiens
gagctcctccttgtcttggca

SEQ ID NO: 6242515 - DNA, 15 bp, Homo sapiens
gagctcctctcctgg

SEQ ID NO: 6242516 - DNA, 16 bp, Homo sapiens
gagctcctctcctgga

SEQ ID NO: 6242517 - DNA, 18 bp, Homo sapiens
gagctcctctgggcagga

SEQ ID NO: 6242518 - DNA, 22 bp, Homo sapiens
gagctcctctgggcaggacctc

SEQ ID NO: 6242519 - DNA, 19 bp, Homo sapiens
gagctcctctgtcctgctt

SEQ ID NO: 6242520 - DNA, 21 bp, Homo sapiens
gagctcctctgtcctgcttct

SEQ ID NO: 6242521 - DNA, 22 bp, Homo sapiens
gagctcctctgtcctgcttctg

SEQ ID NO: 6242522 - DNA, 19 bp, Homo sapiens
gagctcctcttccatgctg

SEQ ID NO: 6242523 - DNA, 11 bp, Homo sapiens
gagctcctgcg

SEQ ID NO: 6242524 - DNA, 14 bp, Homo sapiens
gagctcctgctgcg

SEQ ID NO: 6242525 - DNA, 22 bp, Homo sapiens
gagctcctgctggggggcaggg

SEQ ID NO: 6242526 - DNA, 12 bp, Homo sapiens
gagctcctgggg

SEQ ID NO: 6242527 - DNA, 22 bp, Homo sapiens
gagctcctggggagctcctggg

SEQ ID NO: 6242528 - DNA, 19 bp, Homo sapiens
gagctcctgtcccctgcta

SEQ ID NO: 6242529 - DNA, 20 bp, Homo sapiens
gagctcctgtccctacccac

SEQ ID NO: 6242530 - DNA, 20 bp, Homo sapiens
gagctccttaaggctctttt

SEQ ID NO: 6242531 - DNA, 13 bp, Homo sapiens
gagctcgcagccc

SEQ ID NO: 6242532 - DNA, 14 bp, Homo sapiens
gagctcgcagcccc

SEQ ID NO: 6242533 - DNA, 16 bp, Homo sapiens
gagctcgccattcact

SEQ ID NO: 6242534 - DNA, 23 bp, Homo sapiens
gagctcgcggcgaggacgacttc

SEQ ID NO: 6242535 - DNA, 18 bp, Homo sapiens
gagctcgcggggcagcaa

SEQ ID NO: 6242536 - DNA, 19 bp, Homo sapiens
gagctcgcggggcagcaaa

SEQ ID NO: 6242537 - DNA, 15 bp, Homo sapiens
gagctcgctcttggg

SEQ ID NO: 6242538 - DNA, 17 bp, Homo sapiens
gagctcggggacaggtg

SEQ ID NO: 6242539 - DNA, 13 bp, Homo sapiens
gagctcggggctg

SEQ ID NO: 6242540 - DNA, 16 bp, Homo sapiens
gagctcggggtccacc

SEQ ID NO: 6242541 - DNA, 19 bp, Homo sapiens
gagctcggggtccaccagt

SEQ ID NO: 6242542 - DNA, 15 bp, Homo sapiens
gagctcggtggaccc

SEQ ID NO: 6242543 - DNA, 16 bp, Homo sapiens
gagctcgtgtatcctg

SEQ ID NO: 6242544 - DNA, 21 bp, Homo sapiens
gagctcgtgtatcctggggct

SEQ ID NO: 6242545 - DNA, 19 bp, Homo sapiens
gagctctaagtacctttcc

SEQ ID NO: 6242546 - DNA, 15 bp, Homo sapiens
gagctctacccaggg

SEQ ID NO: 6242547 - DNA, 20 bp, Homo sapiens
gagctctacccagggcctgc

SEQ ID NO: 6242548 - DNA, 17 bp, Homo sapiens
gagctctaccctgctcc

SEQ ID NO: 6242549 - DNA, 13 bp, Homo sapiens
gagctctcaggcc

SEQ ID NO: 6242550 - DNA, 14 bp, Homo sapiens
gagctctcaggccg

SEQ ID NO: 6242551 - DNA, 17 bp, Homo sapiens
gagctctcaggccgaga

SEQ ID NO: 6242552 - DNA, 19 bp, Homo sapiens
gagctctcaggccgagagc

SEQ ID NO: 6242553 - DNA, 20 bp, Homo sapiens
gagctctcaggccgagagcc

SEQ ID NO: 6242554 - DNA, 17 bp, Homo sapiens
gagctctccaggccagg

SEQ ID NO: 6242555 - DNA, 20 bp, Homo sapiens
gagctctcccctcctgctgg

SEQ ID NO: 6242556 - DNA, 21 bp, Homo sapiens
gagctctcccctcctgctggg

SEQ ID NO: 6242557 - DNA, 17 bp, Homo sapiens
gagctctcctgggccag

SEQ ID NO: 6242558 - DNA, 20 bp, Homo sapiens
gagctctcctgggccagggt

SEQ ID NO: 6242559 - DNA, 21 bp, Homo sapiens
gagctctcctgggccagggtc

SEQ ID NO: 6242560 - DNA, 22 bp, Homo sapiens
gagctctcctgggccagggtct

SEQ ID NO: 6242561 - DNA, 15 bp, Homo sapiens
gagctctcgaggaaa

SEQ ID NO: 6242562 - DNA, 19 bp, Homo sapiens
gagctctcgaggaaagtgg

SEQ ID NO: 6242563 - DNA, 13 bp, Homo sapiens
gagctctctcaga

SEQ ID NO: 6242564 - DNA, 15 bp, Homo sapiens
gagctctctgccctt

SEQ ID NO: 6242565 - DNA, 15 bp, Homo sapiens
gagctctgaaatctt

SEQ ID NO: 6242566 - DNA, 13 bp, Homo sapiens
gagctctgagagg

SEQ ID NO: 6242567 - DNA, 16 bp, Homo sapiens
gagctctgagaggccc

SEQ ID NO: 6242568 - DNA, 23 bp, Homo sapiens
gagctctgagaggccctggatca

SEQ ID NO: 6242569 - DNA, 16 bp, Homo sapiens
gagctctgcagagcag

SEQ ID NO: 6242570 - DNA, 13 bp, Homo sapiens
gagctctgcctca

SEQ ID NO: 6242571 - DNA, 14 bp, Homo sapiens
gagctctgcctcaa

SEQ ID NO: 6242572 - DNA, 16 bp, Homo sapiens
gagctctgcgccaggc

SEQ ID NO: 6242573 - DNA, 19 bp, Homo sapiens
gagctctggagccacctgt

SEQ ID NO: 6242574 - DNA, 15 bp, Homo sapiens
gagctctggccccgc

SEQ ID NO: 6242575 - DNA, 13 bp, Homo sapiens
gagctctggcttt

SEQ ID NO: 6242576 - DNA, 18 bp, Homo sapiens
gagctctggggacagctt

SEQ ID NO: 6242577 - DNA, 20 bp, Homo sapiens
gagctctggggacagcttcc

SEQ ID NO: 6242578 - DNA, 19 bp, Homo sapiens
gagctctggttatttttct

SEQ ID NO: 6242579 - DNA, 14 bp, Homo sapiens
gagctctgtaactt

SEQ ID NO: 6242580 - DNA, 17 bp, Homo sapiens
gagctctgtaacttaca

SEQ ID NO: 6242581 - DNA, 16 bp, Homo sapiens
gagctctgtagcctgg

SEQ ID NO: 6242582 - DNA, 17 bp, Homo sapiens
gagctctgtagcctggt

SEQ ID NO: 6242583 - DNA, 18 bp, Homo sapiens
gagctctgtatggtcagg

SEQ ID NO: 6242584 - DNA, 11 bp, Homo sapiens
gagctctgtcc

SEQ ID NO: 6242585 - DNA, 15 bp, Homo sapiens
gagctctgtcctctg

SEQ ID NO: 6242586 - DNA, 11 bp, Homo sapiens
gagctctgtgg

SEQ ID NO: 6242587 - DNA, 16 bp, Homo sapiens
gagctcttcaggcctc

SEQ ID NO: 6242588 - DNA, 22 bp, Homo sapiens
gagctcttcaggcctccctctc

SEQ ID NO: 6242589 - DNA, 17 bp, Homo sapiens
gagctcttcatgtttca

SEQ ID NO: 6242590 - DNA, 12 bp, Homo sapiens
gagctcttccta

SEQ ID NO: 6242591 - DNA, 20 bp, Homo sapiens
gagctcttcggtttctgagc

SEQ ID NO: 6242592 - DNA, 21 bp, Homo sapiens
gagctcttgacagaaagcagt

SEQ ID NO: 6242593 - DNA, 14 bp, Homo sapiens
gagctcttggcctt

SEQ ID NO: 6242594 - DNA, 17 bp, Homo sapiens
gagctcttggcctttgc

SEQ ID NO: 6242595 - DNA, 18 bp, Homo sapiens
gagctcttggcctttgca

SEQ ID NO: 6242596 - DNA, 21 bp, Homo sapiens
gagctcttgtgaggaaagtca

SEQ ID NO: 6242597 - DNA, 14 bp, Homo sapiens
gagctctttgcact

SEQ ID NO: 6242598 - DNA, 21 bp, Homo sapiens
gagctctttgtctcaccagct

SEQ ID NO: 6242599 - DNA, 23 bp, Homo sapiens
gagctgaaagggagcccctcctc

SEQ ID NO: 6242600 - DNA, 15 bp, Homo sapiens
gagctgaaccttgag

SEQ ID NO: 6242601 - DNA, 13 bp, Homo sapiens
gagctgaagaaat

SEQ ID NO: 6242602 - DNA, 17 bp, Homo sapiens
gagctgaagcccatgct

SEQ ID NO: 6242603 - DNA, 20 bp, Homo sapiens
gagctgaaggttgtggcctt

SEQ ID NO: 6242604 - DNA, 17 bp, Homo sapiens
gagctgaattttctgga

SEQ ID NO: 6242605 - DNA, 16 bp, Homo sapiens
gagctgacacaggatg

SEQ ID NO: 6242606 - DNA, 16 bp, Homo sapiens
gagctgacagagccag

SEQ ID NO: 6242607 - DNA, 12 bp, Homo sapiens
gagctgagaaga

SEQ ID NO: 6242608 - DNA, 14 bp, Homo sapiens
gagctgagaagagg

SEQ ID NO: 6242609 - DNA, 21 bp, Homo sapiens
gagctgagaagaggaggaggt

SEQ ID NO: 6242610 - DNA, 14 bp, Homo sapiens
gccagcctcctctg

SEQ ID NO: 6242611 - DNA, 14 bp, Homo sapiens
gccagcctccttgc

SEQ ID NO: 6242612 - DNA, 20 bp, Homo sapiens
gccagcctccttgtgagagt

SEQ ID NO: 6242613 - DNA, 17 bp, Homo sapiens
gccagcctgaccttcct

SEQ ID NO: 6242614 - DNA, 12 bp, Homo sapiens
gccagcctgagc

SEQ ID NO: 6242615 - DNA, 20 bp, Homo sapiens
gccagcctgaggtgcccact

SEQ ID NO: 6242616 - DNA, 20 bp, Homo sapiens
gccagcctgcgggaagctga

SEQ ID NO: 6242617 - DNA, 19 bp, Homo sapiens
gccagcctgctccttccca

SEQ ID NO: 6242618 - DNA, 19 bp, Homo sapiens
gccagcctgcttcccacaa

SEQ ID NO: 6242619 - DNA, 11 bp, Homo sapiens
gccagcctggc

SEQ ID NO: 6242620 - DNA, 13 bp, Homo sapiens
gccagcctggcat

SEQ ID NO: 6242621 - DNA, 12 bp, Homo sapiens
gccagcctggcc

SEQ ID NO: 6242622 - DNA, 13 bp, Homo sapiens
gccagcctggcct

SEQ ID NO: 6242623 - DNA, 15 bp, Homo sapiens
gccagcctggcctcc

SEQ ID NO: 6242624 - DNA, 17 bp, Homo sapiens
gccagcctggcctcctg

SEQ ID NO: 6242625 - DNA, 22 bp, Homo sapiens
gccagcctggcctcctgcctct

SEQ ID NO: 6242626 - DNA, 19 bp, Homo sapiens
gccagcctggctctgcccc

SEQ ID NO: 6242627 - DNA, 14 bp, Homo sapiens
gccagcctggctgg

SEQ ID NO: 6242628 - DNA, 16 bp, Homo sapiens
gccagcctggcttctg

SEQ ID NO: 6242629 - DNA, 17 bp, Homo sapiens
gccagcctggcttctgg

SEQ ID NO: 6242630 - DNA, 18 bp, Homo sapiens
gccagcctggcttctgga

SEQ ID NO: 6242631 - DNA, 22 bp, Homo sapiens
gccagcctggcttctggagccc

SEQ ID NO: 6242632 - DNA, 11 bp, Homo sapiens
gccagcctggg

SEQ ID NO: 6242633 - DNA, 12 bp, Homo sapiens
gccagcctggga

SEQ ID NO: 6242634 - DNA, 13 bp, Homo sapiens
gccagcctgggac

SEQ ID NO: 6242635 - DNA, 20 bp, Homo sapiens
gccagcctgggactcccagt

SEQ ID NO: 6242636 - DNA, 19 bp, Homo sapiens
gccagcctggggcctggca

SEQ ID NO: 6242637 - DNA, 14 bp, Homo sapiens
gccagcctggtcca

SEQ ID NO: 6242638 - DNA, 21 bp, Homo sapiens
gccagccttcctctgcagctg

SEQ ID NO: 6242639 - DNA, 21 bp, Homo sapiens
gccagccttcttccatcccag

SEQ ID NO: 6242640 - DNA, 20 bp, Homo sapiens
gccagccttgagccctggct

SEQ ID NO: 6242641 - DNA, 19 bp, Homo sapiens
gccagccttgcactgtggg

SEQ ID NO: 6242642 - DNA, 15 bp, Homo sapiens
gccagccttggagga

SEQ ID NO: 6242643 - DNA, 23 bp, Homo sapiens
gccagcgaggcgaggctgcctct

SEQ ID NO: 6242644 - DNA, 17 bp, Homo sapiens
gccagcgcagcgccagg

SEQ ID NO: 6242645 - DNA, 13 bp, Homo sapiens
gccagcgcatgtg

SEQ ID NO: 6242646 - DNA, 14 bp, Homo sapiens
gccagcgccagggc

SEQ ID NO: 6242647 - DNA, 20 bp, Homo sapiens
gccagcgccagggcccaggc

SEQ ID NO: 6242648 - DNA, 22 bp, Homo sapiens
gccagcgccagggcccaggcca

SEQ ID NO: 6242649 - DNA, 16 bp, Homo sapiens
gccagcgcccctcagc

SEQ ID NO: 6242650 - DNA, 18 bp, Homo sapiens
gccagcgcccctcagcct

SEQ ID NO: 6242651 - DNA, 16 bp, Homo sapiens
gccagcgcctccctcc

SEQ ID NO: 6242652 - DNA, 21 bp, Homo sapiens
gccagcgcctccctccacccc

SEQ ID NO: 6242653 - DNA, 13 bp, Homo sapiens
gccagcgcctgcc

SEQ ID NO: 6242654 - DNA, 16 bp, Homo sapiens
gccagcgcctgcccga

SEQ ID NO: 6242655 - DNA, 22 bp, Homo sapiens
gccagcgctgtggaccttacaa

SEQ ID NO: 6242656 - DNA, 15 bp, Homo sapiens
gccagcggccctccc

SEQ ID NO: 6242657 - DNA, 14 bp, Homo sapiens
gccagcggggctgc

SEQ ID NO: 6242658 - DNA, 16 bp, Homo sapiens
gccagcggggctgctc

SEQ ID NO: 6242659 - DNA, 17 bp, Homo sapiens
gccagcggggctgctca

SEQ ID NO: 6242660 - DNA, 23 bp, Homo sapiens
gccagcggtgaccagcctgtcac

SEQ ID NO: 6242661 - DNA, 18 bp, Homo sapiens
gccagcggtttcctggtg

SEQ ID NO: 6242662 - DNA, 13 bp, Homo sapiens
gccagcgtcccag

SEQ ID NO: 6242663 - DNA, 20 bp, Homo sapiens
gccagcgtcggtctgtgccc

SEQ ID NO: 6242664 - DNA, 21 bp, Homo sapiens
gccagcgtcggtctgtgcccc

SEQ ID NO: 6242665 - DNA, 15 bp, Homo sapiens
gccagcgtctgttgt

SEQ ID NO: 6242666 - DNA, 16 bp, Homo sapiens
gccagcgtggcgcagt

SEQ ID NO: 6242667 - DNA, 16 bp, Homo sapiens
gccagcgtttattgta

SEQ ID NO: 6242668 - DNA, 21 bp, Homo sapiens
gccagctaccccttgtgggca

SEQ ID NO: 6242669 - DNA, 22 bp, Homo sapiens
gccagctaccccttgtgggcaa

SEQ ID NO: 6242670 - DNA, 15 bp, Homo sapiens
gccagctactcagga

SEQ ID NO: 6242671 - DNA, 18 bp, Homo sapiens
gccagctagagcttccac

SEQ ID NO: 6242672 - DNA, 16 bp, Homo sapiens
gccagctatctgcctg

SEQ ID NO: 6242673 - DNA, 21 bp, Homo sapiens
gccagctatctgcctgacagg

SEQ ID NO: 6242674 - DNA, 22 bp, Homo sapiens
gccagctatctgcctgacaggc

SEQ ID NO: 6242675 - DNA, 17 bp, Homo sapiens
gccagctcacagtgctg

SEQ ID NO: 6242676 - DNA, 22 bp, Homo sapiens
gccagctcaggaattccctgga

SEQ ID NO: 6242677 - DNA, 22 bp, Homo sapiens
gccagctcaggtgactggagcc

SEQ ID NO: 6242678 - DNA, 18 bp, Homo sapiens
gccagctccacagggtgg

SEQ ID NO: 6242679 - DNA, 13 bp, Homo sapiens
gccagctccccac

SEQ ID NO: 6242680 - DNA, 21 bp, Homo sapiens
gccagctcccccttgcccgcc

SEQ ID NO: 6242681 - DNA, 23 bp, Homo sapiens
gccagctcccccttgcccgccag

SEQ ID NO: 6242682 - DNA, 17 bp, Homo sapiens
gccagctcctgggcagc

SEQ ID NO: 6242683 - DNA, 19 bp, Homo sapiens
gccagctcctgggcagctt

SEQ ID NO: 6242684 - DNA, 13 bp, Homo sapiens
gccagctcctggt

SEQ ID NO: 6242685 - DNA, 14 bp, Homo sapiens
gccagctccttggg

SEQ ID NO: 6242686 - DNA, 22 bp, Homo sapiens
gccagctccttggggcagggcc

SEQ ID NO: 6242687 - DNA, 21 bp, Homo sapiens
gccagctctagttttcagcct

SEQ ID NO: 6242688 - DNA, 15 bp, Homo sapiens
gccagctctcagcca

SEQ ID NO: 6242689 - DNA, 16 bp, Homo sapiens
gccagctctgagcaga

SEQ ID NO: 6242690 - DNA, 14 bp, Homo sapiens
gccagctctgaggg

SEQ ID NO: 6242691 - DNA, 17 bp, Homo sapiens
gccagctctgaggggag

SEQ ID NO: 6242692 - DNA, 13 bp, Homo sapiens
gccagctctgtat

SEQ ID NO: 6242693 - DNA, 23 bp, Homo sapiens
gccagctctgtcaccctggccac

SEQ ID NO: 6242694 - DNA, 18 bp, Homo sapiens
gccagctctgttcttcct

SEQ ID NO: 6242695 - DNA, 21 bp, Homo sapiens
gccagctctgttcttcctcag

SEQ ID NO: 6242696 - DNA, 18 bp, Homo sapiens
gccagctgacatcttgaa

SEQ ID NO: 6242697 - DNA, 18 bp, Homo sapiens
gccagctgatgactcaag

SEQ ID NO: 6242698 - DNA, 19 bp, Homo sapiens
gccagctgatgactcaaga

SEQ ID NO: 6242699 - DNA, 11 bp, Homo sapiens
gccagctgcag

SEQ ID NO: 6242700 - DNA, 20 bp, Homo sapiens
gccagctgcaggaatcaaaa

SEQ ID NO: 6242701 - DNA, 17 bp, Homo sapiens
gccagctgcagggcacg

SEQ ID NO: 6242702 - DNA, 19 bp, Homo sapiens
gccagctgcatctactcag

SEQ ID NO: 6242703 - DNA, 21 bp, Homo sapiens
gccagctgccctatgggcctg

SEQ ID NO: 6242704 - DNA, 13 bp, Homo sapiens
gccagctgccgca

SEQ ID NO: 6242705 - DNA, 13 bp, Homo sapiens
gccagctgcctag

SEQ ID NO: 6242706 - DNA, 14 bp, Homo sapiens
gccagctgcctagg

SEQ ID NO: 6242707 - DNA, 18 bp, Homo sapiens
gccagctgcctgtgcctg

SEQ ID NO: 6242708 - DNA, 22 bp, Homo sapiens
gccagctgccttcctcatcccc

SEQ ID NO: 6242709 - DNA, 18 bp, Homo sapiens
gccagctgctgagccgca

SEQ ID NO: 6242710 - DNA, 19 bp, Homo sapiens
gccagctgctgagccgcag

SEQ ID NO: 6242711 - DNA, 20 bp, Homo sapiens
gccagctgctgagccgcaga

SEQ ID NO: 6242712 - DNA, 14 bp, Homo sapiens
gccagctgcttctg

SEQ ID NO: 6242713 - DNA, 16 bp, Homo sapiens
gccagctgcttctgcc

SEQ ID NO: 6242714 - DNA, 13 bp, Homo sapiens
gccagctgcttga

SEQ ID NO: 6242715 - DNA, 15 bp, Homo sapiens
gccagctgcttgacc

SEQ ID NO: 6242716 - DNA, 18 bp, Homo sapiens
gccagctgcttgggcttc

SEQ ID NO: 6242717 - DNA, 15 bp, Homo sapiens
gccagctggaggcag

SEQ ID NO: 6242718 - DNA, 17 bp, Homo sapiens
gccagctggaggcaggg

SEQ ID NO: 6242719 - DNA, 17 bp, Homo sapiens
gccagctggcagcagag

SEQ ID NO: 6242720 - DNA, 16 bp, Homo sapiens
gccagctggcccagtg

SEQ ID NO: 6242721 - DNA, 18 bp, Homo sapiens
gccagctggcctttgtaa

SEQ ID NO: 6242722 - DNA, 19 bp, Homo sapiens
gccagctgggatctgactg

SEQ ID NO: 6242723 - DNA, 21 bp, Homo sapiens
gccagctgggatctgactgca

SEQ ID NO: 6242724 - DNA, 15 bp, Homo sapiens
gccagctgggcccag

SEQ ID NO: 6242725 - DNA, 12 bp, Homo sapiens
gccagctgggga

SEQ ID NO: 6242726 - DNA, 18 bp, Homo sapiens
gccagctggggagatggg

SEQ ID NO: 6242727 - DNA, 21 bp, Homo sapiens
gccagctggggagatgggggc

SEQ ID NO: 6242728 - DNA, 19 bp, Homo sapiens
gccagctggtgaatccatg

SEQ ID NO: 6242729 - DNA, 15 bp, Homo sapiens
gccagctggtgctgc

SEQ ID NO: 6242730 - DNA, 14 bp, Homo sapiens
gccagctgtctccc

SEQ ID NO: 6242731 - DNA, 17 bp, Homo sapiens
gccagctgtgcactttc

SEQ ID NO: 6242732 - DNA, 14 bp, Homo sapiens
gccagctgtgtcct

SEQ ID NO: 6242733 - DNA, 13 bp, Homo sapiens
gccagcttaaacc

SEQ ID NO: 6242734 - DNA, 18 bp, Homo sapiens
gccagcttcctgtgcaga

SEQ ID NO: 6242735 - DNA, 20 bp, Homo sapiens
gccagcttcctgtgcagaag

SEQ ID NO: 6242736 - DNA, 23 bp, Homo sapiens
gccagcttcctgtgggccaggag

SEQ ID NO: 6242737 - DNA, 20 bp, Homo sapiens
gccagcttcgtgctggagga

SEQ ID NO: 6242738 - DNA, 22 bp, Homo sapiens
gccagcttctctctccagggtg

SEQ ID NO: 6242739 - DNA, 13 bp, Homo sapiens
gccagcttggctc

SEQ ID NO: 6242740 - DNA, 18 bp, Homo sapiens
gccagcttggggccacca

SEQ ID NO: 6242741 - DNA, 22 bp, Homo sapiens
gccagcttggggccaccaaagc

SEQ ID NO: 6242742 - DNA, 21 bp, Homo sapiens
gccagcttggtggttatgtcc

SEQ ID NO: 6242743 - DNA, 14 bp, Homo sapiens
gccagcttgtttac

SEQ ID NO: 6242744 - DNA, 15 bp, Homo sapiens
gccagcttgtttaca

SEQ ID NO: 6242745 - DNA, 23 bp, Homo sapiens
gccagcttgtttacatgcttatt

SEQ ID NO: 6242746 - DNA, 15 bp, Homo sapiens
gccagctttccctgc

SEQ ID NO: 6242747 - DNA, 17 bp, Homo sapiens
gccaggaaaccctcttc

SEQ ID NO: 6242748 - DNA, 17 bp, Homo sapiens
gccaggaacagggacca

SEQ ID NO: 6242749 - DNA, 18 bp, Homo sapiens
gccaggaacagggaccag

SEQ ID NO: 6242750 - DNA, 20 bp, Homo sapiens
gccaggaacagggaccagct

SEQ ID NO: 6242751 - DNA, 22 bp, Homo sapiens
gccaggaacctgtcctaaggaa

SEQ ID NO: 6242752 - DNA, 19 bp, Homo sapiens
gccaggaagatcccccaga

SEQ ID NO: 6242753 - DNA, 11 bp, Homo sapiens
gccaggaagcc

SEQ ID NO: 6242754 - DNA, 12 bp, Homo sapiens
gccaggaagcca

SEQ ID NO: 6242755 - DNA, 14 bp, Homo sapiens
gccaggaagccaga

SEQ ID NO: 6242756 - DNA, 15 bp, Homo sapiens
gccaggaagccagag

SEQ ID NO: 6242757 - DNA, 18 bp, Homo sapiens
gccaggaagccagagccc

SEQ ID NO: 6242758 - DNA, 19 bp, Homo sapiens
gccaggaagccagagcccc

SEQ ID NO: 6242759 - DNA, 18 bp, Homo sapiens
gccaggaagccagcaggc

SEQ ID NO: 6242760 - DNA, 16 bp, Homo sapiens
gccaggaagccccgct

SEQ ID NO: 6242761 - DNA, 17 bp, Homo sapiens
gccaggaaggacagact

SEQ ID NO: 6242762 - DNA, 23 bp, Homo sapiens
gccaggaaggacagactggccgg

SEQ ID NO: 6242763 - DNA, 20 bp, Homo sapiens
gccaggaagtagcacaggct

SEQ ID NO: 6242764 - DNA, 13 bp, Homo sapiens
gccaggaatattg

SEQ ID NO: 6242765 - DNA, 19 bp, Homo sapiens
gccaggaatgtttcagctg

SEQ ID NO: 6242766 - DNA, 13 bp, Homo sapiens
gccaggacagcag

SEQ ID NO: 6242767 - DNA, 15 bp, Homo sapiens
gccaggacagcagca

SEQ ID NO: 6242768 - DNA, 18 bp, Homo sapiens
gccaggacagcagcactc

SEQ ID NO: 6242769 - DNA, 13 bp, Homo sapiens
gccaggacagctg

SEQ ID NO: 6242770 - DNA, 15 bp, Homo sapiens
gccaggacaggcccg

SEQ ID NO: 6242771 - DNA, 19 bp, Homo sapiens
gccaggacagtcagctctc

SEQ ID NO: 6242772 - DNA, 18 bp, Homo sapiens
gccaggaccaagggcaga

SEQ ID NO: 6242773 - DNA, 20 bp, Homo sapiens
gccaggaccaagggcagagg

SEQ ID NO: 6242774 - DNA, 22 bp, Homo sapiens
gccaggaccagtcaacctgggc

SEQ ID NO: 6242775 - DNA, 23 bp, Homo sapiens
gccaggaccagtcccagagcagg

SEQ ID NO: 6242776 - DNA, 17 bp, Homo sapiens
gccaggaccccaggtca

SEQ ID NO: 6242777 - DNA, 20 bp, Homo sapiens
gccaggacccgccagccccg

SEQ ID NO: 6242778 - DNA, 17 bp, Homo sapiens
gccaggacccgcctgct

SEQ ID NO: 6242779 - DNA, 19 bp, Homo sapiens
gccaggaccttggtgagat

SEQ ID NO: 6242780 - DNA, 17 bp, Homo sapiens
gccaggacgaattgaga

SEQ ID NO: 6242781 - DNA, 17 bp, Homo sapiens
gccaggacgggccacac

SEQ ID NO: 6242782 - DNA, 14 bp, Homo sapiens
gccaggactcccag

SEQ ID NO: 6242783 - DNA, 17 bp, Homo sapiens
gccaggactcccagaac

SEQ ID NO: 6242784 - DNA, 19 bp, Homo sapiens
gccaggactcccagaacct

SEQ ID NO: 6242785 - DNA, 21 bp, Homo sapiens
gccaggactcccagaacctct

SEQ ID NO: 6242786 - DNA, 19 bp, Homo sapiens
gccaggactccccaggcca

SEQ ID NO: 6242787 - DNA, 13 bp, Homo sapiens
gccaggactctgc

SEQ ID NO: 6242788 - DNA, 19 bp, Homo sapiens
gccaggactctgcagcctc

SEQ ID NO: 6242789 - DNA, 23 bp, Homo sapiens
gagctgagaagaggaggaggtgg

SEQ ID NO: 6242790 - DNA, 19 bp, Homo sapiens
gagctgagaatagaaggaa

SEQ ID NO: 6242791 - DNA, 17 bp, Homo sapiens
gagctgagatgagcccc

SEQ ID NO: 6242792 - DNA, 22 bp, Homo sapiens
gagctgagatgaggttttggaa

SEQ ID NO: 6242793 - DNA, 13 bp, Homo sapiens
gagctgagatgga

SEQ ID NO: 6242794 - DNA, 20 bp, Homo sapiens
gagctgagattgcgccactg

SEQ ID NO: 6242795 - DNA, 14 bp, Homo sapiens
gagctgagcagcct

SEQ ID NO: 6242796 - DNA, 19 bp, Homo sapiens
gagctgagcagcctctgga

SEQ ID NO: 6242797 - DNA, 16 bp, Homo sapiens
gagctgagcagggaga

SEQ ID NO: 6242798 - DNA, 14 bp, Homo sapiens
gagctgagccaggc

SEQ ID NO: 6242799 - DNA, 15 bp, Homo sapiens
gagctgagccaggct

SEQ ID NO: 6242800 - DNA, 17 bp, Homo sapiens
gagctgagcctctcacc

SEQ ID NO: 6242801 - DNA, 13 bp, Homo sapiens
gagctgagctgga

SEQ ID NO: 6242802 - DNA, 13 bp, Homo sapiens
gagctgaggactc

SEQ ID NO: 6242803 - DNA, 16 bp, Homo sapiens
gagctgaggcagcagt

SEQ ID NO: 6242804 - DNA, 20 bp, Homo sapiens
gagctgagggagggagccat

SEQ ID NO: 6242805 - DNA, 22 bp, Homo sapiens
gagctgagggagggagccatgg

SEQ ID NO: 6242806 - DNA, 14 bp, Homo sapiens
gagctgagggccct

SEQ ID NO: 6242807 - DNA, 16 bp, Homo sapiens
gagctgagggccctgt

SEQ ID NO: 6242808 - DNA, 13 bp, Homo sapiens
gagctgaggggca

SEQ ID NO: 6242809 - DNA, 16 bp, Homo sapiens
gagctgaggggcaggg

SEQ ID NO: 6242810 - DNA, 23 bp, Homo sapiens
gagctgaggggggccgtgcccag

SEQ ID NO: 6242811 - DNA, 14 bp, Homo sapiens
gagctgaggtttca

SEQ ID NO: 6242812 - DNA, 23 bp, Homo sapiens
gagctgaggtttcacccttaacc

SEQ ID NO: 6242813 - DNA, 15 bp, Homo sapiens
gagctgagtcacctc

SEQ ID NO: 6242814 - DNA, 21 bp, Homo sapiens
gagctgagtcacctcctccac

SEQ ID NO: 6242815 - DNA, 21 bp, Homo sapiens
gagctgagtcggctgggcagg

SEQ ID NO: 6242816 - DNA, 15 bp, Homo sapiens
gagctgagtggggga

SEQ ID NO: 6242817 - DNA, 15 bp, Homo sapiens
gagctgatccagagc

SEQ ID NO: 6242818 - DNA, 16 bp, Homo sapiens
gagctgatcgcttctc

SEQ ID NO: 6242819 - DNA, 18 bp, Homo sapiens
gagctgatggagaaggaa

SEQ ID NO: 6242820 - DNA, 16 bp, Homo sapiens
gagctgatttccaggc

SEQ ID NO: 6242821 - DNA, 18 bp, Homo sapiens
gagctgatttccaggccc

SEQ ID NO: 6242822 - DNA, 15 bp, Homo sapiens
gagctgcacacacct

SEQ ID NO: 6242823 - DNA, 22 bp, Homo sapiens
gagctgcacttggcctcagctg

SEQ ID NO: 6242824 - DNA, 18 bp, Homo sapiens
gagctgcagaaccagtcc

SEQ ID NO: 6242825 - DNA, 19 bp, Homo sapiens
gagctgcagaaccagtccc

SEQ ID NO: 6242826 - DNA, 21 bp, Homo sapiens
gagctgcagagagcacctggt

SEQ ID NO: 6242827 - DNA, 13 bp, Homo sapiens
gagctgcagcccc

SEQ ID NO: 6242828 - DNA, 19 bp, Homo sapiens
gagctgcagccccccagag

SEQ ID NO: 6242829 - DNA, 20 bp, Homo sapiens
gagctgcagcgcctcctgga

SEQ ID NO: 6242830 - DNA, 21 bp, Homo sapiens
gagctgcaggaatcacccctc

SEQ ID NO: 6242831 - DNA, 11 bp, Homo sapiens
gagctgcaggg

SEQ ID NO: 6242832 - DNA, 22 bp, Homo sapiens
gagctgcataatgtccctctct

SEQ ID NO: 6242833 - DNA, 17 bp, Homo sapiens
gagctgcatggacgcct

SEQ ID NO: 6242834 - DNA, 23 bp, Homo sapiens
gagctgcatggacgcctggctcc

SEQ ID NO: 6242835 - DNA, 24 bp, Homo sapiens
gagctgcatggacgcctggctcca

SEQ ID NO: 6242836 - DNA, 16 bp, Homo sapiens
gagctgccacagagaa

SEQ ID NO: 6242837 - DNA, 15 bp, Homo sapiens
gagctgccacctgcc

SEQ ID NO: 6242838 - DNA, 19 bp, Homo sapiens
gagctgcccacagcaggcc

SEQ ID NO: 6242839 - DNA, 21 bp, Homo sapiens
gagctgcccagagttgctggg

SEQ ID NO: 6242840 - DNA, 16 bp, Homo sapiens
gagctgcccctgctgc

SEQ ID NO: 6242841 - DNA, 18 bp, Homo sapiens
gagctgcccctgctgctt

SEQ ID NO: 6242842 - DNA, 16 bp, Homo sapiens
gagctgcccggcgcct

SEQ ID NO: 6242843 - DNA, 23 bp, Homo sapiens
gagctgccctccttgtccaccca

SEQ ID NO: 6242844 - DNA, 14 bp, Homo sapiens
gagctgccctctcc

SEQ ID NO: 6242845 - DNA, 21 bp, Homo sapiens
gagctgccctctcctgggcag

SEQ ID NO: 6242846 - DNA, 21 bp, Homo sapiens
gagctgccgcaaggccctgtc

SEQ ID NO: 6242847 - DNA, 17 bp, Homo sapiens
gagctgcctaagaggca

SEQ ID NO: 6242848 - DNA, 13 bp, Homo sapiens
gagctgcctccag

SEQ ID NO: 6242849 - DNA, 16 bp, Homo sapiens
gagctgcctccagcct

SEQ ID NO: 6242850 - DNA, 12 bp, Homo sapiens
gagctgcctccc

SEQ ID NO: 6242851 - DNA, 15 bp, Homo sapiens
gagctgcctgcagca

SEQ ID NO: 6242852 - DNA, 20 bp, Homo sapiens
gagctgcctgcagcacatgc

SEQ ID NO: 6242853 - DNA, 17 bp, Homo sapiens
gagctgcctgctctgca

SEQ ID NO: 6242854 - DNA, 18 bp, Homo sapiens
gagctgcctgctctgcag

SEQ ID NO: 6242855 - DNA, 12 bp, Homo sapiens
gagctgcctggc

SEQ ID NO: 6242856 - DNA, 14 bp, Homo sapiens
gagctgccttccct

SEQ ID NO: 6242857 - DNA, 22 bp, Homo sapiens
gagctgccttggctcagacatg

SEQ ID NO: 6242858 - DNA, 16 bp, Homo sapiens
gagctgcgggctgagg

SEQ ID NO: 6242859 - DNA, 17 bp, Homo sapiens
gagctgcgggctgaggg

SEQ ID NO: 6242860 - DNA, 18 bp, Homo sapiens
gagctgcgggctgagggc

SEQ ID NO: 6242861 - DNA, 19 bp, Homo sapiens
gagctgcgggctgagggca

SEQ ID NO: 6242862 - DNA, 23 bp, Homo sapiens
gagctgctaagctaaagaaactg

SEQ ID NO: 6242863 - DNA, 17 bp, Homo sapiens
gagctgctattaaatta

SEQ ID NO: 6242864 - DNA, 14 bp, Homo sapiens
gagctgctcagaat

SEQ ID NO: 6242865 - DNA, 14 bp, Homo sapiens
gagctgctctgaat

SEQ ID NO: 6242866 - DNA, 13 bp, Homo sapiens
gagctgctgagca

SEQ ID NO: 6242867 - DNA, 14 bp, Homo sapiens
gagctgctgagcag

SEQ ID NO: 6242868 - DNA, 13 bp, Homo sapiens
gagctgctgccct

SEQ ID NO: 6242869 - DNA, 16 bp, Homo sapiens
gagctgctggccatgg

SEQ ID NO: 6242870 - DNA, 20 bp, Homo sapiens
gagctgctggctgacctggg

SEQ ID NO: 6242871 - DNA, 23 bp, Homo sapiens
gagctgctggctgacctgggccc

SEQ ID NO: 6242872 - DNA, 16 bp, Homo sapiens
gagctgctggcttgca

SEQ ID NO: 6242873 - DNA, 12 bp, Homo sapiens
gagctgctgggc

SEQ ID NO: 6242874 - DNA, 17 bp, Homo sapiens
gagctgctgtgcccagc

SEQ ID NO: 6242875 - DNA, 24 bp, Homo sapiens
gagctgctgttccaacagacaggg

SEQ ID NO: 6242876 - DNA, 14 bp, Homo sapiens
gagctgcttcacta

SEQ ID NO: 6242877 - DNA, 11 bp, Homo sapiens
gagctggaaat

SEQ ID NO: 6242878 - DNA, 23 bp, Homo sapiens
gagctggaaataaacctggagat

SEQ ID NO: 6242879 - DNA, 17 bp, Homo sapiens
gagctggaaggcagggc

SEQ ID NO: 6242880 - DNA, 21 bp, Homo sapiens
gagctggacagtggagtgcaa

SEQ ID NO: 6242881 - DNA, 17 bp, Homo sapiens
gagctggacctcaccaa

SEQ ID NO: 6242882 - DNA, 20 bp, Homo sapiens
gagctggagatgaggccaga

SEQ ID NO: 6242883 - DNA, 14 bp, Homo sapiens
gagctggagcctgg

SEQ ID NO: 6242884 - DNA, 14 bp, Homo sapiens
gagctggagctaag

SEQ ID NO: 6242885 - DNA, 16 bp, Homo sapiens
gagctggaggggtggg

SEQ ID NO: 6242886 - DNA, 18 bp, Homo sapiens
gagctggaggggtgggga

SEQ ID NO: 6242887 - DNA, 21 bp, Homo sapiens
gagctggatagacttgggatg

SEQ ID NO: 6242888 - DNA, 22 bp, Homo sapiens
gagctggatttgggagctctgc

SEQ ID NO: 6242889 - DNA, 18 bp, Homo sapiens
gagctggcaaccagccag

SEQ ID NO: 6242890 - DNA, 19 bp, Homo sapiens
gagctggccaggccactgg

SEQ ID NO: 6242891 - DNA, 16 bp, Homo sapiens
gagctggccaggccct

SEQ ID NO: 6242892 - DNA, 12 bp, Homo sapiens
gagctggcccag

SEQ ID NO: 6242893 - DNA, 13 bp, Homo sapiens
gagctggccccgc

SEQ ID NO: 6242894 - DNA, 14 bp, Homo sapiens
gagctggccccgcc

SEQ ID NO: 6242895 - DNA, 16 bp, Homo sapiens
gagctggccccgccgc

SEQ ID NO: 6242896 - DNA, 23 bp, Homo sapiens
gagctggcctaggtgggagccac

SEQ ID NO: 6242897 - DNA, 12 bp, Homo sapiens
gagctggcctcc

SEQ ID NO: 6242898 - DNA, 12 bp, Homo sapiens
gagctggcctgt

SEQ ID NO: 6242899 - DNA, 21 bp, Homo sapiens
gagctggcctgtggcacagcc

SEQ ID NO: 6242900 - DNA, 21 bp, Homo sapiens
gagctggcgactgcagctgca

SEQ ID NO: 6242901 - DNA, 18 bp, Homo sapiens
gagctggcggcggcggct

SEQ ID NO: 6242902 - DNA, 13 bp, Homo sapiens
gagctggctgact

SEQ ID NO: 6242903 - DNA, 21 bp, Homo sapiens
gagctggctgactaagccccg

SEQ ID NO: 6242904 - DNA, 16 bp, Homo sapiens
gagctggctgtgcctg

SEQ ID NO: 6242905 - DNA, 17 bp, Homo sapiens
gagctggctgtgcctgc

SEQ ID NO: 6242906 - DNA, 17 bp, Homo sapiens
gagctggcttcggagat

SEQ ID NO: 6242907 - DNA, 19 bp, Homo sapiens
gagctgggaagctgtactc

SEQ ID NO: 6242908 - DNA, 15 bp, Homo sapiens
gagctgggaaggttc

SEQ ID NO: 6242909 - DNA, 24 bp, Homo sapiens
gagctgggactcagttcttggcct

SEQ ID NO: 6242910 - DNA, 13 bp, Homo sapiens
gagctgggagccg

SEQ ID NO: 6242911 - DNA, 14 bp, Homo sapiens
gagctgggagccgg

SEQ ID NO: 6242912 - DNA, 14 bp, Homo sapiens
gagctgggaggaaa

SEQ ID NO: 6242913 - DNA, 16 bp, Homo sapiens
gagctgggaggaaaag

SEQ ID NO: 6242914 - DNA, 12 bp, Homo sapiens
gagctgggaggc

SEQ ID NO: 6242915 - DNA, 13 bp, Homo sapiens
gagctgggcagct

SEQ ID NO: 6242916 - DNA, 16 bp, Homo sapiens
gagctgggcaggaagg

SEQ ID NO: 6242917 - DNA, 14 bp, Homo sapiens
gagctgggcccagc

SEQ ID NO: 6242918 - DNA, 15 bp, Homo sapiens
gagctgggcccagcc

SEQ ID NO: 6242919 - DNA, 17 bp, Homo sapiens
gagctgggcccagcccc

SEQ ID NO: 6242920 - DNA, 18 bp, Homo sapiens
gagctgggcccagcccct

SEQ ID NO: 6242921 - DNA, 12 bp, Homo sapiens
gagctgggcccc

SEQ ID NO: 6242922 - DNA, 13 bp, Homo sapiens
gagctgggcccct

SEQ ID NO: 6242923 - DNA, 19 bp, Homo sapiens
gagctgggcccctgcacag

SEQ ID NO: 6242924 - DNA, 16 bp, Homo sapiens
gagctgggcccgacat

SEQ ID NO: 6242925 - DNA, 20 bp, Homo sapiens
gagctgggcccgacatggct

SEQ ID NO: 6242926 - DNA, 12 bp, Homo sapiens
gagctgggccct

SEQ ID NO: 6242927 - DNA, 13 bp, Homo sapiens
gagctgggccctg

SEQ ID NO: 6242928 - DNA, 15 bp, Homo sapiens
gagctgggccctgcc

SEQ ID NO: 6242929 - DNA, 20 bp, Homo sapiens
gagctgggccctgcctgcag

SEQ ID NO: 6242930 - DNA, 23 bp, Homo sapiens
gagctgggccctgcctgcagcca

SEQ ID NO: 6242931 - DNA, 12 bp, Homo sapiens
gagctgggcctg

SEQ ID NO: 6242932 - DNA, 13 bp, Homo sapiens
gagctgggcctgg

SEQ ID NO: 6242933 - DNA, 22 bp, Homo sapiens
gagctgggctttcctctgtgac

SEQ ID NO: 6242934 - DNA, 16 bp, Homo sapiens
gagctggggactcagg

SEQ ID NO: 6242935 - DNA, 21 bp, Homo sapiens
gagctggggagggagagatct

SEQ ID NO: 6242936 - DNA, 19 bp, Homo sapiens
gagctggggaggtgggagg

SEQ ID NO: 6242937 - DNA, 23 bp, Homo sapiens
gagctggggaggtgggaggccag

SEQ ID NO: 6242938 - DNA, 13 bp, Homo sapiens
gagctggggccac

SEQ ID NO: 6242939 - DNA, 14 bp, Homo sapiens
gagctggggccaca

SEQ ID NO: 6242940 - DNA, 19 bp, Homo sapiens
gagctggggccaccctggc

SEQ ID NO: 6242941 - DNA, 20 bp, Homo sapiens
gagctggggccaccctggcc

SEQ ID NO: 6242942 - DNA, 22 bp, Homo sapiens
gagctggggctgccagcctgag

SEQ ID NO: 6242943 - DNA, 15 bp, Homo sapiens
gagctggggcttctt

SEQ ID NO: 6242944 - DNA, 22 bp, Homo sapiens
gagctgggggaaggcaggagcc

SEQ ID NO: 6242945 - DNA, 20 bp, Homo sapiens
gagctggggggttggcagcc

SEQ ID NO: 6242946 - DNA, 19 bp, Homo sapiens
gagctggggtacaggtttg

SEQ ID NO: 6242947 - DNA, 17 bp, Homo sapiens
gagctgggtaccaggcc

SEQ ID NO: 6242948 - DNA, 21 bp, Homo sapiens
gagctgggtactgactgagat

SEQ ID NO: 6242949 - DNA, 12 bp, Homo sapiens
gagctgggtggc

SEQ ID NO: 6242950 - DNA, 24 bp, Homo sapiens
gagctgggtggcctgtttctgcag

SEQ ID NO: 6242951 - DNA, 18 bp, Homo sapiens
gagctgggtgtcaagagg

SEQ ID NO: 6242952 - DNA, 17 bp, Homo sapiens
gagctggtagaggggag

SEQ ID NO: 6242953 - DNA, 16 bp, Homo sapiens
gagctggtctgccagg

SEQ ID NO: 6242954 - DNA, 14 bp, Homo sapiens
gagctggtgacttt

SEQ ID NO: 6242955 - DNA, 19 bp, Homo sapiens
gagctggtgactttgggga

SEQ ID NO: 6242956 - DNA, 16 bp, Homo sapiens
gagctggtgcattaca

SEQ ID NO: 6242957 - DNA, 17 bp, Homo sapiens
gagctggtgcattacag

SEQ ID NO: 6242958 - DNA, 17 bp, Homo sapiens
gagctggtgcccggaga

SEQ ID NO: 6242959 - DNA, 21 bp, Homo sapiens
gagctggtgcccggagattgg

SEQ ID NO: 6242960 - DNA, 20 bp, Homo sapiens
gagctggtgcggctggccat

SEQ ID NO: 6242961 - DNA, 22 bp, Homo sapiens
gagctggtggtttgatcatttc

SEQ ID NO: 6242962 - DNA, 14 bp, Homo sapiens
gagctggtgtctga

SEQ ID NO: 6242963 - DNA, 18 bp, Homo sapiens
gagctgtattaagtgact

SEQ ID NO: 6242964 - DNA, 18 bp, Homo sapiens
gagctgtcaccaaggaaa

SEQ ID NO: 6242965 - DNA, 14 bp, Homo sapiens
gagctgtcatcact

SEQ ID NO: 6242966 - DNA, 22 bp, Homo sapiens
gagctgtcctcctggcacctga

SEQ ID NO: 6242967 - DNA, 14 bp, Homo sapiens
gagctgtcgctgcc

SEQ ID NO: 6242968 - DNA, 15 bp, Homo sapiens
gccaggactgagccc

SEQ ID NO: 6242969 - DNA, 12 bp, Homo sapiens
gccaggagaaga

SEQ ID NO: 6242970 - DNA, 18 bp, Homo sapiens
gccaggagaagacccctg

SEQ ID NO: 6242971 - DNA, 20 bp, Homo sapiens
gccaggagaagacccctgcc

SEQ ID NO: 6242972 - DNA, 14 bp, Homo sapiens
gccaggagaagctc

SEQ ID NO: 6242973 - DNA, 14 bp, Homo sapiens
gccaggagagagat

SEQ ID NO: 6242974 - DNA, 20 bp, Homo sapiens
gccaggagagcttagggtct

SEQ ID NO: 6242975 - DNA, 21 bp, Homo sapiens
gccaggagagcttagggtctc

SEQ ID NO: 6242976 - DNA, 16 bp, Homo sapiens
gccaggagatggcccc

SEQ ID NO: 6242977 - DNA, 22 bp, Homo sapiens
gccaggagcaatgggactggag

SEQ ID NO: 6242978 - DNA, 21 bp, Homo sapiens
gccaggagcacggctctgtcc

SEQ ID NO: 6242979 - DNA, 13 bp, Homo sapiens
gccaggagcagat

SEQ ID NO: 6242980 - DNA, 15 bp, Homo sapiens
gccaggagcagccct

SEQ ID NO: 6242981 - DNA, 16 bp, Homo sapiens
gccaggagcctcctgc

SEQ ID NO: 6242982 - DNA, 19 bp, Homo sapiens
gccaggagcctcctgccct

SEQ ID NO: 6242983 - DNA, 20 bp, Homo sapiens
gccaggagcctcctgccctt

SEQ ID NO: 6242984 - DNA, 16 bp, Homo sapiens
gccaggagctggagga

SEQ ID NO: 6242985 - DNA, 13 bp, Homo sapiens
gccaggagctggg

SEQ ID NO: 6242986 - DNA, 22 bp, Homo sapiens
gccaggagcttcttcgttcctg

SEQ ID NO: 6242987 - DNA, 16 bp, Homo sapiens
gccaggaggacccagg

SEQ ID NO: 6242988 - DNA, 16 bp, Homo sapiens
gccaggaggctgcggc

SEQ ID NO: 6242989 - DNA, 17 bp, Homo sapiens
gccaggaggctgcggcc

SEQ ID NO: 6242990 - DNA, 16 bp, Homo sapiens
gccaggaggctggcag

SEQ ID NO: 6242991 - DNA, 18 bp, Homo sapiens
gccaggaggggctgtcca

SEQ ID NO: 6242992 - DNA, 15 bp, Homo sapiens
gccaggaggtcctcc

SEQ ID NO: 6242993 - DNA, 20 bp, Homo sapiens
gccaggaggttggtgactga

SEQ ID NO: 6242994 - DNA, 14 bp, Homo sapiens
gccaggagtaagcc

SEQ ID NO: 6242995 - DNA, 17 bp, Homo sapiens
gccaggagtaagcccaa

SEQ ID NO: 6242996 - DNA, 18 bp, Homo sapiens
gccaggagtaagcccaag

SEQ ID NO: 6242997 - DNA, 20 bp, Homo sapiens
gccaggagtaagcccaagct

SEQ ID NO: 6242998 - DNA, 19 bp, Homo sapiens
gccaggagtctgtgctctt

SEQ ID NO: 6242999 - DNA, 15 bp, Homo sapiens
gccaggagtgccccc

SEQ ID NO: 6243000 - DNA, 21 bp, Homo sapiens
gccaggagtgggtttccctgc

SEQ ID NO: 6243001 - DNA, 19 bp, Homo sapiens
gccaggatcatggtgtaat

SEQ ID NO: 6243002 - DNA, 17 bp, Homo sapiens
gccaggatccccctctt

SEQ ID NO: 6243003 - DNA, 13 bp, Homo sapiens
gccaggatgacta

SEQ ID NO: 6243004 - DNA, 20 bp, Homo sapiens
gccaggatgcctgagccccc

SEQ ID NO: 6243005 - DNA, 20 bp, Homo sapiens
gccaggatgctcccccaggg

SEQ ID NO: 6243006 - DNA, 14 bp, Homo sapiens
gccaggatggcgca

SEQ ID NO: 6243007 - DNA, 22 bp, Homo sapiens
gccaggattcaggcctctgagg

SEQ ID NO: 6243008 - DNA, 18 bp, Homo sapiens
gccaggattggcacaagc

SEQ ID NO: 6243009 - DNA, 24 bp, Homo sapiens
gccaggattggggacctgatggag

SEQ ID NO: 6243010 - DNA, 19 bp, Homo sapiens
gccaggatttggttgttta

SEQ ID NO: 6243011 - DNA, 17 bp, Homo sapiens
gccaggcacacacagcc

SEQ ID NO: 6243012 - DNA, 12 bp, Homo sapiens
gccaggcacagg

SEQ ID NO: 6243013 - DNA, 20 bp, Homo sapiens
gccaggcacaggcagggcag

SEQ ID NO: 6243014 - DNA, 17 bp, Homo sapiens
gccaggcacagggcccg

SEQ ID NO: 6243015 - DNA, 15 bp, Homo sapiens
gccaggcaccacagc

SEQ ID NO: 6243016 - DNA, 16 bp, Homo sapiens
gccaggcaccacagcc

SEQ ID NO: 6243017 - DNA, 13 bp, Homo sapiens
gccaggcacctgg

SEQ ID NO: 6243018 - DNA, 17 bp, Homo sapiens
gccaggcacggaggctc

SEQ ID NO: 6243019 - DNA, 22 bp, Homo sapiens
gccaggcactctcatcacccca

SEQ ID NO: 6243020 - DNA, 18 bp, Homo sapiens
gccaggcagaatggctgc

SEQ ID NO: 6243021 - DNA, 21 bp, Homo sapiens
gccaggcagaatggctgcacg

SEQ ID NO: 6243022 - DNA, 13 bp, Homo sapiens
gccaggcagagct

SEQ ID NO: 6243023 - DNA, 21 bp, Homo sapiens
gccaggcagatctgtgcccca

SEQ ID NO: 6243024 - DNA, 14 bp, Homo sapiens
gccaggcaggaggc

SEQ ID NO: 6243025 - DNA, 14 bp, Homo sapiens
gccaggcaggcgat

SEQ ID NO: 6243026 - DNA, 23 bp, Homo sapiens
gccaggcaggcgggggctgctca

SEQ ID NO: 6243027 - DNA, 14 bp, Homo sapiens
gccaggcagggaga

SEQ ID NO: 6243028 - DNA, 14 bp, Homo sapiens
gccaggcaggggtg

SEQ ID NO: 6243029 - DNA, 16 bp, Homo sapiens
gccaggcaggggtggg

SEQ ID NO: 6243030 - DNA, 17 bp, Homo sapiens
gccaggcaggtccacag

SEQ ID NO: 6243031 - DNA, 14 bp, Homo sapiens
gccaggcatgtggc

SEQ ID NO: 6243032 - DNA, 22 bp, Homo sapiens
gccaggccaacagcacctcccc

SEQ ID NO: 6243033 - DNA, 17 bp, Homo sapiens
gccaggccaactgcccc

SEQ ID NO: 6243034 - DNA, 22 bp, Homo sapiens
gccaggccaatgttgctgatgg

SEQ ID NO: 6243035 - DNA, 23 bp, Homo sapiens
gccaggccacaagacccttgtgg

SEQ ID NO: 6243036 - DNA, 19 bp, Homo sapiens
gccaggccactggcccctg

SEQ ID NO: 6243037 - DNA, 15 bp, Homo sapiens
gccaggccagaggga

SEQ ID NO: 6243038 - DNA, 22 bp, Homo sapiens
gccaggccagagggagtgacag

SEQ ID NO: 6243039 - DNA, 12 bp, Homo sapiens
gccaggccagca

SEQ ID NO: 6243040 - DNA, 20 bp, Homo sapiens
gccaggccaggaccacacag

SEQ ID NO: 6243041 - DNA, 20 bp, Homo sapiens
gccaggccagtaaaagtata

SEQ ID NO: 6243042 - DNA, 14 bp, Homo sapiens
gccaggcccagccg

SEQ ID NO: 6243043 - DNA, 18 bp, Homo sapiens
gccaggcccaggccagcc

SEQ ID NO: 6243044 - DNA, 17 bp, Homo sapiens
gccaggcccatctcagg

SEQ ID NO: 6243045 - DNA, 18 bp, Homo sapiens
gccaggcccatctcaggt

SEQ ID NO: 6243046 - DNA, 13 bp, Homo sapiens
gccaggccccagg

SEQ ID NO: 6243047 - DNA, 12 bp, Homo sapiens
gccaggccccat

SEQ ID NO: 6243048 - DNA, 15 bp, Homo sapiens
gccaggccccatgga

SEQ ID NO: 6243049 - DNA, 18 bp, Homo sapiens
gccaggccccatggaggg

SEQ ID NO: 6243050 - DNA, 20 bp, Homo sapiens
gccaggccccatggagggta

SEQ ID NO: 6243051 - DNA, 22 bp, Homo sapiens
gccaggcccccaccacacatcc

SEQ ID NO: 6243052 - DNA, 23 bp, Homo sapiens
gccaggcccccaccacacatccc

SEQ ID NO: 6243053 - DNA, 13 bp, Homo sapiens
gccaggcccgcac

SEQ ID NO: 6243054 - DNA, 22 bp, Homo sapiens
gccaggcccgcaccccggcctc

SEQ ID NO: 6243055 - DNA, 14 bp, Homo sapiens
gccaggccctcagt

SEQ ID NO: 6243056 - DNA, 13 bp, Homo sapiens
gccaggccctcca

SEQ ID NO: 6243057 - DNA, 14 bp, Homo sapiens
gccaggccctccag

SEQ ID NO: 6243058 - DNA, 23 bp, Homo sapiens
gccaggccctcctgctggctgag

SEQ ID NO: 6243059 - DNA, 13 bp, Homo sapiens
gccaggccctctc

SEQ ID NO: 6243060 - DNA, 19 bp, Homo sapiens
gccaggccctctctgcagt

SEQ ID NO: 6243061 - DNA, 15 bp, Homo sapiens
gccaggccctctgcc

SEQ ID NO: 6243062 - DNA, 16 bp, Homo sapiens
gccaggccctctgccc

SEQ ID NO: 6243063 - DNA, 21 bp, Homo sapiens
gccaggccctctgcccactcc

SEQ ID NO: 6243064 - DNA, 14 bp, Homo sapiens
gccaggccctggag

SEQ ID NO: 6243065 - DNA, 23 bp, Homo sapiens
gccaggccctggagggcagagac

SEQ ID NO: 6243066 - DNA, 21 bp, Homo sapiens
gccaggccctttgcactgagg

SEQ ID NO: 6243067 - DNA, 20 bp, Homo sapiens
gccaggccgcgcccagcaga

SEQ ID NO: 6243068 - DNA, 19 bp, Homo sapiens
gccaggccggcgagccctg

SEQ ID NO: 6243069 - DNA, 20 bp, Homo sapiens
gccaggccggcgagccctgt

SEQ ID NO: 6243070 - DNA, 21 bp, Homo sapiens
gccaggccgggcctgtacagt

SEQ ID NO: 6243071 - DNA, 13 bp, Homo sapiens
gccaggcctagta

SEQ ID NO: 6243072 - DNA, 14 bp, Homo sapiens
gccaggcctccctc

SEQ ID NO: 6243073 - DNA, 15 bp, Homo sapiens
gccaggcctccctcg

SEQ ID NO: 6243074 - DNA, 13 bp, Homo sapiens
gccaggcctcgca

SEQ ID NO: 6243075 - DNA, 14 bp, Homo sapiens
gccaggcctcgcct

SEQ ID NO: 6243076 - DNA, 18 bp, Homo sapiens
gccaggcctcgcctgccc

SEQ ID NO: 6243077 - DNA, 19 bp, Homo sapiens
gccaggcctcgcctgccct

SEQ ID NO: 6243078 - DNA, 21 bp, Homo sapiens
gccaggcctctctcacctctc

SEQ ID NO: 6243079 - DNA, 18 bp, Homo sapiens
gccaggcctctgctggct

SEQ ID NO: 6243080 - DNA, 17 bp, Homo sapiens
gccaggcctcttggcag

SEQ ID NO: 6243081 - DNA, 21 bp, Homo sapiens
gccaggcctcttggcagtcac

SEQ ID NO: 6243082 - DNA, 13 bp, Homo sapiens
gccaggcctgcca

SEQ ID NO: 6243083 - DNA, 19 bp, Homo sapiens
gccaggcctgccagcccct

SEQ ID NO: 6243084 - DNA, 22 bp, Homo sapiens
gccaggcctgcgggcccctggt

SEQ ID NO: 6243085 - DNA, 11 bp, Homo sapiens
gccaggcctgg

SEQ ID NO: 6243086 - DNA, 20 bp, Homo sapiens
gccaggcctgggtgatctgc

SEQ ID NO: 6243087 - DNA, 20 bp, Homo sapiens
gccaggcctgtatgaggctt

SEQ ID NO: 6243088 - DNA, 21 bp, Homo sapiens
gccaggcgagcctgactctgt

SEQ ID NO: 6243089 - DNA, 13 bp, Homo sapiens
gccaggcgaggcc

SEQ ID NO: 6243090 - DNA, 15 bp, Homo sapiens
gccaggcgaggccct

SEQ ID NO: 6243091 - DNA, 15 bp, Homo sapiens
gccaggcgcatgtct

SEQ ID NO: 6243092 - DNA, 18 bp, Homo sapiens
gccaggcgcatgtctgca

SEQ ID NO: 6243093 - DNA, 17 bp, Homo sapiens
gccaggcgctgcagggc

SEQ ID NO: 6243094 - DNA, 17 bp, Homo sapiens
gccaggcggccctgggg

SEQ ID NO: 6243095 - DNA, 20 bp, Homo sapiens
gccaggcgttggtgccactt

SEQ ID NO: 6243096 - DNA, 15 bp, Homo sapiens
gccaggctaattttt

SEQ ID NO: 6243097 - DNA, 17 bp, Homo sapiens
gccaggctatggttgcc

SEQ ID NO: 6243098 - DNA, 23 bp, Homo sapiens
gccaggctatggttgccacccca

SEQ ID NO: 6243099 - DNA, 22 bp, Homo sapiens
gccaggctcactcacagagtca

SEQ ID NO: 6243100 - DNA, 16 bp, Homo sapiens
gccaggctcaggagaa

SEQ ID NO: 6243101 - DNA, 17 bp, Homo sapiens
gccaggctccctgacca

SEQ ID NO: 6243102 - DNA, 18 bp, Homo sapiens
gccaggctccctgaccac

SEQ ID NO: 6243103 - DNA, 14 bp, Homo sapiens
gccaggctccttcc

SEQ ID NO: 6243104 - DNA, 15 bp, Homo sapiens
gccaggctccttcct

SEQ ID NO: 6243105 - DNA, 21 bp, Homo sapiens
gccaggctccttcctgtcttc

SEQ ID NO: 6243106 - DNA, 15 bp, Homo sapiens
gccaggctctccctc

SEQ ID NO: 6243107 - DNA, 13 bp, Homo sapiens
gccaggctctctt

SEQ ID NO: 6243108 - DNA, 15 bp, Homo sapiens
gccaggctctgcctg

SEQ ID NO: 6243109 - DNA, 12 bp, Homo sapiens
gccaggctctgt

SEQ ID NO: 6243110 - DNA, 17 bp, Homo sapiens
gccaggctgaccacagc

SEQ ID NO: 6243111 - DNA, 18 bp, Homo sapiens
gccaggctgaccacagca

SEQ ID NO: 6243112 - DNA, 18 bp, Homo sapiens
gccaggctgagtgagcca

SEQ ID NO: 6243113 - DNA, 14 bp, Homo sapiens
gccaggctgcaggg

SEQ ID NO: 6243114 - DNA, 14 bp, Homo sapiens
gccaggctgccaag

SEQ ID NO: 6243115 - DNA, 14 bp, Homo sapiens
gccaggctgcctcg

SEQ ID NO: 6243116 - DNA, 14 bp, Homo sapiens
gccaggctgcctgg

SEQ ID NO: 6243117 - DNA, 20 bp, Homo sapiens
gccaggctgcggtgggcagc

SEQ ID NO: 6243118 - DNA, 14 bp, Homo sapiens
gccaggctgctctt

SEQ ID NO: 6243119 - DNA, 22 bp, Homo sapiens
gccaggctgctcttgaactcct

SEQ ID NO: 6243120 - DNA, 18 bp, Homo sapiens
gccaggctggagtgcagt

SEQ ID NO: 6243121 - DNA, 19 bp, Homo sapiens
gccaggctggagtgcagtg

SEQ ID NO: 6243122 - DNA, 20 bp, Homo sapiens
gccaggctggagtgcagtgg

SEQ ID NO: 6243123 - DNA, 12 bp, Homo sapiens
gccaggctggga

SEQ ID NO: 6243124 - DNA, 13 bp, Homo sapiens
gccaggctgggag

SEQ ID NO: 6243125 - DNA, 14 bp, Homo sapiens
gccaggctgggagg

SEQ ID NO: 6243126 - DNA, 17 bp, Homo sapiens
gccaggctgggaggctc

SEQ ID NO: 6243127 - DNA, 13 bp, Homo sapiens
gccaggctgggcc

SEQ ID NO: 6243128 - DNA, 23 bp, Homo sapiens
gccaggctgggtcgccctggact

SEQ ID NO: 6243129 - DNA, 11 bp, Homo sapiens
gccaggctggt

SEQ ID NO: 6243130 - DNA, 15 bp, Homo sapiens
gccaggctggtctcg

SEQ ID NO: 6243131 - DNA, 22 bp, Homo sapiens
gccaggctggtctcgaactcct

SEQ ID NO: 6243132 - DNA, 15 bp, Homo sapiens
gccaggctgtaagca

SEQ ID NO: 6243133 - DNA, 14 bp, Homo sapiens
gccaggctgtgcta

SEQ ID NO: 6243134 - DNA, 22 bp, Homo sapiens
gccaggcttttctcaggagctt

SEQ ID NO: 6243135 - DNA, 16 bp, Homo sapiens
gccagggaacagcccc

SEQ ID NO: 6243136 - DNA, 17 bp, Homo sapiens
gccagggaacagcccca

SEQ ID NO: 6243137 - DNA, 19 bp, Homo sapiens
gccagggaacagccccagg

SEQ ID NO: 6243138 - DNA, 19 bp, Homo sapiens
gccagggaagacagagcag

SEQ ID NO: 6243139 - DNA, 22 bp, Homo sapiens
gccagggaagacagagcaggct

SEQ ID NO: 6243140 - DNA, 19 bp, Homo sapiens
gccagggaaggctgtgcag

SEQ ID NO: 6243141 - DNA, 18 bp, Homo sapiens
gccagggacagagggggt

SEQ ID NO: 6243142 - DNA, 19 bp, Homo sapiens
gccagggacccaaagcagg

SEQ ID NO: 6243143 - DNA, 19 bp, Homo sapiens
gccagggacccccgaggcc

SEQ ID NO: 6243144 - DNA, 21 bp, Homo sapiens
gccagggacccccgaggcccc

SEQ ID NO: 6243145 - DNA, 16 bp, Homo sapiens
gccagggagaagctcc

SEQ ID NO: 6243146 - DNA, 16 bp, Homo sapiens
gccagggagacagagc

SEQ ID NO: 6243147 - DNA, 19 bp, Homo sapiens
gagctgtcgctgcctccat

SEQ ID NO: 6243148 - DNA, 21 bp, Homo sapiens
gagctgtctatgcagcctgct

SEQ ID NO: 6243149 - DNA, 18 bp, Homo sapiens
gagctgtctgaagcccaa

SEQ ID NO: 6243150 - DNA, 16 bp, Homo sapiens
gagctgtctgctgccg

SEQ ID NO: 6243151 - DNA, 22 bp, Homo sapiens
gagctgtcttcctgtgtacctc

SEQ ID NO: 6243152 - DNA, 17 bp, Homo sapiens
gagctgtgacccagagg

SEQ ID NO: 6243153 - DNA, 20 bp, Homo sapiens
gagctgtgcatcagctagaa

SEQ ID NO: 6243154 - DNA, 11 bp, Homo sapiens
gagctgtgcca

SEQ ID NO: 6243155 - DNA, 12 bp, Homo sapiens
gagctgtgccag

SEQ ID NO: 6243156 - DNA, 14 bp, Homo sapiens
gagctgtgccagct

SEQ ID NO: 6243157 - DNA, 18 bp, Homo sapiens
gagctgtgccagctgctt

SEQ ID NO: 6243158 - DNA, 21 bp, Homo sapiens
gagctgtgccagctgcttctg

SEQ ID NO: 6243159 - DNA, 14 bp, Homo sapiens
gagctgtgcctgct

SEQ ID NO: 6243160 - DNA, 16 bp, Homo sapiens
gagctgtgcctgctca

SEQ ID NO: 6243161 - DNA, 15 bp, Homo sapiens
gagctgtgcgctgct

SEQ ID NO: 6243162 - DNA, 14 bp, Homo sapiens
gagctgtggctggg

SEQ ID NO: 6243163 - DNA, 21 bp, Homo sapiens
gagctgtgtaccaatcgtctc

SEQ ID NO: 6243164 - DNA, 16 bp, Homo sapiens
gagctgttaccattca

SEQ ID NO: 6243165 - DNA, 16 bp, Homo sapiens
gagctgttatgctgtt

SEQ ID NO: 6243166 - DNA, 20 bp, Homo sapiens
gagctgttatgctgtttcct

SEQ ID NO: 6243167 - DNA, 20 bp, Homo sapiens
gagctgttcacagccagact

SEQ ID NO: 6243168 - DNA, 22 bp, Homo sapiens
gagctgttcacagccagactgg

SEQ ID NO: 6243169 - DNA, 17 bp, Homo sapiens
gagctgttcgctcctcc

SEQ ID NO: 6243170 - DNA, 18 bp, Homo sapiens
gagctgttgatgggatga

SEQ ID NO: 6243171 - DNA, 16 bp, Homo sapiens
gagctgttggaagaaa

SEQ ID NO: 6243172 - DNA, 17 bp, Homo sapiens
gagctgttggaagaaaa

SEQ ID NO: 6243173 - DNA, 15 bp, Homo sapiens
gagctgttggcctgg

SEQ ID NO: 6243174 - DNA, 19 bp, Homo sapiens
gagctgttggggcaggggt

SEQ ID NO: 6243175 - DNA, 14 bp, Homo sapiens
gagctgttgtgagc

SEQ ID NO: 6243176 - DNA, 18 bp, Homo sapiens
gagctgtttatggcctca

SEQ ID NO: 6243177 - DNA, 17 bp, Homo sapiens
gagctgtttatgttttt

SEQ ID NO: 6243178 - DNA, 22 bp, Homo sapiens
gagctgtttggatacagctgct

SEQ ID NO: 6243179 - DNA, 15 bp, Homo sapiens
gagcttaaaatacaa

SEQ ID NO: 6243180 - DNA, 15 bp, Homo sapiens
gagcttaagccactg

SEQ ID NO: 6243181 - DNA, 23 bp, Homo sapiens
gagcttaagccactgcctctccc

SEQ ID NO: 6243182 - DNA, 21 bp, Homo sapiens
gagcttaatctttgaaaggtt

SEQ ID NO: 6243183 - DNA, 22 bp, Homo sapiens
gagcttaatctttgaaaggtta

SEQ ID NO: 6243184 - DNA, 21 bp, Homo sapiens
gagcttaatgctacatgtgag

SEQ ID NO: 6243185 - DNA, 23 bp, Homo sapiens
gagcttacattgaaaacagatat

SEQ ID NO: 6243186 - DNA, 14 bp, Homo sapiens
gagcttagccttgt

SEQ ID NO: 6243187 - DNA, 21 bp, Homo sapiens
gagcttagccttgtgccctgc

SEQ ID NO: 6243188 - DNA, 22 bp, Homo sapiens
gagcttagccttgtgccctgcc

SEQ ID NO: 6243189 - DNA, 17 bp, Homo sapiens
gagcttagggtctcagg

SEQ ID NO: 6243190 - DNA, 22 bp, Homo sapiens
gagcttataaaatttaacttct

SEQ ID NO: 6243191 - DNA, 17 bp, Homo sapiens
gagcttattggccactg

SEQ ID NO: 6243192 - DNA, 21 bp, Homo sapiens
gagcttattgttttaaaaagt

SEQ ID NO: 6243193 - DNA, 20 bp, Homo sapiens
gagcttattgtttttattct

SEQ ID NO: 6243194 - DNA, 20 bp, Homo sapiens
gagcttcaagtctgtgcctg

SEQ ID NO: 6243195 - DNA, 16 bp, Homo sapiens
gagcttcaatataaga

SEQ ID NO: 6243196 - DNA, 20 bp, Homo sapiens
gagcttcaatataagaagca

SEQ ID NO: 6243197 - DNA, 19 bp, Homo sapiens
gagcttcagccaggtctga

SEQ ID NO: 6243198 - DNA, 16 bp, Homo sapiens
gagcttcatggcagaa

SEQ ID NO: 6243199 - DNA, 15 bp, Homo sapiens
gagcttccaaatgtg

SEQ ID NO: 6243200 - DNA, 21 bp, Homo sapiens
gagcttccaaatgtgtcagaa

SEQ ID NO: 6243201 - DNA, 21 bp, Homo sapiens
gagcttcccacacctgcctgc

SEQ ID NO: 6243202 - DNA, 10 bp, Homo sapiens
gagcttcccc

SEQ ID NO: 6243203 - DNA, 14 bp, Homo sapiens
gagcttcctggctc

SEQ ID NO: 6243204 - DNA, 12 bp, Homo sapiens
gagcttcctggg

SEQ ID NO: 6243205 - DNA, 15 bp, Homo sapiens
gagcttcctggggac

SEQ ID NO: 6243206 - DNA, 19 bp, Homo sapiens
gagcttcctgtcctcccag

SEQ ID NO: 6243207 - DNA, 16 bp, Homo sapiens
gagcttcctgtttcta

SEQ ID NO: 6243208 - DNA, 23 bp, Homo sapiens
gagcttctaaactgaagctgctg

SEQ ID NO: 6243209 - DNA, 15 bp, Homo sapiens
gagcttctccagcca

SEQ ID NO: 6243210 - DNA, 15 bp, Homo sapiens
gagcttctctgggct

SEQ ID NO: 6243211 - DNA, 14 bp, Homo sapiens
gagcttctctgtga

SEQ ID NO: 6243212 - DNA, 11 bp, Homo sapiens
gagcttctggg

SEQ ID NO: 6243213 - DNA, 23 bp, Homo sapiens
gagcttctggggtccccagggct

SEQ ID NO: 6243214 - DNA, 18 bp, Homo sapiens
gagcttctgttgctgcct

SEQ ID NO: 6243215 - DNA, 22 bp, Homo sapiens
gagcttcttccaggtgcccagc

SEQ ID NO: 6243216 - DNA, 22 bp, Homo sapiens
gagcttgaaacccgtggcgctt

SEQ ID NO: 6243217 - DNA, 20 bp, Homo sapiens
gagcttgagggacaatgcca

SEQ ID NO: 6243218 - DNA, 16 bp, Homo sapiens
gagcttgaggtgggag

SEQ ID NO: 6243219 - DNA, 18 bp, Homo sapiens
gagcttgaggtgggagcg

SEQ ID NO: 6243220 - DNA, 18 bp, Homo sapiens
gagcttgattctaaaggg

SEQ ID NO: 6243221 - DNA, 19 bp, Homo sapiens
gagcttgattctaaagggg

SEQ ID NO: 6243222 - DNA, 22 bp, Homo sapiens
gagcttgattctaaaggggaca

SEQ ID NO: 6243223 - DNA, 17 bp, Homo sapiens
gagcttgccacactctt

SEQ ID NO: 6243224 - DNA, 13 bp, Homo sapiens
gagcttgcctcag

SEQ ID NO: 6243225 - DNA, 18 bp, Homo sapiens
gagcttgcctcagggcca

SEQ ID NO: 6243226 - DNA, 22 bp, Homo sapiens
gagcttgcctcagggccaagcc

SEQ ID NO: 6243227 - DNA, 20 bp, Homo sapiens
gagcttgctcattaattttg

SEQ ID NO: 6243228 - DNA, 14 bp, Homo sapiens
gagcttgctccaga

SEQ ID NO: 6243229 - DNA, 18 bp, Homo sapiens
gagcttgctccagattct

SEQ ID NO: 6243230 - DNA, 22 bp, Homo sapiens
gagcttgctccagattctgatg

SEQ ID NO: 6243231 - DNA, 14 bp, Homo sapiens
gagcttgctggaga

SEQ ID NO: 6243232 - DNA, 13 bp, Homo sapiens
gagcttggagccc

SEQ ID NO: 6243233 - DNA, 19 bp, Homo sapiens
gagcttggagccccctggc

SEQ ID NO: 6243234 - DNA, 12 bp, Homo sapiens
gagcttggccct

SEQ ID NO: 6243235 - DNA, 15 bp, Homo sapiens
gagcttggccctgcg

SEQ ID NO: 6243236 - DNA, 22 bp, Homo sapiens
gagcttggccctgcgccctgtg

SEQ ID NO: 6243237 - DNA, 14 bp, Homo sapiens
gagcttggccttgg

SEQ ID NO: 6243238 - DNA, 17 bp, Homo sapiens
gagcttggccttgggcc

SEQ ID NO: 6243239 - DNA, 17 bp, Homo sapiens
gagcttgggcagtgccc

SEQ ID NO: 6243240 - DNA, 20 bp, Homo sapiens
gagcttgggcagtgccccag

SEQ ID NO: 6243241 - DNA, 12 bp, Homo sapiens
gagcttggggca

SEQ ID NO: 6243242 - DNA, 18 bp, Homo sapiens
gagcttgggtctctctcg

SEQ ID NO: 6243243 - DNA, 21 bp, Homo sapiens
gagcttgggtctctctcggcc

SEQ ID NO: 6243244 - DNA, 21 bp, Homo sapiens
gagcttggtgcggtaggtgct

SEQ ID NO: 6243245 - DNA, 16 bp, Homo sapiens
gagcttgtacatattg

SEQ ID NO: 6243246 - DNA, 21 bp, Homo sapiens
gagctttaaaagtatctttaa

SEQ ID NO: 6243247 - DNA, 11 bp, Homo sapiens
gagctttatgg

SEQ ID NO: 6243248 - DNA, 21 bp, Homo sapiens
gagctttatggtcctaaaagc

SEQ ID NO: 6243249 - DNA, 18 bp, Homo sapiens
gagctttccatgttgctg

SEQ ID NO: 6243250 - DNA, 19 bp, Homo sapiens
gagctttccatgttgctgc

SEQ ID NO: 6243251 - DNA, 15 bp, Homo sapiens
gagctttccggggag

SEQ ID NO: 6243252 - DNA, 20 bp, Homo sapiens
gagctttccggggaggagcc

SEQ ID NO: 6243253 - DNA, 21 bp, Homo sapiens
gagctttccggggaggagcct

SEQ ID NO: 6243254 - DNA, 14 bp, Homo sapiens
gagctttctcaatg

SEQ ID NO: 6243255 - DNA, 17 bp, Homo sapiens
gagctttctcaatgtct

SEQ ID NO: 6243256 - DNA, 22 bp, Homo sapiens
gagctttctgaacagctggtgt

SEQ ID NO: 6243257 - DNA, 21 bp, Homo sapiens
gagctttctgtccttttggca

SEQ ID NO: 6243258 - DNA, 13 bp, Homo sapiens
gagctttctgtgc

SEQ ID NO: 6243259 - DNA, 17 bp, Homo sapiens
gagctttctgtgcatgt

SEQ ID NO: 6243260 - DNA, 16 bp, Homo sapiens
gagctttcttgtttct

SEQ ID NO: 6243261 - DNA, 17 bp, Homo sapiens
gagctttcttgtttctt

SEQ ID NO: 6243262 - DNA, 23 bp, Homo sapiens
gagctttcttgtttcttattagg

SEQ ID NO: 6243263 - DNA, 21 bp, Homo sapiens
gagctttgagacaggtgcctg

SEQ ID NO: 6243264 - DNA, 19 bp, Homo sapiens
gagctttgcatgttccact

SEQ ID NO: 6243265 - DNA, 21 bp, Homo sapiens
gagctttgcatgttccactaa

SEQ ID NO: 6243266 - DNA, 13 bp, Homo sapiens
gagctttgctgct

SEQ ID NO: 6243267 - DNA, 17 bp, Homo sapiens
gagctttgctgctacag

SEQ ID NO: 6243268 - DNA, 18 bp, Homo sapiens
gagctttggacgcacaca

SEQ ID NO: 6243269 - DNA, 13 bp, Homo sapiens
gagctttgtcact

SEQ ID NO: 6243270 - DNA, 22 bp, Homo sapiens
gagctttgttttatatatttat

SEQ ID NO: 6243271 - DNA, 20 bp, Homo sapiens
gagcttttaaaaatgtttgg

SEQ ID NO: 6243272 - DNA, 19 bp, Homo sapiens
gagcttttcgaactgtgct

SEQ ID NO: 6243273 - DNA, 20 bp, Homo sapiens
gagcttttgcatttcctgtg

SEQ ID NO: 6243274 - DNA, 16 bp, Homo sapiens
gagcttttgcccacac

SEQ ID NO: 6243275 - DNA, 17 bp, Homo sapiens
gagcttttgcccacaca

SEQ ID NO: 6243276 - DNA, 22 bp, Homo sapiens
gagctttttcagaaacagggca

SEQ ID NO: 6243277 - DNA, 21 bp, Homo sapiens
gagctttttgttccctcattc

SEQ ID NO: 6243278 - DNA, 18 bp, Homo sapiens
gagcttttttctttaaga

SEQ ID NO: 6243279 - DNA, 22 bp, Homo sapiens
gaggaaaaaaatcgtccaggga

SEQ ID NO: 6243280 - DNA, 13 bp, Homo sapiens
gaggaaaaaagaa

SEQ ID NO: 6243281 - DNA, 15 bp, Homo sapiens
gaggaaaaaatggta

SEQ ID NO: 6243282 - DNA, 20 bp, Homo sapiens
gaggaaaaaatggtataaaa

SEQ ID NO: 6243283 - DNA, 14 bp, Homo sapiens
gaggaaaaacaaca

SEQ ID NO: 6243284 - DNA, 21 bp, Homo sapiens
gaggaaaaacgatcgctgtga

SEQ ID NO: 6243285 - DNA, 17 bp, Homo sapiens
gaggaaaaactgacaga

SEQ ID NO: 6243286 - DNA, 13 bp, Homo sapiens
gaggaaaaatatg

SEQ ID NO: 6243287 - DNA, 14 bp, Homo sapiens
gaggaaaaatatgt

SEQ ID NO: 6243288 - DNA, 17 bp, Homo sapiens
gaggaaaaatatgtgaa

SEQ ID NO: 6243289 - DNA, 14 bp, Homo sapiens
gaggaaaagacaga

SEQ ID NO: 6243290 - DNA, 18 bp, Homo sapiens
gaggaaaagacagagcct

SEQ ID NO: 6243291 - DNA, 16 bp, Homo sapiens
gaggaaaagactgtgg

SEQ ID NO: 6243292 - DNA, 22 bp, Homo sapiens
gaggaaaaggtccttgcctcct

SEQ ID NO: 6243293 - DNA, 22 bp, Homo sapiens
gaggaaaagtaaccatcactgg

SEQ ID NO: 6243294 - DNA, 21 bp, Homo sapiens
gaggaaaagtaaggtgcagtt

SEQ ID NO: 6243295 - DNA, 21 bp, Homo sapiens
gaggaaaagtcaaagtgttgc

SEQ ID NO: 6243296 - DNA, 17 bp, Homo sapiens
gaggaaaagtcttccta

SEQ ID NO: 6243297 - DNA, 13 bp, Homo sapiens
gaggaaaagtgca

SEQ ID NO: 6243298 - DNA, 14 bp, Homo sapiens
gaggaaaagtgcaa

SEQ ID NO: 6243299 - DNA, 14 bp, Homo sapiens
gaggaaaatgagta

SEQ ID NO: 6243300 - DNA, 16 bp, Homo sapiens
gaggaaaatgagtatt

SEQ ID NO: 6243301 - DNA, 13 bp, Homo sapiens
gaggaaaattctt

SEQ ID NO: 6243302 - DNA, 14 bp, Homo sapiens
gaggaaactcagag

SEQ ID NO: 6243303 - DNA, 22 bp, Homo sapiens
gaggaaagacaacacaaccaac

SEQ ID NO: 6243304 - DNA, 14 bp, Homo sapiens
gaggaaagagagca

SEQ ID NO: 6243305 - DNA, 17 bp, Homo sapiens
gaggaaagcgtttctgt

SEQ ID NO: 6243306 - DNA, 21 bp, Homo sapiens
gaggaaaggagggaaagttcc

SEQ ID NO: 6243307 - DNA, 22 bp, Homo sapiens
gaggaaaggattttaccaaagc

SEQ ID NO: 6243308 - DNA, 21 bp, Homo sapiens
gaggaaagggaggagtggagg

SEQ ID NO: 6243309 - DNA, 22 bp, Homo sapiens
gaggaaagggcctggccagtcc

SEQ ID NO: 6243310 - DNA, 12 bp, Homo sapiens
gaggaaagtcat

SEQ ID NO: 6243311 - DNA, 20 bp, Homo sapiens
gaggaaagtcattggcttta

SEQ ID NO: 6243312 - DNA, 19 bp, Homo sapiens
gaggaaataacagagagaa

SEQ ID NO: 6243313 - DNA, 17 bp, Homo sapiens
gaggaaataactaagag

SEQ ID NO: 6243314 - DNA, 18 bp, Homo sapiens
gaggaaataactaagaga

SEQ ID NO: 6243315 - DNA, 12 bp, Homo sapiens
gaggaaatcaaa

SEQ ID NO: 6243316 - DNA, 14 bp, Homo sapiens
gaggaaatccggtc

SEQ ID NO: 6243317 - DNA, 20 bp, Homo sapiens
gaggaacaagcatgtctctc

SEQ ID NO: 6243318 - DNA, 19 bp, Homo sapiens
gaggaacaatcggctgcat

SEQ ID NO: 6243319 - DNA, 17 bp, Homo sapiens
gaggaacaggtggatgt

SEQ ID NO: 6243320 - DNA, 12 bp, Homo sapiens
gaggaacagtgg

SEQ ID NO: 6243321 - DNA, 18 bp, Homo sapiens
gaggaaccagagccatgg

SEQ ID NO: 6243322 - DNA, 22 bp, Homo sapiens
gaggaaccagagccatggactc

SEQ ID NO: 6243323 - DNA, 18 bp, Homo sapiens
gaggaaccagaggcactt

SEQ ID NO: 6243324 - DNA, 21 bp, Homo sapiens
gccagggagacagagctcaca

SEQ ID NO: 6243325 - DNA, 15 bp, Homo sapiens
gccagggagacctgg

SEQ ID NO: 6243326 - DNA, 16 bp, Homo sapiens
gccagggagagcccag

SEQ ID NO: 6243327 - DNA, 22 bp, Homo sapiens
gccagggagagcccaggagctc

SEQ ID NO: 6243328 - DNA, 11 bp, Homo sapiens
gccagggagct

SEQ ID NO: 6243329 - DNA, 14 bp, Homo sapiens
gccagggagcttgc

SEQ ID NO: 6243330 - DNA, 10 bp, Homo sapiens
gccagggagg

SEQ ID NO: 6243331 - DNA, 15 bp, Homo sapiens
gccagggaggcagag

SEQ ID NO: 6243332 - DNA, 14 bp, Homo sapiens
gccagggaggcgca

SEQ ID NO: 6243333 - DNA, 17 bp, Homo sapiens
gccagggaggcgcaggg

SEQ ID NO: 6243334 - DNA, 20 bp, Homo sapiens
gccagggaggcgcagggaca

SEQ ID NO: 6243335 - DNA, 21 bp, Homo sapiens
gccagggaggcgcagggacat

SEQ ID NO: 6243336 - DNA, 22 bp, Homo sapiens
gccagggaggcgcagggacatg

SEQ ID NO: 6243337 - DNA, 11 bp, Homo sapiens
gccagggatgg

SEQ ID NO: 6243338 - DNA, 20 bp, Homo sapiens
gccagggatggcagtggctg

SEQ ID NO: 6243339 - DNA, 19 bp, Homo sapiens
gccagggatgggcagccca

SEQ ID NO: 6243340 - DNA, 23 bp, Homo sapiens
gccagggatgggcagcccaacag

SEQ ID NO: 6243341 - DNA, 16 bp, Homo sapiens
gccagggcaatgccat

SEQ ID NO: 6243342 - DNA, 21 bp, Homo sapiens
gccagggcaatgccatcagcc

SEQ ID NO: 6243343 - DNA, 13 bp, Homo sapiens
gccagggcagagg

SEQ ID NO: 6243344 - DNA, 18 bp, Homo sapiens
gccagggcagaggaatgt

SEQ ID NO: 6243345 - DNA, 16 bp, Homo sapiens
gccagggcagagtgag

SEQ ID NO: 6243346 - DNA, 15 bp, Homo sapiens
gccagggcagatgtg

SEQ ID NO: 6243347 - DNA, 21 bp, Homo sapiens
gccagggcaggctaccccttc

SEQ ID NO: 6243348 - DNA, 13 bp, Homo sapiens
gccagggcagggc

SEQ ID NO: 6243349 - DNA, 14 bp, Homo sapiens
gccagggcagggcg

SEQ ID NO: 6243350 - DNA, 15 bp, Homo sapiens
gccagggcagggcga

SEQ ID NO: 6243351 - DNA, 17 bp, Homo sapiens
gccagggcagggcgagc

SEQ ID NO: 6243352 - DNA, 15 bp, Homo sapiens
gccagggcagggtct

SEQ ID NO: 6243353 - DNA, 14 bp, Homo sapiens
gccagggcatgtgt

SEQ ID NO: 6243354 - DNA, 15 bp, Homo sapiens
gccagggccacgctc

SEQ ID NO: 6243355 - DNA, 19 bp, Homo sapiens
gccagggccacgctccagc

SEQ ID NO: 6243356 - DNA, 21 bp, Homo sapiens
gccagggccatgtcagacaca

SEQ ID NO: 6243357 - DNA, 18 bp, Homo sapiens
gccagggcccaccccagc

SEQ ID NO: 6243358 - DNA, 22 bp, Homo sapiens
gccagggcccaccccagcctcg

SEQ ID NO: 6243359 - DNA, 14 bp, Homo sapiens
gccagggcccaggc

SEQ ID NO: 6243360 - DNA, 15 bp, Homo sapiens
gccagggcccaggcc

SEQ ID NO: 6243361 - DNA, 13 bp, Homo sapiens
gccagggcccctc

SEQ ID NO: 6243362 - DNA, 17 bp, Homo sapiens
gccagggcccctctccc

SEQ ID NO: 6243363 - DNA, 22 bp, Homo sapiens
gccagggcccctctccccaggg

SEQ ID NO: 6243364 - DNA, 14 bp, Homo sapiens
gccagggccgcggc

SEQ ID NO: 6243365 - DNA, 17 bp, Homo sapiens
gccagggccgcggccgc

SEQ ID NO: 6243366 - DNA, 15 bp, Homo sapiens
gccagggcctctgtg

SEQ ID NO: 6243367 - DNA, 13 bp, Homo sapiens
gccagggcctgcg

SEQ ID NO: 6243368 - DNA, 15 bp, Homo sapiens
gccagggcctggaag

SEQ ID NO: 6243369 - DNA, 15 bp, Homo sapiens
gccagggcctggtgt

SEQ ID NO: 6243370 - DNA, 21 bp, Homo sapiens
gccagggcggccagggaccca

SEQ ID NO: 6243371 - DNA, 10 bp, Homo sapiens
gccagggctc

SEQ ID NO: 6243372 - DNA, 15 bp, Homo sapiens
gccagggctccacgg

SEQ ID NO: 6243373 - DNA, 17 bp, Homo sapiens
gccagggctcgggcgct

SEQ ID NO: 6243374 - DNA, 18 bp, Homo sapiens
gccagggctctgggggca

SEQ ID NO: 6243375 - DNA, 21 bp, Homo sapiens
gccagggctctgggggcagat

SEQ ID NO: 6243376 - DNA, 14 bp, Homo sapiens
gccagggctgcccc

SEQ ID NO: 6243377 - DNA, 18 bp, Homo sapiens
gccagggctggatggaca

SEQ ID NO: 6243378 - DNA, 13 bp, Homo sapiens
gccagggctgggg

SEQ ID NO: 6243379 - DNA, 23 bp, Homo sapiens
gccagggctggggttgccagagg

SEQ ID NO: 6243380 - DNA, 24 bp, Homo sapiens
gccagggctggggttgccagaggc

SEQ ID NO: 6243381 - DNA, 15 bp, Homo sapiens
gccagggctgggtca

SEQ ID NO: 6243382 - DNA, 17 bp, Homo sapiens
gccagggctgggtcaca

SEQ ID NO: 6243383 - DNA, 16 bp, Homo sapiens
gccagggctgtcctta

SEQ ID NO: 6243384 - DNA, 23 bp, Homo sapiens
gccagggcttccccatcagctcc

SEQ ID NO: 6243385 - DNA, 22 bp, Homo sapiens
gccagggcttgtggactctctg

SEQ ID NO: 6243386 - DNA, 22 bp, Homo sapiens
gccaggggaaaatcagcctgct

SEQ ID NO: 6243387 - DNA, 23 bp, Homo sapiens
gccaggggaaaatcagcctgctc

SEQ ID NO: 6243388 - DNA, 20 bp, Homo sapiens
gccaggggatctgggtgtgt

SEQ ID NO: 6243389 - DNA, 17 bp, Homo sapiens
gccaggggcaggcaggg

SEQ ID NO: 6243390 - DNA, 15 bp, Homo sapiens
gccaggggccaggag

SEQ ID NO: 6243391 - DNA, 13 bp, Homo sapiens
gccaggggcgagg

SEQ ID NO: 6243392 - DNA, 18 bp, Homo sapiens
gccaggggctctgtggca

SEQ ID NO: 6243393 - DNA, 16 bp, Homo sapiens
gccaggggcttttgct

SEQ ID NO: 6243394 - DNA, 22 bp, Homo sapiens
gccaggggggtgaggagctggg

SEQ ID NO: 6243395 - DNA, 16 bp, Homo sapiens
gccaggggtaacctgg

SEQ ID NO: 6243396 - DNA, 18 bp, Homo sapiens
gccaggggtaacctggcc

SEQ ID NO: 6243397 - DNA, 18 bp, Homo sapiens
gccaggggtgctcctgtg

SEQ ID NO: 6243398 - DNA, 19 bp, Homo sapiens
gccaggggtggtgagggca

SEQ ID NO: 6243399 - DNA, 19 bp, Homo sapiens
gccaggggtgtcccagtcc

SEQ ID NO: 6243400 - DNA, 22 bp, Homo sapiens
gccaggggtgtcccagtcccag

SEQ ID NO: 6243401 - DNA, 19 bp, Homo sapiens
gccaggggttctgagaagc

SEQ ID NO: 6243402 - DNA, 22 bp, Homo sapiens
gccaggggttctgagaagcgct

SEQ ID NO: 6243403 - DNA, 21 bp, Homo sapiens
gccagggtagagcaaaggaga

SEQ ID NO: 6243404 - DNA, 12 bp, Homo sapiens
gccagggtctcg

SEQ ID NO: 6243405 - DNA, 17 bp, Homo sapiens
gccagggtctctccctc

SEQ ID NO: 6243406 - DNA, 18 bp, Homo sapiens
gccagggtctctccctca

SEQ ID NO: 6243407 - DNA, 20 bp, Homo sapiens
gccagggtctctccctcagg

SEQ ID NO: 6243408 - DNA, 16 bp, Homo sapiens
gccagggtgagcaggg

SEQ ID NO: 6243409 - DNA, 15 bp, Homo sapiens
gccagggtgctgtcg

SEQ ID NO: 6243410 - DNA, 15 bp, Homo sapiens
gccagggtgggaaga

SEQ ID NO: 6243411 - DNA, 20 bp, Homo sapiens
gccagggtgggaagagaaga

SEQ ID NO: 6243412 - DNA, 16 bp, Homo sapiens
gccagggtgggctggg

SEQ ID NO: 6243413 - DNA, 17 bp, Homo sapiens
gccagggtgggctgggg

SEQ ID NO: 6243414 - DNA, 20 bp, Homo sapiens
gccagggtgggctggggact

SEQ ID NO: 6243415 - DNA, 20 bp, Homo sapiens
gccagggtgggtgtccatgt

SEQ ID NO: 6243416 - DNA, 20 bp, Homo sapiens
gccagggtggtcttgatctc

SEQ ID NO: 6243417 - DNA, 23 bp, Homo sapiens
gccagggtgtgactcgggagctg

SEQ ID NO: 6243418 - DNA, 14 bp, Homo sapiens
gccagggttccaga

SEQ ID NO: 6243419 - DNA, 22 bp, Homo sapiens
gccagggttgtgctttctagca

SEQ ID NO: 6243420 - DNA, 19 bp, Homo sapiens
gccaggtacaggagaggca

SEQ ID NO: 6243421 - DNA, 22 bp, Homo sapiens
gccaggtacaggagaggcagca

SEQ ID NO: 6243422 - DNA, 22 bp, Homo sapiens
gccaggtactgcattctctccc

SEQ ID NO: 6243423 - DNA, 17 bp, Homo sapiens
gccaggtatttttctat

SEQ ID NO: 6243424 - DNA, 21 bp, Homo sapiens
gccaggtcaccctttgctgtg

SEQ ID NO: 6243425 - DNA, 17 bp, Homo sapiens
gccaggtccccctgcag

SEQ ID NO: 6243426 - DNA, 14 bp, Homo sapiens
gccaggtccctgga

SEQ ID NO: 6243427 - DNA, 18 bp, Homo sapiens
gccaggtccctggaccag

SEQ ID NO: 6243428 - DNA, 16 bp, Homo sapiens
gccaggtccttgccct

SEQ ID NO: 6243429 - DNA, 16 bp, Homo sapiens
gccaggtctcctggga

SEQ ID NO: 6243430 - DNA, 17 bp, Homo sapiens
gccaggtctcctgggaa

SEQ ID NO: 6243431 - DNA, 20 bp, Homo sapiens
gccaggtctgactccaaagc

SEQ ID NO: 6243432 - DNA, 21 bp, Homo sapiens
gccaggtctgactccaaagct

SEQ ID NO: 6243433 - DNA, 22 bp, Homo sapiens
gccaggtctgactccaaagctg

SEQ ID NO: 6243434 - DNA, 14 bp, Homo sapiens
gccaggtctggcgc

SEQ ID NO: 6243435 - DNA, 21 bp, Homo sapiens
gccaggtgactgtctggggag

SEQ ID NO: 6243436 - DNA, 15 bp, Homo sapiens
gccaggtgagaaact

SEQ ID NO: 6243437 - DNA, 16 bp, Homo sapiens
gccaggtgaggtccac

SEQ ID NO: 6243438 - DNA, 17 bp, Homo sapiens
gccaggtgaggtccacc

SEQ ID NO: 6243439 - DNA, 17 bp, Homo sapiens
gccaggtgcggcctggg

SEQ ID NO: 6243440 - DNA, 22 bp, Homo sapiens
gccaggtgcggcctggggggaa

SEQ ID NO: 6243441 - DNA, 18 bp, Homo sapiens
gccaggtggcacctgcag

SEQ ID NO: 6243442 - DNA, 18 bp, Homo sapiens
gccaggtggccactccag

SEQ ID NO: 6243443 - DNA, 20 bp, Homo sapiens
gccaggtggttgtcttattg

SEQ ID NO: 6243444 - DNA, 22 bp, Homo sapiens
gccaggttagcctttgccctgt

SEQ ID NO: 6243445 - DNA, 19 bp, Homo sapiens
gccaggttatgcctcatgc

SEQ ID NO: 6243446 - DNA, 18 bp, Homo sapiens
gccaggttcacactcaga

SEQ ID NO: 6243447 - DNA, 19 bp, Homo sapiens
gccaggttctatttggaat

SEQ ID NO: 6243448 - DNA, 23 bp, Homo sapiens
gccaggttctatttggaatttat

SEQ ID NO: 6243449 - DNA, 23 bp, Homo sapiens
gccaggttctccgttagctcctg

SEQ ID NO: 6243450 - DNA, 14 bp, Homo sapiens
gccaggttgcagct

SEQ ID NO: 6243451 - DNA, 16 bp, Homo sapiens
gccaggttgcagctgc

SEQ ID NO: 6243452 - DNA, 19 bp, Homo sapiens
gccaggttgcagctgctct

SEQ ID NO: 6243453 - DNA, 18 bp, Homo sapiens
gccaggttgctaagaaac

SEQ ID NO: 6243454 - DNA, 16 bp, Homo sapiens
gccaggttgtgtccca

SEQ ID NO: 6243455 - DNA, 13 bp, Homo sapiens
gccaggttttctg

SEQ ID NO: 6243456 - DNA, 23 bp, Homo sapiens
gccagtaaaatactattgcctca

SEQ ID NO: 6243457 - DNA, 12 bp, Homo sapiens
gccagtaaatgg

SEQ ID NO: 6243458 - DNA, 22 bp, Homo sapiens
gccagtaacacaggccaccctg

SEQ ID NO: 6243459 - DNA, 15 bp, Homo sapiens
gccagtaacaggctc

SEQ ID NO: 6243460 - DNA, 14 bp, Homo sapiens
gccagtaatcccag

SEQ ID NO: 6243461 - DNA, 15 bp, Homo sapiens
gccagtaatctttat

SEQ ID NO: 6243462 - DNA, 19 bp, Homo sapiens
gccagtaattcgtttgcta

SEQ ID NO: 6243463 - DNA, 16 bp, Homo sapiens
gccagtacttgtcata

SEQ ID NO: 6243464 - DNA, 19 bp, Homo sapiens
gccagtagagagtgccctt

SEQ ID NO: 6243465 - DNA, 21 bp, Homo sapiens
gccagtaggagacacgacagc

SEQ ID NO: 6243466 - DNA, 16 bp, Homo sapiens
gccagtagtaccttgt

SEQ ID NO: 6243467 - DNA, 18 bp, Homo sapiens
gccagtagtaccttgttt

SEQ ID NO: 6243468 - DNA, 21 bp, Homo sapiens
gccagtatctatatatgtgta

SEQ ID NO: 6243469 - DNA, 23 bp, Homo sapiens
gccagtattagactggaagttca

SEQ ID NO: 6243470 - DNA, 14 bp, Homo sapiens
gccagtatttttta

SEQ ID NO: 6243471 - DNA, 18 bp, Homo sapiens
gccagtcaccccggccac

SEQ ID NO: 6243472 - DNA, 21 bp, Homo sapiens
gccagtcaccccggccacctg

SEQ ID NO: 6243473 - DNA, 14 bp, Homo sapiens
gccagtcaccttct

SEQ ID NO: 6243474 - DNA, 15 bp, Homo sapiens
gccagtcaccttctg

SEQ ID NO: 6243475 - DNA, 16 bp, Homo sapiens
gccagtcaccttctgg

SEQ ID NO: 6243476 - DNA, 18 bp, Homo sapiens
gccagtcactgctgcaag

SEQ ID NO: 6243477 - DNA, 20 bp, Homo sapiens
gccagtcagacgccaggcac

SEQ ID NO: 6243478 - DNA, 13 bp, Homo sapiens
gccagtcagcaac

SEQ ID NO: 6243479 - DNA, 12 bp, Homo sapiens
gccagtcaggcc

SEQ ID NO: 6243480 - DNA, 14 bp, Homo sapiens
gccagtcagggccc

SEQ ID NO: 6243481 - DNA, 20 bp, Homo sapiens
gccagtccaggctgccgtgg

SEQ ID NO: 6243482 - DNA, 15 bp, Homo sapiens
gccagtcccacggct

SEQ ID NO: 6243483 - DNA, 23 bp, Homo sapiens
gccagtcccacggctctgtgccc

SEQ ID NO: 6243484 - DNA, 24 bp, Homo sapiens
gccagtcccacggctctgtgcccg

SEQ ID NO: 6243485 - DNA, 11 bp, Homo sapiens
gccagtcccag

SEQ ID NO: 6243486 - DNA, 23 bp, Homo sapiens
gccagtccccgaggagctgggcc

SEQ ID NO: 6243487 - DNA, 13 bp, Homo sapiens
gccagtccccgct

SEQ ID NO: 6243488 - DNA, 16 bp, Homo sapiens
gccagtccctgaggca

SEQ ID NO: 6243489 - DNA, 13 bp, Homo sapiens
gccagtcctagag

SEQ ID NO: 6243490 - DNA, 22 bp, Homo sapiens
gccagtcctagagctcctgtcc

SEQ ID NO: 6243491 - DNA, 22 bp, Homo sapiens
gccagtcctagctgcacagggc

SEQ ID NO: 6243492 - DNA, 22 bp, Homo sapiens
gccagtcctaggcccctgccct

SEQ ID NO: 6243493 - DNA, 16 bp, Homo sapiens
gccagtcctcctcagg

SEQ ID NO: 6243494 - DNA, 19 bp, Homo sapiens
gccagtcctcctgggagcc

SEQ ID NO: 6243495 - DNA, 16 bp, Homo sapiens
gccagtcctgcaggag

SEQ ID NO: 6243496 - DNA, 14 bp, Homo sapiens
gccagtcctgcctg

SEQ ID NO: 6243497 - DNA, 18 bp, Homo sapiens
gccagtcctgcctggcca

SEQ ID NO: 6243498 - DNA, 19 bp, Homo sapiens
gccagtcctgcctggccag

SEQ ID NO: 6243499 - DNA, 14 bp, Homo sapiens
gccagtcctggttg

SEQ ID NO: 6243500 - DNA, 19 bp, Homo sapiens
gccagtcgcgctgcctgtg

SEQ ID NO: 6243501 - DNA, 21 bp, Homo sapiens
gccagtcgggagagccaggct

SEQ ID NO: 6243502 - DNA, 22 bp, Homo sapiens
gccagtctcactgtgggaaggc

SEQ ID NO: 6243503 - DNA, 16 bp, Homo sapiens
gccagtctcagagacc

SEQ ID NO: 6243504 - DNA, 17 bp, Homo sapiens
gccagtctcagagacca

SEQ ID NO: 6243505 - DNA, 13 bp, Homo sapiens
gccagtctcagat

SEQ ID NO: 6243506 - DNA, 14 bp, Homo sapiens
gccagtctcattgt

SEQ ID NO: 6243507 - DNA, 18 bp, Homo sapiens
gccagtctcctataccca

SEQ ID NO: 6243508 - DNA, 24 bp, Homo sapiens
gccagtctcctatacccagcagag

SEQ ID NO: 6243509 - DNA, 14 bp, Homo sapiens
gccagtctgcccga

SEQ ID NO: 6243510 - DNA, 17 bp, Homo sapiens
gccagtctgggctgccg

SEQ ID NO: 6243511 - DNA, 20 bp, Homo sapiens
gccagtctgtggatcagaga

SEQ ID NO: 6243512 - DNA, 14 bp, Homo sapiens
gccagtcttcctct

SEQ ID NO: 6243513 - DNA, 20 bp, Homo sapiens
gccagtcttgcctaggccaa

SEQ ID NO: 6243514 - DNA, 23 bp, Homo sapiens
gccagtcttgcctaggccaaatg

SEQ ID NO: 6243515 - DNA, 13 bp, Homo sapiens
gccagtcttgtgt

SEQ ID NO: 6243516 - DNA, 13 bp, Homo sapiens
gccagtgacagac

SEQ ID NO: 6243517 - DNA, 17 bp, Homo sapiens
gccagtgacctgaggaa

SEQ ID NO: 6243518 - DNA, 15 bp, Homo sapiens
gccagtgactccagg

SEQ ID NO: 6243519 - DNA, 16 bp, Homo sapiens
gccagtgactccagga

SEQ ID NO: 6243520 - DNA, 14 bp, Homo sapiens
gccagtgactgctg

SEQ ID NO: 6243521 - DNA, 16 bp, Homo sapiens
gccagtgactgctgcg

SEQ ID NO: 6243522 - DNA, 22 bp, Homo sapiens
gccagtgactgctgcgctgtgc

SEQ ID NO: 6243523 - DNA, 15 bp, Homo sapiens
gccagtgactttttc

SEQ ID NO: 6243524 - DNA, 19 bp, Homo sapiens
gccagtgactttttctgag

SEQ ID NO: 6243525 - DNA, 15 bp, Homo sapiens
gccagtgagccactc

SEQ ID NO: 6243526 - DNA, 17 bp, Homo sapiens
gccagtgatgatgtttt

SEQ ID NO: 6243527 - DNA, 20 bp, Homo sapiens
gccagtgatgctaaaggttg

SEQ ID NO: 6243528 - DNA, 17 bp, Homo sapiens
gccagtgatgtgcggtg

SEQ ID NO: 6243529 - DNA, 16 bp, Homo sapiens
gccagtgcagccactg

SEQ ID NO: 6243530 - DNA, 17 bp, Homo sapiens
gccagtgcagccactgg

SEQ ID NO: 6243531 - DNA, 17 bp, Homo sapiens
gccagtgccaggacagc

SEQ ID NO: 6243532 - DNA, 13 bp, Homo sapiens
gccagtgccaggg

SEQ ID NO: 6243533 - DNA, 14 bp, Homo sapiens
gccagtgccagggt

SEQ ID NO: 6243534 - DNA, 17 bp, Homo sapiens
gccagtgccagggtggg

SEQ ID NO: 6243535 - DNA, 18 bp, Homo sapiens
gccagtgccctgagccag

SEQ ID NO: 6243536 - DNA, 11 bp, Homo sapiens
gccagtgcctt

SEQ ID NO: 6243537 - DNA, 20 bp, Homo sapiens
gccagtgccttacctcctgc

SEQ ID NO: 6243538 - DNA, 23 bp, Homo sapiens
gccagtgccttacctcctgccca

SEQ ID NO: 6243539 - DNA, 14 bp, Homo sapiens
gccagtgctcaagg

SEQ ID NO: 6243540 - DNA, 15 bp, Homo sapiens
gccagtgctccagcc

SEQ ID NO: 6243541 - DNA, 16 bp, Homo sapiens
gccagtgctgcttctt

SEQ ID NO: 6243542 - DNA, 18 bp, Homo sapiens
gccagtggaaattcaggt

SEQ ID NO: 6243543 - DNA, 13 bp, Homo sapiens
gccagtggacaga

SEQ ID NO: 6243544 - DNA, 13 bp, Homo sapiens
gccagtggagacg

SEQ ID NO: 6243545 - DNA, 23 bp, Homo sapiens
gccagtggagctggtctgccagg

SEQ ID NO: 6243546 - DNA, 20 bp, Homo sapiens
gccagtggcccccgggcctg

SEQ ID NO: 6243547 - DNA, 18 bp, Homo sapiens
gccagtggccgaaccccc

SEQ ID NO: 6243548 - DNA, 14 bp, Homo sapiens
gccagtggctgggg

SEQ ID NO: 6243549 - DNA, 12 bp, Homo sapiens
gccagtgggcct

SEQ ID NO: 6243550 - DNA, 14 bp, Homo sapiens
gccagtgggcctgg

SEQ ID NO: 6243551 - DNA, 19 bp, Homo sapiens
gccagtgggcctggtagca

SEQ ID NO: 6243552 - DNA, 18 bp, Homo sapiens
gccagtggggcctgtgga

SEQ ID NO: 6243553 - DNA, 18 bp, Homo sapiens
gccagtggtggaggtggg

SEQ ID NO: 6243554 - DNA, 16 bp, Homo sapiens
gccagtgtctaggcac

SEQ ID NO: 6243555 - DNA, 22 bp, Homo sapiens
gccagtgtctgtcccggggtcc

SEQ ID NO: 6243556 - DNA, 14 bp, Homo sapiens
gccagtgtctttct

SEQ ID NO: 6243557 - DNA, 15 bp, Homo sapiens
gccagtgtctttctt

SEQ ID NO: 6243558 - DNA, 17 bp, Homo sapiens
gccagtgtgatcccaag

SEQ ID NO: 6243559 - DNA, 20 bp, Homo sapiens
gccagtgtgatcccaagtgc

SEQ ID NO: 6243560 - DNA, 19 bp, Homo sapiens
gccagtgtgttactcatct

SEQ ID NO: 6243561 - DNA, 24 bp, Homo sapiens
gccagtgtttagaagagcctgact

SEQ ID NO: 6243562 - DNA, 19 bp, Homo sapiens
gccagtgtttctgaatgtt

SEQ ID NO: 6243563 - DNA, 15 bp, Homo sapiens
gccagttacttgggc

SEQ ID NO: 6243564 - DNA, 18 bp, Homo sapiens
gccagttacttgggcttc

SEQ ID NO: 6243565 - DNA, 17 bp, Homo sapiens
gccagttagactagtcc

SEQ ID NO: 6243566 - DNA, 21 bp, Homo sapiens
gccagttcagtacctggagga

SEQ ID NO: 6243567 - DNA, 22 bp, Homo sapiens
gccagttcagtacctggaggag

SEQ ID NO: 6243568 - DNA, 18 bp, Homo sapiens
gccagttcatctttttat

SEQ ID NO: 6243569 - DNA, 14 bp, Homo sapiens
gccagttctctgtg

SEQ ID NO: 6243570 - DNA, 22 bp, Homo sapiens
gccagttgatctgctctgtttt

SEQ ID NO: 6243571 - DNA, 15 bp, Homo sapiens
gccagttgcccagag

SEQ ID NO: 6243572 - DNA, 16 bp, Homo sapiens
gccagttgcccagagc

SEQ ID NO: 6243573 - DNA, 18 bp, Homo sapiens
gccagttgcccagagcac

SEQ ID NO: 6243574 - DNA, 19 bp, Homo sapiens
gccagttgggctcgcactg

SEQ ID NO: 6243575 - DNA, 16 bp, Homo sapiens
gccagttggtccccct

SEQ ID NO: 6243576 - DNA, 21 bp, Homo sapiens
gccagttggtcccccttccat

SEQ ID NO: 6243577 - DNA, 23 bp, Homo sapiens
gccagttggtcccccttccatgg

SEQ ID NO: 6243578 - DNA, 15 bp, Homo sapiens
gccagttggtggggc

SEQ ID NO: 6243579 - DNA, 18 bp, Homo sapiens
gccagttggtggggccag

SEQ ID NO: 6243580 - DNA, 22 bp, Homo sapiens
gccagttggtggggccaggcca

SEQ ID NO: 6243581 - DNA, 23 bp, Homo sapiens
gccagttggtggggccaggccag

SEQ ID NO: 6243582 - DNA, 16 bp, Homo sapiens
gccagttggtgttcct

SEQ ID NO: 6243583 - DNA, 16 bp, Homo sapiens
gccagttgtcctcctt

SEQ ID NO: 6243584 - DNA, 20 bp, Homo sapiens
gccagtttctctgccttctt

SEQ ID NO: 6243585 - DNA, 18 bp, Homo sapiens
gccagtttgaagcctgtg

SEQ ID NO: 6243586 - DNA, 20 bp, Homo sapiens
gccagtttgcttagttctca

SEQ ID NO: 6243587 - DNA, 20 bp, Homo sapiens
gccagttttcggaaacactg

SEQ ID NO: 6243588 - DNA, 15 bp, Homo sapiens
gccagttttctggta

SEQ ID NO: 6243589 - DNA, 17 bp, Homo sapiens
gccagttttctgttcag

SEQ ID NO: 6243590 - DNA, 20 bp, Homo sapiens
gccagtttttaaaatgctgc

SEQ ID NO: 6243591 - DNA, 21 bp, Homo sapiens
gccataaaacattaagaaaat

SEQ ID NO: 6243592 - DNA, 22 bp, Homo sapiens
gccataaaacattaagaaaatc

SEQ ID NO: 6243593 - DNA, 20 bp, Homo sapiens
gccataaaatctcacgctgc

SEQ ID NO: 6243594 - DNA, 18 bp, Homo sapiens
gccataacgtgcccccag

SEQ ID NO: 6243595 - DNA, 20 bp, Homo sapiens
gccataacgtgcccccagag

SEQ ID NO: 6243596 - DNA, 21 bp, Homo sapiens
gccataacgtgcccccagagt

SEQ ID NO: 6243597 - DNA, 19 bp, Homo sapiens
gccataacttgtttgtaaa

SEQ ID NO: 6243598 - DNA, 21 bp, Homo sapiens
gccataagcaacaattttcag

SEQ ID NO: 6243599 - DNA, 16 bp, Homo sapiens
gccataagcaggagtt

SEQ ID NO: 6243600 - DNA, 16 bp, Homo sapiens
gccataattatgaaaa

SEQ ID NO: 6243601 - DNA, 21 bp, Homo sapiens
gccatacatgttattgttttc

SEQ ID NO: 6243602 - DNA, 14 bp, Homo sapiens
gccataccttctcc

SEQ ID NO: 6243603 - DNA, 14 bp, Homo sapiens
gccatactggcctc

SEQ ID NO: 6243604 - DNA, 18 bp, Homo sapiens
gccatactggcctcgcct

SEQ ID NO: 6243605 - DNA, 16 bp, Homo sapiens
gccatactttgtctga

SEQ ID NO: 6243606 - DNA, 19 bp, Homo sapiens
gccatagacctacagacct

SEQ ID NO: 6243607 - DNA, 21 bp, Homo sapiens
gccatagacctacagacctgg

SEQ ID NO: 6243608 - DNA, 15 bp, Homo sapiens
gccatagaggcccag

SEQ ID NO: 6243609 - DNA, 18 bp, Homo sapiens
gccatagaggcccaggca

SEQ ID NO: 6243610 - DNA, 19 bp, Homo sapiens
gccatagagtacactgcct

SEQ ID NO: 6243611 - DNA, 16 bp, Homo sapiens
gccatagatgctggct

SEQ ID NO: 6243612 - DNA, 18 bp, Homo sapiens
gccatagccaggagcgca

SEQ ID NO: 6243613 - DNA, 13 bp, Homo sapiens
gccatagccccag

SEQ ID NO: 6243614 - DNA, 18 bp, Homo sapiens
gccatagccccaggcccg

SEQ ID NO: 6243615 - DNA, 15 bp, Homo sapiens
gccatagctcctgct

SEQ ID NO: 6243616 - DNA, 23 bp, Homo sapiens
gccatagctcctgctccacagcc

SEQ ID NO: 6243617 - DNA, 17 bp, Homo sapiens
gccatagctgatcatgt

SEQ ID NO: 6243618 - DNA, 14 bp, Homo sapiens
gccataggccaagg

SEQ ID NO: 6243619 - DNA, 17 bp, Homo sapiens
gccataggccaaggtgc

SEQ ID NO: 6243620 - DNA, 15 bp, Homo sapiens
gccatagggggctgc

SEQ ID NO: 6243621 - DNA, 19 bp, Homo sapiens
gccatagggggctgcacgg

SEQ ID NO: 6243622 - DNA, 14 bp, Homo sapiens
gccatagggtctgc

SEQ ID NO: 6243623 - DNA, 23 bp, Homo sapiens
gccatagtcaaagagagttttta

SEQ ID NO: 6243624 - DNA, 21 bp, Homo sapiens
gccatagtcattctgcctgcc

SEQ ID NO: 6243625 - DNA, 22 bp, Homo sapiens
gccatataagtttgaaggaaac

SEQ ID NO: 6243626 - DNA, 23 bp, Homo sapiens
gccatataagtttgaaggaaaca

SEQ ID NO: 6243627 - DNA, 21 bp, Homo sapiens
gccatatataacagatacatt

SEQ ID NO: 6243628 - DNA, 15 bp, Homo sapiens
gccatatcaccagtc

SEQ ID NO: 6243629 - DNA, 21 bp, Homo sapiens
gccatatcatgctaaaattct

SEQ ID NO: 6243630 - DNA, 22 bp, Homo sapiens
gccatatgtgctatggagagga

SEQ ID NO: 6243631 - DNA, 16 bp, Homo sapiens
gccatattaaattttt

SEQ ID NO: 6243632 - DNA, 23 bp, Homo sapiens
gccatattaaattttttgttgac

SEQ ID NO: 6243633 - DNA, 16 bp, Homo sapiens
gccatattcacacctc

SEQ ID NO: 6243634 - DNA, 19 bp, Homo sapiens
gccatattctgttggccag

SEQ ID NO: 6243635 - DNA, 20 bp, Homo sapiens
gccatattctgttggccagt

SEQ ID NO: 6243636 - DNA, 21 bp, Homo sapiens
gccatattgcacatgtcttaa

SEQ ID NO: 6243637 - DNA, 22 bp, Homo sapiens
gccatattgtcacctcagcact

SEQ ID NO: 6243638 - DNA, 19 bp, Homo sapiens
gccatatttacctcagcct

SEQ ID NO: 6243639 - DNA, 21 bp, Homo sapiens
gccatatttacctcagcctgg

SEQ ID NO: 6243640 - DNA, 22 bp, Homo sapiens
gccatatttacctcagcctggg

SEQ ID NO: 6243641 - DNA, 22 bp, Homo sapiens
gccatatttttctgtgtggagt

SEQ ID NO: 6243642 - DNA, 19 bp, Homo sapiens
gccatcaaaatgcttttta

SEQ ID NO: 6243643 - DNA, 17 bp, Homo sapiens
gccatcaaacctgggta

SEQ ID NO: 6243644 - DNA, 15 bp, Homo sapiens
gccatcaactaaagt

SEQ ID NO: 6243645 - DNA, 21 bp, Homo sapiens
gccatcaactaaagttgtact

SEQ ID NO: 6243646 - DNA, 15 bp, Homo sapiens
gccatcaagagactg

SEQ ID NO: 6243647 - DNA, 14 bp, Homo sapiens
gccatcaagcactt

SEQ ID NO: 6243648 - DNA, 18 bp, Homo sapiens
gccatcaagcacttccca

SEQ ID NO: 6243649 - DNA, 24 bp, Homo sapiens
gccatcaataaaaaattatgacat

SEQ ID NO: 6243650 - DNA, 16 bp, Homo sapiens
gccatcacaaggggaa

SEQ ID NO: 6243651 - DNA, 13 bp, Homo sapiens
gccatcacaggat

SEQ ID NO: 6243652 - DNA, 22 bp, Homo sapiens
gccatcacatgatctgtttttc

SEQ ID NO: 6243653 - DNA, 14 bp, Homo sapiens
gccatcaccgctgg

SEQ ID NO: 6243654 - DNA, 14 bp, Homo sapiens
gccatcacctcaga

SEQ ID NO: 6243655 - DNA, 20 bp, Homo sapiens
gccatcaccttagaccacca

SEQ ID NO: 6243656 - DNA, 22 bp, Homo sapiens
gccatcaccttagaccaccaag

SEQ ID NO: 6243657 - DNA, 18 bp, Homo sapiens
gccatcactagaagaaaa

SEQ ID NO: 6243658 - DNA, 14 bp, Homo sapiens
gccatcactcagcc

SEQ ID NO: 6243659 - DNA, 18 bp, Homo sapiens
gccatcactcagccccta

SEQ ID NO: 6243660 - DNA, 18 bp, Homo sapiens
gccatcacttctccccgc

SEQ ID NO: 6243661 - DNA, 16 bp, Homo sapiens
gccatcagaaattttc

SEQ ID NO: 6243662 - DNA, 20 bp, Homo sapiens
gccatcagaagttactttta

SEQ ID NO: 6243663 - DNA, 17 bp, Homo sapiens
gccatcagcccctggga

SEQ ID NO: 6243664 - DNA, 18 bp, Homo sapiens
gccatcagcccctgggaa

SEQ ID NO: 6243665 - DNA, 21 bp, Homo sapiens
gccatcagcccctgggaacag

SEQ ID NO: 6243666 - DNA, 20 bp, Homo sapiens
gccatcagggccctgcccca

SEQ ID NO: 6243667 - DNA, 23 bp, Homo sapiens
gccatcagggccctgccccaggc

SEQ ID NO: 6243668 - DNA, 24 bp, Homo sapiens
gccatcagggtgggccactctccc

SEQ ID NO: 6243669 - DNA, 19 bp, Homo sapiens
gccatcataggaagggacc

SEQ ID NO: 6243670 - DNA, 17 bp, Homo sapiens
gccatcatatcccctgt

SEQ ID NO: 6243671 - DNA, 23 bp, Homo sapiens
gccatcatcctcccgccaggagc

SEQ ID NO: 6243672 - DNA, 15 bp, Homo sapiens
gccatcatgcccagc

SEQ ID NO: 6243673 - DNA, 20 bp, Homo sapiens
gccatcatgtgcctggaaat

SEQ ID NO: 6243674 - DNA, 13 bp, Homo sapiens
gccatcatttctg

SEQ ID NO: 6243675 - DNA, 21 bp, Homo sapiens
gccatccaaataagaaaccta

SEQ ID NO: 6243676 - DNA, 17 bp, Homo sapiens
gccatccaccctgagga

SEQ ID NO: 6243677 - DNA, 12 bp, Homo sapiens
gccatccactgt

SEQ ID NO: 6243678 - DNA, 16 bp, Homo sapiens
gaggaacccccaccag

SEQ ID NO: 6243679 - DNA, 17 bp, Homo sapiens
gaggaacccccaccaga

SEQ ID NO: 6243680 - DNA, 14 bp, Homo sapiens
gaggaacccccatg

SEQ ID NO: 6243681 - DNA, 20 bp, Homo sapiens
gaggaaccctgatctctcag

SEQ ID NO: 6243682 - DNA, 15 bp, Homo sapiens
gaggaaccgaaaggc

SEQ ID NO: 6243683 - DNA, 17 bp, Homo sapiens
gaggaacctcaaactgg

SEQ ID NO: 6243684 - DNA, 18 bp, Homo sapiens
gaggaacctctgatttat

SEQ ID NO: 6243685 - DNA, 17 bp, Homo sapiens
gaggaactccaggacga

SEQ ID NO: 6243686 - DNA, 18 bp, Homo sapiens
gaggaactcgcctcagcc

SEQ ID NO: 6243687 - DNA, 14 bp, Homo sapiens
gaggaactggtcca

SEQ ID NO: 6243688 - DNA, 20 bp, Homo sapiens
gaggaactggtccaggccag

SEQ ID NO: 6243689 - DNA, 19 bp, Homo sapiens
gaggaactgtccagagagc

SEQ ID NO: 6243690 - DNA, 23 bp, Homo sapiens
gaggaacttgctgctgtgcctgc

SEQ ID NO: 6243691 - DNA, 23 bp, Homo sapiens
gaggaagaacggggctcttctca

SEQ ID NO: 6243692 - DNA, 17 bp, Homo sapiens
gaggaagacaagcattt

SEQ ID NO: 6243693 - DNA, 13 bp, Homo sapiens
gaggaagactctg

SEQ ID NO: 6243694 - DNA, 14 bp, Homo sapiens
gaggaagactctgg

SEQ ID NO: 6243695 - DNA, 13 bp, Homo sapiens
gaggaagagaagc

SEQ ID NO: 6243696 - DNA, 19 bp, Homo sapiens
gaggaagagacatgagaaa

SEQ ID NO: 6243697 - DNA, 18 bp, Homo sapiens
gaggaagagagagaccct

SEQ ID NO: 6243698 - DNA, 17 bp, Homo sapiens
gaggaagagcaggcaca

SEQ ID NO: 6243699 - DNA, 14 bp, Homo sapiens
gaggaagagccacc

SEQ ID NO: 6243700 - DNA, 16 bp, Homo sapiens
gaggaagagccacctg

SEQ ID NO: 6243701 - DNA, 23 bp, Homo sapiens
gaggaagagccacctgcaagatg

SEQ ID NO: 6243702 - DNA, 15 bp, Homo sapiens
gaggaagaggctgca

SEQ ID NO: 6243703 - DNA, 15 bp, Homo sapiens
gaggaagatgaagag

SEQ ID NO: 6243704 - DNA, 20 bp, Homo sapiens
gaggaagatgaagagaagct

SEQ ID NO: 6243705 - DNA, 21 bp, Homo sapiens
gaggaagatgggggcaagaag

SEQ ID NO: 6243706 - DNA, 20 bp, Homo sapiens
gaggaagatttgtctacttg

SEQ ID NO: 6243707 - DNA, 22 bp, Homo sapiens
gaggaagatttgtctacttgct

SEQ ID NO: 6243708 - DNA, 14 bp, Homo sapiens
gaggaagcagaata

SEQ ID NO: 6243709 - DNA, 16 bp, Homo sapiens
gaggaagcagaataaa

SEQ ID NO: 6243710 - DNA, 19 bp, Homo sapiens
gaggaagcagaataaagca

SEQ ID NO: 6243711 - DNA, 21 bp, Homo sapiens
gaggaagcagaataaagcaat

SEQ ID NO: 6243712 - DNA, 19 bp, Homo sapiens
gaggaagcagttggggccc

SEQ ID NO: 6243713 - DNA, 22 bp, Homo sapiens
gaggaagcccaggctcggagga

SEQ ID NO: 6243714 - DNA, 19 bp, Homo sapiens
gaggaagccctaagacgtc

SEQ ID NO: 6243715 - DNA, 21 bp, Homo sapiens
gaggaagccggtgtccctgga

SEQ ID NO: 6243716 - DNA, 22 bp, Homo sapiens
gaggaagccggtgtccctggat

SEQ ID NO: 6243717 - DNA, 18 bp, Homo sapiens
gaggaagcctgattaaag

SEQ ID NO: 6243718 - DNA, 12 bp, Homo sapiens
gaggaagcttgg

SEQ ID NO: 6243719 - DNA, 23 bp, Homo sapiens
gaggaaggaaacaacaaaggaag

SEQ ID NO: 6243720 - DNA, 21 bp, Homo sapiens
gaggaaggaaacccagctctg

SEQ ID NO: 6243721 - DNA, 16 bp, Homo sapiens
gaggaaggacttccct

SEQ ID NO: 6243722 - DNA, 14 bp, Homo sapiens
gaggaaggaggcca

SEQ ID NO: 6243723 - DNA, 16 bp, Homo sapiens
gaggaaggaggccacg

SEQ ID NO: 6243724 - DNA, 17 bp, Homo sapiens
gaggaaggatgcaaagt

SEQ ID NO: 6243725 - DNA, 13 bp, Homo sapiens
gaggaaggcaaag

SEQ ID NO: 6243726 - DNA, 16 bp, Homo sapiens
gaggaaggcctttctt

SEQ ID NO: 6243727 - DNA, 13 bp, Homo sapiens
gaggaaggctctg

SEQ ID NO: 6243728 - DNA, 15 bp, Homo sapiens
gaggaaggctctgtc

SEQ ID NO: 6243729 - DNA, 14 bp, Homo sapiens
gaggaaggctgaac

SEQ ID NO: 6243730 - DNA, 18 bp, Homo sapiens
gaggaagggactggtcca

SEQ ID NO: 6243731 - DNA, 18 bp, Homo sapiens
gaggaagggatgggcccc

SEQ ID NO: 6243732 - DNA, 13 bp, Homo sapiens
gaggaagggccag

SEQ ID NO: 6243733 - DNA, 18 bp, Homo sapiens
gaggaagggccaggagag

SEQ ID NO: 6243734 - DNA, 16 bp, Homo sapiens
gaggaagggctgggcc

SEQ ID NO: 6243735 - DNA, 22 bp, Homo sapiens
gaggaagggctgggccaccagg

SEQ ID NO: 6243736 - DNA, 19 bp, Homo sapiens
gaggaaggggccagaggct

SEQ ID NO: 6243737 - DNA, 20 bp, Homo sapiens
gaggaaggggccccatggca

SEQ ID NO: 6243738 - DNA, 15 bp, Homo sapiens
gaggaaggtgctgag

SEQ ID NO: 6243739 - DNA, 21 bp, Homo sapiens
gaggaaggtggcttaccaaga

SEQ ID NO: 6243740 - DNA, 12 bp, Homo sapiens
gaggaagtgagc

SEQ ID NO: 6243741 - DNA, 14 bp, Homo sapiens
gaggaagtggtgtt

SEQ ID NO: 6243742 - DNA, 16 bp, Homo sapiens
gaggaagttgattctt

SEQ ID NO: 6243743 - DNA, 14 bp, Homo sapiens
gaggaataaagctt

SEQ ID NO: 6243744 - DNA, 22 bp, Homo sapiens
gaggaataaagcttctctctga

SEQ ID NO: 6243745 - DNA, 22 bp, Homo sapiens
gaggaatcactcttgtggatgt

SEQ ID NO: 6243746 - DNA, 16 bp, Homo sapiens
gaggaatcacttttaa

SEQ ID NO: 6243747 - DNA, 22 bp, Homo sapiens
gaggaatcatgtcaggcctgtg

SEQ ID NO: 6243748 - DNA, 20 bp, Homo sapiens
gaggaatcctggcagcccag

SEQ ID NO: 6243749 - DNA, 18 bp, Homo sapiens
gaggaatcttttactgtg

SEQ ID NO: 6243750 - DNA, 15 bp, Homo sapiens
gaggaatgaaaaaag

SEQ ID NO: 6243751 - DNA, 14 bp, Homo sapiens
gaggaatgcaccac

SEQ ID NO: 6243752 - DNA, 15 bp, Homo sapiens
gaggaatgctccccc

SEQ ID NO: 6243753 - DNA, 15 bp, Homo sapiens
gaggaatgctctgtg

SEQ ID NO: 6243754 - DNA, 18 bp, Homo sapiens
gaggaatggacatttcta

SEQ ID NO: 6243755 - DNA, 15 bp, Homo sapiens
gaggaatgtgaagcc

SEQ ID NO: 6243756 - DNA, 16 bp, Homo sapiens
gaggaatgtgaagcca

SEQ ID NO: 6243757 - DNA, 17 bp, Homo sapiens
gaggaatgtgaagccag

SEQ ID NO: 6243758 - DNA, 14 bp, Homo sapiens
gaggaatgtgggct

SEQ ID NO: 6243759 - DNA, 15 bp, Homo sapiens
gaggaatgtgggcta

SEQ ID NO: 6243760 - DNA, 19 bp, Homo sapiens
gaggaattatcatgggaaa

SEQ ID NO: 6243761 - DNA, 17 bp, Homo sapiens
gaggaattcagctcagc

SEQ ID NO: 6243762 - DNA, 14 bp, Homo sapiens
gaggaattctgtat

SEQ ID NO: 6243763 - DNA, 14 bp, Homo sapiens
gaggaatttataac

SEQ ID NO: 6243764 - DNA, 19 bp, Homo sapiens
gaggaatttataacaaata

SEQ ID NO: 6243765 - DNA, 14 bp, Homo sapiens
gaggaatttcacct

SEQ ID NO: 6243766 - DNA, 19 bp, Homo sapiens
gaggacaaaacagcgggag

SEQ ID NO: 6243767 - DNA, 22 bp, Homo sapiens
gaggacaaaacttcttgtcaga

SEQ ID NO: 6243768 - DNA, 13 bp, Homo sapiens
gaggacaaaataa

SEQ ID NO: 6243769 - DNA, 17 bp, Homo sapiens
gaggacaaaataaagtg

SEQ ID NO: 6243770 - DNA, 22 bp, Homo sapiens
gaggacaaaataaagtgtgtgt

SEQ ID NO: 6243771 - DNA, 15 bp, Homo sapiens
gaggacaaccattcc

SEQ ID NO: 6243772 - DNA, 18 bp, Homo sapiens
gaggacaagagaaaaaag

SEQ ID NO: 6243773 - DNA, 22 bp, Homo sapiens
gaggacaatctagctctccata

SEQ ID NO: 6243774 - DNA, 20 bp, Homo sapiens
gaggacacaatggcacctct

SEQ ID NO: 6243775 - DNA, 14 bp, Homo sapiens
gaggacacagcaca

SEQ ID NO: 6243776 - DNA, 16 bp, Homo sapiens
gaggacacagcacaag

SEQ ID NO: 6243777 - DNA, 22 bp, Homo sapiens
gaggacacagcacaagggcaca

SEQ ID NO: 6243778 - DNA, 17 bp, Homo sapiens
gaggacacgtggcctgc

SEQ ID NO: 6243779 - DNA, 20 bp, Homo sapiens
gaggacactaagaggaggca

SEQ ID NO: 6243780 - DNA, 16 bp, Homo sapiens
gaggacactagatgat

SEQ ID NO: 6243781 - DNA, 13 bp, Homo sapiens
gaggacactcccg

SEQ ID NO: 6243782 - DNA, 21 bp, Homo sapiens
gaggacacttcaaactgcgga

SEQ ID NO: 6243783 - DNA, 23 bp, Homo sapiens
gaggacacttttgccaatgaact

SEQ ID NO: 6243784 - DNA, 19 bp, Homo sapiens
gaggacagaaggactggtg

SEQ ID NO: 6243785 - DNA, 18 bp, Homo sapiens
gaggacagacggccggcc

SEQ ID NO: 6243786 - DNA, 10 bp, Homo sapiens
gaggacagag

SEQ ID NO: 6243787 - DNA, 11 bp, Homo sapiens
gaggacagagc

SEQ ID NO: 6243788 - DNA, 16 bp, Homo sapiens
gaggacagagtgccct

SEQ ID NO: 6243789 - DNA, 17 bp, Homo sapiens
gaggacagagtgccctg

SEQ ID NO: 6243790 - DNA, 17 bp, Homo sapiens
gaggacagcctgcctct

SEQ ID NO: 6243791 - DNA, 18 bp, Homo sapiens
gaggacagcctgcctctg

SEQ ID NO: 6243792 - DNA, 20 bp, Homo sapiens
gaggacagcctgcctctgcc

SEQ ID NO: 6243793 - DNA, 13 bp, Homo sapiens
gaggacagctctg

SEQ ID NO: 6243794 - DNA, 16 bp, Homo sapiens
gaggacagctctgggg

SEQ ID NO: 6243795 - DNA, 13 bp, Homo sapiens
gaggacagctgtc

SEQ ID NO: 6243796 - DNA, 14 bp, Homo sapiens
gaggacagctgtcc

SEQ ID NO: 6243797 - DNA, 21 bp, Homo sapiens
gaggacagcttccccatcgcc

SEQ ID NO: 6243798 - DNA, 15 bp, Homo sapiens
gaggacagcttgagc

SEQ ID NO: 6243799 - DNA, 18 bp, Homo sapiens
gaggacaggcaggccaga

SEQ ID NO: 6243800 - DNA, 21 bp, Homo sapiens
gaggacaggctctagagagag

SEQ ID NO: 6243801 - DNA, 22 bp, Homo sapiens
gaggacagggacttcgcagagg

SEQ ID NO: 6243802 - DNA, 23 bp, Homo sapiens
gaggacagggaggtgaccccagg

SEQ ID NO: 6243803 - DNA, 13 bp, Homo sapiens
gaggacagggccc

SEQ ID NO: 6243804 - DNA, 16 bp, Homo sapiens
gaggacagtctggaga

SEQ ID NO: 6243805 - DNA, 14 bp, Homo sapiens
gaggacagtgctga

SEQ ID NO: 6243806 - DNA, 19 bp, Homo sapiens
gaggacagtgctgacccca

SEQ ID NO: 6243807 - DNA, 20 bp, Homo sapiens
gaggacataatggggtcctg

SEQ ID NO: 6243808 - DNA, 16 bp, Homo sapiens
gaggacatcaaagtgg

SEQ ID NO: 6243809 - DNA, 17 bp, Homo sapiens
gaggacatgcgtgtgtc

SEQ ID NO: 6243810 - DNA, 16 bp, Homo sapiens
gaggacatggagagag

SEQ ID NO: 6243811 - DNA, 20 bp, Homo sapiens
gaggacatttgtgggcaagc

SEQ ID NO: 6243812 - DNA, 13 bp, Homo sapiens
gaggaccaaagat

SEQ ID NO: 6243813 - DNA, 16 bp, Homo sapiens
gaggaccaaagataca

SEQ ID NO: 6243814 - DNA, 24 bp, Homo sapiens
gaggaccaatgcttgcatggagaa

SEQ ID NO: 6243815 - DNA, 18 bp, Homo sapiens
gaggaccacagtgggtgg

SEQ ID NO: 6243816 - DNA, 22 bp, Homo sapiens
gaggaccactttggagactggg

SEQ ID NO: 6243817 - DNA, 13 bp, Homo sapiens
gaggaccagcaca

SEQ ID NO: 6243818 - DNA, 13 bp, Homo sapiens
gaggaccagggct

SEQ ID NO: 6243819 - DNA, 19 bp, Homo sapiens
gaggaccagggtggagctg

SEQ ID NO: 6243820 - DNA, 20 bp, Homo sapiens
gaggacccaggaaaggcagg

SEQ ID NO: 6243821 - DNA, 15 bp, Homo sapiens
gaggacccaggacag

SEQ ID NO: 6243822 - DNA, 15 bp, Homo sapiens
gaggaccccagggtg

SEQ ID NO: 6243823 - DNA, 20 bp, Homo sapiens
gaggaccccattctgggact

SEQ ID NO: 6243824 - DNA, 23 bp, Homo sapiens
gaggaccccattctgggactgct

SEQ ID NO: 6243825 - DNA, 18 bp, Homo sapiens
gaggaccccgagggctga

SEQ ID NO: 6243826 - DNA, 15 bp, Homo sapiens
gaggacccctgcctt

SEQ ID NO: 6243827 - DNA, 16 bp, Homo sapiens
gaggacccctgccttc

SEQ ID NO: 6243828 - DNA, 19 bp, Homo sapiens
gaggacccctgccttcctc

SEQ ID NO: 6243829 - DNA, 17 bp, Homo sapiens
gaggacccggcgctgag

SEQ ID NO: 6243830 - DNA, 16 bp, Homo sapiens
gaggaccctcagcccc

SEQ ID NO: 6243831 - DNA, 20 bp, Homo sapiens
gaggaccgaggctacagctc

SEQ ID NO: 6243832 - DNA, 21 bp, Homo sapiens
gaggaccgaggctacagctcc

SEQ ID NO: 6243833 - DNA, 23 bp, Homo sapiens
gaggaccgccccaccctggaatg

SEQ ID NO: 6243834 - DNA, 16 bp, Homo sapiens
gaggaccgctgataag

SEQ ID NO: 6243835 - DNA, 13 bp, Homo sapiens
gaggaccgggctg

SEQ ID NO: 6243836 - DNA, 17 bp, Homo sapiens
gaggacctccatgcccc

SEQ ID NO: 6243837 - DNA, 22 bp, Homo sapiens
gaggacctgaccctactccctt

SEQ ID NO: 6243838 - DNA, 12 bp, Homo sapiens
gaggacctgagc

SEQ ID NO: 6243839 - DNA, 14 bp, Homo sapiens
gaggacctgagcct

SEQ ID NO: 6243840 - DNA, 18 bp, Homo sapiens
gaggacctgagcctgccg

SEQ ID NO: 6243841 - DNA, 22 bp, Homo sapiens
gaggacctgagtttgggagagt

SEQ ID NO: 6243842 - DNA, 19 bp, Homo sapiens
gaggacctggcgtgctcag

SEQ ID NO: 6243843 - DNA, 17 bp, Homo sapiens
gaggacctggggcacag

SEQ ID NO: 6243844 - DNA, 18 bp, Homo sapiens
gaggacctggggcacagt

SEQ ID NO: 6243845 - DNA, 14 bp, Homo sapiens
gaggacctgggggg

SEQ ID NO: 6243846 - DNA, 19 bp, Homo sapiens
gaggaccttatctgtgcgt

SEQ ID NO: 6243847 - DNA, 19 bp, Homo sapiens
gaggacgagacccccatcc

SEQ ID NO: 6243848 - DNA, 21 bp, Homo sapiens
gaggacgagacccccatccag

SEQ ID NO: 6243849 - DNA, 22 bp, Homo sapiens
gaggacgagcgattgaggtgta

SEQ ID NO: 6243850 - DNA, 13 bp, Homo sapiens
gaggacgcacgct

SEQ ID NO: 6243851 - DNA, 23 bp, Homo sapiens
gaggacgcacgctcgctgccatc

SEQ ID NO: 6243852 - DNA, 20 bp, Homo sapiens
gaggacgctctctggccttc

SEQ ID NO: 6243853 - DNA, 18 bp, Homo sapiens
gaggacggagttcagagg

SEQ ID NO: 6243854 - DNA, 14 bp, Homo sapiens
gaggacggcttccc

SEQ ID NO: 6243855 - DNA, 17 bp, Homo sapiens
gaggacggggcagagct

SEQ ID NO: 6243856 - DNA, 16 bp, Homo sapiens
gaggacggtgcaaccc

SEQ ID NO: 6243857 - DNA, 20 bp, Homo sapiens
gccatccagggtctggcaga

SEQ ID NO: 6243858 - DNA, 21 bp, Homo sapiens
gccatccagggtctggcagag

SEQ ID NO: 6243859 - DNA, 23 bp, Homo sapiens
gccatccagggtctggcagagcc

SEQ ID NO: 6243860 - DNA, 13 bp, Homo sapiens
gccatcccaaggc

SEQ ID NO: 6243861 - DNA, 13 bp, Homo sapiens
gccatcccacatt

SEQ ID NO: 6243862 - DNA, 15 bp, Homo sapiens
gccatcccagcccca

SEQ ID NO: 6243863 - DNA, 17 bp, Homo sapiens
gccatcccagccttggc

SEQ ID NO: 6243864 - DNA, 18 bp, Homo sapiens
gccatccccagggggcat

SEQ ID NO: 6243865 - DNA, 18 bp, Homo sapiens
gccatccccgctcctggt

SEQ ID NO: 6243866 - DNA, 14 bp, Homo sapiens
gccatccctcgtgg

SEQ ID NO: 6243867 - DNA, 12 bp, Homo sapiens
gccatccctggg

SEQ ID NO: 6243868 - DNA, 16 bp, Homo sapiens
gccatccctgggcccc

SEQ ID NO: 6243869 - DNA, 12 bp, Homo sapiens
gccatccctgtg

SEQ ID NO: 6243870 - DNA, 20 bp, Homo sapiens
gccatcccttcggagccaac

SEQ ID NO: 6243871 - DNA, 21 bp, Homo sapiens
gccatcccttcggagccaaca

SEQ ID NO: 6243872 - DNA, 22 bp, Homo sapiens
gccatccgcagactgcttggcc

SEQ ID NO: 6243873 - DNA, 19 bp, Homo sapiens
gccatccggcccccagagc

SEQ ID NO: 6243874 - DNA, 18 bp, Homo sapiens
gccatccgggacgcttcc

SEQ ID NO: 6243875 - DNA, 22 bp, Homo sapiens
gccatccgggacgcttccagac

SEQ ID NO: 6243876 - DNA, 18 bp, Homo sapiens
gccatccggtcccctgcc

SEQ ID NO: 6243877 - DNA, 13 bp, Homo sapiens
gccatcctaccca

SEQ ID NO: 6243878 - DNA, 20 bp, Homo sapiens
gccatcctcaaacactgcag

SEQ ID NO: 6243879 - DNA, 12 bp, Homo sapiens
gccatcctgatg

SEQ ID NO: 6243880 - DNA, 14 bp, Homo sapiens
gccatcctgatgga

SEQ ID NO: 6243881 - DNA, 21 bp, Homo sapiens
gccatcctgatggacctgccc

SEQ ID NO: 6243882 - DNA, 16 bp, Homo sapiens
gccatcctgcccttct

SEQ ID NO: 6243883 - DNA, 18 bp, Homo sapiens
gccatcctggcccagggc

SEQ ID NO: 6243884 - DNA, 19 bp, Homo sapiens
gccatcctggcccagggca

SEQ ID NO: 6243885 - DNA, 23 bp, Homo sapiens
gccatcctggcccagggcatctg

SEQ ID NO: 6243886 - DNA, 13 bp, Homo sapiens
gccatcctgttaa

SEQ ID NO: 6243887 - DNA, 23 bp, Homo sapiens
gccatccttccgccaatctggcc

SEQ ID NO: 6243888 - DNA, 15 bp, Homo sapiens
gccatccttctgtgt

SEQ ID NO: 6243889 - DNA, 21 bp, Homo sapiens
gccatccttgactttgaacta

SEQ ID NO: 6243890 - DNA, 18 bp, Homo sapiens
gccatcgccgggactcca

SEQ ID NO: 6243891 - DNA, 19 bp, Homo sapiens
gccatcgccgggactccag

SEQ ID NO: 6243892 - DNA, 22 bp, Homo sapiens
gccatcggaagagagggctgag

SEQ ID NO: 6243893 - DNA, 17 bp, Homo sapiens
gccatcggacaggagga

SEQ ID NO: 6243894 - DNA, 17 bp, Homo sapiens
gccatcgggtgccaaat

SEQ ID NO: 6243895 - DNA, 17 bp, Homo sapiens
gccatcggtcctgtctc

SEQ ID NO: 6243896 - DNA, 14 bp, Homo sapiens
gccatcgtcctggg

SEQ ID NO: 6243897 - DNA, 18 bp, Homo sapiens
gccatctaatgcttgttt

SEQ ID NO: 6243898 - DNA, 20 bp, Homo sapiens
gccatctcaattgtgctttg

SEQ ID NO: 6243899 - DNA, 22 bp, Homo sapiens
gccatctccacccccagctgct

SEQ ID NO: 6243900 - DNA, 21 bp, Homo sapiens
gccatctccaccctgagcctg

SEQ ID NO: 6243901 - DNA, 23 bp, Homo sapiens
gccatctccaccctgagcctgac

SEQ ID NO: 6243902 - DNA, 14 bp, Homo sapiens
gccatctcggctca

SEQ ID NO: 6243903 - DNA, 17 bp, Homo sapiens
gccatctcggctcactg

SEQ ID NO: 6243904 - DNA, 19 bp, Homo sapiens
gccatctcggctcactgca

SEQ ID NO: 6243905 - DNA, 12 bp, Homo sapiens
gccatctctgct

SEQ ID NO: 6243906 - DNA, 14 bp, Homo sapiens
gccatctctgctcc

SEQ ID NO: 6243907 - DNA, 15 bp, Homo sapiens
gccatctctggatgc

SEQ ID NO: 6243908 - DNA, 19 bp, Homo sapiens
gccatctgactgccaagcc

SEQ ID NO: 6243909 - DNA, 17 bp, Homo sapiens
gccatctgatccccatg

SEQ ID NO: 6243910 - DNA, 12 bp, Homo sapiens
gccatctgccca

SEQ ID NO: 6243911 - DNA, 13 bp, Homo sapiens
gccatctgcccag

SEQ ID NO: 6243912 - DNA, 20 bp, Homo sapiens
gccatctgcccaggggtgcc

SEQ ID NO: 6243913 - DNA, 22 bp, Homo sapiens
gccatctgcgacaccaccaaca

SEQ ID NO: 6243914 - DNA, 15 bp, Homo sapiens
gccatctgcgcaggg

SEQ ID NO: 6243915 - DNA, 12 bp, Homo sapiens
gccatctgctcc

SEQ ID NO: 6243916 - DNA, 16 bp, Homo sapiens
gccatctgctcctgga

SEQ ID NO: 6243917 - DNA, 13 bp, Homo sapiens
gccatctggaaat

SEQ ID NO: 6243918 - DNA, 19 bp, Homo sapiens
gccatctggagagcccaga

SEQ ID NO: 6243919 - DNA, 18 bp, Homo sapiens
gccatctggggctccttc

SEQ ID NO: 6243920 - DNA, 14 bp, Homo sapiens
gccatctgtaaata

SEQ ID NO: 6243921 - DNA, 20 bp, Homo sapiens
gccatctgtacatattactg

SEQ ID NO: 6243922 - DNA, 13 bp, Homo sapiens
gccatctgtagct

SEQ ID NO: 6243923 - DNA, 18 bp, Homo sapiens
gccatctgtgtcctggtt

SEQ ID NO: 6243924 - DNA, 19 bp, Homo sapiens
gccatctgtgtgcagcaac

SEQ ID NO: 6243925 - DNA, 11 bp, Homo sapiens
gccatcttcag

SEQ ID NO: 6243926 - DNA, 12 bp, Homo sapiens
gccatcttcagg

SEQ ID NO: 6243927 - DNA, 13 bp, Homo sapiens
gccatcttcagga

SEQ ID NO: 6243928 - DNA, 15 bp, Homo sapiens
gccatcttctccccg

SEQ ID NO: 6243929 - DNA, 22 bp, Homo sapiens
gccatcttctccccgaggctgc

SEQ ID NO: 6243930 - DNA, 15 bp, Homo sapiens
gccatcttcttccct

SEQ ID NO: 6243931 - DNA, 13 bp, Homo sapiens
gccatcttctttc

SEQ ID NO: 6243932 - DNA, 18 bp, Homo sapiens
gccatcttgcttttcttt

SEQ ID NO: 6243933 - DNA, 14 bp, Homo sapiens
gccatcttggtaaa

SEQ ID NO: 6243934 - DNA, 15 bp, Homo sapiens
gccatgaaaccagag

SEQ ID NO: 6243935 - DNA, 13 bp, Homo sapiens
gccatgaacaaat

SEQ ID NO: 6243936 - DNA, 20 bp, Homo sapiens
gccatgaacaaattctttag

SEQ ID NO: 6243937 - DNA, 21 bp, Homo sapiens
gccatgaaccaaatggttctt

SEQ ID NO: 6243938 - DNA, 16 bp, Homo sapiens
gccatgaaccatgctt

SEQ ID NO: 6243939 - DNA, 20 bp, Homo sapiens
gccatgaactggaggccagg

SEQ ID NO: 6243940 - DNA, 23 bp, Homo sapiens
gccatgaagaggatgctgtgaaa

SEQ ID NO: 6243941 - DNA, 14 bp, Homo sapiens
gccatgaagcatta

SEQ ID NO: 6243942 - DNA, 16 bp, Homo sapiens
gccatgaatctctgcc

SEQ ID NO: 6243943 - DNA, 17 bp, Homo sapiens
gccatgaatctctgcct

SEQ ID NO: 6243944 - DNA, 12 bp, Homo sapiens
gccatgaatgag

SEQ ID NO: 6243945 - DNA, 11 bp, Homo sapiens
gccatgaatta

SEQ ID NO: 6243946 - DNA, 19 bp, Homo sapiens
gccatgacaacttctaatt

SEQ ID NO: 6243947 - DNA, 23 bp, Homo sapiens
gccatgacaacttctaattgcca

SEQ ID NO: 6243948 - DNA, 17 bp, Homo sapiens
gccatgacagaggctgc

SEQ ID NO: 6243949 - DNA, 20 bp, Homo sapiens
gccatgacagaggctgcacc

SEQ ID NO: 6243950 - DNA, 14 bp, Homo sapiens
gccatgacatttca

SEQ ID NO: 6243951 - DNA, 19 bp, Homo sapiens
gccatgacatttcatctgg

SEQ ID NO: 6243952 - DNA, 21 bp, Homo sapiens
gccatgacatttcatctgggt

SEQ ID NO: 6243953 - DNA, 23 bp, Homo sapiens
gccatgaccctgcctctcccagg

SEQ ID NO: 6243954 - DNA, 22 bp, Homo sapiens
gccatgactagggtcctcaggc

SEQ ID NO: 6243955 - DNA, 16 bp, Homo sapiens
gccatgactgctcagg

SEQ ID NO: 6243956 - DNA, 19 bp, Homo sapiens
gccatgactgctcaggcct

SEQ ID NO: 6243957 - DNA, 16 bp, Homo sapiens
gccatgacttttctgc

SEQ ID NO: 6243958 - DNA, 23 bp, Homo sapiens
gccatgagatgatacatccaaag

SEQ ID NO: 6243959 - DNA, 21 bp, Homo sapiens
gccatgagccgcccaaggcct

SEQ ID NO: 6243960 - DNA, 16 bp, Homo sapiens
gccatgagctccagac

SEQ ID NO: 6243961 - DNA, 23 bp, Homo sapiens
gccatgagctccagacccccagc

SEQ ID NO: 6243962 - DNA, 20 bp, Homo sapiens
gccatgaggaacaaggcaag

SEQ ID NO: 6243963 - DNA, 19 bp, Homo sapiens
gccatgaggagcgtggact

SEQ ID NO: 6243964 - DNA, 12 bp, Homo sapiens
gccatgaggcct

SEQ ID NO: 6243965 - DNA, 15 bp, Homo sapiens
gccatgagggacagg

SEQ ID NO: 6243966 - DNA, 22 bp, Homo sapiens
gccatgagtatgccactgcact

SEQ ID NO: 6243967 - DNA, 20 bp, Homo sapiens
gccatgagttccagaaagta

SEQ ID NO: 6243968 - DNA, 14 bp, Homo sapiens
gccatgatatcact

SEQ ID NO: 6243969 - DNA, 18 bp, Homo sapiens
gccatgatcgagccactg

SEQ ID NO: 6243970 - DNA, 21 bp, Homo sapiens
gccatgatctgcaggggtctg

SEQ ID NO: 6243971 - DNA, 15 bp, Homo sapiens
gccatgatgcctctg

SEQ ID NO: 6243972 - DNA, 16 bp, Homo sapiens
gccatgatggcaacag

SEQ ID NO: 6243973 - DNA, 21 bp, Homo sapiens
gccatgatggtgctgacctct

SEQ ID NO: 6243974 - DNA, 16 bp, Homo sapiens
gccatgatgtccttgg

SEQ ID NO: 6243975 - DNA, 17 bp, Homo sapiens
gccatgatgtccttgga

SEQ ID NO: 6243976 - DNA, 19 bp, Homo sapiens
gccatgatgtccttggact

SEQ ID NO: 6243977 - DNA, 20 bp, Homo sapiens
gccatgatgtccttggactc

SEQ ID NO: 6243978 - DNA, 17 bp, Homo sapiens
gccatgatttcccactg

SEQ ID NO: 6243979 - DNA, 14 bp, Homo sapiens
gccatgatttgtcc

SEQ ID NO: 6243980 - DNA, 18 bp, Homo sapiens
gccatgatttgtcccagc

SEQ ID NO: 6243981 - DNA, 19 bp, Homo sapiens
gccatgatttgtcccagcc

SEQ ID NO: 6243982 - DNA, 20 bp, Homo sapiens
gccatgatttgtcccagcct

SEQ ID NO: 6243983 - DNA, 15 bp, Homo sapiens
gccatgattttggcc

SEQ ID NO: 6243984 - DNA, 17 bp, Homo sapiens
gccatgattttggccac

SEQ ID NO: 6243985 - DNA, 18 bp, Homo sapiens
gccatgattttggccact

SEQ ID NO: 6243986 - DNA, 22 bp, Homo sapiens
gccatgcaactccatgcctatt

SEQ ID NO: 6243987 - DNA, 14 bp, Homo sapiens
gccatgcaagaact

SEQ ID NO: 6243988 - DNA, 13 bp, Homo sapiens
gccatgcaggaag

SEQ ID NO: 6243989 - DNA, 14 bp, Homo sapiens
gccatgcaggaggt

SEQ ID NO: 6243990 - DNA, 22 bp, Homo sapiens
gccatgcatgatgggtaaagca

SEQ ID NO: 6243991 - DNA, 14 bp, Homo sapiens
gccatgccactgcc

SEQ ID NO: 6243992 - DNA, 15 bp, Homo sapiens
gccatgccactgcca

SEQ ID NO: 6243993 - DNA, 16 bp, Homo sapiens
gccatgccactgccag

SEQ ID NO: 6243994 - DNA, 18 bp, Homo sapiens
gccatgccactgccaggc

SEQ ID NO: 6243995 - DNA, 13 bp, Homo sapiens
gccatgccagctg

SEQ ID NO: 6243996 - DNA, 16 bp, Homo sapiens
gccatgccagctggcc

SEQ ID NO: 6243997 - DNA, 18 bp, Homo sapiens
gccatgccaggaacctgt

SEQ ID NO: 6243998 - DNA, 17 bp, Homo sapiens
gccatgccatgcccagg

SEQ ID NO: 6243999 - DNA, 16 bp, Homo sapiens
gccatgcccaccgccc

SEQ ID NO: 6244000 - DNA, 13 bp, Homo sapiens
gccatgcccagag

SEQ ID NO: 6244001 - DNA, 14 bp, Homo sapiens
gccatgcccagaga

SEQ ID NO: 6244002 - DNA, 15 bp, Homo sapiens
gccatgcccagagaa

SEQ ID NO: 6244003 - DNA, 21 bp, Homo sapiens
gccatgccccacccccctcct

SEQ ID NO: 6244004 - DNA, 19 bp, Homo sapiens
gccatgccctagaccctcc

SEQ ID NO: 6244005 - DNA, 23 bp, Homo sapiens
gccatgccctagaccctccccaa

SEQ ID NO: 6244006 - DNA, 21 bp, Homo sapiens
gccatgcctcagccctgaccc

SEQ ID NO: 6244007 - DNA, 15 bp, Homo sapiens
gccatgcctcatgcc

SEQ ID NO: 6244008 - DNA, 21 bp, Homo sapiens
gccatgcctccctgggccacc

SEQ ID NO: 6244009 - DNA, 12 bp, Homo sapiens
gccatgcctgct

SEQ ID NO: 6244010 - DNA, 21 bp, Homo sapiens
gccatgcctgctccctgtctg

SEQ ID NO: 6244011 - DNA, 22 bp, Homo sapiens
gccatgcctgctccctgtctgt

SEQ ID NO: 6244012 - DNA, 16 bp, Homo sapiens
gccatgcgaggggcca

SEQ ID NO: 6244013 - DNA, 21 bp, Homo sapiens
gccatgcgaggggccagcaga

SEQ ID NO: 6244014 - DNA, 20 bp, Homo sapiens
gccatgcgcgcgctctctct

SEQ ID NO: 6244015 - DNA, 21 bp, Homo sapiens
gccatgcgtggctaacatcct

SEQ ID NO: 6244016 - DNA, 14 bp, Homo sapiens
gccatgctgaaggg

SEQ ID NO: 6244017 - DNA, 21 bp, Homo sapiens
gccatgctgctttgcacacac

SEQ ID NO: 6244018 - DNA, 14 bp, Homo sapiens
gccatgctggccag

SEQ ID NO: 6244019 - DNA, 16 bp, Homo sapiens
gccatgctgggaagac

SEQ ID NO: 6244020 - DNA, 16 bp, Homo sapiens
gccatgctgggccact

SEQ ID NO: 6244021 - DNA, 21 bp, Homo sapiens
gccatgcttcttgccccttgg

SEQ ID NO: 6244022 - DNA, 16 bp, Homo sapiens
gccatgctttttggtg

SEQ ID NO: 6244023 - DNA, 17 bp, Homo sapiens
gccatggaactgtttcc

SEQ ID NO: 6244024 - DNA, 15 bp, Homo sapiens
gccatggaaggtgcc

SEQ ID NO: 6244025 - DNA, 17 bp, Homo sapiens
gccatggacgaatatga

SEQ ID NO: 6244026 - DNA, 20 bp, Homo sapiens
gccatggactctacactgtg

SEQ ID NO: 6244027 - DNA, 15 bp, Homo sapiens
gccatggagagctgg

SEQ ID NO: 6244028 - DNA, 16 bp, Homo sapiens
gccatggagagctgga

SEQ ID NO: 6244029 - DNA, 22 bp, Homo sapiens
gccatggagagctggagcctgg

SEQ ID NO: 6244030 - DNA, 23 bp, Homo sapiens
gccatggagagctggagcctggt

SEQ ID NO: 6244031 - DNA, 17 bp, Homo sapiens
gccatggagatctgaag

SEQ ID NO: 6244032 - DNA, 16 bp, Homo sapiens
gccatggaggcgcctt

SEQ ID NO: 6244033 - DNA, 21 bp, Homo sapiens
gccatggagtgagacccagga

SEQ ID NO: 6244034 - DNA, 14 bp, Homo sapiens
gccatggatctgat

SEQ ID NO: 6244035 - DNA, 19 bp, Homo sapiens
gccatggatttccactgct

SEQ ID NO: 6244036 - DNA, 19 bp, Homo sapiens
gccatggcaggacagctcc

SEQ ID NO: 6244037 - DNA, 20 bp, Homo sapiens
gccatggcaggacagctcct

SEQ ID NO: 6244038 - DNA, 17 bp, Homo sapiens
gccatggccaaggggcc

SEQ ID NO: 6244039 - DNA, 18 bp, Homo sapiens
gccatggccaaggggcca

SEQ ID NO: 6244040 - DNA, 17 bp, Homo sapiens
gccatggccccccactc

SEQ ID NO: 6244041 - DNA, 18 bp, Homo sapiens
gccatggccccccactcc

SEQ ID NO: 6244042 - DNA, 18 bp, Homo sapiens
gccatggcctgcaaactg

SEQ ID NO: 6244043 - DNA, 18 bp, Homo sapiens
gccatggccttggcaggc

SEQ ID NO: 6244044 - DNA, 18 bp, Homo sapiens
gccatggcggcccctcag

SEQ ID NO: 6244045 - DNA, 22 bp, Homo sapiens
gccatggcggcccctcagcctg

SEQ ID NO: 6244046 - DNA, 23 bp, Homo sapiens
gccatggctggatgtgcatctgg

SEQ ID NO: 6244047 - DNA, 13 bp, Homo sapiens
gccatggctgtga

SEQ ID NO: 6244048 - DNA, 19 bp, Homo sapiens
gccatggcttccaaggtgg

SEQ ID NO: 6244049 - DNA, 24 bp, Homo sapiens
gccatggcttccaaggtggtctgc

SEQ ID NO: 6244050 - DNA, 16 bp, Homo sapiens
gccatggctttcatcc

SEQ ID NO: 6244051 - DNA, 17 bp, Homo sapiens
gccatggctttcatcct

SEQ ID NO: 6244052 - DNA, 18 bp, Homo sapiens
gccatggctttcatcctg

SEQ ID NO: 6244053 - DNA, 13 bp, Homo sapiens
gccatgggaccaa

SEQ ID NO: 6244054 - DNA, 18 bp, Homo sapiens
gccatgggacctcctccc

SEQ ID NO: 6244055 - DNA, 21 bp, Homo sapiens
gccatgggacctcctccctca

SEQ ID NO: 6244056 - DNA, 11 bp, Homo sapiens
gccatgggaga

SEQ ID NO: 6244057 - DNA, 20 bp, Homo sapiens
gccatgggagagtccaggcc

SEQ ID NO: 6244058 - DNA, 14 bp, Homo sapiens
gccatgggaggaag

SEQ ID NO: 6244059 - DNA, 12 bp, Homo sapiens
gccatgggaggc

SEQ ID NO: 6244060 - DNA, 14 bp, Homo sapiens
gccatgggaggcct

SEQ ID NO: 6244061 - DNA, 19 bp, Homo sapiens
gccatgggccagcctagcc

SEQ ID NO: 6244062 - DNA, 18 bp, Homo sapiens
gccatgggccctctgagc

SEQ ID NO: 6244063 - DNA, 15 bp, Homo sapiens
gccatgggcctgctg

SEQ ID NO: 6244064 - DNA, 16 bp, Homo sapiens
gccatgggcctgggcc

SEQ ID NO: 6244065 - DNA, 17 bp, Homo sapiens
gccatgggcctgggcct

SEQ ID NO: 6244066 - DNA, 16 bp, Homo sapiens
gccatggggcagcctc

SEQ ID NO: 6244067 - DNA, 18 bp, Homo sapiens
gccatggggcagcctcca

SEQ ID NO: 6244068 - DNA, 16 bp, Homo sapiens
gccatggggtccatcc

SEQ ID NO: 6244069 - DNA, 19 bp, Homo sapiens
gccatggggtccatcccct

SEQ ID NO: 6244070 - DNA, 18 bp, Homo sapiens
gccatggggtcggctcct

SEQ ID NO: 6244071 - DNA, 22 bp, Homo sapiens
gccatggggtcggctcctgatg

SEQ ID NO: 6244072 - DNA, 19 bp, Homo sapiens
gccatgggtagcctgggtg

SEQ ID NO: 6244073 - DNA, 16 bp, Homo sapiens
gccatgggtggaaagt

SEQ ID NO: 6244074 - DNA, 14 bp, Homo sapiens
gccatggtaccccc

SEQ ID NO: 6244075 - DNA, 17 bp, Homo sapiens
gccatggtacccccttc

SEQ ID NO: 6244076 - DNA, 15 bp, Homo sapiens
gccatggtcaccctc

SEQ ID NO: 6244077 - DNA, 16 bp, Homo sapiens
gccatggtcaccctca

SEQ ID NO: 6244078 - DNA, 23 bp, Homo sapiens
gccatggtctctcgggcccccca

SEQ ID NO: 6244079 - DNA, 23 bp, Homo sapiens
gccatggtctttgctaggcctct

SEQ ID NO: 6244080 - DNA, 19 bp, Homo sapiens
gccatggtgacacacagca

SEQ ID NO: 6244081 - DNA, 11 bp, Homo sapiens
gccatggtgga

SEQ ID NO: 6244082 - DNA, 20 bp, Homo sapiens
gccatggtggagggcacttc

SEQ ID NO: 6244083 - DNA, 21 bp, Homo sapiens
gccatggtggagggcacttca

SEQ ID NO: 6244084 - DNA, 21 bp, Homo sapiens
gccatggtgttggaggggcag

SEQ ID NO: 6244085 - DNA, 16 bp, Homo sapiens
gccatgtaaaggcctt

SEQ ID NO: 6244086 - DNA, 15 bp, Homo sapiens
gccatgtaactatgt

SEQ ID NO: 6244087 - DNA, 19 bp, Homo sapiens
gccatgtaaggttgtgcag

SEQ ID NO: 6244088 - DNA, 18 bp, Homo sapiens
gccatgtacccattgcag

SEQ ID NO: 6244089 - DNA, 15 bp, Homo sapiens
gccatgtactagttt

SEQ ID NO: 6244090 - DNA, 18 bp, Homo sapiens
gccatgtagaagctgcat

SEQ ID NO: 6244091 - DNA, 15 bp, Homo sapiens
gccatgtagcagaca

SEQ ID NO: 6244092 - DNA, 17 bp, Homo sapiens
gccatgtataaatgtga

SEQ ID NO: 6244093 - DNA, 19 bp, Homo sapiens
gccatgtataaatgtgata

SEQ ID NO: 6244094 - DNA, 16 bp, Homo sapiens
gccatgtattatgaaa

SEQ ID NO: 6244095 - DNA, 20 bp, Homo sapiens
gccatgtatttcagggacct

SEQ ID NO: 6244096 - DNA, 22 bp, Homo sapiens
gccatgtcacctggctgctagg

SEQ ID NO: 6244097 - DNA, 15 bp, Homo sapiens
gccatgtcagacaca

SEQ ID NO: 6244098 - DNA, 16 bp, Homo sapiens
gccatgtcctcaaccc

SEQ ID NO: 6244099 - DNA, 19 bp, Homo sapiens
gccatgtcgccaaaaatac

SEQ ID NO: 6244100 - DNA, 16 bp, Homo sapiens
gccatgtctacaaaag

SEQ ID NO: 6244101 - DNA, 22 bp, Homo sapiens
gccatgtctgagcggcgcagag

SEQ ID NO: 6244102 - DNA, 21 bp, Homo sapiens
gccatgtcttctccctggaat

SEQ ID NO: 6244103 - DNA, 15 bp, Homo sapiens
gccatgtcttgttca

SEQ ID NO: 6244104 - DNA, 15 bp, Homo sapiens
gccatgtgactctgg

SEQ ID NO: 6244105 - DNA, 20 bp, Homo sapiens
gccatgtgcatagtttcttt

SEQ ID NO: 6244106 - DNA, 16 bp, Homo sapiens
gccatgtggagtggac

SEQ ID NO: 6244107 - DNA, 21 bp, Homo sapiens
gccatgtggcagaagtgctct

SEQ ID NO: 6244108 - DNA, 23 bp, Homo sapiens
gccatgtggcctgcccagcctca

SEQ ID NO: 6244109 - DNA, 17 bp, Homo sapiens
gccatgtgtttatccta

SEQ ID NO: 6244110 - DNA, 15 bp, Homo sapiens
gccatgttaaatgac

SEQ ID NO: 6244111 - DNA, 23 bp, Homo sapiens
gccatgttaatgtaatctgatgg

SEQ ID NO: 6244112 - DNA, 16 bp, Homo sapiens
gccatgttcaaaagaa

SEQ ID NO: 6244113 - DNA, 19 bp, Homo sapiens
gccatgttccaataaacag

SEQ ID NO: 6244114 - DNA, 19 bp, Homo sapiens
gccatgttccccagttcag

SEQ ID NO: 6244115 - DNA, 17 bp, Homo sapiens
gccatgttggccaggct

SEQ ID NO: 6244116 - DNA, 20 bp, Homo sapiens
gccatgttggccaggctggt

SEQ ID NO: 6244117 - DNA, 22 bp, Homo sapiens
gccatgttggccaggctggtct

SEQ ID NO: 6244118 - DNA, 20 bp, Homo sapiens
gccatgttgtgcctccctgg

SEQ ID NO: 6244119 - DNA, 22 bp, Homo sapiens
gccatgttgtgcctccctggtg

SEQ ID NO: 6244120 - DNA, 23 bp, Homo sapiens
gccatgttgtgcctccctggtga

SEQ ID NO: 6244121 - DNA, 16 bp, Homo sapiens
gccatgtttaagattt

SEQ ID NO: 6244122 - DNA, 20 bp, Homo sapiens
gccatgtttagattccagga

SEQ ID NO: 6244123 - DNA, 13 bp, Homo sapiens
gccatgtttatta

SEQ ID NO: 6244124 - DNA, 18 bp, Homo sapiens
gccatgtttggttgtaaa

SEQ ID NO: 6244125 - DNA, 17 bp, Homo sapiens
gccatgtttttgccaaa

SEQ ID NO: 6244126 - DNA, 13 bp, Homo sapiens
gccattaaaaaac

SEQ ID NO: 6244127 - DNA, 17 bp, Homo sapiens
gccattaaaataaaaca

SEQ ID NO: 6244128 - DNA, 19 bp, Homo sapiens
gccattaaaataaaacaag

SEQ ID NO: 6244129 - DNA, 17 bp, Homo sapiens
gccattacactccagcc

SEQ ID NO: 6244130 - DNA, 20 bp, Homo sapiens
gccattacactccagcctgg

SEQ ID NO: 6244131 - DNA, 10 bp, Homo sapiens
gccattaccc

SEQ ID NO: 6244132 - DNA, 14 bp, Homo sapiens
gccattacccagtg

SEQ ID NO: 6244133 - DNA, 16 bp, Homo sapiens
gccattaccccatacc

SEQ ID NO: 6244134 - DNA, 15 bp, Homo sapiens
gccattactactgta

SEQ ID NO: 6244135 - DNA, 15 bp, Homo sapiens
gccattatagcgcct

SEQ ID NO: 6244136 - DNA, 17 bp, Homo sapiens
gccattatagcgcctgt

SEQ ID NO: 6244137 - DNA, 16 bp, Homo sapiens
gccattatatttgcat

SEQ ID NO: 6244138 - DNA, 23 bp, Homo sapiens
gccattatatttgcattatgtat

SEQ ID NO: 6244139 - DNA, 12 bp, Homo sapiens
gccattattttc

SEQ ID NO: 6244140 - DNA, 17 bp, Homo sapiens
gccattattttctgtca

SEQ ID NO: 6244141 - DNA, 19 bp, Homo sapiens
gccattattttctgtcaga

SEQ ID NO: 6244142 - DNA, 20 bp, Homo sapiens
gccattcatctgggctggca

SEQ ID NO: 6244143 - DNA, 16 bp, Homo sapiens
gccattccaaaatatt

SEQ ID NO: 6244144 - DNA, 12 bp, Homo sapiens
gccattcccact

SEQ ID NO: 6244145 - DNA, 18 bp, Homo sapiens
gccattccccgtctctgg

SEQ ID NO: 6244146 - DNA, 16 bp, Homo sapiens
gccattcctgttctct

SEQ ID NO: 6244147 - DNA, 18 bp, Homo sapiens
gccattctcaagccctgc

SEQ ID NO: 6244148 - DNA, 17 bp, Homo sapiens
gccattctctacccatc

SEQ ID NO: 6244149 - DNA, 15 bp, Homo sapiens
gccattctgattatt

SEQ ID NO: 6244150 - DNA, 24 bp, Homo sapiens
gccattctgattggacctggccca

SEQ ID NO: 6244151 - DNA, 21 bp, Homo sapiens
gccattctgcctcagcctcct

SEQ ID NO: 6244152 - DNA, 18 bp, Homo sapiens
gccattctggcactttaa

SEQ ID NO: 6244153 - DNA, 12 bp, Homo sapiens
gccattctgtgt

SEQ ID NO: 6244154 - DNA, 20 bp, Homo sapiens
gccattctttttttcttggc

SEQ ID NO: 6244155 - DNA, 16 bp, Homo sapiens
gccattgaacactgca

SEQ ID NO: 6244156 - DNA, 19 bp, Homo sapiens
gccattgaacactgcaccc

SEQ ID NO: 6244157 - DNA, 21 bp, Homo sapiens
gccattgaacactgcaccctc

SEQ ID NO: 6244158 - DNA, 17 bp, Homo sapiens
gccattgaacagctgtg

SEQ ID NO: 6244159 - DNA, 20 bp, Homo sapiens
gccattgaacagctgtgagc

SEQ ID NO: 6244160 - DNA, 17 bp, Homo sapiens
gccattgagctgtttcc

SEQ ID NO: 6244161 - DNA, 22 bp, Homo sapiens
gccattgagtgctgggggaggc

SEQ ID NO: 6244162 - DNA, 21 bp, Homo sapiens
gccattgcactccagcctggg

SEQ ID NO: 6244163 - DNA, 23 bp, Homo sapiens
gccattgcacttcggataatttt

SEQ ID NO: 6244164 - DNA, 18 bp, Homo sapiens
gccattgcggccccagga

SEQ ID NO: 6244165 - DNA, 17 bp, Homo sapiens
gccattggagagctgtc

SEQ ID NO: 6244166 - DNA, 23 bp, Homo sapiens
gccattggagagctgtcttcctg

SEQ ID NO: 6244167 - DNA, 15 bp, Homo sapiens
gccattggcctcttg

SEQ ID NO: 6244168 - DNA, 16 bp, Homo sapiens
gccattggcctcttgt

SEQ ID NO: 6244169 - DNA, 21 bp, Homo sapiens
gccattggcctcttgtccctt

SEQ ID NO: 6244170 - DNA, 16 bp, Homo sapiens
gccattggcttcaaga

SEQ ID NO: 6244171 - DNA, 12 bp, Homo sapiens
gccattgggttt

SEQ ID NO: 6244172 - DNA, 17 bp, Homo sapiens
gccattggtccaccctt

SEQ ID NO: 6244173 - DNA, 19 bp, Homo sapiens
gccattgtactccagcctg

SEQ ID NO: 6244174 - DNA, 21 bp, Homo sapiens
gccattgtactccagcctggg

SEQ ID NO: 6244175 - DNA, 22 bp, Homo sapiens
gccattgtactccagcctgggc

SEQ ID NO: 6244176 - DNA, 14 bp, Homo sapiens
gccattgtctttat

SEQ ID NO: 6244177 - DNA, 15 bp, Homo sapiens
gccattgtctttata

SEQ ID NO: 6244178 - DNA, 12 bp, Homo sapiens
gccattgtgaac

SEQ ID NO: 6244179 - DNA, 18 bp, Homo sapiens
gccattgtgcagagaagc

SEQ ID NO: 6244180 - DNA, 11 bp, Homo sapiens
gccatttaaaa

SEQ ID NO: 6244181 - DNA, 22 bp, Homo sapiens
gccatttagaatctagaaatgt

SEQ ID NO: 6244182 - DNA, 21 bp, Homo sapiens
gccatttatgtgagtgtgtgt

SEQ ID NO: 6244183 - DNA, 15 bp, Homo sapiens
gccatttcacattcc

SEQ ID NO: 6244184 - DNA, 19 bp, Homo sapiens
gccatttcacattcctgac

SEQ ID NO: 6244185 - DNA, 22 bp, Homo sapiens
gccatttcattgagggaaaaca

SEQ ID NO: 6244186 - DNA, 13 bp, Homo sapiens
gccatttccccct

SEQ ID NO: 6244187 - DNA, 17 bp, Homo sapiens
gccatttccccctcctc

SEQ ID NO: 6244188 - DNA, 18 bp, Homo sapiens
gccatttccccctcctca

SEQ ID NO: 6244189 - DNA, 18 bp, Homo sapiens
gccatttccctgaacaga

SEQ ID NO: 6244190 - DNA, 18 bp, Homo sapiens
gccatttctcagggaagt

SEQ ID NO: 6244191 - DNA, 13 bp, Homo sapiens
gccatttctccat

SEQ ID NO: 6244192 - DNA, 19 bp, Homo sapiens
gccatttctccatgggcca

SEQ ID NO: 6244193 - DNA, 12 bp, Homo sapiens
gccatttcttat

SEQ ID NO: 6244194 - DNA, 17 bp, Homo sapiens
gccatttcttccacaag

SEQ ID NO: 6244195 - DNA, 22 bp, Homo sapiens
gccatttcttccacaagagccc

SEQ ID NO: 6244196 - DNA, 14 bp, Homo sapiens
gccatttcttctct

SEQ ID NO: 6244197 - DNA, 20 bp, Homo sapiens
gccatttcttcttcttcttt

SEQ ID NO: 6244198 - DNA, 12 bp, Homo sapiens
gccatttgcaat

SEQ ID NO: 6244199 - DNA, 22 bp, Homo sapiens
gccatttgcaataacagctgca

SEQ ID NO: 6244200 - DNA, 23 bp, Homo sapiens
gccatttgcaataacagctgcaa

SEQ ID NO: 6244201 - DNA, 15 bp, Homo sapiens
gccatttgctgccct

SEQ ID NO: 6244202 - DNA, 16 bp, Homo sapiens
gccatttgctgccctg

SEQ ID NO: 6244203 - DNA, 19 bp, Homo sapiens
gccatttgctgccctgggg

SEQ ID NO: 6244204 - DNA, 21 bp, Homo sapiens
gccatttgctgccctggggca

SEQ ID NO: 6244205 - DNA, 19 bp, Homo sapiens
gccatttggccggctctgg

SEQ ID NO: 6244206 - DNA, 20 bp, Homo sapiens
gccatttggccggctctggt

SEQ ID NO: 6244207 - DNA, 20 bp, Homo sapiens
gccatttgtatttgtattcc

SEQ ID NO: 6244208 - DNA, 18 bp, Homo sapiens
gccatttgtcttttgtaa

SEQ ID NO: 6244209 - DNA, 16 bp, Homo sapiens
gccatttgtgtttata

SEQ ID NO: 6244210 - DNA, 22 bp, Homo sapiens
gccattttaaggaaaactacct

SEQ ID NO: 6244211 - DNA, 20 bp, Homo sapiens
gccattttattaaacatttt

SEQ ID NO: 6244212 - DNA, 23 bp, Homo sapiens
gccattttattaaacattttcat

SEQ ID NO: 6244213 - DNA, 22 bp, Homo sapiens
gaggacgtcatcggaggctggg

SEQ ID NO: 6244214 - DNA, 19 bp, Homo sapiens
gaggacgtggactggggta

SEQ ID NO: 6244215 - DNA, 15 bp, Homo sapiens
gaggacgtgggcggc

SEQ ID NO: 6244216 - DNA, 22 bp, Homo sapiens
gaggacgtgggcggcagagagg

SEQ ID NO: 6244217 - DNA, 16 bp, Homo sapiens
gaggactagaacctgg

SEQ ID NO: 6244218 - DNA, 18 bp, Homo sapiens
gaggactcacttgcccac

SEQ ID NO: 6244219 - DNA, 17 bp, Homo sapiens
gaggactcccaaccctg

SEQ ID NO: 6244220 - DNA, 16 bp, Homo sapiens
gaggactccgggacca

SEQ ID NO: 6244221 - DNA, 23 bp, Homo sapiens
gaggactctttccgactgcccag

SEQ ID NO: 6244222 - DNA, 11 bp, Homo sapiens
gaggactgaga

SEQ ID NO: 6244223 - DNA, 12 bp, Homo sapiens
gaggactggacc

SEQ ID NO: 6244224 - DNA, 16 bp, Homo sapiens
gaggactggactgttt

SEQ ID NO: 6244225 - DNA, 21 bp, Homo sapiens
gaggactgtcctcccacagac

SEQ ID NO: 6244226 - DNA, 13 bp, Homo sapiens
gaggactgttcta

SEQ ID NO: 6244227 - DNA, 16 bp, Homo sapiens
gaggacttgtgtctct

SEQ ID NO: 6244228 - DNA, 17 bp, Homo sapiens
gaggacttgtgtctctg

SEQ ID NO: 6244229 - DNA, 16 bp, Homo sapiens
gaggagaaaaagaaga

SEQ ID NO: 6244230 - DNA, 23 bp, Homo sapiens
gaggagaaacctgcatgaaagca

SEQ ID NO: 6244231 - DNA, 19 bp, Homo sapiens
gaggagaaatgcaataact

SEQ ID NO: 6244232 - DNA, 22 bp, Homo sapiens
gaggagaaatttgataatgaca

SEQ ID NO: 6244233 - DNA, 20 bp, Homo sapiens
gaggagaacactagacatgc

SEQ ID NO: 6244234 - DNA, 17 bp, Homo sapiens
gaggagaacttgaacaa

SEQ ID NO: 6244235 - DNA, 22 bp, Homo sapiens
gaggagaagaattttcagaccc

SEQ ID NO: 6244236 - DNA, 19 bp, Homo sapiens
gaggagacagacacacact

SEQ ID NO: 6244237 - DNA, 14 bp, Homo sapiens
gaggagaccagcgg

SEQ ID NO: 6244238 - DNA, 15 bp, Homo sapiens
gaggagaccagctca

SEQ ID NO: 6244239 - DNA, 22 bp, Homo sapiens
gaggagaccctcccctgcctcc

SEQ ID NO: 6244240 - DNA, 17 bp, Homo sapiens
gaggagactcaggccca

SEQ ID NO: 6244241 - DNA, 22 bp, Homo sapiens
gaggagactcaggcccacattg

SEQ ID NO: 6244242 - DNA, 13 bp, Homo sapiens
gaggagactgggc

SEQ ID NO: 6244243 - DNA, 12 bp, Homo sapiens
gaggagagagac

SEQ ID NO: 6244244 - DNA, 13 bp, Homo sapiens
gaggagagagacc

SEQ ID NO: 6244245 - DNA, 15 bp, Homo sapiens
gaggagagagacccc

SEQ ID NO: 6244246 - DNA, 13 bp, Homo sapiens
gaggagagagagg

SEQ ID NO: 6244247 - DNA, 21 bp, Homo sapiens
gaggagagagcagcttctgcc

SEQ ID NO: 6244248 - DNA, 12 bp, Homo sapiens
gaggagagagcc

SEQ ID NO: 6244249 - DNA, 13 bp, Homo sapiens
gaggagagagcct

SEQ ID NO: 6244250 - DNA, 16 bp, Homo sapiens
gaggagagaggatcac

SEQ ID NO: 6244251 - DNA, 12 bp, Homo sapiens
gaggagagaggc

SEQ ID NO: 6244252 - DNA, 13 bp, Homo sapiens
gaggagagaggca

SEQ ID NO: 6244253 - DNA, 24 bp, Homo sapiens
gaggagagatagcctgtggccctg

SEQ ID NO: 6244254 - DNA, 14 bp, Homo sapiens
gaggagagccactg

SEQ ID NO: 6244255 - DNA, 14 bp, Homo sapiens
gaggagaggagaca

SEQ ID NO: 6244256 - DNA, 17 bp, Homo sapiens
gaggagaggagacagac

SEQ ID NO: 6244257 - DNA, 18 bp, Homo sapiens
gaggagaggagacagaca

SEQ ID NO: 6244258 - DNA, 17 bp, Homo sapiens
gaggagaggagagaggc

SEQ ID NO: 6244259 - DNA, 15 bp, Homo sapiens
gaggagagtggcctg

SEQ ID NO: 6244260 - DNA, 20 bp, Homo sapiens
gaggagagtggttgttgcca

SEQ ID NO: 6244261 - DNA, 20 bp, Homo sapiens
gaggagataaggtggcttct

SEQ ID NO: 6244262 - DNA, 17 bp, Homo sapiens
gaggagatgctccttgg

SEQ ID NO: 6244263 - DNA, 19 bp, Homo sapiens
gaggagatggaaacaatgt

SEQ ID NO: 6244264 - DNA, 22 bp, Homo sapiens
gaggagatgtgatcaggcccca

SEQ ID NO: 6244265 - DNA, 18 bp, Homo sapiens
gaggagattctgcctttg

SEQ ID NO: 6244266 - DNA, 19 bp, Homo sapiens
gaggagattggccagtgag

SEQ ID NO: 6244267 - DNA, 16 bp, Homo sapiens
gaggagcaaaggctga

SEQ ID NO: 6244268 - DNA, 19 bp, Homo sapiens
gaggagcaagggaacagaa

SEQ ID NO: 6244269 - DNA, 16 bp, Homo sapiens
gaggagcacccccagc

SEQ ID NO: 6244270 - DNA, 22 bp, Homo sapiens
gaggagcacccccagcctcccc

SEQ ID NO: 6244271 - DNA, 13 bp, Homo sapiens
gaggagcacctga

SEQ ID NO: 6244272 - DNA, 19 bp, Homo sapiens
gaggagcagaccagcactt

SEQ ID NO: 6244273 - DNA, 13 bp, Homo sapiens
gaggagcagaggg

SEQ ID NO: 6244274 - DNA, 16 bp, Homo sapiens
gaggagcagagggcag

SEQ ID NO: 6244275 - DNA, 15 bp, Homo sapiens
gaggagcagccagga

SEQ ID NO: 6244276 - DNA, 19 bp, Homo sapiens
gaggagcagcccacctgct

SEQ ID NO: 6244277 - DNA, 13 bp, Homo sapiens
gaggagcagcctc

SEQ ID NO: 6244278 - DNA, 19 bp, Homo sapiens
gaggagcaggaagcaaggc

SEQ ID NO: 6244279 - DNA, 15 bp, Homo sapiens
gaggagcagtgcagg

SEQ ID NO: 6244280 - DNA, 14 bp, Homo sapiens
gaggagccagacag

SEQ ID NO: 6244281 - DNA, 16 bp, Homo sapiens
gaggagccagacagac

SEQ ID NO: 6244282 - DNA, 18 bp, Homo sapiens
gaggagccagccaggggt

SEQ ID NO: 6244283 - DNA, 15 bp, Homo sapiens
gaggagccaggcccc

SEQ ID NO: 6244284 - DNA, 20 bp, Homo sapiens
gaggagccaggccccacccc

SEQ ID NO: 6244285 - DNA, 13 bp, Homo sapiens
gaggagcccaggc

SEQ ID NO: 6244286 - DNA, 12 bp, Homo sapiens
gaggagcccagt

SEQ ID NO: 6244287 - DNA, 14 bp, Homo sapiens
gaggagccccagct

SEQ ID NO: 6244288 - DNA, 15 bp, Homo sapiens
gaggagccccagcta

SEQ ID NO: 6244289 - DNA, 19 bp, Homo sapiens
gaggagccccagtggtgag

SEQ ID NO: 6244290 - DNA, 17 bp, Homo sapiens
gaggagccccatctgtc

SEQ ID NO: 6244291 - DNA, 21 bp, Homo sapiens
gaggagcccccaccctgttcc

SEQ ID NO: 6244292 - DNA, 21 bp, Homo sapiens
gaggagcccctggacatgcct

SEQ ID NO: 6244293 - DNA, 22 bp, Homo sapiens
gaggagccctgaggacctctca

SEQ ID NO: 6244294 - DNA, 13 bp, Homo sapiens
gaggagccctgcc

SEQ ID NO: 6244295 - DNA, 15 bp, Homo sapiens
gaggagccctgcctc

SEQ ID NO: 6244296 - DNA, 23 bp, Homo sapiens
gaggagccggccaccagatgctg

SEQ ID NO: 6244297 - DNA, 16 bp, Homo sapiens
gaggagcctcagaaga

SEQ ID NO: 6244298 - DNA, 13 bp, Homo sapiens
gaggagcctctgg

SEQ ID NO: 6244299 - DNA, 21 bp, Homo sapiens
gaggagcctgggggctcctca

SEQ ID NO: 6244300 - DNA, 22 bp, Homo sapiens
gaggagcctgtgcgtcccagct

SEQ ID NO: 6244301 - DNA, 23 bp, Homo sapiens
gaggagcctgtgcgtcccagctg

SEQ ID NO: 6244302 - DNA, 21 bp, Homo sapiens
gaggagcctgtttttgtgaga

SEQ ID NO: 6244303 - DNA, 16 bp, Homo sapiens
gaggagccttgctggg

SEQ ID NO: 6244304 - DNA, 20 bp, Homo sapiens
gaggagcgcaggcagcgcag

SEQ ID NO: 6244305 - DNA, 15 bp, Homo sapiens
gaggagcgtgtccta

SEQ ID NO: 6244306 - DNA, 11 bp, Homo sapiens
gaggagctcaa

SEQ ID NO: 6244307 - DNA, 22 bp, Homo sapiens
gaggagctcaacggtctggcag

SEQ ID NO: 6244308 - DNA, 23 bp, Homo sapiens
gaggagctcaacggtctggcagg

SEQ ID NO: 6244309 - DNA, 18 bp, Homo sapiens
gaggagctcaggacacta

SEQ ID NO: 6244310 - DNA, 16 bp, Homo sapiens
gaggagctctaccctg

SEQ ID NO: 6244311 - DNA, 15 bp, Homo sapiens
gaggagctgagggag

SEQ ID NO: 6244312 - DNA, 23 bp, Homo sapiens
gaggagctgccgcaaggccctgt

SEQ ID NO: 6244313 - DNA, 11 bp, Homo sapiens
gaggagctgct

SEQ ID NO: 6244314 - DNA, 12 bp, Homo sapiens
gaggagctgctg

SEQ ID NO: 6244315 - DNA, 14 bp, Homo sapiens
gaggagctggaggg

SEQ ID NO: 6244316 - DNA, 17 bp, Homo sapiens
gaggagctggaggggtg

SEQ ID NO: 6244317 - DNA, 23 bp, Homo sapiens
gaggagctggcctgtggcacagc

SEQ ID NO: 6244318 - DNA, 13 bp, Homo sapiens
gaggagctgggcc

SEQ ID NO: 6244319 - DNA, 15 bp, Homo sapiens
gaggagctggggcgg

SEQ ID NO: 6244320 - DNA, 19 bp, Homo sapiens
gaggagcttctcccagtgt

SEQ ID NO: 6244321 - DNA, 14 bp, Homo sapiens
gaggagcttctggg

SEQ ID NO: 6244322 - DNA, 19 bp, Homo sapiens
gaggaggaaaaaggctggt

SEQ ID NO: 6244323 - DNA, 14 bp, Homo sapiens
gaggaggaaaagaa

SEQ ID NO: 6244324 - DNA, 14 bp, Homo sapiens
gaggaggaaaagga

SEQ ID NO: 6244325 - DNA, 16 bp, Homo sapiens
gaggaggaacgggcag

SEQ ID NO: 6244326 - DNA, 18 bp, Homo sapiens
gaggaggaacgggcagcc

SEQ ID NO: 6244327 - DNA, 22 bp, Homo sapiens
gaggaggaacgggcagccacag

SEQ ID NO: 6244328 - DNA, 16 bp, Homo sapiens
gaggaggaagactctg

SEQ ID NO: 6244329 - DNA, 14 bp, Homo sapiens
gaggaggaagccgt

SEQ ID NO: 6244330 - DNA, 14 bp, Homo sapiens
gaggaggaaggcaa

SEQ ID NO: 6244331 - DNA, 17 bp, Homo sapiens
gaggaggaaggcaaagc

SEQ ID NO: 6244332 - DNA, 16 bp, Homo sapiens
gaggaggacccctgcc

SEQ ID NO: 6244333 - DNA, 12 bp, Homo sapiens
gaggaggagaag

SEQ ID NO: 6244334 - DNA, 13 bp, Homo sapiens
gaggaggagatgg

SEQ ID NO: 6244335 - DNA, 16 bp, Homo sapiens
gaggaggagatggcca

SEQ ID NO: 6244336 - DNA, 14 bp, Homo sapiens
gaggaggagctgcc

SEQ ID NO: 6244337 - DNA, 12 bp, Homo sapiens
gaggaggaggaa

SEQ ID NO: 6244338 - DNA, 16 bp, Homo sapiens
gaggaggaggacacag

SEQ ID NO: 6244339 - DNA, 13 bp, Homo sapiens
gaggaggaggagc

SEQ ID NO: 6244340 - DNA, 15 bp, Homo sapiens
gaggaggaggagcct

SEQ ID NO: 6244341 - DNA, 13 bp, Homo sapiens
gaggaggatccgg

SEQ ID NO: 6244342 - DNA, 17 bp, Homo sapiens
gaggaggatgactaaca

SEQ ID NO: 6244343 - DNA, 21 bp, Homo sapiens
gaggaggatgtccctgggcca

SEQ ID NO: 6244344 - DNA, 22 bp, Homo sapiens
gaggaggatgtccctgggccag

SEQ ID NO: 6244345 - DNA, 15 bp, Homo sapiens
gaggaggcagaaaga

SEQ ID NO: 6244346 - DNA, 14 bp, Homo sapiens
gaggaggcagagag

SEQ ID NO: 6244347 - DNA, 12 bp, Homo sapiens
gaggaggcagca

SEQ ID NO: 6244348 - DNA, 13 bp, Homo sapiens
gaggaggcagcag

SEQ ID NO: 6244349 - DNA, 19 bp, Homo sapiens
gaggaggccgactgggctg

SEQ ID NO: 6244350 - DNA, 22 bp, Homo sapiens
gaggaggcctgtcccaattctg

SEQ ID NO: 6244351 - DNA, 21 bp, Homo sapiens
gaggaggccttgggctctgct

SEQ ID NO: 6244352 - DNA, 18 bp, Homo sapiens
gaggaggcgcggcctccc

SEQ ID NO: 6244353 - DNA, 14 bp, Homo sapiens
gaggaggctgccct

SEQ ID NO: 6244354 - DNA, 19 bp, Homo sapiens
gaggaggctgccctgaggg

SEQ ID NO: 6244355 - DNA, 17 bp, Homo sapiens
gaggaggctggtgacag

SEQ ID NO: 6244356 - DNA, 16 bp, Homo sapiens
gaggagggacctactg

SEQ ID NO: 6244357 - DNA, 14 bp, Homo sapiens
gaggagggagaaga

SEQ ID NO: 6244358 - DNA, 14 bp, Homo sapiens
gaggagggaggccg

SEQ ID NO: 6244359 - DNA, 14 bp, Homo sapiens
gaggagggaggcgg

SEQ ID NO: 6244360 - DNA, 17 bp, Homo sapiens
gaggagggaggcggcct

SEQ ID NO: 6244361 - DNA, 19 bp, Homo sapiens
gaggagggatgctgcctga

SEQ ID NO: 6244362 - DNA, 15 bp, Homo sapiens
gaggagggatgtggg

SEQ ID NO: 6244363 - DNA, 14 bp, Homo sapiens
gaggagggcaggca

SEQ ID NO: 6244364 - DNA, 16 bp, Homo sapiens
gaggagggccctgagg

SEQ ID NO: 6244365 - DNA, 21 bp, Homo sapiens
gaggagggccctgaggaataa

SEQ ID NO: 6244366 - DNA, 21 bp, Homo sapiens
gaggagggcgcatgtgtgtat

SEQ ID NO: 6244367 - DNA, 20 bp, Homo sapiens
gaggaggggaagctgggccc

SEQ ID NO: 6244368 - DNA, 20 bp, Homo sapiens
gaggaggggaaggggctgag

SEQ ID NO: 6244369 - DNA, 15 bp, Homo sapiens
gaggaggggagcaag

SEQ ID NO: 6244370 - DNA, 13 bp, Homo sapiens
gaggaggggaggg

SEQ ID NO: 6244371 - DNA, 19 bp, Homo sapiens
gaggaggggcacctgccac

SEQ ID NO: 6244372 - DNA, 16 bp, Homo sapiens
gaggaggggccgctgc

SEQ ID NO: 6244373 - DNA, 14 bp, Homo sapiens
gaggagggggagaa

SEQ ID NO: 6244374 - DNA, 22 bp, Homo sapiens
gaggaggggtaaatatatgttt

SEQ ID NO: 6244375 - DNA, 13 bp, Homo sapiens
gaggaggggtgag

SEQ ID NO: 6244376 - DNA, 14 bp, Homo sapiens
gaggaggggtgaga

SEQ ID NO: 6244377 - DNA, 13 bp, Homo sapiens
gaggaggggtgtg

SEQ ID NO: 6244378 - DNA, 21 bp, Homo sapiens
gaggagggtcggtgccttcaa

SEQ ID NO: 6244379 - DNA, 21 bp, Homo sapiens
gaggagggtctagaggcctga

SEQ ID NO: 6244380 - DNA, 15 bp, Homo sapiens
gaggagggtgccctc

SEQ ID NO: 6244381 - DNA, 16 bp, Homo sapiens
gaggagggtggaggaa

SEQ ID NO: 6244382 - DNA, 17 bp, Homo sapiens
gaggagggtgggggagg

SEQ ID NO: 6244383 - DNA, 20 bp, Homo sapiens
gaggagggtttgggcagagc

SEQ ID NO: 6244384 - DNA, 15 bp, Homo sapiens
gaggaggtgctgcag

SEQ ID NO: 6244385 - DNA, 18 bp, Homo sapiens
gaggaggtggcagccctg

SEQ ID NO: 6244386 - DNA, 21 bp, Homo sapiens
gaggaggtgtctcaggctgcc

SEQ ID NO: 6244387 - DNA, 23 bp, Homo sapiens
gaggaggtgtctcaggctgcctg

SEQ ID NO: 6244388 - DNA, 20 bp, Homo sapiens
gaggaggtgtggagtggagg

SEQ ID NO: 6244389 - DNA, 13 bp, Homo sapiens
gaggaggttggga

SEQ ID NO: 6244390 - DNA, 15 bp, Homo sapiens
gaggaggtttgcctg

SEQ ID NO: 6244391 - DNA, 22 bp, Homo sapiens
gaggagtaacaatacaaatgga

SEQ ID NO: 6244392 - DNA, 20 bp, Homo sapiens
gaggagtcaatttgcctctg

SEQ ID NO: 6244393 - DNA, 20 bp, Homo sapiens
gaggagtcagatgaggccct

SEQ ID NO: 6244394 - DNA, 17 bp, Homo sapiens
gccattttcttgcctga

SEQ ID NO: 6244395 - DNA, 13 bp, Homo sapiens
gccattttgcatt

SEQ ID NO: 6244396 - DNA, 22 bp, Homo sapiens
gccattttggggggttatttat

SEQ ID NO: 6244397 - DNA, 14 bp, Homo sapiens
gccattttgtaact

SEQ ID NO: 6244398 - DNA, 20 bp, Homo sapiens
gccattttgtctggctgtgg

SEQ ID NO: 6244399 - DNA, 14 bp, Homo sapiens
gccatttttaatga

SEQ ID NO: 6244400 - DNA, 23 bp, Homo sapiens
gccatttttagtttaaaatcttg

SEQ ID NO: 6244401 - DNA, 18 bp, Homo sapiens
gccatttttctataaatc

SEQ ID NO: 6244402 - DNA, 18 bp, Homo sapiens
gccattttttaagagaca

SEQ ID NO: 6244403 - DNA, 17 bp, Homo sapiens
gccattttttgaggaga

SEQ ID NO: 6244404 - DNA, 20 bp, Homo sapiens
gcccaaaagaggtgtcatgc

SEQ ID NO: 6244405 - DNA, 21 bp, Homo sapiens
gcccaaaatttattttataag

SEQ ID NO: 6244406 - DNA, 23 bp, Homo sapiens
gcccaaaatttattttataagaa

SEQ ID NO: 6244407 - DNA, 20 bp, Homo sapiens
gcccaaacaccctcctggca

SEQ ID NO: 6244408 - DNA, 23 bp, Homo sapiens
gcccaaaccaccagaagcccaga

SEQ ID NO: 6244409 - DNA, 16 bp, Homo sapiens
gcccaaacccttaact

SEQ ID NO: 6244410 - DNA, 20 bp, Homo sapiens
gcccaaacccttaactgaca

SEQ ID NO: 6244411 - DNA, 15 bp, Homo sapiens
gcccaaaccttgggc

SEQ ID NO: 6244412 - DNA, 17 bp, Homo sapiens
gcccaaactccccttcc

SEQ ID NO: 6244413 - DNA, 20 bp, Homo sapiens
gcccaaactccccttccctg

SEQ ID NO: 6244414 - DNA, 22 bp, Homo sapiens
gcccaaactccccttccctggg

SEQ ID NO: 6244415 - DNA, 22 bp, Homo sapiens
gcccaaagagcacaaacatttt

SEQ ID NO: 6244416 - DNA, 15 bp, Homo sapiens
gcccaaagatgcagc

SEQ ID NO: 6244417 - DNA, 17 bp, Homo sapiens
gcccaaagccagacagc

SEQ ID NO: 6244418 - DNA, 17 bp, Homo sapiens
gcccaaagcctgaggac

SEQ ID NO: 6244419 - DNA, 20 bp, Homo sapiens
gcccaaagcctgaggacaga

SEQ ID NO: 6244420 - DNA, 16 bp, Homo sapiens
gcccaaagctggagcc

SEQ ID NO: 6244421 - DNA, 18 bp, Homo sapiens
gcccaaagctggagccaa

SEQ ID NO: 6244422 - DNA, 17 bp, Homo sapiens
gcccaaagcttgtaaat

SEQ ID NO: 6244423 - DNA, 16 bp, Homo sapiens
gcccaaaggcccaggg

SEQ ID NO: 6244424 - DNA, 17 bp, Homo sapiens
gcccaaagtctgtgtga

SEQ ID NO: 6244425 - DNA, 16 bp, Homo sapiens
gcccaaagtggggagg

SEQ ID NO: 6244426 - DNA, 18 bp, Homo sapiens
gcccaaataggaggaaaa

SEQ ID NO: 6244427 - DNA, 17 bp, Homo sapiens
gcccaaattatcaagct

SEQ ID NO: 6244428 - DNA, 22 bp, Homo sapiens
gcccaaattatcaagctaataa

SEQ ID NO: 6244429 - DNA, 23 bp, Homo sapiens
gcccaaattatcaagctaataaa

SEQ ID NO: 6244430 - DNA, 15 bp, Homo sapiens
gcccaacacacactc

SEQ ID NO: 6244431 - DNA, 13 bp, Homo sapiens
gcccaacaccagc

SEQ ID NO: 6244432 - DNA, 13 bp, Homo sapiens
gcccaaccagaac

SEQ ID NO: 6244433 - DNA, 19 bp, Homo sapiens
gcccaaccatcggtccaca

SEQ ID NO: 6244434 - DNA, 22 bp, Homo sapiens
gcccaacccaaccactcggggc

SEQ ID NO: 6244435 - DNA, 15 bp, Homo sapiens
gcccaacccagccca

SEQ ID NO: 6244436 - DNA, 19 bp, Homo sapiens
gcccaacccccacctcccg

SEQ ID NO: 6244437 - DNA, 20 bp, Homo sapiens
gcccaaccctgcccacttca

SEQ ID NO: 6244438 - DNA, 14 bp, Homo sapiens
gcccaaccctgtct

SEQ ID NO: 6244439 - DNA, 15 bp, Homo sapiens
gcccaacccttcccc

SEQ ID NO: 6244440 - DNA, 16 bp, Homo sapiens
gcccaacccttcccca

SEQ ID NO: 6244441 - DNA, 16 bp, Homo sapiens
gcccaacccttccctc

SEQ ID NO: 6244442 - DNA, 14 bp, Homo sapiens
gcccaacccttcta

SEQ ID NO: 6244443 - DNA, 22 bp, Homo sapiens
gcccaaccgggaaaggcatcta

SEQ ID NO: 6244444 - DNA, 16 bp, Homo sapiens
gcccaacctcgccctc

SEQ ID NO: 6244445 - DNA, 24 bp, Homo sapiens
gcccaacctctgtggtcacccatg

SEQ ID NO: 6244446 - DNA, 13 bp, Homo sapiens
gcccaactcccag

SEQ ID NO: 6244447 - DNA, 14 bp, Homo sapiens
gcccaactcccagc

SEQ ID NO: 6244448 - DNA, 15 bp, Homo sapiens
gcccaactgtgtagc

SEQ ID NO: 6244449 - DNA, 15 bp, Homo sapiens
gcccaagaactgcag

SEQ ID NO: 6244450 - DNA, 20 bp, Homo sapiens
gcccaagaactgcagatagc

SEQ ID NO: 6244451 - DNA, 22 bp, Homo sapiens
gcccaagaatagatgctgactg

SEQ ID NO: 6244452 - DNA, 21 bp, Homo sapiens
gcccaagacagatgccccaga

SEQ ID NO: 6244453 - DNA, 23 bp, Homo sapiens
gcccaagacagatgccccagagc

SEQ ID NO: 6244454 - DNA, 13 bp, Homo sapiens
gcccaagagagac

SEQ ID NO: 6244455 - DNA, 20 bp, Homo sapiens
gcccaagagagacagcacag

SEQ ID NO: 6244456 - DNA, 21 bp, Homo sapiens
gcccaagagagacagcacagg

SEQ ID NO: 6244457 - DNA, 13 bp, Homo sapiens
gcccaagagcaga

SEQ ID NO: 6244458 - DNA, 21 bp, Homo sapiens
gcccaagagcagagtctgggc

SEQ ID NO: 6244459 - DNA, 17 bp, Homo sapiens
gcccaagaggactgaga

SEQ ID NO: 6244460 - DNA, 18 bp, Homo sapiens
gcccaagaggtctgagcc

SEQ ID NO: 6244461 - DNA, 13 bp, Homo sapiens
gcccaagatgctt

SEQ ID NO: 6244462 - DNA, 13 bp, Homo sapiens
gcccaagattctt

SEQ ID NO: 6244463 - DNA, 15 bp, Homo sapiens
gcccaagccagaggc

SEQ ID NO: 6244464 - DNA, 16 bp, Homo sapiens
gcccaagccagaggct

SEQ ID NO: 6244465 - DNA, 16 bp, Homo sapiens
gcccaagccccatctc

SEQ ID NO: 6244466 - DNA, 14 bp, Homo sapiens
gcccaagctaagct

SEQ ID NO: 6244467 - DNA, 20 bp, Homo sapiens
gcccaagctcagaaggctct

SEQ ID NO: 6244468 - DNA, 12 bp, Homo sapiens
gcccaagctctt

SEQ ID NO: 6244469 - DNA, 19 bp, Homo sapiens
gcccaagctgggctccctt

SEQ ID NO: 6244470 - DNA, 20 bp, Homo sapiens
gcccaagcttccctccatcc

SEQ ID NO: 6244471 - DNA, 18 bp, Homo sapiens
gcccaaggagggtccagg

SEQ ID NO: 6244472 - DNA, 21 bp, Homo sapiens
gcccaaggcagtgttcctcac

SEQ ID NO: 6244473 - DNA, 16 bp, Homo sapiens
gcccaaggccttcccc

SEQ ID NO: 6244474 - DNA, 15 bp, Homo sapiens
gcccaaggcggcccc

SEQ ID NO: 6244475 - DNA, 18 bp, Homo sapiens
gcccaaggcggcccctcc

SEQ ID NO: 6244476 - DNA, 17 bp, Homo sapiens
gcccaaggtcagggagg

SEQ ID NO: 6244477 - DNA, 20 bp, Homo sapiens
gcccaaggttgcacagcaag

SEQ ID NO: 6244478 - DNA, 21 bp, Homo sapiens
gcccaaggttgcacagcaaga

SEQ ID NO: 6244479 - DNA, 15 bp, Homo sapiens
gcccaagtcacacag

SEQ ID NO: 6244480 - DNA, 22 bp, Homo sapiens
gcccaagtgaagcatggcatat

SEQ ID NO: 6244481 - DNA, 19 bp, Homo sapiens
gcccaagtgaccagggaag

SEQ ID NO: 6244482 - DNA, 22 bp, Homo sapiens
gcccaagtgaccagggaagtgt

SEQ ID NO: 6244483 - DNA, 19 bp, Homo sapiens
gcccaagtgaggcagccga

SEQ ID NO: 6244484 - DNA, 20 bp, Homo sapiens
gcccaagtgccatcccacat

SEQ ID NO: 6244485 - DNA, 20 bp, Homo sapiens
gcccaagtggcagagcttgg

SEQ ID NO: 6244486 - DNA, 14 bp, Homo sapiens
gcccaagtggctct

SEQ ID NO: 6244487 - DNA, 20 bp, Homo sapiens
gcccaagtggctcttgggac

SEQ ID NO: 6244488 - DNA, 13 bp, Homo sapiens
gcccaagtgggca

SEQ ID NO: 6244489 - DNA, 15 bp, Homo sapiens
gcccaagtgggcagt

SEQ ID NO: 6244490 - DNA, 16 bp, Homo sapiens
gcccaagtgggcagtc

SEQ ID NO: 6244491 - DNA, 21 bp, Homo sapiens
gcccaagtgggcagtcaccac

SEQ ID NO: 6244492 - DNA, 15 bp, Homo sapiens
gcccaagttatcttt

SEQ ID NO: 6244493 - DNA, 13 bp, Homo sapiens
gcccaagttgcag

SEQ ID NO: 6244494 - DNA, 14 bp, Homo sapiens
gcccaagttgctct

SEQ ID NO: 6244495 - DNA, 16 bp, Homo sapiens
gcccaagttgctctgt

SEQ ID NO: 6244496 - DNA, 18 bp, Homo sapiens
gcccaagttgctctgtat

SEQ ID NO: 6244497 - DNA, 18 bp, Homo sapiens
gcccaagttgtggtgctg

SEQ ID NO: 6244498 - DNA, 23 bp, Homo sapiens
gcccaataaaggtcccttagccc

SEQ ID NO: 6244499 - DNA, 15 bp, Homo sapiens
gcccaatccaggccc

SEQ ID NO: 6244500 - DNA, 16 bp, Homo sapiens
gcccaatcctccctgg

SEQ ID NO: 6244501 - DNA, 20 bp, Homo sapiens
gcccaatgagactctagggt

SEQ ID NO: 6244502 - DNA, 23 bp, Homo sapiens
gcccaatgaggtggctcatgcct

SEQ ID NO: 6244503 - DNA, 22 bp, Homo sapiens
gcccaatgcatagagccctggc

SEQ ID NO: 6244504 - DNA, 13 bp, Homo sapiens
gcccaatgctgct

SEQ ID NO: 6244505 - DNA, 14 bp, Homo sapiens
gcccaatgctgctt

SEQ ID NO: 6244506 - DNA, 22 bp, Homo sapiens
gcccaatgctttgggaggccaa

SEQ ID NO: 6244507 - DNA, 16 bp, Homo sapiens
gcccaatggagaaatg

SEQ ID NO: 6244508 - DNA, 19 bp, Homo sapiens
gcccaatggagaaatgaag

SEQ ID NO: 6244509 - DNA, 20 bp, Homo sapiens
gcccaatggagaaatgaagc

SEQ ID NO: 6244510 - DNA, 15 bp, Homo sapiens
gcccaattggaggaa

SEQ ID NO: 6244511 - DNA, 14 bp, Homo sapiens
gcccacaaactgat

SEQ ID NO: 6244512 - DNA, 21 bp, Homo sapiens
gcccacaacgtcccctcaagc

SEQ ID NO: 6244513 - DNA, 22 bp, Homo sapiens
gcccacaacgtcccctcaagcc

SEQ ID NO: 6244514 - DNA, 22 bp, Homo sapiens
gcccacaagccttactcacctc

SEQ ID NO: 6244515 - DNA, 21 bp, Homo sapiens
gcccacaataatgaataatca

SEQ ID NO: 6244516 - DNA, 18 bp, Homo sapiens
gcccacacacactccttc

SEQ ID NO: 6244517 - DNA, 19 bp, Homo sapiens
gcccacacacactccttcc

SEQ ID NO: 6244518 - DNA, 14 bp, Homo sapiens
gcccacacacaggt

SEQ ID NO: 6244519 - DNA, 14 bp, Homo sapiens
gcccacaccaccgc

SEQ ID NO: 6244520 - DNA, 19 bp, Homo sapiens
gcccacaccaccgccctcc

SEQ ID NO: 6244521 - DNA, 20 bp, Homo sapiens
gcccacaccaccgccctcct

SEQ ID NO: 6244522 - DNA, 13 bp, Homo sapiens
gcccacaccatct

SEQ ID NO: 6244523 - DNA, 14 bp, Homo sapiens
gcccacaccatctg

SEQ ID NO: 6244524 - DNA, 15 bp, Homo sapiens
gcccacaccatctgg

SEQ ID NO: 6244525 - DNA, 23 bp, Homo sapiens
gcccacaccatctggcccaggct

SEQ ID NO: 6244526 - DNA, 12 bp, Homo sapiens
gcccacacccct

SEQ ID NO: 6244527 - DNA, 23 bp, Homo sapiens
gcccacacccgacaccagccctg

SEQ ID NO: 6244528 - DNA, 14 bp, Homo sapiens
gcccacaccctcgg

SEQ ID NO: 6244529 - DNA, 22 bp, Homo sapiens
gcccacaccgcagggacaagcc

SEQ ID NO: 6244530 - DNA, 12 bp, Homo sapiens
gcccacacctgc

SEQ ID NO: 6244531 - DNA, 16 bp, Homo sapiens
gcccacacctggtgga

SEQ ID NO: 6244532 - DNA, 17 bp, Homo sapiens
gcccacactatgcacag

SEQ ID NO: 6244533 - DNA, 18 bp, Homo sapiens
gcccacactatgcacaga

SEQ ID NO: 6244534 - DNA, 22 bp, Homo sapiens
gcccacactatgcacagagccc

SEQ ID NO: 6244535 - DNA, 20 bp, Homo sapiens
gcccacagaaagccaggagc

SEQ ID NO: 6244536 - DNA, 18 bp, Homo sapiens
gcccacagacagatccca

SEQ ID NO: 6244537 - DNA, 16 bp, Homo sapiens
gcccacagagcctggc

SEQ ID NO: 6244538 - DNA, 18 bp, Homo sapiens
gcccacagagcctggctt

SEQ ID NO: 6244539 - DNA, 12 bp, Homo sapiens
gcccacagagga

SEQ ID NO: 6244540 - DNA, 13 bp, Homo sapiens
gcccacagaggac

SEQ ID NO: 6244541 - DNA, 18 bp, Homo sapiens
gcccacagagtctgtgtg

SEQ ID NO: 6244542 - DNA, 16 bp, Homo sapiens
gcccacagcaggtgct

SEQ ID NO: 6244543 - DNA, 18 bp, Homo sapiens
gcccacagcccccacccc

SEQ ID NO: 6244544 - DNA, 17 bp, Homo sapiens
gcccacagcccgcatgc

SEQ ID NO: 6244545 - DNA, 20 bp, Homo sapiens
gcccacagccgccggaagtg

SEQ ID NO: 6244546 - DNA, 13 bp, Homo sapiens
gcccacagcgagc

SEQ ID NO: 6244547 - DNA, 14 bp, Homo sapiens
gcccacagctccca

SEQ ID NO: 6244548 - DNA, 15 bp, Homo sapiens
gcccacagctctgct

SEQ ID NO: 6244549 - DNA, 16 bp, Homo sapiens
gcccacagctctgctg

SEQ ID NO: 6244550 - DNA, 21 bp, Homo sapiens
gcccacagctctgctggaaga

SEQ ID NO: 6244551 - DNA, 16 bp, Homo sapiens
gcccacaggaggcaag

SEQ ID NO: 6244552 - DNA, 17 bp, Homo sapiens
gcccacaggaggcaagc

SEQ ID NO: 6244553 - DNA, 22 bp, Homo sapiens
gcccacaggaggcaagcaagct

SEQ ID NO: 6244554 - DNA, 19 bp, Homo sapiens
gcccacaggatcagtctga

SEQ ID NO: 6244555 - DNA, 16 bp, Homo sapiens
gcccacagggtaccag

SEQ ID NO: 6244556 - DNA, 13 bp, Homo sapiens
gcccacaggtgcg

SEQ ID NO: 6244557 - DNA, 22 bp, Homo sapiens
gcccacaggtgtccccagccca

SEQ ID NO: 6244558 - DNA, 23 bp, Homo sapiens
gcccacaggtgtccccagcccac

SEQ ID NO: 6244559 - DNA, 13 bp, Homo sapiens
gcccacaggttta

SEQ ID NO: 6244560 - DNA, 23 bp, Homo sapiens
gcccacagtgctcagttgtactt

SEQ ID NO: 6244561 - DNA, 16 bp, Homo sapiens
gcccacatccagtggg

SEQ ID NO: 6244562 - DNA, 14 bp, Homo sapiens
gcccacatcccagg

SEQ ID NO: 6244563 - DNA, 18 bp, Homo sapiens
gcccacatcgggctcacc

SEQ ID NO: 6244564 - DNA, 17 bp, Homo sapiens
gcccacatggccgggcc

SEQ ID NO: 6244565 - DNA, 15 bp, Homo sapiens
gcccacattggaaga

SEQ ID NO: 6244566 - DNA, 20 bp, Homo sapiens
gcccacatttagtctcttta

SEQ ID NO: 6244567 - DNA, 20 bp, Homo sapiens
gcccacatttgggctcaggg

SEQ ID NO: 6244568 - DNA, 12 bp, Homo sapiens
gcccaccaaagg

SEQ ID NO: 6244569 - DNA, 21 bp, Homo sapiens
gcccaccaacatcccattgcc

SEQ ID NO: 6244570 - DNA, 16 bp, Homo sapiens
gcccaccaatctgccc

SEQ ID NO: 6244571 - DNA, 17 bp, Homo sapiens
gcccaccaatctgccct

SEQ ID NO: 6244572 - DNA, 14 bp, Homo sapiens
gaggagtcaggggc

SEQ ID NO: 6244573 - DNA, 13 bp, Homo sapiens
gaggagtccaaaa

SEQ ID NO: 6244574 - DNA, 13 bp, Homo sapiens
gaggagtctgagg

SEQ ID NO: 6244575 - DNA, 14 bp, Homo sapiens
gaggagtctgagga

SEQ ID NO: 6244576 - DNA, 14 bp, Homo sapiens
gaggagtctgaggt

SEQ ID NO: 6244577 - DNA, 18 bp, Homo sapiens
gaggagtgacatgaagca

SEQ ID NO: 6244578 - DNA, 13 bp, Homo sapiens
gaggagtgaggaa

SEQ ID NO: 6244579 - DNA, 23 bp, Homo sapiens
gaggagtgatgggcaaggggcca

SEQ ID NO: 6244580 - DNA, 16 bp, Homo sapiens
gaggagtggagggaaa

SEQ ID NO: 6244581 - DNA, 19 bp, Homo sapiens
gaggagtggattcctcccc

SEQ ID NO: 6244582 - DNA, 19 bp, Homo sapiens
gaggagtggcatctggggc

SEQ ID NO: 6244583 - DNA, 22 bp, Homo sapiens
gaggagtggccctgatccagga

SEQ ID NO: 6244584 - DNA, 22 bp, Homo sapiens
gaggagtggttgggctgtgcct

SEQ ID NO: 6244585 - DNA, 17 bp, Homo sapiens
gaggagtgtcctgtctg

SEQ ID NO: 6244586 - DNA, 19 bp, Homo sapiens
gaggagtgtcctgtctgct

SEQ ID NO: 6244587 - DNA, 21 bp, Homo sapiens
gaggagtgtgctcaggccggg

SEQ ID NO: 6244588 - DNA, 15 bp, Homo sapiens
gaggagttagccaaa

SEQ ID NO: 6244589 - DNA, 16 bp, Homo sapiens
gaggagttagccaaac

SEQ ID NO: 6244590 - DNA, 12 bp, Homo sapiens
gaggagttcaat

SEQ ID NO: 6244591 - DNA, 17 bp, Homo sapiens
gaggagttcaatgatct

SEQ ID NO: 6244592 - DNA, 18 bp, Homo sapiens
gaggagttcaatgatcta

SEQ ID NO: 6244593 - DNA, 19 bp, Homo sapiens
gaggagttctttggctcta

SEQ ID NO: 6244594 - DNA, 17 bp, Homo sapiens
gaggagttgtctgtcct

SEQ ID NO: 6244595 - DNA, 21 bp, Homo sapiens
gaggagttgtctgtcctggtc

SEQ ID NO: 6244596 - DNA, 22 bp, Homo sapiens
gaggataaaaaggaaggagaga

SEQ ID NO: 6244597 - DNA, 17 bp, Homo sapiens
gaggataaagaaaagac

SEQ ID NO: 6244598 - DNA, 20 bp, Homo sapiens
gaggataaataataaaggtt

SEQ ID NO: 6244599 - DNA, 14 bp, Homo sapiens
gaggatacagagga

SEQ ID NO: 6244600 - DNA, 21 bp, Homo sapiens
gaggataccccaaagtccagg

SEQ ID NO: 6244601 - DNA, 21 bp, Homo sapiens
gaggatagaaaaaggatggaa

SEQ ID NO: 6244602 - DNA, 13 bp, Homo sapiens
gaggataggacag

SEQ ID NO: 6244603 - DNA, 14 bp, Homo sapiens
gaggataggacaga

SEQ ID NO: 6244604 - DNA, 23 bp, Homo sapiens
gaggataggagttcacttcatct

SEQ ID NO: 6244605 - DNA, 16 bp, Homo sapiens
gaggatcactggagcc

SEQ ID NO: 6244606 - DNA, 17 bp, Homo sapiens
gaggatcactggagccc

SEQ ID NO: 6244607 - DNA, 19 bp, Homo sapiens
gaggatcactggagcccag

SEQ ID NO: 6244608 - DNA, 23 bp, Homo sapiens
gaggatcacttgggcccaggagg

SEQ ID NO: 6244609 - DNA, 23 bp, Homo sapiens
gaggatccaagcgacctaaacag

SEQ ID NO: 6244610 - DNA, 16 bp, Homo sapiens
gaggatccagggcagc

SEQ ID NO: 6244611 - DNA, 20 bp, Homo sapiens
gaggatccagggcagcaggc

SEQ ID NO: 6244612 - DNA, 15 bp, Homo sapiens
gaggatcccctgagg

SEQ ID NO: 6244613 - DNA, 15 bp, Homo sapiens
gaggatcccctgtcc

SEQ ID NO: 6244614 - DNA, 14 bp, Homo sapiens
gaggatccgggctt

SEQ ID NO: 6244615 - DNA, 19 bp, Homo sapiens
gaggatcctcacaggagca

SEQ ID NO: 6244616 - DNA, 22 bp, Homo sapiens
gaggatcctcacaggagcagac

SEQ ID NO: 6244617 - DNA, 12 bp, Homo sapiens
gaggatcctgag

SEQ ID NO: 6244618 - DNA, 18 bp, Homo sapiens
gaggatcctgagctgctg

SEQ ID NO: 6244619 - DNA, 18 bp, Homo sapiens
gaggatcctggtattgta

SEQ ID NO: 6244620 - DNA, 16 bp, Homo sapiens
gaggatctcttgagcc

SEQ ID NO: 6244621 - DNA, 21 bp, Homo sapiens
gaggatgaatgtatgtgcact

SEQ ID NO: 6244622 - DNA, 23 bp, Homo sapiens
gaggatgacccggggcagctggc

SEQ ID NO: 6244623 - DNA, 15 bp, Homo sapiens
gaggatgagacccag

SEQ ID NO: 6244624 - DNA, 17 bp, Homo sapiens
gaggatgagacccagcc

SEQ ID NO: 6244625 - DNA, 15 bp, Homo sapiens
gaggatgagagccca

SEQ ID NO: 6244626 - DNA, 17 bp, Homo sapiens
gaggatgagagcccaga

SEQ ID NO: 6244627 - DNA, 18 bp, Homo sapiens
gaggatgagagcccagag

SEQ ID NO: 6244628 - DNA, 18 bp, Homo sapiens
gaggatgaggtgggctga

SEQ ID NO: 6244629 - DNA, 20 bp, Homo sapiens
gaggatgaggtgggctgaag

SEQ ID NO: 6244630 - DNA, 18 bp, Homo sapiens
gaggatgcactggcctgt

SEQ ID NO: 6244631 - DNA, 14 bp, Homo sapiens
gaggatgcagaggg

SEQ ID NO: 6244632 - DNA, 21 bp, Homo sapiens
gaggatgcagagtcagcagaa

SEQ ID NO: 6244633 - DNA, 14 bp, Homo sapiens
gaggatgccacagc

SEQ ID NO: 6244634 - DNA, 21 bp, Homo sapiens
gaggatgccacagccccacag

SEQ ID NO: 6244635 - DNA, 15 bp, Homo sapiens
gaggatgccttttct

SEQ ID NO: 6244636 - DNA, 15 bp, Homo sapiens
gaggatgctctttcc

SEQ ID NO: 6244637 - DNA, 18 bp, Homo sapiens
gaggatgctgacatcatt

SEQ ID NO: 6244638 - DNA, 13 bp, Homo sapiens
gaggatgctgtgc

SEQ ID NO: 6244639 - DNA, 14 bp, Homo sapiens
gaggatgctgtgcc

SEQ ID NO: 6244640 - DNA, 23 bp, Homo sapiens
gaggatggaaactggactcacat

SEQ ID NO: 6244641 - DNA, 12 bp, Homo sapiens
gaggatggagag

SEQ ID NO: 6244642 - DNA, 13 bp, Homo sapiens
gaggatggagaga

SEQ ID NO: 6244643 - DNA, 15 bp, Homo sapiens
gaggatggagagagg

SEQ ID NO: 6244644 - DNA, 19 bp, Homo sapiens
gaggatggccagtgtctgt

SEQ ID NO: 6244645 - DNA, 20 bp, Homo sapiens
gaggatggccagtgtctgtc

SEQ ID NO: 6244646 - DNA, 14 bp, Homo sapiens
gaggatggcccagg

SEQ ID NO: 6244647 - DNA, 21 bp, Homo sapiens
gaggatgggatgtatttttct

SEQ ID NO: 6244648 - DNA, 14 bp, Homo sapiens
gaggatgggctcgc

SEQ ID NO: 6244649 - DNA, 17 bp, Homo sapiens
gaggatgggtcagagct

SEQ ID NO: 6244650 - DNA, 22 bp, Homo sapiens
gaggatggtagaagtttggctg

SEQ ID NO: 6244651 - DNA, 18 bp, Homo sapiens
gaggatggtgtcctgagg

SEQ ID NO: 6244652 - DNA, 16 bp, Homo sapiens
gaggatgtaaggcctt

SEQ ID NO: 6244653 - DNA, 13 bp, Homo sapiens
gaggatgtccctg

SEQ ID NO: 6244654 - DNA, 18 bp, Homo sapiens
gaggatgtctcaaacttc

SEQ ID NO: 6244655 - DNA, 20 bp, Homo sapiens
gaggatgttagacttgctcc

SEQ ID NO: 6244656 - DNA, 22 bp, Homo sapiens
gaggatgttagacttgctccct

SEQ ID NO: 6244657 - DNA, 17 bp, Homo sapiens
gaggatgttctgggaca

SEQ ID NO: 6244658 - DNA, 22 bp, Homo sapiens
gaggattaagggacgggggtgg

SEQ ID NO: 6244659 - DNA, 19 bp, Homo sapiens
gaggattctgtcttccagg

SEQ ID NO: 6244660 - DNA, 20 bp, Homo sapiens
gaggattctgtcttccaggc

SEQ ID NO: 6244661 - DNA, 13 bp, Homo sapiens
gaggattctttcc

SEQ ID NO: 6244662 - DNA, 17 bp, Homo sapiens
gaggattctttccccag

SEQ ID NO: 6244663 - DNA, 15 bp, Homo sapiens
gaggattgctatctg

SEQ ID NO: 6244664 - DNA, 18 bp, Homo sapiens
gaggattgctgccagaga

SEQ ID NO: 6244665 - DNA, 15 bp, Homo sapiens
gaggatttcaagcct

SEQ ID NO: 6244666 - DNA, 13 bp, Homo sapiens
gaggatttcctgg

SEQ ID NO: 6244667 - DNA, 18 bp, Homo sapiens
gaggatttcctggagtgc

SEQ ID NO: 6244668 - DNA, 18 bp, Homo sapiens
gaggatttgatgtaagtt

SEQ ID NO: 6244669 - DNA, 19 bp, Homo sapiens
gaggatttgatgtaagtta

SEQ ID NO: 6244670 - DNA, 18 bp, Homo sapiens
gaggatttgatttctgcc

SEQ ID NO: 6244671 - DNA, 19 bp, Homo sapiens
gaggatttggctcgctgtg

SEQ ID NO: 6244672 - DNA, 21 bp, Homo sapiens
gaggatttggctcgctgtggt

SEQ ID NO: 6244673 - DNA, 22 bp, Homo sapiens
gaggattttccagttctgacac

SEQ ID NO: 6244674 - DNA, 20 bp, Homo sapiens
gaggattttgggtggccaaa

SEQ ID NO: 6244675 - DNA, 17 bp, Homo sapiens
gaggatttttttctgag

SEQ ID NO: 6244676 - DNA, 16 bp, Homo sapiens
gaggcaaagctggctc

SEQ ID NO: 6244677 - DNA, 17 bp, Homo sapiens
gaggcaaaggccagcag

SEQ ID NO: 6244678 - DNA, 15 bp, Homo sapiens
gaggcaaaggttcta

SEQ ID NO: 6244679 - DNA, 21 bp, Homo sapiens
gaggcaaaggttctatctgct

SEQ ID NO: 6244680 - DNA, 17 bp, Homo sapiens
gaggcaaattaactgta

SEQ ID NO: 6244681 - DNA, 19 bp, Homo sapiens
gaggcaacactgctgtcca

SEQ ID NO: 6244682 - DNA, 19 bp, Homo sapiens
gaggcaacagtgttctgag

SEQ ID NO: 6244683 - DNA, 23 bp, Homo sapiens
gaggcaacctgattgtaaacttc

SEQ ID NO: 6244684 - DNA, 18 bp, Homo sapiens
gaggcaactcagcaggct

SEQ ID NO: 6244685 - DNA, 14 bp, Homo sapiens
gaggcaagaaaagg

SEQ ID NO: 6244686 - DNA, 15 bp, Homo sapiens
gaggcaagaaaagga

SEQ ID NO: 6244687 - DNA, 21 bp, Homo sapiens
gaggcaagagaaatgaggaag

SEQ ID NO: 6244688 - DNA, 17 bp, Homo sapiens
gaggcaagagacagaat

SEQ ID NO: 6244689 - DNA, 15 bp, Homo sapiens
gaggcaagcaagctc

SEQ ID NO: 6244690 - DNA, 16 bp, Homo sapiens
gaggcaagcctggcca

SEQ ID NO: 6244691 - DNA, 17 bp, Homo sapiens
gaggcaagctgaaattt

SEQ ID NO: 6244692 - DNA, 17 bp, Homo sapiens
gaggcaataaataaatg

SEQ ID NO: 6244693 - DNA, 18 bp, Homo sapiens
gaggcaataaataaatgt

SEQ ID NO: 6244694 - DNA, 11 bp, Homo sapiens
gaggcaataag

SEQ ID NO: 6244695 - DNA, 21 bp, Homo sapiens
gaggcaatcctaccttgcttt

SEQ ID NO: 6244696 - DNA, 21 bp, Homo sapiens
gaggcaatgtcaggaacagaa

SEQ ID NO: 6244697 - DNA, 21 bp, Homo sapiens
gaggcaattagacactttgga

SEQ ID NO: 6244698 - DNA, 22 bp, Homo sapiens
gaggcacaaagggcaggcctgt

SEQ ID NO: 6244699 - DNA, 13 bp, Homo sapiens
gaggcacaagaat

SEQ ID NO: 6244700 - DNA, 19 bp, Homo sapiens
gaggcacaagccaaggaag

SEQ ID NO: 6244701 - DNA, 24 bp, Homo sapiens
gaggcacacagctgcagagacaga

SEQ ID NO: 6244702 - DNA, 11 bp, Homo sapiens
gaggcacagca

SEQ ID NO: 6244703 - DNA, 12 bp, Homo sapiens
gaggcacagcag

SEQ ID NO: 6244704 - DNA, 13 bp, Homo sapiens
gaggcaccagctc

SEQ ID NO: 6244705 - DNA, 20 bp, Homo sapiens
gaggcaccagctctgtggcc

SEQ ID NO: 6244706 - DNA, 14 bp, Homo sapiens
gaggcaccagtcca

SEQ ID NO: 6244707 - DNA, 22 bp, Homo sapiens
gaggcacctccaggcaggccag

SEQ ID NO: 6244708 - DNA, 17 bp, Homo sapiens
gaggcacgcaccactgc

SEQ ID NO: 6244709 - DNA, 22 bp, Homo sapiens
gaggcactaagtcatggtcctg

SEQ ID NO: 6244710 - DNA, 16 bp, Homo sapiens
gaggcactagtcaccg

SEQ ID NO: 6244711 - DNA, 20 bp, Homo sapiens
gaggcactcagtgagcctcc

SEQ ID NO: 6244712 - DNA, 16 bp, Homo sapiens
gaggcagaaaattgca

SEQ ID NO: 6244713 - DNA, 20 bp, Homo sapiens
gaggcagaaaattgcacaat

SEQ ID NO: 6244714 - DNA, 14 bp, Homo sapiens
gaggcagaaagata

SEQ ID NO: 6244715 - DNA, 23 bp, Homo sapiens
gaggcagaaagatacagacattc

SEQ ID NO: 6244716 - DNA, 21 bp, Homo sapiens
gaggcagaaagcagaggctgg

SEQ ID NO: 6244717 - DNA, 17 bp, Homo sapiens
gaggcagaacctggtgg

SEQ ID NO: 6244718 - DNA, 15 bp, Homo sapiens
gaggcagaatggtgg

SEQ ID NO: 6244719 - DNA, 16 bp, Homo sapiens
gaggcagaatggtggg

SEQ ID NO: 6244720 - DNA, 15 bp, Homo sapiens
gaggcagacagcagc

SEQ ID NO: 6244721 - DNA, 20 bp, Homo sapiens
gaggcagacagcagctcagg

SEQ ID NO: 6244722 - DNA, 20 bp, Homo sapiens
gaggcagacgtctgtcaggg

SEQ ID NO: 6244723 - DNA, 16 bp, Homo sapiens
gaggcagagaagaaag

SEQ ID NO: 6244724 - DNA, 18 bp, Homo sapiens
gaggcagagaagaaagaa

SEQ ID NO: 6244725 - DNA, 18 bp, Homo sapiens
gaggcagagaatctcttg

SEQ ID NO: 6244726 - DNA, 19 bp, Homo sapiens
gaggcagagcgggagggag

SEQ ID NO: 6244727 - DNA, 20 bp, Homo sapiens
gaggcagagcgggagggagt

SEQ ID NO: 6244728 - DNA, 13 bp, Homo sapiens
gaggcagaggaca

SEQ ID NO: 6244729 - DNA, 19 bp, Homo sapiens
gaggcagaggttgcagtga

SEQ ID NO: 6244730 - DNA, 16 bp, Homo sapiens
gaggcagagtgcccca

SEQ ID NO: 6244731 - DNA, 14 bp, Homo sapiens
gaggcagatgccct

SEQ ID NO: 6244732 - DNA, 15 bp, Homo sapiens
gaggcagcaacagga

SEQ ID NO: 6244733 - DNA, 19 bp, Homo sapiens
gaggcagcaacaggaccag

SEQ ID NO: 6244734 - DNA, 22 bp, Homo sapiens
gaggcagcaacaggaccaggag

SEQ ID NO: 6244735 - DNA, 17 bp, Homo sapiens
gaggcagcaggactgtc

SEQ ID NO: 6244736 - DNA, 21 bp, Homo sapiens
gaggcagcagtgtgaggccag

SEQ ID NO: 6244737 - DNA, 21 bp, Homo sapiens
gaggcagcatgcttgggctga

SEQ ID NO: 6244738 - DNA, 22 bp, Homo sapiens
gaggcagcatggagagaggcct

SEQ ID NO: 6244739 - DNA, 17 bp, Homo sapiens
gaggcagccacttcggc

SEQ ID NO: 6244740 - DNA, 12 bp, Homo sapiens
gaggcagccaga

SEQ ID NO: 6244741 - DNA, 23 bp, Homo sapiens
gaggcagcccagctcctgaataa

SEQ ID NO: 6244742 - DNA, 15 bp, Homo sapiens
gaggcagccccctcc

SEQ ID NO: 6244743 - DNA, 17 bp, Homo sapiens
gaggcagccgaggcctg

SEQ ID NO: 6244744 - DNA, 18 bp, Homo sapiens
gaggcagccgaggcctgg

SEQ ID NO: 6244745 - DNA, 15 bp, Homo sapiens
gaggcagcctggacc

SEQ ID NO: 6244746 - DNA, 17 bp, Homo sapiens
gaggcagcgccccacca

SEQ ID NO: 6244747 - DNA, 18 bp, Homo sapiens
gaggcagcgccccaccac

SEQ ID NO: 6244748 - DNA, 21 bp, Homo sapiens
gaggcagctatctgcactcta

SEQ ID NO: 6244749 - DNA, 14 bp, Homo sapiens
gaggcagctcagga

SEQ ID NO: 6244750 - DNA, 18 bp, Homo sapiens
gcccaccacaactaacaa

SEQ ID NO: 6244751 - DNA, 18 bp, Homo sapiens
gcccaccaccccctcaag

SEQ ID NO: 6244752 - DNA, 21 bp, Homo sapiens
gcccaccaccccctcaagccc

SEQ ID NO: 6244753 - DNA, 21 bp, Homo sapiens
gcccaccagacgtcaggccct

SEQ ID NO: 6244754 - DNA, 20 bp, Homo sapiens
gcccaccagagcctccctca

SEQ ID NO: 6244755 - DNA, 14 bp, Homo sapiens
gcccaccagccagc

SEQ ID NO: 6244756 - DNA, 17 bp, Homo sapiens
gcccaccagccagccct

SEQ ID NO: 6244757 - DNA, 21 bp, Homo sapiens
gcccaccagccagccctggcc

SEQ ID NO: 6244758 - DNA, 18 bp, Homo sapiens
gcccaccagccttgctct

SEQ ID NO: 6244759 - DNA, 22 bp, Homo sapiens
gcccaccagccttgctctcttc

SEQ ID NO: 6244760 - DNA, 14 bp, Homo sapiens
gcccaccagctggc

SEQ ID NO: 6244761 - DNA, 13 bp, Homo sapiens
gcccaccaggagc

SEQ ID NO: 6244762 - DNA, 19 bp, Homo sapiens
gcccaccagggactgcagc

SEQ ID NO: 6244763 - DNA, 19 bp, Homo sapiens
gcccaccatcaccaccgcc

SEQ ID NO: 6244764 - DNA, 16 bp, Homo sapiens
gcccaccatctgtttg

SEQ ID NO: 6244765 - DNA, 18 bp, Homo sapiens
gcccaccatgcacccctg

SEQ ID NO: 6244766 - DNA, 16 bp, Homo sapiens
gcccaccattcccggc

SEQ ID NO: 6244767 - DNA, 19 bp, Homo sapiens
gcccacccaagcaggaggc

SEQ ID NO: 6244768 - DNA, 17 bp, Homo sapiens
gcccacccacaccccgt

SEQ ID NO: 6244769 - DNA, 21 bp, Homo sapiens
gcccacccacaccccgtctgc

SEQ ID NO: 6244770 - DNA, 13 bp, Homo sapiens
gcccacccacgca

SEQ ID NO: 6244771 - DNA, 17 bp, Homo sapiens
gcccacccagcagcgcc

SEQ ID NO: 6244772 - DNA, 12 bp, Homo sapiens
gcccacccagct

SEQ ID NO: 6244773 - DNA, 15 bp, Homo sapiens
gcccacccagggagc

SEQ ID NO: 6244774 - DNA, 13 bp, Homo sapiens
gcccaccccagcc

SEQ ID NO: 6244775 - DNA, 16 bp, Homo sapiens
gcccaccccatggccg

SEQ ID NO: 6244776 - DNA, 23 bp, Homo sapiens
gcccacccccagtctccagggac

SEQ ID NO: 6244777 - DNA, 14 bp, Homo sapiens
gcccaccccccagc

SEQ ID NO: 6244778 - DNA, 15 bp, Homo sapiens
gcccaccccccagcc

SEQ ID NO: 6244779 - DNA, 17 bp, Homo sapiens
gcccaccccccagcctc

SEQ ID NO: 6244780 - DNA, 15 bp, Homo sapiens
gcccacccccctcat

SEQ ID NO: 6244781 - DNA, 23 bp, Homo sapiens
gcccacccccgggatcctgcccc

SEQ ID NO: 6244782 - DNA, 15 bp, Homo sapiens
gcccaccccctcaag

SEQ ID NO: 6244783 - DNA, 22 bp, Homo sapiens
gcccaccccctcaagccaatcc

SEQ ID NO: 6244784 - DNA, 14 bp, Homo sapiens
gcccaccccctgcc

SEQ ID NO: 6244785 - DNA, 22 bp, Homo sapiens
gcccaccccctgccctgcacgt

SEQ ID NO: 6244786 - DNA, 22 bp, Homo sapiens
gcccaccccctgctggtgccca

SEQ ID NO: 6244787 - DNA, 15 bp, Homo sapiens
gcccaccccgctgcc

SEQ ID NO: 6244788 - DNA, 16 bp, Homo sapiens
gcccaccccgctgcct

SEQ ID NO: 6244789 - DNA, 18 bp, Homo sapiens
gcccaccccgctgcctgg

SEQ ID NO: 6244790 - DNA, 13 bp, Homo sapiens
gcccacccctcac

SEQ ID NO: 6244791 - DNA, 16 bp, Homo sapiens
gcccacccctcactcc

SEQ ID NO: 6244792 - DNA, 19 bp, Homo sapiens
gcccacccctcactcccca

SEQ ID NO: 6244793 - DNA, 21 bp, Homo sapiens
gcccacccctcactccccagg

SEQ ID NO: 6244794 - DNA, 22 bp, Homo sapiens
gcccacccctcactccccaggg

SEQ ID NO: 6244795 - DNA, 21 bp, Homo sapiens
gcccacccctcttcccccttc

SEQ ID NO: 6244796 - DNA, 13 bp, Homo sapiens
gcccacccctgct

SEQ ID NO: 6244797 - DNA, 21 bp, Homo sapiens
gcccacccctgctgccgccac

SEQ ID NO: 6244798 - DNA, 12 bp, Homo sapiens
gcccacccgccc

SEQ ID NO: 6244799 - DNA, 15 bp, Homo sapiens
gcccacccggcccgg

SEQ ID NO: 6244800 - DNA, 23 bp, Homo sapiens
gcccacccggcccggctgagccc

SEQ ID NO: 6244801 - DNA, 20 bp, Homo sapiens
gcccacccgtgttctcctcc

SEQ ID NO: 6244802 - DNA, 13 bp, Homo sapiens
gcccaccctacca

SEQ ID NO: 6244803 - DNA, 17 bp, Homo sapiens
gcccaccctaccagctc

SEQ ID NO: 6244804 - DNA, 19 bp, Homo sapiens
gcccaccctaccagctcct

SEQ ID NO: 6244805 - DNA, 21 bp, Homo sapiens
gcccaccctaccagctcctcc

SEQ ID NO: 6244806 - DNA, 14 bp, Homo sapiens
gcccaccctcctgt

SEQ ID NO: 6244807 - DNA, 17 bp, Homo sapiens
gcccaccctcctgtacc

SEQ ID NO: 6244808 - DNA, 19 bp, Homo sapiens
gcccaccctcctgtcttcc

SEQ ID NO: 6244809 - DNA, 18 bp, Homo sapiens
gcccaccctctgcccagg

SEQ ID NO: 6244810 - DNA, 19 bp, Homo sapiens
gcccaccctgctcctcctg

SEQ ID NO: 6244811 - DNA, 23 bp, Homo sapiens
gcccaccctgctcctcctgccct

SEQ ID NO: 6244812 - DNA, 22 bp, Homo sapiens
gcccaccctgctgctggtgcac

SEQ ID NO: 6244813 - DNA, 20 bp, Homo sapiens
gcccaccctgcttggcccag

SEQ ID NO: 6244814 - DNA, 22 bp, Homo sapiens
gcccaccctgcttggcccaggg

SEQ ID NO: 6244815 - DNA, 15 bp, Homo sapiens
gcccaccctgggcct

SEQ ID NO: 6244816 - DNA, 19 bp, Homo sapiens
gcccaccctgggcctcccg

SEQ ID NO: 6244817 - DNA, 20 bp, Homo sapiens
gcccaccctgggcctcccgt

SEQ ID NO: 6244818 - DNA, 14 bp, Homo sapiens
gcccaccctgggct

SEQ ID NO: 6244819 - DNA, 23 bp, Homo sapiens
gcccaccctgggctccacacagc

SEQ ID NO: 6244820 - DNA, 19 bp, Homo sapiens
gcccaccgaccccctttct

SEQ ID NO: 6244821 - DNA, 20 bp, Homo sapiens
gcccaccgaccccctttcta

SEQ ID NO: 6244822 - DNA, 19 bp, Homo sapiens
gcccaccgaggagccccag

SEQ ID NO: 6244823 - DNA, 14 bp, Homo sapiens
gcccaccgcatgcc

SEQ ID NO: 6244824 - DNA, 17 bp, Homo sapiens
gcccaccgcccctggac

SEQ ID NO: 6244825 - DNA, 18 bp, Homo sapiens
gcccaccgcccctggaca

SEQ ID NO: 6244826 - DNA, 18 bp, Homo sapiens
gcccaccgccctcctcca

SEQ ID NO: 6244827 - DNA, 16 bp, Homo sapiens
gcccacctcagcctcc

SEQ ID NO: 6244828 - DNA, 10 bp, Homo sapiens
gcccacctcc

SEQ ID NO: 6244829 - DNA, 17 bp, Homo sapiens
gcccacctccccacgcc

SEQ ID NO: 6244830 - DNA, 21 bp, Homo sapiens
gcccacctccttccagcactg

SEQ ID NO: 6244831 - DNA, 14 bp, Homo sapiens
gcccacctcgctcc

SEQ ID NO: 6244832 - DNA, 15 bp, Homo sapiens
gcccacctctccctg

SEQ ID NO: 6244833 - DNA, 22 bp, Homo sapiens
gcccacctctccctgcatcctg

SEQ ID NO: 6244834 - DNA, 16 bp, Homo sapiens
gcccacctctgctgcc

SEQ ID NO: 6244835 - DNA, 18 bp, Homo sapiens
gcccacctctgctgccca

SEQ ID NO: 6244836 - DNA, 10 bp, Homo sapiens
gcccacctga

SEQ ID NO: 6244837 - DNA, 16 bp, Homo sapiens
gcccacctgaaagcct

SEQ ID NO: 6244838 - DNA, 18 bp, Homo sapiens
gcccacctgcacccaggt

SEQ ID NO: 6244839 - DNA, 14 bp, Homo sapiens
gcccacctgcatca

SEQ ID NO: 6244840 - DNA, 15 bp, Homo sapiens
gcccacctgccaggc

SEQ ID NO: 6244841 - DNA, 16 bp, Homo sapiens
gcccacctgccaggct

SEQ ID NO: 6244842 - DNA, 20 bp, Homo sapiens
gcccacctgccaggctgcag

SEQ ID NO: 6244843 - DNA, 15 bp, Homo sapiens
gcccacctgccggcc

SEQ ID NO: 6244844 - DNA, 12 bp, Homo sapiens
gcccacctgcct

SEQ ID NO: 6244845 - DNA, 16 bp, Homo sapiens
gcccacctgctcccag

SEQ ID NO: 6244846 - DNA, 17 bp, Homo sapiens
gcccacctgctcccagg

SEQ ID NO: 6244847 - DNA, 16 bp, Homo sapiens
gcccacctggccacct

SEQ ID NO: 6244848 - DNA, 17 bp, Homo sapiens
gcccacctggccacctg

SEQ ID NO: 6244849 - DNA, 20 bp, Homo sapiens
gcccacctggccacctgagg

SEQ ID NO: 6244850 - DNA, 21 bp, Homo sapiens
gcccacctggcctctgcactc

SEQ ID NO: 6244851 - DNA, 17 bp, Homo sapiens
gcccacctgggccctag

SEQ ID NO: 6244852 - DNA, 22 bp, Homo sapiens
gcccacctgggccctaggcata

SEQ ID NO: 6244853 - DNA, 13 bp, Homo sapiens
gcccacctgggct

SEQ ID NO: 6244854 - DNA, 19 bp, Homo sapiens
gcccacctgggctgggcgc

SEQ ID NO: 6244855 - DNA, 13 bp, Homo sapiens
gcccacctggggt

SEQ ID NO: 6244856 - DNA, 15 bp, Homo sapiens
gcccacgacactgca

SEQ ID NO: 6244857 - DNA, 19 bp, Homo sapiens
gcccacgaggagcagcagc

SEQ ID NO: 6244858 - DNA, 23 bp, Homo sapiens
gcccacgagggtctcccctcctg

SEQ ID NO: 6244859 - DNA, 21 bp, Homo sapiens
gcccacgatcccctcccccaa

SEQ ID NO: 6244860 - DNA, 15 bp, Homo sapiens
gcccacgcagagccc

SEQ ID NO: 6244861 - DNA, 16 bp, Homo sapiens
gcccacgcagagcccc

SEQ ID NO: 6244862 - DNA, 17 bp, Homo sapiens
gcccacgcagagccccg

SEQ ID NO: 6244863 - DNA, 14 bp, Homo sapiens
gcccacgccagctg

SEQ ID NO: 6244864 - DNA, 16 bp, Homo sapiens
gcccacgccagctggc

SEQ ID NO: 6244865 - DNA, 17 bp, Homo sapiens
gcccacgccagctggcc

SEQ ID NO: 6244866 - DNA, 16 bp, Homo sapiens
gcccacgcccccactg

SEQ ID NO: 6244867 - DNA, 15 bp, Homo sapiens
gcccacgcccctccc

SEQ ID NO: 6244868 - DNA, 18 bp, Homo sapiens
gcccacgccctccctctc

SEQ ID NO: 6244869 - DNA, 20 bp, Homo sapiens
gcccacgccctccctctccc

SEQ ID NO: 6244870 - DNA, 18 bp, Homo sapiens
gcccacgcccttggagcc

SEQ ID NO: 6244871 - DNA, 19 bp, Homo sapiens
gcccacgcccttggagcct

SEQ ID NO: 6244872 - DNA, 20 bp, Homo sapiens
gcccacgcccttggagcctt

SEQ ID NO: 6244873 - DNA, 22 bp, Homo sapiens
gcccacgcccttggagccttcc

SEQ ID NO: 6244874 - DNA, 14 bp, Homo sapiens
gcccacgccggcct

SEQ ID NO: 6244875 - DNA, 16 bp, Homo sapiens
gcccacgccggcctct

SEQ ID NO: 6244876 - DNA, 18 bp, Homo sapiens
gcccacgcgcttccctgg

SEQ ID NO: 6244877 - DNA, 18 bp, Homo sapiens
gcccacgctgactacagg

SEQ ID NO: 6244878 - DNA, 17 bp, Homo sapiens
gcccacgctggagtgca

SEQ ID NO: 6244879 - DNA, 19 bp, Homo sapiens
gcccacgctggagtgcagt

SEQ ID NO: 6244880 - DNA, 15 bp, Homo sapiens
gcccacggccaccca

SEQ ID NO: 6244881 - DNA, 16 bp, Homo sapiens
gcccacggccacccac

SEQ ID NO: 6244882 - DNA, 21 bp, Homo sapiens
gcccacggctaagaggctgct

SEQ ID NO: 6244883 - DNA, 23 bp, Homo sapiens
gcccacggctaagaggctgctga

SEQ ID NO: 6244884 - DNA, 21 bp, Homo sapiens
gcccacggggcaaagctgctg

SEQ ID NO: 6244885 - DNA, 17 bp, Homo sapiens
gcccacggtctggaggc

SEQ ID NO: 6244886 - DNA, 22 bp, Homo sapiens
gcccacggttcggggcttctgc

SEQ ID NO: 6244887 - DNA, 19 bp, Homo sapiens
gcccacgtacccaggtctg

SEQ ID NO: 6244888 - DNA, 16 bp, Homo sapiens
gcccacgtagggcggc

SEQ ID NO: 6244889 - DNA, 15 bp, Homo sapiens
gcccacgtcctgtca

SEQ ID NO: 6244890 - DNA, 22 bp, Homo sapiens
gcccacgtgtgcagactgtggc

SEQ ID NO: 6244891 - DNA, 18 bp, Homo sapiens
gcccacgttctctctgcc

SEQ ID NO: 6244892 - DNA, 24 bp, Homo sapiens
gcccactaactgaggagctagtgt

SEQ ID NO: 6244893 - DNA, 20 bp, Homo sapiens
gcccactagagggcccatca

SEQ ID NO: 6244894 - DNA, 22 bp, Homo sapiens
gcccactagagggcccatcagg

SEQ ID NO: 6244895 - DNA, 21 bp, Homo sapiens
gcccactaggatcccactggc

SEQ ID NO: 6244896 - DNA, 17 bp, Homo sapiens
gcccactcattccttct

SEQ ID NO: 6244897 - DNA, 15 bp, Homo sapiens
gcccactccatctgg

SEQ ID NO: 6244898 - DNA, 19 bp, Homo sapiens
gcccactccatctggtaga

SEQ ID NO: 6244899 - DNA, 13 bp, Homo sapiens
gcccactcccatc

SEQ ID NO: 6244900 - DNA, 15 bp, Homo sapiens
gcccactcccatccc

SEQ ID NO: 6244901 - DNA, 18 bp, Homo sapiens
gcccactccccagcccca

SEQ ID NO: 6244902 - DNA, 23 bp, Homo sapiens
gcccactccccagttggcccttc

SEQ ID NO: 6244903 - DNA, 16 bp, Homo sapiens
gcccactcccccagga

SEQ ID NO: 6244904 - DNA, 13 bp, Homo sapiens
gcccactccctgc

SEQ ID NO: 6244905 - DNA, 15 bp, Homo sapiens
gcccactccctgcaa

SEQ ID NO: 6244906 - DNA, 16 bp, Homo sapiens
gcccactccctgccta

SEQ ID NO: 6244907 - DNA, 21 bp, Homo sapiens
gcccactccgccagccacagg

SEQ ID NO: 6244908 - DNA, 23 bp, Homo sapiens
gcccactccgccagccacaggac

SEQ ID NO: 6244909 - DNA, 19 bp, Homo sapiens
gcccactcctgctctgctc

SEQ ID NO: 6244910 - DNA, 12 bp, Homo sapiens
gcccactcctgg

SEQ ID NO: 6244911 - DNA, 19 bp, Homo sapiens
gcccactctactgccccag

SEQ ID NO: 6244912 - DNA, 15 bp, Homo sapiens
gcccactctccacct

SEQ ID NO: 6244913 - DNA, 17 bp, Homo sapiens
gcccactctgaccgggc

SEQ ID NO: 6244914 - DNA, 17 bp, Homo sapiens
gcccactctgctcgcct

SEQ ID NO: 6244915 - DNA, 12 bp, Homo sapiens
gcccactctggg

SEQ ID NO: 6244916 - DNA, 13 bp, Homo sapiens
gcccactgagggg

SEQ ID NO: 6244917 - DNA, 20 bp, Homo sapiens
gcccactgcccaccccctca

SEQ ID NO: 6244918 - DNA, 15 bp, Homo sapiens
gcccactgcctcctg

SEQ ID NO: 6244919 - DNA, 15 bp, Homo sapiens
gcccactgctggctg

SEQ ID NO: 6244920 - DNA, 13 bp, Homo sapiens
gcccactgctggt

SEQ ID NO: 6244921 - DNA, 17 bp, Homo sapiens
gcccactgctggtgcca

SEQ ID NO: 6244922 - DNA, 23 bp, Homo sapiens
gcccactgctggtgccagggtgg

SEQ ID NO: 6244923 - DNA, 11 bp, Homo sapiens
gcccactgggc

SEQ ID NO: 6244924 - DNA, 13 bp, Homo sapiens
gcccactgggccc

SEQ ID NO: 6244925 - DNA, 14 bp, Homo sapiens
gcccactgggccct

SEQ ID NO: 6244926 - DNA, 16 bp, Homo sapiens
gcccactgggccctgg

SEQ ID NO: 6244927 - DNA, 16 bp, Homo sapiens
gcccactgtaacaata

SEQ ID NO: 6244928 - DNA, 14 bp, Homo sapiens
gaggcagctccaac

SEQ ID NO: 6244929 - DNA, 15 bp, Homo sapiens
gaggcagctccaaca

SEQ ID NO: 6244930 - DNA, 19 bp, Homo sapiens
gaggcagctccaacagctt

SEQ ID NO: 6244931 - DNA, 21 bp, Homo sapiens
gaggcagcttcaagtgccttt

SEQ ID NO: 6244932 - DNA, 14 bp, Homo sapiens
gaggcaggaatggg

SEQ ID NO: 6244933 - DNA, 17 bp, Homo sapiens
gaggcaggaatgggggt

SEQ ID NO: 6244934 - DNA, 18 bp, Homo sapiens
gaggcaggaccagaaggc

SEQ ID NO: 6244935 - DNA, 22 bp, Homo sapiens
gaggcaggaccagaaggcaatc

SEQ ID NO: 6244936 - DNA, 15 bp, Homo sapiens
gaggcaggactcctg

SEQ ID NO: 6244937 - DNA, 21 bp, Homo sapiens
gaggcaggactcctgggtccc

SEQ ID NO: 6244938 - DNA, 20 bp, Homo sapiens
gaggcaggagaatcacttga

SEQ ID NO: 6244939 - DNA, 20 bp, Homo sapiens
gaggcaggagaattgctgga

SEQ ID NO: 6244940 - DNA, 20 bp, Homo sapiens
gaggcaggaggatcccctga

SEQ ID NO: 6244941 - DNA, 16 bp, Homo sapiens
gaggcaggcatggccc

SEQ ID NO: 6244942 - DNA, 18 bp, Homo sapiens
gaggcaggcatggccctg

SEQ ID NO: 6244943 - DNA, 16 bp, Homo sapiens
gaggcaggctccccct

SEQ ID NO: 6244944 - DNA, 16 bp, Homo sapiens
gaggcagggacctaaa

SEQ ID NO: 6244945 - DNA, 18 bp, Homo sapiens
gaggcagggaggcagccg

SEQ ID NO: 6244946 - DNA, 14 bp, Homo sapiens
gaggcagggccctg

SEQ ID NO: 6244947 - DNA, 15 bp, Homo sapiens
gaggcagggccctgg

SEQ ID NO: 6244948 - DNA, 17 bp, Homo sapiens
gaggcagggccttgccc

SEQ ID NO: 6244949 - DNA, 21 bp, Homo sapiens
gaggcagggccttgcccagag

SEQ ID NO: 6244950 - DNA, 22 bp, Homo sapiens
gaggcagggccttgcccagaga

SEQ ID NO: 6244951 - DNA, 15 bp, Homo sapiens
gaggcagggctctgg

SEQ ID NO: 6244952 - DNA, 13 bp, Homo sapiens
gaggcagggctgg

SEQ ID NO: 6244953 - DNA, 13 bp, Homo sapiens
gaggcagggtcag

SEQ ID NO: 6244954 - DNA, 15 bp, Homo sapiens
gaggcagggtctcac

SEQ ID NO: 6244955 - DNA, 18 bp, Homo sapiens
gaggcagggtctcactct

SEQ ID NO: 6244956 - DNA, 22 bp, Homo sapiens
gaggcagggtctcactctgtcg

SEQ ID NO: 6244957 - DNA, 15 bp, Homo sapiens
gaggcaggtaggggg

SEQ ID NO: 6244958 - DNA, 13 bp, Homo sapiens
gaggcaggtcccc

SEQ ID NO: 6244959 - DNA, 16 bp, Homo sapiens
gaggcaggtccccaga

SEQ ID NO: 6244960 - DNA, 19 bp, Homo sapiens
gaggcaggtcgggctgcca

SEQ ID NO: 6244961 - DNA, 21 bp, Homo sapiens
gaggcaggtcgggctgccagc

SEQ ID NO: 6244962 - DNA, 17 bp, Homo sapiens
gaggcaggtctgggcca

SEQ ID NO: 6244963 - DNA, 18 bp, Homo sapiens
gaggcaggtgacagtgag

SEQ ID NO: 6244964 - DNA, 15 bp, Homo sapiens
gaggcaggtgagaga

SEQ ID NO: 6244965 - DNA, 23 bp, Homo sapiens
gaggcagtacctgggcaagctgg

SEQ ID NO: 6244966 - DNA, 20 bp, Homo sapiens
gaggcagtgatgacttgctg

SEQ ID NO: 6244967 - DNA, 14 bp, Homo sapiens
gaggcagtggctag

SEQ ID NO: 6244968 - DNA, 22 bp, Homo sapiens
gaggcagtgggtcccacttccc

SEQ ID NO: 6244969 - DNA, 21 bp, Homo sapiens
gaggcagttgcccagcctctt

SEQ ID NO: 6244970 - DNA, 18 bp, Homo sapiens
gaggcagtttttgttcct

SEQ ID NO: 6244971 - DNA, 14 bp, Homo sapiens
gaggcatagaggga

SEQ ID NO: 6244972 - DNA, 19 bp, Homo sapiens
gaggcatagagggagagga

SEQ ID NO: 6244973 - DNA, 20 bp, Homo sapiens
gaggcatagagggagaggaa

SEQ ID NO: 6244974 - DNA, 21 bp, Homo sapiens
gaggcatagagggagaggaag

SEQ ID NO: 6244975 - DNA, 23 bp, Homo sapiens
gaggcatagagggagaggaagca

SEQ ID NO: 6244976 - DNA, 21 bp, Homo sapiens
gaggcatcatggaaagactgg

SEQ ID NO: 6244977 - DNA, 22 bp, Homo sapiens
gaggcatccaaaggctcctgag

SEQ ID NO: 6244978 - DNA, 21 bp, Homo sapiens
gaggcatccagcagtctctgc

SEQ ID NO: 6244979 - DNA, 20 bp, Homo sapiens
gaggcatccgtgaggcaggg

SEQ ID NO: 6244980 - DNA, 21 bp, Homo sapiens
gaggcatccgtgaggcaggga

SEQ ID NO: 6244981 - DNA, 20 bp, Homo sapiens
gaggcatcctacccttttct

SEQ ID NO: 6244982 - DNA, 16 bp, Homo sapiens
gaggcatcctgcctgg

SEQ ID NO: 6244983 - DNA, 23 bp, Homo sapiens
gaggcatcctgcctgggtgggac

SEQ ID NO: 6244984 - DNA, 23 bp, Homo sapiens
gaggcatcttttctagagacaca

SEQ ID NO: 6244985 - DNA, 22 bp, Homo sapiens
gaggcatgactaatgcttttta

SEQ ID NO: 6244986 - DNA, 13 bp, Homo sapiens
gaggcatggaaac

SEQ ID NO: 6244987 - DNA, 22 bp, Homo sapiens
gaggcatggcaattctggaagc

SEQ ID NO: 6244988 - DNA, 15 bp, Homo sapiens
gaggcatggccctgg

SEQ ID NO: 6244989 - DNA, 13 bp, Homo sapiens
gaggcatgggggc

SEQ ID NO: 6244990 - DNA, 20 bp, Homo sapiens
gaggcatgggggcccaaagg

SEQ ID NO: 6244991 - DNA, 21 bp, Homo sapiens
gaggcatgtgatgagaggaaa

SEQ ID NO: 6244992 - DNA, 16 bp, Homo sapiens
gaggcattcggggaag

SEQ ID NO: 6244993 - DNA, 14 bp, Homo sapiens
gaggcattgacata

SEQ ID NO: 6244994 - DNA, 12 bp, Homo sapiens
gaggcattgttt

SEQ ID NO: 6244995 - DNA, 15 bp, Homo sapiens
gaggcatttgagcag

SEQ ID NO: 6244996 - DNA, 17 bp, Homo sapiens
gaggcatttgagcagct

SEQ ID NO: 6244997 - DNA, 23 bp, Homo sapiens
gaggcatttgtcttagagagaga

SEQ ID NO: 6244998 - DNA, 19 bp, Homo sapiens
gaggcatttgtttgaactg

SEQ ID NO: 6244999 - DNA, 17 bp, Homo sapiens
gaggccaaactgtccct

SEQ ID NO: 6245000 - DNA, 18 bp, Homo sapiens
gaggccaaactgtccctc

SEQ ID NO: 6245001 - DNA, 17 bp, Homo sapiens
gaggccaaaggctggtg

SEQ ID NO: 6245002 - DNA, 19 bp, Homo sapiens
gaggccaaaggctggtggc

SEQ ID NO: 6245003 - DNA, 17 bp, Homo sapiens
gaggccaacactgtggg

SEQ ID NO: 6245004 - DNA, 14 bp, Homo sapiens
gaggccaaccagcc

SEQ ID NO: 6245005 - DNA, 20 bp, Homo sapiens
gaggccaagagtggccccac

SEQ ID NO: 6245006 - DNA, 16 bp, Homo sapiens
gaggccaagatcccct

SEQ ID NO: 6245007 - DNA, 14 bp, Homo sapiens
gaggccaagatggc

SEQ ID NO: 6245008 - DNA, 20 bp, Homo sapiens
gaggccaagatggctgctgc

SEQ ID NO: 6245009 - DNA, 12 bp, Homo sapiens
gaggccaagcct

SEQ ID NO: 6245010 - DNA, 16 bp, Homo sapiens
gaggccaagcctgcag

SEQ ID NO: 6245011 - DNA, 17 bp, Homo sapiens
gaggccaagcctgcagc

SEQ ID NO: 6245012 - DNA, 17 bp, Homo sapiens
gaggccaagctgaggag

SEQ ID NO: 6245013 - DNA, 16 bp, Homo sapiens
gaggccaaggcaggta

SEQ ID NO: 6245014 - DNA, 14 bp, Homo sapiens
gaggccaaggcggg

SEQ ID NO: 6245015 - DNA, 18 bp, Homo sapiens
gaggccaaggtttcccag

SEQ ID NO: 6245016 - DNA, 21 bp, Homo sapiens
gaggccaaggtttcccagtga

SEQ ID NO: 6245017 - DNA, 17 bp, Homo sapiens
gaggccaagtgcaggct

SEQ ID NO: 6245018 - DNA, 12 bp, Homo sapiens
gaggccaataaa

SEQ ID NO: 6245019 - DNA, 22 bp, Homo sapiens
gaggccacacgcactggtgcca

SEQ ID NO: 6245020 - DNA, 16 bp, Homo sapiens
gaggccacatgagtcc

SEQ ID NO: 6245021 - DNA, 17 bp, Homo sapiens
gaggccacatgagtccc

SEQ ID NO: 6245022 - DNA, 14 bp, Homo sapiens
gaggccacccactg

SEQ ID NO: 6245023 - DNA, 18 bp, Homo sapiens
gaggccacccactgaccc

SEQ ID NO: 6245024 - DNA, 19 bp, Homo sapiens
gaggccacccactgaccca

SEQ ID NO: 6245025 - DNA, 21 bp, Homo sapiens
gaggccaccccaaaccccagc

SEQ ID NO: 6245026 - DNA, 22 bp, Homo sapiens
gaggccaccgggacagacctgg

SEQ ID NO: 6245027 - DNA, 11 bp, Homo sapiens
gaggccacctc

SEQ ID NO: 6245028 - DNA, 14 bp, Homo sapiens
gaggccacctctcc

SEQ ID NO: 6245029 - DNA, 16 bp, Homo sapiens
gaggccacctctccaa

SEQ ID NO: 6245030 - DNA, 17 bp, Homo sapiens
gaggccacctctccaag

SEQ ID NO: 6245031 - DNA, 16 bp, Homo sapiens
gaggccacgggggagg

SEQ ID NO: 6245032 - DNA, 20 bp, Homo sapiens
gaggccacgggggaggccga

SEQ ID NO: 6245033 - DNA, 18 bp, Homo sapiens
gaggccacgtcccacccc

SEQ ID NO: 6245034 - DNA, 17 bp, Homo sapiens
gaggccactcagaggcc

SEQ ID NO: 6245035 - DNA, 20 bp, Homo sapiens
gaggccactcagaggccccc

SEQ ID NO: 6245036 - DNA, 22 bp, Homo sapiens
gaggccactcagaggcccccag

SEQ ID NO: 6245037 - DNA, 17 bp, Homo sapiens
gaggccactgaagagga

SEQ ID NO: 6245038 - DNA, 12 bp, Homo sapiens
gaggccagaaag

SEQ ID NO: 6245039 - DNA, 12 bp, Homo sapiens
gaggccagacca

SEQ ID NO: 6245040 - DNA, 13 bp, Homo sapiens
gaggccagagaca

SEQ ID NO: 6245041 - DNA, 12 bp, Homo sapiens
gaggccagagga

SEQ ID NO: 6245042 - DNA, 20 bp, Homo sapiens
gaggccagaggaagggaggc

SEQ ID NO: 6245043 - DNA, 16 bp, Homo sapiens
gaggccagccccaccc

SEQ ID NO: 6245044 - DNA, 21 bp, Homo sapiens
gaggccagccccacccaggag

SEQ ID NO: 6245045 - DNA, 11 bp, Homo sapiens
gaggccagcct

SEQ ID NO: 6245046 - DNA, 20 bp, Homo sapiens
gaggccagcctggcctcctg

SEQ ID NO: 6245047 - DNA, 15 bp, Homo sapiens
gaggccaggatgcct

SEQ ID NO: 6245048 - DNA, 17 bp, Homo sapiens
gaggccaggccctcctg

SEQ ID NO: 6245049 - DNA, 22 bp, Homo sapiens
gaggccaggccctcctgctggc

SEQ ID NO: 6245050 - DNA, 15 bp, Homo sapiens
gaggccagggcagag

SEQ ID NO: 6245051 - DNA, 19 bp, Homo sapiens
gaggccagggcagagtgag

SEQ ID NO: 6245052 - DNA, 12 bp, Homo sapiens
gaggccagggcc

SEQ ID NO: 6245053 - DNA, 15 bp, Homo sapiens
gaggccagtaggaga

SEQ ID NO: 6245054 - DNA, 14 bp, Homo sapiens
gaggccagtggccc

SEQ ID NO: 6245055 - DNA, 15 bp, Homo sapiens
gaggccagtggcccc

SEQ ID NO: 6245056 - DNA, 16 bp, Homo sapiens
gaggccagtggccccc

SEQ ID NO: 6245057 - DNA, 19 bp, Homo sapiens
gaggccagtgttgtgggct

SEQ ID NO: 6245058 - DNA, 20 bp, Homo sapiens
gaggccagttgatctgctct

SEQ ID NO: 6245059 - DNA, 16 bp, Homo sapiens
gaggccataaaataag

SEQ ID NO: 6245060 - DNA, 22 bp, Homo sapiens
gaggccatgtgcatagtttctt

SEQ ID NO: 6245061 - DNA, 23 bp, Homo sapiens
gaggccatgttccaataaacagg

SEQ ID NO: 6245062 - DNA, 19 bp, Homo sapiens
gaggccattgtgtgagcct

SEQ ID NO: 6245063 - DNA, 17 bp, Homo sapiens
gaggccatttgctgccc

SEQ ID NO: 6245064 - DNA, 23 bp, Homo sapiens
gaggccatttgctgccctggggc

SEQ ID NO: 6245065 - DNA, 13 bp, Homo sapiens
gaggcccaaatga

SEQ ID NO: 6245066 - DNA, 18 bp, Homo sapiens
gaggcccaagagccctgt

SEQ ID NO: 6245067 - DNA, 14 bp, Homo sapiens
gaggcccaaggagc

SEQ ID NO: 6245068 - DNA, 23 bp, Homo sapiens
gaggcccaaggagcttacccaag

SEQ ID NO: 6245069 - DNA, 20 bp, Homo sapiens
gaggcccacattggaagagc

SEQ ID NO: 6245070 - DNA, 19 bp, Homo sapiens
gaggcccacggtttcagct

SEQ ID NO: 6245071 - DNA, 15 bp, Homo sapiens
gaggcccactagagg

SEQ ID NO: 6245072 - DNA, 17 bp, Homo sapiens
gaggcccactagagggc

SEQ ID NO: 6245073 - DNA, 19 bp, Homo sapiens
gaggcccactagagggccc

SEQ ID NO: 6245074 - DNA, 21 bp, Homo sapiens
gaggcccactagagggcccat

SEQ ID NO: 6245075 - DNA, 16 bp, Homo sapiens
gaggcccagagagctg

SEQ ID NO: 6245076 - DNA, 14 bp, Homo sapiens
gaggcccagagggc

SEQ ID NO: 6245077 - DNA, 15 bp, Homo sapiens
gaggcccagagggcc

SEQ ID NO: 6245078 - DNA, 12 bp, Homo sapiens
gaggcccagcca

SEQ ID NO: 6245079 - DNA, 19 bp, Homo sapiens
gaggcccagcgggcagatg

SEQ ID NO: 6245080 - DNA, 15 bp, Homo sapiens
gaggcccaggcacca

SEQ ID NO: 6245081 - DNA, 19 bp, Homo sapiens
gaggcccaggcaccaccag

SEQ ID NO: 6245082 - DNA, 22 bp, Homo sapiens
gaggcccaggcaccaccaggag

SEQ ID NO: 6245083 - DNA, 15 bp, Homo sapiens
gaggcccaggctgcc

SEQ ID NO: 6245084 - DNA, 18 bp, Homo sapiens
gaggcccaggctgccgtc

SEQ ID NO: 6245085 - DNA, 15 bp, Homo sapiens
gaggcccaggctggg

SEQ ID NO: 6245086 - DNA, 23 bp, Homo sapiens
gaggcccaggctgggaactcatc

SEQ ID NO: 6245087 - DNA, 12 bp, Homo sapiens
gaggcccaggga

SEQ ID NO: 6245088 - DNA, 18 bp, Homo sapiens
gaggcccagttcaccctg

SEQ ID NO: 6245089 - DNA, 20 bp, Homo sapiens
gaggcccagttcaccctgat

SEQ ID NO: 6245090 - DNA, 24 bp, Homo sapiens
gaggcccatcccccacctgccagc

SEQ ID NO: 6245091 - DNA, 19 bp, Homo sapiens
gaggcccattagttgagaa

SEQ ID NO: 6245092 - DNA, 13 bp, Homo sapiens
gaggccccaaagg

SEQ ID NO: 6245093 - DNA, 16 bp, Homo sapiens
gaggccccacctgaag

SEQ ID NO: 6245094 - DNA, 15 bp, Homo sapiens
gaggccccactgatg

SEQ ID NO: 6245095 - DNA, 18 bp, Homo sapiens
gaggccccactgatgctg

SEQ ID NO: 6245096 - DNA, 13 bp, Homo sapiens
gaggccccagccg

SEQ ID NO: 6245097 - DNA, 18 bp, Homo sapiens
gaggccccagctctgagg

SEQ ID NO: 6245098 - DNA, 14 bp, Homo sapiens
gaggccccaggctg

SEQ ID NO: 6245099 - DNA, 18 bp, Homo sapiens
gaggccccagggctgtgg

SEQ ID NO: 6245100 - DNA, 17 bp, Homo sapiens
gaggcccccacccttgg

SEQ ID NO: 6245101 - DNA, 15 bp, Homo sapiens
gaggcccccagccca

SEQ ID NO: 6245102 - DNA, 13 bp, Homo sapiens
gaggcccccagtg

SEQ ID NO: 6245103 - DNA, 21 bp, Homo sapiens
gaggcccccagtggggacagg

SEQ ID NO: 6245104 - DNA, 18 bp, Homo sapiens
gaggcccccgtcagggag

SEQ ID NO: 6245105 - DNA, 22 bp, Homo sapiens
gaggccccgccttttcccccac

SEQ ID NO: 6245106 - DNA, 15 bp, Homo sapiens
gcccactgtacttgc

SEQ ID NO: 6245107 - DNA, 16 bp, Homo sapiens
gcccactgtcctgggc

SEQ ID NO: 6245108 - DNA, 17 bp, Homo sapiens
gcccactgtcctgggcc

SEQ ID NO: 6245109 - DNA, 22 bp, Homo sapiens
gcccactgtgcctcagagacca

SEQ ID NO: 6245110 - DNA, 21 bp, Homo sapiens
gcccacttaccctgggctgga

SEQ ID NO: 6245111 - DNA, 17 bp, Homo sapiens
gcccacttcagcccagc

SEQ ID NO: 6245112 - DNA, 20 bp, Homo sapiens
gcccacttctgtgtagacat

SEQ ID NO: 6245113 - DNA, 17 bp, Homo sapiens
gcccacttggggccttc

SEQ ID NO: 6245114 - DNA, 17 bp, Homo sapiens
gcccactttcctgagct

SEQ ID NO: 6245115 - DNA, 21 bp, Homo sapiens
gcccactttcctgagctgtcg

SEQ ID NO: 6245116 - DNA, 15 bp, Homo sapiens
gcccagaaaaaagga

SEQ ID NO: 6245117 - DNA, 17 bp, Homo sapiens
gcccagaaaacctccag

SEQ ID NO: 6245118 - DNA, 17 bp, Homo sapiens
gcccagaaagcctctct

SEQ ID NO: 6245119 - DNA, 18 bp, Homo sapiens
gcccagaaagcctctctc

SEQ ID NO: 6245120 - DNA, 20 bp, Homo sapiens
gcccagaaagcctctctctc

SEQ ID NO: 6245121 - DNA, 15 bp, Homo sapiens
gcccagaaagtgggg

SEQ ID NO: 6245122 - DNA, 16 bp, Homo sapiens
gcccagaaagtggggg

SEQ ID NO: 6245123 - DNA, 16 bp, Homo sapiens
gcccagaacaaaaaga

SEQ ID NO: 6245124 - DNA, 21 bp, Homo sapiens
gcccagaacaaaaagaaatct

SEQ ID NO: 6245125 - DNA, 18 bp, Homo sapiens
gcccagaacgggcctccc

SEQ ID NO: 6245126 - DNA, 11 bp, Homo sapiens
gcccagaactg

SEQ ID NO: 6245127 - DNA, 18 bp, Homo sapiens
gcccagaactgcccccac

SEQ ID NO: 6245128 - DNA, 15 bp, Homo sapiens
gcccagaacttccct

SEQ ID NO: 6245129 - DNA, 12 bp, Homo sapiens
gcccagaaggcc

SEQ ID NO: 6245130 - DNA, 15 bp, Homo sapiens
gcccagaaggccaga

SEQ ID NO: 6245131 - DNA, 16 bp, Homo sapiens
gcccagaaggccagaa

SEQ ID NO: 6245132 - DNA, 20 bp, Homo sapiens
gcccagaaggccagaaaagg

SEQ ID NO: 6245133 - DNA, 23 bp, Homo sapiens
gcccagaaggccagaaaaggcag

SEQ ID NO: 6245134 - DNA, 18 bp, Homo sapiens
gcccagaatccccaagtg

SEQ ID NO: 6245135 - DNA, 18 bp, Homo sapiens
gcccagaattcccagctg

SEQ ID NO: 6245136 - DNA, 21 bp, Homo sapiens
gcccagacacagaagaggctg

SEQ ID NO: 6245137 - DNA, 18 bp, Homo sapiens
gcccagacacagactggc

SEQ ID NO: 6245138 - DNA, 12 bp, Homo sapiens
gcccagacacat

SEQ ID NO: 6245139 - DNA, 17 bp, Homo sapiens
gcccagacaccacagac

SEQ ID NO: 6245140 - DNA, 21 bp, Homo sapiens
gcccagacaccacagacgcca

SEQ ID NO: 6245141 - DNA, 18 bp, Homo sapiens
gcccagacaccatgtgca

SEQ ID NO: 6245142 - DNA, 21 bp, Homo sapiens
gcccagacaccatgtgcaata

SEQ ID NO: 6245143 - DNA, 19 bp, Homo sapiens
gcccagacagcaaggtgtg

SEQ ID NO: 6245144 - DNA, 21 bp, Homo sapiens
gcccagacccactctgcggcc

SEQ ID NO: 6245145 - DNA, 17 bp, Homo sapiens
gcccagacccccagtgt

SEQ ID NO: 6245146 - DNA, 12 bp, Homo sapiens
gcccagaccctg

SEQ ID NO: 6245147 - DNA, 13 bp, Homo sapiens
gcccagaccctgg

SEQ ID NO: 6245148 - DNA, 14 bp, Homo sapiens
gcccagaccctggg

SEQ ID NO: 6245149 - DNA, 16 bp, Homo sapiens
gcccagaccggcttct

SEQ ID NO: 6245150 - DNA, 14 bp, Homo sapiens
gcccagacctggcc

SEQ ID NO: 6245151 - DNA, 19 bp, Homo sapiens
gcccagacctggcctctgc

SEQ ID NO: 6245152 - DNA, 21 bp, Homo sapiens
gcccagacctggcctctgcca

SEQ ID NO: 6245153 - DNA, 15 bp, Homo sapiens
gcccagactacaggg

SEQ ID NO: 6245154 - DNA, 11 bp, Homo sapiens
gcccagactct

SEQ ID NO: 6245155 - DNA, 23 bp, Homo sapiens
gcccagactctgagctgctcacc

SEQ ID NO: 6245156 - DNA, 16 bp, Homo sapiens
gcccagactgatgagc

SEQ ID NO: 6245157 - DNA, 18 bp, Homo sapiens
gcccagactgatgagcac

SEQ ID NO: 6245158 - DNA, 15 bp, Homo sapiens
gcccagactttagtg

SEQ ID NO: 6245159 - DNA, 13 bp, Homo sapiens
gcccagagaacag

SEQ ID NO: 6245160 - DNA, 14 bp, Homo sapiens
gcccagagaacagc

SEQ ID NO: 6245161 - DNA, 21 bp, Homo sapiens
gcccagagaagctggaagcct

SEQ ID NO: 6245162 - DNA, 19 bp, Homo sapiens
gcccagagacccaagctgc

SEQ ID NO: 6245163 - DNA, 16 bp, Homo sapiens
gcccagagacccagcg

SEQ ID NO: 6245164 - DNA, 17 bp, Homo sapiens
gcccagagagaagagcc

SEQ ID NO: 6245165 - DNA, 20 bp, Homo sapiens
gcccagagagaggcgtcctg

SEQ ID NO: 6245166 - DNA, 13 bp, Homo sapiens
gcccagagagctg

SEQ ID NO: 6245167 - DNA, 15 bp, Homo sapiens
gcccagagagggtgg

SEQ ID NO: 6245168 - DNA, 16 bp, Homo sapiens
gcccagagatgcctcc

SEQ ID NO: 6245169 - DNA, 18 bp, Homo sapiens
gcccagagatgcctccac

SEQ ID NO: 6245170 - DNA, 19 bp, Homo sapiens
gcccagagatgcctccacc

SEQ ID NO: 6245171 - DNA, 18 bp, Homo sapiens
gcccagagcactttagca

SEQ ID NO: 6245172 - DNA, 15 bp, Homo sapiens
gcccagagcaggaag

SEQ ID NO: 6245173 - DNA, 13 bp, Homo sapiens
gcccagagcccag

SEQ ID NO: 6245174 - DNA, 24 bp, Homo sapiens
gcccagagcccttgactgtacaga

SEQ ID NO: 6245175 - DNA, 12 bp, Homo sapiens
gcccagagctgg

SEQ ID NO: 6245176 - DNA, 14 bp, Homo sapiens
gcccagagctggcc

SEQ ID NO: 6245177 - DNA, 16 bp, Homo sapiens
gcccagagctggcctc

SEQ ID NO: 6245178 - DNA, 19 bp, Homo sapiens
gcccagagctgggtgagtg

SEQ ID NO: 6245179 - DNA, 16 bp, Homo sapiens
gcccagaggactccca

SEQ ID NO: 6245180 - DNA, 18 bp, Homo sapiens
gcccagaggagaggagac

SEQ ID NO: 6245181 - DNA, 22 bp, Homo sapiens
gcccagaggagaggagacagac

SEQ ID NO: 6245182 - DNA, 18 bp, Homo sapiens
gcccagaggagccaagtc

SEQ ID NO: 6245183 - DNA, 21 bp, Homo sapiens
gcccagaggagcccagcggcc

SEQ ID NO: 6245184 - DNA, 20 bp, Homo sapiens
gcccagagggcccaggcagg

SEQ ID NO: 6245185 - DNA, 19 bp, Homo sapiens
gcccagagggcctgcaagg

SEQ ID NO: 6245186 - DNA, 21 bp, Homo sapiens
gcccagagggcctgcaaggga

SEQ ID NO: 6245187 - DNA, 22 bp, Homo sapiens
gcccagagggcctgcaagggag

SEQ ID NO: 6245188 - DNA, 14 bp, Homo sapiens
gcccagagggtctg

SEQ ID NO: 6245189 - DNA, 15 bp, Homo sapiens
gcccagagggtctgg

SEQ ID NO: 6245190 - DNA, 19 bp, Homo sapiens
gcccagagggtctgggggc

SEQ ID NO: 6245191 - DNA, 16 bp, Homo sapiens
gcccagaggtaacaga

SEQ ID NO: 6245192 - DNA, 18 bp, Homo sapiens
gcccagaggtaacagaac

SEQ ID NO: 6245193 - DNA, 12 bp, Homo sapiens
gcccagagtgag

SEQ ID NO: 6245194 - DNA, 17 bp, Homo sapiens
gcccagagttgggggct

SEQ ID NO: 6245195 - DNA, 20 bp, Homo sapiens
gcccagatacgggggctgtg

SEQ ID NO: 6245196 - DNA, 17 bp, Homo sapiens
gcccagatcagctccta

SEQ ID NO: 6245197 - DNA, 15 bp, Homo sapiens
gcccagatcatgccg

SEQ ID NO: 6245198 - DNA, 15 bp, Homo sapiens
gcccagatcccaaga

SEQ ID NO: 6245199 - DNA, 20 bp, Homo sapiens
gcccagatcgttctgccact

SEQ ID NO: 6245200 - DNA, 15 bp, Homo sapiens
gcccagatggctccc

SEQ ID NO: 6245201 - DNA, 20 bp, Homo sapiens
gcccagatgtgtccccccca

SEQ ID NO: 6245202 - DNA, 16 bp, Homo sapiens
gcccagatgttttaga

SEQ ID NO: 6245203 - DNA, 19 bp, Homo sapiens
gcccagattcccctgtgtc

SEQ ID NO: 6245204 - DNA, 19 bp, Homo sapiens
gcccagcaaggaccagtga

SEQ ID NO: 6245205 - DNA, 13 bp, Homo sapiens
gcccagcaatcaa

SEQ ID NO: 6245206 - DNA, 21 bp, Homo sapiens
gcccagcaccaccctccttcc

SEQ ID NO: 6245207 - DNA, 16 bp, Homo sapiens
gcccagcacctcctcc

SEQ ID NO: 6245208 - DNA, 14 bp, Homo sapiens
gcccagcacctgct

SEQ ID NO: 6245209 - DNA, 15 bp, Homo sapiens
gcccagcacctgctc

SEQ ID NO: 6245210 - DNA, 17 bp, Homo sapiens
gcccagcacctgctccc

SEQ ID NO: 6245211 - DNA, 18 bp, Homo sapiens
gcccagcacctgctccca

SEQ ID NO: 6245212 - DNA, 19 bp, Homo sapiens
gcccagcacctgctcccag

SEQ ID NO: 6245213 - DNA, 22 bp, Homo sapiens
gcccagcacctgctcccagtgg

SEQ ID NO: 6245214 - DNA, 14 bp, Homo sapiens
gcccagcacctgga

SEQ ID NO: 6245215 - DNA, 21 bp, Homo sapiens
gcccagcactgcttgaggaaa

SEQ ID NO: 6245216 - DNA, 16 bp, Homo sapiens
gcccagcactgtctgc

SEQ ID NO: 6245217 - DNA, 14 bp, Homo sapiens
gcccagcagagccg

SEQ ID NO: 6245218 - DNA, 23 bp, Homo sapiens
gcccagcagcccctgagagcctg

SEQ ID NO: 6245219 - DNA, 15 bp, Homo sapiens
gcccagcagcttggc

SEQ ID NO: 6245220 - DNA, 14 bp, Homo sapiens
gcccagcaggagag

SEQ ID NO: 6245221 - DNA, 15 bp, Homo sapiens
gcccagcaggcaggc

SEQ ID NO: 6245222 - DNA, 17 bp, Homo sapiens
gcccagcaggcaggcac

SEQ ID NO: 6245223 - DNA, 19 bp, Homo sapiens
gcccagcaggcaggcactg

SEQ ID NO: 6245224 - DNA, 17 bp, Homo sapiens
gcccagcaggcccagca

SEQ ID NO: 6245225 - DNA, 19 bp, Homo sapiens
gcccagcaggcccagcatg

SEQ ID NO: 6245226 - DNA, 20 bp, Homo sapiens
gcccagcaggcccagcatgc

SEQ ID NO: 6245227 - DNA, 21 bp, Homo sapiens
gcccagcaggcccagcatgca

SEQ ID NO: 6245228 - DNA, 18 bp, Homo sapiens
gcccagcagtttcccaga

SEQ ID NO: 6245229 - DNA, 16 bp, Homo sapiens
gcccagcattgctggt

SEQ ID NO: 6245230 - DNA, 20 bp, Homo sapiens
gcccagcatttcccgaaggc

SEQ ID NO: 6245231 - DNA, 11 bp, Homo sapiens
gcccagccacc

SEQ ID NO: 6245232 - DNA, 23 bp, Homo sapiens
gcccagccacggacgctggctcc

SEQ ID NO: 6245233 - DNA, 17 bp, Homo sapiens
gcccagccactgcagca

SEQ ID NO: 6245234 - DNA, 15 bp, Homo sapiens
gcccagccagccacc

SEQ ID NO: 6245235 - DNA, 21 bp, Homo sapiens
gcccagccagccacccctgcc

SEQ ID NO: 6245236 - DNA, 22 bp, Homo sapiens
gcccagccagccacccctgcca

SEQ ID NO: 6245237 - DNA, 23 bp, Homo sapiens
gcccagccagccatcggaagaga

SEQ ID NO: 6245238 - DNA, 12 bp, Homo sapiens
gcccagccagcg

SEQ ID NO: 6245239 - DNA, 11 bp, Homo sapiens
gcccagccagg

SEQ ID NO: 6245240 - DNA, 13 bp, Homo sapiens
gcccagccaggag

SEQ ID NO: 6245241 - DNA, 17 bp, Homo sapiens
gcccagccaggccccag

SEQ ID NO: 6245242 - DNA, 14 bp, Homo sapiens
gcccagccagggtg

SEQ ID NO: 6245243 - DNA, 14 bp, Homo sapiens
gcccagccatggct

SEQ ID NO: 6245244 - DNA, 19 bp, Homo sapiens
gcccagccatgggccctct

SEQ ID NO: 6245245 - DNA, 22 bp, Homo sapiens
gcccagccatgggccctctgag

SEQ ID NO: 6245246 - DNA, 21 bp, Homo sapiens
gcccagccattaccatggaga

SEQ ID NO: 6245247 - DNA, 14 bp, Homo sapiens
gcccagcccaagtg

SEQ ID NO: 6245248 - DNA, 11 bp, Homo sapiens
gcccagcccag

SEQ ID NO: 6245249 - DNA, 18 bp, Homo sapiens
gcccagcccagagccacc

SEQ ID NO: 6245250 - DNA, 16 bp, Homo sapiens
gcccagcccagctggt

SEQ ID NO: 6245251 - DNA, 12 bp, Homo sapiens
gcccagcccagg

SEQ ID NO: 6245252 - DNA, 20 bp, Homo sapiens
gcccagcccaggagtttgag

SEQ ID NO: 6245253 - DNA, 13 bp, Homo sapiens
gcccagcccaggc

SEQ ID NO: 6245254 - DNA, 15 bp, Homo sapiens
gcccagcccaggcct

SEQ ID NO: 6245255 - DNA, 19 bp, Homo sapiens
gcccagcccatttgggctc

SEQ ID NO: 6245256 - DNA, 17 bp, Homo sapiens
gcccagccccactcctc

SEQ ID NO: 6245257 - DNA, 16 bp, Homo sapiens
gcccagccccaggtct

SEQ ID NO: 6245258 - DNA, 17 bp, Homo sapiens
gcccagccccatccctg

SEQ ID NO: 6245259 - DNA, 21 bp, Homo sapiens
gcccagccccatccctgtcct

SEQ ID NO: 6245260 - DNA, 22 bp, Homo sapiens
gcccagccccatccctgtcctc

SEQ ID NO: 6245261 - DNA, 11 bp, Homo sapiens
gcccagccccc

SEQ ID NO: 6245262 - DNA, 13 bp, Homo sapiens
gcccagcccccac

SEQ ID NO: 6245263 - DNA, 21 bp, Homo sapiens
gcccagcccccacagtgctgt

SEQ ID NO: 6245264 - DNA, 15 bp, Homo sapiens
gcccagcccccaccc

SEQ ID NO: 6245265 - DNA, 19 bp, Homo sapiens
gcccagcccccacccccgt

SEQ ID NO: 6245266 - DNA, 18 bp, Homo sapiens
gcccagcccctactgctg

SEQ ID NO: 6245267 - DNA, 13 bp, Homo sapiens
gcccagcccctcc

SEQ ID NO: 6245268 - DNA, 12 bp, Homo sapiens
gcccagcccctt

SEQ ID NO: 6245269 - DNA, 14 bp, Homo sapiens
gcccagccccttct

SEQ ID NO: 6245270 - DNA, 24 bp, Homo sapiens
gcccagccccttctgacccatgct

SEQ ID NO: 6245271 - DNA, 14 bp, Homo sapiens
gcccagcccctttt

SEQ ID NO: 6245272 - DNA, 16 bp, Homo sapiens
gcccagcccggcaggg

SEQ ID NO: 6245273 - DNA, 11 bp, Homo sapiens
gcccagccctc

SEQ ID NO: 6245274 - DNA, 12 bp, Homo sapiens
gcccagccctcc

SEQ ID NO: 6245275 - DNA, 16 bp, Homo sapiens
gcccagccctccccat

SEQ ID NO: 6245276 - DNA, 17 bp, Homo sapiens
gcccagccctctgtggc

SEQ ID NO: 6245277 - DNA, 18 bp, Homo sapiens
gcccagccctctgtggcc

SEQ ID NO: 6245278 - DNA, 21 bp, Homo sapiens
gcccagccctctgtggccagg

SEQ ID NO: 6245279 - DNA, 12 bp, Homo sapiens
gcccagccctgc

SEQ ID NO: 6245280 - DNA, 12 bp, Homo sapiens
gcccagccctgg

SEQ ID NO: 6245281 - DNA, 17 bp, Homo sapiens
gcccagccctggcccag

SEQ ID NO: 6245282 - DNA, 15 bp, Homo sapiens
gcccagccctgggca

SEQ ID NO: 6245283 - DNA, 17 bp, Homo sapiens
gcccagccctgggcaag

SEQ ID NO: 6245284 - DNA, 15 bp, Homo sapiens
gcccagccctgttct

SEQ ID NO: 6245285 - DNA, 20 bp, Homo sapiens
gcccagccggcctctctggc

SEQ ID NO: 6245286 - DNA, 21 bp, Homo sapiens
gcccagccggcctctctggcc

SEQ ID NO: 6245287 - DNA, 22 bp, Homo sapiens
gcccagccggcctctctggcct

SEQ ID NO: 6245288 - DNA, 23 bp, Homo sapiens
gcccagccggcctctctggcctc

SEQ ID NO: 6245289 - DNA, 16 bp, Homo sapiens
gcccagccgggcacag

SEQ ID NO: 6245290 - DNA, 13 bp, Homo sapiens
gcccagcctaccc

SEQ ID NO: 6245291 - DNA, 10 bp, Homo sapiens
gcccagcctc

SEQ ID NO: 6245292 - DNA, 13 bp, Homo sapiens
gcccagcctcact

SEQ ID NO: 6245293 - DNA, 17 bp, Homo sapiens
gcccagcctcacttcct

SEQ ID NO: 6245294 - DNA, 20 bp, Homo sapiens
gcccagcctcacttcctttg

SEQ ID NO: 6245295 - DNA, 16 bp, Homo sapiens
gcccagcctcctccca

SEQ ID NO: 6245296 - DNA, 21 bp, Homo sapiens
gcccagcctcctcccaccacc

SEQ ID NO: 6245297 - DNA, 21 bp, Homo sapiens
gcccagcctctctggctcagc

SEQ ID NO: 6245298 - DNA, 17 bp, Homo sapiens
gcccagcctctgagtcc

SEQ ID NO: 6245299 - DNA, 19 bp, Homo sapiens
gcccagcctctgagtcccg

SEQ ID NO: 6245300 - DNA, 16 bp, Homo sapiens
gcccagcctctgcccc

SEQ ID NO: 6245301 - DNA, 13 bp, Homo sapiens
gcccagcctctgt

SEQ ID NO: 6245302 - DNA, 20 bp, Homo sapiens
gcccagcctctgtccctctt

SEQ ID NO: 6245303 - DNA, 12 bp, Homo sapiens
gcccagcctgcc

SEQ ID NO: 6245304 - DNA, 15 bp, Homo sapiens
gcccagcctgctcag

SEQ ID NO: 6245305 - DNA, 19 bp, Homo sapiens
gcccagcctgggagcccag

SEQ ID NO: 6245306 - DNA, 20 bp, Homo sapiens
gcccagcctgggagcccaga

SEQ ID NO: 6245307 - DNA, 12 bp, Homo sapiens
gcccagcctgtc

SEQ ID NO: 6245308 - DNA, 16 bp, Homo sapiens
gcccagcctgtcctgg

SEQ ID NO: 6245309 - DNA, 20 bp, Homo sapiens
gcccagcctgtggcctcagc

SEQ ID NO: 6245310 - DNA, 21 bp, Homo sapiens
gcccagcctgtggcctcagca

SEQ ID NO: 6245311 - DNA, 15 bp, Homo sapiens
gcccagcgccaagta

SEQ ID NO: 6245312 - DNA, 14 bp, Homo sapiens
gcccagcgcggcca

SEQ ID NO: 6245313 - DNA, 15 bp, Homo sapiens
gcccagcgcggccag

SEQ ID NO: 6245314 - DNA, 14 bp, Homo sapiens
gcccagcgctcgcc

SEQ ID NO: 6245315 - DNA, 15 bp, Homo sapiens
gcccagcgctcgcca

SEQ ID NO: 6245316 - DNA, 16 bp, Homo sapiens
gcccagcgctcgccac

SEQ ID NO: 6245317 - DNA, 15 bp, Homo sapiens
gcccagcgctctcct

SEQ ID NO: 6245318 - DNA, 16 bp, Homo sapiens
gcccagcgctctgcct

SEQ ID NO: 6245319 - DNA, 14 bp, Homo sapiens
gcccagcggcccaa

SEQ ID NO: 6245320 - DNA, 17 bp, Homo sapiens
gcccagcggcccctccc

SEQ ID NO: 6245321 - DNA, 15 bp, Homo sapiens
gcccagcgggcagat

SEQ ID NO: 6245322 - DNA, 23 bp, Homo sapiens
gcccagcggtccctgcagaagcc

SEQ ID NO: 6245323 - DNA, 16 bp, Homo sapiens
gcccagcgtcagaagt

SEQ ID NO: 6245324 - DNA, 17 bp, Homo sapiens
gcccagcgtcagaagtc

SEQ ID NO: 6245325 - DNA, 17 bp, Homo sapiens
gcccagctaatttttgt

SEQ ID NO: 6245326 - DNA, 21 bp, Homo sapiens
gcccagctacattcctcagct

SEQ ID NO: 6245327 - DNA, 20 bp, Homo sapiens
gcccagctatggccccaggg

SEQ ID NO: 6245328 - DNA, 14 bp, Homo sapiens
gcccagctcagtct

SEQ ID NO: 6245329 - DNA, 15 bp, Homo sapiens
gcccagctccaaggg

SEQ ID NO: 6245330 - DNA, 17 bp, Homo sapiens
gcccagctccactcagg

SEQ ID NO: 6245331 - DNA, 18 bp, Homo sapiens
gcccagctccactcaggg

SEQ ID NO: 6245332 - DNA, 19 bp, Homo sapiens
gcccagctccactcagggc

SEQ ID NO: 6245333 - DNA, 21 bp, Homo sapiens
gcccagctccactcagggctg

SEQ ID NO: 6245334 - DNA, 12 bp, Homo sapiens
gcccagctccag

SEQ ID NO: 6245335 - DNA, 12 bp, Homo sapiens
gcccagctcccc

SEQ ID NO: 6245336 - DNA, 16 bp, Homo sapiens
gcccagctccgcctgc

SEQ ID NO: 6245337 - DNA, 18 bp, Homo sapiens
gcccagctccgcctgctg

SEQ ID NO: 6245338 - DNA, 15 bp, Homo sapiens
gcccagctcctcacc

SEQ ID NO: 6245339 - DNA, 17 bp, Homo sapiens
gcccagctcctcaccca

SEQ ID NO: 6245340 - DNA, 23 bp, Homo sapiens
gcccagctcctgacactgctgga

SEQ ID NO: 6245341 - DNA, 14 bp, Homo sapiens
gcccagctctctga

SEQ ID NO: 6245342 - DNA, 17 bp, Homo sapiens
gcccagctctctgacgc

SEQ ID NO: 6245343 - DNA, 12 bp, Homo sapiens
gcccagctcttg

SEQ ID NO: 6245344 - DNA, 18 bp, Homo sapiens
gcccagctcttgctctct

SEQ ID NO: 6245345 - DNA, 21 bp, Homo sapiens
gcccagctcttgctctcttgt

SEQ ID NO: 6245346 - DNA, 15 bp, Homo sapiens
gcccagctgcacctg

SEQ ID NO: 6245347 - DNA, 20 bp, Homo sapiens
gcccagctgccagggaagac

SEQ ID NO: 6245348 - DNA, 13 bp, Homo sapiens
gcccagctgcctg

SEQ ID NO: 6245349 - DNA, 14 bp, Homo sapiens
gcccagctgcctgg

SEQ ID NO: 6245350 - DNA, 15 bp, Homo sapiens
gcccagctgctctgc

SEQ ID NO: 6245351 - DNA, 19 bp, Homo sapiens
gcccagctgctctgcccag

SEQ ID NO: 6245352 - DNA, 22 bp, Homo sapiens
gcccagctgctctgcccagagc

SEQ ID NO: 6245353 - DNA, 23 bp, Homo sapiens
gcccagctgctctgcccagagct

SEQ ID NO: 6245354 - DNA, 11 bp, Homo sapiens
gcccagctggc

SEQ ID NO: 6245355 - DNA, 14 bp, Homo sapiens
gcccagctggccac

SEQ ID NO: 6245356 - DNA, 17 bp, Homo sapiens
gcccagctggccggaag

SEQ ID NO: 6245357 - DNA, 22 bp, Homo sapiens
gcccagctggcctggcccccag

SEQ ID NO: 6245358 - DNA, 23 bp, Homo sapiens
gcccagctggcctggcccccagc

SEQ ID NO: 6245359 - DNA, 23 bp, Homo sapiens
gcccagctgggctctgccaccct

SEQ ID NO: 6245360 - DNA, 20 bp, Homo sapiens
gcccagctggggcccctcgg

SEQ ID NO: 6245361 - DNA, 21 bp, Homo sapiens
gcccagctggggcccctcggc

SEQ ID NO: 6245362 - DNA, 23 bp, Homo sapiens
gcccagctggggcccctcggcta

SEQ ID NO: 6245363 - DNA, 24 bp, Homo sapiens
gcccagctggggcccctcggctac

SEQ ID NO: 6245364 - DNA, 15 bp, Homo sapiens
gcccagctgggtcag

SEQ ID NO: 6245365 - DNA, 20 bp, Homo sapiens
gcccagctgggtcaggcagg

SEQ ID NO: 6245366 - DNA, 10 bp, Homo sapiens
gcccagctgt

SEQ ID NO: 6245367 - DNA, 14 bp, Homo sapiens
gcccagctgtagcc

SEQ ID NO: 6245368 - DNA, 22 bp, Homo sapiens
gcccagctgtagccatggctca

SEQ ID NO: 6245369 - DNA, 13 bp, Homo sapiens
gcccagcttcctg

SEQ ID NO: 6245370 - DNA, 14 bp, Homo sapiens
gcccagcttcctgg

SEQ ID NO: 6245371 - DNA, 18 bp, Homo sapiens
gcccagcttcgtcagctc

SEQ ID NO: 6245372 - DNA, 20 bp, Homo sapiens
gcccagcttcgtcagctcca

SEQ ID NO: 6245373 - DNA, 23 bp, Homo sapiens
gcccagcttcgtcagctccagcg

SEQ ID NO: 6245374 - DNA, 21 bp, Homo sapiens
gcccagcttggagtgccacgt

SEQ ID NO: 6245375 - DNA, 22 bp, Homo sapiens
gcccagcttgggcccagctggg

SEQ ID NO: 6245376 - DNA, 20 bp, Homo sapiens
gcccaggaaaaacctgtggg

SEQ ID NO: 6245377 - DNA, 19 bp, Homo sapiens
gcccaggaaaaactggaag

SEQ ID NO: 6245378 - DNA, 23 bp, Homo sapiens
gcccaggaaaggacggctgagca

SEQ ID NO: 6245379 - DNA, 18 bp, Homo sapiens
gcccaggaaaggctccag

SEQ ID NO: 6245380 - DNA, 20 bp, Homo sapiens
gcccaggaaaggctccagga

SEQ ID NO: 6245381 - DNA, 22 bp, Homo sapiens
gcccaggaaaggctccaggagc

SEQ ID NO: 6245382 - DNA, 24 bp, Homo sapiens
gcccaggaaaggctccaggagcag

SEQ ID NO: 6245383 - DNA, 23 bp, Homo sapiens
gcccaggaactcgcacctgtgct

SEQ ID NO: 6245384 - DNA, 13 bp, Homo sapiens
gcccaggaagccc

SEQ ID NO: 6245385 - DNA, 19 bp, Homo sapiens
gcccaggaagcccacacta

SEQ ID NO: 6245386 - DNA, 19 bp, Homo sapiens
gcccaggaaggcggcaggc

SEQ ID NO: 6245387 - DNA, 21 bp, Homo sapiens
gcccaggaaggcggcaggcag

SEQ ID NO: 6245388 - DNA, 15 bp, Homo sapiens
gcccaggaagtaatt

SEQ ID NO: 6245389 - DNA, 21 bp, Homo sapiens
gcccaggaagtctcatctggg

SEQ ID NO: 6245390 - DNA, 20 bp, Homo sapiens
gcccaggaatttgaagctgc

SEQ ID NO: 6245391 - DNA, 16 bp, Homo sapiens
gcccaggacagctggt

SEQ ID NO: 6245392 - DNA, 17 bp, Homo sapiens
gcccaggacggtctgtg

SEQ ID NO: 6245393 - DNA, 19 bp, Homo sapiens
gcccaggacggtctgtgcc

SEQ ID NO: 6245394 - DNA, 21 bp, Homo sapiens
gcccaggacggtctgtgcccg

SEQ ID NO: 6245395 - DNA, 22 bp, Homo sapiens
gcccaggacgtcctatctcccc

SEQ ID NO: 6245396 - DNA, 14 bp, Homo sapiens
gcccaggactctgg

SEQ ID NO: 6245397 - DNA, 16 bp, Homo sapiens
gcccaggactgcattg

SEQ ID NO: 6245398 - DNA, 21 bp, Homo sapiens
gcccaggagaattaggaaggc

SEQ ID NO: 6245399 - DNA, 22 bp, Homo sapiens
gcccaggagaattaggaaggcc

SEQ ID NO: 6245400 - DNA, 19 bp, Homo sapiens
gcccaggagacctccagct

SEQ ID NO: 6245401 - DNA, 13 bp, Homo sapiens
gcccaggagagag

SEQ ID NO: 6245402 - DNA, 20 bp, Homo sapiens
gcccaggagagagaaagcca

SEQ ID NO: 6245403 - DNA, 20 bp, Homo sapiens
gcccaggagagcccccacca

SEQ ID NO: 6245404 - DNA, 11 bp, Homo sapiens
gcccaggagca

SEQ ID NO: 6245405 - DNA, 15 bp, Homo sapiens
gcccaggagcaacag

SEQ ID NO: 6245406 - DNA, 19 bp, Homo sapiens
gcccaggagcaagtgaggc

SEQ ID NO: 6245407 - DNA, 21 bp, Homo sapiens
gcccaggagcaagtgaggccg

SEQ ID NO: 6245408 - DNA, 14 bp, Homo sapiens
gcccaggagcagct

SEQ ID NO: 6245409 - DNA, 11 bp, Homo sapiens
gcccaggagcc

SEQ ID NO: 6245410 - DNA, 13 bp, Homo sapiens
gcccaggagccca

SEQ ID NO: 6245411 - DNA, 15 bp, Homo sapiens
gcccaggagcccatt

SEQ ID NO: 6245412 - DNA, 14 bp, Homo sapiens
gcccaggagcctca

SEQ ID NO: 6245413 - DNA, 17 bp, Homo sapiens
gcccaggagcgcagctg

SEQ ID NO: 6245414 - DNA, 19 bp, Homo sapiens
gcccaggagcgcagctgca

SEQ ID NO: 6245415 - DNA, 15 bp, Homo sapiens
gcccaggagctcccc

SEQ ID NO: 6245416 - DNA, 17 bp, Homo sapiens
gcccaggagctcccctc

SEQ ID NO: 6245417 - DNA, 14 bp, Homo sapiens
gcccaggagctctg

SEQ ID NO: 6245418 - DNA, 17 bp, Homo sapiens
gcccaggagctctgcgc

SEQ ID NO: 6245419 - DNA, 18 bp, Homo sapiens
gcccaggagctctgcgcc

SEQ ID NO: 6245420 - DNA, 19 bp, Homo sapiens
gcccaggagctctgcgcca

SEQ ID NO: 6245421 - DNA, 20 bp, Homo sapiens
gcccaggagctctgcgccag

SEQ ID NO: 6245422 - DNA, 16 bp, Homo sapiens
gcccaggaggacctgg

SEQ ID NO: 6245423 - DNA, 22 bp, Homo sapiens
gcccaggagggcatccatacca

SEQ ID NO: 6245424 - DNA, 21 bp, Homo sapiens
gcccaggagtttgaggctgca

SEQ ID NO: 6245425 - DNA, 15 bp, Homo sapiens
gcccaggagtttggc

SEQ ID NO: 6245426 - DNA, 16 bp, Homo sapiens
gcccaggatatatttt

SEQ ID NO: 6245427 - DNA, 18 bp, Homo sapiens
gcccaggatatattttat

SEQ ID NO: 6245428 - DNA, 12 bp, Homo sapiens
gcccaggatctc

SEQ ID NO: 6245429 - DNA, 19 bp, Homo sapiens
gcccaggattgtacgtggg

SEQ ID NO: 6245430 - DNA, 21 bp, Homo sapiens
gcccaggattgtacgtgggag

SEQ ID NO: 6245431 - DNA, 16 bp, Homo sapiens
gcccaggcaccaccag

SEQ ID NO: 6245432 - DNA, 19 bp, Homo sapiens
gcccaggcaccaccaggag

SEQ ID NO: 6245433 - DNA, 21 bp, Homo sapiens
gcccaggcaccaccaggagca

SEQ ID NO: 6245434 - DNA, 15 bp, Homo sapiens
gcccaggcactgcaa

SEQ ID NO: 6245435 - DNA, 12 bp, Homo sapiens
gcccaggcagca

SEQ ID NO: 6245436 - DNA, 13 bp, Homo sapiens
gcccaggcagcac

SEQ ID NO: 6245437 - DNA, 22 bp, Homo sapiens
gcccaggcagctatttcagcct

SEQ ID NO: 6245438 - DNA, 12 bp, Homo sapiens
gcccaggcaggc

SEQ ID NO: 6245439 - DNA, 18 bp, Homo sapiens
gcccaggcaggcccagcc

SEQ ID NO: 6245440 - DNA, 22 bp, Homo sapiens
gcccaggcaggcccagcctctg

SEQ ID NO: 6245441 - DNA, 23 bp, Homo sapiens
gcccaggcaggcccagcctctgc

SEQ ID NO: 6245442 - DNA, 15 bp, Homo sapiens
gcccaggcaggtctg

SEQ ID NO: 6245443 - DNA, 18 bp, Homo sapiens
gcccaggcatctccttgg

SEQ ID NO: 6245444 - DNA, 20 bp, Homo sapiens
gcccaggcatctccttgggc

SEQ ID NO: 6245445 - DNA, 21 bp, Homo sapiens
gcccaggccacagagaacctg

SEQ ID NO: 6245446 - DNA, 14 bp, Homo sapiens
gcccaggccacagc

SEQ ID NO: 6245447 - DNA, 19 bp, Homo sapiens
gcccaggccaggactctgc

SEQ ID NO: 6245448 - DNA, 24 bp, Homo sapiens
gcccaggccaggactctgcagcct

SEQ ID NO: 6245449 - DNA, 16 bp, Homo sapiens
gcccaggccaggtgcc

SEQ ID NO: 6245450 - DNA, 15 bp, Homo sapiens
gcccaggccatgtgg

SEQ ID NO: 6245451 - DNA, 12 bp, Homo sapiens
gcccaggcccag

SEQ ID NO: 6245452 - DNA, 13 bp, Homo sapiens
gcccaggcccagc

SEQ ID NO: 6245453 - DNA, 15 bp, Homo sapiens
gcccaggcccagcct

SEQ ID NO: 6245454 - DNA, 12 bp, Homo sapiens
gcccaggccccc

SEQ ID NO: 6245455 - DNA, 20 bp, Homo sapiens
gcccaggcccccggctttcc

SEQ ID NO: 6245456 - DNA, 14 bp, Homo sapiens
gcccaggccctaga

SEQ ID NO: 6245457 - DNA, 14 bp, Homo sapiens
gcccaggccggcca

SEQ ID NO: 6245458 - DNA, 17 bp, Homo sapiens
gcccaggccggccagcc

SEQ ID NO: 6245459 - DNA, 21 bp, Homo sapiens
gcccaggccgggaagagccac

SEQ ID NO: 6245460 - DNA, 22 bp, Homo sapiens
gcccaggccgttccccttggct

SEQ ID NO: 6245461 - DNA, 16 bp, Homo sapiens
gcccaggcctcaccac

SEQ ID NO: 6245462 - DNA, 13 bp, Homo sapiens
gcccaggcctcca

SEQ ID NO: 6245463 - DNA, 15 bp, Homo sapiens
gcccaggcctccacg

SEQ ID NO: 6245464 - DNA, 22 bp, Homo sapiens
gaggcccctaggtgcccagggc

SEQ ID NO: 6245465 - DNA, 14 bp, Homo sapiens
gaggcccctgggct

SEQ ID NO: 6245466 - DNA, 16 bp, Homo sapiens
gaggcccctgggctct

SEQ ID NO: 6245467 - DNA, 24 bp, Homo sapiens
gaggcccctgggtccttctagctt

SEQ ID NO: 6245468 - DNA, 18 bp, Homo sapiens
gaggcccctgtgcagtag

SEQ ID NO: 6245469 - DNA, 15 bp, Homo sapiens
gaggccccttgctgc

SEQ ID NO: 6245470 - DNA, 18 bp, Homo sapiens
gaggccccttgctgctgg

SEQ ID NO: 6245471 - DNA, 18 bp, Homo sapiens
gaggcccgaggcaccgga

SEQ ID NO: 6245472 - DNA, 18 bp, Homo sapiens
gaggcccgaggcagaagg

SEQ ID NO: 6245473 - DNA, 23 bp, Homo sapiens
gaggcccgccctgcccgggctcc

SEQ ID NO: 6245474 - DNA, 13 bp, Homo sapiens
gaggccctaggcg

SEQ ID NO: 6245475 - DNA, 22 bp, Homo sapiens
gaggccctcaatccaccttcag

SEQ ID NO: 6245476 - DNA, 23 bp, Homo sapiens
gaggccctcaatccaccttcagg

SEQ ID NO: 6245477 - DNA, 18 bp, Homo sapiens
gaggccctccacacctgc

SEQ ID NO: 6245478 - DNA, 13 bp, Homo sapiens
gaggccctcccaa

SEQ ID NO: 6245479 - DNA, 21 bp, Homo sapiens
gaggccctcctgtgctggggg

SEQ ID NO: 6245480 - DNA, 17 bp, Homo sapiens
gaggccctcgctgccag

SEQ ID NO: 6245481 - DNA, 16 bp, Homo sapiens
gaggccctcgggccca

SEQ ID NO: 6245482 - DNA, 20 bp, Homo sapiens
gaggccctcgggcccagccc

SEQ ID NO: 6245483 - DNA, 12 bp, Homo sapiens
gaggccctgcat

SEQ ID NO: 6245484 - DNA, 12 bp, Homo sapiens
gaggccctgccc

SEQ ID NO: 6245485 - DNA, 14 bp, Homo sapiens
gaggccctgccccc

SEQ ID NO: 6245486 - DNA, 16 bp, Homo sapiens
gaggccctgcccccac

SEQ ID NO: 6245487 - DNA, 17 bp, Homo sapiens
gaggccctgcccccacc

SEQ ID NO: 6245488 - DNA, 17 bp, Homo sapiens
gaggccctgcctgaccc

SEQ ID NO: 6245489 - DNA, 15 bp, Homo sapiens
gaggccctggaggga

SEQ ID NO: 6245490 - DNA, 18 bp, Homo sapiens
gaggccctggagggaagg

SEQ ID NO: 6245491 - DNA, 19 bp, Homo sapiens
gaggccctggagggaagga

SEQ ID NO: 6245492 - DNA, 13 bp, Homo sapiens
gaggccctggatc

SEQ ID NO: 6245493 - DNA, 11 bp, Homo sapiens
gaggccctggc

SEQ ID NO: 6245494 - DNA, 12 bp, Homo sapiens
gaggccctggca

SEQ ID NO: 6245495 - DNA, 15 bp, Homo sapiens
gaggccctggccctt

SEQ ID NO: 6245496 - DNA, 18 bp, Homo sapiens
gaggccctggccctttcc

SEQ ID NO: 6245497 - DNA, 14 bp, Homo sapiens
gaggccctggtgtc

SEQ ID NO: 6245498 - DNA, 18 bp, Homo sapiens
gaggccctgttccctgga

SEQ ID NO: 6245499 - DNA, 20 bp, Homo sapiens
gaggcccttctctccagccc

SEQ ID NO: 6245500 - DNA, 12 bp, Homo sapiens
gaggcccttgtc

SEQ ID NO: 6245501 - DNA, 16 bp, Homo sapiens
gaggcccttttctggc

SEQ ID NO: 6245502 - DNA, 18 bp, Homo sapiens
gaggcccttttctggctc

SEQ ID NO: 6245503 - DNA, 18 bp, Homo sapiens
gaggccgaagctaacagg

SEQ ID NO: 6245504 - DNA, 19 bp, Homo sapiens
gaggccgaaggtgcctcag

SEQ ID NO: 6245505 - DNA, 15 bp, Homo sapiens
gaggccgaatgggca

SEQ ID NO: 6245506 - DNA, 21 bp, Homo sapiens
gaggccgactgggctgctggg

SEQ ID NO: 6245507 - DNA, 22 bp, Homo sapiens
gaggccgactgggctgctgggg

SEQ ID NO: 6245508 - DNA, 20 bp, Homo sapiens
gaggccgagcggtggccccg

SEQ ID NO: 6245509 - DNA, 20 bp, Homo sapiens
gaggccgaggaccaccagca

SEQ ID NO: 6245510 - DNA, 13 bp, Homo sapiens
gaggccgaggcag

SEQ ID NO: 6245511 - DNA, 14 bp, Homo sapiens
gaggccgaggcagg

SEQ ID NO: 6245512 - DNA, 15 bp, Homo sapiens
gaggccgaggcagga

SEQ ID NO: 6245513 - DNA, 19 bp, Homo sapiens
gaggccgaggcaggggctg

SEQ ID NO: 6245514 - DNA, 19 bp, Homo sapiens
gaggccgagtctgtcctgg

SEQ ID NO: 6245515 - DNA, 21 bp, Homo sapiens
gaggccgagtctgtcctggaa

SEQ ID NO: 6245516 - DNA, 14 bp, Homo sapiens
gaggccgcccggca

SEQ ID NO: 6245517 - DNA, 16 bp, Homo sapiens
gaggccgcggcctccc

SEQ ID NO: 6245518 - DNA, 20 bp, Homo sapiens
gaggccgctagaggcctgag

SEQ ID NO: 6245519 - DNA, 17 bp, Homo sapiens
gaggccgctatgcaggg

SEQ ID NO: 6245520 - DNA, 14 bp, Homo sapiens
gaggccgctctggg

SEQ ID NO: 6245521 - DNA, 19 bp, Homo sapiens
gaggccggagagctggtga

SEQ ID NO: 6245522 - DNA, 15 bp, Homo sapiens
gaggccggccctgcc

SEQ ID NO: 6245523 - DNA, 19 bp, Homo sapiens
gaggccggccctgcccctc

SEQ ID NO: 6245524 - DNA, 21 bp, Homo sapiens
gaggccgtggctgctgtggga

SEQ ID NO: 6245525 - DNA, 18 bp, Homo sapiens
gaggccgttgattcactt

SEQ ID NO: 6245526 - DNA, 21 bp, Homo sapiens
gaggccgttgctgacttagaa

SEQ ID NO: 6245527 - DNA, 14 bp, Homo sapiens
gaggcctacagagg

SEQ ID NO: 6245528 - DNA, 15 bp, Homo sapiens
gaggcctagactctg

SEQ ID NO: 6245529 - DNA, 17 bp, Homo sapiens
gaggcctagagtggcag

SEQ ID NO: 6245530 - DNA, 22 bp, Homo sapiens
gaggcctattgttgaataaatg

SEQ ID NO: 6245531 - DNA, 14 bp, Homo sapiens
gaggcctcaccctg

SEQ ID NO: 6245532 - DNA, 18 bp, Homo sapiens
gaggcctcaccctgcttg

SEQ ID NO: 6245533 - DNA, 21 bp, Homo sapiens
gaggcctcaccctgcttgggg

SEQ ID NO: 6245534 - DNA, 15 bp, Homo sapiens
gaggcctcaggtgct

SEQ ID NO: 6245535 - DNA, 16 bp, Homo sapiens
gaggcctcaggtgctg

SEQ ID NO: 6245536 - DNA, 12 bp, Homo sapiens
gaggcctcagtt

SEQ ID NO: 6245537 - DNA, 18 bp, Homo sapiens
gaggcctcatgcctgctg

SEQ ID NO: 6245538 - DNA, 19 bp, Homo sapiens
gaggcctcatgcctgctga

SEQ ID NO: 6245539 - DNA, 19 bp, Homo sapiens
gaggcctcccccagccagg

SEQ ID NO: 6245540 - DNA, 20 bp, Homo sapiens
gaggcctcccccagccagga

SEQ ID NO: 6245541 - DNA, 23 bp, Homo sapiens
gaggcctcccttgagtaggccct

SEQ ID NO: 6245542 - DNA, 23 bp, Homo sapiens
gaggcctcctgtggcctgccagt

SEQ ID NO: 6245543 - DNA, 18 bp, Homo sapiens
gaggcctcgagcagagag

SEQ ID NO: 6245544 - DNA, 18 bp, Homo sapiens
gaggcctcggctgtctcc

SEQ ID NO: 6245545 - DNA, 14 bp, Homo sapiens
gaggcctctgcaag

SEQ ID NO: 6245546 - DNA, 12 bp, Homo sapiens
gaggcctctggc

SEQ ID NO: 6245547 - DNA, 15 bp, Homo sapiens
gaggcctctggccct

SEQ ID NO: 6245548 - DNA, 16 bp, Homo sapiens
gaggcctctggccctc

SEQ ID NO: 6245549 - DNA, 18 bp, Homo sapiens
gaggcctctggccctcgg

SEQ ID NO: 6245550 - DNA, 22 bp, Homo sapiens
gaggcctcttggacctctgctc

SEQ ID NO: 6245551 - DNA, 22 bp, Homo sapiens
gaggcctgaagccagctgccct

SEQ ID NO: 6245552 - DNA, 23 bp, Homo sapiens
gaggcctgaagccagctgcccta

SEQ ID NO: 6245553 - DNA, 14 bp, Homo sapiens
gaggcctgacacag

SEQ ID NO: 6245554 - DNA, 19 bp, Homo sapiens
gaggcctgactgccaagcc

SEQ ID NO: 6245555 - DNA, 13 bp, Homo sapiens
gaggcctgagacc

SEQ ID NO: 6245556 - DNA, 17 bp, Homo sapiens
gaggcctgagacccagg

SEQ ID NO: 6245557 - DNA, 18 bp, Homo sapiens
gaggcctgagacccagga

SEQ ID NO: 6245558 - DNA, 20 bp, Homo sapiens
gaggcctgagcgctcctgcc

SEQ ID NO: 6245559 - DNA, 20 bp, Homo sapiens
gaggcctgaggatgagctgg

SEQ ID NO: 6245560 - DNA, 12 bp, Homo sapiens
gaggcctgaggg

SEQ ID NO: 6245561 - DNA, 13 bp, Homo sapiens
gaggcctgagggg

SEQ ID NO: 6245562 - DNA, 14 bp, Homo sapiens
gaggcctgatgctg

SEQ ID NO: 6245563 - DNA, 19 bp, Homo sapiens
gaggcctgcagggcctctg

SEQ ID NO: 6245564 - DNA, 16 bp, Homo sapiens
gaggcctgccccctgg

SEQ ID NO: 6245565 - DNA, 21 bp, Homo sapiens
gaggcctgcctccagggctgg

SEQ ID NO: 6245566 - DNA, 20 bp, Homo sapiens
gaggcctgcgaccctggggg

SEQ ID NO: 6245567 - DNA, 21 bp, Homo sapiens
gaggcctggaccgagatgtga

SEQ ID NO: 6245568 - DNA, 18 bp, Homo sapiens
gaggcctggactttcctg

SEQ ID NO: 6245569 - DNA, 20 bp, Homo sapiens
gaggcctggagcccacaacc

SEQ ID NO: 6245570 - DNA, 12 bp, Homo sapiens
gaggcctggcct

SEQ ID NO: 6245571 - DNA, 13 bp, Homo sapiens
gaggcctggcctt

SEQ ID NO: 6245572 - DNA, 16 bp, Homo sapiens
gaggcctggccttgtc

SEQ ID NO: 6245573 - DNA, 21 bp, Homo sapiens
gaggcctggccttgtcaggac

SEQ ID NO: 6245574 - DNA, 16 bp, Homo sapiens
gaggcctggctctgga

SEQ ID NO: 6245575 - DNA, 13 bp, Homo sapiens
gaggcctgggaga

SEQ ID NO: 6245576 - DNA, 22 bp, Homo sapiens
gaggcctgggagatgcagctgg

SEQ ID NO: 6245577 - DNA, 21 bp, Homo sapiens
gaggcctgggccgctgccacg

SEQ ID NO: 6245578 - DNA, 13 bp, Homo sapiens
gaggcctgggctg

SEQ ID NO: 6245579 - DNA, 18 bp, Homo sapiens
gaggcctgggggacccct

SEQ ID NO: 6245580 - DNA, 21 bp, Homo sapiens
gaggcctggggtgggacaggg

SEQ ID NO: 6245581 - DNA, 22 bp, Homo sapiens
gaggcctgggtgtgacctgaca

SEQ ID NO: 6245582 - DNA, 13 bp, Homo sapiens
gaggcctggtctg

SEQ ID NO: 6245583 - DNA, 21 bp, Homo sapiens
gaggcctggtgccctggccca

SEQ ID NO: 6245584 - DNA, 14 bp, Homo sapiens
gaggcctgtcccaa

SEQ ID NO: 6245585 - DNA, 12 bp, Homo sapiens
gaggcctgtctg

SEQ ID NO: 6245586 - DNA, 19 bp, Homo sapiens
gaggcctgtctgtgacctg

SEQ ID NO: 6245587 - DNA, 19 bp, Homo sapiens
gaggcctgtttggcctctc

SEQ ID NO: 6245588 - DNA, 18 bp, Homo sapiens
gaggccttatcattcatt

SEQ ID NO: 6245589 - DNA, 11 bp, Homo sapiens
gaggccttcca

SEQ ID NO: 6245590 - DNA, 14 bp, Homo sapiens
gaggccttccagct

SEQ ID NO: 6245591 - DNA, 17 bp, Homo sapiens
gaggccttccagctgct

SEQ ID NO: 6245592 - DNA, 13 bp, Homo sapiens
gaggccttccctt

SEQ ID NO: 6245593 - DNA, 12 bp, Homo sapiens
gaggccttctcg

SEQ ID NO: 6245594 - DNA, 14 bp, Homo sapiens
gaggccttctctga

SEQ ID NO: 6245595 - DNA, 18 bp, Homo sapiens
gaggccttctctgaagga

SEQ ID NO: 6245596 - DNA, 12 bp, Homo sapiens
gaggccttgctc

SEQ ID NO: 6245597 - DNA, 22 bp, Homo sapiens
gaggccttggggtgggggccag

SEQ ID NO: 6245598 - DNA, 18 bp, Homo sapiens
gaggccttgggtgttcca

SEQ ID NO: 6245599 - DNA, 18 bp, Homo sapiens
gaggccttgtgtgtcagg

SEQ ID NO: 6245600 - DNA, 19 bp, Homo sapiens
gaggccttgtgtgtcaggc

SEQ ID NO: 6245601 - DNA, 14 bp, Homo sapiens
gaggcctttaacca

SEQ ID NO: 6245602 - DNA, 20 bp, Homo sapiens
gaggcgaagcgttgtcctca

SEQ ID NO: 6245603 - DNA, 18 bp, Homo sapiens
gaggcgaagctgagcggg

SEQ ID NO: 6245604 - DNA, 13 bp, Homo sapiens
gaggcgaataaat

SEQ ID NO: 6245605 - DNA, 17 bp, Homo sapiens
gaggcgacttcctctcc

SEQ ID NO: 6245606 - DNA, 14 bp, Homo sapiens
gaggcgagcagggc

SEQ ID NO: 6245607 - DNA, 16 bp, Homo sapiens
gaggcgagcagggcag

SEQ ID NO: 6245608 - DNA, 23 bp, Homo sapiens
gaggcgagccagattaggcctgg

SEQ ID NO: 6245609 - DNA, 12 bp, Homo sapiens
gaggcgaggctg

SEQ ID NO: 6245610 - DNA, 13 bp, Homo sapiens
gaggcgaggctgc

SEQ ID NO: 6245611 - DNA, 16 bp, Homo sapiens
gaggcgatgccagcct

SEQ ID NO: 6245612 - DNA, 15 bp, Homo sapiens
gaggcgcagcccgaa

SEQ ID NO: 6245613 - DNA, 22 bp, Homo sapiens
gaggcgcagcccgaagcccagt

SEQ ID NO: 6245614 - DNA, 14 bp, Homo sapiens
gaggcgcagggaca

SEQ ID NO: 6245615 - DNA, 20 bp, Homo sapiens
gaggcgcagggacatggggc

SEQ ID NO: 6245616 - DNA, 14 bp, Homo sapiens
gaggcgcccacctg

SEQ ID NO: 6245617 - DNA, 22 bp, Homo sapiens
gaggcgcccttggcttctgtga

SEQ ID NO: 6245618 - DNA, 15 bp, Homo sapiens
gaggcgccttcctgg

SEQ ID NO: 6245619 - DNA, 12 bp, Homo sapiens
gaggcgcggcct

SEQ ID NO: 6245620 - DNA, 15 bp, Homo sapiens
gaggcggaaaccttg

SEQ ID NO: 6245621 - DNA, 16 bp, Homo sapiens
gaggcggaaaccttgc

SEQ ID NO: 6245622 - DNA, 20 bp, Homo sapiens
gaggcggaccttgtagtgag

SEQ ID NO: 6245623 - DNA, 21 bp, Homo sapiens
gaggcggagagtgctgactgt

SEQ ID NO: 6245624 - DNA, 16 bp, Homo sapiens
gaggcggagctccagg

SEQ ID NO: 6245625 - DNA, 18 bp, Homo sapiens
gaggcggcctccatgcac

SEQ ID NO: 6245626 - DNA, 17 bp, Homo sapiens
gaggcgggaaccctctg

SEQ ID NO: 6245627 - DNA, 22 bp, Homo sapiens
gaggcgggaaccctctggggcc

SEQ ID NO: 6245628 - DNA, 13 bp, Homo sapiens
gaggcgggccagc

SEQ ID NO: 6245629 - DNA, 20 bp, Homo sapiens
gaggcgggccagccaggcgg

SEQ ID NO: 6245630 - DNA, 17 bp, Homo sapiens
gaggcgggggagcctgg

SEQ ID NO: 6245631 - DNA, 20 bp, Homo sapiens
gaggcgggggagcctggagc

SEQ ID NO: 6245632 - DNA, 17 bp, Homo sapiens
gaggcgggtctataaca

SEQ ID NO: 6245633 - DNA, 19 bp, Homo sapiens
gaggcgggtggatcacctg

SEQ ID NO: 6245634 - DNA, 19 bp, Homo sapiens
gaggcggtttccaggaaga

SEQ ID NO: 6245635 - DNA, 20 bp, Homo sapiens
gaggcggtttccaggaagag

SEQ ID NO: 6245636 - DNA, 16 bp, Homo sapiens
gaggcgtactacccag

SEQ ID NO: 6245637 - DNA, 15 bp, Homo sapiens
gaggcgtcctggtga

SEQ ID NO: 6245638 - DNA, 16 bp, Homo sapiens
gaggcgtcctggtgag

SEQ ID NO: 6245639 - DNA, 20 bp, Homo sapiens
gaggcgtcttcatctccctg

SEQ ID NO: 6245640 - DNA, 14 bp, Homo sapiens
gaggcgtcttgtat

SEQ ID NO: 6245641 - DNA, 16 bp, Homo sapiens
gaggcgtgcccccctc

SEQ ID NO: 6245642 - DNA, 21 bp, Homo sapiens
gaggcgtgcccccctcctcca

SEQ ID NO: 6245643 - DNA, 22 bp, Homo sapiens
gaggcgtgcccccctcctccag

SEQ ID NO: 6245644 - DNA, 16 bp, Homo sapiens
gcccaggcctccagct

SEQ ID NO: 6245645 - DNA, 21 bp, Homo sapiens
gcccaggcctccagctcagca

SEQ ID NO: 6245646 - DNA, 15 bp, Homo sapiens
gcccaggcctcccca

SEQ ID NO: 6245647 - DNA, 18 bp, Homo sapiens
gcccaggcctcctacagc

SEQ ID NO: 6245648 - DNA, 14 bp, Homo sapiens
gcccaggcctgctg

SEQ ID NO: 6245649 - DNA, 13 bp, Homo sapiens
gcccaggcctgga

SEQ ID NO: 6245650 - DNA, 16 bp, Homo sapiens
gcccaggcctggagcg

SEQ ID NO: 6245651 - DNA, 20 bp, Homo sapiens
gcccaggcctgggatgcagt

SEQ ID NO: 6245652 - DNA, 14 bp, Homo sapiens
gcccaggcctgggt

SEQ ID NO: 6245653 - DNA, 15 bp, Homo sapiens
gcccaggcctggtgg

SEQ ID NO: 6245654 - DNA, 23 bp, Homo sapiens
gcccaggcctggtggagggggag

SEQ ID NO: 6245655 - DNA, 12 bp, Homo sapiens
gcccaggctcca

SEQ ID NO: 6245656 - DNA, 15 bp, Homo sapiens
gcccaggctctgctg

SEQ ID NO: 6245657 - DNA, 17 bp, Homo sapiens
gcccaggctctgggaag

SEQ ID NO: 6245658 - DNA, 20 bp, Homo sapiens
gcccaggctggagggcagtg

SEQ ID NO: 6245659 - DNA, 13 bp, Homo sapiens
gcccaggctggcc

SEQ ID NO: 6245660 - DNA, 14 bp, Homo sapiens
gcccaggctggcca

SEQ ID NO: 6245661 - DNA, 19 bp, Homo sapiens
gcccaggctggccagcccc

SEQ ID NO: 6245662 - DNA, 17 bp, Homo sapiens
gcccaggctggccccca

SEQ ID NO: 6245663 - DNA, 15 bp, Homo sapiens
gcccaggctggcctg

SEQ ID NO: 6245664 - DNA, 16 bp, Homo sapiens
gcccaggctggcctga

SEQ ID NO: 6245665 - DNA, 16 bp, Homo sapiens
gcccaggctggcgtgc

SEQ ID NO: 6245666 - DNA, 19 bp, Homo sapiens
gcccaggctggcgtgcagt

SEQ ID NO: 6245667 - DNA, 22 bp, Homo sapiens
gcccaggctggcgtgcagtggt

SEQ ID NO: 6245668 - DNA, 13 bp, Homo sapiens
gcccaggctggga

SEQ ID NO: 6245669 - DNA, 14 bp, Homo sapiens
gcccagggaagccc

SEQ ID NO: 6245670 - DNA, 16 bp, Homo sapiens
gcccagggaagcctgg

SEQ ID NO: 6245671 - DNA, 17 bp, Homo sapiens
gcccagggaatcaggga

SEQ ID NO: 6245672 - DNA, 18 bp, Homo sapiens
gcccagggaatcagggag

SEQ ID NO: 6245673 - DNA, 19 bp, Homo sapiens
gcccagggaatcagggagc

SEQ ID NO: 6245674 - DNA, 22 bp, Homo sapiens
gcccagggacaccagccaggct

SEQ ID NO: 6245675 - DNA, 16 bp, Homo sapiens
gcccagggagactccg

SEQ ID NO: 6245676 - DNA, 16 bp, Homo sapiens
gcccagggagcggaaa

SEQ ID NO: 6245677 - DNA, 20 bp, Homo sapiens
gcccagggagcggaaagcag

SEQ ID NO: 6245678 - DNA, 21 bp, Homo sapiens
gcccagggagcggaaagcagc

SEQ ID NO: 6245679 - DNA, 23 bp, Homo sapiens
gcccagggagcggaaagcagctc

SEQ ID NO: 6245680 - DNA, 11 bp, Homo sapiens
gcccagggagg

SEQ ID NO: 6245681 - DNA, 14 bp, Homo sapiens
gcccagggaggcag

SEQ ID NO: 6245682 - DNA, 16 bp, Homo sapiens
gcccagggaggcagcg

SEQ ID NO: 6245683 - DNA, 21 bp, Homo sapiens
gcccagggaggccgaagctaa

SEQ ID NO: 6245684 - DNA, 22 bp, Homo sapiens
gcccagggagggaagtgtgagc

SEQ ID NO: 6245685 - DNA, 15 bp, Homo sapiens
gcccagggagggtga

SEQ ID NO: 6245686 - DNA, 12 bp, Homo sapiens
gcccagggaggt

SEQ ID NO: 6245687 - DNA, 17 bp, Homo sapiens
gcccagggatttgtcct

SEQ ID NO: 6245688 - DNA, 16 bp, Homo sapiens
gcccagggcaagctcc

SEQ ID NO: 6245689 - DNA, 18 bp, Homo sapiens
gcccagggcaccatccag

SEQ ID NO: 6245690 - DNA, 18 bp, Homo sapiens
gcccagggcatctgggag

SEQ ID NO: 6245691 - DNA, 20 bp, Homo sapiens
gcccagggcatcttgctggc

SEQ ID NO: 6245692 - DNA, 13 bp, Homo sapiens
gcccagggccact

SEQ ID NO: 6245693 - DNA, 22 bp, Homo sapiens
gcccagggccactctgcctctg

SEQ ID NO: 6245694 - DNA, 15 bp, Homo sapiens
gcccagggccagtgg

SEQ ID NO: 6245695 - DNA, 18 bp, Homo sapiens
gcccagggccagtgggac

SEQ ID NO: 6245696 - DNA, 14 bp, Homo sapiens
gcccagggcccaga

SEQ ID NO: 6245697 - DNA, 15 bp, Homo sapiens
gcccagggcccagag

SEQ ID NO: 6245698 - DNA, 17 bp, Homo sapiens
gcccagggcccagagcc

SEQ ID NO: 6245699 - DNA, 19 bp, Homo sapiens
gcccagggcccagagccca

SEQ ID NO: 6245700 - DNA, 23 bp, Homo sapiens
gcccagggcccagagcccagctc

SEQ ID NO: 6245701 - DNA, 13 bp, Homo sapiens
gcccagggcctct

SEQ ID NO: 6245702 - DNA, 15 bp, Homo sapiens
gcccagggcctctgg

SEQ ID NO: 6245703 - DNA, 19 bp, Homo sapiens
gcccagggcctctggcttc

SEQ ID NO: 6245704 - DNA, 14 bp, Homo sapiens
gcccagggcctgca

SEQ ID NO: 6245705 - DNA, 12 bp, Homo sapiens
gcccagggctca

SEQ ID NO: 6245706 - DNA, 18 bp, Homo sapiens
gcccagggctcagcctgg

SEQ ID NO: 6245707 - DNA, 20 bp, Homo sapiens
gcccagggctgggaggaagg

SEQ ID NO: 6245708 - DNA, 17 bp, Homo sapiens
gcccaggggacgtggcg

SEQ ID NO: 6245709 - DNA, 24 bp, Homo sapiens
gcccaggggagaatgcagcccacc

SEQ ID NO: 6245710 - DNA, 16 bp, Homo sapiens
gcccaggggcttcaga

SEQ ID NO: 6245711 - DNA, 14 bp, Homo sapiens
gcccagggggcctg

SEQ ID NO: 6245712 - DNA, 20 bp, Homo sapiens
gcccagggggcttcctgagg

SEQ ID NO: 6245713 - DNA, 14 bp, Homo sapiens
gcccaggggtcagc

SEQ ID NO: 6245714 - DNA, 20 bp, Homo sapiens
gcccaggggtgccccctcct

SEQ ID NO: 6245715 - DNA, 20 bp, Homo sapiens
gcccaggggtggggcccatg

SEQ ID NO: 6245716 - DNA, 21 bp, Homo sapiens
gcccaggggtggggcccatgg

SEQ ID NO: 6245717 - DNA, 22 bp, Homo sapiens
gcccaggggtggggcccatggg

SEQ ID NO: 6245718 - DNA, 18 bp, Homo sapiens
gcccagggtcgtctttgt

SEQ ID NO: 6245719 - DNA, 15 bp, Homo sapiens
gcccagggtgcagtg

SEQ ID NO: 6245720 - DNA, 14 bp, Homo sapiens
gcccagggtggact

SEQ ID NO: 6245721 - DNA, 20 bp, Homo sapiens
gcccagggtggccacacctc

SEQ ID NO: 6245722 - DNA, 17 bp, Homo sapiens
gcccagggtggctgcca

SEQ ID NO: 6245723 - DNA, 23 bp, Homo sapiens
gcccagggtgtttgcagctgtga

SEQ ID NO: 6245724 - DNA, 17 bp, Homo sapiens
gcccaggtaccaccctt

SEQ ID NO: 6245725 - DNA, 21 bp, Homo sapiens
gcccaggtaccacccttcaga

SEQ ID NO: 6245726 - DNA, 15 bp, Homo sapiens
gcccaggtccctccg

SEQ ID NO: 6245727 - DNA, 16 bp, Homo sapiens
gcccaggtcctctgat

SEQ ID NO: 6245728 - DNA, 17 bp, Homo sapiens
gcccaggtctcctgggc

SEQ ID NO: 6245729 - DNA, 22 bp, Homo sapiens
gcccaggtctcctgggcatctg

SEQ ID NO: 6245730 - DNA, 23 bp, Homo sapiens
gcccaggtctcctgggcatctgg

SEQ ID NO: 6245731 - DNA, 19 bp, Homo sapiens
gcccaggtgagggaaggag

SEQ ID NO: 6245732 - DNA, 22 bp, Homo sapiens
gcccaggtgagggaaggagaca

SEQ ID NO: 6245733 - DNA, 22 bp, Homo sapiens
gcccaggtgccccgactgtggg

SEQ ID NO: 6245734 - DNA, 22 bp, Homo sapiens
gcccaggtggggtttcctgcat

SEQ ID NO: 6245735 - DNA, 16 bp, Homo sapiens
gcccagtaactgccct

SEQ ID NO: 6245736 - DNA, 19 bp, Homo sapiens
gcccagtacatttaaattt

SEQ ID NO: 6245737 - DNA, 21 bp, Homo sapiens
gcccagtagccattttgtaac

SEQ ID NO: 6245738 - DNA, 14 bp, Homo sapiens
gcccagtagcccca

SEQ ID NO: 6245739 - DNA, 16 bp, Homo sapiens
gcccagtagccccaat

SEQ ID NO: 6245740 - DNA, 23 bp, Homo sapiens
gcccagtcatgacatttctcaaa

SEQ ID NO: 6245741 - DNA, 22 bp, Homo sapiens
gcccagtcattgggttttatca

SEQ ID NO: 6245742 - DNA, 13 bp, Homo sapiens
gcccagtccccca

SEQ ID NO: 6245743 - DNA, 24 bp, Homo sapiens
gcccagtccctggagctgtccttc

SEQ ID NO: 6245744 - DNA, 16 bp, Homo sapiens
gcccagtcctggcctg

SEQ ID NO: 6245745 - DNA, 13 bp, Homo sapiens
gcccagtcctggg

SEQ ID NO: 6245746 - DNA, 19 bp, Homo sapiens
gcccagtctggaatgcagt

SEQ ID NO: 6245747 - DNA, 18 bp, Homo sapiens
gcccagtcttgagtgggc

SEQ ID NO: 6245748 - DNA, 21 bp, Homo sapiens
gcccagtgacaaagactcctc

SEQ ID NO: 6245749 - DNA, 24 bp, Homo sapiens
gcccagtgacaaagactcctctgg

SEQ ID NO: 6245750 - DNA, 14 bp, Homo sapiens
gcccagtgagccct

SEQ ID NO: 6245751 - DNA, 15 bp, Homo sapiens
gcccagtgagccctg

SEQ ID NO: 6245752 - DNA, 16 bp, Homo sapiens
gcccagtgagccctgc

SEQ ID NO: 6245753 - DNA, 15 bp, Homo sapiens
gcccagtgatggcat

SEQ ID NO: 6245754 - DNA, 23 bp, Homo sapiens
gcccagtgcaatctgtccagaca

SEQ ID NO: 6245755 - DNA, 17 bp, Homo sapiens
gcccagtgcaggtattt

SEQ ID NO: 6245756 - DNA, 20 bp, Homo sapiens
gcccagtgcatggtggccag

SEQ ID NO: 6245757 - DNA, 21 bp, Homo sapiens
gcccagtgcatggtggccaga

SEQ ID NO: 6245758 - DNA, 15 bp, Homo sapiens
gcccagtgccactgc

SEQ ID NO: 6245759 - DNA, 15 bp, Homo sapiens
gcccagtgccagcaa

SEQ ID NO: 6245760 - DNA, 21 bp, Homo sapiens
gcccagtgccagcaagtcctt

SEQ ID NO: 6245761 - DNA, 14 bp, Homo sapiens
gcccagtgccagct

SEQ ID NO: 6245762 - DNA, 18 bp, Homo sapiens
gcccagtgccctggggct

SEQ ID NO: 6245763 - DNA, 16 bp, Homo sapiens
gcccagtgctggccac

SEQ ID NO: 6245764 - DNA, 20 bp, Homo sapiens
gcccagtgctggccacacag

SEQ ID NO: 6245765 - DNA, 16 bp, Homo sapiens
gcccagtggagcctgc

SEQ ID NO: 6245766 - DNA, 18 bp, Homo sapiens
gcccagtgggacccacag

SEQ ID NO: 6245767 - DNA, 20 bp, Homo sapiens
gcccagtgggacccacagtc

SEQ ID NO: 6245768 - DNA, 13 bp, Homo sapiens
gcccagtgggctg

SEQ ID NO: 6245769 - DNA, 15 bp, Homo sapiens
gcccagtgggctgca

SEQ ID NO: 6245770 - DNA, 16 bp, Homo sapiens
gcccagtgggctgcac

SEQ ID NO: 6245771 - DNA, 18 bp, Homo sapiens
gcccagtggtgaggaaag

SEQ ID NO: 6245772 - DNA, 17 bp, Homo sapiens
gcccagtgttgtttgta

SEQ ID NO: 6245773 - DNA, 19 bp, Homo sapiens
gcccagtgttgtttgtaaa

SEQ ID NO: 6245774 - DNA, 21 bp, Homo sapiens
gcccagtgttttctttgagga

SEQ ID NO: 6245775 - DNA, 13 bp, Homo sapiens
gcccagttaaata

SEQ ID NO: 6245776 - DNA, 17 bp, Homo sapiens
gcccagttagcccggcc

SEQ ID NO: 6245777 - DNA, 18 bp, Homo sapiens
gcccagttggaggagact

SEQ ID NO: 6245778 - DNA, 21 bp, Homo sapiens
gcccagttgggtggatgcctg

SEQ ID NO: 6245779 - DNA, 22 bp, Homo sapiens
gcccagttgggtggatgcctgg

SEQ ID NO: 6245780 - DNA, 15 bp, Homo sapiens
gcccagtttctgcct

SEQ ID NO: 6245781 - DNA, 20 bp, Homo sapiens
gcccataaagtctgagaaat

SEQ ID NO: 6245782 - DNA, 19 bp, Homo sapiens
gcccataatagttagccct

SEQ ID NO: 6245783 - DNA, 20 bp, Homo sapiens
gcccataatagttagccctc

SEQ ID NO: 6245784 - DNA, 23 bp, Homo sapiens
gcccataatagttagccctcagt

SEQ ID NO: 6245785 - DNA, 15 bp, Homo sapiens
gcccatacccctgcc

SEQ ID NO: 6245786 - DNA, 17 bp, Homo sapiens
gcccatacccctgcctg

SEQ ID NO: 6245787 - DNA, 23 bp, Homo sapiens
gcccatacccgtgacagtggctg

SEQ ID NO: 6245788 - DNA, 15 bp, Homo sapiens
gcccatactcagcct

SEQ ID NO: 6245789 - DNA, 21 bp, Homo sapiens
gcccatactcagcctgctgcc

SEQ ID NO: 6245790 - DNA, 17 bp, Homo sapiens
gcccatactgagcctgc

SEQ ID NO: 6245791 - DNA, 23 bp, Homo sapiens
gcccatacttttggctcctctag

SEQ ID NO: 6245792 - DNA, 15 bp, Homo sapiens
gcccatataaaatgc

SEQ ID NO: 6245793 - DNA, 23 bp, Homo sapiens
gcccatataaaatgctgatattt

SEQ ID NO: 6245794 - DNA, 21 bp, Homo sapiens
gcccatatccctggttgcctc

SEQ ID NO: 6245795 - DNA, 15 bp, Homo sapiens
gcccatattttactt

SEQ ID NO: 6245796 - DNA, 12 bp, Homo sapiens
gcccatcagggt

SEQ ID NO: 6245797 - DNA, 21 bp, Homo sapiens
gcccatcagggtaggctggag

SEQ ID NO: 6245798 - DNA, 16 bp, Homo sapiens
gcccatcagtgccagc

SEQ ID NO: 6245799 - DNA, 20 bp, Homo sapiens
gcccatcagtgtacccccgc

SEQ ID NO: 6245800 - DNA, 21 bp, Homo sapiens
gcccatcagtgtacccccgcc

SEQ ID NO: 6245801 - DNA, 23 bp, Homo sapiens
gcccatcatacgcatggtcctgg

SEQ ID NO: 6245802 - DNA, 17 bp, Homo sapiens
gcccatccaaacactga

SEQ ID NO: 6245803 - DNA, 22 bp, Homo sapiens
gcccatccattaggccagcaac

SEQ ID NO: 6245804 - DNA, 12 bp, Homo sapiens
gcccatcccacc

SEQ ID NO: 6245805 - DNA, 16 bp, Homo sapiens
gcccatcccagtccct

SEQ ID NO: 6245806 - DNA, 15 bp, Homo sapiens
gcccatcccccctca

SEQ ID NO: 6245807 - DNA, 17 bp, Homo sapiens
gcccatcccccctcacc

SEQ ID NO: 6245808 - DNA, 20 bp, Homo sapiens
gcccatcccccctcaccagg

SEQ ID NO: 6245809 - DNA, 13 bp, Homo sapiens
gcccatcccctgc

SEQ ID NO: 6245810 - DNA, 14 bp, Homo sapiens
gcccatccccttga

SEQ ID NO: 6245811 - DNA, 17 bp, Homo sapiens
gcccatcccgccttctc

SEQ ID NO: 6245812 - DNA, 18 bp, Homo sapiens
gcccatcccgccttctcc

SEQ ID NO: 6245813 - DNA, 12 bp, Homo sapiens
gcccatccctgc

SEQ ID NO: 6245814 - DNA, 16 bp, Homo sapiens
gcccatccctgcctgg

SEQ ID NO: 6245815 - DNA, 18 bp, Homo sapiens
gcccatccctgcctggtc

SEQ ID NO: 6245816 - DNA, 13 bp, Homo sapiens
gcccatcctccca

SEQ ID NO: 6245817 - DNA, 14 bp, Homo sapiens
gcccatcctgacca

SEQ ID NO: 6245818 - DNA, 16 bp, Homo sapiens
gcccatcctgaccagc

SEQ ID NO: 6245819 - DNA, 18 bp, Homo sapiens
gcccatcctgaccagctg

SEQ ID NO: 6245820 - DNA, 13 bp, Homo sapiens
gcccatccttccc

SEQ ID NO: 6245821 - DNA, 20 bp, Homo sapiens
gcccatcgtgaagaagcctg

SEQ ID NO: 6245822 - DNA, 14 bp, Homo sapiens
gaggcgtggaggag

SEQ ID NO: 6245823 - DNA, 15 bp, Homo sapiens
gaggcgtggaggaga

SEQ ID NO: 6245824 - DNA, 13 bp, Homo sapiens
gaggcgtgtgcag

SEQ ID NO: 6245825 - DNA, 14 bp, Homo sapiens
gaggcgtgtgcagg

SEQ ID NO: 6245826 - DNA, 21 bp, Homo sapiens
gaggcgttagtgggcaggtgg

SEQ ID NO: 6245827 - DNA, 18 bp, Homo sapiens
gaggcgttctcctgcttg

SEQ ID NO: 6245828 - DNA, 19 bp, Homo sapiens
gaggctaaaacaaatctca

SEQ ID NO: 6245829 - DNA, 18 bp, Homo sapiens
gaggctaaaatgttttca

SEQ ID NO: 6245830 - DNA, 16 bp, Homo sapiens
gaggctaagcctggac

SEQ ID NO: 6245831 - DNA, 15 bp, Homo sapiens
gaggctaagttggga

SEQ ID NO: 6245832 - DNA, 21 bp, Homo sapiens
gaggctacagctccacacgcc

SEQ ID NO: 6245833 - DNA, 23 bp, Homo sapiens
gaggctacaggggttagcctgga

SEQ ID NO: 6245834 - DNA, 17 bp, Homo sapiens
gaggctacccgctgtgg

SEQ ID NO: 6245835 - DNA, 23 bp, Homo sapiens
gaggctacccgctgtggccggtg

SEQ ID NO: 6245836 - DNA, 14 bp, Homo sapiens
gaggctagaggcat

SEQ ID NO: 6245837 - DNA, 15 bp, Homo sapiens
gaggctagccccagg

SEQ ID NO: 6245838 - DNA, 19 bp, Homo sapiens
gaggctagccccagggtga

SEQ ID NO: 6245839 - DNA, 14 bp, Homo sapiens
gaggctatcctgga

SEQ ID NO: 6245840 - DNA, 16 bp, Homo sapiens
gaggctatttaaaagt

SEQ ID NO: 6245841 - DNA, 17 bp, Homo sapiens
gaggctcaagaggccca

SEQ ID NO: 6245842 - DNA, 23 bp, Homo sapiens
gaggctcactgagtgatacttta

SEQ ID NO: 6245843 - DNA, 18 bp, Homo sapiens
gaggctcagcccaccctc

SEQ ID NO: 6245844 - DNA, 14 bp, Homo sapiens
gaggctcagcccta

SEQ ID NO: 6245845 - DNA, 16 bp, Homo sapiens
gaggctcatcctgtag

SEQ ID NO: 6245846 - DNA, 13 bp, Homo sapiens
gaggctccaggac

SEQ ID NO: 6245847 - DNA, 20 bp, Homo sapiens
gaggctccaggactccactg

SEQ ID NO: 6245848 - DNA, 22 bp, Homo sapiens
gaggctccaggactccactgga

SEQ ID NO: 6245849 - DNA, 22 bp, Homo sapiens
gaggctccatccttctccccaa

SEQ ID NO: 6245850 - DNA, 23 bp, Homo sapiens
gaggctccatccttctccccaag

SEQ ID NO: 6245851 - DNA, 22 bp, Homo sapiens
gaggctcccagacccagggcag

SEQ ID NO: 6245852 - DNA, 14 bp, Homo sapiens
gaggctccccaggg

SEQ ID NO: 6245853 - DNA, 17 bp, Homo sapiens
gaggctccccagggctc

SEQ ID NO: 6245854 - DNA, 22 bp, Homo sapiens
gaggctccccgcctccactcta

SEQ ID NO: 6245855 - DNA, 21 bp, Homo sapiens
gaggctcccggggcctggaca

SEQ ID NO: 6245856 - DNA, 15 bp, Homo sapiens
gaggctccctcctgt

SEQ ID NO: 6245857 - DNA, 19 bp, Homo sapiens
gaggctccggcccacaggt

SEQ ID NO: 6245858 - DNA, 16 bp, Homo sapiens
gaggctccgtgagccc

SEQ ID NO: 6245859 - DNA, 18 bp, Homo sapiens
gaggctccgtgagccctt

SEQ ID NO: 6245860 - DNA, 13 bp, Homo sapiens
gaggctcctccct

SEQ ID NO: 6245861 - DNA, 14 bp, Homo sapiens
gaggctcctccctc

SEQ ID NO: 6245862 - DNA, 15 bp, Homo sapiens
gaggctcctccctct

SEQ ID NO: 6245863 - DNA, 16 bp, Homo sapiens
gaggctcctctaggcc

SEQ ID NO: 6245864 - DNA, 14 bp, Homo sapiens
gaggctcctggagc

SEQ ID NO: 6245865 - DNA, 15 bp, Homo sapiens
gaggctcctggagcc

SEQ ID NO: 6245866 - DNA, 16 bp, Homo sapiens
gaggctcctggagcca

SEQ ID NO: 6245867 - DNA, 18 bp, Homo sapiens
gaggctcctggagccagc

SEQ ID NO: 6245868 - DNA, 22 bp, Homo sapiens
gaggctcctggagccagccacc

SEQ ID NO: 6245869 - DNA, 12 bp, Homo sapiens
gaggctcctggt

SEQ ID NO: 6245870 - DNA, 14 bp, Homo sapiens
gaggctcctggtgg

SEQ ID NO: 6245871 - DNA, 13 bp, Homo sapiens
gaggctcctgtcc

SEQ ID NO: 6245872 - DNA, 14 bp, Homo sapiens
gaggctcctgtggt

SEQ ID NO: 6245873 - DNA, 21 bp, Homo sapiens
gaggctcctgttagctcctca

SEQ ID NO: 6245874 - DNA, 22 bp, Homo sapiens
gaggctcgagctcggggctggg

SEQ ID NO: 6245875 - DNA, 18 bp, Homo sapiens
gaggctcggagcaccctt

SEQ ID NO: 6245876 - DNA, 18 bp, Homo sapiens
gaggctcggggctcccca

SEQ ID NO: 6245877 - DNA, 21 bp, Homo sapiens
gaggctcggggctccccacgc

SEQ ID NO: 6245878 - DNA, 15 bp, Homo sapiens
gaggctctcatgtct

SEQ ID NO: 6245879 - DNA, 16 bp, Homo sapiens
gaggctctctaagaaa

SEQ ID NO: 6245880 - DNA, 18 bp, Homo sapiens
gaggctctctaagaaaag

SEQ ID NO: 6245881 - DNA, 12 bp, Homo sapiens
gaggctctctct

SEQ ID NO: 6245882 - DNA, 14 bp, Homo sapiens
gaggctctgaagag

SEQ ID NO: 6245883 - DNA, 14 bp, Homo sapiens
gaggctctgccctt

SEQ ID NO: 6245884 - DNA, 14 bp, Homo sapiens
gaggctctggagcc

SEQ ID NO: 6245885 - DNA, 17 bp, Homo sapiens
gaggctctgttctgcct

SEQ ID NO: 6245886 - DNA, 16 bp, Homo sapiens
gaggctgaataaagcc

SEQ ID NO: 6245887 - DNA, 13 bp, Homo sapiens
gaggctgagaaat

SEQ ID NO: 6245888 - DNA, 13 bp, Homo sapiens
gaggctgagacag

SEQ ID NO: 6245889 - DNA, 14 bp, Homo sapiens
gaggctgagacagg

SEQ ID NO: 6245890 - DNA, 20 bp, Homo sapiens
gaggctgagactgcagagga

SEQ ID NO: 6245891 - DNA, 21 bp, Homo sapiens
gaggctgagactgcagaggag

SEQ ID NO: 6245892 - DNA, 15 bp, Homo sapiens
gaggctgagccctgt

SEQ ID NO: 6245893 - DNA, 13 bp, Homo sapiens
gaggctgaggcac

SEQ ID NO: 6245894 - DNA, 15 bp, Homo sapiens
gaggctgaggcacaa

SEQ ID NO: 6245895 - DNA, 14 bp, Homo sapiens
gaggctgaggcagg

SEQ ID NO: 6245896 - DNA, 15 bp, Homo sapiens
gaggctgaggcagga

SEQ ID NO: 6245897 - DNA, 19 bp, Homo sapiens
gaggctgaggcaggagaat

SEQ ID NO: 6245898 - DNA, 14 bp, Homo sapiens
gaggctgaggcctg

SEQ ID NO: 6245899 - DNA, 16 bp, Homo sapiens
gaggctgaggcctgga

SEQ ID NO: 6245900 - DNA, 18 bp, Homo sapiens
gaggctgaggtgggcaga

SEQ ID NO: 6245901 - DNA, 15 bp, Homo sapiens
gaggctgagttctgg

SEQ ID NO: 6245902 - DNA, 19 bp, Homo sapiens
gaggctgagttctggttca

SEQ ID NO: 6245903 - DNA, 18 bp, Homo sapiens
gaggctgcaatgagccat

SEQ ID NO: 6245904 - DNA, 19 bp, Homo sapiens
gaggctgcaatgagccatg

SEQ ID NO: 6245905 - DNA, 14 bp, Homo sapiens
gaggctgcactgca

SEQ ID NO: 6245906 - DNA, 17 bp, Homo sapiens
gaggctgcactggagcc

SEQ ID NO: 6245907 - DNA, 20 bp, Homo sapiens
gaggctgcagaaggccaaga

SEQ ID NO: 6245908 - DNA, 16 bp, Homo sapiens
gaggctgcagcaggtg

SEQ ID NO: 6245909 - DNA, 20 bp, Homo sapiens
gaggctgcagcaggtgctgg

SEQ ID NO: 6245910 - DNA, 13 bp, Homo sapiens
gaggctgcagcca

SEQ ID NO: 6245911 - DNA, 15 bp, Homo sapiens
gaggctgcagccagg

SEQ ID NO: 6245912 - DNA, 19 bp, Homo sapiens
gaggctgcagccaggccac

SEQ ID NO: 6245913 - DNA, 19 bp, Homo sapiens
gaggctgcagccaggcctc

SEQ ID NO: 6245914 - DNA, 14 bp, Homo sapiens
gaggctgcagtcag

SEQ ID NO: 6245915 - DNA, 16 bp, Homo sapiens
gaggctgccccaggcc

SEQ ID NO: 6245916 - DNA, 22 bp, Homo sapiens
gaggctgccccaggccggagcc

SEQ ID NO: 6245917 - DNA, 19 bp, Homo sapiens
gaggctgccccaggggcac

SEQ ID NO: 6245918 - DNA, 21 bp, Homo sapiens
gaggctgcccccatccagcca

SEQ ID NO: 6245919 - DNA, 21 bp, Homo sapiens
gaggctgcccccggccccctg

SEQ ID NO: 6245920 - DNA, 22 bp, Homo sapiens
gaggctgcccccggccccctgg

SEQ ID NO: 6245921 - DNA, 16 bp, Homo sapiens
gaggctgccctgaggg

SEQ ID NO: 6245922 - DNA, 23 bp, Homo sapiens
gaggctgccggagggagccctga

SEQ ID NO: 6245923 - DNA, 13 bp, Homo sapiens
gaggctgcctcag

SEQ ID NO: 6245924 - DNA, 14 bp, Homo sapiens
gaggctgcctcagc

SEQ ID NO: 6245925 - DNA, 14 bp, Homo sapiens
gaggctgcctccca

SEQ ID NO: 6245926 - DNA, 20 bp, Homo sapiens
gaggctgcctccgcacctga

SEQ ID NO: 6245927 - DNA, 12 bp, Homo sapiens
gaggctgcctct

SEQ ID NO: 6245928 - DNA, 19 bp, Homo sapiens
gaggctgcctgctgtgctg

SEQ ID NO: 6245929 - DNA, 16 bp, Homo sapiens
gaggctgcctgggcct

SEQ ID NO: 6245930 - DNA, 11 bp, Homo sapiens
gaggctgctag

SEQ ID NO: 6245931 - DNA, 22 bp, Homo sapiens
gaggctgctcggggtgcacagg

SEQ ID NO: 6245932 - DNA, 10 bp, Homo sapiens
gaggctgctg

SEQ ID NO: 6245933 - DNA, 21 bp, Homo sapiens
gaggctgctgccaggcccggc

SEQ ID NO: 6245934 - DNA, 13 bp, Homo sapiens
gaggctgctgccc

SEQ ID NO: 6245935 - DNA, 12 bp, Homo sapiens
gaggctgctgtg

SEQ ID NO: 6245936 - DNA, 13 bp, Homo sapiens
gaggctgctgtga

SEQ ID NO: 6245937 - DNA, 14 bp, Homo sapiens
gaggctgctgtgaa

SEQ ID NO: 6245938 - DNA, 16 bp, Homo sapiens
gaggctgcttcccaga

SEQ ID NO: 6245939 - DNA, 23 bp, Homo sapiens
gaggctgctttctgcccttctcc

SEQ ID NO: 6245940 - DNA, 19 bp, Homo sapiens
gaggctggaggcagggcct

SEQ ID NO: 6245941 - DNA, 19 bp, Homo sapiens
gaggctggagttggggcag

SEQ ID NO: 6245942 - DNA, 13 bp, Homo sapiens
gaggctggatgac

SEQ ID NO: 6245943 - DNA, 20 bp, Homo sapiens
gaggctggatggctcccctg

SEQ ID NO: 6245944 - DNA, 13 bp, Homo sapiens
gaggctggcaggt

SEQ ID NO: 6245945 - DNA, 16 bp, Homo sapiens
gaggctggcagtacag

SEQ ID NO: 6245946 - DNA, 20 bp, Homo sapiens
gaggctggcatcctggctgg

SEQ ID NO: 6245947 - DNA, 23 bp, Homo sapiens
gaggctggcatcctggctggctg

SEQ ID NO: 6245948 - DNA, 21 bp, Homo sapiens
gaggctggcattgaggctaac

SEQ ID NO: 6245949 - DNA, 21 bp, Homo sapiens
gaggctggccaaggtgtccag

SEQ ID NO: 6245950 - DNA, 18 bp, Homo sapiens
gaggctggcctctacatc

SEQ ID NO: 6245951 - DNA, 21 bp, Homo sapiens
gaggctgggacgctctgctgt

SEQ ID NO: 6245952 - DNA, 13 bp, Homo sapiens
gaggctgggagca

SEQ ID NO: 6245953 - DNA, 15 bp, Homo sapiens
gaggctgggaggagc

SEQ ID NO: 6245954 - DNA, 18 bp, Homo sapiens
gaggctgggcacagaggt

SEQ ID NO: 6245955 - DNA, 21 bp, Homo sapiens
gaggctgggccaagccaggga

SEQ ID NO: 6245956 - DNA, 23 bp, Homo sapiens
gaggctgggccaagccagggatg

SEQ ID NO: 6245957 - DNA, 15 bp, Homo sapiens
gaggctgggcccctg

SEQ ID NO: 6245958 - DNA, 17 bp, Homo sapiens
gaggctgggcccctggg

SEQ ID NO: 6245959 - DNA, 19 bp, Homo sapiens
gaggctgggcccctgggat

SEQ ID NO: 6245960 - DNA, 16 bp, Homo sapiens
gaggctgggctccctt

SEQ ID NO: 6245961 - DNA, 16 bp, Homo sapiens
gaggctggggacccag

SEQ ID NO: 6245962 - DNA, 20 bp, Homo sapiens
gaggctggggcggggctgga

SEQ ID NO: 6245963 - DNA, 17 bp, Homo sapiens
gaggctgggggagagcc

SEQ ID NO: 6245964 - DNA, 23 bp, Homo sapiens
gaggctgggtggccggccctgcc

SEQ ID NO: 6245965 - DNA, 22 bp, Homo sapiens
gaggctggtaagggaccttcag

SEQ ID NO: 6245966 - DNA, 15 bp, Homo sapiens
gaggctggtcctatg

SEQ ID NO: 6245967 - DNA, 13 bp, Homo sapiens
gaggctggtctcc

SEQ ID NO: 6245968 - DNA, 23 bp, Homo sapiens
gaggctggtcttagatgcagcga

SEQ ID NO: 6245969 - DNA, 14 bp, Homo sapiens
gaggctggtgccag

SEQ ID NO: 6245970 - DNA, 20 bp, Homo sapiens
gaggctggtgctgtggccag

SEQ ID NO: 6245971 - DNA, 23 bp, Homo sapiens
gaggctggtggttttcagagcag

SEQ ID NO: 6245972 - DNA, 14 bp, Homo sapiens
gaggctgtcctgta

SEQ ID NO: 6245973 - DNA, 21 bp, Homo sapiens
gaggctgtcttctcaggctct

SEQ ID NO: 6245974 - DNA, 15 bp, Homo sapiens
gaggctgtgagcagc

SEQ ID NO: 6245975 - DNA, 14 bp, Homo sapiens
gaggctgtgctccg

SEQ ID NO: 6245976 - DNA, 22 bp, Homo sapiens
gaggctgtgtccctgctggggt

SEQ ID NO: 6245977 - DNA, 20 bp, Homo sapiens
gaggctgtgtggccaaccag

SEQ ID NO: 6245978 - DNA, 17 bp, Homo sapiens
gaggctgttcccaccag

SEQ ID NO: 6245979 - DNA, 15 bp, Homo sapiens
gaggcttagaaaggt

SEQ ID NO: 6245980 - DNA, 22 bp, Homo sapiens
gaggcttagagagaggaggcag

SEQ ID NO: 6245981 - DNA, 20 bp, Homo sapiens
gaggcttccaagcattactt

SEQ ID NO: 6245982 - DNA, 20 bp, Homo sapiens
gaggcttccagagagtcctc

SEQ ID NO: 6245983 - DNA, 20 bp, Homo sapiens
gaggcttccagctcagtccc

SEQ ID NO: 6245984 - DNA, 23 bp, Homo sapiens
gaggcttccagctcagtcccaca

SEQ ID NO: 6245985 - DNA, 20 bp, Homo sapiens
gaggcttccaggctcttcct

SEQ ID NO: 6245986 - DNA, 20 bp, Homo sapiens
gaggcttccctacacagggc

SEQ ID NO: 6245987 - DNA, 22 bp, Homo sapiens
gaggcttcctactataaaatgt

SEQ ID NO: 6245988 - DNA, 14 bp, Homo sapiens
gaggcttcctgact

SEQ ID NO: 6245989 - DNA, 15 bp, Homo sapiens
gaggcttcctgactg

SEQ ID NO: 6245990 - DNA, 16 bp, Homo sapiens
gaggcttcctgactga

SEQ ID NO: 6245991 - DNA, 15 bp, Homo sapiens
gaggcttcctgcgtc

SEQ ID NO: 6245992 - DNA, 21 bp, Homo sapiens
gaggcttcctgcgtcctcctc

SEQ ID NO: 6245993 - DNA, 14 bp, Homo sapiens
gaggcttccttcat

SEQ ID NO: 6245994 - DNA, 18 bp, Homo sapiens
gaggcttctccgccagcc

SEQ ID NO: 6245995 - DNA, 21 bp, Homo sapiens
gaggcttctccgccagcctcc

SEQ ID NO: 6245996 - DNA, 14 bp, Homo sapiens
gaggcttctcctgt

SEQ ID NO: 6245997 - DNA, 15 bp, Homo sapiens
gaggcttcttcctgg

SEQ ID NO: 6245998 - DNA, 17 bp, Homo sapiens
gaggcttcttcctggat

SEQ ID NO: 6245999 - DNA, 19 bp, Homo sapiens
gaggcttcttcctggatgg

SEQ ID NO: 6246000 - DNA, 14 bp, Homo sapiens
gaggcttcttgccc

SEQ ID NO: 6246001 - DNA, 20 bp, Homo sapiens
gcccatctcagcctcctgag

SEQ ID NO: 6246002 - DNA, 23 bp, Homo sapiens
gcccatctcagcctcctgagcct

SEQ ID NO: 6246003 - DNA, 16 bp, Homo sapiens
gcccatctcaggtgcc

SEQ ID NO: 6246004 - DNA, 20 bp, Homo sapiens
gcccatctcaggtgccactc

SEQ ID NO: 6246005 - DNA, 13 bp, Homo sapiens
gcccatctccctg

SEQ ID NO: 6246006 - DNA, 14 bp, Homo sapiens
gcccatctccctgc

SEQ ID NO: 6246007 - DNA, 17 bp, Homo sapiens
gcccatctccctgcttt

SEQ ID NO: 6246008 - DNA, 14 bp, Homo sapiens
gcccatctctccag

SEQ ID NO: 6246009 - DNA, 18 bp, Homo sapiens
gcccatctctccagagag

SEQ ID NO: 6246010 - DNA, 19 bp, Homo sapiens
gcccatctctccagagagc

SEQ ID NO: 6246011 - DNA, 17 bp, Homo sapiens
gcccatctgccgcctgg

SEQ ID NO: 6246012 - DNA, 22 bp, Homo sapiens
gcccatctgcctgttctgagga

SEQ ID NO: 6246013 - DNA, 14 bp, Homo sapiens
gcccatctgtccat

SEQ ID NO: 6246014 - DNA, 21 bp, Homo sapiens
gcccatctgtccatcctcctc

SEQ ID NO: 6246015 - DNA, 20 bp, Homo sapiens
gcccatgagagcgcagcccg

SEQ ID NO: 6246016 - DNA, 18 bp, Homo sapiens
gcccatgatataacttta

SEQ ID NO: 6246017 - DNA, 11 bp, Homo sapiens
gcccatgcccc

SEQ ID NO: 6246018 - DNA, 18 bp, Homo sapiens
gcccatgcccccttcgct

SEQ ID NO: 6246019 - DNA, 22 bp, Homo sapiens
gcccatgccctccactccactg

SEQ ID NO: 6246020 - DNA, 22 bp, Homo sapiens
gcccatgccctccgtcctggca

SEQ ID NO: 6246021 - DNA, 20 bp, Homo sapiens
gcccatgctcaaccactgtg

SEQ ID NO: 6246022 - DNA, 16 bp, Homo sapiens
gcccatgctggctggg

SEQ ID NO: 6246023 - DNA, 14 bp, Homo sapiens
gcccatgctgtccg

SEQ ID NO: 6246024 - DNA, 20 bp, Homo sapiens
gcccatggacaggctggctc

SEQ ID NO: 6246025 - DNA, 23 bp, Homo sapiens
gcccatggacaggctggctccag

SEQ ID NO: 6246026 - DNA, 13 bp, Homo sapiens
gcccatggagatt

SEQ ID NO: 6246027 - DNA, 14 bp, Homo sapiens
gcccatggagcagg

SEQ ID NO: 6246028 - DNA, 13 bp, Homo sapiens
gcccatggaggag

SEQ ID NO: 6246029 - DNA, 18 bp, Homo sapiens
gcccatggaggagacagg

SEQ ID NO: 6246030 - DNA, 21 bp, Homo sapiens
gcccatggccccagctggctg

SEQ ID NO: 6246031 - DNA, 18 bp, Homo sapiens
gcccatggcccccaataa

SEQ ID NO: 6246032 - DNA, 19 bp, Homo sapiens
gcccatggcccccaataaa

SEQ ID NO: 6246033 - DNA, 21 bp, Homo sapiens
gcccatggcccccaataaagg

SEQ ID NO: 6246034 - DNA, 14 bp, Homo sapiens
gcccatggccctgt

SEQ ID NO: 6246035 - DNA, 14 bp, Homo sapiens
gcccatggcctctg

SEQ ID NO: 6246036 - DNA, 15 bp, Homo sapiens
gcccatggctgggaa

SEQ ID NO: 6246037 - DNA, 20 bp, Homo sapiens
gcccatgggagctggttaga

SEQ ID NO: 6246038 - DNA, 14 bp, Homo sapiens
gcccatgggaggga

SEQ ID NO: 6246039 - DNA, 16 bp, Homo sapiens
gcccatgggagggagc

SEQ ID NO: 6246040 - DNA, 16 bp, Homo sapiens
gcccatgggcactgct

SEQ ID NO: 6246041 - DNA, 18 bp, Homo sapiens
gcccatgggcactgctgg

SEQ ID NO: 6246042 - DNA, 15 bp, Homo sapiens
gcccatggggtctct

SEQ ID NO: 6246043 - DNA, 15 bp, Homo sapiens
gcccatgtagctggc

SEQ ID NO: 6246044 - DNA, 19 bp, Homo sapiens
gcccatgtcgcgctcagca

SEQ ID NO: 6246045 - DNA, 15 bp, Homo sapiens
gcccatgtcttctgc

SEQ ID NO: 6246046 - DNA, 21 bp, Homo sapiens
gcccatgtgactgtggcattt

SEQ ID NO: 6246047 - DNA, 21 bp, Homo sapiens
gcccatgtgggctgaaggatg

SEQ ID NO: 6246048 - DNA, 18 bp, Homo sapiens
gcccatgtgtacattctg

SEQ ID NO: 6246049 - DNA, 13 bp, Homo sapiens
gcccatgtgtatg

SEQ ID NO: 6246050 - DNA, 16 bp, Homo sapiens
gcccatgtgtcccctc

SEQ ID NO: 6246051 - DNA, 14 bp, Homo sapiens
gcccatgtgtgagt

SEQ ID NO: 6246052 - DNA, 14 bp, Homo sapiens
gcccatgttctgcc

SEQ ID NO: 6246053 - DNA, 16 bp, Homo sapiens
gcccatgttctgcccc

SEQ ID NO: 6246054 - DNA, 17 bp, Homo sapiens
gcccatgttgagccatg

SEQ ID NO: 6246055 - DNA, 17 bp, Homo sapiens
gcccattaatcttgatc

SEQ ID NO: 6246056 - DNA, 13 bp, Homo sapiens
gcccattactccg

SEQ ID NO: 6246057 - DNA, 14 bp, Homo sapiens
gcccattagagaag

SEQ ID NO: 6246058 - DNA, 15 bp, Homo sapiens
gcccattaggtccct

SEQ ID NO: 6246059 - DNA, 13 bp, Homo sapiens
gcccattcagcct

SEQ ID NO: 6246060 - DNA, 14 bp, Homo sapiens
gcccattcccacca

SEQ ID NO: 6246061 - DNA, 16 bp, Homo sapiens
gcccattcctgcctgg

SEQ ID NO: 6246062 - DNA, 17 bp, Homo sapiens
gcccattcctgcctggt

SEQ ID NO: 6246063 - DNA, 21 bp, Homo sapiens
gcccattcgtctgtcccagag

SEQ ID NO: 6246064 - DNA, 15 bp, Homo sapiens
gcccattctacttgc

SEQ ID NO: 6246065 - DNA, 17 bp, Homo sapiens
gcccattctacttgctc

SEQ ID NO: 6246066 - DNA, 22 bp, Homo sapiens
gcccattctacttgctctggac

SEQ ID NO: 6246067 - DNA, 15 bp, Homo sapiens
gcccattctctctcc

SEQ ID NO: 6246068 - DNA, 21 bp, Homo sapiens
gcccattctctctcctgtcca

SEQ ID NO: 6246069 - DNA, 17 bp, Homo sapiens
gcccattcttctgggtg

SEQ ID NO: 6246070 - DNA, 18 bp, Homo sapiens
gcccattcttttcacttc

SEQ ID NO: 6246071 - DNA, 16 bp, Homo sapiens
gcccattggagcacct

SEQ ID NO: 6246072 - DNA, 13 bp, Homo sapiens
gcccattgtaact

SEQ ID NO: 6246073 - DNA, 14 bp, Homo sapiens
gcccattgtcctcc

SEQ ID NO: 6246074 - DNA, 19 bp, Homo sapiens
gcccatttcgaagatatac

SEQ ID NO: 6246075 - DNA, 16 bp, Homo sapiens
gcccatttctccagaa

SEQ ID NO: 6246076 - DNA, 18 bp, Homo sapiens
gcccatttctccagaacc

SEQ ID NO: 6246077 - DNA, 13 bp, Homo sapiens
gcccatttctggg

SEQ ID NO: 6246078 - DNA, 18 bp, Homo sapiens
gcccatttggagggcctg

SEQ ID NO: 6246079 - DNA, 20 bp, Homo sapiens
gcccatttggagggcctggg

SEQ ID NO: 6246080 - DNA, 18 bp, Homo sapiens
gcccatttgggcagagag

SEQ ID NO: 6246081 - DNA, 17 bp, Homo sapiens
gcccatttgggctctgg

SEQ ID NO: 6246082 - DNA, 20 bp, Homo sapiens
gcccattttcaactgctttg

SEQ ID NO: 6246083 - DNA, 19 bp, Homo sapiens
gccccaaaactctcctctg

SEQ ID NO: 6246084 - DNA, 18 bp, Homo sapiens
gccccaaaccagggtgca

SEQ ID NO: 6246085 - DNA, 20 bp, Homo sapiens
gccccaaacgggctgccctg

SEQ ID NO: 6246086 - DNA, 17 bp, Homo sapiens
gccccaaagatcccacg

SEQ ID NO: 6246087 - DNA, 18 bp, Homo sapiens
gccccaaagcccagcccg

SEQ ID NO: 6246088 - DNA, 20 bp, Homo sapiens
gccccaaaggaaaaagcaca

SEQ ID NO: 6246089 - DNA, 13 bp, Homo sapiens
gccccaaatcaca

SEQ ID NO: 6246090 - DNA, 22 bp, Homo sapiens
gccccaaattgtcacctgcttc

SEQ ID NO: 6246091 - DNA, 14 bp, Homo sapiens
gccccaacactgtc

SEQ ID NO: 6246092 - DNA, 19 bp, Homo sapiens
gccccaacccaaacctgga

SEQ ID NO: 6246093 - DNA, 20 bp, Homo sapiens
gccccaacccaaacctggag

SEQ ID NO: 6246094 - DNA, 22 bp, Homo sapiens
gccccaacccaaacctggagat

SEQ ID NO: 6246095 - DNA, 15 bp, Homo sapiens
gccccaacccgtgga

SEQ ID NO: 6246096 - DNA, 21 bp, Homo sapiens
gccccaacccgtggaggctgc

SEQ ID NO: 6246097 - DNA, 16 bp, Homo sapiens
gccccaaccctcggag

SEQ ID NO: 6246098 - DNA, 17 bp, Homo sapiens
gccccaaccctcggagc

SEQ ID NO: 6246099 - DNA, 23 bp, Homo sapiens
gccccaaccctcggagcccccca

SEQ ID NO: 6246100 - DNA, 17 bp, Homo sapiens
gccccaacccttcttca

SEQ ID NO: 6246101 - DNA, 15 bp, Homo sapiens
gccccaacctcccac

SEQ ID NO: 6246102 - DNA, 19 bp, Homo sapiens
gccccaactccttccagct

SEQ ID NO: 6246103 - DNA, 21 bp, Homo sapiens
gccccaactccttccagctag

SEQ ID NO: 6246104 - DNA, 20 bp, Homo sapiens
gccccaactcgggctcccgg

SEQ ID NO: 6246105 - DNA, 14 bp, Homo sapiens
gccccaactgcagg

SEQ ID NO: 6246106 - DNA, 17 bp, Homo sapiens
gccccaagaaggctggg

SEQ ID NO: 6246107 - DNA, 19 bp, Homo sapiens
gccccaagactctgctctc

SEQ ID NO: 6246108 - DNA, 21 bp, Homo sapiens
gccccaagaggctagccccag

SEQ ID NO: 6246109 - DNA, 18 bp, Homo sapiens
gccccaagcagccagcca

SEQ ID NO: 6246110 - DNA, 22 bp, Homo sapiens
gccccaagcagccagccagtct

SEQ ID NO: 6246111 - DNA, 14 bp, Homo sapiens
gccccaagccctgc

SEQ ID NO: 6246112 - DNA, 13 bp, Homo sapiens
gccccaagctggg

SEQ ID NO: 6246113 - DNA, 13 bp, Homo sapiens
gccccaaggacaa

SEQ ID NO: 6246114 - DNA, 20 bp, Homo sapiens
gccccaaggaccttacaggc

SEQ ID NO: 6246115 - DNA, 14 bp, Homo sapiens
gccccaaggctgct

SEQ ID NO: 6246116 - DNA, 16 bp, Homo sapiens
gccccaaggctgctca

SEQ ID NO: 6246117 - DNA, 17 bp, Homo sapiens
gccccaaggctgctcag

SEQ ID NO: 6246118 - DNA, 18 bp, Homo sapiens
gccccaagggcccagacc

SEQ ID NO: 6246119 - DNA, 20 bp, Homo sapiens
gccccaagggcccagaccct

SEQ ID NO: 6246120 - DNA, 23 bp, Homo sapiens
gccccaagggctggggcggagct

SEQ ID NO: 6246121 - DNA, 15 bp, Homo sapiens
gccccaaggggccca

SEQ ID NO: 6246122 - DNA, 14 bp, Homo sapiens
gccccaaggggtgg

SEQ ID NO: 6246123 - DNA, 16 bp, Homo sapiens
gccccaaggggtggcc

SEQ ID NO: 6246124 - DNA, 19 bp, Homo sapiens
gccccaaggtttacatagt

SEQ ID NO: 6246125 - DNA, 20 bp, Homo sapiens
gccccaagtggtgagcaagc

SEQ ID NO: 6246126 - DNA, 22 bp, Homo sapiens
gccccaagtggtgagcaagcac

SEQ ID NO: 6246127 - DNA, 13 bp, Homo sapiens
gccccaagttggg

SEQ ID NO: 6246128 - DNA, 22 bp, Homo sapiens
gccccaatatggtggccctggg

SEQ ID NO: 6246129 - DNA, 16 bp, Homo sapiens
gccccaatccagagaa

SEQ ID NO: 6246130 - DNA, 19 bp, Homo sapiens
gccccaatccctttattac

SEQ ID NO: 6246131 - DNA, 20 bp, Homo sapiens
gccccaatcttgcccactgg

SEQ ID NO: 6246132 - DNA, 22 bp, Homo sapiens
gccccaatgtatgtgtggctgt

SEQ ID NO: 6246133 - DNA, 21 bp, Homo sapiens
gccccacaaaacttcagtgtg

SEQ ID NO: 6246134 - DNA, 15 bp, Homo sapiens
gccccacaaggccca

SEQ ID NO: 6246135 - DNA, 16 bp, Homo sapiens
gccccacaaggcccag

SEQ ID NO: 6246136 - DNA, 17 bp, Homo sapiens
gccccacaaggcctggt

SEQ ID NO: 6246137 - DNA, 18 bp, Homo sapiens
gccccacaaggcctggtc

SEQ ID NO: 6246138 - DNA, 21 bp, Homo sapiens
gccccacaaggcctggtctgg

SEQ ID NO: 6246139 - DNA, 9 bp, Homo sapiens
gccccacac

SEQ ID NO: 6246140 - DNA, 14 bp, Homo sapiens
gccccacacaggcc

SEQ ID NO: 6246141 - DNA, 16 bp, Homo sapiens
gccccacacaggcctg

SEQ ID NO: 6246142 - DNA, 19 bp, Homo sapiens
gccccacacaggcctggcc

SEQ ID NO: 6246143 - DNA, 21 bp, Homo sapiens
gccccacaccagggccagcct

SEQ ID NO: 6246144 - DNA, 16 bp, Homo sapiens
gccccacactccccgc

SEQ ID NO: 6246145 - DNA, 19 bp, Homo sapiens
gccccacactttgtacaga

SEQ ID NO: 6246146 - DNA, 16 bp, Homo sapiens
gccccacagcacccag

SEQ ID NO: 6246147 - DNA, 14 bp, Homo sapiens
gccccacagcccac

SEQ ID NO: 6246148 - DNA, 11 bp, Homo sapiens
gccccacagct

SEQ ID NO: 6246149 - DNA, 14 bp, Homo sapiens
gccccacagctacc

SEQ ID NO: 6246150 - DNA, 21 bp, Homo sapiens
gccccacagggcaaggacaca

SEQ ID NO: 6246151 - DNA, 13 bp, Homo sapiens
gccccacagtggt

SEQ ID NO: 6246152 - DNA, 12 bp, Homo sapiens
gccccacagttg

SEQ ID NO: 6246153 - DNA, 23 bp, Homo sapiens
gccccacatccccacctggcgga

SEQ ID NO: 6246154 - DNA, 14 bp, Homo sapiens
gccccaccacctag

SEQ ID NO: 6246155 - DNA, 18 bp, Homo sapiens
gccccaccacctaggcca

SEQ ID NO: 6246156 - DNA, 20 bp, Homo sapiens
gccccaccacctaggccact

SEQ ID NO: 6246157 - DNA, 14 bp, Homo sapiens
gccccaccactccc

SEQ ID NO: 6246158 - DNA, 22 bp, Homo sapiens
gccccaccactccccaacccct

SEQ ID NO: 6246159 - DNA, 14 bp, Homo sapiens
gccccaccagccac

SEQ ID NO: 6246160 - DNA, 16 bp, Homo sapiens
gccccaccagccacct

SEQ ID NO: 6246161 - DNA, 15 bp, Homo sapiens
gccccacccaagccc

SEQ ID NO: 6246162 - DNA, 14 bp, Homo sapiens
gccccacccacccc

SEQ ID NO: 6246163 - DNA, 15 bp, Homo sapiens
gccccacccacccca

SEQ ID NO: 6246164 - DNA, 23 bp, Homo sapiens
gccccacccaccccacacctgca

SEQ ID NO: 6246165 - DNA, 18 bp, Homo sapiens
gccccacccaccctctgg

SEQ ID NO: 6246166 - DNA, 13 bp, Homo sapiens
gccccacccagag

SEQ ID NO: 6246167 - DNA, 15 bp, Homo sapiens
gccccacccaggagg

SEQ ID NO: 6246168 - DNA, 21 bp, Homo sapiens
gccccaccccaccctgcccct

SEQ ID NO: 6246169 - DNA, 16 bp, Homo sapiens
gccccaccccacctca

SEQ ID NO: 6246170 - DNA, 18 bp, Homo sapiens
gccccaccccacctccac

SEQ ID NO: 6246171 - DNA, 22 bp, Homo sapiens
gccccaccccagggcagccagg

SEQ ID NO: 6246172 - DNA, 17 bp, Homo sapiens
gccccacccccatgcag

SEQ ID NO: 6246173 - DNA, 22 bp, Homo sapiens
gccccacccccctcctccccct

SEQ ID NO: 6246174 - DNA, 15 bp, Homo sapiens
gccccaccccttccc

SEQ ID NO: 6246175 - DNA, 21 bp, Homo sapiens
gccccaccctcaaaccctgtg

SEQ ID NO: 6246176 - DNA, 19 bp, Homo sapiens
gccccaccctccttgagac

SEQ ID NO: 6246177 - DNA, 22 bp, Homo sapiens
gccccaccctcggggatgtgtc

SEQ ID NO: 6246178 - DNA, 20 bp, Homo sapiens
gccccaccctcgtggacacc

SEQ ID NO: 6246179 - DNA, 15 bp, Homo sapiens
gccccaccctgggcc

SEQ ID NO: 6246180 - DNA, 14 bp, Homo sapiens
gaggcttgaaggcc

SEQ ID NO: 6246181 - DNA, 14 bp, Homo sapiens
gaggcttgcccagg

SEQ ID NO: 6246182 - DNA, 15 bp, Homo sapiens
gaggcttgcccagga

SEQ ID NO: 6246183 - DNA, 16 bp, Homo sapiens
gaggcttgcccaggag

SEQ ID NO: 6246184 - DNA, 21 bp, Homo sapiens
gaggcttgctgaacatggata

SEQ ID NO: 6246185 - DNA, 15 bp, Homo sapiens
gaggcttggaaagca

SEQ ID NO: 6246186 - DNA, 23 bp, Homo sapiens
gaggcttggctgctcttccagcg

SEQ ID NO: 6246187 - DNA, 17 bp, Homo sapiens
gaggcttgggcccagta

SEQ ID NO: 6246188 - DNA, 19 bp, Homo sapiens
gaggcttgggcccagtagc

SEQ ID NO: 6246189 - DNA, 21 bp, Homo sapiens
gaggcttgggcccagtagccc

SEQ ID NO: 6246190 - DNA, 14 bp, Homo sapiens
gaggcttggttcct

SEQ ID NO: 6246191 - DNA, 20 bp, Homo sapiens
gaggctttaagctccagctt

SEQ ID NO: 6246192 - DNA, 19 bp, Homo sapiens
gaggctttctgggctctgg

SEQ ID NO: 6246193 - DNA, 21 bp, Homo sapiens
gaggctttctgggctctggac

SEQ ID NO: 6246194 - DNA, 20 bp, Homo sapiens
gaggctttggatttgacatt

SEQ ID NO: 6246195 - DNA, 14 bp, Homo sapiens
gaggctttggccca

SEQ ID NO: 6246196 - DNA, 15 bp, Homo sapiens
gaggctttggcccaa

SEQ ID NO: 6246197 - DNA, 23 bp, Homo sapiens
gaggctttggggtcctagcccag

SEQ ID NO: 6246198 - DNA, 23 bp, Homo sapiens
gaggctttggtaaaacagtttca

SEQ ID NO: 6246199 - DNA, 11 bp, Homo sapiens
gaggctttgtg

SEQ ID NO: 6246200 - DNA, 14 bp, Homo sapiens
gagggaaaacagaa

SEQ ID NO: 6246201 - DNA, 13 bp, Homo sapiens
gagggaaaagcta

SEQ ID NO: 6246202 - DNA, 21 bp, Homo sapiens
gagggaaaaggcaggtgcttt

SEQ ID NO: 6246203 - DNA, 16 bp, Homo sapiens
gagggaaaagggaagt

SEQ ID NO: 6246204 - DNA, 19 bp, Homo sapiens
gagggaaactctggagagc

SEQ ID NO: 6246205 - DNA, 21 bp, Homo sapiens
gagggaaactctggagagcct

SEQ ID NO: 6246206 - DNA, 13 bp, Homo sapiens
gagggaaagccag

SEQ ID NO: 6246207 - DNA, 16 bp, Homo sapiens
gagggaaagccagcct

SEQ ID NO: 6246208 - DNA, 18 bp, Homo sapiens
gagggaaagccagcctgg

SEQ ID NO: 6246209 - DNA, 18 bp, Homo sapiens
gagggaaatgtacacttt

SEQ ID NO: 6246210 - DNA, 20 bp, Homo sapiens
gagggaacctgttagtctcc

SEQ ID NO: 6246211 - DNA, 19 bp, Homo sapiens
gagggaacggaaataaagg

SEQ ID NO: 6246212 - DNA, 19 bp, Homo sapiens
gagggaagaaaaaaaatct

SEQ ID NO: 6246213 - DNA, 14 bp, Homo sapiens
gagggaagaacatt

SEQ ID NO: 6246214 - DNA, 15 bp, Homo sapiens
gagggaagacctgaa

SEQ ID NO: 6246215 - DNA, 23 bp, Homo sapiens
gagggaagacctgaaagagagga

SEQ ID NO: 6246216 - DNA, 19 bp, Homo sapiens
gagggaagagtggaggtgg

SEQ ID NO: 6246217 - DNA, 20 bp, Homo sapiens
gagggaagagtggaggtgga

SEQ ID NO: 6246218 - DNA, 19 bp, Homo sapiens
gagggaagatgacctgccc

SEQ ID NO: 6246219 - DNA, 17 bp, Homo sapiens
gagggaagccagtcagg

SEQ ID NO: 6246220 - DNA, 15 bp, Homo sapiens
gagggaagcccaccc

SEQ ID NO: 6246221 - DNA, 18 bp, Homo sapiens
gagggaagcccacccgcc

SEQ ID NO: 6246222 - DNA, 18 bp, Homo sapiens
gagggaagctgaggccca

SEQ ID NO: 6246223 - DNA, 13 bp, Homo sapiens
gagggaagctggc

SEQ ID NO: 6246224 - DNA, 14 bp, Homo sapiens
gagggaaggacaga

SEQ ID NO: 6246225 - DNA, 17 bp, Homo sapiens
gagggaaggacagtccc

SEQ ID NO: 6246226 - DNA, 19 bp, Homo sapiens
gagggaaggacagtccctg

SEQ ID NO: 6246227 - DNA, 13 bp, Homo sapiens
gagggaaggagct

SEQ ID NO: 6246228 - DNA, 16 bp, Homo sapiens
gagggaagggagccaa

SEQ ID NO: 6246229 - DNA, 21 bp, Homo sapiens
gagggaaggggatggaggcca

SEQ ID NO: 6246230 - DNA, 22 bp, Homo sapiens
gagggaaggggatggaggccag

SEQ ID NO: 6246231 - DNA, 17 bp, Homo sapiens
gagggaaggttcttcat

SEQ ID NO: 6246232 - DNA, 16 bp, Homo sapiens
gagggaagtcctggga

SEQ ID NO: 6246233 - DNA, 15 bp, Homo sapiens
gagggaagtggaggt

SEQ ID NO: 6246234 - DNA, 22 bp, Homo sapiens
gagggaagtgtgagcgccttgg

SEQ ID NO: 6246235 - DNA, 19 bp, Homo sapiens
gagggaagtttaaaaccca

SEQ ID NO: 6246236 - DNA, 18 bp, Homo sapiens
gagggacaaactcactca

SEQ ID NO: 6246237 - DNA, 17 bp, Homo sapiens
gagggacaaaggagcct

SEQ ID NO: 6246238 - DNA, 21 bp, Homo sapiens
gagggacaaatttaaaacaaa

SEQ ID NO: 6246239 - DNA, 17 bp, Homo sapiens
gagggacaaccagaagg

SEQ ID NO: 6246240 - DNA, 21 bp, Homo sapiens
gagggacaagggattctggga

SEQ ID NO: 6246241 - DNA, 22 bp, Homo sapiens
gagggacacatgcccctccccc

SEQ ID NO: 6246242 - DNA, 12 bp, Homo sapiens
gagggacagagc

SEQ ID NO: 6246243 - DNA, 16 bp, Homo sapiens
gagggacagagcccgg

SEQ ID NO: 6246244 - DNA, 20 bp, Homo sapiens
gagggacagcagattccaca

SEQ ID NO: 6246245 - DNA, 16 bp, Homo sapiens
gagggacaggctgaag

SEQ ID NO: 6246246 - DNA, 18 bp, Homo sapiens
gagggacaggctgaagag

SEQ ID NO: 6246247 - DNA, 14 bp, Homo sapiens
gagggacagggcag

SEQ ID NO: 6246248 - DNA, 14 bp, Homo sapiens
gagggacagggctt

SEQ ID NO: 6246249 - DNA, 20 bp, Homo sapiens
gagggacagggcttggggag

SEQ ID NO: 6246250 - DNA, 22 bp, Homo sapiens
gagggacagtgggctatgccac

SEQ ID NO: 6246251 - DNA, 18 bp, Homo sapiens
gagggacatatcagtgac

SEQ ID NO: 6246252 - DNA, 18 bp, Homo sapiens
gagggaccaaattgcttc

SEQ ID NO: 6246253 - DNA, 18 bp, Homo sapiens
gagggaccaactgggccc

SEQ ID NO: 6246254 - DNA, 16 bp, Homo sapiens
gagggaccagccaaga

SEQ ID NO: 6246255 - DNA, 19 bp, Homo sapiens
gagggaccaggtgtctaga

SEQ ID NO: 6246256 - DNA, 22 bp, Homo sapiens
gagggaccaggtgtctagaggc

SEQ ID NO: 6246257 - DNA, 13 bp, Homo sapiens
gagggaccttgga

SEQ ID NO: 6246258 - DNA, 14 bp, Homo sapiens
gagggaccttggag

SEQ ID NO: 6246259 - DNA, 23 bp, Homo sapiens
gagggacgcacagcactgcctgc

SEQ ID NO: 6246260 - DNA, 23 bp, Homo sapiens
gagggacgcctgggggtgccagg

SEQ ID NO: 6246261 - DNA, 15 bp, Homo sapiens
gagggacggccaaga

SEQ ID NO: 6246262 - DNA, 20 bp, Homo sapiens
gagggacggccaagaatgta

SEQ ID NO: 6246263 - DNA, 15 bp, Homo sapiens
gagggactccaagcc

SEQ ID NO: 6246264 - DNA, 19 bp, Homo sapiens
gagggactctgaagcctct

SEQ ID NO: 6246265 - DNA, 21 bp, Homo sapiens
gagggactctgaagcctctgg

SEQ ID NO: 6246266 - DNA, 22 bp, Homo sapiens
gagggactctgaagcctctggg

SEQ ID NO: 6246267 - DNA, 16 bp, Homo sapiens
gagggactctgtctgg

SEQ ID NO: 6246268 - DNA, 16 bp, Homo sapiens
gagggactgcctctgc

SEQ ID NO: 6246269 - DNA, 11 bp, Homo sapiens
gagggactgga

SEQ ID NO: 6246270 - DNA, 14 bp, Homo sapiens
gagggactggacag

SEQ ID NO: 6246271 - DNA, 15 bp, Homo sapiens
gagggactgtcagct

SEQ ID NO: 6246272 - DNA, 21 bp, Homo sapiens
gagggactttgctgatttccc

SEQ ID NO: 6246273 - DNA, 14 bp, Homo sapiens
gagggagaagactg

SEQ ID NO: 6246274 - DNA, 14 bp, Homo sapiens
gagggagaagcatg

SEQ ID NO: 6246275 - DNA, 19 bp, Homo sapiens
gagggagaaggagaggctc

SEQ ID NO: 6246276 - DNA, 15 bp, Homo sapiens
gagggagaagggaga

SEQ ID NO: 6246277 - DNA, 11 bp, Homo sapiens
gagggagacca

SEQ ID NO: 6246278 - DNA, 20 bp, Homo sapiens
gagggagacggccctgctgg

SEQ ID NO: 6246279 - DNA, 14 bp, Homo sapiens
gagggagactgacc

SEQ ID NO: 6246280 - DNA, 16 bp, Homo sapiens
gagggagactgaccca

SEQ ID NO: 6246281 - DNA, 15 bp, Homo sapiens
gagggagagagagag

SEQ ID NO: 6246282 - DNA, 16 bp, Homo sapiens
gagggagagagagaga

SEQ ID NO: 6246283 - DNA, 14 bp, Homo sapiens
gagggagagccctg

SEQ ID NO: 6246284 - DNA, 15 bp, Homo sapiens
gagggagaggaagca

SEQ ID NO: 6246285 - DNA, 13 bp, Homo sapiens
gagggagagggag

SEQ ID NO: 6246286 - DNA, 23 bp, Homo sapiens
gagggagaggtggagcaaagtga

SEQ ID NO: 6246287 - DNA, 22 bp, Homo sapiens
gagggagcaggtgcccccaggt

SEQ ID NO: 6246288 - DNA, 16 bp, Homo sapiens
gagggagccatggaag

SEQ ID NO: 6246289 - DNA, 22 bp, Homo sapiens
gagggagccctgagcctggcag

SEQ ID NO: 6246290 - DNA, 19 bp, Homo sapiens
gagggagccggtttgggag

SEQ ID NO: 6246291 - DNA, 20 bp, Homo sapiens
gagggagccggtttgggaga

SEQ ID NO: 6246292 - DNA, 22 bp, Homo sapiens
gagggagcgacacttgaatgta

SEQ ID NO: 6246293 - DNA, 15 bp, Homo sapiens
gagggagctgagaag

SEQ ID NO: 6246294 - DNA, 16 bp, Homo sapiens
gagggagctgagaaga

SEQ ID NO: 6246295 - DNA, 13 bp, Homo sapiens
gagggagctgctg

SEQ ID NO: 6246296 - DNA, 15 bp, Homo sapiens
gagggagctgctggc

SEQ ID NO: 6246297 - DNA, 17 bp, Homo sapiens
gagggagctgctggctg

SEQ ID NO: 6246298 - DNA, 12 bp, Homo sapiens
gagggaggaagg

SEQ ID NO: 6246299 - DNA, 15 bp, Homo sapiens
gagggaggacctggg

SEQ ID NO: 6246300 - DNA, 13 bp, Homo sapiens
gagggaggaggcc

SEQ ID NO: 6246301 - DNA, 16 bp, Homo sapiens
gagggaggagggagtg

SEQ ID NO: 6246302 - DNA, 23 bp, Homo sapiens
gagggaggcagaaagggaaagta

SEQ ID NO: 6246303 - DNA, 16 bp, Homo sapiens
gagggaggccccaggg

SEQ ID NO: 6246304 - DNA, 17 bp, Homo sapiens
gagggaggccccagggg

SEQ ID NO: 6246305 - DNA, 12 bp, Homo sapiens
gagggaggcctg

SEQ ID NO: 6246306 - DNA, 13 bp, Homo sapiens
gagggaggcctga

SEQ ID NO: 6246307 - DNA, 15 bp, Homo sapiens
gagggaggcttcctg

SEQ ID NO: 6246308 - DNA, 14 bp, Homo sapiens
gagggagggagagg

SEQ ID NO: 6246309 - DNA, 14 bp, Homo sapiens
gagggagggagggc

SEQ ID NO: 6246310 - DNA, 15 bp, Homo sapiens
gagggagggcaatag

SEQ ID NO: 6246311 - DNA, 18 bp, Homo sapiens
gagggagggcggtggaca

SEQ ID NO: 6246312 - DNA, 16 bp, Homo sapiens
gagggagggctccaga

SEQ ID NO: 6246313 - DNA, 19 bp, Homo sapiens
gagggagggctccagacac

SEQ ID NO: 6246314 - DNA, 15 bp, Homo sapiens
gagggagggctgggc

SEQ ID NO: 6246315 - DNA, 18 bp, Homo sapiens
gagggagggctgggctag

SEQ ID NO: 6246316 - DNA, 21 bp, Homo sapiens
gagggaggggaagcttctgtc

SEQ ID NO: 6246317 - DNA, 17 bp, Homo sapiens
gagggaggggacagagg

SEQ ID NO: 6246318 - DNA, 19 bp, Homo sapiens
gagggaggggacagaggcc

SEQ ID NO: 6246319 - DNA, 20 bp, Homo sapiens
gagggaggggacagaggccc

SEQ ID NO: 6246320 - DNA, 14 bp, Homo sapiens
gagggaggggaggg

SEQ ID NO: 6246321 - DNA, 12 bp, Homo sapiens
gagggaggggcc

SEQ ID NO: 6246322 - DNA, 22 bp, Homo sapiens
gagggagggggaagtcgaagga

SEQ ID NO: 6246323 - DNA, 20 bp, Homo sapiens
gagggagggggcgctcagga

SEQ ID NO: 6246324 - DNA, 23 bp, Homo sapiens
gagggagggggcgctcaggaccc

SEQ ID NO: 6246325 - DNA, 13 bp, Homo sapiens
gagggagggggct

SEQ ID NO: 6246326 - DNA, 14 bp, Homo sapiens
gagggaggtaagga

SEQ ID NO: 6246327 - DNA, 23 bp, Homo sapiens
gagggaggtgtttaaagagaggt

SEQ ID NO: 6246328 - DNA, 12 bp, Homo sapiens
gagggagtcagt

SEQ ID NO: 6246329 - DNA, 14 bp, Homo sapiens
gagggagtctcagg

SEQ ID NO: 6246330 - DNA, 19 bp, Homo sapiens
gagggagtgagccagcagc

SEQ ID NO: 6246331 - DNA, 13 bp, Homo sapiens
gagggagtgcaga

SEQ ID NO: 6246332 - DNA, 19 bp, Homo sapiens
gagggagtgttcaaaatac

SEQ ID NO: 6246333 - DNA, 22 bp, Homo sapiens
gagggagttagggagagagaag

SEQ ID NO: 6246334 - DNA, 14 bp, Homo sapiens
gagggatcacaggg

SEQ ID NO: 6246335 - DNA, 23 bp, Homo sapiens
gagggatcacagggccccagaag

SEQ ID NO: 6246336 - DNA, 16 bp, Homo sapiens
gagggatctaggtctt

SEQ ID NO: 6246337 - DNA, 22 bp, Homo sapiens
gagggatgatgagggaagcaat

SEQ ID NO: 6246338 - DNA, 21 bp, Homo sapiens
gagggatgccataccttgaga

SEQ ID NO: 6246339 - DNA, 18 bp, Homo sapiens
gagggatgcccccaggca

SEQ ID NO: 6246340 - DNA, 15 bp, Homo sapiens
gagggatgctgctcc

SEQ ID NO: 6246341 - DNA, 18 bp, Homo sapiens
gagggatgctgctccgcc

SEQ ID NO: 6246342 - DNA, 15 bp, Homo sapiens
gagggatgctggaac

SEQ ID NO: 6246343 - DNA, 20 bp, Homo sapiens
gagggatggagaaagaagtg

SEQ ID NO: 6246344 - DNA, 19 bp, Homo sapiens
gagggatggcgggtggggg

SEQ ID NO: 6246345 - DNA, 13 bp, Homo sapiens
gagggatgggaga

SEQ ID NO: 6246346 - DNA, 14 bp, Homo sapiens
gagggatgggcctg

SEQ ID NO: 6246347 - DNA, 21 bp, Homo sapiens
gagggattctggttccagggt

SEQ ID NO: 6246348 - DNA, 20 bp, Homo sapiens
gagggattgaacacaggcaa

SEQ ID NO: 6246349 - DNA, 16 bp, Homo sapiens
gagggattgaggggcc

SEQ ID NO: 6246350 - DNA, 18 bp, Homo sapiens
gagggatttccctgcaga

SEQ ID NO: 6246351 - DNA, 23 bp, Homo sapiens
gagggattttgttcaagtttgct

SEQ ID NO: 6246352 - DNA, 21 bp, Homo sapiens
gagggcaaaccaggctgcagg

SEQ ID NO: 6246353 - DNA, 12 bp, Homo sapiens
gagggcaaagct

SEQ ID NO: 6246354 - DNA, 13 bp, Homo sapiens
gagggcaaagctg

SEQ ID NO: 6246355 - DNA, 17 bp, Homo sapiens
gagggcaaagctgattt

SEQ ID NO: 6246356 - DNA, 19 bp, Homo sapiens
gagggcaagaggtgcctgg

SEQ ID NO: 6246357 - DNA, 19 bp, Homo sapiens
gagggcaagcctctagtgt

SEQ ID NO: 6246358 - DNA, 18 bp, Homo sapiens
gagggcaagggccatgct

SEQ ID NO: 6246359 - DNA, 22 bp, Homo sapiens
gccccaccctgggccctgggct

SEQ ID NO: 6246360 - DNA, 23 bp, Homo sapiens
gccccaccctgggccctgggctg

SEQ ID NO: 6246361 - DNA, 12 bp, Homo sapiens
gccccacccttg

SEQ ID NO: 6246362 - DNA, 19 bp, Homo sapiens
gccccacccttgtccctca

SEQ ID NO: 6246363 - DNA, 14 bp, Homo sapiens
gccccaccggccag

SEQ ID NO: 6246364 - DNA, 20 bp, Homo sapiens
gccccacctacttgtgactg

SEQ ID NO: 6246365 - DNA, 12 bp, Homo sapiens
gccccacctcca

SEQ ID NO: 6246366 - DNA, 18 bp, Homo sapiens
gccccacctccacctgtg

SEQ ID NO: 6246367 - DNA, 20 bp, Homo sapiens
gccccacctccacctgtgag

SEQ ID NO: 6246368 - DNA, 23 bp, Homo sapiens
gccccacctcccatttctgttgc

SEQ ID NO: 6246369 - DNA, 20 bp, Homo sapiens
gccccacctcccgccctcac

SEQ ID NO: 6246370 - DNA, 20 bp, Homo sapiens
gccccacctcggcacacact

SEQ ID NO: 6246371 - DNA, 15 bp, Homo sapiens
gccccacctgaaggg

SEQ ID NO: 6246372 - DNA, 18 bp, Homo sapiens
gccccacctgaagggtgg

SEQ ID NO: 6246373 - DNA, 14 bp, Homo sapiens
gccccacctgagcc

SEQ ID NO: 6246374 - DNA, 17 bp, Homo sapiens
gccccacctgcagctcc

SEQ ID NO: 6246375 - DNA, 15 bp, Homo sapiens
gccccacctgccact

SEQ ID NO: 6246376 - DNA, 15 bp, Homo sapiens
gccccacctggccct

SEQ ID NO: 6246377 - DNA, 11 bp, Homo sapiens
gccccacctgt

SEQ ID NO: 6246378 - DNA, 15 bp, Homo sapiens
gccccaccttgccag

SEQ ID NO: 6246379 - DNA, 18 bp, Homo sapiens
gccccaccttgccagggc

SEQ ID NO: 6246380 - DNA, 16 bp, Homo sapiens
gccccacgccctctcc

SEQ ID NO: 6246381 - DNA, 13 bp, Homo sapiens
gccccacgtccct

SEQ ID NO: 6246382 - DNA, 17 bp, Homo sapiens
gccccactccagcctgg

SEQ ID NO: 6246383 - DNA, 19 bp, Homo sapiens
gccccactccagcctgggg

SEQ ID NO: 6246384 - DNA, 22 bp, Homo sapiens
gccccactccagcctggggacc

SEQ ID NO: 6246385 - DNA, 20 bp, Homo sapiens
gccccactcccttgctggcc

SEQ ID NO: 6246386 - DNA, 23 bp, Homo sapiens
gccccactcccttgctggcccca

SEQ ID NO: 6246387 - DNA, 12 bp, Homo sapiens
gccccactctca

SEQ ID NO: 6246388 - DNA, 14 bp, Homo sapiens
gccccactctcaga

SEQ ID NO: 6246389 - DNA, 16 bp, Homo sapiens
gccccactctcagagg

SEQ ID NO: 6246390 - DNA, 19 bp, Homo sapiens
gccccactctgctgaggcc

SEQ ID NO: 6246391 - DNA, 22 bp, Homo sapiens
gccccactctgctgaggccaga

SEQ ID NO: 6246392 - DNA, 14 bp, Homo sapiens
gccccactgacacc

SEQ ID NO: 6246393 - DNA, 17 bp, Homo sapiens
gccccactgacacccag

SEQ ID NO: 6246394 - DNA, 23 bp, Homo sapiens
gccccactgatgctgttctcttc

SEQ ID NO: 6246395 - DNA, 12 bp, Homo sapiens
gccccactgcca

SEQ ID NO: 6246396 - DNA, 17 bp, Homo sapiens
gccccactgccagcagc

SEQ ID NO: 6246397 - DNA, 20 bp, Homo sapiens
gccccactgccagcagcagc

SEQ ID NO: 6246398 - DNA, 18 bp, Homo sapiens
gccccactgccctccagg

SEQ ID NO: 6246399 - DNA, 20 bp, Homo sapiens
gccccactgccctccagggc

SEQ ID NO: 6246400 - DNA, 22 bp, Homo sapiens
gccccactgccctccagggcca

SEQ ID NO: 6246401 - DNA, 11 bp, Homo sapiens
gccccactgga

SEQ ID NO: 6246402 - DNA, 14 bp, Homo sapiens
gccccactggacaa

SEQ ID NO: 6246403 - DNA, 15 bp, Homo sapiens
gccccactggacaac

SEQ ID NO: 6246404 - DNA, 20 bp, Homo sapiens
gccccactggacaacactga

SEQ ID NO: 6246405 - DNA, 14 bp, Homo sapiens
gccccactggggaa

SEQ ID NO: 6246406 - DNA, 14 bp, Homo sapiens
gccccacttaccgc

SEQ ID NO: 6246407 - DNA, 17 bp, Homo sapiens
gccccacttctggcatg

SEQ ID NO: 6246408 - DNA, 23 bp, Homo sapiens
gccccacttctggcatgggacag

SEQ ID NO: 6246409 - DNA, 18 bp, Homo sapiens
gccccacttgtccttagc

SEQ ID NO: 6246410 - DNA, 16 bp, Homo sapiens
gccccactttgaaggg

SEQ ID NO: 6246411 - DNA, 19 bp, Homo sapiens
gccccactttgaagggcaa

SEQ ID NO: 6246412 - DNA, 16 bp, Homo sapiens
gccccagaaaggggaa

SEQ ID NO: 6246413 - DNA, 18 bp, Homo sapiens
gccccagaaatgccgctg

SEQ ID NO: 6246414 - DNA, 19 bp, Homo sapiens
gccccagaaatgccgctgt

SEQ ID NO: 6246415 - DNA, 21 bp, Homo sapiens
gccccagaacaattctgcaga

SEQ ID NO: 6246416 - DNA, 13 bp, Homo sapiens
gccccagaagaaa

SEQ ID NO: 6246417 - DNA, 22 bp, Homo sapiens
gccccagacacaccccccagtc

SEQ ID NO: 6246418 - DNA, 16 bp, Homo sapiens
gccccagacagggtgg

SEQ ID NO: 6246419 - DNA, 18 bp, Homo sapiens
gccccagacagttctttt

SEQ ID NO: 6246420 - DNA, 17 bp, Homo sapiens
gccccagaccccagggc

SEQ ID NO: 6246421 - DNA, 19 bp, Homo sapiens
gccccagaccccagggcag

SEQ ID NO: 6246422 - DNA, 16 bp, Homo sapiens
gccccagacctgccgc

SEQ ID NO: 6246423 - DNA, 12 bp, Homo sapiens
gccccagactga

SEQ ID NO: 6246424 - DNA, 16 bp, Homo sapiens
gccccagactgagctc

SEQ ID NO: 6246425 - DNA, 24 bp, Homo sapiens
gccccagactgagctctccaggcc

SEQ ID NO: 6246426 - DNA, 21 bp, Homo sapiens
gccccagactgggcccaggca

SEQ ID NO: 6246427 - DNA, 23 bp, Homo sapiens
gccccagactgggcccaggcagg

SEQ ID NO: 6246428 - DNA, 23 bp, Homo sapiens
gccccagagaagcctcagtccct

SEQ ID NO: 6246429 - DNA, 11 bp, Homo sapiens
gccccagagac

SEQ ID NO: 6246430 - DNA, 15 bp, Homo sapiens
gccccagagactcag

SEQ ID NO: 6246431 - DNA, 17 bp, Homo sapiens
gccccagagactgccca

SEQ ID NO: 6246432 - DNA, 19 bp, Homo sapiens
gccccagagactgcccacc

SEQ ID NO: 6246433 - DNA, 20 bp, Homo sapiens
gccccagagactgcccaccc

SEQ ID NO: 6246434 - DNA, 15 bp, Homo sapiens
gccccagagagaccc

SEQ ID NO: 6246435 - DNA, 19 bp, Homo sapiens
gccccagagagaccctgca

SEQ ID NO: 6246436 - DNA, 12 bp, Homo sapiens
gccccagagagg

SEQ ID NO: 6246437 - DNA, 12 bp, Homo sapiens
gccccagagatg

SEQ ID NO: 6246438 - DNA, 19 bp, Homo sapiens
gccccagagatgccagccc

SEQ ID NO: 6246439 - DNA, 22 bp, Homo sapiens
gccccagagatgccagcccttc

SEQ ID NO: 6246440 - DNA, 23 bp, Homo sapiens
gccccagagatgccagcccttca

SEQ ID NO: 6246441 - DNA, 11 bp, Homo sapiens
gccccagagga

SEQ ID NO: 6246442 - DNA, 13 bp, Homo sapiens
gccccagaggccc

SEQ ID NO: 6246443 - DNA, 15 bp, Homo sapiens
gccccagaggccctg

SEQ ID NO: 6246444 - DNA, 22 bp, Homo sapiens
gccccagaggccctggaggtct

SEQ ID NO: 6246445 - DNA, 18 bp, Homo sapiens
gccccagaggtcgcagct

SEQ ID NO: 6246446 - DNA, 21 bp, Homo sapiens
gccccagaggtcgcagctacc

SEQ ID NO: 6246447 - DNA, 16 bp, Homo sapiens
gccccagagtggccca

SEQ ID NO: 6246448 - DNA, 20 bp, Homo sapiens
gccccagataccagcccctg

SEQ ID NO: 6246449 - DNA, 19 bp, Homo sapiens
gccccagataccatgatgc

SEQ ID NO: 6246450 - DNA, 15 bp, Homo sapiens
gccccagatctgcct

SEQ ID NO: 6246451 - DNA, 18 bp, Homo sapiens
gccccagatctgcctggg

SEQ ID NO: 6246452 - DNA, 23 bp, Homo sapiens
gccccagatctgcctgggcctgt

SEQ ID NO: 6246453 - DNA, 17 bp, Homo sapiens
gccccagatgatcccag

SEQ ID NO: 6246454 - DNA, 21 bp, Homo sapiens
gccccagatgatcccagtcac

SEQ ID NO: 6246455 - DNA, 19 bp, Homo sapiens
gccccagatggctttgtga

SEQ ID NO: 6246456 - DNA, 21 bp, Homo sapiens
gccccagcaagagcacaagag

SEQ ID NO: 6246457 - DNA, 20 bp, Homo sapiens
gccccagcacagcttgacct

SEQ ID NO: 6246458 - DNA, 19 bp, Homo sapiens
gccccagcacctcagcctg

SEQ ID NO: 6246459 - DNA, 19 bp, Homo sapiens
gccccagcactaaagcagt

SEQ ID NO: 6246460 - DNA, 12 bp, Homo sapiens
gccccagccaag

SEQ ID NO: 6246461 - DNA, 18 bp, Homo sapiens
gccccagccaagcctgac

SEQ ID NO: 6246462 - DNA, 12 bp, Homo sapiens
gccccagccagc

SEQ ID NO: 6246463 - DNA, 14 bp, Homo sapiens
gccccagcccaagt

SEQ ID NO: 6246464 - DNA, 16 bp, Homo sapiens
gccccagcccaagtcc

SEQ ID NO: 6246465 - DNA, 15 bp, Homo sapiens
gccccagcccaccct

SEQ ID NO: 6246466 - DNA, 13 bp, Homo sapiens
gccccagccccaa

SEQ ID NO: 6246467 - DNA, 22 bp, Homo sapiens
gccccagccccaatccagagaa

SEQ ID NO: 6246468 - DNA, 21 bp, Homo sapiens
gccccagccccgttccttccg

SEQ ID NO: 6246469 - DNA, 12 bp, Homo sapiens
gccccagcccct

SEQ ID NO: 6246470 - DNA, 19 bp, Homo sapiens
gccccagccctactctgtg

SEQ ID NO: 6246471 - DNA, 20 bp, Homo sapiens
gccccagccctgctggggat

SEQ ID NO: 6246472 - DNA, 10 bp, Homo sapiens
gccccagcct

SEQ ID NO: 6246473 - DNA, 19 bp, Homo sapiens
gccccagcctaggtggagg

SEQ ID NO: 6246474 - DNA, 13 bp, Homo sapiens
gccccagcctcct

SEQ ID NO: 6246475 - DNA, 17 bp, Homo sapiens
gccccagcctcctgagt

SEQ ID NO: 6246476 - DNA, 23 bp, Homo sapiens
gccccagcctcctgagtagctgg

SEQ ID NO: 6246477 - DNA, 11 bp, Homo sapiens
gccccagcctg

SEQ ID NO: 6246478 - DNA, 12 bp, Homo sapiens
gccccagcctgc

SEQ ID NO: 6246479 - DNA, 14 bp, Homo sapiens
gccccagcctgcta

SEQ ID NO: 6246480 - DNA, 14 bp, Homo sapiens
gccccagcctggcc

SEQ ID NO: 6246481 - DNA, 15 bp, Homo sapiens
gccccagcctggccc

SEQ ID NO: 6246482 - DNA, 16 bp, Homo sapiens
gccccagcctggccca

SEQ ID NO: 6246483 - DNA, 17 bp, Homo sapiens
gccccagcctggcccag

SEQ ID NO: 6246484 - DNA, 14 bp, Homo sapiens
gccccagcctgggc

SEQ ID NO: 6246485 - DNA, 18 bp, Homo sapiens
gccccagcctgggccatc

SEQ ID NO: 6246486 - DNA, 16 bp, Homo sapiens
gccccagcgcggcttg

SEQ ID NO: 6246487 - DNA, 16 bp, Homo sapiens
gccccagcgggctggc

SEQ ID NO: 6246488 - DNA, 18 bp, Homo sapiens
gccccagcgggctggcgg

SEQ ID NO: 6246489 - DNA, 22 bp, Homo sapiens
gccccagcgtctgcagggtgac

SEQ ID NO: 6246490 - DNA, 13 bp, Homo sapiens
gccccagctagga

SEQ ID NO: 6246491 - DNA, 22 bp, Homo sapiens
gccccagctccgtttctaccac

SEQ ID NO: 6246492 - DNA, 21 bp, Homo sapiens
gccccagctctcttctggctt

SEQ ID NO: 6246493 - DNA, 12 bp, Homo sapiens
gccccagctctg

SEQ ID NO: 6246494 - DNA, 14 bp, Homo sapiens
gccccagctctggc

SEQ ID NO: 6246495 - DNA, 11 bp, Homo sapiens
gccccagctga

SEQ ID NO: 6246496 - DNA, 12 bp, Homo sapiens
gccccagctgcc

SEQ ID NO: 6246497 - DNA, 18 bp, Homo sapiens
gccccagctgccaggcgg

SEQ ID NO: 6246498 - DNA, 14 bp, Homo sapiens
gccccagcttcctg

SEQ ID NO: 6246499 - DNA, 11 bp, Homo sapiens
gccccaggacc

SEQ ID NO: 6246500 - DNA, 12 bp, Homo sapiens
gccccaggacca

SEQ ID NO: 6246501 - DNA, 23 bp, Homo sapiens
gccccaggaccagctcaggacag

SEQ ID NO: 6246502 - DNA, 24 bp, Homo sapiens
gccccaggaccagctcaggacaga

SEQ ID NO: 6246503 - DNA, 22 bp, Homo sapiens
gccccaggacctggctgccata

SEQ ID NO: 6246504 - DNA, 14 bp, Homo sapiens
gccccaggactctg

SEQ ID NO: 6246505 - DNA, 16 bp, Homo sapiens
gccccaggactctggc

SEQ ID NO: 6246506 - DNA, 19 bp, Homo sapiens
gccccaggatcactctctg

SEQ ID NO: 6246507 - DNA, 21 bp, Homo sapiens
gccccaggcagggccaaccct

SEQ ID NO: 6246508 - DNA, 12 bp, Homo sapiens
gccccaggccag

SEQ ID NO: 6246509 - DNA, 16 bp, Homo sapiens
gccccaggccagctgc

SEQ ID NO: 6246510 - DNA, 17 bp, Homo sapiens
gccccaggccagctgcg

SEQ ID NO: 6246511 - DNA, 14 bp, Homo sapiens
gccccaggccaggt

SEQ ID NO: 6246512 - DNA, 17 bp, Homo sapiens
gccccaggccaggtagc

SEQ ID NO: 6246513 - DNA, 11 bp, Homo sapiens
gccccaggccc

SEQ ID NO: 6246514 - DNA, 17 bp, Homo sapiens
gccccaggccccagaca

SEQ ID NO: 6246515 - DNA, 15 bp, Homo sapiens
gccccaggccccagc

SEQ ID NO: 6246516 - DNA, 17 bp, Homo sapiens
gccccaggccctactac

SEQ ID NO: 6246517 - DNA, 16 bp, Homo sapiens
gccccaggccctccct

SEQ ID NO: 6246518 - DNA, 20 bp, Homo sapiens
gccccaggccctccctgact

SEQ ID NO: 6246519 - DNA, 13 bp, Homo sapiens
gccccaggccctg

SEQ ID NO: 6246520 - DNA, 14 bp, Homo sapiens
gccccaggccggag

SEQ ID NO: 6246521 - DNA, 16 bp, Homo sapiens
gccccaggccggagcc

SEQ ID NO: 6246522 - DNA, 19 bp, Homo sapiens
gccccaggccggagcccag

SEQ ID NO: 6246523 - DNA, 12 bp, Homo sapiens
gccccaggcctc

SEQ ID NO: 6246524 - DNA, 14 bp, Homo sapiens
gccccaggcctctg

SEQ ID NO: 6246525 - DNA, 15 bp, Homo sapiens
gccccaggcctggac

SEQ ID NO: 6246526 - DNA, 16 bp, Homo sapiens
gccccaggcctggcct

SEQ ID NO: 6246527 - DNA, 19 bp, Homo sapiens
gccccaggcctgtggctcc

SEQ ID NO: 6246528 - DNA, 20 bp, Homo sapiens
gccccaggcctgtggctccc

SEQ ID NO: 6246529 - DNA, 21 bp, Homo sapiens
gccccaggcctgtggctccct

SEQ ID NO: 6246530 - DNA, 16 bp, Homo sapiens
gccccaggcggagggg

SEQ ID NO: 6246531 - DNA, 11 bp, Homo sapiens
gccccaggctc

SEQ ID NO: 6246532 - DNA, 18 bp, Homo sapiens
gccccaggctcaggctgc

SEQ ID NO: 6246533 - DNA, 22 bp, Homo sapiens
gccccaggctcaggctgcccag

SEQ ID NO: 6246534 - DNA, 17 bp, Homo sapiens
gccccaggctcccctgg

SEQ ID NO: 6246535 - DNA, 18 bp, Homo sapiens
gccccaggctcccctggt

SEQ ID NO: 6246536 - DNA, 17 bp, Homo sapiens
gccccaggctgagagcc

SEQ ID NO: 6246537 - DNA, 19 bp, Homo sapiens
gccccaggctggatgctgg

SEQ ID NO: 6246538 - DNA, 12 bp, Homo sapiens
gccccaggcttc

SEQ ID NO: 6246539 - DNA, 20 bp, Homo sapiens
gagggcaagtggatgggaat

SEQ ID NO: 6246540 - DNA, 21 bp, Homo sapiens
gagggcacaccgccatcctct

SEQ ID NO: 6246541 - DNA, 22 bp, Homo sapiens
gagggcacaccgccatcctctg

SEQ ID NO: 6246542 - DNA, 16 bp, Homo sapiens
gagggcacagccctcc

SEQ ID NO: 6246543 - DNA, 23 bp, Homo sapiens
gagggcacattccttgcctgcac

SEQ ID NO: 6246544 - DNA, 18 bp, Homo sapiens
gagggcactcacatgccg

SEQ ID NO: 6246545 - DNA, 18 bp, Homo sapiens
gagggcactctctgccag

SEQ ID NO: 6246546 - DNA, 18 bp, Homo sapiens
gagggcacttcaggtccg

SEQ ID NO: 6246547 - DNA, 19 bp, Homo sapiens
gagggcacttcctccacag

SEQ ID NO: 6246548 - DNA, 17 bp, Homo sapiens
gagggcagaaaggttct

SEQ ID NO: 6246549 - DNA, 18 bp, Homo sapiens
gagggcagactggggcat

SEQ ID NO: 6246550 - DNA, 23 bp, Homo sapiens
gagggcagactggggcatcctgt

SEQ ID NO: 6246551 - DNA, 20 bp, Homo sapiens
gagggcagagccatgggcct

SEQ ID NO: 6246552 - DNA, 22 bp, Homo sapiens
gagggcagagccatgggcctgg

SEQ ID NO: 6246553 - DNA, 15 bp, Homo sapiens
gagggcagaggctgg

SEQ ID NO: 6246554 - DNA, 19 bp, Homo sapiens
gagggcagcactgggaagc

SEQ ID NO: 6246555 - DNA, 14 bp, Homo sapiens
gagggcagcagcca

SEQ ID NO: 6246556 - DNA, 15 bp, Homo sapiens
gagggcagcagccag

SEQ ID NO: 6246557 - DNA, 20 bp, Homo sapiens
gagggcagcagccagccctg

SEQ ID NO: 6246558 - DNA, 23 bp, Homo sapiens
gagggcagcagccagccctgcct

SEQ ID NO: 6246559 - DNA, 14 bp, Homo sapiens
gagggcagcagggc

SEQ ID NO: 6246560 - DNA, 16 bp, Homo sapiens
gagggcagcagggcta

SEQ ID NO: 6246561 - DNA, 20 bp, Homo sapiens
gagggcagcccccactttcc

SEQ ID NO: 6246562 - DNA, 19 bp, Homo sapiens
gagggcagccccctcccta

SEQ ID NO: 6246563 - DNA, 14 bp, Homo sapiens
gagggcagccccga

SEQ ID NO: 6246564 - DNA, 18 bp, Homo sapiens
gagggcagccccgacccc

SEQ ID NO: 6246565 - DNA, 14 bp, Homo sapiens
gagggcagctgcta

SEQ ID NO: 6246566 - DNA, 15 bp, Homo sapiens
gagggcagctggccc

SEQ ID NO: 6246567 - DNA, 13 bp, Homo sapiens
gagggcaggaccc

SEQ ID NO: 6246568 - DNA, 13 bp, Homo sapiens
gagggcaggcttg

SEQ ID NO: 6246569 - DNA, 20 bp, Homo sapiens
gagggcaggcttggggaaaa

SEQ ID NO: 6246570 - DNA, 23 bp, Homo sapiens
gagggcaggggctgcatcctcag

SEQ ID NO: 6246571 - DNA, 15 bp, Homo sapiens
gagggcaggggtgct

SEQ ID NO: 6246572 - DNA, 17 bp, Homo sapiens
gagggcaggtccagctc

SEQ ID NO: 6246573 - DNA, 19 bp, Homo sapiens
gagggcaggtccagctctg

SEQ ID NO: 6246574 - DNA, 15 bp, Homo sapiens
gagggcagtacctgg

SEQ ID NO: 6246575 - DNA, 17 bp, Homo sapiens
gagggcagtacctggga

SEQ ID NO: 6246576 - DNA, 13 bp, Homo sapiens
gagggcagtgccc

SEQ ID NO: 6246577 - DNA, 17 bp, Homo sapiens
gagggcagtggggagca

SEQ ID NO: 6246578 - DNA, 23 bp, Homo sapiens
gagggcagttcgcagccaccctg

SEQ ID NO: 6246579 - DNA, 22 bp, Homo sapiens
gagggcatgcgcacaaggctga

SEQ ID NO: 6246580 - DNA, 18 bp, Homo sapiens
gagggcatttggcttcct

SEQ ID NO: 6246581 - DNA, 19 bp, Homo sapiens
gagggcatttggcttcctc

SEQ ID NO: 6246582 - DNA, 23 bp, Homo sapiens
gagggcatttggcttcctctgct

SEQ ID NO: 6246583 - DNA, 17 bp, Homo sapiens
gagggccaagagagaca

SEQ ID NO: 6246584 - DNA, 21 bp, Homo sapiens
gagggccaccggtgggcagtg

SEQ ID NO: 6246585 - DNA, 20 bp, Homo sapiens
gagggccacctccacaccca

SEQ ID NO: 6246586 - DNA, 16 bp, Homo sapiens
gagggccagagctagg

SEQ ID NO: 6246587 - DNA, 13 bp, Homo sapiens
gagggccagcagg

SEQ ID NO: 6246588 - DNA, 14 bp, Homo sapiens
gagggccagcaggc

SEQ ID NO: 6246589 - DNA, 21 bp, Homo sapiens
gagggccagcaggctcctggc

SEQ ID NO: 6246590 - DNA, 12 bp, Homo sapiens
gagggccaggca

SEQ ID NO: 6246591 - DNA, 15 bp, Homo sapiens
gagggccagggaccc

SEQ ID NO: 6246592 - DNA, 17 bp, Homo sapiens
gagggccagggaggcag

SEQ ID NO: 6246593 - DNA, 20 bp, Homo sapiens
gagggccagggaggcagagc

SEQ ID NO: 6246594 - DNA, 22 bp, Homo sapiens
gagggcccaaagcttgtaaata

SEQ ID NO: 6246595 - DNA, 21 bp, Homo sapiens
gagggcccagccaggagcaga

SEQ ID NO: 6246596 - DNA, 13 bp, Homo sapiens
gagggcccagccc

SEQ ID NO: 6246597 - DNA, 20 bp, Homo sapiens
gagggcccagcccagagcca

SEQ ID NO: 6246598 - DNA, 23 bp, Homo sapiens
gagggcccagcccagagccacct

SEQ ID NO: 6246599 - DNA, 20 bp, Homo sapiens
gagggcccagctgtagccat

SEQ ID NO: 6246600 - DNA, 22 bp, Homo sapiens
gagggcccagctgtagccatgg

SEQ ID NO: 6246601 - DNA, 20 bp, Homo sapiens
gagggccccctacttgtttt

SEQ ID NO: 6246602 - DNA, 21 bp, Homo sapiens
gagggcccctcactggctgga

SEQ ID NO: 6246603 - DNA, 17 bp, Homo sapiens
gagggcccctctgccca

SEQ ID NO: 6246604 - DNA, 22 bp, Homo sapiens
gagggcccctctgcccagcttg

SEQ ID NO: 6246605 - DNA, 13 bp, Homo sapiens
gagggcccctgcg

SEQ ID NO: 6246606 - DNA, 15 bp, Homo sapiens
gagggccctacctga

SEQ ID NO: 6246607 - DNA, 17 bp, Homo sapiens
gagggccctgagctgag

SEQ ID NO: 6246608 - DNA, 20 bp, Homo sapiens
gagggccctgaggaataaag

SEQ ID NO: 6246609 - DNA, 22 bp, Homo sapiens
gagggccctgtggagtccagct

SEQ ID NO: 6246610 - DNA, 16 bp, Homo sapiens
gagggcccttcccaac

SEQ ID NO: 6246611 - DNA, 18 bp, Homo sapiens
gagggccgagacaggagc

SEQ ID NO: 6246612 - DNA, 15 bp, Homo sapiens
gagggccgcagggcc

SEQ ID NO: 6246613 - DNA, 14 bp, Homo sapiens
gagggccgcccgct

SEQ ID NO: 6246614 - DNA, 15 bp, Homo sapiens
gagggccgcccgctc

SEQ ID NO: 6246615 - DNA, 17 bp, Homo sapiens
gagggccgcccgctccc

SEQ ID NO: 6246616 - DNA, 14 bp, Homo sapiens
gagggccgcctgcc

SEQ ID NO: 6246617 - DNA, 18 bp, Homo sapiens
gagggccggcggctctga

SEQ ID NO: 6246618 - DNA, 20 bp, Homo sapiens
gagggccgtaccccaccctc

SEQ ID NO: 6246619 - DNA, 22 bp, Homo sapiens
gagggcctcaaaggcccgctct

SEQ ID NO: 6246620 - DNA, 22 bp, Homo sapiens
gagggcctctggtgttcctggc

SEQ ID NO: 6246621 - DNA, 17 bp, Homo sapiens
gagggcctgcaagggag

SEQ ID NO: 6246622 - DNA, 20 bp, Homo sapiens
gagggcctgctggaggcctc

SEQ ID NO: 6246623 - DNA, 14 bp, Homo sapiens
gagggcctggacct

SEQ ID NO: 6246624 - DNA, 12 bp, Homo sapiens
gagggcctgggc

SEQ ID NO: 6246625 - DNA, 15 bp, Homo sapiens
gagggcctgggcctg

SEQ ID NO: 6246626 - DNA, 20 bp, Homo sapiens
gagggcctgggcctggctcc

SEQ ID NO: 6246627 - DNA, 16 bp, Homo sapiens
gagggcctggtcacca

SEQ ID NO: 6246628 - DNA, 18 bp, Homo sapiens
gagggccttgcttctctt

SEQ ID NO: 6246629 - DNA, 14 bp, Homo sapiens
gagggcgaaggcca

SEQ ID NO: 6246630 - DNA, 13 bp, Homo sapiens
gagggcgaggcgg

SEQ ID NO: 6246631 - DNA, 14 bp, Homo sapiens
gagggcgaggcggg

SEQ ID NO: 6246632 - DNA, 18 bp, Homo sapiens
gagggcgcatgtgtgtat

SEQ ID NO: 6246633 - DNA, 14 bp, Homo sapiens
gagggcgcccagca

SEQ ID NO: 6246634 - DNA, 16 bp, Homo sapiens
gagggcgcccagcagc

SEQ ID NO: 6246635 - DNA, 17 bp, Homo sapiens
gagggcgcccagcagcc

SEQ ID NO: 6246636 - DNA, 20 bp, Homo sapiens
gagggcgcccagcagcctgc

SEQ ID NO: 6246637 - DNA, 21 bp, Homo sapiens
gagggcgcccagcagcctgcc

SEQ ID NO: 6246638 - DNA, 16 bp, Homo sapiens
gagggcgcccagccca

SEQ ID NO: 6246639 - DNA, 17 bp, Homo sapiens
gagggcgcccagcccag

SEQ ID NO: 6246640 - DNA, 19 bp, Homo sapiens
gagggcgcccagcccaggc

SEQ ID NO: 6246641 - DNA, 20 bp, Homo sapiens
gagggcgcccagcccaggcc

SEQ ID NO: 6246642 - DNA, 22 bp, Homo sapiens
gagggcgcctgggtcctcccag

SEQ ID NO: 6246643 - DNA, 14 bp, Homo sapiens
gagggcgctcctgt

SEQ ID NO: 6246644 - DNA, 19 bp, Homo sapiens
gagggcggcaggggcctgg

SEQ ID NO: 6246645 - DNA, 23 bp, Homo sapiens
gagggcggcaggggcctggagat

SEQ ID NO: 6246646 - DNA, 12 bp, Homo sapiens
gagggcggccag

SEQ ID NO: 6246647 - DNA, 18 bp, Homo sapiens
gagggcggcggggcctgg

SEQ ID NO: 6246648 - DNA, 17 bp, Homo sapiens
gagggcggtggacaata

SEQ ID NO: 6246649 - DNA, 20 bp, Homo sapiens
gagggcgtgactcacccaag

SEQ ID NO: 6246650 - DNA, 23 bp, Homo sapiens
gagggcgtggggaatgggcaggt

SEQ ID NO: 6246651 - DNA, 12 bp, Homo sapiens
gagggcgtgtct

SEQ ID NO: 6246652 - DNA, 19 bp, Homo sapiens
gagggctaattctgggaag

SEQ ID NO: 6246653 - DNA, 16 bp, Homo sapiens
gagggctagaacctgg

SEQ ID NO: 6246654 - DNA, 18 bp, Homo sapiens
gagggctagaacctggag

SEQ ID NO: 6246655 - DNA, 18 bp, Homo sapiens
gagggctagccctgagcc

SEQ ID NO: 6246656 - DNA, 21 bp, Homo sapiens
gagggctagccctgagcccgg

SEQ ID NO: 6246657 - DNA, 12 bp, Homo sapiens
gagggctccaga

SEQ ID NO: 6246658 - DNA, 15 bp, Homo sapiens
gagggctccagacac

SEQ ID NO: 6246659 - DNA, 22 bp, Homo sapiens
gagggctccctatgttgcccag

SEQ ID NO: 6246660 - DNA, 16 bp, Homo sapiens
gagggctccctgctcc

SEQ ID NO: 6246661 - DNA, 14 bp, Homo sapiens
gagggctcctgggg

SEQ ID NO: 6246662 - DNA, 13 bp, Homo sapiens
gagggctgaaccc

SEQ ID NO: 6246663 - DNA, 18 bp, Homo sapiens
gagggctgaacccccact

SEQ ID NO: 6246664 - DNA, 15 bp, Homo sapiens
gagggctgagagggc

SEQ ID NO: 6246665 - DNA, 21 bp, Homo sapiens
gagggctgagagggctgtggc

SEQ ID NO: 6246666 - DNA, 16 bp, Homo sapiens
gagggctgaggagcag

SEQ ID NO: 6246667 - DNA, 17 bp, Homo sapiens
gagggctgaggagcagc

SEQ ID NO: 6246668 - DNA, 19 bp, Homo sapiens
gagggctgagtttgcacag

SEQ ID NO: 6246669 - DNA, 22 bp, Homo sapiens
gagggctgatggaggaaaaagg

SEQ ID NO: 6246670 - DNA, 12 bp, Homo sapiens
gagggctgcagt

SEQ ID NO: 6246671 - DNA, 16 bp, Homo sapiens
gagggctggaggccca

SEQ ID NO: 6246672 - DNA, 17 bp, Homo sapiens
gagggctggaggcccag

SEQ ID NO: 6246673 - DNA, 12 bp, Homo sapiens
gagggctggccg

SEQ ID NO: 6246674 - DNA, 23 bp, Homo sapiens
gagggctggccgggactgctgct

SEQ ID NO: 6246675 - DNA, 18 bp, Homo sapiens
gagggctggctggcctca

SEQ ID NO: 6246676 - DNA, 13 bp, Homo sapiens
gagggctgggcag

SEQ ID NO: 6246677 - DNA, 14 bp, Homo sapiens
gagggctgggcagc

SEQ ID NO: 6246678 - DNA, 19 bp, Homo sapiens
gagggctgggcagggccct

SEQ ID NO: 6246679 - DNA, 20 bp, Homo sapiens
gagggctgggcagggccctg

SEQ ID NO: 6246680 - DNA, 19 bp, Homo sapiens
gagggcttcctctagaagc

SEQ ID NO: 6246681 - DNA, 16 bp, Homo sapiens
gagggcttggggctgc

SEQ ID NO: 6246682 - DNA, 14 bp, Homo sapiens
gaggggaaaaaaac

SEQ ID NO: 6246683 - DNA, 16 bp, Homo sapiens
gaggggaaacaatgaa

SEQ ID NO: 6246684 - DNA, 19 bp, Homo sapiens
gaggggaaacaatgaaaac

SEQ ID NO: 6246685 - DNA, 16 bp, Homo sapiens
gaggggaaatggggaa

SEQ ID NO: 6246686 - DNA, 18 bp, Homo sapiens
gaggggaaatggggaaag

SEQ ID NO: 6246687 - DNA, 13 bp, Homo sapiens
gaggggaaatgta

SEQ ID NO: 6246688 - DNA, 22 bp, Homo sapiens
gaggggaaatgtaatactggaa

SEQ ID NO: 6246689 - DNA, 16 bp, Homo sapiens
gaggggaacactgccc

SEQ ID NO: 6246690 - DNA, 18 bp, Homo sapiens
gaggggaactgagtcacg

SEQ ID NO: 6246691 - DNA, 15 bp, Homo sapiens
gaggggaagaaaaac

SEQ ID NO: 6246692 - DNA, 20 bp, Homo sapiens
gaggggaagaatttaatgga

SEQ ID NO: 6246693 - DNA, 13 bp, Homo sapiens
gaggggaagagag

SEQ ID NO: 6246694 - DNA, 16 bp, Homo sapiens
gaggggaagcttctgt

SEQ ID NO: 6246695 - DNA, 16 bp, Homo sapiens
gaggggaaggggccgg

SEQ ID NO: 6246696 - DNA, 14 bp, Homo sapiens
gaggggaatgaggg

SEQ ID NO: 6246697 - DNA, 18 bp, Homo sapiens
gaggggaatgagggctga

SEQ ID NO: 6246698 - DNA, 11 bp, Homo sapiens
gaggggacaga

SEQ ID NO: 6246699 - DNA, 13 bp, Homo sapiens
gaggggacagagc

SEQ ID NO: 6246700 - DNA, 17 bp, Homo sapiens
gaggggacagaggccct

SEQ ID NO: 6246701 - DNA, 22 bp, Homo sapiens
gaggggacatttccctcctggg

SEQ ID NO: 6246702 - DNA, 12 bp, Homo sapiens
gaggggaccagg

SEQ ID NO: 6246703 - DNA, 11 bp, Homo sapiens
gaggggaccca

SEQ ID NO: 6246704 - DNA, 13 bp, Homo sapiens
gaggggacccagc

SEQ ID NO: 6246705 - DNA, 15 bp, Homo sapiens
gaggggacccagctc

SEQ ID NO: 6246706 - DNA, 22 bp, Homo sapiens
gaggggacccagctcctctgag

SEQ ID NO: 6246707 - DNA, 23 bp, Homo sapiens
gaggggacccagctcctctgagc

SEQ ID NO: 6246708 - DNA, 16 bp, Homo sapiens
gaggggacccatgggg

SEQ ID NO: 6246709 - DNA, 17 bp, Homo sapiens
gaggggacgggacagac

SEQ ID NO: 6246710 - DNA, 16 bp, Homo sapiens
gaggggacgggcaagt

SEQ ID NO: 6246711 - DNA, 12 bp, Homo sapiens
gaggggactctg

SEQ ID NO: 6246712 - DNA, 13 bp, Homo sapiens
gaggggactctgg

SEQ ID NO: 6246713 - DNA, 15 bp, Homo sapiens
gaggggactctgggc

SEQ ID NO: 6246714 - DNA, 19 bp, Homo sapiens
gaggggactctgggctatg

SEQ ID NO: 6246715 - DNA, 23 bp, Homo sapiens
gaggggactctgggctatggaca

SEQ ID NO: 6246716 - DNA, 19 bp, Homo sapiens
gaggggactgcatgcaagc

SEQ ID NO: 6246717 - DNA, 21 bp, Homo sapiens
gaggggactgcatgcaagctc

SEQ ID NO: 6246718 - DNA, 21 bp, Homo sapiens
gccccaggcttccgcgcccag

SEQ ID NO: 6246719 - DNA, 22 bp, Homo sapiens
gccccaggcttccgcgcccagc

SEQ ID NO: 6246720 - DNA, 17 bp, Homo sapiens
gccccagggacagaggc

SEQ ID NO: 6246721 - DNA, 23 bp, Homo sapiens
gccccagggacagaggccaagga

SEQ ID NO: 6246722 - DNA, 23 bp, Homo sapiens
gccccagggacgtgataatgcag

SEQ ID NO: 6246723 - DNA, 13 bp, Homo sapiens
gccccagggcacc

SEQ ID NO: 6246724 - DNA, 15 bp, Homo sapiens
gccccagggcaccct

SEQ ID NO: 6246725 - DNA, 17 bp, Homo sapiens
gccccagggccctgctc

SEQ ID NO: 6246726 - DNA, 19 bp, Homo sapiens
gccccagggccctgctcag

SEQ ID NO: 6246727 - DNA, 21 bp, Homo sapiens
gccccagggccctgctcaggc

SEQ ID NO: 6246728 - DNA, 12 bp, Homo sapiens
gccccagggcct

SEQ ID NO: 6246729 - DNA, 15 bp, Homo sapiens
gccccaggggggcct

SEQ ID NO: 6246730 - DNA, 19 bp, Homo sapiens
gccccaggggtgcctgtgg

SEQ ID NO: 6246731 - DNA, 21 bp, Homo sapiens
gccccagggtcttccctacct

SEQ ID NO: 6246732 - DNA, 12 bp, Homo sapiens
gccccagggtga

SEQ ID NO: 6246733 - DNA, 23 bp, Homo sapiens
gccccaggtacacctccccctgc

SEQ ID NO: 6246734 - DNA, 16 bp, Homo sapiens
gccccaggtagaaact

SEQ ID NO: 6246735 - DNA, 13 bp, Homo sapiens
gccccaggtgcca

SEQ ID NO: 6246736 - DNA, 15 bp, Homo sapiens
gccccaggtgccacc

SEQ ID NO: 6246737 - DNA, 22 bp, Homo sapiens
gccccagtagtcagaagcaggt

SEQ ID NO: 6246738 - DNA, 14 bp, Homo sapiens
gccccagtcagcct

SEQ ID NO: 6246739 - DNA, 17 bp, Homo sapiens
gccccagtcagcctctc

SEQ ID NO: 6246740 - DNA, 18 bp, Homo sapiens
gccccagtcagcctctct

SEQ ID NO: 6246741 - DNA, 23 bp, Homo sapiens
gccccagtcagcctctctcccag

SEQ ID NO: 6246742 - DNA, 22 bp, Homo sapiens
gccccagtcagcctggctgggc

SEQ ID NO: 6246743 - DNA, 20 bp, Homo sapiens
gccccagtcgaactgggggc

SEQ ID NO: 6246744 - DNA, 14 bp, Homo sapiens
gccccagtgacagc

SEQ ID NO: 6246745 - DNA, 13 bp, Homo sapiens
gccccagtgccca

SEQ ID NO: 6246746 - DNA, 14 bp, Homo sapiens
gccccagtgcccac

SEQ ID NO: 6246747 - DNA, 15 bp, Homo sapiens
gccccagtgcccaca

SEQ ID NO: 6246748 - DNA, 21 bp, Homo sapiens
gccccagtgcccacaggatca

SEQ ID NO: 6246749 - DNA, 19 bp, Homo sapiens
gccccagtgcggttcctca

SEQ ID NO: 6246750 - DNA, 12 bp, Homo sapiens
gccccagtgctg

SEQ ID NO: 6246751 - DNA, 18 bp, Homo sapiens
gccccagtggcactgaag

SEQ ID NO: 6246752 - DNA, 13 bp, Homo sapiens
gccccagtggtgc

SEQ ID NO: 6246753 - DNA, 15 bp, Homo sapiens
gccccagtggtgcgg

SEQ ID NO: 6246754 - DNA, 20 bp, Homo sapiens
gccccagtggtgcgggccag

SEQ ID NO: 6246755 - DNA, 15 bp, Homo sapiens
gccccagtttggggt

SEQ ID NO: 6246756 - DNA, 21 bp, Homo sapiens
gccccataattttttttttcc

SEQ ID NO: 6246757 - DNA, 16 bp, Homo sapiens
gccccatcagctccag

SEQ ID NO: 6246758 - DNA, 17 bp, Homo sapiens
gccccatcattgcacct

SEQ ID NO: 6246759 - DNA, 22 bp, Homo sapiens
gccccatcattgcacctgcagg

SEQ ID NO: 6246760 - DNA, 23 bp, Homo sapiens
gccccatcattgcacctgcaggc

SEQ ID NO: 6246761 - DNA, 23 bp, Homo sapiens
gccccatccaccgccagcttccc

SEQ ID NO: 6246762 - DNA, 19 bp, Homo sapiens
gccccatccagacctggct

SEQ ID NO: 6246763 - DNA, 20 bp, Homo sapiens
gccccatccagacctggctc

SEQ ID NO: 6246764 - DNA, 18 bp, Homo sapiens
gccccatcccaaaccctt

SEQ ID NO: 6246765 - DNA, 14 bp, Homo sapiens
gccccatccctgct

SEQ ID NO: 6246766 - DNA, 18 bp, Homo sapiens
gccccatcctcatccctg

SEQ ID NO: 6246767 - DNA, 22 bp, Homo sapiens
gccccatcctctgtacagagcc

SEQ ID NO: 6246768 - DNA, 16 bp, Homo sapiens
gccccatcctggccca

SEQ ID NO: 6246769 - DNA, 13 bp, Homo sapiens
gccccatcctggg

SEQ ID NO: 6246770 - DNA, 16 bp, Homo sapiens
gccccatcctgggcct

SEQ ID NO: 6246771 - DNA, 17 bp, Homo sapiens
gccccatcctgggcctt

SEQ ID NO: 6246772 - DNA, 13 bp, Homo sapiens
gccccatccttcc

SEQ ID NO: 6246773 - DNA, 22 bp, Homo sapiens
gccccatccttcccgcagcacc

SEQ ID NO: 6246774 - DNA, 23 bp, Homo sapiens
gccccatccttcccgcagcacca

SEQ ID NO: 6246775 - DNA, 23 bp, Homo sapiens
gccccatcgcctgggacgcccct

SEQ ID NO: 6246776 - DNA, 19 bp, Homo sapiens
gccccatcggtcaccttgt

SEQ ID NO: 6246777 - DNA, 14 bp, Homo sapiens
gccccatctcatcc

SEQ ID NO: 6246778 - DNA, 20 bp, Homo sapiens
gccccatctcatcctggcac

SEQ ID NO: 6246779 - DNA, 17 bp, Homo sapiens
gccccatctcccctcag

SEQ ID NO: 6246780 - DNA, 20 bp, Homo sapiens
gccccatctggatgtaaatc

SEQ ID NO: 6246781 - DNA, 15 bp, Homo sapiens
gccccatcttcaccc

SEQ ID NO: 6246782 - DNA, 16 bp, Homo sapiens
gccccatcttcaccca

SEQ ID NO: 6246783 - DNA, 21 bp, Homo sapiens
gccccatcttggtcctgtcac

SEQ ID NO: 6246784 - DNA, 14 bp, Homo sapiens
gccccatgacctcc

SEQ ID NO: 6246785 - DNA, 17 bp, Homo sapiens
gccccatgataaaataa

SEQ ID NO: 6246786 - DNA, 15 bp, Homo sapiens
gccccatgctctgcc

SEQ ID NO: 6246787 - DNA, 20 bp, Homo sapiens
gccccatgctctgccccaag

SEQ ID NO: 6246788 - DNA, 22 bp, Homo sapiens
gccccatgctggagcctgtgta

SEQ ID NO: 6246789 - DNA, 23 bp, Homo sapiens
gccccatgctggagcctgtgtaa

SEQ ID NO: 6246790 - DNA, 18 bp, Homo sapiens
gccccatggcagctcctg

SEQ ID NO: 6246791 - DNA, 17 bp, Homo sapiens
gccccatgggccctcag

SEQ ID NO: 6246792 - DNA, 17 bp, Homo sapiens
gccccatggtcacagac

SEQ ID NO: 6246793 - DNA, 22 bp, Homo sapiens
gccccatggtcacagacccctg

SEQ ID NO: 6246794 - DNA, 16 bp, Homo sapiens
gccccatgtctctcag

SEQ ID NO: 6246795 - DNA, 18 bp, Homo sapiens
gccccatgtctctcagaa

SEQ ID NO: 6246796 - DNA, 15 bp, Homo sapiens
gccccatgtgccttg

SEQ ID NO: 6246797 - DNA, 22 bp, Homo sapiens
gccccatgtgccttgtccagga

SEQ ID NO: 6246798 - DNA, 18 bp, Homo sapiens
gccccattcacggcctgg

SEQ ID NO: 6246799 - DNA, 19 bp, Homo sapiens
gccccattcacggcctggc

SEQ ID NO: 6246800 - DNA, 21 bp, Homo sapiens
gccccattcacggcctggcat

SEQ ID NO: 6246801 - DNA, 21 bp, Homo sapiens
gccccattcagaactctcaga

SEQ ID NO: 6246802 - DNA, 23 bp, Homo sapiens
gccccattcagaactctcagact

SEQ ID NO: 6246803 - DNA, 15 bp, Homo sapiens
gccccattccagctc

SEQ ID NO: 6246804 - DNA, 12 bp, Homo sapiens
gccccattcctg

SEQ ID NO: 6246805 - DNA, 15 bp, Homo sapiens
gccccattcctggga

SEQ ID NO: 6246806 - DNA, 21 bp, Homo sapiens
gccccattccttgcgcctcag

SEQ ID NO: 6246807 - DNA, 21 bp, Homo sapiens
gccccattctccctccatggc

SEQ ID NO: 6246808 - DNA, 15 bp, Homo sapiens
gccccattctgcctg

SEQ ID NO: 6246809 - DNA, 18 bp, Homo sapiens
gccccattctgcctgccc

SEQ ID NO: 6246810 - DNA, 22 bp, Homo sapiens
gccccattctgcctgcccaggc

SEQ ID NO: 6246811 - DNA, 23 bp, Homo sapiens
gccccattctgcctgcccaggcc

SEQ ID NO: 6246812 - DNA, 20 bp, Homo sapiens
gccccattgagatcttcctg

SEQ ID NO: 6246813 - DNA, 20 bp, Homo sapiens
gccccatttatccacctcca

SEQ ID NO: 6246814 - DNA, 17 bp, Homo sapiens
gccccattttctttaca

SEQ ID NO: 6246815 - DNA, 20 bp, Homo sapiens
gcccccaaagagctgtggct

SEQ ID NO: 6246816 - DNA, 19 bp, Homo sapiens
gcccccaaagcagcccttc

SEQ ID NO: 6246817 - DNA, 15 bp, Homo sapiens
gcccccaaataagaa

SEQ ID NO: 6246818 - DNA, 14 bp, Homo sapiens
gcccccaacacagg

SEQ ID NO: 6246819 - DNA, 16 bp, Homo sapiens
gcccccaacacaggca

SEQ ID NO: 6246820 - DNA, 18 bp, Homo sapiens
gcccccaacactccaggc

SEQ ID NO: 6246821 - DNA, 16 bp, Homo sapiens
gcccccaaccccaaga

SEQ ID NO: 6246822 - DNA, 17 bp, Homo sapiens
gcccccaaccccaagac

SEQ ID NO: 6246823 - DNA, 22 bp, Homo sapiens
gcccccaacccctcctccctca

SEQ ID NO: 6246824 - DNA, 23 bp, Homo sapiens
gcccccaacctcagggctcccag

SEQ ID NO: 6246825 - DNA, 23 bp, Homo sapiens
gcccccaactccgcccagcctct

SEQ ID NO: 6246826 - DNA, 12 bp, Homo sapiens
gcccccaagcct

SEQ ID NO: 6246827 - DNA, 13 bp, Homo sapiens
gcccccaagcctc

SEQ ID NO: 6246828 - DNA, 21 bp, Homo sapiens
gcccccaaggaggcagcctgg

SEQ ID NO: 6246829 - DNA, 13 bp, Homo sapiens
gcccccaataaac

SEQ ID NO: 6246830 - DNA, 14 bp, Homo sapiens
gcccccaataaacc

SEQ ID NO: 6246831 - DNA, 16 bp, Homo sapiens
gcccccaataaaccag

SEQ ID NO: 6246832 - DNA, 15 bp, Homo sapiens
gcccccaataaaggc

SEQ ID NO: 6246833 - DNA, 16 bp, Homo sapiens
gcccccaataaaggca

SEQ ID NO: 6246834 - DNA, 18 bp, Homo sapiens
gcccccaataaaggcagc

SEQ ID NO: 6246835 - DNA, 20 bp, Homo sapiens
gcccccaataaaggcagctg

SEQ ID NO: 6246836 - DNA, 22 bp, Homo sapiens
gcccccaataaaggcagctgcc

SEQ ID NO: 6246837 - DNA, 23 bp, Homo sapiens
gcccccaataaaggcagctgcct

SEQ ID NO: 6246838 - DNA, 24 bp, Homo sapiens
gcccccaataaaggcagctgcctc

SEQ ID NO: 6246839 - DNA, 11 bp, Homo sapiens
gcccccacacc

SEQ ID NO: 6246840 - DNA, 13 bp, Homo sapiens
gcccccacagatc

SEQ ID NO: 6246841 - DNA, 15 bp, Homo sapiens
gcccccacagccctg

SEQ ID NO: 6246842 - DNA, 17 bp, Homo sapiens
gcccccacagccctgga

SEQ ID NO: 6246843 - DNA, 19 bp, Homo sapiens
gcccccacagccctggaat

SEQ ID NO: 6246844 - DNA, 16 bp, Homo sapiens
gcccccacagcgctcg

SEQ ID NO: 6246845 - DNA, 11 bp, Homo sapiens
gcccccacagg

SEQ ID NO: 6246846 - DNA, 14 bp, Homo sapiens
gcccccacaggagc

SEQ ID NO: 6246847 - DNA, 21 bp, Homo sapiens
gcccccacaggagcatgtcct

SEQ ID NO: 6246848 - DNA, 13 bp, Homo sapiens
gcccccacaggcc

SEQ ID NO: 6246849 - DNA, 15 bp, Homo sapiens
gcccccacagtgctg

SEQ ID NO: 6246850 - DNA, 22 bp, Homo sapiens
gcccccacatttgtgccgacac

SEQ ID NO: 6246851 - DNA, 17 bp, Homo sapiens
gcccccaccacacatcc

SEQ ID NO: 6246852 - DNA, 16 bp, Homo sapiens
gcccccaccagcagca

SEQ ID NO: 6246853 - DNA, 16 bp, Homo sapiens
gcccccacccaccttc

SEQ ID NO: 6246854 - DNA, 20 bp, Homo sapiens
gcccccacccatgccagcgc

SEQ ID NO: 6246855 - DNA, 11 bp, Homo sapiens
gcccccacccc

SEQ ID NO: 6246856 - DNA, 13 bp, Homo sapiens
gcccccaccccag

SEQ ID NO: 6246857 - DNA, 14 bp, Homo sapiens
gcccccaccccagg

SEQ ID NO: 6246858 - DNA, 17 bp, Homo sapiens
gcccccaccccaggctg

SEQ ID NO: 6246859 - DNA, 18 bp, Homo sapiens
gcccccaccccaggctgg

SEQ ID NO: 6246860 - DNA, 19 bp, Homo sapiens
gcccccacccccaccctcg

SEQ ID NO: 6246861 - DNA, 20 bp, Homo sapiens
gcccccacccccgtcacccc

SEQ ID NO: 6246862 - DNA, 16 bp, Homo sapiens
gcccccacccctacag

SEQ ID NO: 6246863 - DNA, 20 bp, Homo sapiens
gcccccacccctacagcctg

SEQ ID NO: 6246864 - DNA, 18 bp, Homo sapiens
gcccccacccctggctac

SEQ ID NO: 6246865 - DNA, 16 bp, Homo sapiens
gcccccaccccttccc

SEQ ID NO: 6246866 - DNA, 22 bp, Homo sapiens
gcccccaccccttcctgtctca

SEQ ID NO: 6246867 - DNA, 12 bp, Homo sapiens
gcccccaccctg

SEQ ID NO: 6246868 - DNA, 13 bp, Homo sapiens
gcccccacccttg

SEQ ID NO: 6246869 - DNA, 18 bp, Homo sapiens
gcccccaccgggctgcag

SEQ ID NO: 6246870 - DNA, 13 bp, Homo sapiens
gcccccacctcca

SEQ ID NO: 6246871 - DNA, 14 bp, Homo sapiens
gcccccacctccac

SEQ ID NO: 6246872 - DNA, 16 bp, Homo sapiens
gcccccacctccaccc

SEQ ID NO: 6246873 - DNA, 18 bp, Homo sapiens
gcccccacctccaccctc

SEQ ID NO: 6246874 - DNA, 14 bp, Homo sapiens
gcccccacctctgg

SEQ ID NO: 6246875 - DNA, 16 bp, Homo sapiens
gcccccacctgcctga

SEQ ID NO: 6246876 - DNA, 12 bp, Homo sapiens
gcccccactgac

SEQ ID NO: 6246877 - DNA, 24 bp, Homo sapiens
gcccccactgacctgcccatgtcc

SEQ ID NO: 6246878 - DNA, 12 bp, Homo sapiens
gcccccactgga

SEQ ID NO: 6246879 - DNA, 16 bp, Homo sapiens
gcccccacttctctcc

SEQ ID NO: 6246880 - DNA, 21 bp, Homo sapiens
gcccccacttgcctcttcctt

SEQ ID NO: 6246881 - DNA, 18 bp, Homo sapiens
gcccccagaaagcctcct

SEQ ID NO: 6246882 - DNA, 21 bp, Homo sapiens
gcccccagaaagcctcctgcc

SEQ ID NO: 6246883 - DNA, 12 bp, Homo sapiens
gcccccagacgc

SEQ ID NO: 6246884 - DNA, 11 bp, Homo sapiens
gcccccagagc

SEQ ID NO: 6246885 - DNA, 15 bp, Homo sapiens
gcccccagagccaca

SEQ ID NO: 6246886 - DNA, 16 bp, Homo sapiens
gcccccagagcccagg

SEQ ID NO: 6246887 - DNA, 18 bp, Homo sapiens
gcccccagagcccaggct

SEQ ID NO: 6246888 - DNA, 22 bp, Homo sapiens
gcccccagagtgtagggggcct

SEQ ID NO: 6246889 - DNA, 12 bp, Homo sapiens
gcccccagcacc

SEQ ID NO: 6246890 - DNA, 13 bp, Homo sapiens
gcccccagcaccc

SEQ ID NO: 6246891 - DNA, 13 bp, Homo sapiens
gcccccagcccaa

SEQ ID NO: 6246892 - DNA, 16 bp, Homo sapiens
gcccccagccctggga

SEQ ID NO: 6246893 - DNA, 17 bp, Homo sapiens
gcccccagccctgggaa

SEQ ID NO: 6246894 - DNA, 13 bp, Homo sapiens
gcccccagcctca

SEQ ID NO: 6246895 - DNA, 14 bp, Homo sapiens
gcccccagcctcag

SEQ ID NO: 6246896 - DNA, 16 bp, Homo sapiens
gcccccagcctcagcc

SEQ ID NO: 6246897 - DNA, 13 bp, Homo sapiens
gaggggagaagcc

SEQ ID NO: 6246898 - DNA, 17 bp, Homo sapiens
gaggggagagaaggtgg

SEQ ID NO: 6246899 - DNA, 21 bp, Homo sapiens
gaggggagagggacgcacagc

SEQ ID NO: 6246900 - DNA, 16 bp, Homo sapiens
gaggggagaggtcagc

SEQ ID NO: 6246901 - DNA, 15 bp, Homo sapiens
gaggggaggaacagg

SEQ ID NO: 6246902 - DNA, 14 bp, Homo sapiens
gaggggatatttag

SEQ ID NO: 6246903 - DNA, 15 bp, Homo sapiens
gaggggatccagcca

SEQ ID NO: 6246904 - DNA, 16 bp, Homo sapiens
gaggggcaagctaggc

SEQ ID NO: 6246905 - DNA, 15 bp, Homo sapiens
gaggggcacctgcca

SEQ ID NO: 6246906 - DNA, 16 bp, Homo sapiens
gaggggcagcccttgc

SEQ ID NO: 6246907 - DNA, 19 bp, Homo sapiens
gaggggcagcgcatgtgtg

SEQ ID NO: 6246908 - DNA, 21 bp, Homo sapiens
gaggggcagcgcatgtgtgca

SEQ ID NO: 6246909 - DNA, 23 bp, Homo sapiens
gaggggcagcgcatgtgtgcatg

SEQ ID NO: 6246910 - DNA, 15 bp, Homo sapiens
gaggggcaggacctg

SEQ ID NO: 6246911 - DNA, 13 bp, Homo sapiens
gaggggcaggccc

SEQ ID NO: 6246912 - DNA, 14 bp, Homo sapiens
gaggggcaggctga

SEQ ID NO: 6246913 - DNA, 14 bp, Homo sapiens
gaggggcagggaga

SEQ ID NO: 6246914 - DNA, 15 bp, Homo sapiens
gaggggcaggtaaac

SEQ ID NO: 6246915 - DNA, 20 bp, Homo sapiens
gaggggccaccccgtgcccc

SEQ ID NO: 6246916 - DNA, 22 bp, Homo sapiens
gaggggccaccccgtgcccctg

SEQ ID NO: 6246917 - DNA, 23 bp, Homo sapiens
gaggggccactgacccacctgcg

SEQ ID NO: 6246918 - DNA, 20 bp, Homo sapiens
gaggggccactgggccccat

SEQ ID NO: 6246919 - DNA, 17 bp, Homo sapiens
gaggggccagcagaggg

SEQ ID NO: 6246920 - DNA, 21 bp, Homo sapiens
gaggggccagcggccctccca

SEQ ID NO: 6246921 - DNA, 23 bp, Homo sapiens
gaggggccagcggccctcccagg

SEQ ID NO: 6246922 - DNA, 12 bp, Homo sapiens
gaggggccaggc

SEQ ID NO: 6246923 - DNA, 13 bp, Homo sapiens
gaggggccaggcc

SEQ ID NO: 6246924 - DNA, 14 bp, Homo sapiens
gaggggccaggccc

SEQ ID NO: 6246925 - DNA, 16 bp, Homo sapiens
gaggggccaggcccag

SEQ ID NO: 6246926 - DNA, 22 bp, Homo sapiens
gaggggccccagcgtctgcagg

SEQ ID NO: 6246927 - DNA, 20 bp, Homo sapiens
gaggggcccctggcccagga

SEQ ID NO: 6246928 - DNA, 13 bp, Homo sapiens
gaggggcccgagc

SEQ ID NO: 6246929 - DNA, 23 bp, Homo sapiens
gaggggcccggtggcggcagggc

SEQ ID NO: 6246930 - DNA, 14 bp, Homo sapiens
gaggggccctcagg

SEQ ID NO: 6246931 - DNA, 16 bp, Homo sapiens
gaggggccctcaggcc

SEQ ID NO: 6246932 - DNA, 20 bp, Homo sapiens
gaggggccctccatgcgcag

SEQ ID NO: 6246933 - DNA, 23 bp, Homo sapiens
gaggggccctccatgcgcagatg

SEQ ID NO: 6246934 - DNA, 23 bp, Homo sapiens
gaggggcctaggcctcagccaga

SEQ ID NO: 6246935 - DNA, 13 bp, Homo sapiens
gaggggcctaggg

SEQ ID NO: 6246936 - DNA, 14 bp, Homo sapiens
gaggggcctcaggt

SEQ ID NO: 6246937 - DNA, 23 bp, Homo sapiens
gaggggcctcatcttccccagcc

SEQ ID NO: 6246938 - DNA, 22 bp, Homo sapiens
gaggggcctcccccagcacaga

SEQ ID NO: 6246939 - DNA, 22 bp, Homo sapiens
gaggggcctgatgagactccac

SEQ ID NO: 6246940 - DNA, 14 bp, Homo sapiens
gaggggcctgccac

SEQ ID NO: 6246941 - DNA, 19 bp, Homo sapiens
gaggggcctgccacctgga

SEQ ID NO: 6246942 - DNA, 22 bp, Homo sapiens
gaggggcctgccactctcctga

SEQ ID NO: 6246943 - DNA, 23 bp, Homo sapiens
gaggggcctgccactctcctgag

SEQ ID NO: 6246944 - DNA, 21 bp, Homo sapiens
gaggggcctgcgcccagagct

SEQ ID NO: 6246945 - DNA, 13 bp, Homo sapiens
gaggggcctggca

SEQ ID NO: 6246946 - DNA, 15 bp, Homo sapiens
gaggggcctgggcag

SEQ ID NO: 6246947 - DNA, 20 bp, Homo sapiens
gaggggcctgggcagcccca

SEQ ID NO: 6246948 - DNA, 22 bp, Homo sapiens
gaggggcgcaccccacagctgg

SEQ ID NO: 6246949 - DNA, 18 bp, Homo sapiens
gaggggcgctgcccccac

SEQ ID NO: 6246950 - DNA, 15 bp, Homo sapiens
gaggggcgctggccc

SEQ ID NO: 6246951 - DNA, 21 bp, Homo sapiens
gaggggcggcaggagggaggt

SEQ ID NO: 6246952 - DNA, 15 bp, Homo sapiens
gaggggcgggctcag

SEQ ID NO: 6246953 - DNA, 12 bp, Homo sapiens
gaggggctcctg

SEQ ID NO: 6246954 - DNA, 23 bp, Homo sapiens
gaggggctctcagctcagcgcca

SEQ ID NO: 6246955 - DNA, 13 bp, Homo sapiens
gaggggctgaatg

SEQ ID NO: 6246956 - DNA, 22 bp, Homo sapiens
gaggggctgctccagtgggcag

SEQ ID NO: 6246957 - DNA, 14 bp, Homo sapiens
gaggggctgggctg

SEQ ID NO: 6246958 - DNA, 16 bp, Homo sapiens
gaggggctgggctggg

SEQ ID NO: 6246959 - DNA, 12 bp, Homo sapiens
gaggggctgggg

SEQ ID NO: 6246960 - DNA, 23 bp, Homo sapiens
gaggggctggggacttgtgtctg

SEQ ID NO: 6246961 - DNA, 20 bp, Homo sapiens
gaggggctggggcaggctct

SEQ ID NO: 6246962 - DNA, 22 bp, Homo sapiens
gaggggctggggcaggctctct

SEQ ID NO: 6246963 - DNA, 11 bp, Homo sapiens
gaggggctgtc

SEQ ID NO: 6246964 - DNA, 23 bp, Homo sapiens
gaggggctgtcctccttcctggg

SEQ ID NO: 6246965 - DNA, 17 bp, Homo sapiens
gaggggctttctggaga

SEQ ID NO: 6246966 - DNA, 12 bp, Homo sapiens
gagggggaagca

SEQ ID NO: 6246967 - DNA, 15 bp, Homo sapiens
gagggggaagtgaga

SEQ ID NO: 6246968 - DNA, 15 bp, Homo sapiens
gagggggacctgtcc

SEQ ID NO: 6246969 - DNA, 14 bp, Homo sapiens
gagggggactgctg

SEQ ID NO: 6246970 - DNA, 20 bp, Homo sapiens
gagggggactgctgctgcct

SEQ ID NO: 6246971 - DNA, 19 bp, Homo sapiens
gagggggagaatgagaagg

SEQ ID NO: 6246972 - DNA, 14 bp, Homo sapiens
gagggggagacccc

SEQ ID NO: 6246973 - DNA, 16 bp, Homo sapiens
gagggggaggggagaa

SEQ ID NO: 6246974 - DNA, 14 bp, Homo sapiens
gagggggaggtgaa

SEQ ID NO: 6246975 - DNA, 14 bp, Homo sapiens
gagggggagtagcc

SEQ ID NO: 6246976 - DNA, 15 bp, Homo sapiens
gagggggagtagcca

SEQ ID NO: 6246977 - DNA, 22 bp, Homo sapiens
gagggggatgcccctggccctg

SEQ ID NO: 6246978 - DNA, 16 bp, Homo sapiens
gagggggcacggcagg

SEQ ID NO: 6246979 - DNA, 22 bp, Homo sapiens
gagggggcactgtggtcaggcc

SEQ ID NO: 6246980 - DNA, 22 bp, Homo sapiens
gagggggccacctccccaggcc

SEQ ID NO: 6246981 - DNA, 16 bp, Homo sapiens
gagggggccagaggga

SEQ ID NO: 6246982 - DNA, 17 bp, Homo sapiens
gagggggcccggctggg

SEQ ID NO: 6246983 - DNA, 23 bp, Homo sapiens
gagggggccggggggaggggaca

SEQ ID NO: 6246984 - DNA, 15 bp, Homo sapiens
gagggggcctcattg

SEQ ID NO: 6246985 - DNA, 16 bp, Homo sapiens
gagggggcgctcagga

SEQ ID NO: 6246986 - DNA, 20 bp, Homo sapiens
gagggggcgctcaggaccca

SEQ ID NO: 6246987 - DNA, 23 bp, Homo sapiens
gagggggcggcagggctgggcct

SEQ ID NO: 6246988 - DNA, 21 bp, Homo sapiens
gagggggcggtaggggctgca

SEQ ID NO: 6246989 - DNA, 20 bp, Homo sapiens
gagggggctccatggaggag

SEQ ID NO: 6246990 - DNA, 14 bp, Homo sapiens
gagggggctctgcc

SEQ ID NO: 6246991 - DNA, 14 bp, Homo sapiens
gagggggctggcca

SEQ ID NO: 6246992 - DNA, 21 bp, Homo sapiens
gagggggcttgaagccaaaga

SEQ ID NO: 6246993 - DNA, 15 bp, Homo sapiens
gaggggggaggtggg

SEQ ID NO: 6246994 - DNA, 13 bp, Homo sapiens
gaggggggcggtg

SEQ ID NO: 6246995 - DNA, 13 bp, Homo sapiens
gaggggggtggga

SEQ ID NO: 6246996 - DNA, 20 bp, Homo sapiens
gagggggtcagttgggcccc

SEQ ID NO: 6246997 - DNA, 15 bp, Homo sapiens
gagggggtgagaggc

SEQ ID NO: 6246998 - DNA, 18 bp, Homo sapiens
gagggggtgagaggcagg

SEQ ID NO: 6246999 - DNA, 13 bp, Homo sapiens
gagggggtggagg

SEQ ID NO: 6247000 - DNA, 15 bp, Homo sapiens
gagggggtggcctcc

SEQ ID NO: 6247001 - DNA, 17 bp, Homo sapiens
gagggggtgtctgcacc

SEQ ID NO: 6247002 - DNA, 18 bp, Homo sapiens
gagggggtgtctgcacct

SEQ ID NO: 6247003 - DNA, 15 bp, Homo sapiens
gagggggttacaaac

SEQ ID NO: 6247004 - DNA, 19 bp, Homo sapiens
gagggggttacaaactgca

SEQ ID NO: 6247005 - DNA, 22 bp, Homo sapiens
gagggggttcgcaccgtgctgg

SEQ ID NO: 6247006 - DNA, 18 bp, Homo sapiens
gaggggtaaatatatgtt

SEQ ID NO: 6247007 - DNA, 14 bp, Homo sapiens
gaggggtaggcaga

SEQ ID NO: 6247008 - DNA, 17 bp, Homo sapiens
gaggggtataggacaag

SEQ ID NO: 6247009 - DNA, 20 bp, Homo sapiens
gaggggtccctagcagccca

SEQ ID NO: 6247010 - DNA, 18 bp, Homo sapiens
gaggggtctagctggcca

SEQ ID NO: 6247011 - DNA, 12 bp, Homo sapiens
gaggggtctgcc

SEQ ID NO: 6247012 - DNA, 14 bp, Homo sapiens
gaggggtctgcctc

SEQ ID NO: 6247013 - DNA, 15 bp, Homo sapiens
gaggggtctgcctcc

SEQ ID NO: 6247014 - DNA, 20 bp, Homo sapiens
gaggggtgacagtggaggaa

SEQ ID NO: 6247015 - DNA, 23 bp, Homo sapiens
gaggggtgagacagtgggggtgc

SEQ ID NO: 6247016 - DNA, 21 bp, Homo sapiens
gaggggtgagagacctgctca

SEQ ID NO: 6247017 - DNA, 23 bp, Homo sapiens
gaggggtgagagacctgctcagg

SEQ ID NO: 6247018 - DNA, 20 bp, Homo sapiens
gaggggtgagtcccctactc

SEQ ID NO: 6247019 - DNA, 15 bp, Homo sapiens
gaggggtgcacccac

SEQ ID NO: 6247020 - DNA, 19 bp, Homo sapiens
gaggggtgcggcggtccca

SEQ ID NO: 6247021 - DNA, 13 bp, Homo sapiens
gaggggtggccca

SEQ ID NO: 6247022 - DNA, 15 bp, Homo sapiens
gaggggtggcccaga

SEQ ID NO: 6247023 - DNA, 13 bp, Homo sapiens
gaggggtggggag

SEQ ID NO: 6247024 - DNA, 15 bp, Homo sapiens
gaggggtgtccgaga

SEQ ID NO: 6247025 - DNA, 15 bp, Homo sapiens
gaggggtgtgggcac

SEQ ID NO: 6247026 - DNA, 22 bp, Homo sapiens
gaggggttcctcccctccagct

SEQ ID NO: 6247027 - DNA, 23 bp, Homo sapiens
gaggggttcctcccctccagctc

SEQ ID NO: 6247028 - DNA, 18 bp, Homo sapiens
gaggggttgccacaggcc

SEQ ID NO: 6247029 - DNA, 23 bp, Homo sapiens
gaggggttgccacaggcctccct

SEQ ID NO: 6247030 - DNA, 18 bp, Homo sapiens
gaggggttgcgggggagc

SEQ ID NO: 6247031 - DNA, 18 bp, Homo sapiens
gaggggttggtgggaggg

SEQ ID NO: 6247032 - DNA, 15 bp, Homo sapiens
gagggtaaataaacc

SEQ ID NO: 6247033 - DNA, 22 bp, Homo sapiens
gagggtaacagaagaggaggga

SEQ ID NO: 6247034 - DNA, 16 bp, Homo sapiens
gagggtaactgggggg

SEQ ID NO: 6247035 - DNA, 13 bp, Homo sapiens
gagggtaaggctg

SEQ ID NO: 6247036 - DNA, 17 bp, Homo sapiens
gagggtactaggggccc

SEQ ID NO: 6247037 - DNA, 14 bp, Homo sapiens
gagggtagacaggg

SEQ ID NO: 6247038 - DNA, 15 bp, Homo sapiens
gagggtagccctggg

SEQ ID NO: 6247039 - DNA, 14 bp, Homo sapiens
gagggtaggcagga

SEQ ID NO: 6247040 - DNA, 15 bp, Homo sapiens
gagggtaggcaggat

SEQ ID NO: 6247041 - DNA, 16 bp, Homo sapiens
gagggtagggcagcag

SEQ ID NO: 6247042 - DNA, 17 bp, Homo sapiens
gagggtcaagggctggg

SEQ ID NO: 6247043 - DNA, 17 bp, Homo sapiens
gagggtcaccctggcct

SEQ ID NO: 6247044 - DNA, 13 bp, Homo sapiens
gagggtcaggaag

SEQ ID NO: 6247045 - DNA, 19 bp, Homo sapiens
gagggtcaggactgtgact

SEQ ID NO: 6247046 - DNA, 13 bp, Homo sapiens
gagggtcagggca

SEQ ID NO: 6247047 - DNA, 21 bp, Homo sapiens
gagggtcattttcctttctgt

SEQ ID NO: 6247048 - DNA, 23 bp, Homo sapiens
gagggtcattttcctttctgtat

SEQ ID NO: 6247049 - DNA, 20 bp, Homo sapiens
gagggtccaatcctaggaca

SEQ ID NO: 6247050 - DNA, 19 bp, Homo sapiens
gagggtcccaagctgggcc

SEQ ID NO: 6247051 - DNA, 20 bp, Homo sapiens
gagggtcccaagctgggccc

SEQ ID NO: 6247052 - DNA, 13 bp, Homo sapiens
gagggtccccggg

SEQ ID NO: 6247053 - DNA, 17 bp, Homo sapiens
gagggtccccgggagca

SEQ ID NO: 6247054 - DNA, 21 bp, Homo sapiens
gagggtccccgggagcacacg

SEQ ID NO: 6247055 - DNA, 14 bp, Homo sapiens
gagggtccctaggt

SEQ ID NO: 6247056 - DNA, 18 bp, Homo sapiens
gagggtcctgcagcctgc

SEQ ID NO: 6247057 - DNA, 17 bp, Homo sapiens
gagggtcctggctcctg

SEQ ID NO: 6247058 - DNA, 21 bp, Homo sapiens
gagggtcgccacacccggctc

SEQ ID NO: 6247059 - DNA, 15 bp, Homo sapiens
gagggtcggtgcctt

SEQ ID NO: 6247060 - DNA, 15 bp, Homo sapiens
gagggtctcccctcc

SEQ ID NO: 6247061 - DNA, 18 bp, Homo sapiens
gagggtctcccctcctgc

SEQ ID NO: 6247062 - DNA, 22 bp, Homo sapiens
gagggtctccctgggcaccctg

SEQ ID NO: 6247063 - DNA, 22 bp, Homo sapiens
gagggtctgggaaatgagcagg

SEQ ID NO: 6247064 - DNA, 17 bp, Homo sapiens
gagggtctgggggcaca

SEQ ID NO: 6247065 - DNA, 16 bp, Homo sapiens
gagggtctgggggcag

SEQ ID NO: 6247066 - DNA, 17 bp, Homo sapiens
gagggtctgggggcagc

SEQ ID NO: 6247067 - DNA, 20 bp, Homo sapiens
gagggtcttttaccctgtgt

SEQ ID NO: 6247068 - DNA, 20 bp, Homo sapiens
gagggtgaaggaggtcaggc

SEQ ID NO: 6247069 - DNA, 18 bp, Homo sapiens
gagggtgacagcttcctt

SEQ ID NO: 6247070 - DNA, 16 bp, Homo sapiens
gagggtgacccacagc

SEQ ID NO: 6247071 - DNA, 19 bp, Homo sapiens
gagggtgacccacagctct

SEQ ID NO: 6247072 - DNA, 22 bp, Homo sapiens
gagggtgacccacagctctggg

SEQ ID NO: 6247073 - DNA, 23 bp, Homo sapiens
gagggtgacccatttcaggaggt

SEQ ID NO: 6247074 - DNA, 23 bp, Homo sapiens
gagggtgacttttcctgctgcct

SEQ ID NO: 6247075 - DNA, 18 bp, Homo sapiens
gcccccagcctcagccca

SEQ ID NO: 6247076 - DNA, 19 bp, Homo sapiens
gcccccagcctcagcccaa

SEQ ID NO: 6247077 - DNA, 14 bp, Homo sapiens
gcccccagcctggc

SEQ ID NO: 6247078 - DNA, 18 bp, Homo sapiens
gcccccagcctggccaga

SEQ ID NO: 6247079 - DNA, 16 bp, Homo sapiens
gcccccagcctgtcag

SEQ ID NO: 6247080 - DNA, 22 bp, Homo sapiens
gcccccagcctgtcagatccag

SEQ ID NO: 6247081 - DNA, 12 bp, Homo sapiens
gcccccagctgg

SEQ ID NO: 6247082 - DNA, 15 bp, Homo sapiens
gcccccagctggccc

SEQ ID NO: 6247083 - DNA, 22 bp, Homo sapiens
gcccccagcttctctctccctg

SEQ ID NO: 6247084 - DNA, 21 bp, Homo sapiens
gcccccaggaacgctctcctc

SEQ ID NO: 6247085 - DNA, 13 bp, Homo sapiens
gcccccaggacaa

SEQ ID NO: 6247086 - DNA, 12 bp, Homo sapiens
gcccccaggact

SEQ ID NO: 6247087 - DNA, 16 bp, Homo sapiens
gcccccaggatctggg

SEQ ID NO: 6247088 - DNA, 19 bp, Homo sapiens
gcccccaggattcccccag

SEQ ID NO: 6247089 - DNA, 22 bp, Homo sapiens
gcccccaggattcccccagcca

SEQ ID NO: 6247090 - DNA, 12 bp, Homo sapiens
gcccccaggcag

SEQ ID NO: 6247091 - DNA, 14 bp, Homo sapiens
gcccccaggcagcc

SEQ ID NO: 6247092 - DNA, 17 bp, Homo sapiens
gcccccaggcagccacc

SEQ ID NO: 6247093 - DNA, 13 bp, Homo sapiens
gcccccaggccag

SEQ ID NO: 6247094 - DNA, 15 bp, Homo sapiens
gcccccaggccaggt

SEQ ID NO: 6247095 - DNA, 17 bp, Homo sapiens
gcccccaggcctgccct

SEQ ID NO: 6247096 - DNA, 18 bp, Homo sapiens
gcccccaggcctgccctg

SEQ ID NO: 6247097 - DNA, 17 bp, Homo sapiens
gcccccaggctgctgga

SEQ ID NO: 6247098 - DNA, 22 bp, Homo sapiens
gcccccagggcacttcacagag

SEQ ID NO: 6247099 - DNA, 15 bp, Homo sapiens
gcccccagggcctcc

SEQ ID NO: 6247100 - DNA, 18 bp, Homo sapiens
gcccccagggcctccagg

SEQ ID NO: 6247101 - DNA, 14 bp, Homo sapiens
gcccccaggggcag

SEQ ID NO: 6247102 - DNA, 16 bp, Homo sapiens
gcccccaggggcagga

SEQ ID NO: 6247103 - DNA, 19 bp, Homo sapiens
gcccccagggtcctgggag

SEQ ID NO: 6247104 - DNA, 14 bp, Homo sapiens
gcccccaggtaggg

SEQ ID NO: 6247105 - DNA, 18 bp, Homo sapiens
gcccccagtccccacccc

SEQ ID NO: 6247106 - DNA, 21 bp, Homo sapiens
gcccccagtccccacccctgc

SEQ ID NO: 6247107 - DNA, 13 bp, Homo sapiens
gcccccagtgcct

SEQ ID NO: 6247108 - DNA, 12 bp, Homo sapiens
gcccccagtggg

SEQ ID NO: 6247109 - DNA, 13 bp, Homo sapiens
gcccccagtgggg

SEQ ID NO: 6247110 - DNA, 19 bp, Homo sapiens
gcccccatcagccctgcta

SEQ ID NO: 6247111 - DNA, 19 bp, Homo sapiens
gcccccatcatcctctggc

SEQ ID NO: 6247112 - DNA, 18 bp, Homo sapiens
gcccccatctccccaggc

SEQ ID NO: 6247113 - DNA, 19 bp, Homo sapiens
gcccccatctccccaggcc

SEQ ID NO: 6247114 - DNA, 23 bp, Homo sapiens
gcccccatctccccaggcctcca

SEQ ID NO: 6247115 - DNA, 20 bp, Homo sapiens
gcccccatctgtcttcagca

SEQ ID NO: 6247116 - DNA, 14 bp, Homo sapiens
gcccccatcttggg

SEQ ID NO: 6247117 - DNA, 20 bp, Homo sapiens
gcccccatgcaggcagcctg

SEQ ID NO: 6247118 - DNA, 17 bp, Homo sapiens
gccccccacacttccct

SEQ ID NO: 6247119 - DNA, 20 bp, Homo sapiens
gccccccacacttccctggc

SEQ ID NO: 6247120 - DNA, 15 bp, Homo sapiens
gccccccaccccaca

SEQ ID NO: 6247121 - DNA, 18 bp, Homo sapiens
gccccccaccccacagat

SEQ ID NO: 6247122 - DNA, 14 bp, Homo sapiens
gccccccaccccag

SEQ ID NO: 6247123 - DNA, 16 bp, Homo sapiens
gccccccacctttctc

SEQ ID NO: 6247124 - DNA, 12 bp, Homo sapiens
gccccccactca

SEQ ID NO: 6247125 - DNA, 17 bp, Homo sapiens
gccccccactcagtagg

SEQ ID NO: 6247126 - DNA, 16 bp, Homo sapiens
gccccccactccccct

SEQ ID NO: 6247127 - DNA, 17 bp, Homo sapiens
gccccccagagccaggg

SEQ ID NO: 6247128 - DNA, 12 bp, Homo sapiens
gccccccagcac

SEQ ID NO: 6247129 - DNA, 13 bp, Homo sapiens
gccccccagctca

SEQ ID NO: 6247130 - DNA, 15 bp, Homo sapiens
gccccccagctcagg

SEQ ID NO: 6247131 - DNA, 13 bp, Homo sapiens
gccccccagctcc

SEQ ID NO: 6247132 - DNA, 17 bp, Homo sapiens
gccccccagctcccaca

SEQ ID NO: 6247133 - DNA, 19 bp, Homo sapiens
gccccccaggctgcccaga

SEQ ID NO: 6247134 - DNA, 12 bp, Homo sapiens
gccccccagtgt

SEQ ID NO: 6247135 - DNA, 22 bp, Homo sapiens
gcccccccaacactgtgccctg

SEQ ID NO: 6247136 - DNA, 23 bp, Homo sapiens
gcccccccaacactgtgccctgg

SEQ ID NO: 6247137 - DNA, 22 bp, Homo sapiens
gcccccccacccacccccaggc

SEQ ID NO: 6247138 - DNA, 23 bp, Homo sapiens
gcccccccactccagcccgcagc

SEQ ID NO: 6247139 - DNA, 13 bp, Homo sapiens
gcccccccagccc

SEQ ID NO: 6247140 - DNA, 22 bp, Homo sapiens
gcccccccctcaaggggcaggg

SEQ ID NO: 6247141 - DNA, 17 bp, Homo sapiens
gccccccctatctcttc

SEQ ID NO: 6247142 - DNA, 16 bp, Homo sapiens
gccccccctcttttgg

SEQ ID NO: 6247143 - DNA, 20 bp, Homo sapiens
gccccccctcttttggcctt

SEQ ID NO: 6247144 - DNA, 21 bp, Homo sapiens
gccccccctcttttggccttg

SEQ ID NO: 6247145 - DNA, 22 bp, Homo sapiens
gccccccctcttttggccttgt

SEQ ID NO: 6247146 - DNA, 14 bp, Homo sapiens
gcccccccttccac

SEQ ID NO: 6247147 - DNA, 15 bp, Homo sapiens
gcccccccttccact

SEQ ID NO: 6247148 - DNA, 23 bp, Homo sapiens
gccccccgaggctaaccctgatc

SEQ ID NO: 6247149 - DNA, 17 bp, Homo sapiens
gccccccgaggctgcta

SEQ ID NO: 6247150 - DNA, 19 bp, Homo sapiens
gccccccgcacagccaccc

SEQ ID NO: 6247151 - DNA, 16 bp, Homo sapiens
gccccccgccctcatg

SEQ ID NO: 6247152 - DNA, 13 bp, Homo sapiens
gccccccgcgcgc

SEQ ID NO: 6247153 - DNA, 19 bp, Homo sapiens
gccccccgcgctcgcccag

SEQ ID NO: 6247154 - DNA, 21 bp, Homo sapiens
gcccccctagcaatacaggga

SEQ ID NO: 6247155 - DNA, 23 bp, Homo sapiens
gcccccctagcaatacagggagg

SEQ ID NO: 6247156 - DNA, 12 bp, Homo sapiens
gcccccctccag

SEQ ID NO: 6247157 - DNA, 14 bp, Homo sapiens
gcccccctcccaga

SEQ ID NO: 6247158 - DNA, 16 bp, Homo sapiens
gcccccctcccagagg

SEQ ID NO: 6247159 - DNA, 14 bp, Homo sapiens
gcccccctcctccc

SEQ ID NO: 6247160 - DNA, 20 bp, Homo sapiens
gcccccctccttgctctgca

SEQ ID NO: 6247161 - DNA, 20 bp, Homo sapiens
gcccccctctgcctttgagc

SEQ ID NO: 6247162 - DNA, 15 bp, Homo sapiens
gcccccctgccctgt

SEQ ID NO: 6247163 - DNA, 12 bp, Homo sapiens
gcccccctggcc

SEQ ID NO: 6247164 - DNA, 13 bp, Homo sapiens
gcccccctggcct

SEQ ID NO: 6247165 - DNA, 18 bp, Homo sapiens
gcccccctggtcccctcc

SEQ ID NO: 6247166 - DNA, 14 bp, Homo sapiens
gccccccttcccac

SEQ ID NO: 6247167 - DNA, 15 bp, Homo sapiens
gccccccttcccacc

SEQ ID NO: 6247168 - DNA, 21 bp, Homo sapiens
gcccccctttggtttggcctc

SEQ ID NO: 6247169 - DNA, 14 bp, Homo sapiens
gcccccgaactgtg

SEQ ID NO: 6247170 - DNA, 19 bp, Homo sapiens
gcccccgaactgtgccttc

SEQ ID NO: 6247171 - DNA, 16 bp, Homo sapiens
gcccccgacagcccag

SEQ ID NO: 6247172 - DNA, 23 bp, Homo sapiens
gcccccgacccccgcagaggcag

SEQ ID NO: 6247173 - DNA, 17 bp, Homo sapiens
gcccccgagccctgact

SEQ ID NO: 6247174 - DNA, 22 bp, Homo sapiens
gcccccgcacgcaagcctcagc

SEQ ID NO: 6247175 - DNA, 21 bp, Homo sapiens
gcccccgcagtcgtcagcctc

SEQ ID NO: 6247176 - DNA, 16 bp, Homo sapiens
gcccccgcatcccctg

SEQ ID NO: 6247177 - DNA, 22 bp, Homo sapiens
gcccccgccacctccccactcc

SEQ ID NO: 6247178 - DNA, 24 bp, Homo sapiens
gcccccgccacctccccactccag

SEQ ID NO: 6247179 - DNA, 13 bp, Homo sapiens
gcccccgcccagg

SEQ ID NO: 6247180 - DNA, 14 bp, Homo sapiens
gcccccgccccaga

SEQ ID NO: 6247181 - DNA, 16 bp, Homo sapiens
gcccccgccccagagt

SEQ ID NO: 6247182 - DNA, 15 bp, Homo sapiens
gcccccgccccaggc

SEQ ID NO: 6247183 - DNA, 15 bp, Homo sapiens
gcccccgcccccacc

SEQ ID NO: 6247184 - DNA, 14 bp, Homo sapiens
gcccccgccccgcc

SEQ ID NO: 6247185 - DNA, 14 bp, Homo sapiens
gcccccgccctcgc

SEQ ID NO: 6247186 - DNA, 18 bp, Homo sapiens
gcccccgccctcgctccg

SEQ ID NO: 6247187 - DNA, 13 bp, Homo sapiens
gcccccgcctggg

SEQ ID NO: 6247188 - DNA, 14 bp, Homo sapiens
gcccccgcctgggc

SEQ ID NO: 6247189 - DNA, 15 bp, Homo sapiens
gcccccgcctgggca

SEQ ID NO: 6247190 - DNA, 16 bp, Homo sapiens
gcccccgcctgggcac

SEQ ID NO: 6247191 - DNA, 23 bp, Homo sapiens
gcccccgcgccctccctccgcct

SEQ ID NO: 6247192 - DNA, 18 bp, Homo sapiens
gcccccgcgggttctaga

SEQ ID NO: 6247193 - DNA, 19 bp, Homo sapiens
gcccccgcgggttctagac

SEQ ID NO: 6247194 - DNA, 20 bp, Homo sapiens
gcccccgctgtaatgaaaca

SEQ ID NO: 6247195 - DNA, 15 bp, Homo sapiens
gcccccgcttagccc

SEQ ID NO: 6247196 - DNA, 21 bp, Homo sapiens
gcccccgcttagccccgctga

SEQ ID NO: 6247197 - DNA, 15 bp, Homo sapiens
gcccccggccaagga

SEQ ID NO: 6247198 - DNA, 17 bp, Homo sapiens
gcccccggccaaggacc

SEQ ID NO: 6247199 - DNA, 21 bp, Homo sapiens
gcccccggccaaggacccagg

SEQ ID NO: 6247200 - DNA, 13 bp, Homo sapiens
gcccccggcggcg

SEQ ID NO: 6247201 - DNA, 15 bp, Homo sapiens
gcccccggcggcgcc

SEQ ID NO: 6247202 - DNA, 15 bp, Homo sapiens
gcccccggctttcct

SEQ ID NO: 6247203 - DNA, 15 bp, Homo sapiens
gcccccgggacaccg

SEQ ID NO: 6247204 - DNA, 20 bp, Homo sapiens
gcccccgggccgctggctgg

SEQ ID NO: 6247205 - DNA, 14 bp, Homo sapiens
gcccccgggcctgc

SEQ ID NO: 6247206 - DNA, 19 bp, Homo sapiens
gcccccgggcctgcacaga

SEQ ID NO: 6247207 - DNA, 21 bp, Homo sapiens
gcccccgtcagggagaggtca

SEQ ID NO: 6247208 - DNA, 15 bp, Homo sapiens
gcccccgttccagct

SEQ ID NO: 6247209 - DNA, 14 bp, Homo sapiens
gcccccgttgaagc

SEQ ID NO: 6247210 - DNA, 20 bp, Homo sapiens
gccccctatcttgtcctgga

SEQ ID NO: 6247211 - DNA, 20 bp, Homo sapiens
gccccctattgtctccaagg

SEQ ID NO: 6247212 - DNA, 23 bp, Homo sapiens
gccccctcacagtattgctcacc

SEQ ID NO: 6247213 - DNA, 15 bp, Homo sapiens
gccccctcagctctg

SEQ ID NO: 6247214 - DNA, 15 bp, Homo sapiens
gccccctccaggaga

SEQ ID NO: 6247215 - DNA, 16 bp, Homo sapiens
gccccctcccaccgct

SEQ ID NO: 6247216 - DNA, 20 bp, Homo sapiens
gccccctcccaccgctgcct

SEQ ID NO: 6247217 - DNA, 16 bp, Homo sapiens
gccccctcccactctt

SEQ ID NO: 6247218 - DNA, 18 bp, Homo sapiens
gccccctcccactcttga

SEQ ID NO: 6247219 - DNA, 14 bp, Homo sapiens
gccccctccccacc

SEQ ID NO: 6247220 - DNA, 18 bp, Homo sapiens
gccccctcccccatgggc

SEQ ID NO: 6247221 - DNA, 20 bp, Homo sapiens
gccccctcccccatgggctg

SEQ ID NO: 6247222 - DNA, 13 bp, Homo sapiens
gccccctcccccg

SEQ ID NO: 6247223 - DNA, 23 bp, Homo sapiens
gccccctccccggcaccctctgg

SEQ ID NO: 6247224 - DNA, 14 bp, Homo sapiens
gccccctcccctcc

SEQ ID NO: 6247225 - DNA, 18 bp, Homo sapiens
gccccctcccttcctgcc

SEQ ID NO: 6247226 - DNA, 16 bp, Homo sapiens
gccccctccgccctgc

SEQ ID NO: 6247227 - DNA, 22 bp, Homo sapiens
gccccctccgccctgccactca

SEQ ID NO: 6247228 - DNA, 21 bp, Homo sapiens
gccccctccgtgatccatcca

SEQ ID NO: 6247229 - DNA, 13 bp, Homo sapiens
gccccctcctccc

SEQ ID NO: 6247230 - DNA, 16 bp, Homo sapiens
gccccctcctctagct

SEQ ID NO: 6247231 - DNA, 19 bp, Homo sapiens
gccccctcctctagctgtg

SEQ ID NO: 6247232 - DNA, 21 bp, Homo sapiens
gccccctcctctagctgtggg

SEQ ID NO: 6247233 - DNA, 13 bp, Homo sapiens
gccccctcctgaa

SEQ ID NO: 6247234 - DNA, 21 bp, Homo sapiens
gccccctcctgaaccgcacag

SEQ ID NO: 6247235 - DNA, 13 bp, Homo sapiens
gccccctcctgac

SEQ ID NO: 6247236 - DNA, 18 bp, Homo sapiens
gccccctcgcgcccctgt

SEQ ID NO: 6247237 - DNA, 19 bp, Homo sapiens
gccccctcgcgcccctgtc

SEQ ID NO: 6247238 - DNA, 16 bp, Homo sapiens
gccccctcggcccctc

SEQ ID NO: 6247239 - DNA, 23 bp, Homo sapiens
gccccctcggcccctcaccacct

SEQ ID NO: 6247240 - DNA, 18 bp, Homo sapiens
gccccctcgggggcctgt

SEQ ID NO: 6247241 - DNA, 20 bp, Homo sapiens
gccccctcgggggcctgtgg

SEQ ID NO: 6247242 - DNA, 18 bp, Homo sapiens
gccccctctcctgaagca

SEQ ID NO: 6247243 - DNA, 12 bp, Homo sapiens
gccccctctcgg

SEQ ID NO: 6247244 - DNA, 20 bp, Homo sapiens
gccccctctcggccaggcat

SEQ ID NO: 6247245 - DNA, 23 bp, Homo sapiens
gccccctctgcagccggaggagg

SEQ ID NO: 6247246 - DNA, 15 bp, Homo sapiens
gccccctctgccctg

SEQ ID NO: 6247247 - DNA, 17 bp, Homo sapiens
gccccctctgccctgcg

SEQ ID NO: 6247248 - DNA, 17 bp, Homo sapiens
gccccctcttccctggt

SEQ ID NO: 6247249 - DNA, 21 bp, Homo sapiens
gccccctctttgtagctccta

SEQ ID NO: 6247250 - DNA, 13 bp, Homo sapiens
gccccctgcaccc

SEQ ID NO: 6247251 - DNA, 17 bp, Homo sapiens
gccccctgcacccaccc

SEQ ID NO: 6247252 - DNA, 20 bp, Homo sapiens
gccccctgcacccacccctg

SEQ ID NO: 6247253 - DNA, 21 bp, Homo sapiens
gccccctgcacccacccctgc

SEQ ID NO: 6247254 - DNA, 14 bp, Homo sapiens
gagggtgagctggt

SEQ ID NO: 6247255 - DNA, 13 bp, Homo sapiens
gagggtgagggcc

SEQ ID NO: 6247256 - DNA, 18 bp, Homo sapiens
gagggtgagggccttctt

SEQ ID NO: 6247257 - DNA, 16 bp, Homo sapiens
gagggtgcagccctct

SEQ ID NO: 6247258 - DNA, 16 bp, Homo sapiens
gagggtgcagggacca

SEQ ID NO: 6247259 - DNA, 21 bp, Homo sapiens
gagggtgccatccacatttta

SEQ ID NO: 6247260 - DNA, 15 bp, Homo sapiens
gagggtgcccctggg

SEQ ID NO: 6247261 - DNA, 16 bp, Homo sapiens
gagggtgcccctggga

SEQ ID NO: 6247262 - DNA, 24 bp, Homo sapiens
gagggtgccggaaagagagctgga

SEQ ID NO: 6247263 - DNA, 23 bp, Homo sapiens
gagggtgccgtgtcccctgacag

SEQ ID NO: 6247264 - DNA, 21 bp, Homo sapiens
gagggtgctaggcccctgtgt

SEQ ID NO: 6247265 - DNA, 13 bp, Homo sapiens
gagggtggagact

SEQ ID NO: 6247266 - DNA, 13 bp, Homo sapiens
gagggtggcagag

SEQ ID NO: 6247267 - DNA, 22 bp, Homo sapiens
gagggtggcagagacagtgggc

SEQ ID NO: 6247268 - DNA, 17 bp, Homo sapiens
gagggtggctggagtga

SEQ ID NO: 6247269 - DNA, 21 bp, Homo sapiens
gagggtgggcttttccctggg

SEQ ID NO: 6247270 - DNA, 21 bp, Homo sapiens
gagggtggggcaatggggaga

SEQ ID NO: 6247271 - DNA, 17 bp, Homo sapiens
gagggtgggggagggag

SEQ ID NO: 6247272 - DNA, 19 bp, Homo sapiens
gagggtggggtgccccagc

SEQ ID NO: 6247273 - DNA, 14 bp, Homo sapiens
gagggtggtgacct

SEQ ID NO: 6247274 - DNA, 22 bp, Homo sapiens
gagggtggtggggacaggtaag

SEQ ID NO: 6247275 - DNA, 22 bp, Homo sapiens
gagggtggttcctgttctcagc

SEQ ID NO: 6247276 - DNA, 22 bp, Homo sapiens
gagggtgtcccaaaaagaaagg

SEQ ID NO: 6247277 - DNA, 16 bp, Homo sapiens
gagggtgttcagaggc

SEQ ID NO: 6247278 - DNA, 16 bp, Homo sapiens
gagggtgtttcctcta

SEQ ID NO: 6247279 - DNA, 20 bp, Homo sapiens
gagggttccaggctgtgtgt

SEQ ID NO: 6247280 - DNA, 13 bp, Homo sapiens
gagggttcccctg

SEQ ID NO: 6247281 - DNA, 15 bp, Homo sapiens
gagggttcccctggc

SEQ ID NO: 6247282 - DNA, 17 bp, Homo sapiens
gagggttcccctggcct

SEQ ID NO: 6247283 - DNA, 24 bp, Homo sapiens
gagggttcctcttaggtcagatgg

SEQ ID NO: 6247284 - DNA, 14 bp, Homo sapiens
gagggttgctgcct

SEQ ID NO: 6247285 - DNA, 12 bp, Homo sapiens
gagggttgctgg

SEQ ID NO: 6247286 - DNA, 24 bp, Homo sapiens
gagggttgctggtcctgcacatga

SEQ ID NO: 6247287 - DNA, 12 bp, Homo sapiens
gagggtttccac

SEQ ID NO: 6247288 - DNA, 20 bp, Homo sapiens
gagggtttgcactccacaca

SEQ ID NO: 6247289 - DNA, 20 bp, Homo sapiens
gagggtttgtaatggtgctt

SEQ ID NO: 6247290 - DNA, 23 bp, Homo sapiens
gagggtttttaaaaataaagcaa

SEQ ID NO: 6247291 - DNA, 15 bp, Homo sapiens
gaggtaaagatatgg

SEQ ID NO: 6247292 - DNA, 13 bp, Homo sapiens
gaggtaacagaac

SEQ ID NO: 6247293 - DNA, 14 bp, Homo sapiens
gaggtaacagaaca

SEQ ID NO: 6247294 - DNA, 18 bp, Homo sapiens
gaggtaacagaacagctt

SEQ ID NO: 6247295 - DNA, 15 bp, Homo sapiens
gaggtaacagggtca

SEQ ID NO: 6247296 - DNA, 24 bp, Homo sapiens
gaggtaacatagatgcctgggcct

SEQ ID NO: 6247297 - DNA, 21 bp, Homo sapiens
gaggtaaggaatacctgtccc

SEQ ID NO: 6247298 - DNA, 19 bp, Homo sapiens
gaggtaccaaaaaagaaag

SEQ ID NO: 6247299 - DNA, 17 bp, Homo sapiens
gaggtactagaatgctt

SEQ ID NO: 6247300 - DNA, 14 bp, Homo sapiens
gaggtactggtccc

SEQ ID NO: 6247301 - DNA, 17 bp, Homo sapiens
gaggtactggtcccttc

SEQ ID NO: 6247302 - DNA, 20 bp, Homo sapiens
gaggtactggtcccttcctt

SEQ ID NO: 6247303 - DNA, 13 bp, Homo sapiens
gaggtagagaaac

SEQ ID NO: 6247304 - DNA, 23 bp, Homo sapiens
gaggtagagtttgaaggaggtga

SEQ ID NO: 6247305 - DNA, 16 bp, Homo sapiens
gaggtagccgggctct

SEQ ID NO: 6247306 - DNA, 14 bp, Homo sapiens
gaggtagcgagctg

SEQ ID NO: 6247307 - DNA, 13 bp, Homo sapiens
gaggtagggctgg

SEQ ID NO: 6247308 - DNA, 17 bp, Homo sapiens
gaggtaggggtggggag

SEQ ID NO: 6247309 - DNA, 23 bp, Homo sapiens
gaggtagtgccaatgacaggaca

SEQ ID NO: 6247310 - DNA, 15 bp, Homo sapiens
gaggtataaagacaa

SEQ ID NO: 6247311 - DNA, 17 bp, Homo sapiens
gaggtatacaatgttct

SEQ ID NO: 6247312 - DNA, 18 bp, Homo sapiens
gaggtatggaaagaacca

SEQ ID NO: 6247313 - DNA, 18 bp, Homo sapiens
gaggtatgggctgggggc

SEQ ID NO: 6247314 - DNA, 23 bp, Homo sapiens
gaggtattatatttaaaaaaaac

SEQ ID NO: 6247315 - DNA, 19 bp, Homo sapiens
gaggtatttatctttactt

SEQ ID NO: 6247316 - DNA, 21 bp, Homo sapiens
gaggtcaaaaaaggattccaa

SEQ ID NO: 6247317 - DNA, 19 bp, Homo sapiens
gaggtcaaatcccaaacca

SEQ ID NO: 6247318 - DNA, 21 bp, Homo sapiens
gaggtcaaatcccaaaccatt

SEQ ID NO: 6247319 - DNA, 23 bp, Homo sapiens
gaggtcaacagagaaggcaggaa

SEQ ID NO: 6247320 - DNA, 19 bp, Homo sapiens
gaggtcaagcccaggagga

SEQ ID NO: 6247321 - DNA, 24 bp, Homo sapiens
gaggtcaagcccaggaggactgcc

SEQ ID NO: 6247322 - DNA, 19 bp, Homo sapiens
gaggtcaaggctgcagtga

SEQ ID NO: 6247323 - DNA, 11 bp, Homo sapiens
gaggtcaataa

SEQ ID NO: 6247324 - DNA, 18 bp, Homo sapiens
gaggtcaataaagcagag

SEQ ID NO: 6247325 - DNA, 19 bp, Homo sapiens
gaggtcaataaagcagagc

SEQ ID NO: 6247326 - DNA, 20 bp, Homo sapiens
gaggtcaataaagcagagcc

SEQ ID NO: 6247327 - DNA, 23 bp, Homo sapiens
gaggtcaataaagcagagccaag

SEQ ID NO: 6247328 - DNA, 20 bp, Homo sapiens
gaggtcacatgttggtgctg

SEQ ID NO: 6247329 - DNA, 15 bp, Homo sapiens
gaggtcaccagctgc

SEQ ID NO: 6247330 - DNA, 17 bp, Homo sapiens
gaggtcaccagctgctg

SEQ ID NO: 6247331 - DNA, 20 bp, Homo sapiens
gaggtcacctgccgccctgt

SEQ ID NO: 6247332 - DNA, 14 bp, Homo sapiens
gaggtcactggctg

SEQ ID NO: 6247333 - DNA, 14 bp, Homo sapiens
gaggtcagaagaaa

SEQ ID NO: 6247334 - DNA, 13 bp, Homo sapiens
gaggtcagagcct

SEQ ID NO: 6247335 - DNA, 17 bp, Homo sapiens
gaggtcagagcctgcag

SEQ ID NO: 6247336 - DNA, 17 bp, Homo sapiens
gaggtcagcatttgatc

SEQ ID NO: 6247337 - DNA, 17 bp, Homo sapiens
gaggtcagccttgacct

SEQ ID NO: 6247338 - DNA, 17 bp, Homo sapiens
gaggtcaggacggctcc

SEQ ID NO: 6247339 - DNA, 22 bp, Homo sapiens
gaggtcaggagttagaggccag

SEQ ID NO: 6247340 - DNA, 11 bp, Homo sapiens
gaggtcaggga

SEQ ID NO: 6247341 - DNA, 22 bp, Homo sapiens
gaggtcagggagtgctggctca

SEQ ID NO: 6247342 - DNA, 23 bp, Homo sapiens
gaggtcagggagtgctggctcac

SEQ ID NO: 6247343 - DNA, 15 bp, Homo sapiens
gaggtcaggggaatg

SEQ ID NO: 6247344 - DNA, 19 bp, Homo sapiens
gaggtcatcccggggccat

SEQ ID NO: 6247345 - DNA, 18 bp, Homo sapiens
gaggtcatcccttcctcc

SEQ ID NO: 6247346 - DNA, 15 bp, Homo sapiens
gaggtcatctgtaaa

SEQ ID NO: 6247347 - DNA, 22 bp, Homo sapiens
gaggtccaaaaaaggctgccct

SEQ ID NO: 6247348 - DNA, 12 bp, Homo sapiens
gaggtccaagca

SEQ ID NO: 6247349 - DNA, 14 bp, Homo sapiens
gaggtccaagcaga

SEQ ID NO: 6247350 - DNA, 23 bp, Homo sapiens
gaggtccaccggcccctggcagc

SEQ ID NO: 6247351 - DNA, 12 bp, Homo sapiens
gaggtccagccc

SEQ ID NO: 6247352 - DNA, 22 bp, Homo sapiens
gaggtccagccctggctgaagg

SEQ ID NO: 6247353 - DNA, 16 bp, Homo sapiens
gaggtccaggcaggag

SEQ ID NO: 6247354 - DNA, 23 bp, Homo sapiens
gaggtccaggtcccagcccctcc

SEQ ID NO: 6247355 - DNA, 20 bp, Homo sapiens
gaggtcccaaggttctgggt

SEQ ID NO: 6247356 - DNA, 22 bp, Homo sapiens
gaggtcccagacatgctgccca

SEQ ID NO: 6247357 - DNA, 20 bp, Homo sapiens
gaggtcccagccctgggggt

SEQ ID NO: 6247358 - DNA, 14 bp, Homo sapiens
gaggtcccaggcag

SEQ ID NO: 6247359 - DNA, 23 bp, Homo sapiens
gaggtccccggttgctggtcagg

SEQ ID NO: 6247360 - DNA, 22 bp, Homo sapiens
gaggtcccctcgtcccatccag

SEQ ID NO: 6247361 - DNA, 10 bp, Homo sapiens
gaggtccctg

SEQ ID NO: 6247362 - DNA, 14 bp, Homo sapiens
gaggtccctgccag

SEQ ID NO: 6247363 - DNA, 23 bp, Homo sapiens
gaggtccctgtgtgtaggctggg

SEQ ID NO: 6247364 - DNA, 13 bp, Homo sapiens
gaggtcccttcaa

SEQ ID NO: 6247365 - DNA, 18 bp, Homo sapiens
gaggtcccttcaaggcct

SEQ ID NO: 6247366 - DNA, 19 bp, Homo sapiens
gaggtcccttcaaggcctc

SEQ ID NO: 6247367 - DNA, 20 bp, Homo sapiens
gaggtcccttcaaggcctcc

SEQ ID NO: 6247368 - DNA, 17 bp, Homo sapiens
gaggtcctcaggtcagc

SEQ ID NO: 6247369 - DNA, 18 bp, Homo sapiens
gaggtcctcaggtcagct

SEQ ID NO: 6247370 - DNA, 17 bp, Homo sapiens
gaggtcctcctggcctg

SEQ ID NO: 6247371 - DNA, 16 bp, Homo sapiens
gaggtcctgagcactg

SEQ ID NO: 6247372 - DNA, 19 bp, Homo sapiens
gaggtcctgagcactgcca

SEQ ID NO: 6247373 - DNA, 20 bp, Homo sapiens
gaggtcctgagcactgccag

SEQ ID NO: 6247374 - DNA, 23 bp, Homo sapiens
gaggtcctgggggcctgacctcc

SEQ ID NO: 6247375 - DNA, 20 bp, Homo sapiens
gaggtcgaagcaatcagcaa

SEQ ID NO: 6247376 - DNA, 20 bp, Homo sapiens
gaggtcgcagctaccctcag

SEQ ID NO: 6247377 - DNA, 13 bp, Homo sapiens
gaggtcgctgcag

SEQ ID NO: 6247378 - DNA, 16 bp, Homo sapiens
gaggtcgctgcagccc

SEQ ID NO: 6247379 - DNA, 22 bp, Homo sapiens
gaggtcgtataatttagtccct

SEQ ID NO: 6247380 - DNA, 17 bp, Homo sapiens
gaggtcgtttatgtgtg

SEQ ID NO: 6247381 - DNA, 19 bp, Homo sapiens
gaggtctcatctcccaggc

SEQ ID NO: 6247382 - DNA, 20 bp, Homo sapiens
gaggtctcatctcccaggcc

SEQ ID NO: 6247383 - DNA, 20 bp, Homo sapiens
gaggtctcccctgatccaga

SEQ ID NO: 6247384 - DNA, 21 bp, Homo sapiens
gaggtctcccctgatccagac

SEQ ID NO: 6247385 - DNA, 16 bp, Homo sapiens
gaggtctcgaccctgt

SEQ ID NO: 6247386 - DNA, 19 bp, Homo sapiens
gaggtctctgggagcccag

SEQ ID NO: 6247387 - DNA, 15 bp, Homo sapiens
gaggtctcttgaggg

SEQ ID NO: 6247388 - DNA, 18 bp, Homo sapiens
gaggtctcttgagggagc

SEQ ID NO: 6247389 - DNA, 14 bp, Homo sapiens
gaggtctcttttct

SEQ ID NO: 6247390 - DNA, 17 bp, Homo sapiens
gaggtctcttttctcta

SEQ ID NO: 6247391 - DNA, 18 bp, Homo sapiens
gaggtctgattggctgct

SEQ ID NO: 6247392 - DNA, 21 bp, Homo sapiens
gaggtctgattggctgcttaa

SEQ ID NO: 6247393 - DNA, 20 bp, Homo sapiens
gaggtctggctgagcccctg

SEQ ID NO: 6247394 - DNA, 17 bp, Homo sapiens
gaggtctggctgcttgc

SEQ ID NO: 6247395 - DNA, 15 bp, Homo sapiens
gaggtctgtgctgag

SEQ ID NO: 6247396 - DNA, 16 bp, Homo sapiens
gaggtctgtgctgagg

SEQ ID NO: 6247397 - DNA, 16 bp, Homo sapiens
gaggtctgttcctttt

SEQ ID NO: 6247398 - DNA, 13 bp, Homo sapiens
gaggtctgttctt

SEQ ID NO: 6247399 - DNA, 14 bp, Homo sapiens
gaggtctgttcttt

SEQ ID NO: 6247400 - DNA, 14 bp, Homo sapiens
gaggtcttcagggc

SEQ ID NO: 6247401 - DNA, 14 bp, Homo sapiens
gaggtctttcagaa

SEQ ID NO: 6247402 - DNA, 13 bp, Homo sapiens
gaggtctttctcc

SEQ ID NO: 6247403 - DNA, 18 bp, Homo sapiens
gaggtcttttgacatgtg

SEQ ID NO: 6247404 - DNA, 15 bp, Homo sapiens
gaggtgaaaaggcca

SEQ ID NO: 6247405 - DNA, 18 bp, Homo sapiens
gaggtgaaaagggcagag

SEQ ID NO: 6247406 - DNA, 19 bp, Homo sapiens
gaggtgaaaagggcagagg

SEQ ID NO: 6247407 - DNA, 15 bp, Homo sapiens
gaggtgaaagggagc

SEQ ID NO: 6247408 - DNA, 17 bp, Homo sapiens
gaggtgaagtccctgtt

SEQ ID NO: 6247409 - DNA, 15 bp, Homo sapiens
gaggtgaccccaggg

SEQ ID NO: 6247410 - DNA, 18 bp, Homo sapiens
gaggtgaccccagggcac

SEQ ID NO: 6247411 - DNA, 21 bp, Homo sapiens
gaggtgaccccagggcacagg

SEQ ID NO: 6247412 - DNA, 22 bp, Homo sapiens
gaggtgaccccagggcacagga

SEQ ID NO: 6247413 - DNA, 17 bp, Homo sapiens
gaggtgacttgcctggg

SEQ ID NO: 6247414 - DNA, 19 bp, Homo sapiens
gaggtgacttgcctggggc

SEQ ID NO: 6247415 - DNA, 16 bp, Homo sapiens
gaggtgagaactcaga

SEQ ID NO: 6247416 - DNA, 16 bp, Homo sapiens
gaggtgagaccacctc

SEQ ID NO: 6247417 - DNA, 15 bp, Homo sapiens
gaggtgagagtggga

SEQ ID NO: 6247418 - DNA, 12 bp, Homo sapiens
gaggtgagcaga

SEQ ID NO: 6247419 - DNA, 22 bp, Homo sapiens
gaggtgagctagacccaaccct

SEQ ID NO: 6247420 - DNA, 17 bp, Homo sapiens
gaggtgaggattccaaa

SEQ ID NO: 6247421 - DNA, 14 bp, Homo sapiens
gaggtgatagcatt

SEQ ID NO: 6247422 - DNA, 22 bp, Homo sapiens
gaggtgatatttttatgtgcag

SEQ ID NO: 6247423 - DNA, 18 bp, Homo sapiens
gaggtgattctcagggct

SEQ ID NO: 6247424 - DNA, 20 bp, Homo sapiens
gaggtgattctcagggctgg

SEQ ID NO: 6247425 - DNA, 21 bp, Homo sapiens
gaggtgcagagtgcccagaac

SEQ ID NO: 6247426 - DNA, 19 bp, Homo sapiens
gaggtgcaggggaagacca

SEQ ID NO: 6247427 - DNA, 17 bp, Homo sapiens
gaggtgcagtggagggg

SEQ ID NO: 6247428 - DNA, 21 bp, Homo sapiens
gaggtgccacccagtagccca

SEQ ID NO: 6247429 - DNA, 13 bp, Homo sapiens
gaggtgccagcaa

SEQ ID NO: 6247430 - DNA, 15 bp, Homo sapiens
gaggtgccagcaaag

SEQ ID NO: 6247431 - DNA, 13 bp, Homo sapiens
gccccctgcagga

SEQ ID NO: 6247432 - DNA, 21 bp, Homo sapiens
gccccctgcaggaaggagctg

SEQ ID NO: 6247433 - DNA, 23 bp, Homo sapiens
gccccctgcaggaaggagctgcc

SEQ ID NO: 6247434 - DNA, 19 bp, Homo sapiens
gccccctgccagccgaccc

SEQ ID NO: 6247435 - DNA, 13 bp, Homo sapiens
gccccctgccagt

SEQ ID NO: 6247436 - DNA, 11 bp, Homo sapiens
gccccctgccc

SEQ ID NO: 6247437 - DNA, 12 bp, Homo sapiens
gccccctgcttc

SEQ ID NO: 6247438 - DNA, 22 bp, Homo sapiens
gccccctggcagctgcccctcc

SEQ ID NO: 6247439 - DNA, 16 bp, Homo sapiens
gccccctggcccctcc

SEQ ID NO: 6247440 - DNA, 14 bp, Homo sapiens
gccccctggcctct

SEQ ID NO: 6247441 - DNA, 15 bp, Homo sapiens
gccccctggcctctg

SEQ ID NO: 6247442 - DNA, 17 bp, Homo sapiens
gccccctggcctctgtg

SEQ ID NO: 6247443 - DNA, 13 bp, Homo sapiens
gccccctggcggc

SEQ ID NO: 6247444 - DNA, 19 bp, Homo sapiens
gccccctggctgactggcc

SEQ ID NO: 6247445 - DNA, 12 bp, Homo sapiens
gccccctgggag

SEQ ID NO: 6247446 - DNA, 15 bp, Homo sapiens
gccccctgggagagt

SEQ ID NO: 6247447 - DNA, 18 bp, Homo sapiens
gccccctgggctggggcc

SEQ ID NO: 6247448 - DNA, 22 bp, Homo sapiens
gccccctggggggcacagccag

SEQ ID NO: 6247449 - DNA, 13 bp, Homo sapiens
gccccctggtctc

SEQ ID NO: 6247450 - DNA, 16 bp, Homo sapiens
gccccctggtctctgg

SEQ ID NO: 6247451 - DNA, 22 bp, Homo sapiens
gccccctggtggacagtcctgg

SEQ ID NO: 6247452 - DNA, 17 bp, Homo sapiens
gccccctgtgccagctc

SEQ ID NO: 6247453 - DNA, 19 bp, Homo sapiens
gccccctgtgcccacccag

SEQ ID NO: 6247454 - DNA, 22 bp, Homo sapiens
gccccctgtgcccacccagggc

SEQ ID NO: 6247455 - DNA, 13 bp, Homo sapiens
gccccctgtggat

SEQ ID NO: 6247456 - DNA, 17 bp, Homo sapiens
gccccctgtggatgctg

SEQ ID NO: 6247457 - DNA, 12 bp, Homo sapiens
gcccccttcagg

SEQ ID NO: 6247458 - DNA, 18 bp, Homo sapiens
gcccccttcaggagcctg

SEQ ID NO: 6247459 - DNA, 14 bp, Homo sapiens
gcccccttccccag

SEQ ID NO: 6247460 - DNA, 19 bp, Homo sapiens
gcccccttccccagccctt

SEQ ID NO: 6247461 - DNA, 23 bp, Homo sapiens
gcccccttccccagcccttagca

SEQ ID NO: 6247462 - DNA, 17 bp, Homo sapiens
gcccccttcgctcctcc

SEQ ID NO: 6247463 - DNA, 22 bp, Homo sapiens
gcccccttctcccacactgcta

SEQ ID NO: 6247464 - DNA, 23 bp, Homo sapiens
gcccccttctttgcagctgccca

SEQ ID NO: 6247465 - DNA, 15 bp, Homo sapiens
gcccccttgcccatc

SEQ ID NO: 6247466 - DNA, 17 bp, Homo sapiens
gcccccttgccctccgc

SEQ ID NO: 6247467 - DNA, 18 bp, Homo sapiens
gccccctttcccgggctg

SEQ ID NO: 6247468 - DNA, 18 bp, Homo sapiens
gccccctttgggcccagg

SEQ ID NO: 6247469 - DNA, 17 bp, Homo sapiens
gccccgaagggccccca

SEQ ID NO: 6247470 - DNA, 22 bp, Homo sapiens
gccccgacacacggggctcggg

SEQ ID NO: 6247471 - DNA, 15 bp, Homo sapiens
gccccgacaggtctt

SEQ ID NO: 6247472 - DNA, 22 bp, Homo sapiens
gccccgacgtttgcggcagtgt

SEQ ID NO: 6247473 - DNA, 12 bp, Homo sapiens
gccccgactcca

SEQ ID NO: 6247474 - DNA, 13 bp, Homo sapiens
gccccgactccag

SEQ ID NO: 6247475 - DNA, 16 bp, Homo sapiens
gccccgactccagcca

SEQ ID NO: 6247476 - DNA, 19 bp, Homo sapiens
gccccgactccagccagcg

SEQ ID NO: 6247477 - DNA, 14 bp, Homo sapiens
gccccgagacacca

SEQ ID NO: 6247478 - DNA, 16 bp, Homo sapiens
gccccgagagcaggct

SEQ ID NO: 6247479 - DNA, 13 bp, Homo sapiens
gccccgagctgtc

SEQ ID NO: 6247480 - DNA, 21 bp, Homo sapiens
gccccgaggacccagacccag

SEQ ID NO: 6247481 - DNA, 13 bp, Homo sapiens
gccccgaggccta

SEQ ID NO: 6247482 - DNA, 18 bp, Homo sapiens
gccccgaggccttctctg

SEQ ID NO: 6247483 - DNA, 17 bp, Homo sapiens
gccccgaggctgggaca

SEQ ID NO: 6247484 - DNA, 19 bp, Homo sapiens
gccccgatggactcctgac

SEQ ID NO: 6247485 - DNA, 18 bp, Homo sapiens
gccccgcacccccgccag

SEQ ID NO: 6247486 - DNA, 16 bp, Homo sapiens
gccccgcacccctcct

SEQ ID NO: 6247487 - DNA, 14 bp, Homo sapiens
gccccgcacgactg

SEQ ID NO: 6247488 - DNA, 20 bp, Homo sapiens
gccccgcagacggtctgtgt

SEQ ID NO: 6247489 - DNA, 14 bp, Homo sapiens
gccccgcaggcctg

SEQ ID NO: 6247490 - DNA, 17 bp, Homo sapiens
gccccgcagtgccctgc

SEQ ID NO: 6247491 - DNA, 17 bp, Homo sapiens
gccccgccagggctggg

SEQ ID NO: 6247492 - DNA, 14 bp, Homo sapiens
gccccgcccacacc

SEQ ID NO: 6247493 - DNA, 17 bp, Homo sapiens
gccccgcccacaccctc

SEQ ID NO: 6247494 - DNA, 13 bp, Homo sapiens
gccccgccccaca

SEQ ID NO: 6247495 - DNA, 15 bp, Homo sapiens
gccccgccccacatt

SEQ ID NO: 6247496 - DNA, 22 bp, Homo sapiens
gccccgccccacattccgacaa

SEQ ID NO: 6247497 - DNA, 13 bp, Homo sapiens
gccccgccccacc

SEQ ID NO: 6247498 - DNA, 16 bp, Homo sapiens
gccccgccccagagct

SEQ ID NO: 6247499 - DNA, 20 bp, Homo sapiens
gccccgcccccacccctaca

SEQ ID NO: 6247500 - DNA, 22 bp, Homo sapiens
gccccgccccccagagccaggg

SEQ ID NO: 6247501 - DNA, 18 bp, Homo sapiens
gccccgcccccgccccgc

SEQ ID NO: 6247502 - DNA, 13 bp, Homo sapiens
gccccgcccctcc

SEQ ID NO: 6247503 - DNA, 16 bp, Homo sapiens
gccccgcccctcccac

SEQ ID NO: 6247504 - DNA, 18 bp, Homo sapiens
gccccgcccctcccacgc

SEQ ID NO: 6247505 - DNA, 16 bp, Homo sapiens
gccccgcccctgcccc

SEQ ID NO: 6247506 - DNA, 23 bp, Homo sapiens
gccccgcccgtagatcatccccg

SEQ ID NO: 6247507 - DNA, 13 bp, Homo sapiens
gccccgccctcat

SEQ ID NO: 6247508 - DNA, 13 bp, Homo sapiens
gccccgccctctg

SEQ ID NO: 6247509 - DNA, 14 bp, Homo sapiens
gccccgccctctgc

SEQ ID NO: 6247510 - DNA, 17 bp, Homo sapiens
gccccgccctcttcctg

SEQ ID NO: 6247511 - DNA, 13 bp, Homo sapiens
gccccgccgcctg

SEQ ID NO: 6247512 - DNA, 22 bp, Homo sapiens
gccccgccggccgcgcaccgcc

SEQ ID NO: 6247513 - DNA, 22 bp, Homo sapiens
gccccgccgtgtctgtggccct

SEQ ID NO: 6247514 - DNA, 22 bp, Homo sapiens
gccccgcctccccatacttcct

SEQ ID NO: 6247515 - DNA, 13 bp, Homo sapiens
gccccgccttcct

SEQ ID NO: 6247516 - DNA, 16 bp, Homo sapiens
gccccgccttcctggg

SEQ ID NO: 6247517 - DNA, 17 bp, Homo sapiens
gccccgcgaccacccct

SEQ ID NO: 6247518 - DNA, 19 bp, Homo sapiens
gccccgcgaccacccctgt

SEQ ID NO: 6247519 - DNA, 21 bp, Homo sapiens
gccccgcgaccacccctgtgc

SEQ ID NO: 6247520 - DNA, 20 bp, Homo sapiens
gccccgcgcaccccacgccc

SEQ ID NO: 6247521 - DNA, 22 bp, Homo sapiens
gccccgcgcaccccacgccctg

SEQ ID NO: 6247522 - DNA, 21 bp, Homo sapiens
gccccgcgcgtgcccccagcg

SEQ ID NO: 6247523 - DNA, 16 bp, Homo sapiens
gccccgcggagccccc

SEQ ID NO: 6247524 - DNA, 18 bp, Homo sapiens
gccccgcggagcccccgc

SEQ ID NO: 6247525 - DNA, 20 bp, Homo sapiens
gccccgcggatcaaccaggc

SEQ ID NO: 6247526 - DNA, 13 bp, Homo sapiens
gccccgcgtggaa

SEQ ID NO: 6247527 - DNA, 23 bp, Homo sapiens
gccccgctagcggggccaggagc

SEQ ID NO: 6247528 - DNA, 13 bp, Homo sapiens
gccccgctcaggt

SEQ ID NO: 6247529 - DNA, 17 bp, Homo sapiens
gccccgctgagcttgga

SEQ ID NO: 6247530 - DNA, 22 bp, Homo sapiens
gccccgctgtgtcctccctccc

SEQ ID NO: 6247531 - DNA, 17 bp, Homo sapiens
gccccgcttccccacag

SEQ ID NO: 6247532 - DNA, 18 bp, Homo sapiens
gccccgcttccccacaga

SEQ ID NO: 6247533 - DNA, 21 bp, Homo sapiens
gccccgcttccccacagaact

SEQ ID NO: 6247534 - DNA, 15 bp, Homo sapiens
gccccggacagggtg

SEQ ID NO: 6247535 - DNA, 17 bp, Homo sapiens
gccccggacagggtggc

SEQ ID NO: 6247536 - DNA, 20 bp, Homo sapiens
gccccggacagggtggcacc

SEQ ID NO: 6247537 - DNA, 23 bp, Homo sapiens
gccccggacggacgttggttctg

SEQ ID NO: 6247538 - DNA, 21 bp, Homo sapiens
gccccggatcagagcaggacc

SEQ ID NO: 6247539 - DNA, 21 bp, Homo sapiens
gccccggatgacttggggaca

SEQ ID NO: 6247540 - DNA, 18 bp, Homo sapiens
gccccggcaactctggct

SEQ ID NO: 6247541 - DNA, 19 bp, Homo sapiens
gccccggcaactctggctc

SEQ ID NO: 6247542 - DNA, 22 bp, Homo sapiens
gccccggcaagccacaggaagg

SEQ ID NO: 6247543 - DNA, 20 bp, Homo sapiens
gccccggccactccctgcca

SEQ ID NO: 6247544 - DNA, 21 bp, Homo sapiens
gccccggccactccctgccaa

SEQ ID NO: 6247545 - DNA, 14 bp, Homo sapiens
gccccggccttgct

SEQ ID NO: 6247546 - DNA, 17 bp, Homo sapiens
gccccggctcccaccgg

SEQ ID NO: 6247547 - DNA, 15 bp, Homo sapiens
gccccgggcaaaggg

SEQ ID NO: 6247548 - DNA, 16 bp, Homo sapiens
gccccgggcaaagggt

SEQ ID NO: 6247549 - DNA, 17 bp, Homo sapiens
gccccgggctctggcca

SEQ ID NO: 6247550 - DNA, 20 bp, Homo sapiens
gccccgggctctggccaccc

SEQ ID NO: 6247551 - DNA, 21 bp, Homo sapiens
gccccgggctctggccaccct

SEQ ID NO: 6247552 - DNA, 14 bp, Homo sapiens
gccccgggctgacc

SEQ ID NO: 6247553 - DNA, 16 bp, Homo sapiens
gccccgggctggagaa

SEQ ID NO: 6247554 - DNA, 22 bp, Homo sapiens
gccccgggctggccctgtgcag

SEQ ID NO: 6247555 - DNA, 16 bp, Homo sapiens
gccccgggcttccctt

SEQ ID NO: 6247556 - DNA, 16 bp, Homo sapiens
gccccggggccccctg

SEQ ID NO: 6247557 - DNA, 15 bp, Homo sapiens
gccccggggcctgtt

SEQ ID NO: 6247558 - DNA, 14 bp, Homo sapiens
gccccggggctggc

SEQ ID NO: 6247559 - DNA, 15 bp, Homo sapiens
gccccggggctggca

SEQ ID NO: 6247560 - DNA, 23 bp, Homo sapiens
gccccggggctggcaagcaggga

SEQ ID NO: 6247561 - DNA, 15 bp, Homo sapiens
gccccgggtccccag

SEQ ID NO: 6247562 - DNA, 18 bp, Homo sapiens
gccccgggtgcctcagag

SEQ ID NO: 6247563 - DNA, 23 bp, Homo sapiens
gccccgggtgcctcagagcaggc

SEQ ID NO: 6247564 - DNA, 20 bp, Homo sapiens
gccccggtcccccagagcat

SEQ ID NO: 6247565 - DNA, 22 bp, Homo sapiens
gccccggtcctggccccagccc

SEQ ID NO: 6247566 - DNA, 17 bp, Homo sapiens
gccccggtggctgggca

SEQ ID NO: 6247567 - DNA, 18 bp, Homo sapiens
gccccggtggctgggcag

SEQ ID NO: 6247568 - DNA, 19 bp, Homo sapiens
gccccggtggctgggcaga

SEQ ID NO: 6247569 - DNA, 16 bp, Homo sapiens
gccccggtgtgcggtg

SEQ ID NO: 6247570 - DNA, 22 bp, Homo sapiens
gccccgtcaccatctcaggcca

SEQ ID NO: 6247571 - DNA, 14 bp, Homo sapiens
gccccgtcccagag

SEQ ID NO: 6247572 - DNA, 15 bp, Homo sapiens
gccccgtcccagagg

SEQ ID NO: 6247573 - DNA, 15 bp, Homo sapiens
gccccgtccccccat

SEQ ID NO: 6247574 - DNA, 17 bp, Homo sapiens
gccccgtccccccatcc

SEQ ID NO: 6247575 - DNA, 21 bp, Homo sapiens
gccccgtccccctctggctcc

SEQ ID NO: 6247576 - DNA, 23 bp, Homo sapiens
gccccgtcccctaacccccagtc

SEQ ID NO: 6247577 - DNA, 18 bp, Homo sapiens
gccccgtcccctgggcca

SEQ ID NO: 6247578 - DNA, 21 bp, Homo sapiens
gccccgtcggactgcccccag

SEQ ID NO: 6247579 - DNA, 21 bp, Homo sapiens
gccccgtctacagctccccca

SEQ ID NO: 6247580 - DNA, 15 bp, Homo sapiens
gccccgtctgacccc

SEQ ID NO: 6247581 - DNA, 22 bp, Homo sapiens
gccccgtctgcccaccattccc

SEQ ID NO: 6247582 - DNA, 15 bp, Homo sapiens
gccccgtgcagactg

SEQ ID NO: 6247583 - DNA, 19 bp, Homo sapiens
gccccgtgctcctctgccc

SEQ ID NO: 6247584 - DNA, 24 bp, Homo sapiens
gccccgtggtgacatttcccaagt

SEQ ID NO: 6247585 - DNA, 16 bp, Homo sapiens
gccccgtgtcccccca

SEQ ID NO: 6247586 - DNA, 17 bp, Homo sapiens
gccccgtgtccccccag

SEQ ID NO: 6247587 - DNA, 24 bp, Homo sapiens
gccccgtgtccccccaggtgctgg

SEQ ID NO: 6247588 - DNA, 13 bp, Homo sapiens
gccccgtgtctgg

SEQ ID NO: 6247589 - DNA, 23 bp, Homo sapiens
gccccgtgtgaatgtagcttcca

SEQ ID NO: 6247590 - DNA, 14 bp, Homo sapiens
gccccgtgtttgcg

SEQ ID NO: 6247591 - DNA, 21 bp, Homo sapiens
gccccgttccctgtcagaggc

SEQ ID NO: 6247592 - DNA, 18 bp, Homo sapiens
gccccgttgtgagctgga

SEQ ID NO: 6247593 - DNA, 20 bp, Homo sapiens
gcccctaaagatgggaggag

SEQ ID NO: 6247594 - DNA, 22 bp, Homo sapiens
gcccctaaagatgggaggagac

SEQ ID NO: 6247595 - DNA, 22 bp, Homo sapiens
gcccctaagtgcaaacacagca

SEQ ID NO: 6247596 - DNA, 21 bp, Homo sapiens
gcccctaagttattacctctc

SEQ ID NO: 6247597 - DNA, 15 bp, Homo sapiens
gcccctaatctctgt

SEQ ID NO: 6247598 - DNA, 19 bp, Homo sapiens
gcccctacccctgccctgc

SEQ ID NO: 6247599 - DNA, 20 bp, Homo sapiens
gcccctacccctgccctgct

SEQ ID NO: 6247600 - DNA, 15 bp, Homo sapiens
gcccctagcccagga

SEQ ID NO: 6247601 - DNA, 21 bp, Homo sapiens
gcccctagcccaggagagaga

SEQ ID NO: 6247602 - DNA, 18 bp, Homo sapiens
gcccctagccggttcctg

SEQ ID NO: 6247603 - DNA, 20 bp, Homo sapiens
gcccctaggatgctgcagca

SEQ ID NO: 6247604 - DNA, 22 bp, Homo sapiens
gcccctaggatgctgcagcaga

SEQ ID NO: 6247605 - DNA, 16 bp, Homo sapiens
gcccctagggtccctc

SEQ ID NO: 6247606 - DNA, 18 bp, Homo sapiens
gcccctaggtgcccaggg

SEQ ID NO: 6247607 - DNA, 19 bp, Homo sapiens
gcccctaggtgcccagggc

SEQ ID NO: 6247608 - DNA, 16 bp, Homo sapiens
gaggtgccagcaaagc

SEQ ID NO: 6247609 - DNA, 14 bp, Homo sapiens
gaggtgcccactcc

SEQ ID NO: 6247610 - DNA, 17 bp, Homo sapiens
gaggtgcccactccgcc

SEQ ID NO: 6247611 - DNA, 23 bp, Homo sapiens
gaggtgcccactccgccagccac

SEQ ID NO: 6247612 - DNA, 13 bp, Homo sapiens
gaggtgcccagga

SEQ ID NO: 6247613 - DNA, 16 bp, Homo sapiens
gaggtgcccaggagaa

SEQ ID NO: 6247614 - DNA, 15 bp, Homo sapiens
gaggtgcctcccagt

SEQ ID NO: 6247615 - DNA, 22 bp, Homo sapiens
gaggtgcctcccagtggcctgg

SEQ ID NO: 6247616 - DNA, 21 bp, Homo sapiens
gaggtgcctgagctggggcct

SEQ ID NO: 6247617 - DNA, 19 bp, Homo sapiens
gaggtgcctgctcaggtgc

SEQ ID NO: 6247618 - DNA, 12 bp, Homo sapiens
gaggtgcctggg

SEQ ID NO: 6247619 - DNA, 16 bp, Homo sapiens
gaggtgcctgggagga

SEQ ID NO: 6247620 - DNA, 15 bp, Homo sapiens
gaggtgcctgtccca

SEQ ID NO: 6247621 - DNA, 15 bp, Homo sapiens
gaggtgccttcttca

SEQ ID NO: 6247622 - DNA, 23 bp, Homo sapiens
gaggtgccttcttcagggcctgg

SEQ ID NO: 6247623 - DNA, 16 bp, Homo sapiens
gaggtgcgctcacctc

SEQ ID NO: 6247624 - DNA, 13 bp, Homo sapiens
gaggtgctagctc

SEQ ID NO: 6247625 - DNA, 11 bp, Homo sapiens
gaggtgctgat

SEQ ID NO: 6247626 - DNA, 13 bp, Homo sapiens
gaggtgctggttc

SEQ ID NO: 6247627 - DNA, 22 bp, Homo sapiens
gaggtgctgtagatgctgggcc

SEQ ID NO: 6247628 - DNA, 19 bp, Homo sapiens
gaggtgctgtccccactgc

SEQ ID NO: 6247629 - DNA, 14 bp, Homo sapiens
gaggtgcttgaggc

SEQ ID NO: 6247630 - DNA, 12 bp, Homo sapiens
gaggtgcttgat

SEQ ID NO: 6247631 - DNA, 15 bp, Homo sapiens
gaggtggaagaaggg

SEQ ID NO: 6247632 - DNA, 17 bp, Homo sapiens
gaggtggaagaagggag

SEQ ID NO: 6247633 - DNA, 15 bp, Homo sapiens
gaggtggaagccctc

SEQ ID NO: 6247634 - DNA, 18 bp, Homo sapiens
gaggtggaattattttaa

SEQ ID NO: 6247635 - DNA, 21 bp, Homo sapiens
gaggtggagcaaagtgagggc

SEQ ID NO: 6247636 - DNA, 20 bp, Homo sapiens
gaggtggagcttgcaatgag

SEQ ID NO: 6247637 - DNA, 16 bp, Homo sapiens
gaggtggagggaggga

SEQ ID NO: 6247638 - DNA, 20 bp, Homo sapiens
gaggtggaggttgcagtgaa

SEQ ID NO: 6247639 - DNA, 20 bp, Homo sapiens
gaggtggatactggggggca

SEQ ID NO: 6247640 - DNA, 24 bp, Homo sapiens
gaggtggattccgagtggtgacag

SEQ ID NO: 6247641 - DNA, 15 bp, Homo sapiens
gaggtggattcctgg

SEQ ID NO: 6247642 - DNA, 22 bp, Homo sapiens
gaggtggattcctgggcaagaa

SEQ ID NO: 6247643 - DNA, 18 bp, Homo sapiens
gaggtggatttactgaga

SEQ ID NO: 6247644 - DNA, 22 bp, Homo sapiens
gaggtggccaccgggggtggct

SEQ ID NO: 6247645 - DNA, 19 bp, Homo sapiens
gaggtggccagagctggga

SEQ ID NO: 6247646 - DNA, 23 bp, Homo sapiens
gaggtggccagagctgggaggca

SEQ ID NO: 6247647 - DNA, 15 bp, Homo sapiens
gaggtggcccaggcc

SEQ ID NO: 6247648 - DNA, 18 bp, Homo sapiens
gaggtggcgccccctggt

SEQ ID NO: 6247649 - DNA, 21 bp, Homo sapiens
gaggtggcgccccctggtggg

SEQ ID NO: 6247650 - DNA, 14 bp, Homo sapiens
gaggtggctgcctg

SEQ ID NO: 6247651 - DNA, 16 bp, Homo sapiens
gaggtggcttcatgtg

SEQ ID NO: 6247652 - DNA, 15 bp, Homo sapiens
gaggtgggagacaag

SEQ ID NO: 6247653 - DNA, 13 bp, Homo sapiens
gaggtgggagcag

SEQ ID NO: 6247654 - DNA, 14 bp, Homo sapiens
gaggtgggagcagg

SEQ ID NO: 6247655 - DNA, 17 bp, Homo sapiens
gaggtgggagcaggaga

SEQ ID NO: 6247656 - DNA, 14 bp, Homo sapiens
gaggtgggagggcc

SEQ ID NO: 6247657 - DNA, 18 bp, Homo sapiens
gaggtgggaggtggaaga

SEQ ID NO: 6247658 - DNA, 13 bp, Homo sapiens
gaggtgggatcct

SEQ ID NO: 6247659 - DNA, 22 bp, Homo sapiens
gaggtgggatcctccaggtgca

SEQ ID NO: 6247660 - DNA, 12 bp, Homo sapiens
gaggtgggcagc

SEQ ID NO: 6247661 - DNA, 14 bp, Homo sapiens
gaggtgggcagcag

SEQ ID NO: 6247662 - DNA, 16 bp, Homo sapiens
gaggtgggcagcagct

SEQ ID NO: 6247663 - DNA, 14 bp, Homo sapiens
gaggtgggcagctg

SEQ ID NO: 6247664 - DNA, 23 bp, Homo sapiens
gaggtgggccacacccaggaagg

SEQ ID NO: 6247665 - DNA, 17 bp, Homo sapiens
gaggtgggccagtctgt

SEQ ID NO: 6247666 - DNA, 16 bp, Homo sapiens
gaggtgggctggggct

SEQ ID NO: 6247667 - DNA, 21 bp, Homo sapiens
gaggtgggctggggctgctcc

SEQ ID NO: 6247668 - DNA, 19 bp, Homo sapiens
gaggtggggaagagagcct

SEQ ID NO: 6247669 - DNA, 14 bp, Homo sapiens
gaggtggggcctca

SEQ ID NO: 6247670 - DNA, 17 bp, Homo sapiens
gaggtgggggatgctga

SEQ ID NO: 6247671 - DNA, 23 bp, Homo sapiens
gaggtgggggcctcctcagcctc

SEQ ID NO: 6247672 - DNA, 23 bp, Homo sapiens
gaggtgggggttttggggtgggc

SEQ ID NO: 6247673 - DNA, 21 bp, Homo sapiens
gaggtgggtgtgggtggaagg

SEQ ID NO: 6247674 - DNA, 21 bp, Homo sapiens
gaggtgggtgtttgggaaagg

SEQ ID NO: 6247675 - DNA, 22 bp, Homo sapiens
gaggtggtagaaccacttggct

SEQ ID NO: 6247676 - DNA, 23 bp, Homo sapiens
gaggtggtagtaaaacacagagg

SEQ ID NO: 6247677 - DNA, 19 bp, Homo sapiens
gaggtggtctgaatgttct

SEQ ID NO: 6247678 - DNA, 14 bp, Homo sapiens
gaggtggtggacat

SEQ ID NO: 6247679 - DNA, 13 bp, Homo sapiens
gaggtggtggagg

SEQ ID NO: 6247680 - DNA, 17 bp, Homo sapiens
gaggtggtggaggagga

SEQ ID NO: 6247681 - DNA, 16 bp, Homo sapiens
gaggtggtggggacca

SEQ ID NO: 6247682 - DNA, 19 bp, Homo sapiens
gaggtgtcaccctgcagag

SEQ ID NO: 6247683 - DNA, 22 bp, Homo sapiens
gaggtgtcaccctgcagagcta

SEQ ID NO: 6247684 - DNA, 14 bp, Homo sapiens
gaggtgtcaggctg

SEQ ID NO: 6247685 - DNA, 18 bp, Homo sapiens
gaggtgtcaggctgctgg

SEQ ID NO: 6247686 - DNA, 15 bp, Homo sapiens
gaggtgtctcaggct

SEQ ID NO: 6247687 - DNA, 17 bp, Homo sapiens
gaggtgtctcctaccct

SEQ ID NO: 6247688 - DNA, 18 bp, Homo sapiens
gaggtgtctggcctgagg

SEQ ID NO: 6247689 - DNA, 13 bp, Homo sapiens
gaggtgtctgggg

SEQ ID NO: 6247690 - DNA, 20 bp, Homo sapiens
gaggtgtctggggtgaggga

SEQ ID NO: 6247691 - DNA, 22 bp, Homo sapiens
gaggtgtctggggtgagggagt

SEQ ID NO: 6247692 - DNA, 13 bp, Homo sapiens
gaggtgtgccaga

SEQ ID NO: 6247693 - DNA, 16 bp, Homo sapiens
gaggtgtgccagaaag

SEQ ID NO: 6247694 - DNA, 16 bp, Homo sapiens
gaggtgtggagccgag

SEQ ID NO: 6247695 - DNA, 17 bp, Homo sapiens
gaggtgtgggccgatct

SEQ ID NO: 6247696 - DNA, 16 bp, Homo sapiens
gaggtgtgggtgcctt

SEQ ID NO: 6247697 - DNA, 17 bp, Homo sapiens
gaggtgttacagaggac

SEQ ID NO: 6247698 - DNA, 21 bp, Homo sapiens
gaggtgttcccaggctgcccc

SEQ ID NO: 6247699 - DNA, 18 bp, Homo sapiens
gaggtgttgcagcccaaa

SEQ ID NO: 6247700 - DNA, 13 bp, Homo sapiens
gaggtgttgtgca

SEQ ID NO: 6247701 - DNA, 20 bp, Homo sapiens
gaggtgttgtgcatttgttc

SEQ ID NO: 6247702 - DNA, 21 bp, Homo sapiens
gaggtgtttaaagagaggtta

SEQ ID NO: 6247703 - DNA, 19 bp, Homo sapiens
gaggttaaagaagctgcat

SEQ ID NO: 6247704 - DNA, 15 bp, Homo sapiens
gaggttaaggctgag

SEQ ID NO: 6247705 - DNA, 21 bp, Homo sapiens
gaggttaaggtgggtccagga

SEQ ID NO: 6247706 - DNA, 20 bp, Homo sapiens
gaggttagcccaatggagaa

SEQ ID NO: 6247707 - DNA, 13 bp, Homo sapiens
gaggttataggtc

SEQ ID NO: 6247708 - DNA, 14 bp, Homo sapiens
gaggttatctgcct

SEQ ID NO: 6247709 - DNA, 21 bp, Homo sapiens
gaggttatctgcctggcctgg

SEQ ID NO: 6247710 - DNA, 22 bp, Homo sapiens
gaggttattcacaacctcacca

SEQ ID NO: 6247711 - DNA, 15 bp, Homo sapiens
gaggttcagcaaggt

SEQ ID NO: 6247712 - DNA, 19 bp, Homo sapiens
gaggttcccactctgggca

SEQ ID NO: 6247713 - DNA, 14 bp, Homo sapiens
gaggttcccagggc

SEQ ID NO: 6247714 - DNA, 17 bp, Homo sapiens
gaggttcgggattccct

SEQ ID NO: 6247715 - DNA, 14 bp, Homo sapiens
gaggttctaaggcc

SEQ ID NO: 6247716 - DNA, 13 bp, Homo sapiens
gaggttctcagag

SEQ ID NO: 6247717 - DNA, 19 bp, Homo sapiens
gaggttctcagagccaagt

SEQ ID NO: 6247718 - DNA, 15 bp, Homo sapiens
gaggttctcagcaag

SEQ ID NO: 6247719 - DNA, 23 bp, Homo sapiens
gaggttctcagcaagtgtacagt

SEQ ID NO: 6247720 - DNA, 17 bp, Homo sapiens
gaggttctgagaccagt

SEQ ID NO: 6247721 - DNA, 15 bp, Homo sapiens
gaggttctgcctcta

SEQ ID NO: 6247722 - DNA, 14 bp, Homo sapiens
gaggttctgggcct

SEQ ID NO: 6247723 - DNA, 16 bp, Homo sapiens
gaggttctggggagga

SEQ ID NO: 6247724 - DNA, 22 bp, Homo sapiens
gaggttcttaaagtttgcagta

SEQ ID NO: 6247725 - DNA, 21 bp, Homo sapiens
gaggttgaggaaaagactgtg

SEQ ID NO: 6247726 - DNA, 17 bp, Homo sapiens
gaggttgaggatgcact

SEQ ID NO: 6247727 - DNA, 13 bp, Homo sapiens
gaggttgagtgag

SEQ ID NO: 6247728 - DNA, 14 bp, Homo sapiens
gaggttgagtgagc

SEQ ID NO: 6247729 - DNA, 15 bp, Homo sapiens
gaggttgataacttt

SEQ ID NO: 6247730 - DNA, 14 bp, Homo sapiens
gaggttgcagtgag

SEQ ID NO: 6247731 - DNA, 15 bp, Homo sapiens
gaggttgcagtgagc

SEQ ID NO: 6247732 - DNA, 19 bp, Homo sapiens
gaggttgcagtgagccaag

SEQ ID NO: 6247733 - DNA, 19 bp, Homo sapiens
gaggttgcagtgagccgag

SEQ ID NO: 6247734 - DNA, 20 bp, Homo sapiens
gaggttgccgtgagccaaga

SEQ ID NO: 6247735 - DNA, 14 bp, Homo sapiens
gaggttgggaaggc

SEQ ID NO: 6247736 - DNA, 19 bp, Homo sapiens
gaggttgggaaggcacctg

SEQ ID NO: 6247737 - DNA, 17 bp, Homo sapiens
gaggttgggggaaccag

SEQ ID NO: 6247738 - DNA, 19 bp, Homo sapiens
gaggttgggggaaccagca

SEQ ID NO: 6247739 - DNA, 14 bp, Homo sapiens
gaggttgggtgggc

SEQ ID NO: 6247740 - DNA, 14 bp, Homo sapiens
gaggttggtgactg

SEQ ID NO: 6247741 - DNA, 14 bp, Homo sapiens
gaggttggtgtgga

SEQ ID NO: 6247742 - DNA, 23 bp, Homo sapiens
gaggttggttccttggggggcca

SEQ ID NO: 6247743 - DNA, 19 bp, Homo sapiens
gaggttgtagtgagccaag

SEQ ID NO: 6247744 - DNA, 18 bp, Homo sapiens
gaggttgtagtgagccca

SEQ ID NO: 6247745 - DNA, 13 bp, Homo sapiens
gaggttgtgcatg

SEQ ID NO: 6247746 - DNA, 21 bp, Homo sapiens
gaggttgtggatgctccaggg

SEQ ID NO: 6247747 - DNA, 15 bp, Homo sapiens
gaggttgtggggagg

SEQ ID NO: 6247748 - DNA, 17 bp, Homo sapiens
gaggttgtggggaggct

SEQ ID NO: 6247749 - DNA, 14 bp, Homo sapiens
gaggttgtggggcc

SEQ ID NO: 6247750 - DNA, 18 bp, Homo sapiens
gaggttgtggggcctcag

SEQ ID NO: 6247751 - DNA, 23 bp, Homo sapiens
gaggttgtggggcctcaggctcc

SEQ ID NO: 6247752 - DNA, 13 bp, Homo sapiens
gaggtttaaatgt

SEQ ID NO: 6247753 - DNA, 19 bp, Homo sapiens
gaggtttagatgtgcaacc

SEQ ID NO: 6247754 - DNA, 22 bp, Homo sapiens
gaggtttatagaaagatagata

SEQ ID NO: 6247755 - DNA, 22 bp, Homo sapiens
gaggtttcaccatgatggccag

SEQ ID NO: 6247756 - DNA, 11 bp, Homo sapiens
gaggtttctgg

SEQ ID NO: 6247757 - DNA, 19 bp, Homo sapiens
gaggtttgaaggagaatgg

SEQ ID NO: 6247758 - DNA, 20 bp, Homo sapiens
gaggtttgaaggagaatggc

SEQ ID NO: 6247759 - DNA, 13 bp, Homo sapiens
gaggtttgggggg

SEQ ID NO: 6247760 - DNA, 17 bp, Homo sapiens
gaggtttggtttcctgt

SEQ ID NO: 6247761 - DNA, 15 bp, Homo sapiens
gaggtttgtcaacac

SEQ ID NO: 6247762 - DNA, 18 bp, Homo sapiens
gaggtttgtcaacacaaa

SEQ ID NO: 6247763 - DNA, 23 bp, Homo sapiens
gaggtttgtcgggcaccagccag

SEQ ID NO: 6247764 - DNA, 19 bp, Homo sapiens
gaggttttaaaaaaatccc

SEQ ID NO: 6247765 - DNA, 15 bp, Homo sapiens
gaggttttaaagtga

SEQ ID NO: 6247766 - DNA, 16 bp, Homo sapiens
gaggttttatgatatt

SEQ ID NO: 6247767 - DNA, 23 bp, Homo sapiens
gaggttttattctgacttcctct

SEQ ID NO: 6247768 - DNA, 21 bp, Homo sapiens
gaggttttatttcatttttca

SEQ ID NO: 6247769 - DNA, 22 bp, Homo sapiens
gaggtttttaaatatatatttt

SEQ ID NO: 6247770 - DNA, 23 bp, Homo sapiens
gaggtttttttgtcaacattgtg

SEQ ID NO: 6247771 - DNA, 21 bp, Homo sapiens
gagtaaaaaaaaaaacaatta

SEQ ID NO: 6247772 - DNA, 13 bp, Homo sapiens
gagtaaaaactag

SEQ ID NO: 6247773 - DNA, 16 bp, Homo sapiens
gagtaaaaagaaaaca

SEQ ID NO: 6247774 - DNA, 20 bp, Homo sapiens
gagtaaaaagacatttttta

SEQ ID NO: 6247775 - DNA, 15 bp, Homo sapiens
gagtaaaaattcata

SEQ ID NO: 6247776 - DNA, 16 bp, Homo sapiens
gagtaaaaattcatat

SEQ ID NO: 6247777 - DNA, 14 bp, Homo sapiens
gagtaaaaccaaag

SEQ ID NO: 6247778 - DNA, 19 bp, Homo sapiens
gagtaaaacttgtattgga

SEQ ID NO: 6247779 - DNA, 22 bp, Homo sapiens
gagtaaaataaatattgtcttt

SEQ ID NO: 6247780 - DNA, 19 bp, Homo sapiens
gagtaaaattacagaagaa

SEQ ID NO: 6247781 - DNA, 16 bp, Homo sapiens
gagtaaacagacagct

SEQ ID NO: 6247782 - DNA, 17 bp, Homo sapiens
gagtaaagataaaagga

SEQ ID NO: 6247783 - DNA, 12 bp, Homo sapiens
gagtaaagcaac

SEQ ID NO: 6247784 - DNA, 16 bp, Homo sapiens
gagtaaataaactgtt

SEQ ID NO: 6247785 - DNA, 17 bp, Homo sapiens
gagtaaataaactgttt

SEQ ID NO: 6247786 - DNA, 17 bp, Homo sapiens
gagtaaatattgtcaca

SEQ ID NO: 6247787 - DNA, 19 bp, Homo sapiens
gcccctagtgctattctgt

SEQ ID NO: 6247788 - DNA, 18 bp, Homo sapiens
gcccctatagcactgagc

SEQ ID NO: 6247789 - DNA, 19 bp, Homo sapiens
gcccctatcctgcaccctc

SEQ ID NO: 6247790 - DNA, 16 bp, Homo sapiens
gcccctcacactgcaa

SEQ ID NO: 6247791 - DNA, 18 bp, Homo sapiens
gcccctcacactgcaagg

SEQ ID NO: 6247792 - DNA, 20 bp, Homo sapiens
gcccctcacatcctctccag

SEQ ID NO: 6247793 - DNA, 22 bp, Homo sapiens
gcccctcacatcctctccagga

SEQ ID NO: 6247794 - DNA, 14 bp, Homo sapiens
gcccctcacccacc

SEQ ID NO: 6247795 - DNA, 16 bp, Homo sapiens
gcccctcaccctctgt

SEQ ID NO: 6247796 - DNA, 19 bp, Homo sapiens
gcccctcaccctctgtccc

SEQ ID NO: 6247797 - DNA, 21 bp, Homo sapiens
gcccctcaccctctgtcccca

SEQ ID NO: 6247798 - DNA, 18 bp, Homo sapiens
gcccctcaccctgcctta

SEQ ID NO: 6247799 - DNA, 14 bp, Homo sapiens
gcccctcaccgctg

SEQ ID NO: 6247800 - DNA, 16 bp, Homo sapiens
gcccctcacctcagga

SEQ ID NO: 6247801 - DNA, 14 bp, Homo sapiens
gcccctcacctggg

SEQ ID NO: 6247802 - DNA, 15 bp, Homo sapiens
gcccctcacctgggc

SEQ ID NO: 6247803 - DNA, 17 bp, Homo sapiens
gcccctcacctgggcac

SEQ ID NO: 6247804 - DNA, 20 bp, Homo sapiens
gcccctcacctgggcacctg

SEQ ID NO: 6247805 - DNA, 17 bp, Homo sapiens
gcccctcactggctgga

SEQ ID NO: 6247806 - DNA, 12 bp, Homo sapiens
gcccctcacttc

SEQ ID NO: 6247807 - DNA, 20 bp, Homo sapiens
gcccctcagagccctgccct

SEQ ID NO: 6247808 - DNA, 22 bp, Homo sapiens
gcccctcagagccctgccctgc

SEQ ID NO: 6247809 - DNA, 23 bp, Homo sapiens
gcccctcagccacccttggtctc

SEQ ID NO: 6247810 - DNA, 17 bp, Homo sapiens
gcccctcagcccttgcc

SEQ ID NO: 6247811 - DNA, 12 bp, Homo sapiens
gcccctcagcct

SEQ ID NO: 6247812 - DNA, 15 bp, Homo sapiens
gcccctcagcctctg

SEQ ID NO: 6247813 - DNA, 19 bp, Homo sapiens
gcccctcagcctctgccac

SEQ ID NO: 6247814 - DNA, 21 bp, Homo sapiens
gcccctcagcctgcctgaaga

SEQ ID NO: 6247815 - DNA, 22 bp, Homo sapiens
gcccctcagggggccagctggg

SEQ ID NO: 6247816 - DNA, 18 bp, Homo sapiens
gcccctcagggtccctgg

SEQ ID NO: 6247817 - DNA, 19 bp, Homo sapiens
gcccctcagggtccctggt

SEQ ID NO: 6247818 - DNA, 16 bp, Homo sapiens
gcccctcatgccacag

SEQ ID NO: 6247819 - DNA, 15 bp, Homo sapiens
gcccctccaccgggc

SEQ ID NO: 6247820 - DNA, 16 bp, Homo sapiens
gcccctccacgcctcc

SEQ ID NO: 6247821 - DNA, 20 bp, Homo sapiens
gcccctccacgcctcctggc

SEQ ID NO: 6247822 - DNA, 12 bp, Homo sapiens
gcccctccactg

SEQ ID NO: 6247823 - DNA, 23 bp, Homo sapiens
gcccctccagaccctgcctgagc

SEQ ID NO: 6247824 - DNA, 12 bp, Homo sapiens
gcccctccagca

SEQ ID NO: 6247825 - DNA, 13 bp, Homo sapiens
gcccctccaggag

SEQ ID NO: 6247826 - DNA, 21 bp, Homo sapiens
gcccctcccaagcgttcctgg

SEQ ID NO: 6247827 - DNA, 18 bp, Homo sapiens
gcccctcccaagctggct

SEQ ID NO: 6247828 - DNA, 15 bp, Homo sapiens
gcccctcccacacac

SEQ ID NO: 6247829 - DNA, 21 bp, Homo sapiens
gcccctcccacacacacccac

SEQ ID NO: 6247830 - DNA, 22 bp, Homo sapiens
gcccctcccacacccaaagctg

SEQ ID NO: 6247831 - DNA, 14 bp, Homo sapiens
gcccctcccagata

SEQ ID NO: 6247832 - DNA, 13 bp, Homo sapiens
gcccctcccatgg

SEQ ID NO: 6247833 - DNA, 12 bp, Homo sapiens
gcccctccccag

SEQ ID NO: 6247834 - DNA, 16 bp, Homo sapiens
gcccctccccagactc

SEQ ID NO: 6247835 - DNA, 20 bp, Homo sapiens
gcccctccccagactctcag

SEQ ID NO: 6247836 - DNA, 15 bp, Homo sapiens
gcccctccccagccc

SEQ ID NO: 6247837 - DNA, 16 bp, Homo sapiens
gcccctccccagccct

SEQ ID NO: 6247838 - DNA, 17 bp, Homo sapiens
gcccctccccagccctt

SEQ ID NO: 6247839 - DNA, 17 bp, Homo sapiens
gcccctccccatggtgc

SEQ ID NO: 6247840 - DNA, 15 bp, Homo sapiens
gcccctcccccaacc

SEQ ID NO: 6247841 - DNA, 15 bp, Homo sapiens
gcccctcccccactt

SEQ ID NO: 6247842 - DNA, 13 bp, Homo sapiens
gcccctcccccag

SEQ ID NO: 6247843 - DNA, 16 bp, Homo sapiens
gcccctcccccagctg

SEQ ID NO: 6247844 - DNA, 17 bp, Homo sapiens
gcccctcccccagctgc

SEQ ID NO: 6247845 - DNA, 16 bp, Homo sapiens
gcccctcccccatctc

SEQ ID NO: 6247846 - DNA, 18 bp, Homo sapiens
gcccctccccctaccgca

SEQ ID NO: 6247847 - DNA, 20 bp, Homo sapiens
gcccctccccgcctcctccc

SEQ ID NO: 6247848 - DNA, 21 bp, Homo sapiens
gcccctccccgcctcctccct

SEQ ID NO: 6247849 - DNA, 17 bp, Homo sapiens
gcccctccccgtccctg

SEQ ID NO: 6247850 - DNA, 21 bp, Homo sapiens
gcccctccccgtccctgtccc

SEQ ID NO: 6247851 - DNA, 22 bp, Homo sapiens
gcccctccccgtccctgtcccc

SEQ ID NO: 6247852 - DNA, 23 bp, Homo sapiens
gcccctccccgtccctgtccccc

SEQ ID NO: 6247853 - DNA, 19 bp, Homo sapiens
gcccctcccctcagagccc

SEQ ID NO: 6247854 - DNA, 15 bp, Homo sapiens
gcccctcccctcagc

SEQ ID NO: 6247855 - DNA, 19 bp, Homo sapiens
gcccctcccctcagcctgc

SEQ ID NO: 6247856 - DNA, 16 bp, Homo sapiens
gcccctcccctccaaa

SEQ ID NO: 6247857 - DNA, 16 bp, Homo sapiens
gcccctcccctccccg

SEQ ID NO: 6247858 - DNA, 18 bp, Homo sapiens
gcccctccctacctcaac

SEQ ID NO: 6247859 - DNA, 21 bp, Homo sapiens
gcccctccctacctcaacctg

SEQ ID NO: 6247860 - DNA, 20 bp, Homo sapiens
gcccctccctagatccaggc

SEQ ID NO: 6247861 - DNA, 19 bp, Homo sapiens
gcccctccctcagggagcg

SEQ ID NO: 6247862 - DNA, 17 bp, Homo sapiens
gcccctccctcctctga

SEQ ID NO: 6247863 - DNA, 20 bp, Homo sapiens
gcccctccctcctctggccc

SEQ ID NO: 6247864 - DNA, 14 bp, Homo sapiens
gcccctccctcctg

SEQ ID NO: 6247865 - DNA, 17 bp, Homo sapiens
gcccctccctctgcccc

SEQ ID NO: 6247866 - DNA, 21 bp, Homo sapiens
gcccctccctctgccccaagc

SEQ ID NO: 6247867 - DNA, 13 bp, Homo sapiens
gcccctccctgct

SEQ ID NO: 6247868 - DNA, 14 bp, Homo sapiens
gcccctcccttcaa

SEQ ID NO: 6247869 - DNA, 15 bp, Homo sapiens
gcccctcccttcaac

SEQ ID NO: 6247870 - DNA, 15 bp, Homo sapiens
gcccctccgatgctg

SEQ ID NO: 6247871 - DNA, 19 bp, Homo sapiens
gcccctccgatgctgaggc

SEQ ID NO: 6247872 - DNA, 16 bp, Homo sapiens
gcccctccgggcagag

SEQ ID NO: 6247873 - DNA, 20 bp, Homo sapiens
gcccctcctaccccggctgc

SEQ ID NO: 6247874 - DNA, 17 bp, Homo sapiens
gcccctcctagacccag

SEQ ID NO: 6247875 - DNA, 20 bp, Homo sapiens
gcccctcctagacccaggtg

SEQ ID NO: 6247876 - DNA, 21 bp, Homo sapiens
gcccctcctagacccaggtgg

SEQ ID NO: 6247877 - DNA, 18 bp, Homo sapiens
gcccctcctccagagcct

SEQ ID NO: 6247878 - DNA, 21 bp, Homo sapiens
gcccctcctccagcccctgtc

SEQ ID NO: 6247879 - DNA, 20 bp, Homo sapiens
gcccctcctcccccggctgg

SEQ ID NO: 6247880 - DNA, 15 bp, Homo sapiens
gcccctcctcccctt

SEQ ID NO: 6247881 - DNA, 20 bp, Homo sapiens
gcccctcctccccttcctgc

SEQ ID NO: 6247882 - DNA, 22 bp, Homo sapiens
gcccctcctccccttcctgcac

SEQ ID NO: 6247883 - DNA, 14 bp, Homo sapiens
gcccctcctccctc

SEQ ID NO: 6247884 - DNA, 17 bp, Homo sapiens
gcccctcctccctcaga

SEQ ID NO: 6247885 - DNA, 18 bp, Homo sapiens
gcccctcctccctcagac

SEQ ID NO: 6247886 - DNA, 21 bp, Homo sapiens
gcccctcctccctcagaccca

SEQ ID NO: 6247887 - DNA, 23 bp, Homo sapiens
gcccctcctccctcagacccagc

SEQ ID NO: 6247888 - DNA, 21 bp, Homo sapiens
gcccctcctccctcaggccca

SEQ ID NO: 6247889 - DNA, 20 bp, Homo sapiens
gcccctcctctgagcagcct

SEQ ID NO: 6247890 - DNA, 17 bp, Homo sapiens
gcccctcctctgccacc

SEQ ID NO: 6247891 - DNA, 21 bp, Homo sapiens
gcccctcctctgccacctccc

SEQ ID NO: 6247892 - DNA, 17 bp, Homo sapiens
gcccctcctctgtgctc

SEQ ID NO: 6247893 - DNA, 18 bp, Homo sapiens
gcccctcctctgtgctcc

SEQ ID NO: 6247894 - DNA, 22 bp, Homo sapiens
gcccctcctctgtgctccctcg

SEQ ID NO: 6247895 - DNA, 19 bp, Homo sapiens
gcccctcctgggtgctcac

SEQ ID NO: 6247896 - DNA, 14 bp, Homo sapiens
gcccctccttctcc

SEQ ID NO: 6247897 - DNA, 16 bp, Homo sapiens
gcccctccttctcccc

SEQ ID NO: 6247898 - DNA, 17 bp, Homo sapiens
gcccctccttgcaacca

SEQ ID NO: 6247899 - DNA, 14 bp, Homo sapiens
gcccctcgaggcct

SEQ ID NO: 6247900 - DNA, 20 bp, Homo sapiens
gcccctcgaggcctacagag

SEQ ID NO: 6247901 - DNA, 21 bp, Homo sapiens
gcccctcgaggcctacagagg

SEQ ID NO: 6247902 - DNA, 21 bp, Homo sapiens
gcccctcgcacacagggctca

SEQ ID NO: 6247903 - DNA, 23 bp, Homo sapiens
gcccctcgcacacagggctcaca

SEQ ID NO: 6247904 - DNA, 18 bp, Homo sapiens
gcccctcgccagcttctc

SEQ ID NO: 6247905 - DNA, 21 bp, Homo sapiens
gcccctcgccagcttctcctg

SEQ ID NO: 6247906 - DNA, 22 bp, Homo sapiens
gcccctcgccagcttctcctgc

SEQ ID NO: 6247907 - DNA, 23 bp, Homo sapiens
gcccctcgcctgtggagctcagc

SEQ ID NO: 6247908 - DNA, 22 bp, Homo sapiens
gcccctcgccttttaggctcag

SEQ ID NO: 6247909 - DNA, 16 bp, Homo sapiens
gcccctcgctgctgct

SEQ ID NO: 6247910 - DNA, 17 bp, Homo sapiens
gcccctcgctgctgcta

SEQ ID NO: 6247911 - DNA, 17 bp, Homo sapiens
gcccctcggctaccccc

SEQ ID NO: 6247912 - DNA, 22 bp, Homo sapiens
gcccctcgtgacctacagggaa

SEQ ID NO: 6247913 - DNA, 22 bp, Homo sapiens
gcccctctcacaggcagctctg

SEQ ID NO: 6247914 - DNA, 14 bp, Homo sapiens
gcccctctcagccc

SEQ ID NO: 6247915 - DNA, 16 bp, Homo sapiens
gcccctctcagccctc

SEQ ID NO: 6247916 - DNA, 20 bp, Homo sapiens
gcccctctcaggctgtgctt

SEQ ID NO: 6247917 - DNA, 16 bp, Homo sapiens
gcccctctcatggtca

SEQ ID NO: 6247918 - DNA, 14 bp, Homo sapiens
gcccctctccaagc

SEQ ID NO: 6247919 - DNA, 19 bp, Homo sapiens
gcccctctccaagcgcctg

SEQ ID NO: 6247920 - DNA, 22 bp, Homo sapiens
gcccctctccaagcgcctggct

SEQ ID NO: 6247921 - DNA, 21 bp, Homo sapiens
gcccctctcccgccagactgt

SEQ ID NO: 6247922 - DNA, 12 bp, Homo sapiens
gcccctctccga

SEQ ID NO: 6247923 - DNA, 13 bp, Homo sapiens
gcccctctcctcc

SEQ ID NO: 6247924 - DNA, 17 bp, Homo sapiens
gcccctctccttcttag

SEQ ID NO: 6247925 - DNA, 21 bp, Homo sapiens
gcccctctctagggacccctc

SEQ ID NO: 6247926 - DNA, 12 bp, Homo sapiens
gcccctctctgg

SEQ ID NO: 6247927 - DNA, 21 bp, Homo sapiens
gcccctctctgtttaccctcc

SEQ ID NO: 6247928 - DNA, 16 bp, Homo sapiens
gcccctctgcaccctt

SEQ ID NO: 6247929 - DNA, 12 bp, Homo sapiens
gcccctctgccc

SEQ ID NO: 6247930 - DNA, 16 bp, Homo sapiens
gcccctctgcccagct

SEQ ID NO: 6247931 - DNA, 18 bp, Homo sapiens
gcccctctgcccagcttg

SEQ ID NO: 6247932 - DNA, 15 bp, Homo sapiens
gcccctctgccttgc

SEQ ID NO: 6247933 - DNA, 12 bp, Homo sapiens
gcccctctgcgc

SEQ ID NO: 6247934 - DNA, 17 bp, Homo sapiens
gcccctctgcgccccag

SEQ ID NO: 6247935 - DNA, 14 bp, Homo sapiens
gcccctctgctgtc

SEQ ID NO: 6247936 - DNA, 21 bp, Homo sapiens
gcccctctgctgtcctgcagt

SEQ ID NO: 6247937 - DNA, 19 bp, Homo sapiens
gcccctctggattcccttt

SEQ ID NO: 6247938 - DNA, 14 bp, Homo sapiens
gcccctctggtcgc

SEQ ID NO: 6247939 - DNA, 18 bp, Homo sapiens
gcccctctggtcgctcct

SEQ ID NO: 6247940 - DNA, 19 bp, Homo sapiens
gcccctctggtcgctcctg

SEQ ID NO: 6247941 - DNA, 13 bp, Homo sapiens
gcccctctgttct

SEQ ID NO: 6247942 - DNA, 17 bp, Homo sapiens
gcccctctgttctctcc

SEQ ID NO: 6247943 - DNA, 14 bp, Homo sapiens
gcccctctgttctg

SEQ ID NO: 6247944 - DNA, 23 bp, Homo sapiens
gcccctctgttctggtggcccca

SEQ ID NO: 6247945 - DNA, 21 bp, Homo sapiens
gcccctcttattcctctaggc

SEQ ID NO: 6247946 - DNA, 22 bp, Homo sapiens
gcccctcttattcctctaggca

SEQ ID NO: 6247947 - DNA, 20 bp, Homo sapiens
gcccctcttccaaaggcagc

SEQ ID NO: 6247948 - DNA, 23 bp, Homo sapiens
gcccctcttccaaaggcagcgtg

SEQ ID NO: 6247949 - DNA, 17 bp, Homo sapiens
gcccctcttccctggcc

SEQ ID NO: 6247950 - DNA, 14 bp, Homo sapiens
gcccctcttccctt

SEQ ID NO: 6247951 - DNA, 21 bp, Homo sapiens
gcccctcttcccttcctccat

SEQ ID NO: 6247952 - DNA, 19 bp, Homo sapiens
gcccctcttgccccccacc

SEQ ID NO: 6247953 - DNA, 21 bp, Homo sapiens
gcccctcttgccccccacccc

SEQ ID NO: 6247954 - DNA, 17 bp, Homo sapiens
gcccctcttggagaagt

SEQ ID NO: 6247955 - DNA, 22 bp, Homo sapiens
gcccctgaagtgaccccagctc

SEQ ID NO: 6247956 - DNA, 22 bp, Homo sapiens
gcccctgacagatctagttctc

SEQ ID NO: 6247957 - DNA, 12 bp, Homo sapiens
gcccctgaccct

SEQ ID NO: 6247958 - DNA, 16 bp, Homo sapiens
gcccctgagatctctg

SEQ ID NO: 6247959 - DNA, 11 bp, Homo sapiens
gcccctgagcc

SEQ ID NO: 6247960 - DNA, 13 bp, Homo sapiens
gcccctgagccca

SEQ ID NO: 6247961 - DNA, 14 bp, Homo sapiens
gcccctgagcccac

SEQ ID NO: 6247962 - DNA, 14 bp, Homo sapiens
gcccctgagcctgt

SEQ ID NO: 6247963 - DNA, 15 bp, Homo sapiens
gcccctgagcctgtg

SEQ ID NO: 6247964 - DNA, 19 bp, Homo sapiens
gagtaacagtcatcattta

SEQ ID NO: 6247965 - DNA, 16 bp, Homo sapiens
gagtaacatttgctgt

SEQ ID NO: 6247966 - DNA, 17 bp, Homo sapiens
gagtaacatttgctgtt

SEQ ID NO: 6247967 - DNA, 19 bp, Homo sapiens
gagtaactggttgctgtgt

SEQ ID NO: 6247968 - DNA, 14 bp, Homo sapiens
gagtaacttagaaa

SEQ ID NO: 6247969 - DNA, 18 bp, Homo sapiens
gagtaagaaatttcaggt

SEQ ID NO: 6247970 - DNA, 14 bp, Homo sapiens
gagtaagtgtacaa

SEQ ID NO: 6247971 - DNA, 14 bp, Homo sapiens
gagtaagtgtgttc

SEQ ID NO: 6247972 - DNA, 18 bp, Homo sapiens
gagtaatactttttaaat

SEQ ID NO: 6247973 - DNA, 19 bp, Homo sapiens
gagtaataggaccagagcg

SEQ ID NO: 6247974 - DNA, 13 bp, Homo sapiens
gagtaatattaca

SEQ ID NO: 6247975 - DNA, 17 bp, Homo sapiens
gagtaatattacatttc

SEQ ID NO: 6247976 - DNA, 22 bp, Homo sapiens
gagtaatccaagcaaatgtgaa

SEQ ID NO: 6247977 - DNA, 20 bp, Homo sapiens
gagtaatctgatcgttcttt

SEQ ID NO: 6247978 - DNA, 20 bp, Homo sapiens
gagtaatgacgtgtgtggct

SEQ ID NO: 6247979 - DNA, 23 bp, Homo sapiens
gagtaatgacgtgtgtggctggg

SEQ ID NO: 6247980 - DNA, 22 bp, Homo sapiens
gagtaatgggtttcatatttct

SEQ ID NO: 6247981 - DNA, 19 bp, Homo sapiens
gagtaatggtgtagaacac

SEQ ID NO: 6247982 - DNA, 22 bp, Homo sapiens
gagtaattaataaagaaaaaga

SEQ ID NO: 6247983 - DNA, 22 bp, Homo sapiens
gagtaattcatctgtgaatctg

SEQ ID NO: 6247984 - DNA, 23 bp, Homo sapiens
gagtaattcatctgtgaatctgc

SEQ ID NO: 6247985 - DNA, 14 bp, Homo sapiens
gagtaatttattgt

SEQ ID NO: 6247986 - DNA, 14 bp, Homo sapiens
gagtaatttcattt

SEQ ID NO: 6247987 - DNA, 13 bp, Homo sapiens
gagtacaaatgtg

SEQ ID NO: 6247988 - DNA, 18 bp, Homo sapiens
gagtacaagctcttgttt

SEQ ID NO: 6247989 - DNA, 20 bp, Homo sapiens
gagtacaaggacagacagca

SEQ ID NO: 6247990 - DNA, 18 bp, Homo sapiens
gagtacaccctttccagg

SEQ ID NO: 6247991 - DNA, 21 bp, Homo sapiens
gagtacaccctttccaggaat

SEQ ID NO: 6247992 - DNA, 16 bp, Homo sapiens
gagtacactcagccac

SEQ ID NO: 6247993 - DNA, 15 bp, Homo sapiens
gagtacactgtgtct

SEQ ID NO: 6247994 - DNA, 18 bp, Homo sapiens
gagtacactgtgtctcta

SEQ ID NO: 6247995 - DNA, 19 bp, Homo sapiens
gagtacactgtgtctctat

SEQ ID NO: 6247996 - DNA, 17 bp, Homo sapiens
gagtacattcatctgga

SEQ ID NO: 6247997 - DNA, 18 bp, Homo sapiens
gagtacattgaaggcctg

SEQ ID NO: 6247998 - DNA, 19 bp, Homo sapiens
gagtacctactgtgtgcca

SEQ ID NO: 6247999 - DNA, 15 bp, Homo sapiens
gagtacctggtcata

SEQ ID NO: 6248000 - DNA, 19 bp, Homo sapiens
gagtacggctggtgtgtca

SEQ ID NO: 6248001 - DNA, 17 bp, Homo sapiens
gagtacgtcctgcctgg

SEQ ID NO: 6248002 - DNA, 18 bp, Homo sapiens
gagtacgtcctgcctggc

SEQ ID NO: 6248003 - DNA, 19 bp, Homo sapiens
gagtacgtcctgcctggca

SEQ ID NO: 6248004 - DNA, 17 bp, Homo sapiens
gagtacgttgtgcattt

SEQ ID NO: 6248005 - DNA, 23 bp, Homo sapiens
gagtactacagtcctcccatctc

SEQ ID NO: 6248006 - DNA, 21 bp, Homo sapiens
gagtactagaatttgtatttt

SEQ ID NO: 6248007 - DNA, 15 bp, Homo sapiens
gagtactatatttac

SEQ ID NO: 6248008 - DNA, 16 bp, Homo sapiens
gagtactatatttaca

SEQ ID NO: 6248009 - DNA, 17 bp, Homo sapiens
gagtactcataaaggac

SEQ ID NO: 6248010 - DNA, 16 bp, Homo sapiens
gagtactccacactgc

SEQ ID NO: 6248011 - DNA, 17 bp, Homo sapiens
gagtactccacactgca

SEQ ID NO: 6248012 - DNA, 13 bp, Homo sapiens
gagtactgtgggc

SEQ ID NO: 6248013 - DNA, 17 bp, Homo sapiens
gagtactgtgggcaatt

SEQ ID NO: 6248014 - DNA, 22 bp, Homo sapiens
gagtactgttaagaataataaa

SEQ ID NO: 6248015 - DNA, 19 bp, Homo sapiens
gagtagaaactgcagggaa

SEQ ID NO: 6248016 - DNA, 23 bp, Homo sapiens
gagtagaaaggcctttaaaattt

SEQ ID NO: 6248017 - DNA, 15 bp, Homo sapiens
gagtagacaaaagga

SEQ ID NO: 6248018 - DNA, 13 bp, Homo sapiens
gagtagagaggcc

SEQ ID NO: 6248019 - DNA, 17 bp, Homo sapiens
gagtagaggtataattg

SEQ ID NO: 6248020 - DNA, 18 bp, Homo sapiens
gagtagatattactttat

SEQ ID NO: 6248021 - DNA, 16 bp, Homo sapiens
gagtagatgagccggg

SEQ ID NO: 6248022 - DNA, 14 bp, Homo sapiens
gagtagcaaggaag

SEQ ID NO: 6248023 - DNA, 13 bp, Homo sapiens
gagtagcaccttc

SEQ ID NO: 6248024 - DNA, 18 bp, Homo sapiens
gagtagcatggactctgg

SEQ ID NO: 6248025 - DNA, 12 bp, Homo sapiens
gagtagccatga

SEQ ID NO: 6248026 - DNA, 15 bp, Homo sapiens
gagtagccatgagga

SEQ ID NO: 6248027 - DNA, 20 bp, Homo sapiens
gagtagccatgaggaggcag

SEQ ID NO: 6248028 - DNA, 15 bp, Homo sapiens
gagtagcccaggtca

SEQ ID NO: 6248029 - DNA, 12 bp, Homo sapiens
gagtagcctgga

SEQ ID NO: 6248030 - DNA, 20 bp, Homo sapiens
gagtagcggtccaagcctgc

SEQ ID NO: 6248031 - DNA, 17 bp, Homo sapiens
gagtagctagtttgctt

SEQ ID NO: 6248032 - DNA, 18 bp, Homo sapiens
gagtagctgagaggaaga

SEQ ID NO: 6248033 - DNA, 20 bp, Homo sapiens
gagtagctgagaggaagatg

SEQ ID NO: 6248034 - DNA, 15 bp, Homo sapiens
gagtagctgcagcct

SEQ ID NO: 6248035 - DNA, 12 bp, Homo sapiens
gagtagctggat

SEQ ID NO: 6248036 - DNA, 12 bp, Homo sapiens
gagtagctggga

SEQ ID NO: 6248037 - DNA, 21 bp, Homo sapiens
gagtagctgggactacaggca

SEQ ID NO: 6248038 - DNA, 12 bp, Homo sapiens
gagtagctgggc

SEQ ID NO: 6248039 - DNA, 23 bp, Homo sapiens
gagtaggatgtctcttggaaatg

SEQ ID NO: 6248040 - DNA, 13 bp, Homo sapiens
gagtaggctccag

SEQ ID NO: 6248041 - DNA, 20 bp, Homo sapiens
gagtaggctccagacaggag

SEQ ID NO: 6248042 - DNA, 15 bp, Homo sapiens
gagtaggctgtattt

SEQ ID NO: 6248043 - DNA, 19 bp, Homo sapiens
gagtaggctgtattttctt

SEQ ID NO: 6248044 - DNA, 22 bp, Homo sapiens
gagtagggttgccagtcctgca

SEQ ID NO: 6248045 - DNA, 17 bp, Homo sapiens
gagtaggtctgggatgg

SEQ ID NO: 6248046 - DNA, 16 bp, Homo sapiens
gagtagtcttatgtaa

SEQ ID NO: 6248047 - DNA, 22 bp, Homo sapiens
gagtataatacattacatgtaa

SEQ ID NO: 6248048 - DNA, 17 bp, Homo sapiens
gagtataatgaacactc

SEQ ID NO: 6248049 - DNA, 15 bp, Homo sapiens
gagtatacatgactg

SEQ ID NO: 6248050 - DNA, 18 bp, Homo sapiens
gagtataccatgagatga

SEQ ID NO: 6248051 - DNA, 16 bp, Homo sapiens
gagtatagtgcaaatt

SEQ ID NO: 6248052 - DNA, 19 bp, Homo sapiens
gagtatatatgtacagtta

SEQ ID NO: 6248053 - DNA, 12 bp, Homo sapiens
gagtatatgcac

SEQ ID NO: 6248054 - DNA, 14 bp, Homo sapiens
gagtatatgcactt

SEQ ID NO: 6248055 - DNA, 17 bp, Homo sapiens
gagtatctaatccttta

SEQ ID NO: 6248056 - DNA, 16 bp, Homo sapiens
gagtatctgggaactg

SEQ ID NO: 6248057 - DNA, 14 bp, Homo sapiens
gagtatctgtggga

SEQ ID NO: 6248058 - DNA, 15 bp, Homo sapiens
gagtatctgtgggag

SEQ ID NO: 6248059 - DNA, 18 bp, Homo sapiens
gagtatctttaaatataa

SEQ ID NO: 6248060 - DNA, 21 bp, Homo sapiens
gagtatgcaatgctatcactg

SEQ ID NO: 6248061 - DNA, 17 bp, Homo sapiens
gagtatgccactgcact

SEQ ID NO: 6248062 - DNA, 17 bp, Homo sapiens
gagtatggtgctgggtc

SEQ ID NO: 6248063 - DNA, 21 bp, Homo sapiens
gagtatggtgctgggtcctta

SEQ ID NO: 6248064 - DNA, 18 bp, Homo sapiens
gagtatgtacgtacgtat

SEQ ID NO: 6248065 - DNA, 15 bp, Homo sapiens
gagtatgtgaagata

SEQ ID NO: 6248066 - DNA, 17 bp, Homo sapiens
gagtatgtgtatgtact

SEQ ID NO: 6248067 - DNA, 11 bp, Homo sapiens
gagtatgttgt

SEQ ID NO: 6248068 - DNA, 12 bp, Homo sapiens
gagtatgttgtc

SEQ ID NO: 6248069 - DNA, 16 bp, Homo sapiens
gagtatgttgtcataa

SEQ ID NO: 6248070 - DNA, 20 bp, Homo sapiens
gagtatgttgtcataacatt

SEQ ID NO: 6248071 - DNA, 14 bp, Homo sapiens
gagtattaaaatgt

SEQ ID NO: 6248072 - DNA, 19 bp, Homo sapiens
gagtattaaatatttaaca

SEQ ID NO: 6248073 - DNA, 20 bp, Homo sapiens
gagtattcattttgcaactt

SEQ ID NO: 6248074 - DNA, 22 bp, Homo sapiens
gagtattctcataggagactgc

SEQ ID NO: 6248075 - DNA, 18 bp, Homo sapiens
gagtattgaatggtggtg

SEQ ID NO: 6248076 - DNA, 13 bp, Homo sapiens
gagtatttccctt

SEQ ID NO: 6248077 - DNA, 19 bp, Homo sapiens
gagtatttcccttccaaag

SEQ ID NO: 6248078 - DNA, 20 bp, Homo sapiens
gagtatttcccttccaaaga

SEQ ID NO: 6248079 - DNA, 14 bp, Homo sapiens
gagtatttgctgtt

SEQ ID NO: 6248080 - DNA, 12 bp, Homo sapiens
gagtattttaag

SEQ ID NO: 6248081 - DNA, 17 bp, Homo sapiens
gagtatttttgacagaa

SEQ ID NO: 6248082 - DNA, 12 bp, Homo sapiens
gagtatttttgg

SEQ ID NO: 6248083 - DNA, 13 bp, Homo sapiens
gagtatttttgta

SEQ ID NO: 6248084 - DNA, 17 bp, Homo sapiens
gagtcaaaacacttgta

SEQ ID NO: 6248085 - DNA, 20 bp, Homo sapiens
gagtcaaaacacttgtaatt

SEQ ID NO: 6248086 - DNA, 20 bp, Homo sapiens
gagtcaaaagcctgggtgag

SEQ ID NO: 6248087 - DNA, 12 bp, Homo sapiens
gagtcaaatcca

SEQ ID NO: 6248088 - DNA, 14 bp, Homo sapiens
gagtcaacaaatta

SEQ ID NO: 6248089 - DNA, 14 bp, Homo sapiens
gagtcaacaggtca

SEQ ID NO: 6248090 - DNA, 14 bp, Homo sapiens
gagtcaactggagc

SEQ ID NO: 6248091 - DNA, 14 bp, Homo sapiens
gagtcaaggcctgc

SEQ ID NO: 6248092 - DNA, 21 bp, Homo sapiens
gagtcaaggcctgctccctgt

SEQ ID NO: 6248093 - DNA, 22 bp, Homo sapiens
gagtcaagtaatggaggtccca

SEQ ID NO: 6248094 - DNA, 14 bp, Homo sapiens
gagtcaagttgttc

SEQ ID NO: 6248095 - DNA, 13 bp, Homo sapiens
gagtcaatacata

SEQ ID NO: 6248096 - DNA, 17 bp, Homo sapiens
gagtcaatcagccttta

SEQ ID NO: 6248097 - DNA, 19 bp, Homo sapiens
gagtcaatcccctcattca

SEQ ID NO: 6248098 - DNA, 21 bp, Homo sapiens
gagtcacaaaataaagctgtg

SEQ ID NO: 6248099 - DNA, 12 bp, Homo sapiens
gagtcacacagt

SEQ ID NO: 6248100 - DNA, 20 bp, Homo sapiens
gagtcacagatgaggccccc

SEQ ID NO: 6248101 - DNA, 14 bp, Homo sapiens
gagtcacaggtgtg

SEQ ID NO: 6248102 - DNA, 15 bp, Homo sapiens
gagtcacaggtgtgg

SEQ ID NO: 6248103 - DNA, 18 bp, Homo sapiens
gagtcacaggtgtgggat

SEQ ID NO: 6248104 - DNA, 19 bp, Homo sapiens
gagtcacaggtgtgggatg

SEQ ID NO: 6248105 - DNA, 22 bp, Homo sapiens
gagtcacatcagtgaggaggga

SEQ ID NO: 6248106 - DNA, 14 bp, Homo sapiens
gagtcaccaagccc

SEQ ID NO: 6248107 - DNA, 14 bp, Homo sapiens
gagtcaccacttcc

SEQ ID NO: 6248108 - DNA, 17 bp, Homo sapiens
gagtcaccacttcctct

SEQ ID NO: 6248109 - DNA, 12 bp, Homo sapiens
gagtcacccccc

SEQ ID NO: 6248110 - DNA, 19 bp, Homo sapiens
gagtcacccctctgtccag

SEQ ID NO: 6248111 - DNA, 14 bp, Homo sapiens
gagtcacctgcaag

SEQ ID NO: 6248112 - DNA, 13 bp, Homo sapiens
gagtcacctgctc

SEQ ID NO: 6248113 - DNA, 14 bp, Homo sapiens
gagtcaccttccag

SEQ ID NO: 6248114 - DNA, 21 bp, Homo sapiens
gagtcaccttccaggacccct

SEQ ID NO: 6248115 - DNA, 20 bp, Homo sapiens
gagtcaccttttctgtggct

SEQ ID NO: 6248116 - DNA, 15 bp, Homo sapiens
gagtcactgagacca

SEQ ID NO: 6248117 - DNA, 21 bp, Homo sapiens
gagtcactggaacactaatga

SEQ ID NO: 6248118 - DNA, 20 bp, Homo sapiens
gagtcagaatgtgaaaaagg

SEQ ID NO: 6248119 - DNA, 19 bp, Homo sapiens
gagtcagatgagcaaggac

SEQ ID NO: 6248120 - DNA, 17 bp, Homo sapiens
gagtcagatgaggccct

SEQ ID NO: 6248121 - DNA, 18 bp, Homo sapiens
gagtcagatgaggccctg

SEQ ID NO: 6248122 - DNA, 17 bp, Homo sapiens
gagtcagcaccttggcc

SEQ ID NO: 6248123 - DNA, 18 bp, Homo sapiens
gagtcagctctctgccct

SEQ ID NO: 6248124 - DNA, 20 bp, Homo sapiens
gagtcagctgaccccctccc

SEQ ID NO: 6248125 - DNA, 23 bp, Homo sapiens
gagtcaggagttttactgcctgt

SEQ ID NO: 6248126 - DNA, 22 bp, Homo sapiens
gagtcaggcagggttaaactgc

SEQ ID NO: 6248127 - DNA, 19 bp, Homo sapiens
gagtcaggcccggcctatt

SEQ ID NO: 6248128 - DNA, 12 bp, Homo sapiens
gagtcaggcctg

SEQ ID NO: 6248129 - DNA, 17 bp, Homo sapiens
gagtcagggacccctgc

SEQ ID NO: 6248130 - DNA, 18 bp, Homo sapiens
gagtcagggacccctgcc

SEQ ID NO: 6248131 - DNA, 22 bp, Homo sapiens
gagtcagggacccctgcccttg

SEQ ID NO: 6248132 - DNA, 18 bp, Homo sapiens
gagtcagggacctgctgc

SEQ ID NO: 6248133 - DNA, 21 bp, Homo sapiens
gagtcagggacctgctgctca

SEQ ID NO: 6248134 - DNA, 22 bp, Homo sapiens
gagtcagggacctgctgctcag

SEQ ID NO: 6248135 - DNA, 16 bp, Homo sapiens
gagtcagggagccctg

SEQ ID NO: 6248136 - DNA, 17 bp, Homo sapiens
gagtcagggagccctgg

SEQ ID NO: 6248137 - DNA, 18 bp, Homo sapiens
gagtcagggagccctggg

SEQ ID NO: 6248138 - DNA, 15 bp, Homo sapiens
gagtcaggggctctg

SEQ ID NO: 6248139 - DNA, 17 bp, Homo sapiens
gagtcaggggctctgtg

SEQ ID NO: 6248140 - DNA, 16 bp, Homo sapiens
gagtcagggtgaactg

SEQ ID NO: 6248141 - DNA, 18 bp, Homo sapiens
gagtcaggtttggggttc

SEQ ID NO: 6248142 - DNA, 15 bp, Homo sapiens
gagtcagtcgccttt

SEQ ID NO: 6248143 - DNA, 18 bp, Homo sapiens
gagtcagtctctttctgt

SEQ ID NO: 6248144 - DNA, 20 bp, Homo sapiens
gcccctgagcctgtgtcctg

SEQ ID NO: 6248145 - DNA, 19 bp, Homo sapiens
gcccctgaggactggagac

SEQ ID NO: 6248146 - DNA, 14 bp, Homo sapiens
gcccctgaggagct

SEQ ID NO: 6248147 - DNA, 15 bp, Homo sapiens
gcccctgaggcagcc

SEQ ID NO: 6248148 - DNA, 22 bp, Homo sapiens
gcccctgagggacgagcagagc

SEQ ID NO: 6248149 - DNA, 15 bp, Homo sapiens
gcccctgagtccgcc

SEQ ID NO: 6248150 - DNA, 17 bp, Homo sapiens
gcccctgagtccgcctg

SEQ ID NO: 6248151 - DNA, 20 bp, Homo sapiens
gcccctgagtccgcctgcgc

SEQ ID NO: 6248152 - DNA, 21 bp, Homo sapiens
gcccctgagtccgcctgcgcc

SEQ ID NO: 6248153 - DNA, 22 bp, Homo sapiens
gcccctgagtccgcctgcgcct

SEQ ID NO: 6248154 - DNA, 16 bp, Homo sapiens
gcccctgatcactccc

SEQ ID NO: 6248155 - DNA, 14 bp, Homo sapiens
gcccctgatctctg

SEQ ID NO: 6248156 - DNA, 18 bp, Homo sapiens
gcccctgatctctgacct

SEQ ID NO: 6248157 - DNA, 21 bp, Homo sapiens
gcccctgatctctgacctctg

SEQ ID NO: 6248158 - DNA, 22 bp, Homo sapiens
gcccctgatgacgggatgctct

SEQ ID NO: 6248159 - DNA, 16 bp, Homo sapiens
gcccctgatgcagcct

SEQ ID NO: 6248160 - DNA, 21 bp, Homo sapiens
gcccctgatgcagcctgtggc

SEQ ID NO: 6248161 - DNA, 14 bp, Homo sapiens
gcccctgcacagca

SEQ ID NO: 6248162 - DNA, 23 bp, Homo sapiens
gcccctgcacagcaggctgccag

SEQ ID NO: 6248163 - DNA, 23 bp, Homo sapiens
gcccctgcagcacggacaataaa

SEQ ID NO: 6248164 - DNA, 12 bp, Homo sapiens
gcccctgcagct

SEQ ID NO: 6248165 - DNA, 22 bp, Homo sapiens
gcccctgcagtttggccctgga

SEQ ID NO: 6248166 - DNA, 15 bp, Homo sapiens
gcccctgcatgcctg

SEQ ID NO: 6248167 - DNA, 13 bp, Homo sapiens
gcccctgccaccc

SEQ ID NO: 6248168 - DNA, 17 bp, Homo sapiens
gcccctgccaccctggg

SEQ ID NO: 6248169 - DNA, 18 bp, Homo sapiens
gcccctgccacctccctg

SEQ ID NO: 6248170 - DNA, 23 bp, Homo sapiens
gcccctgccacctcctgcctcag

SEQ ID NO: 6248171 - DNA, 21 bp, Homo sapiens
gcccctgccattgtagcgtct

SEQ ID NO: 6248172 - DNA, 15 bp, Homo sapiens
gcccctgcccacgcc

SEQ ID NO: 6248173 - DNA, 14 bp, Homo sapiens
gcccctgcccagca

SEQ ID NO: 6248174 - DNA, 15 bp, Homo sapiens
gcccctgccccaacc

SEQ ID NO: 6248175 - DNA, 16 bp, Homo sapiens
gcccctgccccgcccc

SEQ ID NO: 6248176 - DNA, 15 bp, Homo sapiens
gcccctgccccgtca

SEQ ID NO: 6248177 - DNA, 13 bp, Homo sapiens
gcccctgccccta

SEQ ID NO: 6248178 - DNA, 19 bp, Homo sapiens
gcccctgcccctcatgcca

SEQ ID NO: 6248179 - DNA, 15 bp, Homo sapiens
gcccctgcccggctg

SEQ ID NO: 6248180 - DNA, 12 bp, Homo sapiens
gcccctgcctcc

SEQ ID NO: 6248181 - DNA, 18 bp, Homo sapiens
gcccctgcctctctgcag

SEQ ID NO: 6248182 - DNA, 20 bp, Homo sapiens
gcccctgcctgacagccttc

SEQ ID NO: 6248183 - DNA, 21 bp, Homo sapiens
gcccctgcctgacagccttcc

SEQ ID NO: 6248184 - DNA, 16 bp, Homo sapiens
gcccctgcctgagacc

SEQ ID NO: 6248185 - DNA, 12 bp, Homo sapiens
gcccctgcctgc

SEQ ID NO: 6248186 - DNA, 22 bp, Homo sapiens
gcccctgcctgccatgtacctc

SEQ ID NO: 6248187 - DNA, 14 bp, Homo sapiens
gcccctgcctgcct

SEQ ID NO: 6248188 - DNA, 16 bp, Homo sapiens
gcccctgcctgctgga

SEQ ID NO: 6248189 - DNA, 19 bp, Homo sapiens
gcccctgcctgtgcccgca

SEQ ID NO: 6248190 - DNA, 18 bp, Homo sapiens
gcccctgcggccgtcacc

SEQ ID NO: 6248191 - DNA, 16 bp, Homo sapiens
gcccctgcgtgtgttc

SEQ ID NO: 6248192 - DNA, 21 bp, Homo sapiens
gcccctgcgtgtgttctctcc

SEQ ID NO: 6248193 - DNA, 19 bp, Homo sapiens
gcccctgctcactgggccc

SEQ ID NO: 6248194 - DNA, 19 bp, Homo sapiens
gcccctgctctgtagccac

SEQ ID NO: 6248195 - DNA, 22 bp, Homo sapiens
gcccctgctctgtagccacctc

SEQ ID NO: 6248196 - DNA, 17 bp, Homo sapiens
gcccctgctgcctcccc

SEQ ID NO: 6248197 - DNA, 23 bp, Homo sapiens
gcccctgctgctcctcggccaga

SEQ ID NO: 6248198 - DNA, 20 bp, Homo sapiens
gcccctgctgctgtcacctc

SEQ ID NO: 6248199 - DNA, 22 bp, Homo sapiens
gcccctgctgctgtcacctctc

SEQ ID NO: 6248200 - DNA, 22 bp, Homo sapiens
gcccctgctgcttaagtgcatg

SEQ ID NO: 6248201 - DNA, 17 bp, Homo sapiens
gcccctgctgcttggga

SEQ ID NO: 6248202 - DNA, 15 bp, Homo sapiens
gcccctgctggacca

SEQ ID NO: 6248203 - DNA, 12 bp, Homo sapiens
gcccctgctgtc

SEQ ID NO: 6248204 - DNA, 18 bp, Homo sapiens
gcccctgctgtctctctg

SEQ ID NO: 6248205 - DNA, 20 bp, Homo sapiens
gcccctgctgtctctctggg

SEQ ID NO: 6248206 - DNA, 15 bp, Homo sapiens
gcccctgcttctcca

SEQ ID NO: 6248207 - DNA, 19 bp, Homo sapiens
gcccctgcttctccagcct

SEQ ID NO: 6248208 - DNA, 20 bp, Homo sapiens
gcccctggaacctttccctt

SEQ ID NO: 6248209 - DNA, 17 bp, Homo sapiens
gcccctggacatgcctg

SEQ ID NO: 6248210 - DNA, 19 bp, Homo sapiens
gcccctggacatgcctgtc

SEQ ID NO: 6248211 - DNA, 21 bp, Homo sapiens
gcccctggacatgcctgtcct

SEQ ID NO: 6248212 - DNA, 20 bp, Homo sapiens
gcccctggacccctggggtg

SEQ ID NO: 6248213 - DNA, 15 bp, Homo sapiens
gcccctggagcctca

SEQ ID NO: 6248214 - DNA, 11 bp, Homo sapiens
gcccctggagg

SEQ ID NO: 6248215 - DNA, 23 bp, Homo sapiens
gcccctggcaaatgcacacacct

SEQ ID NO: 6248216 - DNA, 12 bp, Homo sapiens
gcccctggcact

SEQ ID NO: 6248217 - DNA, 16 bp, Homo sapiens
gcccctggcactgcag

SEQ ID NO: 6248218 - DNA, 17 bp, Homo sapiens
gcccctggcactgcagg

SEQ ID NO: 6248219 - DNA, 17 bp, Homo sapiens
gcccctggcagagatgc

SEQ ID NO: 6248220 - DNA, 15 bp, Homo sapiens
gcccctggcagcaca

SEQ ID NO: 6248221 - DNA, 21 bp, Homo sapiens
gcccctggcagcacagcccag

SEQ ID NO: 6248222 - DNA, 23 bp, Homo sapiens
gcccctggcagcacagcccaggg

SEQ ID NO: 6248223 - DNA, 23 bp, Homo sapiens
gcccctggcccagcggcccctcc

SEQ ID NO: 6248224 - DNA, 14 bp, Homo sapiens
gcccctggcccagg

SEQ ID NO: 6248225 - DNA, 16 bp, Homo sapiens
gcccctggcccaggag

SEQ ID NO: 6248226 - DNA, 17 bp, Homo sapiens
gcccctggcccaggagg

SEQ ID NO: 6248227 - DNA, 16 bp, Homo sapiens
gcccctggcccatctc

SEQ ID NO: 6248228 - DNA, 21 bp, Homo sapiens
gcccctggcccatctcagcct

SEQ ID NO: 6248229 - DNA, 15 bp, Homo sapiens
gcccctggccctgcc

SEQ ID NO: 6248230 - DNA, 19 bp, Homo sapiens
gcccctggccgcgctccgg

SEQ ID NO: 6248231 - DNA, 20 bp, Homo sapiens
gcccctggccgcgctccggg

SEQ ID NO: 6248232 - DNA, 16 bp, Homo sapiens
gcccctggctgggacg

SEQ ID NO: 6248233 - DNA, 13 bp, Homo sapiens
gcccctggctttg

SEQ ID NO: 6248234 - DNA, 19 bp, Homo sapiens
gcccctggctttgcctctt

SEQ ID NO: 6248235 - DNA, 14 bp, Homo sapiens
gcccctgggaacag

SEQ ID NO: 6248236 - DNA, 22 bp, Homo sapiens
gcccctgggaacaggccccacg

SEQ ID NO: 6248237 - DNA, 14 bp, Homo sapiens
gcccctgggactaa

SEQ ID NO: 6248238 - DNA, 17 bp, Homo sapiens
gcccctgggactaaagc

SEQ ID NO: 6248239 - DNA, 20 bp, Homo sapiens
gcccctgggatccgagggcc

SEQ ID NO: 6248240 - DNA, 22 bp, Homo sapiens
gcccctgggatgggaccaggga

SEQ ID NO: 6248241 - DNA, 19 bp, Homo sapiens
gcccctgggcccttgtgct

SEQ ID NO: 6248242 - DNA, 11 bp, Homo sapiens
gcccctgggct

SEQ ID NO: 6248243 - DNA, 13 bp, Homo sapiens
gcccctgggctac

SEQ ID NO: 6248244 - DNA, 14 bp, Homo sapiens
gcccctgggctctc

SEQ ID NO: 6248245 - DNA, 16 bp, Homo sapiens
gcccctgggctctcac

SEQ ID NO: 6248246 - DNA, 12 bp, Homo sapiens
gcccctgggctt

SEQ ID NO: 6248247 - DNA, 18 bp, Homo sapiens
gcccctgggcttggcctg

SEQ ID NO: 6248248 - DNA, 18 bp, Homo sapiens
gcccctggggacagagcc

SEQ ID NO: 6248249 - DNA, 19 bp, Homo sapiens
gcccctggggacagagcca

SEQ ID NO: 6248250 - DNA, 23 bp, Homo sapiens
gcccctggggacagagccacccc

SEQ ID NO: 6248251 - DNA, 20 bp, Homo sapiens
gcccctggggatcttgcccc

SEQ ID NO: 6248252 - DNA, 12 bp, Homo sapiens
gcccctggggcc

SEQ ID NO: 6248253 - DNA, 18 bp, Homo sapiens
gcccctggggcccagccc

SEQ ID NO: 6248254 - DNA, 20 bp, Homo sapiens
gcccctggggcccagcccct

SEQ ID NO: 6248255 - DNA, 21 bp, Homo sapiens
gcccctgggtcagtctggtgg

SEQ ID NO: 6248256 - DNA, 21 bp, Homo sapiens
gcccctgggtgggtggtgggg

SEQ ID NO: 6248257 - DNA, 11 bp, Homo sapiens
gcccctgggtt

SEQ ID NO: 6248258 - DNA, 17 bp, Homo sapiens
gcccctggtaagcagag

SEQ ID NO: 6248259 - DNA, 16 bp, Homo sapiens
gcccctggtctgccct

SEQ ID NO: 6248260 - DNA, 19 bp, Homo sapiens
gcccctggtgccctgagac

SEQ ID NO: 6248261 - DNA, 13 bp, Homo sapiens
gcccctggtggca

SEQ ID NO: 6248262 - DNA, 20 bp, Homo sapiens
gcccctgtaaggtttcaatg

SEQ ID NO: 6248263 - DNA, 21 bp, Homo sapiens
gcccctgtccatccgtctctg

SEQ ID NO: 6248264 - DNA, 22 bp, Homo sapiens
gcccctgtccatccgtctctgt

SEQ ID NO: 6248265 - DNA, 17 bp, Homo sapiens
gcccctgtcccacctgg

SEQ ID NO: 6248266 - DNA, 18 bp, Homo sapiens
gcccctgtcccacctggc

SEQ ID NO: 6248267 - DNA, 19 bp, Homo sapiens
gcccctgtcccacctggct

SEQ ID NO: 6248268 - DNA, 22 bp, Homo sapiens
gcccctgtcccacctggctccc

SEQ ID NO: 6248269 - DNA, 12 bp, Homo sapiens
gcccctgtcccc

SEQ ID NO: 6248270 - DNA, 23 bp, Homo sapiens
gcccctgtcgcccacccagctgg

SEQ ID NO: 6248271 - DNA, 19 bp, Homo sapiens
gcccctgtctaacctacga

SEQ ID NO: 6248272 - DNA, 16 bp, Homo sapiens
gcccctgtctcggggc

SEQ ID NO: 6248273 - DNA, 19 bp, Homo sapiens
gcccctgtctgttcccagc

SEQ ID NO: 6248274 - DNA, 14 bp, Homo sapiens
gcccctgtgaccct

SEQ ID NO: 6248275 - DNA, 14 bp, Homo sapiens
gcccctgtgcctct

SEQ ID NO: 6248276 - DNA, 19 bp, Homo sapiens
gcccctgtgcctctgtcct

SEQ ID NO: 6248277 - DNA, 16 bp, Homo sapiens
gcccctgtgctgcggg

SEQ ID NO: 6248278 - DNA, 14 bp, Homo sapiens
gcccctgtggccaa

SEQ ID NO: 6248279 - DNA, 16 bp, Homo sapiens
gcccctgtggccaact

SEQ ID NO: 6248280 - DNA, 20 bp, Homo sapiens
gcccctgtggccaactgcaa

SEQ ID NO: 6248281 - DNA, 21 bp, Homo sapiens
gcccctgtggccaactgcaaa

SEQ ID NO: 6248282 - DNA, 14 bp, Homo sapiens
gcccctgtggccct

SEQ ID NO: 6248283 - DNA, 22 bp, Homo sapiens
gcccctgtgggactcatccttg

SEQ ID NO: 6248284 - DNA, 21 bp, Homo sapiens
gcccctgtgtattcaccacca

SEQ ID NO: 6248285 - DNA, 18 bp, Homo sapiens
gcccctgtgtcggggggc

SEQ ID NO: 6248286 - DNA, 12 bp, Homo sapiens
gcccctgtgtga

SEQ ID NO: 6248287 - DNA, 18 bp, Homo sapiens
gcccctgtgtgagttgag

SEQ ID NO: 6248288 - DNA, 18 bp, Homo sapiens
gcccctgtgtgggagggc

SEQ ID NO: 6248289 - DNA, 21 bp, Homo sapiens
gcccctgtgtgggagggcgag

SEQ ID NO: 6248290 - DNA, 15 bp, Homo sapiens
gcccctgtttctcct

SEQ ID NO: 6248291 - DNA, 19 bp, Homo sapiens
gccccttaaacacaggctg

SEQ ID NO: 6248292 - DNA, 17 bp, Homo sapiens
gccccttaagggaaagg

SEQ ID NO: 6248293 - DNA, 20 bp, Homo sapiens
gccccttactatgatctcag

SEQ ID NO: 6248294 - DNA, 21 bp, Homo sapiens
gccccttactatgatctcagg

SEQ ID NO: 6248295 - DNA, 22 bp, Homo sapiens
gccccttactatgatctcagga

SEQ ID NO: 6248296 - DNA, 22 bp, Homo sapiens
gccccttagcccccacccactt

SEQ ID NO: 6248297 - DNA, 15 bp, Homo sapiens
gccccttaggccagt

SEQ ID NO: 6248298 - DNA, 15 bp, Homo sapiens
gccccttcactcatt

SEQ ID NO: 6248299 - DNA, 20 bp, Homo sapiens
gccccttcatccgcctgtgg

SEQ ID NO: 6248300 - DNA, 23 bp, Homo sapiens
gccccttcattgatttcctgtgt

SEQ ID NO: 6248301 - DNA, 13 bp, Homo sapiens
gccccttcccacg

SEQ ID NO: 6248302 - DNA, 16 bp, Homo sapiens
gccccttccccgaggg

SEQ ID NO: 6248303 - DNA, 12 bp, Homo sapiens
gccccttcccct

SEQ ID NO: 6248304 - DNA, 15 bp, Homo sapiens
gccccttcccctggg

SEQ ID NO: 6248305 - DNA, 16 bp, Homo sapiens
gccccttcccctggga

SEQ ID NO: 6248306 - DNA, 18 bp, Homo sapiens
gccccttcccctgggaac

SEQ ID NO: 6248307 - DNA, 21 bp, Homo sapiens
gccccttccctctctccctgc

SEQ ID NO: 6248308 - DNA, 12 bp, Homo sapiens
gccccttccctt

SEQ ID NO: 6248309 - DNA, 13 bp, Homo sapiens
gccccttcccttc

SEQ ID NO: 6248310 - DNA, 22 bp, Homo sapiens
gccccttcctgggtatttattc

SEQ ID NO: 6248311 - DNA, 18 bp, Homo sapiens
gccccttctacactctcc

SEQ ID NO: 6248312 - DNA, 20 bp, Homo sapiens
gccccttctacactctcctg

SEQ ID NO: 6248313 - DNA, 13 bp, Homo sapiens
gccccttctatgc

SEQ ID NO: 6248314 - DNA, 23 bp, Homo sapiens
gccccttctatgcccagctgtgc

SEQ ID NO: 6248315 - DNA, 21 bp, Homo sapiens
gccccttctatgctgcttcca

SEQ ID NO: 6248316 - DNA, 17 bp, Homo sapiens
gccccttctccagcaag

SEQ ID NO: 6248317 - DNA, 12 bp, Homo sapiens
gccccttctccc

SEQ ID NO: 6248318 - DNA, 17 bp, Homo sapiens
gccccttctctccctgc

SEQ ID NO: 6248319 - DNA, 19 bp, Homo sapiens
gccccttctgacccatgct

SEQ ID NO: 6248320 - DNA, 14 bp, Homo sapiens
gccccttctggccg

SEQ ID NO: 6248321 - DNA, 18 bp, Homo sapiens
gccccttctgtttccata

SEQ ID NO: 6248322 - DNA, 17 bp, Homo sapiens
gccccttcttccaagga

SEQ ID NO: 6248323 - DNA, 14 bp, Homo sapiens
gccccttgacccca

SEQ ID NO: 6248324 - DNA, 13 bp, Homo sapiens
gccccttgccatc

SEQ ID NO: 6248325 - DNA, 17 bp, Homo sapiens
gccccttgctgctggct

SEQ ID NO: 6248326 - DNA, 15 bp, Homo sapiens
gccccttgcttctca

SEQ ID NO: 6248327 - DNA, 13 bp, Homo sapiens
gccccttggagag

SEQ ID NO: 6248328 - DNA, 19 bp, Homo sapiens
gccccttggattcctgcac

SEQ ID NO: 6248329 - DNA, 18 bp, Homo sapiens
gccccttggctggatcag

SEQ ID NO: 6248330 - DNA, 22 bp, Homo sapiens
gccccttggctggatcagggaa

SEQ ID NO: 6248331 - DNA, 13 bp, Homo sapiens
gccccttgggcat

SEQ ID NO: 6248332 - DNA, 13 bp, Homo sapiens
gccccttgggcct

SEQ ID NO: 6248333 - DNA, 14 bp, Homo sapiens
gccccttgggcctc

SEQ ID NO: 6248334 - DNA, 15 bp, Homo sapiens
gccccttgggcctcc

SEQ ID NO: 6248335 - DNA, 17 bp, Homo sapiens
gccccttgggcctccca

SEQ ID NO: 6248336 - DNA, 16 bp, Homo sapiens
gccccttggggagcag

SEQ ID NO: 6248337 - DNA, 13 bp, Homo sapiens
gccccttggtcct

SEQ ID NO: 6248338 - DNA, 18 bp, Homo sapiens
gccccttgtcctctcccg

SEQ ID NO: 6248339 - DNA, 19 bp, Homo sapiens
gccccttgtcctgaagccc

SEQ ID NO: 6248340 - DNA, 16 bp, Homo sapiens
gcccctttcaggccta

SEQ ID NO: 6248341 - DNA, 13 bp, Homo sapiens
gcccctttccaaa

SEQ ID NO: 6248342 - DNA, 23 bp, Homo sapiens
gcccctttcccttgtagctcctc

SEQ ID NO: 6248343 - DNA, 13 bp, Homo sapiens
gcccctttccttc

SEQ ID NO: 6248344 - DNA, 18 bp, Homo sapiens
gcccctttctcttgctgt

SEQ ID NO: 6248345 - DNA, 14 bp, Homo sapiens
gcccctttgcctct

SEQ ID NO: 6248346 - DNA, 14 bp, Homo sapiens
gcccctttgcctgt

SEQ ID NO: 6248347 - DNA, 16 bp, Homo sapiens
gcccctttgctgaccc

SEQ ID NO: 6248348 - DNA, 16 bp, Homo sapiens
gcccctttgggccctg

SEQ ID NO: 6248349 - DNA, 17 bp, Homo sapiens
gcccctttgggccctgc

SEQ ID NO: 6248350 - DNA, 20 bp, Homo sapiens
gcccctttgggccctgcatg

SEQ ID NO: 6248351 - DNA, 18 bp, Homo sapiens
gccccttttctctgctct

SEQ ID NO: 6248352 - DNA, 16 bp, Homo sapiens
gccccttttctttggg

SEQ ID NO: 6248353 - DNA, 21 bp, Homo sapiens
gcccgaaactaagccaggcct

SEQ ID NO: 6248354 - DNA, 13 bp, Homo sapiens
gcccgaaagctga

SEQ ID NO: 6248355 - DNA, 12 bp, Homo sapiens
gcccgaagccca

SEQ ID NO: 6248356 - DNA, 13 bp, Homo sapiens
gcccgaagcccag

SEQ ID NO: 6248357 - DNA, 12 bp, Homo sapiens
gcccgaagctct

SEQ ID NO: 6248358 - DNA, 13 bp, Homo sapiens
gcccgaatacaaa

SEQ ID NO: 6248359 - DNA, 21 bp, Homo sapiens
gcccgaatttctcactccctt

SEQ ID NO: 6248360 - DNA, 13 bp, Homo sapiens
gcccgacagagag

SEQ ID NO: 6248361 - DNA, 14 bp, Homo sapiens
gcccgacagagaga

SEQ ID NO: 6248362 - DNA, 19 bp, Homo sapiens
gcccgacagagagatgaag

SEQ ID NO: 6248363 - DNA, 16 bp, Homo sapiens
gcccgacagcctggca

SEQ ID NO: 6248364 - DNA, 22 bp, Homo sapiens
gcccgacaggtgggcctgggag

SEQ ID NO: 6248365 - DNA, 17 bp, Homo sapiens
gcccgacagtgccatcc

SEQ ID NO: 6248366 - DNA, 23 bp, Homo sapiens
gcccgacagtgccatccccacct

SEQ ID NO: 6248367 - DNA, 19 bp, Homo sapiens
gcccgacatggctccggcc

SEQ ID NO: 6248368 - DNA, 24 bp, Homo sapiens
gcccgacatggctccggcctctgc

SEQ ID NO: 6248369 - DNA, 14 bp, Homo sapiens
gcccgacatttctt

SEQ ID NO: 6248370 - DNA, 19 bp, Homo sapiens
gcccgaccccatctcattc

SEQ ID NO: 6248371 - DNA, 14 bp, Homo sapiens
gcccgactagcagg

SEQ ID NO: 6248372 - DNA, 17 bp, Homo sapiens
gcccgagagctcttagt

SEQ ID NO: 6248373 - DNA, 22 bp, Homo sapiens
gcccgagagctcttagttttta

SEQ ID NO: 6248374 - DNA, 13 bp, Homo sapiens
gcccgagcagctg

SEQ ID NO: 6248375 - DNA, 14 bp, Homo sapiens
gcccgagcagctga

SEQ ID NO: 6248376 - DNA, 17 bp, Homo sapiens
gcccgagcagctgagca

SEQ ID NO: 6248377 - DNA, 19 bp, Homo sapiens
gcccgagcagctgagcagg

SEQ ID NO: 6248378 - DNA, 13 bp, Homo sapiens
gcccgagcccctt

SEQ ID NO: 6248379 - DNA, 16 bp, Homo sapiens
gcccgagccccttggg

SEQ ID NO: 6248380 - DNA, 22 bp, Homo sapiens
gcccgaggaaggtgtgtggaga

SEQ ID NO: 6248381 - DNA, 22 bp, Homo sapiens
gcccgaggaggtgtctcaggct

SEQ ID NO: 6248382 - DNA, 23 bp, Homo sapiens
gcccgaggaggtgtctcaggctg

SEQ ID NO: 6248383 - DNA, 22 bp, Homo sapiens
gcccgagggaggggaagcttct

SEQ ID NO: 6248384 - DNA, 23 bp, Homo sapiens
gcccgagggaggggaagcttctg

SEQ ID NO: 6248385 - DNA, 13 bp, Homo sapiens
gcccgagggcagc

SEQ ID NO: 6248386 - DNA, 14 bp, Homo sapiens
gcccgagggcagcc

SEQ ID NO: 6248387 - DNA, 17 bp, Homo sapiens
gcccgagggtcccaagg

SEQ ID NO: 6248388 - DNA, 16 bp, Homo sapiens
gcccgaggtggctgcc

SEQ ID NO: 6248389 - DNA, 17 bp, Homo sapiens
gcccgaggtggctgcct

SEQ ID NO: 6248390 - DNA, 14 bp, Homo sapiens
gcccgaggttcctg

SEQ ID NO: 6248391 - DNA, 16 bp, Homo sapiens
gcccgaggttcctgtc

SEQ ID NO: 6248392 - DNA, 14 bp, Homo sapiens
gcccgagtccgccc

SEQ ID NO: 6248393 - DNA, 17 bp, Homo sapiens
gcccgagtgcggcgtgg

SEQ ID NO: 6248394 - DNA, 18 bp, Homo sapiens
gcccgagtgcggcgtgga

SEQ ID NO: 6248395 - DNA, 21 bp, Homo sapiens
gcccgagtgcggcgtggagac

SEQ ID NO: 6248396 - DNA, 16 bp, Homo sapiens
gcccgatattctccct

SEQ ID NO: 6248397 - DNA, 17 bp, Homo sapiens
gcccgatcctcccctgg

SEQ ID NO: 6248398 - DNA, 20 bp, Homo sapiens
gcccgatcctcccctggact

SEQ ID NO: 6248399 - DNA, 21 bp, Homo sapiens
gcccgcaagagggacagagcc

SEQ ID NO: 6248400 - DNA, 22 bp, Homo sapiens
gcccgcaagagggacagagccc

SEQ ID NO: 6248401 - DNA, 13 bp, Homo sapiens
gcccgcacaccct

SEQ ID NO: 6248402 - DNA, 22 bp, Homo sapiens
gcccgcacaccctcactctgcc

SEQ ID NO: 6248403 - DNA, 17 bp, Homo sapiens
gcccgcacagcagcctg

SEQ ID NO: 6248404 - DNA, 12 bp, Homo sapiens
gcccgcaccccc

SEQ ID NO: 6248405 - DNA, 16 bp, Homo sapiens
gcccgcacccccaccc

SEQ ID NO: 6248406 - DNA, 19 bp, Homo sapiens
gcccgcacccccacccttt

SEQ ID NO: 6248407 - DNA, 21 bp, Homo sapiens
gcccgcacccccaccctttgg

SEQ ID NO: 6248408 - DNA, 13 bp, Homo sapiens
gcccgcacccccg

SEQ ID NO: 6248409 - DNA, 21 bp, Homo sapiens
gcccgcaccccggcctcaggg

SEQ ID NO: 6248410 - DNA, 22 bp, Homo sapiens
gcccgcaccccggcctcagggc

SEQ ID NO: 6248411 - DNA, 16 bp, Homo sapiens
gcccgcaccctggcct

SEQ ID NO: 6248412 - DNA, 17 bp, Homo sapiens
gcccgcaccctggcctg

SEQ ID NO: 6248413 - DNA, 17 bp, Homo sapiens
gcccgcactcaggagca

SEQ ID NO: 6248414 - DNA, 18 bp, Homo sapiens
gcccgcactcaggagcac

SEQ ID NO: 6248415 - DNA, 14 bp, Homo sapiens
gcccgcactggggg

SEQ ID NO: 6248416 - DNA, 21 bp, Homo sapiens
gcccgcactgtcccagtagcc

SEQ ID NO: 6248417 - DNA, 15 bp, Homo sapiens
gcccgcagacctctg

SEQ ID NO: 6248418 - DNA, 22 bp, Homo sapiens
gcccgcagaggtggggtgctgg

SEQ ID NO: 6248419 - DNA, 14 bp, Homo sapiens
gcccgcagcccaga

SEQ ID NO: 6248420 - DNA, 16 bp, Homo sapiens
gcccgcagcccagacc

SEQ ID NO: 6248421 - DNA, 17 bp, Homo sapiens
gcccgcagcccagaccc

SEQ ID NO: 6248422 - DNA, 19 bp, Homo sapiens
gcccgcaggaactgggctg

SEQ ID NO: 6248423 - DNA, 13 bp, Homo sapiens
gcccgcagggcca

SEQ ID NO: 6248424 - DNA, 19 bp, Homo sapiens
gcccgcagggccatgcaga

SEQ ID NO: 6248425 - DNA, 22 bp, Homo sapiens
gcccgcagggccatgcagacct

SEQ ID NO: 6248426 - DNA, 14 bp, Homo sapiens
gcccgcagtgctgg

SEQ ID NO: 6248427 - DNA, 23 bp, Homo sapiens
gcccgcagtgctgggaccagagc

SEQ ID NO: 6248428 - DNA, 16 bp, Homo sapiens
gcccgcatgcagcagc

SEQ ID NO: 6248429 - DNA, 17 bp, Homo sapiens
gcccgcatgcggcccag

SEQ ID NO: 6248430 - DNA, 17 bp, Homo sapiens
gcccgcatgtgtgcctg

SEQ ID NO: 6248431 - DNA, 21 bp, Homo sapiens
gcccgcatgtgtgcctggccg

SEQ ID NO: 6248432 - DNA, 15 bp, Homo sapiens
gcccgccagcctcag

SEQ ID NO: 6248433 - DNA, 17 bp, Homo sapiens
gcccgccagcctcagtg

SEQ ID NO: 6248434 - DNA, 13 bp, Homo sapiens
gcccgcccacccc

SEQ ID NO: 6248435 - DNA, 14 bp, Homo sapiens
gcccgcccaccccg

SEQ ID NO: 6248436 - DNA, 18 bp, Homo sapiens
gcccgcccacctctgctg

SEQ ID NO: 6248437 - DNA, 15 bp, Homo sapiens
gcccgcccacctggg

SEQ ID NO: 6248438 - DNA, 14 bp, Homo sapiens
gcccgcccactgtc

SEQ ID NO: 6248439 - DNA, 17 bp, Homo sapiens
gcccgcccactgtcctg

SEQ ID NO: 6248440 - DNA, 16 bp, Homo sapiens
gcccgcccccgccctc

SEQ ID NO: 6248441 - DNA, 14 bp, Homo sapiens
gcccgcccctgcag

SEQ ID NO: 6248442 - DNA, 16 bp, Homo sapiens
gcccgccctcctctgc

SEQ ID NO: 6248443 - DNA, 18 bp, Homo sapiens
gcccgccctcctctgccc

SEQ ID NO: 6248444 - DNA, 12 bp, Homo sapiens
gcccgccctctg

SEQ ID NO: 6248445 - DNA, 20 bp, Homo sapiens
gcccgccctctgcctcctca

SEQ ID NO: 6248446 - DNA, 12 bp, Homo sapiens
gcccgccctgcc

SEQ ID NO: 6248447 - DNA, 14 bp, Homo sapiens
gcccgccctgcccc

SEQ ID NO: 6248448 - DNA, 14 bp, Homo sapiens
gcccgccctgggct

SEQ ID NO: 6248449 - DNA, 17 bp, Homo sapiens
gcccgccggttggccgg

SEQ ID NO: 6248450 - DNA, 18 bp, Homo sapiens
gcccgcctaagaccctga

SEQ ID NO: 6248451 - DNA, 14 bp, Homo sapiens
gcccgcctctgcct

SEQ ID NO: 6248452 - DNA, 13 bp, Homo sapiens
gcccgcctgccag

SEQ ID NO: 6248453 - DNA, 14 bp, Homo sapiens
gcccgcctgccagt

SEQ ID NO: 6248454 - DNA, 18 bp, Homo sapiens
gcccgcctgccagtccta

SEQ ID NO: 6248455 - DNA, 23 bp, Homo sapiens
gcccgcctgccagtcctagctgc

SEQ ID NO: 6248456 - DNA, 14 bp, Homo sapiens
gcccgcctgcccac

SEQ ID NO: 6248457 - DNA, 16 bp, Homo sapiens
gcccgcctgcccacct

SEQ ID NO: 6248458 - DNA, 18 bp, Homo sapiens
gcccgcctgcccacctgc

SEQ ID NO: 6248459 - DNA, 12 bp, Homo sapiens
gcccgcctgccg

SEQ ID NO: 6248460 - DNA, 19 bp, Homo sapiens
gcccgcctgccgtgcatgg

SEQ ID NO: 6248461 - DNA, 15 bp, Homo sapiens
gcccgcctgcgcccc

SEQ ID NO: 6248462 - DNA, 14 bp, Homo sapiens
gcccgcctggcaga

SEQ ID NO: 6248463 - DNA, 18 bp, Homo sapiens
gcccgcctggcagaactg

SEQ ID NO: 6248464 - DNA, 20 bp, Homo sapiens
gcccgccttcaggctgcccg

SEQ ID NO: 6248465 - DNA, 20 bp, Homo sapiens
gcccgccttggctttctccc

SEQ ID NO: 6248466 - DNA, 23 bp, Homo sapiens
gcccgcctttcatctggattcta

SEQ ID NO: 6248467 - DNA, 14 bp, Homo sapiens
gcccgcgcagctgc

SEQ ID NO: 6248468 - DNA, 15 bp, Homo sapiens
gcccgcgcccgccgc

SEQ ID NO: 6248469 - DNA, 17 bp, Homo sapiens
gcccgcggcctgcaccg

SEQ ID NO: 6248470 - DNA, 23 bp, Homo sapiens
gcccgcgggagacagcttctctg

SEQ ID NO: 6248471 - DNA, 15 bp, Homo sapiens
gcccgcgggcacagc

SEQ ID NO: 6248472 - DNA, 18 bp, Homo sapiens
gcccgcgggcacagccag

SEQ ID NO: 6248473 - DNA, 20 bp, Homo sapiens
gcccgcgggcacagccagcc

SEQ ID NO: 6248474 - DNA, 21 bp, Homo sapiens
gcccgcgggtggctggagccc

SEQ ID NO: 6248475 - DNA, 19 bp, Homo sapiens
gcccgcgtccaaccccggg

SEQ ID NO: 6248476 - DNA, 19 bp, Homo sapiens
gcccgctcaacctctcaga

SEQ ID NO: 6248477 - DNA, 13 bp, Homo sapiens
gcccgctcccaca

SEQ ID NO: 6248478 - DNA, 20 bp, Homo sapiens
gcccgctgagctgagtggcc

SEQ ID NO: 6248479 - DNA, 15 bp, Homo sapiens
gcccgctgagtgggg

SEQ ID NO: 6248480 - DNA, 14 bp, Homo sapiens
gcccgctgcaatgc

SEQ ID NO: 6248481 - DNA, 14 bp, Homo sapiens
gcccgctgcctctt

SEQ ID NO: 6248482 - DNA, 15 bp, Homo sapiens
gcccgctgcctcttg

SEQ ID NO: 6248483 - DNA, 17 bp, Homo sapiens
gcccgctgcctcttggc

SEQ ID NO: 6248484 - DNA, 18 bp, Homo sapiens
gcccgctgcctcttggct

SEQ ID NO: 6248485 - DNA, 12 bp, Homo sapiens
gcccgctgcgct

SEQ ID NO: 6248486 - DNA, 17 bp, Homo sapiens
gcccgctgcgctgccct

SEQ ID NO: 6248487 - DNA, 20 bp, Homo sapiens
gcccgctgcgctgccctgca

SEQ ID NO: 6248488 - DNA, 21 bp, Homo sapiens
gcccgctgcgctgccctgcaa

SEQ ID NO: 6248489 - DNA, 13 bp, Homo sapiens
gcccgctgggctg

SEQ ID NO: 6248490 - DNA, 18 bp, Homo sapiens
gcccgctgggctgagccc

SEQ ID NO: 6248491 - DNA, 13 bp, Homo sapiens
gcccgcttcaagc

SEQ ID NO: 6248492 - DNA, 16 bp, Homo sapiens
gcccgcttcaagctct

SEQ ID NO: 6248493 - DNA, 13 bp, Homo sapiens
gcccgcttccctc

SEQ ID NO: 6248494 - DNA, 15 bp, Homo sapiens
gcccgcttccctcct

SEQ ID NO: 6248495 - DNA, 19 bp, Homo sapiens
gcccgcttgcctcggctcc

SEQ ID NO: 6248496 - DNA, 14 bp, Homo sapiens
gcccgcttggccac

SEQ ID NO: 6248497 - DNA, 23 bp, Homo sapiens
gcccggaagaaccagaagtgcag

SEQ ID NO: 6248498 - DNA, 22 bp, Homo sapiens
gcccggaagcgccaggctggag

SEQ ID NO: 6248499 - DNA, 19 bp, Homo sapiens
gcccggacgcccaggaccc

SEQ ID NO: 6248500 - DNA, 21 bp, Homo sapiens
gcccggacgcccaggacccca

SEQ ID NO: 6248501 - DNA, 14 bp, Homo sapiens
gcccggactgacca

SEQ ID NO: 6248502 - DNA, 15 bp, Homo sapiens
gcccggactgaccaa

SEQ ID NO: 6248503 - DNA, 23 bp, Homo sapiens
gagtcagtctctttctgtacaag

SEQ ID NO: 6248504 - DNA, 19 bp, Homo sapiens
gagtcagtcttcacttgca

SEQ ID NO: 6248505 - DNA, 15 bp, Homo sapiens
gagtcagtgccaggt

SEQ ID NO: 6248506 - DNA, 18 bp, Homo sapiens
gagtcagtgccaggtcct

SEQ ID NO: 6248507 - DNA, 20 bp, Homo sapiens
gagtcagtgcccatgtgtat

SEQ ID NO: 6248508 - DNA, 22 bp, Homo sapiens
gagtcagtgcccatgtgtatgg

SEQ ID NO: 6248509 - DNA, 14 bp, Homo sapiens
gagtcagtgtctgg

SEQ ID NO: 6248510 - DNA, 17 bp, Homo sapiens
gagtcagtgtctggctt

SEQ ID NO: 6248511 - DNA, 20 bp, Homo sapiens
gagtcagtttttttaaaaag

SEQ ID NO: 6248512 - DNA, 23 bp, Homo sapiens
gagtcataacggttaagaaagca

SEQ ID NO: 6248513 - DNA, 22 bp, Homo sapiens
gagtcatctgttagggccttgg

SEQ ID NO: 6248514 - DNA, 20 bp, Homo sapiens
gagtcatcttgtgagtggat

SEQ ID NO: 6248515 - DNA, 16 bp, Homo sapiens
gagtcatgatctccct

SEQ ID NO: 6248516 - DNA, 20 bp, Homo sapiens
gagtcatgatctccctgccg

SEQ ID NO: 6248517 - DNA, 21 bp, Homo sapiens
gagtcatgttgaaggtgccca

SEQ ID NO: 6248518 - DNA, 12 bp, Homo sapiens
gagtcattcata

SEQ ID NO: 6248519 - DNA, 16 bp, Homo sapiens
gagtcattgacttcat

SEQ ID NO: 6248520 - DNA, 22 bp, Homo sapiens
gagtcattgacttcattttata

SEQ ID NO: 6248521 - DNA, 22 bp, Homo sapiens
gagtcattgccttgggcctggg

SEQ ID NO: 6248522 - DNA, 14 bp, Homo sapiens
gagtcattgttaca

SEQ ID NO: 6248523 - DNA, 14 bp, Homo sapiens
gagtcatttaaatg

SEQ ID NO: 6248524 - DNA, 18 bp, Homo sapiens
gagtcatttatgagcaga

SEQ ID NO: 6248525 - DNA, 14 bp, Homo sapiens
gagtcatttttaca

SEQ ID NO: 6248526 - DNA, 18 bp, Homo sapiens
gagtccaaaatcattccc

SEQ ID NO: 6248527 - DNA, 21 bp, Homo sapiens
gagtccaaaccttctaccctg

SEQ ID NO: 6248528 - DNA, 19 bp, Homo sapiens
gagtccaaactggaatgag

SEQ ID NO: 6248529 - DNA, 14 bp, Homo sapiens
gagtccaagctggg

SEQ ID NO: 6248530 - DNA, 19 bp, Homo sapiens
gagtccaaggtttaaagag

SEQ ID NO: 6248531 - DNA, 16 bp, Homo sapiens
gagtccaccctttgga

SEQ ID NO: 6248532 - DNA, 18 bp, Homo sapiens
gagtccacgcccaccagc

SEQ ID NO: 6248533 - DNA, 13 bp, Homo sapiens
gagtccactttgt

SEQ ID NO: 6248534 - DNA, 19 bp, Homo sapiens
gagtccagaccccccagcc

SEQ ID NO: 6248535 - DNA, 20 bp, Homo sapiens
gagtccagacctgggccctg

SEQ ID NO: 6248536 - DNA, 17 bp, Homo sapiens
gagtccagcccctcctc

SEQ ID NO: 6248537 - DNA, 18 bp, Homo sapiens
gagtccagcccctcctcc

SEQ ID NO: 6248538 - DNA, 14 bp, Homo sapiens
gagtccagctcccc

SEQ ID NO: 6248539 - DNA, 21 bp, Homo sapiens
gagtccagctccccccaagat

SEQ ID NO: 6248540 - DNA, 12 bp, Homo sapiens
gagtccagctct

SEQ ID NO: 6248541 - DNA, 23 bp, Homo sapiens
gagtccagctttccttctgccct

SEQ ID NO: 6248542 - DNA, 18 bp, Homo sapiens
gagtccaggagccccagc

SEQ ID NO: 6248543 - DNA, 19 bp, Homo sapiens
gagtccaggagccccagcc

SEQ ID NO: 6248544 - DNA, 21 bp, Homo sapiens
gagtccaggagccccagccag

SEQ ID NO: 6248545 - DNA, 12 bp, Homo sapiens
gagtccagggcg

SEQ ID NO: 6248546 - DNA, 20 bp, Homo sapiens
gagtccagggcgggagtggg

SEQ ID NO: 6248547 - DNA, 18 bp, Homo sapiens
gagtccagggtttctctg

SEQ ID NO: 6248548 - DNA, 19 bp, Homo sapiens
gagtccagggtttctctgc

SEQ ID NO: 6248549 - DNA, 14 bp, Homo sapiens
gagtccagtgctct

SEQ ID NO: 6248550 - DNA, 15 bp, Homo sapiens
gagtccagtgctctg

SEQ ID NO: 6248551 - DNA, 18 bp, Homo sapiens
gagtccagtgctctgcct

SEQ ID NO: 6248552 - DNA, 16 bp, Homo sapiens
gagtccatcagcctcc

SEQ ID NO: 6248553 - DNA, 14 bp, Homo sapiens
gagtccatgaaaat

SEQ ID NO: 6248554 - DNA, 15 bp, Homo sapiens
gagtccatgaaaata

SEQ ID NO: 6248555 - DNA, 17 bp, Homo sapiens
gagtccatgaaaatacc

SEQ ID NO: 6248556 - DNA, 17 bp, Homo sapiens
gagtccatgtcctatgc

SEQ ID NO: 6248557 - DNA, 14 bp, Homo sapiens
gagtccattgcaaa

SEQ ID NO: 6248558 - DNA, 18 bp, Homo sapiens
gagtccatttcccacatc

SEQ ID NO: 6248559 - DNA, 21 bp, Homo sapiens
gagtccatttcccacatcttt

SEQ ID NO: 6248560 - DNA, 12 bp, Homo sapiens
gagtcccaaagc

SEQ ID NO: 6248561 - DNA, 16 bp, Homo sapiens
gagtcccaaggaaagc

SEQ ID NO: 6248562 - DNA, 13 bp, Homo sapiens
gagtcccaccttg

SEQ ID NO: 6248563 - DNA, 17 bp, Homo sapiens
gagtcccactgcctcag

SEQ ID NO: 6248564 - DNA, 22 bp, Homo sapiens
gagtcccactgcctcaggttcc

SEQ ID NO: 6248565 - DNA, 18 bp, Homo sapiens
gagtcccagagcaggagg

SEQ ID NO: 6248566 - DNA, 19 bp, Homo sapiens
gagtcccagagcaggaggc

SEQ ID NO: 6248567 - DNA, 22 bp, Homo sapiens
gagtcccaggttggctctgcca

SEQ ID NO: 6248568 - DNA, 22 bp, Homo sapiens
gagtccccagactctgcctaga

SEQ ID NO: 6248569 - DNA, 22 bp, Homo sapiens
gagtccccatgattccctcctc

SEQ ID NO: 6248570 - DNA, 16 bp, Homo sapiens
gagtcccccagagatg

SEQ ID NO: 6248571 - DNA, 17 bp, Homo sapiens
gagtcccctactccctc

SEQ ID NO: 6248572 - DNA, 17 bp, Homo sapiens
gagtcccctcacctcct

SEQ ID NO: 6248573 - DNA, 13 bp, Homo sapiens
gagtcccctcctc

SEQ ID NO: 6248574 - DNA, 12 bp, Homo sapiens
gagtcccctgtt

SEQ ID NO: 6248575 - DNA, 17 bp, Homo sapiens
gagtccctacctgcttc

SEQ ID NO: 6248576 - DNA, 12 bp, Homo sapiens
gagtccctccaa

SEQ ID NO: 6248577 - DNA, 13 bp, Homo sapiens
gagtccctccaaa

SEQ ID NO: 6248578 - DNA, 22 bp, Homo sapiens
gagtccctccatgcaaaagtgg

SEQ ID NO: 6248579 - DNA, 15 bp, Homo sapiens
gagtccctgcctgga

SEQ ID NO: 6248580 - DNA, 21 bp, Homo sapiens
gagtccctgcctggaccagcc

SEQ ID NO: 6248581 - DNA, 11 bp, Homo sapiens
gagtccctgct

SEQ ID NO: 6248582 - DNA, 21 bp, Homo sapiens
gagtccctgtgatggccaggc

SEQ ID NO: 6248583 - DNA, 13 bp, Homo sapiens
gagtcccttagaa

SEQ ID NO: 6248584 - DNA, 20 bp, Homo sapiens
gagtcccttttcattctcct

SEQ ID NO: 6248585 - DNA, 21 bp, Homo sapiens
gagtcccttttcattctcctc

SEQ ID NO: 6248586 - DNA, 22 bp, Homo sapiens
gagtccgacctggcctgtctgt

SEQ ID NO: 6248587 - DNA, 17 bp, Homo sapiens
gagtccgcccatccctg

SEQ ID NO: 6248588 - DNA, 15 bp, Homo sapiens
gagtccggaggcagc

SEQ ID NO: 6248589 - DNA, 17 bp, Homo sapiens
gagtccggaggcagcag

SEQ ID NO: 6248590 - DNA, 16 bp, Homo sapiens
gagtcctccaccccat

SEQ ID NO: 6248591 - DNA, 16 bp, Homo sapiens
gagtcctccttcccag

SEQ ID NO: 6248592 - DNA, 19 bp, Homo sapiens
gagtcctccttcccagctc

SEQ ID NO: 6248593 - DNA, 16 bp, Homo sapiens
gagtcctctagcaggc

SEQ ID NO: 6248594 - DNA, 13 bp, Homo sapiens
gagtcctctgaat

SEQ ID NO: 6248595 - DNA, 14 bp, Homo sapiens
gagtcctgaggcag

SEQ ID NO: 6248596 - DNA, 12 bp, Homo sapiens
gagtcctgatcc

SEQ ID NO: 6248597 - DNA, 21 bp, Homo sapiens
gagtcctgatcctaaccctgg

SEQ ID NO: 6248598 - DNA, 19 bp, Homo sapiens
gagtcctgccttcttcctt

SEQ ID NO: 6248599 - DNA, 12 bp, Homo sapiens
gagtcctgggag

SEQ ID NO: 6248600 - DNA, 17 bp, Homo sapiens
gagtcctgggtaaatgt

SEQ ID NO: 6248601 - DNA, 20 bp, Homo sapiens
gagtcctggtttcctcagcc

SEQ ID NO: 6248602 - DNA, 18 bp, Homo sapiens
gagtcctggtttcctggc

SEQ ID NO: 6248603 - DNA, 14 bp, Homo sapiens
gagtcctgtctctg

SEQ ID NO: 6248604 - DNA, 20 bp, Homo sapiens
gagtcctgtctctgcctgcg

SEQ ID NO: 6248605 - DNA, 11 bp, Homo sapiens
gagtcctgtta

SEQ ID NO: 6248606 - DNA, 19 bp, Homo sapiens
gagtcctgttctcagagct

SEQ ID NO: 6248607 - DNA, 17 bp, Homo sapiens
gagtcctgttcttccta

SEQ ID NO: 6248608 - DNA, 23 bp, Homo sapiens
gagtcctgttgaagacttcctct

SEQ ID NO: 6248609 - DNA, 14 bp, Homo sapiens
gagtccttaaaatg

SEQ ID NO: 6248610 - DNA, 14 bp, Homo sapiens
gagtccttacctcg

SEQ ID NO: 6248611 - DNA, 20 bp, Homo sapiens
gagtccttacctcggggaga

SEQ ID NO: 6248612 - DNA, 16 bp, Homo sapiens
gagtccttagcctggg

SEQ ID NO: 6248613 - DNA, 23 bp, Homo sapiens
gagtccttagcctgggcctcctc

SEQ ID NO: 6248614 - DNA, 14 bp, Homo sapiens
gagtcctttctttt

SEQ ID NO: 6248615 - DNA, 23 bp, Homo sapiens
gagtcctttcttttgaaatgcca

SEQ ID NO: 6248616 - DNA, 19 bp, Homo sapiens
gagtcgctggcatgtttca

SEQ ID NO: 6248617 - DNA, 12 bp, Homo sapiens
gagtcggcccca

SEQ ID NO: 6248618 - DNA, 19 bp, Homo sapiens
gagtcggctgggcagggcc

SEQ ID NO: 6248619 - DNA, 22 bp, Homo sapiens
gagtcgtacagaaagctgcctg

SEQ ID NO: 6248620 - DNA, 19 bp, Homo sapiens
gagtcgtcatcacttttca

SEQ ID NO: 6248621 - DNA, 15 bp, Homo sapiens
gagtcgtgggaagga

SEQ ID NO: 6248622 - DNA, 19 bp, Homo sapiens
gagtcgtggggtgtgctgg

SEQ ID NO: 6248623 - DNA, 12 bp, Homo sapiens
gagtctaaagat

SEQ ID NO: 6248624 - DNA, 21 bp, Homo sapiens
gagtctaaagatggagtttct

SEQ ID NO: 6248625 - DNA, 19 bp, Homo sapiens
gagtctaatagtctttgcc

SEQ ID NO: 6248626 - DNA, 15 bp, Homo sapiens
gagtctacctcttca

SEQ ID NO: 6248627 - DNA, 21 bp, Homo sapiens
gagtctagattcaaaggttct

SEQ ID NO: 6248628 - DNA, 23 bp, Homo sapiens
gagtctagattcaaaggttctag

SEQ ID NO: 6248629 - DNA, 16 bp, Homo sapiens
gagtctagcactcatt

SEQ ID NO: 6248630 - DNA, 22 bp, Homo sapiens
gagtctagcactcattttctat

SEQ ID NO: 6248631 - DNA, 20 bp, Homo sapiens
gagtctaggaatgcttttat

SEQ ID NO: 6248632 - DNA, 22 bp, Homo sapiens
gagtctatcctagtcttcacaa

SEQ ID NO: 6248633 - DNA, 19 bp, Homo sapiens
gagtctatgttcaaagact

SEQ ID NO: 6248634 - DNA, 21 bp, Homo sapiens
gagtctatgttcaaagactgt

SEQ ID NO: 6248635 - DNA, 22 bp, Homo sapiens
gagtctcaaaggtaattctgaa

SEQ ID NO: 6248636 - DNA, 20 bp, Homo sapiens
gagtctcaacatgtgtttct

SEQ ID NO: 6248637 - DNA, 16 bp, Homo sapiens
gagtctcactcttgtc

SEQ ID NO: 6248638 - DNA, 19 bp, Homo sapiens
gagtctcactgtctgctgg

SEQ ID NO: 6248639 - DNA, 21 bp, Homo sapiens
gagtctcagaaactcccctgg

SEQ ID NO: 6248640 - DNA, 14 bp, Homo sapiens
gagtctcagagcac

SEQ ID NO: 6248641 - DNA, 16 bp, Homo sapiens
gagtctcaggaggagg

SEQ ID NO: 6248642 - DNA, 18 bp, Homo sapiens
gagtctcaggaggaggct

SEQ ID NO: 6248643 - DNA, 21 bp, Homo sapiens
gagtctcattctgttgcccag

SEQ ID NO: 6248644 - DNA, 15 bp, Homo sapiens
gagtctcccagggag

SEQ ID NO: 6248645 - DNA, 13 bp, Homo sapiens
gagtctccctctg

SEQ ID NO: 6248646 - DNA, 15 bp, Homo sapiens
gagtctcctctctga

SEQ ID NO: 6248647 - DNA, 16 bp, Homo sapiens
gagtctcctctctgag

SEQ ID NO: 6248648 - DNA, 17 bp, Homo sapiens
gagtctcctctctgaga

SEQ ID NO: 6248649 - DNA, 20 bp, Homo sapiens
gagtctcctctctgagactg

SEQ ID NO: 6248650 - DNA, 21 bp, Homo sapiens
gagtctcgctctgttgcccag

SEQ ID NO: 6248651 - DNA, 15 bp, Homo sapiens
gagtctctccagcct

SEQ ID NO: 6248652 - DNA, 14 bp, Homo sapiens
gagtctctctgggc

SEQ ID NO: 6248653 - DNA, 15 bp, Homo sapiens
gagtctctcttccaa

SEQ ID NO: 6248654 - DNA, 17 bp, Homo sapiens
gagtctctgccacccac

SEQ ID NO: 6248655 - DNA, 19 bp, Homo sapiens
gagtctctgccacccactc

SEQ ID NO: 6248656 - DNA, 12 bp, Homo sapiens
gagtctctggct

SEQ ID NO: 6248657 - DNA, 14 bp, Homo sapiens
gagtctctggctca

SEQ ID NO: 6248658 - DNA, 17 bp, Homo sapiens
gagtctctggctcagct

SEQ ID NO: 6248659 - DNA, 18 bp, Homo sapiens
gagtctctggctcagctg

SEQ ID NO: 6248660 - DNA, 17 bp, Homo sapiens
gagtctcttctccactg

SEQ ID NO: 6248661 - DNA, 14 bp, Homo sapiens
gagtctgaagcaga

SEQ ID NO: 6248662 - DNA, 17 bp, Homo sapiens
gagtctgaaggagagga

SEQ ID NO: 6248663 - DNA, 15 bp, Homo sapiens
gagtctgaaggctgg

SEQ ID NO: 6248664 - DNA, 16 bp, Homo sapiens
gagtctgacaggaaga

SEQ ID NO: 6248665 - DNA, 13 bp, Homo sapiens
gagtctgaggact

SEQ ID NO: 6248666 - DNA, 12 bp, Homo sapiens
gagtctgaggcc

SEQ ID NO: 6248667 - DNA, 19 bp, Homo sapiens
gagtctgaggccgttgctg

SEQ ID NO: 6248668 - DNA, 18 bp, Homo sapiens
gagtctgaggtcctgagc

SEQ ID NO: 6248669 - DNA, 19 bp, Homo sapiens
gagtctgaggtcctgagca

SEQ ID NO: 6248670 - DNA, 13 bp, Homo sapiens
gagtctgagtcct

SEQ ID NO: 6248671 - DNA, 15 bp, Homo sapiens
gagtctgagtcctgt

SEQ ID NO: 6248672 - DNA, 18 bp, Homo sapiens
gagtctgagtcctgtctc

SEQ ID NO: 6248673 - DNA, 12 bp, Homo sapiens
gagtctgcagtg

SEQ ID NO: 6248674 - DNA, 16 bp, Homo sapiens
gagtctgccacccagg

SEQ ID NO: 6248675 - DNA, 18 bp, Homo sapiens
gagtctgccacccaggat

SEQ ID NO: 6248676 - DNA, 12 bp, Homo sapiens
gagtctgccact

SEQ ID NO: 6248677 - DNA, 22 bp, Homo sapiens
gagtctgcttgtcttagatgtt

SEQ ID NO: 6248678 - DNA, 15 bp, Homo sapiens
gagtctggagaccag

SEQ ID NO: 6248679 - DNA, 20 bp, Homo sapiens
gagtctggagaccaggactc

SEQ ID NO: 6248680 - DNA, 21 bp, Homo sapiens
gagtctggagaccaggactct

SEQ ID NO: 6248681 - DNA, 13 bp, Homo sapiens
gagtctggcttta

SEQ ID NO: 6248682 - DNA, 17 bp, Homo sapiens
gcccggagaaacctgat

SEQ ID NO: 6248683 - DNA, 20 bp, Homo sapiens
gcccggagatgcatctgtgg

SEQ ID NO: 6248684 - DNA, 22 bp, Homo sapiens
gcccggagcagcagcttctcca

SEQ ID NO: 6248685 - DNA, 15 bp, Homo sapiens
gcccggagcagcagg

SEQ ID NO: 6248686 - DNA, 17 bp, Homo sapiens
gcccggagctccggcct

SEQ ID NO: 6248687 - DNA, 18 bp, Homo sapiens
gcccggagctccggcctg

SEQ ID NO: 6248688 - DNA, 18 bp, Homo sapiens
gcccggaggccgggccct

SEQ ID NO: 6248689 - DNA, 19 bp, Homo sapiens
gcccggagtaatcaggcag

SEQ ID NO: 6248690 - DNA, 14 bp, Homo sapiens
gcccggatccagga

SEQ ID NO: 6248691 - DNA, 22 bp, Homo sapiens
gcccggatgcagaggcctgcag

SEQ ID NO: 6248692 - DNA, 15 bp, Homo sapiens
gcccggatgcccacc

SEQ ID NO: 6248693 - DNA, 17 bp, Homo sapiens
gcccggatgcccacccc

SEQ ID NO: 6248694 - DNA, 14 bp, Homo sapiens
gcccggatgcttct

SEQ ID NO: 6248695 - DNA, 17 bp, Homo sapiens
gcccggattctgggagg

SEQ ID NO: 6248696 - DNA, 15 bp, Homo sapiens
gcccggcacagagtc

SEQ ID NO: 6248697 - DNA, 20 bp, Homo sapiens
gcccggcagccccttctggc

SEQ ID NO: 6248698 - DNA, 21 bp, Homo sapiens
gcccggcagccccttctggcc

SEQ ID NO: 6248699 - DNA, 17 bp, Homo sapiens
gcccggcagtgcacccc

SEQ ID NO: 6248700 - DNA, 17 bp, Homo sapiens
gcccggcatgaggcccc

SEQ ID NO: 6248701 - DNA, 14 bp, Homo sapiens
gcccggccaaggac

SEQ ID NO: 6248702 - DNA, 22 bp, Homo sapiens
gcccggccaaggacactgatgg

SEQ ID NO: 6248703 - DNA, 22 bp, Homo sapiens
gcccggccacacccagcggccc

SEQ ID NO: 6248704 - DNA, 12 bp, Homo sapiens
gcccggccagcc

SEQ ID NO: 6248705 - DNA, 16 bp, Homo sapiens
gcccggccagcgggca

SEQ ID NO: 6248706 - DNA, 20 bp, Homo sapiens
gcccggccagcgggcacagg

SEQ ID NO: 6248707 - DNA, 14 bp, Homo sapiens
gcccggccagggcc

SEQ ID NO: 6248708 - DNA, 20 bp, Homo sapiens
gcccggcccacgcagagccc

SEQ ID NO: 6248709 - DNA, 22 bp, Homo sapiens
gcccggcccacgcagagccccg

SEQ ID NO: 6248710 - DNA, 14 bp, Homo sapiens
gcccggcccagcct

SEQ ID NO: 6248711 - DNA, 20 bp, Homo sapiens
gcccggccccaccccctggg

SEQ ID NO: 6248712 - DNA, 12 bp, Homo sapiens
gcccggccccat

SEQ ID NO: 6248713 - DNA, 13 bp, Homo sapiens
gcccggccccatc

SEQ ID NO: 6248714 - DNA, 22 bp, Homo sapiens
gcccggccccgagagcaggctc

SEQ ID NO: 6248715 - DNA, 15 bp, Homo sapiens
gcccggcccctcacc

SEQ ID NO: 6248716 - DNA, 13 bp, Homo sapiens
gcccggcctccta

SEQ ID NO: 6248717 - DNA, 14 bp, Homo sapiens
gcccggcctgctcc

SEQ ID NO: 6248718 - DNA, 18 bp, Homo sapiens
gcccggcctgctcccagc

SEQ ID NO: 6248719 - DNA, 17 bp, Homo sapiens
gcccggcgccctctgtc

SEQ ID NO: 6248720 - DNA, 21 bp, Homo sapiens
gcccggcgccgggcaccaact

SEQ ID NO: 6248721 - DNA, 16 bp, Homo sapiens
gcccggcgcctgccct

SEQ ID NO: 6248722 - DNA, 19 bp, Homo sapiens
gcccggcgcctgccctgcc

SEQ ID NO: 6248723 - DNA, 22 bp, Homo sapiens
gcccggcgcctggcctccaggc

SEQ ID NO: 6248724 - DNA, 18 bp, Homo sapiens
gcccggctccaggctcct

SEQ ID NO: 6248725 - DNA, 16 bp, Homo sapiens
gcccggctcggcccag

SEQ ID NO: 6248726 - DNA, 17 bp, Homo sapiens
gcccggctcggcccagc

SEQ ID NO: 6248727 - DNA, 14 bp, Homo sapiens
gcccggctgagccc

SEQ ID NO: 6248728 - DNA, 17 bp, Homo sapiens
gcccggctgagccctgc

SEQ ID NO: 6248729 - DNA, 13 bp, Homo sapiens
gcccggctgctgc

SEQ ID NO: 6248730 - DNA, 14 bp, Homo sapiens
gcccggctgctgct

SEQ ID NO: 6248731 - DNA, 18 bp, Homo sapiens
gcccggctgctgcttgga

SEQ ID NO: 6248732 - DNA, 12 bp, Homo sapiens
gcccggctgggc

SEQ ID NO: 6248733 - DNA, 14 bp, Homo sapiens
gcccggctggtttt

SEQ ID NO: 6248734 - DNA, 18 bp, Homo sapiens
gcccggctgtgattgctg

SEQ ID NO: 6248735 - DNA, 21 bp, Homo sapiens
gcccggctgtgattgctgcca

SEQ ID NO: 6248736 - DNA, 22 bp, Homo sapiens
gcccggctgtgattgctgccag

SEQ ID NO: 6248737 - DNA, 20 bp, Homo sapiens
gcccgggaaggtcaccagca

SEQ ID NO: 6248738 - DNA, 17 bp, Homo sapiens
gcccgggagatccgccc

SEQ ID NO: 6248739 - DNA, 15 bp, Homo sapiens
gcccgggagccgcag

SEQ ID NO: 6248740 - DNA, 17 bp, Homo sapiens
gcccgggagctcaggaa

SEQ ID NO: 6248741 - DNA, 18 bp, Homo sapiens
gcccgggcacccacaagc

SEQ ID NO: 6248742 - DNA, 19 bp, Homo sapiens
gcccgggcacccacaagcc

SEQ ID NO: 6248743 - DNA, 13 bp, Homo sapiens
gcccgggcaggcc

SEQ ID NO: 6248744 - DNA, 15 bp, Homo sapiens
gcccgggcaggccag

SEQ ID NO: 6248745 - DNA, 14 bp, Homo sapiens
gcccgggcccaggc

SEQ ID NO: 6248746 - DNA, 14 bp, Homo sapiens
gcccgggcccccgc

SEQ ID NO: 6248747 - DNA, 20 bp, Homo sapiens
gcccgggcccccgccccgcc

SEQ ID NO: 6248748 - DNA, 16 bp, Homo sapiens
gcccgggccccttgct

SEQ ID NO: 6248749 - DNA, 13 bp, Homo sapiens
gcccgggctccca

SEQ ID NO: 6248750 - DNA, 18 bp, Homo sapiens
gcccgggctctgcctccc

SEQ ID NO: 6248751 - DNA, 12 bp, Homo sapiens
gcccgggctgcc

SEQ ID NO: 6248752 - DNA, 18 bp, Homo sapiens
gcccgggctgcctgggct

SEQ ID NO: 6248753 - DNA, 16 bp, Homo sapiens
gcccggggtggccaca

SEQ ID NO: 6248754 - DNA, 13 bp, Homo sapiens
gcccgggtcccac

SEQ ID NO: 6248755 - DNA, 13 bp, Homo sapiens
gcccgggtgcagg

SEQ ID NO: 6248756 - DNA, 23 bp, Homo sapiens
gcccgggtgtgcctgccctggag

SEQ ID NO: 6248757 - DNA, 15 bp, Homo sapiens
gcccggtccacaggt

SEQ ID NO: 6248758 - DNA, 22 bp, Homo sapiens
gcccggtccccttcccaggggc

SEQ ID NO: 6248759 - DNA, 14 bp, Homo sapiens
gcccggtgcagggc

SEQ ID NO: 6248760 - DNA, 16 bp, Homo sapiens
gcccggtgcagggcct

SEQ ID NO: 6248761 - DNA, 17 bp, Homo sapiens
gcccggtgcagggcctg

SEQ ID NO: 6248762 - DNA, 22 bp, Homo sapiens
gcccggtgcagggcctggcata

SEQ ID NO: 6248763 - DNA, 14 bp, Homo sapiens
gcccggtgccatct

SEQ ID NO: 6248764 - DNA, 16 bp, Homo sapiens
gcccggtggcggcagg

SEQ ID NO: 6248765 - DNA, 15 bp, Homo sapiens
gcccggtgggtccgc

SEQ ID NO: 6248766 - DNA, 15 bp, Homo sapiens
gcccggtgtgaggag

SEQ ID NO: 6248767 - DNA, 20 bp, Homo sapiens
gcccggtgttcagtggtttc

SEQ ID NO: 6248768 - DNA, 17 bp, Homo sapiens
gcccgtagatcatcccc

SEQ ID NO: 6248769 - DNA, 21 bp, Homo sapiens
gcccgtagatcatccccgagg

SEQ ID NO: 6248770 - DNA, 16 bp, Homo sapiens
gcccgtcagcatcact

SEQ ID NO: 6248771 - DNA, 20 bp, Homo sapiens
gcccgtcagcatcactgatg

SEQ ID NO: 6248772 - DNA, 23 bp, Homo sapiens
gcccgtcagcatcactgatggga

SEQ ID NO: 6248773 - DNA, 14 bp, Homo sapiens
gcccgtcagcgtgg

SEQ ID NO: 6248774 - DNA, 18 bp, Homo sapiens
gcccgtcatgttcctcaa

SEQ ID NO: 6248775 - DNA, 13 bp, Homo sapiens
gcccgtcctgcct

SEQ ID NO: 6248776 - DNA, 16 bp, Homo sapiens
gcccgtcggagctgcc

SEQ ID NO: 6248777 - DNA, 19 bp, Homo sapiens
gcccgtcggagctgcctgc

SEQ ID NO: 6248778 - DNA, 20 bp, Homo sapiens
gcccgtcggagctgcctgca

SEQ ID NO: 6248779 - DNA, 23 bp, Homo sapiens
gcccgtcggagctgcctgcagca

SEQ ID NO: 6248780 - DNA, 15 bp, Homo sapiens
gcccgtcggccctgc

SEQ ID NO: 6248781 - DNA, 13 bp, Homo sapiens
gcccgtctctctc

SEQ ID NO: 6248782 - DNA, 15 bp, Homo sapiens
gcccgtctctctccc

SEQ ID NO: 6248783 - DNA, 20 bp, Homo sapiens
gcccgtctctttctcacctt

SEQ ID NO: 6248784 - DNA, 14 bp, Homo sapiens
gcccgtctgtccat

SEQ ID NO: 6248785 - DNA, 18 bp, Homo sapiens
gcccgtcttcagcctagc

SEQ ID NO: 6248786 - DNA, 19 bp, Homo sapiens
gcccgtgaagcagtgcctc

SEQ ID NO: 6248787 - DNA, 19 bp, Homo sapiens
gcccgtgccacccccagcc

SEQ ID NO: 6248788 - DNA, 22 bp, Homo sapiens
gcccgtgccacccccagccctg

SEQ ID NO: 6248789 - DNA, 21 bp, Homo sapiens
gcccgtgcccccgcctgccac

SEQ ID NO: 6248790 - DNA, 19 bp, Homo sapiens
gcccgtgccctaccacaca

SEQ ID NO: 6248791 - DNA, 15 bp, Homo sapiens
gcccgtgcgcagccg

SEQ ID NO: 6248792 - DNA, 13 bp, Homo sapiens
gcccgtggatctg

SEQ ID NO: 6248793 - DNA, 18 bp, Homo sapiens
gcccgtggatctgggcac

SEQ ID NO: 6248794 - DNA, 20 bp, Homo sapiens
gcccgtggcctggcatctgt

SEQ ID NO: 6248795 - DNA, 22 bp, Homo sapiens
gcccgtggcctggcatctgtgt

SEQ ID NO: 6248796 - DNA, 18 bp, Homo sapiens
gcccgtggcttggcatct

SEQ ID NO: 6248797 - DNA, 19 bp, Homo sapiens
gcccgtgtacatagtgcat

SEQ ID NO: 6248798 - DNA, 23 bp, Homo sapiens
gcccgtgtagtccccaaccgtgt

SEQ ID NO: 6248799 - DNA, 18 bp, Homo sapiens
gcccgtgtcctgccttga

SEQ ID NO: 6248800 - DNA, 17 bp, Homo sapiens
gcccgtgtgacccgttc

SEQ ID NO: 6248801 - DNA, 16 bp, Homo sapiens
gcccgtgtggcccctt

SEQ ID NO: 6248802 - DNA, 16 bp, Homo sapiens
gcccgtgtggcctggg

SEQ ID NO: 6248803 - DNA, 22 bp, Homo sapiens
gcccgtgtgtgtgtatgtgtgt

SEQ ID NO: 6248804 - DNA, 19 bp, Homo sapiens
gcccgttgccgggcctgga

SEQ ID NO: 6248805 - DNA, 20 bp, Homo sapiens
gcccgttgtctccctggccc

SEQ ID NO: 6248806 - DNA, 15 bp, Homo sapiens
gccctaacctgacag

SEQ ID NO: 6248807 - DNA, 16 bp, Homo sapiens
gccctaacgggggtgc

SEQ ID NO: 6248808 - DNA, 22 bp, Homo sapiens
gccctaacgggggtgcggcagg

SEQ ID NO: 6248809 - DNA, 21 bp, Homo sapiens
gccctaagaggtttttcctct

SEQ ID NO: 6248810 - DNA, 15 bp, Homo sapiens
gccctaagcagaaag

SEQ ID NO: 6248811 - DNA, 17 bp, Homo sapiens
gccctaagcagaaagtg

SEQ ID NO: 6248812 - DNA, 18 bp, Homo sapiens
gccctaagcagaaagtgc

SEQ ID NO: 6248813 - DNA, 21 bp, Homo sapiens
gccctaagcagaaagtgcctt

SEQ ID NO: 6248814 - DNA, 13 bp, Homo sapiens
gccctaagccact

SEQ ID NO: 6248815 - DNA, 15 bp, Homo sapiens
gccctaagcctgtcc

SEQ ID NO: 6248816 - DNA, 17 bp, Homo sapiens
gccctaagcctgtcccc

SEQ ID NO: 6248817 - DNA, 18 bp, Homo sapiens
gccctaagcctgtcccca

SEQ ID NO: 6248818 - DNA, 23 bp, Homo sapiens
gccctaaggccttggtgccctga

SEQ ID NO: 6248819 - DNA, 22 bp, Homo sapiens
gccctaaggttttgttgtgttc

SEQ ID NO: 6248820 - DNA, 18 bp, Homo sapiens
gccctaagtggctgcctt

SEQ ID NO: 6248821 - DNA, 20 bp, Homo sapiens
gccctaagtggctgccttct

SEQ ID NO: 6248822 - DNA, 21 bp, Homo sapiens
gccctaagtggctgccttctt

SEQ ID NO: 6248823 - DNA, 16 bp, Homo sapiens
gccctaagtttgtact

SEQ ID NO: 6248824 - DNA, 16 bp, Homo sapiens
gccctaatgcgcaggc

SEQ ID NO: 6248825 - DNA, 23 bp, Homo sapiens
gccctaatgcgcaggctggccct

SEQ ID NO: 6248826 - DNA, 15 bp, Homo sapiens
gccctaattcagcca

SEQ ID NO: 6248827 - DNA, 16 bp, Homo sapiens
gccctaattcagccat

SEQ ID NO: 6248828 - DNA, 23 bp, Homo sapiens
gccctaattcagccatgtacaga

SEQ ID NO: 6248829 - DNA, 19 bp, Homo sapiens
gccctaattcatcttttaa

SEQ ID NO: 6248830 - DNA, 23 bp, Homo sapiens
gccctaattcatcttttaatcat

SEQ ID NO: 6248831 - DNA, 15 bp, Homo sapiens
gccctacaccttgag

SEQ ID NO: 6248832 - DNA, 16 bp, Homo sapiens
gccctacagagctgtg

SEQ ID NO: 6248833 - DNA, 17 bp, Homo sapiens
gccctacagagctgtgg

SEQ ID NO: 6248834 - DNA, 16 bp, Homo sapiens
gccctacagaggtctc

SEQ ID NO: 6248835 - DNA, 21 bp, Homo sapiens
gccctacagaggtctctgccg

SEQ ID NO: 6248836 - DNA, 14 bp, Homo sapiens
gccctacagccctg

SEQ ID NO: 6248837 - DNA, 19 bp, Homo sapiens
gccctacatcttcagctcc

SEQ ID NO: 6248838 - DNA, 20 bp, Homo sapiens
gccctacatcttcagctccc

SEQ ID NO: 6248839 - DNA, 15 bp, Homo sapiens
gccctaccagaggga

SEQ ID NO: 6248840 - DNA, 19 bp, Homo sapiens
gccctaccagagggaacac

SEQ ID NO: 6248841 - DNA, 15 bp, Homo sapiens
gccctaccctcactc

SEQ ID NO: 6248842 - DNA, 14 bp, Homo sapiens
gccctaccctcctg

SEQ ID NO: 6248843 - DNA, 15 bp, Homo sapiens
gccctaccctcctgc

SEQ ID NO: 6248844 - DNA, 16 bp, Homo sapiens
gccctacctgccccac

SEQ ID NO: 6248845 - DNA, 12 bp, Homo sapiens
gccctacctggg

SEQ ID NO: 6248846 - DNA, 13 bp, Homo sapiens
gccctacctgggg

SEQ ID NO: 6248847 - DNA, 14 bp, Homo sapiens
gccctactccactg

SEQ ID NO: 6248848 - DNA, 15 bp, Homo sapiens
gccctactccactgc

SEQ ID NO: 6248849 - DNA, 16 bp, Homo sapiens
gccctactccactgcc

SEQ ID NO: 6248850 - DNA, 21 bp, Homo sapiens
gccctactccactgccctggc

SEQ ID NO: 6248851 - DNA, 17 bp, Homo sapiens
gccctactccctgcaga

SEQ ID NO: 6248852 - DNA, 22 bp, Homo sapiens
gccctactccctgcagatgcca

SEQ ID NO: 6248853 - DNA, 16 bp, Homo sapiens
gccctactcggatggg

SEQ ID NO: 6248854 - DNA, 18 bp, Homo sapiens
gccctactgaagggaaca

SEQ ID NO: 6248855 - DNA, 14 bp, Homo sapiens
gccctactgggaga

SEQ ID NO: 6248856 - DNA, 16 bp, Homo sapiens
gccctacttccaggat

SEQ ID NO: 6248857 - DNA, 23 bp, Homo sapiens
gccctacttccaggatggatgca

SEQ ID NO: 6248858 - DNA, 21 bp, Homo sapiens
gccctagagcacactgtagca

SEQ ID NO: 6248859 - DNA, 16 bp, Homo sapiens
gccctagagcctgcct

SEQ ID NO: 6248860 - DNA, 18 bp, Homo sapiens
gccctagagcctgcctgg

SEQ ID NO: 6248861 - DNA, 14 bp, Homo sapiens
gagtctgggcctct

SEQ ID NO: 6248862 - DNA, 17 bp, Homo sapiens
gagtctggggtgggagg

SEQ ID NO: 6248863 - DNA, 21 bp, Homo sapiens
gagtctggtctgcgccttggg

SEQ ID NO: 6248864 - DNA, 23 bp, Homo sapiens
gagtctgtaggagcaagggcaca

SEQ ID NO: 6248865 - DNA, 18 bp, Homo sapiens
gagtctgtatttttctaa

SEQ ID NO: 6248866 - DNA, 12 bp, Homo sapiens
gagtctgtcctg

SEQ ID NO: 6248867 - DNA, 18 bp, Homo sapiens
gagtctgtctctgtcatg

SEQ ID NO: 6248868 - DNA, 20 bp, Homo sapiens
gagtctgtgaataaagccac

SEQ ID NO: 6248869 - DNA, 11 bp, Homo sapiens
gagtctgtgga

SEQ ID NO: 6248870 - DNA, 18 bp, Homo sapiens
gagtctgtgtgtagccag

SEQ ID NO: 6248871 - DNA, 20 bp, Homo sapiens
gagtctgtgtgtagccagga

SEQ ID NO: 6248872 - DNA, 16 bp, Homo sapiens
gagtctgttctggtaa

SEQ ID NO: 6248873 - DNA, 22 bp, Homo sapiens
gagtctgttgtgtgtcatgcca

SEQ ID NO: 6248874 - DNA, 17 bp, Homo sapiens
gagtctgtttcccaagc

SEQ ID NO: 6248875 - DNA, 18 bp, Homo sapiens
gagtcttaactgtatttc

SEQ ID NO: 6248876 - DNA, 21 bp, Homo sapiens
gagtcttaactgtatttcagt

SEQ ID NO: 6248877 - DNA, 23 bp, Homo sapiens
gagtcttaactgtatttcagtat

SEQ ID NO: 6248878 - DNA, 21 bp, Homo sapiens
gagtcttaagggtcactggcc

SEQ ID NO: 6248879 - DNA, 20 bp, Homo sapiens
gagtcttacaatcaaatctc

SEQ ID NO: 6248880 - DNA, 20 bp, Homo sapiens
gagtcttactctgccgccca

SEQ ID NO: 6248881 - DNA, 20 bp, Homo sapiens
gagtcttactctgtcgccca

SEQ ID NO: 6248882 - DNA, 15 bp, Homo sapiens
gagtcttcacattta

SEQ ID NO: 6248883 - DNA, 18 bp, Homo sapiens
gagtcttcactgctctgc

SEQ ID NO: 6248884 - DNA, 18 bp, Homo sapiens
gagtcttcagacccagag

SEQ ID NO: 6248885 - DNA, 19 bp, Homo sapiens
gagtcttcagacccagaga

SEQ ID NO: 6248886 - DNA, 21 bp, Homo sapiens
gagtcttcagacccagagaag

SEQ ID NO: 6248887 - DNA, 22 bp, Homo sapiens
gagtcttccaaggccagaagga

SEQ ID NO: 6248888 - DNA, 16 bp, Homo sapiens
gagtcttctaatgtaa

SEQ ID NO: 6248889 - DNA, 22 bp, Homo sapiens
gagtcttgctacctcagtcagt

SEQ ID NO: 6248890 - DNA, 15 bp, Homo sapiens
gagtcttgctatatt

SEQ ID NO: 6248891 - DNA, 20 bp, Homo sapiens
gagtcttgctatattgccca

SEQ ID NO: 6248892 - DNA, 20 bp, Homo sapiens
gagtcttgctctgtagccca

SEQ ID NO: 6248893 - DNA, 20 bp, Homo sapiens
gagtcttgctctgtcaccca

SEQ ID NO: 6248894 - DNA, 21 bp, Homo sapiens
gagtcttgctcttgtcgccca

SEQ ID NO: 6248895 - DNA, 20 bp, Homo sapiens
gagtcttggcggcagcagcc

SEQ ID NO: 6248896 - DNA, 15 bp, Homo sapiens
gagtcttgggcctgg

SEQ ID NO: 6248897 - DNA, 20 bp, Homo sapiens
gagtcttggtctgttgccca

SEQ ID NO: 6248898 - DNA, 17 bp, Homo sapiens
gagtcttgtacacttaa

SEQ ID NO: 6248899 - DNA, 13 bp, Homo sapiens
gagtcttgtgaaa

SEQ ID NO: 6248900 - DNA, 14 bp, Homo sapiens
gagtcttgtgaaag

SEQ ID NO: 6248901 - DNA, 18 bp, Homo sapiens
gagtcttgtgaaagtgta

SEQ ID NO: 6248902 - DNA, 18 bp, Homo sapiens
gagtctttctcactgcct

SEQ ID NO: 6248903 - DNA, 22 bp, Homo sapiens
gagtctttgtaatgcttgtaca

SEQ ID NO: 6248904 - DNA, 18 bp, Homo sapiens
gagtctttgtgtgttata

SEQ ID NO: 6248905 - DNA, 22 bp, Homo sapiens
gagtgaaaaatcttaagtacca

SEQ ID NO: 6248906 - DNA, 14 bp, Homo sapiens
gagtgaaacagaga

SEQ ID NO: 6248907 - DNA, 20 bp, Homo sapiens
gagtgaaacagagaaagaaa

SEQ ID NO: 6248908 - DNA, 18 bp, Homo sapiens
gagtgaaagttgccatta

SEQ ID NO: 6248909 - DNA, 24 bp, Homo sapiens
gagtgaaataattaaaaaccactg

SEQ ID NO: 6248910 - DNA, 23 bp, Homo sapiens
gagtgaacaaatttacagagaca

SEQ ID NO: 6248911 - DNA, 21 bp, Homo sapiens
gagtgaacaactatttataaa

SEQ ID NO: 6248912 - DNA, 12 bp, Homo sapiens
gagtgaaccaga

SEQ ID NO: 6248913 - DNA, 19 bp, Homo sapiens
gagtgaaccccacgccctg

SEQ ID NO: 6248914 - DNA, 14 bp, Homo sapiens
gagtgaagaatctt

SEQ ID NO: 6248915 - DNA, 13 bp, Homo sapiens
gagtgaagagcat

SEQ ID NO: 6248916 - DNA, 17 bp, Homo sapiens
gagtgaagagtgaagag

SEQ ID NO: 6248917 - DNA, 16 bp, Homo sapiens
gagtgaagcatttaaa

SEQ ID NO: 6248918 - DNA, 15 bp, Homo sapiens
gagtgaagccacaga

SEQ ID NO: 6248919 - DNA, 22 bp, Homo sapiens
gagtgaagtaattgacagggaa

SEQ ID NO: 6248920 - DNA, 15 bp, Homo sapiens
gagtgaatacactgg

SEQ ID NO: 6248921 - DNA, 19 bp, Homo sapiens
gagtgaatgagtaaataaa

SEQ ID NO: 6248922 - DNA, 21 bp, Homo sapiens
gagtgaatgttaacatgcgca

SEQ ID NO: 6248923 - DNA, 15 bp, Homo sapiens
gagtgaattccctca

SEQ ID NO: 6248924 - DNA, 16 bp, Homo sapiens
gagtgaattccctcac

SEQ ID NO: 6248925 - DNA, 22 bp, Homo sapiens
gagtgaattgtacctatttctg

SEQ ID NO: 6248926 - DNA, 11 bp, Homo sapiens
gagtgaatttc

SEQ ID NO: 6248927 - DNA, 17 bp, Homo sapiens
gagtgaatttgacctag

SEQ ID NO: 6248928 - DNA, 18 bp, Homo sapiens
gagtgacagaaggcccga

SEQ ID NO: 6248929 - DNA, 14 bp, Homo sapiens
gagtgacagaggca

SEQ ID NO: 6248930 - DNA, 22 bp, Homo sapiens
gagtgacagctttctgggatgt

SEQ ID NO: 6248931 - DNA, 20 bp, Homo sapiens
gagtgacatagcctcatgtt

SEQ ID NO: 6248932 - DNA, 20 bp, Homo sapiens
gagtgacatgcggctgccca

SEQ ID NO: 6248933 - DNA, 14 bp, Homo sapiens
gagtgacccagcta

SEQ ID NO: 6248934 - DNA, 16 bp, Homo sapiens
gagtgacccagctact

SEQ ID NO: 6248935 - DNA, 21 bp, Homo sapiens
gagtgaccctcagctgtcacc

SEQ ID NO: 6248936 - DNA, 23 bp, Homo sapiens
gagtgaccgggggctgctgggcg

SEQ ID NO: 6248937 - DNA, 23 bp, Homo sapiens
gagtgacctcacttctggcactg

SEQ ID NO: 6248938 - DNA, 16 bp, Homo sapiens
gagtgacctcggacag

SEQ ID NO: 6248939 - DNA, 22 bp, Homo sapiens
gagtgacctggcatcttggaaa

SEQ ID NO: 6248940 - DNA, 18 bp, Homo sapiens
gagtgacggtcccacact

SEQ ID NO: 6248941 - DNA, 16 bp, Homo sapiens
gagtgactacacacag

SEQ ID NO: 6248942 - DNA, 15 bp, Homo sapiens
gagtgactcaagaag

SEQ ID NO: 6248943 - DNA, 18 bp, Homo sapiens
gagtgactcgagggttgg

SEQ ID NO: 6248944 - DNA, 16 bp, Homo sapiens
gagtgactcggtgtaa

SEQ ID NO: 6248945 - DNA, 14 bp, Homo sapiens
gagtgactctggct

SEQ ID NO: 6248946 - DNA, 23 bp, Homo sapiens
gagtgagaaagaataggggctga

SEQ ID NO: 6248947 - DNA, 22 bp, Homo sapiens
gagtgagaaatttttttccaga

SEQ ID NO: 6248948 - DNA, 19 bp, Homo sapiens
gagtgagacaaaattttag

SEQ ID NO: 6248949 - DNA, 23 bp, Homo sapiens
gagtgagacccagccctcatccc

SEQ ID NO: 6248950 - DNA, 18 bp, Homo sapiens
gagtgagacccaggagcc

SEQ ID NO: 6248951 - DNA, 14 bp, Homo sapiens
gagtgagagagagt

SEQ ID NO: 6248952 - DNA, 17 bp, Homo sapiens
gagtgagagcacaaaga

SEQ ID NO: 6248953 - DNA, 16 bp, Homo sapiens
gagtgagagcctttgc

SEQ ID NO: 6248954 - DNA, 20 bp, Homo sapiens
gagtgagagcctttgccttt

SEQ ID NO: 6248955 - DNA, 14 bp, Homo sapiens
gagtgagaggcccc

SEQ ID NO: 6248956 - DNA, 23 bp, Homo sapiens
gagtgagaggcccccacccttgg

SEQ ID NO: 6248957 - DNA, 15 bp, Homo sapiens
gagtgagaggggagg

SEQ ID NO: 6248958 - DNA, 19 bp, Homo sapiens
gagtgagcaagggggccca

SEQ ID NO: 6248959 - DNA, 15 bp, Homo sapiens
gagtgagcagctact

SEQ ID NO: 6248960 - DNA, 21 bp, Homo sapiens
gagtgagcagctactgtaact

SEQ ID NO: 6248961 - DNA, 13 bp, Homo sapiens
gagtgagccacag

SEQ ID NO: 6248962 - DNA, 23 bp, Homo sapiens
gagtgagccacagaccacctgct

SEQ ID NO: 6248963 - DNA, 21 bp, Homo sapiens
gagtgagcggccgctgccgcc

SEQ ID NO: 6248964 - DNA, 17 bp, Homo sapiens
gagtgagctaccaggaa

SEQ ID NO: 6248965 - DNA, 18 bp, Homo sapiens
gagtgagctaccaggaag

SEQ ID NO: 6248966 - DNA, 17 bp, Homo sapiens
gagtgagctctggtgga

SEQ ID NO: 6248967 - DNA, 17 bp, Homo sapiens
gagtgagcttggtgcgg

SEQ ID NO: 6248968 - DNA, 18 bp, Homo sapiens
gagtgaggacgcaccgcc

SEQ ID NO: 6248969 - DNA, 18 bp, Homo sapiens
gagtgaggatgtctgggc

SEQ ID NO: 6248970 - DNA, 15 bp, Homo sapiens
gagtgaggcttccag

SEQ ID NO: 6248971 - DNA, 18 bp, Homo sapiens
gagtgaggcttccaggct

SEQ ID NO: 6248972 - DNA, 19 bp, Homo sapiens
gagtgaggcttccaggctc

SEQ ID NO: 6248973 - DNA, 14 bp, Homo sapiens
gagtgagggagaca

SEQ ID NO: 6248974 - DNA, 18 bp, Homo sapiens
gagtgagggagacaggaa

SEQ ID NO: 6248975 - DNA, 14 bp, Homo sapiens
gagtgagggcctga

SEQ ID NO: 6248976 - DNA, 15 bp, Homo sapiens
gagtgaggggctgtg

SEQ ID NO: 6248977 - DNA, 22 bp, Homo sapiens
gagtgaggggttacctccctcg

SEQ ID NO: 6248978 - DNA, 19 bp, Homo sapiens
gagtgagtcacctgctcca

SEQ ID NO: 6248979 - DNA, 13 bp, Homo sapiens
gagtgagtcagtg

SEQ ID NO: 6248980 - DNA, 20 bp, Homo sapiens
gagtgagtctgtcataatat

SEQ ID NO: 6248981 - DNA, 14 bp, Homo sapiens
gagtgagtgggaga

SEQ ID NO: 6248982 - DNA, 18 bp, Homo sapiens
gagtgagttcaactacat

SEQ ID NO: 6248983 - DNA, 17 bp, Homo sapiens
gagtgagtttaggcagc

SEQ ID NO: 6248984 - DNA, 22 bp, Homo sapiens
gagtgatagggatcctggtggg

SEQ ID NO: 6248985 - DNA, 19 bp, Homo sapiens
gagtgatagtcttttgctt

SEQ ID NO: 6248986 - DNA, 22 bp, Homo sapiens
gagtgatatggcttgtagggtg

SEQ ID NO: 6248987 - DNA, 20 bp, Homo sapiens
gagtgatcacctcttgggga

SEQ ID NO: 6248988 - DNA, 22 bp, Homo sapiens
gagtgatcacctcttggggacc

SEQ ID NO: 6248989 - DNA, 13 bp, Homo sapiens
gagtgatctcaaa

SEQ ID NO: 6248990 - DNA, 17 bp, Homo sapiens
gagtgatctcaaatcca

SEQ ID NO: 6248991 - DNA, 20 bp, Homo sapiens
gagtgatctcaaatccactg

SEQ ID NO: 6248992 - DNA, 13 bp, Homo sapiens
gagtgatgggcaa

SEQ ID NO: 6248993 - DNA, 21 bp, Homo sapiens
gagtgatgggcaaggggccag

SEQ ID NO: 6248994 - DNA, 19 bp, Homo sapiens
gagtgatggtgtccttccc

SEQ ID NO: 6248995 - DNA, 22 bp, Homo sapiens
gagtgatggtgtccttccctgc

SEQ ID NO: 6248996 - DNA, 14 bp, Homo sapiens
gagtgattctagag

SEQ ID NO: 6248997 - DNA, 12 bp, Homo sapiens
gagtgattgcag

SEQ ID NO: 6248998 - DNA, 20 bp, Homo sapiens
gagtgattgcagctttatgt

SEQ ID NO: 6248999 - DNA, 22 bp, Homo sapiens
gagtgatttccatctctggtaa

SEQ ID NO: 6249000 - DNA, 22 bp, Homo sapiens
gagtgatttgtaaaacagtggt

SEQ ID NO: 6249001 - DNA, 13 bp, Homo sapiens
gagtgcaagagcc

SEQ ID NO: 6249002 - DNA, 17 bp, Homo sapiens
gagtgcaagagcctgag

SEQ ID NO: 6249003 - DNA, 19 bp, Homo sapiens
gagtgcaatgacacagtct

SEQ ID NO: 6249004 - DNA, 17 bp, Homo sapiens
gagtgcaccaaagagaa

SEQ ID NO: 6249005 - DNA, 16 bp, Homo sapiens
gagtgcagaacacctg

SEQ ID NO: 6249006 - DNA, 17 bp, Homo sapiens
gagtgcagaacacctgg

SEQ ID NO: 6249007 - DNA, 16 bp, Homo sapiens
gagtgcagccgtttga

SEQ ID NO: 6249008 - DNA, 16 bp, Homo sapiens
gagtgcagccttctcc

SEQ ID NO: 6249009 - DNA, 14 bp, Homo sapiens
gagtgcaggcccac

SEQ ID NO: 6249010 - DNA, 16 bp, Homo sapiens
gagtgcaggcccaccc

SEQ ID NO: 6249011 - DNA, 19 bp, Homo sapiens
gagtgcaggcctgctcagg

SEQ ID NO: 6249012 - DNA, 22 bp, Homo sapiens
gagtgcaggggatggggtgggg

SEQ ID NO: 6249013 - DNA, 12 bp, Homo sapiens
gagtgcaggggc

SEQ ID NO: 6249014 - DNA, 16 bp, Homo sapiens
gagtgcagtggcacaa

SEQ ID NO: 6249015 - DNA, 15 bp, Homo sapiens
gagtgcatggccaca

SEQ ID NO: 6249016 - DNA, 16 bp, Homo sapiens
gagtgcatggccacag

SEQ ID NO: 6249017 - DNA, 18 bp, Homo sapiens
gagtgccacatggccgct

SEQ ID NO: 6249018 - DNA, 23 bp, Homo sapiens
gagtgccacatggccgctgccca

SEQ ID NO: 6249019 - DNA, 19 bp, Homo sapiens
gagtgccacgttactcccc

SEQ ID NO: 6249020 - DNA, 19 bp, Homo sapiens
gagtgccaggaccagcctg

SEQ ID NO: 6249021 - DNA, 10 bp, Homo sapiens
gagtgccatc

SEQ ID NO: 6249022 - DNA, 14 bp, Homo sapiens
gagtgcccagaact

SEQ ID NO: 6249023 - DNA, 13 bp, Homo sapiens
gagtgcccagcag

SEQ ID NO: 6249024 - DNA, 12 bp, Homo sapiens
gagtgccccaga

SEQ ID NO: 6249025 - DNA, 17 bp, Homo sapiens
gagtgccccagaaatgc

SEQ ID NO: 6249026 - DNA, 22 bp, Homo sapiens
gagtgccccagaaatgccgctg

SEQ ID NO: 6249027 - DNA, 15 bp, Homo sapiens
gagtgcccctgcagg

SEQ ID NO: 6249028 - DNA, 16 bp, Homo sapiens
gagtgcccctgcaggg

SEQ ID NO: 6249029 - DNA, 15 bp, Homo sapiens
gagtgcccctgtccc

SEQ ID NO: 6249030 - DNA, 20 bp, Homo sapiens
gagtgcccctgtcccacctg

SEQ ID NO: 6249031 - DNA, 15 bp, Homo sapiens
gagtgccctgcaggc

SEQ ID NO: 6249032 - DNA, 16 bp, Homo sapiens
gagtgccctgcaggca

SEQ ID NO: 6249033 - DNA, 20 bp, Homo sapiens
gagtgccctgctttgcaaac

SEQ ID NO: 6249034 - DNA, 14 bp, Homo sapiens
gagtgccctggggc

SEQ ID NO: 6249035 - DNA, 15 bp, Homo sapiens
gagtgccctggggca

SEQ ID NO: 6249036 - DNA, 23 bp, Homo sapiens
gagtgcccttaaaataatgattt

SEQ ID NO: 6249037 - DNA, 23 bp, Homo sapiens
gagtgcctccccttcttgtgtcc

SEQ ID NO: 6249038 - DNA, 19 bp, Homo sapiens
gccctagaggacactagga

SEQ ID NO: 6249039 - DNA, 21 bp, Homo sapiens
gccctagaggacactaggaga

SEQ ID NO: 6249040 - DNA, 19 bp, Homo sapiens
gccctagcccagcgctctg

SEQ ID NO: 6249041 - DNA, 16 bp, Homo sapiens
gccctagccctcagcc

SEQ ID NO: 6249042 - DNA, 12 bp, Homo sapiens
gccctagccctg

SEQ ID NO: 6249043 - DNA, 18 bp, Homo sapiens
gccctagccctgctccaa

SEQ ID NO: 6249044 - DNA, 18 bp, Homo sapiens
gccctaggattcctcccc

SEQ ID NO: 6249045 - DNA, 23 bp, Homo sapiens
gccctaggcatactctccaggat

SEQ ID NO: 6249046 - DNA, 15 bp, Homo sapiens
gccctaggctaccct

SEQ ID NO: 6249047 - DNA, 20 bp, Homo sapiens
gccctaggctacccttgcca

SEQ ID NO: 6249048 - DNA, 12 bp, Homo sapiens
gccctaggctcc

SEQ ID NO: 6249049 - DNA, 21 bp, Homo sapiens
gccctagggaaaacacggccc

SEQ ID NO: 6249050 - DNA, 17 bp, Homo sapiens
gccctagggtgctctga

SEQ ID NO: 6249051 - DNA, 18 bp, Homo sapiens
gccctagtgggagcccag

SEQ ID NO: 6249052 - DNA, 21 bp, Homo sapiens
gccctataacccctgcctgga

SEQ ID NO: 6249053 - DNA, 14 bp, Homo sapiens
gccctatggatgtg

SEQ ID NO: 6249054 - DNA, 14 bp, Homo sapiens
gccctatgggcctg

SEQ ID NO: 6249055 - DNA, 15 bp, Homo sapiens
gccctatgggcctgc

SEQ ID NO: 6249056 - DNA, 19 bp, Homo sapiens
gccctatgggcctgccggg

SEQ ID NO: 6249057 - DNA, 14 bp, Homo sapiens
gccctatgtgaaaa

SEQ ID NO: 6249058 - DNA, 12 bp, Homo sapiens
gccctatgtgta

SEQ ID NO: 6249059 - DNA, 14 bp, Homo sapiens
gccctattgctgct

SEQ ID NO: 6249060 - DNA, 18 bp, Homo sapiens
gccctcaacaggcccagg

SEQ ID NO: 6249061 - DNA, 17 bp, Homo sapiens
gccctcaactattctgt

SEQ ID NO: 6249062 - DNA, 15 bp, Homo sapiens
gccctcaaggcctcc

SEQ ID NO: 6249063 - DNA, 20 bp, Homo sapiens
gccctcaaggcctcccacag

SEQ ID NO: 6249064 - DNA, 21 bp, Homo sapiens
gccctcaaggcctcccacagt

SEQ ID NO: 6249065 - DNA, 23 bp, Homo sapiens
gccctcaaggcctcccacagtga

SEQ ID NO: 6249066 - DNA, 17 bp, Homo sapiens
gccctcaagtaaaagaa

SEQ ID NO: 6249067 - DNA, 20 bp, Homo sapiens
gccctcaatccaccttcagg

SEQ ID NO: 6249068 - DNA, 13 bp, Homo sapiens
gccctcaccacag

SEQ ID NO: 6249069 - DNA, 14 bp, Homo sapiens
gccctcaccacagc

SEQ ID NO: 6249070 - DNA, 19 bp, Homo sapiens
gccctcaccccaatccctg

SEQ ID NO: 6249071 - DNA, 20 bp, Homo sapiens
gccctcacccctgccctggg

SEQ ID NO: 6249072 - DNA, 21 bp, Homo sapiens
gccctcacccctggttctcat

SEQ ID NO: 6249073 - DNA, 14 bp, Homo sapiens
gccctcacctctga

SEQ ID NO: 6249074 - DNA, 16 bp, Homo sapiens
gccctcacctctgagg

SEQ ID NO: 6249075 - DNA, 14 bp, Homo sapiens
gccctcacctgcag

SEQ ID NO: 6249076 - DNA, 16 bp, Homo sapiens
gccctcacctgcagag

SEQ ID NO: 6249077 - DNA, 20 bp, Homo sapiens
gccctcacctgcagagaaac

SEQ ID NO: 6249078 - DNA, 16 bp, Homo sapiens
gccctcactaacaaag

SEQ ID NO: 6249079 - DNA, 20 bp, Homo sapiens
gccctcactcaggaaccctg

SEQ ID NO: 6249080 - DNA, 17 bp, Homo sapiens
gccctcactccctctgc

SEQ ID NO: 6249081 - DNA, 15 bp, Homo sapiens
gccctcactgagcct

SEQ ID NO: 6249082 - DNA, 19 bp, Homo sapiens
gccctcactgtcagtccca

SEQ ID NO: 6249083 - DNA, 19 bp, Homo sapiens
gccctcagaacccttggct

SEQ ID NO: 6249084 - DNA, 14 bp, Homo sapiens
gccctcagaagaaa

SEQ ID NO: 6249085 - DNA, 15 bp, Homo sapiens
gccctcagatcccag

SEQ ID NO: 6249086 - DNA, 21 bp, Homo sapiens
gccctcagatcccagggtaca

SEQ ID NO: 6249087 - DNA, 23 bp, Homo sapiens
gccctcagatgaaaataaaataa

SEQ ID NO: 6249088 - DNA, 18 bp, Homo sapiens
gccctcagatgtcccttg

SEQ ID NO: 6249089 - DNA, 21 bp, Homo sapiens
gccctcagcgtctccccatgc

SEQ ID NO: 6249090 - DNA, 14 bp, Homo sapiens
gccctcagctccct

SEQ ID NO: 6249091 - DNA, 15 bp, Homo sapiens
gccctcagctccctg

SEQ ID NO: 6249092 - DNA, 16 bp, Homo sapiens
gccctcagctcctggg

SEQ ID NO: 6249093 - DNA, 15 bp, Homo sapiens
gccctcagctggtcc

SEQ ID NO: 6249094 - DNA, 18 bp, Homo sapiens
gccctcaggccagtgcca

SEQ ID NO: 6249095 - DNA, 19 bp, Homo sapiens
gccctcaggccagtgccag

SEQ ID NO: 6249096 - DNA, 22 bp, Homo sapiens
gccctcaggccagtgccaggac

SEQ ID NO: 6249097 - DNA, 18 bp, Homo sapiens
gccctcaggctccccaga

SEQ ID NO: 6249098 - DNA, 13 bp, Homo sapiens
gccctcaggggcc

SEQ ID NO: 6249099 - DNA, 22 bp, Homo sapiens
gccctcagtcagttcccggagc

SEQ ID NO: 6249100 - DNA, 18 bp, Homo sapiens
gccctcagtcggggcagg

SEQ ID NO: 6249101 - DNA, 22 bp, Homo sapiens
gccctcataaaccaatgtggca

SEQ ID NO: 6249102 - DNA, 20 bp, Homo sapiens
gccctcatgataatctgggc

SEQ ID NO: 6249103 - DNA, 21 bp, Homo sapiens
gccctcatgataatctgggca

SEQ ID NO: 6249104 - DNA, 16 bp, Homo sapiens
gccctcatggcccctc

SEQ ID NO: 6249105 - DNA, 18 bp, Homo sapiens
gccctcatggcccctctg

SEQ ID NO: 6249106 - DNA, 22 bp, Homo sapiens
gccctcatggcccctctgacct

SEQ ID NO: 6249107 - DNA, 19 bp, Homo sapiens
gccctcatgggtcctagcc

SEQ ID NO: 6249108 - DNA, 22 bp, Homo sapiens
gccctcatgggtcctagccctt

SEQ ID NO: 6249109 - DNA, 21 bp, Homo sapiens
gccctcattacggctcctctc

SEQ ID NO: 6249110 - DNA, 12 bp, Homo sapiens
gccctcattcag

SEQ ID NO: 6249111 - DNA, 23 bp, Homo sapiens
gccctccaagaccttctccttca

SEQ ID NO: 6249112 - DNA, 16 bp, Homo sapiens
gccctccacacctgcg

SEQ ID NO: 6249113 - DNA, 18 bp, Homo sapiens
gccctccacacctgcggc

SEQ ID NO: 6249114 - DNA, 14 bp, Homo sapiens
gccctccacagccg

SEQ ID NO: 6249115 - DNA, 14 bp, Homo sapiens
gccctccacatttt

SEQ ID NO: 6249116 - DNA, 16 bp, Homo sapiens
gccctccacattttca

SEQ ID NO: 6249117 - DNA, 21 bp, Homo sapiens
gccctccacgccggctcttcc

SEQ ID NO: 6249118 - DNA, 23 bp, Homo sapiens
gccctccactccactgcctttgg

SEQ ID NO: 6249119 - DNA, 20 bp, Homo sapiens
gccctccagagccccacagc

SEQ ID NO: 6249120 - DNA, 22 bp, Homo sapiens
gccctccagagccccacagccc

SEQ ID NO: 6249121 - DNA, 20 bp, Homo sapiens
gccctccagctgctgctctc

SEQ ID NO: 6249122 - DNA, 22 bp, Homo sapiens
gccctccaggccgacaggaggc

SEQ ID NO: 6249123 - DNA, 15 bp, Homo sapiens
gccctccaggcctgc

SEQ ID NO: 6249124 - DNA, 14 bp, Homo sapiens
gccctccaggcttt

SEQ ID NO: 6249125 - DNA, 18 bp, Homo sapiens
gccctccagggccaggat

SEQ ID NO: 6249126 - DNA, 22 bp, Homo sapiens
gccctccatcccgacatggacc

SEQ ID NO: 6249127 - DNA, 19 bp, Homo sapiens
gccctccatcccttcccca

SEQ ID NO: 6249128 - DNA, 15 bp, Homo sapiens
gccctccatgcgcag

SEQ ID NO: 6249129 - DNA, 17 bp, Homo sapiens
gccctccatggcctggc

SEQ ID NO: 6249130 - DNA, 16 bp, Homo sapiens
gccctccatgggctag

SEQ ID NO: 6249131 - DNA, 16 bp, Homo sapiens
gccctccatggtcctg

SEQ ID NO: 6249132 - DNA, 20 bp, Homo sapiens
gccctccatggtcctgtctg

SEQ ID NO: 6249133 - DNA, 13 bp, Homo sapiens
gccctcccaaaga

SEQ ID NO: 6249134 - DNA, 13 bp, Homo sapiens
gccctcccaagtc

SEQ ID NO: 6249135 - DNA, 16 bp, Homo sapiens
gccctcccaagtccca

SEQ ID NO: 6249136 - DNA, 17 bp, Homo sapiens
gccctcccacagcctcc

SEQ ID NO: 6249137 - DNA, 18 bp, Homo sapiens
gccctcccacagcctcct

SEQ ID NO: 6249138 - DNA, 13 bp, Homo sapiens
gccctcccaccac

SEQ ID NO: 6249139 - DNA, 14 bp, Homo sapiens
gccctcccaccacc

SEQ ID NO: 6249140 - DNA, 12 bp, Homo sapiens
gccctcccaccc

SEQ ID NO: 6249141 - DNA, 13 bp, Homo sapiens
gccctcccacccc

SEQ ID NO: 6249142 - DNA, 15 bp, Homo sapiens
gccctcccagaacct

SEQ ID NO: 6249143 - DNA, 13 bp, Homo sapiens
gccctcccagacc

SEQ ID NO: 6249144 - DNA, 12 bp, Homo sapiens
gccctcccagca

SEQ ID NO: 6249145 - DNA, 14 bp, Homo sapiens
gccctcccaggacc

SEQ ID NO: 6249146 - DNA, 22 bp, Homo sapiens
gccctcccaggaccctccactc

SEQ ID NO: 6249147 - DNA, 13 bp, Homo sapiens
gccctcccaggcg

SEQ ID NO: 6249148 - DNA, 14 bp, Homo sapiens
gccctcccaggctg

SEQ ID NO: 6249149 - DNA, 21 bp, Homo sapiens
gccctcccatgttgcatgcct

SEQ ID NO: 6249150 - DNA, 23 bp, Homo sapiens
gccctcccatgttgcatgcctat

SEQ ID NO: 6249151 - DNA, 13 bp, Homo sapiens
gccctccccacct

SEQ ID NO: 6249152 - DNA, 15 bp, Homo sapiens
gccctccccagagca

SEQ ID NO: 6249153 - DNA, 16 bp, Homo sapiens
gccctccccagagcac

SEQ ID NO: 6249154 - DNA, 18 bp, Homo sapiens
gccctccccatggagcca

SEQ ID NO: 6249155 - DNA, 20 bp, Homo sapiens
gccctcccccaaacagactc

SEQ ID NO: 6249156 - DNA, 17 bp, Homo sapiens
gccctcccccagctcct

SEQ ID NO: 6249157 - DNA, 19 bp, Homo sapiens
gccctcccccagctccttg

SEQ ID NO: 6249158 - DNA, 19 bp, Homo sapiens
gccctccccccagctccct

SEQ ID NO: 6249159 - DNA, 12 bp, Homo sapiens
gccctccccctc

SEQ ID NO: 6249160 - DNA, 13 bp, Homo sapiens
gccctccccctgc

SEQ ID NO: 6249161 - DNA, 18 bp, Homo sapiens
gccctccccctgccagag

SEQ ID NO: 6249162 - DNA, 23 bp, Homo sapiens
gccctccccctgccagaggcctg

SEQ ID NO: 6249163 - DNA, 20 bp, Homo sapiens
gccctccccgatggcgggga

SEQ ID NO: 6249164 - DNA, 13 bp, Homo sapiens
gccctcccctcag

SEQ ID NO: 6249165 - DNA, 18 bp, Homo sapiens
gccctcccctcagcgcag

SEQ ID NO: 6249166 - DNA, 20 bp, Homo sapiens
gccctcccctcagcgcaggc

SEQ ID NO: 6249167 - DNA, 22 bp, Homo sapiens
gccctcccctcagcgcaggctg

SEQ ID NO: 6249168 - DNA, 23 bp, Homo sapiens
gccctcccctcagcgcaggctgc

SEQ ID NO: 6249169 - DNA, 22 bp, Homo sapiens
gccctcccctccggactggtgc

SEQ ID NO: 6249170 - DNA, 18 bp, Homo sapiens
gccctcccctctctgcac

SEQ ID NO: 6249171 - DNA, 16 bp, Homo sapiens
gccctcccgcaccttc

SEQ ID NO: 6249172 - DNA, 13 bp, Homo sapiens
gccctcccgcccc

SEQ ID NO: 6249173 - DNA, 13 bp, Homo sapiens
gccctccctatgt

SEQ ID NO: 6249174 - DNA, 11 bp, Homo sapiens
gccctccctcc

SEQ ID NO: 6249175 - DNA, 14 bp, Homo sapiens
gccctccctcccag

SEQ ID NO: 6249176 - DNA, 17 bp, Homo sapiens
gccctccctccctagcc

SEQ ID NO: 6249177 - DNA, 16 bp, Homo sapiens
gccctccctccctcca

SEQ ID NO: 6249178 - DNA, 14 bp, Homo sapiens
gccctccctccgcc

SEQ ID NO: 6249179 - DNA, 23 bp, Homo sapiens
gccctccctccgcctcccatccc

SEQ ID NO: 6249180 - DNA, 21 bp, Homo sapiens
gccctccctctactcttcctg

SEQ ID NO: 6249181 - DNA, 23 bp, Homo sapiens
gccctccctctactcttcctgtc

SEQ ID NO: 6249182 - DNA, 15 bp, Homo sapiens
gccctccctctccca

SEQ ID NO: 6249183 - DNA, 18 bp, Homo sapiens
gccctccctcttcccagc

SEQ ID NO: 6249184 - DNA, 17 bp, Homo sapiens
gccctccctgactccct

SEQ ID NO: 6249185 - DNA, 20 bp, Homo sapiens
gccctccctgactccctgtg

SEQ ID NO: 6249186 - DNA, 22 bp, Homo sapiens
gccctccctgactccctgtggg

SEQ ID NO: 6249187 - DNA, 15 bp, Homo sapiens
gccctccctgcgctt

SEQ ID NO: 6249188 - DNA, 14 bp, Homo sapiens
gccctccctgctag

SEQ ID NO: 6249189 - DNA, 19 bp, Homo sapiens
gccctccctgctagcacag

SEQ ID NO: 6249190 - DNA, 21 bp, Homo sapiens
gccctccctgctagcacagag

SEQ ID NO: 6249191 - DNA, 13 bp, Homo sapiens
gccctccctgctg

SEQ ID NO: 6249192 - DNA, 16 bp, Homo sapiens
gccctccctgctgcca

SEQ ID NO: 6249193 - DNA, 18 bp, Homo sapiens
gccctccctggcatgtca

SEQ ID NO: 6249194 - DNA, 13 bp, Homo sapiens
gccctccctggcc

SEQ ID NO: 6249195 - DNA, 14 bp, Homo sapiens
gccctccctggcct

SEQ ID NO: 6249196 - DNA, 20 bp, Homo sapiens
gccctccctggggtccttgc

SEQ ID NO: 6249197 - DNA, 21 bp, Homo sapiens
gccctccctgtcctcctcgga

SEQ ID NO: 6249198 - DNA, 13 bp, Homo sapiens
gccctccctgtct

SEQ ID NO: 6249199 - DNA, 20 bp, Homo sapiens
gccctccctgtctccagggc

SEQ ID NO: 6249200 - DNA, 22 bp, Homo sapiens
gccctccctgttccccagagaa

SEQ ID NO: 6249201 - DNA, 18 bp, Homo sapiens
gccctcccttctccctgg

SEQ ID NO: 6249202 - DNA, 19 bp, Homo sapiens
gccctcccttctccctgga

SEQ ID NO: 6249203 - DNA, 21 bp, Homo sapiens
gccctcccttggaaacctgcc

SEQ ID NO: 6249204 - DNA, 23 bp, Homo sapiens
gccctcccttggaaacctgccct

SEQ ID NO: 6249205 - DNA, 15 bp, Homo sapiens
gccctccctttctct

SEQ ID NO: 6249206 - DNA, 23 bp, Homo sapiens
gccctccctttctctctccaccc

SEQ ID NO: 6249207 - DNA, 18 bp, Homo sapiens
gccctccgacagccccct

SEQ ID NO: 6249208 - DNA, 22 bp, Homo sapiens
gccctccgaccacttccagggg

SEQ ID NO: 6249209 - DNA, 18 bp, Homo sapiens
gccctccgacctctctcg

SEQ ID NO: 6249210 - DNA, 21 bp, Homo sapiens
gccctccgagccgcgccaacg

SEQ ID NO: 6249211 - DNA, 18 bp, Homo sapiens
gccctccgccagccctgt

SEQ ID NO: 6249212 - DNA, 19 bp, Homo sapiens
gccctccgccagccctgtt

SEQ ID NO: 6249213 - DNA, 23 bp, Homo sapiens
gccctccgccattctcaagccct

SEQ ID NO: 6249214 - DNA, 19 bp, Homo sapiens
gccctccgccccgtccccc

SEQ ID NO: 6249215 - DNA, 23 bp, Homo sapiens
gccctccgccccgtccccccatc

SEQ ID NO: 6249216 - DNA, 15 bp, Homo sapiens
gagtgcctgcagcat

SEQ ID NO: 6249217 - DNA, 12 bp, Homo sapiens
gagtgcctggag

SEQ ID NO: 6249218 - DNA, 13 bp, Homo sapiens
gagtgcctggagt

SEQ ID NO: 6249219 - DNA, 14 bp, Homo sapiens
gagtgcctggccaa

SEQ ID NO: 6249220 - DNA, 20 bp, Homo sapiens
gagtgcgcagatctgtgcct

SEQ ID NO: 6249221 - DNA, 18 bp, Homo sapiens
gagtgcgccctgcactcc

SEQ ID NO: 6249222 - DNA, 21 bp, Homo sapiens
gagtgcgctcttggtccctgg

SEQ ID NO: 6249223 - DNA, 17 bp, Homo sapiens
gagtgcggcgtggagac

SEQ ID NO: 6249224 - DNA, 14 bp, Homo sapiens
gagtgcgggctgag

SEQ ID NO: 6249225 - DNA, 14 bp, Homo sapiens
gagtgcgtctgagg

SEQ ID NO: 6249226 - DNA, 16 bp, Homo sapiens
gagtgcgtctgagggg

SEQ ID NO: 6249227 - DNA, 20 bp, Homo sapiens
gagtgctaagagcctctgga

SEQ ID NO: 6249228 - DNA, 15 bp, Homo sapiens
gagtgctaagtgtag

SEQ ID NO: 6249229 - DNA, 11 bp, Homo sapiens
gagtgctctga

SEQ ID NO: 6249230 - DNA, 14 bp, Homo sapiens
gagtgctcttccca

SEQ ID NO: 6249231 - DNA, 15 bp, Homo sapiens
gagtgctcttcccac

SEQ ID NO: 6249232 - DNA, 19 bp, Homo sapiens
gagtgctgataagaatgaa

SEQ ID NO: 6249233 - DNA, 22 bp, Homo sapiens
gagtgctgcttgtgcctccctt

SEQ ID NO: 6249234 - DNA, 24 bp, Homo sapiens
gagtgctgcttgtgcctcccttcc

SEQ ID NO: 6249235 - DNA, 13 bp, Homo sapiens
gagtgctggactg

SEQ ID NO: 6249236 - DNA, 21 bp, Homo sapiens
gagtgctggactgttccaggc

SEQ ID NO: 6249237 - DNA, 12 bp, Homo sapiens
gagtgctggcac

SEQ ID NO: 6249238 - DNA, 11 bp, Homo sapiens
gagtgctggct

SEQ ID NO: 6249239 - DNA, 16 bp, Homo sapiens
gagtgctgggggaggc

SEQ ID NO: 6249240 - DNA, 14 bp, Homo sapiens
gagtgctgtgctgt

SEQ ID NO: 6249241 - DNA, 19 bp, Homo sapiens
gagtgctgtgctgtgttta

SEQ ID NO: 6249242 - DNA, 12 bp, Homo sapiens
gagtgctgtttt

SEQ ID NO: 6249243 - DNA, 15 bp, Homo sapiens
gagtgctgttttgtt

SEQ ID NO: 6249244 - DNA, 16 bp, Homo sapiens
gagtgcttaaaaatgc

SEQ ID NO: 6249245 - DNA, 20 bp, Homo sapiens
gagtgcttccgctgcggtga

SEQ ID NO: 6249246 - DNA, 16 bp, Homo sapiens
gagtggaaactcagcc

SEQ ID NO: 6249247 - DNA, 14 bp, Homo sapiens
gagtggaaatacac

SEQ ID NO: 6249248 - DNA, 20 bp, Homo sapiens
gagtggaatagtatcctcca

SEQ ID NO: 6249249 - DNA, 22 bp, Homo sapiens
gagtggaatagtatcctccagg

SEQ ID NO: 6249250 - DNA, 14 bp, Homo sapiens
gagtggaatgcagg

SEQ ID NO: 6249251 - DNA, 16 bp, Homo sapiens
gagtggaatgcaggga

SEQ ID NO: 6249252 - DNA, 21 bp, Homo sapiens
gagtggacaccgctcagtatt

SEQ ID NO: 6249253 - DNA, 22 bp, Homo sapiens
gagtggacaccgctcagtatta

SEQ ID NO: 6249254 - DNA, 16 bp, Homo sapiens
gagtggacagcagctg

SEQ ID NO: 6249255 - DNA, 13 bp, Homo sapiens
gagtggacctgtg

SEQ ID NO: 6249256 - DNA, 16 bp, Homo sapiens
gagtggacctgtgctg

SEQ ID NO: 6249257 - DNA, 17 bp, Homo sapiens
gagtggacgctgtccat

SEQ ID NO: 6249258 - DNA, 19 bp, Homo sapiens
gagtggactgttccctgag

SEQ ID NO: 6249259 - DNA, 16 bp, Homo sapiens
gagtggagagagcagg

SEQ ID NO: 6249260 - DNA, 18 bp, Homo sapiens
gagtggagcccagggtgc

SEQ ID NO: 6249261 - DNA, 17 bp, Homo sapiens
gagtggaggaagcccac

SEQ ID NO: 6249262 - DNA, 19 bp, Homo sapiens
gagtggaggggtcagcagg

SEQ ID NO: 6249263 - DNA, 20 bp, Homo sapiens
gagtggaggggtcagcaggg

SEQ ID NO: 6249264 - DNA, 11 bp, Homo sapiens
gagtggagtta

SEQ ID NO: 6249265 - DNA, 17 bp, Homo sapiens
gagtggagttactgaac

SEQ ID NO: 6249266 - DNA, 18 bp, Homo sapiens
gagtggatagatgccctg

SEQ ID NO: 6249267 - DNA, 19 bp, Homo sapiens
gagtggatctccaaggacc

SEQ ID NO: 6249268 - DNA, 18 bp, Homo sapiens
gagtggatgctgtgctac

SEQ ID NO: 6249269 - DNA, 13 bp, Homo sapiens
gagtggatggatg

SEQ ID NO: 6249270 - DNA, 19 bp, Homo sapiens
gagtggatggatggacaga

SEQ ID NO: 6249271 - DNA, 13 bp, Homo sapiens
gagtggcagcagc

SEQ ID NO: 6249272 - DNA, 16 bp, Homo sapiens
gagtggcagcagcccc

SEQ ID NO: 6249273 - DNA, 11 bp, Homo sapiens
gagtggcagcc

SEQ ID NO: 6249274 - DNA, 15 bp, Homo sapiens
gagtggcagccatgc

SEQ ID NO: 6249275 - DNA, 18 bp, Homo sapiens
gagtggcagccatgcctc

SEQ ID NO: 6249276 - DNA, 19 bp, Homo sapiens
gagtggcagccatgcctca

SEQ ID NO: 6249277 - DNA, 15 bp, Homo sapiens
gagtggcagcccagc

SEQ ID NO: 6249278 - DNA, 15 bp, Homo sapiens
gagtggcaggaaaga

SEQ ID NO: 6249279 - DNA, 19 bp, Homo sapiens
gagtggcaggggacaggag

SEQ ID NO: 6249280 - DNA, 14 bp, Homo sapiens
gagtggcaggtggg

SEQ ID NO: 6249281 - DNA, 21 bp, Homo sapiens
gagtggcatggtcctgtgccc

SEQ ID NO: 6249282 - DNA, 15 bp, Homo sapiens
gagtggccacagcac

SEQ ID NO: 6249283 - DNA, 19 bp, Homo sapiens
gagtggccacggcccaggg

SEQ ID NO: 6249284 - DNA, 13 bp, Homo sapiens
gagtggccactgg

SEQ ID NO: 6249285 - DNA, 19 bp, Homo sapiens
gagtggccagccagtgcca

SEQ ID NO: 6249286 - DNA, 20 bp, Homo sapiens
gagtggccagcgccagggcc

SEQ ID NO: 6249287 - DNA, 21 bp, Homo sapiens
gagtggccagcgccagggccc

SEQ ID NO: 6249288 - DNA, 13 bp, Homo sapiens
gagtggccccacc

SEQ ID NO: 6249289 - DNA, 17 bp, Homo sapiens
gagtggccccacctggc

SEQ ID NO: 6249290 - DNA, 14 bp, Homo sapiens
gagtggcccctggc

SEQ ID NO: 6249291 - DNA, 21 bp, Homo sapiens
gagtggccggggaagctggca

SEQ ID NO: 6249292 - DNA, 17 bp, Homo sapiens
gagtggcctccctgctg

SEQ ID NO: 6249293 - DNA, 12 bp, Homo sapiens
gagtggcctggg

SEQ ID NO: 6249294 - DNA, 22 bp, Homo sapiens
gagtggcctgggtcccagggct

SEQ ID NO: 6249295 - DNA, 18 bp, Homo sapiens
gagtggcgagtccagaca

SEQ ID NO: 6249296 - DNA, 17 bp, Homo sapiens
gagtggctcactggctg

SEQ ID NO: 6249297 - DNA, 18 bp, Homo sapiens
gagtggctcactggctgg

SEQ ID NO: 6249298 - DNA, 24 bp, Homo sapiens
gagtggctgaaataaaagcctctg

SEQ ID NO: 6249299 - DNA, 11 bp, Homo sapiens
gagtggctgac

SEQ ID NO: 6249300 - DNA, 18 bp, Homo sapiens
gagtggctgaccaggccc

SEQ ID NO: 6249301 - DNA, 15 bp, Homo sapiens
gagtggctgccggag

SEQ ID NO: 6249302 - DNA, 17 bp, Homo sapiens
gagtgggaaccggaaac

SEQ ID NO: 6249303 - DNA, 23 bp, Homo sapiens
gagtgggaagagggggctggcca

SEQ ID NO: 6249304 - DNA, 11 bp, Homo sapiens
gagtgggaagc

SEQ ID NO: 6249305 - DNA, 18 bp, Homo sapiens
gagtgggacagacagcag

SEQ ID NO: 6249306 - DNA, 17 bp, Homo sapiens
gagtgggacagagtctg

SEQ ID NO: 6249307 - DNA, 15 bp, Homo sapiens
gagtgggacttggag

SEQ ID NO: 6249308 - DNA, 12 bp, Homo sapiens
gagtgggagagg

SEQ ID NO: 6249309 - DNA, 16 bp, Homo sapiens
gagtgggagaggaagc

SEQ ID NO: 6249310 - DNA, 21 bp, Homo sapiens
gagtgggagagtacctgtgtg

SEQ ID NO: 6249311 - DNA, 23 bp, Homo sapiens
gagtgggcagagcccccaggaag

SEQ ID NO: 6249312 - DNA, 20 bp, Homo sapiens
gagtgggcagaggtggcgcc

SEQ ID NO: 6249313 - DNA, 16 bp, Homo sapiens
gagtgggccccgggct

SEQ ID NO: 6249314 - DNA, 13 bp, Homo sapiens
gagtgggccctgc

SEQ ID NO: 6249315 - DNA, 14 bp, Homo sapiens
gagtgggccctgcc

SEQ ID NO: 6249316 - DNA, 15 bp, Homo sapiens
gagtgggccctgccc

SEQ ID NO: 6249317 - DNA, 17 bp, Homo sapiens
gagtgggctctctggac

SEQ ID NO: 6249318 - DNA, 23 bp, Homo sapiens
gagtgggctctctggacctgacc

SEQ ID NO: 6249319 - DNA, 16 bp, Homo sapiens
gagtgggctgcctggg

SEQ ID NO: 6249320 - DNA, 22 bp, Homo sapiens
gagtgggctttggtggccaggg

SEQ ID NO: 6249321 - DNA, 21 bp, Homo sapiens
gagtgggctttgtggaaacag

SEQ ID NO: 6249322 - DNA, 22 bp, Homo sapiens
gagtgggctttgtggaaacagc

SEQ ID NO: 6249323 - DNA, 20 bp, Homo sapiens
gagtggggagacacctcaga

SEQ ID NO: 6249324 - DNA, 20 bp, Homo sapiens
gagtggggagcggagcttgg

SEQ ID NO: 6249325 - DNA, 19 bp, Homo sapiens
gagtggggagggagtctgg

SEQ ID NO: 6249326 - DNA, 22 bp, Homo sapiens
gagtggggcctttgccagcaga

SEQ ID NO: 6249327 - DNA, 18 bp, Homo sapiens
gagtggggctagactggg

SEQ ID NO: 6249328 - DNA, 16 bp, Homo sapiens
gagtggggcttcctgg

SEQ ID NO: 6249329 - DNA, 23 bp, Homo sapiens
gagtgggggatcacagcctctga

SEQ ID NO: 6249330 - DNA, 14 bp, Homo sapiens
gagtggggggacag

SEQ ID NO: 6249331 - DNA, 15 bp, Homo sapiens
gagtggggggaggaa

SEQ ID NO: 6249332 - DNA, 15 bp, Homo sapiens
gagtggggtttgctt

SEQ ID NO: 6249333 - DNA, 14 bp, Homo sapiens
gagtgggtgggatg

SEQ ID NO: 6249334 - DNA, 15 bp, Homo sapiens
gagtgggtggggagt

SEQ ID NO: 6249335 - DNA, 13 bp, Homo sapiens
gagtgggttttgt

SEQ ID NO: 6249336 - DNA, 19 bp, Homo sapiens
gagtggtaaaaaagaaatg

SEQ ID NO: 6249337 - DNA, 19 bp, Homo sapiens
gagtggtacaagggagaag

SEQ ID NO: 6249338 - DNA, 20 bp, Homo sapiens
gagtggtcactggtcagggc

SEQ ID NO: 6249339 - DNA, 23 bp, Homo sapiens
gagtggtcactggtcagggcagt

SEQ ID NO: 6249340 - DNA, 16 bp, Homo sapiens
gagtggtcagaacaga

SEQ ID NO: 6249341 - DNA, 20 bp, Homo sapiens
gagtggtccacattctgctg

SEQ ID NO: 6249342 - DNA, 18 bp, Homo sapiens
gagtggtgaggggccact

SEQ ID NO: 6249343 - DNA, 12 bp, Homo sapiens
gagtggtgagtg

SEQ ID NO: 6249344 - DNA, 16 bp, Homo sapiens
gagtggtgcagacaga

SEQ ID NO: 6249345 - DNA, 19 bp, Homo sapiens
gagtggtggaggaggacac

SEQ ID NO: 6249346 - DNA, 15 bp, Homo sapiens
gagtggtggcagctc

SEQ ID NO: 6249347 - DNA, 14 bp, Homo sapiens
gagtggtggttcct

SEQ ID NO: 6249348 - DNA, 19 bp, Homo sapiens
gagtggttaggcagcaagc

SEQ ID NO: 6249349 - DNA, 21 bp, Homo sapiens
gagtggtttttcttttcttgg

SEQ ID NO: 6249350 - DNA, 17 bp, Homo sapiens
gagtgtaaaatgtatat

SEQ ID NO: 6249351 - DNA, 18 bp, Homo sapiens
gagtgtaacaagaaagga

SEQ ID NO: 6249352 - DNA, 13 bp, Homo sapiens
gagtgtaactttc

SEQ ID NO: 6249353 - DNA, 17 bp, Homo sapiens
gagtgtaagtgtgagta

SEQ ID NO: 6249354 - DNA, 20 bp, Homo sapiens
gagtgtaagtgtgagtaaga

SEQ ID NO: 6249355 - DNA, 20 bp, Homo sapiens
gagtgtacagacccctgcct

SEQ ID NO: 6249356 - DNA, 17 bp, Homo sapiens
gagtgtactgtgcctgg

SEQ ID NO: 6249357 - DNA, 11 bp, Homo sapiens
gagtgtagaag

SEQ ID NO: 6249358 - DNA, 13 bp, Homo sapiens
gagtgtagaagca

SEQ ID NO: 6249359 - DNA, 14 bp, Homo sapiens
gagtgtagaagcat

SEQ ID NO: 6249360 - DNA, 23 bp, Homo sapiens
gagtgtagactggccatgcaagt

SEQ ID NO: 6249361 - DNA, 15 bp, Homo sapiens
gagtgtagactgtgg

SEQ ID NO: 6249362 - DNA, 17 bp, Homo sapiens
gagtgtagactgtggct

SEQ ID NO: 6249363 - DNA, 18 bp, Homo sapiens
gagtgtagcaactacagt

SEQ ID NO: 6249364 - DNA, 14 bp, Homo sapiens
gagtgtagctgtaa

SEQ ID NO: 6249365 - DNA, 18 bp, Homo sapiens
gagtgtagctgtaagggc

SEQ ID NO: 6249366 - DNA, 23 bp, Homo sapiens
gagtgtagctgtaagggcagtgc

SEQ ID NO: 6249367 - DNA, 16 bp, Homo sapiens
gagtgtagctgtgaaa

SEQ ID NO: 6249368 - DNA, 16 bp, Homo sapiens
gagtgtaggtgaaatg

SEQ ID NO: 6249369 - DNA, 13 bp, Homo sapiens
gagtgtagtcccg

SEQ ID NO: 6249370 - DNA, 11 bp, Homo sapiens
gagtgtagtga

SEQ ID NO: 6249371 - DNA, 17 bp, Homo sapiens
gagtgtatacatgtgtg

SEQ ID NO: 6249372 - DNA, 13 bp, Homo sapiens
gagtgtatatata

SEQ ID NO: 6249373 - DNA, 14 bp, Homo sapiens
gagtgtatatatat

SEQ ID NO: 6249374 - DNA, 18 bp, Homo sapiens
gagtgtatgcatacaaat

SEQ ID NO: 6249375 - DNA, 15 bp, Homo sapiens
gagtgtatgtataca

SEQ ID NO: 6249376 - DNA, 20 bp, Homo sapiens
gagtgtcaaccagacagagg

SEQ ID NO: 6249377 - DNA, 20 bp, Homo sapiens
gagtgtcaactccaggactt

SEQ ID NO: 6249378 - DNA, 16 bp, Homo sapiens
gagtgtcatgaagtgc

SEQ ID NO: 6249379 - DNA, 20 bp, Homo sapiens
gagtgtcatgaagtgcacag

SEQ ID NO: 6249380 - DNA, 23 bp, Homo sapiens
gagtgtccctttttgcaggggac

SEQ ID NO: 6249381 - DNA, 19 bp, Homo sapiens
gagtgtcctcttccctctc

SEQ ID NO: 6249382 - DNA, 18 bp, Homo sapiens
gagtgtcctgcccatgcc

SEQ ID NO: 6249383 - DNA, 16 bp, Homo sapiens
gagtgtctatggagca

SEQ ID NO: 6249384 - DNA, 13 bp, Homo sapiens
gagtgtctctgcc

SEQ ID NO: 6249385 - DNA, 14 bp, Homo sapiens
gagtgtctctgcct

SEQ ID NO: 6249386 - DNA, 17 bp, Homo sapiens
gagtgtctggaattgtg

SEQ ID NO: 6249387 - DNA, 18 bp, Homo sapiens
gagtgtctggtgccctgg

SEQ ID NO: 6249388 - DNA, 19 bp, Homo sapiens
gagtgtcttaattaaaaga

SEQ ID NO: 6249389 - DNA, 13 bp, Homo sapiens
gagtgtctttcca

SEQ ID NO: 6249390 - DNA, 22 bp, Homo sapiens
gagtgtctttccacggagccac

SEQ ID NO: 6249391 - DNA, 16 bp, Homo sapiens
gagtgtgacagggcca

SEQ ID NO: 6249392 - DNA, 12 bp, Homo sapiens
gagtgtgaccaa

SEQ ID NO: 6249393 - DNA, 15 bp, Homo sapiens
gagtgtgactttttg

SEQ ID NO: 6249394 - DNA, 12 bp, Homo sapiens
gagtgtgagaga

SEQ ID NO: 6249395 - DNA, 13 bp, Homo sapiens
gagtgtgagcagg

SEQ ID NO: 6249396 - DNA, 15 bp, Homo sapiens
gagtgtgagcagggc

SEQ ID NO: 6249397 - DNA, 15 bp, Homo sapiens
gccctccgcctggga

SEQ ID NO: 6249398 - DNA, 16 bp, Homo sapiens
gccctccgcctgggat

SEQ ID NO: 6249399 - DNA, 15 bp, Homo sapiens
gccctccgccttcac

SEQ ID NO: 6249400 - DNA, 16 bp, Homo sapiens
gccctccgccttcaca

SEQ ID NO: 6249401 - DNA, 12 bp, Homo sapiens
gccctccggagg

SEQ ID NO: 6249402 - DNA, 15 bp, Homo sapiens
gccctccggaggagc

SEQ ID NO: 6249403 - DNA, 20 bp, Homo sapiens
gccctccggaggagcagcct

SEQ ID NO: 6249404 - DNA, 18 bp, Homo sapiens
gccctccgtcctggcagg

SEQ ID NO: 6249405 - DNA, 23 bp, Homo sapiens
gccctccgtcgggcccctgcctg

SEQ ID NO: 6249406 - DNA, 21 bp, Homo sapiens
gccctcctcaccccgtctggg

SEQ ID NO: 6249407 - DNA, 12 bp, Homo sapiens
gccctcctcagc

SEQ ID NO: 6249408 - DNA, 16 bp, Homo sapiens
gccctcctcagctccc

SEQ ID NO: 6249409 - DNA, 20 bp, Homo sapiens
gccctcctcagctccctgcc

SEQ ID NO: 6249410 - DNA, 19 bp, Homo sapiens
gccctcctccccagagctg

SEQ ID NO: 6249411 - DNA, 13 bp, Homo sapiens
gccctcctccctc

SEQ ID NO: 6249412 - DNA, 21 bp, Homo sapiens
gccctcctcgctgtgccacca

SEQ ID NO: 6249413 - DNA, 11 bp, Homo sapiens
gccctcctctg

SEQ ID NO: 6249414 - DNA, 12 bp, Homo sapiens
gccctcctctgc

SEQ ID NO: 6249415 - DNA, 16 bp, Homo sapiens
gccctcctctgccccc

SEQ ID NO: 6249416 - DNA, 21 bp, Homo sapiens
gccctcctctgccccctcccc

SEQ ID NO: 6249417 - DNA, 12 bp, Homo sapiens
gccctcctgagg

SEQ ID NO: 6249418 - DNA, 12 bp, Homo sapiens
gccctcctgatt

SEQ ID NO: 6249419 - DNA, 22 bp, Homo sapiens
gccctcctgccaaaagatctgg

SEQ ID NO: 6249420 - DNA, 16 bp, Homo sapiens
gccctcctgcccgccc

SEQ ID NO: 6249421 - DNA, 10 bp, Homo sapiens
gccctcctgg

SEQ ID NO: 6249422 - DNA, 13 bp, Homo sapiens
gccctcctggctg

SEQ ID NO: 6249423 - DNA, 12 bp, Homo sapiens
gccctcctggga

SEQ ID NO: 6249424 - DNA, 13 bp, Homo sapiens
gccctcctgggaa

SEQ ID NO: 6249425 - DNA, 13 bp, Homo sapiens
gccctcctgggca

SEQ ID NO: 6249426 - DNA, 14 bp, Homo sapiens
gccctcctgggcac

SEQ ID NO: 6249427 - DNA, 18 bp, Homo sapiens
gccctcctgggcacccca

SEQ ID NO: 6249428 - DNA, 20 bp, Homo sapiens
gccctcctgggccctgggct

SEQ ID NO: 6249429 - DNA, 20 bp, Homo sapiens
gccctcctgtgctcagccct

SEQ ID NO: 6249430 - DNA, 22 bp, Homo sapiens
gccctcctgtgctcagccctga

SEQ ID NO: 6249431 - DNA, 10 bp, Homo sapiens
gccctccttc

SEQ ID NO: 6249432 - DNA, 14 bp, Homo sapiens
gccctccttcccaa

SEQ ID NO: 6249433 - DNA, 17 bp, Homo sapiens
gccctccttccctcctg

SEQ ID NO: 6249434 - DNA, 21 bp, Homo sapiens
gccctccttccctcctgtgcc

SEQ ID NO: 6249435 - DNA, 17 bp, Homo sapiens
gccctccttcttgccct

SEQ ID NO: 6249436 - DNA, 18 bp, Homo sapiens
gccctccttcttgccctg

SEQ ID NO: 6249437 - DNA, 19 bp, Homo sapiens
gccctccttcttgccctga

SEQ ID NO: 6249438 - DNA, 21 bp, Homo sapiens
gccctccttcttgccctgagc

SEQ ID NO: 6249439 - DNA, 17 bp, Homo sapiens
gccctccttcttttcct

SEQ ID NO: 6249440 - DNA, 15 bp, Homo sapiens
gccctccttgccacc

SEQ ID NO: 6249441 - DNA, 19 bp, Homo sapiens
gccctccttgtccacccac

SEQ ID NO: 6249442 - DNA, 14 bp, Homo sapiens
gccctcctttccct

SEQ ID NO: 6249443 - DNA, 23 bp, Homo sapiens
gccctcgaaccaaggcagcctcc

SEQ ID NO: 6249444 - DNA, 17 bp, Homo sapiens
gccctcgctgccagctc

SEQ ID NO: 6249445 - DNA, 16 bp, Homo sapiens
gccctcggagctggct

SEQ ID NO: 6249446 - DNA, 17 bp, Homo sapiens
gccctcggagctggctg

SEQ ID NO: 6249447 - DNA, 13 bp, Homo sapiens
gccctcggcctcc

SEQ ID NO: 6249448 - DNA, 14 bp, Homo sapiens
gccctcggcctcca

SEQ ID NO: 6249449 - DNA, 18 bp, Homo sapiens
gccctcgggaccccactc

SEQ ID NO: 6249450 - DNA, 12 bp, Homo sapiens
gccctcgggccc

SEQ ID NO: 6249451 - DNA, 15 bp, Homo sapiens
gccctcgggcccagc

SEQ ID NO: 6249452 - DNA, 17 bp, Homo sapiens
gccctcgggcccagccc

SEQ ID NO: 6249453 - DNA, 23 bp, Homo sapiens
gccctcgggccgggcaccacccc

SEQ ID NO: 6249454 - DNA, 15 bp, Homo sapiens
gccctcgggtctccc

SEQ ID NO: 6249455 - DNA, 19 bp, Homo sapiens
gccctcgggtctccccacc

SEQ ID NO: 6249456 - DNA, 15 bp, Homo sapiens
gccctcgggtggggc

SEQ ID NO: 6249457 - DNA, 16 bp, Homo sapiens
gccctcgggtggggct

SEQ ID NO: 6249458 - DNA, 18 bp, Homo sapiens
gccctcgggtggggctgg

SEQ ID NO: 6249459 - DNA, 21 bp, Homo sapiens
gccctcgtgcctgggggagag

SEQ ID NO: 6249460 - DNA, 18 bp, Homo sapiens
gccctcgtggccagcccg

SEQ ID NO: 6249461 - DNA, 17 bp, Homo sapiens
gccctcgtggtggaaac

SEQ ID NO: 6249462 - DNA, 23 bp, Homo sapiens
gccctcgtggtggaaacttttct

SEQ ID NO: 6249463 - DNA, 14 bp, Homo sapiens
gccctctagggcag

SEQ ID NO: 6249464 - DNA, 15 bp, Homo sapiens
gccctctagggcagg

SEQ ID NO: 6249465 - DNA, 15 bp, Homo sapiens
gccctctatgctggc

SEQ ID NO: 6249466 - DNA, 23 bp, Homo sapiens
gccctctatttattagccaactg

SEQ ID NO: 6249467 - DNA, 15 bp, Homo sapiens
gccctctcactccag

SEQ ID NO: 6249468 - DNA, 17 bp, Homo sapiens
gccctctcactccagcc

SEQ ID NO: 6249469 - DNA, 22 bp, Homo sapiens
gccctctcagatcaccccagcc

SEQ ID NO: 6249470 - DNA, 14 bp, Homo sapiens
gccctctccacacc

SEQ ID NO: 6249471 - DNA, 16 bp, Homo sapiens
gccctctccacccaga

SEQ ID NO: 6249472 - DNA, 17 bp, Homo sapiens
gccctctccacccagag

SEQ ID NO: 6249473 - DNA, 20 bp, Homo sapiens
gccctctcccaccctcttcc

SEQ ID NO: 6249474 - DNA, 19 bp, Homo sapiens
gccctctcccatgcacaca

SEQ ID NO: 6249475 - DNA, 20 bp, Homo sapiens
gccctctcccatgcacacaa

SEQ ID NO: 6249476 - DNA, 11 bp, Homo sapiens
gccctctcccc

SEQ ID NO: 6249477 - DNA, 20 bp, Homo sapiens
gccctctcccctcagcctct

SEQ ID NO: 6249478 - DNA, 14 bp, Homo sapiens
gccctctcccctgc

SEQ ID NO: 6249479 - DNA, 21 bp, Homo sapiens
gccctctccctctaggctctg

SEQ ID NO: 6249480 - DNA, 15 bp, Homo sapiens
gccctctccctgtgt

SEQ ID NO: 6249481 - DNA, 23 bp, Homo sapiens
gccctctccctgtgttctgggct

SEQ ID NO: 6249482 - DNA, 17 bp, Homo sapiens
gccctctcccttaccct

SEQ ID NO: 6249483 - DNA, 17 bp, Homo sapiens
gccctctcctccccctc

SEQ ID NO: 6249484 - DNA, 12 bp, Homo sapiens
gccctctcctgg

SEQ ID NO: 6249485 - DNA, 15 bp, Homo sapiens
gccctctcctgggca

SEQ ID NO: 6249486 - DNA, 16 bp, Homo sapiens
gccctctcctttgttc

SEQ ID NO: 6249487 - DNA, 16 bp, Homo sapiens
gccctctctcaccagc

SEQ ID NO: 6249488 - DNA, 18 bp, Homo sapiens
gccctctctcaccagcct

SEQ ID NO: 6249489 - DNA, 21 bp, Homo sapiens
gccctctctcaccagccttga

SEQ ID NO: 6249490 - DNA, 13 bp, Homo sapiens
gccctctctcagt

SEQ ID NO: 6249491 - DNA, 13 bp, Homo sapiens
gccctctctcata

SEQ ID NO: 6249492 - DNA, 15 bp, Homo sapiens
gccctctctccgccc

SEQ ID NO: 6249493 - DNA, 21 bp, Homo sapiens
gccctctctccgccccggaca

SEQ ID NO: 6249494 - DNA, 20 bp, Homo sapiens
gccctctctctcactcccct

SEQ ID NO: 6249495 - DNA, 14 bp, Homo sapiens
gccctctctctggg

SEQ ID NO: 6249496 - DNA, 15 bp, Homo sapiens
gccctctctctgggc

SEQ ID NO: 6249497 - DNA, 20 bp, Homo sapiens
gccctctctgaaggaggcca

SEQ ID NO: 6249498 - DNA, 17 bp, Homo sapiens
gccctctctgcaccgga

SEQ ID NO: 6249499 - DNA, 15 bp, Homo sapiens
gccctctctgctcct

SEQ ID NO: 6249500 - DNA, 21 bp, Homo sapiens
gccctctcttaatgccacggc

SEQ ID NO: 6249501 - DNA, 11 bp, Homo sapiens
gccctctcttc

SEQ ID NO: 6249502 - DNA, 14 bp, Homo sapiens
gccctctcttgcca

SEQ ID NO: 6249503 - DNA, 17 bp, Homo sapiens
gccctctgaacttgcct

SEQ ID NO: 6249504 - DNA, 20 bp, Homo sapiens
gccctctgaggctcagccct

SEQ ID NO: 6249505 - DNA, 13 bp, Homo sapiens
gccctctgccact

SEQ ID NO: 6249506 - DNA, 18 bp, Homo sapiens
gccctctgccactgacag

SEQ ID NO: 6249507 - DNA, 16 bp, Homo sapiens
gccctctgccccatca

SEQ ID NO: 6249508 - DNA, 22 bp, Homo sapiens
gccctctgcccccagctgctcc

SEQ ID NO: 6249509 - DNA, 23 bp, Homo sapiens
gccctctgcccccagctgctcct

SEQ ID NO: 6249510 - DNA, 21 bp, Homo sapiens
gccctctgccgaccgcctgct

SEQ ID NO: 6249511 - DNA, 12 bp, Homo sapiens
gccctctgcctg

SEQ ID NO: 6249512 - DNA, 13 bp, Homo sapiens
gccctctgcctgc

SEQ ID NO: 6249513 - DNA, 17 bp, Homo sapiens
gccctctgcctgcactc

SEQ ID NO: 6249514 - DNA, 18 bp, Homo sapiens
gccctctgcctgcactcc

SEQ ID NO: 6249515 - DNA, 22 bp, Homo sapiens
gccctctgcctgcactccctgg

SEQ ID NO: 6249516 - DNA, 20 bp, Homo sapiens
gccctctgcgtcccccagcc

SEQ ID NO: 6249517 - DNA, 21 bp, Homo sapiens
gccctctgcgtcccccagccc

SEQ ID NO: 6249518 - DNA, 22 bp, Homo sapiens
gccctctgcgtcccccagccct

SEQ ID NO: 6249519 - DNA, 12 bp, Homo sapiens
gccctctgctct

SEQ ID NO: 6249520 - DNA, 14 bp, Homo sapiens
gccctctgctctgc

SEQ ID NO: 6249521 - DNA, 16 bp, Homo sapiens
gccctctgctctgcct

SEQ ID NO: 6249522 - DNA, 18 bp, Homo sapiens
gccctctgctctgcctgg

SEQ ID NO: 6249523 - DNA, 19 bp, Homo sapiens
gccctctgctctgcctgga

SEQ ID NO: 6249524 - DNA, 22 bp, Homo sapiens
gccctctgctctgcctggagtg

SEQ ID NO: 6249525 - DNA, 13 bp, Homo sapiens
gccctctgctgct

SEQ ID NO: 6249526 - DNA, 14 bp, Homo sapiens
gccctctgctgctg

SEQ ID NO: 6249527 - DNA, 15 bp, Homo sapiens
gccctctgctgctgc

SEQ ID NO: 6249528 - DNA, 18 bp, Homo sapiens
gccctctggagtggccac

SEQ ID NO: 6249529 - DNA, 11 bp, Homo sapiens
gccctctgggc

SEQ ID NO: 6249530 - DNA, 14 bp, Homo sapiens
gccctctgggctct

SEQ ID NO: 6249531 - DNA, 20 bp, Homo sapiens
gccctctggggctcagccct

SEQ ID NO: 6249532 - DNA, 13 bp, Homo sapiens
gccctctgggtcc

SEQ ID NO: 6249533 - DNA, 20 bp, Homo sapiens
gccctctgggtccctcctct

SEQ ID NO: 6249534 - DNA, 23 bp, Homo sapiens
gccctctgtagctccctcctccc

SEQ ID NO: 6249535 - DNA, 14 bp, Homo sapiens
gccctctgtcctga

SEQ ID NO: 6249536 - DNA, 17 bp, Homo sapiens
gccctctgtggccagga

SEQ ID NO: 6249537 - DNA, 23 bp, Homo sapiens
gccctctgtggccaggagccctg

SEQ ID NO: 6249538 - DNA, 16 bp, Homo sapiens
gccctcttaagatctg

SEQ ID NO: 6249539 - DNA, 19 bp, Homo sapiens
gccctcttaagatctgact

SEQ ID NO: 6249540 - DNA, 19 bp, Homo sapiens
gccctcttatctcatcctt

SEQ ID NO: 6249541 - DNA, 14 bp, Homo sapiens
gccctcttccatca

SEQ ID NO: 6249542 - DNA, 16 bp, Homo sapiens
gccctcttctccttgc

SEQ ID NO: 6249543 - DNA, 12 bp, Homo sapiens
gccctcttctcg

SEQ ID NO: 6249544 - DNA, 13 bp, Homo sapiens
gccctcttcttac

SEQ ID NO: 6249545 - DNA, 14 bp, Homo sapiens
gccctcttcttact

SEQ ID NO: 6249546 - DNA, 11 bp, Homo sapiens
gccctcttgcc

SEQ ID NO: 6249547 - DNA, 18 bp, Homo sapiens
gccctcttgccagcctcc

SEQ ID NO: 6249548 - DNA, 20 bp, Homo sapiens
gccctcttgcgggcctggac

SEQ ID NO: 6249549 - DNA, 21 bp, Homo sapiens
gccctcttgggggcactgctc

SEQ ID NO: 6249550 - DNA, 20 bp, Homo sapiens
gccctctttaatgctgtctt

SEQ ID NO: 6249551 - DNA, 16 bp, Homo sapiens
gccctctttcatctgt

SEQ ID NO: 6249552 - DNA, 19 bp, Homo sapiens
gccctctttcatctgtaag

SEQ ID NO: 6249553 - DNA, 13 bp, Homo sapiens
gccctctttctct

SEQ ID NO: 6249554 - DNA, 18 bp, Homo sapiens
gccctctttctctctgtg

SEQ ID NO: 6249555 - DNA, 22 bp, Homo sapiens
gccctctttctctctgtgtggc

SEQ ID NO: 6249556 - DNA, 13 bp, Homo sapiens
gccctgaaaatgt

SEQ ID NO: 6249557 - DNA, 22 bp, Homo sapiens
gccctgaaacgagaagtgccct

SEQ ID NO: 6249558 - DNA, 15 bp, Homo sapiens
gccctgaaagggccc

SEQ ID NO: 6249559 - DNA, 14 bp, Homo sapiens
gccctgaaccacga

SEQ ID NO: 6249560 - DNA, 22 bp, Homo sapiens
gccctgaaccacgaggctgccc

SEQ ID NO: 6249561 - DNA, 23 bp, Homo sapiens
gccctgaaccacgaggctgcccc

SEQ ID NO: 6249562 - DNA, 19 bp, Homo sapiens
gccctgaagcctccgtgga

SEQ ID NO: 6249563 - DNA, 20 bp, Homo sapiens
gccctgaagcctccgtggaa

SEQ ID NO: 6249564 - DNA, 20 bp, Homo sapiens
gccctgaatttcttcttttc

SEQ ID NO: 6249565 - DNA, 23 bp, Homo sapiens
gccctgaatttcttcttttcctg

SEQ ID NO: 6249566 - DNA, 16 bp, Homo sapiens
gccctgacccaataaa

SEQ ID NO: 6249567 - DNA, 14 bp, Homo sapiens
gccctgaccctgtg

SEQ ID NO: 6249568 - DNA, 17 bp, Homo sapiens
gccctgaccctgtggaa

SEQ ID NO: 6249569 - DNA, 16 bp, Homo sapiens
gccctgacctcccagc

SEQ ID NO: 6249570 - DNA, 19 bp, Homo sapiens
gccctgacctcccagccct

SEQ ID NO: 6249571 - DNA, 15 bp, Homo sapiens
gccctgaccttggct

SEQ ID NO: 6249572 - DNA, 21 bp, Homo sapiens
gccctgactaaactaccacct

SEQ ID NO: 6249573 - DNA, 23 bp, Homo sapiens
gccctgactaaactaccacctca

SEQ ID NO: 6249574 - DNA, 16 bp, Homo sapiens
gccctgactcctctgg

SEQ ID NO: 6249575 - DNA, 19 bp, Homo sapiens
gccctgactcctctggctt

SEQ ID NO: 6249576 - DNA, 21 bp, Homo sapiens
gccctgactcctctggctttc

SEQ ID NO: 6249577 - DNA, 23 bp, Homo sapiens
gagtgtgagccacctaagatctc

SEQ ID NO: 6249578 - DNA, 21 bp, Homo sapiens
gagtgtgagtgtgagagatgg

SEQ ID NO: 6249579 - DNA, 14 bp, Homo sapiens
gagtgtgatgcagg

SEQ ID NO: 6249580 - DNA, 20 bp, Homo sapiens
gagtgtgcagacagccatgc

SEQ ID NO: 6249581 - DNA, 13 bp, Homo sapiens
gagtgtgcctctc

SEQ ID NO: 6249582 - DNA, 16 bp, Homo sapiens
gagtgtgcctctctct

SEQ ID NO: 6249583 - DNA, 23 bp, Homo sapiens
gagtgtgcgtggtggtccctggg

SEQ ID NO: 6249584 - DNA, 14 bp, Homo sapiens
gagtgtgctctccc

SEQ ID NO: 6249585 - DNA, 15 bp, Homo sapiens
gagtgtgctgacttt

SEQ ID NO: 6249586 - DNA, 16 bp, Homo sapiens
gagtgtgctgtatggc

SEQ ID NO: 6249587 - DNA, 23 bp, Homo sapiens
gagtgtgctgtatggcccaggca

SEQ ID NO: 6249588 - DNA, 20 bp, Homo sapiens
gagtgtggaaaaaaaaagaa

SEQ ID NO: 6249589 - DNA, 15 bp, Homo sapiens
gagtgtggactctgg

SEQ ID NO: 6249590 - DNA, 19 bp, Homo sapiens
gagtgtggagctgcttcca

SEQ ID NO: 6249591 - DNA, 22 bp, Homo sapiens
gagtgtggcgggaagggtgggc

SEQ ID NO: 6249592 - DNA, 16 bp, Homo sapiens
gagtgtggctcccctc

SEQ ID NO: 6249593 - DNA, 20 bp, Homo sapiens
gagtgtgggggtgccatggt

SEQ ID NO: 6249594 - DNA, 23 bp, Homo sapiens
gagtgtgggtgatcagaaggctg

SEQ ID NO: 6249595 - DNA, 18 bp, Homo sapiens
gagtgtgtattgttccca

SEQ ID NO: 6249596 - DNA, 21 bp, Homo sapiens
gagtgtgtccaagtgtgtgtg

SEQ ID NO: 6249597 - DNA, 15 bp, Homo sapiens
gagtgtgtctgctga

SEQ ID NO: 6249598 - DNA, 17 bp, Homo sapiens
gagtgtgtgataaatca

SEQ ID NO: 6249599 - DNA, 11 bp, Homo sapiens
gagtgtgtgca

SEQ ID NO: 6249600 - DNA, 15 bp, Homo sapiens
gagtgtgtgggcagg

SEQ ID NO: 6249601 - DNA, 16 bp, Homo sapiens
gagtgtgtgggcaggg

SEQ ID NO: 6249602 - DNA, 18 bp, Homo sapiens
gagtgtgtgggcagggtt

SEQ ID NO: 6249603 - DNA, 12 bp, Homo sapiens
gagtgtgtgggg

SEQ ID NO: 6249604 - DNA, 22 bp, Homo sapiens
gagtgtgtgggggtctgggagg

SEQ ID NO: 6249605 - DNA, 19 bp, Homo sapiens
gagtgtgtggtctctgccc

SEQ ID NO: 6249606 - DNA, 21 bp, Homo sapiens
gagtgtgtgtgtgtgtctgta

SEQ ID NO: 6249607 - DNA, 19 bp, Homo sapiens
gagtgtgtgtttgtgctga

SEQ ID NO: 6249608 - DNA, 16 bp, Homo sapiens
gagtgtgtgtttgtgt

SEQ ID NO: 6249609 - DNA, 14 bp, Homo sapiens
gagtgttatgtatt

SEQ ID NO: 6249610 - DNA, 14 bp, Homo sapiens
gagtgttcaaacta

SEQ ID NO: 6249611 - DNA, 22 bp, Homo sapiens
gagtgttcaaactactgtacat

SEQ ID NO: 6249612 - DNA, 19 bp, Homo sapiens
gagtgttcccaatgctttg

SEQ ID NO: 6249613 - DNA, 15 bp, Homo sapiens
gagtgttcccgtgcc

SEQ ID NO: 6249614 - DNA, 17 bp, Homo sapiens
gagtgttcccgtgcctg

SEQ ID NO: 6249615 - DNA, 13 bp, Homo sapiens
gagtgttccctat

SEQ ID NO: 6249616 - DNA, 18 bp, Homo sapiens
gagtgttctgtgggcttg

SEQ ID NO: 6249617 - DNA, 19 bp, Homo sapiens
gagtgttctgtgggcttgg

SEQ ID NO: 6249618 - DNA, 12 bp, Homo sapiens
gagtgttgaaac

SEQ ID NO: 6249619 - DNA, 18 bp, Homo sapiens
gagtgttggggctggggg

SEQ ID NO: 6249620 - DNA, 14 bp, Homo sapiens
gagtgtttaaatgc

SEQ ID NO: 6249621 - DNA, 22 bp, Homo sapiens
gagtgtttctaataaacttgga

SEQ ID NO: 6249622 - DNA, 14 bp, Homo sapiens
gagtgtttgaaaac

SEQ ID NO: 6249623 - DNA, 11 bp, Homo sapiens
gagttaaaagt

SEQ ID NO: 6249624 - DNA, 12 bp, Homo sapiens
gagttaaaagtt

SEQ ID NO: 6249625 - DNA, 23 bp, Homo sapiens
gagttaaaatgtttactgtaaat

SEQ ID NO: 6249626 - DNA, 21 bp, Homo sapiens
gagttaaacacgaattgattt

SEQ ID NO: 6249627 - DNA, 12 bp, Homo sapiens
gagttaaatggt

SEQ ID NO: 6249628 - DNA, 15 bp, Homo sapiens
gagttaacaggacag

SEQ ID NO: 6249629 - DNA, 12 bp, Homo sapiens
gagttaactttt

SEQ ID NO: 6249630 - DNA, 13 bp, Homo sapiens
gagttaagaagct

SEQ ID NO: 6249631 - DNA, 21 bp, Homo sapiens
gagttaagaagctgttgtaca

SEQ ID NO: 6249632 - DNA, 13 bp, Homo sapiens
gagttaagacctg

SEQ ID NO: 6249633 - DNA, 17 bp, Homo sapiens
gagttaagacctggcag

SEQ ID NO: 6249634 - DNA, 21 bp, Homo sapiens
gagttaagacctggcagctct

SEQ ID NO: 6249635 - DNA, 13 bp, Homo sapiens
gagttaaggtggg

SEQ ID NO: 6249636 - DNA, 19 bp, Homo sapiens
gagttaataggagtatttt

SEQ ID NO: 6249637 - DNA, 17 bp, Homo sapiens
gagttacaataaagttt

SEQ ID NO: 6249638 - DNA, 19 bp, Homo sapiens
gagttacaataaagtttac

SEQ ID NO: 6249639 - DNA, 12 bp, Homo sapiens
gagttacagaca

SEQ ID NO: 6249640 - DNA, 13 bp, Homo sapiens
gagttacagacaa

SEQ ID NO: 6249641 - DNA, 15 bp, Homo sapiens
gagttacagcctggg

SEQ ID NO: 6249642 - DNA, 18 bp, Homo sapiens
gagttacagcgagaggca

SEQ ID NO: 6249643 - DNA, 16 bp, Homo sapiens
gagttacagttctgtg

SEQ ID NO: 6249644 - DNA, 17 bp, Homo sapiens
gagttacagttctgtgg

SEQ ID NO: 6249645 - DNA, 23 bp, Homo sapiens
gagttaccattatttaatttgta

SEQ ID NO: 6249646 - DNA, 21 bp, Homo sapiens
gagttacttgtctgaggcctc

SEQ ID NO: 6249647 - DNA, 18 bp, Homo sapiens
gagttagaaccacagcag

SEQ ID NO: 6249648 - DNA, 20 bp, Homo sapiens
gagttagaaccacagcagac

SEQ ID NO: 6249649 - DNA, 14 bp, Homo sapiens
gagttagaggccag

SEQ ID NO: 6249650 - DNA, 16 bp, Homo sapiens
gagttagaggccagcc

SEQ ID NO: 6249651 - DNA, 11 bp, Homo sapiens
gagttaggaac

SEQ ID NO: 6249652 - DNA, 17 bp, Homo sapiens
gagttaggaatgagaag

SEQ ID NO: 6249653 - DNA, 17 bp, Homo sapiens
gagttaggctattcaca

SEQ ID NO: 6249654 - DNA, 14 bp, Homo sapiens
gagttagggagaga

SEQ ID NO: 6249655 - DNA, 19 bp, Homo sapiens
gagttaggtttaacataaa

SEQ ID NO: 6249656 - DNA, 18 bp, Homo sapiens
gagttagtttctttggga

SEQ ID NO: 6249657 - DNA, 17 bp, Homo sapiens
gagttatagtttgcttt

SEQ ID NO: 6249658 - DNA, 17 bp, Homo sapiens
gagttatcttctttatt

SEQ ID NO: 6249659 - DNA, 17 bp, Homo sapiens
gagttatgatgtaatct

SEQ ID NO: 6249660 - DNA, 20 bp, Homo sapiens
gagttattatagttattcaa

SEQ ID NO: 6249661 - DNA, 23 bp, Homo sapiens
gagttattttaattatcttttct

SEQ ID NO: 6249662 - DNA, 14 bp, Homo sapiens
gagttcaactacat

SEQ ID NO: 6249663 - DNA, 19 bp, Homo sapiens
gagttcaagaccagcctgg

SEQ ID NO: 6249664 - DNA, 22 bp, Homo sapiens
gagttcaagactagcctggcca

SEQ ID NO: 6249665 - DNA, 18 bp, Homo sapiens
gagttcaatgatctaggt

SEQ ID NO: 6249666 - DNA, 16 bp, Homo sapiens
gagttcaatggctgct

SEQ ID NO: 6249667 - DNA, 14 bp, Homo sapiens
gagttcacaggagg

SEQ ID NO: 6249668 - DNA, 19 bp, Homo sapiens
gagttcacaggaggccagt

SEQ ID NO: 6249669 - DNA, 17 bp, Homo sapiens
gagttcacatgtgccct

SEQ ID NO: 6249670 - DNA, 20 bp, Homo sapiens
gagttcacatgtgccctgcc

SEQ ID NO: 6249671 - DNA, 23 bp, Homo sapiens
gagttcacatgtgccctgccttg

SEQ ID NO: 6249672 - DNA, 12 bp, Homo sapiens
gagttcaccttg

SEQ ID NO: 6249673 - DNA, 19 bp, Homo sapiens
gagttcaccttggaagggc

SEQ ID NO: 6249674 - DNA, 21 bp, Homo sapiens
gagttcagagtccttaaaatg

SEQ ID NO: 6249675 - DNA, 15 bp, Homo sapiens
gagttcagctgcttc

SEQ ID NO: 6249676 - DNA, 20 bp, Homo sapiens
gagttcataccctgttacca

SEQ ID NO: 6249677 - DNA, 14 bp, Homo sapiens
gagttcatccaggc

SEQ ID NO: 6249678 - DNA, 13 bp, Homo sapiens
gagttcatcccag

SEQ ID NO: 6249679 - DNA, 19 bp, Homo sapiens
gagttcatcttgaattgta

SEQ ID NO: 6249680 - DNA, 15 bp, Homo sapiens
gagttcattcatatt

SEQ ID NO: 6249681 - DNA, 16 bp, Homo sapiens
gagttccagaaagtaa

SEQ ID NO: 6249682 - DNA, 19 bp, Homo sapiens
gagttccagaccccctgag

SEQ ID NO: 6249683 - DNA, 15 bp, Homo sapiens
gagttccagttgaag

SEQ ID NO: 6249684 - DNA, 14 bp, Homo sapiens
gagttcccacccaa

SEQ ID NO: 6249685 - DNA, 18 bp, Homo sapiens
gagttccccatgcagaca

SEQ ID NO: 6249686 - DNA, 23 bp, Homo sapiens
gagttcccccaaccatcttcact

SEQ ID NO: 6249687 - DNA, 14 bp, Homo sapiens
gagttccggcctgg

SEQ ID NO: 6249688 - DNA, 17 bp, Homo sapiens
gagttccggggagaaac

SEQ ID NO: 6249689 - DNA, 23 bp, Homo sapiens
gagttccggggagaaacccagag

SEQ ID NO: 6249690 - DNA, 17 bp, Homo sapiens
gagttcctaccatggag

SEQ ID NO: 6249691 - DNA, 17 bp, Homo sapiens
gagttcctagcaagttg

SEQ ID NO: 6249692 - DNA, 15 bp, Homo sapiens
gagttcctcgctctg

SEQ ID NO: 6249693 - DNA, 17 bp, Homo sapiens
gagttcctctgcagttt

SEQ ID NO: 6249694 - DNA, 12 bp, Homo sapiens
gagttcctgcat

SEQ ID NO: 6249695 - DNA, 16 bp, Homo sapiens
gagttcctgctccgtg

SEQ ID NO: 6249696 - DNA, 19 bp, Homo sapiens
gagttccttatccctctct

SEQ ID NO: 6249697 - DNA, 14 bp, Homo sapiens
gagttcctttccct

SEQ ID NO: 6249698 - DNA, 15 bp, Homo sapiens
gagttcctttccctc

SEQ ID NO: 6249699 - DNA, 16 bp, Homo sapiens
gagttcctttctggga

SEQ ID NO: 6249700 - DNA, 18 bp, Homo sapiens
gagttcgagaccagcctg

SEQ ID NO: 6249701 - DNA, 19 bp, Homo sapiens
gagttcgagaccagcctgg

SEQ ID NO: 6249702 - DNA, 20 bp, Homo sapiens
gagttcgagaccagcctggc

SEQ ID NO: 6249703 - DNA, 20 bp, Homo sapiens
gagttcgagagcagcctggc

SEQ ID NO: 6249704 - DNA, 16 bp, Homo sapiens
gagttctaacacattt

SEQ ID NO: 6249705 - DNA, 17 bp, Homo sapiens
gagttctaacacatttc

SEQ ID NO: 6249706 - DNA, 20 bp, Homo sapiens
gagttctatggagactttgc

SEQ ID NO: 6249707 - DNA, 13 bp, Homo sapiens
gagttctcagggc

SEQ ID NO: 6249708 - DNA, 14 bp, Homo sapiens
gagttctcagggct

SEQ ID NO: 6249709 - DNA, 19 bp, Homo sapiens
gagttctcagggctcctgc

SEQ ID NO: 6249710 - DNA, 20 bp, Homo sapiens
gagttctcagggctcctgcc

SEQ ID NO: 6249711 - DNA, 19 bp, Homo sapiens
gagttctcatccacagagg

SEQ ID NO: 6249712 - DNA, 19 bp, Homo sapiens
gagttctccttgtacttga

SEQ ID NO: 6249713 - DNA, 20 bp, Homo sapiens
gagttctgatgtcttagtga

SEQ ID NO: 6249714 - DNA, 22 bp, Homo sapiens
gagttctgatgtcttagtgact

SEQ ID NO: 6249715 - DNA, 20 bp, Homo sapiens
gagttctgcacatacagatg

SEQ ID NO: 6249716 - DNA, 20 bp, Homo sapiens
gagttctgctcattctaatg

SEQ ID NO: 6249717 - DNA, 17 bp, Homo sapiens
gagttctggatgtctgg

SEQ ID NO: 6249718 - DNA, 19 bp, Homo sapiens
gagttctggatgtctggct

SEQ ID NO: 6249719 - DNA, 14 bp, Homo sapiens
gagttctgtgaaga

SEQ ID NO: 6249720 - DNA, 22 bp, Homo sapiens
gagttcttagctatccttggct

SEQ ID NO: 6249721 - DNA, 17 bp, Homo sapiens
gagttcttgcaccctca

SEQ ID NO: 6249722 - DNA, 15 bp, Homo sapiens
gagttcttgtgccat

SEQ ID NO: 6249723 - DNA, 14 bp, Homo sapiens
gagttcttgttttt

SEQ ID NO: 6249724 - DNA, 22 bp, Homo sapiens
gagttctttaggtgcctcctgt

SEQ ID NO: 6249725 - DNA, 19 bp, Homo sapiens
gagttgaaatgttctgtca

SEQ ID NO: 6249726 - DNA, 21 bp, Homo sapiens
gagttgaagacagagctacac

SEQ ID NO: 6249727 - DNA, 15 bp, Homo sapiens
gagttgacagtgaaa

SEQ ID NO: 6249728 - DNA, 17 bp, Homo sapiens
gagttgaccttctgaac

SEQ ID NO: 6249729 - DNA, 15 bp, Homo sapiens
gagttgacgcatcct

SEQ ID NO: 6249730 - DNA, 19 bp, Homo sapiens
gagttgacgcatcctgcag

SEQ ID NO: 6249731 - DNA, 14 bp, Homo sapiens
gagttgagcacagg

SEQ ID NO: 6249732 - DNA, 22 bp, Homo sapiens
gagttgagcacaggcaacatta

SEQ ID NO: 6249733 - DNA, 19 bp, Homo sapiens
gagttgaggaactgtacag

SEQ ID NO: 6249734 - DNA, 16 bp, Homo sapiens
gagttgaggccactgt

SEQ ID NO: 6249735 - DNA, 22 bp, Homo sapiens
gagttgaggtctttctcctcag

SEQ ID NO: 6249736 - DNA, 19 bp, Homo sapiens
gagttgatactacagtttg

SEQ ID NO: 6249737 - DNA, 16 bp, Homo sapiens
gagttgcacccttccc

SEQ ID NO: 6249738 - DNA, 21 bp, Homo sapiens
gagttgccaactattctcagg

SEQ ID NO: 6249739 - DNA, 16 bp, Homo sapiens
gagttgccagggaaga

SEQ ID NO: 6249740 - DNA, 23 bp, Homo sapiens
gagttgcctgactcctgggtggg

SEQ ID NO: 6249741 - DNA, 21 bp, Homo sapiens
gagttgctgttaatctgatgt

SEQ ID NO: 6249742 - DNA, 17 bp, Homo sapiens
gagttgctttgccagag

SEQ ID NO: 6249743 - DNA, 22 bp, Homo sapiens
gagttgcttttcagctgaggtt

SEQ ID NO: 6249744 - DNA, 15 bp, Homo sapiens
gagttggaatcactg

SEQ ID NO: 6249745 - DNA, 11 bp, Homo sapiens
gagttggaatt

SEQ ID NO: 6249746 - DNA, 13 bp, Homo sapiens
gagttggagtgag

SEQ ID NO: 6249747 - DNA, 22 bp, Homo sapiens
gagttggattaaattctgggtg

SEQ ID NO: 6249748 - DNA, 20 bp, Homo sapiens
gagttggcaaaatggggttt

SEQ ID NO: 6249749 - DNA, 13 bp, Homo sapiens
gagttggccaaga

SEQ ID NO: 6249750 - DNA, 20 bp, Homo sapiens
gagttggcgttgtgggcagg

SEQ ID NO: 6249751 - DNA, 14 bp, Homo sapiens
gagttggctcaggc

SEQ ID NO: 6249752 - DNA, 16 bp, Homo sapiens
gagttggctgtgttcg

SEQ ID NO: 6249753 - DNA, 22 bp, Homo sapiens
gagttggctgtgttcgggggag

SEQ ID NO: 6249754 - DNA, 14 bp, Homo sapiens
gagttggggctgcc

SEQ ID NO: 6249755 - DNA, 15 bp, Homo sapiens
gagttgggggctagg

SEQ ID NO: 6249756 - DNA, 18 bp, Homo sapiens
gccctgactcctggactc

SEQ ID NO: 6249757 - DNA, 21 bp, Homo sapiens
gccctgactgtcagggagggc

SEQ ID NO: 6249758 - DNA, 14 bp, Homo sapiens
gccctgagacagac

SEQ ID NO: 6249759 - DNA, 13 bp, Homo sapiens
gccctgagactcc

SEQ ID NO: 6249760 - DNA, 17 bp, Homo sapiens
gccctgagcactcctgg

SEQ ID NO: 6249761 - DNA, 15 bp, Homo sapiens
gccctgagccatggc

SEQ ID NO: 6249762 - DNA, 20 bp, Homo sapiens
gccctgagccatggcggccc

SEQ ID NO: 6249763 - DNA, 13 bp, Homo sapiens
gccctgagcccgg

SEQ ID NO: 6249764 - DNA, 19 bp, Homo sapiens
gccctgagctactgcttct

SEQ ID NO: 6249765 - DNA, 16 bp, Homo sapiens
gccctgagctcaggct

SEQ ID NO: 6249766 - DNA, 19 bp, Homo sapiens
gccctgagctcaggctgag

SEQ ID NO: 6249767 - DNA, 22 bp, Homo sapiens
gccctgagctcaggctgagccc

SEQ ID NO: 6249768 - DNA, 22 bp, Homo sapiens
gccctgagctggcctcacctgg

SEQ ID NO: 6249769 - DNA, 21 bp, Homo sapiens
gccctgagctggcgtcacctg

SEQ ID NO: 6249770 - DNA, 21 bp, Homo sapiens
gccctgagctttccggggagg

SEQ ID NO: 6249771 - DNA, 22 bp, Homo sapiens
gccctgaggaaggaggggaagc

SEQ ID NO: 6249772 - DNA, 23 bp, Homo sapiens
gccctgaggaataaagcttctct

SEQ ID NO: 6249773 - DNA, 23 bp, Homo sapiens
gccctgaggacctctcagcatag

SEQ ID NO: 6249774 - DNA, 21 bp, Homo sapiens
gccctgaggcctgaggcctgt

SEQ ID NO: 6249775 - DNA, 22 bp, Homo sapiens
gccctgaggcggaggctgtgct

SEQ ID NO: 6249776 - DNA, 11 bp, Homo sapiens
gccctgagggg

SEQ ID NO: 6249777 - DNA, 12 bp, Homo sapiens
gccctgaggggc

SEQ ID NO: 6249778 - DNA, 14 bp, Homo sapiens
gccctgaggggcag

SEQ ID NO: 6249779 - DNA, 16 bp, Homo sapiens
gccctgaggggcctgc

SEQ ID NO: 6249780 - DNA, 18 bp, Homo sapiens
gccctgaggggcctgcca

SEQ ID NO: 6249781 - DNA, 19 bp, Homo sapiens
gccctgaggggcctgccac

SEQ ID NO: 6249782 - DNA, 14 bp, Homo sapiens
gccctgaggggctg

SEQ ID NO: 6249783 - DNA, 20 bp, Homo sapiens
gccctgaggggctggggagg

SEQ ID NO: 6249784 - DNA, 23 bp, Homo sapiens
gccctgaggggctggggaggggg

SEQ ID NO: 6249785 - DNA, 21 bp, Homo sapiens
gccctgaggggtggactaggc

SEQ ID NO: 6249786 - DNA, 21 bp, Homo sapiens
gccctgaggtgaaagggagct

SEQ ID NO: 6249787 - DNA, 22 bp, Homo sapiens
gccctgaggtgaaagggagcta

SEQ ID NO: 6249788 - DNA, 14 bp, Homo sapiens
gccctgaggtgtgg

SEQ ID NO: 6249789 - DNA, 24 bp, Homo sapiens
gccctgaggtgtgggggctgcagc

SEQ ID NO: 6249790 - DNA, 17 bp, Homo sapiens
gccctgagtctgggcag

SEQ ID NO: 6249791 - DNA, 21 bp, Homo sapiens
gccctgagtggatctccaagg

SEQ ID NO: 6249792 - DNA, 19 bp, Homo sapiens
gccctgagtgtcccaagcc

SEQ ID NO: 6249793 - DNA, 16 bp, Homo sapiens
gccctgagttcctagc

SEQ ID NO: 6249794 - DNA, 21 bp, Homo sapiens
gccctgagttggcatcacctg

SEQ ID NO: 6249795 - DNA, 16 bp, Homo sapiens
gccctgatccaggaaa

SEQ ID NO: 6249796 - DNA, 22 bp, Homo sapiens
gccctgatgcgtctacccagac

SEQ ID NO: 6249797 - DNA, 14 bp, Homo sapiens
gccctgcaaaagga

SEQ ID NO: 6249798 - DNA, 11 bp, Homo sapiens
gccctgcaaat

SEQ ID NO: 6249799 - DNA, 22 bp, Homo sapiens
gccctgcaagacacaggctcag

SEQ ID NO: 6249800 - DNA, 21 bp, Homo sapiens
gccctgcaccatgctgctggg

SEQ ID NO: 6249801 - DNA, 16 bp, Homo sapiens
gccctgcaccttgggc

SEQ ID NO: 6249802 - DNA, 22 bp, Homo sapiens
gccctgcacgtatacacccaga

SEQ ID NO: 6249803 - DNA, 21 bp, Homo sapiens
gccctgcactgtcctgctcca

SEQ ID NO: 6249804 - DNA, 19 bp, Homo sapiens
gccctgcagaccctgccct

SEQ ID NO: 6249805 - DNA, 20 bp, Homo sapiens
gccctgcagaccctgccctt

SEQ ID NO: 6249806 - DNA, 14 bp, Homo sapiens
gccctgcagagcaa

SEQ ID NO: 6249807 - DNA, 17 bp, Homo sapiens
gccctgcagagcaataa

SEQ ID NO: 6249808 - DNA, 13 bp, Homo sapiens
gccctgcagaggg

SEQ ID NO: 6249809 - DNA, 12 bp, Homo sapiens
gccctgcagcac

SEQ ID NO: 6249810 - DNA, 15 bp, Homo sapiens
gccctgcagcatccc

SEQ ID NO: 6249811 - DNA, 20 bp, Homo sapiens
gccctgcagccaaacagagc

SEQ ID NO: 6249812 - DNA, 13 bp, Homo sapiens
gccctgcaggagg

SEQ ID NO: 6249813 - DNA, 16 bp, Homo sapiens
gccctgcaggaggcct

SEQ ID NO: 6249814 - DNA, 17 bp, Homo sapiens
gccctgcaggaggcctg

SEQ ID NO: 6249815 - DNA, 22 bp, Homo sapiens
gccctgcaggaggcctgggagg

SEQ ID NO: 6249816 - DNA, 23 bp, Homo sapiens
gccctgcaggaggcctgggaggg

SEQ ID NO: 6249817 - DNA, 14 bp, Homo sapiens
gccctgcaggcaca

SEQ ID NO: 6249818 - DNA, 21 bp, Homo sapiens
gccctgcaggctgcaggaggg

SEQ ID NO: 6249819 - DNA, 22 bp, Homo sapiens
gccctgcaggctgcaggagggc

SEQ ID NO: 6249820 - DNA, 13 bp, Homo sapiens
gccctgcagtgtt

SEQ ID NO: 6249821 - DNA, 18 bp, Homo sapiens
gccctgcatctgtctgct

SEQ ID NO: 6249822 - DNA, 20 bp, Homo sapiens
gccctgcatctgtctgctct

SEQ ID NO: 6249823 - DNA, 15 bp, Homo sapiens
gccctgcatgggcca

SEQ ID NO: 6249824 - DNA, 11 bp, Homo sapiens
gccctgcatgt

SEQ ID NO: 6249825 - DNA, 17 bp, Homo sapiens
gccctgcattggcctgg

SEQ ID NO: 6249826 - DNA, 18 bp, Homo sapiens
gccctgcattggcctggc

SEQ ID NO: 6249827 - DNA, 20 bp, Homo sapiens
gccctgcattggcctggcct

SEQ ID NO: 6249828 - DNA, 22 bp, Homo sapiens
gccctgcattggcctggcctcc

SEQ ID NO: 6249829 - DNA, 15 bp, Homo sapiens
gccctgcattttcat

SEQ ID NO: 6249830 - DNA, 16 bp, Homo sapiens
gccctgccaagcctgg

SEQ ID NO: 6249831 - DNA, 16 bp, Homo sapiens
gccctgccacctgtct

SEQ ID NO: 6249832 - DNA, 24 bp, Homo sapiens
gccctgccacgtcccgctgcctcc

SEQ ID NO: 6249833 - DNA, 20 bp, Homo sapiens
gccctgccactcactaggcc

SEQ ID NO: 6249834 - DNA, 12 bp, Homo sapiens
gccctgccagga

SEQ ID NO: 6249835 - DNA, 13 bp, Homo sapiens
gccctgccaggag

SEQ ID NO: 6249836 - DNA, 15 bp, Homo sapiens
gccctgccaggaggc

SEQ ID NO: 6249837 - DNA, 19 bp, Homo sapiens
gccctgccattggcctctt

SEQ ID NO: 6249838 - DNA, 14 bp, Homo sapiens
gccctgcccaagtg

SEQ ID NO: 6249839 - DNA, 20 bp, Homo sapiens
gccctgcccacacctcctgg

SEQ ID NO: 6249840 - DNA, 20 bp, Homo sapiens
gccctgcccaccctccctcc

SEQ ID NO: 6249841 - DNA, 22 bp, Homo sapiens
gccctgcccacctggcctctgc

SEQ ID NO: 6249842 - DNA, 23 bp, Homo sapiens
gccctgcccagagtatgggcact

SEQ ID NO: 6249843 - DNA, 14 bp, Homo sapiens
gccctgcccagcca

SEQ ID NO: 6249844 - DNA, 12 bp, Homo sapiens
gccctgcccagg

SEQ ID NO: 6249845 - DNA, 21 bp, Homo sapiens
gccctgcccatactgagcctg

SEQ ID NO: 6249846 - DNA, 15 bp, Homo sapiens
gccctgccccacccc

SEQ ID NO: 6249847 - DNA, 23 bp, Homo sapiens
gccctgccccaccccacctcaca

SEQ ID NO: 6249848 - DNA, 17 bp, Homo sapiens
gccctgccccagcccct

SEQ ID NO: 6249849 - DNA, 20 bp, Homo sapiens
gccctgccccaggcctggac

SEQ ID NO: 6249850 - DNA, 19 bp, Homo sapiens
gccctgccccatcctgggc

SEQ ID NO: 6249851 - DNA, 21 bp, Homo sapiens
gccctgccccatcctgggcct

SEQ ID NO: 6249852 - DNA, 11 bp, Homo sapiens
gccctgccccc

SEQ ID NO: 6249853 - DNA, 14 bp, Homo sapiens
gccctgcccccacc

SEQ ID NO: 6249854 - DNA, 19 bp, Homo sapiens
gccctgcccccaccccttc

SEQ ID NO: 6249855 - DNA, 22 bp, Homo sapiens
gccctgccccctcccactcttg

SEQ ID NO: 6249856 - DNA, 15 bp, Homo sapiens
gccctgccccctggc

SEQ ID NO: 6249857 - DNA, 18 bp, Homo sapiens
gccctgccccctggctga

SEQ ID NO: 6249858 - DNA, 12 bp, Homo sapiens
gccctgccccta

SEQ ID NO: 6249859 - DNA, 13 bp, Homo sapiens
gccctgcccctag

SEQ ID NO: 6249860 - DNA, 15 bp, Homo sapiens
gccctgcccctagga

SEQ ID NO: 6249861 - DNA, 22 bp, Homo sapiens
gccctgcccctaggatgctgca

SEQ ID NO: 6249862 - DNA, 14 bp, Homo sapiens
gccctgcccctccc

SEQ ID NO: 6249863 - DNA, 17 bp, Homo sapiens
gccctgcccctccccct

SEQ ID NO: 6249864 - DNA, 22 bp, Homo sapiens
gccctgcccctccccctaccgc

SEQ ID NO: 6249865 - DNA, 19 bp, Homo sapiens
gccctgcccctgccccaac

SEQ ID NO: 6249866 - DNA, 20 bp, Homo sapiens
gccctgcccgggctcccaca

SEQ ID NO: 6249867 - DNA, 16 bp, Homo sapiens
gccctgcccggggagc

SEQ ID NO: 6249868 - DNA, 20 bp, Homo sapiens
gccctgcccggggagctgca

SEQ ID NO: 6249869 - DNA, 16 bp, Homo sapiens
gccctgccctagctcc

SEQ ID NO: 6249870 - DNA, 17 bp, Homo sapiens
gccctgccctagctcca

SEQ ID NO: 6249871 - DNA, 18 bp, Homo sapiens
gccctgccctagctccac

SEQ ID NO: 6249872 - DNA, 13 bp, Homo sapiens
gccctgccctcac

SEQ ID NO: 6249873 - DNA, 15 bp, Homo sapiens
gccctgccctcactc

SEQ ID NO: 6249874 - DNA, 18 bp, Homo sapiens
gccctgccctcactccac

SEQ ID NO: 6249875 - DNA, 12 bp, Homo sapiens
gccctgccctcc

SEQ ID NO: 6249876 - DNA, 14 bp, Homo sapiens
gccctgccctccca

SEQ ID NO: 6249877 - DNA, 16 bp, Homo sapiens
gccctgccctcccaag

SEQ ID NO: 6249878 - DNA, 16 bp, Homo sapiens
gccctgccctccccca

SEQ ID NO: 6249879 - DNA, 23 bp, Homo sapiens
gccctgccctcctgcccgccctc

SEQ ID NO: 6249880 - DNA, 11 bp, Homo sapiens
gccctgccctg

SEQ ID NO: 6249881 - DNA, 20 bp, Homo sapiens
gccctgccctgaggaaggag

SEQ ID NO: 6249882 - DNA, 17 bp, Homo sapiens
gccctgccctgccacct

SEQ ID NO: 6249883 - DNA, 18 bp, Homo sapiens
gccctgccctgccctcac

SEQ ID NO: 6249884 - DNA, 12 bp, Homo sapiens
gccctgccctgg

SEQ ID NO: 6249885 - DNA, 15 bp, Homo sapiens
gccctgccctggcag

SEQ ID NO: 6249886 - DNA, 17 bp, Homo sapiens
gccctgccctggccact

SEQ ID NO: 6249887 - DNA, 23 bp, Homo sapiens
gccctgccctggccactggccct

SEQ ID NO: 6249888 - DNA, 16 bp, Homo sapiens
gccctgccctggtttc

SEQ ID NO: 6249889 - DNA, 17 bp, Homo sapiens
gccctgcccttcctcag

SEQ ID NO: 6249890 - DNA, 17 bp, Homo sapiens
gccctgcccttggcacc

SEQ ID NO: 6249891 - DNA, 19 bp, Homo sapiens
gccctgcccttggcaccac

SEQ ID NO: 6249892 - DNA, 21 bp, Homo sapiens
gccctgccgtggtggcagctg

SEQ ID NO: 6249893 - DNA, 19 bp, Homo sapiens
gccctgcctatcctctgta

SEQ ID NO: 6249894 - DNA, 16 bp, Homo sapiens
gccctgcctcactgtg

SEQ ID NO: 6249895 - DNA, 18 bp, Homo sapiens
gccctgcctcagccaggc

SEQ ID NO: 6249896 - DNA, 12 bp, Homo sapiens
gccctgcctcct

SEQ ID NO: 6249897 - DNA, 18 bp, Homo sapiens
gccctgcctcctggagga

SEQ ID NO: 6249898 - DNA, 15 bp, Homo sapiens
gccctgcctcctggg

SEQ ID NO: 6249899 - DNA, 22 bp, Homo sapiens
gccctgcctcctttgtgaggaa

SEQ ID NO: 6249900 - DNA, 18 bp, Homo sapiens
gccctgcctctccgcccc

SEQ ID NO: 6249901 - DNA, 15 bp, Homo sapiens
gccctgcctctgttt

SEQ ID NO: 6249902 - DNA, 11 bp, Homo sapiens
gccctgcctga

SEQ ID NO: 6249903 - DNA, 14 bp, Homo sapiens
gccctgcctgaccc

SEQ ID NO: 6249904 - DNA, 21 bp, Homo sapiens
gccctgcctgacccatccctt

SEQ ID NO: 6249905 - DNA, 15 bp, Homo sapiens
gccctgcctgagggc

SEQ ID NO: 6249906 - DNA, 19 bp, Homo sapiens
gccctgcctgagggtgggc

SEQ ID NO: 6249907 - DNA, 13 bp, Homo sapiens
gccctgcctgcag

SEQ ID NO: 6249908 - DNA, 19 bp, Homo sapiens
gccctgcctgcagccaggg

SEQ ID NO: 6249909 - DNA, 20 bp, Homo sapiens
gccctgcctgcagccagggc

SEQ ID NO: 6249910 - DNA, 12 bp, Homo sapiens
gccctgcctgcc

SEQ ID NO: 6249911 - DNA, 13 bp, Homo sapiens
gccctgcctgccc

SEQ ID NO: 6249912 - DNA, 15 bp, Homo sapiens
gccctgcctgctgca

SEQ ID NO: 6249913 - DNA, 19 bp, Homo sapiens
gccctgcctggaggacctg

SEQ ID NO: 6249914 - DNA, 21 bp, Homo sapiens
gccctgcctggaggacctgag

SEQ ID NO: 6249915 - DNA, 22 bp, Homo sapiens
gccctgcctggaggacctgagc

SEQ ID NO: 6249916 - DNA, 15 bp, Homo sapiens
gccctgcctgggcct

SEQ ID NO: 6249917 - DNA, 19 bp, Homo sapiens
gccctgccttcagctttgg

SEQ ID NO: 6249918 - DNA, 22 bp, Homo sapiens
gccctgccttgccgctcccctt

SEQ ID NO: 6249919 - DNA, 13 bp, Homo sapiens
gccctgccttgct

SEQ ID NO: 6249920 - DNA, 18 bp, Homo sapiens
gccctgcgccctgtgcag

SEQ ID NO: 6249921 - DNA, 20 bp, Homo sapiens
gccctgcggagccggcacct

SEQ ID NO: 6249922 - DNA, 15 bp, Homo sapiens
gccctgcggccccgt

SEQ ID NO: 6249923 - DNA, 13 bp, Homo sapiens
gccctgcggctct

SEQ ID NO: 6249924 - DNA, 17 bp, Homo sapiens
gccctgcggctctggaa

SEQ ID NO: 6249925 - DNA, 18 bp, Homo sapiens
gccctgcgggccacaggg

SEQ ID NO: 6249926 - DNA, 18 bp, Homo sapiens
gccctgcggtagatggga

SEQ ID NO: 6249927 - DNA, 16 bp, Homo sapiens
gccctgcgttggagcc

SEQ ID NO: 6249928 - DNA, 19 bp, Homo sapiens
gccctgcgttggagccact

SEQ ID NO: 6249929 - DNA, 20 bp, Homo sapiens
gccctgcgttggagccactc

SEQ ID NO: 6249930 - DNA, 21 bp, Homo sapiens
gccctgcgttggagccactcc

SEQ ID NO: 6249931 - DNA, 22 bp, Homo sapiens
gccctgcgttggagccactcct

SEQ ID NO: 6249932 - DNA, 23 bp, Homo sapiens
gccctgcgttggagccactcctg

SEQ ID NO: 6249933 - DNA, 21 bp, Homo sapiens
gccctgctagacgcaccgcct

SEQ ID NO: 6249934 - DNA, 21 bp, Homo sapiens
gccctgctatttcaggccctc

SEQ ID NO: 6249935 - DNA, 13 bp, Homo sapiens
gccctgctcaggc

SEQ ID NO: 6249936 - DNA, 14 bp, Homo sapiens
gccctgctcaggcc

SEQ ID NO: 6249937 - DNA, 16 bp, Homo sapiens
gccctgctcaggcctc

SEQ ID NO: 6249938 - DNA, 19 bp, Homo sapiens
gccctgctcaggcctcacc

SEQ ID NO: 6249939 - DNA, 16 bp, Homo sapiens
gccctgctccctgcct

SEQ ID NO: 6249940 - DNA, 14 bp, Homo sapiens
gccctgctcctaag

SEQ ID NO: 6249941 - DNA, 15 bp, Homo sapiens
gccctgctcctccct

SEQ ID NO: 6249942 - DNA, 17 bp, Homo sapiens
gccctgctcctccctgg

SEQ ID NO: 6249943 - DNA, 17 bp, Homo sapiens
gccctgctcctgcagca

SEQ ID NO: 6249944 - DNA, 14 bp, Homo sapiens
gccctgctctgccc

SEQ ID NO: 6249945 - DNA, 18 bp, Homo sapiens
gccctgctctgcccaggc

SEQ ID NO: 6249946 - DNA, 14 bp, Homo sapiens
gccctgctctgggg

SEQ ID NO: 6249947 - DNA, 19 bp, Homo sapiens
gccctgctcttctctcccc

SEQ ID NO: 6249948 - DNA, 17 bp, Homo sapiens
gccctgctgaagctgct

SEQ ID NO: 6249949 - DNA, 21 bp, Homo sapiens
gccctgctgagtcccaggctg

SEQ ID NO: 6249950 - DNA, 23 bp, Homo sapiens
gccctgctgagtcccaggctgag

SEQ ID NO: 6249951 - DNA, 11 bp, Homo sapiens
gccctgctgcc

SEQ ID NO: 6249952 - DNA, 14 bp, Homo sapiens
gccctgctgccaca

SEQ ID NO: 6249953 - DNA, 15 bp, Homo sapiens
gccctgctgccccct

SEQ ID NO: 6249954 - DNA, 17 bp, Homo sapiens
gccctgctgcccctccc

SEQ ID NO: 6249955 - DNA, 20 bp, Homo sapiens
gccctgctgcccctccctgc

SEQ ID NO: 6249956 - DNA, 15 bp, Homo sapiens
gccctgctgccctcc

SEQ ID NO: 6249957 - DNA, 18 bp, Homo sapiens
gccctgctgctgcctgcc

SEQ ID NO: 6249958 - DNA, 11 bp, Homo sapiens
gccctgctggc

SEQ ID NO: 6249959 - DNA, 21 bp, Homo sapiens
gccctgctggccgcctcaccc

SEQ ID NO: 6249960 - DNA, 13 bp, Homo sapiens
gccctgctgggga

SEQ ID NO: 6249961 - DNA, 14 bp, Homo sapiens
gccctgctggggct

SEQ ID NO: 6249962 - DNA, 14 bp, Homo sapiens
gccctgctgtggga

SEQ ID NO: 6249963 - DNA, 12 bp, Homo sapiens
gccctgctgttt

SEQ ID NO: 6249964 - DNA, 19 bp, Homo sapiens
gccctgcttcctgcttgcc

SEQ ID NO: 6249965 - DNA, 22 bp, Homo sapiens
gccctgcttcctgcttgccaag

SEQ ID NO: 6249966 - DNA, 20 bp, Homo sapiens
gccctgctttatcaggggac

SEQ ID NO: 6249967 - DNA, 16 bp, Homo sapiens
gccctgctttcagata

SEQ ID NO: 6249968 - DNA, 21 bp, Homo sapiens
gccctgctttgggctgccctg

SEQ ID NO: 6249969 - DNA, 23 bp, Homo sapiens
gccctgctttgggctgccctggt

SEQ ID NO: 6249970 - DNA, 22 bp, Homo sapiens
gccctgcttttgcataatgcaa

SEQ ID NO: 6249971 - DNA, 18 bp, Homo sapiens
gccctgctttttttctta

SEQ ID NO: 6249972 - DNA, 20 bp, Homo sapiens
gccctgctttttttcttaaa

SEQ ID NO: 6249973 - DNA, 14 bp, Homo sapiens
gccctggacacagc

SEQ ID NO: 6249974 - DNA, 13 bp, Homo sapiens
gccctggacagat

SEQ ID NO: 6249975 - DNA, 16 bp, Homo sapiens
gccctggacagatggc

SEQ ID NO: 6249976 - DNA, 21 bp, Homo sapiens
gccctggacagatggcccaag

SEQ ID NO: 6249977 - DNA, 15 bp, Homo sapiens
gccctggaccagccg

SEQ ID NO: 6249978 - DNA, 16 bp, Homo sapiens
gccctggaccccaggc

SEQ ID NO: 6249979 - DNA, 12 bp, Homo sapiens
gccctggactgt

SEQ ID NO: 6249980 - DNA, 22 bp, Homo sapiens
gccctggactgtgtgctcagga

SEQ ID NO: 6249981 - DNA, 15 bp, Homo sapiens
gccctggagagcccc

SEQ ID NO: 6249982 - DNA, 14 bp, Homo sapiens
gccctggagcagct

SEQ ID NO: 6249983 - DNA, 11 bp, Homo sapiens
gccctggagcc

SEQ ID NO: 6249984 - DNA, 21 bp, Homo sapiens
gccctggagccaactgctgct

SEQ ID NO: 6249985 - DNA, 23 bp, Homo sapiens
gccctggagccaactgctgcttt

SEQ ID NO: 6249986 - DNA, 14 bp, Homo sapiens
gccctggagctcag

SEQ ID NO: 6249987 - DNA, 10 bp, Homo sapiens
gccctggagg

SEQ ID NO: 6249988 - DNA, 13 bp, Homo sapiens
gccctggaggatg

SEQ ID NO: 6249989 - DNA, 22 bp, Homo sapiens
gccctggaggcggtgcggcagg

SEQ ID NO: 6249990 - DNA, 14 bp, Homo sapiens
gccctggaggctgg

SEQ ID NO: 6249991 - DNA, 11 bp, Homo sapiens
gccctggaggg

SEQ ID NO: 6249992 - DNA, 23 bp, Homo sapiens
gccctggagggaaggacagtccc

SEQ ID NO: 6249993 - DNA, 17 bp, Homo sapiens
gccctggaggtgccagc

SEQ ID NO: 6249994 - DNA, 22 bp, Homo sapiens
gccctggaggtgccagcaaagc

SEQ ID NO: 6249995 - DNA, 23 bp, Homo sapiens
gccctggaggtgccagcaaagcc

SEQ ID NO: 6249996 - DNA, 24 bp, Homo sapiens
gccctggaggtgccagcaaagccc

SEQ ID NO: 6249997 - DNA, 18 bp, Homo sapiens
gccctggatcagcgtggc

SEQ ID NO: 6249998 - DNA, 21 bp, Homo sapiens
gccctggatcagcgtggcctt

SEQ ID NO: 6249999 - DNA, 22 bp, Homo sapiens
gccctggatcagcgtggccttg

SEQ ID NO: 6250000 - DNA, 23 bp, Homo sapiens
gccctggatcagcgtggccttgt

SEQ ID NO: 6250001 - DNA, 20 bp, Homo sapiens
gccctggatgcccaggaatc

SEQ ID NO: 6250002 - DNA, 16 bp, Homo sapiens
gccctggatggcctct

SEQ ID NO: 6250003 - DNA, 18 bp, Homo sapiens
gccctggatggcctctgg

SEQ ID NO: 6250004 - DNA, 21 bp, Homo sapiens
gccctggatgtgcccacaggg

SEQ ID NO: 6250005 - DNA, 10 bp, Homo sapiens
gccctggcaa

SEQ ID NO: 6250006 - DNA, 19 bp, Homo sapiens
gccctggcagcagcaggtg

SEQ ID NO: 6250007 - DNA, 14 bp, Homo sapiens
gccctggcaggcag

SEQ ID NO: 6250008 - DNA, 16 bp, Homo sapiens
gccctggcagggggca

SEQ ID NO: 6250009 - DNA, 14 bp, Homo sapiens
gccctggccactgg

SEQ ID NO: 6250010 - DNA, 13 bp, Homo sapiens
gccctggccagag

SEQ ID NO: 6250011 - DNA, 13 bp, Homo sapiens
gccctggccagcc

SEQ ID NO: 6250012 - DNA, 15 bp, Homo sapiens
gccctggccagccct

SEQ ID NO: 6250013 - DNA, 17 bp, Homo sapiens
gccctggccagcccttc

SEQ ID NO: 6250014 - DNA, 19 bp, Homo sapiens
gccctggccagcccttcct

SEQ ID NO: 6250015 - DNA, 13 bp, Homo sapiens
gccctggccaggg

SEQ ID NO: 6250016 - DNA, 14 bp, Homo sapiens
gccctggccagggc

SEQ ID NO: 6250017 - DNA, 12 bp, Homo sapiens
gccctggcccag

SEQ ID NO: 6250018 - DNA, 20 bp, Homo sapiens
gccctggcccagagctggaa

SEQ ID NO: 6250019 - DNA, 15 bp, Homo sapiens
gccctggcccagcct

SEQ ID NO: 6250020 - DNA, 14 bp, Homo sapiens
gccctggcccaggt

SEQ ID NO: 6250021 - DNA, 15 bp, Homo sapiens
gccctggcccaggtg

SEQ ID NO: 6250022 - DNA, 16 bp, Homo sapiens
gccctggcccatcatg

SEQ ID NO: 6250023 - DNA, 13 bp, Homo sapiens
gccctggccccca

SEQ ID NO: 6250024 - DNA, 21 bp, Homo sapiens
gccctggcccccacagcgctc

SEQ ID NO: 6250025 - DNA, 16 bp, Homo sapiens
gccctggcccccacat

SEQ ID NO: 6250026 - DNA, 15 bp, Homo sapiens
gccctggcccggtcc

SEQ ID NO: 6250027 - DNA, 19 bp, Homo sapiens
gccctggcccggtcccagt

SEQ ID NO: 6250028 - DNA, 21 bp, Homo sapiens
gccctggcccggtcccagtcc

SEQ ID NO: 6250029 - DNA, 12 bp, Homo sapiens
gccctggccctg

SEQ ID NO: 6250030 - DNA, 18 bp, Homo sapiens
gccctggccctgaggtgt

SEQ ID NO: 6250031 - DNA, 15 bp, Homo sapiens
gccctggccctgccc

SEQ ID NO: 6250032 - DNA, 20 bp, Homo sapiens
gccctggccctttccccttc

SEQ ID NO: 6250033 - DNA, 14 bp, Homo sapiens
gccctggcctacca

SEQ ID NO: 6250034 - DNA, 18 bp, Homo sapiens
gccctggcctaccacagc

SEQ ID NO: 6250035 - DNA, 20 bp, Homo sapiens
gccctggcctaccacagctg

SEQ ID NO: 6250036 - DNA, 17 bp, Homo sapiens
gccctggcctcccctgc

SEQ ID NO: 6250037 - DNA, 20 bp, Homo sapiens
gccctggcctcccctgccac

SEQ ID NO: 6250038 - DNA, 24 bp, Homo sapiens
gccctggcctcccctgccaccagg

SEQ ID NO: 6250039 - DNA, 14 bp, Homo sapiens
gccctggcctgctg

SEQ ID NO: 6250040 - DNA, 20 bp, Homo sapiens
gccctggccttgggccctct

SEQ ID NO: 6250041 - DNA, 19 bp, Homo sapiens
gccctggcgggtggctgca

SEQ ID NO: 6250042 - DNA, 11 bp, Homo sapiens
gccctggctcc

SEQ ID NO: 6250043 - DNA, 19 bp, Homo sapiens
gccctggctcccaagggag

SEQ ID NO: 6250044 - DNA, 23 bp, Homo sapiens
gccctggctcccaagggaggccc

SEQ ID NO: 6250045 - DNA, 19 bp, Homo sapiens
gccctggctcccacaggcc

SEQ ID NO: 6250046 - DNA, 14 bp, Homo sapiens
gccctggctctgca

SEQ ID NO: 6250047 - DNA, 20 bp, Homo sapiens
gccctggctctgcccctcag

SEQ ID NO: 6250048 - DNA, 22 bp, Homo sapiens
gccctggctctgcccctcaggg

SEQ ID NO: 6250049 - DNA, 17 bp, Homo sapiens
gccctggctctgctgtc

SEQ ID NO: 6250050 - DNA, 13 bp, Homo sapiens
gccctggctctgt

SEQ ID NO: 6250051 - DNA, 14 bp, Homo sapiens
gccctggctgaagg

SEQ ID NO: 6250052 - DNA, 19 bp, Homo sapiens
gccctggctgaaggactgt

SEQ ID NO: 6250053 - DNA, 12 bp, Homo sapiens
gccctggctgct

SEQ ID NO: 6250054 - DNA, 22 bp, Homo sapiens
gccctggctgctgcccccaccc

SEQ ID NO: 6250055 - DNA, 13 bp, Homo sapiens
gccctggctgggt

SEQ ID NO: 6250056 - DNA, 15 bp, Homo sapiens
gccctggctgtgggt

SEQ ID NO: 6250057 - DNA, 17 bp, Homo sapiens
gccctggcttggaggct

SEQ ID NO: 6250058 - DNA, 18 bp, Homo sapiens
gccctgggaaaccccttc

SEQ ID NO: 6250059 - DNA, 22 bp, Homo sapiens
gccctgggaaaccccttctctg

SEQ ID NO: 6250060 - DNA, 17 bp, Homo sapiens
gccctgggaaccactcc

SEQ ID NO: 6250061 - DNA, 21 bp, Homo sapiens
gccctgggaaccactcccacc

SEQ ID NO: 6250062 - DNA, 22 bp, Homo sapiens
gccctgggaaccactcccacca

SEQ ID NO: 6250063 - DNA, 14 bp, Homo sapiens
gccctgggaccgct

SEQ ID NO: 6250064 - DNA, 23 bp, Homo sapiens
gccctgggagaatcgctcctgca

SEQ ID NO: 6250065 - DNA, 14 bp, Homo sapiens
gccctgggaggcag

SEQ ID NO: 6250066 - DNA, 16 bp, Homo sapiens
gccctgggaggcagtg

SEQ ID NO: 6250067 - DNA, 17 bp, Homo sapiens
gccctgggaggctctgg

SEQ ID NO: 6250068 - DNA, 18 bp, Homo sapiens
gccctgggaggctctgga

SEQ ID NO: 6250069 - DNA, 23 bp, Homo sapiens
gccctgggaggctctggagccca

SEQ ID NO: 6250070 - DNA, 20 bp, Homo sapiens
gccctgggcaaggaagcttt

SEQ ID NO: 6250071 - DNA, 21 bp, Homo sapiens
gccctgggcaaggaagctttg

SEQ ID NO: 6250072 - DNA, 20 bp, Homo sapiens
gccctgggcacccacctcca

SEQ ID NO: 6250073 - DNA, 22 bp, Homo sapiens
gccctgggcacccacctccacc

SEQ ID NO: 6250074 - DNA, 14 bp, Homo sapiens
gccctgggccaggc

SEQ ID NO: 6250075 - DNA, 17 bp, Homo sapiens
gccctgggccaggcagg

SEQ ID NO: 6250076 - DNA, 21 bp, Homo sapiens
gccctgggccaggcaggcgat

SEQ ID NO: 6250077 - DNA, 18 bp, Homo sapiens
gccctgggccccaccacc

SEQ ID NO: 6250078 - DNA, 19 bp, Homo sapiens
gccctgggccccaccacct

SEQ ID NO: 6250079 - DNA, 11 bp, Homo sapiens
gccctgggcct

SEQ ID NO: 6250080 - DNA, 13 bp, Homo sapiens
gccctgggcctca

SEQ ID NO: 6250081 - DNA, 14 bp, Homo sapiens
gccctgggcctcca

SEQ ID NO: 6250082 - DNA, 19 bp, Homo sapiens
gccctgggcctccacctct

SEQ ID NO: 6250083 - DNA, 23 bp, Homo sapiens
gccctgggcctccacctctgtgc

SEQ ID NO: 6250084 - DNA, 13 bp, Homo sapiens
gccctgggcctgc

SEQ ID NO: 6250085 - DNA, 18 bp, Homo sapiens
gccctgggcgagcccctc

SEQ ID NO: 6250086 - DNA, 23 bp, Homo sapiens
gccctgggcgcagctgaagcctg

SEQ ID NO: 6250087 - DNA, 12 bp, Homo sapiens
gccctgggctcc

SEQ ID NO: 6250088 - DNA, 14 bp, Homo sapiens
gccctgggctcctc

SEQ ID NO: 6250089 - DNA, 16 bp, Homo sapiens
gccctgggctcggagg

SEQ ID NO: 6250090 - DNA, 13 bp, Homo sapiens
gccctgggctctg

SEQ ID NO: 6250091 - DNA, 11 bp, Homo sapiens
gccctgggctg

SEQ ID NO: 6250092 - DNA, 13 bp, Homo sapiens
gccctgggctgcc

SEQ ID NO: 6250093 - DNA, 16 bp, Homo sapiens
gccctgggctggactg

SEQ ID NO: 6250094 - DNA, 17 bp, Homo sapiens
gccctgggctggactgg

SEQ ID NO: 6250095 - DNA, 18 bp, Homo sapiens
gccctgggctggactgga

SEQ ID NO: 6250096 - DNA, 14 bp, Homo sapiens
gccctgggctggca

SEQ ID NO: 6250097 - DNA, 20 bp, Homo sapiens
gccctgggctgggtgctggg

SEQ ID NO: 6250098 - DNA, 22 bp, Homo sapiens
gccctgggctgtctgtcaccag

SEQ ID NO: 6250099 - DNA, 23 bp, Homo sapiens
gccctgggctgtctgtcaccagc

SEQ ID NO: 6250100 - DNA, 16 bp, Homo sapiens
gccctggggaagaggc

SEQ ID NO: 6250101 - DNA, 19 bp, Homo sapiens
gccctggggaagaggcctt

SEQ ID NO: 6250102 - DNA, 21 bp, Homo sapiens
gccctggggaagaggccttgg

SEQ ID NO: 6250103 - DNA, 22 bp, Homo sapiens
gccctggggactgttccaaagc

SEQ ID NO: 6250104 - DNA, 18 bp, Homo sapiens
gccctggggagtgagctt

SEQ ID NO: 6250105 - DNA, 19 bp, Homo sapiens
gccctggggagtgagcttg

SEQ ID NO: 6250106 - DNA, 22 bp, Homo sapiens
gccctggggatcttcccacagg

SEQ ID NO: 6250107 - DNA, 23 bp, Homo sapiens
gccctggggatcttcccacagga

SEQ ID NO: 6250108 - DNA, 14 bp, Homo sapiens
gccctggggcaggg

SEQ ID NO: 6250109 - DNA, 21 bp, Homo sapiens
gccctggggcctgtactgcct

SEQ ID NO: 6250110 - DNA, 22 bp, Homo sapiens
gccctggggcctgtactgcctg

SEQ ID NO: 6250111 - DNA, 20 bp, Homo sapiens
gccctggggctgatctcagg

SEQ ID NO: 6250112 - DNA, 21 bp, Homo sapiens
gccctggggctgatctcaggg

SEQ ID NO: 6250113 - DNA, 21 bp, Homo sapiens
gagttgggggtgtggctctgc

SEQ ID NO: 6250114 - DNA, 21 bp, Homo sapiens
gagttggtgtgctatttttga

SEQ ID NO: 6250115 - DNA, 16 bp, Homo sapiens
gagttgtctgtcctgg

SEQ ID NO: 6250116 - DNA, 17 bp, Homo sapiens
gagttgtctgtcctggt

SEQ ID NO: 6250117 - DNA, 21 bp, Homo sapiens
gagttgtgagccctctagggc

SEQ ID NO: 6250118 - DNA, 17 bp, Homo sapiens
gagttgtgatggagggg

SEQ ID NO: 6250119 - DNA, 16 bp, Homo sapiens
gagttgtggaaagcct

SEQ ID NO: 6250120 - DNA, 15 bp, Homo sapiens
gagttgtgggtagtg

SEQ ID NO: 6250121 - DNA, 18 bp, Homo sapiens
gagttgtgttgttctttt

SEQ ID NO: 6250122 - DNA, 20 bp, Homo sapiens
gagttgttacatttttaagt

SEQ ID NO: 6250123 - DNA, 19 bp, Homo sapiens
gagttgttctcaggggtgc

SEQ ID NO: 6250124 - DNA, 16 bp, Homo sapiens
gagttgttgtgtacag

SEQ ID NO: 6250125 - DNA, 16 bp, Homo sapiens
gagttgttttaacaga

SEQ ID NO: 6250126 - DNA, 16 bp, Homo sapiens
gagttgttttcagact

SEQ ID NO: 6250127 - DNA, 16 bp, Homo sapiens
gagttgtttttgtata

SEQ ID NO: 6250128 - DNA, 23 bp, Homo sapiens
gagtttaaaaaaataacatctga

SEQ ID NO: 6250129 - DNA, 13 bp, Homo sapiens
gagtttaaaaatc

SEQ ID NO: 6250130 - DNA, 18 bp, Homo sapiens
gagtttaaaaattgtctc

SEQ ID NO: 6250131 - DNA, 13 bp, Homo sapiens
gagtttaaagcaa

SEQ ID NO: 6250132 - DNA, 16 bp, Homo sapiens
gagtttaacagatatt

SEQ ID NO: 6250133 - DNA, 19 bp, Homo sapiens
gagtttaagaccagcctgg

SEQ ID NO: 6250134 - DNA, 16 bp, Homo sapiens
gagtttaagtctctga

SEQ ID NO: 6250135 - DNA, 17 bp, Homo sapiens
gagtttaatcttttcag

SEQ ID NO: 6250136 - DNA, 22 bp, Homo sapiens
gagtttaccatttgtaataaag

SEQ ID NO: 6250137 - DNA, 17 bp, Homo sapiens
gagtttacgtggagggg

SEQ ID NO: 6250138 - DNA, 16 bp, Homo sapiens
gagtttagctggaaaa

SEQ ID NO: 6250139 - DNA, 22 bp, Homo sapiens
gagtttagggaacaatttggca

SEQ ID NO: 6250140 - DNA, 20 bp, Homo sapiens
gagtttatacagtgtacatg

SEQ ID NO: 6250141 - DNA, 22 bp, Homo sapiens
gagtttatacagtgtacatgta

SEQ ID NO: 6250142 - DNA, 21 bp, Homo sapiens
gagtttatattctgaaaggaa

SEQ ID NO: 6250143 - DNA, 21 bp, Homo sapiens
gagtttatctatcggaagaac

SEQ ID NO: 6250144 - DNA, 22 bp, Homo sapiens
gagtttatgttccattaaacga

SEQ ID NO: 6250145 - DNA, 17 bp, Homo sapiens
gagtttattacaatgta

SEQ ID NO: 6250146 - DNA, 20 bp, Homo sapiens
gagtttattacaatgtatct

SEQ ID NO: 6250147 - DNA, 13 bp, Homo sapiens
gagtttcagctgg

SEQ ID NO: 6250148 - DNA, 19 bp, Homo sapiens
gagtttcattctcctgcct

SEQ ID NO: 6250149 - DNA, 20 bp, Homo sapiens
gagtttcattctcctgcctg

SEQ ID NO: 6250150 - DNA, 16 bp, Homo sapiens
gagtttccaaaaccag

SEQ ID NO: 6250151 - DNA, 16 bp, Homo sapiens
gagtttcctcaggctg

SEQ ID NO: 6250152 - DNA, 15 bp, Homo sapiens
gagtttcgaggtaga

SEQ ID NO: 6250153 - DNA, 12 bp, Homo sapiens
gagtttctctaa

SEQ ID NO: 6250154 - DNA, 12 bp, Homo sapiens
gagtttctctgt

SEQ ID NO: 6250155 - DNA, 12 bp, Homo sapiens
gagtttctttca

SEQ ID NO: 6250156 - DNA, 13 bp, Homo sapiens
gagtttgaagagg

SEQ ID NO: 6250157 - DNA, 14 bp, Homo sapiens
gagtttgaagaggt

SEQ ID NO: 6250158 - DNA, 17 bp, Homo sapiens
gagtttgagacaagccc

SEQ ID NO: 6250159 - DNA, 20 bp, Homo sapiens
gagtttgagacaagccctgg

SEQ ID NO: 6250160 - DNA, 20 bp, Homo sapiens
gagtttgagaccagcctggc

SEQ ID NO: 6250161 - DNA, 17 bp, Homo sapiens
gagtttgagaccaggct

SEQ ID NO: 6250162 - DNA, 20 bp, Homo sapiens
gagtttgagactagcctggc

SEQ ID NO: 6250163 - DNA, 17 bp, Homo sapiens
gagtttgagctgccttc

SEQ ID NO: 6250164 - DNA, 13 bp, Homo sapiens
gagtttgccctgg

SEQ ID NO: 6250165 - DNA, 12 bp, Homo sapiens
gagtttgctaaa

SEQ ID NO: 6250166 - DNA, 19 bp, Homo sapiens
gagtttgctgttttaaatt

SEQ ID NO: 6250167 - DNA, 13 bp, Homo sapiens
gagtttggccaga

SEQ ID NO: 6250168 - DNA, 14 bp, Homo sapiens
gagtttggccagaa

SEQ ID NO: 6250169 - DNA, 22 bp, Homo sapiens
gagtttgggctggagctcctcc

SEQ ID NO: 6250170 - DNA, 12 bp, Homo sapiens
gagtttggtccc

SEQ ID NO: 6250171 - DNA, 15 bp, Homo sapiens
gagtttggtccctgg

SEQ ID NO: 6250172 - DNA, 13 bp, Homo sapiens
gagtttgtaaata

SEQ ID NO: 6250173 - DNA, 12 bp, Homo sapiens
gagtttgtaagg

SEQ ID NO: 6250174 - DNA, 23 bp, Homo sapiens
gagtttgtaggtaaaatgtattt

SEQ ID NO: 6250175 - DNA, 18 bp, Homo sapiens
gagtttgtataggtaact

SEQ ID NO: 6250176 - DNA, 19 bp, Homo sapiens
gagtttgtattattacaaa

SEQ ID NO: 6250177 - DNA, 14 bp, Homo sapiens
gagtttgtattttg

SEQ ID NO: 6250178 - DNA, 22 bp, Homo sapiens
gagtttgtcgctcatgtgtgca

SEQ ID NO: 6250179 - DNA, 14 bp, Homo sapiens
gagtttgtggtaac

SEQ ID NO: 6250180 - DNA, 13 bp, Homo sapiens
gagtttgtgtctg

SEQ ID NO: 6250181 - DNA, 15 bp, Homo sapiens
gagtttgtgtgtctt

SEQ ID NO: 6250182 - DNA, 20 bp, Homo sapiens
gagtttgtgttgttgttgct

SEQ ID NO: 6250183 - DNA, 16 bp, Homo sapiens
gagtttgttctgttct

SEQ ID NO: 6250184 - DNA, 23 bp, Homo sapiens
gagttttactcttgttgcccagg

SEQ ID NO: 6250185 - DNA, 18 bp, Homo sapiens
gagttttatttttaagaa

SEQ ID NO: 6250186 - DNA, 17 bp, Homo sapiens
gagttttcatgacagaa

SEQ ID NO: 6250187 - DNA, 16 bp, Homo sapiens
gagttttcattaaatc

SEQ ID NO: 6250188 - DNA, 15 bp, Homo sapiens
gagttttcatttcat

SEQ ID NO: 6250189 - DNA, 23 bp, Homo sapiens
gagttttcatttcatatatctat

SEQ ID NO: 6250190 - DNA, 13 bp, Homo sapiens
gagttttcttata

SEQ ID NO: 6250191 - DNA, 23 bp, Homo sapiens
gagttttcttatatatatattga

SEQ ID NO: 6250192 - DNA, 15 bp, Homo sapiens
gagttttctttagta

SEQ ID NO: 6250193 - DNA, 21 bp, Homo sapiens
gagttttctttctttctgttt

SEQ ID NO: 6250194 - DNA, 21 bp, Homo sapiens
gagttttgggaagttaaaggg

SEQ ID NO: 6250195 - DNA, 12 bp, Homo sapiens
gagttttgtagc

SEQ ID NO: 6250196 - DNA, 16 bp, Homo sapiens
gagttttgtcattcag

SEQ ID NO: 6250197 - DNA, 15 bp, Homo sapiens
gagttttgtctgtct

SEQ ID NO: 6250198 - DNA, 18 bp, Homo sapiens
gagtttttatggggctga

SEQ ID NO: 6250199 - DNA, 20 bp, Homo sapiens
gagtttttattttgtctctg

SEQ ID NO: 6250200 - DNA, 16 bp, Homo sapiens
gagtttttcattattt

SEQ ID NO: 6250201 - DNA, 12 bp, Homo sapiens
gagtttttcctc

SEQ ID NO: 6250202 - DNA, 21 bp, Homo sapiens
gagtttttcttacataatttg

SEQ ID NO: 6250203 - DNA, 19 bp, Homo sapiens
gagtttttgtttggagagc

SEQ ID NO: 6250204 - DNA, 21 bp, Homo sapiens
gagtttttgtttgtttcttct

SEQ ID NO: 6250205 - DNA, 17 bp, Homo sapiens
gagttttttattccagt

SEQ ID NO: 6250206 - DNA, 16 bp, Homo sapiens
gagttttttgtaccaa

SEQ ID NO: 6250207 - DNA, 17 bp, Homo sapiens
gagtttttttgtcagat

SEQ ID NO: 6250208 - DNA, 23 bp, Homo sapiens
gataaaaaattttgtaattttct

SEQ ID NO: 6250209 - DNA, 19 bp, Homo sapiens
gataaaaacaatatatgta

SEQ ID NO: 6250210 - DNA, 21 bp, Homo sapiens
gataaaaagatgttcagtcat

SEQ ID NO: 6250211 - DNA, 19 bp, Homo sapiens
gataaaaaggaaggagaga

SEQ ID NO: 6250212 - DNA, 20 bp, Homo sapiens
gataaaaaggaaggagagat

SEQ ID NO: 6250213 - DNA, 16 bp, Homo sapiens
gataaaaataaagctg

SEQ ID NO: 6250214 - DNA, 20 bp, Homo sapiens
gataaaaatatcatcatagt

SEQ ID NO: 6250215 - DNA, 13 bp, Homo sapiens
gataaaaatcata

SEQ ID NO: 6250216 - DNA, 18 bp, Homo sapiens
gataaaaatcatatagac

SEQ ID NO: 6250217 - DNA, 19 bp, Homo sapiens
gataaaacattagaagaaa

SEQ ID NO: 6250218 - DNA, 15 bp, Homo sapiens
gataaaactgggttg

SEQ ID NO: 6250219 - DNA, 21 bp, Homo sapiens
gataaaagaaaaacctgtgat

SEQ ID NO: 6250220 - DNA, 13 bp, Homo sapiens
gataaaagatggc

SEQ ID NO: 6250221 - DNA, 19 bp, Homo sapiens
gataaaataaaattttatt

SEQ ID NO: 6250222 - DNA, 17 bp, Homo sapiens
gataaaataaataattt

SEQ ID NO: 6250223 - DNA, 19 bp, Homo sapiens
gataaaataaataatttta

SEQ ID NO: 6250224 - DNA, 21 bp, Homo sapiens
gataaaataatgctgcaaact

SEQ ID NO: 6250225 - DNA, 17 bp, Homo sapiens
gataaaatatcctcagg

SEQ ID NO: 6250226 - DNA, 13 bp, Homo sapiens
gataaaatatttt

SEQ ID NO: 6250227 - DNA, 23 bp, Homo sapiens
gataaaatcataagtatttggaa

SEQ ID NO: 6250228 - DNA, 18 bp, Homo sapiens
gataaaatgaggttcaac

SEQ ID NO: 6250229 - DNA, 22 bp, Homo sapiens
gataaaatgccagtctcattgt

SEQ ID NO: 6250230 - DNA, 15 bp, Homo sapiens
gataaaatgttcctt

SEQ ID NO: 6250231 - DNA, 19 bp, Homo sapiens
gataaaattatagatggga

SEQ ID NO: 6250232 - DNA, 19 bp, Homo sapiens
gataaaattgtgatgtttt

SEQ ID NO: 6250233 - DNA, 22 bp, Homo sapiens
gataaacacaagattggtgttt

SEQ ID NO: 6250234 - DNA, 13 bp, Homo sapiens
gataaacacaggc

SEQ ID NO: 6250235 - DNA, 15 bp, Homo sapiens
gataaacaccaaccc

SEQ ID NO: 6250236 - DNA, 22 bp, Homo sapiens
gataaacaccaacccaggaatt

SEQ ID NO: 6250237 - DNA, 12 bp, Homo sapiens
gataaacataat

SEQ ID NO: 6250238 - DNA, 13 bp, Homo sapiens
gataaacattaaa

SEQ ID NO: 6250239 - DNA, 19 bp, Homo sapiens
gataaaccaaaaacatttg

SEQ ID NO: 6250240 - DNA, 16 bp, Homo sapiens
gataaaccaataaatc

SEQ ID NO: 6250241 - DNA, 21 bp, Homo sapiens
gataaaccaccctctggggac

SEQ ID NO: 6250242 - DNA, 14 bp, Homo sapiens
gataaactgaaatt

SEQ ID NO: 6250243 - DNA, 11 bp, Homo sapiens
gataaactgac

SEQ ID NO: 6250244 - DNA, 13 bp, Homo sapiens
gataaagaaaaga

SEQ ID NO: 6250245 - DNA, 16 bp, Homo sapiens
gataaagaaaagacat

SEQ ID NO: 6250246 - DNA, 20 bp, Homo sapiens
gataaagaaaccttttaaaa

SEQ ID NO: 6250247 - DNA, 19 bp, Homo sapiens
gataaagacagctgacaga

SEQ ID NO: 6250248 - DNA, 18 bp, Homo sapiens
gataaagaccagaaattc

SEQ ID NO: 6250249 - DNA, 20 bp, Homo sapiens
gataaagacttttatgtgag

SEQ ID NO: 6250250 - DNA, 21 bp, Homo sapiens
gataaagacttttatgtgaga

SEQ ID NO: 6250251 - DNA, 21 bp, Homo sapiens
gataaagattgtgtggtgttt

SEQ ID NO: 6250252 - DNA, 16 bp, Homo sapiens
gataaagatttcttga

SEQ ID NO: 6250253 - DNA, 17 bp, Homo sapiens
gataaagattttttaat

SEQ ID NO: 6250254 - DNA, 15 bp, Homo sapiens
gataaagcacagctg

SEQ ID NO: 6250255 - DNA, 16 bp, Homo sapiens
gataaagcagctcagg

SEQ ID NO: 6250256 - DNA, 19 bp, Homo sapiens
gataaagccactgaaaatt

SEQ ID NO: 6250257 - DNA, 15 bp, Homo sapiens
gataaagtgaccagg

SEQ ID NO: 6250258 - DNA, 19 bp, Homo sapiens
gataaagttggccatgtat

SEQ ID NO: 6250259 - DNA, 15 bp, Homo sapiens
gataaagtttctcag

SEQ ID NO: 6250260 - DNA, 16 bp, Homo sapiens
gataaagtttctcaga

SEQ ID NO: 6250261 - DNA, 20 bp, Homo sapiens
gataaataaaagatagcaat

SEQ ID NO: 6250262 - DNA, 16 bp, Homo sapiens
gataaataactttttt

SEQ ID NO: 6250263 - DNA, 16 bp, Homo sapiens
gataaatacaaggccc

SEQ ID NO: 6250264 - DNA, 20 bp, Homo sapiens
gataaatcagtcaagctgtt

SEQ ID NO: 6250265 - DNA, 19 bp, Homo sapiens
gataaatcataaagtcagt

SEQ ID NO: 6250266 - DNA, 12 bp, Homo sapiens
gataaatcatgg

SEQ ID NO: 6250267 - DNA, 13 bp, Homo sapiens
gataaatcatggg

SEQ ID NO: 6250268 - DNA, 21 bp, Homo sapiens
gataaatcatgggcattgctg

SEQ ID NO: 6250269 - DNA, 14 bp, Homo sapiens
gataaatcatttta

SEQ ID NO: 6250270 - DNA, 20 bp, Homo sapiens
gataaatcattttatgtcaa

SEQ ID NO: 6250271 - DNA, 18 bp, Homo sapiens
gataaatccaactctgac

SEQ ID NO: 6250272 - DNA, 16 bp, Homo sapiens
gataaatcctctattg

SEQ ID NO: 6250273 - DNA, 15 bp, Homo sapiens
gataaatgagctttc

SEQ ID NO: 6250274 - DNA, 20 bp, Homo sapiens
gataaatgattcaaaaagtc

SEQ ID NO: 6250275 - DNA, 22 bp, Homo sapiens
gataaatggcttcctggcaata

SEQ ID NO: 6250276 - DNA, 22 bp, Homo sapiens
gataaattaacctctcacagtt

SEQ ID NO: 6250277 - DNA, 22 bp, Homo sapiens
gataaattatggtaaaattttg

SEQ ID NO: 6250278 - DNA, 16 bp, Homo sapiens
gataaattccactgga

SEQ ID NO: 6250279 - DNA, 13 bp, Homo sapiens
gataaattgccat

SEQ ID NO: 6250280 - DNA, 13 bp, Homo sapiens
gataaatttaatc

SEQ ID NO: 6250281 - DNA, 16 bp, Homo sapiens
gataaattttggaaga

SEQ ID NO: 6250282 - DNA, 17 bp, Homo sapiens
gataacaaaatcacaag

SEQ ID NO: 6250283 - DNA, 20 bp, Homo sapiens
gataacaaaatcacaagcaa

SEQ ID NO: 6250284 - DNA, 12 bp, Homo sapiens
gataacaaagat

SEQ ID NO: 6250285 - DNA, 17 bp, Homo sapiens
gataacaaagatatctt

SEQ ID NO: 6250286 - DNA, 16 bp, Homo sapiens
gataacaacctggaga

SEQ ID NO: 6250287 - DNA, 19 bp, Homo sapiens
gataacaatgttttaacaa

SEQ ID NO: 6250288 - DNA, 16 bp, Homo sapiens
gataacactggagtgg

SEQ ID NO: 6250289 - DNA, 21 bp, Homo sapiens
gataacactgtctacctcaca

SEQ ID NO: 6250290 - DNA, 11 bp, Homo sapiens
gataacagcta

SEQ ID NO: 6250291 - DNA, 16 bp, Homo sapiens
gataaccaattttcag

SEQ ID NO: 6250292 - DNA, 15 bp, Homo sapiens
gccctggggctgccc

SEQ ID NO: 6250293 - DNA, 17 bp, Homo sapiens
gccctggggctgccctc

SEQ ID NO: 6250294 - DNA, 16 bp, Homo sapiens
gccctggggctgggcc

SEQ ID NO: 6250295 - DNA, 20 bp, Homo sapiens
gccctgggggattcctgagc

SEQ ID NO: 6250296 - DNA, 23 bp, Homo sapiens
gccctgggggattcctgagctgg

SEQ ID NO: 6250297 - DNA, 14 bp, Homo sapiens
gccctgggggccag

SEQ ID NO: 6250298 - DNA, 17 bp, Homo sapiens
gccctgggggccagctg

SEQ ID NO: 6250299 - DNA, 19 bp, Homo sapiens
gccctgggggccagctggt

SEQ ID NO: 6250300 - DNA, 16 bp, Homo sapiens
gccctgggggtctggg

SEQ ID NO: 6250301 - DNA, 16 bp, Homo sapiens
gccctggggtaccatg

SEQ ID NO: 6250302 - DNA, 19 bp, Homo sapiens
gccctggggtaccatgtgg

SEQ ID NO: 6250303 - DNA, 15 bp, Homo sapiens
gccctggggtctctg

SEQ ID NO: 6250304 - DNA, 16 bp, Homo sapiens
gccctggggtctctga

SEQ ID NO: 6250305 - DNA, 18 bp, Homo sapiens
gccctggggtctctgagc

SEQ ID NO: 6250306 - DNA, 23 bp, Homo sapiens
gccctggggtctctgagcagtgg

SEQ ID NO: 6250307 - DNA, 20 bp, Homo sapiens
gccctgggtaagaagggtgg

SEQ ID NO: 6250308 - DNA, 22 bp, Homo sapiens
gccctgggtaagaagggtggga

SEQ ID NO: 6250309 - DNA, 20 bp, Homo sapiens
gccctgggtcacctagctgg

SEQ ID NO: 6250310 - DNA, 14 bp, Homo sapiens
gccctgggtcctgc

SEQ ID NO: 6250311 - DNA, 15 bp, Homo sapiens
gccctgggtcctgcc

SEQ ID NO: 6250312 - DNA, 19 bp, Homo sapiens
gccctgggtcctgcctgca

SEQ ID NO: 6250313 - DNA, 21 bp, Homo sapiens
gccctgggtcctgcctgcagt

SEQ ID NO: 6250314 - DNA, 21 bp, Homo sapiens
gccctgggtctaaggggttgg

SEQ ID NO: 6250315 - DNA, 14 bp, Homo sapiens
gccctgggtcttgc

SEQ ID NO: 6250316 - DNA, 22 bp, Homo sapiens
gccctggtaaaagggatacaca

SEQ ID NO: 6250317 - DNA, 16 bp, Homo sapiens
gccctggtagggcagt

SEQ ID NO: 6250318 - DNA, 13 bp, Homo sapiens
gccctggtccagg

SEQ ID NO: 6250319 - DNA, 18 bp, Homo sapiens
gccctggtccagggaagc

SEQ ID NO: 6250320 - DNA, 17 bp, Homo sapiens
gccctggtcctggcctc

SEQ ID NO: 6250321 - DNA, 18 bp, Homo sapiens
gccctggtccttccaggc

SEQ ID NO: 6250322 - DNA, 14 bp, Homo sapiens
gccctggtctcagc

SEQ ID NO: 6250323 - DNA, 14 bp, Homo sapiens
gccctggtgaccag

SEQ ID NO: 6250324 - DNA, 18 bp, Homo sapiens
gccctggtgctcctgccc

SEQ ID NO: 6250325 - DNA, 20 bp, Homo sapiens
gccctggtggcagtgggagc

SEQ ID NO: 6250326 - DNA, 22 bp, Homo sapiens
gccctggtggcagtgggagctg

SEQ ID NO: 6250327 - DNA, 18 bp, Homo sapiens
gccctggtggccctctcc

SEQ ID NO: 6250328 - DNA, 18 bp, Homo sapiens
gccctggtggcctgcccc

SEQ ID NO: 6250329 - DNA, 23 bp, Homo sapiens
gccctggtggtggctcgggaggc

SEQ ID NO: 6250330 - DNA, 18 bp, Homo sapiens
gccctggtgtcaggcagg

SEQ ID NO: 6250331 - DNA, 16 bp, Homo sapiens
gccctggtgtgtttcc

SEQ ID NO: 6250332 - DNA, 14 bp, Homo sapiens
gccctggttagctg

SEQ ID NO: 6250333 - DNA, 17 bp, Homo sapiens
gccctggttcccccagg

SEQ ID NO: 6250334 - DNA, 23 bp, Homo sapiens
gccctggttcccccaggaccctg

SEQ ID NO: 6250335 - DNA, 15 bp, Homo sapiens
gccctggttcctgct

SEQ ID NO: 6250336 - DNA, 23 bp, Homo sapiens
gccctggttcctgctgtcctggt

SEQ ID NO: 6250337 - DNA, 21 bp, Homo sapiens
gccctggttctccatccccat

SEQ ID NO: 6250338 - DNA, 21 bp, Homo sapiens
gccctggttctggctgtggtc

SEQ ID NO: 6250339 - DNA, 16 bp, Homo sapiens
gccctggtttcactgg

SEQ ID NO: 6250340 - DNA, 14 bp, Homo sapiens
gccctggtttcctg

SEQ ID NO: 6250341 - DNA, 19 bp, Homo sapiens
gccctgtacccaccccagc

SEQ ID NO: 6250342 - DNA, 17 bp, Homo sapiens
gccctgtagccctggcc

SEQ ID NO: 6250343 - DNA, 15 bp, Homo sapiens
gccctgtagctcctt

SEQ ID NO: 6250344 - DNA, 11 bp, Homo sapiens
gccctgtcact

SEQ ID NO: 6250345 - DNA, 18 bp, Homo sapiens
gccctgtcagagccgcca

SEQ ID NO: 6250346 - DNA, 18 bp, Homo sapiens
gccctgtcaggaggcaga

SEQ ID NO: 6250347 - DNA, 14 bp, Homo sapiens
gccctgtcagtgca

SEQ ID NO: 6250348 - DNA, 15 bp, Homo sapiens
gccctgtcagtgcag

SEQ ID NO: 6250349 - DNA, 21 bp, Homo sapiens
gccctgtccactctgctcagg

SEQ ID NO: 6250350 - DNA, 12 bp, Homo sapiens
gccctgtccagc

SEQ ID NO: 6250351 - DNA, 18 bp, Homo sapiens
gccctgtccagcccccag

SEQ ID NO: 6250352 - DNA, 13 bp, Homo sapiens
gccctgtcccagg

SEQ ID NO: 6250353 - DNA, 16 bp, Homo sapiens
gccctgtcccaggccg

SEQ ID NO: 6250354 - DNA, 22 bp, Homo sapiens
gccctgtcccaggccggcccag

SEQ ID NO: 6250355 - DNA, 15 bp, Homo sapiens
gccctgtccctagct

SEQ ID NO: 6250356 - DNA, 18 bp, Homo sapiens
gccctgtccctagctcac

SEQ ID NO: 6250357 - DNA, 13 bp, Homo sapiens
gccctgtccctcc

SEQ ID NO: 6250358 - DNA, 17 bp, Homo sapiens
gccctgtccctcccact

SEQ ID NO: 6250359 - DNA, 19 bp, Homo sapiens
gccctgtccctcccactcc

SEQ ID NO: 6250360 - DNA, 20 bp, Homo sapiens
gccctgtccctcccactccc

SEQ ID NO: 6250361 - DNA, 17 bp, Homo sapiens
gccctgtccctgtcccc

SEQ ID NO: 6250362 - DNA, 22 bp, Homo sapiens
gccctgtcctggtggtattttc

SEQ ID NO: 6250363 - DNA, 16 bp, Homo sapiens
gccctgtcgagacact

SEQ ID NO: 6250364 - DNA, 21 bp, Homo sapiens
gccctgtcgagacacttgcct

SEQ ID NO: 6250365 - DNA, 15 bp, Homo sapiens
gccctgtcgcccctc

SEQ ID NO: 6250366 - DNA, 15 bp, Homo sapiens
gccctgtgagagcca

SEQ ID NO: 6250367 - DNA, 17 bp, Homo sapiens
gccctgtgagagccacg

SEQ ID NO: 6250368 - DNA, 20 bp, Homo sapiens
gccctgtgagagccacgctg

SEQ ID NO: 6250369 - DNA, 14 bp, Homo sapiens
gccctgtgcaggga

SEQ ID NO: 6250370 - DNA, 12 bp, Homo sapiens
gccctgtgccag

SEQ ID NO: 6250371 - DNA, 17 bp, Homo sapiens
gccctgtgccaggccaa

SEQ ID NO: 6250372 - DNA, 13 bp, Homo sapiens
gccctgtgccctc

SEQ ID NO: 6250373 - DNA, 16 bp, Homo sapiens
gccctgtgccctctca

SEQ ID NO: 6250374 - DNA, 12 bp, Homo sapiens
gccctgtgccgc

SEQ ID NO: 6250375 - DNA, 19 bp, Homo sapiens
gccctgtgccgcactctgg

SEQ ID NO: 6250376 - DNA, 13 bp, Homo sapiens
gccctgtgctcca

SEQ ID NO: 6250377 - DNA, 23 bp, Homo sapiens
gccctgtggaagggactaggagc

SEQ ID NO: 6250378 - DNA, 16 bp, Homo sapiens
gccctgtggagtccag

SEQ ID NO: 6250379 - DNA, 20 bp, Homo sapiens
gccctgtggagtccagctct

SEQ ID NO: 6250380 - DNA, 21 bp, Homo sapiens
gccctgtggatgagccctcag

SEQ ID NO: 6250381 - DNA, 18 bp, Homo sapiens
gccctgtggattccagca

SEQ ID NO: 6250382 - DNA, 18 bp, Homo sapiens
gccctgtggcccacgggc

SEQ ID NO: 6250383 - DNA, 17 bp, Homo sapiens
gccctgtggccgccacc

SEQ ID NO: 6250384 - DNA, 18 bp, Homo sapiens
gccctgtggccgccacct

SEQ ID NO: 6250385 - DNA, 13 bp, Homo sapiens
gccctgtggctcc

SEQ ID NO: 6250386 - DNA, 20 bp, Homo sapiens
gccctgtgggaccccaggcc

SEQ ID NO: 6250387 - DNA, 13 bp, Homo sapiens
gccctgtgggaga

SEQ ID NO: 6250388 - DNA, 24 bp, Homo sapiens
gccctgtgggagccgcagagcctg

SEQ ID NO: 6250389 - DNA, 17 bp, Homo sapiens
gccctgtgggagtccac

SEQ ID NO: 6250390 - DNA, 21 bp, Homo sapiens
gccctgtgggagtccactttc

SEQ ID NO: 6250391 - DNA, 23 bp, Homo sapiens
gccctgtgggagtccactttcct

SEQ ID NO: 6250392 - DNA, 19 bp, Homo sapiens
gccctgtggtctggggaga

SEQ ID NO: 6250393 - DNA, 16 bp, Homo sapiens
gccctgtggtgctggg

SEQ ID NO: 6250394 - DNA, 20 bp, Homo sapiens
gccctgtgtctgtcacaggc

SEQ ID NO: 6250395 - DNA, 24 bp, Homo sapiens
gccctgtgtctgtcacaggctggg

SEQ ID NO: 6250396 - DNA, 19 bp, Homo sapiens
gccctgtgtgtttgacatg

SEQ ID NO: 6250397 - DNA, 18 bp, Homo sapiens
gccctgttcacgctcacc

SEQ ID NO: 6250398 - DNA, 20 bp, Homo sapiens
gccctgttcacgctcaccca

SEQ ID NO: 6250399 - DNA, 19 bp, Homo sapiens
gccctgttcatgtgcctct

SEQ ID NO: 6250400 - DNA, 15 bp, Homo sapiens
gccctgttcccttcc

SEQ ID NO: 6250401 - DNA, 21 bp, Homo sapiens
gccctgttccgcctcactggg

SEQ ID NO: 6250402 - DNA, 22 bp, Homo sapiens
gccctgttctcctgtccctcca

SEQ ID NO: 6250403 - DNA, 20 bp, Homo sapiens
gccctgttctcgttgcccta

SEQ ID NO: 6250404 - DNA, 14 bp, Homo sapiens
gccctgttgacctg

SEQ ID NO: 6250405 - DNA, 15 bp, Homo sapiens
gccctgttgacctgc

SEQ ID NO: 6250406 - DNA, 18 bp, Homo sapiens
gccctgttgacctgcccg

SEQ ID NO: 6250407 - DNA, 19 bp, Homo sapiens
gccctgttggcagctctag

SEQ ID NO: 6250408 - DNA, 14 bp, Homo sapiens
gccctgttgtgcca

SEQ ID NO: 6250409 - DNA, 17 bp, Homo sapiens
gccctgttgtgtataga

SEQ ID NO: 6250410 - DNA, 18 bp, Homo sapiens
gccctgtttcctgctgct

SEQ ID NO: 6250411 - DNA, 17 bp, Homo sapiens
gcccttaaaataatgat

SEQ ID NO: 6250412 - DNA, 18 bp, Homo sapiens
gcccttaactatcaccag

SEQ ID NO: 6250413 - DNA, 22 bp, Homo sapiens
gcccttaagccaaactcaggcc

SEQ ID NO: 6250414 - DNA, 13 bp, Homo sapiens
gcccttaagggaa

SEQ ID NO: 6250415 - DNA, 18 bp, Homo sapiens
gcccttacacgtgcgtgt

SEQ ID NO: 6250416 - DNA, 16 bp, Homo sapiens
gcccttacctgccagg

SEQ ID NO: 6250417 - DNA, 20 bp, Homo sapiens
gcccttacctgtctctctct

SEQ ID NO: 6250418 - DNA, 22 bp, Homo sapiens
gcccttacctgtctctctcttc

SEQ ID NO: 6250419 - DNA, 20 bp, Homo sapiens
gcccttacctttcctgatgc

SEQ ID NO: 6250420 - DNA, 14 bp, Homo sapiens
gcccttagaatgtg

SEQ ID NO: 6250421 - DNA, 17 bp, Homo sapiens
gcccttagcacagagag

SEQ ID NO: 6250422 - DNA, 19 bp, Homo sapiens
gcccttagcacagagaggg

SEQ ID NO: 6250423 - DNA, 19 bp, Homo sapiens
gcccttagcagggaaacag

SEQ ID NO: 6250424 - DNA, 20 bp, Homo sapiens
gcccttagccttgctgtaga

SEQ ID NO: 6250425 - DNA, 21 bp, Homo sapiens
gcccttagccttgctgtagag

SEQ ID NO: 6250426 - DNA, 23 bp, Homo sapiens
gcccttagggagagcacctgttg

SEQ ID NO: 6250427 - DNA, 16 bp, Homo sapiens
gcccttatctgtgctc

SEQ ID NO: 6250428 - DNA, 15 bp, Homo sapiens
gcccttatggagctc

SEQ ID NO: 6250429 - DNA, 17 bp, Homo sapiens
gcccttattttcaagaa

SEQ ID NO: 6250430 - DNA, 20 bp, Homo sapiens
gcccttattttcaagaaact

SEQ ID NO: 6250431 - DNA, 15 bp, Homo sapiens
gcccttcaccccagt

SEQ ID NO: 6250432 - DNA, 16 bp, Homo sapiens
gcccttcactttctcc

SEQ ID NO: 6250433 - DNA, 22 bp, Homo sapiens
gcccttcactttctcctggtgt

SEQ ID NO: 6250434 - DNA, 19 bp, Homo sapiens
gcccttcagacgagatcct

SEQ ID NO: 6250435 - DNA, 21 bp, Homo sapiens
gcccttcagcatcctcagttc

SEQ ID NO: 6250436 - DNA, 14 bp, Homo sapiens
gcccttcagcccac

SEQ ID NO: 6250437 - DNA, 16 bp, Homo sapiens
gcccttcagcccacca

SEQ ID NO: 6250438 - DNA, 20 bp, Homo sapiens
gcccttcagcccaccaccct

SEQ ID NO: 6250439 - DNA, 14 bp, Homo sapiens
gcccttcaggaagc

SEQ ID NO: 6250440 - DNA, 22 bp, Homo sapiens
gcccttcaggacccttctactt

SEQ ID NO: 6250441 - DNA, 18 bp, Homo sapiens
gcccttcagtccctgagc

SEQ ID NO: 6250442 - DNA, 19 bp, Homo sapiens
gcccttcagtctgctccac

SEQ ID NO: 6250443 - DNA, 13 bp, Homo sapiens
gcccttccagcct

SEQ ID NO: 6250444 - DNA, 14 bp, Homo sapiens
gcccttccagcctg

SEQ ID NO: 6250445 - DNA, 20 bp, Homo sapiens
gcccttccagcctgggacac

SEQ ID NO: 6250446 - DNA, 17 bp, Homo sapiens
gcccttccaggagtggg

SEQ ID NO: 6250447 - DNA, 13 bp, Homo sapiens
gcccttccagtgg

SEQ ID NO: 6250448 - DNA, 22 bp, Homo sapiens
gcccttccagtggtaccagctc

SEQ ID NO: 6250449 - DNA, 21 bp, Homo sapiens
gcccttccatgtcgcctctgc

SEQ ID NO: 6250450 - DNA, 12 bp, Homo sapiens
gcccttcccagg

SEQ ID NO: 6250451 - DNA, 14 bp, Homo sapiens
gcccttcccaggcc

SEQ ID NO: 6250452 - DNA, 15 bp, Homo sapiens
gcccttcccaggcca

SEQ ID NO: 6250453 - DNA, 18 bp, Homo sapiens
gcccttcccaggccagcg

SEQ ID NO: 6250454 - DNA, 14 bp, Homo sapiens
gcccttcccagggc

SEQ ID NO: 6250455 - DNA, 16 bp, Homo sapiens
gcccttccccatcctg

SEQ ID NO: 6250456 - DNA, 13 bp, Homo sapiens
gcccttccccctt

SEQ ID NO: 6250457 - DNA, 24 bp, Homo sapiens
gcccttccccctttctctgcctgg

SEQ ID NO: 6250458 - DNA, 23 bp, Homo sapiens
gcccttcccctcccccactcctc

SEQ ID NO: 6250459 - DNA, 15 bp, Homo sapiens
gcccttcccctcccg

SEQ ID NO: 6250460 - DNA, 13 bp, Homo sapiens
gcccttccctctg

SEQ ID NO: 6250461 - DNA, 16 bp, Homo sapiens
gcccttccctctgggc

SEQ ID NO: 6250462 - DNA, 18 bp, Homo sapiens
gcccttccctctgggcac

SEQ ID NO: 6250463 - DNA, 22 bp, Homo sapiens
gcccttccctctgggcacgcct

SEQ ID NO: 6250464 - DNA, 15 bp, Homo sapiens
gcccttccctggagg

SEQ ID NO: 6250465 - DNA, 12 bp, Homo sapiens
gcccttccctgt

SEQ ID NO: 6250466 - DNA, 13 bp, Homo sapiens
gcccttccctgtc

SEQ ID NO: 6250467 - DNA, 18 bp, Homo sapiens
gcccttccctgtccctct

SEQ ID NO: 6250468 - DNA, 16 bp, Homo sapiens
gcccttccgagcggcg

SEQ ID NO: 6250469 - DNA, 16 bp, Homo sapiens
gcccttccgtagtttg

SEQ ID NO: 6250470 - DNA, 16 bp, Homo sapiens
gataaccagtaaggaa

SEQ ID NO: 6250471 - DNA, 20 bp, Homo sapiens
gataaccagtaaggaaatat

SEQ ID NO: 6250472 - DNA, 17 bp, Homo sapiens
gataaccatattcacaa

SEQ ID NO: 6250473 - DNA, 18 bp, Homo sapiens
gataaccccaagacagtc

SEQ ID NO: 6250474 - DNA, 17 bp, Homo sapiens
gataaccccaggcactg

SEQ ID NO: 6250475 - DNA, 16 bp, Homo sapiens
gataaccttgaaaaaa

SEQ ID NO: 6250476 - DNA, 16 bp, Homo sapiens
gataaccttgtttatt

SEQ ID NO: 6250477 - DNA, 16 bp, Homo sapiens
gataacgcaggagaga

SEQ ID NO: 6250478 - DNA, 14 bp, Homo sapiens
gataactatttaca

SEQ ID NO: 6250479 - DNA, 11 bp, Homo sapiens
gataactctcc

SEQ ID NO: 6250480 - DNA, 16 bp, Homo sapiens
gataactctctttcct

SEQ ID NO: 6250481 - DNA, 11 bp, Homo sapiens
gataactctgt

SEQ ID NO: 6250482 - DNA, 13 bp, Homo sapiens
gataactctttgg

SEQ ID NO: 6250483 - DNA, 22 bp, Homo sapiens
gataactgatggcaatattaag

SEQ ID NO: 6250484 - DNA, 23 bp, Homo sapiens
gataactgatttctatggctttc

SEQ ID NO: 6250485 - DNA, 21 bp, Homo sapiens
gataactgcaattttaattga

SEQ ID NO: 6250486 - DNA, 18 bp, Homo sapiens
gataactgttatttataa

SEQ ID NO: 6250487 - DNA, 15 bp, Homo sapiens
gataacttaaataat

SEQ ID NO: 6250488 - DNA, 16 bp, Homo sapiens
gataacttaaataatt

SEQ ID NO: 6250489 - DNA, 14 bp, Homo sapiens
gataacttactgta

SEQ ID NO: 6250490 - DNA, 15 bp, Homo sapiens
gataacttactgtat

SEQ ID NO: 6250491 - DNA, 18 bp, Homo sapiens
gataacttcatgaagact

SEQ ID NO: 6250492 - DNA, 13 bp, Homo sapiens
gataacttccttg

SEQ ID NO: 6250493 - DNA, 22 bp, Homo sapiens
gataacttcttgaaaaagatgg

SEQ ID NO: 6250494 - DNA, 18 bp, Homo sapiens
gataacttgctttcttct

SEQ ID NO: 6250495 - DNA, 16 bp, Homo sapiens
gataacttggggaggc

SEQ ID NO: 6250496 - DNA, 22 bp, Homo sapiens
gataacttttttgagtcattga

SEQ ID NO: 6250497 - DNA, 11 bp, Homo sapiens
gataagaaaac

SEQ ID NO: 6250498 - DNA, 12 bp, Homo sapiens
gataagaaaacc

SEQ ID NO: 6250499 - DNA, 20 bp, Homo sapiens
gataagaaaagcctgaacta

SEQ ID NO: 6250500 - DNA, 13 bp, Homo sapiens
gataagaaagcag

SEQ ID NO: 6250501 - DNA, 14 bp, Homo sapiens
gataagaaagcagg

SEQ ID NO: 6250502 - DNA, 16 bp, Homo sapiens
gataagaaccacagaa

SEQ ID NO: 6250503 - DNA, 19 bp, Homo sapiens
gataagaacccagggtgga

SEQ ID NO: 6250504 - DNA, 19 bp, Homo sapiens
gataagaattgtctctggg

SEQ ID NO: 6250505 - DNA, 17 bp, Homo sapiens
gataagaccaccacctc

SEQ ID NO: 6250506 - DNA, 16 bp, Homo sapiens
gataagactgttttta

SEQ ID NO: 6250507 - DNA, 22 bp, Homo sapiens
gataagacttgtttctttctgt

SEQ ID NO: 6250508 - DNA, 23 bp, Homo sapiens
gataagacttgtttctttctgtc

SEQ ID NO: 6250509 - DNA, 22 bp, Homo sapiens
gataagagtagaaactgcaggg

SEQ ID NO: 6250510 - DNA, 14 bp, Homo sapiens
gataagatctttta

SEQ ID NO: 6250511 - DNA, 14 bp, Homo sapiens
gataagatggtttc

SEQ ID NO: 6250512 - DNA, 18 bp, Homo sapiens
gataagatggtttccgtg

SEQ ID NO: 6250513 - DNA, 16 bp, Homo sapiens
gataagcacattaaag

SEQ ID NO: 6250514 - DNA, 17 bp, Homo sapiens
gataagcaccagtggga

SEQ ID NO: 6250515 - DNA, 11 bp, Homo sapiens
gataagcctga

SEQ ID NO: 6250516 - DNA, 17 bp, Homo sapiens
gataagcctgagcctta

SEQ ID NO: 6250517 - DNA, 21 bp, Homo sapiens
gataaggaaacacttctattt

SEQ ID NO: 6250518 - DNA, 23 bp, Homo sapiens
gataaggaacatttatccaggaa

SEQ ID NO: 6250519 - DNA, 21 bp, Homo sapiens
gataaggaagaaacagaagag

SEQ ID NO: 6250520 - DNA, 18 bp, Homo sapiens
gataagggactgatgttt

SEQ ID NO: 6250521 - DNA, 16 bp, Homo sapiens
gataagggagagggaa

SEQ ID NO: 6250522 - DNA, 14 bp, Homo sapiens
gataaggggccttg

SEQ ID NO: 6250523 - DNA, 12 bp, Homo sapiens
gataagtgcagt

SEQ ID NO: 6250524 - DNA, 18 bp, Homo sapiens
gataagtgctcagtattg

SEQ ID NO: 6250525 - DNA, 12 bp, Homo sapiens
gataagtggaaa

SEQ ID NO: 6250526 - DNA, 19 bp, Homo sapiens
gataagtgttctgtctgac

SEQ ID NO: 6250527 - DNA, 16 bp, Homo sapiens
gataagttatagagca

SEQ ID NO: 6250528 - DNA, 13 bp, Homo sapiens
gataagttggaaa

SEQ ID NO: 6250529 - DNA, 18 bp, Homo sapiens
gataagttggaaacacta

SEQ ID NO: 6250530 - DNA, 15 bp, Homo sapiens
gataagttggagcag

SEQ ID NO: 6250531 - DNA, 12 bp, Homo sapiens
gataataaaaca

SEQ ID NO: 6250532 - DNA, 13 bp, Homo sapiens
gataataaaacat

SEQ ID NO: 6250533 - DNA, 17 bp, Homo sapiens
gataataaaattcattc

SEQ ID NO: 6250534 - DNA, 22 bp, Homo sapiens
gataataaattgaaattgtgaa

SEQ ID NO: 6250535 - DNA, 16 bp, Homo sapiens
gataataaattgattt

SEQ ID NO: 6250536 - DNA, 17 bp, Homo sapiens
gataataactagatctc

SEQ ID NO: 6250537 - DNA, 19 bp, Homo sapiens
gataataactgtcttctgg

SEQ ID NO: 6250538 - DNA, 15 bp, Homo sapiens
gataataataataat

SEQ ID NO: 6250539 - DNA, 16 bp, Homo sapiens
gataataatgaaataa

SEQ ID NO: 6250540 - DNA, 12 bp, Homo sapiens
gataataatggg

SEQ ID NO: 6250541 - DNA, 12 bp, Homo sapiens
gataatacacca

SEQ ID NO: 6250542 - DNA, 21 bp, Homo sapiens
gataatacaccactacattct

SEQ ID NO: 6250543 - DNA, 18 bp, Homo sapiens
gataatacagatttgtaa

SEQ ID NO: 6250544 - DNA, 14 bp, Homo sapiens
gataatacattccg

SEQ ID NO: 6250545 - DNA, 14 bp, Homo sapiens
gataatagattctc

SEQ ID NO: 6250546 - DNA, 13 bp, Homo sapiens
gataataggaatt

SEQ ID NO: 6250547 - DNA, 14 bp, Homo sapiens
gataataggaattc

SEQ ID NO: 6250548 - DNA, 15 bp, Homo sapiens
gataataggaattca

SEQ ID NO: 6250549 - DNA, 17 bp, Homo sapiens
gataataggtcatatgt

SEQ ID NO: 6250550 - DNA, 18 bp, Homo sapiens
gataatagtaatggttct

SEQ ID NO: 6250551 - DNA, 16 bp, Homo sapiens
gataatatattgtgtt

SEQ ID NO: 6250552 - DNA, 17 bp, Homo sapiens
gataatatatttgcaga

SEQ ID NO: 6250553 - DNA, 16 bp, Homo sapiens
gataatatctgtgagg

SEQ ID NO: 6250554 - DNA, 23 bp, Homo sapiens
gataatatctttgtgataattta

SEQ ID NO: 6250555 - DNA, 17 bp, Homo sapiens
gataatatgagaatcag

SEQ ID NO: 6250556 - DNA, 20 bp, Homo sapiens
gataatatgtttagttttac

SEQ ID NO: 6250557 - DNA, 18 bp, Homo sapiens
gataatattgtggtgcca

SEQ ID NO: 6250558 - DNA, 15 bp, Homo sapiens
gataatattgtttgg

SEQ ID NO: 6250559 - DNA, 12 bp, Homo sapiens
gataatatttaa

SEQ ID NO: 6250560 - DNA, 22 bp, Homo sapiens
gataatatttttgtatttctct

SEQ ID NO: 6250561 - DNA, 13 bp, Homo sapiens
gataatcagcctc

SEQ ID NO: 6250562 - DNA, 15 bp, Homo sapiens
gataatcaggaaaaa

SEQ ID NO: 6250563 - DNA, 15 bp, Homo sapiens
gataatcattgctta

SEQ ID NO: 6250564 - DNA, 16 bp, Homo sapiens
gataatcctagagtct

SEQ ID NO: 6250565 - DNA, 15 bp, Homo sapiens
gataatctaaatata

SEQ ID NO: 6250566 - DNA, 20 bp, Homo sapiens
gataatctaaatataaacca

SEQ ID NO: 6250567 - DNA, 16 bp, Homo sapiens
gataatctcagtgctt

SEQ ID NO: 6250568 - DNA, 14 bp, Homo sapiens
gataatctgagcag

SEQ ID NO: 6250569 - DNA, 15 bp, Homo sapiens
gataatcttttacat

SEQ ID NO: 6250570 - DNA, 16 bp, Homo sapiens
gataatgaaataatca

SEQ ID NO: 6250571 - DNA, 20 bp, Homo sapiens
gataatgaaataatcagtga

SEQ ID NO: 6250572 - DNA, 23 bp, Homo sapiens
gataatgaaataatcagtgactg

SEQ ID NO: 6250573 - DNA, 18 bp, Homo sapiens
gataatgaaatagttatt

SEQ ID NO: 6250574 - DNA, 14 bp, Homo sapiens
gataatgaacagaa

SEQ ID NO: 6250575 - DNA, 21 bp, Homo sapiens
gataatgacactgtttcctga

SEQ ID NO: 6250576 - DNA, 15 bp, Homo sapiens
gataatgataaaaca

SEQ ID NO: 6250577 - DNA, 23 bp, Homo sapiens
gataatgcagataaatacattta

SEQ ID NO: 6250578 - DNA, 21 bp, Homo sapiens
gataatgcatatttttgcaca

SEQ ID NO: 6250579 - DNA, 11 bp, Homo sapiens
gataatgccac

SEQ ID NO: 6250580 - DNA, 22 bp, Homo sapiens
gataatggactcagctctgtct

SEQ ID NO: 6250581 - DNA, 16 bp, Homo sapiens
gataatgggagacagt

SEQ ID NO: 6250582 - DNA, 18 bp, Homo sapiens
gataatggtgaacatttt

SEQ ID NO: 6250583 - DNA, 15 bp, Homo sapiens
gataatgtattttaa

SEQ ID NO: 6250584 - DNA, 16 bp, Homo sapiens
gataatgtccccactc

SEQ ID NO: 6250585 - DNA, 13 bp, Homo sapiens
gataatgttaaat

SEQ ID NO: 6250586 - DNA, 16 bp, Homo sapiens
gataatgttcattttg

SEQ ID NO: 6250587 - DNA, 22 bp, Homo sapiens
gataatgttctttaatgttgtc

SEQ ID NO: 6250588 - DNA, 11 bp, Homo sapiens
gataattacaa

SEQ ID NO: 6250589 - DNA, 23 bp, Homo sapiens
gataattacgtttaaagtgcagt

SEQ ID NO: 6250590 - DNA, 16 bp, Homo sapiens
gataattagcagttta

SEQ ID NO: 6250591 - DNA, 18 bp, Homo sapiens
gataattatgtcccaggg

SEQ ID NO: 6250592 - DNA, 12 bp, Homo sapiens
gataattcattt

SEQ ID NO: 6250593 - DNA, 15 bp, Homo sapiens
gataattcatttgta

SEQ ID NO: 6250594 - DNA, 18 bp, Homo sapiens
gataattcatttgtattg

SEQ ID NO: 6250595 - DNA, 19 bp, Homo sapiens
gataattcatttgtattgc

SEQ ID NO: 6250596 - DNA, 14 bp, Homo sapiens
gataattccttggt

SEQ ID NO: 6250597 - DNA, 17 bp, Homo sapiens
gataattcgagcaaaca

SEQ ID NO: 6250598 - DNA, 15 bp, Homo sapiens
gataattcttatttt

SEQ ID NO: 6250599 - DNA, 11 bp, Homo sapiens
gataattgcta

SEQ ID NO: 6250600 - DNA, 22 bp, Homo sapiens
gataattgctatttatttttac

SEQ ID NO: 6250601 - DNA, 16 bp, Homo sapiens
gataattgtactttga

SEQ ID NO: 6250602 - DNA, 18 bp, Homo sapiens
gataattgtactttgaaa

SEQ ID NO: 6250603 - DNA, 16 bp, Homo sapiens
gataatttaaaatcca

SEQ ID NO: 6250604 - DNA, 22 bp, Homo sapiens
gataatttaaaatccattttag

SEQ ID NO: 6250605 - DNA, 14 bp, Homo sapiens
gataatttatcata

SEQ ID NO: 6250606 - DNA, 13 bp, Homo sapiens
gataatttcaggg

SEQ ID NO: 6250607 - DNA, 15 bp, Homo sapiens
gataatttcagggtg

SEQ ID NO: 6250608 - DNA, 12 bp, Homo sapiens
gataatttgaaa

SEQ ID NO: 6250609 - DNA, 22 bp, Homo sapiens
gataattttatgtgttatagta

SEQ ID NO: 6250610 - DNA, 12 bp, Homo sapiens
gataattttcat

SEQ ID NO: 6250611 - DNA, 13 bp, Homo sapiens
gataattttcatt

SEQ ID NO: 6250612 - DNA, 14 bp, Homo sapiens
gataattttgaaat

SEQ ID NO: 6250613 - DNA, 17 bp, Homo sapiens
gataatttttaaaagag

SEQ ID NO: 6250614 - DNA, 22 bp, Homo sapiens
gataattttttttttttaggaa

SEQ ID NO: 6250615 - DNA, 15 bp, Homo sapiens
gatacaaaccactgt

SEQ ID NO: 6250616 - DNA, 20 bp, Homo sapiens
gatacaaaccactgtgaaca

SEQ ID NO: 6250617 - DNA, 15 bp, Homo sapiens
gatacaaactttgtt

SEQ ID NO: 6250618 - DNA, 14 bp, Homo sapiens
gatacaaatttggc

SEQ ID NO: 6250619 - DNA, 14 bp, Homo sapiens
gatacaacctccct

SEQ ID NO: 6250620 - DNA, 16 bp, Homo sapiens
gatacaacctccctct

SEQ ID NO: 6250621 - DNA, 14 bp, Homo sapiens
gatacaagagtcag

SEQ ID NO: 6250622 - DNA, 22 bp, Homo sapiens
gatacaagtttcagacagggtc

SEQ ID NO: 6250623 - DNA, 11 bp, Homo sapiens
gatacaataaa

SEQ ID NO: 6250624 - DNA, 14 bp, Homo sapiens
gatacaatcagctg

SEQ ID NO: 6250625 - DNA, 15 bp, Homo sapiens
gatacaatcagctgc

SEQ ID NO: 6250626 - DNA, 18 bp, Homo sapiens
gatacaatgctgtgccct

SEQ ID NO: 6250627 - DNA, 22 bp, Homo sapiens
gatacaatgtatttatttaaaa

SEQ ID NO: 6250628 - DNA, 23 bp, Homo sapiens
gatacacaagagggactgtattt

SEQ ID NO: 6250629 - DNA, 18 bp, Homo sapiens
gatacacaggtgagaaag

SEQ ID NO: 6250630 - DNA, 20 bp, Homo sapiens
gatacacattacagccaggt

SEQ ID NO: 6250631 - DNA, 19 bp, Homo sapiens
gatacacccaaagtatcag

SEQ ID NO: 6250632 - DNA, 21 bp, Homo sapiens
gatacacccaaagtatcagga

SEQ ID NO: 6250633 - DNA, 19 bp, Homo sapiens
gatacaccgggcctggaga

SEQ ID NO: 6250634 - DNA, 14 bp, Homo sapiens
gatacactcctgct

SEQ ID NO: 6250635 - DNA, 14 bp, Homo sapiens
gatacactgaatgg

SEQ ID NO: 6250636 - DNA, 22 bp, Homo sapiens
gatacactgaatggaaataaat

SEQ ID NO: 6250637 - DNA, 17 bp, Homo sapiens
gatacactgcactttgt

SEQ ID NO: 6250638 - DNA, 19 bp, Homo sapiens
gatacactgcactttgttt

SEQ ID NO: 6250639 - DNA, 16 bp, Homo sapiens
gatacagaaatgcaaa

SEQ ID NO: 6250640 - DNA, 17 bp, Homo sapiens
gatacagaaatgcaaaa

SEQ ID NO: 6250641 - DNA, 12 bp, Homo sapiens
gatacagaatga

SEQ ID NO: 6250642 - DNA, 15 bp, Homo sapiens
gatacagaatgaatc

SEQ ID NO: 6250643 - DNA, 22 bp, Homo sapiens
gatacagacattcaatgaatta

SEQ ID NO: 6250644 - DNA, 13 bp, Homo sapiens
gatacagagtata

SEQ ID NO: 6250645 - DNA, 15 bp, Homo sapiens
gatacagagtatatt

SEQ ID NO: 6250646 - DNA, 19 bp, Homo sapiens
gatacagatccgcatgtgt

SEQ ID NO: 6250647 - DNA, 16 bp, Homo sapiens
gatacagcagtagaca

SEQ ID NO: 6250648 - DNA, 23 bp, Homo sapiens
gatacagcagtagacattttaac

SEQ ID NO: 6250649 - DNA, 20 bp, Homo sapiens
gatacagccccaaaccaggg

SEQ ID NO: 6250650 - DNA, 16 bp, Homo sapiens
gatacagctcttctca

SEQ ID NO: 6250651 - DNA, 12 bp, Homo sapiens
gatacagctgag

SEQ ID NO: 6250652 - DNA, 13 bp, Homo sapiens
gcccttcctagaa

SEQ ID NO: 6250653 - DNA, 14 bp, Homo sapiens
gcccttcctcaggg

SEQ ID NO: 6250654 - DNA, 12 bp, Homo sapiens
gcccttcctcca

SEQ ID NO: 6250655 - DNA, 15 bp, Homo sapiens
gcccttcctccagga

SEQ ID NO: 6250656 - DNA, 16 bp, Homo sapiens
gcccttcctccaggag

SEQ ID NO: 6250657 - DNA, 19 bp, Homo sapiens
gcccttcctccctgtctct

SEQ ID NO: 6250658 - DNA, 22 bp, Homo sapiens
gcccttcctccctgtctctgca

SEQ ID NO: 6250659 - DNA, 17 bp, Homo sapiens
gcccttcctcctgatgg

SEQ ID NO: 6250660 - DNA, 22 bp, Homo sapiens
gcccttcctcctgatggagtgt

SEQ ID NO: 6250661 - DNA, 16 bp, Homo sapiens
gcccttcctcctgcct

SEQ ID NO: 6250662 - DNA, 21 bp, Homo sapiens
gcccttcctctcactcctgcc

SEQ ID NO: 6250663 - DNA, 22 bp, Homo sapiens
gcccttcctctcactcctgcct

SEQ ID NO: 6250664 - DNA, 24 bp, Homo sapiens
gcccttcctctcactcctgcctcc

SEQ ID NO: 6250665 - DNA, 13 bp, Homo sapiens
gcccttcctctcc

SEQ ID NO: 6250666 - DNA, 14 bp, Homo sapiens
gcccttcctctcca

SEQ ID NO: 6250667 - DNA, 16 bp, Homo sapiens
gcccttcctctccact

SEQ ID NO: 6250668 - DNA, 19 bp, Homo sapiens
gcccttcctctccactgcc

SEQ ID NO: 6250669 - DNA, 20 bp, Homo sapiens
gcccttcctctccactgcct

SEQ ID NO: 6250670 - DNA, 22 bp, Homo sapiens
gcccttcctctccactgccttc

SEQ ID NO: 6250671 - DNA, 14 bp, Homo sapiens
gcccttcctctgct

SEQ ID NO: 6250672 - DNA, 15 bp, Homo sapiens
gcccttcctctttgg

SEQ ID NO: 6250673 - DNA, 14 bp, Homo sapiens
gcccttcctggaca

SEQ ID NO: 6250674 - DNA, 15 bp, Homo sapiens
gcccttcctggacag

SEQ ID NO: 6250675 - DNA, 17 bp, Homo sapiens
gcccttcctggacagct

SEQ ID NO: 6250676 - DNA, 21 bp, Homo sapiens
gcccttcctggacagctgtgc

SEQ ID NO: 6250677 - DNA, 22 bp, Homo sapiens
gcccttcctggactggcccttg

SEQ ID NO: 6250678 - DNA, 13 bp, Homo sapiens
gcccttcctggag

SEQ ID NO: 6250679 - DNA, 11 bp, Homo sapiens
gcccttccttc

SEQ ID NO: 6250680 - DNA, 21 bp, Homo sapiens
gcccttccttcacccaccacc

SEQ ID NO: 6250681 - DNA, 18 bp, Homo sapiens
gcccttccttccattttt

SEQ ID NO: 6250682 - DNA, 14 bp, Homo sapiens
gcccttccttgggc

SEQ ID NO: 6250683 - DNA, 18 bp, Homo sapiens
gcccttccttgggcgtct

SEQ ID NO: 6250684 - DNA, 15 bp, Homo sapiens
gcccttccttgggga

SEQ ID NO: 6250685 - DNA, 21 bp, Homo sapiens
gcccttcggaggaccagggct

SEQ ID NO: 6250686 - DNA, 16 bp, Homo sapiens
gcccttctcccggccc

SEQ ID NO: 6250687 - DNA, 21 bp, Homo sapiens
gcccttctcccggccctcact

SEQ ID NO: 6250688 - DNA, 13 bp, Homo sapiens
gcccttctctcca

SEQ ID NO: 6250689 - DNA, 18 bp, Homo sapiens
gcccttctctccagcccc

SEQ ID NO: 6250690 - DNA, 15 bp, Homo sapiens
gcccttctgactgtt

SEQ ID NO: 6250691 - DNA, 22 bp, Homo sapiens
gcccttctgactgtttatttaa

SEQ ID NO: 6250692 - DNA, 21 bp, Homo sapiens
gcccttctgattcccctccac

SEQ ID NO: 6250693 - DNA, 13 bp, Homo sapiens
gcccttctgccct

SEQ ID NO: 6250694 - DNA, 12 bp, Homo sapiens
gcccttctgcct

SEQ ID NO: 6250695 - DNA, 18 bp, Homo sapiens
gcccttcttccattccca

SEQ ID NO: 6250696 - DNA, 16 bp, Homo sapiens
gcccttcttccccttc

SEQ ID NO: 6250697 - DNA, 16 bp, Homo sapiens
gcccttcttgctgccc

SEQ ID NO: 6250698 - DNA, 23 bp, Homo sapiens
gcccttcttgctgccctgcccca

SEQ ID NO: 6250699 - DNA, 12 bp, Homo sapiens
gcccttctttct

SEQ ID NO: 6250700 - DNA, 16 bp, Homo sapiens
gcccttctttctaccc

SEQ ID NO: 6250701 - DNA, 22 bp, Homo sapiens
gcccttctttgtcccctgggtc

SEQ ID NO: 6250702 - DNA, 22 bp, Homo sapiens
gcccttcttttgaccccttcct

SEQ ID NO: 6250703 - DNA, 16 bp, Homo sapiens
gcccttgaaccccctc

SEQ ID NO: 6250704 - DNA, 16 bp, Homo sapiens
gcccttgactgtacag

SEQ ID NO: 6250705 - DNA, 17 bp, Homo sapiens
gcccttgatttttatct

SEQ ID NO: 6250706 - DNA, 22 bp, Homo sapiens
gcccttgcacagctggagaaat

SEQ ID NO: 6250707 - DNA, 14 bp, Homo sapiens
gcccttgcacaggc

SEQ ID NO: 6250708 - DNA, 15 bp, Homo sapiens
gcccttgcagggtgg

SEQ ID NO: 6250709 - DNA, 19 bp, Homo sapiens
gcccttgcagttcagcacc

SEQ ID NO: 6250710 - DNA, 20 bp, Homo sapiens
gcccttgcagttcagcacca

SEQ ID NO: 6250711 - DNA, 21 bp, Homo sapiens
gcccttgcagttcagcaccac

SEQ ID NO: 6250712 - DNA, 18 bp, Homo sapiens
gcccttgcccaactccca

SEQ ID NO: 6250713 - DNA, 15 bp, Homo sapiens
gcccttgcccatgct

SEQ ID NO: 6250714 - DNA, 14 bp, Homo sapiens
gcccttgccctgac

SEQ ID NO: 6250715 - DNA, 16 bp, Homo sapiens
gcccttgccctgacct

SEQ ID NO: 6250716 - DNA, 21 bp, Homo sapiens
gcccttgccctgacctcccag

SEQ ID NO: 6250717 - DNA, 13 bp, Homo sapiens
gcccttgcctccc

SEQ ID NO: 6250718 - DNA, 14 bp, Homo sapiens
gcccttgcctcccc

SEQ ID NO: 6250719 - DNA, 20 bp, Homo sapiens
gcccttgcctttgtggcctt

SEQ ID NO: 6250720 - DNA, 21 bp, Homo sapiens
gcccttgcctttgtggccttc

SEQ ID NO: 6250721 - DNA, 18 bp, Homo sapiens
gcccttgctctacctggc

SEQ ID NO: 6250722 - DNA, 14 bp, Homo sapiens
gcccttgctgcccg

SEQ ID NO: 6250723 - DNA, 21 bp, Homo sapiens
gcccttgctgggcctgggggt

SEQ ID NO: 6250724 - DNA, 23 bp, Homo sapiens
gcccttgctttcggagctcctgt

SEQ ID NO: 6250725 - DNA, 17 bp, Homo sapiens
gcccttggaacaccctg

SEQ ID NO: 6250726 - DNA, 19 bp, Homo sapiens
gcccttggaacaccctgga

SEQ ID NO: 6250727 - DNA, 22 bp, Homo sapiens
gcccttggaacaccctggatgc

SEQ ID NO: 6250728 - DNA, 17 bp, Homo sapiens
gcccttggagccttcca

SEQ ID NO: 6250729 - DNA, 18 bp, Homo sapiens
gcccttggagccttccac

SEQ ID NO: 6250730 - DNA, 19 bp, Homo sapiens
gcccttggagccttccacc

SEQ ID NO: 6250731 - DNA, 15 bp, Homo sapiens
gcccttggagctgcc

SEQ ID NO: 6250732 - DNA, 19 bp, Homo sapiens
gcccttggcaccaccaggg

SEQ ID NO: 6250733 - DNA, 17 bp, Homo sapiens
gcccttggccccagagg

SEQ ID NO: 6250734 - DNA, 14 bp, Homo sapiens
gcccttggctgcag

SEQ ID NO: 6250735 - DNA, 14 bp, Homo sapiens
gcccttggcttctg

SEQ ID NO: 6250736 - DNA, 12 bp, Homo sapiens
gcccttgggcag

SEQ ID NO: 6250737 - DNA, 14 bp, Homo sapiens
gcccttgggccacc

SEQ ID NO: 6250738 - DNA, 17 bp, Homo sapiens
gcccttgggccacgctc

SEQ ID NO: 6250739 - DNA, 18 bp, Homo sapiens
gcccttggggcctggctt

SEQ ID NO: 6250740 - DNA, 19 bp, Homo sapiens
gcccttggggcctggcttg

SEQ ID NO: 6250741 - DNA, 20 bp, Homo sapiens
gcccttgggggtcctcctcc

SEQ ID NO: 6250742 - DNA, 15 bp, Homo sapiens
gcccttggggtggcg

SEQ ID NO: 6250743 - DNA, 13 bp, Homo sapiens
gcccttggggttc

SEQ ID NO: 6250744 - DNA, 17 bp, Homo sapiens
gcccttggtagagctgg

SEQ ID NO: 6250745 - DNA, 13 bp, Homo sapiens
gcccttggtgcga

SEQ ID NO: 6250746 - DNA, 18 bp, Homo sapiens
gcccttggtttctggggg

SEQ ID NO: 6250747 - DNA, 12 bp, Homo sapiens
gcccttgtccca

SEQ ID NO: 6250748 - DNA, 15 bp, Homo sapiens
gcccttgtcctgcca

SEQ ID NO: 6250749 - DNA, 17 bp, Homo sapiens
gcccttgtcctgccagc

SEQ ID NO: 6250750 - DNA, 21 bp, Homo sapiens
gcccttgtcctgccagctgcc

SEQ ID NO: 6250751 - DNA, 15 bp, Homo sapiens
gcccttgtgctcctc

SEQ ID NO: 6250752 - DNA, 20 bp, Homo sapiens
gcccttgtgtgtgccctggg

SEQ ID NO: 6250753 - DNA, 15 bp, Homo sapiens
gcccttgttgcctgc

SEQ ID NO: 6250754 - DNA, 12 bp, Homo sapiens
gcccttgtttat

SEQ ID NO: 6250755 - DNA, 19 bp, Homo sapiens
gccctttaatatttccaat

SEQ ID NO: 6250756 - DNA, 23 bp, Homo sapiens
gccctttacttgtctttctgggg

SEQ ID NO: 6250757 - DNA, 17 bp, Homo sapiens
gccctttcaaagcactt

SEQ ID NO: 6250758 - DNA, 12 bp, Homo sapiens
gccctttcaccc

SEQ ID NO: 6250759 - DNA, 19 bp, Homo sapiens
gccctttcacccctcttcc

SEQ ID NO: 6250760 - DNA, 22 bp, Homo sapiens
gccctttcacccctcttcccac

SEQ ID NO: 6250761 - DNA, 19 bp, Homo sapiens
gccctttccacgaaatcct

SEQ ID NO: 6250762 - DNA, 13 bp, Homo sapiens
gccctttcccctt

SEQ ID NO: 6250763 - DNA, 22 bp, Homo sapiens
gccctttcctaggcccaggcct

SEQ ID NO: 6250764 - DNA, 13 bp, Homo sapiens
gccctttcctcag

SEQ ID NO: 6250765 - DNA, 14 bp, Homo sapiens
gccctttcctcagg

SEQ ID NO: 6250766 - DNA, 13 bp, Homo sapiens
gccctttcctggc

SEQ ID NO: 6250767 - DNA, 14 bp, Homo sapiens
gccctttcctggca

SEQ ID NO: 6250768 - DNA, 13 bp, Homo sapiens
gccctttccttgc

SEQ ID NO: 6250769 - DNA, 14 bp, Homo sapiens
gccctttcctttgg

SEQ ID NO: 6250770 - DNA, 14 bp, Homo sapiens
gccctttctggacc

SEQ ID NO: 6250771 - DNA, 22 bp, Homo sapiens
gccctttcttgcactgtccagc

SEQ ID NO: 6250772 - DNA, 14 bp, Homo sapiens
gccctttgctctgg

SEQ ID NO: 6250773 - DNA, 13 bp, Homo sapiens
gccctttggagaa

SEQ ID NO: 6250774 - DNA, 14 bp, Homo sapiens
gccctttggccaac

SEQ ID NO: 6250775 - DNA, 14 bp, Homo sapiens
gccctttggcttca

SEQ ID NO: 6250776 - DNA, 14 bp, Homo sapiens
gccctttggcttct

SEQ ID NO: 6250777 - DNA, 17 bp, Homo sapiens
gccctttgggaggctga

SEQ ID NO: 6250778 - DNA, 19 bp, Homo sapiens
gccctttggggttgcccag

SEQ ID NO: 6250779 - DNA, 16 bp, Homo sapiens
gcccttttaaatggca

SEQ ID NO: 6250780 - DNA, 16 bp, Homo sapiens
gcccttttccagcctc

SEQ ID NO: 6250781 - DNA, 21 bp, Homo sapiens
gcccttttctctcacccatcc

SEQ ID NO: 6250782 - DNA, 13 bp, Homo sapiens
gcccttttctggc

SEQ ID NO: 6250783 - DNA, 17 bp, Homo sapiens
gcccttttctggctcct

SEQ ID NO: 6250784 - DNA, 21 bp, Homo sapiens
gcccttttctggctcctgtgt

SEQ ID NO: 6250785 - DNA, 15 bp, Homo sapiens
gccctttttcccttc

SEQ ID NO: 6250786 - DNA, 21 bp, Homo sapiens
gccctttttcccttccctcct

SEQ ID NO: 6250787 - DNA, 13 bp, Homo sapiens
gccgaaactggaa

SEQ ID NO: 6250788 - DNA, 13 bp, Homo sapiens
gccgaacacacat

SEQ ID NO: 6250789 - DNA, 15 bp, Homo sapiens
gccgaaccaaaagaa

SEQ ID NO: 6250790 - DNA, 14 bp, Homo sapiens
gccgaactccaggc

SEQ ID NO: 6250791 - DNA, 17 bp, Homo sapiens
gccgaagccccttggag

SEQ ID NO: 6250792 - DNA, 18 bp, Homo sapiens
gccgaagccccttggaga

SEQ ID NO: 6250793 - DNA, 22 bp, Homo sapiens
gccgaagccccttggagagaga

SEQ ID NO: 6250794 - DNA, 19 bp, Homo sapiens
gccgaagctaacagggaag

SEQ ID NO: 6250795 - DNA, 20 bp, Homo sapiens
gccgaagctgcaggggcagg

SEQ ID NO: 6250796 - DNA, 13 bp, Homo sapiens
gccgaagctgcgg

SEQ ID NO: 6250797 - DNA, 18 bp, Homo sapiens
gccgaagctgctgtgact

SEQ ID NO: 6250798 - DNA, 15 bp, Homo sapiens
gccgaagggcagccc

SEQ ID NO: 6250799 - DNA, 17 bp, Homo sapiens
gccgaagggcagccccg

SEQ ID NO: 6250800 - DNA, 18 bp, Homo sapiens
gccgaaggtgcctcagac

SEQ ID NO: 6250801 - DNA, 14 bp, Homo sapiens
gccgaatcccccag

SEQ ID NO: 6250802 - DNA, 15 bp, Homo sapiens
gccgaatcccccagg

SEQ ID NO: 6250803 - DNA, 17 bp, Homo sapiens
gccgacaccactcctgc

SEQ ID NO: 6250804 - DNA, 18 bp, Homo sapiens
gccgacaccactcctgcc

SEQ ID NO: 6250805 - DNA, 12 bp, Homo sapiens
gccgacactgag

SEQ ID NO: 6250806 - DNA, 24 bp, Homo sapiens
gccgacagtcggtgaccccatcac

SEQ ID NO: 6250807 - DNA, 14 bp, Homo sapiens
gccgacatcagcat

SEQ ID NO: 6250808 - DNA, 15 bp, Homo sapiens
gccgacatccctccc

SEQ ID NO: 6250809 - DNA, 20 bp, Homo sapiens
gccgaccacagggccttgaa

SEQ ID NO: 6250810 - DNA, 19 bp, Homo sapiens
gccgaccagaggagccttt

SEQ ID NO: 6250811 - DNA, 23 bp, Homo sapiens
gccgaccccctctccctgcatgg

SEQ ID NO: 6250812 - DNA, 14 bp, Homo sapiens
gccgaccctcctgg

SEQ ID NO: 6250813 - DNA, 20 bp, Homo sapiens
gccgaccctcctggccttcc

SEQ ID NO: 6250814 - DNA, 18 bp, Homo sapiens
gccgaccgcctgcttcac

SEQ ID NO: 6250815 - DNA, 11 bp, Homo sapiens
gccgacctcag

SEQ ID NO: 6250816 - DNA, 14 bp, Homo sapiens
gccgacctcagcct

SEQ ID NO: 6250817 - DNA, 21 bp, Homo sapiens
gccgacctcgtcctccccctg

SEQ ID NO: 6250818 - DNA, 22 bp, Homo sapiens
gccgaccttccctccgccttct

SEQ ID NO: 6250819 - DNA, 14 bp, Homo sapiens
gccgacggagccac

SEQ ID NO: 6250820 - DNA, 16 bp, Homo sapiens
gccgacggagccactg

SEQ ID NO: 6250821 - DNA, 17 bp, Homo sapiens
gccgacggagccactgg

SEQ ID NO: 6250822 - DNA, 18 bp, Homo sapiens
gccgacgttttctccgca

SEQ ID NO: 6250823 - DNA, 13 bp, Homo sapiens
gccgactcaggga

SEQ ID NO: 6250824 - DNA, 13 bp, Homo sapiens
gccgactcctggg

SEQ ID NO: 6250825 - DNA, 12 bp, Homo sapiens
gccgactctggc

SEQ ID NO: 6250826 - DNA, 18 bp, Homo sapiens
gccgactctggccctggc

SEQ ID NO: 6250827 - DNA, 16 bp, Homo sapiens
gccgactgggctgctg

SEQ ID NO: 6250828 - DNA, 20 bp, Homo sapiens
gccgactgggctgctggggc

SEQ ID NO: 6250829 - DNA, 21 bp, Homo sapiens
gccgactgggctgctggggca

SEQ ID NO: 6250830 - DNA, 18 bp, Homo sapiens
gccgagacaggagcagcc

SEQ ID NO: 6250831 - DNA, 16 bp, Homo sapiens
gccgagaccgcagagg

SEQ ID NO: 6250832 - DNA, 18 bp, Homo sapiens
gccgagaccgcagaggga

SEQ ID NO: 6250833 - DNA, 14 bp, Homo sapiens
gatacagcttggca

SEQ ID NO: 6250834 - DNA, 19 bp, Homo sapiens
gatacaggaaaaatgaaaa

SEQ ID NO: 6250835 - DNA, 18 bp, Homo sapiens
gatacaggaaaagctgct

SEQ ID NO: 6250836 - DNA, 21 bp, Homo sapiens
gatacaggaaaagctgctgac

SEQ ID NO: 6250837 - DNA, 14 bp, Homo sapiens
gatacaggaattat

SEQ ID NO: 6250838 - DNA, 15 bp, Homo sapiens
gatacaggaattatt

SEQ ID NO: 6250839 - DNA, 19 bp, Homo sapiens
gatacaggcccctgggttt

SEQ ID NO: 6250840 - DNA, 19 bp, Homo sapiens
gatacagggagccggcggc

SEQ ID NO: 6250841 - DNA, 17 bp, Homo sapiens
gatacaggtgacagtga

SEQ ID NO: 6250842 - DNA, 18 bp, Homo sapiens
gatacagtccctaaagaa

SEQ ID NO: 6250843 - DNA, 17 bp, Homo sapiens
gatacagtgttttttag

SEQ ID NO: 6250844 - DNA, 12 bp, Homo sapiens
gatacagttttg

SEQ ID NO: 6250845 - DNA, 11 bp, Homo sapiens
gatacataaaa

SEQ ID NO: 6250846 - DNA, 15 bp, Homo sapiens
gatacataataaaaa

SEQ ID NO: 6250847 - DNA, 18 bp, Homo sapiens
gatacatatgagtgtgga

SEQ ID NO: 6250848 - DNA, 17 bp, Homo sapiens
gatacatccaaagcaga

SEQ ID NO: 6250849 - DNA, 16 bp, Homo sapiens
gatacatgctaagaaa

SEQ ID NO: 6250850 - DNA, 22 bp, Homo sapiens
gatacattccctatcaaaacat

SEQ ID NO: 6250851 - DNA, 12 bp, Homo sapiens
gatacatttaat

SEQ ID NO: 6250852 - DNA, 13 bp, Homo sapiens
gatacatttaata

SEQ ID NO: 6250853 - DNA, 16 bp, Homo sapiens
gatacatttaataaaa

SEQ ID NO: 6250854 - DNA, 22 bp, Homo sapiens
gatacatttatcttctgttttt

SEQ ID NO: 6250855 - DNA, 15 bp, Homo sapiens
gatacatttcatctg

SEQ ID NO: 6250856 - DNA, 12 bp, Homo sapiens
gatacatttctg

SEQ ID NO: 6250857 - DNA, 21 bp, Homo sapiens
gatacatttgtatgttgtgaa

SEQ ID NO: 6250858 - DNA, 22 bp, Homo sapiens
gataccacaaaccctgctgaac

SEQ ID NO: 6250859 - DNA, 16 bp, Homo sapiens
gataccaccgacattt

SEQ ID NO: 6250860 - DNA, 21 bp, Homo sapiens
gataccacttttcattgcaaa

SEQ ID NO: 6250861 - DNA, 17 bp, Homo sapiens
gataccaggcccaggag

SEQ ID NO: 6250862 - DNA, 18 bp, Homo sapiens
gataccagttcagacact

SEQ ID NO: 6250863 - DNA, 19 bp, Homo sapiens
gataccattctattctcca

SEQ ID NO: 6250864 - DNA, 23 bp, Homo sapiens
gataccattctattctccagaca

SEQ ID NO: 6250865 - DNA, 17 bp, Homo sapiens
gataccattttgaaata

SEQ ID NO: 6250866 - DNA, 15 bp, Homo sapiens
gatacccagagagaa

SEQ ID NO: 6250867 - DNA, 20 bp, Homo sapiens
gatacccagagagaaaaaga

SEQ ID NO: 6250868 - DNA, 13 bp, Homo sapiens
gatacccatccca

SEQ ID NO: 6250869 - DNA, 16 bp, Homo sapiens
gataccccaaagtcca

SEQ ID NO: 6250870 - DNA, 19 bp, Homo sapiens
gataccccaaagtccaggc

SEQ ID NO: 6250871 - DNA, 20 bp, Homo sapiens
gataccccaaagtccaggct

SEQ ID NO: 6250872 - DNA, 18 bp, Homo sapiens
gatacccggtggcttctg

SEQ ID NO: 6250873 - DNA, 15 bp, Homo sapiens
gataccctctgagac

SEQ ID NO: 6250874 - DNA, 16 bp, Homo sapiens
gataccctctgagaca

SEQ ID NO: 6250875 - DNA, 14 bp, Homo sapiens
gatacctaaaacat

SEQ ID NO: 6250876 - DNA, 19 bp, Homo sapiens
gatacctattaaaggaaaa

SEQ ID NO: 6250877 - DNA, 20 bp, Homo sapiens
gatacctcagccctggccct

SEQ ID NO: 6250878 - DNA, 21 bp, Homo sapiens
gatacctcagccctggccctg

SEQ ID NO: 6250879 - DNA, 23 bp, Homo sapiens
gatacctcagccctggccctgcc

SEQ ID NO: 6250880 - DNA, 19 bp, Homo sapiens
gatacctcatcatccaccc

SEQ ID NO: 6250881 - DNA, 20 bp, Homo sapiens
gatacctcatcatccacccg

SEQ ID NO: 6250882 - DNA, 14 bp, Homo sapiens
gataccttaaaatt

SEQ ID NO: 6250883 - DNA, 23 bp, Homo sapiens
gataccttaattctttgtttcct

SEQ ID NO: 6250884 - DNA, 16 bp, Homo sapiens
gataccttccatctca

SEQ ID NO: 6250885 - DNA, 20 bp, Homo sapiens
gataccttcttatttaatct

SEQ ID NO: 6250886 - DNA, 18 bp, Homo sapiens
gataccttgcaaagcaac

SEQ ID NO: 6250887 - DNA, 14 bp, Homo sapiens
gatacgaatttcta

SEQ ID NO: 6250888 - DNA, 16 bp, Homo sapiens
gatacgacagtacact

SEQ ID NO: 6250889 - DNA, 17 bp, Homo sapiens
gatacgacagtacactg

SEQ ID NO: 6250890 - DNA, 16 bp, Homo sapiens
gatacgatagttacat

SEQ ID NO: 6250891 - DNA, 17 bp, Homo sapiens
gatacgatgactgacac

SEQ ID NO: 6250892 - DNA, 22 bp, Homo sapiens
gatacggatttagctaacaaaa

SEQ ID NO: 6250893 - DNA, 22 bp, Homo sapiens
gatacgggggttccctttcccc

SEQ ID NO: 6250894 - DNA, 23 bp, Homo sapiens
gatacgggggttccctttcccca

SEQ ID NO: 6250895 - DNA, 18 bp, Homo sapiens
gatacggggtcttgctct

SEQ ID NO: 6250896 - DNA, 18 bp, Homo sapiens
gatacgtatatttttaac

SEQ ID NO: 6250897 - DNA, 16 bp, Homo sapiens
gatacgtgtgtgaagt

SEQ ID NO: 6250898 - DNA, 22 bp, Homo sapiens
gatactaaaagttcttctccaa

SEQ ID NO: 6250899 - DNA, 19 bp, Homo sapiens
gatactaaatctggggttc

SEQ ID NO: 6250900 - DNA, 13 bp, Homo sapiens
gatactaaggacg

SEQ ID NO: 6250901 - DNA, 19 bp, Homo sapiens
gatactaatagagtactta

SEQ ID NO: 6250902 - DNA, 21 bp, Homo sapiens
gatactacaacttttgttttc

SEQ ID NO: 6250903 - DNA, 24 bp, Homo sapiens
gatactactagatcacttgtcctc

SEQ ID NO: 6250904 - DNA, 16 bp, Homo sapiens
gatactactgaccaga

SEQ ID NO: 6250905 - DNA, 14 bp, Homo sapiens
gatactactttctc

SEQ ID NO: 6250906 - DNA, 23 bp, Homo sapiens
gatactattaaagtaacatttaa

SEQ ID NO: 6250907 - DNA, 18 bp, Homo sapiens
gatactattcaatgcaat

SEQ ID NO: 6250908 - DNA, 16 bp, Homo sapiens
gatactcaaagtggaa

SEQ ID NO: 6250909 - DNA, 14 bp, Homo sapiens
gatactcatttctt

SEQ ID NO: 6250910 - DNA, 19 bp, Homo sapiens
gatactccatggggtgggg

SEQ ID NO: 6250911 - DNA, 12 bp, Homo sapiens
gatactctcttc

SEQ ID NO: 6250912 - DNA, 20 bp, Homo sapiens
gatactctttctaatgctga

SEQ ID NO: 6250913 - DNA, 20 bp, Homo sapiens
gatactgaatgcataaataa

SEQ ID NO: 6250914 - DNA, 17 bp, Homo sapiens
gatactgcaactttaaa

SEQ ID NO: 6250915 - DNA, 20 bp, Homo sapiens
gatactgcatgtttgctgtt

SEQ ID NO: 6250916 - DNA, 18 bp, Homo sapiens
gatactgcgactttctgc

SEQ ID NO: 6250917 - DNA, 12 bp, Homo sapiens
gatactgctgct

SEQ ID NO: 6250918 - DNA, 14 bp, Homo sapiens
gatactgctgcttg

SEQ ID NO: 6250919 - DNA, 20 bp, Homo sapiens
gatactgcttattttatgat

SEQ ID NO: 6250920 - DNA, 20 bp, Homo sapiens
gatactggcaaagcagaaaa

SEQ ID NO: 6250921 - DNA, 13 bp, Homo sapiens
gatactggcacag

SEQ ID NO: 6250922 - DNA, 13 bp, Homo sapiens
gatactgggtaca

SEQ ID NO: 6250923 - DNA, 21 bp, Homo sapiens
gatactggtcccacttcacag

SEQ ID NO: 6250924 - DNA, 16 bp, Homo sapiens
gatactgtaacacttt

SEQ ID NO: 6250925 - DNA, 22 bp, Homo sapiens
gatactgtatctgggctgattt

SEQ ID NO: 6250926 - DNA, 12 bp, Homo sapiens
gatactgttgca

SEQ ID NO: 6250927 - DNA, 17 bp, Homo sapiens
gatactgttgcacgtgt

SEQ ID NO: 6250928 - DNA, 23 bp, Homo sapiens
gatactgtttcttgcactgaata

SEQ ID NO: 6250929 - DNA, 22 bp, Homo sapiens
gatacttaacaaatacattcaa

SEQ ID NO: 6250930 - DNA, 20 bp, Homo sapiens
gatacttaagtgctgcaatt

SEQ ID NO: 6250931 - DNA, 16 bp, Homo sapiens
gatacttacatttcca

SEQ ID NO: 6250932 - DNA, 22 bp, Homo sapiens
gatacttagaccaaaagcaaca

SEQ ID NO: 6250933 - DNA, 19 bp, Homo sapiens
gatacttagtggtatgtct

SEQ ID NO: 6250934 - DNA, 20 bp, Homo sapiens
gatacttagtggtatgtctc

SEQ ID NO: 6250935 - DNA, 16 bp, Homo sapiens
gatacttatttttctg

SEQ ID NO: 6250936 - DNA, 17 bp, Homo sapiens
gatacttcagctttgtg

SEQ ID NO: 6250937 - DNA, 14 bp, Homo sapiens
gatacttcctgggt

SEQ ID NO: 6250938 - DNA, 19 bp, Homo sapiens
gatacttcgacactgttct

SEQ ID NO: 6250939 - DNA, 22 bp, Homo sapiens
gatacttctgaaataaatgttc

SEQ ID NO: 6250940 - DNA, 19 bp, Homo sapiens
gatacttgaaaccagtatt

SEQ ID NO: 6250941 - DNA, 16 bp, Homo sapiens
gatacttgaataacca

SEQ ID NO: 6250942 - DNA, 16 bp, Homo sapiens
gatacttgatgcactt

SEQ ID NO: 6250943 - DNA, 17 bp, Homo sapiens
gatacttgatgcactta

SEQ ID NO: 6250944 - DNA, 20 bp, Homo sapiens
gatacttggatttagtttca

SEQ ID NO: 6250945 - DNA, 13 bp, Homo sapiens
gatacttgtaact

SEQ ID NO: 6250946 - DNA, 14 bp, Homo sapiens
gatacttgtaactt

SEQ ID NO: 6250947 - DNA, 16 bp, Homo sapiens
gatacttgtaactttt

SEQ ID NO: 6250948 - DNA, 17 bp, Homo sapiens
gatactttaatttttat

SEQ ID NO: 6250949 - DNA, 22 bp, Homo sapiens
gatactttaatttttataaata

SEQ ID NO: 6250950 - DNA, 14 bp, Homo sapiens
gatagaaaaaaact

SEQ ID NO: 6250951 - DNA, 13 bp, Homo sapiens
gatagaaaaagga

SEQ ID NO: 6250952 - DNA, 14 bp, Homo sapiens
gatagaaaaaggat

SEQ ID NO: 6250953 - DNA, 16 bp, Homo sapiens
gatagaaaaaggatgg

SEQ ID NO: 6250954 - DNA, 21 bp, Homo sapiens
gatagaaaacagcccccactc

SEQ ID NO: 6250955 - DNA, 19 bp, Homo sapiens
gatagaaaatccttcagct

SEQ ID NO: 6250956 - DNA, 19 bp, Homo sapiens
gatagaaagaataaaatgt

SEQ ID NO: 6250957 - DNA, 11 bp, Homo sapiens
gatagaaagct

SEQ ID NO: 6250958 - DNA, 17 bp, Homo sapiens
gatagaaagctggactg

SEQ ID NO: 6250959 - DNA, 16 bp, Homo sapiens
gatagaaataaatagc

SEQ ID NO: 6250960 - DNA, 22 bp, Homo sapiens
gatagaactgtactgttttctg

SEQ ID NO: 6250961 - DNA, 23 bp, Homo sapiens
gatagaactttgccagtctttaa

SEQ ID NO: 6250962 - DNA, 17 bp, Homo sapiens
gatagaagaaaaaagaa

SEQ ID NO: 6250963 - DNA, 12 bp, Homo sapiens
gatagaatgaca

SEQ ID NO: 6250964 - DNA, 23 bp, Homo sapiens
gatagaatgatgttttaaaaaaa

SEQ ID NO: 6250965 - DNA, 18 bp, Homo sapiens
gatagaatttggcccaga

SEQ ID NO: 6250966 - DNA, 14 bp, Homo sapiens
gatagacactggac

SEQ ID NO: 6250967 - DNA, 23 bp, Homo sapiens
gatagacctgtgacctggtctgg

SEQ ID NO: 6250968 - DNA, 19 bp, Homo sapiens
gatagacgggttgaaagac

SEQ ID NO: 6250969 - DNA, 24 bp, Homo sapiens
gatagacgggttgaaagacatcaa

SEQ ID NO: 6250970 - DNA, 18 bp, Homo sapiens
gatagacttcgaaaacag

SEQ ID NO: 6250971 - DNA, 15 bp, Homo sapiens
gatagaggaagcctg

SEQ ID NO: 6250972 - DNA, 20 bp, Homo sapiens
gatagaggggctgcagggcc

SEQ ID NO: 6250973 - DNA, 15 bp, Homo sapiens
gatagagtgattttg

SEQ ID NO: 6250974 - DNA, 14 bp, Homo sapiens
gatagataactctt

SEQ ID NO: 6250975 - DNA, 15 bp, Homo sapiens
gatagataactcttt

SEQ ID NO: 6250976 - DNA, 18 bp, Homo sapiens
gatagataactctttgga

SEQ ID NO: 6250977 - DNA, 13 bp, Homo sapiens
gatagataagtat

SEQ ID NO: 6250978 - DNA, 21 bp, Homo sapiens
gatagatgcacttatgcagta

SEQ ID NO: 6250979 - DNA, 12 bp, Homo sapiens
gatagatgctgg

SEQ ID NO: 6250980 - DNA, 16 bp, Homo sapiens
gatagatgctggccca

SEQ ID NO: 6250981 - DNA, 18 bp, Homo sapiens
gatagatgctggcccagg

SEQ ID NO: 6250982 - DNA, 22 bp, Homo sapiens
gatagatgtcgtggactccagc

SEQ ID NO: 6250983 - DNA, 14 bp, Homo sapiens
gatagatgtgtgga

SEQ ID NO: 6250984 - DNA, 16 bp, Homo sapiens
gatagatgttgctctt

SEQ ID NO: 6250985 - DNA, 13 bp, Homo sapiens
gatagatgtttgg

SEQ ID NO: 6250986 - DNA, 21 bp, Homo sapiens
gatagattgtatctcttaaag

SEQ ID NO: 6250987 - DNA, 22 bp, Homo sapiens
gatagattttctgctactttgc

SEQ ID NO: 6250988 - DNA, 15 bp, Homo sapiens
gatagcaaactccag

SEQ ID NO: 6250989 - DNA, 19 bp, Homo sapiens
gatagcacagaccctgccc

SEQ ID NO: 6250990 - DNA, 20 bp, Homo sapiens
gatagcacagaccctgccct

SEQ ID NO: 6250991 - DNA, 19 bp, Homo sapiens
gatagcagaggaaaaagaa

SEQ ID NO: 6250992 - DNA, 22 bp, Homo sapiens
gatagcatatattcatacctgt

SEQ ID NO: 6250993 - DNA, 20 bp, Homo sapiens
gatagcatggggcccctggc

SEQ ID NO: 6250994 - DNA, 17 bp, Homo sapiens
gatagcatttttgattt

SEQ ID NO: 6250995 - DNA, 14 bp, Homo sapiens
gatagccaaggcca

SEQ ID NO: 6250996 - DNA, 22 bp, Homo sapiens
gatagccaaggccaaaggaagc

SEQ ID NO: 6250997 - DNA, 20 bp, Homo sapiens
gatagcccagaacaaaaaga

SEQ ID NO: 6250998 - DNA, 17 bp, Homo sapiens
gatagcccaggagcaac

SEQ ID NO: 6250999 - DNA, 16 bp, Homo sapiens
gatagccctgtcctgg

SEQ ID NO: 6251000 - DNA, 19 bp, Homo sapiens
gatagccgggctccaggga

SEQ ID NO: 6251001 - DNA, 21 bp, Homo sapiens
gatagccgggctccagggagt

SEQ ID NO: 6251002 - DNA, 14 bp, Homo sapiens
gatagcctcagcca

SEQ ID NO: 6251003 - DNA, 15 bp, Homo sapiens
gatagcctcagccac

SEQ ID NO: 6251004 - DNA, 16 bp, Homo sapiens
gatagcctgtggccct

SEQ ID NO: 6251005 - DNA, 18 bp, Homo sapiens
gatagccttgaaaacaaa

SEQ ID NO: 6251006 - DNA, 13 bp, Homo sapiens
gatagcctttgta

SEQ ID NO: 6251007 - DNA, 17 bp, Homo sapiens
gatagcgggaaaaggag

SEQ ID NO: 6251008 - DNA, 15 bp, Homo sapiens
gatagcgttggaatt

SEQ ID NO: 6251009 - DNA, 22 bp, Homo sapiens
gatagcgttggaattaaaacaa

SEQ ID NO: 6251010 - DNA, 18 bp, Homo sapiens
gatagctaaataacttgc

SEQ ID NO: 6251011 - DNA, 15 bp, Homo sapiens
gccgagagcctgctc

SEQ ID NO: 6251012 - DNA, 19 bp, Homo sapiens
gccgagagcctgctccccc

SEQ ID NO: 6251013 - DNA, 12 bp, Homo sapiens
gccgagagcctt

SEQ ID NO: 6251014 - DNA, 16 bp, Homo sapiens
gccgagatagccaagg

SEQ ID NO: 6251015 - DNA, 17 bp, Homo sapiens
gccgagatagccaaggc

SEQ ID NO: 6251016 - DNA, 20 bp, Homo sapiens
gccgagatcacgccactgca

SEQ ID NO: 6251017 - DNA, 21 bp, Homo sapiens
gccgagatcacgccactgcac

SEQ ID NO: 6251018 - DNA, 18 bp, Homo sapiens
gccgagattgcgccactg

SEQ ID NO: 6251019 - DNA, 15 bp, Homo sapiens
gccgagcccacacca

SEQ ID NO: 6251020 - DNA, 19 bp, Homo sapiens
gccgagccgggcctggggc

SEQ ID NO: 6251021 - DNA, 20 bp, Homo sapiens
gccgagccgggcctggggct

SEQ ID NO: 6251022 - DNA, 17 bp, Homo sapiens
gccgagcggtggccccg

SEQ ID NO: 6251023 - DNA, 20 bp, Homo sapiens
gccgagcgttcccagcaggg

SEQ ID NO: 6251024 - DNA, 14 bp, Homo sapiens
gccgagctcctggg

SEQ ID NO: 6251025 - DNA, 19 bp, Homo sapiens
gccgagctcctggggagct

SEQ ID NO: 6251026 - DNA, 22 bp, Homo sapiens
gccgagctcctggggagctcct

SEQ ID NO: 6251027 - DNA, 17 bp, Homo sapiens
gccgagctctcctgggc

SEQ ID NO: 6251028 - DNA, 15 bp, Homo sapiens
gccgagctgcctggc

SEQ ID NO: 6251029 - DNA, 19 bp, Homo sapiens
gccgagctggtttcctgcc

SEQ ID NO: 6251030 - DNA, 19 bp, Homo sapiens
gccgaggaatgtgaagcca

SEQ ID NO: 6251031 - DNA, 20 bp, Homo sapiens
gccgaggaccaccagcaggc

SEQ ID NO: 6251032 - DNA, 12 bp, Homo sapiens
gccgaggaccct

SEQ ID NO: 6251033 - DNA, 15 bp, Homo sapiens
gccgaggactttgat

SEQ ID NO: 6251034 - DNA, 16 bp, Homo sapiens
gccgaggagccaggca

SEQ ID NO: 6251035 - DNA, 18 bp, Homo sapiens
gccgaggagccaggcaac

SEQ ID NO: 6251036 - DNA, 18 bp, Homo sapiens
gccgaggagttgtcgttt

SEQ ID NO: 6251037 - DNA, 12 bp, Homo sapiens
gccgaggcaggg

SEQ ID NO: 6251038 - DNA, 17 bp, Homo sapiens
gccgaggcccagcgggc

SEQ ID NO: 6251039 - DNA, 14 bp, Homo sapiens
gccgaggcctggcc

SEQ ID NO: 6251040 - DNA, 23 bp, Homo sapiens
gccgaggcctggccaatgcggcc

SEQ ID NO: 6251041 - DNA, 18 bp, Homo sapiens
gccgaggcttgggctccc

SEQ ID NO: 6251042 - DNA, 13 bp, Homo sapiens
gccgagggaaatg

SEQ ID NO: 6251043 - DNA, 14 bp, Homo sapiens
gccgagggcgtcag

SEQ ID NO: 6251044 - DNA, 12 bp, Homo sapiens
gccgagggctgg

SEQ ID NO: 6251045 - DNA, 17 bp, Homo sapiens
gccgagggctggccggg

SEQ ID NO: 6251046 - DNA, 13 bp, Homo sapiens
gccgaggggagag

SEQ ID NO: 6251047 - DNA, 20 bp, Homo sapiens
gccgaggggagagagggact

SEQ ID NO: 6251048 - DNA, 15 bp, Homo sapiens
gccgaggtgggcaga

SEQ ID NO: 6251049 - DNA, 16 bp, Homo sapiens
gccgagtcacacccgg

SEQ ID NO: 6251050 - DNA, 14 bp, Homo sapiens
gccgagtccaagct

SEQ ID NO: 6251051 - DNA, 12 bp, Homo sapiens
gccgagtccagg

SEQ ID NO: 6251052 - DNA, 21 bp, Homo sapiens
gccgagtccgggccggggcct

SEQ ID NO: 6251053 - DNA, 14 bp, Homo sapiens
gccgagtctgtcct

SEQ ID NO: 6251054 - DNA, 14 bp, Homo sapiens
gccgagtgccccag

SEQ ID NO: 6251055 - DNA, 15 bp, Homo sapiens
gccgagtgccccaga

SEQ ID NO: 6251056 - DNA, 14 bp, Homo sapiens
gccgagtgctctga

SEQ ID NO: 6251057 - DNA, 21 bp, Homo sapiens
gccgagtggatagatgccctg

SEQ ID NO: 6251058 - DNA, 23 bp, Homo sapiens
gccgagtttgggccactgcactc

SEQ ID NO: 6251059 - DNA, 22 bp, Homo sapiens
gccgatagagggacggccaaga

SEQ ID NO: 6251060 - DNA, 17 bp, Homo sapiens
gccgatataagccatag

SEQ ID NO: 6251061 - DNA, 24 bp, Homo sapiens
gccgatctggtctcgtgttcgctg

SEQ ID NO: 6251062 - DNA, 12 bp, Homo sapiens
gccgatgccacc

SEQ ID NO: 6251063 - DNA, 13 bp, Homo sapiens
gccgatgccaccg

SEQ ID NO: 6251064 - DNA, 14 bp, Homo sapiens
gccgatgcccagag

SEQ ID NO: 6251065 - DNA, 13 bp, Homo sapiens
gccgatggagaca

SEQ ID NO: 6251066 - DNA, 18 bp, Homo sapiens
gccgatgggagtctccct

SEQ ID NO: 6251067 - DNA, 17 bp, Homo sapiens
gccgattcacctgagca

SEQ ID NO: 6251068 - DNA, 19 bp, Homo sapiens
gccgattcctccagccctg

SEQ ID NO: 6251069 - DNA, 14 bp, Homo sapiens
gccgattctctgcc

SEQ ID NO: 6251070 - DNA, 17 bp, Homo sapiens
gccgatttctgtaaact

SEQ ID NO: 6251071 - DNA, 14 bp, Homo sapiens
gccgcaagcgcagg

SEQ ID NO: 6251072 - DNA, 17 bp, Homo sapiens
gccgcaagctctcagca

SEQ ID NO: 6251073 - DNA, 14 bp, Homo sapiens
gccgcaaggccctg

SEQ ID NO: 6251074 - DNA, 20 bp, Homo sapiens
gccgcaaggccctgtcccag

SEQ ID NO: 6251075 - DNA, 17 bp, Homo sapiens
gccgcaagtctgcagcc

SEQ ID NO: 6251076 - DNA, 16 bp, Homo sapiens
gccgcaatctggctcc

SEQ ID NO: 6251077 - DNA, 13 bp, Homo sapiens
gccgcacatctgg

SEQ ID NO: 6251078 - DNA, 16 bp, Homo sapiens
gccgcaccaccagcca

SEQ ID NO: 6251079 - DNA, 19 bp, Homo sapiens
gccgcaccattgaactgta

SEQ ID NO: 6251080 - DNA, 16 bp, Homo sapiens
gccgcaccccagagtg

SEQ ID NO: 6251081 - DNA, 18 bp, Homo sapiens
gccgcaccctgcacctgc

SEQ ID NO: 6251082 - DNA, 20 bp, Homo sapiens
gccgcaccctgcacctgctg

SEQ ID NO: 6251083 - DNA, 14 bp, Homo sapiens
gccgcaccctggct

SEQ ID NO: 6251084 - DNA, 15 bp, Homo sapiens
gccgcaccctggctg

SEQ ID NO: 6251085 - DNA, 15 bp, Homo sapiens
gccgcacgcctctcc

SEQ ID NO: 6251086 - DNA, 12 bp, Homo sapiens
gccgcactctgg

SEQ ID NO: 6251087 - DNA, 13 bp, Homo sapiens
gccgcactctggc

SEQ ID NO: 6251088 - DNA, 12 bp, Homo sapiens
gccgcactggga

SEQ ID NO: 6251089 - DNA, 14 bp, Homo sapiens
gccgcactgggagc

SEQ ID NO: 6251090 - DNA, 16 bp, Homo sapiens
gccgcactgggagcag

SEQ ID NO: 6251091 - DNA, 14 bp, Homo sapiens
gccgcagaagcagc

SEQ ID NO: 6251092 - DNA, 16 bp, Homo sapiens
gccgcagaagcagccc

SEQ ID NO: 6251093 - DNA, 18 bp, Homo sapiens
gccgcagaagcagcccct

SEQ ID NO: 6251094 - DNA, 22 bp, Homo sapiens
gccgcagaaggggaatgtgtcc

SEQ ID NO: 6251095 - DNA, 17 bp, Homo sapiens
gccgcagacctggagct

SEQ ID NO: 6251096 - DNA, 21 bp, Homo sapiens
gccgcagacctggagcttcag

SEQ ID NO: 6251097 - DNA, 15 bp, Homo sapiens
gccgcagacgggcac

SEQ ID NO: 6251098 - DNA, 20 bp, Homo sapiens
gccgcagacgggcacagaca

SEQ ID NO: 6251099 - DNA, 13 bp, Homo sapiens
gccgcagagactg

SEQ ID NO: 6251100 - DNA, 12 bp, Homo sapiens
gccgcagagcct

SEQ ID NO: 6251101 - DNA, 23 bp, Homo sapiens
gccgcagagcctgacgctcagcc

SEQ ID NO: 6251102 - DNA, 12 bp, Homo sapiens
gccgcagaggcc

SEQ ID NO: 6251103 - DNA, 14 bp, Homo sapiens
gccgcagaggcccg

SEQ ID NO: 6251104 - DNA, 19 bp, Homo sapiens
gccgcagaggcccgaggca

SEQ ID NO: 6251105 - DNA, 13 bp, Homo sapiens
gccgcagccccca

SEQ ID NO: 6251106 - DNA, 20 bp, Homo sapiens
gccgcagcccccactgacct

SEQ ID NO: 6251107 - DNA, 13 bp, Homo sapiens
gccgcagccctgc

SEQ ID NO: 6251108 - DNA, 15 bp, Homo sapiens
gccgcagccctgcag

SEQ ID NO: 6251109 - DNA, 16 bp, Homo sapiens
gccgcagccctgcaga

SEQ ID NO: 6251110 - DNA, 19 bp, Homo sapiens
gccgcagccctgcagaggg

SEQ ID NO: 6251111 - DNA, 17 bp, Homo sapiens
gccgcagcctccctctg

SEQ ID NO: 6251112 - DNA, 13 bp, Homo sapiens
gccgcagcggtgg

SEQ ID NO: 6251113 - DNA, 13 bp, Homo sapiens
gccgcagctcttg

SEQ ID NO: 6251114 - DNA, 23 bp, Homo sapiens
gccgcaggagggaggcggggagg

SEQ ID NO: 6251115 - DNA, 12 bp, Homo sapiens
gccgcagggccc

SEQ ID NO: 6251116 - DNA, 13 bp, Homo sapiens
gccgcagggccca

SEQ ID NO: 6251117 - DNA, 15 bp, Homo sapiens
gccgcagggcccacc

SEQ ID NO: 6251118 - DNA, 16 bp, Homo sapiens
gccgcagggcccacct

SEQ ID NO: 6251119 - DNA, 13 bp, Homo sapiens
gccgcagggcgct

SEQ ID NO: 6251120 - DNA, 19 bp, Homo sapiens
gccgcaggggcccctcctc

SEQ ID NO: 6251121 - DNA, 21 bp, Homo sapiens
gccgcagtccaggggtcagca

SEQ ID NO: 6251122 - DNA, 24 bp, Homo sapiens
gccgcagtggggtcaagctgagct

SEQ ID NO: 6251123 - DNA, 15 bp, Homo sapiens
gccgcataggcccag

SEQ ID NO: 6251124 - DNA, 18 bp, Homo sapiens
gccgcatctgcctggagc

SEQ ID NO: 6251125 - DNA, 15 bp, Homo sapiens
gccgcatcttctcca

SEQ ID NO: 6251126 - DNA, 20 bp, Homo sapiens
gccgcatcttctccatctgg

SEQ ID NO: 6251127 - DNA, 15 bp, Homo sapiens
gccgcatggcccctc

SEQ ID NO: 6251128 - DNA, 17 bp, Homo sapiens
gccgcatggcccctcca

SEQ ID NO: 6251129 - DNA, 14 bp, Homo sapiens
gccgcatgtctgca

SEQ ID NO: 6251130 - DNA, 15 bp, Homo sapiens
gccgcattccctgag

SEQ ID NO: 6251131 - DNA, 18 bp, Homo sapiens
gccgcattccctgagtca

SEQ ID NO: 6251132 - DNA, 15 bp, Homo sapiens
gccgccaccagcccg

SEQ ID NO: 6251133 - DNA, 17 bp, Homo sapiens
gccgccaccagcccgca

SEQ ID NO: 6251134 - DNA, 12 bp, Homo sapiens
gccgccaccccc

SEQ ID NO: 6251135 - DNA, 16 bp, Homo sapiens
gccgccacccccatct

SEQ ID NO: 6251136 - DNA, 20 bp, Homo sapiens
gccgccacccccatcttcca

SEQ ID NO: 6251137 - DNA, 16 bp, Homo sapiens
gccgccaccctcccct

SEQ ID NO: 6251138 - DNA, 16 bp, Homo sapiens
gccgccacggcctggc

SEQ ID NO: 6251139 - DNA, 22 bp, Homo sapiens
gccgccactaggtgtccccaac

SEQ ID NO: 6251140 - DNA, 15 bp, Homo sapiens
gccgccactggctgt

SEQ ID NO: 6251141 - DNA, 20 bp, Homo sapiens
gccgccagcgtgtggagcag

SEQ ID NO: 6251142 - DNA, 21 bp, Homo sapiens
gccgccagcgtgtggagcaga

SEQ ID NO: 6251143 - DNA, 17 bp, Homo sapiens
gccgccagttcatcttt

SEQ ID NO: 6251144 - DNA, 16 bp, Homo sapiens
gccgccatccgggacg

SEQ ID NO: 6251145 - DNA, 16 bp, Homo sapiens
gccgccatctgcgcag

SEQ ID NO: 6251146 - DNA, 23 bp, Homo sapiens
gccgccattctgcagagtatttg

SEQ ID NO: 6251147 - DNA, 18 bp, Homo sapiens
gccgccattgccaccagg

SEQ ID NO: 6251148 - DNA, 13 bp, Homo sapiens
gccgcccaaggcc

SEQ ID NO: 6251149 - DNA, 19 bp, Homo sapiens
gccgcccaccgtcttgggt

SEQ ID NO: 6251150 - DNA, 22 bp, Homo sapiens
gccgcccacctcgctcccctct

SEQ ID NO: 6251151 - DNA, 20 bp, Homo sapiens
gccgcccacgccggcctctg

SEQ ID NO: 6251152 - DNA, 20 bp, Homo sapiens
gccgcccagatcatgccgcc

SEQ ID NO: 6251153 - DNA, 14 bp, Homo sapiens
gccgccccacccag

SEQ ID NO: 6251154 - DNA, 15 bp, Homo sapiens
gccgccccagcccct

SEQ ID NO: 6251155 - DNA, 13 bp, Homo sapiens
gccgcccccacct

SEQ ID NO: 6251156 - DNA, 21 bp, Homo sapiens
gccgcccccgcctgggcaccg

SEQ ID NO: 6251157 - DNA, 17 bp, Homo sapiens
gccgccccctgcccccc

SEQ ID NO: 6251158 - DNA, 21 bp, Homo sapiens
gccgccccgccccagagctcc

SEQ ID NO: 6251159 - DNA, 14 bp, Homo sapiens
gccgcccgcccctc

SEQ ID NO: 6251160 - DNA, 13 bp, Homo sapiens
gccgcccgctccc

SEQ ID NO: 6251161 - DNA, 14 bp, Homo sapiens
gccgcccggcagtg

SEQ ID NO: 6251162 - DNA, 15 bp, Homo sapiens
gccgcccgggcccag

SEQ ID NO: 6251163 - DNA, 12 bp, Homo sapiens
gccgccctgggc

SEQ ID NO: 6251164 - DNA, 13 bp, Homo sapiens
gccgccctgggct

SEQ ID NO: 6251165 - DNA, 24 bp, Homo sapiens
gccgccctgggctgtctgtcacca

SEQ ID NO: 6251166 - DNA, 11 bp, Homo sapiens
gccgccctgta

SEQ ID NO: 6251167 - DNA, 13 bp, Homo sapiens
gccgccctgtggg

SEQ ID NO: 6251168 - DNA, 16 bp, Homo sapiens
gccgcccttcctggag

SEQ ID NO: 6251169 - DNA, 17 bp, Homo sapiens
gccgccgacctgtgact

SEQ ID NO: 6251170 - DNA, 15 bp, Homo sapiens
gccgccgccaggact

SEQ ID NO: 6251171 - DNA, 13 bp, Homo sapiens
gccgccgcctctt

SEQ ID NO: 6251172 - DNA, 13 bp, Homo sapiens
gccgccgcgcgcc

SEQ ID NO: 6251173 - DNA, 15 bp, Homo sapiens
gccgccgcgcgcccc

SEQ ID NO: 6251174 - DNA, 16 bp, Homo sapiens
gccgccgcgggtgtgc

SEQ ID NO: 6251175 - DNA, 20 bp, Homo sapiens
gccgccgctaggtagagtct

SEQ ID NO: 6251176 - DNA, 14 bp, Homo sapiens
gccgccgctgccct

SEQ ID NO: 6251177 - DNA, 22 bp, Homo sapiens
gccgccggcaataaaagcccag

SEQ ID NO: 6251178 - DNA, 23 bp, Homo sapiens
gccgccggcaataaaagcccagg

SEQ ID NO: 6251179 - DNA, 16 bp, Homo sapiens
gccgccgggcaggcct

SEQ ID NO: 6251180 - DNA, 14 bp, Homo sapiens
gccgccgtgaccta

SEQ ID NO: 6251181 - DNA, 21 bp, Homo sapiens
gccgccgtggtgacccctgct

SEQ ID NO: 6251182 - DNA, 16 bp, Homo sapiens
gccgcctcaccccctc

SEQ ID NO: 6251183 - DNA, 14 bp, Homo sapiens
gccgcctcccagcc

SEQ ID NO: 6251184 - DNA, 19 bp, Homo sapiens
gccgcctcccagcctgggg

SEQ ID NO: 6251185 - DNA, 22 bp, Homo sapiens
gccgcctccgggacccccagga

SEQ ID NO: 6251186 - DNA, 23 bp, Homo sapiens
gccgcctccgggacccccaggac

SEQ ID NO: 6251187 - DNA, 15 bp, Homo sapiens
gccgcctcctccaga

SEQ ID NO: 6251188 - DNA, 17 bp, Homo sapiens
gccgcctcctccagact

SEQ ID NO: 6251189 - DNA, 13 bp, Homo sapiens
gccgcctcgccca

SEQ ID NO: 6251190 - DNA, 15 bp, Homo sapiens
gccgcctcgcccacc

SEQ ID NO: 6251191 - DNA, 17 bp, Homo sapiens
gccgcctcgcccaccgc

SEQ ID NO: 6251192 - DNA, 13 bp, Homo sapiens
gccgcctcgcccc

SEQ ID NO: 6251193 - DNA, 20 bp, Homo sapiens
gccgcctcgggccgcctcct

SEQ ID NO: 6251194 - DNA, 20 bp, Homo sapiens
gatagctacccacagagcaa

SEQ ID NO: 6251195 - DNA, 17 bp, Homo sapiens
gatagctactgtagaaa

SEQ ID NO: 6251196 - DNA, 20 bp, Homo sapiens
gatagctactgtagaaagga

SEQ ID NO: 6251197 - DNA, 21 bp, Homo sapiens
gatagctcaatactctctgag

SEQ ID NO: 6251198 - DNA, 13 bp, Homo sapiens
gatagctccttca

SEQ ID NO: 6251199 - DNA, 16 bp, Homo sapiens
gatagctggggcttca

SEQ ID NO: 6251200 - DNA, 18 bp, Homo sapiens
gatagcttagtgtctcgt

SEQ ID NO: 6251201 - DNA, 20 bp, Homo sapiens
gatagcttccccaccagctt

SEQ ID NO: 6251202 - DNA, 22 bp, Homo sapiens
gatagcttctcttctttctgaa

SEQ ID NO: 6251203 - DNA, 22 bp, Homo sapiens
gatagctttctttcccttactc

SEQ ID NO: 6251204 - DNA, 14 bp, Homo sapiens
gataggaaaactga

SEQ ID NO: 6251205 - DNA, 13 bp, Homo sapiens
gataggaaactga

SEQ ID NO: 6251206 - DNA, 16 bp, Homo sapiens
gataggaactgggcct

SEQ ID NO: 6251207 - DNA, 22 bp, Homo sapiens
gataggaaggtcatttccatgt

SEQ ID NO: 6251208 - DNA, 23 bp, Homo sapiens
gataggaaggtcatttccatgta

SEQ ID NO: 6251209 - DNA, 18 bp, Homo sapiens
gataggaccttgggccaa

SEQ ID NO: 6251210 - DNA, 17 bp, Homo sapiens
gataggagcctgctggt

SEQ ID NO: 6251211 - DNA, 16 bp, Homo sapiens
gataggagcttccaga

SEQ ID NO: 6251212 - DNA, 17 bp, Homo sapiens
gataggagggggcggca

SEQ ID NO: 6251213 - DNA, 22 bp, Homo sapiens
gataggagggtgcccctgggaa

SEQ ID NO: 6251214 - DNA, 22 bp, Homo sapiens
gataggcaaggatgaaagacaa

SEQ ID NO: 6251215 - DNA, 19 bp, Homo sapiens
gataggcaggaacatacag

SEQ ID NO: 6251216 - DNA, 21 bp, Homo sapiens
gataggcccaaggtcccctcc

SEQ ID NO: 6251217 - DNA, 16 bp, Homo sapiens
gataggccttcttgtg

SEQ ID NO: 6251218 - DNA, 11 bp, Homo sapiens
gataggctaat

SEQ ID NO: 6251219 - DNA, 23 bp, Homo sapiens
gatagggaagagagaaacattta

SEQ ID NO: 6251220 - DNA, 13 bp, Homo sapiens
gatagggagggaa

SEQ ID NO: 6251221 - DNA, 21 bp, Homo sapiens
gatagggctgggcaaggaaaa

SEQ ID NO: 6251222 - DNA, 14 bp, Homo sapiens
gataggggaggggg

SEQ ID NO: 6251223 - DNA, 13 bp, Homo sapiens
gataggggcagag

SEQ ID NO: 6251224 - DNA, 15 bp, Homo sapiens
gatagggtggcacat

SEQ ID NO: 6251225 - DNA, 15 bp, Homo sapiens
gataggtaaattttt

SEQ ID NO: 6251226 - DNA, 17 bp, Homo sapiens
gataggttaataaagat

SEQ ID NO: 6251227 - DNA, 13 bp, Homo sapiens
gatagtaagcata

SEQ ID NO: 6251228 - DNA, 18 bp, Homo sapiens
gatagtagcatacattta

SEQ ID NO: 6251229 - DNA, 14 bp, Homo sapiens
gatagtagtaaaat

SEQ ID NO: 6251230 - DNA, 16 bp, Homo sapiens
gatagtattgtgcata

SEQ ID NO: 6251231 - DNA, 16 bp, Homo sapiens
gatagtcacctgctgg

SEQ ID NO: 6251232 - DNA, 14 bp, Homo sapiens
gatagtctttcagt

SEQ ID NO: 6251233 - DNA, 18 bp, Homo sapiens
gatagtgaaacagctttc

SEQ ID NO: 6251234 - DNA, 14 bp, Homo sapiens
gatagtgccaggtg

SEQ ID NO: 6251235 - DNA, 19 bp, Homo sapiens
gatagtgggatttccagaa

SEQ ID NO: 6251236 - DNA, 14 bp, Homo sapiens
gatagtgtgatttt

SEQ ID NO: 6251237 - DNA, 22 bp, Homo sapiens
gatagtgtgatttttttcacat

SEQ ID NO: 6251238 - DNA, 21 bp, Homo sapiens
gatagtgttctgctcctgctt

SEQ ID NO: 6251239 - DNA, 23 bp, Homo sapiens
gatagtgtttcgttaagcagtac

SEQ ID NO: 6251240 - DNA, 17 bp, Homo sapiens
gatagtgttttgtactt

SEQ ID NO: 6251241 - DNA, 21 bp, Homo sapiens
gatagttaaaagactgcagct

SEQ ID NO: 6251242 - DNA, 14 bp, Homo sapiens
gatagttactgttg

SEQ ID NO: 6251243 - DNA, 17 bp, Homo sapiens
gatagttactgttgtga

SEQ ID NO: 6251244 - DNA, 15 bp, Homo sapiens
gatagttcaccccct

SEQ ID NO: 6251245 - DNA, 19 bp, Homo sapiens
gatagttctataagaataa

SEQ ID NO: 6251246 - DNA, 22 bp, Homo sapiens
gatagttgctatttttgtaaag

SEQ ID NO: 6251247 - DNA, 23 bp, Homo sapiens
gatagttgctatttttgtaaagt

SEQ ID NO: 6251248 - DNA, 16 bp, Homo sapiens
gatagttggttctttt

SEQ ID NO: 6251249 - DNA, 15 bp, Homo sapiens
gatagtttacaaaca

SEQ ID NO: 6251250 - DNA, 16 bp, Homo sapiens
gatagtttacaaacaa

SEQ ID NO: 6251251 - DNA, 20 bp, Homo sapiens
gatagtttgggggaacttgt

SEQ ID NO: 6251252 - DNA, 14 bp, Homo sapiens
gatagttttcatcc

SEQ ID NO: 6251253 - DNA, 22 bp, Homo sapiens
gatagttttcatccataactga

SEQ ID NO: 6251254 - DNA, 15 bp, Homo sapiens
gatataaaaacagat

SEQ ID NO: 6251255 - DNA, 20 bp, Homo sapiens
gatataaaaacagattctga

SEQ ID NO: 6251256 - DNA, 14 bp, Homo sapiens
gatataaaaggatg

SEQ ID NO: 6251257 - DNA, 21 bp, Homo sapiens
gatataaaaggatgttacaag

SEQ ID NO: 6251258 - DNA, 13 bp, Homo sapiens
gatataaaatgaa

SEQ ID NO: 6251259 - DNA, 14 bp, Homo sapiens
gatataaaatgaaa

SEQ ID NO: 6251260 - DNA, 19 bp, Homo sapiens
gatataaaatgaaagattt

SEQ ID NO: 6251261 - DNA, 15 bp, Homo sapiens
gatataaaatgtgca

SEQ ID NO: 6251262 - DNA, 14 bp, Homo sapiens
gatataaacagctt

SEQ ID NO: 6251263 - DNA, 18 bp, Homo sapiens
gatataaatactgacaat

SEQ ID NO: 6251264 - DNA, 23 bp, Homo sapiens
gatataaatactgacaatgtatt

SEQ ID NO: 6251265 - DNA, 13 bp, Homo sapiens
gatataaatatat

SEQ ID NO: 6251266 - DNA, 16 bp, Homo sapiens
gatataaatggctggt

SEQ ID NO: 6251267 - DNA, 20 bp, Homo sapiens
gatataaattaattgtgcct

SEQ ID NO: 6251268 - DNA, 14 bp, Homo sapiens
gatataaattttta

SEQ ID NO: 6251269 - DNA, 15 bp, Homo sapiens
gatataactgtcttg

SEQ ID NO: 6251270 - DNA, 19 bp, Homo sapiens
gatataagagaagtctcat

SEQ ID NO: 6251271 - DNA, 13 bp, Homo sapiens
gatataagatttg

SEQ ID NO: 6251272 - DNA, 14 bp, Homo sapiens
gatataagccatag

SEQ ID NO: 6251273 - DNA, 15 bp, Homo sapiens
gatataagccatagc

SEQ ID NO: 6251274 - DNA, 14 bp, Homo sapiens
gatataagctttta

SEQ ID NO: 6251275 - DNA, 14 bp, Homo sapiens
gatataagtgctgt

SEQ ID NO: 6251276 - DNA, 18 bp, Homo sapiens
gatataagtgctgtataa

SEQ ID NO: 6251277 - DNA, 19 bp, Homo sapiens
gatataagtgctgtataaa

SEQ ID NO: 6251278 - DNA, 22 bp, Homo sapiens
gatataagtgctgtataaaatc

SEQ ID NO: 6251279 - DNA, 23 bp, Homo sapiens
gatataagtgctgtataaaatca

SEQ ID NO: 6251280 - DNA, 15 bp, Homo sapiens
gatataagtgtgtgt

SEQ ID NO: 6251281 - DNA, 23 bp, Homo sapiens
gatataataaatatatatttatc

SEQ ID NO: 6251282 - DNA, 20 bp, Homo sapiens
gatataataattacttaatg

SEQ ID NO: 6251283 - DNA, 19 bp, Homo sapiens
gatataatacctttctaag

SEQ ID NO: 6251284 - DNA, 22 bp, Homo sapiens
gatataatagtagatttgaaca

SEQ ID NO: 6251285 - DNA, 17 bp, Homo sapiens
gatataatcttggcttc

SEQ ID NO: 6251286 - DNA, 23 bp, Homo sapiens
gatataatcttggcttcttaaaa

SEQ ID NO: 6251287 - DNA, 13 bp, Homo sapiens
gatataatgtatt

SEQ ID NO: 6251288 - DNA, 14 bp, Homo sapiens
gatataatgtattt

SEQ ID NO: 6251289 - DNA, 15 bp, Homo sapiens
gatataatgtatttt

SEQ ID NO: 6251290 - DNA, 18 bp, Homo sapiens
gatataattgtactgtgt

SEQ ID NO: 6251291 - DNA, 16 bp, Homo sapiens
gatatacaaagtgtac

SEQ ID NO: 6251292 - DNA, 18 bp, Homo sapiens
gatatacacggatgactt

SEQ ID NO: 6251293 - DNA, 17 bp, Homo sapiens
gatatacagacctccag

SEQ ID NO: 6251294 - DNA, 14 bp, Homo sapiens
gatatacatgaaaa

SEQ ID NO: 6251295 - DNA, 16 bp, Homo sapiens
gatataccaaattaaa

SEQ ID NO: 6251296 - DNA, 21 bp, Homo sapiens
gatatactatgggatgtatat

SEQ ID NO: 6251297 - DNA, 14 bp, Homo sapiens
gatatactccagga

SEQ ID NO: 6251298 - DNA, 17 bp, Homo sapiens
gatatactccaggactt

SEQ ID NO: 6251299 - DNA, 22 bp, Homo sapiens
gatatactccaggacttagaat

SEQ ID NO: 6251300 - DNA, 18 bp, Homo sapiens
gatatacttaagttatgt

SEQ ID NO: 6251301 - DNA, 17 bp, Homo sapiens
gatatacttgtttttgt

SEQ ID NO: 6251302 - DNA, 22 bp, Homo sapiens
gatatactttgtggaccaatta

SEQ ID NO: 6251303 - DNA, 15 bp, Homo sapiens
gatatagaaagctgt

SEQ ID NO: 6251304 - DNA, 12 bp, Homo sapiens
gatatagaacag

SEQ ID NO: 6251305 - DNA, 21 bp, Homo sapiens
gatatagcattaataaaactg

SEQ ID NO: 6251306 - DNA, 22 bp, Homo sapiens
gatatagcattaataaaactgt

SEQ ID NO: 6251307 - DNA, 18 bp, Homo sapiens
gatataggaaaatacatt

SEQ ID NO: 6251308 - DNA, 16 bp, Homo sapiens
gatataggataaaata

SEQ ID NO: 6251309 - DNA, 14 bp, Homo sapiens
gatatagggtgtgg

SEQ ID NO: 6251310 - DNA, 22 bp, Homo sapiens
gatatagggtgtggctcctacc

SEQ ID NO: 6251311 - DNA, 17 bp, Homo sapiens
gatatagtcagctgcct

SEQ ID NO: 6251312 - DNA, 11 bp, Homo sapiens
gatatataaac

SEQ ID NO: 6251313 - DNA, 17 bp, Homo sapiens
gatatataatttcctca

SEQ ID NO: 6251314 - DNA, 14 bp, Homo sapiens
gatatatacatagc

SEQ ID NO: 6251315 - DNA, 21 bp, Homo sapiens
gatatatagaaggactgcagc

SEQ ID NO: 6251316 - DNA, 21 bp, Homo sapiens
gatatataggctattttctaa

SEQ ID NO: 6251317 - DNA, 14 bp, Homo sapiens
gatatatattcacc

SEQ ID NO: 6251318 - DNA, 21 bp, Homo sapiens
gatatatatttactaaaagaa

SEQ ID NO: 6251319 - DNA, 15 bp, Homo sapiens
gatatatatttccaa

SEQ ID NO: 6251320 - DNA, 14 bp, Homo sapiens
gatatatctgaaaa

SEQ ID NO: 6251321 - DNA, 16 bp, Homo sapiens
gatatatctgaaaact

SEQ ID NO: 6251322 - DNA, 18 bp, Homo sapiens
gatatatctgaaaactgg

SEQ ID NO: 6251323 - DNA, 17 bp, Homo sapiens
gatatatctttatactt

SEQ ID NO: 6251324 - DNA, 14 bp, Homo sapiens
gatatatgtaaata

SEQ ID NO: 6251325 - DNA, 12 bp, Homo sapiens
gatatatgtatc

SEQ ID NO: 6251326 - DNA, 12 bp, Homo sapiens
gatatatgtatt

SEQ ID NO: 6251327 - DNA, 22 bp, Homo sapiens
gatatatgtattaataaataga

SEQ ID NO: 6251328 - DNA, 13 bp, Homo sapiens
gatatatgtattt

SEQ ID NO: 6251329 - DNA, 22 bp, Homo sapiens
gatatatgtgtttttcacattt

SEQ ID NO: 6251330 - DNA, 19 bp, Homo sapiens
gatatatgtttttgaaggc

SEQ ID NO: 6251331 - DNA, 18 bp, Homo sapiens
gatatattaaaaatataa

SEQ ID NO: 6251332 - DNA, 13 bp, Homo sapiens
gatatattaaatg

SEQ ID NO: 6251333 - DNA, 22 bp, Homo sapiens
gatatattattgtaagttgtac

SEQ ID NO: 6251334 - DNA, 14 bp, Homo sapiens
gatatattctctaa

SEQ ID NO: 6251335 - DNA, 14 bp, Homo sapiens
gatatattctttcc

SEQ ID NO: 6251336 - DNA, 23 bp, Homo sapiens
gatatatttaaaaacaaaaggca

SEQ ID NO: 6251337 - DNA, 18 bp, Homo sapiens
gatatatttcacttttgt

SEQ ID NO: 6251338 - DNA, 21 bp, Homo sapiens
gatatatttcacttttgttct

SEQ ID NO: 6251339 - DNA, 20 bp, Homo sapiens
gatatatttgaaatagtata

SEQ ID NO: 6251340 - DNA, 14 bp, Homo sapiens
gatatcaacagctt

SEQ ID NO: 6251341 - DNA, 17 bp, Homo sapiens
gatatcaaggtggaaat

SEQ ID NO: 6251342 - DNA, 16 bp, Homo sapiens
gatatcaatcagtaat

SEQ ID NO: 6251343 - DNA, 22 bp, Homo sapiens
gatatcaccatgatttaatcca

SEQ ID NO: 6251344 - DNA, 15 bp, Homo sapiens
gatatcagcactgga

SEQ ID NO: 6251345 - DNA, 21 bp, Homo sapiens
gatatcaggaaatatctgtga

SEQ ID NO: 6251346 - DNA, 18 bp, Homo sapiens
gatatcagggtataaatt

SEQ ID NO: 6251347 - DNA, 14 bp, Homo sapiens
gatatcataaaagt

SEQ ID NO: 6251348 - DNA, 15 bp, Homo sapiens
gatatcataaaagta

SEQ ID NO: 6251349 - DNA, 15 bp, Homo sapiens
gatatccaaacaaga

SEQ ID NO: 6251350 - DNA, 21 bp, Homo sapiens
gatatccatgagctgcactga

SEQ ID NO: 6251351 - DNA, 13 bp, Homo sapiens
gatatcccagctt

SEQ ID NO: 6251352 - DNA, 15 bp, Homo sapiens
gatatccccagggaa

SEQ ID NO: 6251353 - DNA, 22 bp, Homo sapiens
gatatccctatgtcccagcccc

SEQ ID NO: 6251354 - DNA, 21 bp, Homo sapiens
gatatccctgatcctaactga

SEQ ID NO: 6251355 - DNA, 20 bp, Homo sapiens
gatatcctctccccctcctc

SEQ ID NO: 6251356 - DNA, 23 bp, Homo sapiens
gatatcctctccccctcctccag

SEQ ID NO: 6251357 - DNA, 18 bp, Homo sapiens
gatatccttatcagagct

SEQ ID NO: 6251358 - DNA, 16 bp, Homo sapiens
gatatcggtgctatgt

SEQ ID NO: 6251359 - DNA, 19 bp, Homo sapiens
gatatcggtgctatgtgtt

SEQ ID NO: 6251360 - DNA, 20 bp, Homo sapiens
gatatcggtgctatgtgttt

SEQ ID NO: 6251361 - DNA, 20 bp, Homo sapiens
gatatctagctagtaatata

SEQ ID NO: 6251362 - DNA, 23 bp, Homo sapiens
gatatctataaaatagatataaa

SEQ ID NO: 6251363 - DNA, 23 bp, Homo sapiens
gatatctatatatgtatctacaa

SEQ ID NO: 6251364 - DNA, 21 bp, Homo sapiens
gatatctatattctaaagagc

SEQ ID NO: 6251365 - DNA, 17 bp, Homo sapiens
gatatctatatttttat

SEQ ID NO: 6251366 - DNA, 13 bp, Homo sapiens
gatatctcaatgt

SEQ ID NO: 6251367 - DNA, 15 bp, Homo sapiens
gatatctgaacacat

SEQ ID NO: 6251368 - DNA, 15 bp, Homo sapiens
gatatctgagggagg

SEQ ID NO: 6251369 - DNA, 21 bp, Homo sapiens
gatatctgagggaggaggcca

SEQ ID NO: 6251370 - DNA, 13 bp, Homo sapiens
gatatctgcatgt

SEQ ID NO: 6251371 - DNA, 17 bp, Homo sapiens
gatatctgttagatgct

SEQ ID NO: 6251372 - DNA, 24 bp, Homo sapiens
gccgcctcgggccgcctcctccag

SEQ ID NO: 6251373 - DNA, 19 bp, Homo sapiens
gccgcctctggttccactc

SEQ ID NO: 6251374 - DNA, 20 bp, Homo sapiens
gccgcctctggttccactca

SEQ ID NO: 6251375 - DNA, 20 bp, Homo sapiens
gccgcctgagaccctcgcgc

SEQ ID NO: 6251376 - DNA, 18 bp, Homo sapiens
gccgcctgcactcctcag

SEQ ID NO: 6251377 - DNA, 13 bp, Homo sapiens
gccgcctgcagcc

SEQ ID NO: 6251378 - DNA, 23 bp, Homo sapiens
gccgcctgcccgtctctctccca

SEQ ID NO: 6251379 - DNA, 17 bp, Homo sapiens
gccgcctgccctgcctt

SEQ ID NO: 6251380 - DNA, 13 bp, Homo sapiens
gccgcctgcctta

SEQ ID NO: 6251381 - DNA, 19 bp, Homo sapiens
gccgcctgcgggctgcccc

SEQ ID NO: 6251382 - DNA, 12 bp, Homo sapiens
gccgcctgctcc

SEQ ID NO: 6251383 - DNA, 14 bp, Homo sapiens
gccgcctggcaggt

SEQ ID NO: 6251384 - DNA, 16 bp, Homo sapiens
gccgcctgtcaataaa

SEQ ID NO: 6251385 - DNA, 14 bp, Homo sapiens
gccgcctgtccttg

SEQ ID NO: 6251386 - DNA, 14 bp, Homo sapiens
gccgcctgtgccct

SEQ ID NO: 6251387 - DNA, 20 bp, Homo sapiens
gccgcctgtgcccttgctgg

SEQ ID NO: 6251388 - DNA, 22 bp, Homo sapiens
gccgcctgtgcccttgctgggt

SEQ ID NO: 6251389 - DNA, 21 bp, Homo sapiens
gccgccttctcccctctccca

SEQ ID NO: 6251390 - DNA, 18 bp, Homo sapiens
gccgccttggccttgcag

SEQ ID NO: 6251391 - DNA, 16 bp, Homo sapiens
gccgcgcactcagccg

SEQ ID NO: 6251392 - DNA, 14 bp, Homo sapiens
gccgcgccagtccc

SEQ ID NO: 6251393 - DNA, 13 bp, Homo sapiens
gccgcgccgccgc

SEQ ID NO: 6251394 - DNA, 16 bp, Homo sapiens
gccgcgcgcccctgcc

SEQ ID NO: 6251395 - DNA, 18 bp, Homo sapiens
gccgcgcgcccctgcccg

SEQ ID NO: 6251396 - DNA, 16 bp, Homo sapiens
gccgcgcgtccagctg

SEQ ID NO: 6251397 - DNA, 19 bp, Homo sapiens
gccgcgctcccctggaagc

SEQ ID NO: 6251398 - DNA, 23 bp, Homo sapiens
gccgcgctccgaaccccgggccc

SEQ ID NO: 6251399 - DNA, 13 bp, Homo sapiens
gccgcggcccaga

SEQ ID NO: 6251400 - DNA, 16 bp, Homo sapiens
gccgcggcccagaccc

SEQ ID NO: 6251401 - DNA, 21 bp, Homo sapiens
gccgcggccctggggcgggca

SEQ ID NO: 6251402 - DNA, 18 bp, Homo sapiens
gccgcggctccccctgga

SEQ ID NO: 6251403 - DNA, 14 bp, Homo sapiens
gccgcgggccagga

SEQ ID NO: 6251404 - DNA, 16 bp, Homo sapiens
gccgcgggccaggagg

SEQ ID NO: 6251405 - DNA, 23 bp, Homo sapiens
gccgcgggcgagaagggcgcagg

SEQ ID NO: 6251406 - DNA, 19 bp, Homo sapiens
gccgcgggcggccaggcaa

SEQ ID NO: 6251407 - DNA, 19 bp, Homo sapiens
gccgcggggaagctggctt

SEQ ID NO: 6251408 - DNA, 21 bp, Homo sapiens
gccgcggtaggtaagggccgc

SEQ ID NO: 6251409 - DNA, 14 bp, Homo sapiens
gccgcgtccctgcc

SEQ ID NO: 6251410 - DNA, 15 bp, Homo sapiens
gccgcgtccctgccc

SEQ ID NO: 6251411 - DNA, 20 bp, Homo sapiens
gccgcgtgacggacatccag

SEQ ID NO: 6251412 - DNA, 19 bp, Homo sapiens
gccgcgtgccgggccccca

SEQ ID NO: 6251413 - DNA, 19 bp, Homo sapiens
gccgcgtggaatgtgagtg

SEQ ID NO: 6251414 - DNA, 14 bp, Homo sapiens
gccgcgtggacagc

SEQ ID NO: 6251415 - DNA, 14 bp, Homo sapiens
gccgcgtgtgcgtg

SEQ ID NO: 6251416 - DNA, 19 bp, Homo sapiens
gccgcgtttagaccaagga

SEQ ID NO: 6251417 - DNA, 20 bp, Homo sapiens
gccgcgtttagaccaaggaa

SEQ ID NO: 6251418 - DNA, 16 bp, Homo sapiens
gccgctacctccctcc

SEQ ID NO: 6251419 - DNA, 15 bp, Homo sapiens
gccgctagaggcctg

SEQ ID NO: 6251420 - DNA, 18 bp, Homo sapiens
gccgctagaggcctgagg

SEQ ID NO: 6251421 - DNA, 19 bp, Homo sapiens
gccgctagaggcctgagga

SEQ ID NO: 6251422 - DNA, 23 bp, Homo sapiens
gccgctagatgggcatggggtgg

SEQ ID NO: 6251423 - DNA, 17 bp, Homo sapiens
gccgctaggagagactg

SEQ ID NO: 6251424 - DNA, 15 bp, Homo sapiens
gccgctatgcagggt

SEQ ID NO: 6251425 - DNA, 15 bp, Homo sapiens
gccgctccaccagca

SEQ ID NO: 6251426 - DNA, 16 bp, Homo sapiens
gccgctccagagtcag

SEQ ID NO: 6251427 - DNA, 12 bp, Homo sapiens
gccgctccaggg

SEQ ID NO: 6251428 - DNA, 14 bp, Homo sapiens
gccgctccccttgg

SEQ ID NO: 6251429 - DNA, 18 bp, Homo sapiens
gccgctccccttggacct

SEQ ID NO: 6251430 - DNA, 22 bp, Homo sapiens
gccgctccccttggacctccag

SEQ ID NO: 6251431 - DNA, 24 bp, Homo sapiens
gccgctccccttggacctccaggg

SEQ ID NO: 6251432 - DNA, 24 bp, Homo sapiens
gccgctcccggttccctccccagc

SEQ ID NO: 6251433 - DNA, 16 bp, Homo sapiens
gccgctcctgcttccc

SEQ ID NO: 6251434 - DNA, 20 bp, Homo sapiens
gccgctcctgtctgccagcc

SEQ ID NO: 6251435 - DNA, 22 bp, Homo sapiens
gccgctcctgtctgccagccag

SEQ ID NO: 6251436 - DNA, 14 bp, Homo sapiens
gccgctcgatgcct

SEQ ID NO: 6251437 - DNA, 21 bp, Homo sapiens
gccgctcggaggccccaaagg

SEQ ID NO: 6251438 - DNA, 17 bp, Homo sapiens
gccgctctccccctgca

SEQ ID NO: 6251439 - DNA, 19 bp, Homo sapiens
gccgctctccccctgcagc

SEQ ID NO: 6251440 - DNA, 21 bp, Homo sapiens
gccgctctccccctgcagccg

SEQ ID NO: 6251441 - DNA, 15 bp, Homo sapiens
gccgctctcctgcca

SEQ ID NO: 6251442 - DNA, 12 bp, Homo sapiens
gccgctctgatt

SEQ ID NO: 6251443 - DNA, 19 bp, Homo sapiens
gccgctcttctgtcatccc

SEQ ID NO: 6251444 - DNA, 20 bp, Homo sapiens
gccgctcttctgtcatcccg

SEQ ID NO: 6251445 - DNA, 18 bp, Homo sapiens
gccgctgaccctgggcct

SEQ ID NO: 6251446 - DNA, 15 bp, Homo sapiens
gccgctgagcgagga

SEQ ID NO: 6251447 - DNA, 17 bp, Homo sapiens
gccgctgagcgaggaga

SEQ ID NO: 6251448 - DNA, 12 bp, Homo sapiens
gccgctgcacct

SEQ ID NO: 6251449 - DNA, 16 bp, Homo sapiens
gccgctgcagggctcc

SEQ ID NO: 6251450 - DNA, 16 bp, Homo sapiens
gccgctgcagggtggc

SEQ ID NO: 6251451 - DNA, 12 bp, Homo sapiens
gccgctgccacg

SEQ ID NO: 6251452 - DNA, 14 bp, Homo sapiens
gccgctgccatgct

SEQ ID NO: 6251453 - DNA, 18 bp, Homo sapiens
gccgctgcccccaccctg

SEQ ID NO: 6251454 - DNA, 20 bp, Homo sapiens
gccgctgcccccaccctgct

SEQ ID NO: 6251455 - DNA, 15 bp, Homo sapiens
gccgctgcccctgag

SEQ ID NO: 6251456 - DNA, 18 bp, Homo sapiens
gccgctgcccgctcagcc

SEQ ID NO: 6251457 - DNA, 19 bp, Homo sapiens
gccgctgctttgcgctggt

SEQ ID NO: 6251458 - DNA, 11 bp, Homo sapiens
gccgctggccc

SEQ ID NO: 6251459 - DNA, 13 bp, Homo sapiens
gccgctggcccag

SEQ ID NO: 6251460 - DNA, 16 bp, Homo sapiens
gccgctggcccagggt

SEQ ID NO: 6251461 - DNA, 17 bp, Homo sapiens
gccgctggctggtgggc

SEQ ID NO: 6251462 - DNA, 11 bp, Homo sapiens
gccgctggggt

SEQ ID NO: 6251463 - DNA, 12 bp, Homo sapiens
gccgctggggtc

SEQ ID NO: 6251464 - DNA, 19 bp, Homo sapiens
gccgctgtcaaggccgagg

SEQ ID NO: 6251465 - DNA, 13 bp, Homo sapiens
gccgctgtctctg

SEQ ID NO: 6251466 - DNA, 16 bp, Homo sapiens
gccgctgtctctgagg

SEQ ID NO: 6251467 - DNA, 16 bp, Homo sapiens
gccgctgtgtccccgc

SEQ ID NO: 6251468 - DNA, 21 bp, Homo sapiens
gccgcttagtgctgctttgct

SEQ ID NO: 6251469 - DNA, 17 bp, Homo sapiens
gccgcttccagcttcct

SEQ ID NO: 6251470 - DNA, 14 bp, Homo sapiens
gccgcttccccagc

SEQ ID NO: 6251471 - DNA, 16 bp, Homo sapiens
gccgcttccccagctc

SEQ ID NO: 6251472 - DNA, 18 bp, Homo sapiens
gccgcttccctacccaca

SEQ ID NO: 6251473 - DNA, 19 bp, Homo sapiens
gccgcttctccccagagct

SEQ ID NO: 6251474 - DNA, 13 bp, Homo sapiens
gccgcttctcctg

SEQ ID NO: 6251475 - DNA, 20 bp, Homo sapiens
gccgcttctcctgcagtctg

SEQ ID NO: 6251476 - DNA, 16 bp, Homo sapiens
gccgctttctctgagg

SEQ ID NO: 6251477 - DNA, 16 bp, Homo sapiens
gccgcttttctcctct

SEQ ID NO: 6251478 - DNA, 19 bp, Homo sapiens
gccggaaccacagggccag

SEQ ID NO: 6251479 - DNA, 22 bp, Homo sapiens
gccggaaccacagggccagagg

SEQ ID NO: 6251480 - DNA, 16 bp, Homo sapiens
gccggaagtctgttct

SEQ ID NO: 6251481 - DNA, 20 bp, Homo sapiens
gccggacacaagcggccctg

SEQ ID NO: 6251482 - DNA, 21 bp, Homo sapiens
gccggacacaagcggccctga

SEQ ID NO: 6251483 - DNA, 23 bp, Homo sapiens
gccggacacggcttcactgacca

SEQ ID NO: 6251484 - DNA, 16 bp, Homo sapiens
gccggacacttctcag

SEQ ID NO: 6251485 - DNA, 22 bp, Homo sapiens
gccggacccggaggccgaggcc

SEQ ID NO: 6251486 - DNA, 20 bp, Homo sapiens
gccggaccgcgtagagagcc

SEQ ID NO: 6251487 - DNA, 15 bp, Homo sapiens
gccggacctgagccc

SEQ ID NO: 6251488 - DNA, 15 bp, Homo sapiens
gccggacgcatctca

SEQ ID NO: 6251489 - DNA, 23 bp, Homo sapiens
gccggagaacatctgccttgctg

SEQ ID NO: 6251490 - DNA, 14 bp, Homo sapiens
gccggagaggaaga

SEQ ID NO: 6251491 - DNA, 18 bp, Homo sapiens
gccggagaggagttcagg

SEQ ID NO: 6251492 - DNA, 13 bp, Homo sapiens
gccggagcctttg

SEQ ID NO: 6251493 - DNA, 15 bp, Homo sapiens
gccggaggaaggtcc

SEQ ID NO: 6251494 - DNA, 12 bp, Homo sapiens
gccggaggccag

SEQ ID NO: 6251495 - DNA, 17 bp, Homo sapiens
gccggaggccagctatc

SEQ ID NO: 6251496 - DNA, 19 bp, Homo sapiens
gccggaggccttggggtgg

SEQ ID NO: 6251497 - DNA, 13 bp, Homo sapiens
gccggagggcagg

SEQ ID NO: 6251498 - DNA, 14 bp, Homo sapiens
gccggagggcagga

SEQ ID NO: 6251499 - DNA, 16 bp, Homo sapiens
gccggagtccactccc

SEQ ID NO: 6251500 - DNA, 15 bp, Homo sapiens
gccggatctgggctg

SEQ ID NO: 6251501 - DNA, 16 bp, Homo sapiens
gccggatgtgcttttc

SEQ ID NO: 6251502 - DNA, 11 bp, Homo sapiens
gccggcaaccc

SEQ ID NO: 6251503 - DNA, 18 bp, Homo sapiens
gccggcaaccccagttct

SEQ ID NO: 6251504 - DNA, 18 bp, Homo sapiens
gccggcaataaaagccca

SEQ ID NO: 6251505 - DNA, 19 bp, Homo sapiens
gccggcaataaaagcccag

SEQ ID NO: 6251506 - DNA, 20 bp, Homo sapiens
gccggcaataaaagcccagg

SEQ ID NO: 6251507 - DNA, 21 bp, Homo sapiens
gccggcacagggtctgctctt

SEQ ID NO: 6251508 - DNA, 14 bp, Homo sapiens
gccggcagccccag

SEQ ID NO: 6251509 - DNA, 16 bp, Homo sapiens
gccggcagccccagcc

SEQ ID NO: 6251510 - DNA, 18 bp, Homo sapiens
gccggcagccccagcctg

SEQ ID NO: 6251511 - DNA, 13 bp, Homo sapiens
gccggcagcctgg

SEQ ID NO: 6251512 - DNA, 22 bp, Homo sapiens
gccggcagcgggcggaggggat

SEQ ID NO: 6251513 - DNA, 16 bp, Homo sapiens
gccggcaggggcccct

SEQ ID NO: 6251514 - DNA, 17 bp, Homo sapiens
gccggcaggggcccctc

SEQ ID NO: 6251515 - DNA, 16 bp, Homo sapiens
gccggcatccttgcct

SEQ ID NO: 6251516 - DNA, 20 bp, Homo sapiens
gccggcatctcccctagctc

SEQ ID NO: 6251517 - DNA, 24 bp, Homo sapiens
gccggcatctcccctagctcacca

SEQ ID NO: 6251518 - DNA, 20 bp, Homo sapiens
gccggccacacccctctgct

SEQ ID NO: 6251519 - DNA, 18 bp, Homo sapiens
gccggccaccagatgctg

SEQ ID NO: 6251520 - DNA, 12 bp, Homo sapiens
gccggccagcca

SEQ ID NO: 6251521 - DNA, 14 bp, Homo sapiens
gccggccagcccct

SEQ ID NO: 6251522 - DNA, 15 bp, Homo sapiens
gccggccagctcccc

SEQ ID NO: 6251523 - DNA, 15 bp, Homo sapiens
gccggccagctggga

SEQ ID NO: 6251524 - DNA, 17 bp, Homo sapiens
gccggccagtggccttc

SEQ ID NO: 6251525 - DNA, 19 bp, Homo sapiens
gccggcccacgtcctgggt

SEQ ID NO: 6251526 - DNA, 13 bp, Homo sapiens
gccggcccagatg

SEQ ID NO: 6251527 - DNA, 15 bp, Homo sapiens
gccggcccagatgtg

SEQ ID NO: 6251528 - DNA, 19 bp, Homo sapiens
gccggcccagatgtgtccc

SEQ ID NO: 6251529 - DNA, 12 bp, Homo sapiens
gccggccccagg

SEQ ID NO: 6251530 - DNA, 14 bp, Homo sapiens
gccggcccccagga

SEQ ID NO: 6251531 - DNA, 17 bp, Homo sapiens
gccggccctgcccctcc

SEQ ID NO: 6251532 - DNA, 14 bp, Homo sapiens
gccggccctggctt

SEQ ID NO: 6251533 - DNA, 12 bp, Homo sapiens
gccggccctggg

SEQ ID NO: 6251534 - DNA, 15 bp, Homo sapiens
gccggccgcccacat

SEQ ID NO: 6251535 - DNA, 20 bp, Homo sapiens
gccggccgccttctcccctc

SEQ ID NO: 6251536 - DNA, 16 bp, Homo sapiens
gccggccgtggaagga

SEQ ID NO: 6251537 - DNA, 23 bp, Homo sapiens
gccggcctcctcctcacccttcc

SEQ ID NO: 6251538 - DNA, 15 bp, Homo sapiens
gccggcctctctggc

SEQ ID NO: 6251539 - DNA, 18 bp, Homo sapiens
gccggcctctctggcctc

SEQ ID NO: 6251540 - DNA, 20 bp, Homo sapiens
gccggcctctctggcctccc

SEQ ID NO: 6251541 - DNA, 20 bp, Homo sapiens
gccggcctctgctgccccct

SEQ ID NO: 6251542 - DNA, 14 bp, Homo sapiens
gccggcctggggcc

SEQ ID NO: 6251543 - DNA, 12 bp, Homo sapiens
gccggccttggc

SEQ ID NO: 6251544 - DNA, 13 bp, Homo sapiens
gccggccttggcc

SEQ ID NO: 6251545 - DNA, 23 bp, Homo sapiens
gccggccttggccttggggccag

SEQ ID NO: 6251546 - DNA, 18 bp, Homo sapiens
gccggcgagccctgtgga

SEQ ID NO: 6251547 - DNA, 16 bp, Homo sapiens
gccggcgagggggccg

SEQ ID NO: 6251548 - DNA, 17 bp, Homo sapiens
gccggcgagggggccgg

SEQ ID NO: 6251549 - DNA, 23 bp, Homo sapiens
gccggcgagggggccggggggag

SEQ ID NO: 6251550 - DNA, 15 bp, Homo sapiens
gccggcgccccggac

SEQ ID NO: 6251551 - DNA, 17 bp, Homo sapiens
gccggcggcccaagccc

SEQ ID NO: 6251552 - DNA, 15 bp, Homo sapiens
gatatcttgaaatga

SEQ ID NO: 6251553 - DNA, 20 bp, Homo sapiens
gatatcttggacaaatcaca

SEQ ID NO: 6251554 - DNA, 22 bp, Homo sapiens
gatatctttttattgatgtgca

SEQ ID NO: 6251555 - DNA, 18 bp, Homo sapiens
gatatctttttcattatt

SEQ ID NO: 6251556 - DNA, 15 bp, Homo sapiens
gatatgaaaaataaa

SEQ ID NO: 6251557 - DNA, 15 bp, Homo sapiens
gatatgaaagagaaa

SEQ ID NO: 6251558 - DNA, 14 bp, Homo sapiens
gatatgaatatatg

SEQ ID NO: 6251559 - DNA, 23 bp, Homo sapiens
gatatgaatatatggcatttgca

SEQ ID NO: 6251560 - DNA, 18 bp, Homo sapiens
gatatgacccacactgcc

SEQ ID NO: 6251561 - DNA, 22 bp, Homo sapiens
gatatgattgtaacatatttct

SEQ ID NO: 6251562 - DNA, 14 bp, Homo sapiens
gatatgcaaaagct

SEQ ID NO: 6251563 - DNA, 18 bp, Homo sapiens
gatatgcagttttcctta

SEQ ID NO: 6251564 - DNA, 17 bp, Homo sapiens
gatatgcatatttgttt

SEQ ID NO: 6251565 - DNA, 21 bp, Homo sapiens
gatatgcatgtagcatataaa

SEQ ID NO: 6251566 - DNA, 19 bp, Homo sapiens
gatatgctgtattttaaag

SEQ ID NO: 6251567 - DNA, 14 bp, Homo sapiens
gatatgcttagtaa

SEQ ID NO: 6251568 - DNA, 16 bp, Homo sapiens
gatatgctttaagaca

SEQ ID NO: 6251569 - DNA, 11 bp, Homo sapiens
gatatggaaac

SEQ ID NO: 6251570 - DNA, 12 bp, Homo sapiens
gatatggagccc

SEQ ID NO: 6251571 - DNA, 21 bp, Homo sapiens
gatatggagccctgtaatttt

SEQ ID NO: 6251572 - DNA, 15 bp, Homo sapiens
gatatggcagaagac

SEQ ID NO: 6251573 - DNA, 15 bp, Homo sapiens
gatatggcaggactc

SEQ ID NO: 6251574 - DNA, 17 bp, Homo sapiens
gatatggcagggaagct

SEQ ID NO: 6251575 - DNA, 19 bp, Homo sapiens
gatatggcatcgttgcatt

SEQ ID NO: 6251576 - DNA, 15 bp, Homo sapiens
gatatggcattgcac

SEQ ID NO: 6251577 - DNA, 17 bp, Homo sapiens
gatatggcggcctgcag

SEQ ID NO: 6251578 - DNA, 23 bp, Homo sapiens
gatatgggactgattctgtggct

SEQ ID NO: 6251579 - DNA, 14 bp, Homo sapiens
gatatgggctttct

SEQ ID NO: 6251580 - DNA, 14 bp, Homo sapiens
gatatgtaaattaa

SEQ ID NO: 6251581 - DNA, 20 bp, Homo sapiens
gatatgtattcttttctcag

SEQ ID NO: 6251582 - DNA, 21 bp, Homo sapiens
gatatgtattgggcagcagac

SEQ ID NO: 6251583 - DNA, 19 bp, Homo sapiens
gatatgtccagtcatcctg

SEQ ID NO: 6251584 - DNA, 22 bp, Homo sapiens
gatatgtctagggtgtgattta

SEQ ID NO: 6251585 - DNA, 18 bp, Homo sapiens
gatatgtctttaaaatga

SEQ ID NO: 6251586 - DNA, 17 bp, Homo sapiens
gatatgtgaaacaatgt

SEQ ID NO: 6251587 - DNA, 21 bp, Homo sapiens
gatatgtgcttgtgtgtatgt

SEQ ID NO: 6251588 - DNA, 13 bp, Homo sapiens
gatatgtggtgta

SEQ ID NO: 6251589 - DNA, 21 bp, Homo sapiens
gatatgtgtaaatgttatgac

SEQ ID NO: 6251590 - DNA, 18 bp, Homo sapiens
gatatgtgtaatatcatt

SEQ ID NO: 6251591 - DNA, 19 bp, Homo sapiens
gatatgtgtaatatcattt

SEQ ID NO: 6251592 - DNA, 22 bp, Homo sapiens
gatatgttaaatgtatagctgg

SEQ ID NO: 6251593 - DNA, 16 bp, Homo sapiens
gatatgttgatcagcc

SEQ ID NO: 6251594 - DNA, 23 bp, Homo sapiens
gatatgttttatttcattggtta

SEQ ID NO: 6251595 - DNA, 15 bp, Homo sapiens
gatattaaacctctt

SEQ ID NO: 6251596 - DNA, 18 bp, Homo sapiens
gatattaaacgtgtaaat

SEQ ID NO: 6251597 - DNA, 16 bp, Homo sapiens
gatattaaaggagtta

SEQ ID NO: 6251598 - DNA, 16 bp, Homo sapiens
gatattaaatttcaaa

SEQ ID NO: 6251599 - DNA, 23 bp, Homo sapiens
gatattaagaactgctgtttcac

SEQ ID NO: 6251600 - DNA, 19 bp, Homo sapiens
gatattaagaatcttagat

SEQ ID NO: 6251601 - DNA, 13 bp, Homo sapiens
gatattaatgtat

SEQ ID NO: 6251602 - DNA, 18 bp, Homo sapiens
gatattacagcttatttt

SEQ ID NO: 6251603 - DNA, 16 bp, Homo sapiens
gatattactttatcac

SEQ ID NO: 6251604 - DNA, 16 bp, Homo sapiens
gatattatagaaaatt

SEQ ID NO: 6251605 - DNA, 20 bp, Homo sapiens
gatattatattaaacataca

SEQ ID NO: 6251606 - DNA, 22 bp, Homo sapiens
gatattatgtatagaaaataaa

SEQ ID NO: 6251607 - DNA, 23 bp, Homo sapiens
gatattatgtggcttttatttca

SEQ ID NO: 6251608 - DNA, 15 bp, Homo sapiens
gatattattcttgta

SEQ ID NO: 6251609 - DNA, 14 bp, Homo sapiens
gatattatttcttc

SEQ ID NO: 6251610 - DNA, 15 bp, Homo sapiens
gatattatttcttct

SEQ ID NO: 6251611 - DNA, 19 bp, Homo sapiens
gatattatttcttctctta

SEQ ID NO: 6251612 - DNA, 19 bp, Homo sapiens
gatattcaaacacacagta

SEQ ID NO: 6251613 - DNA, 16 bp, Homo sapiens
gatattcaataaagca

SEQ ID NO: 6251614 - DNA, 15 bp, Homo sapiens
gatattcattaatag

SEQ ID NO: 6251615 - DNA, 19 bp, Homo sapiens
gatattcattggcagctca

SEQ ID NO: 6251616 - DNA, 17 bp, Homo sapiens
gatattccaaaataaaa

SEQ ID NO: 6251617 - DNA, 21 bp, Homo sapiens
gatattccatgaatgtatcag

SEQ ID NO: 6251618 - DNA, 20 bp, Homo sapiens
gatattccccccacttaaga

SEQ ID NO: 6251619 - DNA, 20 bp, Homo sapiens
gatattcctacaaagaaaaa

SEQ ID NO: 6251620 - DNA, 17 bp, Homo sapiens
gatattctaaaatataa

SEQ ID NO: 6251621 - DNA, 12 bp, Homo sapiens
gatattctaaga

SEQ ID NO: 6251622 - DNA, 21 bp, Homo sapiens
gatattctaagaaatatctgt

SEQ ID NO: 6251623 - DNA, 19 bp, Homo sapiens
gatattctggattataaaa

SEQ ID NO: 6251624 - DNA, 20 bp, Homo sapiens
gatattctggattataaaaa

SEQ ID NO: 6251625 - DNA, 15 bp, Homo sapiens
gatattctttacaaa

SEQ ID NO: 6251626 - DNA, 20 bp, Homo sapiens
gatattctttacaaactgaa

SEQ ID NO: 6251627 - DNA, 16 bp, Homo sapiens
gatattgaatgttaaa

SEQ ID NO: 6251628 - DNA, 18 bp, Homo sapiens
gatattgacactgtccct

SEQ ID NO: 6251629 - DNA, 20 bp, Homo sapiens
gatattgaggccaagaatat

SEQ ID NO: 6251630 - DNA, 12 bp, Homo sapiens
gatattgcctta

SEQ ID NO: 6251631 - DNA, 19 bp, Homo sapiens
gatattgccttatttgtct

SEQ ID NO: 6251632 - DNA, 15 bp, Homo sapiens
gatattgctaattgt

SEQ ID NO: 6251633 - DNA, 17 bp, Homo sapiens
gatattgctgaagaatc

SEQ ID NO: 6251634 - DNA, 24 bp, Homo sapiens
gatattgctgaagaatctacttaa

SEQ ID NO: 6251635 - DNA, 13 bp, Homo sapiens
gatattggcattt

SEQ ID NO: 6251636 - DNA, 20 bp, Homo sapiens
gatattggttctatttattt

SEQ ID NO: 6251637 - DNA, 15 bp, Homo sapiens
gatattgtatctcct

SEQ ID NO: 6251638 - DNA, 19 bp, Homo sapiens
gatattgtatctcctttaa

SEQ ID NO: 6251639 - DNA, 22 bp, Homo sapiens
gatattgtattatcatatatgc

SEQ ID NO: 6251640 - DNA, 17 bp, Homo sapiens
gatattgtttaaaattc

SEQ ID NO: 6251641 - DNA, 21 bp, Homo sapiens
gatattgtttaaaattcagtt

SEQ ID NO: 6251642 - DNA, 15 bp, Homo sapiens
gatattgtttgctgt

SEQ ID NO: 6251643 - DNA, 18 bp, Homo sapiens
gatattgtttgctgttgg

SEQ ID NO: 6251644 - DNA, 20 bp, Homo sapiens
gatattgttttctgtaaata

SEQ ID NO: 6251645 - DNA, 21 bp, Homo sapiens
gatattgttttctgtaaataa

SEQ ID NO: 6251646 - DNA, 15 bp, Homo sapiens
gatatttaaatttag

SEQ ID NO: 6251647 - DNA, 20 bp, Homo sapiens
gatatttacgtaaagaaaat

SEQ ID NO: 6251648 - DNA, 21 bp, Homo sapiens
gatatttagctctgtggaatt

SEQ ID NO: 6251649 - DNA, 22 bp, Homo sapiens
gatatttaggagtgtgtgacat

SEQ ID NO: 6251650 - DNA, 13 bp, Homo sapiens
gatatttatatat

SEQ ID NO: 6251651 - DNA, 23 bp, Homo sapiens
gatatttatatgttattaaacag

SEQ ID NO: 6251652 - DNA, 23 bp, Homo sapiens
gatatttatatttttattttatt

SEQ ID NO: 6251653 - DNA, 20 bp, Homo sapiens
gatatttatgtatcttgatg

SEQ ID NO: 6251654 - DNA, 20 bp, Homo sapiens
gatatttatttcctgctact

SEQ ID NO: 6251655 - DNA, 12 bp, Homo sapiens
gatatttcaaat

SEQ ID NO: 6251656 - DNA, 18 bp, Homo sapiens
gatatttcaagctcatgt

SEQ ID NO: 6251657 - DNA, 20 bp, Homo sapiens
gatatttcaagctcatgtca

SEQ ID NO: 6251658 - DNA, 11 bp, Homo sapiens
gatatttcaga

SEQ ID NO: 6251659 - DNA, 17 bp, Homo sapiens
gatatttcagaaataca

SEQ ID NO: 6251660 - DNA, 20 bp, Homo sapiens
gatatttccatttcttcctc

SEQ ID NO: 6251661 - DNA, 11 bp, Homo sapiens
gatatttccta

SEQ ID NO: 6251662 - DNA, 12 bp, Homo sapiens
gatatttcctaa

SEQ ID NO: 6251663 - DNA, 23 bp, Homo sapiens
gatatttctacaaggtgttcatt

SEQ ID NO: 6251664 - DNA, 13 bp, Homo sapiens
gatatttctcagc

SEQ ID NO: 6251665 - DNA, 17 bp, Homo sapiens
gatatttcttgctttca

SEQ ID NO: 6251666 - DNA, 14 bp, Homo sapiens
gatatttgatgtag

SEQ ID NO: 6251667 - DNA, 15 bp, Homo sapiens
gatatttgcacttat

SEQ ID NO: 6251668 - DNA, 19 bp, Homo sapiens
gatatttggcttaaatata

SEQ ID NO: 6251669 - DNA, 21 bp, Homo sapiens
gatattttacctcttattgca

SEQ ID NO: 6251670 - DNA, 20 bp, Homo sapiens
gatattttattttgaaatgg

SEQ ID NO: 6251671 - DNA, 12 bp, Homo sapiens
gatattttcaaa

SEQ ID NO: 6251672 - DNA, 21 bp, Homo sapiens
gatattttcaacgcagccctg

SEQ ID NO: 6251673 - DNA, 22 bp, Homo sapiens
gatattttcaacgcagccctgc

SEQ ID NO: 6251674 - DNA, 23 bp, Homo sapiens
gatattttcaacgcagccctgct

SEQ ID NO: 6251675 - DNA, 16 bp, Homo sapiens
gatattttcacatctt

SEQ ID NO: 6251676 - DNA, 18 bp, Homo sapiens
gatattttcacatcttaa

SEQ ID NO: 6251677 - DNA, 17 bp, Homo sapiens
gatattttccatatatt

SEQ ID NO: 6251678 - DNA, 22 bp, Homo sapiens
gatattttccctttttaaaaaa

SEQ ID NO: 6251679 - DNA, 14 bp, Homo sapiens
gatattttgaaatg

SEQ ID NO: 6251680 - DNA, 23 bp, Homo sapiens
gatattttggggggcagagaata

SEQ ID NO: 6251681 - DNA, 17 bp, Homo sapiens
gatattttgtaaaatgt

SEQ ID NO: 6251682 - DNA, 18 bp, Homo sapiens
gatattttgtaaaatgta

SEQ ID NO: 6251683 - DNA, 20 bp, Homo sapiens
gatattttgtaaaatgtatt

SEQ ID NO: 6251684 - DNA, 15 bp, Homo sapiens
gatatttttaattta

SEQ ID NO: 6251685 - DNA, 17 bp, Homo sapiens
gatatttttatctttat

SEQ ID NO: 6251686 - DNA, 19 bp, Homo sapiens
gatatttttatgtgcagcg

SEQ ID NO: 6251687 - DNA, 22 bp, Homo sapiens
gatatttttcataaacaagttc

SEQ ID NO: 6251688 - DNA, 13 bp, Homo sapiens
gatatttttccat

SEQ ID NO: 6251689 - DNA, 18 bp, Homo sapiens
gatatttttccatttatt

SEQ ID NO: 6251690 - DNA, 11 bp, Homo sapiens
gatatttttgt

SEQ ID NO: 6251691 - DNA, 22 bp, Homo sapiens
gatatttttgtacgttatatat

SEQ ID NO: 6251692 - DNA, 21 bp, Homo sapiens
gatattttttcagaaatatgt

SEQ ID NO: 6251693 - DNA, 19 bp, Homo sapiens
gatatttttttacttgagc

SEQ ID NO: 6251694 - DNA, 20 bp, Homo sapiens
gatcaaaaaggcttataaaa

SEQ ID NO: 6251695 - DNA, 16 bp, Homo sapiens
gatcaaaaataaacta

SEQ ID NO: 6251696 - DNA, 23 bp, Homo sapiens
gatcaaaaataaactagtttcca

SEQ ID NO: 6251697 - DNA, 21 bp, Homo sapiens
gatcaaaacatgcttgaataa

SEQ ID NO: 6251698 - DNA, 22 bp, Homo sapiens
gatcaaaacctgtgccaggctg

SEQ ID NO: 6251699 - DNA, 14 bp, Homo sapiens
gatcaaaaggccca

SEQ ID NO: 6251700 - DNA, 15 bp, Homo sapiens
gatcaaaatgcatac

SEQ ID NO: 6251701 - DNA, 21 bp, Homo sapiens
gatcaaacctttctggcctgt

SEQ ID NO: 6251702 - DNA, 22 bp, Homo sapiens
gatcaaacctttctggcctgtt

SEQ ID NO: 6251703 - DNA, 14 bp, Homo sapiens
gatcaaagacacac

SEQ ID NO: 6251704 - DNA, 18 bp, Homo sapiens
gatcaaagatgaaaagta

SEQ ID NO: 6251705 - DNA, 18 bp, Homo sapiens
gatcaaagctaggaaagg

SEQ ID NO: 6251706 - DNA, 18 bp, Homo sapiens
gatcaaagttcctgttca

SEQ ID NO: 6251707 - DNA, 19 bp, Homo sapiens
gatcaaatactttaaagga

SEQ ID NO: 6251708 - DNA, 15 bp, Homo sapiens
gatcaaatatagaaa

SEQ ID NO: 6251709 - DNA, 18 bp, Homo sapiens
gatcaaatgtttaatcat

SEQ ID NO: 6251710 - DNA, 20 bp, Homo sapiens
gatcaaatgtttaatcatat

SEQ ID NO: 6251711 - DNA, 23 bp, Homo sapiens
gatcaaattcatttttttcactg

SEQ ID NO: 6251712 - DNA, 17 bp, Homo sapiens
gatcaacaatacctttt

SEQ ID NO: 6251713 - DNA, 15 bp, Homo sapiens
gatcaacaatgattt

SEQ ID NO: 6251714 - DNA, 19 bp, Homo sapiens
gatcaacagacctaagaaa

SEQ ID NO: 6251715 - DNA, 22 bp, Homo sapiens
gatcaaccccttcgctcctgtg

SEQ ID NO: 6251716 - DNA, 20 bp, Homo sapiens
gatcaagaaaaaaagggaga

SEQ ID NO: 6251717 - DNA, 20 bp, Homo sapiens
gatcaagaaatgtctctgct

SEQ ID NO: 6251718 - DNA, 22 bp, Homo sapiens
gatcaagaatcttttgtgaaat

SEQ ID NO: 6251719 - DNA, 22 bp, Homo sapiens
gatcaagagaatcaacagatga

SEQ ID NO: 6251720 - DNA, 22 bp, Homo sapiens
gatcaagagtccggatttctaa

SEQ ID NO: 6251721 - DNA, 16 bp, Homo sapiens
gatcaagcctgcctca

SEQ ID NO: 6251722 - DNA, 15 bp, Homo sapiens
gatcaaggagggaga

SEQ ID NO: 6251723 - DNA, 15 bp, Homo sapiens
gatcaaggtgctctt

SEQ ID NO: 6251724 - DNA, 19 bp, Homo sapiens
gatcaaggtgctcttctca

SEQ ID NO: 6251725 - DNA, 13 bp, Homo sapiens
gatcaagtccaga

SEQ ID NO: 6251726 - DNA, 15 bp, Homo sapiens
gatcaagtccagagc

SEQ ID NO: 6251727 - DNA, 23 bp, Homo sapiens
gatcaagtcggatctagtccagc

SEQ ID NO: 6251728 - DNA, 13 bp, Homo sapiens
gccggcggcctct

SEQ ID NO: 6251729 - DNA, 13 bp, Homo sapiens
gccggcggctctg

SEQ ID NO: 6251730 - DNA, 16 bp, Homo sapiens
gccggcggctctgagc

SEQ ID NO: 6251731 - DNA, 12 bp, Homo sapiens
gccggctctggg

SEQ ID NO: 6251732 - DNA, 17 bp, Homo sapiens
gccggctctgggctggc

SEQ ID NO: 6251733 - DNA, 18 bp, Homo sapiens
gccggctctgggctggct

SEQ ID NO: 6251734 - DNA, 20 bp, Homo sapiens
gccggctctgggctggctgc

SEQ ID NO: 6251735 - DNA, 24 bp, Homo sapiens
gccggctctgggctggctgctcct

SEQ ID NO: 6251736 - DNA, 20 bp, Homo sapiens
gccggctctggtggccactg

SEQ ID NO: 6251737 - DNA, 17 bp, Homo sapiens
gccggctgagtggcagc

SEQ ID NO: 6251738 - DNA, 19 bp, Homo sapiens
gccggctgagtggcagcag

SEQ ID NO: 6251739 - DNA, 12 bp, Homo sapiens
gccggctggccg

SEQ ID NO: 6251740 - DNA, 16 bp, Homo sapiens
gccggctggccggtcc

SEQ ID NO: 6251741 - DNA, 21 bp, Homo sapiens
gccggctggccggtccacccc

SEQ ID NO: 6251742 - DNA, 19 bp, Homo sapiens
gccggctggcctggaggct

SEQ ID NO: 6251743 - DNA, 20 bp, Homo sapiens
gccggctggcctggaggctc

SEQ ID NO: 6251744 - DNA, 12 bp, Homo sapiens
gccggctggtga

SEQ ID NO: 6251745 - DNA, 19 bp, Homo sapiens
gccggctgtgcagtcctgg

SEQ ID NO: 6251746 - DNA, 18 bp, Homo sapiens
gccggctgtgctcagaga

SEQ ID NO: 6251747 - DNA, 19 bp, Homo sapiens
gccggctgtttcctgacag

SEQ ID NO: 6251748 - DNA, 19 bp, Homo sapiens
gccggcttcatgccagcta

SEQ ID NO: 6251749 - DNA, 18 bp, Homo sapiens
gccgggaagagccacctg

SEQ ID NO: 6251750 - DNA, 22 bp, Homo sapiens
gccgggaccaccctgagccggc

SEQ ID NO: 6251751 - DNA, 16 bp, Homo sapiens
gccgggacccagggcc

SEQ ID NO: 6251752 - DNA, 18 bp, Homo sapiens
gccgggaccccgagcctg

SEQ ID NO: 6251753 - DNA, 15 bp, Homo sapiens
gccgggactgctgct

SEQ ID NO: 6251754 - DNA, 18 bp, Homo sapiens
gccgggactgctgctctc

SEQ ID NO: 6251755 - DNA, 21 bp, Homo sapiens
gccgggactgctgctctccca

SEQ ID NO: 6251756 - DNA, 17 bp, Homo sapiens
gccgggagaagccacct

SEQ ID NO: 6251757 - DNA, 14 bp, Homo sapiens
gccgggagcctgac

SEQ ID NO: 6251758 - DNA, 13 bp, Homo sapiens
gccgggagcgagt

SEQ ID NO: 6251759 - DNA, 23 bp, Homo sapiens
gccgggagcgagtaaagtctggg

SEQ ID NO: 6251760 - DNA, 13 bp, Homo sapiens
gccgggaggagcc

SEQ ID NO: 6251761 - DNA, 17 bp, Homo sapiens
gccgggaggcagccaca

SEQ ID NO: 6251762 - DNA, 20 bp, Homo sapiens
gccgggcacagccctcagcg

SEQ ID NO: 6251763 - DNA, 14 bp, Homo sapiens
gccgggcaggcctg

SEQ ID NO: 6251764 - DNA, 12 bp, Homo sapiens
gccgggcaggcg

SEQ ID NO: 6251765 - DNA, 23 bp, Homo sapiens
gccgggcaggcgtgactcagcag

SEQ ID NO: 6251766 - DNA, 14 bp, Homo sapiens
gccgggcaggtcct

SEQ ID NO: 6251767 - DNA, 18 bp, Homo sapiens
gccgggcaggtcctgccc

SEQ ID NO: 6251768 - DNA, 19 bp, Homo sapiens
gccgggcaggtcctgccca

SEQ ID NO: 6251769 - DNA, 11 bp, Homo sapiens
gccgggcatgg

SEQ ID NO: 6251770 - DNA, 17 bp, Homo sapiens
gccgggcatggtggcag

SEQ ID NO: 6251771 - DNA, 14 bp, Homo sapiens
gccgggcccctggg

SEQ ID NO: 6251772 - DNA, 19 bp, Homo sapiens
gccgggcccctgggcttgg

SEQ ID NO: 6251773 - DNA, 13 bp, Homo sapiens
gccgggcctggac

SEQ ID NO: 6251774 - DNA, 22 bp, Homo sapiens
gccgggcctgggcctcctggga

SEQ ID NO: 6251775 - DNA, 14 bp, Homo sapiens
gccgggcctgtaca

SEQ ID NO: 6251776 - DNA, 15 bp, Homo sapiens
gccgggcctgtacag

SEQ ID NO: 6251777 - DNA, 22 bp, Homo sapiens
gccgggcgccaggacagcagca

SEQ ID NO: 6251778 - DNA, 18 bp, Homo sapiens
gccgggcgcggtggctca

SEQ ID NO: 6251779 - DNA, 22 bp, Homo sapiens
gccgggcgcggtggctcacgcc

SEQ ID NO: 6251780 - DNA, 17 bp, Homo sapiens
gccgggcggaaggggac

SEQ ID NO: 6251781 - DNA, 22 bp, Homo sapiens
gccgggcgtggtggcgggcacc

SEQ ID NO: 6251782 - DNA, 12 bp, Homo sapiens
gccgggctctgc

SEQ ID NO: 6251783 - DNA, 21 bp, Homo sapiens
gccgggctgcccttcgctgcc

SEQ ID NO: 6251784 - DNA, 23 bp, Homo sapiens
gccgggctgcccttcgctgccag

SEQ ID NO: 6251785 - DNA, 12 bp, Homo sapiens
gccgggctgctg

SEQ ID NO: 6251786 - DNA, 17 bp, Homo sapiens
gccgggctgctgctgat

SEQ ID NO: 6251787 - DNA, 18 bp, Homo sapiens
gccgggctggcttctccc

SEQ ID NO: 6251788 - DNA, 17 bp, Homo sapiens
gccggggaactggccaa

SEQ ID NO: 6251789 - DNA, 23 bp, Homo sapiens
gccggggaagacttgaaagaaag

SEQ ID NO: 6251790 - DNA, 22 bp, Homo sapiens
gccggggaagagatccaaagac

SEQ ID NO: 6251791 - DNA, 16 bp, Homo sapiens
gccggggaagctgcca

SEQ ID NO: 6251792 - DNA, 19 bp, Homo sapiens
gccggggacagaggcctgc

SEQ ID NO: 6251793 - DNA, 21 bp, Homo sapiens
gccggggacagaggcctgccc

SEQ ID NO: 6251794 - DNA, 14 bp, Homo sapiens
gccggggacccact

SEQ ID NO: 6251795 - DNA, 18 bp, Homo sapiens
gccggggactggccactg

SEQ ID NO: 6251796 - DNA, 17 bp, Homo sapiens
gccggggagctgagggg

SEQ ID NO: 6251797 - DNA, 15 bp, Homo sapiens
gccggggagggggca

SEQ ID NO: 6251798 - DNA, 15 bp, Homo sapiens
gccggggcagccccc

SEQ ID NO: 6251799 - DNA, 20 bp, Homo sapiens
gccggggccacccaaatgtg

SEQ ID NO: 6251800 - DNA, 17 bp, Homo sapiens
gccggggcctgcctagc

SEQ ID NO: 6251801 - DNA, 24 bp, Homo sapiens
gccggggctctgggtgctgccctg

SEQ ID NO: 6251802 - DNA, 14 bp, Homo sapiens
gccggggctggccc

SEQ ID NO: 6251803 - DNA, 15 bp, Homo sapiens
gccggggctggccct

SEQ ID NO: 6251804 - DNA, 19 bp, Homo sapiens
gccggggctggccctgccc

SEQ ID NO: 6251805 - DNA, 21 bp, Homo sapiens
gccggggctggccctgccctc

SEQ ID NO: 6251806 - DNA, 15 bp, Homo sapiens
gccgggggaggggcc

SEQ ID NO: 6251807 - DNA, 19 bp, Homo sapiens
gccgggggaggggccctca

SEQ ID NO: 6251808 - DNA, 17 bp, Homo sapiens
gccgggggaggggcgcg

SEQ ID NO: 6251809 - DNA, 18 bp, Homo sapiens
gccgggggctggccttct

SEQ ID NO: 6251810 - DNA, 19 bp, Homo sapiens
gccggggggggtaggagag

SEQ ID NO: 6251811 - DNA, 14 bp, Homo sapiens
gccgggggtggggg

SEQ ID NO: 6251812 - DNA, 21 bp, Homo sapiens
gccgggggtgggggcctgctg

SEQ ID NO: 6251813 - DNA, 22 bp, Homo sapiens
gccgggggtgggggcctgctgt

SEQ ID NO: 6251814 - DNA, 16 bp, Homo sapiens
gccggggtccaggccc

SEQ ID NO: 6251815 - DNA, 20 bp, Homo sapiens
gccggggtccaggcccgtgg

SEQ ID NO: 6251816 - DNA, 17 bp, Homo sapiens
gccggggtcctgggagg

SEQ ID NO: 6251817 - DNA, 19 bp, Homo sapiens
gccggggtcctgggaggct

SEQ ID NO: 6251818 - DNA, 23 bp, Homo sapiens
gccggggtggggtgcctgagccc

SEQ ID NO: 6251819 - DNA, 22 bp, Homo sapiens
gccggggtgtaacttcctgctg

SEQ ID NO: 6251820 - DNA, 13 bp, Homo sapiens
gccgggtgcggtg

SEQ ID NO: 6251821 - DNA, 17 bp, Homo sapiens
gccgggtgctcagggct

SEQ ID NO: 6251822 - DNA, 21 bp, Homo sapiens
gccgggtggggggagggcacc

SEQ ID NO: 6251823 - DNA, 18 bp, Homo sapiens
gccgggttctagtctcct

SEQ ID NO: 6251824 - DNA, 16 bp, Homo sapiens
gccggtacacagccag

SEQ ID NO: 6251825 - DNA, 14 bp, Homo sapiens
gccggtacctggga

SEQ ID NO: 6251826 - DNA, 16 bp, Homo sapiens
gccggtagaggctccc

SEQ ID NO: 6251827 - DNA, 17 bp, Homo sapiens
gccggtaggctgctggc

SEQ ID NO: 6251828 - DNA, 18 bp, Homo sapiens
gccggtccaccccgtccc

SEQ ID NO: 6251829 - DNA, 15 bp, Homo sapiens
gccggtcccccatgc

SEQ ID NO: 6251830 - DNA, 20 bp, Homo sapiens
gccggtcccccatgccacca

SEQ ID NO: 6251831 - DNA, 16 bp, Homo sapiens
gccggtccggcgcccc

SEQ ID NO: 6251832 - DNA, 22 bp, Homo sapiens
gccggtcgggcagccagcagag

SEQ ID NO: 6251833 - DNA, 17 bp, Homo sapiens
gccggtgagaataagag

SEQ ID NO: 6251834 - DNA, 18 bp, Homo sapiens
gccggtgccagctgccct

SEQ ID NO: 6251835 - DNA, 13 bp, Homo sapiens
gccggtgcctggc

SEQ ID NO: 6251836 - DNA, 15 bp, Homo sapiens
gccggtgctgggttc

SEQ ID NO: 6251837 - DNA, 20 bp, Homo sapiens
gccggtgctgggttcccact

SEQ ID NO: 6251838 - DNA, 13 bp, Homo sapiens
gccggtgggaccc

SEQ ID NO: 6251839 - DNA, 18 bp, Homo sapiens
gccggtgggctagaaagt

SEQ ID NO: 6251840 - DNA, 15 bp, Homo sapiens
gccggttggccggct

SEQ ID NO: 6251841 - DNA, 21 bp, Homo sapiens
gccgtaatggggactctccag

SEQ ID NO: 6251842 - DNA, 20 bp, Homo sapiens
gccgtaattctttctgtctc

SEQ ID NO: 6251843 - DNA, 23 bp, Homo sapiens
gccgtaattctttctgtctccct

SEQ ID NO: 6251844 - DNA, 15 bp, Homo sapiens
gccgtaccccaccct

SEQ ID NO: 6251845 - DNA, 19 bp, Homo sapiens
gccgtagactcacggctgc

SEQ ID NO: 6251846 - DNA, 17 bp, Homo sapiens
gccgtagagggtggccg

SEQ ID NO: 6251847 - DNA, 21 bp, Homo sapiens
gccgtagggagtacctgctgc

SEQ ID NO: 6251848 - DNA, 13 bp, Homo sapiens
gccgtaggggctc

SEQ ID NO: 6251849 - DNA, 17 bp, Homo sapiens
gccgtaggggctcctga

SEQ ID NO: 6251850 - DNA, 19 bp, Homo sapiens
gccgtaggggctcctgagt

SEQ ID NO: 6251851 - DNA, 13 bp, Homo sapiens
gccgtatagtgga

SEQ ID NO: 6251852 - DNA, 23 bp, Homo sapiens
gccgtatctccggctcccagcct

SEQ ID NO: 6251853 - DNA, 15 bp, Homo sapiens
gccgtatctgtcaca

SEQ ID NO: 6251854 - DNA, 16 bp, Homo sapiens
gccgtatctgtcacaa

SEQ ID NO: 6251855 - DNA, 17 bp, Homo sapiens
gccgtcaaggaaagggc

SEQ ID NO: 6251856 - DNA, 18 bp, Homo sapiens
gccgtcaccaccacccct

SEQ ID NO: 6251857 - DNA, 17 bp, Homo sapiens
gccgtcaccctgggagc

SEQ ID NO: 6251858 - DNA, 12 bp, Homo sapiens
gccgtcacgctt

SEQ ID NO: 6251859 - DNA, 13 bp, Homo sapiens
gccgtcagccatc

SEQ ID NO: 6251860 - DNA, 19 bp, Homo sapiens
gccgtcagccatcagccat

SEQ ID NO: 6251861 - DNA, 13 bp, Homo sapiens
gccgtcagcctgt

SEQ ID NO: 6251862 - DNA, 17 bp, Homo sapiens
gccgtcagggtggctgg

SEQ ID NO: 6251863 - DNA, 17 bp, Homo sapiens
gccgtcagtgctgtgct

SEQ ID NO: 6251864 - DNA, 13 bp, Homo sapiens
gccgtcatttcat

SEQ ID NO: 6251865 - DNA, 14 bp, Homo sapiens
gccgtccatggcac

SEQ ID NO: 6251866 - DNA, 16 bp, Homo sapiens
gccgtccatggcacca

SEQ ID NO: 6251867 - DNA, 17 bp, Homo sapiens
gccgtccatggcaccag

SEQ ID NO: 6251868 - DNA, 18 bp, Homo sapiens
gccgtccatggcaccagc

SEQ ID NO: 6251869 - DNA, 22 bp, Homo sapiens
gccgtcccaaccctgcccagcc

SEQ ID NO: 6251870 - DNA, 20 bp, Homo sapiens
gccgtcccaccagcttcact

SEQ ID NO: 6251871 - DNA, 20 bp, Homo sapiens
gccgtcccaggccaccccca

SEQ ID NO: 6251872 - DNA, 18 bp, Homo sapiens
gccgtcccctctcccctt

SEQ ID NO: 6251873 - DNA, 14 bp, Homo sapiens
gccgtccctcctgt

SEQ ID NO: 6251874 - DNA, 13 bp, Homo sapiens
gccgtccctctgc

SEQ ID NO: 6251875 - DNA, 23 bp, Homo sapiens
gccgtcctaacctcgggcctgct

SEQ ID NO: 6251876 - DNA, 14 bp, Homo sapiens
gccgtcctgagggg

SEQ ID NO: 6251877 - DNA, 14 bp, Homo sapiens
gccgtcctgctgga

SEQ ID NO: 6251878 - DNA, 13 bp, Homo sapiens
gccgtccttgtct

SEQ ID NO: 6251879 - DNA, 12 bp, Homo sapiens
gccgtctaactc

SEQ ID NO: 6251880 - DNA, 15 bp, Homo sapiens
gccgtctacctgagg

SEQ ID NO: 6251881 - DNA, 21 bp, Homo sapiens
gccgtctaggattgggcctcc

SEQ ID NO: 6251882 - DNA, 11 bp, Homo sapiens
gccgtctcaac

SEQ ID NO: 6251883 - DNA, 16 bp, Homo sapiens
gccgtctccaggggct

SEQ ID NO: 6251884 - DNA, 14 bp, Homo sapiens
gccgtctcctccct

SEQ ID NO: 6251885 - DNA, 17 bp, Homo sapiens
gccgtctcctccctcag

SEQ ID NO: 6251886 - DNA, 15 bp, Homo sapiens
gccgtctctcctgct

SEQ ID NO: 6251887 - DNA, 12 bp, Homo sapiens
gccgtctctgga

SEQ ID NO: 6251888 - DNA, 14 bp, Homo sapiens
gccgtctgactcca

SEQ ID NO: 6251889 - DNA, 18 bp, Homo sapiens
gccgtctgcaggggcctg

SEQ ID NO: 6251890 - DNA, 20 bp, Homo sapiens
gccgtcttcactcgcccccg

SEQ ID NO: 6251891 - DNA, 21 bp, Homo sapiens
gccgtcttcactcgcccccgg

SEQ ID NO: 6251892 - DNA, 15 bp, Homo sapiens
gccgtcttctgccct

SEQ ID NO: 6251893 - DNA, 19 bp, Homo sapiens
gccgtctttggttcctcat

SEQ ID NO: 6251894 - DNA, 16 bp, Homo sapiens
gccgtgaactgtgcat

SEQ ID NO: 6251895 - DNA, 22 bp, Homo sapiens
gccgtgacgtctgggtggccct

SEQ ID NO: 6251896 - DNA, 23 bp, Homo sapiens
gccgtgagagcccaatcactgcc

SEQ ID NO: 6251897 - DNA, 15 bp, Homo sapiens
gccgtgagcaggctt

SEQ ID NO: 6251898 - DNA, 18 bp, Homo sapiens
gccgtgagcaggctttgg

SEQ ID NO: 6251899 - DNA, 23 bp, Homo sapiens
gccgtgaggacacgtggcctgca

SEQ ID NO: 6251900 - DNA, 21 bp, Homo sapiens
gccgtgagttctcagggctcc

SEQ ID NO: 6251901 - DNA, 19 bp, Homo sapiens
gccgtgcacggggccagca

SEQ ID NO: 6251902 - DNA, 16 bp, Homo sapiens
gccgtgcaggactcta

SEQ ID NO: 6251903 - DNA, 15 bp, Homo sapiens
gccgtgcagggccag

SEQ ID NO: 6251904 - DNA, 19 bp, Homo sapiens
gccgtgcattagcacagat

SEQ ID NO: 6251905 - DNA, 21 bp, Homo sapiens
gccgtgctcgccccagcaggt

SEQ ID NO: 6251906 - DNA, 15 bp, Homo sapiens
gccgtgctgtaaata

SEQ ID NO: 6251907 - DNA, 19 bp, Homo sapiens
gatcaagttgttgactgtg

SEQ ID NO: 6251908 - DNA, 21 bp, Homo sapiens
gatcaagttgttgactgtgat

SEQ ID NO: 6251909 - DNA, 22 bp, Homo sapiens
gatcaagttgttgactgtgatt

SEQ ID NO: 6251910 - DNA, 14 bp, Homo sapiens
gatcaataaaatgt

SEQ ID NO: 6251911 - DNA, 19 bp, Homo sapiens
gatcaatatttttatatca

SEQ ID NO: 6251912 - DNA, 14 bp, Homo sapiens
gatcaatcctttat

SEQ ID NO: 6251913 - DNA, 12 bp, Homo sapiens
gatcaatgacag

SEQ ID NO: 6251914 - DNA, 16 bp, Homo sapiens
gatcaattaaatgtag

SEQ ID NO: 6251915 - DNA, 19 bp, Homo sapiens
gatcaattatagtttctga

SEQ ID NO: 6251916 - DNA, 21 bp, Homo sapiens
gatcaattatagtttctgagg

SEQ ID NO: 6251917 - DNA, 14 bp, Homo sapiens
gatcacaactgaag

SEQ ID NO: 6251918 - DNA, 19 bp, Homo sapiens
gatcacaactgaagataac

SEQ ID NO: 6251919 - DNA, 16 bp, Homo sapiens
gatcacaacttttctg

SEQ ID NO: 6251920 - DNA, 12 bp, Homo sapiens
gatcacaagatg

SEQ ID NO: 6251921 - DNA, 15 bp, Homo sapiens
gatcacaaggtcagg

SEQ ID NO: 6251922 - DNA, 16 bp, Homo sapiens
gatcacaaggtcagga

SEQ ID NO: 6251923 - DNA, 11 bp, Homo sapiens
gatcacacagc

SEQ ID NO: 6251924 - DNA, 13 bp, Homo sapiens
gatcacacagtgt

SEQ ID NO: 6251925 - DNA, 21 bp, Homo sapiens
gatcacacagtgttagtgctg

SEQ ID NO: 6251926 - DNA, 15 bp, Homo sapiens
gatcacagaccacag

SEQ ID NO: 6251927 - DNA, 14 bp, Homo sapiens
gatcacagagcagc

SEQ ID NO: 6251928 - DNA, 20 bp, Homo sapiens
gatcacagatgtgcccagag

SEQ ID NO: 6251929 - DNA, 13 bp, Homo sapiens
gatcacagcccca

SEQ ID NO: 6251930 - DNA, 17 bp, Homo sapiens
gatcacagccccaccct

SEQ ID NO: 6251931 - DNA, 21 bp, Homo sapiens
gatcacagcctcacccctgcc

SEQ ID NO: 6251932 - DNA, 23 bp, Homo sapiens
gatcacagcctcacccctgcccc

SEQ ID NO: 6251933 - DNA, 14 bp, Homo sapiens
gatcacagcctcca

SEQ ID NO: 6251934 - DNA, 20 bp, Homo sapiens
gatcacagcctccagggccc

SEQ ID NO: 6251935 - DNA, 19 bp, Homo sapiens
gatcacagcgtttcaggaa

SEQ ID NO: 6251936 - DNA, 17 bp, Homo sapiens
gatcacagctgctttct

SEQ ID NO: 6251937 - DNA, 13 bp, Homo sapiens
gatcacagggccc

SEQ ID NO: 6251938 - DNA, 13 bp, Homo sapiens
gatcacagtggcc

SEQ ID NO: 6251939 - DNA, 19 bp, Homo sapiens
gatcacagtggccacggcc

SEQ ID NO: 6251940 - DNA, 21 bp, Homo sapiens
gatcacagtggccacggccac

SEQ ID NO: 6251941 - DNA, 18 bp, Homo sapiens
gatcacataacagaatgc

SEQ ID NO: 6251942 - DNA, 18 bp, Homo sapiens
gatcacataccagagtct

SEQ ID NO: 6251943 - DNA, 15 bp, Homo sapiens
gatcacatgcccctc

SEQ ID NO: 6251944 - DNA, 19 bp, Homo sapiens
gatcaccatgtattttgta

SEQ ID NO: 6251945 - DNA, 19 bp, Homo sapiens
gatcaccatgttagcctta

SEQ ID NO: 6251946 - DNA, 17 bp, Homo sapiens
gatcacccactcctatg

SEQ ID NO: 6251947 - DNA, 17 bp, Homo sapiens
gatcacgacgctgcaga

SEQ ID NO: 6251948 - DNA, 23 bp, Homo sapiens
gatcacgccactgcactccagcc

SEQ ID NO: 6251949 - DNA, 21 bp, Homo sapiens
gatcacgccattgtactccag

SEQ ID NO: 6251950 - DNA, 14 bp, Homo sapiens
gatcacgcctggct

SEQ ID NO: 6251951 - DNA, 13 bp, Homo sapiens
gatcacgctcccc

SEQ ID NO: 6251952 - DNA, 16 bp, Homo sapiens
gatcacggctcactgc

SEQ ID NO: 6251953 - DNA, 23 bp, Homo sapiens
gatcacggctcactgcagcctca

SEQ ID NO: 6251954 - DNA, 12 bp, Homo sapiens
gatcactactgc

SEQ ID NO: 6251955 - DNA, 20 bp, Homo sapiens
gatcactcaaaaaggtgtgt

SEQ ID NO: 6251956 - DNA, 15 bp, Homo sapiens
gatcactctctgctg

SEQ ID NO: 6251957 - DNA, 15 bp, Homo sapiens
gatcactgaactttt

SEQ ID NO: 6251958 - DNA, 16 bp, Homo sapiens
gatcactgaacttttc

SEQ ID NO: 6251959 - DNA, 17 bp, Homo sapiens
gatcactgaacttttca

SEQ ID NO: 6251960 - DNA, 22 bp, Homo sapiens
gatcactgaacttttcaaaata

SEQ ID NO: 6251961 - DNA, 23 bp, Homo sapiens
gatcactgaacttttcaaaataa

SEQ ID NO: 6251962 - DNA, 16 bp, Homo sapiens
gatcactgaatttata

SEQ ID NO: 6251963 - DNA, 20 bp, Homo sapiens
gatcactgactctgactcat

SEQ ID NO: 6251964 - DNA, 13 bp, Homo sapiens
gatcactgagcca

SEQ ID NO: 6251965 - DNA, 16 bp, Homo sapiens
gatcactgccacactc

SEQ ID NO: 6251966 - DNA, 20 bp, Homo sapiens
gatcactgtgaaccaacccc

SEQ ID NO: 6251967 - DNA, 14 bp, Homo sapiens
gatcactgtttaga

SEQ ID NO: 6251968 - DNA, 18 bp, Homo sapiens
gatcacttaagcccagga

SEQ ID NO: 6251969 - DNA, 19 bp, Homo sapiens
gatcacttaagcccaggag

SEQ ID NO: 6251970 - DNA, 12 bp, Homo sapiens
gatcacttgagc

SEQ ID NO: 6251971 - DNA, 21 bp, Homo sapiens
gatcacttgagcccaggaagt

SEQ ID NO: 6251972 - DNA, 19 bp, Homo sapiens
gatcacttgatgccaggag

SEQ ID NO: 6251973 - DNA, 18 bp, Homo sapiens
gatcacttgggcccagga

SEQ ID NO: 6251974 - DNA, 21 bp, Homo sapiens
gatcacttgggcccaggaggt

SEQ ID NO: 6251975 - DNA, 17 bp, Homo sapiens
gatcacttgttgtttta

SEQ ID NO: 6251976 - DNA, 14 bp, Homo sapiens
gatcactttctgaa

SEQ ID NO: 6251977 - DNA, 15 bp, Homo sapiens
gatcactttgctctg

SEQ ID NO: 6251978 - DNA, 20 bp, Homo sapiens
gatcagaaagtaatttcttc

SEQ ID NO: 6251979 - DNA, 14 bp, Homo sapiens
gatcagaacatgaa

SEQ ID NO: 6251980 - DNA, 16 bp, Homo sapiens
gatcagaacattcagc

SEQ ID NO: 6251981 - DNA, 22 bp, Homo sapiens
gatcagaacattcagctctgga

SEQ ID NO: 6251982 - DNA, 23 bp, Homo sapiens
gatcagaacattcagctctggag

SEQ ID NO: 6251983 - DNA, 12 bp, Homo sapiens
gatcagaaggct

SEQ ID NO: 6251984 - DNA, 14 bp, Homo sapiens
gatcagaaggctgg

SEQ ID NO: 6251985 - DNA, 15 bp, Homo sapiens
gatcagaaggctggg

SEQ ID NO: 6251986 - DNA, 19 bp, Homo sapiens
gatcagacattcagagatt

SEQ ID NO: 6251987 - DNA, 16 bp, Homo sapiens
gatcagaccataatgt

SEQ ID NO: 6251988 - DNA, 16 bp, Homo sapiens
gatcagacttgattta

SEQ ID NO: 6251989 - DNA, 17 bp, Homo sapiens
gatcagagcaggacctc

SEQ ID NO: 6251990 - DNA, 23 bp, Homo sapiens
gatcagagcaggacctcccttcc

SEQ ID NO: 6251991 - DNA, 16 bp, Homo sapiens
gatcagagccgtggtc

SEQ ID NO: 6251992 - DNA, 20 bp, Homo sapiens
gatcagaggcatttgagcag

SEQ ID NO: 6251993 - DNA, 22 bp, Homo sapiens
gatcagaggtcatcccttcctc

SEQ ID NO: 6251994 - DNA, 16 bp, Homo sapiens
gatcagaggtgtacac

SEQ ID NO: 6251995 - DNA, 22 bp, Homo sapiens
gatcagagtctggcctgccagg

SEQ ID NO: 6251996 - DNA, 16 bp, Homo sapiens
gatcagagttcctcct

SEQ ID NO: 6251997 - DNA, 20 bp, Homo sapiens
gatcagatgctgaattgaga

SEQ ID NO: 6251998 - DNA, 23 bp, Homo sapiens
gatcagatgctgaattgagaata

SEQ ID NO: 6251999 - DNA, 23 bp, Homo sapiens
gatcagattgcatgtgactctga

SEQ ID NO: 6252000 - DNA, 14 bp, Homo sapiens
gatcagcaaaaaga

SEQ ID NO: 6252001 - DNA, 15 bp, Homo sapiens
gatcagcagcgtgca

SEQ ID NO: 6252002 - DNA, 23 bp, Homo sapiens
gatcagcatccaaaagcaggaac

SEQ ID NO: 6252003 - DNA, 18 bp, Homo sapiens
gatcagcatgcctgtcct

SEQ ID NO: 6252004 - DNA, 12 bp, Homo sapiens
gatcagccatta

SEQ ID NO: 6252005 - DNA, 17 bp, Homo sapiens
gatcagccattaaaata

SEQ ID NO: 6252006 - DNA, 20 bp, Homo sapiens
gatcagccattaaaataaaa

SEQ ID NO: 6252007 - DNA, 21 bp, Homo sapiens
gatcagccattaaaataaaac

SEQ ID NO: 6252008 - DNA, 23 bp, Homo sapiens
gatcagccattaaaataaaacaa

SEQ ID NO: 6252009 - DNA, 16 bp, Homo sapiens
gatcagccccaccctg

SEQ ID NO: 6252010 - DNA, 18 bp, Homo sapiens
gatcagccccgcctgtca

SEQ ID NO: 6252011 - DNA, 19 bp, Homo sapiens
gatcagccccgcctgtcac

SEQ ID NO: 6252012 - DNA, 15 bp, Homo sapiens
gatcagcctgggcaa

SEQ ID NO: 6252013 - DNA, 21 bp, Homo sapiens
gatcagccttatgtggaagaa

SEQ ID NO: 6252014 - DNA, 18 bp, Homo sapiens
gatcagctgtttgtcata

SEQ ID NO: 6252015 - DNA, 19 bp, Homo sapiens
gatcaggaaccagggcctc

SEQ ID NO: 6252016 - DNA, 15 bp, Homo sapiens
gatcaggaagagaag

SEQ ID NO: 6252017 - DNA, 17 bp, Homo sapiens
gatcaggcacaggtcag

SEQ ID NO: 6252018 - DNA, 16 bp, Homo sapiens
gatcaggccccacccc

SEQ ID NO: 6252019 - DNA, 19 bp, Homo sapiens
gatcaggctagccctgccc

SEQ ID NO: 6252020 - DNA, 21 bp, Homo sapiens
gatcaggctagccctgccctc

SEQ ID NO: 6252021 - DNA, 14 bp, Homo sapiens
gatcaggctctgcc

SEQ ID NO: 6252022 - DNA, 17 bp, Homo sapiens
gatcagggaatccagct

SEQ ID NO: 6252023 - DNA, 18 bp, Homo sapiens
gatcagggaatccagctc

SEQ ID NO: 6252024 - DNA, 17 bp, Homo sapiens
gatcagggcattgcctg

SEQ ID NO: 6252025 - DNA, 18 bp, Homo sapiens
gatcagggcctgccccct

SEQ ID NO: 6252026 - DNA, 21 bp, Homo sapiens
gatcagggcctgccccctggg

SEQ ID NO: 6252027 - DNA, 23 bp, Homo sapiens
gatcaggtctttactgaatgtta

SEQ ID NO: 6252028 - DNA, 13 bp, Homo sapiens
gatcaggtgggga

SEQ ID NO: 6252029 - DNA, 23 bp, Homo sapiens
gatcagtatgctgttttaataat

SEQ ID NO: 6252030 - DNA, 23 bp, Homo sapiens
gatcagtcctttgatcagtataa

SEQ ID NO: 6252031 - DNA, 13 bp, Homo sapiens
gatcagtgatttt

SEQ ID NO: 6252032 - DNA, 13 bp, Homo sapiens
gatcagtggacag

SEQ ID NO: 6252033 - DNA, 23 bp, Homo sapiens
gatcagtgggcctccaaggaggg

SEQ ID NO: 6252034 - DNA, 21 bp, Homo sapiens
gatcagtggggccccaaagcc

SEQ ID NO: 6252035 - DNA, 16 bp, Homo sapiens
gatcagtgtgctaacc

SEQ ID NO: 6252036 - DNA, 21 bp, Homo sapiens
gatcagttaagaaatttcaca

SEQ ID NO: 6252037 - DNA, 18 bp, Homo sapiens
gatcagttataagtagca

SEQ ID NO: 6252038 - DNA, 17 bp, Homo sapiens
gatcagttgctctctgt

SEQ ID NO: 6252039 - DNA, 15 bp, Homo sapiens
gatcagttttcctag

SEQ ID NO: 6252040 - DNA, 15 bp, Homo sapiens
gatcataaactgact

SEQ ID NO: 6252041 - DNA, 13 bp, Homo sapiens
gatcataaggctt

SEQ ID NO: 6252042 - DNA, 18 bp, Homo sapiens
gatcatagatttctgatt

SEQ ID NO: 6252043 - DNA, 23 bp, Homo sapiens
gatcatagatttctgattttatg

SEQ ID NO: 6252044 - DNA, 18 bp, Homo sapiens
gatcataggtatttcaaa

SEQ ID NO: 6252045 - DNA, 15 bp, Homo sapiens
gatcatagttgcaaa

SEQ ID NO: 6252046 - DNA, 13 bp, Homo sapiens
gatcatagtttta

SEQ ID NO: 6252047 - DNA, 22 bp, Homo sapiens
gatcatagttttatttatattt

SEQ ID NO: 6252048 - DNA, 19 bp, Homo sapiens
gatcatatacgtgaaaatt

SEQ ID NO: 6252049 - DNA, 15 bp, Homo sapiens
gatcatatgaccatt

SEQ ID NO: 6252050 - DNA, 19 bp, Homo sapiens
gatcatatggagctcatgt

SEQ ID NO: 6252051 - DNA, 20 bp, Homo sapiens
gatcatatggagctcatgtc

SEQ ID NO: 6252052 - DNA, 16 bp, Homo sapiens
gatcatatggtaggac

SEQ ID NO: 6252053 - DNA, 19 bp, Homo sapiens
gatcatatggtaggaccct

SEQ ID NO: 6252054 - DNA, 15 bp, Homo sapiens
gatcatcatgtagaa

SEQ ID NO: 6252055 - DNA, 23 bp, Homo sapiens
gatcatcatttaaaaaaaaagaa

SEQ ID NO: 6252056 - DNA, 16 bp, Homo sapiens
gatcatccactgtgcc

SEQ ID NO: 6252057 - DNA, 17 bp, Homo sapiens
gatcatccactgtgcca

SEQ ID NO: 6252058 - DNA, 21 bp, Homo sapiens
gatcatccactgtgccatgtg

SEQ ID NO: 6252059 - DNA, 13 bp, Homo sapiens
gatcatccctttc

SEQ ID NO: 6252060 - DNA, 16 bp, Homo sapiens
gatcatccctttctcc

SEQ ID NO: 6252061 - DNA, 14 bp, Homo sapiens
gatcatcgccagag

SEQ ID NO: 6252062 - DNA, 23 bp, Homo sapiens
gatcatcgtcatttgctgtgaac

SEQ ID NO: 6252063 - DNA, 20 bp, Homo sapiens
gatcatctccaaatcttgcc

SEQ ID NO: 6252064 - DNA, 13 bp, Homo sapiens
gatcatctctgtg

SEQ ID NO: 6252065 - DNA, 14 bp, Homo sapiens
gatcatctgctgtg

SEQ ID NO: 6252066 - DNA, 14 bp, Homo sapiens
gatcatctggggac

SEQ ID NO: 6252067 - DNA, 19 bp, Homo sapiens
gatcatctttgctgaatgt

SEQ ID NO: 6252068 - DNA, 13 bp, Homo sapiens
gatcatgaaaagt

SEQ ID NO: 6252069 - DNA, 21 bp, Homo sapiens
gatcatgaattatataatttt

SEQ ID NO: 6252070 - DNA, 17 bp, Homo sapiens
gatcatgatagacttgt

SEQ ID NO: 6252071 - DNA, 14 bp, Homo sapiens
gatcatgcaggaac

SEQ ID NO: 6252072 - DNA, 14 bp, Homo sapiens
gatcatgcatagag

SEQ ID NO: 6252073 - DNA, 13 bp, Homo sapiens
gatcatgcattgt

SEQ ID NO: 6252074 - DNA, 16 bp, Homo sapiens
gatcatgctgcagtgg

SEQ ID NO: 6252075 - DNA, 14 bp, Homo sapiens
gatcatggtgtaat

SEQ ID NO: 6252076 - DNA, 15 bp, Homo sapiens
gatcatggtgtaata

SEQ ID NO: 6252077 - DNA, 21 bp, Homo sapiens
gatcatggtgtaataagacat

SEQ ID NO: 6252078 - DNA, 20 bp, Homo sapiens
gatcatgtactttttagtaa

SEQ ID NO: 6252079 - DNA, 15 bp, Homo sapiens
gatcatgtgtggaag

SEQ ID NO: 6252080 - DNA, 21 bp, Homo sapiens
gatcatgtgtggaagttatta

SEQ ID NO: 6252081 - DNA, 22 bp, Homo sapiens
gatcatgttatgatttgtaaca

SEQ ID NO: 6252082 - DNA, 18 bp, Homo sapiens
gatcattacatggctgtg

SEQ ID NO: 6252083 - DNA, 17 bp, Homo sapiens
gatcattatttcatgac

SEQ ID NO: 6252084 - DNA, 23 bp, Homo sapiens
gatcattgaaagtaaaaaataac

SEQ ID NO: 6252085 - DNA, 18 bp, Homo sapiens
gccgtggatggccgtgga

SEQ ID NO: 6252086 - DNA, 21 bp, Homo sapiens
gccgtggattgcacgtggcct

SEQ ID NO: 6252087 - DNA, 22 bp, Homo sapiens
gccgtggattgcacgtggcctc

SEQ ID NO: 6252088 - DNA, 15 bp, Homo sapiens
gccgtggcacagctg

SEQ ID NO: 6252089 - DNA, 15 bp, Homo sapiens
gccgtggccagaggc

SEQ ID NO: 6252090 - DNA, 20 bp, Homo sapiens
gccgtggccatcagggtggg

SEQ ID NO: 6252091 - DNA, 22 bp, Homo sapiens
gccgtggctccagaatgtgctg

SEQ ID NO: 6252092 - DNA, 18 bp, Homo sapiens
gccgtggcttgggctggt

SEQ ID NO: 6252093 - DNA, 21 bp, Homo sapiens
gccgtggcttgggctggtcag

SEQ ID NO: 6252094 - DNA, 17 bp, Homo sapiens
gccgtgggacccaggct

SEQ ID NO: 6252095 - DNA, 15 bp, Homo sapiens
gccgtgggccgggag

SEQ ID NO: 6252096 - DNA, 15 bp, Homo sapiens
gccgtgggcctgggg

SEQ ID NO: 6252097 - DNA, 20 bp, Homo sapiens
gccgtggggccgccgcctct

SEQ ID NO: 6252098 - DNA, 22 bp, Homo sapiens
gccgtggggctccggaggggac

SEQ ID NO: 6252099 - DNA, 23 bp, Homo sapiens
gccgtggtccaaccaggagctga

SEQ ID NO: 6252100 - DNA, 15 bp, Homo sapiens
gccgtggtccagctc

SEQ ID NO: 6252101 - DNA, 16 bp, Homo sapiens
gccgtggtccagctct

SEQ ID NO: 6252102 - DNA, 18 bp, Homo sapiens
gccgtggtccagctcttg

SEQ ID NO: 6252103 - DNA, 19 bp, Homo sapiens
gccgtggtccagctcttgg

SEQ ID NO: 6252104 - DNA, 15 bp, Homo sapiens
gccgtggtccctgag

SEQ ID NO: 6252105 - DNA, 17 bp, Homo sapiens
gccgtggtgacccctgc

SEQ ID NO: 6252106 - DNA, 15 bp, Homo sapiens
gccgtgtctctgagg

SEQ ID NO: 6252107 - DNA, 17 bp, Homo sapiens
gccgtgtctgtggccct

SEQ ID NO: 6252108 - DNA, 21 bp, Homo sapiens
gccgtgtctgtggccctctct

SEQ ID NO: 6252109 - DNA, 18 bp, Homo sapiens
gccgtgtgagtgtgacag

SEQ ID NO: 6252110 - DNA, 19 bp, Homo sapiens
gccgtgtgtttagaagcct

SEQ ID NO: 6252111 - DNA, 21 bp, Homo sapiens
gccgtgttactgttgcactga

SEQ ID NO: 6252112 - DNA, 22 bp, Homo sapiens
gccgttagggaaatccaactcc

SEQ ID NO: 6252113 - DNA, 16 bp, Homo sapiens
gccgttccccttggct

SEQ ID NO: 6252114 - DNA, 14 bp, Homo sapiens
gccgttctgttcca

SEQ ID NO: 6252115 - DNA, 19 bp, Homo sapiens
gccgttctgttccaacctc

SEQ ID NO: 6252116 - DNA, 18 bp, Homo sapiens
gccgttgaatctgggagg

SEQ ID NO: 6252117 - DNA, 17 bp, Homo sapiens
gccgttgatgttggctg

SEQ ID NO: 6252118 - DNA, 20 bp, Homo sapiens
gccgttgcctctctgccagc

SEQ ID NO: 6252119 - DNA, 13 bp, Homo sapiens
gccgttgtttact

SEQ ID NO: 6252120 - DNA, 11 bp, Homo sapiens
gccgtttgctt

SEQ ID NO: 6252121 - DNA, 21 bp, Homo sapiens
gccgttttcttacacaccccc

SEQ ID NO: 6252122 - DNA, 17 bp, Homo sapiens
gcctaaaaatgcaactt

SEQ ID NO: 6252123 - DNA, 19 bp, Homo sapiens
gcctaaaaattcccttcct

SEQ ID NO: 6252124 - DNA, 23 bp, Homo sapiens
gcctaaaacgaatggtctttgct

SEQ ID NO: 6252125 - DNA, 20 bp, Homo sapiens
gcctaaaagattttgtgaaa

SEQ ID NO: 6252126 - DNA, 15 bp, Homo sapiens
gcctaaaagtaaaca

SEQ ID NO: 6252127 - DNA, 21 bp, Homo sapiens
gcctaaaatataatttttaat

SEQ ID NO: 6252128 - DNA, 23 bp, Homo sapiens
gcctaaaatataatttttaattt

SEQ ID NO: 6252129 - DNA, 13 bp, Homo sapiens
gcctaaaatcttg

SEQ ID NO: 6252130 - DNA, 20 bp, Homo sapiens
gcctaaaatcttggaagtac

SEQ ID NO: 6252131 - DNA, 20 bp, Homo sapiens
gcctaaaattgtatgaaaat

SEQ ID NO: 6252132 - DNA, 16 bp, Homo sapiens
gcctaaagggcagggc

SEQ ID NO: 6252133 - DNA, 21 bp, Homo sapiens
gcctaaagtacagcctggacc

SEQ ID NO: 6252134 - DNA, 23 bp, Homo sapiens
gcctaaataggtttttcttgcta

SEQ ID NO: 6252135 - DNA, 12 bp, Homo sapiens
gcctaaatccat

SEQ ID NO: 6252136 - DNA, 13 bp, Homo sapiens
gcctaaatccatt

SEQ ID NO: 6252137 - DNA, 21 bp, Homo sapiens
gcctaaatccatttggaaatc

SEQ ID NO: 6252138 - DNA, 22 bp, Homo sapiens
gcctaaatccatttggaaatct

SEQ ID NO: 6252139 - DNA, 23 bp, Homo sapiens
gcctaaatccatttggaaatctt

SEQ ID NO: 6252140 - DNA, 19 bp, Homo sapiens
gcctaaatcccaagaaatg

SEQ ID NO: 6252141 - DNA, 19 bp, Homo sapiens
gcctaaatttaatgctgcc

SEQ ID NO: 6252142 - DNA, 18 bp, Homo sapiens
gcctaaatttattaaata

SEQ ID NO: 6252143 - DNA, 13 bp, Homo sapiens
gcctaaatttcac

SEQ ID NO: 6252144 - DNA, 13 bp, Homo sapiens
gcctaaccaggcc

SEQ ID NO: 6252145 - DNA, 15 bp, Homo sapiens
gcctaaccaggccca

SEQ ID NO: 6252146 - DNA, 22 bp, Homo sapiens
gcctaaccatgggctcagggcc

SEQ ID NO: 6252147 - DNA, 18 bp, Homo sapiens
gcctaactactagttttt

SEQ ID NO: 6252148 - DNA, 14 bp, Homo sapiens
gcctaacttgtaaa

SEQ ID NO: 6252149 - DNA, 14 bp, Homo sapiens
gcctaagaagaagg

SEQ ID NO: 6252150 - DNA, 14 bp, Homo sapiens
gcctaagaagctct

SEQ ID NO: 6252151 - DNA, 20 bp, Homo sapiens
gcctaagaagttattttctt

SEQ ID NO: 6252152 - DNA, 20 bp, Homo sapiens
gcctaagacatgtgaggagg

SEQ ID NO: 6252153 - DNA, 21 bp, Homo sapiens
gcctaagatatacttgttttt

SEQ ID NO: 6252154 - DNA, 18 bp, Homo sapiens
gcctaagcattgcctggc

SEQ ID NO: 6252155 - DNA, 12 bp, Homo sapiens
gcctaaggccct

SEQ ID NO: 6252156 - DNA, 15 bp, Homo sapiens
gcctaaggctgctgt

SEQ ID NO: 6252157 - DNA, 23 bp, Homo sapiens
gcctaagggatcctgcctgcccc

SEQ ID NO: 6252158 - DNA, 12 bp, Homo sapiens
gcctaagtatta

SEQ ID NO: 6252159 - DNA, 16 bp, Homo sapiens
gcctaagtggctgctg

SEQ ID NO: 6252160 - DNA, 18 bp, Homo sapiens
gcctaagtgtggagaagg

SEQ ID NO: 6252161 - DNA, 12 bp, Homo sapiens
gcctaataaaac

SEQ ID NO: 6252162 - DNA, 23 bp, Homo sapiens
gcctaataaaactgatgtgaaac

SEQ ID NO: 6252163 - DNA, 11 bp, Homo sapiens
gcctaataaag

SEQ ID NO: 6252164 - DNA, 12 bp, Homo sapiens
gcctaataaaga

SEQ ID NO: 6252165 - DNA, 13 bp, Homo sapiens
gcctaatattcat

SEQ ID NO: 6252166 - DNA, 16 bp, Homo sapiens
gcctaatattcatgct

SEQ ID NO: 6252167 - DNA, 14 bp, Homo sapiens
gcctaatccacctg

SEQ ID NO: 6252168 - DNA, 14 bp, Homo sapiens
gcctaatccctggg

SEQ ID NO: 6252169 - DNA, 19 bp, Homo sapiens
gcctaatgcattattttgt

SEQ ID NO: 6252170 - DNA, 17 bp, Homo sapiens
gcctaattcctggcatg

SEQ ID NO: 6252171 - DNA, 21 bp, Homo sapiens
gcctaattggaaagtgccagc

SEQ ID NO: 6252172 - DNA, 18 bp, Homo sapiens
gcctaattgtcacatcaa

SEQ ID NO: 6252173 - DNA, 21 bp, Homo sapiens
gcctaattgtcacatcaagca

SEQ ID NO: 6252174 - DNA, 14 bp, Homo sapiens
gcctaatttacaag

SEQ ID NO: 6252175 - DNA, 18 bp, Homo sapiens
gcctacaaagagatgctt

SEQ ID NO: 6252176 - DNA, 17 bp, Homo sapiens
gcctacaaccatccctg

SEQ ID NO: 6252177 - DNA, 13 bp, Homo sapiens
gcctacaataaaa

SEQ ID NO: 6252178 - DNA, 13 bp, Homo sapiens
gcctacactgcca

SEQ ID NO: 6252179 - DNA, 20 bp, Homo sapiens
gcctacagaacttcagaaag

SEQ ID NO: 6252180 - DNA, 21 bp, Homo sapiens
gcctacagaacttcagaaaga

SEQ ID NO: 6252181 - DNA, 16 bp, Homo sapiens
gcctacagaggaggcc

SEQ ID NO: 6252182 - DNA, 19 bp, Homo sapiens
gcctacagaggaggcctca

SEQ ID NO: 6252183 - DNA, 22 bp, Homo sapiens
gcctacagctttgatccctgac

SEQ ID NO: 6252184 - DNA, 17 bp, Homo sapiens
gcctacaggagtgagca

SEQ ID NO: 6252185 - DNA, 14 bp, Homo sapiens
gcctacattatcta

SEQ ID NO: 6252186 - DNA, 16 bp, Homo sapiens
gcctacattccctggc

SEQ ID NO: 6252187 - DNA, 20 bp, Homo sapiens
gcctacattccctggcctgg

SEQ ID NO: 6252188 - DNA, 14 bp, Homo sapiens
gcctacattcttta

SEQ ID NO: 6252189 - DNA, 18 bp, Homo sapiens
gcctaccaatctctgctc

SEQ ID NO: 6252190 - DNA, 13 bp, Homo sapiens
gcctaccacagct

SEQ ID NO: 6252191 - DNA, 17 bp, Homo sapiens
gcctaccacagctgcct

SEQ ID NO: 6252192 - DNA, 22 bp, Homo sapiens
gcctaccacagctgcctccggg

SEQ ID NO: 6252193 - DNA, 16 bp, Homo sapiens
gcctaccagtcgccct

SEQ ID NO: 6252194 - DNA, 16 bp, Homo sapiens
gcctacccacccccag

SEQ ID NO: 6252195 - DNA, 17 bp, Homo sapiens
gcctacccacccccagg

SEQ ID NO: 6252196 - DNA, 22 bp, Homo sapiens
gcctacccaccccttcccgccc

SEQ ID NO: 6252197 - DNA, 17 bp, Homo sapiens
gcctaccccagttccta

SEQ ID NO: 6252198 - DNA, 20 bp, Homo sapiens
gcctaccccagttcctagca

SEQ ID NO: 6252199 - DNA, 20 bp, Homo sapiens
gcctaccgctggccctgccg

SEQ ID NO: 6252200 - DNA, 21 bp, Homo sapiens
gcctaccgtatttcagccatg

SEQ ID NO: 6252201 - DNA, 22 bp, Homo sapiens
gcctacctcaagttcttggacc

SEQ ID NO: 6252202 - DNA, 15 bp, Homo sapiens
gcctacctcactctc

SEQ ID NO: 6252203 - DNA, 16 bp, Homo sapiens
gcctacctcagcctcc

SEQ ID NO: 6252204 - DNA, 14 bp, Homo sapiens
gcctacctctgtct

SEQ ID NO: 6252205 - DNA, 22 bp, Homo sapiens
gcctacctctgtctgagacagg

SEQ ID NO: 6252206 - DNA, 13 bp, Homo sapiens
gcctacctgctcc

SEQ ID NO: 6252207 - DNA, 14 bp, Homo sapiens
gcctacctgctccc

SEQ ID NO: 6252208 - DNA, 17 bp, Homo sapiens
gcctaccttgtgaggga

SEQ ID NO: 6252209 - DNA, 21 bp, Homo sapiens
gcctaccttgtgagggagaga

SEQ ID NO: 6252210 - DNA, 12 bp, Homo sapiens
gcctacgccagg

SEQ ID NO: 6252211 - DNA, 15 bp, Homo sapiens
gcctacgccaggaga

SEQ ID NO: 6252212 - DNA, 16 bp, Homo sapiens
gcctacgccaggagaa

SEQ ID NO: 6252213 - DNA, 20 bp, Homo sapiens
gcctactagggacctgggga

SEQ ID NO: 6252214 - DNA, 23 bp, Homo sapiens
gcctactcctgtcttctgctttg

SEQ ID NO: 6252215 - DNA, 19 bp, Homo sapiens
gcctactgaaaatgcattt

SEQ ID NO: 6252216 - DNA, 21 bp, Homo sapiens
gcctactggggggctttggcc

SEQ ID NO: 6252217 - DNA, 23 bp, Homo sapiens
gcctactgtccctctcagtgcct

SEQ ID NO: 6252218 - DNA, 13 bp, Homo sapiens
gcctactgtctcc

SEQ ID NO: 6252219 - DNA, 13 bp, Homo sapiens
gcctactgttact

SEQ ID NO: 6252220 - DNA, 12 bp, Homo sapiens
gcctacttttct

SEQ ID NO: 6252221 - DNA, 18 bp, Homo sapiens
gcctacttttggcctcat

SEQ ID NO: 6252222 - DNA, 18 bp, Homo sapiens
gcctagaaacaacactgt

SEQ ID NO: 6252223 - DNA, 20 bp, Homo sapiens
gcctagaacaagccagagcc

SEQ ID NO: 6252224 - DNA, 21 bp, Homo sapiens
gcctagaacaagccagagccg

SEQ ID NO: 6252225 - DNA, 22 bp, Homo sapiens
gcctagaacaagccagagccgc

SEQ ID NO: 6252226 - DNA, 20 bp, Homo sapiens
gcctagaacatccctgggca

SEQ ID NO: 6252227 - DNA, 14 bp, Homo sapiens
gcctagaccagcag

SEQ ID NO: 6252228 - DNA, 16 bp, Homo sapiens
gcctagactgtgtatg

SEQ ID NO: 6252229 - DNA, 13 bp, Homo sapiens
gcctagagctcta

SEQ ID NO: 6252230 - DNA, 12 bp, Homo sapiens
gcctagaggagg

SEQ ID NO: 6252231 - DNA, 17 bp, Homo sapiens
gcctagaggtcccctca

SEQ ID NO: 6252232 - DNA, 18 bp, Homo sapiens
gcctagaggtcccctcac

SEQ ID NO: 6252233 - DNA, 14 bp, Homo sapiens
gcctagagtgtagc

SEQ ID NO: 6252234 - DNA, 16 bp, Homo sapiens
gcctagagtgtagcct

SEQ ID NO: 6252235 - DNA, 20 bp, Homo sapiens
gcctagattaggtagacttt

SEQ ID NO: 6252236 - DNA, 12 bp, Homo sapiens
gcctagcaagct

SEQ ID NO: 6252237 - DNA, 19 bp, Homo sapiens
gcctagcaagctggcctct

SEQ ID NO: 6252238 - DNA, 15 bp, Homo sapiens
gcctagcagagtgct

SEQ ID NO: 6252239 - DNA, 19 bp, Homo sapiens
gcctagcagagtgctggca

SEQ ID NO: 6252240 - DNA, 22 bp, Homo sapiens
gcctagcagagtgctggcactt

SEQ ID NO: 6252241 - DNA, 13 bp, Homo sapiens
gcctagcaggcac

SEQ ID NO: 6252242 - DNA, 20 bp, Homo sapiens
gcctagcatacgtacacatt

SEQ ID NO: 6252243 - DNA, 22 bp, Homo sapiens
gcctagcatacgtacacatttt

SEQ ID NO: 6252244 - DNA, 18 bp, Homo sapiens
gcctagcatggggtcagc

SEQ ID NO: 6252245 - DNA, 15 bp, Homo sapiens
gcctagccacctccc

SEQ ID NO: 6252246 - DNA, 19 bp, Homo sapiens
gcctagccacctcccaccc

SEQ ID NO: 6252247 - DNA, 16 bp, Homo sapiens
gcctagcccaccctgc

SEQ ID NO: 6252248 - DNA, 22 bp, Homo sapiens
gcctagcccaccctgctgcctt

SEQ ID NO: 6252249 - DNA, 15 bp, Homo sapiens
gcctagccgacctca

SEQ ID NO: 6252250 - DNA, 16 bp, Homo sapiens
gcctagccgacctcag

SEQ ID NO: 6252251 - DNA, 17 bp, Homo sapiens
gcctagccgacctcagc

SEQ ID NO: 6252252 - DNA, 18 bp, Homo sapiens
gcctagccgacctcagcc

SEQ ID NO: 6252253 - DNA, 20 bp, Homo sapiens
gcctagccgacctcagcctt

SEQ ID NO: 6252254 - DNA, 17 bp, Homo sapiens
gcctagcctatgtctgg

SEQ ID NO: 6252255 - DNA, 22 bp, Homo sapiens
gcctagcctatgtctggcagat

SEQ ID NO: 6252256 - DNA, 15 bp, Homo sapiens
gcctagcctgagcca

SEQ ID NO: 6252257 - DNA, 17 bp, Homo sapiens
gcctagcgatctctcct

SEQ ID NO: 6252258 - DNA, 16 bp, Homo sapiens
gcctagcggagcccag

SEQ ID NO: 6252259 - DNA, 18 bp, Homo sapiens
gcctagcggagcccagcc

SEQ ID NO: 6252260 - DNA, 15 bp, Homo sapiens
gcctagctcctgcca

SEQ ID NO: 6252261 - DNA, 23 bp, Homo sapiens
gcctagctcctgccacatggagc

SEQ ID NO: 6252262 - DNA, 14 bp, Homo sapiens
gcctagctcttggg

SEQ ID NO: 6252263 - DNA, 14 bp, Homo sapiens
gatcattgaaatac

SEQ ID NO: 6252264 - DNA, 19 bp, Homo sapiens
gatcattgcagtatcagag

SEQ ID NO: 6252265 - DNA, 12 bp, Homo sapiens
gatcattgcatt

SEQ ID NO: 6252266 - DNA, 20 bp, Homo sapiens
gatcattggagtttaggaat

SEQ ID NO: 6252267 - DNA, 22 bp, Homo sapiens
gatcatttaggatactcttaat

SEQ ID NO: 6252268 - DNA, 21 bp, Homo sapiens
gatcatttataatactgtttt

SEQ ID NO: 6252269 - DNA, 17 bp, Homo sapiens
gatcatttctgccatga

SEQ ID NO: 6252270 - DNA, 17 bp, Homo sapiens
gatcatttgagcccagg

SEQ ID NO: 6252271 - DNA, 15 bp, Homo sapiens
gatcatttgagttca

SEQ ID NO: 6252272 - DNA, 17 bp, Homo sapiens
gatcatttgcagctgct

SEQ ID NO: 6252273 - DNA, 21 bp, Homo sapiens
gatcatttgcagctgctggtt

SEQ ID NO: 6252274 - DNA, 15 bp, Homo sapiens
gatcattttcccccc

SEQ ID NO: 6252275 - DNA, 19 bp, Homo sapiens
gatcattttccccccactc

SEQ ID NO: 6252276 - DNA, 23 bp, Homo sapiens
gatcattttccccccactctccc

SEQ ID NO: 6252277 - DNA, 23 bp, Homo sapiens
gatcattttcttatcttctgcaa

SEQ ID NO: 6252278 - DNA, 13 bp, Homo sapiens
gatcatttttcca

SEQ ID NO: 6252279 - DNA, 14 bp, Homo sapiens
gatcatttttccag

SEQ ID NO: 6252280 - DNA, 19 bp, Homo sapiens
gatcatttttccaggactc

SEQ ID NO: 6252281 - DNA, 22 bp, Homo sapiens
gatccaaaagaagcccccagct

SEQ ID NO: 6252282 - DNA, 12 bp, Homo sapiens
gatccaaagact

SEQ ID NO: 6252283 - DNA, 19 bp, Homo sapiens
gatccaaatgctgtgcaaa

SEQ ID NO: 6252284 - DNA, 19 bp, Homo sapiens
gatccaaattgtgcttctc

SEQ ID NO: 6252285 - DNA, 20 bp, Homo sapiens
gatccaactaatgccttact

SEQ ID NO: 6252286 - DNA, 15 bp, Homo sapiens
gatccaagcaaaact

SEQ ID NO: 6252287 - DNA, 15 bp, Homo sapiens
gatccaagctaagca

SEQ ID NO: 6252288 - DNA, 17 bp, Homo sapiens
gatccaagctggtccca

SEQ ID NO: 6252289 - DNA, 23 bp, Homo sapiens
gatccaaggccgcggcccagacc

SEQ ID NO: 6252290 - DNA, 16 bp, Homo sapiens
gatccaatgttagaga

SEQ ID NO: 6252291 - DNA, 15 bp, Homo sapiens
gatccacacacagag

SEQ ID NO: 6252292 - DNA, 13 bp, Homo sapiens
gatccacattgtt

SEQ ID NO: 6252293 - DNA, 19 bp, Homo sapiens
gatccacccacctcagcct

SEQ ID NO: 6252294 - DNA, 22 bp, Homo sapiens
gatccacccacctcagcctccc

SEQ ID NO: 6252295 - DNA, 19 bp, Homo sapiens
gatccacccacctcggcct

SEQ ID NO: 6252296 - DNA, 18 bp, Homo sapiens
gatccacccaccttggcc

SEQ ID NO: 6252297 - DNA, 22 bp, Homo sapiens
gatccacccgccttcagcctcc

SEQ ID NO: 6252298 - DNA, 20 bp, Homo sapiens
gatccaccgccacactggcc

SEQ ID NO: 6252299 - DNA, 13 bp, Homo sapiens
gatccacctgcac

SEQ ID NO: 6252300 - DNA, 20 bp, Homo sapiens
gatccacctgcacaaacata

SEQ ID NO: 6252301 - DNA, 13 bp, Homo sapiens
gatccacctgcct

SEQ ID NO: 6252302 - DNA, 14 bp, Homo sapiens
gatccacctgtctc

SEQ ID NO: 6252303 - DNA, 19 bp, Homo sapiens
gatccactggctggacaaa

SEQ ID NO: 6252304 - DNA, 17 bp, Homo sapiens
gatccacttctctgtta

SEQ ID NO: 6252305 - DNA, 19 bp, Homo sapiens
gatccacttcttggttcct

SEQ ID NO: 6252306 - DNA, 23 bp, Homo sapiens
gatccacttcttggttcctggga

SEQ ID NO: 6252307 - DNA, 14 bp, Homo sapiens
gatccactttgggg

SEQ ID NO: 6252308 - DNA, 14 bp, Homo sapiens
gatccagaacagtg

SEQ ID NO: 6252309 - DNA, 18 bp, Homo sapiens
gatccagagacctgctcc

SEQ ID NO: 6252310 - DNA, 19 bp, Homo sapiens
gatccagagacctgctcca

SEQ ID NO: 6252311 - DNA, 12 bp, Homo sapiens
gatccagagaga

SEQ ID NO: 6252312 - DNA, 18 bp, Homo sapiens
gatccagagaggctggat

SEQ ID NO: 6252313 - DNA, 14 bp, Homo sapiens
gatccagcactggt

SEQ ID NO: 6252314 - DNA, 15 bp, Homo sapiens
gatccagccattcct

SEQ ID NO: 6252315 - DNA, 18 bp, Homo sapiens
gatccagccattcctgaa

SEQ ID NO: 6252316 - DNA, 17 bp, Homo sapiens
gatccagcccaaacctg

SEQ ID NO: 6252317 - DNA, 19 bp, Homo sapiens
gatccagcccaaacctggg

SEQ ID NO: 6252318 - DNA, 21 bp, Homo sapiens
gatccagcccaaacctgggaa

SEQ ID NO: 6252319 - DNA, 14 bp, Homo sapiens
gatccagccctggt

SEQ ID NO: 6252320 - DNA, 13 bp, Homo sapiens
gatccagcctggg

SEQ ID NO: 6252321 - DNA, 17 bp, Homo sapiens
gatccagcctttccaag

SEQ ID NO: 6252322 - DNA, 19 bp, Homo sapiens
gatccagctcaagggagta

SEQ ID NO: 6252323 - DNA, 16 bp, Homo sapiens
gatccagctctgggag

SEQ ID NO: 6252324 - DNA, 23 bp, Homo sapiens
gatccagctgtgtgttttcaatc

SEQ ID NO: 6252325 - DNA, 20 bp, Homo sapiens
gatccaggaacacatgcaca

SEQ ID NO: 6252326 - DNA, 19 bp, Homo sapiens
gatccaggaagcatgagtg

SEQ ID NO: 6252327 - DNA, 19 bp, Homo sapiens
gatccaggagctccagtgt

SEQ ID NO: 6252328 - DNA, 23 bp, Homo sapiens
gatccaggccggcttgccacacc

SEQ ID NO: 6252329 - DNA, 18 bp, Homo sapiens
gatccaggcttctcccgg

SEQ ID NO: 6252330 - DNA, 16 bp, Homo sapiens
gatccagggactgaag

SEQ ID NO: 6252331 - DNA, 18 bp, Homo sapiens
gatccagggatggagatg

SEQ ID NO: 6252332 - DNA, 19 bp, Homo sapiens
gatccagggatggagatgg

SEQ ID NO: 6252333 - DNA, 12 bp, Homo sapiens
gatccagggcag

SEQ ID NO: 6252334 - DNA, 15 bp, Homo sapiens
gatccagggcagcag

SEQ ID NO: 6252335 - DNA, 21 bp, Homo sapiens
gatccagggcagcaggccaga

SEQ ID NO: 6252336 - DNA, 19 bp, Homo sapiens
gatccagtaacctcggaga

SEQ ID NO: 6252337 - DNA, 16 bp, Homo sapiens
gatccagtataagact

SEQ ID NO: 6252338 - DNA, 16 bp, Homo sapiens
gatccagtctgcagac

SEQ ID NO: 6252339 - DNA, 15 bp, Homo sapiens
gatccagtgacatga

SEQ ID NO: 6252340 - DNA, 22 bp, Homo sapiens
gatccagtgtataaatccaata

SEQ ID NO: 6252341 - DNA, 15 bp, Homo sapiens
gatccagtgtgtaaa

SEQ ID NO: 6252342 - DNA, 16 bp, Homo sapiens
gatccatactgaaaaa

SEQ ID NO: 6252343 - DNA, 21 bp, Homo sapiens
gatccatagtgctacctgcac

SEQ ID NO: 6252344 - DNA, 13 bp, Homo sapiens
gatccatatttaa

SEQ ID NO: 6252345 - DNA, 20 bp, Homo sapiens
gatccatccatctctctctt

SEQ ID NO: 6252346 - DNA, 13 bp, Homo sapiens
gatccatcctgct

SEQ ID NO: 6252347 - DNA, 23 bp, Homo sapiens
gatccatttccattgcttattat

SEQ ID NO: 6252348 - DNA, 14 bp, Homo sapiens
gatccatttctaat

SEQ ID NO: 6252349 - DNA, 18 bp, Homo sapiens
gatccatttgcctttctg

SEQ ID NO: 6252350 - DNA, 21 bp, Homo sapiens
gatccatttgcctttctggga

SEQ ID NO: 6252351 - DNA, 23 bp, Homo sapiens
gatccatttgcctttctgggagc

SEQ ID NO: 6252352 - DNA, 21 bp, Homo sapiens
gatccatttggacaaaatgga

SEQ ID NO: 6252353 - DNA, 16 bp, Homo sapiens
gatcccaacactgcca

SEQ ID NO: 6252354 - DNA, 17 bp, Homo sapiens
gatcccaacactgccag

SEQ ID NO: 6252355 - DNA, 17 bp, Homo sapiens
gatcccaagatggagag

SEQ ID NO: 6252356 - DNA, 21 bp, Homo sapiens
gatcccaccccctcctccccc

SEQ ID NO: 6252357 - DNA, 17 bp, Homo sapiens
gatcccagagagcccga

SEQ ID NO: 6252358 - DNA, 22 bp, Homo sapiens
gatcccagcacctattgaatta

SEQ ID NO: 6252359 - DNA, 12 bp, Homo sapiens
gatcccagcatc

SEQ ID NO: 6252360 - DNA, 11 bp, Homo sapiens
gatcccagctc

SEQ ID NO: 6252361 - DNA, 17 bp, Homo sapiens
gatcccagctcacgtca

SEQ ID NO: 6252362 - DNA, 19 bp, Homo sapiens
gatcccagctcacgtcaca

SEQ ID NO: 6252363 - DNA, 16 bp, Homo sapiens
gatcccagctcactgc

SEQ ID NO: 6252364 - DNA, 23 bp, Homo sapiens
gatcccagctcactgcagcctcg

SEQ ID NO: 6252365 - DNA, 15 bp, Homo sapiens
gatcccaggcccctg

SEQ ID NO: 6252366 - DNA, 18 bp, Homo sapiens
gatcccaggcccctggag

SEQ ID NO: 6252367 - DNA, 21 bp, Homo sapiens
gatcccatccatcagctccct

SEQ ID NO: 6252368 - DNA, 15 bp, Homo sapiens
gatcccatgagctcc

SEQ ID NO: 6252369 - DNA, 17 bp, Homo sapiens
gatcccatgagctcctt

SEQ ID NO: 6252370 - DNA, 17 bp, Homo sapiens
gatcccatgtcacctca

SEQ ID NO: 6252371 - DNA, 15 bp, Homo sapiens
gatccccaactgctc

SEQ ID NO: 6252372 - DNA, 16 bp, Homo sapiens
gatccccaactgctcc

SEQ ID NO: 6252373 - DNA, 20 bp, Homo sapiens
gatccccaagcctggcaagg

SEQ ID NO: 6252374 - DNA, 18 bp, Homo sapiens
gatccccacgccacagcc

SEQ ID NO: 6252375 - DNA, 24 bp, Homo sapiens
gatccccagcccctcctccctcag

SEQ ID NO: 6252376 - DNA, 18 bp, Homo sapiens
gatccccagctttctcct

SEQ ID NO: 6252377 - DNA, 21 bp, Homo sapiens
gatccccaggaggcctgggcc

SEQ ID NO: 6252378 - DNA, 20 bp, Homo sapiens
gatccccatggaacagccct

SEQ ID NO: 6252379 - DNA, 18 bp, Homo sapiens
gatcccccaaacagcatg

SEQ ID NO: 6252380 - DNA, 23 bp, Homo sapiens
gatcccccaagtgtcctggaccc

SEQ ID NO: 6252381 - DNA, 12 bp, Homo sapiens
gatcccccagaa

SEQ ID NO: 6252382 - DNA, 21 bp, Homo sapiens
gatccccgacagtggctctcc

SEQ ID NO: 6252383 - DNA, 15 bp, Homo sapiens
gatccccgcctggcc

SEQ ID NO: 6252384 - DNA, 22 bp, Homo sapiens
gatccccggggctggggcccag

SEQ ID NO: 6252385 - DNA, 17 bp, Homo sapiens
gatccccgtctctgccc

SEQ ID NO: 6252386 - DNA, 21 bp, Homo sapiens
gatccccgtctctgccctggg

SEQ ID NO: 6252387 - DNA, 13 bp, Homo sapiens
gatcccctcagga

SEQ ID NO: 6252388 - DNA, 14 bp, Homo sapiens
gatcccctcaggac

SEQ ID NO: 6252389 - DNA, 16 bp, Homo sapiens
gatcccctctcctgcc

SEQ ID NO: 6252390 - DNA, 19 bp, Homo sapiens
gatcccctgcggtcaggct

SEQ ID NO: 6252391 - DNA, 22 bp, Homo sapiens
gatcccctgctactccactgac

SEQ ID NO: 6252392 - DNA, 20 bp, Homo sapiens
gatcccctgcttctggctcc

SEQ ID NO: 6252393 - DNA, 13 bp, Homo sapiens
gatcccctgtccc

SEQ ID NO: 6252394 - DNA, 18 bp, Homo sapiens
gatcccctgtcccctggg

SEQ ID NO: 6252395 - DNA, 20 bp, Homo sapiens
gatcccctgtcccctggggc

SEQ ID NO: 6252396 - DNA, 23 bp, Homo sapiens
gatcccctgtcccctggggctgg

SEQ ID NO: 6252397 - DNA, 13 bp, Homo sapiens
gatcccctttggt

SEQ ID NO: 6252398 - DNA, 19 bp, Homo sapiens
gatcccgcgtagtgtcagt

SEQ ID NO: 6252399 - DNA, 19 bp, Homo sapiens
gatcccggccggccctggc

SEQ ID NO: 6252400 - DNA, 20 bp, Homo sapiens
gatcccggccggccctggct

SEQ ID NO: 6252401 - DNA, 21 bp, Homo sapiens
gatcccggtggtgggatccac

SEQ ID NO: 6252402 - DNA, 17 bp, Homo sapiens
gatcccgttttccccat

SEQ ID NO: 6252403 - DNA, 16 bp, Homo sapiens
gatccctaatgtgttt

SEQ ID NO: 6252404 - DNA, 19 bp, Homo sapiens
gatccctagctgtgacctc

SEQ ID NO: 6252405 - DNA, 18 bp, Homo sapiens
gatccctcatctgtccct

SEQ ID NO: 6252406 - DNA, 14 bp, Homo sapiens
gatccctccacccc

SEQ ID NO: 6252407 - DNA, 18 bp, Homo sapiens
gatccctccatccggctc

SEQ ID NO: 6252408 - DNA, 19 bp, Homo sapiens
gatccctcccccccatgca

SEQ ID NO: 6252409 - DNA, 12 bp, Homo sapiens
gatccctcctga

SEQ ID NO: 6252410 - DNA, 12 bp, Homo sapiens
gatccctcgacc

SEQ ID NO: 6252411 - DNA, 20 bp, Homo sapiens
gatccctcggtcagcaccgt

SEQ ID NO: 6252412 - DNA, 20 bp, Homo sapiens
gatccctgcccttctcaaga

SEQ ID NO: 6252413 - DNA, 17 bp, Homo sapiens
gatccctgctctctgag

SEQ ID NO: 6252414 - DNA, 18 bp, Homo sapiens
gatccctgctctctgagt

SEQ ID NO: 6252415 - DNA, 17 bp, Homo sapiens
gatccctggccactgaa

SEQ ID NO: 6252416 - DNA, 19 bp, Homo sapiens
gatccctgtctttcctaag

SEQ ID NO: 6252417 - DNA, 14 bp, Homo sapiens
gatccctgtgttgt

SEQ ID NO: 6252418 - DNA, 20 bp, Homo sapiens
gatccctgttacccagagaa

SEQ ID NO: 6252419 - DNA, 22 bp, Homo sapiens
gatcccttccacctgctctgct

SEQ ID NO: 6252420 - DNA, 23 bp, Homo sapiens
gatcccttccacctgctctgctg

SEQ ID NO: 6252421 - DNA, 13 bp, Homo sapiens
gatccctttagaa

SEQ ID NO: 6252422 - DNA, 22 bp, Homo sapiens
gatccctttcccatgatccaga

SEQ ID NO: 6252423 - DNA, 19 bp, Homo sapiens
gatccgagcgacggctcct

SEQ ID NO: 6252424 - DNA, 18 bp, Homo sapiens
gatccgcaacccatgccc

SEQ ID NO: 6252425 - DNA, 22 bp, Homo sapiens
gatccgcaacccatgccctgga

SEQ ID NO: 6252426 - DNA, 16 bp, Homo sapiens
gatccgcaagagtaaa

SEQ ID NO: 6252427 - DNA, 18 bp, Homo sapiens
gatccgcccgcctctgcc

SEQ ID NO: 6252428 - DNA, 19 bp, Homo sapiens
gatccgcccgcctctgcct

SEQ ID NO: 6252429 - DNA, 14 bp, Homo sapiens
gatccgccctgggc

SEQ ID NO: 6252430 - DNA, 13 bp, Homo sapiens
gatccgctgccac

SEQ ID NO: 6252431 - DNA, 17 bp, Homo sapiens
gatccggctgctcctcc

SEQ ID NO: 6252432 - DNA, 21 bp, Homo sapiens
gatccggctgctcctccagcc

SEQ ID NO: 6252433 - DNA, 22 bp, Homo sapiens
gatccggctgctcctccagccc

SEQ ID NO: 6252434 - DNA, 16 bp, Homo sapiens
gatccgtgaattctcg

SEQ ID NO: 6252435 - DNA, 15 bp, Homo sapiens
gatccgtttgaccaa

SEQ ID NO: 6252436 - DNA, 16 bp, Homo sapiens
gatccgtttgaccaat

SEQ ID NO: 6252437 - DNA, 17 bp, Homo sapiens
gatcctaaactctctag

SEQ ID NO: 6252438 - DNA, 18 bp, Homo sapiens
gatcctaaccctgggctc

SEQ ID NO: 6252439 - DNA, 21 bp, Homo sapiens
gatcctaaccctgggctccct

SEQ ID NO: 6252440 - DNA, 15 bp, Homo sapiens
gcctagctcttgggc

SEQ ID NO: 6252441 - DNA, 19 bp, Homo sapiens
gcctagctcttgggcctga

SEQ ID NO: 6252442 - DNA, 19 bp, Homo sapiens
gcctagctgcctagcaagc

SEQ ID NO: 6252443 - DNA, 14 bp, Homo sapiens
gcctagctgctaca

SEQ ID NO: 6252444 - DNA, 15 bp, Homo sapiens
gcctagctgctacaa

SEQ ID NO: 6252445 - DNA, 19 bp, Homo sapiens
gcctagctgctacaaagaa

SEQ ID NO: 6252446 - DNA, 18 bp, Homo sapiens
gcctaggaccactcagcc

SEQ ID NO: 6252447 - DNA, 19 bp, Homo sapiens
gcctaggaccactcagccc

SEQ ID NO: 6252448 - DNA, 21 bp, Homo sapiens
gcctaggaccactcagcccct

SEQ ID NO: 6252449 - DNA, 14 bp, Homo sapiens
gcctaggacctcag

SEQ ID NO: 6252450 - DNA, 15 bp, Homo sapiens
gcctaggacctcagg

SEQ ID NO: 6252451 - DNA, 17 bp, Homo sapiens
gcctaggacctcaggcg

SEQ ID NO: 6252452 - DNA, 21 bp, Homo sapiens
gcctaggacgccaacttctcc

SEQ ID NO: 6252453 - DNA, 14 bp, Homo sapiens
gcctaggagctggc

SEQ ID NO: 6252454 - DNA, 16 bp, Homo sapiens
gcctaggagctggctg

SEQ ID NO: 6252455 - DNA, 20 bp, Homo sapiens
gcctaggagctggctggcag

SEQ ID NO: 6252456 - DNA, 21 bp, Homo sapiens
gcctaggagctggctggcagg

SEQ ID NO: 6252457 - DNA, 23 bp, Homo sapiens
gcctaggagctggctggcaggtg

SEQ ID NO: 6252458 - DNA, 18 bp, Homo sapiens
gcctaggaggactggggt

SEQ ID NO: 6252459 - DNA, 14 bp, Homo sapiens
gcctaggaggcccc

SEQ ID NO: 6252460 - DNA, 15 bp, Homo sapiens
gcctaggatttcagc

SEQ ID NO: 6252461 - DNA, 16 bp, Homo sapiens
gcctaggatttcagcc

SEQ ID NO: 6252462 - DNA, 17 bp, Homo sapiens
gcctaggatttcagcca

SEQ ID NO: 6252463 - DNA, 12 bp, Homo sapiens
gcctaggcacct

SEQ ID NO: 6252464 - DNA, 14 bp, Homo sapiens
gcctaggcacctcc

SEQ ID NO: 6252465 - DNA, 14 bp, Homo sapiens
gcctaggcagccag

SEQ ID NO: 6252466 - DNA, 21 bp, Homo sapiens
gcctaggccaaatgcacaagc

SEQ ID NO: 6252467 - DNA, 16 bp, Homo sapiens
gcctaggccagctcct

SEQ ID NO: 6252468 - DNA, 15 bp, Homo sapiens
gcctaggccaggagt

SEQ ID NO: 6252469 - DNA, 12 bp, Homo sapiens
gcctaggcctgg

SEQ ID NO: 6252470 - DNA, 12 bp, Homo sapiens
gcctaggctgca

SEQ ID NO: 6252471 - DNA, 14 bp, Homo sapiens
gcctaggctgcatt

SEQ ID NO: 6252472 - DNA, 11 bp, Homo sapiens
gcctagggagc

SEQ ID NO: 6252473 - DNA, 20 bp, Homo sapiens
gcctagggagccgcaccttg

SEQ ID NO: 6252474 - DNA, 17 bp, Homo sapiens
gcctagggcagacaata

SEQ ID NO: 6252475 - DNA, 17 bp, Homo sapiens
gcctaggggtcagggac

SEQ ID NO: 6252476 - DNA, 18 bp, Homo sapiens
gcctaggggtggcgctca

SEQ ID NO: 6252477 - DNA, 19 bp, Homo sapiens
gcctaggggtggcgctcag

SEQ ID NO: 6252478 - DNA, 16 bp, Homo sapiens
gcctagggtgagggtg

SEQ ID NO: 6252479 - DNA, 22 bp, Homo sapiens
gcctagggttgcttgggccact

SEQ ID NO: 6252480 - DNA, 20 bp, Homo sapiens
gcctaggtcccccaagcatg

SEQ ID NO: 6252481 - DNA, 13 bp, Homo sapiens
gcctaggtgacag

SEQ ID NO: 6252482 - DNA, 17 bp, Homo sapiens
gcctaggtgcagctcct

SEQ ID NO: 6252483 - DNA, 16 bp, Homo sapiens
gcctagtaaccaaggc

SEQ ID NO: 6252484 - DNA, 16 bp, Homo sapiens
gcctagtacaatcttg

SEQ ID NO: 6252485 - DNA, 18 bp, Homo sapiens
gcctagtacaatcttggg

SEQ ID NO: 6252486 - DNA, 16 bp, Homo sapiens
gcctagtattgacaaa

SEQ ID NO: 6252487 - DNA, 22 bp, Homo sapiens
gcctagtcagggcacagctgcc

SEQ ID NO: 6252488 - DNA, 19 bp, Homo sapiens
gcctagtgaaggcttctct

SEQ ID NO: 6252489 - DNA, 23 bp, Homo sapiens
gcctagtgaaggcttctctctgt

SEQ ID NO: 6252490 - DNA, 21 bp, Homo sapiens
gcctagtggcttcagcccctg

SEQ ID NO: 6252491 - DNA, 22 bp, Homo sapiens
gcctagtggcttcagcccctgg

SEQ ID NO: 6252492 - DNA, 14 bp, Homo sapiens
gcctagtggcttgt

SEQ ID NO: 6252493 - DNA, 16 bp, Homo sapiens
gcctagtggggagggg

SEQ ID NO: 6252494 - DNA, 21 bp, Homo sapiens
gcctagtggggaggggcctgg

SEQ ID NO: 6252495 - DNA, 23 bp, Homo sapiens
gcctagtggggaggggcctggcc

SEQ ID NO: 6252496 - DNA, 22 bp, Homo sapiens
gcctagtggggtctccctctcc

SEQ ID NO: 6252497 - DNA, 18 bp, Homo sapiens
gcctagttatcaagggga

SEQ ID NO: 6252498 - DNA, 17 bp, Homo sapiens
gcctataaaatgcccat

SEQ ID NO: 6252499 - DNA, 19 bp, Homo sapiens
gcctataagccaaaattaa

SEQ ID NO: 6252500 - DNA, 22 bp, Homo sapiens
gcctataagccaaaattaaggt

SEQ ID NO: 6252501 - DNA, 14 bp, Homo sapiens
gcctataatcccag

SEQ ID NO: 6252502 - DNA, 15 bp, Homo sapiens
gcctataatcccagc

SEQ ID NO: 6252503 - DNA, 19 bp, Homo sapiens
gcctataatcttatacaac

SEQ ID NO: 6252504 - DNA, 21 bp, Homo sapiens
gcctataatgaagctttatac

SEQ ID NO: 6252505 - DNA, 20 bp, Homo sapiens
gcctatacgtttctgtggag

SEQ ID NO: 6252506 - DNA, 13 bp, Homo sapiens
gcctatatcagtc

SEQ ID NO: 6252507 - DNA, 19 bp, Homo sapiens
gcctatatgagaagaatag

SEQ ID NO: 6252508 - DNA, 15 bp, Homo sapiens
gcctatattatcata

SEQ ID NO: 6252509 - DNA, 18 bp, Homo sapiens
gcctatatttcctcttct

SEQ ID NO: 6252510 - DNA, 20 bp, Homo sapiens
gcctatcagagttgctgcaa

SEQ ID NO: 6252511 - DNA, 14 bp, Homo sapiens
gcctatcagtgtgc

SEQ ID NO: 6252512 - DNA, 15 bp, Homo sapiens
gcctatcagtgtgcc

SEQ ID NO: 6252513 - DNA, 15 bp, Homo sapiens
gcctatcccaaacct

SEQ ID NO: 6252514 - DNA, 13 bp, Homo sapiens
gcctatccgctgc

SEQ ID NO: 6252515 - DNA, 14 bp, Homo sapiens
gcctatcctctgta

SEQ ID NO: 6252516 - DNA, 16 bp, Homo sapiens
gcctatcctctgtata

SEQ ID NO: 6252517 - DNA, 14 bp, Homo sapiens
gcctatctgagact

SEQ ID NO: 6252518 - DNA, 19 bp, Homo sapiens
gcctatgaaactggtttat

SEQ ID NO: 6252519 - DNA, 15 bp, Homo sapiens
gcctatgaccctgtg

SEQ ID NO: 6252520 - DNA, 16 bp, Homo sapiens
gcctatgaccctgtgc

SEQ ID NO: 6252521 - DNA, 17 bp, Homo sapiens
gcctatgaccctgtgcc

SEQ ID NO: 6252522 - DNA, 18 bp, Homo sapiens
gcctatgaccctgtgcct

SEQ ID NO: 6252523 - DNA, 16 bp, Homo sapiens
gcctatgacttgggca

SEQ ID NO: 6252524 - DNA, 23 bp, Homo sapiens
gcctatgcaaaaagaggatccgt

SEQ ID NO: 6252525 - DNA, 19 bp, Homo sapiens
gcctatgcactgaagagct

SEQ ID NO: 6252526 - DNA, 22 bp, Homo sapiens
gcctatgcactgaagagctctt

SEQ ID NO: 6252527 - DNA, 22 bp, Homo sapiens
gcctatgccaagtccctggaaa

SEQ ID NO: 6252528 - DNA, 16 bp, Homo sapiens
gcctatgccacctgca

SEQ ID NO: 6252529 - DNA, 18 bp, Homo sapiens
gcctatgccacctgcagc

SEQ ID NO: 6252530 - DNA, 15 bp, Homo sapiens
gcctatggaaagggt

SEQ ID NO: 6252531 - DNA, 20 bp, Homo sapiens
gcctatggaaagggtgtggc

SEQ ID NO: 6252532 - DNA, 17 bp, Homo sapiens
gcctatggagagccctg

SEQ ID NO: 6252533 - DNA, 19 bp, Homo sapiens
gcctatgggggctctcgga

SEQ ID NO: 6252534 - DNA, 23 bp, Homo sapiens
gcctatgtgcgaagcaagaagaa

SEQ ID NO: 6252535 - DNA, 18 bp, Homo sapiens
gcctatgtggtctaaggt

SEQ ID NO: 6252536 - DNA, 22 bp, Homo sapiens
gcctattagtagttaattctgt

SEQ ID NO: 6252537 - DNA, 22 bp, Homo sapiens
gcctattcccacacctccacag

SEQ ID NO: 6252538 - DNA, 20 bp, Homo sapiens
gcctattgctagagctcctc

SEQ ID NO: 6252539 - DNA, 13 bp, Homo sapiens
gcctattgtaata

SEQ ID NO: 6252540 - DNA, 19 bp, Homo sapiens
gcctattgttgaataaatg

SEQ ID NO: 6252541 - DNA, 12 bp, Homo sapiens
gcctatttaagc

SEQ ID NO: 6252542 - DNA, 15 bp, Homo sapiens
gcctatttaagcccc

SEQ ID NO: 6252543 - DNA, 20 bp, Homo sapiens
gcctatttacctgcaggctg

SEQ ID NO: 6252544 - DNA, 17 bp, Homo sapiens
gcctatttactggaaac

SEQ ID NO: 6252545 - DNA, 13 bp, Homo sapiens
gcctatttattgg

SEQ ID NO: 6252546 - DNA, 15 bp, Homo sapiens
gcctatttattgggg

SEQ ID NO: 6252547 - DNA, 16 bp, Homo sapiens
gcctatttcagctgct

SEQ ID NO: 6252548 - DNA, 18 bp, Homo sapiens
gcctatttcccccttcat

SEQ ID NO: 6252549 - DNA, 17 bp, Homo sapiens
gcctattttaataaaca

SEQ ID NO: 6252550 - DNA, 18 bp, Homo sapiens
gcctatttttatattttt

SEQ ID NO: 6252551 - DNA, 16 bp, Homo sapiens
gcctcaaaacagaagc

SEQ ID NO: 6252552 - DNA, 21 bp, Homo sapiens
gcctcaaaacgggtcagtatt

SEQ ID NO: 6252553 - DNA, 19 bp, Homo sapiens
gcctcaaacagccacgagg

SEQ ID NO: 6252554 - DNA, 23 bp, Homo sapiens
gcctcaaacagccacgaggtggt

SEQ ID NO: 6252555 - DNA, 21 bp, Homo sapiens
gcctcaaagcaacccgctgga

SEQ ID NO: 6252556 - DNA, 15 bp, Homo sapiens
gcctcaaaggcccgc

SEQ ID NO: 6252557 - DNA, 17 bp, Homo sapiens
gcctcaaaggcccgctc

SEQ ID NO: 6252558 - DNA, 22 bp, Homo sapiens
gcctcaaagtcccttgagactc

SEQ ID NO: 6252559 - DNA, 14 bp, Homo sapiens
gcctcaaatccagg

SEQ ID NO: 6252560 - DNA, 22 bp, Homo sapiens
gcctcaaatccaggaccctgcc

SEQ ID NO: 6252561 - DNA, 17 bp, Homo sapiens
gcctcaacagcaggagg

SEQ ID NO: 6252562 - DNA, 23 bp, Homo sapiens
gcctcaacagcaggaggcacagc

SEQ ID NO: 6252563 - DNA, 14 bp, Homo sapiens
gcctcaaccctccc

SEQ ID NO: 6252564 - DNA, 22 bp, Homo sapiens
gcctcaaccctccctcagcccc

SEQ ID NO: 6252565 - DNA, 19 bp, Homo sapiens
gcctcaacctcctgggcta

SEQ ID NO: 6252566 - DNA, 22 bp, Homo sapiens
gcctcaactccaccctctgcga

SEQ ID NO: 6252567 - DNA, 22 bp, Homo sapiens
gcctcaactctgctgagggtcc

SEQ ID NO: 6252568 - DNA, 21 bp, Homo sapiens
gcctcaactgagaagccaagc

SEQ ID NO: 6252569 - DNA, 17 bp, Homo sapiens
gcctcaagaacaccttt

SEQ ID NO: 6252570 - DNA, 18 bp, Homo sapiens
gcctcaagaggaatgaaa

SEQ ID NO: 6252571 - DNA, 23 bp, Homo sapiens
gcctcaagcaaggaagcagagca

SEQ ID NO: 6252572 - DNA, 21 bp, Homo sapiens
gcctcaagccatcttcccgcc

SEQ ID NO: 6252573 - DNA, 20 bp, Homo sapiens
gcctcaaggaagagccagcc

SEQ ID NO: 6252574 - DNA, 21 bp, Homo sapiens
gcctcaaggaagagccagccg

SEQ ID NO: 6252575 - DNA, 12 bp, Homo sapiens
gcctcaaggccc

SEQ ID NO: 6252576 - DNA, 22 bp, Homo sapiens
gcctcaaggttttaggttctaa

SEQ ID NO: 6252577 - DNA, 16 bp, Homo sapiens
gcctcaagtcactccc

SEQ ID NO: 6252578 - DNA, 18 bp, Homo sapiens
gcctcaagtcggtgggcc

SEQ ID NO: 6252579 - DNA, 24 bp, Homo sapiens
gcctcaagtgagccaagaaacact

SEQ ID NO: 6252580 - DNA, 20 bp, Homo sapiens
gcctcaagtgattctcctgc

SEQ ID NO: 6252581 - DNA, 14 bp, Homo sapiens
gcctcaataaagct

SEQ ID NO: 6252582 - DNA, 17 bp, Homo sapiens
gcctcaataagccttgt

SEQ ID NO: 6252583 - DNA, 19 bp, Homo sapiens
gcctcaatctaaggccttc

SEQ ID NO: 6252584 - DNA, 14 bp, Homo sapiens
gcctcaatgccagt

SEQ ID NO: 6252585 - DNA, 21 bp, Homo sapiens
gcctcaatgtgaatcagaccc

SEQ ID NO: 6252586 - DNA, 15 bp, Homo sapiens
gcctcaattttggtt

SEQ ID NO: 6252587 - DNA, 18 bp, Homo sapiens
gcctcacactggcgtctg

SEQ ID NO: 6252588 - DNA, 15 bp, Homo sapiens
gcctcacagatgctg

SEQ ID NO: 6252589 - DNA, 16 bp, Homo sapiens
gcctcacagatgctgg

SEQ ID NO: 6252590 - DNA, 23 bp, Homo sapiens
gcctcacagatgctggcctcttg

SEQ ID NO: 6252591 - DNA, 13 bp, Homo sapiens
gcctcacagtcct

SEQ ID NO: 6252592 - DNA, 18 bp, Homo sapiens
gcctcacagtccttacca

SEQ ID NO: 6252593 - DNA, 17 bp, Homo sapiens
gcctcacatctcccttc

SEQ ID NO: 6252594 - DNA, 22 bp, Homo sapiens
gcctcacattcccccggtgcct

SEQ ID NO: 6252595 - DNA, 23 bp, Homo sapiens
gcctcaccacacccaggtctctt

SEQ ID NO: 6252596 - DNA, 16 bp, Homo sapiens
gcctcaccagcccccc

SEQ ID NO: 6252597 - DNA, 23 bp, Homo sapiens
gcctcaccaggcccacgaggagc

SEQ ID NO: 6252598 - DNA, 13 bp, Homo sapiens
gcctcacccagaa

SEQ ID NO: 6252599 - DNA, 22 bp, Homo sapiens
gcctcaccccctcgggtctcct

SEQ ID NO: 6252600 - DNA, 15 bp, Homo sapiens
gcctcacccctgcag

SEQ ID NO: 6252601 - DNA, 22 bp, Homo sapiens
gcctcacccctgcccctgtggg

SEQ ID NO: 6252602 - DNA, 13 bp, Homo sapiens
gcctcaccctgct

SEQ ID NO: 6252603 - DNA, 14 bp, Homo sapiens
gcctcaccctgctt

SEQ ID NO: 6252604 - DNA, 14 bp, Homo sapiens
gcctcacctcccag

SEQ ID NO: 6252605 - DNA, 18 bp, Homo sapiens
gcctcacctcccagggct

SEQ ID NO: 6252606 - DNA, 18 bp, Homo sapiens
gcctcacctctacccaaa

SEQ ID NO: 6252607 - DNA, 13 bp, Homo sapiens
gcctcacctgcat

SEQ ID NO: 6252608 - DNA, 14 bp, Homo sapiens
gcctcacctgcatc

SEQ ID NO: 6252609 - DNA, 19 bp, Homo sapiens
gcctcacctgcatcctctc

SEQ ID NO: 6252610 - DNA, 22 bp, Homo sapiens
gcctcacctgcccctctgttct

SEQ ID NO: 6252611 - DNA, 23 bp, Homo sapiens
gcctcacctgcccctctgttctc

SEQ ID NO: 6252612 - DNA, 13 bp, Homo sapiens
gcctcacctggct

SEQ ID NO: 6252613 - DNA, 19 bp, Homo sapiens
gcctcacctggcttcccag

SEQ ID NO: 6252614 - DNA, 14 bp, Homo sapiens
gcctcaccttccaa

SEQ ID NO: 6252615 - DNA, 13 bp, Homo sapiens
gcctcaccttcct

SEQ ID NO: 6252616 - DNA, 20 bp, Homo sapiens
gcctcaccttggggccttga

SEQ ID NO: 6252617 - DNA, 19 bp, Homo sapiens
gatcctaactgaagagaca

SEQ ID NO: 6252618 - DNA, 15 bp, Homo sapiens
gatcctaagaatttt

SEQ ID NO: 6252619 - DNA, 19 bp, Homo sapiens
gatcctaagcatctaagtt

SEQ ID NO: 6252620 - DNA, 20 bp, Homo sapiens
gatcctaatcccttcctctc

SEQ ID NO: 6252621 - DNA, 14 bp, Homo sapiens
gatcctacccctga

SEQ ID NO: 6252622 - DNA, 18 bp, Homo sapiens
gatcctacttctctgagt

SEQ ID NO: 6252623 - DNA, 20 bp, Homo sapiens
gatcctacttctctgagtca

SEQ ID NO: 6252624 - DNA, 14 bp, Homo sapiens
gatcctaggtgctg

SEQ ID NO: 6252625 - DNA, 20 bp, Homo sapiens
gatcctagtgtctttaaata

SEQ ID NO: 6252626 - DNA, 22 bp, Homo sapiens
gatcctcaaaaatcatcaaagt

SEQ ID NO: 6252627 - DNA, 22 bp, Homo sapiens
gatcctcacaggagcagacaga

SEQ ID NO: 6252628 - DNA, 20 bp, Homo sapiens
gatcctcagttctcaaatgt

SEQ ID NO: 6252629 - DNA, 23 bp, Homo sapiens
gatcctcatatggcccagtgtca

SEQ ID NO: 6252630 - DNA, 17 bp, Homo sapiens
gatcctccacagagagg

SEQ ID NO: 6252631 - DNA, 15 bp, Homo sapiens
gatcctccatttttg

SEQ ID NO: 6252632 - DNA, 18 bp, Homo sapiens
gatcctcccacctcagcc

SEQ ID NO: 6252633 - DNA, 18 bp, Homo sapiens
gatcctcccatctcagcc

SEQ ID NO: 6252634 - DNA, 18 bp, Homo sapiens
gatcctcccctggactcc

SEQ ID NO: 6252635 - DNA, 15 bp, Homo sapiens
gatcctccctatcaa

SEQ ID NO: 6252636 - DNA, 16 bp, Homo sapiens
gatcctccctcatggc

SEQ ID NO: 6252637 - DNA, 12 bp, Homo sapiens
gatcctcctcat

SEQ ID NO: 6252638 - DNA, 15 bp, Homo sapiens
gatcctcctgcagac

SEQ ID NO: 6252639 - DNA, 21 bp, Homo sapiens
gatcctcctgcagaccacgcc

SEQ ID NO: 6252640 - DNA, 23 bp, Homo sapiens
gatcctcctggagcagcagctga

SEQ ID NO: 6252641 - DNA, 22 bp, Homo sapiens
gatcctcctgtcttggcctccc

SEQ ID NO: 6252642 - DNA, 23 bp, Homo sapiens
gatcctccttccaggccccaggc

SEQ ID NO: 6252643 - DNA, 15 bp, Homo sapiens
gatcctctactgtgc

SEQ ID NO: 6252644 - DNA, 22 bp, Homo sapiens
gatcctctactgtgcatctcct

SEQ ID NO: 6252645 - DNA, 15 bp, Homo sapiens
gatcctctattttgt

SEQ ID NO: 6252646 - DNA, 19 bp, Homo sapiens
gatcctctattttgtgatg

SEQ ID NO: 6252647 - DNA, 15 bp, Homo sapiens
gatcctctcacctca

SEQ ID NO: 6252648 - DNA, 19 bp, Homo sapiens
gatcctctcacctcagcct

SEQ ID NO: 6252649 - DNA, 17 bp, Homo sapiens
gatcctctccaccctcc

SEQ ID NO: 6252650 - DNA, 20 bp, Homo sapiens
gatcctctccaccctcctct

SEQ ID NO: 6252651 - DNA, 21 bp, Homo sapiens
gatcctctcctttgaaacctg

SEQ ID NO: 6252652 - DNA, 16 bp, Homo sapiens
gatcctctctggggct

SEQ ID NO: 6252653 - DNA, 17 bp, Homo sapiens
gatcctctgatatacaa

SEQ ID NO: 6252654 - DNA, 17 bp, Homo sapiens
gatcctcttgccacatc

SEQ ID NO: 6252655 - DNA, 20 bp, Homo sapiens
gatcctcttgccacatcttg

SEQ ID NO: 6252656 - DNA, 16 bp, Homo sapiens
gatcctctttactctg

SEQ ID NO: 6252657 - DNA, 15 bp, Homo sapiens
gatcctctttcccca

SEQ ID NO: 6252658 - DNA, 18 bp, Homo sapiens
gatcctgaacaagaaaga

SEQ ID NO: 6252659 - DNA, 15 bp, Homo sapiens
gatcctgagaagtac

SEQ ID NO: 6252660 - DNA, 23 bp, Homo sapiens
gatcctgatggcacccacacaga

SEQ ID NO: 6252661 - DNA, 15 bp, Homo sapiens
gatcctgcaccccag

SEQ ID NO: 6252662 - DNA, 16 bp, Homo sapiens
gatcctgcaccccagc

SEQ ID NO: 6252663 - DNA, 21 bp, Homo sapiens
gatcctgcactgactctggaa

SEQ ID NO: 6252664 - DNA, 21 bp, Homo sapiens
gatcctgcaggaacgagcact

SEQ ID NO: 6252665 - DNA, 22 bp, Homo sapiens
gatcctgcaggaacgagcactg

SEQ ID NO: 6252666 - DNA, 21 bp, Homo sapiens
gatcctgccaatctaatgtga

SEQ ID NO: 6252667 - DNA, 17 bp, Homo sapiens
gatcctgccaccctgta

SEQ ID NO: 6252668 - DNA, 11 bp, Homo sapiens
gatcctgcccc

SEQ ID NO: 6252669 - DNA, 17 bp, Homo sapiens
gatcctgctccagcagc

SEQ ID NO: 6252670 - DNA, 11 bp, Homo sapiens
gatcctgctga

SEQ ID NO: 6252671 - DNA, 18 bp, Homo sapiens
gatcctgctgctttgggc

SEQ ID NO: 6252672 - DNA, 24 bp, Homo sapiens
gatcctgctgctttgggctgggat

SEQ ID NO: 6252673 - DNA, 19 bp, Homo sapiens
gatcctgctggggccgcca

SEQ ID NO: 6252674 - DNA, 22 bp, Homo sapiens
gatcctgctggggccgccacgg

SEQ ID NO: 6252675 - DNA, 20 bp, Homo sapiens
gatcctggaaacagcagtgt

SEQ ID NO: 6252676 - DNA, 18 bp, Homo sapiens
gatcctggattcactcac

SEQ ID NO: 6252677 - DNA, 19 bp, Homo sapiens
gatcctggggccctcagct

SEQ ID NO: 6252678 - DNA, 22 bp, Homo sapiens
gatcctgggtcaaaaaaaagaa

SEQ ID NO: 6252679 - DNA, 23 bp, Homo sapiens
gatcctggtattgtaatattaaa

SEQ ID NO: 6252680 - DNA, 20 bp, Homo sapiens
gatcctggttaccactcttt

SEQ ID NO: 6252681 - DNA, 14 bp, Homo sapiens
gatcctgtcccatg

SEQ ID NO: 6252682 - DNA, 22 bp, Homo sapiens
gatcctgtcccatgggctctgg

SEQ ID NO: 6252683 - DNA, 20 bp, Homo sapiens
gatcctgtctttaaggaaaa

SEQ ID NO: 6252684 - DNA, 15 bp, Homo sapiens
gatcctgtgattcct

SEQ ID NO: 6252685 - DNA, 16 bp, Homo sapiens
gatcctgttctgcgct

SEQ ID NO: 6252686 - DNA, 21 bp, Homo sapiens
gatccttagaggtcctctgga

SEQ ID NO: 6252687 - DNA, 16 bp, Homo sapiens
gatccttcaaagtctc

SEQ ID NO: 6252688 - DNA, 18 bp, Homo sapiens
gatccttcaactctgtga

SEQ ID NO: 6252689 - DNA, 21 bp, Homo sapiens
gatccttcacaggcagtgcat

SEQ ID NO: 6252690 - DNA, 16 bp, Homo sapiens
gatccttcagcacagg

SEQ ID NO: 6252691 - DNA, 16 bp, Homo sapiens
gatccttccattccat

SEQ ID NO: 6252692 - DNA, 13 bp, Homo sapiens
gatccttcccaag

SEQ ID NO: 6252693 - DNA, 14 bp, Homo sapiens
gatccttcccaagg

SEQ ID NO: 6252694 - DNA, 22 bp, Homo sapiens
gatccttcccaaggtacagctg

SEQ ID NO: 6252695 - DNA, 14 bp, Homo sapiens
gatccttccctgta

SEQ ID NO: 6252696 - DNA, 19 bp, Homo sapiens
gatccttctgagctccacc

SEQ ID NO: 6252697 - DNA, 20 bp, Homo sapiens
gatccttctgagctccacct

SEQ ID NO: 6252698 - DNA, 22 bp, Homo sapiens
gatccttctgagctccacctct

SEQ ID NO: 6252699 - DNA, 13 bp, Homo sapiens
gatccttgcacag

SEQ ID NO: 6252700 - DNA, 24 bp, Homo sapiens
gatccttggaaaccgtgtgtccag

SEQ ID NO: 6252701 - DNA, 16 bp, Homo sapiens
gatccttggtgctgtg

SEQ ID NO: 6252702 - DNA, 21 bp, Homo sapiens
gatccttgtgttcagctcttt

SEQ ID NO: 6252703 - DNA, 23 bp, Homo sapiens
gatccttgttttaagattgtaat

SEQ ID NO: 6252704 - DNA, 14 bp, Homo sapiens
gatccttttatgtt

SEQ ID NO: 6252705 - DNA, 19 bp, Homo sapiens
gatccttttattctccaga

SEQ ID NO: 6252706 - DNA, 17 bp, Homo sapiens
gatccttttggagtcag

SEQ ID NO: 6252707 - DNA, 19 bp, Homo sapiens
gatccttttttgtcatttt

SEQ ID NO: 6252708 - DNA, 17 bp, Homo sapiens
gatcgaaccgttttgaa

SEQ ID NO: 6252709 - DNA, 13 bp, Homo sapiens
gatcgaagaggcc

SEQ ID NO: 6252710 - DNA, 19 bp, Homo sapiens
gatcgacagacagccaggt

SEQ ID NO: 6252711 - DNA, 13 bp, Homo sapiens
gatcgaggacaag

SEQ ID NO: 6252712 - DNA, 19 bp, Homo sapiens
gatcgagtgtagctgtgaa

SEQ ID NO: 6252713 - DNA, 22 bp, Homo sapiens
gatcgcaccactgcactccagc

SEQ ID NO: 6252714 - DNA, 15 bp, Homo sapiens
gatcgcatcattgca

SEQ ID NO: 6252715 - DNA, 15 bp, Homo sapiens
gatcgcatggcagaa

SEQ ID NO: 6252716 - DNA, 15 bp, Homo sapiens
gatcgcccaggctgg

SEQ ID NO: 6252717 - DNA, 14 bp, Homo sapiens
gatcgcccccacct

SEQ ID NO: 6252718 - DNA, 16 bp, Homo sapiens
gatcgcccgataaaga

SEQ ID NO: 6252719 - DNA, 23 bp, Homo sapiens
gatcgcgccactacactccagcc

SEQ ID NO: 6252720 - DNA, 15 bp, Homo sapiens
gatcgctcccttggc

SEQ ID NO: 6252721 - DNA, 18 bp, Homo sapiens
gatcgctgtgctaggtct

SEQ ID NO: 6252722 - DNA, 13 bp, Homo sapiens
gatcgctgtgtta

SEQ ID NO: 6252723 - DNA, 20 bp, Homo sapiens
gatcgcttttaataaactgc

SEQ ID NO: 6252724 - DNA, 20 bp, Homo sapiens
gatcggagcctcctctctca

SEQ ID NO: 6252725 - DNA, 13 bp, Homo sapiens
gatcggcaggaca

SEQ ID NO: 6252726 - DNA, 19 bp, Homo sapiens
gatcggcaggacaccctga

SEQ ID NO: 6252727 - DNA, 18 bp, Homo sapiens
gatcggctttcatgtaat

SEQ ID NO: 6252728 - DNA, 14 bp, Homo sapiens
gatcggggcaagag

SEQ ID NO: 6252729 - DNA, 17 bp, Homo sapiens
gatcggggtggcagaaa

SEQ ID NO: 6252730 - DNA, 15 bp, Homo sapiens
gatcggtctcctagg

SEQ ID NO: 6252731 - DNA, 20 bp, Homo sapiens
gatcggtttcatattttaaa

SEQ ID NO: 6252732 - DNA, 14 bp, Homo sapiens
gatcgtagaaaatt

SEQ ID NO: 6252733 - DNA, 21 bp, Homo sapiens
gatcgtattaattatctgatc

SEQ ID NO: 6252734 - DNA, 21 bp, Homo sapiens
gatcgtctcggcccctctgat

SEQ ID NO: 6252735 - DNA, 20 bp, Homo sapiens
gatcgtctggttagaaaaca

SEQ ID NO: 6252736 - DNA, 21 bp, Homo sapiens
gatcgtgccattacactccag

SEQ ID NO: 6252737 - DNA, 22 bp, Homo sapiens
gatcgtgccgtggagcttggag

SEQ ID NO: 6252738 - DNA, 15 bp, Homo sapiens
gatcgtgctaaattt

SEQ ID NO: 6252739 - DNA, 16 bp, Homo sapiens
gatcgttcaaagcatg

SEQ ID NO: 6252740 - DNA, 13 bp, Homo sapiens
gatcgttgtccct

SEQ ID NO: 6252741 - DNA, 16 bp, Homo sapiens
gatctaaaaaaatgtt

SEQ ID NO: 6252742 - DNA, 21 bp, Homo sapiens
gatctaaaaataactgtaatt

SEQ ID NO: 6252743 - DNA, 20 bp, Homo sapiens
gatctaaaatgatactgtgt

SEQ ID NO: 6252744 - DNA, 15 bp, Homo sapiens
gatctaaaatttgta

SEQ ID NO: 6252745 - DNA, 11 bp, Homo sapiens
gatctaaataa

SEQ ID NO: 6252746 - DNA, 17 bp, Homo sapiens
gatctaagcctttccat

SEQ ID NO: 6252747 - DNA, 20 bp, Homo sapiens
gatctaaggcatgctcccag

SEQ ID NO: 6252748 - DNA, 14 bp, Homo sapiens
gatctaaggctgtt

SEQ ID NO: 6252749 - DNA, 22 bp, Homo sapiens
gatctaagggaagatcactgta

SEQ ID NO: 6252750 - DNA, 18 bp, Homo sapiens
gatctaataaactttatt

SEQ ID NO: 6252751 - DNA, 18 bp, Homo sapiens
gatctaatacaaagatga

SEQ ID NO: 6252752 - DNA, 11 bp, Homo sapiens
gatctacacat

SEQ ID NO: 6252753 - DNA, 12 bp, Homo sapiens
gatctacacatg

SEQ ID NO: 6252754 - DNA, 22 bp, Homo sapiens
gatctacaggacaaagggaggg

SEQ ID NO: 6252755 - DNA, 23 bp, Homo sapiens
gatctacatgaggaactgtagat

SEQ ID NO: 6252756 - DNA, 18 bp, Homo sapiens
gatctaccagcataaata

SEQ ID NO: 6252757 - DNA, 18 bp, Homo sapiens
gatctaccccagggagaa

SEQ ID NO: 6252758 - DNA, 17 bp, Homo sapiens
gatctaccccttactta

SEQ ID NO: 6252759 - DNA, 17 bp, Homo sapiens
gatctacccgtgcctgg

SEQ ID NO: 6252760 - DNA, 22 bp, Homo sapiens
gatctacctgcaacacaacatt

SEQ ID NO: 6252761 - DNA, 20 bp, Homo sapiens
gatctacttcatagctcctt

SEQ ID NO: 6252762 - DNA, 12 bp, Homo sapiens
gatctagaaagt

SEQ ID NO: 6252763 - DNA, 18 bp, Homo sapiens
gatctagaataatcttgc

SEQ ID NO: 6252764 - DNA, 22 bp, Homo sapiens
gatctagaatgtgttttctgaa

SEQ ID NO: 6252765 - DNA, 24 bp, Homo sapiens
gatctagatacaggactggttcct

SEQ ID NO: 6252766 - DNA, 16 bp, Homo sapiens
gatctagcactcctca

SEQ ID NO: 6252767 - DNA, 21 bp, Homo sapiens
gatctagcttcatgcctcagt

SEQ ID NO: 6252768 - DNA, 18 bp, Homo sapiens
gatctaggaagactttgg

SEQ ID NO: 6252769 - DNA, 15 bp, Homo sapiens
gatctaggagaggag

SEQ ID NO: 6252770 - DNA, 13 bp, Homo sapiens
gatctaggtcttg

SEQ ID NO: 6252771 - DNA, 14 bp, Homo sapiens
gatctaggtttaac

SEQ ID NO: 6252772 - DNA, 15 bp, Homo sapiens
gatctaggtttaact

SEQ ID NO: 6252773 - DNA, 17 bp, Homo sapiens
gatctaggtttaactca

SEQ ID NO: 6252774 - DNA, 21 bp, Homo sapiens
gatctagttctcaatcactgc

SEQ ID NO: 6252775 - DNA, 22 bp, Homo sapiens
gatctagttctcttctcctgtg

SEQ ID NO: 6252776 - DNA, 16 bp, Homo sapiens
gatctatacttgcttt

SEQ ID NO: 6252777 - DNA, 15 bp, Homo sapiens
gatctatgcaatttt

SEQ ID NO: 6252778 - DNA, 16 bp, Homo sapiens
gatctatgcctttcaa

SEQ ID NO: 6252779 - DNA, 18 bp, Homo sapiens
gatctatgggaaatctag

SEQ ID NO: 6252780 - DNA, 17 bp, Homo sapiens
gatctatgtttgtgtga

SEQ ID NO: 6252781 - DNA, 17 bp, Homo sapiens
gatctattgatttgaaa

SEQ ID NO: 6252782 - DNA, 18 bp, Homo sapiens
gatctattgatttgaaaa

SEQ ID NO: 6252783 - DNA, 13 bp, Homo sapiens
gatctatttatta

SEQ ID NO: 6252784 - DNA, 15 bp, Homo sapiens
gatctatttattatc

SEQ ID NO: 6252785 - DNA, 13 bp, Homo sapiens
gatctatttcatg

SEQ ID NO: 6252786 - DNA, 16 bp, Homo sapiens
gatctatttcatgttt

SEQ ID NO: 6252787 - DNA, 16 bp, Homo sapiens
gatctatttttgcact

SEQ ID NO: 6252788 - DNA, 17 bp, Homo sapiens
gatctcaaatccactga

SEQ ID NO: 6252789 - DNA, 17 bp, Homo sapiens
gatctcaagccagcccc

SEQ ID NO: 6252790 - DNA, 16 bp, Homo sapiens
gatctcaagtatatgt

SEQ ID NO: 6252791 - DNA, 16 bp, Homo sapiens
gatctcacaggctgag

SEQ ID NO: 6252792 - DNA, 16 bp, Homo sapiens
gatctcaccaggcagc

SEQ ID NO: 6252793 - DNA, 20 bp, Homo sapiens
gatctcaccaggcagcctct

SEQ ID NO: 6252794 - DNA, 22 bp, Homo sapiens
gcctcaccttggggcttgactt

SEQ ID NO: 6252795 - DNA, 19 bp, Homo sapiens
gcctcacgcccagcctcct

SEQ ID NO: 6252796 - DNA, 23 bp, Homo sapiens
gcctcacgcccagcctcctccca

SEQ ID NO: 6252797 - DNA, 23 bp, Homo sapiens
gcctcacggggttggctgttcca

SEQ ID NO: 6252798 - DNA, 19 bp, Homo sapiens
gcctcactaatttttgtat

SEQ ID NO: 6252799 - DNA, 16 bp, Homo sapiens
gcctcactcaagcctg

SEQ ID NO: 6252800 - DNA, 23 bp, Homo sapiens
gcctcactcaagcctgagagaag

SEQ ID NO: 6252801 - DNA, 16 bp, Homo sapiens
gcctcactccaggaag

SEQ ID NO: 6252802 - DNA, 20 bp, Homo sapiens
gcctcactctgttgctcagg

SEQ ID NO: 6252803 - DNA, 19 bp, Homo sapiens
gcctcactgcatctttctc

SEQ ID NO: 6252804 - DNA, 22 bp, Homo sapiens
gcctcactggctggggcagagg

SEQ ID NO: 6252805 - DNA, 14 bp, Homo sapiens
gcctcactggggca

SEQ ID NO: 6252806 - DNA, 13 bp, Homo sapiens
gcctcactgggtg

SEQ ID NO: 6252807 - DNA, 17 bp, Homo sapiens
gcctcactgtgacctgc

SEQ ID NO: 6252808 - DNA, 19 bp, Homo sapiens
gcctcacttcctttgccct

SEQ ID NO: 6252809 - DNA, 20 bp, Homo sapiens
gcctcacttgaatgtgtcac

SEQ ID NO: 6252810 - DNA, 13 bp, Homo sapiens
gcctcagaagaaa

SEQ ID NO: 6252811 - DNA, 21 bp, Homo sapiens
gcctcagaagccttcttgctg

SEQ ID NO: 6252812 - DNA, 20 bp, Homo sapiens
gcctcagaaggccccagaga

SEQ ID NO: 6252813 - DNA, 21 bp, Homo sapiens
gcctcagaaggccccagagag

SEQ ID NO: 6252814 - DNA, 12 bp, Homo sapiens
gcctcagaccaa

SEQ ID NO: 6252815 - DNA, 16 bp, Homo sapiens
gcctcagaccaactct

SEQ ID NO: 6252816 - DNA, 19 bp, Homo sapiens
gcctcagaccccctcagcc

SEQ ID NO: 6252817 - DNA, 13 bp, Homo sapiens
gcctcagactcat

SEQ ID NO: 6252818 - DNA, 16 bp, Homo sapiens
gcctcagactccgccc

SEQ ID NO: 6252819 - DNA, 17 bp, Homo sapiens
gcctcagactgcaccca

SEQ ID NO: 6252820 - DNA, 18 bp, Homo sapiens
gcctcagactgcacccag

SEQ ID NO: 6252821 - DNA, 19 bp, Homo sapiens
gcctcagactgcacccagg

SEQ ID NO: 6252822 - DNA, 22 bp, Homo sapiens
gcctcagagatctcccttctca

SEQ ID NO: 6252823 - DNA, 23 bp, Homo sapiens
gcctcagagatctcccttctcat

SEQ ID NO: 6252824 - DNA, 15 bp, Homo sapiens
gcctcagagcaggct

SEQ ID NO: 6252825 - DNA, 15 bp, Homo sapiens
gcctcagagcctgac

SEQ ID NO: 6252826 - DNA, 15 bp, Homo sapiens
gcctcagagcttcct

SEQ ID NO: 6252827 - DNA, 17 bp, Homo sapiens
gcctcagaggagctcta

SEQ ID NO: 6252828 - DNA, 18 bp, Homo sapiens
gcctcagaggagctctac

SEQ ID NO: 6252829 - DNA, 18 bp, Homo sapiens
gcctcagaggccccttgc

SEQ ID NO: 6252830 - DNA, 17 bp, Homo sapiens
gcctcagagtcctgccg

SEQ ID NO: 6252831 - DNA, 23 bp, Homo sapiens
gcctcagatccaggcaggagcac

SEQ ID NO: 6252832 - DNA, 20 bp, Homo sapiens
gcctcagcaaacccaaagat

SEQ ID NO: 6252833 - DNA, 21 bp, Homo sapiens
gcctcagcagaaggccttgcc

SEQ ID NO: 6252834 - DNA, 22 bp, Homo sapiens
gcctcagcagaaggccttgcct

SEQ ID NO: 6252835 - DNA, 12 bp, Homo sapiens
gcctcagcagca

SEQ ID NO: 6252836 - DNA, 15 bp, Homo sapiens
gcctcagcatctcat

SEQ ID NO: 6252837 - DNA, 13 bp, Homo sapiens
gcctcagccactc

SEQ ID NO: 6252838 - DNA, 21 bp, Homo sapiens
gcctcagccactcccaggggc

SEQ ID NO: 6252839 - DNA, 22 bp, Homo sapiens
gcctcagccactcccaggggcc

SEQ ID NO: 6252840 - DNA, 15 bp, Homo sapiens
gcctcagccagagaa

SEQ ID NO: 6252841 - DNA, 18 bp, Homo sapiens
gcctcagccagccctgga

SEQ ID NO: 6252842 - DNA, 19 bp, Homo sapiens
gcctcagccagccctggag

SEQ ID NO: 6252843 - DNA, 21 bp, Homo sapiens
gcctcagccagccctggaggc

SEQ ID NO: 6252844 - DNA, 17 bp, Homo sapiens
gcctcagccagctgccc

SEQ ID NO: 6252845 - DNA, 19 bp, Homo sapiens
gcctcagccagctgcccac

SEQ ID NO: 6252846 - DNA, 13 bp, Homo sapiens
gcctcagccaggc

SEQ ID NO: 6252847 - DNA, 19 bp, Homo sapiens
gcctcagccagtggcacag

SEQ ID NO: 6252848 - DNA, 15 bp, Homo sapiens
gcctcagccattcac

SEQ ID NO: 6252849 - DNA, 17 bp, Homo sapiens
gcctcagccattcactg

SEQ ID NO: 6252850 - DNA, 12 bp, Homo sapiens
gcctcagccctc

SEQ ID NO: 6252851 - DNA, 19 bp, Homo sapiens
gcctcagccctcagttcct

SEQ ID NO: 6252852 - DNA, 17 bp, Homo sapiens
gcctcagccctgaccct

SEQ ID NO: 6252853 - DNA, 13 bp, Homo sapiens
gcctcagccctgc

SEQ ID NO: 6252854 - DNA, 14 bp, Homo sapiens
gcctcagccctgct

SEQ ID NO: 6252855 - DNA, 15 bp, Homo sapiens
gcctcagccctgctc

SEQ ID NO: 6252856 - DNA, 21 bp, Homo sapiens
gcctcagccctgctccctgcc

SEQ ID NO: 6252857 - DNA, 23 bp, Homo sapiens
gcctcagccctgctccctgcctc

SEQ ID NO: 6252858 - DNA, 14 bp, Homo sapiens
gcctcagcctactc

SEQ ID NO: 6252859 - DNA, 14 bp, Homo sapiens
gcctcagcctccag

SEQ ID NO: 6252860 - DNA, 17 bp, Homo sapiens
gcctcagcctccaggca

SEQ ID NO: 6252861 - DNA, 15 bp, Homo sapiens
gcctcagcctcccaa

SEQ ID NO: 6252862 - DNA, 15 bp, Homo sapiens
gcctcagcctcccga

SEQ ID NO: 6252863 - DNA, 16 bp, Homo sapiens
gcctcagcctcccgag

SEQ ID NO: 6252864 - DNA, 13 bp, Homo sapiens
gcctcagcctcct

SEQ ID NO: 6252865 - DNA, 14 bp, Homo sapiens
gcctcagcctgctt

SEQ ID NO: 6252866 - DNA, 21 bp, Homo sapiens
gcctcagcctgctttcctgca

SEQ ID NO: 6252867 - DNA, 18 bp, Homo sapiens
gcctcagcctggggctct

SEQ ID NO: 6252868 - DNA, 21 bp, Homo sapiens
gcctcagcctggggctctctg

SEQ ID NO: 6252869 - DNA, 22 bp, Homo sapiens
gcctcagccttccaactagctg

SEQ ID NO: 6252870 - DNA, 18 bp, Homo sapiens
gcctcagcgctgcccaca

SEQ ID NO: 6252871 - DNA, 22 bp, Homo sapiens
gcctcagctgacccggcctctc

SEQ ID NO: 6252872 - DNA, 21 bp, Homo sapiens
gcctcagctgcatctgataaa

SEQ ID NO: 6252873 - DNA, 20 bp, Homo sapiens
gcctcagctgcctcacttcc

SEQ ID NO: 6252874 - DNA, 12 bp, Homo sapiens
gcctcagctgct

SEQ ID NO: 6252875 - DNA, 14 bp, Homo sapiens
gcctcagctgctcg

SEQ ID NO: 6252876 - DNA, 19 bp, Homo sapiens
gcctcagctgctcgcacag

SEQ ID NO: 6252877 - DNA, 16 bp, Homo sapiens
gcctcagcttccccag

SEQ ID NO: 6252878 - DNA, 17 bp, Homo sapiens
gcctcagcttccccagt

SEQ ID NO: 6252879 - DNA, 17 bp, Homo sapiens
gcctcaggacccatccc

SEQ ID NO: 6252880 - DNA, 20 bp, Homo sapiens
gcctcaggacccatccctgc

SEQ ID NO: 6252881 - DNA, 16 bp, Homo sapiens
gcctcaggactgggag

SEQ ID NO: 6252882 - DNA, 17 bp, Homo sapiens
gcctcaggactgggagc

SEQ ID NO: 6252883 - DNA, 19 bp, Homo sapiens
gcctcaggcactctcctgt

SEQ ID NO: 6252884 - DNA, 17 bp, Homo sapiens
gcctcaggccagggctc

SEQ ID NO: 6252885 - DNA, 15 bp, Homo sapiens
gcctcaggcctccca

SEQ ID NO: 6252886 - DNA, 15 bp, Homo sapiens
gcctcaggcctctgt

SEQ ID NO: 6252887 - DNA, 16 bp, Homo sapiens
gcctcaggcctggccc

SEQ ID NO: 6252888 - DNA, 12 bp, Homo sapiens
gcctcaggctcc

SEQ ID NO: 6252889 - DNA, 17 bp, Homo sapiens
gcctcaggctccgggca

SEQ ID NO: 6252890 - DNA, 15 bp, Homo sapiens
gcctcaggctctgca

SEQ ID NO: 6252891 - DNA, 20 bp, Homo sapiens
gcctcaggcttgagggaggg

SEQ ID NO: 6252892 - DNA, 21 bp, Homo sapiens
gcctcaggcttgagggagggc

SEQ ID NO: 6252893 - DNA, 15 bp, Homo sapiens
gcctcagggaccaag

SEQ ID NO: 6252894 - DNA, 21 bp, Homo sapiens
gcctcagggaccaaggagatg

SEQ ID NO: 6252895 - DNA, 12 bp, Homo sapiens
gcctcagggcca

SEQ ID NO: 6252896 - DNA, 14 bp, Homo sapiens
gcctcagggccaag

SEQ ID NO: 6252897 - DNA, 16 bp, Homo sapiens
gcctcagggccaagcc

SEQ ID NO: 6252898 - DNA, 17 bp, Homo sapiens
gcctcagggccaagccg

SEQ ID NO: 6252899 - DNA, 20 bp, Homo sapiens
gcctcagggccaagccggcc

SEQ ID NO: 6252900 - DNA, 15 bp, Homo sapiens
gcctcagggccagga

SEQ ID NO: 6252901 - DNA, 16 bp, Homo sapiens
gcctcagggccaggaa

SEQ ID NO: 6252902 - DNA, 17 bp, Homo sapiens
gcctcagggccaggaag

SEQ ID NO: 6252903 - DNA, 22 bp, Homo sapiens
gcctcagggccaggaaggacag

SEQ ID NO: 6252904 - DNA, 13 bp, Homo sapiens
gcctcagggcgct

SEQ ID NO: 6252905 - DNA, 15 bp, Homo sapiens
gcctcagggcgctca

SEQ ID NO: 6252906 - DNA, 16 bp, Homo sapiens
gcctcagggcgctcag

SEQ ID NO: 6252907 - DNA, 18 bp, Homo sapiens
gcctcagggcgctcagac

SEQ ID NO: 6252908 - DNA, 21 bp, Homo sapiens
gcctcagggcgctcagacggc

SEQ ID NO: 6252909 - DNA, 12 bp, Homo sapiens
gcctcagggctc

SEQ ID NO: 6252910 - DNA, 16 bp, Homo sapiens
gcctcaggggtctgag

SEQ ID NO: 6252911 - DNA, 16 bp, Homo sapiens
gcctcagggtcctgcc

SEQ ID NO: 6252912 - DNA, 20 bp, Homo sapiens
gcctcagggtgcacacagga

SEQ ID NO: 6252913 - DNA, 15 bp, Homo sapiens
gcctcaggtgctgtc

SEQ ID NO: 6252914 - DNA, 20 bp, Homo sapiens
gcctcaggtgctgtccatgg

SEQ ID NO: 6252915 - DNA, 20 bp, Homo sapiens
gcctcagtaagacgacaagg

SEQ ID NO: 6252916 - DNA, 23 bp, Homo sapiens
gcctcagtccctccctcctggct

SEQ ID NO: 6252917 - DNA, 16 bp, Homo sapiens
gcctcagtcctcccct

SEQ ID NO: 6252918 - DNA, 22 bp, Homo sapiens
gcctcagtcctcccctcacagc

SEQ ID NO: 6252919 - DNA, 15 bp, Homo sapiens
gcctcagtctccctc

SEQ ID NO: 6252920 - DNA, 22 bp, Homo sapiens
gcctcagtctcccttctcccat

SEQ ID NO: 6252921 - DNA, 20 bp, Homo sapiens
gcctcagtgaccctggctcc

SEQ ID NO: 6252922 - DNA, 12 bp, Homo sapiens
gcctcagtgcca

SEQ ID NO: 6252923 - DNA, 24 bp, Homo sapiens
gcctcagtgccacttgacattcct

SEQ ID NO: 6252924 - DNA, 12 bp, Homo sapiens
gcctcagtgccc

SEQ ID NO: 6252925 - DNA, 21 bp, Homo sapiens
gcctcagtggactttccaccc

SEQ ID NO: 6252926 - DNA, 22 bp, Homo sapiens
gcctcagtggactttccacccc

SEQ ID NO: 6252927 - DNA, 19 bp, Homo sapiens
gcctcagtggcagcatcct

SEQ ID NO: 6252928 - DNA, 20 bp, Homo sapiens
gcctcagtggctctgggtac

SEQ ID NO: 6252929 - DNA, 16 bp, Homo sapiens
gcctcagttcaacctg

SEQ ID NO: 6252930 - DNA, 17 bp, Homo sapiens
gcctcagttcccagctc

SEQ ID NO: 6252931 - DNA, 16 bp, Homo sapiens
gcctcagtttccccat

SEQ ID NO: 6252932 - DNA, 17 bp, Homo sapiens
gcctcagtttccccatt

SEQ ID NO: 6252933 - DNA, 16 bp, Homo sapiens
gcctcagtttctccat

SEQ ID NO: 6252934 - DNA, 20 bp, Homo sapiens
gcctcagtttctccatcagc

SEQ ID NO: 6252935 - DNA, 15 bp, Homo sapiens
gcctcagttttcctt

SEQ ID NO: 6252936 - DNA, 13 bp, Homo sapiens
gcctcataaatta

SEQ ID NO: 6252937 - DNA, 18 bp, Homo sapiens
gcctcatactcctgggct

SEQ ID NO: 6252938 - DNA, 19 bp, Homo sapiens
gcctcatactcctgggctc

SEQ ID NO: 6252939 - DNA, 19 bp, Homo sapiens
gcctcatccgaggcagggt

SEQ ID NO: 6252940 - DNA, 21 bp, Homo sapiens
gcctcatcctccccaggaccc

SEQ ID NO: 6252941 - DNA, 16 bp, Homo sapiens
gcctcatcttccccag

SEQ ID NO: 6252942 - DNA, 18 bp, Homo sapiens
gcctcatcttccccagcc

SEQ ID NO: 6252943 - DNA, 14 bp, Homo sapiens
gcctcatgaataaa

SEQ ID NO: 6252944 - DNA, 15 bp, Homo sapiens
gcctcatgaataaat

SEQ ID NO: 6252945 - DNA, 12 bp, Homo sapiens
gcctcatgcctg

SEQ ID NO: 6252946 - DNA, 18 bp, Homo sapiens
gcctcatgcctgctgaga

SEQ ID NO: 6252947 - DNA, 19 bp, Homo sapiens
gcctcatgctgacttgcag

SEQ ID NO: 6252948 - DNA, 18 bp, Homo sapiens
gcctcatgctggagggag

SEQ ID NO: 6252949 - DNA, 23 bp, Homo sapiens
gcctcatggcttttgctttccct

SEQ ID NO: 6252950 - DNA, 21 bp, Homo sapiens
gcctcatgggaagtcctggca

SEQ ID NO: 6252951 - DNA, 23 bp, Homo sapiens
gcctcatgggaagtcctggcaca

SEQ ID NO: 6252952 - DNA, 22 bp, Homo sapiens
gcctcatgtccactggttcttc

SEQ ID NO: 6252953 - DNA, 13 bp, Homo sapiens
gcctcatgtggct

SEQ ID NO: 6252954 - DNA, 18 bp, Homo sapiens
gcctcatgtggctggaag

SEQ ID NO: 6252955 - DNA, 14 bp, Homo sapiens
gcctcattcagcag

SEQ ID NO: 6252956 - DNA, 21 bp, Homo sapiens
gcctcattcagcatgggtcct

SEQ ID NO: 6252957 - DNA, 16 bp, Homo sapiens
gcctcattgtgccaag

SEQ ID NO: 6252958 - DNA, 17 bp, Homo sapiens
gcctcattgtgccaagc

SEQ ID NO: 6252959 - DNA, 21 bp, Homo sapiens
gcctcattgtgccaagccttc

SEQ ID NO: 6252960 - DNA, 21 bp, Homo sapiens
gcctcatttcttcctctgcat

SEQ ID NO: 6252961 - DNA, 21 bp, Homo sapiens
gcctcattttgcttcccatct

SEQ ID NO: 6252962 - DNA, 21 bp, Homo sapiens
gcctcatttttttccttgcaa

SEQ ID NO: 6252963 - DNA, 17 bp, Homo sapiens
gcctccaaatgccaact

SEQ ID NO: 6252964 - DNA, 22 bp, Homo sapiens
gcctccaaatgccaacttgtcc

SEQ ID NO: 6252965 - DNA, 17 bp, Homo sapiens
gcctccaacccctcgcc

SEQ ID NO: 6252966 - DNA, 20 bp, Homo sapiens
gcctccaacccctcgcccag

SEQ ID NO: 6252967 - DNA, 22 bp, Homo sapiens
gcctccaacccctcgcccagtc

SEQ ID NO: 6252968 - DNA, 15 bp, Homo sapiens
gcctccaaccttctg

SEQ ID NO: 6252969 - DNA, 15 bp, Homo sapiens
gcctccaagcacaga

SEQ ID NO: 6252970 - DNA, 16 bp, Homo sapiens
gcctccaagcacagag

SEQ ID NO: 6252971 - DNA, 23 bp, Homo sapiens
gatctcaccaggcagcctctggg

SEQ ID NO: 6252972 - DNA, 20 bp, Homo sapiens
gatctcactaaaaatataca

SEQ ID NO: 6252973 - DNA, 13 bp, Homo sapiens
gatctcactctgc

SEQ ID NO: 6252974 - DNA, 15 bp, Homo sapiens
gatctcactctgccc

SEQ ID NO: 6252975 - DNA, 20 bp, Homo sapiens
gatctcagataaagtgacca

SEQ ID NO: 6252976 - DNA, 21 bp, Homo sapiens
gatctcagataaagtgaccag

SEQ ID NO: 6252977 - DNA, 11 bp, Homo sapiens
gatctcagcca

SEQ ID NO: 6252978 - DNA, 12 bp, Homo sapiens
gatctcagctca

SEQ ID NO: 6252979 - DNA, 14 bp, Homo sapiens
gatctcagctcact

SEQ ID NO: 6252980 - DNA, 22 bp, Homo sapiens
gatctcagctttgagaagcctt

SEQ ID NO: 6252981 - DNA, 19 bp, Homo sapiens
gatctcagggaagcccagc

SEQ ID NO: 6252982 - DNA, 21 bp, Homo sapiens
gatctcagggaagcccagctc

SEQ ID NO: 6252983 - DNA, 18 bp, Homo sapiens
gatctcatagatgacccc

SEQ ID NO: 6252984 - DNA, 22 bp, Homo sapiens
gatctcatcccaataaaatgat

SEQ ID NO: 6252985 - DNA, 17 bp, Homo sapiens
gatctcattcagtatta

SEQ ID NO: 6252986 - DNA, 20 bp, Homo sapiens
gatctcattcagtattaaag

SEQ ID NO: 6252987 - DNA, 21 bp, Homo sapiens
gatctcattgttcaattccca

SEQ ID NO: 6252988 - DNA, 13 bp, Homo sapiens
gatctccaaagct

SEQ ID NO: 6252989 - DNA, 20 bp, Homo sapiens
gatctccaactctctctgtg

SEQ ID NO: 6252990 - DNA, 13 bp, Homo sapiens
gatctccaaggac

SEQ ID NO: 6252991 - DNA, 17 bp, Homo sapiens
gatctccaattgcctct

SEQ ID NO: 6252992 - DNA, 16 bp, Homo sapiens
gatctccaggcccagc

SEQ ID NO: 6252993 - DNA, 22 bp, Homo sapiens
gatctccaggcccagcctggcc

SEQ ID NO: 6252994 - DNA, 17 bp, Homo sapiens
gatctccatatgttaca

SEQ ID NO: 6252995 - DNA, 13 bp, Homo sapiens
gatctcccagggc

SEQ ID NO: 6252996 - DNA, 15 bp, Homo sapiens
gatctcccagggcta

SEQ ID NO: 6252997 - DNA, 12 bp, Homo sapiens
gatctcccctca

SEQ ID NO: 6252998 - DNA, 15 bp, Homo sapiens
gatctccctccaggg

SEQ ID NO: 6252999 - DNA, 14 bp, Homo sapiens
gatctcccttctca

SEQ ID NO: 6253000 - DNA, 14 bp, Homo sapiens
gatctcctggtagc

SEQ ID NO: 6253001 - DNA, 16 bp, Homo sapiens
gatctcctgtgcacct

SEQ ID NO: 6253002 - DNA, 18 bp, Homo sapiens
gatctccttcccttctct

SEQ ID NO: 6253003 - DNA, 22 bp, Homo sapiens
gatctccttcccttctcttggg

SEQ ID NO: 6253004 - DNA, 14 bp, Homo sapiens
gatctcgactcccc

SEQ ID NO: 6253005 - DNA, 15 bp, Homo sapiens
gatctcggctcactg

SEQ ID NO: 6253006 - DNA, 14 bp, Homo sapiens
gatctcggtttgcc

SEQ ID NO: 6253007 - DNA, 17 bp, Homo sapiens
gatctcgtttactccat

SEQ ID NO: 6253008 - DNA, 21 bp, Homo sapiens
gatctctactaccacaaggaa

SEQ ID NO: 6253009 - DNA, 12 bp, Homo sapiens
gatctctcagga

SEQ ID NO: 6253010 - DNA, 13 bp, Homo sapiens
gatctctcaggag

SEQ ID NO: 6253011 - DNA, 18 bp, Homo sapiens
gatctctcaggagcacag

SEQ ID NO: 6253012 - DNA, 20 bp, Homo sapiens
gatctctcaggagcacaggc

SEQ ID NO: 6253013 - DNA, 17 bp, Homo sapiens
gatctctctagctttgt

SEQ ID NO: 6253014 - DNA, 13 bp, Homo sapiens
gatctctcttgtc

SEQ ID NO: 6253015 - DNA, 21 bp, Homo sapiens
gatctctcttgtcctcttctg

SEQ ID NO: 6253016 - DNA, 14 bp, Homo sapiens
gatctctgacctct

SEQ ID NO: 6253017 - DNA, 18 bp, Homo sapiens
gatctctgacctctgctg

SEQ ID NO: 6253018 - DNA, 24 bp, Homo sapiens
gatctctgacctctgctgagtgct

SEQ ID NO: 6253019 - DNA, 12 bp, Homo sapiens
gatctctgcagg

SEQ ID NO: 6253020 - DNA, 16 bp, Homo sapiens
gatctctgcagggccg

SEQ ID NO: 6253021 - DNA, 17 bp, Homo sapiens
gatctctgctccctgca

SEQ ID NO: 6253022 - DNA, 12 bp, Homo sapiens
gatctcttaaga

SEQ ID NO: 6253023 - DNA, 13 bp, Homo sapiens
gatctcttcctgt

SEQ ID NO: 6253024 - DNA, 14 bp, Homo sapiens
gatctcttcctgtt

SEQ ID NO: 6253025 - DNA, 19 bp, Homo sapiens
gatctcttcttaatgtaca

SEQ ID NO: 6253026 - DNA, 17 bp, Homo sapiens
gatctcttgagcctggg

SEQ ID NO: 6253027 - DNA, 20 bp, Homo sapiens
gatctctttctaaagacagg

SEQ ID NO: 6253028 - DNA, 21 bp, Homo sapiens
gatctgaacccagctgtgccc

SEQ ID NO: 6253029 - DNA, 22 bp, Homo sapiens
gatctgaacccagctgtgcccc

SEQ ID NO: 6253030 - DNA, 20 bp, Homo sapiens
gatctgaactttgtttccag

SEQ ID NO: 6253031 - DNA, 16 bp, Homo sapiens
gatctgaattaaataa

SEQ ID NO: 6253032 - DNA, 17 bp, Homo sapiens
gatctgacatgattcct

SEQ ID NO: 6253033 - DNA, 19 bp, Homo sapiens
gatctgacatgattccttc

SEQ ID NO: 6253034 - DNA, 16 bp, Homo sapiens
gatctgaccctcccag

SEQ ID NO: 6253035 - DNA, 17 bp, Homo sapiens
gatctgaccctcccagt

SEQ ID NO: 6253036 - DNA, 14 bp, Homo sapiens
gatctgactgccaa

SEQ ID NO: 6253037 - DNA, 19 bp, Homo sapiens
gatctgactttaattgtgt

SEQ ID NO: 6253038 - DNA, 12 bp, Homo sapiens
gatctgagaaca

SEQ ID NO: 6253039 - DNA, 15 bp, Homo sapiens
gatctgagaatcttt

SEQ ID NO: 6253040 - DNA, 23 bp, Homo sapiens
gatctgagccctccctcttccca

SEQ ID NO: 6253041 - DNA, 18 bp, Homo sapiens
gatctgagtctagaaccc

SEQ ID NO: 6253042 - DNA, 23 bp, Homo sapiens
gatctgatagggtttgtgacagg

SEQ ID NO: 6253043 - DNA, 20 bp, Homo sapiens
gatctgatggtgagctggga

SEQ ID NO: 6253044 - DNA, 17 bp, Homo sapiens
gatctgcacagtcagaa

SEQ ID NO: 6253045 - DNA, 13 bp, Homo sapiens
gatctgcactcct

SEQ ID NO: 6253046 - DNA, 21 bp, Homo sapiens
gatctgcactcctgtctcttg

SEQ ID NO: 6253047 - DNA, 16 bp, Homo sapiens
gatctgcaggctgcac

SEQ ID NO: 6253048 - DNA, 20 bp, Homo sapiens
gatctgcagggggtgtgtct

SEQ ID NO: 6253049 - DNA, 20 bp, Homo sapiens
gatctgcaggggtctgggag

SEQ ID NO: 6253050 - DNA, 19 bp, Homo sapiens
gatctgcatatttctgtat

SEQ ID NO: 6253051 - DNA, 20 bp, Homo sapiens
gatctgccagacctgcatgg

SEQ ID NO: 6253052 - DNA, 19 bp, Homo sapiens
gatctgcccacctcggcct

SEQ ID NO: 6253053 - DNA, 22 bp, Homo sapiens
gatctgcccacctcggcctccc

SEQ ID NO: 6253054 - DNA, 14 bp, Homo sapiens
gatctgcccctccc

SEQ ID NO: 6253055 - DNA, 20 bp, Homo sapiens
gatctgcccctccctgcttc

SEQ ID NO: 6253056 - DNA, 19 bp, Homo sapiens
gatctgcccgcctcggcct

SEQ ID NO: 6253057 - DNA, 12 bp, Homo sapiens
gatctgcctaag

SEQ ID NO: 6253058 - DNA, 15 bp, Homo sapiens
gatctgcctaaggac

SEQ ID NO: 6253059 - DNA, 16 bp, Homo sapiens
gatctgcctaaggact

SEQ ID NO: 6253060 - DNA, 18 bp, Homo sapiens
gatctgcctaaggacttc

SEQ ID NO: 6253061 - DNA, 21 bp, Homo sapiens
gatctgcctaaggacttcttt

SEQ ID NO: 6253062 - DNA, 15 bp, Homo sapiens
gatctgcctgggcct

SEQ ID NO: 6253063 - DNA, 16 bp, Homo sapiens
gatctgcctgggcctg

SEQ ID NO: 6253064 - DNA, 22 bp, Homo sapiens
gatctgcctgggcctgtgcagc

SEQ ID NO: 6253065 - DNA, 20 bp, Homo sapiens
gatctgctatttttaatttc

SEQ ID NO: 6253066 - DNA, 19 bp, Homo sapiens
gatctgctcagccctggag

SEQ ID NO: 6253067 - DNA, 20 bp, Homo sapiens
gatctgctcagccctggagg

SEQ ID NO: 6253068 - DNA, 16 bp, Homo sapiens
gatctgctccatgcag

SEQ ID NO: 6253069 - DNA, 21 bp, Homo sapiens
gatctgctgaggcccagtgca

SEQ ID NO: 6253070 - DNA, 16 bp, Homo sapiens
gatctgctgcagagca

SEQ ID NO: 6253071 - DNA, 18 bp, Homo sapiens
gatctgctgggctctgcc

SEQ ID NO: 6253072 - DNA, 15 bp, Homo sapiens
gatctgcttccctgg

SEQ ID NO: 6253073 - DNA, 22 bp, Homo sapiens
gatctgcttccctggggcccca

SEQ ID NO: 6253074 - DNA, 19 bp, Homo sapiens
gatctgcttgttgcatttc

SEQ ID NO: 6253075 - DNA, 19 bp, Homo sapiens
gatctgctttctgttcatc

SEQ ID NO: 6253076 - DNA, 21 bp, Homo sapiens
gatctgctttctgttcatctc

SEQ ID NO: 6253077 - DNA, 17 bp, Homo sapiens
gatctggaaagagctgt

SEQ ID NO: 6253078 - DNA, 16 bp, Homo sapiens
gatctggaacctcagc

SEQ ID NO: 6253079 - DNA, 17 bp, Homo sapiens
gatctggaacctcagcc

SEQ ID NO: 6253080 - DNA, 20 bp, Homo sapiens
gatctggaacctcagcctgg

SEQ ID NO: 6253081 - DNA, 22 bp, Homo sapiens
gatctggaagggccaaggtctg

SEQ ID NO: 6253082 - DNA, 23 bp, Homo sapiens
gatctggaccgtcccctgcccac

SEQ ID NO: 6253083 - DNA, 21 bp, Homo sapiens
gatctggatcgttatctactg

SEQ ID NO: 6253084 - DNA, 14 bp, Homo sapiens
gatctggcacactc

SEQ ID NO: 6253085 - DNA, 17 bp, Homo sapiens
gatctggcacactccct

SEQ ID NO: 6253086 - DNA, 19 bp, Homo sapiens
gatctgggaactcccaaga

SEQ ID NO: 6253087 - DNA, 19 bp, Homo sapiens
gatctgggcattttcctcc

SEQ ID NO: 6253088 - DNA, 14 bp, Homo sapiens
gatctggggaagga

SEQ ID NO: 6253089 - DNA, 14 bp, Homo sapiens
gatctggggagagc

SEQ ID NO: 6253090 - DNA, 18 bp, Homo sapiens
gatctggggagagcggct

SEQ ID NO: 6253091 - DNA, 21 bp, Homo sapiens
gatctggggggtggggaggag

SEQ ID NO: 6253092 - DNA, 23 bp, Homo sapiens
gatctggggggtggggaggagga

SEQ ID NO: 6253093 - DNA, 16 bp, Homo sapiens
gatctgggtctctaat

SEQ ID NO: 6253094 - DNA, 18 bp, Homo sapiens
gatctgggttcactgcaa

SEQ ID NO: 6253095 - DNA, 20 bp, Homo sapiens
gatctgggttcactgcaacc

SEQ ID NO: 6253096 - DNA, 20 bp, Homo sapiens
gatctgggttttgcctctgc

SEQ ID NO: 6253097 - DNA, 15 bp, Homo sapiens
gatctggtcctaccc

SEQ ID NO: 6253098 - DNA, 15 bp, Homo sapiens
gatctggtctcgtgt

SEQ ID NO: 6253099 - DNA, 16 bp, Homo sapiens
gatctggtctcgtgtt

SEQ ID NO: 6253100 - DNA, 23 bp, Homo sapiens
gatctggtctcgtgttcgctggc

SEQ ID NO: 6253101 - DNA, 24 bp, Homo sapiens
gatctggtctcgtgttcgctggct

SEQ ID NO: 6253102 - DNA, 22 bp, Homo sapiens
gatctggtgcgtgtggccctgt

SEQ ID NO: 6253103 - DNA, 14 bp, Homo sapiens
gatctggtggtcag

SEQ ID NO: 6253104 - DNA, 20 bp, Homo sapiens
gatctggtggtcagccctag

SEQ ID NO: 6253105 - DNA, 22 bp, Homo sapiens
gatctggtggtcagccctagga

SEQ ID NO: 6253106 - DNA, 16 bp, Homo sapiens
gatctggttttgctat

SEQ ID NO: 6253107 - DNA, 17 bp, Homo sapiens
gatctgtactgtaattt

SEQ ID NO: 6253108 - DNA, 15 bp, Homo sapiens
gatctgtactttgtg

SEQ ID NO: 6253109 - DNA, 14 bp, Homo sapiens
gatctgtagttttt

SEQ ID NO: 6253110 - DNA, 18 bp, Homo sapiens
gatctgtataaaaatgta

SEQ ID NO: 6253111 - DNA, 17 bp, Homo sapiens
gatctgtataaataaga

SEQ ID NO: 6253112 - DNA, 20 bp, Homo sapiens
gatctgtcacaccagccata

SEQ ID NO: 6253113 - DNA, 21 bp, Homo sapiens
gatctgtcattatcaaaagtg

SEQ ID NO: 6253114 - DNA, 17 bp, Homo sapiens
gatctgtcccctctccc

SEQ ID NO: 6253115 - DNA, 18 bp, Homo sapiens
gatctgtcccctctcccc

SEQ ID NO: 6253116 - DNA, 19 bp, Homo sapiens
gatctgtcccctctcccct

SEQ ID NO: 6253117 - DNA, 20 bp, Homo sapiens
gatctgtcccctctcccctc

SEQ ID NO: 6253118 - DNA, 18 bp, Homo sapiens
gatctgtcctcagccttg

SEQ ID NO: 6253119 - DNA, 13 bp, Homo sapiens
gatctgtcctggg

SEQ ID NO: 6253120 - DNA, 14 bp, Homo sapiens
gatctgtcctgggg

SEQ ID NO: 6253121 - DNA, 14 bp, Homo sapiens
gatctgtccttcca

SEQ ID NO: 6253122 - DNA, 22 bp, Homo sapiens
gatctgtccttccaacctgttc

SEQ ID NO: 6253123 - DNA, 14 bp, Homo sapiens
gatctgtctgtgca

SEQ ID NO: 6253124 - DNA, 13 bp, Homo sapiens
gatctgtctgtgg

SEQ ID NO: 6253125 - DNA, 13 bp, Homo sapiens
gatctgtcttgta

SEQ ID NO: 6253126 - DNA, 14 bp, Homo sapiens
gatctgtcttgtaa

SEQ ID NO: 6253127 - DNA, 19 bp, Homo sapiens
gatctgtgacacatcgttt

SEQ ID NO: 6253128 - DNA, 21 bp, Homo sapiens
gatctgtgcagcgaggtccac

SEQ ID NO: 6253129 - DNA, 19 bp, Homo sapiens
gatctgtgcccagagatgg

SEQ ID NO: 6253130 - DNA, 13 bp, Homo sapiens
gatctgtgcccca

SEQ ID NO: 6253131 - DNA, 17 bp, Homo sapiens
gatctgtgcctgggatc

SEQ ID NO: 6253132 - DNA, 18 bp, Homo sapiens
gatctgtgctttccagct

SEQ ID NO: 6253133 - DNA, 19 bp, Homo sapiens
gatctgtgctttccagctc

SEQ ID NO: 6253134 - DNA, 14 bp, Homo sapiens
gatctgtgtggctc

SEQ ID NO: 6253135 - DNA, 20 bp, Homo sapiens
gatctgtgtggctcctgggc

SEQ ID NO: 6253136 - DNA, 13 bp, Homo sapiens
gatctgttgtaat

SEQ ID NO: 6253137 - DNA, 20 bp, Homo sapiens
gatctgttgtgtacgtggag

SEQ ID NO: 6253138 - DNA, 17 bp, Homo sapiens
gatctgttttacaggaa

SEQ ID NO: 6253139 - DNA, 18 bp, Homo sapiens
gatctgttttacaggaaa

SEQ ID NO: 6253140 - DNA, 18 bp, Homo sapiens
gatctgttttctggaagt

SEQ ID NO: 6253141 - DNA, 18 bp, Homo sapiens
gatctgttttgaaggcaa

SEQ ID NO: 6253142 - DNA, 20 bp, Homo sapiens
gatctgttttgaaggcaaaa

SEQ ID NO: 6253143 - DNA, 19 bp, Homo sapiens
gatctgtttttaaaaatca

SEQ ID NO: 6253144 - DNA, 21 bp, Homo sapiens
gatctgtttttaaaaatcata

SEQ ID NO: 6253145 - DNA, 23 bp, Homo sapiens
gatctgtttttaaaaatcataaa

SEQ ID NO: 6253146 - DNA, 10 bp, Homo sapiens
gatcttaaaa

SEQ ID NO: 6253147 - DNA, 16 bp, Homo sapiens
gatcttacaagtttat

SEQ ID NO: 6253148 - DNA, 20 bp, Homo sapiens
gatcttacacgaagaaatag

SEQ ID NO: 6253149 - DNA, 17 bp, Homo sapiens
gcctccaagcctgcctc

SEQ ID NO: 6253150 - DNA, 23 bp, Homo sapiens
gcctccaatgcattggcctctgt

SEQ ID NO: 6253151 - DNA, 18 bp, Homo sapiens
gcctccacaccagctgct

SEQ ID NO: 6253152 - DNA, 21 bp, Homo sapiens
gcctccacactgaccaagtgc

SEQ ID NO: 6253153 - DNA, 20 bp, Homo sapiens
gcctccacatgctgcctggc

SEQ ID NO: 6253154 - DNA, 16 bp, Homo sapiens
gcctccaccaccactg

SEQ ID NO: 6253155 - DNA, 18 bp, Homo sapiens
gcctccaccaccactggc

SEQ ID NO: 6253156 - DNA, 20 bp, Homo sapiens
gcctccaccaccactggcca

SEQ ID NO: 6253157 - DNA, 15 bp, Homo sapiens
gcctccaccagcaag

SEQ ID NO: 6253158 - DNA, 16 bp, Homo sapiens
gcctccaccagcaagg

SEQ ID NO: 6253159 - DNA, 15 bp, Homo sapiens
gcctccaccatcccc

SEQ ID NO: 6253160 - DNA, 20 bp, Homo sapiens
gcctccacccgtcctccctc

SEQ ID NO: 6253161 - DNA, 22 bp, Homo sapiens
gcctccacccgtcctccctcag

SEQ ID NO: 6253162 - DNA, 17 bp, Homo sapiens
gcctccaccctcctcct

SEQ ID NO: 6253163 - DNA, 20 bp, Homo sapiens
gcctccaccgagccagcttg

SEQ ID NO: 6253164 - DNA, 12 bp, Homo sapiens
gcctccaccgct

SEQ ID NO: 6253165 - DNA, 15 bp, Homo sapiens
gcctccacctctgtg

SEQ ID NO: 6253166 - DNA, 16 bp, Homo sapiens
gcctccacctctgtgc

SEQ ID NO: 6253167 - DNA, 15 bp, Homo sapiens
gcctccacctgcagc

SEQ ID NO: 6253168 - DNA, 16 bp, Homo sapiens
gcctccacctgcagcc

SEQ ID NO: 6253169 - DNA, 19 bp, Homo sapiens
gcctccacctgcagcccca

SEQ ID NO: 6253170 - DNA, 22 bp, Homo sapiens
gcctccacctgcagccccaggc

SEQ ID NO: 6253171 - DNA, 23 bp, Homo sapiens
gcctccacctgcagccccaggcc

SEQ ID NO: 6253172 - DNA, 14 bp, Homo sapiens
gcctccacggagag

SEQ ID NO: 6253173 - DNA, 18 bp, Homo sapiens
gcctccactcccacttcc

SEQ ID NO: 6253174 - DNA, 15 bp, Homo sapiens
gcctccactccccca

SEQ ID NO: 6253175 - DNA, 19 bp, Homo sapiens
gcctccactcccccacctg

SEQ ID NO: 6253176 - DNA, 23 bp, Homo sapiens
gcctccactcccccacctgacaa

SEQ ID NO: 6253177 - DNA, 19 bp, Homo sapiens
gcctccactccctgtctga

SEQ ID NO: 6253178 - DNA, 13 bp, Homo sapiens
gcctccactcctt

SEQ ID NO: 6253179 - DNA, 16 bp, Homo sapiens
gcctccactccttcca

SEQ ID NO: 6253180 - DNA, 15 bp, Homo sapiens
gcctccactctagtt

SEQ ID NO: 6253181 - DNA, 22 bp, Homo sapiens
gcctccacttagttttgggagg

SEQ ID NO: 6253182 - DNA, 12 bp, Homo sapiens
gcctccagaacc

SEQ ID NO: 6253183 - DNA, 15 bp, Homo sapiens
gcctccagaagctgc

SEQ ID NO: 6253184 - DNA, 16 bp, Homo sapiens
gcctccagaagctgct

SEQ ID NO: 6253185 - DNA, 17 bp, Homo sapiens
gcctccagaagctgctc

SEQ ID NO: 6253186 - DNA, 19 bp, Homo sapiens
gcctccagagaagccccgc

SEQ ID NO: 6253187 - DNA, 18 bp, Homo sapiens
gcctccagagccagcctg

SEQ ID NO: 6253188 - DNA, 20 bp, Homo sapiens
gcctccagagccagcctggg

SEQ ID NO: 6253189 - DNA, 11 bp, Homo sapiens
gcctccagagg

SEQ ID NO: 6253190 - DNA, 19 bp, Homo sapiens
gcctccagaggaggggtgg

SEQ ID NO: 6253191 - DNA, 21 bp, Homo sapiens
gcctccagccctctcactgtg

SEQ ID NO: 6253192 - DNA, 21 bp, Homo sapiens
gcctccagccgccggctgtgc

SEQ ID NO: 6253193 - DNA, 16 bp, Homo sapiens
gcctccagcctctccc

SEQ ID NO: 6253194 - DNA, 15 bp, Homo sapiens
gcctccagcctctgt

SEQ ID NO: 6253195 - DNA, 12 bp, Homo sapiens
gcctccagcctg

SEQ ID NO: 6253196 - DNA, 18 bp, Homo sapiens
gcctccagcctgcccaag

SEQ ID NO: 6253197 - DNA, 14 bp, Homo sapiens
gcctccagcctggt

SEQ ID NO: 6253198 - DNA, 13 bp, Homo sapiens
gcctccagctcag

SEQ ID NO: 6253199 - DNA, 14 bp, Homo sapiens
gcctccagctttgg

SEQ ID NO: 6253200 - DNA, 19 bp, Homo sapiens
gcctccaggaaccacacca

SEQ ID NO: 6253201 - DNA, 12 bp, Homo sapiens
gcctccaggacc

SEQ ID NO: 6253202 - DNA, 12 bp, Homo sapiens
gcctccaggagg

SEQ ID NO: 6253203 - DNA, 23 bp, Homo sapiens
gcctccaggcaggacgagactcc

SEQ ID NO: 6253204 - DNA, 21 bp, Homo sapiens
gcctccaggccacatggggct

SEQ ID NO: 6253205 - DNA, 14 bp, Homo sapiens
gcctccaggcccgt

SEQ ID NO: 6253206 - DNA, 13 bp, Homo sapiens
gcctccaggctgg

SEQ ID NO: 6253207 - DNA, 14 bp, Homo sapiens
gcctccaggctggg

SEQ ID NO: 6253208 - DNA, 23 bp, Homo sapiens
gcctccaggctggggcctggcct

SEQ ID NO: 6253209 - DNA, 22 bp, Homo sapiens
gcctccagggcattgctcagcc

SEQ ID NO: 6253210 - DNA, 22 bp, Homo sapiens
gcctccagggcgcaggggaggg

SEQ ID NO: 6253211 - DNA, 16 bp, Homo sapiens
gcctccagggctggac

SEQ ID NO: 6253212 - DNA, 17 bp, Homo sapiens
gcctccagggctggact

SEQ ID NO: 6253213 - DNA, 18 bp, Homo sapiens
gcctccagggctggactg

SEQ ID NO: 6253214 - DNA, 19 bp, Homo sapiens
gcctccagggctggactga

SEQ ID NO: 6253215 - DNA, 22 bp, Homo sapiens
gcctccagggctggactgaggc

SEQ ID NO: 6253216 - DNA, 15 bp, Homo sapiens
gcctccaggtgcaga

SEQ ID NO: 6253217 - DNA, 16 bp, Homo sapiens
gcctccaggtgcagag

SEQ ID NO: 6253218 - DNA, 17 bp, Homo sapiens
gcctccaggtgcagagg

SEQ ID NO: 6253219 - DNA, 14 bp, Homo sapiens
gcctccaggtgtgc

SEQ ID NO: 6253220 - DNA, 15 bp, Homo sapiens
gcctccaggttcctc

SEQ ID NO: 6253221 - DNA, 23 bp, Homo sapiens
gcctccagtcatggtactacccc

SEQ ID NO: 6253222 - DNA, 21 bp, Homo sapiens
gcctccagtccaaagccggct

SEQ ID NO: 6253223 - DNA, 14 bp, Homo sapiens
gcctccagtctgct

SEQ ID NO: 6253224 - DNA, 18 bp, Homo sapiens
gcctccagtctgctctca

SEQ ID NO: 6253225 - DNA, 12 bp, Homo sapiens
gcctccagtgca

SEQ ID NO: 6253226 - DNA, 17 bp, Homo sapiens
gcctccagtgctggctg

SEQ ID NO: 6253227 - DNA, 18 bp, Homo sapiens
gcctccagttgtagcagg

SEQ ID NO: 6253228 - DNA, 15 bp, Homo sapiens
gcctccatcagctaa

SEQ ID NO: 6253229 - DNA, 12 bp, Homo sapiens
gcctccatccac

SEQ ID NO: 6253230 - DNA, 15 bp, Homo sapiens
gcctccatccacaca

SEQ ID NO: 6253231 - DNA, 18 bp, Homo sapiens
gcctccatccacacacag

SEQ ID NO: 6253232 - DNA, 12 bp, Homo sapiens
gcctccatcctc

SEQ ID NO: 6253233 - DNA, 13 bp, Homo sapiens
gcctccatcctca

SEQ ID NO: 6253234 - DNA, 18 bp, Homo sapiens
gcctccatcctcatctct

SEQ ID NO: 6253235 - DNA, 18 bp, Homo sapiens
gcctccatctttttcttg

SEQ ID NO: 6253236 - DNA, 21 bp, Homo sapiens
gcctccatgatgcaagccagc

SEQ ID NO: 6253237 - DNA, 20 bp, Homo sapiens
gcctccatgccccagctctg

SEQ ID NO: 6253238 - DNA, 22 bp, Homo sapiens
gcctccatgccccagctctgga

SEQ ID NO: 6253239 - DNA, 23 bp, Homo sapiens
gcctccatgccccagctctggat

SEQ ID NO: 6253240 - DNA, 21 bp, Homo sapiens
gcctccatgtgggtgctaggg

SEQ ID NO: 6253241 - DNA, 14 bp, Homo sapiens
gcctccatgtttta

SEQ ID NO: 6253242 - DNA, 16 bp, Homo sapiens
gcctccatttctggct

SEQ ID NO: 6253243 - DNA, 15 bp, Homo sapiens
gcctccatttctgtc

SEQ ID NO: 6253244 - DNA, 14 bp, Homo sapiens
gcctcccaaaagac

SEQ ID NO: 6253245 - DNA, 19 bp, Homo sapiens
gcctcccaaagtactggga

SEQ ID NO: 6253246 - DNA, 19 bp, Homo sapiens
gcctcccaaagtgctggga

SEQ ID NO: 6253247 - DNA, 17 bp, Homo sapiens
gcctcccaactcacccc

SEQ ID NO: 6253248 - DNA, 13 bp, Homo sapiens
gcctcccaagcag

SEQ ID NO: 6253249 - DNA, 20 bp, Homo sapiens
gcctcccaagctcagagcag

SEQ ID NO: 6253250 - DNA, 13 bp, Homo sapiens
gcctcccaagctg

SEQ ID NO: 6253251 - DNA, 21 bp, Homo sapiens
gcctcccaagtagctgggatt

SEQ ID NO: 6253252 - DNA, 15 bp, Homo sapiens
gcctcccaataaagc

SEQ ID NO: 6253253 - DNA, 19 bp, Homo sapiens
gcctcccaataaagctgga

SEQ ID NO: 6253254 - DNA, 16 bp, Homo sapiens
gcctcccacacttgct

SEQ ID NO: 6253255 - DNA, 19 bp, Homo sapiens
gcctcccacacttgctggg

SEQ ID NO: 6253256 - DNA, 21 bp, Homo sapiens
gcctcccacacttgctggggc

SEQ ID NO: 6253257 - DNA, 13 bp, Homo sapiens
gcctcccacagac

SEQ ID NO: 6253258 - DNA, 12 bp, Homo sapiens
gcctcccacagt

SEQ ID NO: 6253259 - DNA, 23 bp, Homo sapiens
gcctcccacagtgactcgggctc

SEQ ID NO: 6253260 - DNA, 12 bp, Homo sapiens
gcctcccaccag

SEQ ID NO: 6253261 - DNA, 13 bp, Homo sapiens
gcctcccaccaga

SEQ ID NO: 6253262 - DNA, 16 bp, Homo sapiens
gcctcccaccagagcc

SEQ ID NO: 6253263 - DNA, 17 bp, Homo sapiens
gcctcccaccagagccg

SEQ ID NO: 6253264 - DNA, 12 bp, Homo sapiens
gcctcccacccc

SEQ ID NO: 6253265 - DNA, 17 bp, Homo sapiens
gcctcccacccccatct

SEQ ID NO: 6253266 - DNA, 14 bp, Homo sapiens
gcctcccacgactg

SEQ ID NO: 6253267 - DNA, 21 bp, Homo sapiens
gcctcccacgactgcccggca

SEQ ID NO: 6253268 - DNA, 19 bp, Homo sapiens
gcctcccagagtgctggga

SEQ ID NO: 6253269 - DNA, 17 bp, Homo sapiens
gcctcccagcccaacat

SEQ ID NO: 6253270 - DNA, 19 bp, Homo sapiens
gcctcccagctttctgtgt

SEQ ID NO: 6253271 - DNA, 11 bp, Homo sapiens
gcctcccaggc

SEQ ID NO: 6253272 - DNA, 12 bp, Homo sapiens
gcctcccaggcc

SEQ ID NO: 6253273 - DNA, 12 bp, Homo sapiens
gcctcccaggtc

SEQ ID NO: 6253274 - DNA, 14 bp, Homo sapiens
gcctcccaggttca

SEQ ID NO: 6253275 - DNA, 16 bp, Homo sapiens
gcctcccagtggcctg

SEQ ID NO: 6253276 - DNA, 18 bp, Homo sapiens
gcctcccagtggcctggc

SEQ ID NO: 6253277 - DNA, 19 bp, Homo sapiens
gcctcccagtggcctggct

SEQ ID NO: 6253278 - DNA, 21 bp, Homo sapiens
gcctcccataattgctttgcc

SEQ ID NO: 6253279 - DNA, 17 bp, Homo sapiens
gcctcccatagtgctgg

SEQ ID NO: 6253280 - DNA, 19 bp, Homo sapiens
gcctcccatagtgctggga

SEQ ID NO: 6253281 - DNA, 12 bp, Homo sapiens
gcctcccatgcc

SEQ ID NO: 6253282 - DNA, 16 bp, Homo sapiens
gcctcccatgcctggt

SEQ ID NO: 6253283 - DNA, 23 bp, Homo sapiens
gcctcccatgcctggtcccaaga

SEQ ID NO: 6253284 - DNA, 19 bp, Homo sapiens
gcctccccaaccctgcccc

SEQ ID NO: 6253285 - DNA, 22 bp, Homo sapiens
gcctccccaaccctgcccctgc

SEQ ID NO: 6253286 - DNA, 20 bp, Homo sapiens
gcctccccaatccaggccaa

SEQ ID NO: 6253287 - DNA, 20 bp, Homo sapiens
gcctccccacatatggcaca

SEQ ID NO: 6253288 - DNA, 19 bp, Homo sapiens
gcctccccaccccagtggg

SEQ ID NO: 6253289 - DNA, 18 bp, Homo sapiens
gcctccccacctccaggc

SEQ ID NO: 6253290 - DNA, 21 bp, Homo sapiens
gcctccccacggccgctccag

SEQ ID NO: 6253291 - DNA, 23 bp, Homo sapiens
gcctccccacgtggcacctcctc

SEQ ID NO: 6253292 - DNA, 17 bp, Homo sapiens
gcctccccagctcaccc

SEQ ID NO: 6253293 - DNA, 19 bp, Homo sapiens
gcctccccatacttcctgg

SEQ ID NO: 6253294 - DNA, 21 bp, Homo sapiens
gcctccccatacttcctggga

SEQ ID NO: 6253295 - DNA, 17 bp, Homo sapiens
gcctccccatctgtcca

SEQ ID NO: 6253296 - DNA, 18 bp, Homo sapiens
gcctcccccaacacctgc

SEQ ID NO: 6253297 - DNA, 19 bp, Homo sapiens
gcctcccccaacacctgct

SEQ ID NO: 6253298 - DNA, 16 bp, Homo sapiens
gcctcccccagccagg

SEQ ID NO: 6253299 - DNA, 13 bp, Homo sapiens
gcctcccccaggc

SEQ ID NO: 6253300 - DNA, 23 bp, Homo sapiens
gcctcccccaggctgcgcctgcc

SEQ ID NO: 6253301 - DNA, 19 bp, Homo sapiens
gcctccccccacaagaact

SEQ ID NO: 6253302 - DNA, 15 bp, Homo sapiens
gcctccccccagacc

SEQ ID NO: 6253303 - DNA, 18 bp, Homo sapiens
gcctccccccagcccctc

SEQ ID NO: 6253304 - DNA, 13 bp, Homo sapiens
gcctccccccgct

SEQ ID NO: 6253305 - DNA, 20 bp, Homo sapiens
gcctccccccgctggggagc

SEQ ID NO: 6253306 - DNA, 14 bp, Homo sapiens
gcctcccccgcctc

SEQ ID NO: 6253307 - DNA, 21 bp, Homo sapiens
gcctccccctagccattttta

SEQ ID NO: 6253308 - DNA, 14 bp, Homo sapiens
gcctccccctcaga

SEQ ID NO: 6253309 - DNA, 21 bp, Homo sapiens
gcctccccctcccccattccc

SEQ ID NO: 6253310 - DNA, 14 bp, Homo sapiens
gcctccccctgctg

SEQ ID NO: 6253311 - DNA, 18 bp, Homo sapiens
gcctccccgggggtcccc

SEQ ID NO: 6253312 - DNA, 12 bp, Homo sapiens
gcctcccctccc

SEQ ID NO: 6253313 - DNA, 13 bp, Homo sapiens
gcctcccctcccc

SEQ ID NO: 6253314 - DNA, 16 bp, Homo sapiens
gcctcccctcccctgg

SEQ ID NO: 6253315 - DNA, 14 bp, Homo sapiens
gcctcccctcctct

SEQ ID NO: 6253316 - DNA, 16 bp, Homo sapiens
gcctcccctcctctcc

SEQ ID NO: 6253317 - DNA, 22 bp, Homo sapiens
gcctcccctcctctcctgccca

SEQ ID NO: 6253318 - DNA, 16 bp, Homo sapiens
gcctcccctcctctgc

SEQ ID NO: 6253319 - DNA, 22 bp, Homo sapiens
gcctcccctgaggatcccctgt

SEQ ID NO: 6253320 - DNA, 14 bp, Homo sapiens
gcctcccctgccac

SEQ ID NO: 6253321 - DNA, 15 bp, Homo sapiens
gcctcccctgccacc

SEQ ID NO: 6253322 - DNA, 16 bp, Homo sapiens
gcctcccctgccacca

SEQ ID NO: 6253323 - DNA, 15 bp, Homo sapiens
gcctcccctgccagg

SEQ ID NO: 6253324 - DNA, 23 bp, Homo sapiens
gcctcccctgggttaacaaatga

SEQ ID NO: 6253325 - DNA, 19 bp, Homo sapiens
gcctccccttaaaggggag

SEQ ID NO: 6253326 - DNA, 17 bp, Homo sapiens
gcctccccttcccagac

SEQ ID NO: 6253327 - DNA, 12 bp, Homo sapiens
gcctccccttct

SEQ ID NO: 6253328 - DNA, 13 bp, Homo sapiens
gcctccccttctt

SEQ ID NO: 6253329 - DNA, 23 bp, Homo sapiens
gatcttacacgaagaaatagaat

SEQ ID NO: 6253330 - DNA, 19 bp, Homo sapiens
gatcttacagaaaatacca

SEQ ID NO: 6253331 - DNA, 17 bp, Homo sapiens
gatcttactctactgct

SEQ ID NO: 6253332 - DNA, 13 bp, Homo sapiens
gatcttagattct

SEQ ID NO: 6253333 - DNA, 19 bp, Homo sapiens
gatcttatattggtttgca

SEQ ID NO: 6253334 - DNA, 13 bp, Homo sapiens
gatcttatttatt

SEQ ID NO: 6253335 - DNA, 16 bp, Homo sapiens
gatcttatttggaatt

SEQ ID NO: 6253336 - DNA, 22 bp, Homo sapiens
gatcttatttggaattgacatt

SEQ ID NO: 6253337 - DNA, 14 bp, Homo sapiens
gatcttatttttct

SEQ ID NO: 6253338 - DNA, 16 bp, Homo sapiens
gatcttatttttctaa

SEQ ID NO: 6253339 - DNA, 16 bp, Homo sapiens
gatcttcaacaaattg

SEQ ID NO: 6253340 - DNA, 14 bp, Homo sapiens
gatcttcaatggct

SEQ ID NO: 6253341 - DNA, 19 bp, Homo sapiens
gatcttcactgtatatgta

SEQ ID NO: 6253342 - DNA, 21 bp, Homo sapiens
gatcttcagaactgcccttgc

SEQ ID NO: 6253343 - DNA, 14 bp, Homo sapiens
gatcttcagagcag

SEQ ID NO: 6253344 - DNA, 15 bp, Homo sapiens
gatcttcccacagga

SEQ ID NO: 6253345 - DNA, 17 bp, Homo sapiens
gatcttcccacaggagg

SEQ ID NO: 6253346 - DNA, 20 bp, Homo sapiens
gatcttcccataataaagca

SEQ ID NO: 6253347 - DNA, 21 bp, Homo sapiens
gatcttcccataataaagcaa

SEQ ID NO: 6253348 - DNA, 18 bp, Homo sapiens
gatcttccgtggtcagag

SEQ ID NO: 6253349 - DNA, 17 bp, Homo sapiens
gatcttcctctgctaaa

SEQ ID NO: 6253350 - DNA, 13 bp, Homo sapiens
gatcttctccctc

SEQ ID NO: 6253351 - DNA, 16 bp, Homo sapiens
gatcttctgaaatgaa

SEQ ID NO: 6253352 - DNA, 20 bp, Homo sapiens
gatcttctgggagcaggaac

SEQ ID NO: 6253353 - DNA, 14 bp, Homo sapiens
gatcttcttcatcc

SEQ ID NO: 6253354 - DNA, 13 bp, Homo sapiens
gatcttgaatgtg

SEQ ID NO: 6253355 - DNA, 14 bp, Homo sapiens
gatcttgagagctg

SEQ ID NO: 6253356 - DNA, 19 bp, Homo sapiens
gatcttgagatttctttta

SEQ ID NO: 6253357 - DNA, 23 bp, Homo sapiens
gatcttgagtataagaaatgcat

SEQ ID NO: 6253358 - DNA, 16 bp, Homo sapiens
gatcttgcaaaacagg

SEQ ID NO: 6253359 - DNA, 15 bp, Homo sapiens
gatcttgcagaagtt

SEQ ID NO: 6253360 - DNA, 20 bp, Homo sapiens
gatcttgccacatttctgat

SEQ ID NO: 6253361 - DNA, 13 bp, Homo sapiens
gatcttgcctctt

SEQ ID NO: 6253362 - DNA, 20 bp, Homo sapiens
gatcttgcctctttcctcct

SEQ ID NO: 6253363 - DNA, 18 bp, Homo sapiens
gatcttgcctgtctggct

SEQ ID NO: 6253364 - DNA, 16 bp, Homo sapiens
gatcttggaaaaacag

SEQ ID NO: 6253365 - DNA, 13 bp, Homo sapiens
gatcttggagaca

SEQ ID NO: 6253366 - DNA, 20 bp, Homo sapiens
gatcttggagacaattacaa

SEQ ID NO: 6253367 - DNA, 21 bp, Homo sapiens
gatcttggagacaattacaag

SEQ ID NO: 6253368 - DNA, 19 bp, Homo sapiens
gatcttggcttactgcagc

SEQ ID NO: 6253369 - DNA, 14 bp, Homo sapiens
gatcttgtgctcag

SEQ ID NO: 6253370 - DNA, 17 bp, Homo sapiens
gatcttgttaatgcatt

SEQ ID NO: 6253371 - DNA, 17 bp, Homo sapiens
gatcttgttactgtgat

SEQ ID NO: 6253372 - DNA, 21 bp, Homo sapiens
gatctttatatttcaataaat

SEQ ID NO: 6253373 - DNA, 23 bp, Homo sapiens
gatctttatatttcaataaatga

SEQ ID NO: 6253374 - DNA, 21 bp, Homo sapiens
gatctttattggtgacctttt

SEQ ID NO: 6253375 - DNA, 22 bp, Homo sapiens
gatctttcacccacagaaagag

SEQ ID NO: 6253376 - DNA, 11 bp, Homo sapiens
gatctttcagg

SEQ ID NO: 6253377 - DNA, 16 bp, Homo sapiens
gatctttcccaggccg

SEQ ID NO: 6253378 - DNA, 18 bp, Homo sapiens
gatctttctagagccagc

SEQ ID NO: 6253379 - DNA, 13 bp, Homo sapiens
gatctttctcttc

SEQ ID NO: 6253380 - DNA, 15 bp, Homo sapiens
gatctttctcttccc

SEQ ID NO: 6253381 - DNA, 15 bp, Homo sapiens
gatctttgactgaaa

SEQ ID NO: 6253382 - DNA, 16 bp, Homo sapiens
gatctttgagcccatt

SEQ ID NO: 6253383 - DNA, 21 bp, Homo sapiens
gatctttgagcccattcttct

SEQ ID NO: 6253384 - DNA, 14 bp, Homo sapiens
gatctttgagtgta

SEQ ID NO: 6253385 - DNA, 13 bp, Homo sapiens
gatctttgcttcc

SEQ ID NO: 6253386 - DNA, 21 bp, Homo sapiens
gatctttggacagaagcagct

SEQ ID NO: 6253387 - DNA, 20 bp, Homo sapiens
gatctttgtttaaatgccaa

SEQ ID NO: 6253388 - DNA, 21 bp, Homo sapiens
gatctttgttttttgttttca

SEQ ID NO: 6253389 - DNA, 18 bp, Homo sapiens
gatcttttagaagtgaga

SEQ ID NO: 6253390 - DNA, 16 bp, Homo sapiens
gatcttttgaagggag

SEQ ID NO: 6253391 - DNA, 18 bp, Homo sapiens
gatcttttgttcccatcc

SEQ ID NO: 6253392 - DNA, 16 bp, Homo sapiens
gatctttttatacaca

SEQ ID NO: 6253393 - DNA, 22 bp, Homo sapiens
gatctttttttaagtgttctgt

SEQ ID NO: 6253394 - DNA, 15 bp, Homo sapiens
gatgaaaaaaactaa

SEQ ID NO: 6253395 - DNA, 19 bp, Homo sapiens
gatgaaaaaaagggaaaac

SEQ ID NO: 6253396 - DNA, 22 bp, Homo sapiens
gatgaaaaaaagggaaaacaaa

SEQ ID NO: 6253397 - DNA, 15 bp, Homo sapiens
gatgaaaaagcatgt

SEQ ID NO: 6253398 - DNA, 19 bp, Homo sapiens
gatgaaaaagcatgtacag

SEQ ID NO: 6253399 - DNA, 22 bp, Homo sapiens
gatgaaaaagcatgtacagtgt

SEQ ID NO: 6253400 - DNA, 14 bp, Homo sapiens
gatgaaaaatagca

SEQ ID NO: 6253401 - DNA, 23 bp, Homo sapiens
gatgaaaacaaaatcacagcacc

SEQ ID NO: 6253402 - DNA, 21 bp, Homo sapiens
gatgaaaacctacatattcca

SEQ ID NO: 6253403 - DNA, 18 bp, Homo sapiens
gatgaaaactaaggattt

SEQ ID NO: 6253404 - DNA, 15 bp, Homo sapiens
gatgaaaagtacatg

SEQ ID NO: 6253405 - DNA, 14 bp, Homo sapiens
gatgaaaataaaga

SEQ ID NO: 6253406 - DNA, 19 bp, Homo sapiens
gatgaaaataaagaatgga

SEQ ID NO: 6253407 - DNA, 22 bp, Homo sapiens
gatgaaaatattctgattggtc

SEQ ID NO: 6253408 - DNA, 15 bp, Homo sapiens
gatgaaaatatttaa

SEQ ID NO: 6253409 - DNA, 15 bp, Homo sapiens
gatgaaaatttgaga

SEQ ID NO: 6253410 - DNA, 16 bp, Homo sapiens
gatgaaactaaagcaa

SEQ ID NO: 6253411 - DNA, 14 bp, Homo sapiens
gatgaaataaaata

SEQ ID NO: 6253412 - DNA, 13 bp, Homo sapiens
gatgaaataattt

SEQ ID NO: 6253413 - DNA, 14 bp, Homo sapiens
gatgaaataatttt

SEQ ID NO: 6253414 - DNA, 21 bp, Homo sapiens
gatgaaatctgctagaaagtt

SEQ ID NO: 6253415 - DNA, 15 bp, Homo sapiens
gatgaaatctttctt

SEQ ID NO: 6253416 - DNA, 15 bp, Homo sapiens
gatgaaatgaggtca

SEQ ID NO: 6253417 - DNA, 14 bp, Homo sapiens
gatgaaatgcactg

SEQ ID NO: 6253418 - DNA, 16 bp, Homo sapiens
gatgaaatgcactgta

SEQ ID NO: 6253419 - DNA, 14 bp, Homo sapiens
gatgaaatgccaag

SEQ ID NO: 6253420 - DNA, 21 bp, Homo sapiens
gatgaaattgaacctggtttt

SEQ ID NO: 6253421 - DNA, 23 bp, Homo sapiens
gatgaaattttctagactttctg

SEQ ID NO: 6253422 - DNA, 13 bp, Homo sapiens
gatgaacagactg

SEQ ID NO: 6253423 - DNA, 15 bp, Homo sapiens
gatgaacagttctcc

SEQ ID NO: 6253424 - DNA, 14 bp, Homo sapiens
gatgaacatctaac

SEQ ID NO: 6253425 - DNA, 23 bp, Homo sapiens
gatgaacatttcaaattgaattt

SEQ ID NO: 6253426 - DNA, 14 bp, Homo sapiens
gatgaaccaagtgt

SEQ ID NO: 6253427 - DNA, 20 bp, Homo sapiens
gatgaaccagccggggcctt

SEQ ID NO: 6253428 - DNA, 22 bp, Homo sapiens
gatgaacccaggacgcttctga

SEQ ID NO: 6253429 - DNA, 23 bp, Homo sapiens
gatgaacccaggacgcttctgaa

SEQ ID NO: 6253430 - DNA, 20 bp, Homo sapiens
gatgaaccctggcatttggc

SEQ ID NO: 6253431 - DNA, 18 bp, Homo sapiens
gatgaactgactgaagga

SEQ ID NO: 6253432 - DNA, 18 bp, Homo sapiens
gatgaactgagaaggtca

SEQ ID NO: 6253433 - DNA, 17 bp, Homo sapiens
gatgaacttattctgta

SEQ ID NO: 6253434 - DNA, 20 bp, Homo sapiens
gatgaactttttaacaaatg

SEQ ID NO: 6253435 - DNA, 14 bp, Homo sapiens
gatgaagaaattta

SEQ ID NO: 6253436 - DNA, 13 bp, Homo sapiens
gatgaagaagaaa

SEQ ID NO: 6253437 - DNA, 16 bp, Homo sapiens
gatgaagaagggggtg

SEQ ID NO: 6253438 - DNA, 17 bp, Homo sapiens
gatgaagaagggggtgg

SEQ ID NO: 6253439 - DNA, 15 bp, Homo sapiens
gatgaagagaagctg

SEQ ID NO: 6253440 - DNA, 16 bp, Homo sapiens
gatgaagagaagctga

SEQ ID NO: 6253441 - DNA, 19 bp, Homo sapiens
gatgaagcaaacacattaa

SEQ ID NO: 6253442 - DNA, 20 bp, Homo sapiens
gatgaagcaaggaagatata

SEQ ID NO: 6253443 - DNA, 15 bp, Homo sapiens
gatgaagcatttaca

SEQ ID NO: 6253444 - DNA, 16 bp, Homo sapiens
gatgaaggaaaggaag

SEQ ID NO: 6253445 - DNA, 13 bp, Homo sapiens
gatgaaggaaggg

SEQ ID NO: 6253446 - DNA, 18 bp, Homo sapiens
gatgaaggctgtatctat

SEQ ID NO: 6253447 - DNA, 18 bp, Homo sapiens
gatgaaggtctgttttgt

SEQ ID NO: 6253448 - DNA, 20 bp, Homo sapiens
gatgaagtcacccctttctg

SEQ ID NO: 6253449 - DNA, 17 bp, Homo sapiens
gatgaagttatctggct

SEQ ID NO: 6253450 - DNA, 17 bp, Homo sapiens
gatgaagttttacattg

SEQ ID NO: 6253451 - DNA, 22 bp, Homo sapiens
gatgaagttttacattgttgag

SEQ ID NO: 6253452 - DNA, 23 bp, Homo sapiens
gatgaagttttacattgttgagc

SEQ ID NO: 6253453 - DNA, 17 bp, Homo sapiens
gatgaataaaatgttta

SEQ ID NO: 6253454 - DNA, 12 bp, Homo sapiens
gatgaataaaca

SEQ ID NO: 6253455 - DNA, 22 bp, Homo sapiens
gatgaataaatgttatagctgc

SEQ ID NO: 6253456 - DNA, 15 bp, Homo sapiens
gatgaatagatgtga

SEQ ID NO: 6253457 - DNA, 16 bp, Homo sapiens
gatgaatcaatgaaaa

SEQ ID NO: 6253458 - DNA, 22 bp, Homo sapiens
gatgaatcagtatgaagacact

SEQ ID NO: 6253459 - DNA, 14 bp, Homo sapiens
gatgaatccaaatg

SEQ ID NO: 6253460 - DNA, 23 bp, Homo sapiens
gatgaatccaaatgtgaaagatg

SEQ ID NO: 6253461 - DNA, 19 bp, Homo sapiens
gatgaatgaggtcccaggc

SEQ ID NO: 6253462 - DNA, 15 bp, Homo sapiens
gatgaatgataaact

SEQ ID NO: 6253463 - DNA, 15 bp, Homo sapiens
gatgaatgcagatta

SEQ ID NO: 6253464 - DNA, 13 bp, Homo sapiens
gatgaatgtatgt

SEQ ID NO: 6253465 - DNA, 20 bp, Homo sapiens
gatgaattaggggacactgt

SEQ ID NO: 6253466 - DNA, 21 bp, Homo sapiens
gatgaattctgaccagagcta

SEQ ID NO: 6253467 - DNA, 16 bp, Homo sapiens
gatgacaaaatggaaa

SEQ ID NO: 6253468 - DNA, 15 bp, Homo sapiens
gatgacaaagaaaat

SEQ ID NO: 6253469 - DNA, 16 bp, Homo sapiens
gatgacaaagaaaatg

SEQ ID NO: 6253470 - DNA, 20 bp, Homo sapiens
gatgacaaagaaaatgagaa

SEQ ID NO: 6253471 - DNA, 16 bp, Homo sapiens
gatgacaaagaacagt

SEQ ID NO: 6253472 - DNA, 19 bp, Homo sapiens
gatgacaaatggagaagaa

SEQ ID NO: 6253473 - DNA, 17 bp, Homo sapiens
gatgacaacttcccagt

SEQ ID NO: 6253474 - DNA, 22 bp, Homo sapiens
gatgacaagaaaggctgctgta

SEQ ID NO: 6253475 - DNA, 15 bp, Homo sapiens
gatgacaataaagct

SEQ ID NO: 6253476 - DNA, 20 bp, Homo sapiens
gatgacacccaccctgtgcc

SEQ ID NO: 6253477 - DNA, 21 bp, Homo sapiens
gatgacacgcgctctccacca

SEQ ID NO: 6253478 - DNA, 14 bp, Homo sapiens
gatgacagagcgag

SEQ ID NO: 6253479 - DNA, 17 bp, Homo sapiens
gatgacaggctctcctg

SEQ ID NO: 6253480 - DNA, 15 bp, Homo sapiens
gatgacagggagctg

SEQ ID NO: 6253481 - DNA, 13 bp, Homo sapiens
gatgacagggcag

SEQ ID NO: 6253482 - DNA, 14 bp, Homo sapiens
gatgacagggcaga

SEQ ID NO: 6253483 - DNA, 21 bp, Homo sapiens
gatgacaggtgtgagccactg

SEQ ID NO: 6253484 - DNA, 17 bp, Homo sapiens
gatgacattgactattt

SEQ ID NO: 6253485 - DNA, 14 bp, Homo sapiens
gatgacattgctaa

SEQ ID NO: 6253486 - DNA, 15 bp, Homo sapiens
gatgacattgctaag

SEQ ID NO: 6253487 - DNA, 18 bp, Homo sapiens
gatgacattgctaagatg

SEQ ID NO: 6253488 - DNA, 18 bp, Homo sapiens
gatgaccaattttaactt

SEQ ID NO: 6253489 - DNA, 22 bp, Homo sapiens
gatgaccacacccgaagtcctg

SEQ ID NO: 6253490 - DNA, 13 bp, Homo sapiens
gatgaccagaaca

SEQ ID NO: 6253491 - DNA, 18 bp, Homo sapiens
gatgaccagaacaaggtt

SEQ ID NO: 6253492 - DNA, 14 bp, Homo sapiens
gatgaccaggacta

SEQ ID NO: 6253493 - DNA, 22 bp, Homo sapiens
gatgaccagggatgctgggctg

SEQ ID NO: 6253494 - DNA, 23 bp, Homo sapiens
gatgaccagggatgctgggctgg

SEQ ID NO: 6253495 - DNA, 15 bp, Homo sapiens
gatgacccactaaag

SEQ ID NO: 6253496 - DNA, 18 bp, Homo sapiens
gatgacccctaccccctc

SEQ ID NO: 6253497 - DNA, 15 bp, Homo sapiens
gatgacccttttcat

SEQ ID NO: 6253498 - DNA, 17 bp, Homo sapiens
gatgacctcattaaccg

SEQ ID NO: 6253499 - DNA, 17 bp, Homo sapiens
gatgacctccagaagtc

SEQ ID NO: 6253500 - DNA, 14 bp, Homo sapiens
gatgacctgcccca

SEQ ID NO: 6253501 - DNA, 13 bp, Homo sapiens
gatgaccttccca

SEQ ID NO: 6253502 - DNA, 15 bp, Homo sapiens
gatgacgcctctgga

SEQ ID NO: 6253503 - DNA, 16 bp, Homo sapiens
gatgacggccaggctc

SEQ ID NO: 6253504 - DNA, 21 bp, Homo sapiens
gatgacggccaggctccctga

SEQ ID NO: 6253505 - DNA, 17 bp, Homo sapiens
gatgacgggatgctctt

SEQ ID NO: 6253506 - DNA, 20 bp, Homo sapiens
gatgacgggatgctctttaa

SEQ ID NO: 6253507 - DNA, 21 bp, Homo sapiens
gatgacgggatgctctttaaa

SEQ ID NO: 6253508 - DNA, 22 bp, Homo sapiens
gcctcccgaacacgcacagaag

SEQ ID NO: 6253509 - DNA, 18 bp, Homo sapiens
gcctcccgaatagctggg

SEQ ID NO: 6253510 - DNA, 21 bp, Homo sapiens
gcctcccgaatagctgggact

SEQ ID NO: 6253511 - DNA, 15 bp, Homo sapiens
gcctcccgagtagct

SEQ ID NO: 6253512 - DNA, 17 bp, Homo sapiens
gcctcccgagtagctgg

SEQ ID NO: 6253513 - DNA, 13 bp, Homo sapiens
gcctcccgccacc

SEQ ID NO: 6253514 - DNA, 22 bp, Homo sapiens
gcctcccgccactcgccttctt

SEQ ID NO: 6253515 - DNA, 13 bp, Homo sapiens
gcctcccgccgcc

SEQ ID NO: 6253516 - DNA, 15 bp, Homo sapiens
gcctcccgccgcctc

SEQ ID NO: 6253517 - DNA, 20 bp, Homo sapiens
gcctcccggggcccaggact

SEQ ID NO: 6253518 - DNA, 18 bp, Homo sapiens
gcctcccggggtgcccgt

SEQ ID NO: 6253519 - DNA, 21 bp, Homo sapiens
gcctcccggggtgcccgtgtg

SEQ ID NO: 6253520 - DNA, 23 bp, Homo sapiens
gcctcccggggtgcccgtgtggc

SEQ ID NO: 6253521 - DNA, 23 bp, Homo sapiens
gcctcccgggtctcaggcctcca

SEQ ID NO: 6253522 - DNA, 21 bp, Homo sapiens
gcctcccgtccgtccgcccgc

SEQ ID NO: 6253523 - DNA, 22 bp, Homo sapiens
gcctccctagttagcatccagg

SEQ ID NO: 6253524 - DNA, 14 bp, Homo sapiens
gcctccctcaaccc

SEQ ID NO: 6253525 - DNA, 14 bp, Homo sapiens
gcctccctcagcca

SEQ ID NO: 6253526 - DNA, 21 bp, Homo sapiens
gcctccctcagcccccaggat

SEQ ID NO: 6253527 - DNA, 16 bp, Homo sapiens
gcctccctccacccca

SEQ ID NO: 6253528 - DNA, 17 bp, Homo sapiens
gcctccctccaccccag

SEQ ID NO: 6253529 - DNA, 18 bp, Homo sapiens
gcctccctccaccccagg

SEQ ID NO: 6253530 - DNA, 19 bp, Homo sapiens
gcctccctccaccccagga

SEQ ID NO: 6253531 - DNA, 21 bp, Homo sapiens
gcctccctccaccccaggacg

SEQ ID NO: 6253532 - DNA, 16 bp, Homo sapiens
gcctccctcccctgcc

SEQ ID NO: 6253533 - DNA, 19 bp, Homo sapiens
gcctccctcccctgccctc

SEQ ID NO: 6253534 - DNA, 23 bp, Homo sapiens
gcctccctccgcggcgggccctg

SEQ ID NO: 6253535 - DNA, 13 bp, Homo sapiens
gcctccctccgtc

SEQ ID NO: 6253536 - DNA, 18 bp, Homo sapiens
gcctccctccgtccctct

SEQ ID NO: 6253537 - DNA, 21 bp, Homo sapiens
gcctccctctcagaggcctgc

SEQ ID NO: 6253538 - DNA, 24 bp, Homo sapiens
gcctccctctcagaggcctgctgc

SEQ ID NO: 6253539 - DNA, 16 bp, Homo sapiens
gcctccctctctcttc

SEQ ID NO: 6253540 - DNA, 21 bp, Homo sapiens
gcctccctctctcttctgctc

SEQ ID NO: 6253541 - DNA, 15 bp, Homo sapiens
gcctccctctcttcc

SEQ ID NO: 6253542 - DNA, 15 bp, Homo sapiens
gcctccctctgctgt

SEQ ID NO: 6253543 - DNA, 10 bp, Homo sapiens
gcctccctga

SEQ ID NO: 6253544 - DNA, 11 bp, Homo sapiens
gcctccctgaa

SEQ ID NO: 6253545 - DNA, 18 bp, Homo sapiens
gcctccctgaagcctttg

SEQ ID NO: 6253546 - DNA, 13 bp, Homo sapiens
gcctccctgagcc

SEQ ID NO: 6253547 - DNA, 14 bp, Homo sapiens
gcctccctgagcct

SEQ ID NO: 6253548 - DNA, 16 bp, Homo sapiens
gcctccctgagcctgc

SEQ ID NO: 6253549 - DNA, 12 bp, Homo sapiens
gcctccctgcag

SEQ ID NO: 6253550 - DNA, 17 bp, Homo sapiens
gcctccctgcagactcc

SEQ ID NO: 6253551 - DNA, 14 bp, Homo sapiens
gcctccctgcctca

SEQ ID NO: 6253552 - DNA, 16 bp, Homo sapiens
gcctccctgcctcagg

SEQ ID NO: 6253553 - DNA, 23 bp, Homo sapiens
gcctccctgctgtgccatgctgg

SEQ ID NO: 6253554 - DNA, 17 bp, Homo sapiens
gcctccctgggccacct

SEQ ID NO: 6253555 - DNA, 18 bp, Homo sapiens
gcctccctgggccacctc

SEQ ID NO: 6253556 - DNA, 19 bp, Homo sapiens
gcctccctgggccacctcc

SEQ ID NO: 6253557 - DNA, 21 bp, Homo sapiens
gcctccctgggccacctccta

SEQ ID NO: 6253558 - DNA, 22 bp, Homo sapiens
gcctccctgtcactcagctgag

SEQ ID NO: 6253559 - DNA, 14 bp, Homo sapiens
gcctccctgtctcc

SEQ ID NO: 6253560 - DNA, 15 bp, Homo sapiens
gcctccctgtctcca

SEQ ID NO: 6253561 - DNA, 23 bp, Homo sapiens
gcctccctgtctccagctgcctg

SEQ ID NO: 6253562 - DNA, 14 bp, Homo sapiens
gcctccctgttcac

SEQ ID NO: 6253563 - DNA, 15 bp, Homo sapiens
gcctcccttcatgca

SEQ ID NO: 6253564 - DNA, 13 bp, Homo sapiens
gcctcccttccca

SEQ ID NO: 6253565 - DNA, 17 bp, Homo sapiens
gcctcccttcctccgct

SEQ ID NO: 6253566 - DNA, 13 bp, Homo sapiens
gcctccctttggg

SEQ ID NO: 6253567 - DNA, 16 bp, Homo sapiens
gcctcccttttctcct

SEQ ID NO: 6253568 - DNA, 18 bp, Homo sapiens
gcctccgacgctgcctct

SEQ ID NO: 6253569 - DNA, 21 bp, Homo sapiens
gcctccgacgctgcctctcat

SEQ ID NO: 6253570 - DNA, 15 bp, Homo sapiens
gcctccgagagggag

SEQ ID NO: 6253571 - DNA, 19 bp, Homo sapiens
gcctccgaggctccccgcc

SEQ ID NO: 6253572 - DNA, 19 bp, Homo sapiens
gcctccgaggttttgaggc

SEQ ID NO: 6253573 - DNA, 17 bp, Homo sapiens
gcctccgatgcctggcc

SEQ ID NO: 6253574 - DNA, 20 bp, Homo sapiens
gcctccgccaagatctacag

SEQ ID NO: 6253575 - DNA, 23 bp, Homo sapiens
gcctccgcctgggtcatgggcct

SEQ ID NO: 6253576 - DNA, 14 bp, Homo sapiens
gcctccgctggctt

SEQ ID NO: 6253577 - DNA, 17 bp, Homo sapiens
gcctccgctggctttgg

SEQ ID NO: 6253578 - DNA, 14 bp, Homo sapiens
gcctccgctgggct

SEQ ID NO: 6253579 - DNA, 18 bp, Homo sapiens
gcctccgcttatcctgct

SEQ ID NO: 6253580 - DNA, 14 bp, Homo sapiens
gcctccggccctgc

SEQ ID NO: 6253581 - DNA, 23 bp, Homo sapiens
gcctccggccctgccccacacag

SEQ ID NO: 6253582 - DNA, 15 bp, Homo sapiens
gcctccggcctgcac

SEQ ID NO: 6253583 - DNA, 18 bp, Homo sapiens
gcctccggcctgcactcc

SEQ ID NO: 6253584 - DNA, 20 bp, Homo sapiens
gcctccggcgtcagcctcca

SEQ ID NO: 6253585 - DNA, 14 bp, Homo sapiens
gcctccggcgtctt

SEQ ID NO: 6253586 - DNA, 15 bp, Homo sapiens
gcctccgggaccccc

SEQ ID NO: 6253587 - DNA, 16 bp, Homo sapiens
gcctccgggaccccca

SEQ ID NO: 6253588 - DNA, 18 bp, Homo sapiens
gcctccgggacccccagg

SEQ ID NO: 6253589 - DNA, 21 bp, Homo sapiens
gcctccgggcctcggcctggc

SEQ ID NO: 6253590 - DNA, 22 bp, Homo sapiens
gcctccgggcctcggcctggct

SEQ ID NO: 6253591 - DNA, 22 bp, Homo sapiens
gcctccggggttcagcctcctg

SEQ ID NO: 6253592 - DNA, 16 bp, Homo sapiens
gcctccgtatttcaga

SEQ ID NO: 6253593 - DNA, 21 bp, Homo sapiens
gcctccgtcactacctggctg

SEQ ID NO: 6253594 - DNA, 14 bp, Homo sapiens
gcctccgtcaggag

SEQ ID NO: 6253595 - DNA, 20 bp, Homo sapiens
gcctccgtcaggagagacgc

SEQ ID NO: 6253596 - DNA, 20 bp, Homo sapiens
gcctccgtcatccatgccct

SEQ ID NO: 6253597 - DNA, 18 bp, Homo sapiens
gcctccgtcccctgccca

SEQ ID NO: 6253598 - DNA, 22 bp, Homo sapiens
gcctccgtcctgtcactgatgg

SEQ ID NO: 6253599 - DNA, 13 bp, Homo sapiens
gcctccgtggaac

SEQ ID NO: 6253600 - DNA, 16 bp, Homo sapiens
gcctccgttcccacct

SEQ ID NO: 6253601 - DNA, 22 bp, Homo sapiens
gcctccgttcccacctctgagg

SEQ ID NO: 6253602 - DNA, 23 bp, Homo sapiens
gcctccgttcccacctctgagga

SEQ ID NO: 6253603 - DNA, 20 bp, Homo sapiens
gcctccgttgtctggttgct

SEQ ID NO: 6253604 - DNA, 18 bp, Homo sapiens
gcctccgtttatgggcct

SEQ ID NO: 6253605 - DNA, 18 bp, Homo sapiens
gcctcctaagcagctggg

SEQ ID NO: 6253606 - DNA, 17 bp, Homo sapiens
gcctcctagagtgcagg

SEQ ID NO: 6253607 - DNA, 15 bp, Homo sapiens
gcctcctagcctctc

SEQ ID NO: 6253608 - DNA, 19 bp, Homo sapiens
gcctcctaggctccctgag

SEQ ID NO: 6253609 - DNA, 17 bp, Homo sapiens
gcctcctaggggaaggg

SEQ ID NO: 6253610 - DNA, 17 bp, Homo sapiens
gcctcctcacccccagc

SEQ ID NO: 6253611 - DNA, 18 bp, Homo sapiens
gcctcctcacccccagct

SEQ ID NO: 6253612 - DNA, 21 bp, Homo sapiens
gcctcctcacccccagctttg

SEQ ID NO: 6253613 - DNA, 12 bp, Homo sapiens
gcctcctcagcc

SEQ ID NO: 6253614 - DNA, 14 bp, Homo sapiens
gcctcctcagcctc

SEQ ID NO: 6253615 - DNA, 12 bp, Homo sapiens
gcctcctcatca

SEQ ID NO: 6253616 - DNA, 12 bp, Homo sapiens
gcctcctcatcc

SEQ ID NO: 6253617 - DNA, 17 bp, Homo sapiens
gcctcctcatcccgtgt

SEQ ID NO: 6253618 - DNA, 14 bp, Homo sapiens
gcctcctcatctgg

SEQ ID NO: 6253619 - DNA, 13 bp, Homo sapiens
gcctcctccagct

SEQ ID NO: 6253620 - DNA, 15 bp, Homo sapiens
gcctcctccagctcc

SEQ ID NO: 6253621 - DNA, 17 bp, Homo sapiens
gcctcctccagctcctg

SEQ ID NO: 6253622 - DNA, 14 bp, Homo sapiens
gcctcctcccaaag

SEQ ID NO: 6253623 - DNA, 13 bp, Homo sapiens
gcctcctcccacc

SEQ ID NO: 6253624 - DNA, 15 bp, Homo sapiens
gcctcctcccactgg

SEQ ID NO: 6253625 - DNA, 19 bp, Homo sapiens
gcctcctcccactgggact

SEQ ID NO: 6253626 - DNA, 14 bp, Homo sapiens
gcctcctcccatcc

SEQ ID NO: 6253627 - DNA, 13 bp, Homo sapiens
gcctcctccccag

SEQ ID NO: 6253628 - DNA, 17 bp, Homo sapiens
gcctcctccccaggtgg

SEQ ID NO: 6253629 - DNA, 14 bp, Homo sapiens
gcctcctcccccac

SEQ ID NO: 6253630 - DNA, 15 bp, Homo sapiens
gcctcctcccccacc

SEQ ID NO: 6253631 - DNA, 12 bp, Homo sapiens
gcctcctccctc

SEQ ID NO: 6253632 - DNA, 14 bp, Homo sapiens
gcctcctccctccc

SEQ ID NO: 6253633 - DNA, 22 bp, Homo sapiens
gcctcctccctcccagctgcac

SEQ ID NO: 6253634 - DNA, 19 bp, Homo sapiens
gcctcctccctccctctcc

SEQ ID NO: 6253635 - DNA, 17 bp, Homo sapiens
gcctcctccctgcctgg

SEQ ID NO: 6253636 - DNA, 15 bp, Homo sapiens
gcctcctccctggct

SEQ ID NO: 6253637 - DNA, 13 bp, Homo sapiens
gcctcctcctagc

SEQ ID NO: 6253638 - DNA, 15 bp, Homo sapiens
gcctcctcctagctg

SEQ ID NO: 6253639 - DNA, 13 bp, Homo sapiens
gcctcctcctcac

SEQ ID NO: 6253640 - DNA, 15 bp, Homo sapiens
gcctcctcctcctgc

SEQ ID NO: 6253641 - DNA, 18 bp, Homo sapiens
gcctcctcctcctgccct

SEQ ID NO: 6253642 - DNA, 20 bp, Homo sapiens
gcctcctcctcctgccctcc

SEQ ID NO: 6253643 - DNA, 15 bp, Homo sapiens
gcctcctcctgacca

SEQ ID NO: 6253644 - DNA, 19 bp, Homo sapiens
gcctcctcctgagagctgt

SEQ ID NO: 6253645 - DNA, 20 bp, Homo sapiens
gcctcctcggggctccaggc

SEQ ID NO: 6253646 - DNA, 21 bp, Homo sapiens
gcctcctcggggctccaggct

SEQ ID NO: 6253647 - DNA, 19 bp, Homo sapiens
gcctcctcgttcctttctc

SEQ ID NO: 6253648 - DNA, 21 bp, Homo sapiens
gcctcctctcataaaagagac

SEQ ID NO: 6253649 - DNA, 14 bp, Homo sapiens
gcctcctctctccc

SEQ ID NO: 6253650 - DNA, 15 bp, Homo sapiens
gcctcctctctccct

SEQ ID NO: 6253651 - DNA, 19 bp, Homo sapiens
gcctcctctctccctgcct

SEQ ID NO: 6253652 - DNA, 21 bp, Homo sapiens
gcctcctctctccctgcctca

SEQ ID NO: 6253653 - DNA, 17 bp, Homo sapiens
gcctcctctggacggca

SEQ ID NO: 6253654 - DNA, 20 bp, Homo sapiens
gcctcctctggacggcaggc

SEQ ID NO: 6253655 - DNA, 17 bp, Homo sapiens
gcctcctctgtctgccc

SEQ ID NO: 6253656 - DNA, 19 bp, Homo sapiens
gcctcctctgtctgccctt

SEQ ID NO: 6253657 - DNA, 13 bp, Homo sapiens
gcctcctcttcac

SEQ ID NO: 6253658 - DNA, 23 bp, Homo sapiens
gcctcctgacacacctgcagcct

SEQ ID NO: 6253659 - DNA, 15 bp, Homo sapiens
gcctcctgagcctgt

SEQ ID NO: 6253660 - DNA, 19 bp, Homo sapiens
gcctcctgagcctgtgggt

SEQ ID NO: 6253661 - DNA, 16 bp, Homo sapiens
gcctcctgagtagctg

SEQ ID NO: 6253662 - DNA, 10 bp, Homo sapiens
gcctcctgca

SEQ ID NO: 6253663 - DNA, 19 bp, Homo sapiens
gcctcctgccaccccttcc

SEQ ID NO: 6253664 - DNA, 15 bp, Homo sapiens
gcctcctgcccagtc

SEQ ID NO: 6253665 - DNA, 15 bp, Homo sapiens
gcctcctgccccctg

SEQ ID NO: 6253666 - DNA, 18 bp, Homo sapiens
gcctcctgcccttacctg

SEQ ID NO: 6253667 - DNA, 17 bp, Homo sapiens
gcctcctgcctccgggc

SEQ ID NO: 6253668 - DNA, 23 bp, Homo sapiens
gcctcctgcctgcccctctcccg

SEQ ID NO: 6253669 - DNA, 22 bp, Homo sapiens
gcctcctgctgagtggtccaca

SEQ ID NO: 6253670 - DNA, 12 bp, Homo sapiens
gcctcctgcttt

SEQ ID NO: 6253671 - DNA, 17 bp, Homo sapiens
gcctcctggaggaccag

SEQ ID NO: 6253672 - DNA, 12 bp, Homo sapiens
gcctcctggcca

SEQ ID NO: 6253673 - DNA, 21 bp, Homo sapiens
gcctcctggccaagcaggctg

SEQ ID NO: 6253674 - DNA, 13 bp, Homo sapiens
gcctcctggccag

SEQ ID NO: 6253675 - DNA, 15 bp, Homo sapiens
gcctcctggcccagg

SEQ ID NO: 6253676 - DNA, 12 bp, Homo sapiens
gcctcctggctc

SEQ ID NO: 6253677 - DNA, 14 bp, Homo sapiens
gcctcctggctcag

SEQ ID NO: 6253678 - DNA, 17 bp, Homo sapiens
gcctcctggctcaggcc

SEQ ID NO: 6253679 - DNA, 18 bp, Homo sapiens
gcctcctggctcaggccc

SEQ ID NO: 6253680 - DNA, 14 bp, Homo sapiens
gcctcctgggacca

SEQ ID NO: 6253681 - DNA, 18 bp, Homo sapiens
gcctcctgtacctcagtg

SEQ ID NO: 6253682 - DNA, 18 bp, Homo sapiens
gcctcctgtggcctgcca

SEQ ID NO: 6253683 - DNA, 12 bp, Homo sapiens
gcctcctgtggg

SEQ ID NO: 6253684 - DNA, 13 bp, Homo sapiens
gcctcctgtgtaa

SEQ ID NO: 6253685 - DNA, 18 bp, Homo sapiens
gcctcctgtgtgtctgca

SEQ ID NO: 6253686 - DNA, 13 bp, Homo sapiens
gcctcctgttctg

SEQ ID NO: 6253687 - DNA, 18 bp, Homo sapiens
gcctcctgttctgcccac

SEQ ID NO: 6253688 - DNA, 17 bp, Homo sapiens
gcctccttaggagtggg

SEQ ID NO: 6253689 - DNA, 16 bp, Homo sapiens
gcctccttccacctcc

SEQ ID NO: 6253690 - DNA, 20 bp, Homo sapiens
gcctccttcccatgcctgtc

SEQ ID NO: 6253691 - DNA, 13 bp, Homo sapiens
gcctccttcctct

SEQ ID NO: 6253692 - DNA, 12 bp, Homo sapiens
gcctccttctga

SEQ ID NO: 6253693 - DNA, 18 bp, Homo sapiens
gcctccttctgagctcct

SEQ ID NO: 6253694 - DNA, 20 bp, Homo sapiens
gcctccttctgagctcctgt

SEQ ID NO: 6253695 - DNA, 21 bp, Homo sapiens
gcctccttcttaactctgcag

SEQ ID NO: 6253696 - DNA, 15 bp, Homo sapiens
gcctccttgccagcc

SEQ ID NO: 6253697 - DNA, 19 bp, Homo sapiens
gcctccttgctgaccccag

SEQ ID NO: 6253698 - DNA, 23 bp, Homo sapiens
gcctccttgctgaccccaggtca

SEQ ID NO: 6253699 - DNA, 18 bp, Homo sapiens
gcctccttgtccaggtct

SEQ ID NO: 6253700 - DNA, 14 bp, Homo sapiens
gcctccttgtgcaa

SEQ ID NO: 6253701 - DNA, 21 bp, Homo sapiens
gcctccttttgctgtttggat

SEQ ID NO: 6253702 - DNA, 14 bp, Homo sapiens
gcctccttttggtt

SEQ ID NO: 6253703 - DNA, 14 bp, Homo sapiens
gcctcgaaagtgtc

SEQ ID NO: 6253704 - DNA, 15 bp, Homo sapiens
gcctcgaactcctgg

SEQ ID NO: 6253705 - DNA, 20 bp, Homo sapiens
gcctcgaactcctgggctca

SEQ ID NO: 6253706 - DNA, 21 bp, Homo sapiens
gcctcgaactcctgggctcaa

SEQ ID NO: 6253707 - DNA, 13 bp, Homo sapiens
gcctcgaactggc

SEQ ID NO: 6253708 - DNA, 15 bp, Homo sapiens
gcctcgacacgtggg

SEQ ID NO: 6253709 - DNA, 22 bp, Homo sapiens
gcctcgacagggcctggagccc

SEQ ID NO: 6253710 - DNA, 16 bp, Homo sapiens
gcctcgacctccctgg

SEQ ID NO: 6253711 - DNA, 19 bp, Homo sapiens
gcctcgacctccctggctt

SEQ ID NO: 6253712 - DNA, 14 bp, Homo sapiens
gcctcgaggcaccg

SEQ ID NO: 6253713 - DNA, 15 bp, Homo sapiens
gcctcgaggcaccgg

SEQ ID NO: 6253714 - DNA, 13 bp, Homo sapiens
gcctcgaggctgg

SEQ ID NO: 6253715 - DNA, 17 bp, Homo sapiens
gcctcgaggctggtggt

SEQ ID NO: 6253716 - DNA, 17 bp, Homo sapiens
gcctcgagggccgcctg

SEQ ID NO: 6253717 - DNA, 19 bp, Homo sapiens
gcctcgagggccgcctgcc

SEQ ID NO: 6253718 - DNA, 20 bp, Homo sapiens
gcctcgagggccgcctgcct

SEQ ID NO: 6253719 - DNA, 15 bp, Homo sapiens
gcctcgaggtgcctt

SEQ ID NO: 6253720 - DNA, 15 bp, Homo sapiens
gcctcgagtcccccc

SEQ ID NO: 6253721 - DNA, 17 bp, Homo sapiens
gcctcgagtccccccac

SEQ ID NO: 6253722 - DNA, 21 bp, Homo sapiens
gcctcgagtccccccacccct

SEQ ID NO: 6253723 - DNA, 21 bp, Homo sapiens
gcctcgatgtcctcctctgtg

SEQ ID NO: 6253724 - DNA, 12 bp, Homo sapiens
gcctcgcaaccc

SEQ ID NO: 6253725 - DNA, 23 bp, Homo sapiens
gcctcgcaacccgtgccaagtcc

SEQ ID NO: 6253726 - DNA, 14 bp, Homo sapiens
gcctcgcacaggcc

SEQ ID NO: 6253727 - DNA, 15 bp, Homo sapiens
gcctcgcacaggccc

SEQ ID NO: 6253728 - DNA, 18 bp, Homo sapiens
gcctcgcacttgcagagg

SEQ ID NO: 6253729 - DNA, 19 bp, Homo sapiens
gcctcgcaggcctccctgc

SEQ ID NO: 6253730 - DNA, 21 bp, Homo sapiens
gcctcgcaggcctccctgcca

SEQ ID NO: 6253731 - DNA, 14 bp, Homo sapiens
gcctcgcatgccag

SEQ ID NO: 6253732 - DNA, 14 bp, Homo sapiens
gcctcgccccagcc

SEQ ID NO: 6253733 - DNA, 17 bp, Homo sapiens
gcctcgcccccgggccc

SEQ ID NO: 6253734 - DNA, 12 bp, Homo sapiens
gcctcgcccctc

SEQ ID NO: 6253735 - DNA, 14 bp, Homo sapiens
gcctcgcccctcca

SEQ ID NO: 6253736 - DNA, 17 bp, Homo sapiens
gcctcgcccctggcaga

SEQ ID NO: 6253737 - DNA, 22 bp, Homo sapiens
gcctcgcctaccaatctctgct

SEQ ID NO: 6253738 - DNA, 13 bp, Homo sapiens
gcctcgcctgcct

SEQ ID NO: 6253739 - DNA, 17 bp, Homo sapiens
gcctcgcctgggcccag

SEQ ID NO: 6253740 - DNA, 20 bp, Homo sapiens
gcctcgcctgggcccaggct

SEQ ID NO: 6253741 - DNA, 22 bp, Homo sapiens
gcctcgcctgggcccaggctct

SEQ ID NO: 6253742 - DNA, 23 bp, Homo sapiens
gcctcgcgggtgtcacattcctg

SEQ ID NO: 6253743 - DNA, 22 bp, Homo sapiens
gcctcgctcaccgctggccctt

SEQ ID NO: 6253744 - DNA, 20 bp, Homo sapiens
gcctcgctccccactctgct

SEQ ID NO: 6253745 - DNA, 24 bp, Homo sapiens
gcctcgctccccactctgctctga

SEQ ID NO: 6253746 - DNA, 19 bp, Homo sapiens
gcctcgctctgttacccag

SEQ ID NO: 6253747 - DNA, 20 bp, Homo sapiens
gcctcgctctgttacccagg

SEQ ID NO: 6253748 - DNA, 17 bp, Homo sapiens
gcctcggactccatggc

SEQ ID NO: 6253749 - DNA, 21 bp, Homo sapiens
gcctcggacttagctgggaga

SEQ ID NO: 6253750 - DNA, 17 bp, Homo sapiens
gcctcggagcctcatcc

SEQ ID NO: 6253751 - DNA, 23 bp, Homo sapiens
gcctcggagcctcatccgaggca

SEQ ID NO: 6253752 - DNA, 16 bp, Homo sapiens
gcctcggaggctcctc

SEQ ID NO: 6253753 - DNA, 18 bp, Homo sapiens
gcctcggaggctcctccc

SEQ ID NO: 6253754 - DNA, 20 bp, Homo sapiens
gcctcggaggctcctccctc

SEQ ID NO: 6253755 - DNA, 21 bp, Homo sapiens
gcctcggaggctcctccctct

SEQ ID NO: 6253756 - DNA, 22 bp, Homo sapiens
gcctcggaggctcctccctctg

SEQ ID NO: 6253757 - DNA, 17 bp, Homo sapiens
gcctcggagtgtggcct

SEQ ID NO: 6253758 - DNA, 20 bp, Homo sapiens
gcctcggcagaactctctgt

SEQ ID NO: 6253759 - DNA, 15 bp, Homo sapiens
gcctcggcctcccaa

SEQ ID NO: 6253760 - DNA, 17 bp, Homo sapiens
gcctcggcctcccaaag

SEQ ID NO: 6253761 - DNA, 13 bp, Homo sapiens
gcctcggcctggc

SEQ ID NO: 6253762 - DNA, 23 bp, Homo sapiens
gcctcggcctggcttcaccgcat

SEQ ID NO: 6253763 - DNA, 18 bp, Homo sapiens
gcctcggctaggggtcct

SEQ ID NO: 6253764 - DNA, 14 bp, Homo sapiens
gcctcggctcctgc

SEQ ID NO: 6253765 - DNA, 20 bp, Homo sapiens
gcctcggctggctcccctgc

SEQ ID NO: 6253766 - DNA, 19 bp, Homo sapiens
gcctcggctgtctcctgtc

SEQ ID NO: 6253767 - DNA, 19 bp, Homo sapiens
gcctcggcttttctcagct

SEQ ID NO: 6253768 - DNA, 15 bp, Homo sapiens
gcctcgggccgcctc

SEQ ID NO: 6253769 - DNA, 21 bp, Homo sapiens
gcctcgggccgcctcctccag

SEQ ID NO: 6253770 - DNA, 17 bp, Homo sapiens
gcctcggggatggggag

SEQ ID NO: 6253771 - DNA, 18 bp, Homo sapiens
gcctcggggatggggagg

SEQ ID NO: 6253772 - DNA, 19 bp, Homo sapiens
gcctcggggatggggaggg

SEQ ID NO: 6253773 - DNA, 18 bp, Homo sapiens
gcctcggggcagggcagg

SEQ ID NO: 6253774 - DNA, 16 bp, Homo sapiens
gcctcggtatctggct

SEQ ID NO: 6253775 - DNA, 21 bp, Homo sapiens
gcctcggtatctggcttccct

SEQ ID NO: 6253776 - DNA, 15 bp, Homo sapiens
gcctcggtggccatg

SEQ ID NO: 6253777 - DNA, 23 bp, Homo sapiens
gcctcggtggccatgcttcttgc

SEQ ID NO: 6253778 - DNA, 14 bp, Homo sapiens
gcctcggtggccct

SEQ ID NO: 6253779 - DNA, 16 bp, Homo sapiens
gcctcgtaccagccag

SEQ ID NO: 6253780 - DNA, 14 bp, Homo sapiens
gcctcgtccaaggc

SEQ ID NO: 6253781 - DNA, 16 bp, Homo sapiens
gcctcgtccctccctc

SEQ ID NO: 6253782 - DNA, 14 bp, Homo sapiens
gcctcgtctttcag

SEQ ID NO: 6253783 - DNA, 15 bp, Homo sapiens
gcctcgtgaggggca

SEQ ID NO: 6253784 - DNA, 14 bp, Homo sapiens
gcctcgtgccagca

SEQ ID NO: 6253785 - DNA, 16 bp, Homo sapiens
gcctcgtgccagcagc

SEQ ID NO: 6253786 - DNA, 19 bp, Homo sapiens
gcctcgtggagctcgcccc

SEQ ID NO: 6253787 - DNA, 18 bp, Homo sapiens
gcctcgtgggttcttcct

SEQ ID NO: 6253788 - DNA, 21 bp, Homo sapiens
gcctcgtgggttcttcctctg

SEQ ID NO: 6253789 - DNA, 14 bp, Homo sapiens
gcctcgtgtcatct

SEQ ID NO: 6253790 - DNA, 19 bp, Homo sapiens
gcctcgtgtccagactcag

SEQ ID NO: 6253791 - DNA, 21 bp, Homo sapiens
gcctcgttaggacaaggctgt

SEQ ID NO: 6253792 - DNA, 20 bp, Homo sapiens
gcctcgttggaagaggaaca

SEQ ID NO: 6253793 - DNA, 16 bp, Homo sapiens
gcctctaactccctcc

SEQ ID NO: 6253794 - DNA, 21 bp, Homo sapiens
gcctctaactccctcctcaca

SEQ ID NO: 6253795 - DNA, 22 bp, Homo sapiens
gcctctaagcgtgctgacatca

SEQ ID NO: 6253796 - DNA, 14 bp, Homo sapiens
gcctctaaggccaa

SEQ ID NO: 6253797 - DNA, 15 bp, Homo sapiens
gcctctaaggccaag

SEQ ID NO: 6253798 - DNA, 16 bp, Homo sapiens
gcctctaaggccaagg

SEQ ID NO: 6253799 - DNA, 21 bp, Homo sapiens
gcctctacccaaccagggccc

SEQ ID NO: 6253800 - DNA, 16 bp, Homo sapiens
gcctctactaggtctg

SEQ ID NO: 6253801 - DNA, 17 bp, Homo sapiens
gcctctactgggaaggc

SEQ ID NO: 6253802 - DNA, 19 bp, Homo sapiens
gcctctactttgtcccctc

SEQ ID NO: 6253803 - DNA, 15 bp, Homo sapiens
gcctctagaacaccc

SEQ ID NO: 6253804 - DNA, 19 bp, Homo sapiens
gcctctagaacacccactg

SEQ ID NO: 6253805 - DNA, 21 bp, Homo sapiens
gcctctagaacacccactggc

SEQ ID NO: 6253806 - DNA, 23 bp, Homo sapiens
gcctctagaacacccactggcca

SEQ ID NO: 6253807 - DNA, 13 bp, Homo sapiens
gcctctagctgaa

SEQ ID NO: 6253808 - DNA, 20 bp, Homo sapiens
gcctctagtccccaaggcct

SEQ ID NO: 6253809 - DNA, 23 bp, Homo sapiens
gcctctagtccccaaggcctctc

SEQ ID NO: 6253810 - DNA, 14 bp, Homo sapiens
gcctctatccctgg

SEQ ID NO: 6253811 - DNA, 16 bp, Homo sapiens
gcctctatccctggcc

SEQ ID NO: 6253812 - DNA, 22 bp, Homo sapiens
gcctctatccctggccacctgc

SEQ ID NO: 6253813 - DNA, 21 bp, Homo sapiens
gcctctatcctacaaggccta

SEQ ID NO: 6253814 - DNA, 17 bp, Homo sapiens
gcctctatgccctgcag

SEQ ID NO: 6253815 - DNA, 18 bp, Homo sapiens
gcctctatgccctgcaga

SEQ ID NO: 6253816 - DNA, 12 bp, Homo sapiens
gcctctcacaca

SEQ ID NO: 6253817 - DNA, 13 bp, Homo sapiens
gcctctcacacat

SEQ ID NO: 6253818 - DNA, 17 bp, Homo sapiens
gcctctcaccccacttc

SEQ ID NO: 6253819 - DNA, 21 bp, Homo sapiens
gcctctcaccccacttcccat

SEQ ID NO: 6253820 - DNA, 23 bp, Homo sapiens
gcctctcacctgtactcttccga

SEQ ID NO: 6253821 - DNA, 16 bp, Homo sapiens
gcctctcactctggca

SEQ ID NO: 6253822 - DNA, 17 bp, Homo sapiens
gcctctcactctggcag

SEQ ID NO: 6253823 - DNA, 19 bp, Homo sapiens
gcctctcagagggttttct

SEQ ID NO: 6253824 - DNA, 19 bp, Homo sapiens
gcctctcagagtcaccact

SEQ ID NO: 6253825 - DNA, 21 bp, Homo sapiens
gcctctcagtcaaacaagttg

SEQ ID NO: 6253826 - DNA, 22 bp, Homo sapiens
gcctctcagtgccctccagccc

SEQ ID NO: 6253827 - DNA, 21 bp, Homo sapiens
gcctctccactcatgtgactc

SEQ ID NO: 6253828 - DNA, 24 bp, Homo sapiens
gcctctccactcatgtgactcttt

SEQ ID NO: 6253829 - DNA, 15 bp, Homo sapiens
gcctctccagcctca

SEQ ID NO: 6253830 - DNA, 14 bp, Homo sapiens
gcctctcccacgat

SEQ ID NO: 6253831 - DNA, 15 bp, Homo sapiens
gcctctcccatggct

SEQ ID NO: 6253832 - DNA, 12 bp, Homo sapiens
gcctctccccac

SEQ ID NO: 6253833 - DNA, 18 bp, Homo sapiens
gcctctccccagagcatt

SEQ ID NO: 6253834 - DNA, 22 bp, Homo sapiens
gcctctccccaggtccagctct

SEQ ID NO: 6253835 - DNA, 23 bp, Homo sapiens
gcctctccccaggtccagctctg

SEQ ID NO: 6253836 - DNA, 17 bp, Homo sapiens
gcctctcccctgcctgc

SEQ ID NO: 6253837 - DNA, 14 bp, Homo sapiens
gcctctcccggctg

SEQ ID NO: 6253838 - DNA, 15 bp, Homo sapiens
gcctctcccggctgc

SEQ ID NO: 6253839 - DNA, 17 bp, Homo sapiens
gcctctcccggctgcct

SEQ ID NO: 6253840 - DNA, 18 bp, Homo sapiens
gcctctcccggctgcctg

SEQ ID NO: 6253841 - DNA, 19 bp, Homo sapiens
gcctctcccggctgcctgc

SEQ ID NO: 6253842 - DNA, 22 bp, Homo sapiens
gcctctcccggctgcctgccgc

SEQ ID NO: 6253843 - DNA, 13 bp, Homo sapiens
gcctctcccgtca

SEQ ID NO: 6253844 - DNA, 18 bp, Homo sapiens
gcctctcccgtcagggcc

SEQ ID NO: 6253845 - DNA, 23 bp, Homo sapiens
gcctctcccgtcagggcccaagt

SEQ ID NO: 6253846 - DNA, 18 bp, Homo sapiens
gcctctccctctggtccc

SEQ ID NO: 6253847 - DNA, 19 bp, Homo sapiens
gcctctccctctggtccca

SEQ ID NO: 6253848 - DNA, 18 bp, Homo sapiens
gcctctccctgctgctcc

SEQ ID NO: 6253849 - DNA, 19 bp, Homo sapiens
gcctctccctgctgctcct

SEQ ID NO: 6253850 - DNA, 12 bp, Homo sapiens
gcctctccctgg

SEQ ID NO: 6253851 - DNA, 14 bp, Homo sapiens
gcctctccctggcc

SEQ ID NO: 6253852 - DNA, 12 bp, Homo sapiens
gcctctccctta

SEQ ID NO: 6253853 - DNA, 23 bp, Homo sapiens
gcctctccctttagtggagccag

SEQ ID NO: 6253854 - DNA, 12 bp, Homo sapiens
gcctctccgccc

SEQ ID NO: 6253855 - DNA, 18 bp, Homo sapiens
gcctctcctccacagccc

SEQ ID NO: 6253856 - DNA, 22 bp, Homo sapiens
gcctctcctccttgggcagggt

SEQ ID NO: 6253857 - DNA, 15 bp, Homo sapiens
gcctctccttgcccc

SEQ ID NO: 6253858 - DNA, 16 bp, Homo sapiens
gcctctccttgcctgg

SEQ ID NO: 6253859 - DNA, 17 bp, Homo sapiens
gcctctccttggaaggt

SEQ ID NO: 6253860 - DNA, 14 bp, Homo sapiens
gcctctcctttgta

SEQ ID NO: 6253861 - DNA, 19 bp, Homo sapiens
gcctctcgctcctcaaccc

SEQ ID NO: 6253862 - DNA, 14 bp, Homo sapiens
gcctctctacagtc

SEQ ID NO: 6253863 - DNA, 13 bp, Homo sapiens
gcctctctagcac

SEQ ID NO: 6253864 - DNA, 20 bp, Homo sapiens
gcctctctatcctctcttcc

SEQ ID NO: 6253865 - DNA, 21 bp, Homo sapiens
gatgacgtacaagtagttctg

SEQ ID NO: 6253866 - DNA, 22 bp, Homo sapiens
gatgactaacaagatttgtaat

SEQ ID NO: 6253867 - DNA, 16 bp, Homo sapiens
gatgactagaggcagg

SEQ ID NO: 6253868 - DNA, 21 bp, Homo sapiens
gatgactatgcagaggcctgg

SEQ ID NO: 6253869 - DNA, 14 bp, Homo sapiens
gatgactatggaaa

SEQ ID NO: 6253870 - DNA, 13 bp, Homo sapiens
gatgactcaagat

SEQ ID NO: 6253871 - DNA, 21 bp, Homo sapiens
gatgactcaagattcccagga

SEQ ID NO: 6253872 - DNA, 22 bp, Homo sapiens
gatgactcaagattcccaggag

SEQ ID NO: 6253873 - DNA, 15 bp, Homo sapiens
gatgactcaaggcca

SEQ ID NO: 6253874 - DNA, 20 bp, Homo sapiens
gatgactcactccattccta

SEQ ID NO: 6253875 - DNA, 13 bp, Homo sapiens
gatgactctctcc

SEQ ID NO: 6253876 - DNA, 14 bp, Homo sapiens
gatgactcttctta

SEQ ID NO: 6253877 - DNA, 13 bp, Homo sapiens
gatgactgaattt

SEQ ID NO: 6253878 - DNA, 14 bp, Homo sapiens
gatgactgaatttc

SEQ ID NO: 6253879 - DNA, 14 bp, Homo sapiens
gatgactgagtcct

SEQ ID NO: 6253880 - DNA, 12 bp, Homo sapiens
gatgactgcctt

SEQ ID NO: 6253881 - DNA, 13 bp, Homo sapiens
gatgactggaatt

SEQ ID NO: 6253882 - DNA, 22 bp, Homo sapiens
gatgactggaatttttattatg

SEQ ID NO: 6253883 - DNA, 19 bp, Homo sapiens
gatgactggggtgggaggt

SEQ ID NO: 6253884 - DNA, 15 bp, Homo sapiens
gatgactgtgttgta

SEQ ID NO: 6253885 - DNA, 15 bp, Homo sapiens
gatgactgtttttaa

SEQ ID NO: 6253886 - DNA, 16 bp, Homo sapiens
gatgacttgagccctg

SEQ ID NO: 6253887 - DNA, 22 bp, Homo sapiens
gatgactttgcagatggaaaga

SEQ ID NO: 6253888 - DNA, 12 bp, Homo sapiens
gatgagaaaaaa

SEQ ID NO: 6253889 - DNA, 13 bp, Homo sapiens
gatgagaaaaaac

SEQ ID NO: 6253890 - DNA, 16 bp, Homo sapiens
gatgagaaaactgaga

SEQ ID NO: 6253891 - DNA, 19 bp, Homo sapiens
gatgagaaacaacagaaac

SEQ ID NO: 6253892 - DNA, 13 bp, Homo sapiens
gatgagaaacagc

SEQ ID NO: 6253893 - DNA, 18 bp, Homo sapiens
gatgagaaacagctcagc

SEQ ID NO: 6253894 - DNA, 19 bp, Homo sapiens
gatgagaaacagctcagcc

SEQ ID NO: 6253895 - DNA, 23 bp, Homo sapiens
gatgagaaagcttttattccttt

SEQ ID NO: 6253896 - DNA, 11 bp, Homo sapiens
gatgagaaagg

SEQ ID NO: 6253897 - DNA, 15 bp, Homo sapiens
gatgagaacaagcta

SEQ ID NO: 6253898 - DNA, 14 bp, Homo sapiens
gatgagaagagggg

SEQ ID NO: 6253899 - DNA, 15 bp, Homo sapiens
gatgagaagccagga

SEQ ID NO: 6253900 - DNA, 12 bp, Homo sapiens
gatgagaagtgt

SEQ ID NO: 6253901 - DNA, 19 bp, Homo sapiens
gatgagaagttaagcagcc

SEQ ID NO: 6253902 - DNA, 14 bp, Homo sapiens
gatgagaatgtgac

SEQ ID NO: 6253903 - DNA, 20 bp, Homo sapiens
gatgagaattcagctgcccc

SEQ ID NO: 6253904 - DNA, 17 bp, Homo sapiens
gatgagacaacacacac

SEQ ID NO: 6253905 - DNA, 14 bp, Homo sapiens
gatgagacctgggg

SEQ ID NO: 6253906 - DNA, 17 bp, Homo sapiens
gatgagagagtgctgag

SEQ ID NO: 6253907 - DNA, 18 bp, Homo sapiens
gatgagagcccagaggta

SEQ ID NO: 6253908 - DNA, 15 bp, Homo sapiens
gatgagcaaggacat

SEQ ID NO: 6253909 - DNA, 18 bp, Homo sapiens
gatgagcaaggacattgc

SEQ ID NO: 6253910 - DNA, 19 bp, Homo sapiens
gatgagcacatctctctgc

SEQ ID NO: 6253911 - DNA, 13 bp, Homo sapiens
gatgagcaggagc

SEQ ID NO: 6253912 - DNA, 16 bp, Homo sapiens
gatgagcatcccagga

SEQ ID NO: 6253913 - DNA, 15 bp, Homo sapiens
gatgagcatggagct

SEQ ID NO: 6253914 - DNA, 15 bp, Homo sapiens
gatgagccctcagaa

SEQ ID NO: 6253915 - DNA, 22 bp, Homo sapiens
gatgagccctcagaacccttgg

SEQ ID NO: 6253916 - DNA, 13 bp, Homo sapiens
gatgagccgctgt

SEQ ID NO: 6253917 - DNA, 13 bp, Homo sapiens
gatgagcctgggc

SEQ ID NO: 6253918 - DNA, 22 bp, Homo sapiens
gatgagccttcgtgccccccct

SEQ ID NO: 6253919 - DNA, 12 bp, Homo sapiens
gatgagctccca

SEQ ID NO: 6253920 - DNA, 18 bp, Homo sapiens
gatgagctcccacaagcc

SEQ ID NO: 6253921 - DNA, 21 bp, Homo sapiens
gatgagctcccacaagcctga

SEQ ID NO: 6253922 - DNA, 15 bp, Homo sapiens
gatgagctgaaaagt

SEQ ID NO: 6253923 - DNA, 14 bp, Homo sapiens
gatgagctgggccg

SEQ ID NO: 6253924 - DNA, 11 bp, Homo sapiens
gatgagctggt

SEQ ID NO: 6253925 - DNA, 20 bp, Homo sapiens
gatgagctggtttgactcat

SEQ ID NO: 6253926 - DNA, 20 bp, Homo sapiens
gatgagcttagggtgttttt

SEQ ID NO: 6253927 - DNA, 23 bp, Homo sapiens
gatgaggaacaccactatcttaa

SEQ ID NO: 6253928 - DNA, 20 bp, Homo sapiens
gatgaggacagagggcacat

SEQ ID NO: 6253929 - DNA, 21 bp, Homo sapiens
gatgaggacccagagctgctg

SEQ ID NO: 6253930 - DNA, 22 bp, Homo sapiens
gatgaggccagaccatggacac

SEQ ID NO: 6253931 - DNA, 20 bp, Homo sapiens
gatgaggccccgccttttcc

SEQ ID NO: 6253932 - DNA, 16 bp, Homo sapiens
gatgaggccctgcacc

SEQ ID NO: 6253933 - DNA, 21 bp, Homo sapiens
gatgaggccctgcaccttccc

SEQ ID NO: 6253934 - DNA, 19 bp, Homo sapiens
gatgaggccgctagaggcc

SEQ ID NO: 6253935 - DNA, 21 bp, Homo sapiens
gatgaggccgctagaggcctg

SEQ ID NO: 6253936 - DNA, 23 bp, Homo sapiens
gatgaggctcagagaggtagcac

SEQ ID NO: 6253937 - DNA, 15 bp, Homo sapiens
gatgagggcagcagc

SEQ ID NO: 6253938 - DNA, 17 bp, Homo sapiens
gatgagggcagcagcca

SEQ ID NO: 6253939 - DNA, 18 bp, Homo sapiens
gatgagggccaccaggaa

SEQ ID NO: 6253940 - DNA, 14 bp, Homo sapiens
gatgagggctggct

SEQ ID NO: 6253941 - DNA, 15 bp, Homo sapiens
gatgaggggccactg

SEQ ID NO: 6253942 - DNA, 23 bp, Homo sapiens
gatgaggggcttcctgggtcctg

SEQ ID NO: 6253943 - DNA, 23 bp, Homo sapiens
gatgagggggaattcctggaacc

SEQ ID NO: 6253944 - DNA, 22 bp, Homo sapiens
gatgagggtgtcggctgtgagg

SEQ ID NO: 6253945 - DNA, 18 bp, Homo sapiens
gatgaggtaattctccct

SEQ ID NO: 6253946 - DNA, 19 bp, Homo sapiens
gatgaggtcagttgtgttt

SEQ ID NO: 6253947 - DNA, 20 bp, Homo sapiens
gatgaggtctcgaccctgtc

SEQ ID NO: 6253948 - DNA, 17 bp, Homo sapiens
gatgaggtgctgggagg

SEQ ID NO: 6253949 - DNA, 19 bp, Homo sapiens
gatgaggtgctgggaggga

SEQ ID NO: 6253950 - DNA, 17 bp, Homo sapiens
gatgaggttctgagacc

SEQ ID NO: 6253951 - DNA, 20 bp, Homo sapiens
gatgaggttgagctatgata

SEQ ID NO: 6253952 - DNA, 23 bp, Homo sapiens
gatgagtcagacacgattgagaa

SEQ ID NO: 6253953 - DNA, 20 bp, Homo sapiens
gatgagtcccctgtgagatt

SEQ ID NO: 6253954 - DNA, 13 bp, Homo sapiens
gatgagtcctgtt

SEQ ID NO: 6253955 - DNA, 21 bp, Homo sapiens
gatgagtgggaggcgtgcccc

SEQ ID NO: 6253956 - DNA, 22 bp, Homo sapiens
gatgagtgggaggcgtgccccc

SEQ ID NO: 6253957 - DNA, 16 bp, Homo sapiens
gatgagttgcagtttt

SEQ ID NO: 6253958 - DNA, 17 bp, Homo sapiens
gatgagttgcagttttt

SEQ ID NO: 6253959 - DNA, 19 bp, Homo sapiens
gatgagttgcagtttttat

SEQ ID NO: 6253960 - DNA, 14 bp, Homo sapiens
gatgagtttctggg

SEQ ID NO: 6253961 - DNA, 21 bp, Homo sapiens
gatgagtttttcattatttgg

SEQ ID NO: 6253962 - DNA, 23 bp, Homo sapiens
gatgataaaaggaatctggcatt

SEQ ID NO: 6253963 - DNA, 14 bp, Homo sapiens
gatgataaaaggag

SEQ ID NO: 6253964 - DNA, 21 bp, Homo sapiens
gatgataaatatttatgctta

SEQ ID NO: 6253965 - DNA, 14 bp, Homo sapiens
gatgatacagtgtt

SEQ ID NO: 6253966 - DNA, 18 bp, Homo sapiens
gatgatacatccaaagca

SEQ ID NO: 6253967 - DNA, 15 bp, Homo sapiens
gatgatactgtttct

SEQ ID NO: 6253968 - DNA, 16 bp, Homo sapiens
gatgatactgtttctt

SEQ ID NO: 6253969 - DNA, 12 bp, Homo sapiens
gatgatagactt

SEQ ID NO: 6253970 - DNA, 20 bp, Homo sapiens
gatgatagtccaatttttac

SEQ ID NO: 6253971 - DNA, 22 bp, Homo sapiens
gatgatattaagaactgctgtt

SEQ ID NO: 6253972 - DNA, 20 bp, Homo sapiens
gatgatcaattatagtttct

SEQ ID NO: 6253973 - DNA, 19 bp, Homo sapiens
gatgatcagctgtttgtca

SEQ ID NO: 6253974 - DNA, 16 bp, Homo sapiens
gatgatcatgatgatg

SEQ ID NO: 6253975 - DNA, 16 bp, Homo sapiens
gatgatccagaacagt

SEQ ID NO: 6253976 - DNA, 23 bp, Homo sapiens
gatgatccatgagtttgccctgg

SEQ ID NO: 6253977 - DNA, 15 bp, Homo sapiens
gatgatcccagtcac

SEQ ID NO: 6253978 - DNA, 15 bp, Homo sapiens
gatgatccccacgcc

SEQ ID NO: 6253979 - DNA, 21 bp, Homo sapiens
gatgatccggatttaatttga

SEQ ID NO: 6253980 - DNA, 12 bp, Homo sapiens
gatgatccttgc

SEQ ID NO: 6253981 - DNA, 13 bp, Homo sapiens
gatgatcgtgcct

SEQ ID NO: 6253982 - DNA, 21 bp, Homo sapiens
gatgatctactcagaaatttt

SEQ ID NO: 6253983 - DNA, 16 bp, Homo sapiens
gatgatctttaaaata

SEQ ID NO: 6253984 - DNA, 16 bp, Homo sapiens
gatgatgaaaactaag

SEQ ID NO: 6253985 - DNA, 21 bp, Homo sapiens
gatgatgaaatgaggtcagag

SEQ ID NO: 6253986 - DNA, 23 bp, Homo sapiens
gatgatgacgacgacaacgatga

SEQ ID NO: 6253987 - DNA, 19 bp, Homo sapiens
gatgatgagaatttctaaa

SEQ ID NO: 6253988 - DNA, 14 bp, Homo sapiens
gatgatgatgaaaa

SEQ ID NO: 6253989 - DNA, 19 bp, Homo sapiens
gatgatgccaacctctgga

SEQ ID NO: 6253990 - DNA, 13 bp, Homo sapiens
gatgatgccacac

SEQ ID NO: 6253991 - DNA, 15 bp, Homo sapiens
gatgatgccacacca

SEQ ID NO: 6253992 - DNA, 16 bp, Homo sapiens
gatgatgctgtgacaa

SEQ ID NO: 6253993 - DNA, 14 bp, Homo sapiens
gatgatggaaaaat

SEQ ID NO: 6253994 - DNA, 16 bp, Homo sapiens
gatgatggaaaaatca

SEQ ID NO: 6253995 - DNA, 19 bp, Homo sapiens
gatgatgggaattgtgtga

SEQ ID NO: 6253996 - DNA, 15 bp, Homo sapiens
gatgatggggtcagc

SEQ ID NO: 6253997 - DNA, 20 bp, Homo sapiens
gatgatggggtcagcaggcc

SEQ ID NO: 6253998 - DNA, 21 bp, Homo sapiens
gatgatggtcttcagcctctt

SEQ ID NO: 6253999 - DNA, 22 bp, Homo sapiens
gatgatggttgcaaaagactaa

SEQ ID NO: 6254000 - DNA, 18 bp, Homo sapiens
gatgatgtaaaaatatgt

SEQ ID NO: 6254001 - DNA, 19 bp, Homo sapiens
gatgatgtctacagaaaat

SEQ ID NO: 6254002 - DNA, 16 bp, Homo sapiens
gatgatgtctcttgta

SEQ ID NO: 6254003 - DNA, 15 bp, Homo sapiens
gatgatgtggttttt

SEQ ID NO: 6254004 - DNA, 13 bp, Homo sapiens
gatgatgtgtata

SEQ ID NO: 6254005 - DNA, 13 bp, Homo sapiens
gatgatgtgtgaa

SEQ ID NO: 6254006 - DNA, 15 bp, Homo sapiens
gatgatgttctgaaa

SEQ ID NO: 6254007 - DNA, 14 bp, Homo sapiens
gatgattaaacacc

SEQ ID NO: 6254008 - DNA, 19 bp, Homo sapiens
gatgattaaacacctgaca

SEQ ID NO: 6254009 - DNA, 11 bp, Homo sapiens
gatgattaaat

SEQ ID NO: 6254010 - DNA, 22 bp, Homo sapiens
gatgattcaatcattttgggaa

SEQ ID NO: 6254011 - DNA, 15 bp, Homo sapiens
gatgattcccaccca

SEQ ID NO: 6254012 - DNA, 17 bp, Homo sapiens
gatgattcttaacacag

SEQ ID NO: 6254013 - DNA, 13 bp, Homo sapiens
gatgattgcttga

SEQ ID NO: 6254014 - DNA, 19 bp, Homo sapiens
gatgattgcttgagctcag

SEQ ID NO: 6254015 - DNA, 13 bp, Homo sapiens
gatgattgtacag

SEQ ID NO: 6254016 - DNA, 17 bp, Homo sapiens
gatgatttaagtataca

SEQ ID NO: 6254017 - DNA, 16 bp, Homo sapiens
gatgatttaattctta

SEQ ID NO: 6254018 - DNA, 17 bp, Homo sapiens
gatgatttaattcttac

SEQ ID NO: 6254019 - DNA, 18 bp, Homo sapiens
gatgatttcagaaggaga

SEQ ID NO: 6254020 - DNA, 19 bp, Homo sapiens
gatgatttcagaaggagaa

SEQ ID NO: 6254021 - DNA, 16 bp, Homo sapiens
gatgatttcagttcta

SEQ ID NO: 6254022 - DNA, 23 bp, Homo sapiens
gatgatttcagttctaggaaaat

SEQ ID NO: 6254023 - DNA, 17 bp, Homo sapiens
gatgatttcatcttctg

SEQ ID NO: 6254024 - DNA, 18 bp, Homo sapiens
gatgatttcatcttctgg

SEQ ID NO: 6254025 - DNA, 23 bp, Homo sapiens
gatgatttctatgctgagtttgt

SEQ ID NO: 6254026 - DNA, 18 bp, Homo sapiens
gatgatttgcaatgggat

SEQ ID NO: 6254027 - DNA, 20 bp, Homo sapiens
gatgatttgctatcaaaata

SEQ ID NO: 6254028 - DNA, 18 bp, Homo sapiens
gatgattttaacagtttt

SEQ ID NO: 6254029 - DNA, 21 bp, Homo sapiens
gatgattttcatttcatgaaa

SEQ ID NO: 6254030 - DNA, 23 bp, Homo sapiens
gatgattttcatttcatgaaaat

SEQ ID NO: 6254031 - DNA, 15 bp, Homo sapiens
gatgatttttaactt

SEQ ID NO: 6254032 - DNA, 21 bp, Homo sapiens
gatgattttttaaggagctgg

SEQ ID NO: 6254033 - DNA, 22 bp, Homo sapiens
gatgattttttaaggagctggg

SEQ ID NO: 6254034 - DNA, 23 bp, Homo sapiens
gatgattttttttcttttgagtt

SEQ ID NO: 6254035 - DNA, 15 bp, Homo sapiens
gatgcaaagaggcaa

SEQ ID NO: 6254036 - DNA, 17 bp, Homo sapiens
gatgcaaagaggcaaga

SEQ ID NO: 6254037 - DNA, 11 bp, Homo sapiens
gatgcaaataa

SEQ ID NO: 6254038 - DNA, 19 bp, Homo sapiens
gatgcaaataaagcctgct

SEQ ID NO: 6254039 - DNA, 23 bp, Homo sapiens
gatgcaaatgcatggcaaatcct

SEQ ID NO: 6254040 - DNA, 13 bp, Homo sapiens
gatgcaaccaaaa

SEQ ID NO: 6254041 - DNA, 18 bp, Homo sapiens
gatgcaacctcactatgg

SEQ ID NO: 6254042 - DNA, 19 bp, Homo sapiens
gatgcaaggattacagaaa

SEQ ID NO: 6254043 - DNA, 23 bp, Homo sapiens
gatgcaaggattacagaaactga

SEQ ID NO: 6254044 - DNA, 18 bp, Homo sapiens
gcctctctcagcccaggt

SEQ ID NO: 6254045 - DNA, 20 bp, Homo sapiens
gcctctctcaggagtatctt

SEQ ID NO: 6254046 - DNA, 14 bp, Homo sapiens
gcctctctccacta

SEQ ID NO: 6254047 - DNA, 14 bp, Homo sapiens
gcctctctcctgcc

SEQ ID NO: 6254048 - DNA, 16 bp, Homo sapiens
gcctctctctccctcc

SEQ ID NO: 6254049 - DNA, 15 bp, Homo sapiens
gcctctctctgctcc

SEQ ID NO: 6254050 - DNA, 10 bp, Homo sapiens
gcctctctgc

SEQ ID NO: 6254051 - DNA, 14 bp, Homo sapiens
gcctctctgcaggt

SEQ ID NO: 6254052 - DNA, 16 bp, Homo sapiens
gcctctctgccccacc

SEQ ID NO: 6254053 - DNA, 23 bp, Homo sapiens
gcctctctgccccacccaagccc

SEQ ID NO: 6254054 - DNA, 14 bp, Homo sapiens
gcctctctgctcca

SEQ ID NO: 6254055 - DNA, 17 bp, Homo sapiens
gcctctctgctccagag

SEQ ID NO: 6254056 - DNA, 18 bp, Homo sapiens
gcctctctgctccagaga

SEQ ID NO: 6254057 - DNA, 14 bp, Homo sapiens
gcctctctggaaga

SEQ ID NO: 6254058 - DNA, 14 bp, Homo sapiens
gcctctctggcctc

SEQ ID NO: 6254059 - DNA, 20 bp, Homo sapiens
gcctctctggcctcccaccc

SEQ ID NO: 6254060 - DNA, 14 bp, Homo sapiens
gcctctctggctca

SEQ ID NO: 6254061 - DNA, 15 bp, Homo sapiens
gcctctctggctcag

SEQ ID NO: 6254062 - DNA, 17 bp, Homo sapiens
gcctctctggctcagcc

SEQ ID NO: 6254063 - DNA, 11 bp, Homo sapiens
gcctctctggg

SEQ ID NO: 6254064 - DNA, 14 bp, Homo sapiens
gcctctctggggga

SEQ ID NO: 6254065 - DNA, 19 bp, Homo sapiens
gcctctctgtacactgccc

SEQ ID NO: 6254066 - DNA, 15 bp, Homo sapiens
gcctctcttcctatc

SEQ ID NO: 6254067 - DNA, 22 bp, Homo sapiens
gcctctcttcctatcccatccc

SEQ ID NO: 6254068 - DNA, 23 bp, Homo sapiens
gcctctcttcctatcccatccca

SEQ ID NO: 6254069 - DNA, 17 bp, Homo sapiens
gcctctcttgccccttg

SEQ ID NO: 6254070 - DNA, 22 bp, Homo sapiens
gcctctcttgccccttgtcctg

SEQ ID NO: 6254071 - DNA, 19 bp, Homo sapiens
gcctctcttggaccctggg

SEQ ID NO: 6254072 - DNA, 14 bp, Homo sapiens
gcctctcttttccc

SEQ ID NO: 6254073 - DNA, 15 bp, Homo sapiens
gcctctcttttcccc

SEQ ID NO: 6254074 - DNA, 18 bp, Homo sapiens
gcctctcttttccccgcc

SEQ ID NO: 6254075 - DNA, 19 bp, Homo sapiens
gcctctgaactgctgctgg

SEQ ID NO: 6254076 - DNA, 15 bp, Homo sapiens
gcctctgacacacag

SEQ ID NO: 6254077 - DNA, 19 bp, Homo sapiens
gcctctgacacacagctct

SEQ ID NO: 6254078 - DNA, 18 bp, Homo sapiens
gcctctgacagcagcctg

SEQ ID NO: 6254079 - DNA, 19 bp, Homo sapiens
gcctctgacagtccacagg

SEQ ID NO: 6254080 - DNA, 16 bp, Homo sapiens
gcctctgacccctcct

SEQ ID NO: 6254081 - DNA, 22 bp, Homo sapiens
gcctctgacccctcctcactgg

SEQ ID NO: 6254082 - DNA, 24 bp, Homo sapiens
gcctctgactctgagtccactgct

SEQ ID NO: 6254083 - DNA, 19 bp, Homo sapiens
gcctctgagaagctctgaa

SEQ ID NO: 6254084 - DNA, 13 bp, Homo sapiens
gcctctgagagca

SEQ ID NO: 6254085 - DNA, 16 bp, Homo sapiens
gcctctgagagcatca

SEQ ID NO: 6254086 - DNA, 20 bp, Homo sapiens
gcctctgagatgctaattta

SEQ ID NO: 6254087 - DNA, 14 bp, Homo sapiens
gcctctgagccagg

SEQ ID NO: 6254088 - DNA, 17 bp, Homo sapiens
gcctctgagccaggagc

SEQ ID NO: 6254089 - DNA, 19 bp, Homo sapiens
gcctctgagccaggagcct

SEQ ID NO: 6254090 - DNA, 14 bp, Homo sapiens
gcctctgagcttct

SEQ ID NO: 6254091 - DNA, 12 bp, Homo sapiens
gcctctgaggcc

SEQ ID NO: 6254092 - DNA, 20 bp, Homo sapiens
gcctctgaggccagcctggc

SEQ ID NO: 6254093 - DNA, 20 bp, Homo sapiens
gcctctgagggaaagcccag

SEQ ID NO: 6254094 - DNA, 22 bp, Homo sapiens
gcctctgattctatgtaacttg

SEQ ID NO: 6254095 - DNA, 14 bp, Homo sapiens
gcctctgattttct

SEQ ID NO: 6254096 - DNA, 17 bp, Homo sapiens
gcctctgcaactgctca

SEQ ID NO: 6254097 - DNA, 22 bp, Homo sapiens
gcctctgcaactgctcagctct

SEQ ID NO: 6254098 - DNA, 21 bp, Homo sapiens
gcctctgcaagattctgtggg

SEQ ID NO: 6254099 - DNA, 22 bp, Homo sapiens
gcctctgcaagattctgtgggc

SEQ ID NO: 6254100 - DNA, 19 bp, Homo sapiens
gcctctgcacgtgcacaca

SEQ ID NO: 6254101 - DNA, 20 bp, Homo sapiens
gcctctgcacgtgcacacac

SEQ ID NO: 6254102 - DNA, 14 bp, Homo sapiens
gcctctgcactccc

SEQ ID NO: 6254103 - DNA, 17 bp, Homo sapiens
gcctctgcactcccctg

SEQ ID NO: 6254104 - DNA, 21 bp, Homo sapiens
gcctctgcactcccctgctgg

SEQ ID NO: 6254105 - DNA, 12 bp, Homo sapiens
gcctctgcagtc

SEQ ID NO: 6254106 - DNA, 21 bp, Homo sapiens
gcctctgcagtctcatttctc

SEQ ID NO: 6254107 - DNA, 16 bp, Homo sapiens
gcctctgccagcgcca

SEQ ID NO: 6254108 - DNA, 13 bp, Homo sapiens
gcctctgccaggc

SEQ ID NO: 6254109 - DNA, 16 bp, Homo sapiens
gcctctgccaggcctg

SEQ ID NO: 6254110 - DNA, 12 bp, Homo sapiens
gcctctgccatc

SEQ ID NO: 6254111 - DNA, 19 bp, Homo sapiens
gcctctgccatcctccctg

SEQ ID NO: 6254112 - DNA, 21 bp, Homo sapiens
gcctctgccatgcccagagaa

SEQ ID NO: 6254113 - DNA, 18 bp, Homo sapiens
gcctctgcccaagcagcc

SEQ ID NO: 6254114 - DNA, 17 bp, Homo sapiens
gcctctgcccagcctgc

SEQ ID NO: 6254115 - DNA, 13 bp, Homo sapiens
gcctctgccccaa

SEQ ID NO: 6254116 - DNA, 16 bp, Homo sapiens
gcctctgccccaagag

SEQ ID NO: 6254117 - DNA, 15 bp, Homo sapiens
gcctctgccccaagg

SEQ ID NO: 6254118 - DNA, 21 bp, Homo sapiens
gcctctgccccaaggggccca

SEQ ID NO: 6254119 - DNA, 14 bp, Homo sapiens
gcctctgccccagc

SEQ ID NO: 6254120 - DNA, 15 bp, Homo sapiens
gcctctgccccgtct

SEQ ID NO: 6254121 - DNA, 18 bp, Homo sapiens
gcctctgcccctcccaac

SEQ ID NO: 6254122 - DNA, 12 bp, Homo sapiens
gcctctgccctg

SEQ ID NO: 6254123 - DNA, 13 bp, Homo sapiens
gcctctgccctgc

SEQ ID NO: 6254124 - DNA, 15 bp, Homo sapiens
gcctctgcccttggg

SEQ ID NO: 6254125 - DNA, 15 bp, Homo sapiens
gcctctgccgctgcc

SEQ ID NO: 6254126 - DNA, 17 bp, Homo sapiens
gcctctgccgctgccat

SEQ ID NO: 6254127 - DNA, 20 bp, Homo sapiens
gcctctgccgctgccatgct

SEQ ID NO: 6254128 - DNA, 10 bp, Homo sapiens
gcctctgcct

SEQ ID NO: 6254129 - DNA, 13 bp, Homo sapiens
gcctctgcctcca

SEQ ID NO: 6254130 - DNA, 19 bp, Homo sapiens
gcctctgcctccaggaggg

SEQ ID NO: 6254131 - DNA, 15 bp, Homo sapiens
gcctctgcctcccaa

SEQ ID NO: 6254132 - DNA, 12 bp, Homo sapiens
gcctctgcctct

SEQ ID NO: 6254133 - DNA, 18 bp, Homo sapiens
gcctctgcctctgacaca

SEQ ID NO: 6254134 - DNA, 14 bp, Homo sapiens
gcctctgcctggga

SEQ ID NO: 6254135 - DNA, 12 bp, Homo sapiens
gcctctgcctgt

SEQ ID NO: 6254136 - DNA, 13 bp, Homo sapiens
gcctctgcctgtg

SEQ ID NO: 6254137 - DNA, 15 bp, Homo sapiens
gcctctgccttagag

SEQ ID NO: 6254138 - DNA, 12 bp, Homo sapiens
gcctctgccttg

SEQ ID NO: 6254139 - DNA, 21 bp, Homo sapiens
gcctctgcggagcacactggc

SEQ ID NO: 6254140 - DNA, 20 bp, Homo sapiens
gcctctgcggggcagggcct

SEQ ID NO: 6254141 - DNA, 21 bp, Homo sapiens
gcctctgcggggcagggcctt

SEQ ID NO: 6254142 - DNA, 16 bp, Homo sapiens
gcctctgcgtcttttt

SEQ ID NO: 6254143 - DNA, 12 bp, Homo sapiens
gcctctgctccc

SEQ ID NO: 6254144 - DNA, 19 bp, Homo sapiens
gcctctgctgatcctccca

SEQ ID NO: 6254145 - DNA, 15 bp, Homo sapiens
gcctctgctgccatg

SEQ ID NO: 6254146 - DNA, 15 bp, Homo sapiens
gcctctgctgccgcc

SEQ ID NO: 6254147 - DNA, 17 bp, Homo sapiens
gcctctgctgccgccct

SEQ ID NO: 6254148 - DNA, 12 bp, Homo sapiens
gcctctgctgga

SEQ ID NO: 6254149 - DNA, 14 bp, Homo sapiens
gcctctgctggctc

SEQ ID NO: 6254150 - DNA, 15 bp, Homo sapiens
gcctctgcttgccag

SEQ ID NO: 6254151 - DNA, 16 bp, Homo sapiens
gcctctgcttgccagc

SEQ ID NO: 6254152 - DNA, 17 bp, Homo sapiens
gcctctgcttgccagcc

SEQ ID NO: 6254153 - DNA, 23 bp, Homo sapiens
gcctctgcttgccagccaggagt

SEQ ID NO: 6254154 - DNA, 16 bp, Homo sapiens
gcctctggaatgcatg

SEQ ID NO: 6254155 - DNA, 19 bp, Homo sapiens
gcctctggaggcctctggg

SEQ ID NO: 6254156 - DNA, 14 bp, Homo sapiens
gcctctggatctag

SEQ ID NO: 6254157 - DNA, 17 bp, Homo sapiens
gcctctggccagacggc

SEQ ID NO: 6254158 - DNA, 19 bp, Homo sapiens
gcctctggccaggcatggc

SEQ ID NO: 6254159 - DNA, 12 bp, Homo sapiens
gcctctggccct

SEQ ID NO: 6254160 - DNA, 12 bp, Homo sapiens
gcctctggctcc

SEQ ID NO: 6254161 - DNA, 21 bp, Homo sapiens
gcctctggctccacacctcca

SEQ ID NO: 6254162 - DNA, 19 bp, Homo sapiens
gcctctggctctacacata

SEQ ID NO: 6254163 - DNA, 15 bp, Homo sapiens
gcctctggctgcctg

SEQ ID NO: 6254164 - DNA, 16 bp, Homo sapiens
gcctctggctgctgta

SEQ ID NO: 6254165 - DNA, 15 bp, Homo sapiens
gcctctggcttccct

SEQ ID NO: 6254166 - DNA, 15 bp, Homo sapiens
gcctctgggacccac

SEQ ID NO: 6254167 - DNA, 21 bp, Homo sapiens
gcctctgggacccacagaact

SEQ ID NO: 6254168 - DNA, 14 bp, Homo sapiens
gcctctgggcagcc

SEQ ID NO: 6254169 - DNA, 20 bp, Homo sapiens
gcctctgggcagcctgcttt

SEQ ID NO: 6254170 - DNA, 19 bp, Homo sapiens
gcctctgggcagtgtggcc

SEQ ID NO: 6254171 - DNA, 13 bp, Homo sapiens
gcctctgggccat

SEQ ID NO: 6254172 - DNA, 12 bp, Homo sapiens
gcctctgggctc

SEQ ID NO: 6254173 - DNA, 15 bp, Homo sapiens
gcctctgggctcaca

SEQ ID NO: 6254174 - DNA, 16 bp, Homo sapiens
gcctctgggctcacac

SEQ ID NO: 6254175 - DNA, 13 bp, Homo sapiens
gcctctggggcag

SEQ ID NO: 6254176 - DNA, 19 bp, Homo sapiens
gcctctggggcaggaccac

SEQ ID NO: 6254177 - DNA, 21 bp, Homo sapiens
gcctctggggggtggccaggc

SEQ ID NO: 6254178 - DNA, 23 bp, Homo sapiens
gcctctggggggtggccaggccg

SEQ ID NO: 6254179 - DNA, 18 bp, Homo sapiens
gcctctggtgttcctggc

SEQ ID NO: 6254180 - DNA, 17 bp, Homo sapiens
gcctctggttgcctccc

SEQ ID NO: 6254181 - DNA, 23 bp, Homo sapiens
gcctctggtttggggcgaggcag

SEQ ID NO: 6254182 - DNA, 18 bp, Homo sapiens
gcctctgtaccgcccggc

SEQ ID NO: 6254183 - DNA, 20 bp, Homo sapiens
gcctctgtaccgcccggcag

SEQ ID NO: 6254184 - DNA, 18 bp, Homo sapiens
gcctctgtcaggccttca

SEQ ID NO: 6254185 - DNA, 21 bp, Homo sapiens
gcctctgtcatatcttcacaa

SEQ ID NO: 6254186 - DNA, 14 bp, Homo sapiens
gcctctgtccctct

SEQ ID NO: 6254187 - DNA, 17 bp, Homo sapiens
gcctctgtcctagactc

SEQ ID NO: 6254188 - DNA, 14 bp, Homo sapiens
gcctctgtcctccc

SEQ ID NO: 6254189 - DNA, 15 bp, Homo sapiens
gcctctgtcctccca

SEQ ID NO: 6254190 - DNA, 18 bp, Homo sapiens
gcctctgtcctcccatcc

SEQ ID NO: 6254191 - DNA, 19 bp, Homo sapiens
gcctctgtcctcccatccc

SEQ ID NO: 6254192 - DNA, 23 bp, Homo sapiens
gcctctgtcctcccatcccctca

SEQ ID NO: 6254193 - DNA, 14 bp, Homo sapiens
gcctctgtcctggc

SEQ ID NO: 6254194 - DNA, 20 bp, Homo sapiens
gcctctgtcctggctgtgca

SEQ ID NO: 6254195 - DNA, 18 bp, Homo sapiens
gcctctgtcttaaagaat

SEQ ID NO: 6254196 - DNA, 18 bp, Homo sapiens
gcctctgtgattacatag

SEQ ID NO: 6254197 - DNA, 13 bp, Homo sapiens
gcctctgtgcaca

SEQ ID NO: 6254198 - DNA, 14 bp, Homo sapiens
gcctctgtgcacag

SEQ ID NO: 6254199 - DNA, 21 bp, Homo sapiens
gcctctgtgcacagtggcttc

SEQ ID NO: 6254200 - DNA, 22 bp, Homo sapiens
gcctctgtgcacagtggcttct

SEQ ID NO: 6254201 - DNA, 11 bp, Homo sapiens
gcctctgtgct

SEQ ID NO: 6254202 - DNA, 12 bp, Homo sapiens
gcctctgtggaa

SEQ ID NO: 6254203 - DNA, 13 bp, Homo sapiens
gcctctgtggaag

SEQ ID NO: 6254204 - DNA, 21 bp, Homo sapiens
gcctctgtggagccccagcat

SEQ ID NO: 6254205 - DNA, 21 bp, Homo sapiens
gcctctgtgtagccgccctga

SEQ ID NO: 6254206 - DNA, 22 bp, Homo sapiens
gcctctgtgtcactggctgcct

SEQ ID NO: 6254207 - DNA, 14 bp, Homo sapiens
gcctctgtgtcctt

SEQ ID NO: 6254208 - DNA, 23 bp, Homo sapiens
gcctctgttcctttctctgggct

SEQ ID NO: 6254209 - DNA, 22 bp, Homo sapiens
gcctcttaaagctgcctgtagt

SEQ ID NO: 6254210 - DNA, 20 bp, Homo sapiens
gcctcttaacttaaaagaac

SEQ ID NO: 6254211 - DNA, 19 bp, Homo sapiens
gcctcttaccttcccgcct

SEQ ID NO: 6254212 - DNA, 20 bp, Homo sapiens
gcctcttacggtagttagga

SEQ ID NO: 6254213 - DNA, 17 bp, Homo sapiens
gcctcttactaatgtaa

SEQ ID NO: 6254214 - DNA, 20 bp, Homo sapiens
gcctcttaggactggtgcct

SEQ ID NO: 6254215 - DNA, 23 bp, Homo sapiens
gcctcttaggactggtgcctggc

SEQ ID NO: 6254216 - DNA, 14 bp, Homo sapiens
gcctcttagtgatt

SEQ ID NO: 6254217 - DNA, 17 bp, Homo sapiens
gcctcttatgggctggg

SEQ ID NO: 6254218 - DNA, 15 bp, Homo sapiens
gcctcttatgggggt

SEQ ID NO: 6254219 - DNA, 12 bp, Homo sapiens
gcctcttcagca

SEQ ID NO: 6254220 - DNA, 13 bp, Homo sapiens
gcctcttcagccc

SEQ ID NO: 6254221 - DNA, 14 bp, Homo sapiens
gcctcttcaggcct

SEQ ID NO: 6254222 - DNA, 14 bp, Homo sapiens
gcctcttccccctg

SEQ ID NO: 6254223 - DNA, 20 bp, Homo sapiens
gcctcttcccgccgcccagc

SEQ ID NO: 6254224 - DNA, 14 bp, Homo sapiens
gcctcttccctcag

SEQ ID NO: 6254225 - DNA, 16 bp, Homo sapiens
gcctcttcctctgggc

SEQ ID NO: 6254226 - DNA, 18 bp, Homo sapiens
gcctcttcctctgggcag

SEQ ID NO: 6254227 - DNA, 20 bp, Homo sapiens
gcctcttctcctgcagcctg

SEQ ID NO: 6254228 - DNA, 12 bp, Homo sapiens
gcctcttctcta

SEQ ID NO: 6254229 - DNA, 22 bp, Homo sapiens
gcctcttctcttgacagtctga

SEQ ID NO: 6254230 - DNA, 22 bp, Homo sapiens
gcctcttctgaagatggaaggc

SEQ ID NO: 6254231 - DNA, 15 bp, Homo sapiens
gcctcttctgagctt

SEQ ID NO: 6254232 - DNA, 19 bp, Homo sapiens
gcctcttctgccccggagc

SEQ ID NO: 6254233 - DNA, 14 bp, Homo sapiens
gcctcttctgggag

SEQ ID NO: 6254234 - DNA, 15 bp, Homo sapiens
gcctcttctgggagg

SEQ ID NO: 6254235 - DNA, 20 bp, Homo sapiens
gcctcttctgtcccaagtct

SEQ ID NO: 6254236 - DNA, 20 bp, Homo sapiens
gcctcttcttcttcagaaga

SEQ ID NO: 6254237 - DNA, 17 bp, Homo sapiens
gcctcttctttgtgcct

SEQ ID NO: 6254238 - DNA, 18 bp, Homo sapiens
gcctcttctttgtgcctt

SEQ ID NO: 6254239 - DNA, 14 bp, Homo sapiens
gcctcttgaatttt

SEQ ID NO: 6254240 - DNA, 19 bp, Homo sapiens
gcctcttgagcagtggctg

SEQ ID NO: 6254241 - DNA, 20 bp, Homo sapiens
gcctcttgagcagtggctgg

SEQ ID NO: 6254242 - DNA, 19 bp, Homo sapiens
gcctcttgagttcctctgc

SEQ ID NO: 6254243 - DNA, 21 bp, Homo sapiens
gcctcttgagttcctctgcag

SEQ ID NO: 6254244 - DNA, 22 bp, Homo sapiens
gcctcttgagttcctctgcagt

SEQ ID NO: 6254245 - DNA, 24 bp, Homo sapiens
gcctcttgagttcctctgcagttt

SEQ ID NO: 6254246 - DNA, 16 bp, Homo sapiens
gcctcttgcagggtct

SEQ ID NO: 6254247 - DNA, 15 bp, Homo sapiens
gcctcttggaaatca

SEQ ID NO: 6254248 - DNA, 19 bp, Homo sapiens
gcctcttggacctctgctc

SEQ ID NO: 6254249 - DNA, 23 bp, Homo sapiens
gcctcttggataccagctcaggg

SEQ ID NO: 6254250 - DNA, 12 bp, Homo sapiens
gcctcttggcac

SEQ ID NO: 6254251 - DNA, 20 bp, Homo sapiens
gcctcttggcttctcagccc

SEQ ID NO: 6254252 - DNA, 16 bp, Homo sapiens
gcctcttgggagacgt

SEQ ID NO: 6254253 - DNA, 20 bp, Homo sapiens
gcctcttggggaaggggcac

SEQ ID NO: 6254254 - DNA, 14 bp, Homo sapiens
gcctcttgggttca

SEQ ID NO: 6254255 - DNA, 17 bp, Homo sapiens
gcctcttgtaaagactg

SEQ ID NO: 6254256 - DNA, 18 bp, Homo sapiens
gcctcttgtaaagactgg

SEQ ID NO: 6254257 - DNA, 23 bp, Homo sapiens
gcctcttgtatccctagtgctcc

SEQ ID NO: 6254258 - DNA, 23 bp, Homo sapiens
gcctcttgtcttcctatttcaga

SEQ ID NO: 6254259 - DNA, 13 bp, Homo sapiens
gcctcttgttgca

SEQ ID NO: 6254260 - DNA, 15 bp, Homo sapiens
gcctcttgtttctgt

SEQ ID NO: 6254261 - DNA, 18 bp, Homo sapiens
gcctcttgtttctgtgcc

SEQ ID NO: 6254262 - DNA, 19 bp, Homo sapiens
gcctcttgtttctgtgccc

SEQ ID NO: 6254263 - DNA, 12 bp, Homo sapiens
gcctctttaaat

SEQ ID NO: 6254264 - DNA, 13 bp, Homo sapiens
gcctctttaaatt

SEQ ID NO: 6254265 - DNA, 15 bp, Homo sapiens
gcctctttaaattat

SEQ ID NO: 6254266 - DNA, 17 bp, Homo sapiens
gcctctttcccttccag

SEQ ID NO: 6254267 - DNA, 20 bp, Homo sapiens
gcctctttcctaacttcctt

SEQ ID NO: 6254268 - DNA, 18 bp, Homo sapiens
gcctctttgccccgactc

SEQ ID NO: 6254269 - DNA, 15 bp, Homo sapiens
gcctctttgctgctt

SEQ ID NO: 6254270 - DNA, 19 bp, Homo sapiens
gcctcttttacctgctgct

SEQ ID NO: 6254271 - DNA, 22 bp, Homo sapiens
gcctcttttacctgctgcttct

SEQ ID NO: 6254272 - DNA, 16 bp, Homo sapiens
gcctcttttcacattt

SEQ ID NO: 6254273 - DNA, 23 bp, Homo sapiens
gcctcttttcacattttttttct

SEQ ID NO: 6254274 - DNA, 21 bp, Homo sapiens
gcctcttttcagtagtgagca

SEQ ID NO: 6254275 - DNA, 19 bp, Homo sapiens
gcctcttttcctgaagaaa

SEQ ID NO: 6254276 - DNA, 15 bp, Homo sapiens
gcctctttttccttc

SEQ ID NO: 6254277 - DNA, 20 bp, Homo sapiens
gcctgaaaaggaaggaccag

SEQ ID NO: 6254278 - DNA, 16 bp, Homo sapiens
gcctgaaaagggcgga

SEQ ID NO: 6254279 - DNA, 14 bp, Homo sapiens
gcctgaaaattcca

SEQ ID NO: 6254280 - DNA, 23 bp, Homo sapiens
gcctgaaagaggctgaggcctgg

SEQ ID NO: 6254281 - DNA, 17 bp, Homo sapiens
gcctgaaagcaacagct

SEQ ID NO: 6254282 - DNA, 17 bp, Homo sapiens
gcctgaaagctgggagc

SEQ ID NO: 6254283 - DNA, 19 bp, Homo sapiens
gcctgaaagtaatttcaag

SEQ ID NO: 6254284 - DNA, 19 bp, Homo sapiens
gcctgaaatgacatttcac

SEQ ID NO: 6254285 - DNA, 20 bp, Homo sapiens
gcctgaaatgacatttcact

SEQ ID NO: 6254286 - DNA, 22 bp, Homo sapiens
gcctgaaatgacatttcactaa

SEQ ID NO: 6254287 - DNA, 18 bp, Homo sapiens
gcctgaaatttcaccatt

SEQ ID NO: 6254288 - DNA, 18 bp, Homo sapiens
gcctgaacagatgtaaat

SEQ ID NO: 6254289 - DNA, 14 bp, Homo sapiens
gcctgaacatcctt

SEQ ID NO: 6254290 - DNA, 21 bp, Homo sapiens
gcctgaacatccttccttccc

SEQ ID NO: 6254291 - DNA, 14 bp, Homo sapiens
gcctgaaccttcca

SEQ ID NO: 6254292 - DNA, 18 bp, Homo sapiens
gcctgaactaggtgctgg

SEQ ID NO: 6254293 - DNA, 20 bp, Homo sapiens
gcctgaactaggtgctggca

SEQ ID NO: 6254294 - DNA, 23 bp, Homo sapiens
gcctgaactaggtgctggcatgt

SEQ ID NO: 6254295 - DNA, 14 bp, Homo sapiens
gcctgaactgaggc

SEQ ID NO: 6254296 - DNA, 20 bp, Homo sapiens
gcctgaactgaggccttgtg

SEQ ID NO: 6254297 - DNA, 16 bp, Homo sapiens
gcctgaagaccccaga

SEQ ID NO: 6254298 - DNA, 17 bp, Homo sapiens
gcctgaagagtttgtaa

SEQ ID NO: 6254299 - DNA, 18 bp, Homo sapiens
gcctgaagagtttgtaaa

SEQ ID NO: 6254300 - DNA, 19 bp, Homo sapiens
gcctgaagatcagagctgc

SEQ ID NO: 6254301 - DNA, 16 bp, Homo sapiens
gcctgaagcaactgaa

SEQ ID NO: 6254302 - DNA, 16 bp, Homo sapiens
gcctgaagccagctgc

SEQ ID NO: 6254303 - DNA, 13 bp, Homo sapiens
gcctgaagcctgg

SEQ ID NO: 6254304 - DNA, 12 bp, Homo sapiens
gcctgaaggatt

SEQ ID NO: 6254305 - DNA, 18 bp, Homo sapiens
gcctgaagggcctcccag

SEQ ID NO: 6254306 - DNA, 15 bp, Homo sapiens
gcctgaagtcacaca

SEQ ID NO: 6254307 - DNA, 16 bp, Homo sapiens
gcctgaagtcacacag

SEQ ID NO: 6254308 - DNA, 18 bp, Homo sapiens
gcctgaataaaccaagac

SEQ ID NO: 6254309 - DNA, 23 bp, Homo sapiens
gcctgaataaagagccctaagtt

SEQ ID NO: 6254310 - DNA, 23 bp, Homo sapiens
gcctgaatcatgagcctgctgga

SEQ ID NO: 6254311 - DNA, 19 bp, Homo sapiens
gcctgaattgctttctgct

SEQ ID NO: 6254312 - DNA, 14 bp, Homo sapiens
gcctgacaacagcc

SEQ ID NO: 6254313 - DNA, 16 bp, Homo sapiens
gcctgacaaggccagc

SEQ ID NO: 6254314 - DNA, 22 bp, Homo sapiens
gcctgacacaatggtagctctg

SEQ ID NO: 6254315 - DNA, 15 bp, Homo sapiens
gcctgacacaggcca

SEQ ID NO: 6254316 - DNA, 21 bp, Homo sapiens
gcctgacacaggggacactga

SEQ ID NO: 6254317 - DNA, 22 bp, Homo sapiens
gcctgacacaggggacactgaa

SEQ ID NO: 6254318 - DNA, 20 bp, Homo sapiens
gcctgacaccacgctggagc

SEQ ID NO: 6254319 - DNA, 16 bp, Homo sapiens
gcctgacaccccctcc

SEQ ID NO: 6254320 - DNA, 20 bp, Homo sapiens
gcctgacaccccctccccgc

SEQ ID NO: 6254321 - DNA, 19 bp, Homo sapiens
gcctgacagcatcctctct

SEQ ID NO: 6254322 - DNA, 17 bp, Homo sapiens
gcctgacagccagaact

SEQ ID NO: 6254323 - DNA, 17 bp, Homo sapiens
gcctgacagccttcccc

SEQ ID NO: 6254324 - DNA, 19 bp, Homo sapiens
gcctgacagccttccccag

SEQ ID NO: 6254325 - DNA, 22 bp, Homo sapiens
gcctgacagccttccccagctc

SEQ ID NO: 6254326 - DNA, 13 bp, Homo sapiens
gcctgacagctct

SEQ ID NO: 6254327 - DNA, 14 bp, Homo sapiens
gcctgacagctctg

SEQ ID NO: 6254328 - DNA, 18 bp, Homo sapiens
gcctgacaggttcccagc

SEQ ID NO: 6254329 - DNA, 21 bp, Homo sapiens
gcctgacagtgtgggacaggc

SEQ ID NO: 6254330 - DNA, 22 bp, Homo sapiens
gcctgacatttggagtgttccc

SEQ ID NO: 6254331 - DNA, 21 bp, Homo sapiens
gcctgaccatcccatgagcag

SEQ ID NO: 6254332 - DNA, 17 bp, Homo sapiens
gcctgacccacggggca

SEQ ID NO: 6254333 - DNA, 17 bp, Homo sapiens
gcctgaccccaggcagc

SEQ ID NO: 6254334 - DNA, 23 bp, Homo sapiens
gcctgacccggcccctaccagcc

SEQ ID NO: 6254335 - DNA, 19 bp, Homo sapiens
gcctgacctcaagcaacca

SEQ ID NO: 6254336 - DNA, 13 bp, Homo sapiens
gcctgacctccag

SEQ ID NO: 6254337 - DNA, 14 bp, Homo sapiens
gcctgacctccagt

SEQ ID NO: 6254338 - DNA, 19 bp, Homo sapiens
gcctgacctccagtcctgc

SEQ ID NO: 6254339 - DNA, 14 bp, Homo sapiens
gcctgacctccccc

SEQ ID NO: 6254340 - DNA, 13 bp, Homo sapiens
gcctgacctgaga

SEQ ID NO: 6254341 - DNA, 16 bp, Homo sapiens
gcctgacctggcacag

SEQ ID NO: 6254342 - DNA, 16 bp, Homo sapiens
gcctgaccttggaatc

SEQ ID NO: 6254343 - DNA, 17 bp, Homo sapiens
gcctgacctttgggact

SEQ ID NO: 6254344 - DNA, 14 bp, Homo sapiens
gcctgactagaact

SEQ ID NO: 6254345 - DNA, 22 bp, Homo sapiens
gcctgactagaactcctgtctt

SEQ ID NO: 6254346 - DNA, 18 bp, Homo sapiens
gcctgactaggaaaagtt

SEQ ID NO: 6254347 - DNA, 15 bp, Homo sapiens
gcctgactcccatgc

SEQ ID NO: 6254348 - DNA, 13 bp, Homo sapiens
gcctgactctgtg

SEQ ID NO: 6254349 - DNA, 20 bp, Homo sapiens
gcctgactctgtgctgagca

SEQ ID NO: 6254350 - DNA, 18 bp, Homo sapiens
gcctgactgcacacagct

SEQ ID NO: 6254351 - DNA, 14 bp, Homo sapiens
gcctgactgccaag

SEQ ID NO: 6254352 - DNA, 16 bp, Homo sapiens
gcctgactgccaagcc

SEQ ID NO: 6254353 - DNA, 17 bp, Homo sapiens
gcctgactgccaagcca

SEQ ID NO: 6254354 - DNA, 13 bp, Homo sapiens
gcctgactgctcg

SEQ ID NO: 6254355 - DNA, 19 bp, Homo sapiens
gcctgactggttgtcagaa

SEQ ID NO: 6254356 - DNA, 16 bp, Homo sapiens
gcctgacttgagccac

SEQ ID NO: 6254357 - DNA, 18 bp, Homo sapiens
gcctgacttgagccactc

SEQ ID NO: 6254358 - DNA, 14 bp, Homo sapiens
gcctgacttttaca

SEQ ID NO: 6254359 - DNA, 22 bp, Homo sapiens
gcctgacttttacagcttttct

SEQ ID NO: 6254360 - DNA, 18 bp, Homo sapiens
gcctgagaagaagtggct

SEQ ID NO: 6254361 - DNA, 19 bp, Homo sapiens
gcctgagaagaagtggctg

SEQ ID NO: 6254362 - DNA, 22 bp, Homo sapiens
gcctgagaagagagatcaaatg

SEQ ID NO: 6254363 - DNA, 13 bp, Homo sapiens
gcctgagaagggg

SEQ ID NO: 6254364 - DNA, 18 bp, Homo sapiens
gcctgagaatgagtggga

SEQ ID NO: 6254365 - DNA, 19 bp, Homo sapiens
gcctgagaatgagtgggaa

SEQ ID NO: 6254366 - DNA, 18 bp, Homo sapiens
gcctgagaatgcctaggc

SEQ ID NO: 6254367 - DNA, 19 bp, Homo sapiens
gcctgagaattgaggggag

SEQ ID NO: 6254368 - DNA, 22 bp, Homo sapiens
gcctgagaattgaggggaggtg

SEQ ID NO: 6254369 - DNA, 22 bp, Homo sapiens
gcctgagaatttaatttttaaa

SEQ ID NO: 6254370 - DNA, 13 bp, Homo sapiens
gcctgagaccagg

SEQ ID NO: 6254371 - DNA, 14 bp, Homo sapiens
gcctgagaccaggg

SEQ ID NO: 6254372 - DNA, 19 bp, Homo sapiens
gcctgagaccagggtggcc

SEQ ID NO: 6254373 - DNA, 21 bp, Homo sapiens
gcctgagaccagggtggccac

SEQ ID NO: 6254374 - DNA, 22 bp, Homo sapiens
gcctgagaccagggtggccaca

SEQ ID NO: 6254375 - DNA, 13 bp, Homo sapiens
gcctgagacccag

SEQ ID NO: 6254376 - DNA, 16 bp, Homo sapiens
gcctgagacccaggac

SEQ ID NO: 6254377 - DNA, 17 bp, Homo sapiens
gcctgagacccaggact

SEQ ID NO: 6254378 - DNA, 22 bp, Homo sapiens
gcctgagactggaaaaggtgga

SEQ ID NO: 6254379 - DNA, 13 bp, Homo sapiens
gcctgagaggcag

SEQ ID NO: 6254380 - DNA, 19 bp, Homo sapiens
gcctgagaggcaggcatag

SEQ ID NO: 6254381 - DNA, 21 bp, Homo sapiens
gcctgagagtatttaggcaga

SEQ ID NO: 6254382 - DNA, 14 bp, Homo sapiens
gcctgagatgcctg

SEQ ID NO: 6254383 - DNA, 22 bp, Homo sapiens
gcctgagattctttaaggagat

SEQ ID NO: 6254384 - DNA, 23 bp, Homo sapiens
gcctgagatttcatctgctctcc

SEQ ID NO: 6254385 - DNA, 18 bp, Homo sapiens
gcctgagcacctcccagc

SEQ ID NO: 6254386 - DNA, 13 bp, Homo sapiens
gcctgagcaggca

SEQ ID NO: 6254387 - DNA, 15 bp, Homo sapiens
gcctgagcaggcagg

SEQ ID NO: 6254388 - DNA, 16 bp, Homo sapiens
gcctgagcaggcaggg

SEQ ID NO: 6254389 - DNA, 22 bp, Homo sapiens
gcctgagcaggcaggggcttgg

SEQ ID NO: 6254390 - DNA, 18 bp, Homo sapiens
gcctgagcagtccttggc

SEQ ID NO: 6254391 - DNA, 19 bp, Homo sapiens
gcctgagcagtccttggcc

SEQ ID NO: 6254392 - DNA, 23 bp, Homo sapiens
gcctgagcagtccttggcctgct

SEQ ID NO: 6254393 - DNA, 13 bp, Homo sapiens
gcctgagccacag

SEQ ID NO: 6254394 - DNA, 22 bp, Homo sapiens
gcctgagccacagtggggccca

SEQ ID NO: 6254395 - DNA, 14 bp, Homo sapiens
gcctgagcccagga

SEQ ID NO: 6254396 - DNA, 20 bp, Homo sapiens
gcctgagcccagggaggccg

SEQ ID NO: 6254397 - DNA, 19 bp, Homo sapiens
gcctgagccccaacaactt

SEQ ID NO: 6254398 - DNA, 13 bp, Homo sapiens
gcctgagccccct

SEQ ID NO: 6254399 - DNA, 15 bp, Homo sapiens
gcctgagccccctga

SEQ ID NO: 6254400 - DNA, 21 bp, Homo sapiens
gcctgagcccctttgcctgtc

SEQ ID NO: 6254401 - DNA, 10 bp, Homo sapiens
gcctgagcct

SEQ ID NO: 6254402 - DNA, 19 bp, Homo sapiens
gatgcaagtgtttctgttc

SEQ ID NO: 6254403 - DNA, 21 bp, Homo sapiens
gatgcaagtgtttctgttctg

SEQ ID NO: 6254404 - DNA, 13 bp, Homo sapiens
gatgcaataaaca

SEQ ID NO: 6254405 - DNA, 18 bp, Homo sapiens
gatgcaatatatccccac

SEQ ID NO: 6254406 - DNA, 21 bp, Homo sapiens
gatgcaatcggtttaaacatg

SEQ ID NO: 6254407 - DNA, 19 bp, Homo sapiens
gatgcaatcttggctcact

SEQ ID NO: 6254408 - DNA, 18 bp, Homo sapiens
gatgcaattgctcccatc

SEQ ID NO: 6254409 - DNA, 15 bp, Homo sapiens
gatgcacagagaagc

SEQ ID NO: 6254410 - DNA, 21 bp, Homo sapiens
gatgcacagagttgttacatt

SEQ ID NO: 6254411 - DNA, 14 bp, Homo sapiens
gatgcacagtatct

SEQ ID NO: 6254412 - DNA, 18 bp, Homo sapiens
gatgcacagtatctgctg

SEQ ID NO: 6254413 - DNA, 19 bp, Homo sapiens
gatgcacagtatctgctgt

SEQ ID NO: 6254414 - DNA, 21 bp, Homo sapiens
gatgcacagtatctgctgttc

SEQ ID NO: 6254415 - DNA, 18 bp, Homo sapiens
gatgcacagtgcctgatg

SEQ ID NO: 6254416 - DNA, 22 bp, Homo sapiens
gatgcacatgttggaggagaga

SEQ ID NO: 6254417 - DNA, 16 bp, Homo sapiens
gatgcacatttctgga

SEQ ID NO: 6254418 - DNA, 19 bp, Homo sapiens
gatgcacggcggcagggtg

SEQ ID NO: 6254419 - DNA, 19 bp, Homo sapiens
gatgcacggtttctgttct

SEQ ID NO: 6254420 - DNA, 20 bp, Homo sapiens
gatgcacggtttctgttctg

SEQ ID NO: 6254421 - DNA, 21 bp, Homo sapiens
gatgcacggtttctgttctgc

SEQ ID NO: 6254422 - DNA, 19 bp, Homo sapiens
gatgcacgtggggcccact

SEQ ID NO: 6254423 - DNA, 23 bp, Homo sapiens
gatgcacgtggggcccactgctc

SEQ ID NO: 6254424 - DNA, 22 bp, Homo sapiens
gatgcactatatgtttacacaa

SEQ ID NO: 6254425 - DNA, 18 bp, Homo sapiens
gatgcactcgcactgcaa

SEQ ID NO: 6254426 - DNA, 21 bp, Homo sapiens
gatgcactgaaaacttagcca

SEQ ID NO: 6254427 - DNA, 15 bp, Homo sapiens
gatgcacttcaaatt

SEQ ID NO: 6254428 - DNA, 22 bp, Homo sapiens
gatgcacttcaaattcaaataa

SEQ ID NO: 6254429 - DNA, 12 bp, Homo sapiens
gatgcagaactt

SEQ ID NO: 6254430 - DNA, 22 bp, Homo sapiens
gatgcagaggcctgcagggcct

SEQ ID NO: 6254431 - DNA, 12 bp, Homo sapiens
gatgcagagggg

SEQ ID NO: 6254432 - DNA, 16 bp, Homo sapiens
gatgcagagtaagtat

SEQ ID NO: 6254433 - DNA, 19 bp, Homo sapiens
gatgcagcacctctcagga

SEQ ID NO: 6254434 - DNA, 12 bp, Homo sapiens
gatgcagcattt

SEQ ID NO: 6254435 - DNA, 15 bp, Homo sapiens
gatgcagcatttgat

SEQ ID NO: 6254436 - DNA, 21 bp, Homo sapiens
gatgcagcattttgtatttgt

SEQ ID NO: 6254437 - DNA, 20 bp, Homo sapiens
gatgcagccgccttccttga

SEQ ID NO: 6254438 - DNA, 12 bp, Homo sapiens
gatgcagcctca

SEQ ID NO: 6254439 - DNA, 23 bp, Homo sapiens
gatgcagcggcgtgaggcctggg

SEQ ID NO: 6254440 - DNA, 15 bp, Homo sapiens
gatgcagctactgga

SEQ ID NO: 6254441 - DNA, 13 bp, Homo sapiens
gatgcaggacagg

SEQ ID NO: 6254442 - DNA, 16 bp, Homo sapiens
gatgcaggacaggagg

SEQ ID NO: 6254443 - DNA, 17 bp, Homo sapiens
gatgcaggacaggaggc

SEQ ID NO: 6254444 - DNA, 22 bp, Homo sapiens
gatgcaggatttgttctctgtc

SEQ ID NO: 6254445 - DNA, 21 bp, Homo sapiens
gatgcaggcacttattgtaaa

SEQ ID NO: 6254446 - DNA, 22 bp, Homo sapiens
gatgcaggcacttattgtaaat

SEQ ID NO: 6254447 - DNA, 12 bp, Homo sapiens
gatgcaggctcc

SEQ ID NO: 6254448 - DNA, 20 bp, Homo sapiens
gatgcaggctcccctgagga

SEQ ID NO: 6254449 - DNA, 14 bp, Homo sapiens
gatgcagggcagtc

SEQ ID NO: 6254450 - DNA, 15 bp, Homo sapiens
gatgcagggcagtca

SEQ ID NO: 6254451 - DNA, 23 bp, Homo sapiens
gatgcaggtcagcccatggaggc

SEQ ID NO: 6254452 - DNA, 22 bp, Homo sapiens
gatgcaggtggatctccttgag

SEQ ID NO: 6254453 - DNA, 20 bp, Homo sapiens
gatgcagtattgagtgttct

SEQ ID NO: 6254454 - DNA, 13 bp, Homo sapiens
gatgcagtctcct

SEQ ID NO: 6254455 - DNA, 21 bp, Homo sapiens
gatgcagtctcctctttaaaa

SEQ ID NO: 6254456 - DNA, 22 bp, Homo sapiens
gatgcagtgccaggaaccctta

SEQ ID NO: 6254457 - DNA, 12 bp, Homo sapiens
gatgcagtgccc

SEQ ID NO: 6254458 - DNA, 20 bp, Homo sapiens
gatgcatacagttttctagc

SEQ ID NO: 6254459 - DNA, 18 bp, Homo sapiens
gatgcatatagacacaca

SEQ ID NO: 6254460 - DNA, 19 bp, Homo sapiens
gatgcatatagacacacat

SEQ ID NO: 6254461 - DNA, 13 bp, Homo sapiens
gatgcatcactgg

SEQ ID NO: 6254462 - DNA, 16 bp, Homo sapiens
gatgcatcactgggtg

SEQ ID NO: 6254463 - DNA, 20 bp, Homo sapiens
gatgcatcagaaagggaggg

SEQ ID NO: 6254464 - DNA, 23 bp, Homo sapiens
gatgcatcgggaaagaagaaact

SEQ ID NO: 6254465 - DNA, 12 bp, Homo sapiens
gatgcatgcagg

SEQ ID NO: 6254466 - DNA, 13 bp, Homo sapiens
gatgcatggagat

SEQ ID NO: 6254467 - DNA, 14 bp, Homo sapiens
gatgcatgtctttt

SEQ ID NO: 6254468 - DNA, 21 bp, Homo sapiens
gatgcattcccggtgcagaac

SEQ ID NO: 6254469 - DNA, 15 bp, Homo sapiens
gatgcatttaataaa

SEQ ID NO: 6254470 - DNA, 19 bp, Homo sapiens
gatgcatttaataaagatg

SEQ ID NO: 6254471 - DNA, 21 bp, Homo sapiens
gatgcatttaataaagatgag

SEQ ID NO: 6254472 - DNA, 22 bp, Homo sapiens
gatgcatttaataaagatgagt

SEQ ID NO: 6254473 - DNA, 11 bp, Homo sapiens
gatgcatttca

SEQ ID NO: 6254474 - DNA, 20 bp, Homo sapiens
gatgcatttgggtccaggag

SEQ ID NO: 6254475 - DNA, 19 bp, Homo sapiens
gatgcattttaaatgtcta

SEQ ID NO: 6254476 - DNA, 19 bp, Homo sapiens
gatgccaaagatgtttgaa

SEQ ID NO: 6254477 - DNA, 16 bp, Homo sapiens
gatgccaaagcagaca

SEQ ID NO: 6254478 - DNA, 19 bp, Homo sapiens
gatgccaaagcagacattt

SEQ ID NO: 6254479 - DNA, 16 bp, Homo sapiens
gatgccaaagctgctt

SEQ ID NO: 6254480 - DNA, 17 bp, Homo sapiens
gatgccaaagctgcttt

SEQ ID NO: 6254481 - DNA, 20 bp, Homo sapiens
gatgccaacttcccacacgg

SEQ ID NO: 6254482 - DNA, 21 bp, Homo sapiens
gatgccaacttcccacacggc

SEQ ID NO: 6254483 - DNA, 12 bp, Homo sapiens
gatgccaagctt

SEQ ID NO: 6254484 - DNA, 21 bp, Homo sapiens
gatgccaaggaggtcccagga

SEQ ID NO: 6254485 - DNA, 22 bp, Homo sapiens
gatgccaaggaggtcccaggaa

SEQ ID NO: 6254486 - DNA, 22 bp, Homo sapiens
gatgccacaccaagctgtgcca

SEQ ID NO: 6254487 - DNA, 20 bp, Homo sapiens
gatgccacagccccacagca

SEQ ID NO: 6254488 - DNA, 21 bp, Homo sapiens
gatgccacagccccacagcac

SEQ ID NO: 6254489 - DNA, 19 bp, Homo sapiens
gatgccacgcacttcctct

SEQ ID NO: 6254490 - DNA, 17 bp, Homo sapiens
gatgccacgcctggaag

SEQ ID NO: 6254491 - DNA, 17 bp, Homo sapiens
gatgccagagggccagc

SEQ ID NO: 6254492 - DNA, 18 bp, Homo sapiens
gatgccagagggccagca

SEQ ID NO: 6254493 - DNA, 12 bp, Homo sapiens
gatgccagccaa

SEQ ID NO: 6254494 - DNA, 22 bp, Homo sapiens
gatgccagccaagctctgcagt

SEQ ID NO: 6254495 - DNA, 13 bp, Homo sapiens
gatgccagccctt

SEQ ID NO: 6254496 - DNA, 12 bp, Homo sapiens
gatgccagctgt

SEQ ID NO: 6254497 - DNA, 15 bp, Homo sapiens
gatgccagctgtctc

SEQ ID NO: 6254498 - DNA, 21 bp, Homo sapiens
gatgccagcttctctctccag

SEQ ID NO: 6254499 - DNA, 23 bp, Homo sapiens
gatgccatagcataatatgaagc

SEQ ID NO: 6254500 - DNA, 17 bp, Homo sapiens
gatgccatctgtgtcct

SEQ ID NO: 6254501 - DNA, 18 bp, Homo sapiens
gatgccatctgtgtcctg

SEQ ID NO: 6254502 - DNA, 14 bp, Homo sapiens
gatgccatttgtct

SEQ ID NO: 6254503 - DNA, 20 bp, Homo sapiens
gatgccatttgtcttttgta

SEQ ID NO: 6254504 - DNA, 19 bp, Homo sapiens
gatgcccaaagatgcagcc

SEQ ID NO: 6254505 - DNA, 18 bp, Homo sapiens
gatgcccaatccaggccc

SEQ ID NO: 6254506 - DNA, 17 bp, Homo sapiens
gatgcccacatactgtc

SEQ ID NO: 6254507 - DNA, 19 bp, Homo sapiens
gatgcccaccgaggagccc

SEQ ID NO: 6254508 - DNA, 22 bp, Homo sapiens
gatgcccaccgaggagccccag

SEQ ID NO: 6254509 - DNA, 19 bp, Homo sapiens
gatgcccagagggcccagg

SEQ ID NO: 6254510 - DNA, 14 bp, Homo sapiens
gatgcccagctcag

SEQ ID NO: 6254511 - DNA, 20 bp, Homo sapiens
gatgcccagggccactctgc

SEQ ID NO: 6254512 - DNA, 21 bp, Homo sapiens
gatgcccagggccactctgcc

SEQ ID NO: 6254513 - DNA, 17 bp, Homo sapiens
gatgcccattcctgcct

SEQ ID NO: 6254514 - DNA, 12 bp, Homo sapiens
gatgccccagag

SEQ ID NO: 6254515 - DNA, 13 bp, Homo sapiens
gatgccccaggga

SEQ ID NO: 6254516 - DNA, 13 bp, Homo sapiens
gatgcccccaggc

SEQ ID NO: 6254517 - DNA, 18 bp, Homo sapiens
gatgcccccaggcagcca

SEQ ID NO: 6254518 - DNA, 20 bp, Homo sapiens
gatgcccccaggcagccacc

SEQ ID NO: 6254519 - DNA, 16 bp, Homo sapiens
gatgccccgtccccct

SEQ ID NO: 6254520 - DNA, 21 bp, Homo sapiens
gatgccccgtccccctctggc

SEQ ID NO: 6254521 - DNA, 23 bp, Homo sapiens
gatgcccctgcagtttggccctg

SEQ ID NO: 6254522 - DNA, 19 bp, Homo sapiens
gatgcccctgctccctctg

SEQ ID NO: 6254523 - DNA, 22 bp, Homo sapiens
gatgcccctggccctgcctcac

SEQ ID NO: 6254524 - DNA, 14 bp, Homo sapiens
gatgccccttctcc

SEQ ID NO: 6254525 - DNA, 15 bp, Homo sapiens
gatgccccttctccc

SEQ ID NO: 6254526 - DNA, 13 bp, Homo sapiens
gatgccctcccct

SEQ ID NO: 6254527 - DNA, 16 bp, Homo sapiens
gatgccctcccctcag

SEQ ID NO: 6254528 - DNA, 19 bp, Homo sapiens
gatgccctcccctcagcgc

SEQ ID NO: 6254529 - DNA, 18 bp, Homo sapiens
gatgccctggaggtggct

SEQ ID NO: 6254530 - DNA, 13 bp, Homo sapiens
gatgcccttcccc

SEQ ID NO: 6254531 - DNA, 21 bp, Homo sapiens
gatgcccttgctgggcctggg

SEQ ID NO: 6254532 - DNA, 22 bp, Homo sapiens
gatgccgaacattaggaattgt

SEQ ID NO: 6254533 - DNA, 14 bp, Homo sapiens
gatgccgggcgcca

SEQ ID NO: 6254534 - DNA, 15 bp, Homo sapiens
gatgccgggcgccag

SEQ ID NO: 6254535 - DNA, 15 bp, Homo sapiens
gatgccgtcctgctg

SEQ ID NO: 6254536 - DNA, 16 bp, Homo sapiens
gatgccgtcctgctgg

SEQ ID NO: 6254537 - DNA, 17 bp, Homo sapiens
gatgccgttctgttcca

SEQ ID NO: 6254538 - DNA, 14 bp, Homo sapiens
gatgcctacttttg

SEQ ID NO: 6254539 - DNA, 18 bp, Homo sapiens
gatgcctacttttggcct

SEQ ID NO: 6254540 - DNA, 19 bp, Homo sapiens
gatgcctcaccacacccag

SEQ ID NO: 6254541 - DNA, 12 bp, Homo sapiens
gatgcctcagaa

SEQ ID NO: 6254542 - DNA, 14 bp, Homo sapiens
gatgcctccccaag

SEQ ID NO: 6254543 - DNA, 19 bp, Homo sapiens
gatgcctcccggctttgca

SEQ ID NO: 6254544 - DNA, 18 bp, Homo sapiens
gatgcctccctgaccctg

SEQ ID NO: 6254545 - DNA, 21 bp, Homo sapiens
gatgcctctccccagagcatt

SEQ ID NO: 6254546 - DNA, 17 bp, Homo sapiens
gatgcctcttctacctc

SEQ ID NO: 6254547 - DNA, 13 bp, Homo sapiens
gatgcctgagccc

SEQ ID NO: 6254548 - DNA, 20 bp, Homo sapiens
gatgcctgagccccctgagt

SEQ ID NO: 6254549 - DNA, 15 bp, Homo sapiens
gatgcctgattgcca

SEQ ID NO: 6254550 - DNA, 13 bp, Homo sapiens
gatgcctgcaggc

SEQ ID NO: 6254551 - DNA, 14 bp, Homo sapiens
gatgcctgcaggca

SEQ ID NO: 6254552 - DNA, 18 bp, Homo sapiens
gatgcctgcatgctgaaa

SEQ ID NO: 6254553 - DNA, 13 bp, Homo sapiens
gatgcctgcttga

SEQ ID NO: 6254554 - DNA, 16 bp, Homo sapiens
gatgcctggcctgcca

SEQ ID NO: 6254555 - DNA, 16 bp, Homo sapiens
gatgcctggtgagcag

SEQ ID NO: 6254556 - DNA, 15 bp, Homo sapiens
gatgcctggtggcag

SEQ ID NO: 6254557 - DNA, 20 bp, Homo sapiens
gatgcctgttaatttataat

SEQ ID NO: 6254558 - DNA, 20 bp, Homo sapiens
gatgcctgttttgagaccag

SEQ ID NO: 6254559 - DNA, 23 bp, Homo sapiens
gatgcctttgctgtttagcttcc

SEQ ID NO: 6254560 - DNA, 21 bp, Homo sapiens
gatgcgaaaacttgaatctgt

SEQ ID NO: 6254561 - DNA, 17 bp, Homo sapiens
gatgcgagcttggcctt

SEQ ID NO: 6254562 - DNA, 14 bp, Homo sapiens
gatgcgaggctcgg

SEQ ID NO: 6254563 - DNA, 19 bp, Homo sapiens
gatgcgcagccccatctgt

SEQ ID NO: 6254564 - DNA, 14 bp, Homo sapiens
gatgcgcagtgcct

SEQ ID NO: 6254565 - DNA, 13 bp, Homo sapiens
gatgcgccttgct

SEQ ID NO: 6254566 - DNA, 18 bp, Homo sapiens
gatgcggatcctgctggg

SEQ ID NO: 6254567 - DNA, 20 bp, Homo sapiens
gatgcggctttctctgcctc

SEQ ID NO: 6254568 - DNA, 21 bp, Homo sapiens
gatgcggctttctctgcctct

SEQ ID NO: 6254569 - DNA, 23 bp, Homo sapiens
gatgcggctttctctgcctctgg

SEQ ID NO: 6254570 - DNA, 20 bp, Homo sapiens
gatgcgggccagtgctccag

SEQ ID NO: 6254571 - DNA, 16 bp, Homo sapiens
gatgcggtggctcacg

SEQ ID NO: 6254572 - DNA, 21 bp, Homo sapiens
gatgcggtggctcacgcctgt

SEQ ID NO: 6254573 - DNA, 17 bp, Homo sapiens
gatgcgtattctgtggc

SEQ ID NO: 6254574 - DNA, 18 bp, Homo sapiens
gatgcgtattctgtggcc

SEQ ID NO: 6254575 - DNA, 15 bp, Homo sapiens
gatgcgtggctccca

SEQ ID NO: 6254576 - DNA, 14 bp, Homo sapiens
gatgcgtgggaggc

SEQ ID NO: 6254577 - DNA, 15 bp, Homo sapiens
gatgcgtgggaggca

SEQ ID NO: 6254578 - DNA, 18 bp, Homo sapiens
gatgcgttgttacaggaa

SEQ ID NO: 6254579 - DNA, 13 bp, Homo sapiens
gcctgagccttag

SEQ ID NO: 6254580 - DNA, 19 bp, Homo sapiens
gcctgagccttagctccca

SEQ ID NO: 6254581 - DNA, 20 bp, Homo sapiens
gcctgagccttagctcccag

SEQ ID NO: 6254582 - DNA, 23 bp, Homo sapiens
gcctgagccttagctcccagcta

SEQ ID NO: 6254583 - DNA, 15 bp, Homo sapiens
gcctgagctccaccc

SEQ ID NO: 6254584 - DNA, 20 bp, Homo sapiens
gcctgagctccaccctcccc

SEQ ID NO: 6254585 - DNA, 14 bp, Homo sapiens
gcctgagctgcttc

SEQ ID NO: 6254586 - DNA, 15 bp, Homo sapiens
gcctgagctgcttca

SEQ ID NO: 6254587 - DNA, 15 bp, Homo sapiens
gcctgagctggggaa

SEQ ID NO: 6254588 - DNA, 16 bp, Homo sapiens
gcctgaggagcagcag

SEQ ID NO: 6254589 - DNA, 13 bp, Homo sapiens
gcctgaggaggag

SEQ ID NO: 6254590 - DNA, 18 bp, Homo sapiens
gcctgaggcctgtgcctg

SEQ ID NO: 6254591 - DNA, 20 bp, Homo sapiens
gcctgaggcctgtgcctgtc

SEQ ID NO: 6254592 - DNA, 17 bp, Homo sapiens
gcctgaggctgagactg

SEQ ID NO: 6254593 - DNA, 19 bp, Homo sapiens
gcctgaggctggctggggg

SEQ ID NO: 6254594 - DNA, 14 bp, Homo sapiens
gcctgaggctggga

SEQ ID NO: 6254595 - DNA, 13 bp, Homo sapiens
gcctgaggctgta

SEQ ID NO: 6254596 - DNA, 10 bp, Homo sapiens
gcctgaggga

SEQ ID NO: 6254597 - DNA, 17 bp, Homo sapiens
gcctgagggaaaggcca

SEQ ID NO: 6254598 - DNA, 18 bp, Homo sapiens
gcctgagggaaaggccag

SEQ ID NO: 6254599 - DNA, 19 bp, Homo sapiens
gcctgagggaagcccaccc

SEQ ID NO: 6254600 - DNA, 20 bp, Homo sapiens
gcctgagggaagcccacccg

SEQ ID NO: 6254601 - DNA, 18 bp, Homo sapiens
gcctgagggcccctctgc

SEQ ID NO: 6254602 - DNA, 20 bp, Homo sapiens
gcctgagggcccctctgccc

SEQ ID NO: 6254603 - DNA, 20 bp, Homo sapiens
gcctgaggggaaagagagat

SEQ ID NO: 6254604 - DNA, 14 bp, Homo sapiens
gcctgaggggcaga

SEQ ID NO: 6254605 - DNA, 16 bp, Homo sapiens
gcctgagggtccacct

SEQ ID NO: 6254606 - DNA, 19 bp, Homo sapiens
gcctgagggtccacctgga

SEQ ID NO: 6254607 - DNA, 21 bp, Homo sapiens
gcctgagggtccacctggaga

SEQ ID NO: 6254608 - DNA, 12 bp, Homo sapiens
gcctgagggtgg

SEQ ID NO: 6254609 - DNA, 13 bp, Homo sapiens
gcctgaggtcaat

SEQ ID NO: 6254610 - DNA, 21 bp, Homo sapiens
gcctgaggtcaggagttcaag

SEQ ID NO: 6254611 - DNA, 17 bp, Homo sapiens
gcctgaggtccgatggc

SEQ ID NO: 6254612 - DNA, 21 bp, Homo sapiens
gcctgaggtctcgctgatgct

SEQ ID NO: 6254613 - DNA, 19 bp, Homo sapiens
gcctgaggtctggctgctt

SEQ ID NO: 6254614 - DNA, 20 bp, Homo sapiens
gcctgaggtctggctgcttg

SEQ ID NO: 6254615 - DNA, 14 bp, Homo sapiens
gcctgaggtgccca

SEQ ID NO: 6254616 - DNA, 19 bp, Homo sapiens
gcctgaggtgcccactccg

SEQ ID NO: 6254617 - DNA, 13 bp, Homo sapiens
gcctgagtactcc

SEQ ID NO: 6254618 - DNA, 21 bp, Homo sapiens
gcctgagtagaaaggccttta

SEQ ID NO: 6254619 - DNA, 13 bp, Homo sapiens
gcctgagtcacct

SEQ ID NO: 6254620 - DNA, 22 bp, Homo sapiens
gcctgagtcagggcccagaggc

SEQ ID NO: 6254621 - DNA, 15 bp, Homo sapiens
gcctgagtcagtgct

SEQ ID NO: 6254622 - DNA, 23 bp, Homo sapiens
gcctgagtcagtgctctcagctg

SEQ ID NO: 6254623 - DNA, 14 bp, Homo sapiens
gcctgagtcctggt

SEQ ID NO: 6254624 - DNA, 22 bp, Homo sapiens
gcctgagtcctggtccctctga

SEQ ID NO: 6254625 - DNA, 23 bp, Homo sapiens
gcctgagtcctggtccctctgag

SEQ ID NO: 6254626 - DNA, 20 bp, Homo sapiens
gcctgagtcgtgacctgcta

SEQ ID NO: 6254627 - DNA, 23 bp, Homo sapiens
gcctgagtcgtgacctgctaggc

SEQ ID NO: 6254628 - DNA, 22 bp, Homo sapiens
gcctgagtgacctccttctgca

SEQ ID NO: 6254629 - DNA, 22 bp, Homo sapiens
gcctgagtgagaggggaggcca

SEQ ID NO: 6254630 - DNA, 23 bp, Homo sapiens
gcctgagtgcaccaccctttgaa

SEQ ID NO: 6254631 - DNA, 13 bp, Homo sapiens
gcctgagtggtga

SEQ ID NO: 6254632 - DNA, 20 bp, Homo sapiens
gcctgataagcttcaaagct

SEQ ID NO: 6254633 - DNA, 14 bp, Homo sapiens
gcctgatactttag

SEQ ID NO: 6254634 - DNA, 14 bp, Homo sapiens
gcctgatataaatg

SEQ ID NO: 6254635 - DNA, 16 bp, Homo sapiens
gcctgatctctgctcc

SEQ ID NO: 6254636 - DNA, 15 bp, Homo sapiens
gcctgatctgcccat

SEQ ID NO: 6254637 - DNA, 15 bp, Homo sapiens
gcctgatcttgcctg

SEQ ID NO: 6254638 - DNA, 21 bp, Homo sapiens
gcctgatctttgggcatcaga

SEQ ID NO: 6254639 - DNA, 12 bp, Homo sapiens
gcctgatgacag

SEQ ID NO: 6254640 - DNA, 20 bp, Homo sapiens
gcctgatgagatttttaaaa

SEQ ID NO: 6254641 - DNA, 14 bp, Homo sapiens
gcctgatgctccct

SEQ ID NO: 6254642 - DNA, 16 bp, Homo sapiens
gcctgatgctccctcc

SEQ ID NO: 6254643 - DNA, 17 bp, Homo sapiens
gcctgatggagaggaga

SEQ ID NO: 6254644 - DNA, 17 bp, Homo sapiens
gcctgatggccaagggg

SEQ ID NO: 6254645 - DNA, 20 bp, Homo sapiens
gcctgatgggagtaggctcc

SEQ ID NO: 6254646 - DNA, 20 bp, Homo sapiens
gcctgatggtatactactgc

SEQ ID NO: 6254647 - DNA, 13 bp, Homo sapiens
gcctgattaaaga

SEQ ID NO: 6254648 - DNA, 20 bp, Homo sapiens
gcctgattcggacggccaat

SEQ ID NO: 6254649 - DNA, 20 bp, Homo sapiens
gcctgattcggctgtctcag

SEQ ID NO: 6254650 - DNA, 23 bp, Homo sapiens
gcctgattctcgcgattattctc

SEQ ID NO: 6254651 - DNA, 15 bp, Homo sapiens
gcctgattggggcct

SEQ ID NO: 6254652 - DNA, 20 bp, Homo sapiens
gcctgattggggcctcaccc

SEQ ID NO: 6254653 - DNA, 16 bp, Homo sapiens
gcctgcaaacctgctg

SEQ ID NO: 6254654 - DNA, 21 bp, Homo sapiens
gcctgcaaacctgctggtggg

SEQ ID NO: 6254655 - DNA, 19 bp, Homo sapiens
gcctgcaaaccttcctggg

SEQ ID NO: 6254656 - DNA, 19 bp, Homo sapiens
gcctgcaaacgctgcctgc

SEQ ID NO: 6254657 - DNA, 21 bp, Homo sapiens
gcctgcaaactcactgctcaa

SEQ ID NO: 6254658 - DNA, 14 bp, Homo sapiens
gcctgcaagagaat

SEQ ID NO: 6254659 - DNA, 16 bp, Homo sapiens
gcctgcacaataaaaa

SEQ ID NO: 6254660 - DNA, 18 bp, Homo sapiens
gcctgcacacacctgcct

SEQ ID NO: 6254661 - DNA, 19 bp, Homo sapiens
gcctgcacacacctgcctg

SEQ ID NO: 6254662 - DNA, 21 bp, Homo sapiens
gcctgcacacagagtgaggga

SEQ ID NO: 6254663 - DNA, 12 bp, Homo sapiens
gcctgcacagat

SEQ ID NO: 6254664 - DNA, 12 bp, Homo sapiens
gcctgcaccagg

SEQ ID NO: 6254665 - DNA, 21 bp, Homo sapiens
gcctgcaccaggagacagaca

SEQ ID NO: 6254666 - DNA, 22 bp, Homo sapiens
gcctgcaccctcttctcctctg

SEQ ID NO: 6254667 - DNA, 20 bp, Homo sapiens
gcctgcacccttccacagct

SEQ ID NO: 6254668 - DNA, 15 bp, Homo sapiens
gcctgcacccttccc

SEQ ID NO: 6254669 - DNA, 22 bp, Homo sapiens
gcctgcaccgacccgaggccca

SEQ ID NO: 6254670 - DNA, 14 bp, Homo sapiens
gcctgcacctgccc

SEQ ID NO: 6254671 - DNA, 15 bp, Homo sapiens
gcctgcacctgcccc

SEQ ID NO: 6254672 - DNA, 17 bp, Homo sapiens
gcctgcactccctggcc

SEQ ID NO: 6254673 - DNA, 15 bp, Homo sapiens
gcctgcactgggaag

SEQ ID NO: 6254674 - DNA, 21 bp, Homo sapiens
gcctgcacttgggggctcagc

SEQ ID NO: 6254675 - DNA, 23 bp, Homo sapiens
gcctgcacttgggggctcagcaa

SEQ ID NO: 6254676 - DNA, 16 bp, Homo sapiens
gcctgcagaatttggg

SEQ ID NO: 6254677 - DNA, 17 bp, Homo sapiens
gcctgcagagagaagcc

SEQ ID NO: 6254678 - DNA, 22 bp, Homo sapiens
gcctgcagagcaggacctggga

SEQ ID NO: 6254679 - DNA, 15 bp, Homo sapiens
gcctgcagagctgcg

SEQ ID NO: 6254680 - DNA, 19 bp, Homo sapiens
gcctgcagaggtctgtgct

SEQ ID NO: 6254681 - DNA, 22 bp, Homo sapiens
gcctgcagcacatgcgggctcg

SEQ ID NO: 6254682 - DNA, 14 bp, Homo sapiens
gcctgcagcaggca

SEQ ID NO: 6254683 - DNA, 16 bp, Homo sapiens
gcctgcagcaggcagc

SEQ ID NO: 6254684 - DNA, 17 bp, Homo sapiens
gcctgcagcaggcagct

SEQ ID NO: 6254685 - DNA, 10 bp, Homo sapiens
gcctgcagcc

SEQ ID NO: 6254686 - DNA, 15 bp, Homo sapiens
gcctgcagccacatg

SEQ ID NO: 6254687 - DNA, 14 bp, Homo sapiens
gcctgcagccaggg

SEQ ID NO: 6254688 - DNA, 16 bp, Homo sapiens
gcctgcagccagggct

SEQ ID NO: 6254689 - DNA, 18 bp, Homo sapiens
gcctgcagccagggctgg

SEQ ID NO: 6254690 - DNA, 19 bp, Homo sapiens
gcctgcagccagggctggg

SEQ ID NO: 6254691 - DNA, 20 bp, Homo sapiens
gcctgcagccagggctgggg

SEQ ID NO: 6254692 - DNA, 21 bp, Homo sapiens
gcctgcagccagggctggggt

SEQ ID NO: 6254693 - DNA, 15 bp, Homo sapiens
gcctgcagcccagaa

SEQ ID NO: 6254694 - DNA, 16 bp, Homo sapiens
gcctgcagcccagaac

SEQ ID NO: 6254695 - DNA, 24 bp, Homo sapiens
gcctgcagcccgtgtccaggagcc

SEQ ID NO: 6254696 - DNA, 13 bp, Homo sapiens
gcctgcagcgagc

SEQ ID NO: 6254697 - DNA, 17 bp, Homo sapiens
gcctgcagcgcctccct

SEQ ID NO: 6254698 - DNA, 13 bp, Homo sapiens
gcctgcagctgag

SEQ ID NO: 6254699 - DNA, 15 bp, Homo sapiens
gcctgcagctgagat

SEQ ID NO: 6254700 - DNA, 13 bp, Homo sapiens
gcctgcaggacct

SEQ ID NO: 6254701 - DNA, 18 bp, Homo sapiens
gcctgcaggacctcgtgc

SEQ ID NO: 6254702 - DNA, 21 bp, Homo sapiens
gcctgcaggacctgcctgtag

SEQ ID NO: 6254703 - DNA, 18 bp, Homo sapiens
gcctgcaggagagagcag

SEQ ID NO: 6254704 - DNA, 24 bp, Homo sapiens
gcctgcaggatctcaccaggcagc

SEQ ID NO: 6254705 - DNA, 19 bp, Homo sapiens
gcctgcaggcagagctgga

SEQ ID NO: 6254706 - DNA, 21 bp, Homo sapiens
gcctgcaggcagagctggagc

SEQ ID NO: 6254707 - DNA, 13 bp, Homo sapiens
gcctgcaggccag

SEQ ID NO: 6254708 - DNA, 21 bp, Homo sapiens
gcctgcaggccagtcccacgg

SEQ ID NO: 6254709 - DNA, 13 bp, Homo sapiens
gcctgcaggcccc

SEQ ID NO: 6254710 - DNA, 15 bp, Homo sapiens
gcctgcaggccccag

SEQ ID NO: 6254711 - DNA, 20 bp, Homo sapiens
gcctgcaggccccagccaag

SEQ ID NO: 6254712 - DNA, 15 bp, Homo sapiens
gcctgcaggctggag

SEQ ID NO: 6254713 - DNA, 20 bp, Homo sapiens
gcctgcagggaagccccaca

SEQ ID NO: 6254714 - DNA, 13 bp, Homo sapiens
gcctgcagggcca

SEQ ID NO: 6254715 - DNA, 14 bp, Homo sapiens
gcctgcagggccat

SEQ ID NO: 6254716 - DNA, 21 bp, Homo sapiens
gcctgcagggcctctgtcaat

SEQ ID NO: 6254717 - DNA, 14 bp, Homo sapiens
gcctgcaggggagc

SEQ ID NO: 6254718 - DNA, 20 bp, Homo sapiens
gcctgcaggggcaaggggct

SEQ ID NO: 6254719 - DNA, 22 bp, Homo sapiens
gcctgcagggtggtgctgggac

SEQ ID NO: 6254720 - DNA, 24 bp, Homo sapiens
gcctgcagggtggtgctgggactg

SEQ ID NO: 6254721 - DNA, 18 bp, Homo sapiens
gcctgcaggtcagttgta

SEQ ID NO: 6254722 - DNA, 17 bp, Homo sapiens
gcctgcagtcctggaag

SEQ ID NO: 6254723 - DNA, 13 bp, Homo sapiens
gcctgcagtggtg

SEQ ID NO: 6254724 - DNA, 22 bp, Homo sapiens
gcctgcagtgtcaaatcgatgg

SEQ ID NO: 6254725 - DNA, 24 bp, Homo sapiens
gcctgcagttaattagcattctgg

SEQ ID NO: 6254726 - DNA, 17 bp, Homo sapiens
gcctgcagtttcttgtg

SEQ ID NO: 6254727 - DNA, 20 bp, Homo sapiens
gcctgcagtttcttgtgtag

SEQ ID NO: 6254728 - DNA, 18 bp, Homo sapiens
gcctgcatctagctggag

SEQ ID NO: 6254729 - DNA, 13 bp, Homo sapiens
gcctgcatgagct

SEQ ID NO: 6254730 - DNA, 18 bp, Homo sapiens
gcctgcatgagctggcaa

SEQ ID NO: 6254731 - DNA, 20 bp, Homo sapiens
gcctgcatgagctggcaacc

SEQ ID NO: 6254732 - DNA, 20 bp, Homo sapiens
gcctgcatggcatcagacta

SEQ ID NO: 6254733 - DNA, 18 bp, Homo sapiens
gcctgcattcgcagcagc

SEQ ID NO: 6254734 - DNA, 12 bp, Homo sapiens
gcctgcattctg

SEQ ID NO: 6254735 - DNA, 14 bp, Homo sapiens
gcctgcatttcctc

SEQ ID NO: 6254736 - DNA, 19 bp, Homo sapiens
gcctgcatttcctcgcagc

SEQ ID NO: 6254737 - DNA, 13 bp, Homo sapiens
gcctgccaaagta

SEQ ID NO: 6254738 - DNA, 17 bp, Homo sapiens
gcctgccaaagtgcctg

SEQ ID NO: 6254739 - DNA, 19 bp, Homo sapiens
gcctgccaaagtgcctggg

SEQ ID NO: 6254740 - DNA, 22 bp, Homo sapiens
gcctgccaaagtgcctgggaag

SEQ ID NO: 6254741 - DNA, 11 bp, Homo sapiens
gcctgccaaga

SEQ ID NO: 6254742 - DNA, 14 bp, Homo sapiens
gcctgccaatgcca

SEQ ID NO: 6254743 - DNA, 21 bp, Homo sapiens
gcctgccaatgccacagccaa

SEQ ID NO: 6254744 - DNA, 22 bp, Homo sapiens
gcctgccaatgccacagccaag

SEQ ID NO: 6254745 - DNA, 16 bp, Homo sapiens
gcctgccaccctcctg

SEQ ID NO: 6254746 - DNA, 16 bp, Homo sapiens
gcctgccaccggaggt

SEQ ID NO: 6254747 - DNA, 13 bp, Homo sapiens
gcctgccacctcc

SEQ ID NO: 6254748 - DNA, 15 bp, Homo sapiens
gcctgccacctggac

SEQ ID NO: 6254749 - DNA, 18 bp, Homo sapiens
gcctgccacctggacccc

SEQ ID NO: 6254750 - DNA, 22 bp, Homo sapiens
gcctgccacctggacccctgca

SEQ ID NO: 6254751 - DNA, 21 bp, Homo sapiens
gcctgccactctcctgaggag

SEQ ID NO: 6254752 - DNA, 14 bp, Homo sapiens
gcctgccactctct

SEQ ID NO: 6254753 - DNA, 16 bp, Homo sapiens
gcctgccactctctgg

SEQ ID NO: 6254754 - DNA, 21 bp, Homo sapiens
gcctgccactctctgggactc

SEQ ID NO: 6254755 - DNA, 11 bp, Homo sapiens
gcctgccagca

SEQ ID NO: 6254756 - DNA, 12 bp, Homo sapiens
gcctgccagcag

SEQ ID NO: 6254757 - DNA, 13 bp, Homo sapiens
gatgctaaaacct

SEQ ID NO: 6254758 - DNA, 14 bp, Homo sapiens
gatgctaaaacctg

SEQ ID NO: 6254759 - DNA, 23 bp, Homo sapiens
gatgctaagagaaaaaaaagact

SEQ ID NO: 6254760 - DNA, 17 bp, Homo sapiens
gatgctaagagtcctgg

SEQ ID NO: 6254761 - DNA, 14 bp, Homo sapiens
gatgctaatcttgt

SEQ ID NO: 6254762 - DNA, 14 bp, Homo sapiens
gatgctaatttatt

SEQ ID NO: 6254763 - DNA, 22 bp, Homo sapiens
gatgctactactgcagtcttta

SEQ ID NO: 6254764 - DNA, 21 bp, Homo sapiens
gatgctagcgcgttgcctgtc

SEQ ID NO: 6254765 - DNA, 20 bp, Homo sapiens
gatgctaggctgtctgcgaa

SEQ ID NO: 6254766 - DNA, 18 bp, Homo sapiens
gatgctatggaacataaa

SEQ ID NO: 6254767 - DNA, 18 bp, Homo sapiens
gatgctatggtcaggtta

SEQ ID NO: 6254768 - DNA, 16 bp, Homo sapiens
gatgctatttcagcca

SEQ ID NO: 6254769 - DNA, 17 bp, Homo sapiens
gatgctatttcagccaa

SEQ ID NO: 6254770 - DNA, 18 bp, Homo sapiens
gatgctatttcagccaat

SEQ ID NO: 6254771 - DNA, 14 bp, Homo sapiens
gatgctcacagggc

SEQ ID NO: 6254772 - DNA, 14 bp, Homo sapiens
gatgctcaggcttg

SEQ ID NO: 6254773 - DNA, 20 bp, Homo sapiens
gatgctcattcatattcctg

SEQ ID NO: 6254774 - DNA, 16 bp, Homo sapiens
gatgctccaagattct

SEQ ID NO: 6254775 - DNA, 20 bp, Homo sapiens
gatgctccctcagcctcaga

SEQ ID NO: 6254776 - DNA, 20 bp, Homo sapiens
gatgctccctcccctgccct

SEQ ID NO: 6254777 - DNA, 23 bp, Homo sapiens
gatgctccctcccctgccctggt

SEQ ID NO: 6254778 - DNA, 15 bp, Homo sapiens
gatgctccgaggact

SEQ ID NO: 6254779 - DNA, 16 bp, Homo sapiens
gatgctccttgggccc

SEQ ID NO: 6254780 - DNA, 14 bp, Homo sapiens
gatgctctcaggct

SEQ ID NO: 6254781 - DNA, 16 bp, Homo sapiens
gatgctctctgaggca

SEQ ID NO: 6254782 - DNA, 14 bp, Homo sapiens
gatgctctttccca

SEQ ID NO: 6254783 - DNA, 18 bp, Homo sapiens
gatgctctttcccaggac

SEQ ID NO: 6254784 - DNA, 19 bp, Homo sapiens
gatgctctttcccaggacg

SEQ ID NO: 6254785 - DNA, 16 bp, Homo sapiens
gatgctctttcccttt

SEQ ID NO: 6254786 - DNA, 21 bp, Homo sapiens
gatgctctttcccttttctgt

SEQ ID NO: 6254787 - DNA, 15 bp, Homo sapiens
gatgctgacatcatt

SEQ ID NO: 6254788 - DNA, 16 bp, Homo sapiens
gatgctgacatcattt

SEQ ID NO: 6254789 - DNA, 22 bp, Homo sapiens
gatgctgacctcacctggtcct

SEQ ID NO: 6254790 - DNA, 12 bp, Homo sapiens
gatgctgagcca

SEQ ID NO: 6254791 - DNA, 13 bp, Homo sapiens
gatgctgagccat

SEQ ID NO: 6254792 - DNA, 16 bp, Homo sapiens
gatgctgagcccggaa

SEQ ID NO: 6254793 - DNA, 12 bp, Homo sapiens
gatgctgaggag

SEQ ID NO: 6254794 - DNA, 18 bp, Homo sapiens
gatgctgaggatgattga

SEQ ID NO: 6254795 - DNA, 14 bp, Homo sapiens
gatgctgaggccac

SEQ ID NO: 6254796 - DNA, 20 bp, Homo sapiens
gatgctgaggccacccactg

SEQ ID NO: 6254797 - DNA, 13 bp, Homo sapiens
gatgctgaggccc

SEQ ID NO: 6254798 - DNA, 18 bp, Homo sapiens
gatgctgatgttcagtgt

SEQ ID NO: 6254799 - DNA, 19 bp, Homo sapiens
gatgctgatgttcagtgta

SEQ ID NO: 6254800 - DNA, 14 bp, Homo sapiens
gatgctgcagcaga

SEQ ID NO: 6254801 - DNA, 19 bp, Homo sapiens
gatgctgccccgttccctg

SEQ ID NO: 6254802 - DNA, 16 bp, Homo sapiens
gatgctgcctgagtca

SEQ ID NO: 6254803 - DNA, 11 bp, Homo sapiens
gatgctgctcc

SEQ ID NO: 6254804 - DNA, 13 bp, Homo sapiens
gatgctgctgaag

SEQ ID NO: 6254805 - DNA, 15 bp, Homo sapiens
gatgctgctggcctc

SEQ ID NO: 6254806 - DNA, 22 bp, Homo sapiens
gatgctgcttccggtagggagg

SEQ ID NO: 6254807 - DNA, 11 bp, Homo sapiens
gatgctgcttt

SEQ ID NO: 6254808 - DNA, 16 bp, Homo sapiens
gatgctggagaagaga

SEQ ID NO: 6254809 - DNA, 16 bp, Homo sapiens
gatgctggatgctcct

SEQ ID NO: 6254810 - DNA, 20 bp, Homo sapiens
gatgctggatgtctgccaat

SEQ ID NO: 6254811 - DNA, 14 bp, Homo sapiens
gatgctggcccagg

SEQ ID NO: 6254812 - DNA, 15 bp, Homo sapiens
gatgctggcccaggg

SEQ ID NO: 6254813 - DNA, 16 bp, Homo sapiens
gatgctggcctcttgg

SEQ ID NO: 6254814 - DNA, 22 bp, Homo sapiens
gatgctggcctcttggcacctg

SEQ ID NO: 6254815 - DNA, 13 bp, Homo sapiens
gatgctgggaccc

SEQ ID NO: 6254816 - DNA, 21 bp, Homo sapiens
gatgctgggcaatgaggcaga

SEQ ID NO: 6254817 - DNA, 12 bp, Homo sapiens
gatgctgggctg

SEQ ID NO: 6254818 - DNA, 22 bp, Homo sapiens
gatgctgggttctggggctgag

SEQ ID NO: 6254819 - DNA, 20 bp, Homo sapiens
gatgctggtaccactggaat

SEQ ID NO: 6254820 - DNA, 18 bp, Homo sapiens
gatgctggtcatcctggg

SEQ ID NO: 6254821 - DNA, 20 bp, Homo sapiens
gatgctgtcactggcagagc

SEQ ID NO: 6254822 - DNA, 21 bp, Homo sapiens
gatgctgtcactggcagagca

SEQ ID NO: 6254823 - DNA, 22 bp, Homo sapiens
gatgctgtcactggcagagcac

SEQ ID NO: 6254824 - DNA, 16 bp, Homo sapiens
gatgctgtcatgtgga

SEQ ID NO: 6254825 - DNA, 22 bp, Homo sapiens
gatgctgtgacaataagtttga

SEQ ID NO: 6254826 - DNA, 21 bp, Homo sapiens
gatgctgtgctacgtgtgaaa

SEQ ID NO: 6254827 - DNA, 16 bp, Homo sapiens
gatgcttacagtgact

SEQ ID NO: 6254828 - DNA, 19 bp, Homo sapiens
gatgcttcatgtgaacgtg

SEQ ID NO: 6254829 - DNA, 23 bp, Homo sapiens
gatgcttctcactgccatgccag

SEQ ID NO: 6254830 - DNA, 17 bp, Homo sapiens
gatgcttcttcagagac

SEQ ID NO: 6254831 - DNA, 21 bp, Homo sapiens
gatgcttcttcagagactcct

SEQ ID NO: 6254832 - DNA, 15 bp, Homo sapiens
gatgcttgatataat

SEQ ID NO: 6254833 - DNA, 21 bp, Homo sapiens
gatgctttaagtgcacaacat

SEQ ID NO: 6254834 - DNA, 18 bp, Homo sapiens
gatgctttgcccaggctt

SEQ ID NO: 6254835 - DNA, 22 bp, Homo sapiens
gatgctttgcccaggcttctca

SEQ ID NO: 6254836 - DNA, 18 bp, Homo sapiens
gatgctttggaagatgca

SEQ ID NO: 6254837 - DNA, 19 bp, Homo sapiens
gatgcttttctctcagcat

SEQ ID NO: 6254838 - DNA, 13 bp, Homo sapiens
gatgcttttgctg

SEQ ID NO: 6254839 - DNA, 17 bp, Homo sapiens
gatgcttttgctgctgc

SEQ ID NO: 6254840 - DNA, 16 bp, Homo sapiens
gatgcttttgtctaat

SEQ ID NO: 6254841 - DNA, 12 bp, Homo sapiens
gatggaaaaaca

SEQ ID NO: 6254842 - DNA, 14 bp, Homo sapiens
gatggaaaaagaat

SEQ ID NO: 6254843 - DNA, 16 bp, Homo sapiens
gatggaaaaataacaa

SEQ ID NO: 6254844 - DNA, 15 bp, Homo sapiens
gatggaaaataaaca

SEQ ID NO: 6254845 - DNA, 18 bp, Homo sapiens
gatggaaaataaacatca

SEQ ID NO: 6254846 - DNA, 16 bp, Homo sapiens
gatggaaactgccaaa

SEQ ID NO: 6254847 - DNA, 23 bp, Homo sapiens
gatggaaactgccaaacctcctg

SEQ ID NO: 6254848 - DNA, 15 bp, Homo sapiens
gatggaaacttcctg

SEQ ID NO: 6254849 - DNA, 15 bp, Homo sapiens
gatggaaagaaagca

SEQ ID NO: 6254850 - DNA, 22 bp, Homo sapiens
gatggaaagaggtgaaaatgaa

SEQ ID NO: 6254851 - DNA, 13 bp, Homo sapiens
gatggaaaggtga

SEQ ID NO: 6254852 - DNA, 20 bp, Homo sapiens
gatggaaataacgggtggca

SEQ ID NO: 6254853 - DNA, 14 bp, Homo sapiens
gatggaacacacac

SEQ ID NO: 6254854 - DNA, 17 bp, Homo sapiens
gatggaacacggccaca

SEQ ID NO: 6254855 - DNA, 17 bp, Homo sapiens
gatggaacatcagtgga

SEQ ID NO: 6254856 - DNA, 22 bp, Homo sapiens
gatggaacccttttggcccccg

SEQ ID NO: 6254857 - DNA, 17 bp, Homo sapiens
gatggaaccgcaggaag

SEQ ID NO: 6254858 - DNA, 20 bp, Homo sapiens
gatggaaccgcaggaagctg

SEQ ID NO: 6254859 - DNA, 21 bp, Homo sapiens
gatggaactgtgtatttattt

SEQ ID NO: 6254860 - DNA, 23 bp, Homo sapiens
gatggaagaaaatggaattactc

SEQ ID NO: 6254861 - DNA, 14 bp, Homo sapiens
gatggaagaaagaa

SEQ ID NO: 6254862 - DNA, 15 bp, Homo sapiens
gatggaagcttccag

SEQ ID NO: 6254863 - DNA, 14 bp, Homo sapiens
gatggaaggagaga

SEQ ID NO: 6254864 - DNA, 17 bp, Homo sapiens
gatggaaggagagaggt

SEQ ID NO: 6254865 - DNA, 23 bp, Homo sapiens
gatggaagtgggccagtcctggt

SEQ ID NO: 6254866 - DNA, 18 bp, Homo sapiens
gatggaatgtgccacctg

SEQ ID NO: 6254867 - DNA, 22 bp, Homo sapiens
gatggaatgtgccacctgtccg

SEQ ID NO: 6254868 - DNA, 15 bp, Homo sapiens
gatggaattcttcct

SEQ ID NO: 6254869 - DNA, 13 bp, Homo sapiens
gatggacaccccc

SEQ ID NO: 6254870 - DNA, 15 bp, Homo sapiens
gatggacacgagcca

SEQ ID NO: 6254871 - DNA, 16 bp, Homo sapiens
gatggacacgagccac

SEQ ID NO: 6254872 - DNA, 18 bp, Homo sapiens
gatggacacgagccacaa

SEQ ID NO: 6254873 - DNA, 19 bp, Homo sapiens
gatggacacgagccacaag

SEQ ID NO: 6254874 - DNA, 17 bp, Homo sapiens
gatggacactaatgcag

SEQ ID NO: 6254875 - DNA, 19 bp, Homo sapiens
gatggacactaatgcagcc

SEQ ID NO: 6254876 - DNA, 15 bp, Homo sapiens
gatggacagaatgat

SEQ ID NO: 6254877 - DNA, 12 bp, Homo sapiens
gatggacagact

SEQ ID NO: 6254878 - DNA, 17 bp, Homo sapiens
gatggacagatggacca

SEQ ID NO: 6254879 - DNA, 21 bp, Homo sapiens
gatggacagatggaccaaaag

SEQ ID NO: 6254880 - DNA, 22 bp, Homo sapiens
gatggacagatggaccaaaaga

SEQ ID NO: 6254881 - DNA, 23 bp, Homo sapiens
gatggacagttcacaccctgcaa

SEQ ID NO: 6254882 - DNA, 13 bp, Homo sapiens
gatggacatcttg

SEQ ID NO: 6254883 - DNA, 20 bp, Homo sapiens
gatggacatgagagtagggc

SEQ ID NO: 6254884 - DNA, 21 bp, Homo sapiens
gatggaccaaaagatgggtgg

SEQ ID NO: 6254885 - DNA, 13 bp, Homo sapiens
gatggaccaaagc

SEQ ID NO: 6254886 - DNA, 19 bp, Homo sapiens
gatggaccaaagccacctg

SEQ ID NO: 6254887 - DNA, 19 bp, Homo sapiens
gatggaccaacctgctctg

SEQ ID NO: 6254888 - DNA, 15 bp, Homo sapiens
gatggaccctcgcag

SEQ ID NO: 6254889 - DNA, 17 bp, Homo sapiens
gatggaccctcgcagca

SEQ ID NO: 6254890 - DNA, 15 bp, Homo sapiens
gatggaccgggtggg

SEQ ID NO: 6254891 - DNA, 21 bp, Homo sapiens
gatggaccgggtgggcctggc

SEQ ID NO: 6254892 - DNA, 14 bp, Homo sapiens
gatggacctcagca

SEQ ID NO: 6254893 - DNA, 19 bp, Homo sapiens
gatggacctcagcaagctg

SEQ ID NO: 6254894 - DNA, 13 bp, Homo sapiens
gatggacctgccc

SEQ ID NO: 6254895 - DNA, 18 bp, Homo sapiens
gatggacgcaggccctgt

SEQ ID NO: 6254896 - DNA, 17 bp, Homo sapiens
gatggacgctgccggga

SEQ ID NO: 6254897 - DNA, 14 bp, Homo sapiens
gatggactcaggat

SEQ ID NO: 6254898 - DNA, 13 bp, Homo sapiens
gatggactcctga

SEQ ID NO: 6254899 - DNA, 16 bp, Homo sapiens
gatggactcctgacca

SEQ ID NO: 6254900 - DNA, 21 bp, Homo sapiens
gatggactgggaaaaacatca

SEQ ID NO: 6254901 - DNA, 19 bp, Homo sapiens
gatggacttgtgattggct

SEQ ID NO: 6254902 - DNA, 20 bp, Homo sapiens
gatggacttgtgattggctg

SEQ ID NO: 6254903 - DNA, 16 bp, Homo sapiens
gatggagaaagaagtg

SEQ ID NO: 6254904 - DNA, 19 bp, Homo sapiens
gatggagaaagaagtggag

SEQ ID NO: 6254905 - DNA, 12 bp, Homo sapiens
gatggagaagga

SEQ ID NO: 6254906 - DNA, 14 bp, Homo sapiens
gatggagaataaat

SEQ ID NO: 6254907 - DNA, 22 bp, Homo sapiens
gatggagactccatgagaagcc

SEQ ID NO: 6254908 - DNA, 16 bp, Homo sapiens
gatggagagaggggaa

SEQ ID NO: 6254909 - DNA, 12 bp, Homo sapiens
gatggagaggaa

SEQ ID NO: 6254910 - DNA, 13 bp, Homo sapiens
gatggagaggaag

SEQ ID NO: 6254911 - DNA, 14 bp, Homo sapiens
gatggagaggaaga

SEQ ID NO: 6254912 - DNA, 16 bp, Homo sapiens
gatggagaggaagaaa

SEQ ID NO: 6254913 - DNA, 15 bp, Homo sapiens
gatggagaggacaga

SEQ ID NO: 6254914 - DNA, 12 bp, Homo sapiens
gatggagaggca

SEQ ID NO: 6254915 - DNA, 15 bp, Homo sapiens
gatggagaggcatgg

SEQ ID NO: 6254916 - DNA, 21 bp, Homo sapiens
gatggagaggcggcctcgtgc

SEQ ID NO: 6254917 - DNA, 19 bp, Homo sapiens
gatggagagtggggagagg

SEQ ID NO: 6254918 - DNA, 22 bp, Homo sapiens
gatggagcaagctcttcccttg

SEQ ID NO: 6254919 - DNA, 22 bp, Homo sapiens
gatggagcagagcaagtctgca

SEQ ID NO: 6254920 - DNA, 20 bp, Homo sapiens
gatggagccagctctgcatt

SEQ ID NO: 6254921 - DNA, 12 bp, Homo sapiens
gatggagcccat

SEQ ID NO: 6254922 - DNA, 15 bp, Homo sapiens
gatggagccccacct

SEQ ID NO: 6254923 - DNA, 23 bp, Homo sapiens
gatggagcccccagatagagctg

SEQ ID NO: 6254924 - DNA, 22 bp, Homo sapiens
gatggagcgcacctgccccctg

SEQ ID NO: 6254925 - DNA, 12 bp, Homo sapiens
gatggagctgat

SEQ ID NO: 6254926 - DNA, 14 bp, Homo sapiens
gatggagctggagg

SEQ ID NO: 6254927 - DNA, 19 bp, Homo sapiens
gatggaggactccaggcag

SEQ ID NO: 6254928 - DNA, 13 bp, Homo sapiens
gatggaggccaga

SEQ ID NO: 6254929 - DNA, 16 bp, Homo sapiens
gatggaggccagagtc

SEQ ID NO: 6254930 - DNA, 17 bp, Homo sapiens
gatggaggccgagccaa

SEQ ID NO: 6254931 - DNA, 14 bp, Homo sapiens
gatggaggctgcag

SEQ ID NO: 6254932 - DNA, 22 bp, Homo sapiens
gatggagggaagacctgaaaga

SEQ ID NO: 6254933 - DNA, 20 bp, Homo sapiens
gatggagggagggggaagtc

SEQ ID NO: 6254934 - DNA, 15 bp, Homo sapiens
gatggagggcttggc

SEQ ID NO: 6254935 - DNA, 18 bp, Homo sapiens
gatggagggcttggccca

SEQ ID NO: 6254936 - DNA, 16 bp, Homo sapiens
gatggaggggagtgtt

SEQ ID NO: 6254937 - DNA, 21 bp, Homo sapiens
gcctgccagcagttactgtga

SEQ ID NO: 6254938 - DNA, 14 bp, Homo sapiens
gcctgccagctgca

SEQ ID NO: 6254939 - DNA, 18 bp, Homo sapiens
gcctgccagctgcactga

SEQ ID NO: 6254940 - DNA, 14 bp, Homo sapiens
gcctgccaggagga

SEQ ID NO: 6254941 - DNA, 21 bp, Homo sapiens
gcctgccaggaggacccaggg

SEQ ID NO: 6254942 - DNA, 14 bp, Homo sapiens
gcctgccagtccta

SEQ ID NO: 6254943 - DNA, 13 bp, Homo sapiens
gcctgccataccg

SEQ ID NO: 6254944 - DNA, 15 bp, Homo sapiens
gcctgccatagccag

SEQ ID NO: 6254945 - DNA, 18 bp, Homo sapiens
gcctgccatagccaggag

SEQ ID NO: 6254946 - DNA, 19 bp, Homo sapiens
gcctgccatagccaggagc

SEQ ID NO: 6254947 - DNA, 16 bp, Homo sapiens
gcctgccatcttctcc

SEQ ID NO: 6254948 - DNA, 20 bp, Homo sapiens
gcctgccatcttctccccga

SEQ ID NO: 6254949 - DNA, 11 bp, Homo sapiens
gcctgccatgg

SEQ ID NO: 6254950 - DNA, 17 bp, Homo sapiens
gcctgccatggctgtga

SEQ ID NO: 6254951 - DNA, 15 bp, Homo sapiens
gcctgccatgggcca

SEQ ID NO: 6254952 - DNA, 16 bp, Homo sapiens
gcctgccatgggccag

SEQ ID NO: 6254953 - DNA, 17 bp, Homo sapiens
gcctgccatgggccagc

SEQ ID NO: 6254954 - DNA, 18 bp, Homo sapiens
gcctgccatgggccagcc

SEQ ID NO: 6254955 - DNA, 22 bp, Homo sapiens
gcctgccatgggccagcctagc

SEQ ID NO: 6254956 - DNA, 17 bp, Homo sapiens
gcctgcccaatgctttg

SEQ ID NO: 6254957 - DNA, 13 bp, Homo sapiens
gcctgcccacctc

SEQ ID NO: 6254958 - DNA, 14 bp, Homo sapiens
gcctgcccacctct

SEQ ID NO: 6254959 - DNA, 17 bp, Homo sapiens
gcctgcccacctctccc

SEQ ID NO: 6254960 - DNA, 18 bp, Homo sapiens
gcctgcccacctgcctgg

SEQ ID NO: 6254961 - DNA, 20 bp, Homo sapiens
gcctgcccacctgcctggcc

SEQ ID NO: 6254962 - DNA, 12 bp, Homo sapiens
gcctgcccagac

SEQ ID NO: 6254963 - DNA, 13 bp, Homo sapiens
gcctgcccagact

SEQ ID NO: 6254964 - DNA, 14 bp, Homo sapiens
gcctgcccagcctc

SEQ ID NO: 6254965 - DNA, 15 bp, Homo sapiens
gcctgcccagcctca

SEQ ID NO: 6254966 - DNA, 12 bp, Homo sapiens
gcctgcccaggc

SEQ ID NO: 6254967 - DNA, 14 bp, Homo sapiens
gcctgcccaggccc

SEQ ID NO: 6254968 - DNA, 19 bp, Homo sapiens
gcctgccccagcctcccag

SEQ ID NO: 6254969 - DNA, 15 bp, Homo sapiens
gcctgccccagctgg

SEQ ID NO: 6254970 - DNA, 21 bp, Homo sapiens
gcctgcccccacacccactcc

SEQ ID NO: 6254971 - DNA, 12 bp, Homo sapiens
gcctgcccccag

SEQ ID NO: 6254972 - DNA, 16 bp, Homo sapiens
gcctgccccccagtct

SEQ ID NO: 6254973 - DNA, 21 bp, Homo sapiens
gcctgccccccagtctcccca

SEQ ID NO: 6254974 - DNA, 15 bp, Homo sapiens
gcctgccccccttcc

SEQ ID NO: 6254975 - DNA, 22 bp, Homo sapiens
gcctgccccccttcccacccct

SEQ ID NO: 6254976 - DNA, 21 bp, Homo sapiens
gcctgccccctatcttgtcct

SEQ ID NO: 6254977 - DNA, 23 bp, Homo sapiens
gcctgccccctatcttgtcctgg

SEQ ID NO: 6254978 - DNA, 13 bp, Homo sapiens
gcctgccccctgg

SEQ ID NO: 6254979 - DNA, 16 bp, Homo sapiens
gcctgccccctgggga

SEQ ID NO: 6254980 - DNA, 22 bp, Homo sapiens
gcctgcccctaccctggacttg

SEQ ID NO: 6254981 - DNA, 16 bp, Homo sapiens
gcctgcccctcccaga

SEQ ID NO: 6254982 - DNA, 23 bp, Homo sapiens
gcctgcccctgctgcttgggacg

SEQ ID NO: 6254983 - DNA, 12 bp, Homo sapiens
gcctgcccctgt

SEQ ID NO: 6254984 - DNA, 15 bp, Homo sapiens
gcctgcccgcacagc

SEQ ID NO: 6254985 - DNA, 17 bp, Homo sapiens
gcctgcccgcacagcag

SEQ ID NO: 6254986 - DNA, 21 bp, Homo sapiens
gcctgcccgcaccctggcctg

SEQ ID NO: 6254987 - DNA, 23 bp, Homo sapiens
gcctgcccgcaccctggcctggt

SEQ ID NO: 6254988 - DNA, 16 bp, Homo sapiens
gcctgcccgcccgccg

SEQ ID NO: 6254989 - DNA, 16 bp, Homo sapiens
gcctgcccgtaaacac

SEQ ID NO: 6254990 - DNA, 22 bp, Homo sapiens
gcctgcccgttgccgggcctgg

SEQ ID NO: 6254991 - DNA, 14 bp, Homo sapiens
gcctgccctcaggg

SEQ ID NO: 6254992 - DNA, 21 bp, Homo sapiens
gcctgccctcatggcccctct

SEQ ID NO: 6254993 - DNA, 17 bp, Homo sapiens
gcctgccctcccacccc

SEQ ID NO: 6254994 - DNA, 15 bp, Homo sapiens
gcctgccctcccatg

SEQ ID NO: 6254995 - DNA, 17 bp, Homo sapiens
gcctgccctccccagag

SEQ ID NO: 6254996 - DNA, 18 bp, Homo sapiens
gcctgccctccccagagc

SEQ ID NO: 6254997 - DNA, 19 bp, Homo sapiens
gcctgccctccccagagca

SEQ ID NO: 6254998 - DNA, 21 bp, Homo sapiens
gcctgccctccccagagcact

SEQ ID NO: 6254999 - DNA, 15 bp, Homo sapiens
gcctgccctcccgca

SEQ ID NO: 6255000 - DNA, 20 bp, Homo sapiens
gcctgccctcccgcaccttc

SEQ ID NO: 6255001 - DNA, 15 bp, Homo sapiens
gcctgccctcctctc

SEQ ID NO: 6255002 - DNA, 17 bp, Homo sapiens
gcctgccctcctctccc

SEQ ID NO: 6255003 - DNA, 16 bp, Homo sapiens
gcctgccctctgcccc

SEQ ID NO: 6255004 - DNA, 18 bp, Homo sapiens
gcctgccctctgccccat

SEQ ID NO: 6255005 - DNA, 23 bp, Homo sapiens
gcctgccctgcccaagtgaccag

SEQ ID NO: 6255006 - DNA, 13 bp, Homo sapiens
gcctgccctgcct

SEQ ID NO: 6255007 - DNA, 14 bp, Homo sapiens
gcctgccctgcctc

SEQ ID NO: 6255008 - DNA, 17 bp, Homo sapiens
gcctgccctgcctcagc

SEQ ID NO: 6255009 - DNA, 22 bp, Homo sapiens
gcctgccctgcctcagccaggc

SEQ ID NO: 6255010 - DNA, 22 bp, Homo sapiens
gcctgccctgccttgccgctcc

SEQ ID NO: 6255011 - DNA, 12 bp, Homo sapiens
gcctgccctgct

SEQ ID NO: 6255012 - DNA, 13 bp, Homo sapiens
gcctgccctgcta

SEQ ID NO: 6255013 - DNA, 16 bp, Homo sapiens
gcctgccctgctattt

SEQ ID NO: 6255014 - DNA, 18 bp, Homo sapiens
gcctgccctgctatttca

SEQ ID NO: 6255015 - DNA, 18 bp, Homo sapiens
gcctgccctggagggagg

SEQ ID NO: 6255016 - DNA, 12 bp, Homo sapiens
gcctgccctggt

SEQ ID NO: 6255017 - DNA, 13 bp, Homo sapiens
gcctgccctgtca

SEQ ID NO: 6255018 - DNA, 19 bp, Homo sapiens
gcctgccctgtcaggaggc

SEQ ID NO: 6255019 - DNA, 13 bp, Homo sapiens
gcctgcccttgtc

SEQ ID NO: 6255020 - DNA, 20 bp, Homo sapiens
gcctgccctttgtcctcctg

SEQ ID NO: 6255021 - DNA, 22 bp, Homo sapiens
gcctgccctttgtcctcctgct

SEQ ID NO: 6255022 - DNA, 17 bp, Homo sapiens
gcctgccgcccccgcct

SEQ ID NO: 6255023 - DNA, 21 bp, Homo sapiens
gcctgccgcccccgcctgggc

SEQ ID NO: 6255024 - DNA, 14 bp, Homo sapiens
gcctgccgctgcag

SEQ ID NO: 6255025 - DNA, 17 bp, Homo sapiens
gcctgccggacacagca

SEQ ID NO: 6255026 - DNA, 12 bp, Homo sapiens
gcctgccgtgca

SEQ ID NO: 6255027 - DNA, 22 bp, Homo sapiens
gcctgccgtgcatggctcctgt

SEQ ID NO: 6255028 - DNA, 10 bp, Homo sapiens
gcctgcctaa

SEQ ID NO: 6255029 - DNA, 16 bp, Homo sapiens
gcctgcctaaccaggc

SEQ ID NO: 6255030 - DNA, 17 bp, Homo sapiens
gcctgcctaaccaggcc

SEQ ID NO: 6255031 - DNA, 21 bp, Homo sapiens
gcctgcctaaccaggcccagc

SEQ ID NO: 6255032 - DNA, 21 bp, Homo sapiens
gcctgcctagcactcacatgc

SEQ ID NO: 6255033 - DNA, 11 bp, Homo sapiens
gcctgcctcac

SEQ ID NO: 6255034 - DNA, 12 bp, Homo sapiens
gcctgcctcacc

SEQ ID NO: 6255035 - DNA, 15 bp, Homo sapiens
gcctgcctcagctgc

SEQ ID NO: 6255036 - DNA, 13 bp, Homo sapiens
gcctgcctcccac

SEQ ID NO: 6255037 - DNA, 17 bp, Homo sapiens
gcctgcctcccagccct

SEQ ID NO: 6255038 - DNA, 18 bp, Homo sapiens
gcctgcctccggccctgc

SEQ ID NO: 6255039 - DNA, 23 bp, Homo sapiens
gcctgcctccggccctgccccac

SEQ ID NO: 6255040 - DNA, 23 bp, Homo sapiens
gcctgcctcctccctcccagctg

SEQ ID NO: 6255041 - DNA, 18 bp, Homo sapiens
gcctgcctcctggctcag

SEQ ID NO: 6255042 - DNA, 20 bp, Homo sapiens
gcctgcctcgccttgtgtta

SEQ ID NO: 6255043 - DNA, 20 bp, Homo sapiens
gcctgcctctgactcacact

SEQ ID NO: 6255044 - DNA, 17 bp, Homo sapiens
gcctgcctctgccacag

SEQ ID NO: 6255045 - DNA, 20 bp, Homo sapiens
gcctgcctgatccctgaacc

SEQ ID NO: 6255046 - DNA, 21 bp, Homo sapiens
gcctgcctgcaaacctgctgg

SEQ ID NO: 6255047 - DNA, 20 bp, Homo sapiens
gcctgcctgcagcaggcagc

SEQ ID NO: 6255048 - DNA, 21 bp, Homo sapiens
gcctgcctgcagcaggcagct

SEQ ID NO: 6255049 - DNA, 14 bp, Homo sapiens
gcctgcctgcctcc

SEQ ID NO: 6255050 - DNA, 16 bp, Homo sapiens
gcctgcctgcctgtgg

SEQ ID NO: 6255051 - DNA, 14 bp, Homo sapiens
gcctgcctggagcg

SEQ ID NO: 6255052 - DNA, 17 bp, Homo sapiens
gcctgcctggcaggctg

SEQ ID NO: 6255053 - DNA, 14 bp, Homo sapiens
gcctgcctggcccc

SEQ ID NO: 6255054 - DNA, 13 bp, Homo sapiens
gcctgcctgggcc

SEQ ID NO: 6255055 - DNA, 23 bp, Homo sapiens
gcctgcctgtggagacagccctg

SEQ ID NO: 6255056 - DNA, 17 bp, Homo sapiens
gcctgcctgttcccatt

SEQ ID NO: 6255057 - DNA, 21 bp, Homo sapiens
gcctgccttctcccctccacg

SEQ ID NO: 6255058 - DNA, 19 bp, Homo sapiens
gcctgccttctgggcaagg

SEQ ID NO: 6255059 - DNA, 14 bp, Homo sapiens
gcctgcctttccat

SEQ ID NO: 6255060 - DNA, 22 bp, Homo sapiens
gcctgcctttccatccatggcc

SEQ ID NO: 6255061 - DNA, 16 bp, Homo sapiens
gcctgcgaccctgggg

SEQ ID NO: 6255062 - DNA, 16 bp, Homo sapiens
gcctgcgagacccaag

SEQ ID NO: 6255063 - DNA, 19 bp, Homo sapiens
gcctgcgatggtgctgcac

SEQ ID NO: 6255064 - DNA, 15 bp, Homo sapiens
gcctgcgcagctcct

SEQ ID NO: 6255065 - DNA, 17 bp, Homo sapiens
gcctgcgcagctccttc

SEQ ID NO: 6255066 - DNA, 18 bp, Homo sapiens
gcctgcgcagctccttcc

SEQ ID NO: 6255067 - DNA, 18 bp, Homo sapiens
gcctgcgcccaccccgct

SEQ ID NO: 6255068 - DNA, 18 bp, Homo sapiens
gcctgcgcccagagctgg

SEQ ID NO: 6255069 - DNA, 14 bp, Homo sapiens
gcctgcgcccccca

SEQ ID NO: 6255070 - DNA, 16 bp, Homo sapiens
gcctgcgcctccatcc

SEQ ID NO: 6255071 - DNA, 17 bp, Homo sapiens
gcctgcgcctccatcca

SEQ ID NO: 6255072 - DNA, 20 bp, Homo sapiens
gcctgcgcctcctcctgcat

SEQ ID NO: 6255073 - DNA, 20 bp, Homo sapiens
gcctgcgcctgcacctgcgc

SEQ ID NO: 6255074 - DNA, 14 bp, Homo sapiens
gcctgcgcctgctg

SEQ ID NO: 6255075 - DNA, 18 bp, Homo sapiens
gcctgcgcctgctgcctg

SEQ ID NO: 6255076 - DNA, 14 bp, Homo sapiens
gcctgcgctcctct

SEQ ID NO: 6255077 - DNA, 15 bp, Homo sapiens
gcctgcgctcctctg

SEQ ID NO: 6255078 - DNA, 18 bp, Homo sapiens
gcctgcgctcctctgcag

SEQ ID NO: 6255079 - DNA, 20 bp, Homo sapiens
gcctgcgctcctctgcagcc

SEQ ID NO: 6255080 - DNA, 21 bp, Homo sapiens
gcctgcgctcctctgcagcct

SEQ ID NO: 6255081 - DNA, 15 bp, Homo sapiens
gcctgcgctcggcag

SEQ ID NO: 6255082 - DNA, 19 bp, Homo sapiens
gcctgcgctcggcaggaag

SEQ ID NO: 6255083 - DNA, 21 bp, Homo sapiens
gcctgcggccgggctgccctt

SEQ ID NO: 6255084 - DNA, 19 bp, Homo sapiens
gcctgcgggcccctggtga

SEQ ID NO: 6255085 - DNA, 16 bp, Homo sapiens
gcctgcggggcagcag

SEQ ID NO: 6255086 - DNA, 17 bp, Homo sapiens
gcctgcggggcagcagg

SEQ ID NO: 6255087 - DNA, 19 bp, Homo sapiens
gcctgcggtcaaggccagc

SEQ ID NO: 6255088 - DNA, 15 bp, Homo sapiens
gcctgcggtggaggg

SEQ ID NO: 6255089 - DNA, 13 bp, Homo sapiens
gcctgcgtcttcc

SEQ ID NO: 6255090 - DNA, 22 bp, Homo sapiens
gcctgcgtcttttttctcttcc

SEQ ID NO: 6255091 - DNA, 18 bp, Homo sapiens
gcctgcgtggcctggggc

SEQ ID NO: 6255092 - DNA, 23 bp, Homo sapiens
gcctgcgtggcctggggctgccg

SEQ ID NO: 6255093 - DNA, 15 bp, Homo sapiens
gcctgcgtgtgtctg

SEQ ID NO: 6255094 - DNA, 23 bp, Homo sapiens
gcctgcgtttggaggcccctggg

SEQ ID NO: 6255095 - DNA, 17 bp, Homo sapiens
gcctgctaaggctcctc

SEQ ID NO: 6255096 - DNA, 19 bp, Homo sapiens
gcctgctaatagctgctag

SEQ ID NO: 6255097 - DNA, 14 bp, Homo sapiens
gcctgctacacagg

SEQ ID NO: 6255098 - DNA, 17 bp, Homo sapiens
gcctgctacacaggcag

SEQ ID NO: 6255099 - DNA, 16 bp, Homo sapiens
gcctgctatccagccg

SEQ ID NO: 6255100 - DNA, 20 bp, Homo sapiens
gcctgctatttgaagtgtaa

SEQ ID NO: 6255101 - DNA, 14 bp, Homo sapiens
gcctgctcagcagc

SEQ ID NO: 6255102 - DNA, 21 bp, Homo sapiens
gcctgctcagcagccagtctc

SEQ ID NO: 6255103 - DNA, 13 bp, Homo sapiens
gcctgctcaggtg

SEQ ID NO: 6255104 - DNA, 13 bp, Homo sapiens
gcctgctccagac

SEQ ID NO: 6255105 - DNA, 14 bp, Homo sapiens
gcctgctccagacc

SEQ ID NO: 6255106 - DNA, 16 bp, Homo sapiens
gcctgctccagctgtt

SEQ ID NO: 6255107 - DNA, 13 bp, Homo sapiens
gcctgctcccagc

SEQ ID NO: 6255108 - DNA, 22 bp, Homo sapiens
gcctgctcccagcagccctaag

SEQ ID NO: 6255109 - DNA, 15 bp, Homo sapiens
gcctgctcccatcct

SEQ ID NO: 6255110 - DNA, 22 bp, Homo sapiens
gcctgctcccatcctcacccag

SEQ ID NO: 6255111 - DNA, 21 bp, Homo sapiens
gcctgctcccatcctgtgtgt

SEQ ID NO: 6255112 - DNA, 17 bp, Homo sapiens
gcctgctcccccacccc

SEQ ID NO: 6255113 - DNA, 15 bp, Homo sapiens
gcctgctccctccag

SEQ ID NO: 6255114 - DNA, 21 bp, Homo sapiens
gcctgctccctgtctgtgtcc

SEQ ID NO: 6255115 - DNA, 15 bp, Homo sapiens
gcctgctcctcactg

SEQ ID NO: 6255116 - DNA, 16 bp, Homo sapiens
gcctgctcctcactgg

SEQ ID NO: 6255117 - DNA, 17 bp, Homo sapiens
gatggagggggctgggg

SEQ ID NO: 6255118 - DNA, 16 bp, Homo sapiens
gatggaggtagggctg

SEQ ID NO: 6255119 - DNA, 17 bp, Homo sapiens
gatggaggttctcagag

SEQ ID NO: 6255120 - DNA, 18 bp, Homo sapiens
gatggagtctcgctctgc

SEQ ID NO: 6255121 - DNA, 24 bp, Homo sapiens
gatggagtctcgctctgctgccca

SEQ ID NO: 6255122 - DNA, 15 bp, Homo sapiens
gatggagtgctgttt

SEQ ID NO: 6255123 - DNA, 19 bp, Homo sapiens
gatggagtgtgcagacagc

SEQ ID NO: 6255124 - DNA, 21 bp, Homo sapiens
gatggagtgtgcgtgtgtgca

SEQ ID NO: 6255125 - DNA, 18 bp, Homo sapiens
gatggatattagatgccc

SEQ ID NO: 6255126 - DNA, 16 bp, Homo sapiens
gatggatgagtcagac

SEQ ID NO: 6255127 - DNA, 15 bp, Homo sapiens
gatggatggacagaa

SEQ ID NO: 6255128 - DNA, 13 bp, Homo sapiens
gatggatggcacc

SEQ ID NO: 6255129 - DNA, 14 bp, Homo sapiens
gatggatggcaccc

SEQ ID NO: 6255130 - DNA, 15 bp, Homo sapiens
gatggatggcaccct

SEQ ID NO: 6255131 - DNA, 16 bp, Homo sapiens
gatggatggcaccctg

SEQ ID NO: 6255132 - DNA, 16 bp, Homo sapiens
gatggatgtagataca

SEQ ID NO: 6255133 - DNA, 13 bp, Homo sapiens
gatggatgtattt

SEQ ID NO: 6255134 - DNA, 21 bp, Homo sapiens
gatggattccaaccccaactc

SEQ ID NO: 6255135 - DNA, 18 bp, Homo sapiens
gatggattctcagatatt

SEQ ID NO: 6255136 - DNA, 15 bp, Homo sapiens
gatggcaaaaaaaaa

SEQ ID NO: 6255137 - DNA, 21 bp, Homo sapiens
gatggcaacagatctggaacc

SEQ ID NO: 6255138 - DNA, 22 bp, Homo sapiens
gatggcaacagatctggaacct

SEQ ID NO: 6255139 - DNA, 23 bp, Homo sapiens
gatggcacaatgaatgtatattt

SEQ ID NO: 6255140 - DNA, 22 bp, Homo sapiens
gatggcacagggcatgaaatga

SEQ ID NO: 6255141 - DNA, 23 bp, Homo sapiens
gatggcacatagatgttgtagaa

SEQ ID NO: 6255142 - DNA, 18 bp, Homo sapiens
gatggcaccaacgggacc

SEQ ID NO: 6255143 - DNA, 21 bp, Homo sapiens
gatggcaccatccaccctgca

SEQ ID NO: 6255144 - DNA, 17 bp, Homo sapiens
gatggcacccacacaga

SEQ ID NO: 6255145 - DNA, 14 bp, Homo sapiens
gatggcaccctgga

SEQ ID NO: 6255146 - DNA, 15 bp, Homo sapiens
gatggcaccctggaa

SEQ ID NO: 6255147 - DNA, 16 bp, Homo sapiens
gatggcactgtccagg

SEQ ID NO: 6255148 - DNA, 20 bp, Homo sapiens
gatggcactgtccagggccc

SEQ ID NO: 6255149 - DNA, 10 bp, Homo sapiens
gatggcactt

SEQ ID NO: 6255150 - DNA, 21 bp, Homo sapiens
gatggcacttataaccaaagc

SEQ ID NO: 6255151 - DNA, 19 bp, Homo sapiens
gatggcagactctttaata

SEQ ID NO: 6255152 - DNA, 16 bp, Homo sapiens
gatggcagagccaggc

SEQ ID NO: 6255153 - DNA, 23 bp, Homo sapiens
gatggcagagccaggctgttgga

SEQ ID NO: 6255154 - DNA, 14 bp, Homo sapiens
gatggcagagccat

SEQ ID NO: 6255155 - DNA, 13 bp, Homo sapiens
gatggcagatgca

SEQ ID NO: 6255156 - DNA, 12 bp, Homo sapiens
gatggcagcctc

SEQ ID NO: 6255157 - DNA, 18 bp, Homo sapiens
gatggcagcctcagggct

SEQ ID NO: 6255158 - DNA, 12 bp, Homo sapiens
gatggcagctgg

SEQ ID NO: 6255159 - DNA, 15 bp, Homo sapiens
gatggcagctgttta

SEQ ID NO: 6255160 - DNA, 17 bp, Homo sapiens
gatggcaggatggcctg

SEQ ID NO: 6255161 - DNA, 21 bp, Homo sapiens
gatggcaggatggcctggcca

SEQ ID NO: 6255162 - DNA, 14 bp, Homo sapiens
gatggcaggcctga

SEQ ID NO: 6255163 - DNA, 13 bp, Homo sapiens
gatggcagtggct

SEQ ID NO: 6255164 - DNA, 14 bp, Homo sapiens
gatggcagtggctg

SEQ ID NO: 6255165 - DNA, 23 bp, Homo sapiens
gatggcatttggtctcaggcagc

SEQ ID NO: 6255166 - DNA, 16 bp, Homo sapiens
gatggccaagagcatc

SEQ ID NO: 6255167 - DNA, 12 bp, Homo sapiens
gatggccagagg

SEQ ID NO: 6255168 - DNA, 14 bp, Homo sapiens
gatggccaggcctc

SEQ ID NO: 6255169 - DNA, 13 bp, Homo sapiens
gatggccatgctc

SEQ ID NO: 6255170 - DNA, 22 bp, Homo sapiens
gatggccatgctcaacccccct

SEQ ID NO: 6255171 - DNA, 12 bp, Homo sapiens
gatggcccaagg

SEQ ID NO: 6255172 - DNA, 14 bp, Homo sapiens
gatggcccaaggga

SEQ ID NO: 6255173 - DNA, 18 bp, Homo sapiens
gatggcccaagggatggc

SEQ ID NO: 6255174 - DNA, 23 bp, Homo sapiens
gatggccccaacaagcaccccgc

SEQ ID NO: 6255175 - DNA, 18 bp, Homo sapiens
gatggccccatctggatg

SEQ ID NO: 6255176 - DNA, 15 bp, Homo sapiens
gatggcccctccact

SEQ ID NO: 6255177 - DNA, 15 bp, Homo sapiens
gatggcccctccagc

SEQ ID NO: 6255178 - DNA, 20 bp, Homo sapiens
gatggcccctccagcacaca

SEQ ID NO: 6255179 - DNA, 21 bp, Homo sapiens
gatggcccgagagctgggact

SEQ ID NO: 6255180 - DNA, 15 bp, Homo sapiens
gatggccctctggta

SEQ ID NO: 6255181 - DNA, 22 bp, Homo sapiens
gatggcccttcccactggaggt

SEQ ID NO: 6255182 - DNA, 21 bp, Homo sapiens
gatggccgcagggctgtgcac

SEQ ID NO: 6255183 - DNA, 13 bp, Homo sapiens
gatggcctctggg

SEQ ID NO: 6255184 - DNA, 14 bp, Homo sapiens
gatggcctctgggg

SEQ ID NO: 6255185 - DNA, 14 bp, Homo sapiens
gatggcctggccag

SEQ ID NO: 6255186 - DNA, 18 bp, Homo sapiens
gatggccttaatttcctt

SEQ ID NO: 6255187 - DNA, 16 bp, Homo sapiens
gatggcctttccttcc

SEQ ID NO: 6255188 - DNA, 21 bp, Homo sapiens
gatggcctttccttccctctc

SEQ ID NO: 6255189 - DNA, 19 bp, Homo sapiens
gatggcctttggacccagg

SEQ ID NO: 6255190 - DNA, 23 bp, Homo sapiens
gatggcctttggacccagggcct

SEQ ID NO: 6255191 - DNA, 24 bp, Homo sapiens
gatggcctttggacccagggcctg

SEQ ID NO: 6255192 - DNA, 14 bp, Homo sapiens
gatggcgaccacca

SEQ ID NO: 6255193 - DNA, 16 bp, Homo sapiens
gatggcgcgggaggca

SEQ ID NO: 6255194 - DNA, 22 bp, Homo sapiens
gatggcgcgggaggcaccagct

SEQ ID NO: 6255195 - DNA, 14 bp, Homo sapiens
gatggcgctaggca

SEQ ID NO: 6255196 - DNA, 15 bp, Homo sapiens
gatggcgggtggggg

SEQ ID NO: 6255197 - DNA, 19 bp, Homo sapiens
gatggcgtgggctgcgtga

SEQ ID NO: 6255198 - DNA, 15 bp, Homo sapiens
gatggcgtgtcccct

SEQ ID NO: 6255199 - DNA, 20 bp, Homo sapiens
gatggctaacttacaaagat

SEQ ID NO: 6255200 - DNA, 21 bp, Homo sapiens
gatggctagtatcaaaagaaa

SEQ ID NO: 6255201 - DNA, 23 bp, Homo sapiens
gatggctcccaggggctccctcc

SEQ ID NO: 6255202 - DNA, 13 bp, Homo sapiens
gatggctcctctc

SEQ ID NO: 6255203 - DNA, 17 bp, Homo sapiens
gatggctgaggcaggag

SEQ ID NO: 6255204 - DNA, 19 bp, Homo sapiens
gatggctgaggcaggagaa

SEQ ID NO: 6255205 - DNA, 12 bp, Homo sapiens
gatggctgctgc

SEQ ID NO: 6255206 - DNA, 23 bp, Homo sapiens
gatggctgctggaggggacgctg

SEQ ID NO: 6255207 - DNA, 14 bp, Homo sapiens
gatggctggaagga

SEQ ID NO: 6255208 - DNA, 19 bp, Homo sapiens
gatggctggaaggggtcca

SEQ ID NO: 6255209 - DNA, 21 bp, Homo sapiens
gatggctgggtccttgggcct

SEQ ID NO: 6255210 - DNA, 22 bp, Homo sapiens
gatggctgggtccttgggcctg

SEQ ID NO: 6255211 - DNA, 23 bp, Homo sapiens
gatggctgggtccttgggcctgg

SEQ ID NO: 6255212 - DNA, 13 bp, Homo sapiens
gatggctgtgaaa

SEQ ID NO: 6255213 - DNA, 18 bp, Homo sapiens
gatggctgtgcctctgcc

SEQ ID NO: 6255214 - DNA, 19 bp, Homo sapiens
gatggctgtgcctctgcct

SEQ ID NO: 6255215 - DNA, 14 bp, Homo sapiens
gatggctgtggcat

SEQ ID NO: 6255216 - DNA, 22 bp, Homo sapiens
gatggctgtggcatttccaaac

SEQ ID NO: 6255217 - DNA, 19 bp, Homo sapiens
gatggcttatttgtataat

SEQ ID NO: 6255218 - DNA, 19 bp, Homo sapiens
gatggcttcggagggccgc

SEQ ID NO: 6255219 - DNA, 21 bp, Homo sapiens
gatggcttcggagggccgcag

SEQ ID NO: 6255220 - DNA, 13 bp, Homo sapiens
gatggcttgtcta

SEQ ID NO: 6255221 - DNA, 23 bp, Homo sapiens
gatggcttttgtttcttcccttc

SEQ ID NO: 6255222 - DNA, 18 bp, Homo sapiens
gatgggaaaaactgcagt

SEQ ID NO: 6255223 - DNA, 22 bp, Homo sapiens
gatgggaaagaccctaggtgct

SEQ ID NO: 6255224 - DNA, 17 bp, Homo sapiens
gatgggaaataaagaaa

SEQ ID NO: 6255225 - DNA, 18 bp, Homo sapiens
gatgggaagatggtagca

SEQ ID NO: 6255226 - DNA, 13 bp, Homo sapiens
gatgggaaggagg

SEQ ID NO: 6255227 - DNA, 18 bp, Homo sapiens
gatgggaaggagggaggt

SEQ ID NO: 6255228 - DNA, 16 bp, Homo sapiens
gatgggaataaaagta

SEQ ID NO: 6255229 - DNA, 15 bp, Homo sapiens
gatgggacagcaaca

SEQ ID NO: 6255230 - DNA, 18 bp, Homo sapiens
gatgggacagggaggcca

SEQ ID NO: 6255231 - DNA, 22 bp, Homo sapiens
gatgggacattccaaagaacag

SEQ ID NO: 6255232 - DNA, 15 bp, Homo sapiens
gatgggacatttttg

SEQ ID NO: 6255233 - DNA, 14 bp, Homo sapiens
gatgggaccaggga

SEQ ID NO: 6255234 - DNA, 20 bp, Homo sapiens
gatgggagctcctctcctgg

SEQ ID NO: 6255235 - DNA, 23 bp, Homo sapiens
gatgggagctcctctcctggagg

SEQ ID NO: 6255236 - DNA, 19 bp, Homo sapiens
gatgggaggtatgggctgg

SEQ ID NO: 6255237 - DNA, 20 bp, Homo sapiens
gatgggaggtatgggctggg

SEQ ID NO: 6255238 - DNA, 13 bp, Homo sapiens
gatgggaggtgga

SEQ ID NO: 6255239 - DNA, 14 bp, Homo sapiens
gatgggagtaagag

SEQ ID NO: 6255240 - DNA, 18 bp, Homo sapiens
gatgggagtaggctccag

SEQ ID NO: 6255241 - DNA, 16 bp, Homo sapiens
gatgggagtctccctc

SEQ ID NO: 6255242 - DNA, 20 bp, Homo sapiens
gatgggagtgggcacctcag

SEQ ID NO: 6255243 - DNA, 20 bp, Homo sapiens
gatgggatgattgaagaaac

SEQ ID NO: 6255244 - DNA, 22 bp, Homo sapiens
gatgggatgtatttttcttgct

SEQ ID NO: 6255245 - DNA, 21 bp, Homo sapiens
gatgggcaaaccctggtgctt

SEQ ID NO: 6255246 - DNA, 16 bp, Homo sapiens
gatgggcaaagcttgt

SEQ ID NO: 6255247 - DNA, 21 bp, Homo sapiens
gatgggcaacccccagcctgc

SEQ ID NO: 6255248 - DNA, 22 bp, Homo sapiens
gatgggcaacccccagcctgct

SEQ ID NO: 6255249 - DNA, 13 bp, Homo sapiens
gatgggcacaggc

SEQ ID NO: 6255250 - DNA, 17 bp, Homo sapiens
gatgggcacatgaggag

SEQ ID NO: 6255251 - DNA, 18 bp, Homo sapiens
gatgggcacatgaggagg

SEQ ID NO: 6255252 - DNA, 22 bp, Homo sapiens
gatgggcacatgaggagggtgc

SEQ ID NO: 6255253 - DNA, 16 bp, Homo sapiens
gatgggcagcccaaca

SEQ ID NO: 6255254 - DNA, 17 bp, Homo sapiens
gatgggcatggggtggg

SEQ ID NO: 6255255 - DNA, 20 bp, Homo sapiens
gatgggcatggggtgggcct

SEQ ID NO: 6255256 - DNA, 22 bp, Homo sapiens
gatgggcatggggtgggcctct

SEQ ID NO: 6255257 - DNA, 22 bp, Homo sapiens
gatgggcatggtgttctcctgc

SEQ ID NO: 6255258 - DNA, 22 bp, Homo sapiens
gatgggcattgggctgacacct

SEQ ID NO: 6255259 - DNA, 21 bp, Homo sapiens
gatgggccctatgtctcagga

SEQ ID NO: 6255260 - DNA, 13 bp, Homo sapiens
gatgggccctgca

SEQ ID NO: 6255261 - DNA, 14 bp, Homo sapiens
gatgggccgagcca

SEQ ID NO: 6255262 - DNA, 19 bp, Homo sapiens
gatgggccggcccccttcc

SEQ ID NO: 6255263 - DNA, 14 bp, Homo sapiens
gatgggcctgtgtg

SEQ ID NO: 6255264 - DNA, 17 bp, Homo sapiens
gatgggcctttgagcct

SEQ ID NO: 6255265 - DNA, 15 bp, Homo sapiens
gatgggctccccagg

SEQ ID NO: 6255266 - DNA, 23 bp, Homo sapiens
gatgggctctacctctctttctc

SEQ ID NO: 6255267 - DNA, 16 bp, Homo sapiens
gatgggctggggcagg

SEQ ID NO: 6255268 - DNA, 14 bp, Homo sapiens
gatgggcttctgtt

SEQ ID NO: 6255269 - DNA, 16 bp, Homo sapiens
gatgggcttctgttct

SEQ ID NO: 6255270 - DNA, 20 bp, Homo sapiens
gatgggcttctgttctctgc

SEQ ID NO: 6255271 - DNA, 22 bp, Homo sapiens
gatgggcttctgttctctgctg

SEQ ID NO: 6255272 - DNA, 24 bp, Homo sapiens
gatgggcttctgttctctgctgag

SEQ ID NO: 6255273 - DNA, 21 bp, Homo sapiens
gatgggcttttgttctgaggg

SEQ ID NO: 6255274 - DNA, 21 bp, Homo sapiens
gatggggaatccgtgtgtgtg

SEQ ID NO: 6255275 - DNA, 21 bp, Homo sapiens
gatggggacactaatgaagat

SEQ ID NO: 6255276 - DNA, 14 bp, Homo sapiens
gatggggactctgc

SEQ ID NO: 6255277 - DNA, 14 bp, Homo sapiens
gatggggagggcgc

SEQ ID NO: 6255278 - DNA, 14 bp, Homo sapiens
gatggggagtccca

SEQ ID NO: 6255279 - DNA, 19 bp, Homo sapiens
gatggggatgcttccgcct

SEQ ID NO: 6255280 - DNA, 23 bp, Homo sapiens
gatggggcaggccacctggctct

SEQ ID NO: 6255281 - DNA, 13 bp, Homo sapiens
gatggggcccaca

SEQ ID NO: 6255282 - DNA, 24 bp, Homo sapiens
gatggggccctgcctcctttgtga

SEQ ID NO: 6255283 - DNA, 18 bp, Homo sapiens
gatggggcggcggtagca

SEQ ID NO: 6255284 - DNA, 16 bp, Homo sapiens
gatggggctgagcagg

SEQ ID NO: 6255285 - DNA, 21 bp, Homo sapiens
gatggggctggcatgttttct

SEQ ID NO: 6255286 - DNA, 12 bp, Homo sapiens
gatggggctggg

SEQ ID NO: 6255287 - DNA, 16 bp, Homo sapiens
gatgggggcagggctg

SEQ ID NO: 6255288 - DNA, 17 bp, Homo sapiens
gatgggggcagggctgt

SEQ ID NO: 6255289 - DNA, 15 bp, Homo sapiens
gatgggggctcctgg

SEQ ID NO: 6255290 - DNA, 18 bp, Homo sapiens
gatgggggctcctggcag

SEQ ID NO: 6255291 - DNA, 15 bp, Homo sapiens
gatgggggctctgca

SEQ ID NO: 6255292 - DNA, 16 bp, Homo sapiens
gatgggggctctgcac

SEQ ID NO: 6255293 - DNA, 17 bp, Homo sapiens
gatgggggcttcttcct

SEQ ID NO: 6255294 - DNA, 12 bp, Homo sapiens
gcctgctccttc

SEQ ID NO: 6255295 - DNA, 13 bp, Homo sapiens
gcctgctccttcc

SEQ ID NO: 6255296 - DNA, 14 bp, Homo sapiens
gcctgctccttccc

SEQ ID NO: 6255297 - DNA, 20 bp, Homo sapiens
gcctgctccttcccttgcta

SEQ ID NO: 6255298 - DNA, 20 bp, Homo sapiens
gcctgctccttggcaccccc

SEQ ID NO: 6255299 - DNA, 22 bp, Homo sapiens
gcctgctctccttgccctgggc

SEQ ID NO: 6255300 - DNA, 13 bp, Homo sapiens
gcctgctctgcag

SEQ ID NO: 6255301 - DNA, 14 bp, Homo sapiens
gcctgctctgcagc

SEQ ID NO: 6255302 - DNA, 20 bp, Homo sapiens
gcctgctctgcagcccacag

SEQ ID NO: 6255303 - DNA, 23 bp, Homo sapiens
gcctgctctgcttttcctgtctg

SEQ ID NO: 6255304 - DNA, 18 bp, Homo sapiens
gcctgctctttggcctga

SEQ ID NO: 6255305 - DNA, 18 bp, Homo sapiens
gcctgctgaggccttctc

SEQ ID NO: 6255306 - DNA, 21 bp, Homo sapiens
gcctgctgaggccttctcttg

SEQ ID NO: 6255307 - DNA, 22 bp, Homo sapiens
gcctgctgcagtcacgtgtaaa

SEQ ID NO: 6255308 - DNA, 21 bp, Homo sapiens
gcctgctgcatgccctctcag

SEQ ID NO: 6255309 - DNA, 14 bp, Homo sapiens
gcctgctgccagtg

SEQ ID NO: 6255310 - DNA, 18 bp, Homo sapiens
gcctgctgcgccccaggc

SEQ ID NO: 6255311 - DNA, 20 bp, Homo sapiens
gcctgctgctctctaagaat

SEQ ID NO: 6255312 - DNA, 11 bp, Homo sapiens
gcctgctgctg

SEQ ID NO: 6255313 - DNA, 12 bp, Homo sapiens
gcctgctgctga

SEQ ID NO: 6255314 - DNA, 13 bp, Homo sapiens
gcctgctgctgag

SEQ ID NO: 6255315 - DNA, 15 bp, Homo sapiens
gcctgctgctgagaa

SEQ ID NO: 6255316 - DNA, 20 bp, Homo sapiens
gcctgctgctgagaacctgg

SEQ ID NO: 6255317 - DNA, 22 bp, Homo sapiens
gcctgctgctgagaacctggcc

SEQ ID NO: 6255318 - DNA, 23 bp, Homo sapiens
gcctgctgctgagaacctggcct

SEQ ID NO: 6255319 - DNA, 13 bp, Homo sapiens
gcctgctgctgcc

SEQ ID NO: 6255320 - DNA, 21 bp, Homo sapiens
gcctgctgcttggagtgcccc

SEQ ID NO: 6255321 - DNA, 17 bp, Homo sapiens
gcctgctggaagcccag

SEQ ID NO: 6255322 - DNA, 19 bp, Homo sapiens
gcctgctggagaaaccttc

SEQ ID NO: 6255323 - DNA, 10 bp, Homo sapiens
gcctgctggc

SEQ ID NO: 6255324 - DNA, 16 bp, Homo sapiens
gcctgctggcacccac

SEQ ID NO: 6255325 - DNA, 19 bp, Homo sapiens
gcctgctggcacccaccgt

SEQ ID NO: 6255326 - DNA, 19 bp, Homo sapiens
gcctgctggcagggccagg

SEQ ID NO: 6255327 - DNA, 22 bp, Homo sapiens
gcctgctggcagggccagggca

SEQ ID NO: 6255328 - DNA, 14 bp, Homo sapiens
gcctgctggcatca

SEQ ID NO: 6255329 - DNA, 21 bp, Homo sapiens
gcctgctggcatcaggtctgg

SEQ ID NO: 6255330 - DNA, 14 bp, Homo sapiens
gcctgctggctgcg

SEQ ID NO: 6255331 - DNA, 18 bp, Homo sapiens
gcctgctggctgcggccc

SEQ ID NO: 6255332 - DNA, 20 bp, Homo sapiens
gcctgctgggaaccccgcag

SEQ ID NO: 6255333 - DNA, 22 bp, Homo sapiens
gcctgctgggctccccccagtg

SEQ ID NO: 6255334 - DNA, 21 bp, Homo sapiens
gcctgctgggctctccacctc

SEQ ID NO: 6255335 - DNA, 24 bp, Homo sapiens
gcctgctgggctctccacctcagc

SEQ ID NO: 6255336 - DNA, 22 bp, Homo sapiens
gcctgctgggcttggctcggcg

SEQ ID NO: 6255337 - DNA, 15 bp, Homo sapiens
gcctgctggggatta

SEQ ID NO: 6255338 - DNA, 13 bp, Homo sapiens
gcctgctggggct

SEQ ID NO: 6255339 - DNA, 17 bp, Homo sapiens
gcctgctgggtgccagg

SEQ ID NO: 6255340 - DNA, 11 bp, Homo sapiens
gcctgctgtca

SEQ ID NO: 6255341 - DNA, 21 bp, Homo sapiens
gcctgctgtcaagtcccccag

SEQ ID NO: 6255342 - DNA, 22 bp, Homo sapiens
gcctgctgtcaagtcccccagc

SEQ ID NO: 6255343 - DNA, 15 bp, Homo sapiens
gcctgctgtgctggg

SEQ ID NO: 6255344 - DNA, 12 bp, Homo sapiens
gcctgctgtgga

SEQ ID NO: 6255345 - DNA, 21 bp, Homo sapiens
gcctgctgtgtccttcctcca

SEQ ID NO: 6255346 - DNA, 20 bp, Homo sapiens
gcctgctgttggtcctctct

SEQ ID NO: 6255347 - DNA, 16 bp, Homo sapiens
gcctgcttcacacccc

SEQ ID NO: 6255348 - DNA, 13 bp, Homo sapiens
gcctgcttcccac

SEQ ID NO: 6255349 - DNA, 21 bp, Homo sapiens
gcctgcttcccacctccctgc

SEQ ID NO: 6255350 - DNA, 23 bp, Homo sapiens
gcctgcttcccacctccctgccc

SEQ ID NO: 6255351 - DNA, 12 bp, Homo sapiens
gcctgcttcccc

SEQ ID NO: 6255352 - DNA, 14 bp, Homo sapiens
gcctgcttccccct

SEQ ID NO: 6255353 - DNA, 20 bp, Homo sapiens
gcctgcttccccttcctaag

SEQ ID NO: 6255354 - DNA, 16 bp, Homo sapiens
gcctgcttcctgtctt

SEQ ID NO: 6255355 - DNA, 12 bp, Homo sapiens
gcctgcttctgt

SEQ ID NO: 6255356 - DNA, 19 bp, Homo sapiens
gcctgctttgacgggccag

SEQ ID NO: 6255357 - DNA, 22 bp, Homo sapiens
gcctgctttgacgggccaggcc

SEQ ID NO: 6255358 - DNA, 15 bp, Homo sapiens
gcctgctttggcctt

SEQ ID NO: 6255359 - DNA, 16 bp, Homo sapiens
gcctgctttggccttt

SEQ ID NO: 6255360 - DNA, 18 bp, Homo sapiens
gcctgcttttcactgctg

SEQ ID NO: 6255361 - DNA, 16 bp, Homo sapiens
gcctgcttttccagga

SEQ ID NO: 6255362 - DNA, 17 bp, Homo sapiens
gcctgcttttccaggat

SEQ ID NO: 6255363 - DNA, 19 bp, Homo sapiens
gcctgcttttccaggatcc

SEQ ID NO: 6255364 - DNA, 13 bp, Homo sapiens
gcctgcttttgat

SEQ ID NO: 6255365 - DNA, 15 bp, Homo sapiens
gcctgcttttgcaaa

SEQ ID NO: 6255366 - DNA, 21 bp, Homo sapiens
gcctgctttttggaaagtcag

SEQ ID NO: 6255367 - DNA, 20 bp, Homo sapiens
gcctggaaacagaggtaaaa

SEQ ID NO: 6255368 - DNA, 16 bp, Homo sapiens
gcctggaacaccagca

SEQ ID NO: 6255369 - DNA, 12 bp, Homo sapiens
gcctggaaccag

SEQ ID NO: 6255370 - DNA, 20 bp, Homo sapiens
gcctggaaccagggaggaga

SEQ ID NO: 6255371 - DNA, 23 bp, Homo sapiens
gcctggaactgcatcagtgactg

SEQ ID NO: 6255372 - DNA, 13 bp, Homo sapiens
gcctggaagacag

SEQ ID NO: 6255373 - DNA, 17 bp, Homo sapiens
gcctggaagagcagccc

SEQ ID NO: 6255374 - DNA, 19 bp, Homo sapiens
gcctggaagagccgagcac

SEQ ID NO: 6255375 - DNA, 18 bp, Homo sapiens
gcctggaagagctgagac

SEQ ID NO: 6255376 - DNA, 13 bp, Homo sapiens
gcctggaagcact

SEQ ID NO: 6255377 - DNA, 18 bp, Homo sapiens
gcctggaatttgggcaga

SEQ ID NO: 6255378 - DNA, 14 bp, Homo sapiens
gcctggacaaaccc

SEQ ID NO: 6255379 - DNA, 17 bp, Homo sapiens
gcctggacacagtcagg

SEQ ID NO: 6255380 - DNA, 20 bp, Homo sapiens
gcctggacacagtcagggcg

SEQ ID NO: 6255381 - DNA, 20 bp, Homo sapiens
gcctggacatttgccttgct

SEQ ID NO: 6255382 - DNA, 15 bp, Homo sapiens
gcctggaccaaaggg

SEQ ID NO: 6255383 - DNA, 17 bp, Homo sapiens
gcctggaccagcctctc

SEQ ID NO: 6255384 - DNA, 15 bp, Homo sapiens
gcctggaccattcct

SEQ ID NO: 6255385 - DNA, 15 bp, Homo sapiens
gcctggacccctgga

SEQ ID NO: 6255386 - DNA, 16 bp, Homo sapiens
gcctggacccctggac

SEQ ID NO: 6255387 - DNA, 23 bp, Homo sapiens
gcctggaccgagatgtgagtcct

SEQ ID NO: 6255388 - DNA, 18 bp, Homo sapiens
gcctggaccgcttcccag

SEQ ID NO: 6255389 - DNA, 19 bp, Homo sapiens
gcctggaccgcttcccaga

SEQ ID NO: 6255390 - DNA, 23 bp, Homo sapiens
gcctggaccgcttcccagaggcc

SEQ ID NO: 6255391 - DNA, 16 bp, Homo sapiens
gcctggacctatgcag

SEQ ID NO: 6255392 - DNA, 23 bp, Homo sapiens
gcctggacctatgcagggaggcc

SEQ ID NO: 6255393 - DNA, 15 bp, Homo sapiens
gcctggacctctgac

SEQ ID NO: 6255394 - DNA, 18 bp, Homo sapiens
gcctggacctctgacagc

SEQ ID NO: 6255395 - DNA, 21 bp, Homo sapiens
gcctggacctctgacagcagc

SEQ ID NO: 6255396 - DNA, 22 bp, Homo sapiens
gcctggacctctgacagcagca

SEQ ID NO: 6255397 - DNA, 14 bp, Homo sapiens
gcctggacgcagcc

SEQ ID NO: 6255398 - DNA, 20 bp, Homo sapiens
gcctggacgcagccacacag

SEQ ID NO: 6255399 - DNA, 20 bp, Homo sapiens
gcctggacgggccctccttc

SEQ ID NO: 6255400 - DNA, 23 bp, Homo sapiens
gcctggacgggccctccttccct

SEQ ID NO: 6255401 - DNA, 12 bp, Homo sapiens
gcctggactcag

SEQ ID NO: 6255402 - DNA, 23 bp, Homo sapiens
gcctggactctaagctggagctc

SEQ ID NO: 6255403 - DNA, 16 bp, Homo sapiens
gcctggactctgcccc

SEQ ID NO: 6255404 - DNA, 24 bp, Homo sapiens
gcctggactctgccccacgctgtg

SEQ ID NO: 6255405 - DNA, 12 bp, Homo sapiens
gcctggactgac

SEQ ID NO: 6255406 - DNA, 14 bp, Homo sapiens
gcctggactgactg

SEQ ID NO: 6255407 - DNA, 15 bp, Homo sapiens
gcctggactgactgc

SEQ ID NO: 6255408 - DNA, 18 bp, Homo sapiens
gcctggactgactgcagc

SEQ ID NO: 6255409 - DNA, 15 bp, Homo sapiens
gcctggactttcctg

SEQ ID NO: 6255410 - DNA, 16 bp, Homo sapiens
gcctggactttcctgc

SEQ ID NO: 6255411 - DNA, 14 bp, Homo sapiens
gcctggagaaagga

SEQ ID NO: 6255412 - DNA, 15 bp, Homo sapiens
gcctggagaaaggat

SEQ ID NO: 6255413 - DNA, 15 bp, Homo sapiens
gcctggagacccacc

SEQ ID NO: 6255414 - DNA, 17 bp, Homo sapiens
gcctggagacttagggc

SEQ ID NO: 6255415 - DNA, 13 bp, Homo sapiens
gcctggagagcga

SEQ ID NO: 6255416 - DNA, 12 bp, Homo sapiens
gcctggagaggc

SEQ ID NO: 6255417 - DNA, 13 bp, Homo sapiens
gcctggagaggcc

SEQ ID NO: 6255418 - DNA, 15 bp, Homo sapiens
gcctggagaggcctg

SEQ ID NO: 6255419 - DNA, 17 bp, Homo sapiens
gcctggagaggcctggg

SEQ ID NO: 6255420 - DNA, 14 bp, Homo sapiens
gcctggagagggtc

SEQ ID NO: 6255421 - DNA, 17 bp, Homo sapiens
gcctggagatcctcctg

SEQ ID NO: 6255422 - DNA, 19 bp, Homo sapiens
gcctggagatcctcctgca

SEQ ID NO: 6255423 - DNA, 14 bp, Homo sapiens
gcctggagatgact

SEQ ID NO: 6255424 - DNA, 16 bp, Homo sapiens
gcctggagcaggccca

SEQ ID NO: 6255425 - DNA, 15 bp, Homo sapiens
gcctggagcaggggt

SEQ ID NO: 6255426 - DNA, 17 bp, Homo sapiens
gcctggagcaggggtgg

SEQ ID NO: 6255427 - DNA, 17 bp, Homo sapiens
gcctggagcatggacag

SEQ ID NO: 6255428 - DNA, 12 bp, Homo sapiens
gcctggagcccc

SEQ ID NO: 6255429 - DNA, 23 bp, Homo sapiens
gcctggagcccctgtgtgggagg

SEQ ID NO: 6255430 - DNA, 13 bp, Homo sapiens
gcctggagccctc

SEQ ID NO: 6255431 - DNA, 22 bp, Homo sapiens
gcctggagccctccgccttcac

SEQ ID NO: 6255432 - DNA, 16 bp, Homo sapiens
gcctggagccctggag

SEQ ID NO: 6255433 - DNA, 18 bp, Homo sapiens
gcctggagccctgggcgg

SEQ ID NO: 6255434 - DNA, 14 bp, Homo sapiens
gcctggagccgtgg

SEQ ID NO: 6255435 - DNA, 18 bp, Homo sapiens
gcctggagcctgggcagc

SEQ ID NO: 6255436 - DNA, 22 bp, Homo sapiens
gcctggaggaatcactggggat

SEQ ID NO: 6255437 - DNA, 18 bp, Homo sapiens
gcctggaggacctgagcc

SEQ ID NO: 6255438 - DNA, 14 bp, Homo sapiens
gcctggaggctcag

SEQ ID NO: 6255439 - DNA, 19 bp, Homo sapiens
gcctggaggctcagcccac

SEQ ID NO: 6255440 - DNA, 15 bp, Homo sapiens
gcctggagggacttt

SEQ ID NO: 6255441 - DNA, 23 bp, Homo sapiens
gcctggagggatgcccccaggca

SEQ ID NO: 6255442 - DNA, 12 bp, Homo sapiens
gcctggagggca

SEQ ID NO: 6255443 - DNA, 14 bp, Homo sapiens
gcctggagggcact

SEQ ID NO: 6255444 - DNA, 21 bp, Homo sapiens
gcctggagggcacttcctcca

SEQ ID NO: 6255445 - DNA, 14 bp, Homo sapiens
gcctggagggggag

SEQ ID NO: 6255446 - DNA, 20 bp, Homo sapiens
gcctggagggggagcaccag

SEQ ID NO: 6255447 - DNA, 14 bp, Homo sapiens
gcctggaggtctgg

SEQ ID NO: 6255448 - DNA, 18 bp, Homo sapiens
gcctggaggtctggctga

SEQ ID NO: 6255449 - DNA, 19 bp, Homo sapiens
gcctggagtaggcctgggg

SEQ ID NO: 6255450 - DNA, 18 bp, Homo sapiens
gcctggagtcagtagcca

SEQ ID NO: 6255451 - DNA, 16 bp, Homo sapiens
gcctggagtgctgtgc

SEQ ID NO: 6255452 - DNA, 21 bp, Homo sapiens
gcctggatattattcttgtag

SEQ ID NO: 6255453 - DNA, 21 bp, Homo sapiens
gcctggatccagctctgggag

SEQ ID NO: 6255454 - DNA, 16 bp, Homo sapiens
gcctggatccatcctg

SEQ ID NO: 6255455 - DNA, 22 bp, Homo sapiens
gcctggatccatcctgctagca

SEQ ID NO: 6255456 - DNA, 12 bp, Homo sapiens
gcctggatctcc

SEQ ID NO: 6255457 - DNA, 21 bp, Homo sapiens
gcctggatgagaaacagctca

SEQ ID NO: 6255458 - DNA, 23 bp, Homo sapiens
gcctggatgagaaacagctcagc

SEQ ID NO: 6255459 - DNA, 17 bp, Homo sapiens
gcctggatgcacagtgc

SEQ ID NO: 6255460 - DNA, 19 bp, Homo sapiens
gcctggatgcacagtgcct

SEQ ID NO: 6255461 - DNA, 20 bp, Homo sapiens
gcctggatgcacagtgcctg

SEQ ID NO: 6255462 - DNA, 16 bp, Homo sapiens
gcctggatgccagctg

SEQ ID NO: 6255463 - DNA, 17 bp, Homo sapiens
gcctggatgccagctgt

SEQ ID NO: 6255464 - DNA, 18 bp, Homo sapiens
gcctggatgccagctgtg

SEQ ID NO: 6255465 - DNA, 14 bp, Homo sapiens
gcctggatggcccc

SEQ ID NO: 6255466 - DNA, 14 bp, Homo sapiens
gcctggatggggct

SEQ ID NO: 6255467 - DNA, 16 bp, Homo sapiens
gcctggatggggctgc

SEQ ID NO: 6255468 - DNA, 18 bp, Homo sapiens
gcctggatggggctgcac

SEQ ID NO: 6255469 - DNA, 20 bp, Homo sapiens
gcctggatggggctgcaccg

SEQ ID NO: 6255470 - DNA, 14 bp, Homo sapiens
gcctggattcattt

SEQ ID NO: 6255471 - DNA, 20 bp, Homo sapiens
gcctggattcatttcctgcc

SEQ ID NO: 6255472 - DNA, 14 bp, Homo sapiens
gcctggattccagc

SEQ ID NO: 6255473 - DNA, 15 bp, Homo sapiens
gatggggggctgatg

SEQ ID NO: 6255474 - DNA, 18 bp, Homo sapiens
gatggggggctgatggct

SEQ ID NO: 6255475 - DNA, 17 bp, Homo sapiens
gatggggtccagagagc

SEQ ID NO: 6255476 - DNA, 20 bp, Homo sapiens
gatggggtccagagagcctc

SEQ ID NO: 6255477 - DNA, 23 bp, Homo sapiens
gatggggtctcacagtgttgccc

SEQ ID NO: 6255478 - DNA, 16 bp, Homo sapiens
gatggggtctgtaaaa

SEQ ID NO: 6255479 - DNA, 20 bp, Homo sapiens
gatggggtctgtgactggat

SEQ ID NO: 6255480 - DNA, 13 bp, Homo sapiens
gatggggtgagaa

SEQ ID NO: 6255481 - DNA, 21 bp, Homo sapiens
gatggggtgggcagggctggg

SEQ ID NO: 6255482 - DNA, 12 bp, Homo sapiens
gatggggtgggg

SEQ ID NO: 6255483 - DNA, 14 bp, Homo sapiens
gatggggttctgga

SEQ ID NO: 6255484 - DNA, 17 bp, Homo sapiens
gatggggtttcaccatg

SEQ ID NO: 6255485 - DNA, 22 bp, Homo sapiens
gatgggtattaaacttgtcaga

SEQ ID NO: 6255486 - DNA, 18 bp, Homo sapiens
gatgggtcaacctttgtg

SEQ ID NO: 6255487 - DNA, 14 bp, Homo sapiens
gatgggtcaagcaa

SEQ ID NO: 6255488 - DNA, 14 bp, Homo sapiens
gatgggtcctgctg

SEQ ID NO: 6255489 - DNA, 15 bp, Homo sapiens
gatgggtcctgctgc

SEQ ID NO: 6255490 - DNA, 16 bp, Homo sapiens
gatgggtgaaggctgg

SEQ ID NO: 6255491 - DNA, 21 bp, Homo sapiens
gatgggtgaaggctggcatga

SEQ ID NO: 6255492 - DNA, 18 bp, Homo sapiens
gatgggtggggagggggg

SEQ ID NO: 6255493 - DNA, 16 bp, Homo sapiens
gatgggtgggggctcc

SEQ ID NO: 6255494 - DNA, 22 bp, Homo sapiens
gatgggtgggtggggtattttt

SEQ ID NO: 6255495 - DNA, 16 bp, Homo sapiens
gatgggtgtggatgta

SEQ ID NO: 6255496 - DNA, 21 bp, Homo sapiens
gatgggttctaattttggatg

SEQ ID NO: 6255497 - DNA, 14 bp, Homo sapiens
gatgggttcttagc

SEQ ID NO: 6255498 - DNA, 13 bp, Homo sapiens
gatggtaattctt

SEQ ID NO: 6255499 - DNA, 14 bp, Homo sapiens
gatggtagcagata

SEQ ID NO: 6255500 - DNA, 18 bp, Homo sapiens
gatggtcacacagagata

SEQ ID NO: 6255501 - DNA, 15 bp, Homo sapiens
gatggtcacttaaaa

SEQ ID NO: 6255502 - DNA, 17 bp, Homo sapiens
gatggtcagagcccagt

SEQ ID NO: 6255503 - DNA, 12 bp, Homo sapiens
gatggtcaggcc

SEQ ID NO: 6255504 - DNA, 22 bp, Homo sapiens
gatggtccatttgttcctgctt

SEQ ID NO: 6255505 - DNA, 19 bp, Homo sapiens
gatggtcccaggaagcagg

SEQ ID NO: 6255506 - DNA, 21 bp, Homo sapiens
gatggtccgtgcccaggccct

SEQ ID NO: 6255507 - DNA, 18 bp, Homo sapiens
gatggtcggatctcacag

SEQ ID NO: 6255508 - DNA, 19 bp, Homo sapiens
gatggtctccacctgtgct

SEQ ID NO: 6255509 - DNA, 20 bp, Homo sapiens
gatggtctccacctgtgctt

SEQ ID NO: 6255510 - DNA, 21 bp, Homo sapiens
gatggtctccacctgtgcttg

SEQ ID NO: 6255511 - DNA, 23 bp, Homo sapiens
gatggtctctctccctctgtctt

SEQ ID NO: 6255512 - DNA, 16 bp, Homo sapiens
gatggtcttacagcag

SEQ ID NO: 6255513 - DNA, 18 bp, Homo sapiens
gatggtgaagtcacatta

SEQ ID NO: 6255514 - DNA, 20 bp, Homo sapiens
gatggtgacttttgaagaac

SEQ ID NO: 6255515 - DNA, 14 bp, Homo sapiens
gatggtgagctggg

SEQ ID NO: 6255516 - DNA, 21 bp, Homo sapiens
gatggtgcatgcctgtagtct

SEQ ID NO: 6255517 - DNA, 14 bp, Homo sapiens
gatggtgccccctg

SEQ ID NO: 6255518 - DNA, 17 bp, Homo sapiens
gatggtgccccctgggg

SEQ ID NO: 6255519 - DNA, 16 bp, Homo sapiens
gatggtgctgagaagc

SEQ ID NO: 6255520 - DNA, 12 bp, Homo sapiens
gatggtgctgca

SEQ ID NO: 6255521 - DNA, 21 bp, Homo sapiens
gatggtgctgcacccctggtg

SEQ ID NO: 6255522 - DNA, 21 bp, Homo sapiens
gatggtgctgcccaggcctct

SEQ ID NO: 6255523 - DNA, 22 bp, Homo sapiens
gatggtggaccctactattcat

SEQ ID NO: 6255524 - DNA, 18 bp, Homo sapiens
gatggtggactaagcaat

SEQ ID NO: 6255525 - DNA, 15 bp, Homo sapiens
gatggtggagggcca

SEQ ID NO: 6255526 - DNA, 16 bp, Homo sapiens
gatggtggagtgagag

SEQ ID NO: 6255527 - DNA, 21 bp, Homo sapiens
gatggtggccacagactgacc

SEQ ID NO: 6255528 - DNA, 18 bp, Homo sapiens
gatggtggctgtgtctct

SEQ ID NO: 6255529 - DNA, 19 bp, Homo sapiens
gatggtggctttaggggaa

SEQ ID NO: 6255530 - DNA, 17 bp, Homo sapiens
gatggtgggcaggatct

SEQ ID NO: 6255531 - DNA, 15 bp, Homo sapiens
gatggtgggcttcag

SEQ ID NO: 6255532 - DNA, 15 bp, Homo sapiens
gatggtgtccttccc

SEQ ID NO: 6255533 - DNA, 18 bp, Homo sapiens
gatggtgtccttccctgc

SEQ ID NO: 6255534 - DNA, 15 bp, Homo sapiens
gatggtgtgccttcc

SEQ ID NO: 6255535 - DNA, 16 bp, Homo sapiens
gatggtgtggcctgtg

SEQ ID NO: 6255536 - DNA, 18 bp, Homo sapiens
gatggtgtgggtgtcctg

SEQ ID NO: 6255537 - DNA, 14 bp, Homo sapiens
gatggtgttaaagc

SEQ ID NO: 6255538 - DNA, 13 bp, Homo sapiens
gatggtgtttctt

SEQ ID NO: 6255539 - DNA, 17 bp, Homo sapiens
gatggttattttctttt

SEQ ID NO: 6255540 - DNA, 16 bp, Homo sapiens
gatggttccccaggag

SEQ ID NO: 6255541 - DNA, 17 bp, Homo sapiens
gatggttccccaggagg

SEQ ID NO: 6255542 - DNA, 18 bp, Homo sapiens
gatggttcttcacctcct

SEQ ID NO: 6255543 - DNA, 18 bp, Homo sapiens
gatggttggttagtgcat

SEQ ID NO: 6255544 - DNA, 20 bp, Homo sapiens
gatggttggttagtgcatgt

SEQ ID NO: 6255545 - DNA, 12 bp, Homo sapiens
gatggttgtgta

SEQ ID NO: 6255546 - DNA, 17 bp, Homo sapiens
gatggtttaataggtaa

SEQ ID NO: 6255547 - DNA, 14 bp, Homo sapiens
gatggtttggaaaa

SEQ ID NO: 6255548 - DNA, 17 bp, Homo sapiens
gatggtttggaaaataa

SEQ ID NO: 6255549 - DNA, 16 bp, Homo sapiens
gatggttttaaacttt

SEQ ID NO: 6255550 - DNA, 12 bp, Homo sapiens
gatggttttgat

SEQ ID NO: 6255551 - DNA, 18 bp, Homo sapiens
gatgtaaaaaatattaaa

SEQ ID NO: 6255552 - DNA, 14 bp, Homo sapiens
gatgtaaaatcttg

SEQ ID NO: 6255553 - DNA, 20 bp, Homo sapiens
gatgtaaaatcttgtcatgt

SEQ ID NO: 6255554 - DNA, 16 bp, Homo sapiens
gatgtaaacagtgcct

SEQ ID NO: 6255555 - DNA, 20 bp, Homo sapiens
gatgtaaacagtgcctgctg

SEQ ID NO: 6255556 - DNA, 12 bp, Homo sapiens
gatgtaaagatg

SEQ ID NO: 6255557 - DNA, 20 bp, Homo sapiens
gatgtaaagcgggaaggaca

SEQ ID NO: 6255558 - DNA, 14 bp, Homo sapiens
gatgtaaataaaat

SEQ ID NO: 6255559 - DNA, 23 bp, Homo sapiens
gatgtaaatcgggaaggatggga

SEQ ID NO: 6255560 - DNA, 17 bp, Homo sapiens
gatgtaaattgaagaag

SEQ ID NO: 6255561 - DNA, 12 bp, Homo sapiens
gatgtaaatttt

SEQ ID NO: 6255562 - DNA, 13 bp, Homo sapiens
gatgtaaggcctt

SEQ ID NO: 6255563 - DNA, 20 bp, Homo sapiens
gatgtaatatagggtttgtt

SEQ ID NO: 6255564 - DNA, 20 bp, Homo sapiens
gatgtaatctctctgcagct

SEQ ID NO: 6255565 - DNA, 21 bp, Homo sapiens
gatgtaatctctctgcagctg

SEQ ID NO: 6255566 - DNA, 22 bp, Homo sapiens
gatgtaatctctctgcagctgc

SEQ ID NO: 6255567 - DNA, 18 bp, Homo sapiens
gatgtaatgacagagagt

SEQ ID NO: 6255568 - DNA, 23 bp, Homo sapiens
gatgtaatgacagagagttctgg

SEQ ID NO: 6255569 - DNA, 18 bp, Homo sapiens
gatgtaattagctctggg

SEQ ID NO: 6255570 - DNA, 23 bp, Homo sapiens
gatgtaatttagggtactaaatt

SEQ ID NO: 6255571 - DNA, 17 bp, Homo sapiens
gatgtacagtctgtcat

SEQ ID NO: 6255572 - DNA, 19 bp, Homo sapiens
gatgtacagtctgtcatga

SEQ ID NO: 6255573 - DNA, 14 bp, Homo sapiens
gatgtacattaaat

SEQ ID NO: 6255574 - DNA, 17 bp, Homo sapiens
gatgtacattaaatacc

SEQ ID NO: 6255575 - DNA, 18 bp, Homo sapiens
gatgtacattaaatacca

SEQ ID NO: 6255576 - DNA, 15 bp, Homo sapiens
gatgtacattacaga

SEQ ID NO: 6255577 - DNA, 16 bp, Homo sapiens
gatgtacattacagat

SEQ ID NO: 6255578 - DNA, 15 bp, Homo sapiens
gatgtacatttccaa

SEQ ID NO: 6255579 - DNA, 14 bp, Homo sapiens
gatgtaccagtttg

SEQ ID NO: 6255580 - DNA, 19 bp, Homo sapiens
gatgtaccatgaaacaaag

SEQ ID NO: 6255581 - DNA, 15 bp, Homo sapiens
gatgtactaaagtag

SEQ ID NO: 6255582 - DNA, 22 bp, Homo sapiens
gatgtactgttgaaaaagataa

SEQ ID NO: 6255583 - DNA, 17 bp, Homo sapiens
gatgtagaaacaatatt

SEQ ID NO: 6255584 - DNA, 12 bp, Homo sapiens
gatgtagaactt

SEQ ID NO: 6255585 - DNA, 14 bp, Homo sapiens
gatgtagatttatt

SEQ ID NO: 6255586 - DNA, 15 bp, Homo sapiens
gatgtagatttattt

SEQ ID NO: 6255587 - DNA, 14 bp, Homo sapiens
gatgtagcattgtt

SEQ ID NO: 6255588 - DNA, 14 bp, Homo sapiens
gatgtagccaggga

SEQ ID NO: 6255589 - DNA, 14 bp, Homo sapiens
gatgtaggagctgg

SEQ ID NO: 6255590 - DNA, 14 bp, Homo sapiens
gatgtaggagggac

SEQ ID NO: 6255591 - DNA, 13 bp, Homo sapiens
gatgtaggcattc

SEQ ID NO: 6255592 - DNA, 13 bp, Homo sapiens
gatgtagtcacat

SEQ ID NO: 6255593 - DNA, 20 bp, Homo sapiens
gatgtagttctgccaggcaa

SEQ ID NO: 6255594 - DNA, 14 bp, Homo sapiens
gatgtataatacat

SEQ ID NO: 6255595 - DNA, 18 bp, Homo sapiens
gatgtatccatgggggca

SEQ ID NO: 6255596 - DNA, 20 bp, Homo sapiens
gatgtatgaaggcttttggt

SEQ ID NO: 6255597 - DNA, 21 bp, Homo sapiens
gatgtatgaatacagcagcaa

SEQ ID NO: 6255598 - DNA, 14 bp, Homo sapiens
gatgtatgtgtata

SEQ ID NO: 6255599 - DNA, 17 bp, Homo sapiens
gatgtatgttggttttt

SEQ ID NO: 6255600 - DNA, 20 bp, Homo sapiens
gatgtattaacctacctgtg

SEQ ID NO: 6255601 - DNA, 20 bp, Homo sapiens
gatgtattttcaataaagaa

SEQ ID NO: 6255602 - DNA, 14 bp, Homo sapiens
gatgtattttcata

SEQ ID NO: 6255603 - DNA, 16 bp, Homo sapiens
gatgtattttcatagt

SEQ ID NO: 6255604 - DNA, 23 bp, Homo sapiens
gatgtcaaccttgtgtgagtgtg

SEQ ID NO: 6255605 - DNA, 16 bp, Homo sapiens
gatgtcaagctggccg

SEQ ID NO: 6255606 - DNA, 19 bp, Homo sapiens
gatgtcaagctggccgtgg

SEQ ID NO: 6255607 - DNA, 15 bp, Homo sapiens
gatgtcaatagcatt

SEQ ID NO: 6255608 - DNA, 16 bp, Homo sapiens
gatgtcaatagcattg

SEQ ID NO: 6255609 - DNA, 19 bp, Homo sapiens
gatgtcaatagcattgttt

SEQ ID NO: 6255610 - DNA, 18 bp, Homo sapiens
gatgtcaatttctgtgtt

SEQ ID NO: 6255611 - DNA, 21 bp, Homo sapiens
gatgtcagcagacacacatgg

SEQ ID NO: 6255612 - DNA, 17 bp, Homo sapiens
gatgtcagcagttgctg

SEQ ID NO: 6255613 - DNA, 22 bp, Homo sapiens
gatgtcagccgagccgggcctg

SEQ ID NO: 6255614 - DNA, 12 bp, Homo sapiens
gatgtcagcctt

SEQ ID NO: 6255615 - DNA, 19 bp, Homo sapiens
gatgtcagcttcccagcca

SEQ ID NO: 6255616 - DNA, 20 bp, Homo sapiens
gatgtcagcttcccagccat

SEQ ID NO: 6255617 - DNA, 22 bp, Homo sapiens
gatgtcagtatttcaactgctg

SEQ ID NO: 6255618 - DNA, 13 bp, Homo sapiens
gatgtcatatcat

SEQ ID NO: 6255619 - DNA, 20 bp, Homo sapiens
gatgtcatcagagctcctct

SEQ ID NO: 6255620 - DNA, 14 bp, Homo sapiens
gatgtcatcttgag

SEQ ID NO: 6255621 - DNA, 14 bp, Homo sapiens
gatgtcatgtgttc

SEQ ID NO: 6255622 - DNA, 16 bp, Homo sapiens
gatgtcatgtgttccc

SEQ ID NO: 6255623 - DNA, 16 bp, Homo sapiens
gatgtcatttgagcag

SEQ ID NO: 6255624 - DNA, 17 bp, Homo sapiens
gatgtccacagatgcct

SEQ ID NO: 6255625 - DNA, 20 bp, Homo sapiens
gatgtccacagatgcctcca

SEQ ID NO: 6255626 - DNA, 13 bp, Homo sapiens
gatgtccagagct

SEQ ID NO: 6255627 - DNA, 16 bp, Homo sapiens
gatgtccagggcccca

SEQ ID NO: 6255628 - DNA, 16 bp, Homo sapiens
gatgtccagggggaga

SEQ ID NO: 6255629 - DNA, 11 bp, Homo sapiens
gatgtcccagt

SEQ ID NO: 6255630 - DNA, 16 bp, Homo sapiens
gatgtcccatctgctc

SEQ ID NO: 6255631 - DNA, 22 bp, Homo sapiens
gatgtcccatctgctcctccca

SEQ ID NO: 6255632 - DNA, 14 bp, Homo sapiens
gatgtccccaaagt

SEQ ID NO: 6255633 - DNA, 22 bp, Homo sapiens
gatgtccccaatgctgtacctg

SEQ ID NO: 6255634 - DNA, 12 bp, Homo sapiens
gatgtcccccac

SEQ ID NO: 6255635 - DNA, 17 bp, Homo sapiens
gatgtcccctgtcccac

SEQ ID NO: 6255636 - DNA, 16 bp, Homo sapiens
gatgtccctgggccag

SEQ ID NO: 6255637 - DNA, 21 bp, Homo sapiens
gatgtccctgggccagggtct

SEQ ID NO: 6255638 - DNA, 11 bp, Homo sapiens
gatgtccctgt

SEQ ID NO: 6255639 - DNA, 16 bp, Homo sapiens
gatgtccctgtcccct

SEQ ID NO: 6255640 - DNA, 20 bp, Homo sapiens
gatgtccctttcttggccag

SEQ ID NO: 6255641 - DNA, 21 bp, Homo sapiens
gatgtccctttcttggccagt

SEQ ID NO: 6255642 - DNA, 22 bp, Homo sapiens
gatgtcctcctctgtgaaactg

SEQ ID NO: 6255643 - DNA, 22 bp, Homo sapiens
gatgtccttggactccatcgct

SEQ ID NO: 6255644 - DNA, 23 bp, Homo sapiens
gatgtcgatgctcactgcttctg

SEQ ID NO: 6255645 - DNA, 21 bp, Homo sapiens
gatgtctaaaagattctttaa

SEQ ID NO: 6255646 - DNA, 21 bp, Homo sapiens
gatgtctcctcaagcctgtgg

SEQ ID NO: 6255647 - DNA, 22 bp, Homo sapiens
gatgtctcctcaagcctgtggg

SEQ ID NO: 6255648 - DNA, 21 bp, Homo sapiens
gatgtctctgacaaagtgtgt

SEQ ID NO: 6255649 - DNA, 15 bp, Homo sapiens
gatgtctctggggca

SEQ ID NO: 6255650 - DNA, 22 bp, Homo sapiens
gatgtctgaggataccttccat

SEQ ID NO: 6255651 - DNA, 14 bp, Homo sapiens
gatgtctgccaatt

SEQ ID NO: 6255652 - DNA, 19 bp, Homo sapiens
gcctggattccagcagtga

SEQ ID NO: 6255653 - DNA, 19 bp, Homo sapiens
gcctggattgggagccatt

SEQ ID NO: 6255654 - DNA, 23 bp, Homo sapiens
gcctggatttctggttctgatgc

SEQ ID NO: 6255655 - DNA, 17 bp, Homo sapiens
gcctggatttcttccta

SEQ ID NO: 6255656 - DNA, 9 bp, Homo sapiens
gcctggcaa

SEQ ID NO: 6255657 - DNA, 15 bp, Homo sapiens
gcctggcaacagagc

SEQ ID NO: 6255658 - DNA, 18 bp, Homo sapiens
gcctggcaacagagcaag

SEQ ID NO: 6255659 - DNA, 19 bp, Homo sapiens
gcctggcaacagagcgaga

SEQ ID NO: 6255660 - DNA, 16 bp, Homo sapiens
gcctggcacacatcag

SEQ ID NO: 6255661 - DNA, 21 bp, Homo sapiens
gcctggcacagaccaggcctt

SEQ ID NO: 6255662 - DNA, 23 bp, Homo sapiens
gcctggcacaggccgaggcagga

SEQ ID NO: 6255663 - DNA, 14 bp, Homo sapiens
gcctggcacagggc

SEQ ID NO: 6255664 - DNA, 19 bp, Homo sapiens
gcctggcacagggcagtgg

SEQ ID NO: 6255665 - DNA, 18 bp, Homo sapiens
gcctggcacatcagaaag

SEQ ID NO: 6255666 - DNA, 16 bp, Homo sapiens
gcctggcacatttcag

SEQ ID NO: 6255667 - DNA, 14 bp, Homo sapiens
gcctggcacccacc

SEQ ID NO: 6255668 - DNA, 15 bp, Homo sapiens
gcctggcacccaccg

SEQ ID NO: 6255669 - DNA, 16 bp, Homo sapiens
gcctggcacccactcc

SEQ ID NO: 6255670 - DNA, 20 bp, Homo sapiens
gcctggcacttactggtcct

SEQ ID NO: 6255671 - DNA, 21 bp, Homo sapiens
gcctggcacttactggtcctt

SEQ ID NO: 6255672 - DNA, 13 bp, Homo sapiens
gcctggcagaact

SEQ ID NO: 6255673 - DNA, 22 bp, Homo sapiens
gcctggcagaactgagctcctc

SEQ ID NO: 6255674 - DNA, 20 bp, Homo sapiens
gcctggcagccgtgccttca

SEQ ID NO: 6255675 - DNA, 16 bp, Homo sapiens
gcctggcaggccagtg

SEQ ID NO: 6255676 - DNA, 17 bp, Homo sapiens
gcctggcaggtgccccg

SEQ ID NO: 6255677 - DNA, 22 bp, Homo sapiens
gcctggcatcagtttaggcctt

SEQ ID NO: 6255678 - DNA, 15 bp, Homo sapiens
gcctggcatctgtgt

SEQ ID NO: 6255679 - DNA, 19 bp, Homo sapiens
gcctggccaacatggtgaa

SEQ ID NO: 6255680 - DNA, 14 bp, Homo sapiens
gcctggccaccagc

SEQ ID NO: 6255681 - DNA, 18 bp, Homo sapiens
gcctggccaccagccatc

SEQ ID NO: 6255682 - DNA, 16 bp, Homo sapiens
gcctggccacctctct

SEQ ID NO: 6255683 - DNA, 19 bp, Homo sapiens
gcctggccacgcagccagg

SEQ ID NO: 6255684 - DNA, 20 bp, Homo sapiens
gcctggccacgcagccagga

SEQ ID NO: 6255685 - DNA, 21 bp, Homo sapiens
gcctggccacgcagccaggac

SEQ ID NO: 6255686 - DNA, 23 bp, Homo sapiens
gcctggccacgcagccaggacac

SEQ ID NO: 6255687 - DNA, 15 bp, Homo sapiens
gcctggccagaccag

SEQ ID NO: 6255688 - DNA, 16 bp, Homo sapiens
gcctggccagatgcac

SEQ ID NO: 6255689 - DNA, 22 bp, Homo sapiens
gcctggccagatgcaccagccc

SEQ ID NO: 6255690 - DNA, 21 bp, Homo sapiens
gcctggccagatttttctttt

SEQ ID NO: 6255691 - DNA, 16 bp, Homo sapiens
gcctggccagcctaca

SEQ ID NO: 6255692 - DNA, 14 bp, Homo sapiens
gcctggccaggagc

SEQ ID NO: 6255693 - DNA, 15 bp, Homo sapiens
gcctggccaggagct

SEQ ID NO: 6255694 - DNA, 15 bp, Homo sapiens
gcctggccaggcacc

SEQ ID NO: 6255695 - DNA, 15 bp, Homo sapiens
gcctggccaggcaga

SEQ ID NO: 6255696 - DNA, 23 bp, Homo sapiens
gcctggccaggcagatctgtgcc

SEQ ID NO: 6255697 - DNA, 17 bp, Homo sapiens
gcctggccaggcaggga

SEQ ID NO: 6255698 - DNA, 14 bp, Homo sapiens
gcctggccagggca

SEQ ID NO: 6255699 - DNA, 19 bp, Homo sapiens
gcctggccagggcagggcc

SEQ ID NO: 6255700 - DNA, 21 bp, Homo sapiens
gcctggccagggcagggccac

SEQ ID NO: 6255701 - DNA, 15 bp, Homo sapiens
gcctggccagtgccc

SEQ ID NO: 6255702 - DNA, 17 bp, Homo sapiens
gcctggccagtgccctg

SEQ ID NO: 6255703 - DNA, 16 bp, Homo sapiens
gcctggccatcatggc

SEQ ID NO: 6255704 - DNA, 21 bp, Homo sapiens
gcctggccatctccctcccca

SEQ ID NO: 6255705 - DNA, 14 bp, Homo sapiens
gcctggccatgctg

SEQ ID NO: 6255706 - DNA, 16 bp, Homo sapiens
gcctggccatgtcctc

SEQ ID NO: 6255707 - DNA, 22 bp, Homo sapiens
gcctggcccacagcaggtgctg

SEQ ID NO: 6255708 - DNA, 17 bp, Homo sapiens
gcctggcccacgccctc

SEQ ID NO: 6255709 - DNA, 18 bp, Homo sapiens
gcctggcccacgccctcc

SEQ ID NO: 6255710 - DNA, 16 bp, Homo sapiens
gcctggcccagccagc

SEQ ID NO: 6255711 - DNA, 19 bp, Homo sapiens
gcctggcccagccagcagg

SEQ ID NO: 6255712 - DNA, 13 bp, Homo sapiens
gcctggcccagct

SEQ ID NO: 6255713 - DNA, 17 bp, Homo sapiens
gcctggcccagctcccc

SEQ ID NO: 6255714 - DNA, 18 bp, Homo sapiens
gcctggcccagggaggaa

SEQ ID NO: 6255715 - DNA, 19 bp, Homo sapiens
gcctggcccatagaaacat

SEQ ID NO: 6255716 - DNA, 11 bp, Homo sapiens
gcctggcccca

SEQ ID NO: 6255717 - DNA, 16 bp, Homo sapiens
gcctggccccaaatgt

SEQ ID NO: 6255718 - DNA, 15 bp, Homo sapiens
gcctggccccagcct

SEQ ID NO: 6255719 - DNA, 14 bp, Homo sapiens
gcctggccccaggc

SEQ ID NO: 6255720 - DNA, 18 bp, Homo sapiens
gcctggccccaggcccca

SEQ ID NO: 6255721 - DNA, 18 bp, Homo sapiens
gcctggcccccagctgtg

SEQ ID NO: 6255722 - DNA, 20 bp, Homo sapiens
gcctggcccccctccaggca

SEQ ID NO: 6255723 - DNA, 22 bp, Homo sapiens
gcctggcccccgacccagctct

SEQ ID NO: 6255724 - DNA, 20 bp, Homo sapiens
gcctggccccggcctttatg

SEQ ID NO: 6255725 - DNA, 13 bp, Homo sapiens
gcctggcccctca

SEQ ID NO: 6255726 - DNA, 22 bp, Homo sapiens
gcctggcccctcagggtccctg

SEQ ID NO: 6255727 - DNA, 13 bp, Homo sapiens
gcctggccctccc

SEQ ID NO: 6255728 - DNA, 17 bp, Homo sapiens
gcctggccctcctggct

SEQ ID NO: 6255729 - DNA, 16 bp, Homo sapiens
gcctggccctgccctg

SEQ ID NO: 6255730 - DNA, 17 bp, Homo sapiens
gcctggccctgccctga

SEQ ID NO: 6255731 - DNA, 16 bp, Homo sapiens
gcctggcccttgagtg

SEQ ID NO: 6255732 - DNA, 16 bp, Homo sapiens
gcctggcccttgccgg

SEQ ID NO: 6255733 - DNA, 21 bp, Homo sapiens
gcctggccctttcacccctct

SEQ ID NO: 6255734 - DNA, 18 bp, Homo sapiens
gcctggccgcagggcggg

SEQ ID NO: 6255735 - DNA, 15 bp, Homo sapiens
gcctggccgcagtcc

SEQ ID NO: 6255736 - DNA, 13 bp, Homo sapiens
gcctggccggcca

SEQ ID NO: 6255737 - DNA, 18 bp, Homo sapiens
gcctggccggccagccag

SEQ ID NO: 6255738 - DNA, 20 bp, Homo sapiens
gcctggccggccagccagcc

SEQ ID NO: 6255739 - DNA, 18 bp, Homo sapiens
gcctggccgttcagcctg

SEQ ID NO: 6255740 - DNA, 14 bp, Homo sapiens
gcctggcctattta

SEQ ID NO: 6255741 - DNA, 13 bp, Homo sapiens
gcctggcctcatc

SEQ ID NO: 6255742 - DNA, 11 bp, Homo sapiens
gcctggcctcc

SEQ ID NO: 6255743 - DNA, 14 bp, Homo sapiens
gcctggcctccagc

SEQ ID NO: 6255744 - DNA, 15 bp, Homo sapiens
gcctggcctccagct

SEQ ID NO: 6255745 - DNA, 17 bp, Homo sapiens
gcctggcctccagctcc

SEQ ID NO: 6255746 - DNA, 17 bp, Homo sapiens
gcctggcctccaggccc

SEQ ID NO: 6255747 - DNA, 14 bp, Homo sapiens
gcctggcctcctgc

SEQ ID NO: 6255748 - DNA, 16 bp, Homo sapiens
gcctggcctcctgcct

SEQ ID NO: 6255749 - DNA, 17 bp, Homo sapiens
gcctggcctcgcctgcc

SEQ ID NO: 6255750 - DNA, 18 bp, Homo sapiens
gcctggcctcgcctgcct

SEQ ID NO: 6255751 - DNA, 23 bp, Homo sapiens
gcctggcctcgcctgcctttctg

SEQ ID NO: 6255752 - DNA, 13 bp, Homo sapiens
gcctggcctctgg

SEQ ID NO: 6255753 - DNA, 10 bp, Homo sapiens
gcctggcctg

SEQ ID NO: 6255754 - DNA, 13 bp, Homo sapiens
gcctggcctgagc

SEQ ID NO: 6255755 - DNA, 16 bp, Homo sapiens
gcctggcctgagctgg

SEQ ID NO: 6255756 - DNA, 14 bp, Homo sapiens
gcctggcctgagga

SEQ ID NO: 6255757 - DNA, 17 bp, Homo sapiens
gcctggcctgaggaccc

SEQ ID NO: 6255758 - DNA, 14 bp, Homo sapiens
gcctggcctgaggt

SEQ ID NO: 6255759 - DNA, 12 bp, Homo sapiens
gcctggcctgat

SEQ ID NO: 6255760 - DNA, 16 bp, Homo sapiens
gcctggcctgcccgtg

SEQ ID NO: 6255761 - DNA, 16 bp, Homo sapiens
gcctggcctggcaccg

SEQ ID NO: 6255762 - DNA, 13 bp, Homo sapiens
gcctggcctggcc

SEQ ID NO: 6255763 - DNA, 16 bp, Homo sapiens
gcctggcctggccctg

SEQ ID NO: 6255764 - DNA, 17 bp, Homo sapiens
gcctggcctggccctgc

SEQ ID NO: 6255765 - DNA, 22 bp, Homo sapiens
gcctggccttgtcctcagccag

SEQ ID NO: 6255766 - DNA, 23 bp, Homo sapiens
gcctggccttgtcctcagccagt

SEQ ID NO: 6255767 - DNA, 21 bp, Homo sapiens
gcctggcgaaaccccatctct

SEQ ID NO: 6255768 - DNA, 19 bp, Homo sapiens
gcctggcgacagagcgaga

SEQ ID NO: 6255769 - DNA, 22 bp, Homo sapiens
gcctggcggaggtggagtggcc

SEQ ID NO: 6255770 - DNA, 15 bp, Homo sapiens
gcctggcggcagggg

SEQ ID NO: 6255771 - DNA, 13 bp, Homo sapiens
gcctggcgggcag

SEQ ID NO: 6255772 - DNA, 14 bp, Homo sapiens
gcctggcgggcagc

SEQ ID NO: 6255773 - DNA, 18 bp, Homo sapiens
gcctggcgggcagcccct

SEQ ID NO: 6255774 - DNA, 21 bp, Homo sapiens
gcctggcgggcagcccctgct

SEQ ID NO: 6255775 - DNA, 20 bp, Homo sapiens
gcctggcggggcaggaggcc

SEQ ID NO: 6255776 - DNA, 23 bp, Homo sapiens
gcctggcgtggggggagctctgg

SEQ ID NO: 6255777 - DNA, 14 bp, Homo sapiens
gcctggctagaaaa

SEQ ID NO: 6255778 - DNA, 15 bp, Homo sapiens
gcctggctagaaaac

SEQ ID NO: 6255779 - DNA, 22 bp, Homo sapiens
gcctggctcccacaggcagctt

SEQ ID NO: 6255780 - DNA, 23 bp, Homo sapiens
gcctggctcccacaggcagcttt

SEQ ID NO: 6255781 - DNA, 17 bp, Homo sapiens
gcctggctcccaggaca

SEQ ID NO: 6255782 - DNA, 23 bp, Homo sapiens
gcctggctccccacgagtcacct

SEQ ID NO: 6255783 - DNA, 14 bp, Homo sapiens
gcctggctccccga

SEQ ID NO: 6255784 - DNA, 21 bp, Homo sapiens
gcctggctccctcactctcag

SEQ ID NO: 6255785 - DNA, 22 bp, Homo sapiens
gcctggctccctcactctcagg

SEQ ID NO: 6255786 - DNA, 13 bp, Homo sapiens
gcctggctccctg

SEQ ID NO: 6255787 - DNA, 15 bp, Homo sapiens
gcctggctccctgat

SEQ ID NO: 6255788 - DNA, 21 bp, Homo sapiens
gcctggctccctgatggggga

SEQ ID NO: 6255789 - DNA, 21 bp, Homo sapiens
gcctggctctgattcttcatt

SEQ ID NO: 6255790 - DNA, 13 bp, Homo sapiens
gcctggctctgga

SEQ ID NO: 6255791 - DNA, 14 bp, Homo sapiens
gcctggctctggag

SEQ ID NO: 6255792 - DNA, 21 bp, Homo sapiens
gcctggctcttgtgctggatg

SEQ ID NO: 6255793 - DNA, 21 bp, Homo sapiens
gcctggctgctgatcgccttc

SEQ ID NO: 6255794 - DNA, 11 bp, Homo sapiens
gcctggctgga

SEQ ID NO: 6255795 - DNA, 18 bp, Homo sapiens
gcctggctggaagagggt

SEQ ID NO: 6255796 - DNA, 18 bp, Homo sapiens
gcctggctggagagctgc

SEQ ID NO: 6255797 - DNA, 19 bp, Homo sapiens
gcctggctggagagctgct

SEQ ID NO: 6255798 - DNA, 15 bp, Homo sapiens
gcctggctggctgag

SEQ ID NO: 6255799 - DNA, 18 bp, Homo sapiens
gcctggctggctgagggc

SEQ ID NO: 6255800 - DNA, 19 bp, Homo sapiens
gcctggctggtttgcccag

SEQ ID NO: 6255801 - DNA, 14 bp, Homo sapiens
gcctggctgtcacc

SEQ ID NO: 6255802 - DNA, 12 bp, Homo sapiens
gcctggctgtgg

SEQ ID NO: 6255803 - DNA, 21 bp, Homo sapiens
gcctggctgtggaggcctgat

SEQ ID NO: 6255804 - DNA, 24 bp, Homo sapiens
gcctggctgtggaggcctgatgct

SEQ ID NO: 6255805 - DNA, 17 bp, Homo sapiens
gcctggcttagaaggca

SEQ ID NO: 6255806 - DNA, 20 bp, Homo sapiens
gcctggcttcaccgcattcc

SEQ ID NO: 6255807 - DNA, 21 bp, Homo sapiens
gcctggcttcaccgcattcca

SEQ ID NO: 6255808 - DNA, 22 bp, Homo sapiens
gcctggcttcaccgcattccag

SEQ ID NO: 6255809 - DNA, 16 bp, Homo sapiens
gcctggcttctggagc

SEQ ID NO: 6255810 - DNA, 17 bp, Homo sapiens
gcctggcttgctccagg

SEQ ID NO: 6255811 - DNA, 18 bp, Homo sapiens
gcctggcttgctccaggg

SEQ ID NO: 6255812 - DNA, 15 bp, Homo sapiens
gcctggcttgctgtg

SEQ ID NO: 6255813 - DNA, 16 bp, Homo sapiens
gcctggcttgctgtgg

SEQ ID NO: 6255814 - DNA, 17 bp, Homo sapiens
gcctggcttgctgtggc

SEQ ID NO: 6255815 - DNA, 22 bp, Homo sapiens
gcctggctttggtccccagcat

SEQ ID NO: 6255816 - DNA, 15 bp, Homo sapiens
gcctggcttttctgg

SEQ ID NO: 6255817 - DNA, 18 bp, Homo sapiens
gcctgggaaaccctctcc

SEQ ID NO: 6255818 - DNA, 14 bp, Homo sapiens
gcctgggaaaggaa

SEQ ID NO: 6255819 - DNA, 16 bp, Homo sapiens
gcctgggaaaggaaaa

SEQ ID NO: 6255820 - DNA, 17 bp, Homo sapiens
gcctgggaaaggaaaac

SEQ ID NO: 6255821 - DNA, 14 bp, Homo sapiens
gcctgggaagccca

SEQ ID NO: 6255822 - DNA, 22 bp, Homo sapiens
gcctgggacaactgctcccacc

SEQ ID NO: 6255823 - DNA, 23 bp, Homo sapiens
gcctgggacacttccctgggcct

SEQ ID NO: 6255824 - DNA, 16 bp, Homo sapiens
gcctgggaccagggca

SEQ ID NO: 6255825 - DNA, 17 bp, Homo sapiens
gcctgggaccagggcat

SEQ ID NO: 6255826 - DNA, 16 bp, Homo sapiens
gcctgggacccagcta

SEQ ID NO: 6255827 - DNA, 18 bp, Homo sapiens
gcctgggacccagctact

SEQ ID NO: 6255828 - DNA, 21 bp, Homo sapiens
gcctgggacgcccctttctct

SEQ ID NO: 6255829 - DNA, 17 bp, Homo sapiens
gcctgggacttccatgc

SEQ ID NO: 6255830 - DNA, 20 bp, Homo sapiens
gcctgggagatgcagctgga

SEQ ID NO: 6255831 - DNA, 22 bp, Homo sapiens
gatgtctgtgagtacctggtca

SEQ ID NO: 6255832 - DNA, 16 bp, Homo sapiens
gatgtctgtgtataca

SEQ ID NO: 6255833 - DNA, 22 bp, Homo sapiens
gatgtctgttgaaataaaacat

SEQ ID NO: 6255834 - DNA, 19 bp, Homo sapiens
gatgtctgtttgctgatgg

SEQ ID NO: 6255835 - DNA, 22 bp, Homo sapiens
gatgtcttaacctattcccaaa

SEQ ID NO: 6255836 - DNA, 20 bp, Homo sapiens
gatgtcttaactgtcaccca

SEQ ID NO: 6255837 - DNA, 22 bp, Homo sapiens
gatgtcttcatcacttcttcca

SEQ ID NO: 6255838 - DNA, 14 bp, Homo sapiens
gatgtcttctgcct

SEQ ID NO: 6255839 - DNA, 15 bp, Homo sapiens
gatgtcttgagagcg

SEQ ID NO: 6255840 - DNA, 18 bp, Homo sapiens
gatgtcttgagagcgctg

SEQ ID NO: 6255841 - DNA, 22 bp, Homo sapiens
gatgtcttgagagcgctggcct

SEQ ID NO: 6255842 - DNA, 13 bp, Homo sapiens
gatgtgaaaatat

SEQ ID NO: 6255843 - DNA, 19 bp, Homo sapiens
gatgtgaaacactttgcct

SEQ ID NO: 6255844 - DNA, 18 bp, Homo sapiens
gatgtgaaagataaatga

SEQ ID NO: 6255845 - DNA, 22 bp, Homo sapiens
gatgtgaaattcatttgtggca

SEQ ID NO: 6255846 - DNA, 16 bp, Homo sapiens
gatgtgaacacatcag

SEQ ID NO: 6255847 - DNA, 20 bp, Homo sapiens
gatgtgaagataatttgcat

SEQ ID NO: 6255848 - DNA, 13 bp, Homo sapiens
gatgtgaagccaa

SEQ ID NO: 6255849 - DNA, 14 bp, Homo sapiens
gatgtgaagccaat

SEQ ID NO: 6255850 - DNA, 22 bp, Homo sapiens
gatgtgaattattgacactgaa

SEQ ID NO: 6255851 - DNA, 15 bp, Homo sapiens
gatgtgacattccat

SEQ ID NO: 6255852 - DNA, 18 bp, Homo sapiens
gatgtgacccaccagtgc

SEQ ID NO: 6255853 - DNA, 20 bp, Homo sapiens
gatgtgacggggtgtgtggc

SEQ ID NO: 6255854 - DNA, 12 bp, Homo sapiens
gatgtgagcccc

SEQ ID NO: 6255855 - DNA, 13 bp, Homo sapiens
gatgtgagccttg

SEQ ID NO: 6255856 - DNA, 18 bp, Homo sapiens
gatgtgatatataagtgt

SEQ ID NO: 6255857 - DNA, 19 bp, Homo sapiens
gatgtgatatattcctaaa

SEQ ID NO: 6255858 - DNA, 15 bp, Homo sapiens
gatgtgatcaggccc

SEQ ID NO: 6255859 - DNA, 18 bp, Homo sapiens
gatgtgatcaggccccac

SEQ ID NO: 6255860 - DNA, 20 bp, Homo sapiens
gatgtgatcatagctcactg

SEQ ID NO: 6255861 - DNA, 18 bp, Homo sapiens
gatgtgatggaacacaca

SEQ ID NO: 6255862 - DNA, 19 bp, Homo sapiens
gatgtgatggaacacacac

SEQ ID NO: 6255863 - DNA, 15 bp, Homo sapiens
gatgtgatgtggcag

SEQ ID NO: 6255864 - DNA, 15 bp, Homo sapiens
gatgtgattgtggaa

SEQ ID NO: 6255865 - DNA, 18 bp, Homo sapiens
gatgtgattgtggaatgg

SEQ ID NO: 6255866 - DNA, 18 bp, Homo sapiens
gatgtgatttaatagtgt

SEQ ID NO: 6255867 - DNA, 16 bp, Homo sapiens
gatgtgcaacctgtgg

SEQ ID NO: 6255868 - DNA, 21 bp, Homo sapiens
gatgtgcaacctgtggctcag

SEQ ID NO: 6255869 - DNA, 23 bp, Homo sapiens
gatgtgcaacctgtggctcaggg

SEQ ID NO: 6255870 - DNA, 20 bp, Homo sapiens
gatgtgcaataatttgtaca

SEQ ID NO: 6255871 - DNA, 18 bp, Homo sapiens
gatgtgcaatacattttt

SEQ ID NO: 6255872 - DNA, 20 bp, Homo sapiens
gatgtgcacggcagcttgag

SEQ ID NO: 6255873 - DNA, 14 bp, Homo sapiens
gatgtgcaggaaga

SEQ ID NO: 6255874 - DNA, 15 bp, Homo sapiens
gatgtgcaggaagaa

SEQ ID NO: 6255875 - DNA, 17 bp, Homo sapiens
gatgtgcagtttggaat

SEQ ID NO: 6255876 - DNA, 16 bp, Homo sapiens
gatgtgcatctggcct

SEQ ID NO: 6255877 - DNA, 17 bp, Homo sapiens
gatgtgcatctggccta

SEQ ID NO: 6255878 - DNA, 11 bp, Homo sapiens
gatgtgcattc

SEQ ID NO: 6255879 - DNA, 17 bp, Homo sapiens
gatgtgccaataaccaa

SEQ ID NO: 6255880 - DNA, 15 bp, Homo sapiens
gatgtgcccccaccc

SEQ ID NO: 6255881 - DNA, 23 bp, Homo sapiens
gatgtgcccccacccccaccctc

SEQ ID NO: 6255882 - DNA, 18 bp, Homo sapiens
gatgtgccctagatcaac

SEQ ID NO: 6255883 - DNA, 13 bp, Homo sapiens
gatgtgcctgggt

SEQ ID NO: 6255884 - DNA, 15 bp, Homo sapiens
gatgtgctgctttga

SEQ ID NO: 6255885 - DNA, 18 bp, Homo sapiens
gatgtgctggaggggtgg

SEQ ID NO: 6255886 - DNA, 19 bp, Homo sapiens
gatgtgctgttttctgtaa

SEQ ID NO: 6255887 - DNA, 21 bp, Homo sapiens
gatgtgctgttttctgtaaat

SEQ ID NO: 6255888 - DNA, 12 bp, Homo sapiens
gatgtgcttctg

SEQ ID NO: 6255889 - DNA, 16 bp, Homo sapiens
gatgtgctttgtggct

SEQ ID NO: 6255890 - DNA, 21 bp, Homo sapiens
gatgtggaaaagccaagaggc

SEQ ID NO: 6255891 - DNA, 17 bp, Homo sapiens
gatgtggaaagcacttt

SEQ ID NO: 6255892 - DNA, 17 bp, Homo sapiens
gatgtggaacctgttta

SEQ ID NO: 6255893 - DNA, 18 bp, Homo sapiens
gatgtggaactgctgcca

SEQ ID NO: 6255894 - DNA, 15 bp, Homo sapiens
gatgtggacatgcac

SEQ ID NO: 6255895 - DNA, 21 bp, Homo sapiens
gatgtggacatgcacccgcat

SEQ ID NO: 6255896 - DNA, 23 bp, Homo sapiens
gatgtggacgtcacgctccctga

SEQ ID NO: 6255897 - DNA, 24 bp, Homo sapiens
gatgtggagcacaaaagcctctca

SEQ ID NO: 6255898 - DNA, 13 bp, Homo sapiens
gatgtggagccag

SEQ ID NO: 6255899 - DNA, 16 bp, Homo sapiens
gatgtggagccaggcg

SEQ ID NO: 6255900 - DNA, 13 bp, Homo sapiens
gatgtggaggaag

SEQ ID NO: 6255901 - DNA, 20 bp, Homo sapiens
gatgtggaggaagagccacc

SEQ ID NO: 6255902 - DNA, 23 bp, Homo sapiens
gatgtggaggaagagccacctgc

SEQ ID NO: 6255903 - DNA, 23 bp, Homo sapiens
gatgtggagggtggcgccctgcg

SEQ ID NO: 6255904 - DNA, 17 bp, Homo sapiens
gatgtggcaaagtgctg

SEQ ID NO: 6255905 - DNA, 18 bp, Homo sapiens
gatgtggcaggggcagtg

SEQ ID NO: 6255906 - DNA, 22 bp, Homo sapiens
gatgtggccaggggtgctcctg

SEQ ID NO: 6255907 - DNA, 13 bp, Homo sapiens
gatgtggccctgg

SEQ ID NO: 6255908 - DNA, 14 bp, Homo sapiens
gatgtggccctggc

SEQ ID NO: 6255909 - DNA, 21 bp, Homo sapiens
gatgtggccctggcctgctgg

SEQ ID NO: 6255910 - DNA, 18 bp, Homo sapiens
gatgtggctgcagcagcg

SEQ ID NO: 6255911 - DNA, 22 bp, Homo sapiens
gatgtgggagggagcagacagg

SEQ ID NO: 6255912 - DNA, 23 bp, Homo sapiens
gatgtgggagggagcagacagga

SEQ ID NO: 6255913 - DNA, 22 bp, Homo sapiens
gatgtgggccaagtccactgtc

SEQ ID NO: 6255914 - DNA, 20 bp, Homo sapiens
gatgtgggggaagacctggc

SEQ ID NO: 6255915 - DNA, 15 bp, Homo sapiens
gatgtgggtgtcctg

SEQ ID NO: 6255916 - DNA, 18 bp, Homo sapiens
gatgtgggttccacagac

SEQ ID NO: 6255917 - DNA, 20 bp, Homo sapiens
gatgtggtaggtgataaaga

SEQ ID NO: 6255918 - DNA, 17 bp, Homo sapiens
gatgtggtcacagctgt

SEQ ID NO: 6255919 - DNA, 14 bp, Homo sapiens
gatgtggtgaaaag

SEQ ID NO: 6255920 - DNA, 22 bp, Homo sapiens
gatgtggtgcctgaggtctgta

SEQ ID NO: 6255921 - DNA, 16 bp, Homo sapiens
gatgtgtaaacaggta

SEQ ID NO: 6255922 - DNA, 17 bp, Homo sapiens
gatgtgtaaacaggtat

SEQ ID NO: 6255923 - DNA, 19 bp, Homo sapiens
gatgtgtaatttttctgta

SEQ ID NO: 6255924 - DNA, 15 bp, Homo sapiens
gatgtgtcatctaat

SEQ ID NO: 6255925 - DNA, 11 bp, Homo sapiens
gatgtgtcctg

SEQ ID NO: 6255926 - DNA, 19 bp, Homo sapiens
gatgtgtcctgacactgca

SEQ ID NO: 6255927 - DNA, 21 bp, Homo sapiens
gatgtgtcctgataagctgag

SEQ ID NO: 6255928 - DNA, 18 bp, Homo sapiens
gatgtgtcctttctgaac

SEQ ID NO: 6255929 - DNA, 17 bp, Homo sapiens
gatgtgtctcccagaac

SEQ ID NO: 6255930 - DNA, 13 bp, Homo sapiens
gatgtgtctgtat

SEQ ID NO: 6255931 - DNA, 20 bp, Homo sapiens
gatgtgtggctcattctttt

SEQ ID NO: 6255932 - DNA, 13 bp, Homo sapiens
gatgtgtggggca

SEQ ID NO: 6255933 - DNA, 18 bp, Homo sapiens
gatgtgtgttctcagtga

SEQ ID NO: 6255934 - DNA, 20 bp, Homo sapiens
gatgtgtgttgatactgttg

SEQ ID NO: 6255935 - DNA, 20 bp, Homo sapiens
gatgtgttcattcaagctat

SEQ ID NO: 6255936 - DNA, 16 bp, Homo sapiens
gatgtgttcctcctgc

SEQ ID NO: 6255937 - DNA, 18 bp, Homo sapiens
gatgtgttcctcctgctg

SEQ ID NO: 6255938 - DNA, 23 bp, Homo sapiens
gatgtgttggtttacagggtata

SEQ ID NO: 6255939 - DNA, 22 bp, Homo sapiens
gatgtgtttaaactgagtagca

SEQ ID NO: 6255940 - DNA, 22 bp, Homo sapiens
gatgtgtttacatttactgaaa

SEQ ID NO: 6255941 - DNA, 14 bp, Homo sapiens
gatgtgtttgcttt

SEQ ID NO: 6255942 - DNA, 17 bp, Homo sapiens
gatgtgttttgcacgtc

SEQ ID NO: 6255943 - DNA, 12 bp, Homo sapiens
gatgttaaaaca

SEQ ID NO: 6255944 - DNA, 17 bp, Homo sapiens
gatgttaaaataaatgg

SEQ ID NO: 6255945 - DNA, 20 bp, Homo sapiens
gatgttaaaataaatggttt

SEQ ID NO: 6255946 - DNA, 12 bp, Homo sapiens
gatgttaaaatc

SEQ ID NO: 6255947 - DNA, 20 bp, Homo sapiens
gatgttaaacgtcacagcag

SEQ ID NO: 6255948 - DNA, 14 bp, Homo sapiens
gatgttaaagcatt

SEQ ID NO: 6255949 - DNA, 12 bp, Homo sapiens
gatgttaaatgg

SEQ ID NO: 6255950 - DNA, 14 bp, Homo sapiens
gatgttaaatggaa

SEQ ID NO: 6255951 - DNA, 17 bp, Homo sapiens
gatgttaaatggaattc

SEQ ID NO: 6255952 - DNA, 20 bp, Homo sapiens
gatgttaacaagaggggaaa

SEQ ID NO: 6255953 - DNA, 11 bp, Homo sapiens
gatgttaacac

SEQ ID NO: 6255954 - DNA, 16 bp, Homo sapiens
gatgttaacagtattt

SEQ ID NO: 6255955 - DNA, 14 bp, Homo sapiens
gatgttaactatta

SEQ ID NO: 6255956 - DNA, 23 bp, Homo sapiens
gatgttacatcacagtgtttgca

SEQ ID NO: 6255957 - DNA, 16 bp, Homo sapiens
gatgttagaaagtgct

SEQ ID NO: 6255958 - DNA, 20 bp, Homo sapiens
gatgttagacttgctccctc

SEQ ID NO: 6255959 - DNA, 18 bp, Homo sapiens
gatgttagtgttttaaga

SEQ ID NO: 6255960 - DNA, 16 bp, Homo sapiens
gatgttagttttcctt

SEQ ID NO: 6255961 - DNA, 22 bp, Homo sapiens
gatgttatacatcaatatgtat

SEQ ID NO: 6255962 - DNA, 13 bp, Homo sapiens
gatgttatagaat

SEQ ID NO: 6255963 - DNA, 20 bp, Homo sapiens
gatgttatatttttcttaaa

SEQ ID NO: 6255964 - DNA, 19 bp, Homo sapiens
gatgttatgaacagctgtg

SEQ ID NO: 6255965 - DNA, 18 bp, Homo sapiens
gatgttcactgtggcatt

SEQ ID NO: 6255966 - DNA, 16 bp, Homo sapiens
gatgttcagaattttg

SEQ ID NO: 6255967 - DNA, 16 bp, Homo sapiens
gatgttcagagtggct

SEQ ID NO: 6255968 - DNA, 18 bp, Homo sapiens
gatgttcagagtggctca

SEQ ID NO: 6255969 - DNA, 20 bp, Homo sapiens
gatgttcagtgtaatttctt

SEQ ID NO: 6255970 - DNA, 19 bp, Homo sapiens
gatgttcatgatagaaaga

SEQ ID NO: 6255971 - DNA, 18 bp, Homo sapiens
gatgttcatggaattggt

SEQ ID NO: 6255972 - DNA, 21 bp, Homo sapiens
gatgttcatttttaaagcctg

SEQ ID NO: 6255973 - DNA, 22 bp, Homo sapiens
gatgttcatttttaaagcctgg

SEQ ID NO: 6255974 - DNA, 24 bp, Homo sapiens
gatgttcatttttaaagcctggct

SEQ ID NO: 6255975 - DNA, 17 bp, Homo sapiens
gatgttccacctgccac

SEQ ID NO: 6255976 - DNA, 16 bp, Homo sapiens
gatgttccagtgagga

SEQ ID NO: 6255977 - DNA, 17 bp, Homo sapiens
gatgttccagtgaggaa

SEQ ID NO: 6255978 - DNA, 14 bp, Homo sapiens
gatgttccttacca

SEQ ID NO: 6255979 - DNA, 12 bp, Homo sapiens
gatgttcctttt

SEQ ID NO: 6255980 - DNA, 18 bp, Homo sapiens
gatgttccttttatttat

SEQ ID NO: 6255981 - DNA, 12 bp, Homo sapiens
gatgttctaagg

SEQ ID NO: 6255982 - DNA, 16 bp, Homo sapiens
gatgttctaaggctct

SEQ ID NO: 6255983 - DNA, 18 bp, Homo sapiens
gatgttctagcatggctg

SEQ ID NO: 6255984 - DNA, 14 bp, Homo sapiens
gatgttctcctgat

SEQ ID NO: 6255985 - DNA, 17 bp, Homo sapiens
gatgttctggacctccc

SEQ ID NO: 6255986 - DNA, 21 bp, Homo sapiens
gatgttctttcacccttttct

SEQ ID NO: 6255987 - DNA, 15 bp, Homo sapiens
gatgttctttccatg

SEQ ID NO: 6255988 - DNA, 19 bp, Homo sapiens
gatgttgaaaaagttctgc

SEQ ID NO: 6255989 - DNA, 19 bp, Homo sapiens
gatgttgaaatatgcatac

SEQ ID NO: 6255990 - DNA, 12 bp, Homo sapiens
gatgttgaactt

SEQ ID NO: 6255991 - DNA, 13 bp, Homo sapiens
gatgttgaacttt

SEQ ID NO: 6255992 - DNA, 23 bp, Homo sapiens
gatgttgaatgcccacaggcaaa

SEQ ID NO: 6255993 - DNA, 19 bp, Homo sapiens
gatgttgacatcactggca

SEQ ID NO: 6255994 - DNA, 23 bp, Homo sapiens
gatgttgaggcgagcagggcagg

SEQ ID NO: 6255995 - DNA, 15 bp, Homo sapiens
gatgttgaggggagg

SEQ ID NO: 6255996 - DNA, 15 bp, Homo sapiens
gatgttgataatttc

SEQ ID NO: 6255997 - DNA, 19 bp, Homo sapiens
gatgttgataatttcaggg

SEQ ID NO: 6255998 - DNA, 14 bp, Homo sapiens
gatgttgatgcaat

SEQ ID NO: 6255999 - DNA, 12 bp, Homo sapiens
gatgttgcaaag

SEQ ID NO: 6256000 - DNA, 16 bp, Homo sapiens
gatgttgctatagtga

SEQ ID NO: 6256001 - DNA, 23 bp, Homo sapiens
gatgttgtcttagcatggtacct

SEQ ID NO: 6256002 - DNA, 19 bp, Homo sapiens
gatgttgttactgattctc

SEQ ID NO: 6256003 - DNA, 14 bp, Homo sapiens
gatgttgttcctgg

SEQ ID NO: 6256004 - DNA, 19 bp, Homo sapiens
gatgttgttgttgatggca

SEQ ID NO: 6256005 - DNA, 18 bp, Homo sapiens
gatgtttaacttaatcaa

SEQ ID NO: 6256006 - DNA, 23 bp, Homo sapiens
gatgtttacatggcgccctgcct

SEQ ID NO: 6256007 - DNA, 16 bp, Homo sapiens
gatgtttagtaatcat

SEQ ID NO: 6256008 - DNA, 12 bp, Homo sapiens
gatgtttataaa

SEQ ID NO: 6256009 - DNA, 13 bp, Homo sapiens
gcctgggagccag

SEQ ID NO: 6256010 - DNA, 22 bp, Homo sapiens
gcctgggagggttcccctggcc

SEQ ID NO: 6256011 - DNA, 21 bp, Homo sapiens
gcctgggaggtcaaggctgca

SEQ ID NO: 6256012 - DNA, 22 bp, Homo sapiens
gcctgggaggtcaaggctgcag

SEQ ID NO: 6256013 - DNA, 14 bp, Homo sapiens
gcctgggatccctc

SEQ ID NO: 6256014 - DNA, 22 bp, Homo sapiens
gcctgggatctggcacactccc

SEQ ID NO: 6256015 - DNA, 14 bp, Homo sapiens
gcctgggatgcagt

SEQ ID NO: 6256016 - DNA, 23 bp, Homo sapiens
gcctgggatgctagccccagaga

SEQ ID NO: 6256017 - DNA, 15 bp, Homo sapiens
gcctgggcaacagag

SEQ ID NO: 6256018 - DNA, 20 bp, Homo sapiens
gcctgggcaacagagcaaga

SEQ ID NO: 6256019 - DNA, 20 bp, Homo sapiens
gcctgggcaacatagtgaga

SEQ ID NO: 6256020 - DNA, 12 bp, Homo sapiens
gcctgggcaaga

SEQ ID NO: 6256021 - DNA, 15 bp, Homo sapiens
gcctgggcagaagga

SEQ ID NO: 6256022 - DNA, 16 bp, Homo sapiens
gcctgggcagaaggaa

SEQ ID NO: 6256023 - DNA, 18 bp, Homo sapiens
gcctgggcagaaggaaga

SEQ ID NO: 6256024 - DNA, 18 bp, Homo sapiens
gcctgggcagcacctccg

SEQ ID NO: 6256025 - DNA, 19 bp, Homo sapiens
gcctgggcagcatagcaag

SEQ ID NO: 6256026 - DNA, 18 bp, Homo sapiens
gcctgggcagccaggctg

SEQ ID NO: 6256027 - DNA, 16 bp, Homo sapiens
gcctgggcagccccac

SEQ ID NO: 6256028 - DNA, 17 bp, Homo sapiens
gcctgggcagccccaca

SEQ ID NO: 6256029 - DNA, 16 bp, Homo sapiens
gcctgggcaggaccct

SEQ ID NO: 6256030 - DNA, 16 bp, Homo sapiens
gcctgggcaggaggga

SEQ ID NO: 6256031 - DNA, 12 bp, Homo sapiens
gcctgggcagtg

SEQ ID NO: 6256032 - DNA, 14 bp, Homo sapiens
gcctgggcagtgga

SEQ ID NO: 6256033 - DNA, 20 bp, Homo sapiens
gcctgggccacagggcgaga

SEQ ID NO: 6256034 - DNA, 16 bp, Homo sapiens
gcctgggccagagaag

SEQ ID NO: 6256035 - DNA, 21 bp, Homo sapiens
gcctgggccatgcgaggggcc

SEQ ID NO: 6256036 - DNA, 15 bp, Homo sapiens
gcctgggcccaggct

SEQ ID NO: 6256037 - DNA, 19 bp, Homo sapiens
gcctgggcccaggctctgg

SEQ ID NO: 6256038 - DNA, 20 bp, Homo sapiens
gcctgggcccaggctctggg

SEQ ID NO: 6256039 - DNA, 15 bp, Homo sapiens
gcctgggcccatctc

SEQ ID NO: 6256040 - DNA, 13 bp, Homo sapiens
gcctgggcccctc

SEQ ID NO: 6256041 - DNA, 14 bp, Homo sapiens
gcctgggcccctcc

SEQ ID NO: 6256042 - DNA, 18 bp, Homo sapiens
gcctgggcccctcccctc

SEQ ID NO: 6256043 - DNA, 20 bp, Homo sapiens
gcctgggcccggaagggctt

SEQ ID NO: 6256044 - DNA, 15 bp, Homo sapiens
gcctgggccctgggc

SEQ ID NO: 6256045 - DNA, 17 bp, Homo sapiens
gcctgggccgctgccac

SEQ ID NO: 6256046 - DNA, 20 bp, Homo sapiens
gcctgggcctatggagagcc

SEQ ID NO: 6256047 - DNA, 16 bp, Homo sapiens
gcctgggcctcatggc

SEQ ID NO: 6256048 - DNA, 13 bp, Homo sapiens
gcctgggcctccc

SEQ ID NO: 6256049 - DNA, 17 bp, Homo sapiens
gcctgggcctcctccta

SEQ ID NO: 6256050 - DNA, 15 bp, Homo sapiens
gcctgggcctcctgg

SEQ ID NO: 6256051 - DNA, 14 bp, Homo sapiens
gcctgggcctctgc

SEQ ID NO: 6256052 - DNA, 11 bp, Homo sapiens
gcctgggcctg

SEQ ID NO: 6256053 - DNA, 13 bp, Homo sapiens
gcctgggcctgat

SEQ ID NO: 6256054 - DNA, 12 bp, Homo sapiens
gcctgggcctgc

SEQ ID NO: 6256055 - DNA, 15 bp, Homo sapiens
gcctgggcctgtgca

SEQ ID NO: 6256056 - DNA, 19 bp, Homo sapiens
gcctgggcctgtgcagcag

SEQ ID NO: 6256057 - DNA, 16 bp, Homo sapiens
gcctgggcgaaagggt

SEQ ID NO: 6256058 - DNA, 20 bp, Homo sapiens
gcctgggcgacagagcgaga

SEQ ID NO: 6256059 - DNA, 23 bp, Homo sapiens
gcctgggcgacagagcgagactg

SEQ ID NO: 6256060 - DNA, 22 bp, Homo sapiens
gcctgggcgagacggcaagact

SEQ ID NO: 6256061 - DNA, 20 bp, Homo sapiens
gcctgggcgctggtcctttc

SEQ ID NO: 6256062 - DNA, 21 bp, Homo sapiens
gcctgggcgctggtcctttct

SEQ ID NO: 6256063 - DNA, 21 bp, Homo sapiens
gcctgggcgtacagagcacat

SEQ ID NO: 6256064 - DNA, 10 bp, Homo sapiens
gcctgggctc

SEQ ID NO: 6256065 - DNA, 19 bp, Homo sapiens
gcctgggctcactgtgctg

SEQ ID NO: 6256066 - DNA, 22 bp, Homo sapiens
gcctgggctcactgtgctgggg

SEQ ID NO: 6256067 - DNA, 17 bp, Homo sapiens
gcctgggctcagcctgg

SEQ ID NO: 6256068 - DNA, 13 bp, Homo sapiens
gcctgggctccct

SEQ ID NO: 6256069 - DNA, 20 bp, Homo sapiens
gcctgggctcctctgcatct

SEQ ID NO: 6256070 - DNA, 14 bp, Homo sapiens
gcctgggctcctgg

SEQ ID NO: 6256071 - DNA, 16 bp, Homo sapiens
gcctgggctctggaag

SEQ ID NO: 6256072 - DNA, 20 bp, Homo sapiens
gcctgggctggagtgcagtg

SEQ ID NO: 6256073 - DNA, 15 bp, Homo sapiens
gcctgggctgggaaa

SEQ ID NO: 6256074 - DNA, 15 bp, Homo sapiens
gcctgggctgtgagg

SEQ ID NO: 6256075 - DNA, 16 bp, Homo sapiens
gcctgggctgtgagga

SEQ ID NO: 6256076 - DNA, 21 bp, Homo sapiens
gcctgggctgtgaggacaggg

SEQ ID NO: 6256077 - DNA, 18 bp, Homo sapiens
gcctgggctgttggcact

SEQ ID NO: 6256078 - DNA, 23 bp, Homo sapiens
gcctgggcttggcccgcggcctg

SEQ ID NO: 6256079 - DNA, 13 bp, Homo sapiens
gcctggggacccc

SEQ ID NO: 6256080 - DNA, 15 bp, Homo sapiens
gcctggggaggccct

SEQ ID NO: 6256081 - DNA, 18 bp, Homo sapiens
gcctggggattgggaggg

SEQ ID NO: 6256082 - DNA, 23 bp, Homo sapiens
gcctggggattgggagggacagg

SEQ ID NO: 6256083 - DNA, 13 bp, Homo sapiens
gcctggggcccaa

SEQ ID NO: 6256084 - DNA, 20 bp, Homo sapiens
gcctggggcccaagttgcag

SEQ ID NO: 6256085 - DNA, 13 bp, Homo sapiens
gcctggggccggt

SEQ ID NO: 6256086 - DNA, 18 bp, Homo sapiens
gcctggggcctgagagaa

SEQ ID NO: 6256087 - DNA, 13 bp, Homo sapiens
gcctggggcctgg

SEQ ID NO: 6256088 - DNA, 17 bp, Homo sapiens
gcctggggccttcctgg

SEQ ID NO: 6256089 - DNA, 20 bp, Homo sapiens
gcctggggccttcctggctt

SEQ ID NO: 6256090 - DNA, 23 bp, Homo sapiens
gcctggggctcctttctccagcc

SEQ ID NO: 6256091 - DNA, 17 bp, Homo sapiens
gcctggggctctctgac

SEQ ID NO: 6256092 - DNA, 22 bp, Homo sapiens
gcctggggctgaggctgaggca

SEQ ID NO: 6256093 - DNA, 13 bp, Homo sapiens
gcctggggctgcc

SEQ ID NO: 6256094 - DNA, 15 bp, Homo sapiens
gcctggggctgccgt

SEQ ID NO: 6256095 - DNA, 16 bp, Homo sapiens
gcctggggctggctgc

SEQ ID NO: 6256096 - DNA, 21 bp, Homo sapiens
gcctgggggacccctggctct

SEQ ID NO: 6256097 - DNA, 14 bp, Homo sapiens
gcctgggggagaga

SEQ ID NO: 6256098 - DNA, 22 bp, Homo sapiens
gcctgggggcagggagaggagt

SEQ ID NO: 6256099 - DNA, 15 bp, Homo sapiens
gcctgggggcagtga

SEQ ID NO: 6256100 - DNA, 18 bp, Homo sapiens
gcctgggggcagtgactg

SEQ ID NO: 6256101 - DNA, 22 bp, Homo sapiens
gcctgggggcagtgactggcag

SEQ ID NO: 6256102 - DNA, 15 bp, Homo sapiens
gcctgggggccagtg

SEQ ID NO: 6256103 - DNA, 17 bp, Homo sapiens
gcctgggggccagtggg

SEQ ID NO: 6256104 - DNA, 18 bp, Homo sapiens
gcctgggggcctggctgg

SEQ ID NO: 6256105 - DNA, 20 bp, Homo sapiens
gcctgggggcctggctggct

SEQ ID NO: 6256106 - DNA, 20 bp, Homo sapiens
gcctgggggctgggcagagg

SEQ ID NO: 6256107 - DNA, 21 bp, Homo sapiens
gcctgggggctgggcagagga

SEQ ID NO: 6256108 - DNA, 22 bp, Homo sapiens
gcctgggggcttttgccactcc

SEQ ID NO: 6256109 - DNA, 18 bp, Homo sapiens
gcctgggggggccgctct

SEQ ID NO: 6256110 - DNA, 20 bp, Homo sapiens
gcctgggggttttccaagcc

SEQ ID NO: 6256111 - DNA, 22 bp, Homo sapiens
gcctggggtaccaagagactcc

SEQ ID NO: 6256112 - DNA, 22 bp, Homo sapiens
gcctggggtaggaggaacaggt

SEQ ID NO: 6256113 - DNA, 18 bp, Homo sapiens
gcctggggtccctctgaa

SEQ ID NO: 6256114 - DNA, 22 bp, Homo sapiens
gcctggggtgacccggcacccc

SEQ ID NO: 6256115 - DNA, 18 bp, Homo sapiens
gcctggggtgacctctag

SEQ ID NO: 6256116 - DNA, 19 bp, Homo sapiens
gcctggggtgatagaacaa

SEQ ID NO: 6256117 - DNA, 22 bp, Homo sapiens
gcctggggtgcatcctcctcag

SEQ ID NO: 6256118 - DNA, 22 bp, Homo sapiens
gcctggggtggggtcatgccct

SEQ ID NO: 6256119 - DNA, 22 bp, Homo sapiens
gcctggggtgggtgtgagcagg

SEQ ID NO: 6256120 - DNA, 23 bp, Homo sapiens
gcctggggtgggtgtgagcaggg

SEQ ID NO: 6256121 - DNA, 19 bp, Homo sapiens
gcctggggttcccgaggga

SEQ ID NO: 6256122 - DNA, 18 bp, Homo sapiens
gcctggggttgtccccgc

SEQ ID NO: 6256123 - DNA, 15 bp, Homo sapiens
gcctgggtaggaaaa

SEQ ID NO: 6256124 - DNA, 18 bp, Homo sapiens
gcctgggtaggccccaca

SEQ ID NO: 6256125 - DNA, 22 bp, Homo sapiens
gcctgggtcacgctcaaggaag

SEQ ID NO: 6256126 - DNA, 13 bp, Homo sapiens
gcctgggtcatgg

SEQ ID NO: 6256127 - DNA, 14 bp, Homo sapiens
gcctgggtcccagg

SEQ ID NO: 6256128 - DNA, 17 bp, Homo sapiens
gcctgggtcccagggct

SEQ ID NO: 6256129 - DNA, 22 bp, Homo sapiens
gcctgggtcccagggctggccc

SEQ ID NO: 6256130 - DNA, 23 bp, Homo sapiens
gcctgggtcccagggctggccct

SEQ ID NO: 6256131 - DNA, 14 bp, Homo sapiens
gcctgggtccccct

SEQ ID NO: 6256132 - DNA, 15 bp, Homo sapiens
gcctgggtccccctc

SEQ ID NO: 6256133 - DNA, 19 bp, Homo sapiens
gcctgggtccccctcctgc

SEQ ID NO: 6256134 - DNA, 16 bp, Homo sapiens
gcctgggtcctcccag

SEQ ID NO: 6256135 - DNA, 15 bp, Homo sapiens
gcctgggtcctcggc

SEQ ID NO: 6256136 - DNA, 16 bp, Homo sapiens
gcctgggtcctcggcc

SEQ ID NO: 6256137 - DNA, 21 bp, Homo sapiens
gcctgggtctcaccggctctc

SEQ ID NO: 6256138 - DNA, 22 bp, Homo sapiens
gcctgggtctccacatccccag

SEQ ID NO: 6256139 - DNA, 15 bp, Homo sapiens
gcctgggtctcctaa

SEQ ID NO: 6256140 - DNA, 13 bp, Homo sapiens
gcctgggtctgga

SEQ ID NO: 6256141 - DNA, 20 bp, Homo sapiens
gcctgggtctggatgggagg

SEQ ID NO: 6256142 - DNA, 22 bp, Homo sapiens
gcctgggtctggatgggaggag

SEQ ID NO: 6256143 - DNA, 16 bp, Homo sapiens
gcctgggtctgtgtct

SEQ ID NO: 6256144 - DNA, 20 bp, Homo sapiens
gcctgggtgacagagcaaga

SEQ ID NO: 6256145 - DNA, 20 bp, Homo sapiens
gcctgggtgacagagcgaga

SEQ ID NO: 6256146 - DNA, 20 bp, Homo sapiens
gcctgggtgacagagtgaga

SEQ ID NO: 6256147 - DNA, 22 bp, Homo sapiens
gcctgggtgacagagtgagacc

SEQ ID NO: 6256148 - DNA, 23 bp, Homo sapiens
gcctgggtgagaatcctgcctct

SEQ ID NO: 6256149 - DNA, 20 bp, Homo sapiens
gcctgggtgatctgctgctg

SEQ ID NO: 6256150 - DNA, 12 bp, Homo sapiens
gcctgggtgctg

SEQ ID NO: 6256151 - DNA, 20 bp, Homo sapiens
gcctgggtggcagagtgaga

SEQ ID NO: 6256152 - DNA, 15 bp, Homo sapiens
gcctgggtggctcag

SEQ ID NO: 6256153 - DNA, 16 bp, Homo sapiens
gcctgggtggctcagc

SEQ ID NO: 6256154 - DNA, 12 bp, Homo sapiens
gcctgggtggga

SEQ ID NO: 6256155 - DNA, 18 bp, Homo sapiens
gcctgggtgggacagcct

SEQ ID NO: 6256156 - DNA, 15 bp, Homo sapiens
gcctgggtggggctg

SEQ ID NO: 6256157 - DNA, 20 bp, Homo sapiens
gcctgggtggggctgctcct

SEQ ID NO: 6256158 - DNA, 21 bp, Homo sapiens
gcctgggtggtacccaggctt

SEQ ID NO: 6256159 - DNA, 22 bp, Homo sapiens
gcctgggtgtcaagtgcctgca

SEQ ID NO: 6256160 - DNA, 21 bp, Homo sapiens
gcctgggttgggggcactcag

SEQ ID NO: 6256161 - DNA, 23 bp, Homo sapiens
gcctgggttgggggcactcagcc

SEQ ID NO: 6256162 - DNA, 21 bp, Homo sapiens
gcctgggtttgttcctggggc

SEQ ID NO: 6256163 - DNA, 18 bp, Homo sapiens
gcctgggttttctaactg

SEQ ID NO: 6256164 - DNA, 19 bp, Homo sapiens
gcctgggttttctaactgt

SEQ ID NO: 6256165 - DNA, 20 bp, Homo sapiens
gcctgggttttctaactgta

SEQ ID NO: 6256166 - DNA, 22 bp, Homo sapiens
gcctgggttttctaactgtaaa

SEQ ID NO: 6256167 - DNA, 22 bp, Homo sapiens
gcctgggttttgttccctattt

SEQ ID NO: 6256168 - DNA, 19 bp, Homo sapiens
gcctggtactctggcaaat

SEQ ID NO: 6256169 - DNA, 21 bp, Homo sapiens
gcctggtagaattgggaagct

SEQ ID NO: 6256170 - DNA, 17 bp, Homo sapiens
gcctggtatggctgcag

SEQ ID NO: 6256171 - DNA, 21 bp, Homo sapiens
gcctggtcagaaggccagccg

SEQ ID NO: 6256172 - DNA, 13 bp, Homo sapiens
gcctggtcagccc

SEQ ID NO: 6256173 - DNA, 14 bp, Homo sapiens
gcctggtcagccca

SEQ ID NO: 6256174 - DNA, 15 bp, Homo sapiens
gcctggtcagcccaa

SEQ ID NO: 6256175 - DNA, 22 bp, Homo sapiens
gcctggtccagtggggaacagg

SEQ ID NO: 6256176 - DNA, 22 bp, Homo sapiens
gcctggtccatgatggagtcag

SEQ ID NO: 6256177 - DNA, 20 bp, Homo sapiens
gcctggtccatgcagggggc

SEQ ID NO: 6256178 - DNA, 15 bp, Homo sapiens
gcctggtccctggga

SEQ ID NO: 6256179 - DNA, 14 bp, Homo sapiens
gcctggtccctggt

SEQ ID NO: 6256180 - DNA, 17 bp, Homo sapiens
gcctggtccctggtcct

SEQ ID NO: 6256181 - DNA, 21 bp, Homo sapiens
gcctggtccctggtccttcac

SEQ ID NO: 6256182 - DNA, 20 bp, Homo sapiens
gcctggtcctccctcccaag

SEQ ID NO: 6256183 - DNA, 21 bp, Homo sapiens
gcctggtcctccctcccaagg

SEQ ID NO: 6256184 - DNA, 18 bp, Homo sapiens
gcctggtcgccttccacc

SEQ ID NO: 6256185 - DNA, 17 bp, Homo sapiens
gatgtttatatcaaatg

SEQ ID NO: 6256186 - DNA, 14 bp, Homo sapiens
gatgtttattcttc

SEQ ID NO: 6256187 - DNA, 19 bp, Homo sapiens
gatgtttatttagaaactg

SEQ ID NO: 6256188 - DNA, 17 bp, Homo sapiens
gatgtttcaactgtgct

SEQ ID NO: 6256189 - DNA, 17 bp, Homo sapiens
gatgtttcaccaaggaa

SEQ ID NO: 6256190 - DNA, 20 bp, Homo sapiens
gatgtttccaagatgtccca

SEQ ID NO: 6256191 - DNA, 17 bp, Homo sapiens
gatgtttccagaaaata

SEQ ID NO: 6256192 - DNA, 20 bp, Homo sapiens
gatgtttccagaaaatataa

SEQ ID NO: 6256193 - DNA, 13 bp, Homo sapiens
gatgtttccagct

SEQ ID NO: 6256194 - DNA, 15 bp, Homo sapiens
gatgtttcctggaag

SEQ ID NO: 6256195 - DNA, 21 bp, Homo sapiens
gatgtttcgagtaaacttgaa

SEQ ID NO: 6256196 - DNA, 22 bp, Homo sapiens
gatgtttcttgccttttgttaa

SEQ ID NO: 6256197 - DNA, 14 bp, Homo sapiens
gatgtttggaaaaa

SEQ ID NO: 6256198 - DNA, 22 bp, Homo sapiens
gatgtttggaaaaaactctgaa

SEQ ID NO: 6256199 - DNA, 12 bp, Homo sapiens
gatgtttggcct

SEQ ID NO: 6256200 - DNA, 14 bp, Homo sapiens
gatgtttgtgcagt

SEQ ID NO: 6256201 - DNA, 13 bp, Homo sapiens
gatgtttgtgctg

SEQ ID NO: 6256202 - DNA, 16 bp, Homo sapiens
gatgtttgtggcctca

SEQ ID NO: 6256203 - DNA, 19 bp, Homo sapiens
gatgtttgttttcgatgag

SEQ ID NO: 6256204 - DNA, 17 bp, Homo sapiens
gatgttttacgtgcaaa

SEQ ID NO: 6256205 - DNA, 18 bp, Homo sapiens
gatgttttacgtgcaaac

SEQ ID NO: 6256206 - DNA, 16 bp, Homo sapiens
gatgttttagaatgat

SEQ ID NO: 6256207 - DNA, 21 bp, Homo sapiens
gatgttttatccttacaatgt

SEQ ID NO: 6256208 - DNA, 20 bp, Homo sapiens
gatgttttatttatgaagtt

SEQ ID NO: 6256209 - DNA, 15 bp, Homo sapiens
gatgttttccatgag

SEQ ID NO: 6256210 - DNA, 14 bp, Homo sapiens
gatgttttgcaaag

SEQ ID NO: 6256211 - DNA, 17 bp, Homo sapiens
gatgttttgcaaaggaa

SEQ ID NO: 6256212 - DNA, 17 bp, Homo sapiens
gatgttttgggatcagg

SEQ ID NO: 6256213 - DNA, 21 bp, Homo sapiens
gatgttttgtcccatttcctt

SEQ ID NO: 6256214 - DNA, 18 bp, Homo sapiens
gatgttttgttcaaagtt

SEQ ID NO: 6256215 - DNA, 13 bp, Homo sapiens
gatgtttttaaaa

SEQ ID NO: 6256216 - DNA, 20 bp, Homo sapiens
gatgtttttaaaagtttcaa

SEQ ID NO: 6256217 - DNA, 21 bp, Homo sapiens
gatgtttttaaaagtttcaat

SEQ ID NO: 6256218 - DNA, 22 bp, Homo sapiens
gatgtttttaaaagtttcaatg

SEQ ID NO: 6256219 - DNA, 21 bp, Homo sapiens
gatgtttttagttctgacttt

SEQ ID NO: 6256220 - DNA, 15 bp, Homo sapiens
gatgtttttcttacc

SEQ ID NO: 6256221 - DNA, 16 bp, Homo sapiens
gatgttttttctgtaa

SEQ ID NO: 6256222 - DNA, 21 bp, Homo sapiens
gattaaaaataccttctatgt

SEQ ID NO: 6256223 - DNA, 15 bp, Homo sapiens
gattaaaagcacaag

SEQ ID NO: 6256224 - DNA, 20 bp, Homo sapiens
gattaaaatctcttgattat

SEQ ID NO: 6256225 - DNA, 19 bp, Homo sapiens
gattaaaatgtttgagcac

SEQ ID NO: 6256226 - DNA, 13 bp, Homo sapiens
gattaaacacctg

SEQ ID NO: 6256227 - DNA, 14 bp, Homo sapiens
gattaaacacctga

SEQ ID NO: 6256228 - DNA, 15 bp, Homo sapiens
gattaaacacctgac

SEQ ID NO: 6256229 - DNA, 19 bp, Homo sapiens
gattaaacacctgacacat

SEQ ID NO: 6256230 - DNA, 20 bp, Homo sapiens
gattaaacagcaaagccata

SEQ ID NO: 6256231 - DNA, 21 bp, Homo sapiens
gattaaacagcaaagccatat

SEQ ID NO: 6256232 - DNA, 16 bp, Homo sapiens
gattaaactgtatgtc

SEQ ID NO: 6256233 - DNA, 15 bp, Homo sapiens
gattaaacttaatct

SEQ ID NO: 6256234 - DNA, 15 bp, Homo sapiens
gattaaacttatgaa

SEQ ID NO: 6256235 - DNA, 18 bp, Homo sapiens
gattaaacttatgaatgt

SEQ ID NO: 6256236 - DNA, 12 bp, Homo sapiens
gattaaagaaaa

SEQ ID NO: 6256237 - DNA, 21 bp, Homo sapiens
gattaaagcaagagaattatt

SEQ ID NO: 6256238 - DNA, 14 bp, Homo sapiens
gattaaaggaagga

SEQ ID NO: 6256239 - DNA, 16 bp, Homo sapiens
gattaaataagattct

SEQ ID NO: 6256240 - DNA, 17 bp, Homo sapiens
gattaaataagattcta

SEQ ID NO: 6256241 - DNA, 12 bp, Homo sapiens
gattaaatacat

SEQ ID NO: 6256242 - DNA, 19 bp, Homo sapiens
gattaaatatagattagaa

SEQ ID NO: 6256243 - DNA, 23 bp, Homo sapiens
gattaaatatatctttgtaaatt

SEQ ID NO: 6256244 - DNA, 13 bp, Homo sapiens
gattaaatattta

SEQ ID NO: 6256245 - DNA, 15 bp, Homo sapiens
gattaaatatttaat

SEQ ID NO: 6256246 - DNA, 18 bp, Homo sapiens
gattaaatatttgaagag

SEQ ID NO: 6256247 - DNA, 12 bp, Homo sapiens
gattaaatggca

SEQ ID NO: 6256248 - DNA, 13 bp, Homo sapiens
gattaaattacag

SEQ ID NO: 6256249 - DNA, 14 bp, Homo sapiens
gattaaattatgaa

SEQ ID NO: 6256250 - DNA, 20 bp, Homo sapiens
gattaaatttaatatactgc

SEQ ID NO: 6256251 - DNA, 22 bp, Homo sapiens
gattaaatttaatatactgcat

SEQ ID NO: 6256252 - DNA, 21 bp, Homo sapiens
gattaaattttagtacatttt

SEQ ID NO: 6256253 - DNA, 14 bp, Homo sapiens
gattaacaaataaa

SEQ ID NO: 6256254 - DNA, 21 bp, Homo sapiens
gattaacaaatatgctaattt

SEQ ID NO: 6256255 - DNA, 14 bp, Homo sapiens
gattaacacactga

SEQ ID NO: 6256256 - DNA, 15 bp, Homo sapiens
gattaacacactgaa

SEQ ID NO: 6256257 - DNA, 21 bp, Homo sapiens
gattaacaggtatgaaccacc

SEQ ID NO: 6256258 - DNA, 21 bp, Homo sapiens
gattaaccacttcagctgact

SEQ ID NO: 6256259 - DNA, 18 bp, Homo sapiens
gattaaccccttctttca

SEQ ID NO: 6256260 - DNA, 23 bp, Homo sapiens
gattaacggtgctaaccccgtct

SEQ ID NO: 6256261 - DNA, 18 bp, Homo sapiens
gattaactaaagaagagg

SEQ ID NO: 6256262 - DNA, 20 bp, Homo sapiens
gattaactgaaataaaaaat

SEQ ID NO: 6256263 - DNA, 16 bp, Homo sapiens
gattaactgtgaataa

SEQ ID NO: 6256264 - DNA, 17 bp, Homo sapiens
gattaacttatttagag

SEQ ID NO: 6256265 - DNA, 22 bp, Homo sapiens
gattaagagatgggtttgacaa

SEQ ID NO: 6256266 - DNA, 23 bp, Homo sapiens
gattaagcttttcattttaatat

SEQ ID NO: 6256267 - DNA, 19 bp, Homo sapiens
gattaaggcgtggcttctg

SEQ ID NO: 6256268 - DNA, 19 bp, Homo sapiens
gattaagggacatttctat

SEQ ID NO: 6256269 - DNA, 16 bp, Homo sapiens
gattaaggtcctgctt

SEQ ID NO: 6256270 - DNA, 19 bp, Homo sapiens
gattaaggtctctctttgg

SEQ ID NO: 6256271 - DNA, 17 bp, Homo sapiens
gattaaggtgatgtgat

SEQ ID NO: 6256272 - DNA, 17 bp, Homo sapiens
gattaagtacaagcaca

SEQ ID NO: 6256273 - DNA, 15 bp, Homo sapiens
gattaagttcctatc

SEQ ID NO: 6256274 - DNA, 20 bp, Homo sapiens
gattaataaaatatctattt

SEQ ID NO: 6256275 - DNA, 18 bp, Homo sapiens
gattaataagaacttgaa

SEQ ID NO: 6256276 - DNA, 20 bp, Homo sapiens
gattaataagatttttcaaa

SEQ ID NO: 6256277 - DNA, 21 bp, Homo sapiens
gattaataagatttttcaaaa

SEQ ID NO: 6256278 - DNA, 22 bp, Homo sapiens
gattaatagagttggagtttta

SEQ ID NO: 6256279 - DNA, 17 bp, Homo sapiens
gattaatagcattcgaa

SEQ ID NO: 6256280 - DNA, 18 bp, Homo sapiens
gattaatatgaaaactta

SEQ ID NO: 6256281 - DNA, 20 bp, Homo sapiens
gattaatcagctgttgcagg

SEQ ID NO: 6256282 - DNA, 21 bp, Homo sapiens
gattaatcagctgttgcaggc

SEQ ID NO: 6256283 - DNA, 19 bp, Homo sapiens
gattaatccagaataacta

SEQ ID NO: 6256284 - DNA, 23 bp, Homo sapiens
gattaatccattttaacaaacaa

SEQ ID NO: 6256285 - DNA, 16 bp, Homo sapiens
gattaatggcactgat

SEQ ID NO: 6256286 - DNA, 14 bp, Homo sapiens
gattaatgtacttt

SEQ ID NO: 6256287 - DNA, 16 bp, Homo sapiens
gattaatgtacttttt

SEQ ID NO: 6256288 - DNA, 19 bp, Homo sapiens
gattaatgtactttttatt

SEQ ID NO: 6256289 - DNA, 21 bp, Homo sapiens
gattaatgtactttttattgc

SEQ ID NO: 6256290 - DNA, 13 bp, Homo sapiens
gattaatgtttct

SEQ ID NO: 6256291 - DNA, 16 bp, Homo sapiens
gattaatgttttcatt

SEQ ID NO: 6256292 - DNA, 14 bp, Homo sapiens
gattaattaaaatt

SEQ ID NO: 6256293 - DNA, 15 bp, Homo sapiens
gattaattggagatt

SEQ ID NO: 6256294 - DNA, 21 bp, Homo sapiens
gattaatttctgccatttcat

SEQ ID NO: 6256295 - DNA, 16 bp, Homo sapiens
gattaatttgtgtaga

SEQ ID NO: 6256296 - DNA, 21 bp, Homo sapiens
gattaattttaacttaaattt

SEQ ID NO: 6256297 - DNA, 15 bp, Homo sapiens
gattacaaaagcaat

SEQ ID NO: 6256298 - DNA, 21 bp, Homo sapiens
gattacaaataaacagttgtt

SEQ ID NO: 6256299 - DNA, 21 bp, Homo sapiens
gattacaaatagaagcttctt

SEQ ID NO: 6256300 - DNA, 16 bp, Homo sapiens
gattacaaatcagaag

SEQ ID NO: 6256301 - DNA, 21 bp, Homo sapiens
gattacaagcgtgagccactg

SEQ ID NO: 6256302 - DNA, 22 bp, Homo sapiens
gattacaagcgtgagccactgc

SEQ ID NO: 6256303 - DNA, 15 bp, Homo sapiens
gattacaccactgca

SEQ ID NO: 6256304 - DNA, 17 bp, Homo sapiens
gattacagaaactgatg

SEQ ID NO: 6256305 - DNA, 20 bp, Homo sapiens
gattacagacatgagccacc

SEQ ID NO: 6256306 - DNA, 21 bp, Homo sapiens
gattacagacatgagccactg

SEQ ID NO: 6256307 - DNA, 20 bp, Homo sapiens
gattacaggaatgaagaact

SEQ ID NO: 6256308 - DNA, 20 bp, Homo sapiens
gattacaggcatgagccact

SEQ ID NO: 6256309 - DNA, 15 bp, Homo sapiens
gattacaggcgcctg

SEQ ID NO: 6256310 - DNA, 18 bp, Homo sapiens
gattacaggctcctgcca

SEQ ID NO: 6256311 - DNA, 20 bp, Homo sapiens
gattacaggtgtgaaccacc

SEQ ID NO: 6256312 - DNA, 22 bp, Homo sapiens
gattacaggtgtgagccaccac

SEQ ID NO: 6256313 - DNA, 21 bp, Homo sapiens
gattacaggtgtgtgggccac

SEQ ID NO: 6256314 - DNA, 14 bp, Homo sapiens
gattacataatctg

SEQ ID NO: 6256315 - DNA, 19 bp, Homo sapiens
gattacatagatcagccat

SEQ ID NO: 6256316 - DNA, 23 bp, Homo sapiens
gattacatagatcagccattaaa

SEQ ID NO: 6256317 - DNA, 15 bp, Homo sapiens
gattacatctgcctt

SEQ ID NO: 6256318 - DNA, 19 bp, Homo sapiens
gattacatgtatgttcttg

SEQ ID NO: 6256319 - DNA, 14 bp, Homo sapiens
gattacattttaaa

SEQ ID NO: 6256320 - DNA, 23 bp, Homo sapiens
gattaccagggactatctttgct

SEQ ID NO: 6256321 - DNA, 20 bp, Homo sapiens
gattacccaaatataaccat

SEQ ID NO: 6256322 - DNA, 14 bp, Homo sapiens
gattacctcctgag

SEQ ID NO: 6256323 - DNA, 17 bp, Homo sapiens
gattacctgaaagccct

SEQ ID NO: 6256324 - DNA, 21 bp, Homo sapiens
gattacctgatcatggtcagc

SEQ ID NO: 6256325 - DNA, 14 bp, Homo sapiens
gattacctgccaat

SEQ ID NO: 6256326 - DNA, 18 bp, Homo sapiens
gattacgatgtaaatttt

SEQ ID NO: 6256327 - DNA, 18 bp, Homo sapiens
gattacgtgtatgtttct

SEQ ID NO: 6256328 - DNA, 18 bp, Homo sapiens
gattactagagaaagaca

SEQ ID NO: 6256329 - DNA, 14 bp, Homo sapiens
gattactcctccat

SEQ ID NO: 6256330 - DNA, 12 bp, Homo sapiens
gattactctttg

SEQ ID NO: 6256331 - DNA, 22 bp, Homo sapiens
gattactgaaatataccttttg

SEQ ID NO: 6256332 - DNA, 22 bp, Homo sapiens
gattactgatgtgatattctgt

SEQ ID NO: 6256333 - DNA, 18 bp, Homo sapiens
gattactgcctattttaa

SEQ ID NO: 6256334 - DNA, 22 bp, Homo sapiens
gattactgtttggctgacatga

SEQ ID NO: 6256335 - DNA, 20 bp, Homo sapiens
gattacttagattgtgttcc

SEQ ID NO: 6256336 - DNA, 18 bp, Homo sapiens
gattacttctctataaaa

SEQ ID NO: 6256337 - DNA, 20 bp, Homo sapiens
gattactttaaaataaaaaa

SEQ ID NO: 6256338 - DNA, 20 bp, Homo sapiens
gattagaaacaaacaaaact

SEQ ID NO: 6256339 - DNA, 22 bp, Homo sapiens
gattagaaattacctgtggata

SEQ ID NO: 6256340 - DNA, 19 bp, Homo sapiens
gattagaagccaagacagt

SEQ ID NO: 6256341 - DNA, 15 bp, Homo sapiens
gattagaattctgta

SEQ ID NO: 6256342 - DNA, 22 bp, Homo sapiens
gattagacagtaagagtttaca

SEQ ID NO: 6256343 - DNA, 16 bp, Homo sapiens
gattagaccaattact

SEQ ID NO: 6256344 - DNA, 14 bp, Homo sapiens
gattagacctttat

SEQ ID NO: 6256345 - DNA, 19 bp, Homo sapiens
gattagactggacagcttg

SEQ ID NO: 6256346 - DNA, 17 bp, Homo sapiens
gattagagcctgtaaac

SEQ ID NO: 6256347 - DNA, 18 bp, Homo sapiens
gattagaggcagatctgg

SEQ ID NO: 6256348 - DNA, 20 bp, Homo sapiens
gattagagggaggtgtttaa

SEQ ID NO: 6256349 - DNA, 13 bp, Homo sapiens
gattagataaaga

SEQ ID NO: 6256350 - DNA, 22 bp, Homo sapiens
gattagatgtgccaataaccaa

SEQ ID NO: 6256351 - DNA, 18 bp, Homo sapiens
gattagcctcgtctttca

SEQ ID NO: 6256352 - DNA, 10 bp, Homo sapiens
gattagcttt

SEQ ID NO: 6256353 - DNA, 19 bp, Homo sapiens
gattagctttattatggct

SEQ ID NO: 6256354 - DNA, 21 bp, Homo sapiens
gattagctttattatggcttg

SEQ ID NO: 6256355 - DNA, 12 bp, Homo sapiens
gattaggattaa

SEQ ID NO: 6256356 - DNA, 13 bp, Homo sapiens
gattaggcctgga

SEQ ID NO: 6256357 - DNA, 15 bp, Homo sapiens
gattaggcctggagt

SEQ ID NO: 6256358 - DNA, 17 bp, Homo sapiens
gattagggagagaagat

SEQ ID NO: 6256359 - DNA, 18 bp, Homo sapiens
gattaggggatggggagg

SEQ ID NO: 6256360 - DNA, 19 bp, Homo sapiens
gattaggtatgtttgtaac

SEQ ID NO: 6256361 - DNA, 20 bp, Homo sapiens
gattaggtatgtttgtaact

SEQ ID NO: 6256362 - DNA, 18 bp, Homo sapiens
gcctggtctcaccctgga

SEQ ID NO: 6256363 - DNA, 20 bp, Homo sapiens
gcctggtctcaccctggagg

SEQ ID NO: 6256364 - DNA, 15 bp, Homo sapiens
gcctggtctgtctgg

SEQ ID NO: 6256365 - DNA, 19 bp, Homo sapiens
gcctggtctgtgcattgtg

SEQ ID NO: 6256366 - DNA, 14 bp, Homo sapiens
gcctggtgacaggc

SEQ ID NO: 6256367 - DNA, 22 bp, Homo sapiens
gcctggtgatgcgcagttgctg

SEQ ID NO: 6256368 - DNA, 16 bp, Homo sapiens
gcctggtgcacagggc

SEQ ID NO: 6256369 - DNA, 21 bp, Homo sapiens
gcctggtgcattgctgtgtga

SEQ ID NO: 6256370 - DNA, 21 bp, Homo sapiens
gcctggtgcgctgtgctccag

SEQ ID NO: 6256371 - DNA, 20 bp, Homo sapiens
gcctggtgcttccaaatatt

SEQ ID NO: 6256372 - DNA, 19 bp, Homo sapiens
gcctggtggcagctgcggt

SEQ ID NO: 6256373 - DNA, 14 bp, Homo sapiens
gcctggtggcccag

SEQ ID NO: 6256374 - DNA, 18 bp, Homo sapiens
gcctggtgggccacgtgt

SEQ ID NO: 6256375 - DNA, 13 bp, Homo sapiens
gcctggtgggcct

SEQ ID NO: 6256376 - DNA, 19 bp, Homo sapiens
gcctggtggtcagatgcag

SEQ ID NO: 6256377 - DNA, 17 bp, Homo sapiens
gcctggtgtgaggctgg

SEQ ID NO: 6256378 - DNA, 17 bp, Homo sapiens
gcctggtgttctgaagt

SEQ ID NO: 6256379 - DNA, 19 bp, Homo sapiens
gcctggttaatattaatat

SEQ ID NO: 6256380 - DNA, 15 bp, Homo sapiens
gcctggttcgtgcca

SEQ ID NO: 6256381 - DNA, 20 bp, Homo sapiens
gcctggttcgtgccatgccc

SEQ ID NO: 6256382 - DNA, 15 bp, Homo sapiens
gcctggttgaagaag

SEQ ID NO: 6256383 - DNA, 17 bp, Homo sapiens
gcctggtttcctcgaga

SEQ ID NO: 6256384 - DNA, 21 bp, Homo sapiens
gcctggtttgcaaagaccacc

SEQ ID NO: 6256385 - DNA, 22 bp, Homo sapiens
gcctggttttcgtcatcttccc

SEQ ID NO: 6256386 - DNA, 22 bp, Homo sapiens
gcctgtaaatgtattcattctt

SEQ ID NO: 6256387 - DNA, 13 bp, Homo sapiens
gcctgtaacaatg

SEQ ID NO: 6256388 - DNA, 22 bp, Homo sapiens
gcctgtaatcagctctcctggc

SEQ ID NO: 6256389 - DNA, 15 bp, Homo sapiens
gcctgtaatcccagc

SEQ ID NO: 6256390 - DNA, 20 bp, Homo sapiens
gcctgtaatcccagcacttt

SEQ ID NO: 6256391 - DNA, 21 bp, Homo sapiens
gcctgtaatcccagcactttg

SEQ ID NO: 6256392 - DNA, 21 bp, Homo sapiens
gcctgtaatctaccagtggtg

SEQ ID NO: 6256393 - DNA, 15 bp, Homo sapiens
gcctgtaatctcagc

SEQ ID NO: 6256394 - DNA, 23 bp, Homo sapiens
gcctgtaatctcagctactcagg

SEQ ID NO: 6256395 - DNA, 12 bp, Homo sapiens
gcctgtaatctt

SEQ ID NO: 6256396 - DNA, 22 bp, Homo sapiens
gcctgtacagtctgtcttctgt

SEQ ID NO: 6256397 - DNA, 13 bp, Homo sapiens
gcctgtactgcct

SEQ ID NO: 6256398 - DNA, 17 bp, Homo sapiens
gcctgtactgcctgctt

SEQ ID NO: 6256399 - DNA, 22 bp, Homo sapiens
gcctgtagagacaatacagtaa

SEQ ID NO: 6256400 - DNA, 14 bp, Homo sapiens
gcctgtagagccag

SEQ ID NO: 6256401 - DNA, 21 bp, Homo sapiens
gcctgtagcaatggccagagc

SEQ ID NO: 6256402 - DNA, 14 bp, Homo sapiens
gcctgtagcagtga

SEQ ID NO: 6256403 - DNA, 13 bp, Homo sapiens
gcctgtagcccac

SEQ ID NO: 6256404 - DNA, 22 bp, Homo sapiens
gcctgtagcccactctgctcgc

SEQ ID NO: 6256405 - DNA, 21 bp, Homo sapiens
gcctgtagctcccctgctgag

SEQ ID NO: 6256406 - DNA, 19 bp, Homo sapiens
gcctgtagctttcctggtc

SEQ ID NO: 6256407 - DNA, 19 bp, Homo sapiens
gcctgtagggaactttctg

SEQ ID NO: 6256408 - DNA, 19 bp, Homo sapiens
gcctgtagtcccagctaca

SEQ ID NO: 6256409 - DNA, 14 bp, Homo sapiens
gcctgtagttagga

SEQ ID NO: 6256410 - DNA, 18 bp, Homo sapiens
gcctgtagttaggaaata

SEQ ID NO: 6256411 - DNA, 22 bp, Homo sapiens
gcctgtagttaggaaataaaac

SEQ ID NO: 6256412 - DNA, 23 bp, Homo sapiens
gcctgtagttaggaaataaaacc

SEQ ID NO: 6256413 - DNA, 13 bp, Homo sapiens
gcctgtataagta

SEQ ID NO: 6256414 - DNA, 13 bp, Homo sapiens
gcctgtatacttt

SEQ ID NO: 6256415 - DNA, 17 bp, Homo sapiens
gcctgtatactttagta

SEQ ID NO: 6256416 - DNA, 21 bp, Homo sapiens
gcctgtatcctccctggcaga

SEQ ID NO: 6256417 - DNA, 15 bp, Homo sapiens
gcctgtattcccagc

SEQ ID NO: 6256418 - DNA, 14 bp, Homo sapiens
gcctgtcaccagac

SEQ ID NO: 6256419 - DNA, 15 bp, Homo sapiens
gcctgtcaccagacc

SEQ ID NO: 6256420 - DNA, 17 bp, Homo sapiens
gcctgtcaccccagtca

SEQ ID NO: 6256421 - DNA, 13 bp, Homo sapiens
gcctgtcaccccc

SEQ ID NO: 6256422 - DNA, 20 bp, Homo sapiens
gcctgtcacccccactcccg

SEQ ID NO: 6256423 - DNA, 23 bp, Homo sapiens
gcctgtcacccccactcccgcct

SEQ ID NO: 6256424 - DNA, 15 bp, Homo sapiens
gcctgtcacctggga

SEQ ID NO: 6256425 - DNA, 16 bp, Homo sapiens
gcctgtcacgctctgg

SEQ ID NO: 6256426 - DNA, 15 bp, Homo sapiens
gcctgtcagatccag

SEQ ID NO: 6256427 - DNA, 20 bp, Homo sapiens
gcctgtcaggctctggccct

SEQ ID NO: 6256428 - DNA, 21 bp, Homo sapiens
gcctgtcaggctctggccctt

SEQ ID NO: 6256429 - DNA, 18 bp, Homo sapiens
gcctgtccacaggcttct

SEQ ID NO: 6256430 - DNA, 20 bp, Homo sapiens
gcctgtccacctgtgctgct

SEQ ID NO: 6256431 - DNA, 20 bp, Homo sapiens
gcctgtcccaattctgcccg

SEQ ID NO: 6256432 - DNA, 20 bp, Homo sapiens
gcctgtcccacccccacccc

SEQ ID NO: 6256433 - DNA, 17 bp, Homo sapiens
gcctgtcccactggctc

SEQ ID NO: 6256434 - DNA, 12 bp, Homo sapiens
gcctgtcccagg

SEQ ID NO: 6256435 - DNA, 14 bp, Homo sapiens
gcctgtcccaggac

SEQ ID NO: 6256436 - DNA, 21 bp, Homo sapiens
gcctgtcccatggacactcca

SEQ ID NO: 6256437 - DNA, 22 bp, Homo sapiens
gcctgtcccatggacactccag

SEQ ID NO: 6256438 - DNA, 23 bp, Homo sapiens
gcctgtccccagaccaaccctgg

SEQ ID NO: 6256439 - DNA, 13 bp, Homo sapiens
gcctgtccccctg

SEQ ID NO: 6256440 - DNA, 17 bp, Homo sapiens
gcctgtccccgccttcc

SEQ ID NO: 6256441 - DNA, 14 bp, Homo sapiens
gcctgtcccctcac

SEQ ID NO: 6256442 - DNA, 22 bp, Homo sapiens
gcctgtccctagggctctccaa

SEQ ID NO: 6256443 - DNA, 12 bp, Homo sapiens
gcctgtccctgg

SEQ ID NO: 6256444 - DNA, 18 bp, Homo sapiens
gcctgtccctggccatct

SEQ ID NO: 6256445 - DNA, 20 bp, Homo sapiens
gcctgtccctggccatctct

SEQ ID NO: 6256446 - DNA, 21 bp, Homo sapiens
gcctgtccctggccatctctg

SEQ ID NO: 6256447 - DNA, 14 bp, Homo sapiens
gcctgtccctggga

SEQ ID NO: 6256448 - DNA, 16 bp, Homo sapiens
gcctgtccctgggagt

SEQ ID NO: 6256449 - DNA, 17 bp, Homo sapiens
gcctgtcccttgcctct

SEQ ID NO: 6256450 - DNA, 11 bp, Homo sapiens
gcctgtcctca

SEQ ID NO: 6256451 - DNA, 16 bp, Homo sapiens
gcctgtcctcctggaa

SEQ ID NO: 6256452 - DNA, 15 bp, Homo sapiens
gcctgtcctgaaagc

SEQ ID NO: 6256453 - DNA, 22 bp, Homo sapiens
gcctgtcctgaaagcggctgcc

SEQ ID NO: 6256454 - DNA, 20 bp, Homo sapiens
gcctgtcctgacctgtctca

SEQ ID NO: 6256455 - DNA, 12 bp, Homo sapiens
gcctgtcctgcc

SEQ ID NO: 6256456 - DNA, 13 bp, Homo sapiens
gcctgtcctgcct

SEQ ID NO: 6256457 - DNA, 15 bp, Homo sapiens
gcctgtcctgcctct

SEQ ID NO: 6256458 - DNA, 16 bp, Homo sapiens
gcctgtcctgggctgg

SEQ ID NO: 6256459 - DNA, 16 bp, Homo sapiens
gcctgtcctggtacag

SEQ ID NO: 6256460 - DNA, 20 bp, Homo sapiens
gcctgtcctggtacagcagg

SEQ ID NO: 6256461 - DNA, 21 bp, Homo sapiens
gcctgtcctggtacagcaggg

SEQ ID NO: 6256462 - DNA, 16 bp, Homo sapiens
gcctgtcgatgagact

SEQ ID NO: 6256463 - DNA, 22 bp, Homo sapiens
gcctgtcggccacaccccagac

SEQ ID NO: 6256464 - DNA, 23 bp, Homo sapiens
gcctgtcggccacaccccagact

SEQ ID NO: 6256465 - DNA, 15 bp, Homo sapiens
gcctgtcgggcccgc

SEQ ID NO: 6256466 - DNA, 18 bp, Homo sapiens
gcctgtcgggcccgcact

SEQ ID NO: 6256467 - DNA, 14 bp, Homo sapiens
gcctgtcgtgccag

SEQ ID NO: 6256468 - DNA, 16 bp, Homo sapiens
gcctgtcgtgccagtc

SEQ ID NO: 6256469 - DNA, 21 bp, Homo sapiens
gcctgtcgtgccagtcctggg

SEQ ID NO: 6256470 - DNA, 14 bp, Homo sapiens
gcctgtctaaagcc

SEQ ID NO: 6256471 - DNA, 12 bp, Homo sapiens
gcctgtctcagt

SEQ ID NO: 6256472 - DNA, 15 bp, Homo sapiens
gcctgtctcagtgat

SEQ ID NO: 6256473 - DNA, 18 bp, Homo sapiens
gcctgtctcatccccagg

SEQ ID NO: 6256474 - DNA, 19 bp, Homo sapiens
gcctgtctcatccccaggg

SEQ ID NO: 6256475 - DNA, 22 bp, Homo sapiens
gcctgtctcctttgcaggctca

SEQ ID NO: 6256476 - DNA, 20 bp, Homo sapiens
gcctgtctcggaacctgtga

SEQ ID NO: 6256477 - DNA, 19 bp, Homo sapiens
gcctgtctctattagctgg

SEQ ID NO: 6256478 - DNA, 14 bp, Homo sapiens
gcctgtctctgttc

SEQ ID NO: 6256479 - DNA, 19 bp, Homo sapiens
gcctgtctctttaagggca

SEQ ID NO: 6256480 - DNA, 15 bp, Homo sapiens
gcctgtctgccccag

SEQ ID NO: 6256481 - DNA, 15 bp, Homo sapiens
gcctgtctgtacttc

SEQ ID NO: 6256482 - DNA, 16 bp, Homo sapiens
gcctgtctgtccaacc

SEQ ID NO: 6256483 - DNA, 17 bp, Homo sapiens
gcctgtctgtctctcca

SEQ ID NO: 6256484 - DNA, 19 bp, Homo sapiens
gcctgtctgtgaagagcaa

SEQ ID NO: 6256485 - DNA, 23 bp, Homo sapiens
gcctgtcttcagatcctgctgcc

SEQ ID NO: 6256486 - DNA, 14 bp, Homo sapiens
gcctgtctttcagc

SEQ ID NO: 6256487 - DNA, 14 bp, Homo sapiens
gcctgtgaacccag

SEQ ID NO: 6256488 - DNA, 15 bp, Homo sapiens
gcctgtgaacccagg

SEQ ID NO: 6256489 - DNA, 17 bp, Homo sapiens
gcctgtgaacccaggac

SEQ ID NO: 6256490 - DNA, 21 bp, Homo sapiens
gcctgtgaacccaggacaagc

SEQ ID NO: 6256491 - DNA, 17 bp, Homo sapiens
gcctgtgaactgaactc

SEQ ID NO: 6256492 - DNA, 11 bp, Homo sapiens
gcctgtgaatc

SEQ ID NO: 6256493 - DNA, 23 bp, Homo sapiens
gcctgtgacataccccctccccc

SEQ ID NO: 6256494 - DNA, 16 bp, Homo sapiens
gcctgtgaccttggga

SEQ ID NO: 6256495 - DNA, 14 bp, Homo sapiens
gcctgtgagcaaga

SEQ ID NO: 6256496 - DNA, 21 bp, Homo sapiens
gcctgtgagcatggggccagg

SEQ ID NO: 6256497 - DNA, 16 bp, Homo sapiens
gcctgtgagccagtct

SEQ ID NO: 6256498 - DNA, 15 bp, Homo sapiens
gcctgtgagccattg

SEQ ID NO: 6256499 - DNA, 23 bp, Homo sapiens
gcctgtgagctaggaattgtgtt

SEQ ID NO: 6256500 - DNA, 18 bp, Homo sapiens
gcctgtgaggcaggggcg

SEQ ID NO: 6256501 - DNA, 20 bp, Homo sapiens
gcctgtgaggggcccctggc

SEQ ID NO: 6256502 - DNA, 24 bp, Homo sapiens
gcctgtgaggggcccctggcccag

SEQ ID NO: 6256503 - DNA, 19 bp, Homo sapiens
gcctgtgatccaggaaaga

SEQ ID NO: 6256504 - DNA, 20 bp, Homo sapiens
gcctgtgatgttttatcctt

SEQ ID NO: 6256505 - DNA, 18 bp, Homo sapiens
gcctgtgattaacttgct

SEQ ID NO: 6256506 - DNA, 23 bp, Homo sapiens
gcctgtgcactgggcaggttcct

SEQ ID NO: 6256507 - DNA, 13 bp, Homo sapiens
gcctgtgcagcag

SEQ ID NO: 6256508 - DNA, 16 bp, Homo sapiens
gcctgtgcagcagccc

SEQ ID NO: 6256509 - DNA, 19 bp, Homo sapiens
gcctgtgcagcagcccagc

SEQ ID NO: 6256510 - DNA, 20 bp, Homo sapiens
gcctgtgcagcagcccagct

SEQ ID NO: 6256511 - DNA, 19 bp, Homo sapiens
gcctgtgcatgtatgtctt

SEQ ID NO: 6256512 - DNA, 14 bp, Homo sapiens
gcctgtgccacccc

SEQ ID NO: 6256513 - DNA, 16 bp, Homo sapiens
gcctgtgccacctgca

SEQ ID NO: 6256514 - DNA, 15 bp, Homo sapiens
gcctgtgccaggtga

SEQ ID NO: 6256515 - DNA, 22 bp, Homo sapiens
gcctgtgccaggtgaggtcagc

SEQ ID NO: 6256516 - DNA, 14 bp, Homo sapiens
gcctgtgccatgcc

SEQ ID NO: 6256517 - DNA, 15 bp, Homo sapiens
gcctgtgccatgccc

SEQ ID NO: 6256518 - DNA, 13 bp, Homo sapiens
gcctgtgcccgca

SEQ ID NO: 6256519 - DNA, 17 bp, Homo sapiens
gcctgtgcccgctgcgc

SEQ ID NO: 6256520 - DNA, 21 bp, Homo sapiens
gcctgtgcccgctgcgctgcc

SEQ ID NO: 6256521 - DNA, 16 bp, Homo sapiens
gcctgtgcccttgctg

SEQ ID NO: 6256522 - DNA, 22 bp, Homo sapiens
gcctgtgcccttgctgggtcca

SEQ ID NO: 6256523 - DNA, 18 bp, Homo sapiens
gcctgtgcctctgggact

SEQ ID NO: 6256524 - DNA, 13 bp, Homo sapiens
gcctgtgcctgcc

SEQ ID NO: 6256525 - DNA, 17 bp, Homo sapiens
gcctgtgcctgccatgg

SEQ ID NO: 6256526 - DNA, 15 bp, Homo sapiens
gcctgtgcctgtcag

SEQ ID NO: 6256527 - DNA, 12 bp, Homo sapiens
gcctgtgccttc

SEQ ID NO: 6256528 - DNA, 18 bp, Homo sapiens
gcctgtgccttcctcccc

SEQ ID NO: 6256529 - DNA, 13 bp, Homo sapiens
gcctgtgctcctg

SEQ ID NO: 6256530 - DNA, 15 bp, Homo sapiens
gcctgtgctcctgcc

SEQ ID NO: 6256531 - DNA, 16 bp, Homo sapiens
gcctgtgctcctgccc

SEQ ID NO: 6256532 - DNA, 17 bp, Homo sapiens
gcctgtgctcctgccca

SEQ ID NO: 6256533 - DNA, 15 bp, Homo sapiens
gcctgtgctgcatgc

SEQ ID NO: 6256534 - DNA, 21 bp, Homo sapiens
gcctgtgctgcatgcgacagc

SEQ ID NO: 6256535 - DNA, 23 bp, Homo sapiens
gcctgtgctgcccgtcttcagcc

SEQ ID NO: 6256536 - DNA, 16 bp, Homo sapiens
gcctgtgctgggccag

SEQ ID NO: 6256537 - DNA, 14 bp, Homo sapiens
gcctgtgctgtgac

SEQ ID NO: 6256538 - DNA, 13 bp, Homo sapiens
gcctgtgcttgga

SEQ ID NO: 6256539 - DNA, 15 bp, Homo sapiens
gcctgtgcttggagg

SEQ ID NO: 6256540 - DNA, 14 bp, Homo sapiens
gattaggtcttgct

SEQ ID NO: 6256541 - DNA, 20 bp, Homo sapiens
gattaggtcttgctggaaga

SEQ ID NO: 6256542 - DNA, 22 bp, Homo sapiens
gattaggtgaagggatggggga

SEQ ID NO: 6256543 - DNA, 20 bp, Homo sapiens
gattaggtttcagcagagct

SEQ ID NO: 6256544 - DNA, 20 bp, Homo sapiens
gattagtagaaaatacatta

SEQ ID NO: 6256545 - DNA, 17 bp, Homo sapiens
gattagtattcaggcac

SEQ ID NO: 6256546 - DNA, 22 bp, Homo sapiens
gattagtattcaggcactgaga

SEQ ID NO: 6256547 - DNA, 12 bp, Homo sapiens
gattagtatttt

SEQ ID NO: 6256548 - DNA, 20 bp, Homo sapiens
gattagtgaactaagttatt

SEQ ID NO: 6256549 - DNA, 15 bp, Homo sapiens
gattagtgatgtcct

SEQ ID NO: 6256550 - DNA, 17 bp, Homo sapiens
gattagttgacagtatt

SEQ ID NO: 6256551 - DNA, 20 bp, Homo sapiens
gattataaaaaatgtaacat

SEQ ID NO: 6256552 - DNA, 16 bp, Homo sapiens
gattataaaattattt

SEQ ID NO: 6256553 - DNA, 22 bp, Homo sapiens
gattataaacaacctagacagt

SEQ ID NO: 6256554 - DNA, 14 bp, Homo sapiens
gattataaatgttt

SEQ ID NO: 6256555 - DNA, 21 bp, Homo sapiens
gattataatatgtgccttaag

SEQ ID NO: 6256556 - DNA, 14 bp, Homo sapiens
gattataatcagaa

SEQ ID NO: 6256557 - DNA, 15 bp, Homo sapiens
gattatacaaaaaaa

SEQ ID NO: 6256558 - DNA, 21 bp, Homo sapiens
gattatacaaaagagcatgga

SEQ ID NO: 6256559 - DNA, 15 bp, Homo sapiens
gattatagattctaa

SEQ ID NO: 6256560 - DNA, 22 bp, Homo sapiens
gattatagattctaaagattct

SEQ ID NO: 6256561 - DNA, 20 bp, Homo sapiens
gattatagattggagccacc

SEQ ID NO: 6256562 - DNA, 17 bp, Homo sapiens
gattatagtaactataa

SEQ ID NO: 6256563 - DNA, 16 bp, Homo sapiens
gattatataagcaaaa

SEQ ID NO: 6256564 - DNA, 18 bp, Homo sapiens
gattatatatcataaagt

SEQ ID NO: 6256565 - DNA, 21 bp, Homo sapiens
gattatatatcataaagtatg

SEQ ID NO: 6256566 - DNA, 22 bp, Homo sapiens
gattatatcattttgtggatat

SEQ ID NO: 6256567 - DNA, 17 bp, Homo sapiens
gattatatgaagtttaa

SEQ ID NO: 6256568 - DNA, 13 bp, Homo sapiens
gattatatgggta

SEQ ID NO: 6256569 - DNA, 17 bp, Homo sapiens
gattatattgagacaaa

SEQ ID NO: 6256570 - DNA, 18 bp, Homo sapiens
gattatcagtagaaagag

SEQ ID NO: 6256571 - DNA, 22 bp, Homo sapiens
gattatcagtagaaagagtgtt

SEQ ID NO: 6256572 - DNA, 19 bp, Homo sapiens
gattatcctgttactgaat

SEQ ID NO: 6256573 - DNA, 13 bp, Homo sapiens
gattatctaccca

SEQ ID NO: 6256574 - DNA, 20 bp, Homo sapiens
gattatctatttgtgtgtgt

SEQ ID NO: 6256575 - DNA, 18 bp, Homo sapiens
gattatcttcagcccagg

SEQ ID NO: 6256576 - DNA, 13 bp, Homo sapiens
gattatcttgaaa

SEQ ID NO: 6256577 - DNA, 20 bp, Homo sapiens
gattatcttgaaaaagtatt

SEQ ID NO: 6256578 - DNA, 13 bp, Homo sapiens
gattatgaaatgc

SEQ ID NO: 6256579 - DNA, 14 bp, Homo sapiens
gattatgaaatgcc

SEQ ID NO: 6256580 - DNA, 18 bp, Homo sapiens
gattatgaaatgccagac

SEQ ID NO: 6256581 - DNA, 13 bp, Homo sapiens
gattatgaaatgt

SEQ ID NO: 6256582 - DNA, 21 bp, Homo sapiens
gattatgagttccctaaacaa

SEQ ID NO: 6256583 - DNA, 16 bp, Homo sapiens
gattatgggtcacagg

SEQ ID NO: 6256584 - DNA, 17 bp, Homo sapiens
gattatgggtcacagga

SEQ ID NO: 6256585 - DNA, 15 bp, Homo sapiens
gattatgggtcctgc

SEQ ID NO: 6256586 - DNA, 17 bp, Homo sapiens
gattatgggtcctgcaa

SEQ ID NO: 6256587 - DNA, 16 bp, Homo sapiens
gattatggttttgtga

SEQ ID NO: 6256588 - DNA, 16 bp, Homo sapiens
gattatgtaagcattt

SEQ ID NO: 6256589 - DNA, 15 bp, Homo sapiens
gattatgttcctgct

SEQ ID NO: 6256590 - DNA, 19 bp, Homo sapiens
gattatgttcctgctgtat

SEQ ID NO: 6256591 - DNA, 22 bp, Homo sapiens
gattatgttcctgctgtatttc

SEQ ID NO: 6256592 - DNA, 12 bp, Homo sapiens
gattattaaaat

SEQ ID NO: 6256593 - DNA, 23 bp, Homo sapiens
gattattaactaatatgggcatt

SEQ ID NO: 6256594 - DNA, 16 bp, Homo sapiens
gattattataaactat

SEQ ID NO: 6256595 - DNA, 14 bp, Homo sapiens
gattattatagcaa

SEQ ID NO: 6256596 - DNA, 16 bp, Homo sapiens
gattattcaacagaga

SEQ ID NO: 6256597 - DNA, 12 bp, Homo sapiens
gattattcaaga

SEQ ID NO: 6256598 - DNA, 14 bp, Homo sapiens
gattattcatttaa

SEQ ID NO: 6256599 - DNA, 15 bp, Homo sapiens
gattattcatttaaa

SEQ ID NO: 6256600 - DNA, 19 bp, Homo sapiens
gattattcatttaaaatga

SEQ ID NO: 6256601 - DNA, 19 bp, Homo sapiens
gattattctgattccactt

SEQ ID NO: 6256602 - DNA, 15 bp, Homo sapiens
gattattggctgctt

SEQ ID NO: 6256603 - DNA, 14 bp, Homo sapiens
gattattgtctgat

SEQ ID NO: 6256604 - DNA, 13 bp, Homo sapiens
gattatttacaag

SEQ ID NO: 6256605 - DNA, 16 bp, Homo sapiens
gattatttatgacctg

SEQ ID NO: 6256606 - DNA, 15 bp, Homo sapiens
gattatttatttctg

SEQ ID NO: 6256607 - DNA, 23 bp, Homo sapiens
gattatttcactttagatgctga

SEQ ID NO: 6256608 - DNA, 18 bp, Homo sapiens
gattatttgtgcatttta

SEQ ID NO: 6256609 - DNA, 15 bp, Homo sapiens
gattattttctatat

SEQ ID NO: 6256610 - DNA, 14 bp, Homo sapiens
gattattttggaaa

SEQ ID NO: 6256611 - DNA, 21 bp, Homo sapiens
gattattttgtgcaacataac

SEQ ID NO: 6256612 - DNA, 16 bp, Homo sapiens
gattattttttcagac

SEQ ID NO: 6256613 - DNA, 17 bp, Homo sapiens
gattattttttttttct

SEQ ID NO: 6256614 - DNA, 14 bp, Homo sapiens
gattcaaaaaaaaa

SEQ ID NO: 6256615 - DNA, 14 bp, Homo sapiens
gattcaaaatattt

SEQ ID NO: 6256616 - DNA, 23 bp, Homo sapiens
gattcaaaatatttaaaaatgtc

SEQ ID NO: 6256617 - DNA, 17 bp, Homo sapiens
gattcaaataaccctga

SEQ ID NO: 6256618 - DNA, 14 bp, Homo sapiens
gattcaaatgcatg

SEQ ID NO: 6256619 - DNA, 19 bp, Homo sapiens
gattcaacaggttttcctg

SEQ ID NO: 6256620 - DNA, 13 bp, Homo sapiens
gattcaacatcaa

SEQ ID NO: 6256621 - DNA, 19 bp, Homo sapiens
gattcaaccaaccaaggac

SEQ ID NO: 6256622 - DNA, 22 bp, Homo sapiens
gattcaacctgatacatttaca

SEQ ID NO: 6256623 - DNA, 13 bp, Homo sapiens
gattcaataatga

SEQ ID NO: 6256624 - DNA, 21 bp, Homo sapiens
gattcaatattgaatttttcc

SEQ ID NO: 6256625 - DNA, 18 bp, Homo sapiens
gattcaatcgactgggtt

SEQ ID NO: 6256626 - DNA, 18 bp, Homo sapiens
gattcaatctgtaaactg

SEQ ID NO: 6256627 - DNA, 22 bp, Homo sapiens
gattcaatctgtaaactgtgta

SEQ ID NO: 6256628 - DNA, 13 bp, Homo sapiens
gattcaatgtgaa

SEQ ID NO: 6256629 - DNA, 15 bp, Homo sapiens
gattcaattaacata

SEQ ID NO: 6256630 - DNA, 17 bp, Homo sapiens
gattcaattataattgt

SEQ ID NO: 6256631 - DNA, 17 bp, Homo sapiens
gattcaattttctttaa

SEQ ID NO: 6256632 - DNA, 21 bp, Homo sapiens
gattcacaactaggacctcat

SEQ ID NO: 6256633 - DNA, 12 bp, Homo sapiens
gattcacacatg

SEQ ID NO: 6256634 - DNA, 23 bp, Homo sapiens
gattcacacatgcctatattatc

SEQ ID NO: 6256635 - DNA, 17 bp, Homo sapiens
gattcacatgttttcaa

SEQ ID NO: 6256636 - DNA, 20 bp, Homo sapiens
gattcacatgttttcaaatg

SEQ ID NO: 6256637 - DNA, 21 bp, Homo sapiens
gattcaccctgtccaaactgc

SEQ ID NO: 6256638 - DNA, 17 bp, Homo sapiens
gattcacctcttcctct

SEQ ID NO: 6256639 - DNA, 14 bp, Homo sapiens
gattcacctgagca

SEQ ID NO: 6256640 - DNA, 15 bp, Homo sapiens
gattcacctgtaaaa

SEQ ID NO: 6256641 - DNA, 16 bp, Homo sapiens
gattcacctgtaaaac

SEQ ID NO: 6256642 - DNA, 16 bp, Homo sapiens
gattcactattagaga

SEQ ID NO: 6256643 - DNA, 15 bp, Homo sapiens
gattcactcagaaga

SEQ ID NO: 6256644 - DNA, 13 bp, Homo sapiens
gattcactggcct

SEQ ID NO: 6256645 - DNA, 14 bp, Homo sapiens
gattcactggcctg

SEQ ID NO: 6256646 - DNA, 20 bp, Homo sapiens
gattcactggcctggcggag

SEQ ID NO: 6256647 - DNA, 13 bp, Homo sapiens
gattcactgtgct

SEQ ID NO: 6256648 - DNA, 19 bp, Homo sapiens
gattcactgtgcttcgagc

SEQ ID NO: 6256649 - DNA, 14 bp, Homo sapiens
gattcagacagctg

SEQ ID NO: 6256650 - DNA, 18 bp, Homo sapiens
gattcagacagctgcctg

SEQ ID NO: 6256651 - DNA, 16 bp, Homo sapiens
gattcagactgcttca

SEQ ID NO: 6256652 - DNA, 21 bp, Homo sapiens
gattcagagaaaggcaaggga

SEQ ID NO: 6256653 - DNA, 21 bp, Homo sapiens
gattcagaggtcacttcattt

SEQ ID NO: 6256654 - DNA, 20 bp, Homo sapiens
gattcagatttctctttgaa

SEQ ID NO: 6256655 - DNA, 12 bp, Homo sapiens
gattcagccttc

SEQ ID NO: 6256656 - DNA, 23 bp, Homo sapiens
gattcagccttctttttctggac

SEQ ID NO: 6256657 - DNA, 20 bp, Homo sapiens
gattcagctcattatgaaaa

SEQ ID NO: 6256658 - DNA, 22 bp, Homo sapiens
gattcagctcattatgaaaaac

SEQ ID NO: 6256659 - DNA, 23 bp, Homo sapiens
gattcagctcattatgaaaaaca

SEQ ID NO: 6256660 - DNA, 13 bp, Homo sapiens
gattcagctctgc

SEQ ID NO: 6256661 - DNA, 18 bp, Homo sapiens
gattcaggaaaaggcctg

SEQ ID NO: 6256662 - DNA, 20 bp, Homo sapiens
gattcaggaaaaggcctggg

SEQ ID NO: 6256663 - DNA, 20 bp, Homo sapiens
gattcaggcagcagtgtctg

SEQ ID NO: 6256664 - DNA, 17 bp, Homo sapiens
gattcaggcattttccc

SEQ ID NO: 6256665 - DNA, 15 bp, Homo sapiens
gattcaggccagccc

SEQ ID NO: 6256666 - DNA, 17 bp, Homo sapiens
gattcaggccagcccag

SEQ ID NO: 6256667 - DNA, 13 bp, Homo sapiens
gattcaggctgct

SEQ ID NO: 6256668 - DNA, 13 bp, Homo sapiens
gattcaggggctt

SEQ ID NO: 6256669 - DNA, 16 bp, Homo sapiens
gattcaggggctttgg

SEQ ID NO: 6256670 - DNA, 17 bp, Homo sapiens
gattcaggtatgttgcc

SEQ ID NO: 6256671 - DNA, 17 bp, Homo sapiens
gattcagtcttctggat

SEQ ID NO: 6256672 - DNA, 18 bp, Homo sapiens
gattcagtcttctggatt

SEQ ID NO: 6256673 - DNA, 15 bp, Homo sapiens
gattcagtcttgcct

SEQ ID NO: 6256674 - DNA, 17 bp, Homo sapiens
gattcagtcttgcctta

SEQ ID NO: 6256675 - DNA, 18 bp, Homo sapiens
gattcagtcttgccttac

SEQ ID NO: 6256676 - DNA, 23 bp, Homo sapiens
gattcagtcttgccttacacaaa

SEQ ID NO: 6256677 - DNA, 20 bp, Homo sapiens
gattcagtggaggctggcag

SEQ ID NO: 6256678 - DNA, 22 bp, Homo sapiens
gattcagttttcatttggttca

SEQ ID NO: 6256679 - DNA, 17 bp, Homo sapiens
gattcataaagtaatga

SEQ ID NO: 6256680 - DNA, 14 bp, Homo sapiens
gattcataacaatg

SEQ ID NO: 6256681 - DNA, 15 bp, Homo sapiens
gattcatagtaaaat

SEQ ID NO: 6256682 - DNA, 16 bp, Homo sapiens
gattcatagtaacttc

SEQ ID NO: 6256683 - DNA, 18 bp, Homo sapiens
gattcatatttacttctt

SEQ ID NO: 6256684 - DNA, 19 bp, Homo sapiens
gattcatatttacttctta

SEQ ID NO: 6256685 - DNA, 16 bp, Homo sapiens
gattcatctatggagg

SEQ ID NO: 6256686 - DNA, 22 bp, Homo sapiens
gattcatctctcagaagggagg

SEQ ID NO: 6256687 - DNA, 23 bp, Homo sapiens
gattcatctctcagaagggaggc

SEQ ID NO: 6256688 - DNA, 19 bp, Homo sapiens
gattcatctttcagaaata

SEQ ID NO: 6256689 - DNA, 20 bp, Homo sapiens
gattcatggagtagcctgga

SEQ ID NO: 6256690 - DNA, 16 bp, Homo sapiens
gattcatggctttgta

SEQ ID NO: 6256691 - DNA, 11 bp, Homo sapiens
gattcatgtgg

SEQ ID NO: 6256692 - DNA, 14 bp, Homo sapiens
gattcattcttaac

SEQ ID NO: 6256693 - DNA, 20 bp, Homo sapiens
gattcatttcatcttgcaaa

SEQ ID NO: 6256694 - DNA, 16 bp, Homo sapiens
gattcatttcctgccc

SEQ ID NO: 6256695 - DNA, 14 bp, Homo sapiens
gattcattttcctg

SEQ ID NO: 6256696 - DNA, 18 bp, Homo sapiens
gattcatttttgaaactg

SEQ ID NO: 6256697 - DNA, 13 bp, Homo sapiens
gattccaaaccag

SEQ ID NO: 6256698 - DNA, 19 bp, Homo sapiens
gattccaaagagtagaatt

SEQ ID NO: 6256699 - DNA, 10 bp, Homo sapiens
gattccaaat

SEQ ID NO: 6256700 - DNA, 12 bp, Homo sapiens
gattccaaataa

SEQ ID NO: 6256701 - DNA, 23 bp, Homo sapiens
gattccaaataaaacttgagccc

SEQ ID NO: 6256702 - DNA, 17 bp, Homo sapiens
gattccaaccccaactc

SEQ ID NO: 6256703 - DNA, 18 bp, Homo sapiens
gattccaaccttcctttt

SEQ ID NO: 6256704 - DNA, 21 bp, Homo sapiens
gattccaaggctttaaagctg

SEQ ID NO: 6256705 - DNA, 14 bp, Homo sapiens
gattccaagtgatg

SEQ ID NO: 6256706 - DNA, 17 bp, Homo sapiens
gattccacacaaaatgt

SEQ ID NO: 6256707 - DNA, 18 bp, Homo sapiens
gattccacacaaaatgtc

SEQ ID NO: 6256708 - DNA, 17 bp, Homo sapiens
gattccactacacctgg

SEQ ID NO: 6256709 - DNA, 20 bp, Homo sapiens
gattccactacacctggctg

SEQ ID NO: 6256710 - DNA, 18 bp, Homo sapiens
gattccagcagtgaatgc

SEQ ID NO: 6256711 - DNA, 23 bp, Homo sapiens
gattccaggaggagttagccaaa

SEQ ID NO: 6256712 - DNA, 13 bp, Homo sapiens
gattccagtgcag

SEQ ID NO: 6256713 - DNA, 15 bp, Homo sapiens
gattccatctccttg

SEQ ID NO: 6256714 - DNA, 14 bp, Homo sapiens
gattccatgctaag

SEQ ID NO: 6256715 - DNA, 17 bp, Homo sapiens
gattccattccatggaa

SEQ ID NO: 6256716 - DNA, 18 bp, Homo sapiens
gattccattggtccaaga

SEQ ID NO: 6256717 - DNA, 17 bp, Homo sapiens
gattccatttactgcat

SEQ ID NO: 6256718 - DNA, 16 bp, Homo sapiens
gattccattttggaaa

SEQ ID NO: 6256719 - DNA, 17 bp, Homo sapiens
gcctgtggaatgagtgt

SEQ ID NO: 6256720 - DNA, 18 bp, Homo sapiens
gcctgtggaatgagtgtg

SEQ ID NO: 6256721 - DNA, 22 bp, Homo sapiens
gcctgtggacggggaggctctc

SEQ ID NO: 6256722 - DNA, 17 bp, Homo sapiens
gcctgtggcacagccct

SEQ ID NO: 6256723 - DNA, 22 bp, Homo sapiens
gcctgtggcacagccctgagtg

SEQ ID NO: 6256724 - DNA, 14 bp, Homo sapiens
gcctgtggcaggcc

SEQ ID NO: 6256725 - DNA, 20 bp, Homo sapiens
gcctgtggcaggcctaggac

SEQ ID NO: 6256726 - DNA, 23 bp, Homo sapiens
gcctgtggcaggcctaggacctc

SEQ ID NO: 6256727 - DNA, 22 bp, Homo sapiens
gcctgtggcagtaaagagaaac

SEQ ID NO: 6256728 - DNA, 22 bp, Homo sapiens
gcctgtggccatgaccctgcct

SEQ ID NO: 6256729 - DNA, 23 bp, Homo sapiens
gcctgtggccccgaggctgggac

SEQ ID NO: 6256730 - DNA, 19 bp, Homo sapiens
gcctgtggcccctcccctg

SEQ ID NO: 6256731 - DNA, 14 bp, Homo sapiens
gcctgtggccctgt

SEQ ID NO: 6256732 - DNA, 16 bp, Homo sapiens
gcctgtggcctcagca

SEQ ID NO: 6256733 - DNA, 16 bp, Homo sapiens
gcctgtggcctgtgtc

SEQ ID NO: 6256734 - DNA, 18 bp, Homo sapiens
gcctgtggcctgtgtccc

SEQ ID NO: 6256735 - DNA, 23 bp, Homo sapiens
gcctgtggcgccgtctccagggg

SEQ ID NO: 6256736 - DNA, 16 bp, Homo sapiens
gcctgtggcggtgcct

SEQ ID NO: 6256737 - DNA, 18 bp, Homo sapiens
gcctgtggcggtgcctgg

SEQ ID NO: 6256738 - DNA, 19 bp, Homo sapiens
gcctgtggcggtgcctggg

SEQ ID NO: 6256739 - DNA, 12 bp, Homo sapiens
gcctgtggctgc

SEQ ID NO: 6256740 - DNA, 15 bp, Homo sapiens
gcctgtggctgtcgg

SEQ ID NO: 6256741 - DNA, 23 bp, Homo sapiens
gcctgtggctgtcggtgggactc

SEQ ID NO: 6256742 - DNA, 20 bp, Homo sapiens
gcctgtggcttggagtggcc

SEQ ID NO: 6256743 - DNA, 22 bp, Homo sapiens
gcctgtgggagaagggacagcg

SEQ ID NO: 6256744 - DNA, 13 bp, Homo sapiens
gcctgtgggaggg

SEQ ID NO: 6256745 - DNA, 21 bp, Homo sapiens
gcctgtgggcctcacctgccc

SEQ ID NO: 6256746 - DNA, 21 bp, Homo sapiens
gcctgtgggcgcatactacag

SEQ ID NO: 6256747 - DNA, 14 bp, Homo sapiens
gcctgtgggtctct

SEQ ID NO: 6256748 - DNA, 20 bp, Homo sapiens
gcctgtggtgaagtgtggct

SEQ ID NO: 6256749 - DNA, 23 bp, Homo sapiens
gcctgtggtgaagtgtggctggt

SEQ ID NO: 6256750 - DNA, 19 bp, Homo sapiens
gcctgtggtgaggtcctgt

SEQ ID NO: 6256751 - DNA, 16 bp, Homo sapiens
gcctgtggttctgaga

SEQ ID NO: 6256752 - DNA, 18 bp, Homo sapiens
gcctgtgtaacagctcct

SEQ ID NO: 6256753 - DNA, 19 bp, Homo sapiens
gcctgtgtaacagctcctt

SEQ ID NO: 6256754 - DNA, 15 bp, Homo sapiens
gcctgtgtagctgtg

SEQ ID NO: 6256755 - DNA, 20 bp, Homo sapiens
gcctgtgtcacgagcccttt

SEQ ID NO: 6256756 - DNA, 13 bp, Homo sapiens
gcctgtgtccagc

SEQ ID NO: 6256757 - DNA, 14 bp, Homo sapiens
gcctgtgtccagca

SEQ ID NO: 6256758 - DNA, 20 bp, Homo sapiens
gcctgtgtccagcagctgcg

SEQ ID NO: 6256759 - DNA, 21 bp, Homo sapiens
gcctgtgtccagcagctgcgg

SEQ ID NO: 6256760 - DNA, 12 bp, Homo sapiens
gcctgtgtccat

SEQ ID NO: 6256761 - DNA, 20 bp, Homo sapiens
gcctgtgtccatgcgctcag

SEQ ID NO: 6256762 - DNA, 11 bp, Homo sapiens
gcctgtgtccc

SEQ ID NO: 6256763 - DNA, 22 bp, Homo sapiens
gcctgtgtcccatgacccaccc

SEQ ID NO: 6256764 - DNA, 23 bp, Homo sapiens
gcctgtgtcccatgacccacccc

SEQ ID NO: 6256765 - DNA, 15 bp, Homo sapiens
gcctgtgtctggccc

SEQ ID NO: 6256766 - DNA, 22 bp, Homo sapiens
gcctgtgtctttaaatgctgct

SEQ ID NO: 6256767 - DNA, 22 bp, Homo sapiens
gcctgtgtgacatcagtggcat

SEQ ID NO: 6256768 - DNA, 18 bp, Homo sapiens
gcctgtgtgagcatctct

SEQ ID NO: 6256769 - DNA, 20 bp, Homo sapiens
gcctgtgtgagcatctctgt

SEQ ID NO: 6256770 - DNA, 23 bp, Homo sapiens
gcctgtgtggaggcctcagggag

SEQ ID NO: 6256771 - DNA, 24 bp, Homo sapiens
gcctgtgttagtgtctgtccatct

SEQ ID NO: 6256772 - DNA, 18 bp, Homo sapiens
gcctgtgttcttcctggc

SEQ ID NO: 6256773 - DNA, 23 bp, Homo sapiens
gcctgttaatttataatgtattt

SEQ ID NO: 6256774 - DNA, 15 bp, Homo sapiens
gcctgttacaggaat

SEQ ID NO: 6256775 - DNA, 14 bp, Homo sapiens
gcctgttcacgtgt

SEQ ID NO: 6256776 - DNA, 12 bp, Homo sapiens
gcctgttcagtt

SEQ ID NO: 6256777 - DNA, 13 bp, Homo sapiens
gcctgttcagtta

SEQ ID NO: 6256778 - DNA, 20 bp, Homo sapiens
gcctgttcagttacagaaag

SEQ ID NO: 6256779 - DNA, 21 bp, Homo sapiens
gcctgttcagttacagaaagt

SEQ ID NO: 6256780 - DNA, 22 bp, Homo sapiens
gcctgttcagttacagaaagtg

SEQ ID NO: 6256781 - DNA, 22 bp, Homo sapiens
gcctgttcccactcagcagtga

SEQ ID NO: 6256782 - DNA, 12 bp, Homo sapiens
gcctgttcccta

SEQ ID NO: 6256783 - DNA, 15 bp, Homo sapiens
gcctgttccctgagg

SEQ ID NO: 6256784 - DNA, 15 bp, Homo sapiens
gcctgttccttcctg

SEQ ID NO: 6256785 - DNA, 19 bp, Homo sapiens
gcctgttccttcctgcaga

SEQ ID NO: 6256786 - DNA, 13 bp, Homo sapiens
gcctgttctccag

SEQ ID NO: 6256787 - DNA, 15 bp, Homo sapiens
gcctgttctgaggat

SEQ ID NO: 6256788 - DNA, 13 bp, Homo sapiens
gcctgttctgctt

SEQ ID NO: 6256789 - DNA, 22 bp, Homo sapiens
gcctgttctgtaggagagactg

SEQ ID NO: 6256790 - DNA, 19 bp, Homo sapiens
gcctgttgaaggtacatcg

SEQ ID NO: 6256791 - DNA, 23 bp, Homo sapiens
gcctgttgaaggtacatcgtttg

SEQ ID NO: 6256792 - DNA, 16 bp, Homo sapiens
gcctgttgatctatgg

SEQ ID NO: 6256793 - DNA, 19 bp, Homo sapiens
gcctgttgctgaagtcatt

SEQ ID NO: 6256794 - DNA, 16 bp, Homo sapiens
gcctgttggcaggccc

SEQ ID NO: 6256795 - DNA, 18 bp, Homo sapiens
gcctgttggcaggcccac

SEQ ID NO: 6256796 - DNA, 19 bp, Homo sapiens
gcctgttggcaggcccact

SEQ ID NO: 6256797 - DNA, 15 bp, Homo sapiens
gcctgttgggccagg

SEQ ID NO: 6256798 - DNA, 20 bp, Homo sapiens
gcctgttgggccaggagcct

SEQ ID NO: 6256799 - DNA, 21 bp, Homo sapiens
gcctgttgggccaggagcctc

SEQ ID NO: 6256800 - DNA, 19 bp, Homo sapiens
gcctgtttctgatttgctg

SEQ ID NO: 6256801 - DNA, 16 bp, Homo sapiens
gcctgtttctgcagcc

SEQ ID NO: 6256802 - DNA, 19 bp, Homo sapiens
gcctgtttctgcagccctt

SEQ ID NO: 6256803 - DNA, 22 bp, Homo sapiens
gcctgtttctgcagcccttggg

SEQ ID NO: 6256804 - DNA, 17 bp, Homo sapiens
gcctgtttgatgtatgt

SEQ ID NO: 6256805 - DNA, 21 bp, Homo sapiens
gcctgtttggcctctctatcc

SEQ ID NO: 6256806 - DNA, 19 bp, Homo sapiens
gcctgtttgggaggctgga

SEQ ID NO: 6256807 - DNA, 17 bp, Homo sapiens
gcctgtttgggagtgcg

SEQ ID NO: 6256808 - DNA, 15 bp, Homo sapiens
gcctgtttgggatgt

SEQ ID NO: 6256809 - DNA, 20 bp, Homo sapiens
gcctgtttggggaggggggc

SEQ ID NO: 6256810 - DNA, 14 bp, Homo sapiens
gcctgtttggtgag

SEQ ID NO: 6256811 - DNA, 15 bp, Homo sapiens
gcctgttttgagacc

SEQ ID NO: 6256812 - DNA, 21 bp, Homo sapiens
gcctgttttgagaccagaagg

SEQ ID NO: 6256813 - DNA, 18 bp, Homo sapiens
gcctgtttttgtgagaga

SEQ ID NO: 6256814 - DNA, 21 bp, Homo sapiens
gccttaaaaaaacacggaagc

SEQ ID NO: 6256815 - DNA, 13 bp, Homo sapiens
gccttaaaatgga

SEQ ID NO: 6256816 - DNA, 17 bp, Homo sapiens
gccttaaacaattcttg

SEQ ID NO: 6256817 - DNA, 15 bp, Homo sapiens
gccttaaacctgaag

SEQ ID NO: 6256818 - DNA, 22 bp, Homo sapiens
gccttaaactctggacactcta

SEQ ID NO: 6256819 - DNA, 13 bp, Homo sapiens
gccttaaagacaa

SEQ ID NO: 6256820 - DNA, 19 bp, Homo sapiens
gccttaaagagggacaggc

SEQ ID NO: 6256821 - DNA, 16 bp, Homo sapiens
gccttaacacactggc

SEQ ID NO: 6256822 - DNA, 19 bp, Homo sapiens
gccttaactaagactcccg

SEQ ID NO: 6256823 - DNA, 21 bp, Homo sapiens
gccttaactaagactcccgcc

SEQ ID NO: 6256824 - DNA, 15 bp, Homo sapiens
gccttaagcagaaca

SEQ ID NO: 6256825 - DNA, 23 bp, Homo sapiens
gccttaagcagaacaaatgtgtt

SEQ ID NO: 6256826 - DNA, 14 bp, Homo sapiens
gccttaagctgcag

SEQ ID NO: 6256827 - DNA, 21 bp, Homo sapiens
gccttaaggtagaaggcacat

SEQ ID NO: 6256828 - DNA, 17 bp, Homo sapiens
gccttaataaatatgta

SEQ ID NO: 6256829 - DNA, 19 bp, Homo sapiens
gccttaataaatatgtaat

SEQ ID NO: 6256830 - DNA, 22 bp, Homo sapiens
gccttaataaatatgtaatata

SEQ ID NO: 6256831 - DNA, 23 bp, Homo sapiens
gccttaatacttttttattttgt

SEQ ID NO: 6256832 - DNA, 20 bp, Homo sapiens
gccttaatctggaaggcccc

SEQ ID NO: 6256833 - DNA, 21 bp, Homo sapiens
gccttaatgagaacatttaca

SEQ ID NO: 6256834 - DNA, 23 bp, Homo sapiens
gccttaattcttacctcatttgc

SEQ ID NO: 6256835 - DNA, 18 bp, Homo sapiens
gccttaatttagaaactg

SEQ ID NO: 6256836 - DNA, 20 bp, Homo sapiens
gccttaatttagaaactgaa

SEQ ID NO: 6256837 - DNA, 22 bp, Homo sapiens
gccttaatttagaaactgaaaa

SEQ ID NO: 6256838 - DNA, 17 bp, Homo sapiens
gccttaatttccttttt

SEQ ID NO: 6256839 - DNA, 12 bp, Homo sapiens
gccttaattttt

SEQ ID NO: 6256840 - DNA, 18 bp, Homo sapiens
gccttaatttttgaaaag

SEQ ID NO: 6256841 - DNA, 22 bp, Homo sapiens
gccttacaaagggaaagcctct

SEQ ID NO: 6256842 - DNA, 16 bp, Homo sapiens
gccttacacaatggtt

SEQ ID NO: 6256843 - DNA, 13 bp, Homo sapiens
gccttacactgaa

SEQ ID NO: 6256844 - DNA, 16 bp, Homo sapiens
gccttacagttatcct

SEQ ID NO: 6256845 - DNA, 17 bp, Homo sapiens
gccttacatctggctgg

SEQ ID NO: 6256846 - DNA, 18 bp, Homo sapiens
gccttaccgagagccaaa

SEQ ID NO: 6256847 - DNA, 17 bp, Homo sapiens
gccttactattgtatta

SEQ ID NO: 6256848 - DNA, 17 bp, Homo sapiens
gccttactcacctctct

SEQ ID NO: 6256849 - DNA, 23 bp, Homo sapiens
gccttagaaacacataaattatg

SEQ ID NO: 6256850 - DNA, 19 bp, Homo sapiens
gccttagaagtcacacagt

SEQ ID NO: 6256851 - DNA, 19 bp, Homo sapiens
gccttagcactatggacat

SEQ ID NO: 6256852 - DNA, 15 bp, Homo sapiens
gccttagcagccctg

SEQ ID NO: 6256853 - DNA, 16 bp, Homo sapiens
gccttagcagccctgg

SEQ ID NO: 6256854 - DNA, 14 bp, Homo sapiens
gccttagcaggggt

SEQ ID NO: 6256855 - DNA, 22 bp, Homo sapiens
gccttagcatgtgactcctgaa

SEQ ID NO: 6256856 - DNA, 16 bp, Homo sapiens
gccttagcatgtgttg

SEQ ID NO: 6256857 - DNA, 15 bp, Homo sapiens
gccttagcatgtttg

SEQ ID NO: 6256858 - DNA, 17 bp, Homo sapiens
gccttagcatgtttgct

SEQ ID NO: 6256859 - DNA, 17 bp, Homo sapiens
gccttagcctcttggaa

SEQ ID NO: 6256860 - DNA, 18 bp, Homo sapiens
gccttagctcccagctag

SEQ ID NO: 6256861 - DNA, 12 bp, Homo sapiens
gccttagctgcc

SEQ ID NO: 6256862 - DNA, 14 bp, Homo sapiens
gccttagcttcagg

SEQ ID NO: 6256863 - DNA, 18 bp, Homo sapiens
gccttagcttcaggaacc

SEQ ID NO: 6256864 - DNA, 21 bp, Homo sapiens
gccttaggaagtgacttgaat

SEQ ID NO: 6256865 - DNA, 15 bp, Homo sapiens
gccttaggcctacct

SEQ ID NO: 6256866 - DNA, 19 bp, Homo sapiens
gccttagggcactgggctg

SEQ ID NO: 6256867 - DNA, 18 bp, Homo sapiens
gccttagtacggctgctg

SEQ ID NO: 6256868 - DNA, 14 bp, Homo sapiens
gccttagtgggcca

SEQ ID NO: 6256869 - DNA, 20 bp, Homo sapiens
gccttagtgggccagggctg

SEQ ID NO: 6256870 - DNA, 16 bp, Homo sapiens
gccttagttaccctga

SEQ ID NO: 6256871 - DNA, 16 bp, Homo sapiens
gccttataaaccaatc

SEQ ID NO: 6256872 - DNA, 15 bp, Homo sapiens
gccttatcctctgat

SEQ ID NO: 6256873 - DNA, 17 bp, Homo sapiens
gccttatcctctgatct

SEQ ID NO: 6256874 - DNA, 19 bp, Homo sapiens
gccttatcgggctccagcc

SEQ ID NO: 6256875 - DNA, 23 bp, Homo sapiens
gccttatctccaagaccagagat

SEQ ID NO: 6256876 - DNA, 19 bp, Homo sapiens
gccttatctgaaaggccag

SEQ ID NO: 6256877 - DNA, 22 bp, Homo sapiens
gccttatctgaaaggccagcag

SEQ ID NO: 6256878 - DNA, 17 bp, Homo sapiens
gccttatcttgaaaaga

SEQ ID NO: 6256879 - DNA, 22 bp, Homo sapiens
gccttatcttgcaccccaaagc

SEQ ID NO: 6256880 - DNA, 18 bp, Homo sapiens
gccttatgaaaattatac

SEQ ID NO: 6256881 - DNA, 21 bp, Homo sapiens
gccttatgagaacatggtgtg

SEQ ID NO: 6256882 - DNA, 18 bp, Homo sapiens
gccttatgagctcagcct

SEQ ID NO: 6256883 - DNA, 14 bp, Homo sapiens
gccttatggaacac

SEQ ID NO: 6256884 - DNA, 16 bp, Homo sapiens
gccttatggaacactc

SEQ ID NO: 6256885 - DNA, 19 bp, Homo sapiens
gccttatggaacactctga

SEQ ID NO: 6256886 - DNA, 19 bp, Homo sapiens
gccttattagagtgtcttt

SEQ ID NO: 6256887 - DNA, 13 bp, Homo sapiens
gccttatttccct

SEQ ID NO: 6256888 - DNA, 22 bp, Homo sapiens
gccttatttgtctgtaaaaaat

SEQ ID NO: 6256889 - DNA, 18 bp, Homo sapiens
gccttatttttgaattct

SEQ ID NO: 6256890 - DNA, 19 bp, Homo sapiens
gccttatttttgaattctt

SEQ ID NO: 6256891 - DNA, 21 bp, Homo sapiens
gccttcaaaaatgtgctgcct

SEQ ID NO: 6256892 - DNA, 22 bp, Homo sapiens
gccttcaaaactatagcttgca

SEQ ID NO: 6256893 - DNA, 18 bp, Homo sapiens
gccttcaaatagtataga

SEQ ID NO: 6256894 - DNA, 14 bp, Homo sapiens
gattcccaactcct

SEQ ID NO: 6256895 - DNA, 16 bp, Homo sapiens
gattcccaagctctgc

SEQ ID NO: 6256896 - DNA, 22 bp, Homo sapiens
gattcccaccaaggtcttcagc

SEQ ID NO: 6256897 - DNA, 23 bp, Homo sapiens
gattcccactgccgctgcccgct

SEQ ID NO: 6256898 - DNA, 18 bp, Homo sapiens
gattcccagaccttaaga

SEQ ID NO: 6256899 - DNA, 13 bp, Homo sapiens
gattcccagagac

SEQ ID NO: 6256900 - DNA, 19 bp, Homo sapiens
gattcccagagagacgctg

SEQ ID NO: 6256901 - DNA, 13 bp, Homo sapiens
gattcccaggcca

SEQ ID NO: 6256902 - DNA, 16 bp, Homo sapiens
gattcccaggccaggc

SEQ ID NO: 6256903 - DNA, 20 bp, Homo sapiens
gattcccaggccaggctccc

SEQ ID NO: 6256904 - DNA, 19 bp, Homo sapiens
gattcccaggccagggctg

SEQ ID NO: 6256905 - DNA, 16 bp, Homo sapiens
gattcccattgaaaat

SEQ ID NO: 6256906 - DNA, 16 bp, Homo sapiens
gattccccactcagcc

SEQ ID NO: 6256907 - DNA, 17 bp, Homo sapiens
gattccccactcagcct

SEQ ID NO: 6256908 - DNA, 11 bp, Homo sapiens
gattcccccag

SEQ ID NO: 6256909 - DNA, 16 bp, Homo sapiens
gattccccctgccctg

SEQ ID NO: 6256910 - DNA, 17 bp, Homo sapiens
gattccccctgccctgt

SEQ ID NO: 6256911 - DNA, 21 bp, Homo sapiens
gattccccctgccctgtgccg

SEQ ID NO: 6256912 - DNA, 17 bp, Homo sapiens
gattccccggagctggg

SEQ ID NO: 6256913 - DNA, 21 bp, Homo sapiens
gattcccctaacctcattccc

SEQ ID NO: 6256914 - DNA, 13 bp, Homo sapiens
gattcccctccac

SEQ ID NO: 6256915 - DNA, 17 bp, Homo sapiens
gattcccgcatggtttt

SEQ ID NO: 6256916 - DNA, 22 bp, Homo sapiens
gattcccgcatggtttttataa

SEQ ID NO: 6256917 - DNA, 20 bp, Homo sapiens
gattcccgtggctttgtgct

SEQ ID NO: 6256918 - DNA, 21 bp, Homo sapiens
gattcccgtggctttgtgctt

SEQ ID NO: 6256919 - DNA, 22 bp, Homo sapiens
gattcccgtggctttgtgctta

SEQ ID NO: 6256920 - DNA, 21 bp, Homo sapiens
gattccctcctgctactctgt

SEQ ID NO: 6256921 - DNA, 13 bp, Homo sapiens
gattccctctccc

SEQ ID NO: 6256922 - DNA, 17 bp, Homo sapiens
gattccctctcccaccc

SEQ ID NO: 6256923 - DNA, 17 bp, Homo sapiens
gattccctctcccaggc

SEQ ID NO: 6256924 - DNA, 18 bp, Homo sapiens
gattccctctcccaggcc

SEQ ID NO: 6256925 - DNA, 14 bp, Homo sapiens
gattccctcttcct

SEQ ID NO: 6256926 - DNA, 11 bp, Homo sapiens
gattccctggt

SEQ ID NO: 6256927 - DNA, 22 bp, Homo sapiens
gattcccttgcactgtatcatt

SEQ ID NO: 6256928 - DNA, 14 bp, Homo sapiens
gattccgcaccctg

SEQ ID NO: 6256929 - DNA, 15 bp, Homo sapiens
gattccgcaccctgc

SEQ ID NO: 6256930 - DNA, 18 bp, Homo sapiens
gattccgcaccctgccta

SEQ ID NO: 6256931 - DNA, 23 bp, Homo sapiens
gattcctaaggcccagctgccag

SEQ ID NO: 6256932 - DNA, 22 bp, Homo sapiens
gattcctacccctcttccagct

SEQ ID NO: 6256933 - DNA, 15 bp, Homo sapiens
gattcctacttaaac

SEQ ID NO: 6256934 - DNA, 17 bp, Homo sapiens
gattcctacttaaacaa

SEQ ID NO: 6256935 - DNA, 19 bp, Homo sapiens
gattcctacttaaacaaaa

SEQ ID NO: 6256936 - DNA, 23 bp, Homo sapiens
gattcctatgatggatggcagac

SEQ ID NO: 6256937 - DNA, 21 bp, Homo sapiens
gattcctcgcgacatcttctc

SEQ ID NO: 6256938 - DNA, 17 bp, Homo sapiens
gattcctctcatttcca

SEQ ID NO: 6256939 - DNA, 17 bp, Homo sapiens
gattcctctctaagtgg

SEQ ID NO: 6256940 - DNA, 22 bp, Homo sapiens
gattcctcttggcaagatgttt

SEQ ID NO: 6256941 - DNA, 15 bp, Homo sapiens
gattcctgacccagg

SEQ ID NO: 6256942 - DNA, 18 bp, Homo sapiens
gattcctgacccaggccg

SEQ ID NO: 6256943 - DNA, 19 bp, Homo sapiens
gattcctgacccaggccgc

SEQ ID NO: 6256944 - DNA, 17 bp, Homo sapiens
gattcctgagctggcct

SEQ ID NO: 6256945 - DNA, 14 bp, Homo sapiens
gattcctgggcctg

SEQ ID NO: 6256946 - DNA, 13 bp, Homo sapiens
gattcctggtttg

SEQ ID NO: 6256947 - DNA, 16 bp, Homo sapiens
gattcctggtttgact

SEQ ID NO: 6256948 - DNA, 12 bp, Homo sapiens
gattccttccca

SEQ ID NO: 6256949 - DNA, 13 bp, Homo sapiens
gattccttctctg

SEQ ID NO: 6256950 - DNA, 22 bp, Homo sapiens
gattccttctctgaacacaggc

SEQ ID NO: 6256951 - DNA, 14 bp, Homo sapiens
gattccttcttccc

SEQ ID NO: 6256952 - DNA, 18 bp, Homo sapiens
gattccttcttgctcagt

SEQ ID NO: 6256953 - DNA, 17 bp, Homo sapiens
gattccttgtgttttgt

SEQ ID NO: 6256954 - DNA, 13 bp, Homo sapiens
gattcctttaaca

SEQ ID NO: 6256955 - DNA, 15 bp, Homo sapiens
gattcctttaacaac

SEQ ID NO: 6256956 - DNA, 10 bp, Homo sapiens
gattcctttt

SEQ ID NO: 6256957 - DNA, 15 bp, Homo sapiens
gattccttttcttgt

SEQ ID NO: 6256958 - DNA, 12 bp, Homo sapiens
gattccttttga

SEQ ID NO: 6256959 - DNA, 17 bp, Homo sapiens
gattcgaaggatgaaga

SEQ ID NO: 6256960 - DNA, 18 bp, Homo sapiens
gattcgctgtcccctcag

SEQ ID NO: 6256961 - DNA, 17 bp, Homo sapiens
gattcgggggctgacct

SEQ ID NO: 6256962 - DNA, 17 bp, Homo sapiens
gattcggtatcccccca

SEQ ID NO: 6256963 - DNA, 22 bp, Homo sapiens
gattctaaacagatgtccctga

SEQ ID NO: 6256964 - DNA, 20 bp, Homo sapiens
gattctaaagattctatagt

SEQ ID NO: 6256965 - DNA, 15 bp, Homo sapiens
gattctaaaggggac

SEQ ID NO: 6256966 - DNA, 19 bp, Homo sapiens
gattctaaaggggacagat

SEQ ID NO: 6256967 - DNA, 15 bp, Homo sapiens
gattctaaaggtcca

SEQ ID NO: 6256968 - DNA, 14 bp, Homo sapiens
gattctaaattatg

SEQ ID NO: 6256969 - DNA, 15 bp, Homo sapiens
gattctaatgtcttc

SEQ ID NO: 6256970 - DNA, 23 bp, Homo sapiens
gattctactttaagcactacata

SEQ ID NO: 6256971 - DNA, 21 bp, Homo sapiens
gattctagtacataattgatt

SEQ ID NO: 6256972 - DNA, 19 bp, Homo sapiens
gattctatagttctagaca

SEQ ID NO: 6256973 - DNA, 18 bp, Homo sapiens
gattctatgcctgtattt

SEQ ID NO: 6256974 - DNA, 15 bp, Homo sapiens
gattctatgtaactt

SEQ ID NO: 6256975 - DNA, 17 bp, Homo sapiens
gattctatgtaacttgt

SEQ ID NO: 6256976 - DNA, 18 bp, Homo sapiens
gattctatgtaacttgtt

SEQ ID NO: 6256977 - DNA, 17 bp, Homo sapiens
gattctatgtaatgtaa

SEQ ID NO: 6256978 - DNA, 13 bp, Homo sapiens
gattctatgttaa

SEQ ID NO: 6256979 - DNA, 21 bp, Homo sapiens
gattctattatatattttata

SEQ ID NO: 6256980 - DNA, 15 bp, Homo sapiens
gattctatttatatg

SEQ ID NO: 6256981 - DNA, 14 bp, Homo sapiens
gattctcagggctg

SEQ ID NO: 6256982 - DNA, 18 bp, Homo sapiens
gattctcagggctggagc

SEQ ID NO: 6256983 - DNA, 21 bp, Homo sapiens
gattctcagggtctctgctgc

SEQ ID NO: 6256984 - DNA, 23 bp, Homo sapiens
gattctcagggtctctgctgccg

SEQ ID NO: 6256985 - DNA, 18 bp, Homo sapiens
gattctcccgcctcagcc

SEQ ID NO: 6256986 - DNA, 13 bp, Homo sapiens
gattctccctggg

SEQ ID NO: 6256987 - DNA, 12 bp, Homo sapiens
gattctcctctc

SEQ ID NO: 6256988 - DNA, 13 bp, Homo sapiens
gattctcctctcc

SEQ ID NO: 6256989 - DNA, 15 bp, Homo sapiens
gattctcctgcctca

SEQ ID NO: 6256990 - DNA, 16 bp, Homo sapiens
gattctcctgcctcag

SEQ ID NO: 6256991 - DNA, 17 bp, Homo sapiens
gattctcctgcctcagc

SEQ ID NO: 6256992 - DNA, 19 bp, Homo sapiens
gattctcctgcctcagcct

SEQ ID NO: 6256993 - DNA, 20 bp, Homo sapiens
gattctcctgcctcagcctc

SEQ ID NO: 6256994 - DNA, 20 bp, Homo sapiens
gattctcctgcctcagcctt

SEQ ID NO: 6256995 - DNA, 16 bp, Homo sapiens
gattctcctgtcagag

SEQ ID NO: 6256996 - DNA, 14 bp, Homo sapiens
gattctcctgtgct

SEQ ID NO: 6256997 - DNA, 13 bp, Homo sapiens
gattctcgcccct

SEQ ID NO: 6256998 - DNA, 15 bp, Homo sapiens
gattctctaagatga

SEQ ID NO: 6256999 - DNA, 18 bp, Homo sapiens
gattctctacatgctctt

SEQ ID NO: 6257000 - DNA, 15 bp, Homo sapiens
gattctctattggct

SEQ ID NO: 6257001 - DNA, 11 bp, Homo sapiens
gattctctcca

SEQ ID NO: 6257002 - DNA, 14 bp, Homo sapiens
gattctctgcagcc

SEQ ID NO: 6257003 - DNA, 12 bp, Homo sapiens
gattctctgccc

SEQ ID NO: 6257004 - DNA, 18 bp, Homo sapiens
gattctctgtgtctaaga

SEQ ID NO: 6257005 - DNA, 22 bp, Homo sapiens
gattctctgtgtctaagattct

SEQ ID NO: 6257006 - DNA, 20 bp, Homo sapiens
gattctcttagctactgtat

SEQ ID NO: 6257007 - DNA, 22 bp, Homo sapiens
gattctcttgagataaggtttt

SEQ ID NO: 6257008 - DNA, 14 bp, Homo sapiens
gattctcttgcctc

SEQ ID NO: 6257009 - DNA, 15 bp, Homo sapiens
gattctcttgcctca

SEQ ID NO: 6257010 - DNA, 12 bp, Homo sapiens
gattctgaatct

SEQ ID NO: 6257011 - DNA, 15 bp, Homo sapiens
gattctgacatttat

SEQ ID NO: 6257012 - DNA, 17 bp, Homo sapiens
gattctgagcaaaggcc

SEQ ID NO: 6257013 - DNA, 21 bp, Homo sapiens
gattctgagcaaaggccctgg

SEQ ID NO: 6257014 - DNA, 22 bp, Homo sapiens
gattctgagcaaaggccctggg

SEQ ID NO: 6257015 - DNA, 16 bp, Homo sapiens
gattctgagcagtgcc

SEQ ID NO: 6257016 - DNA, 15 bp, Homo sapiens
gattctgattgctat

SEQ ID NO: 6257017 - DNA, 18 bp, Homo sapiens
gattctgattgctatcag

SEQ ID NO: 6257018 - DNA, 16 bp, Homo sapiens
gattctgatttcagtt

SEQ ID NO: 6257019 - DNA, 22 bp, Homo sapiens
gattctgcagctgcttttgcat

SEQ ID NO: 6257020 - DNA, 16 bp, Homo sapiens
gattctgcctctctgg

SEQ ID NO: 6257021 - DNA, 17 bp, Homo sapiens
gattctgcctctctgga

SEQ ID NO: 6257022 - DNA, 15 bp, Homo sapiens
gattctgcctttgcc

SEQ ID NO: 6257023 - DNA, 17 bp, Homo sapiens
gattctgctggcctctg

SEQ ID NO: 6257024 - DNA, 13 bp, Homo sapiens
gattctgctttta

SEQ ID NO: 6257025 - DNA, 19 bp, Homo sapiens
gattctggacagtcagctc

SEQ ID NO: 6257026 - DNA, 17 bp, Homo sapiens
gattctggataaagcca

SEQ ID NO: 6257027 - DNA, 17 bp, Homo sapiens
gattctggatctcctgc

SEQ ID NO: 6257028 - DNA, 21 bp, Homo sapiens
gattctgggaatcatgtccat

SEQ ID NO: 6257029 - DNA, 15 bp, Homo sapiens
gattctgggaggaag

SEQ ID NO: 6257030 - DNA, 22 bp, Homo sapiens
gattctgggaggaagcaggttg

SEQ ID NO: 6257031 - DNA, 15 bp, Homo sapiens
gattctggggctgtg

SEQ ID NO: 6257032 - DNA, 18 bp, Homo sapiens
gattctgggtttgcccag

SEQ ID NO: 6257033 - DNA, 23 bp, Homo sapiens
gattctgggtttgcccagtcctg

SEQ ID NO: 6257034 - DNA, 19 bp, Homo sapiens
gattctggtccctggaaat

SEQ ID NO: 6257035 - DNA, 22 bp, Homo sapiens
gattctggttccagggtccctc

SEQ ID NO: 6257036 - DNA, 14 bp, Homo sapiens
gattctgtccccca

SEQ ID NO: 6257037 - DNA, 19 bp, Homo sapiens
gattctgtgggcagctggc

SEQ ID NO: 6257038 - DNA, 15 bp, Homo sapiens
gattctgtgtatctt

SEQ ID NO: 6257039 - DNA, 21 bp, Homo sapiens
gattctgtgttttcagactgc

SEQ ID NO: 6257040 - DNA, 21 bp, Homo sapiens
gattctgtttattcttccaga

SEQ ID NO: 6257041 - DNA, 22 bp, Homo sapiens
gattctgtttattcttccagaa

SEQ ID NO: 6257042 - DNA, 22 bp, Homo sapiens
gattcttaacacagccttcctt

SEQ ID NO: 6257043 - DNA, 15 bp, Homo sapiens
gattcttacatatga

SEQ ID NO: 6257044 - DNA, 15 bp, Homo sapiens
gattcttactgttct

SEQ ID NO: 6257045 - DNA, 23 bp, Homo sapiens
gattcttatgtagcaggaaataa

SEQ ID NO: 6257046 - DNA, 15 bp, Homo sapiens
gattcttcccgctcc

SEQ ID NO: 6257047 - DNA, 17 bp, Homo sapiens
gattcttcctccctccc

SEQ ID NO: 6257048 - DNA, 21 bp, Homo sapiens
gattcttccttttattaaaac

SEQ ID NO: 6257049 - DNA, 13 bp, Homo sapiens
gattcttctgctt

SEQ ID NO: 6257050 - DNA, 20 bp, Homo sapiens
gattcttctgcttcagcctc

SEQ ID NO: 6257051 - DNA, 20 bp, Homo sapiens
gattcttctgtgtttataaa

SEQ ID NO: 6257052 - DNA, 17 bp, Homo sapiens
gattcttcttaaaagtt

SEQ ID NO: 6257053 - DNA, 17 bp, Homo sapiens
gattcttgattcctggc

SEQ ID NO: 6257054 - DNA, 23 bp, Homo sapiens
gattcttggcccgcacagagctg

SEQ ID NO: 6257055 - DNA, 16 bp, Homo sapiens
gattcttgtaaatctt

SEQ ID NO: 6257056 - DNA, 17 bp, Homo sapiens
gattcttgtaaatcttt

SEQ ID NO: 6257057 - DNA, 20 bp, Homo sapiens
gattcttgttttgcttcccc

SEQ ID NO: 6257058 - DNA, 17 bp, Homo sapiens
gattctttaaggagata

SEQ ID NO: 6257059 - DNA, 23 bp, Homo sapiens
gattctttaatcatggagcaaga

SEQ ID NO: 6257060 - DNA, 23 bp, Homo sapiens
gattctttcaatccacagtattg

SEQ ID NO: 6257061 - DNA, 16 bp, Homo sapiens
gattctttcctgaggc

SEQ ID NO: 6257062 - DNA, 17 bp, Homo sapiens
gattctttcctgaggct

SEQ ID NO: 6257063 - DNA, 18 bp, Homo sapiens
gattctttcctgaggctg

SEQ ID NO: 6257064 - DNA, 19 bp, Homo sapiens
gattcttttaaattagaaa

SEQ ID NO: 6257065 - DNA, 21 bp, Homo sapiens
gattcttttttcttccccctc

SEQ ID NO: 6257066 - DNA, 20 bp, Homo sapiens
gattctttttttctgtcagt

SEQ ID NO: 6257067 - DNA, 23 bp, Homo sapiens
gattgaaaaaaagggcactctga

SEQ ID NO: 6257068 - DNA, 16 bp, Homo sapiens
gattgaaaagaagaaa

SEQ ID NO: 6257069 - DNA, 16 bp, Homo sapiens
gattgaaaagtgtcct

SEQ ID NO: 6257070 - DNA, 18 bp, Homo sapiens
gattgaaaatgtccagga

SEQ ID NO: 6257071 - DNA, 15 bp, Homo sapiens
gattgaaaattcgcc

SEQ ID NO: 6257072 - DNA, 18 bp, Homo sapiens
gattgaaaccaagttgaa

SEQ ID NO: 6257073 - DNA, 21 bp, Homo sapiens
gccttcaacaacgtgagagaa

SEQ ID NO: 6257074 - DNA, 22 bp, Homo sapiens
gccttcaacaacgtgagagaaa

SEQ ID NO: 6257075 - DNA, 17 bp, Homo sapiens
gccttcaacacagcttg

SEQ ID NO: 6257076 - DNA, 19 bp, Homo sapiens
gccttcaacacagcttgtc

SEQ ID NO: 6257077 - DNA, 22 bp, Homo sapiens
gccttcaagaaaacaggcactg

SEQ ID NO: 6257078 - DNA, 17 bp, Homo sapiens
gccttcaagaatcagaa

SEQ ID NO: 6257079 - DNA, 19 bp, Homo sapiens
gccttcaagctctgaggga

SEQ ID NO: 6257080 - DNA, 14 bp, Homo sapiens
gccttcacaaatgt

SEQ ID NO: 6257081 - DNA, 17 bp, Homo sapiens
gccttcaccctgaacat

SEQ ID NO: 6257082 - DNA, 15 bp, Homo sapiens
gccttcactgggcca

SEQ ID NO: 6257083 - DNA, 17 bp, Homo sapiens
gccttcactgggccagt

SEQ ID NO: 6257084 - DNA, 18 bp, Homo sapiens
gccttcagaaaagacact

SEQ ID NO: 6257085 - DNA, 20 bp, Homo sapiens
gccttcagagtacgtcctgc

SEQ ID NO: 6257086 - DNA, 21 bp, Homo sapiens
gccttcagagtacgtcctgcc

SEQ ID NO: 6257087 - DNA, 13 bp, Homo sapiens
gccttcagctcca

SEQ ID NO: 6257088 - DNA, 13 bp, Homo sapiens
gccttcagctcta

SEQ ID NO: 6257089 - DNA, 16 bp, Homo sapiens
gccttcagctgttgca

SEQ ID NO: 6257090 - DNA, 19 bp, Homo sapiens
gccttcaggcaccacagat

SEQ ID NO: 6257091 - DNA, 14 bp, Homo sapiens
gccttcaggccagc

SEQ ID NO: 6257092 - DNA, 17 bp, Homo sapiens
gccttcaggccagctgg

SEQ ID NO: 6257093 - DNA, 21 bp, Homo sapiens
gccttcagggagtgagggatt

SEQ ID NO: 6257094 - DNA, 17 bp, Homo sapiens
gccttcaggttcctcct

SEQ ID NO: 6257095 - DNA, 19 bp, Homo sapiens
gccttcaggttcctcctag

SEQ ID NO: 6257096 - DNA, 20 bp, Homo sapiens
gccttcaggttcctcctagg

SEQ ID NO: 6257097 - DNA, 20 bp, Homo sapiens
gccttcagtaggaacaagct

SEQ ID NO: 6257098 - DNA, 21 bp, Homo sapiens
gccttcagtaggaacaagctg

SEQ ID NO: 6257099 - DNA, 19 bp, Homo sapiens
gccttcagtatcaaggctg

SEQ ID NO: 6257100 - DNA, 22 bp, Homo sapiens
gccttcagtatcaaggctgcct

SEQ ID NO: 6257101 - DNA, 19 bp, Homo sapiens
gccttcagtttatttccac

SEQ ID NO: 6257102 - DNA, 18 bp, Homo sapiens
gccttcatatcatccaca

SEQ ID NO: 6257103 - DNA, 14 bp, Homo sapiens
gccttcatcagaac

SEQ ID NO: 6257104 - DNA, 15 bp, Homo sapiens
gccttcatcagaact

SEQ ID NO: 6257105 - DNA, 17 bp, Homo sapiens
gccttcatcctcctccc

SEQ ID NO: 6257106 - DNA, 21 bp, Homo sapiens
gccttcatcctcctccccagc

SEQ ID NO: 6257107 - DNA, 23 bp, Homo sapiens
gccttcatgccagtgcatgccag

SEQ ID NO: 6257108 - DNA, 16 bp, Homo sapiens
gccttcattaaatgtt

SEQ ID NO: 6257109 - DNA, 18 bp, Homo sapiens
gccttcattaaatgtttg

SEQ ID NO: 6257110 - DNA, 16 bp, Homo sapiens
gccttcattctgcaag

SEQ ID NO: 6257111 - DNA, 22 bp, Homo sapiens
gccttcattgaggaaggaaatc

SEQ ID NO: 6257112 - DNA, 21 bp, Homo sapiens
gccttccaaaacctgcttcct

SEQ ID NO: 6257113 - DNA, 14 bp, Homo sapiens
gccttccacccagg

SEQ ID NO: 6257114 - DNA, 19 bp, Homo sapiens
gccttccaccctgccctgg

SEQ ID NO: 6257115 - DNA, 21 bp, Homo sapiens
gccttccaccctgccctggcc

SEQ ID NO: 6257116 - DNA, 18 bp, Homo sapiens
gccttccaccggcactca

SEQ ID NO: 6257117 - DNA, 19 bp, Homo sapiens
gccttccaccggcactcat

SEQ ID NO: 6257118 - DNA, 13 bp, Homo sapiens
gccttccacctct

SEQ ID NO: 6257119 - DNA, 19 bp, Homo sapiens
gccttccacgctgtctcca

SEQ ID NO: 6257120 - DNA, 22 bp, Homo sapiens
gccttccagatcctctctgggg

SEQ ID NO: 6257121 - DNA, 23 bp, Homo sapiens
gccttccagatcctctctggggc

SEQ ID NO: 6257122 - DNA, 14 bp, Homo sapiens
gccttccagctgct

SEQ ID NO: 6257123 - DNA, 15 bp, Homo sapiens
gccttccagctgctg

SEQ ID NO: 6257124 - DNA, 16 bp, Homo sapiens
gccttccagctgctgt

SEQ ID NO: 6257125 - DNA, 18 bp, Homo sapiens
gccttccagctgctgtct

SEQ ID NO: 6257126 - DNA, 12 bp, Homo sapiens
gccttccaggcg

SEQ ID NO: 6257127 - DNA, 20 bp, Homo sapiens
gccttccagggatttgcctc

SEQ ID NO: 6257128 - DNA, 21 bp, Homo sapiens
gccttccagggatttgcctca

SEQ ID NO: 6257129 - DNA, 21 bp, Homo sapiens
gccttccaggggtgggacacc

SEQ ID NO: 6257130 - DNA, 14 bp, Homo sapiens
gccttccaggtcag

SEQ ID NO: 6257131 - DNA, 14 bp, Homo sapiens
gccttccaggtggc

SEQ ID NO: 6257132 - DNA, 19 bp, Homo sapiens
gccttccagtggcttctcc

SEQ ID NO: 6257133 - DNA, 22 bp, Homo sapiens
gccttccagtggcttctcccaa

SEQ ID NO: 6257134 - DNA, 12 bp, Homo sapiens
gccttccagttt

SEQ ID NO: 6257135 - DNA, 14 bp, Homo sapiens
gccttccagttttg

SEQ ID NO: 6257136 - DNA, 14 bp, Homo sapiens
gccttccatgacct

SEQ ID NO: 6257137 - DNA, 15 bp, Homo sapiens
gccttccatgggcat

SEQ ID NO: 6257138 - DNA, 20 bp, Homo sapiens
gccttccatgggcatggccg

SEQ ID NO: 6257139 - DNA, 18 bp, Homo sapiens
gccttccatgtcggcctc

SEQ ID NO: 6257140 - DNA, 15 bp, Homo sapiens
gccttcccatggcca

SEQ ID NO: 6257141 - DNA, 15 bp, Homo sapiens
gccttccccagcctc

SEQ ID NO: 6257142 - DNA, 17 bp, Homo sapiens
gccttccccagcctctt

SEQ ID NO: 6257143 - DNA, 13 bp, Homo sapiens
gccttccccagct

SEQ ID NO: 6257144 - DNA, 14 bp, Homo sapiens
gccttccccagctc

SEQ ID NO: 6257145 - DNA, 20 bp, Homo sapiens
gccttccccagctccagcag

SEQ ID NO: 6257146 - DNA, 23 bp, Homo sapiens
gccttccccctcccagggccagg

SEQ ID NO: 6257147 - DNA, 16 bp, Homo sapiens
gccttccccctgccct

SEQ ID NO: 6257148 - DNA, 12 bp, Homo sapiens
gccttcccctca

SEQ ID NO: 6257149 - DNA, 19 bp, Homo sapiens
gccttcccctcccagccct

SEQ ID NO: 6257150 - DNA, 19 bp, Homo sapiens
gccttcccctggcactggc

SEQ ID NO: 6257151 - DNA, 20 bp, Homo sapiens
gccttcccctggcactggca

SEQ ID NO: 6257152 - DNA, 15 bp, Homo sapiens
gccttcccctgtctt

SEQ ID NO: 6257153 - DNA, 21 bp, Homo sapiens
gccttccccttgaacctcatt

SEQ ID NO: 6257154 - DNA, 22 bp, Homo sapiens
gccttccccttgaacctcatta

SEQ ID NO: 6257155 - DNA, 18 bp, Homo sapiens
gccttccccttttgcctg

SEQ ID NO: 6257156 - DNA, 20 bp, Homo sapiens
gccttcccgccggaggccag

SEQ ID NO: 6257157 - DNA, 22 bp, Homo sapiens
gccttcccgccggaggccagct

SEQ ID NO: 6257158 - DNA, 19 bp, Homo sapiens
gccttccctcactcttcct

SEQ ID NO: 6257159 - DNA, 21 bp, Homo sapiens
gccttccctcactcttcctca

SEQ ID NO: 6257160 - DNA, 22 bp, Homo sapiens
gccttccctcactcttcctcat

SEQ ID NO: 6257161 - DNA, 19 bp, Homo sapiens
gccttccctccccacagtc

SEQ ID NO: 6257162 - DNA, 17 bp, Homo sapiens
gccttccctcctgcttt

SEQ ID NO: 6257163 - DNA, 18 bp, Homo sapiens
gccttccctggccttgag

SEQ ID NO: 6257164 - DNA, 13 bp, Homo sapiens
gccttcccttctc

SEQ ID NO: 6257165 - DNA, 18 bp, Homo sapiens
gccttcccttctctggtc

SEQ ID NO: 6257166 - DNA, 20 bp, Homo sapiens
gccttccctttacagctctc

SEQ ID NO: 6257167 - DNA, 20 bp, Homo sapiens
gccttccgtaacccaactct

SEQ ID NO: 6257168 - DNA, 18 bp, Homo sapiens
gccttcctaagcctgtgg

SEQ ID NO: 6257169 - DNA, 20 bp, Homo sapiens
gccttcctaagcctgtggct

SEQ ID NO: 6257170 - DNA, 15 bp, Homo sapiens
gccttcctcatcccc

SEQ ID NO: 6257171 - DNA, 16 bp, Homo sapiens
gccttcctcatcccct

SEQ ID NO: 6257172 - DNA, 17 bp, Homo sapiens
gccttcctcatcccctc

SEQ ID NO: 6257173 - DNA, 17 bp, Homo sapiens
gccttcctccacatcct

SEQ ID NO: 6257174 - DNA, 13 bp, Homo sapiens
gccttcctcctcc

SEQ ID NO: 6257175 - DNA, 22 bp, Homo sapiens
gccttcctcctccacagtgctg

SEQ ID NO: 6257176 - DNA, 13 bp, Homo sapiens
gccttcctcctgg

SEQ ID NO: 6257177 - DNA, 14 bp, Homo sapiens
gccttcctcctggg

SEQ ID NO: 6257178 - DNA, 13 bp, Homo sapiens
gccttcctctgag

SEQ ID NO: 6257179 - DNA, 14 bp, Homo sapiens
gccttcctctgagg

SEQ ID NO: 6257180 - DNA, 21 bp, Homo sapiens
gccttcctctgcagctgacct

SEQ ID NO: 6257181 - DNA, 16 bp, Homo sapiens
gccttcctgacctcca

SEQ ID NO: 6257182 - DNA, 23 bp, Homo sapiens
gccttcctggttttgtacactgc

SEQ ID NO: 6257183 - DNA, 23 bp, Homo sapiens
gccttccttcccgccagagggct

SEQ ID NO: 6257184 - DNA, 13 bp, Homo sapiens
gccttcctttctc

SEQ ID NO: 6257185 - DNA, 19 bp, Homo sapiens
gccttcctttctccaggac

SEQ ID NO: 6257186 - DNA, 18 bp, Homo sapiens
gccttcctttctcctgcc

SEQ ID NO: 6257187 - DNA, 18 bp, Homo sapiens
gccttcgaaaagaaattg

SEQ ID NO: 6257188 - DNA, 14 bp, Homo sapiens
gccttcgattttaa

SEQ ID NO: 6257189 - DNA, 19 bp, Homo sapiens
gccttcgcaccttgctgtg

SEQ ID NO: 6257190 - DNA, 21 bp, Homo sapiens
gccttcgccccagtgttctgc

SEQ ID NO: 6257191 - DNA, 22 bp, Homo sapiens
gccttcgcggtggaaggcccga

SEQ ID NO: 6257192 - DNA, 14 bp, Homo sapiens
gccttcgctccatg

SEQ ID NO: 6257193 - DNA, 19 bp, Homo sapiens
gccttcggacaactcagtc

SEQ ID NO: 6257194 - DNA, 18 bp, Homo sapiens
gccttcggtacccaccac

SEQ ID NO: 6257195 - DNA, 15 bp, Homo sapiens
gccttcgtctccatc

SEQ ID NO: 6257196 - DNA, 20 bp, Homo sapiens
gccttcgtctccatctctgg

SEQ ID NO: 6257197 - DNA, 21 bp, Homo sapiens
gccttcgtctccatctctggt

SEQ ID NO: 6257198 - DNA, 19 bp, Homo sapiens
gccttcgtgcctgagacca

SEQ ID NO: 6257199 - DNA, 16 bp, Homo sapiens
gccttcgtgtgctgct

SEQ ID NO: 6257200 - DNA, 17 bp, Homo sapiens
gccttcgtgtgctgctg

SEQ ID NO: 6257201 - DNA, 19 bp, Homo sapiens
gccttcgtgtgctgctgct

SEQ ID NO: 6257202 - DNA, 20 bp, Homo sapiens
gccttcgtgtgctgctgctg

SEQ ID NO: 6257203 - DNA, 15 bp, Homo sapiens
gccttcgtttatatt

SEQ ID NO: 6257204 - DNA, 21 bp, Homo sapiens
gccttctagattcactgtctt

SEQ ID NO: 6257205 - DNA, 24 bp, Homo sapiens
gccttctaggaatggaggagccag

SEQ ID NO: 6257206 - DNA, 13 bp, Homo sapiens
gccttctcaccag

SEQ ID NO: 6257207 - DNA, 15 bp, Homo sapiens
gccttctcaccagct

SEQ ID NO: 6257208 - DNA, 16 bp, Homo sapiens
gccttctcaccagctg

SEQ ID NO: 6257209 - DNA, 19 bp, Homo sapiens
gccttctcaccagctgcaa

SEQ ID NO: 6257210 - DNA, 22 bp, Homo sapiens
gccttctcaccagctgcaaagt

SEQ ID NO: 6257211 - DNA, 16 bp, Homo sapiens
gccttctcactagctg

SEQ ID NO: 6257212 - DNA, 15 bp, Homo sapiens
gccttctcagaagca

SEQ ID NO: 6257213 - DNA, 12 bp, Homo sapiens
gccttctcagcc

SEQ ID NO: 6257214 - DNA, 13 bp, Homo sapiens
gccttctcagctc

SEQ ID NO: 6257215 - DNA, 19 bp, Homo sapiens
gccttctcagctctccacc

SEQ ID NO: 6257216 - DNA, 20 bp, Homo sapiens
gccttctcagggacttctgc

SEQ ID NO: 6257217 - DNA, 14 bp, Homo sapiens
gccttctcccacat

SEQ ID NO: 6257218 - DNA, 15 bp, Homo sapiens
gccttctcccacatg

SEQ ID NO: 6257219 - DNA, 23 bp, Homo sapiens
gccttctcccccccggggctggg

SEQ ID NO: 6257220 - DNA, 23 bp, Homo sapiens
gccttctcccctctcccagggat

SEQ ID NO: 6257221 - DNA, 19 bp, Homo sapiens
gccttctcccctcttctga

SEQ ID NO: 6257222 - DNA, 20 bp, Homo sapiens
gccttctcccctcttctgag

SEQ ID NO: 6257223 - DNA, 22 bp, Homo sapiens
gccttctcccctcttctgagct

SEQ ID NO: 6257224 - DNA, 23 bp, Homo sapiens
gccttctcccctcttctgagcta

SEQ ID NO: 6257225 - DNA, 14 bp, Homo sapiens
gccttctcctcccc

SEQ ID NO: 6257226 - DNA, 19 bp, Homo sapiens
gccttctcctctctgggcc

SEQ ID NO: 6257227 - DNA, 20 bp, Homo sapiens
gccttctcctctctgggcct

SEQ ID NO: 6257228 - DNA, 21 bp, Homo sapiens
gccttctcctctctgggcctt

SEQ ID NO: 6257229 - DNA, 14 bp, Homo sapiens
gccttctcctgcct

SEQ ID NO: 6257230 - DNA, 14 bp, Homo sapiens
gccttctcctgtct

SEQ ID NO: 6257231 - DNA, 19 bp, Homo sapiens
gccttctccttccccagga

SEQ ID NO: 6257232 - DNA, 20 bp, Homo sapiens
gccttctccttccccaggat

SEQ ID NO: 6257233 - DNA, 14 bp, Homo sapiens
gccttctcgcattt

SEQ ID NO: 6257234 - DNA, 18 bp, Homo sapiens
gccttctcggagctggcc

SEQ ID NO: 6257235 - DNA, 19 bp, Homo sapiens
gccttctctaaacatttca

SEQ ID NO: 6257236 - DNA, 17 bp, Homo sapiens
gccttctctcagctccc

SEQ ID NO: 6257237 - DNA, 22 bp, Homo sapiens
gccttctctcagctcccaggcc

SEQ ID NO: 6257238 - DNA, 23 bp, Homo sapiens
gccttctctcagctcccaggcca

SEQ ID NO: 6257239 - DNA, 16 bp, Homo sapiens
gccttctctgaaggac

SEQ ID NO: 6257240 - DNA, 18 bp, Homo sapiens
gccttctcttctatcctg

SEQ ID NO: 6257241 - DNA, 21 bp, Homo sapiens
gccttctcttctatcctgcaa

SEQ ID NO: 6257242 - DNA, 15 bp, Homo sapiens
gccttctgaactcca

SEQ ID NO: 6257243 - DNA, 17 bp, Homo sapiens
gccttctgaactccata

SEQ ID NO: 6257244 - DNA, 21 bp, Homo sapiens
gccttctgaactccatacagc

SEQ ID NO: 6257245 - DNA, 17 bp, Homo sapiens
gccttctgatgaaatgt

SEQ ID NO: 6257246 - DNA, 18 bp, Homo sapiens
gccttctgcagcaggaac

SEQ ID NO: 6257247 - DNA, 13 bp, Homo sapiens
gccttctgccacc

SEQ ID NO: 6257248 - DNA, 20 bp, Homo sapiens
gccttctgctgaaagactcg

SEQ ID NO: 6257249 - DNA, 22 bp, Homo sapiens
gattgaaagaaaaaaaaatact

SEQ ID NO: 6257250 - DNA, 12 bp, Homo sapiens
gattgaaattta

SEQ ID NO: 6257251 - DNA, 18 bp, Homo sapiens
gattgaacacaggcaaag

SEQ ID NO: 6257252 - DNA, 11 bp, Homo sapiens
gattgaacttt

SEQ ID NO: 6257253 - DNA, 19 bp, Homo sapiens
gattgaaggggcttctaat

SEQ ID NO: 6257254 - DNA, 22 bp, Homo sapiens
gattgaaggggcttctaatgac

SEQ ID NO: 6257255 - DNA, 19 bp, Homo sapiens
gattgaagtatctgtacct

SEQ ID NO: 6257256 - DNA, 19 bp, Homo sapiens
gattgaagtttattatttt

SEQ ID NO: 6257257 - DNA, 21 bp, Homo sapiens
gattgaattacggaaaatgcc

SEQ ID NO: 6257258 - DNA, 23 bp, Homo sapiens
gattgacacacagcactctctaa

SEQ ID NO: 6257259 - DNA, 15 bp, Homo sapiens
gattgacagtaactt

SEQ ID NO: 6257260 - DNA, 14 bp, Homo sapiens
gattgacatctaat

SEQ ID NO: 6257261 - DNA, 13 bp, Homo sapiens
gattgacattcta

SEQ ID NO: 6257262 - DNA, 15 bp, Homo sapiens
gattgacattctaca

SEQ ID NO: 6257263 - DNA, 18 bp, Homo sapiens
gattgacattctacagtt

SEQ ID NO: 6257264 - DNA, 21 bp, Homo sapiens
gattgacattttgtagctagt

SEQ ID NO: 6257265 - DNA, 12 bp, Homo sapiens
gattgacctgct

SEQ ID NO: 6257266 - DNA, 14 bp, Homo sapiens
gattgactaaataa

SEQ ID NO: 6257267 - DNA, 13 bp, Homo sapiens
gattgagaaagat

SEQ ID NO: 6257268 - DNA, 18 bp, Homo sapiens
gattgagaaggagagaaa

SEQ ID NO: 6257269 - DNA, 14 bp, Homo sapiens
gattgagaagttca

SEQ ID NO: 6257270 - DNA, 17 bp, Homo sapiens
gattgagctctctgccc

SEQ ID NO: 6257271 - DNA, 19 bp, Homo sapiens
gattgaggagttgcctgac

SEQ ID NO: 6257272 - DNA, 22 bp, Homo sapiens
gattgaggcctgccctcaggga

SEQ ID NO: 6257273 - DNA, 20 bp, Homo sapiens
gattgaggggccctggccag

SEQ ID NO: 6257274 - DNA, 21 bp, Homo sapiens
gattgagtaatgggatttgaa

SEQ ID NO: 6257275 - DNA, 18 bp, Homo sapiens
gattgagtcctacagtgt

SEQ ID NO: 6257276 - DNA, 15 bp, Homo sapiens
gattgagttgtaaag

SEQ ID NO: 6257277 - DNA, 16 bp, Homo sapiens
gattgataagtaatga

SEQ ID NO: 6257278 - DNA, 19 bp, Homo sapiens
gattgataagtaatgaaag

SEQ ID NO: 6257279 - DNA, 15 bp, Homo sapiens
gattgataattgcat

SEQ ID NO: 6257280 - DNA, 23 bp, Homo sapiens
gattgatcagagcattgtgcaat

SEQ ID NO: 6257281 - DNA, 14 bp, Homo sapiens
gattgatgtacaga

SEQ ID NO: 6257282 - DNA, 21 bp, Homo sapiens
gattgatttacctttggaatt

SEQ ID NO: 6257283 - DNA, 19 bp, Homo sapiens
gattgatttgggttttttt

SEQ ID NO: 6257284 - DNA, 16 bp, Homo sapiens
gattgattttaaaatg

SEQ ID NO: 6257285 - DNA, 17 bp, Homo sapiens
gattgattttaaaatgt

SEQ ID NO: 6257286 - DNA, 15 bp, Homo sapiens
gattgcaaagggaca

SEQ ID NO: 6257287 - DNA, 15 bp, Homo sapiens
gattgcaacaggctg

SEQ ID NO: 6257288 - DNA, 17 bp, Homo sapiens
gattgcaacaggctggg

SEQ ID NO: 6257289 - DNA, 18 bp, Homo sapiens
gattgcaacaggctgggc

SEQ ID NO: 6257290 - DNA, 21 bp, Homo sapiens
gattgcaacaggctgggcttc

SEQ ID NO: 6257291 - DNA, 14 bp, Homo sapiens
gattgcacagaatt

SEQ ID NO: 6257292 - DNA, 23 bp, Homo sapiens
gattgcaccactgcactccagcc

SEQ ID NO: 6257293 - DNA, 19 bp, Homo sapiens
gattgcacgtggcctcttg

SEQ ID NO: 6257294 - DNA, 12 bp, Homo sapiens
gattgcactaaa

SEQ ID NO: 6257295 - DNA, 19 bp, Homo sapiens
gattgcagaaaattctgtg

SEQ ID NO: 6257296 - DNA, 16 bp, Homo sapiens
gattgcagaattgttt

SEQ ID NO: 6257297 - DNA, 23 bp, Homo sapiens
gattgcaggagtccctgccatca

SEQ ID NO: 6257298 - DNA, 16 bp, Homo sapiens
gattgcatattttgtt

SEQ ID NO: 6257299 - DNA, 17 bp, Homo sapiens
gattgcatcctgctggg

SEQ ID NO: 6257300 - DNA, 17 bp, Homo sapiens
gattgcatgtgactctg

SEQ ID NO: 6257301 - DNA, 13 bp, Homo sapiens
gattgccacagct

SEQ ID NO: 6257302 - DNA, 16 bp, Homo sapiens
gattgccacagctcaa

SEQ ID NO: 6257303 - DNA, 16 bp, Homo sapiens
gattgccatttcttcc

SEQ ID NO: 6257304 - DNA, 16 bp, Homo sapiens
gattgccccagagccc

SEQ ID NO: 6257305 - DNA, 14 bp, Homo sapiens
gattgcccctggct

SEQ ID NO: 6257306 - DNA, 20 bp, Homo sapiens
gattgcccctggctttgcct

SEQ ID NO: 6257307 - DNA, 16 bp, Homo sapiens
gattgcctcaataaag

SEQ ID NO: 6257308 - DNA, 15 bp, Homo sapiens
gattgcctttaatat

SEQ ID NO: 6257309 - DNA, 17 bp, Homo sapiens
gattgcctttaatattt

SEQ ID NO: 6257310 - DNA, 14 bp, Homo sapiens
gattgcgagagatg

SEQ ID NO: 6257311 - DNA, 19 bp, Homo sapiens
gattgcgagagatgtgtgt

SEQ ID NO: 6257312 - DNA, 22 bp, Homo sapiens
gattgcgagagatgtgtgttga

SEQ ID NO: 6257313 - DNA, 16 bp, Homo sapiens
gattgcgcaaaactga

SEQ ID NO: 6257314 - DNA, 17 bp, Homo sapiens
gattgcgcctaatgtgt

SEQ ID NO: 6257315 - DNA, 21 bp, Homo sapiens
gattgcgcctaatgtgtttga

SEQ ID NO: 6257316 - DNA, 19 bp, Homo sapiens
gattgcggtttacagctat

SEQ ID NO: 6257317 - DNA, 22 bp, Homo sapiens
gattgcgtggaattgtgctgag

SEQ ID NO: 6257318 - DNA, 20 bp, Homo sapiens
gattgctaaatgtaacagtc

SEQ ID NO: 6257319 - DNA, 15 bp, Homo sapiens
gattgctacacacac

SEQ ID NO: 6257320 - DNA, 16 bp, Homo sapiens
gattgctacacacaca

SEQ ID NO: 6257321 - DNA, 15 bp, Homo sapiens
gattgctatcagcaa

SEQ ID NO: 6257322 - DNA, 18 bp, Homo sapiens
gattgctcccaggatctc

SEQ ID NO: 6257323 - DNA, 21 bp, Homo sapiens
gattgctctggaagcctgctg

SEQ ID NO: 6257324 - DNA, 19 bp, Homo sapiens
gattgctctggagcagcca

SEQ ID NO: 6257325 - DNA, 20 bp, Homo sapiens
gattgctgccccatcagtgc

SEQ ID NO: 6257326 - DNA, 17 bp, Homo sapiens
gattgctggaaaccaag

SEQ ID NO: 6257327 - DNA, 19 bp, Homo sapiens
gattgctggaaaccaagtc

SEQ ID NO: 6257328 - DNA, 19 bp, Homo sapiens
gattgctggggccaggccc

SEQ ID NO: 6257329 - DNA, 19 bp, Homo sapiens
gattgctgtgtccaactcc

SEQ ID NO: 6257330 - DNA, 22 bp, Homo sapiens
gattgctgtgtccaactccagt

SEQ ID NO: 6257331 - DNA, 15 bp, Homo sapiens
gattgcttaaaagca

SEQ ID NO: 6257332 - DNA, 14 bp, Homo sapiens
gattgcttaaaata

SEQ ID NO: 6257333 - DNA, 18 bp, Homo sapiens
gattgcttaaaatagcaa

SEQ ID NO: 6257334 - DNA, 16 bp, Homo sapiens
gattgcttgagcccag

SEQ ID NO: 6257335 - DNA, 18 bp, Homo sapiens
gattgcttgagctcagga

SEQ ID NO: 6257336 - DNA, 21 bp, Homo sapiens
gattgctttgcattactgtcc

SEQ ID NO: 6257337 - DNA, 21 bp, Homo sapiens
gattgctttgctgcacagcag

SEQ ID NO: 6257338 - DNA, 20 bp, Homo sapiens
gattggaaaataataaaaga

SEQ ID NO: 6257339 - DNA, 21 bp, Homo sapiens
gattggaaggagacacagatg

SEQ ID NO: 6257340 - DNA, 19 bp, Homo sapiens
gattggaatttctggcctc

SEQ ID NO: 6257341 - DNA, 14 bp, Homo sapiens
gattggaccaggcc

SEQ ID NO: 6257342 - DNA, 16 bp, Homo sapiens
gattggacggcctgat

SEQ ID NO: 6257343 - DNA, 14 bp, Homo sapiens
gattggagaatact

SEQ ID NO: 6257344 - DNA, 19 bp, Homo sapiens
gattggagaatactttgct

SEQ ID NO: 6257345 - DNA, 22 bp, Homo sapiens
gattggagatagggaaagaaag

SEQ ID NO: 6257346 - DNA, 22 bp, Homo sapiens
gattggatattctcctcggact

SEQ ID NO: 6257347 - DNA, 11 bp, Homo sapiens
gattggattat

SEQ ID NO: 6257348 - DNA, 21 bp, Homo sapiens
gattggattatttaataacat

SEQ ID NO: 6257349 - DNA, 18 bp, Homo sapiens
gattggcacaagctccct

SEQ ID NO: 6257350 - DNA, 13 bp, Homo sapiens
gattggcaggagg

SEQ ID NO: 6257351 - DNA, 11 bp, Homo sapiens
gattggcaggt

SEQ ID NO: 6257352 - DNA, 22 bp, Homo sapiens
gattggccagtgagaagctgag

SEQ ID NO: 6257353 - DNA, 17 bp, Homo sapiens
gattggcctgtgtctgg

SEQ ID NO: 6257354 - DNA, 22 bp, Homo sapiens
gattggcctgtgtctggcccct

SEQ ID NO: 6257355 - DNA, 15 bp, Homo sapiens
gattggcgcccccct

SEQ ID NO: 6257356 - DNA, 20 bp, Homo sapiens
gattggcgggtccacttgcc

SEQ ID NO: 6257357 - DNA, 12 bp, Homo sapiens
gattggctcacc

SEQ ID NO: 6257358 - DNA, 14 bp, Homo sapiens
gattggctgcagga

SEQ ID NO: 6257359 - DNA, 19 bp, Homo sapiens
gattggctgggcaaaagaa

SEQ ID NO: 6257360 - DNA, 19 bp, Homo sapiens
gattggcttaaagtgaagg

SEQ ID NO: 6257361 - DNA, 11 bp, Homo sapiens
gattggctttg

SEQ ID NO: 6257362 - DNA, 23 bp, Homo sapiens
gattggctttgtgcttggggcta

SEQ ID NO: 6257363 - DNA, 23 bp, Homo sapiens
gattgggaataaatatgcctctc

SEQ ID NO: 6257364 - DNA, 13 bp, Homo sapiens
gattgggacagag

SEQ ID NO: 6257365 - DNA, 15 bp, Homo sapiens
gattgggagccattt

SEQ ID NO: 6257366 - DNA, 16 bp, Homo sapiens
gattgggagccatttt

SEQ ID NO: 6257367 - DNA, 22 bp, Homo sapiens
gattgggaggtgcgtgttcagc

SEQ ID NO: 6257368 - DNA, 20 bp, Homo sapiens
gattggggaagactgtggct

SEQ ID NO: 6257369 - DNA, 20 bp, Homo sapiens
gattggggcctcacccagaa

SEQ ID NO: 6257370 - DNA, 17 bp, Homo sapiens
gattgggggctggtgcc

SEQ ID NO: 6257371 - DNA, 18 bp, Homo sapiens
gattgggggctggtgcca

SEQ ID NO: 6257372 - DNA, 17 bp, Homo sapiens
gattgggggggcttggg

SEQ ID NO: 6257373 - DNA, 21 bp, Homo sapiens
gattggggggtgggctttgtt

SEQ ID NO: 6257374 - DNA, 14 bp, Homo sapiens
gattgggtgccatg

SEQ ID NO: 6257375 - DNA, 17 bp, Homo sapiens
gattgggtgccatgtgg

SEQ ID NO: 6257376 - DNA, 19 bp, Homo sapiens
gattgggtgccatgtggag

SEQ ID NO: 6257377 - DNA, 21 bp, Homo sapiens
gattgggtttttggacttctg

SEQ ID NO: 6257378 - DNA, 17 bp, Homo sapiens
gattggtaactgcctgg

SEQ ID NO: 6257379 - DNA, 19 bp, Homo sapiens
gattggtcattaaatacta

SEQ ID NO: 6257380 - DNA, 22 bp, Homo sapiens
gattggtgggctgatttacatg

SEQ ID NO: 6257381 - DNA, 22 bp, Homo sapiens
gattggtgttcgtttccatcat

SEQ ID NO: 6257382 - DNA, 17 bp, Homo sapiens
gattggtgtttttttct

SEQ ID NO: 6257383 - DNA, 17 bp, Homo sapiens
gattggttcatgcctgg

SEQ ID NO: 6257384 - DNA, 18 bp, Homo sapiens
gattggttcatgcctggg

SEQ ID NO: 6257385 - DNA, 21 bp, Homo sapiens
gattggttcatgcctggggtg

SEQ ID NO: 6257386 - DNA, 20 bp, Homo sapiens
gattggttgtgccttccctt

SEQ ID NO: 6257387 - DNA, 21 bp, Homo sapiens
gattggttttaattgaaggaa

SEQ ID NO: 6257388 - DNA, 21 bp, Homo sapiens
gattggttttggggaaatgtg

SEQ ID NO: 6257389 - DNA, 22 bp, Homo sapiens
gattgtaaaaaaaaatgccttt

SEQ ID NO: 6257390 - DNA, 12 bp, Homo sapiens
gattgtaaaatg

SEQ ID NO: 6257391 - DNA, 22 bp, Homo sapiens
gattgtaaaccgctttggcctg

SEQ ID NO: 6257392 - DNA, 20 bp, Homo sapiens
gattgtaaactaaagtgtgc

SEQ ID NO: 6257393 - DNA, 14 bp, Homo sapiens
gattgtaacatatt

SEQ ID NO: 6257394 - DNA, 19 bp, Homo sapiens
gattgtaacgttgctgtgg

SEQ ID NO: 6257395 - DNA, 22 bp, Homo sapiens
gattgtaatacacatatctaaa

SEQ ID NO: 6257396 - DNA, 22 bp, Homo sapiens
gattgtacagaatcattgctta

SEQ ID NO: 6257397 - DNA, 15 bp, Homo sapiens
gattgtacatatttt

SEQ ID NO: 6257398 - DNA, 19 bp, Homo sapiens
gattgtacgtagccacagg

SEQ ID NO: 6257399 - DNA, 22 bp, Homo sapiens
gattgtactgttcatacagttt

SEQ ID NO: 6257400 - DNA, 21 bp, Homo sapiens
gattgtacttttatcttaaaa

SEQ ID NO: 6257401 - DNA, 23 bp, Homo sapiens
gattgtagtatttagtatatgaa

SEQ ID NO: 6257402 - DNA, 13 bp, Homo sapiens
gattgtattgctg

SEQ ID NO: 6257403 - DNA, 15 bp, Homo sapiens
gattgtattgttgaa

SEQ ID NO: 6257404 - DNA, 16 bp, Homo sapiens
gattgtatttaagaca

SEQ ID NO: 6257405 - DNA, 19 bp, Homo sapiens
gattgtatttaagacataa

SEQ ID NO: 6257406 - DNA, 12 bp, Homo sapiens
gattgtatttgt

SEQ ID NO: 6257407 - DNA, 19 bp, Homo sapiens
gattgtcaacacaaactgg

SEQ ID NO: 6257408 - DNA, 17 bp, Homo sapiens
gattgtccacaaatgtc

SEQ ID NO: 6257409 - DNA, 20 bp, Homo sapiens
gattgtccccgacccttgcc

SEQ ID NO: 6257410 - DNA, 18 bp, Homo sapiens
gattgtctaaccaattgt

SEQ ID NO: 6257411 - DNA, 14 bp, Homo sapiens
gattgtctgctgcc

SEQ ID NO: 6257412 - DNA, 15 bp, Homo sapiens
gattgtcttaatatt

SEQ ID NO: 6257413 - DNA, 15 bp, Homo sapiens
gattgtgaggcttct

SEQ ID NO: 6257414 - DNA, 16 bp, Homo sapiens
gattgtgccagagcat

SEQ ID NO: 6257415 - DNA, 22 bp, Homo sapiens
gattgtggggtgcagctgggtg

SEQ ID NO: 6257416 - DNA, 16 bp, Homo sapiens
gattgtggtggtgcta

SEQ ID NO: 6257417 - DNA, 23 bp, Homo sapiens
gattgtgtacatagagcaatgtt

SEQ ID NO: 6257418 - DNA, 20 bp, Homo sapiens
gattgtgtctcttggtcctg

SEQ ID NO: 6257419 - DNA, 20 bp, Homo sapiens
gattgtgtgactattcatgg

SEQ ID NO: 6257420 - DNA, 16 bp, Homo sapiens
gattgtgttgaagaag

SEQ ID NO: 6257421 - DNA, 21 bp, Homo sapiens
gattgttaagtctaaatattt

SEQ ID NO: 6257422 - DNA, 16 bp, Homo sapiens
gattgttacagaagct

SEQ ID NO: 6257423 - DNA, 14 bp, Homo sapiens
gattgttattaaat

SEQ ID NO: 6257424 - DNA, 16 bp, Homo sapiens
gattgttattaaatgt

SEQ ID NO: 6257425 - DNA, 14 bp, Homo sapiens
gattgttcataata

SEQ ID NO: 6257426 - DNA, 21 bp, Homo sapiens
gccttctgctgcccaggccac

SEQ ID NO: 6257427 - DNA, 19 bp, Homo sapiens
gccttctggattcttggcc

SEQ ID NO: 6257428 - DNA, 19 bp, Homo sapiens
gccttctggttatttatgg

SEQ ID NO: 6257429 - DNA, 11 bp, Homo sapiens
gccttctgtat

SEQ ID NO: 6257430 - DNA, 16 bp, Homo sapiens
gccttctgtctcttgc

SEQ ID NO: 6257431 - DNA, 17 bp, Homo sapiens
gccttctgtggggctgg

SEQ ID NO: 6257432 - DNA, 19 bp, Homo sapiens
gccttctgtggggctgggc

SEQ ID NO: 6257433 - DNA, 20 bp, Homo sapiens
gccttctgtggggctgggca

SEQ ID NO: 6257434 - DNA, 23 bp, Homo sapiens
gccttcttaagatacaaatggtg

SEQ ID NO: 6257435 - DNA, 17 bp, Homo sapiens
gccttcttcacccagct

SEQ ID NO: 6257436 - DNA, 14 bp, Homo sapiens
gccttcttcagggc

SEQ ID NO: 6257437 - DNA, 15 bp, Homo sapiens
gccttcttcagggcc

SEQ ID NO: 6257438 - DNA, 22 bp, Homo sapiens
gccttcttccatcccaggacac

SEQ ID NO: 6257439 - DNA, 21 bp, Homo sapiens
gccttcttccttgaggggcag

SEQ ID NO: 6257440 - DNA, 22 bp, Homo sapiens
gccttcttcggggaactcctgg

SEQ ID NO: 6257441 - DNA, 11 bp, Homo sapiens
gccttcttctt

SEQ ID NO: 6257442 - DNA, 17 bp, Homo sapiens
gccttcttctttttgct

SEQ ID NO: 6257443 - DNA, 15 bp, Homo sapiens
gccttctttgaagaa

SEQ ID NO: 6257444 - DNA, 18 bp, Homo sapiens
gccttctttgcttgcctc

SEQ ID NO: 6257445 - DNA, 22 bp, Homo sapiens
gccttcttttgattatgttttt

SEQ ID NO: 6257446 - DNA, 16 bp, Homo sapiens
gccttgaaaaatgaca

SEQ ID NO: 6257447 - DNA, 22 bp, Homo sapiens
gccttgaaaaatgacaattgtg

SEQ ID NO: 6257448 - DNA, 23 bp, Homo sapiens
gccttgaaaaatgacaattgtga

SEQ ID NO: 6257449 - DNA, 14 bp, Homo sapiens
gccttgaaaacaaa

SEQ ID NO: 6257450 - DNA, 14 bp, Homo sapiens
gccttgaaatcaag

SEQ ID NO: 6257451 - DNA, 18 bp, Homo sapiens
gccttgaaatttacacag

SEQ ID NO: 6257452 - DNA, 16 bp, Homo sapiens
gccttgaactctgggc

SEQ ID NO: 6257453 - DNA, 21 bp, Homo sapiens
gccttgaactgtggccaccta

SEQ ID NO: 6257454 - DNA, 14 bp, Homo sapiens
gccttgaactgttg

SEQ ID NO: 6257455 - DNA, 21 bp, Homo sapiens
gccttgaagaaaatgacttta

SEQ ID NO: 6257456 - DNA, 23 bp, Homo sapiens
gccttgaagaaaatgactttatt

SEQ ID NO: 6257457 - DNA, 15 bp, Homo sapiens
gccttgaagacagag

SEQ ID NO: 6257458 - DNA, 16 bp, Homo sapiens
gccttgaagacagagc

SEQ ID NO: 6257459 - DNA, 14 bp, Homo sapiens
gccttgaagccact

SEQ ID NO: 6257460 - DNA, 11 bp, Homo sapiens
gccttgaagtg

SEQ ID NO: 6257461 - DNA, 12 bp, Homo sapiens
gccttgaagtgt

SEQ ID NO: 6257462 - DNA, 11 bp, Homo sapiens
gccttgacaca

SEQ ID NO: 6257463 - DNA, 16 bp, Homo sapiens
gccttgacatcagttc

SEQ ID NO: 6257464 - DNA, 21 bp, Homo sapiens
gccttgacatcagttcctttg

SEQ ID NO: 6257465 - DNA, 16 bp, Homo sapiens
gccttgaccattctcc

SEQ ID NO: 6257466 - DNA, 21 bp, Homo sapiens
gccttgaccattctccacctg

SEQ ID NO: 6257467 - DNA, 11 bp, Homo sapiens
gccttgaccta

SEQ ID NO: 6257468 - DNA, 15 bp, Homo sapiens
gccttgagcatctgg

SEQ ID NO: 6257469 - DNA, 15 bp, Homo sapiens
gccttgagccctggc

SEQ ID NO: 6257470 - DNA, 17 bp, Homo sapiens
gccttgagctgcctgct

SEQ ID NO: 6257471 - DNA, 20 bp, Homo sapiens
gccttgagctgcctgctctg

SEQ ID NO: 6257472 - DNA, 21 bp, Homo sapiens
gccttgagctgcctgctctgc

SEQ ID NO: 6257473 - DNA, 18 bp, Homo sapiens
gccttgagtccccagggg

SEQ ID NO: 6257474 - DNA, 21 bp, Homo sapiens
gccttgagtgacatgcggctg

SEQ ID NO: 6257475 - DNA, 19 bp, Homo sapiens
gccttgataatacttgacc

SEQ ID NO: 6257476 - DNA, 15 bp, Homo sapiens
gccttgatccccttg

SEQ ID NO: 6257477 - DNA, 14 bp, Homo sapiens
gccttgatgaagcc

SEQ ID NO: 6257478 - DNA, 17 bp, Homo sapiens
gccttgatgaagcccgt

SEQ ID NO: 6257479 - DNA, 18 bp, Homo sapiens
gccttgatgaagcctgtg

SEQ ID NO: 6257480 - DNA, 21 bp, Homo sapiens
gccttgatgaagcctgtgcca

SEQ ID NO: 6257481 - DNA, 22 bp, Homo sapiens
gccttgatgaagcctgtgccac

SEQ ID NO: 6257482 - DNA, 15 bp, Homo sapiens
gccttgatggagaag

SEQ ID NO: 6257483 - DNA, 16 bp, Homo sapiens
gccttgatggagaagg

SEQ ID NO: 6257484 - DNA, 16 bp, Homo sapiens
gccttgatgttgtgtt

SEQ ID NO: 6257485 - DNA, 20 bp, Homo sapiens
gccttgattataccactgca

SEQ ID NO: 6257486 - DNA, 12 bp, Homo sapiens
gccttgatttcc

SEQ ID NO: 6257487 - DNA, 19 bp, Homo sapiens
gccttgatttgttcttaca

SEQ ID NO: 6257488 - DNA, 18 bp, Homo sapiens
gccttgattttaattcag

SEQ ID NO: 6257489 - DNA, 20 bp, Homo sapiens
gccttgattttaattcaggt

SEQ ID NO: 6257490 - DNA, 14 bp, Homo sapiens
gccttgcaagatgg

SEQ ID NO: 6257491 - DNA, 17 bp, Homo sapiens
gccttgcacacccactg

SEQ ID NO: 6257492 - DNA, 19 bp, Homo sapiens
gccttgcacacccactgcc

SEQ ID NO: 6257493 - DNA, 20 bp, Homo sapiens
gccttgcacacccactgccc

SEQ ID NO: 6257494 - DNA, 22 bp, Homo sapiens
gccttgcacacccactgccccg

SEQ ID NO: 6257495 - DNA, 17 bp, Homo sapiens
gccttgcacggctgctc

SEQ ID NO: 6257496 - DNA, 15 bp, Homo sapiens
gccttgcagaactgc

SEQ ID NO: 6257497 - DNA, 23 bp, Homo sapiens
gccttgcagcactcacacaggac

SEQ ID NO: 6257498 - DNA, 14 bp, Homo sapiens
gccttgcagccaca

SEQ ID NO: 6257499 - DNA, 12 bp, Homo sapiens
gccttgcagctg

SEQ ID NO: 6257500 - DNA, 13 bp, Homo sapiens
gccttgcagctgg

SEQ ID NO: 6257501 - DNA, 17 bp, Homo sapiens
gccttgcagctggccca

SEQ ID NO: 6257502 - DNA, 18 bp, Homo sapiens
gccttgcagctggcccac

SEQ ID NO: 6257503 - DNA, 16 bp, Homo sapiens
gccttgcatgtacttg

SEQ ID NO: 6257504 - DNA, 21 bp, Homo sapiens
gccttgcatgtacttgaagga

SEQ ID NO: 6257505 - DNA, 19 bp, Homo sapiens
gccttgcatttgtacctta

SEQ ID NO: 6257506 - DNA, 12 bp, Homo sapiens
gccttgccagag

SEQ ID NO: 6257507 - DNA, 13 bp, Homo sapiens
gccttgccagttt

SEQ ID NO: 6257508 - DNA, 14 bp, Homo sapiens
gccttgcccacagg

SEQ ID NO: 6257509 - DNA, 21 bp, Homo sapiens
gccttgcccacccccaccatg

SEQ ID NO: 6257510 - DNA, 17 bp, Homo sapiens
gccttgcccactcctgc

SEQ ID NO: 6257511 - DNA, 14 bp, Homo sapiens
gccttgcccagaga

SEQ ID NO: 6257512 - DNA, 15 bp, Homo sapiens
gccttgcccagagat

SEQ ID NO: 6257513 - DNA, 16 bp, Homo sapiens
gccttgcccagagatg

SEQ ID NO: 6257514 - DNA, 22 bp, Homo sapiens
gccttgcccagagatgcctcca

SEQ ID NO: 6257515 - DNA, 14 bp, Homo sapiens
gccttgcccagcct

SEQ ID NO: 6257516 - DNA, 15 bp, Homo sapiens
gccttgcccagcctg

SEQ ID NO: 6257517 - DNA, 19 bp, Homo sapiens
gccttgcccagcctggatg

SEQ ID NO: 6257518 - DNA, 14 bp, Homo sapiens
gccttgccctcctg

SEQ ID NO: 6257519 - DNA, 18 bp, Homo sapiens
gccttgccctcctgggcc

SEQ ID NO: 6257520 - DNA, 19 bp, Homo sapiens
gccttgccctcctgggccc

SEQ ID NO: 6257521 - DNA, 17 bp, Homo sapiens
gccttgccgctcccctt

SEQ ID NO: 6257522 - DNA, 15 bp, Homo sapiens
gccttgcctcctcag

SEQ ID NO: 6257523 - DNA, 16 bp, Homo sapiens
gccttgcctcctcagt

SEQ ID NO: 6257524 - DNA, 15 bp, Homo sapiens
gccttgcctggcctg

SEQ ID NO: 6257525 - DNA, 14 bp, Homo sapiens
gccttgccttgtgt

SEQ ID NO: 6257526 - DNA, 17 bp, Homo sapiens
gccttgcgctgtcccag

SEQ ID NO: 6257527 - DNA, 18 bp, Homo sapiens
gccttgcgctgtcccagg

SEQ ID NO: 6257528 - DNA, 15 bp, Homo sapiens
gccttgcggaagcca

SEQ ID NO: 6257529 - DNA, 20 bp, Homo sapiens
gccttgcggctcctcaggga

SEQ ID NO: 6257530 - DNA, 21 bp, Homo sapiens
gccttgctattttaataaaga

SEQ ID NO: 6257531 - DNA, 13 bp, Homo sapiens
gccttgctcattc

SEQ ID NO: 6257532 - DNA, 15 bp, Homo sapiens
gccttgctctcttca

SEQ ID NO: 6257533 - DNA, 14 bp, Homo sapiens
gccttgctctgagc

SEQ ID NO: 6257534 - DNA, 19 bp, Homo sapiens
gccttgctctgagcacagg

SEQ ID NO: 6257535 - DNA, 14 bp, Homo sapiens
gccttgctctgttg

SEQ ID NO: 6257536 - DNA, 13 bp, Homo sapiens
gccttgctgacct

SEQ ID NO: 6257537 - DNA, 21 bp, Homo sapiens
gccttgctgacctcccagcct

SEQ ID NO: 6257538 - DNA, 17 bp, Homo sapiens
gccttgctgactctctg

SEQ ID NO: 6257539 - DNA, 23 bp, Homo sapiens
gccttgctgactctctgagctgg

SEQ ID NO: 6257540 - DNA, 17 bp, Homo sapiens
gccttgctgagacttac

SEQ ID NO: 6257541 - DNA, 14 bp, Homo sapiens
gccttgctgcacct

SEQ ID NO: 6257542 - DNA, 21 bp, Homo sapiens
gccttgctgccttcaccctga

SEQ ID NO: 6257543 - DNA, 12 bp, Homo sapiens
gccttgctgctc

SEQ ID NO: 6257544 - DNA, 16 bp, Homo sapiens
gccttgctgctctgcg

SEQ ID NO: 6257545 - DNA, 14 bp, Homo sapiens
gccttgctgctgct

SEQ ID NO: 6257546 - DNA, 20 bp, Homo sapiens
gccttgctgctgctgcaccc

SEQ ID NO: 6257547 - DNA, 18 bp, Homo sapiens
gccttgctggggtccagg

SEQ ID NO: 6257548 - DNA, 20 bp, Homo sapiens
gccttgctggggtccagggc

SEQ ID NO: 6257549 - DNA, 22 bp, Homo sapiens
gccttgctggggtccagggctg

SEQ ID NO: 6257550 - DNA, 22 bp, Homo sapiens
gccttgctgtttgtcctgagat

SEQ ID NO: 6257551 - DNA, 16 bp, Homo sapiens
gccttgcttctcttct

SEQ ID NO: 6257552 - DNA, 17 bp, Homo sapiens
gccttgctttgggcttt

SEQ ID NO: 6257553 - DNA, 22 bp, Homo sapiens
gccttgctttgggctttgcagg

SEQ ID NO: 6257554 - DNA, 21 bp, Homo sapiens
gccttgctttgtctggcctca

SEQ ID NO: 6257555 - DNA, 13 bp, Homo sapiens
gccttggaaattc

SEQ ID NO: 6257556 - DNA, 16 bp, Homo sapiens
gccttggacaccatcc

SEQ ID NO: 6257557 - DNA, 23 bp, Homo sapiens
gccttggatcgctaagctggctc

SEQ ID NO: 6257558 - DNA, 22 bp, Homo sapiens
gccttggcaggctgctggaagg

SEQ ID NO: 6257559 - DNA, 15 bp, Homo sapiens
gccttggccggctgt

SEQ ID NO: 6257560 - DNA, 12 bp, Homo sapiens
gccttggcctcc

SEQ ID NO: 6257561 - DNA, 11 bp, Homo sapiens
gccttggcctg

SEQ ID NO: 6257562 - DNA, 12 bp, Homo sapiens
gccttggcctgg

SEQ ID NO: 6257563 - DNA, 23 bp, Homo sapiens
gccttggcctgtgttcttcctgg

SEQ ID NO: 6257564 - DNA, 18 bp, Homo sapiens
gccttggccttgcagctg

SEQ ID NO: 6257565 - DNA, 17 bp, Homo sapiens
gccttggctcctgagaa

SEQ ID NO: 6257566 - DNA, 17 bp, Homo sapiens
gccttggctcgttctct

SEQ ID NO: 6257567 - DNA, 12 bp, Homo sapiens
gccttgggagcc

SEQ ID NO: 6257568 - DNA, 15 bp, Homo sapiens
gccttgggagccact

SEQ ID NO: 6257569 - DNA, 18 bp, Homo sapiens
gccttgggagccactgcc

SEQ ID NO: 6257570 - DNA, 19 bp, Homo sapiens
gccttgggagccactgcca

SEQ ID NO: 6257571 - DNA, 21 bp, Homo sapiens
gccttgggagccactgccact

SEQ ID NO: 6257572 - DNA, 22 bp, Homo sapiens
gccttgggagccactgccactc

SEQ ID NO: 6257573 - DNA, 20 bp, Homo sapiens
gccttgggagctcatccctc

SEQ ID NO: 6257574 - DNA, 17 bp, Homo sapiens
gccttgggccctctggt

SEQ ID NO: 6257575 - DNA, 14 bp, Homo sapiens
gccttgggcctggg

SEQ ID NO: 6257576 - DNA, 17 bp, Homo sapiens
gccttgggccttgctgc

SEQ ID NO: 6257577 - DNA, 18 bp, Homo sapiens
gccttgggctccgtgtgg

SEQ ID NO: 6257578 - DNA, 20 bp, Homo sapiens
gccttgggctccgtgtggga

SEQ ID NO: 6257579 - DNA, 21 bp, Homo sapiens
gccttgggctccgtgtgggag

SEQ ID NO: 6257580 - DNA, 17 bp, Homo sapiens
gccttgggctctgctga

SEQ ID NO: 6257581 - DNA, 14 bp, Homo sapiens
gccttgggctgctc

SEQ ID NO: 6257582 - DNA, 16 bp, Homo sapiens
gccttgggctgctcct

SEQ ID NO: 6257583 - DNA, 20 bp, Homo sapiens
gccttggggaggacaaaact

SEQ ID NO: 6257584 - DNA, 23 bp, Homo sapiens
gccttggggaggacaaaacttct

SEQ ID NO: 6257585 - DNA, 14 bp, Homo sapiens
gccttggggccaga

SEQ ID NO: 6257586 - DNA, 15 bp, Homo sapiens
gccttggggccagac

SEQ ID NO: 6257587 - DNA, 22 bp, Homo sapiens
gccttggggccagactggctgc

SEQ ID NO: 6257588 - DNA, 18 bp, Homo sapiens
gccttgggggggctgcct

SEQ ID NO: 6257589 - DNA, 19 bp, Homo sapiens
gccttgggggggctgcctt

SEQ ID NO: 6257590 - DNA, 20 bp, Homo sapiens
gccttgggggggctgccttt

SEQ ID NO: 6257591 - DNA, 18 bp, Homo sapiens
gccttgggggtctgctct

SEQ ID NO: 6257592 - DNA, 15 bp, Homo sapiens
gccttggggtggggg

SEQ ID NO: 6257593 - DNA, 21 bp, Homo sapiens
gccttggggtgggggccaggc

SEQ ID NO: 6257594 - DNA, 21 bp, Homo sapiens
gccttgggtctcagctgctga

SEQ ID NO: 6257595 - DNA, 18 bp, Homo sapiens
gccttgggttccaaccag

SEQ ID NO: 6257596 - DNA, 16 bp, Homo sapiens
gccttggtatcatttt

SEQ ID NO: 6257597 - DNA, 21 bp, Homo sapiens
gccttggtcccagacagctgg

SEQ ID NO: 6257598 - DNA, 23 bp, Homo sapiens
gccttggtcccagacagctggac

SEQ ID NO: 6257599 - DNA, 18 bp, Homo sapiens
gccttggtgaacacacac

SEQ ID NO: 6257600 - DNA, 17 bp, Homo sapiens
gccttggtggagcagcc

SEQ ID NO: 6257601 - DNA, 22 bp, Homo sapiens
gccttggtggagcagccagagc

SEQ ID NO: 6257602 - DNA, 15 bp, Homo sapiens
gccttggtgggggag

SEQ ID NO: 6257603 - DNA, 23 bp, Homo sapiens
gccttggtgggggagcctctgga

SEQ ID NO: 6257604 - DNA, 17 bp, Homo sapiens
gccttggtgtccacctg

SEQ ID NO: 6257605 - DNA, 13 bp, Homo sapiens
gattgttcatcat

SEQ ID NO: 6257606 - DNA, 13 bp, Homo sapiens
gattgttcctccc

SEQ ID NO: 6257607 - DNA, 17 bp, Homo sapiens
gattgttcctccccagc

SEQ ID NO: 6257608 - DNA, 22 bp, Homo sapiens
gattgttctgtccagtttccaa

SEQ ID NO: 6257609 - DNA, 11 bp, Homo sapiens
gattgtttaaa

SEQ ID NO: 6257610 - DNA, 18 bp, Homo sapiens
gattgtttcctcttccaa

SEQ ID NO: 6257611 - DNA, 19 bp, Homo sapiens
gattgtttctggtgactgc

SEQ ID NO: 6257612 - DNA, 15 bp, Homo sapiens
gattgtttgatgaat

SEQ ID NO: 6257613 - DNA, 22 bp, Homo sapiens
gattgtttgatgaataaaatgt

SEQ ID NO: 6257614 - DNA, 16 bp, Homo sapiens
gattgtttgcacagag

SEQ ID NO: 6257615 - DNA, 19 bp, Homo sapiens
gattgtttgcacagagggc

SEQ ID NO: 6257616 - DNA, 19 bp, Homo sapiens
gattgttttagaagttaaa

SEQ ID NO: 6257617 - DNA, 17 bp, Homo sapiens
gattgttttggtctcaa

SEQ ID NO: 6257618 - DNA, 17 bp, Homo sapiens
gatttaaaaaataaata

SEQ ID NO: 6257619 - DNA, 23 bp, Homo sapiens
gatttaaaaagtgagaaagaaag

SEQ ID NO: 6257620 - DNA, 20 bp, Homo sapiens
gatttaaaaatgccaaaact

SEQ ID NO: 6257621 - DNA, 18 bp, Homo sapiens
gatttaaaagcctgctca

SEQ ID NO: 6257622 - DNA, 13 bp, Homo sapiens
gatttaaactctg

SEQ ID NO: 6257623 - DNA, 14 bp, Homo sapiens
gatttaaactctga

SEQ ID NO: 6257624 - DNA, 16 bp, Homo sapiens
gatttaaagaaaacca

SEQ ID NO: 6257625 - DNA, 17 bp, Homo sapiens
gatttaaatagaacttg

SEQ ID NO: 6257626 - DNA, 19 bp, Homo sapiens
gatttaaattttcacctgt

SEQ ID NO: 6257627 - DNA, 14 bp, Homo sapiens
gatttaacaaatac

SEQ ID NO: 6257628 - DNA, 13 bp, Homo sapiens
gatttaacacttt

SEQ ID NO: 6257629 - DNA, 13 bp, Homo sapiens
gatttaacagaaa

SEQ ID NO: 6257630 - DNA, 18 bp, Homo sapiens
gatttaacagaaatgtac

SEQ ID NO: 6257631 - DNA, 19 bp, Homo sapiens
gatttaacagtcatttaaa

SEQ ID NO: 6257632 - DNA, 20 bp, Homo sapiens
gatttaacctgttatttcta

SEQ ID NO: 6257633 - DNA, 22 bp, Homo sapiens
gatttaaccttaattttacagc

SEQ ID NO: 6257634 - DNA, 12 bp, Homo sapiens
gatttaactggg

SEQ ID NO: 6257635 - DNA, 15 bp, Homo sapiens
gatttaactgtgaac

SEQ ID NO: 6257636 - DNA, 18 bp, Homo sapiens
gatttaagacactttttg

SEQ ID NO: 6257637 - DNA, 17 bp, Homo sapiens
gatttaagatatgtaac

SEQ ID NO: 6257638 - DNA, 16 bp, Homo sapiens
gatttaagcacaaact

SEQ ID NO: 6257639 - DNA, 17 bp, Homo sapiens
gatttaagccttacaaa

SEQ ID NO: 6257640 - DNA, 15 bp, Homo sapiens
gatttaaggtattta

SEQ ID NO: 6257641 - DNA, 22 bp, Homo sapiens
gatttaagtgaatacattaacg

SEQ ID NO: 6257642 - DNA, 20 bp, Homo sapiens
gatttaagttacaatgtttt

SEQ ID NO: 6257643 - DNA, 20 bp, Homo sapiens
gatttaagttcctgctgcct

SEQ ID NO: 6257644 - DNA, 13 bp, Homo sapiens
gatttaataaaat

SEQ ID NO: 6257645 - DNA, 14 bp, Homo sapiens
gatttaataaaata

SEQ ID NO: 6257646 - DNA, 17 bp, Homo sapiens
gatttaataaaataatt

SEQ ID NO: 6257647 - DNA, 19 bp, Homo sapiens
gatttaataaaataattct

SEQ ID NO: 6257648 - DNA, 14 bp, Homo sapiens
gatttaatagtgtt

SEQ ID NO: 6257649 - DNA, 15 bp, Homo sapiens
gatttaatagtgtta

SEQ ID NO: 6257650 - DNA, 16 bp, Homo sapiens
gatttaatagtgttaa

SEQ ID NO: 6257651 - DNA, 18 bp, Homo sapiens
gatttaatagtgttaatc

SEQ ID NO: 6257652 - DNA, 19 bp, Homo sapiens
gatttaatctgccaagggc

SEQ ID NO: 6257653 - DNA, 14 bp, Homo sapiens
gatttaatgttttc

SEQ ID NO: 6257654 - DNA, 13 bp, Homo sapiens
gatttaatttcca

SEQ ID NO: 6257655 - DNA, 14 bp, Homo sapiens
gatttaatttgcca

SEQ ID NO: 6257656 - DNA, 15 bp, Homo sapiens
gatttaatttgccaa

SEQ ID NO: 6257657 - DNA, 23 bp, Homo sapiens
gatttaatttgccaaaataatgt

SEQ ID NO: 6257658 - DNA, 16 bp, Homo sapiens
gatttacactgggaga

SEQ ID NO: 6257659 - DNA, 21 bp, Homo sapiens
gatttacagcaagtagataaa

SEQ ID NO: 6257660 - DNA, 22 bp, Homo sapiens
gatttacagtttcaaaaactgt

SEQ ID NO: 6257661 - DNA, 14 bp, Homo sapiens
gatttacatgtatg

SEQ ID NO: 6257662 - DNA, 16 bp, Homo sapiens
gatttacatgtatggt

SEQ ID NO: 6257663 - DNA, 10 bp, Homo sapiens
gatttacatt

SEQ ID NO: 6257664 - DNA, 20 bp, Homo sapiens
gatttacccagaatgtcaga

SEQ ID NO: 6257665 - DNA, 21 bp, Homo sapiens
gatttacccagaatgtcagat

SEQ ID NO: 6257666 - DNA, 17 bp, Homo sapiens
gatttacctttggaatt

SEQ ID NO: 6257667 - DNA, 20 bp, Homo sapiens
gatttaccttttctgttgta

SEQ ID NO: 6257668 - DNA, 15 bp, Homo sapiens
gatttacgctcattg

SEQ ID NO: 6257669 - DNA, 19 bp, Homo sapiens
gatttagaagatagaaata

SEQ ID NO: 6257670 - DNA, 20 bp, Homo sapiens
gatttagaagtgtcatgttt

SEQ ID NO: 6257671 - DNA, 20 bp, Homo sapiens
gatttagagcaatgcattct

SEQ ID NO: 6257672 - DNA, 15 bp, Homo sapiens
gatttagagtttttt

SEQ ID NO: 6257673 - DNA, 16 bp, Homo sapiens
gatttagatatgcaaa

SEQ ID NO: 6257674 - DNA, 20 bp, Homo sapiens
gatttagcaagcaactaatt

SEQ ID NO: 6257675 - DNA, 19 bp, Homo sapiens
gatttagcacccttctgct

SEQ ID NO: 6257676 - DNA, 17 bp, Homo sapiens
gatttagctaacaaaag

SEQ ID NO: 6257677 - DNA, 23 bp, Homo sapiens
gatttagctgtggctccctcctc

SEQ ID NO: 6257678 - DNA, 16 bp, Homo sapiens
gatttagtaagtgttc

SEQ ID NO: 6257679 - DNA, 23 bp, Homo sapiens
gatttagtctgttatatttcctt

SEQ ID NO: 6257680 - DNA, 21 bp, Homo sapiens
gatttagtgcttaacattttc

SEQ ID NO: 6257681 - DNA, 21 bp, Homo sapiens
gatttagtgtttttacctctg

SEQ ID NO: 6257682 - DNA, 14 bp, Homo sapiens
gatttataaatgca

SEQ ID NO: 6257683 - DNA, 17 bp, Homo sapiens
gatttataaatgcactg

SEQ ID NO: 6257684 - DNA, 18 bp, Homo sapiens
gatttataaatgcactgt

SEQ ID NO: 6257685 - DNA, 13 bp, Homo sapiens
gatttatatctat

SEQ ID NO: 6257686 - DNA, 13 bp, Homo sapiens
gatttatcaaatc

SEQ ID NO: 6257687 - DNA, 19 bp, Homo sapiens
gatttatcacacaaagcag

SEQ ID NO: 6257688 - DNA, 20 bp, Homo sapiens
gatttatcacacaaagcaga

SEQ ID NO: 6257689 - DNA, 14 bp, Homo sapiens
gatttatcactttt

SEQ ID NO: 6257690 - DNA, 20 bp, Homo sapiens
gatttatgaacagaaatatt

SEQ ID NO: 6257691 - DNA, 13 bp, Homo sapiens
gatttatggctgt

SEQ ID NO: 6257692 - DNA, 12 bp, Homo sapiens
gatttattaaag

SEQ ID NO: 6257693 - DNA, 21 bp, Homo sapiens
gatttattaatatatattatc

SEQ ID NO: 6257694 - DNA, 14 bp, Homo sapiens
gatttattatataa

SEQ ID NO: 6257695 - DNA, 14 bp, Homo sapiens
gatttattatgaac

SEQ ID NO: 6257696 - DNA, 19 bp, Homo sapiens
gatttattcccttttaaag

SEQ ID NO: 6257697 - DNA, 14 bp, Homo sapiens
gatttattctcaga

SEQ ID NO: 6257698 - DNA, 14 bp, Homo sapiens
gatttattgaaatt

SEQ ID NO: 6257699 - DNA, 15 bp, Homo sapiens
gatttattgaaattt

SEQ ID NO: 6257700 - DNA, 11 bp, Homo sapiens
gatttatttgc

SEQ ID NO: 6257701 - DNA, 13 bp, Homo sapiens
gatttatttgctt

SEQ ID NO: 6257702 - DNA, 15 bp, Homo sapiens
gatttatttgcttct

SEQ ID NO: 6257703 - DNA, 17 bp, Homo sapiens
gatttatttgcttcttc

SEQ ID NO: 6257704 - DNA, 12 bp, Homo sapiens
gatttatttgga

SEQ ID NO: 6257705 - DNA, 23 bp, Homo sapiens
gatttatttttaatatgttgact

SEQ ID NO: 6257706 - DNA, 20 bp, Homo sapiens
gatttatttttcagttccaa

SEQ ID NO: 6257707 - DNA, 18 bp, Homo sapiens
gatttattttttgtaact

SEQ ID NO: 6257708 - DNA, 21 bp, Homo sapiens
gatttattttttgtaactctt

SEQ ID NO: 6257709 - DNA, 15 bp, Homo sapiens
gatttcaaacttaaa

SEQ ID NO: 6257710 - DNA, 20 bp, Homo sapiens
gatttcaaattgtctggtac

SEQ ID NO: 6257711 - DNA, 14 bp, Homo sapiens
gatttcaacatatc

SEQ ID NO: 6257712 - DNA, 19 bp, Homo sapiens
gatttcaagaaaaaataaa

SEQ ID NO: 6257713 - DNA, 22 bp, Homo sapiens
gatttcaagaaaaaataaatgg

SEQ ID NO: 6257714 - DNA, 15 bp, Homo sapiens
gatttcaagcctgcc

SEQ ID NO: 6257715 - DNA, 13 bp, Homo sapiens
gatttcacagtgt

SEQ ID NO: 6257716 - DNA, 20 bp, Homo sapiens
gatttcacagtgtgtggtca

SEQ ID NO: 6257717 - DNA, 14 bp, Homo sapiens
gatttcactaggac

SEQ ID NO: 6257718 - DNA, 21 bp, Homo sapiens
gatttcactaggactcagaaa

SEQ ID NO: 6257719 - DNA, 13 bp, Homo sapiens
gatttcactctcc

SEQ ID NO: 6257720 - DNA, 19 bp, Homo sapiens
gatttcagaagccaagttt

SEQ ID NO: 6257721 - DNA, 20 bp, Homo sapiens
gatttcagcacatgcactac

SEQ ID NO: 6257722 - DNA, 18 bp, Homo sapiens
gatttcaggcagcagggg

SEQ ID NO: 6257723 - DNA, 22 bp, Homo sapiens
gatttcaggtcaactctgaaga

SEQ ID NO: 6257724 - DNA, 19 bp, Homo sapiens
gatttcagtaatgtcttca

SEQ ID NO: 6257725 - DNA, 22 bp, Homo sapiens
gatttcagtagaattttagtcc

SEQ ID NO: 6257726 - DNA, 21 bp, Homo sapiens
gatttcagtcatagcaagctt

SEQ ID NO: 6257727 - DNA, 19 bp, Homo sapiens
gatttcagttctaggaaaa

SEQ ID NO: 6257728 - DNA, 20 bp, Homo sapiens
gatttcagttttaacaaatg

SEQ ID NO: 6257729 - DNA, 20 bp, Homo sapiens
gatttcagtttttcatttgt

SEQ ID NO: 6257730 - DNA, 21 bp, Homo sapiens
gatttcagtttttcatttgtt

SEQ ID NO: 6257731 - DNA, 12 bp, Homo sapiens
gatttcataatt

SEQ ID NO: 6257732 - DNA, 22 bp, Homo sapiens
gatttcatatctaactttgtaa

SEQ ID NO: 6257733 - DNA, 17 bp, Homo sapiens
gatttcatattgatctt

SEQ ID NO: 6257734 - DNA, 18 bp, Homo sapiens
gatttcatctgagtgtgg

SEQ ID NO: 6257735 - DNA, 15 bp, Homo sapiens
gatttcatctgctct

SEQ ID NO: 6257736 - DNA, 22 bp, Homo sapiens
gatttcatctgctctccttcct

SEQ ID NO: 6257737 - DNA, 18 bp, Homo sapiens
gatttcatgattagacaa

SEQ ID NO: 6257738 - DNA, 22 bp, Homo sapiens
gatttcatgtaaccaagagtat

SEQ ID NO: 6257739 - DNA, 13 bp, Homo sapiens
gatttcatgtact

SEQ ID NO: 6257740 - DNA, 20 bp, Homo sapiens
gatttcatgtactgcattat

SEQ ID NO: 6257741 - DNA, 14 bp, Homo sapiens
gatttccaagcctc

SEQ ID NO: 6257742 - DNA, 15 bp, Homo sapiens
gatttccaagtaata

SEQ ID NO: 6257743 - DNA, 18 bp, Homo sapiens
gatttccaagtaatataa

SEQ ID NO: 6257744 - DNA, 23 bp, Homo sapiens
gatttccacctttatgttttaat

SEQ ID NO: 6257745 - DNA, 19 bp, Homo sapiens
gatttccagaaccacactt

SEQ ID NO: 6257746 - DNA, 19 bp, Homo sapiens
gatttccagccagggctgc

SEQ ID NO: 6257747 - DNA, 13 bp, Homo sapiens
gatttccaggccc

SEQ ID NO: 6257748 - DNA, 19 bp, Homo sapiens
gatttccagtgagtgtaaa

SEQ ID NO: 6257749 - DNA, 13 bp, Homo sapiens
gatttccatattt

SEQ ID NO: 6257750 - DNA, 16 bp, Homo sapiens
gatttccatctctggt

SEQ ID NO: 6257751 - DNA, 16 bp, Homo sapiens
gatttccatgggcccc

SEQ ID NO: 6257752 - DNA, 18 bp, Homo sapiens
gatttccatgggccccac

SEQ ID NO: 6257753 - DNA, 17 bp, Homo sapiens
gatttccattgtgtggc

SEQ ID NO: 6257754 - DNA, 20 bp, Homo sapiens
gatttccattgtgtggcctg

SEQ ID NO: 6257755 - DNA, 21 bp, Homo sapiens
gatttccattgtgtggcctgg

SEQ ID NO: 6257756 - DNA, 15 bp, Homo sapiens
gatttccatttctga

SEQ ID NO: 6257757 - DNA, 13 bp, Homo sapiens
gatttccattttt

SEQ ID NO: 6257758 - DNA, 19 bp, Homo sapiens
gatttcccactgcactcca

SEQ ID NO: 6257759 - DNA, 22 bp, Homo sapiens
gatttcccactgcactccagcc

SEQ ID NO: 6257760 - DNA, 22 bp, Homo sapiens
gatttcccatcccctgtgggaa

SEQ ID NO: 6257761 - DNA, 17 bp, Homo sapiens
gatttccccttttgcat

SEQ ID NO: 6257762 - DNA, 22 bp, Homo sapiens
gatttccccttttgcattctcc

SEQ ID NO: 6257763 - DNA, 23 bp, Homo sapiens
gatttccccttttgcattctccc

SEQ ID NO: 6257764 - DNA, 19 bp, Homo sapiens
gatttccctccagagaaag

SEQ ID NO: 6257765 - DNA, 21 bp, Homo sapiens
gatttccctccagagaaagca

SEQ ID NO: 6257766 - DNA, 18 bp, Homo sapiens
gatttccctgcagacctc

SEQ ID NO: 6257767 - DNA, 15 bp, Homo sapiens
gatttcccttcttct

SEQ ID NO: 6257768 - DNA, 16 bp, Homo sapiens
gatttccgtcatgctc

SEQ ID NO: 6257769 - DNA, 13 bp, Homo sapiens
gatttcctcctcc

SEQ ID NO: 6257770 - DNA, 21 bp, Homo sapiens
gatttcctcctcccagtgcct

SEQ ID NO: 6257771 - DNA, 22 bp, Homo sapiens
gatttccttgaatgtggcttga

SEQ ID NO: 6257772 - DNA, 18 bp, Homo sapiens
gatttcgaagtttgcaac

SEQ ID NO: 6257773 - DNA, 20 bp, Homo sapiens
gatttcgtgggtctgttttc

SEQ ID NO: 6257774 - DNA, 22 bp, Homo sapiens
gatttctacaactgatcatttg

SEQ ID NO: 6257775 - DNA, 17 bp, Homo sapiens
gatttctacattaactt

SEQ ID NO: 6257776 - DNA, 13 bp, Homo sapiens
gatttctacctca

SEQ ID NO: 6257777 - DNA, 14 bp, Homo sapiens
gatttctacctcag

SEQ ID NO: 6257778 - DNA, 21 bp, Homo sapiens
gatttctagtgtatactctgt

SEQ ID NO: 6257779 - DNA, 15 bp, Homo sapiens
gatttctatgaactt

SEQ ID NO: 6257780 - DNA, 18 bp, Homo sapiens
gatttctatggctttcaa

SEQ ID NO: 6257781 - DNA, 20 bp, Homo sapiens
gatttctatggctttcaaag

SEQ ID NO: 6257782 - DNA, 22 bp, Homo sapiens
gatttctcaccctctgtccttc

SEQ ID NO: 6257783 - DNA, 21 bp, Homo sapiens
gccttggtgtccacctggccc

SEQ ID NO: 6257784 - DNA, 19 bp, Homo sapiens
gccttggttcatcagtgtt

SEQ ID NO: 6257785 - DNA, 21 bp, Homo sapiens
gccttggttctggccacccca

SEQ ID NO: 6257786 - DNA, 22 bp, Homo sapiens
gccttggttggacctattgcca

SEQ ID NO: 6257787 - DNA, 16 bp, Homo sapiens
gccttggtttcctgag

SEQ ID NO: 6257788 - DNA, 17 bp, Homo sapiens
gccttggtttttactgc

SEQ ID NO: 6257789 - DNA, 23 bp, Homo sapiens
gccttggtttttactgctctgag

SEQ ID NO: 6257790 - DNA, 17 bp, Homo sapiens
gccttgtaattctaaat

SEQ ID NO: 6257791 - DNA, 12 bp, Homo sapiens
gccttgtacttt

SEQ ID NO: 6257792 - DNA, 14 bp, Homo sapiens
gccttgtcagtgtg

SEQ ID NO: 6257793 - DNA, 18 bp, Homo sapiens
gccttgtcagtgtgtcag

SEQ ID NO: 6257794 - DNA, 18 bp, Homo sapiens
gccttgtcccctgcctgt

SEQ ID NO: 6257795 - DNA, 22 bp, Homo sapiens
gccttgtccctctcactcccca

SEQ ID NO: 6257796 - DNA, 19 bp, Homo sapiens
gccttgtctcctactcctg

SEQ ID NO: 6257797 - DNA, 20 bp, Homo sapiens
gccttgtctcctactcctga

SEQ ID NO: 6257798 - DNA, 18 bp, Homo sapiens
gccttgtgacattcactc

SEQ ID NO: 6257799 - DNA, 19 bp, Homo sapiens
gccttgtgacattcactca

SEQ ID NO: 6257800 - DNA, 20 bp, Homo sapiens
gccttgtgagatccttcaca

SEQ ID NO: 6257801 - DNA, 21 bp, Homo sapiens
gccttgtgatgtcatacagag

SEQ ID NO: 6257802 - DNA, 12 bp, Homo sapiens
gccttgtgccct

SEQ ID NO: 6257803 - DNA, 16 bp, Homo sapiens
gccttgtgccctgccc

SEQ ID NO: 6257804 - DNA, 19 bp, Homo sapiens
gccttgtgccctgccccca

SEQ ID NO: 6257805 - DNA, 14 bp, Homo sapiens
gccttgtggtccaa

SEQ ID NO: 6257806 - DNA, 22 bp, Homo sapiens
gccttgtgtcagagctgggagt

SEQ ID NO: 6257807 - DNA, 15 bp, Homo sapiens
gccttgtgtctacag

SEQ ID NO: 6257808 - DNA, 20 bp, Homo sapiens
gccttgtgtggcttggagga

SEQ ID NO: 6257809 - DNA, 23 bp, Homo sapiens
gccttgtgtggcttggaggaaat

SEQ ID NO: 6257810 - DNA, 18 bp, Homo sapiens
gccttgtgtgtcaggccc

SEQ ID NO: 6257811 - DNA, 14 bp, Homo sapiens
gccttgttcctgct

SEQ ID NO: 6257812 - DNA, 18 bp, Homo sapiens
gccttgttgtattcctgc

SEQ ID NO: 6257813 - DNA, 18 bp, Homo sapiens
gccttgtttaatgttaat

SEQ ID NO: 6257814 - DNA, 14 bp, Homo sapiens
gcctttaaaaccag

SEQ ID NO: 6257815 - DNA, 15 bp, Homo sapiens
gcctttaaaaccagt

SEQ ID NO: 6257816 - DNA, 18 bp, Homo sapiens
gcctttaaaggtttttaa

SEQ ID NO: 6257817 - DNA, 14 bp, Homo sapiens
gcctttaacagaaa

SEQ ID NO: 6257818 - DNA, 14 bp, Homo sapiens
gcctttaagaacct

SEQ ID NO: 6257819 - DNA, 18 bp, Homo sapiens
gcctttaaggagaagaga

SEQ ID NO: 6257820 - DNA, 21 bp, Homo sapiens
gcctttactgaccctggggct

SEQ ID NO: 6257821 - DNA, 23 bp, Homo sapiens
gcctttactgaccctggggctgg

SEQ ID NO: 6257822 - DNA, 14 bp, Homo sapiens
gcctttagaaaata

SEQ ID NO: 6257823 - DNA, 20 bp, Homo sapiens
gcctttagcctggaccaaag

SEQ ID NO: 6257824 - DNA, 19 bp, Homo sapiens
gcctttaggggtgtgtatt

SEQ ID NO: 6257825 - DNA, 19 bp, Homo sapiens
gcctttagtgatcacagca

SEQ ID NO: 6257826 - DNA, 15 bp, Homo sapiens
gcctttatacaattg

SEQ ID NO: 6257827 - DNA, 16 bp, Homo sapiens
gcctttatatttcaca

SEQ ID NO: 6257828 - DNA, 20 bp, Homo sapiens
gcctttatcaagcttagtga

SEQ ID NO: 6257829 - DNA, 16 bp, Homo sapiens
gcctttatctcagcca

SEQ ID NO: 6257830 - DNA, 17 bp, Homo sapiens
gcctttatcttgaagtc

SEQ ID NO: 6257831 - DNA, 14 bp, Homo sapiens
gcctttatggtttc

SEQ ID NO: 6257832 - DNA, 17 bp, Homo sapiens
gcctttatgttctttca

SEQ ID NO: 6257833 - DNA, 21 bp, Homo sapiens
gcctttattaaaaactgagtg

SEQ ID NO: 6257834 - DNA, 13 bp, Homo sapiens
gcctttattgtgt

SEQ ID NO: 6257835 - DNA, 22 bp, Homo sapiens
gcctttattgtgtttgtcatta

SEQ ID NO: 6257836 - DNA, 14 bp, Homo sapiens
gcctttatttgtta

SEQ ID NO: 6257837 - DNA, 23 bp, Homo sapiens
gcctttatttttggcgtggctga

SEQ ID NO: 6257838 - DNA, 15 bp, Homo sapiens
gcctttcaaatttag

SEQ ID NO: 6257839 - DNA, 19 bp, Homo sapiens
gcctttcacagcttcttta

SEQ ID NO: 6257840 - DNA, 20 bp, Homo sapiens
gcctttcacaggactctgca

SEQ ID NO: 6257841 - DNA, 22 bp, Homo sapiens
gcctttcacaggactctgcaga

SEQ ID NO: 6257842 - DNA, 19 bp, Homo sapiens
gcctttcagaagtgattta

SEQ ID NO: 6257843 - DNA, 17 bp, Homo sapiens
gcctttcaggatctatt

SEQ ID NO: 6257844 - DNA, 23 bp, Homo sapiens
gcctttcagtgtagcgggaggaa

SEQ ID NO: 6257845 - DNA, 19 bp, Homo sapiens
gcctttcatggcaatgaaa

SEQ ID NO: 6257846 - DNA, 23 bp, Homo sapiens
gcctttcatggcaatgaaaattt

SEQ ID NO: 6257847 - DNA, 24 bp, Homo sapiens
gcctttccagagaactgcagacct

SEQ ID NO: 6257848 - DNA, 12 bp, Homo sapiens
gcctttccaggg

SEQ ID NO: 6257849 - DNA, 21 bp, Homo sapiens
gcctttccataaggaatgtag

SEQ ID NO: 6257850 - DNA, 15 bp, Homo sapiens
gcctttccatccatg

SEQ ID NO: 6257851 - DNA, 18 bp, Homo sapiens
gcctttcccaactctagc

SEQ ID NO: 6257852 - DNA, 14 bp, Homo sapiens
gcctttcccaccct

SEQ ID NO: 6257853 - DNA, 22 bp, Homo sapiens
gcctttcccattggtctgcatg

SEQ ID NO: 6257854 - DNA, 21 bp, Homo sapiens
gcctttccctcctaaagctga

SEQ ID NO: 6257855 - DNA, 23 bp, Homo sapiens
gcctttccgcggagcccttggcc

SEQ ID NO: 6257856 - DNA, 14 bp, Homo sapiens
gcctttcctcaaaa

SEQ ID NO: 6257857 - DNA, 22 bp, Homo sapiens
gcctttcctcggtctcccttcc

SEQ ID NO: 6257858 - DNA, 18 bp, Homo sapiens
gcctttcctctctcctgt

SEQ ID NO: 6257859 - DNA, 15 bp, Homo sapiens
gcctttcctgttcag

SEQ ID NO: 6257860 - DNA, 18 bp, Homo sapiens
gcctttcctgttcagcat

SEQ ID NO: 6257861 - DNA, 14 bp, Homo sapiens
gcctttccttccct

SEQ ID NO: 6257862 - DNA, 15 bp, Homo sapiens
gcctttcgaggcctg

SEQ ID NO: 6257863 - DNA, 14 bp, Homo sapiens
gcctttcgtgatct

SEQ ID NO: 6257864 - DNA, 19 bp, Homo sapiens
gcctttctcaactgtccca

SEQ ID NO: 6257865 - DNA, 18 bp, Homo sapiens
gcctttctcccaggccag

SEQ ID NO: 6257866 - DNA, 14 bp, Homo sapiens
gcctttctcctccc

SEQ ID NO: 6257867 - DNA, 19 bp, Homo sapiens
gcctttctcctccccacct

SEQ ID NO: 6257868 - DNA, 13 bp, Homo sapiens
gcctttctgcctt

SEQ ID NO: 6257869 - DNA, 12 bp, Homo sapiens
gcctttctgtat

SEQ ID NO: 6257870 - DNA, 12 bp, Homo sapiens
gcctttcttctg

SEQ ID NO: 6257871 - DNA, 15 bp, Homo sapiens
gcctttcttctgccc

SEQ ID NO: 6257872 - DNA, 12 bp, Homo sapiens
gcctttctttgc

SEQ ID NO: 6257873 - DNA, 14 bp, Homo sapiens
gcctttctttgcct

SEQ ID NO: 6257874 - DNA, 21 bp, Homo sapiens
gcctttgaaattcccccactt

SEQ ID NO: 6257875 - DNA, 11 bp, Homo sapiens
gcctttgaagt

SEQ ID NO: 6257876 - DNA, 12 bp, Homo sapiens
gcctttgaagtg

SEQ ID NO: 6257877 - DNA, 15 bp, Homo sapiens
gcctttgacatttaa

SEQ ID NO: 6257878 - DNA, 16 bp, Homo sapiens
gcctttgacctgcctc

SEQ ID NO: 6257879 - DNA, 14 bp, Homo sapiens
gcctttgagacagt

SEQ ID NO: 6257880 - DNA, 23 bp, Homo sapiens
gcctttgagcccacaaagcctta

SEQ ID NO: 6257881 - DNA, 14 bp, Homo sapiens
gcctttgagctcag

SEQ ID NO: 6257882 - DNA, 12 bp, Homo sapiens
gcctttgaggtt

SEQ ID NO: 6257883 - DNA, 22 bp, Homo sapiens
gcctttgagtttcctcaggctg

SEQ ID NO: 6257884 - DNA, 15 bp, Homo sapiens
gcctttgcaaatcag

SEQ ID NO: 6257885 - DNA, 19 bp, Homo sapiens
gcctttgcaagatgcttgg

SEQ ID NO: 6257886 - DNA, 17 bp, Homo sapiens
gcctttgccagcagagc

SEQ ID NO: 6257887 - DNA, 18 bp, Homo sapiens
gcctttgccagcagagcc

SEQ ID NO: 6257888 - DNA, 19 bp, Homo sapiens
gcctttgccagcagagcca

SEQ ID NO: 6257889 - DNA, 20 bp, Homo sapiens
gcctttgccagcagagccag

SEQ ID NO: 6257890 - DNA, 21 bp, Homo sapiens
gcctttgccagcagagccagg

SEQ ID NO: 6257891 - DNA, 14 bp, Homo sapiens
gcctttgccaggtg

SEQ ID NO: 6257892 - DNA, 15 bp, Homo sapiens
gcctttgccaggtga

SEQ ID NO: 6257893 - DNA, 16 bp, Homo sapiens
gcctttgccaggtgac

SEQ ID NO: 6257894 - DNA, 18 bp, Homo sapiens
gcctttgccgtgagcatg

SEQ ID NO: 6257895 - DNA, 20 bp, Homo sapiens
gcctttgccgtgagcatgca

SEQ ID NO: 6257896 - DNA, 15 bp, Homo sapiens
gcctttgcctccccg

SEQ ID NO: 6257897 - DNA, 14 bp, Homo sapiens
gcctttgcctttag

SEQ ID NO: 6257898 - DNA, 23 bp, Homo sapiens
gcctttgcgctcctggcccagcc

SEQ ID NO: 6257899 - DNA, 16 bp, Homo sapiens
gcctttgctcttataa

SEQ ID NO: 6257900 - DNA, 16 bp, Homo sapiens
gcctttgctgcccttg

SEQ ID NO: 6257901 - DNA, 14 bp, Homo sapiens
gcctttgctgcctt

SEQ ID NO: 6257902 - DNA, 19 bp, Homo sapiens
gcctttggaagggtctctc

SEQ ID NO: 6257903 - DNA, 19 bp, Homo sapiens
gcctttggacccagggcct

SEQ ID NO: 6257904 - DNA, 21 bp, Homo sapiens
gcctttggacccagggcctga

SEQ ID NO: 6257905 - DNA, 15 bp, Homo sapiens
gcctttggaggggaa

SEQ ID NO: 6257906 - DNA, 20 bp, Homo sapiens
gcctttggatgaccagaaca

SEQ ID NO: 6257907 - DNA, 16 bp, Homo sapiens
gcctttggcagagttc

SEQ ID NO: 6257908 - DNA, 12 bp, Homo sapiens
gcctttggcctg

SEQ ID NO: 6257909 - DNA, 22 bp, Homo sapiens
gcctttggcctggggtgcatct

SEQ ID NO: 6257910 - DNA, 15 bp, Homo sapiens
gcctttggctctgga

SEQ ID NO: 6257911 - DNA, 13 bp, Homo sapiens
gcctttggcttca

SEQ ID NO: 6257912 - DNA, 10 bp, Homo sapiens
gcctttggga

SEQ ID NO: 6257913 - DNA, 15 bp, Homo sapiens
gcctttgggagcagg

SEQ ID NO: 6257914 - DNA, 19 bp, Homo sapiens
gcctttgggaggcagcatc

SEQ ID NO: 6257915 - DNA, 17 bp, Homo sapiens
gcctttgggtgctgttt

SEQ ID NO: 6257916 - DNA, 11 bp, Homo sapiens
gcctttgtaac

SEQ ID NO: 6257917 - DNA, 16 bp, Homo sapiens
gcctttgtaagacaca

SEQ ID NO: 6257918 - DNA, 14 bp, Homo sapiens
gcctttgtccccac

SEQ ID NO: 6257919 - DNA, 15 bp, Homo sapiens
gcctttgtccccaca

SEQ ID NO: 6257920 - DNA, 15 bp, Homo sapiens
gcctttgtcttgtac

SEQ ID NO: 6257921 - DNA, 18 bp, Homo sapiens
gcctttgtcttgtacttc

SEQ ID NO: 6257922 - DNA, 19 bp, Homo sapiens
gcctttgtcttgtacttct

SEQ ID NO: 6257923 - DNA, 16 bp, Homo sapiens
gcctttgtgatcctga

SEQ ID NO: 6257924 - DNA, 20 bp, Homo sapiens
gcctttgtgctttttgtcat

SEQ ID NO: 6257925 - DNA, 22 bp, Homo sapiens
gcctttgtgctttttgtcatgt

SEQ ID NO: 6257926 - DNA, 20 bp, Homo sapiens
gcctttgtggtgggcgctgg

SEQ ID NO: 6257927 - DNA, 21 bp, Homo sapiens
gcctttgttccccactggagc

SEQ ID NO: 6257928 - DNA, 22 bp, Homo sapiens
gcctttgttccccactggagca

SEQ ID NO: 6257929 - DNA, 23 bp, Homo sapiens
gcctttgttccccactggagcag

SEQ ID NO: 6257930 - DNA, 14 bp, Homo sapiens
gcctttgttctggg

SEQ ID NO: 6257931 - DNA, 14 bp, Homo sapiens
gccttttaagtttg

SEQ ID NO: 6257932 - DNA, 23 bp, Homo sapiens
gccttttaattttgtatgaggtc

SEQ ID NO: 6257933 - DNA, 15 bp, Homo sapiens
gccttttacctggat

SEQ ID NO: 6257934 - DNA, 22 bp, Homo sapiens
gccttttacctggatataaatt

SEQ ID NO: 6257935 - DNA, 16 bp, Homo sapiens
gccttttagttcctgt

SEQ ID NO: 6257936 - DNA, 17 bp, Homo sapiens
gccttttagttcctgtg

SEQ ID NO: 6257937 - DNA, 18 bp, Homo sapiens
gccttttataaacctcta

SEQ ID NO: 6257938 - DNA, 16 bp, Homo sapiens
gccttttatctgcaga

SEQ ID NO: 6257939 - DNA, 14 bp, Homo sapiens
gccttttatgtaaa

SEQ ID NO: 6257940 - DNA, 15 bp, Homo sapiens
gccttttatgtaaat

SEQ ID NO: 6257941 - DNA, 16 bp, Homo sapiens
gccttttatgtaaatt

SEQ ID NO: 6257942 - DNA, 15 bp, Homo sapiens
gccttttcagccctt

SEQ ID NO: 6257943 - DNA, 13 bp, Homo sapiens
gccttttccctct

SEQ ID NO: 6257944 - DNA, 11 bp, Homo sapiens
gccttttctgg

SEQ ID NO: 6257945 - DNA, 14 bp, Homo sapiens
gccttttctggagt

SEQ ID NO: 6257946 - DNA, 15 bp, Homo sapiens
gccttttctgtgatt

SEQ ID NO: 6257947 - DNA, 21 bp, Homo sapiens
gccttttcttcccctcctgta

SEQ ID NO: 6257948 - DNA, 23 bp, Homo sapiens
gccttttcttcccctcctgtaag

SEQ ID NO: 6257949 - DNA, 14 bp, Homo sapiens
gccttttgaataca

SEQ ID NO: 6257950 - DNA, 22 bp, Homo sapiens
gccttttgaatacatttgtatt

SEQ ID NO: 6257951 - DNA, 12 bp, Homo sapiens
gccttttgcaaa

SEQ ID NO: 6257952 - DNA, 16 bp, Homo sapiens
gccttttgcacccctc

SEQ ID NO: 6257953 - DNA, 18 bp, Homo sapiens
gccttttgcacccctccc

SEQ ID NO: 6257954 - DNA, 20 bp, Homo sapiens
gccttttgcacccctcccat

SEQ ID NO: 6257955 - DNA, 16 bp, Homo sapiens
gccttttgctgctgct

SEQ ID NO: 6257956 - DNA, 14 bp, Homo sapiens
gccttttggatatg

SEQ ID NO: 6257957 - DNA, 23 bp, Homo sapiens
gccttttggtttcaccttccctc

SEQ ID NO: 6257958 - DNA, 12 bp, Homo sapiens
gccttttgtata

SEQ ID NO: 6257959 - DNA, 13 bp, Homo sapiens
gccttttgttaat

SEQ ID NO: 6257960 - DNA, 19 bp, Homo sapiens
gccttttgttaatgcattg

SEQ ID NO: 6257961 - DNA, 22 bp, Homo sapiens
gcctttttaaaacacatgtttt

SEQ ID NO: 6257962 - DNA, 23 bp, Homo sapiens
gatttctcattgatcacagatgt

SEQ ID NO: 6257963 - DNA, 18 bp, Homo sapiens
gatttctccagaaattta

SEQ ID NO: 6257964 - DNA, 20 bp, Homo sapiens
gatttctcccagctctagac

SEQ ID NO: 6257965 - DNA, 13 bp, Homo sapiens
gatttctcctgac

SEQ ID NO: 6257966 - DNA, 15 bp, Homo sapiens
gatttctctgaacag

SEQ ID NO: 6257967 - DNA, 21 bp, Homo sapiens
gatttctcttgggcaggcaga

SEQ ID NO: 6257968 - DNA, 18 bp, Homo sapiens
gatttctctttctctctc

SEQ ID NO: 6257969 - DNA, 13 bp, Homo sapiens
gatttctctttga

SEQ ID NO: 6257970 - DNA, 10 bp, Homo sapiens
gatttctgag

SEQ ID NO: 6257971 - DNA, 20 bp, Homo sapiens
gatttctgtctactaagtga

SEQ ID NO: 6257972 - DNA, 14 bp, Homo sapiens
gatttcttaaattt

SEQ ID NO: 6257973 - DNA, 11 bp, Homo sapiens
gatttcttagg

SEQ ID NO: 6257974 - DNA, 20 bp, Homo sapiens
gatttcttattgaatttgtt

SEQ ID NO: 6257975 - DNA, 17 bp, Homo sapiens
gatttcttcaaatctca

SEQ ID NO: 6257976 - DNA, 20 bp, Homo sapiens
gatttcttcaaatctcagca

SEQ ID NO: 6257977 - DNA, 14 bp, Homo sapiens
gatttcttctccct

SEQ ID NO: 6257978 - DNA, 20 bp, Homo sapiens
gatttctttaaaagaatgac

SEQ ID NO: 6257979 - DNA, 17 bp, Homo sapiens
gatttctttccagaggg

SEQ ID NO: 6257980 - DNA, 14 bp, Homo sapiens
gatttctttgaaaa

SEQ ID NO: 6257981 - DNA, 14 bp, Homo sapiens
gatttcttttaaag

SEQ ID NO: 6257982 - DNA, 18 bp, Homo sapiens
gatttcttttaaagaagt

SEQ ID NO: 6257983 - DNA, 19 bp, Homo sapiens
gatttcttttcttcctggc

SEQ ID NO: 6257984 - DNA, 23 bp, Homo sapiens
gatttcttttgtaataaactatt

SEQ ID NO: 6257985 - DNA, 18 bp, Homo sapiens
gatttgaaaaaaagcatg

SEQ ID NO: 6257986 - DNA, 13 bp, Homo sapiens
gatttgaaaaact

SEQ ID NO: 6257987 - DNA, 18 bp, Homo sapiens
gatttgaaaaacttttag

SEQ ID NO: 6257988 - DNA, 19 bp, Homo sapiens
gatttgaaaagaatttgtt

SEQ ID NO: 6257989 - DNA, 13 bp, Homo sapiens
gatttgaaaattg

SEQ ID NO: 6257990 - DNA, 16 bp, Homo sapiens
gatttgaaaattgtat

SEQ ID NO: 6257991 - DNA, 13 bp, Homo sapiens
gatttgaactcag

SEQ ID NO: 6257992 - DNA, 16 bp, Homo sapiens
gatttgaactgagccg

SEQ ID NO: 6257993 - DNA, 14 bp, Homo sapiens
gatttgaattctgt

SEQ ID NO: 6257994 - DNA, 13 bp, Homo sapiens
gatttgacccact

SEQ ID NO: 6257995 - DNA, 12 bp, Homo sapiens
gatttgacctcc

SEQ ID NO: 6257996 - DNA, 20 bp, Homo sapiens
gatttgacctcctccctgtt

SEQ ID NO: 6257997 - DNA, 23 bp, Homo sapiens
gatttgaggagcagcttcagttg

SEQ ID NO: 6257998 - DNA, 16 bp, Homo sapiens
gatttgatatttgcat

SEQ ID NO: 6257999 - DNA, 15 bp, Homo sapiens
gatttgatctttgtt

SEQ ID NO: 6258000 - DNA, 18 bp, Homo sapiens
gatttgatgctgtttgac

SEQ ID NO: 6258001 - DNA, 17 bp, Homo sapiens
gatttgatgcttttctc

SEQ ID NO: 6258002 - DNA, 22 bp, Homo sapiens
gatttgatgtgactttttttgg

SEQ ID NO: 6258003 - DNA, 18 bp, Homo sapiens
gatttgattcattttcct

SEQ ID NO: 6258004 - DNA, 20 bp, Homo sapiens
gatttgattcattttcctgt

SEQ ID NO: 6258005 - DNA, 14 bp, Homo sapiens
gatttgcaaaaaaa

SEQ ID NO: 6258006 - DNA, 17 bp, Homo sapiens
gatttgcaaatgcacat

SEQ ID NO: 6258007 - DNA, 13 bp, Homo sapiens
gatttgcaacttt

SEQ ID NO: 6258008 - DNA, 11 bp, Homo sapiens
gatttgcacct

SEQ ID NO: 6258009 - DNA, 22 bp, Homo sapiens
gatttgcacgttggggagctgg

SEQ ID NO: 6258010 - DNA, 22 bp, Homo sapiens
gatttgcaggattcccttctgg

SEQ ID NO: 6258011 - DNA, 15 bp, Homo sapiens
gatttgcattgaaca

SEQ ID NO: 6258012 - DNA, 17 bp, Homo sapiens
gatttgcattgaacaca

SEQ ID NO: 6258013 - DNA, 21 bp, Homo sapiens
gatttgcattgaacacaaact

SEQ ID NO: 6258014 - DNA, 12 bp, Homo sapiens
gatttgccagca

SEQ ID NO: 6258015 - DNA, 14 bp, Homo sapiens
gatttgccagcaca

SEQ ID NO: 6258016 - DNA, 15 bp, Homo sapiens
gatttgccagcacag

SEQ ID NO: 6258017 - DNA, 19 bp, Homo sapiens
gatttgcccatttacactt

SEQ ID NO: 6258018 - DNA, 15 bp, Homo sapiens
gatttgcctcacctt

SEQ ID NO: 6258019 - DNA, 17 bp, Homo sapiens
gatttgcctgcctgggc

SEQ ID NO: 6258020 - DNA, 20 bp, Homo sapiens
gatttgcgtggaaatctcag

SEQ ID NO: 6258021 - DNA, 15 bp, Homo sapiens
gatttggaaaattca

SEQ ID NO: 6258022 - DNA, 17 bp, Homo sapiens
gatttggaaaattcaca

SEQ ID NO: 6258023 - DNA, 13 bp, Homo sapiens
gatttggaagaga

SEQ ID NO: 6258024 - DNA, 21 bp, Homo sapiens
gatttggaagagaggcacctg

SEQ ID NO: 6258025 - DNA, 19 bp, Homo sapiens
gatttggagaccgaagact

SEQ ID NO: 6258026 - DNA, 18 bp, Homo sapiens
gatttggatcaaaaggag

SEQ ID NO: 6258027 - DNA, 11 bp, Homo sapiens
gatttggctcg

SEQ ID NO: 6258028 - DNA, 20 bp, Homo sapiens
gatttggggcctcaagaaat

SEQ ID NO: 6258029 - DNA, 16 bp, Homo sapiens
gatttgggggaggctt

SEQ ID NO: 6258030 - DNA, 21 bp, Homo sapiens
gatttgggggctcggggaggc

SEQ ID NO: 6258031 - DNA, 23 bp, Homo sapiens
gatttgggtggaaaacagggtgc

SEQ ID NO: 6258032 - DNA, 22 bp, Homo sapiens
gatttggtcctgcctaaatttc

SEQ ID NO: 6258033 - DNA, 15 bp, Homo sapiens
gatttggtgaacaac

SEQ ID NO: 6258034 - DNA, 17 bp, Homo sapiens
gatttggtgaatttgaa

SEQ ID NO: 6258035 - DNA, 20 bp, Homo sapiens
gatttggtgatggaaaaagc

SEQ ID NO: 6258036 - DNA, 19 bp, Homo sapiens
gatttggtgtacaattcag

SEQ ID NO: 6258037 - DNA, 23 bp, Homo sapiens
gatttggtgtaggtaggtctgtt

SEQ ID NO: 6258038 - DNA, 17 bp, Homo sapiens
gatttggtttttctctt

SEQ ID NO: 6258039 - DNA, 17 bp, Homo sapiens
gatttgtaacattagtt

SEQ ID NO: 6258040 - DNA, 23 bp, Homo sapiens
gatttgtaccattccttcaaata

SEQ ID NO: 6258041 - DNA, 14 bp, Homo sapiens
gatttgtactgaaa

SEQ ID NO: 6258042 - DNA, 11 bp, Homo sapiens
gatttgtagca

SEQ ID NO: 6258043 - DNA, 17 bp, Homo sapiens
gatttgtatgttaaagt

SEQ ID NO: 6258044 - DNA, 17 bp, Homo sapiens
gatttgtatttatatta

SEQ ID NO: 6258045 - DNA, 19 bp, Homo sapiens
gatttgtccaaacaggtgc

SEQ ID NO: 6258046 - DNA, 14 bp, Homo sapiens
gatttgtctacttg

SEQ ID NO: 6258047 - DNA, 20 bp, Homo sapiens
gatttgtcttatccccccca

SEQ ID NO: 6258048 - DNA, 22 bp, Homo sapiens
gatttgtcttcccttctttgca

SEQ ID NO: 6258049 - DNA, 23 bp, Homo sapiens
gatttgtgaaacagttgctgtga

SEQ ID NO: 6258050 - DNA, 20 bp, Homo sapiens
gatttgtgaactcagccaag

SEQ ID NO: 6258051 - DNA, 14 bp, Homo sapiens
gatttgtgaactgg

SEQ ID NO: 6258052 - DNA, 18 bp, Homo sapiens
gatttgtgcccattccta

SEQ ID NO: 6258053 - DNA, 18 bp, Homo sapiens
gatttgtgtttttctttt

SEQ ID NO: 6258054 - DNA, 17 bp, Homo sapiens
gatttgttcatgaatat

SEQ ID NO: 6258055 - DNA, 20 bp, Homo sapiens
gatttgttcctgccccaccc

SEQ ID NO: 6258056 - DNA, 23 bp, Homo sapiens
gatttgttcctgccccaccctaa

SEQ ID NO: 6258057 - DNA, 16 bp, Homo sapiens
gatttgttttgaattt

SEQ ID NO: 6258058 - DNA, 18 bp, Homo sapiens
gatttgttttgaattttg

SEQ ID NO: 6258059 - DNA, 22 bp, Homo sapiens
gatttgtttttaaactgtacag

SEQ ID NO: 6258060 - DNA, 14 bp, Homo sapiens
gatttgtttttgta

SEQ ID NO: 6258061 - DNA, 15 bp, Homo sapiens
gattttaaaaaatca

SEQ ID NO: 6258062 - DNA, 16 bp, Homo sapiens
gattttaaaaaatcaa

SEQ ID NO: 6258063 - DNA, 20 bp, Homo sapiens
gattttaaaaaatcaatcaa

SEQ ID NO: 6258064 - DNA, 23 bp, Homo sapiens
gattttaaaaagggtaacttgtt

SEQ ID NO: 6258065 - DNA, 22 bp, Homo sapiens
gattttaaaaggttgactcaag

SEQ ID NO: 6258066 - DNA, 19 bp, Homo sapiens
gattttaaaagttttgttc

SEQ ID NO: 6258067 - DNA, 13 bp, Homo sapiens
gattttaaaatga

SEQ ID NO: 6258068 - DNA, 16 bp, Homo sapiens
gattttaaaatgaata

SEQ ID NO: 6258069 - DNA, 22 bp, Homo sapiens
gattttaaaatgtacatgtatt

SEQ ID NO: 6258070 - DNA, 17 bp, Homo sapiens
gattttaaactagatga

SEQ ID NO: 6258071 - DNA, 21 bp, Homo sapiens
gattttaaactagatgacctc

SEQ ID NO: 6258072 - DNA, 22 bp, Homo sapiens
gattttaaactagatgacctca

SEQ ID NO: 6258073 - DNA, 22 bp, Homo sapiens
gattttaaagagtgaaaaatga

SEQ ID NO: 6258074 - DNA, 12 bp, Homo sapiens
gattttaaatgt

SEQ ID NO: 6258075 - DNA, 15 bp, Homo sapiens
gattttaaatgtgtg

SEQ ID NO: 6258076 - DNA, 23 bp, Homo sapiens
gattttaaattacacagttcaca

SEQ ID NO: 6258077 - DNA, 15 bp, Homo sapiens
gattttaaatttttt

SEQ ID NO: 6258078 - DNA, 20 bp, Homo sapiens
gattttaacaaaagcaagac

SEQ ID NO: 6258079 - DNA, 14 bp, Homo sapiens
gattttaactctgt

SEQ ID NO: 6258080 - DNA, 16 bp, Homo sapiens
gattttaactctgtct

SEQ ID NO: 6258081 - DNA, 23 bp, Homo sapiens
gattttaatagggaatatatctc

SEQ ID NO: 6258082 - DNA, 23 bp, Homo sapiens
gattttaatggattgttaatttc

SEQ ID NO: 6258083 - DNA, 16 bp, Homo sapiens
gattttaattcaggtg

SEQ ID NO: 6258084 - DNA, 14 bp, Homo sapiens
gattttaattgtca

SEQ ID NO: 6258085 - DNA, 18 bp, Homo sapiens
gattttaatttcaggaaa

SEQ ID NO: 6258086 - DNA, 15 bp, Homo sapiens
gattttaattttgaa

SEQ ID NO: 6258087 - DNA, 17 bp, Homo sapiens
gattttacaaaagatgt

SEQ ID NO: 6258088 - DNA, 15 bp, Homo sapiens
gattttaccaaagca

SEQ ID NO: 6258089 - DNA, 21 bp, Homo sapiens
gattttacctgggatatgaca

SEQ ID NO: 6258090 - DNA, 16 bp, Homo sapiens
gattttagaaaaacat

SEQ ID NO: 6258091 - DNA, 14 bp, Homo sapiens
gattttagcctctt

SEQ ID NO: 6258092 - DNA, 14 bp, Homo sapiens
gattttagttcact

SEQ ID NO: 6258093 - DNA, 15 bp, Homo sapiens
gattttatacatagt

SEQ ID NO: 6258094 - DNA, 15 bp, Homo sapiens
gattttatctgtgga

SEQ ID NO: 6258095 - DNA, 22 bp, Homo sapiens
gattttatctttcgcacagcag

SEQ ID NO: 6258096 - DNA, 13 bp, Homo sapiens
gattttatgcaca

SEQ ID NO: 6258097 - DNA, 13 bp, Homo sapiens
gattttatgttta

SEQ ID NO: 6258098 - DNA, 23 bp, Homo sapiens
gattttatgtttaaaatggcatt

SEQ ID NO: 6258099 - DNA, 14 bp, Homo sapiens
gattttattaatca

SEQ ID NO: 6258100 - DNA, 19 bp, Homo sapiens
gattttattacagaaatgt

SEQ ID NO: 6258101 - DNA, 13 bp, Homo sapiens
gattttattatgt

SEQ ID NO: 6258102 - DNA, 19 bp, Homo sapiens
gattttattatgtaaatcc

SEQ ID NO: 6258103 - DNA, 23 bp, Homo sapiens
gattttattatgtaaatcccatt

SEQ ID NO: 6258104 - DNA, 20 bp, Homo sapiens
gattttattcaatatggtta

SEQ ID NO: 6258105 - DNA, 15 bp, Homo sapiens
gattttattttcaag

SEQ ID NO: 6258106 - DNA, 17 bp, Homo sapiens
gattttatttttgcaaa

SEQ ID NO: 6258107 - DNA, 18 bp, Homo sapiens
gattttcaaagctttttc

SEQ ID NO: 6258108 - DNA, 22 bp, Homo sapiens
gattttcaaatatgtaaacttt

SEQ ID NO: 6258109 - DNA, 18 bp, Homo sapiens
gattttcaagattctaaa

SEQ ID NO: 6258110 - DNA, 21 bp, Homo sapiens
gattttcaagattctaaagct

SEQ ID NO: 6258111 - DNA, 20 bp, Homo sapiens
gattttcaagttattcagaa

SEQ ID NO: 6258112 - DNA, 21 bp, Homo sapiens
gattttcacagctttgaggaa

SEQ ID NO: 6258113 - DNA, 19 bp, Homo sapiens
gattttcacattcttggct

SEQ ID NO: 6258114 - DNA, 11 bp, Homo sapiens
gattttcagcc

SEQ ID NO: 6258115 - DNA, 12 bp, Homo sapiens
gattttcagtta

SEQ ID NO: 6258116 - DNA, 16 bp, Homo sapiens
gattttcatctattat

SEQ ID NO: 6258117 - DNA, 15 bp, Homo sapiens
gattttcatgttctt

SEQ ID NO: 6258118 - DNA, 16 bp, Homo sapiens
gattttcattgaggat

SEQ ID NO: 6258119 - DNA, 16 bp, Homo sapiens
gattttcatttcatga

SEQ ID NO: 6258120 - DNA, 13 bp, Homo sapiens
gattttcatttta

SEQ ID NO: 6258121 - DNA, 13 bp, Homo sapiens
gattttccaaatg

SEQ ID NO: 6258122 - DNA, 22 bp, Homo sapiens
gattttccaggactgtttcaaa

SEQ ID NO: 6258123 - DNA, 21 bp, Homo sapiens
gattttccatctaaaaatata

SEQ ID NO: 6258124 - DNA, 15 bp, Homo sapiens
gattttcctgaaaac

SEQ ID NO: 6258125 - DNA, 21 bp, Homo sapiens
gattttcctgaagctgcttaa

SEQ ID NO: 6258126 - DNA, 18 bp, Homo sapiens
gattttcctgtgtccaca

SEQ ID NO: 6258127 - DNA, 16 bp, Homo sapiens
gattttcgacgtttga

SEQ ID NO: 6258128 - DNA, 23 bp, Homo sapiens
gattttctacaagtattctgcct

SEQ ID NO: 6258129 - DNA, 17 bp, Homo sapiens
gattttctagtttcctg

SEQ ID NO: 6258130 - DNA, 12 bp, Homo sapiens
gattttctattg

SEQ ID NO: 6258131 - DNA, 17 bp, Homo sapiens
gattttctattgttact

SEQ ID NO: 6258132 - DNA, 19 bp, Homo sapiens
gattttctccatttgtcat

SEQ ID NO: 6258133 - DNA, 21 bp, Homo sapiens
gattttctgggcctaaaggat

SEQ ID NO: 6258134 - DNA, 13 bp, Homo sapiens
gattttctttcta

SEQ ID NO: 6258135 - DNA, 17 bp, Homo sapiens
gattttcttttgccttt

SEQ ID NO: 6258136 - DNA, 12 bp, Homo sapiens
gattttgaaaaa

SEQ ID NO: 6258137 - DNA, 23 bp, Homo sapiens
gattttgaacctgatgaaaataa

SEQ ID NO: 6258138 - DNA, 15 bp, Homo sapiens
gattttgaacttttt

SEQ ID NO: 6258139 - DNA, 16 bp, Homo sapiens
gattttgaacttttta

SEQ ID NO: 6258140 - DNA, 13 bp, Homo sapiens
gattttgaccttg

SEQ ID NO: 6258141 - DNA, 17 bp, Homo sapiens
gcctttttacagccaac

SEQ ID NO: 6258142 - DNA, 18 bp, Homo sapiens
gcctttttacctggccta

SEQ ID NO: 6258143 - DNA, 23 bp, Homo sapiens
gcctttttacctggcctagaaag

SEQ ID NO: 6258144 - DNA, 16 bp, Homo sapiens
gcctttttagggcaga

SEQ ID NO: 6258145 - DNA, 19 bp, Homo sapiens
gcctttttataacttttta

SEQ ID NO: 6258146 - DNA, 23 bp, Homo sapiens
gcctttttcacaattccatttcc

SEQ ID NO: 6258147 - DNA, 18 bp, Homo sapiens
gcctttttcataaactga

SEQ ID NO: 6258148 - DNA, 22 bp, Homo sapiens
gcctttttcataaactgagcct

SEQ ID NO: 6258149 - DNA, 12 bp, Homo sapiens
gcctttttcatt

SEQ ID NO: 6258150 - DNA, 16 bp, Homo sapiens
gcctttttcattattt

SEQ ID NO: 6258151 - DNA, 23 bp, Homo sapiens
gcctttttcattattttattatg

SEQ ID NO: 6258152 - DNA, 15 bp, Homo sapiens
gcctttttcatttat

SEQ ID NO: 6258153 - DNA, 22 bp, Homo sapiens
gcctttttcatttatctataat

SEQ ID NO: 6258154 - DNA, 20 bp, Homo sapiens
gcctttttccttatttcaag

SEQ ID NO: 6258155 - DNA, 15 bp, Homo sapiens
gcctttttgagccaa

SEQ ID NO: 6258156 - DNA, 23 bp, Homo sapiens
gcctttttggcctgtgatgtttt

SEQ ID NO: 6258157 - DNA, 15 bp, Homo sapiens
gcctttttgtaattt

SEQ ID NO: 6258158 - DNA, 20 bp, Homo sapiens
gccttttttcacggaagttt

SEQ ID NO: 6258159 - DNA, 17 bp, Homo sapiens
gccttttttccccagac

SEQ ID NO: 6258160 - DNA, 22 bp, Homo sapiens
gcgaaaaaatcaggtggctttt

SEQ ID NO: 6258161 - DNA, 14 bp, Homo sapiens
gcgaaaacaggaga

SEQ ID NO: 6258162 - DNA, 20 bp, Homo sapiens
gcgaaaacttgaatctgtta

SEQ ID NO: 6258163 - DNA, 11 bp, Homo sapiens
gcgaaaatagt

SEQ ID NO: 6258164 - DNA, 21 bp, Homo sapiens
gcgaaacccccttttcccttc

SEQ ID NO: 6258165 - DNA, 22 bp, Homo sapiens
gcgaaacccggtgcatctggca

SEQ ID NO: 6258166 - DNA, 18 bp, Homo sapiens
gcgaaaggcgagtccagg

SEQ ID NO: 6258167 - DNA, 20 bp, Homo sapiens
gcgaaagggtgagactccat

SEQ ID NO: 6258168 - DNA, 17 bp, Homo sapiens
gcgaaataaaaatggca

SEQ ID NO: 6258169 - DNA, 16 bp, Homo sapiens
gcgaaattattggttg

SEQ ID NO: 6258170 - DNA, 22 bp, Homo sapiens
gcgaacacaggtgttggaagcc

SEQ ID NO: 6258171 - DNA, 16 bp, Homo sapiens
gcgaacagccttagag

SEQ ID NO: 6258172 - DNA, 15 bp, Homo sapiens
gcgaaccgtgaggag

SEQ ID NO: 6258173 - DNA, 20 bp, Homo sapiens
gcgaacgtatttctccagac

SEQ ID NO: 6258174 - DNA, 23 bp, Homo sapiens
gcgaacgtatttctccagaccca

SEQ ID NO: 6258175 - DNA, 16 bp, Homo sapiens
gcgaactctcaggact

SEQ ID NO: 6258176 - DNA, 13 bp, Homo sapiens
gcgaactgggttc

SEQ ID NO: 6258177 - DNA, 15 bp, Homo sapiens
gcgaactgtgcagtt

SEQ ID NO: 6258178 - DNA, 17 bp, Homo sapiens
gcgaagacccggccagg

SEQ ID NO: 6258179 - DNA, 22 bp, Homo sapiens
gcgaagaccctcttgcccatcc

SEQ ID NO: 6258180 - DNA, 19 bp, Homo sapiens
gcgaagcaagaagaattga

SEQ ID NO: 6258181 - DNA, 14 bp, Homo sapiens
gcgaagcctgagca

SEQ ID NO: 6258182 - DNA, 21 bp, Homo sapiens
gcgaagcctgagcaggcaggg

SEQ ID NO: 6258183 - DNA, 14 bp, Homo sapiens
gcgaaggggccctg

SEQ ID NO: 6258184 - DNA, 16 bp, Homo sapiens
gcgaaggtcccacagc

SEQ ID NO: 6258185 - DNA, 20 bp, Homo sapiens
gcgaaggtcccacagccctg

SEQ ID NO: 6258186 - DNA, 22 bp, Homo sapiens
gcgaaggtcccacagccctgag

SEQ ID NO: 6258187 - DNA, 23 bp, Homo sapiens
gcgaaggtcccacagccctgaga

SEQ ID NO: 6258188 - DNA, 16 bp, Homo sapiens
gcgaagtagcttgctc

SEQ ID NO: 6258189 - DNA, 19 bp, Homo sapiens
gcgaagtctcatgggaagc

SEQ ID NO: 6258190 - DNA, 20 bp, Homo sapiens
gcgaagtctttgccttctct

SEQ ID NO: 6258191 - DNA, 15 bp, Homo sapiens
gcgaagtggctctca

SEQ ID NO: 6258192 - DNA, 17 bp, Homo sapiens
gcgaagtggctctcagg

SEQ ID NO: 6258193 - DNA, 11 bp, Homo sapiens
gcgaataaatg

SEQ ID NO: 6258194 - DNA, 14 bp, Homo sapiens
gcgaatcatttgtt

SEQ ID NO: 6258195 - DNA, 14 bp, Homo sapiens
gcgaatgagctggg

SEQ ID NO: 6258196 - DNA, 19 bp, Homo sapiens
gcgaattcatcccctcccc

SEQ ID NO: 6258197 - DNA, 15 bp, Homo sapiens
gcgaattttaaaaga

SEQ ID NO: 6258198 - DNA, 19 bp, Homo sapiens
gcgacaaaatctcctggct

SEQ ID NO: 6258199 - DNA, 12 bp, Homo sapiens
gcgacaatgcaa

SEQ ID NO: 6258200 - DNA, 20 bp, Homo sapiens
gcgacaatgcaaaccatcat

SEQ ID NO: 6258201 - DNA, 23 bp, Homo sapiens
gcgacaatgcaaaccatcattga

SEQ ID NO: 6258202 - DNA, 20 bp, Homo sapiens
gcgacactcagggcagctgc

SEQ ID NO: 6258203 - DNA, 20 bp, Homo sapiens
gcgacagaaaacctcaaggg

SEQ ID NO: 6258204 - DNA, 12 bp, Homo sapiens
gcgacagagcag

SEQ ID NO: 6258205 - DNA, 23 bp, Homo sapiens
gcgacagagcgagagtctgtctc

SEQ ID NO: 6258206 - DNA, 16 bp, Homo sapiens
gcgacagcattttaag

SEQ ID NO: 6258207 - DNA, 23 bp, Homo sapiens
gcgacagcgtccggggtggtgga

SEQ ID NO: 6258208 - DNA, 22 bp, Homo sapiens
gcgacagcttgtgattcctacc

SEQ ID NO: 6258209 - DNA, 18 bp, Homo sapiens
gcgacaggagtatttttt

SEQ ID NO: 6258210 - DNA, 16 bp, Homo sapiens
gcgacatagcccatcc

SEQ ID NO: 6258211 - DNA, 17 bp, Homo sapiens
gcgacatagcccatccc

SEQ ID NO: 6258212 - DNA, 18 bp, Homo sapiens
gcgacatagcccatccct

SEQ ID NO: 6258213 - DNA, 21 bp, Homo sapiens
gcgacatagcccatccctgcc

SEQ ID NO: 6258214 - DNA, 13 bp, Homo sapiens
gcgaccaccaaag

SEQ ID NO: 6258215 - DNA, 11 bp, Homo sapiens
gcgaccacccc

SEQ ID NO: 6258216 - DNA, 14 bp, Homo sapiens
gcgaccacccctgt

SEQ ID NO: 6258217 - DNA, 16 bp, Homo sapiens
gcgaccagcaggctcc

SEQ ID NO: 6258218 - DNA, 17 bp, Homo sapiens
gcgaccagcaggctcct

SEQ ID NO: 6258219 - DNA, 18 bp, Homo sapiens
gcgaccagcaggctcctc

SEQ ID NO: 6258220 - DNA, 21 bp, Homo sapiens
gcgaccagcaggctcctcagc

SEQ ID NO: 6258221 - DNA, 16 bp, Homo sapiens
gcgaccagggccatct

SEQ ID NO: 6258222 - DNA, 11 bp, Homo sapiens
gcgaccccaga

SEQ ID NO: 6258223 - DNA, 14 bp, Homo sapiens
gcgaccccagactg

SEQ ID NO: 6258224 - DNA, 17 bp, Homo sapiens
gcgaccccgtcacagcc

SEQ ID NO: 6258225 - DNA, 14 bp, Homo sapiens
gcgacccctcagtg

SEQ ID NO: 6258226 - DNA, 12 bp, Homo sapiens
gcgaccctggct

SEQ ID NO: 6258227 - DNA, 13 bp, Homo sapiens
gcgaccgccccct

SEQ ID NO: 6258228 - DNA, 15 bp, Homo sapiens
gcgaccgggcctccc

SEQ ID NO: 6258229 - DNA, 17 bp, Homo sapiens
gcgaccgggcctcccct

SEQ ID NO: 6258230 - DNA, 22 bp, Homo sapiens
gcgaccttcctcatccacccca

SEQ ID NO: 6258231 - DNA, 23 bp, Homo sapiens
gcgaccttcctcatccaccccat

SEQ ID NO: 6258232 - DNA, 20 bp, Homo sapiens
gcgacgcacctcgagggtgt

SEQ ID NO: 6258233 - DNA, 17 bp, Homo sapiens
gcgacgctcccctgaga

SEQ ID NO: 6258234 - DNA, 17 bp, Homo sapiens
gcgacggagagaaaaaa

SEQ ID NO: 6258235 - DNA, 17 bp, Homo sapiens
gcgacggaggcaggacc

SEQ ID NO: 6258236 - DNA, 13 bp, Homo sapiens
gcgactaatttca

SEQ ID NO: 6258237 - DNA, 13 bp, Homo sapiens
gcgactcccagct

SEQ ID NO: 6258238 - DNA, 18 bp, Homo sapiens
gcgactccgttggccact

SEQ ID NO: 6258239 - DNA, 19 bp, Homo sapiens
gcgactggatgctcgccat

SEQ ID NO: 6258240 - DNA, 19 bp, Homo sapiens
gcgacttccacagcagcag

SEQ ID NO: 6258241 - DNA, 14 bp, Homo sapiens
gcgacttctcagga

SEQ ID NO: 6258242 - DNA, 12 bp, Homo sapiens
gcgactttctgc

SEQ ID NO: 6258243 - DNA, 22 bp, Homo sapiens
gcgagaaacaagacaagctcct

SEQ ID NO: 6258244 - DNA, 19 bp, Homo sapiens
gcgagaaacagagatcata

SEQ ID NO: 6258245 - DNA, 17 bp, Homo sapiens
gcgagaaaggcctctgt

SEQ ID NO: 6258246 - DNA, 21 bp, Homo sapiens
gcgagaacacaagccacgcct

SEQ ID NO: 6258247 - DNA, 22 bp, Homo sapiens
gcgagaacacaagccacgcctg

SEQ ID NO: 6258248 - DNA, 20 bp, Homo sapiens
gcgagaacctaagtttcagt

SEQ ID NO: 6258249 - DNA, 14 bp, Homo sapiens
gcgagaagggcgca

SEQ ID NO: 6258250 - DNA, 17 bp, Homo sapiens
gcgagaatgcaggcccc

SEQ ID NO: 6258251 - DNA, 21 bp, Homo sapiens
gcgagacccaaggctcactgc

SEQ ID NO: 6258252 - DNA, 22 bp, Homo sapiens
gcgagacccaaggctcactgca

SEQ ID NO: 6258253 - DNA, 16 bp, Homo sapiens
gcgagaccctgtctca

SEQ ID NO: 6258254 - DNA, 21 bp, Homo sapiens
gcgagacccttgcattagaaa

SEQ ID NO: 6258255 - DNA, 19 bp, Homo sapiens
gcgagagaggtgggcagca

SEQ ID NO: 6258256 - DNA, 14 bp, Homo sapiens
gcgagaggcagcaa

SEQ ID NO: 6258257 - DNA, 18 bp, Homo sapiens
gcgagaggtccctgctta

SEQ ID NO: 6258258 - DNA, 19 bp, Homo sapiens
gcgagaggtgagctacttt

SEQ ID NO: 6258259 - DNA, 23 bp, Homo sapiens
gcgagatagggggaagacagata

SEQ ID NO: 6258260 - DNA, 21 bp, Homo sapiens
gcgagatcggggtagaaatgc

SEQ ID NO: 6258261 - DNA, 15 bp, Homo sapiens
gcgagcaacagtgcc

SEQ ID NO: 6258262 - DNA, 13 bp, Homo sapiens
gcgagcacacaca

SEQ ID NO: 6258263 - DNA, 15 bp, Homo sapiens
gcgagcacatgttca

SEQ ID NO: 6258264 - DNA, 18 bp, Homo sapiens
gcgagcaccaagtacaag

SEQ ID NO: 6258265 - DNA, 13 bp, Homo sapiens
gcgagcacccacg

SEQ ID NO: 6258266 - DNA, 18 bp, Homo sapiens
gcgagcagaggctccaca

SEQ ID NO: 6258267 - DNA, 16 bp, Homo sapiens
gcgagcatgggggctg

SEQ ID NO: 6258268 - DNA, 20 bp, Homo sapiens
gcgagcatgggggctgccag

SEQ ID NO: 6258269 - DNA, 21 bp, Homo sapiens
gcgagcatgggggctgccagc

SEQ ID NO: 6258270 - DNA, 13 bp, Homo sapiens
gcgagccacagga

SEQ ID NO: 6258271 - DNA, 17 bp, Homo sapiens
gcgagccacaggaacgg

SEQ ID NO: 6258272 - DNA, 22 bp, Homo sapiens
gcgagccacaggaacggccctg

SEQ ID NO: 6258273 - DNA, 19 bp, Homo sapiens
gcgagccagattaggcctg

SEQ ID NO: 6258274 - DNA, 15 bp, Homo sapiens
gcgagcccctccttc

SEQ ID NO: 6258275 - DNA, 19 bp, Homo sapiens
gcgagcccctccttctccc

SEQ ID NO: 6258276 - DNA, 12 bp, Homo sapiens
gcgagcccttag

SEQ ID NO: 6258277 - DNA, 13 bp, Homo sapiens
gcgagcctgctag

SEQ ID NO: 6258278 - DNA, 15 bp, Homo sapiens
gcgagcctgcttgct

SEQ ID NO: 6258279 - DNA, 14 bp, Homo sapiens
gcgagctgcaggaa

SEQ ID NO: 6258280 - DNA, 13 bp, Homo sapiens
gcgagctgctctg

SEQ ID NO: 6258281 - DNA, 15 bp, Homo sapiens
gcgagctgctctgct

SEQ ID NO: 6258282 - DNA, 14 bp, Homo sapiens
gcgagcttggcctt

SEQ ID NO: 6258283 - DNA, 21 bp, Homo sapiens
gcgagcttggccttgggccgg

SEQ ID NO: 6258284 - DNA, 22 bp, Homo sapiens
gcgaggaccactttggagactg

SEQ ID NO: 6258285 - DNA, 20 bp, Homo sapiens
gcgaggagatgctccttggg

SEQ ID NO: 6258286 - DNA, 15 bp, Homo sapiens
gcgaggaggctccag

SEQ ID NO: 6258287 - DNA, 17 bp, Homo sapiens
gcgaggaggctccagag

SEQ ID NO: 6258288 - DNA, 13 bp, Homo sapiens
gcgaggcaggccg

SEQ ID NO: 6258289 - DNA, 20 bp, Homo sapiens
gcgaggcattaaaacttggg

SEQ ID NO: 6258290 - DNA, 23 bp, Homo sapiens
gcgaggcctctctcaggagcagg

SEQ ID NO: 6258291 - DNA, 18 bp, Homo sapiens
gcgaggcgaagctgagcg

SEQ ID NO: 6258292 - DNA, 14 bp, Homo sapiens
gcgaggcgggggag

SEQ ID NO: 6258293 - DNA, 20 bp, Homo sapiens
gcgaggcgggggagcctgga

SEQ ID NO: 6258294 - DNA, 24 bp, Homo sapiens
gcgaggcgggggatcctggagccc

SEQ ID NO: 6258295 - DNA, 20 bp, Homo sapiens
gcgaggctcggagcaccctt

SEQ ID NO: 6258296 - DNA, 15 bp, Homo sapiens
gcgaggctgcccctt

SEQ ID NO: 6258297 - DNA, 13 bp, Homo sapiens
gcgaggctgcctc

SEQ ID NO: 6258298 - DNA, 15 bp, Homo sapiens
gcgaggctgcctctg

SEQ ID NO: 6258299 - DNA, 17 bp, Homo sapiens
gcgaggctgcctctggg

SEQ ID NO: 6258300 - DNA, 19 bp, Homo sapiens
gcgagggatgatgagggaa

SEQ ID NO: 6258301 - DNA, 20 bp, Homo sapiens
gcgagggatgatgagggaag

SEQ ID NO: 6258302 - DNA, 14 bp, Homo sapiens
gcgagggcagcacc

SEQ ID NO: 6258303 - DNA, 14 bp, Homo sapiens
gcgagggcagcagg

SEQ ID NO: 6258304 - DNA, 14 bp, Homo sapiens
gcgagggcagctgc

SEQ ID NO: 6258305 - DNA, 16 bp, Homo sapiens
gcgagggcagctgcta

SEQ ID NO: 6258306 - DNA, 17 bp, Homo sapiens
gcgagggcctgcgttca

SEQ ID NO: 6258307 - DNA, 17 bp, Homo sapiens
gcgaggggaaaggcctg

SEQ ID NO: 6258308 - DNA, 12 bp, Homo sapiens
gcgagtacccca

SEQ ID NO: 6258309 - DNA, 15 bp, Homo sapiens
gcgagtcaccctcct

SEQ ID NO: 6258310 - DNA, 17 bp, Homo sapiens
gcgagtccagacaccat

SEQ ID NO: 6258311 - DNA, 12 bp, Homo sapiens
gcgagtctggag

SEQ ID NO: 6258312 - DNA, 22 bp, Homo sapiens
gcgagtgaatgccagtgtgctg

SEQ ID NO: 6258313 - DNA, 17 bp, Homo sapiens
gcgagtgacagaaggcc

SEQ ID NO: 6258314 - DNA, 21 bp, Homo sapiens
gcgagtgccaggactccccag

SEQ ID NO: 6258315 - DNA, 17 bp, Homo sapiens
gcgagtggatgctgtgc

SEQ ID NO: 6258316 - DNA, 14 bp, Homo sapiens
gcgagtggtcaagg

SEQ ID NO: 6258317 - DNA, 21 bp, Homo sapiens
gcgagtgtgctgtatggccca

SEQ ID NO: 6258318 - DNA, 23 bp, Homo sapiens
gcgagtgtgctgtatggcccagg

SEQ ID NO: 6258319 - DNA, 14 bp, Homo sapiens
gattttgagtatct

SEQ ID NO: 6258320 - DNA, 18 bp, Homo sapiens
gattttgatagcaaagcg

SEQ ID NO: 6258321 - DNA, 12 bp, Homo sapiens
gattttgcacaa

SEQ ID NO: 6258322 - DNA, 13 bp, Homo sapiens
gattttgcctgtg

SEQ ID NO: 6258323 - DNA, 15 bp, Homo sapiens
gattttgctgtatat

SEQ ID NO: 6258324 - DNA, 20 bp, Homo sapiens
gattttggaactgtgtttca

SEQ ID NO: 6258325 - DNA, 18 bp, Homo sapiens
gattttggataaatcatt

SEQ ID NO: 6258326 - DNA, 19 bp, Homo sapiens
gattttggcctcattactt

SEQ ID NO: 6258327 - DNA, 22 bp, Homo sapiens
gattttgtaaagttgcctttat

SEQ ID NO: 6258328 - DNA, 14 bp, Homo sapiens
gattttgtaaatgt

SEQ ID NO: 6258329 - DNA, 13 bp, Homo sapiens
gattttgtaaccc

SEQ ID NO: 6258330 - DNA, 15 bp, Homo sapiens
gattttgtacagaat

SEQ ID NO: 6258331 - DNA, 17 bp, Homo sapiens
gattttgtacagaattt

SEQ ID NO: 6258332 - DNA, 18 bp, Homo sapiens
gattttgtacagaatttt

SEQ ID NO: 6258333 - DNA, 22 bp, Homo sapiens
gattttgtaggttattttatat

SEQ ID NO: 6258334 - DNA, 12 bp, Homo sapiens
gattttgtagtt

SEQ ID NO: 6258335 - DNA, 12 bp, Homo sapiens
gattttgtgaaa

SEQ ID NO: 6258336 - DNA, 13 bp, Homo sapiens
gattttgtgaaat

SEQ ID NO: 6258337 - DNA, 16 bp, Homo sapiens
gattttgtgaaatttc

SEQ ID NO: 6258338 - DNA, 22 bp, Homo sapiens
gattttgtgtcttttaaactgg

SEQ ID NO: 6258339 - DNA, 13 bp, Homo sapiens
gattttgtgttta

SEQ ID NO: 6258340 - DNA, 20 bp, Homo sapiens
gattttgtgttttttcgttc

SEQ ID NO: 6258341 - DNA, 14 bp, Homo sapiens
gattttgttatgtt

SEQ ID NO: 6258342 - DNA, 21 bp, Homo sapiens
gattttgttgatacctctgct

SEQ ID NO: 6258343 - DNA, 17 bp, Homo sapiens
gatttttaaaaaatatt

SEQ ID NO: 6258344 - DNA, 14 bp, Homo sapiens
gatttttaaaactc

SEQ ID NO: 6258345 - DNA, 21 bp, Homo sapiens
gatttttaaaactcagattta

SEQ ID NO: 6258346 - DNA, 21 bp, Homo sapiens
gatttttaaaatgtcaagaca

SEQ ID NO: 6258347 - DNA, 13 bp, Homo sapiens
gatttttaaagtt

SEQ ID NO: 6258348 - DNA, 18 bp, Homo sapiens
gatttttaaattggagaa

SEQ ID NO: 6258349 - DNA, 22 bp, Homo sapiens
gatttttaaattggagaaaagc

SEQ ID NO: 6258350 - DNA, 11 bp, Homo sapiens
gatttttaaga

SEQ ID NO: 6258351 - DNA, 13 bp, Homo sapiens
gatttttaagaac

SEQ ID NO: 6258352 - DNA, 13 bp, Homo sapiens
gatttttaagagc

SEQ ID NO: 6258353 - DNA, 20 bp, Homo sapiens
gatttttaattaaaaactag

SEQ ID NO: 6258354 - DNA, 14 bp, Homo sapiens
gatttttacacatg

SEQ ID NO: 6258355 - DNA, 16 bp, Homo sapiens
gatttttacactaata

SEQ ID NO: 6258356 - DNA, 22 bp, Homo sapiens
gatttttacgtttgaagacatt

SEQ ID NO: 6258357 - DNA, 18 bp, Homo sapiens
gatttttactgtgtttta

SEQ ID NO: 6258358 - DNA, 18 bp, Homo sapiens
gatttttagagcattaaa

SEQ ID NO: 6258359 - DNA, 20 bp, Homo sapiens
gatttttatattagttgctt

SEQ ID NO: 6258360 - DNA, 22 bp, Homo sapiens
gatttttatattagttgctttg

SEQ ID NO: 6258361 - DNA, 13 bp, Homo sapiens
gatttttatcaca

SEQ ID NO: 6258362 - DNA, 14 bp, Homo sapiens
gatttttatccaat

SEQ ID NO: 6258363 - DNA, 20 bp, Homo sapiens
gatttttatccaatcttgtt

SEQ ID NO: 6258364 - DNA, 18 bp, Homo sapiens
gatttttcatatgtggaa

SEQ ID NO: 6258365 - DNA, 22 bp, Homo sapiens
gatttttctaaccttgaatgct

SEQ ID NO: 6258366 - DNA, 23 bp, Homo sapiens
gatttttctaaccttgaatgctg

SEQ ID NO: 6258367 - DNA, 18 bp, Homo sapiens
gatttttctcaaagtttt

SEQ ID NO: 6258368 - DNA, 12 bp, Homo sapiens
gatttttctctt

SEQ ID NO: 6258369 - DNA, 13 bp, Homo sapiens
gatttttctcttt

SEQ ID NO: 6258370 - DNA, 22 bp, Homo sapiens
gatttttctcttttttaaaaac

SEQ ID NO: 6258371 - DNA, 21 bp, Homo sapiens
gatttttcttcaggtaacact

SEQ ID NO: 6258372 - DNA, 12 bp, Homo sapiens
gatttttcttta

SEQ ID NO: 6258373 - DNA, 13 bp, Homo sapiens
gatttttctttaa

SEQ ID NO: 6258374 - DNA, 15 bp, Homo sapiens
gatttttctttaact

SEQ ID NO: 6258375 - DNA, 14 bp, Homo sapiens
gatttttgggctcc

SEQ ID NO: 6258376 - DNA, 14 bp, Homo sapiens
gatttttgttaagc

SEQ ID NO: 6258377 - DNA, 20 bp, Homo sapiens
gatttttgttaagctcagga

SEQ ID NO: 6258378 - DNA, 14 bp, Homo sapiens
gatttttgttaatt

SEQ ID NO: 6258379 - DNA, 16 bp, Homo sapiens
gatttttgtttgttca

SEQ ID NO: 6258380 - DNA, 22 bp, Homo sapiens
gatttttgttttgtttttacaa

SEQ ID NO: 6258381 - DNA, 15 bp, Homo sapiens
gattttttaaaaatt

SEQ ID NO: 6258382 - DNA, 15 bp, Homo sapiens
gattttttaagcaga

SEQ ID NO: 6258383 - DNA, 19 bp, Homo sapiens
gattttttaaggagctggg

SEQ ID NO: 6258384 - DNA, 19 bp, Homo sapiens
gattttttaataatttaga

SEQ ID NO: 6258385 - DNA, 18 bp, Homo sapiens
gattttttaattgtttaa

SEQ ID NO: 6258386 - DNA, 22 bp, Homo sapiens
gattttttatgtacaaccctga

SEQ ID NO: 6258387 - DNA, 23 bp, Homo sapiens
gattttttatgtacaaccctgac

SEQ ID NO: 6258388 - DNA, 22 bp, Homo sapiens
gattttttattgctagtatttg

SEQ ID NO: 6258389 - DNA, 17 bp, Homo sapiens
gattttttcaaaaaagt

SEQ ID NO: 6258390 - DNA, 21 bp, Homo sapiens
gattttttcagacttgtcaag

SEQ ID NO: 6258391 - DNA, 22 bp, Homo sapiens
gattttttccattatgttcatc

SEQ ID NO: 6258392 - DNA, 18 bp, Homo sapiens
gattttttccttcaaagt

SEQ ID NO: 6258393 - DNA, 19 bp, Homo sapiens
gattttttgcattcctgac

SEQ ID NO: 6258394 - DNA, 17 bp, Homo sapiens
gatttttttaaagtagt

SEQ ID NO: 6258395 - DNA, 19 bp, Homo sapiens
gatttttttaaagtagttc

SEQ ID NO: 6258396 - DNA, 13 bp, Homo sapiens
gatttttttaact

SEQ ID NO: 6258397 - DNA, 19 bp, Homo sapiens
gatttttttataaacagtt

SEQ ID NO: 6258398 - DNA, 13 bp, Homo sapiens
gatttttttcctc

SEQ ID NO: 6258399 - DNA, 22 bp, Homo sapiens
gatttttttgtcattaaaattg

SEQ ID NO: 6258400 - DNA, 15 bp, Homo sapiens
gattttttttaaagt

SEQ ID NO: 6258401 - DNA, 23 bp, Homo sapiens
gattttttttcccatttagaatg

SEQ ID NO: 6258402 - DNA, 17 bp, Homo sapiens
gattttttttccgtgtg

SEQ ID NO: 6258403 - DNA, 22 bp, Homo sapiens
gatttttttttccacttttgtt

SEQ ID NO: 6258404 - DNA, 23 bp, Homo sapiens
gatttttttttccttcagtgcct

SEQ ID NO: 6258405 - DNA, 19 bp, Homo sapiens
gattttttttttcaggtta

SEQ ID NO: 6258406 - DNA, 18 bp, Homo sapiens
gatttttttttttaattt

SEQ ID NO: 6258407 - DNA, 23 bp, Homo sapiens
gatttttttttttgtttgtttga

SEQ ID NO: 6258408 - DNA, 21 bp, Homo sapiens
gattttttttttttctctcaa

SEQ ID NO: 6258409 - DNA, 22 bp, Homo sapiens
gcaaaaaaaaaaattacattat

SEQ ID NO: 6258410 - DNA, 18 bp, Homo sapiens
gcaaaaaaaaacttaaag

SEQ ID NO: 6258411 - DNA, 13 bp, Homo sapiens
gcaaaaaaaatta

SEQ ID NO: 6258412 - DNA, 16 bp, Homo sapiens
gcaaaaaaaattagcc

SEQ ID NO: 6258413 - DNA, 12 bp, Homo sapiens
gcaaaaaaagtt

SEQ ID NO: 6258414 - DNA, 12 bp, Homo sapiens
gcaaaaaaatta

SEQ ID NO: 6258415 - DNA, 21 bp, Homo sapiens
gcaaaaaaattaaaatggatg

SEQ ID NO: 6258416 - DNA, 13 bp, Homo sapiens
gcaaaaaactctt

SEQ ID NO: 6258417 - DNA, 14 bp, Homo sapiens
gcaaaaaagaaaac

SEQ ID NO: 6258418 - DNA, 20 bp, Homo sapiens
gcaaaaaaggtaactaactg

SEQ ID NO: 6258419 - DNA, 16 bp, Homo sapiens
gcaaaaaagtccaatt

SEQ ID NO: 6258420 - DNA, 11 bp, Homo sapiens
gcaaaaaatac

SEQ ID NO: 6258421 - DNA, 14 bp, Homo sapiens
gcaaaaaataccct

SEQ ID NO: 6258422 - DNA, 20 bp, Homo sapiens
gcaaaaaatactttttctaa

SEQ ID NO: 6258423 - DNA, 22 bp, Homo sapiens
gcaaaaaatcttaatactgtta

SEQ ID NO: 6258424 - DNA, 15 bp, Homo sapiens
gcaaaaaattcttta

SEQ ID NO: 6258425 - DNA, 20 bp, Homo sapiens
gcaaaaacaaaaagaaaaga

SEQ ID NO: 6258426 - DNA, 20 bp, Homo sapiens
gcaaaaacatatgtctgtct

SEQ ID NO: 6258427 - DNA, 14 bp, Homo sapiens
gcaaaaactgtggg

SEQ ID NO: 6258428 - DNA, 15 bp, Homo sapiens
gcaaaaacttccttt

SEQ ID NO: 6258429 - DNA, 20 bp, Homo sapiens
gcaaaaagagtcagacattt

SEQ ID NO: 6258430 - DNA, 18 bp, Homo sapiens
gcaaaaagcaagggagaa

SEQ ID NO: 6258431 - DNA, 14 bp, Homo sapiens
gcaaaaaggactgg

SEQ ID NO: 6258432 - DNA, 17 bp, Homo sapiens
gcaaaaaggactggaaa

SEQ ID NO: 6258433 - DNA, 12 bp, Homo sapiens
gcaaaaataatt

SEQ ID NO: 6258434 - DNA, 20 bp, Homo sapiens
gcaaaaataatttattttgc

SEQ ID NO: 6258435 - DNA, 22 bp, Homo sapiens
gcaaaaataatttattttgctc

SEQ ID NO: 6258436 - DNA, 14 bp, Homo sapiens
gcaaaaatagctct

SEQ ID NO: 6258437 - DNA, 12 bp, Homo sapiens
gcaaaaatattt

SEQ ID NO: 6258438 - DNA, 14 bp, Homo sapiens
gcaaaaatatttat

SEQ ID NO: 6258439 - DNA, 17 bp, Homo sapiens
gcaaaaatattttatga

SEQ ID NO: 6258440 - DNA, 16 bp, Homo sapiens
gcaaaaatattttgca

SEQ ID NO: 6258441 - DNA, 19 bp, Homo sapiens
gcaaaaatgaattcacccc

SEQ ID NO: 6258442 - DNA, 14 bp, Homo sapiens
gcaaaaatgctaat

SEQ ID NO: 6258443 - DNA, 13 bp, Homo sapiens
gcaaaaatgtaaa

SEQ ID NO: 6258444 - DNA, 15 bp, Homo sapiens
gcaaaaatttgacat

SEQ ID NO: 6258445 - DNA, 22 bp, Homo sapiens
gcaaaacaaaaccctcagcact

SEQ ID NO: 6258446 - DNA, 18 bp, Homo sapiens
gcaaaacactatgtatag

SEQ ID NO: 6258447 - DNA, 13 bp, Homo sapiens
gcaaaacatcaca

SEQ ID NO: 6258448 - DNA, 16 bp, Homo sapiens
gcaaaacatctctgca

SEQ ID NO: 6258449 - DNA, 17 bp, Homo sapiens
gcaaaacatgctacctg

SEQ ID NO: 6258450 - DNA, 11 bp, Homo sapiens
gcaaaacattt

SEQ ID NO: 6258451 - DNA, 16 bp, Homo sapiens
gcaaaaccttttactg

SEQ ID NO: 6258452 - DNA, 17 bp, Homo sapiens
gcaaaaccttttactgg

SEQ ID NO: 6258453 - DNA, 17 bp, Homo sapiens
gcaaaactagacaaaag

SEQ ID NO: 6258454 - DNA, 21 bp, Homo sapiens
gcaaaactatgacaatttttg

SEQ ID NO: 6258455 - DNA, 15 bp, Homo sapiens
gcaaaactcacagag

SEQ ID NO: 6258456 - DNA, 18 bp, Homo sapiens
gcaaaactccaggcagga

SEQ ID NO: 6258457 - DNA, 17 bp, Homo sapiens
gcaaaactctacttaat

SEQ ID NO: 6258458 - DNA, 22 bp, Homo sapiens
gcaaaactctacttaatccaat

SEQ ID NO: 6258459 - DNA, 20 bp, Homo sapiens
gcaaaactgcctgaaagcaa

SEQ ID NO: 6258460 - DNA, 19 bp, Homo sapiens
gcaaaactggaagcacagc

SEQ ID NO: 6258461 - DNA, 14 bp, Homo sapiens
gcaaaactgtgtca

SEQ ID NO: 6258462 - DNA, 17 bp, Homo sapiens
gcaaaacttttaaacta

SEQ ID NO: 6258463 - DNA, 10 bp, Homo sapiens
gcaaaagaaa

SEQ ID NO: 6258464 - DNA, 16 bp, Homo sapiens
gcaaaagaaacaccag

SEQ ID NO: 6258465 - DNA, 21 bp, Homo sapiens
gcaaaagaaacaccagtgtta

SEQ ID NO: 6258466 - DNA, 11 bp, Homo sapiens
gcaaaagaaga

SEQ ID NO: 6258467 - DNA, 22 bp, Homo sapiens
gcaaaagaatgttttggcaaga

SEQ ID NO: 6258468 - DNA, 10 bp, Homo sapiens
gcaaaagact

SEQ ID NO: 6258469 - DNA, 11 bp, Homo sapiens
gcaaaagactg

SEQ ID NO: 6258470 - DNA, 12 bp, Homo sapiens
gcaaaagagaaa

SEQ ID NO: 6258471 - DNA, 18 bp, Homo sapiens
gcaaaagagaaaaagaag

SEQ ID NO: 6258472 - DNA, 18 bp, Homo sapiens
gcaaaagagaaatacata

SEQ ID NO: 6258473 - DNA, 15 bp, Homo sapiens
gcaaaagatgcttct

SEQ ID NO: 6258474 - DNA, 22 bp, Homo sapiens
gcaaaagatgtgcaaaatcact

SEQ ID NO: 6258475 - DNA, 18 bp, Homo sapiens
gcaaaagccaagaaagta

SEQ ID NO: 6258476 - DNA, 14 bp, Homo sapiens
gcaaaagccttgtg

SEQ ID NO: 6258477 - DNA, 12 bp, Homo sapiens
gcaaaaggagag

SEQ ID NO: 6258478 - DNA, 21 bp, Homo sapiens
gcaaaaggatctttgtggcca

SEQ ID NO: 6258479 - DNA, 21 bp, Homo sapiens
gcaaaaggcagtggggctggg

SEQ ID NO: 6258480 - DNA, 20 bp, Homo sapiens
gcaaaaggccctctggaggg

SEQ ID NO: 6258481 - DNA, 17 bp, Homo sapiens
gcaaaaggcctcttgta

SEQ ID NO: 6258482 - DNA, 13 bp, Homo sapiens
gcaaaaggctgag

SEQ ID NO: 6258483 - DNA, 18 bp, Homo sapiens
gcaaaagggcagctgtga

SEQ ID NO: 6258484 - DNA, 17 bp, Homo sapiens
gcaaaagggtgtctgag

SEQ ID NO: 6258485 - DNA, 18 bp, Homo sapiens
gcaaaaggttaagccata

SEQ ID NO: 6258486 - DNA, 19 bp, Homo sapiens
gcaaaaggttaagccatat

SEQ ID NO: 6258487 - DNA, 22 bp, Homo sapiens
gcaaaagtggggctaaatgaag

SEQ ID NO: 6258488 - DNA, 16 bp, Homo sapiens
gcaaaataaaaactat

SEQ ID NO: 6258489 - DNA, 16 bp, Homo sapiens
gcaaaataaaatgagt

SEQ ID NO: 6258490 - DNA, 19 bp, Homo sapiens
gcaaaataaaatgagttac

SEQ ID NO: 6258491 - DNA, 12 bp, Homo sapiens
gcaaaataaaga

SEQ ID NO: 6258492 - DNA, 21 bp, Homo sapiens
gcaaaataaagaatagcaatt

SEQ ID NO: 6258493 - DNA, 23 bp, Homo sapiens
gcaaaataacaaaaaagagaaac

SEQ ID NO: 6258494 - DNA, 10 bp, Homo sapiens
gcaaaataag

SEQ ID NO: 6258495 - DNA, 13 bp, Homo sapiens
gcaaaataatttt

SEQ ID NO: 6258496 - DNA, 17 bp, Homo sapiens
gcaaaatacatgaagct

SEQ ID NO: 6258497 - DNA, 18 bp, Homo sapiens
gcaaaatacatgatgatt

SEQ ID NO: 6258498 - DNA, 16 bp, Homo sapiens
gcaaaatacattattc

SEQ ID NO: 6258499 - DNA, 23 bp, Homo sapiens
gcgagttcctcgctctgggatgc

SEQ ID NO: 6258500 - DNA, 17 bp, Homo sapiens
gcgagttgtggaaagcc

SEQ ID NO: 6258501 - DNA, 20 bp, Homo sapiens
gcgataaaactaaatatatg

SEQ ID NO: 6258502 - DNA, 22 bp, Homo sapiens
gcgataaaactaaatatatgtc

SEQ ID NO: 6258503 - DNA, 16 bp, Homo sapiens
gcgatatgagagggat

SEQ ID NO: 6258504 - DNA, 15 bp, Homo sapiens
gcgatcaagtccaga

SEQ ID NO: 6258505 - DNA, 15 bp, Homo sapiens
gcgatcccacacagg

SEQ ID NO: 6258506 - DNA, 16 bp, Homo sapiens
gcgatccccgcttccc

SEQ ID NO: 6258507 - DNA, 21 bp, Homo sapiens
gcgatccctcccctcagcctc

SEQ ID NO: 6258508 - DNA, 24 bp, Homo sapiens
gcgatccctcccctcagcctcctg

SEQ ID NO: 6258509 - DNA, 14 bp, Homo sapiens
gcgatctcagctca

SEQ ID NO: 6258510 - DNA, 23 bp, Homo sapiens
gcgatctcccagggctctctgga

SEQ ID NO: 6258511 - DNA, 16 bp, Homo sapiens
gcgatctcggctcagt

SEQ ID NO: 6258512 - DNA, 18 bp, Homo sapiens
gcgatctctcctggccta

SEQ ID NO: 6258513 - DNA, 17 bp, Homo sapiens
gcgatgatgggctggag

SEQ ID NO: 6258514 - DNA, 16 bp, Homo sapiens
gcgatgctccctcagc

SEQ ID NO: 6258515 - DNA, 18 bp, Homo sapiens
gcgatggcaggcctgacc

SEQ ID NO: 6258516 - DNA, 20 bp, Homo sapiens
gcgatggcaggcctgaccca

SEQ ID NO: 6258517 - DNA, 12 bp, Homo sapiens
gcgatgggtcag

SEQ ID NO: 6258518 - DNA, 19 bp, Homo sapiens
gcgatgtggaactgctgcc

SEQ ID NO: 6258519 - DNA, 22 bp, Homo sapiens
gcgatgtggaactgctgccact

SEQ ID NO: 6258520 - DNA, 23 bp, Homo sapiens
gcgatgtggaactgctgccactg

SEQ ID NO: 6258521 - DNA, 22 bp, Homo sapiens
gcgatgtggacgtcacgctccc

SEQ ID NO: 6258522 - DNA, 13 bp, Homo sapiens
gcgatgtgtttta

SEQ ID NO: 6258523 - DNA, 17 bp, Homo sapiens
gcgatgttagttttaga

SEQ ID NO: 6258524 - DNA, 17 bp, Homo sapiens
gcgattattgatcaaaa

SEQ ID NO: 6258525 - DNA, 23 bp, Homo sapiens
gcgattcaagtcgcggctgcagg

SEQ ID NO: 6258526 - DNA, 14 bp, Homo sapiens
gcgattccctctca

SEQ ID NO: 6258527 - DNA, 21 bp, Homo sapiens
gcgattctcccgcctcagcct

SEQ ID NO: 6258528 - DNA, 20 bp, Homo sapiens
gcgattctcctgcctcagcc

SEQ ID NO: 6258529 - DNA, 23 bp, Homo sapiens
gcgattctcctgcctcagcctcc

SEQ ID NO: 6258530 - DNA, 19 bp, Homo sapiens
gcgattcttgtgcctcagc

SEQ ID NO: 6258531 - DNA, 12 bp, Homo sapiens
gcgatttcttcc

SEQ ID NO: 6258532 - DNA, 14 bp, Homo sapiens
gcgatttcttcctt

SEQ ID NO: 6258533 - DNA, 13 bp, Homo sapiens
gcgatttgaaaca

SEQ ID NO: 6258534 - DNA, 15 bp, Homo sapiens
gcgattttgtctacc

SEQ ID NO: 6258535 - DNA, 19 bp, Homo sapiens
gcgcaaaactgcctgaaag

SEQ ID NO: 6258536 - DNA, 12 bp, Homo sapiens
gcgcaaacttta

SEQ ID NO: 6258537 - DNA, 14 bp, Homo sapiens
gcgcaagccacagc

SEQ ID NO: 6258538 - DNA, 21 bp, Homo sapiens
gcgcaagcctgtaatcccagc

SEQ ID NO: 6258539 - DNA, 22 bp, Homo sapiens
gcgcaagcctgtaatcccagct

SEQ ID NO: 6258540 - DNA, 23 bp, Homo sapiens
gcgcaagcctgtaatcccagcta

SEQ ID NO: 6258541 - DNA, 13 bp, Homo sapiens
gcgcaaggcactt

SEQ ID NO: 6258542 - DNA, 15 bp, Homo sapiens
gcgcaagtgcctggg

SEQ ID NO: 6258543 - DNA, 17 bp, Homo sapiens
gcgcacaaggctgacca

SEQ ID NO: 6258544 - DNA, 11 bp, Homo sapiens
gcgcacacaca

SEQ ID NO: 6258545 - DNA, 17 bp, Homo sapiens
gcgcaccaggctgagcc

SEQ ID NO: 6258546 - DNA, 16 bp, Homo sapiens
gcgcacccagagaaaa

SEQ ID NO: 6258547 - DNA, 14 bp, Homo sapiens
gcgcaccccacagc

SEQ ID NO: 6258548 - DNA, 17 bp, Homo sapiens
gcgcaccccacagctgg

SEQ ID NO: 6258549 - DNA, 19 bp, Homo sapiens
gcgcaccccacgccctgtt

SEQ ID NO: 6258550 - DNA, 15 bp, Homo sapiens
gcgcacccggcagcc

SEQ ID NO: 6258551 - DNA, 16 bp, Homo sapiens
gcgcaccctcccctcc

SEQ ID NO: 6258552 - DNA, 21 bp, Homo sapiens
gcgcaccctcccctcccgtct

SEQ ID NO: 6258553 - DNA, 15 bp, Homo sapiens
gcgcaccgaaaaact

SEQ ID NO: 6258554 - DNA, 15 bp, Homo sapiens
gcgcaccgccatgca

SEQ ID NO: 6258555 - DNA, 16 bp, Homo sapiens
gcgcaccgccatgcat

SEQ ID NO: 6258556 - DNA, 17 bp, Homo sapiens
gcgcaccgcccaacccc

SEQ ID NO: 6258557 - DNA, 23 bp, Homo sapiens
gcgcacctatcacccaggctgga

SEQ ID NO: 6258558 - DNA, 20 bp, Homo sapiens
gcgcacgcgcgagtgtgctg

SEQ ID NO: 6258559 - DNA, 21 bp, Homo sapiens
gcgcacgcgcgagtgtgctgt

SEQ ID NO: 6258560 - DNA, 13 bp, Homo sapiens
gcgcactgcatgg

SEQ ID NO: 6258561 - DNA, 15 bp, Homo sapiens
gcgcactgcatggga

SEQ ID NO: 6258562 - DNA, 23 bp, Homo sapiens
gcgcacttaccgccctgcgggcc

SEQ ID NO: 6258563 - DNA, 11 bp, Homo sapiens
gcgcagacagg

SEQ ID NO: 6258564 - DNA, 21 bp, Homo sapiens
gcgcagagccctccaggcctg

SEQ ID NO: 6258565 - DNA, 22 bp, Homo sapiens
gcgcagagccctccaggcctgc

SEQ ID NO: 6258566 - DNA, 16 bp, Homo sapiens
gcgcagaggacatcac

SEQ ID NO: 6258567 - DNA, 17 bp, Homo sapiens
gcgcagagtaaaataag

SEQ ID NO: 6258568 - DNA, 12 bp, Homo sapiens
gcgcagagtagc

SEQ ID NO: 6258569 - DNA, 22 bp, Homo sapiens
gcgcagagtagctgcttcctgg

SEQ ID NO: 6258570 - DNA, 16 bp, Homo sapiens
gcgcagatctgtgcct

SEQ ID NO: 6258571 - DNA, 18 bp, Homo sapiens
gcgcagatctgtgcctgg

SEQ ID NO: 6258572 - DNA, 19 bp, Homo sapiens
gcgcagatgaggggccact

SEQ ID NO: 6258573 - DNA, 21 bp, Homo sapiens
gcgcagatgaggggccactga

SEQ ID NO: 6258574 - DNA, 21 bp, Homo sapiens
gcgcagcatattcaggaagct

SEQ ID NO: 6258575 - DNA, 14 bp, Homo sapiens
gcgcagccccatct

SEQ ID NO: 6258576 - DNA, 16 bp, Homo sapiens
gcgcagcccgaagccc

SEQ ID NO: 6258577 - DNA, 18 bp, Homo sapiens
gcgcagcccgaagcccag

SEQ ID NO: 6258578 - DNA, 19 bp, Homo sapiens
gcgcagccgcgctctgccc

SEQ ID NO: 6258579 - DNA, 17 bp, Homo sapiens
gcgcagcctccagggcc

SEQ ID NO: 6258580 - DNA, 18 bp, Homo sapiens
gcgcagcgcgtgcacagc

SEQ ID NO: 6258581 - DNA, 13 bp, Homo sapiens
gcgcagctccttc

SEQ ID NO: 6258582 - DNA, 14 bp, Homo sapiens
gcgcagctccttcc

SEQ ID NO: 6258583 - DNA, 18 bp, Homo sapiens
gcgcagctgaagcctgga

SEQ ID NO: 6258584 - DNA, 12 bp, Homo sapiens
gcgcagctgcct

SEQ ID NO: 6258585 - DNA, 18 bp, Homo sapiens
gcgcagctggactctgca

SEQ ID NO: 6258586 - DNA, 17 bp, Homo sapiens
gcgcaggaaccgaggac

SEQ ID NO: 6258587 - DNA, 17 bp, Homo sapiens
gcgcaggcagcgcaggg

SEQ ID NO: 6258588 - DNA, 21 bp, Homo sapiens
gcgcaggcagcgcagggctgg

SEQ ID NO: 6258589 - DNA, 13 bp, Homo sapiens
gcgcaggcccagt

SEQ ID NO: 6258590 - DNA, 15 bp, Homo sapiens
gcgcaggcccagtga

SEQ ID NO: 6258591 - DNA, 11 bp, Homo sapiens
gcgcaggccct

SEQ ID NO: 6258592 - DNA, 17 bp, Homo sapiens
gcgcaggctggccctgc

SEQ ID NO: 6258593 - DNA, 20 bp, Homo sapiens
gcgcaggctggccctgccct

SEQ ID NO: 6258594 - DNA, 21 bp, Homo sapiens
gcgcaggctggccctgccctg

SEQ ID NO: 6258595 - DNA, 22 bp, Homo sapiens
gcgcaggctggccctgccctgg

SEQ ID NO: 6258596 - DNA, 20 bp, Homo sapiens
gcgcagggacatggggcaag

SEQ ID NO: 6258597 - DNA, 21 bp, Homo sapiens
gcgcagggacatggggcaagc

SEQ ID NO: 6258598 - DNA, 22 bp, Homo sapiens
gcgcagggaggatgccacagcc

SEQ ID NO: 6258599 - DNA, 16 bp, Homo sapiens
gcgcagggctggcacg

SEQ ID NO: 6258600 - DNA, 18 bp, Homo sapiens
gcgcaggtctcttctggg

SEQ ID NO: 6258601 - DNA, 11 bp, Homo sapiens
gcgcaggtgcc

SEQ ID NO: 6258602 - DNA, 18 bp, Homo sapiens
gcgcaggtgggctggact

SEQ ID NO: 6258603 - DNA, 14 bp, Homo sapiens
gcgcagtgccttgc

SEQ ID NO: 6258604 - DNA, 22 bp, Homo sapiens
gcgcagttttttttttcttgtc

SEQ ID NO: 6258605 - DNA, 16 bp, Homo sapiens
gcgcatatagactgta

SEQ ID NO: 6258606 - DNA, 22 bp, Homo sapiens
gcgcatcttgcctccaggtgca

SEQ ID NO: 6258607 - DNA, 18 bp, Homo sapiens
gcgcatgcctcccaggcc

SEQ ID NO: 6258608 - DNA, 13 bp, Homo sapiens
gcgcatggcgccc

SEQ ID NO: 6258609 - DNA, 17 bp, Homo sapiens
gcgcatggcgccccggg

SEQ ID NO: 6258610 - DNA, 15 bp, Homo sapiens
gcgcatggtgcagtg

SEQ ID NO: 6258611 - DNA, 21 bp, Homo sapiens
gcgcatgtaatcccagctact

SEQ ID NO: 6258612 - DNA, 22 bp, Homo sapiens
gcgcatgtaatcccagctactc

SEQ ID NO: 6258613 - DNA, 13 bp, Homo sapiens
gcgcatgtctgca

SEQ ID NO: 6258614 - DNA, 14 bp, Homo sapiens
gcgcatgtctgcac

SEQ ID NO: 6258615 - DNA, 21 bp, Homo sapiens
gcgcatgtgtgcatgtgctgt

SEQ ID NO: 6258616 - DNA, 22 bp, Homo sapiens
gcgcattttgtggctgatttca

SEQ ID NO: 6258617 - DNA, 13 bp, Homo sapiens
gcgccaataaacc

SEQ ID NO: 6258618 - DNA, 21 bp, Homo sapiens
gcgccacacactgcacatctt

SEQ ID NO: 6258619 - DNA, 13 bp, Homo sapiens
gcgccacaggacc

SEQ ID NO: 6258620 - DNA, 14 bp, Homo sapiens
gcgccacaggaccc

SEQ ID NO: 6258621 - DNA, 14 bp, Homo sapiens
gcgccaccatcctg

SEQ ID NO: 6258622 - DNA, 14 bp, Homo sapiens
gcgccaccatgccc

SEQ ID NO: 6258623 - DNA, 20 bp, Homo sapiens
gcgccacccaccatcaaagg

SEQ ID NO: 6258624 - DNA, 15 bp, Homo sapiens
gcgccacccgcccgc

SEQ ID NO: 6258625 - DNA, 18 bp, Homo sapiens
gcgccaccgtgcctggct

SEQ ID NO: 6258626 - DNA, 16 bp, Homo sapiens
gcgccaccgtgggaga

SEQ ID NO: 6258627 - DNA, 23 bp, Homo sapiens
gcgccacggcactccagcctggg

SEQ ID NO: 6258628 - DNA, 16 bp, Homo sapiens
gcgccactcgcttccc

SEQ ID NO: 6258629 - DNA, 18 bp, Homo sapiens
gcgccactcgcttccccc

SEQ ID NO: 6258630 - DNA, 19 bp, Homo sapiens
gcgccactgcactccagcc

SEQ ID NO: 6258631 - DNA, 21 bp, Homo sapiens
gcgccactgcactccagcctg

SEQ ID NO: 6258632 - DNA, 23 bp, Homo sapiens
gcgccactgcactccagcctggg

SEQ ID NO: 6258633 - DNA, 11 bp, Homo sapiens
gcgccactgct

SEQ ID NO: 6258634 - DNA, 17 bp, Homo sapiens
gcgccactgtccgctgt

SEQ ID NO: 6258635 - DNA, 15 bp, Homo sapiens
gcgccacttcctttg

SEQ ID NO: 6258636 - DNA, 17 bp, Homo sapiens
gcgccacttcctttgtg

SEQ ID NO: 6258637 - DNA, 17 bp, Homo sapiens
gcgccagcacagaaaca

SEQ ID NO: 6258638 - DNA, 13 bp, Homo sapiens
gcgccagctcctt

SEQ ID NO: 6258639 - DNA, 18 bp, Homo sapiens
gcgccagctccttggggc

SEQ ID NO: 6258640 - DNA, 16 bp, Homo sapiens
gcgccaggaagccaga

SEQ ID NO: 6258641 - DNA, 19 bp, Homo sapiens
gcgccaggaagccagagcc

SEQ ID NO: 6258642 - DNA, 16 bp, Homo sapiens
gcgccaggacagcagc

SEQ ID NO: 6258643 - DNA, 17 bp, Homo sapiens
gcgccaggacagcagca

SEQ ID NO: 6258644 - DNA, 15 bp, Homo sapiens
gcgccaggcagagct

SEQ ID NO: 6258645 - DNA, 16 bp, Homo sapiens
gcgccaggcagagctg

SEQ ID NO: 6258646 - DNA, 15 bp, Homo sapiens
gcgccaggccctcag

SEQ ID NO: 6258647 - DNA, 16 bp, Homo sapiens
gcgccaggctggagat

SEQ ID NO: 6258648 - DNA, 15 bp, Homo sapiens
gcgccagggcccagg

SEQ ID NO: 6258649 - DNA, 18 bp, Homo sapiens
gcgccagggcccaggcca

SEQ ID NO: 6258650 - DNA, 19 bp, Homo sapiens
gcgccagggcccaggccat

SEQ ID NO: 6258651 - DNA, 17 bp, Homo sapiens
gcgccaggggcaggcag

SEQ ID NO: 6258652 - DNA, 14 bp, Homo sapiens
gcgccagtccccgc

SEQ ID NO: 6258653 - DNA, 14 bp, Homo sapiens
gcgccagtcctgct

SEQ ID NO: 6258654 - DNA, 23 bp, Homo sapiens
gcgccagtgtaatcccccaggag

SEQ ID NO: 6258655 - DNA, 12 bp, Homo sapiens
gcgcccacccgg

SEQ ID NO: 6258656 - DNA, 16 bp, Homo sapiens
gcgcccacctgcccag

SEQ ID NO: 6258657 - DNA, 13 bp, Homo sapiens
gcgcccagcagcc

SEQ ID NO: 6258658 - DNA, 19 bp, Homo sapiens
gcgcccagccaagaataaa

SEQ ID NO: 6258659 - DNA, 12 bp, Homo sapiens
gcgcccagccca

SEQ ID NO: 6258660 - DNA, 17 bp, Homo sapiens
gcgcccagcccaggcct

SEQ ID NO: 6258661 - DNA, 18 bp, Homo sapiens
gcgcccagcccaggcctg

SEQ ID NO: 6258662 - DNA, 20 bp, Homo sapiens
gcgcccagcccaggcctggt

SEQ ID NO: 6258663 - DNA, 14 bp, Homo sapiens
gcgcccagctcctg

SEQ ID NO: 6258664 - DNA, 14 bp, Homo sapiens
gcgcccaggcctgc

SEQ ID NO: 6258665 - DNA, 19 bp, Homo sapiens
gcgcccagggctgggagga

SEQ ID NO: 6258666 - DNA, 22 bp, Homo sapiens
gcgcccagtccttccacctcga

SEQ ID NO: 6258667 - DNA, 13 bp, Homo sapiens
gcgccccaggccc

SEQ ID NO: 6258668 - DNA, 15 bp, Homo sapiens
gcgccccagtcactt

SEQ ID NO: 6258669 - DNA, 18 bp, Homo sapiens
gcgccccagtcacttcct

SEQ ID NO: 6258670 - DNA, 12 bp, Homo sapiens
gcgcccccactc

SEQ ID NO: 6258671 - DNA, 19 bp, Homo sapiens
gcgcccccactcctcctcc

SEQ ID NO: 6258672 - DNA, 14 bp, Homo sapiens
gcgcccccaggacc

SEQ ID NO: 6258673 - DNA, 15 bp, Homo sapiens
gcgcccccaggaccc

SEQ ID NO: 6258674 - DNA, 13 bp, Homo sapiens
gcgcccccaggcc

SEQ ID NO: 6258675 - DNA, 21 bp, Homo sapiens
gcgcccccaggcctgccctgc

SEQ ID NO: 6258676 - DNA, 13 bp, Homo sapiens
gcgcccccagtgt

SEQ ID NO: 6258677 - DNA, 16 bp, Homo sapiens
gcgcccccgagccctg

SEQ ID NO: 6258678 - DNA, 20 bp, Homo sapiens
gcgcccccgagccctgactc

SEQ ID NO: 6258679 - DNA, 13 bp, Homo sapiens
gcaaaatagaaga

SEQ ID NO: 6258680 - DNA, 14 bp, Homo sapiens
gcaaaatagaagaa

SEQ ID NO: 6258681 - DNA, 21 bp, Homo sapiens
gcaaaatagaagaagaggaag

SEQ ID NO: 6258682 - DNA, 14 bp, Homo sapiens
gcaaaatagtattg

SEQ ID NO: 6258683 - DNA, 23 bp, Homo sapiens
gcaaaatattggtattaaagaat

SEQ ID NO: 6258684 - DNA, 21 bp, Homo sapiens
gcaaaatcaacatgactggtg

SEQ ID NO: 6258685 - DNA, 15 bp, Homo sapiens
gcaaaatcaagagat

SEQ ID NO: 6258686 - DNA, 19 bp, Homo sapiens
gcaaaatcaagcaagcctc

SEQ ID NO: 6258687 - DNA, 15 bp, Homo sapiens
gcaaaatcaggaaag

SEQ ID NO: 6258688 - DNA, 15 bp, Homo sapiens
gcaaaatcagttttc

SEQ ID NO: 6258689 - DNA, 20 bp, Homo sapiens
gcaaaatcatggaatggtta

SEQ ID NO: 6258690 - DNA, 20 bp, Homo sapiens
gcaaaatcttgttaatgtca

SEQ ID NO: 6258691 - DNA, 21 bp, Homo sapiens
gcaaaatcttgttaatgtcat

SEQ ID NO: 6258692 - DNA, 12 bp, Homo sapiens
gcaaaatgaaga

SEQ ID NO: 6258693 - DNA, 19 bp, Homo sapiens
gcaaaatgcgtatttgcat

SEQ ID NO: 6258694 - DNA, 20 bp, Homo sapiens
gcaaaatgctcttgtccctg

SEQ ID NO: 6258695 - DNA, 22 bp, Homo sapiens
gcaaaatggaacgctaatgaaa

SEQ ID NO: 6258696 - DNA, 20 bp, Homo sapiens
gcaaaatggaagcaaagaca

SEQ ID NO: 6258697 - DNA, 16 bp, Homo sapiens
gcaaaatgttgaagaa

SEQ ID NO: 6258698 - DNA, 15 bp, Homo sapiens
gcaaaattaaatcta

SEQ ID NO: 6258699 - DNA, 17 bp, Homo sapiens
gcaaaattacctacccc

SEQ ID NO: 6258700 - DNA, 18 bp, Homo sapiens
gcaaaattatagaagttt

SEQ ID NO: 6258701 - DNA, 13 bp, Homo sapiens
gcaaaattcctga

SEQ ID NO: 6258702 - DNA, 15 bp, Homo sapiens
gcaaaattcctgtgt

SEQ ID NO: 6258703 - DNA, 17 bp, Homo sapiens
gcaaaattgcaaatctt

SEQ ID NO: 6258704 - DNA, 23 bp, Homo sapiens
gcaaaattgttttcacttgtatt

SEQ ID NO: 6258705 - DNA, 10 bp, Homo sapiens
gcaaaatttc

SEQ ID NO: 6258706 - DNA, 15 bp, Homo sapiens
gcaaaatttctgtat

SEQ ID NO: 6258707 - DNA, 20 bp, Homo sapiens
gcaaaatttgatgccaggac

SEQ ID NO: 6258708 - DNA, 22 bp, Homo sapiens
gcaaaattttacagtaataata

SEQ ID NO: 6258709 - DNA, 15 bp, Homo sapiens
gcaaaatttttaaaa

SEQ ID NO: 6258710 - DNA, 18 bp, Homo sapiens
gcaaacaacctgaatctt

SEQ ID NO: 6258711 - DNA, 19 bp, Homo sapiens
gcaaacaacctgaatcttt

SEQ ID NO: 6258712 - DNA, 14 bp, Homo sapiens
gcaaacaagaaacg

SEQ ID NO: 6258713 - DNA, 22 bp, Homo sapiens
gcaaacaatcccaatctttcta

SEQ ID NO: 6258714 - DNA, 16 bp, Homo sapiens
gcaaacaatggtgtct

SEQ ID NO: 6258715 - DNA, 22 bp, Homo sapiens
gcaaacacagcatgggtccaga

SEQ ID NO: 6258716 - DNA, 15 bp, Homo sapiens
gcaaacaccagtgag

SEQ ID NO: 6258717 - DNA, 14 bp, Homo sapiens
gcaaacactccacc

SEQ ID NO: 6258718 - DNA, 13 bp, Homo sapiens
gcaaacacttgaa

SEQ ID NO: 6258719 - DNA, 20 bp, Homo sapiens
gcaaacactttggccacagc

SEQ ID NO: 6258720 - DNA, 14 bp, Homo sapiens
gcaaacagaaaaag

SEQ ID NO: 6258721 - DNA, 16 bp, Homo sapiens
gcaaacagaacagggt

SEQ ID NO: 6258722 - DNA, 16 bp, Homo sapiens
gcaaacagaagtgcat

SEQ ID NO: 6258723 - DNA, 23 bp, Homo sapiens
gcaaacagaggaagaatttgtta

SEQ ID NO: 6258724 - DNA, 19 bp, Homo sapiens
gcaaacagccctaaataaa

SEQ ID NO: 6258725 - DNA, 19 bp, Homo sapiens
gcaaacagctgaaagagga

SEQ ID NO: 6258726 - DNA, 20 bp, Homo sapiens
gcaaacaggttgttttctac

SEQ ID NO: 6258727 - DNA, 15 bp, Homo sapiens
gcaaacatcaaataa

SEQ ID NO: 6258728 - DNA, 23 bp, Homo sapiens
gcaaacatcaaataaatttctgg

SEQ ID NO: 6258729 - DNA, 19 bp, Homo sapiens
gcaaacatgtgcagatatc

SEQ ID NO: 6258730 - DNA, 10 bp, Homo sapiens
gcaaacattt

SEQ ID NO: 6258731 - DNA, 15 bp, Homo sapiens
gcaaacatttaaaaa

SEQ ID NO: 6258732 - DNA, 13 bp, Homo sapiens
gcaaacatttctt

SEQ ID NO: 6258733 - DNA, 16 bp, Homo sapiens
gcaaacatttcttaaa

SEQ ID NO: 6258734 - DNA, 22 bp, Homo sapiens
gcaaacatttcttaaaatgttt

SEQ ID NO: 6258735 - DNA, 19 bp, Homo sapiens
gcaaaccaacctttctgac

SEQ ID NO: 6258736 - DNA, 18 bp, Homo sapiens
gcaaaccaagagattgct

SEQ ID NO: 6258737 - DNA, 20 bp, Homo sapiens
gcaaaccaagagattgctaa

SEQ ID NO: 6258738 - DNA, 21 bp, Homo sapiens
gcaaaccaagagattgctaat

SEQ ID NO: 6258739 - DNA, 15 bp, Homo sapiens
gcaaaccacactgga

SEQ ID NO: 6258740 - DNA, 14 bp, Homo sapiens
gcaaaccaggactc

SEQ ID NO: 6258741 - DNA, 19 bp, Homo sapiens
gcaaaccatcattgaaatc

SEQ ID NO: 6258742 - DNA, 21 bp, Homo sapiens
gcaaaccatcattgaaatctt

SEQ ID NO: 6258743 - DNA, 18 bp, Homo sapiens
gcaaaccatcatttaatt

SEQ ID NO: 6258744 - DNA, 18 bp, Homo sapiens
gcaaaccatttcaaatgg

SEQ ID NO: 6258745 - DNA, 19 bp, Homo sapiens
gcaaacccaaagatgttaa

SEQ ID NO: 6258746 - DNA, 22 bp, Homo sapiens
gcaaacccagaggtggatgtta

SEQ ID NO: 6258747 - DNA, 22 bp, Homo sapiens
gcaaacccagtgagacagaccg

SEQ ID NO: 6258748 - DNA, 19 bp, Homo sapiens
gcaaacccatgaagctggc

SEQ ID NO: 6258749 - DNA, 18 bp, Homo sapiens
gcaaaccccctttgtgct

SEQ ID NO: 6258750 - DNA, 22 bp, Homo sapiens
gcaaaccctcccagaaacatct

SEQ ID NO: 6258751 - DNA, 16 bp, Homo sapiens
gcaaaccctggtgctt

SEQ ID NO: 6258752 - DNA, 16 bp, Homo sapiens
gcaaacccttctcttc

SEQ ID NO: 6258753 - DNA, 13 bp, Homo sapiens
gcaaacctcagag

SEQ ID NO: 6258754 - DNA, 19 bp, Homo sapiens
gcaaacctcagagggataa

SEQ ID NO: 6258755 - DNA, 19 bp, Homo sapiens
gcaaacctctccttcctca

SEQ ID NO: 6258756 - DNA, 23 bp, Homo sapiens
gcaaacctgcagtttttaatttg

SEQ ID NO: 6258757 - DNA, 13 bp, Homo sapiens
gcaaacctgcccc

SEQ ID NO: 6258758 - DNA, 18 bp, Homo sapiens
gcaaacctgccccatccc

SEQ ID NO: 6258759 - DNA, 17 bp, Homo sapiens
gcaaacctgctggtggg

SEQ ID NO: 6258760 - DNA, 13 bp, Homo sapiens
gcaaaccttcctg

SEQ ID NO: 6258761 - DNA, 15 bp, Homo sapiens
gcaaaccttcctggg

SEQ ID NO: 6258762 - DNA, 16 bp, Homo sapiens
gcaaaccttcctggga

SEQ ID NO: 6258763 - DNA, 22 bp, Homo sapiens
gcaaacctttctataattttac

SEQ ID NO: 6258764 - DNA, 15 bp, Homo sapiens
gcaaacgagactttc

SEQ ID NO: 6258765 - DNA, 15 bp, Homo sapiens
gcaaacgctgcctgc

SEQ ID NO: 6258766 - DNA, 16 bp, Homo sapiens
gcaaacgctgcctgcc

SEQ ID NO: 6258767 - DNA, 16 bp, Homo sapiens
gcaaacgtctattttg

SEQ ID NO: 6258768 - DNA, 19 bp, Homo sapiens
gcaaactaagcccccgctg

SEQ ID NO: 6258769 - DNA, 14 bp, Homo sapiens
gcaaactatgattt

SEQ ID NO: 6258770 - DNA, 18 bp, Homo sapiens
gcaaactatttgcgactc

SEQ ID NO: 6258771 - DNA, 20 bp, Homo sapiens
gcaaactctttggtcgtttt

SEQ ID NO: 6258772 - DNA, 14 bp, Homo sapiens
gcaaactgaaatta

SEQ ID NO: 6258773 - DNA, 21 bp, Homo sapiens
gcaaactgaaattagtgtttt

SEQ ID NO: 6258774 - DNA, 21 bp, Homo sapiens
gcaaactgaagctgcacagtg

SEQ ID NO: 6258775 - DNA, 15 bp, Homo sapiens
gcaaactgatgctga

SEQ ID NO: 6258776 - DNA, 13 bp, Homo sapiens
gcaaactgcttta

SEQ ID NO: 6258777 - DNA, 15 bp, Homo sapiens
gcaaactgtgcttct

SEQ ID NO: 6258778 - DNA, 16 bp, Homo sapiens
gcaaactgtgcttctc

SEQ ID NO: 6258779 - DNA, 18 bp, Homo sapiens
gcaaactgtgcttctcta

SEQ ID NO: 6258780 - DNA, 21 bp, Homo sapiens
gcaaactgtgcttctctatga

SEQ ID NO: 6258781 - DNA, 15 bp, Homo sapiens
gcaaacttcagagtt

SEQ ID NO: 6258782 - DNA, 20 bp, Homo sapiens
gcaaacttgtatctgaagac

SEQ ID NO: 6258783 - DNA, 16 bp, Homo sapiens
gcaaactttagtgtct

SEQ ID NO: 6258784 - DNA, 23 bp, Homo sapiens
gcaaactttgtatgtcatttcct

SEQ ID NO: 6258785 - DNA, 19 bp, Homo sapiens
gcaaagaaaacacacaaaa

SEQ ID NO: 6258786 - DNA, 23 bp, Homo sapiens
gcaaagaaagtgggaggtcagga

SEQ ID NO: 6258787 - DNA, 14 bp, Homo sapiens
gcaaagaattgact

SEQ ID NO: 6258788 - DNA, 15 bp, Homo sapiens
gcaaagacaaaagaa

SEQ ID NO: 6258789 - DNA, 15 bp, Homo sapiens
gcaaagacagaagcc

SEQ ID NO: 6258790 - DNA, 17 bp, Homo sapiens
gcaaagacagaagcctc

SEQ ID NO: 6258791 - DNA, 21 bp, Homo sapiens
gcaaagacagtatttattggt

SEQ ID NO: 6258792 - DNA, 19 bp, Homo sapiens
gcaaagacagtttcttgca

SEQ ID NO: 6258793 - DNA, 19 bp, Homo sapiens
gcaaagacctacctccaga

SEQ ID NO: 6258794 - DNA, 12 bp, Homo sapiens
gcaaagactctg

SEQ ID NO: 6258795 - DNA, 14 bp, Homo sapiens
gcaaagactctgag

SEQ ID NO: 6258796 - DNA, 15 bp, Homo sapiens
gcaaagactctgagc

SEQ ID NO: 6258797 - DNA, 17 bp, Homo sapiens
gcaaagactctgagcca

SEQ ID NO: 6258798 - DNA, 19 bp, Homo sapiens
gcaaagagacatttcaaaa

SEQ ID NO: 6258799 - DNA, 19 bp, Homo sapiens
gcaaagagacccagtcaat

SEQ ID NO: 6258800 - DNA, 20 bp, Homo sapiens
gcaaagaggactcgcttgta

SEQ ID NO: 6258801 - DNA, 16 bp, Homo sapiens
gcaaagaggggcgctg

SEQ ID NO: 6258802 - DNA, 23 bp, Homo sapiens
gcaaagaggtgctgctttgcttc

SEQ ID NO: 6258803 - DNA, 21 bp, Homo sapiens
gcaaagataatttatttcaat

SEQ ID NO: 6258804 - DNA, 15 bp, Homo sapiens
gcaaagatatatatt

SEQ ID NO: 6258805 - DNA, 16 bp, Homo sapiens
gcaaagatcaaaataa

SEQ ID NO: 6258806 - DNA, 21 bp, Homo sapiens
gcaaagatctgtcctcagcct

SEQ ID NO: 6258807 - DNA, 22 bp, Homo sapiens
gcaaagatctgtcctcagcctt

SEQ ID NO: 6258808 - DNA, 14 bp, Homo sapiens
gcaaagatgaaggt

SEQ ID NO: 6258809 - DNA, 18 bp, Homo sapiens
gcaaagatggtaaaaaga

SEQ ID NO: 6258810 - DNA, 19 bp, Homo sapiens
gcaaagatggtaaaaagaa

SEQ ID NO: 6258811 - DNA, 18 bp, Homo sapiens
gcaaagatggtggctgtg

SEQ ID NO: 6258812 - DNA, 21 bp, Homo sapiens
gcaaagatggtggctgtgtct

SEQ ID NO: 6258813 - DNA, 16 bp, Homo sapiens
gcaaagatttaatctg

SEQ ID NO: 6258814 - DNA, 16 bp, Homo sapiens
gcaaagatttcagtag

SEQ ID NO: 6258815 - DNA, 21 bp, Homo sapiens
gcaaagatttcagtagaattt

SEQ ID NO: 6258816 - DNA, 22 bp, Homo sapiens
gcaaagatttcagtagaatttt

SEQ ID NO: 6258817 - DNA, 17 bp, Homo sapiens
gcaaagcaatcttttat

SEQ ID NO: 6258818 - DNA, 14 bp, Homo sapiens
gcaaagcacagaga

SEQ ID NO: 6258819 - DNA, 17 bp, Homo sapiens
gcaaagcactctctgca

SEQ ID NO: 6258820 - DNA, 22 bp, Homo sapiens
gcaaagcagcaactattcacaa

SEQ ID NO: 6258821 - DNA, 20 bp, Homo sapiens
gcaaagcatgttttgcatgt

SEQ ID NO: 6258822 - DNA, 19 bp, Homo sapiens
gcaaagcatttgagctgtg

SEQ ID NO: 6258823 - DNA, 14 bp, Homo sapiens
gcaaagccaaggca

SEQ ID NO: 6258824 - DNA, 10 bp, Homo sapiens
gcaaagccag

SEQ ID NO: 6258825 - DNA, 12 bp, Homo sapiens
gcaaagccagaa

SEQ ID NO: 6258826 - DNA, 20 bp, Homo sapiens
gcaaagccatattctaaatt

SEQ ID NO: 6258827 - DNA, 23 bp, Homo sapiens
gcaaagccccatgctggagcctg

SEQ ID NO: 6258828 - DNA, 23 bp, Homo sapiens
gcaaagcccttggaacaccctgg

SEQ ID NO: 6258829 - DNA, 15 bp, Homo sapiens
gcaaagcctccagca

SEQ ID NO: 6258830 - DNA, 21 bp, Homo sapiens
gcaaagcctgttcatggcaga

SEQ ID NO: 6258831 - DNA, 15 bp, Homo sapiens
gcaaagcctttaaat

SEQ ID NO: 6258832 - DNA, 16 bp, Homo sapiens
gcaaagcctttaaatt

SEQ ID NO: 6258833 - DNA, 14 bp, Homo sapiens
gcaaagcgacagat

SEQ ID NO: 6258834 - DNA, 14 bp, Homo sapiens
gcaaagcgacgtta

SEQ ID NO: 6258835 - DNA, 18 bp, Homo sapiens
gcaaagctacaggactgg

SEQ ID NO: 6258836 - DNA, 16 bp, Homo sapiens
gcaaagctctgtggcc

SEQ ID NO: 6258837 - DNA, 13 bp, Homo sapiens
gcaaagctgattt

SEQ ID NO: 6258838 - DNA, 14 bp, Homo sapiens
gcaaagctgctggg

SEQ ID NO: 6258839 - DNA, 20 bp, Homo sapiens
gcaaagctgctgggccagtg

SEQ ID NO: 6258840 - DNA, 12 bp, Homo sapiens
gcaaagctgctt

SEQ ID NO: 6258841 - DNA, 17 bp, Homo sapiens
gcaaagctgttcttcct

SEQ ID NO: 6258842 - DNA, 18 bp, Homo sapiens
gcaaaggaaaccaaagga

SEQ ID NO: 6258843 - DNA, 14 bp, Homo sapiens
gcaaaggaccagcg

SEQ ID NO: 6258844 - DNA, 20 bp, Homo sapiens
gcaaaggagagtcctgggag

SEQ ID NO: 6258845 - DNA, 17 bp, Homo sapiens
gcaaaggagggcctcag

SEQ ID NO: 6258846 - DNA, 21 bp, Homo sapiens
gcaaaggagggcctcagagac

SEQ ID NO: 6258847 - DNA, 22 bp, Homo sapiens
gcaaaggagggcctcagagaca

SEQ ID NO: 6258848 - DNA, 22 bp, Homo sapiens
gcaaaggaggggaaacaatgaa

SEQ ID NO: 6258849 - DNA, 14 bp, Homo sapiens
gcaaaggcagagga

SEQ ID NO: 6258850 - DNA, 15 bp, Homo sapiens
gcaaaggcagaggaa

SEQ ID NO: 6258851 - DNA, 15 bp, Homo sapiens
gcaaaggcccatgcc

SEQ ID NO: 6258852 - DNA, 16 bp, Homo sapiens
gcaaaggcccatgccc

SEQ ID NO: 6258853 - DNA, 17 bp, Homo sapiens
gcaaaggcccatgcccc

SEQ ID NO: 6258854 - DNA, 14 bp, Homo sapiens
gcaaaggcccggct

SEQ ID NO: 6258855 - DNA, 12 bp, Homo sapiens
gcaaaggccctg

SEQ ID NO: 6258856 - DNA, 15 bp, Homo sapiens
gcaaaggcctgggct

SEQ ID NO: 6258857 - DNA, 12 bp, Homo sapiens
gcaaaggctccc

SEQ ID NO: 6258858 - DNA, 22 bp, Homo sapiens
gcgcccccgagccctgactcct

SEQ ID NO: 6258859 - DNA, 13 bp, Homo sapiens
gcgcccccgcccc

SEQ ID NO: 6258860 - DNA, 16 bp, Homo sapiens
gcgcccccgccccagg

SEQ ID NO: 6258861 - DNA, 21 bp, Homo sapiens
gcgccccctccgccctgccac

SEQ ID NO: 6258862 - DNA, 15 bp, Homo sapiens
gcgccccctggtggg

SEQ ID NO: 6258863 - DNA, 22 bp, Homo sapiens
gcgccccgaaaggtcacctcac

SEQ ID NO: 6258864 - DNA, 16 bp, Homo sapiens
gcgccccgcccacacc

SEQ ID NO: 6258865 - DNA, 14 bp, Homo sapiens
gcgccccgccccca

SEQ ID NO: 6258866 - DNA, 21 bp, Homo sapiens
gcgcccctctgcgccccagcg

SEQ ID NO: 6258867 - DNA, 19 bp, Homo sapiens
gcgcccctctttttcccct

SEQ ID NO: 6258868 - DNA, 18 bp, Homo sapiens
gcgcccctgcctgtgccc

SEQ ID NO: 6258869 - DNA, 14 bp, Homo sapiens
gcgcccctgctgtc

SEQ ID NO: 6258870 - DNA, 15 bp, Homo sapiens
gcgcccctgctgtct

SEQ ID NO: 6258871 - DNA, 15 bp, Homo sapiens
gcgcccctgggacta

SEQ ID NO: 6258872 - DNA, 14 bp, Homo sapiens
gcgcccctgggaga

SEQ ID NO: 6258873 - DNA, 12 bp, Homo sapiens
gcgcccctgggg

SEQ ID NO: 6258874 - DNA, 16 bp, Homo sapiens
gcgcccgcccctgcag

SEQ ID NO: 6258875 - DNA, 15 bp, Homo sapiens
gcgcccgccgcctcc

SEQ ID NO: 6258876 - DNA, 17 bp, Homo sapiens
gcgcccgcggcgcgacc

SEQ ID NO: 6258877 - DNA, 14 bp, Homo sapiens
gcgcccgctgggct

SEQ ID NO: 6258878 - DNA, 22 bp, Homo sapiens
gcgcccggactgaccgaaggga

SEQ ID NO: 6258879 - DNA, 14 bp, Homo sapiens
gcgcccggcccaag

SEQ ID NO: 6258880 - DNA, 14 bp, Homo sapiens
gcgccctccctccc

SEQ ID NO: 6258881 - DNA, 20 bp, Homo sapiens
gcgccctccctccctccaca

SEQ ID NO: 6258882 - DNA, 18 bp, Homo sapiens
gcgccctccctccgcctc

SEQ ID NO: 6258883 - DNA, 19 bp, Homo sapiens
gcgccctccgacctctctc

SEQ ID NO: 6258884 - DNA, 21 bp, Homo sapiens
gcgccctctctgctccttcac

SEQ ID NO: 6258885 - DNA, 14 bp, Homo sapiens
gcgccctctgtcct

SEQ ID NO: 6258886 - DNA, 12 bp, Homo sapiens
gcgccctgcagg

SEQ ID NO: 6258887 - DNA, 17 bp, Homo sapiens
gcgccctgcagggccgg

SEQ ID NO: 6258888 - DNA, 13 bp, Homo sapiens
gcgccctggactt

SEQ ID NO: 6258889 - DNA, 14 bp, Homo sapiens
gcgccctggacttg

SEQ ID NO: 6258890 - DNA, 20 bp, Homo sapiens
gcgcccttgtgccctgcctc

SEQ ID NO: 6258891 - DNA, 14 bp, Homo sapiens
gcgccgatgccacc

SEQ ID NO: 6258892 - DNA, 22 bp, Homo sapiens
gcgccgccgccgcgcgcccctg

SEQ ID NO: 6258893 - DNA, 17 bp, Homo sapiens
gcgccgcgtggacagcc

SEQ ID NO: 6258894 - DNA, 17 bp, Homo sapiens
gcgccggcgccccggac

SEQ ID NO: 6258895 - DNA, 20 bp, Homo sapiens
gcgccggcgccccggacgcc

SEQ ID NO: 6258896 - DNA, 18 bp, Homo sapiens
gcgccggcgggcgggccg

SEQ ID NO: 6258897 - DNA, 19 bp, Homo sapiens
gcgccggggggagggagga

SEQ ID NO: 6258898 - DNA, 16 bp, Homo sapiens
gcgccggttccacgtg

SEQ ID NO: 6258899 - DNA, 13 bp, Homo sapiens
gcgccgtctccag

SEQ ID NO: 6258900 - DNA, 23 bp, Homo sapiens
gcgccgtgagttctcagggctcc

SEQ ID NO: 6258901 - DNA, 15 bp, Homo sapiens
gcgccgtgctgggca

SEQ ID NO: 6258902 - DNA, 16 bp, Homo sapiens
gcgccgtgctgggcag

SEQ ID NO: 6258903 - DNA, 18 bp, Homo sapiens
gcgccgtgctgggcagcc

SEQ ID NO: 6258904 - DNA, 21 bp, Homo sapiens
gcgcctacaggagtgagcact

SEQ ID NO: 6258905 - DNA, 24 bp, Homo sapiens
gcgcctacccttcccgcctccctc

SEQ ID NO: 6258906 - DNA, 19 bp, Homo sapiens
gcgcctagagcgcggctgg

SEQ ID NO: 6258907 - DNA, 16 bp, Homo sapiens
gcgcctcacctgcatc

SEQ ID NO: 6258908 - DNA, 20 bp, Homo sapiens
gcgcctcagttacacaggaa

SEQ ID NO: 6258909 - DNA, 15 bp, Homo sapiens
gcgcctccaccctgc

SEQ ID NO: 6258910 - DNA, 17 bp, Homo sapiens
gcgcctccaccctgccc

SEQ ID NO: 6258911 - DNA, 19 bp, Homo sapiens
gcgcctccaccctgccctg

SEQ ID NO: 6258912 - DNA, 15 bp, Homo sapiens
gcgcctccagaggtc

SEQ ID NO: 6258913 - DNA, 12 bp, Homo sapiens
gcgcctccatcc

SEQ ID NO: 6258914 - DNA, 21 bp, Homo sapiens
gcgcctccatccatctgtccg

SEQ ID NO: 6258915 - DNA, 17 bp, Homo sapiens
gcgcctcccgccgcctc

SEQ ID NO: 6258916 - DNA, 14 bp, Homo sapiens
gcgcctccctccac

SEQ ID NO: 6258917 - DNA, 19 bp, Homo sapiens
gcgcctccctccaccccag

SEQ ID NO: 6258918 - DNA, 22 bp, Homo sapiens
gcgcctccctccaccccaggac

SEQ ID NO: 6258919 - DNA, 23 bp, Homo sapiens
gcgcctccctccaccccaggacg

SEQ ID NO: 6258920 - DNA, 17 bp, Homo sapiens
gcgcctcctcctgcatg

SEQ ID NO: 6258921 - DNA, 13 bp, Homo sapiens
gcgcctcctggac

SEQ ID NO: 6258922 - DNA, 14 bp, Homo sapiens
gcgcctcctggaca

SEQ ID NO: 6258923 - DNA, 20 bp, Homo sapiens
gcgcctcgccccagccaagc

SEQ ID NO: 6258924 - DNA, 18 bp, Homo sapiens
gcgcctcgttctctgggt

SEQ ID NO: 6258925 - DNA, 16 bp, Homo sapiens
gcgcctctccactgtt

SEQ ID NO: 6258926 - DNA, 14 bp, Homo sapiens
gcgcctctcctggg

SEQ ID NO: 6258927 - DNA, 12 bp, Homo sapiens
gcgcctcttcct

SEQ ID NO: 6258928 - DNA, 14 bp, Homo sapiens
gcgcctcttcctct

SEQ ID NO: 6258929 - DNA, 19 bp, Homo sapiens
gcgcctgagtgagtgtgtg

SEQ ID NO: 6258930 - DNA, 21 bp, Homo sapiens
gcgcctgcacctgcgcctggc

SEQ ID NO: 6258931 - DNA, 14 bp, Homo sapiens
gcgcctgcaggcag

SEQ ID NO: 6258932 - DNA, 15 bp, Homo sapiens
gcgcctgcaggcaga

SEQ ID NO: 6258933 - DNA, 18 bp, Homo sapiens
gcgcctgcaggcagagct

SEQ ID NO: 6258934 - DNA, 21 bp, Homo sapiens
gcgcctgcaggcagagctgga

SEQ ID NO: 6258935 - DNA, 17 bp, Homo sapiens
gcgcctgcccgcccgcc

SEQ ID NO: 6258936 - DNA, 11 bp, Homo sapiens
gcgcctgccct

SEQ ID NO: 6258937 - DNA, 20 bp, Homo sapiens
gcgcctgccctccctggggt

SEQ ID NO: 6258938 - DNA, 13 bp, Homo sapiens
gcgcctgccctgc

SEQ ID NO: 6258939 - DNA, 14 bp, Homo sapiens
gcgcctgccctgcc

SEQ ID NO: 6258940 - DNA, 13 bp, Homo sapiens
gcgcctgcgcctc

SEQ ID NO: 6258941 - DNA, 16 bp, Homo sapiens
gcgcctgcgcctcctc

SEQ ID NO: 6258942 - DNA, 17 bp, Homo sapiens
gcgcctgcgctcctctg

SEQ ID NO: 6258943 - DNA, 17 bp, Homo sapiens
gcgcctgcgttcccaga

SEQ ID NO: 6258944 - DNA, 16 bp, Homo sapiens
gcgcctgctgcatgcc

SEQ ID NO: 6258945 - DNA, 19 bp, Homo sapiens
gcgcctgctgcctgctgag

SEQ ID NO: 6258946 - DNA, 16 bp, Homo sapiens
gcgcctggagggatgc

SEQ ID NO: 6258947 - DNA, 13 bp, Homo sapiens
gcgcctggcacat

SEQ ID NO: 6258948 - DNA, 19 bp, Homo sapiens
gcgcctggcacatttcagg

SEQ ID NO: 6258949 - DNA, 23 bp, Homo sapiens
gcgcctggcacatttcagggaga

SEQ ID NO: 6258950 - DNA, 14 bp, Homo sapiens
gcgcctgggtcctc

SEQ ID NO: 6258951 - DNA, 17 bp, Homo sapiens
gcgcctgtataagtaga

SEQ ID NO: 6258952 - DNA, 18 bp, Homo sapiens
gcgcctgtcccctcacag

SEQ ID NO: 6258953 - DNA, 13 bp, Homo sapiens
gcgcctgtcgggc

SEQ ID NO: 6258954 - DNA, 16 bp, Homo sapiens
gcgcctgtcgggcccg

SEQ ID NO: 6258955 - DNA, 12 bp, Homo sapiens
gcgcctgtgacc

SEQ ID NO: 6258956 - DNA, 17 bp, Homo sapiens
gcgcctgtgcacacaca

SEQ ID NO: 6258957 - DNA, 18 bp, Homo sapiens
gcgccttcctgggttggc

SEQ ID NO: 6258958 - DNA, 19 bp, Homo sapiens
gcgccttcgtgcctgagac

SEQ ID NO: 6258959 - DNA, 18 bp, Homo sapiens
gcgccttctacctgcagg

SEQ ID NO: 6258960 - DNA, 18 bp, Homo sapiens
gcgccttctcggagctgg

SEQ ID NO: 6258961 - DNA, 23 bp, Homo sapiens
gcgccttgtctcctactcctgac

SEQ ID NO: 6258962 - DNA, 14 bp, Homo sapiens
gcgcgactgagaac

SEQ ID NO: 6258963 - DNA, 15 bp, Homo sapiens
gcgcgatctcagctc

SEQ ID NO: 6258964 - DNA, 14 bp, Homo sapiens
gcgcgcaccgccca

SEQ ID NO: 6258965 - DNA, 17 bp, Homo sapiens
gcgcgcaggcagggaga

SEQ ID NO: 6258966 - DNA, 14 bp, Homo sapiens
gcgcgcccccagga

SEQ ID NO: 6258967 - DNA, 14 bp, Homo sapiens
gcgcgcccctagcc

SEQ ID NO: 6258968 - DNA, 12 bp, Homo sapiens
gcgcgcctgcct

SEQ ID NO: 6258969 - DNA, 13 bp, Homo sapiens
gcgcgcctgcctt

SEQ ID NO: 6258970 - DNA, 18 bp, Homo sapiens
gcgcgcgcccccaggacc

SEQ ID NO: 6258971 - DNA, 22 bp, Homo sapiens
gcgcgcgggacagcggccccgc

SEQ ID NO: 6258972 - DNA, 13 bp, Homo sapiens
gcgcgctcctgac

SEQ ID NO: 6258973 - DNA, 13 bp, Homo sapiens
gcgcgctctctct

SEQ ID NO: 6258974 - DNA, 12 bp, Homo sapiens
gcgcggccagcg

SEQ ID NO: 6258975 - DNA, 17 bp, Homo sapiens
gcgcggcctcccgagga

SEQ ID NO: 6258976 - DNA, 12 bp, Homo sapiens
gcgcggctggga

SEQ ID NO: 6258977 - DNA, 20 bp, Homo sapiens
gcgcgggacagcggccccgc

SEQ ID NO: 6258978 - DNA, 17 bp, Homo sapiens
gcgcgggaggcaccagc

SEQ ID NO: 6258979 - DNA, 17 bp, Homo sapiens
gcgcggggagcccgtcg

SEQ ID NO: 6258980 - DNA, 15 bp, Homo sapiens
gcgcggtggctcacg

SEQ ID NO: 6258981 - DNA, 19 bp, Homo sapiens
gcgcggtggctcacgcctg

SEQ ID NO: 6258982 - DNA, 21 bp, Homo sapiens
gcgcggttcaggtcagggcta

SEQ ID NO: 6258983 - DNA, 14 bp, Homo sapiens
gcgcgtgaggcccg

SEQ ID NO: 6258984 - DNA, 19 bp, Homo sapiens
gcgcgtgcatgtgtgcgtg

SEQ ID NO: 6258985 - DNA, 13 bp, Homo sapiens
gcgcgtgccccca

SEQ ID NO: 6258986 - DNA, 20 bp, Homo sapiens
gcgcgtgtgggtctctgggc

SEQ ID NO: 6258987 - DNA, 20 bp, Homo sapiens
gcgctaacttgcttaaatgt

SEQ ID NO: 6258988 - DNA, 22 bp, Homo sapiens
gcgctaattcaaggaatttctt

SEQ ID NO: 6258989 - DNA, 13 bp, Homo sapiens
gcgctacccactt

SEQ ID NO: 6258990 - DNA, 18 bp, Homo sapiens
gcgctagcacagctccct

SEQ ID NO: 6258991 - DNA, 14 bp, Homo sapiens
gcgctagcagccct

SEQ ID NO: 6258992 - DNA, 17 bp, Homo sapiens
gcgctagcagcccttgt

SEQ ID NO: 6258993 - DNA, 21 bp, Homo sapiens
gcgctagtgccttgcccacag

SEQ ID NO: 6258994 - DNA, 20 bp, Homo sapiens
gcgctatctccctgcctcct

SEQ ID NO: 6258995 - DNA, 20 bp, Homo sapiens
gcgctattgcactccagtct

SEQ ID NO: 6258996 - DNA, 14 bp, Homo sapiens
gcgctcagacccca

SEQ ID NO: 6258997 - DNA, 19 bp, Homo sapiens
gcgctcagacggcggccag

SEQ ID NO: 6258998 - DNA, 21 bp, Homo sapiens
gcgctcagaggccgctctggg

SEQ ID NO: 6258999 - DNA, 13 bp, Homo sapiens
gcgctcagatgcc

SEQ ID NO: 6259000 - DNA, 17 bp, Homo sapiens
gcgctcagcagccctag

SEQ ID NO: 6259001 - DNA, 16 bp, Homo sapiens
gcgctcaggacccagg

SEQ ID NO: 6259002 - DNA, 18 bp, Homo sapiens
gcgctcaggacccaggcc

SEQ ID NO: 6259003 - DNA, 22 bp, Homo sapiens
gcgctcaggggctccatgctgg

SEQ ID NO: 6259004 - DNA, 15 bp, Homo sapiens
gcgctcagtaaacgg

SEQ ID NO: 6259005 - DNA, 17 bp, Homo sapiens
gcgctcagtaaacggga

SEQ ID NO: 6259006 - DNA, 18 bp, Homo sapiens
gcgctcatgttgagccag

SEQ ID NO: 6259007 - DNA, 14 bp, Homo sapiens
gcgctcccagcctg

SEQ ID NO: 6259008 - DNA, 21 bp, Homo sapiens
gcgctcccagcctgccctcca

SEQ ID NO: 6259009 - DNA, 14 bp, Homo sapiens
gcgctcccgcattt

SEQ ID NO: 6259010 - DNA, 20 bp, Homo sapiens
gcgctcccgggcctcagggt

SEQ ID NO: 6259011 - DNA, 24 bp, Homo sapiens
gcgctcccgggcctcagggtcctg

SEQ ID NO: 6259012 - DNA, 14 bp, Homo sapiens
gcgctccgggcttt

SEQ ID NO: 6259013 - DNA, 14 bp, Homo sapiens
gcgctcctcccagc

SEQ ID NO: 6259014 - DNA, 17 bp, Homo sapiens
gcgctcctctgcagcct

SEQ ID NO: 6259015 - DNA, 18 bp, Homo sapiens
gcgctcctctgcagcctg

SEQ ID NO: 6259016 - DNA, 19 bp, Homo sapiens
gcgctcctggcccagcctt

SEQ ID NO: 6259017 - DNA, 12 bp, Homo sapiens
gcgctcctggct

SEQ ID NO: 6259018 - DNA, 14 bp, Homo sapiens
gcgctcctggcttt

SEQ ID NO: 6259019 - DNA, 15 bp, Homo sapiens
gcgctcctggctttt

SEQ ID NO: 6259020 - DNA, 15 bp, Homo sapiens
gcgctcgcccagcag

SEQ ID NO: 6259021 - DNA, 15 bp, Homo sapiens
gcgctcggcaggaag

SEQ ID NO: 6259022 - DNA, 16 bp, Homo sapiens
gcgctcggcaggaagg

SEQ ID NO: 6259023 - DNA, 15 bp, Homo sapiens
gcgctcggcccggag

SEQ ID NO: 6259024 - DNA, 15 bp, Homo sapiens
gcgctcggggctggg

SEQ ID NO: 6259025 - DNA, 17 bp, Homo sapiens
gcgctcggtctccaccc

SEQ ID NO: 6259026 - DNA, 22 bp, Homo sapiens
gcgctcggtctccaccccaggg

SEQ ID NO: 6259027 - DNA, 16 bp, Homo sapiens
gcgctctagcctgggc

SEQ ID NO: 6259028 - DNA, 20 bp, Homo sapiens
gcgctctcaagaccagagac

SEQ ID NO: 6259029 - DNA, 13 bp, Homo sapiens
gcgctctccacca

SEQ ID NO: 6259030 - DNA, 16 bp, Homo sapiens
gcgctctccctacctt

SEQ ID NO: 6259031 - DNA, 19 bp, Homo sapiens
gcgctctccctaccttgcc

SEQ ID NO: 6259032 - DNA, 13 bp, Homo sapiens
gcgctctcctgga

SEQ ID NO: 6259033 - DNA, 19 bp, Homo sapiens
gcgctctctttgcaactgt

SEQ ID NO: 6259034 - DNA, 14 bp, Homo sapiens
gcgctctgcatgct

SEQ ID NO: 6259035 - DNA, 19 bp, Homo sapiens
gcgctctgcatgctcctct

SEQ ID NO: 6259036 - DNA, 14 bp, Homo sapiens
gcgctctgcccctc

SEQ ID NO: 6259037 - DNA, 18 bp, Homo sapiens
gcgctctgcccctccgtc

SEQ ID NO: 6259038 - DNA, 20 bp, Homo sapiens
gcgctctgcccctccgtccc

SEQ ID NO: 6259039 - DNA, 17 bp, Homo sapiens
gcaaaggctccctcgcc

SEQ ID NO: 6259040 - DNA, 18 bp, Homo sapiens
gcaaaggctccctcgccc

SEQ ID NO: 6259041 - DNA, 18 bp, Homo sapiens
gcaaagggagcactgggt

SEQ ID NO: 6259042 - DNA, 20 bp, Homo sapiens
gcaaagggagcactgggttg

SEQ ID NO: 6259043 - DNA, 18 bp, Homo sapiens
gcaaagggagcagaactg

SEQ ID NO: 6259044 - DNA, 19 bp, Homo sapiens
gcaaagggattactagaga

SEQ ID NO: 6259045 - DNA, 14 bp, Homo sapiens
gcaaagggcaagga

SEQ ID NO: 6259046 - DNA, 20 bp, Homo sapiens
gcaaagggcatgggtcggga

SEQ ID NO: 6259047 - DNA, 22 bp, Homo sapiens
gcaaagggcatgggtcgggaga

SEQ ID NO: 6259048 - DNA, 13 bp, Homo sapiens
gcaaagggctgcc

SEQ ID NO: 6259049 - DNA, 20 bp, Homo sapiens
gcaaagggcttggtggccaa

SEQ ID NO: 6259050 - DNA, 14 bp, Homo sapiens
gcaaaggggggagg

SEQ ID NO: 6259051 - DNA, 18 bp, Homo sapiens
gcaaagggtccagaagga

SEQ ID NO: 6259052 - DNA, 22 bp, Homo sapiens
gcaaagggtccagaaggagaca

SEQ ID NO: 6259053 - DNA, 12 bp, Homo sapiens
gcaaagggtctt

SEQ ID NO: 6259054 - DNA, 18 bp, Homo sapiens
gcaaagggtcttttgcag

SEQ ID NO: 6259055 - DNA, 19 bp, Homo sapiens
gcaaaggtcaagactgtgg

SEQ ID NO: 6259056 - DNA, 21 bp, Homo sapiens
gcaaaggtccctgagctcttg

SEQ ID NO: 6259057 - DNA, 16 bp, Homo sapiens
gcaaaggtcttgaata

SEQ ID NO: 6259058 - DNA, 16 bp, Homo sapiens
gcaaaggtgcactcca

SEQ ID NO: 6259059 - DNA, 18 bp, Homo sapiens
gcaaaggtgcactccaga

SEQ ID NO: 6259060 - DNA, 20 bp, Homo sapiens
gcaaaggtgcactccagact

SEQ ID NO: 6259061 - DNA, 14 bp, Homo sapiens
gcaaaggtgcctca

SEQ ID NO: 6259062 - DNA, 21 bp, Homo sapiens
gcaaaggtggcaatgcttaaa

SEQ ID NO: 6259063 - DNA, 18 bp, Homo sapiens
gcaaaggtggctctccag

SEQ ID NO: 6259064 - DNA, 18 bp, Homo sapiens
gcaaaggtgtgcttcctg

SEQ ID NO: 6259065 - DNA, 19 bp, Homo sapiens
gcaaaggttccaactgtat

SEQ ID NO: 6259066 - DNA, 17 bp, Homo sapiens
gcaaagtaaaattagag

SEQ ID NO: 6259067 - DNA, 12 bp, Homo sapiens
gcaaagtacaaa

SEQ ID NO: 6259068 - DNA, 20 bp, Homo sapiens
gcaaagtacaggtactttgt

SEQ ID NO: 6259069 - DNA, 17 bp, Homo sapiens
gcaaagtaccaactgag

SEQ ID NO: 6259070 - DNA, 11 bp, Homo sapiens
gcaaagtactg

SEQ ID NO: 6259071 - DNA, 13 bp, Homo sapiens
gcaaagtactgta

SEQ ID NO: 6259072 - DNA, 14 bp, Homo sapiens
gcaaagtactgtaa

SEQ ID NO: 6259073 - DNA, 23 bp, Homo sapiens
gcaaagtagtacttcttctgtaa

SEQ ID NO: 6259074 - DNA, 15 bp, Homo sapiens
gcaaagtattgtaaa

SEQ ID NO: 6259075 - DNA, 17 bp, Homo sapiens
gcaaagtattgtaaatt

SEQ ID NO: 6259076 - DNA, 20 bp, Homo sapiens
gcaaagtattgtaaattata

SEQ ID NO: 6259077 - DNA, 16 bp, Homo sapiens
gcaaagtcacttctcc

SEQ ID NO: 6259078 - DNA, 20 bp, Homo sapiens
gcaaagtcacttctccatca

SEQ ID NO: 6259079 - DNA, 14 bp, Homo sapiens
gcaaagtcctcctt

SEQ ID NO: 6259080 - DNA, 14 bp, Homo sapiens
gcaaagtcgccagt

SEQ ID NO: 6259081 - DNA, 18 bp, Homo sapiens
gcaaagtcgccagtcact

SEQ ID NO: 6259082 - DNA, 22 bp, Homo sapiens
gcaaagtcgccagtcactgctg

SEQ ID NO: 6259083 - DNA, 23 bp, Homo sapiens
gcaaagtcgccagtcactgctgc

SEQ ID NO: 6259084 - DNA, 15 bp, Homo sapiens
gcaaagtctaaagtt

SEQ ID NO: 6259085 - DNA, 22 bp, Homo sapiens
gcaaagtctctcatttctttca

SEQ ID NO: 6259086 - DNA, 16 bp, Homo sapiens
gcaaagtgaagtgatg

SEQ ID NO: 6259087 - DNA, 22 bp, Homo sapiens
gcaaagtgaagttgcttcttct

SEQ ID NO: 6259088 - DNA, 17 bp, Homo sapiens
gcaaagtgagggccgag

SEQ ID NO: 6259089 - DNA, 18 bp, Homo sapiens
gcaaagtgctagccactg

SEQ ID NO: 6259090 - DNA, 16 bp, Homo sapiens
gcaaagtgctgtaccc

SEQ ID NO: 6259091 - DNA, 15 bp, Homo sapiens
gcaaagtggcaggga

SEQ ID NO: 6259092 - DNA, 20 bp, Homo sapiens
gcaaagtggcagggaccggc

SEQ ID NO: 6259093 - DNA, 18 bp, Homo sapiens
gcaaagtgttgtcttatt

SEQ ID NO: 6259094 - DNA, 12 bp, Homo sapiens
gcaaagtgtttt

SEQ ID NO: 6259095 - DNA, 23 bp, Homo sapiens
gcaaagtgttttctcagaacagc

SEQ ID NO: 6259096 - DNA, 17 bp, Homo sapiens
gcaaagtgttttgtacc

SEQ ID NO: 6259097 - DNA, 16 bp, Homo sapiens
gcaaagttatcttaaa

SEQ ID NO: 6259098 - DNA, 17 bp, Homo sapiens
gcaaagttatcttaaat

SEQ ID NO: 6259099 - DNA, 18 bp, Homo sapiens
gcaaagttatcttaaata

SEQ ID NO: 6259100 - DNA, 17 bp, Homo sapiens
gcaaagttcaacttatt

SEQ ID NO: 6259101 - DNA, 17 bp, Homo sapiens
gcaaagtttaaatgtat

SEQ ID NO: 6259102 - DNA, 14 bp, Homo sapiens
gcaaagtttacaga

SEQ ID NO: 6259103 - DNA, 22 bp, Homo sapiens
gcaaagttttccatttttgtca

SEQ ID NO: 6259104 - DNA, 20 bp, Homo sapiens
gcaaataaaacgctttcccc

SEQ ID NO: 6259105 - DNA, 16 bp, Homo sapiens
gcaaataaagcctgct

SEQ ID NO: 6259106 - DNA, 20 bp, Homo sapiens
gcaaataaggacagcagctg

SEQ ID NO: 6259107 - DNA, 17 bp, Homo sapiens
gcaaataagtgtatttt

SEQ ID NO: 6259108 - DNA, 23 bp, Homo sapiens
gcaaataagtgtattttgaaatt

SEQ ID NO: 6259109 - DNA, 20 bp, Homo sapiens
gcaaataatgatcgaaaaaa

SEQ ID NO: 6259110 - DNA, 22 bp, Homo sapiens
gcaaatacaaaatgattgtctt

SEQ ID NO: 6259111 - DNA, 18 bp, Homo sapiens
gcaaatacctatgtcaac

SEQ ID NO: 6259112 - DNA, 21 bp, Homo sapiens
gcaaatactgattttcaaaaa

SEQ ID NO: 6259113 - DNA, 21 bp, Homo sapiens
gcaaatagaaaacaggaaaaa

SEQ ID NO: 6259114 - DNA, 21 bp, Homo sapiens
gcaaatagattcttaaagtgg

SEQ ID NO: 6259115 - DNA, 14 bp, Homo sapiens
gcaaatagcaaatg

SEQ ID NO: 6259116 - DNA, 15 bp, Homo sapiens
gcaaatagtttcaaa

SEQ ID NO: 6259117 - DNA, 22 bp, Homo sapiens
gcaaatatactttactttttcc

SEQ ID NO: 6259118 - DNA, 14 bp, Homo sapiens
gcaaatatatgatt

SEQ ID NO: 6259119 - DNA, 22 bp, Homo sapiens
gcaaatatcctccactttcagg

SEQ ID NO: 6259120 - DNA, 16 bp, Homo sapiens
gcaaatattaaaattg

SEQ ID NO: 6259121 - DNA, 16 bp, Homo sapiens
gcaaatcaaccccaga

SEQ ID NO: 6259122 - DNA, 17 bp, Homo sapiens
gcaaatcacaacattct

SEQ ID NO: 6259123 - DNA, 13 bp, Homo sapiens
gcaaatcagaaaa

SEQ ID NO: 6259124 - DNA, 15 bp, Homo sapiens
gcaaatcagaaaacc

SEQ ID NO: 6259125 - DNA, 14 bp, Homo sapiens
gcaaatcagacaca

SEQ ID NO: 6259126 - DNA, 20 bp, Homo sapiens
gcaaatcagtatattttctg

SEQ ID NO: 6259127 - DNA, 19 bp, Homo sapiens
gcaaatcagtgtttttctt

SEQ ID NO: 6259128 - DNA, 18 bp, Homo sapiens
gcaaatcagttactaaga

SEQ ID NO: 6259129 - DNA, 22 bp, Homo sapiens
gcaaatcatctgcattcctgat

SEQ ID NO: 6259130 - DNA, 14 bp, Homo sapiens
gcaaatcatttgtt

SEQ ID NO: 6259131 - DNA, 13 bp, Homo sapiens
gcaaatccaggct

SEQ ID NO: 6259132 - DNA, 21 bp, Homo sapiens
gcaaatccataccccctgccc

SEQ ID NO: 6259133 - DNA, 17 bp, Homo sapiens
gcaaatcctatgtgatt

SEQ ID NO: 6259134 - DNA, 17 bp, Homo sapiens
gcaaatcgtacattgtg

SEQ ID NO: 6259135 - DNA, 22 bp, Homo sapiens
gcaaatcgtacattgtgccctg

SEQ ID NO: 6259136 - DNA, 19 bp, Homo sapiens
gcaaatctaaaatttaaaa

SEQ ID NO: 6259137 - DNA, 15 bp, Homo sapiens
gcaaatctacagatc

SEQ ID NO: 6259138 - DNA, 13 bp, Homo sapiens
gcaaatctgactt

SEQ ID NO: 6259139 - DNA, 12 bp, Homo sapiens
gcaaatcttgaa

SEQ ID NO: 6259140 - DNA, 22 bp, Homo sapiens
gcaaatctttctgtaaacagaa

SEQ ID NO: 6259141 - DNA, 12 bp, Homo sapiens
gcaaatgccaaa

SEQ ID NO: 6259142 - DNA, 19 bp, Homo sapiens
gcaaatgccactctgggca

SEQ ID NO: 6259143 - DNA, 21 bp, Homo sapiens
gcaaatgccactctgggcagt

SEQ ID NO: 6259144 - DNA, 21 bp, Homo sapiens
gcaaatgccaggacagctgca

SEQ ID NO: 6259145 - DNA, 23 bp, Homo sapiens
gcaaatgccaggacagctgcagg

SEQ ID NO: 6259146 - DNA, 20 bp, Homo sapiens
gcaaatgcccaagggaaaga

SEQ ID NO: 6259147 - DNA, 17 bp, Homo sapiens
gcaaatgcctgccaaat

SEQ ID NO: 6259148 - DNA, 18 bp, Homo sapiens
gcaaatgccttttcaaat

SEQ ID NO: 6259149 - DNA, 14 bp, Homo sapiens
gcaaatgcttaaaa

SEQ ID NO: 6259150 - DNA, 18 bp, Homo sapiens
gcaaatggaggcttttca

SEQ ID NO: 6259151 - DNA, 21 bp, Homo sapiens
gcaaatggaggcttttcactg

SEQ ID NO: 6259152 - DNA, 15 bp, Homo sapiens
gcaaatggctgagat

SEQ ID NO: 6259153 - DNA, 15 bp, Homo sapiens
gcaaatgggcagctc

SEQ ID NO: 6259154 - DNA, 22 bp, Homo sapiens
gcaaatgtcacagtaatgcaag

SEQ ID NO: 6259155 - DNA, 15 bp, Homo sapiens
gcaaatgtccaagca

SEQ ID NO: 6259156 - DNA, 12 bp, Homo sapiens
gcaaatgtgaat

SEQ ID NO: 6259157 - DNA, 12 bp, Homo sapiens
gcaaatgtgtac

SEQ ID NO: 6259158 - DNA, 14 bp, Homo sapiens
gcaaatgttccttt

SEQ ID NO: 6259159 - DNA, 17 bp, Homo sapiens
gcaaatgtttacatttt

SEQ ID NO: 6259160 - DNA, 17 bp, Homo sapiens
gcaaatgtttatttaaa

SEQ ID NO: 6259161 - DNA, 14 bp, Homo sapiens
gcaaattaaacaat

SEQ ID NO: 6259162 - DNA, 19 bp, Homo sapiens
gcaaattaactgtatgtgt

SEQ ID NO: 6259163 - DNA, 13 bp, Homo sapiens
gcaaattagtaat

SEQ ID NO: 6259164 - DNA, 16 bp, Homo sapiens
gcaaattattctagtc

SEQ ID NO: 6259165 - DNA, 22 bp, Homo sapiens
gcaaattcaagagcctcccctg

SEQ ID NO: 6259166 - DNA, 14 bp, Homo sapiens
gcaaattccaatac

SEQ ID NO: 6259167 - DNA, 17 bp, Homo sapiens
gcaaattccaatacatt

SEQ ID NO: 6259168 - DNA, 21 bp, Homo sapiens
gcaaattccacccctccttcc

SEQ ID NO: 6259169 - DNA, 22 bp, Homo sapiens
gcaaattccacccctccttccc

SEQ ID NO: 6259170 - DNA, 11 bp, Homo sapiens
gcaaattctga

SEQ ID NO: 6259171 - DNA, 17 bp, Homo sapiens
gcaaattcttgaataaa

SEQ ID NO: 6259172 - DNA, 15 bp, Homo sapiens
gcaaattggagaaaa

SEQ ID NO: 6259173 - DNA, 21 bp, Homo sapiens
gcaaatttagtttgttaaagc

SEQ ID NO: 6259174 - DNA, 13 bp, Homo sapiens
gcaaatttataat

SEQ ID NO: 6259175 - DNA, 21 bp, Homo sapiens
gcaaatttataattttaagat

SEQ ID NO: 6259176 - DNA, 12 bp, Homo sapiens
gcaaatttcaaa

SEQ ID NO: 6259177 - DNA, 21 bp, Homo sapiens
gcaaatttcattatctaatga

SEQ ID NO: 6259178 - DNA, 22 bp, Homo sapiens
gcaaatttctagatatgagaaa

SEQ ID NO: 6259179 - DNA, 21 bp, Homo sapiens
gcaaatttctataaatttaag

SEQ ID NO: 6259180 - DNA, 14 bp, Homo sapiens
gcaaatttgtggtt

SEQ ID NO: 6259181 - DNA, 21 bp, Homo sapiens
gcaaatttttattttttagtg

SEQ ID NO: 6259182 - DNA, 19 bp, Homo sapiens
gcaacaaaactatggaaat

SEQ ID NO: 6259183 - DNA, 15 bp, Homo sapiens
gcaacaaaatcaatt

SEQ ID NO: 6259184 - DNA, 21 bp, Homo sapiens
gcaacaaactgcacatgattt

SEQ ID NO: 6259185 - DNA, 17 bp, Homo sapiens
gcaacaaagattgagaa

SEQ ID NO: 6259186 - DNA, 16 bp, Homo sapiens
gcaacaaatatgtcaa

SEQ ID NO: 6259187 - DNA, 23 bp, Homo sapiens
gcaacaaatccatggacctatga

SEQ ID NO: 6259188 - DNA, 19 bp, Homo sapiens
gcaacaaatgtggccaagc

SEQ ID NO: 6259189 - DNA, 14 bp, Homo sapiens
gcaacaactttgtt

SEQ ID NO: 6259190 - DNA, 23 bp, Homo sapiens
gcaacaagccctgcttttgcata

SEQ ID NO: 6259191 - DNA, 15 bp, Homo sapiens
gcaacaagctatttt

SEQ ID NO: 6259192 - DNA, 11 bp, Homo sapiens
gcaacaaggtg

SEQ ID NO: 6259193 - DNA, 13 bp, Homo sapiens
gcaacaataaata

SEQ ID NO: 6259194 - DNA, 22 bp, Homo sapiens
gcaacaatacatgctgctaatt

SEQ ID NO: 6259195 - DNA, 15 bp, Homo sapiens
gcaacaatggatatt

SEQ ID NO: 6259196 - DNA, 19 bp, Homo sapiens
gcaacacaagctggaagca

SEQ ID NO: 6259197 - DNA, 23 bp, Homo sapiens
gcaacacaagctggaagcacatg

SEQ ID NO: 6259198 - DNA, 13 bp, Homo sapiens
gcaacacacagac

SEQ ID NO: 6259199 - DNA, 18 bp, Homo sapiens
gcaacacagcctgggccc

SEQ ID NO: 6259200 - DNA, 15 bp, Homo sapiens
gcaacacgtcattgt

SEQ ID NO: 6259201 - DNA, 16 bp, Homo sapiens
gcaacactcactgcct

SEQ ID NO: 6259202 - DNA, 21 bp, Homo sapiens
gcaacactcactgcctgcagc

SEQ ID NO: 6259203 - DNA, 13 bp, Homo sapiens
gcaacactccggt

SEQ ID NO: 6259204 - DNA, 21 bp, Homo sapiens
gcaacactccggtcagcccct

SEQ ID NO: 6259205 - DNA, 18 bp, Homo sapiens
gcaacactctacttgaag

SEQ ID NO: 6259206 - DNA, 14 bp, Homo sapiens
gcaacactgcagga

SEQ ID NO: 6259207 - DNA, 18 bp, Homo sapiens
gcaacactgccaaacatc

SEQ ID NO: 6259208 - DNA, 13 bp, Homo sapiens
gcaacagacaagt

SEQ ID NO: 6259209 - DNA, 15 bp, Homo sapiens
gcaacagactctcac

SEQ ID NO: 6259210 - DNA, 16 bp, Homo sapiens
gcaacagagcaagact

SEQ ID NO: 6259211 - DNA, 12 bp, Homo sapiens
gcaacagatctg

SEQ ID NO: 6259212 - DNA, 13 bp, Homo sapiens
gcaacagatctgg

SEQ ID NO: 6259213 - DNA, 18 bp, Homo sapiens
gcaacagatctggaacct

SEQ ID NO: 6259214 - DNA, 18 bp, Homo sapiens
gcaacagattgaaaagac

SEQ ID NO: 6259215 - DNA, 18 bp, Homo sapiens
gcaacagcactggctctc

SEQ ID NO: 6259216 - DNA, 20 bp, Homo sapiens
gcaacagcactggctctctc

SEQ ID NO: 6259217 - DNA, 20 bp, Homo sapiens
gcgctctgccctccctggcc

SEQ ID NO: 6259218 - DNA, 16 bp, Homo sapiens
gcgctcttcaccagga

SEQ ID NO: 6259219 - DNA, 23 bp, Homo sapiens
gcgctctttaatttgttgtagat

SEQ ID NO: 6259220 - DNA, 21 bp, Homo sapiens
gcgctctttcttccctcgtga

SEQ ID NO: 6259221 - DNA, 23 bp, Homo sapiens
gcgctgacaaccaccgctcccca

SEQ ID NO: 6259222 - DNA, 14 bp, Homo sapiens
gcgctgagggcagg

SEQ ID NO: 6259223 - DNA, 14 bp, Homo sapiens
gcgctgcagcctcc

SEQ ID NO: 6259224 - DNA, 21 bp, Homo sapiens
gcgctgcatacaggggagggg

SEQ ID NO: 6259225 - DNA, 23 bp, Homo sapiens
gcgctgccccatctcccctcagc

SEQ ID NO: 6259226 - DNA, 15 bp, Homo sapiens
gcgctgcccccacag

SEQ ID NO: 6259227 - DNA, 23 bp, Homo sapiens
gcgctgcccccacagatccatcc

SEQ ID NO: 6259228 - DNA, 18 bp, Homo sapiens
gcgctgcccctggcagcc

SEQ ID NO: 6259229 - DNA, 12 bp, Homo sapiens
gcgctgccctgc

SEQ ID NO: 6259230 - DNA, 13 bp, Homo sapiens
gcgctgccctgca

SEQ ID NO: 6259231 - DNA, 16 bp, Homo sapiens
gcgctgccctgtgaga

SEQ ID NO: 6259232 - DNA, 16 bp, Homo sapiens
gcgctgccgcacccca

SEQ ID NO: 6259233 - DNA, 17 bp, Homo sapiens
gcgctgccgcaccccag

SEQ ID NO: 6259234 - DNA, 21 bp, Homo sapiens
gcgctgccgcaccccagagtg

SEQ ID NO: 6259235 - DNA, 12 bp, Homo sapiens
gcgctgcctggc

SEQ ID NO: 6259236 - DNA, 13 bp, Homo sapiens
gcgctgcctggcc

SEQ ID NO: 6259237 - DNA, 14 bp, Homo sapiens
gcgctgcctgtgtg

SEQ ID NO: 6259238 - DNA, 13 bp, Homo sapiens
gcgctgctcaacc

SEQ ID NO: 6259239 - DNA, 18 bp, Homo sapiens
gcgctgctcaacctctct

SEQ ID NO: 6259240 - DNA, 20 bp, Homo sapiens
gcgctgctctgcaggctggg

SEQ ID NO: 6259241 - DNA, 17 bp, Homo sapiens
gcgctggaatccagaag

SEQ ID NO: 6259242 - DNA, 22 bp, Homo sapiens
gcgctggaatccagaaggaagc

SEQ ID NO: 6259243 - DNA, 21 bp, Homo sapiens
gcgctggacacctacagcagc

SEQ ID NO: 6259244 - DNA, 11 bp, Homo sapiens
gcgctggccca

SEQ ID NO: 6259245 - DNA, 12 bp, Homo sapiens
gcgctggcccag

SEQ ID NO: 6259246 - DNA, 13 bp, Homo sapiens
gcgctggcccagc

SEQ ID NO: 6259247 - DNA, 16 bp, Homo sapiens
gcgctggcccagccgg

SEQ ID NO: 6259248 - DNA, 17 bp, Homo sapiens
gcgctggcccagccggc

SEQ ID NO: 6259249 - DNA, 19 bp, Homo sapiens
gcgctggctccctgggcag

SEQ ID NO: 6259250 - DNA, 15 bp, Homo sapiens
gcgctggctgcactc

SEQ ID NO: 6259251 - DNA, 19 bp, Homo sapiens
gcgctgggcacttccctgc

SEQ ID NO: 6259252 - DNA, 22 bp, Homo sapiens
gcgctgggcacttccctgctgc

SEQ ID NO: 6259253 - DNA, 17 bp, Homo sapiens
gcgctgggcgctcccgg

SEQ ID NO: 6259254 - DNA, 21 bp, Homo sapiens
gcgctgggtgcctgcagcgcc

SEQ ID NO: 6259255 - DNA, 21 bp, Homo sapiens
gcgctggtcccctccctctgt

SEQ ID NO: 6259256 - DNA, 17 bp, Homo sapiens
gcgctggtggaccacag

SEQ ID NO: 6259257 - DNA, 14 bp, Homo sapiens
gcgctgtcccaggc

SEQ ID NO: 6259258 - DNA, 23 bp, Homo sapiens
gcgctgtcctgcgttcagcccct

SEQ ID NO: 6259259 - DNA, 15 bp, Homo sapiens
gcgctgtgagatgga

SEQ ID NO: 6259260 - DNA, 14 bp, Homo sapiens
gcgctgtgctggtc

SEQ ID NO: 6259261 - DNA, 18 bp, Homo sapiens
gcgctgtggactgtcctg

SEQ ID NO: 6259262 - DNA, 23 bp, Homo sapiens
gcgctgtgtaaatgctccagcac

SEQ ID NO: 6259263 - DNA, 22 bp, Homo sapiens
gcgctgttgcccgccctccacc

SEQ ID NO: 6259264 - DNA, 15 bp, Homo sapiens
gcgcttaccttccca

SEQ ID NO: 6259265 - DNA, 13 bp, Homo sapiens
gcgcttcccaact

SEQ ID NO: 6259266 - DNA, 14 bp, Homo sapiens
gcgcttcccacctg

SEQ ID NO: 6259267 - DNA, 12 bp, Homo sapiens
gcgcttccctgg

SEQ ID NO: 6259268 - DNA, 19 bp, Homo sapiens
gcgcttcctgagcagtccc

SEQ ID NO: 6259269 - DNA, 19 bp, Homo sapiens
gcgcttctccaatgctctg

SEQ ID NO: 6259270 - DNA, 14 bp, Homo sapiens
gcgcttctgctgga

SEQ ID NO: 6259271 - DNA, 16 bp, Homo sapiens
gcgcttctgctggagg

SEQ ID NO: 6259272 - DNA, 21 bp, Homo sapiens
gcgcttgaccatgttgcactg

SEQ ID NO: 6259273 - DNA, 15 bp, Homo sapiens
gcgcttgctggccag

SEQ ID NO: 6259274 - DNA, 21 bp, Homo sapiens
gcgcttgggcgccgtgctggg

SEQ ID NO: 6259275 - DNA, 20 bp, Homo sapiens
gcgcttggtctttctgtgct

SEQ ID NO: 6259276 - DNA, 18 bp, Homo sapiens
gcgctttctcctgtgccc

SEQ ID NO: 6259277 - DNA, 12 bp, Homo sapiens
gcgctttgaacg

SEQ ID NO: 6259278 - DNA, 17 bp, Homo sapiens
gcgctttgaacgtgcca

SEQ ID NO: 6259279 - DNA, 13 bp, Homo sapiens
gcggaaacaggtg

SEQ ID NO: 6259280 - DNA, 17 bp, Homo sapiens
gcggaaaccgggtggca

SEQ ID NO: 6259281 - DNA, 20 bp, Homo sapiens
gcggaaaccgggtggcagcg

SEQ ID NO: 6259282 - DNA, 12 bp, Homo sapiens
gcggaaaccttg

SEQ ID NO: 6259283 - DNA, 15 bp, Homo sapiens
gcggaaagcagctca

SEQ ID NO: 6259284 - DNA, 15 bp, Homo sapiens
gcggaacctggctgc

SEQ ID NO: 6259285 - DNA, 20 bp, Homo sapiens
gcggaagccaaaggcagcta

SEQ ID NO: 6259286 - DNA, 17 bp, Homo sapiens
gcggaagggactctggg

SEQ ID NO: 6259287 - DNA, 21 bp, Homo sapiens
gcggaagtacttccctcaggc

SEQ ID NO: 6259288 - DNA, 18 bp, Homo sapiens
gcggacaaaagggccagg

SEQ ID NO: 6259289 - DNA, 21 bp, Homo sapiens
gcggacaaaagggccaggtgc

SEQ ID NO: 6259290 - DNA, 20 bp, Homo sapiens
gcggacaccatgttcccagc

SEQ ID NO: 6259291 - DNA, 23 bp, Homo sapiens
gcggacaccatgttcccagctca

SEQ ID NO: 6259292 - DNA, 18 bp, Homo sapiens
gcggacaccgtggcctgg

SEQ ID NO: 6259293 - DNA, 23 bp, Homo sapiens
gcggacagccacggccaggccag

SEQ ID NO: 6259294 - DNA, 17 bp, Homo sapiens
gcggaccaccctcactg

SEQ ID NO: 6259295 - DNA, 13 bp, Homo sapiens
gcggaccccagct

SEQ ID NO: 6259296 - DNA, 20 bp, Homo sapiens
gcggaccggagcggctgagg

SEQ ID NO: 6259297 - DNA, 17 bp, Homo sapiens
gcggacggctgtggacc

SEQ ID NO: 6259298 - DNA, 14 bp, Homo sapiens
gcggacgggctgtc

SEQ ID NO: 6259299 - DNA, 14 bp, Homo sapiens
gcggacgttccagc

SEQ ID NO: 6259300 - DNA, 19 bp, Homo sapiens
gcggactcctcctttctcc

SEQ ID NO: 6259301 - DNA, 16 bp, Homo sapiens
gcggagaaaggaaggg

SEQ ID NO: 6259302 - DNA, 15 bp, Homo sapiens
gcggagacctcctga

SEQ ID NO: 6259303 - DNA, 18 bp, Homo sapiens
gcggagacctcctgacaa

SEQ ID NO: 6259304 - DNA, 19 bp, Homo sapiens
gcggagacggagtcccacc

SEQ ID NO: 6259305 - DNA, 15 bp, Homo sapiens
gcggagagtacagtg

SEQ ID NO: 6259306 - DNA, 20 bp, Homo sapiens
gcggagagtacagtgagcca

SEQ ID NO: 6259307 - DNA, 12 bp, Homo sapiens
gcggagccagca

SEQ ID NO: 6259308 - DNA, 13 bp, Homo sapiens
gcggagccagcag

SEQ ID NO: 6259309 - DNA, 14 bp, Homo sapiens
gcggagcccagcct

SEQ ID NO: 6259310 - DNA, 21 bp, Homo sapiens
gcggagcccagcctgggagcc

SEQ ID NO: 6259311 - DNA, 19 bp, Homo sapiens
gcggagcccccgcccctcc

SEQ ID NO: 6259312 - DNA, 20 bp, Homo sapiens
gcggagcccccgcccctccc

SEQ ID NO: 6259313 - DNA, 18 bp, Homo sapiens
gcggagccccggctctta

SEQ ID NO: 6259314 - DNA, 23 bp, Homo sapiens
gcggagcgggaggcggtggtaga

SEQ ID NO: 6259315 - DNA, 12 bp, Homo sapiens
gcggagctggcc

SEQ ID NO: 6259316 - DNA, 17 bp, Homo sapiens
gcggagctggggtctgg

SEQ ID NO: 6259317 - DNA, 21 bp, Homo sapiens
gcggagctggggtctgggcag

SEQ ID NO: 6259318 - DNA, 22 bp, Homo sapiens
gcggagctggggtctgggcagt

SEQ ID NO: 6259319 - DNA, 20 bp, Homo sapiens
gcggagcttgcagtgagccg

SEQ ID NO: 6259320 - DNA, 15 bp, Homo sapiens
gcggagcttgcctgc

SEQ ID NO: 6259321 - DNA, 19 bp, Homo sapiens
gcggagcttgcctgcctgc

SEQ ID NO: 6259322 - DNA, 19 bp, Homo sapiens
gcggaggaaagcaagtgtt

SEQ ID NO: 6259323 - DNA, 23 bp, Homo sapiens
gcggaggaaggaggacccaggac

SEQ ID NO: 6259324 - DNA, 15 bp, Homo sapiens
gcggaggagaccagc

SEQ ID NO: 6259325 - DNA, 17 bp, Homo sapiens
gcggaggagaccagctc

SEQ ID NO: 6259326 - DNA, 16 bp, Homo sapiens
gcggaggagagagagg

SEQ ID NO: 6259327 - DNA, 13 bp, Homo sapiens
gcggaggaggagg

SEQ ID NO: 6259328 - DNA, 18 bp, Homo sapiens
gcggaggaggagggaggc

SEQ ID NO: 6259329 - DNA, 21 bp, Homo sapiens
gcggaggagttttctgtgtgg

SEQ ID NO: 6259330 - DNA, 14 bp, Homo sapiens
gcggaggcaggagc

SEQ ID NO: 6259331 - DNA, 11 bp, Homo sapiens
gcggaggcccc

SEQ ID NO: 6259332 - DNA, 14 bp, Homo sapiens
gcggaggcccctga

SEQ ID NO: 6259333 - DNA, 16 bp, Homo sapiens
gcggaggcccctgagg

SEQ ID NO: 6259334 - DNA, 17 bp, Homo sapiens
gcggaggcccctgaggg

SEQ ID NO: 6259335 - DNA, 15 bp, Homo sapiens
gcggaggctgtgctc

SEQ ID NO: 6259336 - DNA, 14 bp, Homo sapiens
gcggaggctgtgtg

SEQ ID NO: 6259337 - DNA, 18 bp, Homo sapiens
gcggaggctgtgtgcctg

SEQ ID NO: 6259338 - DNA, 16 bp, Homo sapiens
gcggagggaggggagg

SEQ ID NO: 6259339 - DNA, 17 bp, Homo sapiens
gcggaggggatccagcc

SEQ ID NO: 6259340 - DNA, 21 bp, Homo sapiens
gcggaggggatccagccactt

SEQ ID NO: 6259341 - DNA, 16 bp, Homo sapiens
gcggaggggcttggag

SEQ ID NO: 6259342 - DNA, 19 bp, Homo sapiens
gcggaggtctctgggagcc

SEQ ID NO: 6259343 - DNA, 21 bp, Homo sapiens
gcggaggtggagtggccactg

SEQ ID NO: 6259344 - DNA, 22 bp, Homo sapiens
gcggaggtggagtggccactgg

SEQ ID NO: 6259345 - DNA, 21 bp, Homo sapiens
gcggaggtgtggagccgaggc

SEQ ID NO: 6259346 - DNA, 22 bp, Homo sapiens
gcggaggtgttcccaggctgcc

SEQ ID NO: 6259347 - DNA, 19 bp, Homo sapiens
gcggatcaaccaggcagag

SEQ ID NO: 6259348 - DNA, 20 bp, Homo sapiens
gcggattaatttgcatctga

SEQ ID NO: 6259349 - DNA, 22 bp, Homo sapiens
gcggattgctctggagcagcca

SEQ ID NO: 6259350 - DNA, 14 bp, Homo sapiens
gcggattggggtga

SEQ ID NO: 6259351 - DNA, 20 bp, Homo sapiens
gcggatttctctttctctct

SEQ ID NO: 6259352 - DNA, 15 bp, Homo sapiens
gcggcaaaagcccat

SEQ ID NO: 6259353 - DNA, 17 bp, Homo sapiens
gcggcaaacctttcccc

SEQ ID NO: 6259354 - DNA, 14 bp, Homo sapiens
gcggcaaaggcccg

SEQ ID NO: 6259355 - DNA, 15 bp, Homo sapiens
gcggcacattggcag

SEQ ID NO: 6259356 - DNA, 19 bp, Homo sapiens
gcggcacattggcagtgtg

SEQ ID NO: 6259357 - DNA, 15 bp, Homo sapiens
gcggcaccgcccacc

SEQ ID NO: 6259358 - DNA, 16 bp, Homo sapiens
gcggcaccgcccaccc

SEQ ID NO: 6259359 - DNA, 18 bp, Homo sapiens
gcggcacgccaacagccc

SEQ ID NO: 6259360 - DNA, 15 bp, Homo sapiens
gcggcactccaacct

SEQ ID NO: 6259361 - DNA, 12 bp, Homo sapiens
gcggcagagagg

SEQ ID NO: 6259362 - DNA, 17 bp, Homo sapiens
gcggcagagcaattcca

SEQ ID NO: 6259363 - DNA, 16 bp, Homo sapiens
gcggcagatggggaga

SEQ ID NO: 6259364 - DNA, 18 bp, Homo sapiens
gcggcagctcttctgggc

SEQ ID NO: 6259365 - DNA, 12 bp, Homo sapiens
gcggcagctggg

SEQ ID NO: 6259366 - DNA, 18 bp, Homo sapiens
gcggcaggactgcagagc

SEQ ID NO: 6259367 - DNA, 17 bp, Homo sapiens
gcggcaggagcaggaac

SEQ ID NO: 6259368 - DNA, 14 bp, Homo sapiens
gcggcaggagggag

SEQ ID NO: 6259369 - DNA, 15 bp, Homo sapiens
gcggcaggcttctca

SEQ ID NO: 6259370 - DNA, 13 bp, Homo sapiens
gcggcagggaaga

SEQ ID NO: 6259371 - DNA, 16 bp, Homo sapiens
gcggcaggggcctgga

SEQ ID NO: 6259372 - DNA, 21 bp, Homo sapiens
gcggcagggtgggggagggag

SEQ ID NO: 6259373 - DNA, 14 bp, Homo sapiens
gcggcatagcaccc

SEQ ID NO: 6259374 - DNA, 13 bp, Homo sapiens
gcggcatgggcga

SEQ ID NO: 6259375 - DNA, 15 bp, Homo sapiens
gcggccacagcacta

SEQ ID NO: 6259376 - DNA, 17 bp, Homo sapiens
gcggccacgcactgggc

SEQ ID NO: 6259377 - DNA, 23 bp, Homo sapiens
gcggccacgcactgggccacgga

SEQ ID NO: 6259378 - DNA, 15 bp, Homo sapiens
gcggccactgcgcca

SEQ ID NO: 6259379 - DNA, 18 bp, Homo sapiens
gcggccagccccggccct

SEQ ID NO: 6259380 - DNA, 20 bp, Homo sapiens
gcggccagccccggccctgg

SEQ ID NO: 6259381 - DNA, 22 bp, Homo sapiens
gcggccagcgtcccagggtacc

SEQ ID NO: 6259382 - DNA, 16 bp, Homo sapiens
gcggccaggcacaggg

SEQ ID NO: 6259383 - DNA, 17 bp, Homo sapiens
gcggccaggcacagggc

SEQ ID NO: 6259384 - DNA, 17 bp, Homo sapiens
gcggccaggcacccatg

SEQ ID NO: 6259385 - DNA, 15 bp, Homo sapiens
gcggccaggcctgcg

SEQ ID NO: 6259386 - DNA, 18 bp, Homo sapiens
gcggccaggcctgcgggc

SEQ ID NO: 6259387 - DNA, 15 bp, Homo sapiens
gcggccaggcggggc

SEQ ID NO: 6259388 - DNA, 18 bp, Homo sapiens
gcggccaggcggggcgcc

SEQ ID NO: 6259389 - DNA, 15 bp, Homo sapiens
gcggccagggaccca

SEQ ID NO: 6259390 - DNA, 19 bp, Homo sapiens
gcggccagggcggccaggg

SEQ ID NO: 6259391 - DNA, 19 bp, Homo sapiens
gcggccagtattagactgg

SEQ ID NO: 6259392 - DNA, 17 bp, Homo sapiens
gcggccatccccgtgtt

SEQ ID NO: 6259393 - DNA, 16 bp, Homo sapiens
gcggcccaagagcccg

SEQ ID NO: 6259394 - DNA, 20 bp, Homo sapiens
gcggcccactttcctgagct

SEQ ID NO: 6259395 - DNA, 14 bp, Homo sapiens
gcggcccagcaggt

SEQ ID NO: 6259396 - DNA, 12 bp, Homo sapiens
gcaacagcagag

SEQ ID NO: 6259397 - DNA, 12 bp, Homo sapiens
gcaacagcctgt

SEQ ID NO: 6259398 - DNA, 18 bp, Homo sapiens
gcaacagcctttgaatgt

SEQ ID NO: 6259399 - DNA, 18 bp, Homo sapiens
gcaacaggaatcaagagc

SEQ ID NO: 6259400 - DNA, 16 bp, Homo sapiens
gcaacaggaatctcag

SEQ ID NO: 6259401 - DNA, 19 bp, Homo sapiens
gcaacaggaatctcagaga

SEQ ID NO: 6259402 - DNA, 20 bp, Homo sapiens
gcaacaggaatctcagagac

SEQ ID NO: 6259403 - DNA, 22 bp, Homo sapiens
gcaacaggacagagttcacagg

SEQ ID NO: 6259404 - DNA, 16 bp, Homo sapiens
gcaacaggaccaggag

SEQ ID NO: 6259405 - DNA, 19 bp, Homo sapiens
gcaacaggccattgtgaac

SEQ ID NO: 6259406 - DNA, 14 bp, Homo sapiens
gcaacaggctgggc

SEQ ID NO: 6259407 - DNA, 13 bp, Homo sapiens
gcaacaggtttta

SEQ ID NO: 6259408 - DNA, 20 bp, Homo sapiens
gcaacaggttttataatttt

SEQ ID NO: 6259409 - DNA, 21 bp, Homo sapiens
gcaacagtaatctatgtgttt

SEQ ID NO: 6259410 - DNA, 16 bp, Homo sapiens
gcaacagtagcaggga

SEQ ID NO: 6259411 - DNA, 17 bp, Homo sapiens
gcaacagtgttctgagc

SEQ ID NO: 6259412 - DNA, 17 bp, Homo sapiens
gcaacagtttgacattt

SEQ ID NO: 6259413 - DNA, 15 bp, Homo sapiens
gcaacataaaacaat

SEQ ID NO: 6259414 - DNA, 17 bp, Homo sapiens
gcaacataattcttcct

SEQ ID NO: 6259415 - DNA, 18 bp, Homo sapiens
gcaacatctagcaaatgt

SEQ ID NO: 6259416 - DNA, 21 bp, Homo sapiens
gcaacatctcgagccccctgg

SEQ ID NO: 6259417 - DNA, 14 bp, Homo sapiens
gcaacatgatgagg

SEQ ID NO: 6259418 - DNA, 16 bp, Homo sapiens
gcaacatgatgaggta

SEQ ID NO: 6259419 - DNA, 22 bp, Homo sapiens
gcaacatgatgaggtagtacct

SEQ ID NO: 6259420 - DNA, 24 bp, Homo sapiens
gcaacattccacagctgccctggc

SEQ ID NO: 6259421 - DNA, 23 bp, Homo sapiens
gcaacattcctttcttgtgccct

SEQ ID NO: 6259422 - DNA, 14 bp, Homo sapiens
gcaacattggacag

SEQ ID NO: 6259423 - DNA, 15 bp, Homo sapiens
gcaacattggacaga

SEQ ID NO: 6259424 - DNA, 17 bp, Homo sapiens
gcaacattggacagaaa

SEQ ID NO: 6259425 - DNA, 14 bp, Homo sapiens
gcaacattggcaca

SEQ ID NO: 6259426 - DNA, 21 bp, Homo sapiens
gcaacattgttcacctttgta

SEQ ID NO: 6259427 - DNA, 23 bp, Homo sapiens
gcaacatttacagtccttcaaaa

SEQ ID NO: 6259428 - DNA, 20 bp, Homo sapiens
gcaacatttctgtatactgt

SEQ ID NO: 6259429 - DNA, 15 bp, Homo sapiens
gcaacatttggggag

SEQ ID NO: 6259430 - DNA, 22 bp, Homo sapiens
gcaacatttgtatggatttaag

SEQ ID NO: 6259431 - DNA, 13 bp, Homo sapiens
gcaacattttctt

SEQ ID NO: 6259432 - DNA, 23 bp, Homo sapiens
gcaaccaactatccaagtgttat

SEQ ID NO: 6259433 - DNA, 20 bp, Homo sapiens
gcaaccaataaaagtgtcac

SEQ ID NO: 6259434 - DNA, 15 bp, Homo sapiens
gcaaccacacacctc

SEQ ID NO: 6259435 - DNA, 12 bp, Homo sapiens
gcaaccacatgt

SEQ ID NO: 6259436 - DNA, 22 bp, Homo sapiens
gcaaccacatttagaaatgttt

SEQ ID NO: 6259437 - DNA, 16 bp, Homo sapiens
gcaaccaccaccaacc

SEQ ID NO: 6259438 - DNA, 18 bp, Homo sapiens
gcaaccaccaccaaccac

SEQ ID NO: 6259439 - DNA, 17 bp, Homo sapiens
gcaaccactctgtggcc

SEQ ID NO: 6259440 - DNA, 21 bp, Homo sapiens
gcaaccactctgtggccagcc

SEQ ID NO: 6259441 - DNA, 22 bp, Homo sapiens
gcaaccactctgtggccagcct

SEQ ID NO: 6259442 - DNA, 24 bp, Homo sapiens
gcaaccactctgtggccagcctgg

SEQ ID NO: 6259443 - DNA, 17 bp, Homo sapiens
gcaaccagagcactgta

SEQ ID NO: 6259444 - DNA, 18 bp, Homo sapiens
gcaaccagagcactgtat

SEQ ID NO: 6259445 - DNA, 15 bp, Homo sapiens
gcaaccaggaacagc

SEQ ID NO: 6259446 - DNA, 16 bp, Homo sapiens
gcaaccagttggctag

SEQ ID NO: 6259447 - DNA, 18 bp, Homo sapiens
gcaaccatatagaaagct

SEQ ID NO: 6259448 - DNA, 20 bp, Homo sapiens
gcaaccattcatctttcctt

SEQ ID NO: 6259449 - DNA, 21 bp, Homo sapiens
gcaacccacagctcagctgcc

SEQ ID NO: 6259450 - DNA, 23 bp, Homo sapiens
gcaacccacagctcagctgccca

SEQ ID NO: 6259451 - DNA, 14 bp, Homo sapiens
gcaacccacgtgta

SEQ ID NO: 6259452 - DNA, 13 bp, Homo sapiens
gcaacccagaatg

SEQ ID NO: 6259453 - DNA, 16 bp, Homo sapiens
gcaaccccagttctgc

SEQ ID NO: 6259454 - DNA, 18 bp, Homo sapiens
gcaaccccagttctgctc

SEQ ID NO: 6259455 - DNA, 20 bp, Homo sapiens
gcaaccccagttctgctcct

SEQ ID NO: 6259456 - DNA, 22 bp, Homo sapiens
gcaaccccagttctgctcctct

SEQ ID NO: 6259457 - DNA, 15 bp, Homo sapiens
gcaacccccagcctg

SEQ ID NO: 6259458 - DNA, 16 bp, Homo sapiens
gcaacccccagcctgc

SEQ ID NO: 6259459 - DNA, 18 bp, Homo sapiens
gcaacccccagcctgcta

SEQ ID NO: 6259460 - DNA, 13 bp, Homo sapiens
gcaaccccccagc

SEQ ID NO: 6259461 - DNA, 19 bp, Homo sapiens
gcaacccctggaccccagc

SEQ ID NO: 6259462 - DNA, 22 bp, Homo sapiens
gcaacccctggaccccagcctc

SEQ ID NO: 6259463 - DNA, 14 bp, Homo sapiens
gcaacccctgtacc

SEQ ID NO: 6259464 - DNA, 20 bp, Homo sapiens
gcaacccctgtacccagctc

SEQ ID NO: 6259465 - DNA, 21 bp, Homo sapiens
gcaacccctgtacccagctcc

SEQ ID NO: 6259466 - DNA, 22 bp, Homo sapiens
gcaacccgctggagcccacagc

SEQ ID NO: 6259467 - DNA, 15 bp, Homo sapiens
gcaacccgtgccaag

SEQ ID NO: 6259468 - DNA, 19 bp, Homo sapiens
gcaacccgtgccaagtcca

SEQ ID NO: 6259469 - DNA, 22 bp, Homo sapiens
gcaacccgtgccaagtccaggt

SEQ ID NO: 6259470 - DNA, 23 bp, Homo sapiens
gcaaccctcctatcacctcccct

SEQ ID NO: 6259471 - DNA, 12 bp, Homo sapiens
gcaaccctgcct

SEQ ID NO: 6259472 - DNA, 13 bp, Homo sapiens
gcaacccttgctg

SEQ ID NO: 6259473 - DNA, 17 bp, Homo sapiens
gcaacccttgctgctgc

SEQ ID NO: 6259474 - DNA, 16 bp, Homo sapiens
gcaaccgtgcagccac

SEQ ID NO: 6259475 - DNA, 21 bp, Homo sapiens
gcaaccgtggcccttcctgga

SEQ ID NO: 6259476 - DNA, 14 bp, Homo sapiens
gcaacctacccagc

SEQ ID NO: 6259477 - DNA, 15 bp, Homo sapiens
gcaacctatttgact

SEQ ID NO: 6259478 - DNA, 17 bp, Homo sapiens
gcaacctcaccttcctg

SEQ ID NO: 6259479 - DNA, 15 bp, Homo sapiens
gcaacctcactatgg

SEQ ID NO: 6259480 - DNA, 19 bp, Homo sapiens
gcaacctccacctccgggt

SEQ ID NO: 6259481 - DNA, 17 bp, Homo sapiens
gcaacctcccaacccag

SEQ ID NO: 6259482 - DNA, 12 bp, Homo sapiens
gcaacctcccat

SEQ ID NO: 6259483 - DNA, 13 bp, Homo sapiens
gcaacctctgcct

SEQ ID NO: 6259484 - DNA, 14 bp, Homo sapiens
gcaacctctgcctc

SEQ ID NO: 6259485 - DNA, 23 bp, Homo sapiens
gcaacctctgcctcccaggttcc

SEQ ID NO: 6259486 - DNA, 18 bp, Homo sapiens
gcaacctcttcagctggg

SEQ ID NO: 6259487 - DNA, 22 bp, Homo sapiens
gcaacctgacagcaaacacagt

SEQ ID NO: 6259488 - DNA, 17 bp, Homo sapiens
gcaacctgattgtaaac

SEQ ID NO: 6259489 - DNA, 19 bp, Homo sapiens
gcaacctgcggaaggaggt

SEQ ID NO: 6259490 - DNA, 15 bp, Homo sapiens
gcaacctgtaactgc

SEQ ID NO: 6259491 - DNA, 12 bp, Homo sapiens
gcaacctgtgca

SEQ ID NO: 6259492 - DNA, 21 bp, Homo sapiens
gcaaccttaaagcaataagtt

SEQ ID NO: 6259493 - DNA, 20 bp, Homo sapiens
gcaaccttcgccacctgggt

SEQ ID NO: 6259494 - DNA, 22 bp, Homo sapiens
gcaacctttcacctttgtgtat

SEQ ID NO: 6259495 - DNA, 16 bp, Homo sapiens
gcaacgattcacagcc

SEQ ID NO: 6259496 - DNA, 17 bp, Homo sapiens
gcaacgattcacagcct

SEQ ID NO: 6259497 - DNA, 18 bp, Homo sapiens
gcaacgattcacagcctc

SEQ ID NO: 6259498 - DNA, 19 bp, Homo sapiens
gcaacgattcacagcctcc

SEQ ID NO: 6259499 - DNA, 13 bp, Homo sapiens
gcaacgcaggagg

SEQ ID NO: 6259500 - DNA, 16 bp, Homo sapiens
gcaacgccagtggcaa

SEQ ID NO: 6259501 - DNA, 17 bp, Homo sapiens
gcaacgcccctccaaac

SEQ ID NO: 6259502 - DNA, 20 bp, Homo sapiens
gcaacgctgattcctaaggc

SEQ ID NO: 6259503 - DNA, 18 bp, Homo sapiens
gcaacggggaggccaagt

SEQ ID NO: 6259504 - DNA, 22 bp, Homo sapiens
gcaacggtctcctgactggtgc

SEQ ID NO: 6259505 - DNA, 14 bp, Homo sapiens
gcaacgtagcctgg

SEQ ID NO: 6259506 - DNA, 21 bp, Homo sapiens
gcaacgtgcgtgtctctgcca

SEQ ID NO: 6259507 - DNA, 16 bp, Homo sapiens
gcaactaaatgagacc

SEQ ID NO: 6259508 - DNA, 15 bp, Homo sapiens
gcaactaactaacca

SEQ ID NO: 6259509 - DNA, 19 bp, Homo sapiens
gcaactaaggacaaattag

SEQ ID NO: 6259510 - DNA, 23 bp, Homo sapiens
gcaactaaggacaaattagcatg

SEQ ID NO: 6259511 - DNA, 18 bp, Homo sapiens
gcaactaagttaataata

SEQ ID NO: 6259512 - DNA, 20 bp, Homo sapiens
gcaactaagttaataataat

SEQ ID NO: 6259513 - DNA, 15 bp, Homo sapiens
gcaactacaacttct

SEQ ID NO: 6259514 - DNA, 22 bp, Homo sapiens
gcaactacccaaaacaagcctg

SEQ ID NO: 6259515 - DNA, 14 bp, Homo sapiens
gcaactagccaagg

SEQ ID NO: 6259516 - DNA, 16 bp, Homo sapiens
gcaactagccaaggct

SEQ ID NO: 6259517 - DNA, 16 bp, Homo sapiens
gcaactagtggagaga

SEQ ID NO: 6259518 - DNA, 23 bp, Homo sapiens
gcaactatcagactaagccagca

SEQ ID NO: 6259519 - DNA, 16 bp, Homo sapiens
gcaactcacacctcct

SEQ ID NO: 6259520 - DNA, 21 bp, Homo sapiens
gcaactcacacctccttttct

SEQ ID NO: 6259521 - DNA, 18 bp, Homo sapiens
gcaactcagaatgctcta

SEQ ID NO: 6259522 - DNA, 21 bp, Homo sapiens
gcaactcagggctaaagtcat

SEQ ID NO: 6259523 - DNA, 16 bp, Homo sapiens
gcaactccatgcctat

SEQ ID NO: 6259524 - DNA, 16 bp, Homo sapiens
gcaactcggagagggc

SEQ ID NO: 6259525 - DNA, 19 bp, Homo sapiens
gcaactcggagagggctgc

SEQ ID NO: 6259526 - DNA, 17 bp, Homo sapiens
gcaactcgtgacagcct

SEQ ID NO: 6259527 - DNA, 18 bp, Homo sapiens
gcaactcgtgacagcctc

SEQ ID NO: 6259528 - DNA, 13 bp, Homo sapiens
gcaactctgaagg

SEQ ID NO: 6259529 - DNA, 17 bp, Homo sapiens
gcaactctggctccagg

SEQ ID NO: 6259530 - DNA, 21 bp, Homo sapiens
gcaactctggctccaggcaga

SEQ ID NO: 6259531 - DNA, 19 bp, Homo sapiens
gcaactcttatttctttcc

SEQ ID NO: 6259532 - DNA, 20 bp, Homo sapiens
gcaactcttatttctttcct

SEQ ID NO: 6259533 - DNA, 17 bp, Homo sapiens
gcaactcttttaagtgc

SEQ ID NO: 6259534 - DNA, 18 bp, Homo sapiens
gcaactcttttaagtgcc

SEQ ID NO: 6259535 - DNA, 18 bp, Homo sapiens
gcaactgaaaatgaatgc

SEQ ID NO: 6259536 - DNA, 20 bp, Homo sapiens
gcaactgaacaaaagctcag

SEQ ID NO: 6259537 - DNA, 14 bp, Homo sapiens
gcaactgaaggaag

SEQ ID NO: 6259538 - DNA, 13 bp, Homo sapiens
gcaactgaataaa

SEQ ID NO: 6259539 - DNA, 19 bp, Homo sapiens
gcaactgacctgagcggca

SEQ ID NO: 6259540 - DNA, 23 bp, Homo sapiens
gcaactgacttcatttgtgccac

SEQ ID NO: 6259541 - DNA, 14 bp, Homo sapiens
gcaactgaggcaga

SEQ ID NO: 6259542 - DNA, 19 bp, Homo sapiens
gcaactgaggcagacagca

SEQ ID NO: 6259543 - DNA, 22 bp, Homo sapiens
gcaactgaggcagacagcagct

SEQ ID NO: 6259544 - DNA, 15 bp, Homo sapiens
gcaactgcccttcca

SEQ ID NO: 6259545 - DNA, 20 bp, Homo sapiens
gcaactgcgacaaaacattt

SEQ ID NO: 6259546 - DNA, 18 bp, Homo sapiens
gcaactgctcagctctgg

SEQ ID NO: 6259547 - DNA, 18 bp, Homo sapiens
gcaactggaaaagtgttc

SEQ ID NO: 6259548 - DNA, 22 bp, Homo sapiens
gcaactggagccagcaaccagc

SEQ ID NO: 6259549 - DNA, 15 bp, Homo sapiens
gcaactggccagcca

SEQ ID NO: 6259550 - DNA, 18 bp, Homo sapiens
gcaactggtatatattta

SEQ ID NO: 6259551 - DNA, 21 bp, Homo sapiens
gcaactggtatatatttagga

SEQ ID NO: 6259552 - DNA, 22 bp, Homo sapiens
gcaactggtatatatttaggat

SEQ ID NO: 6259553 - DNA, 18 bp, Homo sapiens
gcaactgtattaaagaaa

SEQ ID NO: 6259554 - DNA, 23 bp, Homo sapiens
gcaactgtctatttctgctgaat

SEQ ID NO: 6259555 - DNA, 14 bp, Homo sapiens
gcaactgtgcagca

SEQ ID NO: 6259556 - DNA, 15 bp, Homo sapiens
gcaactgtgcagcac

SEQ ID NO: 6259557 - DNA, 21 bp, Homo sapiens
gcaactgttagctgggaagaa

SEQ ID NO: 6259558 - DNA, 12 bp, Homo sapiens
gcaactgttatg

SEQ ID NO: 6259559 - DNA, 18 bp, Homo sapiens
gcaactgttatgaaataa

SEQ ID NO: 6259560 - DNA, 23 bp, Homo sapiens
gcaacttcagttttatttttgcc

SEQ ID NO: 6259561 - DNA, 17 bp, Homo sapiens
gcaacttcatcccagct

SEQ ID NO: 6259562 - DNA, 21 bp, Homo sapiens
gcaacttcatcccagctgctg

SEQ ID NO: 6259563 - DNA, 15 bp, Homo sapiens
gcaacttccgctgag

SEQ ID NO: 6259564 - DNA, 18 bp, Homo sapiens
gcaacttccgctgagggg

SEQ ID NO: 6259565 - DNA, 18 bp, Homo sapiens
gcaacttctagcatatag

SEQ ID NO: 6259566 - DNA, 20 bp, Homo sapiens
gcaacttcttctccatccct

SEQ ID NO: 6259567 - DNA, 15 bp, Homo sapiens
gcaacttgaaattat

SEQ ID NO: 6259568 - DNA, 13 bp, Homo sapiens
gcaacttgaagaa

SEQ ID NO: 6259569 - DNA, 18 bp, Homo sapiens
gcaacttgagggacgact

SEQ ID NO: 6259570 - DNA, 15 bp, Homo sapiens
gcaacttgcttctaa

SEQ ID NO: 6259571 - DNA, 15 bp, Homo sapiens
gcaactttagaaaga

SEQ ID NO: 6259572 - DNA, 23 bp, Homo sapiens
gcaactttctggggcctaataaa

SEQ ID NO: 6259573 - DNA, 15 bp, Homo sapiens
gcggcccagcaggtg

SEQ ID NO: 6259574 - DNA, 16 bp, Homo sapiens
gcggcccagcccggct

SEQ ID NO: 6259575 - DNA, 18 bp, Homo sapiens
gcggcccagcccggctcc

SEQ ID NO: 6259576 - DNA, 22 bp, Homo sapiens
gcggccccctctcggccaggca

SEQ ID NO: 6259577 - DNA, 18 bp, Homo sapiens
gcggccccgcacccctcc

SEQ ID NO: 6259578 - DNA, 14 bp, Homo sapiens
gcggcccctcagcc

SEQ ID NO: 6259579 - DNA, 15 bp, Homo sapiens
gcggcccctcagcct

SEQ ID NO: 6259580 - DNA, 14 bp, Homo sapiens
gcggcccctcccac

SEQ ID NO: 6259581 - DNA, 15 bp, Homo sapiens
gcggcccctcccaca

SEQ ID NO: 6259582 - DNA, 16 bp, Homo sapiens
gcggcccctcccgccc

SEQ ID NO: 6259583 - DNA, 17 bp, Homo sapiens
gcggcccctctgttctg

SEQ ID NO: 6259584 - DNA, 16 bp, Homo sapiens
gcggcccgcgcagctg

SEQ ID NO: 6259585 - DNA, 17 bp, Homo sapiens
gcggcccgcgcagctgc

SEQ ID NO: 6259586 - DNA, 12 bp, Homo sapiens
gcggcccggcca

SEQ ID NO: 6259587 - DNA, 21 bp, Homo sapiens
gcggcccggcccacgcagagc

SEQ ID NO: 6259588 - DNA, 13 bp, Homo sapiens
gcggcccgggccg

SEQ ID NO: 6259589 - DNA, 15 bp, Homo sapiens
gcggcccgtgcgcag

SEQ ID NO: 6259590 - DNA, 16 bp, Homo sapiens
gcggcccgtgcgcagc

SEQ ID NO: 6259591 - DNA, 19 bp, Homo sapiens
gcggccctcaaaagcactt

SEQ ID NO: 6259592 - DNA, 13 bp, Homo sapiens
gcggccctcagta

SEQ ID NO: 6259593 - DNA, 14 bp, Homo sapiens
gcggccctcagtgc

SEQ ID NO: 6259594 - DNA, 16 bp, Homo sapiens
gcggccctcccaggcg

SEQ ID NO: 6259595 - DNA, 13 bp, Homo sapiens
gcggccctgctga

SEQ ID NO: 6259596 - DNA, 13 bp, Homo sapiens
gcggccctggagg

SEQ ID NO: 6259597 - DNA, 12 bp, Homo sapiens
gcggccctgggg

SEQ ID NO: 6259598 - DNA, 17 bp, Homo sapiens
gcggccctggggcgggc

SEQ ID NO: 6259599 - DNA, 13 bp, Homo sapiens
gcggccctgtcat

SEQ ID NO: 6259600 - DNA, 17 bp, Homo sapiens
gcggccgaagcccacca

SEQ ID NO: 6259601 - DNA, 22 bp, Homo sapiens
gcggccgatgggagtctccctc

SEQ ID NO: 6259602 - DNA, 16 bp, Homo sapiens
gcggccgcagagactg

SEQ ID NO: 6259603 - DNA, 21 bp, Homo sapiens
gcggccgccccccgcccctcg

SEQ ID NO: 6259604 - DNA, 15 bp, Homo sapiens
gcggccgcccgcacg

SEQ ID NO: 6259605 - DNA, 22 bp, Homo sapiens
gcggccgcccgcacgtccgcgg

SEQ ID NO: 6259606 - DNA, 11 bp, Homo sapiens
gcggccgcctt

SEQ ID NO: 6259607 - DNA, 13 bp, Homo sapiens
gcggccgctctcc

SEQ ID NO: 6259608 - DNA, 12 bp, Homo sapiens
gcggccgggctg

SEQ ID NO: 6259609 - DNA, 14 bp, Homo sapiens
gcggccgggctgcc

SEQ ID NO: 6259610 - DNA, 16 bp, Homo sapiens
gcggccgggctgccct

SEQ ID NO: 6259611 - DNA, 21 bp, Homo sapiens
gcggccgtcaccccgccagcc

SEQ ID NO: 6259612 - DNA, 19 bp, Homo sapiens
gcggcctatgacttgggca

SEQ ID NO: 6259613 - DNA, 12 bp, Homo sapiens
gcggcctcacca

SEQ ID NO: 6259614 - DNA, 15 bp, Homo sapiens
gcggcctcaccaggc

SEQ ID NO: 6259615 - DNA, 14 bp, Homo sapiens
gcggcctcccaggt

SEQ ID NO: 6259616 - DNA, 16 bp, Homo sapiens
gcggcctcccgaggag

SEQ ID NO: 6259617 - DNA, 20 bp, Homo sapiens
gcggcctcccgaggaggggc

SEQ ID NO: 6259618 - DNA, 22 bp, Homo sapiens
gcggcctccggcgtcttgccca

SEQ ID NO: 6259619 - DNA, 23 bp, Homo sapiens
gcggcctccggcgtcttgcccag

SEQ ID NO: 6259620 - DNA, 19 bp, Homo sapiens
gcggcctccttctgagctc

SEQ ID NO: 6259621 - DNA, 13 bp, Homo sapiens
gcggcctgcagac

SEQ ID NO: 6259622 - DNA, 13 bp, Homo sapiens
gcggcctgcagtg

SEQ ID NO: 6259623 - DNA, 16 bp, Homo sapiens
gcggcctgcagtggtg

SEQ ID NO: 6259624 - DNA, 10 bp, Homo sapiens
gcggcctgga

SEQ ID NO: 6259625 - DNA, 18 bp, Homo sapiens
gcggcctggggggaacgg

SEQ ID NO: 6259626 - DNA, 22 bp, Homo sapiens
gcggcctggggggaacggatgc

SEQ ID NO: 6259627 - DNA, 21 bp, Homo sapiens
gcggcctgtgggtttgggtgc

SEQ ID NO: 6259628 - DNA, 20 bp, Homo sapiens
gcggcctgttgggcagagct

SEQ ID NO: 6259629 - DNA, 16 bp, Homo sapiens
gcggccttccaccggg

SEQ ID NO: 6259630 - DNA, 20 bp, Homo sapiens
gcggccttccaccgggcctg

SEQ ID NO: 6259631 - DNA, 18 bp, Homo sapiens
gcggccttgaagacagag

SEQ ID NO: 6259632 - DNA, 19 bp, Homo sapiens
gcggccttttccaaatgcc

SEQ ID NO: 6259633 - DNA, 22 bp, Homo sapiens
gcggcgatgcactcgcactgca

SEQ ID NO: 6259634 - DNA, 13 bp, Homo sapiens
gcggcgcagagcc

SEQ ID NO: 6259635 - DNA, 12 bp, Homo sapiens
gcggcgcagagg

SEQ ID NO: 6259636 - DNA, 16 bp, Homo sapiens
gcggcggtgggcgcct

SEQ ID NO: 6259637 - DNA, 15 bp, Homo sapiens
gcggcgtggagactg

SEQ ID NO: 6259638 - DNA, 21 bp, Homo sapiens
gcggcgtggagactggcaggc

SEQ ID NO: 6259639 - DNA, 22 bp, Homo sapiens
gcggctactcagcagccctcct

SEQ ID NO: 6259640 - DNA, 21 bp, Homo sapiens
gcggctaggccggccagctcc

SEQ ID NO: 6259641 - DNA, 16 bp, Homo sapiens
gcggctcagccttgca

SEQ ID NO: 6259642 - DNA, 18 bp, Homo sapiens
gcggctcccctctgcttc

SEQ ID NO: 6259643 - DNA, 20 bp, Homo sapiens
gcggctcccctctgcttctc

SEQ ID NO: 6259644 - DNA, 12 bp, Homo sapiens
gcggctcctcag

SEQ ID NO: 6259645 - DNA, 15 bp, Homo sapiens
gcggctcctcgcccc

SEQ ID NO: 6259646 - DNA, 20 bp, Homo sapiens
gcggctcctcgcccccacca

SEQ ID NO: 6259647 - DNA, 12 bp, Homo sapiens
gcggctcctggt

SEQ ID NO: 6259648 - DNA, 20 bp, Homo sapiens
gcggctctaaacctcaggcc

SEQ ID NO: 6259649 - DNA, 16 bp, Homo sapiens
gcggctctagccccag

SEQ ID NO: 6259650 - DNA, 13 bp, Homo sapiens
gcggctctcctga

SEQ ID NO: 6259651 - DNA, 11 bp, Homo sapiens
gcggctctgag

SEQ ID NO: 6259652 - DNA, 13 bp, Homo sapiens
gcggctctgagca

SEQ ID NO: 6259653 - DNA, 16 bp, Homo sapiens
gcggctctgagcaggg

SEQ ID NO: 6259654 - DNA, 18 bp, Homo sapiens
gcggctctgagcaggggc

SEQ ID NO: 6259655 - DNA, 14 bp, Homo sapiens
gcggctctgcccac

SEQ ID NO: 6259656 - DNA, 21 bp, Homo sapiens
gcggctctgcccacctctctt

SEQ ID NO: 6259657 - DNA, 12 bp, Homo sapiens
gcggctctggga

SEQ ID NO: 6259658 - DNA, 19 bp, Homo sapiens
gcggctgagctccagccac

SEQ ID NO: 6259659 - DNA, 14 bp, Homo sapiens
gcggctgaggacgg

SEQ ID NO: 6259660 - DNA, 20 bp, Homo sapiens
gcggctgaggacggggcaga

SEQ ID NO: 6259661 - DNA, 23 bp, Homo sapiens
gcggctgaggacggggcagagct

SEQ ID NO: 6259662 - DNA, 23 bp, Homo sapiens
gcggctgagtcatgatctccctg

SEQ ID NO: 6259663 - DNA, 12 bp, Homo sapiens
gcggctgctcct

SEQ ID NO: 6259664 - DNA, 19 bp, Homo sapiens
gcggctggaaagaggagaa

SEQ ID NO: 6259665 - DNA, 12 bp, Homo sapiens
gcggctggagcg

SEQ ID NO: 6259666 - DNA, 18 bp, Homo sapiens
gcggctggatgggggctc

SEQ ID NO: 6259667 - DNA, 22 bp, Homo sapiens
gcggctggatgggggctctgca

SEQ ID NO: 6259668 - DNA, 16 bp, Homo sapiens
gcggctggccatggag

SEQ ID NO: 6259669 - DNA, 14 bp, Homo sapiens
gcggctggctctgt

SEQ ID NO: 6259670 - DNA, 20 bp, Homo sapiens
gcggctggctctgtggaggg

SEQ ID NO: 6259671 - DNA, 22 bp, Homo sapiens
gcggctggctctgtggaggggc

SEQ ID NO: 6259672 - DNA, 16 bp, Homo sapiens
gcggctggggtcccag

SEQ ID NO: 6259673 - DNA, 18 bp, Homo sapiens
gcggctggggtcccagca

SEQ ID NO: 6259674 - DNA, 12 bp, Homo sapiens
gcggctgtgctt

SEQ ID NO: 6259675 - DNA, 15 bp, Homo sapiens
gcggctgtgggggag

SEQ ID NO: 6259676 - DNA, 13 bp, Homo sapiens
gcggcttccctgc

SEQ ID NO: 6259677 - DNA, 15 bp, Homo sapiens
gcggcttcctgtcca

SEQ ID NO: 6259678 - DNA, 19 bp, Homo sapiens
gcggcttcgcgctggaatc

SEQ ID NO: 6259679 - DNA, 16 bp, Homo sapiens
gcggcttggccgccat

SEQ ID NO: 6259680 - DNA, 16 bp, Homo sapiens
gcggctttctctgcct

SEQ ID NO: 6259681 - DNA, 23 bp, Homo sapiens
gcggctttctctgcctctgggca

SEQ ID NO: 6259682 - DNA, 19 bp, Homo sapiens
gcggcttttcagaagaaat

SEQ ID NO: 6259683 - DNA, 14 bp, Homo sapiens
gcgggaaaagcagc

SEQ ID NO: 6259684 - DNA, 16 bp, Homo sapiens
gcgggaaccctctggg

SEQ ID NO: 6259685 - DNA, 18 bp, Homo sapiens
gcgggaaccctctggggc

SEQ ID NO: 6259686 - DNA, 22 bp, Homo sapiens
gcgggaaccctctggggccctt

SEQ ID NO: 6259687 - DNA, 14 bp, Homo sapiens
gcgggaaggagggt

SEQ ID NO: 6259688 - DNA, 13 bp, Homo sapiens
gcgggaagggtgg

SEQ ID NO: 6259689 - DNA, 23 bp, Homo sapiens
gcgggaatactcttggtcacctc

SEQ ID NO: 6259690 - DNA, 19 bp, Homo sapiens
gcgggaatggcagctgcca

SEQ ID NO: 6259691 - DNA, 13 bp, Homo sapiens
gcgggacagccaa

SEQ ID NO: 6259692 - DNA, 14 bp, Homo sapiens
gcgggacccaggca

SEQ ID NO: 6259693 - DNA, 20 bp, Homo sapiens
gcgggaccggtacagaaagg

SEQ ID NO: 6259694 - DNA, 15 bp, Homo sapiens
gcgggacctgtggct

SEQ ID NO: 6259695 - DNA, 18 bp, Homo sapiens
gcgggactcagtgagctg

SEQ ID NO: 6259696 - DNA, 15 bp, Homo sapiens
gcgggagaactgaag

SEQ ID NO: 6259697 - DNA, 14 bp, Homo sapiens
gcgggagacagctt

SEQ ID NO: 6259698 - DNA, 12 bp, Homo sapiens
gcgggagccaga

SEQ ID NO: 6259699 - DNA, 13 bp, Homo sapiens
gcgggagccagac

SEQ ID NO: 6259700 - DNA, 15 bp, Homo sapiens
gcgggagccagactg

SEQ ID NO: 6259701 - DNA, 12 bp, Homo sapiens
gcgggaggaagc

SEQ ID NO: 6259702 - DNA, 13 bp, Homo sapiens
gcgggaggaagcc

SEQ ID NO: 6259703 - DNA, 12 bp, Homo sapiens
gcgggaggcacc

SEQ ID NO: 6259704 - DNA, 15 bp, Homo sapiens
gcgggaggcaccagc

SEQ ID NO: 6259705 - DNA, 13 bp, Homo sapiens
gcgggaggccctg

SEQ ID NO: 6259706 - DNA, 17 bp, Homo sapiens
gcgggaggccctggccc

SEQ ID NO: 6259707 - DNA, 16 bp, Homo sapiens
gcgggaggctggggcc

SEQ ID NO: 6259708 - DNA, 22 bp, Homo sapiens
gcgggaggctggggccccatct

SEQ ID NO: 6259709 - DNA, 12 bp, Homo sapiens
gcgggagggagt

SEQ ID NO: 6259710 - DNA, 20 bp, Homo sapiens
gcgggagggagtctcaggag

SEQ ID NO: 6259711 - DNA, 15 bp, Homo sapiens
gcgggagtcagggac

SEQ ID NO: 6259712 - DNA, 18 bp, Homo sapiens
gcgggagtctcctcactg

SEQ ID NO: 6259713 - DNA, 21 bp, Homo sapiens
gcgggagtctcctcactgcca

SEQ ID NO: 6259714 - DNA, 15 bp, Homo sapiens
gcgggatacagctga

SEQ ID NO: 6259715 - DNA, 21 bp, Homo sapiens
gcgggatcccagcatctcaga

SEQ ID NO: 6259716 - DNA, 15 bp, Homo sapiens
gcgggatgggccacc

SEQ ID NO: 6259717 - DNA, 15 bp, Homo sapiens
gcgggatggtgcaga

SEQ ID NO: 6259718 - DNA, 14 bp, Homo sapiens
gcgggcaaggagtg

SEQ ID NO: 6259719 - DNA, 14 bp, Homo sapiens
gcgggcacagccag

SEQ ID NO: 6259720 - DNA, 15 bp, Homo sapiens
gcgggcacagccagc

SEQ ID NO: 6259721 - DNA, 17 bp, Homo sapiens
gcgggcacagccagccc

SEQ ID NO: 6259722 - DNA, 13 bp, Homo sapiens
gcgggcacagggc

SEQ ID NO: 6259723 - DNA, 15 bp, Homo sapiens
gcgggcacagggcac

SEQ ID NO: 6259724 - DNA, 23 bp, Homo sapiens
gcgggcacagggcaccagaggcc

SEQ ID NO: 6259725 - DNA, 20 bp, Homo sapiens
gcgggcacgggtgtcacggc

SEQ ID NO: 6259726 - DNA, 18 bp, Homo sapiens
gcgggcagagggctggag

SEQ ID NO: 6259727 - DNA, 15 bp, Homo sapiens
gcgggcagcccagcc

SEQ ID NO: 6259728 - DNA, 22 bp, Homo sapiens
gcgggcagcccctgctggacca

SEQ ID NO: 6259729 - DNA, 13 bp, Homo sapiens
gcgggcagcgggc

SEQ ID NO: 6259730 - DNA, 22 bp, Homo sapiens
gcgggcagggccgctcgatgcc

SEQ ID NO: 6259731 - DNA, 19 bp, Homo sapiens
gcgggcagtgacgtgagtg

SEQ ID NO: 6259732 - DNA, 13 bp, Homo sapiens
gcgggccaaggac

SEQ ID NO: 6259733 - DNA, 20 bp, Homo sapiens
gcgggccaaggactgccgac

SEQ ID NO: 6259734 - DNA, 15 bp, Homo sapiens
gcgggccagccaggc

SEQ ID NO: 6259735 - DNA, 13 bp, Homo sapiens
gcgggccaggagg

SEQ ID NO: 6259736 - DNA, 17 bp, Homo sapiens
gcgggccaggaggctgc

SEQ ID NO: 6259737 - DNA, 21 bp, Homo sapiens
gcgggccaggaggctgccaca

SEQ ID NO: 6259738 - DNA, 13 bp, Homo sapiens
gcgggccaggcag

SEQ ID NO: 6259739 - DNA, 15 bp, Homo sapiens
gcgggccaggcccgc

SEQ ID NO: 6259740 - DNA, 18 bp, Homo sapiens
gcgggccaggcccgcacc

SEQ ID NO: 6259741 - DNA, 14 bp, Homo sapiens
gcgggccagggtgg

SEQ ID NO: 6259742 - DNA, 23 bp, Homo sapiens
gcgggccaggtctggcgccaggg

SEQ ID NO: 6259743 - DNA, 17 bp, Homo sapiens
gcgggccatgagggaca

SEQ ID NO: 6259744 - DNA, 22 bp, Homo sapiens
gcgggccatttcacattcctga

SEQ ID NO: 6259745 - DNA, 14 bp, Homo sapiens
gcgggcccagcact

SEQ ID NO: 6259746 - DNA, 20 bp, Homo sapiens
gcgggcccctcacctggtac

SEQ ID NO: 6259747 - DNA, 23 bp, Homo sapiens
gcgggcccctcacctggtacctg

SEQ ID NO: 6259748 - DNA, 18 bp, Homo sapiens
gcgggccctgcctgaggg

SEQ ID NO: 6259749 - DNA, 20 bp, Homo sapiens
gcgggccgtctcccttggcc

SEQ ID NO: 6259750 - DNA, 16 bp, Homo sapiens
gcgggccttgccagcg

SEQ ID NO: 6259751 - DNA, 15 bp, Homo sapiens
gcgggcgccatcttc

SEQ ID NO: 6259752 - DNA, 22 bp, Homo sapiens
gcgggcgcccgcggcgcgaccc

SEQ ID NO: 6259753 - DNA, 20 bp, Homo sapiens
gcgggcgcctgtagtcccag

SEQ ID NO: 6259754 - DNA, 15 bp, Homo sapiens
gcgggcgcgtgagtg

SEQ ID NO: 6259755 - DNA, 13 bp, Homo sapiens
gcaacttttaaag

SEQ ID NO: 6259756 - DNA, 14 bp, Homo sapiens
gcaacttttctcat

SEQ ID NO: 6259757 - DNA, 11 bp, Homo sapiens
gcaacttttta

SEQ ID NO: 6259758 - DNA, 19 bp, Homo sapiens
gcaactttttaattccata

SEQ ID NO: 6259759 - DNA, 21 bp, Homo sapiens
gcaacttttttatgtctctta

SEQ ID NO: 6259760 - DNA, 19 bp, Homo sapiens
gcaagaaaaaaaaatgcca

SEQ ID NO: 6259761 - DNA, 16 bp, Homo sapiens
gcaagaaaaaagtaca

SEQ ID NO: 6259762 - DNA, 16 bp, Homo sapiens
gcaagaaaagcgcaga

SEQ ID NO: 6259763 - DNA, 17 bp, Homo sapiens
gcaagaaagaaacccga

SEQ ID NO: 6259764 - DNA, 21 bp, Homo sapiens
gcaagaaagagggtcccaggg

SEQ ID NO: 6259765 - DNA, 11 bp, Homo sapiens
gcaagaaagcc

SEQ ID NO: 6259766 - DNA, 16 bp, Homo sapiens
gcaagaaagcttcctt

SEQ ID NO: 6259767 - DNA, 20 bp, Homo sapiens
gcaagaaaggggacccaaga

SEQ ID NO: 6259768 - DNA, 17 bp, Homo sapiens
gcaagaaatggcgtctg

SEQ ID NO: 6259769 - DNA, 21 bp, Homo sapiens
gcaagaaatggcgtctgctct

SEQ ID NO: 6259770 - DNA, 15 bp, Homo sapiens
gcaagaaattcatta

SEQ ID NO: 6259771 - DNA, 18 bp, Homo sapiens
gcaagaacccaagtgcct

SEQ ID NO: 6259772 - DNA, 21 bp, Homo sapiens
gcaagaacccaagtgcctcac

SEQ ID NO: 6259773 - DNA, 14 bp, Homo sapiens
gcaagaacttgttt

SEQ ID NO: 6259774 - DNA, 14 bp, Homo sapiens
gcaagaagaaaatg

SEQ ID NO: 6259775 - DNA, 15 bp, Homo sapiens
gcaagaagaaaatgt

SEQ ID NO: 6259776 - DNA, 18 bp, Homo sapiens
gcaagaagaaaatgtggc

SEQ ID NO: 6259777 - DNA, 14 bp, Homo sapiens
gcaagaagaatata

SEQ ID NO: 6259778 - DNA, 17 bp, Homo sapiens
gcaagaagattctaaaa

SEQ ID NO: 6259779 - DNA, 18 bp, Homo sapiens
gcaagaagcagcctgttt

SEQ ID NO: 6259780 - DNA, 13 bp, Homo sapiens
gcaagaagctgct

SEQ ID NO: 6259781 - DNA, 14 bp, Homo sapiens
gcaagaagctgctt

SEQ ID NO: 6259782 - DNA, 17 bp, Homo sapiens
gcaagaagctgcttctg

SEQ ID NO: 6259783 - DNA, 23 bp, Homo sapiens
gcaagaagctgcttctgcccaca

SEQ ID NO: 6259784 - DNA, 14 bp, Homo sapiens
gcaagaaggaaaga

SEQ ID NO: 6259785 - DNA, 15 bp, Homo sapiens
gcaagaaggaaagat

SEQ ID NO: 6259786 - DNA, 11 bp, Homo sapiens
gcaagaaggag

SEQ ID NO: 6259787 - DNA, 14 bp, Homo sapiens
gcaagaaggaggct

SEQ ID NO: 6259788 - DNA, 20 bp, Homo sapiens
gcaagaaggcaaaaatagtt

SEQ ID NO: 6259789 - DNA, 21 bp, Homo sapiens
gcaagaaggcaacttgaagaa

SEQ ID NO: 6259790 - DNA, 17 bp, Homo sapiens
gcaagaataaaaaagaa

SEQ ID NO: 6259791 - DNA, 11 bp, Homo sapiens
gcaagaatgaa

SEQ ID NO: 6259792 - DNA, 19 bp, Homo sapiens
gcaagaatgaaatgaatga

SEQ ID NO: 6259793 - DNA, 21 bp, Homo sapiens
gcaagaatggtggcttctttt

SEQ ID NO: 6259794 - DNA, 14 bp, Homo sapiens
gcaagaattaaaac

SEQ ID NO: 6259795 - DNA, 19 bp, Homo sapiens
gcaagaatttctggaagaa

SEQ ID NO: 6259796 - DNA, 21 bp, Homo sapiens
gcaagaatttctggaagaaag

SEQ ID NO: 6259797 - DNA, 13 bp, Homo sapiens
gcaagacacaggc

SEQ ID NO: 6259798 - DNA, 17 bp, Homo sapiens
gcaagacacaggctcag

SEQ ID NO: 6259799 - DNA, 23 bp, Homo sapiens
gcaagacacgtggcctcgtgagg

SEQ ID NO: 6259800 - DNA, 16 bp, Homo sapiens
gcaagacagaaaagtg

SEQ ID NO: 6259801 - DNA, 21 bp, Homo sapiens
gcaagacagtggcactaaaat

SEQ ID NO: 6259802 - DNA, 15 bp, Homo sapiens
gcaagaccagtcact

SEQ ID NO: 6259803 - DNA, 12 bp, Homo sapiens
gcaagacctcat

SEQ ID NO: 6259804 - DNA, 14 bp, Homo sapiens
gcaagacctcatct

SEQ ID NO: 6259805 - DNA, 15 bp, Homo sapiens
gcaagacctcatctc

SEQ ID NO: 6259806 - DNA, 24 bp, Homo sapiens
gcaagacctcatctgtggagctgc

SEQ ID NO: 6259807 - DNA, 12 bp, Homo sapiens
gcaagacctctt

SEQ ID NO: 6259808 - DNA, 15 bp, Homo sapiens
gcaagacctcttccc

SEQ ID NO: 6259809 - DNA, 22 bp, Homo sapiens
gcaagacctcttccctctgggc

SEQ ID NO: 6259810 - DNA, 19 bp, Homo sapiens
gcaagacgtaaagaatttt

SEQ ID NO: 6259811 - DNA, 17 bp, Homo sapiens
gcaagacgtcctggaat

SEQ ID NO: 6259812 - DNA, 19 bp, Homo sapiens
gcaagactccgtctcaaaa

SEQ ID NO: 6259813 - DNA, 23 bp, Homo sapiens
gcaagactctgccttaatttttg

SEQ ID NO: 6259814 - DNA, 14 bp, Homo sapiens
gcaagactgcaaga

SEQ ID NO: 6259815 - DNA, 21 bp, Homo sapiens
gcaagacttctctttgcctca

SEQ ID NO: 6259816 - DNA, 18 bp, Homo sapiens
gcaagagaatctgatcaa

SEQ ID NO: 6259817 - DNA, 12 bp, Homo sapiens
gcaagagaatta

SEQ ID NO: 6259818 - DNA, 14 bp, Homo sapiens
gcaagagaattatt

SEQ ID NO: 6259819 - DNA, 16 bp, Homo sapiens
gcaagagacagaatga

SEQ ID NO: 6259820 - DNA, 20 bp, Homo sapiens
gcaagagacagagcccccaa

SEQ ID NO: 6259821 - DNA, 16 bp, Homo sapiens
gcaagagagaaagaaa

SEQ ID NO: 6259822 - DNA, 14 bp, Homo sapiens
gcaagagagaacct

SEQ ID NO: 6259823 - DNA, 22 bp, Homo sapiens
gcaagagagaacctaactgtat

SEQ ID NO: 6259824 - DNA, 21 bp, Homo sapiens
gcaagagagcagcgcccaggc

SEQ ID NO: 6259825 - DNA, 17 bp, Homo sapiens
gcaagagatgagaaaca

SEQ ID NO: 6259826 - DNA, 18 bp, Homo sapiens
gcaagagatggaaaaaaa

SEQ ID NO: 6259827 - DNA, 16 bp, Homo sapiens
gcaagagccaggggtg

SEQ ID NO: 6259828 - DNA, 18 bp, Homo sapiens
gcaagagcctgagactgg

SEQ ID NO: 6259829 - DNA, 13 bp, Homo sapiens
gcaagagccttgg

SEQ ID NO: 6259830 - DNA, 14 bp, Homo sapiens
gcaagagctcagga

SEQ ID NO: 6259831 - DNA, 11 bp, Homo sapiens
gcaagaggagt

SEQ ID NO: 6259832 - DNA, 19 bp, Homo sapiens
gcaagaggatgaaggaagg

SEQ ID NO: 6259833 - DNA, 23 bp, Homo sapiens
gcaagaggcatcccaagacctca

SEQ ID NO: 6259834 - DNA, 18 bp, Homo sapiens
gcaagaggccgtggctgc

SEQ ID NO: 6259835 - DNA, 14 bp, Homo sapiens
gcaagaggcctcat

SEQ ID NO: 6259836 - DNA, 15 bp, Homo sapiens
gcaagaggcctcatg

SEQ ID NO: 6259837 - DNA, 17 bp, Homo sapiens
gcaagagggaacaaaac

SEQ ID NO: 6259838 - DNA, 18 bp, Homo sapiens
gcaagagggacagagccc

SEQ ID NO: 6259839 - DNA, 15 bp, Homo sapiens
gcaagagggagggga

SEQ ID NO: 6259840 - DNA, 21 bp, Homo sapiens
gcaagagggaggggacagagg

SEQ ID NO: 6259841 - DNA, 22 bp, Homo sapiens
gcaagagggaggggacagaggc

SEQ ID NO: 6259842 - DNA, 19 bp, Homo sapiens
gcaagaggtgcctgggagg

SEQ ID NO: 6259843 - DNA, 16 bp, Homo sapiens
gcaagaggtttcagca

SEQ ID NO: 6259844 - DNA, 20 bp, Homo sapiens
gcaagaggtttcagcattcc

SEQ ID NO: 6259845 - DNA, 20 bp, Homo sapiens
gcaagagtaagcagtgttac

SEQ ID NO: 6259846 - DNA, 19 bp, Homo sapiens
gcaagagtgattgcagctt

SEQ ID NO: 6259847 - DNA, 21 bp, Homo sapiens
gcaagagtgggctttccaggg

SEQ ID NO: 6259848 - DNA, 19 bp, Homo sapiens
gcaagagtgtggaggctga

SEQ ID NO: 6259849 - DNA, 17 bp, Homo sapiens
gcaagatacaggaaaaa

SEQ ID NO: 6259850 - DNA, 22 bp, Homo sapiens
gcaagatagctccttcatgctt

SEQ ID NO: 6259851 - DNA, 15 bp, Homo sapiens
gcaagatatttttga

SEQ ID NO: 6259852 - DNA, 13 bp, Homo sapiens
gcaagatgaattt

SEQ ID NO: 6259853 - DNA, 17 bp, Homo sapiens
gcaagatgaattttatc

SEQ ID NO: 6259854 - DNA, 21 bp, Homo sapiens
gcaagatgatttttaagtaca

SEQ ID NO: 6259855 - DNA, 22 bp, Homo sapiens
gcaagatggcacagggcatgaa

SEQ ID NO: 6259856 - DNA, 15 bp, Homo sapiens
gcaagatgtgaatta

SEQ ID NO: 6259857 - DNA, 17 bp, Homo sapiens
gcaagatgtgaattatt

SEQ ID NO: 6259858 - DNA, 13 bp, Homo sapiens
gcaagatgtttct

SEQ ID NO: 6259859 - DNA, 14 bp, Homo sapiens
gcaagatgtttctt

SEQ ID NO: 6259860 - DNA, 14 bp, Homo sapiens
gcaagattgtgtcc

SEQ ID NO: 6259861 - DNA, 12 bp, Homo sapiens
gcaagcaaagca

SEQ ID NO: 6259862 - DNA, 22 bp, Homo sapiens
gcaagcaacttgcaggctccat

SEQ ID NO: 6259863 - DNA, 17 bp, Homo sapiens
gcaagcaagctctcttg

SEQ ID NO: 6259864 - DNA, 14 bp, Homo sapiens
gcaagcaattctgc

SEQ ID NO: 6259865 - DNA, 15 bp, Homo sapiens
gcaagcacagccctt

SEQ ID NO: 6259866 - DNA, 15 bp, Homo sapiens
gcaagcaccaacctc

SEQ ID NO: 6259867 - DNA, 19 bp, Homo sapiens
gcaagcaccaacctccaga

SEQ ID NO: 6259868 - DNA, 22 bp, Homo sapiens
gcaagcaccaacctccagactc

SEQ ID NO: 6259869 - DNA, 15 bp, Homo sapiens
gcaagcacctcctgc

SEQ ID NO: 6259870 - DNA, 13 bp, Homo sapiens
gcaagcacctggg

SEQ ID NO: 6259871 - DNA, 16 bp, Homo sapiens
gcaagcacctgggtgt

SEQ ID NO: 6259872 - DNA, 21 bp, Homo sapiens
gcaagcacctgttaataaagg

SEQ ID NO: 6259873 - DNA, 18 bp, Homo sapiens
gcaagcacgggacaggag

SEQ ID NO: 6259874 - DNA, 21 bp, Homo sapiens
gcaagcactgcatgggcaagc

SEQ ID NO: 6259875 - DNA, 18 bp, Homo sapiens
gcaagcagcctcctgggc

SEQ ID NO: 6259876 - DNA, 21 bp, Homo sapiens
gcaagcagcctcctgggcagt

SEQ ID NO: 6259877 - DNA, 14 bp, Homo sapiens
gcaagcagggaaag

SEQ ID NO: 6259878 - DNA, 22 bp, Homo sapiens
gcaagcagggaaagctccacgg

SEQ ID NO: 6259879 - DNA, 23 bp, Homo sapiens
gcaagcagtctaccctgtccttt

SEQ ID NO: 6259880 - DNA, 19 bp, Homo sapiens
gcaagcagtgccctctgga

SEQ ID NO: 6259881 - DNA, 15 bp, Homo sapiens
gcaagcagtttcaat

SEQ ID NO: 6259882 - DNA, 22 bp, Homo sapiens
gcaagcatgtaacttatattaa

SEQ ID NO: 6259883 - DNA, 11 bp, Homo sapiens
gcaagccacca

SEQ ID NO: 6259884 - DNA, 22 bp, Homo sapiens
gcaagccagacctagcaggctg

SEQ ID NO: 6259885 - DNA, 13 bp, Homo sapiens
gcaagccaggaga

SEQ ID NO: 6259886 - DNA, 13 bp, Homo sapiens
gcaagccaggctc

SEQ ID NO: 6259887 - DNA, 20 bp, Homo sapiens
gcaagccaggctcactcaca

SEQ ID NO: 6259888 - DNA, 21 bp, Homo sapiens
gcaagccaggctcactcacag

SEQ ID NO: 6259889 - DNA, 11 bp, Homo sapiens
gcaagccaggg

SEQ ID NO: 6259890 - DNA, 15 bp, Homo sapiens
gcaagccagggccca

SEQ ID NO: 6259891 - DNA, 19 bp, Homo sapiens
gcaagccagggcccagagc

SEQ ID NO: 6259892 - DNA, 18 bp, Homo sapiens
gcaagccataacgtgccc

SEQ ID NO: 6259893 - DNA, 20 bp, Homo sapiens
gcaagccataacgtgccccc

SEQ ID NO: 6259894 - DNA, 17 bp, Homo sapiens
gcaagcccacctcggcc

SEQ ID NO: 6259895 - DNA, 16 bp, Homo sapiens
gcaagccccagggcct

SEQ ID NO: 6259896 - DNA, 18 bp, Homo sapiens
gcaagccccagggcctgg

SEQ ID NO: 6259897 - DNA, 20 bp, Homo sapiens
gcaagccccattcacggcct

SEQ ID NO: 6259898 - DNA, 14 bp, Homo sapiens
gcaagcccctcagc

SEQ ID NO: 6259899 - DNA, 18 bp, Homo sapiens
gcaagcccctcagccctt

SEQ ID NO: 6259900 - DNA, 21 bp, Homo sapiens
gcaagccctacagagctgtgg

SEQ ID NO: 6259901 - DNA, 17 bp, Homo sapiens
gcaagccctgcccacag

SEQ ID NO: 6259902 - DNA, 18 bp, Homo sapiens
gcaagccctgcccacaga

SEQ ID NO: 6259903 - DNA, 15 bp, Homo sapiens
gcaagccggcagaaa

SEQ ID NO: 6259904 - DNA, 11 bp, Homo sapiens
gcaagcctcag

SEQ ID NO: 6259905 - DNA, 15 bp, Homo sapiens
gcaagcctgagtggt

SEQ ID NO: 6259906 - DNA, 20 bp, Homo sapiens
gcaagcctgagtggtgaggg

SEQ ID NO: 6259907 - DNA, 11 bp, Homo sapiens
gcaagcctgcg

SEQ ID NO: 6259908 - DNA, 24 bp, Homo sapiens
gcaagcctgcgttcttgtgacaga

SEQ ID NO: 6259909 - DNA, 16 bp, Homo sapiens
gcaagcctttgacctg

SEQ ID NO: 6259910 - DNA, 19 bp, Homo sapiens
gcaagcgagcacagtatta

SEQ ID NO: 6259911 - DNA, 17 bp, Homo sapiens
gcaagcgcagggaggat

SEQ ID NO: 6259912 - DNA, 17 bp, Homo sapiens
gcaagcgtgttctcagc

SEQ ID NO: 6259913 - DNA, 15 bp, Homo sapiens
gcaagctaaccttat

SEQ ID NO: 6259914 - DNA, 13 bp, Homo sapiens
gcaagctagaact

SEQ ID NO: 6259915 - DNA, 22 bp, Homo sapiens
gcaagctaggccccagaggccc

SEQ ID NO: 6259916 - DNA, 23 bp, Homo sapiens
gcaagctaggccccagaggccct

SEQ ID NO: 6259917 - DNA, 17 bp, Homo sapiens
gcaagctcagggtgctc

SEQ ID NO: 6259918 - DNA, 17 bp, Homo sapiens
gcaagctcatagcacat

SEQ ID NO: 6259919 - DNA, 20 bp, Homo sapiens
gcaagctcatagcacatgtt

SEQ ID NO: 6259920 - DNA, 18 bp, Homo sapiens
gcaagctccagtagctcc

SEQ ID NO: 6259921 - DNA, 21 bp, Homo sapiens
gcaagctctcagcaagtgccc

SEQ ID NO: 6259922 - DNA, 15 bp, Homo sapiens
gcaagctcttctcct

SEQ ID NO: 6259923 - DNA, 19 bp, Homo sapiens
gcaagctgattaaatgaca

SEQ ID NO: 6259924 - DNA, 12 bp, Homo sapiens
gcaagctgcagg

SEQ ID NO: 6259925 - DNA, 13 bp, Homo sapiens
gcaagctgcaggt

SEQ ID NO: 6259926 - DNA, 19 bp, Homo sapiens
gcaagctgcccagccctgg

SEQ ID NO: 6259927 - DNA, 21 bp, Homo sapiens
gcaagctgcccagccctggcc

SEQ ID NO: 6259928 - DNA, 15 bp, Homo sapiens
gcaagctggcaggag

SEQ ID NO: 6259929 - DNA, 17 bp, Homo sapiens
gcaagctggcggctggg

SEQ ID NO: 6259930 - DNA, 17 bp, Homo sapiens
gcaagctgtgttacttg

SEQ ID NO: 6259931 - DNA, 23 bp, Homo sapiens
gcaagctgtgttacttgaagtaa

SEQ ID NO: 6259932 - DNA, 20 bp, Homo sapiens
gcaagcttacacaagaagtg

SEQ ID NO: 6259933 - DNA, 21 bp, Homo sapiens
gcaagcttatttagcacattt

SEQ ID NO: 6259934 - DNA, 15 bp, Homo sapiens
gcgggcggaggcggc

SEQ ID NO: 6259935 - DNA, 14 bp, Homo sapiens
gcgggcggagggag

SEQ ID NO: 6259936 - DNA, 17 bp, Homo sapiens
gcgggcggagggagggg

SEQ ID NO: 6259937 - DNA, 19 bp, Homo sapiens
gcgggcggatcacgaggtc

SEQ ID NO: 6259938 - DNA, 15 bp, Homo sapiens
gcgggcggccaggca

SEQ ID NO: 6259939 - DNA, 23 bp, Homo sapiens
gcgggctaacgggaggctgggca

SEQ ID NO: 6259940 - DNA, 13 bp, Homo sapiens
gcgggctcagagc

SEQ ID NO: 6259941 - DNA, 16 bp, Homo sapiens
gcgggctccctcctct

SEQ ID NO: 6259942 - DNA, 18 bp, Homo sapiens
gcgggctccctcctctgg

SEQ ID NO: 6259943 - DNA, 19 bp, Homo sapiens
gcgggctccctcctctggc

SEQ ID NO: 6259944 - DNA, 16 bp, Homo sapiens
gcgggctccctggcag

SEQ ID NO: 6259945 - DNA, 18 bp, Homo sapiens
gcgggctccctggcagga

SEQ ID NO: 6259946 - DNA, 21 bp, Homo sapiens
gcgggctccctggcaggatgc

SEQ ID NO: 6259947 - DNA, 13 bp, Homo sapiens
gcgggctcgccca

SEQ ID NO: 6259948 - DNA, 12 bp, Homo sapiens
gcgggctgagga

SEQ ID NO: 6259949 - DNA, 15 bp, Homo sapiens
gcgggctgaggagac

SEQ ID NO: 6259950 - DNA, 19 bp, Homo sapiens
gcgggctggcgggcctttt

SEQ ID NO: 6259951 - DNA, 15 bp, Homo sapiens
gcgggcttcctcctg

SEQ ID NO: 6259952 - DNA, 17 bp, Homo sapiens
gcggggacaccgggaag

SEQ ID NO: 6259953 - DNA, 17 bp, Homo sapiens
gcggggacagctccttc

SEQ ID NO: 6259954 - DNA, 16 bp, Homo sapiens
gcggggaccctgccga

SEQ ID NO: 6259955 - DNA, 17 bp, Homo sapiens
gcggggaccttggtctg

SEQ ID NO: 6259956 - DNA, 19 bp, Homo sapiens
gcggggactcggtaagcac

SEQ ID NO: 6259957 - DNA, 18 bp, Homo sapiens
gcggggagagaggaggag

SEQ ID NO: 6259958 - DNA, 22 bp, Homo sapiens
gcggggaggaggaacgggcagc

SEQ ID NO: 6259959 - DNA, 15 bp, Homo sapiens
gcggggaggaggctg

SEQ ID NO: 6259960 - DNA, 16 bp, Homo sapiens
gcggggagtacaaggc

SEQ ID NO: 6259961 - DNA, 23 bp, Homo sapiens
gcggggatcagagcgcacaggga

SEQ ID NO: 6259962 - DNA, 13 bp, Homo sapiens
gcggggcagcagg

SEQ ID NO: 6259963 - DNA, 15 bp, Homo sapiens
gcggggcaggaggcc

SEQ ID NO: 6259964 - DNA, 21 bp, Homo sapiens
gcggggcagtatgtgatggac

SEQ ID NO: 6259965 - DNA, 22 bp, Homo sapiens
gcggggcccagcgctctcctgg

SEQ ID NO: 6259966 - DNA, 17 bp, Homo sapiens
gcggggcgaagcccagg

SEQ ID NO: 6259967 - DNA, 18 bp, Homo sapiens
gcggggcgaagcccaggc

SEQ ID NO: 6259968 - DNA, 18 bp, Homo sapiens
gcggggcgccccaagagc

SEQ ID NO: 6259969 - DNA, 22 bp, Homo sapiens
gcggggctacagattgggcggg

SEQ ID NO: 6259970 - DNA, 13 bp, Homo sapiens
gcggggctatgcc

SEQ ID NO: 6259971 - DNA, 11 bp, Homo sapiens
gcggggctggc

SEQ ID NO: 6259972 - DNA, 18 bp, Homo sapiens
gcggggctggccagctgt

SEQ ID NO: 6259973 - DNA, 18 bp, Homo sapiens
gcggggctgtcggcgctg

SEQ ID NO: 6259974 - DNA, 15 bp, Homo sapiens
gcggggcttctctcc

SEQ ID NO: 6259975 - DNA, 11 bp, Homo sapiens
gcgggggagcc

SEQ ID NO: 6259976 - DNA, 13 bp, Homo sapiens
gcgggggagccag

SEQ ID NO: 6259977 - DNA, 13 bp, Homo sapiens
gcgggggagcctg

SEQ ID NO: 6259978 - DNA, 15 bp, Homo sapiens
gcgggggccagggaa

SEQ ID NO: 6259979 - DNA, 15 bp, Homo sapiens
gcgggggcgtggctg

SEQ ID NO: 6259980 - DNA, 22 bp, Homo sapiens
gcgggggctaactggccccagg

SEQ ID NO: 6259981 - DNA, 14 bp, Homo sapiens
gcgggggctgctca

SEQ ID NO: 6259982 - DNA, 22 bp, Homo sapiens
gcggggggggcgcctggagagc

SEQ ID NO: 6259983 - DNA, 22 bp, Homo sapiens
gcggggggtgtcttccctgcct

SEQ ID NO: 6259984 - DNA, 18 bp, Homo sapiens
gcgggggtctatacattc

SEQ ID NO: 6259985 - DNA, 16 bp, Homo sapiens
gcggggtttcaccatg

SEQ ID NO: 6259986 - DNA, 17 bp, Homo sapiens
gcgggtaaaaagagaag

SEQ ID NO: 6259987 - DNA, 24 bp, Homo sapiens
gcgggtagatgatttctagcaggc

SEQ ID NO: 6259988 - DNA, 15 bp, Homo sapiens
gcgggtcacaggagg

SEQ ID NO: 6259989 - DNA, 19 bp, Homo sapiens
gcgggtcacaggagggagg

SEQ ID NO: 6259990 - DNA, 15 bp, Homo sapiens
gcgggtctcctccca

SEQ ID NO: 6259991 - DNA, 16 bp, Homo sapiens
gcgggtctcctcccag

SEQ ID NO: 6259992 - DNA, 21 bp, Homo sapiens
gcgggtgaacaaagcagccac

SEQ ID NO: 6259993 - DNA, 15 bp, Homo sapiens
gcgggtgatgagacc

SEQ ID NO: 6259994 - DNA, 22 bp, Homo sapiens
gcgggtgcaagcactcggggtc

SEQ ID NO: 6259995 - DNA, 21 bp, Homo sapiens
gcgggtgctctgaggcctcac

SEQ ID NO: 6259996 - DNA, 20 bp, Homo sapiens
gcgggtggatcacctgaggt

SEQ ID NO: 6259997 - DNA, 12 bp, Homo sapiens
gcgggtggctgc

SEQ ID NO: 6259998 - DNA, 19 bp, Homo sapiens
gcgggttataatgaatgac

SEQ ID NO: 6259999 - DNA, 13 bp, Homo sapiens
gcgggttctagac

SEQ ID NO: 6260000 - DNA, 11 bp, Homo sapiens
gcggtacccca

SEQ ID NO: 6260001 - DNA, 17 bp, Homo sapiens
gcggtaggggctgcagg

SEQ ID NO: 6260002 - DNA, 14 bp, Homo sapiens
gcggtatccagagg

SEQ ID NO: 6260003 - DNA, 14 bp, Homo sapiens
gcggtcacagcatg

SEQ ID NO: 6260004 - DNA, 19 bp, Homo sapiens
gcggtcaggctgggcagcc

SEQ ID NO: 6260005 - DNA, 17 bp, Homo sapiens
gcggtcatgtgtgcatg

SEQ ID NO: 6260006 - DNA, 18 bp, Homo sapiens
gcggtcatgtgtgcatgt

SEQ ID NO: 6260007 - DNA, 13 bp, Homo sapiens
gcggtccacccag

SEQ ID NO: 6260008 - DNA, 18 bp, Homo sapiens
gcggtccacccaggagcc

SEQ ID NO: 6260009 - DNA, 23 bp, Homo sapiens
gcggtccacccaggagccccgag

SEQ ID NO: 6260010 - DNA, 14 bp, Homo sapiens
gcggtccagaagga

SEQ ID NO: 6260011 - DNA, 22 bp, Homo sapiens
gcggtccagaggaggtgcccgg

SEQ ID NO: 6260012 - DNA, 16 bp, Homo sapiens
gcggtccccatcccca

SEQ ID NO: 6260013 - DNA, 21 bp, Homo sapiens
gcggtccctgtccctctagtg

SEQ ID NO: 6260014 - DNA, 15 bp, Homo sapiens
gcggtcctgcacaga

SEQ ID NO: 6260015 - DNA, 16 bp, Homo sapiens
gcggtcgcggctggga

SEQ ID NO: 6260016 - DNA, 22 bp, Homo sapiens
gcggtctcaggctggtgggagg

SEQ ID NO: 6260017 - DNA, 19 bp, Homo sapiens
gcggtcttcaacatcctgc

SEQ ID NO: 6260018 - DNA, 14 bp, Homo sapiens
gcggtgaccagcct

SEQ ID NO: 6260019 - DNA, 21 bp, Homo sapiens
gcggtgaccagcctgtcaccc

SEQ ID NO: 6260020 - DNA, 13 bp, Homo sapiens
gcggtgaggcagg

SEQ ID NO: 6260021 - DNA, 17 bp, Homo sapiens
gcggtgaggtgggggca

SEQ ID NO: 6260022 - DNA, 15 bp, Homo sapiens
gcggtgccatgtctg

SEQ ID NO: 6260023 - DNA, 15 bp, Homo sapiens
gcggtgccgcgctcc

SEQ ID NO: 6260024 - DNA, 22 bp, Homo sapiens
gcggtgctatctcccccagccc

SEQ ID NO: 6260025 - DNA, 22 bp, Homo sapiens
gcggtgctgactgaggcctgct

SEQ ID NO: 6260026 - DNA, 18 bp, Homo sapiens
gcggtggaaggcccgagg

SEQ ID NO: 6260027 - DNA, 15 bp, Homo sapiens
gcggtggaggaaggc

SEQ ID NO: 6260028 - DNA, 17 bp, Homo sapiens
gcggtggaggaaggctc

SEQ ID NO: 6260029 - DNA, 15 bp, Homo sapiens
gcggtggctcacgcc

SEQ ID NO: 6260030 - DNA, 19 bp, Homo sapiens
gcggtggctcttgcctgta

SEQ ID NO: 6260031 - DNA, 20 bp, Homo sapiens
gcggtgggacctagggaggc

SEQ ID NO: 6260032 - DNA, 14 bp, Homo sapiens
gcggtgggcctggt

SEQ ID NO: 6260033 - DNA, 13 bp, Homo sapiens
gcggtgggtgctg

SEQ ID NO: 6260034 - DNA, 17 bp, Homo sapiens
gcggtggtgccagaggt

SEQ ID NO: 6260035 - DNA, 21 bp, Homo sapiens
gcggtgtctctcctgcccctt

SEQ ID NO: 6260036 - DNA, 22 bp, Homo sapiens
gcggtgtgagatggtgccccct

SEQ ID NO: 6260037 - DNA, 21 bp, Homo sapiens
gcggtgtgtcctctgtgccca

SEQ ID NO: 6260038 - DNA, 23 bp, Homo sapiens
gcggttatgaaattcaccccctt

SEQ ID NO: 6260039 - DNA, 19 bp, Homo sapiens
gcggttcaggtcagggcta

SEQ ID NO: 6260040 - DNA, 18 bp, Homo sapiens
gcggttccggcatggaca

SEQ ID NO: 6260041 - DNA, 19 bp, Homo sapiens
gcggttcctcatctgagag

SEQ ID NO: 6260042 - DNA, 20 bp, Homo sapiens
gcggttcctgtgcagatgct

SEQ ID NO: 6260043 - DNA, 15 bp, Homo sapiens
gcggttgggaggcag

SEQ ID NO: 6260044 - DNA, 16 bp, Homo sapiens
gcggttgggaggcagg

SEQ ID NO: 6260045 - DNA, 23 bp, Homo sapiens
gcggttgtaaatacaattcaaac

SEQ ID NO: 6260046 - DNA, 22 bp, Homo sapiens
gcggtttaaccacattaattaa

SEQ ID NO: 6260047 - DNA, 15 bp, Homo sapiens
gcggtttccaggaag

SEQ ID NO: 6260048 - DNA, 14 bp, Homo sapiens
gcggtttcctggtg

SEQ ID NO: 6260049 - DNA, 18 bp, Homo sapiens
gcgtaagtacagagaagc

SEQ ID NO: 6260050 - DNA, 20 bp, Homo sapiens
gcgtaagtacagagaagcca

SEQ ID NO: 6260051 - DNA, 14 bp, Homo sapiens
gcgtaatgggcctg

SEQ ID NO: 6260052 - DNA, 16 bp, Homo sapiens
gcgtactacccagctc

SEQ ID NO: 6260053 - DNA, 19 bp, Homo sapiens
gcgtactacccagctctgt

SEQ ID NO: 6260054 - DNA, 19 bp, Homo sapiens
gcgtagaaaacgcacctcc

SEQ ID NO: 6260055 - DNA, 12 bp, Homo sapiens
gcgtagaagtgg

SEQ ID NO: 6260056 - DNA, 15 bp, Homo sapiens
gcgtagaagtttttg

SEQ ID NO: 6260057 - DNA, 22 bp, Homo sapiens
gcgtagacttgacaacatccca

SEQ ID NO: 6260058 - DNA, 15 bp, Homo sapiens
gcgtagagagccggg

SEQ ID NO: 6260059 - DNA, 17 bp, Homo sapiens
gcgtagcacccacaagt

SEQ ID NO: 6260060 - DNA, 20 bp, Homo sapiens
gcgtagctctcaaatgtgtg

SEQ ID NO: 6260061 - DNA, 20 bp, Homo sapiens
gcgtaggctacagagaagcc

SEQ ID NO: 6260062 - DNA, 14 bp, Homo sapiens
gcgtatgagtccca

SEQ ID NO: 6260063 - DNA, 19 bp, Homo sapiens
gcgtatgcagtgtagattt

SEQ ID NO: 6260064 - DNA, 13 bp, Homo sapiens
gcgtatgtctgtt

SEQ ID NO: 6260065 - DNA, 18 bp, Homo sapiens
gcgtatgttcgttgcagc

SEQ ID NO: 6260066 - DNA, 14 bp, Homo sapiens
gcgtattctgtggc

SEQ ID NO: 6260067 - DNA, 22 bp, Homo sapiens
gcgtatttagactgtggccata

SEQ ID NO: 6260068 - DNA, 22 bp, Homo sapiens
gcgtatttatttttctgcacct

SEQ ID NO: 6260069 - DNA, 17 bp, Homo sapiens
gcgtcactccagtgctc

SEQ ID NO: 6260070 - DNA, 19 bp, Homo sapiens
gcgtcactgcccaccaaag

SEQ ID NO: 6260071 - DNA, 21 bp, Homo sapiens
gcgtcactgcccaccaaaggt

SEQ ID NO: 6260072 - DNA, 22 bp, Homo sapiens
gcgtcactgcccaccaaaggtc

SEQ ID NO: 6260073 - DNA, 16 bp, Homo sapiens
gcgtcagcctccagcc

SEQ ID NO: 6260074 - DNA, 18 bp, Homo sapiens
gcgtcagcctccagcctc

SEQ ID NO: 6260075 - DNA, 21 bp, Homo sapiens
gcgtcaggcacgtctcctgct

SEQ ID NO: 6260076 - DNA, 16 bp, Homo sapiens
gcgtcaggcagaggca

SEQ ID NO: 6260077 - DNA, 12 bp, Homo sapiens
gcgtcaggccta

SEQ ID NO: 6260078 - DNA, 20 bp, Homo sapiens
gcgtcaggggtgcacagtcc

SEQ ID NO: 6260079 - DNA, 21 bp, Homo sapiens
gcgtcagggttggtgtgctga

SEQ ID NO: 6260080 - DNA, 15 bp, Homo sapiens
gcgtcatctggtcct

SEQ ID NO: 6260081 - DNA, 21 bp, Homo sapiens
gcgtcatgggccccccatgca

SEQ ID NO: 6260082 - DNA, 22 bp, Homo sapiens
gcgtccactttcccttcccctg

SEQ ID NO: 6260083 - DNA, 18 bp, Homo sapiens
gcgtccagctcagccctg

SEQ ID NO: 6260084 - DNA, 19 bp, Homo sapiens
gcgtccaggtgatccccca

SEQ ID NO: 6260085 - DNA, 15 bp, Homo sapiens
gcgtcccccagccct

SEQ ID NO: 6260086 - DNA, 20 bp, Homo sapiens
gcgtcccccagccctcaggc

SEQ ID NO: 6260087 - DNA, 14 bp, Homo sapiens
gcgtcccccgccgc

SEQ ID NO: 6260088 - DNA, 17 bp, Homo sapiens
gcgtcccccgccgcgcc

SEQ ID NO: 6260089 - DNA, 15 bp, Homo sapiens
gcgtcccgcacctgt

SEQ ID NO: 6260090 - DNA, 18 bp, Homo sapiens
gcgtccctgccccgaccc

SEQ ID NO: 6260091 - DNA, 20 bp, Homo sapiens
gcgtccctgctcagcccatc

SEQ ID NO: 6260092 - DNA, 13 bp, Homo sapiens
gcgtcctcagcac

SEQ ID NO: 6260093 - DNA, 18 bp, Homo sapiens
gcgtcctcagcaccccac

SEQ ID NO: 6260094 - DNA, 22 bp, Homo sapiens
gcgtcctcatttcccctcccaa

SEQ ID NO: 6260095 - DNA, 22 bp, Homo sapiens
gcgtcctccatcttccaggatg

SEQ ID NO: 6260096 - DNA, 20 bp, Homo sapiens
gcgtcctcctcacctcatgc

SEQ ID NO: 6260097 - DNA, 23 bp, Homo sapiens
gcgtcctcgttcaaaacattcca

SEQ ID NO: 6260098 - DNA, 18 bp, Homo sapiens
gcgtcctctccctcctgg

SEQ ID NO: 6260099 - DNA, 21 bp, Homo sapiens
gcgtcctctccctcctggcca

SEQ ID NO: 6260100 - DNA, 22 bp, Homo sapiens
gcgtcctctccctcctggccag

SEQ ID NO: 6260101 - DNA, 13 bp, Homo sapiens
gcgtcctgaggaa

SEQ ID NO: 6260102 - DNA, 15 bp, Homo sapiens
gcgtcctgcagagga

SEQ ID NO: 6260103 - DNA, 12 bp, Homo sapiens
gcgtcctgccct

SEQ ID NO: 6260104 - DNA, 13 bp, Homo sapiens
gcgtcctgccctg

SEQ ID NO: 6260105 - DNA, 21 bp, Homo sapiens
gcgtccttccccctgtagact

SEQ ID NO: 6260106 - DNA, 13 bp, Homo sapiens
gcgtcgagctggg

SEQ ID NO: 6260107 - DNA, 15 bp, Homo sapiens
gcgtcgagctgggaa

SEQ ID NO: 6260108 - DNA, 16 bp, Homo sapiens
gcgtcgccccagtggc

SEQ ID NO: 6260109 - DNA, 23 bp, Homo sapiens
gcgtcgccccagtggcactgaag

SEQ ID NO: 6260110 - DNA, 12 bp, Homo sapiens
gcgtcggccaga

SEQ ID NO: 6260111 - DNA, 14 bp, Homo sapiens
gcgtctacccagac

SEQ ID NO: 6260112 - DNA, 14 bp, Homo sapiens
gcgtctagcttagt

SEQ ID NO: 6260113 - DNA, 14 bp, Homo sapiens
gcaagcttcttgct

SEQ ID NO: 6260114 - DNA, 15 bp, Homo sapiens
gcaagcttgaggcca

SEQ ID NO: 6260115 - DNA, 18 bp, Homo sapiens
gcaaggaaaaagaaaata

SEQ ID NO: 6260116 - DNA, 18 bp, Homo sapiens
gcaaggaaacaggctcca

SEQ ID NO: 6260117 - DNA, 10 bp, Homo sapiens
gcaaggaaag

SEQ ID NO: 6260118 - DNA, 21 bp, Homo sapiens
gcaaggaaatgtcctgcatgg

SEQ ID NO: 6260119 - DNA, 18 bp, Homo sapiens
gcaaggaacagaagtgag

SEQ ID NO: 6260120 - DNA, 20 bp, Homo sapiens
gcaaggaacagaagtgagga

SEQ ID NO: 6260121 - DNA, 17 bp, Homo sapiens
gcaaggaagcagagcac

SEQ ID NO: 6260122 - DNA, 22 bp, Homo sapiens
gcaaggaagctttggaagcagc

SEQ ID NO: 6260123 - DNA, 13 bp, Homo sapiens
gcaaggaaggaaa

SEQ ID NO: 6260124 - DNA, 14 bp, Homo sapiens
gcaaggaaggaaag

SEQ ID NO: 6260125 - DNA, 12 bp, Homo sapiens
gcaaggaaggac

SEQ ID NO: 6260126 - DNA, 18 bp, Homo sapiens
gcaaggacattgccccaa

SEQ ID NO: 6260127 - DNA, 20 bp, Homo sapiens
gcaaggacattgccccaaga

SEQ ID NO: 6260128 - DNA, 21 bp, Homo sapiens
gcaaggacattgccccaagat

SEQ ID NO: 6260129 - DNA, 14 bp, Homo sapiens
gcaaggaccaggac

SEQ ID NO: 6260130 - DNA, 19 bp, Homo sapiens
gcaaggaggaggagtcaga

SEQ ID NO: 6260131 - DNA, 13 bp, Homo sapiens
gcaaggaggctgg

SEQ ID NO: 6260132 - DNA, 15 bp, Homo sapiens
gcaaggaggctggct

SEQ ID NO: 6260133 - DNA, 20 bp, Homo sapiens
gcaaggaggctggctggggc

SEQ ID NO: 6260134 - DNA, 17 bp, Homo sapiens
gcaaggagtgtaaaatg

SEQ ID NO: 6260135 - DNA, 21 bp, Homo sapiens
gcaaggagtttattacaatgt

SEQ ID NO: 6260136 - DNA, 22 bp, Homo sapiens
gcaaggagtttattacaatgta

SEQ ID NO: 6260137 - DNA, 16 bp, Homo sapiens
gcaaggatgaaagaca

SEQ ID NO: 6260138 - DNA, 15 bp, Homo sapiens
gcaaggatggtgggg

SEQ ID NO: 6260139 - DNA, 22 bp, Homo sapiens
gcaaggatggtggggcccccag

SEQ ID NO: 6260140 - DNA, 15 bp, Homo sapiens
gcaaggattacagaa

SEQ ID NO: 6260141 - DNA, 23 bp, Homo sapiens
gcaaggattacagaaactgatgc

SEQ ID NO: 6260142 - DNA, 20 bp, Homo sapiens
gcaaggattttttaaaaatt

SEQ ID NO: 6260143 - DNA, 16 bp, Homo sapiens
gcaaggcacaggctcc

SEQ ID NO: 6260144 - DNA, 13 bp, Homo sapiens
gcaaggcagccgt

SEQ ID NO: 6260145 - DNA, 16 bp, Homo sapiens
gcaaggcagctcccag

SEQ ID NO: 6260146 - DNA, 11 bp, Homo sapiens
gcaaggcaggt

SEQ ID NO: 6260147 - DNA, 18 bp, Homo sapiens
gcaaggcaggtgcctcca

SEQ ID NO: 6260148 - DNA, 19 bp, Homo sapiens
gcaaggcaggtgcctccag

SEQ ID NO: 6260149 - DNA, 21 bp, Homo sapiens
gcaaggcaggtgcctccaggt

SEQ ID NO: 6260150 - DNA, 22 bp, Homo sapiens
gcaaggcaggtgcctccaggtg

SEQ ID NO: 6260151 - DNA, 21 bp, Homo sapiens
gcaaggcagtctctatattat

SEQ ID NO: 6260152 - DNA, 14 bp, Homo sapiens
gcaaggccagggca

SEQ ID NO: 6260153 - DNA, 21 bp, Homo sapiens
gcaaggccagggcacagctgg

SEQ ID NO: 6260154 - DNA, 15 bp, Homo sapiens
gcaaggcccagacct

SEQ ID NO: 6260155 - DNA, 16 bp, Homo sapiens
gcaaggccccttccac

SEQ ID NO: 6260156 - DNA, 16 bp, Homo sapiens
gcaaggcccgagcagc

SEQ ID NO: 6260157 - DNA, 17 bp, Homo sapiens
gcaaggcccgagcagct

SEQ ID NO: 6260158 - DNA, 21 bp, Homo sapiens
gcaaggcccgagcagctgagc

SEQ ID NO: 6260159 - DNA, 15 bp, Homo sapiens
gcaaggccctgccct

SEQ ID NO: 6260160 - DNA, 16 bp, Homo sapiens
gcaaggccctgtccca

SEQ ID NO: 6260161 - DNA, 18 bp, Homo sapiens
gcaaggccctgtcccagc

SEQ ID NO: 6260162 - DNA, 19 bp, Homo sapiens
gcaaggccctgtcccagca

SEQ ID NO: 6260163 - DNA, 14 bp, Homo sapiens
gcaaggcctgtgct

SEQ ID NO: 6260164 - DNA, 17 bp, Homo sapiens
gcaaggcctgtgctgca

SEQ ID NO: 6260165 - DNA, 21 bp, Homo sapiens
gcaaggccttggtggagcagc

SEQ ID NO: 6260166 - DNA, 24 bp, Homo sapiens
gcaaggccttggtggagcagccag

SEQ ID NO: 6260167 - DNA, 19 bp, Homo sapiens
gcaaggcgcctgccttggg

SEQ ID NO: 6260168 - DNA, 12 bp, Homo sapiens
gcaaggctgact

SEQ ID NO: 6260169 - DNA, 14 bp, Homo sapiens
gcaaggctgattta

SEQ ID NO: 6260170 - DNA, 15 bp, Homo sapiens
gcaaggctgccctgt

SEQ ID NO: 6260171 - DNA, 12 bp, Homo sapiens
gcaaggctgccg

SEQ ID NO: 6260172 - DNA, 14 bp, Homo sapiens
gcaaggctgctaag

SEQ ID NO: 6260173 - DNA, 12 bp, Homo sapiens
gcaaggctgtcg

SEQ ID NO: 6260174 - DNA, 22 bp, Homo sapiens
gcaaggctgtgctcttcctctg

SEQ ID NO: 6260175 - DNA, 16 bp, Homo sapiens
gcaagggacaggaagg

SEQ ID NO: 6260176 - DNA, 20 bp, Homo sapiens
gcaagggacctgctcatcat

SEQ ID NO: 6260177 - DNA, 13 bp, Homo sapiens
gcaagggaccttc

SEQ ID NO: 6260178 - DNA, 12 bp, Homo sapiens
gcaagggactgt

SEQ ID NO: 6260179 - DNA, 15 bp, Homo sapiens
gcaagggagaaaaga

SEQ ID NO: 6260180 - DNA, 15 bp, Homo sapiens
gcaagggagaagaaa

SEQ ID NO: 6260181 - DNA, 15 bp, Homo sapiens
gcaagggaggggtgg

SEQ ID NO: 6260182 - DNA, 20 bp, Homo sapiens
gcaagggcatcaggcactgg

SEQ ID NO: 6260183 - DNA, 19 bp, Homo sapiens
gcaagggccatgctgaagg

SEQ ID NO: 6260184 - DNA, 13 bp, Homo sapiens
gcaagggcccaga

SEQ ID NO: 6260185 - DNA, 21 bp, Homo sapiens
gcaagggcggcctttcccact

SEQ ID NO: 6260186 - DNA, 20 bp, Homo sapiens
gcaagggctccagcatccag

SEQ ID NO: 6260187 - DNA, 21 bp, Homo sapiens
gcaagggctccagcatccagc

SEQ ID NO: 6260188 - DNA, 16 bp, Homo sapiens
gcaaggggaaaatctc

SEQ ID NO: 6260189 - DNA, 16 bp, Homo sapiens
gcaaggggaaacctgt

SEQ ID NO: 6260190 - DNA, 13 bp, Homo sapiens
gcaaggggacctt

SEQ ID NO: 6260191 - DNA, 13 bp, Homo sapiens
gcaaggggccagg

SEQ ID NO: 6260192 - DNA, 21 bp, Homo sapiens
gcaaggggcgcgcgcccccag

SEQ ID NO: 6260193 - DNA, 16 bp, Homo sapiens
gcaaggggctcagaac

SEQ ID NO: 6260194 - DNA, 21 bp, Homo sapiens
gcaaggggctgcatgacctac

SEQ ID NO: 6260195 - DNA, 22 bp, Homo sapiens
gcaaggggctgcttctggggct

SEQ ID NO: 6260196 - DNA, 16 bp, Homo sapiens
gcaagggggaaggctg

SEQ ID NO: 6260197 - DNA, 21 bp, Homo sapiens
gcaagggggaatattttaaaa

SEQ ID NO: 6260198 - DNA, 15 bp, Homo sapiens
gcaagggggacacat

SEQ ID NO: 6260199 - DNA, 14 bp, Homo sapiens
gcaaggggtgcctg

SEQ ID NO: 6260200 - DNA, 23 bp, Homo sapiens
gcaagggtcctacggagggacca

SEQ ID NO: 6260201 - DNA, 23 bp, Homo sapiens
gcaagggtgcttgtggtcacact

SEQ ID NO: 6260202 - DNA, 16 bp, Homo sapiens
gcaagggttccctcaa

SEQ ID NO: 6260203 - DNA, 15 bp, Homo sapiens
gcaaggtagcatggg

SEQ ID NO: 6260204 - DNA, 23 bp, Homo sapiens
gcaaggtattggtaggttactca

SEQ ID NO: 6260205 - DNA, 17 bp, Homo sapiens
gcaaggtcatagacaat

SEQ ID NO: 6260206 - DNA, 15 bp, Homo sapiens
gcaaggtcatttctt

SEQ ID NO: 6260207 - DNA, 22 bp, Homo sapiens
gcaaggtctcgggggtccggaa

SEQ ID NO: 6260208 - DNA, 13 bp, Homo sapiens
gcaaggtgaaacg

SEQ ID NO: 6260209 - DNA, 22 bp, Homo sapiens
gcaaggtgaacaccactttgtc

SEQ ID NO: 6260210 - DNA, 18 bp, Homo sapiens
gcaaggtggagtggatgc

SEQ ID NO: 6260211 - DNA, 17 bp, Homo sapiens
gcaaggtggcctctgcc

SEQ ID NO: 6260212 - DNA, 20 bp, Homo sapiens
gcaaggtggctccagcacca

SEQ ID NO: 6260213 - DNA, 18 bp, Homo sapiens
gcaaggtgggggagcctg

SEQ ID NO: 6260214 - DNA, 19 bp, Homo sapiens
gcaaggtgggggagcctgg

SEQ ID NO: 6260215 - DNA, 19 bp, Homo sapiens
gcaaggtgtccctgccttc

SEQ ID NO: 6260216 - DNA, 15 bp, Homo sapiens
gcaaggtgtgaatga

SEQ ID NO: 6260217 - DNA, 13 bp, Homo sapiens
gcaaggtgtgctc

SEQ ID NO: 6260218 - DNA, 20 bp, Homo sapiens
gcaaggtgtggaggctcctg

SEQ ID NO: 6260219 - DNA, 23 bp, Homo sapiens
gcaaggtgtggaggctcctgtgg

SEQ ID NO: 6260220 - DNA, 19 bp, Homo sapiens
gcaaggttaagcaaggtgg

SEQ ID NO: 6260221 - DNA, 13 bp, Homo sapiens
gcaaggttccaca

SEQ ID NO: 6260222 - DNA, 17 bp, Homo sapiens
gcaaggttccacagagt

SEQ ID NO: 6260223 - DNA, 14 bp, Homo sapiens
gcaaggtttaagtt

SEQ ID NO: 6260224 - DNA, 22 bp, Homo sapiens
gcaaggtttaagttattaagag

SEQ ID NO: 6260225 - DNA, 19 bp, Homo sapiens
gcaaggtttacactgcgga

SEQ ID NO: 6260226 - DNA, 20 bp, Homo sapiens
gcaaggtttaggctggtggc

SEQ ID NO: 6260227 - DNA, 18 bp, Homo sapiens
gcaagtaagaatggccaa

SEQ ID NO: 6260228 - DNA, 14 bp, Homo sapiens
gcaagtagcaggac

SEQ ID NO: 6260229 - DNA, 20 bp, Homo sapiens
gcaagtcacaaaggaatgga

SEQ ID NO: 6260230 - DNA, 21 bp, Homo sapiens
gcaagtcagaggatggccagt

SEQ ID NO: 6260231 - DNA, 12 bp, Homo sapiens
gcaagtcatgta

SEQ ID NO: 6260232 - DNA, 14 bp, Homo sapiens
gcaagtcatgtaaa

SEQ ID NO: 6260233 - DNA, 20 bp, Homo sapiens
gcaagtcccagggagctctg

SEQ ID NO: 6260234 - DNA, 19 bp, Homo sapiens
gcaagtccttttgtaaagt

SEQ ID NO: 6260235 - DNA, 18 bp, Homo sapiens
gcaagtcgccaggcagga

SEQ ID NO: 6260236 - DNA, 18 bp, Homo sapiens
gcaagtcggggcctggga

SEQ ID NO: 6260237 - DNA, 19 bp, Homo sapiens
gcaagtctctttatatggc

SEQ ID NO: 6260238 - DNA, 18 bp, Homo sapiens
gcaagtctgagggtctgg

SEQ ID NO: 6260239 - DNA, 20 bp, Homo sapiens
gcaagtctgcaggtgcacca

SEQ ID NO: 6260240 - DNA, 13 bp, Homo sapiens
gcaagtctgccga

SEQ ID NO: 6260241 - DNA, 23 bp, Homo sapiens
gcaagtctgtgagtgcgtctgag

SEQ ID NO: 6260242 - DNA, 22 bp, Homo sapiens
gcaagtctttaggtctttgtaa

SEQ ID NO: 6260243 - DNA, 15 bp, Homo sapiens
gcaagtgaactcatc

SEQ ID NO: 6260244 - DNA, 13 bp, Homo sapiens
gcaagtgaatttg

SEQ ID NO: 6260245 - DNA, 18 bp, Homo sapiens
gcaagtgacatgccatcc

SEQ ID NO: 6260246 - DNA, 16 bp, Homo sapiens
gcaagtgagaaagaca

SEQ ID NO: 6260247 - DNA, 18 bp, Homo sapiens
gcaagtgagagctgggtg

SEQ ID NO: 6260248 - DNA, 17 bp, Homo sapiens
gcaagtgagaggggagg

SEQ ID NO: 6260249 - DNA, 18 bp, Homo sapiens
gcaagtgagaggggaggg

SEQ ID NO: 6260250 - DNA, 19 bp, Homo sapiens
gcaagtgagaggggaggga

SEQ ID NO: 6260251 - DNA, 13 bp, Homo sapiens
gcaagtgagcaga

SEQ ID NO: 6260252 - DNA, 19 bp, Homo sapiens
gcaagtgattgggacagag

SEQ ID NO: 6260253 - DNA, 23 bp, Homo sapiens
gcaagtgcccagtggagcctgcc

SEQ ID NO: 6260254 - DNA, 18 bp, Homo sapiens
gcaagtgcccgccctgcc

SEQ ID NO: 6260255 - DNA, 14 bp, Homo sapiens
gcaagtgcctggga

SEQ ID NO: 6260256 - DNA, 14 bp, Homo sapiens
gcaagtgctcaggg

SEQ ID NO: 6260257 - DNA, 21 bp, Homo sapiens
gcaagtgctcagggaaatggc

SEQ ID NO: 6260258 - DNA, 16 bp, Homo sapiens
gcaagtggagctgtct

SEQ ID NO: 6260259 - DNA, 15 bp, Homo sapiens
gcaagtggatgggaa

SEQ ID NO: 6260260 - DNA, 21 bp, Homo sapiens
gcaagtggatgggaatttgtc

SEQ ID NO: 6260261 - DNA, 14 bp, Homo sapiens
gcaagtgggaccag

SEQ ID NO: 6260262 - DNA, 14 bp, Homo sapiens
gcaagtggggctgg

SEQ ID NO: 6260263 - DNA, 22 bp, Homo sapiens
gcaagtggggtgagtggatgaa

SEQ ID NO: 6260264 - DNA, 16 bp, Homo sapiens
gcaagtgtctggagcg

SEQ ID NO: 6260265 - DNA, 15 bp, Homo sapiens
gcaagtgtctgtgtg

SEQ ID NO: 6260266 - DNA, 19 bp, Homo sapiens
gcaagtgtgaatactgctt

SEQ ID NO: 6260267 - DNA, 17 bp, Homo sapiens
gcaagtgtttctgttct

SEQ ID NO: 6260268 - DNA, 22 bp, Homo sapiens
gcaagttatattagtgaagatg

SEQ ID NO: 6260269 - DNA, 13 bp, Homo sapiens
gcaagttcaagac

SEQ ID NO: 6260270 - DNA, 18 bp, Homo sapiens
gcaagttcaagactgaaa

SEQ ID NO: 6260271 - DNA, 16 bp, Homo sapiens
gcaagttcaatttgtt

SEQ ID NO: 6260272 - DNA, 22 bp, Homo sapiens
gcaagttcagggaagcaggcag

SEQ ID NO: 6260273 - DNA, 24 bp, Homo sapiens
gcaagttcagggaagcaggcagag

SEQ ID NO: 6260274 - DNA, 21 bp, Homo sapiens
gcaagttcatgtgtggaaatg

SEQ ID NO: 6260275 - DNA, 13 bp, Homo sapiens
gcaagttgaacaa

SEQ ID NO: 6260276 - DNA, 15 bp, Homo sapiens
gcaagtttcatcagc

SEQ ID NO: 6260277 - DNA, 18 bp, Homo sapiens
gcaagtttccatcatcta

SEQ ID NO: 6260278 - DNA, 22 bp, Homo sapiens
gcaagtttctagctagaaatat

SEQ ID NO: 6260279 - DNA, 13 bp, Homo sapiens
gcaagtttctgtt

SEQ ID NO: 6260280 - DNA, 18 bp, Homo sapiens
gcaataaaagcccaggag

SEQ ID NO: 6260281 - DNA, 19 bp, Homo sapiens
gcaataaaagcccaggagc

SEQ ID NO: 6260282 - DNA, 22 bp, Homo sapiens
gcaataaaagcccaggagccca

SEQ ID NO: 6260283 - DNA, 18 bp, Homo sapiens
gcaataaaattatttgca

SEQ ID NO: 6260284 - DNA, 19 bp, Homo sapiens
gcaataaaattatttgcag

SEQ ID NO: 6260285 - DNA, 14 bp, Homo sapiens
gcaataaaatttaa

SEQ ID NO: 6260286 - DNA, 19 bp, Homo sapiens
gcaataaaatttaaaaaat

SEQ ID NO: 6260287 - DNA, 11 bp, Homo sapiens
gcaataaactc

SEQ ID NO: 6260288 - DNA, 15 bp, Homo sapiens
gcaataaactcagtc

SEQ ID NO: 6260289 - DNA, 21 bp, Homo sapiens
gcaataaactcagtcaaatgt

SEQ ID NO: 6260290 - DNA, 13 bp, Homo sapiens
gcaataaactcct

SEQ ID NO: 6260291 - DNA, 21 bp, Homo sapiens
gcaataaagcagcgtttctat

SEQ ID NO: 6260292 - DNA, 23 bp, Homo sapiens
gcgtctcccatcttaactctttg

SEQ ID NO: 6260293 - DNA, 11 bp, Homo sapiens
gcgtctccccc

SEQ ID NO: 6260294 - DNA, 12 bp, Homo sapiens
gcgtctccccca

SEQ ID NO: 6260295 - DNA, 14 bp, Homo sapiens
gcgtctcccccaga

SEQ ID NO: 6260296 - DNA, 12 bp, Homo sapiens
gcgtctccctcg

SEQ ID NO: 6260297 - DNA, 14 bp, Homo sapiens
gcgtctcccttggc

SEQ ID NO: 6260298 - DNA, 20 bp, Homo sapiens
gcgtctcctgtttttctggg

SEQ ID NO: 6260299 - DNA, 17 bp, Homo sapiens
gcgtctctaatgtctgc

SEQ ID NO: 6260300 - DNA, 19 bp, Homo sapiens
gcgtctctgtcgtggacac

SEQ ID NO: 6260301 - DNA, 14 bp, Homo sapiens
gcgtctgactccct

SEQ ID NO: 6260302 - DNA, 18 bp, Homo sapiens
gcgtctgagcggccgcct

SEQ ID NO: 6260303 - DNA, 14 bp, Homo sapiens
gcgtctgaggcctg

SEQ ID NO: 6260304 - DNA, 15 bp, Homo sapiens
gcgtctgcagggtga

SEQ ID NO: 6260305 - DNA, 17 bp, Homo sapiens
gcgtctgccaccatgcc

SEQ ID NO: 6260306 - DNA, 18 bp, Homo sapiens
gcgtctgccaccatgcct

SEQ ID NO: 6260307 - DNA, 18 bp, Homo sapiens
gcgtctgcctaggagctg

SEQ ID NO: 6260308 - DNA, 20 bp, Homo sapiens
gcgtctgctcaggtaaatct

SEQ ID NO: 6260309 - DNA, 23 bp, Homo sapiens
gcgtctgctgttgattccactga

SEQ ID NO: 6260310 - DNA, 18 bp, Homo sapiens
gcgtctggaggggcccct

SEQ ID NO: 6260311 - DNA, 20 bp, Homo sapiens
gcgtctggaggggcccctgc

SEQ ID NO: 6260312 - DNA, 18 bp, Homo sapiens
gcgtctgggcaagaggaa

SEQ ID NO: 6260313 - DNA, 18 bp, Homo sapiens
gcgtctgtcttcaagggc

SEQ ID NO: 6260314 - DNA, 22 bp, Homo sapiens
gcgtctgtgtgtgcctgtgtgc

SEQ ID NO: 6260315 - DNA, 14 bp, Homo sapiens
gcgtcttcctgagt

SEQ ID NO: 6260316 - DNA, 20 bp, Homo sapiens
gcgtcttgtgaaattgtgta

SEQ ID NO: 6260317 - DNA, 19 bp, Homo sapiens
gcgtctttaagagactcac

SEQ ID NO: 6260318 - DNA, 11 bp, Homo sapiens
gcgtgaaacac

SEQ ID NO: 6260319 - DNA, 13 bp, Homo sapiens
gcgtgaaacacaa

SEQ ID NO: 6260320 - DNA, 20 bp, Homo sapiens
gcgtgaaacacaccaggctg

SEQ ID NO: 6260321 - DNA, 16 bp, Homo sapiens
gcgtgaagagcagtga

SEQ ID NO: 6260322 - DNA, 16 bp, Homo sapiens
gcgtgaaggccgagaa

SEQ ID NO: 6260323 - DNA, 20 bp, Homo sapiens
gcgtgaccggcccgccacct

SEQ ID NO: 6260324 - DNA, 14 bp, Homo sapiens
gcgtgactcaccca

SEQ ID NO: 6260325 - DNA, 15 bp, Homo sapiens
gcgtgactcagcagc

SEQ ID NO: 6260326 - DNA, 16 bp, Homo sapiens
gcgtgactcagcagcc

SEQ ID NO: 6260327 - DNA, 24 bp, Homo sapiens
gcgtgacttcagactctctcctct

SEQ ID NO: 6260328 - DNA, 15 bp, Homo sapiens
gcgtgagacctgccc

SEQ ID NO: 6260329 - DNA, 15 bp, Homo sapiens
gcgtgagacgccacc

SEQ ID NO: 6260330 - DNA, 16 bp, Homo sapiens
gcgtgagccactgcac

SEQ ID NO: 6260331 - DNA, 14 bp, Homo sapiens
gcgtgagctgagca

SEQ ID NO: 6260332 - DNA, 13 bp, Homo sapiens
gcgtgagctgccc

SEQ ID NO: 6260333 - DNA, 12 bp, Homo sapiens
gcgtgagcttaa

SEQ ID NO: 6260334 - DNA, 16 bp, Homo sapiens
gcgtgaggtcccagga

SEQ ID NO: 6260335 - DNA, 12 bp, Homo sapiens
gcgtgatctcag

SEQ ID NO: 6260336 - DNA, 16 bp, Homo sapiens
gcgtgatctcagctca

SEQ ID NO: 6260337 - DNA, 18 bp, Homo sapiens
gcgtgatgaagacagaag

SEQ ID NO: 6260338 - DNA, 15 bp, Homo sapiens
gcgtgatggcaggtg

SEQ ID NO: 6260339 - DNA, 18 bp, Homo sapiens
gcgtgcacacaccagagc

SEQ ID NO: 6260340 - DNA, 19 bp, Homo sapiens
gcgtgcacacaccagagcc

SEQ ID NO: 6260341 - DNA, 20 bp, Homo sapiens
gcgtgcacacaccagagccc

SEQ ID NO: 6260342 - DNA, 23 bp, Homo sapiens
gcgtgcacatatgggtgctggca

SEQ ID NO: 6260343 - DNA, 23 bp, Homo sapiens
gcgtgcaccccgccggaggaagg

SEQ ID NO: 6260344 - DNA, 19 bp, Homo sapiens
gcgtgcagggacaaagagg

SEQ ID NO: 6260345 - DNA, 21 bp, Homo sapiens
gcgtgcaggggcggtccagag

SEQ ID NO: 6260346 - DNA, 19 bp, Homo sapiens
gcgtgcagttcctgctgcc

SEQ ID NO: 6260347 - DNA, 16 bp, Homo sapiens
gcgtgcccccctcctc

SEQ ID NO: 6260348 - DNA, 17 bp, Homo sapiens
gcgtgcccccctcctcc

SEQ ID NO: 6260349 - DNA, 18 bp, Homo sapiens
gcgtgcccccctcctcca

SEQ ID NO: 6260350 - DNA, 22 bp, Homo sapiens
gcgtgcccccctcctccagtac

SEQ ID NO: 6260351 - DNA, 16 bp, Homo sapiens
gcgtgcccctgctgct

SEQ ID NO: 6260352 - DNA, 21 bp, Homo sapiens
gcgtgccctgacccctgcacc

SEQ ID NO: 6260353 - DNA, 14 bp, Homo sapiens
gcgtgccgagccag

SEQ ID NO: 6260354 - DNA, 16 bp, Homo sapiens
gcgtgccgcctgctcc

SEQ ID NO: 6260355 - DNA, 17 bp, Homo sapiens
gcgtgccgggcccccac

SEQ ID NO: 6260356 - DNA, 22 bp, Homo sapiens
gcgtgccgggcccccaccgccg

SEQ ID NO: 6260357 - DNA, 15 bp, Homo sapiens
gcgtgccgtggcacc

SEQ ID NO: 6260358 - DNA, 21 bp, Homo sapiens
gcgtgccgtgtgagtgtgaca

SEQ ID NO: 6260359 - DNA, 23 bp, Homo sapiens
gcgtgcgagcacacacacacata

SEQ ID NO: 6260360 - DNA, 21 bp, Homo sapiens
gcgtgcgcatcttgcctccag

SEQ ID NO: 6260361 - DNA, 23 bp, Homo sapiens
gcgtgcgcatcttgcctccaggt

SEQ ID NO: 6260362 - DNA, 14 bp, Homo sapiens
gcgtgctacctgca

SEQ ID NO: 6260363 - DNA, 15 bp, Homo sapiens
gcgtgctccttttct

SEQ ID NO: 6260364 - DNA, 20 bp, Homo sapiens
gcgtgctggcgacactcagg

SEQ ID NO: 6260365 - DNA, 14 bp, Homo sapiens
gcgtgctgtctgtc

SEQ ID NO: 6260366 - DNA, 19 bp, Homo sapiens
gcgtggaagggggaggagt

SEQ ID NO: 6260367 - DNA, 13 bp, Homo sapiens
gcgtggaagtgtt

SEQ ID NO: 6260368 - DNA, 17 bp, Homo sapiens
gcgtggaagtgttcctg

SEQ ID NO: 6260369 - DNA, 13 bp, Homo sapiens
gcgtggacagccg

SEQ ID NO: 6260370 - DNA, 15 bp, Homo sapiens
gcgtggacagccgga

SEQ ID NO: 6260371 - DNA, 18 bp, Homo sapiens
gcgtggacagccggagca

SEQ ID NO: 6260372 - DNA, 14 bp, Homo sapiens
gcgtggacaggtgt

SEQ ID NO: 6260373 - DNA, 13 bp, Homo sapiens
gcgtggactctgc

SEQ ID NO: 6260374 - DNA, 18 bp, Homo sapiens
gcgtggactctgcacatg

SEQ ID NO: 6260375 - DNA, 15 bp, Homo sapiens
gcgtggagactggca

SEQ ID NO: 6260376 - DNA, 19 bp, Homo sapiens
gcgtggagactggcaggcg

SEQ ID NO: 6260377 - DNA, 14 bp, Homo sapiens
gcgtggagcaggcg

SEQ ID NO: 6260378 - DNA, 16 bp, Homo sapiens
gcgtggaggagaggag

SEQ ID NO: 6260379 - DNA, 20 bp, Homo sapiens
gcgtggagggaggccccagg

SEQ ID NO: 6260380 - DNA, 13 bp, Homo sapiens
gcgtggattaaac

SEQ ID NO: 6260381 - DNA, 23 bp, Homo sapiens
gcgtggattaaacttatgaatgt

SEQ ID NO: 6260382 - DNA, 20 bp, Homo sapiens
gcgtggcccaaggctggcag

SEQ ID NO: 6260383 - DNA, 12 bp, Homo sapiens
gcgtggcccagg

SEQ ID NO: 6260384 - DNA, 14 bp, Homo sapiens
gcgtggcccaggcc

SEQ ID NO: 6260385 - DNA, 19 bp, Homo sapiens
gcgtggcctccccatgggc

SEQ ID NO: 6260386 - DNA, 19 bp, Homo sapiens
gcgtggcctccgtgaccca

SEQ ID NO: 6260387 - DNA, 15 bp, Homo sapiens
gcgtggcctgagtcc

SEQ ID NO: 6260388 - DNA, 18 bp, Homo sapiens
gcgtggcctgagtcctgg

SEQ ID NO: 6260389 - DNA, 15 bp, Homo sapiens
gcgtggcctggggct

SEQ ID NO: 6260390 - DNA, 15 bp, Homo sapiens
gcgtggccttgggag

SEQ ID NO: 6260391 - DNA, 18 bp, Homo sapiens
gcgtggcgcaggtgccat

SEQ ID NO: 6260392 - DNA, 13 bp, Homo sapiens
gcgtggctctggg

SEQ ID NO: 6260393 - DNA, 19 bp, Homo sapiens
gcgtggctctgggtgggcg

SEQ ID NO: 6260394 - DNA, 12 bp, Homo sapiens
gcgtggctgtgg

SEQ ID NO: 6260395 - DNA, 15 bp, Homo sapiens
gcgtggctgtggcac

SEQ ID NO: 6260396 - DNA, 16 bp, Homo sapiens
gcgtgggagccagcct

SEQ ID NO: 6260397 - DNA, 22 bp, Homo sapiens
gcgtgggatccagagagaagca

SEQ ID NO: 6260398 - DNA, 11 bp, Homo sapiens
gcgtgggcaga

SEQ ID NO: 6260399 - DNA, 14 bp, Homo sapiens
gcgtgggcagagga

SEQ ID NO: 6260400 - DNA, 19 bp, Homo sapiens
gcgtgggcgaggcctgaca

SEQ ID NO: 6260401 - DNA, 13 bp, Homo sapiens
gcgtggggagggc

SEQ ID NO: 6260402 - DNA, 16 bp, Homo sapiens
gcgtggggaggggctg

SEQ ID NO: 6260403 - DNA, 13 bp, Homo sapiens
gcgtggggctccc

SEQ ID NO: 6260404 - DNA, 18 bp, Homo sapiens
gcgtggggctcccgcctc

SEQ ID NO: 6260405 - DNA, 13 bp, Homo sapiens
gcgtgggggtggc

SEQ ID NO: 6260406 - DNA, 14 bp, Homo sapiens
gcgtgggtctctgg

SEQ ID NO: 6260407 - DNA, 15 bp, Homo sapiens
gcgtgggtctctggg

SEQ ID NO: 6260408 - DNA, 16 bp, Homo sapiens
gcgtgggtctctgggg

SEQ ID NO: 6260409 - DNA, 18 bp, Homo sapiens
gcgtgggtctctggggac

SEQ ID NO: 6260410 - DNA, 18 bp, Homo sapiens
gcgtgggtggaggaagat

SEQ ID NO: 6260411 - DNA, 22 bp, Homo sapiens
gcgtggtatacatgtgtacata

SEQ ID NO: 6260412 - DNA, 17 bp, Homo sapiens
gcgtggtcactgctgtc

SEQ ID NO: 6260413 - DNA, 18 bp, Homo sapiens
gcgtggtcactgctgtca

SEQ ID NO: 6260414 - DNA, 16 bp, Homo sapiens
gcgtggtcccgaggaa

SEQ ID NO: 6260415 - DNA, 13 bp, Homo sapiens
gcgtggtgccatc

SEQ ID NO: 6260416 - DNA, 14 bp, Homo sapiens
gcgtggtgccatcc

SEQ ID NO: 6260417 - DNA, 22 bp, Homo sapiens
gcgtggtgggatttgctcctgg

SEQ ID NO: 6260418 - DNA, 18 bp, Homo sapiens
gcgtggtgtgtccctgga

SEQ ID NO: 6260419 - DNA, 14 bp, Homo sapiens
gcgtgtaagcttgt

SEQ ID NO: 6260420 - DNA, 18 bp, Homo sapiens
gcgtgtcaactttcattt

SEQ ID NO: 6260421 - DNA, 17 bp, Homo sapiens
gcgtgtcacctgtgctt

SEQ ID NO: 6260422 - DNA, 17 bp, Homo sapiens
gcgtgtccccggggccc

SEQ ID NO: 6260423 - DNA, 13 bp, Homo sapiens
gcgtgtgaagaac

SEQ ID NO: 6260424 - DNA, 20 bp, Homo sapiens
gcgtgtgcaggccgacagtc

SEQ ID NO: 6260425 - DNA, 17 bp, Homo sapiens
gcgtgtgcctgtgtgcg

SEQ ID NO: 6260426 - DNA, 13 bp, Homo sapiens
gcgtgtggagcag

SEQ ID NO: 6260427 - DNA, 12 bp, Homo sapiens
gcgtgtggcagc

SEQ ID NO: 6260428 - DNA, 17 bp, Homo sapiens
gcgtgtggcagccacac

SEQ ID NO: 6260429 - DNA, 11 bp, Homo sapiens
gcgtgtggccc

SEQ ID NO: 6260430 - DNA, 17 bp, Homo sapiens
gcgtgtggcgtggcccg

SEQ ID NO: 6260431 - DNA, 11 bp, Homo sapiens
gcgtgtggctc

SEQ ID NO: 6260432 - DNA, 21 bp, Homo sapiens
gcgtgtggctcacgtgtgtga

SEQ ID NO: 6260433 - DNA, 17 bp, Homo sapiens
gcgtgtgggtctctggg

SEQ ID NO: 6260434 - DNA, 18 bp, Homo sapiens
gcgtgtgtacacgggact

SEQ ID NO: 6260435 - DNA, 15 bp, Homo sapiens
gcgtgtgtagagtta

SEQ ID NO: 6260436 - DNA, 20 bp, Homo sapiens
gcgtgtgtagagttaagaag

SEQ ID NO: 6260437 - DNA, 17 bp, Homo sapiens
gcgtgtgtatccgactc

SEQ ID NO: 6260438 - DNA, 13 bp, Homo sapiens
gcgtgtgtccctg

SEQ ID NO: 6260439 - DNA, 17 bp, Homo sapiens
gcgtgtgtgacactgat

SEQ ID NO: 6260440 - DNA, 23 bp, Homo sapiens
gcgtgtgtgggtggatataaata

SEQ ID NO: 6260441 - DNA, 20 bp, Homo sapiens
gcgtgtgtttgtatgtctgt

SEQ ID NO: 6260442 - DNA, 17 bp, Homo sapiens
gcgtgttcagcagaacc

SEQ ID NO: 6260443 - DNA, 23 bp, Homo sapiens
gcgtgttcatatctactctttac

SEQ ID NO: 6260444 - DNA, 21 bp, Homo sapiens
gcgtgttccagccaaagcatg

SEQ ID NO: 6260445 - DNA, 13 bp, Homo sapiens
gcgtgttcctttg

SEQ ID NO: 6260446 - DNA, 15 bp, Homo sapiens
gcgtgttctcagagg

SEQ ID NO: 6260447 - DNA, 13 bp, Homo sapiens
gcgtgttctcagc

SEQ ID NO: 6260448 - DNA, 14 bp, Homo sapiens
gcgtgtttgcacgt

SEQ ID NO: 6260449 - DNA, 15 bp, Homo sapiens
gcgtgtttgcacgtt

SEQ ID NO: 6260450 - DNA, 21 bp, Homo sapiens
gcgttaacagttcctttcaaa

SEQ ID NO: 6260451 - DNA, 17 bp, Homo sapiens
gcgttacaacagtaaca

SEQ ID NO: 6260452 - DNA, 19 bp, Homo sapiens
gcgttatagtaactcccat

SEQ ID NO: 6260453 - DNA, 17 bp, Homo sapiens
gcgttatctcttcctta

SEQ ID NO: 6260454 - DNA, 20 bp, Homo sapiens
gcgttatggcagcccggctg

SEQ ID NO: 6260455 - DNA, 15 bp, Homo sapiens
gcgttcagcccctga

SEQ ID NO: 6260456 - DNA, 22 bp, Homo sapiens
gcgttcagcccctgatctctga

SEQ ID NO: 6260457 - DNA, 17 bp, Homo sapiens
gcgttccatgatgctgg

SEQ ID NO: 6260458 - DNA, 11 bp, Homo sapiens
gcgttcctgcc

SEQ ID NO: 6260459 - DNA, 11 bp, Homo sapiens
gcgttcctggc

SEQ ID NO: 6260460 - DNA, 14 bp, Homo sapiens
gcgttcctggcctt

SEQ ID NO: 6260461 - DNA, 13 bp, Homo sapiens
gcgttcctttctt

SEQ ID NO: 6260462 - DNA, 15 bp, Homo sapiens
gcgttcctttctttt

SEQ ID NO: 6260463 - DNA, 16 bp, Homo sapiens
gcgttcgcctctggcc

SEQ ID NO: 6260464 - DNA, 13 bp, Homo sapiens
gcgttctcccagc

SEQ ID NO: 6260465 - DNA, 19 bp, Homo sapiens
gcgttctgctgcccctgca

SEQ ID NO: 6260466 - DNA, 21 bp, Homo sapiens
gcgttctgctgcccctgcagt

SEQ ID NO: 6260467 - DNA, 18 bp, Homo sapiens
gcgttctggactctgccc

SEQ ID NO: 6260468 - DNA, 22 bp, Homo sapiens
gcgttctgggagctcaaggcca

SEQ ID NO: 6260469 - DNA, 22 bp, Homo sapiens
gcgttcttgtaattttacacgc

SEQ ID NO: 6260470 - DNA, 12 bp, Homo sapiens
gcgttgaaattg

SEQ ID NO: 6260471 - DNA, 17 bp, Homo sapiens
gcgttggaattaaaaca

SEQ ID NO: 6260472 - DNA, 14 bp, Homo sapiens
gcgttggcttctcc

SEQ ID NO: 6260473 - DNA, 17 bp, Homo sapiens
gcgttgggagcctagct

SEQ ID NO: 6260474 - DNA, 21 bp, Homo sapiens
gcaataaagtgtagcaccctg

SEQ ID NO: 6260475 - DNA, 16 bp, Homo sapiens
gcaataaatctgaccc

SEQ ID NO: 6260476 - DNA, 19 bp, Homo sapiens
gcaataaatctgacccagt

SEQ ID NO: 6260477 - DNA, 15 bp, Homo sapiens
gcaataaatggctcg

SEQ ID NO: 6260478 - DNA, 17 bp, Homo sapiens
gcaataaatttatatac

SEQ ID NO: 6260479 - DNA, 14 bp, Homo sapiens
gcaataaattttga

SEQ ID NO: 6260480 - DNA, 16 bp, Homo sapiens
gcaataaattttgaaa

SEQ ID NO: 6260481 - DNA, 14 bp, Homo sapiens
gcaataacaagcat

SEQ ID NO: 6260482 - DNA, 22 bp, Homo sapiens
gcaataacagtagtgttacatg

SEQ ID NO: 6260483 - DNA, 14 bp, Homo sapiens
gcaataacagtttt

SEQ ID NO: 6260484 - DNA, 20 bp, Homo sapiens
gcaataacctcaaagtgact

SEQ ID NO: 6260485 - DNA, 21 bp, Homo sapiens
gcaataacgtttaagccaaaa

SEQ ID NO: 6260486 - DNA, 14 bp, Homo sapiens
gcaataactccaag

SEQ ID NO: 6260487 - DNA, 16 bp, Homo sapiens
gcaataactccaagca

SEQ ID NO: 6260488 - DNA, 19 bp, Homo sapiens
gcaataactccaagcagac

SEQ ID NO: 6260489 - DNA, 16 bp, Homo sapiens
gcaataactctgggag

SEQ ID NO: 6260490 - DNA, 13 bp, Homo sapiens
gcaataactgaaa

SEQ ID NO: 6260491 - DNA, 15 bp, Homo sapiens
gcaataacttctata

SEQ ID NO: 6260492 - DNA, 20 bp, Homo sapiens
gcaataacttctatatttta

SEQ ID NO: 6260493 - DNA, 15 bp, Homo sapiens
gcaataacttctgac

SEQ ID NO: 6260494 - DNA, 17 bp, Homo sapiens
gcaataacttctgacct

SEQ ID NO: 6260495 - DNA, 13 bp, Homo sapiens
gcaataagaaatg

SEQ ID NO: 6260496 - DNA, 21 bp, Homo sapiens
gcaataagctggactagtgtc

SEQ ID NO: 6260497 - DNA, 21 bp, Homo sapiens
gcaataaggatttattctcag

SEQ ID NO: 6260498 - DNA, 22 bp, Homo sapiens
gcaataagttcattaaacagaa

SEQ ID NO: 6260499 - DNA, 14 bp, Homo sapiens
gcaataagttgaat

SEQ ID NO: 6260500 - DNA, 15 bp, Homo sapiens
gcaataataaagtac

SEQ ID NO: 6260501 - DNA, 18 bp, Homo sapiens
gcaataatatcaaaacaa

SEQ ID NO: 6260502 - DNA, 17 bp, Homo sapiens
gcaataatccaccccca

SEQ ID NO: 6260503 - DNA, 12 bp, Homo sapiens
gcaataatgcag

SEQ ID NO: 6260504 - DNA, 19 bp, Homo sapiens
gcaataatgcagtatggta

SEQ ID NO: 6260505 - DNA, 13 bp, Homo sapiens
gcaataatttgta

SEQ ID NO: 6260506 - DNA, 20 bp, Homo sapiens
gcaataatttgtacaatggt

SEQ ID NO: 6260507 - DNA, 18 bp, Homo sapiens
gcaatacaactttaccat

SEQ ID NO: 6260508 - DNA, 19 bp, Homo sapiens
gcaatacattaaaataact

SEQ ID NO: 6260509 - DNA, 13 bp, Homo sapiens
gcaatacatttga

SEQ ID NO: 6260510 - DNA, 21 bp, Homo sapiens
gcaatacgggagtgacccagc

SEQ ID NO: 6260511 - DNA, 23 bp, Homo sapiens
gcaatactaattgagaaacatga

SEQ ID NO: 6260512 - DNA, 22 bp, Homo sapiens
gcaatactgccgctgcccccac

SEQ ID NO: 6260513 - DNA, 15 bp, Homo sapiens
gcaatactggaatat

SEQ ID NO: 6260514 - DNA, 18 bp, Homo sapiens
gcaatagcagttataaca

SEQ ID NO: 6260515 - DNA, 23 bp, Homo sapiens
gcaatagcagttataacagatgt

SEQ ID NO: 6260516 - DNA, 21 bp, Homo sapiens
gcaataggtaaatggggccca

SEQ ID NO: 6260517 - DNA, 23 bp, Homo sapiens
gcaataggtggaaagagaaatga

SEQ ID NO: 6260518 - DNA, 17 bp, Homo sapiens
gcaatagtgggccctcc

SEQ ID NO: 6260519 - DNA, 17 bp, Homo sapiens
gcaatagtgttgaggag

SEQ ID NO: 6260520 - DNA, 22 bp, Homo sapiens
gcaatagtgttgaggaggggag

SEQ ID NO: 6260521 - DNA, 17 bp, Homo sapiens
gcaatataagcataaaa

SEQ ID NO: 6260522 - DNA, 20 bp, Homo sapiens
gcaatatactggaaagcttt

SEQ ID NO: 6260523 - DNA, 16 bp, Homo sapiens
gcaatatatttgtagg

SEQ ID NO: 6260524 - DNA, 12 bp, Homo sapiens
gcaatatatttt

SEQ ID NO: 6260525 - DNA, 17 bp, Homo sapiens
gcaatatattttgtatg

SEQ ID NO: 6260526 - DNA, 19 bp, Homo sapiens
gcaatatcttcgttagtaa

SEQ ID NO: 6260527 - DNA, 14 bp, Homo sapiens
gcaatatctttaat

SEQ ID NO: 6260528 - DNA, 19 bp, Homo sapiens
gcaatatgaggggactgca

SEQ ID NO: 6260529 - DNA, 22 bp, Homo sapiens
gcaatatgaggggactgcatgc

SEQ ID NO: 6260530 - DNA, 14 bp, Homo sapiens
gcaatattctctgt

SEQ ID NO: 6260531 - DNA, 21 bp, Homo sapiens
gcaatattctctgtacatatt

SEQ ID NO: 6260532 - DNA, 13 bp, Homo sapiens
gcaatattgcctg

SEQ ID NO: 6260533 - DNA, 22 bp, Homo sapiens
gcaatattgtatatttttatct

SEQ ID NO: 6260534 - DNA, 22 bp, Homo sapiens
gcaatatttaaggagatgtaag

SEQ ID NO: 6260535 - DNA, 19 bp, Homo sapiens
gcaatatttcctcatgtga

SEQ ID NO: 6260536 - DNA, 14 bp, Homo sapiens
gcaatatttgaatt

SEQ ID NO: 6260537 - DNA, 23 bp, Homo sapiens
gcaatattttgtatattatgttt

SEQ ID NO: 6260538 - DNA, 23 bp, Homo sapiens
gcaatcaaaaatatgtgttttta

SEQ ID NO: 6260539 - DNA, 12 bp, Homo sapiens
gcaatcaaagca

SEQ ID NO: 6260540 - DNA, 17 bp, Homo sapiens
gcaatcaaatctgcttt

SEQ ID NO: 6260541 - DNA, 17 bp, Homo sapiens
gcaatcaagagcttcca

SEQ ID NO: 6260542 - DNA, 19 bp, Homo sapiens
gcaatcaagcaccaggaag

SEQ ID NO: 6260543 - DNA, 15 bp, Homo sapiens
gcaatcacagatgag

SEQ ID NO: 6260544 - DNA, 22 bp, Homo sapiens
gcaatcacagctcactgcagcc

SEQ ID NO: 6260545 - DNA, 15 bp, Homo sapiens
gcaatcacaggaaaa

SEQ ID NO: 6260546 - DNA, 18 bp, Homo sapiens
gcaatcactgggcccaga

SEQ ID NO: 6260547 - DNA, 20 bp, Homo sapiens
gcaatcagattttcctgtgg

SEQ ID NO: 6260548 - DNA, 21 bp, Homo sapiens
gcaatcattttatataaagaa

SEQ ID NO: 6260549 - DNA, 20 bp, Homo sapiens
gcaatccaggctgttctcag

SEQ ID NO: 6260550 - DNA, 13 bp, Homo sapiens
gcaatccatgtta

SEQ ID NO: 6260551 - DNA, 22 bp, Homo sapiens
gcaatccatgttagtttttact

SEQ ID NO: 6260552 - DNA, 20 bp, Homo sapiens
gcaatcctcccacttcagcc

SEQ ID NO: 6260553 - DNA, 21 bp, Homo sapiens
gcaatcctcctgcctcagcct

SEQ ID NO: 6260554 - DNA, 17 bp, Homo sapiens
gcaatcctgcaagaaca

SEQ ID NO: 6260555 - DNA, 14 bp, Homo sapiens
gcaatcctgtcttt

SEQ ID NO: 6260556 - DNA, 16 bp, Homo sapiens
gcaatcgttctgctgg

SEQ ID NO: 6260557 - DNA, 22 bp, Homo sapiens
gcaatcgttctgctggccaaga

SEQ ID NO: 6260558 - DNA, 17 bp, Homo sapiens
gcaatctccatgtgtac

SEQ ID NO: 6260559 - DNA, 23 bp, Homo sapiens
gcaatctccccttgatttaaaca

SEQ ID NO: 6260560 - DNA, 17 bp, Homo sapiens
gcaatctctctctgtgt

SEQ ID NO: 6260561 - DNA, 23 bp, Homo sapiens
gcaatctcttcattattctctgc

SEQ ID NO: 6260562 - DNA, 19 bp, Homo sapiens
gcaatctgcctgtatctct

SEQ ID NO: 6260563 - DNA, 13 bp, Homo sapiens
gcaatctggaaaa

SEQ ID NO: 6260564 - DNA, 21 bp, Homo sapiens
gcaatctgtaactgcttttcg

SEQ ID NO: 6260565 - DNA, 18 bp, Homo sapiens
gcaatctgtctttagaat

SEQ ID NO: 6260566 - DNA, 16 bp, Homo sapiens
gcaatcttggctcact

SEQ ID NO: 6260567 - DNA, 18 bp, Homo sapiens
gcaatcttggctcactgc

SEQ ID NO: 6260568 - DNA, 15 bp, Homo sapiens
gcaatctttgaaata

SEQ ID NO: 6260569 - DNA, 13 bp, Homo sapiens
gcaatgaaaacaa

SEQ ID NO: 6260570 - DNA, 14 bp, Homo sapiens
gcaatgaaaacaaa

SEQ ID NO: 6260571 - DNA, 17 bp, Homo sapiens
gcaatgaaaattttaag

SEQ ID NO: 6260572 - DNA, 20 bp, Homo sapiens
gcaatgaaaattttaagaag

SEQ ID NO: 6260573 - DNA, 13 bp, Homo sapiens
gcaatgaaggaaa

SEQ ID NO: 6260574 - DNA, 16 bp, Homo sapiens
gcaatgacatctcagg

SEQ ID NO: 6260575 - DNA, 16 bp, Homo sapiens
gcaatgacatcttcaa

SEQ ID NO: 6260576 - DNA, 14 bp, Homo sapiens
gcaatgacctttca

SEQ ID NO: 6260577 - DNA, 17 bp, Homo sapiens
gcaatgacctttcaata

SEQ ID NO: 6260578 - DNA, 15 bp, Homo sapiens
gcaatgactgtgagc

SEQ ID NO: 6260579 - DNA, 16 bp, Homo sapiens
gcaatgagtgtgccag

SEQ ID NO: 6260580 - DNA, 20 bp, Homo sapiens
gcaatgagtgtgttggcttg

SEQ ID NO: 6260581 - DNA, 14 bp, Homo sapiens
gcaatgataaataa

SEQ ID NO: 6260582 - DNA, 18 bp, Homo sapiens
gcaatgataaataaagtc

SEQ ID NO: 6260583 - DNA, 20 bp, Homo sapiens
gcaatgatcagacttgattt

SEQ ID NO: 6260584 - DNA, 15 bp, Homo sapiens
gcaatgatgtccaga

SEQ ID NO: 6260585 - DNA, 17 bp, Homo sapiens
gcaatgatgtccagaag

SEQ ID NO: 6260586 - DNA, 16 bp, Homo sapiens
gcaatgattactcttt

SEQ ID NO: 6260587 - DNA, 14 bp, Homo sapiens
gcaatgcaattcaa

SEQ ID NO: 6260588 - DNA, 11 bp, Homo sapiens
gcaatgcattt

SEQ ID NO: 6260589 - DNA, 19 bp, Homo sapiens
gcaatgccacagccctgtc

SEQ ID NO: 6260590 - DNA, 18 bp, Homo sapiens
gcaatgccatcagcccct

SEQ ID NO: 6260591 - DNA, 22 bp, Homo sapiens
gcaatgccatcagcccctggga

SEQ ID NO: 6260592 - DNA, 20 bp, Homo sapiens
gcaatgccccctcccctcct

SEQ ID NO: 6260593 - DNA, 12 bp, Homo sapiens
gcaatgccctgc

SEQ ID NO: 6260594 - DNA, 14 bp, Homo sapiens
gcaatgccctgcct

SEQ ID NO: 6260595 - DNA, 21 bp, Homo sapiens
gcaatgcctagacttcccaac

SEQ ID NO: 6260596 - DNA, 15 bp, Homo sapiens
gcaatgcgtcttgtg

SEQ ID NO: 6260597 - DNA, 13 bp, Homo sapiens
gcaatgctggctg

SEQ ID NO: 6260598 - DNA, 15 bp, Homo sapiens
gcaatgctgtacttt

SEQ ID NO: 6260599 - DNA, 17 bp, Homo sapiens
gcaatgcttaaactaaa

SEQ ID NO: 6260600 - DNA, 18 bp, Homo sapiens
gcaatgcttaaactaaat

SEQ ID NO: 6260601 - DNA, 22 bp, Homo sapiens
gcaatgcttaaactaaataatg

SEQ ID NO: 6260602 - DNA, 20 bp, Homo sapiens
gcaatgcttaacacaggcag

SEQ ID NO: 6260603 - DNA, 16 bp, Homo sapiens
gcaatggaatataaat

SEQ ID NO: 6260604 - DNA, 15 bp, Homo sapiens
gcaatggcagccttg

SEQ ID NO: 6260605 - DNA, 15 bp, Homo sapiens
gcaatggccagagcc

SEQ ID NO: 6260606 - DNA, 17 bp, Homo sapiens
gcaatggccagagcctc

SEQ ID NO: 6260607 - DNA, 20 bp, Homo sapiens
gcaatggccagagcctctgg

SEQ ID NO: 6260608 - DNA, 16 bp, Homo sapiens
gcaatggccaggggcc

SEQ ID NO: 6260609 - DNA, 21 bp, Homo sapiens
gcaatggccaggggccaggag

SEQ ID NO: 6260610 - DNA, 15 bp, Homo sapiens
gcaatgggactggag

SEQ ID NO: 6260611 - DNA, 23 bp, Homo sapiens
gcaatgggactggagtcagatga

SEQ ID NO: 6260612 - DNA, 20 bp, Homo sapiens
gcaatgggagctgaggccac

SEQ ID NO: 6260613 - DNA, 17 bp, Homo sapiens
gcaatgggagggggctc

SEQ ID NO: 6260614 - DNA, 16 bp, Homo sapiens
gcaatgggcactggga

SEQ ID NO: 6260615 - DNA, 20 bp, Homo sapiens
gcaatggggagaggcaaatg

SEQ ID NO: 6260616 - DNA, 18 bp, Homo sapiens
gcaatgggggagggaggg

SEQ ID NO: 6260617 - DNA, 18 bp, Homo sapiens
gcaatgggtaagggaggg

SEQ ID NO: 6260618 - DNA, 19 bp, Homo sapiens
gcaatgggtcactcattaa

SEQ ID NO: 6260619 - DNA, 15 bp, Homo sapiens
gcaatgtaaatattt

SEQ ID NO: 6260620 - DNA, 18 bp, Homo sapiens
gcaatgtaaatattttaa

SEQ ID NO: 6260621 - DNA, 23 bp, Homo sapiens
gcaatgtaaatattttaaagaat

SEQ ID NO: 6260622 - DNA, 17 bp, Homo sapiens
gcaatgtaagcatactt

SEQ ID NO: 6260623 - DNA, 23 bp, Homo sapiens
gcaatgtactcttccgatgtttg

SEQ ID NO: 6260624 - DNA, 22 bp, Homo sapiens
gcaatgtagaggggaaaagaga

SEQ ID NO: 6260625 - DNA, 18 bp, Homo sapiens
gcaatgtcacaacctctc

SEQ ID NO: 6260626 - DNA, 19 bp, Homo sapiens
gcaatgtcttaaataaaac

SEQ ID NO: 6260627 - DNA, 21 bp, Homo sapiens
gcaatgtcttaaataaaacta

SEQ ID NO: 6260628 - DNA, 14 bp, Homo sapiens
gcaatgtgaaaaat

SEQ ID NO: 6260629 - DNA, 15 bp, Homo sapiens
gcaatgtgattttgt

SEQ ID NO: 6260630 - DNA, 18 bp, Homo sapiens
gcaatgtgccttgattga

SEQ ID NO: 6260631 - DNA, 19 bp, Homo sapiens
gcaatgtggagcagcagcc

SEQ ID NO: 6260632 - DNA, 17 bp, Homo sapiens
gcaatgtgggatctcag

SEQ ID NO: 6260633 - DNA, 19 bp, Homo sapiens
gcaatgtggtgacacctcc

SEQ ID NO: 6260634 - DNA, 20 bp, Homo sapiens
gcaatgtgtataaacaagaa

SEQ ID NO: 6260635 - DNA, 14 bp, Homo sapiens
gcaatgtgtgtata

SEQ ID NO: 6260636 - DNA, 18 bp, Homo sapiens
gcaatgttccaggaatga

SEQ ID NO: 6260637 - DNA, 17 bp, Homo sapiens
gcaatgttggtttttta

SEQ ID NO: 6260638 - DNA, 21 bp, Homo sapiens
gcaatgttggttttttataaa

SEQ ID NO: 6260639 - DNA, 15 bp, Homo sapiens
gcaatgtttatttca

SEQ ID NO: 6260640 - DNA, 13 bp, Homo sapiens
gcaattaactctg

SEQ ID NO: 6260641 - DNA, 19 bp, Homo sapiens
gcaattaattccttcagca

SEQ ID NO: 6260642 - DNA, 15 bp, Homo sapiens
gcaattactgcctgc

SEQ ID NO: 6260643 - DNA, 18 bp, Homo sapiens
gcaattactgcctgcaga

SEQ ID NO: 6260644 - DNA, 19 bp, Homo sapiens
gcaattaggattttgatgt

SEQ ID NO: 6260645 - DNA, 19 bp, Homo sapiens
gcaattaggtttttcctta

SEQ ID NO: 6260646 - DNA, 17 bp, Homo sapiens
gcaattagtctgaaact

SEQ ID NO: 6260647 - DNA, 19 bp, Homo sapiens
gcaattatatctattatgt

SEQ ID NO: 6260648 - DNA, 16 bp, Homo sapiens
gcaattatgaaaataa

SEQ ID NO: 6260649 - DNA, 14 bp, Homo sapiens
gcaattatttaaag

SEQ ID NO: 6260650 - DNA, 18 bp, Homo sapiens
gcaattatttaaagaaag

SEQ ID NO: 6260651 - DNA, 16 bp, Homo sapiens
gcaattcaaaagttcc

SEQ ID NO: 6260652 - DNA, 14 bp, Homo sapiens
gcgttggtctctgc

SEQ ID NO: 6260653 - DNA, 15 bp, Homo sapiens
gcgttggtctctgca

SEQ ID NO: 6260654 - DNA, 17 bp, Homo sapiens
gcgttgttttgtggata

SEQ ID NO: 6260655 - DNA, 19 bp, Homo sapiens
gcgtttaagactgtaatga

SEQ ID NO: 6260656 - DNA, 15 bp, Homo sapiens
gcgtttaagttgtat

SEQ ID NO: 6260657 - DNA, 19 bp, Homo sapiens
gcgtttacatatttacctg

SEQ ID NO: 6260658 - DNA, 22 bp, Homo sapiens
gcgtttgaccttttatgtagta

SEQ ID NO: 6260659 - DNA, 19 bp, Homo sapiens
gcgtttgcccaaatctgcc

SEQ ID NO: 6260660 - DNA, 13 bp, Homo sapiens
gcgtttgctgtgc

SEQ ID NO: 6260661 - DNA, 20 bp, Homo sapiens
gcgtttttctcgtccccctc

SEQ ID NO: 6260662 - DNA, 22 bp, Homo sapiens
gcgtttttctcgtccccctccc

SEQ ID NO: 6260663 - DNA, 19 bp, Homo sapiens
gcgttttttaaatgtatac

SEQ ID NO: 6260664 - DNA, 14 bp, Homo sapiens
gcgtttttttacaa

SEQ ID NO: 6260665 - DNA, 20 bp, Homo sapiens
gctaaaaaataaataaaagc

SEQ ID NO: 6260666 - DNA, 14 bp, Homo sapiens
gctaaaaagcaaca

SEQ ID NO: 6260667 - DNA, 19 bp, Homo sapiens
gctaaaaaggcccttagag

SEQ ID NO: 6260668 - DNA, 20 bp, Homo sapiens
gctaaaaaggtcctgtaaga

SEQ ID NO: 6260669 - DNA, 16 bp, Homo sapiens
gctaaaaataaaacat

SEQ ID NO: 6260670 - DNA, 21 bp, Homo sapiens
gctaaaaatatgcagaatctc

SEQ ID NO: 6260671 - DNA, 12 bp, Homo sapiens
gctaaaaatatt

SEQ ID NO: 6260672 - DNA, 16 bp, Homo sapiens
gctaaaaatattactc

SEQ ID NO: 6260673 - DNA, 17 bp, Homo sapiens
gctaaaacaatgaataa

SEQ ID NO: 6260674 - DNA, 12 bp, Homo sapiens
gctaaaagaaac

SEQ ID NO: 6260675 - DNA, 16 bp, Homo sapiens
gctaaaagaagagagg

SEQ ID NO: 6260676 - DNA, 21 bp, Homo sapiens
gctaaaagcatggccctgctg

SEQ ID NO: 6260677 - DNA, 13 bp, Homo sapiens
gctaaaaggaaaa

SEQ ID NO: 6260678 - DNA, 15 bp, Homo sapiens
gctaaaaggaatagg

SEQ ID NO: 6260679 - DNA, 14 bp, Homo sapiens
gctaaaatatataa

SEQ ID NO: 6260680 - DNA, 15 bp, Homo sapiens
gctaaaatatataat

SEQ ID NO: 6260681 - DNA, 15 bp, Homo sapiens
gctaaaatgttttca

SEQ ID NO: 6260682 - DNA, 23 bp, Homo sapiens
gctaaaattaaaaagaaaatatt

SEQ ID NO: 6260683 - DNA, 14 bp, Homo sapiens
gctaaacctatctg

SEQ ID NO: 6260684 - DNA, 20 bp, Homo sapiens
gctaaacgactccgagaaca

SEQ ID NO: 6260685 - DNA, 23 bp, Homo sapiens
gctaaacgtgtatgtttttcagt

SEQ ID NO: 6260686 - DNA, 17 bp, Homo sapiens
gctaaacgttggtgacg

SEQ ID NO: 6260687 - DNA, 22 bp, Homo sapiens
gctaaactccttcctggcctga

SEQ ID NO: 6260688 - DNA, 23 bp, Homo sapiens
gctaaactccttcctggcctgag

SEQ ID NO: 6260689 - DNA, 12 bp, Homo sapiens
gctaaactctcg

SEQ ID NO: 6260690 - DNA, 21 bp, Homo sapiens
gctaaactgtgaaaaatcaga

SEQ ID NO: 6260691 - DNA, 15 bp, Homo sapiens
gctaaacttttctga

SEQ ID NO: 6260692 - DNA, 18 bp, Homo sapiens
gctaaagagcccttgcct

SEQ ID NO: 6260693 - DNA, 22 bp, Homo sapiens
gctaaagagcccttgcctcccc

SEQ ID NO: 6260694 - DNA, 14 bp, Homo sapiens
gctaaagaggtggg

SEQ ID NO: 6260695 - DNA, 16 bp, Homo sapiens
gctaaagaggtggggt

SEQ ID NO: 6260696 - DNA, 20 bp, Homo sapiens
gctaaagaggtggggtgaag

SEQ ID NO: 6260697 - DNA, 23 bp, Homo sapiens
gctaaagaggtggggtgaagctg

SEQ ID NO: 6260698 - DNA, 15 bp, Homo sapiens
gctaaagattgttaa

SEQ ID NO: 6260699 - DNA, 18 bp, Homo sapiens
gctaaagccaaccagcct

SEQ ID NO: 6260700 - DNA, 16 bp, Homo sapiens
gctaaagcctgaattt

SEQ ID NO: 6260701 - DNA, 20 bp, Homo sapiens
gctaaagtcatccagtgaaa

SEQ ID NO: 6260702 - DNA, 19 bp, Homo sapiens
gctaaataaaatttgttgc

SEQ ID NO: 6260703 - DNA, 19 bp, Homo sapiens
gctaaataacttgccattt

SEQ ID NO: 6260704 - DNA, 19 bp, Homo sapiens
gctaaatactgtacataga

SEQ ID NO: 6260705 - DNA, 19 bp, Homo sapiens
gctaaatatttaccttgaa

SEQ ID NO: 6260706 - DNA, 16 bp, Homo sapiens
gctaaatcatttgaga

SEQ ID NO: 6260707 - DNA, 13 bp, Homo sapiens
gctaaatcccaag

SEQ ID NO: 6260708 - DNA, 16 bp, Homo sapiens
gctaaatctcctattt

SEQ ID NO: 6260709 - DNA, 20 bp, Homo sapiens
gctaaatgacttgcagatga

SEQ ID NO: 6260710 - DNA, 13 bp, Homo sapiens
gctaaatgcaaac

SEQ ID NO: 6260711 - DNA, 20 bp, Homo sapiens
gctaaatgcaaacactgtgt

SEQ ID NO: 6260712 - DNA, 22 bp, Homo sapiens
gctaaatgcaccaagaaagctt

SEQ ID NO: 6260713 - DNA, 19 bp, Homo sapiens
gctaaatggtcgcccagga

SEQ ID NO: 6260714 - DNA, 23 bp, Homo sapiens
gctaaatggtcgcccaggagaca

SEQ ID NO: 6260715 - DNA, 18 bp, Homo sapiens
gctaaatgtaagaatcat

SEQ ID NO: 6260716 - DNA, 15 bp, Homo sapiens
gctaaatgtttaaag

SEQ ID NO: 6260717 - DNA, 18 bp, Homo sapiens
gctaaattctatgttaaa

SEQ ID NO: 6260718 - DNA, 18 bp, Homo sapiens
gctaaattgatgttgatg

SEQ ID NO: 6260719 - DNA, 21 bp, Homo sapiens
gctaaattgatgttgatgcaa

SEQ ID NO: 6260720 - DNA, 18 bp, Homo sapiens
gctaaattgattgaatta

SEQ ID NO: 6260721 - DNA, 18 bp, Homo sapiens
gctaacaaactgaaaaat

SEQ ID NO: 6260722 - DNA, 13 bp, Homo sapiens
gctaacaataaag

SEQ ID NO: 6260723 - DNA, 14 bp, Homo sapiens
gctaacaataaagt

SEQ ID NO: 6260724 - DNA, 16 bp, Homo sapiens
gctaacaatgtctggt

SEQ ID NO: 6260725 - DNA, 20 bp, Homo sapiens
gctaacacacagctcccata

SEQ ID NO: 6260726 - DNA, 19 bp, Homo sapiens
gctaacacggtgaaacccg

SEQ ID NO: 6260727 - DNA, 15 bp, Homo sapiens
gctaacactggcccc

SEQ ID NO: 6260728 - DNA, 14 bp, Homo sapiens
gctaacagtgaaga

SEQ ID NO: 6260729 - DNA, 13 bp, Homo sapiens
gctaacatgaaga

SEQ ID NO: 6260730 - DNA, 14 bp, Homo sapiens
gctaacatggaagt

SEQ ID NO: 6260731 - DNA, 17 bp, Homo sapiens
gctaacatggaagtact

SEQ ID NO: 6260732 - DNA, 22 bp, Homo sapiens
gctaaccactgtctgtccctga

SEQ ID NO: 6260733 - DNA, 19 bp, Homo sapiens
gctaacccccagcccacag

SEQ ID NO: 6260734 - DNA, 21 bp, Homo sapiens
gctaacccccagcccacagag

SEQ ID NO: 6260735 - DNA, 21 bp, Homo sapiens
gctaacccccttctactgagc

SEQ ID NO: 6260736 - DNA, 19 bp, Homo sapiens
gctaaccccgtctgctcct

SEQ ID NO: 6260737 - DNA, 19 bp, Homo sapiens
gctaacctcaatttatgtt

SEQ ID NO: 6260738 - DNA, 14 bp, Homo sapiens
gctaacctctctga

SEQ ID NO: 6260739 - DNA, 14 bp, Homo sapiens
gctaacctggaaag

SEQ ID NO: 6260740 - DNA, 22 bp, Homo sapiens
gctaacctgttacactgggctg

SEQ ID NO: 6260741 - DNA, 18 bp, Homo sapiens
gctaacgtttatttaaaa

SEQ ID NO: 6260742 - DNA, 19 bp, Homo sapiens
gctaacgttttttcttctt

SEQ ID NO: 6260743 - DNA, 16 bp, Homo sapiens
gctaactaattctgtc

SEQ ID NO: 6260744 - DNA, 23 bp, Homo sapiens
gctaactccagtctcctgacatt

SEQ ID NO: 6260745 - DNA, 14 bp, Homo sapiens
gctaactggcccca

SEQ ID NO: 6260746 - DNA, 13 bp, Homo sapiens
gctaactggttaa

SEQ ID NO: 6260747 - DNA, 23 bp, Homo sapiens
gctaactgtggagaagcccctgg

SEQ ID NO: 6260748 - DNA, 20 bp, Homo sapiens
gctaacttggagccccagtg

SEQ ID NO: 6260749 - DNA, 14 bp, Homo sapiens
gctaacttgggtta

SEQ ID NO: 6260750 - DNA, 21 bp, Homo sapiens
gctaactttgcccttcactgt

SEQ ID NO: 6260751 - DNA, 12 bp, Homo sapiens
gctaagaaaaag

SEQ ID NO: 6260752 - DNA, 23 bp, Homo sapiens
gctaagaaaaaggaaaaccattc

SEQ ID NO: 6260753 - DNA, 23 bp, Homo sapiens
gctaagaacctggaacttgggga

SEQ ID NO: 6260754 - DNA, 23 bp, Homo sapiens
gctaagaagttcaccagccctga

SEQ ID NO: 6260755 - DNA, 17 bp, Homo sapiens
gctaagaccctgtgtcc

SEQ ID NO: 6260756 - DNA, 15 bp, Homo sapiens
gctaagagcctctgg

SEQ ID NO: 6260757 - DNA, 18 bp, Homo sapiens
gctaagagctagcgctgc

SEQ ID NO: 6260758 - DNA, 20 bp, Homo sapiens
gctaagagctagcgctgccg

SEQ ID NO: 6260759 - DNA, 13 bp, Homo sapiens
gctaagaggctgc

SEQ ID NO: 6260760 - DNA, 14 bp, Homo sapiens
gctaagaggctgct

SEQ ID NO: 6260761 - DNA, 20 bp, Homo sapiens
gctaagagggtgaacaaaga

SEQ ID NO: 6260762 - DNA, 16 bp, Homo sapiens
gctaagagttttctgt

SEQ ID NO: 6260763 - DNA, 22 bp, Homo sapiens
gctaagataattaaatgaaata

SEQ ID NO: 6260764 - DNA, 23 bp, Homo sapiens
gctaagataattaaatgaaatac

SEQ ID NO: 6260765 - DNA, 17 bp, Homo sapiens
gctaagatataatttaa

SEQ ID NO: 6260766 - DNA, 21 bp, Homo sapiens
gctaagatgagatttgccagc

SEQ ID NO: 6260767 - DNA, 22 bp, Homo sapiens
gctaagatgagatttgccagca

SEQ ID NO: 6260768 - DNA, 18 bp, Homo sapiens
gctaagattatctgggga

SEQ ID NO: 6260769 - DNA, 17 bp, Homo sapiens
gctaagccccagcaagc

SEQ ID NO: 6260770 - DNA, 21 bp, Homo sapiens
gctaagccccctactgagaaa

SEQ ID NO: 6260771 - DNA, 14 bp, Homo sapiens
gctaagctaaagaa

SEQ ID NO: 6260772 - DNA, 16 bp, Homo sapiens
gctaagctaaagaaac

SEQ ID NO: 6260773 - DNA, 16 bp, Homo sapiens
gctaagctcaaatgta

SEQ ID NO: 6260774 - DNA, 18 bp, Homo sapiens
gctaagcttaaaaaaaac

SEQ ID NO: 6260775 - DNA, 16 bp, Homo sapiens
gctaaggaaattctaa

SEQ ID NO: 6260776 - DNA, 13 bp, Homo sapiens
gctaaggaacaat

SEQ ID NO: 6260777 - DNA, 17 bp, Homo sapiens
gctaaggacatttccca

SEQ ID NO: 6260778 - DNA, 11 bp, Homo sapiens
gctaaggactt

SEQ ID NO: 6260779 - DNA, 22 bp, Homo sapiens
gctaaggaggggaaaaaaatgt

SEQ ID NO: 6260780 - DNA, 23 bp, Homo sapiens
gctaaggccaatgggctagaggg

SEQ ID NO: 6260781 - DNA, 16 bp, Homo sapiens
gctaaggccagctaga

SEQ ID NO: 6260782 - DNA, 16 bp, Homo sapiens
gctaaggcctcttgct

SEQ ID NO: 6260783 - DNA, 21 bp, Homo sapiens
gctaaggcctcttgctggtgc

SEQ ID NO: 6260784 - DNA, 17 bp, Homo sapiens
gctaaggcgtggagctg

SEQ ID NO: 6260785 - DNA, 21 bp, Homo sapiens
gctaaggcgtggagctgcctg

SEQ ID NO: 6260786 - DNA, 11 bp, Homo sapiens
gctaaggctct

SEQ ID NO: 6260787 - DNA, 13 bp, Homo sapiens
gctaaggctgctg

SEQ ID NO: 6260788 - DNA, 12 bp, Homo sapiens
gctaaggcttcc

SEQ ID NO: 6260789 - DNA, 18 bp, Homo sapiens
gctaagggaagacatttc

SEQ ID NO: 6260790 - DNA, 23 bp, Homo sapiens
gctaagggcttgtttttcttcag

SEQ ID NO: 6260791 - DNA, 14 bp, Homo sapiens
gctaaggggcagga

SEQ ID NO: 6260792 - DNA, 16 bp, Homo sapiens
gctaaggggtggggct

SEQ ID NO: 6260793 - DNA, 22 bp, Homo sapiens
gctaagggtgggtgctcagaat

SEQ ID NO: 6260794 - DNA, 21 bp, Homo sapiens
gctaagtaatttagaagatat

SEQ ID NO: 6260795 - DNA, 21 bp, Homo sapiens
gctaagtacacaataagcaaa

SEQ ID NO: 6260796 - DNA, 22 bp, Homo sapiens
gctaagtacacaataagcaaaa

SEQ ID NO: 6260797 - DNA, 21 bp, Homo sapiens
gctaagtatcaggggaaaaaa

SEQ ID NO: 6260798 - DNA, 22 bp, Homo sapiens
gctaagtctttcccaatctcta

SEQ ID NO: 6260799 - DNA, 18 bp, Homo sapiens
gctaagtgatcctcccac

SEQ ID NO: 6260800 - DNA, 21 bp, Homo sapiens
gctaagtggaagacagagatg

SEQ ID NO: 6260801 - DNA, 22 bp, Homo sapiens
gctaagttctaagttcatgttt

SEQ ID NO: 6260802 - DNA, 17 bp, Homo sapiens
gctaagttgggatctag

SEQ ID NO: 6260803 - DNA, 20 bp, Homo sapiens
gctaataaaagtcagagctc

SEQ ID NO: 6260804 - DNA, 17 bp, Homo sapiens
gctaataaaatatcatt

SEQ ID NO: 6260805 - DNA, 22 bp, Homo sapiens
gctaataaaattcgctttctaa

SEQ ID NO: 6260806 - DNA, 19 bp, Homo sapiens
gctaataaacactggctct

SEQ ID NO: 6260807 - DNA, 20 bp, Homo sapiens
gctaataaacactggctctg

SEQ ID NO: 6260808 - DNA, 21 bp, Homo sapiens
gctaataaacactggctctgg

SEQ ID NO: 6260809 - DNA, 20 bp, Homo sapiens
gctaataaactgtattaaat

SEQ ID NO: 6260810 - DNA, 22 bp, Homo sapiens
gctaataaactgtattaaatct

SEQ ID NO: 6260811 - DNA, 14 bp, Homo sapiens
gctaataaactgtt

SEQ ID NO: 6260812 - DNA, 18 bp, Homo sapiens
gctaataaactgtttttt

SEQ ID NO: 6260813 - DNA, 23 bp, Homo sapiens
gctaataaactttgtgctgatct

SEQ ID NO: 6260814 - DNA, 20 bp, Homo sapiens
gctaataaagttaaattgca

SEQ ID NO: 6260815 - DNA, 17 bp, Homo sapiens
gctaataaatgaccagt

SEQ ID NO: 6260816 - DNA, 20 bp, Homo sapiens
gctaataaatgaccagttta

SEQ ID NO: 6260817 - DNA, 22 bp, Homo sapiens
gctaataaatgaccagtttacc

SEQ ID NO: 6260818 - DNA, 15 bp, Homo sapiens
gctaataactgatct

SEQ ID NO: 6260819 - DNA, 19 bp, Homo sapiens
gctaataagtttgaaatat

SEQ ID NO: 6260820 - DNA, 20 bp, Homo sapiens
gctaataatgagctattaaa

SEQ ID NO: 6260821 - DNA, 21 bp, Homo sapiens
gctaataatgagctattaaaa

SEQ ID NO: 6260822 - DNA, 18 bp, Homo sapiens
gctaataatttgccatta

SEQ ID NO: 6260823 - DNA, 20 bp, Homo sapiens
gctaataccaaaattgagct

SEQ ID NO: 6260824 - DNA, 16 bp, Homo sapiens
gctaatacctcttact

SEQ ID NO: 6260825 - DNA, 13 bp, Homo sapiens
gctaatatacttt

SEQ ID NO: 6260826 - DNA, 23 bp, Homo sapiens
gctaatattaaacctttcagtac

SEQ ID NO: 6260827 - DNA, 21 bp, Homo sapiens
gctaatattttatttgaaaaa

SEQ ID NO: 6260828 - DNA, 22 bp, Homo sapiens
gcaattcaaaagttccaagagt

SEQ ID NO: 6260829 - DNA, 20 bp, Homo sapiens
gcaattcaatgcaatgaaaa

SEQ ID NO: 6260830 - DNA, 21 bp, Homo sapiens
gcaattcatgtaacagttgtg

SEQ ID NO: 6260831 - DNA, 15 bp, Homo sapiens
gcaattccagaaatc

SEQ ID NO: 6260832 - DNA, 13 bp, Homo sapiens
gcaattccaggct

SEQ ID NO: 6260833 - DNA, 14 bp, Homo sapiens
gcaattccaggctg

SEQ ID NO: 6260834 - DNA, 20 bp, Homo sapiens
gcaattccaggctgagccat

SEQ ID NO: 6260835 - DNA, 14 bp, Homo sapiens
gcaattcccctctg

SEQ ID NO: 6260836 - DNA, 21 bp, Homo sapiens
gcaattctacccagagccttc

SEQ ID NO: 6260837 - DNA, 17 bp, Homo sapiens
gcaattctcctgcctca

SEQ ID NO: 6260838 - DNA, 19 bp, Homo sapiens
gcaattctcctgcctcagc

SEQ ID NO: 6260839 - DNA, 23 bp, Homo sapiens
gcaattctcgattctttgaagag

SEQ ID NO: 6260840 - DNA, 14 bp, Homo sapiens
gcaattctggaagc

SEQ ID NO: 6260841 - DNA, 14 bp, Homo sapiens
gcaattgacttcct

SEQ ID NO: 6260842 - DNA, 15 bp, Homo sapiens
gcaattgatttcttt

SEQ ID NO: 6260843 - DNA, 16 bp, Homo sapiens
gcaattgcacaaatac

SEQ ID NO: 6260844 - DNA, 15 bp, Homo sapiens
gcaattgcttaggat

SEQ ID NO: 6260845 - DNA, 22 bp, Homo sapiens
gcaattgtaaacagaaattgca

SEQ ID NO: 6260846 - DNA, 22 bp, Homo sapiens
gcaattgtacaaaaaagttata

SEQ ID NO: 6260847 - DNA, 16 bp, Homo sapiens
gcaattgtatatatat

SEQ ID NO: 6260848 - DNA, 22 bp, Homo sapiens
gcaattgtctatttatctttta

SEQ ID NO: 6260849 - DNA, 18 bp, Homo sapiens
gcaattgtggatcttgag

SEQ ID NO: 6260850 - DNA, 18 bp, Homo sapiens
gcaattgttaatcaaaga

SEQ ID NO: 6260851 - DNA, 21 bp, Homo sapiens
gcaatttactgatgagagaat

SEQ ID NO: 6260852 - DNA, 14 bp, Homo sapiens
gcaatttagacaaa

SEQ ID NO: 6260853 - DNA, 15 bp, Homo sapiens
gcaatttcccctctg

SEQ ID NO: 6260854 - DNA, 14 bp, Homo sapiens
gcaatttcctggcc

SEQ ID NO: 6260855 - DNA, 18 bp, Homo sapiens
gcaatttccttttttgtt

SEQ ID NO: 6260856 - DNA, 18 bp, Homo sapiens
gcaatttgtctttggaaa

SEQ ID NO: 6260857 - DNA, 21 bp, Homo sapiens
gcaatttgttattcttttatt

SEQ ID NO: 6260858 - DNA, 17 bp, Homo sapiens
gcaatttgtttaaagaa

SEQ ID NO: 6260859 - DNA, 19 bp, Homo sapiens
gcaattttaattgattatt

SEQ ID NO: 6260860 - DNA, 11 bp, Homo sapiens
gcaattttact

SEQ ID NO: 6260861 - DNA, 11 bp, Homo sapiens
gcaattttcct

SEQ ID NO: 6260862 - DNA, 17 bp, Homo sapiens
gcaattttctttgtttc

SEQ ID NO: 6260863 - DNA, 18 bp, Homo sapiens
gcaattttgcatttgaat

SEQ ID NO: 6260864 - DNA, 12 bp, Homo sapiens
gcaattttgtgg

SEQ ID NO: 6260865 - DNA, 16 bp, Homo sapiens
gcacaaaagacaagca

SEQ ID NO: 6260866 - DNA, 16 bp, Homo sapiens
gcacaaaagacagctg

SEQ ID NO: 6260867 - DNA, 21 bp, Homo sapiens
gcacaaaagcagatacttgag

SEQ ID NO: 6260868 - DNA, 21 bp, Homo sapiens
gcacaaaatataaagcatcta

SEQ ID NO: 6260869 - DNA, 13 bp, Homo sapiens
gcacaaaatgtga

SEQ ID NO: 6260870 - DNA, 22 bp, Homo sapiens
gcacaaaattcgacctgattta

SEQ ID NO: 6260871 - DNA, 14 bp, Homo sapiens
gcacaaacacaagg

SEQ ID NO: 6260872 - DNA, 16 bp, Homo sapiens
gcacaaacacaaggtc

SEQ ID NO: 6260873 - DNA, 17 bp, Homo sapiens
gcacaaacacaaggtca

SEQ ID NO: 6260874 - DNA, 17 bp, Homo sapiens
gcacaaacacacacact

SEQ ID NO: 6260875 - DNA, 17 bp, Homo sapiens
gcacaaacatagacaga

SEQ ID NO: 6260876 - DNA, 13 bp, Homo sapiens
gcacaaacatgaa

SEQ ID NO: 6260877 - DNA, 13 bp, Homo sapiens
gcacaaacatttt

SEQ ID NO: 6260878 - DNA, 16 bp, Homo sapiens
gcacaaacatttttca

SEQ ID NO: 6260879 - DNA, 18 bp, Homo sapiens
gcacaaacatttttcaac

SEQ ID NO: 6260880 - DNA, 15 bp, Homo sapiens
gcacaaaccctgggg

SEQ ID NO: 6260881 - DNA, 21 bp, Homo sapiens
gcacaaaccttcttttcaatg

SEQ ID NO: 6260882 - DNA, 22 bp, Homo sapiens
gcacaaaccttcttttcaatgc

SEQ ID NO: 6260883 - DNA, 18 bp, Homo sapiens
gcacaaactcaccatctg

SEQ ID NO: 6260884 - DNA, 20 bp, Homo sapiens
gcacaaactgcagctgtgag

SEQ ID NO: 6260885 - DNA, 17 bp, Homo sapiens
gcacaaagaccctggct

SEQ ID NO: 6260886 - DNA, 19 bp, Homo sapiens
gcacaaagagggagttggc

SEQ ID NO: 6260887 - DNA, 17 bp, Homo sapiens
gcacaaagcagtttttc

SEQ ID NO: 6260888 - DNA, 13 bp, Homo sapiens
gcacaaagctcaa

SEQ ID NO: 6260889 - DNA, 13 bp, Homo sapiens
gcacaaagtggca

SEQ ID NO: 6260890 - DNA, 15 bp, Homo sapiens
gcacaaagttctcag

SEQ ID NO: 6260891 - DNA, 20 bp, Homo sapiens
gcacaaagttctcagagctc

SEQ ID NO: 6260892 - DNA, 13 bp, Homo sapiens
gcacaaatattta

SEQ ID NO: 6260893 - DNA, 16 bp, Homo sapiens
gcacaaatatttattt

SEQ ID NO: 6260894 - DNA, 19 bp, Homo sapiens
gcacaaattagttatatat

SEQ ID NO: 6260895 - DNA, 19 bp, Homo sapiens
gcacaacagagtaactatc

SEQ ID NO: 6260896 - DNA, 19 bp, Homo sapiens
gcacaacagccctgcctga

SEQ ID NO: 6260897 - DNA, 14 bp, Homo sapiens
gcacaacatgcaca

SEQ ID NO: 6260898 - DNA, 17 bp, Homo sapiens
gcacaacccccagctcc

SEQ ID NO: 6260899 - DNA, 19 bp, Homo sapiens
gcacaactctactgttgca

SEQ ID NO: 6260900 - DNA, 18 bp, Homo sapiens
gcacaacttcagcagggg

SEQ ID NO: 6260901 - DNA, 17 bp, Homo sapiens
gcacaagaagcgtgaga

SEQ ID NO: 6260902 - DNA, 17 bp, Homo sapiens
gcacaagaagtttcttc

SEQ ID NO: 6260903 - DNA, 17 bp, Homo sapiens
gcacaagaatcacttga

SEQ ID NO: 6260904 - DNA, 14 bp, Homo sapiens
gcacaagaatggat

SEQ ID NO: 6260905 - DNA, 16 bp, Homo sapiens
gcacaagaatggatca

SEQ ID NO: 6260906 - DNA, 17 bp, Homo sapiens
gcacaagactggcccag

SEQ ID NO: 6260907 - DNA, 19 bp, Homo sapiens
gcacaagatgccccaggga

SEQ ID NO: 6260908 - DNA, 21 bp, Homo sapiens
gcacaagcagagtgcacagct

SEQ ID NO: 6260909 - DNA, 23 bp, Homo sapiens
gcacaagcagagtgcacagctgt

SEQ ID NO: 6260910 - DNA, 19 bp, Homo sapiens
gcacaagcagggcactctg

SEQ ID NO: 6260911 - DNA, 18 bp, Homo sapiens
gcacaagcattccttagc

SEQ ID NO: 6260912 - DNA, 13 bp, Homo sapiens
gcacaagccaggg

SEQ ID NO: 6260913 - DNA, 11 bp, Homo sapiens
gcacaagccca

SEQ ID NO: 6260914 - DNA, 14 bp, Homo sapiens
gcacaagctcagaa

SEQ ID NO: 6260915 - DNA, 18 bp, Homo sapiens
gcacaagctccaagctcc

SEQ ID NO: 6260916 - DNA, 23 bp, Homo sapiens
gcacaagctccaagctcccaggc

SEQ ID NO: 6260917 - DNA, 14 bp, Homo sapiens
gcacaagctccctg

SEQ ID NO: 6260918 - DNA, 18 bp, Homo sapiens
gcacaagctccctggtga

SEQ ID NO: 6260919 - DNA, 21 bp, Homo sapiens
gcacaagcttgtatatacata

SEQ ID NO: 6260920 - DNA, 15 bp, Homo sapiens
gcacaaggagtgccc

SEQ ID NO: 6260921 - DNA, 22 bp, Homo sapiens
gcacaaggagtgcccgccttga

SEQ ID NO: 6260922 - DNA, 18 bp, Homo sapiens
gcacaaggattgaaaatt

SEQ ID NO: 6260923 - DNA, 19 bp, Homo sapiens
gcacaaggccttaatggac

SEQ ID NO: 6260924 - DNA, 14 bp, Homo sapiens
gcacaagggcacat

SEQ ID NO: 6260925 - DNA, 16 bp, Homo sapiens
gcacaagggcacattg

SEQ ID NO: 6260926 - DNA, 19 bp, Homo sapiens
gcacaagtaacacatttgg

SEQ ID NO: 6260927 - DNA, 14 bp, Homo sapiens
gcacaagtgtaatg

SEQ ID NO: 6260928 - DNA, 19 bp, Homo sapiens
gcacaagtgtaatgaatac

SEQ ID NO: 6260929 - DNA, 18 bp, Homo sapiens
gcacaagttccagctggt

SEQ ID NO: 6260930 - DNA, 20 bp, Homo sapiens
gcacaagtttttttgttcat

SEQ ID NO: 6260931 - DNA, 21 bp, Homo sapiens
gcacaagtttttttgttcata

SEQ ID NO: 6260932 - DNA, 16 bp, Homo sapiens
gcacaataaaaatgtt

SEQ ID NO: 6260933 - DNA, 12 bp, Homo sapiens
gcacaataaaac

SEQ ID NO: 6260934 - DNA, 22 bp, Homo sapiens
gcacaataaaaccaagcctctg

SEQ ID NO: 6260935 - DNA, 11 bp, Homo sapiens
gcacaataaat

SEQ ID NO: 6260936 - DNA, 14 bp, Homo sapiens
gcacaataaatata

SEQ ID NO: 6260937 - DNA, 18 bp, Homo sapiens
gcacaataaatggctgta

SEQ ID NO: 6260938 - DNA, 20 bp, Homo sapiens
gcacaataatttgttttcat

SEQ ID NO: 6260939 - DNA, 14 bp, Homo sapiens
gcacaatatttctt

SEQ ID NO: 6260940 - DNA, 19 bp, Homo sapiens
gcacaatatttcttttgtt

SEQ ID NO: 6260941 - DNA, 17 bp, Homo sapiens
gcacaatcactaaactt

SEQ ID NO: 6260942 - DNA, 18 bp, Homo sapiens
gcacaatcactaaacttt

SEQ ID NO: 6260943 - DNA, 21 bp, Homo sapiens
gcacaatcactaaactttatt

SEQ ID NO: 6260944 - DNA, 17 bp, Homo sapiens
gcacaatctcacacagc

SEQ ID NO: 6260945 - DNA, 18 bp, Homo sapiens
gcacaatctcacacagct

SEQ ID NO: 6260946 - DNA, 22 bp, Homo sapiens
gcacaatctcggctcactgcat

SEQ ID NO: 6260947 - DNA, 17 bp, Homo sapiens
gcacaatctgtaaattt

SEQ ID NO: 6260948 - DNA, 23 bp, Homo sapiens
gcacaatctgttctactcttaat

SEQ ID NO: 6260949 - DNA, 21 bp, Homo sapiens
gcacaatgcatgtgctgtctc

SEQ ID NO: 6260950 - DNA, 22 bp, Homo sapiens
gcacaatggtttcaaagaaaga

SEQ ID NO: 6260951 - DNA, 12 bp, Homo sapiens
gcacaatgtctt

SEQ ID NO: 6260952 - DNA, 17 bp, Homo sapiens
gcacaatgtttgatgtc

SEQ ID NO: 6260953 - DNA, 12 bp, Homo sapiens
gcacaattataa

SEQ ID NO: 6260954 - DNA, 22 bp, Homo sapiens
gcacaattcattgttaaaaaac

SEQ ID NO: 6260955 - DNA, 18 bp, Homo sapiens
gcacaattctgtccctgt

SEQ ID NO: 6260956 - DNA, 13 bp, Homo sapiens
gcacaatttagaa

SEQ ID NO: 6260957 - DNA, 16 bp, Homo sapiens
gcacaatttagaaaac

SEQ ID NO: 6260958 - DNA, 18 bp, Homo sapiens
gcacaatttagaaaacat

SEQ ID NO: 6260959 - DNA, 20 bp, Homo sapiens
gcacaatttgagactgaaat

SEQ ID NO: 6260960 - DNA, 21 bp, Homo sapiens
gcacaatttgagcaattcatt

SEQ ID NO: 6260961 - DNA, 22 bp, Homo sapiens
gcacaatttgagcaattcattt

SEQ ID NO: 6260962 - DNA, 14 bp, Homo sapiens
gcacaatttgcact

SEQ ID NO: 6260963 - DNA, 18 bp, Homo sapiens
gcacacaaacacctccta

SEQ ID NO: 6260964 - DNA, 14 bp, Homo sapiens
gcacacaaatatta

SEQ ID NO: 6260965 - DNA, 18 bp, Homo sapiens
gcacacaacgattatagt

SEQ ID NO: 6260966 - DNA, 20 bp, Homo sapiens
gcacacaactgtggtcccag

SEQ ID NO: 6260967 - DNA, 15 bp, Homo sapiens
gcacacaatgctatt

SEQ ID NO: 6260968 - DNA, 18 bp, Homo sapiens
gcacacaattagatttct

SEQ ID NO: 6260969 - DNA, 22 bp, Homo sapiens
gcacacacaaacctactgccca

SEQ ID NO: 6260970 - DNA, 14 bp, Homo sapiens
gcacacacacacac

SEQ ID NO: 6260971 - DNA, 21 bp, Homo sapiens
gcacacacacacacacacatc

SEQ ID NO: 6260972 - DNA, 23 bp, Homo sapiens
gcacacacacacacacatacaca

SEQ ID NO: 6260973 - DNA, 19 bp, Homo sapiens
gcacacacacacacaggag

SEQ ID NO: 6260974 - DNA, 13 bp, Homo sapiens
gcacacacacaga

SEQ ID NO: 6260975 - DNA, 21 bp, Homo sapiens
gcacacacaccgatgctgact

SEQ ID NO: 6260976 - DNA, 21 bp, Homo sapiens
gcacacacacgcgtccacata

SEQ ID NO: 6260977 - DNA, 20 bp, Homo sapiens
gcacacacacggatgcacac

SEQ ID NO: 6260978 - DNA, 11 bp, Homo sapiens
gcacacacact

SEQ ID NO: 6260979 - DNA, 18 bp, Homo sapiens
gcacacacactagccttc

SEQ ID NO: 6260980 - DNA, 23 bp, Homo sapiens
gcacacacagatatacacatgga

SEQ ID NO: 6260981 - DNA, 16 bp, Homo sapiens
gcacacacatctggcc

SEQ ID NO: 6260982 - DNA, 17 bp, Homo sapiens
gcacacacatctggccc

SEQ ID NO: 6260983 - DNA, 19 bp, Homo sapiens
gcacacacatctggccctg

SEQ ID NO: 6260984 - DNA, 21 bp, Homo sapiens
gcacacacatctggccctgac

SEQ ID NO: 6260985 - DNA, 13 bp, Homo sapiens
gcacacacatgca

SEQ ID NO: 6260986 - DNA, 21 bp, Homo sapiens
gcacacacatggatgagcaca

SEQ ID NO: 6260987 - DNA, 14 bp, Homo sapiens
gcacacaccagagc

SEQ ID NO: 6260988 - DNA, 15 bp, Homo sapiens
gcacacaccctgagc

SEQ ID NO: 6260989 - DNA, 22 bp, Homo sapiens
gcacacacctatggctggctgg

SEQ ID NO: 6260990 - DNA, 13 bp, Homo sapiens
gcacacacctgca

SEQ ID NO: 6260991 - DNA, 14 bp, Homo sapiens
gcacacacctgcac

SEQ ID NO: 6260992 - DNA, 23 bp, Homo sapiens
gcacacacctgcacacccctgca

SEQ ID NO: 6260993 - DNA, 14 bp, Homo sapiens
gcacacacctgcct

SEQ ID NO: 6260994 - DNA, 21 bp, Homo sapiens
gcacacacgccttcatgccag

SEQ ID NO: 6260995 - DNA, 17 bp, Homo sapiens
gcacacactgtgctttc

SEQ ID NO: 6260996 - DNA, 16 bp, Homo sapiens
gcacacactttcatgc

SEQ ID NO: 6260997 - DNA, 15 bp, Homo sapiens
gcacacagaaatata

SEQ ID NO: 6260998 - DNA, 18 bp, Homo sapiens
gcacacagaaatatatat

SEQ ID NO: 6260999 - DNA, 13 bp, Homo sapiens
gcacacagactgg

SEQ ID NO: 6261000 - DNA, 19 bp, Homo sapiens
gcacacagagaagggaaga

SEQ ID NO: 6261001 - DNA, 15 bp, Homo sapiens
gcacacagagatttg

SEQ ID NO: 6261002 - DNA, 20 bp, Homo sapiens
gcacacagatcccctggaaa

SEQ ID NO: 6261003 - DNA, 12 bp, Homo sapiens
gcacacagcagc

SEQ ID NO: 6261004 - DNA, 13 bp, Homo sapiens
gcacacagcagcc

SEQ ID NO: 6261005 - DNA, 17 bp, Homo sapiens
gcacacagcagcccccc

SEQ ID NO: 6261006 - DNA, 20 bp, Homo sapiens
gcacacagcagccccccagc

SEQ ID NO: 6261007 - DNA, 22 bp, Homo sapiens
gctaatcagcattctcactcct

SEQ ID NO: 6261008 - DNA, 15 bp, Homo sapiens
gctaatcagtgtctc

SEQ ID NO: 6261009 - DNA, 22 bp, Homo sapiens
gctaatcatgtgggtgagccag

SEQ ID NO: 6261010 - DNA, 13 bp, Homo sapiens
gctaatctgcctg

SEQ ID NO: 6261011 - DNA, 20 bp, Homo sapiens
gctaatctgcctggttttat

SEQ ID NO: 6261012 - DNA, 23 bp, Homo sapiens
gctaatctgcctggttttattta

SEQ ID NO: 6261013 - DNA, 12 bp, Homo sapiens
gctaatgaattt

SEQ ID NO: 6261014 - DNA, 19 bp, Homo sapiens
gctaatgcctttcatcttg

SEQ ID NO: 6261015 - DNA, 19 bp, Homo sapiens
gctaatggagtgtttgaaa

SEQ ID NO: 6261016 - DNA, 23 bp, Homo sapiens
gctaatggatgtagccagggact

SEQ ID NO: 6261017 - DNA, 16 bp, Homo sapiens
gctaatgggctgctgt

SEQ ID NO: 6261018 - DNA, 15 bp, Homo sapiens
gctaatgtaatcatt

SEQ ID NO: 6261019 - DNA, 20 bp, Homo sapiens
gctaatgtaatcatttatct

SEQ ID NO: 6261020 - DNA, 20 bp, Homo sapiens
gctaatgtgaatgtgagtga

SEQ ID NO: 6261021 - DNA, 17 bp, Homo sapiens
gctaatgtgtctgtgga

SEQ ID NO: 6261022 - DNA, 12 bp, Homo sapiens
gctaatgttgat

SEQ ID NO: 6261023 - DNA, 21 bp, Homo sapiens
gctaattagaaatcaacttgt

SEQ ID NO: 6261024 - DNA, 15 bp, Homo sapiens
gctaattaggaagct

SEQ ID NO: 6261025 - DNA, 16 bp, Homo sapiens
gctaattataattcag

SEQ ID NO: 6261026 - DNA, 17 bp, Homo sapiens
gctaattcaaggaattt

SEQ ID NO: 6261027 - DNA, 22 bp, Homo sapiens
gctaattcaaggaatttcttaa

SEQ ID NO: 6261028 - DNA, 14 bp, Homo sapiens
gctaattcaattta

SEQ ID NO: 6261029 - DNA, 20 bp, Homo sapiens
gctaattcatacctccctcc

SEQ ID NO: 6261030 - DNA, 16 bp, Homo sapiens
gctaattctactcaca

SEQ ID NO: 6261031 - DNA, 15 bp, Homo sapiens
gctaattctgggaag

SEQ ID NO: 6261032 - DNA, 13 bp, Homo sapiens
gctaattctttgc

SEQ ID NO: 6261033 - DNA, 17 bp, Homo sapiens
gctaattctttgcaaaa

SEQ ID NO: 6261034 - DNA, 12 bp, Homo sapiens
gctaattgagac

SEQ ID NO: 6261035 - DNA, 18 bp, Homo sapiens
gctaattgctgttgaaag

SEQ ID NO: 6261036 - DNA, 19 bp, Homo sapiens
gctaattgggagtccaggc

SEQ ID NO: 6261037 - DNA, 20 bp, Homo sapiens
gctaattgggagtccaggca

SEQ ID NO: 6261038 - DNA, 12 bp, Homo sapiens
gctaattgtacc

SEQ ID NO: 6261039 - DNA, 11 bp, Homo sapiens
gctaattgtgt

SEQ ID NO: 6261040 - DNA, 16 bp, Homo sapiens
gctaatttaaagagac

SEQ ID NO: 6261041 - DNA, 20 bp, Homo sapiens
gctaatttaaggatgacttt

SEQ ID NO: 6261042 - DNA, 13 bp, Homo sapiens
gctaatttttgta

SEQ ID NO: 6261043 - DNA, 20 bp, Homo sapiens
gctaatttttgtatttttag

SEQ ID NO: 6261044 - DNA, 18 bp, Homo sapiens
gctaattttttgtacttt

SEQ ID NO: 6261045 - DNA, 22 bp, Homo sapiens
gctaatttttttaatgtttttt

SEQ ID NO: 6261046 - DNA, 21 bp, Homo sapiens
gctaatttttttgtattttag

SEQ ID NO: 6261047 - DNA, 18 bp, Homo sapiens
gctacaaaacgcgcagat

SEQ ID NO: 6261048 - DNA, 22 bp, Homo sapiens
gctacaaaacgcgcagatgtgc

SEQ ID NO: 6261049 - DNA, 14 bp, Homo sapiens
gctacaaagaagac

SEQ ID NO: 6261050 - DNA, 15 bp, Homo sapiens
gctacaaagaagaca

SEQ ID NO: 6261051 - DNA, 12 bp, Homo sapiens
gctacaaagcag

SEQ ID NO: 6261052 - DNA, 22 bp, Homo sapiens
gctacaaaggaggacaagaccc

SEQ ID NO: 6261053 - DNA, 17 bp, Homo sapiens
gctacaaatttatgcat

SEQ ID NO: 6261054 - DNA, 12 bp, Homo sapiens
gctacaagaaca

SEQ ID NO: 6261055 - DNA, 15 bp, Homo sapiens
gctacaataaatgct

SEQ ID NO: 6261056 - DNA, 20 bp, Homo sapiens
gctacaattttctcccagga

SEQ ID NO: 6261057 - DNA, 21 bp, Homo sapiens
gctacaattttctcccaggaa

SEQ ID NO: 6261058 - DNA, 16 bp, Homo sapiens
gctacacaaaagccaa

SEQ ID NO: 6261059 - DNA, 12 bp, Homo sapiens
gctacacagacc

SEQ ID NO: 6261060 - DNA, 16 bp, Homo sapiens
gctacacagacccctc

SEQ ID NO: 6261061 - DNA, 15 bp, Homo sapiens
gctacacaggcagga

SEQ ID NO: 6261062 - DNA, 17 bp, Homo sapiens
gctacaccactctggca

SEQ ID NO: 6261063 - DNA, 19 bp, Homo sapiens
gctacaccactctggcagc

SEQ ID NO: 6261064 - DNA, 20 bp, Homo sapiens
gctacaccactctggcagcc

SEQ ID NO: 6261065 - DNA, 17 bp, Homo sapiens
gctacacccttttccag

SEQ ID NO: 6261066 - DNA, 23 bp, Homo sapiens
gctacacctattatcccagctgc

SEQ ID NO: 6261067 - DNA, 20 bp, Homo sapiens
gctacaccttagcagctctt

SEQ ID NO: 6261068 - DNA, 21 bp, Homo sapiens
gctacactattgcattgttca

SEQ ID NO: 6261069 - DNA, 18 bp, Homo sapiens
gctacactgagcagggag

SEQ ID NO: 6261070 - DNA, 24 bp, Homo sapiens
gctacacttacaagtaatgaattt

SEQ ID NO: 6261071 - DNA, 15 bp, Homo sapiens
gctacagaaagcaca

SEQ ID NO: 6261072 - DNA, 16 bp, Homo sapiens
gctacagaaagcacaa

SEQ ID NO: 6261073 - DNA, 17 bp, Homo sapiens
gctacagaatagggtgg

SEQ ID NO: 6261074 - DNA, 13 bp, Homo sapiens
gctacagagaagc

SEQ ID NO: 6261075 - DNA, 17 bp, Homo sapiens
gctacagagaagccttc

SEQ ID NO: 6261076 - DNA, 23 bp, Homo sapiens
gctacagagaagccttcaagctc

SEQ ID NO: 6261077 - DNA, 12 bp, Homo sapiens
gctacagagccg

SEQ ID NO: 6261078 - DNA, 17 bp, Homo sapiens
gctacagagtaacaaaa

SEQ ID NO: 6261079 - DNA, 21 bp, Homo sapiens
gctacagagtaacaaaaaata

SEQ ID NO: 6261080 - DNA, 15 bp, Homo sapiens
gctacagcaaataaa

SEQ ID NO: 6261081 - DNA, 17 bp, Homo sapiens
gctacagctccacacgc

SEQ ID NO: 6261082 - DNA, 22 bp, Homo sapiens
gctacagctccacacgccccgg

SEQ ID NO: 6261083 - DNA, 20 bp, Homo sapiens
gctacaggaagcaccccatg

SEQ ID NO: 6261084 - DNA, 21 bp, Homo sapiens
gctacaggaagcaccccatgc

SEQ ID NO: 6261085 - DNA, 23 bp, Homo sapiens
gctacagggcgagactctgtctc

SEQ ID NO: 6261086 - DNA, 23 bp, Homo sapiens
gctacaggggaaggtggcctctg

SEQ ID NO: 6261087 - DNA, 16 bp, Homo sapiens
gctacaggggaggctg

SEQ ID NO: 6261088 - DNA, 15 bp, Homo sapiens
gctacaggttacaac

SEQ ID NO: 6261089 - DNA, 15 bp, Homo sapiens
gctacagtaataaat

SEQ ID NO: 6261090 - DNA, 19 bp, Homo sapiens
gctacagtactatgtaaat

SEQ ID NO: 6261091 - DNA, 13 bp, Homo sapiens
gctacataaattg

SEQ ID NO: 6261092 - DNA, 18 bp, Homo sapiens
gctacatatgtaggaaaa

SEQ ID NO: 6261093 - DNA, 13 bp, Homo sapiens
gctacatcagttt

SEQ ID NO: 6261094 - DNA, 22 bp, Homo sapiens
gctacatgaagttgtaagaaaa

SEQ ID NO: 6261095 - DNA, 20 bp, Homo sapiens
gctacatggggtctgggtgg

SEQ ID NO: 6261096 - DNA, 19 bp, Homo sapiens
gctacatgttgcaacaaat

SEQ ID NO: 6261097 - DNA, 21 bp, Homo sapiens
gctacattaaactcaaatgta

SEQ ID NO: 6261098 - DNA, 18 bp, Homo sapiens
gctacattcacacactca

SEQ ID NO: 6261099 - DNA, 13 bp, Homo sapiens
gctacattcctca

SEQ ID NO: 6261100 - DNA, 15 bp, Homo sapiens
gctacattcctcagc

SEQ ID NO: 6261101 - DNA, 16 bp, Homo sapiens
gctacattcctcagct

SEQ ID NO: 6261102 - DNA, 20 bp, Homo sapiens
gctacattcctcagctgcca

SEQ ID NO: 6261103 - DNA, 14 bp, Homo sapiens
gctacattgtaatc

SEQ ID NO: 6261104 - DNA, 21 bp, Homo sapiens
gctacatttccgccacatccc

SEQ ID NO: 6261105 - DNA, 21 bp, Homo sapiens
gctacattttcagaagttaac

SEQ ID NO: 6261106 - DNA, 20 bp, Homo sapiens
gctaccaaagcaccttagct

SEQ ID NO: 6261107 - DNA, 15 bp, Homo sapiens
gctaccaaggcccag

SEQ ID NO: 6261108 - DNA, 18 bp, Homo sapiens
gctaccaattgtttcttg

SEQ ID NO: 6261109 - DNA, 16 bp, Homo sapiens
gctaccacagacttgc

SEQ ID NO: 6261110 - DNA, 16 bp, Homo sapiens
gctaccaccagctgtg

SEQ ID NO: 6261111 - DNA, 16 bp, Homo sapiens
gctaccaggatgctaa

SEQ ID NO: 6261112 - DNA, 17 bp, Homo sapiens
gctaccagggctcaccc

SEQ ID NO: 6261113 - DNA, 22 bp, Homo sapiens
gctaccagtatttagaagccaa

SEQ ID NO: 6261114 - DNA, 13 bp, Homo sapiens
gctaccatctgca

SEQ ID NO: 6261115 - DNA, 15 bp, Homo sapiens
gctaccatctgcatg

SEQ ID NO: 6261116 - DNA, 16 bp, Homo sapiens
gctaccatctgcatgg

SEQ ID NO: 6261117 - DNA, 20 bp, Homo sapiens
gctaccattttacatttcta

SEQ ID NO: 6261118 - DNA, 14 bp, Homo sapiens
gctacccaggaggc

SEQ ID NO: 6261119 - DNA, 21 bp, Homo sapiens
gctacccaggaggctgaggtg

SEQ ID NO: 6261120 - DNA, 19 bp, Homo sapiens
gctacccctcgactcagca

SEQ ID NO: 6261121 - DNA, 17 bp, Homo sapiens
gctaccccttgtgggca

SEQ ID NO: 6261122 - DNA, 16 bp, Homo sapiens
gctacccgcagagttc

SEQ ID NO: 6261123 - DNA, 14 bp, Homo sapiens
gctacccgggaagg

SEQ ID NO: 6261124 - DNA, 15 bp, Homo sapiens
gctacccgggaaggg

SEQ ID NO: 6261125 - DNA, 13 bp, Homo sapiens
gctaccctcagcc

SEQ ID NO: 6261126 - DNA, 14 bp, Homo sapiens
gctaccctcagcct

SEQ ID NO: 6261127 - DNA, 17 bp, Homo sapiens
gctaccctccctgctgt

SEQ ID NO: 6261128 - DNA, 14 bp, Homo sapiens
gctaccctgagctg

SEQ ID NO: 6261129 - DNA, 16 bp, Homo sapiens
gctaccctgagctgag

SEQ ID NO: 6261130 - DNA, 17 bp, Homo sapiens
gctacccttgccaaggc

SEQ ID NO: 6261131 - DNA, 18 bp, Homo sapiens
gctaccctttttctccag

SEQ ID NO: 6261132 - DNA, 16 bp, Homo sapiens
gctaccgccctgggct

SEQ ID NO: 6261133 - DNA, 23 bp, Homo sapiens
gctaccgccctgggctggactgg

SEQ ID NO: 6261134 - DNA, 18 bp, Homo sapiens
gctaccgtggatctcctt

SEQ ID NO: 6261135 - DNA, 14 bp, Homo sapiens
gctacctcactggg

SEQ ID NO: 6261136 - DNA, 14 bp, Homo sapiens
gctacctccctccc

SEQ ID NO: 6261137 - DNA, 21 bp, Homo sapiens
gctacctctctcttccctagg

SEQ ID NO: 6261138 - DNA, 22 bp, Homo sapiens
gctacctctctgtcccttgctg

SEQ ID NO: 6261139 - DNA, 15 bp, Homo sapiens
gctacctctgagaag

SEQ ID NO: 6261140 - DNA, 23 bp, Homo sapiens
gctacctgaacacttattgcttt

SEQ ID NO: 6261141 - DNA, 20 bp, Homo sapiens
gctacctgctcagccctgca

SEQ ID NO: 6261142 - DNA, 21 bp, Homo sapiens
gctacctgggaggctgcggca

SEQ ID NO: 6261143 - DNA, 14 bp, Homo sapiens
gctacctgtgagca

SEQ ID NO: 6261144 - DNA, 14 bp, Homo sapiens
gctacctgtgtgga

SEQ ID NO: 6261145 - DNA, 18 bp, Homo sapiens
gctacctgtgtggacagg

SEQ ID NO: 6261146 - DNA, 18 bp, Homo sapiens
gctacctgtttgaagggg

SEQ ID NO: 6261147 - DNA, 17 bp, Homo sapiens
gctaccttattgtacgt

SEQ ID NO: 6261148 - DNA, 13 bp, Homo sapiens
gctaccttgcccc

SEQ ID NO: 6261149 - DNA, 15 bp, Homo sapiens
gctaccttgccccaa

SEQ ID NO: 6261150 - DNA, 21 bp, Homo sapiens
gctaccttgtgacccagcact

SEQ ID NO: 6261151 - DNA, 16 bp, Homo sapiens
gctacctttcaaagct

SEQ ID NO: 6261152 - DNA, 22 bp, Homo sapiens
gctacgaaaggatgagcagagc

SEQ ID NO: 6261153 - DNA, 14 bp, Homo sapiens
gctacgaatcttcc

SEQ ID NO: 6261154 - DNA, 12 bp, Homo sapiens
gctacgcctctt

SEQ ID NO: 6261155 - DNA, 12 bp, Homo sapiens
gctacgcctgca

SEQ ID NO: 6261156 - DNA, 22 bp, Homo sapiens
gctacggggaaaatgcattttc

SEQ ID NO: 6261157 - DNA, 18 bp, Homo sapiens
gctacgtacatgtgaggc

SEQ ID NO: 6261158 - DNA, 17 bp, Homo sapiens
gctacgtgcctcccgag

SEQ ID NO: 6261159 - DNA, 15 bp, Homo sapiens
gctacgtgtgaaatc

SEQ ID NO: 6261160 - DNA, 18 bp, Homo sapiens
gctactaacctggagaca

SEQ ID NO: 6261161 - DNA, 16 bp, Homo sapiens
gctactaacgataaaa

SEQ ID NO: 6261162 - DNA, 18 bp, Homo sapiens
gctactaatgatgttttc

SEQ ID NO: 6261163 - DNA, 21 bp, Homo sapiens
gctactacccgagcccagcta

SEQ ID NO: 6261164 - DNA, 18 bp, Homo sapiens
gctactactgcagtcttt

SEQ ID NO: 6261165 - DNA, 14 bp, Homo sapiens
gctactagctcttt

SEQ ID NO: 6261166 - DNA, 16 bp, Homo sapiens
gctactataaagagaa

SEQ ID NO: 6261167 - DNA, 19 bp, Homo sapiens
gctactataatcaaatgat

SEQ ID NO: 6261168 - DNA, 20 bp, Homo sapiens
gctactatgatttaatttga

SEQ ID NO: 6261169 - DNA, 16 bp, Homo sapiens
gctactcaagaggctg

SEQ ID NO: 6261170 - DNA, 17 bp, Homo sapiens
gctactcactcaagttc

SEQ ID NO: 6261171 - DNA, 20 bp, Homo sapiens
gctactcactcaagttcaag

SEQ ID NO: 6261172 - DNA, 23 bp, Homo sapiens
gctactcactcaagttcaaggac

SEQ ID NO: 6261173 - DNA, 23 bp, Homo sapiens
gctactcagaaatggacaaagaa

SEQ ID NO: 6261174 - DNA, 14 bp, Homo sapiens
gctactcagaagcc

SEQ ID NO: 6261175 - DNA, 18 bp, Homo sapiens
gctactcagaagcctgag

SEQ ID NO: 6261176 - DNA, 13 bp, Homo sapiens
gctactcagatgg

SEQ ID NO: 6261177 - DNA, 19 bp, Homo sapiens
gctactcagcagccctcct

SEQ ID NO: 6261178 - DNA, 13 bp, Homo sapiens
gctactcagcagt

SEQ ID NO: 6261179 - DNA, 19 bp, Homo sapiens
gctactcagcagtaagcag

SEQ ID NO: 6261180 - DNA, 21 bp, Homo sapiens
gctactcagcagtaagcaggc

SEQ ID NO: 6261181 - DNA, 17 bp, Homo sapiens
gctactcaggaggctga

SEQ ID NO: 6261182 - DNA, 21 bp, Homo sapiens
gctactcaggaggctgagaca

SEQ ID NO: 6261183 - DNA, 22 bp, Homo sapiens
gctactcaggaggctgagacag

SEQ ID NO: 6261184 - DNA, 22 bp, Homo sapiens
gctactcaggaggctgaggcag

SEQ ID NO: 6261185 - DNA, 20 bp, Homo sapiens
gcacacagcggctgcctcct

SEQ ID NO: 6261186 - DNA, 23 bp, Homo sapiens
gcacacagctaggcatgcctggg

SEQ ID NO: 6261187 - DNA, 22 bp, Homo sapiens
gcacacagctgagcacttagca

SEQ ID NO: 6261188 - DNA, 23 bp, Homo sapiens
gcacacagcttttagtacccacc

SEQ ID NO: 6261189 - DNA, 14 bp, Homo sapiens
gcacacaggacagc

SEQ ID NO: 6261190 - DNA, 18 bp, Homo sapiens
gcacacaggcagccagcc

SEQ ID NO: 6261191 - DNA, 22 bp, Homo sapiens
gcacacaggcagccagccgtgg

SEQ ID NO: 6261192 - DNA, 11 bp, Homo sapiens
gcacacagggc

SEQ ID NO: 6261193 - DNA, 12 bp, Homo sapiens
gcacacagggca

SEQ ID NO: 6261194 - DNA, 13 bp, Homo sapiens
gcacacagggcag

SEQ ID NO: 6261195 - DNA, 19 bp, Homo sapiens
gcacacagggcccggccac

SEQ ID NO: 6261196 - DNA, 17 bp, Homo sapiens
gcacacagggctcacag

SEQ ID NO: 6261197 - DNA, 17 bp, Homo sapiens
gcacacataacacacat

SEQ ID NO: 6261198 - DNA, 14 bp, Homo sapiens
gcacacatcaccag

SEQ ID NO: 6261199 - DNA, 15 bp, Homo sapiens
gcacacatcatctgt

SEQ ID NO: 6261200 - DNA, 20 bp, Homo sapiens
gcacacatcatctgtaagct

SEQ ID NO: 6261201 - DNA, 17 bp, Homo sapiens
gcacacatcttacctct

SEQ ID NO: 6261202 - DNA, 20 bp, Homo sapiens
gcacacatcttacctctcat

SEQ ID NO: 6261203 - DNA, 21 bp, Homo sapiens
gcacacatgcatcctcccctc

SEQ ID NO: 6261204 - DNA, 15 bp, Homo sapiens
gcacacatggacaca

SEQ ID NO: 6261205 - DNA, 12 bp, Homo sapiens
gcacacattttt

SEQ ID NO: 6261206 - DNA, 17 bp, Homo sapiens
gcacaccaatcttactt

SEQ ID NO: 6261207 - DNA, 20 bp, Homo sapiens
gcacaccaatcttactttgt

SEQ ID NO: 6261208 - DNA, 20 bp, Homo sapiens
gcacaccaccacacacagct

SEQ ID NO: 6261209 - DNA, 13 bp, Homo sapiens
gcacaccactgcc

SEQ ID NO: 6261210 - DNA, 18 bp, Homo sapiens
gcacaccactgccctgcc

SEQ ID NO: 6261211 - DNA, 20 bp, Homo sapiens
gcacaccactgccctgcctg

SEQ ID NO: 6261212 - DNA, 15 bp, Homo sapiens
gcacaccagccgctg

SEQ ID NO: 6261213 - DNA, 17 bp, Homo sapiens
gcacaccagccgctgca

SEQ ID NO: 6261214 - DNA, 19 bp, Homo sapiens
gcacaccagccgctgcagg

SEQ ID NO: 6261215 - DNA, 19 bp, Homo sapiens
gcacaccagtgcaagcaga

SEQ ID NO: 6261216 - DNA, 22 bp, Homo sapiens
gcacaccagtgtcgtgtctgct

SEQ ID NO: 6261217 - DNA, 17 bp, Homo sapiens
gcacaccattttgtaaa

SEQ ID NO: 6261218 - DNA, 15 bp, Homo sapiens
gcacacccaggtttg

SEQ ID NO: 6261219 - DNA, 21 bp, Homo sapiens
gcacacccctgcacacacctg

SEQ ID NO: 6261220 - DNA, 15 bp, Homo sapiens
gcacacccctggggc

SEQ ID NO: 6261221 - DNA, 15 bp, Homo sapiens
gcacacccgtgtgca

SEQ ID NO: 6261222 - DNA, 23 bp, Homo sapiens
gcacaccctcactctgccagggc

SEQ ID NO: 6261223 - DNA, 18 bp, Homo sapiens
gcacaccctctctgtcca

SEQ ID NO: 6261224 - DNA, 16 bp, Homo sapiens
gcacaccgccatcctc

SEQ ID NO: 6261225 - DNA, 14 bp, Homo sapiens
gcacacctcagccc

SEQ ID NO: 6261226 - DNA, 15 bp, Homo sapiens
gcacacctcctccca

SEQ ID NO: 6261227 - DNA, 22 bp, Homo sapiens
gcacacctcctcccactgccca

SEQ ID NO: 6261228 - DNA, 21 bp, Homo sapiens
gcacacctgaatcagctggac

SEQ ID NO: 6261229 - DNA, 15 bp, Homo sapiens
gcacacctgtgtcca

SEQ ID NO: 6261230 - DNA, 17 bp, Homo sapiens
gcacaccttttccccag

SEQ ID NO: 6261231 - DNA, 18 bp, Homo sapiens
gcacaccttttccccagg

SEQ ID NO: 6261232 - DNA, 23 bp, Homo sapiens
gcacacgaaccctgccaggcccc

SEQ ID NO: 6261233 - DNA, 17 bp, Homo sapiens
gcacacgagttccagac

SEQ ID NO: 6261234 - DNA, 19 bp, Homo sapiens
gcacacgcacgcacacaca

SEQ ID NO: 6261235 - DNA, 19 bp, Homo sapiens
gcacacgcctcccactggg

SEQ ID NO: 6261236 - DNA, 14 bp, Homo sapiens
gcacacgcctgtaa

SEQ ID NO: 6261237 - DNA, 14 bp, Homo sapiens
gcacacgctgctct

SEQ ID NO: 6261238 - DNA, 17 bp, Homo sapiens
gcacacgctgctctgcc

SEQ ID NO: 6261239 - DNA, 13 bp, Homo sapiens
gcacacggatgca

SEQ ID NO: 6261240 - DNA, 14 bp, Homo sapiens
gcacacggccctgc

SEQ ID NO: 6261241 - DNA, 19 bp, Homo sapiens
gcacacggccctgccccat

SEQ ID NO: 6261242 - DNA, 20 bp, Homo sapiens
gcacacggccctgccccatc

SEQ ID NO: 6261243 - DNA, 16 bp, Homo sapiens
gcacacgggcctctgc

SEQ ID NO: 6261244 - DNA, 20 bp, Homo sapiens
gcacacgggcctctgcttgc

SEQ ID NO: 6261245 - DNA, 22 bp, Homo sapiens
gcacacgggcctctgcttgcca

SEQ ID NO: 6261246 - DNA, 14 bp, Homo sapiens
gcacacgggcgagc

SEQ ID NO: 6261247 - DNA, 21 bp, Homo sapiens
gcacacgggcgagctttctct

SEQ ID NO: 6261248 - DNA, 23 bp, Homo sapiens
gcacacggggtgcgtctccccgg

SEQ ID NO: 6261249 - DNA, 22 bp, Homo sapiens
gcacactacagagcagctcccc

SEQ ID NO: 6261250 - DNA, 17 bp, Homo sapiens
gcacactatttccctct

SEQ ID NO: 6261251 - DNA, 21 bp, Homo sapiens
gcacactcagcacccccttct

SEQ ID NO: 6261252 - DNA, 19 bp, Homo sapiens
gcacactcagttctgctct

SEQ ID NO: 6261253 - DNA, 20 bp, Homo sapiens
gcacactcatcccctcactt

SEQ ID NO: 6261254 - DNA, 18 bp, Homo sapiens
gcacactccatctcctgc

SEQ ID NO: 6261255 - DNA, 15 bp, Homo sapiens
gcacactcccctgca

SEQ ID NO: 6261256 - DNA, 22 bp, Homo sapiens
gcacactctcccattatattta

SEQ ID NO: 6261257 - DNA, 17 bp, Homo sapiens
gcacactctctaaggcc

SEQ ID NO: 6261258 - DNA, 17 bp, Homo sapiens
gcacactctcttctcca

SEQ ID NO: 6261259 - DNA, 19 bp, Homo sapiens
gcacactctgccagcaaag

SEQ ID NO: 6261260 - DNA, 17 bp, Homo sapiens
gcacactgacataatgt

SEQ ID NO: 6261261 - DNA, 17 bp, Homo sapiens
gcacactgagaatgcta

SEQ ID NO: 6261262 - DNA, 13 bp, Homo sapiens
gcacactgaggcc

SEQ ID NO: 6261263 - DNA, 22 bp, Homo sapiens
gcacactgcagggctgctgtgg

SEQ ID NO: 6261264 - DNA, 12 bp, Homo sapiens
gcacactgccaa

SEQ ID NO: 6261265 - DNA, 18 bp, Homo sapiens
gcacactgccctctgcca

SEQ ID NO: 6261266 - DNA, 21 bp, Homo sapiens
gcacactgctcttaagaaact

SEQ ID NO: 6261267 - DNA, 13 bp, Homo sapiens
gcacactggaata

SEQ ID NO: 6261268 - DNA, 13 bp, Homo sapiens
gcacactggggcc

SEQ ID NO: 6261269 - DNA, 17 bp, Homo sapiens
gcacactggggccccgg

SEQ ID NO: 6261270 - DNA, 22 bp, Homo sapiens
gcacactgtgattttgccctcc

SEQ ID NO: 6261271 - DNA, 19 bp, Homo sapiens
gcacacttatttatgaatt

SEQ ID NO: 6261272 - DNA, 11 bp, Homo sapiens
gcacacttccc

SEQ ID NO: 6261273 - DNA, 14 bp, Homo sapiens
gcacacttccccat

SEQ ID NO: 6261274 - DNA, 14 bp, Homo sapiens
gcacactttctggc

SEQ ID NO: 6261275 - DNA, 15 bp, Homo sapiens
gcacactttctggca

SEQ ID NO: 6261276 - DNA, 13 bp, Homo sapiens
gcacactttgcca

SEQ ID NO: 6261277 - DNA, 16 bp, Homo sapiens
gcacactttggcccag

SEQ ID NO: 6261278 - DNA, 16 bp, Homo sapiens
gcacacttttccacat

SEQ ID NO: 6261279 - DNA, 15 bp, Homo sapiens
gcacagaaaactaga

SEQ ID NO: 6261280 - DNA, 22 bp, Homo sapiens
gcacagaaaatggaagacagct

SEQ ID NO: 6261281 - DNA, 15 bp, Homo sapiens
gcacagaacaagcca

SEQ ID NO: 6261282 - DNA, 11 bp, Homo sapiens
gcacagaacag

SEQ ID NO: 6261283 - DNA, 12 bp, Homo sapiens
gcacagaacagg

SEQ ID NO: 6261284 - DNA, 19 bp, Homo sapiens
gcacagaacaggaggtgtg

SEQ ID NO: 6261285 - DNA, 22 bp, Homo sapiens
gcacagaaggaaggagccagct

SEQ ID NO: 6261286 - DNA, 21 bp, Homo sapiens
gcacagaaggaatctgtgcag

SEQ ID NO: 6261287 - DNA, 17 bp, Homo sapiens
gcacagaagtcctgtat

SEQ ID NO: 6261288 - DNA, 18 bp, Homo sapiens
gcacagaagtcctgtatg

SEQ ID NO: 6261289 - DNA, 19 bp, Homo sapiens
gcacagaagtcctgtatgt

SEQ ID NO: 6261290 - DNA, 18 bp, Homo sapiens
gcacagacaagcagccct

SEQ ID NO: 6261291 - DNA, 17 bp, Homo sapiens
gcacagacacgctcgcg

SEQ ID NO: 6261292 - DNA, 22 bp, Homo sapiens
gcacagacaggttttcacataa

SEQ ID NO: 6261293 - DNA, 14 bp, Homo sapiens
gcacagaccctgcc

SEQ ID NO: 6261294 - DNA, 18 bp, Homo sapiens
gcacagaccctgccctgt

SEQ ID NO: 6261295 - DNA, 19 bp, Homo sapiens
gcacagaccctgccctgtg

SEQ ID NO: 6261296 - DNA, 22 bp, Homo sapiens
gcacagaccctgccctgtgggc

SEQ ID NO: 6261297 - DNA, 14 bp, Homo sapiens
gcacagacctctcc

SEQ ID NO: 6261298 - DNA, 18 bp, Homo sapiens
gcacagacggaggaagcc

SEQ ID NO: 6261299 - DNA, 15 bp, Homo sapiens
gcacagactggtcca

SEQ ID NO: 6261300 - DNA, 18 bp, Homo sapiens
gcacagactgttccctcc

SEQ ID NO: 6261301 - DNA, 22 bp, Homo sapiens
gcacagactgttccctccaagg

SEQ ID NO: 6261302 - DNA, 18 bp, Homo sapiens
gcacagacttcacacagc

SEQ ID NO: 6261303 - DNA, 15 bp, Homo sapiens
gcacagacttctgga

SEQ ID NO: 6261304 - DNA, 18 bp, Homo sapiens
gcacagacttctggaagg

SEQ ID NO: 6261305 - DNA, 21 bp, Homo sapiens
gcacagacttctggaaggctg

SEQ ID NO: 6261306 - DNA, 12 bp, Homo sapiens
gcacagagaagc

SEQ ID NO: 6261307 - DNA, 14 bp, Homo sapiens
gcacagagaagctg

SEQ ID NO: 6261308 - DNA, 12 bp, Homo sapiens
gcacagagaggg

SEQ ID NO: 6261309 - DNA, 17 bp, Homo sapiens
gcacagagagggggcca

SEQ ID NO: 6261310 - DNA, 19 bp, Homo sapiens
gcacagagagggggccacc

SEQ ID NO: 6261311 - DNA, 18 bp, Homo sapiens
gcacagagatatgcacac

SEQ ID NO: 6261312 - DNA, 21 bp, Homo sapiens
gcacagagcatccgtctcccc

SEQ ID NO: 6261313 - DNA, 18 bp, Homo sapiens
gcacagagccctgagggg

SEQ ID NO: 6261314 - DNA, 11 bp, Homo sapiens
gcacagagcct

SEQ ID NO: 6261315 - DNA, 16 bp, Homo sapiens
gcacagagcctggccc

SEQ ID NO: 6261316 - DNA, 19 bp, Homo sapiens
gcacagagcgtccttcccc

SEQ ID NO: 6261317 - DNA, 18 bp, Homo sapiens
gcacagaggaggtcagca

SEQ ID NO: 6261318 - DNA, 18 bp, Homo sapiens
gcacagaggcagctgtgt

SEQ ID NO: 6261319 - DNA, 14 bp, Homo sapiens
gcacagaggcctga

SEQ ID NO: 6261320 - DNA, 20 bp, Homo sapiens
gcacagagggaagccatgtg

SEQ ID NO: 6261321 - DNA, 17 bp, Homo sapiens
gcacagagggctaggga

SEQ ID NO: 6261322 - DNA, 19 bp, Homo sapiens
gcacagagggctagggagg

SEQ ID NO: 6261323 - DNA, 20 bp, Homo sapiens
gcacagagggtcccattgtg

SEQ ID NO: 6261324 - DNA, 16 bp, Homo sapiens
gcacagagttgttaca

SEQ ID NO: 6261325 - DNA, 21 bp, Homo sapiens
gcacagagttgttacattttt

SEQ ID NO: 6261326 - DNA, 19 bp, Homo sapiens
gcacagataaaaagtggaa

SEQ ID NO: 6261327 - DNA, 17 bp, Homo sapiens
gcacagatatactttgt

SEQ ID NO: 6261328 - DNA, 16 bp, Homo sapiens
gcacagatgaggagca

SEQ ID NO: 6261329 - DNA, 22 bp, Homo sapiens
gcacagatgaggagcagctggg

SEQ ID NO: 6261330 - DNA, 14 bp, Homo sapiens
gcacagatgcccac

SEQ ID NO: 6261331 - DNA, 19 bp, Homo sapiens
gcacagatggatttgcctg

SEQ ID NO: 6261332 - DNA, 19 bp, Homo sapiens
gcacagatggccagcccct

SEQ ID NO: 6261333 - DNA, 23 bp, Homo sapiens
gcacagatggccagccccttaga

SEQ ID NO: 6261334 - DNA, 18 bp, Homo sapiens
gcacagattaaacttcac

SEQ ID NO: 6261335 - DNA, 20 bp, Homo sapiens
gcacagattaaacttcacct

SEQ ID NO: 6261336 - DNA, 20 bp, Homo sapiens
gcacagattcccaggccagg

SEQ ID NO: 6261337 - DNA, 23 bp, Homo sapiens
gcacagattcccaggccagggct

SEQ ID NO: 6261338 - DNA, 23 bp, Homo sapiens
gcacagattgaagaatctgcccc

SEQ ID NO: 6261339 - DNA, 16 bp, Homo sapiens
gcacagatttcaacag

SEQ ID NO: 6261340 - DNA, 19 bp, Homo sapiens
gcacagcaaggaggctggc

SEQ ID NO: 6261341 - DNA, 23 bp, Homo sapiens
gcacagcaaggaggctggctggg

SEQ ID NO: 6261342 - DNA, 14 bp, Homo sapiens
gcacagcactgcct

SEQ ID NO: 6261343 - DNA, 15 bp, Homo sapiens
gcacagcactgcctg

SEQ ID NO: 6261344 - DNA, 18 bp, Homo sapiens
gcacagcactgcctgcca

SEQ ID NO: 6261345 - DNA, 17 bp, Homo sapiens
gcacagcagcctgcttc

SEQ ID NO: 6261346 - DNA, 22 bp, Homo sapiens
gcacagcagcctggggctggcc

SEQ ID NO: 6261347 - DNA, 20 bp, Homo sapiens
gcacagcagctgcaggggcc

SEQ ID NO: 6261348 - DNA, 22 bp, Homo sapiens
gcacagcaggacctgtgctttg

SEQ ID NO: 6261349 - DNA, 17 bp, Homo sapiens
gcacagcaggctgccag

SEQ ID NO: 6261350 - DNA, 18 bp, Homo sapiens
gcacagcaggctgccagt

SEQ ID NO: 6261351 - DNA, 22 bp, Homo sapiens
gcacagcaggctgccagtgcct

SEQ ID NO: 6261352 - DNA, 23 bp, Homo sapiens
gcacagcaggggagccctgattt

SEQ ID NO: 6261353 - DNA, 21 bp, Homo sapiens
gcacagcaggtttatccagat

SEQ ID NO: 6261354 - DNA, 16 bp, Homo sapiens
gcacagcagttccgga

SEQ ID NO: 6261355 - DNA, 18 bp, Homo sapiens
gcacagcatctcagctca

SEQ ID NO: 6261356 - DNA, 20 bp, Homo sapiens
gcacagccaacgagacacat

SEQ ID NO: 6261357 - DNA, 15 bp, Homo sapiens
gcacagccacctccg

SEQ ID NO: 6261358 - DNA, 19 bp, Homo sapiens
gcacagccacctccgccag

SEQ ID NO: 6261359 - DNA, 14 bp, Homo sapiens
gcacagccagaaac

SEQ ID NO: 6261360 - DNA, 21 bp, Homo sapiens
gcacagccatacggcactgaa

SEQ ID NO: 6261361 - DNA, 12 bp, Homo sapiens
gcacagccatag

SEQ ID NO: 6261362 - DNA, 23 bp, Homo sapiens
gctactcaggaggctgaggcagg

SEQ ID NO: 6261363 - DNA, 19 bp, Homo sapiens
gctactcagtggggctggc

SEQ ID NO: 6261364 - DNA, 13 bp, Homo sapiens
gctactcatggca

SEQ ID NO: 6261365 - DNA, 14 bp, Homo sapiens
gctactcccacagc

SEQ ID NO: 6261366 - DNA, 15 bp, Homo sapiens
gctactccctggacc

SEQ ID NO: 6261367 - DNA, 19 bp, Homo sapiens
gctactccctggaccacga

SEQ ID NO: 6261368 - DNA, 22 bp, Homo sapiens
gctactccctggaccacgaggc

SEQ ID NO: 6261369 - DNA, 14 bp, Homo sapiens
gctactccggaggc

SEQ ID NO: 6261370 - DNA, 16 bp, Homo sapiens
gctactcctgtgctct

SEQ ID NO: 6261371 - DNA, 17 bp, Homo sapiens
gctactcgggaggctga

SEQ ID NO: 6261372 - DNA, 19 bp, Homo sapiens
gctactctagtattccaga

SEQ ID NO: 6261373 - DNA, 21 bp, Homo sapiens
gctactctagtattccagacc

SEQ ID NO: 6261374 - DNA, 23 bp, Homo sapiens
gctactctccccacgagggctgg

SEQ ID NO: 6261375 - DNA, 12 bp, Homo sapiens
gctactctgtcc

SEQ ID NO: 6261376 - DNA, 15 bp, Homo sapiens
gctactctgtccagg

SEQ ID NO: 6261377 - DNA, 19 bp, Homo sapiens
gctactctgtccaggccac

SEQ ID NO: 6261378 - DNA, 13 bp, Homo sapiens
gctactctgtgcc

SEQ ID NO: 6261379 - DNA, 16 bp, Homo sapiens
gctactctgtgccaga

SEQ ID NO: 6261380 - DNA, 12 bp, Homo sapiens
gctactgaaact

SEQ ID NO: 6261381 - DNA, 13 bp, Homo sapiens
gctactgaaactt

SEQ ID NO: 6261382 - DNA, 12 bp, Homo sapiens
gctactgaattt

SEQ ID NO: 6261383 - DNA, 20 bp, Homo sapiens
gctactgaatttattgccgc

SEQ ID NO: 6261384 - DNA, 16 bp, Homo sapiens
gctactgacccagagg

SEQ ID NO: 6261385 - DNA, 17 bp, Homo sapiens
gctactgatttttgtga

SEQ ID NO: 6261386 - DNA, 18 bp, Homo sapiens
gctactgcactccagcct

SEQ ID NO: 6261387 - DNA, 18 bp, Homo sapiens
gctactgcagctttacat

SEQ ID NO: 6261388 - DNA, 15 bp, Homo sapiens
gctactgccactgtg

SEQ ID NO: 6261389 - DNA, 17 bp, Homo sapiens
gctactgccactgtgtg

SEQ ID NO: 6261390 - DNA, 19 bp, Homo sapiens
gctactgccactgtgtgcc

SEQ ID NO: 6261391 - DNA, 11 bp, Homo sapiens
gctactgccat

SEQ ID NO: 6261392 - DNA, 14 bp, Homo sapiens
gctactgcccctct

SEQ ID NO: 6261393 - DNA, 16 bp, Homo sapiens
gctactgcccctctcc

SEQ ID NO: 6261394 - DNA, 18 bp, Homo sapiens
gctactgcccctctccga

SEQ ID NO: 6261395 - DNA, 23 bp, Homo sapiens
gctactgcccctctccgaaagaa

SEQ ID NO: 6261396 - DNA, 18 bp, Homo sapiens
gctactgccgtcagtgct

SEQ ID NO: 6261397 - DNA, 14 bp, Homo sapiens
gctactggaaatat

SEQ ID NO: 6261398 - DNA, 20 bp, Homo sapiens
gctactggaatggtgttttg

SEQ ID NO: 6261399 - DNA, 22 bp, Homo sapiens
gctactggacttgaatggttaa

SEQ ID NO: 6261400 - DNA, 12 bp, Homo sapiens
gctactggcagc

SEQ ID NO: 6261401 - DNA, 14 bp, Homo sapiens
gctactggcagctc

SEQ ID NO: 6261402 - DNA, 15 bp, Homo sapiens
gctactggcagctcc

SEQ ID NO: 6261403 - DNA, 20 bp, Homo sapiens
gctactggcagctcctctcc

SEQ ID NO: 6261404 - DNA, 17 bp, Homo sapiens
gctactggggaaactgg

SEQ ID NO: 6261405 - DNA, 20 bp, Homo sapiens
gctactggggaaactggcca

SEQ ID NO: 6261406 - DNA, 16 bp, Homo sapiens
gctactgtaacttttt

SEQ ID NO: 6261407 - DNA, 22 bp, Homo sapiens
gctactgtaatgctgcctcagg

SEQ ID NO: 6261408 - DNA, 18 bp, Homo sapiens
gctactgtaattttatat

SEQ ID NO: 6261409 - DNA, 22 bp, Homo sapiens
gctactgtaattttatatgaag

SEQ ID NO: 6261410 - DNA, 15 bp, Homo sapiens
gctactgtagaaagg

SEQ ID NO: 6261411 - DNA, 18 bp, Homo sapiens
gctactgtagaaaggaaa

SEQ ID NO: 6261412 - DNA, 12 bp, Homo sapiens
gctactgtctca

SEQ ID NO: 6261413 - DNA, 19 bp, Homo sapiens
gctactgtgtgtgtgaatg

SEQ ID NO: 6261414 - DNA, 21 bp, Homo sapiens
gctactgtgttacatgttgta

SEQ ID NO: 6261415 - DNA, 21 bp, Homo sapiens
gctacttaaatttgaatctga

SEQ ID NO: 6261416 - DNA, 13 bp, Homo sapiens
gctacttaagaga

SEQ ID NO: 6261417 - DNA, 13 bp, Homo sapiens
gctacttagctgg

SEQ ID NO: 6261418 - DNA, 16 bp, Homo sapiens
gctacttagctggcca

SEQ ID NO: 6261419 - DNA, 14 bp, Homo sapiens
gctacttatcattt

SEQ ID NO: 6261420 - DNA, 18 bp, Homo sapiens
gctacttatcatttttgt

SEQ ID NO: 6261421 - DNA, 20 bp, Homo sapiens
gctacttccctcacccactt

SEQ ID NO: 6261422 - DNA, 12 bp, Homo sapiens
gctacttccctt

SEQ ID NO: 6261423 - DNA, 15 bp, Homo sapiens
gctacttcccttcct

SEQ ID NO: 6261424 - DNA, 20 bp, Homo sapiens
gctacttcctgcctggtctc

SEQ ID NO: 6261425 - DNA, 15 bp, Homo sapiens
gctacttctgggaaa

SEQ ID NO: 6261426 - DNA, 14 bp, Homo sapiens
gctacttgctctgc

SEQ ID NO: 6261427 - DNA, 17 bp, Homo sapiens
gctacttgctctgctct

SEQ ID NO: 6261428 - DNA, 23 bp, Homo sapiens
gctacttgcttgaagttttcagt

SEQ ID NO: 6261429 - DNA, 15 bp, Homo sapiens
gctacttgggagcct

SEQ ID NO: 6261430 - DNA, 16 bp, Homo sapiens
gctacttgggagcctg

SEQ ID NO: 6261431 - DNA, 17 bp, Homo sapiens
gctacttgggagcctga

SEQ ID NO: 6261432 - DNA, 19 bp, Homo sapiens
gctacttgggagcctgagg

SEQ ID NO: 6261433 - DNA, 13 bp, Homo sapiens
gctacttgggagg

SEQ ID NO: 6261434 - DNA, 15 bp, Homo sapiens
gctacttggtttgtg

SEQ ID NO: 6261435 - DNA, 20 bp, Homo sapiens
gctactttatgtaaatcact

SEQ ID NO: 6261436 - DNA, 21 bp, Homo sapiens
gctactttatttatacactgt

SEQ ID NO: 6261437 - DNA, 12 bp, Homo sapiens
gctactttccat

SEQ ID NO: 6261438 - DNA, 12 bp, Homo sapiens
gctactttgttt

SEQ ID NO: 6261439 - DNA, 17 bp, Homo sapiens
gctacttttgaaaatca

SEQ ID NO: 6261440 - DNA, 15 bp, Homo sapiens
gctagaaaaaacata

SEQ ID NO: 6261441 - DNA, 13 bp, Homo sapiens
gctagaaaaataa

SEQ ID NO: 6261442 - DNA, 19 bp, Homo sapiens
gctagaaaaattgttaagg

SEQ ID NO: 6261443 - DNA, 14 bp, Homo sapiens
gctagaaagtggca

SEQ ID NO: 6261444 - DNA, 11 bp, Homo sapiens
gctagaaatgg

SEQ ID NO: 6261445 - DNA, 19 bp, Homo sapiens
gctagaacctagaagggct

SEQ ID NO: 6261446 - DNA, 13 bp, Homo sapiens
gctagaactccct

SEQ ID NO: 6261447 - DNA, 14 bp, Homo sapiens
gctagaactccctt

SEQ ID NO: 6261448 - DNA, 13 bp, Homo sapiens
gctagaacttttt

SEQ ID NO: 6261449 - DNA, 23 bp, Homo sapiens
gctagaagaatttgagaagaaat

SEQ ID NO: 6261450 - DNA, 17 bp, Homo sapiens
gctagaagcctactggt

SEQ ID NO: 6261451 - DNA, 14 bp, Homo sapiens
gctagaagctggag

SEQ ID NO: 6261452 - DNA, 13 bp, Homo sapiens
gctagaatacttt

SEQ ID NO: 6261453 - DNA, 20 bp, Homo sapiens
gctagaatatcctatactgg

SEQ ID NO: 6261454 - DNA, 21 bp, Homo sapiens
gctagaatcagggtggagaag

SEQ ID NO: 6261455 - DNA, 23 bp, Homo sapiens
gctagaatggaaaactgcctgtt

SEQ ID NO: 6261456 - DNA, 15 bp, Homo sapiens
gctagaatggtggga

SEQ ID NO: 6261457 - DNA, 17 bp, Homo sapiens
gctagacaaaggcccag

SEQ ID NO: 6261458 - DNA, 20 bp, Homo sapiens
gctagacaaggttgctgttg

SEQ ID NO: 6261459 - DNA, 15 bp, Homo sapiens
gctagacacccattt

SEQ ID NO: 6261460 - DNA, 11 bp, Homo sapiens
gctagacagaa

SEQ ID NO: 6261461 - DNA, 19 bp, Homo sapiens
gctagacagaaacatgtct

SEQ ID NO: 6261462 - DNA, 20 bp, Homo sapiens
gctagacagaaaccaagcca

SEQ ID NO: 6261463 - DNA, 15 bp, Homo sapiens
gctagacaggaaccc

SEQ ID NO: 6261464 - DNA, 21 bp, Homo sapiens
gctagacgagcaggcttcttc

SEQ ID NO: 6261465 - DNA, 15 bp, Homo sapiens
gctagactgggctgg

SEQ ID NO: 6261466 - DNA, 13 bp, Homo sapiens
gctagactggtga

SEQ ID NO: 6261467 - DNA, 18 bp, Homo sapiens
gctagactgtaagccctt

SEQ ID NO: 6261468 - DNA, 15 bp, Homo sapiens
gctagactgtgtctg

SEQ ID NO: 6261469 - DNA, 21 bp, Homo sapiens
gctagagaaatcagctgctat

SEQ ID NO: 6261470 - DNA, 13 bp, Homo sapiens
gctagagaagggg

SEQ ID NO: 6261471 - DNA, 18 bp, Homo sapiens
gctagagacgctgatcca

SEQ ID NO: 6261472 - DNA, 20 bp, Homo sapiens
gctagagaggggcctctggc

SEQ ID NO: 6261473 - DNA, 21 bp, Homo sapiens
gctagagaggggcctctggct

SEQ ID NO: 6261474 - DNA, 20 bp, Homo sapiens
gctagagcaacccctgtacc

SEQ ID NO: 6261475 - DNA, 21 bp, Homo sapiens
gctagagcaacccctgtaccc

SEQ ID NO: 6261476 - DNA, 15 bp, Homo sapiens
gctagagcattctgg

SEQ ID NO: 6261477 - DNA, 17 bp, Homo sapiens
gctagagcattctgggg

SEQ ID NO: 6261478 - DNA, 14 bp, Homo sapiens
gctagagcctctgc

SEQ ID NO: 6261479 - DNA, 12 bp, Homo sapiens
gctagagctaac

SEQ ID NO: 6261480 - DNA, 13 bp, Homo sapiens
gctagagctcctc

SEQ ID NO: 6261481 - DNA, 15 bp, Homo sapiens
gctagagctcctccc

SEQ ID NO: 6261482 - DNA, 17 bp, Homo sapiens
gctagagctcctccctc

SEQ ID NO: 6261483 - DNA, 19 bp, Homo sapiens
gctagagctcctccctctc

SEQ ID NO: 6261484 - DNA, 24 bp, Homo sapiens
gctagaggaataaagctgtgagca

SEQ ID NO: 6261485 - DNA, 16 bp, Homo sapiens
gctagaggcctgagga

SEQ ID NO: 6261486 - DNA, 14 bp, Homo sapiens
gctagagggcccaa

SEQ ID NO: 6261487 - DNA, 20 bp, Homo sapiens
gctagagtcctcactcccag

SEQ ID NO: 6261488 - DNA, 20 bp, Homo sapiens
gctagagtgcagtggtgcga

SEQ ID NO: 6261489 - DNA, 14 bp, Homo sapiens
gctagagtttttgt

SEQ ID NO: 6261490 - DNA, 13 bp, Homo sapiens
gctagataaaagc

SEQ ID NO: 6261491 - DNA, 14 bp, Homo sapiens
gctagatatgcctt

SEQ ID NO: 6261492 - DNA, 12 bp, Homo sapiens
gctagatccagc

SEQ ID NO: 6261493 - DNA, 20 bp, Homo sapiens
gctagatccagcccaaacct

SEQ ID NO: 6261494 - DNA, 19 bp, Homo sapiens
gctagatgggcatggggtg

SEQ ID NO: 6261495 - DNA, 20 bp, Homo sapiens
gctagattacagagggctca

SEQ ID NO: 6261496 - DNA, 13 bp, Homo sapiens
gctagattctaac

SEQ ID NO: 6261497 - DNA, 16 bp, Homo sapiens
gctagcaaatagtaat

SEQ ID NO: 6261498 - DNA, 12 bp, Homo sapiens
gctagcacagag

SEQ ID NO: 6261499 - DNA, 13 bp, Homo sapiens
gctagcacagagg

SEQ ID NO: 6261500 - DNA, 17 bp, Homo sapiens
gctagcacagaggcctg

SEQ ID NO: 6261501 - DNA, 13 bp, Homo sapiens
gctagcacctccc

SEQ ID NO: 6261502 - DNA, 16 bp, Homo sapiens
gctagcacctccccag

SEQ ID NO: 6261503 - DNA, 17 bp, Homo sapiens
gctagcacttggagcca

SEQ ID NO: 6261504 - DNA, 14 bp, Homo sapiens
gctagcagcccttg

SEQ ID NO: 6261505 - DNA, 20 bp, Homo sapiens
gctagcaggccccctaggat

SEQ ID NO: 6261506 - DNA, 17 bp, Homo sapiens
gctagcattcctcagga

SEQ ID NO: 6261507 - DNA, 17 bp, Homo sapiens
gctagccacctcctcgt

SEQ ID NO: 6261508 - DNA, 15 bp, Homo sapiens
gctagccactggaaa

SEQ ID NO: 6261509 - DNA, 22 bp, Homo sapiens
gctagcccagtccctggagctg

SEQ ID NO: 6261510 - DNA, 14 bp, Homo sapiens
gctagccccagaga

SEQ ID NO: 6261511 - DNA, 17 bp, Homo sapiens
gctagccccagggtgag

SEQ ID NO: 6261512 - DNA, 13 bp, Homo sapiens
gctagccctgagc

SEQ ID NO: 6261513 - DNA, 18 bp, Homo sapiens
gctagccctgagcccggc

SEQ ID NO: 6261514 - DNA, 19 bp, Homo sapiens
gctagccctgagcccggcc

SEQ ID NO: 6261515 - DNA, 17 bp, Homo sapiens
gctagcctccagctttg

SEQ ID NO: 6261516 - DNA, 18 bp, Homo sapiens
gctagcctgaaggattct

SEQ ID NO: 6261517 - DNA, 23 bp, Homo sapiens
gctagcctgttcttttaccactg

SEQ ID NO: 6261518 - DNA, 13 bp, Homo sapiens
gctagcctttctt

SEQ ID NO: 6261519 - DNA, 16 bp, Homo sapiens
gctagcgatttcagac

SEQ ID NO: 6261520 - DNA, 17 bp, Homo sapiens
gctagcgatttcagacc

SEQ ID NO: 6261521 - DNA, 14 bp, Homo sapiens
gctagcgctgccgc

SEQ ID NO: 6261522 - DNA, 14 bp, Homo sapiens
gctagctagccagc

SEQ ID NO: 6261523 - DNA, 16 bp, Homo sapiens
gctagctatatattta

SEQ ID NO: 6261524 - DNA, 12 bp, Homo sapiens
gctagctcaact

SEQ ID NO: 6261525 - DNA, 21 bp, Homo sapiens
gctagctcccctcctctcccc

SEQ ID NO: 6261526 - DNA, 16 bp, Homo sapiens
gctagctgcagagcca

SEQ ID NO: 6261527 - DNA, 14 bp, Homo sapiens
gctagctgccactt

SEQ ID NO: 6261528 - DNA, 15 bp, Homo sapiens
gctagctgccacttt

SEQ ID NO: 6261529 - DNA, 12 bp, Homo sapiens
gctagctgcttt

SEQ ID NO: 6261530 - DNA, 18 bp, Homo sapiens
gctagctgtagaaatgta

SEQ ID NO: 6261531 - DNA, 23 bp, Homo sapiens
gctagcttctgcttttctgccct

SEQ ID NO: 6261532 - DNA, 21 bp, Homo sapiens
gctagcttgacacagtcagca

SEQ ID NO: 6261533 - DNA, 15 bp, Homo sapiens
gctaggaaagaggag

SEQ ID NO: 6261534 - DNA, 20 bp, Homo sapiens
gctaggaaagggaagcctga

SEQ ID NO: 6261535 - DNA, 14 bp, Homo sapiens
gctaggaacaaatc

SEQ ID NO: 6261536 - DNA, 16 bp, Homo sapiens
gctaggaacactcctt

SEQ ID NO: 6261537 - DNA, 14 bp, Homo sapiens
gctaggaagcaaga

SEQ ID NO: 6261538 - DNA, 13 bp, Homo sapiens
gctaggaatgaaa

SEQ ID NO: 6261539 - DNA, 18 bp, Homo sapiens
gctaggaatgaaatcctg

SEQ ID NO: 6261540 - DNA, 22 bp, Homo sapiens
gctaggacccctccatgtgggc

SEQ ID NO: 6261541 - DNA, 18 bp, Homo sapiens
gctaggactgtggagggg

SEQ ID NO: 6261542 - DNA, 18 bp, Homo sapiens
gctaggacttaaccttga

SEQ ID NO: 6261543 - DNA, 19 bp, Homo sapiens
gctaggagagactgaaagc

SEQ ID NO: 6261544 - DNA, 18 bp, Homo sapiens
gcacagcccaaccaggag

SEQ ID NO: 6261545 - DNA, 22 bp, Homo sapiens
gcacagcccaaccaggaggggt

SEQ ID NO: 6261546 - DNA, 11 bp, Homo sapiens
gcacagcccag

SEQ ID NO: 6261547 - DNA, 16 bp, Homo sapiens
gcacagcccctggagc

SEQ ID NO: 6261548 - DNA, 23 bp, Homo sapiens
gcacagcccctggagcctcagaa

SEQ ID NO: 6261549 - DNA, 17 bp, Homo sapiens
gcacagccctcccgccc

SEQ ID NO: 6261550 - DNA, 23 bp, Homo sapiens
gcacagccctccgaccctcatgg

SEQ ID NO: 6261551 - DNA, 13 bp, Homo sapiens
gcacagccctgag

SEQ ID NO: 6261552 - DNA, 20 bp, Homo sapiens
gcacagccctgagtgtccca

SEQ ID NO: 6261553 - DNA, 13 bp, Homo sapiens
gcacagccctggg

SEQ ID NO: 6261554 - DNA, 23 bp, Homo sapiens
gcacagccggggcctgcctagca

SEQ ID NO: 6261555 - DNA, 11 bp, Homo sapiens
gcacagcctag

SEQ ID NO: 6261556 - DNA, 15 bp, Homo sapiens
gcacagcctcgggga

SEQ ID NO: 6261557 - DNA, 12 bp, Homo sapiens
gcacagcctcta

SEQ ID NO: 6261558 - DNA, 12 bp, Homo sapiens
gcacagcctggc

SEQ ID NO: 6261559 - DNA, 22 bp, Homo sapiens
gcacagcgcgggcggaggcggc

SEQ ID NO: 6261560 - DNA, 23 bp, Homo sapiens
gcacagcgcgggcggaggcggct

SEQ ID NO: 6261561 - DNA, 13 bp, Homo sapiens
gcacagctaacca

SEQ ID NO: 6261562 - DNA, 15 bp, Homo sapiens
gcacagctaattcta

SEQ ID NO: 6261563 - DNA, 16 bp, Homo sapiens
gcacagctatgaaggc

SEQ ID NO: 6261564 - DNA, 12 bp, Homo sapiens
gcacagctcagg

SEQ ID NO: 6261565 - DNA, 20 bp, Homo sapiens
gcacagctcaggaggcgccc

SEQ ID NO: 6261566 - DNA, 17 bp, Homo sapiens
gcacagctccctgccaa

SEQ ID NO: 6261567 - DNA, 23 bp, Homo sapiens
gcacagctccctgccaaactgaa

SEQ ID NO: 6261568 - DNA, 20 bp, Homo sapiens
gcacagctcccttctgttga

SEQ ID NO: 6261569 - DNA, 11 bp, Homo sapiens
gcacagctcct

SEQ ID NO: 6261570 - DNA, 16 bp, Homo sapiens
gcacagctcctcccct

SEQ ID NO: 6261571 - DNA, 15 bp, Homo sapiens
gcacagctcctgcca

SEQ ID NO: 6261572 - DNA, 15 bp, Homo sapiens
gcacagctgccctgc

SEQ ID NO: 6261573 - DNA, 17 bp, Homo sapiens
gcacagctgccctgctg

SEQ ID NO: 6261574 - DNA, 14 bp, Homo sapiens
gcacagctgctctg

SEQ ID NO: 6261575 - DNA, 21 bp, Homo sapiens
gcacagctgctgtgccaggac

SEQ ID NO: 6261576 - DNA, 12 bp, Homo sapiens
gcacagctgctt

SEQ ID NO: 6261577 - DNA, 23 bp, Homo sapiens
gcacagctgcttgtcctgctctc

SEQ ID NO: 6261578 - DNA, 23 bp, Homo sapiens
gcacagctgtagtggggttctag

SEQ ID NO: 6261579 - DNA, 13 bp, Homo sapiens
gcacagctgtctg

SEQ ID NO: 6261580 - DNA, 17 bp, Homo sapiens
gcacagctgtctgccag

SEQ ID NO: 6261581 - DNA, 23 bp, Homo sapiens
gcacagctgtctgccaggcactc

SEQ ID NO: 6261582 - DNA, 12 bp, Homo sapiens
gcacagctgtgg

SEQ ID NO: 6261583 - DNA, 13 bp, Homo sapiens
gcacagctgtttg

SEQ ID NO: 6261584 - DNA, 16 bp, Homo sapiens
gcacagctgtttgaaa

SEQ ID NO: 6261585 - DNA, 17 bp, Homo sapiens
gcacagctgtttgaaat

SEQ ID NO: 6261586 - DNA, 16 bp, Homo sapiens
gcacagcttagatttc

SEQ ID NO: 6261587 - DNA, 17 bp, Homo sapiens
gcacagcttagatttca

SEQ ID NO: 6261588 - DNA, 21 bp, Homo sapiens
gcacagcttcatttcctgtgt

SEQ ID NO: 6261589 - DNA, 18 bp, Homo sapiens
gcacagcttgacctgagg

SEQ ID NO: 6261590 - DNA, 20 bp, Homo sapiens
gcacagcttgacctgaggct

SEQ ID NO: 6261591 - DNA, 16 bp, Homo sapiens
gcacagcttgggtcag

SEQ ID NO: 6261592 - DNA, 17 bp, Homo sapiens
gcacagcttttccaaaa

SEQ ID NO: 6261593 - DNA, 18 bp, Homo sapiens
gcacaggaaaaggtagct

SEQ ID NO: 6261594 - DNA, 14 bp, Homo sapiens
gcacaggacatgcg

SEQ ID NO: 6261595 - DNA, 21 bp, Homo sapiens
gcacaggacatgcggtagcca

SEQ ID NO: 6261596 - DNA, 22 bp, Homo sapiens
gcacaggacatgcggtagccag

SEQ ID NO: 6261597 - DNA, 12 bp, Homo sapiens
gcacaggagcta

SEQ ID NO: 6261598 - DNA, 15 bp, Homo sapiens
gcacaggaggcaggc

SEQ ID NO: 6261599 - DNA, 21 bp, Homo sapiens
gcacaggagggggtcgtggag

SEQ ID NO: 6261600 - DNA, 22 bp, Homo sapiens
gcacaggagggggtcgtggaga

SEQ ID NO: 6261601 - DNA, 16 bp, Homo sapiens
gcacaggatgctggcc

SEQ ID NO: 6261602 - DNA, 15 bp, Homo sapiens
gcacaggcaacatta

SEQ ID NO: 6261603 - DNA, 13 bp, Homo sapiens
gcacaggcaccta

SEQ ID NO: 6261604 - DNA, 11 bp, Homo sapiens
gcacaggcaga

SEQ ID NO: 6261605 - DNA, 11 bp, Homo sapiens
gcacaggcagc

SEQ ID NO: 6261606 - DNA, 14 bp, Homo sapiens
gcacaggcaggaag

SEQ ID NO: 6261607 - DNA, 18 bp, Homo sapiens
gcacaggcaggaagagag

SEQ ID NO: 6261608 - DNA, 20 bp, Homo sapiens
gcacaggcaggaagagagag

SEQ ID NO: 6261609 - DNA, 15 bp, Homo sapiens
gcacaggcatattat

SEQ ID NO: 6261610 - DNA, 15 bp, Homo sapiens
gcacaggccctagct

SEQ ID NO: 6261611 - DNA, 17 bp, Homo sapiens
gcacaggccgaggcagg

SEQ ID NO: 6261612 - DNA, 19 bp, Homo sapiens
gcacaggccgtcaccctgg

SEQ ID NO: 6261613 - DNA, 22 bp, Homo sapiens
gcacaggccgtcaccctgggag

SEQ ID NO: 6261614 - DNA, 12 bp, Homo sapiens
gcacaggcctct

SEQ ID NO: 6261615 - DNA, 14 bp, Homo sapiens
gcacaggcctctgc

SEQ ID NO: 6261616 - DNA, 15 bp, Homo sapiens
gcacaggcctctgcc

SEQ ID NO: 6261617 - DNA, 16 bp, Homo sapiens
gcacaggctaattttt

SEQ ID NO: 6261618 - DNA, 15 bp, Homo sapiens
gcacaggctcctgta

SEQ ID NO: 6261619 - DNA, 22 bp, Homo sapiens
gcacaggctgagtgcaggccca

SEQ ID NO: 6261620 - DNA, 23 bp, Homo sapiens
gcacaggctgagtgcaggcccac

SEQ ID NO: 6261621 - DNA, 13 bp, Homo sapiens
gcacaggctgccc

SEQ ID NO: 6261622 - DNA, 19 bp, Homo sapiens
gcacaggcttgctgtatga

SEQ ID NO: 6261623 - DNA, 17 bp, Homo sapiens
gcacagggagtgcacat

SEQ ID NO: 6261624 - DNA, 22 bp, Homo sapiens
gcacagggagtgcacatatcca

SEQ ID NO: 6261625 - DNA, 14 bp, Homo sapiens
gcacagggcaccag

SEQ ID NO: 6261626 - DNA, 18 bp, Homo sapiens
gcacagggcaccagaggc

SEQ ID NO: 6261627 - DNA, 19 bp, Homo sapiens
gcacagggcaccagaggcc

SEQ ID NO: 6261628 - DNA, 16 bp, Homo sapiens
gcacagggcagctggg

SEQ ID NO: 6261629 - DNA, 17 bp, Homo sapiens
gcacagggcagctgggc

SEQ ID NO: 6261630 - DNA, 18 bp, Homo sapiens
gcacagggcagctgggcc

SEQ ID NO: 6261631 - DNA, 20 bp, Homo sapiens
gcacagggcagctgggccca

SEQ ID NO: 6261632 - DNA, 16 bp, Homo sapiens
gcacagggcatgaaat

SEQ ID NO: 6261633 - DNA, 18 bp, Homo sapiens
gcacagggcatgaaatga

SEQ ID NO: 6261634 - DNA, 22 bp, Homo sapiens
gcacagggcatgaaatgaacac

SEQ ID NO: 6261635 - DNA, 14 bp, Homo sapiens
gcacagggcatgcc

SEQ ID NO: 6261636 - DNA, 18 bp, Homo sapiens
gcacagggcatgcctggc

SEQ ID NO: 6261637 - DNA, 22 bp, Homo sapiens
gcacagggcatgcctggcctga

SEQ ID NO: 6261638 - DNA, 23 bp, Homo sapiens
gcacagggcccgcagtgctggga

SEQ ID NO: 6261639 - DNA, 21 bp, Homo sapiens
gcacagggccctctgaggctc

SEQ ID NO: 6261640 - DNA, 18 bp, Homo sapiens
gcacagggcctggcccat

SEQ ID NO: 6261641 - DNA, 14 bp, Homo sapiens
gcacaggtattttt

SEQ ID NO: 6261642 - DNA, 22 bp, Homo sapiens
gcacaggtcaggggtgacacag

SEQ ID NO: 6261643 - DNA, 18 bp, Homo sapiens
gcacaggtccaaggctgg

SEQ ID NO: 6261644 - DNA, 13 bp, Homo sapiens
gcacaggtcccac

SEQ ID NO: 6261645 - DNA, 21 bp, Homo sapiens
gcacaggtcccacctccagcc

SEQ ID NO: 6261646 - DNA, 23 bp, Homo sapiens
gcacaggtcccacctccagcccg

SEQ ID NO: 6261647 - DNA, 16 bp, Homo sapiens
gcacaggtctctgttt

SEQ ID NO: 6261648 - DNA, 21 bp, Homo sapiens
gcacaggtgggcttcccagtg

SEQ ID NO: 6261649 - DNA, 18 bp, Homo sapiens
gcacaggtttgttttttc

SEQ ID NO: 6261650 - DNA, 14 bp, Homo sapiens
gcacagtaaaagta

SEQ ID NO: 6261651 - DNA, 16 bp, Homo sapiens
gcacagtaatgtagaa

SEQ ID NO: 6261652 - DNA, 16 bp, Homo sapiens
gcacagtacaataatg

SEQ ID NO: 6261653 - DNA, 15 bp, Homo sapiens
gcacagtatctgctg

SEQ ID NO: 6261654 - DNA, 14 bp, Homo sapiens
gcacagtcaggggc

SEQ ID NO: 6261655 - DNA, 18 bp, Homo sapiens
gcacagtcatacaagtca

SEQ ID NO: 6261656 - DNA, 17 bp, Homo sapiens
gcacagtccacagctga

SEQ ID NO: 6261657 - DNA, 15 bp, Homo sapiens
gcacagtccagaccc

SEQ ID NO: 6261658 - DNA, 15 bp, Homo sapiens
gcacagtccctcctg

SEQ ID NO: 6261659 - DNA, 16 bp, Homo sapiens
gcacagtctccatgtg

SEQ ID NO: 6261660 - DNA, 16 bp, Homo sapiens
gcacagtgaagtgctg

SEQ ID NO: 6261661 - DNA, 16 bp, Homo sapiens
gcacagtgacttctga

SEQ ID NO: 6261662 - DNA, 19 bp, Homo sapiens
gcacagtgacttctgagat

SEQ ID NO: 6261663 - DNA, 20 bp, Homo sapiens
gcacagtgatgccgggcgcc

SEQ ID NO: 6261664 - DNA, 19 bp, Homo sapiens
gcacagtgcagcaagcctg

SEQ ID NO: 6261665 - DNA, 19 bp, Homo sapiens
gcacagtgcatctcagccc

SEQ ID NO: 6261666 - DNA, 13 bp, Homo sapiens
gcacagtgcctga

SEQ ID NO: 6261667 - DNA, 20 bp, Homo sapiens
gcacagtgcctgatgggagt

SEQ ID NO: 6261668 - DNA, 22 bp, Homo sapiens
gcacagtgcctgatgggagtag

SEQ ID NO: 6261669 - DNA, 15 bp, Homo sapiens
gcacagtgctgcccc

SEQ ID NO: 6261670 - DNA, 20 bp, Homo sapiens
gcacagtggactcagcagtg

SEQ ID NO: 6261671 - DNA, 18 bp, Homo sapiens
gcacagtgggcctgtgtg

SEQ ID NO: 6261672 - DNA, 23 bp, Homo sapiens
gcacagtgggcctgtgtgtgtgc

SEQ ID NO: 6261673 - DNA, 17 bp, Homo sapiens
gcacagtggtggcaggg

SEQ ID NO: 6261674 - DNA, 18 bp, Homo sapiens
gcacagtggtggcagggc

SEQ ID NO: 6261675 - DNA, 17 bp, Homo sapiens
gcacagtgtctgggctg

SEQ ID NO: 6261676 - DNA, 21 bp, Homo sapiens
gcacagtgtctgggctgactg

SEQ ID NO: 6261677 - DNA, 21 bp, Homo sapiens
gcacagttgaagggaggggct

SEQ ID NO: 6261678 - DNA, 14 bp, Homo sapiens
gcacagtttgaaca

SEQ ID NO: 6261679 - DNA, 22 bp, Homo sapiens
gcacagtttgctatttgcttta

SEQ ID NO: 6261680 - DNA, 14 bp, Homo sapiens
gcacagttttctga

SEQ ID NO: 6261681 - DNA, 17 bp, Homo sapiens
gcacagtttttgtaaag

SEQ ID NO: 6261682 - DNA, 24 bp, Homo sapiens
gcacagtttttgtaaagcccttgc

SEQ ID NO: 6261683 - DNA, 14 bp, Homo sapiens
gcacatagcagact

SEQ ID NO: 6261684 - DNA, 14 bp, Homo sapiens
gcacatagccctgt

SEQ ID NO: 6261685 - DNA, 15 bp, Homo sapiens
gcacatagccctgtt

SEQ ID NO: 6261686 - DNA, 21 bp, Homo sapiens
gcacatagccctgttgacctg

SEQ ID NO: 6261687 - DNA, 21 bp, Homo sapiens
gcacataggctggtggccttg

SEQ ID NO: 6261688 - DNA, 16 bp, Homo sapiens
gcacatagtgtcctgc

SEQ ID NO: 6261689 - DNA, 17 bp, Homo sapiens
gcacatagtgtcctgcc

SEQ ID NO: 6261690 - DNA, 18 bp, Homo sapiens
gcacatagtgtcctgccc

SEQ ID NO: 6261691 - DNA, 19 bp, Homo sapiens
gcacatatattttttacaa

SEQ ID NO: 6261692 - DNA, 17 bp, Homo sapiens
gcacatatcaagaagtc

SEQ ID NO: 6261693 - DNA, 12 bp, Homo sapiens
gcacatcacctc

SEQ ID NO: 6261694 - DNA, 19 bp, Homo sapiens
gcacatcactgagaagatg

SEQ ID NO: 6261695 - DNA, 23 bp, Homo sapiens
gcacatcagcacgatttctgttt

SEQ ID NO: 6261696 - DNA, 22 bp, Homo sapiens
gcacatcatgagccttcagtca

SEQ ID NO: 6261697 - DNA, 18 bp, Homo sapiens
gcacatccacccaggtcc

SEQ ID NO: 6261698 - DNA, 22 bp, Homo sapiens
gcacatccatcagcaccccagt

SEQ ID NO: 6261699 - DNA, 23 bp, Homo sapiens
gcacatccattcccaagaaatgc

SEQ ID NO: 6261700 - DNA, 19 bp, Homo sapiens
gcacatccgcgtgtgcctg

SEQ ID NO: 6261701 - DNA, 23 bp, Homo sapiens
gcacatccgcgtgtgcctgtgtg

SEQ ID NO: 6261702 - DNA, 17 bp, Homo sapiens
gcacatcctatgcaata

SEQ ID NO: 6261703 - DNA, 20 bp, Homo sapiens
gcacatcctatgcaatatat

SEQ ID NO: 6261704 - DNA, 21 bp, Homo sapiens
gcacatccttcttggcttcct

SEQ ID NO: 6261705 - DNA, 22 bp, Homo sapiens
gcacatccttcttggcttcctg

SEQ ID NO: 6261706 - DNA, 23 bp, Homo sapiens
gcacatctaaattgatcattcat

SEQ ID NO: 6261707 - DNA, 18 bp, Homo sapiens
gcacatctcaacaggcct

SEQ ID NO: 6261708 - DNA, 22 bp, Homo sapiens
gcacatctcaacaggcctcagg

SEQ ID NO: 6261709 - DNA, 15 bp, Homo sapiens
gcacatctcacttca

SEQ ID NO: 6261710 - DNA, 21 bp, Homo sapiens
gcacatctcacttcagttgtg

SEQ ID NO: 6261711 - DNA, 21 bp, Homo sapiens
gcacatctggatgccttcccc

SEQ ID NO: 6261712 - DNA, 12 bp, Homo sapiens
gcacatctggga

SEQ ID NO: 6261713 - DNA, 21 bp, Homo sapiens
gcacatctgtaaatctacaca

SEQ ID NO: 6261714 - DNA, 14 bp, Homo sapiens
gcacatctgtcctg

SEQ ID NO: 6261715 - DNA, 18 bp, Homo sapiens
gcacatctgtgtcttgtt

SEQ ID NO: 6261716 - DNA, 19 bp, Homo sapiens
gcacatgaacagcttgcca

SEQ ID NO: 6261717 - DNA, 21 bp, Homo sapiens
gcacatgaataatttcactta

SEQ ID NO: 6261718 - DNA, 13 bp, Homo sapiens
gcacatgactcgg

SEQ ID NO: 6261719 - DNA, 13 bp, Homo sapiens
gcacatgatttca

SEQ ID NO: 6261720 - DNA, 19 bp, Homo sapiens
gcacatgatttcacaaata

SEQ ID NO: 6261721 - DNA, 20 bp, Homo sapiens
gcacatgatttcacaaatat

SEQ ID NO: 6261722 - DNA, 20 bp, Homo sapiens
gctaggagcaggcttgtggc

SEQ ID NO: 6261723 - DNA, 18 bp, Homo sapiens
gctaggatgttgctcaga

SEQ ID NO: 6261724 - DNA, 15 bp, Homo sapiens
gctaggattacaggc

SEQ ID NO: 6261725 - DNA, 13 bp, Homo sapiens
gctaggcagggag

SEQ ID NO: 6261726 - DNA, 22 bp, Homo sapiens
gctaggcagggtgtctgccccc

SEQ ID NO: 6261727 - DNA, 17 bp, Homo sapiens
gctaggcatgcctggga

SEQ ID NO: 6261728 - DNA, 17 bp, Homo sapiens
gctaggccagcaggggc

SEQ ID NO: 6261729 - DNA, 16 bp, Homo sapiens
gctaggcccctgtgta

SEQ ID NO: 6261730 - DNA, 16 bp, Homo sapiens
gctaggccggccagct

SEQ ID NO: 6261731 - DNA, 21 bp, Homo sapiens
gctaggcctccgttgtctggt

SEQ ID NO: 6261732 - DNA, 15 bp, Homo sapiens
gctaggcctggccag

SEQ ID NO: 6261733 - DNA, 17 bp, Homo sapiens
gctaggcctggccagat

SEQ ID NO: 6261734 - DNA, 23 bp, Homo sapiens
gctaggcctggccagatgcacca

SEQ ID NO: 6261735 - DNA, 16 bp, Homo sapiens
gctaggcgagtgccag

SEQ ID NO: 6261736 - DNA, 21 bp, Homo sapiens
gctaggctcgccttccctcct

SEQ ID NO: 6261737 - DNA, 18 bp, Homo sapiens
gctagggaaacttcccgt

SEQ ID NO: 6261738 - DNA, 14 bp, Homo sapiens
gctagggaggacca

SEQ ID NO: 6261739 - DNA, 20 bp, Homo sapiens
gctagggcccctagaaacca

SEQ ID NO: 6261740 - DNA, 14 bp, Homo sapiens
gctagggctgagca

SEQ ID NO: 6261741 - DNA, 13 bp, Homo sapiens
gctagggctggac

SEQ ID NO: 6261742 - DNA, 14 bp, Homo sapiens
gctaggggagcagg

SEQ ID NO: 6261743 - DNA, 19 bp, Homo sapiens
gctaggggccgagtccagg

SEQ ID NO: 6261744 - DNA, 23 bp, Homo sapiens
gctaggggcgggggcggaggagg

SEQ ID NO: 6261745 - DNA, 14 bp, Homo sapiens
gctagggtggccct

SEQ ID NO: 6261746 - DNA, 22 bp, Homo sapiens
gctaggtagaggcatttgtctt

SEQ ID NO: 6261747 - DNA, 22 bp, Homo sapiens
gctaggtctgaccaaaaccaga

SEQ ID NO: 6261748 - DNA, 22 bp, Homo sapiens
gctaggtcttgccaactccatc

SEQ ID NO: 6261749 - DNA, 14 bp, Homo sapiens
gctaggtgggccag

SEQ ID NO: 6261750 - DNA, 21 bp, Homo sapiens
gctaggtgggccagcccctcc

SEQ ID NO: 6261751 - DNA, 18 bp, Homo sapiens
gctaggtgtctgggatcg

SEQ ID NO: 6261752 - DNA, 22 bp, Homo sapiens
gctaggttaataggaggacaga

SEQ ID NO: 6261753 - DNA, 17 bp, Homo sapiens
gctagtagcaatgtgcc

SEQ ID NO: 6261754 - DNA, 19 bp, Homo sapiens
gctagtagcaatgtgcctt

SEQ ID NO: 6261755 - DNA, 14 bp, Homo sapiens
gctagtatttgaat

SEQ ID NO: 6261756 - DNA, 16 bp, Homo sapiens
gctagtatttgaatta

SEQ ID NO: 6261757 - DNA, 22 bp, Homo sapiens
gctagtcaacagtaccctggtt

SEQ ID NO: 6261758 - DNA, 22 bp, Homo sapiens
gctagtcaactggggaaaagga

SEQ ID NO: 6261759 - DNA, 23 bp, Homo sapiens
gctagtcaagctcctcctccctg

SEQ ID NO: 6261760 - DNA, 16 bp, Homo sapiens
gctagtcactggaaat

SEQ ID NO: 6261761 - DNA, 19 bp, Homo sapiens
gctagtcactggcagcctg

SEQ ID NO: 6261762 - DNA, 20 bp, Homo sapiens
gctagtcactggcagcctgc

SEQ ID NO: 6261763 - DNA, 20 bp, Homo sapiens
gctagtccggacccacctca

SEQ ID NO: 6261764 - DNA, 18 bp, Homo sapiens
gctagtcctagtgaacct

SEQ ID NO: 6261765 - DNA, 18 bp, Homo sapiens
gctagtcctttctgtgaa

SEQ ID NO: 6261766 - DNA, 16 bp, Homo sapiens
gctagtcgcccctcag

SEQ ID NO: 6261767 - DNA, 14 bp, Homo sapiens
gctagtctgtgcct

SEQ ID NO: 6261768 - DNA, 18 bp, Homo sapiens
gctagtctgtgcctcagt

SEQ ID NO: 6261769 - DNA, 16 bp, Homo sapiens
gctagtcttaagaact

SEQ ID NO: 6261770 - DNA, 21 bp, Homo sapiens
gctagtcttcccttacctcaa

SEQ ID NO: 6261771 - DNA, 19 bp, Homo sapiens
gctagtcttgaatttctga

SEQ ID NO: 6261772 - DNA, 15 bp, Homo sapiens
gctagtctttcacag

SEQ ID NO: 6261773 - DNA, 12 bp, Homo sapiens
gctagtcttttg

SEQ ID NO: 6261774 - DNA, 15 bp, Homo sapiens
gctagtcttttgctt

SEQ ID NO: 6261775 - DNA, 17 bp, Homo sapiens
gctagtcttttgctttt

SEQ ID NO: 6261776 - DNA, 21 bp, Homo sapiens
gctagtgaaatggctggggcc

SEQ ID NO: 6261777 - DNA, 17 bp, Homo sapiens
gctagtgaagaccagag

SEQ ID NO: 6261778 - DNA, 14 bp, Homo sapiens
gctagtgagccttc

SEQ ID NO: 6261779 - DNA, 23 bp, Homo sapiens
gctagtgatacactgtatctaaa

SEQ ID NO: 6261780 - DNA, 17 bp, Homo sapiens
gctagtgatgtttttat

SEQ ID NO: 6261781 - DNA, 18 bp, Homo sapiens
gctagtgcatttcaagga

SEQ ID NO: 6261782 - DNA, 14 bp, Homo sapiens
gctagtgccttgcc

SEQ ID NO: 6261783 - DNA, 13 bp, Homo sapiens
gctagtgccttta

SEQ ID NO: 6261784 - DNA, 17 bp, Homo sapiens
gctagtggggtgaacag

SEQ ID NO: 6261785 - DNA, 19 bp, Homo sapiens
gctagtgtagcttctgaaa

SEQ ID NO: 6261786 - DNA, 19 bp, Homo sapiens
gctagtgtctcctctctgg

SEQ ID NO: 6261787 - DNA, 16 bp, Homo sapiens
gctagtgtctttgtca

SEQ ID NO: 6261788 - DNA, 21 bp, Homo sapiens
gctagtgtgagtggcagccat

SEQ ID NO: 6261789 - DNA, 23 bp, Homo sapiens
gctagtgtgagtggcagccatgc

SEQ ID NO: 6261790 - DNA, 17 bp, Homo sapiens
gctagtgttaatccaga

SEQ ID NO: 6261791 - DNA, 17 bp, Homo sapiens
gctagttctgctgccct

SEQ ID NO: 6261792 - DNA, 19 bp, Homo sapiens
gctagttctgctgccctct

SEQ ID NO: 6261793 - DNA, 13 bp, Homo sapiens
gctagttgaatac

SEQ ID NO: 6261794 - DNA, 14 bp, Homo sapiens
gctagttgggcttc

SEQ ID NO: 6261795 - DNA, 16 bp, Homo sapiens
gctagttgggcttcct

SEQ ID NO: 6261796 - DNA, 21 bp, Homo sapiens
gctagttgggcttcctcatag

SEQ ID NO: 6261797 - DNA, 20 bp, Homo sapiens
gctagttggttgaatttttt

SEQ ID NO: 6261798 - DNA, 21 bp, Homo sapiens
gctagtttaaaattattaaaa

SEQ ID NO: 6261799 - DNA, 18 bp, Homo sapiens
gctataaactttacatat

SEQ ID NO: 6261800 - DNA, 19 bp, Homo sapiens
gctataaagcagtattttt

SEQ ID NO: 6261801 - DNA, 18 bp, Homo sapiens
gctataaatagtgaaaat

SEQ ID NO: 6261802 - DNA, 15 bp, Homo sapiens
gctataaatatataa

SEQ ID NO: 6261803 - DNA, 16 bp, Homo sapiens
gctataaatgccagag

SEQ ID NO: 6261804 - DNA, 23 bp, Homo sapiens
gctataacaactctattttttac

SEQ ID NO: 6261805 - DNA, 18 bp, Homo sapiens
gctataacagtagggatg

SEQ ID NO: 6261806 - DNA, 15 bp, Homo sapiens
gctataacattctga

SEQ ID NO: 6261807 - DNA, 15 bp, Homo sapiens
gctataactaagcat

SEQ ID NO: 6261808 - DNA, 14 bp, Homo sapiens
gctataagaaaagt

SEQ ID NO: 6261809 - DNA, 16 bp, Homo sapiens
gctatacctcattcac

SEQ ID NO: 6261810 - DNA, 19 bp, Homo sapiens
gctatagacccgaggaaac

SEQ ID NO: 6261811 - DNA, 16 bp, Homo sapiens
gctatagatgtctttt

SEQ ID NO: 6261812 - DNA, 21 bp, Homo sapiens
gctatagatgtcttttcccat

SEQ ID NO: 6261813 - DNA, 21 bp, Homo sapiens
gctatagcaaaaatagttaaa

SEQ ID NO: 6261814 - DNA, 17 bp, Homo sapiens
gctatagcctggggtgg

SEQ ID NO: 6261815 - DNA, 16 bp, Homo sapiens
gctatagctacaggaa

SEQ ID NO: 6261816 - DNA, 17 bp, Homo sapiens
gctatagctcaggacct

SEQ ID NO: 6261817 - DNA, 17 bp, Homo sapiens
gctataggtcagagatg

SEQ ID NO: 6261818 - DNA, 18 bp, Homo sapiens
gctataggtgctacaaaa

SEQ ID NO: 6261819 - DNA, 19 bp, Homo sapiens
gctataggtgctacaaaaa

SEQ ID NO: 6261820 - DNA, 16 bp, Homo sapiens
gctatagtatttgatt

SEQ ID NO: 6261821 - DNA, 15 bp, Homo sapiens
gctatagtgacatgc

SEQ ID NO: 6261822 - DNA, 19 bp, Homo sapiens
gctatagtgacatgcagtt

SEQ ID NO: 6261823 - DNA, 23 bp, Homo sapiens
gctatagttactgtcctgttgat

SEQ ID NO: 6261824 - DNA, 13 bp, Homo sapiens
gctatagttgcag

SEQ ID NO: 6261825 - DNA, 17 bp, Homo sapiens
gctatagttgcagccca

SEQ ID NO: 6261826 - DNA, 13 bp, Homo sapiens
gctatataaaatg

SEQ ID NO: 6261827 - DNA, 16 bp, Homo sapiens
gctatataaaatgtgg

SEQ ID NO: 6261828 - DNA, 17 bp, Homo sapiens
gctatataagacaagaa

SEQ ID NO: 6261829 - DNA, 22 bp, Homo sapiens
gctatataattgtgaagtatta

SEQ ID NO: 6261830 - DNA, 11 bp, Homo sapiens
gctatatatat

SEQ ID NO: 6261831 - DNA, 16 bp, Homo sapiens
gctatatatataaata

SEQ ID NO: 6261832 - DNA, 23 bp, Homo sapiens
gctatatatatatatatatgtat

SEQ ID NO: 6261833 - DNA, 19 bp, Homo sapiens
gctatatatttaggaaatt

SEQ ID NO: 6261834 - DNA, 19 bp, Homo sapiens
gctatatccagttcctgct

SEQ ID NO: 6261835 - DNA, 15 bp, Homo sapiens
gctatatccatgtac

SEQ ID NO: 6261836 - DNA, 17 bp, Homo sapiens
gctatatccatgtactg

SEQ ID NO: 6261837 - DNA, 23 bp, Homo sapiens
gctatatccatgtactgtagttt

SEQ ID NO: 6261838 - DNA, 19 bp, Homo sapiens
gctatatctatatataatt

SEQ ID NO: 6261839 - DNA, 14 bp, Homo sapiens
gctatatttcagtg

SEQ ID NO: 6261840 - DNA, 14 bp, Homo sapiens
gctatattttcatg

SEQ ID NO: 6261841 - DNA, 21 bp, Homo sapiens
gctatatttttaaagaaggag

SEQ ID NO: 6261842 - DNA, 16 bp, Homo sapiens
gctatcaaaagaaata

SEQ ID NO: 6261843 - DNA, 16 bp, Homo sapiens
gctatcaagaaatgct

SEQ ID NO: 6261844 - DNA, 13 bp, Homo sapiens
gctatcaagaggc

SEQ ID NO: 6261845 - DNA, 20 bp, Homo sapiens
gctatcaagaggctgagaca

SEQ ID NO: 6261846 - DNA, 14 bp, Homo sapiens
gctatcacctagca

SEQ ID NO: 6261847 - DNA, 23 bp, Homo sapiens
gctatcagcaatactcatcagag

SEQ ID NO: 6261848 - DNA, 16 bp, Homo sapiens
gctatcagggaggaag

SEQ ID NO: 6261849 - DNA, 18 bp, Homo sapiens
gctatcagggaggaagat

SEQ ID NO: 6261850 - DNA, 14 bp, Homo sapiens
gctatcagtgcttt

SEQ ID NO: 6261851 - DNA, 23 bp, Homo sapiens
gctatccaatgatataggaaaat

SEQ ID NO: 6261852 - DNA, 19 bp, Homo sapiens
gctatccacagaacctttg

SEQ ID NO: 6261853 - DNA, 15 bp, Homo sapiens
gctatccagccgcaa

SEQ ID NO: 6261854 - DNA, 19 bp, Homo sapiens
gctatccagctatttttat

SEQ ID NO: 6261855 - DNA, 16 bp, Homo sapiens
gctatccagttgcagg

SEQ ID NO: 6261856 - DNA, 18 bp, Homo sapiens
gctatccccatctccctg

SEQ ID NO: 6261857 - DNA, 16 bp, Homo sapiens
gctatcctagagaggc

SEQ ID NO: 6261858 - DNA, 17 bp, Homo sapiens
gctatcctagagaggct

SEQ ID NO: 6261859 - DNA, 18 bp, Homo sapiens
gctatcctagagaggctg

SEQ ID NO: 6261860 - DNA, 12 bp, Homo sapiens
gctatcctgatt

SEQ ID NO: 6261861 - DNA, 17 bp, Homo sapiens
gctatcctgctgaaagt

SEQ ID NO: 6261862 - DNA, 20 bp, Homo sapiens
gctatcctgggacctcccca

SEQ ID NO: 6261863 - DNA, 23 bp, Homo sapiens
gctatccttggctttcagagcca

SEQ ID NO: 6261864 - DNA, 19 bp, Homo sapiens
gctatcggggaagccagac

SEQ ID NO: 6261865 - DNA, 22 bp, Homo sapiens
gctatctactaagtttcctttt

SEQ ID NO: 6261866 - DNA, 21 bp, Homo sapiens
gctatctactaccagaagggc

SEQ ID NO: 6261867 - DNA, 13 bp, Homo sapiens
gctatctccccca

SEQ ID NO: 6261868 - DNA, 14 bp, Homo sapiens
gctatctcccccag

SEQ ID NO: 6261869 - DNA, 16 bp, Homo sapiens
gctatctcccccagcc

SEQ ID NO: 6261870 - DNA, 19 bp, Homo sapiens
gctatctgcctgacaggct

SEQ ID NO: 6261871 - DNA, 21 bp, Homo sapiens
gctatctgcctgacaggctgt

SEQ ID NO: 6261872 - DNA, 17 bp, Homo sapiens
gctatctggtcaacctc

SEQ ID NO: 6261873 - DNA, 16 bp, Homo sapiens
gctatctgtcatctct

SEQ ID NO: 6261874 - DNA, 12 bp, Homo sapiens
gctatcttaatt

SEQ ID NO: 6261875 - DNA, 15 bp, Homo sapiens
gctatcttcatgtaa

SEQ ID NO: 6261876 - DNA, 18 bp, Homo sapiens
gctatcttcatgtaaatt

SEQ ID NO: 6261877 - DNA, 15 bp, Homo sapiens
gctatcttttctgga

SEQ ID NO: 6261878 - DNA, 17 bp, Homo sapiens
gctatgaaaatgagccc

SEQ ID NO: 6261879 - DNA, 19 bp, Homo sapiens
gctatgaaaatgagccctg

SEQ ID NO: 6261880 - DNA, 21 bp, Homo sapiens
gctatgaagagctagagaaat

SEQ ID NO: 6261881 - DNA, 18 bp, Homo sapiens
gctatgaagccaactgac

SEQ ID NO: 6261882 - DNA, 23 bp, Homo sapiens
gctatgaagggacagctgctggg

SEQ ID NO: 6261883 - DNA, 12 bp, Homo sapiens
gctatgaatgtt

SEQ ID NO: 6261884 - DNA, 17 bp, Homo sapiens
gctatgacagctggcta

SEQ ID NO: 6261885 - DNA, 20 bp, Homo sapiens
gctatgacatggaggcactg

SEQ ID NO: 6261886 - DNA, 13 bp, Homo sapiens
gctatgagaataa

SEQ ID NO: 6261887 - DNA, 17 bp, Homo sapiens
gctatgagctggggatg

SEQ ID NO: 6261888 - DNA, 20 bp, Homo sapiens
gctatgaggaaactgagtca

SEQ ID NO: 6261889 - DNA, 14 bp, Homo sapiens
gctatgagggcctt

SEQ ID NO: 6261890 - DNA, 23 bp, Homo sapiens
gctatgagggtccccgggagcac

SEQ ID NO: 6261891 - DNA, 14 bp, Homo sapiens
gctatgagttttct

SEQ ID NO: 6261892 - DNA, 21 bp, Homo sapiens
gctatgataagattgaaattc

SEQ ID NO: 6261893 - DNA, 14 bp, Homo sapiens
gctatgatatgtgc

SEQ ID NO: 6261894 - DNA, 18 bp, Homo sapiens
gctatgatgttagttttc

SEQ ID NO: 6261895 - DNA, 18 bp, Homo sapiens
gctatgattatgccactg

SEQ ID NO: 6261896 - DNA, 20 bp, Homo sapiens
gctatgatttttttttccaa

SEQ ID NO: 6261897 - DNA, 13 bp, Homo sapiens
gctatgcaaaata

SEQ ID NO: 6261898 - DNA, 22 bp, Homo sapiens
gctatgcaaaatagacatcttt

SEQ ID NO: 6261899 - DNA, 17 bp, Homo sapiens
gctatgcatattcaatg

SEQ ID NO: 6261900 - DNA, 22 bp, Homo sapiens
gcacatgcagatggggctcccg

SEQ ID NO: 6261901 - DNA, 17 bp, Homo sapiens
gcacatgccacctggca

SEQ ID NO: 6261902 - DNA, 18 bp, Homo sapiens
gcacatgcctctctcagg

SEQ ID NO: 6261903 - DNA, 22 bp, Homo sapiens
gcacatgcctctctcaggccaa

SEQ ID NO: 6261904 - DNA, 19 bp, Homo sapiens
gcacatgcctgtagtccca

SEQ ID NO: 6261905 - DNA, 14 bp, Homo sapiens
gcacatgcgcactc

SEQ ID NO: 6261906 - DNA, 20 bp, Homo sapiens
gcacatgctgagtctcccaa

SEQ ID NO: 6261907 - DNA, 14 bp, Homo sapiens
gcacatgctggcca

SEQ ID NO: 6261908 - DNA, 20 bp, Homo sapiens
gcacatgctgtctggccctg

SEQ ID NO: 6261909 - DNA, 15 bp, Homo sapiens
gcacatgcttagctt

SEQ ID NO: 6261910 - DNA, 13 bp, Homo sapiens
gcacatgcttcaa

SEQ ID NO: 6261911 - DNA, 22 bp, Homo sapiens
gcacatggccatagaggcccag

SEQ ID NO: 6261912 - DNA, 13 bp, Homo sapiens
gcacatggcctga

SEQ ID NO: 6261913 - DNA, 16 bp, Homo sapiens
gcacatggctggggga

SEQ ID NO: 6261914 - DNA, 21 bp, Homo sapiens
gcacatgtcattgcccacttc

SEQ ID NO: 6261915 - DNA, 22 bp, Homo sapiens
gcacatgtcattgcccacttct

SEQ ID NO: 6261916 - DNA, 22 bp, Homo sapiens
gcacatgtctgtcctcagagca

SEQ ID NO: 6261917 - DNA, 23 bp, Homo sapiens
gcacatgtctgtcctcagagcag

SEQ ID NO: 6261918 - DNA, 20 bp, Homo sapiens
gcacatgtcttaatgaagtt

SEQ ID NO: 6261919 - DNA, 20 bp, Homo sapiens
gcacatgtcttgtacatgtg

SEQ ID NO: 6261920 - DNA, 21 bp, Homo sapiens
gcacatgtcttgtacatgtgt

SEQ ID NO: 6261921 - DNA, 18 bp, Homo sapiens
gcacatgtgccacacagt

SEQ ID NO: 6261922 - DNA, 16 bp, Homo sapiens
gcacatgttggaggag

SEQ ID NO: 6261923 - DNA, 20 bp, Homo sapiens
gcacatgttgttctcattga

SEQ ID NO: 6261924 - DNA, 12 bp, Homo sapiens
gcacatgtttcc

SEQ ID NO: 6261925 - DNA, 23 bp, Homo sapiens
gcacatgttttacaaagaaacaa

SEQ ID NO: 6261926 - DNA, 14 bp, Homo sapiens
gcacattaaatgac

SEQ ID NO: 6261927 - DNA, 21 bp, Homo sapiens
gcacattaactccctccacca

SEQ ID NO: 6261928 - DNA, 23 bp, Homo sapiens
gcacattaactccctccaccagc

SEQ ID NO: 6261929 - DNA, 21 bp, Homo sapiens
gcacattaactgttgcacttt

SEQ ID NO: 6261930 - DNA, 13 bp, Homo sapiens
gcacattatgttt

SEQ ID NO: 6261931 - DNA, 21 bp, Homo sapiens
gcacattcatcctcacatgtg

SEQ ID NO: 6261932 - DNA, 21 bp, Homo sapiens
gcacattccaattgtgcagtg

SEQ ID NO: 6261933 - DNA, 15 bp, Homo sapiens
gcacattcctggccc

SEQ ID NO: 6261934 - DNA, 17 bp, Homo sapiens
gcacattcctggccccg

SEQ ID NO: 6261935 - DNA, 18 bp, Homo sapiens
gcacattcctggccccgg

SEQ ID NO: 6261936 - DNA, 12 bp, Homo sapiens
gcacattcttaa

SEQ ID NO: 6261937 - DNA, 17 bp, Homo sapiens
gcacattcttagagtta

SEQ ID NO: 6261938 - DNA, 19 bp, Homo sapiens
gcacattgaaatacttgaa

SEQ ID NO: 6261939 - DNA, 13 bp, Homo sapiens
gcacattgcccat

SEQ ID NO: 6261940 - DNA, 20 bp, Homo sapiens
gcacattgcccctctgcctt

SEQ ID NO: 6261941 - DNA, 18 bp, Homo sapiens
gcacattgcctgttctgc

SEQ ID NO: 6261942 - DNA, 16 bp, Homo sapiens
gcacattggcagtgtg

SEQ ID NO: 6261943 - DNA, 18 bp, Homo sapiens
gcacattgttgttttttt

SEQ ID NO: 6261944 - DNA, 19 bp, Homo sapiens
gcacatttaataatcagac

SEQ ID NO: 6261945 - DNA, 23 bp, Homo sapiens
gcacatttagtccaatgaagata

SEQ ID NO: 6261946 - DNA, 13 bp, Homo sapiens
gcacatttcagaa

SEQ ID NO: 6261947 - DNA, 14 bp, Homo sapiens
gcacatttcaggga

SEQ ID NO: 6261948 - DNA, 16 bp, Homo sapiens
gcacatttcagggaga

SEQ ID NO: 6261949 - DNA, 19 bp, Homo sapiens
gcacatttccccagacctg

SEQ ID NO: 6261950 - DNA, 16 bp, Homo sapiens
gcacatttcctctcta

SEQ ID NO: 6261951 - DNA, 14 bp, Homo sapiens
gcacatttctggat

SEQ ID NO: 6261952 - DNA, 21 bp, Homo sapiens
gcacattttacttagctggag

SEQ ID NO: 6261953 - DNA, 17 bp, Homo sapiens
gcacatttttttctatg

SEQ ID NO: 6261954 - DNA, 21 bp, Homo sapiens
gcacatttttttctatgcata

SEQ ID NO: 6261955 - DNA, 14 bp, Homo sapiens
gcaccaaaagaagt

SEQ ID NO: 6261956 - DNA, 15 bp, Homo sapiens
gcaccaaaagaagta

SEQ ID NO: 6261957 - DNA, 19 bp, Homo sapiens
gcaccaaaataagaaaaga

SEQ ID NO: 6261958 - DNA, 14 bp, Homo sapiens
gcaccaaatgtcag

SEQ ID NO: 6261959 - DNA, 13 bp, Homo sapiens
gcaccaaccacag

SEQ ID NO: 6261960 - DNA, 18 bp, Homo sapiens
gcaccaacccagccgctg

SEQ ID NO: 6261961 - DNA, 22 bp, Homo sapiens
gcaccaacccagccgctgcccg

SEQ ID NO: 6261962 - DNA, 18 bp, Homo sapiens
gcaccaacctcactgccc

SEQ ID NO: 6261963 - DNA, 17 bp, Homo sapiens
gcaccaacctccagact

SEQ ID NO: 6261964 - DNA, 18 bp, Homo sapiens
gcaccaacctccagactc

SEQ ID NO: 6261965 - DNA, 13 bp, Homo sapiens
gcaccaagagcag

SEQ ID NO: 6261966 - DNA, 14 bp, Homo sapiens
gcaccaagcccaca

SEQ ID NO: 6261967 - DNA, 16 bp, Homo sapiens
gcaccaagcccacagg

SEQ ID NO: 6261968 - DNA, 19 bp, Homo sapiens
gcaccaagggacaggagaa

SEQ ID NO: 6261969 - DNA, 18 bp, Homo sapiens
gcaccaagtacagccttc

SEQ ID NO: 6261970 - DNA, 13 bp, Homo sapiens
gcaccaataaagg

SEQ ID NO: 6261971 - DNA, 20 bp, Homo sapiens
gcaccaatcttgtttatagc

SEQ ID NO: 6261972 - DNA, 14 bp, Homo sapiens
gcaccaatgcccag

SEQ ID NO: 6261973 - DNA, 16 bp, Homo sapiens
gcaccaatgcccagca

SEQ ID NO: 6261974 - DNA, 14 bp, Homo sapiens
gcaccacaaaatat

SEQ ID NO: 6261975 - DNA, 15 bp, Homo sapiens
gcaccacaaaatata

SEQ ID NO: 6261976 - DNA, 16 bp, Homo sapiens
gcaccacagcctccaa

SEQ ID NO: 6261977 - DNA, 17 bp, Homo sapiens
gcaccaccaagccaagg

SEQ ID NO: 6261978 - DNA, 18 bp, Homo sapiens
gcaccaccaagccaaggg

SEQ ID NO: 6261979 - DNA, 14 bp, Homo sapiens
gcaccaccacacag

SEQ ID NO: 6261980 - DNA, 17 bp, Homo sapiens
gcaccaccacacagtca

SEQ ID NO: 6261981 - DNA, 14 bp, Homo sapiens
gcaccaccatttaa

SEQ ID NO: 6261982 - DNA, 20 bp, Homo sapiens
gcaccacccccagtcccccc

SEQ ID NO: 6261983 - DNA, 16 bp, Homo sapiens
gcaccacccctgggca

SEQ ID NO: 6261984 - DNA, 11 bp, Homo sapiens
gcaccacccta

SEQ ID NO: 6261985 - DNA, 20 bp, Homo sapiens
gcaccaccctagtcccttcc

SEQ ID NO: 6261986 - DNA, 22 bp, Homo sapiens
gcaccaccctagtcccttcccc

SEQ ID NO: 6261987 - DNA, 13 bp, Homo sapiens
gcaccaccctcct

SEQ ID NO: 6261988 - DNA, 16 bp, Homo sapiens
gcaccaccctccttcc

SEQ ID NO: 6261989 - DNA, 18 bp, Homo sapiens
gcaccaccgaccaactcc

SEQ ID NO: 6261990 - DNA, 18 bp, Homo sapiens
gcaccacctacacaggag

SEQ ID NO: 6261991 - DNA, 16 bp, Homo sapiens
gcaccacctctgtggg

SEQ ID NO: 6261992 - DNA, 17 bp, Homo sapiens
gcaccacctctgtgggc

SEQ ID NO: 6261993 - DNA, 13 bp, Homo sapiens
gcaccacggccag

SEQ ID NO: 6261994 - DNA, 14 bp, Homo sapiens
gcaccacggccaga

SEQ ID NO: 6261995 - DNA, 15 bp, Homo sapiens
gcaccacggccagaa

SEQ ID NO: 6261996 - DNA, 23 bp, Homo sapiens
gcaccacgggacatcacagggtg

SEQ ID NO: 6261997 - DNA, 15 bp, Homo sapiens
gcaccacgggcccgg

SEQ ID NO: 6261998 - DNA, 13 bp, Homo sapiens
gcaccactcaaga

SEQ ID NO: 6261999 - DNA, 17 bp, Homo sapiens
gcaccactcaagaccaa

SEQ ID NO: 6262000 - DNA, 12 bp, Homo sapiens
gcaccactgcac

SEQ ID NO: 6262001 - DNA, 18 bp, Homo sapiens
gcaccactgcactccagc

SEQ ID NO: 6262002 - DNA, 16 bp, Homo sapiens
gcaccactgctgagga

SEQ ID NO: 6262003 - DNA, 12 bp, Homo sapiens
gcaccactgctt

SEQ ID NO: 6262004 - DNA, 18 bp, Homo sapiens
gcaccactgtgtatttaa

SEQ ID NO: 6262005 - DNA, 22 bp, Homo sapiens
gcaccacttatttattgttgcc

SEQ ID NO: 6262006 - DNA, 23 bp, Homo sapiens
gcaccacttatttattgttgcct

SEQ ID NO: 6262007 - DNA, 12 bp, Homo sapiens
gcaccagaatgc

SEQ ID NO: 6262008 - DNA, 14 bp, Homo sapiens
gcaccagacaccca

SEQ ID NO: 6262009 - DNA, 19 bp, Homo sapiens
gcaccagacacccaggact

SEQ ID NO: 6262010 - DNA, 21 bp, Homo sapiens
gcaccagacacccaggactta

SEQ ID NO: 6262011 - DNA, 22 bp, Homo sapiens
gcaccagacgaacagtgaggaa

SEQ ID NO: 6262012 - DNA, 13 bp, Homo sapiens
gcaccagaggccg

SEQ ID NO: 6262013 - DNA, 21 bp, Homo sapiens
gcaccagaggctgcagaaggc

SEQ ID NO: 6262014 - DNA, 13 bp, Homo sapiens
gcaccagcagcct

SEQ ID NO: 6262015 - DNA, 14 bp, Homo sapiens
gcaccagcaggcac

SEQ ID NO: 6262016 - DNA, 15 bp, Homo sapiens
gcaccagcatccacc

SEQ ID NO: 6262017 - DNA, 17 bp, Homo sapiens
gcaccagcccttccctg

SEQ ID NO: 6262018 - DNA, 19 bp, Homo sapiens
gcaccagcccttccctgct

SEQ ID NO: 6262019 - DNA, 12 bp, Homo sapiens
gcaccagcctga

SEQ ID NO: 6262020 - DNA, 14 bp, Homo sapiens
gcaccagcctgagc

SEQ ID NO: 6262021 - DNA, 18 bp, Homo sapiens
gcaccagcctgagccaca

SEQ ID NO: 6262022 - DNA, 16 bp, Homo sapiens
gcaccagctctgtggc

SEQ ID NO: 6262023 - DNA, 17 bp, Homo sapiens
gcaccagctctgtggcc

SEQ ID NO: 6262024 - DNA, 19 bp, Homo sapiens
gcaccagctctgtggcctg

SEQ ID NO: 6262025 - DNA, 22 bp, Homo sapiens
gcaccagctctgtggcctgtgt

SEQ ID NO: 6262026 - DNA, 23 bp, Homo sapiens
gcaccagctctgtggcctgtgtc

SEQ ID NO: 6262027 - DNA, 13 bp, Homo sapiens
gcaccagctgctc

SEQ ID NO: 6262028 - DNA, 16 bp, Homo sapiens
gcaccagctgctctgc

SEQ ID NO: 6262029 - DNA, 17 bp, Homo sapiens
gcaccagctgctctgcc

SEQ ID NO: 6262030 - DNA, 12 bp, Homo sapiens
gcaccagcttct

SEQ ID NO: 6262031 - DNA, 16 bp, Homo sapiens
gcaccagcttctccag

SEQ ID NO: 6262032 - DNA, 18 bp, Homo sapiens
gcaccagcttctttctcg

SEQ ID NO: 6262033 - DNA, 11 bp, Homo sapiens
gcaccagcttg

SEQ ID NO: 6262034 - DNA, 19 bp, Homo sapiens
gcaccaggaagtgtttatg

SEQ ID NO: 6262035 - DNA, 12 bp, Homo sapiens
gcaccaggagac

SEQ ID NO: 6262036 - DNA, 22 bp, Homo sapiens
gcaccaggcaaacgaataaaga

SEQ ID NO: 6262037 - DNA, 23 bp, Homo sapiens
gcaccaggcacgaacccacctgc

SEQ ID NO: 6262038 - DNA, 20 bp, Homo sapiens
gcaccaggccgggcttgggc

SEQ ID NO: 6262039 - DNA, 13 bp, Homo sapiens
gcaccagggaaga

SEQ ID NO: 6262040 - DNA, 20 bp, Homo sapiens
gcaccagggactatgaatgg

SEQ ID NO: 6262041 - DNA, 14 bp, Homo sapiens
gcaccagggagagg

SEQ ID NO: 6262042 - DNA, 16 bp, Homo sapiens
gcaccagggagaggcc

SEQ ID NO: 6262043 - DNA, 18 bp, Homo sapiens
gcaccagggagaggcctc

SEQ ID NO: 6262044 - DNA, 20 bp, Homo sapiens
gcaccagggcattcgggcca

SEQ ID NO: 6262045 - DNA, 14 bp, Homo sapiens
gcaccaggggccaa

SEQ ID NO: 6262046 - DNA, 22 bp, Homo sapiens
gcaccaggggccaacctcaggc

SEQ ID NO: 6262047 - DNA, 19 bp, Homo sapiens
gcaccaggggtgcacaata

SEQ ID NO: 6262048 - DNA, 12 bp, Homo sapiens
gcaccagtccag

SEQ ID NO: 6262049 - DNA, 14 bp, Homo sapiens
gcaccagtccctgt

SEQ ID NO: 6262050 - DNA, 20 bp, Homo sapiens
gcaccagtgccgcctgtgcc

SEQ ID NO: 6262051 - DNA, 19 bp, Homo sapiens
gcaccagttttatccataa

SEQ ID NO: 6262052 - DNA, 19 bp, Homo sapiens
gcaccataatgagatgtga

SEQ ID NO: 6262053 - DNA, 21 bp, Homo sapiens
gcaccatagaagaacagcaga

SEQ ID NO: 6262054 - DNA, 13 bp, Homo sapiens
gcaccatcccctc

SEQ ID NO: 6262055 - DNA, 14 bp, Homo sapiens
gcaccatcccctcc

SEQ ID NO: 6262056 - DNA, 16 bp, Homo sapiens
gcaccatgctgctggg

SEQ ID NO: 6262057 - DNA, 18 bp, Homo sapiens
gcaccatgctgctgggga

SEQ ID NO: 6262058 - DNA, 22 bp, Homo sapiens
gcaccatggtatcatatattaa

SEQ ID NO: 6262059 - DNA, 16 bp, Homo sapiens
gcaccattcaggaacc

SEQ ID NO: 6262060 - DNA, 23 bp, Homo sapiens
gcaccattcaggaacctggacca

SEQ ID NO: 6262061 - DNA, 15 bp, Homo sapiens
gcaccattctcctgc

SEQ ID NO: 6262062 - DNA, 23 bp, Homo sapiens
gcaccattctgactcggtttctc

SEQ ID NO: 6262063 - DNA, 23 bp, Homo sapiens
gcaccattgcactctagcctggc

SEQ ID NO: 6262064 - DNA, 20 bp, Homo sapiens
gcaccatttaaaaacaggca

SEQ ID NO: 6262065 - DNA, 14 bp, Homo sapiens
gcaccattttgtca

SEQ ID NO: 6262066 - DNA, 12 bp, Homo sapiens
gcacccaaatca

SEQ ID NO: 6262067 - DNA, 21 bp, Homo sapiens
gcacccaaatcacatctcacc

SEQ ID NO: 6262068 - DNA, 16 bp, Homo sapiens
gcacccaactactgag

SEQ ID NO: 6262069 - DNA, 18 bp, Homo sapiens
gcacccacaccctacagc

SEQ ID NO: 6262070 - DNA, 21 bp, Homo sapiens
gcacccacaccctacagcaga

SEQ ID NO: 6262071 - DNA, 23 bp, Homo sapiens
gcacccacaccctacagcagatc

SEQ ID NO: 6262072 - DNA, 20 bp, Homo sapiens
gcacccacatcctggagtca

SEQ ID NO: 6262073 - DNA, 17 bp, Homo sapiens
gcacccaccaccacgcc

SEQ ID NO: 6262074 - DNA, 14 bp, Homo sapiens
gcacccaccactct

SEQ ID NO: 6262075 - DNA, 18 bp, Homo sapiens
gcacccaccactctcagg

SEQ ID NO: 6262076 - DNA, 20 bp, Homo sapiens
gcacccaccagttgctgctg

SEQ ID NO: 6262077 - DNA, 22 bp, Homo sapiens
gcacccacccagcacccagcaa

SEQ ID NO: 6262078 - DNA, 22 bp, Homo sapiens
gcacccaccgtctcggccctga

SEQ ID NO: 6262079 - DNA, 12 bp, Homo sapiens
gctatgcatttg

SEQ ID NO: 6262080 - DNA, 19 bp, Homo sapiens
gctatgcattttcttcaca

SEQ ID NO: 6262081 - DNA, 13 bp, Homo sapiens
gctatgccttgca

SEQ ID NO: 6262082 - DNA, 18 bp, Homo sapiens
gctatgctaaacctcctg

SEQ ID NO: 6262083 - DNA, 18 bp, Homo sapiens
gctatggaaatacattta

SEQ ID NO: 6262084 - DNA, 19 bp, Homo sapiens
gctatggaaatacatttag

SEQ ID NO: 6262085 - DNA, 19 bp, Homo sapiens
gctatggacaatttaccac

SEQ ID NO: 6262086 - DNA, 23 bp, Homo sapiens
gctatggatggggcccaggggct

SEQ ID NO: 6262087 - DNA, 21 bp, Homo sapiens
gctatggcaagggggtgtcat

SEQ ID NO: 6262088 - DNA, 20 bp, Homo sapiens
gctatggcaggataagaaag

SEQ ID NO: 6262089 - DNA, 15 bp, Homo sapiens
gctatggcccagaaa

SEQ ID NO: 6262090 - DNA, 16 bp, Homo sapiens
gctatggccccagggt

SEQ ID NO: 6262091 - DNA, 17 bp, Homo sapiens
gctatgggaatcagctg

SEQ ID NO: 6262092 - DNA, 16 bp, Homo sapiens
gctatgggaggcagcc

SEQ ID NO: 6262093 - DNA, 19 bp, Homo sapiens
gctatggggatagatgtgt

SEQ ID NO: 6262094 - DNA, 20 bp, Homo sapiens
gctatggggtaggagaaaag

SEQ ID NO: 6262095 - DNA, 14 bp, Homo sapiens
gctatggtgagatg

SEQ ID NO: 6262096 - DNA, 14 bp, Homo sapiens
gctatggtgggaga

SEQ ID NO: 6262097 - DNA, 16 bp, Homo sapiens
gctatggttgccaccc

SEQ ID NO: 6262098 - DNA, 23 bp, Homo sapiens
gctatgtaaacaaaccacagcag

SEQ ID NO: 6262099 - DNA, 14 bp, Homo sapiens
gctatgtaagggtc

SEQ ID NO: 6262100 - DNA, 17 bp, Homo sapiens
gctatgtaatttaataa

SEQ ID NO: 6262101 - DNA, 17 bp, Homo sapiens
gctatgtagtcataata

SEQ ID NO: 6262102 - DNA, 21 bp, Homo sapiens
gctatgtatttgcaaggctga

SEQ ID NO: 6262103 - DNA, 15 bp, Homo sapiens
gctatgtcccaagag

SEQ ID NO: 6262104 - DNA, 16 bp, Homo sapiens
gctatgtcccaagagc

SEQ ID NO: 6262105 - DNA, 20 bp, Homo sapiens
gctatgtcccaagagccata

SEQ ID NO: 6262106 - DNA, 16 bp, Homo sapiens
gctatgtctcatgttt

SEQ ID NO: 6262107 - DNA, 21 bp, Homo sapiens
gctatgtctcatgttttatat

SEQ ID NO: 6262108 - DNA, 14 bp, Homo sapiens
gctatgtctgtgat

SEQ ID NO: 6262109 - DNA, 12 bp, Homo sapiens
gctatgtgaaac

SEQ ID NO: 6262110 - DNA, 18 bp, Homo sapiens
gctatgtgtgagatatgt

SEQ ID NO: 6262111 - DNA, 16 bp, Homo sapiens
gctatgtgtttggttt

SEQ ID NO: 6262112 - DNA, 13 bp, Homo sapiens
gctatgttcttct

SEQ ID NO: 6262113 - DNA, 18 bp, Homo sapiens
gctatgtttccatcttca

SEQ ID NO: 6262114 - DNA, 23 bp, Homo sapiens
gctatgttttggagagagcaatc

SEQ ID NO: 6262115 - DNA, 20 bp, Homo sapiens
gctattaaaactcagcctgg

SEQ ID NO: 6262116 - DNA, 16 bp, Homo sapiens
gctattaaaatgtaac

SEQ ID NO: 6262117 - DNA, 23 bp, Homo sapiens
gctattaagaatttaagacttgt

SEQ ID NO: 6262118 - DNA, 15 bp, Homo sapiens
gctattaatatttgt

SEQ ID NO: 6262119 - DNA, 13 bp, Homo sapiens
gctattacaaata

SEQ ID NO: 6262120 - DNA, 22 bp, Homo sapiens
gctattacttggcaaattctga

SEQ ID NO: 6262121 - DNA, 13 bp, Homo sapiens
gctattagccagg

SEQ ID NO: 6262122 - DNA, 19 bp, Homo sapiens
gctattagccaggatcatg

SEQ ID NO: 6262123 - DNA, 17 bp, Homo sapiens
gctattataatatagaa

SEQ ID NO: 6262124 - DNA, 19 bp, Homo sapiens
gctattataatatagaaag

SEQ ID NO: 6262125 - DNA, 15 bp, Homo sapiens
gctattatgatgttt

SEQ ID NO: 6262126 - DNA, 20 bp, Homo sapiens
gctattatgatgttttgcaa

SEQ ID NO: 6262127 - DNA, 21 bp, Homo sapiens
gctattatgatgttttgcaaa

SEQ ID NO: 6262128 - DNA, 14 bp, Homo sapiens
gctattatgtaaca

SEQ ID NO: 6262129 - DNA, 17 bp, Homo sapiens
gctattcagataaggca

SEQ ID NO: 6262130 - DNA, 20 bp, Homo sapiens
gctattcaggaggctgaggc

SEQ ID NO: 6262131 - DNA, 13 bp, Homo sapiens
gctattcccaggc

SEQ ID NO: 6262132 - DNA, 16 bp, Homo sapiens
gctattcccaggcagg

SEQ ID NO: 6262133 - DNA, 14 bp, Homo sapiens
gctattccctggag

SEQ ID NO: 6262134 - DNA, 15 bp, Homo sapiens
gctattccctggaga

SEQ ID NO: 6262135 - DNA, 18 bp, Homo sapiens
gctattcccttctgatct

SEQ ID NO: 6262136 - DNA, 22 bp, Homo sapiens
gctattcccttctgatcttgga

SEQ ID NO: 6262137 - DNA, 16 bp, Homo sapiens
gctattcctttccctt

SEQ ID NO: 6262138 - DNA, 18 bp, Homo sapiens
gctattcgtaagttctgt

SEQ ID NO: 6262139 - DNA, 18 bp, Homo sapiens
gctattctcatgcctcag

SEQ ID NO: 6262140 - DNA, 20 bp, Homo sapiens
gctattctgtgttgaacaca

SEQ ID NO: 6262141 - DNA, 14 bp, Homo sapiens
gctattgacaataa

SEQ ID NO: 6262142 - DNA, 15 bp, Homo sapiens
gctattgacaataaa

SEQ ID NO: 6262143 - DNA, 19 bp, Homo sapiens
gctattgaccatgtggttc

SEQ ID NO: 6262144 - DNA, 21 bp, Homo sapiens
gctattgatgtttccagaaaa

SEQ ID NO: 6262145 - DNA, 22 bp, Homo sapiens
gctattgatgtttccagaaaat

SEQ ID NO: 6262146 - DNA, 16 bp, Homo sapiens
gctattgcaaatgagg

SEQ ID NO: 6262147 - DNA, 16 bp, Homo sapiens
gctattgcactccagt

SEQ ID NO: 6262148 - DNA, 13 bp, Homo sapiens
gctattgcataag

SEQ ID NO: 6262149 - DNA, 21 bp, Homo sapiens
gctattgcatgtaaaatgcag

SEQ ID NO: 6262150 - DNA, 16 bp, Homo sapiens
gctattggaggatcag

SEQ ID NO: 6262151 - DNA, 15 bp, Homo sapiens
gctattggcctccca

SEQ ID NO: 6262152 - DNA, 13 bp, Homo sapiens
gctattgtaaata

SEQ ID NO: 6262153 - DNA, 16 bp, Homo sapiens
gctattgtaaatatgt

SEQ ID NO: 6262154 - DNA, 18 bp, Homo sapiens
gctattgtaaggtctttg

SEQ ID NO: 6262155 - DNA, 21 bp, Homo sapiens
gctattgtcaccagggctgga

SEQ ID NO: 6262156 - DNA, 18 bp, Homo sapiens
gctattgtccttgtgtat

SEQ ID NO: 6262157 - DNA, 22 bp, Homo sapiens
gctattgtttataggaaataaa

SEQ ID NO: 6262158 - DNA, 22 bp, Homo sapiens
gctattgtttctttaagaaagt

SEQ ID NO: 6262159 - DNA, 14 bp, Homo sapiens
gctatttaaaactt

SEQ ID NO: 6262160 - DNA, 18 bp, Homo sapiens
gctatttaacatgggagg

SEQ ID NO: 6262161 - DNA, 15 bp, Homo sapiens
gctatttaacatttt

SEQ ID NO: 6262162 - DNA, 12 bp, Homo sapiens
gctatttaagtg

SEQ ID NO: 6262163 - DNA, 20 bp, Homo sapiens
gctatttaagtggactgtat

SEQ ID NO: 6262164 - DNA, 16 bp, Homo sapiens
gctatttaatactaat

SEQ ID NO: 6262165 - DNA, 12 bp, Homo sapiens
gctatttaatat

SEQ ID NO: 6262166 - DNA, 15 bp, Homo sapiens
gctatttatattcat

SEQ ID NO: 6262167 - DNA, 16 bp, Homo sapiens
gctatttatgggcccc

SEQ ID NO: 6262168 - DNA, 15 bp, Homo sapiens
gctatttattttcct

SEQ ID NO: 6262169 - DNA, 16 bp, Homo sapiens
gctatttattttccta

SEQ ID NO: 6262170 - DNA, 22 bp, Homo sapiens
gctatttattttcctaaagaga

SEQ ID NO: 6262171 - DNA, 17 bp, Homo sapiens
gctatttcagcctcctg

SEQ ID NO: 6262172 - DNA, 15 bp, Homo sapiens
gctatttcaggccct

SEQ ID NO: 6262173 - DNA, 14 bp, Homo sapiens
gctatttcatctat

SEQ ID NO: 6262174 - DNA, 16 bp, Homo sapiens
gctatttcatttgctg

SEQ ID NO: 6262175 - DNA, 16 bp, Homo sapiens
gctatttcccaagctg

SEQ ID NO: 6262176 - DNA, 21 bp, Homo sapiens
gctatttcccaagctggagtg

SEQ ID NO: 6262177 - DNA, 19 bp, Homo sapiens
gctatttcccttttctgtg

SEQ ID NO: 6262178 - DNA, 22 bp, Homo sapiens
gctatttccttccagccttttt

SEQ ID NO: 6262179 - DNA, 18 bp, Homo sapiens
gctatttctatattttca

SEQ ID NO: 6262180 - DNA, 19 bp, Homo sapiens
gctatttctatattttcat

SEQ ID NO: 6262181 - DNA, 14 bp, Homo sapiens
gctatttctatgta

SEQ ID NO: 6262182 - DNA, 18 bp, Homo sapiens
gctatttctatgtatgtg

SEQ ID NO: 6262183 - DNA, 15 bp, Homo sapiens
gctatttctggcctc

SEQ ID NO: 6262184 - DNA, 15 bp, Homo sapiens
gctatttctgtgtcc

SEQ ID NO: 6262185 - DNA, 12 bp, Homo sapiens
gctatttgaaat

SEQ ID NO: 6262186 - DNA, 19 bp, Homo sapiens
gctatttgaaatactaaaa

SEQ ID NO: 6262187 - DNA, 20 bp, Homo sapiens
gctatttgaaatactaaaag

SEQ ID NO: 6262188 - DNA, 17 bp, Homo sapiens
gctatttgatgtaatac

SEQ ID NO: 6262189 - DNA, 21 bp, Homo sapiens
gctatttgctttagagacagg

SEQ ID NO: 6262190 - DNA, 15 bp, Homo sapiens
gctatttgtaaatct

SEQ ID NO: 6262191 - DNA, 17 bp, Homo sapiens
gctatttgtaaatctgc

SEQ ID NO: 6262192 - DNA, 17 bp, Homo sapiens
gctatttgtacaaataa

SEQ ID NO: 6262193 - DNA, 18 bp, Homo sapiens
gctatttgtacaaataaa

SEQ ID NO: 6262194 - DNA, 13 bp, Homo sapiens
gctatttgtgtaa

SEQ ID NO: 6262195 - DNA, 13 bp, Homo sapiens
gctatttgttcag

SEQ ID NO: 6262196 - DNA, 22 bp, Homo sapiens
gctatttgtttacatgcagatt

SEQ ID NO: 6262197 - DNA, 21 bp, Homo sapiens
gctattttaaaccaattgcag

SEQ ID NO: 6262198 - DNA, 17 bp, Homo sapiens
gctattttaagccatct

SEQ ID NO: 6262199 - DNA, 16 bp, Homo sapiens
gctattttactgtctt

SEQ ID NO: 6262200 - DNA, 18 bp, Homo sapiens
gctattttatattacact

SEQ ID NO: 6262201 - DNA, 23 bp, Homo sapiens
gctattttatattacactacaca

SEQ ID NO: 6262202 - DNA, 16 bp, Homo sapiens
gctattttcctctggc

SEQ ID NO: 6262203 - DNA, 23 bp, Homo sapiens
gctattttcctctggccgcagag

SEQ ID NO: 6262204 - DNA, 12 bp, Homo sapiens
gctattttcctt

SEQ ID NO: 6262205 - DNA, 17 bp, Homo sapiens
gctattttctaaagact

SEQ ID NO: 6262206 - DNA, 18 bp, Homo sapiens
gctattttctaaagactt

SEQ ID NO: 6262207 - DNA, 16 bp, Homo sapiens
gctattttctgaccaa

SEQ ID NO: 6262208 - DNA, 23 bp, Homo sapiens
gctattttctgaccaaaatgtgt

SEQ ID NO: 6262209 - DNA, 21 bp, Homo sapiens
gctattttcttacagtggagt

SEQ ID NO: 6262210 - DNA, 13 bp, Homo sapiens
gctatttttatac

SEQ ID NO: 6262211 - DNA, 18 bp, Homo sapiens
gctatttttatacactgt

SEQ ID NO: 6262212 - DNA, 20 bp, Homo sapiens
gctatttttatacactgtaa

SEQ ID NO: 6262213 - DNA, 12 bp, Homo sapiens
gctatttttccc

SEQ ID NO: 6262214 - DNA, 18 bp, Homo sapiens
gctattttttatcattga

SEQ ID NO: 6262215 - DNA, 24 bp, Homo sapiens
gctattttttcccttctcttctaa

SEQ ID NO: 6262216 - DNA, 15 bp, Homo sapiens
gctatttttttccta

SEQ ID NO: 6262217 - DNA, 17 bp, Homo sapiens
gctattttttttaaatc

SEQ ID NO: 6262218 - DNA, 20 bp, Homo sapiens
gctattttttttaaatcaaa

SEQ ID NO: 6262219 - DNA, 23 bp, Homo sapiens
gctcaaaacacgataagtttact

SEQ ID NO: 6262220 - DNA, 21 bp, Homo sapiens
gctcaaaataaaaagcctcag

SEQ ID NO: 6262221 - DNA, 20 bp, Homo sapiens
gctcaaaatttgaagaatga

SEQ ID NO: 6262222 - DNA, 20 bp, Homo sapiens
gctcaaacaatgacaaagca

SEQ ID NO: 6262223 - DNA, 15 bp, Homo sapiens
gctcaaagcagcagg

SEQ ID NO: 6262224 - DNA, 20 bp, Homo sapiens
gctcaaatctattcagacaa

SEQ ID NO: 6262225 - DNA, 23 bp, Homo sapiens
gctcaaatctattcagacaagca

SEQ ID NO: 6262226 - DNA, 15 bp, Homo sapiens
gctcaaatgaaatgt

SEQ ID NO: 6262227 - DNA, 16 bp, Homo sapiens
gctcaacaataaaaca

SEQ ID NO: 6262228 - DNA, 19 bp, Homo sapiens
gctcaacagacaattagaa

SEQ ID NO: 6262229 - DNA, 16 bp, Homo sapiens
gctcaaccactgtggc

SEQ ID NO: 6262230 - DNA, 14 bp, Homo sapiens
gctcaaccagacag

SEQ ID NO: 6262231 - DNA, 15 bp, Homo sapiens
gctcaacccccctcc

SEQ ID NO: 6262232 - DNA, 18 bp, Homo sapiens
gctcaacccccctcccag

SEQ ID NO: 6262233 - DNA, 19 bp, Homo sapiens
gctcaacccccctcccaga

SEQ ID NO: 6262234 - DNA, 21 bp, Homo sapiens
gctcaacccccctcccagaca

SEQ ID NO: 6262235 - DNA, 16 bp, Homo sapiens
gctcaacctaccctgg

SEQ ID NO: 6262236 - DNA, 13 bp, Homo sapiens
gctcaacctctca

SEQ ID NO: 6262237 - DNA, 20 bp, Homo sapiens
gctcaacctctcagatccct

SEQ ID NO: 6262238 - DNA, 21 bp, Homo sapiens
gctcaacctctcagatccctc

SEQ ID NO: 6262239 - DNA, 20 bp, Homo sapiens
gctcaacctctctccttctg

SEQ ID NO: 6262240 - DNA, 18 bp, Homo sapiens
gctcaactcacagcttct

SEQ ID NO: 6262241 - DNA, 20 bp, Homo sapiens
gctcaactcacagcttctcc

SEQ ID NO: 6262242 - DNA, 20 bp, Homo sapiens
gctcaactcgggggcgcctg

SEQ ID NO: 6262243 - DNA, 17 bp, Homo sapiens
gctcaagaatcctctgg

SEQ ID NO: 6262244 - DNA, 16 bp, Homo sapiens
gctcaagacaaggctg

SEQ ID NO: 6262245 - DNA, 17 bp, Homo sapiens
gctcaagatgacagctc

SEQ ID NO: 6262246 - DNA, 18 bp, Homo sapiens
gctcaagcaatcctcctg

SEQ ID NO: 6262247 - DNA, 20 bp, Homo sapiens
gctcaagcaatcctcctgcc

SEQ ID NO: 6262248 - DNA, 23 bp, Homo sapiens
gctcaagcaatcctcctgcctca

SEQ ID NO: 6262249 - DNA, 23 bp, Homo sapiens
gctcaagcagcgaccgccccctc

SEQ ID NO: 6262250 - DNA, 19 bp, Homo sapiens
gctcaagcaggaagttcaa

SEQ ID NO: 6262251 - DNA, 22 bp, Homo sapiens
gctcaagcagtctacccacctc

SEQ ID NO: 6262252 - DNA, 17 bp, Homo sapiens
gctcaagcattctgttt

SEQ ID NO: 6262253 - DNA, 17 bp, Homo sapiens
gctcaagcccaggaggg

SEQ ID NO: 6262254 - DNA, 22 bp, Homo sapiens
gctcaagccctgaatttcttct

SEQ ID NO: 6262255 - DNA, 17 bp, Homo sapiens
gctcaagccgtggccgg

SEQ ID NO: 6262256 - DNA, 13 bp, Homo sapiens
gctcaagcttccc

SEQ ID NO: 6262257 - DNA, 19 bp, Homo sapiens
gcacccaccgtggaggagg

SEQ ID NO: 6262258 - DNA, 20 bp, Homo sapiens
gcacccaccgtggaggagga

SEQ ID NO: 6262259 - DNA, 14 bp, Homo sapiens
gcacccacctccac

SEQ ID NO: 6262260 - DNA, 23 bp, Homo sapiens
gcacccactaccatacagacagc

SEQ ID NO: 6262261 - DNA, 18 bp, Homo sapiens
gcacccactcaccagggt

SEQ ID NO: 6262262 - DNA, 15 bp, Homo sapiens
gcacccactcagcca

SEQ ID NO: 6262263 - DNA, 14 bp, Homo sapiens
gcacccactctgct

SEQ ID NO: 6262264 - DNA, 15 bp, Homo sapiens
gcacccactgtgcac

SEQ ID NO: 6262265 - DNA, 17 bp, Homo sapiens
gcacccagaaattcctt

SEQ ID NO: 6262266 - DNA, 12 bp, Homo sapiens
gcacccagaaca

SEQ ID NO: 6262267 - DNA, 22 bp, Homo sapiens
gcacccagagcaccccctgctc

SEQ ID NO: 6262268 - DNA, 19 bp, Homo sapiens
gcacccagcccaaccggga

SEQ ID NO: 6262269 - DNA, 20 bp, Homo sapiens
gcacccagccccaaggggtg

SEQ ID NO: 6262270 - DNA, 15 bp, Homo sapiens
gcacccagccctggt

SEQ ID NO: 6262271 - DNA, 15 bp, Homo sapiens
gcacccaggcctccc

SEQ ID NO: 6262272 - DNA, 17 bp, Homo sapiens
gcacccaggcctccctg

SEQ ID NO: 6262273 - DNA, 17 bp, Homo sapiens
gcacccagggtcccagc

SEQ ID NO: 6262274 - DNA, 17 bp, Homo sapiens
gcacccagtcctctgcc

SEQ ID NO: 6262275 - DNA, 19 bp, Homo sapiens
gcacccagtcctctgcctc

SEQ ID NO: 6262276 - DNA, 18 bp, Homo sapiens
gcacccatcatgccacac

SEQ ID NO: 6262277 - DNA, 15 bp, Homo sapiens
gcacccatcctagag

SEQ ID NO: 6262278 - DNA, 16 bp, Homo sapiens
gcacccatcctagaga

SEQ ID NO: 6262279 - DNA, 13 bp, Homo sapiens
gcacccatgcccc

SEQ ID NO: 6262280 - DNA, 21 bp, Homo sapiens
gcacccatgtgggcgcccacc

SEQ ID NO: 6262281 - DNA, 22 bp, Homo sapiens
gcacccatgtgggcgcccaccc

SEQ ID NO: 6262282 - DNA, 15 bp, Homo sapiens
gcaccccacagctgg

SEQ ID NO: 6262283 - DNA, 16 bp, Homo sapiens
gcaccccacagctggg

SEQ ID NO: 6262284 - DNA, 12 bp, Homo sapiens
gcaccccacagg

SEQ ID NO: 6262285 - DNA, 14 bp, Homo sapiens
gcaccccagcattc

SEQ ID NO: 6262286 - DNA, 22 bp, Homo sapiens
gcaccccagcattccagctctg

SEQ ID NO: 6262287 - DNA, 16 bp, Homo sapiens
gcaccccagcgtcagg

SEQ ID NO: 6262288 - DNA, 19 bp, Homo sapiens
gcaccccagctaccccttc

SEQ ID NO: 6262289 - DNA, 22 bp, Homo sapiens
gcaccccagctggggccaggct

SEQ ID NO: 6262290 - DNA, 13 bp, Homo sapiens
gcaccccaggcag

SEQ ID NO: 6262291 - DNA, 17 bp, Homo sapiens
gcaccccaggcagctcc

SEQ ID NO: 6262292 - DNA, 21 bp, Homo sapiens
gcaccccaggcagctcctgtt

SEQ ID NO: 6262293 - DNA, 19 bp, Homo sapiens
gcaccccatcccaccagcc

SEQ ID NO: 6262294 - DNA, 21 bp, Homo sapiens
gcaccccatcccaccagcccc

SEQ ID NO: 6262295 - DNA, 16 bp, Homo sapiens
gcacccccaaattcaa

SEQ ID NO: 6262296 - DNA, 15 bp, Homo sapiens
gcacccccaagcctg

SEQ ID NO: 6262297 - DNA, 17 bp, Homo sapiens
gcacccccaagcctggg

SEQ ID NO: 6262298 - DNA, 12 bp, Homo sapiens
gcacccccacaa

SEQ ID NO: 6262299 - DNA, 22 bp, Homo sapiens
gcacccccacaagctgtccctg

SEQ ID NO: 6262300 - DNA, 13 bp, Homo sapiens
gcacccccaccca

SEQ ID NO: 6262301 - DNA, 14 bp, Homo sapiens
gcacccccacccac

SEQ ID NO: 6262302 - DNA, 14 bp, Homo sapiens
gcacccccaccctt

SEQ ID NO: 6262303 - DNA, 12 bp, Homo sapiens
gcacccccagcc

SEQ ID NO: 6262304 - DNA, 16 bp, Homo sapiens
gcacccccagcctccc

SEQ ID NO: 6262305 - DNA, 18 bp, Homo sapiens
gcacccccagcctccccc

SEQ ID NO: 6262306 - DNA, 19 bp, Homo sapiens
gcacccccagcctccccca

SEQ ID NO: 6262307 - DNA, 21 bp, Homo sapiens
gcacccccagcctcccccagg

SEQ ID NO: 6262308 - DNA, 13 bp, Homo sapiens
gcacccccatgct

SEQ ID NO: 6262309 - DNA, 14 bp, Homo sapiens
gcaccccccaagct

SEQ ID NO: 6262310 - DNA, 21 bp, Homo sapiens
gcacccccctgggctgagaga

SEQ ID NO: 6262311 - DNA, 20 bp, Homo sapiens
gcacccccctgtgcctgctg

SEQ ID NO: 6262312 - DNA, 17 bp, Homo sapiens
gcacccccctgttctaa

SEQ ID NO: 6262313 - DNA, 16 bp, Homo sapiens
gcacccccgcaccctt

SEQ ID NO: 6262314 - DNA, 13 bp, Homo sapiens
gcacccccgccag

SEQ ID NO: 6262315 - DNA, 14 bp, Homo sapiens
gcacccccgccagg

SEQ ID NO: 6262316 - DNA, 18 bp, Homo sapiens
gcacccccgccaggcgca

SEQ ID NO: 6262317 - DNA, 22 bp, Homo sapiens
gcaccccctcccttctgggaaa

SEQ ID NO: 6262318 - DNA, 12 bp, Homo sapiens
gcaccccctcct

SEQ ID NO: 6262319 - DNA, 14 bp, Homo sapiens
gcaccccctgcagc

SEQ ID NO: 6262320 - DNA, 24 bp, Homo sapiens
gcaccccctgcagcttgtagccag

SEQ ID NO: 6262321 - DNA, 19 bp, Homo sapiens
gcaccccctgctccaccag

SEQ ID NO: 6262322 - DNA, 18 bp, Homo sapiens
gcaccccctggcttgaac

SEQ ID NO: 6262323 - DNA, 18 bp, Homo sapiens
gcaccccgatgtggacct

SEQ ID NO: 6262324 - DNA, 17 bp, Homo sapiens
gcaccccgcccctgcat

SEQ ID NO: 6262325 - DNA, 20 bp, Homo sapiens
gcaccccgcccctgcatgcc

SEQ ID NO: 6262326 - DNA, 21 bp, Homo sapiens
gcaccccgcccctgcatgcct

SEQ ID NO: 6262327 - DNA, 23 bp, Homo sapiens
gcaccccgccggaggaaggtccc

SEQ ID NO: 6262328 - DNA, 14 bp, Homo sapiens
gcaccccgctgcgg

SEQ ID NO: 6262329 - DNA, 21 bp, Homo sapiens
gcaccccggatcgaggacaag

SEQ ID NO: 6262330 - DNA, 15 bp, Homo sapiens
gcaccccggcctcag

SEQ ID NO: 6262331 - DNA, 16 bp, Homo sapiens
gcaccccggcctcagg

SEQ ID NO: 6262332 - DNA, 18 bp, Homo sapiens
gcaccccggcctcagggc

SEQ ID NO: 6262333 - DNA, 22 bp, Homo sapiens
gcacccctccagttttgcctga

SEQ ID NO: 6262334 - DNA, 13 bp, Homo sapiens
gcacccctcccag

SEQ ID NO: 6262335 - DNA, 13 bp, Homo sapiens
gcacccctccctg

SEQ ID NO: 6262336 - DNA, 20 bp, Homo sapiens
gcacccctccgtgtggagca

SEQ ID NO: 6262337 - DNA, 12 bp, Homo sapiens
gcacccctgcct

SEQ ID NO: 6262338 - DNA, 20 bp, Homo sapiens
gcacccctggtgtccctgcc

SEQ ID NO: 6262339 - DNA, 23 bp, Homo sapiens
gcacccctggtgtccctgcctgg

SEQ ID NO: 6262340 - DNA, 17 bp, Homo sapiens
gcaccccttctctcctc

SEQ ID NO: 6262341 - DNA, 18 bp, Homo sapiens
gcaccccttctctcctcc

SEQ ID NO: 6262342 - DNA, 19 bp, Homo sapiens
gcaccccttctctcctccc

SEQ ID NO: 6262343 - DNA, 16 bp, Homo sapiens
gcacccctttccccag

SEQ ID NO: 6262344 - DNA, 18 bp, Homo sapiens
gcacccctttccccagcc

SEQ ID NO: 6262345 - DNA, 19 bp, Homo sapiens
gcacccctttcctccccat

SEQ ID NO: 6262346 - DNA, 23 bp, Homo sapiens
gcacccgcatgtacaaaaacaca

SEQ ID NO: 6262347 - DNA, 15 bp, Homo sapiens
gcacccgcctctccc

SEQ ID NO: 6262348 - DNA, 16 bp, Homo sapiens
gcacccgcctctcccg

SEQ ID NO: 6262349 - DNA, 20 bp, Homo sapiens
gcacccgcggcccgcgcagc

SEQ ID NO: 6262350 - DNA, 16 bp, Homo sapiens
gcacccggcagccccc

SEQ ID NO: 6262351 - DNA, 21 bp, Homo sapiens
gcacccggcagccccccagtg

SEQ ID NO: 6262352 - DNA, 23 bp, Homo sapiens
gcacccggcagccccccagtgtc

SEQ ID NO: 6262353 - DNA, 17 bp, Homo sapiens
gcacccggcccctgctg

SEQ ID NO: 6262354 - DNA, 13 bp, Homo sapiens
gcacccggctcgt

SEQ ID NO: 6262355 - DNA, 21 bp, Homo sapiens
gcacccgggctcagggaccac

SEQ ID NO: 6262356 - DNA, 21 bp, Homo sapiens
gcacccggggccagagacata

SEQ ID NO: 6262357 - DNA, 16 bp, Homo sapiens
gcacccggtcagtcag

SEQ ID NO: 6262358 - DNA, 16 bp, Homo sapiens
gcacccggtcccctct

SEQ ID NO: 6262359 - DNA, 17 bp, Homo sapiens
gcacccggtcccctctg

SEQ ID NO: 6262360 - DNA, 23 bp, Homo sapiens
gcacccgtacccccgtggtcttt

SEQ ID NO: 6262361 - DNA, 15 bp, Homo sapiens
gcacccgtatctgcc

SEQ ID NO: 6262362 - DNA, 17 bp, Homo sapiens
gcacccgtatctgccct

SEQ ID NO: 6262363 - DNA, 13 bp, Homo sapiens
gcacccgtcccca

SEQ ID NO: 6262364 - DNA, 18 bp, Homo sapiens
gcaccctaggcagcctgc

SEQ ID NO: 6262365 - DNA, 14 bp, Homo sapiens
gcaccctataaatc

SEQ ID NO: 6262366 - DNA, 19 bp, Homo sapiens
gcaccctcaggcaggtggg

SEQ ID NO: 6262367 - DNA, 23 bp, Homo sapiens
gcaccctcattccctcgggaccc

SEQ ID NO: 6262368 - DNA, 18 bp, Homo sapiens
gcaccctccacaggagcc

SEQ ID NO: 6262369 - DNA, 18 bp, Homo sapiens
gcaccctccaccctgtcc

SEQ ID NO: 6262370 - DNA, 22 bp, Homo sapiens
gcaccctccaccctgtccccca

SEQ ID NO: 6262371 - DNA, 15 bp, Homo sapiens
gcaccctcccctccc

SEQ ID NO: 6262372 - DNA, 15 bp, Homo sapiens
gcaccctccctagct

SEQ ID NO: 6262373 - DNA, 15 bp, Homo sapiens
gcaccctccctcctg

SEQ ID NO: 6262374 - DNA, 15 bp, Homo sapiens
gcaccctctcctggg

SEQ ID NO: 6262375 - DNA, 11 bp, Homo sapiens
gcaccctgagg

SEQ ID NO: 6262376 - DNA, 13 bp, Homo sapiens
gcaccctgagggc

SEQ ID NO: 6262377 - DNA, 13 bp, Homo sapiens
gcaccctgcacct

SEQ ID NO: 6262378 - DNA, 13 bp, Homo sapiens
gcaccctgcagag

SEQ ID NO: 6262379 - DNA, 21 bp, Homo sapiens
gcaccctgcagagcacacagg

SEQ ID NO: 6262380 - DNA, 18 bp, Homo sapiens
gcaccctgccctcatggg

SEQ ID NO: 6262381 - DNA, 21 bp, Homo sapiens
gcaccctgccctcatgggacc

SEQ ID NO: 6262382 - DNA, 20 bp, Homo sapiens
gcaccctgcctacgccagga

SEQ ID NO: 6262383 - DNA, 14 bp, Homo sapiens
gcaccctggaaccg

SEQ ID NO: 6262384 - DNA, 23 bp, Homo sapiens
gcaccctggaaccgggaagggtg

SEQ ID NO: 6262385 - DNA, 13 bp, Homo sapiens
gcaccctggcctg

SEQ ID NO: 6262386 - DNA, 19 bp, Homo sapiens
gcaccctggcctggtccct

SEQ ID NO: 6262387 - DNA, 14 bp, Homo sapiens
gcaccctggctgga

SEQ ID NO: 6262388 - DNA, 14 bp, Homo sapiens
gcaccctggggcct

SEQ ID NO: 6262389 - DNA, 12 bp, Homo sapiens
gcaccctgggtg

SEQ ID NO: 6262390 - DNA, 14 bp, Homo sapiens
gcaccctggtctgt

SEQ ID NO: 6262391 - DNA, 16 bp, Homo sapiens
gcaccctgtagatgtt

SEQ ID NO: 6262392 - DNA, 15 bp, Homo sapiens
gcaccctgtcctgca

SEQ ID NO: 6262393 - DNA, 21 bp, Homo sapiens
gcaccctgtcctgcacaccct

SEQ ID NO: 6262394 - DNA, 16 bp, Homo sapiens
gcaccctgttccctct

SEQ ID NO: 6262395 - DNA, 14 bp, Homo sapiens
gcacccttaaaact

SEQ ID NO: 6262396 - DNA, 17 bp, Homo sapiens
gcacccttaagaaggta

SEQ ID NO: 6262397 - DNA, 16 bp, Homo sapiens
gcacccttccacagct

SEQ ID NO: 6262398 - DNA, 14 bp, Homo sapiens
gcacccttccctct

SEQ ID NO: 6262399 - DNA, 17 bp, Homo sapiens
gcacccttctttcctct

SEQ ID NO: 6262400 - DNA, 19 bp, Homo sapiens
gcacccttctttcctcttc

SEQ ID NO: 6262401 - DNA, 14 bp, Homo sapiens
gcaccgaagcccag

SEQ ID NO: 6262402 - DNA, 13 bp, Homo sapiens
gcaccgaccacgg

SEQ ID NO: 6262403 - DNA, 21 bp, Homo sapiens
gcaccgaccacggggccgaca

SEQ ID NO: 6262404 - DNA, 19 bp, Homo sapiens
gcaccgaccccgggccgga

SEQ ID NO: 6262405 - DNA, 19 bp, Homo sapiens
gcaccgactagacacacaa

SEQ ID NO: 6262406 - DNA, 22 bp, Homo sapiens
gcaccgacttcaatttcccacc

SEQ ID NO: 6262407 - DNA, 23 bp, Homo sapiens
gcaccgagaactcgaagcccttc

SEQ ID NO: 6262408 - DNA, 17 bp, Homo sapiens
gcaccgcagcatgtggg

SEQ ID NO: 6262409 - DNA, 14 bp, Homo sapiens
gcaccgcagcctct

SEQ ID NO: 6262410 - DNA, 14 bp, Homo sapiens
gcaccgcagcctgt

SEQ ID NO: 6262411 - DNA, 15 bp, Homo sapiens
gcaccgcagcctgtc

SEQ ID NO: 6262412 - DNA, 19 bp, Homo sapiens
gcaccgcagcctgtcagcc

SEQ ID NO: 6262413 - DNA, 18 bp, Homo sapiens
gcaccgccacgtcccagc

SEQ ID NO: 6262414 - DNA, 15 bp, Homo sapiens
gcaccgcccaacccc

SEQ ID NO: 6262415 - DNA, 23 bp, Homo sapiens
gcaccgcccaacccccacctccc

SEQ ID NO: 6262416 - DNA, 14 bp, Homo sapiens
gcaccgcccaccca

SEQ ID NO: 6262417 - DNA, 19 bp, Homo sapiens
gcaccgccgcagaagcagc

SEQ ID NO: 6262418 - DNA, 19 bp, Homo sapiens
gcaccgccgccaccagccc

SEQ ID NO: 6262419 - DNA, 15 bp, Homo sapiens
gcaccgcctgaaggc

SEQ ID NO: 6262420 - DNA, 13 bp, Homo sapiens
gcaccgcctgccc

SEQ ID NO: 6262421 - DNA, 20 bp, Homo sapiens
gcaccgcctgccctcccgca

SEQ ID NO: 6262422 - DNA, 14 bp, Homo sapiens
gcaccgccttctct

SEQ ID NO: 6262423 - DNA, 20 bp, Homo sapiens
gcaccgcttttgttctcgca

SEQ ID NO: 6262424 - DNA, 22 bp, Homo sapiens
gcaccgcttttgttctcgcaaa

SEQ ID NO: 6262425 - DNA, 19 bp, Homo sapiens
gcaccggacgctggagacc

SEQ ID NO: 6262426 - DNA, 20 bp, Homo sapiens
gcaccggacgctggagaccc

SEQ ID NO: 6262427 - DNA, 15 bp, Homo sapiens
gcaccggcgctgcag

SEQ ID NO: 6262428 - DNA, 16 bp, Homo sapiens
gcaccggcgctgcagg

SEQ ID NO: 6262429 - DNA, 18 bp, Homo sapiens
gcaccggcgctgcaggta

SEQ ID NO: 6262430 - DNA, 17 bp, Homo sapiens
gcaccggctgcccacag

SEQ ID NO: 6262431 - DNA, 13 bp, Homo sapiens
gcaccgggacccc

SEQ ID NO: 6262432 - DNA, 15 bp, Homo sapiens
gcaccgggaccccct

SEQ ID NO: 6262433 - DNA, 16 bp, Homo sapiens
gcaccgggctccatgc

SEQ ID NO: 6262434 - DNA, 18 bp, Homo sapiens
gcaccgggctccatgcct

SEQ ID NO: 6262435 - DNA, 15 bp, Homo sapiens
gcaccgggctggcct

SEQ ID NO: 6262436 - DNA, 18 bp, Homo sapiens
gcaccgggctggcctgac

SEQ ID NO: 6262437 - DNA, 12 bp, Homo sapiens
gctcaagctttc

SEQ ID NO: 6262438 - DNA, 13 bp, Homo sapiens
gctcaaggaaagg

SEQ ID NO: 6262439 - DNA, 23 bp, Homo sapiens
gctcaaggaaagggggtcccagt

SEQ ID NO: 6262440 - DNA, 18 bp, Homo sapiens
gctcaaggcaatgggcta

SEQ ID NO: 6262441 - DNA, 19 bp, Homo sapiens
gctcaaggcaatgggctac

SEQ ID NO: 6262442 - DNA, 17 bp, Homo sapiens
gctcaaggcgtgaggat

SEQ ID NO: 6262443 - DNA, 21 bp, Homo sapiens
gctcaagggagtaagtagagg

SEQ ID NO: 6262444 - DNA, 15 bp, Homo sapiens
gctcaagggctggca

SEQ ID NO: 6262445 - DNA, 19 bp, Homo sapiens
gctcaagtctgcacagagc

SEQ ID NO: 6262446 - DNA, 17 bp, Homo sapiens
gctcaagtcttccctga

SEQ ID NO: 6262447 - DNA, 14 bp, Homo sapiens
gctcaagtgatcct

SEQ ID NO: 6262448 - DNA, 16 bp, Homo sapiens
gctcaagtttaaaagc

SEQ ID NO: 6262449 - DNA, 18 bp, Homo sapiens
gctcaagtttcagagtca

SEQ ID NO: 6262450 - DNA, 18 bp, Homo sapiens
gctcaataaaagaatctg

SEQ ID NO: 6262451 - DNA, 12 bp, Homo sapiens
gctcaataaact

SEQ ID NO: 6262452 - DNA, 17 bp, Homo sapiens
gctcaataaacttgtgc

SEQ ID NO: 6262453 - DNA, 14 bp, Homo sapiens
gctcaataaaggtc

SEQ ID NO: 6262454 - DNA, 14 bp, Homo sapiens
gctcaatcctctaa

SEQ ID NO: 6262455 - DNA, 23 bp, Homo sapiens
gctcaatctctgttgcacctgag

SEQ ID NO: 6262456 - DNA, 19 bp, Homo sapiens
gctcaatgaaaccttcctc

SEQ ID NO: 6262457 - DNA, 13 bp, Homo sapiens
gctcaatgagcat

SEQ ID NO: 6262458 - DNA, 14 bp, Homo sapiens
gctcaatgagcatg

SEQ ID NO: 6262459 - DNA, 22 bp, Homo sapiens
gctcaattcaagtgacacatta

SEQ ID NO: 6262460 - DNA, 14 bp, Homo sapiens
gctcaattgttaat

SEQ ID NO: 6262461 - DNA, 15 bp, Homo sapiens
gctcaatttcagcac

SEQ ID NO: 6262462 - DNA, 17 bp, Homo sapiens
gctcacaactgtttttg

SEQ ID NO: 6262463 - DNA, 16 bp, Homo sapiens
gctcacaagcccaggc

SEQ ID NO: 6262464 - DNA, 19 bp, Homo sapiens
gctcacaagccgtgtttta

SEQ ID NO: 6262465 - DNA, 15 bp, Homo sapiens
gctcacaaggcagca

SEQ ID NO: 6262466 - DNA, 22 bp, Homo sapiens
gctcacaaggcagcaaggcccg

SEQ ID NO: 6262467 - DNA, 19 bp, Homo sapiens
gctcacaaggcccaggaga

SEQ ID NO: 6262468 - DNA, 13 bp, Homo sapiens
gctcacacacctg

SEQ ID NO: 6262469 - DNA, 15 bp, Homo sapiens
gctcacaccagccct

SEQ ID NO: 6262470 - DNA, 22 bp, Homo sapiens
gctcacaccccattggtggact

SEQ ID NO: 6262471 - DNA, 19 bp, Homo sapiens
gctcacaccctaccttccc

SEQ ID NO: 6262472 - DNA, 22 bp, Homo sapiens
gctcacaccctaccttccccag

SEQ ID NO: 6262473 - DNA, 21 bp, Homo sapiens
gctcacacctgcaatcccagc

SEQ ID NO: 6262474 - DNA, 12 bp, Homo sapiens
gctcacacctgt

SEQ ID NO: 6262475 - DNA, 13 bp, Homo sapiens
gctcacacctgta

SEQ ID NO: 6262476 - DNA, 23 bp, Homo sapiens
gctcacactgatgggctggggca

SEQ ID NO: 6262477 - DNA, 14 bp, Homo sapiens
gctcacacttgggc

SEQ ID NO: 6262478 - DNA, 17 bp, Homo sapiens
gctcacacttgggctgg

SEQ ID NO: 6262479 - DNA, 11 bp, Homo sapiens
gctcacagcac

SEQ ID NO: 6262480 - DNA, 11 bp, Homo sapiens
gctcacagcca

SEQ ID NO: 6262481 - DNA, 11 bp, Homo sapiens
gctcacaggcc

SEQ ID NO: 6262482 - DNA, 17 bp, Homo sapiens
gctcacaggcctctctt

SEQ ID NO: 6262483 - DNA, 14 bp, Homo sapiens
gctcacagggatgc

SEQ ID NO: 6262484 - DNA, 12 bp, Homo sapiens
gctcacagggca

SEQ ID NO: 6262485 - DNA, 15 bp, Homo sapiens
gctcacagtacagca

SEQ ID NO: 6262486 - DNA, 16 bp, Homo sapiens
gctcacatatctgtca

SEQ ID NO: 6262487 - DNA, 23 bp, Homo sapiens
gctcacattccctctcatccagg

SEQ ID NO: 6262488 - DNA, 18 bp, Homo sapiens
gctcaccacaacctccac

SEQ ID NO: 6262489 - DNA, 14 bp, Homo sapiens
gctcaccacctgcc

SEQ ID NO: 6262490 - DNA, 15 bp, Homo sapiens
gctcaccacctgcct

SEQ ID NO: 6262491 - DNA, 12 bp, Homo sapiens
gctcaccagccc

SEQ ID NO: 6262492 - DNA, 13 bp, Homo sapiens
gctcaccagcccc

SEQ ID NO: 6262493 - DNA, 18 bp, Homo sapiens
gctcaccagccccagtgc

SEQ ID NO: 6262494 - DNA, 14 bp, Homo sapiens
gctcaccagccctg

SEQ ID NO: 6262495 - DNA, 15 bp, Homo sapiens
gctcaccagccctgc

SEQ ID NO: 6262496 - DNA, 18 bp, Homo sapiens
gctcaccagccctgcagc

SEQ ID NO: 6262497 - DNA, 21 bp, Homo sapiens
gctcaccagccctgcagccca

SEQ ID NO: 6262498 - DNA, 15 bp, Homo sapiens
gctcaccaggcctgg

SEQ ID NO: 6262499 - DNA, 16 bp, Homo sapiens
gctcaccaggcctggc

SEQ ID NO: 6262500 - DNA, 21 bp, Homo sapiens
gctcaccaggcctggcctctg

SEQ ID NO: 6262501 - DNA, 14 bp, Homo sapiens
gctcacccacctct

SEQ ID NO: 6262502 - DNA, 13 bp, Homo sapiens
gctcacccaggac

SEQ ID NO: 6262503 - DNA, 18 bp, Homo sapiens
gctcacccaggacctctg

SEQ ID NO: 6262504 - DNA, 13 bp, Homo sapiens
gctcacccagtca

SEQ ID NO: 6262505 - DNA, 16 bp, Homo sapiens
gctcacccagtcacct

SEQ ID NO: 6262506 - DNA, 19 bp, Homo sapiens
gctcacccattgtctcatt

SEQ ID NO: 6262507 - DNA, 16 bp, Homo sapiens
gctcaccccccacact

SEQ ID NO: 6262508 - DNA, 16 bp, Homo sapiens
gctcacccccttctcc

SEQ ID NO: 6262509 - DNA, 22 bp, Homo sapiens
gctcacccccttctccatccac

SEQ ID NO: 6262510 - DNA, 11 bp, Homo sapiens
gctcacccctg

SEQ ID NO: 6262511 - DNA, 20 bp, Homo sapiens
gctcaccctctcttggtgca

SEQ ID NO: 6262512 - DNA, 17 bp, Homo sapiens
gctcaccctgcccgctc

SEQ ID NO: 6262513 - DNA, 21 bp, Homo sapiens
gctcaccctgcccgctcccaa

SEQ ID NO: 6262514 - DNA, 14 bp, Homo sapiens
gctcaccctgctcc

SEQ ID NO: 6262515 - DNA, 15 bp, Homo sapiens
gctcaccgactcacc

SEQ ID NO: 6262516 - DNA, 17 bp, Homo sapiens
gctcaccgactcacctg

SEQ ID NO: 6262517 - DNA, 17 bp, Homo sapiens
gctcaccgcccatcagg

SEQ ID NO: 6262518 - DNA, 15 bp, Homo sapiens
gctcaccgccctgct

SEQ ID NO: 6262519 - DNA, 21 bp, Homo sapiens
gctcaccgctggcccttagag

SEQ ID NO: 6262520 - DNA, 13 bp, Homo sapiens
gctcacctagagc

SEQ ID NO: 6262521 - DNA, 14 bp, Homo sapiens
gctcacctagagcc

SEQ ID NO: 6262522 - DNA, 16 bp, Homo sapiens
gctcacctagagccag

SEQ ID NO: 6262523 - DNA, 19 bp, Homo sapiens
gctcacctagagccagacc

SEQ ID NO: 6262524 - DNA, 14 bp, Homo sapiens
gctcacctcaacct

SEQ ID NO: 6262525 - DNA, 16 bp, Homo sapiens
gctcacctctcccttg

SEQ ID NO: 6262526 - DNA, 17 bp, Homo sapiens
gctcacctctcccttgg

SEQ ID NO: 6262527 - DNA, 14 bp, Homo sapiens
gctcacctctgaag

SEQ ID NO: 6262528 - DNA, 17 bp, Homo sapiens
gctcacctgcagcccct

SEQ ID NO: 6262529 - DNA, 11 bp, Homo sapiens
gctcacctggg

SEQ ID NO: 6262530 - DNA, 17 bp, Homo sapiens
gctcacctgtgtgccca

SEQ ID NO: 6262531 - DNA, 20 bp, Homo sapiens
gctcacctgtgtgcccagca

SEQ ID NO: 6262532 - DNA, 18 bp, Homo sapiens
gctcaccttaaaggtcaa

SEQ ID NO: 6262533 - DNA, 13 bp, Homo sapiens
gctcacctttgtt

SEQ ID NO: 6262534 - DNA, 16 bp, Homo sapiens
gctcacgactcttcct

SEQ ID NO: 6262535 - DNA, 19 bp, Homo sapiens
gctcacgactcttcctgca

SEQ ID NO: 6262536 - DNA, 17 bp, Homo sapiens
gctcacgccccgctgtg

SEQ ID NO: 6262537 - DNA, 18 bp, Homo sapiens
gctcacgccccgctgtgt

SEQ ID NO: 6262538 - DNA, 19 bp, Homo sapiens
gctcacgccccgctgtgtc

SEQ ID NO: 6262539 - DNA, 17 bp, Homo sapiens
gctcacgcctgtaatcc

SEQ ID NO: 6262540 - DNA, 20 bp, Homo sapiens
gctcacgcctgtaatcccag

SEQ ID NO: 6262541 - DNA, 23 bp, Homo sapiens
gctcacgctcccccgcagtcccc

SEQ ID NO: 6262542 - DNA, 24 bp, Homo sapiens
gctcacgctgacagcctcctaggc

SEQ ID NO: 6262543 - DNA, 18 bp, Homo sapiens
gctcacgcttcacagtga

SEQ ID NO: 6262544 - DNA, 20 bp, Homo sapiens
gctcacgtcctgagaaagct

SEQ ID NO: 6262545 - DNA, 21 bp, Homo sapiens
gctcacgtctctgccgcctgc

SEQ ID NO: 6262546 - DNA, 15 bp, Homo sapiens
gctcacgtgtgtgac

SEQ ID NO: 6262547 - DNA, 17 bp, Homo sapiens
gctcactacatgggcca

SEQ ID NO: 6262548 - DNA, 22 bp, Homo sapiens
gctcactacatgggccagccct

SEQ ID NO: 6262549 - DNA, 21 bp, Homo sapiens
gctcactacctcctcagggat

SEQ ID NO: 6262550 - DNA, 15 bp, Homo sapiens
gctcactactgaaca

SEQ ID NO: 6262551 - DNA, 14 bp, Homo sapiens
gctcactatgaatc

SEQ ID NO: 6262552 - DNA, 20 bp, Homo sapiens
gctcactcactcactccaag

SEQ ID NO: 6262553 - DNA, 14 bp, Homo sapiens
gctcactcagcact

SEQ ID NO: 6262554 - DNA, 13 bp, Homo sapiens
gctcactccaggt

SEQ ID NO: 6262555 - DNA, 20 bp, Homo sapiens
gctcactcccaagggacagc

SEQ ID NO: 6262556 - DNA, 23 bp, Homo sapiens
gctcactccctaaagccctcttc

SEQ ID NO: 6262557 - DNA, 20 bp, Homo sapiens
gctcactgaaacctctgcct

SEQ ID NO: 6262558 - DNA, 22 bp, Homo sapiens
gctcactgaactccttccccac

SEQ ID NO: 6262559 - DNA, 13 bp, Homo sapiens
gctcactgcaaat

SEQ ID NO: 6262560 - DNA, 19 bp, Homo sapiens
gctcactgcaacctccgcc

SEQ ID NO: 6262561 - DNA, 20 bp, Homo sapiens
gctcactgcaagctctgcct

SEQ ID NO: 6262562 - DNA, 11 bp, Homo sapiens
gctcactgcag

SEQ ID NO: 6262563 - DNA, 12 bp, Homo sapiens
gctcactgcagc

SEQ ID NO: 6262564 - DNA, 15 bp, Homo sapiens
gctcactgcagcctc

SEQ ID NO: 6262565 - DNA, 17 bp, Homo sapiens
gctcactgcagcctcaa

SEQ ID NO: 6262566 - DNA, 18 bp, Homo sapiens
gctcactgcagcctcata

SEQ ID NO: 6262567 - DNA, 15 bp, Homo sapiens
gctcactgcaggcat

SEQ ID NO: 6262568 - DNA, 22 bp, Homo sapiens
gctcactgcaggcatgctgaac

SEQ ID NO: 6262569 - DNA, 17 bp, Homo sapiens
gctcactggcaggtgtg

SEQ ID NO: 6262570 - DNA, 16 bp, Homo sapiens
gctcactggctgggag

SEQ ID NO: 6262571 - DNA, 19 bp, Homo sapiens
gctcactgtggtgtctgtg

SEQ ID NO: 6262572 - DNA, 20 bp, Homo sapiens
gctcactgtgtataggaatt

SEQ ID NO: 6262573 - DNA, 24 bp, Homo sapiens
gctcacttctaataactgcagtgt

SEQ ID NO: 6262574 - DNA, 23 bp, Homo sapiens
gctcacttctgggcttcatctgg

SEQ ID NO: 6262575 - DNA, 22 bp, Homo sapiens
gctcacttttcatccttcccca

SEQ ID NO: 6262576 - DNA, 23 bp, Homo sapiens
gctcacttttcatccttccccaa

SEQ ID NO: 6262577 - DNA, 16 bp, Homo sapiens
gctcacttttgtgaaa

SEQ ID NO: 6262578 - DNA, 15 bp, Homo sapiens
gctcactttttcata

SEQ ID NO: 6262579 - DNA, 23 bp, Homo sapiens
gctcagaacccagggctctgccc

SEQ ID NO: 6262580 - DNA, 20 bp, Homo sapiens
gctcagaacttgctgctgtc

SEQ ID NO: 6262581 - DNA, 11 bp, Homo sapiens
gctcagaagag

SEQ ID NO: 6262582 - DNA, 14 bp, Homo sapiens
gctcagaagagcag

SEQ ID NO: 6262583 - DNA, 18 bp, Homo sapiens
gctcagaagtttcttctt

SEQ ID NO: 6262584 - DNA, 20 bp, Homo sapiens
gctcagaataaggcaggcat

SEQ ID NO: 6262585 - DNA, 21 bp, Homo sapiens
gctcagaatagatctgatggt

SEQ ID NO: 6262586 - DNA, 22 bp, Homo sapiens
gctcagaatccaagtgaacact

SEQ ID NO: 6262587 - DNA, 21 bp, Homo sapiens
gctcagacatgttttccgtga

SEQ ID NO: 6262588 - DNA, 14 bp, Homo sapiens
gctcagaccccacc

SEQ ID NO: 6262589 - DNA, 15 bp, Homo sapiens
gctcagacccccact

SEQ ID NO: 6262590 - DNA, 19 bp, Homo sapiens
gctcagacccccactctca

SEQ ID NO: 6262591 - DNA, 23 bp, Homo sapiens
gctcagacccctcagccccagcc

SEQ ID NO: 6262592 - DNA, 17 bp, Homo sapiens
gctcagacgagacaccc

SEQ ID NO: 6262593 - DNA, 22 bp, Homo sapiens
gctcagacgagacaccctaact

SEQ ID NO: 6262594 - DNA, 22 bp, Homo sapiens
gctcagacggcggccaggcaca

SEQ ID NO: 6262595 - DNA, 15 bp, Homo sapiens
gctcagagaggacaa

SEQ ID NO: 6262596 - DNA, 13 bp, Homo sapiens
gctcagagagggc

SEQ ID NO: 6262597 - DNA, 18 bp, Homo sapiens
gctcagagagggcaggca

SEQ ID NO: 6262598 - DNA, 18 bp, Homo sapiens
gctcagagagggtgggag

SEQ ID NO: 6262599 - DNA, 16 bp, Homo sapiens
gctcagagcagtgttt

SEQ ID NO: 6262600 - DNA, 14 bp, Homo sapiens
gctcagagccaagg

SEQ ID NO: 6262601 - DNA, 14 bp, Homo sapiens
gctcagagccccgc

SEQ ID NO: 6262602 - DNA, 15 bp, Homo sapiens
gctcagagccccgcc

SEQ ID NO: 6262603 - DNA, 12 bp, Homo sapiens
gctcagagctgc

SEQ ID NO: 6262604 - DNA, 16 bp, Homo sapiens
gctcagagcttgaaga

SEQ ID NO: 6262605 - DNA, 18 bp, Homo sapiens
gctcagagcttgaagatt

SEQ ID NO: 6262606 - DNA, 17 bp, Homo sapiens
gctcagagctttgtcac

SEQ ID NO: 6262607 - DNA, 19 bp, Homo sapiens
gctcagagctttgtcactt

SEQ ID NO: 6262608 - DNA, 23 bp, Homo sapiens
gctcagagctttgtcacttgcca

SEQ ID NO: 6262609 - DNA, 13 bp, Homo sapiens
gctcagaggagag

SEQ ID NO: 6262610 - DNA, 14 bp, Homo sapiens
gctcagaggagagg

SEQ ID NO: 6262611 - DNA, 12 bp, Homo sapiens
gctcagaggccc

SEQ ID NO: 6262612 - DNA, 20 bp, Homo sapiens
gctcagaggcgcactgtgac

SEQ ID NO: 6262613 - DNA, 23 bp, Homo sapiens
gctcagagggttgttctcctaga

SEQ ID NO: 6262614 - DNA, 17 bp, Homo sapiens
gctcagagtaggtgggt

SEQ ID NO: 6262615 - DNA, 15 bp, Homo sapiens
gctcagagtccaatg

SEQ ID NO: 6262616 - DNA, 17 bp, Homo sapiens
gctcagagtgaagagtg

SEQ ID NO: 6262617 - DNA, 15 bp, Homo sapiens
gcaccgggctggctg

SEQ ID NO: 6262618 - DNA, 17 bp, Homo sapiens
gcaccgggctggctgct

SEQ ID NO: 6262619 - DNA, 21 bp, Homo sapiens
gcaccggggaacaatttctct

SEQ ID NO: 6262620 - DNA, 22 bp, Homo sapiens
gcaccggggaacaatttctctg

SEQ ID NO: 6262621 - DNA, 14 bp, Homo sapiens
gcaccggggcctgg

SEQ ID NO: 6262622 - DNA, 14 bp, Homo sapiens
gcaccgtactgtgg

SEQ ID NO: 6262623 - DNA, 13 bp, Homo sapiens
gcaccgtattcct

SEQ ID NO: 6262624 - DNA, 17 bp, Homo sapiens
gcaccgtccaggcccca

SEQ ID NO: 6262625 - DNA, 21 bp, Homo sapiens
gcaccgtcctcagcagtccac

SEQ ID NO: 6262626 - DNA, 16 bp, Homo sapiens
gcaccgtgatggagag

SEQ ID NO: 6262627 - DNA, 22 bp, Homo sapiens
gcaccgtgccaaccccacccag

SEQ ID NO: 6262628 - DNA, 18 bp, Homo sapiens
gcaccgtgctgggctccc

SEQ ID NO: 6262629 - DNA, 17 bp, Homo sapiens
gcaccgtggtgtgaggc

SEQ ID NO: 6262630 - DNA, 17 bp, Homo sapiens
gcaccgtgtcctcctct

SEQ ID NO: 6262631 - DNA, 14 bp, Homo sapiens
gcaccgttctgtgc

SEQ ID NO: 6262632 - DNA, 15 bp, Homo sapiens
gcaccgttctgtgca

SEQ ID NO: 6262633 - DNA, 20 bp, Homo sapiens
gcacctaaaacccaaaggtg

SEQ ID NO: 6262634 - DNA, 21 bp, Homo sapiens
gcacctaaaccaccagtgccc

SEQ ID NO: 6262635 - DNA, 17 bp, Homo sapiens
gcacctaaagaaaaaca

SEQ ID NO: 6262636 - DNA, 18 bp, Homo sapiens
gcacctaaagcagccagc

SEQ ID NO: 6262637 - DNA, 23 bp, Homo sapiens
gcacctaatccaggcagatccag

SEQ ID NO: 6262638 - DNA, 19 bp, Homo sapiens
gcacctacatccccaggtc

SEQ ID NO: 6262639 - DNA, 17 bp, Homo sapiens
gcacctaccatcaggga

SEQ ID NO: 6262640 - DNA, 23 bp, Homo sapiens
gcacctaccatcagggacaggat

SEQ ID NO: 6262641 - DNA, 14 bp, Homo sapiens
gcacctacgggggc

SEQ ID NO: 6262642 - DNA, 17 bp, Homo sapiens
gcacctactatgtgctg

SEQ ID NO: 6262643 - DNA, 22 bp, Homo sapiens
gcacctactatgtgctgggtgc

SEQ ID NO: 6262644 - DNA, 14 bp, Homo sapiens
gcacctacttacat

SEQ ID NO: 6262645 - DNA, 14 bp, Homo sapiens
gcacctaggtgggg

SEQ ID NO: 6262646 - DNA, 19 bp, Homo sapiens
gcacctagtaagtgcctgc

SEQ ID NO: 6262647 - DNA, 13 bp, Homo sapiens
gcacctataaata

SEQ ID NO: 6262648 - DNA, 14 bp, Homo sapiens
gcacctatggccca

SEQ ID NO: 6262649 - DNA, 14 bp, Homo sapiens
gcacctatttcttt

SEQ ID NO: 6262650 - DNA, 18 bp, Homo sapiens
gcacctcaagtgcaagga

SEQ ID NO: 6262651 - DNA, 11 bp, Homo sapiens
gcacctcagaa

SEQ ID NO: 6262652 - DNA, 21 bp, Homo sapiens
gcacctcagacaatccactct

SEQ ID NO: 6262653 - DNA, 13 bp, Homo sapiens
gcacctcagcctg

SEQ ID NO: 6262654 - DNA, 15 bp, Homo sapiens
gcacctcagcctgca

SEQ ID NO: 6262655 - DNA, 18 bp, Homo sapiens
gcacctcagcctgcacag

SEQ ID NO: 6262656 - DNA, 13 bp, Homo sapiens
gcacctccacgcc

SEQ ID NO: 6262657 - DNA, 12 bp, Homo sapiens
gcacctcccagc

SEQ ID NO: 6262658 - DNA, 14 bp, Homo sapiens
gcacctcccagccc

SEQ ID NO: 6262659 - DNA, 17 bp, Homo sapiens
gcacctcccagcccctg

SEQ ID NO: 6262660 - DNA, 17 bp, Homo sapiens
gcacctcccatcctaat

SEQ ID NO: 6262661 - DNA, 14 bp, Homo sapiens
gcacctccccaaag

SEQ ID NO: 6262662 - DNA, 12 bp, Homo sapiens
gcacctccccag

SEQ ID NO: 6262663 - DNA, 16 bp, Homo sapiens
gcacctccccagacag

SEQ ID NO: 6262664 - DNA, 23 bp, Homo sapiens
gcacctccccccactgcaggccc

SEQ ID NO: 6262665 - DNA, 16 bp, Homo sapiens
gcacctccccgctctc

SEQ ID NO: 6262666 - DNA, 16 bp, Homo sapiens
gcacctccccgctggg

SEQ ID NO: 6262667 - DNA, 15 bp, Homo sapiens
gcacctccctcccca

SEQ ID NO: 6262668 - DNA, 23 bp, Homo sapiens
gcacctccctccccagctccgga

SEQ ID NO: 6262669 - DNA, 20 bp, Homo sapiens
gcacctccgcgggctgactg

SEQ ID NO: 6262670 - DNA, 20 bp, Homo sapiens
gcacctccggctgcctagcc

SEQ ID NO: 6262671 - DNA, 18 bp, Homo sapiens
gcacctcctaccctccca

SEQ ID NO: 6262672 - DNA, 22 bp, Homo sapiens
gcacctcctaccctcccaccag

SEQ ID NO: 6262673 - DNA, 16 bp, Homo sapiens
gcacctcctcagcctg

SEQ ID NO: 6262674 - DNA, 22 bp, Homo sapiens
gcacctcctccgtgggcagctc

SEQ ID NO: 6262675 - DNA, 11 bp, Homo sapiens
gcacctcctcg

SEQ ID NO: 6262676 - DNA, 18 bp, Homo sapiens
gcacctcctctctgctgg

SEQ ID NO: 6262677 - DNA, 13 bp, Homo sapiens
gcacctcctgaga

SEQ ID NO: 6262678 - DNA, 15 bp, Homo sapiens
gcacctcctgagaag

SEQ ID NO: 6262679 - DNA, 12 bp, Homo sapiens
gcacctcctgcc

SEQ ID NO: 6262680 - DNA, 17 bp, Homo sapiens
gcacctccttgtcactt

SEQ ID NO: 6262681 - DNA, 17 bp, Homo sapiens
gcacctcgccgtgtctt

SEQ ID NO: 6262682 - DNA, 14 bp, Homo sapiens
gcacctcggggaca

SEQ ID NO: 6262683 - DNA, 21 bp, Homo sapiens
gcacctcggggacaccagagc

SEQ ID NO: 6262684 - DNA, 15 bp, Homo sapiens
gcacctctccagctc

SEQ ID NO: 6262685 - DNA, 21 bp, Homo sapiens
gcacctctgcccttcccctcc

SEQ ID NO: 6262686 - DNA, 21 bp, Homo sapiens
gcacctctggctagagccgag

SEQ ID NO: 6262687 - DNA, 15 bp, Homo sapiens
gcacctctgttcatt

SEQ ID NO: 6262688 - DNA, 17 bp, Homo sapiens
gcacctctgttcatttc

SEQ ID NO: 6262689 - DNA, 19 bp, Homo sapiens
gcacctctgttcatttcac

SEQ ID NO: 6262690 - DNA, 15 bp, Homo sapiens
gcacctcttggcttt

SEQ ID NO: 6262691 - DNA, 22 bp, Homo sapiens
gcacctgaaattaatttgtgaa

SEQ ID NO: 6262692 - DNA, 13 bp, Homo sapiens
gcacctgaaccac

SEQ ID NO: 6262693 - DNA, 16 bp, Homo sapiens
gcacctgaaccccatg

SEQ ID NO: 6262694 - DNA, 20 bp, Homo sapiens
gcacctgaaccccatgggct

SEQ ID NO: 6262695 - DNA, 17 bp, Homo sapiens
gcacctgacctgctgaa

SEQ ID NO: 6262696 - DNA, 16 bp, Homo sapiens
gcacctgacttggctg

SEQ ID NO: 6262697 - DNA, 13 bp, Homo sapiens
gcacctgagcctg

SEQ ID NO: 6262698 - DNA, 14 bp, Homo sapiens
gcacctgagcctgt

SEQ ID NO: 6262699 - DNA, 12 bp, Homo sapiens
gcacctgaggcc

SEQ ID NO: 6262700 - DNA, 19 bp, Homo sapiens
gcacctgcaatcccagcta

SEQ ID NO: 6262701 - DNA, 13 bp, Homo sapiens
gcacctgcacact

SEQ ID NO: 6262702 - DNA, 19 bp, Homo sapiens
gcacctgcacactccatct

SEQ ID NO: 6262703 - DNA, 13 bp, Homo sapiens
gcacctgcaggga

SEQ ID NO: 6262704 - DNA, 13 bp, Homo sapiens
gcacctgccaccg

SEQ ID NO: 6262705 - DNA, 16 bp, Homo sapiens
gcacctgccagaggat

SEQ ID NO: 6262706 - DNA, 22 bp, Homo sapiens
gcacctgccagcctggcttctg

SEQ ID NO: 6262707 - DNA, 15 bp, Homo sapiens
gcacctgccagggcc

SEQ ID NO: 6262708 - DNA, 11 bp, Homo sapiens
gcacctgcccc

SEQ ID NO: 6262709 - DNA, 13 bp, Homo sapiens
gcacctgccccag

SEQ ID NO: 6262710 - DNA, 16 bp, Homo sapiens
gcacctgccccaggct

SEQ ID NO: 6262711 - DNA, 12 bp, Homo sapiens
gcacctgccccc

SEQ ID NO: 6262712 - DNA, 16 bp, Homo sapiens
gcacctgcccccacag

SEQ ID NO: 6262713 - DNA, 17 bp, Homo sapiens
gcacctgcccccacagc

SEQ ID NO: 6262714 - DNA, 23 bp, Homo sapiens
gcacctgcccccacagctccttg

SEQ ID NO: 6262715 - DNA, 15 bp, Homo sapiens
gcacctgccccctgg

SEQ ID NO: 6262716 - DNA, 18 bp, Homo sapiens
gcacctgccccctggtgg

SEQ ID NO: 6262717 - DNA, 21 bp, Homo sapiens
gcacctgccgacctcgtcctc

SEQ ID NO: 6262718 - DNA, 18 bp, Homo sapiens
gcacctgcctagctcttg

SEQ ID NO: 6262719 - DNA, 13 bp, Homo sapiens
gcacctgcctcag

SEQ ID NO: 6262720 - DNA, 17 bp, Homo sapiens
gcacctgcctcagcaat

SEQ ID NO: 6262721 - DNA, 18 bp, Homo sapiens
gcacctgcctcagctacc

SEQ ID NO: 6262722 - DNA, 17 bp, Homo sapiens
gcacctgcctccaccag

SEQ ID NO: 6262723 - DNA, 18 bp, Homo sapiens
gcacctgcctccaccagc

SEQ ID NO: 6262724 - DNA, 17 bp, Homo sapiens
gcacctgcctccagccg

SEQ ID NO: 6262725 - DNA, 21 bp, Homo sapiens
gcacctgcctgccgctgcagg

SEQ ID NO: 6262726 - DNA, 22 bp, Homo sapiens
gcacctgcctgccgctgcagga

SEQ ID NO: 6262727 - DNA, 22 bp, Homo sapiens
gcacctgcgagaggtccctgct

SEQ ID NO: 6262728 - DNA, 20 bp, Homo sapiens
gcacctgcgcctggctctgt

SEQ ID NO: 6262729 - DNA, 21 bp, Homo sapiens
gcacctgcgcctggctctgtc

SEQ ID NO: 6262730 - DNA, 22 bp, Homo sapiens
gcacctgcgcggaggacgcgac

SEQ ID NO: 6262731 - DNA, 15 bp, Homo sapiens
gcacctgctcccaca

SEQ ID NO: 6262732 - DNA, 16 bp, Homo sapiens
gcacctgctcccacag

SEQ ID NO: 6262733 - DNA, 23 bp, Homo sapiens
gcacctgctgtctgggtggctca

SEQ ID NO: 6262734 - DNA, 16 bp, Homo sapiens
gcacctgcttccccca

SEQ ID NO: 6262735 - DNA, 12 bp, Homo sapiens
gcacctgcttct

SEQ ID NO: 6262736 - DNA, 14 bp, Homo sapiens
gcacctgcttctca

SEQ ID NO: 6262737 - DNA, 21 bp, Homo sapiens
gcacctggaccccctgcccgc

SEQ ID NO: 6262738 - DNA, 16 bp, Homo sapiens
gcacctggagcccaca

SEQ ID NO: 6262739 - DNA, 21 bp, Homo sapiens
gcacctggagcccacagagtc

SEQ ID NO: 6262740 - DNA, 21 bp, Homo sapiens
gcacctggaggggcaccaggt

SEQ ID NO: 6262741 - DNA, 15 bp, Homo sapiens
gcacctggcacacca

SEQ ID NO: 6262742 - DNA, 16 bp, Homo sapiens
gcacctggcacaccag

SEQ ID NO: 6262743 - DNA, 12 bp, Homo sapiens
gcacctggcctg

SEQ ID NO: 6262744 - DNA, 13 bp, Homo sapiens
gcacctggcctgc

SEQ ID NO: 6262745 - DNA, 13 bp, Homo sapiens
gcacctggcctgg

SEQ ID NO: 6262746 - DNA, 15 bp, Homo sapiens
gcacctggcgggctg

SEQ ID NO: 6262747 - DNA, 21 bp, Homo sapiens
gcacctggctgagcctggctg

SEQ ID NO: 6262748 - DNA, 20 bp, Homo sapiens
gcacctgggaaaacagagga

SEQ ID NO: 6262749 - DNA, 15 bp, Homo sapiens
gcacctgggccctgg

SEQ ID NO: 6262750 - DNA, 23 bp, Homo sapiens
gcacctgggccctggggcctgta

SEQ ID NO: 6262751 - DNA, 17 bp, Homo sapiens
gcacctggggagtggga

SEQ ID NO: 6262752 - DNA, 17 bp, Homo sapiens
gcacctgggtgctctgg

SEQ ID NO: 6262753 - DNA, 17 bp, Homo sapiens
gcacctgggtgtgctcc

SEQ ID NO: 6262754 - DNA, 22 bp, Homo sapiens
gcacctgggtgtgctccaggct

SEQ ID NO: 6262755 - DNA, 22 bp, Homo sapiens
gcacctggtggccatgctcctc

SEQ ID NO: 6262756 - DNA, 15 bp, Homo sapiens
gcacctggtggggag

SEQ ID NO: 6262757 - DNA, 13 bp, Homo sapiens
gcacctgtacagt

SEQ ID NO: 6262758 - DNA, 23 bp, Homo sapiens
gcacctgtacagtggaaccgttg

SEQ ID NO: 6262759 - DNA, 19 bp, Homo sapiens
gcacctgtagtcccagcta

SEQ ID NO: 6262760 - DNA, 22 bp, Homo sapiens
gcacctgtcccagaaaaagcat

SEQ ID NO: 6262761 - DNA, 19 bp, Homo sapiens
gcacctgtcggtggctgcc

SEQ ID NO: 6262762 - DNA, 23 bp, Homo sapiens
gcacctgtcggtggctgcctttg

SEQ ID NO: 6262763 - DNA, 14 bp, Homo sapiens
gcacctgtgctgga

SEQ ID NO: 6262764 - DNA, 15 bp, Homo sapiens
gcacctgtggccaga

SEQ ID NO: 6262765 - DNA, 14 bp, Homo sapiens
gcacctgttgtgtg

SEQ ID NO: 6262766 - DNA, 18 bp, Homo sapiens
gcacctgttgtgtgcctg

SEQ ID NO: 6262767 - DNA, 17 bp, Homo sapiens
gcaccttaactggagac

SEQ ID NO: 6262768 - DNA, 20 bp, Homo sapiens
gcaccttaatattattgggg

SEQ ID NO: 6262769 - DNA, 19 bp, Homo sapiens
gcaccttaccaactttctg

SEQ ID NO: 6262770 - DNA, 21 bp, Homo sapiens
gcaccttaccaactttctgta

SEQ ID NO: 6262771 - DNA, 21 bp, Homo sapiens
gcaccttagacagtccctgcc

SEQ ID NO: 6262772 - DNA, 18 bp, Homo sapiens
gcaccttcaagcgctcca

SEQ ID NO: 6262773 - DNA, 20 bp, Homo sapiens
gcaccttcactctccagggt

SEQ ID NO: 6262774 - DNA, 16 bp, Homo sapiens
gcaccttccagcccgg

SEQ ID NO: 6262775 - DNA, 13 bp, Homo sapiens
gcaccttccccct

SEQ ID NO: 6262776 - DNA, 12 bp, Homo sapiens
gcaccttcctcc

SEQ ID NO: 6262777 - DNA, 15 bp, Homo sapiens
gcaccttcctcctcc

SEQ ID NO: 6262778 - DNA, 17 bp, Homo sapiens
gcaccttcctcctcccc

SEQ ID NO: 6262779 - DNA, 19 bp, Homo sapiens
gcaccttctgacgcagcct

SEQ ID NO: 6262780 - DNA, 19 bp, Homo sapiens
gcaccttcttggcgctgga

SEQ ID NO: 6262781 - DNA, 16 bp, Homo sapiens
gcaccttgctgtgtga

SEQ ID NO: 6262782 - DNA, 14 bp, Homo sapiens
gcaccttggcccag

SEQ ID NO: 6262783 - DNA, 19 bp, Homo sapiens
gcaccttggcccaggagct

SEQ ID NO: 6262784 - DNA, 13 bp, Homo sapiens
gcaccttgggcac

SEQ ID NO: 6262785 - DNA, 20 bp, Homo sapiens
gcaccttgtgtctgtacacg

SEQ ID NO: 6262786 - DNA, 15 bp, Homo sapiens
gcacctttagaatat

SEQ ID NO: 6262787 - DNA, 17 bp, Homo sapiens
gcacctttctagttgaa

SEQ ID NO: 6262788 - DNA, 16 bp, Homo sapiens
gcacctttctctgaga

SEQ ID NO: 6262789 - DNA, 15 bp, Homo sapiens
gcacctttgagagag

SEQ ID NO: 6262790 - DNA, 22 bp, Homo sapiens
gcacctttgagagagggggcac

SEQ ID NO: 6262791 - DNA, 21 bp, Homo sapiens
gcacctttgtctggatgcaca

SEQ ID NO: 6262792 - DNA, 22 bp, Homo sapiens
gcacctttgtctggatgcacac

SEQ ID NO: 6262793 - DNA, 21 bp, Homo sapiens
gcaccttttataccagagacc

SEQ ID NO: 6262794 - DNA, 22 bp, Homo sapiens
gcaccttttataccagagacct

SEQ ID NO: 6262795 - DNA, 17 bp, Homo sapiens
gcacgacccttaggcct

SEQ ID NO: 6262796 - DNA, 14 bp, Homo sapiens
gcacgacgccctct

SEQ ID NO: 6262797 - DNA, 19 bp, Homo sapiens
gctcagatagaatgacagt

SEQ ID NO: 6262798 - DNA, 22 bp, Homo sapiens
gctcagatcggccacagggcgg

SEQ ID NO: 6262799 - DNA, 23 bp, Homo sapiens
gctcagatgctggtcatcctggg

SEQ ID NO: 6262800 - DNA, 20 bp, Homo sapiens
gctcagatggactgggagga

SEQ ID NO: 6262801 - DNA, 18 bp, Homo sapiens
gctcagatggcctgagcc

SEQ ID NO: 6262802 - DNA, 17 bp, Homo sapiens
gctcagatggggcctgg

SEQ ID NO: 6262803 - DNA, 20 bp, Homo sapiens
gctcagatggggcctgggct

SEQ ID NO: 6262804 - DNA, 22 bp, Homo sapiens
gctcagatggggcctgggctgt

SEQ ID NO: 6262805 - DNA, 23 bp, Homo sapiens
gctcagatgtcgtaatttgcact

SEQ ID NO: 6262806 - DNA, 18 bp, Homo sapiens
gctcagattccccccatc

SEQ ID NO: 6262807 - DNA, 17 bp, Homo sapiens
gctcagcaaaagatgct

SEQ ID NO: 6262808 - DNA, 16 bp, Homo sapiens
gctcagcaaggccacc

SEQ ID NO: 6262809 - DNA, 17 bp, Homo sapiens
gctcagcaaggccacct

SEQ ID NO: 6262810 - DNA, 20 bp, Homo sapiens
gctcagcaaggtgtgaatga

SEQ ID NO: 6262811 - DNA, 20 bp, Homo sapiens
gctcagcaatagggtgcagt

SEQ ID NO: 6262812 - DNA, 18 bp, Homo sapiens
gctcagcaattcagaccc

SEQ ID NO: 6262813 - DNA, 14 bp, Homo sapiens
gctcagcacagcct

SEQ ID NO: 6262814 - DNA, 13 bp, Homo sapiens
gctcagcagccag

SEQ ID NO: 6262815 - DNA, 15 bp, Homo sapiens
gctcagcagccagtc

SEQ ID NO: 6262816 - DNA, 14 bp, Homo sapiens
gctcagcagcccca

SEQ ID NO: 6262817 - DNA, 21 bp, Homo sapiens
gctcagcagggctggtcacct

SEQ ID NO: 6262818 - DNA, 16 bp, Homo sapiens
gctcagcagttcactt

SEQ ID NO: 6262819 - DNA, 13 bp, Homo sapiens
gctcagcatgcag

SEQ ID NO: 6262820 - DNA, 18 bp, Homo sapiens
gctcagccaccactcagt

SEQ ID NO: 6262821 - DNA, 22 bp, Homo sapiens
gctcagccaccactcagtgctt

SEQ ID NO: 6262822 - DNA, 17 bp, Homo sapiens
gctcagccagccccatc

SEQ ID NO: 6262823 - DNA, 15 bp, Homo sapiens
gctcagcccaccccc

SEQ ID NO: 6262824 - DNA, 16 bp, Homo sapiens
gctcagcccaccctcc

SEQ ID NO: 6262825 - DNA, 20 bp, Homo sapiens
gctcagccccaccccagggc

SEQ ID NO: 6262826 - DNA, 13 bp, Homo sapiens
gctcagccccacg

SEQ ID NO: 6262827 - DNA, 16 bp, Homo sapiens
gctcagccccagacct

SEQ ID NO: 6262828 - DNA, 18 bp, Homo sapiens
gctcagccccagacctgc

SEQ ID NO: 6262829 - DNA, 16 bp, Homo sapiens
gctcagccccagccca

SEQ ID NO: 6262830 - DNA, 18 bp, Homo sapiens
gctcagccccagcccagc

SEQ ID NO: 6262831 - DNA, 22 bp, Homo sapiens
gctcagccccagcttatctcct

SEQ ID NO: 6262832 - DNA, 17 bp, Homo sapiens
gctcagccccaggccag

SEQ ID NO: 6262833 - DNA, 21 bp, Homo sapiens
gctcagccccaggccagctgc

SEQ ID NO: 6262834 - DNA, 23 bp, Homo sapiens
gctcagccccaggccagctgcgg

SEQ ID NO: 6262835 - DNA, 19 bp, Homo sapiens
gctcagccccgagctgtcc

SEQ ID NO: 6262836 - DNA, 15 bp, Homo sapiens
gctcagccccggcca

SEQ ID NO: 6262837 - DNA, 20 bp, Homo sapiens
gctcagccccggccactccc

SEQ ID NO: 6262838 - DNA, 19 bp, Homo sapiens
gctcagcccgcttggccac

SEQ ID NO: 6262839 - DNA, 20 bp, Homo sapiens
gctcagcccgcttggccacc

SEQ ID NO: 6262840 - DNA, 15 bp, Homo sapiens
gctcagccctccctg

SEQ ID NO: 6262841 - DNA, 16 bp, Homo sapiens
gctcagccctccctgc

SEQ ID NO: 6262842 - DNA, 21 bp, Homo sapiens
gctcagccctccctgcccctc

SEQ ID NO: 6262843 - DNA, 12 bp, Homo sapiens
gctcagccctga

SEQ ID NO: 6262844 - DNA, 20 bp, Homo sapiens
gctcagccctgactggtgct

SEQ ID NO: 6262845 - DNA, 21 bp, Homo sapiens
gctcagccctgactggtgcta

SEQ ID NO: 6262846 - DNA, 19 bp, Homo sapiens
gctcagccctgagctggcg

SEQ ID NO: 6262847 - DNA, 13 bp, Homo sapiens
gctcagccctggc

SEQ ID NO: 6262848 - DNA, 17 bp, Homo sapiens
gctcagccctggcctgg

SEQ ID NO: 6262849 - DNA, 18 bp, Homo sapiens
gctcagccctggcctggc

SEQ ID NO: 6262850 - DNA, 14 bp, Homo sapiens
gctcagcccttcct

SEQ ID NO: 6262851 - DNA, 18 bp, Homo sapiens
gctcagcccttcctagaa

SEQ ID NO: 6262852 - DNA, 19 bp, Homo sapiens
gctcagccgtgcactccct

SEQ ID NO: 6262853 - DNA, 17 bp, Homo sapiens
gctcagcctcatcctga

SEQ ID NO: 6262854 - DNA, 19 bp, Homo sapiens
gctcagcctcatcctgaga

SEQ ID NO: 6262855 - DNA, 15 bp, Homo sapiens
gctcagcctcccccc

SEQ ID NO: 6262856 - DNA, 15 bp, Homo sapiens
gctcagcctcccgag

SEQ ID NO: 6262857 - DNA, 20 bp, Homo sapiens
gctcagcctcgctttgaggt

SEQ ID NO: 6262858 - DNA, 11 bp, Homo sapiens
gctcagcctgg

SEQ ID NO: 6262859 - DNA, 13 bp, Homo sapiens
gctcagcctgtct

SEQ ID NO: 6262860 - DNA, 21 bp, Homo sapiens
gctcagcctgtctcgggctga

SEQ ID NO: 6262861 - DNA, 15 bp, Homo sapiens
gctcagccttgcaca

SEQ ID NO: 6262862 - DNA, 21 bp, Homo sapiens
gctcagccttgcacacccact

SEQ ID NO: 6262863 - DNA, 14 bp, Homo sapiens
gctcagccttgctg

SEQ ID NO: 6262864 - DNA, 16 bp, Homo sapiens
gctcagccttgctgct

SEQ ID NO: 6262865 - DNA, 19 bp, Homo sapiens
gctcagccttgctgctctg

SEQ ID NO: 6262866 - DNA, 21 bp, Homo sapiens
gctcagccttgctgctctgcg

SEQ ID NO: 6262867 - DNA, 18 bp, Homo sapiens
gctcagcggggacagctc

SEQ ID NO: 6262868 - DNA, 18 bp, Homo sapiens
gctcagctcatccatgcc

SEQ ID NO: 6262869 - DNA, 20 bp, Homo sapiens
gctcagctcctacctctgtg

SEQ ID NO: 6262870 - DNA, 22 bp, Homo sapiens
gctcagctcctacctctgtgcc

SEQ ID NO: 6262871 - DNA, 12 bp, Homo sapiens
gctcagctctgg

SEQ ID NO: 6262872 - DNA, 14 bp, Homo sapiens
gctcagctctggct

SEQ ID NO: 6262873 - DNA, 15 bp, Homo sapiens
gctcagctctggctc

SEQ ID NO: 6262874 - DNA, 20 bp, Homo sapiens
gctcagctctggctcacaga

SEQ ID NO: 6262875 - DNA, 14 bp, Homo sapiens
gctcagctctggtc

SEQ ID NO: 6262876 - DNA, 20 bp, Homo sapiens
gctcagctctggtccaggcc

SEQ ID NO: 6262877 - DNA, 13 bp, Homo sapiens
gctcagctgccca

SEQ ID NO: 6262878 - DNA, 14 bp, Homo sapiens
gctcagctgcccat

SEQ ID NO: 6262879 - DNA, 13 bp, Homo sapiens
gctcagctgcgcc

SEQ ID NO: 6262880 - DNA, 15 bp, Homo sapiens
gctcagctgcgcccc

SEQ ID NO: 6262881 - DNA, 18 bp, Homo sapiens
gctcagctgcgccccctt

SEQ ID NO: 6262882 - DNA, 13 bp, Homo sapiens
gctcagctgtggc

SEQ ID NO: 6262883 - DNA, 15 bp, Homo sapiens
gctcagctgtggctg

SEQ ID NO: 6262884 - DNA, 14 bp, Homo sapiens
gctcagcttcttcc

SEQ ID NO: 6262885 - DNA, 17 bp, Homo sapiens
gctcagctttctgaggc

SEQ ID NO: 6262886 - DNA, 21 bp, Homo sapiens
gctcaggaagaaaccccaagc

SEQ ID NO: 6262887 - DNA, 22 bp, Homo sapiens
gctcaggaagaaaccccaagca

SEQ ID NO: 6262888 - DNA, 16 bp, Homo sapiens
gctcaggaagaagaga

SEQ ID NO: 6262889 - DNA, 18 bp, Homo sapiens
gctcaggaattccctgga

SEQ ID NO: 6262890 - DNA, 12 bp, Homo sapiens
gctcaggaccca

SEQ ID NO: 6262891 - DNA, 18 bp, Homo sapiens
gctcaggacccaggccct

SEQ ID NO: 6262892 - DNA, 17 bp, Homo sapiens
gctcaggactcagaagc

SEQ ID NO: 6262893 - DNA, 14 bp, Homo sapiens
gctcaggagaagcc

SEQ ID NO: 6262894 - DNA, 20 bp, Homo sapiens
gctcaggagaagccagtgtc

SEQ ID NO: 6262895 - DNA, 14 bp, Homo sapiens
gctcaggagccctg

SEQ ID NO: 6262896 - DNA, 22 bp, Homo sapiens
gctcaggagccctgggaggctc

SEQ ID NO: 6262897 - DNA, 19 bp, Homo sapiens
gctcaggaggcgaataaat

SEQ ID NO: 6262898 - DNA, 21 bp, Homo sapiens
gctcaggagggtgacgcccag

SEQ ID NO: 6262899 - DNA, 23 bp, Homo sapiens
gctcaggagggtgacgcccagct

SEQ ID NO: 6262900 - DNA, 22 bp, Homo sapiens
gctcaggatatggcttaggaat

SEQ ID NO: 6262901 - DNA, 14 bp, Homo sapiens
gctcaggatctctt

SEQ ID NO: 6262902 - DNA, 18 bp, Homo sapiens
gctcaggatctcttagca

SEQ ID NO: 6262903 - DNA, 12 bp, Homo sapiens
gctcaggcaagc

SEQ ID NO: 6262904 - DNA, 13 bp, Homo sapiens
gctcaggcaagcc

SEQ ID NO: 6262905 - DNA, 19 bp, Homo sapiens
gctcaggcaagcccctcag

SEQ ID NO: 6262906 - DNA, 22 bp, Homo sapiens
gctcaggcagcgttagggctgc

SEQ ID NO: 6262907 - DNA, 20 bp, Homo sapiens
gctcaggcagctcgaggccc

SEQ ID NO: 6262908 - DNA, 24 bp, Homo sapiens
gctcaggcaggggcctccatgggc

SEQ ID NO: 6262909 - DNA, 17 bp, Homo sapiens
gctcaggcctaggaggc

SEQ ID NO: 6262910 - DNA, 18 bp, Homo sapiens
gctcaggcctaggaggcc

SEQ ID NO: 6262911 - DNA, 22 bp, Homo sapiens
gctcaggcctccctagcacctc

SEQ ID NO: 6262912 - DNA, 23 bp, Homo sapiens
gctcaggcctccctagcacctcc

SEQ ID NO: 6262913 - DNA, 15 bp, Homo sapiens
gctcaggcgcagccc

SEQ ID NO: 6262914 - DNA, 17 bp, Homo sapiens
gctcaggcgcagcccta

SEQ ID NO: 6262915 - DNA, 16 bp, Homo sapiens
gctcaggcgtcgctgg

SEQ ID NO: 6262916 - DNA, 22 bp, Homo sapiens
gctcaggctactataggtccag

SEQ ID NO: 6262917 - DNA, 17 bp, Homo sapiens
gctcaggctccccaaga

SEQ ID NO: 6262918 - DNA, 23 bp, Homo sapiens
gctcaggctgcagctggacagag

SEQ ID NO: 6262919 - DNA, 17 bp, Homo sapiens
gctcagggaaaagcagc

SEQ ID NO: 6262920 - DNA, 15 bp, Homo sapiens
gctcagggaaatggc

SEQ ID NO: 6262921 - DNA, 20 bp, Homo sapiens
gctcagggatcttctccctc

SEQ ID NO: 6262922 - DNA, 16 bp, Homo sapiens
gctcagggcagtggct

SEQ ID NO: 6262923 - DNA, 11 bp, Homo sapiens
gctcagggcca

SEQ ID NO: 6262924 - DNA, 14 bp, Homo sapiens
gctcagggccaggt

SEQ ID NO: 6262925 - DNA, 17 bp, Homo sapiens
gctcagggccaggtcct

SEQ ID NO: 6262926 - DNA, 19 bp, Homo sapiens
gctcagggccaggtcctca

SEQ ID NO: 6262927 - DNA, 16 bp, Homo sapiens
gctcagggcctggctc

SEQ ID NO: 6262928 - DNA, 13 bp, Homo sapiens
gctcagggctgga

SEQ ID NO: 6262929 - DNA, 14 bp, Homo sapiens
gctcagggctggag

SEQ ID NO: 6262930 - DNA, 17 bp, Homo sapiens
gctcaggggacactggc

SEQ ID NO: 6262931 - DNA, 18 bp, Homo sapiens
gctcaggggacactggcc

SEQ ID NO: 6262932 - DNA, 15 bp, Homo sapiens
gctcaggggagcaag

SEQ ID NO: 6262933 - DNA, 17 bp, Homo sapiens
gctcaggggccctggag

SEQ ID NO: 6262934 - DNA, 15 bp, Homo sapiens
gctcaggggcctgga

SEQ ID NO: 6262935 - DNA, 22 bp, Homo sapiens
gctcagggtcactgaaccactg

SEQ ID NO: 6262936 - DNA, 22 bp, Homo sapiens
gctcagggtgctagaggattag

SEQ ID NO: 6262937 - DNA, 21 bp, Homo sapiens
gctcagggtgctccctcctca

SEQ ID NO: 6262938 - DNA, 16 bp, Homo sapiens
gctcagggtttcggaa

SEQ ID NO: 6262939 - DNA, 19 bp, Homo sapiens
gctcaggtacagagaagga

SEQ ID NO: 6262940 - DNA, 23 bp, Homo sapiens
gctcaggtacagagaaggaatgt

SEQ ID NO: 6262941 - DNA, 21 bp, Homo sapiens
gctcaggtcacataaaacttt

SEQ ID NO: 6262942 - DNA, 19 bp, Homo sapiens
gctcaggtgactggagccc

SEQ ID NO: 6262943 - DNA, 21 bp, Homo sapiens
gctcaggtgatcaaaataaag

SEQ ID NO: 6262944 - DNA, 15 bp, Homo sapiens
gctcaggtgcaagtg

SEQ ID NO: 6262945 - DNA, 17 bp, Homo sapiens
gctcaggtgctggggcc

SEQ ID NO: 6262946 - DNA, 14 bp, Homo sapiens
gctcaggtgtccct

SEQ ID NO: 6262947 - DNA, 19 bp, Homo sapiens
gctcaggttccctgccaca

SEQ ID NO: 6262948 - DNA, 17 bp, Homo sapiens
gctcaggtttctggaca

SEQ ID NO: 6262949 - DNA, 18 bp, Homo sapiens
gctcaggtttgtcctggt

SEQ ID NO: 6262950 - DNA, 21 bp, Homo sapiens
gctcaggtttgtcctggtcat

SEQ ID NO: 6262951 - DNA, 20 bp, Homo sapiens
gctcagtaacacagtgcagt

SEQ ID NO: 6262952 - DNA, 21 bp, Homo sapiens
gctcagtaacacagtgcagtg

SEQ ID NO: 6262953 - DNA, 18 bp, Homo sapiens
gctcagtaatataatttg

SEQ ID NO: 6262954 - DNA, 11 bp, Homo sapiens
gctcagtatta

SEQ ID NO: 6262955 - DNA, 22 bp, Homo sapiens
gctcagtattactttctgccgc

SEQ ID NO: 6262956 - DNA, 22 bp, Homo sapiens
gctcagtattgagacactgtca

SEQ ID NO: 6262957 - DNA, 23 bp, Homo sapiens
gctcagtattgagacactgtcaa

SEQ ID NO: 6262958 - DNA, 16 bp, Homo sapiens
gctcagtcagtgcact

SEQ ID NO: 6262959 - DNA, 19 bp, Homo sapiens
gctcagtcccacagcccct

SEQ ID NO: 6262960 - DNA, 23 bp, Homo sapiens
gctcagtcccatcagagagcgag

SEQ ID NO: 6262961 - DNA, 14 bp, Homo sapiens
gctcagtctcagga

SEQ ID NO: 6262962 - DNA, 17 bp, Homo sapiens
gctcagtctcaggagca

SEQ ID NO: 6262963 - DNA, 20 bp, Homo sapiens
gctcagtctcaggagcatgg

SEQ ID NO: 6262964 - DNA, 21 bp, Homo sapiens
gctcagtctcaggagcatggg

SEQ ID NO: 6262965 - DNA, 16 bp, Homo sapiens
gctcagtctccctttc

SEQ ID NO: 6262966 - DNA, 19 bp, Homo sapiens
gctcagtctccctttccct

SEQ ID NO: 6262967 - DNA, 14 bp, Homo sapiens
gctcagtctgttca

SEQ ID NO: 6262968 - DNA, 17 bp, Homo sapiens
gctcagtgaagttgctg

SEQ ID NO: 6262969 - DNA, 17 bp, Homo sapiens
gctcagtgatctcactt

SEQ ID NO: 6262970 - DNA, 14 bp, Homo sapiens
gctcagtgccaaag

SEQ ID NO: 6262971 - DNA, 17 bp, Homo sapiens
gctcagtgccacctatg

SEQ ID NO: 6262972 - DNA, 19 bp, Homo sapiens
gctcagtgccacctatgcc

SEQ ID NO: 6262973 - DNA, 22 bp, Homo sapiens
gctcagtgccacctatgcctgt

SEQ ID NO: 6262974 - DNA, 19 bp, Homo sapiens
gcacgacgccctctcccca

SEQ ID NO: 6262975 - DNA, 20 bp, Homo sapiens
gcacgacgccctctccccac

SEQ ID NO: 6262976 - DNA, 21 bp, Homo sapiens
gcacgacgccctctccccacc

SEQ ID NO: 6262977 - DNA, 15 bp, Homo sapiens
gcacgacgtcagcct

SEQ ID NO: 6262978 - DNA, 16 bp, Homo sapiens
gcacgagcctgggcga

SEQ ID NO: 6262979 - DNA, 15 bp, Homo sapiens
gcacgagctggaacc

SEQ ID NO: 6262980 - DNA, 23 bp, Homo sapiens
gcacgagctggaacccacgagga

SEQ ID NO: 6262981 - DNA, 18 bp, Homo sapiens
gcacgaggggggccaggg

SEQ ID NO: 6262982 - DNA, 23 bp, Homo sapiens
gcacgatgtggaaaaatgagaga

SEQ ID NO: 6262983 - DNA, 15 bp, Homo sapiens
gcacgatttctgttt

SEQ ID NO: 6262984 - DNA, 20 bp, Homo sapiens
gcacgcaacccttgctgctg

SEQ ID NO: 6262985 - DNA, 14 bp, Homo sapiens
gcacgcaagcctca

SEQ ID NO: 6262986 - DNA, 18 bp, Homo sapiens
gcacgcaagcctcagcca

SEQ ID NO: 6262987 - DNA, 24 bp, Homo sapiens
gcacgcaagcctcagccactccca

SEQ ID NO: 6262988 - DNA, 17 bp, Homo sapiens
gcacgcacacacacata

SEQ ID NO: 6262989 - DNA, 12 bp, Homo sapiens
gcacgcaccact

SEQ ID NO: 6262990 - DNA, 21 bp, Homo sapiens
gcacgcaccactgcttcccac

SEQ ID NO: 6262991 - DNA, 22 bp, Homo sapiens
gcacgcaccccgcccctgcatg

SEQ ID NO: 6262992 - DNA, 15 bp, Homo sapiens
gcacgcacctgtagt

SEQ ID NO: 6262993 - DNA, 20 bp, Homo sapiens
gcacgcacctgtagtcccag

SEQ ID NO: 6262994 - DNA, 18 bp, Homo sapiens
gcacgcacttgcctgttg

SEQ ID NO: 6262995 - DNA, 19 bp, Homo sapiens
gcacgcacttgcctgttgg

SEQ ID NO: 6262996 - DNA, 16 bp, Homo sapiens
gcacgcaggcacagca

SEQ ID NO: 6262997 - DNA, 22 bp, Homo sapiens
gcacgcccatgtgtgagtgtgt

SEQ ID NO: 6262998 - DNA, 23 bp, Homo sapiens
gcacgccctactccactgccctg

SEQ ID NO: 6262999 - DNA, 14 bp, Homo sapiens
gcacgcctctcccc

SEQ ID NO: 6263000 - DNA, 16 bp, Homo sapiens
gcacgcctctccccac

SEQ ID NO: 6263001 - DNA, 20 bp, Homo sapiens
gcacgcctctccccaccttc

SEQ ID NO: 6263002 - DNA, 15 bp, Homo sapiens
gcacgcctgccatct

SEQ ID NO: 6263003 - DNA, 16 bp, Homo sapiens
gcacgcctgccatctt

SEQ ID NO: 6263004 - DNA, 16 bp, Homo sapiens
gcacgcctgcccagcc

SEQ ID NO: 6263005 - DNA, 17 bp, Homo sapiens
gcacgcctgcccagcct

SEQ ID NO: 6263006 - DNA, 18 bp, Homo sapiens
gcacgcctgcccagcctc

SEQ ID NO: 6263007 - DNA, 15 bp, Homo sapiens
gcacgcctgctggcc

SEQ ID NO: 6263008 - DNA, 14 bp, Homo sapiens
gcacgctcaatgcc

SEQ ID NO: 6263009 - DNA, 15 bp, Homo sapiens
gcacgctcccctcca

SEQ ID NO: 6263010 - DNA, 15 bp, Homo sapiens
gcacgctcgctgcca

SEQ ID NO: 6263011 - DNA, 16 bp, Homo sapiens
gcacgctcgctgccat

SEQ ID NO: 6263012 - DNA, 17 bp, Homo sapiens
gcacgctcgctgccatc

SEQ ID NO: 6263013 - DNA, 16 bp, Homo sapiens
gcacgctgtgggcagg

SEQ ID NO: 6263014 - DNA, 12 bp, Homo sapiens
gcacggacaata

SEQ ID NO: 6263015 - DNA, 15 bp, Homo sapiens
gcacggacaataaac

SEQ ID NO: 6263016 - DNA, 18 bp, Homo sapiens
gcacggacaataaacctc

SEQ ID NO: 6263017 - DNA, 22 bp, Homo sapiens
gcacggacatggtctgtcctga

SEQ ID NO: 6263018 - DNA, 14 bp, Homo sapiens
gcacggcagcttga

SEQ ID NO: 6263019 - DNA, 19 bp, Homo sapiens
gcacggcccggcccctcac

SEQ ID NO: 6263020 - DNA, 21 bp, Homo sapiens
gcacggcccggcccctcaccc

SEQ ID NO: 6263021 - DNA, 21 bp, Homo sapiens
gcacggccctccttcttttcc

SEQ ID NO: 6263022 - DNA, 23 bp, Homo sapiens
gcacggcgtggtgtgtccctgga

SEQ ID NO: 6263023 - DNA, 21 bp, Homo sapiens
gcacggctccgagggcggcca

SEQ ID NO: 6263024 - DNA, 23 bp, Homo sapiens
gcacggctccgagggcggccagg

SEQ ID NO: 6263025 - DNA, 14 bp, Homo sapiens
gcacggctctgtcc

SEQ ID NO: 6263026 - DNA, 18 bp, Homo sapiens
gcacggctctgtccccag

SEQ ID NO: 6263027 - DNA, 14 bp, Homo sapiens
gcacggctgctcgg

SEQ ID NO: 6263028 - DNA, 12 bp, Homo sapiens
gcacggctgctg

SEQ ID NO: 6263029 - DNA, 15 bp, Homo sapiens
gcacgggagagcgcc

SEQ ID NO: 6263030 - DNA, 20 bp, Homo sapiens
gcacgggagagcgccacccg

SEQ ID NO: 6263031 - DNA, 17 bp, Homo sapiens
gcacgggcaaagaaaac

SEQ ID NO: 6263032 - DNA, 15 bp, Homo sapiens
gcacgggccctccct

SEQ ID NO: 6263033 - DNA, 13 bp, Homo sapiens
gcacgggcctgta

SEQ ID NO: 6263034 - DNA, 15 bp, Homo sapiens
gcacgggctgtctgg

SEQ ID NO: 6263035 - DNA, 15 bp, Homo sapiens
gcacggggcattcct

SEQ ID NO: 6263036 - DNA, 13 bp, Homo sapiens
gcacggggccagc

SEQ ID NO: 6263037 - DNA, 16 bp, Homo sapiens
gcacgggggagtgaga

SEQ ID NO: 6263038 - DNA, 13 bp, Homo sapiens
gcacgggtggtcc

SEQ ID NO: 6263039 - DNA, 18 bp, Homo sapiens
gcacgggtgtcacggcca

SEQ ID NO: 6263040 - DNA, 18 bp, Homo sapiens
gcacggtacaaacccaaa

SEQ ID NO: 6263041 - DNA, 19 bp, Homo sapiens
gcacggtggctcacacctg

SEQ ID NO: 6263042 - DNA, 18 bp, Homo sapiens
gcacggtgggccttgctg

SEQ ID NO: 6263043 - DNA, 19 bp, Homo sapiens
gcacggtgggccttgctgg

SEQ ID NO: 6263044 - DNA, 17 bp, Homo sapiens
gcacggtttctgttctg

SEQ ID NO: 6263045 - DNA, 20 bp, Homo sapiens
gcacggtttctgttctgccc

SEQ ID NO: 6263046 - DNA, 17 bp, Homo sapiens
gcacgtaaagtacttgt

SEQ ID NO: 6263047 - DNA, 22 bp, Homo sapiens
gcacgtagctgaggccggatgc

SEQ ID NO: 6263048 - DNA, 20 bp, Homo sapiens
gcacgtagtagggtcaggcc

SEQ ID NO: 6263049 - DNA, 22 bp, Homo sapiens
gcacgtagtttgcattccagcg

SEQ ID NO: 6263050 - DNA, 19 bp, Homo sapiens
gcacgtatacacccagatg

SEQ ID NO: 6263051 - DNA, 15 bp, Homo sapiens
gcacgtattgctgtg

SEQ ID NO: 6263052 - DNA, 14 bp, Homo sapiens
gcacgtattttaat

SEQ ID NO: 6263053 - DNA, 20 bp, Homo sapiens
gcacgtcaccctcctgagcc

SEQ ID NO: 6263054 - DNA, 13 bp, Homo sapiens
gcacgtcatggga

SEQ ID NO: 6263055 - DNA, 22 bp, Homo sapiens
gcacgtcctccaccggtgcctc

SEQ ID NO: 6263056 - DNA, 16 bp, Homo sapiens
gcacgtcgccatccgt

SEQ ID NO: 6263057 - DNA, 23 bp, Homo sapiens
gcacgtcgccatccgtcaccaga

SEQ ID NO: 6263058 - DNA, 20 bp, Homo sapiens
gcacgtctcctgctgcgtga

SEQ ID NO: 6263059 - DNA, 17 bp, Homo sapiens
gcacgtcttgctatttg

SEQ ID NO: 6263060 - DNA, 15 bp, Homo sapiens
gcacgtgacaggctc

SEQ ID NO: 6263061 - DNA, 13 bp, Homo sapiens
gcacgtgcacaaa

SEQ ID NO: 6263062 - DNA, 19 bp, Homo sapiens
gcacgtgcacacacctgca

SEQ ID NO: 6263063 - DNA, 20 bp, Homo sapiens
gcacgtgcacacacctgcac

SEQ ID NO: 6263064 - DNA, 21 bp, Homo sapiens
gcacgtgcacacacctgcaca

SEQ ID NO: 6263065 - DNA, 19 bp, Homo sapiens
gcacgtgcctgtgggcctg

SEQ ID NO: 6263066 - DNA, 20 bp, Homo sapiens
gcacgtggagatagtgccag

SEQ ID NO: 6263067 - DNA, 16 bp, Homo sapiens
gcacgtggccaggagc

SEQ ID NO: 6263068 - DNA, 15 bp, Homo sapiens
gcacgtggcctcttg

SEQ ID NO: 6263069 - DNA, 14 bp, Homo sapiens
gcacgtggggccca

SEQ ID NO: 6263070 - DNA, 16 bp, Homo sapiens
gcacgtggggcccact

SEQ ID NO: 6263071 - DNA, 18 bp, Homo sapiens
gcacgtggggcccactgc

SEQ ID NO: 6263072 - DNA, 18 bp, Homo sapiens
gcacgtggtaaaacactt

SEQ ID NO: 6263073 - DNA, 19 bp, Homo sapiens
gcacgtgtgtttttctatt

SEQ ID NO: 6263074 - DNA, 22 bp, Homo sapiens
gcacgttaaaaattaaaagaag

SEQ ID NO: 6263075 - DNA, 16 bp, Homo sapiens
gcacgttcataaccaa

SEQ ID NO: 6263076 - DNA, 17 bp, Homo sapiens
gcacgttcataaccaac

SEQ ID NO: 6263077 - DNA, 21 bp, Homo sapiens
gcacgttctatattgtgccaa

SEQ ID NO: 6263078 - DNA, 15 bp, Homo sapiens
gcacgttgcttcagg

SEQ ID NO: 6263079 - DNA, 19 bp, Homo sapiens
gcacgtttgtgagaagaaa

SEQ ID NO: 6263080 - DNA, 17 bp, Homo sapiens
gcactaaaatgtttaat

SEQ ID NO: 6263081 - DNA, 22 bp, Homo sapiens
gcactaaaccacttctctgctg

SEQ ID NO: 6263082 - DNA, 23 bp, Homo sapiens
gcactaaaccacttctctgctgc

SEQ ID NO: 6263083 - DNA, 20 bp, Homo sapiens
gcactaaagcagtggacacc

SEQ ID NO: 6263084 - DNA, 17 bp, Homo sapiens
gcactaaagccagcctg

SEQ ID NO: 6263085 - DNA, 17 bp, Homo sapiens
gcactaaagttagtaaa

SEQ ID NO: 6263086 - DNA, 14 bp, Homo sapiens
gcactaaatatgaa

SEQ ID NO: 6263087 - DNA, 17 bp, Homo sapiens
gcactaaatcagagaca

SEQ ID NO: 6263088 - DNA, 22 bp, Homo sapiens
gcactaagagaaaattgcacta

SEQ ID NO: 6263089 - DNA, 14 bp, Homo sapiens
gcactaaggggccc

SEQ ID NO: 6263090 - DNA, 17 bp, Homo sapiens
gcactaagggtggagag

SEQ ID NO: 6263091 - DNA, 17 bp, Homo sapiens
gcactaaggtgtgctct

SEQ ID NO: 6263092 - DNA, 19 bp, Homo sapiens
gcactaaggtgtgctctga

SEQ ID NO: 6263093 - DNA, 21 bp, Homo sapiens
gcactaattctgcatctgggc

SEQ ID NO: 6263094 - DNA, 17 bp, Homo sapiens
gcactaattgacccaaa

SEQ ID NO: 6263095 - DNA, 17 bp, Homo sapiens
gcactacaccttgcctt

SEQ ID NO: 6263096 - DNA, 21 bp, Homo sapiens
gcactaccactcctgccaagg

SEQ ID NO: 6263097 - DNA, 16 bp, Homo sapiens
gcactaccgattcttt

SEQ ID NO: 6263098 - DNA, 19 bp, Homo sapiens
gcactactaaaagtttaga

SEQ ID NO: 6263099 - DNA, 22 bp, Homo sapiens
gcactactctaccatggttctg

SEQ ID NO: 6263100 - DNA, 15 bp, Homo sapiens
gcactactctgtgcc

SEQ ID NO: 6263101 - DNA, 18 bp, Homo sapiens
gcactactgacatgtggg

SEQ ID NO: 6263102 - DNA, 12 bp, Homo sapiens
gcactactgggt

SEQ ID NO: 6263103 - DNA, 20 bp, Homo sapiens
gcactactgtactccagcca

SEQ ID NO: 6263104 - DNA, 18 bp, Homo sapiens
gcactagaaattgggcag

SEQ ID NO: 6263105 - DNA, 20 bp, Homo sapiens
gcactagaagtggtttcctg

SEQ ID NO: 6263106 - DNA, 20 bp, Homo sapiens
gcactagccaaacctcacca

SEQ ID NO: 6263107 - DNA, 13 bp, Homo sapiens
gcactagcctttg

SEQ ID NO: 6263108 - DNA, 15 bp, Homo sapiens
gcactagcctttggc

SEQ ID NO: 6263109 - DNA, 12 bp, Homo sapiens
gcactaggaatt

SEQ ID NO: 6263110 - DNA, 14 bp, Homo sapiens
gcactaggaattct

SEQ ID NO: 6263111 - DNA, 21 bp, Homo sapiens
gcactaggcacccagctgcca

SEQ ID NO: 6263112 - DNA, 13 bp, Homo sapiens
gcactaggcaggt

SEQ ID NO: 6263113 - DNA, 17 bp, Homo sapiens
gcactagtaaaggagga

SEQ ID NO: 6263114 - DNA, 18 bp, Homo sapiens
gcactagtcaccgacagc

SEQ ID NO: 6263115 - DNA, 21 bp, Homo sapiens
gcactagtcaccgacagcggc

SEQ ID NO: 6263116 - DNA, 15 bp, Homo sapiens
gcactataatgtaag

SEQ ID NO: 6263117 - DNA, 22 bp, Homo sapiens
gcactataatgtaagctctact

SEQ ID NO: 6263118 - DNA, 18 bp, Homo sapiens
gcactatatacatcacgt

SEQ ID NO: 6263119 - DNA, 14 bp, Homo sapiens
gcactatatgcaaa

SEQ ID NO: 6263120 - DNA, 18 bp, Homo sapiens
gcactatatgcaaacagg

SEQ ID NO: 6263121 - DNA, 19 bp, Homo sapiens
gcactatctttaaacgaaa

SEQ ID NO: 6263122 - DNA, 17 bp, Homo sapiens
gcactatctttcaggaa

SEQ ID NO: 6263123 - DNA, 15 bp, Homo sapiens
gcactattgagtctt

SEQ ID NO: 6263124 - DNA, 14 bp, Homo sapiens
gcactattggactt

SEQ ID NO: 6263125 - DNA, 15 bp, Homo sapiens
gcactattggacttt

SEQ ID NO: 6263126 - DNA, 17 bp, Homo sapiens
gcactatttatttacaa

SEQ ID NO: 6263127 - DNA, 19 bp, Homo sapiens
gcactattttatatttaaa

SEQ ID NO: 6263128 - DNA, 23 bp, Homo sapiens
gcactcaaaagctgggaaccagc

SEQ ID NO: 6263129 - DNA, 19 bp, Homo sapiens
gcactcaaccttaagacct

SEQ ID NO: 6263130 - DNA, 21 bp, Homo sapiens
gcactcacaattgttgactaa

SEQ ID NO: 6263131 - DNA, 23 bp, Homo sapiens
gcactcacaattgttgactaaaa

SEQ ID NO: 6263132 - DNA, 23 bp, Homo sapiens
gcactcacacaggacccccttcc

SEQ ID NO: 6263133 - DNA, 20 bp, Homo sapiens
gcactcacagacctggagcc

SEQ ID NO: 6263134 - DNA, 13 bp, Homo sapiens
gcactcacatgct

SEQ ID NO: 6263135 - DNA, 14 bp, Homo sapiens
gcactcacatgctg

SEQ ID NO: 6263136 - DNA, 20 bp, Homo sapiens
gcactcacccatgtgccaag

SEQ ID NO: 6263137 - DNA, 21 bp, Homo sapiens
gcactcacccctagccctggt

SEQ ID NO: 6263138 - DNA, 13 bp, Homo sapiens
gcactcagaaaat

SEQ ID NO: 6263139 - DNA, 17 bp, Homo sapiens
gcactcagaagacactg

SEQ ID NO: 6263140 - DNA, 20 bp, Homo sapiens
gcactcagaagacactgatg

SEQ ID NO: 6263141 - DNA, 17 bp, Homo sapiens
gcactcagccacgacca

SEQ ID NO: 6263142 - DNA, 21 bp, Homo sapiens
gcactcagccacgaccagccc

SEQ ID NO: 6263143 - DNA, 13 bp, Homo sapiens
gcactcagcctca

SEQ ID NO: 6263144 - DNA, 20 bp, Homo sapiens
gcactcaggagcacagccat

SEQ ID NO: 6263145 - DNA, 22 bp, Homo sapiens
gcactcagtctagtgaagatgt

SEQ ID NO: 6263146 - DNA, 20 bp, Homo sapiens
gcactcagtgagcctcctgt

SEQ ID NO: 6263147 - DNA, 23 bp, Homo sapiens
gcactcagtgaggccgcccggca

SEQ ID NO: 6263148 - DNA, 16 bp, Homo sapiens
gcactcatctactgaa

SEQ ID NO: 6263149 - DNA, 18 bp, Homo sapiens
gcactcatgacggcctgc

SEQ ID NO: 6263150 - DNA, 19 bp, Homo sapiens
gcactcatgacggcctgcc

SEQ ID NO: 6263151 - DNA, 15 bp, Homo sapiens
gctcagtgcctcctg

SEQ ID NO: 6263152 - DNA, 17 bp, Homo sapiens
gctcagtgcctcctggc

SEQ ID NO: 6263153 - DNA, 14 bp, Homo sapiens
gctcagtgcctttt

SEQ ID NO: 6263154 - DNA, 18 bp, Homo sapiens
gctcagtgcttgggctcc

SEQ ID NO: 6263155 - DNA, 13 bp, Homo sapiens
gctcagtgtcagc

SEQ ID NO: 6263156 - DNA, 16 bp, Homo sapiens
gctcagtgtccagctt

SEQ ID NO: 6263157 - DNA, 22 bp, Homo sapiens
gctcagtgtctggctgcagagc

SEQ ID NO: 6263158 - DNA, 19 bp, Homo sapiens
gctcagttgctaaacactg

SEQ ID NO: 6263159 - DNA, 12 bp, Homo sapiens
gctcagttgtag

SEQ ID NO: 6263160 - DNA, 17 bp, Homo sapiens
gctcagttgtagaatgt

SEQ ID NO: 6263161 - DNA, 13 bp, Homo sapiens
gctcagtttggct

SEQ ID NO: 6263162 - DNA, 23 bp, Homo sapiens
gctcataaaacatgaatcaagca

SEQ ID NO: 6263163 - DNA, 21 bp, Homo sapiens
gctcataaaatggaagcaatt

SEQ ID NO: 6263164 - DNA, 22 bp, Homo sapiens
gctcataaagatgttaaatgga

SEQ ID NO: 6263165 - DNA, 18 bp, Homo sapiens
gctcataacatctttgaa

SEQ ID NO: 6263166 - DNA, 20 bp, Homo sapiens
gctcataatggaaaaaaaga

SEQ ID NO: 6263167 - DNA, 16 bp, Homo sapiens
gctcatacaaaataaa

SEQ ID NO: 6263168 - DNA, 20 bp, Homo sapiens
gctcatacaggaatgaagcc

SEQ ID NO: 6263169 - DNA, 22 bp, Homo sapiens
gctcatagaattttgagtattc

SEQ ID NO: 6263170 - DNA, 19 bp, Homo sapiens
gctcatagaggtgagaaaa

SEQ ID NO: 6263171 - DNA, 16 bp, Homo sapiens
gctcatagcacatgtt

SEQ ID NO: 6263172 - DNA, 22 bp, Homo sapiens
gctcatagcacatgttttacaa

SEQ ID NO: 6263173 - DNA, 19 bp, Homo sapiens
gctcatatggggctgggag

SEQ ID NO: 6263174 - DNA, 15 bp, Homo sapiens
gctcatatttcccat

SEQ ID NO: 6263175 - DNA, 19 bp, Homo sapiens
gctcatcacccagtcctgg

SEQ ID NO: 6263176 - DNA, 21 bp, Homo sapiens
gctcatcacccagtcctggcc

SEQ ID NO: 6263177 - DNA, 22 bp, Homo sapiens
gctcatcacccggatagaggac

SEQ ID NO: 6263178 - DNA, 15 bp, Homo sapiens
gctcatcactgtgcc

SEQ ID NO: 6263179 - DNA, 16 bp, Homo sapiens
gctcatcagaactgaa

SEQ ID NO: 6263180 - DNA, 15 bp, Homo sapiens
gctcatcatattcca

SEQ ID NO: 6263181 - DNA, 21 bp, Homo sapiens
gctcatccccacctgtcttca

SEQ ID NO: 6263182 - DNA, 18 bp, Homo sapiens
gctcatcccccctgctgc

SEQ ID NO: 6263183 - DNA, 14 bp, Homo sapiens
gctcatccctggac

SEQ ID NO: 6263184 - DNA, 23 bp, Homo sapiens
gctcatcctgtagggcacccaaa

SEQ ID NO: 6263185 - DNA, 15 bp, Homo sapiens
gctcatctacacata

SEQ ID NO: 6263186 - DNA, 22 bp, Homo sapiens
gctcatctctggaaggggcagc

SEQ ID NO: 6263187 - DNA, 14 bp, Homo sapiens
gctcatctgagcca

SEQ ID NO: 6263188 - DNA, 15 bp, Homo sapiens
gctcatctgctggtc

SEQ ID NO: 6263189 - DNA, 16 bp, Homo sapiens
gctcatctgctggtcc

SEQ ID NO: 6263190 - DNA, 15 bp, Homo sapiens
gctcatgagctcctg

SEQ ID NO: 6263191 - DNA, 22 bp, Homo sapiens
gctcatgcctgtaatcccagca

SEQ ID NO: 6263192 - DNA, 13 bp, Homo sapiens
gctcatgctgctc

SEQ ID NO: 6263193 - DNA, 23 bp, Homo sapiens
gctcatggcgtaatgggcctgcc

SEQ ID NO: 6263194 - DNA, 16 bp, Homo sapiens
gctcatgggcccctct

SEQ ID NO: 6263195 - DNA, 15 bp, Homo sapiens
gctcatggtccccat

SEQ ID NO: 6263196 - DNA, 20 bp, Homo sapiens
gctcatgtaatgtggtcacc

SEQ ID NO: 6263197 - DNA, 15 bp, Homo sapiens
gctcatgtagcaatc

SEQ ID NO: 6263198 - DNA, 21 bp, Homo sapiens
gctcatgtaggtgagcctggg

SEQ ID NO: 6263199 - DNA, 22 bp, Homo sapiens
gctcatgtaggtgagcctgggc

SEQ ID NO: 6263200 - DNA, 23 bp, Homo sapiens
gctcatgtaggtgagcctgggca

SEQ ID NO: 6263201 - DNA, 21 bp, Homo sapiens
gctcatgtccctgtccccagg

SEQ ID NO: 6263202 - DNA, 15 bp, Homo sapiens
gctcatgtcctgtcc

SEQ ID NO: 6263203 - DNA, 20 bp, Homo sapiens
gctcatgtcctgtcctggtc

SEQ ID NO: 6263204 - DNA, 19 bp, Homo sapiens
gctcattaaactgattcca

SEQ ID NO: 6263205 - DNA, 17 bp, Homo sapiens
gctcattaaactttttt

SEQ ID NO: 6263206 - DNA, 20 bp, Homo sapiens
gctcattacagttctttcct

SEQ ID NO: 6263207 - DNA, 23 bp, Homo sapiens
gctcattacagttctttcctctt

SEQ ID NO: 6263208 - DNA, 13 bp, Homo sapiens
gctcattatgaaa

SEQ ID NO: 6263209 - DNA, 18 bp, Homo sapiens
gctcattcagcatctgac

SEQ ID NO: 6263210 - DNA, 22 bp, Homo sapiens
gctcattcagcatctgacctct

SEQ ID NO: 6263211 - DNA, 22 bp, Homo sapiens
gctcattcatattcctgccttt

SEQ ID NO: 6263212 - DNA, 17 bp, Homo sapiens
gctcattcattttatat

SEQ ID NO: 6263213 - DNA, 22 bp, Homo sapiens
gctcattcattttatattgaaa

SEQ ID NO: 6263214 - DNA, 16 bp, Homo sapiens
gctcattccacactgt

SEQ ID NO: 6263215 - DNA, 12 bp, Homo sapiens
gctcattccatg

SEQ ID NO: 6263216 - DNA, 22 bp, Homo sapiens
gctcattccatgactctgccta

SEQ ID NO: 6263217 - DNA, 22 bp, Homo sapiens
gctcattctgcaccttgccagg

SEQ ID NO: 6263218 - DNA, 17 bp, Homo sapiens
gctcattcttcagttct

SEQ ID NO: 6263219 - DNA, 13 bp, Homo sapiens
gctcattcttttc

SEQ ID NO: 6263220 - DNA, 19 bp, Homo sapiens
gctcattgtataagccccg

SEQ ID NO: 6263221 - DNA, 16 bp, Homo sapiens
gctcattgtggccagt

SEQ ID NO: 6263222 - DNA, 14 bp, Homo sapiens
gctcatttaaaaca

SEQ ID NO: 6263223 - DNA, 11 bp, Homo sapiens
gctcatttaag

SEQ ID NO: 6263224 - DNA, 17 bp, Homo sapiens
gctcatttaatcccagg

SEQ ID NO: 6263225 - DNA, 18 bp, Homo sapiens
gctcatttaatcccagga

SEQ ID NO: 6263226 - DNA, 14 bp, Homo sapiens
gctcatttcaggat

SEQ ID NO: 6263227 - DNA, 16 bp, Homo sapiens
gctcatttcagtttct

SEQ ID NO: 6263228 - DNA, 12 bp, Homo sapiens
gctcatttcatg

SEQ ID NO: 6263229 - DNA, 16 bp, Homo sapiens
gctcatttcatgaagc

SEQ ID NO: 6263230 - DNA, 17 bp, Homo sapiens
gctcatttgagaactgt

SEQ ID NO: 6263231 - DNA, 21 bp, Homo sapiens
gctcatttggggaccacagag

SEQ ID NO: 6263232 - DNA, 21 bp, Homo sapiens
gctcattttcctgacatttgt

SEQ ID NO: 6263233 - DNA, 16 bp, Homo sapiens
gctcattttgcaattt

SEQ ID NO: 6263234 - DNA, 13 bp, Homo sapiens
gctcatttttgca

SEQ ID NO: 6263235 - DNA, 15 bp, Homo sapiens
gctcattttttctta

SEQ ID NO: 6263236 - DNA, 18 bp, Homo sapiens
gctccaaaccctcgaggc

SEQ ID NO: 6263237 - DNA, 22 bp, Homo sapiens
gctccaaaccttcacacacaga

SEQ ID NO: 6263238 - DNA, 20 bp, Homo sapiens
gctccaaagtcataattgca

SEQ ID NO: 6263239 - DNA, 14 bp, Homo sapiens
gctccaacagaaat

SEQ ID NO: 6263240 - DNA, 18 bp, Homo sapiens
gctccaacagacaccctc

SEQ ID NO: 6263241 - DNA, 21 bp, Homo sapiens
gctccaacagcttgaccagac

SEQ ID NO: 6263242 - DNA, 18 bp, Homo sapiens
gctccaacccgttgggtc

SEQ ID NO: 6263243 - DNA, 21 bp, Homo sapiens
gctccaacccgttgggtccct

SEQ ID NO: 6263244 - DNA, 16 bp, Homo sapiens
gctccaacctggaggc

SEQ ID NO: 6263245 - DNA, 22 bp, Homo sapiens
gctccaacctggaggctggacc

SEQ ID NO: 6263246 - DNA, 13 bp, Homo sapiens
gctccaactccaa

SEQ ID NO: 6263247 - DNA, 21 bp, Homo sapiens
gctccaactccaacatccact

SEQ ID NO: 6263248 - DNA, 22 bp, Homo sapiens
gctccaactcctttcagccaca

SEQ ID NO: 6263249 - DNA, 23 bp, Homo sapiens
gctccaactcctttcagccacat

SEQ ID NO: 6263250 - DNA, 18 bp, Homo sapiens
gctccaagacctaggctc

SEQ ID NO: 6263251 - DNA, 16 bp, Homo sapiens
gctccaagacctgttg

SEQ ID NO: 6263252 - DNA, 17 bp, Homo sapiens
gctccaagatgttctcc

SEQ ID NO: 6263253 - DNA, 14 bp, Homo sapiens
gctccaagattcta

SEQ ID NO: 6263254 - DNA, 15 bp, Homo sapiens
gctccaagattctag

SEQ ID NO: 6263255 - DNA, 13 bp, Homo sapiens
gctccaagcacaa

SEQ ID NO: 6263256 - DNA, 19 bp, Homo sapiens
gctccaagccccatcttct

SEQ ID NO: 6263257 - DNA, 13 bp, Homo sapiens
gctccaagctccc

SEQ ID NO: 6263258 - DNA, 14 bp, Homo sapiens
gctccaagctccca

SEQ ID NO: 6263259 - DNA, 16 bp, Homo sapiens
gctccaagctcccagg

SEQ ID NO: 6263260 - DNA, 21 bp, Homo sapiens
gctccaagctcccaggcattc

SEQ ID NO: 6263261 - DNA, 12 bp, Homo sapiens
gctccaagctgt

SEQ ID NO: 6263262 - DNA, 13 bp, Homo sapiens
gctccaagctgtt

SEQ ID NO: 6263263 - DNA, 13 bp, Homo sapiens
gctccaaggcagt

SEQ ID NO: 6263264 - DNA, 14 bp, Homo sapiens
gctccaaggcagtg

SEQ ID NO: 6263265 - DNA, 14 bp, Homo sapiens
gctccaagggacag

SEQ ID NO: 6263266 - DNA, 19 bp, Homo sapiens
gctccaagggacaggtggg

SEQ ID NO: 6263267 - DNA, 20 bp, Homo sapiens
gctccaagggacaggtgggc

SEQ ID NO: 6263268 - DNA, 23 bp, Homo sapiens
gctccaagggacaggtgggcctg

SEQ ID NO: 6263269 - DNA, 16 bp, Homo sapiens
gctccaaggtgctctg

SEQ ID NO: 6263270 - DNA, 17 bp, Homo sapiens
gctccaaggtgctctgt

SEQ ID NO: 6263271 - DNA, 21 bp, Homo sapiens
gctccaatctctggtgcctaa

SEQ ID NO: 6263272 - DNA, 23 bp, Homo sapiens
gctccaatggggcggggcttctc

SEQ ID NO: 6263273 - DNA, 16 bp, Homo sapiens
gctccaatttccccac

SEQ ID NO: 6263274 - DNA, 18 bp, Homo sapiens
gctccacacattccagcc

SEQ ID NO: 6263275 - DNA, 19 bp, Homo sapiens
gctccacacattccagcca

SEQ ID NO: 6263276 - DNA, 20 bp, Homo sapiens
gctccacacattccagccag

SEQ ID NO: 6263277 - DNA, 21 bp, Homo sapiens
gctccacaccctctcccagga

SEQ ID NO: 6263278 - DNA, 14 bp, Homo sapiens
gctccacacctcca

SEQ ID NO: 6263279 - DNA, 19 bp, Homo sapiens
gctccacacgccccggtcc

SEQ ID NO: 6263280 - DNA, 16 bp, Homo sapiens
gctccacagccatccc

SEQ ID NO: 6263281 - DNA, 12 bp, Homo sapiens
gctccacagtgt

SEQ ID NO: 6263282 - DNA, 15 bp, Homo sapiens
gctccaccacatcct

SEQ ID NO: 6263283 - DNA, 16 bp, Homo sapiens
gctccaccactgtgca

SEQ ID NO: 6263284 - DNA, 21 bp, Homo sapiens
gctccaccactgtgcacttag

SEQ ID NO: 6263285 - DNA, 20 bp, Homo sapiens
gctccaccagcatcacctgc

SEQ ID NO: 6263286 - DNA, 23 bp, Homo sapiens
gctccaccctcaccaggatgaag

SEQ ID NO: 6263287 - DNA, 17 bp, Homo sapiens
gctccaccctcccccag

SEQ ID NO: 6263288 - DNA, 21 bp, Homo sapiens
gctccaccctcccccagacac

SEQ ID NO: 6263289 - DNA, 15 bp, Homo sapiens
gctccaccctcccct

SEQ ID NO: 6263290 - DNA, 19 bp, Homo sapiens
gctccacccttggcctgtc

SEQ ID NO: 6263291 - DNA, 23 bp, Homo sapiens
gctccacccttggcctgtctcat

SEQ ID NO: 6263292 - DNA, 13 bp, Homo sapiens
gctccacctctgg

SEQ ID NO: 6263293 - DNA, 14 bp, Homo sapiens
gctccacctctggt

SEQ ID NO: 6263294 - DNA, 19 bp, Homo sapiens
gctccaccttgcagctctc

SEQ ID NO: 6263295 - DNA, 15 bp, Homo sapiens
gctccacgccctggg

SEQ ID NO: 6263296 - DNA, 16 bp, Homo sapiens
gctccacgccctgggg

SEQ ID NO: 6263297 - DNA, 18 bp, Homo sapiens
gctccacgccctggggag

SEQ ID NO: 6263298 - DNA, 21 bp, Homo sapiens
gctccacgggggcctagtggc

SEQ ID NO: 6263299 - DNA, 21 bp, Homo sapiens
gctccacggtgcgtggctgtg

SEQ ID NO: 6263300 - DNA, 16 bp, Homo sapiens
gctccactattttatt

SEQ ID NO: 6263301 - DNA, 17 bp, Homo sapiens
gctccactcagggctgg

SEQ ID NO: 6263302 - DNA, 13 bp, Homo sapiens
gctccactctgct

SEQ ID NO: 6263303 - DNA, 16 bp, Homo sapiens
gctccactctgcttct

SEQ ID NO: 6263304 - DNA, 15 bp, Homo sapiens
gctccactgccatgt

SEQ ID NO: 6263305 - DNA, 16 bp, Homo sapiens
gctccactgccatgta

SEQ ID NO: 6263306 - DNA, 12 bp, Homo sapiens
gctccactgtca

SEQ ID NO: 6263307 - DNA, 17 bp, Homo sapiens
gctccactttctcatcc

SEQ ID NO: 6263308 - DNA, 15 bp, Homo sapiens
gctccagaagatgcc

SEQ ID NO: 6263309 - DNA, 20 bp, Homo sapiens
gctccagaatgtgctgcctt

SEQ ID NO: 6263310 - DNA, 20 bp, Homo sapiens
gctccagaattaaggtttgt

SEQ ID NO: 6263311 - DNA, 18 bp, Homo sapiens
gctccagacacatgtcca

SEQ ID NO: 6263312 - DNA, 23 bp, Homo sapiens
gctccagacacatgtccaagaag

SEQ ID NO: 6263313 - DNA, 12 bp, Homo sapiens
gctccagacagg

SEQ ID NO: 6263314 - DNA, 20 bp, Homo sapiens
gctccagacaggaggagtgg

SEQ ID NO: 6263315 - DNA, 14 bp, Homo sapiens
gctccagacaggga

SEQ ID NO: 6263316 - DNA, 23 bp, Homo sapiens
gctccagacccccagcaaccctc

SEQ ID NO: 6263317 - DNA, 12 bp, Homo sapiens
gctccagacctg

SEQ ID NO: 6263318 - DNA, 20 bp, Homo sapiens
gctccagacctgatcctgga

SEQ ID NO: 6263319 - DNA, 13 bp, Homo sapiens
gctccagacctgc

SEQ ID NO: 6263320 - DNA, 19 bp, Homo sapiens
gctccagacctgcccctcc

SEQ ID NO: 6263321 - DNA, 22 bp, Homo sapiens
gctccagacctgcccctccctc

SEQ ID NO: 6263322 - DNA, 21 bp, Homo sapiens
gctccagagagaggatgcaga

SEQ ID NO: 6263323 - DNA, 17 bp, Homo sapiens
gctccagaggacctgag

SEQ ID NO: 6263324 - DNA, 20 bp, Homo sapiens
gctccagagggcactctgct

SEQ ID NO: 6263325 - DNA, 18 bp, Homo sapiens
gctccagataactctctt

SEQ ID NO: 6263326 - DNA, 20 bp, Homo sapiens
gctccagataactctctttc

SEQ ID NO: 6263327 - DNA, 22 bp, Homo sapiens
gctccagataactctctttcct

SEQ ID NO: 6263328 - DNA, 20 bp, Homo sapiens
gcactcatgacggcctgcct

SEQ ID NO: 6263329 - DNA, 17 bp, Homo sapiens
gcactcattttctataa

SEQ ID NO: 6263330 - DNA, 19 bp, Homo sapiens
gcactccacacatctttct

SEQ ID NO: 6263331 - DNA, 13 bp, Homo sapiens
gcactccagactc

SEQ ID NO: 6263332 - DNA, 17 bp, Homo sapiens
gcactccagactctggg

SEQ ID NO: 6263333 - DNA, 19 bp, Homo sapiens
gcactccagactctggggg

SEQ ID NO: 6263334 - DNA, 14 bp, Homo sapiens
gcactccagcctga

SEQ ID NO: 6263335 - DNA, 15 bp, Homo sapiens
gcactccagcctgag

SEQ ID NO: 6263336 - DNA, 17 bp, Homo sapiens
gcactccagcctgggcg

SEQ ID NO: 6263337 - DNA, 17 bp, Homo sapiens
gcactccagcctggggg

SEQ ID NO: 6263338 - DNA, 17 bp, Homo sapiens
gcactccagcctgggtc

SEQ ID NO: 6263339 - DNA, 15 bp, Homo sapiens
gcactccatccagct

SEQ ID NO: 6263340 - DNA, 21 bp, Homo sapiens
gcactccatgcttagtcactg

SEQ ID NO: 6263341 - DNA, 15 bp, Homo sapiens
gcactcccagggccc

SEQ ID NO: 6263342 - DNA, 16 bp, Homo sapiens
gcactcccagggcccg

SEQ ID NO: 6263343 - DNA, 18 bp, Homo sapiens
gcactcccagggcccgag

SEQ ID NO: 6263344 - DNA, 20 bp, Homo sapiens
gcactccccagagctgtgcc

SEQ ID NO: 6263345 - DNA, 21 bp, Homo sapiens
gcactccccagagctgtgcca

SEQ ID NO: 6263346 - DNA, 15 bp, Homo sapiens
gcactcccccagttc

SEQ ID NO: 6263347 - DNA, 14 bp, Homo sapiens
gcactcccctgctg

SEQ ID NO: 6263348 - DNA, 22 bp, Homo sapiens
gcactcccctgctgggtgtggc

SEQ ID NO: 6263349 - DNA, 14 bp, Homo sapiens
gcactcccgcctgg

SEQ ID NO: 6263350 - DNA, 19 bp, Homo sapiens
gcactccctaatttatgtg

SEQ ID NO: 6263351 - DNA, 16 bp, Homo sapiens
gcactccctccagcac

SEQ ID NO: 6263352 - DNA, 17 bp, Homo sapiens
gcactccctccagcaca

SEQ ID NO: 6263353 - DNA, 15 bp, Homo sapiens
gcactccctcctgga

SEQ ID NO: 6263354 - DNA, 14 bp, Homo sapiens
gcactccctggcct

SEQ ID NO: 6263355 - DNA, 14 bp, Homo sapiens
gcactccggaggta

SEQ ID NO: 6263356 - DNA, 19 bp, Homo sapiens
gcactcctcggtactccca

SEQ ID NO: 6263357 - DNA, 18 bp, Homo sapiens
gcactcctctgtctctgc

SEQ ID NO: 6263358 - DNA, 21 bp, Homo sapiens
gcactcctctgtctctgctct

SEQ ID NO: 6263359 - DNA, 12 bp, Homo sapiens
gcactcctgatt

SEQ ID NO: 6263360 - DNA, 11 bp, Homo sapiens
gcactcctgcc

SEQ ID NO: 6263361 - DNA, 13 bp, Homo sapiens
gcactcctgtctc

SEQ ID NO: 6263362 - DNA, 16 bp, Homo sapiens
gcactcctttatctgt

SEQ ID NO: 6263363 - DNA, 18 bp, Homo sapiens
gcactcgagaccatcctg

SEQ ID NO: 6263364 - DNA, 14 bp, Homo sapiens
gcactcgcactgca

SEQ ID NO: 6263365 - DNA, 20 bp, Homo sapiens
gcactcgctagcagtggcag

SEQ ID NO: 6263366 - DNA, 18 bp, Homo sapiens
gcactcgctgttatcaaa

SEQ ID NO: 6263367 - DNA, 17 bp, Homo sapiens
gcactcggggtccctgg

SEQ ID NO: 6263368 - DNA, 17 bp, Homo sapiens
gcactctaaaaggttca

SEQ ID NO: 6263369 - DNA, 17 bp, Homo sapiens
gcactctaaactgcaaa

SEQ ID NO: 6263370 - DNA, 18 bp, Homo sapiens
gcactctaaactgcaaac

SEQ ID NO: 6263371 - DNA, 14 bp, Homo sapiens
gcactctcacccca

SEQ ID NO: 6263372 - DNA, 23 bp, Homo sapiens
gcactctcaccccaagcggcctt

SEQ ID NO: 6263373 - DNA, 22 bp, Homo sapiens
gcactctcatatgccaccccat

SEQ ID NO: 6263374 - DNA, 20 bp, Homo sapiens
gcactctcctgtctgaacct

SEQ ID NO: 6263375 - DNA, 21 bp, Homo sapiens
gcactctctctctgttaaaga

SEQ ID NO: 6263376 - DNA, 13 bp, Homo sapiens
gcactctctgcca

SEQ ID NO: 6263377 - DNA, 14 bp, Homo sapiens
gcactctctgccag

SEQ ID NO: 6263378 - DNA, 22 bp, Homo sapiens
gcactctctgccattctgtgca

SEQ ID NO: 6263379 - DNA, 14 bp, Homo sapiens
gcactctgccccca

SEQ ID NO: 6263380 - DNA, 13 bp, Homo sapiens
gcactctgctggc

SEQ ID NO: 6263381 - DNA, 18 bp, Homo sapiens
gcactctggactccacga

SEQ ID NO: 6263382 - DNA, 20 bp, Homo sapiens
gcactctggcggtggccaca

SEQ ID NO: 6263383 - DNA, 12 bp, Homo sapiens
gcactctggggt

SEQ ID NO: 6263384 - DNA, 21 bp, Homo sapiens
gcactctggggtgggagggtc

SEQ ID NO: 6263385 - DNA, 20 bp, Homo sapiens
gcactctgggtctggccagg

SEQ ID NO: 6263386 - DNA, 20 bp, Homo sapiens
gcactctgtgcccatgggca

SEQ ID NO: 6263387 - DNA, 14 bp, Homo sapiens
gcactctgttattt

SEQ ID NO: 6263388 - DNA, 19 bp, Homo sapiens
gcactctgttatttagact

SEQ ID NO: 6263389 - DNA, 17 bp, Homo sapiens
gcactctgttcccctcc

SEQ ID NO: 6263390 - DNA, 22 bp, Homo sapiens
gcactctgttcccctccccctt

SEQ ID NO: 6263391 - DNA, 12 bp, Homo sapiens
gcactgaaacct

SEQ ID NO: 6263392 - DNA, 17 bp, Homo sapiens
gcactgaaacctgagat

SEQ ID NO: 6263393 - DNA, 12 bp, Homo sapiens
gcactgaacagg

SEQ ID NO: 6263394 - DNA, 15 bp, Homo sapiens
gcactgaacaggctg

SEQ ID NO: 6263395 - DNA, 19 bp, Homo sapiens
gcactgaaccttaggcttt

SEQ ID NO: 6263396 - DNA, 9 bp, Homo sapiens
gcactgaag

SEQ ID NO: 6263397 - DNA, 13 bp, Homo sapiens
gcactgaagagct

SEQ ID NO: 6263398 - DNA, 16 bp, Homo sapiens
gcactgaagagctctt

SEQ ID NO: 6263399 - DNA, 11 bp, Homo sapiens
gcactgaagcc

SEQ ID NO: 6263400 - DNA, 21 bp, Homo sapiens
gcactgaagccggacagctgc

SEQ ID NO: 6263401 - DNA, 18 bp, Homo sapiens
gcactgaagtttttgaaa

SEQ ID NO: 6263402 - DNA, 19 bp, Homo sapiens
gcactgaagtttttgaaat

SEQ ID NO: 6263403 - DNA, 16 bp, Homo sapiens
gcactgaataaagcac

SEQ ID NO: 6263404 - DNA, 20 bp, Homo sapiens
gcactgaataaagcacgtgc

SEQ ID NO: 6263405 - DNA, 21 bp, Homo sapiens
gcactgaataaattgtacagc

SEQ ID NO: 6263406 - DNA, 20 bp, Homo sapiens
gcactgaatatataaacact

SEQ ID NO: 6263407 - DNA, 12 bp, Homo sapiens
gcactgacaaga

SEQ ID NO: 6263408 - DNA, 14 bp, Homo sapiens
gcactgacagcctg

SEQ ID NO: 6263409 - DNA, 17 bp, Homo sapiens
gcactgacagcctgggg

SEQ ID NO: 6263410 - DNA, 18 bp, Homo sapiens
gcactgacagcctggggg

SEQ ID NO: 6263411 - DNA, 15 bp, Homo sapiens
gcactgacccttcca

SEQ ID NO: 6263412 - DNA, 16 bp, Homo sapiens
gcactgacccttccag

SEQ ID NO: 6263413 - DNA, 20 bp, Homo sapiens
gcactgacccttccagacat

SEQ ID NO: 6263414 - DNA, 21 bp, Homo sapiens
gcactgacccttccagacata

SEQ ID NO: 6263415 - DNA, 21 bp, Homo sapiens
gcactgacctgctccgccagg

SEQ ID NO: 6263416 - DNA, 14 bp, Homo sapiens
gcactgactgatag

SEQ ID NO: 6263417 - DNA, 15 bp, Homo sapiens
gcactgactggaagg

SEQ ID NO: 6263418 - DNA, 20 bp, Homo sapiens
gcactgactgggaccaggca

SEQ ID NO: 6263419 - DNA, 21 bp, Homo sapiens
gcactgagagagcgcagccgc

SEQ ID NO: 6263420 - DNA, 21 bp, Homo sapiens
gcactgagatatttattgttt

SEQ ID NO: 6263421 - DNA, 11 bp, Homo sapiens
gcactgagccc

SEQ ID NO: 6263422 - DNA, 16 bp, Homo sapiens
gcactgagcgcctgca

SEQ ID NO: 6263423 - DNA, 17 bp, Homo sapiens
gcactgagcgcctgcag

SEQ ID NO: 6263424 - DNA, 19 bp, Homo sapiens
gcactgagctcacatggga

SEQ ID NO: 6263425 - DNA, 22 bp, Homo sapiens
gcactgagctcacatgggactg

SEQ ID NO: 6263426 - DNA, 13 bp, Homo sapiens
gcactgaggaaga

SEQ ID NO: 6263427 - DNA, 13 bp, Homo sapiens
gcactgagggatc

SEQ ID NO: 6263428 - DNA, 24 bp, Homo sapiens
gcactgagggccacactattacca

SEQ ID NO: 6263429 - DNA, 19 bp, Homo sapiens
gcactgagggtggcactca

SEQ ID NO: 6263430 - DNA, 18 bp, Homo sapiens
gcactgagtacaaatgtg

SEQ ID NO: 6263431 - DNA, 22 bp, Homo sapiens
gcactgatatatttaaaaacaa

SEQ ID NO: 6263432 - DNA, 17 bp, Homo sapiens
gcactgatcaatccttc

SEQ ID NO: 6263433 - DNA, 13 bp, Homo sapiens
gcactgatgtccc

SEQ ID NO: 6263434 - DNA, 17 bp, Homo sapiens
gcactgatgtgtgaagt

SEQ ID NO: 6263435 - DNA, 14 bp, Homo sapiens
gcactgcacactca

SEQ ID NO: 6263436 - DNA, 16 bp, Homo sapiens
gcactgcacactcagt

SEQ ID NO: 6263437 - DNA, 16 bp, Homo sapiens
gcactgcacataattt

SEQ ID NO: 6263438 - DNA, 12 bp, Homo sapiens
gcactgcacctg

SEQ ID NO: 6263439 - DNA, 23 bp, Homo sapiens
gcactgcacctgcctccagccgc

SEQ ID NO: 6263440 - DNA, 17 bp, Homo sapiens
gcactgcaggtggcctc

SEQ ID NO: 6263441 - DNA, 23 bp, Homo sapiens
gcactgcaggtggcctccctcca

SEQ ID NO: 6263442 - DNA, 14 bp, Homo sapiens
gcactgcagtgatg

SEQ ID NO: 6263443 - DNA, 23 bp, Homo sapiens
gcactgcatgcaaacaagaaacg

SEQ ID NO: 6263444 - DNA, 19 bp, Homo sapiens
gcactgcatgtcagagcac

SEQ ID NO: 6263445 - DNA, 20 bp, Homo sapiens
gcactgcatgtcagagcact

SEQ ID NO: 6263446 - DNA, 17 bp, Homo sapiens
gcactgcattcctgtgc

SEQ ID NO: 6263447 - DNA, 22 bp, Homo sapiens
gcactgcattcctgtgccctag

SEQ ID NO: 6263448 - DNA, 23 bp, Homo sapiens
gcactgccaccagcaatgccctg

SEQ ID NO: 6263449 - DNA, 14 bp, Homo sapiens
gcactgcccacatg

SEQ ID NO: 6263450 - DNA, 20 bp, Homo sapiens
gcactgcccacatgggacct

SEQ ID NO: 6263451 - DNA, 21 bp, Homo sapiens
gcactgcccacatgggacctg

SEQ ID NO: 6263452 - DNA, 13 bp, Homo sapiens
gcactgccccaca

SEQ ID NO: 6263453 - DNA, 15 bp, Homo sapiens
gcactgccccacatg

SEQ ID NO: 6263454 - DNA, 17 bp, Homo sapiens
gcactgccccacatgca

SEQ ID NO: 6263455 - DNA, 20 bp, Homo sapiens
gcactgccccacatgcatgt

SEQ ID NO: 6263456 - DNA, 13 bp, Homo sapiens
gcactgccctccg

SEQ ID NO: 6263457 - DNA, 22 bp, Homo sapiens
gcactgccctgttcatgtgcct

SEQ ID NO: 6263458 - DNA, 11 bp, Homo sapiens
gcactgcctga

SEQ ID NO: 6263459 - DNA, 18 bp, Homo sapiens
gcactgcctgcatgagct

SEQ ID NO: 6263460 - DNA, 15 bp, Homo sapiens
gcactgcctgccaag

SEQ ID NO: 6263461 - DNA, 19 bp, Homo sapiens
gcactgcctgctcccatcc

SEQ ID NO: 6263462 - DNA, 20 bp, Homo sapiens
gcactgctaggcgagtgcca

SEQ ID NO: 6263463 - DNA, 18 bp, Homo sapiens
gcactgctcacgtctctg

SEQ ID NO: 6263464 - DNA, 19 bp, Homo sapiens
gcactgctcacgtctctgc

SEQ ID NO: 6263465 - DNA, 21 bp, Homo sapiens
gcactgctcacgtctctgccg

SEQ ID NO: 6263466 - DNA, 17 bp, Homo sapiens
gcactgctccaagggac

SEQ ID NO: 6263467 - DNA, 21 bp, Homo sapiens
gcactgctccaagggacaggt

SEQ ID NO: 6263468 - DNA, 13 bp, Homo sapiens
gcactgctctcac

SEQ ID NO: 6263469 - DNA, 15 bp, Homo sapiens
gcactgctgcccagc

SEQ ID NO: 6263470 - DNA, 16 bp, Homo sapiens
gcactgctgcctcagc

SEQ ID NO: 6263471 - DNA, 14 bp, Homo sapiens
gcactgctgggtgg

SEQ ID NO: 6263472 - DNA, 19 bp, Homo sapiens
gcactgctgggtggcccat

SEQ ID NO: 6263473 - DNA, 13 bp, Homo sapiens
gcactgctgtgtc

SEQ ID NO: 6263474 - DNA, 22 bp, Homo sapiens
gcactgctgttcctgctccatg

SEQ ID NO: 6263475 - DNA, 12 bp, Homo sapiens
gcactgcttcca

SEQ ID NO: 6263476 - DNA, 22 bp, Homo sapiens
gcactgcttccagtgaggctct

SEQ ID NO: 6263477 - DNA, 23 bp, Homo sapiens
gcactgcttccagtgaggctctg

SEQ ID NO: 6263478 - DNA, 16 bp, Homo sapiens
gcactgcttgaggaaa

SEQ ID NO: 6263479 - DNA, 17 bp, Homo sapiens
gcactgcttgaggaaaa

SEQ ID NO: 6263480 - DNA, 21 bp, Homo sapiens
gcactgcttgaggaggggcac

SEQ ID NO: 6263481 - DNA, 14 bp, Homo sapiens
gcactggaaaacat

SEQ ID NO: 6263482 - DNA, 19 bp, Homo sapiens
gcactggaaccacctggac

SEQ ID NO: 6263483 - DNA, 15 bp, Homo sapiens
gcactggactccggg

SEQ ID NO: 6263484 - DNA, 14 bp, Homo sapiens
gcactggagccaca

SEQ ID NO: 6263485 - DNA, 12 bp, Homo sapiens
gcactggaggcc

SEQ ID NO: 6263486 - DNA, 17 bp, Homo sapiens
gcactggaggcctctgc

SEQ ID NO: 6263487 - DNA, 18 bp, Homo sapiens
gcactggaggggcccacc

SEQ ID NO: 6263488 - DNA, 21 bp, Homo sapiens
gcactggaggggcccacccac

SEQ ID NO: 6263489 - DNA, 14 bp, Homo sapiens
gcactggagtccag

SEQ ID NO: 6263490 - DNA, 23 bp, Homo sapiens
gcactggagtggctcgccaggcc

SEQ ID NO: 6263491 - DNA, 22 bp, Homo sapiens
gcactggattgtagaacttgtt

SEQ ID NO: 6263492 - DNA, 20 bp, Homo sapiens
gcactggcaaacagggcctc

SEQ ID NO: 6263493 - DNA, 20 bp, Homo sapiens
gcactggcaggatcacagct

SEQ ID NO: 6263494 - DNA, 19 bp, Homo sapiens
gcactggcattgtccctgt

SEQ ID NO: 6263495 - DNA, 20 bp, Homo sapiens
gcactggcattgtccctgtg

SEQ ID NO: 6263496 - DNA, 14 bp, Homo sapiens
gcactggccagaga

SEQ ID NO: 6263497 - DNA, 16 bp, Homo sapiens
gcactggccagagagg

SEQ ID NO: 6263498 - DNA, 18 bp, Homo sapiens
gcactggccagagagggc

SEQ ID NO: 6263499 - DNA, 22 bp, Homo sapiens
gcactggccagagagggcccag

SEQ ID NO: 6263500 - DNA, 12 bp, Homo sapiens
gcactggccttg

SEQ ID NO: 6263501 - DNA, 19 bp, Homo sapiens
gcactggccttgcctccag

SEQ ID NO: 6263502 - DNA, 17 bp, Homo sapiens
gcactggctctctccag

SEQ ID NO: 6263503 - DNA, 19 bp, Homo sapiens
gcactggctctctccagga

SEQ ID NO: 6263504 - DNA, 16 bp, Homo sapiens
gcactggctgctctgt

SEQ ID NO: 6263505 - DNA, 15 bp, Homo sapiens
gcactgggaaggaaa

SEQ ID NO: 6263506 - DNA, 11 bp, Homo sapiens
gcactgggagg

SEQ ID NO: 6263507 - DNA, 14 bp, Homo sapiens
gctccagatcctct

SEQ ID NO: 6263508 - DNA, 18 bp, Homo sapiens
gctccagatgcagggcag

SEQ ID NO: 6263509 - DNA, 13 bp, Homo sapiens
gctccagatgttt

SEQ ID NO: 6263510 - DNA, 16 bp, Homo sapiens
gctccagattctgatg

SEQ ID NO: 6263511 - DNA, 18 bp, Homo sapiens
gctccagattctgatgca

SEQ ID NO: 6263512 - DNA, 19 bp, Homo sapiens
gctccagcaacacagcctg

SEQ ID NO: 6263513 - DNA, 17 bp, Homo sapiens
gctccagcagtgctggg

SEQ ID NO: 6263514 - DNA, 18 bp, Homo sapiens
gctccagcagtgctgggc

SEQ ID NO: 6263515 - DNA, 22 bp, Homo sapiens
gctccagcagtgctgggcccag

SEQ ID NO: 6263516 - DNA, 14 bp, Homo sapiens
gctccagcatccag

SEQ ID NO: 6263517 - DNA, 16 bp, Homo sapiens
gctccagcatccagcc

SEQ ID NO: 6263518 - DNA, 19 bp, Homo sapiens
gctccagcatccagcctgt

SEQ ID NO: 6263519 - DNA, 20 bp, Homo sapiens
gctccagcatccagcctgtg

SEQ ID NO: 6263520 - DNA, 21 bp, Homo sapiens
gctccagcatccagcctgtgt

SEQ ID NO: 6263521 - DNA, 17 bp, Homo sapiens
gctccagccaacccctg

SEQ ID NO: 6263522 - DNA, 11 bp, Homo sapiens
gctccagcccc

SEQ ID NO: 6263523 - DNA, 12 bp, Homo sapiens
gctccagcccct

SEQ ID NO: 6263524 - DNA, 19 bp, Homo sapiens
gctccagcccctttccaaa

SEQ ID NO: 6263525 - DNA, 22 bp, Homo sapiens
gctccagcccctttgcctctgt

SEQ ID NO: 6263526 - DNA, 17 bp, Homo sapiens
gctccagcctctgccgc

SEQ ID NO: 6263527 - DNA, 19 bp, Homo sapiens
gctccagcctctgccgctg

SEQ ID NO: 6263528 - DNA, 22 bp, Homo sapiens
gctccagcctctgccgctgcca

SEQ ID NO: 6263529 - DNA, 23 bp, Homo sapiens
gctccagcctgacaacagcctga

SEQ ID NO: 6263530 - DNA, 18 bp, Homo sapiens
gctccagcctgtcggcca

SEQ ID NO: 6263531 - DNA, 18 bp, Homo sapiens
gctccagcgatggtgctg

SEQ ID NO: 6263532 - DNA, 23 bp, Homo sapiens
gctccagcgatggtgctgcccag

SEQ ID NO: 6263533 - DNA, 21 bp, Homo sapiens
gctccagcgtggcctccgtga

SEQ ID NO: 6263534 - DNA, 13 bp, Homo sapiens
gctccagctcacc

SEQ ID NO: 6263535 - DNA, 14 bp, Homo sapiens
gctccagctcacca

SEQ ID NO: 6263536 - DNA, 21 bp, Homo sapiens
gctccagctcaccagccccag

SEQ ID NO: 6263537 - DNA, 18 bp, Homo sapiens
gctccagctctggcacag

SEQ ID NO: 6263538 - DNA, 12 bp, Homo sapiens
gctccagctgcc

SEQ ID NO: 6263539 - DNA, 13 bp, Homo sapiens
gctccagctgccc

SEQ ID NO: 6263540 - DNA, 21 bp, Homo sapiens
gctccagctgccccggcccct

SEQ ID NO: 6263541 - DNA, 12 bp, Homo sapiens
gctccaggacac

SEQ ID NO: 6263542 - DNA, 20 bp, Homo sapiens
gctccaggactccactggac

SEQ ID NO: 6263543 - DNA, 22 bp, Homo sapiens
gctccaggactccactggacag

SEQ ID NO: 6263544 - DNA, 14 bp, Homo sapiens
gctccaggagcagc

SEQ ID NO: 6263545 - DNA, 18 bp, Homo sapiens
gctccaggagcctcatcc

SEQ ID NO: 6263546 - DNA, 22 bp, Homo sapiens
gctccaggagcctcatccagcc

SEQ ID NO: 6263547 - DNA, 23 bp, Homo sapiens
gctccaggagcctcatccagcct

SEQ ID NO: 6263548 - DNA, 16 bp, Homo sapiens
gctccaggatggggag

SEQ ID NO: 6263549 - DNA, 15 bp, Homo sapiens
gctccaggcagcacc

SEQ ID NO: 6263550 - DNA, 20 bp, Homo sapiens
gctccaggcagcacccaggt

SEQ ID NO: 6263551 - DNA, 21 bp, Homo sapiens
gctccaggcaggctaaggcgt

SEQ ID NO: 6263552 - DNA, 18 bp, Homo sapiens
gctccaggccagggggcc

SEQ ID NO: 6263553 - DNA, 12 bp, Homo sapiens
gctccaggccca

SEQ ID NO: 6263554 - DNA, 16 bp, Homo sapiens
gctccaggcctgcatt

SEQ ID NO: 6263555 - DNA, 14 bp, Homo sapiens
gctccaggcgcgcc

SEQ ID NO: 6263556 - DNA, 12 bp, Homo sapiens
gctccaggctcc

SEQ ID NO: 6263557 - DNA, 13 bp, Homo sapiens
gctccaggctcct

SEQ ID NO: 6263558 - DNA, 23 bp, Homo sapiens
gctccaggctcctttagcgccca

SEQ ID NO: 6263559 - DNA, 16 bp, Homo sapiens
gctccaggctgactgg

SEQ ID NO: 6263560 - DNA, 14 bp, Homo sapiens
gctccaggcttcct

SEQ ID NO: 6263561 - DNA, 17 bp, Homo sapiens
gctccaggcttcctgcc

SEQ ID NO: 6263562 - DNA, 18 bp, Homo sapiens
gctccaggcttcctgccc

SEQ ID NO: 6263563 - DNA, 20 bp, Homo sapiens
gctccaggcttcctgcccta

SEQ ID NO: 6263564 - DNA, 21 bp, Homo sapiens
gctccaggcttcctgccctag

SEQ ID NO: 6263565 - DNA, 17 bp, Homo sapiens
gctccagggagtgggga

SEQ ID NO: 6263566 - DNA, 23 bp, Homo sapiens
gctccagggagtggggaggagag

SEQ ID NO: 6263567 - DNA, 23 bp, Homo sapiens
gctccagggatgattcaagccat

SEQ ID NO: 6263568 - DNA, 12 bp, Homo sapiens
gctccagggccg

SEQ ID NO: 6263569 - DNA, 19 bp, Homo sapiens
gctccaggggcccttggga

SEQ ID NO: 6263570 - DNA, 22 bp, Homo sapiens
gctccaggggcccttgggacag

SEQ ID NO: 6263571 - DNA, 20 bp, Homo sapiens
gctccagggggtgccctccc

SEQ ID NO: 6263572 - DNA, 21 bp, Homo sapiens
gctccagggggtgccctccca

SEQ ID NO: 6263573 - DNA, 18 bp, Homo sapiens
gctccagggtcaggcgga

SEQ ID NO: 6263574 - DNA, 14 bp, Homo sapiens
gctccagggtcttg

SEQ ID NO: 6263575 - DNA, 18 bp, Homo sapiens
gctccagggtcttgggct

SEQ ID NO: 6263576 - DNA, 19 bp, Homo sapiens
gctccaggtccggaggggt

SEQ ID NO: 6263577 - DNA, 20 bp, Homo sapiens
gctccaggtccggaggggtt

SEQ ID NO: 6263578 - DNA, 19 bp, Homo sapiens
gctccaggtgccctgtggg

SEQ ID NO: 6263579 - DNA, 22 bp, Homo sapiens
gctccaggtgccctgtgggaga

SEQ ID NO: 6263580 - DNA, 15 bp, Homo sapiens
gctccagtagctccg

SEQ ID NO: 6263581 - DNA, 16 bp, Homo sapiens
gctccagtagctccgc

SEQ ID NO: 6263582 - DNA, 18 bp, Homo sapiens
gctccagtctcatcctcc

SEQ ID NO: 6263583 - DNA, 23 bp, Homo sapiens
gctccagtctcatcctcccattg

SEQ ID NO: 6263584 - DNA, 17 bp, Homo sapiens
gctccagtctgctgccc

SEQ ID NO: 6263585 - DNA, 14 bp, Homo sapiens
gctccagtgccgct

SEQ ID NO: 6263586 - DNA, 19 bp, Homo sapiens
gctccagtgccgctcctgc

SEQ ID NO: 6263587 - DNA, 22 bp, Homo sapiens
gctccagtgccgctcctgcttc

SEQ ID NO: 6263588 - DNA, 12 bp, Homo sapiens
gctccagtggaa

SEQ ID NO: 6263589 - DNA, 21 bp, Homo sapiens
gctccagtggaagaagaaaac

SEQ ID NO: 6263590 - DNA, 18 bp, Homo sapiens
gctccagtgggcaggggt

SEQ ID NO: 6263591 - DNA, 15 bp, Homo sapiens
gctccagtgtcctga

SEQ ID NO: 6263592 - DNA, 16 bp, Homo sapiens
gctccagtgtcctgag

SEQ ID NO: 6263593 - DNA, 20 bp, Homo sapiens
gctccagtgtcctgagctca

SEQ ID NO: 6263594 - DNA, 14 bp, Homo sapiens
gctccagtgttttc

SEQ ID NO: 6263595 - DNA, 15 bp, Homo sapiens
gctccagtgttttct

SEQ ID NO: 6263596 - DNA, 20 bp, Homo sapiens
gctccagtgttttcttgtgt

SEQ ID NO: 6263597 - DNA, 20 bp, Homo sapiens
gctccagtttctcttaagct

SEQ ID NO: 6263598 - DNA, 11 bp, Homo sapiens
gctccatacaa

SEQ ID NO: 6263599 - DNA, 20 bp, Homo sapiens
gctccatacacacgctgcct

SEQ ID NO: 6263600 - DNA, 22 bp, Homo sapiens
gctccataccttttctcttttc

SEQ ID NO: 6263601 - DNA, 15 bp, Homo sapiens
gctccatagagcagt

SEQ ID NO: 6263602 - DNA, 19 bp, Homo sapiens
gctccatagtttggcattt

SEQ ID NO: 6263603 - DNA, 17 bp, Homo sapiens
gctccatcctcctggga

SEQ ID NO: 6263604 - DNA, 17 bp, Homo sapiens
gctccatccttctcccc

SEQ ID NO: 6263605 - DNA, 20 bp, Homo sapiens
gctccatccttgcatcactg

SEQ ID NO: 6263606 - DNA, 19 bp, Homo sapiens
gctccatcctttgtcttgg

SEQ ID NO: 6263607 - DNA, 15 bp, Homo sapiens
gctccatcgcccagg

SEQ ID NO: 6263608 - DNA, 22 bp, Homo sapiens
gctccatctccgcctccacact

SEQ ID NO: 6263609 - DNA, 22 bp, Homo sapiens
gctccatgattagcataaagca

SEQ ID NO: 6263610 - DNA, 22 bp, Homo sapiens
gctccatgcacctcccttccct

SEQ ID NO: 6263611 - DNA, 14 bp, Homo sapiens
gctccatgcctctg

SEQ ID NO: 6263612 - DNA, 23 bp, Homo sapiens
gctccatgctgggtctgaggccc

SEQ ID NO: 6263613 - DNA, 17 bp, Homo sapiens
gctccatgctttcacct

SEQ ID NO: 6263614 - DNA, 14 bp, Homo sapiens
gctccatggaggag

SEQ ID NO: 6263615 - DNA, 12 bp, Homo sapiens
gctccatgggga

SEQ ID NO: 6263616 - DNA, 20 bp, Homo sapiens
gctccatgtgccccctctac

SEQ ID NO: 6263617 - DNA, 16 bp, Homo sapiens
gctccatgtgcctctt

SEQ ID NO: 6263618 - DNA, 17 bp, Homo sapiens
gctccatgtgcctcttt

SEQ ID NO: 6263619 - DNA, 16 bp, Homo sapiens
gctccattcactccca

SEQ ID NO: 6263620 - DNA, 12 bp, Homo sapiens
gctccattcctg

SEQ ID NO: 6263621 - DNA, 23 bp, Homo sapiens
gctccatttaaacagatgtccat

SEQ ID NO: 6263622 - DNA, 20 bp, Homo sapiens
gctccatttataaccccagc

SEQ ID NO: 6263623 - DNA, 20 bp, Homo sapiens
gctccatttttagtgaaata

SEQ ID NO: 6263624 - DNA, 23 bp, Homo sapiens
gctcccaacacaaggtgggcagg

SEQ ID NO: 6263625 - DNA, 20 bp, Homo sapiens
gctcccaacagaggcctccc

SEQ ID NO: 6263626 - DNA, 19 bp, Homo sapiens
gctcccaacccccctcctg

SEQ ID NO: 6263627 - DNA, 22 bp, Homo sapiens
gctcccaacgagcctcctcagg

SEQ ID NO: 6263628 - DNA, 14 bp, Homo sapiens
gctcccaagcccct

SEQ ID NO: 6263629 - DNA, 15 bp, Homo sapiens
gctcccaagcccctg

SEQ ID NO: 6263630 - DNA, 14 bp, Homo sapiens
gctcccaagggagg

SEQ ID NO: 6263631 - DNA, 17 bp, Homo sapiens
gctcccaaggggcctga

SEQ ID NO: 6263632 - DNA, 20 bp, Homo sapiens
gctcccaaggggcctgagca

SEQ ID NO: 6263633 - DNA, 17 bp, Homo sapiens
gctcccaatcagctttt

SEQ ID NO: 6263634 - DNA, 21 bp, Homo sapiens
gctcccaatggtgcttggagg

SEQ ID NO: 6263635 - DNA, 22 bp, Homo sapiens
gctcccaatggtgcttggaggg

SEQ ID NO: 6263636 - DNA, 16 bp, Homo sapiens
gctcccaattcacctc

SEQ ID NO: 6263637 - DNA, 18 bp, Homo sapiens
gctcccacaagcctgagg

SEQ ID NO: 6263638 - DNA, 19 bp, Homo sapiens
gctcccacaagcctgaggg

SEQ ID NO: 6263639 - DNA, 22 bp, Homo sapiens
gctcccacacccacctctgcca

SEQ ID NO: 6263640 - DNA, 21 bp, Homo sapiens
gctcccacaccgcgtcccagc

SEQ ID NO: 6263641 - DNA, 13 bp, Homo sapiens
gctcccacaccgt

SEQ ID NO: 6263642 - DNA, 23 bp, Homo sapiens
gctcccacaccgtcaggtactcc

SEQ ID NO: 6263643 - DNA, 22 bp, Homo sapiens
gctcccacagcttcctgagggc

SEQ ID NO: 6263644 - DNA, 21 bp, Homo sapiens
gctcccacaggcccttcctct

SEQ ID NO: 6263645 - DNA, 22 bp, Homo sapiens
gctcccacagtcccatctgctt

SEQ ID NO: 6263646 - DNA, 20 bp, Homo sapiens
gctcccacataagcactagt

SEQ ID NO: 6263647 - DNA, 17 bp, Homo sapiens
gctcccaccaccagtga

SEQ ID NO: 6263648 - DNA, 18 bp, Homo sapiens
gctcccaccagcccacat

SEQ ID NO: 6263649 - DNA, 18 bp, Homo sapiens
gctcccaccccaccccct

SEQ ID NO: 6263650 - DNA, 16 bp, Homo sapiens
gctcccaccccagaaa

SEQ ID NO: 6263651 - DNA, 18 bp, Homo sapiens
gctcccaccgcccccacc

SEQ ID NO: 6263652 - DNA, 21 bp, Homo sapiens
gctcccaccgcccccacccct

SEQ ID NO: 6263653 - DNA, 18 bp, Homo sapiens
gctcccaccggtgccaaa

SEQ ID NO: 6263654 - DNA, 20 bp, Homo sapiens
gctcccaccggtgccaaacc

SEQ ID NO: 6263655 - DNA, 18 bp, Homo sapiens
gctcccacctcccttccc

SEQ ID NO: 6263656 - DNA, 15 bp, Homo sapiens
gctcccacctcctga

SEQ ID NO: 6263657 - DNA, 12 bp, Homo sapiens
gctcccacctgt

SEQ ID NO: 6263658 - DNA, 19 bp, Homo sapiens
gctcccacgcctgcttctt

SEQ ID NO: 6263659 - DNA, 14 bp, Homo sapiens
gctcccacggggac

SEQ ID NO: 6263660 - DNA, 20 bp, Homo sapiens
gctcccacggggaccactgg

SEQ ID NO: 6263661 - DNA, 22 bp, Homo sapiens
gctcccactcagaactctccag

SEQ ID NO: 6263662 - DNA, 14 bp, Homo sapiens
gctcccagacccag

SEQ ID NO: 6263663 - DNA, 17 bp, Homo sapiens
gctcccagacccagggc

SEQ ID NO: 6263664 - DNA, 14 bp, Homo sapiens
gctcccagatgctg

SEQ ID NO: 6263665 - DNA, 9 bp, Homo sapiens
gctcccagc

SEQ ID NO: 6263666 - DNA, 19 bp, Homo sapiens
gctcccagcagccctaagg

SEQ ID NO: 6263667 - DNA, 14 bp, Homo sapiens
gctcccagcctgcc

SEQ ID NO: 6263668 - DNA, 17 bp, Homo sapiens
gctcccagcctgctgag

SEQ ID NO: 6263669 - DNA, 17 bp, Homo sapiens
gctcccagctagggggc

SEQ ID NO: 6263670 - DNA, 13 bp, Homo sapiens
gctcccagctgtg

SEQ ID NO: 6263671 - DNA, 13 bp, Homo sapiens
gctcccaggagcc

SEQ ID NO: 6263672 - DNA, 21 bp, Homo sapiens
gctcccaggagcctgcccagc

SEQ ID NO: 6263673 - DNA, 16 bp, Homo sapiens
gctcccaggagggctt

SEQ ID NO: 6263674 - DNA, 14 bp, Homo sapiens
gctcccaggagggg

SEQ ID NO: 6263675 - DNA, 22 bp, Homo sapiens
gctcccaggcattccccaggag

SEQ ID NO: 6263676 - DNA, 23 bp, Homo sapiens
gctcccaggcattccccaggagg

SEQ ID NO: 6263677 - DNA, 17 bp, Homo sapiens
gctcccaggccccaggc

SEQ ID NO: 6263678 - DNA, 11 bp, Homo sapiens
gctcccagggc

SEQ ID NO: 6263679 - DNA, 19 bp, Homo sapiens
gctcccaggggctccctcc

SEQ ID NO: 6263680 - DNA, 20 bp, Homo sapiens
gctcccaggggctccctccg

SEQ ID NO: 6263681 - DNA, 21 bp, Homo sapiens
gctcccaggggctccctccgc

SEQ ID NO: 6263682 - DNA, 16 bp, Homo sapiens
gctcccaggggtctcc

SEQ ID NO: 6263683 - DNA, 22 bp, Homo sapiens
gctcccaggggtctccctggct

SEQ ID NO: 6263684 - DNA, 19 bp, Homo sapiens
gcactgggaggcagggctc

SEQ ID NO: 6263685 - DNA, 18 bp, Homo sapiens
gcactgggaggctcccct

SEQ ID NO: 6263686 - DNA, 21 bp, Homo sapiens
gcactgggagggggtggggga

SEQ ID NO: 6263687 - DNA, 12 bp, Homo sapiens
gcactgggcact

SEQ ID NO: 6263688 - DNA, 23 bp, Homo sapiens
gcactgggcaggttcctggggcc

SEQ ID NO: 6263689 - DNA, 13 bp, Homo sapiens
gcactgggccacg

SEQ ID NO: 6263690 - DNA, 20 bp, Homo sapiens
gcactgggccggcagcctgg

SEQ ID NO: 6263691 - DNA, 21 bp, Homo sapiens
gcactgggccggcagcctggt

SEQ ID NO: 6263692 - DNA, 23 bp, Homo sapiens
gcactgggcgtctgactccctcc

SEQ ID NO: 6263693 - DNA, 22 bp, Homo sapiens
gcactgggctaatttgtatgtt

SEQ ID NO: 6263694 - DNA, 18 bp, Homo sapiens
gcactggggagcccgtct

SEQ ID NO: 6263695 - DNA, 15 bp, Homo sapiens
gcactggggcagggg

SEQ ID NO: 6263696 - DNA, 18 bp, Homo sapiens
gcactggggcaggggccg

SEQ ID NO: 6263697 - DNA, 23 bp, Homo sapiens
gcactggggcaggggccgggggc

SEQ ID NO: 6263698 - DNA, 20 bp, Homo sapiens
gcactgggggaacagatgct

SEQ ID NO: 6263699 - DNA, 17 bp, Homo sapiens
gcactggggtaccacat

SEQ ID NO: 6263700 - DNA, 18 bp, Homo sapiens
gcactgggttgactttca

SEQ ID NO: 6263701 - DNA, 20 bp, Homo sapiens
gcactgggtttgctccctga

SEQ ID NO: 6263702 - DNA, 19 bp, Homo sapiens
gcactggtaggttgggaca

SEQ ID NO: 6263703 - DNA, 19 bp, Homo sapiens
gcactggtggcccgacagc

SEQ ID NO: 6263704 - DNA, 22 bp, Homo sapiens
gcactggtggcttgcagtttgc

SEQ ID NO: 6263705 - DNA, 17 bp, Homo sapiens
gcactgtaaatatccct

SEQ ID NO: 6263706 - DNA, 22 bp, Homo sapiens
gcactgtaagacgtatgtaaca

SEQ ID NO: 6263707 - DNA, 22 bp, Homo sapiens
gcactgtaaggtgcttgctccc

SEQ ID NO: 6263708 - DNA, 10 bp, Homo sapiens
gcactgtaat

SEQ ID NO: 6263709 - DNA, 17 bp, Homo sapiens
gcactgtatcatttcat

SEQ ID NO: 6263710 - DNA, 15 bp, Homo sapiens
gcactgtcaagatga

SEQ ID NO: 6263711 - DNA, 22 bp, Homo sapiens
gcactgtcatgcccagcttgga

SEQ ID NO: 6263712 - DNA, 17 bp, Homo sapiens
gcactgtccagctggtt

SEQ ID NO: 6263713 - DNA, 15 bp, Homo sapiens
gcactgtccagggcc

SEQ ID NO: 6263714 - DNA, 20 bp, Homo sapiens
gcactgtccagggcccatgt

SEQ ID NO: 6263715 - DNA, 19 bp, Homo sapiens
gcactgtcctgctccacag

SEQ ID NO: 6263716 - DNA, 15 bp, Homo sapiens
gcactgtctcagcca

SEQ ID NO: 6263717 - DNA, 16 bp, Homo sapiens
gcactgtctcagccaa

SEQ ID NO: 6263718 - DNA, 16 bp, Homo sapiens
gcactgtctgtaccta

SEQ ID NO: 6263719 - DNA, 15 bp, Homo sapiens
gcactgtgaactatt

SEQ ID NO: 6263720 - DNA, 11 bp, Homo sapiens
gcactgtgaag

SEQ ID NO: 6263721 - DNA, 21 bp, Homo sapiens
gcactgtgaagacccagcagg

SEQ ID NO: 6263722 - DNA, 16 bp, Homo sapiens
gcactgtgaaggaccc

SEQ ID NO: 6263723 - DNA, 19 bp, Homo sapiens
gcactgtgatacagttttg

SEQ ID NO: 6263724 - DNA, 12 bp, Homo sapiens
gcactgtgccaa

SEQ ID NO: 6263725 - DNA, 22 bp, Homo sapiens
gcactgtgccccgcgggctttg

SEQ ID NO: 6263726 - DNA, 18 bp, Homo sapiens
gcactgtgctcagggcta

SEQ ID NO: 6263727 - DNA, 22 bp, Homo sapiens
gcactgtgcttgctcctaagca

SEQ ID NO: 6263728 - DNA, 18 bp, Homo sapiens
gcactgtggattatttca

SEQ ID NO: 6263729 - DNA, 17 bp, Homo sapiens
gcactgtggcactgcca

SEQ ID NO: 6263730 - DNA, 18 bp, Homo sapiens
gcactgtggcactgccac

SEQ ID NO: 6263731 - DNA, 13 bp, Homo sapiens
gcactgtggcctt

SEQ ID NO: 6263732 - DNA, 14 bp, Homo sapiens
gcactgtggccttg

SEQ ID NO: 6263733 - DNA, 14 bp, Homo sapiens
gcactgtggtcagg

SEQ ID NO: 6263734 - DNA, 15 bp, Homo sapiens
gcactgtggtcaggc

SEQ ID NO: 6263735 - DNA, 20 bp, Homo sapiens
gcactgtggtcaggcccagc

SEQ ID NO: 6263736 - DNA, 22 bp, Homo sapiens
gcactgtggtcaggcccagcct

SEQ ID NO: 6263737 - DNA, 23 bp, Homo sapiens
gcactgtggtcgtcaactttcct

SEQ ID NO: 6263738 - DNA, 17 bp, Homo sapiens
gcactgtgtaaccagca

SEQ ID NO: 6263739 - DNA, 19 bp, Homo sapiens
gcactgtgtaaccagcagt

SEQ ID NO: 6263740 - DNA, 18 bp, Homo sapiens
gcactgtgttcacacttt

SEQ ID NO: 6263741 - DNA, 19 bp, Homo sapiens
gcactgtgttcacactttt

SEQ ID NO: 6263742 - DNA, 17 bp, Homo sapiens
gcactgtgtttatatgt

SEQ ID NO: 6263743 - DNA, 17 bp, Homo sapiens
gcactgttaatacacag

SEQ ID NO: 6263744 - DNA, 15 bp, Homo sapiens
gcactgttcaatact

SEQ ID NO: 6263745 - DNA, 22 bp, Homo sapiens
gcactgttctgggactccaggt

SEQ ID NO: 6263746 - DNA, 18 bp, Homo sapiens
gcactgttgatgtatctg

SEQ ID NO: 6263747 - DNA, 19 bp, Homo sapiens
gcactgttgatgtatctga

SEQ ID NO: 6263748 - DNA, 21 bp, Homo sapiens
gcactgttggtgttcggagct

SEQ ID NO: 6263749 - DNA, 17 bp, Homo sapiens
gcactgttgtcatttcc

SEQ ID NO: 6263750 - DNA, 20 bp, Homo sapiens
gcactgttgtcatttccaaa

SEQ ID NO: 6263751 - DNA, 19 bp, Homo sapiens
gcactgttttattttaatt

SEQ ID NO: 6263752 - DNA, 21 bp, Homo sapiens
gcactgttttctagtgtatca

SEQ ID NO: 6263753 - DNA, 23 bp, Homo sapiens
gcactgttttctagtgtatcaaa

SEQ ID NO: 6263754 - DNA, 18 bp, Homo sapiens
gcacttaaacagaagcag

SEQ ID NO: 6263755 - DNA, 21 bp, Homo sapiens
gcacttaaacagaagcagagg

SEQ ID NO: 6263756 - DNA, 13 bp, Homo sapiens
gcacttaaagaag

SEQ ID NO: 6263757 - DNA, 14 bp, Homo sapiens
gcacttaaagtttt

SEQ ID NO: 6263758 - DNA, 22 bp, Homo sapiens
gcacttaaatatcaatcatttt

SEQ ID NO: 6263759 - DNA, 22 bp, Homo sapiens
gcacttaagcacaagcagagtg

SEQ ID NO: 6263760 - DNA, 19 bp, Homo sapiens
gcacttaagtcttccttaa

SEQ ID NO: 6263761 - DNA, 16 bp, Homo sapiens
gcacttaagtgcactt

SEQ ID NO: 6263762 - DNA, 18 bp, Homo sapiens
gcacttaagtgcactttt

SEQ ID NO: 6263763 - DNA, 19 bp, Homo sapiens
gcacttaagtgcacttttt

SEQ ID NO: 6263764 - DNA, 22 bp, Homo sapiens
gcacttaatattagcttgctta

SEQ ID NO: 6263765 - DNA, 23 bp, Homo sapiens
gcacttaatctgtaacccccaag

SEQ ID NO: 6263766 - DNA, 14 bp, Homo sapiens
gcacttaatggctg

SEQ ID NO: 6263767 - DNA, 18 bp, Homo sapiens
gcacttaatttgtaaact

SEQ ID NO: 6263768 - DNA, 12 bp, Homo sapiens
gcacttacaagt

SEQ ID NO: 6263769 - DNA, 15 bp, Homo sapiens
gcacttacaatccca

SEQ ID NO: 6263770 - DNA, 21 bp, Homo sapiens
gcacttacacttataaaataa

SEQ ID NO: 6263771 - DNA, 22 bp, Homo sapiens
gcacttacagataggccttctt

SEQ ID NO: 6263772 - DNA, 18 bp, Homo sapiens
gcacttaccgccctgcgg

SEQ ID NO: 6263773 - DNA, 14 bp, Homo sapiens
gcacttacctgctt

SEQ ID NO: 6263774 - DNA, 14 bp, Homo sapiens
gcacttactggtcc

SEQ ID NO: 6263775 - DNA, 17 bp, Homo sapiens
gcacttagacctgccag

SEQ ID NO: 6263776 - DNA, 19 bp, Homo sapiens
gcacttagacctgccagcc

SEQ ID NO: 6263777 - DNA, 18 bp, Homo sapiens
gcacttagccatgatggc

SEQ ID NO: 6263778 - DNA, 21 bp, Homo sapiens
gcacttagcccaagaggtctg

SEQ ID NO: 6263779 - DNA, 21 bp, Homo sapiens
gcacttatatagcacctttca

SEQ ID NO: 6263780 - DNA, 22 bp, Homo sapiens
gcacttatctcgaatttgaaga

SEQ ID NO: 6263781 - DNA, 23 bp, Homo sapiens
gcacttatctcgaatttgaagag

SEQ ID NO: 6263782 - DNA, 14 bp, Homo sapiens
gcacttatgtactt

SEQ ID NO: 6263783 - DNA, 15 bp, Homo sapiens
gcacttatgtacttg

SEQ ID NO: 6263784 - DNA, 23 bp, Homo sapiens
gcacttattatgaggctattaaa

SEQ ID NO: 6263785 - DNA, 18 bp, Homo sapiens
gcacttattgaatatatg

SEQ ID NO: 6263786 - DNA, 16 bp, Homo sapiens
gcacttattttttaat

SEQ ID NO: 6263787 - DNA, 18 bp, Homo sapiens
gcacttattttttaatgt

SEQ ID NO: 6263788 - DNA, 21 bp, Homo sapiens
gcacttcaagcaaagacagtt

SEQ ID NO: 6263789 - DNA, 13 bp, Homo sapiens
gcacttcacagag

SEQ ID NO: 6263790 - DNA, 14 bp, Homo sapiens
gcacttcaggtccg

SEQ ID NO: 6263791 - DNA, 18 bp, Homo sapiens
gcacttcaggtccgtggg

SEQ ID NO: 6263792 - DNA, 17 bp, Homo sapiens
gcacttcatctggctgc

SEQ ID NO: 6263793 - DNA, 16 bp, Homo sapiens
gcacttccacctccag

SEQ ID NO: 6263794 - DNA, 19 bp, Homo sapiens
gcacttccacctccagcct

SEQ ID NO: 6263795 - DNA, 23 bp, Homo sapiens
gcacttccacctccagcctctgg

SEQ ID NO: 6263796 - DNA, 14 bp, Homo sapiens
gcacttcctcccct

SEQ ID NO: 6263797 - DNA, 17 bp, Homo sapiens
gcacttcctgttggaag

SEQ ID NO: 6263798 - DNA, 22 bp, Homo sapiens
gcacttcggataattttcattt

SEQ ID NO: 6263799 - DNA, 22 bp, Homo sapiens
gcacttcgggaggtcgaggcag

SEQ ID NO: 6263800 - DNA, 12 bp, Homo sapiens
gcacttctagaa

SEQ ID NO: 6263801 - DNA, 13 bp, Homo sapiens
gcacttctagaat

SEQ ID NO: 6263802 - DNA, 13 bp, Homo sapiens
gcacttctgctgc

SEQ ID NO: 6263803 - DNA, 14 bp, Homo sapiens
gcacttctgctgca

SEQ ID NO: 6263804 - DNA, 17 bp, Homo sapiens
gcacttctgctgcatcg

SEQ ID NO: 6263805 - DNA, 20 bp, Homo sapiens
gcacttctggaatactgaaa

SEQ ID NO: 6263806 - DNA, 20 bp, Homo sapiens
gcacttctggggccagcccc

SEQ ID NO: 6263807 - DNA, 22 bp, Homo sapiens
gcacttctggggccagcccctc

SEQ ID NO: 6263808 - DNA, 23 bp, Homo sapiens
gcacttctggggccagcccctcc

SEQ ID NO: 6263809 - DNA, 17 bp, Homo sapiens
gcacttctgttatcagg

SEQ ID NO: 6263810 - DNA, 21 bp, Homo sapiens
gcacttcttttccaaaaatac

SEQ ID NO: 6263811 - DNA, 16 bp, Homo sapiens
gcacttgacaccaacc

SEQ ID NO: 6263812 - DNA, 21 bp, Homo sapiens
gcacttgagaaccagtctcct

SEQ ID NO: 6263813 - DNA, 15 bp, Homo sapiens
gcacttgatatttat

SEQ ID NO: 6263814 - DNA, 17 bp, Homo sapiens
gcacttgatatttatta

SEQ ID NO: 6263815 - DNA, 17 bp, Homo sapiens
gcacttgatgtgtagac

SEQ ID NO: 6263816 - DNA, 20 bp, Homo sapiens
gcacttgattaagcttttgt

SEQ ID NO: 6263817 - DNA, 22 bp, Homo sapiens
gcacttgcacgcccatgtgtga

SEQ ID NO: 6263818 - DNA, 14 bp, Homo sapiens
gcacttgcagactc

SEQ ID NO: 6263819 - DNA, 16 bp, Homo sapiens
gcacttgcagactcta

SEQ ID NO: 6263820 - DNA, 14 bp, Homo sapiens
gcacttgcctggaa

SEQ ID NO: 6263821 - DNA, 15 bp, Homo sapiens
gcacttgcctggaat

SEQ ID NO: 6263822 - DNA, 22 bp, Homo sapiens
gcacttgcctggaataaaatat

SEQ ID NO: 6263823 - DNA, 14 bp, Homo sapiens
gcacttgcctgggt

SEQ ID NO: 6263824 - DNA, 15 bp, Homo sapiens
gcacttgcctgggtc

SEQ ID NO: 6263825 - DNA, 17 bp, Homo sapiens
gcacttgcctgtagtct

SEQ ID NO: 6263826 - DNA, 22 bp, Homo sapiens
gcacttgcctgttggctgctgc

SEQ ID NO: 6263827 - DNA, 15 bp, Homo sapiens
gcacttgcgtcctgc

SEQ ID NO: 6263828 - DNA, 16 bp, Homo sapiens
gcacttgcgtcctgca

SEQ ID NO: 6263829 - DNA, 20 bp, Homo sapiens
gcacttgcgtcctgcagagg

SEQ ID NO: 6263830 - DNA, 18 bp, Homo sapiens
gcacttggactcttgctc

SEQ ID NO: 6263831 - DNA, 18 bp, Homo sapiens
gcacttggagacttgtat

SEQ ID NO: 6263832 - DNA, 16 bp, Homo sapiens
gcacttggagaggctg

SEQ ID NO: 6263833 - DNA, 13 bp, Homo sapiens
gcacttggagcca

SEQ ID NO: 6263834 - DNA, 13 bp, Homo sapiens
gcacttggcagcc

SEQ ID NO: 6263835 - DNA, 16 bp, Homo sapiens
gcacttggcagccttg

SEQ ID NO: 6263836 - DNA, 15 bp, Homo sapiens
gcacttggcctcagc

SEQ ID NO: 6263837 - DNA, 19 bp, Homo sapiens
gcacttggcctcagctggc

SEQ ID NO: 6263838 - DNA, 22 bp, Homo sapiens
gcacttggcctcagctggctgt

SEQ ID NO: 6263839 - DNA, 23 bp, Homo sapiens
gcacttggcctcagctggctgta

SEQ ID NO: 6263840 - DNA, 13 bp, Homo sapiens
gcacttggcctct

SEQ ID NO: 6263841 - DNA, 14 bp, Homo sapiens
gcacttggcctctg

SEQ ID NO: 6263842 - DNA, 17 bp, Homo sapiens
gcacttggggcaccttg

SEQ ID NO: 6263843 - DNA, 23 bp, Homo sapiens
gcacttgggggctcagcaaggcc

SEQ ID NO: 6263844 - DNA, 19 bp, Homo sapiens
gcacttgtaactcaccgtg

SEQ ID NO: 6263845 - DNA, 12 bp, Homo sapiens
gcacttgtatat

SEQ ID NO: 6263846 - DNA, 11 bp, Homo sapiens
gcacttgtatt

SEQ ID NO: 6263847 - DNA, 17 bp, Homo sapiens
gcacttgtcactatgct

SEQ ID NO: 6263848 - DNA, 16 bp, Homo sapiens
gcacttgtccagctga

SEQ ID NO: 6263849 - DNA, 21 bp, Homo sapiens
gcacttgtctcaggactctga

SEQ ID NO: 6263850 - DNA, 14 bp, Homo sapiens
gcacttgtgatcct

SEQ ID NO: 6263851 - DNA, 17 bp, Homo sapiens
gcacttgtgattattta

SEQ ID NO: 6263852 - DNA, 20 bp, Homo sapiens
gcacttgtgattatttatta

SEQ ID NO: 6263853 - DNA, 22 bp, Homo sapiens
gcacttgttccttctgcttctc

SEQ ID NO: 6263854 - DNA, 18 bp, Homo sapiens
gcactttaaacttaatgc

SEQ ID NO: 6263855 - DNA, 19 bp, Homo sapiens
gcactttaaagaggctgtg

SEQ ID NO: 6263856 - DNA, 20 bp, Homo sapiens
gcactttaaagaggctgtgt

SEQ ID NO: 6263857 - DNA, 21 bp, Homo sapiens
gcactttaaccctctcttccc

SEQ ID NO: 6263858 - DNA, 22 bp, Homo sapiens
gcactttaaccctctcttccct

SEQ ID NO: 6263859 - DNA, 16 bp, Homo sapiens
gcactttaatgataaa

SEQ ID NO: 6263860 - DNA, 22 bp, Homo sapiens
gctcccagggtccctgcccact

SEQ ID NO: 6263861 - DNA, 14 bp, Homo sapiens
gctcccagggtcct

SEQ ID NO: 6263862 - DNA, 22 bp, Homo sapiens
gctcccaggttcccccagcaag

SEQ ID NO: 6263863 - DNA, 16 bp, Homo sapiens
gctcccagtcctgcct

SEQ ID NO: 6263864 - DNA, 13 bp, Homo sapiens
gctcccagtgcca

SEQ ID NO: 6263865 - DNA, 13 bp, Homo sapiens
gctcccagtgtct

SEQ ID NO: 6263866 - DNA, 22 bp, Homo sapiens
gctcccatagcgctggctcagg

SEQ ID NO: 6263867 - DNA, 23 bp, Homo sapiens
gctcccatagcgctggctcagga

SEQ ID NO: 6263868 - DNA, 19 bp, Homo sapiens
gctcccatcctcacccaga

SEQ ID NO: 6263869 - DNA, 21 bp, Homo sapiens
gctcccatctccctcccattt

SEQ ID NO: 6263870 - DNA, 13 bp, Homo sapiens
gctcccatctcct

SEQ ID NO: 6263871 - DNA, 23 bp, Homo sapiens
gctcccatgcacaactctccaaa

SEQ ID NO: 6263872 - DNA, 20 bp, Homo sapiens
gctcccattcactcttccag

SEQ ID NO: 6263873 - DNA, 17 bp, Homo sapiens
gctcccattcctccctc

SEQ ID NO: 6263874 - DNA, 17 bp, Homo sapiens
gctcccatttctactct

SEQ ID NO: 6263875 - DNA, 20 bp, Homo sapiens
gctccccaacacctgcctct

SEQ ID NO: 6263876 - DNA, 17 bp, Homo sapiens
gctccccaatccaaccc

SEQ ID NO: 6263877 - DNA, 23 bp, Homo sapiens
gctccccaatccaacccatgcat

SEQ ID NO: 6263878 - DNA, 17 bp, Homo sapiens
gctccccaatccctgac

SEQ ID NO: 6263879 - DNA, 21 bp, Homo sapiens
gctccccacaccttccagggc

SEQ ID NO: 6263880 - DNA, 21 bp, Homo sapiens
gctccccacagcgtccctggc

SEQ ID NO: 6263881 - DNA, 13 bp, Homo sapiens
gctccccacccct

SEQ ID NO: 6263882 - DNA, 12 bp, Homo sapiens
gctccccacctg

SEQ ID NO: 6263883 - DNA, 13 bp, Homo sapiens
gctccccacctgg

SEQ ID NO: 6263884 - DNA, 14 bp, Homo sapiens
gctccccacctgga

SEQ ID NO: 6263885 - DNA, 15 bp, Homo sapiens
gctccccacctggac

SEQ ID NO: 6263886 - DNA, 15 bp, Homo sapiens
gctccccacgccccc

SEQ ID NO: 6263887 - DNA, 20 bp, Homo sapiens
gctccccactctgctctgat

SEQ ID NO: 6263888 - DNA, 20 bp, Homo sapiens
gctccccagaactggctggg

SEQ ID NO: 6263889 - DNA, 13 bp, Homo sapiens
gctccccagccca

SEQ ID NO: 6263890 - DNA, 19 bp, Homo sapiens
gctccccagcccacctgct

SEQ ID NO: 6263891 - DNA, 15 bp, Homo sapiens
gctccccagcccagg

SEQ ID NO: 6263892 - DNA, 15 bp, Homo sapiens
gctccccagccctgg

SEQ ID NO: 6263893 - DNA, 16 bp, Homo sapiens
gctccccagccctggc

SEQ ID NO: 6263894 - DNA, 22 bp, Homo sapiens
gctccccagccctggctctgca

SEQ ID NO: 6263895 - DNA, 13 bp, Homo sapiens
gctccccaggact

SEQ ID NO: 6263896 - DNA, 14 bp, Homo sapiens
gctccccaggactc

SEQ ID NO: 6263897 - DNA, 13 bp, Homo sapiens
gctccccagggct

SEQ ID NO: 6263898 - DNA, 15 bp, Homo sapiens
gctccccagggctcc

SEQ ID NO: 6263899 - DNA, 17 bp, Homo sapiens
gctccccagtgctcctg

SEQ ID NO: 6263900 - DNA, 22 bp, Homo sapiens
gctccccatggctcctcaccac

SEQ ID NO: 6263901 - DNA, 14 bp, Homo sapiens
gctcccccaccccc

SEQ ID NO: 6263902 - DNA, 20 bp, Homo sapiens
gctcccccaccccctcccca

SEQ ID NO: 6263903 - DNA, 13 bp, Homo sapiens
gctcccccagctc

SEQ ID NO: 6263904 - DNA, 14 bp, Homo sapiens
gctcccccagctcc

SEQ ID NO: 6263905 - DNA, 14 bp, Homo sapiens
gctcccccaggcag

SEQ ID NO: 6263906 - DNA, 13 bp, Homo sapiens
gctcccccaggcc

SEQ ID NO: 6263907 - DNA, 20 bp, Homo sapiens
gctcccccaggcctgagctg

SEQ ID NO: 6263908 - DNA, 14 bp, Homo sapiens
gctcccccaggctg

SEQ ID NO: 6263909 - DNA, 15 bp, Homo sapiens
gctcccccgcagtcc

SEQ ID NO: 6263910 - DNA, 19 bp, Homo sapiens
gctcccccgcagtccccag

SEQ ID NO: 6263911 - DNA, 15 bp, Homo sapiens
gctcccccgggaggg

SEQ ID NO: 6263912 - DNA, 21 bp, Homo sapiens
gctcccccgggaggggcccgc

SEQ ID NO: 6263913 - DNA, 20 bp, Homo sapiens
gctcccccgtggtgcctgca

SEQ ID NO: 6263914 - DNA, 17 bp, Homo sapiens
gctccccctccacctgc

SEQ ID NO: 6263915 - DNA, 19 bp, Homo sapiens
gctccccctccccaggctg

SEQ ID NO: 6263916 - DNA, 13 bp, Homo sapiens
gctccccctctgc

SEQ ID NO: 6263917 - DNA, 17 bp, Homo sapiens
gctccccctctgcttct

SEQ ID NO: 6263918 - DNA, 13 bp, Homo sapiens
gctccccctgcca

SEQ ID NO: 6263919 - DNA, 17 bp, Homo sapiens
gctccccctgccagcaa

SEQ ID NO: 6263920 - DNA, 17 bp, Homo sapiens
gctccccctgcttctca

SEQ ID NO: 6263921 - DNA, 16 bp, Homo sapiens
gctccccctggacggg

SEQ ID NO: 6263922 - DNA, 12 bp, Homo sapiens
gctccccctgtc

SEQ ID NO: 6263923 - DNA, 19 bp, Homo sapiens
gctcccccttgcccgccag

SEQ ID NO: 6263924 - DNA, 15 bp, Homo sapiens
gctccccgcctccac

SEQ ID NO: 6263925 - DNA, 20 bp, Homo sapiens
gctccccgcctccactctag

SEQ ID NO: 6263926 - DNA, 20 bp, Homo sapiens
gctccccgcctgttcccccg

SEQ ID NO: 6263927 - DNA, 22 bp, Homo sapiens
gctccccggacatactctctgc

SEQ ID NO: 6263928 - DNA, 16 bp, Homo sapiens
gctcccctaaagccag

SEQ ID NO: 6263929 - DNA, 18 bp, Homo sapiens
gctcccctaaccctactt

SEQ ID NO: 6263930 - DNA, 15 bp, Homo sapiens
gctcccctccacagc

SEQ ID NO: 6263931 - DNA, 20 bp, Homo sapiens
gctcccctccacagctgcag

SEQ ID NO: 6263932 - DNA, 14 bp, Homo sapiens
gctcccctccatcc

SEQ ID NO: 6263933 - DNA, 13 bp, Homo sapiens
gctcccctcctct

SEQ ID NO: 6263934 - DNA, 16 bp, Homo sapiens
gctcccctctcctccg

SEQ ID NO: 6263935 - DNA, 21 bp, Homo sapiens
gctcccctctgcttctcatcc

SEQ ID NO: 6263936 - DNA, 13 bp, Homo sapiens
gctcccctcttcc

SEQ ID NO: 6263937 - DNA, 13 bp, Homo sapiens
gctcccctgagga

SEQ ID NO: 6263938 - DNA, 14 bp, Homo sapiens
gctcccctgcctta

SEQ ID NO: 6263939 - DNA, 17 bp, Homo sapiens
gctcccctgctgaggca

SEQ ID NO: 6263940 - DNA, 14 bp, Homo sapiens
gctcccctggagcc

SEQ ID NO: 6263941 - DNA, 19 bp, Homo sapiens
gctcccctggagccagcag

SEQ ID NO: 6263942 - DNA, 23 bp, Homo sapiens
gctcccctggagccagcagggct

SEQ ID NO: 6263943 - DNA, 13 bp, Homo sapiens
gctcccctggtct

SEQ ID NO: 6263944 - DNA, 23 bp, Homo sapiens
gctcccctgtttgcatgagaaaa

SEQ ID NO: 6263945 - DNA, 17 bp, Homo sapiens
gctccccttgcccttcc

SEQ ID NO: 6263946 - DNA, 16 bp, Homo sapiens
gctccccttggacctc

SEQ ID NO: 6263947 - DNA, 12 bp, Homo sapiens
gctcccctttcc

SEQ ID NO: 6263948 - DNA, 14 bp, Homo sapiens
gctcccctttccca

SEQ ID NO: 6263949 - DNA, 18 bp, Homo sapiens
gctcccgaccccatccac

SEQ ID NO: 6263950 - DNA, 17 bp, Homo sapiens
gctcccgagctactctc

SEQ ID NO: 6263951 - DNA, 15 bp, Homo sapiens
gctcccgcagggctg

SEQ ID NO: 6263952 - DNA, 17 bp, Homo sapiens
gctcccgccccagggtc

SEQ ID NO: 6263953 - DNA, 22 bp, Homo sapiens
gctcccgccccagggtctgaaa

SEQ ID NO: 6263954 - DNA, 14 bp, Homo sapiens
gctcccgctcccag

SEQ ID NO: 6263955 - DNA, 15 bp, Homo sapiens
gctcccgctcccagg

SEQ ID NO: 6263956 - DNA, 21 bp, Homo sapiens
gctcccgcttgctctcctgga

SEQ ID NO: 6263957 - DNA, 18 bp, Homo sapiens
gctcccggcaagcgcttc

SEQ ID NO: 6263958 - DNA, 14 bp, Homo sapiens
gctcccggcatcct

SEQ ID NO: 6263959 - DNA, 23 bp, Homo sapiens
gctcccggccttgtgtgatttta

SEQ ID NO: 6263960 - DNA, 20 bp, Homo sapiens
gctcccggggcagggcagcc

SEQ ID NO: 6263961 - DNA, 17 bp, Homo sapiens
gctcccggggcctggac

SEQ ID NO: 6263962 - DNA, 18 bp, Homo sapiens
gctcccggggcctggaca

SEQ ID NO: 6263963 - DNA, 16 bp, Homo sapiens
gctcccgggggcccca

SEQ ID NO: 6263964 - DNA, 16 bp, Homo sapiens
gctcccggtgtgcagc

SEQ ID NO: 6263965 - DNA, 15 bp, Homo sapiens
gctcccggttccctc

SEQ ID NO: 6263966 - DNA, 17 bp, Homo sapiens
gctcccggttccctccc

SEQ ID NO: 6263967 - DNA, 20 bp, Homo sapiens
gctcccggttccctccccag

SEQ ID NO: 6263968 - DNA, 23 bp, Homo sapiens
gctcccggttccctccccagctc

SEQ ID NO: 6263969 - DNA, 20 bp, Homo sapiens
gctccctaaactttggcctt

SEQ ID NO: 6263970 - DNA, 18 bp, Homo sapiens
gctccctaccccagggcc

SEQ ID NO: 6263971 - DNA, 19 bp, Homo sapiens
gctccctaccccagggccc

SEQ ID NO: 6263972 - DNA, 22 bp, Homo sapiens
gctccctaccccagggccctgg

SEQ ID NO: 6263973 - DNA, 16 bp, Homo sapiens
gctccctagactgcat

SEQ ID NO: 6263974 - DNA, 20 bp, Homo sapiens
gctccctagtggcttcctcc

SEQ ID NO: 6263975 - DNA, 19 bp, Homo sapiens
gctccctatgttgcccagg

SEQ ID NO: 6263976 - DNA, 16 bp, Homo sapiens
gctccctcaaagaggc

SEQ ID NO: 6263977 - DNA, 22 bp, Homo sapiens
gctccctcaaatgacagaccta

SEQ ID NO: 6263978 - DNA, 16 bp, Homo sapiens
gctccctcactctcag

SEQ ID NO: 6263979 - DNA, 17 bp, Homo sapiens
gctccctcactctcagg

SEQ ID NO: 6263980 - DNA, 15 bp, Homo sapiens
gctccctcagcctca

SEQ ID NO: 6263981 - DNA, 16 bp, Homo sapiens
gctccctcagcctcag

SEQ ID NO: 6263982 - DNA, 18 bp, Homo sapiens
gctccctcagcctcagag

SEQ ID NO: 6263983 - DNA, 15 bp, Homo sapiens
gctccctcccaggac

SEQ ID NO: 6263984 - DNA, 19 bp, Homo sapiens
gctccctcccaggactctg

SEQ ID NO: 6263985 - DNA, 22 bp, Homo sapiens
gctccctccccctgccccttct

SEQ ID NO: 6263986 - DNA, 12 bp, Homo sapiens
gctccctcccct

SEQ ID NO: 6263987 - DNA, 20 bp, Homo sapiens
gctccctcccctgccctggt

SEQ ID NO: 6263988 - DNA, 23 bp, Homo sapiens
gctccctcccctgccctggtcca

SEQ ID NO: 6263989 - DNA, 21 bp, Homo sapiens
gctccctcccgtagtctcctg

SEQ ID NO: 6263990 - DNA, 22 bp, Homo sapiens
gctccctcccgtagtctcctgg

SEQ ID NO: 6263991 - DNA, 23 bp, Homo sapiens
gctccctcccgtagtctcctggg

SEQ ID NO: 6263992 - DNA, 14 bp, Homo sapiens
gctccctccctcca

SEQ ID NO: 6263993 - DNA, 17 bp, Homo sapiens
gctccctccctcccaga

SEQ ID NO: 6263994 - DNA, 22 bp, Homo sapiens
gctccctccctcccagatccag

SEQ ID NO: 6263995 - DNA, 18 bp, Homo sapiens
gctccctccctccctgct

SEQ ID NO: 6263996 - DNA, 16 bp, Homo sapiens
gctccctccgccccca

SEQ ID NO: 6263997 - DNA, 20 bp, Homo sapiens
gctccctccgggtcttccta

SEQ ID NO: 6263998 - DNA, 15 bp, Homo sapiens
gctccctcctcagtc

SEQ ID NO: 6263999 - DNA, 18 bp, Homo sapiens
gctccctcctccaggcct

SEQ ID NO: 6264000 - DNA, 19 bp, Homo sapiens
gctccctcctccaggcctg

SEQ ID NO: 6264001 - DNA, 22 bp, Homo sapiens
gctccctcctccaggcctgcct

SEQ ID NO: 6264002 - DNA, 19 bp, Homo sapiens
gctccctcctcccatctcc

SEQ ID NO: 6264003 - DNA, 21 bp, Homo sapiens
gctccctcctcctgtcctccc

SEQ ID NO: 6264004 - DNA, 13 bp, Homo sapiens
gctccctcctctg

SEQ ID NO: 6264005 - DNA, 15 bp, Homo sapiens
gctccctcctgcaca

SEQ ID NO: 6264006 - DNA, 16 bp, Homo sapiens
gctccctcctggagca

SEQ ID NO: 6264007 - DNA, 16 bp, Homo sapiens
gctccctcggtcacct

SEQ ID NO: 6264008 - DNA, 23 bp, Homo sapiens
gctccctcgtcttcagctgcatt

SEQ ID NO: 6264009 - DNA, 14 bp, Homo sapiens
gctccctctccaag

SEQ ID NO: 6264010 - DNA, 15 bp, Homo sapiens
gctccctctccaaga

SEQ ID NO: 6264011 - DNA, 20 bp, Homo sapiens
gctccctctccaagacagca

SEQ ID NO: 6264012 - DNA, 23 bp, Homo sapiens
gctccctctccaagacagcagca

SEQ ID NO: 6264013 - DNA, 14 bp, Homo sapiens
gctccctctctcct

SEQ ID NO: 6264014 - DNA, 19 bp, Homo sapiens
gctccctctctcctggact

SEQ ID NO: 6264015 - DNA, 14 bp, Homo sapiens
gctccctctctggt

SEQ ID NO: 6264016 - DNA, 11 bp, Homo sapiens
gctccctctgt

SEQ ID NO: 6264017 - DNA, 18 bp, Homo sapiens
gctccctcttcctctcca

SEQ ID NO: 6264018 - DNA, 23 bp, Homo sapiens
gctccctcttcctctccatacct

SEQ ID NO: 6264019 - DNA, 19 bp, Homo sapiens
gctccctcttggtcttccc

SEQ ID NO: 6264020 - DNA, 12 bp, Homo sapiens
gctccctgaagc

SEQ ID NO: 6264021 - DNA, 13 bp, Homo sapiens
gctccctgaagcc

SEQ ID NO: 6264022 - DNA, 14 bp, Homo sapiens
gctccctgaagcca

SEQ ID NO: 6264023 - DNA, 16 bp, Homo sapiens
gctccctgaagccagc

SEQ ID NO: 6264024 - DNA, 18 bp, Homo sapiens
gctccctgaagccagcct

SEQ ID NO: 6264025 - DNA, 21 bp, Homo sapiens
gctccctgaatctgaccacag

SEQ ID NO: 6264026 - DNA, 18 bp, Homo sapiens
gctccctgaccaccctgc

SEQ ID NO: 6264027 - DNA, 14 bp, Homo sapiens
gctccctgaccccc

SEQ ID NO: 6264028 - DNA, 13 bp, Homo sapiens
gctccctgactgg

SEQ ID NO: 6264029 - DNA, 20 bp, Homo sapiens
gctccctgacttctcccccg

SEQ ID NO: 6264030 - DNA, 21 bp, Homo sapiens
gctccctgattaatggaggct

SEQ ID NO: 6264031 - DNA, 21 bp, Homo sapiens
gctccctgcaagctccgcctc

SEQ ID NO: 6264032 - DNA, 11 bp, Homo sapiens
gctccctgcac

SEQ ID NO: 6264033 - DNA, 12 bp, Homo sapiens
gctccctgcccc

SEQ ID NO: 6264034 - DNA, 14 bp, Homo sapiens
gctccctgcctcct

SEQ ID NO: 6264035 - DNA, 16 bp, Homo sapiens
gctccctgcctcctgc

SEQ ID NO: 6264036 - DNA, 19 bp, Homo sapiens
gctccctgcctcctgccta

SEQ ID NO: 6264037 - DNA, 10 bp, Homo sapiens
gctccctgct

SEQ ID NO: 6264038 - DNA, 12 bp, Homo sapiens
gctccctgctcc

SEQ ID NO: 6264039 - DNA, 13 bp, Homo sapiens
gctccctgctccc

SEQ ID NO: 6264040 - DNA, 19 bp, Homo sapiens
gcactttagaatatgcctt

SEQ ID NO: 6264041 - DNA, 17 bp, Homo sapiens
gcactttagacattttt

SEQ ID NO: 6264042 - DNA, 20 bp, Homo sapiens
gcactttagggctgtaaaat

SEQ ID NO: 6264043 - DNA, 17 bp, Homo sapiens
gcactttagtgattgct

SEQ ID NO: 6264044 - DNA, 17 bp, Homo sapiens
gcactttataaaagcaa

SEQ ID NO: 6264045 - DNA, 17 bp, Homo sapiens
gcactttataagccaat

SEQ ID NO: 6264046 - DNA, 13 bp, Homo sapiens
gcactttccccct

SEQ ID NO: 6264047 - DNA, 21 bp, Homo sapiens
gcactttcccccttcccgcct

SEQ ID NO: 6264048 - DNA, 23 bp, Homo sapiens
gcactttccgtcaacgttgtact

SEQ ID NO: 6264049 - DNA, 16 bp, Homo sapiens
gcactttcctttcaat

SEQ ID NO: 6264050 - DNA, 17 bp, Homo sapiens
gcactttctaatgtttc

SEQ ID NO: 6264051 - DNA, 23 bp, Homo sapiens
gcactttgaaaatatttctatgt

SEQ ID NO: 6264052 - DNA, 18 bp, Homo sapiens
gcactttgaaatacctca

SEQ ID NO: 6264053 - DNA, 19 bp, Homo sapiens
gcactttgaaatacctcat

SEQ ID NO: 6264054 - DNA, 21 bp, Homo sapiens
gcactttgaaatacctcatgt

SEQ ID NO: 6264055 - DNA, 16 bp, Homo sapiens
gcactttgagaggctg

SEQ ID NO: 6264056 - DNA, 21 bp, Homo sapiens
gcactttgagaggctgaggtg

SEQ ID NO: 6264057 - DNA, 18 bp, Homo sapiens
gcactttgctcaaaattt

SEQ ID NO: 6264058 - DNA, 20 bp, Homo sapiens
gcactttgggaagctgaggc

SEQ ID NO: 6264059 - DNA, 20 bp, Homo sapiens
gcactttgggaggcaaaggc

SEQ ID NO: 6264060 - DNA, 21 bp, Homo sapiens
gcactttgggaggcaaaggcg

SEQ ID NO: 6264061 - DNA, 19 bp, Homo sapiens
gcactttgggaggccaagg

SEQ ID NO: 6264062 - DNA, 20 bp, Homo sapiens
gcactttgggaggccgaggc

SEQ ID NO: 6264063 - DNA, 19 bp, Homo sapiens
gcactttgggtttttaact

SEQ ID NO: 6264064 - DNA, 22 bp, Homo sapiens
gcactttgttctggctcttcca

SEQ ID NO: 6264065 - DNA, 14 bp, Homo sapiens
gcactttgtttaga

SEQ ID NO: 6264066 - DNA, 18 bp, Homo sapiens
gcacttttaaaaaaattt

SEQ ID NO: 6264067 - DNA, 18 bp, Homo sapiens
gcacttttcattactttc

SEQ ID NO: 6264068 - DNA, 21 bp, Homo sapiens
gcacttttcctgtctcagcct

SEQ ID NO: 6264069 - DNA, 14 bp, Homo sapiens
gcacttttctgtgt

SEQ ID NO: 6264070 - DNA, 14 bp, Homo sapiens
gcacttttgttatt

SEQ ID NO: 6264071 - DNA, 17 bp, Homo sapiens
gcacttttgttattcca

SEQ ID NO: 6264072 - DNA, 20 bp, Homo sapiens
gcactttttcatttgcctat

SEQ ID NO: 6264073 - DNA, 15 bp, Homo sapiens
gcacttttttaaata

SEQ ID NO: 6264074 - DNA, 20 bp, Homo sapiens
gcacttttttaaatataaaa

SEQ ID NO: 6264075 - DNA, 20 bp, Homo sapiens
gcacttttttgtttgaatgt

SEQ ID NO: 6264076 - DNA, 18 bp, Homo sapiens
gcagaaaaaaaagaaaaa

SEQ ID NO: 6264077 - DNA, 21 bp, Homo sapiens
gcagaaaaacaggcacaggct

SEQ ID NO: 6264078 - DNA, 22 bp, Homo sapiens
gcagaaaaaccaacatctacaa

SEQ ID NO: 6264079 - DNA, 14 bp, Homo sapiens
gcagaaaaagaaaa

SEQ ID NO: 6264080 - DNA, 17 bp, Homo sapiens
gcagaaaaaggctgtgc

SEQ ID NO: 6264081 - DNA, 19 bp, Homo sapiens
gcagaaaaaggctgtgctg

SEQ ID NO: 6264082 - DNA, 19 bp, Homo sapiens
gcagaaaacaaaagccctt

SEQ ID NO: 6264083 - DNA, 17 bp, Homo sapiens
gcagaaaacagagcctg

SEQ ID NO: 6264084 - DNA, 16 bp, Homo sapiens
gcagaaaacagggtct

SEQ ID NO: 6264085 - DNA, 16 bp, Homo sapiens
gcagaaaacccttggg

SEQ ID NO: 6264086 - DNA, 21 bp, Homo sapiens
gcagaaaacccttgggccaga

SEQ ID NO: 6264087 - DNA, 14 bp, Homo sapiens
gcagaaaagaggag

SEQ ID NO: 6264088 - DNA, 15 bp, Homo sapiens
gcagaaaagaggaga

SEQ ID NO: 6264089 - DNA, 16 bp, Homo sapiens
gcagaaaagaggagac

SEQ ID NO: 6264090 - DNA, 22 bp, Homo sapiens
gcagaaaagaggagaccctgga

SEQ ID NO: 6264091 - DNA, 23 bp, Homo sapiens
gcagaaaagatgaatttgtccaa

SEQ ID NO: 6264092 - DNA, 15 bp, Homo sapiens
gcagaaaagcacctg

SEQ ID NO: 6264093 - DNA, 16 bp, Homo sapiens
gcagaaaagcacctgc

SEQ ID NO: 6264094 - DNA, 19 bp, Homo sapiens
gcagaaaagtgcttagaaa

SEQ ID NO: 6264095 - DNA, 20 bp, Homo sapiens
gcagaaaatataaatggtaa

SEQ ID NO: 6264096 - DNA, 14 bp, Homo sapiens
gcagaaaatattta

SEQ ID NO: 6264097 - DNA, 17 bp, Homo sapiens
gcagaaaatatttaata

SEQ ID NO: 6264098 - DNA, 13 bp, Homo sapiens
gcagaaaatgaac

SEQ ID NO: 6264099 - DNA, 14 bp, Homo sapiens
gcagaaaattgcac

SEQ ID NO: 6264100 - DNA, 19 bp, Homo sapiens
gcagaaacacacagtcaca

SEQ ID NO: 6264101 - DNA, 20 bp, Homo sapiens
gcagaaaccaacaagaacca

SEQ ID NO: 6264102 - DNA, 16 bp, Homo sapiens
gcagaaacccccagga

SEQ ID NO: 6264103 - DNA, 18 bp, Homo sapiens
gcagaaacccccaggagg

SEQ ID NO: 6264104 - DNA, 22 bp, Homo sapiens
gcagaaacctatctcagggagg

SEQ ID NO: 6264105 - DNA, 17 bp, Homo sapiens
gcagaaacgaagccatc

SEQ ID NO: 6264106 - DNA, 23 bp, Homo sapiens
gcagaaacgaagccatctttctt

SEQ ID NO: 6264107 - DNA, 19 bp, Homo sapiens
gcagaaagatacagacatt

SEQ ID NO: 6264108 - DNA, 20 bp, Homo sapiens
gcagaaagatacagacattc

SEQ ID NO: 6264109 - DNA, 19 bp, Homo sapiens
gcagaaagatttggaaaat

SEQ ID NO: 6264110 - DNA, 20 bp, Homo sapiens
gcagaaagcaaaattatgtt

SEQ ID NO: 6264111 - DNA, 23 bp, Homo sapiens
gcagaaagcaaatgtgacctgtg

SEQ ID NO: 6264112 - DNA, 13 bp, Homo sapiens
gcagaaagcagag

SEQ ID NO: 6264113 - DNA, 18 bp, Homo sapiens
gcagaaagccagggtcct

SEQ ID NO: 6264114 - DNA, 21 bp, Homo sapiens
gcagaaaggaaaacctgaaga

SEQ ID NO: 6264115 - DNA, 23 bp, Homo sapiens
gcagaaaggaaaacctgaagact

SEQ ID NO: 6264116 - DNA, 21 bp, Homo sapiens
gcagaaaggaaaagattcctg

SEQ ID NO: 6264117 - DNA, 15 bp, Homo sapiens
gcagaaagggtaggt

SEQ ID NO: 6264118 - DNA, 20 bp, Homo sapiens
gcagaaagtaagcatttcca

SEQ ID NO: 6264119 - DNA, 13 bp, Homo sapiens
gcagaaagtgcct

SEQ ID NO: 6264120 - DNA, 22 bp, Homo sapiens
gcagaaagtgcctttatctcag

SEQ ID NO: 6264121 - DNA, 23 bp, Homo sapiens
gcagaaagtgcctttcaggatct

SEQ ID NO: 6264122 - DNA, 18 bp, Homo sapiens
gcagaaataggttagagt

SEQ ID NO: 6264123 - DNA, 19 bp, Homo sapiens
gcagaaatagttgtctgtg

SEQ ID NO: 6264124 - DNA, 22 bp, Homo sapiens
gcagaaatagttgtctgtgctt

SEQ ID NO: 6264125 - DNA, 20 bp, Homo sapiens
gcagaaatatttagtatcta

SEQ ID NO: 6264126 - DNA, 16 bp, Homo sapiens
gcagaaatccaagcac

SEQ ID NO: 6264127 - DNA, 20 bp, Homo sapiens
gcagaaatcccagttcatgt

SEQ ID NO: 6264128 - DNA, 16 bp, Homo sapiens
gcagaaatcgagagtg

SEQ ID NO: 6264129 - DNA, 15 bp, Homo sapiens
gcagaaatctagaag

SEQ ID NO: 6264130 - DNA, 12 bp, Homo sapiens
gcagaaattctg

SEQ ID NO: 6264131 - DNA, 21 bp, Homo sapiens
gcagaaattctgtttttaaaa

SEQ ID NO: 6264132 - DNA, 20 bp, Homo sapiens
gcagaacaaactcagatctc

SEQ ID NO: 6264133 - DNA, 14 bp, Homo sapiens
gcagaacaaatgaa

SEQ ID NO: 6264134 - DNA, 17 bp, Homo sapiens
gcagaacaaatgtgttt

SEQ ID NO: 6264135 - DNA, 18 bp, Homo sapiens
gcagaacacatttcaaat

SEQ ID NO: 6264136 - DNA, 15 bp, Homo sapiens
gcagaacacctggcc

SEQ ID NO: 6264137 - DNA, 13 bp, Homo sapiens
gcagaacactaac

SEQ ID NO: 6264138 - DNA, 18 bp, Homo sapiens
gcagaacagacactttaa

SEQ ID NO: 6264139 - DNA, 18 bp, Homo sapiens
gcagaacatcgatatgta

SEQ ID NO: 6264140 - DNA, 22 bp, Homo sapiens
gcagaacatgtgggaggaagaa

SEQ ID NO: 6264141 - DNA, 15 bp, Homo sapiens
gcagaaccagcacta

SEQ ID NO: 6264142 - DNA, 23 bp, Homo sapiens
gcagaaccagtccctctgagtga

SEQ ID NO: 6264143 - DNA, 16 bp, Homo sapiens
gcagaacccccaggtg

SEQ ID NO: 6264144 - DNA, 20 bp, Homo sapiens
gcagaaccggagagccagct

SEQ ID NO: 6264145 - DNA, 20 bp, Homo sapiens
gcagaaccggtcccagcctg

SEQ ID NO: 6264146 - DNA, 19 bp, Homo sapiens
gcagaacctgcacacagga

SEQ ID NO: 6264147 - DNA, 13 bp, Homo sapiens
gcagaacctggtg

SEQ ID NO: 6264148 - DNA, 20 bp, Homo sapiens
gcagaacgatgcctgcaggc

SEQ ID NO: 6264149 - DNA, 13 bp, Homo sapiens
gcagaacggagcc

SEQ ID NO: 6264150 - DNA, 19 bp, Homo sapiens
gcagaacggaggaggctgc

SEQ ID NO: 6264151 - DNA, 17 bp, Homo sapiens
gcagaacggtttttgga

SEQ ID NO: 6264152 - DNA, 21 bp, Homo sapiens
gcagaactaaactcatttata

SEQ ID NO: 6264153 - DNA, 14 bp, Homo sapiens
gcagaactgaagcc

SEQ ID NO: 6264154 - DNA, 14 bp, Homo sapiens
gcagaactgagctc

SEQ ID NO: 6264155 - DNA, 19 bp, Homo sapiens
gcagaactgcagtcactgc

SEQ ID NO: 6264156 - DNA, 15 bp, Homo sapiens
gcagaactgctgggg

SEQ ID NO: 6264157 - DNA, 18 bp, Homo sapiens
gcagaactgctggggctg

SEQ ID NO: 6264158 - DNA, 19 bp, Homo sapiens
gcagaacttccctccatcc

SEQ ID NO: 6264159 - DNA, 19 bp, Homo sapiens
gcagaacttgaagcctgct

SEQ ID NO: 6264160 - DNA, 20 bp, Homo sapiens
gcagaactttccagggatcc

SEQ ID NO: 6264161 - DNA, 19 bp, Homo sapiens
gcagaactttctcttttga

SEQ ID NO: 6264162 - DNA, 14 bp, Homo sapiens
gcagaagaaaggaa

SEQ ID NO: 6264163 - DNA, 15 bp, Homo sapiens
gcagaagaaaggaac

SEQ ID NO: 6264164 - DNA, 17 bp, Homo sapiens
gcagaagaaagggtgga

SEQ ID NO: 6264165 - DNA, 18 bp, Homo sapiens
gcagaagaatctttcttc

SEQ ID NO: 6264166 - DNA, 14 bp, Homo sapiens
gcagaagacaccag

SEQ ID NO: 6264167 - DNA, 21 bp, Homo sapiens
gcagaagacaccagagcagat

SEQ ID NO: 6264168 - DNA, 14 bp, Homo sapiens
gcagaagacagtat

SEQ ID NO: 6264169 - DNA, 15 bp, Homo sapiens
gcagaagagaaagta

SEQ ID NO: 6264170 - DNA, 21 bp, Homo sapiens
gcagaagagagtggggcctgc

SEQ ID NO: 6264171 - DNA, 14 bp, Homo sapiens
gcagaagagggagg

SEQ ID NO: 6264172 - DNA, 12 bp, Homo sapiens
gcagaagagggt

SEQ ID NO: 6264173 - DNA, 16 bp, Homo sapiens
gcagaagcagggtacc

SEQ ID NO: 6264174 - DNA, 18 bp, Homo sapiens
gcagaagcagggtaccct

SEQ ID NO: 6264175 - DNA, 20 bp, Homo sapiens
gcagaagcatattttgctgg

SEQ ID NO: 6264176 - DNA, 13 bp, Homo sapiens
gcagaagcattaa

SEQ ID NO: 6264177 - DNA, 19 bp, Homo sapiens
gcagaagccaagggaagac

SEQ ID NO: 6264178 - DNA, 22 bp, Homo sapiens
gcagaagccccacagcctggca

SEQ ID NO: 6264179 - DNA, 15 bp, Homo sapiens
gcagaagccctgatg

SEQ ID NO: 6264180 - DNA, 22 bp, Homo sapiens
gcagaagctatgtttttaaagt

SEQ ID NO: 6264181 - DNA, 13 bp, Homo sapiens
gcagaaggaaaaa

SEQ ID NO: 6264182 - DNA, 12 bp, Homo sapiens
gcagaaggaaac

SEQ ID NO: 6264183 - DNA, 15 bp, Homo sapiens
gcagaaggaaagaag

SEQ ID NO: 6264184 - DNA, 23 bp, Homo sapiens
gcagaaggaaagaagggggccct

SEQ ID NO: 6264185 - DNA, 21 bp, Homo sapiens
gcagaaggacaggtctctgag

SEQ ID NO: 6264186 - DNA, 15 bp, Homo sapiens
gcagaaggagagtga

SEQ ID NO: 6264187 - DNA, 20 bp, Homo sapiens
gcagaaggaggaagggactg

SEQ ID NO: 6264188 - DNA, 21 bp, Homo sapiens
gcagaaggcaaggccctgccc

SEQ ID NO: 6264189 - DNA, 14 bp, Homo sapiens
gcagaaggccaaga

SEQ ID NO: 6264190 - DNA, 22 bp, Homo sapiens
gcagaagggagctggctccagc

SEQ ID NO: 6264191 - DNA, 16 bp, Homo sapiens
gcagaaggggaagata

SEQ ID NO: 6264192 - DNA, 17 bp, Homo sapiens
gcagaagtaagcctcat

SEQ ID NO: 6264193 - DNA, 23 bp, Homo sapiens
gcagaagtctggctttgctctat

SEQ ID NO: 6264194 - DNA, 22 bp, Homo sapiens
gcagaagtgctctttgtggcag

SEQ ID NO: 6264195 - DNA, 22 bp, Homo sapiens
gcagaagtgtcaccctgtgggt

SEQ ID NO: 6264196 - DNA, 16 bp, Homo sapiens
gcagaataaagcaatt

SEQ ID NO: 6264197 - DNA, 22 bp, Homo sapiens
gcagaataaagcaattttcctt

SEQ ID NO: 6264198 - DNA, 15 bp, Homo sapiens
gcagaataaatgttt

SEQ ID NO: 6264199 - DNA, 21 bp, Homo sapiens
gcagaataaatgttttacaac

SEQ ID NO: 6264200 - DNA, 15 bp, Homo sapiens
gcagaataatggaaa

SEQ ID NO: 6264201 - DNA, 19 bp, Homo sapiens
gcagaatactggtctcagg

SEQ ID NO: 6264202 - DNA, 23 bp, Homo sapiens
gcagaatcctaggctccacccca

SEQ ID NO: 6264203 - DNA, 17 bp, Homo sapiens
gcagaatcctgggcccc

SEQ ID NO: 6264204 - DNA, 20 bp, Homo sapiens
gcagaatcctgggcccccag

SEQ ID NO: 6264205 - DNA, 22 bp, Homo sapiens
gcagaatcctgggcccccagag

SEQ ID NO: 6264206 - DNA, 15 bp, Homo sapiens
gcagaatgaagggcc

SEQ ID NO: 6264207 - DNA, 14 bp, Homo sapiens
gcagaatggaaaaa

SEQ ID NO: 6264208 - DNA, 14 bp, Homo sapiens
gcagaatggctgca

SEQ ID NO: 6264209 - DNA, 18 bp, Homo sapiens
gcagaatgtaagtgggcc

SEQ ID NO: 6264210 - DNA, 17 bp, Homo sapiens
gcagaatgtttttaaaa

SEQ ID NO: 6264211 - DNA, 17 bp, Homo sapiens
gcagaattctaggcagc

SEQ ID NO: 6264212 - DNA, 21 bp, Homo sapiens
gcagaattgtttagattttgt

SEQ ID NO: 6264213 - DNA, 19 bp, Homo sapiens
gcagacaaagccctgtcct

SEQ ID NO: 6264214 - DNA, 14 bp, Homo sapiens
gcagacaaagtcaa

SEQ ID NO: 6264215 - DNA, 14 bp, Homo sapiens
gcagacaaccttgt

SEQ ID NO: 6264216 - DNA, 20 bp, Homo sapiens
gctccctgctttggctgagg

SEQ ID NO: 6264217 - DNA, 22 bp, Homo sapiens
gctccctggaaagcaggcaagc

SEQ ID NO: 6264218 - DNA, 13 bp, Homo sapiens
gctccctggaagc

SEQ ID NO: 6264219 - DNA, 11 bp, Homo sapiens
gctccctggag

SEQ ID NO: 6264220 - DNA, 13 bp, Homo sapiens
gctccctggagcc

SEQ ID NO: 6264221 - DNA, 16 bp, Homo sapiens
gctccctggcccagcc

SEQ ID NO: 6264222 - DNA, 13 bp, Homo sapiens
gctccctgggcag

SEQ ID NO: 6264223 - DNA, 12 bp, Homo sapiens
gctccctggggg

SEQ ID NO: 6264224 - DNA, 21 bp, Homo sapiens
gctccctgtaacctcttcaga

SEQ ID NO: 6264225 - DNA, 16 bp, Homo sapiens
gctccctgtgccccca

SEQ ID NO: 6264226 - DNA, 21 bp, Homo sapiens
gctccctgtgtccacctgtgg

SEQ ID NO: 6264227 - DNA, 23 bp, Homo sapiens
gctcccttcaagacgaggggcag

SEQ ID NO: 6264228 - DNA, 13 bp, Homo sapiens
gctcccttcagcc

SEQ ID NO: 6264229 - DNA, 15 bp, Homo sapiens
gctcccttcagcccc

SEQ ID NO: 6264230 - DNA, 15 bp, Homo sapiens
gctcccttcccacct

SEQ ID NO: 6264231 - DNA, 18 bp, Homo sapiens
gctcccttcccacctctc

SEQ ID NO: 6264232 - DNA, 20 bp, Homo sapiens
gctcccttcccacctctctc

SEQ ID NO: 6264233 - DNA, 14 bp, Homo sapiens
gctcccttcctccc

SEQ ID NO: 6264234 - DNA, 14 bp, Homo sapiens
gctcccttcttccc

SEQ ID NO: 6264235 - DNA, 16 bp, Homo sapiens
gctcccttggctttga

SEQ ID NO: 6264236 - DNA, 15 bp, Homo sapiens
gctcccttgggaagg

SEQ ID NO: 6264237 - DNA, 19 bp, Homo sapiens
gctccctttaagccaagag

SEQ ID NO: 6264238 - DNA, 17 bp, Homo sapiens
gctccgaaacaagagac

SEQ ID NO: 6264239 - DNA, 15 bp, Homo sapiens
gctccgaaattccaa

SEQ ID NO: 6264240 - DNA, 20 bp, Homo sapiens
gctccgaaattccaaggccc

SEQ ID NO: 6264241 - DNA, 18 bp, Homo sapiens
gctccgaaccccgggccc

SEQ ID NO: 6264242 - DNA, 13 bp, Homo sapiens
gctccgacctctc

SEQ ID NO: 6264243 - DNA, 17 bp, Homo sapiens
gctccgaggactggact

SEQ ID NO: 6264244 - DNA, 20 bp, Homo sapiens
gctccgagtggctcccgtgt

SEQ ID NO: 6264245 - DNA, 21 bp, Homo sapiens
gctccgatgcccgcccgggga

SEQ ID NO: 6264246 - DNA, 13 bp, Homo sapiens
gctccgcagggcg

SEQ ID NO: 6264247 - DNA, 13 bp, Homo sapiens
gctccgcaggggt

SEQ ID NO: 6264248 - DNA, 13 bp, Homo sapiens
gctccgccaggaa

SEQ ID NO: 6264249 - DNA, 12 bp, Homo sapiens
gctccgccctta

SEQ ID NO: 6264250 - DNA, 15 bp, Homo sapiens
gctccgcctggcacc

SEQ ID NO: 6264251 - DNA, 17 bp, Homo sapiens
gctccgcctggcctggc

SEQ ID NO: 6264252 - DNA, 18 bp, Homo sapiens
gctccgcgctcggggctg

SEQ ID NO: 6264253 - DNA, 15 bp, Homo sapiens
gctccgctgccgtgc

SEQ ID NO: 6264254 - DNA, 16 bp, Homo sapiens
gctccgctgcctggaa

SEQ ID NO: 6264255 - DNA, 16 bp, Homo sapiens
gctccgctgtgcccgc

SEQ ID NO: 6264256 - DNA, 14 bp, Homo sapiens
gctccgctgtgtgg

SEQ ID NO: 6264257 - DNA, 21 bp, Homo sapiens
gctccgctttctacccagcga

SEQ ID NO: 6264258 - DNA, 22 bp, Homo sapiens
gctccggaggggacccagctcc

SEQ ID NO: 6264259 - DNA, 23 bp, Homo sapiens
gctccggaggggacccagctcct

SEQ ID NO: 6264260 - DNA, 14 bp, Homo sapiens
gctccggcagaggc

SEQ ID NO: 6264261 - DNA, 19 bp, Homo sapiens
gctccggcagaggcagggc

SEQ ID NO: 6264262 - DNA, 22 bp, Homo sapiens
gctccggcagaggcagggccct

SEQ ID NO: 6264263 - DNA, 21 bp, Homo sapiens
gctccgggacgtggcacctcc

SEQ ID NO: 6264264 - DNA, 22 bp, Homo sapiens
gctccgggacgtggcacctcct

SEQ ID NO: 6264265 - DNA, 17 bp, Homo sapiens
gctccgggggtacagcc

SEQ ID NO: 6264266 - DNA, 16 bp, Homo sapiens
gctccgggtcactgct

SEQ ID NO: 6264267 - DNA, 17 bp, Homo sapiens
gctccgggtcactgctg

SEQ ID NO: 6264268 - DNA, 14 bp, Homo sapiens
gctccgggtgcgtg

SEQ ID NO: 6264269 - DNA, 17 bp, Homo sapiens
gctccgtagctctgctg

SEQ ID NO: 6264270 - DNA, 19 bp, Homo sapiens
gctccgtagctctgctgct

SEQ ID NO: 6264271 - DNA, 13 bp, Homo sapiens
gctccgtcatctg

SEQ ID NO: 6264272 - DNA, 13 bp, Homo sapiens
gctccgtctctgt

SEQ ID NO: 6264273 - DNA, 14 bp, Homo sapiens
gctccgtctctgtc

SEQ ID NO: 6264274 - DNA, 16 bp, Homo sapiens
gctccgtctctgtcct

SEQ ID NO: 6264275 - DNA, 15 bp, Homo sapiens
gctccgtgagccctt

SEQ ID NO: 6264276 - DNA, 14 bp, Homo sapiens
gctccgtgcctcca

SEQ ID NO: 6264277 - DNA, 21 bp, Homo sapiens
gctccgtggactgcagtcggc

SEQ ID NO: 6264278 - DNA, 16 bp, Homo sapiens
gctccgtggaggaggt

SEQ ID NO: 6264279 - DNA, 21 bp, Homo sapiens
gctccgtggccccgccctcag

SEQ ID NO: 6264280 - DNA, 13 bp, Homo sapiens
gctccgtgtgtct

SEQ ID NO: 6264281 - DNA, 16 bp, Homo sapiens
gctccgtgtgtctcat

SEQ ID NO: 6264282 - DNA, 18 bp, Homo sapiens
gctccgtgtgtctcatgc

SEQ ID NO: 6264283 - DNA, 19 bp, Homo sapiens
gctccgtgttcctcggtgg

SEQ ID NO: 6264284 - DNA, 12 bp, Homo sapiens
gctccgtgtttc

SEQ ID NO: 6264285 - DNA, 21 bp, Homo sapiens
gctcctaaacccccgctccag

SEQ ID NO: 6264286 - DNA, 16 bp, Homo sapiens
gctcctaacctacctc

SEQ ID NO: 6264287 - DNA, 17 bp, Homo sapiens
gctcctaagctgccagc

SEQ ID NO: 6264288 - DNA, 23 bp, Homo sapiens
gctcctaagctgccagccttccc

SEQ ID NO: 6264289 - DNA, 16 bp, Homo sapiens
gctcctacatccagct

SEQ ID NO: 6264290 - DNA, 21 bp, Homo sapiens
gctcctacccaccgcccttgc

SEQ ID NO: 6264291 - DNA, 21 bp, Homo sapiens
gctcctaccccatctccaaga

SEQ ID NO: 6264292 - DNA, 15 bp, Homo sapiens
gctcctacctctgtg

SEQ ID NO: 6264293 - DNA, 16 bp, Homo sapiens
gctcctacctctgtgc

SEQ ID NO: 6264294 - DNA, 11 bp, Homo sapiens
gctcctacctg

SEQ ID NO: 6264295 - DNA, 14 bp, Homo sapiens
gctcctacctgggg

SEQ ID NO: 6264296 - DNA, 20 bp, Homo sapiens
gctcctacctgggggcagaa

SEQ ID NO: 6264297 - DNA, 18 bp, Homo sapiens
gctcctacctgtctgctg

SEQ ID NO: 6264298 - DNA, 19 bp, Homo sapiens
gctcctacctgtctgctgc

SEQ ID NO: 6264299 - DNA, 16 bp, Homo sapiens
gctcctagaagtctta

SEQ ID NO: 6264300 - DNA, 18 bp, Homo sapiens
gctcctagaagtcttaat

SEQ ID NO: 6264301 - DNA, 14 bp, Homo sapiens
gctcctagagagga

SEQ ID NO: 6264302 - DNA, 13 bp, Homo sapiens
gctcctagaggga

SEQ ID NO: 6264303 - DNA, 16 bp, Homo sapiens
gctcctagagggaggg

SEQ ID NO: 6264304 - DNA, 17 bp, Homo sapiens
gctcctagcagacagaa

SEQ ID NO: 6264305 - DNA, 19 bp, Homo sapiens
gctcctagcccagcagaga

SEQ ID NO: 6264306 - DNA, 19 bp, Homo sapiens
gctcctagtatgccctgta

SEQ ID NO: 6264307 - DNA, 23 bp, Homo sapiens
gctcctataaagggcccacacct

SEQ ID NO: 6264308 - DNA, 21 bp, Homo sapiens
gctcctattcaacacacacat

SEQ ID NO: 6264309 - DNA, 22 bp, Homo sapiens
gctcctattgaaagaccagatc

SEQ ID NO: 6264310 - DNA, 11 bp, Homo sapiens
gctcctcaccc

SEQ ID NO: 6264311 - DNA, 12 bp, Homo sapiens
gctcctcacccc

SEQ ID NO: 6264312 - DNA, 17 bp, Homo sapiens
gctcctcacccccaccc

SEQ ID NO: 6264313 - DNA, 23 bp, Homo sapiens
gctcctcacccccacccctgtac

SEQ ID NO: 6264314 - DNA, 19 bp, Homo sapiens
gctcctcacccctgtaggg

SEQ ID NO: 6264315 - DNA, 14 bp, Homo sapiens
gctcctcactgccc

SEQ ID NO: 6264316 - DNA, 16 bp, Homo sapiens
gctcctcactgcccgc

SEQ ID NO: 6264317 - DNA, 11 bp, Homo sapiens
gctcctcagag

SEQ ID NO: 6264318 - DNA, 14 bp, Homo sapiens
gctcctcagccctc

SEQ ID NO: 6264319 - DNA, 15 bp, Homo sapiens
gctcctcatgggaag

SEQ ID NO: 6264320 - DNA, 11 bp, Homo sapiens
gctcctccagc

SEQ ID NO: 6264321 - DNA, 12 bp, Homo sapiens
gctcctccagcc

SEQ ID NO: 6264322 - DNA, 23 bp, Homo sapiens
gctcctccagcccttcagacgag

SEQ ID NO: 6264323 - DNA, 22 bp, Homo sapiens
gctcctccagggccacgtgcca

SEQ ID NO: 6264324 - DNA, 21 bp, Homo sapiens
gctcctccagggtggcagcaa

SEQ ID NO: 6264325 - DNA, 16 bp, Homo sapiens
gctcctcccagatggc

SEQ ID NO: 6264326 - DNA, 12 bp, Homo sapiens
gctcctcccagc

SEQ ID NO: 6264327 - DNA, 22 bp, Homo sapiens
gctcctcccagcacaggcacct

SEQ ID NO: 6264328 - DNA, 11 bp, Homo sapiens
gctcctcccct

SEQ ID NO: 6264329 - DNA, 15 bp, Homo sapiens
gctcctcccctcttg

SEQ ID NO: 6264330 - DNA, 16 bp, Homo sapiens
gctcctcccctcttga

SEQ ID NO: 6264331 - DNA, 17 bp, Homo sapiens
gctcctcccctcttgag

SEQ ID NO: 6264332 - DNA, 16 bp, Homo sapiens
gctcctcccctgccgc

SEQ ID NO: 6264333 - DNA, 18 bp, Homo sapiens
gctcctcccctgccgcct

SEQ ID NO: 6264334 - DNA, 15 bp, Homo sapiens
gctcctcccctggag

SEQ ID NO: 6264335 - DNA, 13 bp, Homo sapiens
gctcctcccgaaa

SEQ ID NO: 6264336 - DNA, 21 bp, Homo sapiens
gctcctccctccctctgccgg

SEQ ID NO: 6264337 - DNA, 16 bp, Homo sapiens
gctcctccctctgcct

SEQ ID NO: 6264338 - DNA, 18 bp, Homo sapiens
gctcctccctctgcctca

SEQ ID NO: 6264339 - DNA, 13 bp, Homo sapiens
gctcctccctgcc

SEQ ID NO: 6264340 - DNA, 22 bp, Homo sapiens
gctcctccctgccccccaaggt

SEQ ID NO: 6264341 - DNA, 21 bp, Homo sapiens
gctcctccctgctcctcatgg

SEQ ID NO: 6264342 - DNA, 14 bp, Homo sapiens
gctcctccctggag

SEQ ID NO: 6264343 - DNA, 20 bp, Homo sapiens
gctcctccctggctgccctg

SEQ ID NO: 6264344 - DNA, 21 bp, Homo sapiens
gctcctccctgtgcccccagc

SEQ ID NO: 6264345 - DNA, 17 bp, Homo sapiens
gctcctccgtctgaccc

SEQ ID NO: 6264346 - DNA, 14 bp, Homo sapiens
gctcctcctcaccc

SEQ ID NO: 6264347 - DNA, 16 bp, Homo sapiens
gctcctcctcacccac

SEQ ID NO: 6264348 - DNA, 23 bp, Homo sapiens
gctcctcctcacccacctctggg

SEQ ID NO: 6264349 - DNA, 16 bp, Homo sapiens
gctcctcctccctgca

SEQ ID NO: 6264350 - DNA, 13 bp, Homo sapiens
gctcctcctcctg

SEQ ID NO: 6264351 - DNA, 19 bp, Homo sapiens
gctcctcctcctgggctat

SEQ ID NO: 6264352 - DNA, 21 bp, Homo sapiens
gctcctcctcttggagctgag

SEQ ID NO: 6264353 - DNA, 14 bp, Homo sapiens
gctcctcctgaagg

SEQ ID NO: 6264354 - DNA, 16 bp, Homo sapiens
gctcctcctgccctgt

SEQ ID NO: 6264355 - DNA, 12 bp, Homo sapiens
gctcctcctgga

SEQ ID NO: 6264356 - DNA, 14 bp, Homo sapiens
gctcctcctgtgtg

SEQ ID NO: 6264357 - DNA, 14 bp, Homo sapiens
gctcctccttccca

SEQ ID NO: 6264358 - DNA, 15 bp, Homo sapiens
gctcctccttcccag

SEQ ID NO: 6264359 - DNA, 16 bp, Homo sapiens
gctcctccttcccagg

SEQ ID NO: 6264360 - DNA, 19 bp, Homo sapiens
gctcctccttcccagggac

SEQ ID NO: 6264361 - DNA, 20 bp, Homo sapiens
gctcctccttcccagggacc

SEQ ID NO: 6264362 - DNA, 15 bp, Homo sapiens
gctcctccttcccct

SEQ ID NO: 6264363 - DNA, 23 bp, Homo sapiens
gctcctcctttactttctctctc

SEQ ID NO: 6264364 - DNA, 21 bp, Homo sapiens
gctcctcgctgcgtctccatc

SEQ ID NO: 6264365 - DNA, 17 bp, Homo sapiens
gctcctcggccagagct

SEQ ID NO: 6264366 - DNA, 21 bp, Homo sapiens
gctcctcggccagagctccca

SEQ ID NO: 6264367 - DNA, 22 bp, Homo sapiens
gctcctcggccagagctcccag

SEQ ID NO: 6264368 - DNA, 23 bp, Homo sapiens
gctcctcggccagagctcccagg

SEQ ID NO: 6264369 - DNA, 20 bp, Homo sapiens
gctcctcgggtggggcctgc

SEQ ID NO: 6264370 - DNA, 21 bp, Homo sapiens
gctcctcgtctttgaactgcc

SEQ ID NO: 6264371 - DNA, 18 bp, Homo sapiens
gctcctctaggggcagcc

SEQ ID NO: 6264372 - DNA, 19 bp, Homo sapiens
gctcctctcaggctgggcc

SEQ ID NO: 6264373 - DNA, 17 bp, Homo sapiens
gctcctctccagacaca

SEQ ID NO: 6264374 - DNA, 16 bp, Homo sapiens
gctcctctccaggcac

SEQ ID NO: 6264375 - DNA, 19 bp, Homo sapiens
gctcctctccccagcaagt

SEQ ID NO: 6264376 - DNA, 22 bp, Homo sapiens
gctcctctccccagcccagaga

SEQ ID NO: 6264377 - DNA, 16 bp, Homo sapiens
gctcctctccctcaca

SEQ ID NO: 6264378 - DNA, 14 bp, Homo sapiens
gctcctctcctgga

SEQ ID NO: 6264379 - DNA, 18 bp, Homo sapiens
gctcctctcctggaggat

SEQ ID NO: 6264380 - DNA, 18 bp, Homo sapiens
gctcctctccttgggctc

SEQ ID NO: 6264381 - DNA, 21 bp, Homo sapiens
gctcctctccttgggctcctg

SEQ ID NO: 6264382 - DNA, 12 bp, Homo sapiens
gctcctctctga

SEQ ID NO: 6264383 - DNA, 13 bp, Homo sapiens
gctcctctctttg

SEQ ID NO: 6264384 - DNA, 12 bp, Homo sapiens
gctcctctgagc

SEQ ID NO: 6264385 - DNA, 13 bp, Homo sapiens
gctcctctgagcc

SEQ ID NO: 6264386 - DNA, 15 bp, Homo sapiens
gctcctctgcagcct

SEQ ID NO: 6264387 - DNA, 20 bp, Homo sapiens
gctcctctgcagcctgagct

SEQ ID NO: 6264388 - DNA, 13 bp, Homo sapiens
gctcctctgccct

SEQ ID NO: 6264389 - DNA, 13 bp, Homo sapiens
gctcctctgcctg

SEQ ID NO: 6264390 - DNA, 15 bp, Homo sapiens
gctcctctgcctgtg

SEQ ID NO: 6264391 - DNA, 16 bp, Homo sapiens
gctcctctgcctgtgc

SEQ ID NO: 6264392 - DNA, 19 bp, Homo sapiens
gctcctctgcctgtgcccg

SEQ ID NO: 6264393 - DNA, 20 bp, Homo sapiens
gctcctctgcctgtgcccgc

SEQ ID NO: 6264394 - DNA, 17 bp, Homo sapiens
gctcctctgccttggac

SEQ ID NO: 6264395 - DNA, 12 bp, Homo sapiens
gctcctctgctc

SEQ ID NO: 6264396 - DNA, 17 bp, Homo sapiens
gctcctctgctgctccc

SEQ ID NO: 6264397 - DNA, 15 bp, Homo sapiens
gcagacaagagctgc

SEQ ID NO: 6264398 - DNA, 18 bp, Homo sapiens
gcagacaagagctgctgt

SEQ ID NO: 6264399 - DNA, 23 bp, Homo sapiens
gcagacaagagggcaagcctcta

SEQ ID NO: 6264400 - DNA, 24 bp, Homo sapiens
gcagacaagtcttgctgtgcttta

SEQ ID NO: 6264401 - DNA, 22 bp, Homo sapiens
gcagacaatagtatagaagtct

SEQ ID NO: 6264402 - DNA, 12 bp, Homo sapiens
gcagacacacac

SEQ ID NO: 6264403 - DNA, 13 bp, Homo sapiens
gcagacacacaca

SEQ ID NO: 6264404 - DNA, 14 bp, Homo sapiens
gcagacacacacat

SEQ ID NO: 6264405 - DNA, 16 bp, Homo sapiens
gcagacacacacatat

SEQ ID NO: 6264406 - DNA, 12 bp, Homo sapiens
gcagacacacat

SEQ ID NO: 6264407 - DNA, 22 bp, Homo sapiens
gcagacacattgtcatcagagg

SEQ ID NO: 6264408 - DNA, 19 bp, Homo sapiens
gcagacacctaaccccagg

SEQ ID NO: 6264409 - DNA, 17 bp, Homo sapiens
gcagacacctggactga

SEQ ID NO: 6264410 - DNA, 22 bp, Homo sapiens
gcagacacctggactgagccaa

SEQ ID NO: 6264411 - DNA, 20 bp, Homo sapiens
gcagacacgccttcccctca

SEQ ID NO: 6264412 - DNA, 18 bp, Homo sapiens
gcagacactcaagagccc

SEQ ID NO: 6264413 - DNA, 17 bp, Homo sapiens
gcagacagacagacaga

SEQ ID NO: 6264414 - DNA, 13 bp, Homo sapiens
gcagacagagaaa

SEQ ID NO: 6264415 - DNA, 16 bp, Homo sapiens
gcagacagagccagga

SEQ ID NO: 6264416 - DNA, 22 bp, Homo sapiens
gcagacagagccaggagaagct

SEQ ID NO: 6264417 - DNA, 15 bp, Homo sapiens
gcagacagaggggat

SEQ ID NO: 6264418 - DNA, 14 bp, Homo sapiens
gcagacagcagctc

SEQ ID NO: 6264419 - DNA, 14 bp, Homo sapiens
gcagacagccatgc

SEQ ID NO: 6264420 - DNA, 13 bp, Homo sapiens
gcagacaggaagg

SEQ ID NO: 6264421 - DNA, 16 bp, Homo sapiens
gcagacaggaaggaag

SEQ ID NO: 6264422 - DNA, 14 bp, Homo sapiens
gcagacaggaggaa

SEQ ID NO: 6264423 - DNA, 19 bp, Homo sapiens
gcagacaggcaagcacctc

SEQ ID NO: 6264424 - DNA, 20 bp, Homo sapiens
gcagacaggccccgtgaggc

SEQ ID NO: 6264425 - DNA, 17 bp, Homo sapiens
gcagacagggcgtcctc

SEQ ID NO: 6264426 - DNA, 21 bp, Homo sapiens
gcagacagggcgtcctctcgt

SEQ ID NO: 6264427 - DNA, 22 bp, Homo sapiens
gcagacagtccttaatgctgaa

SEQ ID NO: 6264428 - DNA, 21 bp, Homo sapiens
gcagacagtctgttatgcact

SEQ ID NO: 6264429 - DNA, 21 bp, Homo sapiens
gcagacatctctggagccaga

SEQ ID NO: 6264430 - DNA, 22 bp, Homo sapiens
gcagacatctctggagccagag

SEQ ID NO: 6264431 - DNA, 19 bp, Homo sapiens
gcagacatgtgcacttgaa

SEQ ID NO: 6264432 - DNA, 17 bp, Homo sapiens
gcagacattctcaaagc

SEQ ID NO: 6264433 - DNA, 15 bp, Homo sapiens
gcagacatttacatg

SEQ ID NO: 6264434 - DNA, 17 bp, Homo sapiens
gcagaccacattgcttt

SEQ ID NO: 6264435 - DNA, 17 bp, Homo sapiens
gcagaccaccccgcctg

SEQ ID NO: 6264436 - DNA, 21 bp, Homo sapiens
gcagaccaccccgcctgccct

SEQ ID NO: 6264437 - DNA, 21 bp, Homo sapiens
gcagaccagctggcgggtgtg

SEQ ID NO: 6264438 - DNA, 16 bp, Homo sapiens
gcagaccatctccagc

SEQ ID NO: 6264439 - DNA, 23 bp, Homo sapiens
gcagaccattggggctcccagcc

SEQ ID NO: 6264440 - DNA, 22 bp, Homo sapiens
gcagacccagcttagagttctt

SEQ ID NO: 6264441 - DNA, 16 bp, Homo sapiens
gcagacccagtcccac

SEQ ID NO: 6264442 - DNA, 19 bp, Homo sapiens
gcagacccagtcccacact

SEQ ID NO: 6264443 - DNA, 15 bp, Homo sapiens
gcagaccccaggttc

SEQ ID NO: 6264444 - DNA, 18 bp, Homo sapiens
gcagaccccttggccagc

SEQ ID NO: 6264445 - DNA, 14 bp, Homo sapiens
gcagaccctgccag

SEQ ID NO: 6264446 - DNA, 15 bp, Homo sapiens
gcagaccctgccagg

SEQ ID NO: 6264447 - DNA, 17 bp, Homo sapiens
gcagaccctgccagggg

SEQ ID NO: 6264448 - DNA, 15 bp, Homo sapiens
gcagaccctgccctt

SEQ ID NO: 6264449 - DNA, 20 bp, Homo sapiens
gcagaccgggggccagacac

SEQ ID NO: 6264450 - DNA, 16 bp, Homo sapiens
gcagacctaagccctg

SEQ ID NO: 6264451 - DNA, 13 bp, Homo sapiens
gcagacctcccca

SEQ ID NO: 6264452 - DNA, 17 bp, Homo sapiens
gcagacctccccagccc

SEQ ID NO: 6264453 - DNA, 12 bp, Homo sapiens
gcagacctctgg

SEQ ID NO: 6264454 - DNA, 12 bp, Homo sapiens
gcagacctggag

SEQ ID NO: 6264455 - DNA, 13 bp, Homo sapiens
gcagacctggctg

SEQ ID NO: 6264456 - DNA, 14 bp, Homo sapiens
gcagacctggctgg

SEQ ID NO: 6264457 - DNA, 19 bp, Homo sapiens
gcagacctgtcctcctggt

SEQ ID NO: 6264458 - DNA, 20 bp, Homo sapiens
gcagacctgtcctcctggtg

SEQ ID NO: 6264459 - DNA, 18 bp, Homo sapiens
gcagacgcagcagctggg

SEQ ID NO: 6264460 - DNA, 14 bp, Homo sapiens
gcagacgccgggga

SEQ ID NO: 6264461 - DNA, 16 bp, Homo sapiens
gcagacgcggcgggga

SEQ ID NO: 6264462 - DNA, 16 bp, Homo sapiens
gcagacgggcacagac

SEQ ID NO: 6264463 - DNA, 19 bp, Homo sapiens
gcagacgggcacagacacg

SEQ ID NO: 6264464 - DNA, 21 bp, Homo sapiens
gcagacggggggctgcgggcg

SEQ ID NO: 6264465 - DNA, 19 bp, Homo sapiens
gcagacggtctgtgtgctg

SEQ ID NO: 6264466 - DNA, 21 bp, Homo sapiens
gcagacggtctgtgtgctgtt

SEQ ID NO: 6264467 - DNA, 23 bp, Homo sapiens
gcagacggtctgtgtgctgtttg

SEQ ID NO: 6264468 - DNA, 19 bp, Homo sapiens
gcagacgtcgtacccagcc

SEQ ID NO: 6264469 - DNA, 15 bp, Homo sapiens
gcagactacacagga

SEQ ID NO: 6264470 - DNA, 16 bp, Homo sapiens
gcagactacacaggat

SEQ ID NO: 6264471 - DNA, 23 bp, Homo sapiens
gcagactagagtctgagatgccc

SEQ ID NO: 6264472 - DNA, 20 bp, Homo sapiens
gcagactcaataaaatcatg

SEQ ID NO: 6264473 - DNA, 13 bp, Homo sapiens
gcagactcagctg

SEQ ID NO: 6264474 - DNA, 18 bp, Homo sapiens
gcagactcagtttgtcag

SEQ ID NO: 6264475 - DNA, 16 bp, Homo sapiens
gcagactccagcccct

SEQ ID NO: 6264476 - DNA, 20 bp, Homo sapiens
gcagactccagcccctggac

SEQ ID NO: 6264477 - DNA, 13 bp, Homo sapiens
gcagactcctcca

SEQ ID NO: 6264478 - DNA, 17 bp, Homo sapiens
gcagactcctccacgtg

SEQ ID NO: 6264479 - DNA, 24 bp, Homo sapiens
gcagactcgttctcgtgacccagt

SEQ ID NO: 6264480 - DNA, 19 bp, Homo sapiens
gcagactctacagaggcca

SEQ ID NO: 6264481 - DNA, 22 bp, Homo sapiens
gcagactctacagaggccatgg

SEQ ID NO: 6264482 - DNA, 21 bp, Homo sapiens
gcagactgctgctagagccag

SEQ ID NO: 6264483 - DNA, 13 bp, Homo sapiens
gcagactggaggg

SEQ ID NO: 6264484 - DNA, 15 bp, Homo sapiens
gcagactggagggga

SEQ ID NO: 6264485 - DNA, 21 bp, Homo sapiens
gcagactggcggagaaggaga

SEQ ID NO: 6264486 - DNA, 17 bp, Homo sapiens
gcagactggtgttaatg

SEQ ID NO: 6264487 - DNA, 22 bp, Homo sapiens
gcagactgtgaacttgactggg

SEQ ID NO: 6264488 - DNA, 23 bp, Homo sapiens
gcagactgtggctgcagagacct

SEQ ID NO: 6264489 - DNA, 22 bp, Homo sapiens
gcagacttcttaaaaggagctc

SEQ ID NO: 6264490 - DNA, 22 bp, Homo sapiens
gcagacttgagtctgaggcccc

SEQ ID NO: 6264491 - DNA, 19 bp, Homo sapiens
gcagactttcccaaatgta

SEQ ID NO: 6264492 - DNA, 20 bp, Homo sapiens
gcagactttcccaaatgtat

SEQ ID NO: 6264493 - DNA, 21 bp, Homo sapiens
gcagactttcccaaatgtatt

SEQ ID NO: 6264494 - DNA, 20 bp, Homo sapiens
gcagactttctctgtgtatg

SEQ ID NO: 6264495 - DNA, 17 bp, Homo sapiens
gcagacttttaaagact

SEQ ID NO: 6264496 - DNA, 18 bp, Homo sapiens
gcagacttttcagaagat

SEQ ID NO: 6264497 - DNA, 14 bp, Homo sapiens
gcagagaaaacaca

SEQ ID NO: 6264498 - DNA, 18 bp, Homo sapiens
gcagagaaagaagagaca

SEQ ID NO: 6264499 - DNA, 20 bp, Homo sapiens
gcagagaaagggacaatgat

SEQ ID NO: 6264500 - DNA, 20 bp, Homo sapiens
gcagagaaatgccccagtgt

SEQ ID NO: 6264501 - DNA, 12 bp, Homo sapiens
gcagagaagaga

SEQ ID NO: 6264502 - DNA, 17 bp, Homo sapiens
gcagagaagctctcggg

SEQ ID NO: 6264503 - DNA, 16 bp, Homo sapiens
gcagagaagctggact

SEQ ID NO: 6264504 - DNA, 13 bp, Homo sapiens
gcagagaaggctt

SEQ ID NO: 6264505 - DNA, 22 bp, Homo sapiens
gcagagaagggcataaaacagc

SEQ ID NO: 6264506 - DNA, 20 bp, Homo sapiens
gcagagaagtgacggttcct

SEQ ID NO: 6264507 - DNA, 15 bp, Homo sapiens
gcagagaagttctca

SEQ ID NO: 6264508 - DNA, 10 bp, Homo sapiens
gcagagaatg

SEQ ID NO: 6264509 - DNA, 20 bp, Homo sapiens
gcagagaatgaaagggccca

SEQ ID NO: 6264510 - DNA, 22 bp, Homo sapiens
gcagagaatgaaagggcccaga

SEQ ID NO: 6264511 - DNA, 20 bp, Homo sapiens
gcagagaatggctgggtcag

SEQ ID NO: 6264512 - DNA, 21 bp, Homo sapiens
gcagagaatggctgggtcagg

SEQ ID NO: 6264513 - DNA, 12 bp, Homo sapiens
gcagagacaata

SEQ ID NO: 6264514 - DNA, 19 bp, Homo sapiens
gcagagacaataaaacatt

SEQ ID NO: 6264515 - DNA, 14 bp, Homo sapiens
gcagagaccatccc

SEQ ID NO: 6264516 - DNA, 15 bp, Homo sapiens
gcagagaccatccct

SEQ ID NO: 6264517 - DNA, 19 bp, Homo sapiens
gcagagaccatccctgaag

SEQ ID NO: 6264518 - DNA, 22 bp, Homo sapiens
gcagagaccatccctgaaggcc

SEQ ID NO: 6264519 - DNA, 15 bp, Homo sapiens
gcagagaccccagga

SEQ ID NO: 6264520 - DNA, 22 bp, Homo sapiens
gcagagacgaggtgtcttcctt

SEQ ID NO: 6264521 - DNA, 16 bp, Homo sapiens
gcagagacgcaaggga

SEQ ID NO: 6264522 - DNA, 15 bp, Homo sapiens
gcagagacggcagcc

SEQ ID NO: 6264523 - DNA, 18 bp, Homo sapiens
gcagagacggcagcccca

SEQ ID NO: 6264524 - DNA, 19 bp, Homo sapiens
gcagagacggcagccccat

SEQ ID NO: 6264525 - DNA, 22 bp, Homo sapiens
gcagagacggcagccccatcct

SEQ ID NO: 6264526 - DNA, 12 bp, Homo sapiens
gcagagacttgg

SEQ ID NO: 6264527 - DNA, 16 bp, Homo sapiens
gcagagagaagcctgt

SEQ ID NO: 6264528 - DNA, 11 bp, Homo sapiens
gcagagagagc

SEQ ID NO: 6264529 - DNA, 19 bp, Homo sapiens
gcagagagagccagacagc

SEQ ID NO: 6264530 - DNA, 23 bp, Homo sapiens
gcagagagatcttcccataataa

SEQ ID NO: 6264531 - DNA, 13 bp, Homo sapiens
gcagagagcacag

SEQ ID NO: 6264532 - DNA, 15 bp, Homo sapiens
gcagagagcacagcc

SEQ ID NO: 6264533 - DNA, 19 bp, Homo sapiens
gcagagagcacctggtggg

SEQ ID NO: 6264534 - DNA, 19 bp, Homo sapiens
gcagagagccattttgtga

SEQ ID NO: 6264535 - DNA, 14 bp, Homo sapiens
gcagagaggaagtg

SEQ ID NO: 6264536 - DNA, 18 bp, Homo sapiens
gcagagagggatgggttc

SEQ ID NO: 6264537 - DNA, 18 bp, Homo sapiens
gcagagaggggaggtggg

SEQ ID NO: 6264538 - DNA, 21 bp, Homo sapiens
gcagagaggtggagaactggg

SEQ ID NO: 6264539 - DNA, 15 bp, Homo sapiens
gcagagaggtggcca

SEQ ID NO: 6264540 - DNA, 16 bp, Homo sapiens
gcagagaggtggccac

SEQ ID NO: 6264541 - DNA, 17 bp, Homo sapiens
gcagagaggttaacaga

SEQ ID NO: 6264542 - DNA, 21 bp, Homo sapiens
gcagagaggtttcgatattta

SEQ ID NO: 6264543 - DNA, 22 bp, Homo sapiens
gcagagaggtttgcagtcccaa

SEQ ID NO: 6264544 - DNA, 22 bp, Homo sapiens
gcagagagtacagactgcagac

SEQ ID NO: 6264545 - DNA, 17 bp, Homo sapiens
gcagagatcgacagaca

SEQ ID NO: 6264546 - DNA, 20 bp, Homo sapiens
gcagagatcgacagacagcc

SEQ ID NO: 6264547 - DNA, 23 bp, Homo sapiens
gcagagatcgacagacagccagg

SEQ ID NO: 6264548 - DNA, 15 bp, Homo sapiens
gcagagatgcctccc

SEQ ID NO: 6264549 - DNA, 16 bp, Homo sapiens
gcagagatgcctccct

SEQ ID NO: 6264550 - DNA, 16 bp, Homo sapiens
gcagagatgtactgca

SEQ ID NO: 6264551 - DNA, 21 bp, Homo sapiens
gcagagatgtgcccccacccc

SEQ ID NO: 6264552 - DNA, 22 bp, Homo sapiens
gcagagattggaatgggcagct

SEQ ID NO: 6264553 - DNA, 23 bp, Homo sapiens
gcagagatttctcattgactttt

SEQ ID NO: 6264554 - DNA, 19 bp, Homo sapiens
gcagagattttcaacattt

SEQ ID NO: 6264555 - DNA, 17 bp, Homo sapiens
gcagagcaaatgaggga

SEQ ID NO: 6264556 - DNA, 15 bp, Homo sapiens
gcagagcaataacac

SEQ ID NO: 6264557 - DNA, 14 bp, Homo sapiens
gcagagcacacagg

SEQ ID NO: 6264558 - DNA, 16 bp, Homo sapiens
gcagagcacagcccac

SEQ ID NO: 6264559 - DNA, 13 bp, Homo sapiens
gcagagcagacag

SEQ ID NO: 6264560 - DNA, 15 bp, Homo sapiens
gcagagcagacaggc

SEQ ID NO: 6264561 - DNA, 19 bp, Homo sapiens
gcagagcagagaccatccc

SEQ ID NO: 6264562 - DNA, 20 bp, Homo sapiens
gcagagcagagaccatccct

SEQ ID NO: 6264563 - DNA, 14 bp, Homo sapiens
gcagagcagcacaa

SEQ ID NO: 6264564 - DNA, 23 bp, Homo sapiens
gcagagcaggacctgggacagga

SEQ ID NO: 6264565 - DNA, 20 bp, Homo sapiens
gcagagcaggggcagggtga

SEQ ID NO: 6264566 - DNA, 21 bp, Homo sapiens
gcagagcagtgggcctggcca

SEQ ID NO: 6264567 - DNA, 12 bp, Homo sapiens
gcagagccaagg

SEQ ID NO: 6264568 - DNA, 15 bp, Homo sapiens
gcagagccaaggcca

SEQ ID NO: 6264569 - DNA, 15 bp, Homo sapiens
gcagagccaggaaga

SEQ ID NO: 6264570 - DNA, 12 bp, Homo sapiens
gcagagccaggc

SEQ ID NO: 6264571 - DNA, 16 bp, Homo sapiens
gcagagccagggcagg

SEQ ID NO: 6264572 - DNA, 19 bp, Homo sapiens
gcagagccagggcagggcg

SEQ ID NO: 6264573 - DNA, 21 bp, Homo sapiens
gcagagccagggcagggcgag

SEQ ID NO: 6264574 - DNA, 12 bp, Homo sapiens
gctcctctgggc

SEQ ID NO: 6264575 - DNA, 16 bp, Homo sapiens
gctcctctgggcagga

SEQ ID NO: 6264576 - DNA, 17 bp, Homo sapiens
gctcctctgtcctgctt

SEQ ID NO: 6264577 - DNA, 13 bp, Homo sapiens
gctcctctgtctc

SEQ ID NO: 6264578 - DNA, 17 bp, Homo sapiens
gctcctctgtctcgagc

SEQ ID NO: 6264579 - DNA, 22 bp, Homo sapiens
gctcctctgtctcgagcgccct

SEQ ID NO: 6264580 - DNA, 23 bp, Homo sapiens
gctcctctgtctcgagcgccctg

SEQ ID NO: 6264581 - DNA, 20 bp, Homo sapiens
gctcctctgtggtgtctgcc

SEQ ID NO: 6264582 - DNA, 12 bp, Homo sapiens
gctcctctgttt

SEQ ID NO: 6264583 - DNA, 20 bp, Homo sapiens
gctcctcttaccgtagcctc

SEQ ID NO: 6264584 - DNA, 18 bp, Homo sapiens
gctcctcttagctcagct

SEQ ID NO: 6264585 - DNA, 19 bp, Homo sapiens
gctcctcttagctcagctg

SEQ ID NO: 6264586 - DNA, 14 bp, Homo sapiens
gctcctcttcctgc

SEQ ID NO: 6264587 - DNA, 15 bp, Homo sapiens
gctcctctttcccct

SEQ ID NO: 6264588 - DNA, 23 bp, Homo sapiens
gctcctctttcccctcctttgtc

SEQ ID NO: 6264589 - DNA, 15 bp, Homo sapiens
gctcctgaaaaatga

SEQ ID NO: 6264590 - DNA, 23 bp, Homo sapiens
gctcctgaaccagtcctgctgcc

SEQ ID NO: 6264591 - DNA, 19 bp, Homo sapiens
gctcctgaagggtgctcag

SEQ ID NO: 6264592 - DNA, 20 bp, Homo sapiens
gctcctgaatgaggcggagc

SEQ ID NO: 6264593 - DNA, 21 bp, Homo sapiens
gctcctgaatgaggcggagct

SEQ ID NO: 6264594 - DNA, 16 bp, Homo sapiens
gctcctgacactgctg

SEQ ID NO: 6264595 - DNA, 14 bp, Homo sapiens
gctcctgaccaaag

SEQ ID NO: 6264596 - DNA, 19 bp, Homo sapiens
gctcctgaccagttgcagt

SEQ ID NO: 6264597 - DNA, 15 bp, Homo sapiens
gctcctgacctacct

SEQ ID NO: 6264598 - DNA, 15 bp, Homo sapiens
gctcctgaccttggg

SEQ ID NO: 6264599 - DNA, 18 bp, Homo sapiens
gctcctgaggggcatctg

SEQ ID NO: 6264600 - DNA, 15 bp, Homo sapiens
gctcctgagtagctg

SEQ ID NO: 6264601 - DNA, 23 bp, Homo sapiens
gctcctgcaggccacagccacct

SEQ ID NO: 6264602 - DNA, 19 bp, Homo sapiens
gctcctgccaaccacaatt

SEQ ID NO: 6264603 - DNA, 12 bp, Homo sapiens
gctcctgccact

SEQ ID NO: 6264604 - DNA, 13 bp, Homo sapiens
gctcctgcccagc

SEQ ID NO: 6264605 - DNA, 15 bp, Homo sapiens
gctcctgcccagcca

SEQ ID NO: 6264606 - DNA, 15 bp, Homo sapiens
gctcctgcccaggcc

SEQ ID NO: 6264607 - DNA, 16 bp, Homo sapiens
gctcctgcccaggcca

SEQ ID NO: 6264608 - DNA, 15 bp, Homo sapiens
gctcctgcccgccca

SEQ ID NO: 6264609 - DNA, 19 bp, Homo sapiens
gctcctgccgcagacgggc

SEQ ID NO: 6264610 - DNA, 18 bp, Homo sapiens
gctcctgccgcagagctg

SEQ ID NO: 6264611 - DNA, 18 bp, Homo sapiens
gctcctgccttctgtcct

SEQ ID NO: 6264612 - DNA, 13 bp, Homo sapiens
gctcctgccttga

SEQ ID NO: 6264613 - DNA, 13 bp, Homo sapiens
gctcctgctactt

SEQ ID NO: 6264614 - DNA, 14 bp, Homo sapiens
gctcctgctacttc

SEQ ID NO: 6264615 - DNA, 15 bp, Homo sapiens
gctcctgctcattgt

SEQ ID NO: 6264616 - DNA, 19 bp, Homo sapiens
gctcctgctgaccttctgc

SEQ ID NO: 6264617 - DNA, 22 bp, Homo sapiens
gctcctgctgcaccaacccagc

SEQ ID NO: 6264618 - DNA, 13 bp, Homo sapiens
gctcctgctgcgg

SEQ ID NO: 6264619 - DNA, 14 bp, Homo sapiens
gctcctgctgcgga

SEQ ID NO: 6264620 - DNA, 13 bp, Homo sapiens
gctcctgcttccc

SEQ ID NO: 6264621 - DNA, 18 bp, Homo sapiens
gctcctgcttcccctccc

SEQ ID NO: 6264622 - DNA, 21 bp, Homo sapiens
gctcctgcttttggggctctt

SEQ ID NO: 6264623 - DNA, 14 bp, Homo sapiens
gctcctggaacctg

SEQ ID NO: 6264624 - DNA, 22 bp, Homo sapiens
gctcctggaacctggcaggccc

SEQ ID NO: 6264625 - DNA, 19 bp, Homo sapiens
gctcctggactcattgctt

SEQ ID NO: 6264626 - DNA, 11 bp, Homo sapiens
gctcctggagc

SEQ ID NO: 6264627 - DNA, 19 bp, Homo sapiens
gctcctggagccagccacc

SEQ ID NO: 6264628 - DNA, 20 bp, Homo sapiens
gctcctggagccagccaccc

SEQ ID NO: 6264629 - DNA, 22 bp, Homo sapiens
gctcctggcagaagggagcagc

SEQ ID NO: 6264630 - DNA, 14 bp, Homo sapiens
gctcctggcagtga

SEQ ID NO: 6264631 - DNA, 15 bp, Homo sapiens
gctcctggcccactg

SEQ ID NO: 6264632 - DNA, 18 bp, Homo sapiens
gctcctggcccactgcat

SEQ ID NO: 6264633 - DNA, 14 bp, Homo sapiens
gctcctggctgcca

SEQ ID NO: 6264634 - DNA, 22 bp, Homo sapiens
gctcctggctgtgcccagcagg

SEQ ID NO: 6264635 - DNA, 12 bp, Homo sapiens
gctcctggcttt

SEQ ID NO: 6264636 - DNA, 18 bp, Homo sapiens
gctcctgggacccttggc

SEQ ID NO: 6264637 - DNA, 12 bp, Homo sapiens
gctcctgggagg

SEQ ID NO: 6264638 - DNA, 21 bp, Homo sapiens
gctcctgggaggccctggcag

SEQ ID NO: 6264639 - DNA, 17 bp, Homo sapiens
gctcctgggcagcttga

SEQ ID NO: 6264640 - DNA, 13 bp, Homo sapiens
gctcctggggaga

SEQ ID NO: 6264641 - DNA, 15 bp, Homo sapiens
gctcctggggagaaa

SEQ ID NO: 6264642 - DNA, 22 bp, Homo sapiens
gctcctggggagaaagaggggc

SEQ ID NO: 6264643 - DNA, 19 bp, Homo sapiens
gctcctggggagctcctgg

SEQ ID NO: 6264644 - DNA, 20 bp, Homo sapiens
gctcctggggagctcctggg

SEQ ID NO: 6264645 - DNA, 23 bp, Homo sapiens
gctcctgggggttctttcttcct

SEQ ID NO: 6264646 - DNA, 19 bp, Homo sapiens
gctcctgggttggagggaa

SEQ ID NO: 6264647 - DNA, 20 bp, Homo sapiens
gctcctgggttggagggaac

SEQ ID NO: 6264648 - DNA, 22 bp, Homo sapiens
gctcctggtatgggtttctccc

SEQ ID NO: 6264649 - DNA, 21 bp, Homo sapiens
gctcctggtcacctaggaagc

SEQ ID NO: 6264650 - DNA, 19 bp, Homo sapiens
gctcctggtcttgagatgt

SEQ ID NO: 6264651 - DNA, 16 bp, Homo sapiens
gctcctggtggggcag

SEQ ID NO: 6264652 - DNA, 17 bp, Homo sapiens
gctcctggtggggcaga

SEQ ID NO: 6264653 - DNA, 19 bp, Homo sapiens
gctcctgtacttgtcctca

SEQ ID NO: 6264654 - DNA, 22 bp, Homo sapiens
gctcctgtacttgtcctcagct

SEQ ID NO: 6264655 - DNA, 16 bp, Homo sapiens
gctcctgtccctaccc

SEQ ID NO: 6264656 - DNA, 13 bp, Homo sapiens
gctcctgtctcca

SEQ ID NO: 6264657 - DNA, 20 bp, Homo sapiens
gctcctgtctgccagccagc

SEQ ID NO: 6264658 - DNA, 21 bp, Homo sapiens
gctcctgtctgccagccagca

SEQ ID NO: 6264659 - DNA, 15 bp, Homo sapiens
gctcctgtgccctta

SEQ ID NO: 6264660 - DNA, 19 bp, Homo sapiens
gctcctgtggcagctgccc

SEQ ID NO: 6264661 - DNA, 14 bp, Homo sapiens
gctcctgtggcagg

SEQ ID NO: 6264662 - DNA, 15 bp, Homo sapiens
gctcctgtggcagga

SEQ ID NO: 6264663 - DNA, 17 bp, Homo sapiens
gctcctgtggcaggagg

SEQ ID NO: 6264664 - DNA, 13 bp, Homo sapiens
gctcctgtggccc

SEQ ID NO: 6264665 - DNA, 15 bp, Homo sapiens
gctcctgtggcccca

SEQ ID NO: 6264666 - DNA, 12 bp, Homo sapiens
gctcctgtgtct

SEQ ID NO: 6264667 - DNA, 17 bp, Homo sapiens
gctcctgttagctcctc

SEQ ID NO: 6264668 - DNA, 18 bp, Homo sapiens
gctcctgttagctcctca

SEQ ID NO: 6264669 - DNA, 15 bp, Homo sapiens
gctccttaaggctct

SEQ ID NO: 6264670 - DNA, 15 bp, Homo sapiens
gctccttagctgcca

SEQ ID NO: 6264671 - DNA, 16 bp, Homo sapiens
gctccttagctgccaa

SEQ ID NO: 6264672 - DNA, 21 bp, Homo sapiens
gctccttagggttttctctct

SEQ ID NO: 6264673 - DNA, 13 bp, Homo sapiens
gctccttcactgt

SEQ ID NO: 6264674 - DNA, 16 bp, Homo sapiens
gctccttcactgttcc

SEQ ID NO: 6264675 - DNA, 17 bp, Homo sapiens
gctccttcactgttccc

SEQ ID NO: 6264676 - DNA, 15 bp, Homo sapiens
gctccttcagttctg

SEQ ID NO: 6264677 - DNA, 22 bp, Homo sapiens
gctccttcagttctgcttgctc

SEQ ID NO: 6264678 - DNA, 17 bp, Homo sapiens
gctccttcccaggaccc

SEQ ID NO: 6264679 - DNA, 13 bp, Homo sapiens
gctccttcccatc

SEQ ID NO: 6264680 - DNA, 12 bp, Homo sapiens
gctccttcccct

SEQ ID NO: 6264681 - DNA, 19 bp, Homo sapiens
gctccttcccctgcacctg

SEQ ID NO: 6264682 - DNA, 15 bp, Homo sapiens
gctccttccctaggc

SEQ ID NO: 6264683 - DNA, 19 bp, Homo sapiens
gctccttcccttgctacca

SEQ ID NO: 6264684 - DNA, 18 bp, Homo sapiens
gctccttcctctgaggct

SEQ ID NO: 6264685 - DNA, 20 bp, Homo sapiens
gctccttcctctgaggctga

SEQ ID NO: 6264686 - DNA, 14 bp, Homo sapiens
gctccttcctggag

SEQ ID NO: 6264687 - DNA, 23 bp, Homo sapiens
gctccttcctggagactgcccag

SEQ ID NO: 6264688 - DNA, 14 bp, Homo sapiens
gctccttcctgtgg

SEQ ID NO: 6264689 - DNA, 21 bp, Homo sapiens
gctccttctctagtttcccct

SEQ ID NO: 6264690 - DNA, 12 bp, Homo sapiens
gctccttctggc

SEQ ID NO: 6264691 - DNA, 21 bp, Homo sapiens
gctccttctgtcctactctgt

SEQ ID NO: 6264692 - DNA, 23 bp, Homo sapiens
gctccttgaagacatatcatgtg

SEQ ID NO: 6264693 - DNA, 15 bp, Homo sapiens
gctccttgactcctt

SEQ ID NO: 6264694 - DNA, 15 bp, Homo sapiens
gctccttgattgcct

SEQ ID NO: 6264695 - DNA, 22 bp, Homo sapiens
gctccttgcaaactatgagttc

SEQ ID NO: 6264696 - DNA, 11 bp, Homo sapiens
gctccttgctg

SEQ ID NO: 6264697 - DNA, 14 bp, Homo sapiens
gctccttgctgcat

SEQ ID NO: 6264698 - DNA, 20 bp, Homo sapiens
gctccttggcacccccatgc

SEQ ID NO: 6264699 - DNA, 22 bp, Homo sapiens
gctccttggcacccccatgctg

SEQ ID NO: 6264700 - DNA, 20 bp, Homo sapiens
gctccttggcggacactggg

SEQ ID NO: 6264701 - DNA, 19 bp, Homo sapiens
gctccttggcttacctgac

SEQ ID NO: 6264702 - DNA, 19 bp, Homo sapiens
gctccttgggaggaagcag

SEQ ID NO: 6264703 - DNA, 23 bp, Homo sapiens
gctccttgggaggaagcagaata

SEQ ID NO: 6264704 - DNA, 22 bp, Homo sapiens
gctccttggggcagggcctggg

SEQ ID NO: 6264705 - DNA, 16 bp, Homo sapiens
gctccttgggtcctgc

SEQ ID NO: 6264706 - DNA, 17 bp, Homo sapiens
gctccttgtgggcctgg

SEQ ID NO: 6264707 - DNA, 21 bp, Homo sapiens
gctccttgtgggcctgggctc

SEQ ID NO: 6264708 - DNA, 22 bp, Homo sapiens
gctccttgtgggcctgggctcc

SEQ ID NO: 6264709 - DNA, 13 bp, Homo sapiens
gctcctttcccac

SEQ ID NO: 6264710 - DNA, 15 bp, Homo sapiens
gctcctttcccacag

SEQ ID NO: 6264711 - DNA, 16 bp, Homo sapiens
gctcctttcccacagt

SEQ ID NO: 6264712 - DNA, 17 bp, Homo sapiens
gctcctttcccctctca

SEQ ID NO: 6264713 - DNA, 15 bp, Homo sapiens
gctcctttccctgga

SEQ ID NO: 6264714 - DNA, 14 bp, Homo sapiens
gctcctttctccag

SEQ ID NO: 6264715 - DNA, 16 bp, Homo sapiens
gctcctttctccagcc

SEQ ID NO: 6264716 - DNA, 19 bp, Homo sapiens
gctcctttctccagccagc

SEQ ID NO: 6264717 - DNA, 14 bp, Homo sapiens
gctcctttctcctg

SEQ ID NO: 6264718 - DNA, 19 bp, Homo sapiens
gctcctttctcctgtgaat

SEQ ID NO: 6264719 - DNA, 12 bp, Homo sapiens
gctcctttctga

SEQ ID NO: 6264720 - DNA, 21 bp, Homo sapiens
gctcctttctgtcctggagct

SEQ ID NO: 6264721 - DNA, 13 bp, Homo sapiens
gctcctttgtgtg

SEQ ID NO: 6264722 - DNA, 19 bp, Homo sapiens
gctcctttgtgtgtgtgtc

SEQ ID NO: 6264723 - DNA, 21 bp, Homo sapiens
gctccttttctgtgaagccct

SEQ ID NO: 6264724 - DNA, 19 bp, Homo sapiens
gctccttttgtatcttcct

SEQ ID NO: 6264725 - DNA, 23 bp, Homo sapiens
gctccttttgtatcttcctttct

SEQ ID NO: 6264726 - DNA, 22 bp, Homo sapiens
gctccttttgtccccagggccc

SEQ ID NO: 6264727 - DNA, 15 bp, Homo sapiens
gctcgaagaaaataa

SEQ ID NO: 6264728 - DNA, 15 bp, Homo sapiens
gctcgaatctctgtg

SEQ ID NO: 6264729 - DNA, 17 bp, Homo sapiens
gctcgagcagtcctgcc

SEQ ID NO: 6264730 - DNA, 17 bp, Homo sapiens
gctcgagcatgcctgga

SEQ ID NO: 6264731 - DNA, 15 bp, Homo sapiens
gctcgaggctggtgc

SEQ ID NO: 6264732 - DNA, 16 bp, Homo sapiens
gctcgaggctggtgcc

SEQ ID NO: 6264733 - DNA, 20 bp, Homo sapiens
gctcgatccaaattgtgctt

SEQ ID NO: 6264734 - DNA, 17 bp, Homo sapiens
gctcgatgcagacaggg

SEQ ID NO: 6264735 - DNA, 15 bp, Homo sapiens
gctcgatgcctttgc

SEQ ID NO: 6264736 - DNA, 18 bp, Homo sapiens
gctcgatgcctttgctgt

SEQ ID NO: 6264737 - DNA, 20 bp, Homo sapiens
gctcgatgtggtcacagctg

SEQ ID NO: 6264738 - DNA, 13 bp, Homo sapiens
gctcgcaccccca

SEQ ID NO: 6264739 - DNA, 16 bp, Homo sapiens
gctcgcacccccctgt

SEQ ID NO: 6264740 - DNA, 13 bp, Homo sapiens
gctcgcactgccc

SEQ ID NO: 6264741 - DNA, 14 bp, Homo sapiens
gctcgcactgccca

SEQ ID NO: 6264742 - DNA, 14 bp, Homo sapiens
gctcgcagcctggc

SEQ ID NO: 6264743 - DNA, 22 bp, Homo sapiens
gctcgccaaccgcatctgctca

SEQ ID NO: 6264744 - DNA, 23 bp, Homo sapiens
gctcgccaaccgcatctgctcat

SEQ ID NO: 6264745 - DNA, 13 bp, Homo sapiens
gctcgccaaggcc

SEQ ID NO: 6264746 - DNA, 16 bp, Homo sapiens
gctcgccacagtgggc

SEQ ID NO: 6264747 - DNA, 14 bp, Homo sapiens
gctcgccacgctca

SEQ ID NO: 6264748 - DNA, 21 bp, Homo sapiens
gctcgccacgctcagtgcccg

SEQ ID NO: 6264749 - DNA, 22 bp, Homo sapiens
gctcgccatcaaggtccagtgg

SEQ ID NO: 6264750 - DNA, 17 bp, Homo sapiens
gctcgccattcactgat

SEQ ID NO: 6264751 - DNA, 23 bp, Homo sapiens
gctcgcccagacaccatgtgcaa

SEQ ID NO: 6264752 - DNA, 23 bp, Homo sapiens
gctcgcccatacccgtgacagtg

SEQ ID NO: 6264753 - DNA, 22 bp, Homo sapiens
gcagagccatccaccctgagga

SEQ ID NO: 6264754 - DNA, 23 bp, Homo sapiens
gcagagccatccaccctgaggag

SEQ ID NO: 6264755 - DNA, 12 bp, Homo sapiens
gcagagccatgg

SEQ ID NO: 6264756 - DNA, 15 bp, Homo sapiens
gcagagccatgggcc

SEQ ID NO: 6264757 - DNA, 19 bp, Homo sapiens
gcagagccatgggcctggg

SEQ ID NO: 6264758 - DNA, 16 bp, Homo sapiens
gcagagcccaagggaa

SEQ ID NO: 6264759 - DNA, 15 bp, Homo sapiens
gcagagcccaccagc

SEQ ID NO: 6264760 - DNA, 20 bp, Homo sapiens
gcagagcccaccagccagcc

SEQ ID NO: 6264761 - DNA, 21 bp, Homo sapiens
gcagagcccaccagccagccc

SEQ ID NO: 6264762 - DNA, 22 bp, Homo sapiens
gcagagcccaccagccagccct

SEQ ID NO: 6264763 - DNA, 18 bp, Homo sapiens
gcagagccccggagcacc

SEQ ID NO: 6264764 - DNA, 19 bp, Homo sapiens
gcagagccccggagcacca

SEQ ID NO: 6264765 - DNA, 22 bp, Homo sapiens
gcagagcccgcccacctgggcc

SEQ ID NO: 6264766 - DNA, 16 bp, Homo sapiens
gcagagccctccaggc

SEQ ID NO: 6264767 - DNA, 19 bp, Homo sapiens
gcagagccctccaggcctg

SEQ ID NO: 6264768 - DNA, 20 bp, Homo sapiens
gcagagccctccaggcctgc

SEQ ID NO: 6264769 - DNA, 22 bp, Homo sapiens
gcagagccctccaggcctgcag

SEQ ID NO: 6264770 - DNA, 16 bp, Homo sapiens
gcagagccctgctccc

SEQ ID NO: 6264771 - DNA, 18 bp, Homo sapiens
gcagagccgttcctggga

SEQ ID NO: 6264772 - DNA, 19 bp, Homo sapiens
gcagagccgttcctgggac

SEQ ID NO: 6264773 - DNA, 12 bp, Homo sapiens
gcagagcctcct

SEQ ID NO: 6264774 - DNA, 12 bp, Homo sapiens
gcagagcctggg

SEQ ID NO: 6264775 - DNA, 15 bp, Homo sapiens
gcagagcctggggtg

SEQ ID NO: 6264776 - DNA, 11 bp, Homo sapiens
gcagagcctgt

SEQ ID NO: 6264777 - DNA, 13 bp, Homo sapiens
gcagagcctgtcc

SEQ ID NO: 6264778 - DNA, 14 bp, Homo sapiens
gcagagccttctca

SEQ ID NO: 6264779 - DNA, 21 bp, Homo sapiens
gcagagccttttacccctgca

SEQ ID NO: 6264780 - DNA, 15 bp, Homo sapiens
gcagagcgcagcccc

SEQ ID NO: 6264781 - DNA, 14 bp, Homo sapiens
gcagagcggggagg

SEQ ID NO: 6264782 - DNA, 17 bp, Homo sapiens
gcagagcggggaggtgc

SEQ ID NO: 6264783 - DNA, 20 bp, Homo sapiens
gcagagcggggaggtgcctg

SEQ ID NO: 6264784 - DNA, 22 bp, Homo sapiens
gcagagcggggaggtgcctgag

SEQ ID NO: 6264785 - DNA, 13 bp, Homo sapiens
gcagagctcagag

SEQ ID NO: 6264786 - DNA, 21 bp, Homo sapiens
gcagagctcagaggagtctgg

SEQ ID NO: 6264787 - DNA, 22 bp, Homo sapiens
gcagagctcagaggagtctggg

SEQ ID NO: 6264788 - DNA, 17 bp, Homo sapiens
gcagagctcagcacagc

SEQ ID NO: 6264789 - DNA, 13 bp, Homo sapiens
gcagagctgacgg

SEQ ID NO: 6264790 - DNA, 22 bp, Homo sapiens
gcagagctgacgggaggcccca

SEQ ID NO: 6264791 - DNA, 15 bp, Homo sapiens
gcagagctgagggcc

SEQ ID NO: 6264792 - DNA, 17 bp, Homo sapiens
gcagagctgagggccct

SEQ ID NO: 6264793 - DNA, 19 bp, Homo sapiens
gcagagctgagggccctgt

SEQ ID NO: 6264794 - DNA, 19 bp, Homo sapiens
gcagagctgatggagaagg

SEQ ID NO: 6264795 - DNA, 22 bp, Homo sapiens
gcagagctgatggagaaggaag

SEQ ID NO: 6264796 - DNA, 23 bp, Homo sapiens
gcagagctgatggagaaggaagg

SEQ ID NO: 6264797 - DNA, 19 bp, Homo sapiens
gcagagctgcgggctgggt

SEQ ID NO: 6264798 - DNA, 17 bp, Homo sapiens
gcagagctggctctgag

SEQ ID NO: 6264799 - DNA, 22 bp, Homo sapiens
gcagagctggggctgccagcct

SEQ ID NO: 6264800 - DNA, 17 bp, Homo sapiens
gcagagctggggggaag

SEQ ID NO: 6264801 - DNA, 21 bp, Homo sapiens
gcagagctggtgcggctggcc

SEQ ID NO: 6264802 - DNA, 12 bp, Homo sapiens
gcagagcttctc

SEQ ID NO: 6264803 - DNA, 16 bp, Homo sapiens
gcagagcttctcctga

SEQ ID NO: 6264804 - DNA, 19 bp, Homo sapiens
gcagagcttctcctgacca

SEQ ID NO: 6264805 - DNA, 23 bp, Homo sapiens
gcagagcttctcctgaccagggc

SEQ ID NO: 6264806 - DNA, 18 bp, Homo sapiens
gcagagcttgtagccctg

SEQ ID NO: 6264807 - DNA, 21 bp, Homo sapiens
gcagagcttgtagccctggat

SEQ ID NO: 6264808 - DNA, 18 bp, Homo sapiens
gcagaggaaagcaaagga

SEQ ID NO: 6264809 - DNA, 20 bp, Homo sapiens
gcagaggaaagcaaaggaga

SEQ ID NO: 6264810 - DNA, 22 bp, Homo sapiens
gcagaggaatgtgggctatgta

SEQ ID NO: 6264811 - DNA, 17 bp, Homo sapiens
gcagaggaattatgaac

SEQ ID NO: 6264812 - DNA, 21 bp, Homo sapiens
gcagaggacagtctggagaag

SEQ ID NO: 6264813 - DNA, 13 bp, Homo sapiens
gcagaggaccaca

SEQ ID NO: 6264814 - DNA, 14 bp, Homo sapiens
gcagaggaccaggg

SEQ ID NO: 6264815 - DNA, 14 bp, Homo sapiens
gcagaggacgcacg

SEQ ID NO: 6264816 - DNA, 13 bp, Homo sapiens
gcagaggagccca

SEQ ID NO: 6264817 - DNA, 19 bp, Homo sapiens
gcagaggatagtaatgaaa

SEQ ID NO: 6264818 - DNA, 16 bp, Homo sapiens
gcagaggcaaggatgg

SEQ ID NO: 6264819 - DNA, 12 bp, Homo sapiens
gcagaggcagaa

SEQ ID NO: 6264820 - DNA, 13 bp, Homo sapiens
gcagaggcagaat

SEQ ID NO: 6264821 - DNA, 11 bp, Homo sapiens
gcagaggcagc

SEQ ID NO: 6264822 - DNA, 11 bp, Homo sapiens
gcagaggcagg

SEQ ID NO: 6264823 - DNA, 16 bp, Homo sapiens
gcagaggcaggctggg

SEQ ID NO: 6264824 - DNA, 21 bp, Homo sapiens
gcagaggcaggctgggacgga

SEQ ID NO: 6264825 - DNA, 20 bp, Homo sapiens
gcagaggcagggccctgggg

SEQ ID NO: 6264826 - DNA, 21 bp, Homo sapiens
gcagaggcagtacctgggcaa

SEQ ID NO: 6264827 - DNA, 15 bp, Homo sapiens
gcagaggccagaggc

SEQ ID NO: 6264828 - DNA, 14 bp, Homo sapiens
gcagaggcccacat

SEQ ID NO: 6264829 - DNA, 14 bp, Homo sapiens
gcagaggcccgagg

SEQ ID NO: 6264830 - DNA, 11 bp, Homo sapiens
gcagaggcctg

SEQ ID NO: 6264831 - DNA, 18 bp, Homo sapiens
gcagaggcctgaggagtg

SEQ ID NO: 6264832 - DNA, 19 bp, Homo sapiens
gcagaggcctgcagggcct

SEQ ID NO: 6264833 - DNA, 23 bp, Homo sapiens
gcagaggcctgcagggcctctgt

SEQ ID NO: 6264834 - DNA, 14 bp, Homo sapiens
gcagaggcctgggc

SEQ ID NO: 6264835 - DNA, 17 bp, Homo sapiens
gcagaggcctgggctgg

SEQ ID NO: 6264836 - DNA, 20 bp, Homo sapiens
gcagaggcctgggctgggaa

SEQ ID NO: 6264837 - DNA, 20 bp, Homo sapiens
gcagaggcggaaaccttgca

SEQ ID NO: 6264838 - DNA, 16 bp, Homo sapiens
gcagaggcggctctgg

SEQ ID NO: 6264839 - DNA, 20 bp, Homo sapiens
gcagaggcgtactacccagc

SEQ ID NO: 6264840 - DNA, 12 bp, Homo sapiens
gcagaggctggc

SEQ ID NO: 6264841 - DNA, 14 bp, Homo sapiens
gcagaggctggcac

SEQ ID NO: 6264842 - DNA, 21 bp, Homo sapiens
gcagaggcttccgtgtcctct

SEQ ID NO: 6264843 - DNA, 17 bp, Homo sapiens
gcagagggaatgttccc

SEQ ID NO: 6264844 - DNA, 21 bp, Homo sapiens
gcagagggaatgttccctgca

SEQ ID NO: 6264845 - DNA, 12 bp, Homo sapiens
gcagagggacca

SEQ ID NO: 6264846 - DNA, 14 bp, Homo sapiens
gcagagggaggaag

SEQ ID NO: 6264847 - DNA, 16 bp, Homo sapiens
gcagagggcaggggtg

SEQ ID NO: 6264848 - DNA, 18 bp, Homo sapiens
gcagagggcatcggggcc

SEQ ID NO: 6264849 - DNA, 16 bp, Homo sapiens
gcagagggcgccacca

SEQ ID NO: 6264850 - DNA, 14 bp, Homo sapiens
gcagagggctggag

SEQ ID NO: 6264851 - DNA, 17 bp, Homo sapiens
gcagagggctggaggcc

SEQ ID NO: 6264852 - DNA, 21 bp, Homo sapiens
gcagagggctggaggcccagg

SEQ ID NO: 6264853 - DNA, 24 bp, Homo sapiens
gcagagggctggaggcccaggctg

SEQ ID NO: 6264854 - DNA, 13 bp, Homo sapiens
gcagaggggacag

SEQ ID NO: 6264855 - DNA, 19 bp, Homo sapiens
gcagaggggcagatggaaa

SEQ ID NO: 6264856 - DNA, 18 bp, Homo sapiens
gcagaggggcagccgcta

SEQ ID NO: 6264857 - DNA, 21 bp, Homo sapiens
gcagaggggcagccgctagga

SEQ ID NO: 6264858 - DNA, 13 bp, Homo sapiens
gcagaggggcagg

SEQ ID NO: 6264859 - DNA, 18 bp, Homo sapiens
gcagaggggcaggccctg

SEQ ID NO: 6264860 - DNA, 14 bp, Homo sapiens
gcagaggggccagg

SEQ ID NO: 6264861 - DNA, 15 bp, Homo sapiens
gcagaggggccaggc

SEQ ID NO: 6264862 - DNA, 20 bp, Homo sapiens
gcagaggggccaggcccagg

SEQ ID NO: 6264863 - DNA, 17 bp, Homo sapiens
gcagaggggcgttctcc

SEQ ID NO: 6264864 - DNA, 23 bp, Homo sapiens
gcagaggggcgttctcccaaaga

SEQ ID NO: 6264865 - DNA, 12 bp, Homo sapiens
gcagaggggctt

SEQ ID NO: 6264866 - DNA, 19 bp, Homo sapiens
gcagaggggctttctggag

SEQ ID NO: 6264867 - DNA, 18 bp, Homo sapiens
gcagagggggagtagcca

SEQ ID NO: 6264868 - DNA, 19 bp, Homo sapiens
gcagaggggtaagagagga

SEQ ID NO: 6264869 - DNA, 19 bp, Homo sapiens
gcagaggggtaggcagagc

SEQ ID NO: 6264870 - DNA, 14 bp, Homo sapiens
gcagaggtaccctg

SEQ ID NO: 6264871 - DNA, 16 bp, Homo sapiens
gcagaggtaccctggg

SEQ ID NO: 6264872 - DNA, 16 bp, Homo sapiens
gcagaggtcccagccc

SEQ ID NO: 6264873 - DNA, 18 bp, Homo sapiens
gcagaggtcccagcccca

SEQ ID NO: 6264874 - DNA, 19 bp, Homo sapiens
gcagaggtcccagccccag

SEQ ID NO: 6264875 - DNA, 23 bp, Homo sapiens
gcagaggtcccagccccaggcct

SEQ ID NO: 6264876 - DNA, 19 bp, Homo sapiens
gcagaggtcttcagggctc

SEQ ID NO: 6264877 - DNA, 19 bp, Homo sapiens
gcagaggtggaaaatgatc

SEQ ID NO: 6264878 - DNA, 14 bp, Homo sapiens
gcagaggtggggtg

SEQ ID NO: 6264879 - DNA, 14 bp, Homo sapiens
gcagaggtggtctg

SEQ ID NO: 6264880 - DNA, 23 bp, Homo sapiens
gcagaggttgcagtgagccgaga

SEQ ID NO: 6264881 - DNA, 22 bp, Homo sapiens
gcagaggttgcagtgagtcaag

SEQ ID NO: 6264882 - DNA, 20 bp, Homo sapiens
gcagaggttttaatgtctgt

SEQ ID NO: 6264883 - DNA, 19 bp, Homo sapiens
gcagagtaaaattacagaa

SEQ ID NO: 6264884 - DNA, 21 bp, Homo sapiens
gcagagtaaaattacagaaga

SEQ ID NO: 6264885 - DNA, 18 bp, Homo sapiens
gcagagtaaattgctctg

SEQ ID NO: 6264886 - DNA, 22 bp, Homo sapiens
gcagagtaggggtctgtctttt

SEQ ID NO: 6264887 - DNA, 14 bp, Homo sapiens
gcagagtcacacgg

SEQ ID NO: 6264888 - DNA, 23 bp, Homo sapiens
gcagagtcacacgggggcagctg

SEQ ID NO: 6264889 - DNA, 22 bp, Homo sapiens
gcagagtcagccattcctgttc

SEQ ID NO: 6264890 - DNA, 22 bp, Homo sapiens
gcagagtcctgcacagttttct

SEQ ID NO: 6264891 - DNA, 14 bp, Homo sapiens
gcagagtcctggag

SEQ ID NO: 6264892 - DNA, 20 bp, Homo sapiens
gcagagtcgttggagactga

SEQ ID NO: 6264893 - DNA, 16 bp, Homo sapiens
gcagagtctgggcctc

SEQ ID NO: 6264894 - DNA, 16 bp, Homo sapiens
gcagagtctgtctctt

SEQ ID NO: 6264895 - DNA, 12 bp, Homo sapiens
gcagagtgagga

SEQ ID NO: 6264896 - DNA, 22 bp, Homo sapiens
gcagagtgattcaggggctccc

SEQ ID NO: 6264897 - DNA, 16 bp, Homo sapiens
gcagagtgcacagctg

SEQ ID NO: 6264898 - DNA, 14 bp, Homo sapiens
gcagagtgccccac

SEQ ID NO: 6264899 - DNA, 21 bp, Homo sapiens
gcagagtgccccacctgccac

SEQ ID NO: 6264900 - DNA, 17 bp, Homo sapiens
gcagagtggactgcatt

SEQ ID NO: 6264901 - DNA, 20 bp, Homo sapiens
gcagagtggagcccagggtg

SEQ ID NO: 6264902 - DNA, 16 bp, Homo sapiens
gcagagtggcctgtga

SEQ ID NO: 6264903 - DNA, 18 bp, Homo sapiens
gcagagtggcctgtgagc

SEQ ID NO: 6264904 - DNA, 20 bp, Homo sapiens
gcagagtggcgtggcctccc

SEQ ID NO: 6264905 - DNA, 22 bp, Homo sapiens
gcagagtgggacttggagagca

SEQ ID NO: 6264906 - DNA, 21 bp, Homo sapiens
gcagagttaaatctcaaatag

SEQ ID NO: 6264907 - DNA, 21 bp, Homo sapiens
gcagagttacagttctgtggt

SEQ ID NO: 6264908 - DNA, 15 bp, Homo sapiens
gcagagttacttgat

SEQ ID NO: 6264909 - DNA, 21 bp, Homo sapiens
gcagagttctcctggaggcag

SEQ ID NO: 6264910 - DNA, 17 bp, Homo sapiens
gcagagttctgtgaaga

SEQ ID NO: 6264911 - DNA, 14 bp, Homo sapiens
gcagagttctttgc

SEQ ID NO: 6264912 - DNA, 17 bp, Homo sapiens
gcagagttgaagacaga

SEQ ID NO: 6264913 - DNA, 14 bp, Homo sapiens
gcagagttgtaaat

SEQ ID NO: 6264914 - DNA, 20 bp, Homo sapiens
gcagagttgtaaatatataa

SEQ ID NO: 6264915 - DNA, 22 bp, Homo sapiens
gcagataaaatgccagtctcat

SEQ ID NO: 6264916 - DNA, 16 bp, Homo sapiens
gcagataaatacattt

SEQ ID NO: 6264917 - DNA, 17 bp, Homo sapiens
gcagataaatacattta

SEQ ID NO: 6264918 - DNA, 21 bp, Homo sapiens
gcagataacaatgcagcaagg

SEQ ID NO: 6264919 - DNA, 16 bp, Homo sapiens
gcagataactggttac

SEQ ID NO: 6264920 - DNA, 16 bp, Homo sapiens
gcagataaggccgagc

SEQ ID NO: 6264921 - DNA, 18 bp, Homo sapiens
gcagataagttggagcag

SEQ ID NO: 6264922 - DNA, 21 bp, Homo sapiens
gcagataagttggagcagggg

SEQ ID NO: 6264923 - DNA, 17 bp, Homo sapiens
gcagataatcagcctct

SEQ ID NO: 6264924 - DNA, 24 bp, Homo sapiens
gcagatactactgaccagacaagc

SEQ ID NO: 6264925 - DNA, 16 bp, Homo sapiens
gcagatactgctgtgt

SEQ ID NO: 6264926 - DNA, 18 bp, Homo sapiens
gcagatactgctgtgtaa

SEQ ID NO: 6264927 - DNA, 20 bp, Homo sapiens
gcagatagaatttggcccag

SEQ ID NO: 6264928 - DNA, 19 bp, Homo sapiens
gcagatagccagacacatg

SEQ ID NO: 6264929 - DNA, 13 bp, Homo sapiens
gcagatagcccag

SEQ ID NO: 6264930 - DNA, 15 bp, Homo sapiens
gctcgccccacccag

SEQ ID NO: 6264931 - DNA, 17 bp, Homo sapiens
gctcgccccacccaggg

SEQ ID NO: 6264932 - DNA, 21 bp, Homo sapiens
gctcgccccacctccacctgt

SEQ ID NO: 6264933 - DNA, 23 bp, Homo sapiens
gctcgcccctcccctcagcctgc

SEQ ID NO: 6264934 - DNA, 19 bp, Homo sapiens
gctcgccctcctttctgtg

SEQ ID NO: 6264935 - DNA, 16 bp, Homo sapiens
gctcgccctgtgccct

SEQ ID NO: 6264936 - DNA, 20 bp, Homo sapiens
gctcgccctgtgccctctca

SEQ ID NO: 6264937 - DNA, 16 bp, Homo sapiens
gctcgccgtgtctcag

SEQ ID NO: 6264938 - DNA, 18 bp, Homo sapiens
gctcgccgtgtctcagcc

SEQ ID NO: 6264939 - DNA, 17 bp, Homo sapiens
gctcgccttccctcctg

SEQ ID NO: 6264940 - DNA, 20 bp, Homo sapiens
gctcgcgaaggtcccacagc

SEQ ID NO: 6264941 - DNA, 14 bp, Homo sapiens
gctcgcgggcagcg

SEQ ID NO: 6264942 - DNA, 17 bp, Homo sapiens
gctcgcgggcagcgggc

SEQ ID NO: 6264943 - DNA, 22 bp, Homo sapiens
gctcgcgggcagcgggccaggc

SEQ ID NO: 6264944 - DNA, 15 bp, Homo sapiens
gctcgcggggcagca

SEQ ID NO: 6264945 - DNA, 13 bp, Homo sapiens
gctcgctccctgc

SEQ ID NO: 6264946 - DNA, 16 bp, Homo sapiens
gctcgctccctgtagc

SEQ ID NO: 6264947 - DNA, 21 bp, Homo sapiens
gctcgctccctgtagctctgc

SEQ ID NO: 6264948 - DNA, 22 bp, Homo sapiens
gctcgctccctgtagctctgcc

SEQ ID NO: 6264949 - DNA, 23 bp, Homo sapiens
gctcgctccctgtagctctgcct

SEQ ID NO: 6264950 - DNA, 15 bp, Homo sapiens
gctcgctctctcgta

SEQ ID NO: 6264951 - DNA, 16 bp, Homo sapiens
gctcgctgcccaggga

SEQ ID NO: 6264952 - DNA, 17 bp, Homo sapiens
gctcgctggctttctct

SEQ ID NO: 6264953 - DNA, 13 bp, Homo sapiens
gctcgctgttgct

SEQ ID NO: 6264954 - DNA, 14 bp, Homo sapiens
gctcgctgttgctg

SEQ ID NO: 6264955 - DNA, 16 bp, Homo sapiens
gctcgctgttgctgaa

SEQ ID NO: 6264956 - DNA, 16 bp, Homo sapiens
gctcgcttctcctcca

SEQ ID NO: 6264957 - DNA, 13 bp, Homo sapiens
gctcggacacagt

SEQ ID NO: 6264958 - DNA, 15 bp, Homo sapiens
gctcggacccacccc

SEQ ID NO: 6264959 - DNA, 16 bp, Homo sapiens
gctcggacccacccca

SEQ ID NO: 6264960 - DNA, 17 bp, Homo sapiens
gctcggacccaccccaa

SEQ ID NO: 6264961 - DNA, 23 bp, Homo sapiens
gctcggagaagagcgcagtgttt

SEQ ID NO: 6264962 - DNA, 15 bp, Homo sapiens
gctcggagcaccctt

SEQ ID NO: 6264963 - DNA, 21 bp, Homo sapiens
gctcggaggccccaaaggaaa

SEQ ID NO: 6264964 - DNA, 16 bp, Homo sapiens
gctcggaggctgcccc

SEQ ID NO: 6264965 - DNA, 22 bp, Homo sapiens
gctcggccaggcacggaggctc

SEQ ID NO: 6264966 - DNA, 18 bp, Homo sapiens
gctcggcccggagcagca

SEQ ID NO: 6264967 - DNA, 23 bp, Homo sapiens
gctcggcccggagcagcaggaag

SEQ ID NO: 6264968 - DNA, 13 bp, Homo sapiens
gctcggcgcccac

SEQ ID NO: 6264969 - DNA, 23 bp, Homo sapiens
gctcggcgcccccacccctggct

SEQ ID NO: 6264970 - DNA, 13 bp, Homo sapiens
gctcggctactgg

SEQ ID NO: 6264971 - DNA, 17 bp, Homo sapiens
gctcgggcgctgtggct

SEQ ID NO: 6264972 - DNA, 14 bp, Homo sapiens
gctcggggacaggt

SEQ ID NO: 6264973 - DNA, 17 bp, Homo sapiens
gctcggggaggcagaga

SEQ ID NO: 6264974 - DNA, 16 bp, Homo sapiens
gctcggggctccccac

SEQ ID NO: 6264975 - DNA, 17 bp, Homo sapiens
gctcggggctccccacg

SEQ ID NO: 6264976 - DNA, 13 bp, Homo sapiens
gctcggggctggg

SEQ ID NO: 6264977 - DNA, 16 bp, Homo sapiens
gctcggggggctctgc

SEQ ID NO: 6264978 - DNA, 18 bp, Homo sapiens
gctcggggtaaaaagtgg

SEQ ID NO: 6264979 - DNA, 18 bp, Homo sapiens
gctcgggtgcccaggacg

SEQ ID NO: 6264980 - DNA, 24 bp, Homo sapiens
gctcggtacccggggcccagggca

SEQ ID NO: 6264981 - DNA, 12 bp, Homo sapiens
gctcggtgagtg

SEQ ID NO: 6264982 - DNA, 22 bp, Homo sapiens
gctcgtaaatattccctgacga

SEQ ID NO: 6264983 - DNA, 16 bp, Homo sapiens
gctcgtcagccacctg

SEQ ID NO: 6264984 - DNA, 19 bp, Homo sapiens
gctcgtcagccacctggga

SEQ ID NO: 6264985 - DNA, 13 bp, Homo sapiens
gctcgtggccttc

SEQ ID NO: 6264986 - DNA, 15 bp, Homo sapiens
gctcgtggccttccc

SEQ ID NO: 6264987 - DNA, 13 bp, Homo sapiens
gctcgtgggctct

SEQ ID NO: 6264988 - DNA, 17 bp, Homo sapiens
gctcgtgggctctggct

SEQ ID NO: 6264989 - DNA, 19 bp, Homo sapiens
gctcgtgtatcctggggct

SEQ ID NO: 6264990 - DNA, 13 bp, Homo sapiens
gctcgttccccca

SEQ ID NO: 6264991 - DNA, 19 bp, Homo sapiens
gctcgtttacactgcacat

SEQ ID NO: 6264992 - DNA, 21 bp, Homo sapiens
gctcgtttttcagcaccccca

SEQ ID NO: 6264993 - DNA, 13 bp, Homo sapiens
gctctaaaacaga

SEQ ID NO: 6264994 - DNA, 17 bp, Homo sapiens
gctctaaaacatagact

SEQ ID NO: 6264995 - DNA, 22 bp, Homo sapiens
gctctaaaacatagactgaaga

SEQ ID NO: 6264996 - DNA, 15 bp, Homo sapiens
gctctaaagcagaga

SEQ ID NO: 6264997 - DNA, 20 bp, Homo sapiens
gctctaaagtagcaactgct

SEQ ID NO: 6264998 - DNA, 13 bp, Homo sapiens
gctctaaataaag

SEQ ID NO: 6264999 - DNA, 17 bp, Homo sapiens
gctctaacgcctgagcc

SEQ ID NO: 6265000 - DNA, 21 bp, Homo sapiens
gctctaacgcctgagcccagg

SEQ ID NO: 6265001 - DNA, 17 bp, Homo sapiens
gctctaactgattcagg

SEQ ID NO: 6265002 - DNA, 20 bp, Homo sapiens
gctctaactggacatgaagg

SEQ ID NO: 6265003 - DNA, 23 bp, Homo sapiens
gctctaactggacatgaaggaaa

SEQ ID NO: 6265004 - DNA, 21 bp, Homo sapiens
gctctaagcagccaggaggga

SEQ ID NO: 6265005 - DNA, 19 bp, Homo sapiens
gctctaataagtttgtgtt

SEQ ID NO: 6265006 - DNA, 18 bp, Homo sapiens
gctctaatgtttgcatat

SEQ ID NO: 6265007 - DNA, 15 bp, Homo sapiens
gctctaattcacagt

SEQ ID NO: 6265008 - DNA, 16 bp, Homo sapiens
gctctaattcacagtg

SEQ ID NO: 6265009 - DNA, 18 bp, Homo sapiens
gctctacacaacatgtat

SEQ ID NO: 6265010 - DNA, 20 bp, Homo sapiens
gctctacagctaatcagcat

SEQ ID NO: 6265011 - DNA, 22 bp, Homo sapiens
gctctacaggcctgcagcccct

SEQ ID NO: 6265012 - DNA, 20 bp, Homo sapiens
gctctacatcttctgcctta

SEQ ID NO: 6265013 - DNA, 16 bp, Homo sapiens
gctctacattctgctc

SEQ ID NO: 6265014 - DNA, 19 bp, Homo sapiens
gctctacattctgctctgc

SEQ ID NO: 6265015 - DNA, 19 bp, Homo sapiens
gctctacccagggcctgca

SEQ ID NO: 6265016 - DNA, 13 bp, Homo sapiens
gctctacccatga

SEQ ID NO: 6265017 - DNA, 15 bp, Homo sapiens
gctctacccatgagc

SEQ ID NO: 6265018 - DNA, 20 bp, Homo sapiens
gctctacccatgagcctgcc

SEQ ID NO: 6265019 - DNA, 19 bp, Homo sapiens
gctctaccctgcagcttgg

SEQ ID NO: 6265020 - DNA, 13 bp, Homo sapiens
gctctaccctgct

SEQ ID NO: 6265021 - DNA, 15 bp, Homo sapiens
gctctaccctgctcc

SEQ ID NO: 6265022 - DNA, 16 bp, Homo sapiens
gctctaccctgtctgt

SEQ ID NO: 6265023 - DNA, 18 bp, Homo sapiens
gctctaccctgtctgtcc

SEQ ID NO: 6265024 - DNA, 11 bp, Homo sapiens
gctctacctct

SEQ ID NO: 6265025 - DNA, 18 bp, Homo sapiens
gctctaccttcctgtccc

SEQ ID NO: 6265026 - DNA, 21 bp, Homo sapiens
gctctaccttcctgtccctga

SEQ ID NO: 6265027 - DNA, 16 bp, Homo sapiens
gctctactgccctccc

SEQ ID NO: 6265028 - DNA, 22 bp, Homo sapiens
gctctacttccccatggccctg

SEQ ID NO: 6265029 - DNA, 13 bp, Homo sapiens
gctctactttata

SEQ ID NO: 6265030 - DNA, 16 bp, Homo sapiens
gctctagataaaactt

SEQ ID NO: 6265031 - DNA, 14 bp, Homo sapiens
gctctagatgagct

SEQ ID NO: 6265032 - DNA, 20 bp, Homo sapiens
gctctagccaggagtctgtg

SEQ ID NO: 6265033 - DNA, 21 bp, Homo sapiens
gctctagcctctggactggaa

SEQ ID NO: 6265034 - DNA, 15 bp, Homo sapiens
gctctagctggcagg

SEQ ID NO: 6265035 - DNA, 16 bp, Homo sapiens
gctctagctggcagga

SEQ ID NO: 6265036 - DNA, 20 bp, Homo sapiens
gctctagctggcaggacaca

SEQ ID NO: 6265037 - DNA, 16 bp, Homo sapiens
gctctaggacccccag

SEQ ID NO: 6265038 - DNA, 12 bp, Homo sapiens
gctctaggatgg

SEQ ID NO: 6265039 - DNA, 23 bp, Homo sapiens
gctctaggatggggcacggctct

SEQ ID NO: 6265040 - DNA, 19 bp, Homo sapiens
gctctaggctgttctgtag

SEQ ID NO: 6265041 - DNA, 21 bp, Homo sapiens
gctctagggaagcagtgcgtg

SEQ ID NO: 6265042 - DNA, 20 bp, Homo sapiens
gctctagggaatctggatta

SEQ ID NO: 6265043 - DNA, 23 bp, Homo sapiens
gctctagggactgccaggctgtt

SEQ ID NO: 6265044 - DNA, 19 bp, Homo sapiens
gctctagggttgctggagc

SEQ ID NO: 6265045 - DNA, 21 bp, Homo sapiens
gctctagggttgctggagcct

SEQ ID NO: 6265046 - DNA, 22 bp, Homo sapiens
gctctagggttgctggagcctg

SEQ ID NO: 6265047 - DNA, 23 bp, Homo sapiens
gctctagggttgctggagcctga

SEQ ID NO: 6265048 - DNA, 16 bp, Homo sapiens
gctctaggtttcttga

SEQ ID NO: 6265049 - DNA, 23 bp, Homo sapiens
gctctagtcttgctttgctgtct

SEQ ID NO: 6265050 - DNA, 15 bp, Homo sapiens
gctctagtgccttct

SEQ ID NO: 6265051 - DNA, 21 bp, Homo sapiens
gctctagtgggacagcccaga

SEQ ID NO: 6265052 - DNA, 13 bp, Homo sapiens
gctctagttcaaa

SEQ ID NO: 6265053 - DNA, 14 bp, Homo sapiens
gctctatactgtgg

SEQ ID NO: 6265054 - DNA, 17 bp, Homo sapiens
gctctatactgtggcct

SEQ ID NO: 6265055 - DNA, 21 bp, Homo sapiens
gctctatactgtggcctgcag

SEQ ID NO: 6265056 - DNA, 17 bp, Homo sapiens
gctctatctgctgggct

SEQ ID NO: 6265057 - DNA, 19 bp, Homo sapiens
gctctatcttgctctgtaa

SEQ ID NO: 6265058 - DNA, 22 bp, Homo sapiens
gctctatcttgctctgtaatct

SEQ ID NO: 6265059 - DNA, 11 bp, Homo sapiens
gctctatgcca

SEQ ID NO: 6265060 - DNA, 17 bp, Homo sapiens
gctctatgccaggctgt

SEQ ID NO: 6265061 - DNA, 18 bp, Homo sapiens
gctctatgccaggctgtg

SEQ ID NO: 6265062 - DNA, 19 bp, Homo sapiens
gctctatgccaggctgtgc

SEQ ID NO: 6265063 - DNA, 21 bp, Homo sapiens
gctctatgccaggctgtgcta

SEQ ID NO: 6265064 - DNA, 15 bp, Homo sapiens
gctctatgtctgcct

SEQ ID NO: 6265065 - DNA, 18 bp, Homo sapiens
gctctatgtgggaaaaaa

SEQ ID NO: 6265066 - DNA, 23 bp, Homo sapiens
gctctatgtgggaaaaaagaaat

SEQ ID NO: 6265067 - DNA, 20 bp, Homo sapiens
gctctatgtttgtatttgga

SEQ ID NO: 6265068 - DNA, 12 bp, Homo sapiens
gctctattaaga

SEQ ID NO: 6265069 - DNA, 22 bp, Homo sapiens
gctctattaagattggaaatgt

SEQ ID NO: 6265070 - DNA, 21 bp, Homo sapiens
gctctattatataaactttat

SEQ ID NO: 6265071 - DNA, 16 bp, Homo sapiens
gctctattatgaatgt

SEQ ID NO: 6265072 - DNA, 14 bp, Homo sapiens
gctctattgagcca

SEQ ID NO: 6265073 - DNA, 18 bp, Homo sapiens
gctctatttcggaaatac

SEQ ID NO: 6265074 - DNA, 22 bp, Homo sapiens
gctctatttcggaaatacacta

SEQ ID NO: 6265075 - DNA, 19 bp, Homo sapiens
gctctcaacccaggagcat

SEQ ID NO: 6265076 - DNA, 23 bp, Homo sapiens
gctctcaagtcaaggaagctggg

SEQ ID NO: 6265077 - DNA, 14 bp, Homo sapiens
gctctcaagtgaaa

SEQ ID NO: 6265078 - DNA, 18 bp, Homo sapiens
gctctcaagttatcaggg

SEQ ID NO: 6265079 - DNA, 16 bp, Homo sapiens
gctctcaatatataat

SEQ ID NO: 6265080 - DNA, 13 bp, Homo sapiens
gctctcacagaca

SEQ ID NO: 6265081 - DNA, 13 bp, Homo sapiens
gctctcacagata

SEQ ID NO: 6265082 - DNA, 16 bp, Homo sapiens
gctctcacccagtccc

SEQ ID NO: 6265083 - DNA, 23 bp, Homo sapiens
gctctcacccagtccccacccgc

SEQ ID NO: 6265084 - DNA, 19 bp, Homo sapiens
gctctcacccataataaag

SEQ ID NO: 6265085 - DNA, 12 bp, Homo sapiens
gctctcacctct

SEQ ID NO: 6265086 - DNA, 17 bp, Homo sapiens
gctctcacctggccctg

SEQ ID NO: 6265087 - DNA, 18 bp, Homo sapiens
gctctcactagttgtcag

SEQ ID NO: 6265088 - DNA, 16 bp, Homo sapiens
gctctcagagcagcag

SEQ ID NO: 6265089 - DNA, 14 bp, Homo sapiens
gctctcagaggaaa

SEQ ID NO: 6265090 - DNA, 19 bp, Homo sapiens
gctctcagcaagtgcccag

SEQ ID NO: 6265091 - DNA, 21 bp, Homo sapiens
gctctcagcaagtgcccagtg

SEQ ID NO: 6265092 - DNA, 22 bp, Homo sapiens
gctctcagcaagtgcccagtgg

SEQ ID NO: 6265093 - DNA, 23 bp, Homo sapiens
gctctcagcaagtgcccagtgga

SEQ ID NO: 6265094 - DNA, 11 bp, Homo sapiens
gctctcagcca

SEQ ID NO: 6265095 - DNA, 17 bp, Homo sapiens
gctctcagcctcccaac

SEQ ID NO: 6265096 - DNA, 23 bp, Homo sapiens
gctctcagcctcccaaccccagg

SEQ ID NO: 6265097 - DNA, 18 bp, Homo sapiens
gctctcagctcagcgcca

SEQ ID NO: 6265098 - DNA, 14 bp, Homo sapiens
gctctcagctccgg

SEQ ID NO: 6265099 - DNA, 14 bp, Homo sapiens
gctctcagcttgtg

SEQ ID NO: 6265100 - DNA, 17 bp, Homo sapiens
gctctcagcttgtgcct

SEQ ID NO: 6265101 - DNA, 13 bp, Homo sapiens
gctctcagctttc

SEQ ID NO: 6265102 - DNA, 17 bp, Homo sapiens
gctctcaggaccagaga

SEQ ID NO: 6265103 - DNA, 18 bp, Homo sapiens
gctctcaggccagctgct

SEQ ID NO: 6265104 - DNA, 19 bp, Homo sapiens
gctctcaggccagctgctt

SEQ ID NO: 6265105 - DNA, 21 bp, Homo sapiens
gctctcaggccagctgcttgg

SEQ ID NO: 6265106 - DNA, 19 bp, Homo sapiens
gctctcaggccgagagcct

SEQ ID NO: 6265107 - DNA, 12 bp, Homo sapiens
gctctcaggctg

SEQ ID NO: 6265108 - DNA, 14 bp, Homo sapiens
gcagatagcccagg

SEQ ID NO: 6265109 - DNA, 19 bp, Homo sapiens
gcagatatagcattaataa

SEQ ID NO: 6265110 - DNA, 20 bp, Homo sapiens
gcagatatagcattaataaa

SEQ ID NO: 6265111 - DNA, 21 bp, Homo sapiens
gcagatatagcattaataaaa

SEQ ID NO: 6265112 - DNA, 18 bp, Homo sapiens
gcagatatctgcatgtgt

SEQ ID NO: 6265113 - DNA, 18 bp, Homo sapiens
gcagatatgtattacttt

SEQ ID NO: 6265114 - DNA, 21 bp, Homo sapiens
gcagatcaacagacctaagaa

SEQ ID NO: 6265115 - DNA, 14 bp, Homo sapiens
gcagatcacctgag

SEQ ID NO: 6265116 - DNA, 19 bp, Homo sapiens
gcagatcatgtaaggaagg

SEQ ID NO: 6265117 - DNA, 16 bp, Homo sapiens
gcagatccacctgcac

SEQ ID NO: 6265118 - DNA, 21 bp, Homo sapiens
gcagatccacctgcacaaaca

SEQ ID NO: 6265119 - DNA, 18 bp, Homo sapiens
gcagatcccagcccaccc

SEQ ID NO: 6265120 - DNA, 22 bp, Homo sapiens
gcagatcgtgccgtggagcttg

SEQ ID NO: 6265121 - DNA, 17 bp, Homo sapiens
gcagatctagccaggcc

SEQ ID NO: 6265122 - DNA, 17 bp, Homo sapiens
gcagatctcatgtcctc

SEQ ID NO: 6265123 - DNA, 13 bp, Homo sapiens
gcagatctgtgcc

SEQ ID NO: 6265124 - DNA, 22 bp, Homo sapiens
gcagatctgtgccccatgcctg

SEQ ID NO: 6265125 - DNA, 16 bp, Homo sapiens
gcagatctgtgcctgg

SEQ ID NO: 6265126 - DNA, 15 bp, Homo sapiens
gcagatctttaaata

SEQ ID NO: 6265127 - DNA, 16 bp, Homo sapiens
gcagatcttttcttta

SEQ ID NO: 6265128 - DNA, 15 bp, Homo sapiens
gcagatctttttgtg

SEQ ID NO: 6265129 - DNA, 23 bp, Homo sapiens
gcagatctttttgtgaaattcaa

SEQ ID NO: 6265130 - DNA, 15 bp, Homo sapiens
gcagatgaaaagcta

SEQ ID NO: 6265131 - DNA, 21 bp, Homo sapiens
gcagatgacaagatggtacaa

SEQ ID NO: 6265132 - DNA, 22 bp, Homo sapiens
gcagatgacacgcgctctccac

SEQ ID NO: 6265133 - DNA, 15 bp, Homo sapiens
gcagatgacccctcc

SEQ ID NO: 6265134 - DNA, 16 bp, Homo sapiens
gcagatgacccctccc

SEQ ID NO: 6265135 - DNA, 17 bp, Homo sapiens
gcagatgactgagaaca

SEQ ID NO: 6265136 - DNA, 14 bp, Homo sapiens
gcagatgaggggcc

SEQ ID NO: 6265137 - DNA, 16 bp, Homo sapiens
gcagatgagtgtgtgt

SEQ ID NO: 6265138 - DNA, 21 bp, Homo sapiens
gcagatgataaaaggaatctg

SEQ ID NO: 6265139 - DNA, 16 bp, Homo sapiens
gcagatgcaaagaggc

SEQ ID NO: 6265140 - DNA, 16 bp, Homo sapiens
gcagatgcacatgttg

SEQ ID NO: 6265141 - DNA, 15 bp, Homo sapiens
gcagatgcagagagc

SEQ ID NO: 6265142 - DNA, 17 bp, Homo sapiens
gcagatgcagagagcca

SEQ ID NO: 6265143 - DNA, 15 bp, Homo sapiens
gcagatgcagctctt

SEQ ID NO: 6265144 - DNA, 13 bp, Homo sapiens
gcagatgccaaaa

SEQ ID NO: 6265145 - DNA, 16 bp, Homo sapiens
gcagatgccaccctag

SEQ ID NO: 6265146 - DNA, 14 bp, Homo sapiens
gcagatgccagtga

SEQ ID NO: 6265147 - DNA, 11 bp, Homo sapiens
gcagatgctgc

SEQ ID NO: 6265148 - DNA, 17 bp, Homo sapiens
gcagatgctgctgaaga

SEQ ID NO: 6265149 - DNA, 23 bp, Homo sapiens
gcagatgctgctgaagagaggtg

SEQ ID NO: 6265150 - DNA, 17 bp, Homo sapiens
gcagatggaaaggagcc

SEQ ID NO: 6265151 - DNA, 22 bp, Homo sapiens
gcagatggaatgctgtgttaaa

SEQ ID NO: 6265152 - DNA, 19 bp, Homo sapiens
gcagatggccactgctctt

SEQ ID NO: 6265153 - DNA, 14 bp, Homo sapiens
gcagatgggggcct

SEQ ID NO: 6265154 - DNA, 17 bp, Homo sapiens
gcagatggtactgctga

SEQ ID NO: 6265155 - DNA, 20 bp, Homo sapiens
gcagatggtactgctgaggt

SEQ ID NO: 6265156 - DNA, 13 bp, Homo sapiens
gcagatgtaggag

SEQ ID NO: 6265157 - DNA, 19 bp, Homo sapiens
gcagatgtaggagggactg

SEQ ID NO: 6265158 - DNA, 18 bp, Homo sapiens
gcagatgtattgactgta

SEQ ID NO: 6265159 - DNA, 15 bp, Homo sapiens
gcagatgtcccccac

SEQ ID NO: 6265160 - DNA, 19 bp, Homo sapiens
gcagatgtcttccctgggc

SEQ ID NO: 6265161 - DNA, 20 bp, Homo sapiens
gcagatgtcttccctgggct

SEQ ID NO: 6265162 - DNA, 22 bp, Homo sapiens
gcagatgtcttccctgggctgc

SEQ ID NO: 6265163 - DNA, 17 bp, Homo sapiens
gcagatgtgagccaccg

SEQ ID NO: 6265164 - DNA, 22 bp, Homo sapiens
gcagatgtgagccaccgtgcct

SEQ ID NO: 6265165 - DNA, 14 bp, Homo sapiens
gcagatgtttaatg

SEQ ID NO: 6265166 - DNA, 16 bp, Homo sapiens
gcagatgtttgcctca

SEQ ID NO: 6265167 - DNA, 18 bp, Homo sapiens
gcagatgttttgggggaa

SEQ ID NO: 6265168 - DNA, 16 bp, Homo sapiens
gcagattagcaggcca

SEQ ID NO: 6265169 - DNA, 20 bp, Homo sapiens
gcagattcatttttctttct

SEQ ID NO: 6265170 - DNA, 13 bp, Homo sapiens
gcagattcctggg

SEQ ID NO: 6265171 - DNA, 14 bp, Homo sapiens
gcagattcctgggc

SEQ ID NO: 6265172 - DNA, 16 bp, Homo sapiens
gcagattcctgggcct

SEQ ID NO: 6265173 - DNA, 19 bp, Homo sapiens
gcagattcggaccactagg

SEQ ID NO: 6265174 - DNA, 14 bp, Homo sapiens
gcagattctatttc

SEQ ID NO: 6265175 - DNA, 19 bp, Homo sapiens
gcagattctcccttgctct

SEQ ID NO: 6265176 - DNA, 17 bp, Homo sapiens
gcagattgagacctaca

SEQ ID NO: 6265177 - DNA, 20 bp, Homo sapiens
gcagattggaaggagacaca

SEQ ID NO: 6265178 - DNA, 14 bp, Homo sapiens
gcagattggagaaa

SEQ ID NO: 6265179 - DNA, 18 bp, Homo sapiens
gcagattgggctggctct

SEQ ID NO: 6265180 - DNA, 20 bp, Homo sapiens
gcagattggttcatgcctgg

SEQ ID NO: 6265181 - DNA, 20 bp, Homo sapiens
gcagatttagtgaaagctag

SEQ ID NO: 6265182 - DNA, 23 bp, Homo sapiens
gcagatttcagatgtaagaagcc

SEQ ID NO: 6265183 - DNA, 14 bp, Homo sapiens
gcagatttctcacc

SEQ ID NO: 6265184 - DNA, 19 bp, Homo sapiens
gcagatttctctttagcct

SEQ ID NO: 6265185 - DNA, 19 bp, Homo sapiens
gcagatttctgccttgaaa

SEQ ID NO: 6265186 - DNA, 16 bp, Homo sapiens
gcagatttgggctgga

SEQ ID NO: 6265187 - DNA, 23 bp, Homo sapiens
gcagatttgtggggacctcagcc

SEQ ID NO: 6265188 - DNA, 16 bp, Homo sapiens
gcagattttacaaaag

SEQ ID NO: 6265189 - DNA, 21 bp, Homo sapiens
gcagattttcagcaaactctt

SEQ ID NO: 6265190 - DNA, 17 bp, Homo sapiens
gcagattttcctaaggc

SEQ ID NO: 6265191 - DNA, 16 bp, Homo sapiens
gcagattttggccatg

SEQ ID NO: 6265192 - DNA, 14 bp, Homo sapiens
gcagcaaaaatata

SEQ ID NO: 6265193 - DNA, 15 bp, Homo sapiens
gcagcaaaaatataa

SEQ ID NO: 6265194 - DNA, 16 bp, Homo sapiens
gcagcaaaaatataaa

SEQ ID NO: 6265195 - DNA, 18 bp, Homo sapiens
gcagcaaaaatataaaat

SEQ ID NO: 6265196 - DNA, 19 bp, Homo sapiens
gcagcaaaaatataaaata

SEQ ID NO: 6265197 - DNA, 18 bp, Homo sapiens
gcagcaaaaccaaactgg

SEQ ID NO: 6265198 - DNA, 13 bp, Homo sapiens
gcagcaaaatcct

SEQ ID NO: 6265199 - DNA, 16 bp, Homo sapiens
gcagcaaaatccttac

SEQ ID NO: 6265200 - DNA, 23 bp, Homo sapiens
gcagcaaaatccttacttccagc

SEQ ID NO: 6265201 - DNA, 21 bp, Homo sapiens
gcagcaaagaggggcgctgtc

SEQ ID NO: 6265202 - DNA, 24 bp, Homo sapiens
gcagcaaagaggggcgctgtcctg

SEQ ID NO: 6265203 - DNA, 23 bp, Homo sapiens
gcagcaaatgccactctgggcag

SEQ ID NO: 6265204 - DNA, 14 bp, Homo sapiens
gcagcaaattttca

SEQ ID NO: 6265205 - DNA, 14 bp, Homo sapiens
gcagcaacacacat

SEQ ID NO: 6265206 - DNA, 21 bp, Homo sapiens
gcagcaacacccaagtccacc

SEQ ID NO: 6265207 - DNA, 15 bp, Homo sapiens
gcagcaacaggacca

SEQ ID NO: 6265208 - DNA, 16 bp, Homo sapiens
gcagcaaccagagcac

SEQ ID NO: 6265209 - DNA, 13 bp, Homo sapiens
gcagcaactccca

SEQ ID NO: 6265210 - DNA, 13 bp, Homo sapiens
gcagcaactgaaa

SEQ ID NO: 6265211 - DNA, 17 bp, Homo sapiens
gcagcaactgaagacaa

SEQ ID NO: 6265212 - DNA, 20 bp, Homo sapiens
gcagcaagaaaaaaaaatgc

SEQ ID NO: 6265213 - DNA, 22 bp, Homo sapiens
gcagcaaggcccgagcagctga

SEQ ID NO: 6265214 - DNA, 17 bp, Homo sapiens
gcagcaaggccctgctg

SEQ ID NO: 6265215 - DNA, 19 bp, Homo sapiens
gcagcaaggccctgctgcc

SEQ ID NO: 6265216 - DNA, 16 bp, Homo sapiens
gcagcaaggccttggt

SEQ ID NO: 6265217 - DNA, 11 bp, Homo sapiens
gcagcaaggct

SEQ ID NO: 6265218 - DNA, 13 bp, Homo sapiens
gcagcaaggctgc

SEQ ID NO: 6265219 - DNA, 14 bp, Homo sapiens
gcagcaagggacct

SEQ ID NO: 6265220 - DNA, 16 bp, Homo sapiens
gcagcaataaagcagc

SEQ ID NO: 6265221 - DNA, 17 bp, Homo sapiens
gcagcaataatttctgt

SEQ ID NO: 6265222 - DNA, 16 bp, Homo sapiens
gcagcaatattttgta

SEQ ID NO: 6265223 - DNA, 13 bp, Homo sapiens
gcagcacaaggaa

SEQ ID NO: 6265224 - DNA, 18 bp, Homo sapiens
gcagcacaagtgtaatga

SEQ ID NO: 6265225 - DNA, 13 bp, Homo sapiens
gcagcacaattct

SEQ ID NO: 6265226 - DNA, 17 bp, Homo sapiens
gcagcacaattctgtcc

SEQ ID NO: 6265227 - DNA, 22 bp, Homo sapiens
gcagcacagcaaggaggctggc

SEQ ID NO: 6265228 - DNA, 17 bp, Homo sapiens
gcagcacagcccagggc

SEQ ID NO: 6265229 - DNA, 20 bp, Homo sapiens
gcagcacagcccagggcctg

SEQ ID NO: 6265230 - DNA, 20 bp, Homo sapiens
gcagcacagctactcagatc

SEQ ID NO: 6265231 - DNA, 15 bp, Homo sapiens
gcagcacagctgaga

SEQ ID NO: 6265232 - DNA, 22 bp, Homo sapiens
gcagcacatggtgttgtatact

SEQ ID NO: 6265233 - DNA, 20 bp, Homo sapiens
gcagcacattgccctgaggg

SEQ ID NO: 6265234 - DNA, 15 bp, Homo sapiens
gcagcaccacactgg

SEQ ID NO: 6265235 - DNA, 16 bp, Homo sapiens
gcagcaccacactggg

SEQ ID NO: 6265236 - DNA, 19 bp, Homo sapiens
gcagcaccagcctgagcca

SEQ ID NO: 6265237 - DNA, 23 bp, Homo sapiens
gcagcaccagcctgagccacagt

SEQ ID NO: 6265238 - DNA, 19 bp, Homo sapiens
gcagcacccacccatgcac

SEQ ID NO: 6265239 - DNA, 14 bp, Homo sapiens
gcagcacccactca

SEQ ID NO: 6265240 - DNA, 15 bp, Homo sapiens
gcagcacccactcag

SEQ ID NO: 6265241 - DNA, 17 bp, Homo sapiens
gcagcacccactcagcc

SEQ ID NO: 6265242 - DNA, 21 bp, Homo sapiens
gcagcacccaggttttgcact

SEQ ID NO: 6265243 - DNA, 17 bp, Homo sapiens
gcagcaccctataaatc

SEQ ID NO: 6265244 - DNA, 23 bp, Homo sapiens
gcagcacctcacctgagacctcc

SEQ ID NO: 6265245 - DNA, 13 bp, Homo sapiens
gcagcacctccgg

SEQ ID NO: 6265246 - DNA, 15 bp, Homo sapiens
gcagcacctccggga

SEQ ID NO: 6265247 - DNA, 12 bp, Homo sapiens
gcagcacctcct

SEQ ID NO: 6265248 - DNA, 12 bp, Homo sapiens
gcagcacctctg

SEQ ID NO: 6265249 - DNA, 13 bp, Homo sapiens
gcagcacctgccc

SEQ ID NO: 6265250 - DNA, 17 bp, Homo sapiens
gcagcacctgtcacctt

SEQ ID NO: 6265251 - DNA, 15 bp, Homo sapiens
gcagcacctttctct

SEQ ID NO: 6265252 - DNA, 19 bp, Homo sapiens
gcagcacctttctctgaga

SEQ ID NO: 6265253 - DNA, 20 bp, Homo sapiens
gcagcacgcatgtccctcca

SEQ ID NO: 6265254 - DNA, 15 bp, Homo sapiens
gcagcacgccaaccc

SEQ ID NO: 6265255 - DNA, 20 bp, Homo sapiens
gcagcacgccaaccccagca

SEQ ID NO: 6265256 - DNA, 21 bp, Homo sapiens
gcagcacgccaaccccagcag

SEQ ID NO: 6265257 - DNA, 15 bp, Homo sapiens
gcagcacgcctctcc

SEQ ID NO: 6265258 - DNA, 17 bp, Homo sapiens
gcagcacgcctctcccc

SEQ ID NO: 6265259 - DNA, 20 bp, Homo sapiens
gcagcacgcctctccccacc

SEQ ID NO: 6265260 - DNA, 15 bp, Homo sapiens
gcagcacggacaata

SEQ ID NO: 6265261 - DNA, 18 bp, Homo sapiens
gcagcacggacaataaac

SEQ ID NO: 6265262 - DNA, 19 bp, Homo sapiens
gcagcacggacaataaacc

SEQ ID NO: 6265263 - DNA, 15 bp, Homo sapiens
gcagcacggcccggc

SEQ ID NO: 6265264 - DNA, 13 bp, Homo sapiens
gcagcactcccca

SEQ ID NO: 6265265 - DNA, 16 bp, Homo sapiens
gcagcactccccagag

SEQ ID NO: 6265266 - DNA, 19 bp, Homo sapiens
gcagcactcccgctgcaca

SEQ ID NO: 6265267 - DNA, 22 bp, Homo sapiens
gcagcactcccgctgcacacag

SEQ ID NO: 6265268 - DNA, 16 bp, Homo sapiens
gcagcactgctgcctc

SEQ ID NO: 6265269 - DNA, 18 bp, Homo sapiens
gcagcactttaaccctct

SEQ ID NO: 6265270 - DNA, 12 bp, Homo sapiens
gcagcagagagc

SEQ ID NO: 6265271 - DNA, 16 bp, Homo sapiens
gcagcagagagccctg

SEQ ID NO: 6265272 - DNA, 13 bp, Homo sapiens
gcagcagagcctg

SEQ ID NO: 6265273 - DNA, 18 bp, Homo sapiens
gcagcagagcctggaaga

SEQ ID NO: 6265274 - DNA, 11 bp, Homo sapiens
gcagcagagga

SEQ ID NO: 6265275 - DNA, 22 bp, Homo sapiens
gcagcagaggacagtctggaga

SEQ ID NO: 6265276 - DNA, 15 bp, Homo sapiens
gcagcagaggcactg

SEQ ID NO: 6265277 - DNA, 16 bp, Homo sapiens
gcagcagaggcaggac

SEQ ID NO: 6265278 - DNA, 17 bp, Homo sapiens
gcagcagaggcaggacc

SEQ ID NO: 6265279 - DNA, 19 bp, Homo sapiens
gcagcagaggcaggaccag

SEQ ID NO: 6265280 - DNA, 13 bp, Homo sapiens
gcagcagaggtga

SEQ ID NO: 6265281 - DNA, 14 bp, Homo sapiens
gcagcagataactt

SEQ ID NO: 6265282 - DNA, 18 bp, Homo sapiens
gcagcagataactttttt

SEQ ID NO: 6265283 - DNA, 13 bp, Homo sapiens
gcagcagcacctt

SEQ ID NO: 6265284 - DNA, 14 bp, Homo sapiens
gcagcagcagccct

SEQ ID NO: 6265285 - DNA, 15 bp, Homo sapiens
gcagcagcagccctg

SEQ ID NO: 6265286 - DNA, 17 bp, Homo sapiens
gcagcagcatcccagcc

SEQ ID NO: 6265287 - DNA, 18 bp, Homo sapiens
gcagcagcatcccagcct

SEQ ID NO: 6265288 - DNA, 18 bp, Homo sapiens
gctctcaggctgagggag

SEQ ID NO: 6265289 - DNA, 20 bp, Homo sapiens
gctctcaggggccagtgagg

SEQ ID NO: 6265290 - DNA, 21 bp, Homo sapiens
gctctcaggggccagtgaggg

SEQ ID NO: 6265291 - DNA, 13 bp, Homo sapiens
gctctcatagctc

SEQ ID NO: 6265292 - DNA, 15 bp, Homo sapiens
gctctcatagctcat

SEQ ID NO: 6265293 - DNA, 14 bp, Homo sapiens
gctctcatctgagg

SEQ ID NO: 6265294 - DNA, 22 bp, Homo sapiens
gctctcatctgaggcatccagc

SEQ ID NO: 6265295 - DNA, 14 bp, Homo sapiens
gctctcatgaagcc

SEQ ID NO: 6265296 - DNA, 13 bp, Homo sapiens
gctctcatgcctg

SEQ ID NO: 6265297 - DNA, 16 bp, Homo sapiens
gctctcatgcctgcct

SEQ ID NO: 6265298 - DNA, 20 bp, Homo sapiens
gctctcatggtacttcctct

SEQ ID NO: 6265299 - DNA, 13 bp, Homo sapiens
gctctcatgtctc

SEQ ID NO: 6265300 - DNA, 20 bp, Homo sapiens
gctctccaaaggggctgctg

SEQ ID NO: 6265301 - DNA, 22 bp, Homo sapiens
gctctccaaaggggctgctggg

SEQ ID NO: 6265302 - DNA, 13 bp, Homo sapiens
gctctccaagtgc

SEQ ID NO: 6265303 - DNA, 19 bp, Homo sapiens
gctctccaagtgccagagg

SEQ ID NO: 6265304 - DNA, 20 bp, Homo sapiens
gctctccaagtgccagaggt

SEQ ID NO: 6265305 - DNA, 19 bp, Homo sapiens
gctctccacctcagccttg

SEQ ID NO: 6265306 - DNA, 14 bp, Homo sapiens
gctctccagacctg

SEQ ID NO: 6265307 - DNA, 18 bp, Homo sapiens
gctctccagacctgagct

SEQ ID NO: 6265308 - DNA, 18 bp, Homo sapiens
gctctccagcctgggagg

SEQ ID NO: 6265309 - DNA, 15 bp, Homo sapiens
gctctccagctccaa

SEQ ID NO: 6265310 - DNA, 11 bp, Homo sapiens
gctctccaggc

SEQ ID NO: 6265311 - DNA, 15 bp, Homo sapiens
gctctccaggccagg

SEQ ID NO: 6265312 - DNA, 17 bp, Homo sapiens
gctctccaggccaggtg

SEQ ID NO: 6265313 - DNA, 20 bp, Homo sapiens
gctctccattctgctccttc

SEQ ID NO: 6265314 - DNA, 21 bp, Homo sapiens
gctctcccacatcccactgga

SEQ ID NO: 6265315 - DNA, 12 bp, Homo sapiens
gctctcccaccc

SEQ ID NO: 6265316 - DNA, 16 bp, Homo sapiens
gctctccccctgcagc

SEQ ID NO: 6265317 - DNA, 20 bp, Homo sapiens
gctctccccctgcagccgtg

SEQ ID NO: 6265318 - DNA, 23 bp, Homo sapiens
gctctcccccttggatttgaact

SEQ ID NO: 6265319 - DNA, 18 bp, Homo sapiens
gctctccccggcaggcct

SEQ ID NO: 6265320 - DNA, 20 bp, Homo sapiens
gctctcccctcccttgtcct

SEQ ID NO: 6265321 - DNA, 16 bp, Homo sapiens
gctctcccctcctgct

SEQ ID NO: 6265322 - DNA, 18 bp, Homo sapiens
gctctcccctcctgctgg

SEQ ID NO: 6265323 - DNA, 22 bp, Homo sapiens
gctctcccctctcgccccatcc

SEQ ID NO: 6265324 - DNA, 14 bp, Homo sapiens
gctctcccctgcgc

SEQ ID NO: 6265325 - DNA, 17 bp, Homo sapiens
gctctcccctgcgcagg

SEQ ID NO: 6265326 - DNA, 19 bp, Homo sapiens
gctctcccctgcgcaggcc

SEQ ID NO: 6265327 - DNA, 19 bp, Homo sapiens
gctctccctaccttgcctc

SEQ ID NO: 6265328 - DNA, 11 bp, Homo sapiens
gctctccctct

SEQ ID NO: 6265329 - DNA, 14 bp, Homo sapiens
gctctccctctctg

SEQ ID NO: 6265330 - DNA, 15 bp, Homo sapiens
gctctccctctggcc

SEQ ID NO: 6265331 - DNA, 20 bp, Homo sapiens
gctctccctctggccctgcc

SEQ ID NO: 6265332 - DNA, 14 bp, Homo sapiens
gctctccctcttct

SEQ ID NO: 6265333 - DNA, 23 bp, Homo sapiens
gctctccctcttctcaagtgcct

SEQ ID NO: 6265334 - DNA, 18 bp, Homo sapiens
gctctcccttgtttactc

SEQ ID NO: 6265335 - DNA, 16 bp, Homo sapiens
gctctccgagctctgg

SEQ ID NO: 6265336 - DNA, 19 bp, Homo sapiens
gctctccgagctctggtgc

SEQ ID NO: 6265337 - DNA, 21 bp, Homo sapiens
gctctccgccaatttctctca

SEQ ID NO: 6265338 - DNA, 19 bp, Homo sapiens
gctctccggggccatttgc

SEQ ID NO: 6265339 - DNA, 17 bp, Homo sapiens
gctctcctaccccacct

SEQ ID NO: 6265340 - DNA, 18 bp, Homo sapiens
gctctcctaccccacctc

SEQ ID NO: 6265341 - DNA, 19 bp, Homo sapiens
gctctcctcagaagaaaga

SEQ ID NO: 6265342 - DNA, 11 bp, Homo sapiens
gctctcctcca

SEQ ID NO: 6265343 - DNA, 14 bp, Homo sapiens
gctctcctccagcc

SEQ ID NO: 6265344 - DNA, 17 bp, Homo sapiens
gctctcctccagccctg

SEQ ID NO: 6265345 - DNA, 18 bp, Homo sapiens
gctctcctccagccctgg

SEQ ID NO: 6265346 - DNA, 19 bp, Homo sapiens
gctctcctccagccctggg

SEQ ID NO: 6265347 - DNA, 15 bp, Homo sapiens
gctctcctcgagccc

SEQ ID NO: 6265348 - DNA, 14 bp, Homo sapiens
gctctcctcgggcc

SEQ ID NO: 6265349 - DNA, 17 bp, Homo sapiens
gctctcctcgggccctg

SEQ ID NO: 6265350 - DNA, 18 bp, Homo sapiens
gctctcctcgggccctgt

SEQ ID NO: 6265351 - DNA, 20 bp, Homo sapiens
gctctcctcgggccctgtgg

SEQ ID NO: 6265352 - DNA, 14 bp, Homo sapiens
gctctcctctggct

SEQ ID NO: 6265353 - DNA, 13 bp, Homo sapiens
gctctcctcttct

SEQ ID NO: 6265354 - DNA, 15 bp, Homo sapiens
gctctcctcttgcca

SEQ ID NO: 6265355 - DNA, 19 bp, Homo sapiens
gctctcctcttgccactgc

SEQ ID NO: 6265356 - DNA, 17 bp, Homo sapiens
gctctcctgacagccac

SEQ ID NO: 6265357 - DNA, 14 bp, Homo sapiens
gctctcctgacttt

SEQ ID NO: 6265358 - DNA, 23 bp, Homo sapiens
gctctcctgagaggtgctgcagg

SEQ ID NO: 6265359 - DNA, 12 bp, Homo sapiens
gctctcctggag

SEQ ID NO: 6265360 - DNA, 14 bp, Homo sapiens
gctctcctggagca

SEQ ID NO: 6265361 - DNA, 17 bp, Homo sapiens
gctctcctggagcaagc

SEQ ID NO: 6265362 - DNA, 18 bp, Homo sapiens
gctctcctggagcaagct

SEQ ID NO: 6265363 - DNA, 12 bp, Homo sapiens
gctctcctggct

SEQ ID NO: 6265364 - DNA, 15 bp, Homo sapiens
gctctcctggctgtc

SEQ ID NO: 6265365 - DNA, 23 bp, Homo sapiens
gctctcctggcttcccatcccca

SEQ ID NO: 6265366 - DNA, 15 bp, Homo sapiens
gctctcctgggccag

SEQ ID NO: 6265367 - DNA, 15 bp, Homo sapiens
gctctccttgccctg

SEQ ID NO: 6265368 - DNA, 18 bp, Homo sapiens
gctctcgaggaaagtggt

SEQ ID NO: 6265369 - DNA, 20 bp, Homo sapiens
gctctcgaggcagcagtggg

SEQ ID NO: 6265370 - DNA, 14 bp, Homo sapiens
gctctcgctctctc

SEQ ID NO: 6265371 - DNA, 19 bp, Homo sapiens
gctctcggaactgcatgct

SEQ ID NO: 6265372 - DNA, 19 bp, Homo sapiens
gctctcggcttcaccaggg

SEQ ID NO: 6265373 - DNA, 17 bp, Homo sapiens
gctctcgggactagctg

SEQ ID NO: 6265374 - DNA, 19 bp, Homo sapiens
gctctcgggtgggggagcc

SEQ ID NO: 6265375 - DNA, 20 bp, Homo sapiens
gctctctaacccacaggtgt

SEQ ID NO: 6265376 - DNA, 16 bp, Homo sapiens
gctctctaagaaaaga

SEQ ID NO: 6265377 - DNA, 15 bp, Homo sapiens
gctctctaggcctct

SEQ ID NO: 6265378 - DNA, 20 bp, Homo sapiens
gctctctatccaaaataaag

SEQ ID NO: 6265379 - DNA, 19 bp, Homo sapiens
gctctctattccctcagcc

SEQ ID NO: 6265380 - DNA, 23 bp, Homo sapiens
gctctctcacccagcctggtact

SEQ ID NO: 6265381 - DNA, 18 bp, Homo sapiens
gctctctcacctgctccc

SEQ ID NO: 6265382 - DNA, 15 bp, Homo sapiens
gctctctcagaccct

SEQ ID NO: 6265383 - DNA, 22 bp, Homo sapiens
gctctctcatcttgttcttccc

SEQ ID NO: 6265384 - DNA, 12 bp, Homo sapiens
gctctctcatgt

SEQ ID NO: 6265385 - DNA, 13 bp, Homo sapiens
gctctctccagga

SEQ ID NO: 6265386 - DNA, 14 bp, Homo sapiens
gctctctcctctct

SEQ ID NO: 6265387 - DNA, 17 bp, Homo sapiens
gctctctctagctcccc

SEQ ID NO: 6265388 - DNA, 14 bp, Homo sapiens
gctctctctccctg

SEQ ID NO: 6265389 - DNA, 21 bp, Homo sapiens
gctctctctcgctgcgtcctc

SEQ ID NO: 6265390 - DNA, 14 bp, Homo sapiens
gctctctctgtccc

SEQ ID NO: 6265391 - DNA, 13 bp, Homo sapiens
gctctctgacccg

SEQ ID NO: 6265392 - DNA, 19 bp, Homo sapiens
gctctctgacgcttgtgac

SEQ ID NO: 6265393 - DNA, 23 bp, Homo sapiens
gctctctgacgtcaacccaagct

SEQ ID NO: 6265394 - DNA, 15 bp, Homo sapiens
gctctctgactgctt

SEQ ID NO: 6265395 - DNA, 17 bp, Homo sapiens
gctctctgagagcacag

SEQ ID NO: 6265396 - DNA, 16 bp, Homo sapiens
gctctctgaggcaagg

SEQ ID NO: 6265397 - DNA, 18 bp, Homo sapiens
gctctctgagtcctggcc

SEQ ID NO: 6265398 - DNA, 17 bp, Homo sapiens
gctctctgcagccagcc

SEQ ID NO: 6265399 - DNA, 18 bp, Homo sapiens
gctctctgcagccagccc

SEQ ID NO: 6265400 - DNA, 19 bp, Homo sapiens
gctctctgcagccagccca

SEQ ID NO: 6265401 - DNA, 20 bp, Homo sapiens
gctctctgcagccagcccag

SEQ ID NO: 6265402 - DNA, 22 bp, Homo sapiens
gctctctgcagccagcccagcc

SEQ ID NO: 6265403 - DNA, 14 bp, Homo sapiens
gctctctgccctgt

SEQ ID NO: 6265404 - DNA, 18 bp, Homo sapiens
gctctctgccctgtgtac

SEQ ID NO: 6265405 - DNA, 13 bp, Homo sapiens
gctctctgctcat

SEQ ID NO: 6265406 - DNA, 15 bp, Homo sapiens
gctctctgctcatgg

SEQ ID NO: 6265407 - DNA, 11 bp, Homo sapiens
gctctctgctg

SEQ ID NO: 6265408 - DNA, 13 bp, Homo sapiens
gctctctgctgag

SEQ ID NO: 6265409 - DNA, 15 bp, Homo sapiens
gctctctgctgagca

SEQ ID NO: 6265410 - DNA, 20 bp, Homo sapiens
gctctctggacctgaccaga

SEQ ID NO: 6265411 - DNA, 12 bp, Homo sapiens
gctctctggcct

SEQ ID NO: 6265412 - DNA, 15 bp, Homo sapiens
gctctctggccttcg

SEQ ID NO: 6265413 - DNA, 19 bp, Homo sapiens
gctctctggccttcggcct

SEQ ID NO: 6265414 - DNA, 13 bp, Homo sapiens
gctctctgggctt

SEQ ID NO: 6265415 - DNA, 11 bp, Homo sapiens
gctctctgtat

SEQ ID NO: 6265416 - DNA, 18 bp, Homo sapiens
gctctctgtataaacatt

SEQ ID NO: 6265417 - DNA, 11 bp, Homo sapiens
gctctctgtct

SEQ ID NO: 6265418 - DNA, 19 bp, Homo sapiens
gctctctgtctccaggcag

SEQ ID NO: 6265419 - DNA, 18 bp, Homo sapiens
gctctctgtgtctgagag

SEQ ID NO: 6265420 - DNA, 18 bp, Homo sapiens
gctctctgttctcttgct

SEQ ID NO: 6265421 - DNA, 18 bp, Homo sapiens
gctctcttaaatgaagtg

SEQ ID NO: 6265422 - DNA, 23 bp, Homo sapiens
gctctcttaaatgaagtgcccac

SEQ ID NO: 6265423 - DNA, 14 bp, Homo sapiens
gctctcttcaataa

SEQ ID NO: 6265424 - DNA, 18 bp, Homo sapiens
gctctcttcaataaacca

SEQ ID NO: 6265425 - DNA, 13 bp, Homo sapiens
gctctcttcctgc

SEQ ID NO: 6265426 - DNA, 21 bp, Homo sapiens
gctctcttcctgcccctcttt

SEQ ID NO: 6265427 - DNA, 23 bp, Homo sapiens
gctctcttcctgcccctctttct

SEQ ID NO: 6265428 - DNA, 16 bp, Homo sapiens
gctctcttctggcttt

SEQ ID NO: 6265429 - DNA, 23 bp, Homo sapiens
gctctcttctggctttctgagca

SEQ ID NO: 6265430 - DNA, 15 bp, Homo sapiens
gctctctttctgtct

SEQ ID NO: 6265431 - DNA, 23 bp, Homo sapiens
gctctctttcttttctctgtcta

SEQ ID NO: 6265432 - DNA, 11 bp, Homo sapiens
gctctgaaaac

SEQ ID NO: 6265433 - DNA, 16 bp, Homo sapiens
gctctgaaaccagtgt

SEQ ID NO: 6265434 - DNA, 15 bp, Homo sapiens
gctctgaaagctgct

SEQ ID NO: 6265435 - DNA, 18 bp, Homo sapiens
gctctgaacacacacgcc

SEQ ID NO: 6265436 - DNA, 18 bp, Homo sapiens
gctctgaagccaagcctc

SEQ ID NO: 6265437 - DNA, 11 bp, Homo sapiens
gctctgaaggg

SEQ ID NO: 6265438 - DNA, 22 bp, Homo sapiens
gctctgaagggaggggaagaga

SEQ ID NO: 6265439 - DNA, 23 bp, Homo sapiens
gctctgaagtcacatcacaggac

SEQ ID NO: 6265440 - DNA, 18 bp, Homo sapiens
gctctgaagttaaaatga

SEQ ID NO: 6265441 - DNA, 19 bp, Homo sapiens
gctctgaatattttgtaat

SEQ ID NO: 6265442 - DNA, 14 bp, Homo sapiens
gctctgaatctctc

SEQ ID NO: 6265443 - DNA, 15 bp, Homo sapiens
gctctgaatctctca

SEQ ID NO: 6265444 - DNA, 17 bp, Homo sapiens
gctctgaatctctcaaa

SEQ ID NO: 6265445 - DNA, 22 bp, Homo sapiens
gctctgaatctctcaaaatgtg

SEQ ID NO: 6265446 - DNA, 12 bp, Homo sapiens
gctctgaatctg

SEQ ID NO: 6265447 - DNA, 17 bp, Homo sapiens
gctctgaatctgtacat

SEQ ID NO: 6265448 - DNA, 20 bp, Homo sapiens
gctctgaatgtagccagccc

SEQ ID NO: 6265449 - DNA, 19 bp, Homo sapiens
gctctgacaaagcttcccg

SEQ ID NO: 6265450 - DNA, 14 bp, Homo sapiens
gctctgacatccct

SEQ ID NO: 6265451 - DNA, 15 bp, Homo sapiens
gctctgacatccctt

SEQ ID NO: 6265452 - DNA, 17 bp, Homo sapiens
gctctgacatcccttcc

SEQ ID NO: 6265453 - DNA, 18 bp, Homo sapiens
gctctgacatcccttcct

SEQ ID NO: 6265454 - DNA, 21 bp, Homo sapiens
gctctgacatcccttcctgga

SEQ ID NO: 6265455 - DNA, 23 bp, Homo sapiens
gctctgacccaagtggggcctcc

SEQ ID NO: 6265456 - DNA, 15 bp, Homo sapiens
gctctgacccacagc

SEQ ID NO: 6265457 - DNA, 17 bp, Homo sapiens
gctctgacccacagcct

SEQ ID NO: 6265458 - DNA, 20 bp, Homo sapiens
gctctgacccacagcctcca

SEQ ID NO: 6265459 - DNA, 22 bp, Homo sapiens
gctctgaccctgatgcttaata

SEQ ID NO: 6265460 - DNA, 14 bp, Homo sapiens
gctctgacctcctc

SEQ ID NO: 6265461 - DNA, 23 bp, Homo sapiens
gctctgacctcctctgggccctg

SEQ ID NO: 6265462 - DNA, 22 bp, Homo sapiens
gctctgacgtagaaagatcctt

SEQ ID NO: 6265463 - DNA, 18 bp, Homo sapiens
gctctgactctgccaggg

SEQ ID NO: 6265464 - DNA, 10 bp, Homo sapiens
gctctgagaa

SEQ ID NO: 6265465 - DNA, 17 bp, Homo sapiens
gctctgagaaattgaat

SEQ ID NO: 6265466 - DNA, 11 bp, Homo sapiens
gctctgagaat

SEQ ID NO: 6265467 - DNA, 23 bp, Homo sapiens
gctctgagacccttttctcagga

SEQ ID NO: 6265468 - DNA, 11 bp, Homo sapiens
gcagcagccag

SEQ ID NO: 6265469 - DNA, 12 bp, Homo sapiens
gcagcagccagc

SEQ ID NO: 6265470 - DNA, 15 bp, Homo sapiens
gcagcagccagcacc

SEQ ID NO: 6265471 - DNA, 20 bp, Homo sapiens
gcagcagccagccctgcctg

SEQ ID NO: 6265472 - DNA, 23 bp, Homo sapiens
gcagcagccagccctgcctggag

SEQ ID NO: 6265473 - DNA, 22 bp, Homo sapiens
gcagcagccagggacccccaga

SEQ ID NO: 6265474 - DNA, 22 bp, Homo sapiens
gcagcagccatcataggaaggg

SEQ ID NO: 6265475 - DNA, 20 bp, Homo sapiens
gcagcagcccaagcttccct

SEQ ID NO: 6265476 - DNA, 21 bp, Homo sapiens
gcagcagcccaagcttccctc

SEQ ID NO: 6265477 - DNA, 17 bp, Homo sapiens
gcagcagcctgcacctg

SEQ ID NO: 6265478 - DNA, 20 bp, Homo sapiens
gcagcagctaggactgagga

SEQ ID NO: 6265479 - DNA, 17 bp, Homo sapiens
gcagcagctcagcctcc

SEQ ID NO: 6265480 - DNA, 20 bp, Homo sapiens
gcagcagctcagcctccccc

SEQ ID NO: 6265481 - DNA, 14 bp, Homo sapiens
gcagcagctccgcc

SEQ ID NO: 6265482 - DNA, 15 bp, Homo sapiens
gcagcagctccgcct

SEQ ID NO: 6265483 - DNA, 18 bp, Homo sapiens
gcagcagctccgcctggc

SEQ ID NO: 6265484 - DNA, 20 bp, Homo sapiens
gcagcagctccgcctggcac

SEQ ID NO: 6265485 - DNA, 20 bp, Homo sapiens
gcagcagctctgagccagat

SEQ ID NO: 6265486 - DNA, 18 bp, Homo sapiens
gcagcagctgggacccct

SEQ ID NO: 6265487 - DNA, 22 bp, Homo sapiens
gcagcagctgggacccctccca

SEQ ID NO: 6265488 - DNA, 17 bp, Homo sapiens
gcagcagcttggggaga

SEQ ID NO: 6265489 - DNA, 19 bp, Homo sapiens
gcagcaggaactctggacc

SEQ ID NO: 6265490 - DNA, 12 bp, Homo sapiens
gcagcaggaggg

SEQ ID NO: 6265491 - DNA, 22 bp, Homo sapiens
gcagcaggagggactctgtctg

SEQ ID NO: 6265492 - DNA, 21 bp, Homo sapiens
gcagcaggcatttgctaaggc

SEQ ID NO: 6265493 - DNA, 11 bp, Homo sapiens
gcagcaggcca

SEQ ID NO: 6265494 - DNA, 12 bp, Homo sapiens
gcagcaggccag

SEQ ID NO: 6265495 - DNA, 13 bp, Homo sapiens
gcagcaggccaga

SEQ ID NO: 6265496 - DNA, 15 bp, Homo sapiens
gcagcaggccagaga

SEQ ID NO: 6265497 - DNA, 17 bp, Homo sapiens
gcagcaggccagagaaa

SEQ ID NO: 6265498 - DNA, 21 bp, Homo sapiens
gcagcaggccagagaaagcaa

SEQ ID NO: 6265499 - DNA, 13 bp, Homo sapiens
gcagcaggcctct

SEQ ID NO: 6265500 - DNA, 16 bp, Homo sapiens
gcagcaggcctctggg

SEQ ID NO: 6265501 - DNA, 13 bp, Homo sapiens
gcagcaggctcag

SEQ ID NO: 6265502 - DNA, 15 bp, Homo sapiens
gcagcaggctcaggc

SEQ ID NO: 6265503 - DNA, 17 bp, Homo sapiens
gcagcagggaagctctt

SEQ ID NO: 6265504 - DNA, 16 bp, Homo sapiens
gcagcagggaaggccc

SEQ ID NO: 6265505 - DNA, 22 bp, Homo sapiens
gcagcagggaaggcccaactgg

SEQ ID NO: 6265506 - DNA, 19 bp, Homo sapiens
gcagcagggatgccctgga

SEQ ID NO: 6265507 - DNA, 17 bp, Homo sapiens
gcagcagggctaccctg

SEQ ID NO: 6265508 - DNA, 21 bp, Homo sapiens
gcagcaggggaaagattatat

SEQ ID NO: 6265509 - DNA, 22 bp, Homo sapiens
gcagcaggggaaagattatatt

SEQ ID NO: 6265510 - DNA, 20 bp, Homo sapiens
gcagcaggggctgctgtgat

SEQ ID NO: 6265511 - DNA, 13 bp, Homo sapiens
gcagcaggggttg

SEQ ID NO: 6265512 - DNA, 21 bp, Homo sapiens
gcagcaggtgattggaccagg

SEQ ID NO: 6265513 - DNA, 19 bp, Homo sapiens
gcagcaggtgcaagagaca

SEQ ID NO: 6265514 - DNA, 15 bp, Homo sapiens
gcagcaggtgctgct

SEQ ID NO: 6265515 - DNA, 19 bp, Homo sapiens
gcagcaggtgctgctaccc

SEQ ID NO: 6265516 - DNA, 17 bp, Homo sapiens
gcagcagtaccatccca

SEQ ID NO: 6265517 - DNA, 20 bp, Homo sapiens
gcagcagtagctttggggaa

SEQ ID NO: 6265518 - DNA, 22 bp, Homo sapiens
gcagcagtcgcccaagcagaca

SEQ ID NO: 6265519 - DNA, 16 bp, Homo sapiens
gcagcagtgaaaacaa

SEQ ID NO: 6265520 - DNA, 18 bp, Homo sapiens
gcagcagtgaaaacaagt

SEQ ID NO: 6265521 - DNA, 12 bp, Homo sapiens
gcagcagtgaag

SEQ ID NO: 6265522 - DNA, 13 bp, Homo sapiens
gcagcagtggggt

SEQ ID NO: 6265523 - DNA, 18 bp, Homo sapiens
gcagcagtgtccagagac

SEQ ID NO: 6265524 - DNA, 15 bp, Homo sapiens
gcagcagtgtgaggc

SEQ ID NO: 6265525 - DNA, 19 bp, Homo sapiens
gcagcagtgtgaggccagg

SEQ ID NO: 6265526 - DNA, 21 bp, Homo sapiens
gcagcagtgtgaggccagggc

SEQ ID NO: 6265527 - DNA, 23 bp, Homo sapiens
gcagcagtgtgaggccagggcag

SEQ ID NO: 6265528 - DNA, 17 bp, Homo sapiens
gcagcataaagaatttg

SEQ ID NO: 6265529 - DNA, 19 bp, Homo sapiens
gcagcatagaacaggacct

SEQ ID NO: 6265530 - DNA, 14 bp, Homo sapiens
gcagcatatgagga

SEQ ID NO: 6265531 - DNA, 24 bp, Homo sapiens
gcagcatcgaggaagggccgagga

SEQ ID NO: 6265532 - DNA, 15 bp, Homo sapiens
gcagcatctgctaat

SEQ ID NO: 6265533 - DNA, 21 bp, Homo sapiens
gcagcatgcccagattcccag

SEQ ID NO: 6265534 - DNA, 23 bp, Homo sapiens
gcagcatgcccagattcccagac

SEQ ID NO: 6265535 - DNA, 19 bp, Homo sapiens
gcagcatgcgatgtcatat

SEQ ID NO: 6265536 - DNA, 14 bp, Homo sapiens
gcagcatgcttggg

SEQ ID NO: 6265537 - DNA, 12 bp, Homo sapiens
gcagcatggaaa

SEQ ID NO: 6265538 - DNA, 15 bp, Homo sapiens
gcagcatggaaaaat

SEQ ID NO: 6265539 - DNA, 16 bp, Homo sapiens
gcagcatggagagagg

SEQ ID NO: 6265540 - DNA, 13 bp, Homo sapiens
gcagcatgtatag

SEQ ID NO: 6265541 - DNA, 21 bp, Homo sapiens
gcagcatgtggggaagcaaga

SEQ ID NO: 6265542 - DNA, 20 bp, Homo sapiens
gcagcattcagcacacccca

SEQ ID NO: 6265543 - DNA, 22 bp, Homo sapiens
gcagcattcccagggaccttgg

SEQ ID NO: 6265544 - DNA, 13 bp, Homo sapiens
gcagcatttacta

SEQ ID NO: 6265545 - DNA, 14 bp, Homo sapiens
gcagcatttactat

SEQ ID NO: 6265546 - DNA, 13 bp, Homo sapiens
gcagcatttcact

SEQ ID NO: 6265547 - DNA, 15 bp, Homo sapiens
gcagcattttcatat

SEQ ID NO: 6265548 - DNA, 21 bp, Homo sapiens
gcagccaaacccatgaggcaa

SEQ ID NO: 6265549 - DNA, 13 bp, Homo sapiens
gcagccaaagaat

SEQ ID NO: 6265550 - DNA, 19 bp, Homo sapiens
gcagccaaaggggagccag

SEQ ID NO: 6265551 - DNA, 20 bp, Homo sapiens
gcagccaaaggggagccaga

SEQ ID NO: 6265552 - DNA, 19 bp, Homo sapiens
gcagccaaggccgccagcg

SEQ ID NO: 6265553 - DNA, 13 bp, Homo sapiens
gcagccacacagt

SEQ ID NO: 6265554 - DNA, 20 bp, Homo sapiens
gcagccacaccgctggctcc

SEQ ID NO: 6265555 - DNA, 21 bp, Homo sapiens
gcagccacaccgctggctccg

SEQ ID NO: 6265556 - DNA, 23 bp, Homo sapiens
gcagccacacgcaggcggccagg

SEQ ID NO: 6265557 - DNA, 18 bp, Homo sapiens
gcagccacacttctcagg

SEQ ID NO: 6265558 - DNA, 19 bp, Homo sapiens
gcagccacacttctcagga

SEQ ID NO: 6265559 - DNA, 21 bp, Homo sapiens
gcagccacacttctcaggaca

SEQ ID NO: 6265560 - DNA, 14 bp, Homo sapiens
gcagccacaggact

SEQ ID NO: 6265561 - DNA, 19 bp, Homo sapiens
gcagccacaggactgagcc

SEQ ID NO: 6265562 - DNA, 22 bp, Homo sapiens
gcagccacaggactgagccctc

SEQ ID NO: 6265563 - DNA, 15 bp, Homo sapiens
gcagccacaggggat

SEQ ID NO: 6265564 - DNA, 18 bp, Homo sapiens
gcagccacatggccccat

SEQ ID NO: 6265565 - DNA, 20 bp, Homo sapiens
gcagccacccaagcctgctg

SEQ ID NO: 6265566 - DNA, 20 bp, Homo sapiens
gcagccaccctgaggagtct

SEQ ID NO: 6265567 - DNA, 21 bp, Homo sapiens
gcagccaccctgaggagtctg

SEQ ID NO: 6265568 - DNA, 15 bp, Homo sapiens
gcagccaccctgcca

SEQ ID NO: 6265569 - DNA, 16 bp, Homo sapiens
gcagccaccctgccat

SEQ ID NO: 6265570 - DNA, 15 bp, Homo sapiens
gcagccagacccaga

SEQ ID NO: 6265571 - DNA, 14 bp, Homo sapiens
gcagccagaggcac

SEQ ID NO: 6265572 - DNA, 16 bp, Homo sapiens
gcagccagatccccag

SEQ ID NO: 6265573 - DNA, 18 bp, Homo sapiens
gcagccagatccccaggg

SEQ ID NO: 6265574 - DNA, 20 bp, Homo sapiens
gcagccagatccccagggca

SEQ ID NO: 6265575 - DNA, 21 bp, Homo sapiens
gcagccagatccccagggcag

SEQ ID NO: 6265576 - DNA, 22 bp, Homo sapiens
gcagccagatccccagggcagc

SEQ ID NO: 6265577 - DNA, 13 bp, Homo sapiens
gcagccagcacca

SEQ ID NO: 6265578 - DNA, 19 bp, Homo sapiens
gcagccagcaccacctaca

SEQ ID NO: 6265579 - DNA, 13 bp, Homo sapiens
gcagccagcatct

SEQ ID NO: 6265580 - DNA, 17 bp, Homo sapiens
gcagccagcatctgggc

SEQ ID NO: 6265581 - DNA, 12 bp, Homo sapiens
gcagccagccag

SEQ ID NO: 6265582 - DNA, 11 bp, Homo sapiens
gcagccagccc

SEQ ID NO: 6265583 - DNA, 13 bp, Homo sapiens
gcagccagcccag

SEQ ID NO: 6265584 - DNA, 15 bp, Homo sapiens
gcagccagcccagcc

SEQ ID NO: 6265585 - DNA, 16 bp, Homo sapiens
gcagccagcccagccc

SEQ ID NO: 6265586 - DNA, 17 bp, Homo sapiens
gcagccagcccagccca

SEQ ID NO: 6265587 - DNA, 14 bp, Homo sapiens
gcagccagccctgc

SEQ ID NO: 6265588 - DNA, 19 bp, Homo sapiens
gcagccagccctgcctgga

SEQ ID NO: 6265589 - DNA, 21 bp, Homo sapiens
gcagccagccctgcctggagg

SEQ ID NO: 6265590 - DNA, 14 bp, Homo sapiens
gcagccagccctgg

SEQ ID NO: 6265591 - DNA, 16 bp, Homo sapiens
gcagccagctcctggt

SEQ ID NO: 6265592 - DNA, 18 bp, Homo sapiens
gcagccagctctcagcca

SEQ ID NO: 6265593 - DNA, 14 bp, Homo sapiens
gcagccaggacccg

SEQ ID NO: 6265594 - DNA, 15 bp, Homo sapiens
gcagccaggagggac

SEQ ID NO: 6265595 - DNA, 17 bp, Homo sapiens
gcagccaggagtgcccc

SEQ ID NO: 6265596 - DNA, 20 bp, Homo sapiens
gcagccaggagtgcccccgg

SEQ ID NO: 6265597 - DNA, 12 bp, Homo sapiens
gcagccaggcca

SEQ ID NO: 6265598 - DNA, 14 bp, Homo sapiens
gcagccaggccaca

SEQ ID NO: 6265599 - DNA, 16 bp, Homo sapiens
gcagccaggccacaag

SEQ ID NO: 6265600 - DNA, 20 bp, Homo sapiens
gcagccaggccactggcccc

SEQ ID NO: 6265601 - DNA, 15 bp, Homo sapiens
gcagccaggcctcgc

SEQ ID NO: 6265602 - DNA, 13 bp, Homo sapiens
gcagccaggctgg

SEQ ID NO: 6265603 - DNA, 13 bp, Homo sapiens
gcagccagggacc

SEQ ID NO: 6265604 - DNA, 21 bp, Homo sapiens
gcagccagggacccccagaac

SEQ ID NO: 6265605 - DNA, 12 bp, Homo sapiens
gcagccagggag

SEQ ID NO: 6265606 - DNA, 14 bp, Homo sapiens
gcagccagggagag

SEQ ID NO: 6265607 - DNA, 18 bp, Homo sapiens
gcagccagggagagccca

SEQ ID NO: 6265608 - DNA, 19 bp, Homo sapiens
gcagccagggagagcccag

SEQ ID NO: 6265609 - DNA, 21 bp, Homo sapiens
gcagccagggagagcccagga

SEQ ID NO: 6265610 - DNA, 16 bp, Homo sapiens
gcagccagggagcccg

SEQ ID NO: 6265611 - DNA, 12 bp, Homo sapiens
gcagccagggct

SEQ ID NO: 6265612 - DNA, 14 bp, Homo sapiens
gcagccagggctgg

SEQ ID NO: 6265613 - DNA, 23 bp, Homo sapiens
gcagccagggcttacctgtacac

SEQ ID NO: 6265614 - DNA, 19 bp, Homo sapiens
gcagccaggggctgctcat

SEQ ID NO: 6265615 - DNA, 19 bp, Homo sapiens
gcagccagtctcagagacc

SEQ ID NO: 6265616 - DNA, 22 bp, Homo sapiens
gcagccatcccgcttagcctgc

SEQ ID NO: 6265617 - DNA, 14 bp, Homo sapiens
gcagccatgataat

SEQ ID NO: 6265618 - DNA, 18 bp, Homo sapiens
gcagccatgataataggt

SEQ ID NO: 6265619 - DNA, 14 bp, Homo sapiens
gcagccatgcctca

SEQ ID NO: 6265620 - DNA, 16 bp, Homo sapiens
gcagccatgcctcatg

SEQ ID NO: 6265621 - DNA, 23 bp, Homo sapiens
gcagccatgcctcatgccacacc

SEQ ID NO: 6265622 - DNA, 18 bp, Homo sapiens
gcagcccaacagcacttt

SEQ ID NO: 6265623 - DNA, 15 bp, Homo sapiens
gcagcccaagcttcc

SEQ ID NO: 6265624 - DNA, 17 bp, Homo sapiens
gcagcccaagcttccct

SEQ ID NO: 6265625 - DNA, 14 bp, Homo sapiens
gcagcccacagagg

SEQ ID NO: 6265626 - DNA, 13 bp, Homo sapiens
gcagcccaccagg

SEQ ID NO: 6265627 - DNA, 13 bp, Homo sapiens
gcagcccaccctg

SEQ ID NO: 6265628 - DNA, 17 bp, Homo sapiens
gcagcccacctgctgcc

SEQ ID NO: 6265629 - DNA, 14 bp, Homo sapiens
gcagcccactgcac

SEQ ID NO: 6265630 - DNA, 18 bp, Homo sapiens
gcagcccactgcaccgcc

SEQ ID NO: 6265631 - DNA, 21 bp, Homo sapiens
gcagcccagaacgggcctccc

SEQ ID NO: 6265632 - DNA, 23 bp, Homo sapiens
gcagcccagaacgggcctccccg

SEQ ID NO: 6265633 - DNA, 22 bp, Homo sapiens
gcagcccagaagcccagtaact

SEQ ID NO: 6265634 - DNA, 12 bp, Homo sapiens
gcagcccagaga

SEQ ID NO: 6265635 - DNA, 13 bp, Homo sapiens
gcagcccagagac

SEQ ID NO: 6265636 - DNA, 14 bp, Homo sapiens
gcagcccagagact

SEQ ID NO: 6265637 - DNA, 14 bp, Homo sapiens
gcagcccagagaga

SEQ ID NO: 6265638 - DNA, 13 bp, Homo sapiens
gcagcccagcagt

SEQ ID NO: 6265639 - DNA, 13 bp, Homo sapiens
gcagcccagcatt

SEQ ID NO: 6265640 - DNA, 13 bp, Homo sapiens
gcagcccagccag

SEQ ID NO: 6265641 - DNA, 14 bp, Homo sapiens
gcagcccagccagc

SEQ ID NO: 6265642 - DNA, 13 bp, Homo sapiens
gcagcccagcttc

SEQ ID NO: 6265643 - DNA, 16 bp, Homo sapiens
gcagcccagcttcctg

SEQ ID NO: 6265644 - DNA, 16 bp, Homo sapiens
gcagcccaggaagtct

SEQ ID NO: 6265645 - DNA, 15 bp, Homo sapiens
gcagcccaggcggtt

SEQ ID NO: 6265646 - DNA, 19 bp, Homo sapiens
gcagcccatttctccagaa

SEQ ID NO: 6265647 - DNA, 21 bp, Homo sapiens
gcagccccacggacgacgcga

SEQ ID NO: 6265648 - DNA, 22 bp, Homo sapiens
gctctgagagccccaggactgg

SEQ ID NO: 6265649 - DNA, 14 bp, Homo sapiens
gctctgagagtcta

SEQ ID NO: 6265650 - DNA, 20 bp, Homo sapiens
gctctgagagtctagattct

SEQ ID NO: 6265651 - DNA, 21 bp, Homo sapiens
gctctgagagtctagattctc

SEQ ID NO: 6265652 - DNA, 17 bp, Homo sapiens
gctctgagcaggggcag

SEQ ID NO: 6265653 - DNA, 18 bp, Homo sapiens
gctctgagcaggggcagg

SEQ ID NO: 6265654 - DNA, 22 bp, Homo sapiens
gctctgagcaggggcaggcgca

SEQ ID NO: 6265655 - DNA, 14 bp, Homo sapiens
gctctgagccagat

SEQ ID NO: 6265656 - DNA, 13 bp, Homo sapiens
gctctgagccctc

SEQ ID NO: 6265657 - DNA, 9 bp, Homo sapiens
gctctgagg

SEQ ID NO: 6265658 - DNA, 23 bp, Homo sapiens
gctctgaggcaaccccctcggag

SEQ ID NO: 6265659 - DNA, 15 bp, Homo sapiens
gctctgaggcctcac

SEQ ID NO: 6265660 - DNA, 20 bp, Homo sapiens
gctctgaggcgccccaaccc

SEQ ID NO: 6265661 - DNA, 18 bp, Homo sapiens
gctctgaggcttccagag

SEQ ID NO: 6265662 - DNA, 19 bp, Homo sapiens
gctctgaggcttccagaga

SEQ ID NO: 6265663 - DNA, 11 bp, Homo sapiens
gctctgaggga

SEQ ID NO: 6265664 - DNA, 13 bp, Homo sapiens
gctctgagggaaa

SEQ ID NO: 6265665 - DNA, 14 bp, Homo sapiens
gctctgaggggagg

SEQ ID NO: 6265666 - DNA, 15 bp, Homo sapiens
gctctgaggggaggg

SEQ ID NO: 6265667 - DNA, 22 bp, Homo sapiens
gctctgaggtcaataaagcaga

SEQ ID NO: 6265668 - DNA, 22 bp, Homo sapiens
gctctgaggtcccttcaaggcc

SEQ ID NO: 6265669 - DNA, 22 bp, Homo sapiens
gctctgagtacccctgctttgg

SEQ ID NO: 6265670 - DNA, 14 bp, Homo sapiens
gctctgatcagcat

SEQ ID NO: 6265671 - DNA, 17 bp, Homo sapiens
gctctgatcatccactg

SEQ ID NO: 6265672 - DNA, 19 bp, Homo sapiens
gctctgatgcatcagaaag

SEQ ID NO: 6265673 - DNA, 23 bp, Homo sapiens
gctctgattggaatttctggcct

SEQ ID NO: 6265674 - DNA, 23 bp, Homo sapiens
gctctgcaattcccctctgctgc

SEQ ID NO: 6265675 - DNA, 13 bp, Homo sapiens
gctctgcacagac

SEQ ID NO: 6265676 - DNA, 23 bp, Homo sapiens
gctctgcacagacaagcagccct

SEQ ID NO: 6265677 - DNA, 14 bp, Homo sapiens
gctctgcacagatg

SEQ ID NO: 6265678 - DNA, 18 bp, Homo sapiens
gctctgcacagatggatt

SEQ ID NO: 6265679 - DNA, 19 bp, Homo sapiens
gctctgcagcattgaagta

SEQ ID NO: 6265680 - DNA, 20 bp, Homo sapiens
gctctgcagcattgaagtat

SEQ ID NO: 6265681 - DNA, 21 bp, Homo sapiens
gctctgcagcattgaagtatg

SEQ ID NO: 6265682 - DNA, 18 bp, Homo sapiens
gctctgcagcccacagag

SEQ ID NO: 6265683 - DNA, 19 bp, Homo sapiens
gctctgcagcccacagagg

SEQ ID NO: 6265684 - DNA, 18 bp, Homo sapiens
gctctgcagcccagggac

SEQ ID NO: 6265685 - DNA, 15 bp, Homo sapiens
gctctgcaggcagcc

SEQ ID NO: 6265686 - DNA, 16 bp, Homo sapiens
gctctgcaggcagcct

SEQ ID NO: 6265687 - DNA, 18 bp, Homo sapiens
gctctgcagtcctactca

SEQ ID NO: 6265688 - DNA, 22 bp, Homo sapiens
gctctgcatgattagtgcaata

SEQ ID NO: 6265689 - DNA, 11 bp, Homo sapiens
gctctgcatgc

SEQ ID NO: 6265690 - DNA, 19 bp, Homo sapiens
gctctgcatgcggcccagc

SEQ ID NO: 6265691 - DNA, 20 bp, Homo sapiens
gctctgcatgcggcccagcc

SEQ ID NO: 6265692 - DNA, 22 bp, Homo sapiens
gctctgcatgcggcccagcccg

SEQ ID NO: 6265693 - DNA, 16 bp, Homo sapiens
gctctgcatgttttcc

SEQ ID NO: 6265694 - DNA, 17 bp, Homo sapiens
gctctgcatgttttcca

SEQ ID NO: 6265695 - DNA, 22 bp, Homo sapiens
gctctgccaacttcttcagagc

SEQ ID NO: 6265696 - DNA, 18 bp, Homo sapiens
gctctgccaccctacctg

SEQ ID NO: 6265697 - DNA, 18 bp, Homo sapiens
gctctgccatcagcccct

SEQ ID NO: 6265698 - DNA, 16 bp, Homo sapiens
gctctgccatcttcag

SEQ ID NO: 6265699 - DNA, 16 bp, Homo sapiens
gctctgcccacctctc

SEQ ID NO: 6265700 - DNA, 22 bp, Homo sapiens
gctctgcccacctctcttttcc

SEQ ID NO: 6265701 - DNA, 12 bp, Homo sapiens
gctctgcccaga

SEQ ID NO: 6265702 - DNA, 21 bp, Homo sapiens
gctctgcccagagctgggtga

SEQ ID NO: 6265703 - DNA, 14 bp, Homo sapiens
gctctgcccaggca

SEQ ID NO: 6265704 - DNA, 16 bp, Homo sapiens
gctctgcccatgccta

SEQ ID NO: 6265705 - DNA, 21 bp, Homo sapiens
gctctgccccaccttgccagg

SEQ ID NO: 6265706 - DNA, 22 bp, Homo sapiens
gctctgccccaccttgccaggg

SEQ ID NO: 6265707 - DNA, 20 bp, Homo sapiens
gctctgccccagaggcctct

SEQ ID NO: 6265708 - DNA, 21 bp, Homo sapiens
gctctgccccagaggcctctc

SEQ ID NO: 6265709 - DNA, 18 bp, Homo sapiens
gctctgccccagctctgg

SEQ ID NO: 6265710 - DNA, 22 bp, Homo sapiens
gctctgccccagcttgggcaga

SEQ ID NO: 6265711 - DNA, 14 bp, Homo sapiens
gctctgccccaggc

SEQ ID NO: 6265712 - DNA, 22 bp, Homo sapiens
gctctgcccccgcgggttctag

SEQ ID NO: 6265713 - DNA, 11 bp, Homo sapiens
gctctgcccct

SEQ ID NO: 6265714 - DNA, 19 bp, Homo sapiens
gctctgcccctcagggggc

SEQ ID NO: 6265715 - DNA, 22 bp, Homo sapiens
gctctgcccctcagggggccag

SEQ ID NO: 6265716 - DNA, 22 bp, Homo sapiens
gctctgcccctccgtccccagg

SEQ ID NO: 6265717 - DNA, 17 bp, Homo sapiens
gctctgccccttcccca

SEQ ID NO: 6265718 - DNA, 17 bp, Homo sapiens
gctctgccctccctggc

SEQ ID NO: 6265719 - DNA, 22 bp, Homo sapiens
gctctgccctccctggcctcac

SEQ ID NO: 6265720 - DNA, 15 bp, Homo sapiens
gctctgccctgccct

SEQ ID NO: 6265721 - DNA, 17 bp, Homo sapiens
gctctgccctggaacct

SEQ ID NO: 6265722 - DNA, 14 bp, Homo sapiens
gctctgccctggct

SEQ ID NO: 6265723 - DNA, 14 bp, Homo sapiens
gctctgcccttggt

SEQ ID NO: 6265724 - DNA, 21 bp, Homo sapiens
gctctgccgccgcccgctggg

SEQ ID NO: 6265725 - DNA, 24 bp, Homo sapiens
gctctgcctcagacgttgcctgag

SEQ ID NO: 6265726 - DNA, 22 bp, Homo sapiens
gctctgcctcccatcacccgct

SEQ ID NO: 6265727 - DNA, 16 bp, Homo sapiens
gctctgcctcccgtgt

SEQ ID NO: 6265728 - DNA, 13 bp, Homo sapiens
gctctgcctgtgg

SEQ ID NO: 6265729 - DNA, 14 bp, Homo sapiens
gctctgccttctca

SEQ ID NO: 6265730 - DNA, 19 bp, Homo sapiens
gctctgccttctcaggccc

SEQ ID NO: 6265731 - DNA, 16 bp, Homo sapiens
gctctgcgccaggcag

SEQ ID NO: 6265732 - DNA, 17 bp, Homo sapiens
gctctgcgccaggcaga

SEQ ID NO: 6265733 - DNA, 16 bp, Homo sapiens
gctctgcgcgttcctc

SEQ ID NO: 6265734 - DNA, 21 bp, Homo sapiens
gctctgcgtcggtcctggtgc

SEQ ID NO: 6265735 - DNA, 17 bp, Homo sapiens
gctctgcgttggcttct

SEQ ID NO: 6265736 - DNA, 13 bp, Homo sapiens
gctctgctcctct

SEQ ID NO: 6265737 - DNA, 14 bp, Homo sapiens
gctctgctcctctc

SEQ ID NO: 6265738 - DNA, 19 bp, Homo sapiens
gctctgctcctctccccag

SEQ ID NO: 6265739 - DNA, 21 bp, Homo sapiens
gctctgctcctctccccagca

SEQ ID NO: 6265740 - DNA, 13 bp, Homo sapiens
gctctgctgacag

SEQ ID NO: 6265741 - DNA, 14 bp, Homo sapiens
gctctgctgacaga

SEQ ID NO: 6265742 - DNA, 20 bp, Homo sapiens
gctctgctgacagacacagg

SEQ ID NO: 6265743 - DNA, 23 bp, Homo sapiens
gctctgctgacagacacaggccc

SEQ ID NO: 6265744 - DNA, 11 bp, Homo sapiens
gctctgctgct

SEQ ID NO: 6265745 - DNA, 15 bp, Homo sapiens
gctctgctggaagaa

SEQ ID NO: 6265746 - DNA, 15 bp, Homo sapiens
gctctgctggcctgg

SEQ ID NO: 6265747 - DNA, 18 bp, Homo sapiens
gctctgctggcctggccg

SEQ ID NO: 6265748 - DNA, 11 bp, Homo sapiens
gctctgctggt

SEQ ID NO: 6265749 - DNA, 20 bp, Homo sapiens
gctctgctgtgagccgccag

SEQ ID NO: 6265750 - DNA, 23 bp, Homo sapiens
gctctgctgtgggcacaggtcag

SEQ ID NO: 6265751 - DNA, 11 bp, Homo sapiens
gctctgcttcc

SEQ ID NO: 6265752 - DNA, 16 bp, Homo sapiens
gctctgcttcctcagg

SEQ ID NO: 6265753 - DNA, 21 bp, Homo sapiens
gctctgcttgacaacatctga

SEQ ID NO: 6265754 - DNA, 13 bp, Homo sapiens
gctctgcttgccg

SEQ ID NO: 6265755 - DNA, 19 bp, Homo sapiens
gctctgcttgccgaaactg

SEQ ID NO: 6265756 - DNA, 24 bp, Homo sapiens
gctctggaactgattgctcccagg

SEQ ID NO: 6265757 - DNA, 22 bp, Homo sapiens
gctctggaagaggccttcccat

SEQ ID NO: 6265758 - DNA, 15 bp, Homo sapiens
gctctggaagcctgc

SEQ ID NO: 6265759 - DNA, 20 bp, Homo sapiens
gctctggaagcctgctgatt

SEQ ID NO: 6265760 - DNA, 23 bp, Homo sapiens
gctctggaattgttgaatgtatt

SEQ ID NO: 6265761 - DNA, 20 bp, Homo sapiens
gctctggacagcagaagcct

SEQ ID NO: 6265762 - DNA, 21 bp, Homo sapiens
gctctggacagcagaagcctc

SEQ ID NO: 6265763 - DNA, 19 bp, Homo sapiens
gctctggacagccccaccc

SEQ ID NO: 6265764 - DNA, 22 bp, Homo sapiens
gctctggacaggcatgttctct

SEQ ID NO: 6265765 - DNA, 17 bp, Homo sapiens
gctctggaccagcctgt

SEQ ID NO: 6265766 - DNA, 21 bp, Homo sapiens
gctctggacctcaggagggca

SEQ ID NO: 6265767 - DNA, 22 bp, Homo sapiens
gctctggacctcaggagggcag

SEQ ID NO: 6265768 - DNA, 12 bp, Homo sapiens
gctctggactcc

SEQ ID NO: 6265769 - DNA, 11 bp, Homo sapiens
gctctggagaa

SEQ ID NO: 6265770 - DNA, 15 bp, Homo sapiens
gctctggagaacagt

SEQ ID NO: 6265771 - DNA, 14 bp, Homo sapiens
gctctggagacagc

SEQ ID NO: 6265772 - DNA, 18 bp, Homo sapiens
gctctggagacagcccca

SEQ ID NO: 6265773 - DNA, 14 bp, Homo sapiens
gctctggagagaaa

SEQ ID NO: 6265774 - DNA, 15 bp, Homo sapiens
gctctggagcaagcc

SEQ ID NO: 6265775 - DNA, 18 bp, Homo sapiens
gctctggagcaagccctg

SEQ ID NO: 6265776 - DNA, 12 bp, Homo sapiens
gctctggagcag

SEQ ID NO: 6265777 - DNA, 13 bp, Homo sapiens
gctctggagcagc

SEQ ID NO: 6265778 - DNA, 15 bp, Homo sapiens
gctctggagccacct

SEQ ID NO: 6265779 - DNA, 17 bp, Homo sapiens
gctctggagccacctgt

SEQ ID NO: 6265780 - DNA, 20 bp, Homo sapiens
gctctggagccacctgtccc

SEQ ID NO: 6265781 - DNA, 22 bp, Homo sapiens
gctctggagccacctgtcccac

SEQ ID NO: 6265782 - DNA, 15 bp, Homo sapiens
gctctggagccagag

SEQ ID NO: 6265783 - DNA, 17 bp, Homo sapiens
gctctggagcccactgt

SEQ ID NO: 6265784 - DNA, 14 bp, Homo sapiens
gctctggagcccgc

SEQ ID NO: 6265785 - DNA, 22 bp, Homo sapiens
gctctggagcccgcctgcgccc

SEQ ID NO: 6265786 - DNA, 14 bp, Homo sapiens
gctctggaggtgct

SEQ ID NO: 6265787 - DNA, 17 bp, Homo sapiens
gctctggaggtgctgct

SEQ ID NO: 6265788 - DNA, 19 bp, Homo sapiens
gctctggaggtgctgctct

SEQ ID NO: 6265789 - DNA, 14 bp, Homo sapiens
gctctggagtgtgc

SEQ ID NO: 6265790 - DNA, 12 bp, Homo sapiens
gctctggcacag

SEQ ID NO: 6265791 - DNA, 17 bp, Homo sapiens
gctctggcaccatcagc

SEQ ID NO: 6265792 - DNA, 22 bp, Homo sapiens
gctctggcaggtggccagggct

SEQ ID NO: 6265793 - DNA, 19 bp, Homo sapiens
gctctggcagtaggtgtcc

SEQ ID NO: 6265794 - DNA, 14 bp, Homo sapiens
gctctggccaaggg

SEQ ID NO: 6265795 - DNA, 17 bp, Homo sapiens
gctctggccaagggcca

SEQ ID NO: 6265796 - DNA, 18 bp, Homo sapiens
gctctggccaagggccag

SEQ ID NO: 6265797 - DNA, 21 bp, Homo sapiens
gctctggccaagggccagaca

SEQ ID NO: 6265798 - DNA, 23 bp, Homo sapiens
gctctggccaagggccagacaga

SEQ ID NO: 6265799 - DNA, 13 bp, Homo sapiens
gctctggccacaa

SEQ ID NO: 6265800 - DNA, 14 bp, Homo sapiens
gctctggccccagg

SEQ ID NO: 6265801 - DNA, 18 bp, Homo sapiens
gctctggccccaggcttg

SEQ ID NO: 6265802 - DNA, 20 bp, Homo sapiens
gctctggccccagtcgaact

SEQ ID NO: 6265803 - DNA, 14 bp, Homo sapiens
gctctggccccgct

SEQ ID NO: 6265804 - DNA, 15 bp, Homo sapiens
gctctggcctccaag

SEQ ID NO: 6265805 - DNA, 21 bp, Homo sapiens
gctctggcggcttcctgtcca

SEQ ID NO: 6265806 - DNA, 14 bp, Homo sapiens
gctctggctcacag

SEQ ID NO: 6265807 - DNA, 23 bp, Homo sapiens
gctctggctcagggcccacctcc

SEQ ID NO: 6265808 - DNA, 17 bp, Homo sapiens
gctctggctccagagga

SEQ ID NO: 6265809 - DNA, 13 bp, Homo sapiens
gctctggctccct

SEQ ID NO: 6265810 - DNA, 19 bp, Homo sapiens
gctctggctccctgggacc

SEQ ID NO: 6265811 - DNA, 11 bp, Homo sapiens
gctctggctct

SEQ ID NO: 6265812 - DNA, 15 bp, Homo sapiens
gctctggctctgcct

SEQ ID NO: 6265813 - DNA, 19 bp, Homo sapiens
gctctggctctgcctcagg

SEQ ID NO: 6265814 - DNA, 18 bp, Homo sapiens
gctctggcttcctgctga

SEQ ID NO: 6265815 - DNA, 13 bp, Homo sapiens
gctctggcttgcc

SEQ ID NO: 6265816 - DNA, 15 bp, Homo sapiens
gctctggcttgcccc

SEQ ID NO: 6265817 - DNA, 18 bp, Homo sapiens
gctctggcttgccccagg

SEQ ID NO: 6265818 - DNA, 20 bp, Homo sapiens
gctctggcttgccccaggac

SEQ ID NO: 6265819 - DNA, 18 bp, Homo sapiens
gctctgggaaggggtgcc

SEQ ID NO: 6265820 - DNA, 21 bp, Homo sapiens
gctctgggaaggggtgccctc

SEQ ID NO: 6265821 - DNA, 15 bp, Homo sapiens
gctctgggacgtgga

SEQ ID NO: 6265822 - DNA, 20 bp, Homo sapiens
gctctgggacgtggacatgc

SEQ ID NO: 6265823 - DNA, 21 bp, Homo sapiens
gctctgggatagctgacccag

SEQ ID NO: 6265824 - DNA, 13 bp, Homo sapiens
gctctgggcacag

SEQ ID NO: 6265825 - DNA, 16 bp, Homo sapiens
gctctgggcacagtgc

SEQ ID NO: 6265826 - DNA, 22 bp, Homo sapiens
gcagccccacttcacccccaac

SEQ ID NO: 6265827 - DNA, 14 bp, Homo sapiens
gcagccccagagag

SEQ ID NO: 6265828 - DNA, 22 bp, Homo sapiens
gcagccccagcaccaccaggtc

SEQ ID NO: 6265829 - DNA, 13 bp, Homo sapiens
gcagccccagcct

SEQ ID NO: 6265830 - DNA, 17 bp, Homo sapiens
gcagccccagcctgcta

SEQ ID NO: 6265831 - DNA, 13 bp, Homo sapiens
gcagccccaggac

SEQ ID NO: 6265832 - DNA, 15 bp, Homo sapiens
gcagccccaggacca

SEQ ID NO: 6265833 - DNA, 15 bp, Homo sapiens
gcagccccaggagaa

SEQ ID NO: 6265834 - DNA, 16 bp, Homo sapiens
gcagccccaggagaag

SEQ ID NO: 6265835 - DNA, 13 bp, Homo sapiens
gcagccccaggcc

SEQ ID NO: 6265836 - DNA, 18 bp, Homo sapiens
gcagccccagggcctgcg

SEQ ID NO: 6265837 - DNA, 15 bp, Homo sapiens
gcagcccccacgccg

SEQ ID NO: 6265838 - DNA, 13 bp, Homo sapiens
gcagcccccactg

SEQ ID NO: 6265839 - DNA, 20 bp, Homo sapiens
gcagcccccactgacctgcc

SEQ ID NO: 6265840 - DNA, 21 bp, Homo sapiens
gcagcccccactgacctgccc

SEQ ID NO: 6265841 - DNA, 13 bp, Homo sapiens
gcagccccccaga

SEQ ID NO: 6265842 - DNA, 12 bp, Homo sapiens
gcagccccctcc

SEQ ID NO: 6265843 - DNA, 14 bp, Homo sapiens
gcagccccctccac

SEQ ID NO: 6265844 - DNA, 18 bp, Homo sapiens
gcagccccctcctgaccc

SEQ ID NO: 6265845 - DNA, 13 bp, Homo sapiens
gcagccccctgct

SEQ ID NO: 6265846 - DNA, 17 bp, Homo sapiens
gcagccccctgcttctc

SEQ ID NO: 6265847 - DNA, 23 bp, Homo sapiens
gcagccccctgcttctcccgcca

SEQ ID NO: 6265848 - DNA, 21 bp, Homo sapiens
gcagccccgcgaccacccctg

SEQ ID NO: 6265849 - DNA, 14 bp, Homo sapiens
gcagccccgggagg

SEQ ID NO: 6265850 - DNA, 18 bp, Homo sapiens
gcagccccgggcggagcc

SEQ ID NO: 6265851 - DNA, 20 bp, Homo sapiens
gcagccccgtctgcccacca

SEQ ID NO: 6265852 - DNA, 20 bp, Homo sapiens
gcagcccctcgaggcctaca

SEQ ID NO: 6265853 - DNA, 13 bp, Homo sapiens
gcagcccctgaga

SEQ ID NO: 6265854 - DNA, 11 bp, Homo sapiens
gcagcccctgc

SEQ ID NO: 6265855 - DNA, 13 bp, Homo sapiens
gcagcccctgcag

SEQ ID NO: 6265856 - DNA, 18 bp, Homo sapiens
gcagcccctgctggacca

SEQ ID NO: 6265857 - DNA, 20 bp, Homo sapiens
gcagcccctggagctcctgc

SEQ ID NO: 6265858 - DNA, 15 bp, Homo sapiens
gcagcccctgggccc

SEQ ID NO: 6265859 - DNA, 16 bp, Homo sapiens
gcagcccctgggccct

SEQ ID NO: 6265860 - DNA, 17 bp, Homo sapiens
gcagcccctgggccctt

SEQ ID NO: 6265861 - DNA, 17 bp, Homo sapiens
gcagccccttgctctca

SEQ ID NO: 6265862 - DNA, 18 bp, Homo sapiens
gcagcccgatgtccctgt

SEQ ID NO: 6265863 - DNA, 20 bp, Homo sapiens
gcagcccgatgtccctgtcc

SEQ ID NO: 6265864 - DNA, 22 bp, Homo sapiens
gcagcccgcatcagctgctcag

SEQ ID NO: 6265865 - DNA, 16 bp, Homo sapiens
gcagcccgcctgccgt

SEQ ID NO: 6265866 - DNA, 15 bp, Homo sapiens
gcagcccggctgctg

SEQ ID NO: 6265867 - DNA, 20 bp, Homo sapiens
gcagcccggctgctgcttgg

SEQ ID NO: 6265868 - DNA, 23 bp, Homo sapiens
gcagcccgggagatccgccctgg

SEQ ID NO: 6265869 - DNA, 21 bp, Homo sapiens
gcagcccgtgaagcagtgcct

SEQ ID NO: 6265870 - DNA, 18 bp, Homo sapiens
gcagcccgtgtggcccct

SEQ ID NO: 6265871 - DNA, 13 bp, Homo sapiens
gcagccctagagc

SEQ ID NO: 6265872 - DNA, 16 bp, Homo sapiens
gcagccctagcggctg

SEQ ID NO: 6265873 - DNA, 15 bp, Homo sapiens
gcagccctcaacagg

SEQ ID NO: 6265874 - DNA, 13 bp, Homo sapiens
gcagccctcctca

SEQ ID NO: 6265875 - DNA, 23 bp, Homo sapiens
gcagccctctccacccagaggtc

SEQ ID NO: 6265876 - DNA, 14 bp, Homo sapiens
gcagccctctgcct

SEQ ID NO: 6265877 - DNA, 16 bp, Homo sapiens
gcagccctcttgcccg

SEQ ID NO: 6265878 - DNA, 12 bp, Homo sapiens
gcagccctgagt

SEQ ID NO: 6265879 - DNA, 14 bp, Homo sapiens
gcagccctgcagag

SEQ ID NO: 6265880 - DNA, 16 bp, Homo sapiens
gcagccctgcagaggg

SEQ ID NO: 6265881 - DNA, 22 bp, Homo sapiens
gcagccctgccccacacctcct

SEQ ID NO: 6265882 - DNA, 24 bp, Homo sapiens
gcagccctgctttgggctgccctg

SEQ ID NO: 6265883 - DNA, 16 bp, Homo sapiens
gcagccctggccccca

SEQ ID NO: 6265884 - DNA, 20 bp, Homo sapiens
gcagccctgggggccagctg

SEQ ID NO: 6265885 - DNA, 21 bp, Homo sapiens
gcagccctgggggccagctgg

SEQ ID NO: 6265886 - DNA, 16 bp, Homo sapiens
gcagcccttcccccag

SEQ ID NO: 6265887 - DNA, 23 bp, Homo sapiens
gcagcccttgctttcggagctcc

SEQ ID NO: 6265888 - DNA, 16 bp, Homo sapiens
gcagccgagccccagg

SEQ ID NO: 6265889 - DNA, 14 bp, Homo sapiens
gcagccgaggcctg

SEQ ID NO: 6265890 - DNA, 17 bp, Homo sapiens
gcagccgaggcctggcc

SEQ ID NO: 6265891 - DNA, 15 bp, Homo sapiens
gcagccgcagagaaa

SEQ ID NO: 6265892 - DNA, 18 bp, Homo sapiens
gcagccgcagagaaatgc

SEQ ID NO: 6265893 - DNA, 22 bp, Homo sapiens
gcagccgcagagaaatgcccca

SEQ ID NO: 6265894 - DNA, 23 bp, Homo sapiens
gcagccgcagagaaatgccccag

SEQ ID NO: 6265895 - DNA, 15 bp, Homo sapiens
gcagccgccagctgg

SEQ ID NO: 6265896 - DNA, 17 bp, Homo sapiens
gcagccgccagctggga

SEQ ID NO: 6265897 - DNA, 17 bp, Homo sapiens
gcagccgccgccgccca

SEQ ID NO: 6265898 - DNA, 16 bp, Homo sapiens
gcagccgccgggcagg

SEQ ID NO: 6265899 - DNA, 22 bp, Homo sapiens
gcagccgcctcccttatgcagg

SEQ ID NO: 6265900 - DNA, 18 bp, Homo sapiens
gcagccgccttcacagca

SEQ ID NO: 6265901 - DNA, 18 bp, Homo sapiens
gcagccgccttccttgac

SEQ ID NO: 6265902 - DNA, 21 bp, Homo sapiens
gcagccgctaggagagactga

SEQ ID NO: 6265903 - DNA, 16 bp, Homo sapiens
gcagccgctgagcgag

SEQ ID NO: 6265904 - DNA, 14 bp, Homo sapiens
gcagccggaagtct

SEQ ID NO: 6265905 - DNA, 18 bp, Homo sapiens
gcagccggaatagagcct

SEQ ID NO: 6265906 - DNA, 12 bp, Homo sapiens
gcagccggagga

SEQ ID NO: 6265907 - DNA, 14 bp, Homo sapiens
gcagccggaggagg

SEQ ID NO: 6265908 - DNA, 16 bp, Homo sapiens
gcagccgtcccaggcc

SEQ ID NO: 6265909 - DNA, 22 bp, Homo sapiens
gcagccgtcccaggccaccccc

SEQ ID NO: 6265910 - DNA, 23 bp, Homo sapiens
gcagccgtcccaggccaccccca

SEQ ID NO: 6265911 - DNA, 15 bp, Homo sapiens
gcagccgtgatcaag

SEQ ID NO: 6265912 - DNA, 18 bp, Homo sapiens
gcagccgtgccttcagct

SEQ ID NO: 6265913 - DNA, 17 bp, Homo sapiens
gcagccgttttcctcat

SEQ ID NO: 6265914 - DNA, 18 bp, Homo sapiens
gcagccgttttcctcatc

SEQ ID NO: 6265915 - DNA, 21 bp, Homo sapiens
gcagcctaaagtacagcctgg

SEQ ID NO: 6265916 - DNA, 18 bp, Homo sapiens
gcagcctaagaagaaggc

SEQ ID NO: 6265917 - DNA, 20 bp, Homo sapiens
gcagcctaagaagaaggcca

SEQ ID NO: 6265918 - DNA, 22 bp, Homo sapiens
gcagcctactgagtagctttca

SEQ ID NO: 6265919 - DNA, 20 bp, Homo sapiens
gcagcctcaacctcctgggc

SEQ ID NO: 6265920 - DNA, 22 bp, Homo sapiens
gcagcctcaacctcctgggcta

SEQ ID NO: 6265921 - DNA, 17 bp, Homo sapiens
gcagcctcacagtcctt

SEQ ID NO: 6265922 - DNA, 19 bp, Homo sapiens
gcagcctcaggactgggag

SEQ ID NO: 6265923 - DNA, 19 bp, Homo sapiens
gcagcctcagggcttcctt

SEQ ID NO: 6265924 - DNA, 20 bp, Homo sapiens
gcagcctcagggcttcctta

SEQ ID NO: 6265925 - DNA, 18 bp, Homo sapiens
gcagcctccaacacaagg

SEQ ID NO: 6265926 - DNA, 20 bp, Homo sapiens
gcagcctccagagccagcct

SEQ ID NO: 6265927 - DNA, 23 bp, Homo sapiens
gcagcctccagagccagcctggg

SEQ ID NO: 6265928 - DNA, 12 bp, Homo sapiens
gcagcctccagt

SEQ ID NO: 6265929 - DNA, 13 bp, Homo sapiens
gcagcctccagtc

SEQ ID NO: 6265930 - DNA, 14 bp, Homo sapiens
gcagcctccagtct

SEQ ID NO: 6265931 - DNA, 18 bp, Homo sapiens
gcagcctccagtctgctc

SEQ ID NO: 6265932 - DNA, 18 bp, Homo sapiens
gcagcctccagtgctggc

SEQ ID NO: 6265933 - DNA, 23 bp, Homo sapiens
gcagcctccagtgctggctgctg

SEQ ID NO: 6265934 - DNA, 22 bp, Homo sapiens
gcagcctccagtgggaggacag

SEQ ID NO: 6265935 - DNA, 23 bp, Homo sapiens
gcagcctccagtgggaggacaga

SEQ ID NO: 6265936 - DNA, 18 bp, Homo sapiens
gcagcctcccatccaggg

SEQ ID NO: 6265937 - DNA, 16 bp, Homo sapiens
gcagcctccctctgac

SEQ ID NO: 6265938 - DNA, 23 bp, Homo sapiens
gcagcctccctctgacctgcagg

SEQ ID NO: 6265939 - DNA, 15 bp, Homo sapiens
gcagcctcccttcca

SEQ ID NO: 6265940 - DNA, 20 bp, Homo sapiens
gcagcctccgcctcccgggt

SEQ ID NO: 6265941 - DNA, 19 bp, Homo sapiens
gcagcctccgcttccctgg

SEQ ID NO: 6265942 - DNA, 19 bp, Homo sapiens
gcagcctcgacctccctgg

SEQ ID NO: 6265943 - DNA, 22 bp, Homo sapiens
gcagcctcgacctccctggctt

SEQ ID NO: 6265944 - DNA, 15 bp, Homo sapiens
gcagcctcgaggctg

SEQ ID NO: 6265945 - DNA, 19 bp, Homo sapiens
gcagcctcgaggctggtgg

SEQ ID NO: 6265946 - DNA, 17 bp, Homo sapiens
gcagcctcgcacaggcc

SEQ ID NO: 6265947 - DNA, 16 bp, Homo sapiens
gcagcctcgcccctgg

SEQ ID NO: 6265948 - DNA, 20 bp, Homo sapiens
gcagcctcgcccctggcaga

SEQ ID NO: 6265949 - DNA, 22 bp, Homo sapiens
gcagcctcgttaggacaaggct

SEQ ID NO: 6265950 - DNA, 20 bp, Homo sapiens
gcagcctctaactcctgggc

SEQ ID NO: 6265951 - DNA, 19 bp, Homo sapiens
gcagcctctcttcactgct

SEQ ID NO: 6265952 - DNA, 20 bp, Homo sapiens
gcagcctctcttcactgcta

SEQ ID NO: 6265953 - DNA, 14 bp, Homo sapiens
gcagcctctgatct

SEQ ID NO: 6265954 - DNA, 14 bp, Homo sapiens
gcagcctctgccag

SEQ ID NO: 6265955 - DNA, 16 bp, Homo sapiens
gcagcctctgccaggc

SEQ ID NO: 6265956 - DNA, 13 bp, Homo sapiens
gcagcctctgccc

SEQ ID NO: 6265957 - DNA, 13 bp, Homo sapiens
gcagcctctgcct

SEQ ID NO: 6265958 - DNA, 13 bp, Homo sapiens
gcagcctctgggc

SEQ ID NO: 6265959 - DNA, 23 bp, Homo sapiens
gcagcctctggggggtggccagg

SEQ ID NO: 6265960 - DNA, 23 bp, Homo sapiens
gcagcctctgtcctggctgtgca

SEQ ID NO: 6265961 - DNA, 14 bp, Homo sapiens
gcagcctgaagcct

SEQ ID NO: 6265962 - DNA, 16 bp, Homo sapiens
gcagcctgaagcctgg

SEQ ID NO: 6265963 - DNA, 20 bp, Homo sapiens
gcagcctgaagcctggattc

SEQ ID NO: 6265964 - DNA, 16 bp, Homo sapiens
gcagcctgagagctgg

SEQ ID NO: 6265965 - DNA, 12 bp, Homo sapiens
gcagcctgagct

SEQ ID NO: 6265966 - DNA, 13 bp, Homo sapiens
gcagcctgagctc

SEQ ID NO: 6265967 - DNA, 18 bp, Homo sapiens
gcagcctgagctccaccc

SEQ ID NO: 6265968 - DNA, 15 bp, Homo sapiens
gcagcctgatggcca

SEQ ID NO: 6265969 - DNA, 20 bp, Homo sapiens
gcagcctgatggccaagggg

SEQ ID NO: 6265970 - DNA, 13 bp, Homo sapiens
gcagcctgcacct

SEQ ID NO: 6265971 - DNA, 23 bp, Homo sapiens
gcagcctgcagaccacactctgc

SEQ ID NO: 6265972 - DNA, 15 bp, Homo sapiens
gcagcctgccagcag

SEQ ID NO: 6265973 - DNA, 24 bp, Homo sapiens
gcagcctgccttgcccactcctgc

SEQ ID NO: 6265974 - DNA, 20 bp, Homo sapiens
gcagcctgcgctcggcagga

SEQ ID NO: 6265975 - DNA, 15 bp, Homo sapiens
gcagcctgcgtggct

SEQ ID NO: 6265976 - DNA, 22 bp, Homo sapiens
gcagcctgctataaagttaaag

SEQ ID NO: 6265977 - DNA, 16 bp, Homo sapiens
gcagcctgctgcgcgt

SEQ ID NO: 6265978 - DNA, 16 bp, Homo sapiens
gcagcctgctggggct

SEQ ID NO: 6265979 - DNA, 12 bp, Homo sapiens
gcagcctggagg

SEQ ID NO: 6265980 - DNA, 14 bp, Homo sapiens
gcagcctggcatct

SEQ ID NO: 6265981 - DNA, 15 bp, Homo sapiens
gcagcctggccaaca

SEQ ID NO: 6265982 - DNA, 18 bp, Homo sapiens
gcagcctggcggggcagg

SEQ ID NO: 6265983 - DNA, 15 bp, Homo sapiens
gcagcctggctcccc

SEQ ID NO: 6265984 - DNA, 14 bp, Homo sapiens
gcagcctggctggt

SEQ ID NO: 6265985 - DNA, 17 bp, Homo sapiens
gcagcctggttccctct

SEQ ID NO: 6265986 - DNA, 22 bp, Homo sapiens
gcagcctggttccctctttcct

SEQ ID NO: 6265987 - DNA, 18 bp, Homo sapiens
gcagcctggttggcagca

SEQ ID NO: 6265988 - DNA, 20 bp, Homo sapiens
gcagcctgtatgtggtgtgg

SEQ ID NO: 6265989 - DNA, 23 bp, Homo sapiens
gcagcctgtcctgggctggtggc

SEQ ID NO: 6265990 - DNA, 17 bp, Homo sapiens
gcagcctgtgagggagt

SEQ ID NO: 6265991 - DNA, 16 bp, Homo sapiens
gcagcctgtggcatct

SEQ ID NO: 6265992 - DNA, 20 bp, Homo sapiens
gcagcctgtgggagaaggga

SEQ ID NO: 6265993 - DNA, 23 bp, Homo sapiens
gcagcctgtgggagaagggacag

SEQ ID NO: 6265994 - DNA, 20 bp, Homo sapiens
gcagccttaaacagtgtcca

SEQ ID NO: 6265995 - DNA, 21 bp, Homo sapiens
gcagccttaaacagtgtccag

SEQ ID NO: 6265996 - DNA, 18 bp, Homo sapiens
gcagccttcatcagaact

SEQ ID NO: 6265997 - DNA, 24 bp, Homo sapiens
gcagccttccagtggcttctccca

SEQ ID NO: 6265998 - DNA, 15 bp, Homo sapiens
gcagccttcccctcc

SEQ ID NO: 6265999 - DNA, 19 bp, Homo sapiens
gcagccttgaactctgggc

SEQ ID NO: 6266000 - DNA, 20 bp, Homo sapiens
gcagccttgaactctgggct

SEQ ID NO: 6266001 - DNA, 19 bp, Homo sapiens
gcagccttgaccacggctg

SEQ ID NO: 6266002 - DNA, 20 bp, Homo sapiens
gcagccttgcgctgtcccag

SEQ ID NO: 6266003 - DNA, 21 bp, Homo sapiens
gctctgggcggtccagaagga

SEQ ID NO: 6266004 - DNA, 20 bp, Homo sapiens
gctctgggctatatgcctat

SEQ ID NO: 6266005 - DNA, 11 bp, Homo sapiens
gctctgggctc

SEQ ID NO: 6266006 - DNA, 12 bp, Homo sapiens
gctctgggctca

SEQ ID NO: 6266007 - DNA, 17 bp, Homo sapiens
gctctgggctcactgca

SEQ ID NO: 6266008 - DNA, 17 bp, Homo sapiens
gctctgggctcagggct

SEQ ID NO: 6266009 - DNA, 21 bp, Homo sapiens
gctctgggctcagggctggag

SEQ ID NO: 6266010 - DNA, 18 bp, Homo sapiens
gctctgggctggctgctc

SEQ ID NO: 6266011 - DNA, 19 bp, Homo sapiens
gctctgggctggctgctcc

SEQ ID NO: 6266012 - DNA, 19 bp, Homo sapiens
gctctggggacagcttcct

SEQ ID NO: 6266013 - DNA, 19 bp, Homo sapiens
gctctggggatgggtgggg

SEQ ID NO: 6266014 - DNA, 15 bp, Homo sapiens
gctctggggggcagg

SEQ ID NO: 6266015 - DNA, 17 bp, Homo sapiens
gctctggggggcagttg

SEQ ID NO: 6266016 - DNA, 17 bp, Homo sapiens
gctctgggggtcccttg

SEQ ID NO: 6266017 - DNA, 22 bp, Homo sapiens
gctctgggggtgggaagtgggg

SEQ ID NO: 6266018 - DNA, 20 bp, Homo sapiens
gctctggggtaggctgctcc

SEQ ID NO: 6266019 - DNA, 22 bp, Homo sapiens
gctctgggtacctgcaagcaga

SEQ ID NO: 6266020 - DNA, 14 bp, Homo sapiens
gctctgggttcggg

SEQ ID NO: 6266021 - DNA, 15 bp, Homo sapiens
gctctggtggccact

SEQ ID NO: 6266022 - DNA, 16 bp, Homo sapiens
gctctggtggccactg

SEQ ID NO: 6266023 - DNA, 21 bp, Homo sapiens
gctctggtggccactgagctg

SEQ ID NO: 6266024 - DNA, 22 bp, Homo sapiens
gctctggtggccactgagctgg

SEQ ID NO: 6266025 - DNA, 17 bp, Homo sapiens
gctctggttatttttct

SEQ ID NO: 6266026 - DNA, 21 bp, Homo sapiens
gctctggttcctccagccacc

SEQ ID NO: 6266027 - DNA, 21 bp, Homo sapiens
gctctggttgtttctgttcca

SEQ ID NO: 6266028 - DNA, 15 bp, Homo sapiens
gctctggttttctgg

SEQ ID NO: 6266029 - DNA, 19 bp, Homo sapiens
gctctggttttctggtggg

SEQ ID NO: 6266030 - DNA, 23 bp, Homo sapiens
gctctggttttctggtggggctg

SEQ ID NO: 6266031 - DNA, 22 bp, Homo sapiens
gctctgtaacatcgcacagttt

SEQ ID NO: 6266032 - DNA, 17 bp, Homo sapiens
gctctgtacctgtcaaa

SEQ ID NO: 6266033 - DNA, 16 bp, Homo sapiens
gctctgtagccacctc

SEQ ID NO: 6266034 - DNA, 17 bp, Homo sapiens
gctctgtagccacctcc

SEQ ID NO: 6266035 - DNA, 18 bp, Homo sapiens
gctctgtagcccaggcca

SEQ ID NO: 6266036 - DNA, 16 bp, Homo sapiens
gctctgtagcctggtc

SEQ ID NO: 6266037 - DNA, 22 bp, Homo sapiens
gctctgtagcctggtctgtgca

SEQ ID NO: 6266038 - DNA, 17 bp, Homo sapiens
gctctgtagtgctacag

SEQ ID NO: 6266039 - DNA, 22 bp, Homo sapiens
gctctgtatcaggacccagagg

SEQ ID NO: 6266040 - DNA, 14 bp, Homo sapiens
gctctgtattctgc

SEQ ID NO: 6266041 - DNA, 18 bp, Homo sapiens
gctctgtcaccctggcca

SEQ ID NO: 6266042 - DNA, 19 bp, Homo sapiens
gctctgtcaccctggccac

SEQ ID NO: 6266043 - DNA, 21 bp, Homo sapiens
gctctgtcaccctggccacca

SEQ ID NO: 6266044 - DNA, 17 bp, Homo sapiens
gctctgtccccagcctg

SEQ ID NO: 6266045 - DNA, 16 bp, Homo sapiens
gctctgtcccccaggc

SEQ ID NO: 6266046 - DNA, 20 bp, Homo sapiens
gctctgtcccccaggctgga

SEQ ID NO: 6266047 - DNA, 22 bp, Homo sapiens
gctctgtcctacctccactctc

SEQ ID NO: 6266048 - DNA, 16 bp, Homo sapiens
gctctgtcctgggagt

SEQ ID NO: 6266049 - DNA, 13 bp, Homo sapiens
gctctgtccttgt

SEQ ID NO: 6266050 - DNA, 19 bp, Homo sapiens
gctctgtcgcccaggctgg

SEQ ID NO: 6266051 - DNA, 23 bp, Homo sapiens
gctctgtcgcccaggctggagtg

SEQ ID NO: 6266052 - DNA, 15 bp, Homo sapiens
gctctgtctcccagg

SEQ ID NO: 6266053 - DNA, 15 bp, Homo sapiens
gctctgtgagcccca

SEQ ID NO: 6266054 - DNA, 16 bp, Homo sapiens
gctctgtgcctgggat

SEQ ID NO: 6266055 - DNA, 22 bp, Homo sapiens
gctctgtgctgaccctcctgtt

SEQ ID NO: 6266056 - DNA, 14 bp, Homo sapiens
gctctgtgcttgac

SEQ ID NO: 6266057 - DNA, 15 bp, Homo sapiens
gctctgtggaattca

SEQ ID NO: 6266058 - DNA, 22 bp, Homo sapiens
gctctgtggcaaaaagagtcag

SEQ ID NO: 6266059 - DNA, 23 bp, Homo sapiens
gctctgtggcaaaaagagtcaga

SEQ ID NO: 6266060 - DNA, 11 bp, Homo sapiens
gctctgtggcc

SEQ ID NO: 6266061 - DNA, 13 bp, Homo sapiens
gctctgtggcctt

SEQ ID NO: 6266062 - DNA, 15 bp, Homo sapiens
gctctgtggccttgg

SEQ ID NO: 6266063 - DNA, 20 bp, Homo sapiens
gctctgtggcgagccatttg

SEQ ID NO: 6266064 - DNA, 19 bp, Homo sapiens
gctctgtgggccctaccct

SEQ ID NO: 6266065 - DNA, 22 bp, Homo sapiens
gctctgtgggccctaccctcct

SEQ ID NO: 6266066 - DNA, 16 bp, Homo sapiens
gctctgtgggtgatgg

SEQ ID NO: 6266067 - DNA, 23 bp, Homo sapiens
gctctgtgggttttaacattttt

SEQ ID NO: 6266068 - DNA, 16 bp, Homo sapiens
gctctgtgtatatctc

SEQ ID NO: 6266069 - DNA, 19 bp, Homo sapiens
gctctgtgtatatctcttg

SEQ ID NO: 6266070 - DNA, 23 bp, Homo sapiens
gctctgtgtatatctcttggaaa

SEQ ID NO: 6266071 - DNA, 19 bp, Homo sapiens
gctctgtgtccgtctgtgt

SEQ ID NO: 6266072 - DNA, 20 bp, Homo sapiens
gctctgtgtgttaaaatgag

SEQ ID NO: 6266073 - DNA, 16 bp, Homo sapiens
gctctgtgttgccatg

SEQ ID NO: 6266074 - DNA, 23 bp, Homo sapiens
gctctgttacccagggtggagtg

SEQ ID NO: 6266075 - DNA, 21 bp, Homo sapiens
gctctgttatgcaagcacaaa

SEQ ID NO: 6266076 - DNA, 14 bp, Homo sapiens
gctctgttcacagt

SEQ ID NO: 6266077 - DNA, 21 bp, Homo sapiens
gctctgttcacagtctctgga

SEQ ID NO: 6266078 - DNA, 23 bp, Homo sapiens
gctctgttcttcctcagccagcc

SEQ ID NO: 6266079 - DNA, 18 bp, Homo sapiens
gctctgttgcaggtgtcc

SEQ ID NO: 6266080 - DNA, 21 bp, Homo sapiens
gctctgttgcccaggctggag

SEQ ID NO: 6266081 - DNA, 20 bp, Homo sapiens
gctctgtttagaggaggcaa

SEQ ID NO: 6266082 - DNA, 15 bp, Homo sapiens
gctctgtttcttcct

SEQ ID NO: 6266083 - DNA, 19 bp, Homo sapiens
gctctgtttcttcctttct

SEQ ID NO: 6266084 - DNA, 23 bp, Homo sapiens
gctctgtttgatgctatttatgc

SEQ ID NO: 6266085 - DNA, 15 bp, Homo sapiens
gctctgtttgtgggg

SEQ ID NO: 6266086 - DNA, 21 bp, Homo sapiens
gctctgtttgtggggtgacgg

SEQ ID NO: 6266087 - DNA, 19 bp, Homo sapiens
gctctgttttgacataatg

SEQ ID NO: 6266088 - DNA, 19 bp, Homo sapiens
gctcttaagcagcatggaa

SEQ ID NO: 6266089 - DNA, 12 bp, Homo sapiens
gctcttaatgtt

SEQ ID NO: 6266090 - DNA, 17 bp, Homo sapiens
gctcttacttcccccac

SEQ ID NO: 6266091 - DNA, 21 bp, Homo sapiens
gctcttacttcccccaccctg

SEQ ID NO: 6266092 - DNA, 17 bp, Homo sapiens
gctcttagcagcttcca

SEQ ID NO: 6266093 - DNA, 16 bp, Homo sapiens
gctcttagtgcccgcc

SEQ ID NO: 6266094 - DNA, 21 bp, Homo sapiens
gctcttatagaagcttcagca

SEQ ID NO: 6266095 - DNA, 20 bp, Homo sapiens
gctcttatccccagctgtta

SEQ ID NO: 6266096 - DNA, 17 bp, Homo sapiens
gctcttatgtgtgcctt

SEQ ID NO: 6266097 - DNA, 13 bp, Homo sapiens
gctcttatttcat

SEQ ID NO: 6266098 - DNA, 17 bp, Homo sapiens
gctcttatttctgaatt

SEQ ID NO: 6266099 - DNA, 14 bp, Homo sapiens
gctcttatttttgt

SEQ ID NO: 6266100 - DNA, 12 bp, Homo sapiens
gctcttcacagt

SEQ ID NO: 6266101 - DNA, 18 bp, Homo sapiens
gctcttcactcagccaca

SEQ ID NO: 6266102 - DNA, 15 bp, Homo sapiens
gctcttcagatgcca

SEQ ID NO: 6266103 - DNA, 17 bp, Homo sapiens
gctcttcataattctaa

SEQ ID NO: 6266104 - DNA, 15 bp, Homo sapiens
gctcttcatctgcct

SEQ ID NO: 6266105 - DNA, 17 bp, Homo sapiens
gctcttcatctgctaca

SEQ ID NO: 6266106 - DNA, 14 bp, Homo sapiens
gctcttcattccat

SEQ ID NO: 6266107 - DNA, 21 bp, Homo sapiens
gctcttccagcgtctctcctc

SEQ ID NO: 6266108 - DNA, 19 bp, Homo sapiens
gctcttccaggctgggaga

SEQ ID NO: 6266109 - DNA, 19 bp, Homo sapiens
gctcttcccaagtcctcgc

SEQ ID NO: 6266110 - DNA, 11 bp, Homo sapiens
gctcttcccct

SEQ ID NO: 6266111 - DNA, 21 bp, Homo sapiens
gctcttcccctagacctcccc

SEQ ID NO: 6266112 - DNA, 23 bp, Homo sapiens
gctcttcccctagacctccccct

SEQ ID NO: 6266113 - DNA, 12 bp, Homo sapiens
gctcttcccttg

SEQ ID NO: 6266114 - DNA, 21 bp, Homo sapiens
gctcttcccttgctcatgagc

SEQ ID NO: 6266115 - DNA, 22 bp, Homo sapiens
gctcttcccttgctcatgagct

SEQ ID NO: 6266116 - DNA, 16 bp, Homo sapiens
gctcttcctctggttt

SEQ ID NO: 6266117 - DNA, 13 bp, Homo sapiens
gctcttcgcgccc

SEQ ID NO: 6266118 - DNA, 15 bp, Homo sapiens
gctcttctatttaaa

SEQ ID NO: 6266119 - DNA, 18 bp, Homo sapiens
gctcttctatttaaaaaa

SEQ ID NO: 6266120 - DNA, 19 bp, Homo sapiens
gctcttctatttaaaaaat

SEQ ID NO: 6266121 - DNA, 13 bp, Homo sapiens
gctcttctcaggg

SEQ ID NO: 6266122 - DNA, 20 bp, Homo sapiens
gctcttctcatttcacccct

SEQ ID NO: 6266123 - DNA, 19 bp, Homo sapiens
gctcttctcattttttcct

SEQ ID NO: 6266124 - DNA, 12 bp, Homo sapiens
gctcttctccag

SEQ ID NO: 6266125 - DNA, 18 bp, Homo sapiens
gctcttctcctcagcttg

SEQ ID NO: 6266126 - DNA, 23 bp, Homo sapiens
gctcttctcctttcacaaccttc

SEQ ID NO: 6266127 - DNA, 20 bp, Homo sapiens
gctcttctctccccagcccc

SEQ ID NO: 6266128 - DNA, 21 bp, Homo sapiens
gctcttctctccccagccccc

SEQ ID NO: 6266129 - DNA, 23 bp, Homo sapiens
gctcttctgcccaattggaggaa

SEQ ID NO: 6266130 - DNA, 21 bp, Homo sapiens
gctcttctgccggccctgggg

SEQ ID NO: 6266131 - DNA, 12 bp, Homo sapiens
gctcttctggag

SEQ ID NO: 6266132 - DNA, 14 bp, Homo sapiens
gctcttctggagtt

SEQ ID NO: 6266133 - DNA, 14 bp, Homo sapiens
gctcttctgggcag

SEQ ID NO: 6266134 - DNA, 19 bp, Homo sapiens
gctcttctgtgcccagggt

SEQ ID NO: 6266135 - DNA, 12 bp, Homo sapiens
gctcttcttaaa

SEQ ID NO: 6266136 - DNA, 14 bp, Homo sapiens
gctcttcttctttc

SEQ ID NO: 6266137 - DNA, 15 bp, Homo sapiens
gctcttcttgaaaaa

SEQ ID NO: 6266138 - DNA, 16 bp, Homo sapiens
gctcttcttgaaaaaa

SEQ ID NO: 6266139 - DNA, 16 bp, Homo sapiens
gctcttcttgtgaaat

SEQ ID NO: 6266140 - DNA, 15 bp, Homo sapiens
gctcttctttctgag

SEQ ID NO: 6266141 - DNA, 21 bp, Homo sapiens
gctcttgaaatattcagaaat

SEQ ID NO: 6266142 - DNA, 18 bp, Homo sapiens
gctcttgaacctgtgctc

SEQ ID NO: 6266143 - DNA, 18 bp, Homo sapiens
gctcttgaattcctgggc

SEQ ID NO: 6266144 - DNA, 15 bp, Homo sapiens
gctcttgacagaaag

SEQ ID NO: 6266145 - DNA, 20 bp, Homo sapiens
gctcttgacagaaagcagtt

SEQ ID NO: 6266146 - DNA, 19 bp, Homo sapiens
gctcttgaggaagcccagg

SEQ ID NO: 6266147 - DNA, 18 bp, Homo sapiens
gctcttgaggagctcaac

SEQ ID NO: 6266148 - DNA, 17 bp, Homo sapiens
gctcttgatacccccct

SEQ ID NO: 6266149 - DNA, 19 bp, Homo sapiens
gctcttgatacccccctct

SEQ ID NO: 6266150 - DNA, 20 bp, Homo sapiens
gctcttgatacccccctctg

SEQ ID NO: 6266151 - DNA, 15 bp, Homo sapiens
gctcttgatcagtgt

SEQ ID NO: 6266152 - DNA, 17 bp, Homo sapiens
gctcttgatgcctggcg

SEQ ID NO: 6266153 - DNA, 16 bp, Homo sapiens
gctcttgcccttccct

SEQ ID NO: 6266154 - DNA, 19 bp, Homo sapiens
gctcttgcccttccctgtc

SEQ ID NO: 6266155 - DNA, 10 bp, Homo sapiens
gctcttgcct

SEQ ID NO: 6266156 - DNA, 12 bp, Homo sapiens
gctcttgcctta

SEQ ID NO: 6266157 - DNA, 13 bp, Homo sapiens
gctcttgctaatc

SEQ ID NO: 6266158 - DNA, 20 bp, Homo sapiens
gctcttgctaatcagtgtct

SEQ ID NO: 6266159 - DNA, 12 bp, Homo sapiens
gctcttgctctc

SEQ ID NO: 6266160 - DNA, 22 bp, Homo sapiens
gctcttggaaagctgatgatgt

SEQ ID NO: 6266161 - DNA, 12 bp, Homo sapiens
gctcttggaaga

SEQ ID NO: 6266162 - DNA, 18 bp, Homo sapiens
gctcttggacaacagctc

SEQ ID NO: 6266163 - DNA, 17 bp, Homo sapiens
gctcttggcattttcct

SEQ ID NO: 6266164 - DNA, 16 bp, Homo sapiens
gctcttggcccctgtg

SEQ ID NO: 6266165 - DNA, 19 bp, Homo sapiens
gctcttggcccctgtgtga

SEQ ID NO: 6266166 - DNA, 13 bp, Homo sapiens
gctcttggcccgg

SEQ ID NO: 6266167 - DNA, 18 bp, Homo sapiens
gctcttggcccggcaggg

SEQ ID NO: 6266168 - DNA, 16 bp, Homo sapiens
gctcttggcctttgca

SEQ ID NO: 6266169 - DNA, 17 bp, Homo sapiens
gctcttggcctttgcat

SEQ ID NO: 6266170 - DNA, 18 bp, Homo sapiens
gctcttggctgacccctc

SEQ ID NO: 6266171 - DNA, 19 bp, Homo sapiens
gctcttggctgacccctct

SEQ ID NO: 6266172 - DNA, 22 bp, Homo sapiens
gctcttggctgacccctctggt

SEQ ID NO: 6266173 - DNA, 15 bp, Homo sapiens
gctcttggctggacc

SEQ ID NO: 6266174 - DNA, 14 bp, Homo sapiens
gctcttggcttcca

SEQ ID NO: 6266175 - DNA, 15 bp, Homo sapiens
gctcttggcttccag

SEQ ID NO: 6266176 - DNA, 23 bp, Homo sapiens
gctcttggcttccagaaggcagc

SEQ ID NO: 6266177 - DNA, 22 bp, Homo sapiens
gctcttgggacaacgtgctgct

SEQ ID NO: 6266178 - DNA, 23 bp, Homo sapiens
gctcttgggcaatattctctgta

SEQ ID NO: 6266179 - DNA, 13 bp, Homo sapiens
gctcttgggcctg

SEQ ID NO: 6266180 - DNA, 15 bp, Homo sapiens
gcagcctttaatgca

SEQ ID NO: 6266181 - DNA, 15 bp, Homo sapiens
gcagcctttatcaag

SEQ ID NO: 6266182 - DNA, 20 bp, Homo sapiens
gcagcctttatcaagagact

SEQ ID NO: 6266183 - DNA, 16 bp, Homo sapiens
gcagcctttcacagga

SEQ ID NO: 6266184 - DNA, 13 bp, Homo sapiens
gcagcctttctgt

SEQ ID NO: 6266185 - DNA, 14 bp, Homo sapiens
gcagcctttctgtg

SEQ ID NO: 6266186 - DNA, 18 bp, Homo sapiens
gcagcctttgcctccccg

SEQ ID NO: 6266187 - DNA, 21 bp, Homo sapiens
gcagcctttttcaccatggca

SEQ ID NO: 6266188 - DNA, 15 bp, Homo sapiens
gcagcgaccccagga

SEQ ID NO: 6266189 - DNA, 14 bp, Homo sapiens
gcagcgacccttgg

SEQ ID NO: 6266190 - DNA, 13 bp, Homo sapiens
gcagcgagctgag

SEQ ID NO: 6266191 - DNA, 14 bp, Homo sapiens
gcagcgagctgaga

SEQ ID NO: 6266192 - DNA, 15 bp, Homo sapiens
gcagcgagctgagat

SEQ ID NO: 6266193 - DNA, 15 bp, Homo sapiens
gcagcgaggctgggc

SEQ ID NO: 6266194 - DNA, 13 bp, Homo sapiens
gcagcgagggcgg

SEQ ID NO: 6266195 - DNA, 14 bp, Homo sapiens
gcagcgagggcgga

SEQ ID NO: 6266196 - DNA, 14 bp, Homo sapiens
gcagcgagtgcatg

SEQ ID NO: 6266197 - DNA, 22 bp, Homo sapiens
gcagcgcagccgccgggcaggc

SEQ ID NO: 6266198 - DNA, 19 bp, Homo sapiens
gcagcgcagggctggcacg

SEQ ID NO: 6266199 - DNA, 20 bp, Homo sapiens
gcagcgccaagcaacctggg

SEQ ID NO: 6266200 - DNA, 15 bp, Homo sapiens
gcagcgccactgtcc

SEQ ID NO: 6266201 - DNA, 20 bp, Homo sapiens
gcagcgccactgtccgctgt

SEQ ID NO: 6266202 - DNA, 13 bp, Homo sapiens
gcagcgccaggct

SEQ ID NO: 6266203 - DNA, 13 bp, Homo sapiens
gcagcgcccaggc

SEQ ID NO: 6266204 - DNA, 19 bp, Homo sapiens
gcagcgcccaggcctgctg

SEQ ID NO: 6266205 - DNA, 21 bp, Homo sapiens
gcagcgcccaggcctgctggc

SEQ ID NO: 6266206 - DNA, 13 bp, Homo sapiens
gcagcgccccacc

SEQ ID NO: 6266207 - DNA, 14 bp, Homo sapiens
gcagcgcccgaggc

SEQ ID NO: 6266208 - DNA, 16 bp, Homo sapiens
gcagcgcccttcctct

SEQ ID NO: 6266209 - DNA, 18 bp, Homo sapiens
gcagcgcccttcctctcc

SEQ ID NO: 6266210 - DNA, 17 bp, Homo sapiens
gcagcgcctgtcccctc

SEQ ID NO: 6266211 - DNA, 15 bp, Homo sapiens
gcagcgcctttccca

SEQ ID NO: 6266212 - DNA, 15 bp, Homo sapiens
gcagcgcgcaggcct

SEQ ID NO: 6266213 - DNA, 17 bp, Homo sapiens
gcagcgcgcaggcctgc

SEQ ID NO: 6266214 - DNA, 16 bp, Homo sapiens
gcagcgcgtgcacagc

SEQ ID NO: 6266215 - DNA, 19 bp, Homo sapiens
gcagcgctcggcccggagc

SEQ ID NO: 6266216 - DNA, 22 bp, Homo sapiens
gcagcgctcggcccggagcagc

SEQ ID NO: 6266217 - DNA, 12 bp, Homo sapiens
gcagcggcagag

SEQ ID NO: 6266218 - DNA, 14 bp, Homo sapiens
gcagcggcagagca

SEQ ID NO: 6266219 - DNA, 14 bp, Homo sapiens
gcagcggcaggacc

SEQ ID NO: 6266220 - DNA, 18 bp, Homo sapiens
gcagcggccccgcacccc

SEQ ID NO: 6266221 - DNA, 16 bp, Homo sapiens
gcagcggcgtgaggcc

SEQ ID NO: 6266222 - DNA, 19 bp, Homo sapiens
gcagcgggccaggcccgca

SEQ ID NO: 6266223 - DNA, 16 bp, Homo sapiens
gcagcggggctggcca

SEQ ID NO: 6266224 - DNA, 18 bp, Homo sapiens
gcagcggtgggaaggaaa

SEQ ID NO: 6266225 - DNA, 19 bp, Homo sapiens
gcagcggtgtggaccgagg

SEQ ID NO: 6266226 - DNA, 16 bp, Homo sapiens
gcagcgtcccccgccg

SEQ ID NO: 6266227 - DNA, 14 bp, Homo sapiens
gcagcgtgggctct

SEQ ID NO: 6266228 - DNA, 16 bp, Homo sapiens
gcagcgtgtgggtccc

SEQ ID NO: 6266229 - DNA, 20 bp, Homo sapiens
gcagcgtgtgggtcccgcac

SEQ ID NO: 6266230 - DNA, 15 bp, Homo sapiens
gcagcgtgtgtgcca

SEQ ID NO: 6266231 - DNA, 16 bp, Homo sapiens
gcagcgttagggctgc

SEQ ID NO: 6266232 - DNA, 22 bp, Homo sapiens
gcagctaaaagcatccctgtga

SEQ ID NO: 6266233 - DNA, 18 bp, Homo sapiens
gcagctaagatagaaagc

SEQ ID NO: 6266234 - DNA, 15 bp, Homo sapiens
gcagctaaggggcag

SEQ ID NO: 6266235 - DNA, 16 bp, Homo sapiens
gcagctaatttgtgaa

SEQ ID NO: 6266236 - DNA, 18 bp, Homo sapiens
gcagctaatttgtgaaag

SEQ ID NO: 6266237 - DNA, 12 bp, Homo sapiens
gcagctaccctc

SEQ ID NO: 6266238 - DNA, 19 bp, Homo sapiens
gcagctaccctcagcctcc

SEQ ID NO: 6266239 - DNA, 15 bp, Homo sapiens
gcagctagaaagaga

SEQ ID NO: 6266240 - DNA, 17 bp, Homo sapiens
gcagctagactggagtg

SEQ ID NO: 6266241 - DNA, 21 bp, Homo sapiens
gcagctagactggagtgaggc

SEQ ID NO: 6266242 - DNA, 17 bp, Homo sapiens
gcagctaggactgagga

SEQ ID NO: 6266243 - DNA, 18 bp, Homo sapiens
gcagctaggactgaggag

SEQ ID NO: 6266244 - DNA, 17 bp, Homo sapiens
gcagctaggcagggagg

SEQ ID NO: 6266245 - DNA, 23 bp, Homo sapiens
gcagctaggcagggagggggctg

SEQ ID NO: 6266246 - DNA, 13 bp, Homo sapiens
gcagctaggcgcg

SEQ ID NO: 6266247 - DNA, 14 bp, Homo sapiens
gcagctagttttct

SEQ ID NO: 6266248 - DNA, 14 bp, Homo sapiens
gcagctatctgcac

SEQ ID NO: 6266249 - DNA, 22 bp, Homo sapiens
gcagctatgcgcaatgtggcat

SEQ ID NO: 6266250 - DNA, 13 bp, Homo sapiens
gcagctatggaca

SEQ ID NO: 6266251 - DNA, 17 bp, Homo sapiens
gcagctattcacacaca

SEQ ID NO: 6266252 - DNA, 16 bp, Homo sapiens
gcagctatttcagcct

SEQ ID NO: 6266253 - DNA, 16 bp, Homo sapiens
gcagctcaacctaccc

SEQ ID NO: 6266254 - DNA, 20 bp, Homo sapiens
gcagctcaacctaccctggt

SEQ ID NO: 6266255 - DNA, 18 bp, Homo sapiens
gcagctcaagagatccca

SEQ ID NO: 6266256 - DNA, 22 bp, Homo sapiens
gcagctcaagttagcatttcaa

SEQ ID NO: 6266257 - DNA, 17 bp, Homo sapiens
gcagctcacccctgggc

SEQ ID NO: 6266258 - DNA, 20 bp, Homo sapiens
gcagctcacccctgggcagg

SEQ ID NO: 6266259 - DNA, 22 bp, Homo sapiens
gcagctcacccctgggcaggcg

SEQ ID NO: 6266260 - DNA, 14 bp, Homo sapiens
gcagctcacctctc

SEQ ID NO: 6266261 - DNA, 16 bp, Homo sapiens
gcagctcacctctccc

SEQ ID NO: 6266262 - DNA, 20 bp, Homo sapiens
gcagctcagaaccacagcaa

SEQ ID NO: 6266263 - DNA, 15 bp, Homo sapiens
gcagctcagcttccc

SEQ ID NO: 6266264 - DNA, 16 bp, Homo sapiens
gcagctcaggagacga

SEQ ID NO: 6266265 - DNA, 14 bp, Homo sapiens
gcagctcaggcgca

SEQ ID NO: 6266266 - DNA, 15 bp, Homo sapiens
gcagctcaggcgcag

SEQ ID NO: 6266267 - DNA, 18 bp, Homo sapiens
gcagctcaggcgcagccc

SEQ ID NO: 6266268 - DNA, 14 bp, Homo sapiens
gcagctcatctctg

SEQ ID NO: 6266269 - DNA, 19 bp, Homo sapiens
gcagctcatctctgtccca

SEQ ID NO: 6266270 - DNA, 21 bp, Homo sapiens
gcagctcatctctgtcccact

SEQ ID NO: 6266271 - DNA, 22 bp, Homo sapiens
gcagctccaacagcttgaccag

SEQ ID NO: 6266272 - DNA, 19 bp, Homo sapiens
gcagctccaacctggaggc

SEQ ID NO: 6266273 - DNA, 22 bp, Homo sapiens
gcagctccaacctggaggctgg

SEQ ID NO: 6266274 - DNA, 21 bp, Homo sapiens
gcagctccatcctcttgactc

SEQ ID NO: 6266275 - DNA, 14 bp, Homo sapiens
gcagctccccagga

SEQ ID NO: 6266276 - DNA, 12 bp, Homo sapiens
gcagctccctca

SEQ ID NO: 6266277 - DNA, 16 bp, Homo sapiens
gcagctccctttctca

SEQ ID NO: 6266278 - DNA, 18 bp, Homo sapiens
gcagctccgcctggcacc

SEQ ID NO: 6266279 - DNA, 12 bp, Homo sapiens
gcagctcctcag

SEQ ID NO: 6266280 - DNA, 22 bp, Homo sapiens
gcagctcctccctgtgccccca

SEQ ID NO: 6266281 - DNA, 23 bp, Homo sapiens
gcagctcctcgggtggggcctgc

SEQ ID NO: 6266282 - DNA, 13 bp, Homo sapiens
gcagctcctctcc

SEQ ID NO: 6266283 - DNA, 13 bp, Homo sapiens
gcagctcctctgt

SEQ ID NO: 6266284 - DNA, 16 bp, Homo sapiens
gcagctcctctgtctc

SEQ ID NO: 6266285 - DNA, 18 bp, Homo sapiens
gcagctcctgtttggaaa

SEQ ID NO: 6266286 - DNA, 20 bp, Homo sapiens
gcagctccttcctagccttg

SEQ ID NO: 6266287 - DNA, 18 bp, Homo sapiens
gcagctctagctttgcag

SEQ ID NO: 6266288 - DNA, 21 bp, Homo sapiens
gcagctctccagtcaggaggc

SEQ ID NO: 6266289 - DNA, 13 bp, Homo sapiens
gcagctctgagcc

SEQ ID NO: 6266290 - DNA, 16 bp, Homo sapiens
gcagctctgagccaga

SEQ ID NO: 6266291 - DNA, 19 bp, Homo sapiens
gcagctctgagccagatta

SEQ ID NO: 6266292 - DNA, 14 bp, Homo sapiens
gcagctctgagccg

SEQ ID NO: 6266293 - DNA, 11 bp, Homo sapiens
gcagctctgcc

SEQ ID NO: 6266294 - DNA, 20 bp, Homo sapiens
gcagctctggacagccccac

SEQ ID NO: 6266295 - DNA, 18 bp, Homo sapiens
gcagctctggctctgcct

SEQ ID NO: 6266296 - DNA, 19 bp, Homo sapiens
gcagctctggctctgcctc

SEQ ID NO: 6266297 - DNA, 22 bp, Homo sapiens
gcagctcttcccctttcctggg

SEQ ID NO: 6266298 - DNA, 14 bp, Homo sapiens
gcagctcttcctgg

SEQ ID NO: 6266299 - DNA, 17 bp, Homo sapiens
gcagctcttctggagtt

SEQ ID NO: 6266300 - DNA, 23 bp, Homo sapiens
gcagctcttctgggcagagcctg

SEQ ID NO: 6266301 - DNA, 18 bp, Homo sapiens
gcagctcttgcccttccc

SEQ ID NO: 6266302 - DNA, 20 bp, Homo sapiens
gcagctcttgcccttccctg

SEQ ID NO: 6266303 - DNA, 23 bp, Homo sapiens
gcagctcttgcccttccctgtcc

SEQ ID NO: 6266304 - DNA, 15 bp, Homo sapiens
gcagctgaaaagtaa

SEQ ID NO: 6266305 - DNA, 12 bp, Homo sapiens
gcagctgaaatt

SEQ ID NO: 6266306 - DNA, 18 bp, Homo sapiens
gcagctgaaattgaaaag

SEQ ID NO: 6266307 - DNA, 16 bp, Homo sapiens
gcagctgaagcctgga

SEQ ID NO: 6266308 - DNA, 18 bp, Homo sapiens
gcagctgaagcctggacg

SEQ ID NO: 6266309 - DNA, 18 bp, Homo sapiens
gcagctgaataacctgca

SEQ ID NO: 6266310 - DNA, 15 bp, Homo sapiens
gcagctgagaccagg

SEQ ID NO: 6266311 - DNA, 11 bp, Homo sapiens
gcagctgagca

SEQ ID NO: 6266312 - DNA, 15 bp, Homo sapiens
gcagctgagcagggc

SEQ ID NO: 6266313 - DNA, 16 bp, Homo sapiens
gcagctgagcagggcc

SEQ ID NO: 6266314 - DNA, 21 bp, Homo sapiens
gcagctgagcagggccgggga

SEQ ID NO: 6266315 - DNA, 13 bp, Homo sapiens
gcagctgatgctg

SEQ ID NO: 6266316 - DNA, 21 bp, Homo sapiens
gcagctgcccagcccctcctc

SEQ ID NO: 6266317 - DNA, 17 bp, Homo sapiens
gcagctgcccctcctgg

SEQ ID NO: 6266318 - DNA, 18 bp, Homo sapiens
gcagctgcccctggcacc

SEQ ID NO: 6266319 - DNA, 20 bp, Homo sapiens
gcagctgcccctggcacctg

SEQ ID NO: 6266320 - DNA, 13 bp, Homo sapiens
gcagctgcctagg

SEQ ID NO: 6266321 - DNA, 13 bp, Homo sapiens
gcagctgcctccc

SEQ ID NO: 6266322 - DNA, 16 bp, Homo sapiens
gcagctgcctcccctc

SEQ ID NO: 6266323 - DNA, 19 bp, Homo sapiens
gcagctgcctctgctccct

SEQ ID NO: 6266324 - DNA, 21 bp, Homo sapiens
gcagctgcctctgctccctct

SEQ ID NO: 6266325 - DNA, 12 bp, Homo sapiens
gcagctgcctgg

SEQ ID NO: 6266326 - DNA, 16 bp, Homo sapiens
gcagctgcctggccat

SEQ ID NO: 6266327 - DNA, 20 bp, Homo sapiens
gcagctgcctggccatgctg

SEQ ID NO: 6266328 - DNA, 16 bp, Homo sapiens
gcagctgcgatggatg

SEQ ID NO: 6266329 - DNA, 15 bp, Homo sapiens
gcagctgcgcgggct

SEQ ID NO: 6266330 - DNA, 17 bp, Homo sapiens
gcagctgcggtccaccc

SEQ ID NO: 6266331 - DNA, 23 bp, Homo sapiens
gcagctgcggtccacccaggagc

SEQ ID NO: 6266332 - DNA, 23 bp, Homo sapiens
gcagctgctatccccatctccct

SEQ ID NO: 6266333 - DNA, 22 bp, Homo sapiens
gcagctgctatttattttccta

SEQ ID NO: 6266334 - DNA, 22 bp, Homo sapiens
gcagctgctgaagttctgagcc

SEQ ID NO: 6266335 - DNA, 20 bp, Homo sapiens
gcagctgctgccactctgct

SEQ ID NO: 6266336 - DNA, 14 bp, Homo sapiens
gcagctggacagag

SEQ ID NO: 6266337 - DNA, 20 bp, Homo sapiens
gcagctggaccatctctgta

SEQ ID NO: 6266338 - DNA, 21 bp, Homo sapiens
gcagctggaccatctctgtag

SEQ ID NO: 6266339 - DNA, 22 bp, Homo sapiens
gcagctggactctgcatcccag

SEQ ID NO: 6266340 - DNA, 18 bp, Homo sapiens
gcagctggactgctgctg

SEQ ID NO: 6266341 - DNA, 20 bp, Homo sapiens
gcagctggatggggcggcct

SEQ ID NO: 6266342 - DNA, 13 bp, Homo sapiens
gcagctggcactg

SEQ ID NO: 6266343 - DNA, 16 bp, Homo sapiens
gcagctggcactgaca

SEQ ID NO: 6266344 - DNA, 23 bp, Homo sapiens
gcagctggcactgacagcctggg

SEQ ID NO: 6266345 - DNA, 17 bp, Homo sapiens
gcagctggcaggagtgg

SEQ ID NO: 6266346 - DNA, 12 bp, Homo sapiens
gcagctggccca

SEQ ID NO: 6266347 - DNA, 15 bp, Homo sapiens
gcagctggcccccag

SEQ ID NO: 6266348 - DNA, 15 bp, Homo sapiens
gcagctggctctcca

SEQ ID NO: 6266349 - DNA, 18 bp, Homo sapiens
gcagctggctctccacct

SEQ ID NO: 6266350 - DNA, 16 bp, Homo sapiens
gcagctgggacccctc

SEQ ID NO: 6266351 - DNA, 20 bp, Homo sapiens
gcagctgggacccctcccaa

SEQ ID NO: 6266352 - DNA, 12 bp, Homo sapiens
gcagctgggact

SEQ ID NO: 6266353 - DNA, 14 bp, Homo sapiens
gcagctgggatttg

SEQ ID NO: 6266354 - DNA, 22 bp, Homo sapiens
gcagctgggcactgggccggca

SEQ ID NO: 6266355 - DNA, 19 bp, Homo sapiens
gcagctgggcccaaccctg

SEQ ID NO: 6266356 - DNA, 21 bp, Homo sapiens
gcagctgggcccaaccctgtc

SEQ ID NO: 6266357 - DNA, 16 bp, Homo sapiens
gcagctgggcccacag

SEQ ID NO: 6266358 - DNA, 18 bp, Homo sapiens
gcagctgggcccacagcc

SEQ ID NO: 6266359 - DNA, 19 bp, Homo sapiens
gcagctgggcccacagccc

SEQ ID NO: 6266360 - DNA, 20 bp, Homo sapiens
gctcttgggcctgacctcca

SEQ ID NO: 6266361 - DNA, 23 bp, Homo sapiens
gctcttgggcctgacctccagtc

SEQ ID NO: 6266362 - DNA, 12 bp, Homo sapiens
gctcttggggaa

SEQ ID NO: 6266363 - DNA, 22 bp, Homo sapiens
gctcttggggttcataggggca

SEQ ID NO: 6266364 - DNA, 14 bp, Homo sapiens
gctcttggtccctg

SEQ ID NO: 6266365 - DNA, 16 bp, Homo sapiens
gctcttggtccctggt

SEQ ID NO: 6266366 - DNA, 19 bp, Homo sapiens
gctcttggtccctggtccc

SEQ ID NO: 6266367 - DNA, 23 bp, Homo sapiens
gctcttggtgggcccagggacac

SEQ ID NO: 6266368 - DNA, 18 bp, Homo sapiens
gctcttgtcggggtgggg

SEQ ID NO: 6266369 - DNA, 17 bp, Homo sapiens
gctcttgtgaggaaagt

SEQ ID NO: 6266370 - DNA, 16 bp, Homo sapiens
gctcttgtgatgtttg

SEQ ID NO: 6266371 - DNA, 18 bp, Homo sapiens
gctcttgtgttcagaaga

SEQ ID NO: 6266372 - DNA, 20 bp, Homo sapiens
gctcttgtgttcagaagaat

SEQ ID NO: 6266373 - DNA, 20 bp, Homo sapiens
gctcttgttccgtgccaggc

SEQ ID NO: 6266374 - DNA, 17 bp, Homo sapiens
gctcttgtttcactcca

SEQ ID NO: 6266375 - DNA, 19 bp, Homo sapiens
gctcttgtttcactccacc

SEQ ID NO: 6266376 - DNA, 22 bp, Homo sapiens
gctcttgtttcactccaccatc

SEQ ID NO: 6266377 - DNA, 12 bp, Homo sapiens
gctcttgtttct

SEQ ID NO: 6266378 - DNA, 14 bp, Homo sapiens
gctcttgtttctgt

SEQ ID NO: 6266379 - DNA, 18 bp, Homo sapiens
gctctttaagtaaaatgt

SEQ ID NO: 6266380 - DNA, 17 bp, Homo sapiens
gctctttacatttcttt

SEQ ID NO: 6266381 - DNA, 14 bp, Homo sapiens
gctctttagccagt

SEQ ID NO: 6266382 - DNA, 16 bp, Homo sapiens
gctctttcaatgcagc

SEQ ID NO: 6266383 - DNA, 16 bp, Homo sapiens
gctctttcacctgggt

SEQ ID NO: 6266384 - DNA, 15 bp, Homo sapiens
gctctttcagagagg

SEQ ID NO: 6266385 - DNA, 12 bp, Homo sapiens
gctctttcatct

SEQ ID NO: 6266386 - DNA, 12 bp, Homo sapiens
gctctttccaaa

SEQ ID NO: 6266387 - DNA, 20 bp, Homo sapiens
gctctttccacttgccctgt

SEQ ID NO: 6266388 - DNA, 22 bp, Homo sapiens
gctctttcccacccagcctggg

SEQ ID NO: 6266389 - DNA, 15 bp, Homo sapiens
gctctttcccaggac

SEQ ID NO: 6266390 - DNA, 16 bp, Homo sapiens
gctctttcccaggacg

SEQ ID NO: 6266391 - DNA, 11 bp, Homo sapiens
gctctttccct

SEQ ID NO: 6266392 - DNA, 12 bp, Homo sapiens
gctctttccctc

SEQ ID NO: 6266393 - DNA, 13 bp, Homo sapiens
gctctttcccttt

SEQ ID NO: 6266394 - DNA, 15 bp, Homo sapiens
gctctttcctccttc

SEQ ID NO: 6266395 - DNA, 17 bp, Homo sapiens
gctctttcctccttcca

SEQ ID NO: 6266396 - DNA, 15 bp, Homo sapiens
gctctttcctgccct

SEQ ID NO: 6266397 - DNA, 20 bp, Homo sapiens
gctctttctacatgactggg

SEQ ID NO: 6266398 - DNA, 13 bp, Homo sapiens
gctctttctctga

SEQ ID NO: 6266399 - DNA, 16 bp, Homo sapiens
gctctttctctgccag

SEQ ID NO: 6266400 - DNA, 21 bp, Homo sapiens
gctctttctctgccagtgaca

SEQ ID NO: 6266401 - DNA, 21 bp, Homo sapiens
gctctttcttcttccacacat

SEQ ID NO: 6266402 - DNA, 17 bp, Homo sapiens
gctctttgaaacaactt

SEQ ID NO: 6266403 - DNA, 19 bp, Homo sapiens
gctctttgactgtcagcaa

SEQ ID NO: 6266404 - DNA, 13 bp, Homo sapiens
gctctttgcacta

SEQ ID NO: 6266405 - DNA, 18 bp, Homo sapiens
gctctttggtagaaaagg

SEQ ID NO: 6266406 - DNA, 13 bp, Homo sapiens
gctctttgtagct

SEQ ID NO: 6266407 - DNA, 16 bp, Homo sapiens
gctctttgtcagggag

SEQ ID NO: 6266408 - DNA, 19 bp, Homo sapiens
gctctttgtctcaccagct

SEQ ID NO: 6266409 - DNA, 15 bp, Homo sapiens
gctctttgttcatca

SEQ ID NO: 6266410 - DNA, 17 bp, Homo sapiens
gctctttgttcatcatt

SEQ ID NO: 6266411 - DNA, 23 bp, Homo sapiens
gctcttttaaaataagctttctc

SEQ ID NO: 6266412 - DNA, 15 bp, Homo sapiens
gctcttttccactcc

SEQ ID NO: 6266413 - DNA, 12 bp, Homo sapiens
gctcttttcctg

SEQ ID NO: 6266414 - DNA, 15 bp, Homo sapiens
gctcttttgtgatga

SEQ ID NO: 6266415 - DNA, 17 bp, Homo sapiens
gctctttttttaaaagg

SEQ ID NO: 6266416 - DNA, 21 bp, Homo sapiens
gctgaaaactaatgtactgta

SEQ ID NO: 6266417 - DNA, 21 bp, Homo sapiens
gctgaaaaggatcgaggcatg

SEQ ID NO: 6266418 - DNA, 22 bp, Homo sapiens
gctgaaaaggatcgaggcatgg

SEQ ID NO: 6266419 - DNA, 15 bp, Homo sapiens
gctgaaaagggcact

SEQ ID NO: 6266420 - DNA, 17 bp, Homo sapiens
gctgaaaagggcactcc

SEQ ID NO: 6266421 - DNA, 12 bp, Homo sapiens
gctgaaaagtgc

SEQ ID NO: 6266422 - DNA, 14 bp, Homo sapiens
gctgaaaatcacta

SEQ ID NO: 6266423 - DNA, 15 bp, Homo sapiens
gctgaaaatcactat

SEQ ID NO: 6266424 - DNA, 20 bp, Homo sapiens
gctgaaaatgcaaagctgaa

SEQ ID NO: 6266425 - DNA, 22 bp, Homo sapiens
gctgaaaattgcctttctgtgt

SEQ ID NO: 6266426 - DNA, 18 bp, Homo sapiens
gctgaaacaaaaatgcca

SEQ ID NO: 6266427 - DNA, 19 bp, Homo sapiens
gctgaaacacctcccaggg

SEQ ID NO: 6266428 - DNA, 18 bp, Homo sapiens
gctgaaacaggagagaaa

SEQ ID NO: 6266429 - DNA, 12 bp, Homo sapiens
gctgaaagactc

SEQ ID NO: 6266430 - DNA, 10 bp, Homo sapiens
gctgaaagca

SEQ ID NO: 6266431 - DNA, 17 bp, Homo sapiens
gctgaaatctattaaac

SEQ ID NO: 6266432 - DNA, 15 bp, Homo sapiens
gctgaaatgctgcat

SEQ ID NO: 6266433 - DNA, 12 bp, Homo sapiens
gctgaaattatg

SEQ ID NO: 6266434 - DNA, 17 bp, Homo sapiens
gctgaaattatgtcaaa

SEQ ID NO: 6266435 - DNA, 15 bp, Homo sapiens
gctgaaatttggaaa

SEQ ID NO: 6266436 - DNA, 15 bp, Homo sapiens
gctgaaattttatat

SEQ ID NO: 6266437 - DNA, 12 bp, Homo sapiens
gctgaacacaca

SEQ ID NO: 6266438 - DNA, 14 bp, Homo sapiens
gctgaacacacaca

SEQ ID NO: 6266439 - DNA, 21 bp, Homo sapiens
gctgaacacacaccagtttac

SEQ ID NO: 6266440 - DNA, 19 bp, Homo sapiens
gctgaacacagtgtctgtt

SEQ ID NO: 6266441 - DNA, 18 bp, Homo sapiens
gctgaacacatttctttt

SEQ ID NO: 6266442 - DNA, 20 bp, Homo sapiens
gctgaacactccaattaagg

SEQ ID NO: 6266443 - DNA, 23 bp, Homo sapiens
gctgaacagatgacccctgccca

SEQ ID NO: 6266444 - DNA, 16 bp, Homo sapiens
gctgaacaggaaagag

SEQ ID NO: 6266445 - DNA, 21 bp, Homo sapiens
gctgaacaggaaagagctagg

SEQ ID NO: 6266446 - DNA, 17 bp, Homo sapiens
gctgaacagtgctctgc

SEQ ID NO: 6266447 - DNA, 19 bp, Homo sapiens
gctgaacagtgctctgcct

SEQ ID NO: 6266448 - DNA, 22 bp, Homo sapiens
gctgaacagtggaggaagaggg

SEQ ID NO: 6266449 - DNA, 12 bp, Homo sapiens
gctgaacatcac

SEQ ID NO: 6266450 - DNA, 17 bp, Homo sapiens
gctgaacatgcctgcca

SEQ ID NO: 6266451 - DNA, 15 bp, Homo sapiens
gctgaacattgcata

SEQ ID NO: 6266452 - DNA, 16 bp, Homo sapiens
gctgaaccctcagcct

SEQ ID NO: 6266453 - DNA, 20 bp, Homo sapiens
gctgaaccctcagccttgac

SEQ ID NO: 6266454 - DNA, 20 bp, Homo sapiens
gctgaaccctgtgctggtgt

SEQ ID NO: 6266455 - DNA, 21 bp, Homo sapiens
gctgaaccctgtgctggtgtc

SEQ ID NO: 6266456 - DNA, 16 bp, Homo sapiens
gctgaacggggagaaa

SEQ ID NO: 6266457 - DNA, 17 bp, Homo sapiens
gctgaactaaaataaaa

SEQ ID NO: 6266458 - DNA, 22 bp, Homo sapiens
gctgaactgagcctagctacct

SEQ ID NO: 6266459 - DNA, 18 bp, Homo sapiens
gctgaagaatgaagacca

SEQ ID NO: 6266460 - DNA, 19 bp, Homo sapiens
gctgaagacatgtttcaag

SEQ ID NO: 6266461 - DNA, 15 bp, Homo sapiens
gctgaagagaggtgc

SEQ ID NO: 6266462 - DNA, 15 bp, Homo sapiens
gctgaagagcaaggt

SEQ ID NO: 6266463 - DNA, 19 bp, Homo sapiens
gctgaagaggaccagagga

SEQ ID NO: 6266464 - DNA, 21 bp, Homo sapiens
gctgaagatccccaactgctc

SEQ ID NO: 6266465 - DNA, 16 bp, Homo sapiens
gctgaagatggagggg

SEQ ID NO: 6266466 - DNA, 18 bp, Homo sapiens
gctgaagatggcatcctg

SEQ ID NO: 6266467 - DNA, 21 bp, Homo sapiens
gctgaagattaggcacacaga

SEQ ID NO: 6266468 - DNA, 19 bp, Homo sapiens
gctgaagccacacagccca

SEQ ID NO: 6266469 - DNA, 11 bp, Homo sapiens
gctgaagccag

SEQ ID NO: 6266470 - DNA, 19 bp, Homo sapiens
gctgaagccgccaggaccg

SEQ ID NO: 6266471 - DNA, 15 bp, Homo sapiens
gctgaagcctggacg

SEQ ID NO: 6266472 - DNA, 19 bp, Homo sapiens
gctgaagcggtcagactgg

SEQ ID NO: 6266473 - DNA, 20 bp, Homo sapiens
gctgaagcggtcagactgga

SEQ ID NO: 6266474 - DNA, 15 bp, Homo sapiens
gctgaagctgcctgc

SEQ ID NO: 6266475 - DNA, 17 bp, Homo sapiens
gctgaagctgcctgctt

SEQ ID NO: 6266476 - DNA, 16 bp, Homo sapiens
gctgaagctggagcag

SEQ ID NO: 6266477 - DNA, 21 bp, Homo sapiens
gctgaagcttattaatgctaa

SEQ ID NO: 6266478 - DNA, 12 bp, Homo sapiens
gctgaaggactg

SEQ ID NO: 6266479 - DNA, 14 bp, Homo sapiens
gctgaaggactgtg

SEQ ID NO: 6266480 - DNA, 22 bp, Homo sapiens
gctgaaggactgtgacaggcag

SEQ ID NO: 6266481 - DNA, 23 bp, Homo sapiens
gctgaaggactgtgacaggcagc

SEQ ID NO: 6266482 - DNA, 21 bp, Homo sapiens
gctgaaggatgggggctcctg

SEQ ID NO: 6266483 - DNA, 20 bp, Homo sapiens
gctgaaggctcgagcatgcc

SEQ ID NO: 6266484 - DNA, 18 bp, Homo sapiens
gctgaaggctgaggcagg

SEQ ID NO: 6266485 - DNA, 19 bp, Homo sapiens
gctgaagggagggggctgg

SEQ ID NO: 6266486 - DNA, 20 bp, Homo sapiens
gctgaagtcaaaatatgtaa

SEQ ID NO: 6266487 - DNA, 14 bp, Homo sapiens
gctgaagtctcccc

SEQ ID NO: 6266488 - DNA, 16 bp, Homo sapiens
gctgaagtgaaggaga

SEQ ID NO: 6266489 - DNA, 19 bp, Homo sapiens
gctgaagtgaaggagaaag

SEQ ID NO: 6266490 - DNA, 21 bp, Homo sapiens
gctgaagtgcatgggtcaggg

SEQ ID NO: 6266491 - DNA, 14 bp, Homo sapiens
gctgaagttctgag

SEQ ID NO: 6266492 - DNA, 16 bp, Homo sapiens
gctgaagttctgagcc

SEQ ID NO: 6266493 - DNA, 19 bp, Homo sapiens
gctgaagttgcagatgtta

SEQ ID NO: 6266494 - DNA, 15 bp, Homo sapiens
gctgaataaagggaa

SEQ ID NO: 6266495 - DNA, 16 bp, Homo sapiens
gctgaataaatgtctt

SEQ ID NO: 6266496 - DNA, 17 bp, Homo sapiens
gctgaataaatgtcttt

SEQ ID NO: 6266497 - DNA, 12 bp, Homo sapiens
gctgaataacaa

SEQ ID NO: 6266498 - DNA, 17 bp, Homo sapiens
gctgaataacctgcaca

SEQ ID NO: 6266499 - DNA, 23 bp, Homo sapiens
gctgaatacgctaagcctggaag

SEQ ID NO: 6266500 - DNA, 22 bp, Homo sapiens
gctgaatatatagaattcagaa

SEQ ID NO: 6266501 - DNA, 10 bp, Homo sapiens
gctgaatcca

SEQ ID NO: 6266502 - DNA, 19 bp, Homo sapiens
gctgaatccacctcggagc

SEQ ID NO: 6266503 - DNA, 23 bp, Homo sapiens
gctgaatcccatcaggctgttat

SEQ ID NO: 6266504 - DNA, 21 bp, Homo sapiens
gctgaatgaagctgccatcct

SEQ ID NO: 6266505 - DNA, 14 bp, Homo sapiens
gctgaatgcctcct

SEQ ID NO: 6266506 - DNA, 19 bp, Homo sapiens
gctgaatgcctcctgtggg

SEQ ID NO: 6266507 - DNA, 18 bp, Homo sapiens
gctgaatgtatgtaaata

SEQ ID NO: 6266508 - DNA, 15 bp, Homo sapiens
gctgaatgtttttct

SEQ ID NO: 6266509 - DNA, 17 bp, Homo sapiens
gctgaatgtttttctaa

SEQ ID NO: 6266510 - DNA, 22 bp, Homo sapiens
gctgaattattttgttgtgatt

SEQ ID NO: 6266511 - DNA, 21 bp, Homo sapiens
gctgaattcctttacaactaa

SEQ ID NO: 6266512 - DNA, 14 bp, Homo sapiens
gctgaattgaacat

SEQ ID NO: 6266513 - DNA, 22 bp, Homo sapiens
gctgaattgagctagaaatcac

SEQ ID NO: 6266514 - DNA, 24 bp, Homo sapiens
gctgaatttccctctctcataccc

SEQ ID NO: 6266515 - DNA, 13 bp, Homo sapiens
gctgaatttctaa

SEQ ID NO: 6266516 - DNA, 17 bp, Homo sapiens
gctgaattttctggaaa

SEQ ID NO: 6266517 - DNA, 14 bp, Homo sapiens
gctgacaaaaatat

SEQ ID NO: 6266518 - DNA, 21 bp, Homo sapiens
gctgacaaaaatattttccta

SEQ ID NO: 6266519 - DNA, 19 bp, Homo sapiens
gctgacaaccaccgctccc

SEQ ID NO: 6266520 - DNA, 19 bp, Homo sapiens
gctgacaaccattaaagtc

SEQ ID NO: 6266521 - DNA, 22 bp, Homo sapiens
gctgacaaccattaaagtcaga

SEQ ID NO: 6266522 - DNA, 18 bp, Homo sapiens
gctgacaacttagctcag

SEQ ID NO: 6266523 - DNA, 19 bp, Homo sapiens
gctgacaacttagctcagg

SEQ ID NO: 6266524 - DNA, 15 bp, Homo sapiens
gctgacaagggacta

SEQ ID NO: 6266525 - DNA, 23 bp, Homo sapiens
gctgacaatgctgccatgcccac

SEQ ID NO: 6266526 - DNA, 21 bp, Homo sapiens
gctgacacaaacctgcctggg

SEQ ID NO: 6266527 - DNA, 19 bp, Homo sapiens
gctgacacataatttgaat

SEQ ID NO: 6266528 - DNA, 17 bp, Homo sapiens
gctgacacctaactctt

SEQ ID NO: 6266529 - DNA, 18 bp, Homo sapiens
gctgacacctaccatgct

SEQ ID NO: 6266530 - DNA, 20 bp, Homo sapiens
gctgacacctaccatgctgc

SEQ ID NO: 6266531 - DNA, 19 bp, Homo sapiens
gctgacacctcccttcgtg

SEQ ID NO: 6266532 - DNA, 18 bp, Homo sapiens
gctgacactgacatttca

SEQ ID NO: 6266533 - DNA, 16 bp, Homo sapiens
gctgacagacacaggc

SEQ ID NO: 6266534 - DNA, 20 bp, Homo sapiens
gctgacagacacaggcccgg

SEQ ID NO: 6266535 - DNA, 21 bp, Homo sapiens
gctgacagacacaggcccggc

SEQ ID NO: 6266536 - DNA, 13 bp, Homo sapiens
gctgacagacact

SEQ ID NO: 6266537 - DNA, 14 bp, Homo sapiens
gctgacagacacta

SEQ ID NO: 6266538 - DNA, 11 bp, Homo sapiens
gctgacagata

SEQ ID NO: 6266539 - DNA, 13 bp, Homo sapiens
gcagctgggcccc

SEQ ID NO: 6266540 - DNA, 22 bp, Homo sapiens
gcagctgggccccatgctctgc

SEQ ID NO: 6266541 - DNA, 18 bp, Homo sapiens
gcagctgggcttggcctg

SEQ ID NO: 6266542 - DNA, 21 bp, Homo sapiens
gcagctggggtaggctgtctg

SEQ ID NO: 6266543 - DNA, 16 bp, Homo sapiens
gcagctggtcttttct

SEQ ID NO: 6266544 - DNA, 19 bp, Homo sapiens
gcagctggtgccccacctg

SEQ ID NO: 6266545 - DNA, 21 bp, Homo sapiens
gcagctgtcaccactacagta

SEQ ID NO: 6266546 - DNA, 12 bp, Homo sapiens
gcagctgtcatg

SEQ ID NO: 6266547 - DNA, 22 bp, Homo sapiens
gcagctgtcatggaaaagccca

SEQ ID NO: 6266548 - DNA, 15 bp, Homo sapiens
gcagctgtcccttgc

SEQ ID NO: 6266549 - DNA, 15 bp, Homo sapiens
gcagctgtcctgtga

SEQ ID NO: 6266550 - DNA, 10 bp, Homo sapiens
gcagctgtga

SEQ ID NO: 6266551 - DNA, 15 bp, Homo sapiens
gcagctgtgcattga

SEQ ID NO: 6266552 - DNA, 14 bp, Homo sapiens
gcagctgtgctgca

SEQ ID NO: 6266553 - DNA, 15 bp, Homo sapiens
gcagctgtgtctgag

SEQ ID NO: 6266554 - DNA, 18 bp, Homo sapiens
gcagctgtgtctgagccc

SEQ ID NO: 6266555 - DNA, 19 bp, Homo sapiens
gcagctgtgtctgagccca

SEQ ID NO: 6266556 - DNA, 23 bp, Homo sapiens
gcagctgtgtttgagtttctggc

SEQ ID NO: 6266557 - DNA, 15 bp, Homo sapiens
gcagctgttgagaaa

SEQ ID NO: 6266558 - DNA, 17 bp, Homo sapiens
gcagctgttgagaaaac

SEQ ID NO: 6266559 - DNA, 16 bp, Homo sapiens
gcagctgtttaaatgt

SEQ ID NO: 6266560 - DNA, 15 bp, Homo sapiens
gcagctgtttctcat

SEQ ID NO: 6266561 - DNA, 15 bp, Homo sapiens
gcagctgtttctgga

SEQ ID NO: 6266562 - DNA, 19 bp, Homo sapiens
gcagcttataatgggctct

SEQ ID NO: 6266563 - DNA, 23 bp, Homo sapiens
gcagcttataatgggctctccgg

SEQ ID NO: 6266564 - DNA, 13 bp, Homo sapiens
gcagcttattgtt

SEQ ID NO: 6266565 - DNA, 15 bp, Homo sapiens
gcagcttcaagtgcc

SEQ ID NO: 6266566 - DNA, 14 bp, Homo sapiens
gcagcttcctgtca

SEQ ID NO: 6266567 - DNA, 15 bp, Homo sapiens
gcagcttccttctgg

SEQ ID NO: 6266568 - DNA, 21 bp, Homo sapiens
gcagcttccttctgggactgg

SEQ ID NO: 6266569 - DNA, 16 bp, Homo sapiens
gcagcttcgaggacag

SEQ ID NO: 6266570 - DNA, 17 bp, Homo sapiens
gcagcttcgaggacagg

SEQ ID NO: 6266571 - DNA, 19 bp, Homo sapiens
gcagcttcgaggacaggaa

SEQ ID NO: 6266572 - DNA, 17 bp, Homo sapiens
gcagcttcggtgtgcag

SEQ ID NO: 6266573 - DNA, 13 bp, Homo sapiens
gcagcttctccag

SEQ ID NO: 6266574 - DNA, 14 bp, Homo sapiens
gcagcttctgccac

SEQ ID NO: 6266575 - DNA, 17 bp, Homo sapiens
gcagcttctgccacttc

SEQ ID NO: 6266576 - DNA, 16 bp, Homo sapiens
gcagcttctgccccct

SEQ ID NO: 6266577 - DNA, 20 bp, Homo sapiens
gcagcttctgccccctgcag

SEQ ID NO: 6266578 - DNA, 22 bp, Homo sapiens
gcagcttctgccccctgcagaa

SEQ ID NO: 6266579 - DNA, 21 bp, Homo sapiens
gcagcttctgttggcagagct

SEQ ID NO: 6266580 - DNA, 13 bp, Homo sapiens
gcagcttcttggg

SEQ ID NO: 6266581 - DNA, 15 bp, Homo sapiens
gcagcttcttgggct

SEQ ID NO: 6266582 - DNA, 24 bp, Homo sapiens
gcagcttcttgggctgagtgcagc

SEQ ID NO: 6266583 - DNA, 18 bp, Homo sapiens
gcagcttgacattatgtt

SEQ ID NO: 6266584 - DNA, 13 bp, Homo sapiens
gcagcttgagcct

SEQ ID NO: 6266585 - DNA, 16 bp, Homo sapiens
gcagcttgagggttgg

SEQ ID NO: 6266586 - DNA, 19 bp, Homo sapiens
gcagcttgagggttgggct

SEQ ID NO: 6266587 - DNA, 12 bp, Homo sapiens
gcagcttgcccc

SEQ ID NO: 6266588 - DNA, 21 bp, Homo sapiens
gcagcttgcgttagaatgagg

SEQ ID NO: 6266589 - DNA, 14 bp, Homo sapiens
gcagcttgctgggc

SEQ ID NO: 6266590 - DNA, 15 bp, Homo sapiens
gcagcttgctgggct

SEQ ID NO: 6266591 - DNA, 22 bp, Homo sapiens
gcagcttgggagagcccctggg

SEQ ID NO: 6266592 - DNA, 14 bp, Homo sapiens
gcagcttgggctgg

SEQ ID NO: 6266593 - DNA, 15 bp, Homo sapiens
gcagcttgggctggc

SEQ ID NO: 6266594 - DNA, 16 bp, Homo sapiens
gcagcttgggctggcg

SEQ ID NO: 6266595 - DNA, 15 bp, Homo sapiens
gcagcttgtagccag

SEQ ID NO: 6266596 - DNA, 16 bp, Homo sapiens
gcagcttgtagccagc

SEQ ID NO: 6266597 - DNA, 22 bp, Homo sapiens
gcagcttgtccttgctcctgga

SEQ ID NO: 6266598 - DNA, 16 bp, Homo sapiens
gcagctttaaaaaaat

SEQ ID NO: 6266599 - DNA, 15 bp, Homo sapiens
gcagctttgctcata

SEQ ID NO: 6266600 - DNA, 16 bp, Homo sapiens
gcagctttgggaaagc

SEQ ID NO: 6266601 - DNA, 22 bp, Homo sapiens
gcagctttgggatcccaccctg

SEQ ID NO: 6266602 - DNA, 23 bp, Homo sapiens
gcagctttgggatcccaccctgg

SEQ ID NO: 6266603 - DNA, 20 bp, Homo sapiens
gcagcttttagttcagactt

SEQ ID NO: 6266604 - DNA, 23 bp, Homo sapiens
gcagcttttgccttggttcttcc

SEQ ID NO: 6266605 - DNA, 21 bp, Homo sapiens
gcagcttttggtctccttggg

SEQ ID NO: 6266606 - DNA, 22 bp, Homo sapiens
gcagcttttggttaatatgtct

SEQ ID NO: 6266607 - DNA, 15 bp, Homo sapiens
gcagctttttctgtg

SEQ ID NO: 6266608 - DNA, 16 bp, Homo sapiens
gcagctttttctgtgg

SEQ ID NO: 6266609 - DNA, 11 bp, Homo sapiens
gcaggaaaaaa

SEQ ID NO: 6266610 - DNA, 12 bp, Homo sapiens
gcaggaaaaaag

SEQ ID NO: 6266611 - DNA, 14 bp, Homo sapiens
gcaggaaaaggcta

SEQ ID NO: 6266612 - DNA, 20 bp, Homo sapiens
gcaggaaacatttctgacac

SEQ ID NO: 6266613 - DNA, 22 bp, Homo sapiens
gcaggaaagcatgcattgaaaa

SEQ ID NO: 6266614 - DNA, 17 bp, Homo sapiens
gcaggaaagccacatct

SEQ ID NO: 6266615 - DNA, 19 bp, Homo sapiens
gcaggaaagccacatcttg

SEQ ID NO: 6266616 - DNA, 12 bp, Homo sapiens
gcaggaaatata

SEQ ID NO: 6266617 - DNA, 23 bp, Homo sapiens
gcaggaaatgaaaatgtcttgtg

SEQ ID NO: 6266618 - DNA, 18 bp, Homo sapiens
gcaggaacaaacagggct

SEQ ID NO: 6266619 - DNA, 15 bp, Homo sapiens
gcaggaacagagact

SEQ ID NO: 6266620 - DNA, 14 bp, Homo sapiens
gcaggaacatacag

SEQ ID NO: 6266621 - DNA, 21 bp, Homo sapiens
gcaggaaccgaggactccagg

SEQ ID NO: 6266622 - DNA, 17 bp, Homo sapiens
gcaggaacctgtactgg

SEQ ID NO: 6266623 - DNA, 14 bp, Homo sapiens
gcaggaacgagcac

SEQ ID NO: 6266624 - DNA, 16 bp, Homo sapiens
gcaggaactcccagca

SEQ ID NO: 6266625 - DNA, 14 bp, Homo sapiens
gcaggaactgagcc

SEQ ID NO: 6266626 - DNA, 16 bp, Homo sapiens
gcaggaactgggctgg

SEQ ID NO: 6266627 - DNA, 15 bp, Homo sapiens
gcaggaagaaacttt

SEQ ID NO: 6266628 - DNA, 13 bp, Homo sapiens
gcaggaagagaga

SEQ ID NO: 6266629 - DNA, 15 bp, Homo sapiens
gcaggaagcaaggcc

SEQ ID NO: 6266630 - DNA, 16 bp, Homo sapiens
gcaggaagcaaggcca

SEQ ID NO: 6266631 - DNA, 20 bp, Homo sapiens
gcaggaagcattcagagagc

SEQ ID NO: 6266632 - DNA, 22 bp, Homo sapiens
gcaggaagccaaagagactggg

SEQ ID NO: 6266633 - DNA, 17 bp, Homo sapiens
gcaggaagctcagactg

SEQ ID NO: 6266634 - DNA, 13 bp, Homo sapiens
gcaggaagctgct

SEQ ID NO: 6266635 - DNA, 15 bp, Homo sapiens
gcaggaagctgctcc

SEQ ID NO: 6266636 - DNA, 21 bp, Homo sapiens
gcaggaaggacaggaagctgg

SEQ ID NO: 6266637 - DNA, 16 bp, Homo sapiens
gcaggaaggaccccac

SEQ ID NO: 6266638 - DNA, 18 bp, Homo sapiens
gcaggaaggaccccacat

SEQ ID NO: 6266639 - DNA, 15 bp, Homo sapiens
gcaggaaggagagcc

SEQ ID NO: 6266640 - DNA, 14 bp, Homo sapiens
gcaggaaggagcgg

SEQ ID NO: 6266641 - DNA, 23 bp, Homo sapiens
gcaggaaggagcggcgccctgga

SEQ ID NO: 6266642 - DNA, 13 bp, Homo sapiens
gcaggaaggagct

SEQ ID NO: 6266643 - DNA, 16 bp, Homo sapiens
gcaggaaggagctgcc

SEQ ID NO: 6266644 - DNA, 18 bp, Homo sapiens
gcaggaaggagctgcctg

SEQ ID NO: 6266645 - DNA, 21 bp, Homo sapiens
gcaggaaggagctgcctggac

SEQ ID NO: 6266646 - DNA, 13 bp, Homo sapiens
gcaggaaggcctg

SEQ ID NO: 6266647 - DNA, 14 bp, Homo sapiens
gcaggaaggcctgg

SEQ ID NO: 6266648 - DNA, 15 bp, Homo sapiens
gcaggaaggcctggg

SEQ ID NO: 6266649 - DNA, 14 bp, Homo sapiens
gcaggaagggaagc

SEQ ID NO: 6266650 - DNA, 15 bp, Homo sapiens
gcaggaagggaagcg

SEQ ID NO: 6266651 - DNA, 16 bp, Homo sapiens
gcaggaagggaagcgt

SEQ ID NO: 6266652 - DNA, 16 bp, Homo sapiens
gcaggaagggtgggaa

SEQ ID NO: 6266653 - DNA, 21 bp, Homo sapiens
gcaggaaggtctcatgcctga

SEQ ID NO: 6266654 - DNA, 17 bp, Homo sapiens
gcaggaagtcaggagcc

SEQ ID NO: 6266655 - DNA, 18 bp, Homo sapiens
gcaggaagtcaggagcca

SEQ ID NO: 6266656 - DNA, 20 bp, Homo sapiens
gcaggaagtcaggagccagc

SEQ ID NO: 6266657 - DNA, 13 bp, Homo sapiens
gcaggaagtccct

SEQ ID NO: 6266658 - DNA, 12 bp, Homo sapiens
gcaggaataaag

SEQ ID NO: 6266659 - DNA, 18 bp, Homo sapiens
gcaggaatcaaggagcct

SEQ ID NO: 6266660 - DNA, 19 bp, Homo sapiens
gcaggaatcaaggagcctc

SEQ ID NO: 6266661 - DNA, 16 bp, Homo sapiens
gcaggaatcacccctc

SEQ ID NO: 6266662 - DNA, 19 bp, Homo sapiens
gcaggaatcacccctctgc

SEQ ID NO: 6266663 - DNA, 21 bp, Homo sapiens
gcaggaatcacccctctgccc

SEQ ID NO: 6266664 - DNA, 20 bp, Homo sapiens
gcaggaatcccggctccaga

SEQ ID NO: 6266665 - DNA, 23 bp, Homo sapiens
gcaggaatcccggctccagagca

SEQ ID NO: 6266666 - DNA, 22 bp, Homo sapiens
gcaggaatgctgacaatgctgc

SEQ ID NO: 6266667 - DNA, 10 bp, Homo sapiens
gcaggaatgg

SEQ ID NO: 6266668 - DNA, 17 bp, Homo sapiens
gcaggaatgggggtcag

SEQ ID NO: 6266669 - DNA, 18 bp, Homo sapiens
gcaggaattggtggcaga

SEQ ID NO: 6266670 - DNA, 17 bp, Homo sapiens
gcaggacaacgaggaag

SEQ ID NO: 6266671 - DNA, 20 bp, Homo sapiens
gcaggacacatcccggcctc

SEQ ID NO: 6266672 - DNA, 15 bp, Homo sapiens
gcaggacagccagca

SEQ ID NO: 6266673 - DNA, 17 bp, Homo sapiens
gcaggacagctcttgat

SEQ ID NO: 6266674 - DNA, 13 bp, Homo sapiens
gcaggacaggagg

SEQ ID NO: 6266675 - DNA, 19 bp, Homo sapiens
gcaggacaggaggcggccc

SEQ ID NO: 6266676 - DNA, 13 bp, Homo sapiens
gcaggacattaat

SEQ ID NO: 6266677 - DNA, 15 bp, Homo sapiens
gcaggaccaaggggg

SEQ ID NO: 6266678 - DNA, 23 bp, Homo sapiens
gcaggaccactagctaagcaagc

SEQ ID NO: 6266679 - DNA, 14 bp, Homo sapiens
gcaggaccagaagg

SEQ ID NO: 6266680 - DNA, 18 bp, Homo sapiens
gcaggaccagcccacgct

SEQ ID NO: 6266681 - DNA, 13 bp, Homo sapiens
gcaggaccaggca

SEQ ID NO: 6266682 - DNA, 16 bp, Homo sapiens
gcaggaccaggtggca

SEQ ID NO: 6266683 - DNA, 23 bp, Homo sapiens
gcaggaccagtttgattgaggag

SEQ ID NO: 6266684 - DNA, 11 bp, Homo sapiens
gcaggaccctg

SEQ ID NO: 6266685 - DNA, 15 bp, Homo sapiens
gcaggaccctgctga

SEQ ID NO: 6266686 - DNA, 16 bp, Homo sapiens
gcaggaccctgctgac

SEQ ID NO: 6266687 - DNA, 17 bp, Homo sapiens
gcaggaccctgctgact

SEQ ID NO: 6266688 - DNA, 12 bp, Homo sapiens
gcaggaccctgt

SEQ ID NO: 6266689 - DNA, 18 bp, Homo sapiens
gcaggaccctgtcctgca

SEQ ID NO: 6266690 - DNA, 11 bp, Homo sapiens
gcaggacctca

SEQ ID NO: 6266691 - DNA, 14 bp, Homo sapiens
gcaggacctcagag

SEQ ID NO: 6266692 - DNA, 22 bp, Homo sapiens
gcaggacctcccttccgaccct

SEQ ID NO: 6266693 - DNA, 13 bp, Homo sapiens
gcaggacctgcct

SEQ ID NO: 6266694 - DNA, 15 bp, Homo sapiens
gcaggacctgcctag

SEQ ID NO: 6266695 - DNA, 21 bp, Homo sapiens
gcaggacctgcctagcatggg

SEQ ID NO: 6266696 - DNA, 22 bp, Homo sapiens
gcaggacctgcctagcatgggg

SEQ ID NO: 6266697 - DNA, 15 bp, Homo sapiens
gcaggacctgcctgt

SEQ ID NO: 6266698 - DNA, 22 bp, Homo sapiens
gcaggacctggcatcatggtgg

SEQ ID NO: 6266699 - DNA, 17 bp, Homo sapiens
gcaggacctgtgctttg

SEQ ID NO: 6266700 - DNA, 21 bp, Homo sapiens
gcaggaccttcgggctgtgcc

SEQ ID NO: 6266701 - DNA, 16 bp, Homo sapiens
gcaggacgagactcct

SEQ ID NO: 6266702 - DNA, 17 bp, Homo sapiens
gcaggacgttaggcccg

SEQ ID NO: 6266703 - DNA, 21 bp, Homo sapiens
gcaggactaacaactgggaaa

SEQ ID NO: 6266704 - DNA, 18 bp, Homo sapiens
gcaggactaggcatgtca

SEQ ID NO: 6266705 - DNA, 17 bp, Homo sapiens
gcaggactccaggccca

SEQ ID NO: 6266706 - DNA, 22 bp, Homo sapiens
gcaggactccaggcccaaggct

SEQ ID NO: 6266707 - DNA, 16 bp, Homo sapiens
gcaggactcccaccta

SEQ ID NO: 6266708 - DNA, 15 bp, Homo sapiens
gcaggactcctggca

SEQ ID NO: 6266709 - DNA, 21 bp, Homo sapiens
gcaggactctatccctggctt

SEQ ID NO: 6266710 - DNA, 18 bp, Homo sapiens
gcaggactgaggacaggc

SEQ ID NO: 6266711 - DNA, 13 bp, Homo sapiens
gcaggactgcaga

SEQ ID NO: 6266712 - DNA, 14 bp, Homo sapiens
gcaggactgtgcct

SEQ ID NO: 6266713 - DNA, 15 bp, Homo sapiens
gcaggactgttgtgg

SEQ ID NO: 6266714 - DNA, 14 bp, Homo sapiens
gcaggagaatcact

SEQ ID NO: 6266715 - DNA, 20 bp, Homo sapiens
gcaggagaatcactgcagcc

SEQ ID NO: 6266716 - DNA, 22 bp, Homo sapiens
gcaggagaatcactgcagccca

SEQ ID NO: 6266717 - DNA, 22 bp, Homo sapiens
gcaggagaatcacttgcactcc

SEQ ID NO: 6266718 - DNA, 17 bp, Homo sapiens
gcaggagaatcagcctg

SEQ ID NO: 6266719 - DNA, 19 bp, Homo sapiens
gctgacagcactaaacttg

SEQ ID NO: 6266720 - DNA, 14 bp, Homo sapiens
gctgacagccacac

SEQ ID NO: 6266721 - DNA, 23 bp, Homo sapiens
gctgacagccacaccgtggcagc

SEQ ID NO: 6266722 - DNA, 18 bp, Homo sapiens
gctgacagcctcctaggc

SEQ ID NO: 6266723 - DNA, 20 bp, Homo sapiens
gctgacaggtgatgctctgg

SEQ ID NO: 6266724 - DNA, 13 bp, Homo sapiens
gctgacagtcagc

SEQ ID NO: 6266725 - DNA, 16 bp, Homo sapiens
gctgacagtcagctgt

SEQ ID NO: 6266726 - DNA, 12 bp, Homo sapiens
gctgacagtcct

SEQ ID NO: 6266727 - DNA, 16 bp, Homo sapiens
gctgacagtcctctcc

SEQ ID NO: 6266728 - DNA, 19 bp, Homo sapiens
gctgacagtcctctccacc

SEQ ID NO: 6266729 - DNA, 19 bp, Homo sapiens
gctgacagtttgtggcatc

SEQ ID NO: 6266730 - DNA, 20 bp, Homo sapiens
gctgacatcaagtgtaatta

SEQ ID NO: 6266731 - DNA, 14 bp, Homo sapiens
gctgacatcatttg

SEQ ID NO: 6266732 - DNA, 14 bp, Homo sapiens
gctgacatctcctc

SEQ ID NO: 6266733 - DNA, 14 bp, Homo sapiens
gctgacatgctcac

SEQ ID NO: 6266734 - DNA, 19 bp, Homo sapiens
gctgacatggctctggact

SEQ ID NO: 6266735 - DNA, 14 bp, Homo sapiens
gctgaccaagagag

SEQ ID NO: 6266736 - DNA, 15 bp, Homo sapiens
gctgaccaattgtgc

SEQ ID NO: 6266737 - DNA, 21 bp, Homo sapiens
gctgaccaattgtgctgccat

SEQ ID NO: 6266738 - DNA, 13 bp, Homo sapiens
gctgaccacagca

SEQ ID NO: 6266739 - DNA, 14 bp, Homo sapiens
gctgaccacagcac

SEQ ID NO: 6266740 - DNA, 19 bp, Homo sapiens
gctgaccacagcacagcca

SEQ ID NO: 6266741 - DNA, 19 bp, Homo sapiens
gctgaccagaagtggcagg

SEQ ID NO: 6266742 - DNA, 12 bp, Homo sapiens
gctgaccagaca

SEQ ID NO: 6266743 - DNA, 13 bp, Homo sapiens
gctgaccagctgg

SEQ ID NO: 6266744 - DNA, 13 bp, Homo sapiens
gctgaccaggccc

SEQ ID NO: 6266745 - DNA, 16 bp, Homo sapiens
gctgaccaggccctgc

SEQ ID NO: 6266746 - DNA, 20 bp, Homo sapiens
gctgaccataacagtgccag

SEQ ID NO: 6266747 - DNA, 15 bp, Homo sapiens
gctgacccaccaagg

SEQ ID NO: 6266748 - DNA, 22 bp, Homo sapiens
gctgacccagccccttgagaaa

SEQ ID NO: 6266749 - DNA, 16 bp, Homo sapiens
gctgacccagtccctg

SEQ ID NO: 6266750 - DNA, 17 bp, Homo sapiens
gctgacccagtccctgg

SEQ ID NO: 6266751 - DNA, 19 bp, Homo sapiens
gctgacccagtccctgggg

SEQ ID NO: 6266752 - DNA, 21 bp, Homo sapiens
gctgacccagtgtgtgctcag

SEQ ID NO: 6266753 - DNA, 22 bp, Homo sapiens
gctgacccagtgtgtgctcagc

SEQ ID NO: 6266754 - DNA, 14 bp, Homo sapiens
gctgaccccaggaa

SEQ ID NO: 6266755 - DNA, 19 bp, Homo sapiens
gctgaccccaggtcagccc

SEQ ID NO: 6266756 - DNA, 13 bp, Homo sapiens
gctgacccccctc

SEQ ID NO: 6266757 - DNA, 12 bp, Homo sapiens
gctgacccctct

SEQ ID NO: 6266758 - DNA, 18 bp, Homo sapiens
gctgacccctctggtgtg

SEQ ID NO: 6266759 - DNA, 15 bp, Homo sapiens
gctgacccctgtgtg

SEQ ID NO: 6266760 - DNA, 22 bp, Homo sapiens
gctgaccctcctgttgcaccca

SEQ ID NO: 6266761 - DNA, 16 bp, Homo sapiens
gctgaccctgggcctg

SEQ ID NO: 6266762 - DNA, 15 bp, Homo sapiens
gctgaccctgtgccc

SEQ ID NO: 6266763 - DNA, 15 bp, Homo sapiens
gctgacccttttctg

SEQ ID NO: 6266764 - DNA, 23 bp, Homo sapiens
gctgacctagaccagtttgcatg

SEQ ID NO: 6266765 - DNA, 16 bp, Homo sapiens
gctgacctcactgtcc

SEQ ID NO: 6266766 - DNA, 17 bp, Homo sapiens
gctgacctcccagcctt

SEQ ID NO: 6266767 - DNA, 13 bp, Homo sapiens
gctgacctctggt

SEQ ID NO: 6266768 - DNA, 22 bp, Homo sapiens
gctgacctctgttgtcctcccc

SEQ ID NO: 6266769 - DNA, 13 bp, Homo sapiens
gctgacctgacct

SEQ ID NO: 6266770 - DNA, 15 bp, Homo sapiens
gctgacctgcctctc

SEQ ID NO: 6266771 - DNA, 22 bp, Homo sapiens
gctgacctgcctctcacacaca

SEQ ID NO: 6266772 - DNA, 13 bp, Homo sapiens
gctgacctgggcc

SEQ ID NO: 6266773 - DNA, 19 bp, Homo sapiens
gctgaccttcctcgcagag

SEQ ID NO: 6266774 - DNA, 20 bp, Homo sapiens
gctgaccttgaactcctggg

SEQ ID NO: 6266775 - DNA, 23 bp, Homo sapiens
gctgaccttgaactcctgggctc

SEQ ID NO: 6266776 - DNA, 17 bp, Homo sapiens
gctgacgaacttccatg

SEQ ID NO: 6266777 - DNA, 15 bp, Homo sapiens
gctgacgcttccctt

SEQ ID NO: 6266778 - DNA, 15 bp, Homo sapiens
gctgacggccaggga

SEQ ID NO: 6266779 - DNA, 18 bp, Homo sapiens
gctgacgggaggccccag

SEQ ID NO: 6266780 - DNA, 20 bp, Homo sapiens
gctgacgggaggccccagct

SEQ ID NO: 6266781 - DNA, 22 bp, Homo sapiens
gctgacgggaggccccagctct

SEQ ID NO: 6266782 - DNA, 24 bp, Homo sapiens
gctgacgggaggccccagctctga

SEQ ID NO: 6266783 - DNA, 15 bp, Homo sapiens
gctgacggtttctcc

SEQ ID NO: 6266784 - DNA, 15 bp, Homo sapiens
gctgacgtgtgaggg

SEQ ID NO: 6266785 - DNA, 16 bp, Homo sapiens
gctgacgttccgggca

SEQ ID NO: 6266786 - DNA, 20 bp, Homo sapiens
gctgactactactctgccaa

SEQ ID NO: 6266787 - DNA, 21 bp, Homo sapiens
gctgactatttgacccccaca

SEQ ID NO: 6266788 - DNA, 23 bp, Homo sapiens
gctgactatttgacccccacaac

SEQ ID NO: 6266789 - DNA, 17 bp, Homo sapiens
gctgactcacacctgaa

SEQ ID NO: 6266790 - DNA, 13 bp, Homo sapiens
gctgactcctggt

SEQ ID NO: 6266791 - DNA, 14 bp, Homo sapiens
gctgactcctggtc

SEQ ID NO: 6266792 - DNA, 23 bp, Homo sapiens
gctgactctaggtgcccttggag

SEQ ID NO: 6266793 - DNA, 15 bp, Homo sapiens
gctgactctctgagc

SEQ ID NO: 6266794 - DNA, 23 bp, Homo sapiens
gctgactctctgagctggggagg

SEQ ID NO: 6266795 - DNA, 14 bp, Homo sapiens
gctgactcttacta

SEQ ID NO: 6266796 - DNA, 12 bp, Homo sapiens
gctgactgaggc

SEQ ID NO: 6266797 - DNA, 15 bp, Homo sapiens
gctgactgaggcctg

SEQ ID NO: 6266798 - DNA, 16 bp, Homo sapiens
gctgactgaggcctgc

SEQ ID NO: 6266799 - DNA, 17 bp, Homo sapiens
gctgactgaggcctgct

SEQ ID NO: 6266800 - DNA, 22 bp, Homo sapiens
gctgactgccaataacattctt

SEQ ID NO: 6266801 - DNA, 17 bp, Homo sapiens
gctgactggatgtccag

SEQ ID NO: 6266802 - DNA, 20 bp, Homo sapiens
gctgactggccccagggact

SEQ ID NO: 6266803 - DNA, 14 bp, Homo sapiens
gctgactgggccac

SEQ ID NO: 6266804 - DNA, 13 bp, Homo sapiens
gctgactggggct

SEQ ID NO: 6266805 - DNA, 13 bp, Homo sapiens
gctgactgggggc

SEQ ID NO: 6266806 - DNA, 18 bp, Homo sapiens
gctgactgggggcctctg

SEQ ID NO: 6266807 - DNA, 19 bp, Homo sapiens
gctgactgggggcctctgc

SEQ ID NO: 6266808 - DNA, 23 bp, Homo sapiens
gctgactgggggcctctgcctcc

SEQ ID NO: 6266809 - DNA, 18 bp, Homo sapiens
gctgactggtttctcctg

SEQ ID NO: 6266810 - DNA, 19 bp, Homo sapiens
gctgactgtactcctccca

SEQ ID NO: 6266811 - DNA, 21 bp, Homo sapiens
gctgactgtactcctcccagg

SEQ ID NO: 6266812 - DNA, 14 bp, Homo sapiens
gctgactgtagctt

SEQ ID NO: 6266813 - DNA, 18 bp, Homo sapiens
gctgactgtcctctcccc

SEQ ID NO: 6266814 - DNA, 23 bp, Homo sapiens
gctgactgtcctctcccctccag

SEQ ID NO: 6266815 - DNA, 13 bp, Homo sapiens
gctgactgtggcc

SEQ ID NO: 6266816 - DNA, 22 bp, Homo sapiens
gctgactgttttctcttgagag

SEQ ID NO: 6266817 - DNA, 13 bp, Homo sapiens
gctgacttagaat

SEQ ID NO: 6266818 - DNA, 13 bp, Homo sapiens
gctgacttcactt

SEQ ID NO: 6266819 - DNA, 20 bp, Homo sapiens
gctgacttcacttattagtc

SEQ ID NO: 6266820 - DNA, 15 bp, Homo sapiens
gctgacttctccagg

SEQ ID NO: 6266821 - DNA, 16 bp, Homo sapiens
gctgacttctccagga

SEQ ID NO: 6266822 - DNA, 14 bp, Homo sapiens
gctgacttctctga

SEQ ID NO: 6266823 - DNA, 15 bp, Homo sapiens
gctgacttctctgaa

SEQ ID NO: 6266824 - DNA, 15 bp, Homo sapiens
gctgacttgcagacg

SEQ ID NO: 6266825 - DNA, 18 bp, Homo sapiens
gctgacttggctggtgtg

SEQ ID NO: 6266826 - DNA, 19 bp, Homo sapiens
gctgacttggttctgaagc

SEQ ID NO: 6266827 - DNA, 20 bp, Homo sapiens
gctgactttaaaaggattaa

SEQ ID NO: 6266828 - DNA, 15 bp, Homo sapiens
gctgacttttccaaa

SEQ ID NO: 6266829 - DNA, 21 bp, Homo sapiens
gctgagaaaagtattctcaaa

SEQ ID NO: 6266830 - DNA, 14 bp, Homo sapiens
gctgagaacactgt

SEQ ID NO: 6266831 - DNA, 14 bp, Homo sapiens
gctgagaacctggc

SEQ ID NO: 6266832 - DNA, 17 bp, Homo sapiens
gctgagaactcctgact

SEQ ID NO: 6266833 - DNA, 12 bp, Homo sapiens
gctgagaagaag

SEQ ID NO: 6266834 - DNA, 14 bp, Homo sapiens
gctgagaagaagct

SEQ ID NO: 6266835 - DNA, 15 bp, Homo sapiens
gctgagaagaagctg

SEQ ID NO: 6266836 - DNA, 20 bp, Homo sapiens
gctgagaagaagctgaggat

SEQ ID NO: 6266837 - DNA, 21 bp, Homo sapiens
gctgagaaggcaaactgaggc

SEQ ID NO: 6266838 - DNA, 13 bp, Homo sapiens
gctgagaaggcag

SEQ ID NO: 6266839 - DNA, 14 bp, Homo sapiens
gctgagaaggcagt

SEQ ID NO: 6266840 - DNA, 16 bp, Homo sapiens
gctgagaatagaagga

SEQ ID NO: 6266841 - DNA, 14 bp, Homo sapiens
gctgagaccttgct

SEQ ID NO: 6266842 - DNA, 21 bp, Homo sapiens
gctgagactgcagaggagcca

SEQ ID NO: 6266843 - DNA, 15 bp, Homo sapiens
gctgagactgtgctg

SEQ ID NO: 6266844 - DNA, 22 bp, Homo sapiens
gctgagacttacgccctgttcc

SEQ ID NO: 6266845 - DNA, 15 bp, Homo sapiens
gctgagagaaaataa

SEQ ID NO: 6266846 - DNA, 19 bp, Homo sapiens
gctgagagaccaggagggc

SEQ ID NO: 6266847 - DNA, 14 bp, Homo sapiens
gctgagagacccaa

SEQ ID NO: 6266848 - DNA, 22 bp, Homo sapiens
gctgagagacccaaggaggaaa

SEQ ID NO: 6266849 - DNA, 20 bp, Homo sapiens
gctgagagccagatgcctcc

SEQ ID NO: 6266850 - DNA, 13 bp, Homo sapiens
gctgagagcccca

SEQ ID NO: 6266851 - DNA, 13 bp, Homo sapiens
gctgagagccctg

SEQ ID NO: 6266852 - DNA, 17 bp, Homo sapiens
gctgagagccctgctgt

SEQ ID NO: 6266853 - DNA, 16 bp, Homo sapiens
gctgagaggaagatga

SEQ ID NO: 6266854 - DNA, 22 bp, Homo sapiens
gctgagaggaagatgaagagaa

SEQ ID NO: 6266855 - DNA, 16 bp, Homo sapiens
gctgagaggagagaga

SEQ ID NO: 6266856 - DNA, 21 bp, Homo sapiens
gctgagaggcaccagtccagc

SEQ ID NO: 6266857 - DNA, 16 bp, Homo sapiens
gctgagaggctgcctc

SEQ ID NO: 6266858 - DNA, 19 bp, Homo sapiens
gctgagaggctgcctccgc

SEQ ID NO: 6266859 - DNA, 20 bp, Homo sapiens
gctgagaggctgcctccgca

SEQ ID NO: 6266860 - DNA, 19 bp, Homo sapiens
gctgagagggtgtgggtgc

SEQ ID NO: 6266861 - DNA, 21 bp, Homo sapiens
gctgagagtctgaaagacaga

SEQ ID NO: 6266862 - DNA, 22 bp, Homo sapiens
gctgagagtctgaaagacagaa

SEQ ID NO: 6266863 - DNA, 14 bp, Homo sapiens
gctgagagtggggc

SEQ ID NO: 6266864 - DNA, 23 bp, Homo sapiens
gctgagatcacaccactgtactc

SEQ ID NO: 6266865 - DNA, 14 bp, Homo sapiens
gctgagatcctgga

SEQ ID NO: 6266866 - DNA, 16 bp, Homo sapiens
gctgagatcgaagagg

SEQ ID NO: 6266867 - DNA, 21 bp, Homo sapiens
gctgagatgcaccaagtacag

SEQ ID NO: 6266868 - DNA, 22 bp, Homo sapiens
gctgagcaaagttcagcaagta

SEQ ID NO: 6266869 - DNA, 21 bp, Homo sapiens
gctgagcaaatattaaaattg

SEQ ID NO: 6266870 - DNA, 18 bp, Homo sapiens
gctgagcaaatcaccaca

SEQ ID NO: 6266871 - DNA, 17 bp, Homo sapiens
gctgagcaacctcttca

SEQ ID NO: 6266872 - DNA, 21 bp, Homo sapiens
gctgagcaacctcttcagctg

SEQ ID NO: 6266873 - DNA, 14 bp, Homo sapiens
gctgagcacatctc

SEQ ID NO: 6266874 - DNA, 14 bp, Homo sapiens
gctgagcagcccag

SEQ ID NO: 6266875 - DNA, 12 bp, Homo sapiens
gctgagcagcct

SEQ ID NO: 6266876 - DNA, 20 bp, Homo sapiens
gctgagcagcctctggacag

SEQ ID NO: 6266877 - DNA, 21 bp, Homo sapiens
gctgagcaggacagccagcag

SEQ ID NO: 6266878 - DNA, 22 bp, Homo sapiens
gctgagcaggacgttaggcccg

SEQ ID NO: 6266879 - DNA, 21 bp, Homo sapiens
gctgagcatggagacagcagt

SEQ ID NO: 6266880 - DNA, 19 bp, Homo sapiens
gctgagcatggggcgctcc

SEQ ID NO: 6266881 - DNA, 13 bp, Homo sapiens
gctgagccaaagc

SEQ ID NO: 6266882 - DNA, 15 bp, Homo sapiens
gctgagccactcgca

SEQ ID NO: 6266883 - DNA, 17 bp, Homo sapiens
gctgagccagctgcaga

SEQ ID NO: 6266884 - DNA, 15 bp, Homo sapiens
gctgagcccagccac

SEQ ID NO: 6266885 - DNA, 14 bp, Homo sapiens
gctgagcccctacc

SEQ ID NO: 6266886 - DNA, 20 bp, Homo sapiens
gctgagcccctaccccacac

SEQ ID NO: 6266887 - DNA, 13 bp, Homo sapiens
gctgagcccctgg

SEQ ID NO: 6266888 - DNA, 16 bp, Homo sapiens
gctgagcccctgggga

SEQ ID NO: 6266889 - DNA, 22 bp, Homo sapiens
gctgagcccctgtctagagagg

SEQ ID NO: 6266890 - DNA, 19 bp, Homo sapiens
gctgagccctcctgagggc

SEQ ID NO: 6266891 - DNA, 13 bp, Homo sapiens
gctgagccctgcc

SEQ ID NO: 6266892 - DNA, 16 bp, Homo sapiens
gctgagccctgcccca

SEQ ID NO: 6266893 - DNA, 15 bp, Homo sapiens
gctgagccctggcag

SEQ ID NO: 6266894 - DNA, 13 bp, Homo sapiens
gctgagccctggg

SEQ ID NO: 6266895 - DNA, 18 bp, Homo sapiens
gctgagccgatctggtct

SEQ ID NO: 6266896 - DNA, 19 bp, Homo sapiens
gctgagcctactgtctcct

SEQ ID NO: 6266897 - DNA, 19 bp, Homo sapiens
gctgagcctcacagcagtg

SEQ ID NO: 6266898 - DNA, 21 bp, Homo sapiens
gctgagcctcacagcagtgag

SEQ ID NO: 6266899 - DNA, 23 bp, Homo sapiens
gcaggagaatcgcttgaacctgg

SEQ ID NO: 6266900 - DNA, 22 bp, Homo sapiens
gcaggagagactgagcagccgc

SEQ ID NO: 6266901 - DNA, 21 bp, Homo sapiens
gcaggagagagagagagaaag

SEQ ID NO: 6266902 - DNA, 23 bp, Homo sapiens
gcaggagagagagagagaaagaa

SEQ ID NO: 6266903 - DNA, 18 bp, Homo sapiens
gcaggagaggagagccag

SEQ ID NO: 6266904 - DNA, 20 bp, Homo sapiens
gcaggagaggagagccagag

SEQ ID NO: 6266905 - DNA, 18 bp, Homo sapiens
gcaggagaggctgggctg

SEQ ID NO: 6266906 - DNA, 14 bp, Homo sapiens
gcaggagattgaga

SEQ ID NO: 6266907 - DNA, 13 bp, Homo sapiens
gcaggagcagaaa

SEQ ID NO: 6266908 - DNA, 15 bp, Homo sapiens
gcaggagcagaaaga

SEQ ID NO: 6266909 - DNA, 17 bp, Homo sapiens
gcaggagcagctgtgct

SEQ ID NO: 6266910 - DNA, 16 bp, Homo sapiens
gcaggagcaggaacag

SEQ ID NO: 6266911 - DNA, 21 bp, Homo sapiens
gcaggagcaggaacagagact

SEQ ID NO: 6266912 - DNA, 14 bp, Homo sapiens
gcaggagcagggcg

SEQ ID NO: 6266913 - DNA, 17 bp, Homo sapiens
gcaggagcagggcggct

SEQ ID NO: 6266914 - DNA, 13 bp, Homo sapiens
gcaggagcagtat

SEQ ID NO: 6266915 - DNA, 24 bp, Homo sapiens
gcaggagcatgtatgtctgcaggt

SEQ ID NO: 6266916 - DNA, 14 bp, Homo sapiens
gcaggagcccccct

SEQ ID NO: 6266917 - DNA, 14 bp, Homo sapiens
gcaggagcctagag

SEQ ID NO: 6266918 - DNA, 15 bp, Homo sapiens
gcaggagcctagagg

SEQ ID NO: 6266919 - DNA, 18 bp, Homo sapiens
gcaggagcctagaggagg

SEQ ID NO: 6266920 - DNA, 19 bp, Homo sapiens
gcaggagcctagaggagga

SEQ ID NO: 6266921 - DNA, 14 bp, Homo sapiens
gcaggagcctccct

SEQ ID NO: 6266922 - DNA, 24 bp, Homo sapiens
gcaggagcctccctgcacggccca

SEQ ID NO: 6266923 - DNA, 20 bp, Homo sapiens
gcaggagcctcgtgtcctgc

SEQ ID NO: 6266924 - DNA, 14 bp, Homo sapiens
gcaggagcctgagc

SEQ ID NO: 6266925 - DNA, 21 bp, Homo sapiens
gcaggagctactgagaacata

SEQ ID NO: 6266926 - DNA, 22 bp, Homo sapiens
gcaggagctagttctcagcttg

SEQ ID NO: 6266927 - DNA, 13 bp, Homo sapiens
gcaggagctcaga

SEQ ID NO: 6266928 - DNA, 16 bp, Homo sapiens
gcaggagctcctggaa

SEQ ID NO: 6266929 - DNA, 12 bp, Homo sapiens
gcaggagctgct

SEQ ID NO: 6266930 - DNA, 22 bp, Homo sapiens
gcaggagctgtggaaatggtga

SEQ ID NO: 6266931 - DNA, 15 bp, Homo sapiens
gcaggagcttggcag

SEQ ID NO: 6266932 - DNA, 13 bp, Homo sapiens
gcaggagcttggg

SEQ ID NO: 6266933 - DNA, 20 bp, Homo sapiens
gcaggagcttgggtctctct

SEQ ID NO: 6266934 - DNA, 14 bp, Homo sapiens
gcaggaggaaaggg

SEQ ID NO: 6266935 - DNA, 23 bp, Homo sapiens
gcaggaggacagagtgccctggg

SEQ ID NO: 6266936 - DNA, 17 bp, Homo sapiens
gcaggaggacaggtgga

SEQ ID NO: 6266937 - DNA, 14 bp, Homo sapiens
gcaggaggaggtgc

SEQ ID NO: 6266938 - DNA, 14 bp, Homo sapiens
gcaggaggcacagc

SEQ ID NO: 6266939 - DNA, 16 bp, Homo sapiens
gcaggaggcacagcag

SEQ ID NO: 6266940 - DNA, 15 bp, Homo sapiens
gcaggaggcaggata

SEQ ID NO: 6266941 - DNA, 21 bp, Homo sapiens
gcaggaggccaaactgtccct

SEQ ID NO: 6266942 - DNA, 22 bp, Homo sapiens
gcaggaggccaataaaaagttc

SEQ ID NO: 6266943 - DNA, 15 bp, Homo sapiens
gcaggaggccaggcc

SEQ ID NO: 6266944 - DNA, 12 bp, Homo sapiens
gcaggaggcccc

SEQ ID NO: 6266945 - DNA, 16 bp, Homo sapiens
gcaggaggccccaggc

SEQ ID NO: 6266946 - DNA, 24 bp, Homo sapiens
gcaggaggccccaggctgagagcc

SEQ ID NO: 6266947 - DNA, 14 bp, Homo sapiens
gcaggaggcccctg

SEQ ID NO: 6266948 - DNA, 16 bp, Homo sapiens
gcaggaggcccctggc

SEQ ID NO: 6266949 - DNA, 12 bp, Homo sapiens
gcaggaggcctg

SEQ ID NO: 6266950 - DNA, 15 bp, Homo sapiens
gcaggaggcctggcc

SEQ ID NO: 6266951 - DNA, 17 bp, Homo sapiens
gcaggaggctcaggtga

SEQ ID NO: 6266952 - DNA, 21 bp, Homo sapiens
gcaggaggctttctgggctct

SEQ ID NO: 6266953 - DNA, 22 bp, Homo sapiens
gcaggaggctttctgggctctg

SEQ ID NO: 6266954 - DNA, 23 bp, Homo sapiens
gcaggaggctttctgggctctgg

SEQ ID NO: 6266955 - DNA, 18 bp, Homo sapiens
gcaggagggaaggacaga

SEQ ID NO: 6266956 - DNA, 19 bp, Homo sapiens
gcaggagggaaggacagac

SEQ ID NO: 6266957 - DNA, 15 bp, Homo sapiens
gcaggagggactctg

SEQ ID NO: 6266958 - DNA, 22 bp, Homo sapiens
gcaggagggaggcggggaggag

SEQ ID NO: 6266959 - DNA, 14 bp, Homo sapiens
gcaggagggcactg

SEQ ID NO: 6266960 - DNA, 14 bp, Homo sapiens
gcaggagggcagat

SEQ ID NO: 6266961 - DNA, 22 bp, Homo sapiens
gcaggagggccctacctgattg

SEQ ID NO: 6266962 - DNA, 15 bp, Homo sapiens
gcaggagggtggcac

SEQ ID NO: 6266963 - DNA, 13 bp, Homo sapiens
gcaggaggtgcct

SEQ ID NO: 6266964 - DNA, 15 bp, Homo sapiens
gcaggaggtgcctga

SEQ ID NO: 6266965 - DNA, 14 bp, Homo sapiens
gcaggaggtggaga

SEQ ID NO: 6266966 - DNA, 15 bp, Homo sapiens
gcaggaggtgggtga

SEQ ID NO: 6266967 - DNA, 14 bp, Homo sapiens
gcaggagtagctga

SEQ ID NO: 6266968 - DNA, 17 bp, Homo sapiens
gcaggagtagctgagct

SEQ ID NO: 6266969 - DNA, 23 bp, Homo sapiens
gcaggagtctctgccacccactc

SEQ ID NO: 6266970 - DNA, 12 bp, Homo sapiens
gcaggagtgcca

SEQ ID NO: 6266971 - DNA, 13 bp, Homo sapiens
gcaggagtgccag

SEQ ID NO: 6266972 - DNA, 19 bp, Homo sapiens
gcaggagtgccaggaccag

SEQ ID NO: 6266973 - DNA, 21 bp, Homo sapiens
gcaggagtgccaggaccagcc

SEQ ID NO: 6266974 - DNA, 23 bp, Homo sapiens
gcaggagtgccaggaccagcctg

SEQ ID NO: 6266975 - DNA, 17 bp, Homo sapiens
gcaggagtgggctctga

SEQ ID NO: 6266976 - DNA, 22 bp, Homo sapiens
gcaggagtgtcctgcccatgcc

SEQ ID NO: 6266977 - DNA, 17 bp, Homo sapiens
gcaggagttgggggcag

SEQ ID NO: 6266978 - DNA, 18 bp, Homo sapiens
gcaggagttgggggcagg

SEQ ID NO: 6266979 - DNA, 22 bp, Homo sapiens
gcaggagttgggggcaggtcag

SEQ ID NO: 6266980 - DNA, 17 bp, Homo sapiens
gcaggatccctcctgag

SEQ ID NO: 6266981 - DNA, 18 bp, Homo sapiens
gcaggatccctcctgagc

SEQ ID NO: 6266982 - DNA, 20 bp, Homo sapiens
gcaggatccctcctgagctc

SEQ ID NO: 6266983 - DNA, 18 bp, Homo sapiens
gcaggatccgctgccacc

SEQ ID NO: 6266984 - DNA, 16 bp, Homo sapiens
gcaggatctcaagcca

SEQ ID NO: 6266985 - DNA, 18 bp, Homo sapiens
gcaggatctcaagccagc

SEQ ID NO: 6266986 - DNA, 20 bp, Homo sapiens
gcaggatctcagatcactgc

SEQ ID NO: 6266987 - DNA, 15 bp, Homo sapiens
gcaggatctgcccac

SEQ ID NO: 6266988 - DNA, 18 bp, Homo sapiens
gcaggatctgtctgtgca

SEQ ID NO: 6266989 - DNA, 20 bp, Homo sapiens
gcaggatgaattttctgcag

SEQ ID NO: 6266990 - DNA, 21 bp, Homo sapiens
gcaggatgaccacgcacctcc

SEQ ID NO: 6266991 - DNA, 18 bp, Homo sapiens
gcaggatgattgtacaga

SEQ ID NO: 6266992 - DNA, 16 bp, Homo sapiens
gcaggatgctcagtga

SEQ ID NO: 6266993 - DNA, 24 bp, Homo sapiens
gcaggatggcctggccagggcctg

SEQ ID NO: 6266994 - DNA, 14 bp, Homo sapiens
gcaggatggccttt

SEQ ID NO: 6266995 - DNA, 21 bp, Homo sapiens
gcaggatggcctttccttccc

SEQ ID NO: 6266996 - DNA, 14 bp, Homo sapiens
gcaggatgggctga

SEQ ID NO: 6266997 - DNA, 15 bp, Homo sapiens
gcaggatgggctgag

SEQ ID NO: 6266998 - DNA, 22 bp, Homo sapiens
gcaggatgggtgaaaccacatg

SEQ ID NO: 6266999 - DNA, 15 bp, Homo sapiens
gcaggattcccttct

SEQ ID NO: 6267000 - DNA, 17 bp, Homo sapiens
gcaggattctctgcagc

SEQ ID NO: 6267001 - DNA, 18 bp, Homo sapiens
gcaggattctctgcagcc

SEQ ID NO: 6267002 - DNA, 17 bp, Homo sapiens
gcaggattctgcagctg

SEQ ID NO: 6267003 - DNA, 14 bp, Homo sapiens
gcaggatttagccc

SEQ ID NO: 6267004 - DNA, 16 bp, Homo sapiens
gcaggatttgttctct

SEQ ID NO: 6267005 - DNA, 22 bp, Homo sapiens
gcaggatttgttctctgtccag

SEQ ID NO: 6267006 - DNA, 18 bp, Homo sapiens
gcaggcaaaaaagggaca

SEQ ID NO: 6267007 - DNA, 18 bp, Homo sapiens
gcaggcacacacgccttc

SEQ ID NO: 6267008 - DNA, 16 bp, Homo sapiens
gcaggcacacagcagc

SEQ ID NO: 6267009 - DNA, 18 bp, Homo sapiens
gcaggcacacagcagccc

SEQ ID NO: 6267010 - DNA, 19 bp, Homo sapiens
gcaggcacacagcagcccc

SEQ ID NO: 6267011 - DNA, 16 bp, Homo sapiens
gcaggcacagaggagg

SEQ ID NO: 6267012 - DNA, 22 bp, Homo sapiens
gcaggcacagaggaggtcagca

SEQ ID NO: 6267013 - DNA, 14 bp, Homo sapiens
gcaggcaccgccac

SEQ ID NO: 6267014 - DNA, 22 bp, Homo sapiens
gcaggcaccgccacgtcccagc

SEQ ID NO: 6267015 - DNA, 19 bp, Homo sapiens
gcaggcaccgggctggctg

SEQ ID NO: 6267016 - DNA, 15 bp, Homo sapiens
gcaggcaccttagtg

SEQ ID NO: 6267017 - DNA, 20 bp, Homo sapiens
gcaggcaccttagtggcttt

SEQ ID NO: 6267018 - DNA, 20 bp, Homo sapiens
gcaggcactcaatgcagcca

SEQ ID NO: 6267019 - DNA, 19 bp, Homo sapiens
gcaggcactgaagctgcgg

SEQ ID NO: 6267020 - DNA, 15 bp, Homo sapiens
gcaggcactgtggcc

SEQ ID NO: 6267021 - DNA, 16 bp, Homo sapiens
gcaggcactgtggccc

SEQ ID NO: 6267022 - DNA, 19 bp, Homo sapiens
gcaggcacttattgtaaat

SEQ ID NO: 6267023 - DNA, 23 bp, Homo sapiens
gcaggcagacacggatctgagaa

SEQ ID NO: 6267024 - DNA, 23 bp, Homo sapiens
gcaggcagacgaggcctttgctt

SEQ ID NO: 6267025 - DNA, 13 bp, Homo sapiens
gcaggcagagaag

SEQ ID NO: 6267026 - DNA, 15 bp, Homo sapiens
gcaggcagagaagtg

SEQ ID NO: 6267027 - DNA, 13 bp, Homo sapiens
gcaggcagagagt

SEQ ID NO: 6267028 - DNA, 17 bp, Homo sapiens
gcaggcagagcggggag

SEQ ID NO: 6267029 - DNA, 20 bp, Homo sapiens
gcaggcagagcggggaggtg

SEQ ID NO: 6267030 - DNA, 23 bp, Homo sapiens
gcaggcagagctcagcacagcct

SEQ ID NO: 6267031 - DNA, 13 bp, Homo sapiens
gcaggcagagctg

SEQ ID NO: 6267032 - DNA, 16 bp, Homo sapiens
gcaggcagaggcccag

SEQ ID NO: 6267033 - DNA, 23 bp, Homo sapiens
gcaggcagataagttggagcagg

SEQ ID NO: 6267034 - DNA, 9 bp, Homo sapiens
gcaggcagc

SEQ ID NO: 6267035 - DNA, 14 bp, Homo sapiens
gcaggcagccaggc

SEQ ID NO: 6267036 - DNA, 15 bp, Homo sapiens
gcaggcagccaggcc

SEQ ID NO: 6267037 - DNA, 17 bp, Homo sapiens
gcaggcagccaggccac

SEQ ID NO: 6267038 - DNA, 18 bp, Homo sapiens
gcaggcagccaggccaca

SEQ ID NO: 6267039 - DNA, 13 bp, Homo sapiens
gcaggcagccttg

SEQ ID NO: 6267040 - DNA, 16 bp, Homo sapiens
gcaggcagccttgacc

SEQ ID NO: 6267041 - DNA, 13 bp, Homo sapiens
gcaggcagcgcag

SEQ ID NO: 6267042 - DNA, 21 bp, Homo sapiens
gcaggcagcgccaagcaacct

SEQ ID NO: 6267043 - DNA, 15 bp, Homo sapiens
gcaggcagctaggca

SEQ ID NO: 6267044 - DNA, 11 bp, Homo sapiens
gcaggcaggca

SEQ ID NO: 6267045 - DNA, 16 bp, Homo sapiens
gcaggcaggcggctcc

SEQ ID NO: 6267046 - DNA, 12 bp, Homo sapiens
gcaggcaggctg

SEQ ID NO: 6267047 - DNA, 15 bp, Homo sapiens
gcaggcagggagaag

SEQ ID NO: 6267048 - DNA, 16 bp, Homo sapiens
gcaggcagggagaagg

SEQ ID NO: 6267049 - DNA, 17 bp, Homo sapiens
gcaggcagggagaaggg

SEQ ID NO: 6267050 - DNA, 15 bp, Homo sapiens
gcaggcagggctctc

SEQ ID NO: 6267051 - DNA, 22 bp, Homo sapiens
gcaggcagggctctcctggctt

SEQ ID NO: 6267052 - DNA, 13 bp, Homo sapiens
gcaggcagggctg

SEQ ID NO: 6267053 - DNA, 20 bp, Homo sapiens
gcaggcaggggcttggctgc

SEQ ID NO: 6267054 - DNA, 23 bp, Homo sapiens
gcaggcaggggcttggctgcccc

SEQ ID NO: 6267055 - DNA, 18 bp, Homo sapiens
gcaggcaggtgggggctg

SEQ ID NO: 6267056 - DNA, 20 bp, Homo sapiens
gcaggcaggtgtttattaaa

SEQ ID NO: 6267057 - DNA, 10 bp, Homo sapiens
gcaggcagtg

SEQ ID NO: 6267058 - DNA, 22 bp, Homo sapiens
gcaggcagtgtcttaaggagac

SEQ ID NO: 6267059 - DNA, 16 bp, Homo sapiens
gcaggcagttctagaa

SEQ ID NO: 6267060 - DNA, 22 bp, Homo sapiens
gcaggcatatcaacttgaggcc

SEQ ID NO: 6267061 - DNA, 12 bp, Homo sapiens
gcaggcatgccg

SEQ ID NO: 6267062 - DNA, 19 bp, Homo sapiens
gcaggcatggccctgggcg

SEQ ID NO: 6267063 - DNA, 18 bp, Homo sapiens
gcaggcatggctggtgcc

SEQ ID NO: 6267064 - DNA, 21 bp, Homo sapiens
gcaggcatggctggtgcctga

SEQ ID NO: 6267065 - DNA, 15 bp, Homo sapiens
gcaggcattgaggaa

SEQ ID NO: 6267066 - DNA, 16 bp, Homo sapiens
gcaggcattgaggaag

SEQ ID NO: 6267067 - DNA, 20 bp, Homo sapiens
gcaggccaagagcagaggca

SEQ ID NO: 6267068 - DNA, 21 bp, Homo sapiens
gcaggccacacttcaaactac

SEQ ID NO: 6267069 - DNA, 13 bp, Homo sapiens
gcaggccaccagc

SEQ ID NO: 6267070 - DNA, 23 bp, Homo sapiens
gcaggccacccccacctccctgc

SEQ ID NO: 6267071 - DNA, 21 bp, Homo sapiens
gcaggccacccgggctgcctg

SEQ ID NO: 6267072 - DNA, 18 bp, Homo sapiens
gcaggccacctggctctc

SEQ ID NO: 6267073 - DNA, 14 bp, Homo sapiens
gcaggccagagaaa

SEQ ID NO: 6267074 - DNA, 23 bp, Homo sapiens
gcaggccagcttcgtgctggagg

SEQ ID NO: 6267075 - DNA, 20 bp, Homo sapiens
gcaggccagtcccacggctc

SEQ ID NO: 6267076 - DNA, 18 bp, Homo sapiens
gcaggcccaatgctgctt

SEQ ID NO: 6267077 - DNA, 12 bp, Homo sapiens
gctgagcctgag

SEQ ID NO: 6267078 - DNA, 16 bp, Homo sapiens
gctgagcctgcaggga

SEQ ID NO: 6267079 - DNA, 14 bp, Homo sapiens
gctgagcctgccca

SEQ ID NO: 6267080 - DNA, 14 bp, Homo sapiens
gctgagcctggctg

SEQ ID NO: 6267081 - DNA, 13 bp, Homo sapiens
gctgagccttcag

SEQ ID NO: 6267082 - DNA, 19 bp, Homo sapiens
gctgagcgtggaaggggga

SEQ ID NO: 6267083 - DNA, 17 bp, Homo sapiens
gctgagctagcctccag

SEQ ID NO: 6267084 - DNA, 19 bp, Homo sapiens
gctgagctcacaaggcagc

SEQ ID NO: 6267085 - DNA, 21 bp, Homo sapiens
gctgagctcacaaggcagcaa

SEQ ID NO: 6267086 - DNA, 22 bp, Homo sapiens
gctgagctcacaaggcagcaag

SEQ ID NO: 6267087 - DNA, 23 bp, Homo sapiens
gctgagctcacaaggcagcaagg

SEQ ID NO: 6267088 - DNA, 16 bp, Homo sapiens
gctgagctccagccac

SEQ ID NO: 6267089 - DNA, 17 bp, Homo sapiens
gctgagctccagccacc

SEQ ID NO: 6267090 - DNA, 16 bp, Homo sapiens
gctgagctctgacctg

SEQ ID NO: 6267091 - DNA, 14 bp, Homo sapiens
gctgagctctgaga

SEQ ID NO: 6267092 - DNA, 17 bp, Homo sapiens
gctgagctctgagaggc

SEQ ID NO: 6267093 - DNA, 20 bp, Homo sapiens
gctgagctctgagaggccct

SEQ ID NO: 6267094 - DNA, 22 bp, Homo sapiens
gctgagctctgagaggccctgg

SEQ ID NO: 6267095 - DNA, 17 bp, Homo sapiens
gctgagctgcccctgct

SEQ ID NO: 6267096 - DNA, 14 bp, Homo sapiens
gctgagctggccta

SEQ ID NO: 6267097 - DNA, 17 bp, Homo sapiens
gctgagctgggcccagc

SEQ ID NO: 6267098 - DNA, 14 bp, Homo sapiens
gctgagctggggaa

SEQ ID NO: 6267099 - DNA, 12 bp, Homo sapiens
gctgagctgtga

SEQ ID NO: 6267100 - DNA, 13 bp, Homo sapiens
gctgagctgtgcc

SEQ ID NO: 6267101 - DNA, 19 bp, Homo sapiens
gctgagctgtgccagctgc

SEQ ID NO: 6267102 - DNA, 21 bp, Homo sapiens
gctgagctgtgccagctgctt

SEQ ID NO: 6267103 - DNA, 14 bp, Homo sapiens
gctgagctgtgccc

SEQ ID NO: 6267104 - DNA, 16 bp, Homo sapiens
gctgagcttagccttg

SEQ ID NO: 6267105 - DNA, 21 bp, Homo sapiens
gctgagcttcggttctccaga

SEQ ID NO: 6267106 - DNA, 16 bp, Homo sapiens
gctgagctttccagcc

SEQ ID NO: 6267107 - DNA, 16 bp, Homo sapiens
gctgaggaccctcagc

SEQ ID NO: 6267108 - DNA, 14 bp, Homo sapiens
gctgaggacgagac

SEQ ID NO: 6267109 - DNA, 19 bp, Homo sapiens
gctgaggacgagaccccca

SEQ ID NO: 6267110 - DNA, 21 bp, Homo sapiens
gctgaggacgagacccccatc

SEQ ID NO: 6267111 - DNA, 19 bp, Homo sapiens
gctgaggacggggcagagc

SEQ ID NO: 6267112 - DNA, 16 bp, Homo sapiens
gctgaggactctgcaa

SEQ ID NO: 6267113 - DNA, 12 bp, Homo sapiens
gctgaggagcag

SEQ ID NO: 6267114 - DNA, 16 bp, Homo sapiens
gctgaggagcagcagg

SEQ ID NO: 6267115 - DNA, 16 bp, Homo sapiens
gctgaggagcagccag

SEQ ID NO: 6267116 - DNA, 19 bp, Homo sapiens
gctgaggagcagccaggac

SEQ ID NO: 6267117 - DNA, 14 bp, Homo sapiens
gctgaggaggcctc

SEQ ID NO: 6267118 - DNA, 20 bp, Homo sapiens
gctgaggagtctgaggactg

SEQ ID NO: 6267119 - DNA, 21 bp, Homo sapiens
gctgaggagtctgaggactgt

SEQ ID NO: 6267120 - DNA, 23 bp, Homo sapiens
gctgaggagtctgaggactgtcc

SEQ ID NO: 6267121 - DNA, 14 bp, Homo sapiens
gctgaggatgattg

SEQ ID NO: 6267122 - DNA, 18 bp, Homo sapiens
gctgaggatttcaagcct

SEQ ID NO: 6267123 - DNA, 20 bp, Homo sapiens
gctgaggatttcaagcctgc

SEQ ID NO: 6267124 - DNA, 15 bp, Homo sapiens
gctgaggcaattcta

SEQ ID NO: 6267125 - DNA, 19 bp, Homo sapiens
gctgaggcacaagaatcac

SEQ ID NO: 6267126 - DNA, 18 bp, Homo sapiens
gctgaggcaccgtccagg

SEQ ID NO: 6267127 - DNA, 20 bp, Homo sapiens
gctgaggcaccgtccaggcc

SEQ ID NO: 6267128 - DNA, 16 bp, Homo sapiens
gctgaggcagaagaat

SEQ ID NO: 6267129 - DNA, 13 bp, Homo sapiens
gctgaggcagcag

SEQ ID NO: 6267130 - DNA, 23 bp, Homo sapiens
gctgaggcagcagtgtgaggcca

SEQ ID NO: 6267131 - DNA, 17 bp, Homo sapiens
gctgaggcaggagaatt

SEQ ID NO: 6267132 - DNA, 15 bp, Homo sapiens
gctgaggcaggagga

SEQ ID NO: 6267133 - DNA, 19 bp, Homo sapiens
gctgaggccacactcagca

SEQ ID NO: 6267134 - DNA, 16 bp, Homo sapiens
gctgaggccagaggaa

SEQ ID NO: 6267135 - DNA, 18 bp, Homo sapiens
gctgaggccagaggaagg

SEQ ID NO: 6267136 - DNA, 14 bp, Homo sapiens
gctgaggccagagt

SEQ ID NO: 6267137 - DNA, 19 bp, Homo sapiens
gctgaggccagagtcacct

SEQ ID NO: 6267138 - DNA, 12 bp, Homo sapiens
gctgaggccagg

SEQ ID NO: 6267139 - DNA, 18 bp, Homo sapiens
gctgaggccattccctgt

SEQ ID NO: 6267140 - DNA, 11 bp, Homo sapiens
gctgaggccca

SEQ ID NO: 6267141 - DNA, 13 bp, Homo sapiens
gctgaggcccagt

SEQ ID NO: 6267142 - DNA, 19 bp, Homo sapiens
gctgaggcccagtgcatat

SEQ ID NO: 6267143 - DNA, 12 bp, Homo sapiens
gctgaggcccat

SEQ ID NO: 6267144 - DNA, 17 bp, Homo sapiens
gctgaggcccatggcca

SEQ ID NO: 6267145 - DNA, 19 bp, Homo sapiens
gctgaggcccatggccaca

SEQ ID NO: 6267146 - DNA, 13 bp, Homo sapiens
gctgaggcctccc

SEQ ID NO: 6267147 - DNA, 12 bp, Homo sapiens
gctgaggcctcg

SEQ ID NO: 6267148 - DNA, 17 bp, Homo sapiens
gctgaggcctgggccgc

SEQ ID NO: 6267149 - DNA, 23 bp, Homo sapiens
gctgaggcctgggccgctgccac

SEQ ID NO: 6267150 - DNA, 21 bp, Homo sapiens
gctgaggccttatcattcatt

SEQ ID NO: 6267151 - DNA, 15 bp, Homo sapiens
gctgaggcgggagaa

SEQ ID NO: 6267152 - DNA, 15 bp, Homo sapiens
gctgaggctgagaaa

SEQ ID NO: 6267153 - DNA, 16 bp, Homo sapiens
gctgaggctgagaaag

SEQ ID NO: 6267154 - DNA, 16 bp, Homo sapiens
gctgaggctgctgcca

SEQ ID NO: 6267155 - DNA, 22 bp, Homo sapiens
gctgaggctgctgccaggcccg

SEQ ID NO: 6267156 - DNA, 18 bp, Homo sapiens
gctgaggctggcacagga

SEQ ID NO: 6267157 - DNA, 22 bp, Homo sapiens
gctgaggctgggggagagccgt

SEQ ID NO: 6267158 - DNA, 23 bp, Homo sapiens
gctgaggctgggggagagccgtg

SEQ ID NO: 6267159 - DNA, 16 bp, Homo sapiens
gctgagggaccagcca

SEQ ID NO: 6267160 - DNA, 15 bp, Homo sapiens
gctgagggaccgagc

SEQ ID NO: 6267161 - DNA, 18 bp, Homo sapiens
gctgagggaccgagccca

SEQ ID NO: 6267162 - DNA, 15 bp, Homo sapiens
gctgagggagggagc

SEQ ID NO: 6267163 - DNA, 18 bp, Homo sapiens
gctgagggagggagccat

SEQ ID NO: 6267164 - DNA, 19 bp, Homo sapiens
gctgagggagggagccatg

SEQ ID NO: 6267165 - DNA, 22 bp, Homo sapiens
gctgagggatggactgatgctt

SEQ ID NO: 6267166 - DNA, 20 bp, Homo sapiens
gctgagggcagttcgcagcc

SEQ ID NO: 6267167 - DNA, 13 bp, Homo sapiens
gctgagggcatct

SEQ ID NO: 6267168 - DNA, 14 bp, Homo sapiens
gctgagggccctgt

SEQ ID NO: 6267169 - DNA, 21 bp, Homo sapiens
gctgagggccctgtggagtcc

SEQ ID NO: 6267170 - DNA, 13 bp, Homo sapiens
gctgagggcctgc

SEQ ID NO: 6267171 - DNA, 19 bp, Homo sapiens
gctgagggctgccagcagc

SEQ ID NO: 6267172 - DNA, 11 bp, Homo sapiens
gctgaggggac

SEQ ID NO: 6267173 - DNA, 11 bp, Homo sapiens
gctgaggggca

SEQ ID NO: 6267174 - DNA, 15 bp, Homo sapiens
gctgaggggcaggga

SEQ ID NO: 6267175 - DNA, 17 bp, Homo sapiens
gctgaggggcctgcgcc

SEQ ID NO: 6267176 - DNA, 18 bp, Homo sapiens
gctgaggggcctgcgccc

SEQ ID NO: 6267177 - DNA, 20 bp, Homo sapiens
gctgaggggcctgcgcccag

SEQ ID NO: 6267178 - DNA, 15 bp, Homo sapiens
gctgagggtccagaa

SEQ ID NO: 6267179 - DNA, 16 bp, Homo sapiens
gctgagggtcgtggga

SEQ ID NO: 6267180 - DNA, 18 bp, Homo sapiens
gctgagggtgagtgggtg

SEQ ID NO: 6267181 - DNA, 19 bp, Homo sapiens
gctgagggtgtttcttcct

SEQ ID NO: 6267182 - DNA, 21 bp, Homo sapiens
gctgaggtcccgggcttagtg

SEQ ID NO: 6267183 - DNA, 17 bp, Homo sapiens
gctgaggtctcttgagg

SEQ ID NO: 6267184 - DNA, 20 bp, Homo sapiens
gctgaggtgaacaaggtaaa

SEQ ID NO: 6267185 - DNA, 13 bp, Homo sapiens
gctgaggtgagaa

SEQ ID NO: 6267186 - DNA, 23 bp, Homo sapiens
gctgaggtggctaagggggacca

SEQ ID NO: 6267187 - DNA, 15 bp, Homo sapiens
gctgaggtgggcaga

SEQ ID NO: 6267188 - DNA, 15 bp, Homo sapiens
gctgaggtgtctggc

SEQ ID NO: 6267189 - DNA, 18 bp, Homo sapiens
gctgaggtgtctggcctg

SEQ ID NO: 6267190 - DNA, 21 bp, Homo sapiens
gctgaggtgtctggcctgagg

SEQ ID NO: 6267191 - DNA, 22 bp, Homo sapiens
gctgaggttcctctgcctgccc

SEQ ID NO: 6267192 - DNA, 23 bp, Homo sapiens
gctgaggttcctctgcctgcccc

SEQ ID NO: 6267193 - DNA, 22 bp, Homo sapiens
gctgaggttttgaataaaaagt

SEQ ID NO: 6267194 - DNA, 20 bp, Homo sapiens
gctgagtagatgcgcagccc

SEQ ID NO: 6267195 - DNA, 18 bp, Homo sapiens
gctgagtcacctcctcca

SEQ ID NO: 6267196 - DNA, 19 bp, Homo sapiens
gctgagtcacctcctccac

SEQ ID NO: 6267197 - DNA, 22 bp, Homo sapiens
gctgagtcacctcctccactca

SEQ ID NO: 6267198 - DNA, 21 bp, Homo sapiens
gctgagtcatgatctccctgc

SEQ ID NO: 6267199 - DNA, 22 bp, Homo sapiens
gctgagtcatgatctccctgcc

SEQ ID NO: 6267200 - DNA, 23 bp, Homo sapiens
gctgagtcatgatctccctgccg

SEQ ID NO: 6267201 - DNA, 14 bp, Homo sapiens
gctgagtcctgggg

SEQ ID NO: 6267202 - DNA, 22 bp, Homo sapiens
gctgagtcgctctcatgaagcc

SEQ ID NO: 6267203 - DNA, 15 bp, Homo sapiens
gctgagtctccaggg

SEQ ID NO: 6267204 - DNA, 16 bp, Homo sapiens
gctgagtctcccaagg

SEQ ID NO: 6267205 - DNA, 17 bp, Homo sapiens
gctgagtctcccaaggc

SEQ ID NO: 6267206 - DNA, 13 bp, Homo sapiens
gctgagtctggct

SEQ ID NO: 6267207 - DNA, 15 bp, Homo sapiens
gctgagtctggctag

SEQ ID NO: 6267208 - DNA, 22 bp, Homo sapiens
gctgagtgaaaaatctgtggaa

SEQ ID NO: 6267209 - DNA, 12 bp, Homo sapiens
gctgagtgaagg

SEQ ID NO: 6267210 - DNA, 20 bp, Homo sapiens
gctgagtgaccgggggctgc

SEQ ID NO: 6267211 - DNA, 12 bp, Homo sapiens
gctgagtgagct

SEQ ID NO: 6267212 - DNA, 22 bp, Homo sapiens
gctgagtgaggaatggcagtga

SEQ ID NO: 6267213 - DNA, 15 bp, Homo sapiens
gctgagtgagtggga

SEQ ID NO: 6267214 - DNA, 16 bp, Homo sapiens
gctgagtgcactcctg

SEQ ID NO: 6267215 - DNA, 15 bp, Homo sapiens
gctgagtgcactggc

SEQ ID NO: 6267216 - DNA, 17 bp, Homo sapiens
gctgagtgcactggcag

SEQ ID NO: 6267217 - DNA, 18 bp, Homo sapiens
gctgagtgcactggcagg

SEQ ID NO: 6267218 - DNA, 16 bp, Homo sapiens
gctgagtgcagaggct

SEQ ID NO: 6267219 - DNA, 22 bp, Homo sapiens
gctgagtgcagccaaaggggag

SEQ ID NO: 6267220 - DNA, 15 bp, Homo sapiens
gctgagtgcaggccc

SEQ ID NO: 6267221 - DNA, 16 bp, Homo sapiens
gctgagtgcaggccca

SEQ ID NO: 6267222 - DNA, 20 bp, Homo sapiens
gctgagtgcaggcccaccct

SEQ ID NO: 6267223 - DNA, 22 bp, Homo sapiens
gctgagtgcaggcccaccctgc

SEQ ID NO: 6267224 - DNA, 23 bp, Homo sapiens
gctgagtgcaggcccaccctgct

SEQ ID NO: 6267225 - DNA, 13 bp, Homo sapiens
gctgagtgctggg

SEQ ID NO: 6267226 - DNA, 17 bp, Homo sapiens
gctgagtgctgggcact

SEQ ID NO: 6267227 - DNA, 18 bp, Homo sapiens
gctgagtggcagcagccc

SEQ ID NO: 6267228 - DNA, 14 bp, Homo sapiens
gctgagtggccact

SEQ ID NO: 6267229 - DNA, 21 bp, Homo sapiens
gctgagtggcggggcccctgc

SEQ ID NO: 6267230 - DNA, 22 bp, Homo sapiens
gctgagtgggagaaggcagtga

SEQ ID NO: 6267231 - DNA, 16 bp, Homo sapiens
gctgagtggggagcag

SEQ ID NO: 6267232 - DNA, 22 bp, Homo sapiens
gctgagtgggggatcacagcct

SEQ ID NO: 6267233 - DNA, 15 bp, Homo sapiens
gctgagtggtccaca

SEQ ID NO: 6267234 - DNA, 22 bp, Homo sapiens
gctgagttacttgtctgaggcc

SEQ ID NO: 6267235 - DNA, 12 bp, Homo sapiens
gctgagttctgg

SEQ ID NO: 6267236 - DNA, 13 bp, Homo sapiens
gctgagttggtgt

SEQ ID NO: 6267237 - DNA, 12 bp, Homo sapiens
gctgagttgttc

SEQ ID NO: 6267238 - DNA, 18 bp, Homo sapiens
gctgagttgttgagtctg

SEQ ID NO: 6267239 - DNA, 11 bp, Homo sapiens
gctgagtttcc

SEQ ID NO: 6267240 - DNA, 15 bp, Homo sapiens
gctgagtttcccttc

SEQ ID NO: 6267241 - DNA, 20 bp, Homo sapiens
gctgagtttggatgtctgta

SEQ ID NO: 6267242 - DNA, 13 bp, Homo sapiens
gctgataaaagat

SEQ ID NO: 6267243 - DNA, 14 bp, Homo sapiens
gctgataattgtgt

SEQ ID NO: 6267244 - DNA, 17 bp, Homo sapiens
gctgataattgtgtatt

SEQ ID NO: 6267245 - DNA, 19 bp, Homo sapiens
gctgataattttaaattct

SEQ ID NO: 6267246 - DNA, 19 bp, Homo sapiens
gctgatacataactaaatt

SEQ ID NO: 6267247 - DNA, 21 bp, Homo sapiens
gctgatacataactaaatttg

SEQ ID NO: 6267248 - DNA, 13 bp, Homo sapiens
gctgataccatat

SEQ ID NO: 6267249 - DNA, 17 bp, Homo sapiens
gctgataccatatgaat

SEQ ID NO: 6267250 - DNA, 19 bp, Homo sapiens
gctgatactgggtctgcga

SEQ ID NO: 6267251 - DNA, 16 bp, Homo sapiens
gctgatagctaagtga

SEQ ID NO: 6267252 - DNA, 23 bp, Homo sapiens
gctgatagtgtttcgttaagcag

SEQ ID NO: 6267253 - DNA, 16 bp, Homo sapiens
gctgatatcaacagct

SEQ ID NO: 6267254 - DNA, 18 bp, Homo sapiens
gctgatatgcaagtaaga

SEQ ID NO: 6267255 - DNA, 15 bp, Homo sapiens
gctgatattatttct

SEQ ID NO: 6267256 - DNA, 15 bp, Homo sapiens
gcaggcccaccctgc

SEQ ID NO: 6267257 - DNA, 22 bp, Homo sapiens
gcaggcccactccccagcccca

SEQ ID NO: 6267258 - DNA, 14 bp, Homo sapiens
gcaggcccagagga

SEQ ID NO: 6267259 - DNA, 16 bp, Homo sapiens
gcaggcccagcctctg

SEQ ID NO: 6267260 - DNA, 17 bp, Homo sapiens
gcaggcccagcctctgc

SEQ ID NO: 6267261 - DNA, 21 bp, Homo sapiens
gcaggcccagcctctgcccca

SEQ ID NO: 6267262 - DNA, 22 bp, Homo sapiens
gcaggcccagctggggcccctc

SEQ ID NO: 6267263 - DNA, 13 bp, Homo sapiens
gcaggcccaggag

SEQ ID NO: 6267264 - DNA, 16 bp, Homo sapiens
gcaggcccaggcaggc

SEQ ID NO: 6267265 - DNA, 14 bp, Homo sapiens
gcaggcccagtgac

SEQ ID NO: 6267266 - DNA, 17 bp, Homo sapiens
gcaggcccatgggaggc

SEQ ID NO: 6267267 - DNA, 13 bp, Homo sapiens
gcaggccccagcc

SEQ ID NO: 6267268 - DNA, 14 bp, Homo sapiens
gcaggccccagcca

SEQ ID NO: 6267269 - DNA, 22 bp, Homo sapiens
gcaggccccagccaagtgcctt

SEQ ID NO: 6267270 - DNA, 15 bp, Homo sapiens
gcaggccccctagga

SEQ ID NO: 6267271 - DNA, 17 bp, Homo sapiens
gcaggcccctctcctcc

SEQ ID NO: 6267272 - DNA, 21 bp, Homo sapiens
gcaggcccctctcctccgtgg

SEQ ID NO: 6267273 - DNA, 19 bp, Homo sapiens
gcaggcccctttggacctg

SEQ ID NO: 6267274 - DNA, 22 bp, Homo sapiens
gcaggcccctttggacctgcag

SEQ ID NO: 6267275 - DNA, 14 bp, Homo sapiens
gcaggccctccctc

SEQ ID NO: 6267276 - DNA, 15 bp, Homo sapiens
gcaggccctccctct

SEQ ID NO: 6267277 - DNA, 23 bp, Homo sapiens
gcaggccctgcactgtcctgctc

SEQ ID NO: 6267278 - DNA, 16 bp, Homo sapiens
gcaggccctgcccagc

SEQ ID NO: 6267279 - DNA, 12 bp, Homo sapiens
gcaggccctggc

SEQ ID NO: 6267280 - DNA, 17 bp, Homo sapiens
gcaggccctgggcctcc

SEQ ID NO: 6267281 - DNA, 14 bp, Homo sapiens
gcaggccctgtcca

SEQ ID NO: 6267282 - DNA, 19 bp, Homo sapiens
gcaggccctttgaagcctc

SEQ ID NO: 6267283 - DNA, 18 bp, Homo sapiens
gcaggccgccctcggact

SEQ ID NO: 6267284 - DNA, 15 bp, Homo sapiens
gcaggccgggcctgc

SEQ ID NO: 6267285 - DNA, 20 bp, Homo sapiens
gcaggccgggcctgctgtca

SEQ ID NO: 6267286 - DNA, 14 bp, Homo sapiens
gcaggcctaggacc

SEQ ID NO: 6267287 - DNA, 15 bp, Homo sapiens
gcaggcctatttcat

SEQ ID NO: 6267288 - DNA, 17 bp, Homo sapiens
gcaggcctccctgccag

SEQ ID NO: 6267289 - DNA, 19 bp, Homo sapiens
gcaggcctccctgcctcag

SEQ ID NO: 6267290 - DNA, 19 bp, Homo sapiens
gcaggcctccgtcttccca

SEQ ID NO: 6267291 - DNA, 22 bp, Homo sapiens
gcaggcctctggttgcctcccc

SEQ ID NO: 6267292 - DNA, 14 bp, Homo sapiens
gcaggcctgaccca

SEQ ID NO: 6267293 - DNA, 16 bp, Homo sapiens
gcaggcctgacccacg

SEQ ID NO: 6267294 - DNA, 13 bp, Homo sapiens
gcaggcctgcctt

SEQ ID NO: 6267295 - DNA, 17 bp, Homo sapiens
gcaggcctgccttctca

SEQ ID NO: 6267296 - DNA, 20 bp, Homo sapiens
gcaggcctgggacccagcta

SEQ ID NO: 6267297 - DNA, 22 bp, Homo sapiens
gcaggcctgggacccagctact

SEQ ID NO: 6267298 - DNA, 16 bp, Homo sapiens
gcaggcctgtccctgg

SEQ ID NO: 6267299 - DNA, 23 bp, Homo sapiens
gcaggcctgttccctgaggacct

SEQ ID NO: 6267300 - DNA, 15 bp, Homo sapiens
gcaggccttgctggg

SEQ ID NO: 6267301 - DNA, 17 bp, Homo sapiens
gcaggccttgctggggt

SEQ ID NO: 6267302 - DNA, 21 bp, Homo sapiens
gcaggccttgctggggtccag

SEQ ID NO: 6267303 - DNA, 16 bp, Homo sapiens
gcaggcctttcctaca

SEQ ID NO: 6267304 - DNA, 18 bp, Homo sapiens
gcaggcctttttgagcca

SEQ ID NO: 6267305 - DNA, 18 bp, Homo sapiens
gcaggcgaccgggcctcc

SEQ ID NO: 6267306 - DNA, 22 bp, Homo sapiens
gcaggcgatggggcaagacaga

SEQ ID NO: 6267307 - DNA, 22 bp, Homo sapiens
gcaggcgcaagggaggcccagc

SEQ ID NO: 6267308 - DNA, 13 bp, Homo sapiens
gcaggcgcagagg

SEQ ID NO: 6267309 - DNA, 14 bp, Homo sapiens
gcaggcgcagaggt

SEQ ID NO: 6267310 - DNA, 23 bp, Homo sapiens
gcaggcgcatgagtatctgtggg

SEQ ID NO: 6267311 - DNA, 21 bp, Homo sapiens
gcaggcgcctataatcccagc

SEQ ID NO: 6267312 - DNA, 14 bp, Homo sapiens
gcaggcggccaggg

SEQ ID NO: 6267313 - DNA, 15 bp, Homo sapiens
gcaggcggccagggc

SEQ ID NO: 6267314 - DNA, 17 bp, Homo sapiens
gcaggcggccctcagtg

SEQ ID NO: 6267315 - DNA, 22 bp, Homo sapiens
gcaggcggccctcagtgcatcc

SEQ ID NO: 6267316 - DNA, 19 bp, Homo sapiens
gcaggcgggccggggcagg

SEQ ID NO: 6267317 - DNA, 13 bp, Homo sapiens
gcaggcggggcag

SEQ ID NO: 6267318 - DNA, 13 bp, Homo sapiens
gcaggcggggctc

SEQ ID NO: 6267319 - DNA, 18 bp, Homo sapiens
gcaggcggggctcctcct

SEQ ID NO: 6267320 - DNA, 19 bp, Homo sapiens
gcaggcggggctcctcctg

SEQ ID NO: 6267321 - DNA, 20 bp, Homo sapiens
gcaggcggggggggcgcctg

SEQ ID NO: 6267322 - DNA, 20 bp, Homo sapiens
gcaggcggtccccatcccca

SEQ ID NO: 6267323 - DNA, 23 bp, Homo sapiens
gcaggcggtgggcacccaccctg

SEQ ID NO: 6267324 - DNA, 16 bp, Homo sapiens
gcaggcggtggggaga

SEQ ID NO: 6267325 - DNA, 16 bp, Homo sapiens
gcaggcgtgactcagc

SEQ ID NO: 6267326 - DNA, 22 bp, Homo sapiens
gcaggcgtgactcagcagcctg

SEQ ID NO: 6267327 - DNA, 14 bp, Homo sapiens
gcaggcgtgtggca

SEQ ID NO: 6267328 - DNA, 17 bp, Homo sapiens
gcaggcgtgtggcagcc

SEQ ID NO: 6267329 - DNA, 23 bp, Homo sapiens
gcaggcgtgtggcagccacacgc

SEQ ID NO: 6267330 - DNA, 21 bp, Homo sapiens
gcaggctaaggcgtggagctg

SEQ ID NO: 6267331 - DNA, 20 bp, Homo sapiens
gcaggctacactgacactgg

SEQ ID NO: 6267332 - DNA, 15 bp, Homo sapiens
gcaggctaccccttc

SEQ ID NO: 6267333 - DNA, 15 bp, Homo sapiens
gcaggctactgtcag

SEQ ID NO: 6267334 - DNA, 14 bp, Homo sapiens
gcaggctagacaga

SEQ ID NO: 6267335 - DNA, 17 bp, Homo sapiens
gcaggctcactgccagg

SEQ ID NO: 6267336 - DNA, 19 bp, Homo sapiens
gcaggctcactgccaggcc

SEQ ID NO: 6267337 - DNA, 23 bp, Homo sapiens
gcaggctcactgccaggccagcc

SEQ ID NO: 6267338 - DNA, 18 bp, Homo sapiens
gcaggctccagttgaaca

SEQ ID NO: 6267339 - DNA, 14 bp, Homo sapiens
gcaggctcccaggg

SEQ ID NO: 6267340 - DNA, 13 bp, Homo sapiens
gcaggctccccct

SEQ ID NO: 6267341 - DNA, 16 bp, Homo sapiens
gcaggctccccctgcc

SEQ ID NO: 6267342 - DNA, 23 bp, Homo sapiens
gcaggctccccctgcctttgaaa

SEQ ID NO: 6267343 - DNA, 19 bp, Homo sapiens
gcaggctcctcagccctct

SEQ ID NO: 6267344 - DNA, 15 bp, Homo sapiens
gcaggctcctggctg

SEQ ID NO: 6267345 - DNA, 19 bp, Homo sapiens
gcaggctcctggctgtgcc

SEQ ID NO: 6267346 - DNA, 12 bp, Homo sapiens
gcaggctctggg

SEQ ID NO: 6267347 - DNA, 16 bp, Homo sapiens
gcaggctctgggctca

SEQ ID NO: 6267348 - DNA, 19 bp, Homo sapiens
gcaggctctgggctcaggg

SEQ ID NO: 6267349 - DNA, 22 bp, Homo sapiens
gcaggctctgggctcagggctg

SEQ ID NO: 6267350 - DNA, 11 bp, Homo sapiens
gcaggctgaca

SEQ ID NO: 6267351 - DNA, 17 bp, Homo sapiens
gcaggctgagccactct

SEQ ID NO: 6267352 - DNA, 20 bp, Homo sapiens
gcaggctgaggtggggaagg

SEQ ID NO: 6267353 - DNA, 21 bp, Homo sapiens
gcaggctgaggtggggaagga

SEQ ID NO: 6267354 - DNA, 20 bp, Homo sapiens
gcaggctgagtccagagctt

SEQ ID NO: 6267355 - DNA, 20 bp, Homo sapiens
gcaggctgagtgcactggca

SEQ ID NO: 6267356 - DNA, 17 bp, Homo sapiens
gcaggctgatttctagg

SEQ ID NO: 6267357 - DNA, 20 bp, Homo sapiens
gcaggctgcacctctggcta

SEQ ID NO: 6267358 - DNA, 12 bp, Homo sapiens
gcaggctgcaga

SEQ ID NO: 6267359 - DNA, 13 bp, Homo sapiens
gcaggctgcagag

SEQ ID NO: 6267360 - DNA, 14 bp, Homo sapiens
gcaggctgcagagc

SEQ ID NO: 6267361 - DNA, 17 bp, Homo sapiens
gcaggctgcagagcccg

SEQ ID NO: 6267362 - DNA, 17 bp, Homo sapiens
gcaggctgcagcaggca

SEQ ID NO: 6267363 - DNA, 19 bp, Homo sapiens
gcaggctgcaggagggcac

SEQ ID NO: 6267364 - DNA, 20 bp, Homo sapiens
gcaggctgcaggagggcact

SEQ ID NO: 6267365 - DNA, 19 bp, Homo sapiens
gcaggctgcagtggctccc

SEQ ID NO: 6267366 - DNA, 17 bp, Homo sapiens
gcaggctgccagtgcct

SEQ ID NO: 6267367 - DNA, 22 bp, Homo sapiens
gcaggctgcccggcctccctcc

SEQ ID NO: 6267368 - DNA, 17 bp, Homo sapiens
gcaggctggcagctctc

SEQ ID NO: 6267369 - DNA, 12 bp, Homo sapiens
gcaggctggcca

SEQ ID NO: 6267370 - DNA, 13 bp, Homo sapiens
gcaggctggccag

SEQ ID NO: 6267371 - DNA, 17 bp, Homo sapiens
gcaggctggccagccgc

SEQ ID NO: 6267372 - DNA, 14 bp, Homo sapiens
gcaggctggccagt

SEQ ID NO: 6267373 - DNA, 13 bp, Homo sapiens
gcaggctggccct

SEQ ID NO: 6267374 - DNA, 16 bp, Homo sapiens
gcaggctggccctgcc

SEQ ID NO: 6267375 - DNA, 19 bp, Homo sapiens
gcaggctggccctgccctg

SEQ ID NO: 6267376 - DNA, 20 bp, Homo sapiens
gcaggctggccctgccctgg

SEQ ID NO: 6267377 - DNA, 10 bp, Homo sapiens
gcaggctggg

SEQ ID NO: 6267378 - DNA, 12 bp, Homo sapiens
gcaggctgggcc

SEQ ID NO: 6267379 - DNA, 13 bp, Homo sapiens
gcaggctgggcca

SEQ ID NO: 6267380 - DNA, 23 bp, Homo sapiens
gcaggctgggccatgtccaaaga

SEQ ID NO: 6267381 - DNA, 13 bp, Homo sapiens
gcaggctggggag

SEQ ID NO: 6267382 - DNA, 19 bp, Homo sapiens
gcaggctggggaggccagt

SEQ ID NO: 6267383 - DNA, 19 bp, Homo sapiens
gcaggctggggaggtgctg

SEQ ID NO: 6267384 - DNA, 12 bp, Homo sapiens
gcaggctgttcc

SEQ ID NO: 6267385 - DNA, 15 bp, Homo sapiens
gcaggcttcaaacta

SEQ ID NO: 6267386 - DNA, 14 bp, Homo sapiens
gcaggcttccccct

SEQ ID NO: 6267387 - DNA, 21 bp, Homo sapiens
gcaggcttcgtttgcctccag

SEQ ID NO: 6267388 - DNA, 16 bp, Homo sapiens
gcaggctttgtgagag

SEQ ID NO: 6267389 - DNA, 16 bp, Homo sapiens
gcagggaaaacacaga

SEQ ID NO: 6267390 - DNA, 22 bp, Homo sapiens
gcagggaaacagctaatgggac

SEQ ID NO: 6267391 - DNA, 13 bp, Homo sapiens
gcagggaaaggaa

SEQ ID NO: 6267392 - DNA, 21 bp, Homo sapiens
gcagggaaagggatggtcagg

SEQ ID NO: 6267393 - DNA, 11 bp, Homo sapiens
gcagggaagct

SEQ ID NO: 6267394 - DNA, 12 bp, Homo sapiens
gcagggaagctc

SEQ ID NO: 6267395 - DNA, 21 bp, Homo sapiens
gcagggaaggacaggaccctc

SEQ ID NO: 6267396 - DNA, 23 bp, Homo sapiens
gcagggaaggacaggaccctcag

SEQ ID NO: 6267397 - DNA, 13 bp, Homo sapiens
gcagggaaggaga

SEQ ID NO: 6267398 - DNA, 18 bp, Homo sapiens
gcagggaaggagacacca

SEQ ID NO: 6267399 - DNA, 15 bp, Homo sapiens
gcagggaaggcctga

SEQ ID NO: 6267400 - DNA, 21 bp, Homo sapiens
gcagggaaggggaggcagccg

SEQ ID NO: 6267401 - DNA, 21 bp, Homo sapiens
gcagggaagggtgcctggctg

SEQ ID NO: 6267402 - DNA, 18 bp, Homo sapiens
gcagggaatgcagcagga

SEQ ID NO: 6267403 - DNA, 15 bp, Homo sapiens
gcagggaattcctgg

SEQ ID NO: 6267404 - DNA, 15 bp, Homo sapiens
gcagggacaaggcga

SEQ ID NO: 6267405 - DNA, 19 bp, Homo sapiens
gcagggacacgggcagcct

SEQ ID NO: 6267406 - DNA, 14 bp, Homo sapiens
gcagggacagcctg

SEQ ID NO: 6267407 - DNA, 15 bp, Homo sapiens
gcagggacagttggg

SEQ ID NO: 6267408 - DNA, 22 bp, Homo sapiens
gcagggacatggggcaagccag

SEQ ID NO: 6267409 - DNA, 23 bp, Homo sapiens
gcagggacatggggcaagccagg

SEQ ID NO: 6267410 - DNA, 16 bp, Homo sapiens
gcagggaccgggcgca

SEQ ID NO: 6267411 - DNA, 20 bp, Homo sapiens
gcagggacctaaagggacta

SEQ ID NO: 6267412 - DNA, 14 bp, Homo sapiens
gcagggacctgaga

SEQ ID NO: 6267413 - DNA, 17 bp, Homo sapiens
gcagggacggggactgg

SEQ ID NO: 6267414 - DNA, 15 bp, Homo sapiens
gcagggagaccctgg

SEQ ID NO: 6267415 - DNA, 18 bp, Homo sapiens
gcagggagaccctgggag

SEQ ID NO: 6267416 - DNA, 14 bp, Homo sapiens
gcagggagagagta

SEQ ID NO: 6267417 - DNA, 13 bp, Homo sapiens
gcagggagagcgc

SEQ ID NO: 6267418 - DNA, 20 bp, Homo sapiens
gcagggagagcgcctcttcc

SEQ ID NO: 6267419 - DNA, 19 bp, Homo sapiens
gcagggagagctcaccatg

SEQ ID NO: 6267420 - DNA, 14 bp, Homo sapiens
gcagggagagttgg

SEQ ID NO: 6267421 - DNA, 18 bp, Homo sapiens
gcagggagcaactctcca

SEQ ID NO: 6267422 - DNA, 13 bp, Homo sapiens
gcagggagcacca

SEQ ID NO: 6267423 - DNA, 19 bp, Homo sapiens
gcagggagcaccacggcca

SEQ ID NO: 6267424 - DNA, 13 bp, Homo sapiens
gcagggagcactg

SEQ ID NO: 6267425 - DNA, 21 bp, Homo sapiens
gcagggagcatggctgtgagg

SEQ ID NO: 6267426 - DNA, 17 bp, Homo sapiens
gcagggagccttctgcc

SEQ ID NO: 6267427 - DNA, 19 bp, Homo sapiens
gcagggagccttctgccac

SEQ ID NO: 6267428 - DNA, 16 bp, Homo sapiens
gcagggagctcaagcc

SEQ ID NO: 6267429 - DNA, 23 bp, Homo sapiens
gcagggaggaagaagcttaggca

SEQ ID NO: 6267430 - DNA, 22 bp, Homo sapiens
gcagggaggcaacactgctgtc

SEQ ID NO: 6267431 - DNA, 24 bp, Homo sapiens
gcagggaggcaacactgctgtcca

SEQ ID NO: 6267432 - DNA, 19 bp, Homo sapiens
gcagggaggcaccattcag

SEQ ID NO: 6267433 - DNA, 22 bp, Homo sapiens
gcagggagggaaacccggggaa

SEQ ID NO: 6267434 - DNA, 14 bp, Homo sapiens
gcagggagggcagt

SEQ ID NO: 6267435 - DNA, 19 bp, Homo sapiens
gctgatattatttcttctc

SEQ ID NO: 6267436 - DNA, 22 bp, Homo sapiens
gctgatcaatctgcagtttgtg

SEQ ID NO: 6267437 - DNA, 18 bp, Homo sapiens
gctgatcatcgccagagg

SEQ ID NO: 6267438 - DNA, 13 bp, Homo sapiens
gctgatccccaac

SEQ ID NO: 6267439 - DNA, 14 bp, Homo sapiens
gctgatccccaacc

SEQ ID NO: 6267440 - DNA, 13 bp, Homo sapiens
gctgatccggctg

SEQ ID NO: 6267441 - DNA, 18 bp, Homo sapiens
gctgatcctaagaatttt

SEQ ID NO: 6267442 - DNA, 20 bp, Homo sapiens
gctgatccttcaactctgtg

SEQ ID NO: 6267443 - DNA, 23 bp, Homo sapiens
gctgatccttcaactctgtgagg

SEQ ID NO: 6267444 - DNA, 15 bp, Homo sapiens
gctgatcgccttccc

SEQ ID NO: 6267445 - DNA, 19 bp, Homo sapiens
gctgatcgtagaaaatttg

SEQ ID NO: 6267446 - DNA, 19 bp, Homo sapiens
gctgatctaaggaccccag

SEQ ID NO: 6267447 - DNA, 12 bp, Homo sapiens
gctgatctcagg

SEQ ID NO: 6267448 - DNA, 13 bp, Homo sapiens
gctgatctcaggg

SEQ ID NO: 6267449 - DNA, 22 bp, Homo sapiens
gctgatgaaactcctgattttg

SEQ ID NO: 6267450 - DNA, 21 bp, Homo sapiens
gctgatgaatcactgttttta

SEQ ID NO: 6267451 - DNA, 13 bp, Homo sapiens
gctgatgactcaa

SEQ ID NO: 6267452 - DNA, 12 bp, Homo sapiens
gctgatgaggaa

SEQ ID NO: 6267453 - DNA, 14 bp, Homo sapiens
gctgatgaggctgg

SEQ ID NO: 6267454 - DNA, 16 bp, Homo sapiens
gctgatgagttaattg

SEQ ID NO: 6267455 - DNA, 16 bp, Homo sapiens
gctgatgcagacacag

SEQ ID NO: 6267456 - DNA, 23 bp, Homo sapiens
gctgatgcattcccggtgcagaa

SEQ ID NO: 6267457 - DNA, 17 bp, Homo sapiens
gctgatgccccttctcc

SEQ ID NO: 6267458 - DNA, 16 bp, Homo sapiens
gctgatgcctccttgg

SEQ ID NO: 6267459 - DNA, 18 bp, Homo sapiens
gctgatgctcctccgggt

SEQ ID NO: 6267460 - DNA, 22 bp, Homo sapiens
gctgatgctcctccgggtctgc

SEQ ID NO: 6267461 - DNA, 14 bp, Homo sapiens
gctgatgcttgaag

SEQ ID NO: 6267462 - DNA, 16 bp, Homo sapiens
gctgatgcttgaagta

SEQ ID NO: 6267463 - DNA, 18 bp, Homo sapiens
gctgatggagccccacct

SEQ ID NO: 6267464 - DNA, 19 bp, Homo sapiens
gctgatggagccccacctt

SEQ ID NO: 6267465 - DNA, 15 bp, Homo sapiens
gctgatggaggaaaa

SEQ ID NO: 6267466 - DNA, 20 bp, Homo sapiens
gctgatggattccaaaccag

SEQ ID NO: 6267467 - DNA, 13 bp, Homo sapiens
gctgatggcagct

SEQ ID NO: 6267468 - DNA, 20 bp, Homo sapiens
gctgatggcccctccagcac

SEQ ID NO: 6267469 - DNA, 19 bp, Homo sapiens
gctgatggcttgacatgtg

SEQ ID NO: 6267470 - DNA, 18 bp, Homo sapiens
gctgatgggtgccctttc

SEQ ID NO: 6267471 - DNA, 13 bp, Homo sapiens
gctgatggtctgg

SEQ ID NO: 6267472 - DNA, 21 bp, Homo sapiens
gctgatggtgcaatgaccttt

SEQ ID NO: 6267473 - DNA, 22 bp, Homo sapiens
gctgatggtgtggcctgtggct

SEQ ID NO: 6267474 - DNA, 17 bp, Homo sapiens
gctgatgtaggagctgg

SEQ ID NO: 6267475 - DNA, 16 bp, Homo sapiens
gctgatgtatcctttc

SEQ ID NO: 6267476 - DNA, 14 bp, Homo sapiens
gctgatgtcaaagt

SEQ ID NO: 6267477 - DNA, 14 bp, Homo sapiens
gctgatgtggactg

SEQ ID NO: 6267478 - DNA, 18 bp, Homo sapiens
gctgatgttcagtgtaat

SEQ ID NO: 6267479 - DNA, 21 bp, Homo sapiens
gctgatgttcagtgtaatttc

SEQ ID NO: 6267480 - DNA, 13 bp, Homo sapiens
gctgatgtttatg

SEQ ID NO: 6267481 - DNA, 21 bp, Homo sapiens
gctgattaaaccaaggctaga

SEQ ID NO: 6267482 - DNA, 15 bp, Homo sapiens
gctgattaaatgaca

SEQ ID NO: 6267483 - DNA, 14 bp, Homo sapiens
gctgattactgtca

SEQ ID NO: 6267484 - DNA, 17 bp, Homo sapiens
gctgattatttatgacc

SEQ ID NO: 6267485 - DNA, 24 bp, Homo sapiens
gctgattcaaaccaaagctgcctg

SEQ ID NO: 6267486 - DNA, 13 bp, Homo sapiens
gctgattcaagaa

SEQ ID NO: 6267487 - DNA, 18 bp, Homo sapiens
gctgattcagcagtgcct

SEQ ID NO: 6267488 - DNA, 19 bp, Homo sapiens
gctgattcagcagtgccta

SEQ ID NO: 6267489 - DNA, 20 bp, Homo sapiens
gctgattcctaaggcccagc

SEQ ID NO: 6267490 - DNA, 16 bp, Homo sapiens
gctgattcttgtaaat

SEQ ID NO: 6267491 - DNA, 21 bp, Homo sapiens
gctgattcttgtaaatctttt

SEQ ID NO: 6267492 - DNA, 20 bp, Homo sapiens
gctgattgcagaaaggagag

SEQ ID NO: 6267493 - DNA, 14 bp, Homo sapiens
gctgattgtattta

SEQ ID NO: 6267494 - DNA, 17 bp, Homo sapiens
gctgatttaaaaagtga

SEQ ID NO: 6267495 - DNA, 19 bp, Homo sapiens
gctgatttactaacagtaa

SEQ ID NO: 6267496 - DNA, 12 bp, Homo sapiens
gctgatttcaaa

SEQ ID NO: 6267497 - DNA, 14 bp, Homo sapiens
gctgatttcaaatg

SEQ ID NO: 6267498 - DNA, 15 bp, Homo sapiens
gctgatttccaggcc

SEQ ID NO: 6267499 - DNA, 16 bp, Homo sapiens
gctgatttccaggccc

SEQ ID NO: 6267500 - DNA, 18 bp, Homo sapiens
gctgatttccaggcccct

SEQ ID NO: 6267501 - DNA, 22 bp, Homo sapiens
gctgatttccaggcccctgagg

SEQ ID NO: 6267502 - DNA, 23 bp, Homo sapiens
gctgatttccaggcccctgagga

SEQ ID NO: 6267503 - DNA, 19 bp, Homo sapiens
gctgatttcccttttttct

SEQ ID NO: 6267504 - DNA, 14 bp, Homo sapiens
gctgatttctagtg

SEQ ID NO: 6267505 - DNA, 20 bp, Homo sapiens
gctgatttctagtgtatact

SEQ ID NO: 6267506 - DNA, 17 bp, Homo sapiens
gctgatttggtgaccaa

SEQ ID NO: 6267507 - DNA, 15 bp, Homo sapiens
gctgattttaacaat

SEQ ID NO: 6267508 - DNA, 17 bp, Homo sapiens
gctgattttgaccttgt

SEQ ID NO: 6267509 - DNA, 18 bp, Homo sapiens
gctgcaaaactggaagca

SEQ ID NO: 6267510 - DNA, 17 bp, Homo sapiens
gctgcaaaagtgagggc

SEQ ID NO: 6267511 - DNA, 15 bp, Homo sapiens
gctgcaaaatgaaga

SEQ ID NO: 6267512 - DNA, 21 bp, Homo sapiens
gctgcaaacattgtacatcca

SEQ ID NO: 6267513 - DNA, 21 bp, Homo sapiens
gctgcaaacccatgaagctgg

SEQ ID NO: 6267514 - DNA, 12 bp, Homo sapiens
gctgcaaagaga

SEQ ID NO: 6267515 - DNA, 21 bp, Homo sapiens
gctgcaaagcaaaacagactg

SEQ ID NO: 6267516 - DNA, 13 bp, Homo sapiens
gctgcaaaggaca

SEQ ID NO: 6267517 - DNA, 15 bp, Homo sapiens
gctgcaaaggacaga

SEQ ID NO: 6267518 - DNA, 22 bp, Homo sapiens
gctgcaaataaggacagcagct

SEQ ID NO: 6267519 - DNA, 23 bp, Homo sapiens
gctgcaaataaggacagcagctg

SEQ ID NO: 6267520 - DNA, 19 bp, Homo sapiens
gctgcaaatgcattgtgaa

SEQ ID NO: 6267521 - DNA, 20 bp, Homo sapiens
gctgcaacaagctcatccct

SEQ ID NO: 6267522 - DNA, 17 bp, Homo sapiens
gctgcaagagcccagat

SEQ ID NO: 6267523 - DNA, 16 bp, Homo sapiens
gctgcaagccagggat

SEQ ID NO: 6267524 - DNA, 16 bp, Homo sapiens
gctgcaagctgcaggg

SEQ ID NO: 6267525 - DNA, 19 bp, Homo sapiens
gctgcaaggcctttctgtg

SEQ ID NO: 6267526 - DNA, 20 bp, Homo sapiens
gctgcaaggtggcctctgcc

SEQ ID NO: 6267527 - DNA, 23 bp, Homo sapiens
gctgcaaggtggcctctgcctgg

SEQ ID NO: 6267528 - DNA, 19 bp, Homo sapiens
gctgcaaggtttaggctgg

SEQ ID NO: 6267529 - DNA, 23 bp, Homo sapiens
gctgcaagtggttaagaatgtat

SEQ ID NO: 6267530 - DNA, 20 bp, Homo sapiens
gctgcaatacattaaaataa

SEQ ID NO: 6267531 - DNA, 17 bp, Homo sapiens
gctgcaatgcctagact

SEQ ID NO: 6267532 - DNA, 15 bp, Homo sapiens
gctgcaattccctgg

SEQ ID NO: 6267533 - DNA, 21 bp, Homo sapiens
gctgcacaaagtcagcaggga

SEQ ID NO: 6267534 - DNA, 16 bp, Homo sapiens
gctgcacaacagccct

SEQ ID NO: 6267535 - DNA, 16 bp, Homo sapiens
gctgcacacagacggc

SEQ ID NO: 6267536 - DNA, 16 bp, Homo sapiens
gctgcacaccaaggcc

SEQ ID NO: 6267537 - DNA, 18 bp, Homo sapiens
gctgcacaccaaggccct

SEQ ID NO: 6267538 - DNA, 20 bp, Homo sapiens
gctgcacaccagttactgtt

SEQ ID NO: 6267539 - DNA, 14 bp, Homo sapiens
gctgcacagaaggg

SEQ ID NO: 6267540 - DNA, 20 bp, Homo sapiens
gctgcacagaagggctcttt

SEQ ID NO: 6267541 - DNA, 12 bp, Homo sapiens
gctgcacagcag

SEQ ID NO: 6267542 - DNA, 12 bp, Homo sapiens
gctgcacagccc

SEQ ID NO: 6267543 - DNA, 16 bp, Homo sapiens
gctgcacaggccctgg

SEQ ID NO: 6267544 - DNA, 17 bp, Homo sapiens
gctgcacaggccctggg

SEQ ID NO: 6267545 - DNA, 19 bp, Homo sapiens
gctgcacaggccctgggga

SEQ ID NO: 6267546 - DNA, 17 bp, Homo sapiens
gctgcacagggcagctg

SEQ ID NO: 6267547 - DNA, 14 bp, Homo sapiens
gctgcacagtagtg

SEQ ID NO: 6267548 - DNA, 17 bp, Homo sapiens
gctgcacatggcctgag

SEQ ID NO: 6267549 - DNA, 19 bp, Homo sapiens
gctgcacattcctggcccc

SEQ ID NO: 6267550 - DNA, 19 bp, Homo sapiens
gctgcacattgcctgttct

SEQ ID NO: 6267551 - DNA, 22 bp, Homo sapiens
gctgcacattgcctgttctgct

SEQ ID NO: 6267552 - DNA, 23 bp, Homo sapiens
gctgcacattgcctgttctgctt

SEQ ID NO: 6267553 - DNA, 20 bp, Homo sapiens
gctgcaccaacccagccgct

SEQ ID NO: 6267554 - DNA, 23 bp, Homo sapiens
gctgcaccaacccagccgctgcc

SEQ ID NO: 6267555 - DNA, 19 bp, Homo sapiens
gctgcaccaatgcactgag

SEQ ID NO: 6267556 - DNA, 20 bp, Homo sapiens
gctgcaccacggcgtttttt

SEQ ID NO: 6267557 - DNA, 13 bp, Homo sapiens
gctgcaccagagc

SEQ ID NO: 6267558 - DNA, 17 bp, Homo sapiens
gctgcaccagagcaacc

SEQ ID NO: 6267559 - DNA, 14 bp, Homo sapiens
gctgcaccagagtg

SEQ ID NO: 6267560 - DNA, 15 bp, Homo sapiens
gctgcaccagagtga

SEQ ID NO: 6267561 - DNA, 14 bp, Homo sapiens
gctgcaccagcagg

SEQ ID NO: 6267562 - DNA, 23 bp, Homo sapiens
gctgcacccaactactgagctga

SEQ ID NO: 6267563 - DNA, 19 bp, Homo sapiens
gctgcaccccagcgtcagg

SEQ ID NO: 6267564 - DNA, 14 bp, Homo sapiens
gctgcacccctggg

SEQ ID NO: 6267565 - DNA, 17 bp, Homo sapiens
gctgcacccctgggcca

SEQ ID NO: 6267566 - DNA, 15 bp, Homo sapiens
gctgcaccccttcct

SEQ ID NO: 6267567 - DNA, 21 bp, Homo sapiens
gctgcaccccttcctgggcac

SEQ ID NO: 6267568 - DNA, 19 bp, Homo sapiens
gctgcaccctcaggcaggt

SEQ ID NO: 6267569 - DNA, 13 bp, Homo sapiens
gctgcaccggctg

SEQ ID NO: 6267570 - DNA, 14 bp, Homo sapiens
gctgcaccggctgg

SEQ ID NO: 6267571 - DNA, 18 bp, Homo sapiens
gctgcaccggctggcctg

SEQ ID NO: 6267572 - DNA, 22 bp, Homo sapiens
gctgcaccggctggcctggccc

SEQ ID NO: 6267573 - DNA, 23 bp, Homo sapiens
gctgcacctcctaccctcccacc

SEQ ID NO: 6267574 - DNA, 14 bp, Homo sapiens
gctgcacctgaggc

SEQ ID NO: 6267575 - DNA, 14 bp, Homo sapiens
gctgcacctgcagg

SEQ ID NO: 6267576 - DNA, 15 bp, Homo sapiens
gctgcacctgcaggg

SEQ ID NO: 6267577 - DNA, 20 bp, Homo sapiens
gctgcacctgcagggagcag

SEQ ID NO: 6267578 - DNA, 17 bp, Homo sapiens
gctgcacctgccagcct

SEQ ID NO: 6267579 - DNA, 19 bp, Homo sapiens
gctgcacctgccagcctgg

SEQ ID NO: 6267580 - DNA, 21 bp, Homo sapiens
gctgcacctgccagcctggct

SEQ ID NO: 6267581 - DNA, 22 bp, Homo sapiens
gctgcacctgccagcctggctt

SEQ ID NO: 6267582 - DNA, 22 bp, Homo sapiens
gctgcacgctcccctccatccc

SEQ ID NO: 6267583 - DNA, 22 bp, Homo sapiens
gctgcacgggatgcgtgggagg

SEQ ID NO: 6267584 - DNA, 20 bp, Homo sapiens
gctgcacgtcaccctcctga

SEQ ID NO: 6267585 - DNA, 20 bp, Homo sapiens
gctgcactatcacgagcctt

SEQ ID NO: 6267586 - DNA, 18 bp, Homo sapiens
gctgcactctgtgcccat

SEQ ID NO: 6267587 - DNA, 19 bp, Homo sapiens
gctgcactctgtgcccatg

SEQ ID NO: 6267588 - DNA, 20 bp, Homo sapiens
gctgcactgatgctgcccct

SEQ ID NO: 6267589 - DNA, 19 bp, Homo sapiens
gctgcactggagccacagg

SEQ ID NO: 6267590 - DNA, 23 bp, Homo sapiens
gctgcactggagccacaggcagg

SEQ ID NO: 6267591 - DNA, 13 bp, Homo sapiens
gctgcactgtgaa

SEQ ID NO: 6267592 - DNA, 15 bp, Homo sapiens
gctgcactgtgaacc

SEQ ID NO: 6267593 - DNA, 13 bp, Homo sapiens
gctgcactgttta

SEQ ID NO: 6267594 - DNA, 19 bp, Homo sapiens
gctgcacttgacaccaacc

SEQ ID NO: 6267595 - DNA, 16 bp, Homo sapiens
gctgcagaaccagtcc

SEQ ID NO: 6267596 - DNA, 15 bp, Homo sapiens
gctgcagaagggtgg

SEQ ID NO: 6267597 - DNA, 16 bp, Homo sapiens
gctgcagacaaaaaga

SEQ ID NO: 6267598 - DNA, 19 bp, Homo sapiens
gctgcagacaaaaagaaca

SEQ ID NO: 6267599 - DNA, 16 bp, Homo sapiens
gctgcagaccatgcca

SEQ ID NO: 6267600 - DNA, 20 bp, Homo sapiens
gctgcagaccatgccagacc

SEQ ID NO: 6267601 - DNA, 13 bp, Homo sapiens
gctgcagagaaac

SEQ ID NO: 6267602 - DNA, 13 bp, Homo sapiens
gctgcagagcagt

SEQ ID NO: 6267603 - DNA, 20 bp, Homo sapiens
gctgcagagcagtgggcctg

SEQ ID NO: 6267604 - DNA, 15 bp, Homo sapiens
gctgcagagcccggc

SEQ ID NO: 6267605 - DNA, 12 bp, Homo sapiens
gctgcagagcct

SEQ ID NO: 6267606 - DNA, 18 bp, Homo sapiens
gctgcagaggcacctcaa

SEQ ID NO: 6267607 - DNA, 21 bp, Homo sapiens
gctgcagaggggcaggccctg

SEQ ID NO: 6267608 - DNA, 21 bp, Homo sapiens
gctgcagattagttctttttg

SEQ ID NO: 6267609 - DNA, 15 bp, Homo sapiens
gctgcagattccttt

SEQ ID NO: 6267610 - DNA, 23 bp, Homo sapiens
gctgcagatttgatatttgcatt

SEQ ID NO: 6267611 - DNA, 21 bp, Homo sapiens
gctgcagatttgggctggaac

SEQ ID NO: 6267612 - DNA, 12 bp, Homo sapiens
gctgcagcagcc

SEQ ID NO: 6267613 - DNA, 18 bp, Homo sapiens
gcagggagggcagttttc

SEQ ID NO: 6267614 - DNA, 17 bp, Homo sapiens
gcagggagggcctgggc

SEQ ID NO: 6267615 - DNA, 18 bp, Homo sapiens
gcagggagggcctgggcc

SEQ ID NO: 6267616 - DNA, 17 bp, Homo sapiens
gcagggagggcttgggg

SEQ ID NO: 6267617 - DNA, 19 bp, Homo sapiens
gcagggagtgtctgcagtc

SEQ ID NO: 6267618 - DNA, 16 bp, Homo sapiens
gcagggatattgcctt

SEQ ID NO: 6267619 - DNA, 14 bp, Homo sapiens
gcagggatcctggt

SEQ ID NO: 6267620 - DNA, 13 bp, Homo sapiens
gcagggatgccct

SEQ ID NO: 6267621 - DNA, 21 bp, Homo sapiens
gcagggatgccctggaggtgg

SEQ ID NO: 6267622 - DNA, 17 bp, Homo sapiens
gcagggatgggggtggc

SEQ ID NO: 6267623 - DNA, 22 bp, Homo sapiens
gcagggatgggggtggctggga

SEQ ID NO: 6267624 - DNA, 22 bp, Homo sapiens
gcagggatgtcacgtcttgaaa

SEQ ID NO: 6267625 - DNA, 13 bp, Homo sapiens
gcagggatgtggg

SEQ ID NO: 6267626 - DNA, 22 bp, Homo sapiens
gcagggattaacctctgcacta

SEQ ID NO: 6267627 - DNA, 15 bp, Homo sapiens
gcagggattacaggc

SEQ ID NO: 6267628 - DNA, 15 bp, Homo sapiens
gcagggcacagaagg

SEQ ID NO: 6267629 - DNA, 16 bp, Homo sapiens
gcagggcacagaaggc

SEQ ID NO: 6267630 - DNA, 19 bp, Homo sapiens
gcagggcacagaaggctgg

SEQ ID NO: 6267631 - DNA, 13 bp, Homo sapiens
gcagggcacagat

SEQ ID NO: 6267632 - DNA, 23 bp, Homo sapiens
gcagggcacagatgaccaaagtc

SEQ ID NO: 6267633 - DNA, 19 bp, Homo sapiens
gcagggcacagggcctggc

SEQ ID NO: 6267634 - DNA, 12 bp, Homo sapiens
gcagggcacggg

SEQ ID NO: 6267635 - DNA, 18 bp, Homo sapiens
gcagggcacggggacctg

SEQ ID NO: 6267636 - DNA, 19 bp, Homo sapiens
gcagggcacggggacctgg

SEQ ID NO: 6267637 - DNA, 23 bp, Homo sapiens
gcagggcacggggacctggatag

SEQ ID NO: 6267638 - DNA, 13 bp, Homo sapiens
gcagggcagcccc

SEQ ID NO: 6267639 - DNA, 19 bp, Homo sapiens
gcagggcagcctgtgggag

SEQ ID NO: 6267640 - DNA, 15 bp, Homo sapiens
gcagggcaggaccag

SEQ ID NO: 6267641 - DNA, 16 bp, Homo sapiens
gcagggcaggaccagc

SEQ ID NO: 6267642 - DNA, 17 bp, Homo sapiens
gcagggcaggaccagcc

SEQ ID NO: 6267643 - DNA, 19 bp, Homo sapiens
gcagggcaggaccagccca

SEQ ID NO: 6267644 - DNA, 15 bp, Homo sapiens
gcagggcatctcctg

SEQ ID NO: 6267645 - DNA, 19 bp, Homo sapiens
gcagggcatctcctgtgca

SEQ ID NO: 6267646 - DNA, 19 bp, Homo sapiens
gcagggccactcaacagag

SEQ ID NO: 6267647 - DNA, 15 bp, Homo sapiens
gcagggccagggcaa

SEQ ID NO: 6267648 - DNA, 18 bp, Homo sapiens
gcagggccagggcaatgc

SEQ ID NO: 6267649 - DNA, 20 bp, Homo sapiens
gcagggccagggcaatgcca

SEQ ID NO: 6267650 - DNA, 23 bp, Homo sapiens
gcagggccagtcatggctgtccc

SEQ ID NO: 6267651 - DNA, 14 bp, Homo sapiens
gcagggccatccac

SEQ ID NO: 6267652 - DNA, 18 bp, Homo sapiens
gcagggccatccactgtg

SEQ ID NO: 6267653 - DNA, 18 bp, Homo sapiens
gcagggccatctgactgc

SEQ ID NO: 6267654 - DNA, 18 bp, Homo sapiens
gcagggccatgcagacct

SEQ ID NO: 6267655 - DNA, 18 bp, Homo sapiens
gcagggccatggctcagg

SEQ ID NO: 6267656 - DNA, 11 bp, Homo sapiens
gcagggcccac

SEQ ID NO: 6267657 - DNA, 12 bp, Homo sapiens
gcagggcccacc

SEQ ID NO: 6267658 - DNA, 19 bp, Homo sapiens
gcagggcccaccttggacc

SEQ ID NO: 6267659 - DNA, 23 bp, Homo sapiens
gcagggcccaccttggaccctgg

SEQ ID NO: 6267660 - DNA, 12 bp, Homo sapiens
gcagggcccagg

SEQ ID NO: 6267661 - DNA, 22 bp, Homo sapiens
gcagggcccagggaggtggcag

SEQ ID NO: 6267662 - DNA, 17 bp, Homo sapiens
gcagggcccccaataaa

SEQ ID NO: 6267663 - DNA, 19 bp, Homo sapiens
gcagggcccccaataaacc

SEQ ID NO: 6267664 - DNA, 21 bp, Homo sapiens
gcagggcccccaataaaccag

SEQ ID NO: 6267665 - DNA, 23 bp, Homo sapiens
gcagggcccccaataaaccagtg

SEQ ID NO: 6267666 - DNA, 17 bp, Homo sapiens
gcagggcccccacagga

SEQ ID NO: 6267667 - DNA, 23 bp, Homo sapiens
gcagggcccctgaccctcccggc

SEQ ID NO: 6267668 - DNA, 14 bp, Homo sapiens
gcagggccctcaga

SEQ ID NO: 6267669 - DNA, 16 bp, Homo sapiens
gcagggccctcagagg

SEQ ID NO: 6267670 - DNA, 11 bp, Homo sapiens
gcagggccctg

SEQ ID NO: 6267671 - DNA, 22 bp, Homo sapiens
gcagggccctgaaatggcctgt

SEQ ID NO: 6267672 - DNA, 22 bp, Homo sapiens
gcagggccctggggtctctgag

SEQ ID NO: 6267673 - DNA, 13 bp, Homo sapiens
gcagggccctgtg

SEQ ID NO: 6267674 - DNA, 18 bp, Homo sapiens
gcagggccctgtggctcc

SEQ ID NO: 6267675 - DNA, 21 bp, Homo sapiens
gcagggcccttggggctgggg

SEQ ID NO: 6267676 - DNA, 18 bp, Homo sapiens
gcagggccgcagggcgct

SEQ ID NO: 6267677 - DNA, 22 bp, Homo sapiens
gcagggccgcccgggcccagag

SEQ ID NO: 6267678 - DNA, 23 bp, Homo sapiens
gcagggccgcccgggcccagagg

SEQ ID NO: 6267679 - DNA, 18 bp, Homo sapiens
gcagggccgcgagaggcc

SEQ ID NO: 6267680 - DNA, 23 bp, Homo sapiens
gcagggccgctcgatgcctttgc

SEQ ID NO: 6267681 - DNA, 15 bp, Homo sapiens
gcagggccgggcagg

SEQ ID NO: 6267682 - DNA, 16 bp, Homo sapiens
gcagggccgggcaggg

SEQ ID NO: 6267683 - DNA, 13 bp, Homo sapiens
gcagggccgggga

SEQ ID NO: 6267684 - DNA, 14 bp, Homo sapiens
gcagggccggggaa

SEQ ID NO: 6267685 - DNA, 20 bp, Homo sapiens
gcagggccggggaactggcc

SEQ ID NO: 6267686 - DNA, 20 bp, Homo sapiens
gcagggcctagctgctacaa

SEQ ID NO: 6267687 - DNA, 13 bp, Homo sapiens
gcagggcctctgt

SEQ ID NO: 6267688 - DNA, 13 bp, Homo sapiens
gcagggcctggca

SEQ ID NO: 6267689 - DNA, 16 bp, Homo sapiens
gcagggcctggcctgg

SEQ ID NO: 6267690 - DNA, 18 bp, Homo sapiens
gcagggcctggcggaggt

SEQ ID NO: 6267691 - DNA, 19 bp, Homo sapiens
gcagggcctggctccagtc

SEQ ID NO: 6267692 - DNA, 12 bp, Homo sapiens
gcagggcctggg

SEQ ID NO: 6267693 - DNA, 16 bp, Homo sapiens
gcagggccttctgcct

SEQ ID NO: 6267694 - DNA, 21 bp, Homo sapiens
gcagggccttctgcctgctga

SEQ ID NO: 6267695 - DNA, 18 bp, Homo sapiens
gcagggccttgcccagag

SEQ ID NO: 6267696 - DNA, 19 bp, Homo sapiens
gcagggccttgcccagaga

SEQ ID NO: 6267697 - DNA, 17 bp, Homo sapiens
gcagggcgagctgcagg

SEQ ID NO: 6267698 - DNA, 18 bp, Homo sapiens
gcagggcgagctgcagga

SEQ ID NO: 6267699 - DNA, 23 bp, Homo sapiens
gcagggcgaggaccaataatttt

SEQ ID NO: 6267700 - DNA, 17 bp, Homo sapiens
gcagggcgccaagtctg

SEQ ID NO: 6267701 - DNA, 16 bp, Homo sapiens
gcagggcgcccagcgc

SEQ ID NO: 6267702 - DNA, 18 bp, Homo sapiens
gcagggcgggcagagggc

SEQ ID NO: 6267703 - DNA, 21 bp, Homo sapiens
gcagggcgggcagagggctgg

SEQ ID NO: 6267704 - DNA, 19 bp, Homo sapiens
gcagggcgggccaggagaa

SEQ ID NO: 6267705 - DNA, 21 bp, Homo sapiens
gcagggcggtctcactcccag

SEQ ID NO: 6267706 - DNA, 21 bp, Homo sapiens
gcagggctaaataaagaggag

SEQ ID NO: 6267707 - DNA, 22 bp, Homo sapiens
gcagggctaccctgagctgagg

SEQ ID NO: 6267708 - DNA, 21 bp, Homo sapiens
gcagggctcaggatttcgtgg

SEQ ID NO: 6267709 - DNA, 18 bp, Homo sapiens
gcagggctcctccctgga

SEQ ID NO: 6267710 - DNA, 12 bp, Homo sapiens
gcagggctctcc

SEQ ID NO: 6267711 - DNA, 16 bp, Homo sapiens
gcagggctctgcccca

SEQ ID NO: 6267712 - DNA, 12 bp, Homo sapiens
gcagggctctgg

SEQ ID NO: 6267713 - DNA, 16 bp, Homo sapiens
gcagggctctggggcc

SEQ ID NO: 6267714 - DNA, 21 bp, Homo sapiens
gcagggctgactccctctcag

SEQ ID NO: 6267715 - DNA, 17 bp, Homo sapiens
gcagggctgaggatggg

SEQ ID NO: 6267716 - DNA, 21 bp, Homo sapiens
gcagggctgctgtggcccagt

SEQ ID NO: 6267717 - DNA, 13 bp, Homo sapiens
gcagggctggccc

SEQ ID NO: 6267718 - DNA, 19 bp, Homo sapiens
gcagggctgggcctgcgag

SEQ ID NO: 6267719 - DNA, 23 bp, Homo sapiens
gcagggctgggcgcctctgtcct

SEQ ID NO: 6267720 - DNA, 19 bp, Homo sapiens
gcagggctgggtcaggggt

SEQ ID NO: 6267721 - DNA, 22 bp, Homo sapiens
gcagggctggtcacctcccatc

SEQ ID NO: 6267722 - DNA, 14 bp, Homo sapiens
gcagggctggtttg

SEQ ID NO: 6267723 - DNA, 20 bp, Homo sapiens
gcagggctgttccctccagg

SEQ ID NO: 6267724 - DNA, 17 bp, Homo sapiens
gcagggctttaaaattc

SEQ ID NO: 6267725 - DNA, 16 bp, Homo sapiens
gcaggggaaactctgg

SEQ ID NO: 6267726 - DNA, 17 bp, Homo sapiens
gcaggggaagcaggacc

SEQ ID NO: 6267727 - DNA, 18 bp, Homo sapiens
gcaggggaattttctctc

SEQ ID NO: 6267728 - DNA, 19 bp, Homo sapiens
gcaggggaattttctctcc

SEQ ID NO: 6267729 - DNA, 18 bp, Homo sapiens
gcaggggagacaggagcc

SEQ ID NO: 6267730 - DNA, 19 bp, Homo sapiens
gcaggggagacaggagcct

SEQ ID NO: 6267731 - DNA, 22 bp, Homo sapiens
gcaggggagacaggagcctagc

SEQ ID NO: 6267732 - DNA, 13 bp, Homo sapiens
gcaggggagccag

SEQ ID NO: 6267733 - DNA, 15 bp, Homo sapiens
gcaggggagcttggg

SEQ ID NO: 6267734 - DNA, 20 bp, Homo sapiens
gcaggggagcttgggactca

SEQ ID NO: 6267735 - DNA, 18 bp, Homo sapiens
gcaggggaggccatctgg

SEQ ID NO: 6267736 - DNA, 19 bp, Homo sapiens
gcaggggaggccatctgga

SEQ ID NO: 6267737 - DNA, 13 bp, Homo sapiens
gcaggggagggtc

SEQ ID NO: 6267738 - DNA, 12 bp, Homo sapiens
gcaggggagtct

SEQ ID NO: 6267739 - DNA, 15 bp, Homo sapiens
gcaggggagtctgct

SEQ ID NO: 6267740 - DNA, 13 bp, Homo sapiens
gcaggggagtgcc

SEQ ID NO: 6267741 - DNA, 16 bp, Homo sapiens
gcaggggcaggcgcag

SEQ ID NO: 6267742 - DNA, 16 bp, Homo sapiens
gcaggggcagtggcct

SEQ ID NO: 6267743 - DNA, 18 bp, Homo sapiens
gcaggggcagtggcctgg

SEQ ID NO: 6267744 - DNA, 19 bp, Homo sapiens
gcaggggccaagcaggcac

SEQ ID NO: 6267745 - DNA, 12 bp, Homo sapiens
gcaggggcccct

SEQ ID NO: 6267746 - DNA, 19 bp, Homo sapiens
gcaggggcccctcctctgt

SEQ ID NO: 6267747 - DNA, 21 bp, Homo sapiens
gcaggggcccctcctctgtgc

SEQ ID NO: 6267748 - DNA, 20 bp, Homo sapiens
gcaggggcctggagatcctc

SEQ ID NO: 6267749 - DNA, 22 bp, Homo sapiens
gcaggggcgggcggagggaggg

SEQ ID NO: 6267750 - DNA, 23 bp, Homo sapiens
gcaggggcgggcggagggagggg

SEQ ID NO: 6267751 - DNA, 23 bp, Homo sapiens
gcaggggcgggtggatcacctga

SEQ ID NO: 6267752 - DNA, 19 bp, Homo sapiens
gcaggggctacaagaggga

SEQ ID NO: 6267753 - DNA, 20 bp, Homo sapiens
gcaggggctctggagagaaa

SEQ ID NO: 6267754 - DNA, 21 bp, Homo sapiens
gcaggggctgcatcctcagcc

SEQ ID NO: 6267755 - DNA, 20 bp, Homo sapiens
gcaggggctgctgccttgtt

SEQ ID NO: 6267756 - DNA, 22 bp, Homo sapiens
gcaggggctgctgggggctccc

SEQ ID NO: 6267757 - DNA, 17 bp, Homo sapiens
gcaggggctgggcagag

SEQ ID NO: 6267758 - DNA, 21 bp, Homo sapiens
gcaggggctgggcagagggga

SEQ ID NO: 6267759 - DNA, 13 bp, Homo sapiens
gcaggggcttcct

SEQ ID NO: 6267760 - DNA, 14 bp, Homo sapiens
gcaggggcttcctg

SEQ ID NO: 6267761 - DNA, 12 bp, Homo sapiens
gcaggggcttgg

SEQ ID NO: 6267762 - DNA, 13 bp, Homo sapiens
gcaggggcttggc

SEQ ID NO: 6267763 - DNA, 21 bp, Homo sapiens
gcagggggacctaggctcctc

SEQ ID NO: 6267764 - DNA, 19 bp, Homo sapiens
gcagggggaggaggacttg

SEQ ID NO: 6267765 - DNA, 15 bp, Homo sapiens
gcagggggccccgcc

SEQ ID NO: 6267766 - DNA, 20 bp, Homo sapiens
gcagggggccccgccagggc

SEQ ID NO: 6267767 - DNA, 13 bp, Homo sapiens
gcagggggccctg

SEQ ID NO: 6267768 - DNA, 10 bp, Homo sapiens
gcagggggct

SEQ ID NO: 6267769 - DNA, 14 bp, Homo sapiens
gcagggggctgctg

SEQ ID NO: 6267770 - DNA, 17 bp, Homo sapiens
gcagggggctgctgctg

SEQ ID NO: 6267771 - DNA, 22 bp, Homo sapiens
gcagggggctgctgctgggctc

SEQ ID NO: 6267772 - DNA, 14 bp, Homo sapiens
gcaggggggttggg

SEQ ID NO: 6267773 - DNA, 18 bp, Homo sapiens
gcagggggtgaaggcagg

SEQ ID NO: 6267774 - DNA, 19 bp, Homo sapiens
gcagggggtgaaggcagga

SEQ ID NO: 6267775 - DNA, 23 bp, Homo sapiens
gcagggggttctgggacccactc

SEQ ID NO: 6267776 - DNA, 23 bp, Homo sapiens
gcaggggtaggggtagggagcct

SEQ ID NO: 6267777 - DNA, 17 bp, Homo sapiens
gcaggggtcagagcact

SEQ ID NO: 6267778 - DNA, 19 bp, Homo sapiens
gcaggggtcagtgcagcag

SEQ ID NO: 6267779 - DNA, 13 bp, Homo sapiens
gcaggggtccctg

SEQ ID NO: 6267780 - DNA, 14 bp, Homo sapiens
gcaggggtccctgc

SEQ ID NO: 6267781 - DNA, 16 bp, Homo sapiens
gcaggggtctgagcca

SEQ ID NO: 6267782 - DNA, 23 bp, Homo sapiens
gcaggggtctgggagtcaggccc

SEQ ID NO: 6267783 - DNA, 23 bp, Homo sapiens
gcaggggtggaggagagcctggt

SEQ ID NO: 6267784 - DNA, 18 bp, Homo sapiens
gcaggggtggctgcctca

SEQ ID NO: 6267785 - DNA, 18 bp, Homo sapiens
gcaggggtgggagagcca

SEQ ID NO: 6267786 - DNA, 19 bp, Homo sapiens
gcaggggtgggagagccag

SEQ ID NO: 6267787 - DNA, 20 bp, Homo sapiens
gcaggggtgggagagccagc

SEQ ID NO: 6267788 - DNA, 18 bp, Homo sapiens
gcaggggtgggaggctcc

SEQ ID NO: 6267789 - DNA, 17 bp, Homo sapiens
gcaggggtgggggtgga

SEQ ID NO: 6267790 - DNA, 15 bp, Homo sapiens
gctgcagcaggcaga

SEQ ID NO: 6267791 - DNA, 18 bp, Homo sapiens
gctgcagcatgaaggcag

SEQ ID NO: 6267792 - DNA, 17 bp, Homo sapiens
gctgcagccaggcctcg

SEQ ID NO: 6267793 - DNA, 14 bp, Homo sapiens
gctgcagccccctg

SEQ ID NO: 6267794 - DNA, 19 bp, Homo sapiens
gctgcagccccctgcttct

SEQ ID NO: 6267795 - DNA, 17 bp, Homo sapiens
gctgcagccctgccagt

SEQ ID NO: 6267796 - DNA, 15 bp, Homo sapiens
gctgcagcctcagga

SEQ ID NO: 6267797 - DNA, 19 bp, Homo sapiens
gctgcagcctcaggactgg

SEQ ID NO: 6267798 - DNA, 22 bp, Homo sapiens
gctgcagcctcaggactgggag

SEQ ID NO: 6267799 - DNA, 23 bp, Homo sapiens
gctgcagcctcaggactgggagc

SEQ ID NO: 6267800 - DNA, 13 bp, Homo sapiens
gctgcagcctgca

SEQ ID NO: 6267801 - DNA, 14 bp, Homo sapiens
gctgcagcctgcat

SEQ ID NO: 6267802 - DNA, 16 bp, Homo sapiens
gctgcagcctggctgg

SEQ ID NO: 6267803 - DNA, 20 bp, Homo sapiens
gctgcagcctggctggtcct

SEQ ID NO: 6267804 - DNA, 21 bp, Homo sapiens
gctgcagccttcatcagaact

SEQ ID NO: 6267805 - DNA, 23 bp, Homo sapiens
gctgcagccttcatcagaactct

SEQ ID NO: 6267806 - DNA, 22 bp, Homo sapiens
gctgcagctaatttgtgaaagt

SEQ ID NO: 6267807 - DNA, 14 bp, Homo sapiens
gctgcagctccctg

SEQ ID NO: 6267808 - DNA, 23 bp, Homo sapiens
gctgcagctccctggcttctgtg

SEQ ID NO: 6267809 - DNA, 14 bp, Homo sapiens
gctgcagctggaca

SEQ ID NO: 6267810 - DNA, 19 bp, Homo sapiens
gctgcagctgggccccatg

SEQ ID NO: 6267811 - DNA, 10 bp, Homo sapiens
gctgcagctt

SEQ ID NO: 6267812 - DNA, 14 bp, Homo sapiens
gctgcagcttggga

SEQ ID NO: 6267813 - DNA, 13 bp, Homo sapiens
gctgcagctttgg

SEQ ID NO: 6267814 - DNA, 23 bp, Homo sapiens
gctgcaggaagaaacttttttat

SEQ ID NO: 6267815 - DNA, 16 bp, Homo sapiens
gctgcaggaatcaaaa

SEQ ID NO: 6267816 - DNA, 20 bp, Homo sapiens
gctgcaggaatcacccctct

SEQ ID NO: 6267817 - DNA, 22 bp, Homo sapiens
gctgcaggaatctttaaaagat

SEQ ID NO: 6267818 - DNA, 12 bp, Homo sapiens
gctgcaggaggg

SEQ ID NO: 6267819 - DNA, 15 bp, Homo sapiens
gctgcaggagggcac

SEQ ID NO: 6267820 - DNA, 21 bp, Homo sapiens
gctgcaggagtgtcctgccca

SEQ ID NO: 6267821 - DNA, 23 bp, Homo sapiens
gctgcaggcaggcggctcctcct

SEQ ID NO: 6267822 - DNA, 15 bp, Homo sapiens
gctgcaggccctccc

SEQ ID NO: 6267823 - DNA, 12 bp, Homo sapiens
gctgcagggagc

SEQ ID NO: 6267824 - DNA, 15 bp, Homo sapiens
gctgcagggagcacc

SEQ ID NO: 6267825 - DNA, 12 bp, Homo sapiens
gctgcagggcac

SEQ ID NO: 6267826 - DNA, 18 bp, Homo sapiens
gctgcagggcacggggac

SEQ ID NO: 6267827 - DNA, 23 bp, Homo sapiens
gctgcagggcacggggacctgga

SEQ ID NO: 6267828 - DNA, 20 bp, Homo sapiens
gctgcagggccactggaagg

SEQ ID NO: 6267829 - DNA, 11 bp, Homo sapiens
gctgcagggct

SEQ ID NO: 6267830 - DNA, 14 bp, Homo sapiens
gctgcagggctggg

SEQ ID NO: 6267831 - DNA, 15 bp, Homo sapiens
gctgcagggctgggt

SEQ ID NO: 6267832 - DNA, 17 bp, Homo sapiens
gctgcaggggcatggga

SEQ ID NO: 6267833 - DNA, 16 bp, Homo sapiens
gctgcaggggctctgg

SEQ ID NO: 6267834 - DNA, 20 bp, Homo sapiens
gctgcaggtacttcctcctg

SEQ ID NO: 6267835 - DNA, 21 bp, Homo sapiens
gctgcagtagctgtggcctca

SEQ ID NO: 6267836 - DNA, 16 bp, Homo sapiens
gctgcagtaggggagg

SEQ ID NO: 6267837 - DNA, 16 bp, Homo sapiens
gctgcagtatggccag

SEQ ID NO: 6267838 - DNA, 21 bp, Homo sapiens
gctgcagtcacattgatgtaa

SEQ ID NO: 6267839 - DNA, 16 bp, Homo sapiens
gctgcagtcttctctc

SEQ ID NO: 6267840 - DNA, 19 bp, Homo sapiens
gctgcagtcttctctctgg

SEQ ID NO: 6267841 - DNA, 22 bp, Homo sapiens
gctgcagtcttctctctggctc

SEQ ID NO: 6267842 - DNA, 15 bp, Homo sapiens
gctgcagttgaagag

SEQ ID NO: 6267843 - DNA, 13 bp, Homo sapiens
gctgcagttgcca

SEQ ID NO: 6267844 - DNA, 13 bp, Homo sapiens
gctgcagtttttt

SEQ ID NO: 6267845 - DNA, 17 bp, Homo sapiens
gctgcataaatttgtaa

SEQ ID NO: 6267846 - DNA, 21 bp, Homo sapiens
gctgcatactttgacaaggaa

SEQ ID NO: 6267847 - DNA, 18 bp, Homo sapiens
gctgcatatttgaccttt

SEQ ID NO: 6267848 - DNA, 15 bp, Homo sapiens
gctgcatatttgtgc

SEQ ID NO: 6267849 - DNA, 20 bp, Homo sapiens
gctgcatcaaatgcatgcgt

SEQ ID NO: 6267850 - DNA, 15 bp, Homo sapiens
gctgcatccaaggct

SEQ ID NO: 6267851 - DNA, 16 bp, Homo sapiens
gctgcatccaaggctt

SEQ ID NO: 6267852 - DNA, 22 bp, Homo sapiens
gctgcatcccccccacctctcc

SEQ ID NO: 6267853 - DNA, 20 bp, Homo sapiens
gctgcatccccttccagctc

SEQ ID NO: 6267854 - DNA, 21 bp, Homo sapiens
gctgcatccccttccagctcc

SEQ ID NO: 6267855 - DNA, 18 bp, Homo sapiens
gctgcatcccgagcaacc

SEQ ID NO: 6267856 - DNA, 15 bp, Homo sapiens
gctgcatctactcag

SEQ ID NO: 6267857 - DNA, 13 bp, Homo sapiens
gctgcatctgtct

SEQ ID NO: 6267858 - DNA, 19 bp, Homo sapiens
gctgcatcttatagcactt

SEQ ID NO: 6267859 - DNA, 22 bp, Homo sapiens
gctgcatcttatagcactttga

SEQ ID NO: 6267860 - DNA, 13 bp, Homo sapiens
gctgcatgaccta

SEQ ID NO: 6267861 - DNA, 23 bp, Homo sapiens
gctgcatgacctaccaggacaga

SEQ ID NO: 6267862 - DNA, 21 bp, Homo sapiens
gctgcatgccctctcaggccg

SEQ ID NO: 6267863 - DNA, 22 bp, Homo sapiens
gctgcatgccctctcaggccgg

SEQ ID NO: 6267864 - DNA, 19 bp, Homo sapiens
gctgcatgctctggaagcc

SEQ ID NO: 6267865 - DNA, 22 bp, Homo sapiens
gctgcatggcacataccaaagc

SEQ ID NO: 6267866 - DNA, 22 bp, Homo sapiens
gctgcatggcagggggctgctg

SEQ ID NO: 6267867 - DNA, 19 bp, Homo sapiens
gctgcatgttaagtgccat

SEQ ID NO: 6267868 - DNA, 18 bp, Homo sapiens
gctgcattgagtccagct

SEQ ID NO: 6267869 - DNA, 21 bp, Homo sapiens
gctgcattgcctgcggtcaag

SEQ ID NO: 6267870 - DNA, 18 bp, Homo sapiens
gctgcatttaaaagatac

SEQ ID NO: 6267871 - DNA, 16 bp, Homo sapiens
gctgcatttaaatcaa

SEQ ID NO: 6267872 - DNA, 21 bp, Homo sapiens
gctgcatttcacatgccttgc

SEQ ID NO: 6267873 - DNA, 20 bp, Homo sapiens
gctgcatttggctggagccc

SEQ ID NO: 6267874 - DNA, 19 bp, Homo sapiens
gctgcattttaagcataat

SEQ ID NO: 6267875 - DNA, 23 bp, Homo sapiens
gctgcattttaattttaaccaaa

SEQ ID NO: 6267876 - DNA, 20 bp, Homo sapiens
gctgccaagataccttcatg

SEQ ID NO: 6267877 - DNA, 15 bp, Homo sapiens
gctgccaagccccat

SEQ ID NO: 6267878 - DNA, 16 bp, Homo sapiens
gctgccaaggccagag

SEQ ID NO: 6267879 - DNA, 17 bp, Homo sapiens
gctgccaaggccagagt

SEQ ID NO: 6267880 - DNA, 23 bp, Homo sapiens
gctgccaaggccagagtggcctg

SEQ ID NO: 6267881 - DNA, 16 bp, Homo sapiens
gctgccaatatcctaa

SEQ ID NO: 6267882 - DNA, 20 bp, Homo sapiens
gctgccaatatcctaataaa

SEQ ID NO: 6267883 - DNA, 16 bp, Homo sapiens
gctgccaatgggagct

SEQ ID NO: 6267884 - DNA, 18 bp, Homo sapiens
gctgccacacttcaggct

SEQ ID NO: 6267885 - DNA, 23 bp, Homo sapiens
gctgccacacttcaggctcttct

SEQ ID NO: 6267886 - DNA, 19 bp, Homo sapiens
gctgccaccaaatctgtct

SEQ ID NO: 6267887 - DNA, 21 bp, Homo sapiens
gctgccaccacgtctgccagg

SEQ ID NO: 6267888 - DNA, 22 bp, Homo sapiens
gctgccaccacgtctgccaggc

SEQ ID NO: 6267889 - DNA, 12 bp, Homo sapiens
gctgccacccac

SEQ ID NO: 6267890 - DNA, 22 bp, Homo sapiens
gctgccacccaccccaagctgc

SEQ ID NO: 6267891 - DNA, 17 bp, Homo sapiens
gctgccacccacctccc

SEQ ID NO: 6267892 - DNA, 22 bp, Homo sapiens
gctgccacccacctccctgcct

SEQ ID NO: 6267893 - DNA, 23 bp, Homo sapiens
gctgccacccacctccctgcctc

SEQ ID NO: 6267894 - DNA, 22 bp, Homo sapiens
gctgccacccctcttctgctcc

SEQ ID NO: 6267895 - DNA, 17 bp, Homo sapiens
gctgccaccccttggca

SEQ ID NO: 6267896 - DNA, 19 bp, Homo sapiens
gctgccacccgcccacccg

SEQ ID NO: 6267897 - DNA, 14 bp, Homo sapiens
gctgccactctgct

SEQ ID NO: 6267898 - DNA, 22 bp, Homo sapiens
gctgccactctgctgcctgtac

SEQ ID NO: 6267899 - DNA, 11 bp, Homo sapiens
gctgccactgg

SEQ ID NO: 6267900 - DNA, 13 bp, Homo sapiens
gctgccactgggc

SEQ ID NO: 6267901 - DNA, 18 bp, Homo sapiens
gctgccactgggcacctg

SEQ ID NO: 6267902 - DNA, 21 bp, Homo sapiens
gctgccactgggcacctgcgc

SEQ ID NO: 6267903 - DNA, 14 bp, Homo sapiens
gctgccacttttta

SEQ ID NO: 6267904 - DNA, 15 bp, Homo sapiens
gctgccagcaccaag

SEQ ID NO: 6267905 - DNA, 12 bp, Homo sapiens
gctgccagccca

SEQ ID NO: 6267906 - DNA, 16 bp, Homo sapiens
gctgccagcccagaac

SEQ ID NO: 6267907 - DNA, 17 bp, Homo sapiens
gctgccagcccagaaca

SEQ ID NO: 6267908 - DNA, 19 bp, Homo sapiens
gctgccagcccagaacacc

SEQ ID NO: 6267909 - DNA, 15 bp, Homo sapiens
gctgccagcccagct

SEQ ID NO: 6267910 - DNA, 22 bp, Homo sapiens
gctgccagcccagctggccgga

SEQ ID NO: 6267911 - DNA, 14 bp, Homo sapiens
gctgccagccgggc

SEQ ID NO: 6267912 - DNA, 15 bp, Homo sapiens
gctgccagccgggca

SEQ ID NO: 6267913 - DNA, 16 bp, Homo sapiens
gctgccagccttccct

SEQ ID NO: 6267914 - DNA, 22 bp, Homo sapiens
gctgccagccttgagccctggc

SEQ ID NO: 6267915 - DNA, 23 bp, Homo sapiens
gctgccagccttgagccctggct

SEQ ID NO: 6267916 - DNA, 17 bp, Homo sapiens
gctgccagctctgtatc

SEQ ID NO: 6267917 - DNA, 12 bp, Homo sapiens
gctgccaggaca

SEQ ID NO: 6267918 - DNA, 13 bp, Homo sapiens
gctgccaggacac

SEQ ID NO: 6267919 - DNA, 19 bp, Homo sapiens
gctgccaggacacctgccc

SEQ ID NO: 6267920 - DNA, 10 bp, Homo sapiens
gctgccaggc

SEQ ID NO: 6267921 - DNA, 21 bp, Homo sapiens
gctgccaggcaccatctgcca

SEQ ID NO: 6267922 - DNA, 16 bp, Homo sapiens
gctgccaggcggccct

SEQ ID NO: 6267923 - DNA, 22 bp, Homo sapiens
gctgccaggcggccctggggag

SEQ ID NO: 6267924 - DNA, 23 bp, Homo sapiens
gctgccagggaagacagagcagg

SEQ ID NO: 6267925 - DNA, 12 bp, Homo sapiens
gctgccaggggg

SEQ ID NO: 6267926 - DNA, 21 bp, Homo sapiens
gctgccagggggcaaggagaa

SEQ ID NO: 6267927 - DNA, 17 bp, Homo sapiens
gctgccaggtgagaaac

SEQ ID NO: 6267928 - DNA, 17 bp, Homo sapiens
gctgccagtgcagccac

SEQ ID NO: 6267929 - DNA, 14 bp, Homo sapiens
gctgccagtgcctg

SEQ ID NO: 6267930 - DNA, 23 bp, Homo sapiens
gctgccagtgtgttactcatctt

SEQ ID NO: 6267931 - DNA, 13 bp, Homo sapiens
gctgccatcaccg

SEQ ID NO: 6267932 - DNA, 16 bp, Homo sapiens
gctgccatcagaaatt

SEQ ID NO: 6267933 - DNA, 17 bp, Homo sapiens
gctgccatccaggttca

SEQ ID NO: 6267934 - DNA, 21 bp, Homo sapiens
gctgccatccaggttcagctt

SEQ ID NO: 6267935 - DNA, 23 bp, Homo sapiens
gctgccatctcacctcctgctgg

SEQ ID NO: 6267936 - DNA, 12 bp, Homo sapiens
gctgccatgcca

SEQ ID NO: 6267937 - DNA, 15 bp, Homo sapiens
gctgccatgccactg

SEQ ID NO: 6267938 - DNA, 20 bp, Homo sapiens
gctgccatgccactgccagg

SEQ ID NO: 6267939 - DNA, 23 bp, Homo sapiens
gctgccatgccactgccaggcac

SEQ ID NO: 6267940 - DNA, 21 bp, Homo sapiens
gctgccatgtgaagagggaga

SEQ ID NO: 6267941 - DNA, 21 bp, Homo sapiens
gctgccatttccctgaacaga

SEQ ID NO: 6267942 - DNA, 18 bp, Homo sapiens
gctgccatttgatttttc

SEQ ID NO: 6267943 - DNA, 16 bp, Homo sapiens
gctgcccaatccatta

SEQ ID NO: 6267944 - DNA, 18 bp, Homo sapiens
gctgcccaatttcacaga

SEQ ID NO: 6267945 - DNA, 17 bp, Homo sapiens
gctgcccacacacccca

SEQ ID NO: 6267946 - DNA, 19 bp, Homo sapiens
gctgcccacaccaccgccc

SEQ ID NO: 6267947 - DNA, 16 bp, Homo sapiens
gctgcccacctggctg

SEQ ID NO: 6267948 - DNA, 18 bp, Homo sapiens
gctgcccacctggctgcc

SEQ ID NO: 6267949 - DNA, 19 bp, Homo sapiens
gctgcccacggccacccac

SEQ ID NO: 6267950 - DNA, 23 bp, Homo sapiens
gctgcccacggccacccaccctt

SEQ ID NO: 6267951 - DNA, 19 bp, Homo sapiens
gctgcccagacacatgggc

SEQ ID NO: 6267952 - DNA, 21 bp, Homo sapiens
gctgcccagcagcccctgaga

SEQ ID NO: 6267953 - DNA, 13 bp, Homo sapiens
gctgcccagcccc

SEQ ID NO: 6267954 - DNA, 20 bp, Homo sapiens
gctgcccagcccctcctccc

SEQ ID NO: 6267955 - DNA, 14 bp, Homo sapiens
gctgcccagccctc

SEQ ID NO: 6267956 - DNA, 13 bp, Homo sapiens
gctgcccaggcca

SEQ ID NO: 6267957 - DNA, 22 bp, Homo sapiens
gctgcccaggccacagccgcct

SEQ ID NO: 6267958 - DNA, 22 bp, Homo sapiens
gctgcccaggcctctcggtgct

SEQ ID NO: 6267959 - DNA, 18 bp, Homo sapiens
gctgcccaggggagccct

SEQ ID NO: 6267960 - DNA, 13 bp, Homo sapiens
gctgcccagtgca

SEQ ID NO: 6267961 - DNA, 17 bp, Homo sapiens
gctgcccatcatgtggc

SEQ ID NO: 6267962 - DNA, 19 bp, Homo sapiens
gctgcccatcatgtggccc

SEQ ID NO: 6267963 - DNA, 17 bp, Homo sapiens
gctgcccatcccagtcc

SEQ ID NO: 6267964 - DNA, 20 bp, Homo sapiens
gctgcccatcccagtccctc

SEQ ID NO: 6267965 - DNA, 16 bp, Homo sapiens
gctgcccatttcgtga

SEQ ID NO: 6267966 - DNA, 18 bp, Homo sapiens
gctgccccaacctgctga

SEQ ID NO: 6267967 - DNA, 22 bp, Homo sapiens
gcaggggttgagagctttctgc

SEQ ID NO: 6267968 - DNA, 15 bp, Homo sapiens
gcaggggttgcagtg

SEQ ID NO: 6267969 - DNA, 16 bp, Homo sapiens
gcaggggttggcagcg

SEQ ID NO: 6267970 - DNA, 19 bp, Homo sapiens
gcaggggtttgggtggggg

SEQ ID NO: 6267971 - DNA, 23 bp, Homo sapiens
gcaggggtttgggtgggggctgt

SEQ ID NO: 6267972 - DNA, 15 bp, Homo sapiens
gcagggtcaagcctc

SEQ ID NO: 6267973 - DNA, 16 bp, Homo sapiens
gcagggtcaggagagg

SEQ ID NO: 6267974 - DNA, 17 bp, Homo sapiens
gcagggtcaggagaggg

SEQ ID NO: 6267975 - DNA, 19 bp, Homo sapiens
gcagggtcattatcagaac

SEQ ID NO: 6267976 - DNA, 22 bp, Homo sapiens
gcagggtcattatcagaacatg

SEQ ID NO: 6267977 - DNA, 16 bp, Homo sapiens
gcagggtccacagctg

SEQ ID NO: 6267978 - DNA, 16 bp, Homo sapiens
gcagggtctcactctg

SEQ ID NO: 6267979 - DNA, 17 bp, Homo sapiens
gcagggtctcactctgt

SEQ ID NO: 6267980 - DNA, 18 bp, Homo sapiens
gcagggtctcactctgtc

SEQ ID NO: 6267981 - DNA, 17 bp, Homo sapiens
gcagggtctctgctcca

SEQ ID NO: 6267982 - DNA, 14 bp, Homo sapiens
gcagggtcttcctg

SEQ ID NO: 6267983 - DNA, 20 bp, Homo sapiens
gcagggtcttcctgcagtgc

SEQ ID NO: 6267984 - DNA, 13 bp, Homo sapiens
gcagggtcttgct

SEQ ID NO: 6267985 - DNA, 13 bp, Homo sapiens
gcagggtctttgt

SEQ ID NO: 6267986 - DNA, 23 bp, Homo sapiens
gcagggtcttttcatctgggaaa

SEQ ID NO: 6267987 - DNA, 15 bp, Homo sapiens
gcagggtgacgcctg

SEQ ID NO: 6267988 - DNA, 21 bp, Homo sapiens
gcagggtgacgcctgagacag

SEQ ID NO: 6267989 - DNA, 14 bp, Homo sapiens
gcagggtgagaagc

SEQ ID NO: 6267990 - DNA, 22 bp, Homo sapiens
gcagggtgggcttgtggggcct

SEQ ID NO: 6267991 - DNA, 16 bp, Homo sapiens
gcagggtggggggcca

SEQ ID NO: 6267992 - DNA, 13 bp, Homo sapiens
gcagggtggggtc

SEQ ID NO: 6267993 - DNA, 22 bp, Homo sapiens
gcagggtggggtctgggagggg

SEQ ID NO: 6267994 - DNA, 18 bp, Homo sapiens
gcagggtgggtgagctct

SEQ ID NO: 6267995 - DNA, 21 bp, Homo sapiens
gcagggtggtggtattctgtc

SEQ ID NO: 6267996 - DNA, 22 bp, Homo sapiens
gcagggtggtggtattctgtca

SEQ ID NO: 6267997 - DNA, 15 bp, Homo sapiens
gcagggtgtgtactg

SEQ ID NO: 6267998 - DNA, 19 bp, Homo sapiens
gcagggttcaagccttcca

SEQ ID NO: 6267999 - DNA, 18 bp, Homo sapiens
gcagggtttgagcacaat

SEQ ID NO: 6268000 - DNA, 22 bp, Homo sapiens
gcagggtttgagcacaatctgt

SEQ ID NO: 6268001 - DNA, 16 bp, Homo sapiens
gcaggtacatttctga

SEQ ID NO: 6268002 - DNA, 21 bp, Homo sapiens
gcaggtacatttctgattctg

SEQ ID NO: 6268003 - DNA, 22 bp, Homo sapiens
gcaggtacttcctcctgatggc

SEQ ID NO: 6268004 - DNA, 24 bp, Homo sapiens
gcaggtacttcctcctgatggcca

SEQ ID NO: 6268005 - DNA, 23 bp, Homo sapiens
gcaggtagatcgcttgagcccag

SEQ ID NO: 6268006 - DNA, 17 bp, Homo sapiens
gcaggtagcctgctggt

SEQ ID NO: 6268007 - DNA, 16 bp, Homo sapiens
gcaggtaggggcacag

SEQ ID NO: 6268008 - DNA, 17 bp, Homo sapiens
gcaggtaggggcacagt

SEQ ID NO: 6268009 - DNA, 20 bp, Homo sapiens
gcaggtatttagaagcagag

SEQ ID NO: 6268010 - DNA, 23 bp, Homo sapiens
gcaggtatttagaagcagaggga

SEQ ID NO: 6268011 - DNA, 21 bp, Homo sapiens
gcaggtcaacagctatgctgg

SEQ ID NO: 6268012 - DNA, 16 bp, Homo sapiens
gcaggtcactgtcact

SEQ ID NO: 6268013 - DNA, 18 bp, Homo sapiens
gcaggtcactgtcactgc

SEQ ID NO: 6268014 - DNA, 14 bp, Homo sapiens
gcaggtcagcccat

SEQ ID NO: 6268015 - DNA, 23 bp, Homo sapiens
gcaggtcagcccatggaggcaga

SEQ ID NO: 6268016 - DNA, 18 bp, Homo sapiens
gcaggtcaggaccaggac

SEQ ID NO: 6268017 - DNA, 17 bp, Homo sapiens
gcaggtcatggagcagc

SEQ ID NO: 6268018 - DNA, 21 bp, Homo sapiens
gcaggtcatggagcagccccc

SEQ ID NO: 6268019 - DNA, 22 bp, Homo sapiens
gcaggtcatggagcagccccca

SEQ ID NO: 6268020 - DNA, 14 bp, Homo sapiens
gcaggtccagctct

SEQ ID NO: 6268021 - DNA, 15 bp, Homo sapiens
gcaggtccagctctg

SEQ ID NO: 6268022 - DNA, 17 bp, Homo sapiens
gcaggtccagctctgtg

SEQ ID NO: 6268023 - DNA, 23 bp, Homo sapiens
gcaggtccccagactccaccaag

SEQ ID NO: 6268024 - DNA, 18 bp, Homo sapiens
gcaggtcccgagccccct

SEQ ID NO: 6268025 - DNA, 11 bp, Homo sapiens
gcaggtcccta

SEQ ID NO: 6268026 - DNA, 12 bp, Homo sapiens
gcaggtccctaa

SEQ ID NO: 6268027 - DNA, 17 bp, Homo sapiens
gcaggtccctaataaag

SEQ ID NO: 6268028 - DNA, 23 bp, Homo sapiens
gcaggtccctaataaagctgtgt

SEQ ID NO: 6268029 - DNA, 15 bp, Homo sapiens
gcaggtcgggctgcc

SEQ ID NO: 6268030 - DNA, 22 bp, Homo sapiens
gcaggtcgggctgccagcccag

SEQ ID NO: 6268031 - DNA, 16 bp, Homo sapiens
gcaggtctccacctgc

SEQ ID NO: 6268032 - DNA, 15 bp, Homo sapiens
gcaggtctctggcag

SEQ ID NO: 6268033 - DNA, 16 bp, Homo sapiens
gcaggtctctggcaga

SEQ ID NO: 6268034 - DNA, 22 bp, Homo sapiens
gcaggtctctgtacgggccagt

SEQ ID NO: 6268035 - DNA, 17 bp, Homo sapiens
gcaggtctcttctgggc

SEQ ID NO: 6268036 - DNA, 12 bp, Homo sapiens
gcaggtctgaga

SEQ ID NO: 6268037 - DNA, 21 bp, Homo sapiens
gcaggtctgcaagggcccaga

SEQ ID NO: 6268038 - DNA, 13 bp, Homo sapiens
gcaggtctgggcc

SEQ ID NO: 6268039 - DNA, 20 bp, Homo sapiens
gcaggtcttgaactcctggc

SEQ ID NO: 6268040 - DNA, 16 bp, Homo sapiens
gcaggtgaaacccagt

SEQ ID NO: 6268041 - DNA, 17 bp, Homo sapiens
gcaggtgagcaaccagt

SEQ ID NO: 6268042 - DNA, 21 bp, Homo sapiens
gcaggtgattggaccaggcca

SEQ ID NO: 6268043 - DNA, 18 bp, Homo sapiens
gcaggtgcaagagacaga

SEQ ID NO: 6268044 - DNA, 19 bp, Homo sapiens
gcaggtgcaagagacagag

SEQ ID NO: 6268045 - DNA, 22 bp, Homo sapiens
gcaggtgcaagagacagagccc

SEQ ID NO: 6268046 - DNA, 13 bp, Homo sapiens
gcaggtgcagccc

SEQ ID NO: 6268047 - DNA, 12 bp, Homo sapiens
gcaggtgccatc

SEQ ID NO: 6268048 - DNA, 16 bp, Homo sapiens
gcaggtgcctccaggt

SEQ ID NO: 6268049 - DNA, 21 bp, Homo sapiens
gcaggtgcctccaggtgtgca

SEQ ID NO: 6268050 - DNA, 13 bp, Homo sapiens
gcaggtgcctggc

SEQ ID NO: 6268051 - DNA, 15 bp, Homo sapiens
gcaggtgcctggctt

SEQ ID NO: 6268052 - DNA, 16 bp, Homo sapiens
gcaggtgctattgtta

SEQ ID NO: 6268053 - DNA, 20 bp, Homo sapiens
gcaggtgctcatgctgctcc

SEQ ID NO: 6268054 - DNA, 12 bp, Homo sapiens
gcaggtgctgcc

SEQ ID NO: 6268055 - DNA, 22 bp, Homo sapiens
gcaggtgctgcggcgcgggccc

SEQ ID NO: 6268056 - DNA, 16 bp, Homo sapiens
gcaggtgctggagcac

SEQ ID NO: 6268057 - DNA, 21 bp, Homo sapiens
gcaggtgctggagcactgggc

SEQ ID NO: 6268058 - DNA, 17 bp, Homo sapiens
gcaggtgctggtcccgg

SEQ ID NO: 6268059 - DNA, 23 bp, Homo sapiens
gcaggtgctgtgcgccttgtaga

SEQ ID NO: 6268060 - DNA, 20 bp, Homo sapiens
gcaggtgcttttggcagaga

SEQ ID NO: 6268061 - DNA, 17 bp, Homo sapiens
gcaggtggacgctgcag

SEQ ID NO: 6268062 - DNA, 19 bp, Homo sapiens
gcaggtggatctatttcat

SEQ ID NO: 6268063 - DNA, 20 bp, Homo sapiens
gcaggtggatctatttcatg

SEQ ID NO: 6268064 - DNA, 18 bp, Homo sapiens
gcaggtggccaagttcct

SEQ ID NO: 6268065 - DNA, 19 bp, Homo sapiens
gcaggtggccacagcagga

SEQ ID NO: 6268066 - DNA, 12 bp, Homo sapiens
gcaggtggccag

SEQ ID NO: 6268067 - DNA, 13 bp, Homo sapiens
gcaggtggccagg

SEQ ID NO: 6268068 - DNA, 15 bp, Homo sapiens
gcaggtggccagggc

SEQ ID NO: 6268069 - DNA, 17 bp, Homo sapiens
gcaggtggccgcccctg

SEQ ID NO: 6268070 - DNA, 20 bp, Homo sapiens
gcaggtggccgcccctgagg

SEQ ID NO: 6268071 - DNA, 17 bp, Homo sapiens
gcaggtggcctccctcc

SEQ ID NO: 6268072 - DNA, 20 bp, Homo sapiens
gcaggtggcctccctccaga

SEQ ID NO: 6268073 - DNA, 14 bp, Homo sapiens
gcaggtggcctctg

SEQ ID NO: 6268074 - DNA, 13 bp, Homo sapiens
gcaggtgggatga

SEQ ID NO: 6268075 - DNA, 14 bp, Homo sapiens
gcaggtgggcagac

SEQ ID NO: 6268076 - DNA, 21 bp, Homo sapiens
gcaggtgggcagacagtgacc

SEQ ID NO: 6268077 - DNA, 14 bp, Homo sapiens
gcaggtgggctgcc

SEQ ID NO: 6268078 - DNA, 16 bp, Homo sapiens
gcaggtgggctgcctg

SEQ ID NO: 6268079 - DNA, 18 bp, Homo sapiens
gcaggtgggctgcctgct

SEQ ID NO: 6268080 - DNA, 17 bp, Homo sapiens
gcaggtgggctggactt

SEQ ID NO: 6268081 - DNA, 13 bp, Homo sapiens
gcaggtggggagg

SEQ ID NO: 6268082 - DNA, 15 bp, Homo sapiens
gcaggtgggggctgc

SEQ ID NO: 6268083 - DNA, 22 bp, Homo sapiens
gcaggtgggggctgcgtccctg

SEQ ID NO: 6268084 - DNA, 23 bp, Homo sapiens
gcaggtggggtgatggccagagg

SEQ ID NO: 6268085 - DNA, 21 bp, Homo sapiens
gcaggtggggttcgaggggaa

SEQ ID NO: 6268086 - DNA, 22 bp, Homo sapiens
gcaggtggggttttcacttcct

SEQ ID NO: 6268087 - DNA, 18 bp, Homo sapiens
gcaggtggtggaggggcg

SEQ ID NO: 6268088 - DNA, 22 bp, Homo sapiens
gcaggtggtggcactgagcccc

SEQ ID NO: 6268089 - DNA, 21 bp, Homo sapiens
gcaggtgtcatatgactgatt

SEQ ID NO: 6268090 - DNA, 14 bp, Homo sapiens
gcaggtgtcctttc

SEQ ID NO: 6268091 - DNA, 19 bp, Homo sapiens
gcaggtgtcctttcccctc

SEQ ID NO: 6268092 - DNA, 21 bp, Homo sapiens
gcaggtgtcctttcccctctc

SEQ ID NO: 6268093 - DNA, 11 bp, Homo sapiens
gcaggtgtcta

SEQ ID NO: 6268094 - DNA, 15 bp, Homo sapiens
gcaggtgtgaccctg

SEQ ID NO: 6268095 - DNA, 18 bp, Homo sapiens
gcaggtgtgggctcccac

SEQ ID NO: 6268096 - DNA, 18 bp, Homo sapiens
gcaggtgtggtggctcat

SEQ ID NO: 6268097 - DNA, 22 bp, Homo sapiens
gcaggtgttgggacctgctgct

SEQ ID NO: 6268098 - DNA, 13 bp, Homo sapiens
gcaggtgtttctt

SEQ ID NO: 6268099 - DNA, 20 bp, Homo sapiens
gcaggtgtttggcacccaaa

SEQ ID NO: 6268100 - DNA, 15 bp, Homo sapiens
gcaggttagagacag

SEQ ID NO: 6268101 - DNA, 15 bp, Homo sapiens
gcaggttatttttat

SEQ ID NO: 6268102 - DNA, 15 bp, Homo sapiens
gcaggttcccaagct

SEQ ID NO: 6268103 - DNA, 17 bp, Homo sapiens
gcaggttcctggggccg

SEQ ID NO: 6268104 - DNA, 19 bp, Homo sapiens
gcaggttctcagctgggct

SEQ ID NO: 6268105 - DNA, 17 bp, Homo sapiens
gcaggttctctcctgtg

SEQ ID NO: 6268106 - DNA, 12 bp, Homo sapiens
gcaggttcttga

SEQ ID NO: 6268107 - DNA, 17 bp, Homo sapiens
gcaggttcttgttggtg

SEQ ID NO: 6268108 - DNA, 19 bp, Homo sapiens
gcaggttgaatgggttctc

SEQ ID NO: 6268109 - DNA, 16 bp, Homo sapiens
gcaggttgaggggctc

SEQ ID NO: 6268110 - DNA, 19 bp, Homo sapiens
gcaggttgatcagtgagct

SEQ ID NO: 6268111 - DNA, 22 bp, Homo sapiens
gcaggttggaactatgcagtgt

SEQ ID NO: 6268112 - DNA, 21 bp, Homo sapiens
gcaggttggaaggggccttgc

SEQ ID NO: 6268113 - DNA, 15 bp, Homo sapiens
gcaggttggacccca

SEQ ID NO: 6268114 - DNA, 18 bp, Homo sapiens
gcaggttggaccccagag

SEQ ID NO: 6268115 - DNA, 19 bp, Homo sapiens
gcaggttggaccccagaga

SEQ ID NO: 6268116 - DNA, 23 bp, Homo sapiens
gcaggttgggaatgaggcttgct

SEQ ID NO: 6268117 - DNA, 21 bp, Homo sapiens
gcaggtttatattgggaagct

SEQ ID NO: 6268118 - DNA, 18 bp, Homo sapiens
gcaggtttcatttcttat

SEQ ID NO: 6268119 - DNA, 20 bp, Homo sapiens
gcaggtttgtaatgcaaaag

SEQ ID NO: 6268120 - DNA, 14 bp, Homo sapiens
gcagtaaaaactgt

SEQ ID NO: 6268121 - DNA, 16 bp, Homo sapiens
gcagtaaaacacattt

SEQ ID NO: 6268122 - DNA, 18 bp, Homo sapiens
gcagtaaactttctctgc

SEQ ID NO: 6268123 - DNA, 15 bp, Homo sapiens
gcagtaaagaagaaa

SEQ ID NO: 6268124 - DNA, 16 bp, Homo sapiens
gcagtaaagagaaact

SEQ ID NO: 6268125 - DNA, 17 bp, Homo sapiens
gcagtaaagagaaactt

SEQ ID NO: 6268126 - DNA, 19 bp, Homo sapiens
gcagtaaatacttgcagtt

SEQ ID NO: 6268127 - DNA, 20 bp, Homo sapiens
gcagtaaatacttgcagttg

SEQ ID NO: 6268128 - DNA, 16 bp, Homo sapiens
gcagtaaatatttact

SEQ ID NO: 6268129 - DNA, 15 bp, Homo sapiens
gcagtaaatccacag

SEQ ID NO: 6268130 - DNA, 21 bp, Homo sapiens
gcagtaacactggccttccct

SEQ ID NO: 6268131 - DNA, 13 bp, Homo sapiens
gcagtaacattct

SEQ ID NO: 6268132 - DNA, 16 bp, Homo sapiens
gcagtaacttgggagt

SEQ ID NO: 6268133 - DNA, 15 bp, Homo sapiens
gcagtaagcaggcct

SEQ ID NO: 6268134 - DNA, 15 bp, Homo sapiens
gcagtaagtcttttt

SEQ ID NO: 6268135 - DNA, 13 bp, Homo sapiens
gcagtaataaaaa

SEQ ID NO: 6268136 - DNA, 21 bp, Homo sapiens
gcagtaatctgtcagtgtttg

SEQ ID NO: 6268137 - DNA, 14 bp, Homo sapiens
gcagtaattcccat

SEQ ID NO: 6268138 - DNA, 22 bp, Homo sapiens
gcagtaattcccatctgcttta

SEQ ID NO: 6268139 - DNA, 12 bp, Homo sapiens
gcagtacatcaa

SEQ ID NO: 6268140 - DNA, 19 bp, Homo sapiens
gcagtacatcttgtgcatg

SEQ ID NO: 6268141 - DNA, 17 bp, Homo sapiens
gcagtaccatcccactg

SEQ ID NO: 6268142 - DNA, 22 bp, Homo sapiens
gcagtaccctccattgggcaca

SEQ ID NO: 6268143 - DNA, 16 bp, Homo sapiens
gcagtacctataaagt

SEQ ID NO: 6268144 - DNA, 18 bp, Homo sapiens
gctgccccaatgtgacct

SEQ ID NO: 6268145 - DNA, 20 bp, Homo sapiens
gctgccccacatccccacct

SEQ ID NO: 6268146 - DNA, 16 bp, Homo sapiens
gctgccccacctgccg

SEQ ID NO: 6268147 - DNA, 14 bp, Homo sapiens
gctgccccagctga

SEQ ID NO: 6268148 - DNA, 15 bp, Homo sapiens
gctgccccagctgac

SEQ ID NO: 6268149 - DNA, 20 bp, Homo sapiens
gctgccccaggccggagccc

SEQ ID NO: 6268150 - DNA, 21 bp, Homo sapiens
gctgccccagggcctgcttcc

SEQ ID NO: 6268151 - DNA, 21 bp, Homo sapiens
gctgccccatctcccctcagc

SEQ ID NO: 6268152 - DNA, 23 bp, Homo sapiens
gctgccccatgaagccacagccc

SEQ ID NO: 6268153 - DNA, 17 bp, Homo sapiens
gctgccccattccagct

SEQ ID NO: 6268154 - DNA, 23 bp, Homo sapiens
gctgccccattgagatcttcctg

SEQ ID NO: 6268155 - DNA, 15 bp, Homo sapiens
gctgcccccaacact

SEQ ID NO: 6268156 - DNA, 18 bp, Homo sapiens
gctgcccccaacactcca

SEQ ID NO: 6268157 - DNA, 21 bp, Homo sapiens
gctgcccccaacactccaggc

SEQ ID NO: 6268158 - DNA, 13 bp, Homo sapiens
gctgcccccaccc

SEQ ID NO: 6268159 - DNA, 15 bp, Homo sapiens
gctgcccccacctct

SEQ ID NO: 6268160 - DNA, 15 bp, Homo sapiens
gctgcccccagagcc

SEQ ID NO: 6268161 - DNA, 20 bp, Homo sapiens
gctgcccccagagccacagt

SEQ ID NO: 6268162 - DNA, 21 bp, Homo sapiens
gctgcccccagagccacagtt

SEQ ID NO: 6268163 - DNA, 14 bp, Homo sapiens
gctgcccccgctca

SEQ ID NO: 6268164 - DNA, 14 bp, Homo sapiens
gctgcccccggccc

SEQ ID NO: 6268165 - DNA, 19 bp, Homo sapiens
gctgcccccggccccctgg

SEQ ID NO: 6268166 - DNA, 23 bp, Homo sapiens
gctgcccccggccccctggtctc

SEQ ID NO: 6268167 - DNA, 17 bp, Homo sapiens
gctgcccccttccccag

SEQ ID NO: 6268168 - DNA, 19 bp, Homo sapiens
gctgcccccttccccagcc

SEQ ID NO: 6268169 - DNA, 20 bp, Homo sapiens
gctgcccccttccccagccc

SEQ ID NO: 6268170 - DNA, 15 bp, Homo sapiens
gctgccccggcccct

SEQ ID NO: 6268171 - DNA, 11 bp, Homo sapiens
gctgccccggg

SEQ ID NO: 6268172 - DNA, 21 bp, Homo sapiens
gctgccccgggatgcgaggct

SEQ ID NO: 6268173 - DNA, 22 bp, Homo sapiens
gctgccccgggtccccagctcc

SEQ ID NO: 6268174 - DNA, 23 bp, Homo sapiens
gctgccccgggtccccagctccc

SEQ ID NO: 6268175 - DNA, 19 bp, Homo sapiens
gctgccccgttccctgtca

SEQ ID NO: 6268176 - DNA, 19 bp, Homo sapiens
gctgcccctaatctctgta

SEQ ID NO: 6268177 - DNA, 23 bp, Homo sapiens
gctgcccctcatttatcactctg

SEQ ID NO: 6268178 - DNA, 24 bp, Homo sapiens
gctgcccctccctgcctccaccca

SEQ ID NO: 6268179 - DNA, 13 bp, Homo sapiens
gctgcccctcctg

SEQ ID NO: 6268180 - DNA, 20 bp, Homo sapiens
gctgcccctcctggagcaga

SEQ ID NO: 6268181 - DNA, 15 bp, Homo sapiens
gctgcccctcgcaca

SEQ ID NO: 6268182 - DNA, 22 bp, Homo sapiens
gctgcccctcgcacacagggct

SEQ ID NO: 6268183 - DNA, 12 bp, Homo sapiens
gctgcccctctc

SEQ ID NO: 6268184 - DNA, 17 bp, Homo sapiens
gctgcccctctctgggc

SEQ ID NO: 6268185 - DNA, 19 bp, Homo sapiens
gctgcccctctctgggcct

SEQ ID NO: 6268186 - DNA, 20 bp, Homo sapiens
gctgcccctgcacagcaggc

SEQ ID NO: 6268187 - DNA, 14 bp, Homo sapiens
gctgcccctgcctt

SEQ ID NO: 6268188 - DNA, 14 bp, Homo sapiens
gctgcccctgctgc

SEQ ID NO: 6268189 - DNA, 13 bp, Homo sapiens
gctgcccctggca

SEQ ID NO: 6268190 - DNA, 19 bp, Homo sapiens
gctgcccctggcagcccct

SEQ ID NO: 6268191 - DNA, 13 bp, Homo sapiens
gctgccccttgca

SEQ ID NO: 6268192 - DNA, 14 bp, Homo sapiens
gctgccccttgcaa

SEQ ID NO: 6268193 - DNA, 17 bp, Homo sapiens
gctgcccgccgcccctc

SEQ ID NO: 6268194 - DNA, 19 bp, Homo sapiens
gctgcccgccgcccctcca

SEQ ID NO: 6268195 - DNA, 23 bp, Homo sapiens
gctgcccgcgggagacagcttct

SEQ ID NO: 6268196 - DNA, 12 bp, Homo sapiens
gctgcccgctcc

SEQ ID NO: 6268197 - DNA, 19 bp, Homo sapiens
gctgcccgctcccagtgtc

SEQ ID NO: 6268198 - DNA, 17 bp, Homo sapiens
gctgcccggcgccctct

SEQ ID NO: 6268199 - DNA, 23 bp, Homo sapiens
gctgcccggcgccctctgtcctg

SEQ ID NO: 6268200 - DNA, 20 bp, Homo sapiens
gctgcccggggtggggtgca

SEQ ID NO: 6268201 - DNA, 21 bp, Homo sapiens
gctgcccgtgaggagggggag

SEQ ID NO: 6268202 - DNA, 16 bp, Homo sapiens
gctgccctagctgacc

SEQ ID NO: 6268203 - DNA, 17 bp, Homo sapiens
gctgccctagctgaccc

SEQ ID NO: 6268204 - DNA, 18 bp, Homo sapiens
gctgccctagctgacccc

SEQ ID NO: 6268205 - DNA, 18 bp, Homo sapiens
gctgccctatgggcctgc

SEQ ID NO: 6268206 - DNA, 21 bp, Homo sapiens
gctgccctcagggactgcacc

SEQ ID NO: 6268207 - DNA, 21 bp, Homo sapiens
gctgccctccatcccgacatg

SEQ ID NO: 6268208 - DNA, 14 bp, Homo sapiens
gctgccctcccaca

SEQ ID NO: 6268209 - DNA, 12 bp, Homo sapiens
gctgccctcctg

SEQ ID NO: 6268210 - DNA, 23 bp, Homo sapiens
gctgccctcctgtgctcagccct

SEQ ID NO: 6268211 - DNA, 12 bp, Homo sapiens
gctgccctctcc

SEQ ID NO: 6268212 - DNA, 15 bp, Homo sapiens
gctgccctctcctgg

SEQ ID NO: 6268213 - DNA, 18 bp, Homo sapiens
gctgccctctcctgggca

SEQ ID NO: 6268214 - DNA, 22 bp, Homo sapiens
gctgccctctcctgggcagctg

SEQ ID NO: 6268215 - DNA, 13 bp, Homo sapiens
gctgccctctggg

SEQ ID NO: 6268216 - DNA, 22 bp, Homo sapiens
gctgccctgagaagctgctcca

SEQ ID NO: 6268217 - DNA, 17 bp, Homo sapiens
gctgccctgaggggctg

SEQ ID NO: 6268218 - DNA, 15 bp, Homo sapiens
gctgccctgccactt

SEQ ID NO: 6268219 - DNA, 16 bp, Homo sapiens
gctgccctgcccacct

SEQ ID NO: 6268220 - DNA, 22 bp, Homo sapiens
gctgccctgcccacctggcctc

SEQ ID NO: 6268221 - DNA, 24 bp, Homo sapiens
gctgccctgcccacctggcctctg

SEQ ID NO: 6268222 - DNA, 21 bp, Homo sapiens
gctgccctggaggaaccgaaa

SEQ ID NO: 6268223 - DNA, 13 bp, Homo sapiens
gctgccctggccc

SEQ ID NO: 6268224 - DNA, 23 bp, Homo sapiens
gctgccctggggcatcatgggca

SEQ ID NO: 6268225 - DNA, 14 bp, Homo sapiens
gctgccctgggtcc

SEQ ID NO: 6268226 - DNA, 22 bp, Homo sapiens
gctgccctgggtcctgcctgca

SEQ ID NO: 6268227 - DNA, 12 bp, Homo sapiens
gctgccctggtg

SEQ ID NO: 6268228 - DNA, 14 bp, Homo sapiens
gctgccctggtgct

SEQ ID NO: 6268229 - DNA, 15 bp, Homo sapiens
gctgccctggtgctg

SEQ ID NO: 6268230 - DNA, 18 bp, Homo sapiens
gctgccctggtgctgcca

SEQ ID NO: 6268231 - DNA, 18 bp, Homo sapiens
gctgccctgtccactctg

SEQ ID NO: 6268232 - DNA, 12 bp, Homo sapiens
gctgccctgtga

SEQ ID NO: 6268233 - DNA, 23 bp, Homo sapiens
gctgccctgtgagagccacgctg

SEQ ID NO: 6268234 - DNA, 14 bp, Homo sapiens
gctgccctgtgagt

SEQ ID NO: 6268235 - DNA, 18 bp, Homo sapiens
gctgcccttcgctgccag

SEQ ID NO: 6268236 - DNA, 19 bp, Homo sapiens
gctgcccttcgctgccagg

SEQ ID NO: 6268237 - DNA, 22 bp, Homo sapiens
gctgcccttcgctgccaggaca

SEQ ID NO: 6268238 - DNA, 16 bp, Homo sapiens
gctgcccttgcagggt

SEQ ID NO: 6268239 - DNA, 15 bp, Homo sapiens
gctgcccttgttgcc

SEQ ID NO: 6268240 - DNA, 17 bp, Homo sapiens
gctgccctttctgggca

SEQ ID NO: 6268241 - DNA, 21 bp, Homo sapiens
gctgccctttggccaacaggg

SEQ ID NO: 6268242 - DNA, 22 bp, Homo sapiens
gctgccgacttggagactcctg

SEQ ID NO: 6268243 - DNA, 24 bp, Homo sapiens
gctgccgacttggagactcctggt

SEQ ID NO: 6268244 - DNA, 13 bp, Homo sapiens
gctgccgagggct

SEQ ID NO: 6268245 - DNA, 20 bp, Homo sapiens
gctgccgagggctggccggg

SEQ ID NO: 6268246 - DNA, 22 bp, Homo sapiens
gctgccgagggctggccgggac

SEQ ID NO: 6268247 - DNA, 13 bp, Homo sapiens
gctgccgcaaggc

SEQ ID NO: 6268248 - DNA, 15 bp, Homo sapiens
gctgccgcaaggccc

SEQ ID NO: 6268249 - DNA, 16 bp, Homo sapiens
gctgccgcaaggccct

SEQ ID NO: 6268250 - DNA, 17 bp, Homo sapiens
gctgccgcaaggccctg

SEQ ID NO: 6268251 - DNA, 16 bp, Homo sapiens
gctgccgcatctgcct

SEQ ID NO: 6268252 - DNA, 19 bp, Homo sapiens
gctgccgcatctgcctgga

SEQ ID NO: 6268253 - DNA, 23 bp, Homo sapiens
gctgccgcatctgcctggagcct

SEQ ID NO: 6268254 - DNA, 13 bp, Homo sapiens
gctgccgccacca

SEQ ID NO: 6268255 - DNA, 14 bp, Homo sapiens
gctgccgccaccac

SEQ ID NO: 6268256 - DNA, 17 bp, Homo sapiens
gctgccgccccacccag

SEQ ID NO: 6268257 - DNA, 23 bp, Homo sapiens
gctgccgcccttcctggaggctg

SEQ ID NO: 6268258 - DNA, 13 bp, Homo sapiens
gctgccgcctccc

SEQ ID NO: 6268259 - DNA, 20 bp, Homo sapiens
gctgccgcctcccagcctgg

SEQ ID NO: 6268260 - DNA, 16 bp, Homo sapiens
gctgccgcgcagtgtg

SEQ ID NO: 6268261 - DNA, 17 bp, Homo sapiens
gctgccgctgccgctgc

SEQ ID NO: 6268262 - DNA, 16 bp, Homo sapiens
gctgccggaggagcat

SEQ ID NO: 6268263 - DNA, 21 bp, Homo sapiens
gctgccggcacagctgggata

SEQ ID NO: 6268264 - DNA, 14 bp, Homo sapiens
gctgccggcagtgc

SEQ ID NO: 6268265 - DNA, 15 bp, Homo sapiens
gctgccggcagtgct

SEQ ID NO: 6268266 - DNA, 14 bp, Homo sapiens
gctgccggctctgg

SEQ ID NO: 6268267 - DNA, 19 bp, Homo sapiens
gctgccgtgcacggggcca

SEQ ID NO: 6268268 - DNA, 20 bp, Homo sapiens
gctgccgtgcacggggccag

SEQ ID NO: 6268269 - DNA, 18 bp, Homo sapiens
gctgccgtgccgcctgca

SEQ ID NO: 6268270 - DNA, 21 bp, Homo sapiens
gctgccgtgcctgtgtcctga

SEQ ID NO: 6268271 - DNA, 14 bp, Homo sapiens
gctgcctaaatcca

SEQ ID NO: 6268272 - DNA, 18 bp, Homo sapiens
gctgcctaagtggctgct

SEQ ID NO: 6268273 - DNA, 14 bp, Homo sapiens
gctgcctaataaag

SEQ ID NO: 6268274 - DNA, 14 bp, Homo sapiens
gctgcctacctaat

SEQ ID NO: 6268275 - DNA, 20 bp, Homo sapiens
gctgcctagattcagggaaa

SEQ ID NO: 6268276 - DNA, 17 bp, Homo sapiens
gctgcctagcaagctgg

SEQ ID NO: 6268277 - DNA, 22 bp, Homo sapiens
gctgcctagccctccccccagc

SEQ ID NO: 6268278 - DNA, 18 bp, Homo sapiens
gctgcctagtgctacaga

SEQ ID NO: 6268279 - DNA, 12 bp, Homo sapiens
gctgcctcactt

SEQ ID NO: 6268280 - DNA, 12 bp, Homo sapiens
gctgcctcagcc

SEQ ID NO: 6268281 - DNA, 24 bp, Homo sapiens
gctgcctcagccagtggcacagga

SEQ ID NO: 6268282 - DNA, 24 bp, Homo sapiens
gctgcctcatgaccctcctgtcca

SEQ ID NO: 6268283 - DNA, 14 bp, Homo sapiens
gctgcctcatttag

SEQ ID NO: 6268284 - DNA, 21 bp, Homo sapiens
gctgcctcatttagagaggaa

SEQ ID NO: 6268285 - DNA, 21 bp, Homo sapiens
gctgcctccaagtcatgggag

SEQ ID NO: 6268286 - DNA, 20 bp, Homo sapiens
gctgcctccactcccacttc

SEQ ID NO: 6268287 - DNA, 15 bp, Homo sapiens
gctgcctccagcctg

SEQ ID NO: 6268288 - DNA, 16 bp, Homo sapiens
gctgcctccagcctgg

SEQ ID NO: 6268289 - DNA, 19 bp, Homo sapiens
gctgcctccagcctggtgg

SEQ ID NO: 6268290 - DNA, 23 bp, Homo sapiens
gctgcctccagcctggtggccca

SEQ ID NO: 6268291 - DNA, 15 bp, Homo sapiens
gctgcctccatggca

SEQ ID NO: 6268292 - DNA, 21 bp, Homo sapiens
gctgcctccattatccattcc

SEQ ID NO: 6268293 - DNA, 23 bp, Homo sapiens
gctgcctccccaaccctgcccct

SEQ ID NO: 6268294 - DNA, 15 bp, Homo sapiens
gctgcctccccaatc

SEQ ID NO: 6268295 - DNA, 17 bp, Homo sapiens
gctgcctcccctcctct

SEQ ID NO: 6268296 - DNA, 20 bp, Homo sapiens
gctgcctcccctcctctgct

SEQ ID NO: 6268297 - DNA, 22 bp, Homo sapiens
gctgcctcccctcctctgcttg

SEQ ID NO: 6268298 - DNA, 21 bp, Homo sapiens
gctgcctcccctctccttcct

SEQ ID NO: 6268299 - DNA, 21 bp, Homo sapiens
gctgcctcccttgtggcagca

SEQ ID NO: 6268300 - DNA, 17 bp, Homo sapiens
gctgcctccgcacctga

SEQ ID NO: 6268301 - DNA, 13 bp, Homo sapiens
gctgcctccgggc

SEQ ID NO: 6268302 - DNA, 16 bp, Homo sapiens
gctgcctccgggcctc

SEQ ID NO: 6268303 - DNA, 19 bp, Homo sapiens
gctgcctccgggcctcggc

SEQ ID NO: 6268304 - DNA, 23 bp, Homo sapiens
gctgcctccgggcctcggcctgg

SEQ ID NO: 6268305 - DNA, 18 bp, Homo sapiens
gctgcctcctgctctctg

SEQ ID NO: 6268306 - DNA, 21 bp, Homo sapiens
gctgcctcggactccatggct

SEQ ID NO: 6268307 - DNA, 21 bp, Homo sapiens
gctgcctcggatccccttcct

SEQ ID NO: 6268308 - DNA, 22 bp, Homo sapiens
gctgcctcgtagagtgacctcg

SEQ ID NO: 6268309 - DNA, 18 bp, Homo sapiens
gctgcctctcggtggcca

SEQ ID NO: 6268310 - DNA, 18 bp, Homo sapiens
gctgcctctcttctgtgt

SEQ ID NO: 6268311 - DNA, 13 bp, Homo sapiens
gctgcctctgaaa

SEQ ID NO: 6268312 - DNA, 21 bp, Homo sapiens
gctgcctctgacagcagcctg

SEQ ID NO: 6268313 - DNA, 22 bp, Homo sapiens
gctgcctctgacagcagcctgt

SEQ ID NO: 6268314 - DNA, 14 bp, Homo sapiens
gctgcctctgctcc

SEQ ID NO: 6268315 - DNA, 17 bp, Homo sapiens
gctgcctctgctccctc

SEQ ID NO: 6268316 - DNA, 15 bp, Homo sapiens
gctgcctctgggcca

SEQ ID NO: 6268317 - DNA, 16 bp, Homo sapiens
gctgcctctgggtgag

SEQ ID NO: 6268318 - DNA, 16 bp, Homo sapiens
gctgcctctggtcaag

SEQ ID NO: 6268319 - DNA, 12 bp, Homo sapiens
gctgcctctgtg

SEQ ID NO: 6268320 - DNA, 20 bp, Homo sapiens
gctgcctcttctcttgacag

SEQ ID NO: 6268321 - DNA, 22 bp, Homo sapiens
gcagtacctgggaaaggaccca

SEQ ID NO: 6268322 - DNA, 15 bp, Homo sapiens
gcagtactaaaatta

SEQ ID NO: 6268323 - DNA, 15 bp, Homo sapiens
gcagtactaacattt

SEQ ID NO: 6268324 - DNA, 15 bp, Homo sapiens
gcagtactcctccct

SEQ ID NO: 6268325 - DNA, 16 bp, Homo sapiens
gcagtactcctccctg

SEQ ID NO: 6268326 - DNA, 15 bp, Homo sapiens
gcagtacttgctcaa

SEQ ID NO: 6268327 - DNA, 21 bp, Homo sapiens
gcagtacttgctcaataaagg

SEQ ID NO: 6268328 - DNA, 21 bp, Homo sapiens
gcagtacttttgttgtatggg

SEQ ID NO: 6268329 - DNA, 21 bp, Homo sapiens
gcagtagaaataatatgcatt

SEQ ID NO: 6268330 - DNA, 18 bp, Homo sapiens
gcagtagactcatctttt

SEQ ID NO: 6268331 - DNA, 14 bp, Homo sapiens
gcagtagagagcct

SEQ ID NO: 6268332 - DNA, 15 bp, Homo sapiens
gcagtagatgtgctt

SEQ ID NO: 6268333 - DNA, 15 bp, Homo sapiens
gcagtagattttctt

SEQ ID NO: 6268334 - DNA, 22 bp, Homo sapiens
gcagtagccaaacaccactttg

SEQ ID NO: 6268335 - DNA, 13 bp, Homo sapiens
gcagtagcctcct

SEQ ID NO: 6268336 - DNA, 19 bp, Homo sapiens
gcagtaggaacccagctct

SEQ ID NO: 6268337 - DNA, 21 bp, Homo sapiens
gcagtaggaacccagctctca

SEQ ID NO: 6268338 - DNA, 20 bp, Homo sapiens
gcagtaggggaacctaggag

SEQ ID NO: 6268339 - DNA, 18 bp, Homo sapiens
gcagtaggggagagagca

SEQ ID NO: 6268340 - DNA, 23 bp, Homo sapiens
gcagtatataataactttattgc

SEQ ID NO: 6268341 - DNA, 18 bp, Homo sapiens
gcagtatatattctttca

SEQ ID NO: 6268342 - DNA, 22 bp, Homo sapiens
gcagtatatattctttcacaag

SEQ ID NO: 6268343 - DNA, 15 bp, Homo sapiens
gcagtatcatgaagc

SEQ ID NO: 6268344 - DNA, 22 bp, Homo sapiens
gcagtatcggcactgtacaaaa

SEQ ID NO: 6268345 - DNA, 18 bp, Homo sapiens
gcagtatctcttacatca

SEQ ID NO: 6268346 - DNA, 16 bp, Homo sapiens
gcagtatctcttgctg

SEQ ID NO: 6268347 - DNA, 18 bp, Homo sapiens
gcagtatctcttgctggg

SEQ ID NO: 6268348 - DNA, 15 bp, Homo sapiens
gcagtatgaaaataa

SEQ ID NO: 6268349 - DNA, 18 bp, Homo sapiens
gcagtatgaatgatgttt

SEQ ID NO: 6268350 - DNA, 14 bp, Homo sapiens
gcagtatgtgtgct

SEQ ID NO: 6268351 - DNA, 23 bp, Homo sapiens
gcagtattccctttttaaatgag

SEQ ID NO: 6268352 - DNA, 18 bp, Homo sapiens
gcagtattttattaaagc

SEQ ID NO: 6268353 - DNA, 16 bp, Homo sapiens
gcagtattttgtgtcc

SEQ ID NO: 6268354 - DNA, 16 bp, Homo sapiens
gcagtcacactgctgg

SEQ ID NO: 6268355 - DNA, 17 bp, Homo sapiens
gcagtcacactgctggg

SEQ ID NO: 6268356 - DNA, 14 bp, Homo sapiens
gcagtcacaggccc

SEQ ID NO: 6268357 - DNA, 15 bp, Homo sapiens
gcagtcacaggccca

SEQ ID NO: 6268358 - DNA, 17 bp, Homo sapiens
gcagtcacatctcttcc

SEQ ID NO: 6268359 - DNA, 17 bp, Homo sapiens
gcagtcaccaccacccg

SEQ ID NO: 6268360 - DNA, 14 bp, Homo sapiens
gcagtcaccaccca

SEQ ID NO: 6268361 - DNA, 19 bp, Homo sapiens
gcagtcaccacccagccct

SEQ ID NO: 6268362 - DNA, 14 bp, Homo sapiens
gcagtcagactgaa

SEQ ID NO: 6268363 - DNA, 15 bp, Homo sapiens
gcagtcagagtccag

SEQ ID NO: 6268364 - DNA, 19 bp, Homo sapiens
gcagtcagagtccagtgct

SEQ ID NO: 6268365 - DNA, 16 bp, Homo sapiens
gcagtcagatttttaa

SEQ ID NO: 6268366 - DNA, 19 bp, Homo sapiens
gcagtcagcacagagagcg

SEQ ID NO: 6268367 - DNA, 22 bp, Homo sapiens
gcagtcagcacagagagcggct

SEQ ID NO: 6268368 - DNA, 15 bp, Homo sapiens
gcagtcagcggagag

SEQ ID NO: 6268369 - DNA, 19 bp, Homo sapiens
gcagtcagtgtttctttta

SEQ ID NO: 6268370 - DNA, 23 bp, Homo sapiens
gcagtcatcttgaccaagcagga

SEQ ID NO: 6268371 - DNA, 19 bp, Homo sapiens
gcagtcattatccaggtaa

SEQ ID NO: 6268372 - DNA, 21 bp, Homo sapiens
gcagtccacttctgacagcct

SEQ ID NO: 6268373 - DNA, 15 bp, Homo sapiens
gcagtccagaataag

SEQ ID NO: 6268374 - DNA, 21 bp, Homo sapiens
gcagtccagaataagtgctgt

SEQ ID NO: 6268375 - DNA, 12 bp, Homo sapiens
gcagtccagagc

SEQ ID NO: 6268376 - DNA, 13 bp, Homo sapiens
gcagtccagagct

SEQ ID NO: 6268377 - DNA, 14 bp, Homo sapiens
gcagtccagagctt

SEQ ID NO: 6268378 - DNA, 16 bp, Homo sapiens
gcagtccagagctttt

SEQ ID NO: 6268379 - DNA, 20 bp, Homo sapiens
gcagtccagagcttttcagc

SEQ ID NO: 6268380 - DNA, 13 bp, Homo sapiens
gcagtccagccag

SEQ ID NO: 6268381 - DNA, 15 bp, Homo sapiens
gcagtccagccagct

SEQ ID NO: 6268382 - DNA, 21 bp, Homo sapiens
gcagtccaggcctctctctgc

SEQ ID NO: 6268383 - DNA, 16 bp, Homo sapiens
gcagtccagtgagaaa

SEQ ID NO: 6268384 - DNA, 20 bp, Homo sapiens
gcagtccatttttgagtaaa

SEQ ID NO: 6268385 - DNA, 14 bp, Homo sapiens
gcagtcccacactg

SEQ ID NO: 6268386 - DNA, 23 bp, Homo sapiens
gcagtcccattcatattaagaca

SEQ ID NO: 6268387 - DNA, 15 bp, Homo sapiens
gcagtccccagccct

SEQ ID NO: 6268388 - DNA, 23 bp, Homo sapiens
gcagtccccttccctccaagaag

SEQ ID NO: 6268389 - DNA, 18 bp, Homo sapiens
gcagtcccgggagaaaag

SEQ ID NO: 6268390 - DNA, 23 bp, Homo sapiens
gcagtccctgagaccatttaaca

SEQ ID NO: 6268391 - DNA, 14 bp, Homo sapiens
gcagtccctgctta

SEQ ID NO: 6268392 - DNA, 13 bp, Homo sapiens
gcagtcctcagga

SEQ ID NO: 6268393 - DNA, 16 bp, Homo sapiens
gcagtcctcggcagct

SEQ ID NO: 6268394 - DNA, 17 bp, Homo sapiens
gcagtcctcggcagctc

SEQ ID NO: 6268395 - DNA, 14 bp, Homo sapiens
gcagtcctgaggag

SEQ ID NO: 6268396 - DNA, 18 bp, Homo sapiens
gcagtcctggaagccagc

SEQ ID NO: 6268397 - DNA, 12 bp, Homo sapiens
gcagtcctggag

SEQ ID NO: 6268398 - DNA, 16 bp, Homo sapiens
gcagtcctggaggcag

SEQ ID NO: 6268399 - DNA, 12 bp, Homo sapiens
gcagtcctgggc

SEQ ID NO: 6268400 - DNA, 15 bp, Homo sapiens
gcagtcctgggcccc

SEQ ID NO: 6268401 - DNA, 21 bp, Homo sapiens
gcagtcctgggccccctggga

SEQ ID NO: 6268402 - DNA, 14 bp, Homo sapiens
gcagtcctgttcaa

SEQ ID NO: 6268403 - DNA, 23 bp, Homo sapiens
gcagtccttttactacagctatg

SEQ ID NO: 6268404 - DNA, 21 bp, Homo sapiens
gcagtcgagggtcgtgagccc

SEQ ID NO: 6268405 - DNA, 17 bp, Homo sapiens
gcagtcgcacacacatt

SEQ ID NO: 6268406 - DNA, 21 bp, Homo sapiens
gcagtcgcaggatccgctgcc

SEQ ID NO: 6268407 - DNA, 12 bp, Homo sapiens
gcagtcgcctgc

SEQ ID NO: 6268408 - DNA, 16 bp, Homo sapiens
gcagtcgcttgccaaa

SEQ ID NO: 6268409 - DNA, 22 bp, Homo sapiens
gcagtcgcttgccaaagcagat

SEQ ID NO: 6268410 - DNA, 15 bp, Homo sapiens
gcagtcggcatgcca

SEQ ID NO: 6268411 - DNA, 16 bp, Homo sapiens
gcagtcggcatgccag

SEQ ID NO: 6268412 - DNA, 18 bp, Homo sapiens
gcagtcggcatgccagga

SEQ ID NO: 6268413 - DNA, 16 bp, Homo sapiens
gcagtcgggggctggc

SEQ ID NO: 6268414 - DNA, 21 bp, Homo sapiens
gcagtcgggggctggcctagg

SEQ ID NO: 6268415 - DNA, 23 bp, Homo sapiens
gcagtcgggggctggcctaggag

SEQ ID NO: 6268416 - DNA, 17 bp, Homo sapiens
gcagtcgtaagggttgc

SEQ ID NO: 6268417 - DNA, 17 bp, Homo sapiens
gcagtcgtcagcctccc

SEQ ID NO: 6268418 - DNA, 20 bp, Homo sapiens
gcagtcgtcagcctccctga

SEQ ID NO: 6268419 - DNA, 22 bp, Homo sapiens
gcagtcgtcgcacagtctctct

SEQ ID NO: 6268420 - DNA, 15 bp, Homo sapiens
gcagtcgtgcctgtg

SEQ ID NO: 6268421 - DNA, 18 bp, Homo sapiens
gcagtcgtgcctgtgtcc

SEQ ID NO: 6268422 - DNA, 20 bp, Homo sapiens
gcagtctaaattttctaaat

SEQ ID NO: 6268423 - DNA, 22 bp, Homo sapiens
gcagtctaaattttctaaataa

SEQ ID NO: 6268424 - DNA, 16 bp, Homo sapiens
gcagtctacccacctc

SEQ ID NO: 6268425 - DNA, 13 bp, Homo sapiens
gcagtctaccctg

SEQ ID NO: 6268426 - DNA, 16 bp, Homo sapiens
gcagtctacttctgtg

SEQ ID NO: 6268427 - DNA, 16 bp, Homo sapiens
gcagtctcagaaagcc

SEQ ID NO: 6268428 - DNA, 17 bp, Homo sapiens
gcagtctccccttcctg

SEQ ID NO: 6268429 - DNA, 18 bp, Homo sapiens
gcagtctccgctcccgca

SEQ ID NO: 6268430 - DNA, 16 bp, Homo sapiens
gcagtctcctctttaa

SEQ ID NO: 6268431 - DNA, 17 bp, Homo sapiens
gcagtctcctctttaaa

SEQ ID NO: 6268432 - DNA, 18 bp, Homo sapiens
gcagtctctataccaata

SEQ ID NO: 6268433 - DNA, 21 bp, Homo sapiens
gcagtctctataccaataaag

SEQ ID NO: 6268434 - DNA, 20 bp, Homo sapiens
gcagtctctatattatgtct

SEQ ID NO: 6268435 - DNA, 13 bp, Homo sapiens
gcagtctctgcct

SEQ ID NO: 6268436 - DNA, 20 bp, Homo sapiens
gcagtctctttattttacta

SEQ ID NO: 6268437 - DNA, 18 bp, Homo sapiens
gcagtctgaacccttgtg

SEQ ID NO: 6268438 - DNA, 19 bp, Homo sapiens
gcagtctgaacccttgtgc

SEQ ID NO: 6268439 - DNA, 21 bp, Homo sapiens
gcagtctgcccacgcagagga

SEQ ID NO: 6268440 - DNA, 12 bp, Homo sapiens
gcagtctgcctg

SEQ ID NO: 6268441 - DNA, 14 bp, Homo sapiens
gcagtctgctctgc

SEQ ID NO: 6268442 - DNA, 15 bp, Homo sapiens
gcagtctgctctgct

SEQ ID NO: 6268443 - DNA, 14 bp, Homo sapiens
gcagtctggagggg

SEQ ID NO: 6268444 - DNA, 20 bp, Homo sapiens
gcagtctgtggagcgtcctt

SEQ ID NO: 6268445 - DNA, 15 bp, Homo sapiens
gcagtcttctctctg

SEQ ID NO: 6268446 - DNA, 22 bp, Homo sapiens
gcagtcttctctctggctcagg

SEQ ID NO: 6268447 - DNA, 16 bp, Homo sapiens
gcagtcttctgggctg

SEQ ID NO: 6268448 - DNA, 17 bp, Homo sapiens
gcagtctttcccccagg

SEQ ID NO: 6268449 - DNA, 16 bp, Homo sapiens
gcagtctttcttgaaa

SEQ ID NO: 6268450 - DNA, 19 bp, Homo sapiens
gcagtctttgctcagtgga

SEQ ID NO: 6268451 - DNA, 18 bp, Homo sapiens
gcagtctttttctacagc

SEQ ID NO: 6268452 - DNA, 16 bp, Homo sapiens
gcagtgaaaaatatgt

SEQ ID NO: 6268453 - DNA, 14 bp, Homo sapiens
gcagtgaaaatgaa

SEQ ID NO: 6268454 - DNA, 16 bp, Homo sapiens
gcagtgaaacttgtgc

SEQ ID NO: 6268455 - DNA, 21 bp, Homo sapiens
gcagtgaacacactcagcagc

SEQ ID NO: 6268456 - DNA, 23 bp, Homo sapiens
gcagtgaacacactcagcagccc

SEQ ID NO: 6268457 - DNA, 14 bp, Homo sapiens
gcagtgaactattt

SEQ ID NO: 6268458 - DNA, 16 bp, Homo sapiens
gcagtgaactgagact

SEQ ID NO: 6268459 - DNA, 22 bp, Homo sapiens
gcagtgaagatgtgtaaataag

SEQ ID NO: 6268460 - DNA, 12 bp, Homo sapiens
gcagtgaagtgt

SEQ ID NO: 6268461 - DNA, 16 bp, Homo sapiens
gcagtgaatttgaata

SEQ ID NO: 6268462 - DNA, 17 bp, Homo sapiens
gcagtgacaagtggagg

SEQ ID NO: 6268463 - DNA, 18 bp, Homo sapiens
gcagtgacaagtggaggg

SEQ ID NO: 6268464 - DNA, 19 bp, Homo sapiens
gcagtgacaagtggagggg

SEQ ID NO: 6268465 - DNA, 15 bp, Homo sapiens
gcagtgactggcagg

SEQ ID NO: 6268466 - DNA, 13 bp, Homo sapiens
gcagtgactttgt

SEQ ID NO: 6268467 - DNA, 14 bp, Homo sapiens
gcagtgactttgta

SEQ ID NO: 6268468 - DNA, 20 bp, Homo sapiens
gcagtgagaaaaagctcctg

SEQ ID NO: 6268469 - DNA, 17 bp, Homo sapiens
gcagtgagactgcaggt

SEQ ID NO: 6268470 - DNA, 13 bp, Homo sapiens
gcagtgagactgg

SEQ ID NO: 6268471 - DNA, 14 bp, Homo sapiens
gcagtgagactggg

SEQ ID NO: 6268472 - DNA, 22 bp, Homo sapiens
gcagtgagagagtggctggggc

SEQ ID NO: 6268473 - DNA, 23 bp, Homo sapiens
gcagtgagagagtggctggggca

SEQ ID NO: 6268474 - DNA, 13 bp, Homo sapiens
gcagtgagcagaa

SEQ ID NO: 6268475 - DNA, 15 bp, Homo sapiens
gcagtgagcagggtg

SEQ ID NO: 6268476 - DNA, 17 bp, Homo sapiens
gcagtgagcagggtggg

SEQ ID NO: 6268477 - DNA, 15 bp, Homo sapiens
gcagtgagctaagat

SEQ ID NO: 6268478 - DNA, 20 bp, Homo sapiens
gcagtgagctatgagcccag

SEQ ID NO: 6268479 - DNA, 13 bp, Homo sapiens
gcagtgagctgag

SEQ ID NO: 6268480 - DNA, 14 bp, Homo sapiens
gcagtgagctgtgt

SEQ ID NO: 6268481 - DNA, 21 bp, Homo sapiens
gcagtgaggggagatgctggg

SEQ ID NO: 6268482 - DNA, 22 bp, Homo sapiens
gcagtgaggggagatgctggga

SEQ ID NO: 6268483 - DNA, 22 bp, Homo sapiens
gcagtgagtcgagattgcactg

SEQ ID NO: 6268484 - DNA, 18 bp, Homo sapiens
gcagtgagtctcttcaga

SEQ ID NO: 6268485 - DNA, 17 bp, Homo sapiens
gcagtgagtgagcctgg

SEQ ID NO: 6268486 - DNA, 17 bp, Homo sapiens
gcagtgagttgggattg

SEQ ID NO: 6268487 - DNA, 15 bp, Homo sapiens
gcagtgatacatgta

SEQ ID NO: 6268488 - DNA, 16 bp, Homo sapiens
gcagtgatatggcaga

SEQ ID NO: 6268489 - DNA, 21 bp, Homo sapiens
gcagtgatatggcagaagaca

SEQ ID NO: 6268490 - DNA, 22 bp, Homo sapiens
gcagtgatatggcagaagacac

SEQ ID NO: 6268491 - DNA, 18 bp, Homo sapiens
gcagtgatattctttgtt

SEQ ID NO: 6268492 - DNA, 14 bp, Homo sapiens
gcagtgatctcagg

SEQ ID NO: 6268493 - DNA, 13 bp, Homo sapiens
gcagtgatgtcac

SEQ ID NO: 6268494 - DNA, 17 bp, Homo sapiens
gcagtgattcagcaggc

SEQ ID NO: 6268495 - DNA, 23 bp, Homo sapiens
gcagtgcaagagactctggcctc

SEQ ID NO: 6268496 - DNA, 16 bp, Homo sapiens
gcagtgcaaggaggga

SEQ ID NO: 6268497 - DNA, 19 bp, Homo sapiens
gcagtgcaatgcttgtaga

SEQ ID NO: 6268498 - DNA, 13 bp, Homo sapiens
gcagtgcacattt

SEQ ID NO: 6268499 - DNA, 21 bp, Homo sapiens
gcagtgcagcaaccagagcac

SEQ ID NO: 6268500 - DNA, 19 bp, Homo sapiens
gctgcctcttggcttctca

SEQ ID NO: 6268501 - DNA, 21 bp, Homo sapiens
gctgcctcttggcttctcagc

SEQ ID NO: 6268502 - DNA, 13 bp, Homo sapiens
gctgcctctttcc

SEQ ID NO: 6268503 - DNA, 19 bp, Homo sapiens
gctgcctctttgctgcttt

SEQ ID NO: 6268504 - DNA, 14 bp, Homo sapiens
gctgcctgaaaacc

SEQ ID NO: 6268505 - DNA, 16 bp, Homo sapiens
gctgcctgaaaatcaa

SEQ ID NO: 6268506 - DNA, 19 bp, Homo sapiens
gctgcctgacactgagccc

SEQ ID NO: 6268507 - DNA, 21 bp, Homo sapiens
gctgcctgacactgagcccca

SEQ ID NO: 6268508 - DNA, 23 bp, Homo sapiens
gctgcctgacactgagccccacc

SEQ ID NO: 6268509 - DNA, 22 bp, Homo sapiens
gctgcctgagcacctcccagcc

SEQ ID NO: 6268510 - DNA, 11 bp, Homo sapiens
gctgcctgagt

SEQ ID NO: 6268511 - DNA, 17 bp, Homo sapiens
gctgcctgagtattact

SEQ ID NO: 6268512 - DNA, 16 bp, Homo sapiens
gctgcctgccaaagta

SEQ ID NO: 6268513 - DNA, 17 bp, Homo sapiens
gctgcctgcccacacag

SEQ ID NO: 6268514 - DNA, 19 bp, Homo sapiens
gctgcctgcccctgctgct

SEQ ID NO: 6268515 - DNA, 19 bp, Homo sapiens
gctgcctgcccgcacagca

SEQ ID NO: 6268516 - DNA, 20 bp, Homo sapiens
gctgcctgcccgcacagcag

SEQ ID NO: 6268517 - DNA, 22 bp, Homo sapiens
gctgcctgcccgcacagcagcc

SEQ ID NO: 6268518 - DNA, 13 bp, Homo sapiens
gctgcctgccgcc

SEQ ID NO: 6268519 - DNA, 22 bp, Homo sapiens
gctgcctgccggtaaacacgcc

SEQ ID NO: 6268520 - DNA, 11 bp, Homo sapiens
gctgcctgcct

SEQ ID NO: 6268521 - DNA, 15 bp, Homo sapiens
gctgcctgcctccgg

SEQ ID NO: 6268522 - DNA, 15 bp, Homo sapiens
gctgcctgcctgtct

SEQ ID NO: 6268523 - DNA, 21 bp, Homo sapiens
gctgcctgctctgcagcccac

SEQ ID NO: 6268524 - DNA, 16 bp, Homo sapiens
gctgcctgctctgtga

SEQ ID NO: 6268525 - DNA, 13 bp, Homo sapiens
gctgcctggagaa

SEQ ID NO: 6268526 - DNA, 18 bp, Homo sapiens
gctgcctggagagggtct

SEQ ID NO: 6268527 - DNA, 19 bp, Homo sapiens
gctgcctggagagggtctc

SEQ ID NO: 6268528 - DNA, 14 bp, Homo sapiens
gctgcctggagccc

SEQ ID NO: 6268529 - DNA, 17 bp, Homo sapiens
gctgcctggagccccac

SEQ ID NO: 6268530 - DNA, 20 bp, Homo sapiens
gctgcctggagtcagtagcc

SEQ ID NO: 6268531 - DNA, 11 bp, Homo sapiens
gctgcctggca

SEQ ID NO: 6268532 - DNA, 12 bp, Homo sapiens
gctgcctggcac

SEQ ID NO: 6268533 - DNA, 13 bp, Homo sapiens
gctgcctggccag

SEQ ID NO: 6268534 - DNA, 18 bp, Homo sapiens
gctgcctggccaggccct

SEQ ID NO: 6268535 - DNA, 18 bp, Homo sapiens
gctgcctggccatgctgt

SEQ ID NO: 6268536 - DNA, 20 bp, Homo sapiens
gctgcctggccatgctgtcc

SEQ ID NO: 6268537 - DNA, 22 bp, Homo sapiens
gctgcctggcccccagctgtgg

SEQ ID NO: 6268538 - DNA, 15 bp, Homo sapiens
gctgcctggcgggca

SEQ ID NO: 6268539 - DNA, 12 bp, Homo sapiens
gctgcctgggag

SEQ ID NO: 6268540 - DNA, 17 bp, Homo sapiens
gctgcctgggagccagg

SEQ ID NO: 6268541 - DNA, 13 bp, Homo sapiens
gctgcctgggatc

SEQ ID NO: 6268542 - DNA, 16 bp, Homo sapiens
gctgcctgggatccct

SEQ ID NO: 6268543 - DNA, 13 bp, Homo sapiens
gctgcctgggctg

SEQ ID NO: 6268544 - DNA, 16 bp, Homo sapiens
gctgcctgggctgttg

SEQ ID NO: 6268545 - DNA, 19 bp, Homo sapiens
gctgcctgggctgttggca

SEQ ID NO: 6268546 - DNA, 21 bp, Homo sapiens
gctgcctggggattgggaggg

SEQ ID NO: 6268547 - DNA, 12 bp, Homo sapiens
gctgcctggggc

SEQ ID NO: 6268548 - DNA, 13 bp, Homo sapiens
gctgcctggggcc

SEQ ID NO: 6268549 - DNA, 18 bp, Homo sapiens
gctgcctgggtaggcccc

SEQ ID NO: 6268550 - DNA, 13 bp, Homo sapiens
gctgcctgtagtt

SEQ ID NO: 6268551 - DNA, 19 bp, Homo sapiens
gctgcctgtagttaggaaa

SEQ ID NO: 6268552 - DNA, 18 bp, Homo sapiens
gctgcctgtgccatgccc

SEQ ID NO: 6268553 - DNA, 19 bp, Homo sapiens
gctgcctgtgcctgccatg

SEQ ID NO: 6268554 - DNA, 18 bp, Homo sapiens
gctgcctgttcagctcca

SEQ ID NO: 6268555 - DNA, 22 bp, Homo sapiens
gctgccttaatgacattcccct

SEQ ID NO: 6268556 - DNA, 20 bp, Homo sapiens
gctgccttagaacctttctt

SEQ ID NO: 6268557 - DNA, 20 bp, Homo sapiens
gctgccttagcttcaggaac

SEQ ID NO: 6268558 - DNA, 21 bp, Homo sapiens
gctgccttattcagggaagga

SEQ ID NO: 6268559 - DNA, 15 bp, Homo sapiens
gctgccttcaccctg

SEQ ID NO: 6268560 - DNA, 18 bp, Homo sapiens
gctgccttcaccctgaac

SEQ ID NO: 6268561 - DNA, 14 bp, Homo sapiens
gctgccttcaggga

SEQ ID NO: 6268562 - DNA, 21 bp, Homo sapiens
gctgccttcccatgaatctgt

SEQ ID NO: 6268563 - DNA, 12 bp, Homo sapiens
gctgccttccct

SEQ ID NO: 6268564 - DNA, 16 bp, Homo sapiens
gctgccttcctggggc

SEQ ID NO: 6268565 - DNA, 12 bp, Homo sapiens
gctgccttcctt

SEQ ID NO: 6268566 - DNA, 20 bp, Homo sapiens
gctgccttctgacggccctg

SEQ ID NO: 6268567 - DNA, 21 bp, Homo sapiens
gctgccttctgacggccctgc

SEQ ID NO: 6268568 - DNA, 22 bp, Homo sapiens
gctgccttctgacggccctgca

SEQ ID NO: 6268569 - DNA, 16 bp, Homo sapiens
gctgccttctggattc

SEQ ID NO: 6268570 - DNA, 17 bp, Homo sapiens
gctgccttctggattct

SEQ ID NO: 6268571 - DNA, 16 bp, Homo sapiens
gctgccttctttccat

SEQ ID NO: 6268572 - DNA, 15 bp, Homo sapiens
gctgccttgaaatca

SEQ ID NO: 6268573 - DNA, 20 bp, Homo sapiens
gctgccttgtttcaccttcc

SEQ ID NO: 6268574 - DNA, 20 bp, Homo sapiens
gctgcctttagtcgctgagg

SEQ ID NO: 6268575 - DNA, 15 bp, Homo sapiens
gctgcctttggactt

SEQ ID NO: 6268576 - DNA, 18 bp, Homo sapiens
gctgcctttgtccccaca

SEQ ID NO: 6268577 - DNA, 23 bp, Homo sapiens
gctgcctttgtccccacacagcc

SEQ ID NO: 6268578 - DNA, 13 bp, Homo sapiens
gctgcctttgtgg

SEQ ID NO: 6268579 - DNA, 20 bp, Homo sapiens
gctgcctttgtggtgggcgc

SEQ ID NO: 6268580 - DNA, 17 bp, Homo sapiens
gctgccttttctggagt

SEQ ID NO: 6268581 - DNA, 17 bp, Homo sapiens
gctgccttttgctgctg

SEQ ID NO: 6268582 - DNA, 19 bp, Homo sapiens
gctgcgaatctagaggagg

SEQ ID NO: 6268583 - DNA, 21 bp, Homo sapiens
gctgcgaatctagaggagggg

SEQ ID NO: 6268584 - DNA, 18 bp, Homo sapiens
gctgcgacgcttgctctg

SEQ ID NO: 6268585 - DNA, 21 bp, Homo sapiens
gctgcgcagcctccagggccc

SEQ ID NO: 6268586 - DNA, 13 bp, Homo sapiens
gctgcgcagggct

SEQ ID NO: 6268587 - DNA, 23 bp, Homo sapiens
gctgcgcccccttctttgcagct

SEQ ID NO: 6268588 - DNA, 19 bp, Homo sapiens
gctgcgcccttaccttccc

SEQ ID NO: 6268589 - DNA, 13 bp, Homo sapiens
gctgcgccggaca

SEQ ID NO: 6268590 - DNA, 13 bp, Homo sapiens
gctgcgcctgccc

SEQ ID NO: 6268591 - DNA, 22 bp, Homo sapiens
gctgcgcctgcccgcccgccgg

SEQ ID NO: 6268592 - DNA, 18 bp, Homo sapiens
gctgcgcggactcgcccc

SEQ ID NO: 6268593 - DNA, 20 bp, Homo sapiens
gctgcgctagcagcccttgt

SEQ ID NO: 6268594 - DNA, 12 bp, Homo sapiens
gctgcgctgccc

SEQ ID NO: 6268595 - DNA, 15 bp, Homo sapiens
gctgcgctgccctgc

SEQ ID NO: 6268596 - DNA, 16 bp, Homo sapiens
gctgcgctgccctgca

SEQ ID NO: 6268597 - DNA, 14 bp, Homo sapiens
gctgcgctgtgctg

SEQ ID NO: 6268598 - DNA, 14 bp, Homo sapiens
gctgcggcaccctt

SEQ ID NO: 6268599 - DNA, 23 bp, Homo sapiens
gctgcggcagcccctcccagcct

SEQ ID NO: 6268600 - DNA, 17 bp, Homo sapiens
gctgcggcccctccccc

SEQ ID NO: 6268601 - DNA, 20 bp, Homo sapiens
gctgcggcctaggggtccac

SEQ ID NO: 6268602 - DNA, 18 bp, Homo sapiens
gctgcggcgtacaggctg

SEQ ID NO: 6268603 - DNA, 15 bp, Homo sapiens
gctgcggctgtgggc

SEQ ID NO: 6268604 - DNA, 19 bp, Homo sapiens
gctgcgggaggccctggcc

SEQ ID NO: 6268605 - DNA, 22 bp, Homo sapiens
gctgcgggaggccctggccctt

SEQ ID NO: 6268606 - DNA, 18 bp, Homo sapiens
gctgcgggcccagctgag

SEQ ID NO: 6268607 - DNA, 16 bp, Homo sapiens
gctgcgggctgagggc

SEQ ID NO: 6268608 - DNA, 16 bp, Homo sapiens
gctgcgggggagccag

SEQ ID NO: 6268609 - DNA, 17 bp, Homo sapiens
gctgcgggggagccagt

SEQ ID NO: 6268610 - DNA, 22 bp, Homo sapiens
gctgcgggtgggtatcccacct

SEQ ID NO: 6268611 - DNA, 13 bp, Homo sapiens
gctgcggtcactc

SEQ ID NO: 6268612 - DNA, 15 bp, Homo sapiens
gctgcggtccaccca

SEQ ID NO: 6268613 - DNA, 18 bp, Homo sapiens
gctgcggtccacccagga

SEQ ID NO: 6268614 - DNA, 17 bp, Homo sapiens
gctgcgtcattacaggg

SEQ ID NO: 6268615 - DNA, 18 bp, Homo sapiens
gctgcgtccccactccct

SEQ ID NO: 6268616 - DNA, 13 bp, Homo sapiens
gctgcgtccctgc

SEQ ID NO: 6268617 - DNA, 20 bp, Homo sapiens
gctgcgtccctgctcagccc

SEQ ID NO: 6268618 - DNA, 13 bp, Homo sapiens
gctgcgtctccca

SEQ ID NO: 6268619 - DNA, 16 bp, Homo sapiens
gctgcgtctgcactga

SEQ ID NO: 6268620 - DNA, 21 bp, Homo sapiens
gctgcgtgacatgtgcagtgc

SEQ ID NO: 6268621 - DNA, 18 bp, Homo sapiens
gctgctaaatctcctatt

SEQ ID NO: 6268622 - DNA, 17 bp, Homo sapiens
gctgctaacctggaaag

SEQ ID NO: 6268623 - DNA, 20 bp, Homo sapiens
gctgctaagctaaagaaact

SEQ ID NO: 6268624 - DNA, 21 bp, Homo sapiens
gctgctaagctaaagaaactg

SEQ ID NO: 6268625 - DNA, 21 bp, Homo sapiens
gctgctaagtcattggcaaag

SEQ ID NO: 6268626 - DNA, 22 bp, Homo sapiens
gctgctaagtcattggcaaagt

SEQ ID NO: 6268627 - DNA, 13 bp, Homo sapiens
gctgctaagtgga

SEQ ID NO: 6268628 - DNA, 20 bp, Homo sapiens
gctgctaagtggaagacaga

SEQ ID NO: 6268629 - DNA, 18 bp, Homo sapiens
gctgctaatattaaacct

SEQ ID NO: 6268630 - DNA, 19 bp, Homo sapiens
gctgctaatattaaacctt

SEQ ID NO: 6268631 - DNA, 18 bp, Homo sapiens
gctgctaatcttcagggc

SEQ ID NO: 6268632 - DNA, 20 bp, Homo sapiens
gctgctaatcttcagggcac

SEQ ID NO: 6268633 - DNA, 16 bp, Homo sapiens
gctgctaattctttgc

SEQ ID NO: 6268634 - DNA, 18 bp, Homo sapiens
gctgctacaaagaagaca

SEQ ID NO: 6268635 - DNA, 21 bp, Homo sapiens
gctgctacaaagaagacatgt

SEQ ID NO: 6268636 - DNA, 12 bp, Homo sapiens
gctgctacccag

SEQ ID NO: 6268637 - DNA, 18 bp, Homo sapiens
gctgctaccctccctgct

SEQ ID NO: 6268638 - DNA, 22 bp, Homo sapiens
gctgctaccctccctgctgtcc

SEQ ID NO: 6268639 - DNA, 17 bp, Homo sapiens
gctgctaccgccctggg

SEQ ID NO: 6268640 - DNA, 22 bp, Homo sapiens
gctgctaccgttgacttccagg

SEQ ID NO: 6268641 - DNA, 17 bp, Homo sapiens
gctgctacctaaaaaaa

SEQ ID NO: 6268642 - DNA, 16 bp, Homo sapiens
gctgctactagctctt

SEQ ID NO: 6268643 - DNA, 10 bp, Homo sapiens
gctgctagaa

SEQ ID NO: 6268644 - DNA, 14 bp, Homo sapiens
gctgctagaacttt

SEQ ID NO: 6268645 - DNA, 15 bp, Homo sapiens
gctgctagaactttt

SEQ ID NO: 6268646 - DNA, 17 bp, Homo sapiens
gctgctagaactttttt

SEQ ID NO: 6268647 - DNA, 19 bp, Homo sapiens
gctgctagaacttttttaa

SEQ ID NO: 6268648 - DNA, 21 bp, Homo sapiens
gctgctagaacttttttaaat

SEQ ID NO: 6268649 - DNA, 14 bp, Homo sapiens
gctgctagagaagg

SEQ ID NO: 6268650 - DNA, 17 bp, Homo sapiens
gctgctagagaaggggg

SEQ ID NO: 6268651 - DNA, 16 bp, Homo sapiens
gctgctagagccagca

SEQ ID NO: 6268652 - DNA, 19 bp, Homo sapiens
gctgctagagtgactcact

SEQ ID NO: 6268653 - DNA, 21 bp, Homo sapiens
gctgctagattttaatttatt

SEQ ID NO: 6268654 - DNA, 18 bp, Homo sapiens
gctgctaggccagagcca

SEQ ID NO: 6268655 - DNA, 16 bp, Homo sapiens
gctgctatagcctggg

SEQ ID NO: 6268656 - DNA, 17 bp, Homo sapiens
gctgctatagcctgggg

SEQ ID NO: 6268657 - DNA, 17 bp, Homo sapiens
gctgctatccccatctc

SEQ ID NO: 6268658 - DNA, 22 bp, Homo sapiens
gctgctatccccatctccctgc

SEQ ID NO: 6268659 - DNA, 16 bp, Homo sapiens
gctgctattgctgtct

SEQ ID NO: 6268660 - DNA, 17 bp, Homo sapiens
gctgctattgctgtctg

SEQ ID NO: 6268661 - DNA, 20 bp, Homo sapiens
gctgctattgctgtctggtg

SEQ ID NO: 6268662 - DNA, 22 bp, Homo sapiens
gctgctattttataaacatttt

SEQ ID NO: 6268663 - DNA, 22 bp, Homo sapiens
gctgctcaagccgcaagctctc

SEQ ID NO: 6268664 - DNA, 20 bp, Homo sapiens
gctgctcaaggaccaagagc

SEQ ID NO: 6268665 - DNA, 23 bp, Homo sapiens
gctgctcactacctcctcaggga

SEQ ID NO: 6268666 - DNA, 12 bp, Homo sapiens
gctgctcagaat

SEQ ID NO: 6268667 - DNA, 21 bp, Homo sapiens
gctgctcagcctcatcctgag

SEQ ID NO: 6268668 - DNA, 23 bp, Homo sapiens
gctgctcatcacccagtcctggc

SEQ ID NO: 6268669 - DNA, 17 bp, Homo sapiens
gctgctcatgggaagaa

SEQ ID NO: 6268670 - DNA, 18 bp, Homo sapiens
gctgctcattacagttct

SEQ ID NO: 6268671 - DNA, 24 bp, Homo sapiens
gctgctcattacagttctttcctc

SEQ ID NO: 6268672 - DNA, 19 bp, Homo sapiens
gctgctcattccacactgt

SEQ ID NO: 6268673 - DNA, 19 bp, Homo sapiens
gctgctccaggcctgcagc

SEQ ID NO: 6268674 - DNA, 19 bp, Homo sapiens
gctgctcccacacttgtgc

SEQ ID NO: 6268675 - DNA, 15 bp, Homo sapiens
gctgctcccacctgg

SEQ ID NO: 6268676 - DNA, 20 bp, Homo sapiens
gctgctcccacctggctctg

SEQ ID NO: 6268677 - DNA, 19 bp, Homo sapiens
gctgctcccagcctcttgc

SEQ ID NO: 6268678 - DNA, 23 bp, Homo sapiens
gcagtgcagcaaccagagcactg

SEQ ID NO: 6268679 - DNA, 12 bp, Homo sapiens
gcagtgcatgca

SEQ ID NO: 6268680 - DNA, 13 bp, Homo sapiens
gcagtgcatgcat

SEQ ID NO: 6268681 - DNA, 14 bp, Homo sapiens
gcagtgcatgcatg

SEQ ID NO: 6268682 - DNA, 17 bp, Homo sapiens
gcagtgcatgcatgttg

SEQ ID NO: 6268683 - DNA, 17 bp, Homo sapiens
gcagtgccacagcctgc

SEQ ID NO: 6268684 - DNA, 21 bp, Homo sapiens
gcagtgccacagcctgctggc

SEQ ID NO: 6268685 - DNA, 15 bp, Homo sapiens
gcagtgccagccaat

SEQ ID NO: 6268686 - DNA, 14 bp, Homo sapiens
gcagtgcccaccat

SEQ ID NO: 6268687 - DNA, 18 bp, Homo sapiens
gcagtgcccagtgatggc

SEQ ID NO: 6268688 - DNA, 21 bp, Homo sapiens
gcagtgcccagtgatggcatt

SEQ ID NO: 6268689 - DNA, 18 bp, Homo sapiens
gcagtgcccatgtgtaca

SEQ ID NO: 6268690 - DNA, 21 bp, Homo sapiens
gcagtgccccagggagtccag

SEQ ID NO: 6268691 - DNA, 18 bp, Homo sapiens
gcagtgccctagaagggg

SEQ ID NO: 6268692 - DNA, 12 bp, Homo sapiens
gcagtgcctcct

SEQ ID NO: 6268693 - DNA, 17 bp, Homo sapiens
gcagtgcctcgaggcac

SEQ ID NO: 6268694 - DNA, 19 bp, Homo sapiens
gcagtgcctcgaggcaccg

SEQ ID NO: 6268695 - DNA, 20 bp, Homo sapiens
gcagtgcctcgaggcaccgg

SEQ ID NO: 6268696 - DNA, 13 bp, Homo sapiens
gcagtgcctctgg

SEQ ID NO: 6268697 - DNA, 17 bp, Homo sapiens
gcagtgcctctggtctg

SEQ ID NO: 6268698 - DNA, 13 bp, Homo sapiens
gcagtgcctcttg

SEQ ID NO: 6268699 - DNA, 14 bp, Homo sapiens
gcagtgcctcttgt

SEQ ID NO: 6268700 - DNA, 14 bp, Homo sapiens
gcagtgcctggagt

SEQ ID NO: 6268701 - DNA, 23 bp, Homo sapiens
gcagtgccttggggaatttcctc

SEQ ID NO: 6268702 - DNA, 17 bp, Homo sapiens
gcagtgctcgctgttgc

SEQ ID NO: 6268703 - DNA, 18 bp, Homo sapiens
gcagtgctcgctgttgct

SEQ ID NO: 6268704 - DNA, 16 bp, Homo sapiens
gcagtgctgggaccag

SEQ ID NO: 6268705 - DNA, 17 bp, Homo sapiens
gcagtgctgggaccaga

SEQ ID NO: 6268706 - DNA, 19 bp, Homo sapiens
gcagtgctgggaccagagc

SEQ ID NO: 6268707 - DNA, 20 bp, Homo sapiens
gcagtgctgggaccagagcc

SEQ ID NO: 6268708 - DNA, 18 bp, Homo sapiens
gcagtgctgggcccagcc

SEQ ID NO: 6268709 - DNA, 19 bp, Homo sapiens
gcagtgctgggcccagccg

SEQ ID NO: 6268710 - DNA, 23 bp, Homo sapiens
gcagtgctgtaatcggctcccgc

SEQ ID NO: 6268711 - DNA, 23 bp, Homo sapiens
gcagtgcttccaaggatggacca

SEQ ID NO: 6268712 - DNA, 15 bp, Homo sapiens
gcagtgcttctcaaa

SEQ ID NO: 6268713 - DNA, 15 bp, Homo sapiens
gcagtggacaccagg

SEQ ID NO: 6268714 - DNA, 21 bp, Homo sapiens
gcagtggacatcgtaggcagc

SEQ ID NO: 6268715 - DNA, 23 bp, Homo sapiens
gcagtggacatcgtaggcagcca

SEQ ID NO: 6268716 - DNA, 18 bp, Homo sapiens
gcagtggacggagagcct

SEQ ID NO: 6268717 - DNA, 14 bp, Homo sapiens
gcagtggactcaga

SEQ ID NO: 6268718 - DNA, 16 bp, Homo sapiens
gcagtggactgtgtcc

SEQ ID NO: 6268719 - DNA, 18 bp, Homo sapiens
gcagtggactgtgtccct

SEQ ID NO: 6268720 - DNA, 14 bp, Homo sapiens
gcagtggagagggg

SEQ ID NO: 6268721 - DNA, 24 bp, Homo sapiens
gcagtggagaggggacttggatag

SEQ ID NO: 6268722 - DNA, 21 bp, Homo sapiens
gcagtggagagtgttcctgtt

SEQ ID NO: 6268723 - DNA, 16 bp, Homo sapiens
gcagtggagcccagga

SEQ ID NO: 6268724 - DNA, 15 bp, Homo sapiens
gcagtggagctggca

SEQ ID NO: 6268725 - DNA, 16 bp, Homo sapiens
gcagtggaggctgctg

SEQ ID NO: 6268726 - DNA, 18 bp, Homo sapiens
gcagtggagggggcaagc

SEQ ID NO: 6268727 - DNA, 18 bp, Homo sapiens
gcagtggcaaaggatcca

SEQ ID NO: 6268728 - DNA, 16 bp, Homo sapiens
gcagtggcacgatctc

SEQ ID NO: 6268729 - DNA, 13 bp, Homo sapiens
gcagtggcagaga

SEQ ID NO: 6268730 - DNA, 14 bp, Homo sapiens
gcagtggcagcaac

SEQ ID NO: 6268731 - DNA, 15 bp, Homo sapiens
gcagtggcaggcaga

SEQ ID NO: 6268732 - DNA, 22 bp, Homo sapiens
gcagtggcaggcagaggcccag

SEQ ID NO: 6268733 - DNA, 22 bp, Homo sapiens
gcagtggcatcatctcagctca

SEQ ID NO: 6268734 - DNA, 17 bp, Homo sapiens
gcagtggccaagcctgc

SEQ ID NO: 6268735 - DNA, 22 bp, Homo sapiens
gcagtggccacgttcagggagg

SEQ ID NO: 6268736 - DNA, 23 bp, Homo sapiens
gcagtggccacgttcagggaggg

SEQ ID NO: 6268737 - DNA, 14 bp, Homo sapiens
gcagtggccaggca

SEQ ID NO: 6268738 - DNA, 15 bp, Homo sapiens
gcagtggccaggcag

SEQ ID NO: 6268739 - DNA, 18 bp, Homo sapiens
gcagtggcccctattgag

SEQ ID NO: 6268740 - DNA, 17 bp, Homo sapiens
gcagtggcctgatctct

SEQ ID NO: 6268741 - DNA, 14 bp, Homo sapiens
gcagtggcctggcc

SEQ ID NO: 6268742 - DNA, 15 bp, Homo sapiens
gcagtggcctggccg

SEQ ID NO: 6268743 - DNA, 19 bp, Homo sapiens
gcagtggcgcattctaggc

SEQ ID NO: 6268744 - DNA, 20 bp, Homo sapiens
gcagtggcgcgatctcagct

SEQ ID NO: 6268745 - DNA, 22 bp, Homo sapiens
gcagtggcgcgatctcagctca

SEQ ID NO: 6268746 - DNA, 22 bp, Homo sapiens
gcagtggcgtgatctcagctca

SEQ ID NO: 6268747 - DNA, 16 bp, Homo sapiens
gcagtggctcccctgc

SEQ ID NO: 6268748 - DNA, 18 bp, Homo sapiens
gcagtggctctcagagca

SEQ ID NO: 6268749 - DNA, 23 bp, Homo sapiens
gcagtggctctcagagcagcaga

SEQ ID NO: 6268750 - DNA, 13 bp, Homo sapiens
gcagtggctgggg

SEQ ID NO: 6268751 - DNA, 15 bp, Homo sapiens
gcagtggctggtcca

SEQ ID NO: 6268752 - DNA, 15 bp, Homo sapiens
gcagtggctggtgcc

SEQ ID NO: 6268753 - DNA, 19 bp, Homo sapiens
gcagtggcttagctgccat

SEQ ID NO: 6268754 - DNA, 22 bp, Homo sapiens
gcagtggcttttcatggccctt

SEQ ID NO: 6268755 - DNA, 19 bp, Homo sapiens
gcagtgggaaaaatgtagg

SEQ ID NO: 6268756 - DNA, 12 bp, Homo sapiens
gcagtgggagct

SEQ ID NO: 6268757 - DNA, 13 bp, Homo sapiens
gcagtgggagctg

SEQ ID NO: 6268758 - DNA, 14 bp, Homo sapiens
gcagtgggagctgc

SEQ ID NO: 6268759 - DNA, 22 bp, Homo sapiens
gcagtgggaggcaaatgggatg

SEQ ID NO: 6268760 - DNA, 18 bp, Homo sapiens
gcagtgggagggtaccag

SEQ ID NO: 6268761 - DNA, 20 bp, Homo sapiens
gcagtgggccctggctctgt

SEQ ID NO: 6268762 - DNA, 17 bp, Homo sapiens
gcagtgggcctgctgag

SEQ ID NO: 6268763 - DNA, 20 bp, Homo sapiens
gcagtgggcctgctgaggcc

SEQ ID NO: 6268764 - DNA, 15 bp, Homo sapiens
gcagtgggcctggcc

SEQ ID NO: 6268765 - DNA, 12 bp, Homo sapiens
gcagtggggagc

SEQ ID NO: 6268766 - DNA, 21 bp, Homo sapiens
gcagtggggctggaagcagaa

SEQ ID NO: 6268767 - DNA, 22 bp, Homo sapiens
gcagtggggctggaagcagaaa

SEQ ID NO: 6268768 - DNA, 22 bp, Homo sapiens
gcagtggggtcaagctgagctg

SEQ ID NO: 6268769 - DNA, 21 bp, Homo sapiens
gcagtggggtttcgcagcctg

SEQ ID NO: 6268770 - DNA, 11 bp, Homo sapiens
gcagtgggtcc

SEQ ID NO: 6268771 - DNA, 15 bp, Homo sapiens
gcagtgggtggggct

SEQ ID NO: 6268772 - DNA, 15 bp, Homo sapiens
gcagtggtgatgcct

SEQ ID NO: 6268773 - DNA, 16 bp, Homo sapiens
gcagtggtgcgatctc

SEQ ID NO: 6268774 - DNA, 22 bp, Homo sapiens
gcagtggtgcgatctgggttca

SEQ ID NO: 6268775 - DNA, 22 bp, Homo sapiens
gcagtggtggttttctgttctt

SEQ ID NO: 6268776 - DNA, 19 bp, Homo sapiens
gcagtgtacactgttccca

SEQ ID NO: 6268777 - DNA, 20 bp, Homo sapiens
gcagtgtatttaatgtttgt

SEQ ID NO: 6268778 - DNA, 22 bp, Homo sapiens
gcagtgtatttaatgtttgtaa

SEQ ID NO: 6268779 - DNA, 23 bp, Homo sapiens
gcagtgtcaaatcgatggcctgg

SEQ ID NO: 6268780 - DNA, 17 bp, Homo sapiens
gcagtgtcccagggccc

SEQ ID NO: 6268781 - DNA, 18 bp, Homo sapiens
gcagtgtcccctgcccca

SEQ ID NO: 6268782 - DNA, 22 bp, Homo sapiens
gcagtgtcccctgccccagagg

SEQ ID NO: 6268783 - DNA, 19 bp, Homo sapiens
gcagtgtcctgtgctttct

SEQ ID NO: 6268784 - DNA, 18 bp, Homo sapiens
gcagtgtcgccgtccctc

SEQ ID NO: 6268785 - DNA, 16 bp, Homo sapiens
gcagtgtctgttcttc

SEQ ID NO: 6268786 - DNA, 19 bp, Homo sapiens
gcagtgtcttaaggagact

SEQ ID NO: 6268787 - DNA, 15 bp, Homo sapiens
gcagtgtcttccata

SEQ ID NO: 6268788 - DNA, 22 bp, Homo sapiens
gcagtgtgaatagcctggccac

SEQ ID NO: 6268789 - DNA, 17 bp, Homo sapiens
gcagtgtgaatgctggg

SEQ ID NO: 6268790 - DNA, 18 bp, Homo sapiens
gcagtgtgaatgctgggc

SEQ ID NO: 6268791 - DNA, 22 bp, Homo sapiens
gcagtgtgaatgctgggcccct

SEQ ID NO: 6268792 - DNA, 19 bp, Homo sapiens
gcagtgtgacctcctgtga

SEQ ID NO: 6268793 - DNA, 15 bp, Homo sapiens
gcagtgtgagggtgc

SEQ ID NO: 6268794 - DNA, 16 bp, Homo sapiens
gcagtgtgatccagtt

SEQ ID NO: 6268795 - DNA, 14 bp, Homo sapiens
gcagtgtgcccccc

SEQ ID NO: 6268796 - DNA, 21 bp, Homo sapiens
gcagtgtggagttcaccttgg

SEQ ID NO: 6268797 - DNA, 12 bp, Homo sapiens
gcagtgtggcct

SEQ ID NO: 6268798 - DNA, 14 bp, Homo sapiens
gcagtgtggcctct

SEQ ID NO: 6268799 - DNA, 16 bp, Homo sapiens
gcagtgtggggagggc

SEQ ID NO: 6268800 - DNA, 19 bp, Homo sapiens
gcagtgtggggagggcagg

SEQ ID NO: 6268801 - DNA, 16 bp, Homo sapiens
gcagtgtggtgggagg

SEQ ID NO: 6268802 - DNA, 21 bp, Homo sapiens
gcagtgtgtcacactgagctg

SEQ ID NO: 6268803 - DNA, 14 bp, Homo sapiens
gcagtgtgtccatc

SEQ ID NO: 6268804 - DNA, 18 bp, Homo sapiens
gcagtgtgtctcctgcat

SEQ ID NO: 6268805 - DNA, 11 bp, Homo sapiens
gcagtgttaag

SEQ ID NO: 6268806 - DNA, 23 bp, Homo sapiens
gcagtgttacctgttagctccct

SEQ ID NO: 6268807 - DNA, 14 bp, Homo sapiens
gcagtgttagctta

SEQ ID NO: 6268808 - DNA, 20 bp, Homo sapiens
gcagtgttccccatctgggt

SEQ ID NO: 6268809 - DNA, 21 bp, Homo sapiens
gcagtgttccccatctgggtc

SEQ ID NO: 6268810 - DNA, 22 bp, Homo sapiens
gcagtgttcctcaccaataact

SEQ ID NO: 6268811 - DNA, 23 bp, Homo sapiens
gcagtgttcctcaccaataactt

SEQ ID NO: 6268812 - DNA, 14 bp, Homo sapiens
gcagtgttccttgt

SEQ ID NO: 6268813 - DNA, 15 bp, Homo sapiens
gcagtgttctcacag

SEQ ID NO: 6268814 - DNA, 16 bp, Homo sapiens
gcagtgttctcacagt

SEQ ID NO: 6268815 - DNA, 20 bp, Homo sapiens
gcagtgttctcacagtgtgg

SEQ ID NO: 6268816 - DNA, 20 bp, Homo sapiens
gcagtgttgcgtttttcctt

SEQ ID NO: 6268817 - DNA, 16 bp, Homo sapiens
gcagtgtttaaaaaat

SEQ ID NO: 6268818 - DNA, 14 bp, Homo sapiens
gcagtgtttccttt

SEQ ID NO: 6268819 - DNA, 15 bp, Homo sapiens
gcagtgtttcctttt

SEQ ID NO: 6268820 - DNA, 20 bp, Homo sapiens
gcagttaacatctgaagtgt

SEQ ID NO: 6268821 - DNA, 18 bp, Homo sapiens
gcagttaatggggtagag

SEQ ID NO: 6268822 - DNA, 17 bp, Homo sapiens
gcagttaattagcattc

SEQ ID NO: 6268823 - DNA, 19 bp, Homo sapiens
gcagttacagctctgtagt

SEQ ID NO: 6268824 - DNA, 13 bp, Homo sapiens
gcagttaccacag

SEQ ID NO: 6268825 - DNA, 19 bp, Homo sapiens
gcagttaccattaaaccat

SEQ ID NO: 6268826 - DNA, 18 bp, Homo sapiens
gcagttacccaacagaaa

SEQ ID NO: 6268827 - DNA, 14 bp, Homo sapiens
gcagttaccgagga

SEQ ID NO: 6268828 - DNA, 21 bp, Homo sapiens
gcagttaccgaggagctaaac

SEQ ID NO: 6268829 - DNA, 20 bp, Homo sapiens
gcagttactatttttatatt

SEQ ID NO: 6268830 - DNA, 22 bp, Homo sapiens
gcagttagctgaagaattgaaa

SEQ ID NO: 6268831 - DNA, 14 bp, Homo sapiens
gcagttataacaga

SEQ ID NO: 6268832 - DNA, 20 bp, Homo sapiens
gcagttataacagatgtgaa

SEQ ID NO: 6268833 - DNA, 16 bp, Homo sapiens
gcagttatttaccaga

SEQ ID NO: 6268834 - DNA, 13 bp, Homo sapiens
gcagttcaccatg

SEQ ID NO: 6268835 - DNA, 13 bp, Homo sapiens
gcagttcacctgc

SEQ ID NO: 6268836 - DNA, 20 bp, Homo sapiens
gcagttcagaatggcagtcc

SEQ ID NO: 6268837 - DNA, 23 bp, Homo sapiens
gcagttcagaatggcagtcctgg

SEQ ID NO: 6268838 - DNA, 16 bp, Homo sapiens
gcagttcagagctgcc

SEQ ID NO: 6268839 - DNA, 22 bp, Homo sapiens
gcagttcagagctgccctctcc

SEQ ID NO: 6268840 - DNA, 19 bp, Homo sapiens
gcagttcagtttgtctctt

SEQ ID NO: 6268841 - DNA, 19 bp, Homo sapiens
gcagttcatactgaatgac

SEQ ID NO: 6268842 - DNA, 19 bp, Homo sapiens
gcagttcatccgcactgta

SEQ ID NO: 6268843 - DNA, 19 bp, Homo sapiens
gcagttcattctaccaagc

SEQ ID NO: 6268844 - DNA, 21 bp, Homo sapiens
gcagttcattctaccaagctg

SEQ ID NO: 6268845 - DNA, 17 bp, Homo sapiens
gcagttcattgcagaca

SEQ ID NO: 6268846 - DNA, 17 bp, Homo sapiens
gcagttccatgaagaca

SEQ ID NO: 6268847 - DNA, 19 bp, Homo sapiens
gcagttcccacattaaaga

SEQ ID NO: 6268848 - DNA, 23 bp, Homo sapiens
gcagttcccccaacctcagactt

SEQ ID NO: 6268849 - DNA, 21 bp, Homo sapiens
gcagttcccctggagcccctt

SEQ ID NO: 6268850 - DNA, 21 bp, Homo sapiens
gcagttccggattggcttgtg

SEQ ID NO: 6268851 - DNA, 14 bp, Homo sapiens
gcagttcctgctgc

SEQ ID NO: 6268852 - DNA, 19 bp, Homo sapiens
gcagttcctgtcccacatg

SEQ ID NO: 6268853 - DNA, 15 bp, Homo sapiens
gcagttcctgtgcct

SEQ ID NO: 6268854 - DNA, 17 bp, Homo sapiens
gcagttcgactctgtgc

SEQ ID NO: 6268855 - DNA, 21 bp, Homo sapiens
gctgctccccaacacctgcct

SEQ ID NO: 6268856 - DNA, 17 bp, Homo sapiens
gctgctccccacccgcc

SEQ ID NO: 6268857 - DNA, 13 bp, Homo sapiens
gctgctccccacg

SEQ ID NO: 6268858 - DNA, 17 bp, Homo sapiens
gctgctccccaggccac

SEQ ID NO: 6268859 - DNA, 20 bp, Homo sapiens
gctgctcccctaaagccagg

SEQ ID NO: 6268860 - DNA, 13 bp, Homo sapiens
gctgctcccctgc

SEQ ID NO: 6268861 - DNA, 17 bp, Homo sapiens
gctgctcccctgccacg

SEQ ID NO: 6268862 - DNA, 14 bp, Homo sapiens
gctgctccctcaga

SEQ ID NO: 6268863 - DNA, 15 bp, Homo sapiens
gctgctccctgaggg

SEQ ID NO: 6268864 - DNA, 20 bp, Homo sapiens
gctgctccctgctcccaggg

SEQ ID NO: 6268865 - DNA, 21 bp, Homo sapiens
gctgctccctgctcccaggga

SEQ ID NO: 6268866 - DNA, 13 bp, Homo sapiens
gctgctccctggc

SEQ ID NO: 6268867 - DNA, 23 bp, Homo sapiens
gctgctccggtttgggctgtctt

SEQ ID NO: 6268868 - DNA, 15 bp, Homo sapiens
gctgctcctagaggg

SEQ ID NO: 6268869 - DNA, 13 bp, Homo sapiens
gctgctcctcatg

SEQ ID NO: 6268870 - DNA, 11 bp, Homo sapiens
gctgctcctcc

SEQ ID NO: 6268871 - DNA, 13 bp, Homo sapiens
gctgctcctccag

SEQ ID NO: 6268872 - DNA, 18 bp, Homo sapiens
gctgctcctccagggcca

SEQ ID NO: 6268873 - DNA, 22 bp, Homo sapiens
gctgctcctccctctgacccag

SEQ ID NO: 6268874 - DNA, 14 bp, Homo sapiens
gctgctcctcgcag

SEQ ID NO: 6268875 - DNA, 15 bp, Homo sapiens
gctgctcctctttcc

SEQ ID NO: 6268876 - DNA, 12 bp, Homo sapiens
gctgctcctgtt

SEQ ID NO: 6268877 - DNA, 21 bp, Homo sapiens
gctgctcctgtttgtctgatg

SEQ ID NO: 6268878 - DNA, 17 bp, Homo sapiens
gctgctccttagctgcc

SEQ ID NO: 6268879 - DNA, 18 bp, Homo sapiens
gctgctccttagctgcca

SEQ ID NO: 6268880 - DNA, 19 bp, Homo sapiens
gctgctccttagctgccaa

SEQ ID NO: 6268881 - DNA, 20 bp, Homo sapiens
gctgctccttagctgccaag

SEQ ID NO: 6268882 - DNA, 14 bp, Homo sapiens
gctgctccttggct

SEQ ID NO: 6268883 - DNA, 20 bp, Homo sapiens
gctgctcctttaccctcttg

SEQ ID NO: 6268884 - DNA, 22 bp, Homo sapiens
gctgctcggcttgatcacagct

SEQ ID NO: 6268885 - DNA, 16 bp, Homo sapiens
gctgctcgggaaggcc

SEQ ID NO: 6268886 - DNA, 19 bp, Homo sapiens
gctgctcgggaaggcctga

SEQ ID NO: 6268887 - DNA, 21 bp, Homo sapiens
gctgctcgggaaggcctgagg

SEQ ID NO: 6268888 - DNA, 21 bp, Homo sapiens
gctgctcggggtgcacaggag

SEQ ID NO: 6268889 - DNA, 13 bp, Homo sapiens
gctgctctagctg

SEQ ID NO: 6268890 - DNA, 16 bp, Homo sapiens
gctgctctagctggca

SEQ ID NO: 6268891 - DNA, 17 bp, Homo sapiens
gctgctctagctggcag

SEQ ID NO: 6268892 - DNA, 19 bp, Homo sapiens
gctgctctaggcccacaag

SEQ ID NO: 6268893 - DNA, 15 bp, Homo sapiens
gctgctctcccaagg

SEQ ID NO: 6268894 - DNA, 22 bp, Homo sapiens
gctgctctgaattagtccttgc

SEQ ID NO: 6268895 - DNA, 22 bp, Homo sapiens
gctgctctgcaggctggggagg

SEQ ID NO: 6268896 - DNA, 13 bp, Homo sapiens
gctgctctgccca

SEQ ID NO: 6268897 - DNA, 15 bp, Homo sapiens
gctgctctgcccaga

SEQ ID NO: 6268898 - DNA, 21 bp, Homo sapiens
gctgctctgcccagagctggg

SEQ ID NO: 6268899 - DNA, 14 bp, Homo sapiens
gctgctctgcccca

SEQ ID NO: 6268900 - DNA, 12 bp, Homo sapiens
gctgctctggaa

SEQ ID NO: 6268901 - DNA, 14 bp, Homo sapiens
gctgctctggaaaa

SEQ ID NO: 6268902 - DNA, 13 bp, Homo sapiens
gctgctctgggaa

SEQ ID NO: 6268903 - DNA, 15 bp, Homo sapiens
gctgctctgggaagg

SEQ ID NO: 6268904 - DNA, 22 bp, Homo sapiens
gctgctcttatgccatttgttt

SEQ ID NO: 6268905 - DNA, 22 bp, Homo sapiens
gctgctcttccagcgtctctcc

SEQ ID NO: 6268906 - DNA, 23 bp, Homo sapiens
gctgctcttggctggacccagcc

SEQ ID NO: 6268907 - DNA, 13 bp, Homo sapiens
gctgctgaaacaa

SEQ ID NO: 6268908 - DNA, 19 bp, Homo sapiens
gctgctgaactaatttctg

SEQ ID NO: 6268909 - DNA, 20 bp, Homo sapiens
gctgctgaagctgcctgctt

SEQ ID NO: 6268910 - DNA, 23 bp, Homo sapiens
gctgctgaagctgcctgcttttc

SEQ ID NO: 6268911 - DNA, 12 bp, Homo sapiens
gctgctgaaggc

SEQ ID NO: 6268912 - DNA, 13 bp, Homo sapiens
gctgctgaaggct

SEQ ID NO: 6268913 - DNA, 14 bp, Homo sapiens
gctgctgaaggctc

SEQ ID NO: 6268914 - DNA, 15 bp, Homo sapiens
gctgctgaaggctca

SEQ ID NO: 6268915 - DNA, 14 bp, Homo sapiens
gctgctgaagggag

SEQ ID NO: 6268916 - DNA, 18 bp, Homo sapiens
gctgctgaagggaggggg

SEQ ID NO: 6268917 - DNA, 19 bp, Homo sapiens
gctgctgaagttctgagcc

SEQ ID NO: 6268918 - DNA, 23 bp, Homo sapiens
gctgctgacacgcagcctgctct

SEQ ID NO: 6268919 - DNA, 18 bp, Homo sapiens
gctgctgacaggatgtgg

SEQ ID NO: 6268920 - DNA, 21 bp, Homo sapiens
gctgctgacaggatgtggcac

SEQ ID NO: 6268921 - DNA, 22 bp, Homo sapiens
gctgctgaccaattgtgctgcc

SEQ ID NO: 6268922 - DNA, 23 bp, Homo sapiens
gctgctgaccaattgtgctgcca

SEQ ID NO: 6268923 - DNA, 18 bp, Homo sapiens
gctgctgacccctgtgtg

SEQ ID NO: 6268924 - DNA, 19 bp, Homo sapiens
gctgctgacccctgtgtga

SEQ ID NO: 6268925 - DNA, 18 bp, Homo sapiens
gctgctgacctccacagc

SEQ ID NO: 6268926 - DNA, 14 bp, Homo sapiens
gctgctgagaacct

SEQ ID NO: 6268927 - DNA, 21 bp, Homo sapiens
gctgctgagaacctggccttc

SEQ ID NO: 6268928 - DNA, 16 bp, Homo sapiens
gctgctgagcaggaac

SEQ ID NO: 6268929 - DNA, 20 bp, Homo sapiens
gctgctgagccgcagagaag

SEQ ID NO: 6268930 - DNA, 18 bp, Homo sapiens
gctgctgaggacaatgtc

SEQ ID NO: 6268931 - DNA, 13 bp, Homo sapiens
gctgctgaggcga

SEQ ID NO: 6268932 - DNA, 16 bp, Homo sapiens
gctgctgatgcgctgg

SEQ ID NO: 6268933 - DNA, 14 bp, Homo sapiens
gctgctgcacagct

SEQ ID NO: 6268934 - DNA, 16 bp, Homo sapiens
gctgctgcactgccct

SEQ ID NO: 6268935 - DNA, 15 bp, Homo sapiens
gctgctgcaggacat

SEQ ID NO: 6268936 - DNA, 16 bp, Homo sapiens
gctgctgcaggacatt

SEQ ID NO: 6268937 - DNA, 21 bp, Homo sapiens
gctgctgcagtcagcacagag

SEQ ID NO: 6268938 - DNA, 22 bp, Homo sapiens
gctgctgcagtcagcacagaga

SEQ ID NO: 6268939 - DNA, 22 bp, Homo sapiens
gctgctgccaccaaatctgtct

SEQ ID NO: 6268940 - DNA, 23 bp, Homo sapiens
gctgctgccaccaaatctgtcta

SEQ ID NO: 6268941 - DNA, 19 bp, Homo sapiens
gctgctgccactctgctgc

SEQ ID NO: 6268942 - DNA, 15 bp, Homo sapiens
gctgctgccagggct

SEQ ID NO: 6268943 - DNA, 16 bp, Homo sapiens
gctgctgccagggctt

SEQ ID NO: 6268944 - DNA, 17 bp, Homo sapiens
gctgctgccagggcttc

SEQ ID NO: 6268945 - DNA, 18 bp, Homo sapiens
gctgctgcccatgtttca

SEQ ID NO: 6268946 - DNA, 14 bp, Homo sapiens
gctgctgccccctg

SEQ ID NO: 6268947 - DNA, 14 bp, Homo sapiens
gctgctgcccctgc

SEQ ID NO: 6268948 - DNA, 19 bp, Homo sapiens
gctgctgccctgctgtgga

SEQ ID NO: 6268949 - DNA, 14 bp, Homo sapiens
gctgctgccgccgc

SEQ ID NO: 6268950 - DNA, 15 bp, Homo sapiens
gctgctgcctccctg

SEQ ID NO: 6268951 - DNA, 18 bp, Homo sapiens
gctgctgcctccctgggg

SEQ ID NO: 6268952 - DNA, 18 bp, Homo sapiens
gctgctgcctggccactg

SEQ ID NO: 6268953 - DNA, 13 bp, Homo sapiens
gctgctgccttca

SEQ ID NO: 6268954 - DNA, 12 bp, Homo sapiens
gctgctgccttg

SEQ ID NO: 6268955 - DNA, 14 bp, Homo sapiens
gctgctgctattgc

SEQ ID NO: 6268956 - DNA, 15 bp, Homo sapiens
gctgctgctattgct

SEQ ID NO: 6268957 - DNA, 12 bp, Homo sapiens
gctgctgctcac

SEQ ID NO: 6268958 - DNA, 12 bp, Homo sapiens
gctgctgctctc

SEQ ID NO: 6268959 - DNA, 14 bp, Homo sapiens
gctgctgctgcacc

SEQ ID NO: 6268960 - DNA, 15 bp, Homo sapiens
gctgctgctgctatt

SEQ ID NO: 6268961 - DNA, 15 bp, Homo sapiens
gctgctgctgggctc

SEQ ID NO: 6268962 - DNA, 17 bp, Homo sapiens
gctgctgctgggctcag

SEQ ID NO: 6268963 - DNA, 12 bp, Homo sapiens
gctgctgcttct

SEQ ID NO: 6268964 - DNA, 17 bp, Homo sapiens
gctgctggaaacacagt

SEQ ID NO: 6268965 - DNA, 12 bp, Homo sapiens
gctgctggagaa

SEQ ID NO: 6268966 - DNA, 19 bp, Homo sapiens
gctgctggagcccgcactg

SEQ ID NO: 6268967 - DNA, 19 bp, Homo sapiens
gctgctggaggggacgctg

SEQ ID NO: 6268968 - DNA, 16 bp, Homo sapiens
gctgctggagtgcagt

SEQ ID NO: 6268969 - DNA, 18 bp, Homo sapiens
gctgctggatcacagctg

SEQ ID NO: 6268970 - DNA, 13 bp, Homo sapiens
gctgctggatgac

SEQ ID NO: 6268971 - DNA, 12 bp, Homo sapiens
gctgctggccag

SEQ ID NO: 6268972 - DNA, 13 bp, Homo sapiens
gctgctggccagg

SEQ ID NO: 6268973 - DNA, 18 bp, Homo sapiens
gctgctggccatggctgc

SEQ ID NO: 6268974 - DNA, 16 bp, Homo sapiens
gctgctggcccacagc

SEQ ID NO: 6268975 - DNA, 17 bp, Homo sapiens
gctgctggcctccctcc

SEQ ID NO: 6268976 - DNA, 20 bp, Homo sapiens
gctgctggcctccctccgtc

SEQ ID NO: 6268977 - DNA, 12 bp, Homo sapiens
gctgctggcctg

SEQ ID NO: 6268978 - DNA, 18 bp, Homo sapiens
gctgctggcctggccctt

SEQ ID NO: 6268979 - DNA, 13 bp, Homo sapiens
gctgctggcgcct

SEQ ID NO: 6268980 - DNA, 12 bp, Homo sapiens
gctgctggctcc

SEQ ID NO: 6268981 - DNA, 11 bp, Homo sapiens
gctgctggctt

SEQ ID NO: 6268982 - DNA, 20 bp, Homo sapiens
gctgctgggatggtgggctt

SEQ ID NO: 6268983 - DNA, 23 bp, Homo sapiens
gctgctgggatggtgggcttcag

SEQ ID NO: 6268984 - DNA, 21 bp, Homo sapiens
gctgctgggccagtggcactc

SEQ ID NO: 6268985 - DNA, 19 bp, Homo sapiens
gctgctgggctcagtgaag

SEQ ID NO: 6268986 - DNA, 15 bp, Homo sapiens
gctgctggggcaggg

SEQ ID NO: 6268987 - DNA, 20 bp, Homo sapiens
gctgctggggcagggcccag

SEQ ID NO: 6268988 - DNA, 21 bp, Homo sapiens
gctgctggggcagggcccagg

SEQ ID NO: 6268989 - DNA, 23 bp, Homo sapiens
gctgctggggcagggcccaggga

SEQ ID NO: 6268990 - DNA, 15 bp, Homo sapiens
gctgctggggcatgt

SEQ ID NO: 6268991 - DNA, 18 bp, Homo sapiens
gctgctggggcctcagac

SEQ ID NO: 6268992 - DNA, 12 bp, Homo sapiens
gctgctgggggc

SEQ ID NO: 6268993 - DNA, 21 bp, Homo sapiens
gctgctgggggcaactggcca

SEQ ID NO: 6268994 - DNA, 18 bp, Homo sapiens
gctgctgggggctcccct

SEQ ID NO: 6268995 - DNA, 13 bp, Homo sapiens
gctgctggttttg

SEQ ID NO: 6268996 - DNA, 16 bp, Homo sapiens
gctgctgtaactgctg

SEQ ID NO: 6268997 - DNA, 20 bp, Homo sapiens
gctgctgtaactgctgagcc

SEQ ID NO: 6268998 - DNA, 23 bp, Homo sapiens
gctgctgtaactgctgagccact

SEQ ID NO: 6268999 - DNA, 19 bp, Homo sapiens
gctgctgtacaacttctgg

SEQ ID NO: 6269000 - DNA, 16 bp, Homo sapiens
gctgctgtccagtgcc

SEQ ID NO: 6269001 - DNA, 16 bp, Homo sapiens
gctgctgtccctcccc

SEQ ID NO: 6269002 - DNA, 15 bp, Homo sapiens
gctgctgtctcgggg

SEQ ID NO: 6269003 - DNA, 22 bp, Homo sapiens
gctgctgtctgagtagtggcca

SEQ ID NO: 6269004 - DNA, 13 bp, Homo sapiens
gctgctgtctggg

SEQ ID NO: 6269005 - DNA, 22 bp, Homo sapiens
gctgctgtgaaaactctggtac

SEQ ID NO: 6269006 - DNA, 12 bp, Homo sapiens
gctgctgtgaag

SEQ ID NO: 6269007 - DNA, 14 bp, Homo sapiens
gctgctgtgaattt

SEQ ID NO: 6269008 - DNA, 18 bp, Homo sapiens
gctgctgtgatgccgtcc

SEQ ID NO: 6269009 - DNA, 20 bp, Homo sapiens
gctgctgtgatgccgtcctg

SEQ ID NO: 6269010 - DNA, 15 bp, Homo sapiens
gctgctgtgccagga

SEQ ID NO: 6269011 - DNA, 14 bp, Homo sapiens
gctgctgtgcccca

SEQ ID NO: 6269012 - DNA, 19 bp, Homo sapiens
gctgctgtgccccaccacg

SEQ ID NO: 6269013 - DNA, 13 bp, Homo sapiens
gctgctgtgcctg

SEQ ID NO: 6269014 - DNA, 11 bp, Homo sapiens
gctgctgtgct

SEQ ID NO: 6269015 - DNA, 15 bp, Homo sapiens
gctgctgtggcatca

SEQ ID NO: 6269016 - DNA, 15 bp, Homo sapiens
gctgctgtggcccag

SEQ ID NO: 6269017 - DNA, 17 bp, Homo sapiens
gctgctgtggcccagtc

SEQ ID NO: 6269018 - DNA, 22 bp, Homo sapiens
gctgctgtgtgctttttttgtg

SEQ ID NO: 6269019 - DNA, 18 bp, Homo sapiens
gctgctgtgtgtgagcag

SEQ ID NO: 6269020 - DNA, 16 bp, Homo sapiens
gctgctgttcaggagc

SEQ ID NO: 6269021 - DNA, 15 bp, Homo sapiens
gctgctgttctcagg

SEQ ID NO: 6269022 - DNA, 21 bp, Homo sapiens
gctgctgttctcaggacagca

SEQ ID NO: 6269023 - DNA, 15 bp, Homo sapiens
gctgctgttctgtgt

SEQ ID NO: 6269024 - DNA, 15 bp, Homo sapiens
gctgcttaaactgga

SEQ ID NO: 6269025 - DNA, 16 bp, Homo sapiens
gctgcttaagtgcatg

SEQ ID NO: 6269026 - DNA, 22 bp, Homo sapiens
gctgcttaagtgcatgcattga

SEQ ID NO: 6269027 - DNA, 23 bp, Homo sapiens
gctgcttaatcctaccccctctt

SEQ ID NO: 6269028 - DNA, 18 bp, Homo sapiens
gctgcttaggtctcatgg

SEQ ID NO: 6269029 - DNA, 21 bp, Homo sapiens
gctgcttatttattgaaaata

SEQ ID NO: 6269030 - DNA, 14 bp, Homo sapiens
gctgcttcccagag

SEQ ID NO: 6269031 - DNA, 22 bp, Homo sapiens
gctgcttcccatgcctgcaacc

SEQ ID NO: 6269032 - DNA, 12 bp, Homo sapiens
gctgcttccctc

SEQ ID NO: 6269033 - DNA, 12 bp, Homo sapiens
gctgcttcctaa

SEQ ID NO: 6269034 - DNA, 16 bp, Homo sapiens
gctgcttcctaactta

SEQ ID NO: 6269035 - DNA, 13 bp, Homo sapiens
gctgcttcctcct

SEQ ID NO: 6269036 - DNA, 16 bp, Homo sapiens
gcagttcgcagccacc

SEQ ID NO: 6269037 - DNA, 21 bp, Homo sapiens
gcagttctagtttgcattcct

SEQ ID NO: 6269038 - DNA, 22 bp, Homo sapiens
gcagttctcacgaaagtattta

SEQ ID NO: 6269039 - DNA, 19 bp, Homo sapiens
gcagttctcactcctagga

SEQ ID NO: 6269040 - DNA, 14 bp, Homo sapiens
gcagttctcccagg

SEQ ID NO: 6269041 - DNA, 16 bp, Homo sapiens
gcagttctcccaggga

SEQ ID NO: 6269042 - DNA, 17 bp, Homo sapiens
gcagttctcccagggag

SEQ ID NO: 6269043 - DNA, 19 bp, Homo sapiens
gcagttctcccagggagtg

SEQ ID NO: 6269044 - DNA, 17 bp, Homo sapiens
gcagttctgatgcttac

SEQ ID NO: 6269045 - DNA, 15 bp, Homo sapiens
gcagttctgcaaata

SEQ ID NO: 6269046 - DNA, 13 bp, Homo sapiens
gcagttctgcacc

SEQ ID NO: 6269047 - DNA, 14 bp, Homo sapiens
gcagttctgtgtcc

SEQ ID NO: 6269048 - DNA, 15 bp, Homo sapiens
gcagttctgtgtcct

SEQ ID NO: 6269049 - DNA, 17 bp, Homo sapiens
gcagttcttgtggaaga

SEQ ID NO: 6269050 - DNA, 15 bp, Homo sapiens
gcagttgaaaagact

SEQ ID NO: 6269051 - DNA, 19 bp, Homo sapiens
gcagttgaaaagactccaa

SEQ ID NO: 6269052 - DNA, 19 bp, Homo sapiens
gcagttgacggggcagtca

SEQ ID NO: 6269053 - DNA, 21 bp, Homo sapiens
gcagttgagaggacactcccg

SEQ ID NO: 6269054 - DNA, 14 bp, Homo sapiens
gcagttgaggtggg

SEQ ID NO: 6269055 - DNA, 21 bp, Homo sapiens
gcagttgaggtggggtagtgc

SEQ ID NO: 6269056 - DNA, 15 bp, Homo sapiens
gcagttgataagagg

SEQ ID NO: 6269057 - DNA, 17 bp, Homo sapiens
gcagttgatgtgtcttt

SEQ ID NO: 6269058 - DNA, 14 bp, Homo sapiens
gcagttgccagtca

SEQ ID NO: 6269059 - DNA, 16 bp, Homo sapiens
gcagttgcccagcctc

SEQ ID NO: 6269060 - DNA, 23 bp, Homo sapiens
gcagttgctggtaaaatgaagaa

SEQ ID NO: 6269061 - DNA, 19 bp, Homo sapiens
gcagttggccaagcagaaa

SEQ ID NO: 6269062 - DNA, 14 bp, Homo sapiens
gcagttggccagag

SEQ ID NO: 6269063 - DNA, 13 bp, Homo sapiens
gcagttggcctgt

SEQ ID NO: 6269064 - DNA, 15 bp, Homo sapiens
gcagttggcctgtgc

SEQ ID NO: 6269065 - DNA, 16 bp, Homo sapiens
gcagttggcctgtgct

SEQ ID NO: 6269066 - DNA, 19 bp, Homo sapiens
gcagttgggagtacatatg

SEQ ID NO: 6269067 - DNA, 23 bp, Homo sapiens
gcagttgggtagatgggtggggg

SEQ ID NO: 6269068 - DNA, 14 bp, Homo sapiens
gcagttgtctctgt

SEQ ID NO: 6269069 - DNA, 15 bp, Homo sapiens
gcagttgtctctgtt

SEQ ID NO: 6269070 - DNA, 16 bp, Homo sapiens
gcagttgtctctgttt

SEQ ID NO: 6269071 - DNA, 23 bp, Homo sapiens
gcagtttaaaaaataacttcatt

SEQ ID NO: 6269072 - DNA, 15 bp, Homo sapiens
gcagtttaacaaaat

SEQ ID NO: 6269073 - DNA, 15 bp, Homo sapiens
gcagtttatatttaa

SEQ ID NO: 6269074 - DNA, 18 bp, Homo sapiens
gcagtttatatttaactc

SEQ ID NO: 6269075 - DNA, 12 bp, Homo sapiens
gcagtttcaata

SEQ ID NO: 6269076 - DNA, 18 bp, Homo sapiens
gcagtttcagataaatca

SEQ ID NO: 6269077 - DNA, 20 bp, Homo sapiens
gcagtttcatctggttgtga

SEQ ID NO: 6269078 - DNA, 20 bp, Homo sapiens
gcagtttcattcaacacatt

SEQ ID NO: 6269079 - DNA, 13 bp, Homo sapiens
gcagtttcccaga

SEQ ID NO: 6269080 - DNA, 14 bp, Homo sapiens
gcagtttcctcagt

SEQ ID NO: 6269081 - DNA, 20 bp, Homo sapiens
gcagtttctgtcctgctggt

SEQ ID NO: 6269082 - DNA, 11 bp, Homo sapiens
gcagtttgaaa

SEQ ID NO: 6269083 - DNA, 17 bp, Homo sapiens
gcagtttgaaattctga

SEQ ID NO: 6269084 - DNA, 15 bp, Homo sapiens
gcagtttgcctctgc

SEQ ID NO: 6269085 - DNA, 18 bp, Homo sapiens
gcagtttggccctggagc

SEQ ID NO: 6269086 - DNA, 20 bp, Homo sapiens
gcagtttggccctggagcca

SEQ ID NO: 6269087 - DNA, 18 bp, Homo sapiens
gcagtttgggagacatgg

SEQ ID NO: 6269088 - DNA, 22 bp, Homo sapiens
gcagtttgggagacatggacca

SEQ ID NO: 6269089 - DNA, 23 bp, Homo sapiens
gcagtttgggagacatggaccag

SEQ ID NO: 6269090 - DNA, 17 bp, Homo sapiens
gcagtttggtatgaaac

SEQ ID NO: 6269091 - DNA, 14 bp, Homo sapiens
gcagtttgtgaatg

SEQ ID NO: 6269092 - DNA, 16 bp, Homo sapiens
gcagttttccaggagg

SEQ ID NO: 6269093 - DNA, 21 bp, Homo sapiens
gcagttttgacatcagccagc

SEQ ID NO: 6269094 - DNA, 16 bp, Homo sapiens
gcagttttgtaaatgt

SEQ ID NO: 6269095 - DNA, 21 bp, Homo sapiens
gcagttttgttttaaaactgg

SEQ ID NO: 6269096 - DNA, 14 bp, Homo sapiens
gcagtttttaattt

SEQ ID NO: 6269097 - DNA, 13 bp, Homo sapiens
gcagtttttgaaa

SEQ ID NO: 6269098 - DNA, 22 bp, Homo sapiens
gcagtttttttatggcattttt

SEQ ID NO: 6269099 - DNA, 20 bp, Homo sapiens
gcagttttttttttcttgtc

SEQ ID NO: 6269100 - DNA, 15 bp, Homo sapiens
gcataaaaaaatgat

SEQ ID NO: 6269101 - DNA, 16 bp, Homo sapiens
gcataaaaaaatgatg

SEQ ID NO: 6269102 - DNA, 11 bp, Homo sapiens
gcataaaacaa

SEQ ID NO: 6269103 - DNA, 13 bp, Homo sapiens
gcataaaacagct

SEQ ID NO: 6269104 - DNA, 21 bp, Homo sapiens
gcataaaagggtcaaacctgt

SEQ ID NO: 6269105 - DNA, 12 bp, Homo sapiens
gcataaaagtta

SEQ ID NO: 6269106 - DNA, 12 bp, Homo sapiens
gcataaaattct

SEQ ID NO: 6269107 - DNA, 18 bp, Homo sapiens
gcataaacaatattgcta

SEQ ID NO: 6269108 - DNA, 12 bp, Homo sapiens
gcataaactgtt

SEQ ID NO: 6269109 - DNA, 19 bp, Homo sapiens
gcataaagctcaaatgaaa

SEQ ID NO: 6269110 - DNA, 14 bp, Homo sapiens
gcataaaggccttt

SEQ ID NO: 6269111 - DNA, 19 bp, Homo sapiens
gcataaataaaactgaatc

SEQ ID NO: 6269112 - DNA, 15 bp, Homo sapiens
gcataaattaaaatg

SEQ ID NO: 6269113 - DNA, 15 bp, Homo sapiens
gcataaattgcatca

SEQ ID NO: 6269114 - DNA, 14 bp, Homo sapiens
gcataaatttgtaa

SEQ ID NO: 6269115 - DNA, 12 bp, Homo sapiens
gcataacacagc

SEQ ID NO: 6269116 - DNA, 15 bp, Homo sapiens
gcataacataaatct

SEQ ID NO: 6269117 - DNA, 23 bp, Homo sapiens
gcataacataaatctgtgaactt

SEQ ID NO: 6269118 - DNA, 14 bp, Homo sapiens
gcataacctgtctc

SEQ ID NO: 6269119 - DNA, 13 bp, Homo sapiens
gcataagaaaaag

SEQ ID NO: 6269120 - DNA, 15 bp, Homo sapiens
gcataagaccaatct

SEQ ID NO: 6269121 - DNA, 13 bp, Homo sapiens
gcataagattaaa

SEQ ID NO: 6269122 - DNA, 18 bp, Homo sapiens
gcataagattaaaggaag

SEQ ID NO: 6269123 - DNA, 19 bp, Homo sapiens
gcataagattaaaggaagg

SEQ ID NO: 6269124 - DNA, 17 bp, Homo sapiens
gcataagcctcaggcct

SEQ ID NO: 6269125 - DNA, 24 bp, Homo sapiens
gcataagcctcaggcctggccctt

SEQ ID NO: 6269126 - DNA, 14 bp, Homo sapiens
gcataataaatgct

SEQ ID NO: 6269127 - DNA, 19 bp, Homo sapiens
gcataataagccatggctg

SEQ ID NO: 6269128 - DNA, 14 bp, Homo sapiens
gcataataagctaa

SEQ ID NO: 6269129 - DNA, 17 bp, Homo sapiens
gcataataatcctgcaa

SEQ ID NO: 6269130 - DNA, 18 bp, Homo sapiens
gcataatactaatttatt

SEQ ID NO: 6269131 - DNA, 15 bp, Homo sapiens
gcataatatgaagcc

SEQ ID NO: 6269132 - DNA, 16 bp, Homo sapiens
gcataatctgaaaaca

SEQ ID NO: 6269133 - DNA, 21 bp, Homo sapiens
gcataatgaaccgtttacagt

SEQ ID NO: 6269134 - DNA, 20 bp, Homo sapiens
gcataatgataaaataaata

SEQ ID NO: 6269135 - DNA, 17 bp, Homo sapiens
gcataatgcaatcaaaa

SEQ ID NO: 6269136 - DNA, 13 bp, Homo sapiens
gcataatgctttg

SEQ ID NO: 6269137 - DNA, 17 bp, Homo sapiens
gcataatgctttggaaa

SEQ ID NO: 6269138 - DNA, 16 bp, Homo sapiens
gcataatggtaaatct

SEQ ID NO: 6269139 - DNA, 14 bp, Homo sapiens
gcataatgtcttta

SEQ ID NO: 6269140 - DNA, 23 bp, Homo sapiens
gcataattcggaagggaaaacag

SEQ ID NO: 6269141 - DNA, 20 bp, Homo sapiens
gcataatttgtttaaaattc

SEQ ID NO: 6269142 - DNA, 20 bp, Homo sapiens
gcatacaaaaatatattaaa

SEQ ID NO: 6269143 - DNA, 21 bp, Homo sapiens
gcatacaaaaatatattaaaa

SEQ ID NO: 6269144 - DNA, 14 bp, Homo sapiens
gcatacaaaatatt

SEQ ID NO: 6269145 - DNA, 12 bp, Homo sapiens
gcatacaaacaa

SEQ ID NO: 6269146 - DNA, 18 bp, Homo sapiens
gcatacaaacaagcatat

SEQ ID NO: 6269147 - DNA, 20 bp, Homo sapiens
gcatacaaatctcactgtat

SEQ ID NO: 6269148 - DNA, 20 bp, Homo sapiens
gcatacaagtttcattctcc

SEQ ID NO: 6269149 - DNA, 12 bp, Homo sapiens
gcatacaataaa

SEQ ID NO: 6269150 - DNA, 15 bp, Homo sapiens
gcatacaataaaaga

SEQ ID NO: 6269151 - DNA, 17 bp, Homo sapiens
gcatacaataaaagagc

SEQ ID NO: 6269152 - DNA, 11 bp, Homo sapiens
gcatacacaca

SEQ ID NO: 6269153 - DNA, 13 bp, Homo sapiens
gcatacacacaca

SEQ ID NO: 6269154 - DNA, 21 bp, Homo sapiens
gcatacacacatgccctcctg

SEQ ID NO: 6269155 - DNA, 22 bp, Homo sapiens
gcatacacacatgccctcctgg

SEQ ID NO: 6269156 - DNA, 23 bp, Homo sapiens
gcatacacacatgccctcctgga

SEQ ID NO: 6269157 - DNA, 21 bp, Homo sapiens
gcatacacccccacctcctgc

SEQ ID NO: 6269158 - DNA, 17 bp, Homo sapiens
gcatacagatattctaa

SEQ ID NO: 6269159 - DNA, 18 bp, Homo sapiens
gcatacaggttaacctgc

SEQ ID NO: 6269160 - DNA, 22 bp, Homo sapiens
gcatacatacacacacacacat

SEQ ID NO: 6269161 - DNA, 19 bp, Homo sapiens
gcatacatgcaaaaagaaa

SEQ ID NO: 6269162 - DNA, 17 bp, Homo sapiens
gcatacatttataatgt

SEQ ID NO: 6269163 - DNA, 20 bp, Homo sapiens
gcataccacaagacatttct

SEQ ID NO: 6269164 - DNA, 20 bp, Homo sapiens
gcatacccacacaaataaca

SEQ ID NO: 6269165 - DNA, 23 bp, Homo sapiens
gcataccggacttgtcacacgga

SEQ ID NO: 6269166 - DNA, 18 bp, Homo sapiens
gcatacctcctatgggtt

SEQ ID NO: 6269167 - DNA, 22 bp, Homo sapiens
gcatacgcattaagggcctgct

SEQ ID NO: 6269168 - DNA, 23 bp, Homo sapiens
gcatacgcattaagggcctgctg

SEQ ID NO: 6269169 - DNA, 15 bp, Homo sapiens
gcatacgcctcttgt

SEQ ID NO: 6269170 - DNA, 19 bp, Homo sapiens
gcatacgtacacattttat

SEQ ID NO: 6269171 - DNA, 16 bp, Homo sapiens
gcatactaataaagta

SEQ ID NO: 6269172 - DNA, 14 bp, Homo sapiens
gcatactattaaac

SEQ ID NO: 6269173 - DNA, 17 bp, Homo sapiens
gcatactattaaacatg

SEQ ID NO: 6269174 - DNA, 13 bp, Homo sapiens
gcatactgaaaat

SEQ ID NO: 6269175 - DNA, 22 bp, Homo sapiens
gcatactgagccaagtataatt

SEQ ID NO: 6269176 - DNA, 23 bp, Homo sapiens
gcatactgccttgtttaatgtta

SEQ ID NO: 6269177 - DNA, 14 bp, Homo sapiens
gcatactgtgtatg

SEQ ID NO: 6269178 - DNA, 16 bp, Homo sapiens
gcatactgttgataca

SEQ ID NO: 6269179 - DNA, 14 bp, Homo sapiens
gcatacttcaaaag

SEQ ID NO: 6269180 - DNA, 17 bp, Homo sapiens
gcatacttcaaaagtat

SEQ ID NO: 6269181 - DNA, 21 bp, Homo sapiens
gcatacttcaaaagtattttc

SEQ ID NO: 6269182 - DNA, 22 bp, Homo sapiens
gcatacttcaaaagtattttcc

SEQ ID NO: 6269183 - DNA, 14 bp, Homo sapiens
gcatactttgtatt

SEQ ID NO: 6269184 - DNA, 18 bp, Homo sapiens
gcatacttttaatcaagt

SEQ ID NO: 6269185 - DNA, 15 bp, Homo sapiens
gcatacttttcaaag

SEQ ID NO: 6269186 - DNA, 18 bp, Homo sapiens
gcatagaaactgaggagt

SEQ ID NO: 6269187 - DNA, 16 bp, Homo sapiens
gcatagaactgggtaa

SEQ ID NO: 6269188 - DNA, 18 bp, Homo sapiens
gcatagaattctagcttt

SEQ ID NO: 6269189 - DNA, 14 bp, Homo sapiens
gcatagacaagtgt

SEQ ID NO: 6269190 - DNA, 21 bp, Homo sapiens
gcatagagaatacacatataa

SEQ ID NO: 6269191 - DNA, 14 bp, Homo sapiens
gcatagagctatat

SEQ ID NO: 6269192 - DNA, 22 bp, Homo sapiens
gcatagaggcttctccgccagc

SEQ ID NO: 6269193 - DNA, 22 bp, Homo sapiens
gcatagaggtaccagcaatatg

SEQ ID NO: 6269194 - DNA, 19 bp, Homo sapiens
gcatagagtaggtactcca

SEQ ID NO: 6269195 - DNA, 19 bp, Homo sapiens
gcatagatgcaggtgagcc

SEQ ID NO: 6269196 - DNA, 18 bp, Homo sapiens
gcatagattccctgagca

SEQ ID NO: 6269197 - DNA, 16 bp, Homo sapiens
gcatagcaagacacat

SEQ ID NO: 6269198 - DNA, 16 bp, Homo sapiens
gcatagcagaggggcc

SEQ ID NO: 6269199 - DNA, 21 bp, Homo sapiens
gcatagcagaggggccaggcc

SEQ ID NO: 6269200 - DNA, 18 bp, Homo sapiens
gcatagcccatgttaagt

SEQ ID NO: 6269201 - DNA, 22 bp, Homo sapiens
gcatagcctgcctgatccctga

SEQ ID NO: 6269202 - DNA, 19 bp, Homo sapiens
gcatagcgtcctgccctgc

SEQ ID NO: 6269203 - DNA, 20 bp, Homo sapiens
gcatagcgtcctgccctgcc

SEQ ID NO: 6269204 - DNA, 22 bp, Homo sapiens
gcatagctactaaaatcagtga

SEQ ID NO: 6269205 - DNA, 23 bp, Homo sapiens
gcatagctgttttagctgaggga

SEQ ID NO: 6269206 - DNA, 13 bp, Homo sapiens
gcataggaagaaa

SEQ ID NO: 6269207 - DNA, 17 bp, Homo sapiens
gcataggcccagccagg

SEQ ID NO: 6269208 - DNA, 16 bp, Homo sapiens
gcataggcctgctttg

SEQ ID NO: 6269209 - DNA, 23 bp, Homo sapiens
gcataggcctgctttgtctcctc

SEQ ID NO: 6269210 - DNA, 16 bp, Homo sapiens
gcataggcctgggtgc

SEQ ID NO: 6269211 - DNA, 22 bp, Homo sapiens
gcataggcctgggtgctggctg

SEQ ID NO: 6269212 - DNA, 12 bp, Homo sapiens
gcataggctggg

SEQ ID NO: 6269213 - DNA, 15 bp, Homo sapiens
gcataggggggaggg

SEQ ID NO: 6269214 - DNA, 18 bp, Homo sapiens
gcataggggggagggtct

SEQ ID NO: 6269215 - DNA, 17 bp, Homo sapiens
gctgcttcctcctggaa

SEQ ID NO: 6269216 - DNA, 23 bp, Homo sapiens
gctgcttcctgtgacagtgaaat

SEQ ID NO: 6269217 - DNA, 11 bp, Homo sapiens
gctgcttctcc

SEQ ID NO: 6269218 - DNA, 15 bp, Homo sapiens
gctgcttctccacct

SEQ ID NO: 6269219 - DNA, 18 bp, Homo sapiens
gctgcttctccacctccc

SEQ ID NO: 6269220 - DNA, 21 bp, Homo sapiens
gctgcttctcccacttggcca

SEQ ID NO: 6269221 - DNA, 19 bp, Homo sapiens
gctgcttctcccaggcaag

SEQ ID NO: 6269222 - DNA, 21 bp, Homo sapiens
gctgcttctcccaggcaaggc

SEQ ID NO: 6269223 - DNA, 15 bp, Homo sapiens
gctgcttctgcccac

SEQ ID NO: 6269224 - DNA, 22 bp, Homo sapiens
gctgcttctgcccaccccgcct

SEQ ID NO: 6269225 - DNA, 13 bp, Homo sapiens
gctgcttctgctc

SEQ ID NO: 6269226 - DNA, 14 bp, Homo sapiens
gctgcttctgggcc

SEQ ID NO: 6269227 - DNA, 15 bp, Homo sapiens
gctgcttctggggct

SEQ ID NO: 6269228 - DNA, 15 bp, Homo sapiens
gctgcttctggggga

SEQ ID NO: 6269229 - DNA, 14 bp, Homo sapiens
gctgcttctgtgca

SEQ ID NO: 6269230 - DNA, 14 bp, Homo sapiens
gctgcttcttgctt

SEQ ID NO: 6269231 - DNA, 23 bp, Homo sapiens
gctgcttgagtggacagcagctg

SEQ ID NO: 6269232 - DNA, 15 bp, Homo sapiens
gctgcttggacggat

SEQ ID NO: 6269233 - DNA, 17 bp, Homo sapiens
gctgcttggagtgcccc

SEQ ID NO: 6269234 - DNA, 20 bp, Homo sapiens
gctgcttggagtgccccaag

SEQ ID NO: 6269235 - DNA, 16 bp, Homo sapiens
gctgcttgggcttcat

SEQ ID NO: 6269236 - DNA, 17 bp, Homo sapiens
gctgcttgtcctgctct

SEQ ID NO: 6269237 - DNA, 14 bp, Homo sapiens
gctgcttgtcctgg

SEQ ID NO: 6269238 - DNA, 19 bp, Homo sapiens
gctgcttgtgaccttgact

SEQ ID NO: 6269239 - DNA, 16 bp, Homo sapiens
gctgctttatcaaaat

SEQ ID NO: 6269240 - DNA, 16 bp, Homo sapiens
gctgctttccatggca

SEQ ID NO: 6269241 - DNA, 19 bp, Homo sapiens
gctgctttcccctgtgggg

SEQ ID NO: 6269242 - DNA, 13 bp, Homo sapiens
gctgctttccttc

SEQ ID NO: 6269243 - DNA, 23 bp, Homo sapiens
gctgctttctcctttcaccaccc

SEQ ID NO: 6269244 - DNA, 17 bp, Homo sapiens
gctgctttcttctctgc

SEQ ID NO: 6269245 - DNA, 19 bp, Homo sapiens
gctgctttcttctctgcct

SEQ ID NO: 6269246 - DNA, 22 bp, Homo sapiens
gctgctttcttctctgcctcct

SEQ ID NO: 6269247 - DNA, 22 bp, Homo sapiens
gctgctttgacaaaatgactgg

SEQ ID NO: 6269248 - DNA, 15 bp, Homo sapiens
gctgctttgatatat

SEQ ID NO: 6269249 - DNA, 22 bp, Homo sapiens
gctgctttgcacacacactagc

SEQ ID NO: 6269250 - DNA, 15 bp, Homo sapiens
gctgctttgggctgg

SEQ ID NO: 6269251 - DNA, 22 bp, Homo sapiens
gctgctttgttaccttaaaact

SEQ ID NO: 6269252 - DNA, 23 bp, Homo sapiens
gctgctttgttaccttaaaacta

SEQ ID NO: 6269253 - DNA, 22 bp, Homo sapiens
gctgcttttaaaacataggaaa

SEQ ID NO: 6269254 - DNA, 22 bp, Homo sapiens
gctgcttttccctaagccaagg

SEQ ID NO: 6269255 - DNA, 17 bp, Homo sapiens
gctgcttttctgtcagt

SEQ ID NO: 6269256 - DNA, 19 bp, Homo sapiens
gctgcttttcttttctaac

SEQ ID NO: 6269257 - DNA, 15 bp, Homo sapiens
gctgcttttgagcct

SEQ ID NO: 6269258 - DNA, 17 bp, Homo sapiens
gctgcttttgagcctca

SEQ ID NO: 6269259 - DNA, 18 bp, Homo sapiens
gctgcttttgagcctcag

SEQ ID NO: 6269260 - DNA, 13 bp, Homo sapiens
gctgcttttgatg

SEQ ID NO: 6269261 - DNA, 18 bp, Homo sapiens
gctgcttttgtctccctt

SEQ ID NO: 6269262 - DNA, 18 bp, Homo sapiens
gctgctttttggcacagt

SEQ ID NO: 6269263 - DNA, 14 bp, Homo sapiens
gctgctttttttga

SEQ ID NO: 6269264 - DNA, 16 bp, Homo sapiens
gctggaaaactgccac

SEQ ID NO: 6269265 - DNA, 23 bp, Homo sapiens
gctggaaaagggtcttgggaaat

SEQ ID NO: 6269266 - DNA, 18 bp, Homo sapiens
gctggaaaagtcacacag

SEQ ID NO: 6269267 - DNA, 23 bp, Homo sapiens
gctggaaaatcatattgagaata

SEQ ID NO: 6269268 - DNA, 20 bp, Homo sapiens
gctggaaaccaagtcaggcc

SEQ ID NO: 6269269 - DNA, 23 bp, Homo sapiens
gctggaaagcaaacaggaagatt

SEQ ID NO: 6269270 - DNA, 21 bp, Homo sapiens
gctggaaaggatgcttctgct

SEQ ID NO: 6269271 - DNA, 19 bp, Homo sapiens
gctggaaaggccagcagcc

SEQ ID NO: 6269272 - DNA, 23 bp, Homo sapiens
gctggaaaggccagcagccttcc

SEQ ID NO: 6269273 - DNA, 20 bp, Homo sapiens
gctggaaagttgggcccctg

SEQ ID NO: 6269274 - DNA, 22 bp, Homo sapiens
gctggaaataaacctggagatg

SEQ ID NO: 6269275 - DNA, 23 bp, Homo sapiens
gctggaaataaacctggagatga

SEQ ID NO: 6269276 - DNA, 16 bp, Homo sapiens
gctggaacagattcac

SEQ ID NO: 6269277 - DNA, 21 bp, Homo sapiens
gctggaacagattcacactgt

SEQ ID NO: 6269278 - DNA, 16 bp, Homo sapiens
gctggaagaacatcaa

SEQ ID NO: 6269279 - DNA, 18 bp, Homo sapiens
gctggaagaacccttctc

SEQ ID NO: 6269280 - DNA, 17 bp, Homo sapiens
gctggaagaactgcatg

SEQ ID NO: 6269281 - DNA, 15 bp, Homo sapiens
gctggaagacagaga

SEQ ID NO: 6269282 - DNA, 18 bp, Homo sapiens
gctggaagactgtgcaga

SEQ ID NO: 6269283 - DNA, 23 bp, Homo sapiens
gctggaagagggtgaaaggcagg

SEQ ID NO: 6269284 - DNA, 18 bp, Homo sapiens
gctggaagatagctgtga

SEQ ID NO: 6269285 - DNA, 16 bp, Homo sapiens
gctggaaggaggaaga

SEQ ID NO: 6269286 - DNA, 18 bp, Homo sapiens
gctggaaggaggaagaat

SEQ ID NO: 6269287 - DNA, 13 bp, Homo sapiens
gctggaaggcagc

SEQ ID NO: 6269288 - DNA, 14 bp, Homo sapiens
gctggaaggcagca

SEQ ID NO: 6269289 - DNA, 15 bp, Homo sapiens
gctggaaggcagggc

SEQ ID NO: 6269290 - DNA, 20 bp, Homo sapiens
gctggaaggcagggcagagg

SEQ ID NO: 6269291 - DNA, 22 bp, Homo sapiens
gctggaaggcagggcagaggga

SEQ ID NO: 6269292 - DNA, 17 bp, Homo sapiens
gctggaagggaggaagg

SEQ ID NO: 6269293 - DNA, 16 bp, Homo sapiens
gctggaaggggcagca

SEQ ID NO: 6269294 - DNA, 17 bp, Homo sapiens
gctggaagtacttggcc

SEQ ID NO: 6269295 - DNA, 21 bp, Homo sapiens
gctggaatcaatttcccagaa

SEQ ID NO: 6269296 - DNA, 17 bp, Homo sapiens
gctggaatccagaagga

SEQ ID NO: 6269297 - DNA, 16 bp, Homo sapiens
gctggaatctggagag

SEQ ID NO: 6269298 - DNA, 16 bp, Homo sapiens
gctggaatgagggagg

SEQ ID NO: 6269299 - DNA, 23 bp, Homo sapiens
gctggaatgatttcagctcactg

SEQ ID NO: 6269300 - DNA, 20 bp, Homo sapiens
gctggaatgcagtggtgcga

SEQ ID NO: 6269301 - DNA, 19 bp, Homo sapiens
gctggaatgggggccaggc

SEQ ID NO: 6269302 - DNA, 18 bp, Homo sapiens
gctggaatgtgccacaga

SEQ ID NO: 6269303 - DNA, 20 bp, Homo sapiens
gctggaatgtgccacagagg

SEQ ID NO: 6269304 - DNA, 16 bp, Homo sapiens
gctggaattaaaacaa

SEQ ID NO: 6269305 - DNA, 17 bp, Homo sapiens
gctggaattgctgctct

SEQ ID NO: 6269306 - DNA, 14 bp, Homo sapiens
gctggacaaactgc

SEQ ID NO: 6269307 - DNA, 18 bp, Homo sapiens
gctggacacccccttggt

SEQ ID NO: 6269308 - DNA, 22 bp, Homo sapiens
gctggacacccccttggtgctc

SEQ ID NO: 6269309 - DNA, 14 bp, Homo sapiens
gctggacaccctct

SEQ ID NO: 6269310 - DNA, 16 bp, Homo sapiens
gctggacaccctctgc

SEQ ID NO: 6269311 - DNA, 21 bp, Homo sapiens
gctggacacctacagcagcac

SEQ ID NO: 6269312 - DNA, 14 bp, Homo sapiens
gctggacagcctcc

SEQ ID NO: 6269313 - DNA, 15 bp, Homo sapiens
gctggacagcttacc

SEQ ID NO: 6269314 - DNA, 21 bp, Homo sapiens
gctggacatactgctggagtc

SEQ ID NO: 6269315 - DNA, 19 bp, Homo sapiens
gctggacatgagatggaga

SEQ ID NO: 6269316 - DNA, 18 bp, Homo sapiens
gctggacatttgtggcag

SEQ ID NO: 6269317 - DNA, 15 bp, Homo sapiens
gctggaccaaggtgc

SEQ ID NO: 6269318 - DNA, 18 bp, Homo sapiens
gctggaccagctggcctg

SEQ ID NO: 6269319 - DNA, 15 bp, Homo sapiens
gctggacccagccag

SEQ ID NO: 6269320 - DNA, 20 bp, Homo sapiens
gctggacccagccaggccca

SEQ ID NO: 6269321 - DNA, 21 bp, Homo sapiens
gctggacccagccaggcccag

SEQ ID NO: 6269322 - DNA, 20 bp, Homo sapiens
gctggacccatttgccagga

SEQ ID NO: 6269323 - DNA, 14 bp, Homo sapiens
gctggaccctgacc

SEQ ID NO: 6269324 - DNA, 23 bp, Homo sapiens
gctggacctatgtcctaaggaca

SEQ ID NO: 6269325 - DNA, 14 bp, Homo sapiens
gctggacctggggt

SEQ ID NO: 6269326 - DNA, 16 bp, Homo sapiens
gctggaccttgaactg

SEQ ID NO: 6269327 - DNA, 16 bp, Homo sapiens
gctggacggcattcct

SEQ ID NO: 6269328 - DNA, 19 bp, Homo sapiens
gctggacgggttagacagc

SEQ ID NO: 6269329 - DNA, 16 bp, Homo sapiens
gctggactattgtgcc

SEQ ID NO: 6269330 - DNA, 17 bp, Homo sapiens
gctggactattgtgcca

SEQ ID NO: 6269331 - DNA, 17 bp, Homo sapiens
gctggactccagatctg

SEQ ID NO: 6269332 - DNA, 21 bp, Homo sapiens
gctggactccagatctgcacc

SEQ ID NO: 6269333 - DNA, 22 bp, Homo sapiens
gctggactccagatctgcaccg

SEQ ID NO: 6269334 - DNA, 16 bp, Homo sapiens
gctggactccctcaag

SEQ ID NO: 6269335 - DNA, 13 bp, Homo sapiens
gctggactctgca

SEQ ID NO: 6269336 - DNA, 19 bp, Homo sapiens
gctggactctggcacccag

SEQ ID NO: 6269337 - DNA, 21 bp, Homo sapiens
gctggactgatggttgctttg

SEQ ID NO: 6269338 - DNA, 13 bp, Homo sapiens
gctggactggctg

SEQ ID NO: 6269339 - DNA, 14 bp, Homo sapiens
gctggactgtagaa

SEQ ID NO: 6269340 - DNA, 15 bp, Homo sapiens
gctggacttctgtgg

SEQ ID NO: 6269341 - DNA, 17 bp, Homo sapiens
gctggacttctgtgggc

SEQ ID NO: 6269342 - DNA, 18 bp, Homo sapiens
gctggacttctgtgggcc

SEQ ID NO: 6269343 - DNA, 14 bp, Homo sapiens
gctggagaaaaata

SEQ ID NO: 6269344 - DNA, 21 bp, Homo sapiens
gctggagaaaccttcactcca

SEQ ID NO: 6269345 - DNA, 13 bp, Homo sapiens
gctggagaaagag

SEQ ID NO: 6269346 - DNA, 22 bp, Homo sapiens
gctggagaaagagctgcctgga

SEQ ID NO: 6269347 - DNA, 16 bp, Homo sapiens
gctggagaaagccacg

SEQ ID NO: 6269348 - DNA, 18 bp, Homo sapiens
gctggagaaagccacgcc

SEQ ID NO: 6269349 - DNA, 15 bp, Homo sapiens
gctggagaagagagg

SEQ ID NO: 6269350 - DNA, 17 bp, Homo sapiens
gctggagaagagaggag

SEQ ID NO: 6269351 - DNA, 16 bp, Homo sapiens
gctggagaagcccatg

SEQ ID NO: 6269352 - DNA, 20 bp, Homo sapiens
gctggagaataaatttggga

SEQ ID NO: 6269353 - DNA, 23 bp, Homo sapiens
gctggagacaggtgcgcccctgg

SEQ ID NO: 6269354 - DNA, 23 bp, Homo sapiens
gctggagaccagaacagcatggc

SEQ ID NO: 6269355 - DNA, 20 bp, Homo sapiens
gctggagaccatgcagagcg

SEQ ID NO: 6269356 - DNA, 14 bp, Homo sapiens
gctggagaccctgc

SEQ ID NO: 6269357 - DNA, 18 bp, Homo sapiens
gctggagaccctgcgccc

SEQ ID NO: 6269358 - DNA, 20 bp, Homo sapiens
gctggagaccctgcgcccct

SEQ ID NO: 6269359 - DNA, 21 bp, Homo sapiens
gctggagaccctgcgcccctg

SEQ ID NO: 6269360 - DNA, 23 bp, Homo sapiens
gctggagaccctgcgcccctgcc

SEQ ID NO: 6269361 - DNA, 23 bp, Homo sapiens
gctggagaccgaggccagaaggc

SEQ ID NO: 6269362 - DNA, 18 bp, Homo sapiens
gctggagactatttaagt

SEQ ID NO: 6269363 - DNA, 20 bp, Homo sapiens
gctggagactggaccgctga

SEQ ID NO: 6269364 - DNA, 19 bp, Homo sapiens
gctggagacttcctctggt

SEQ ID NO: 6269365 - DNA, 21 bp, Homo sapiens
gctggagaggagccctgcctc

SEQ ID NO: 6269366 - DNA, 22 bp, Homo sapiens
gctggagatacttggtcacagc

SEQ ID NO: 6269367 - DNA, 19 bp, Homo sapiens
gctggagatctgaacccag

SEQ ID NO: 6269368 - DNA, 18 bp, Homo sapiens
gctggagatgaggccaga

SEQ ID NO: 6269369 - DNA, 20 bp, Homo sapiens
gctggagatgaggccagacc

SEQ ID NO: 6269370 - DNA, 21 bp, Homo sapiens
gctggagatgcaaggtgctgg

SEQ ID NO: 6269371 - DNA, 19 bp, Homo sapiens
gctggagatggctgctgct

SEQ ID NO: 6269372 - DNA, 24 bp, Homo sapiens
gctggagcagcggattgctctgga

SEQ ID NO: 6269373 - DNA, 20 bp, Homo sapiens
gctggagcagtttggggcag

SEQ ID NO: 6269374 - DNA, 21 bp, Homo sapiens
gctggagcagtttggggcagg

SEQ ID NO: 6269375 - DNA, 15 bp, Homo sapiens
gctggagcccacagc

SEQ ID NO: 6269376 - DNA, 16 bp, Homo sapiens
gctggagcccacagcg

SEQ ID NO: 6269377 - DNA, 19 bp, Homo sapiens
gctggagcccacagcgagc

SEQ ID NO: 6269378 - DNA, 22 bp, Homo sapiens
gctggagcccagggagcggaaa

SEQ ID NO: 6269379 - DNA, 13 bp, Homo sapiens
gctggagccccat

SEQ ID NO: 6269380 - DNA, 14 bp, Homo sapiens
gctggagccccgca

SEQ ID NO: 6269381 - DNA, 13 bp, Homo sapiens
gctggagccctgt

SEQ ID NO: 6269382 - DNA, 20 bp, Homo sapiens
gctggagccgcttccccagc

SEQ ID NO: 6269383 - DNA, 22 bp, Homo sapiens
gctggagccgcttccccagctc

SEQ ID NO: 6269384 - DNA, 21 bp, Homo sapiens
gctggagcctagaacaggcct

SEQ ID NO: 6269385 - DNA, 22 bp, Homo sapiens
gctggagcctgcggggcagcag

SEQ ID NO: 6269386 - DNA, 21 bp, Homo sapiens
gctggagcctgtgtaacagct

SEQ ID NO: 6269387 - DNA, 22 bp, Homo sapiens
gctggagcctgtgtaacagctc

SEQ ID NO: 6269388 - DNA, 21 bp, Homo sapiens
gctggagcgcagtccccagct

SEQ ID NO: 6269389 - DNA, 17 bp, Homo sapiens
gctggagctaaggccag

SEQ ID NO: 6269390 - DNA, 19 bp, Homo sapiens
gcatagggtcactttgcca

SEQ ID NO: 6269391 - DNA, 20 bp, Homo sapiens
gcatagggtttggaagaaag

SEQ ID NO: 6269392 - DNA, 21 bp, Homo sapiens
gcatagggtttggaagaaagg

SEQ ID NO: 6269393 - DNA, 18 bp, Homo sapiens
gcataggtaagctgtgcc

SEQ ID NO: 6269394 - DNA, 14 bp, Homo sapiens
gcataggtctggaa

SEQ ID NO: 6269395 - DNA, 17 bp, Homo sapiens
gcataggtttaataatt

SEQ ID NO: 6269396 - DNA, 17 bp, Homo sapiens
gcatagtaaatgtagtt

SEQ ID NO: 6269397 - DNA, 20 bp, Homo sapiens
gcatagtattccattgtgtg

SEQ ID NO: 6269398 - DNA, 22 bp, Homo sapiens
gcatagtccccagagctccccc

SEQ ID NO: 6269399 - DNA, 18 bp, Homo sapiens
gcatagttcccatgttaa

SEQ ID NO: 6269400 - DNA, 13 bp, Homo sapiens
gcatagtttcttt

SEQ ID NO: 6269401 - DNA, 15 bp, Homo sapiens
gcatagtttctttat

SEQ ID NO: 6269402 - DNA, 19 bp, Homo sapiens
gcatataaaggttatgaaa

SEQ ID NO: 6269403 - DNA, 20 bp, Homo sapiens
gcatataaaggttatgaaac

SEQ ID NO: 6269404 - DNA, 14 bp, Homo sapiens
gcatataaatgttt

SEQ ID NO: 6269405 - DNA, 15 bp, Homo sapiens
gcatataacttatat

SEQ ID NO: 6269406 - DNA, 16 bp, Homo sapiens
gcatataacttatatt

SEQ ID NO: 6269407 - DNA, 18 bp, Homo sapiens
gcatataaggctaaatgt

SEQ ID NO: 6269408 - DNA, 19 bp, Homo sapiens
gcatataaggctaaatgta

SEQ ID NO: 6269409 - DNA, 17 bp, Homo sapiens
gcatataatgaataaat

SEQ ID NO: 6269410 - DNA, 20 bp, Homo sapiens
gcatataattttcacttctg

SEQ ID NO: 6269411 - DNA, 13 bp, Homo sapiens
gcatatacaataa

SEQ ID NO: 6269412 - DNA, 16 bp, Homo sapiens
gcatatacaataatgt

SEQ ID NO: 6269413 - DNA, 15 bp, Homo sapiens
gcatatagaaaacaa

SEQ ID NO: 6269414 - DNA, 22 bp, Homo sapiens
gcatatagacacacatacataa

SEQ ID NO: 6269415 - DNA, 18 bp, Homo sapiens
gcatatagactatataat

SEQ ID NO: 6269416 - DNA, 17 bp, Homo sapiens
gcatataggtgatgttt

SEQ ID NO: 6269417 - DNA, 19 bp, Homo sapiens
gcatatatgtctctttgga

SEQ ID NO: 6269418 - DNA, 15 bp, Homo sapiens
gcatatatgttcttc

SEQ ID NO: 6269419 - DNA, 23 bp, Homo sapiens
gcatatattgggttccattctca

SEQ ID NO: 6269420 - DNA, 14 bp, Homo sapiens
gcatatcacttgat

SEQ ID NO: 6269421 - DNA, 18 bp, Homo sapiens
gcatatccaccacctccc

SEQ ID NO: 6269422 - DNA, 16 bp, Homo sapiens
gcatatcctgagccat

SEQ ID NO: 6269423 - DNA, 20 bp, Homo sapiens
gcatatcctggtgtctagtt

SEQ ID NO: 6269424 - DNA, 14 bp, Homo sapiens
gcatatccttttag

SEQ ID NO: 6269425 - DNA, 16 bp, Homo sapiens
gcatatcggaggtggt

SEQ ID NO: 6269426 - DNA, 23 bp, Homo sapiens
gcatatcggaggtggtggaggag

SEQ ID NO: 6269427 - DNA, 17 bp, Homo sapiens
gcatatctgcctcccct

SEQ ID NO: 6269428 - DNA, 21 bp, Homo sapiens
gcatatctggtatatgtcatt

SEQ ID NO: 6269429 - DNA, 20 bp, Homo sapiens
gcatatgaaaggagagcatc

SEQ ID NO: 6269430 - DNA, 15 bp, Homo sapiens
gcatatgacaaatgt

SEQ ID NO: 6269431 - DNA, 18 bp, Homo sapiens
gcatatgacaaatgtttc

SEQ ID NO: 6269432 - DNA, 18 bp, Homo sapiens
gcatatgaccctgtttac

SEQ ID NO: 6269433 - DNA, 23 bp, Homo sapiens
gcatatgagtaagggcactgacg

SEQ ID NO: 6269434 - DNA, 11 bp, Homo sapiens
gcatatgcagc

SEQ ID NO: 6269435 - DNA, 13 bp, Homo sapiens
gcatatgcatgcc

SEQ ID NO: 6269436 - DNA, 22 bp, Homo sapiens
gcatatgcttctttaaaaaagc

SEQ ID NO: 6269437 - DNA, 15 bp, Homo sapiens
gcatatgtgttggct

SEQ ID NO: 6269438 - DNA, 17 bp, Homo sapiens
gcatatgttacaattct

SEQ ID NO: 6269439 - DNA, 18 bp, Homo sapiens
gcatatgttccatgcctg

SEQ ID NO: 6269440 - DNA, 21 bp, Homo sapiens
gcatatgttgaatacttttta

SEQ ID NO: 6269441 - DNA, 22 bp, Homo sapiens
gcatatgtttccccatctctgt

SEQ ID NO: 6269442 - DNA, 12 bp, Homo sapiens
gcatatgtttct

SEQ ID NO: 6269443 - DNA, 19 bp, Homo sapiens
gcatattaaagataagact

SEQ ID NO: 6269444 - DNA, 23 bp, Homo sapiens
gcatattattttatgttgcatag

SEQ ID NO: 6269445 - DNA, 18 bp, Homo sapiens
gcatattcaacacactgc

SEQ ID NO: 6269446 - DNA, 21 bp, Homo sapiens
gcatattcaatgtattgagaa

SEQ ID NO: 6269447 - DNA, 20 bp, Homo sapiens
gcatattccctgcacacaca

SEQ ID NO: 6269448 - DNA, 20 bp, Homo sapiens
gcatattcctttctatcatt

SEQ ID NO: 6269449 - DNA, 22 bp, Homo sapiens
gcatattctagtaataaagact

SEQ ID NO: 6269450 - DNA, 23 bp, Homo sapiens
gcatattctagtaataaagactc

SEQ ID NO: 6269451 - DNA, 18 bp, Homo sapiens
gcatattctctattttac

SEQ ID NO: 6269452 - DNA, 17 bp, Homo sapiens
gcatattctgatgtttc

SEQ ID NO: 6269453 - DNA, 21 bp, Homo sapiens
gcatattgaaaagcacagagg

SEQ ID NO: 6269454 - DNA, 14 bp, Homo sapiens
gcatattgactttt

SEQ ID NO: 6269455 - DNA, 13 bp, Homo sapiens
gcatattgataat

SEQ ID NO: 6269456 - DNA, 18 bp, Homo sapiens
gcatattgataataaaat

SEQ ID NO: 6269457 - DNA, 22 bp, Homo sapiens
gcatattgcatactattaaaca

SEQ ID NO: 6269458 - DNA, 19 bp, Homo sapiens
gcatattgtacactttttt

SEQ ID NO: 6269459 - DNA, 21 bp, Homo sapiens
gcatattgtattactagaaga

SEQ ID NO: 6269460 - DNA, 19 bp, Homo sapiens
gcatattgttggcacagaa

SEQ ID NO: 6269461 - DNA, 14 bp, Homo sapiens
gcatatttagctgt

SEQ ID NO: 6269462 - DNA, 23 bp, Homo sapiens
gcatatttagctgttttggaacg

SEQ ID NO: 6269463 - DNA, 15 bp, Homo sapiens
gcatatttataagag

SEQ ID NO: 6269464 - DNA, 17 bp, Homo sapiens
gcatatttataagagaa

SEQ ID NO: 6269465 - DNA, 13 bp, Homo sapiens
gcatatttatatt

SEQ ID NO: 6269466 - DNA, 21 bp, Homo sapiens
gcatatttattgcattgctgg

SEQ ID NO: 6269467 - DNA, 15 bp, Homo sapiens
gcatatttctatgtt

SEQ ID NO: 6269468 - DNA, 15 bp, Homo sapiens
gcatatttctgtata

SEQ ID NO: 6269469 - DNA, 21 bp, Homo sapiens
gcatatttctgtatatttgtc

SEQ ID NO: 6269470 - DNA, 19 bp, Homo sapiens
gcatatttgcaaagtgtat

SEQ ID NO: 6269471 - DNA, 20 bp, Homo sapiens
gcatatttgtgccgtaatta

SEQ ID NO: 6269472 - DNA, 16 bp, Homo sapiens
gcatattttctccgaa

SEQ ID NO: 6269473 - DNA, 14 bp, Homo sapiens
gcatattttgtaac

SEQ ID NO: 6269474 - DNA, 15 bp, Homo sapiens
gcatatttttcacat

SEQ ID NO: 6269475 - DNA, 19 bp, Homo sapiens
gcatatttttcacatatct

SEQ ID NO: 6269476 - DNA, 20 bp, Homo sapiens
gcatatttttcacatatcta

SEQ ID NO: 6269477 - DNA, 18 bp, Homo sapiens
gcatatttttctaaagaa

SEQ ID NO: 6269478 - DNA, 14 bp, Homo sapiens
gcatatttttgcac

SEQ ID NO: 6269479 - DNA, 22 bp, Homo sapiens
gcatcaaaaacatcactccctc

SEQ ID NO: 6269480 - DNA, 18 bp, Homo sapiens
gcatcaaaagacaattct

SEQ ID NO: 6269481 - DNA, 21 bp, Homo sapiens
gcatcaaaagacaattcttta

SEQ ID NO: 6269482 - DNA, 12 bp, Homo sapiens
gcatcaaacatg

SEQ ID NO: 6269483 - DNA, 22 bp, Homo sapiens
gcatcaaacatgaaaacattga

SEQ ID NO: 6269484 - DNA, 19 bp, Homo sapiens
gcatcaaataatacatctt

SEQ ID NO: 6269485 - DNA, 18 bp, Homo sapiens
gcatcaaccaccatggat

SEQ ID NO: 6269486 - DNA, 14 bp, Homo sapiens
gcatcaaccaggaa

SEQ ID NO: 6269487 - DNA, 24 bp, Homo sapiens
gcatcaaccaggaagagttctatc

SEQ ID NO: 6269488 - DNA, 15 bp, Homo sapiens
gcatcaaccccccga

SEQ ID NO: 6269489 - DNA, 22 bp, Homo sapiens
gcatcaaccccccgactgtgct

SEQ ID NO: 6269490 - DNA, 17 bp, Homo sapiens
gcatcaagaactattgt

SEQ ID NO: 6269491 - DNA, 13 bp, Homo sapiens
gcatcaagaatta

SEQ ID NO: 6269492 - DNA, 13 bp, Homo sapiens
gcatcaagacttc

SEQ ID NO: 6269493 - DNA, 15 bp, Homo sapiens
gcatcaagggagaca

SEQ ID NO: 6269494 - DNA, 16 bp, Homo sapiens
gcatcaagggctttat

SEQ ID NO: 6269495 - DNA, 21 bp, Homo sapiens
gcatcaaggtcagcatgagga

SEQ ID NO: 6269496 - DNA, 13 bp, Homo sapiens
gcatcaatcctgt

SEQ ID NO: 6269497 - DNA, 14 bp, Homo sapiens
gcatcaatcttgtt

SEQ ID NO: 6269498 - DNA, 16 bp, Homo sapiens
gcatcacactcaagga

SEQ ID NO: 6269499 - DNA, 22 bp, Homo sapiens
gcatcacactcaaggacaggag

SEQ ID NO: 6269500 - DNA, 14 bp, Homo sapiens
gcatcacagggcag

SEQ ID NO: 6269501 - DNA, 15 bp, Homo sapiens
gcatcacagggcaga

SEQ ID NO: 6269502 - DNA, 14 bp, Homo sapiens
gcatcacagttcac

SEQ ID NO: 6269503 - DNA, 14 bp, Homo sapiens
gcatcacatctgca

SEQ ID NO: 6269504 - DNA, 17 bp, Homo sapiens
gcatcacatctgcacac

SEQ ID NO: 6269505 - DNA, 18 bp, Homo sapiens
gcatcacattgtcaccag

SEQ ID NO: 6269506 - DNA, 16 bp, Homo sapiens
gcatcaccaccacacc

SEQ ID NO: 6269507 - DNA, 17 bp, Homo sapiens
gcatcaccaccacaccc

SEQ ID NO: 6269508 - DNA, 16 bp, Homo sapiens
gcatcacctcaccaag

SEQ ID NO: 6269509 - DNA, 14 bp, Homo sapiens
gcatcacctcaggc

SEQ ID NO: 6269510 - DNA, 17 bp, Homo sapiens
gcatcacctcaggccag

SEQ ID NO: 6269511 - DNA, 15 bp, Homo sapiens
gcatcacctctgtaa

SEQ ID NO: 6269512 - DNA, 15 bp, Homo sapiens
gcatcacctgcctgt

SEQ ID NO: 6269513 - DNA, 18 bp, Homo sapiens
gcatcaccttaggcaggg

SEQ ID NO: 6269514 - DNA, 16 bp, Homo sapiens
gcatcacgctacccag

SEQ ID NO: 6269515 - DNA, 21 bp, Homo sapiens
gcatcactccccaaggaagag

SEQ ID NO: 6269516 - DNA, 22 bp, Homo sapiens
gcatcactgattccctctccca

SEQ ID NO: 6269517 - DNA, 18 bp, Homo sapiens
gcatcactgggtgttgat

SEQ ID NO: 6269518 - DNA, 23 bp, Homo sapiens
gcatcactttcctggatccagga

SEQ ID NO: 6269519 - DNA, 19 bp, Homo sapiens
gcatcagaaagggagggct

SEQ ID NO: 6269520 - DNA, 22 bp, Homo sapiens
gcatcagaaagggagggctctg

SEQ ID NO: 6269521 - DNA, 23 bp, Homo sapiens
gcatcagaaagggagggctctga

SEQ ID NO: 6269522 - DNA, 11 bp, Homo sapiens
gcatcagaaat

SEQ ID NO: 6269523 - DNA, 20 bp, Homo sapiens
gcatcagaaatcctctgtta

SEQ ID NO: 6269524 - DNA, 12 bp, Homo sapiens
gcatcagaaatg

SEQ ID NO: 6269525 - DNA, 21 bp, Homo sapiens
gcatcagaaggttcacccagc

SEQ ID NO: 6269526 - DNA, 14 bp, Homo sapiens
gcatcagcaagaca

SEQ ID NO: 6269527 - DNA, 18 bp, Homo sapiens
gcatcagcctctggccag

SEQ ID NO: 6269528 - DNA, 11 bp, Homo sapiens
gcatcagcctg

SEQ ID NO: 6269529 - DNA, 17 bp, Homo sapiens
gcatcagctggcgtcat

SEQ ID NO: 6269530 - DNA, 17 bp, Homo sapiens
gcatcagctttccctgg

SEQ ID NO: 6269531 - DNA, 19 bp, Homo sapiens
gcatcagctttccctggct

SEQ ID NO: 6269532 - DNA, 23 bp, Homo sapiens
gcatcaggatactcaaagtggaa

SEQ ID NO: 6269533 - DNA, 12 bp, Homo sapiens
gcatcaggccag

SEQ ID NO: 6269534 - DNA, 23 bp, Homo sapiens
gcatcaggccaggccctctgccc

SEQ ID NO: 6269535 - DNA, 19 bp, Homo sapiens
gcatcaggctaagaccctg

SEQ ID NO: 6269536 - DNA, 21 bp, Homo sapiens
gcatcagggcctttctcctcc

SEQ ID NO: 6269537 - DNA, 22 bp, Homo sapiens
gcatcagggcctttctcctccc

SEQ ID NO: 6269538 - DNA, 13 bp, Homo sapiens
gcatcagggggaa

SEQ ID NO: 6269539 - DNA, 12 bp, Homo sapiens
gcatcagggtta

SEQ ID NO: 6269540 - DNA, 17 bp, Homo sapiens
gcatcaggtctgggcaa

SEQ ID NO: 6269541 - DNA, 19 bp, Homo sapiens
gcatcaggtctgggcaagt

SEQ ID NO: 6269542 - DNA, 18 bp, Homo sapiens
gcatcagtatgtcactct

SEQ ID NO: 6269543 - DNA, 15 bp, Homo sapiens
gcatcagtccccctg

SEQ ID NO: 6269544 - DNA, 19 bp, Homo sapiens
gcatcagtccccctgtgca

SEQ ID NO: 6269545 - DNA, 17 bp, Homo sapiens
gcatcagtttaggcctt

SEQ ID NO: 6269546 - DNA, 18 bp, Homo sapiens
gcatcagtttaggccttg

SEQ ID NO: 6269547 - DNA, 20 bp, Homo sapiens
gcatcagtttaggccttggc

SEQ ID NO: 6269548 - DNA, 23 bp, Homo sapiens
gcatcagtttaggccttggcttg

SEQ ID NO: 6269549 - DNA, 22 bp, Homo sapiens
gcatcatcatcacaacctaaat

SEQ ID NO: 6269550 - DNA, 21 bp, Homo sapiens
gcatcatccattctctctgcc

SEQ ID NO: 6269551 - DNA, 20 bp, Homo sapiens
gcatcatgcctctgaggcca

SEQ ID NO: 6269552 - DNA, 21 bp, Homo sapiens
gcatcatgcctctgaggccag

SEQ ID NO: 6269553 - DNA, 21 bp, Homo sapiens
gcatcatggaaagactgggac

SEQ ID NO: 6269554 - DNA, 22 bp, Homo sapiens
gcatcatgggagtaagttcttc

SEQ ID NO: 6269555 - DNA, 14 bp, Homo sapiens
gcatcatggtggat

SEQ ID NO: 6269556 - DNA, 22 bp, Homo sapiens
gcatcattcagcaaatgccttt

SEQ ID NO: 6269557 - DNA, 17 bp, Homo sapiens
gcatcattccaggcccg

SEQ ID NO: 6269558 - DNA, 16 bp, Homo sapiens
gcatcattctctaata

SEQ ID NO: 6269559 - DNA, 13 bp, Homo sapiens
gcatcatttaaac

SEQ ID NO: 6269560 - DNA, 20 bp, Homo sapiens
gcatcattttaacaggtgcc

SEQ ID NO: 6269561 - DNA, 16 bp, Homo sapiens
gcatccaaaagcagga

SEQ ID NO: 6269562 - DNA, 22 bp, Homo sapiens
gcatccaaaggctcctgagaca

SEQ ID NO: 6269563 - DNA, 16 bp, Homo sapiens
gcatccacaggattcc

SEQ ID NO: 6269564 - DNA, 20 bp, Homo sapiens
gcatccacccagtgctgcca

SEQ ID NO: 6269565 - DNA, 22 bp, Homo sapiens
gcatccacccagtgctgccatg

SEQ ID NO: 6269566 - DNA, 24 bp, Homo sapiens
gcatccacccagtgctgccatgcc

SEQ ID NO: 6269567 - DNA, 13 bp, Homo sapiens
gctggagctcctc

SEQ ID NO: 6269568 - DNA, 13 bp, Homo sapiens
gctggagctcttg

SEQ ID NO: 6269569 - DNA, 15 bp, Homo sapiens
gctggagctcttgga

SEQ ID NO: 6269570 - DNA, 13 bp, Homo sapiens
gctggagctggct

SEQ ID NO: 6269571 - DNA, 12 bp, Homo sapiens
gctggaggaaca

SEQ ID NO: 6269572 - DNA, 13 bp, Homo sapiens
gctggaggaagga

SEQ ID NO: 6269573 - DNA, 19 bp, Homo sapiens
gctggaggagcagcagctt

SEQ ID NO: 6269574 - DNA, 14 bp, Homo sapiens
gctggaggagccca

SEQ ID NO: 6269575 - DNA, 15 bp, Homo sapiens
gctggaggagcccag

SEQ ID NO: 6269576 - DNA, 17 bp, Homo sapiens
gctggaggagcccaggc

SEQ ID NO: 6269577 - DNA, 20 bp, Homo sapiens
gctggaggagcccaggccag

SEQ ID NO: 6269578 - DNA, 21 bp, Homo sapiens
gctggaggagcccaggccagg

SEQ ID NO: 6269579 - DNA, 16 bp, Homo sapiens
gctggaggagctggcc

SEQ ID NO: 6269580 - DNA, 19 bp, Homo sapiens
gctggaggatgtgggcagc

SEQ ID NO: 6269581 - DNA, 13 bp, Homo sapiens
gctggaggcaggg

SEQ ID NO: 6269582 - DNA, 12 bp, Homo sapiens
gctggaggccca

SEQ ID NO: 6269583 - DNA, 14 bp, Homo sapiens
gctggaggcccagg

SEQ ID NO: 6269584 - DNA, 12 bp, Homo sapiens
gctggagggagg

SEQ ID NO: 6269585 - DNA, 14 bp, Homo sapiens
gctggagggctggg

SEQ ID NO: 6269586 - DNA, 20 bp, Homo sapiens
gctggaggggctgtcctcct

SEQ ID NO: 6269587 - DNA, 22 bp, Homo sapiens
gctggaggggctgtcctccttc

SEQ ID NO: 6269588 - DNA, 23 bp, Homo sapiens
gctggaggggctgtcctccttcc

SEQ ID NO: 6269589 - DNA, 22 bp, Homo sapiens
gctggagggggcagagtggcct

SEQ ID NO: 6269590 - DNA, 22 bp, Homo sapiens
gctggaggggtggcccagagcc

SEQ ID NO: 6269591 - DNA, 16 bp, Homo sapiens
gctggaggggtgggga

SEQ ID NO: 6269592 - DNA, 20 bp, Homo sapiens
gctggaggggtggggagcta

SEQ ID NO: 6269593 - DNA, 22 bp, Homo sapiens
gctggagggtgctaggcccctg

SEQ ID NO: 6269594 - DNA, 16 bp, Homo sapiens
gctggaggtagagagg

SEQ ID NO: 6269595 - DNA, 16 bp, Homo sapiens
gctggaggtgggagca

SEQ ID NO: 6269596 - DNA, 22 bp, Homo sapiens
gctggaggtgggagcaggagat

SEQ ID NO: 6269597 - DNA, 22 bp, Homo sapiens
gctggaggtggggcgaggcagg

SEQ ID NO: 6269598 - DNA, 15 bp, Homo sapiens
gctggagtacccagc

SEQ ID NO: 6269599 - DNA, 14 bp, Homo sapiens
gctggagtcctctc

SEQ ID NO: 6269600 - DNA, 15 bp, Homo sapiens
gctggagtcctctcc

SEQ ID NO: 6269601 - DNA, 18 bp, Homo sapiens
gctggagtctcagagcac

SEQ ID NO: 6269602 - DNA, 16 bp, Homo sapiens
gctggagtctggcttt

SEQ ID NO: 6269603 - DNA, 17 bp, Homo sapiens
gctggagtctgggctcc

SEQ ID NO: 6269604 - DNA, 12 bp, Homo sapiens
gctggagtgagg

SEQ ID NO: 6269605 - DNA, 18 bp, Homo sapiens
gctggagtgagggcctca

SEQ ID NO: 6269606 - DNA, 12 bp, Homo sapiens
gctggagtgcag

SEQ ID NO: 6269607 - DNA, 19 bp, Homo sapiens
gctggagtgcagtggcgaa

SEQ ID NO: 6269608 - DNA, 19 bp, Homo sapiens
gctggagtgcagtggtgca

SEQ ID NO: 6269609 - DNA, 20 bp, Homo sapiens
gctggagtgcagtggtgcca

SEQ ID NO: 6269610 - DNA, 20 bp, Homo sapiens
gctggagtgcagtggtgtga

SEQ ID NO: 6269611 - DNA, 17 bp, Homo sapiens
gctggagtgccatggct

SEQ ID NO: 6269612 - DNA, 19 bp, Homo sapiens
gctggagtgccatggctgg

SEQ ID NO: 6269613 - DNA, 20 bp, Homo sapiens
gctggagtgcggtggtgtga

SEQ ID NO: 6269614 - DNA, 17 bp, Homo sapiens
gctggagtgctgcttgt

SEQ ID NO: 6269615 - DNA, 19 bp, Homo sapiens
gctggagtgctgcttgtgc

SEQ ID NO: 6269616 - DNA, 18 bp, Homo sapiens
gctggagtgggctctctg

SEQ ID NO: 6269617 - DNA, 20 bp, Homo sapiens
gctggagtgtagtggcgcga

SEQ ID NO: 6269618 - DNA, 22 bp, Homo sapiens
gctggagttattgaagcagagt

SEQ ID NO: 6269619 - DNA, 18 bp, Homo sapiens
gctggagttcagcagtga

SEQ ID NO: 6269620 - DNA, 17 bp, Homo sapiens
gctggagttggggcaga

SEQ ID NO: 6269621 - DNA, 21 bp, Homo sapiens
gctggagttttgttggtgtga

SEQ ID NO: 6269622 - DNA, 14 bp, Homo sapiens
gctggataaaatga

SEQ ID NO: 6269623 - DNA, 15 bp, Homo sapiens
gctggataaaatgag

SEQ ID NO: 6269624 - DNA, 18 bp, Homo sapiens
gctggatataatgtattt

SEQ ID NO: 6269625 - DNA, 16 bp, Homo sapiens
gctggatattttacta

SEQ ID NO: 6269626 - DNA, 19 bp, Homo sapiens
gctggatcacagctgcttt

SEQ ID NO: 6269627 - DNA, 20 bp, Homo sapiens
gctggatctgtagtgatgga

SEQ ID NO: 6269628 - DNA, 19 bp, Homo sapiens
gctggatgaccccatgctc

SEQ ID NO: 6269629 - DNA, 20 bp, Homo sapiens
gctggatgagaatttgagtg

SEQ ID NO: 6269630 - DNA, 21 bp, Homo sapiens
gctggatgagcaactcctgtt

SEQ ID NO: 6269631 - DNA, 23 bp, Homo sapiens
gctggatgagctcccacaagcct

SEQ ID NO: 6269632 - DNA, 13 bp, Homo sapiens
gctggatgctggg

SEQ ID NO: 6269633 - DNA, 16 bp, Homo sapiens
gctggatggacagaca

SEQ ID NO: 6269634 - DNA, 18 bp, Homo sapiens
gctggatggacagacacc

SEQ ID NO: 6269635 - DNA, 20 bp, Homo sapiens
gctggatggacagacacctc

SEQ ID NO: 6269636 - DNA, 20 bp, Homo sapiens
gctggatggcacctcaggct

SEQ ID NO: 6269637 - DNA, 16 bp, Homo sapiens
gctggatgtgctttca

SEQ ID NO: 6269638 - DNA, 15 bp, Homo sapiens
gctggattggcaggt

SEQ ID NO: 6269639 - DNA, 22 bp, Homo sapiens
gctggattgggttatgaatatt

SEQ ID NO: 6269640 - DNA, 15 bp, Homo sapiens
gctggattgtccttg

SEQ ID NO: 6269641 - DNA, 22 bp, Homo sapiens
gctggcaaaccctcccagaaac

SEQ ID NO: 6269642 - DNA, 19 bp, Homo sapiens
gctggcaaagacagaagcc

SEQ ID NO: 6269643 - DNA, 14 bp, Homo sapiens
gctggcaacacaga

SEQ ID NO: 6269644 - DNA, 21 bp, Homo sapiens
gctggcaacacagaggcagcc

SEQ ID NO: 6269645 - DNA, 15 bp, Homo sapiens
gctggcaaccagcca

SEQ ID NO: 6269646 - DNA, 17 bp, Homo sapiens
gctggcaaccagccagc

SEQ ID NO: 6269647 - DNA, 18 bp, Homo sapiens
gctggcaagaaccagttg

SEQ ID NO: 6269648 - DNA, 16 bp, Homo sapiens
gctggcaagcagggaa

SEQ ID NO: 6269649 - DNA, 15 bp, Homo sapiens
gctggcacagcccct

SEQ ID NO: 6269650 - DNA, 18 bp, Homo sapiens
gctggcacagcccctgga

SEQ ID NO: 6269651 - DNA, 19 bp, Homo sapiens
gctggcacagcccctggag

SEQ ID NO: 6269652 - DNA, 16 bp, Homo sapiens
gctggcacccactgga

SEQ ID NO: 6269653 - DNA, 17 bp, Homo sapiens
gctggcaccgccttctc

SEQ ID NO: 6269654 - DNA, 18 bp, Homo sapiens
gctggcaccgccttctct

SEQ ID NO: 6269655 - DNA, 20 bp, Homo sapiens
gctggcacgtgacaggctcg

SEQ ID NO: 6269656 - DNA, 19 bp, Homo sapiens
gctggcacttttttaaata

SEQ ID NO: 6269657 - DNA, 21 bp, Homo sapiens
gctggcagaacggaggaggct

SEQ ID NO: 6269658 - DNA, 17 bp, Homo sapiens
gctggcagagagcacag

SEQ ID NO: 6269659 - DNA, 18 bp, Homo sapiens
gctggcagagagcacagt

SEQ ID NO: 6269660 - DNA, 16 bp, Homo sapiens
gctggcagaggggaca

SEQ ID NO: 6269661 - DNA, 17 bp, Homo sapiens
gctggcagcctccagtg

SEQ ID NO: 6269662 - DNA, 15 bp, Homo sapiens
gctggcagctctcca

SEQ ID NO: 6269663 - DNA, 18 bp, Homo sapiens
gctggcaggagacactgg

SEQ ID NO: 6269664 - DNA, 20 bp, Homo sapiens
gctggcaggagggtggcact

SEQ ID NO: 6269665 - DNA, 16 bp, Homo sapiens
gctggcagggccaggg

SEQ ID NO: 6269666 - DNA, 18 bp, Homo sapiens
gctggcagggccagggca

SEQ ID NO: 6269667 - DNA, 23 bp, Homo sapiens
gctggcagggccagggcaatgcc

SEQ ID NO: 6269668 - DNA, 19 bp, Homo sapiens
gctggcagggtccctccag

SEQ ID NO: 6269669 - DNA, 21 bp, Homo sapiens
gctggcagtgtgcggagctga

SEQ ID NO: 6269670 - DNA, 21 bp, Homo sapiens
gctggcatcaagggagacacc

SEQ ID NO: 6269671 - DNA, 16 bp, Homo sapiens
gctggcatcctggctg

SEQ ID NO: 6269672 - DNA, 14 bp, Homo sapiens
gctggcatgcagtg

SEQ ID NO: 6269673 - DNA, 14 bp, Homo sapiens
gctggcatggggag

SEQ ID NO: 6269674 - DNA, 22 bp, Homo sapiens
gctggcatggggaggggagaga

SEQ ID NO: 6269675 - DNA, 18 bp, Homo sapiens
gctggcatggtggctccc

SEQ ID NO: 6269676 - DNA, 12 bp, Homo sapiens
gctggcatgtct

SEQ ID NO: 6269677 - DNA, 14 bp, Homo sapiens
gctggcatgtctgg

SEQ ID NO: 6269678 - DNA, 22 bp, Homo sapiens
gctggcattaccctctgcagaa

SEQ ID NO: 6269679 - DNA, 13 bp, Homo sapiens
gctggccaaagtc

SEQ ID NO: 6269680 - DNA, 16 bp, Homo sapiens
gctggccaaagtcact

SEQ ID NO: 6269681 - DNA, 13 bp, Homo sapiens
gctggccaaggag

SEQ ID NO: 6269682 - DNA, 18 bp, Homo sapiens
gctggccacacagcagcg

SEQ ID NO: 6269683 - DNA, 13 bp, Homo sapiens
gctggccacagaa

SEQ ID NO: 6269684 - DNA, 19 bp, Homo sapiens
gctggccactgcacagagc

SEQ ID NO: 6269685 - DNA, 21 bp, Homo sapiens
gctggccagcaccctctcctg

SEQ ID NO: 6269686 - DNA, 18 bp, Homo sapiens
gctggccagccccacagc

SEQ ID NO: 6269687 - DNA, 12 bp, Homo sapiens
gctggccagcct

SEQ ID NO: 6269688 - DNA, 13 bp, Homo sapiens
gctggccagctgt

SEQ ID NO: 6269689 - DNA, 12 bp, Homo sapiens
gctggccaggac

SEQ ID NO: 6269690 - DNA, 12 bp, Homo sapiens
gctggccagtct

SEQ ID NO: 6269691 - DNA, 18 bp, Homo sapiens
gctggccatggagaaagc

SEQ ID NO: 6269692 - DNA, 16 bp, Homo sapiens
gctggccatggggccc

SEQ ID NO: 6269693 - DNA, 15 bp, Homo sapiens
gctggcccacagctc

SEQ ID NO: 6269694 - DNA, 23 bp, Homo sapiens
gctggcccacccagtccatgctc

SEQ ID NO: 6269695 - DNA, 12 bp, Homo sapiens
gctggcccagcc

SEQ ID NO: 6269696 - DNA, 14 bp, Homo sapiens
gctggcccagccct

SEQ ID NO: 6269697 - DNA, 16 bp, Homo sapiens
gctggcccagccctgc

SEQ ID NO: 6269698 - DNA, 17 bp, Homo sapiens
gctggcccagccctgct

SEQ ID NO: 6269699 - DNA, 15 bp, Homo sapiens
gctggcccagggccc

SEQ ID NO: 6269700 - DNA, 13 bp, Homo sapiens
gctggcccagggg

SEQ ID NO: 6269701 - DNA, 20 bp, Homo sapiens
gctggcccagggggcctgga

SEQ ID NO: 6269702 - DNA, 22 bp, Homo sapiens
gctggcccaggggtcccctggc

SEQ ID NO: 6269703 - DNA, 18 bp, Homo sapiens
gctggccccagccctgct

SEQ ID NO: 6269704 - DNA, 18 bp, Homo sapiens
gctggccccagggcaccc

SEQ ID NO: 6269705 - DNA, 11 bp, Homo sapiens
gctggccccat

SEQ ID NO: 6269706 - DNA, 21 bp, Homo sapiens
gctggccccatcctggcccag

SEQ ID NO: 6269707 - DNA, 14 bp, Homo sapiens
gctggcccccactg

SEQ ID NO: 6269708 - DNA, 17 bp, Homo sapiens
gctggcccccactggct

SEQ ID NO: 6269709 - DNA, 19 bp, Homo sapiens
gctggcccccactggctgt

SEQ ID NO: 6269710 - DNA, 24 bp, Homo sapiens
gctggcccccactggctgtgggct

SEQ ID NO: 6269711 - DNA, 21 bp, Homo sapiens
gctggcccccccagccccaca

SEQ ID NO: 6269712 - DNA, 13 bp, Homo sapiens
gctggccccgccg

SEQ ID NO: 6269713 - DNA, 23 bp, Homo sapiens
gctggccccgccgcctggtactc

SEQ ID NO: 6269714 - DNA, 21 bp, Homo sapiens
gctggcccctttgggccctgc

SEQ ID NO: 6269715 - DNA, 23 bp, Homo sapiens
gctggcccctttgggccctgcat

SEQ ID NO: 6269716 - DNA, 18 bp, Homo sapiens
gctggccctaggcactga

SEQ ID NO: 6269717 - DNA, 14 bp, Homo sapiens
gctggccctcagct

SEQ ID NO: 6269718 - DNA, 14 bp, Homo sapiens
gctggccctgccct

SEQ ID NO: 6269719 - DNA, 19 bp, Homo sapiens
gctggccctgccctccccc

SEQ ID NO: 6269720 - DNA, 15 bp, Homo sapiens
gctggccctgccctg

SEQ ID NO: 6269721 - DNA, 19 bp, Homo sapiens
gctggccctgcctcctggg

SEQ ID NO: 6269722 - DNA, 19 bp, Homo sapiens
gctggccctggctcccaca

SEQ ID NO: 6269723 - DNA, 14 bp, Homo sapiens
gctggccctgtgca

SEQ ID NO: 6269724 - DNA, 16 bp, Homo sapiens
gctggccctgtgcaga

SEQ ID NO: 6269725 - DNA, 18 bp, Homo sapiens
gctggcccttagagaccc

SEQ ID NO: 6269726 - DNA, 21 bp, Homo sapiens
gctggccgacccactgaccca

SEQ ID NO: 6269727 - DNA, 16 bp, Homo sapiens
gctggccgcctgcagc

SEQ ID NO: 6269728 - DNA, 19 bp, Homo sapiens
gctggccgcctgcagcccg

SEQ ID NO: 6269729 - DNA, 17 bp, Homo sapiens
gctggccgggactgctg

SEQ ID NO: 6269730 - DNA, 18 bp, Homo sapiens
gctggccgggactgctgc

SEQ ID NO: 6269731 - DNA, 18 bp, Homo sapiens
gctggccgggcacagctg

SEQ ID NO: 6269732 - DNA, 21 bp, Homo sapiens
gctggccgggcacagctgtgg

SEQ ID NO: 6269733 - DNA, 20 bp, Homo sapiens
gctggccgggttggaggcct

SEQ ID NO: 6269734 - DNA, 20 bp, Homo sapiens
gctggccggtccaccccgtc

SEQ ID NO: 6269735 - DNA, 20 bp, Homo sapiens
gctggcctaatcactctgag

SEQ ID NO: 6269736 - DNA, 23 bp, Homo sapiens
gctggcctcaaacagccacgagg

SEQ ID NO: 6269737 - DNA, 22 bp, Homo sapiens
gctggcctcccaaatgagccat

SEQ ID NO: 6269738 - DNA, 14 bp, Homo sapiens
gctggcctccccca

SEQ ID NO: 6269739 - DNA, 22 bp, Homo sapiens
gctggcctctagaacacccact

SEQ ID NO: 6269740 - DNA, 23 bp, Homo sapiens
gctggcctctagaacacccactg

SEQ ID NO: 6269741 - DNA, 12 bp, Homo sapiens
gctggcctctgc

SEQ ID NO: 6269742 - DNA, 15 bp, Homo sapiens
gctggcctctgcgag

SEQ ID NO: 6269743 - DNA, 13 bp, Homo sapiens
gctggcctcttcc

SEQ ID NO: 6269744 - DNA, 14 bp, Homo sapiens
gctggcctcttcct

SEQ ID NO: 6269745 - DNA, 13 bp, Homo sapiens
gctggcctcttgg

SEQ ID NO: 6269746 - DNA, 13 bp, Homo sapiens
gcatccaccgcca

SEQ ID NO: 6269747 - DNA, 18 bp, Homo sapiens
gcatccaccgccacccca

SEQ ID NO: 6269748 - DNA, 16 bp, Homo sapiens
gcatccacctccttct

SEQ ID NO: 6269749 - DNA, 20 bp, Homo sapiens
gcatccaccttcctgcccag

SEQ ID NO: 6269750 - DNA, 18 bp, Homo sapiens
gcatccacgcacacatgg

SEQ ID NO: 6269751 - DNA, 23 bp, Homo sapiens
gcatccactaatattcagtcctg

SEQ ID NO: 6269752 - DNA, 13 bp, Homo sapiens
gcatccactagct

SEQ ID NO: 6269753 - DNA, 18 bp, Homo sapiens
gcatccacttcaggagcc

SEQ ID NO: 6269754 - DNA, 21 bp, Homo sapiens
gcatccacttcaggagcccta

SEQ ID NO: 6269755 - DNA, 22 bp, Homo sapiens
gcatccagagtccctgcctgga

SEQ ID NO: 6269756 - DNA, 18 bp, Homo sapiens
gcatccagcagtctctgc

SEQ ID NO: 6269757 - DNA, 19 bp, Homo sapiens
gcatccagcagtctctgcc

SEQ ID NO: 6269758 - DNA, 14 bp, Homo sapiens
gcatccagccgtgc

SEQ ID NO: 6269759 - DNA, 13 bp, Homo sapiens
gcatccagcctgt

SEQ ID NO: 6269760 - DNA, 18 bp, Homo sapiens
gcatccaggcctgaggct

SEQ ID NO: 6269761 - DNA, 12 bp, Homo sapiens
gcatccaggctg

SEQ ID NO: 6269762 - DNA, 18 bp, Homo sapiens
gcatccagggctgccagg

SEQ ID NO: 6269763 - DNA, 14 bp, Homo sapiens
gcatccagtatctt

SEQ ID NO: 6269764 - DNA, 16 bp, Homo sapiens
gcatccagtgtgagat

SEQ ID NO: 6269765 - DNA, 20 bp, Homo sapiens
gcatccagtgtgagatactg

SEQ ID NO: 6269766 - DNA, 19 bp, Homo sapiens
gcatccataccagctcgca

SEQ ID NO: 6269767 - DNA, 21 bp, Homo sapiens
gcatccatgcggccggcctgg

SEQ ID NO: 6269768 - DNA, 22 bp, Homo sapiens
gcatccatggggtctctcacag

SEQ ID NO: 6269769 - DNA, 17 bp, Homo sapiens
gcatccattctcctgag

SEQ ID NO: 6269770 - DNA, 13 bp, Homo sapiens
gcatcccacagga

SEQ ID NO: 6269771 - DNA, 19 bp, Homo sapiens
gcatcccacgatcggcctt

SEQ ID NO: 6269772 - DNA, 18 bp, Homo sapiens
gcatcccacgttctgtta

SEQ ID NO: 6269773 - DNA, 23 bp, Homo sapiens
gcatcccagcctcagaagccttc

SEQ ID NO: 6269774 - DNA, 13 bp, Homo sapiens
gcatcccagcctg

SEQ ID NO: 6269775 - DNA, 14 bp, Homo sapiens
gcatcccagcctgg

SEQ ID NO: 6269776 - DNA, 12 bp, Homo sapiens
gcatcccagctt

SEQ ID NO: 6269777 - DNA, 15 bp, Homo sapiens
gcatcccagcttgcc

SEQ ID NO: 6269778 - DNA, 16 bp, Homo sapiens
gcatcccagcttgccc

SEQ ID NO: 6269779 - DNA, 21 bp, Homo sapiens
gcatcccaggggaccacacct

SEQ ID NO: 6269780 - DNA, 14 bp, Homo sapiens
gcatcccagtggcc

SEQ ID NO: 6269781 - DNA, 13 bp, Homo sapiens
gcatcccatccct

SEQ ID NO: 6269782 - DNA, 14 bp, Homo sapiens
gcatcccatctctc

SEQ ID NO: 6269783 - DNA, 21 bp, Homo sapiens
gcatcccatgggggtgctgca

SEQ ID NO: 6269784 - DNA, 16 bp, Homo sapiens
gcatcccattgctagc

SEQ ID NO: 6269785 - DNA, 12 bp, Homo sapiens
gcatccccagcc

SEQ ID NO: 6269786 - DNA, 14 bp, Homo sapiens
gcatccccagcccc

SEQ ID NO: 6269787 - DNA, 19 bp, Homo sapiens
gcatcccccagcactgatg

SEQ ID NO: 6269788 - DNA, 15 bp, Homo sapiens
gcatcccccctgctc

SEQ ID NO: 6269789 - DNA, 16 bp, Homo sapiens
gcatcccccctgctca

SEQ ID NO: 6269790 - DNA, 18 bp, Homo sapiens
gcatcccccctgctcagc

SEQ ID NO: 6269791 - DNA, 20 bp, Homo sapiens
gcatccccctcctctccctg

SEQ ID NO: 6269792 - DNA, 16 bp, Homo sapiens
gcatcccccttagaat

SEQ ID NO: 6269793 - DNA, 14 bp, Homo sapiens
gcatcccctgcctc

SEQ ID NO: 6269794 - DNA, 16 bp, Homo sapiens
gcatcccctgcctcca

SEQ ID NO: 6269795 - DNA, 17 bp, Homo sapiens
gcatcccctgcctccat

SEQ ID NO: 6269796 - DNA, 12 bp, Homo sapiens
gcatccccttcc

SEQ ID NO: 6269797 - DNA, 15 bp, Homo sapiens
gcatccccttccagc

SEQ ID NO: 6269798 - DNA, 21 bp, Homo sapiens
gcatccccttccagctccctc

SEQ ID NO: 6269799 - DNA, 23 bp, Homo sapiens
gcatccccttccagctccctccc

SEQ ID NO: 6269800 - DNA, 20 bp, Homo sapiens
gcatccccttggctgtgagg

SEQ ID NO: 6269801 - DNA, 16 bp, Homo sapiens
gcatcccggaggaaat

SEQ ID NO: 6269802 - DNA, 19 bp, Homo sapiens
gcatcccggaggaaatctg

SEQ ID NO: 6269803 - DNA, 22 bp, Homo sapiens
gcatcccggctgaccctgtgcc

SEQ ID NO: 6269804 - DNA, 17 bp, Homo sapiens
gcatccctaattcttca

SEQ ID NO: 6269805 - DNA, 21 bp, Homo sapiens
gcatccctcacccatcctaga

SEQ ID NO: 6269806 - DNA, 14 bp, Homo sapiens
gcatccctccaccc

SEQ ID NO: 6269807 - DNA, 21 bp, Homo sapiens
gcatccctccaccccagtccc

SEQ ID NO: 6269808 - DNA, 13 bp, Homo sapiens
gcatccctgcttc

SEQ ID NO: 6269809 - DNA, 19 bp, Homo sapiens
gcatccctgcttctggcgc

SEQ ID NO: 6269810 - DNA, 13 bp, Homo sapiens
gcatccctggagc

SEQ ID NO: 6269811 - DNA, 21 bp, Homo sapiens
gcatccctgtgtccactgaga

SEQ ID NO: 6269812 - DNA, 21 bp, Homo sapiens
gcatcccttcgcctgcagcct

SEQ ID NO: 6269813 - DNA, 22 bp, Homo sapiens
gcatccctttttcataaattat

SEQ ID NO: 6269814 - DNA, 14 bp, Homo sapiens
gcatccgagcccct

SEQ ID NO: 6269815 - DNA, 15 bp, Homo sapiens
gcatccgagcccctg

SEQ ID NO: 6269816 - DNA, 16 bp, Homo sapiens
gcatccgagcccctgt

SEQ ID NO: 6269817 - DNA, 15 bp, Homo sapiens
gcatccgcagcccag

SEQ ID NO: 6269818 - DNA, 20 bp, Homo sapiens
gcatccgcaggtgctggtcc

SEQ ID NO: 6269819 - DNA, 13 bp, Homo sapiens
gcatccgcctctg

SEQ ID NO: 6269820 - DNA, 21 bp, Homo sapiens
gcatccgcctctgagccagga

SEQ ID NO: 6269821 - DNA, 19 bp, Homo sapiens
gcatcctaaagataaagcc

SEQ ID NO: 6269822 - DNA, 15 bp, Homo sapiens
gcatcctaagaaata

SEQ ID NO: 6269823 - DNA, 23 bp, Homo sapiens
gcatcctagtctctatcattaaa

SEQ ID NO: 6269824 - DNA, 22 bp, Homo sapiens
gcatcctatcgatctggaaaga

SEQ ID NO: 6269825 - DNA, 17 bp, Homo sapiens
gcatcctcactgggctc

SEQ ID NO: 6269826 - DNA, 18 bp, Homo sapiens
gcatcctcactgggctca

SEQ ID NO: 6269827 - DNA, 15 bp, Homo sapiens
gcatcctcagcccca

SEQ ID NO: 6269828 - DNA, 15 bp, Homo sapiens
gcatcctcagttcct

SEQ ID NO: 6269829 - DNA, 16 bp, Homo sapiens
gcatcctccacatcct

SEQ ID NO: 6269830 - DNA, 20 bp, Homo sapiens
gcatcctccacatcctgtgt

SEQ ID NO: 6269831 - DNA, 13 bp, Homo sapiens
gcatcctccagcc

SEQ ID NO: 6269832 - DNA, 12 bp, Homo sapiens
gcatcctccagg

SEQ ID NO: 6269833 - DNA, 12 bp, Homo sapiens
gcatcctcccca

SEQ ID NO: 6269834 - DNA, 21 bp, Homo sapiens
gcatcctccccaccagagctg

SEQ ID NO: 6269835 - DNA, 22 bp, Homo sapiens
gcatcctccccaccagagctgc

SEQ ID NO: 6269836 - DNA, 16 bp, Homo sapiens
gcatcctccggagaga

SEQ ID NO: 6269837 - DNA, 21 bp, Homo sapiens
gcatcctcctctctggccttg

SEQ ID NO: 6269838 - DNA, 23 bp, Homo sapiens
gcatcctctcccccacaagagcc

SEQ ID NO: 6269839 - DNA, 11 bp, Homo sapiens
gcatcctctga

SEQ ID NO: 6269840 - DNA, 14 bp, Homo sapiens
gcatcctctgactc

SEQ ID NO: 6269841 - DNA, 14 bp, Homo sapiens
gcatcctctggagc

SEQ ID NO: 6269842 - DNA, 18 bp, Homo sapiens
gcatcctctggagccagc

SEQ ID NO: 6269843 - DNA, 19 bp, Homo sapiens
gcatcctgaggccagtggc

SEQ ID NO: 6269844 - DNA, 18 bp, Homo sapiens
gcatcctgattattttca

SEQ ID NO: 6269845 - DNA, 21 bp, Homo sapiens
gcatcctgcccgagggcagcc

SEQ ID NO: 6269846 - DNA, 23 bp, Homo sapiens
gcatcctgcctgggtgggacagc

SEQ ID NO: 6269847 - DNA, 12 bp, Homo sapiens
gcatcctgctgg

SEQ ID NO: 6269848 - DNA, 15 bp, Homo sapiens
gcatcctgcttcctg

SEQ ID NO: 6269849 - DNA, 16 bp, Homo sapiens
gcatcctgcttcctga

SEQ ID NO: 6269850 - DNA, 22 bp, Homo sapiens
gcatcctgcttcctgaaagctg

SEQ ID NO: 6269851 - DNA, 22 bp, Homo sapiens
gcatcctggcacccggcccctg

SEQ ID NO: 6269852 - DNA, 18 bp, Homo sapiens
gcatcctgtctggcattt

SEQ ID NO: 6269853 - DNA, 17 bp, Homo sapiens
gcatcctgtgaagtcct

SEQ ID NO: 6269854 - DNA, 18 bp, Homo sapiens
gcatccttcatcacagca

SEQ ID NO: 6269855 - DNA, 23 bp, Homo sapiens
gcatccttcctataacttgatgc

SEQ ID NO: 6269856 - DNA, 20 bp, Homo sapiens
gcatccttgcctgtctaaag

SEQ ID NO: 6269857 - DNA, 23 bp, Homo sapiens
gcatccttgcctgtctaaagcct

SEQ ID NO: 6269858 - DNA, 23 bp, Homo sapiens
gcatcctttagggttctgcctct

SEQ ID NO: 6269859 - DNA, 13 bp, Homo sapiens
gcatcgcaatgta

SEQ ID NO: 6269860 - DNA, 20 bp, Homo sapiens
gcatcgcaccattctgactc

SEQ ID NO: 6269861 - DNA, 17 bp, Homo sapiens
gcatcgcatcctcttcc

SEQ ID NO: 6269862 - DNA, 19 bp, Homo sapiens
gcatcgcatcctcttccat

SEQ ID NO: 6269863 - DNA, 20 bp, Homo sapiens
gcatcggactaaactatctg

SEQ ID NO: 6269864 - DNA, 17 bp, Homo sapiens
gcatcggagggagtccc

SEQ ID NO: 6269865 - DNA, 14 bp, Homo sapiens
gcatcggcctaggg

SEQ ID NO: 6269866 - DNA, 15 bp, Homo sapiens
gcatcggcctagggc

SEQ ID NO: 6269867 - DNA, 19 bp, Homo sapiens
gcatcgggagcacccagag

SEQ ID NO: 6269868 - DNA, 17 bp, Homo sapiens
gcatcggggccatttgg

SEQ ID NO: 6269869 - DNA, 17 bp, Homo sapiens
gcatcgggggcctgcaa

SEQ ID NO: 6269870 - DNA, 15 bp, Homo sapiens
gcatcgtagaagaga

SEQ ID NO: 6269871 - DNA, 17 bp, Homo sapiens
gcatcgtcccctccccc

SEQ ID NO: 6269872 - DNA, 19 bp, Homo sapiens
gcatcgtctcatgtaaaat

SEQ ID NO: 6269873 - DNA, 22 bp, Homo sapiens
gcatcgtgacccttcagggcca

SEQ ID NO: 6269874 - DNA, 20 bp, Homo sapiens
gcatctaaactttaatatgt

SEQ ID NO: 6269875 - DNA, 15 bp, Homo sapiens
gcatctaagcccatg

SEQ ID NO: 6269876 - DNA, 19 bp, Homo sapiens
gcatctaagttataagact

SEQ ID NO: 6269877 - DNA, 19 bp, Homo sapiens
gcatctacacagcctggac

SEQ ID NO: 6269878 - DNA, 21 bp, Homo sapiens
gcatctacacagcctggactt

SEQ ID NO: 6269879 - DNA, 17 bp, Homo sapiens
gcatctacctgctcctt

SEQ ID NO: 6269880 - DNA, 20 bp, Homo sapiens
gcatctagcatgtcgtcaaa

SEQ ID NO: 6269881 - DNA, 14 bp, Homo sapiens
gcatctatctcatc

SEQ ID NO: 6269882 - DNA, 18 bp, Homo sapiens
gcatctatctggtgattt

SEQ ID NO: 6269883 - DNA, 20 bp, Homo sapiens
gcatctatctggtgatttct

SEQ ID NO: 6269884 - DNA, 16 bp, Homo sapiens
gcatctatctgtgcta

SEQ ID NO: 6269885 - DNA, 15 bp, Homo sapiens
gcatctcaaatgttt

SEQ ID NO: 6269886 - DNA, 17 bp, Homo sapiens
gcatctcaaatgttttc

SEQ ID NO: 6269887 - DNA, 18 bp, Homo sapiens
gcatctcaaatgttttct

SEQ ID NO: 6269888 - DNA, 17 bp, Homo sapiens
gcatctcaatggcatgg

SEQ ID NO: 6269889 - DNA, 15 bp, Homo sapiens
gcatctcagcccaca

SEQ ID NO: 6269890 - DNA, 18 bp, Homo sapiens
gcatctcaggaggggcag

SEQ ID NO: 6269891 - DNA, 20 bp, Homo sapiens
gcatctcagtggtgtgtgaa

SEQ ID NO: 6269892 - DNA, 21 bp, Homo sapiens
gcatctcattgtagagcttgg

SEQ ID NO: 6269893 - DNA, 15 bp, Homo sapiens
gcatctccacctgct

SEQ ID NO: 6269894 - DNA, 12 bp, Homo sapiens
gcatctcccaga

SEQ ID NO: 6269895 - DNA, 13 bp, Homo sapiens
gcatctcccagat

SEQ ID NO: 6269896 - DNA, 20 bp, Homo sapiens
gcatctcccccaccctgtgc

SEQ ID NO: 6269897 - DNA, 20 bp, Homo sapiens
gcatctcccctagctcacca

SEQ ID NO: 6269898 - DNA, 23 bp, Homo sapiens
gcatctcctcccgcccttccatg

SEQ ID NO: 6269899 - DNA, 23 bp, Homo sapiens
gcatctcctgaggatcagaaagt

SEQ ID NO: 6269900 - DNA, 16 bp, Homo sapiens
gcatctcctgtgcatg

SEQ ID NO: 6269901 - DNA, 14 bp, Homo sapiens
gcatctccttgact

SEQ ID NO: 6269902 - DNA, 23 bp, Homo sapiens
gcatctctccccatatataaatt

SEQ ID NO: 6269903 - DNA, 22 bp, Homo sapiens
gcatctctgagtgtctctgcct

SEQ ID NO: 6269904 - DNA, 12 bp, Homo sapiens
gcatctctgggc

SEQ ID NO: 6269905 - DNA, 16 bp, Homo sapiens
gcatctctgggctgga

SEQ ID NO: 6269906 - DNA, 17 bp, Homo sapiens
gcatctctgtactttgc

SEQ ID NO: 6269907 - DNA, 21 bp, Homo sapiens
gcatctctgtcccattccctg

SEQ ID NO: 6269908 - DNA, 23 bp, Homo sapiens
gcatctctgtcccattccctggg

SEQ ID NO: 6269909 - DNA, 16 bp, Homo sapiens
gcatctcttccccaga

SEQ ID NO: 6269910 - DNA, 20 bp, Homo sapiens
gcatctcttccccagagagg

SEQ ID NO: 6269911 - DNA, 23 bp, Homo sapiens
gcatctcttccccagagaggcac

SEQ ID NO: 6269912 - DNA, 14 bp, Homo sapiens
gcatctcttgaggc

SEQ ID NO: 6269913 - DNA, 20 bp, Homo sapiens
gcatctcttgtgtaccagct

SEQ ID NO: 6269914 - DNA, 17 bp, Homo sapiens
gcatctgacacaaaaaa

SEQ ID NO: 6269915 - DNA, 18 bp, Homo sapiens
gcatctgaccagcagcgc

SEQ ID NO: 6269916 - DNA, 14 bp, Homo sapiens
gcatctgaccatct

SEQ ID NO: 6269917 - DNA, 15 bp, Homo sapiens
gcatctgaccatctg

SEQ ID NO: 6269918 - DNA, 16 bp, Homo sapiens
gcatctgaccatctgt

SEQ ID NO: 6269919 - DNA, 21 bp, Homo sapiens
gcatctgaccatctgtgacta

SEQ ID NO: 6269920 - DNA, 11 bp, Homo sapiens
gcatctgaccc

SEQ ID NO: 6269921 - DNA, 13 bp, Homo sapiens
gcatctgatagaa

SEQ ID NO: 6269922 - DNA, 20 bp, Homo sapiens
gcatctgcaggcaccgggct

SEQ ID NO: 6269923 - DNA, 21 bp, Homo sapiens
gcatctgccacaaaaatgttc

SEQ ID NO: 6269924 - DNA, 19 bp, Homo sapiens
gctggcctgacacaatggt

SEQ ID NO: 6269925 - DNA, 12 bp, Homo sapiens
gctggcctgagc

SEQ ID NO: 6269926 - DNA, 12 bp, Homo sapiens
gctggcctgctc

SEQ ID NO: 6269927 - DNA, 19 bp, Homo sapiens
gctggcctggaggctcagc

SEQ ID NO: 6269928 - DNA, 14 bp, Homo sapiens
gctggcctggcccc

SEQ ID NO: 6269929 - DNA, 18 bp, Homo sapiens
gctggcctggcccctcag

SEQ ID NO: 6269930 - DNA, 20 bp, Homo sapiens
gctggcctggcccctcaggg

SEQ ID NO: 6269931 - DNA, 16 bp, Homo sapiens
gctggcctgtggcagg

SEQ ID NO: 6269932 - DNA, 18 bp, Homo sapiens
gctggcctgtggcaggcc

SEQ ID NO: 6269933 - DNA, 13 bp, Homo sapiens
gctggccttcctg

SEQ ID NO: 6269934 - DNA, 16 bp, Homo sapiens
gctggccttcctgccc

SEQ ID NO: 6269935 - DNA, 23 bp, Homo sapiens
gctggccttcgtctccatctctg

SEQ ID NO: 6269936 - DNA, 23 bp, Homo sapiens
gctggcctttcaggtccaggcca

SEQ ID NO: 6269937 - DNA, 21 bp, Homo sapiens
gctggcctttgtaagtgcagg

SEQ ID NO: 6269938 - DNA, 20 bp, Homo sapiens
gctggcgacacactccgtcc

SEQ ID NO: 6269939 - DNA, 20 bp, Homo sapiens
gctggcgacactcagggcag

SEQ ID NO: 6269940 - DNA, 17 bp, Homo sapiens
gctggcgcagccaaggc

SEQ ID NO: 6269941 - DNA, 14 bp, Homo sapiens
gctggcgcccatcc

SEQ ID NO: 6269942 - DNA, 15 bp, Homo sapiens
gctggcgcctctgca

SEQ ID NO: 6269943 - DNA, 16 bp, Homo sapiens
gctggcgcctctgcaa

SEQ ID NO: 6269944 - DNA, 20 bp, Homo sapiens
gctggcgctcagcagcccta

SEQ ID NO: 6269945 - DNA, 22 bp, Homo sapiens
gctggcgctcagcagccctagc

SEQ ID NO: 6269946 - DNA, 16 bp, Homo sapiens
gctggcggaggctgct

SEQ ID NO: 6269947 - DNA, 19 bp, Homo sapiens
gctggcggccatccccgtg

SEQ ID NO: 6269948 - DNA, 22 bp, Homo sapiens
gctggcggcccttctgactgtt

SEQ ID NO: 6269949 - DNA, 15 bp, Homo sapiens
gctggcggcgcagag

SEQ ID NO: 6269950 - DNA, 17 bp, Homo sapiens
gctggcggcgcagaggg

SEQ ID NO: 6269951 - DNA, 21 bp, Homo sapiens
gctggcggctactcagcagcc

SEQ ID NO: 6269952 - DNA, 14 bp, Homo sapiens
gctggcgggccctg

SEQ ID NO: 6269953 - DNA, 15 bp, Homo sapiens
gctggcgggccctgg

SEQ ID NO: 6269954 - DNA, 15 bp, Homo sapiens
gctggcgtgcagtgg

SEQ ID NO: 6269955 - DNA, 20 bp, Homo sapiens
gctggctatctactaccaga

SEQ ID NO: 6269956 - DNA, 18 bp, Homo sapiens
gctggctcacagtacagc

SEQ ID NO: 6269957 - DNA, 14 bp, Homo sapiens
gctggctcaggaag

SEQ ID NO: 6269958 - DNA, 21 bp, Homo sapiens
gctggctccacgccctgggga

SEQ ID NO: 6269959 - DNA, 16 bp, Homo sapiens
gctggctcccagggcc

SEQ ID NO: 6269960 - DNA, 15 bp, Homo sapiens
gctggctcccagggt

SEQ ID NO: 6269961 - DNA, 15 bp, Homo sapiens
gctggctcccatctc

SEQ ID NO: 6269962 - DNA, 21 bp, Homo sapiens
gctggctccccaaagggtgtg

SEQ ID NO: 6269963 - DNA, 17 bp, Homo sapiens
gctggctccccctcccc

SEQ ID NO: 6269964 - DNA, 19 bp, Homo sapiens
gctggctccccctccccag

SEQ ID NO: 6269965 - DNA, 21 bp, Homo sapiens
gctggctccccctccccaggc

SEQ ID NO: 6269966 - DNA, 21 bp, Homo sapiens
gctggctcccctgcagccctg

SEQ ID NO: 6269967 - DNA, 22 bp, Homo sapiens
gctggctcccctgcagccctgg

SEQ ID NO: 6269968 - DNA, 18 bp, Homo sapiens
gctggctccctgggcagt

SEQ ID NO: 6269969 - DNA, 11 bp, Homo sapiens
gctggctccta

SEQ ID NO: 6269970 - DNA, 13 bp, Homo sapiens
gctggctcctagg

SEQ ID NO: 6269971 - DNA, 16 bp, Homo sapiens
gctggctcctccaggc

SEQ ID NO: 6269972 - DNA, 23 bp, Homo sapiens
gctggctcctggggatggccagg

SEQ ID NO: 6269973 - DNA, 22 bp, Homo sapiens
gctggctctaccttcctgtccc

SEQ ID NO: 6269974 - DNA, 12 bp, Homo sapiens
gctggctctgaa

SEQ ID NO: 6269975 - DNA, 16 bp, Homo sapiens
gctggctctgagcgcc

SEQ ID NO: 6269976 - DNA, 15 bp, Homo sapiens
gctggctctgcacta

SEQ ID NO: 6269977 - DNA, 15 bp, Homo sapiens
gctggctctgcagca

SEQ ID NO: 6269978 - DNA, 17 bp, Homo sapiens
gctggctctgtggaggg

SEQ ID NO: 6269979 - DNA, 16 bp, Homo sapiens
gctggctcttctgccc

SEQ ID NO: 6269980 - DNA, 13 bp, Homo sapiens
gctggctgaaaat

SEQ ID NO: 6269981 - DNA, 12 bp, Homo sapiens
gctggctgaaga

SEQ ID NO: 6269982 - DNA, 21 bp, Homo sapiens
gctggctgaagaggaccagag

SEQ ID NO: 6269983 - DNA, 22 bp, Homo sapiens
gctggctgaagaggaccagagg

SEQ ID NO: 6269984 - DNA, 15 bp, Homo sapiens
gctggctgacctggg

SEQ ID NO: 6269985 - DNA, 22 bp, Homo sapiens
gctggctgacctgggcccacag

SEQ ID NO: 6269986 - DNA, 15 bp, Homo sapiens
gctggctgaggcttg

SEQ ID NO: 6269987 - DNA, 21 bp, Homo sapiens
gctggctgagtggaatgcagg

SEQ ID NO: 6269988 - DNA, 21 bp, Homo sapiens
gctggctgatgggtggacctg

SEQ ID NO: 6269989 - DNA, 14 bp, Homo sapiens
gctggctgccttag

SEQ ID NO: 6269990 - DNA, 18 bp, Homo sapiens
gctggctgccttctgcgg

SEQ ID NO: 6269991 - DNA, 12 bp, Homo sapiens
gctggctgctgg

SEQ ID NO: 6269992 - DNA, 12 bp, Homo sapiens
gctggctgcttg

SEQ ID NO: 6269993 - DNA, 19 bp, Homo sapiens
gctggctgcttgcagccag

SEQ ID NO: 6269994 - DNA, 14 bp, Homo sapiens
gctggctggaggaa

SEQ ID NO: 6269995 - DNA, 18 bp, Homo sapiens
gctggctggaggaaggaa

SEQ ID NO: 6269996 - DNA, 18 bp, Homo sapiens
gctggctggagtctcaga

SEQ ID NO: 6269997 - DNA, 14 bp, Homo sapiens
gctggctggagtga

SEQ ID NO: 6269998 - DNA, 17 bp, Homo sapiens
gctggctgggccttcac

SEQ ID NO: 6269999 - DNA, 15 bp, Homo sapiens
gctggctggggccgg

SEQ ID NO: 6270000 - DNA, 12 bp, Homo sapiens
gctggctggggg

SEQ ID NO: 6270001 - DNA, 17 bp, Homo sapiens
gctggctgggggcagga

SEQ ID NO: 6270002 - DNA, 12 bp, Homo sapiens
gctggctgtatg

SEQ ID NO: 6270003 - DNA, 14 bp, Homo sapiens
gctggctgtgacaa

SEQ ID NO: 6270004 - DNA, 16 bp, Homo sapiens
gctggctgtgtcctct

SEQ ID NO: 6270005 - DNA, 12 bp, Homo sapiens
gctggctgttgg

SEQ ID NO: 6270006 - DNA, 17 bp, Homo sapiens
gctggctgttggctggg

SEQ ID NO: 6270007 - DNA, 20 bp, Homo sapiens
gctggctgttggctgggggc

SEQ ID NO: 6270008 - DNA, 15 bp, Homo sapiens
gctggcttcagggag

SEQ ID NO: 6270009 - DNA, 13 bp, Homo sapiens
gctggcttccagc

SEQ ID NO: 6270010 - DNA, 22 bp, Homo sapiens
gctggcttccagcgggccctct

SEQ ID NO: 6270011 - DNA, 23 bp, Homo sapiens
gctggcttccagcttcaggcacc

SEQ ID NO: 6270012 - DNA, 18 bp, Homo sapiens
gctggcttccgctgtcac

SEQ ID NO: 6270013 - DNA, 13 bp, Homo sapiens
gctggcttctgtg

SEQ ID NO: 6270014 - DNA, 14 bp, Homo sapiens
gctggcttctgtga

SEQ ID NO: 6270015 - DNA, 21 bp, Homo sapiens
gctggcttctgttgcgccact

SEQ ID NO: 6270016 - DNA, 22 bp, Homo sapiens
gctggcttctgttgcgccactg

SEQ ID NO: 6270017 - DNA, 15 bp, Homo sapiens
gctggcttgggcagc

SEQ ID NO: 6270018 - DNA, 22 bp, Homo sapiens
gctggctttgggaaagcccaga

SEQ ID NO: 6270019 - DNA, 11 bp, Homo sapiens
gctgggaaaca

SEQ ID NO: 6270020 - DNA, 22 bp, Homo sapiens
gctgggaaacagggagccccta

SEQ ID NO: 6270021 - DNA, 14 bp, Homo sapiens
gctgggaaagcata

SEQ ID NO: 6270022 - DNA, 17 bp, Homo sapiens
gctgggaaatgcagaaa

SEQ ID NO: 6270023 - DNA, 23 bp, Homo sapiens
gctgggaacatgacccagcctga

SEQ ID NO: 6270024 - DNA, 19 bp, Homo sapiens
gctgggaacgtgtgtccag

SEQ ID NO: 6270025 - DNA, 19 bp, Homo sapiens
gctgggaactgcagacctg

SEQ ID NO: 6270026 - DNA, 22 bp, Homo sapiens
gctgggaagcccggactgacca

SEQ ID NO: 6270027 - DNA, 20 bp, Homo sapiens
gctgggaataagtgccagga

SEQ ID NO: 6270028 - DNA, 16 bp, Homo sapiens
gctgggaccagagcca

SEQ ID NO: 6270029 - DNA, 21 bp, Homo sapiens
gctgggaccagagccagatgc

SEQ ID NO: 6270030 - DNA, 19 bp, Homo sapiens
gctgggacccacctccccc

SEQ ID NO: 6270031 - DNA, 15 bp, Homo sapiens
gctgggacctaatgc

SEQ ID NO: 6270032 - DNA, 18 bp, Homo sapiens
gctgggacctaatgctgg

SEQ ID NO: 6270033 - DNA, 18 bp, Homo sapiens
gctgggacgatcgcccag

SEQ ID NO: 6270034 - DNA, 17 bp, Homo sapiens
gctgggacgctctgctg

SEQ ID NO: 6270035 - DNA, 19 bp, Homo sapiens
gctgggactacaggcaccc

SEQ ID NO: 6270036 - DNA, 22 bp, Homo sapiens
gctgggactcagccttcagaca

SEQ ID NO: 6270037 - DNA, 19 bp, Homo sapiens
gctgggactcagttcttgg

SEQ ID NO: 6270038 - DNA, 22 bp, Homo sapiens
gctgggactcagttcttggcct

SEQ ID NO: 6270039 - DNA, 16 bp, Homo sapiens
gctgggactcctggtg

SEQ ID NO: 6270040 - DNA, 22 bp, Homo sapiens
gctgggactcctggtgcccctc

SEQ ID NO: 6270041 - DNA, 22 bp, Homo sapiens
gctgggacttcttacccaaagc

SEQ ID NO: 6270042 - DNA, 23 bp, Homo sapiens
gctgggacttcttacccaaagca

SEQ ID NO: 6270043 - DNA, 14 bp, Homo sapiens
gctgggagaagaaa

SEQ ID NO: 6270044 - DNA, 22 bp, Homo sapiens
gctgggagaagggggtcaaagc

SEQ ID NO: 6270045 - DNA, 14 bp, Homo sapiens
gctgggagacaaag

SEQ ID NO: 6270046 - DNA, 13 bp, Homo sapiens
gctgggagaccct

SEQ ID NO: 6270047 - DNA, 20 bp, Homo sapiens
gctgggagaccctccccaca

SEQ ID NO: 6270048 - DNA, 12 bp, Homo sapiens
gctgggagagcc

SEQ ID NO: 6270049 - DNA, 23 bp, Homo sapiens
gctgggagaggcagcccaggaag

SEQ ID NO: 6270050 - DNA, 17 bp, Homo sapiens
gctgggagatgctctct

SEQ ID NO: 6270051 - DNA, 16 bp, Homo sapiens
gctgggagcaggactg

SEQ ID NO: 6270052 - DNA, 17 bp, Homo sapiens
gctgggagccagtgtgc

SEQ ID NO: 6270053 - DNA, 20 bp, Homo sapiens
gctgggagctccactctgct

SEQ ID NO: 6270054 - DNA, 14 bp, Homo sapiens
gctgggaggactgg

SEQ ID NO: 6270055 - DNA, 21 bp, Homo sapiens
gctgggaggagcccctggaca

SEQ ID NO: 6270056 - DNA, 16 bp, Homo sapiens
gctgggaggagggaga

SEQ ID NO: 6270057 - DNA, 19 bp, Homo sapiens
gctgggaggagggcaggca

SEQ ID NO: 6270058 - DNA, 12 bp, Homo sapiens
gctgggaggcaa

SEQ ID NO: 6270059 - DNA, 17 bp, Homo sapiens
gctgggagggaggggga

SEQ ID NO: 6270060 - DNA, 19 bp, Homo sapiens
gctgggagggatagagggg

SEQ ID NO: 6270061 - DNA, 21 bp, Homo sapiens
gctgggagggatagagggggg

SEQ ID NO: 6270062 - DNA, 21 bp, Homo sapiens
gctgggaggtataggggtcct

SEQ ID NO: 6270063 - DNA, 18 bp, Homo sapiens
gctgggaggtcccagggc

SEQ ID NO: 6270064 - DNA, 21 bp, Homo sapiens
gctgggaggtctcgtcccagc

SEQ ID NO: 6270065 - DNA, 19 bp, Homo sapiens
gctgggagtccttacctcg

SEQ ID NO: 6270066 - DNA, 21 bp, Homo sapiens
gctgggagttctagaaccact

SEQ ID NO: 6270067 - DNA, 22 bp, Homo sapiens
gctgggagttctagaaccactt

SEQ ID NO: 6270068 - DNA, 18 bp, Homo sapiens
gctgggatagaggggtca

SEQ ID NO: 6270069 - DNA, 22 bp, Homo sapiens
gctgggatcacagctgcaggcc

SEQ ID NO: 6270070 - DNA, 16 bp, Homo sapiens
gctgggatcagagcag

SEQ ID NO: 6270071 - DNA, 18 bp, Homo sapiens
gctgggatcagagcagga

SEQ ID NO: 6270072 - DNA, 16 bp, Homo sapiens
gctgggatcccacagc

SEQ ID NO: 6270073 - DNA, 22 bp, Homo sapiens
gctgggatctgactgcacgtgg

SEQ ID NO: 6270074 - DNA, 17 bp, Homo sapiens
gctgggatgacaggtgt

SEQ ID NO: 6270075 - DNA, 18 bp, Homo sapiens
gctgggatgacaggtgtg

SEQ ID NO: 6270076 - DNA, 20 bp, Homo sapiens
gctgggatggtgactcctga

SEQ ID NO: 6270077 - DNA, 22 bp, Homo sapiens
gctgggatggtgactcctgaaa

SEQ ID NO: 6270078 - DNA, 17 bp, Homo sapiens
gctgggattacaggcat

SEQ ID NO: 6270079 - DNA, 21 bp, Homo sapiens
gctgggattacaggcgtgagc

SEQ ID NO: 6270080 - DNA, 22 bp, Homo sapiens
gctgggattacaggcgtgagcc

SEQ ID NO: 6270081 - DNA, 23 bp, Homo sapiens
gctgggattacaggctcctgcca

SEQ ID NO: 6270082 - DNA, 15 bp, Homo sapiens
gctgggattacaggt

SEQ ID NO: 6270083 - DNA, 17 bp, Homo sapiens
gctgggattacaggtgt

SEQ ID NO: 6270084 - DNA, 18 bp, Homo sapiens
gctgggattacaggtgtg

SEQ ID NO: 6270085 - DNA, 22 bp, Homo sapiens
gctgggatttcttcgctgctct

SEQ ID NO: 6270086 - DNA, 23 bp, Homo sapiens
gctgggatttcttcgctgctcta

SEQ ID NO: 6270087 - DNA, 15 bp, Homo sapiens
gctgggattttaaac

SEQ ID NO: 6270088 - DNA, 20 bp, Homo sapiens
gctgggcaaacccttctctt

SEQ ID NO: 6270089 - DNA, 15 bp, Homo sapiens
gctgggcaaagccac

SEQ ID NO: 6270090 - DNA, 18 bp, Homo sapiens
gctgggcaaagccacaag

SEQ ID NO: 6270091 - DNA, 19 bp, Homo sapiens
gctgggcaacatgcctgct

SEQ ID NO: 6270092 - DNA, 19 bp, Homo sapiens
gctgggcaaggaaaaagaa

SEQ ID NO: 6270093 - DNA, 16 bp, Homo sapiens
gctgggcacagaggtc

SEQ ID NO: 6270094 - DNA, 19 bp, Homo sapiens
gctgggcaccgtgtcctcc

SEQ ID NO: 6270095 - DNA, 23 bp, Homo sapiens
gctgggcaccgtgtcctcctctg

SEQ ID NO: 6270096 - DNA, 17 bp, Homo sapiens
gctgggcacctctagtg

SEQ ID NO: 6270097 - DNA, 12 bp, Homo sapiens
gctgggcacctg

SEQ ID NO: 6270098 - DNA, 14 bp, Homo sapiens
gctgggcactgctc

SEQ ID NO: 6270099 - DNA, 17 bp, Homo sapiens
gctgggcactgctccaa

SEQ ID NO: 6270100 - DNA, 18 bp, Homo sapiens
gctgggcactgctccaag

SEQ ID NO: 6270101 - DNA, 13 bp, Homo sapiens
gcatctgccccag

SEQ ID NO: 6270102 - DNA, 15 bp, Homo sapiens
gcatctgccccaggt

SEQ ID NO: 6270103 - DNA, 17 bp, Homo sapiens
gcatctgccccaggtac

SEQ ID NO: 6270104 - DNA, 24 bp, Homo sapiens
gcatctgccccaggtacacctccc

SEQ ID NO: 6270105 - DNA, 12 bp, Homo sapiens
gcatctgcccct

SEQ ID NO: 6270106 - DNA, 14 bp, Homo sapiens
gcatctgcccctcc

SEQ ID NO: 6270107 - DNA, 13 bp, Homo sapiens
gcatctgcctgga

SEQ ID NO: 6270108 - DNA, 16 bp, Homo sapiens
gcatctgcctggagcc

SEQ ID NO: 6270109 - DNA, 17 bp, Homo sapiens
gcatctgcctggagcct

SEQ ID NO: 6270110 - DNA, 18 bp, Homo sapiens
gcatctgctaataaaacc

SEQ ID NO: 6270111 - DNA, 21 bp, Homo sapiens
gcatctgctctagattcataa

SEQ ID NO: 6270112 - DNA, 23 bp, Homo sapiens
gcatctgctctagattcataaat

SEQ ID NO: 6270113 - DNA, 12 bp, Homo sapiens
gcatctgctttt

SEQ ID NO: 6270114 - DNA, 23 bp, Homo sapiens
gcatctggaagagctaggcaggg

SEQ ID NO: 6270115 - DNA, 20 bp, Homo sapiens
gcatctggcacgtggccagg

SEQ ID NO: 6270116 - DNA, 21 bp, Homo sapiens
gcatctggcacgtggccagga

SEQ ID NO: 6270117 - DNA, 22 bp, Homo sapiens
gcatctggcacgtggccaggag

SEQ ID NO: 6270118 - DNA, 13 bp, Homo sapiens
gcatctggccctg

SEQ ID NO: 6270119 - DNA, 14 bp, Homo sapiens
gcatctggccctgc

SEQ ID NO: 6270120 - DNA, 15 bp, Homo sapiens
gcatctggccctgct

SEQ ID NO: 6270121 - DNA, 13 bp, Homo sapiens
gcatctggcctat

SEQ ID NO: 6270122 - DNA, 12 bp, Homo sapiens
gcatctggcctg

SEQ ID NO: 6270123 - DNA, 13 bp, Homo sapiens
gcatctggcctgg

SEQ ID NO: 6270124 - DNA, 14 bp, Homo sapiens
gcatctggcctggg

SEQ ID NO: 6270125 - DNA, 17 bp, Homo sapiens
gcatctggcctgggggc

SEQ ID NO: 6270126 - DNA, 21 bp, Homo sapiens
gcatctggctactttttcatg

SEQ ID NO: 6270127 - DNA, 20 bp, Homo sapiens
gcatctgggattcccaccaa

SEQ ID NO: 6270128 - DNA, 12 bp, Homo sapiens
gcatctggtctt

SEQ ID NO: 6270129 - DNA, 13 bp, Homo sapiens
gcatctggtcttg

SEQ ID NO: 6270130 - DNA, 13 bp, Homo sapiens
gcatctgtataag

SEQ ID NO: 6270131 - DNA, 14 bp, Homo sapiens
gcatctgtcccact

SEQ ID NO: 6270132 - DNA, 13 bp, Homo sapiens
gcatctgtctgct

SEQ ID NO: 6270133 - DNA, 15 bp, Homo sapiens
gcatctgtctgctct

SEQ ID NO: 6270134 - DNA, 19 bp, Homo sapiens
gcatctgtctgctctgcat

SEQ ID NO: 6270135 - DNA, 17 bp, Homo sapiens
gcatctgtctgtctgtg

SEQ ID NO: 6270136 - DNA, 15 bp, Homo sapiens
gcatctgtgatggga

SEQ ID NO: 6270137 - DNA, 14 bp, Homo sapiens
gcatctgtggcctg

SEQ ID NO: 6270138 - DNA, 18 bp, Homo sapiens
gcatctgtggcctggggc

SEQ ID NO: 6270139 - DNA, 11 bp, Homo sapiens
gcatctgtgtg

SEQ ID NO: 6270140 - DNA, 13 bp, Homo sapiens
gcatctgtgtgtg

SEQ ID NO: 6270141 - DNA, 23 bp, Homo sapiens
gcatctgttagcagagtctgtct

SEQ ID NO: 6270142 - DNA, 19 bp, Homo sapiens
gcatctgtttacctggcag

SEQ ID NO: 6270143 - DNA, 13 bp, Homo sapiens
gcatctgtttatt

SEQ ID NO: 6270144 - DNA, 16 bp, Homo sapiens
gcatcttagggtaggg

SEQ ID NO: 6270145 - DNA, 14 bp, Homo sapiens
gcatcttcctctgc

SEQ ID NO: 6270146 - DNA, 15 bp, Homo sapiens
gcatcttcctctgca

SEQ ID NO: 6270147 - DNA, 19 bp, Homo sapiens
gcatcttctcactcccttc

SEQ ID NO: 6270148 - DNA, 14 bp, Homo sapiens
gcatcttctccatc

SEQ ID NO: 6270149 - DNA, 19 bp, Homo sapiens
gcatcttctggagtctcca

SEQ ID NO: 6270150 - DNA, 20 bp, Homo sapiens
gcatcttctggagtctccag

SEQ ID NO: 6270151 - DNA, 14 bp, Homo sapiens
gcatcttcttgcat

SEQ ID NO: 6270152 - DNA, 19 bp, Homo sapiens
gcatcttgcctccaggtgc

SEQ ID NO: 6270153 - DNA, 23 bp, Homo sapiens
gcatcttgcctccaggtgcagag

SEQ ID NO: 6270154 - DNA, 23 bp, Homo sapiens
gcatcttgctctgtggccttggc

SEQ ID NO: 6270155 - DNA, 22 bp, Homo sapiens
gcatcttggtccaggaaatgtg

SEQ ID NO: 6270156 - DNA, 21 bp, Homo sapiens
gcatctttcatagttctgtta

SEQ ID NO: 6270157 - DNA, 16 bp, Homo sapiens
gcatctttcatatggt

SEQ ID NO: 6270158 - DNA, 12 bp, Homo sapiens
gcatctttctct

SEQ ID NO: 6270159 - DNA, 13 bp, Homo sapiens
gcatctttgatgt

SEQ ID NO: 6270160 - DNA, 15 bp, Homo sapiens
gcatctttgatgtgt

SEQ ID NO: 6270161 - DNA, 17 bp, Homo sapiens
gcatctttgcccttctg

SEQ ID NO: 6270162 - DNA, 15 bp, Homo sapiens
gcatctttgcctctc

SEQ ID NO: 6270163 - DNA, 15 bp, Homo sapiens
gcatctttgccttgg

SEQ ID NO: 6270164 - DNA, 19 bp, Homo sapiens
gcatcttttccatcctgag

SEQ ID NO: 6270165 - DNA, 12 bp, Homo sapiens
gcatcttttgta

SEQ ID NO: 6270166 - DNA, 13 bp, Homo sapiens
gcatgaaaaggat

SEQ ID NO: 6270167 - DNA, 19 bp, Homo sapiens
gcatgaaactatgcaccta

SEQ ID NO: 6270168 - DNA, 21 bp, Homo sapiens
gcatgaaaggtaatctgaaac

SEQ ID NO: 6270169 - DNA, 15 bp, Homo sapiens
gcatgaaataaaata

SEQ ID NO: 6270170 - DNA, 19 bp, Homo sapiens
gcatgaaatgaacacaaat

SEQ ID NO: 6270171 - DNA, 16 bp, Homo sapiens
gcatgaaattgtatct

SEQ ID NO: 6270172 - DNA, 24 bp, Homo sapiens
gcatgaaattgtatctcagtctaa

SEQ ID NO: 6270173 - DNA, 20 bp, Homo sapiens
gcatgaacagggtccctgga

SEQ ID NO: 6270174 - DNA, 20 bp, Homo sapiens
gcatgaacatgtactgttct

SEQ ID NO: 6270175 - DNA, 21 bp, Homo sapiens
gcatgaaccctcttgccatcc

SEQ ID NO: 6270176 - DNA, 22 bp, Homo sapiens
gcatgaaccctcttgccatcct

SEQ ID NO: 6270177 - DNA, 23 bp, Homo sapiens
gcatgaaccctcttgccatcctg

SEQ ID NO: 6270178 - DNA, 21 bp, Homo sapiens
gcatgaacgccaaggaatgta

SEQ ID NO: 6270179 - DNA, 19 bp, Homo sapiens
gcatgaacgtggattgtat

SEQ ID NO: 6270180 - DNA, 21 bp, Homo sapiens
gcatgaagaattttttctcat

SEQ ID NO: 6270181 - DNA, 19 bp, Homo sapiens
gcatgaagattttctttct

SEQ ID NO: 6270182 - DNA, 15 bp, Homo sapiens
gcatgaataaaacac

SEQ ID NO: 6270183 - DNA, 15 bp, Homo sapiens
gcatgaatcactgtg

SEQ ID NO: 6270184 - DNA, 23 bp, Homo sapiens
gcatgaatcactgtgctcagcca

SEQ ID NO: 6270185 - DNA, 17 bp, Homo sapiens
gcatgaattcacaaaca

SEQ ID NO: 6270186 - DNA, 15 bp, Homo sapiens
gcatgaattctgcat

SEQ ID NO: 6270187 - DNA, 15 bp, Homo sapiens
gcatgaatttgtgaa

SEQ ID NO: 6270188 - DNA, 15 bp, Homo sapiens
gcatgacaaaaataa

SEQ ID NO: 6270189 - DNA, 16 bp, Homo sapiens
gcatgacaaaaataac

SEQ ID NO: 6270190 - DNA, 14 bp, Homo sapiens
gcatgacaaaaatt

SEQ ID NO: 6270191 - DNA, 16 bp, Homo sapiens
gcatgacaaaagtgac

SEQ ID NO: 6270192 - DNA, 22 bp, Homo sapiens
gcatgacaaaagtgacagatgt

SEQ ID NO: 6270193 - DNA, 16 bp, Homo sapiens
gcatgacaagccccag

SEQ ID NO: 6270194 - DNA, 17 bp, Homo sapiens
gcatgacaagccccagg

SEQ ID NO: 6270195 - DNA, 20 bp, Homo sapiens
gcatgacacgaatattgctg

SEQ ID NO: 6270196 - DNA, 22 bp, Homo sapiens
gcatgacacgaatattgctgat

SEQ ID NO: 6270197 - DNA, 14 bp, Homo sapiens
gcatgacactctag

SEQ ID NO: 6270198 - DNA, 15 bp, Homo sapiens
gcatgacagaaaata

SEQ ID NO: 6270199 - DNA, 17 bp, Homo sapiens
gcatgacagaaaatatg

SEQ ID NO: 6270200 - DNA, 19 bp, Homo sapiens
gcatgacagaaaatatgta

SEQ ID NO: 6270201 - DNA, 18 bp, Homo sapiens
gcatgacagcctgcagca

SEQ ID NO: 6270202 - DNA, 15 bp, Homo sapiens
gcatgaccagatgcg

SEQ ID NO: 6270203 - DNA, 12 bp, Homo sapiens
gcatgaccctgg

SEQ ID NO: 6270204 - DNA, 13 bp, Homo sapiens
gcatgaccctgga

SEQ ID NO: 6270205 - DNA, 23 bp, Homo sapiens
gcatgacctaccaggacagaact

SEQ ID NO: 6270206 - DNA, 18 bp, Homo sapiens
gcatgacctcagtcaggc

SEQ ID NO: 6270207 - DNA, 22 bp, Homo sapiens
gcatgacctcagtcaggcactg

SEQ ID NO: 6270208 - DNA, 20 bp, Homo sapiens
gcatgaccttttggcctttg

SEQ ID NO: 6270209 - DNA, 23 bp, Homo sapiens
gcatgaccttttggcctttgtaa

SEQ ID NO: 6270210 - DNA, 17 bp, Homo sapiens
gcatgacgtgaatgtgt

SEQ ID NO: 6270211 - DNA, 15 bp, Homo sapiens
gcatgacgtttaagg

SEQ ID NO: 6270212 - DNA, 18 bp, Homo sapiens
gcatgacgtttaaggcca

SEQ ID NO: 6270213 - DNA, 18 bp, Homo sapiens
gcatgactaatgcttttt

SEQ ID NO: 6270214 - DNA, 22 bp, Homo sapiens
gcatgactaatgctttttagaa

SEQ ID NO: 6270215 - DNA, 14 bp, Homo sapiens
gcatgactggacag

SEQ ID NO: 6270216 - DNA, 16 bp, Homo sapiens
gcatgactggacagcg

SEQ ID NO: 6270217 - DNA, 12 bp, Homo sapiens
gcatgagaaaga

SEQ ID NO: 6270218 - DNA, 20 bp, Homo sapiens
gcatgagaatgtcatttgct

SEQ ID NO: 6270219 - DNA, 21 bp, Homo sapiens
gcatgagactcagtgcagatg

SEQ ID NO: 6270220 - DNA, 17 bp, Homo sapiens
gcatgagaggaggcagc

SEQ ID NO: 6270221 - DNA, 13 bp, Homo sapiens
gcatgagccacca

SEQ ID NO: 6270222 - DNA, 15 bp, Homo sapiens
gcatgagccactgca

SEQ ID NO: 6270223 - DNA, 12 bp, Homo sapiens
gcatgagctggc

SEQ ID NO: 6270224 - DNA, 21 bp, Homo sapiens
gcatgagctttccagttaggg

SEQ ID NO: 6270225 - DNA, 22 bp, Homo sapiens
gcatgaggaactagccaccaac

SEQ ID NO: 6270226 - DNA, 21 bp, Homo sapiens
gcatgagggatcacagggccc

SEQ ID NO: 6270227 - DNA, 20 bp, Homo sapiens
gcatgaggggttcctcccct

SEQ ID NO: 6270228 - DNA, 21 bp, Homo sapiens
gcatgaggtgttgtgcatttg

SEQ ID NO: 6270229 - DNA, 18 bp, Homo sapiens
gcatgagtctgtttccca

SEQ ID NO: 6270230 - DNA, 21 bp, Homo sapiens
gcatgagttctgcacatacag

SEQ ID NO: 6270231 - DNA, 14 bp, Homo sapiens
gcatgataaacatt

SEQ ID NO: 6270232 - DNA, 19 bp, Homo sapiens
gcatgatccaagcaagact

SEQ ID NO: 6270233 - DNA, 16 bp, Homo sapiens
gcatgatctgaaaaat

SEQ ID NO: 6270234 - DNA, 23 bp, Homo sapiens
gcatgatcttacacgaagaaata

SEQ ID NO: 6270235 - DNA, 14 bp, Homo sapiens
gcatgatgactctt

SEQ ID NO: 6270236 - DNA, 22 bp, Homo sapiens
gcatgatgactcttcttatcac

SEQ ID NO: 6270237 - DNA, 14 bp, Homo sapiens
gcatgatgccctcc

SEQ ID NO: 6270238 - DNA, 21 bp, Homo sapiens
gcatgatgggaggtgtgccag

SEQ ID NO: 6270239 - DNA, 21 bp, Homo sapiens
gcatgatgggccgagccacct

SEQ ID NO: 6270240 - DNA, 20 bp, Homo sapiens
gcatgatggtgcatgcctgt

SEQ ID NO: 6270241 - DNA, 14 bp, Homo sapiens
gcatgatgtttccc

SEQ ID NO: 6270242 - DNA, 18 bp, Homo sapiens
gcatgatgtttgcccaaa

SEQ ID NO: 6270243 - DNA, 21 bp, Homo sapiens
gcatgattcttccaaggaaat

SEQ ID NO: 6270244 - DNA, 17 bp, Homo sapiens
gcatgattcttctcttg

SEQ ID NO: 6270245 - DNA, 20 bp, Homo sapiens
gcatgattcttctcttgtga

SEQ ID NO: 6270246 - DNA, 16 bp, Homo sapiens
gcatgatttatatatg

SEQ ID NO: 6270247 - DNA, 11 bp, Homo sapiens
gcatgatttga

SEQ ID NO: 6270248 - DNA, 23 bp, Homo sapiens
gcatgattttaagaggctttggc

SEQ ID NO: 6270249 - DNA, 15 bp, Homo sapiens
gcatgattttataca

SEQ ID NO: 6270250 - DNA, 16 bp, Homo sapiens
gcatgattttatacat

SEQ ID NO: 6270251 - DNA, 17 bp, Homo sapiens
gcatgattttatacata

SEQ ID NO: 6270252 - DNA, 17 bp, Homo sapiens
gcatgatttttgccctg

SEQ ID NO: 6270253 - DNA, 17 bp, Homo sapiens
gcatgcaaaaatgaatt

SEQ ID NO: 6270254 - DNA, 20 bp, Homo sapiens
gcatgcaaaagaaagcaaat

SEQ ID NO: 6270255 - DNA, 21 bp, Homo sapiens
gcatgcaaatgagctctgaaa

SEQ ID NO: 6270256 - DNA, 18 bp, Homo sapiens
gcatgcaataatgtgcaa

SEQ ID NO: 6270257 - DNA, 14 bp, Homo sapiens
gcatgcaatttgaa

SEQ ID NO: 6270258 - DNA, 21 bp, Homo sapiens
gcatgcacacggctggtcact

SEQ ID NO: 6270259 - DNA, 16 bp, Homo sapiens
gcatgcacactgagaa

SEQ ID NO: 6270260 - DNA, 14 bp, Homo sapiens
gcatgcacagctgt

SEQ ID NO: 6270261 - DNA, 13 bp, Homo sapiens
gcatgcacgggca

SEQ ID NO: 6270262 - DNA, 18 bp, Homo sapiens
gcatgcacgggcatgcac

SEQ ID NO: 6270263 - DNA, 21 bp, Homo sapiens
gcatgcacgggcatgcacacg

SEQ ID NO: 6270264 - DNA, 23 bp, Homo sapiens
gcatgcacgggcatgcacacggc

SEQ ID NO: 6270265 - DNA, 24 bp, Homo sapiens
gcatgcacgggcatgcacacggct

SEQ ID NO: 6270266 - DNA, 22 bp, Homo sapiens
gcatgcactgttccccctgtgc

SEQ ID NO: 6270267 - DNA, 13 bp, Homo sapiens
gcatgcagaaagg

SEQ ID NO: 6270268 - DNA, 18 bp, Homo sapiens
gcatgcagaaagggagca

SEQ ID NO: 6270269 - DNA, 13 bp, Homo sapiens
gcatgcagcagct

SEQ ID NO: 6270270 - DNA, 22 bp, Homo sapiens
gcatgcagcagcttgctgcacc

SEQ ID NO: 6270271 - DNA, 16 bp, Homo sapiens
gcatgcaggctgtgtt

SEQ ID NO: 6270272 - DNA, 15 bp, Homo sapiens
gcatgcataaatcaa

SEQ ID NO: 6270273 - DNA, 15 bp, Homo sapiens
gcatgcatggaggac

SEQ ID NO: 6270274 - DNA, 21 bp, Homo sapiens
gcatgcatggaggactctcct

SEQ ID NO: 6270275 - DNA, 16 bp, Homo sapiens
gcatgcattgagctgc

SEQ ID NO: 6270276 - DNA, 18 bp, Homo sapiens
gcatgcattgagctgcct

SEQ ID NO: 6270277 - DNA, 19 bp, Homo sapiens
gcatgcattgagctgcctc

SEQ ID NO: 6270278 - DNA, 23 bp, Homo sapiens
gcatgcattgagctgcctccagc

SEQ ID NO: 6270279 - DNA, 19 bp, Homo sapiens
gcatgcatttagcatgagt

SEQ ID NO: 6270280 - DNA, 15 bp, Homo sapiens
gctgggcagacaggt

SEQ ID NO: 6270281 - DNA, 22 bp, Homo sapiens
gctgggcagagcctgtgtgaaa

SEQ ID NO: 6270282 - DNA, 16 bp, Homo sapiens
gctgggcagaggaaag

SEQ ID NO: 6270283 - DNA, 19 bp, Homo sapiens
gctgggcagaggaaagcaa

SEQ ID NO: 6270284 - DNA, 17 bp, Homo sapiens
gctgggcagaggggaga

SEQ ID NO: 6270285 - DNA, 20 bp, Homo sapiens
gctgggcagaggggagagga

SEQ ID NO: 6270286 - DNA, 21 bp, Homo sapiens
gctgggcagcacaaggccttg

SEQ ID NO: 6270287 - DNA, 16 bp, Homo sapiens
gctgggcagccccaga

SEQ ID NO: 6270288 - DNA, 17 bp, Homo sapiens
gctgggcagccccagag

SEQ ID NO: 6270289 - DNA, 13 bp, Homo sapiens
gctgggcagcccg

SEQ ID NO: 6270290 - DNA, 15 bp, Homo sapiens
gctgggcagccttgg

SEQ ID NO: 6270291 - DNA, 13 bp, Homo sapiens
gctgggcagggcc

SEQ ID NO: 6270292 - DNA, 14 bp, Homo sapiens
gctgggcagggccc

SEQ ID NO: 6270293 - DNA, 19 bp, Homo sapiens
gctgggcagggccctgtgg

SEQ ID NO: 6270294 - DNA, 15 bp, Homo sapiens
gctgggcagggccgc

SEQ ID NO: 6270295 - DNA, 17 bp, Homo sapiens
gctgggcagggccgcag

SEQ ID NO: 6270296 - DNA, 21 bp, Homo sapiens
gctgggcagggccgcagggcg

SEQ ID NO: 6270297 - DNA, 15 bp, Homo sapiens
gctgggcagggcctg

SEQ ID NO: 6270298 - DNA, 19 bp, Homo sapiens
gctgggcagggcctggcgg

SEQ ID NO: 6270299 - DNA, 13 bp, Homo sapiens
gctgggcagggtg

SEQ ID NO: 6270300 - DNA, 14 bp, Homo sapiens
gctgggcagggtga

SEQ ID NO: 6270301 - DNA, 19 bp, Homo sapiens
gctgggcagggtgagaagc

SEQ ID NO: 6270302 - DNA, 14 bp, Homo sapiens
gctgggcagttttt

SEQ ID NO: 6270303 - DNA, 22 bp, Homo sapiens
gctgggcatggtaccagccctg

SEQ ID NO: 6270304 - DNA, 19 bp, Homo sapiens
gctgggccaactccagtga

SEQ ID NO: 6270305 - DNA, 20 bp, Homo sapiens
gctgggccactcctcttcac

SEQ ID NO: 6270306 - DNA, 13 bp, Homo sapiens
gctgggccactgg

SEQ ID NO: 6270307 - DNA, 23 bp, Homo sapiens
gctgggccagcctcagctcagcc

SEQ ID NO: 6270308 - DNA, 12 bp, Homo sapiens
gctgggccagtg

SEQ ID NO: 6270309 - DNA, 15 bp, Homo sapiens
gctgggccagtggca

SEQ ID NO: 6270310 - DNA, 19 bp, Homo sapiens
gctgggcccaaaggcccag

SEQ ID NO: 6270311 - DNA, 21 bp, Homo sapiens
gctgggcccaaaggcccaggg

SEQ ID NO: 6270312 - DNA, 23 bp, Homo sapiens
gctgggcccaaaggcccagggag

SEQ ID NO: 6270313 - DNA, 15 bp, Homo sapiens
gctgggcccacagcc

SEQ ID NO: 6270314 - DNA, 20 bp, Homo sapiens
gctgggcccacccaagcagg

SEQ ID NO: 6270315 - DNA, 19 bp, Homo sapiens
gctgggcccacccagggag

SEQ ID NO: 6270316 - DNA, 16 bp, Homo sapiens
gctgggcccagaggca

SEQ ID NO: 6270317 - DNA, 12 bp, Homo sapiens
gctgggcccagc

SEQ ID NO: 6270318 - DNA, 13 bp, Homo sapiens
gctgggcccagca

SEQ ID NO: 6270319 - DNA, 16 bp, Homo sapiens
gctgggcccagcccct

SEQ ID NO: 6270320 - DNA, 17 bp, Homo sapiens
gctgggccccagcccac

SEQ ID NO: 6270321 - DNA, 20 bp, Homo sapiens
gctgggccccagcccaccct

SEQ ID NO: 6270322 - DNA, 19 bp, Homo sapiens
gctgggccccatctccaca

SEQ ID NO: 6270323 - DNA, 19 bp, Homo sapiens
gctgggccccatgctctgc

SEQ ID NO: 6270324 - DNA, 22 bp, Homo sapiens
gctgggccccatgctctgcccc

SEQ ID NO: 6270325 - DNA, 20 bp, Homo sapiens
gctgggcccccagcctggcc

SEQ ID NO: 6270326 - DNA, 17 bp, Homo sapiens
gctgggccccccagctc

SEQ ID NO: 6270327 - DNA, 12 bp, Homo sapiens
gctgggcccctc

SEQ ID NO: 6270328 - DNA, 20 bp, Homo sapiens
gctgggcccctgcacaggca

SEQ ID NO: 6270329 - DNA, 18 bp, Homo sapiens
gctgggcccctgcctctc

SEQ ID NO: 6270330 - DNA, 21 bp, Homo sapiens
gctgggcccctgcctctctgc

SEQ ID NO: 6270331 - DNA, 15 bp, Homo sapiens
gctgggcccctggga

SEQ ID NO: 6270332 - DNA, 22 bp, Homo sapiens
gctgggcccgacatggctccgg

SEQ ID NO: 6270333 - DNA, 15 bp, Homo sapiens
gctgggccctctctt

SEQ ID NO: 6270334 - DNA, 18 bp, Homo sapiens
gctgggccctctcttctc

SEQ ID NO: 6270335 - DNA, 19 bp, Homo sapiens
gctgggccctctttccctg

SEQ ID NO: 6270336 - DNA, 24 bp, Homo sapiens
gctgggccctctttccctgcgaga

SEQ ID NO: 6270337 - DNA, 14 bp, Homo sapiens
gctgggccctgcct

SEQ ID NO: 6270338 - DNA, 20 bp, Homo sapiens
gctgggccctgcctgcagcc

SEQ ID NO: 6270339 - DNA, 17 bp, Homo sapiens
gctgggcccttcctggc

SEQ ID NO: 6270340 - DNA, 18 bp, Homo sapiens
gctgggcccttcctggct

SEQ ID NO: 6270341 - DNA, 20 bp, Homo sapiens
gctgggcccttcctggctag

SEQ ID NO: 6270342 - DNA, 22 bp, Homo sapiens
gctgggcccttcctggctagga

SEQ ID NO: 6270343 - DNA, 15 bp, Homo sapiens
gctgggccggccagc

SEQ ID NO: 6270344 - DNA, 16 bp, Homo sapiens
gctgggccggccagcc

SEQ ID NO: 6270345 - DNA, 19 bp, Homo sapiens
gctgggcctcccctgggca

SEQ ID NO: 6270346 - DNA, 13 bp, Homo sapiens
gctgggcctcctg

SEQ ID NO: 6270347 - DNA, 14 bp, Homo sapiens
gctgggcctccttc

SEQ ID NO: 6270348 - DNA, 12 bp, Homo sapiens
gctgggcctctg

SEQ ID NO: 6270349 - DNA, 19 bp, Homo sapiens
gctgggcctgggcttccac

SEQ ID NO: 6270350 - DNA, 13 bp, Homo sapiens
gctgggcctgtgc

SEQ ID NO: 6270351 - DNA, 17 bp, Homo sapiens
gctgggcctgtgcactg

SEQ ID NO: 6270352 - DNA, 21 bp, Homo sapiens
gctgggcctgtgcactgggca

SEQ ID NO: 6270353 - DNA, 21 bp, Homo sapiens
gctgggcgcctctgtcctggc

SEQ ID NO: 6270354 - DNA, 17 bp, Homo sapiens
gctgggcggctgtgctt

SEQ ID NO: 6270355 - DNA, 18 bp, Homo sapiens
gctgggcgtgtgtgacac

SEQ ID NO: 6270356 - DNA, 20 bp, Homo sapiens
gctgggctacaaaccaggag

SEQ ID NO: 6270357 - DNA, 22 bp, Homo sapiens
gctgggctaccccccctcctgc

SEQ ID NO: 6270358 - DNA, 17 bp, Homo sapiens
gctgggctaggcatagg

SEQ ID NO: 6270359 - DNA, 13 bp, Homo sapiens
gctgggctcccgt

SEQ ID NO: 6270360 - DNA, 12 bp, Homo sapiens
gctgggctccct

SEQ ID NO: 6270361 - DNA, 20 bp, Homo sapiens
gctgggctccctgatgacac

SEQ ID NO: 6270362 - DNA, 20 bp, Homo sapiens
gctgggctcccttcccacct

SEQ ID NO: 6270363 - DNA, 21 bp, Homo sapiens
gctgggctcccttcccacctc

SEQ ID NO: 6270364 - DNA, 13 bp, Homo sapiens
gctgggctctcca

SEQ ID NO: 6270365 - DNA, 14 bp, Homo sapiens
gctgggctctgcca

SEQ ID NO: 6270366 - DNA, 15 bp, Homo sapiens
gctgggctctgccac

SEQ ID NO: 6270367 - DNA, 19 bp, Homo sapiens
gctgggctctgtcttcctg

SEQ ID NO: 6270368 - DNA, 14 bp, Homo sapiens
gctgggctgagccc

SEQ ID NO: 6270369 - DNA, 19 bp, Homo sapiens
gctgggctgagcccctacc

SEQ ID NO: 6270370 - DNA, 22 bp, Homo sapiens
gctgggctgagcccctacccca

SEQ ID NO: 6270371 - DNA, 14 bp, Homo sapiens
gctgggctgagtga

SEQ ID NO: 6270372 - DNA, 17 bp, Homo sapiens
gctgggctgctcctgaa

SEQ ID NO: 6270373 - DNA, 13 bp, Homo sapiens
gctgggctgggca

SEQ ID NO: 6270374 - DNA, 15 bp, Homo sapiens
gctgggctgggccct

SEQ ID NO: 6270375 - DNA, 18 bp, Homo sapiens
gctgggctgggccctctt

SEQ ID NO: 6270376 - DNA, 13 bp, Homo sapiens
gctgggctgggct

SEQ ID NO: 6270377 - DNA, 15 bp, Homo sapiens
gctgggctgggctga

SEQ ID NO: 6270378 - DNA, 18 bp, Homo sapiens
gctgggctgggctgggct

SEQ ID NO: 6270379 - DNA, 12 bp, Homo sapiens
gctgggctgggg

SEQ ID NO: 6270380 - DNA, 17 bp, Homo sapiens
gctgggctggggcctga

SEQ ID NO: 6270381 - DNA, 15 bp, Homo sapiens
gctgggctgggtgcg

SEQ ID NO: 6270382 - DNA, 14 bp, Homo sapiens
gctgggctgggtgg

SEQ ID NO: 6270383 - DNA, 15 bp, Homo sapiens
gctgggcttacaggc

SEQ ID NO: 6270384 - DNA, 22 bp, Homo sapiens
gctgggcttcagtggcagctgc

SEQ ID NO: 6270385 - DNA, 21 bp, Homo sapiens
gctgggcttctgtccaaggca

SEQ ID NO: 6270386 - DNA, 19 bp, Homo sapiens
gctgggcttggcctggaga

SEQ ID NO: 6270387 - DNA, 21 bp, Homo sapiens
gctggggaagaacagccccgg

SEQ ID NO: 6270388 - DNA, 22 bp, Homo sapiens
gctggggaagaggactgtgtga

SEQ ID NO: 6270389 - DNA, 13 bp, Homo sapiens
gctggggaaggaa

SEQ ID NO: 6270390 - DNA, 13 bp, Homo sapiens
gctggggacagct

SEQ ID NO: 6270391 - DNA, 18 bp, Homo sapiens
gctggggaccggttccca

SEQ ID NO: 6270392 - DNA, 16 bp, Homo sapiens
gctggggacctggtac

SEQ ID NO: 6270393 - DNA, 16 bp, Homo sapiens
gctggggactcaggga

SEQ ID NO: 6270394 - DNA, 16 bp, Homo sapiens
gctggggactctggca

SEQ ID NO: 6270395 - DNA, 19 bp, Homo sapiens
gctggggactctggcacag

SEQ ID NO: 6270396 - DNA, 17 bp, Homo sapiens
gctggggagcagctgag

SEQ ID NO: 6270397 - DNA, 16 bp, Homo sapiens
gctggggaggaggaga

SEQ ID NO: 6270398 - DNA, 21 bp, Homo sapiens
gctggggatccccgcctggcc

SEQ ID NO: 6270399 - DNA, 14 bp, Homo sapiens
gctggggatgtctc

SEQ ID NO: 6270400 - DNA, 20 bp, Homo sapiens
gctggggcaaggggcagcca

SEQ ID NO: 6270401 - DNA, 13 bp, Homo sapiens
gctggggcagagt

SEQ ID NO: 6270402 - DNA, 23 bp, Homo sapiens
gctggggcagagtggagcccagg

SEQ ID NO: 6270403 - DNA, 17 bp, Homo sapiens
gctggggcagggcccag

SEQ ID NO: 6270404 - DNA, 22 bp, Homo sapiens
gctggggcagggcccagggagg

SEQ ID NO: 6270405 - DNA, 23 bp, Homo sapiens
gctggggcagggcccagggaggt

SEQ ID NO: 6270406 - DNA, 17 bp, Homo sapiens
gctggggcaggggcctg

SEQ ID NO: 6270407 - DNA, 20 bp, Homo sapiens
gctggggcaggggcctgggc

SEQ ID NO: 6270408 - DNA, 19 bp, Homo sapiens
gctggggcatggcaggctg

SEQ ID NO: 6270409 - DNA, 13 bp, Homo sapiens
gctggggccacca

SEQ ID NO: 6270410 - DNA, 20 bp, Homo sapiens
gctggggccaccctggcccg

SEQ ID NO: 6270411 - DNA, 19 bp, Homo sapiens
gctggggccacctttgtgc

SEQ ID NO: 6270412 - DNA, 13 bp, Homo sapiens
gctggggccagag

SEQ ID NO: 6270413 - DNA, 18 bp, Homo sapiens
gctggggccagaggctgg

SEQ ID NO: 6270414 - DNA, 16 bp, Homo sapiens
gctggggccaggcccc

SEQ ID NO: 6270415 - DNA, 16 bp, Homo sapiens
gctggggccaggctgg

SEQ ID NO: 6270416 - DNA, 19 bp, Homo sapiens
gctggggccaggctgggtc

SEQ ID NO: 6270417 - DNA, 16 bp, Homo sapiens
gctggggccagggcag

SEQ ID NO: 6270418 - DNA, 12 bp, Homo sapiens
gctggggccagt

SEQ ID NO: 6270419 - DNA, 14 bp, Homo sapiens
gctggggccccatc

SEQ ID NO: 6270420 - DNA, 14 bp, Homo sapiens
gctggggccgccac

SEQ ID NO: 6270421 - DNA, 22 bp, Homo sapiens
gctggggccgccacggcctggc

SEQ ID NO: 6270422 - DNA, 21 bp, Homo sapiens
gctggggcctatcagtgtgcc

SEQ ID NO: 6270423 - DNA, 16 bp, Homo sapiens
gctggggcctcagacc

SEQ ID NO: 6270424 - DNA, 17 bp, Homo sapiens
gctggggcctcagacga

SEQ ID NO: 6270425 - DNA, 19 bp, Homo sapiens
gctggggcctgatggggag

SEQ ID NO: 6270426 - DNA, 12 bp, Homo sapiens
gctggggcctgg

SEQ ID NO: 6270427 - DNA, 15 bp, Homo sapiens
gctggggcctggaga

SEQ ID NO: 6270428 - DNA, 16 bp, Homo sapiens
gctggggcctggaggc

SEQ ID NO: 6270429 - DNA, 16 bp, Homo sapiens
gctggggcctggccta

SEQ ID NO: 6270430 - DNA, 17 bp, Homo sapiens
gctggggcggagctggg

SEQ ID NO: 6270431 - DNA, 18 bp, Homo sapiens
gctggggcgtggggaggg

SEQ ID NO: 6270432 - DNA, 11 bp, Homo sapiens
gctggggctgc

SEQ ID NO: 6270433 - DNA, 15 bp, Homo sapiens
gctggggctgccagc

SEQ ID NO: 6270434 - DNA, 18 bp, Homo sapiens
gctggggctgccagcctg

SEQ ID NO: 6270435 - DNA, 16 bp, Homo sapiens
gctggggctggtgagg

SEQ ID NO: 6270436 - DNA, 18 bp, Homo sapiens
gctggggcttttgtgcca

SEQ ID NO: 6270437 - DNA, 20 bp, Homo sapiens
gctgggggaatgagcccaga

SEQ ID NO: 6270438 - DNA, 22 bp, Homo sapiens
gctgggggaatgagcccagaga

SEQ ID NO: 6270439 - DNA, 13 bp, Homo sapiens
gctgggggagcct

SEQ ID NO: 6270440 - DNA, 21 bp, Homo sapiens
gctgggggaggtccaagcaga

SEQ ID NO: 6270441 - DNA, 14 bp, Homo sapiens
gctgggggcaactg

SEQ ID NO: 6270442 - DNA, 19 bp, Homo sapiens
gctgggggcacagctgtct

SEQ ID NO: 6270443 - DNA, 13 bp, Homo sapiens
gctgggggcagga

SEQ ID NO: 6270444 - DNA, 20 bp, Homo sapiens
gctgggggcaggagggccct

SEQ ID NO: 6270445 - DNA, 22 bp, Homo sapiens
gctgggggccagggctggatgg

SEQ ID NO: 6270446 - DNA, 20 bp, Homo sapiens
gctgggggcctcactccagg

SEQ ID NO: 6270447 - DNA, 20 bp, Homo sapiens
gctgggggcctcagtgccac

SEQ ID NO: 6270448 - DNA, 15 bp, Homo sapiens
gctgggggctatgta

SEQ ID NO: 6270449 - DNA, 13 bp, Homo sapiens
gctgggggctccc

SEQ ID NO: 6270450 - DNA, 20 bp, Homo sapiens
gctgggggctccccttgccc

SEQ ID NO: 6270451 - DNA, 15 bp, Homo sapiens
gctgggggctgcagg

SEQ ID NO: 6270452 - DNA, 17 bp, Homo sapiens
gctgggggctgcagggc

SEQ ID NO: 6270453 - DNA, 19 bp, Homo sapiens
gctgggggctgcagggctg

SEQ ID NO: 6270454 - DNA, 19 bp, Homo sapiens
gctgggggctggacctgct

SEQ ID NO: 6270455 - DNA, 14 bp, Homo sapiens
gctggggggatgac

SEQ ID NO: 6270456 - DNA, 18 bp, Homo sapiens
gctggggggcagggggga

SEQ ID NO: 6270457 - DNA, 16 bp, Homo sapiens
gctggggggtctcagc

SEQ ID NO: 6270458 - DNA, 19 bp, Homo sapiens
gctggggggttggcagccc

SEQ ID NO: 6270459 - DNA, 15 bp, Homo sapiens
gcatgcattttgcag

SEQ ID NO: 6270460 - DNA, 18 bp, Homo sapiens
gcatgccaacaagaatgc

SEQ ID NO: 6270461 - DNA, 23 bp, Homo sapiens
gcatgccacgccccgtgtctgga

SEQ ID NO: 6270462 - DNA, 11 bp, Homo sapiens
gcatgccaggc

SEQ ID NO: 6270463 - DNA, 15 bp, Homo sapiens
gcatgccaggctggg

SEQ ID NO: 6270464 - DNA, 17 bp, Homo sapiens
gcatgccatctccaccc

SEQ ID NO: 6270465 - DNA, 19 bp, Homo sapiens
gcatgcccagagacccagc

SEQ ID NO: 6270466 - DNA, 20 bp, Homo sapiens
gcatgcccagagacccagcg

SEQ ID NO: 6270467 - DNA, 13 bp, Homo sapiens
gcatgccccaccc

SEQ ID NO: 6270468 - DNA, 15 bp, Homo sapiens
gcatgccccctcgtg

SEQ ID NO: 6270469 - DNA, 14 bp, Homo sapiens
gcatgccccggcca

SEQ ID NO: 6270470 - DNA, 17 bp, Homo sapiens
gcatgccccggccacct

SEQ ID NO: 6270471 - DNA, 19 bp, Homo sapiens
gcatgccccggccacctct

SEQ ID NO: 6270472 - DNA, 13 bp, Homo sapiens
gcatgccccttgg

SEQ ID NO: 6270473 - DNA, 15 bp, Homo sapiens
gcatgccccttggct

SEQ ID NO: 6270474 - DNA, 17 bp, Homo sapiens
gcatgccccttggctgg

SEQ ID NO: 6270475 - DNA, 17 bp, Homo sapiens
gcatgccctctctgagt

SEQ ID NO: 6270476 - DNA, 16 bp, Homo sapiens
gcatgcctcagccagc

SEQ ID NO: 6270477 - DNA, 14 bp, Homo sapiens
gcatgcctcccagg

SEQ ID NO: 6270478 - DNA, 22 bp, Homo sapiens
gcatgcctggatggggctgcac

SEQ ID NO: 6270479 - DNA, 14 bp, Homo sapiens
gcatgcctggcccc

SEQ ID NO: 6270480 - DNA, 18 bp, Homo sapiens
gcatgcctggcccctcct

SEQ ID NO: 6270481 - DNA, 22 bp, Homo sapiens
gcatgcctgggaatcctgctgc

SEQ ID NO: 6270482 - DNA, 21 bp, Homo sapiens
gcatgcctgtaatcccagaac

SEQ ID NO: 6270483 - DNA, 22 bp, Homo sapiens
gcatgcctgtaatcccagaact

SEQ ID NO: 6270484 - DNA, 15 bp, Homo sapiens
gcatgcctgtgtgac

SEQ ID NO: 6270485 - DNA, 12 bp, Homo sapiens
gcatgccttgtg

SEQ ID NO: 6270486 - DNA, 21 bp, Homo sapiens
gcatgcgaaatgttctcatga

SEQ ID NO: 6270487 - DNA, 22 bp, Homo sapiens
gcatgcgaaatgttctcatgaa

SEQ ID NO: 6270488 - DNA, 17 bp, Homo sapiens
gcatgcgaatgagctgg

SEQ ID NO: 6270489 - DNA, 19 bp, Homo sapiens
gcatgcgattatctaccca

SEQ ID NO: 6270490 - DNA, 14 bp, Homo sapiens
gcatgcgcacaagg

SEQ ID NO: 6270491 - DNA, 13 bp, Homo sapiens
gcatgcgcaggct

SEQ ID NO: 6270492 - DNA, 14 bp, Homo sapiens
gcatgcgcaggctc

SEQ ID NO: 6270493 - DNA, 17 bp, Homo sapiens
gcatgcgcccgaggcag

SEQ ID NO: 6270494 - DNA, 13 bp, Homo sapiens
gcatgcggcccag

SEQ ID NO: 6270495 - DNA, 14 bp, Homo sapiens
gcatgcggcccagc

SEQ ID NO: 6270496 - DNA, 18 bp, Homo sapiens
gcatgcgggcttcctcct

SEQ ID NO: 6270497 - DNA, 14 bp, Homo sapiens
gcatgctcaaatga

SEQ ID NO: 6270498 - DNA, 14 bp, Homo sapiens
gcatgctcagccct

SEQ ID NO: 6270499 - DNA, 22 bp, Homo sapiens
gcatgctcagcccttcctagaa

SEQ ID NO: 6270500 - DNA, 14 bp, Homo sapiens
gcatgctcagtatt

SEQ ID NO: 6270501 - DNA, 17 bp, Homo sapiens
gcatgctcagtgccttt

SEQ ID NO: 6270502 - DNA, 14 bp, Homo sapiens
gcatgctcccagca

SEQ ID NO: 6270503 - DNA, 20 bp, Homo sapiens
gcatgctccctcatgcagat

SEQ ID NO: 6270504 - DNA, 15 bp, Homo sapiens
gcatgctcctctgcc

SEQ ID NO: 6270505 - DNA, 17 bp, Homo sapiens
gcatgctcctctgcctg

SEQ ID NO: 6270506 - DNA, 21 bp, Homo sapiens
gcatgctcctctgcctgtgcc

SEQ ID NO: 6270507 - DNA, 15 bp, Homo sapiens
gcatgctctctgcag

SEQ ID NO: 6270508 - DNA, 21 bp, Homo sapiens
gcatgctctctgcagccagcc

SEQ ID NO: 6270509 - DNA, 22 bp, Homo sapiens
gcatgctctctgcagccagccc

SEQ ID NO: 6270510 - DNA, 15 bp, Homo sapiens
gcatgctgcccagcc

SEQ ID NO: 6270511 - DNA, 21 bp, Homo sapiens
gcatgctgcctgagtattact

SEQ ID NO: 6270512 - DNA, 14 bp, Homo sapiens
gcatgctgcctgcc

SEQ ID NO: 6270513 - DNA, 13 bp, Homo sapiens
gcatgctgcttta

SEQ ID NO: 6270514 - DNA, 16 bp, Homo sapiens
gcatgctggcctgtgg

SEQ ID NO: 6270515 - DNA, 19 bp, Homo sapiens
gcatgctggcctgtggcag

SEQ ID NO: 6270516 - DNA, 20 bp, Homo sapiens
gcatgctggcctgtggcagg

SEQ ID NO: 6270517 - DNA, 23 bp, Homo sapiens
gcatgctggcctgtggcaggcct

SEQ ID NO: 6270518 - DNA, 16 bp, Homo sapiens
gcatgctggggcaagt

SEQ ID NO: 6270519 - DNA, 14 bp, Homo sapiens
gcatgctgtagctg

SEQ ID NO: 6270520 - DNA, 20 bp, Homo sapiens
gcatgctgtagctgcagcct

SEQ ID NO: 6270521 - DNA, 13 bp, Homo sapiens
gcatgcttagagc

SEQ ID NO: 6270522 - DNA, 17 bp, Homo sapiens
gcatgcttagagcatgt

SEQ ID NO: 6270523 - DNA, 23 bp, Homo sapiens
gcatgcttattagcagctgggtt

SEQ ID NO: 6270524 - DNA, 16 bp, Homo sapiens
gcatgcttccctgcag

SEQ ID NO: 6270525 - DNA, 20 bp, Homo sapiens
gcatgcttccctgcagctga

SEQ ID NO: 6270526 - DNA, 22 bp, Homo sapiens
gcatgcttccctgcagctgacc

SEQ ID NO: 6270527 - DNA, 18 bp, Homo sapiens
gcatgcttcctttctctc

SEQ ID NO: 6270528 - DNA, 23 bp, Homo sapiens
gcatgcttcctttctctcctggc

SEQ ID NO: 6270529 - DNA, 15 bp, Homo sapiens
gcatgcttgggctga

SEQ ID NO: 6270530 - DNA, 14 bp, Homo sapiens
gcatgctttgctgc

SEQ ID NO: 6270531 - DNA, 15 bp, Homo sapiens
gcatgctttgctgct

SEQ ID NO: 6270532 - DNA, 17 bp, Homo sapiens
gcatgctttgctgctat

SEQ ID NO: 6270533 - DNA, 16 bp, Homo sapiens
gcatggaaaaatggtt

SEQ ID NO: 6270534 - DNA, 17 bp, Homo sapiens
gcatggaaaatcagtga

SEQ ID NO: 6270535 - DNA, 17 bp, Homo sapiens
gcatggaaagatgggga

SEQ ID NO: 6270536 - DNA, 17 bp, Homo sapiens
gcatggaaatttaaagc

SEQ ID NO: 6270537 - DNA, 19 bp, Homo sapiens
gcatggaaatttaaagcag

SEQ ID NO: 6270538 - DNA, 19 bp, Homo sapiens
gcatggaagtaattaaggt

SEQ ID NO: 6270539 - DNA, 17 bp, Homo sapiens
gcatggaatttgtaagt

SEQ ID NO: 6270540 - DNA, 14 bp, Homo sapiens
gcatggacaatgga

SEQ ID NO: 6270541 - DNA, 23 bp, Homo sapiens
gcatggacaccccttatccagga

SEQ ID NO: 6270542 - DNA, 22 bp, Homo sapiens
gcatggacagggccagggttgc

SEQ ID NO: 6270543 - DNA, 11 bp, Homo sapiens
gcatggacagt

SEQ ID NO: 6270544 - DNA, 20 bp, Homo sapiens
gcatggacatttagaagaaa

SEQ ID NO: 6270545 - DNA, 18 bp, Homo sapiens
gcatggaccgcaggaggg

SEQ ID NO: 6270546 - DNA, 15 bp, Homo sapiens
gcatggacgcctggc

SEQ ID NO: 6270547 - DNA, 17 bp, Homo sapiens
gcatggacgcctggctc

SEQ ID NO: 6270548 - DNA, 18 bp, Homo sapiens
gcatggacgcctggctcc

SEQ ID NO: 6270549 - DNA, 22 bp, Homo sapiens
gcatggacgcctggctccaggc

SEQ ID NO: 6270550 - DNA, 14 bp, Homo sapiens
gcatggagaacagt

SEQ ID NO: 6270551 - DNA, 12 bp, Homo sapiens
gcatggagaagg

SEQ ID NO: 6270552 - DNA, 13 bp, Homo sapiens
gcatggagaatgg

SEQ ID NO: 6270553 - DNA, 15 bp, Homo sapiens
gcatggagacagcag

SEQ ID NO: 6270554 - DNA, 13 bp, Homo sapiens
gcatggagactct

SEQ ID NO: 6270555 - DNA, 19 bp, Homo sapiens
gcatggagagcctcttagt

SEQ ID NO: 6270556 - DNA, 14 bp, Homo sapiens
gcatggagcctgga

SEQ ID NO: 6270557 - DNA, 18 bp, Homo sapiens
gcatggagctgtcacctc

SEQ ID NO: 6270558 - DNA, 22 bp, Homo sapiens
gcatggagctgtcacctctcag

SEQ ID NO: 6270559 - DNA, 19 bp, Homo sapiens
gcatggaggactctcctct

SEQ ID NO: 6270560 - DNA, 15 bp, Homo sapiens
gcatggaggaggagg

SEQ ID NO: 6270561 - DNA, 18 bp, Homo sapiens
gcatggagtgtgtattgt

SEQ ID NO: 6270562 - DNA, 19 bp, Homo sapiens
gcatggagtgtgtattgtt

SEQ ID NO: 6270563 - DNA, 14 bp, Homo sapiens
gcatggatgcattt

SEQ ID NO: 6270564 - DNA, 19 bp, Homo sapiens
gcatggatgcatttcaaat

SEQ ID NO: 6270565 - DNA, 15 bp, Homo sapiens
gcatggatttctgtc

SEQ ID NO: 6270566 - DNA, 15 bp, Homo sapiens
gcatggatttctttg

SEQ ID NO: 6270567 - DNA, 16 bp, Homo sapiens
gcatggcaattctgga

SEQ ID NO: 6270568 - DNA, 18 bp, Homo sapiens
gcatggcaattctggaag

SEQ ID NO: 6270569 - DNA, 19 bp, Homo sapiens
gcatggcaattctggaagc

SEQ ID NO: 6270570 - DNA, 21 bp, Homo sapiens
gcatggcacctgtcgcccagt

SEQ ID NO: 6270571 - DNA, 18 bp, Homo sapiens
gcatggcagcaggcctgt

SEQ ID NO: 6270572 - DNA, 15 bp, Homo sapiens
gcatggcagctgggc

SEQ ID NO: 6270573 - DNA, 17 bp, Homo sapiens
gcatggcagctgggccc

SEQ ID NO: 6270574 - DNA, 18 bp, Homo sapiens
gcatggcagctgggccca

SEQ ID NO: 6270575 - DNA, 19 bp, Homo sapiens
gcatggcagggcctcatct

SEQ ID NO: 6270576 - DNA, 19 bp, Homo sapiens
gcatggcatcctccagccc

SEQ ID NO: 6270577 - DNA, 21 bp, Homo sapiens
gcatggcatcctccagcccct

SEQ ID NO: 6270578 - DNA, 15 bp, Homo sapiens
gcatggccacagcca

SEQ ID NO: 6270579 - DNA, 19 bp, Homo sapiens
gcatggccacagccacctc

SEQ ID NO: 6270580 - DNA, 20 bp, Homo sapiens
gcatggccagactattccct

SEQ ID NO: 6270581 - DNA, 17 bp, Homo sapiens
gcatggccaggtggcca

SEQ ID NO: 6270582 - DNA, 15 bp, Homo sapiens
gcatggcccagcctg

SEQ ID NO: 6270583 - DNA, 15 bp, Homo sapiens
gcatggccctgctgc

SEQ ID NO: 6270584 - DNA, 13 bp, Homo sapiens
gcatggccctggg

SEQ ID NO: 6270585 - DNA, 22 bp, Homo sapiens
gcatggccctggggtcccacga

SEQ ID NO: 6270586 - DNA, 22 bp, Homo sapiens
gcatggccgcaacttcccaggc

SEQ ID NO: 6270587 - DNA, 13 bp, Homo sapiens
gcatggcctccca

SEQ ID NO: 6270588 - DNA, 19 bp, Homo sapiens
gcatggcgccccgggccgc

SEQ ID NO: 6270589 - DNA, 23 bp, Homo sapiens
gcatggctcagagcttgaagatt

SEQ ID NO: 6270590 - DNA, 16 bp, Homo sapiens
gcatggcttggggagc

SEQ ID NO: 6270591 - DNA, 19 bp, Homo sapiens
gcatggcttggggagcaga

SEQ ID NO: 6270592 - DNA, 18 bp, Homo sapiens
gcatgggaaagccacctc

SEQ ID NO: 6270593 - DNA, 22 bp, Homo sapiens
gcatgggaaatagcggccctgg

SEQ ID NO: 6270594 - DNA, 23 bp, Homo sapiens
gcatgggaaatagcggccctgga

SEQ ID NO: 6270595 - DNA, 16 bp, Homo sapiens
gcatgggaatacaaaa

SEQ ID NO: 6270596 - DNA, 16 bp, Homo sapiens
gcatgggaatgaatgt

SEQ ID NO: 6270597 - DNA, 18 bp, Homo sapiens
gcatgggagggagggaga

SEQ ID NO: 6270598 - DNA, 16 bp, Homo sapiens
gcatgggagggggaga

SEQ ID NO: 6270599 - DNA, 17 bp, Homo sapiens
gcatgggccagcccctc

SEQ ID NO: 6270600 - DNA, 14 bp, Homo sapiens
gcatgggcctctct

SEQ ID NO: 6270601 - DNA, 17 bp, Homo sapiens
gcatgggcctctctggg

SEQ ID NO: 6270602 - DNA, 17 bp, Homo sapiens
gcatggggaggcagcag

SEQ ID NO: 6270603 - DNA, 22 bp, Homo sapiens
gcatggggagtacattcatctg

SEQ ID NO: 6270604 - DNA, 22 bp, Homo sapiens
gcatggggataaaggagaaggc

SEQ ID NO: 6270605 - DNA, 16 bp, Homo sapiens
gcatggggattgcaga

SEQ ID NO: 6270606 - DNA, 15 bp, Homo sapiens
gcatggggccaggaa

SEQ ID NO: 6270607 - DNA, 21 bp, Homo sapiens
gcatggggcccctggcccaga

SEQ ID NO: 6270608 - DNA, 22 bp, Homo sapiens
gcatggggcgctcccactcaga

SEQ ID NO: 6270609 - DNA, 18 bp, Homo sapiens
gcatggggctggggtcct

SEQ ID NO: 6270610 - DNA, 18 bp, Homo sapiens
gcatgggggaccccttcc

SEQ ID NO: 6270611 - DNA, 23 bp, Homo sapiens
gcatgggggcaccgggctccatg

SEQ ID NO: 6270612 - DNA, 14 bp, Homo sapiens
gcatgggggcccaa

SEQ ID NO: 6270613 - DNA, 17 bp, Homo sapiens
gcatgggggcccaaagg

SEQ ID NO: 6270614 - DNA, 15 bp, Homo sapiens
gcatgggggctgcca

SEQ ID NO: 6270615 - DNA, 16 bp, Homo sapiens
gcatgggggctgccag

SEQ ID NO: 6270616 - DNA, 18 bp, Homo sapiens
gcatggggggtgggggga

SEQ ID NO: 6270617 - DNA, 17 bp, Homo sapiens
gcatggggtcagcccca

SEQ ID NO: 6270618 - DNA, 19 bp, Homo sapiens
gcatggggtgggcctctgg

SEQ ID NO: 6270619 - DNA, 20 bp, Homo sapiens
gcatgggtccaagagacatg

SEQ ID NO: 6270620 - DNA, 21 bp, Homo sapiens
gcatgggtccagggcctgaca

SEQ ID NO: 6270621 - DNA, 23 bp, Homo sapiens
gcatgggtccttgatgccagagg

SEQ ID NO: 6270622 - DNA, 20 bp, Homo sapiens
gcatgggtcgggagagggga

SEQ ID NO: 6270623 - DNA, 17 bp, Homo sapiens
gcatgggtgagacctga

SEQ ID NO: 6270624 - DNA, 22 bp, Homo sapiens
gcatggtaccagccctggggct

SEQ ID NO: 6270625 - DNA, 22 bp, Homo sapiens
gcatggtcaaccctcaggggaa

SEQ ID NO: 6270626 - DNA, 20 bp, Homo sapiens
gcatggtcacaagcacaaag

SEQ ID NO: 6270627 - DNA, 18 bp, Homo sapiens
gcatggtcacacactgat

SEQ ID NO: 6270628 - DNA, 22 bp, Homo sapiens
gcatggtccattctcaagggac

SEQ ID NO: 6270629 - DNA, 20 bp, Homo sapiens
gcatggtcccacatccctgg

SEQ ID NO: 6270630 - DNA, 13 bp, Homo sapiens
gcatggtcctgtg

SEQ ID NO: 6270631 - DNA, 19 bp, Homo sapiens
gcatggtgaggtgaaagta

SEQ ID NO: 6270632 - DNA, 18 bp, Homo sapiens
gcatggtgccccaggacc

SEQ ID NO: 6270633 - DNA, 18 bp, Homo sapiens
gcatggtgcgggcacctg

SEQ ID NO: 6270634 - DNA, 14 bp, Homo sapiens
gcatggtgctttca

SEQ ID NO: 6270635 - DNA, 20 bp, Homo sapiens
gcatggtggcacgtgcctgt

SEQ ID NO: 6270636 - DNA, 18 bp, Homo sapiens
gcatggtggcatgtgcct

SEQ ID NO: 6270637 - DNA, 21 bp, Homo sapiens
gctggggggttggcagcccac

SEQ ID NO: 6270638 - DNA, 16 bp, Homo sapiens
gctgggggtagcctgg

SEQ ID NO: 6270639 - DNA, 21 bp, Homo sapiens
gctgggggtgaggggccaggc

SEQ ID NO: 6270640 - DNA, 18 bp, Homo sapiens
gctgggggtgggccaggc

SEQ ID NO: 6270641 - DNA, 15 bp, Homo sapiens
gctggggtacaggtt

SEQ ID NO: 6270642 - DNA, 12 bp, Homo sapiens
gctggggtccag

SEQ ID NO: 6270643 - DNA, 13 bp, Homo sapiens
gctggggtccagg

SEQ ID NO: 6270644 - DNA, 14 bp, Homo sapiens
gctggggtccaggg

SEQ ID NO: 6270645 - DNA, 19 bp, Homo sapiens
gctggggtctcaggtccag

SEQ ID NO: 6270646 - DNA, 17 bp, Homo sapiens
gctggggtctgggcagt

SEQ ID NO: 6270647 - DNA, 18 bp, Homo sapiens
gctggggtctgggcagtg

SEQ ID NO: 6270648 - DNA, 20 bp, Homo sapiens
gctggggtctgggcagtgcc

SEQ ID NO: 6270649 - DNA, 21 bp, Homo sapiens
gctggggtctgggcagtgcca

SEQ ID NO: 6270650 - DNA, 16 bp, Homo sapiens
gctggggtgagagagg

SEQ ID NO: 6270651 - DNA, 19 bp, Homo sapiens
gctggggtgagcctgactg

SEQ ID NO: 6270652 - DNA, 19 bp, Homo sapiens
gctggggtggcctgtgtgg

SEQ ID NO: 6270653 - DNA, 12 bp, Homo sapiens
gctggggtgtca

SEQ ID NO: 6270654 - DNA, 13 bp, Homo sapiens
gctggggtgtcaa

SEQ ID NO: 6270655 - DNA, 15 bp, Homo sapiens
gctggggttgccaga

SEQ ID NO: 6270656 - DNA, 18 bp, Homo sapiens
gctggggttgccagaggc

SEQ ID NO: 6270657 - DNA, 23 bp, Homo sapiens
gctggggttgccagaggccctgg

SEQ ID NO: 6270658 - DNA, 20 bp, Homo sapiens
gctggggtttttgttttgtt

SEQ ID NO: 6270659 - DNA, 21 bp, Homo sapiens
gctgggtaaactgtggatgat

SEQ ID NO: 6270660 - DNA, 22 bp, Homo sapiens
gctgggtaatgtgaaggcccaa

SEQ ID NO: 6270661 - DNA, 15 bp, Homo sapiens
gctgggtaccaggcc

SEQ ID NO: 6270662 - DNA, 16 bp, Homo sapiens
gctgggtaccaggcca

SEQ ID NO: 6270663 - DNA, 23 bp, Homo sapiens
gctgggtattggaaatggatgca

SEQ ID NO: 6270664 - DNA, 14 bp, Homo sapiens
gctgggtcacagga

SEQ ID NO: 6270665 - DNA, 13 bp, Homo sapiens
gctgggtcaggca

SEQ ID NO: 6270666 - DNA, 16 bp, Homo sapiens
gctgggtcaggcaggg

SEQ ID NO: 6270667 - DNA, 12 bp, Homo sapiens
gctgggtcaggg

SEQ ID NO: 6270668 - DNA, 16 bp, Homo sapiens
gctgggtcagggccag

SEQ ID NO: 6270669 - DNA, 13 bp, Homo sapiens
gctgggtccaggg

SEQ ID NO: 6270670 - DNA, 14 bp, Homo sapiens
gctgggtccagggg

SEQ ID NO: 6270671 - DNA, 17 bp, Homo sapiens
gctgggtcccgggtgcc

SEQ ID NO: 6270672 - DNA, 12 bp, Homo sapiens
gctgggtcctgc

SEQ ID NO: 6270673 - DNA, 19 bp, Homo sapiens
gctgggtccttgggcctgg

SEQ ID NO: 6270674 - DNA, 23 bp, Homo sapiens
gctgggtccttgggcctggccag

SEQ ID NO: 6270675 - DNA, 16 bp, Homo sapiens
gctgggtcgcccctcc

SEQ ID NO: 6270676 - DNA, 18 bp, Homo sapiens
gctgggtcgccctggact

SEQ ID NO: 6270677 - DNA, 19 bp, Homo sapiens
gctgggtcgccctggactg

SEQ ID NO: 6270678 - DNA, 18 bp, Homo sapiens
gctgggtctgaggcccct

SEQ ID NO: 6270679 - DNA, 23 bp, Homo sapiens
gctgggtctgaggcccctgcctc

SEQ ID NO: 6270680 - DNA, 16 bp, Homo sapiens
gctgggtgagctgaga

SEQ ID NO: 6270681 - DNA, 16 bp, Homo sapiens
gctgggtgccaggtgc

SEQ ID NO: 6270682 - DNA, 16 bp, Homo sapiens
gctgggtgcccacagc

SEQ ID NO: 6270683 - DNA, 14 bp, Homo sapiens
gctgggtgccccag

SEQ ID NO: 6270684 - DNA, 22 bp, Homo sapiens
gctgggtgccccagggacgtga

SEQ ID NO: 6270685 - DNA, 17 bp, Homo sapiens
gctgggtgccgggctgc

SEQ ID NO: 6270686 - DNA, 22 bp, Homo sapiens
gctgggtgcgaccccatctgcc

SEQ ID NO: 6270687 - DNA, 15 bp, Homo sapiens
gctgggtggcacacc

SEQ ID NO: 6270688 - DNA, 19 bp, Homo sapiens
gctgggtggcacaccaccc

SEQ ID NO: 6270689 - DNA, 22 bp, Homo sapiens
gctgggtggcaccagcagcctg

SEQ ID NO: 6270690 - DNA, 13 bp, Homo sapiens
gctgggtggccca

SEQ ID NO: 6270691 - DNA, 19 bp, Homo sapiens
gctgggtggccggccctgc

SEQ ID NO: 6270692 - DNA, 22 bp, Homo sapiens
gctgggtggtagatttcctcct

SEQ ID NO: 6270693 - DNA, 13 bp, Homo sapiens
gctgggtggtcag

SEQ ID NO: 6270694 - DNA, 16 bp, Homo sapiens
gctgggtggtcagcag

SEQ ID NO: 6270695 - DNA, 20 bp, Homo sapiens
gctgggtggttctctgggcc

SEQ ID NO: 6270696 - DNA, 16 bp, Homo sapiens
gctgggttcatttgtg

SEQ ID NO: 6270697 - DNA, 14 bp, Homo sapiens
gctgggttcccact

SEQ ID NO: 6270698 - DNA, 15 bp, Homo sapiens
gctgggttctaccca

SEQ ID NO: 6270699 - DNA, 17 bp, Homo sapiens
gctgggttctgactctg

SEQ ID NO: 6270700 - DNA, 23 bp, Homo sapiens
gctgggttctggggctgagagtg

SEQ ID NO: 6270701 - DNA, 21 bp, Homo sapiens
gctgggttggcgcaccctccc

SEQ ID NO: 6270702 - DNA, 17 bp, Homo sapiens
gctgggttgtcactgag

SEQ ID NO: 6270703 - DNA, 20 bp, Homo sapiens
gctgggtttagcccgaggct

SEQ ID NO: 6270704 - DNA, 21 bp, Homo sapiens
gctgggtttagcccgaggctg

SEQ ID NO: 6270705 - DNA, 20 bp, Homo sapiens
gctgggtttgctgtcttggg

SEQ ID NO: 6270706 - DNA, 14 bp, Homo sapiens
gctggtaaaatgaa

SEQ ID NO: 6270707 - DNA, 16 bp, Homo sapiens
gctggtaacagtggct

SEQ ID NO: 6270708 - DNA, 18 bp, Homo sapiens
gctggtaacagtggctgc

SEQ ID NO: 6270709 - DNA, 13 bp, Homo sapiens
gctggtaacagtt

SEQ ID NO: 6270710 - DNA, 16 bp, Homo sapiens
gctggtaacagttcat

SEQ ID NO: 6270711 - DNA, 15 bp, Homo sapiens
gctggtaagggccaa

SEQ ID NO: 6270712 - DNA, 16 bp, Homo sapiens
gctggtactttctgta

SEQ ID NO: 6270713 - DNA, 15 bp, Homo sapiens
gctggtagagacccc

SEQ ID NO: 6270714 - DNA, 18 bp, Homo sapiens
gctggtagagacccccag

SEQ ID NO: 6270715 - DNA, 21 bp, Homo sapiens
gctggtagagacccccaggcc

SEQ ID NO: 6270716 - DNA, 17 bp, Homo sapiens
gctggtagagatggagg

SEQ ID NO: 6270717 - DNA, 18 bp, Homo sapiens
gctggtagagatggagga

SEQ ID NO: 6270718 - DNA, 16 bp, Homo sapiens
gctggtagaggggaga

SEQ ID NO: 6270719 - DNA, 22 bp, Homo sapiens
gctggtagcataaataaaactg

SEQ ID NO: 6270720 - DNA, 18 bp, Homo sapiens
gctggtatattgtgtaaa

SEQ ID NO: 6270721 - DNA, 18 bp, Homo sapiens
gctggtattggtggcttt

SEQ ID NO: 6270722 - DNA, 13 bp, Homo sapiens
gctggtcacagcc

SEQ ID NO: 6270723 - DNA, 23 bp, Homo sapiens
gctggtcacccccacccccgggt

SEQ ID NO: 6270724 - DNA, 17 bp, Homo sapiens
gctggtcacctcccatc

SEQ ID NO: 6270725 - DNA, 20 bp, Homo sapiens
gctggtcacctcccatcccg

SEQ ID NO: 6270726 - DNA, 23 bp, Homo sapiens
gctggtcactaaccaacaaggtt

SEQ ID NO: 6270727 - DNA, 22 bp, Homo sapiens
gctggtcactctgccctctgct

SEQ ID NO: 6270728 - DNA, 15 bp, Homo sapiens
gctggtcactgccat

SEQ ID NO: 6270729 - DNA, 14 bp, Homo sapiens
gctggtcacttctt

SEQ ID NO: 6270730 - DNA, 21 bp, Homo sapiens
gctggtcacttcttctgtcca

SEQ ID NO: 6270731 - DNA, 16 bp, Homo sapiens
gctggtcatcctgggc

SEQ ID NO: 6270732 - DNA, 16 bp, Homo sapiens
gctggtcatccttggt

SEQ ID NO: 6270733 - DNA, 13 bp, Homo sapiens
gctggtccagggc

SEQ ID NO: 6270734 - DNA, 15 bp, Homo sapiens
gctggtcccactcag

SEQ ID NO: 6270735 - DNA, 22 bp, Homo sapiens
gctggtcccctccctctgtctt

SEQ ID NO: 6270736 - DNA, 18 bp, Homo sapiens
gctggtcccctcctcagt

SEQ ID NO: 6270737 - DNA, 22 bp, Homo sapiens
gctggtccgagctgaggactct

SEQ ID NO: 6270738 - DNA, 15 bp, Homo sapiens
gctggtccgtgggac

SEQ ID NO: 6270739 - DNA, 19 bp, Homo sapiens
gctggtcctatggcctcat

SEQ ID NO: 6270740 - DNA, 14 bp, Homo sapiens
gctggtcctcccat

SEQ ID NO: 6270741 - DNA, 17 bp, Homo sapiens
gctggtcctgaccagga

SEQ ID NO: 6270742 - DNA, 23 bp, Homo sapiens
gctggtcctgaccaggatggagc

SEQ ID NO: 6270743 - DNA, 16 bp, Homo sapiens
gctggtcctgcacatg

SEQ ID NO: 6270744 - DNA, 16 bp, Homo sapiens
gctggtccttatttat

SEQ ID NO: 6270745 - DNA, 22 bp, Homo sapiens
gctggtcgtaaacatctcagag

SEQ ID NO: 6270746 - DNA, 23 bp, Homo sapiens
gctggtcgtaaacatctcagaga

SEQ ID NO: 6270747 - DNA, 20 bp, Homo sapiens
gctggtctattttgattttg

SEQ ID NO: 6270748 - DNA, 20 bp, Homo sapiens
gctggtctcaaactcctgac

SEQ ID NO: 6270749 - DNA, 22 bp, Homo sapiens
gctggtctcaaacttgtggcct

SEQ ID NO: 6270750 - DNA, 24 bp, Homo sapiens
gctggtctcaaacttgtggcctca

SEQ ID NO: 6270751 - DNA, 15 bp, Homo sapiens
gctggtctccctcca

SEQ ID NO: 6270752 - DNA, 16 bp, Homo sapiens
gctggtctccctccag

SEQ ID NO: 6270753 - DNA, 18 bp, Homo sapiens
gctggtctcgaactcctg

SEQ ID NO: 6270754 - DNA, 20 bp, Homo sapiens
gctggtctcgaactgctgga

SEQ ID NO: 6270755 - DNA, 16 bp, Homo sapiens
gctggtctctaggcct

SEQ ID NO: 6270756 - DNA, 16 bp, Homo sapiens
gctggtctctggctct

SEQ ID NO: 6270757 - DNA, 21 bp, Homo sapiens
gctggtctgaaacccttgagc

SEQ ID NO: 6270758 - DNA, 17 bp, Homo sapiens
gctggtctgccaggggc

SEQ ID NO: 6270759 - DNA, 19 bp, Homo sapiens
gctggtctggagtcccacc

SEQ ID NO: 6270760 - DNA, 20 bp, Homo sapiens
gctggtcttagatgcagcga

SEQ ID NO: 6270761 - DNA, 22 bp, Homo sapiens
gctggtcttcactttcctcagt

SEQ ID NO: 6270762 - DNA, 21 bp, Homo sapiens
gctggtcttgaactcctagac

SEQ ID NO: 6270763 - DNA, 18 bp, Homo sapiens
gctggtcttgaactcctg

SEQ ID NO: 6270764 - DNA, 20 bp, Homo sapiens
gctggtcttgaactcctgac

SEQ ID NO: 6270765 - DNA, 13 bp, Homo sapiens
gctggtcttttct

SEQ ID NO: 6270766 - DNA, 18 bp, Homo sapiens
gctggtgaacactgtgac

SEQ ID NO: 6270767 - DNA, 14 bp, Homo sapiens
gctggtgacagcct

SEQ ID NO: 6270768 - DNA, 15 bp, Homo sapiens
gctggtgacagcctt

SEQ ID NO: 6270769 - DNA, 13 bp, Homo sapiens
gctggtgactttg

SEQ ID NO: 6270770 - DNA, 21 bp, Homo sapiens
gctggtgactttggggacagg

SEQ ID NO: 6270771 - DNA, 23 bp, Homo sapiens
gctggtgagaccccgcactgcag

SEQ ID NO: 6270772 - DNA, 12 bp, Homo sapiens
gctggtgaggcc

SEQ ID NO: 6270773 - DNA, 19 bp, Homo sapiens
gctggtgatggaggtttca

SEQ ID NO: 6270774 - DNA, 21 bp, Homo sapiens
gctggtgatggaggtttcata

SEQ ID NO: 6270775 - DNA, 22 bp, Homo sapiens
gctggtgcattctgtttcctct

SEQ ID NO: 6270776 - DNA, 23 bp, Homo sapiens
gctggtgccaaatagccccagac

SEQ ID NO: 6270777 - DNA, 22 bp, Homo sapiens
gctggtgccagccttcctctgc

SEQ ID NO: 6270778 - DNA, 12 bp, Homo sapiens
gctggtgcccac

SEQ ID NO: 6270779 - DNA, 16 bp, Homo sapiens
gctggtgcccaccctt

SEQ ID NO: 6270780 - DNA, 13 bp, Homo sapiens
gctggtgcccatg

SEQ ID NO: 6270781 - DNA, 15 bp, Homo sapiens
gctggtgcccatgaa

SEQ ID NO: 6270782 - DNA, 16 bp, Homo sapiens
gctggtgccccacagc

SEQ ID NO: 6270783 - DNA, 16 bp, Homo sapiens
gctggtgccccacctg

SEQ ID NO: 6270784 - DNA, 13 bp, Homo sapiens
gctggtgccccca

SEQ ID NO: 6270785 - DNA, 14 bp, Homo sapiens
gctggtgcccggag

SEQ ID NO: 6270786 - DNA, 19 bp, Homo sapiens
gctggtgccgaagtgtttc

SEQ ID NO: 6270787 - DNA, 12 bp, Homo sapiens
gctggtgcctga

SEQ ID NO: 6270788 - DNA, 15 bp, Homo sapiens
gctggtgcctgaaga

SEQ ID NO: 6270789 - DNA, 15 bp, Homo sapiens
gctggtgcggctggc

SEQ ID NO: 6270790 - DNA, 15 bp, Homo sapiens
gctggtgctactgtt

SEQ ID NO: 6270791 - DNA, 18 bp, Homo sapiens
gctggtggacagacccag

SEQ ID NO: 6270792 - DNA, 18 bp, Homo sapiens
gctggtggagatgtagga

SEQ ID NO: 6270793 - DNA, 13 bp, Homo sapiens
gctggtggaggaa

SEQ ID NO: 6270794 - DNA, 19 bp, Homo sapiens
gctggtggaggaagggctg

SEQ ID NO: 6270795 - DNA, 17 bp, Homo sapiens
gctggtggatggtgact

SEQ ID NO: 6270796 - DNA, 14 bp, Homo sapiens
gctggtggcccagg

SEQ ID NO: 6270797 - DNA, 15 bp, Homo sapiens
gctggtggcccagga

SEQ ID NO: 6270798 - DNA, 14 bp, Homo sapiens
gctggtggctggtg

SEQ ID NO: 6270799 - DNA, 20 bp, Homo sapiens
gctggtggctggtgagaccc

SEQ ID NO: 6270800 - DNA, 12 bp, Homo sapiens
gctggtgggagg

SEQ ID NO: 6270801 - DNA, 21 bp, Homo sapiens
gctggtgggcaccaagagcca

SEQ ID NO: 6270802 - DNA, 13 bp, Homo sapiens
gctggtgggtctg

SEQ ID NO: 6270803 - DNA, 19 bp, Homo sapiens
gctggtgggtgaaagaaat

SEQ ID NO: 6270804 - DNA, 22 bp, Homo sapiens
gctggtggttaaggccagggcc

SEQ ID NO: 6270805 - DNA, 12 bp, Homo sapiens
gctggtggtttc

SEQ ID NO: 6270806 - DNA, 15 bp, Homo sapiens
gctggtggtttgatc

SEQ ID NO: 6270807 - DNA, 21 bp, Homo sapiens
gctggtggtttgatcatttct

SEQ ID NO: 6270808 - DNA, 16 bp, Homo sapiens
gctggtgtactctagg

SEQ ID NO: 6270809 - DNA, 21 bp, Homo sapiens
gctggtgtactctaggacttc

SEQ ID NO: 6270810 - DNA, 23 bp, Homo sapiens
gctggtgtactctaggacttcaa

SEQ ID NO: 6270811 - DNA, 20 bp, Homo sapiens
gctggtgtagctacagagaa

SEQ ID NO: 6270812 - DNA, 22 bp, Homo sapiens
gctggtgtagctacagagaaac

SEQ ID NO: 6270813 - DNA, 15 bp, Homo sapiens
gctggtgtagtcttt

SEQ ID NO: 6270814 - DNA, 18 bp, Homo sapiens
gctggtgtcacctgaaga

SEQ ID NO: 6270815 - DNA, 19 bp, Homo sapiens
gcatggtggcatgtgcctg

SEQ ID NO: 6270816 - DNA, 13 bp, Homo sapiens
gcatggtggccag

SEQ ID NO: 6270817 - DNA, 15 bp, Homo sapiens
gcatggtggccagag

SEQ ID NO: 6270818 - DNA, 22 bp, Homo sapiens
gcatggtggttgggacccagtg

SEQ ID NO: 6270819 - DNA, 22 bp, Homo sapiens
gcatggtgtgaactaagttatt

SEQ ID NO: 6270820 - DNA, 18 bp, Homo sapiens
gcatggtgttctcctgct

SEQ ID NO: 6270821 - DNA, 22 bp, Homo sapiens
gcatggttccttccctgggaag

SEQ ID NO: 6270822 - DNA, 15 bp, Homo sapiens
gcatggttgttgcat

SEQ ID NO: 6270823 - DNA, 16 bp, Homo sapiens
gcatggtttcagcact

SEQ ID NO: 6270824 - DNA, 17 bp, Homo sapiens
gcatggtttcagcacta

SEQ ID NO: 6270825 - DNA, 16 bp, Homo sapiens
gcatggtttggagctg

SEQ ID NO: 6270826 - DNA, 20 bp, Homo sapiens
gcatgtaaaatcttcagctg

SEQ ID NO: 6270827 - DNA, 23 bp, Homo sapiens
gcatgtaaaatgcagtccagaat

SEQ ID NO: 6270828 - DNA, 15 bp, Homo sapiens
gcatgtaaatgtaaa

SEQ ID NO: 6270829 - DNA, 17 bp, Homo sapiens
gcatgtaacgcaagttc

SEQ ID NO: 6270830 - DNA, 17 bp, Homo sapiens
gcatgtaatcccagcta

SEQ ID NO: 6270831 - DNA, 18 bp, Homo sapiens
gcatgtacaaaaacacaa

SEQ ID NO: 6270832 - DNA, 21 bp, Homo sapiens
gcatgtacaaaaacacaaata

SEQ ID NO: 6270833 - DNA, 11 bp, Homo sapiens
gcatgtacagt

SEQ ID NO: 6270834 - DNA, 22 bp, Homo sapiens
gcatgtaccctaaggtcattac

SEQ ID NO: 6270835 - DNA, 20 bp, Homo sapiens
gcatgtactctgttgagtaa

SEQ ID NO: 6270836 - DNA, 13 bp, Homo sapiens
gcatgtacttgaa

SEQ ID NO: 6270837 - DNA, 11 bp, Homo sapiens
gcatgtacttt

SEQ ID NO: 6270838 - DNA, 22 bp, Homo sapiens
gcatgtactttatattttctat

SEQ ID NO: 6270839 - DNA, 23 bp, Homo sapiens
gcatgtactttatattttctata

SEQ ID NO: 6270840 - DNA, 14 bp, Homo sapiens
gcatgtagccagtt

SEQ ID NO: 6270841 - DNA, 23 bp, Homo sapiens
gcatgtagccagttaaggaaaga

SEQ ID NO: 6270842 - DNA, 19 bp, Homo sapiens
gcatgtagctctatggggg

SEQ ID NO: 6270843 - DNA, 14 bp, Homo sapiens
gcatgtaggagaat

SEQ ID NO: 6270844 - DNA, 13 bp, Homo sapiens
gcatgtagtaaca

SEQ ID NO: 6270845 - DNA, 17 bp, Homo sapiens
gcatgtagtaacactaa

SEQ ID NO: 6270846 - DNA, 23 bp, Homo sapiens
gcatgtagtaacactaatatatt

SEQ ID NO: 6270847 - DNA, 22 bp, Homo sapiens
gcatgtagtgtgggaggctcct

SEQ ID NO: 6270848 - DNA, 13 bp, Homo sapiens
gcatgtatgccat

SEQ ID NO: 6270849 - DNA, 16 bp, Homo sapiens
gcatgtattggcctgg

SEQ ID NO: 6270850 - DNA, 19 bp, Homo sapiens
gcatgtattggcctggagg

SEQ ID NO: 6270851 - DNA, 21 bp, Homo sapiens
gcatgtattgtgtcttttgca

SEQ ID NO: 6270852 - DNA, 23 bp, Homo sapiens
gcatgtattgtgtcttttgcatg

SEQ ID NO: 6270853 - DNA, 16 bp, Homo sapiens
gcatgtcactcccaga

SEQ ID NO: 6270854 - DNA, 23 bp, Homo sapiens
gcatgtcactcccagaccacctc

SEQ ID NO: 6270855 - DNA, 23 bp, Homo sapiens
gcatgtcagaggaccccagggtg

SEQ ID NO: 6270856 - DNA, 16 bp, Homo sapiens
gcatgtccctccaagg

SEQ ID NO: 6270857 - DNA, 21 bp, Homo sapiens
gcatgtccctccaaggctgtc

SEQ ID NO: 6270858 - DNA, 18 bp, Homo sapiens
gcatgtcctatccctgga

SEQ ID NO: 6270859 - DNA, 22 bp, Homo sapiens
gcatgtcctttccatctgtcca

SEQ ID NO: 6270860 - DNA, 22 bp, Homo sapiens
gcatgtctaacctgatttacct

SEQ ID NO: 6270861 - DNA, 15 bp, Homo sapiens
gcatgtctaattcat

SEQ ID NO: 6270862 - DNA, 13 bp, Homo sapiens
gcatgtctactgc

SEQ ID NO: 6270863 - DNA, 13 bp, Homo sapiens
gcatgtctctgct

SEQ ID NO: 6270864 - DNA, 22 bp, Homo sapiens
gcatgtctgcatggcagaagcg

SEQ ID NO: 6270865 - DNA, 18 bp, Homo sapiens
gcatgtctgcctggagtg

SEQ ID NO: 6270866 - DNA, 19 bp, Homo sapiens
gcatgtctttttttctgtt

SEQ ID NO: 6270867 - DNA, 19 bp, Homo sapiens
gcatgtgaagcatgctttg

SEQ ID NO: 6270868 - DNA, 15 bp, Homo sapiens
gcatgtgactctgaa

SEQ ID NO: 6270869 - DNA, 20 bp, Homo sapiens
gcatgtgactctgaagctga

SEQ ID NO: 6270870 - DNA, 23 bp, Homo sapiens
gcatgtgacttctcccctgccct

SEQ ID NO: 6270871 - DNA, 20 bp, Homo sapiens
gcatgtgatcacgcctggct

SEQ ID NO: 6270872 - DNA, 18 bp, Homo sapiens
gcatgtgatgagaggaaa

SEQ ID NO: 6270873 - DNA, 22 bp, Homo sapiens
gcatgtgattggcagcttcaaa

SEQ ID NO: 6270874 - DNA, 14 bp, Homo sapiens
gcatgtgcatgcat

SEQ ID NO: 6270875 - DNA, 12 bp, Homo sapiens
gcatgtgccaag

SEQ ID NO: 6270876 - DNA, 14 bp, Homo sapiens
gcatgtgccgaggt

SEQ ID NO: 6270877 - DNA, 11 bp, Homo sapiens
gcatgtgcctg

SEQ ID NO: 6270878 - DNA, 23 bp, Homo sapiens
gcatgtgcctgtattcccagcta

SEQ ID NO: 6270879 - DNA, 22 bp, Homo sapiens
gcatgtgcggctgaactgagaa

SEQ ID NO: 6270880 - DNA, 22 bp, Homo sapiens
gcatgtgcgtggaagtgttcct

SEQ ID NO: 6270881 - DNA, 22 bp, Homo sapiens
gcatgtgctcagccccagacct

SEQ ID NO: 6270882 - DNA, 15 bp, Homo sapiens
gcatgtgctgtgtga

SEQ ID NO: 6270883 - DNA, 11 bp, Homo sapiens
gcatgtggaga

SEQ ID NO: 6270884 - DNA, 20 bp, Homo sapiens
gcatgtggcctttatctcaa

SEQ ID NO: 6270885 - DNA, 16 bp, Homo sapiens
gcatgtggcttctctg

SEQ ID NO: 6270886 - DNA, 14 bp, Homo sapiens
gcatgtgggggaag

SEQ ID NO: 6270887 - DNA, 23 bp, Homo sapiens
gcatgtggtaaggtgtgtactca

SEQ ID NO: 6270888 - DNA, 16 bp, Homo sapiens
gcatgtgtatatatgt

SEQ ID NO: 6270889 - DNA, 21 bp, Homo sapiens
gcatgtgtatttccagtgcaa

SEQ ID NO: 6270890 - DNA, 14 bp, Homo sapiens
gcatgtgtcagagt

SEQ ID NO: 6270891 - DNA, 14 bp, Homo sapiens
gcatgtgtctgtat

SEQ ID NO: 6270892 - DNA, 15 bp, Homo sapiens
gcatgtgtctgtatt

SEQ ID NO: 6270893 - DNA, 24 bp, Homo sapiens
gcatgtgtctgtattcatacagca

SEQ ID NO: 6270894 - DNA, 13 bp, Homo sapiens
gcatgtgtgcctg

SEQ ID NO: 6270895 - DNA, 15 bp, Homo sapiens
gcatgtgtgcctgtg

SEQ ID NO: 6270896 - DNA, 18 bp, Homo sapiens
gcatgtgtgcctgtggca

SEQ ID NO: 6270897 - DNA, 13 bp, Homo sapiens
gcatgtgtgtata

SEQ ID NO: 6270898 - DNA, 13 bp, Homo sapiens
gcatgtgtgtatc

SEQ ID NO: 6270899 - DNA, 16 bp, Homo sapiens
gcatgtgtgtgctcag

SEQ ID NO: 6270900 - DNA, 16 bp, Homo sapiens
gcatgtgttgcagctg

SEQ ID NO: 6270901 - DNA, 13 bp, Homo sapiens
gcatgttacataa

SEQ ID NO: 6270902 - DNA, 17 bp, Homo sapiens
gcatgttaggaattaga

SEQ ID NO: 6270903 - DNA, 16 bp, Homo sapiens
gcatgttatgtttaat

SEQ ID NO: 6270904 - DNA, 12 bp, Homo sapiens
gcatgttcaggg

SEQ ID NO: 6270905 - DNA, 13 bp, Homo sapiens
gcatgttcctcct

SEQ ID NO: 6270906 - DNA, 22 bp, Homo sapiens
gcatgttcgtattacaagagaa

SEQ ID NO: 6270907 - DNA, 15 bp, Homo sapiens
gcatgttctcctcta

SEQ ID NO: 6270908 - DNA, 21 bp, Homo sapiens
gcatgttctctgaggacacta

SEQ ID NO: 6270909 - DNA, 19 bp, Homo sapiens
gcatgttgccatgaggcct

SEQ ID NO: 6270910 - DNA, 23 bp, Homo sapiens
gcatgttgccatgaggcctttcc

SEQ ID NO: 6270911 - DNA, 15 bp, Homo sapiens
gcatgttggactctg

SEQ ID NO: 6270912 - DNA, 19 bp, Homo sapiens
gcatgttgggttgttacag

SEQ ID NO: 6270913 - DNA, 21 bp, Homo sapiens
gcatgttgtgatgtacacatt

SEQ ID NO: 6270914 - DNA, 21 bp, Homo sapiens
gcatgttgttttttcatagtg

SEQ ID NO: 6270915 - DNA, 13 bp, Homo sapiens
gcatgtttaataa

SEQ ID NO: 6270916 - DNA, 22 bp, Homo sapiens
gcatgtttaataatatgtacaa

SEQ ID NO: 6270917 - DNA, 18 bp, Homo sapiens
gcatgtttaatgtgaact

SEQ ID NO: 6270918 - DNA, 23 bp, Homo sapiens
gcatgtttaatgtgaactctccc

SEQ ID NO: 6270919 - DNA, 23 bp, Homo sapiens
gcatgtttaattgtgatatttga

SEQ ID NO: 6270920 - DNA, 18 bp, Homo sapiens
gcatgtttcactcctgct

SEQ ID NO: 6270921 - DNA, 15 bp, Homo sapiens
gcatgtttccagcag

SEQ ID NO: 6270922 - DNA, 15 bp, Homo sapiens
gcatgtttgaaatga

SEQ ID NO: 6270923 - DNA, 18 bp, Homo sapiens
gcatgtttgaaatgaggt

SEQ ID NO: 6270924 - DNA, 21 bp, Homo sapiens
gcatgtttgtctgtgtgctgt

SEQ ID NO: 6270925 - DNA, 18 bp, Homo sapiens
gcatgttttccagctcct

SEQ ID NO: 6270926 - DNA, 14 bp, Homo sapiens
gcatgttttctgct

SEQ ID NO: 6270927 - DNA, 13 bp, Homo sapiens
gcatgttttgcat

SEQ ID NO: 6270928 - DNA, 20 bp, Homo sapiens
gcatgttttgtatacaaata

SEQ ID NO: 6270929 - DNA, 19 bp, Homo sapiens
gcatgttttgtcattgttt

SEQ ID NO: 6270930 - DNA, 23 bp, Homo sapiens
gcattaaaaaaaaaaaaaaactc

SEQ ID NO: 6270931 - DNA, 13 bp, Homo sapiens
gcattaaaaataa

SEQ ID NO: 6270932 - DNA, 13 bp, Homo sapiens
gcattaaaactta

SEQ ID NO: 6270933 - DNA, 17 bp, Homo sapiens
gcattaaaccacatcat

SEQ ID NO: 6270934 - DNA, 21 bp, Homo sapiens
gcattaaaccacatcatggac

SEQ ID NO: 6270935 - DNA, 15 bp, Homo sapiens
gcattaaacctgtct

SEQ ID NO: 6270936 - DNA, 19 bp, Homo sapiens
gcattaaattttaaggtag

SEQ ID NO: 6270937 - DNA, 20 bp, Homo sapiens
gcattaacagcaggtgtgac

SEQ ID NO: 6270938 - DNA, 15 bp, Homo sapiens
gcattaactaaatgc

SEQ ID NO: 6270939 - DNA, 20 bp, Homo sapiens
gcattaactaaatgctcata

SEQ ID NO: 6270940 - DNA, 18 bp, Homo sapiens
gcattaactaatctattg

SEQ ID NO: 6270941 - DNA, 14 bp, Homo sapiens
gcattaacttctct

SEQ ID NO: 6270942 - DNA, 14 bp, Homo sapiens
gcattaacttttgt

SEQ ID NO: 6270943 - DNA, 17 bp, Homo sapiens
gcattaagcacacacat

SEQ ID NO: 6270944 - DNA, 14 bp, Homo sapiens
gcattaagcccaat

SEQ ID NO: 6270945 - DNA, 23 bp, Homo sapiens
gcattaagtcagtggctttgcat

SEQ ID NO: 6270946 - DNA, 22 bp, Homo sapiens
gcattaataatagttatttctt

SEQ ID NO: 6270947 - DNA, 13 bp, Homo sapiens
gcattaattatta

SEQ ID NO: 6270948 - DNA, 14 bp, Homo sapiens
gcattacagagagg

SEQ ID NO: 6270949 - DNA, 12 bp, Homo sapiens
gcattacattat

SEQ ID NO: 6270950 - DNA, 19 bp, Homo sapiens
gcattaccgcgttgtaaaa

SEQ ID NO: 6270951 - DNA, 15 bp, Homo sapiens
gcattactattaact

SEQ ID NO: 6270952 - DNA, 14 bp, Homo sapiens
gcattactctgcac

SEQ ID NO: 6270953 - DNA, 17 bp, Homo sapiens
gcattactcttgtaaga

SEQ ID NO: 6270954 - DNA, 17 bp, Homo sapiens
gcattactgcatgcact

SEQ ID NO: 6270955 - DNA, 20 bp, Homo sapiens
gcattactggccttttcact

SEQ ID NO: 6270956 - DNA, 16 bp, Homo sapiens
gcattacttactgtta

SEQ ID NO: 6270957 - DNA, 18 bp, Homo sapiens
gcattacttgctttcaat

SEQ ID NO: 6270958 - DNA, 17 bp, Homo sapiens
gcattagaatggaggaa

SEQ ID NO: 6270959 - DNA, 17 bp, Homo sapiens
gcattagaattatttaa

SEQ ID NO: 6270960 - DNA, 18 bp, Homo sapiens
gcattagagaaatgaatt

SEQ ID NO: 6270961 - DNA, 21 bp, Homo sapiens
gcattagagtcaactacacaa

SEQ ID NO: 6270962 - DNA, 18 bp, Homo sapiens
gcattagatagtcatgct

SEQ ID NO: 6270963 - DNA, 20 bp, Homo sapiens
gcattagattcctttcctgt

SEQ ID NO: 6270964 - DNA, 12 bp, Homo sapiens
gcattagcaagg

SEQ ID NO: 6270965 - DNA, 17 bp, Homo sapiens
gcattagcaaggcagag

SEQ ID NO: 6270966 - DNA, 18 bp, Homo sapiens
gcattagcaaggcagagc

SEQ ID NO: 6270967 - DNA, 20 bp, Homo sapiens
gcattagcaaggcagagcct

SEQ ID NO: 6270968 - DNA, 22 bp, Homo sapiens
gcattagcaaggcagagccttt

SEQ ID NO: 6270969 - DNA, 19 bp, Homo sapiens
gcattagcacagattttaa

SEQ ID NO: 6270970 - DNA, 20 bp, Homo sapiens
gcattagcacagattttaat

SEQ ID NO: 6270971 - DNA, 21 bp, Homo sapiens
gcattagcacagattttaatt

SEQ ID NO: 6270972 - DNA, 21 bp, Homo sapiens
gcattagcctggatcctcagt

SEQ ID NO: 6270973 - DNA, 21 bp, Homo sapiens
gcattaggcttttaagaaaca

SEQ ID NO: 6270974 - DNA, 17 bp, Homo sapiens
gcattagtaactttgaa

SEQ ID NO: 6270975 - DNA, 18 bp, Homo sapiens
gcattagtaactttgaaa

SEQ ID NO: 6270976 - DNA, 19 bp, Homo sapiens
gcattagtgtccccccttg

SEQ ID NO: 6270977 - DNA, 22 bp, Homo sapiens
gcattagtgtccccccttgaag

SEQ ID NO: 6270978 - DNA, 15 bp, Homo sapiens
gcattataaaaagaa

SEQ ID NO: 6270979 - DNA, 15 bp, Homo sapiens
gcattatataccatt

SEQ ID NO: 6270980 - DNA, 17 bp, Homo sapiens
gcattatctagatactg

SEQ ID NO: 6270981 - DNA, 18 bp, Homo sapiens
gcattatctctttctctc

SEQ ID NO: 6270982 - DNA, 16 bp, Homo sapiens
gcattatcttgctcat

SEQ ID NO: 6270983 - DNA, 13 bp, Homo sapiens
gcattatgcaatt

SEQ ID NO: 6270984 - DNA, 19 bp, Homo sapiens
gcattatgcaatttttata

SEQ ID NO: 6270985 - DNA, 15 bp, Homo sapiens
gcattatgtatttat

SEQ ID NO: 6270986 - DNA, 13 bp, Homo sapiens
gcattattcattt

SEQ ID NO: 6270987 - DNA, 22 bp, Homo sapiens
gcattattggaatataattgtt

SEQ ID NO: 6270988 - DNA, 14 bp, Homo sapiens
gcattatttacaaa

SEQ ID NO: 6270989 - DNA, 15 bp, Homo sapiens
gcattatttgagaag

SEQ ID NO: 6270990 - DNA, 20 bp, Homo sapiens
gcattatttggatgtgagtt

SEQ ID NO: 6270991 - DNA, 23 bp, Homo sapiens
gcattattttgtcataaaatgct

SEQ ID NO: 6270992 - DNA, 15 bp, Homo sapiens
gctggtgtcactctg

SEQ ID NO: 6270993 - DNA, 22 bp, Homo sapiens
gctggtgtccccttcccctgct

SEQ ID NO: 6270994 - DNA, 19 bp, Homo sapiens
gctggtgtcctgaccaccc

SEQ ID NO: 6270995 - DNA, 22 bp, Homo sapiens
gctggtgtcctgaccaccctcc

SEQ ID NO: 6270996 - DNA, 15 bp, Homo sapiens
gctggtgtcctgccc

SEQ ID NO: 6270997 - DNA, 18 bp, Homo sapiens
gctggtgtcttgagacca

SEQ ID NO: 6270998 - DNA, 17 bp, Homo sapiens
gctggtgtggtacagag

SEQ ID NO: 6270999 - DNA, 20 bp, Homo sapiens
gctggtgtggtacagagaag

SEQ ID NO: 6271000 - DNA, 21 bp, Homo sapiens
gctggtgtggtacagagaagc

SEQ ID NO: 6271001 - DNA, 14 bp, Homo sapiens
gctggtgttaacag

SEQ ID NO: 6271002 - DNA, 17 bp, Homo sapiens
gctggttactcagggtt

SEQ ID NO: 6271003 - DNA, 13 bp, Homo sapiens
gctggttcactct

SEQ ID NO: 6271004 - DNA, 15 bp, Homo sapiens
gctggttcagggttg

SEQ ID NO: 6271005 - DNA, 23 bp, Homo sapiens
gctggttcagggttggcccctgc

SEQ ID NO: 6271006 - DNA, 15 bp, Homo sapiens
gctggttcctctctc

SEQ ID NO: 6271007 - DNA, 23 bp, Homo sapiens
gctggttcctctctcccacccta

SEQ ID NO: 6271008 - DNA, 20 bp, Homo sapiens
gctggttcggatttggggtg

SEQ ID NO: 6271009 - DNA, 16 bp, Homo sapiens
gctggttctgcaatga

SEQ ID NO: 6271010 - DNA, 12 bp, Homo sapiens
gctggttctgta

SEQ ID NO: 6271011 - DNA, 20 bp, Homo sapiens
gctggttctttgttctgtcc

SEQ ID NO: 6271012 - DNA, 14 bp, Homo sapiens
gctggttgctgtag

SEQ ID NO: 6271013 - DNA, 15 bp, Homo sapiens
gctggttgctgtaga

SEQ ID NO: 6271014 - DNA, 14 bp, Homo sapiens
gctggttgctgtgt

SEQ ID NO: 6271015 - DNA, 16 bp, Homo sapiens
gctggttggagagcta

SEQ ID NO: 6271016 - DNA, 17 bp, Homo sapiens
gctggttggagagctag

SEQ ID NO: 6271017 - DNA, 18 bp, Homo sapiens
gctggttggagagctaga

SEQ ID NO: 6271018 - DNA, 19 bp, Homo sapiens
gctggttggattaatcttt

SEQ ID NO: 6271019 - DNA, 21 bp, Homo sapiens
gctggttgtaccctctccagg

SEQ ID NO: 6271020 - DNA, 24 bp, Homo sapiens
gctggttgtcatttttgcagtaga

SEQ ID NO: 6271021 - DNA, 15 bp, Homo sapiens
gctggttgttgccag

SEQ ID NO: 6271022 - DNA, 17 bp, Homo sapiens
gctggttgttgccaggt

SEQ ID NO: 6271023 - DNA, 18 bp, Homo sapiens
gctggttgttgccaggtt

SEQ ID NO: 6271024 - DNA, 23 bp, Homo sapiens
gctggtttatttgttgttttctg

SEQ ID NO: 6271025 - DNA, 15 bp, Homo sapiens
gctggtttcctcatt

SEQ ID NO: 6271026 - DNA, 15 bp, Homo sapiens
gctggtttctgccct

SEQ ID NO: 6271027 - DNA, 22 bp, Homo sapiens
gctggtttgaaagattatgatg

SEQ ID NO: 6271028 - DNA, 14 bp, Homo sapiens
gctggtttgttctg

SEQ ID NO: 6271029 - DNA, 14 bp, Homo sapiens
gctggttttcctaa

SEQ ID NO: 6271030 - DNA, 19 bp, Homo sapiens
gctggtttttagatttttt

SEQ ID NO: 6271031 - DNA, 15 bp, Homo sapiens
gctggtttttcagtt

SEQ ID NO: 6271032 - DNA, 21 bp, Homo sapiens
gctgtaaaaacacaaatgtgt

SEQ ID NO: 6271033 - DNA, 15 bp, Homo sapiens
gctgtaaaacttatt

SEQ ID NO: 6271034 - DNA, 18 bp, Homo sapiens
gctgtaaaacttattcca

SEQ ID NO: 6271035 - DNA, 14 bp, Homo sapiens
gctgtaaaatcttg

SEQ ID NO: 6271036 - DNA, 14 bp, Homo sapiens
gctgtaaaatggaa

SEQ ID NO: 6271037 - DNA, 18 bp, Homo sapiens
gctgtaaaattataaact

SEQ ID NO: 6271038 - DNA, 19 bp, Homo sapiens
gctgtaaaattataaactt

SEQ ID NO: 6271039 - DNA, 20 bp, Homo sapiens
gctgtaaaattataaacttt

SEQ ID NO: 6271040 - DNA, 16 bp, Homo sapiens
gctgtaaacagctctg

SEQ ID NO: 6271041 - DNA, 21 bp, Homo sapiens
gctgtaaactataaactactg

SEQ ID NO: 6271042 - DNA, 15 bp, Homo sapiens
gctgtaaagcaaaat

SEQ ID NO: 6271043 - DNA, 18 bp, Homo sapiens
gctgtaaagcaaaatatt

SEQ ID NO: 6271044 - DNA, 21 bp, Homo sapiens
gctgtaaagcaaaatatttgt

SEQ ID NO: 6271045 - DNA, 17 bp, Homo sapiens
gctgtaaataaaaatag

SEQ ID NO: 6271046 - DNA, 20 bp, Homo sapiens
gctgtaaatacatgtgtgga

SEQ ID NO: 6271047 - DNA, 14 bp, Homo sapiens
gctgtaaatataaa

SEQ ID NO: 6271048 - DNA, 16 bp, Homo sapiens
gctgtaaattgaactt

SEQ ID NO: 6271049 - DNA, 17 bp, Homo sapiens
gctgtaaatttggcttc

SEQ ID NO: 6271050 - DNA, 15 bp, Homo sapiens
gctgtaacctgctgg

SEQ ID NO: 6271051 - DNA, 18 bp, Homo sapiens
gctgtaactgagagaaag

SEQ ID NO: 6271052 - DNA, 14 bp, Homo sapiens
gctgtaactgctga

SEQ ID NO: 6271053 - DNA, 18 bp, Homo sapiens
gctgtaactgctgagcca

SEQ ID NO: 6271054 - DNA, 16 bp, Homo sapiens
gctgtaagaagagact

SEQ ID NO: 6271055 - DNA, 18 bp, Homo sapiens
gctgtaaggcatgaagga

SEQ ID NO: 6271056 - DNA, 15 bp, Homo sapiens
gctgtaaggctctag

SEQ ID NO: 6271057 - DNA, 22 bp, Homo sapiens
gctgtaatattgtaaatactgg

SEQ ID NO: 6271058 - DNA, 16 bp, Homo sapiens
gctgtaatcaagaaaa

SEQ ID NO: 6271059 - DNA, 22 bp, Homo sapiens
gctgtaatcatttgtttacatt

SEQ ID NO: 6271060 - DNA, 22 bp, Homo sapiens
gctgtaatctatgaattctaag

SEQ ID NO: 6271061 - DNA, 17 bp, Homo sapiens
gctgtaatgacaaaaga

SEQ ID NO: 6271062 - DNA, 17 bp, Homo sapiens
gctgtaatgtaacagca

SEQ ID NO: 6271063 - DNA, 12 bp, Homo sapiens
gctgtaatttaa

SEQ ID NO: 6271064 - DNA, 14 bp, Homo sapiens
gctgtaatttaatt

SEQ ID NO: 6271065 - DNA, 21 bp, Homo sapiens
gctgtaatttcgccttaaact

SEQ ID NO: 6271066 - DNA, 18 bp, Homo sapiens
gctgtacaacttctgggc

SEQ ID NO: 6271067 - DNA, 14 bp, Homo sapiens
gctgtacagatatc

SEQ ID NO: 6271068 - DNA, 14 bp, Homo sapiens
gctgtacaggaaaa

SEQ ID NO: 6271069 - DNA, 17 bp, Homo sapiens
gctgtacatactttttg

SEQ ID NO: 6271070 - DNA, 13 bp, Homo sapiens
gctgtaccatatt

SEQ ID NO: 6271071 - DNA, 17 bp, Homo sapiens
gctgtacccagatgcct

SEQ ID NO: 6271072 - DNA, 16 bp, Homo sapiens
gctgtacccagtttct

SEQ ID NO: 6271073 - DNA, 15 bp, Homo sapiens
gctgtacccttccac

SEQ ID NO: 6271074 - DNA, 17 bp, Homo sapiens
gctgtacccttccacct

SEQ ID NO: 6271075 - DNA, 17 bp, Homo sapiens
gctgtaccctttaagat

SEQ ID NO: 6271076 - DNA, 17 bp, Homo sapiens
gctgtaccggccactgc

SEQ ID NO: 6271077 - DNA, 13 bp, Homo sapiens
gctgtacctggct

SEQ ID NO: 6271078 - DNA, 15 bp, Homo sapiens
gctgtacctgttcct

SEQ ID NO: 6271079 - DNA, 18 bp, Homo sapiens
gctgtacctgttcctccc

SEQ ID NO: 6271080 - DNA, 17 bp, Homo sapiens
gctgtactagtgccatt

SEQ ID NO: 6271081 - DNA, 15 bp, Homo sapiens
gctgtactataagta

SEQ ID NO: 6271082 - DNA, 20 bp, Homo sapiens
gctgtactcagagcagagca

SEQ ID NO: 6271083 - DNA, 22 bp, Homo sapiens
gctgtactcttctgactgcccc

SEQ ID NO: 6271084 - DNA, 18 bp, Homo sapiens
gctgtagacatctgtcct

SEQ ID NO: 6271085 - DNA, 14 bp, Homo sapiens
gctgtagataaata

SEQ ID NO: 6271086 - DNA, 16 bp, Homo sapiens
gctgtagataacagca

SEQ ID NO: 6271087 - DNA, 18 bp, Homo sapiens
gctgtagatggtgacctg

SEQ ID NO: 6271088 - DNA, 14 bp, Homo sapiens
gctgtagccatggc

SEQ ID NO: 6271089 - DNA, 15 bp, Homo sapiens
gctgtagccatggct

SEQ ID NO: 6271090 - DNA, 20 bp, Homo sapiens
gctgtagccatggctcaggc

SEQ ID NO: 6271091 - DNA, 22 bp, Homo sapiens
gctgtagccatggctcaggcaa

SEQ ID NO: 6271092 - DNA, 20 bp, Homo sapiens
gctgtagctacaagggaagc

SEQ ID NO: 6271093 - DNA, 16 bp, Homo sapiens
gctgtaggagagtcgg

SEQ ID NO: 6271094 - DNA, 22 bp, Homo sapiens
gctgtataaaatcagccaatta

SEQ ID NO: 6271095 - DNA, 16 bp, Homo sapiens
gctgtataaagcatgt

SEQ ID NO: 6271096 - DNA, 22 bp, Homo sapiens
gctgtataactgtgcagagact

SEQ ID NO: 6271097 - DNA, 15 bp, Homo sapiens
gctgtatacaaacag

SEQ ID NO: 6271098 - DNA, 17 bp, Homo sapiens
gctgtatacaaacaggt

SEQ ID NO: 6271099 - DNA, 20 bp, Homo sapiens
gctgtatacaaacaggtgct

SEQ ID NO: 6271100 - DNA, 15 bp, Homo sapiens
gctgtatagctgctt

SEQ ID NO: 6271101 - DNA, 21 bp, Homo sapiens
gctgtatataaacgtgtcccg

SEQ ID NO: 6271102 - DNA, 19 bp, Homo sapiens
gctgtatatttatctttca

SEQ ID NO: 6271103 - DNA, 22 bp, Homo sapiens
gctgtatccatgtaatgatctt

SEQ ID NO: 6271104 - DNA, 19 bp, Homo sapiens
gctgtatcccatgagcctc

SEQ ID NO: 6271105 - DNA, 22 bp, Homo sapiens
gctgtatctatttttttttctt

SEQ ID NO: 6271106 - DNA, 13 bp, Homo sapiens
gctgtatctgtaa

SEQ ID NO: 6271107 - DNA, 14 bp, Homo sapiens
gctgtatctgtgct

SEQ ID NO: 6271108 - DNA, 20 bp, Homo sapiens
gctgtatcttgatgtttaga

SEQ ID NO: 6271109 - DNA, 16 bp, Homo sapiens
gctgtatcttgttttt

SEQ ID NO: 6271110 - DNA, 21 bp, Homo sapiens
gctgtatgactgaagtaataa

SEQ ID NO: 6271111 - DNA, 14 bp, Homo sapiens
gctgtatgatttgt

SEQ ID NO: 6271112 - DNA, 15 bp, Homo sapiens
gctgtatgatttgtt

SEQ ID NO: 6271113 - DNA, 21 bp, Homo sapiens
gctgtatgatttgttttgaat

SEQ ID NO: 6271114 - DNA, 15 bp, Homo sapiens
gctgtatgctgatca

SEQ ID NO: 6271115 - DNA, 13 bp, Homo sapiens
gctgtatggtata

SEQ ID NO: 6271116 - DNA, 17 bp, Homo sapiens
gctgtatgtcattaaag

SEQ ID NO: 6271117 - DNA, 15 bp, Homo sapiens
gctgtatgtgagctg

SEQ ID NO: 6271118 - DNA, 20 bp, Homo sapiens
gctgtattcatatattgcat

SEQ ID NO: 6271119 - DNA, 19 bp, Homo sapiens
gctgtattgcccccatggg

SEQ ID NO: 6271120 - DNA, 23 bp, Homo sapiens
gctgtatttagtaaaaataaatc

SEQ ID NO: 6271121 - DNA, 20 bp, Homo sapiens
gctgtatttcctgcttccct

SEQ ID NO: 6271122 - DNA, 21 bp, Homo sapiens
gctgtatttcctgcttccctg

SEQ ID NO: 6271123 - DNA, 16 bp, Homo sapiens
gctgtatttctttgta

SEQ ID NO: 6271124 - DNA, 22 bp, Homo sapiens
gctgtatttctttgtagaataa

SEQ ID NO: 6271125 - DNA, 22 bp, Homo sapiens
gctgtattttaaaagaatgatt

SEQ ID NO: 6271126 - DNA, 14 bp, Homo sapiens
gctgtattttaaca

SEQ ID NO: 6271127 - DNA, 16 bp, Homo sapiens
gctgtattttctttta

SEQ ID NO: 6271128 - DNA, 19 bp, Homo sapiens
gctgtattttcttttatat

SEQ ID NO: 6271129 - DNA, 22 bp, Homo sapiens
gctgtattttcttttatatctg

SEQ ID NO: 6271130 - DNA, 23 bp, Homo sapiens
gctgtattttcttttatatctgt

SEQ ID NO: 6271131 - DNA, 24 bp, Homo sapiens
gctgtattttcttttatatctgta

SEQ ID NO: 6271132 - DNA, 13 bp, Homo sapiens
gctgtattttgaa

SEQ ID NO: 6271133 - DNA, 22 bp, Homo sapiens
gctgtattttgagtttcagctg

SEQ ID NO: 6271134 - DNA, 17 bp, Homo sapiens
gctgtattttgatataa

SEQ ID NO: 6271135 - DNA, 19 bp, Homo sapiens
gctgtattttgatataatt

SEQ ID NO: 6271136 - DNA, 20 bp, Homo sapiens
gctgtattttggctttctcc

SEQ ID NO: 6271137 - DNA, 17 bp, Homo sapiens
gctgtatttttattttt

SEQ ID NO: 6271138 - DNA, 20 bp, Homo sapiens
gctgtcaaaacaagtttttc

SEQ ID NO: 6271139 - DNA, 20 bp, Homo sapiens
gctgtcaaatccatgtgtcc

SEQ ID NO: 6271140 - DNA, 14 bp, Homo sapiens
gctgtcaaggctca

SEQ ID NO: 6271141 - DNA, 12 bp, Homo sapiens
gctgtcaataaa

SEQ ID NO: 6271142 - DNA, 16 bp, Homo sapiens
gctgtcaataaatgac

SEQ ID NO: 6271143 - DNA, 17 bp, Homo sapiens
gctgtcaattacaggaa

SEQ ID NO: 6271144 - DNA, 23 bp, Homo sapiens
gctgtcaattacaggaagtactg

SEQ ID NO: 6271145 - DNA, 17 bp, Homo sapiens
gctgtcacaaccaagaa

SEQ ID NO: 6271146 - DNA, 13 bp, Homo sapiens
gctgtcacaggcg

SEQ ID NO: 6271147 - DNA, 19 bp, Homo sapiens
gctgtcacatacaactttt

SEQ ID NO: 6271148 - DNA, 17 bp, Homo sapiens
gctgtcaccaaggaaac

SEQ ID NO: 6271149 - DNA, 17 bp, Homo sapiens
gctgtcaccacgtgcag

SEQ ID NO: 6271150 - DNA, 20 bp, Homo sapiens
gctgtcaccctccaccgagc

SEQ ID NO: 6271151 - DNA, 13 bp, Homo sapiens
gctgtcacctctc

SEQ ID NO: 6271152 - DNA, 16 bp, Homo sapiens
gctgtcacctctcagc

SEQ ID NO: 6271153 - DNA, 12 bp, Homo sapiens
gctgtcactggc

SEQ ID NO: 6271154 - DNA, 17 bp, Homo sapiens
gctgtcactggcagagc

SEQ ID NO: 6271155 - DNA, 16 bp, Homo sapiens
gctgtcactggctggc

SEQ ID NO: 6271156 - DNA, 17 bp, Homo sapiens
gctgtcactggctggct

SEQ ID NO: 6271157 - DNA, 18 bp, Homo sapiens
gctgtcactggctggctc

SEQ ID NO: 6271158 - DNA, 20 bp, Homo sapiens
gctgtcactggctggctcct

SEQ ID NO: 6271159 - DNA, 19 bp, Homo sapiens
gctgtcagaccttcttcca

SEQ ID NO: 6271160 - DNA, 13 bp, Homo sapiens
gctgtcagcctgg

SEQ ID NO: 6271161 - DNA, 22 bp, Homo sapiens
gctgtcaggattgcgagagatg

SEQ ID NO: 6271162 - DNA, 16 bp, Homo sapiens
gctgtcaggctgggac

SEQ ID NO: 6271163 - DNA, 21 bp, Homo sapiens
gctgtcagtgtatggggcagc

SEQ ID NO: 6271164 - DNA, 11 bp, Homo sapiens
gctgtcatctg

SEQ ID NO: 6271165 - DNA, 15 bp, Homo sapiens
gctgtcatctgtgca

SEQ ID NO: 6271166 - DNA, 16 bp, Homo sapiens
gctgtcatctgtgcac

SEQ ID NO: 6271167 - DNA, 21 bp, Homo sapiens
gctgtcatgcccagcttggag

SEQ ID NO: 6271168 - DNA, 19 bp, Homo sapiens
gctgtcatgtggaaactat

SEQ ID NO: 6271169 - DNA, 15 bp, Homo sapiens
gctgtcattgcttct

SEQ ID NO: 6271170 - DNA, 20 bp, Homo sapiens
gcattcaaaaagacagcaga

SEQ ID NO: 6271171 - DNA, 21 bp, Homo sapiens
gcattcaaaatagttctattt

SEQ ID NO: 6271172 - DNA, 24 bp, Homo sapiens
gcattcaaaatagttctatttcta

SEQ ID NO: 6271173 - DNA, 19 bp, Homo sapiens
gcattcaaatgtattacag

SEQ ID NO: 6271174 - DNA, 21 bp, Homo sapiens
gcattcaaccaactgtaatgc

SEQ ID NO: 6271175 - DNA, 13 bp, Homo sapiens
gcattcaacctta

SEQ ID NO: 6271176 - DNA, 19 bp, Homo sapiens
gcattcaaccttaccaaaa

SEQ ID NO: 6271177 - DNA, 15 bp, Homo sapiens
gcattcaataaatat

SEQ ID NO: 6271178 - DNA, 22 bp, Homo sapiens
gcattcaatttattcaagaaaa

SEQ ID NO: 6271179 - DNA, 16 bp, Homo sapiens
gcattcacaaagtagc

SEQ ID NO: 6271180 - DNA, 16 bp, Homo sapiens
gcattcacacacagcc

SEQ ID NO: 6271181 - DNA, 19 bp, Homo sapiens
gcattcacagcgcctcctg

SEQ ID NO: 6271182 - DNA, 20 bp, Homo sapiens
gcattcacagcgcctcctgg

SEQ ID NO: 6271183 - DNA, 21 bp, Homo sapiens
gcattcacagcgcctcctgga

SEQ ID NO: 6271184 - DNA, 19 bp, Homo sapiens
gcattcacatttagaaaag

SEQ ID NO: 6271185 - DNA, 12 bp, Homo sapiens
gcattcacccag

SEQ ID NO: 6271186 - DNA, 16 bp, Homo sapiens
gcattcagaacataaa

SEQ ID NO: 6271187 - DNA, 17 bp, Homo sapiens
gcattcagcacacacaa

SEQ ID NO: 6271188 - DNA, 16 bp, Homo sapiens
gcattcagcacacccc

SEQ ID NO: 6271189 - DNA, 20 bp, Homo sapiens
gcattcagcacaccccaagg

SEQ ID NO: 6271190 - DNA, 17 bp, Homo sapiens
gcattcagcagtttctg

SEQ ID NO: 6271191 - DNA, 23 bp, Homo sapiens
gcattcagtgcacctgcctcagc

SEQ ID NO: 6271192 - DNA, 12 bp, Homo sapiens
gcattcatgttt

SEQ ID NO: 6271193 - DNA, 20 bp, Homo sapiens
gcattcatttgttttttcaa

SEQ ID NO: 6271194 - DNA, 14 bp, Homo sapiens
gcattcatttttat

SEQ ID NO: 6271195 - DNA, 18 bp, Homo sapiens
gcattcatttttatagca

SEQ ID NO: 6271196 - DNA, 17 bp, Homo sapiens
gcattccaacaaagggt

SEQ ID NO: 6271197 - DNA, 18 bp, Homo sapiens
gcattccaacaaagggtt

SEQ ID NO: 6271198 - DNA, 20 bp, Homo sapiens
gcattccacaggatcatcat

SEQ ID NO: 6271199 - DNA, 15 bp, Homo sapiens
gcattccagaatctt

SEQ ID NO: 6271200 - DNA, 23 bp, Homo sapiens
gcattccagacttcaaaaataaa

SEQ ID NO: 6271201 - DNA, 19 bp, Homo sapiens
gcattccagcccctctggt

SEQ ID NO: 6271202 - DNA, 19 bp, Homo sapiens
gcattccagcgtctgctgt

SEQ ID NO: 6271203 - DNA, 13 bp, Homo sapiens
gcattccaggctc

SEQ ID NO: 6271204 - DNA, 18 bp, Homo sapiens
gcattccaggtaacaggt

SEQ ID NO: 6271205 - DNA, 20 bp, Homo sapiens
gcattccaggtaacaggtgt

SEQ ID NO: 6271206 - DNA, 15 bp, Homo sapiens
gcattccatgaccag

SEQ ID NO: 6271207 - DNA, 14 bp, Homo sapiens
gcattccatgattt

SEQ ID NO: 6271208 - DNA, 15 bp, Homo sapiens
gcattccatgatttt

SEQ ID NO: 6271209 - DNA, 15 bp, Homo sapiens
gcattcccagggacc

SEQ ID NO: 6271210 - DNA, 14 bp, Homo sapiens
gcattccccaggag

SEQ ID NO: 6271211 - DNA, 16 bp, Homo sapiens
gcattccccaggaggc

SEQ ID NO: 6271212 - DNA, 17 bp, Homo sapiens
gcattccccaggaggcc

SEQ ID NO: 6271213 - DNA, 21 bp, Homo sapiens
gcattccccaggaggccagcc

SEQ ID NO: 6271214 - DNA, 13 bp, Homo sapiens
gcattccccgctg

SEQ ID NO: 6271215 - DNA, 17 bp, Homo sapiens
gcattccccgctgccca

SEQ ID NO: 6271216 - DNA, 18 bp, Homo sapiens
gcattccccgctgcccaa

SEQ ID NO: 6271217 - DNA, 13 bp, Homo sapiens
gcattccctgagt

SEQ ID NO: 6271218 - DNA, 22 bp, Homo sapiens
gcattccctgagtcaccaggaa

SEQ ID NO: 6271219 - DNA, 21 bp, Homo sapiens
gcattcctaagaagtccccag

SEQ ID NO: 6271220 - DNA, 19 bp, Homo sapiens
gcattcctctaatgttgtg

SEQ ID NO: 6271221 - DNA, 21 bp, Homo sapiens
gcattcctgatatgatttaaa

SEQ ID NO: 6271222 - DNA, 20 bp, Homo sapiens
gcattcctgtaacttttaat

SEQ ID NO: 6271223 - DNA, 20 bp, Homo sapiens
gcattccttacttgcactgt

SEQ ID NO: 6271224 - DNA, 13 bp, Homo sapiens
gcattccttcttt

SEQ ID NO: 6271225 - DNA, 13 bp, Homo sapiens
gcattcctttctt

SEQ ID NO: 6271226 - DNA, 18 bp, Homo sapiens
gcattcgggccacagggc

SEQ ID NO: 6271227 - DNA, 22 bp, Homo sapiens
gcattcggtacttacccggaga

SEQ ID NO: 6271228 - DNA, 18 bp, Homo sapiens
gcattctagattactttt

SEQ ID NO: 6271229 - DNA, 18 bp, Homo sapiens
gcattctatcgttattat

SEQ ID NO: 6271230 - DNA, 21 bp, Homo sapiens
gcattctatcgttattataaa

SEQ ID NO: 6271231 - DNA, 14 bp, Homo sapiens
gcattctattgcct

SEQ ID NO: 6271232 - DNA, 15 bp, Homo sapiens
gcattctattgcctt

SEQ ID NO: 6271233 - DNA, 15 bp, Homo sapiens
gcattctcagccaca

SEQ ID NO: 6271234 - DNA, 13 bp, Homo sapiens
gcattctctctgc

SEQ ID NO: 6271235 - DNA, 23 bp, Homo sapiens
gcattctgaatcagaatctcgca

SEQ ID NO: 6271236 - DNA, 18 bp, Homo sapiens
gcattctgataggagggg

SEQ ID NO: 6271237 - DNA, 20 bp, Homo sapiens
gcattctgataggagggggc

SEQ ID NO: 6271238 - DNA, 20 bp, Homo sapiens
gcattctgccgtgtgccctc

SEQ ID NO: 6271239 - DNA, 16 bp, Homo sapiens
gcattctgcctgcctg

SEQ ID NO: 6271240 - DNA, 21 bp, Homo sapiens
gcattctggcataatttttac

SEQ ID NO: 6271241 - DNA, 19 bp, Homo sapiens
gcattctggggtggggctt

SEQ ID NO: 6271242 - DNA, 13 bp, Homo sapiens
gcattctgtttat

SEQ ID NO: 6271243 - DNA, 17 bp, Homo sapiens
gcattctgtttcctctt

SEQ ID NO: 6271244 - DNA, 22 bp, Homo sapiens
gcattcttaacaaactcttcag

SEQ ID NO: 6271245 - DNA, 13 bp, Homo sapiens
gcattcttagact

SEQ ID NO: 6271246 - DNA, 21 bp, Homo sapiens
gcattcttggttggctggcct

SEQ ID NO: 6271247 - DNA, 11 bp, Homo sapiens
gcattctttcc

SEQ ID NO: 6271248 - DNA, 13 bp, Homo sapiens
gcattctttccca

SEQ ID NO: 6271249 - DNA, 18 bp, Homo sapiens
gcattctttcccagtgag

SEQ ID NO: 6271250 - DNA, 13 bp, Homo sapiens
gcattctttctgt

SEQ ID NO: 6271251 - DNA, 16 bp, Homo sapiens
gcattctttgcaatac

SEQ ID NO: 6271252 - DNA, 21 bp, Homo sapiens
gcattgaaagaagagatgaga

SEQ ID NO: 6271253 - DNA, 14 bp, Homo sapiens
gcattgaaataata

SEQ ID NO: 6271254 - DNA, 17 bp, Homo sapiens
gcattgaaatgagcacc

SEQ ID NO: 6271255 - DNA, 22 bp, Homo sapiens
gcattgaacacaaactgtaaat

SEQ ID NO: 6271256 - DNA, 23 bp, Homo sapiens
gcattgaacacaaactgtaaata

SEQ ID NO: 6271257 - DNA, 21 bp, Homo sapiens
gcattgaagagaactgcaact

SEQ ID NO: 6271258 - DNA, 20 bp, Homo sapiens
gcattgaaggcgaggctgcc

SEQ ID NO: 6271259 - DNA, 22 bp, Homo sapiens
gcattgaagtgtttgctgcaga

SEQ ID NO: 6271260 - DNA, 16 bp, Homo sapiens
gcattgaatatattat

SEQ ID NO: 6271261 - DNA, 15 bp, Homo sapiens
gcattgaatgacaag

SEQ ID NO: 6271262 - DNA, 21 bp, Homo sapiens
gcattgaatggctatgttttt

SEQ ID NO: 6271263 - DNA, 19 bp, Homo sapiens
gcattgacaaatctgtgta

SEQ ID NO: 6271264 - DNA, 22 bp, Homo sapiens
gcattgaccgcgactaatttca

SEQ ID NO: 6271265 - DNA, 16 bp, Homo sapiens
gcattgacctggaggg

SEQ ID NO: 6271266 - DNA, 14 bp, Homo sapiens
gcattgactcagat

SEQ ID NO: 6271267 - DNA, 22 bp, Homo sapiens
gcattgactggtttacaggccc

SEQ ID NO: 6271268 - DNA, 12 bp, Homo sapiens
gcattgactttc

SEQ ID NO: 6271269 - DNA, 15 bp, Homo sapiens
gcattgactttcccc

SEQ ID NO: 6271270 - DNA, 16 bp, Homo sapiens
gcattgactttcccca

SEQ ID NO: 6271271 - DNA, 14 bp, Homo sapiens
gcattgagaaggaa

SEQ ID NO: 6271272 - DNA, 15 bp, Homo sapiens
gcattgagaaggaac

SEQ ID NO: 6271273 - DNA, 20 bp, Homo sapiens
gcattgagaaggaactgata

SEQ ID NO: 6271274 - DNA, 21 bp, Homo sapiens
gcattgagaatggaggctccc

SEQ ID NO: 6271275 - DNA, 17 bp, Homo sapiens
gcattgagcatattttc

SEQ ID NO: 6271276 - DNA, 14 bp, Homo sapiens
gcattgagctgcct

SEQ ID NO: 6271277 - DNA, 15 bp, Homo sapiens
gcattgagctgcctc

SEQ ID NO: 6271278 - DNA, 22 bp, Homo sapiens
gcattgagctgcctccagcctg

SEQ ID NO: 6271279 - DNA, 17 bp, Homo sapiens
gcattgagtcattgtca

SEQ ID NO: 6271280 - DNA, 23 bp, Homo sapiens
gcattgagttttgaaagatgagt

SEQ ID NO: 6271281 - DNA, 21 bp, Homo sapiens
gcattgataatcttcaggtga

SEQ ID NO: 6271282 - DNA, 15 bp, Homo sapiens
gcattgatattgtga

SEQ ID NO: 6271283 - DNA, 18 bp, Homo sapiens
gcattgattgcacttgat

SEQ ID NO: 6271284 - DNA, 14 bp, Homo sapiens
gcattgcactaaaa

SEQ ID NO: 6271285 - DNA, 20 bp, Homo sapiens
gcattgcactaaaagtgatg

SEQ ID NO: 6271286 - DNA, 13 bp, Homo sapiens
gcattgcagcctt

SEQ ID NO: 6271287 - DNA, 16 bp, Homo sapiens
gcattgcagccttgcg

SEQ ID NO: 6271288 - DNA, 23 bp, Homo sapiens
gcattgccagtaacacaggccac

SEQ ID NO: 6271289 - DNA, 14 bp, Homo sapiens
gcattgcctggact

SEQ ID NO: 6271290 - DNA, 15 bp, Homo sapiens
gcattgcctggactg

SEQ ID NO: 6271291 - DNA, 19 bp, Homo sapiens
gcattgcctggactgacca

SEQ ID NO: 6271292 - DNA, 13 bp, Homo sapiens
gcattgcctgtga

SEQ ID NO: 6271293 - DNA, 15 bp, Homo sapiens
gcattgctagataaa

SEQ ID NO: 6271294 - DNA, 16 bp, Homo sapiens
gcattgctagataaaa

SEQ ID NO: 6271295 - DNA, 14 bp, Homo sapiens
gcattgctcagccc

SEQ ID NO: 6271296 - DNA, 17 bp, Homo sapiens
gcattgctgtccttggg

SEQ ID NO: 6271297 - DNA, 15 bp, Homo sapiens
gcattgctttccact

SEQ ID NO: 6271298 - DNA, 12 bp, Homo sapiens
gcattgctttct

SEQ ID NO: 6271299 - DNA, 13 bp, Homo sapiens
gcattgctttctg

SEQ ID NO: 6271300 - DNA, 16 bp, Homo sapiens
gcattgcttttggaca

SEQ ID NO: 6271301 - DNA, 19 bp, Homo sapiens
gcattggaactggaggcag

SEQ ID NO: 6271302 - DNA, 21 bp, Homo sapiens
gcattggccagaccacagcag

SEQ ID NO: 6271303 - DNA, 13 bp, Homo sapiens
gcattggcctctg

SEQ ID NO: 6271304 - DNA, 16 bp, Homo sapiens
gcattggcctctgtgt

SEQ ID NO: 6271305 - DNA, 14 bp, Homo sapiens
gcattggcctggcc

SEQ ID NO: 6271306 - DNA, 15 bp, Homo sapiens
gcattggcctggcct

SEQ ID NO: 6271307 - DNA, 13 bp, Homo sapiens
gcattgggatttt

SEQ ID NO: 6271308 - DNA, 20 bp, Homo sapiens
gcattgggcattagtgtccc

SEQ ID NO: 6271309 - DNA, 19 bp, Homo sapiens
gcattggggggccgggcag

SEQ ID NO: 6271310 - DNA, 22 bp, Homo sapiens
gcattggggttcctctgtacag

SEQ ID NO: 6271311 - DNA, 17 bp, Homo sapiens
gcattggtctgctgacc

SEQ ID NO: 6271312 - DNA, 17 bp, Homo sapiens
gcattggttttccatga

SEQ ID NO: 6271313 - DNA, 16 bp, Homo sapiens
gcattgtaaaataatt

SEQ ID NO: 6271314 - DNA, 16 bp, Homo sapiens
gcattgtaaacataaa

SEQ ID NO: 6271315 - DNA, 21 bp, Homo sapiens
gcattgtaagcgtatggcttt

SEQ ID NO: 6271316 - DNA, 21 bp, Homo sapiens
gcattgtatagatataatgaa

SEQ ID NO: 6271317 - DNA, 15 bp, Homo sapiens
gcattgtatcgatgt

SEQ ID NO: 6271318 - DNA, 23 bp, Homo sapiens
gcattgtccttttcttttcttga

SEQ ID NO: 6271319 - DNA, 13 bp, Homo sapiens
gcattgtctgcaa

SEQ ID NO: 6271320 - DNA, 14 bp, Homo sapiens
gcattgtcttgttc

SEQ ID NO: 6271321 - DNA, 16 bp, Homo sapiens
gcattgtcttgttctg

SEQ ID NO: 6271322 - DNA, 21 bp, Homo sapiens
gcattgtcttgttctgtccct

SEQ ID NO: 6271323 - DNA, 15 bp, Homo sapiens
gcattgtctttgctg

SEQ ID NO: 6271324 - DNA, 20 bp, Homo sapiens
gcattgtgaattgcctgcca

SEQ ID NO: 6271325 - DNA, 21 bp, Homo sapiens
gcattgtgaattgcctgccat

SEQ ID NO: 6271326 - DNA, 20 bp, Homo sapiens
gcattgtgtcagaaacatga

SEQ ID NO: 6271327 - DNA, 23 bp, Homo sapiens
gcattgtgtggaatttgaggtct

SEQ ID NO: 6271328 - DNA, 21 bp, Homo sapiens
gcattgttagtttagtgtgtg

SEQ ID NO: 6271329 - DNA, 15 bp, Homo sapiens
gcattgttgaggtgg

SEQ ID NO: 6271330 - DNA, 20 bp, Homo sapiens
gcattgttggctatttgaaa

SEQ ID NO: 6271331 - DNA, 22 bp, Homo sapiens
gcattgttgtaaagtatttgat

SEQ ID NO: 6271332 - DNA, 20 bp, Homo sapiens
gcattgtttgcttattgttc

SEQ ID NO: 6271333 - DNA, 13 bp, Homo sapiens
gcatttaaaaaaa

SEQ ID NO: 6271334 - DNA, 12 bp, Homo sapiens
gcatttaaaaga

SEQ ID NO: 6271335 - DNA, 18 bp, Homo sapiens
gcatttaaaagatacagt

SEQ ID NO: 6271336 - DNA, 22 bp, Homo sapiens
gcatttaaaagatacagttact

SEQ ID NO: 6271337 - DNA, 22 bp, Homo sapiens
gcatttaaactctgccagaaaa

SEQ ID NO: 6271338 - DNA, 18 bp, Homo sapiens
gcatttaacttacatttg

SEQ ID NO: 6271339 - DNA, 14 bp, Homo sapiens
gcatttaaggaaac

SEQ ID NO: 6271340 - DNA, 14 bp, Homo sapiens
gcatttaaggagat

SEQ ID NO: 6271341 - DNA, 16 bp, Homo sapiens
gcatttaatcaggagg

SEQ ID NO: 6271342 - DNA, 15 bp, Homo sapiens
gcatttaccaacatg

SEQ ID NO: 6271343 - DNA, 18 bp, Homo sapiens
gcatttactatgccacag

SEQ ID NO: 6271344 - DNA, 18 bp, Homo sapiens
gcatttactgtgtctttg

SEQ ID NO: 6271345 - DNA, 18 bp, Homo sapiens
gcatttactttgtgttca

SEQ ID NO: 6271346 - DNA, 13 bp, Homo sapiens
gcatttagaaatc

SEQ ID NO: 6271347 - DNA, 22 bp, Homo sapiens
gcatttagaactttctgctttg

SEQ ID NO: 6271348 - DNA, 18 bp, Homo sapiens
gctgtcattgcttcttct

SEQ ID NO: 6271349 - DNA, 20 bp, Homo sapiens
gctgtcattgcttcttctga

SEQ ID NO: 6271350 - DNA, 13 bp, Homo sapiens
gctgtcattttat

SEQ ID NO: 6271351 - DNA, 18 bp, Homo sapiens
gctgtccagaaaggtttg

SEQ ID NO: 6271352 - DNA, 15 bp, Homo sapiens
gctgtccagacagcc

SEQ ID NO: 6271353 - DNA, 12 bp, Homo sapiens
gctgtccagtgc

SEQ ID NO: 6271354 - DNA, 23 bp, Homo sapiens
gctgtccagtgcccattcctcac

SEQ ID NO: 6271355 - DNA, 19 bp, Homo sapiens
gctgtccagtgcctacatc

SEQ ID NO: 6271356 - DNA, 16 bp, Homo sapiens
gctgtccattgccacg

SEQ ID NO: 6271357 - DNA, 18 bp, Homo sapiens
gctgtccattgccacggc

SEQ ID NO: 6271358 - DNA, 19 bp, Homo sapiens
gctgtcccaagctcccaag

SEQ ID NO: 6271359 - DNA, 21 bp, Homo sapiens
gctgtcccaagctcccaagag

SEQ ID NO: 6271360 - DNA, 13 bp, Homo sapiens
gctgtcccaggca

SEQ ID NO: 6271361 - DNA, 14 bp, Homo sapiens
gctgtcccaggggt

SEQ ID NO: 6271362 - DNA, 23 bp, Homo sapiens
gctgtcccatagtccctgccacg

SEQ ID NO: 6271363 - DNA, 17 bp, Homo sapiens
gctgtccccactgcccc

SEQ ID NO: 6271364 - DNA, 18 bp, Homo sapiens
gctgtccccactgcccca

SEQ ID NO: 6271365 - DNA, 14 bp, Homo sapiens
gctgtccccccact

SEQ ID NO: 6271366 - DNA, 15 bp, Homo sapiens
gctgtccccccactc

SEQ ID NO: 6271367 - DNA, 15 bp, Homo sapiens
gctgtcccctcagcg

SEQ ID NO: 6271368 - DNA, 15 bp, Homo sapiens
gctgtcccctccatc

SEQ ID NO: 6271369 - DNA, 14 bp, Homo sapiens
gctgtcccctctcc

SEQ ID NO: 6271370 - DNA, 18 bp, Homo sapiens
gctgtcccctcttgcccc

SEQ ID NO: 6271371 - DNA, 19 bp, Homo sapiens
gctgtcccctcttgcccca

SEQ ID NO: 6271372 - DNA, 20 bp, Homo sapiens
gctgtcccctcttgccccaa

SEQ ID NO: 6271373 - DNA, 16 bp, Homo sapiens
gctgtcccctgcaagt

SEQ ID NO: 6271374 - DNA, 13 bp, Homo sapiens
gctgtccctcact

SEQ ID NO: 6271375 - DNA, 16 bp, Homo sapiens
gctgtccctcctgagg

SEQ ID NO: 6271376 - DNA, 12 bp, Homo sapiens
gctgtccctgca

SEQ ID NO: 6271377 - DNA, 18 bp, Homo sapiens
gctgtccctgcactgtgc

SEQ ID NO: 6271378 - DNA, 13 bp, Homo sapiens
gctgtccctgcag

SEQ ID NO: 6271379 - DNA, 11 bp, Homo sapiens
gctgtccctgt

SEQ ID NO: 6271380 - DNA, 16 bp, Homo sapiens
gctgtccctgtcagga

SEQ ID NO: 6271381 - DNA, 13 bp, Homo sapiens
gctgtccctgtgg

SEQ ID NO: 6271382 - DNA, 15 bp, Homo sapiens
gctgtccctgtgggc

SEQ ID NO: 6271383 - DNA, 21 bp, Homo sapiens
gctgtcccttacgtgagtcct

SEQ ID NO: 6271384 - DNA, 23 bp, Homo sapiens
gctgtcccttacgtgagtcctgg

SEQ ID NO: 6271385 - DNA, 15 bp, Homo sapiens
gctgtccgtgcttgc

SEQ ID NO: 6271386 - DNA, 17 bp, Homo sapiens
gctgtccgtgcttgctg

SEQ ID NO: 6271387 - DNA, 19 bp, Homo sapiens
gctgtccgtgtgcctcctg

SEQ ID NO: 6271388 - DNA, 16 bp, Homo sapiens
gctgtcctaagaactt

SEQ ID NO: 6271389 - DNA, 15 bp, Homo sapiens
gctgtcctccctcca

SEQ ID NO: 6271390 - DNA, 15 bp, Homo sapiens
gctgtcctcctggca

SEQ ID NO: 6271391 - DNA, 16 bp, Homo sapiens
gctgtcctcctggcac

SEQ ID NO: 6271392 - DNA, 14 bp, Homo sapiens
gctgtcctccttcc

SEQ ID NO: 6271393 - DNA, 15 bp, Homo sapiens
gctgtcctccttcct

SEQ ID NO: 6271394 - DNA, 21 bp, Homo sapiens
gctgtcctctcatttgcagtc

SEQ ID NO: 6271395 - DNA, 15 bp, Homo sapiens
gctgtcctctccccc

SEQ ID NO: 6271396 - DNA, 16 bp, Homo sapiens
gctgtcctctccccct

SEQ ID NO: 6271397 - DNA, 21 bp, Homo sapiens
gctgtcctctcccccttcagc

SEQ ID NO: 6271398 - DNA, 15 bp, Homo sapiens
gctgtcctgcgttca

SEQ ID NO: 6271399 - DNA, 14 bp, Homo sapiens
gctgtcctgctgcc

SEQ ID NO: 6271400 - DNA, 16 bp, Homo sapiens
gctgtcctggaggggc

SEQ ID NO: 6271401 - DNA, 13 bp, Homo sapiens
gctgtcctggtgg

SEQ ID NO: 6271402 - DNA, 18 bp, Homo sapiens
gctgtcctggtggctggg

SEQ ID NO: 6271403 - DNA, 14 bp, Homo sapiens
gctgtccttcccct

SEQ ID NO: 6271404 - DNA, 21 bp, Homo sapiens
gctgtccttccccttccccgt

SEQ ID NO: 6271405 - DNA, 18 bp, Homo sapiens
gctgtccttgaatgccat

SEQ ID NO: 6271406 - DNA, 14 bp, Homo sapiens
gctgtcctttctag

SEQ ID NO: 6271407 - DNA, 14 bp, Homo sapiens
gctgtcgccccagg

SEQ ID NO: 6271408 - DNA, 15 bp, Homo sapiens
gctgtcgccccaggc

SEQ ID NO: 6271409 - DNA, 16 bp, Homo sapiens
gctgtcgccccaggcc

SEQ ID NO: 6271410 - DNA, 17 bp, Homo sapiens
gctgtcgccccaggccc

SEQ ID NO: 6271411 - DNA, 17 bp, Homo sapiens
gctgtcggagggctgga

SEQ ID NO: 6271412 - DNA, 13 bp, Homo sapiens
gctgtcggcacca

SEQ ID NO: 6271413 - DNA, 18 bp, Homo sapiens
gctgtcggcgctgcccca

SEQ ID NO: 6271414 - DNA, 14 bp, Homo sapiens
gctgtcgggaccac

SEQ ID NO: 6271415 - DNA, 21 bp, Homo sapiens
gctgtcgggggccactgtgtt

SEQ ID NO: 6271416 - DNA, 13 bp, Homo sapiens
gctgtcggtgttt

SEQ ID NO: 6271417 - DNA, 21 bp, Homo sapiens
gctgtcgtccccctccagtgc

SEQ ID NO: 6271418 - DNA, 17 bp, Homo sapiens
gctgtctaacccccagc

SEQ ID NO: 6271419 - DNA, 19 bp, Homo sapiens
gctgtctaacccccagctg

SEQ ID NO: 6271420 - DNA, 21 bp, Homo sapiens
gctgtctaacccccagctggg

SEQ ID NO: 6271421 - DNA, 22 bp, Homo sapiens
gctgtctaacccccagctgggt

SEQ ID NO: 6271422 - DNA, 21 bp, Homo sapiens
gctgtctacagtagctgctac

SEQ ID NO: 6271423 - DNA, 19 bp, Homo sapiens
gctgtctagaatgtggatt

SEQ ID NO: 6271424 - DNA, 19 bp, Homo sapiens
gctgtctatgcagcctgct

SEQ ID NO: 6271425 - DNA, 19 bp, Homo sapiens
gctgtctcagacgactagc

SEQ ID NO: 6271426 - DNA, 23 bp, Homo sapiens
gctgtctcagacgactagcccag

SEQ ID NO: 6271427 - DNA, 21 bp, Homo sapiens
gctgtctccataatgccactg

SEQ ID NO: 6271428 - DNA, 17 bp, Homo sapiens
gctgtctccatgtttga

SEQ ID NO: 6271429 - DNA, 13 bp, Homo sapiens
gctgtctccctcc

SEQ ID NO: 6271430 - DNA, 14 bp, Homo sapiens
gctgtctccctcct

SEQ ID NO: 6271431 - DNA, 15 bp, Homo sapiens
gctgtctccctcctg

SEQ ID NO: 6271432 - DNA, 14 bp, Homo sapiens
gctgtctcctgtcc

SEQ ID NO: 6271433 - DNA, 13 bp, Homo sapiens
gctgtctctcttg

SEQ ID NO: 6271434 - DNA, 14 bp, Homo sapiens
gctgtctctcttgt

SEQ ID NO: 6271435 - DNA, 18 bp, Homo sapiens
gctgtctctgaggggtgg

SEQ ID NO: 6271436 - DNA, 13 bp, Homo sapiens
gctgtctctgctc

SEQ ID NO: 6271437 - DNA, 12 bp, Homo sapiens
gctgtctctgtc

SEQ ID NO: 6271438 - DNA, 13 bp, Homo sapiens
gctgtctctgtcc

SEQ ID NO: 6271439 - DNA, 20 bp, Homo sapiens
gctgtctgaagcccaaagcc

SEQ ID NO: 6271440 - DNA, 21 bp, Homo sapiens
gctgtctgaagcccaaagcct

SEQ ID NO: 6271441 - DNA, 18 bp, Homo sapiens
gctgtctgaccagagaat

SEQ ID NO: 6271442 - DNA, 18 bp, Homo sapiens
gctgtctgagtagtggcc

SEQ ID NO: 6271443 - DNA, 20 bp, Homo sapiens
gctgtctgagtagtggccac

SEQ ID NO: 6271444 - DNA, 21 bp, Homo sapiens
gctgtctgagtagtggccact

SEQ ID NO: 6271445 - DNA, 19 bp, Homo sapiens
gctgtctgatctgtgcttt

SEQ ID NO: 6271446 - DNA, 14 bp, Homo sapiens
gctgtctgcacaga

SEQ ID NO: 6271447 - DNA, 12 bp, Homo sapiens
gctgtctgcagc

SEQ ID NO: 6271448 - DNA, 14 bp, Homo sapiens
gctgtctgcagcct

SEQ ID NO: 6271449 - DNA, 13 bp, Homo sapiens
gctgtctgccagg

SEQ ID NO: 6271450 - DNA, 12 bp, Homo sapiens
gctgtctgcctg

SEQ ID NO: 6271451 - DNA, 15 bp, Homo sapiens
gctgtctgcctgtat

SEQ ID NO: 6271452 - DNA, 21 bp, Homo sapiens
gctgtctgcggagccagcgcc

SEQ ID NO: 6271453 - DNA, 19 bp, Homo sapiens
gctgtctggcacagcctgc

SEQ ID NO: 6271454 - DNA, 13 bp, Homo sapiens
gctgtctgggact

SEQ ID NO: 6271455 - DNA, 14 bp, Homo sapiens
gctgtctgggactc

SEQ ID NO: 6271456 - DNA, 22 bp, Homo sapiens
gctgtctgggtgctactgggga

SEQ ID NO: 6271457 - DNA, 21 bp, Homo sapiens
gctgtctggtgaggtggccca

SEQ ID NO: 6271458 - DNA, 21 bp, Homo sapiens
gctgtctgtcaccagctatct

SEQ ID NO: 6271459 - DNA, 13 bp, Homo sapiens
gctgtctgtctct

SEQ ID NO: 6271460 - DNA, 14 bp, Homo sapiens
gctgtctgtgaata

SEQ ID NO: 6271461 - DNA, 17 bp, Homo sapiens
gctgtctgtgtgaggct

SEQ ID NO: 6271462 - DNA, 23 bp, Homo sapiens
gctgtctgttgtattcattgtgg

SEQ ID NO: 6271463 - DNA, 21 bp, Homo sapiens
gctgtcttactaataggtctg

SEQ ID NO: 6271464 - DNA, 12 bp, Homo sapiens
gctgtcttcagt

SEQ ID NO: 6271465 - DNA, 16 bp, Homo sapiens
gctgtcttcagtctca

SEQ ID NO: 6271466 - DNA, 16 bp, Homo sapiens
gctgtcttctcccaga

SEQ ID NO: 6271467 - DNA, 18 bp, Homo sapiens
gctgtcttctcccagagc

SEQ ID NO: 6271468 - DNA, 13 bp, Homo sapiens
gctgtcttctgga

SEQ ID NO: 6271469 - DNA, 20 bp, Homo sapiens
gctgtcttgatgactgctga

SEQ ID NO: 6271470 - DNA, 13 bp, Homo sapiens
gctgtcttgcccc

SEQ ID NO: 6271471 - DNA, 15 bp, Homo sapiens
gctgtcttgccccag

SEQ ID NO: 6271472 - DNA, 20 bp, Homo sapiens
gctgtcttggggtcccactg

SEQ ID NO: 6271473 - DNA, 16 bp, Homo sapiens
gctgtctttcttgctc

SEQ ID NO: 6271474 - DNA, 18 bp, Homo sapiens
gctgtctttcttgctccc

SEQ ID NO: 6271475 - DNA, 23 bp, Homo sapiens
gctgtctttcttgctccctgact

SEQ ID NO: 6271476 - DNA, 16 bp, Homo sapiens
gctgtctttgcagggc

SEQ ID NO: 6271477 - DNA, 17 bp, Homo sapiens
gctgtctttgcagggca

SEQ ID NO: 6271478 - DNA, 12 bp, Homo sapiens
gctgtctttgtg

SEQ ID NO: 6271479 - DNA, 13 bp, Homo sapiens
gctgtgaaaaaaa

SEQ ID NO: 6271480 - DNA, 16 bp, Homo sapiens
gctgtgaaaattacac

SEQ ID NO: 6271481 - DNA, 16 bp, Homo sapiens
gctgtgaaatggagaa

SEQ ID NO: 6271482 - DNA, 19 bp, Homo sapiens
gctgtgaacatgcctcctc

SEQ ID NO: 6271483 - DNA, 22 bp, Homo sapiens
gctgtgaacatgcctcctcctg

SEQ ID NO: 6271484 - DNA, 21 bp, Homo sapiens
gctgtgaaccctggggcctga

SEQ ID NO: 6271485 - DNA, 23 bp, Homo sapiens
gctgtgaaccctggggcctgact

SEQ ID NO: 6271486 - DNA, 18 bp, Homo sapiens
gctgtgaataaaaagaaa

SEQ ID NO: 6271487 - DNA, 22 bp, Homo sapiens
gctgtgaataaaaagaaagatt

SEQ ID NO: 6271488 - DNA, 20 bp, Homo sapiens
gctgtgaatttgtgtaagga

SEQ ID NO: 6271489 - DNA, 15 bp, Homo sapiens
gctgtgacaaccctg

SEQ ID NO: 6271490 - DNA, 21 bp, Homo sapiens
gctgtgacaaccctggcctca

SEQ ID NO: 6271491 - DNA, 23 bp, Homo sapiens
gctgtgacaaccctggcctcact

SEQ ID NO: 6271492 - DNA, 22 bp, Homo sapiens
gctgtgacaatggcaacaattt

SEQ ID NO: 6271493 - DNA, 13 bp, Homo sapiens
gctgtgacatcta

SEQ ID NO: 6271494 - DNA, 17 bp, Homo sapiens
gctgtgacctgctgagc

SEQ ID NO: 6271495 - DNA, 22 bp, Homo sapiens
gctgtgacctgctgagctctga

SEQ ID NO: 6271496 - DNA, 23 bp, Homo sapiens
gctgtgacctgctgagctctgag

SEQ ID NO: 6271497 - DNA, 15 bp, Homo sapiens
gctgtgacgcagccg

SEQ ID NO: 6271498 - DNA, 20 bp, Homo sapiens
gctgtgactcttctctcaac

SEQ ID NO: 6271499 - DNA, 15 bp, Homo sapiens
gctgtgactgagggc

SEQ ID NO: 6271500 - DNA, 17 bp, Homo sapiens
gctgtgactgagggcct

SEQ ID NO: 6271501 - DNA, 16 bp, Homo sapiens
gctgtgacttctccag

SEQ ID NO: 6271502 - DNA, 22 bp, Homo sapiens
gctgtgagatggatgtatttgt

SEQ ID NO: 6271503 - DNA, 24 bp, Homo sapiens
gctgtgagcaaacagaggaggcca

SEQ ID NO: 6271504 - DNA, 17 bp, Homo sapiens
gctgtgagcagcctcca

SEQ ID NO: 6271505 - DNA, 18 bp, Homo sapiens
gctgtgagcagcctccac

SEQ ID NO: 6271506 - DNA, 16 bp, Homo sapiens
gctgtgagccatgcct

SEQ ID NO: 6271507 - DNA, 20 bp, Homo sapiens
gctgtgagccatgcctccct

SEQ ID NO: 6271508 - DNA, 15 bp, Homo sapiens
gctgtgagcccctgg

SEQ ID NO: 6271509 - DNA, 13 bp, Homo sapiens
gctgtgagccttg

SEQ ID NO: 6271510 - DNA, 18 bp, Homo sapiens
gctgtgaggaatgctctg

SEQ ID NO: 6271511 - DNA, 14 bp, Homo sapiens
gctgtgaggacagg

SEQ ID NO: 6271512 - DNA, 15 bp, Homo sapiens
gctgtgaggcgggtg

SEQ ID NO: 6271513 - DNA, 12 bp, Homo sapiens
gctgtgaggctg

SEQ ID NO: 6271514 - DNA, 15 bp, Homo sapiens
gctgtgaggcttgcc

SEQ ID NO: 6271515 - DNA, 19 bp, Homo sapiens
gctgtgaggcttgcccagg

SEQ ID NO: 6271516 - DNA, 13 bp, Homo sapiens
gctgtgagggagg

SEQ ID NO: 6271517 - DNA, 23 bp, Homo sapiens
gctgtgagggaggggaaaagcat

SEQ ID NO: 6271518 - DNA, 20 bp, Homo sapiens
gctgtgagtctttggttcta

SEQ ID NO: 6271519 - DNA, 15 bp, Homo sapiens
gctgtgagtgcgcct

SEQ ID NO: 6271520 - DNA, 20 bp, Homo sapiens
gctgtgagtgcgtgtgtgtg

SEQ ID NO: 6271521 - DNA, 14 bp, Homo sapiens
gctgtgatgcatga

SEQ ID NO: 6271522 - DNA, 15 bp, Homo sapiens
gctgtgatgcatgag

SEQ ID NO: 6271523 - DNA, 20 bp, Homo sapiens
gctgtgcaacgccgtgggct

SEQ ID NO: 6271524 - DNA, 23 bp, Homo sapiens
gctgtgcaattactgcctgcaga

SEQ ID NO: 6271525 - DNA, 19 bp, Homo sapiens
gctgtgcacaaagtggcat

SEQ ID NO: 6271526 - DNA, 9 bp, Homo sapiens
gctgtgcca

SEQ ID NO: 6271527 - DNA, 19 bp, Homo sapiens
gctgtgccaaagcaggtca

SEQ ID NO: 6271528 - DNA, 19 bp, Homo sapiens
gcatttagagcttttcaga

SEQ ID NO: 6271529 - DNA, 13 bp, Homo sapiens
gcatttagatgta

SEQ ID NO: 6271530 - DNA, 23 bp, Homo sapiens
gcatttagcacagtatttaacat

SEQ ID NO: 6271531 - DNA, 17 bp, Homo sapiens
gcatttagcatgagttc

SEQ ID NO: 6271532 - DNA, 19 bp, Homo sapiens
gcatttagcatgagttctg

SEQ ID NO: 6271533 - DNA, 16 bp, Homo sapiens
gcatttagctggccac

SEQ ID NO: 6271534 - DNA, 14 bp, Homo sapiens
gcatttagcttctt

SEQ ID NO: 6271535 - DNA, 13 bp, Homo sapiens
gcatttaggagaa

SEQ ID NO: 6271536 - DNA, 19 bp, Homo sapiens
gcatttaggccatgggaca

SEQ ID NO: 6271537 - DNA, 18 bp, Homo sapiens
gcatttagggagtattct

SEQ ID NO: 6271538 - DNA, 19 bp, Homo sapiens
gcatttagtgaagttgtgc

SEQ ID NO: 6271539 - DNA, 21 bp, Homo sapiens
gcatttagttttatggcatga

SEQ ID NO: 6271540 - DNA, 23 bp, Homo sapiens
gcatttagttttatggcatgatt

SEQ ID NO: 6271541 - DNA, 17 bp, Homo sapiens
gcatttatagatcattt

SEQ ID NO: 6271542 - DNA, 18 bp, Homo sapiens
gcatttatcttttttcct

SEQ ID NO: 6271543 - DNA, 16 bp, Homo sapiens
gcatttatgcatgaga

SEQ ID NO: 6271544 - DNA, 20 bp, Homo sapiens
gcatttatggtaatcatatt

SEQ ID NO: 6271545 - DNA, 19 bp, Homo sapiens
gcatttatggtcaacactt

SEQ ID NO: 6271546 - DNA, 14 bp, Homo sapiens
gcatttatgtagac

SEQ ID NO: 6271547 - DNA, 22 bp, Homo sapiens
gcatttatgtagacattgtaaa

SEQ ID NO: 6271548 - DNA, 23 bp, Homo sapiens
gcatttatttatacagtgccttg

SEQ ID NO: 6271549 - DNA, 18 bp, Homo sapiens
gcatttatttatgtgcaa

SEQ ID NO: 6271550 - DNA, 16 bp, Homo sapiens
gcatttatttgtgatg

SEQ ID NO: 6271551 - DNA, 17 bp, Homo sapiens
gcatttatttgtgatga

SEQ ID NO: 6271552 - DNA, 16 bp, Homo sapiens
gcatttcaaagccctg

SEQ ID NO: 6271553 - DNA, 20 bp, Homo sapiens
gcatttcaaagccctgcctc

SEQ ID NO: 6271554 - DNA, 17 bp, Homo sapiens
gcatttcaaatgttaga

SEQ ID NO: 6271555 - DNA, 18 bp, Homo sapiens
gcatttcaaggaatggaa

SEQ ID NO: 6271556 - DNA, 12 bp, Homo sapiens
gcatttcaatcc

SEQ ID NO: 6271557 - DNA, 15 bp, Homo sapiens
gcatttcaatttcaa

SEQ ID NO: 6271558 - DNA, 19 bp, Homo sapiens
gcatttcacaaaacagcct

SEQ ID NO: 6271559 - DNA, 22 bp, Homo sapiens
gcatttcacaaaacagcctttg

SEQ ID NO: 6271560 - DNA, 18 bp, Homo sapiens
gcatttcacatgccttgc

SEQ ID NO: 6271561 - DNA, 19 bp, Homo sapiens
gcatttcacatgccttgca

SEQ ID NO: 6271562 - DNA, 17 bp, Homo sapiens
gcatttcacgaactgtt

SEQ ID NO: 6271563 - DNA, 21 bp, Homo sapiens
gcatttcagcttgaacctgct

SEQ ID NO: 6271564 - DNA, 22 bp, Homo sapiens
gcatttcatgaaaaagctgctt

SEQ ID NO: 6271565 - DNA, 23 bp, Homo sapiens
gcatttcatgctatcagaaacag

SEQ ID NO: 6271566 - DNA, 15 bp, Homo sapiens
gcatttcattatgct

SEQ ID NO: 6271567 - DNA, 16 bp, Homo sapiens
gcatttcattatgctt

SEQ ID NO: 6271568 - DNA, 19 bp, Homo sapiens
gcatttcattatgctttga

SEQ ID NO: 6271569 - DNA, 20 bp, Homo sapiens
gcatttcattatgctttgaa

SEQ ID NO: 6271570 - DNA, 13 bp, Homo sapiens
gcatttcattctt

SEQ ID NO: 6271571 - DNA, 12 bp, Homo sapiens
gcatttccaaac

SEQ ID NO: 6271572 - DNA, 13 bp, Homo sapiens
gcatttccaaaca

SEQ ID NO: 6271573 - DNA, 20 bp, Homo sapiens
gcatttccacactgtcagag

SEQ ID NO: 6271574 - DNA, 14 bp, Homo sapiens
gcatttccagagca

SEQ ID NO: 6271575 - DNA, 15 bp, Homo sapiens
gcatttcccaccctg

SEQ ID NO: 6271576 - DNA, 17 bp, Homo sapiens
gcatttcccccagggaa

SEQ ID NO: 6271577 - DNA, 18 bp, Homo sapiens
gcatttcccttccttcct

SEQ ID NO: 6271578 - DNA, 14 bp, Homo sapiens
gcatttcctgctga

SEQ ID NO: 6271579 - DNA, 21 bp, Homo sapiens
gcatttcctgggtggctactc

SEQ ID NO: 6271580 - DNA, 22 bp, Homo sapiens
gcatttctcatgcttcttctca

SEQ ID NO: 6271581 - DNA, 17 bp, Homo sapiens
gcatttctcttcctaaa

SEQ ID NO: 6271582 - DNA, 18 bp, Homo sapiens
gcatttctcttcctaaat

SEQ ID NO: 6271583 - DNA, 13 bp, Homo sapiens
gcatttctcttct

SEQ ID NO: 6271584 - DNA, 18 bp, Homo sapiens
gcatttctgaatagaaat

SEQ ID NO: 6271585 - DNA, 15 bp, Homo sapiens
gcatttctgggcctt

SEQ ID NO: 6271586 - DNA, 21 bp, Homo sapiens
gcatttcttgatgttgcttag

SEQ ID NO: 6271587 - DNA, 18 bp, Homo sapiens
gcatttctttatttctgt

SEQ ID NO: 6271588 - DNA, 16 bp, Homo sapiens
gcatttctttggaaac

SEQ ID NO: 6271589 - DNA, 17 bp, Homo sapiens
gcatttgaaaggtgtgc

SEQ ID NO: 6271590 - DNA, 15 bp, Homo sapiens
gcatttgaatgcatt

SEQ ID NO: 6271591 - DNA, 14 bp, Homo sapiens
gcatttgagaaatg

SEQ ID NO: 6271592 - DNA, 15 bp, Homo sapiens
gcatttgagaaatgc

SEQ ID NO: 6271593 - DNA, 14 bp, Homo sapiens
gcatttgaggggcc

SEQ ID NO: 6271594 - DNA, 17 bp, Homo sapiens
gcatttgaggggccagg

SEQ ID NO: 6271595 - DNA, 21 bp, Homo sapiens
gcatttgaggggccaggggca

SEQ ID NO: 6271596 - DNA, 19 bp, Homo sapiens
gcatttgatagcaatgtaa

SEQ ID NO: 6271597 - DNA, 13 bp, Homo sapiens
gcatttgattttt

SEQ ID NO: 6271598 - DNA, 23 bp, Homo sapiens
gcatttgcaggtgaccagaatga

SEQ ID NO: 6271599 - DNA, 23 bp, Homo sapiens
gcatttgctctttcatctctgct

SEQ ID NO: 6271600 - DNA, 13 bp, Homo sapiens
gcatttgctggtt

SEQ ID NO: 6271601 - DNA, 22 bp, Homo sapiens
gcatttgctggttataacagca

SEQ ID NO: 6271602 - DNA, 22 bp, Homo sapiens
gcatttgctgttgtttctataa

SEQ ID NO: 6271603 - DNA, 14 bp, Homo sapiens
gcatttgcttttgt

SEQ ID NO: 6271604 - DNA, 22 bp, Homo sapiens
gcatttggattggggtccctct

SEQ ID NO: 6271605 - DNA, 20 bp, Homo sapiens
gcatttggcaggaagatgta

SEQ ID NO: 6271606 - DNA, 13 bp, Homo sapiens
gcatttggcctct

SEQ ID NO: 6271607 - DNA, 16 bp, Homo sapiens
gcatttggctgctgta

SEQ ID NO: 6271608 - DNA, 14 bp, Homo sapiens
gcatttggcttcct

SEQ ID NO: 6271609 - DNA, 20 bp, Homo sapiens
gcatttgggtaatttagatt

SEQ ID NO: 6271610 - DNA, 17 bp, Homo sapiens
gcatttgggtccaggag

SEQ ID NO: 6271611 - DNA, 20 bp, Homo sapiens
gcatttgggtggtttttatt

SEQ ID NO: 6271612 - DNA, 12 bp, Homo sapiens
gcatttggtctc

SEQ ID NO: 6271613 - DNA, 21 bp, Homo sapiens
gcatttggtggtttcagaaat

SEQ ID NO: 6271614 - DNA, 12 bp, Homo sapiens
gcatttgtaaaa

SEQ ID NO: 6271615 - DNA, 18 bp, Homo sapiens
gcatttgtaaatattaaa

SEQ ID NO: 6271616 - DNA, 20 bp, Homo sapiens
gcatttgtaaatattaaacc

SEQ ID NO: 6271617 - DNA, 12 bp, Homo sapiens
gcatttgtattt

SEQ ID NO: 6271618 - DNA, 15 bp, Homo sapiens
gcatttgtccaccca

SEQ ID NO: 6271619 - DNA, 23 bp, Homo sapiens
gcatttgtctattctccagctga

SEQ ID NO: 6271620 - DNA, 19 bp, Homo sapiens
gcatttgtcttagagagag

SEQ ID NO: 6271621 - DNA, 20 bp, Homo sapiens
gcatttgtcttagagagaga

SEQ ID NO: 6271622 - DNA, 18 bp, Homo sapiens
gcatttgtgtctgcctgc

SEQ ID NO: 6271623 - DNA, 23 bp, Homo sapiens
gcatttgtgtgtgtgtgtgtgtt

SEQ ID NO: 6271624 - DNA, 16 bp, Homo sapiens
gcatttgtgttattat

SEQ ID NO: 6271625 - DNA, 12 bp, Homo sapiens
gcatttgttcac

SEQ ID NO: 6271626 - DNA, 18 bp, Homo sapiens
gcatttgttcagctcccc

SEQ ID NO: 6271627 - DNA, 20 bp, Homo sapiens
gcatttgtttatgtaatttc

SEQ ID NO: 6271628 - DNA, 20 bp, Homo sapiens
gcatttgtttgctgaaattt

SEQ ID NO: 6271629 - DNA, 15 bp, Homo sapiens
gcattttaaaagcaa

SEQ ID NO: 6271630 - DNA, 23 bp, Homo sapiens
gcattttaaatgtctataaatgg

SEQ ID NO: 6271631 - DNA, 13 bp, Homo sapiens
gcattttaagtaa

SEQ ID NO: 6271632 - DNA, 15 bp, Homo sapiens
gcattttaagtaaaa

SEQ ID NO: 6271633 - DNA, 23 bp, Homo sapiens
gcattttaagtgtttaaaagcaa

SEQ ID NO: 6271634 - DNA, 22 bp, Homo sapiens
gcattttactatgcctgttgat

SEQ ID NO: 6271635 - DNA, 16 bp, Homo sapiens
gcattttactgtacag

SEQ ID NO: 6271636 - DNA, 16 bp, Homo sapiens
gcattttagaaactac

SEQ ID NO: 6271637 - DNA, 18 bp, Homo sapiens
gcattttagaaactacaa

SEQ ID NO: 6271638 - DNA, 23 bp, Homo sapiens
gcattttagaaactacaaatata

SEQ ID NO: 6271639 - DNA, 23 bp, Homo sapiens
gcattttaggtcccagaatggaa

SEQ ID NO: 6271640 - DNA, 13 bp, Homo sapiens
gcattttatagac

SEQ ID NO: 6271641 - DNA, 18 bp, Homo sapiens
gcattttattaaacttaa

SEQ ID NO: 6271642 - DNA, 12 bp, Homo sapiens
gcattttattct

SEQ ID NO: 6271643 - DNA, 12 bp, Homo sapiens
gcattttattga

SEQ ID NO: 6271644 - DNA, 23 bp, Homo sapiens
gcattttcaagatacatttcatc

SEQ ID NO: 6271645 - DNA, 22 bp, Homo sapiens
gcattttcacattttgcctttc

SEQ ID NO: 6271646 - DNA, 12 bp, Homo sapiens
gcattttcctcc

SEQ ID NO: 6271647 - DNA, 21 bp, Homo sapiens
gcattttcctctgctttgaaa

SEQ ID NO: 6271648 - DNA, 16 bp, Homo sapiens
gcattttctaaacaga

SEQ ID NO: 6271649 - DNA, 20 bp, Homo sapiens
gcattttctaagtgggacat

SEQ ID NO: 6271650 - DNA, 17 bp, Homo sapiens
gcattttctgcatctcc

SEQ ID NO: 6271651 - DNA, 14 bp, Homo sapiens
gcattttcttcaga

SEQ ID NO: 6271652 - DNA, 16 bp, Homo sapiens
gcattttgacaacatg

SEQ ID NO: 6271653 - DNA, 12 bp, Homo sapiens
gcattttgcaaa

SEQ ID NO: 6271654 - DNA, 12 bp, Homo sapiens
gcattttgctaa

SEQ ID NO: 6271655 - DNA, 22 bp, Homo sapiens
gcattttggagagtttcctgaa

SEQ ID NO: 6271656 - DNA, 13 bp, Homo sapiens
gcattttggctca

SEQ ID NO: 6271657 - DNA, 17 bp, Homo sapiens
gcattttgggttgttta

SEQ ID NO: 6271658 - DNA, 19 bp, Homo sapiens
gcattttgtttcactcttt

SEQ ID NO: 6271659 - DNA, 14 bp, Homo sapiens
gcatttttaaactt

SEQ ID NO: 6271660 - DNA, 18 bp, Homo sapiens
gcatttttaaacttgaaa

SEQ ID NO: 6271661 - DNA, 20 bp, Homo sapiens
gcatttttaaacttgaaata

SEQ ID NO: 6271662 - DNA, 14 bp, Homo sapiens
gcatttttaaagga

SEQ ID NO: 6271663 - DNA, 21 bp, Homo sapiens
gcatttttaattttcacaaaa

SEQ ID NO: 6271664 - DNA, 22 bp, Homo sapiens
gcatttttatactcagaactgt

SEQ ID NO: 6271665 - DNA, 20 bp, Homo sapiens
gcatttttcaatatattgaa

SEQ ID NO: 6271666 - DNA, 19 bp, Homo sapiens
gcatttttccatctgtgtg

SEQ ID NO: 6271667 - DNA, 12 bp, Homo sapiens
gcatttttctgc

SEQ ID NO: 6271668 - DNA, 21 bp, Homo sapiens
gcatttttgatttatgcatgg

SEQ ID NO: 6271669 - DNA, 16 bp, Homo sapiens
gcatttttgcaggagc

SEQ ID NO: 6271670 - DNA, 17 bp, Homo sapiens
gcatttttgcaggagca

SEQ ID NO: 6271671 - DNA, 17 bp, Homo sapiens
gcatttttgcttcctag

SEQ ID NO: 6271672 - DNA, 18 bp, Homo sapiens
gcatttttgtgaaatgaa

SEQ ID NO: 6271673 - DNA, 21 bp, Homo sapiens
gcatttttgtgaaatgaaaac

SEQ ID NO: 6271674 - DNA, 15 bp, Homo sapiens
gcatttttgttttga

SEQ ID NO: 6271675 - DNA, 22 bp, Homo sapiens
gcatttttgttttgaaagttta

SEQ ID NO: 6271676 - DNA, 16 bp, Homo sapiens
gcattttttaaaacaa

SEQ ID NO: 6271677 - DNA, 14 bp, Homo sapiens
gcattttttatgat

SEQ ID NO: 6271678 - DNA, 14 bp, Homo sapiens
gccaaaaaaagaca

SEQ ID NO: 6271679 - DNA, 20 bp, Homo sapiens
gccaaaaaccttagctccct

SEQ ID NO: 6271680 - DNA, 21 bp, Homo sapiens
gccaaaaactaaaattcaaca

SEQ ID NO: 6271681 - DNA, 20 bp, Homo sapiens
gccaaaaaggaccaactggc

SEQ ID NO: 6271682 - DNA, 22 bp, Homo sapiens
gccaaaaagtgaaataatgtgt

SEQ ID NO: 6271683 - DNA, 23 bp, Homo sapiens
gccaaaacaagagcctgattttt

SEQ ID NO: 6271684 - DNA, 19 bp, Homo sapiens
gccaaaacaagccaaagag

SEQ ID NO: 6271685 - DNA, 19 bp, Homo sapiens
gccaaaacacttaggaaga

SEQ ID NO: 6271686 - DNA, 14 bp, Homo sapiens
gccaaaaccaaatt

SEQ ID NO: 6271687 - DNA, 15 bp, Homo sapiens
gccaaaaccaaattg

SEQ ID NO: 6271688 - DNA, 18 bp, Homo sapiens
gccaaaaccaatgctgat

SEQ ID NO: 6271689 - DNA, 14 bp, Homo sapiens
gccaaaaccacatg

SEQ ID NO: 6271690 - DNA, 15 bp, Homo sapiens
gccaaaaccacatgg

SEQ ID NO: 6271691 - DNA, 20 bp, Homo sapiens
gccaaaaccacatgggctgg

SEQ ID NO: 6271692 - DNA, 15 bp, Homo sapiens
gccaaaaccaggcct

SEQ ID NO: 6271693 - DNA, 19 bp, Homo sapiens
gccaaaaccaggcctctgc

SEQ ID NO: 6271694 - DNA, 22 bp, Homo sapiens
gccaaaaccaggcctctgctgc

SEQ ID NO: 6271695 - DNA, 16 bp, Homo sapiens
gccaaaacccagctgc

SEQ ID NO: 6271696 - DNA, 13 bp, Homo sapiens
gccaaaagaagtt

SEQ ID NO: 6271697 - DNA, 21 bp, Homo sapiens
gccaaaagctagacagatccc

SEQ ID NO: 6271698 - DNA, 15 bp, Homo sapiens
gccaaaagctgctca

SEQ ID NO: 6271699 - DNA, 20 bp, Homo sapiens
gccaaaagcttccctccctg

SEQ ID NO: 6271700 - DNA, 22 bp, Homo sapiens
gccaaaagcttccctccctgct

SEQ ID NO: 6271701 - DNA, 17 bp, Homo sapiens
gccaaaaggaaaaagct

SEQ ID NO: 6271702 - DNA, 23 bp, Homo sapiens
gccaaaaggaaaaagctccatgt

SEQ ID NO: 6271703 - DNA, 21 bp, Homo sapiens
gccaaaataatgtcttgttaa

SEQ ID NO: 6271704 - DNA, 18 bp, Homo sapiens
gccaaaataccagagcct

SEQ ID NO: 6271705 - DNA, 19 bp, Homo sapiens
gctgtgccaacctgttctt

SEQ ID NO: 6271706 - DNA, 19 bp, Homo sapiens
gctgtgccacaggcttagg

SEQ ID NO: 6271707 - DNA, 20 bp, Homo sapiens
gctgtgccacaggcttaggg

SEQ ID NO: 6271708 - DNA, 14 bp, Homo sapiens
gctgtgccaccacc

SEQ ID NO: 6271709 - DNA, 15 bp, Homo sapiens
gctgtgccaccaccc

SEQ ID NO: 6271710 - DNA, 17 bp, Homo sapiens
gctgtgccaccacccct

SEQ ID NO: 6271711 - DNA, 20 bp, Homo sapiens
gctgtgccaccacccctccc

SEQ ID NO: 6271712 - DNA, 15 bp, Homo sapiens
gctgtgccaccctgg

SEQ ID NO: 6271713 - DNA, 21 bp, Homo sapiens
gctgtgccaccctgggctctg

SEQ ID NO: 6271714 - DNA, 16 bp, Homo sapiens
gctgtgccagctgctt

SEQ ID NO: 6271715 - DNA, 18 bp, Homo sapiens
gctgtgccagctgcttct

SEQ ID NO: 6271716 - DNA, 19 bp, Homo sapiens
gctgtgccaggactgtgac

SEQ ID NO: 6271717 - DNA, 13 bp, Homo sapiens
gctgtgccaggct

SEQ ID NO: 6271718 - DNA, 19 bp, Homo sapiens
gctgtgccaggctgggagg

SEQ ID NO: 6271719 - DNA, 16 bp, Homo sapiens
gctgtgcccagcaggc

SEQ ID NO: 6271720 - DNA, 17 bp, Homo sapiens
gctgtgcccagcaggcc

SEQ ID NO: 6271721 - DNA, 21 bp, Homo sapiens
gctgtgcccagcaggcccagc

SEQ ID NO: 6271722 - DNA, 23 bp, Homo sapiens
gctgtgcccagcaggcccagcat

SEQ ID NO: 6271723 - DNA, 22 bp, Homo sapiens
gctgtgcccagcctccatgttt

SEQ ID NO: 6271724 - DNA, 18 bp, Homo sapiens
gctgtgccccacctgttg

SEQ ID NO: 6271725 - DNA, 18 bp, Homo sapiens
gctgtgcccgccctgggc

SEQ ID NO: 6271726 - DNA, 22 bp, Homo sapiens
gctgtgccgaggcttgggctcc

SEQ ID NO: 6271727 - DNA, 13 bp, Homo sapiens
gctgtgcctcccc

SEQ ID NO: 6271728 - DNA, 23 bp, Homo sapiens
gctgtgcctcgctccccactctg

SEQ ID NO: 6271729 - DNA, 22 bp, Homo sapiens
gctgtgcctgaggctggctggg

SEQ ID NO: 6271730 - DNA, 23 bp, Homo sapiens
gctgtgcctgaggctggctgggg

SEQ ID NO: 6271731 - DNA, 15 bp, Homo sapiens
gctgtgcctgctcag

SEQ ID NO: 6271732 - DNA, 20 bp, Homo sapiens
gctgtgcctgctcagcagcc

SEQ ID NO: 6271733 - DNA, 21 bp, Homo sapiens
gctgtgcctgctcagcagcca

SEQ ID NO: 6271734 - DNA, 23 bp, Homo sapiens
gctgtgcctgctcagcagccagt

SEQ ID NO: 6271735 - DNA, 11 bp, Homo sapiens
gctgtgcctgg

SEQ ID NO: 6271736 - DNA, 16 bp, Homo sapiens
gctgtgcgcccagggc

SEQ ID NO: 6271737 - DNA, 17 bp, Homo sapiens
gctgtgcgcccagggct

SEQ ID NO: 6271738 - DNA, 15 bp, Homo sapiens
gctgtgcgctgctct

SEQ ID NO: 6271739 - DNA, 14 bp, Homo sapiens
gctgtgctaggtct

SEQ ID NO: 6271740 - DNA, 14 bp, Homo sapiens
gctgtgctatgaat

SEQ ID NO: 6271741 - DNA, 16 bp, Homo sapiens
gctgtgctatggtgct

SEQ ID NO: 6271742 - DNA, 16 bp, Homo sapiens
gctgtgctccagcagt

SEQ ID NO: 6271743 - DNA, 18 bp, Homo sapiens
gctgtgctccatatttga

SEQ ID NO: 6271744 - DNA, 19 bp, Homo sapiens
gctgtgctctcaccagctg

SEQ ID NO: 6271745 - DNA, 13 bp, Homo sapiens
gctgtgctctgga

SEQ ID NO: 6271746 - DNA, 15 bp, Homo sapiens
gctgtgctctggaca

SEQ ID NO: 6271747 - DNA, 21 bp, Homo sapiens
gctgtgctcttcctctggttt

SEQ ID NO: 6271748 - DNA, 22 bp, Homo sapiens
gctgtgctcttcctctggtttc

SEQ ID NO: 6271749 - DNA, 17 bp, Homo sapiens
gctgtgctgccctgaag

SEQ ID NO: 6271750 - DNA, 16 bp, Homo sapiens
gctgtgctgccctgcc

SEQ ID NO: 6271751 - DNA, 23 bp, Homo sapiens
gctgtgctgcttttgagcctcag

SEQ ID NO: 6271752 - DNA, 19 bp, Homo sapiens
gctgtgctgggaagcccgg

SEQ ID NO: 6271753 - DNA, 15 bp, Homo sapiens
gctgtgctgggagaa

SEQ ID NO: 6271754 - DNA, 18 bp, Homo sapiens
gctgtgctgggaggtccc

SEQ ID NO: 6271755 - DNA, 21 bp, Homo sapiens
gctgtgctgggaggtcccagg

SEQ ID NO: 6271756 - DNA, 22 bp, Homo sapiens
gctgtgctggtctctaggcctg

SEQ ID NO: 6271757 - DNA, 15 bp, Homo sapiens
gctgtgctgtatttt

SEQ ID NO: 6271758 - DNA, 14 bp, Homo sapiens
gctgtgctgtgttt

SEQ ID NO: 6271759 - DNA, 17 bp, Homo sapiens
gctgtgcttatggtacc

SEQ ID NO: 6271760 - DNA, 19 bp, Homo sapiens
gctgtgctttatttgtgaa

SEQ ID NO: 6271761 - DNA, 12 bp, Homo sapiens
gctgtgctttgg

SEQ ID NO: 6271762 - DNA, 22 bp, Homo sapiens
gctgtggaccgtggacaggccc

SEQ ID NO: 6271763 - DNA, 14 bp, Homo sapiens
gctgtggactgtcc

SEQ ID NO: 6271764 - DNA, 16 bp, Homo sapiens
gctgtggactgtcctg

SEQ ID NO: 6271765 - DNA, 20 bp, Homo sapiens
gctgtggactgtcctgagga

SEQ ID NO: 6271766 - DNA, 20 bp, Homo sapiens
gctgtggagaacaaagacca

SEQ ID NO: 6271767 - DNA, 20 bp, Homo sapiens
gctgtggagacaatgtctgc

SEQ ID NO: 6271768 - DNA, 23 bp, Homo sapiens
gctgtggagacaatgtctgcagc

SEQ ID NO: 6271769 - DNA, 20 bp, Homo sapiens
gctgtggagcaaaaggcagc

SEQ ID NO: 6271770 - DNA, 22 bp, Homo sapiens
gctgtggagcaaaaggcagctc

SEQ ID NO: 6271771 - DNA, 16 bp, Homo sapiens
gctgtggaggcctgat

SEQ ID NO: 6271772 - DNA, 19 bp, Homo sapiens
gctgtggattttgtggctt

SEQ ID NO: 6271773 - DNA, 21 bp, Homo sapiens
gctgtggattttgtggcttca

SEQ ID NO: 6271774 - DNA, 15 bp, Homo sapiens
gctgtggcacagact

SEQ ID NO: 6271775 - DNA, 14 bp, Homo sapiens
gctgtggcaggcca

SEQ ID NO: 6271776 - DNA, 19 bp, Homo sapiens
gctgtggcatagacatgga

SEQ ID NO: 6271777 - DNA, 21 bp, Homo sapiens
gctgtggcatgggtgaagagg

SEQ ID NO: 6271778 - DNA, 15 bp, Homo sapiens
gctgtggcatttcca

SEQ ID NO: 6271779 - DNA, 12 bp, Homo sapiens
gctgtggccagg

SEQ ID NO: 6271780 - DNA, 13 bp, Homo sapiens
gctgtggccagga

SEQ ID NO: 6271781 - DNA, 16 bp, Homo sapiens
gctgtggccaggaggt

SEQ ID NO: 6271782 - DNA, 13 bp, Homo sapiens
gctgtggccaggc

SEQ ID NO: 6271783 - DNA, 19 bp, Homo sapiens
gctgtggccaggcctgcag

SEQ ID NO: 6271784 - DNA, 21 bp, Homo sapiens
gctgtggccaggcctgcagac

SEQ ID NO: 6271785 - DNA, 12 bp, Homo sapiens
gctgtggcccag

SEQ ID NO: 6271786 - DNA, 12 bp, Homo sapiens
gctgtggccctg

SEQ ID NO: 6271787 - DNA, 13 bp, Homo sapiens
gctgtggccctgc

SEQ ID NO: 6271788 - DNA, 14 bp, Homo sapiens
gctgtggccctgcc

SEQ ID NO: 6271789 - DNA, 16 bp, Homo sapiens
gctgtggccctggagg

SEQ ID NO: 6271790 - DNA, 18 bp, Homo sapiens
gctgtggccggtgccagc

SEQ ID NO: 6271791 - DNA, 21 bp, Homo sapiens
gctgtggccggtgccagctgc

SEQ ID NO: 6271792 - DNA, 24 bp, Homo sapiens
gctgtggccggtgccagctgccct

SEQ ID NO: 6271793 - DNA, 15 bp, Homo sapiens
gctgtggccgtctcc

SEQ ID NO: 6271794 - DNA, 19 bp, Homo sapiens
gctgtggcctaacctgccg

SEQ ID NO: 6271795 - DNA, 13 bp, Homo sapiens
gctgtggcctcac

SEQ ID NO: 6271796 - DNA, 14 bp, Homo sapiens
gctgtggcctcacc

SEQ ID NO: 6271797 - DNA, 22 bp, Homo sapiens
gctgtggcctcacttccctggg

SEQ ID NO: 6271798 - DNA, 21 bp, Homo sapiens
gctgtggctcaacacatgaga

SEQ ID NO: 6271799 - DNA, 16 bp, Homo sapiens
gctgtggctcctgcct

SEQ ID NO: 6271800 - DNA, 17 bp, Homo sapiens
gctgtggctcctgcctt

SEQ ID NO: 6271801 - DNA, 18 bp, Homo sapiens
gctgtggctcctgccttg

SEQ ID NO: 6271802 - DNA, 13 bp, Homo sapiens
gctgtggctctgg

SEQ ID NO: 6271803 - DNA, 17 bp, Homo sapiens
gctgtggctctgggtgg

SEQ ID NO: 6271804 - DNA, 18 bp, Homo sapiens
gctgtggctggaggagct

SEQ ID NO: 6271805 - DNA, 22 bp, Homo sapiens
gctgtggctggaggagctggcc

SEQ ID NO: 6271806 - DNA, 14 bp, Homo sapiens
gctgtgggaccagg

SEQ ID NO: 6271807 - DNA, 18 bp, Homo sapiens
gctgtgggcaagcctaag

SEQ ID NO: 6271808 - DNA, 14 bp, Homo sapiens
gctgtgggcagcac

SEQ ID NO: 6271809 - DNA, 18 bp, Homo sapiens
gctgtgggcctcaaggac

SEQ ID NO: 6271810 - DNA, 19 bp, Homo sapiens
gctgtgggcctcaaggact

SEQ ID NO: 6271811 - DNA, 19 bp, Homo sapiens
gctgtgggcggctcctggt

SEQ ID NO: 6271812 - DNA, 21 bp, Homo sapiens
gctgtgggcgtgagacctgcc

SEQ ID NO: 6271813 - DNA, 13 bp, Homo sapiens
gctgtgggctccc

SEQ ID NO: 6271814 - DNA, 16 bp, Homo sapiens
gctgtgggctcccttc

SEQ ID NO: 6271815 - DNA, 18 bp, Homo sapiens
gctgtgggctcccttcct

SEQ ID NO: 6271816 - DNA, 21 bp, Homo sapiens
gctgtggggctaggggctggg

SEQ ID NO: 6271817 - DNA, 16 bp, Homo sapiens
gctgtggggtggagca

SEQ ID NO: 6271818 - DNA, 14 bp, Homo sapiens
gctgtggggtgggc

SEQ ID NO: 6271819 - DNA, 19 bp, Homo sapiens
gctgtgggtcagtgtgcca

SEQ ID NO: 6271820 - DNA, 16 bp, Homo sapiens
gctgtgggtgtgggtg

SEQ ID NO: 6271821 - DNA, 18 bp, Homo sapiens
gctgtggtacaaatgtga

SEQ ID NO: 6271822 - DNA, 16 bp, Homo sapiens
gctgtggtcagcagat

SEQ ID NO: 6271823 - DNA, 17 bp, Homo sapiens
gctgtggtcccacccag

SEQ ID NO: 6271824 - DNA, 22 bp, Homo sapiens
gctgtggtctataaaataaact

SEQ ID NO: 6271825 - DNA, 13 bp, Homo sapiens
gctgtggtctctt

SEQ ID NO: 6271826 - DNA, 13 bp, Homo sapiens
gctgtggttcctg

SEQ ID NO: 6271827 - DNA, 16 bp, Homo sapiens
gctgtggttcctgggg

SEQ ID NO: 6271828 - DNA, 23 bp, Homo sapiens
gctgtggtttccatctgaaagta

SEQ ID NO: 6271829 - DNA, 23 bp, Homo sapiens
gctgtggtttctcgtactttcac

SEQ ID NO: 6271830 - DNA, 13 bp, Homo sapiens
gctgtggttttct

SEQ ID NO: 6271831 - DNA, 13 bp, Homo sapiens
gctgtgtaaagtt

SEQ ID NO: 6271832 - DNA, 15 bp, Homo sapiens
gctgtgtaaagttag

SEQ ID NO: 6271833 - DNA, 17 bp, Homo sapiens
gctgtgtaaagttagtc

SEQ ID NO: 6271834 - DNA, 21 bp, Homo sapiens
gctgtgtaaatgctccagcac

SEQ ID NO: 6271835 - DNA, 16 bp, Homo sapiens
gctgtgtaagatttgt

SEQ ID NO: 6271836 - DNA, 23 bp, Homo sapiens
gctgtgtactcttaggctaagag

SEQ ID NO: 6271837 - DNA, 12 bp, Homo sapiens
gctgtgtagctc

SEQ ID NO: 6271838 - DNA, 18 bp, Homo sapiens
gctgtgtagctctgtcca

SEQ ID NO: 6271839 - DNA, 19 bp, Homo sapiens
gctgtgtagttccctctgc

SEQ ID NO: 6271840 - DNA, 23 bp, Homo sapiens
gctgtgtatgtgaaccacccatg

SEQ ID NO: 6271841 - DNA, 14 bp, Homo sapiens
gctgtgtatttctg

SEQ ID NO: 6271842 - DNA, 17 bp, Homo sapiens
gctgtgtatttctgtag

SEQ ID NO: 6271843 - DNA, 19 bp, Homo sapiens
gctgtgtcacactctgtgt

SEQ ID NO: 6271844 - DNA, 19 bp, Homo sapiens
gctgtgtcctaaggcccat

SEQ ID NO: 6271845 - DNA, 15 bp, Homo sapiens
gctgtgtcctccctc

SEQ ID NO: 6271846 - DNA, 16 bp, Homo sapiens
gctgtgtcctccctcc

SEQ ID NO: 6271847 - DNA, 19 bp, Homo sapiens
gctgtgtccttgcacctgc

SEQ ID NO: 6271848 - DNA, 15 bp, Homo sapiens
gctgtgtctcccttc

SEQ ID NO: 6271849 - DNA, 18 bp, Homo sapiens
gctgtgtctcctctcaga

SEQ ID NO: 6271850 - DNA, 12 bp, Homo sapiens
gctgtgtctgag

SEQ ID NO: 6271851 - DNA, 14 bp, Homo sapiens
gctgtgtctgccaa

SEQ ID NO: 6271852 - DNA, 19 bp, Homo sapiens
gctgtgtctgccaaacaca

SEQ ID NO: 6271853 - DNA, 21 bp, Homo sapiens
gctgtgtcttcattttcatta

SEQ ID NO: 6271854 - DNA, 18 bp, Homo sapiens
gctgtgtgaatacctgct

SEQ ID NO: 6271855 - DNA, 14 bp, Homo sapiens
gctgtgtgagacca

SEQ ID NO: 6271856 - DNA, 12 bp, Homo sapiens
gctgtgtgcagg

SEQ ID NO: 6271857 - DNA, 21 bp, Homo sapiens
gctgtgtgcccaagtgggcag

SEQ ID NO: 6271858 - DNA, 18 bp, Homo sapiens
gctgtgtgccccactcca

SEQ ID NO: 6271859 - DNA, 16 bp, Homo sapiens
gctgtgtggcagtctg

SEQ ID NO: 6271860 - DNA, 12 bp, Homo sapiens
gctgtgtggcca

SEQ ID NO: 6271861 - DNA, 16 bp, Homo sapiens
gctgtgtggccaacca

SEQ ID NO: 6271862 - DNA, 22 bp, Homo sapiens
gctgtgtggccaaccaggaccc

SEQ ID NO: 6271863 - DNA, 19 bp, Homo sapiens
gctgtgtggggagggtggg

SEQ ID NO: 6271864 - DNA, 23 bp, Homo sapiens
gctgtgtgtcccaggcagggaga

SEQ ID NO: 6271865 - DNA, 13 bp, Homo sapiens
gctgtgtgtgagc

SEQ ID NO: 6271866 - DNA, 18 bp, Homo sapiens
gctgtgtgtggggcccaa

SEQ ID NO: 6271867 - DNA, 21 bp, Homo sapiens
gctgtgttactaatgatcact

SEQ ID NO: 6271868 - DNA, 14 bp, Homo sapiens
gctgtgttacttga

SEQ ID NO: 6271869 - DNA, 18 bp, Homo sapiens
gctgtgttacttgaagta

SEQ ID NO: 6271870 - DNA, 21 bp, Homo sapiens
gctgtgttacttgaagtaact

SEQ ID NO: 6271871 - DNA, 16 bp, Homo sapiens
gctgtgttcacagacc

SEQ ID NO: 6271872 - DNA, 14 bp, Homo sapiens
gctgtgttccccaa

SEQ ID NO: 6271873 - DNA, 17 bp, Homo sapiens
gctgtgttcgggggagc

SEQ ID NO: 6271874 - DNA, 17 bp, Homo sapiens
gctgtgttctggtgagg

SEQ ID NO: 6271875 - DNA, 16 bp, Homo sapiens
gctgtgtttaatttga

SEQ ID NO: 6271876 - DNA, 22 bp, Homo sapiens
gctgtgtttatatggaagaaag

SEQ ID NO: 6271877 - DNA, 16 bp, Homo sapiens
gctgtgtttgctcccc

SEQ ID NO: 6271878 - DNA, 18 bp, Homo sapiens
gctgtgttttgtctgagc

SEQ ID NO: 6271879 - DNA, 14 bp, Homo sapiens
gctgttaaactgtt

SEQ ID NO: 6271880 - DNA, 14 bp, Homo sapiens
gctgttaaagacat

SEQ ID NO: 6271881 - DNA, 14 bp, Homo sapiens
gctgttaaagatat

SEQ ID NO: 6271882 - DNA, 13 bp, Homo sapiens
gctgttaaataca

SEQ ID NO: 6271883 - DNA, 15 bp, Homo sapiens
gctgttaaatacagg

SEQ ID NO: 6271884 - DNA, 17 bp, Homo sapiens
gccaaaatataatcaga

SEQ ID NO: 6271885 - DNA, 22 bp, Homo sapiens
gccaaaatattgcttatgtctc

SEQ ID NO: 6271886 - DNA, 19 bp, Homo sapiens
gccaaaatgactttgaact

SEQ ID NO: 6271887 - DNA, 20 bp, Homo sapiens
gccaaaatgtacttaaatga

SEQ ID NO: 6271888 - DNA, 21 bp, Homo sapiens
gccaaaatgtacttaaatgag

SEQ ID NO: 6271889 - DNA, 16 bp, Homo sapiens
gccaaaatgttggctg

SEQ ID NO: 6271890 - DNA, 14 bp, Homo sapiens
gccaaaattaaggt

SEQ ID NO: 6271891 - DNA, 23 bp, Homo sapiens
gccaaacaacaacaaaaacaaaa

SEQ ID NO: 6271892 - DNA, 17 bp, Homo sapiens
gccaaacacactgtaaa

SEQ ID NO: 6271893 - DNA, 20 bp, Homo sapiens
gccaaacacccaagcacaaa

SEQ ID NO: 6271894 - DNA, 14 bp, Homo sapiens
gccaaacactccac

SEQ ID NO: 6271895 - DNA, 14 bp, Homo sapiens
gccaaacaggccct

SEQ ID NO: 6271896 - DNA, 15 bp, Homo sapiens
gccaaacccagacaa

SEQ ID NO: 6271897 - DNA, 20 bp, Homo sapiens
gccaaacccttgctttcctg

SEQ ID NO: 6271898 - DNA, 13 bp, Homo sapiens
gccaaacctctgt

SEQ ID NO: 6271899 - DNA, 22 bp, Homo sapiens
gccaaacctctgttcagtgtaa

SEQ ID NO: 6271900 - DNA, 17 bp, Homo sapiens
gccaaacctttcctgta

SEQ ID NO: 6271901 - DNA, 14 bp, Homo sapiens
gccaaactcacctg

SEQ ID NO: 6271902 - DNA, 15 bp, Homo sapiens
gccaaactcaggccc

SEQ ID NO: 6271903 - DNA, 18 bp, Homo sapiens
gccaaactctgccagcca

SEQ ID NO: 6271904 - DNA, 12 bp, Homo sapiens
gccaaactgctg

SEQ ID NO: 6271905 - DNA, 11 bp, Homo sapiens
gccaaactgtc

SEQ ID NO: 6271906 - DNA, 19 bp, Homo sapiens
gccaaactgtccctccctt

SEQ ID NO: 6271907 - DNA, 20 bp, Homo sapiens
gccaaactgtccctcccttg

SEQ ID NO: 6271908 - DNA, 16 bp, Homo sapiens
gccaaagaaacaagct

SEQ ID NO: 6271909 - DNA, 17 bp, Homo sapiens
gccaaagaaacaagctg

SEQ ID NO: 6271910 - DNA, 21 bp, Homo sapiens
gccaaagaaacaagctgtgca

SEQ ID NO: 6271911 - DNA, 19 bp, Homo sapiens
gccaaagaaatgggcctgc

SEQ ID NO: 6271912 - DNA, 21 bp, Homo sapiens
gccaaagaaatgggcctgcct

SEQ ID NO: 6271913 - DNA, 21 bp, Homo sapiens
gccaaagaaccaaagaagaaa

SEQ ID NO: 6271914 - DNA, 18 bp, Homo sapiens
gccaaagaatatttaaat

SEQ ID NO: 6271915 - DNA, 14 bp, Homo sapiens
gccaaagacaaata

SEQ ID NO: 6271916 - DNA, 21 bp, Homo sapiens
gccaaagacctcccaagctgt

SEQ ID NO: 6271917 - DNA, 15 bp, Homo sapiens
gccaaagagactggg

SEQ ID NO: 6271918 - DNA, 17 bp, Homo sapiens
gccaaagagactgggcc

SEQ ID NO: 6271919 - DNA, 23 bp, Homo sapiens
gccaaagagcctcccaccagagc

SEQ ID NO: 6271920 - DNA, 16 bp, Homo sapiens
gccaaagagcctttcc

SEQ ID NO: 6271921 - DNA, 22 bp, Homo sapiens
gccaaagagcctttccaaagag

SEQ ID NO: 6271922 - DNA, 13 bp, Homo sapiens
gccaaagataaaa

SEQ ID NO: 6271923 - DNA, 16 bp, Homo sapiens
gccaaagatagcagaa

SEQ ID NO: 6271924 - DNA, 15 bp, Homo sapiens
gccaaagatttcata

SEQ ID NO: 6271925 - DNA, 18 bp, Homo sapiens
gccaaagatttcatatct

SEQ ID NO: 6271926 - DNA, 21 bp, Homo sapiens
gccaaagcaaaagaagtaaaa

SEQ ID NO: 6271927 - DNA, 16 bp, Homo sapiens
gccaaagcacagctgg

SEQ ID NO: 6271928 - DNA, 16 bp, Homo sapiens
gccaaagcctcctcca

SEQ ID NO: 6271929 - DNA, 16 bp, Homo sapiens
gccaaagctaggcctg

SEQ ID NO: 6271930 - DNA, 12 bp, Homo sapiens
gccaaagctgct

SEQ ID NO: 6271931 - DNA, 11 bp, Homo sapiens
gccaaagctgg

SEQ ID NO: 6271932 - DNA, 15 bp, Homo sapiens
gccaaagctgttagt

SEQ ID NO: 6271933 - DNA, 16 bp, Homo sapiens
gccaaaggaagcacat

SEQ ID NO: 6271934 - DNA, 23 bp, Homo sapiens
gccaaaggaccgttttgtattgc

SEQ ID NO: 6271935 - DNA, 20 bp, Homo sapiens
gccaaaggctggtggcaagt

SEQ ID NO: 6271936 - DNA, 19 bp, Homo sapiens
gccaaagggaaatatcatt

SEQ ID NO: 6271937 - DNA, 18 bp, Homo sapiens
gccaaaggggacctggaa

SEQ ID NO: 6271938 - DNA, 19 bp, Homo sapiens
gccaaaggggacctggaag

SEQ ID NO: 6271939 - DNA, 20 bp, Homo sapiens
gccaaaggggacctggaagg

SEQ ID NO: 6271940 - DNA, 17 bp, Homo sapiens
gccaaaggggagccaga

SEQ ID NO: 6271941 - DNA, 18 bp, Homo sapiens
gccaaaggtcaaacaggc

SEQ ID NO: 6271942 - DNA, 17 bp, Homo sapiens
gccaaagtacagaattt

SEQ ID NO: 6271943 - DNA, 17 bp, Homo sapiens
gccaaagtgcagccctt

SEQ ID NO: 6271944 - DNA, 14 bp, Homo sapiens
gccaaagtgcctgg

SEQ ID NO: 6271945 - DNA, 22 bp, Homo sapiens
gccaaagtgtacaattttcatc

SEQ ID NO: 6271946 - DNA, 16 bp, Homo sapiens
gccaaagttaaatgta

SEQ ID NO: 6271947 - DNA, 17 bp, Homo sapiens
gccaaagttaaatgtat

SEQ ID NO: 6271948 - DNA, 22 bp, Homo sapiens
gccaaataaaatgtttacattt

SEQ ID NO: 6271949 - DNA, 17 bp, Homo sapiens
gccaaataaacagctat

SEQ ID NO: 6271950 - DNA, 19 bp, Homo sapiens
gccaaataaagttaaaagt

SEQ ID NO: 6271951 - DNA, 22 bp, Homo sapiens
gccaaataatgtctctgtgaga

SEQ ID NO: 6271952 - DNA, 22 bp, Homo sapiens
gccaaatagagtttttatattt

SEQ ID NO: 6271953 - DNA, 14 bp, Homo sapiens
gccaaatagcaaag

SEQ ID NO: 6271954 - DNA, 20 bp, Homo sapiens
gccaaatagtgaaaagtaga

SEQ ID NO: 6271955 - DNA, 17 bp, Homo sapiens
gccaaatatattctctt

SEQ ID NO: 6271956 - DNA, 17 bp, Homo sapiens
gccaaatatgcactttc

SEQ ID NO: 6271957 - DNA, 17 bp, Homo sapiens
gccaaatccgctctctt

SEQ ID NO: 6271958 - DNA, 22 bp, Homo sapiens
gccaaatccgctctcttcctgc

SEQ ID NO: 6271959 - DNA, 19 bp, Homo sapiens
gccaaatgaccgagccctg

SEQ ID NO: 6271960 - DNA, 22 bp, Homo sapiens
gccaaatgaccgagccctggag

SEQ ID NO: 6271961 - DNA, 20 bp, Homo sapiens
gccaaatgagttcccttgat

SEQ ID NO: 6271962 - DNA, 16 bp, Homo sapiens
gccaaatgcaaaatta

SEQ ID NO: 6271963 - DNA, 17 bp, Homo sapiens
gccaaatgctggggcag

SEQ ID NO: 6271964 - DNA, 18 bp, Homo sapiens
gccaaatgttaactgcca

SEQ ID NO: 6271965 - DNA, 14 bp, Homo sapiens
gccaaatgttcatc

SEQ ID NO: 6271966 - DNA, 18 bp, Homo sapiens
gccaaatgttcatcctca

SEQ ID NO: 6271967 - DNA, 14 bp, Homo sapiens
gccaaattaaaaaa

SEQ ID NO: 6271968 - DNA, 16 bp, Homo sapiens
gccaaattaaaaaaga

SEQ ID NO: 6271969 - DNA, 21 bp, Homo sapiens
gccaaattaaaaaagataaac

SEQ ID NO: 6271970 - DNA, 22 bp, Homo sapiens
gccaaattaaaaaagataaaca

SEQ ID NO: 6271971 - DNA, 20 bp, Homo sapiens
gccaaattaatcttttaaaa

SEQ ID NO: 6271972 - DNA, 16 bp, Homo sapiens
gccaaattgcagaaga

SEQ ID NO: 6271973 - DNA, 17 bp, Homo sapiens
gccaaattgcagaagaa

SEQ ID NO: 6271974 - DNA, 19 bp, Homo sapiens
gccaaatttatcaaagcat

SEQ ID NO: 6271975 - DNA, 19 bp, Homo sapiens
gccaaatttcctgtttgaa

SEQ ID NO: 6271976 - DNA, 17 bp, Homo sapiens
gccaaatttcttttgct

SEQ ID NO: 6271977 - DNA, 22 bp, Homo sapiens
gccaaattttagatttaccttg

SEQ ID NO: 6271978 - DNA, 22 bp, Homo sapiens
gccaaattttttgtatattaaa

SEQ ID NO: 6271979 - DNA, 22 bp, Homo sapiens
gccaacaaaccctctgtagcta

SEQ ID NO: 6271980 - DNA, 21 bp, Homo sapiens
gccaacaactctgcctttatg

SEQ ID NO: 6271981 - DNA, 22 bp, Homo sapiens
gccaacaactctgcctttatga

SEQ ID NO: 6271982 - DNA, 16 bp, Homo sapiens
gccaacaacttctcca

SEQ ID NO: 6271983 - DNA, 22 bp, Homo sapiens
gccaacaagaatgcattgatat

SEQ ID NO: 6271984 - DNA, 20 bp, Homo sapiens
gccaacaagaccgccccagg

SEQ ID NO: 6271985 - DNA, 21 bp, Homo sapiens
gccaacacttgtgttgctttc

SEQ ID NO: 6271986 - DNA, 16 bp, Homo sapiens
gccaacagaacacttg

SEQ ID NO: 6271987 - DNA, 19 bp, Homo sapiens
gccaacagacactacatta

SEQ ID NO: 6271988 - DNA, 19 bp, Homo sapiens
gccaacagagaggttcctg

SEQ ID NO: 6271989 - DNA, 14 bp, Homo sapiens
gccaacagctacaa

SEQ ID NO: 6271990 - DNA, 18 bp, Homo sapiens
gccaacagctacaacagc

SEQ ID NO: 6271991 - DNA, 22 bp, Homo sapiens
gccaacagctacaacagcctca

SEQ ID NO: 6271992 - DNA, 20 bp, Homo sapiens
gccaacagtcaaaacagaga

SEQ ID NO: 6271993 - DNA, 23 bp, Homo sapiens
gccaacagttgtatgtttgctga

SEQ ID NO: 6271994 - DNA, 21 bp, Homo sapiens
gccaacataagttaatagaaa

SEQ ID NO: 6271995 - DNA, 23 bp, Homo sapiens
gccaacatcatatacctcttgaa

SEQ ID NO: 6271996 - DNA, 20 bp, Homo sapiens
gccaacatggtgaaaccctg

SEQ ID NO: 6271997 - DNA, 22 bp, Homo sapiens
gccaacatggtgaaactccatc

SEQ ID NO: 6271998 - DNA, 23 bp, Homo sapiens
gccaaccacctctggccctgttg

SEQ ID NO: 6271999 - DNA, 14 bp, Homo sapiens
gccaaccagccttt

SEQ ID NO: 6272000 - DNA, 16 bp, Homo sapiens
gccaaccaggacccag

SEQ ID NO: 6272001 - DNA, 17 bp, Homo sapiens
gccaaccaggacccagg

SEQ ID NO: 6272002 - DNA, 19 bp, Homo sapiens
gccaaccaggacccagggt

SEQ ID NO: 6272003 - DNA, 20 bp, Homo sapiens
gccaaccaggacccagggtc

SEQ ID NO: 6272004 - DNA, 14 bp, Homo sapiens
gccaaccatcatgt

SEQ ID NO: 6272005 - DNA, 19 bp, Homo sapiens
gccaaccccacccagctcc

SEQ ID NO: 6272006 - DNA, 14 bp, Homo sapiens
gccaaccccagcag

SEQ ID NO: 6272007 - DNA, 16 bp, Homo sapiens
gccaaccccatcctca

SEQ ID NO: 6272008 - DNA, 16 bp, Homo sapiens
gccaacccctctctca

SEQ ID NO: 6272009 - DNA, 14 bp, Homo sapiens
gccaacccctgtgg

SEQ ID NO: 6272010 - DNA, 17 bp, Homo sapiens
gccaaccctgcctgccg

SEQ ID NO: 6272011 - DNA, 22 bp, Homo sapiens
gccaaccctgcctgccgctgca

SEQ ID NO: 6272012 - DNA, 18 bp, Homo sapiens
gccaaccctggaaaagga

SEQ ID NO: 6272013 - DNA, 23 bp, Homo sapiens
gccaacccttctcctcttgtaaa

SEQ ID NO: 6272014 - DNA, 18 bp, Homo sapiens
gccaacctcaggctccta

SEQ ID NO: 6272015 - DNA, 14 bp, Homo sapiens
gccaacctcgctcc

SEQ ID NO: 6272016 - DNA, 22 bp, Homo sapiens
gccaacctctttgcgtttcctt

SEQ ID NO: 6272017 - DNA, 14 bp, Homo sapiens
gccaacctgatgcc

SEQ ID NO: 6272018 - DNA, 17 bp, Homo sapiens
gccaacctgatgcccct

SEQ ID NO: 6272019 - DNA, 21 bp, Homo sapiens
gccaacctgtaataaatatga

SEQ ID NO: 6272020 - DNA, 14 bp, Homo sapiens
gccaacgacaaagc

SEQ ID NO: 6272021 - DNA, 17 bp, Homo sapiens
gccaacgagattgctgg

SEQ ID NO: 6272022 - DNA, 14 bp, Homo sapiens
gccaacgcctcctg

SEQ ID NO: 6272023 - DNA, 15 bp, Homo sapiens
gccaacgcctcctgt

SEQ ID NO: 6272024 - DNA, 20 bp, Homo sapiens
gccaacgttcgatttctacc

SEQ ID NO: 6272025 - DNA, 23 bp, Homo sapiens
gccaacgttcgatttctacctca

SEQ ID NO: 6272026 - DNA, 15 bp, Homo sapiens
gccaactaagccctc

SEQ ID NO: 6272027 - DNA, 14 bp, Homo sapiens
gccaactaatttta

SEQ ID NO: 6272028 - DNA, 18 bp, Homo sapiens
gccaactatgattattaa

SEQ ID NO: 6272029 - DNA, 23 bp, Homo sapiens
gccaactcactcttatgaaatgg

SEQ ID NO: 6272030 - DNA, 22 bp, Homo sapiens
gccaactccatgtcagggaagt

SEQ ID NO: 6272031 - DNA, 14 bp, Homo sapiens
gccaactcctcctt

SEQ ID NO: 6272032 - DNA, 17 bp, Homo sapiens
gccaactgaagccttct

SEQ ID NO: 6272033 - DNA, 16 bp, Homo sapiens
gccaactgacaaagat

SEQ ID NO: 6272034 - DNA, 21 bp, Homo sapiens
gccaactgattttgtatgtaa

SEQ ID NO: 6272035 - DNA, 19 bp, Homo sapiens
gccaactgcaaaaaaagcc

SEQ ID NO: 6272036 - DNA, 21 bp, Homo sapiens
gccaactgcaaaaaaagcctc

SEQ ID NO: 6272037 - DNA, 22 bp, Homo sapiens
gccaactgcaaaaaaagcctcc

SEQ ID NO: 6272038 - DNA, 22 bp, Homo sapiens
gccaactgcctccttgccagcc

SEQ ID NO: 6272039 - DNA, 20 bp, Homo sapiens
gccaactgtttccctgctga

SEQ ID NO: 6272040 - DNA, 23 bp, Homo sapiens
gccaacttcccacacggcagccc

SEQ ID NO: 6272041 - DNA, 17 bp, Homo sapiens
gccaacttctcccaccc

SEQ ID NO: 6272042 - DNA, 19 bp, Homo sapiens
gccaacttctcccacccct

SEQ ID NO: 6272043 - DNA, 20 bp, Homo sapiens
gccaacttcttcagagctga

SEQ ID NO: 6272044 - DNA, 21 bp, Homo sapiens
gccaacttgatgttccacctg

SEQ ID NO: 6272045 - DNA, 17 bp, Homo sapiens
gccaacttgtaaataca

SEQ ID NO: 6272046 - DNA, 15 bp, Homo sapiens
gccaactttccagac

SEQ ID NO: 6272047 - DNA, 18 bp, Homo sapiens
gccaagaaaatgaaggga

SEQ ID NO: 6272048 - DNA, 20 bp, Homo sapiens
gccaagaaacactgcctgcc

SEQ ID NO: 6272049 - DNA, 19 bp, Homo sapiens
gccaagaaagatgtatata

SEQ ID NO: 6272050 - DNA, 12 bp, Homo sapiens
gccaagaaatcg

SEQ ID NO: 6272051 - DNA, 23 bp, Homo sapiens
gccaagaaatcgccttatgagaa

SEQ ID NO: 6272052 - DNA, 20 bp, Homo sapiens
gccaagaacagaaaacaaga

SEQ ID NO: 6272053 - DNA, 13 bp, Homo sapiens
gccaagaactgaa

SEQ ID NO: 6272054 - DNA, 22 bp, Homo sapiens
gccaagaagcctgcaggagaaa

SEQ ID NO: 6272055 - DNA, 14 bp, Homo sapiens
gccaagaatacttg

SEQ ID NO: 6272056 - DNA, 23 bp, Homo sapiens
gccaagaatattgcaaaatacat

SEQ ID NO: 6272057 - DNA, 15 bp, Homo sapiens
gccaagaattagatt

SEQ ID NO: 6272058 - DNA, 14 bp, Homo sapiens
gccaagaattctta

SEQ ID NO: 6272059 - DNA, 13 bp, Homo sapiens
gccaagacaaatc

SEQ ID NO: 6272060 - DNA, 15 bp, Homo sapiens
gccaagacaaatcaa

SEQ ID NO: 6272061 - DNA, 22 bp, Homo sapiens
gccaagacaaatcaacagaagc

SEQ ID NO: 6272062 - DNA, 11 bp, Homo sapiens
gccaagacagt

SEQ ID NO: 6272063 - DNA, 11 bp, Homo sapiens
gccaagaccat

SEQ ID NO: 6272064 - DNA, 16 bp, Homo sapiens
gccaagactctatgct

SEQ ID NO: 6272065 - DNA, 20 bp, Homo sapiens
gccaagactctatgctctgg

SEQ ID NO: 6272066 - DNA, 14 bp, Homo sapiens
gccaagactgctgt

SEQ ID NO: 6272067 - DNA, 23 bp, Homo sapiens
gccaagactgctgtggccaggag

SEQ ID NO: 6272068 - DNA, 18 bp, Homo sapiens
gccaagagaaacttccta

SEQ ID NO: 6272069 - DNA, 23 bp, Homo sapiens
gccaagagatctgtgtggctcct

SEQ ID NO: 6272070 - DNA, 20 bp, Homo sapiens
gccaagagcatcgtgaccct

SEQ ID NO: 6272071 - DNA, 13 bp, Homo sapiens
gccaagaggaaaa

SEQ ID NO: 6272072 - DNA, 14 bp, Homo sapiens
gccaagaggaaaaa

SEQ ID NO: 6272073 - DNA, 12 bp, Homo sapiens
gccaagaggctg

SEQ ID NO: 6272074 - DNA, 14 bp, Homo sapiens
gccaagaggctgca

SEQ ID NO: 6272075 - DNA, 21 bp, Homo sapiens
gccaagaggtttggctcctgc

SEQ ID NO: 6272076 - DNA, 21 bp, Homo sapiens
gccaagagtggccccacctgg

SEQ ID NO: 6272077 - DNA, 22 bp, Homo sapiens
gccaagagtggccccacctggc

SEQ ID NO: 6272078 - DNA, 18 bp, Homo sapiens
gccaagatcgcgccactg

SEQ ID NO: 6272079 - DNA, 13 bp, Homo sapiens
gccaagatggaag

SEQ ID NO: 6272080 - DNA, 23 bp, Homo sapiens
gccaagatggaagtcacctttct

SEQ ID NO: 6272081 - DNA, 22 bp, Homo sapiens
gccaagattgcgccactgcact

SEQ ID NO: 6272082 - DNA, 13 bp, Homo sapiens
gccaagcaacctg

SEQ ID NO: 6272083 - DNA, 18 bp, Homo sapiens
gccaagcaacctgggtcc

SEQ ID NO: 6272084 - DNA, 16 bp, Homo sapiens
gccaagcacagtggtg

SEQ ID NO: 6272085 - DNA, 13 bp, Homo sapiens
gccaagcactgct

SEQ ID NO: 6272086 - DNA, 17 bp, Homo sapiens
gccaagcactgctcacg

SEQ ID NO: 6272087 - DNA, 20 bp, Homo sapiens
gccaagcagaaaaaaaagtg

SEQ ID NO: 6272088 - DNA, 12 bp, Homo sapiens
gccaagcaggca

SEQ ID NO: 6272089 - DNA, 14 bp, Homo sapiens
gccaagcaggctgg

SEQ ID NO: 6272090 - DNA, 14 bp, Homo sapiens
gccaagcagggagg

SEQ ID NO: 6272091 - DNA, 20 bp, Homo sapiens
gccaagccagattctcttga

SEQ ID NO: 6272092 - DNA, 15 bp, Homo sapiens
gccaagccagctgcc

SEQ ID NO: 6272093 - DNA, 16 bp, Homo sapiens
gccaagccagctgcct

SEQ ID NO: 6272094 - DNA, 17 bp, Homo sapiens
gccaagccagctgccta

SEQ ID NO: 6272095 - DNA, 19 bp, Homo sapiens
gccaagccagggttccaga

SEQ ID NO: 6272096 - DNA, 13 bp, Homo sapiens
gccaagcccaata

SEQ ID NO: 6272097 - DNA, 15 bp, Homo sapiens
gccaagcccaccctg

SEQ ID NO: 6272098 - DNA, 16 bp, Homo sapiens
gccaagcccaccctgg

SEQ ID NO: 6272099 - DNA, 19 bp, Homo sapiens
gccaagcccacctgcacgt

SEQ ID NO: 6272100 - DNA, 15 bp, Homo sapiens
gccaagccccatcct

SEQ ID NO: 6272101 - DNA, 23 bp, Homo sapiens
gccaagcccctgccctggggaga

SEQ ID NO: 6272102 - DNA, 20 bp, Homo sapiens
gccaagccctaagcctgtcc

SEQ ID NO: 6272103 - DNA, 21 bp, Homo sapiens
gccaagccctaagcctgtccc

SEQ ID NO: 6272104 - DNA, 23 bp, Homo sapiens
gccaagccctaagcctgtcccca

SEQ ID NO: 6272105 - DNA, 22 bp, Homo sapiens
gccaagccctccccatcccatg

SEQ ID NO: 6272106 - DNA, 14 bp, Homo sapiens
gccaagccctccgc

SEQ ID NO: 6272107 - DNA, 15 bp, Homo sapiens
gccaagccctggccc

SEQ ID NO: 6272108 - DNA, 20 bp, Homo sapiens
gccaagccctttgctgttcg

SEQ ID NO: 6272109 - DNA, 23 bp, Homo sapiens
gccaagccggcccaacccaacca

SEQ ID NO: 6272110 - DNA, 12 bp, Homo sapiens
gccaagcctatc

SEQ ID NO: 6272111 - DNA, 13 bp, Homo sapiens
gccaagcctgcag

SEQ ID NO: 6272112 - DNA, 14 bp, Homo sapiens
gccaagcctgcagc

SEQ ID NO: 6272113 - DNA, 15 bp, Homo sapiens
gccaagcctgcagct

SEQ ID NO: 6272114 - DNA, 13 bp, Homo sapiens
gccaagcctgccc

SEQ ID NO: 6272115 - DNA, 16 bp, Homo sapiens
gccaagcctgccccgg

SEQ ID NO: 6272116 - DNA, 12 bp, Homo sapiens
gccaagcctgct

SEQ ID NO: 6272117 - DNA, 15 bp, Homo sapiens
gccaagcctgctgtg

SEQ ID NO: 6272118 - DNA, 12 bp, Homo sapiens
gccaagcctgga

SEQ ID NO: 6272119 - DNA, 20 bp, Homo sapiens
gccaagcctggagtaggcct

SEQ ID NO: 6272120 - DNA, 12 bp, Homo sapiens
gccaagcctggc

SEQ ID NO: 6272121 - DNA, 17 bp, Homo sapiens
gccaagccttaaactgt

SEQ ID NO: 6272122 - DNA, 17 bp, Homo sapiens
gccaagctaatctgcct

SEQ ID NO: 6272123 - DNA, 16 bp, Homo sapiens
gccaagctcacacagc

SEQ ID NO: 6272124 - DNA, 23 bp, Homo sapiens
gccaagctcaggaccaggcaatg

SEQ ID NO: 6272125 - DNA, 16 bp, Homo sapiens
gccaagctccaagccc

SEQ ID NO: 6272126 - DNA, 16 bp, Homo sapiens
gccaagctccctggag

SEQ ID NO: 6272127 - DNA, 18 bp, Homo sapiens
gccaagctccctggagcc

SEQ ID NO: 6272128 - DNA, 17 bp, Homo sapiens
gccaagctccttgggag

SEQ ID NO: 6272129 - DNA, 13 bp, Homo sapiens
gccaagctgagga

SEQ ID NO: 6272130 - DNA, 18 bp, Homo sapiens
gccaagctgaggtgccca

SEQ ID NO: 6272131 - DNA, 11 bp, Homo sapiens
gccaagctgca

SEQ ID NO: 6272132 - DNA, 15 bp, Homo sapiens
gccaagctggcacaa

SEQ ID NO: 6272133 - DNA, 16 bp, Homo sapiens
gccaagctggcacaaa

SEQ ID NO: 6272134 - DNA, 17 bp, Homo sapiens
gccaagctggggcaagg

SEQ ID NO: 6272135 - DNA, 14 bp, Homo sapiens
gccaagctgtgttc

SEQ ID NO: 6272136 - DNA, 16 bp, Homo sapiens
gccaagctgtgttcat

SEQ ID NO: 6272137 - DNA, 17 bp, Homo sapiens
gccaagctgtgttcatc

SEQ ID NO: 6272138 - DNA, 16 bp, Homo sapiens
gccaagcttcctgtgc

SEQ ID NO: 6272139 - DNA, 22 bp, Homo sapiens
gccaagcttcctgtgccctcac

SEQ ID NO: 6272140 - DNA, 18 bp, Homo sapiens
gccaaggaagtctgtgtc

SEQ ID NO: 6272141 - DNA, 16 bp, Homo sapiens
gccaaggaatgtgtcc

SEQ ID NO: 6272142 - DNA, 17 bp, Homo sapiens
gccaaggacagggctgg

SEQ ID NO: 6272143 - DNA, 20 bp, Homo sapiens
gccaaggacagggctggctc

SEQ ID NO: 6272144 - DNA, 14 bp, Homo sapiens
gccaaggacccagg

SEQ ID NO: 6272145 - DNA, 16 bp, Homo sapiens
gccaaggacccaggcg

SEQ ID NO: 6272146 - DNA, 21 bp, Homo sapiens
gccaaggacccaggcgctgca

SEQ ID NO: 6272147 - DNA, 14 bp, Homo sapiens
gccaaggactgact

SEQ ID NO: 6272148 - DNA, 20 bp, Homo sapiens
gccaaggagaggagttcttt

SEQ ID NO: 6272149 - DNA, 12 bp, Homo sapiens
gccaaggagcat

SEQ ID NO: 6272150 - DNA, 14 bp, Homo sapiens
gccaaggagcccct

SEQ ID NO: 6272151 - DNA, 11 bp, Homo sapiens
gccaaggagct

SEQ ID NO: 6272152 - DNA, 21 bp, Homo sapiens
gccaaggagggtgagtgcaag

SEQ ID NO: 6272153 - DNA, 19 bp, Homo sapiens
gccaaggaggtcccaggaa

SEQ ID NO: 6272154 - DNA, 20 bp, Homo sapiens
gccaaggaggtgaggagcag

SEQ ID NO: 6272155 - DNA, 12 bp, Homo sapiens
gccaaggcagcg

SEQ ID NO: 6272156 - DNA, 21 bp, Homo sapiens
gccaaggcatccccagtgcca

SEQ ID NO: 6272157 - DNA, 22 bp, Homo sapiens
gccaaggcatccccagtgccag

SEQ ID NO: 6272158 - DNA, 20 bp, Homo sapiens
gccaaggccagagtggcctg

SEQ ID NO: 6272159 - DNA, 21 bp, Homo sapiens
gccaaggccagagtggcctgg

SEQ ID NO: 6272160 - DNA, 16 bp, Homo sapiens
gccaaggccgccagcg

SEQ ID NO: 6272161 - DNA, 19 bp, Homo sapiens
gccaaggccgcccacctgc

SEQ ID NO: 6272162 - DNA, 14 bp, Homo sapiens
gccaaggccggaga

SEQ ID NO: 6272163 - DNA, 16 bp, Homo sapiens
gccaaggcctaggacc

SEQ ID NO: 6272164 - DNA, 15 bp, Homo sapiens
gccaaggccttctcc

SEQ ID NO: 6272165 - DNA, 18 bp, Homo sapiens
gccaaggccttctcctcc

SEQ ID NO: 6272166 - DNA, 23 bp, Homo sapiens
gccaaggctatttttcagaactg

SEQ ID NO: 6272167 - DNA, 17 bp, Homo sapiens
gccaaggctctgtttat

SEQ ID NO: 6272168 - DNA, 14 bp, Homo sapiens
gccaaggctgagag

SEQ ID NO: 6272169 - DNA, 14 bp, Homo sapiens
gccaagggacacag

SEQ ID NO: 6272170 - DNA, 20 bp, Homo sapiens
gccaagggacgttgacctgg

SEQ ID NO: 6272171 - DNA, 13 bp, Homo sapiens
gccaagggaggga

SEQ ID NO: 6272172 - DNA, 15 bp, Homo sapiens
gccaagggagggaag

SEQ ID NO: 6272173 - DNA, 17 bp, Homo sapiens
gccaagggagggaaggg

SEQ ID NO: 6272174 - DNA, 23 bp, Homo sapiens
gccaagggagggaagggccaccc

SEQ ID NO: 6272175 - DNA, 21 bp, Homo sapiens
gccaagggatgaaagagaagg

SEQ ID NO: 6272176 - DNA, 14 bp, Homo sapiens
gccaagggccagac

SEQ ID NO: 6272177 - DNA, 23 bp, Homo sapiens
gccaagggctccagggccagggt

SEQ ID NO: 6272178 - DNA, 21 bp, Homo sapiens
gccaaggggagtcaccttccc

SEQ ID NO: 6272179 - DNA, 15 bp, Homo sapiens
gccaaggggccagct

SEQ ID NO: 6272180 - DNA, 17 bp, Homo sapiens
gccaaggggccagctgc

SEQ ID NO: 6272181 - DNA, 19 bp, Homo sapiens
gccaaggggccagctgccc

SEQ ID NO: 6272182 - DNA, 13 bp, Homo sapiens
gccaagggggacc

SEQ ID NO: 6272183 - DNA, 21 bp, Homo sapiens
gccaagggggacctcgggctg

SEQ ID NO: 6272184 - DNA, 23 bp, Homo sapiens
gccaagggggcagagggctttca

SEQ ID NO: 6272185 - DNA, 20 bp, Homo sapiens
gccaaggggtctgctcctgt

SEQ ID NO: 6272186 - DNA, 14 bp, Homo sapiens
gccaaggtctgaac

SEQ ID NO: 6272187 - DNA, 14 bp, Homo sapiens
gccaaggtgccacc

SEQ ID NO: 6272188 - DNA, 14 bp, Homo sapiens
gccaaggtgggagg

SEQ ID NO: 6272189 - DNA, 22 bp, Homo sapiens
gccaaggtgggctgagccctgg

SEQ ID NO: 6272190 - DNA, 23 bp, Homo sapiens
gccaaggtgggctgagccctggc

SEQ ID NO: 6272191 - DNA, 23 bp, Homo sapiens
gccaaggtgggtggatcacctgt

SEQ ID NO: 6272192 - DNA, 14 bp, Homo sapiens
gccaaggtgtccta

SEQ ID NO: 6272193 - DNA, 18 bp, Homo sapiens
gccaaggtgtcctacaga

SEQ ID NO: 6272194 - DNA, 21 bp, Homo sapiens
gccaaggtgtcctacagaaaa

SEQ ID NO: 6272195 - DNA, 23 bp, Homo sapiens
gccaaggtgtttccatttctcaa

SEQ ID NO: 6272196 - DNA, 15 bp, Homo sapiens
gccaaggttgtcctg

SEQ ID NO: 6272197 - DNA, 20 bp, Homo sapiens
gccaaggttttataaggctg

SEQ ID NO: 6272198 - DNA, 19 bp, Homo sapiens
gccaagtaaacagggtacc

SEQ ID NO: 6272199 - DNA, 19 bp, Homo sapiens
gccaagtaatcctgcacag

SEQ ID NO: 6272200 - DNA, 14 bp, Homo sapiens
gccaagtagctttg

SEQ ID NO: 6272201 - DNA, 17 bp, Homo sapiens
gccaagtccactgtcct

SEQ ID NO: 6272202 - DNA, 14 bp, Homo sapiens
gccaagtccagatt

SEQ ID NO: 6272203 - DNA, 21 bp, Homo sapiens
gccaagtccaggtcctggtgg

SEQ ID NO: 6272204 - DNA, 22 bp, Homo sapiens
gccaagtccaggtcctggtggg

SEQ ID NO: 6272205 - DNA, 22 bp, Homo sapiens
gccaagtcctagctcctcctcc

SEQ ID NO: 6272206 - DNA, 14 bp, Homo sapiens
gccaagtctcagaa

SEQ ID NO: 6272207 - DNA, 16 bp, Homo sapiens
gccaagtctcagaaga

SEQ ID NO: 6272208 - DNA, 16 bp, Homo sapiens
gccaagtgcaggctgg

SEQ ID NO: 6272209 - DNA, 17 bp, Homo sapiens
gccaagtgccaaatgct

SEQ ID NO: 6272210 - DNA, 13 bp, Homo sapiens
gccaagtgcctgc

SEQ ID NO: 6272211 - DNA, 23 bp, Homo sapiens
gccaagtgcgtgccgtgtgagtg

SEQ ID NO: 6272212 - DNA, 19 bp, Homo sapiens
gccaagtggacttggagct

SEQ ID NO: 6272213 - DNA, 23 bp, Homo sapiens
gccaagtggccactggcatcgca

SEQ ID NO: 6272214 - DNA, 20 bp, Homo sapiens
gccaagtggggatggggcct

SEQ ID NO: 6272215 - DNA, 13 bp, Homo sapiens
gccaagtggggtg

SEQ ID NO: 6272216 - DNA, 19 bp, Homo sapiens
gccaagtggggtgctggga

SEQ ID NO: 6272217 - DNA, 20 bp, Homo sapiens
gccaagtggggtgctgggag

SEQ ID NO: 6272218 - DNA, 23 bp, Homo sapiens
gccaagtggggtgctgggaggag

SEQ ID NO: 6272219 - DNA, 23 bp, Homo sapiens
gccaagtgttttgtattttatag

SEQ ID NO: 6272220 - DNA, 16 bp, Homo sapiens
gccaagttcctctaac

SEQ ID NO: 6272221 - DNA, 21 bp, Homo sapiens
gccaagttcctctagtgccct

SEQ ID NO: 6272222 - DNA, 15 bp, Homo sapiens
gccaagtttatatac

SEQ ID NO: 6272223 - DNA, 23 bp, Homo sapiens
gccaagtttttcagaaagtttga

SEQ ID NO: 6272224 - DNA, 15 bp, Homo sapiens
gccaataaaaagttc

SEQ ID NO: 6272225 - DNA, 15 bp, Homo sapiens
gccaataaaatgtat

SEQ ID NO: 6272226 - DNA, 16 bp, Homo sapiens
gccaataaaccaatga

SEQ ID NO: 6272227 - DNA, 19 bp, Homo sapiens
gccaataaaccaatgaacg

SEQ ID NO: 6272228 - DNA, 22 bp, Homo sapiens
gccaataaaccaatgaacgaag

SEQ ID NO: 6272229 - DNA, 16 bp, Homo sapiens
gccaataaagctcaca

SEQ ID NO: 6272230 - DNA, 18 bp, Homo sapiens
gccaataaagctcacact

SEQ ID NO: 6272231 - DNA, 20 bp, Homo sapiens
gccaataaagcttttggaag

SEQ ID NO: 6272232 - DNA, 18 bp, Homo sapiens
gccaataaagtgatctgt

SEQ ID NO: 6272233 - DNA, 18 bp, Homo sapiens
gccaataaattctaaatt

SEQ ID NO: 6272234 - DNA, 16 bp, Homo sapiens
gccaataataaagaca

SEQ ID NO: 6272235 - DNA, 18 bp, Homo sapiens
gccaataccctactgtgg

SEQ ID NO: 6272236 - DNA, 19 bp, Homo sapiens
gccaataccctactgtggg

SEQ ID NO: 6272237 - DNA, 17 bp, Homo sapiens
gccaatactgagtgcct

SEQ ID NO: 6272238 - DNA, 23 bp, Homo sapiens
gctgttaaatacaggaaacagtt

SEQ ID NO: 6272239 - DNA, 18 bp, Homo sapiens
gctgttaactttcatgct

SEQ ID NO: 6272240 - DNA, 18 bp, Homo sapiens
gctgttaatagatcttag

SEQ ID NO: 6272241 - DNA, 22 bp, Homo sapiens
gctgttaatctgatgtataatg

SEQ ID NO: 6272242 - DNA, 14 bp, Homo sapiens
gctgttacctgaga

SEQ ID NO: 6272243 - DNA, 17 bp, Homo sapiens
gctgttacgtttgaagt

SEQ ID NO: 6272244 - DNA, 13 bp, Homo sapiens
gctgttactgctt

SEQ ID NO: 6272245 - DNA, 20 bp, Homo sapiens
gctgttactgcttctctttg

SEQ ID NO: 6272246 - DNA, 22 bp, Homo sapiens
gctgttactgcttctctttgtg

SEQ ID NO: 6272247 - DNA, 18 bp, Homo sapiens
gctgttactgttaaccat

SEQ ID NO: 6272248 - DNA, 22 bp, Homo sapiens
gctgttacttgctttgagttgg

SEQ ID NO: 6272249 - DNA, 14 bp, Homo sapiens
gctgttagctcaga

SEQ ID NO: 6272250 - DNA, 23 bp, Homo sapiens
gctgttaggacagcaaagcagca

SEQ ID NO: 6272251 - DNA, 20 bp, Homo sapiens
gctgttagggacatttccaa

SEQ ID NO: 6272252 - DNA, 22 bp, Homo sapiens
gctgttagggctgaatcttctg

SEQ ID NO: 6272253 - DNA, 23 bp, Homo sapiens
gctgttaggggttattggtgtaa

SEQ ID NO: 6272254 - DNA, 20 bp, Homo sapiens
gctgttagttataaaactat

SEQ ID NO: 6272255 - DNA, 14 bp, Homo sapiens
gctgttagttgctg

SEQ ID NO: 6272256 - DNA, 13 bp, Homo sapiens
gctgttatctgtc

SEQ ID NO: 6272257 - DNA, 14 bp, Homo sapiens
gctgttatctgtct

SEQ ID NO: 6272258 - DNA, 13 bp, Homo sapiens
gctgttatgctgt

SEQ ID NO: 6272259 - DNA, 15 bp, Homo sapiens
gctgttattcttgtt

SEQ ID NO: 6272260 - DNA, 18 bp, Homo sapiens
gctgttattcttgttata

SEQ ID NO: 6272261 - DNA, 20 bp, Homo sapiens
gctgttatttcttccctgct

SEQ ID NO: 6272262 - DNA, 15 bp, Homo sapiens
gctgttcacagccag

SEQ ID NO: 6272263 - DNA, 16 bp, Homo sapiens
gctgttcacagccaga

SEQ ID NO: 6272264 - DNA, 17 bp, Homo sapiens
gctgttcacagcttttc

SEQ ID NO: 6272265 - DNA, 22 bp, Homo sapiens
gctgttcacccacagggctaag

SEQ ID NO: 6272266 - DNA, 19 bp, Homo sapiens
gctgttcagattggacata

SEQ ID NO: 6272267 - DNA, 13 bp, Homo sapiens
gctgttcagctgg

SEQ ID NO: 6272268 - DNA, 20 bp, Homo sapiens
gctgttcagggcatcggcag

SEQ ID NO: 6272269 - DNA, 16 bp, Homo sapiens
gctgttcatcttgtac

SEQ ID NO: 6272270 - DNA, 12 bp, Homo sapiens
gctgttcatgaa

SEQ ID NO: 6272271 - DNA, 21 bp, Homo sapiens
gctgttcatgaaagattcaat

SEQ ID NO: 6272272 - DNA, 14 bp, Homo sapiens
gctgttcatgctcc

SEQ ID NO: 6272273 - DNA, 19 bp, Homo sapiens
gctgttcatggcaagtggg

SEQ ID NO: 6272274 - DNA, 17 bp, Homo sapiens
gctgttccacaggggct

SEQ ID NO: 6272275 - DNA, 14 bp, Homo sapiens
gctgttccagactc

SEQ ID NO: 6272276 - DNA, 19 bp, Homo sapiens
gctgttccagactcaggtt

SEQ ID NO: 6272277 - DNA, 22 bp, Homo sapiens
gctgttccattacaccacagca

SEQ ID NO: 6272278 - DNA, 21 bp, Homo sapiens
gctgttcctgttcagtaataa

SEQ ID NO: 6272279 - DNA, 12 bp, Homo sapiens
gctgttctcaat

SEQ ID NO: 6272280 - DNA, 12 bp, Homo sapiens
gctgttctcagc

SEQ ID NO: 6272281 - DNA, 21 bp, Homo sapiens
gctgttctcattcctgttctt

SEQ ID NO: 6272282 - DNA, 17 bp, Homo sapiens
gctgttctccaggcttc

SEQ ID NO: 6272283 - DNA, 17 bp, Homo sapiens
gctgttctctttgctga

SEQ ID NO: 6272284 - DNA, 16 bp, Homo sapiens
gctgttctgaaaggga

SEQ ID NO: 6272285 - DNA, 14 bp, Homo sapiens
gctgttctgcactg

SEQ ID NO: 6272286 - DNA, 15 bp, Homo sapiens
gctgttctgcactga

SEQ ID NO: 6272287 - DNA, 20 bp, Homo sapiens
gctgttctggagctgctgtt

SEQ ID NO: 6272288 - DNA, 19 bp, Homo sapiens
gctgttctgggcatggcag

SEQ ID NO: 6272289 - DNA, 20 bp, Homo sapiens
gctgttctgggcatggcagg

SEQ ID NO: 6272290 - DNA, 13 bp, Homo sapiens
gctgttctgtgta

SEQ ID NO: 6272291 - DNA, 22 bp, Homo sapiens
gctgttcttcaactcctgggct

SEQ ID NO: 6272292 - DNA, 19 bp, Homo sapiens
gctgttcttcacttctggg

SEQ ID NO: 6272293 - DNA, 19 bp, Homo sapiens
gctgttcttcagtcctttg

SEQ ID NO: 6272294 - DNA, 20 bp, Homo sapiens
gctgttcttcagtcctttgt

SEQ ID NO: 6272295 - DNA, 12 bp, Homo sapiens
gctgttcttcct

SEQ ID NO: 6272296 - DNA, 20 bp, Homo sapiens
gctgttcttctgttctgcag

SEQ ID NO: 6272297 - DNA, 18 bp, Homo sapiens
gctgttcttgaagctggg

SEQ ID NO: 6272298 - DNA, 19 bp, Homo sapiens
gctgttcttgaagctgggc

SEQ ID NO: 6272299 - DNA, 23 bp, Homo sapiens
gctgttctttagtagcaactaaa

SEQ ID NO: 6272300 - DNA, 21 bp, Homo sapiens
gctgttgaagcattttctcag

SEQ ID NO: 6272301 - DNA, 14 bp, Homo sapiens
gctgttgacatatt

SEQ ID NO: 6272302 - DNA, 23 bp, Homo sapiens
gctgttgacgttgatctcctggt

SEQ ID NO: 6272303 - DNA, 14 bp, Homo sapiens
gctgttgagaaaac

SEQ ID NO: 6272304 - DNA, 16 bp, Homo sapiens
gctgttgagctgtttt

SEQ ID NO: 6272305 - DNA, 15 bp, Homo sapiens
gctgttgagggccaa

SEQ ID NO: 6272306 - DNA, 15 bp, Homo sapiens
gctgttgaggtggct

SEQ ID NO: 6272307 - DNA, 18 bp, Homo sapiens
gctgttgaggtggctgta

SEQ ID NO: 6272308 - DNA, 16 bp, Homo sapiens
gctgttgattctttca

SEQ ID NO: 6272309 - DNA, 17 bp, Homo sapiens
gctgttgcaggcagtgt

SEQ ID NO: 6272310 - DNA, 21 bp, Homo sapiens
gctgttgcgtaactggctgtg

SEQ ID NO: 6272311 - DNA, 16 bp, Homo sapiens
gctgttgctatttgta

SEQ ID NO: 6272312 - DNA, 17 bp, Homo sapiens
gctgttgctatttgtat

SEQ ID NO: 6272313 - DNA, 15 bp, Homo sapiens
gctgttgctgaatag

SEQ ID NO: 6272314 - DNA, 21 bp, Homo sapiens
gctgttgctgattttattctt

SEQ ID NO: 6272315 - DNA, 17 bp, Homo sapiens
gctgttgctggactgag

SEQ ID NO: 6272316 - DNA, 13 bp, Homo sapiens
gctgttgctgttg

SEQ ID NO: 6272317 - DNA, 12 bp, Homo sapiens
gctgttgcttga

SEQ ID NO: 6272318 - DNA, 21 bp, Homo sapiens
gctgttggacagctgcttgtg

SEQ ID NO: 6272319 - DNA, 16 bp, Homo sapiens
gctgttggaggacccc

SEQ ID NO: 6272320 - DNA, 16 bp, Homo sapiens
gctgttggcagtgagt

SEQ ID NO: 6272321 - DNA, 22 bp, Homo sapiens
gctgttggcagtgagtgagcct

SEQ ID NO: 6272322 - DNA, 16 bp, Homo sapiens
gctgttggcctcgcct

SEQ ID NO: 6272323 - DNA, 21 bp, Homo sapiens
gctgttggcctcgcctgggcc

SEQ ID NO: 6272324 - DNA, 14 bp, Homo sapiens
gctgttggctgggg

SEQ ID NO: 6272325 - DNA, 18 bp, Homo sapiens
gctgttggctgggggcat

SEQ ID NO: 6272326 - DNA, 21 bp, Homo sapiens
gctgttgggtttttgctgttt

SEQ ID NO: 6272327 - DNA, 15 bp, Homo sapiens
gctgttggtgggacc

SEQ ID NO: 6272328 - DNA, 14 bp, Homo sapiens
gctgttgtacattt

SEQ ID NO: 6272329 - DNA, 19 bp, Homo sapiens
gctgttgtcacatctcagg

SEQ ID NO: 6272330 - DNA, 16 bp, Homo sapiens
gctgttgtccctctgc

SEQ ID NO: 6272331 - DNA, 18 bp, Homo sapiens
gctgttgtccctctgcta

SEQ ID NO: 6272332 - DNA, 14 bp, Homo sapiens
gctgttgtgcagtg

SEQ ID NO: 6272333 - DNA, 17 bp, Homo sapiens
gctgttgtgcagtgtgc

SEQ ID NO: 6272334 - DNA, 18 bp, Homo sapiens
gctgttgtgtctggagcc

SEQ ID NO: 6272335 - DNA, 19 bp, Homo sapiens
gctgttgttatgatgtgct

SEQ ID NO: 6272336 - DNA, 21 bp, Homo sapiens
gctgttgttgttacttccctc

SEQ ID NO: 6272337 - DNA, 16 bp, Homo sapiens
gctgttgtttaaaata

SEQ ID NO: 6272338 - DNA, 14 bp, Homo sapiens
gctgttgtttctat

SEQ ID NO: 6272339 - DNA, 22 bp, Homo sapiens
gctgtttaaagtcacatccctg

SEQ ID NO: 6272340 - DNA, 12 bp, Homo sapiens
gctgtttacaac

SEQ ID NO: 6272341 - DNA, 15 bp, Homo sapiens
gctgtttactaggga

SEQ ID NO: 6272342 - DNA, 21 bp, Homo sapiens
gctgtttactcccttctgtag

SEQ ID NO: 6272343 - DNA, 14 bp, Homo sapiens
gctgtttactgaca

SEQ ID NO: 6272344 - DNA, 22 bp, Homo sapiens
gctgtttacttgaatagtattg

SEQ ID NO: 6272345 - DNA, 15 bp, Homo sapiens
gctgtttagcagaac

SEQ ID NO: 6272346 - DNA, 19 bp, Homo sapiens
gctgtttatcccttaagaa

SEQ ID NO: 6272347 - DNA, 16 bp, Homo sapiens
gctgtttatggcctca

SEQ ID NO: 6272348 - DNA, 17 bp, Homo sapiens
gctgtttatggcctcag

SEQ ID NO: 6272349 - DNA, 17 bp, Homo sapiens
gctgtttatttattcac

SEQ ID NO: 6272350 - DNA, 14 bp, Homo sapiens
gctgtttcaaatgt

SEQ ID NO: 6272351 - DNA, 15 bp, Homo sapiens
gctgtttcccctgca

SEQ ID NO: 6272352 - DNA, 21 bp, Homo sapiens
gctgtttcctagctaggagca

SEQ ID NO: 6272353 - DNA, 18 bp, Homo sapiens
gctgtttctcatgaagct

SEQ ID NO: 6272354 - DNA, 19 bp, Homo sapiens
gctgtttctcatgaagcta

SEQ ID NO: 6272355 - DNA, 13 bp, Homo sapiens
gctgtttgaaatg

SEQ ID NO: 6272356 - DNA, 13 bp, Homo sapiens
gctgtttgagatg

SEQ ID NO: 6272357 - DNA, 20 bp, Homo sapiens
gctgtttgagatgtgatgct

SEQ ID NO: 6272358 - DNA, 19 bp, Homo sapiens
gctgtttgagattctcaaa

SEQ ID NO: 6272359 - DNA, 16 bp, Homo sapiens
gctgtttgcgtgaatg

SEQ ID NO: 6272360 - DNA, 20 bp, Homo sapiens
gctgtttgcttcaccgtgga

SEQ ID NO: 6272361 - DNA, 12 bp, Homo sapiens
gctgtttggaaa

SEQ ID NO: 6272362 - DNA, 19 bp, Homo sapiens
gctgtttggttttaaaata

SEQ ID NO: 6272363 - DNA, 21 bp, Homo sapiens
gctgtttgtgtgtctgggttg

SEQ ID NO: 6272364 - DNA, 21 bp, Homo sapiens
gctgtttgtttgacaaagaaa

SEQ ID NO: 6272365 - DNA, 15 bp, Homo sapiens
gctgttttaatttgt

SEQ ID NO: 6272366 - DNA, 21 bp, Homo sapiens
gctgttttagttaaatttctg

SEQ ID NO: 6272367 - DNA, 19 bp, Homo sapiens
gctgttttatgtcatactc

SEQ ID NO: 6272368 - DNA, 18 bp, Homo sapiens
gctgttttccctctgctg

SEQ ID NO: 6272369 - DNA, 19 bp, Homo sapiens
gctgttttccctctgctgc

SEQ ID NO: 6272370 - DNA, 15 bp, Homo sapiens
gctgttttgcctccc

SEQ ID NO: 6272371 - DNA, 18 bp, Homo sapiens
gctgttttgttctgtggt

SEQ ID NO: 6272372 - DNA, 14 bp, Homo sapiens
gctgttttgttgac

SEQ ID NO: 6272373 - DNA, 14 bp, Homo sapiens
gctgtttttgttgt

SEQ ID NO: 6272374 - DNA, 15 bp, Homo sapiens
gctgtttttgttgtg

SEQ ID NO: 6272375 - DNA, 13 bp, Homo sapiens
gctgttttttgtt

SEQ ID NO: 6272376 - DNA, 18 bp, Homo sapiens
gctgttttttgtttttta

SEQ ID NO: 6272377 - DNA, 16 bp, Homo sapiens
gcttaaaaaaaggaaa

SEQ ID NO: 6272378 - DNA, 13 bp, Homo sapiens
gcttaaaaatact

SEQ ID NO: 6272379 - DNA, 17 bp, Homo sapiens
gcttaaaaatacttcta

SEQ ID NO: 6272380 - DNA, 14 bp, Homo sapiens
gcttaaaaatcatt

SEQ ID NO: 6272381 - DNA, 20 bp, Homo sapiens
gcttaaaaatcattctaatt

SEQ ID NO: 6272382 - DNA, 12 bp, Homo sapiens
gcttaaaacttt

SEQ ID NO: 6272383 - DNA, 15 bp, Homo sapiens
gcttaaaagaaacta

SEQ ID NO: 6272384 - DNA, 13 bp, Homo sapiens
gcttaaaagagta

SEQ ID NO: 6272385 - DNA, 20 bp, Homo sapiens
gcttaaaaggtataattaaa

SEQ ID NO: 6272386 - DNA, 14 bp, Homo sapiens
gcttaaaatgcaag

SEQ ID NO: 6272387 - DNA, 20 bp, Homo sapiens
gcttaaaattggtaattgaa

SEQ ID NO: 6272388 - DNA, 18 bp, Homo sapiens
gcttaaacaaaactggaa

SEQ ID NO: 6272389 - DNA, 18 bp, Homo sapiens
gcttaaacaaagcagtat

SEQ ID NO: 6272390 - DNA, 23 bp, Homo sapiens
gcttaaacaacacctcctcctgc

SEQ ID NO: 6272391 - DNA, 20 bp, Homo sapiens
gcttaaacatttccctgctg

SEQ ID NO: 6272392 - DNA, 19 bp, Homo sapiens
gcttaaacccatacaatgt

SEQ ID NO: 6272393 - DNA, 20 bp, Homo sapiens
gcttaaacccatacaatgta

SEQ ID NO: 6272394 - DNA, 23 bp, Homo sapiens
gcttaaacccatacaatgtatgt

SEQ ID NO: 6272395 - DNA, 18 bp, Homo sapiens
gcttaaagaattcaaatt

SEQ ID NO: 6272396 - DNA, 12 bp, Homo sapiens
gcttaaagatgt

SEQ ID NO: 6272397 - DNA, 14 bp, Homo sapiens
gcttaaagccccct

SEQ ID NO: 6272398 - DNA, 15 bp, Homo sapiens
gcttaaagggatgga

SEQ ID NO: 6272399 - DNA, 22 bp, Homo sapiens
gcttaaagggatggacttgtga

SEQ ID NO: 6272400 - DNA, 22 bp, Homo sapiens
gcttaaaggtgtcttcctccca

SEQ ID NO: 6272401 - DNA, 23 bp, Homo sapiens
gcttaaaggtgtcttcctcccaa

SEQ ID NO: 6272402 - DNA, 16 bp, Homo sapiens
gcttaaagtgaaggaa

SEQ ID NO: 6272403 - DNA, 17 bp, Homo sapiens
gcttaaagtgaaggaaa

SEQ ID NO: 6272404 - DNA, 21 bp, Homo sapiens
gcttaaagttggtattaataa

SEQ ID NO: 6272405 - DNA, 18 bp, Homo sapiens
gcttaaataaattcaaac

SEQ ID NO: 6272406 - DNA, 23 bp, Homo sapiens
gcttaaatatagttcctaagaag

SEQ ID NO: 6272407 - DNA, 12 bp, Homo sapiens
gcttaaatgtga

SEQ ID NO: 6272408 - DNA, 23 bp, Homo sapiens
gcttaaatgtgaattactaactt

SEQ ID NO: 6272409 - DNA, 22 bp, Homo sapiens
gcttaaattgcttttgttgtga

SEQ ID NO: 6272410 - DNA, 14 bp, Homo sapiens
gcttaaatttcaga

SEQ ID NO: 6272411 - DNA, 16 bp, Homo sapiens
gcttaaatttcttatg

SEQ ID NO: 6272412 - DNA, 13 bp, Homo sapiens
gcttaaattttaa

SEQ ID NO: 6272413 - DNA, 18 bp, Homo sapiens
gcttaacaatgcaacttt

SEQ ID NO: 6272414 - DNA, 21 bp, Homo sapiens
gcttaacaatgcaacttttaa

SEQ ID NO: 6272415 - DNA, 19 bp, Homo sapiens
gcttaacagggaacgtgat

SEQ ID NO: 6272416 - DNA, 14 bp, Homo sapiens
gccaatatcctaat

SEQ ID NO: 6272417 - DNA, 18 bp, Homo sapiens
gccaatatcctaataaaa

SEQ ID NO: 6272418 - DNA, 23 bp, Homo sapiens
gccaatatcctaataaaaaggtg

SEQ ID NO: 6272419 - DNA, 23 bp, Homo sapiens
gccaatatgacacagcttgtgaa

SEQ ID NO: 6272420 - DNA, 15 bp, Homo sapiens
gccaatcaagggcaa

SEQ ID NO: 6272421 - DNA, 18 bp, Homo sapiens
gccaatccaggtgggaga

SEQ ID NO: 6272422 - DNA, 18 bp, Homo sapiens
gccaatcccctccttggg

SEQ ID NO: 6272423 - DNA, 18 bp, Homo sapiens
gccaatctagaggcaagc

SEQ ID NO: 6272424 - DNA, 17 bp, Homo sapiens
gccaatctattctcaaa

SEQ ID NO: 6272425 - DNA, 13 bp, Homo sapiens
gccaatctggccc

SEQ ID NO: 6272426 - DNA, 21 bp, Homo sapiens
gccaatctggcccttacacac

SEQ ID NO: 6272427 - DNA, 21 bp, Homo sapiens
gccaatgaagcaaacacacag

SEQ ID NO: 6272428 - DNA, 17 bp, Homo sapiens
gccaatgatgtgaccct

SEQ ID NO: 6272429 - DNA, 15 bp, Homo sapiens
gccaatgattccaga

SEQ ID NO: 6272430 - DNA, 19 bp, Homo sapiens
gccaatgcacctaaagaaa

SEQ ID NO: 6272431 - DNA, 21 bp, Homo sapiens
gccaatgcacctaaagaaaaa

SEQ ID NO: 6272432 - DNA, 17 bp, Homo sapiens
gccaatgccacagccaa

SEQ ID NO: 6272433 - DNA, 18 bp, Homo sapiens
gccaatgccacagccaag

SEQ ID NO: 6272434 - DNA, 19 bp, Homo sapiens
gccaatgccatgactgctc

SEQ ID NO: 6272435 - DNA, 18 bp, Homo sapiens
gccaatgccccactggca

SEQ ID NO: 6272436 - DNA, 23 bp, Homo sapiens
gccaatgcggcccactttcctga

SEQ ID NO: 6272437 - DNA, 13 bp, Homo sapiens
gccaatggaaacc

SEQ ID NO: 6272438 - DNA, 22 bp, Homo sapiens
gccaatggaggggggtgctggc

SEQ ID NO: 6272439 - DNA, 14 bp, Homo sapiens
gccaatggtgcttc

SEQ ID NO: 6272440 - DNA, 19 bp, Homo sapiens
gccaatggtgcttccccca

SEQ ID NO: 6272441 - DNA, 22 bp, Homo sapiens
gccaatgtattgataagagggc

SEQ ID NO: 6272442 - DNA, 15 bp, Homo sapiens
gccaatgtccaggtc

SEQ ID NO: 6272443 - DNA, 21 bp, Homo sapiens
gccaatgtccaggtcacaggc

SEQ ID NO: 6272444 - DNA, 16 bp, Homo sapiens
gccaatgtgggctgcc

SEQ ID NO: 6272445 - DNA, 19 bp, Homo sapiens
gccaatgtgggctgcccct

SEQ ID NO: 6272446 - DNA, 18 bp, Homo sapiens
gccaatgttatgccagct

SEQ ID NO: 6272447 - DNA, 23 bp, Homo sapiens
gccaatgttatgccagctccatg

SEQ ID NO: 6272448 - DNA, 19 bp, Homo sapiens
gccaatgttgctgatggcc

SEQ ID NO: 6272449 - DNA, 19 bp, Homo sapiens
gccaattaaaaacgaaaac

SEQ ID NO: 6272450 - DNA, 18 bp, Homo sapiens
gccaattacttgaagtat

SEQ ID NO: 6272451 - DNA, 15 bp, Homo sapiens
gccaattatgttaaa

SEQ ID NO: 6272452 - DNA, 16 bp, Homo sapiens
gccaattatgttaaac

SEQ ID NO: 6272453 - DNA, 17 bp, Homo sapiens
gccaattatgttaaact

SEQ ID NO: 6272454 - DNA, 19 bp, Homo sapiens
gccaattattgttacacat

SEQ ID NO: 6272455 - DNA, 15 bp, Homo sapiens
gccaattcagacagg

SEQ ID NO: 6272456 - DNA, 21 bp, Homo sapiens
gccaattcagtttcactttgg

SEQ ID NO: 6272457 - DNA, 14 bp, Homo sapiens
gccaattcatctca

SEQ ID NO: 6272458 - DNA, 13 bp, Homo sapiens
gccaattgctacc

SEQ ID NO: 6272459 - DNA, 17 bp, Homo sapiens
gccaatttactggccac

SEQ ID NO: 6272460 - DNA, 18 bp, Homo sapiens
gccaatttcaaagaaaac

SEQ ID NO: 6272461 - DNA, 20 bp, Homo sapiens
gccaatttcaagttccaagt

SEQ ID NO: 6272462 - DNA, 17 bp, Homo sapiens
gccaatttcccggagcc

SEQ ID NO: 6272463 - DNA, 13 bp, Homo sapiens
gccaatttcctct

SEQ ID NO: 6272464 - DNA, 11 bp, Homo sapiens
gccaattttgt

SEQ ID NO: 6272465 - DNA, 13 bp, Homo sapiens
gccaatttttctg

SEQ ID NO: 6272466 - DNA, 15 bp, Homo sapiens
gccacaaaaacaggt

SEQ ID NO: 6272467 - DNA, 18 bp, Homo sapiens
gccacaaaaatgttcact

SEQ ID NO: 6272468 - DNA, 20 bp, Homo sapiens
gccacaaaactctgtcaggc

SEQ ID NO: 6272469 - DNA, 14 bp, Homo sapiens
gccacaaagccccc

SEQ ID NO: 6272470 - DNA, 16 bp, Homo sapiens
gccacaaagcccccca

SEQ ID NO: 6272471 - DNA, 21 bp, Homo sapiens
gccacaaagccccccagctcc

SEQ ID NO: 6272472 - DNA, 23 bp, Homo sapiens
gccacaaagccccccagctccca

SEQ ID NO: 6272473 - DNA, 22 bp, Homo sapiens
gccacaaagggacacacagtga

SEQ ID NO: 6272474 - DNA, 22 bp, Homo sapiens
gccacaaatcaaagcaagggct

SEQ ID NO: 6272475 - DNA, 16 bp, Homo sapiens
gccacaaatgccttga

SEQ ID NO: 6272476 - DNA, 22 bp, Homo sapiens
gccacaaattctttgacactca

SEQ ID NO: 6272477 - DNA, 18 bp, Homo sapiens
gccacaacaccagcccca

SEQ ID NO: 6272478 - DNA, 14 bp, Homo sapiens
gccacaactgctgt

SEQ ID NO: 6272479 - DNA, 23 bp, Homo sapiens
gccacaactgctgtggccccctg

SEQ ID NO: 6272480 - DNA, 23 bp, Homo sapiens
gccacaagaaatttgatttctat

SEQ ID NO: 6272481 - DNA, 22 bp, Homo sapiens
gccacaagacccttgtggtccc

SEQ ID NO: 6272482 - DNA, 13 bp, Homo sapiens
gccacaagcacaa

SEQ ID NO: 6272483 - DNA, 16 bp, Homo sapiens
gccacaagctgcactg

SEQ ID NO: 6272484 - DNA, 17 bp, Homo sapiens
gccacaagctgcactgt

SEQ ID NO: 6272485 - DNA, 21 bp, Homo sapiens
gccacaagctgcactgtgaac

SEQ ID NO: 6272486 - DNA, 18 bp, Homo sapiens
gccacaaggaaaaggagg

SEQ ID NO: 6272487 - DNA, 20 bp, Homo sapiens
gccacaaggaaaaggaggag

SEQ ID NO: 6272488 - DNA, 23 bp, Homo sapiens
gccacaaggaagaaattaactta

SEQ ID NO: 6272489 - DNA, 16 bp, Homo sapiens
gccacaaggctggcca

SEQ ID NO: 6272490 - DNA, 17 bp, Homo sapiens
gccacaaggctggccag

SEQ ID NO: 6272491 - DNA, 16 bp, Homo sapiens
gccacaagtcttccag

SEQ ID NO: 6272492 - DNA, 21 bp, Homo sapiens
gccacaagttctttcccagcc

SEQ ID NO: 6272493 - DNA, 17 bp, Homo sapiens
gccacaatcctccccac

SEQ ID NO: 6272494 - DNA, 18 bp, Homo sapiens
gccacaatgcctctccca

SEQ ID NO: 6272495 - DNA, 20 bp, Homo sapiens
gccacaatgcctctcccacg

SEQ ID NO: 6272496 - DNA, 21 bp, Homo sapiens
gccacaattatataaatcatt

SEQ ID NO: 6272497 - DNA, 19 bp, Homo sapiens
gccacacaaacgtttactt

SEQ ID NO: 6272498 - DNA, 13 bp, Homo sapiens
gccacacacacag

SEQ ID NO: 6272499 - DNA, 20 bp, Homo sapiens
gccacacacacagaaaatat

SEQ ID NO: 6272500 - DNA, 18 bp, Homo sapiens
gccacacactgcacatct

SEQ ID NO: 6272501 - DNA, 15 bp, Homo sapiens
gccacacagaccacc

SEQ ID NO: 6272502 - DNA, 19 bp, Homo sapiens
gccacacagagcctgcctc

SEQ ID NO: 6272503 - DNA, 20 bp, Homo sapiens
gccacacagagcctgcctca

SEQ ID NO: 6272504 - DNA, 13 bp, Homo sapiens
gccacacagcagc

SEQ ID NO: 6272505 - DNA, 14 bp, Homo sapiens
gccacacagcccag

SEQ ID NO: 6272506 - DNA, 19 bp, Homo sapiens
gccacacagcccagaaggc

SEQ ID NO: 6272507 - DNA, 15 bp, Homo sapiens
gccacacagctgccg

SEQ ID NO: 6272508 - DNA, 20 bp, Homo sapiens
gccacacaggcagggcctgg

SEQ ID NO: 6272509 - DNA, 10 bp, Homo sapiens
gccacacagt

SEQ ID NO: 6272510 - DNA, 13 bp, Homo sapiens
gccacacagtggc

SEQ ID NO: 6272511 - DNA, 20 bp, Homo sapiens
gccacacagtggccggggct

SEQ ID NO: 6272512 - DNA, 16 bp, Homo sapiens
gccacaccaagctgtg

SEQ ID NO: 6272513 - DNA, 17 bp, Homo sapiens
gccacaccaagctgtgc

SEQ ID NO: 6272514 - DNA, 18 bp, Homo sapiens
gccacaccaagctgtgcc

SEQ ID NO: 6272515 - DNA, 21 bp, Homo sapiens
gccacaccaagctgtgccacc

SEQ ID NO: 6272516 - DNA, 23 bp, Homo sapiens
gccacaccaagctgtgccaccct

SEQ ID NO: 6272517 - DNA, 20 bp, Homo sapiens
gccacaccaatcagagagcc

SEQ ID NO: 6272518 - DNA, 21 bp, Homo sapiens
gccacaccaatcagagagcct

SEQ ID NO: 6272519 - DNA, 12 bp, Homo sapiens
gccacacccagc

SEQ ID NO: 6272520 - DNA, 15 bp, Homo sapiens
gccacacccaggcac

SEQ ID NO: 6272521 - DNA, 14 bp, Homo sapiens
gccacacccagggg

SEQ ID NO: 6272522 - DNA, 17 bp, Homo sapiens
gccacaccccagactcc

SEQ ID NO: 6272523 - DNA, 19 bp, Homo sapiens
gccacacccctctgctgca

SEQ ID NO: 6272524 - DNA, 22 bp, Homo sapiens
gccacacccctctgctgcaaca

SEQ ID NO: 6272525 - DNA, 15 bp, Homo sapiens
gccacacccggctcc

SEQ ID NO: 6272526 - DNA, 15 bp, Homo sapiens
gccacaccctcccca

SEQ ID NO: 6272527 - DNA, 16 bp, Homo sapiens
gccacaccctccccat

SEQ ID NO: 6272528 - DNA, 17 bp, Homo sapiens
gccacaccctccccatt

SEQ ID NO: 6272529 - DNA, 12 bp, Homo sapiens
gccacacctggc

SEQ ID NO: 6272530 - DNA, 20 bp, Homo sapiens
gccacacctggccttaaaga

SEQ ID NO: 6272531 - DNA, 17 bp, Homo sapiens
gccacacgagaacctga

SEQ ID NO: 6272532 - DNA, 20 bp, Homo sapiens
gccacacgcaggcggccagg

SEQ ID NO: 6272533 - DNA, 16 bp, Homo sapiens
gccacacgcatgggca

SEQ ID NO: 6272534 - DNA, 19 bp, Homo sapiens
gccacacgcatgggcattg

SEQ ID NO: 6272535 - DNA, 16 bp, Homo sapiens
gccacacgcctctgtg

SEQ ID NO: 6272536 - DNA, 19 bp, Homo sapiens
gccacacgcctctgtgtac

SEQ ID NO: 6272537 - DNA, 15 bp, Homo sapiens
gccacacgctcactc

SEQ ID NO: 6272538 - DNA, 18 bp, Homo sapiens
gccacacgctgcccaggc

SEQ ID NO: 6272539 - DNA, 20 bp, Homo sapiens
gccacacgtggctggcggcc

SEQ ID NO: 6272540 - DNA, 18 bp, Homo sapiens
gccacactattaccatga

SEQ ID NO: 6272541 - DNA, 17 bp, Homo sapiens
gccacactctccatcac

SEQ ID NO: 6272542 - DNA, 14 bp, Homo sapiens
gccacactgatggc

SEQ ID NO: 6272543 - DNA, 12 bp, Homo sapiens
gccacactgggc

SEQ ID NO: 6272544 - DNA, 14 bp, Homo sapiens
gccacactgggcct

SEQ ID NO: 6272545 - DNA, 15 bp, Homo sapiens
gccacactggggctg

SEQ ID NO: 6272546 - DNA, 17 bp, Homo sapiens
gccacactggggctgac

SEQ ID NO: 6272547 - DNA, 15 bp, Homo sapiens
gccacactgtgacac

SEQ ID NO: 6272548 - DNA, 18 bp, Homo sapiens
gccacactgtgacacact

SEQ ID NO: 6272549 - DNA, 19 bp, Homo sapiens
gccacacttcaaactactt

SEQ ID NO: 6272550 - DNA, 20 bp, Homo sapiens
gccacacttcaggctcttct

SEQ ID NO: 6272551 - DNA, 22 bp, Homo sapiens
gccacacttcaggctcttctcc

SEQ ID NO: 6272552 - DNA, 23 bp, Homo sapiens
gccacacttctcaggacacaggc

SEQ ID NO: 6272553 - DNA, 18 bp, Homo sapiens
gccacagaagccaggagc

SEQ ID NO: 6272554 - DNA, 15 bp, Homo sapiens
gccacagaccacctg

SEQ ID NO: 6272555 - DNA, 17 bp, Homo sapiens
gccacagaccacctgct

SEQ ID NO: 6272556 - DNA, 17 bp, Homo sapiens
gccacagacccctggga

SEQ ID NO: 6272557 - DNA, 19 bp, Homo sapiens
gccacagacccctgggagc

SEQ ID NO: 6272558 - DNA, 14 bp, Homo sapiens
gccacagagaaagt

SEQ ID NO: 6272559 - DNA, 12 bp, Homo sapiens
gccacagagaag

SEQ ID NO: 6272560 - DNA, 16 bp, Homo sapiens
gccacagaggccccac

SEQ ID NO: 6272561 - DNA, 18 bp, Homo sapiens
gccacagaggccccacct

SEQ ID NO: 6272562 - DNA, 22 bp, Homo sapiens
gccacagagtgtagccaggtcc

SEQ ID NO: 6272563 - DNA, 12 bp, Homo sapiens
gccacagcactc

SEQ ID NO: 6272564 - DNA, 14 bp, Homo sapiens
gccacagcagcatt

SEQ ID NO: 6272565 - DNA, 15 bp, Homo sapiens
gccacagcagcattt

SEQ ID NO: 6272566 - DNA, 17 bp, Homo sapiens
gccacagcagcctctga

SEQ ID NO: 6272567 - DNA, 21 bp, Homo sapiens
gccacagcaggactgaggaca

SEQ ID NO: 6272568 - DNA, 14 bp, Homo sapiens
gccacagccagaac

SEQ ID NO: 6272569 - DNA, 14 bp, Homo sapiens
gccacagccagagg

SEQ ID NO: 6272570 - DNA, 17 bp, Homo sapiens
gccacagccagaggagg

SEQ ID NO: 6272571 - DNA, 13 bp, Homo sapiens
gccacagcccagc

SEQ ID NO: 6272572 - DNA, 20 bp, Homo sapiens
gccacagccccacagcaccc

SEQ ID NO: 6272573 - DNA, 12 bp, Homo sapiens
gccacagcccct

SEQ ID NO: 6272574 - DNA, 15 bp, Homo sapiens
gccacagccctgtca

SEQ ID NO: 6272575 - DNA, 14 bp, Homo sapiens
gccacagccgcctt

SEQ ID NO: 6272576 - DNA, 20 bp, Homo sapiens
gccacagccgcctttgggtt

SEQ ID NO: 6272577 - DNA, 21 bp, Homo sapiens
gccacagcctcccctgccagg

SEQ ID NO: 6272578 - DNA, 11 bp, Homo sapiens
gccacagcctg

SEQ ID NO: 6272579 - DNA, 16 bp, Homo sapiens
gccacagcctgctggc

SEQ ID NO: 6272580 - DNA, 22 bp, Homo sapiens
gccacagcctgctggcagggcc

SEQ ID NO: 6272581 - DNA, 23 bp, Homo sapiens
gccacagcctgctggcagggcca

SEQ ID NO: 6272582 - DNA, 21 bp, Homo sapiens
gccacagcctgggaaggagcg

SEQ ID NO: 6272583 - DNA, 13 bp, Homo sapiens
gccacagcctgtc

SEQ ID NO: 6272584 - DNA, 14 bp, Homo sapiens
gccacagccttccc

SEQ ID NO: 6272585 - DNA, 20 bp, Homo sapiens
gccacagccttccctctgca

SEQ ID NO: 6272586 - DNA, 15 bp, Homo sapiens
gccacagcgccagcc

SEQ ID NO: 6272587 - DNA, 14 bp, Homo sapiens
gccacagcgtgctg

SEQ ID NO: 6272588 - DNA, 13 bp, Homo sapiens
gccacagctgctg

SEQ ID NO: 6272589 - DNA, 15 bp, Homo sapiens
gccacagctgctgga

SEQ ID NO: 6272590 - DNA, 20 bp, Homo sapiens
gccacagctgctgttctcag

SEQ ID NO: 6272591 - DNA, 12 bp, Homo sapiens
gccacagctttt

SEQ ID NO: 6272592 - DNA, 19 bp, Homo sapiens
gccacaggacccagaaaaa

SEQ ID NO: 6272593 - DNA, 17 bp, Homo sapiens
gccacaggactgagccc

SEQ ID NO: 6272594 - DNA, 20 bp, Homo sapiens
gccacaggactgagccctct

SEQ ID NO: 6272595 - DNA, 22 bp, Homo sapiens
gcttaacataaacttgtactta

SEQ ID NO: 6272596 - DNA, 21 bp, Homo sapiens
gcttaacattagatgtcatga

SEQ ID NO: 6272597 - DNA, 17 bp, Homo sapiens
gcttaacgttttcttaa

SEQ ID NO: 6272598 - DNA, 20 bp, Homo sapiens
gcttaagaaatctagtattt

SEQ ID NO: 6272599 - DNA, 20 bp, Homo sapiens
gcttaagatgctaatagaaa

SEQ ID NO: 6272600 - DNA, 21 bp, Homo sapiens
gcttaagcatccgtgtatttg

SEQ ID NO: 6272601 - DNA, 15 bp, Homo sapiens
gcttaagccactgcc

SEQ ID NO: 6272602 - DNA, 12 bp, Homo sapiens
gcttaaggagag

SEQ ID NO: 6272603 - DNA, 15 bp, Homo sapiens
gcttaaggagaggag

SEQ ID NO: 6272604 - DNA, 20 bp, Homo sapiens
gcttaaggcctaaggaagcc

SEQ ID NO: 6272605 - DNA, 18 bp, Homo sapiens
gcttaagggggtgtaatg

SEQ ID NO: 6272606 - DNA, 16 bp, Homo sapiens
gcttaagtcatcatta

SEQ ID NO: 6272607 - DNA, 16 bp, Homo sapiens
gcttaagtgtaaatga

SEQ ID NO: 6272608 - DNA, 17 bp, Homo sapiens
gcttaagtgtaaatgaa

SEQ ID NO: 6272609 - DNA, 18 bp, Homo sapiens
gcttaagtgtaaatgaag

SEQ ID NO: 6272610 - DNA, 11 bp, Homo sapiens
gcttaagttcc

SEQ ID NO: 6272611 - DNA, 19 bp, Homo sapiens
gcttaataaaaatgacaga

SEQ ID NO: 6272612 - DNA, 19 bp, Homo sapiens
gcttaatagccctccccct

SEQ ID NO: 6272613 - DNA, 17 bp, Homo sapiens
gcttaatcagatagata

SEQ ID NO: 6272614 - DNA, 15 bp, Homo sapiens
gcttaatcattttca

SEQ ID NO: 6272615 - DNA, 22 bp, Homo sapiens
gcttaatccaatattttgcctt

SEQ ID NO: 6272616 - DNA, 19 bp, Homo sapiens
gcttaatctagagctatgc

SEQ ID NO: 6272617 - DNA, 22 bp, Homo sapiens
gcttaatcttcaaagccttctc

SEQ ID NO: 6272618 - DNA, 15 bp, Homo sapiens
gcttaatctttgaaa

SEQ ID NO: 6272619 - DNA, 12 bp, Homo sapiens
gcttaatgaaaa

SEQ ID NO: 6272620 - DNA, 16 bp, Homo sapiens
gcttaatgctacatgt

SEQ ID NO: 6272621 - DNA, 18 bp, Homo sapiens
gcttaatggagttcttgt

SEQ ID NO: 6272622 - DNA, 13 bp, Homo sapiens
gcttaatgtcagt

SEQ ID NO: 6272623 - DNA, 23 bp, Homo sapiens
gcttaatgtttattcctgataat

SEQ ID NO: 6272624 - DNA, 16 bp, Homo sapiens
gcttaattctccttcc

SEQ ID NO: 6272625 - DNA, 12 bp, Homo sapiens
gcttaattgaaa

SEQ ID NO: 6272626 - DNA, 13 bp, Homo sapiens
gcttaattgtgaa

SEQ ID NO: 6272627 - DNA, 15 bp, Homo sapiens
gcttaatttaatgta

SEQ ID NO: 6272628 - DNA, 18 bp, Homo sapiens
gcttaatttaatgtatta

SEQ ID NO: 6272629 - DNA, 12 bp, Homo sapiens
gcttaatttcct

SEQ ID NO: 6272630 - DNA, 20 bp, Homo sapiens
gcttaatttccttctgttaa

SEQ ID NO: 6272631 - DNA, 13 bp, Homo sapiens
gcttaatttctaa

SEQ ID NO: 6272632 - DNA, 18 bp, Homo sapiens
gcttaatttctaaagata

SEQ ID NO: 6272633 - DNA, 15 bp, Homo sapiens
gcttacaaagcctta

SEQ ID NO: 6272634 - DNA, 22 bp, Homo sapiens
gcttacaaagtatatttaagga

SEQ ID NO: 6272635 - DNA, 18 bp, Homo sapiens
gcttacaatctttattat

SEQ ID NO: 6272636 - DNA, 22 bp, Homo sapiens
gcttacaatggagtctgcagtg

SEQ ID NO: 6272637 - DNA, 14 bp, Homo sapiens
gcttacaatgtgca

SEQ ID NO: 6272638 - DNA, 20 bp, Homo sapiens
gcttacaattccctgctgtc

SEQ ID NO: 6272639 - DNA, 12 bp, Homo sapiens
gcttacaatttt

SEQ ID NO: 6272640 - DNA, 14 bp, Homo sapiens
gcttacaatttttt

SEQ ID NO: 6272641 - DNA, 19 bp, Homo sapiens
gcttacaatttttttaatt

SEQ ID NO: 6272642 - DNA, 19 bp, Homo sapiens
gcttacacaagaagtgagg

SEQ ID NO: 6272643 - DNA, 13 bp, Homo sapiens
gcttacaggaagc

SEQ ID NO: 6272644 - DNA, 14 bp, Homo sapiens
gcttacaggagcca

SEQ ID NO: 6272645 - DNA, 22 bp, Homo sapiens
gcttacaggagccagcctgctt

SEQ ID NO: 6272646 - DNA, 16 bp, Homo sapiens
gcttacagtgactgtc

SEQ ID NO: 6272647 - DNA, 17 bp, Homo sapiens
gcttacagtgatgccat

SEQ ID NO: 6272648 - DNA, 20 bp, Homo sapiens
gcttacagtttattttctgt

SEQ ID NO: 6272649 - DNA, 23 bp, Homo sapiens
gcttacagtttattttctgtgta

SEQ ID NO: 6272650 - DNA, 15 bp, Homo sapiens
gcttacatagtttta

SEQ ID NO: 6272651 - DNA, 22 bp, Homo sapiens
gcttacatctggaatctgaggc

SEQ ID NO: 6272652 - DNA, 23 bp, Homo sapiens
gcttacatctggaatctgaggca

SEQ ID NO: 6272653 - DNA, 15 bp, Homo sapiens
gcttacattgaaaac

SEQ ID NO: 6272654 - DNA, 12 bp, Homo sapiens
gcttacatttga

SEQ ID NO: 6272655 - DNA, 14 bp, Homo sapiens
gcttacccaagctg

SEQ ID NO: 6272656 - DNA, 17 bp, Homo sapiens
gcttacccaagctgtgg

SEQ ID NO: 6272657 - DNA, 14 bp, Homo sapiens
gcttacctcccacc

SEQ ID NO: 6272658 - DNA, 12 bp, Homo sapiens
gcttacctgaca

SEQ ID NO: 6272659 - DNA, 19 bp, Homo sapiens
gcttaccttgactgttgat

SEQ ID NO: 6272660 - DNA, 15 bp, Homo sapiens
gcttaccttttccta

SEQ ID NO: 6272661 - DNA, 19 bp, Homo sapiens
gcttacggccctggccttg

SEQ ID NO: 6272662 - DNA, 19 bp, Homo sapiens
gcttactaatgtgccccat

SEQ ID NO: 6272663 - DNA, 12 bp, Homo sapiens
gcttactacagt

SEQ ID NO: 6272664 - DNA, 13 bp, Homo sapiens
gcttactatttct

SEQ ID NO: 6272665 - DNA, 22 bp, Homo sapiens
gcttactcctctgaccctcctt

SEQ ID NO: 6272666 - DNA, 16 bp, Homo sapiens
gcttactctctgcttc

SEQ ID NO: 6272667 - DNA, 11 bp, Homo sapiens
gcttactctgt

SEQ ID NO: 6272668 - DNA, 20 bp, Homo sapiens
gcttactttggaatacattt

SEQ ID NO: 6272669 - DNA, 19 bp, Homo sapiens
gcttagaacgttaaactat

SEQ ID NO: 6272670 - DNA, 23 bp, Homo sapiens
gcttagaacgttaaactattaga

SEQ ID NO: 6272671 - DNA, 13 bp, Homo sapiens
gcttagaatgggg

SEQ ID NO: 6272672 - DNA, 16 bp, Homo sapiens
gcttagaccctcatgc

SEQ ID NO: 6272673 - DNA, 17 bp, Homo sapiens
gcttagacctcagcctg

SEQ ID NO: 6272674 - DNA, 16 bp, Homo sapiens
gcttagagaatgttct

SEQ ID NO: 6272675 - DNA, 13 bp, Homo sapiens
gcttagagagagg

SEQ ID NO: 6272676 - DNA, 16 bp, Homo sapiens
gcttagagaggacaat

SEQ ID NO: 6272677 - DNA, 12 bp, Homo sapiens
gcttagaggcat

SEQ ID NO: 6272678 - DNA, 21 bp, Homo sapiens
gcttagaggcatgggcttgct

SEQ ID NO: 6272679 - DNA, 18 bp, Homo sapiens
gcttagagtgcccagcag

SEQ ID NO: 6272680 - DNA, 19 bp, Homo sapiens
gcttagagtgcccagcaga

SEQ ID NO: 6272681 - DNA, 20 bp, Homo sapiens
gcttagagtgcccagcagag

SEQ ID NO: 6272682 - DNA, 14 bp, Homo sapiens
gcttagagttcttc

SEQ ID NO: 6272683 - DNA, 18 bp, Homo sapiens
gcttagagttcttctttc

SEQ ID NO: 6272684 - DNA, 18 bp, Homo sapiens
gcttagcaggagaggaga

SEQ ID NO: 6272685 - DNA, 22 bp, Homo sapiens
gcttagcattttgcatgtttta

SEQ ID NO: 6272686 - DNA, 18 bp, Homo sapiens
gcttagccaagccctaag

SEQ ID NO: 6272687 - DNA, 22 bp, Homo sapiens
gcttagcctcctgacctgaggc

SEQ ID NO: 6272688 - DNA, 14 bp, Homo sapiens
gcttagcctgcctc

SEQ ID NO: 6272689 - DNA, 15 bp, Homo sapiens
gcttagcctgtgctg

SEQ ID NO: 6272690 - DNA, 13 bp, Homo sapiens
gcttagccttgtg

SEQ ID NO: 6272691 - DNA, 21 bp, Homo sapiens
gcttagccttgtgccctgccc

SEQ ID NO: 6272692 - DNA, 14 bp, Homo sapiens
gcttagcgctctgg

SEQ ID NO: 6272693 - DNA, 15 bp, Homo sapiens
gcttagcgctctgga

SEQ ID NO: 6272694 - DNA, 18 bp, Homo sapiens
gcttagcggcaagaagcc

SEQ ID NO: 6272695 - DNA, 20 bp, Homo sapiens
gcttagctgccttgagctaa

SEQ ID NO: 6272696 - DNA, 18 bp, Homo sapiens
gcttaggacttcaaaagg

SEQ ID NO: 6272697 - DNA, 21 bp, Homo sapiens
gcttaggagaagtcttctatt

SEQ ID NO: 6272698 - DNA, 22 bp, Homo sapiens
gcttaggagacagatcactcct

SEQ ID NO: 6272699 - DNA, 13 bp, Homo sapiens
gcttaggagagac

SEQ ID NO: 6272700 - DNA, 15 bp, Homo sapiens
gcttagggccctgga

SEQ ID NO: 6272701 - DNA, 14 bp, Homo sapiens
gcttagggtcctgt

SEQ ID NO: 6272702 - DNA, 24 bp, Homo sapiens
gcttaggtcctcacttctgtctcc

SEQ ID NO: 6272703 - DNA, 22 bp, Homo sapiens
gcttagtatctcatcaacaaag

SEQ ID NO: 6272704 - DNA, 15 bp, Homo sapiens
gcttagtatttctca

SEQ ID NO: 6272705 - DNA, 19 bp, Homo sapiens
gcttagtcactgagacagc

SEQ ID NO: 6272706 - DNA, 21 bp, Homo sapiens
gcttagtcactgagacagccc

SEQ ID NO: 6272707 - DNA, 16 bp, Homo sapiens
gcttagtgctatgtgt

SEQ ID NO: 6272708 - DNA, 17 bp, Homo sapiens
gcttagtgctatgtgtg

SEQ ID NO: 6272709 - DNA, 11 bp, Homo sapiens
gcttagtgtct

SEQ ID NO: 6272710 - DNA, 14 bp, Homo sapiens
gcttagtgtgaagt

SEQ ID NO: 6272711 - DNA, 13 bp, Homo sapiens
gcttagttcttga

SEQ ID NO: 6272712 - DNA, 19 bp, Homo sapiens
gcttagttcttgaattgtt

SEQ ID NO: 6272713 - DNA, 14 bp, Homo sapiens
gcttagtttgtgtg

SEQ ID NO: 6272714 - DNA, 20 bp, Homo sapiens
gcttagtttttttttaatct

SEQ ID NO: 6272715 - DNA, 19 bp, Homo sapiens
gcttataaaacagagtaat

SEQ ID NO: 6272716 - DNA, 17 bp, Homo sapiens
gcttataaacacattga

SEQ ID NO: 6272717 - DNA, 22 bp, Homo sapiens
gcttataagttaaaacaaagga

SEQ ID NO: 6272718 - DNA, 14 bp, Homo sapiens
gcttataataaaga

SEQ ID NO: 6272719 - DNA, 17 bp, Homo sapiens
gcttataataaaggact

SEQ ID NO: 6272720 - DNA, 14 bp, Homo sapiens
gcttataatgtgtg

SEQ ID NO: 6272721 - DNA, 16 bp, Homo sapiens
gcttatacccagtgag

SEQ ID NO: 6272722 - DNA, 17 bp, Homo sapiens
gcttatacgaaataatt

SEQ ID NO: 6272723 - DNA, 19 bp, Homo sapiens
gcttatacgaaataattgt

SEQ ID NO: 6272724 - DNA, 18 bp, Homo sapiens
gcttatatgtacttttat

SEQ ID NO: 6272725 - DNA, 22 bp, Homo sapiens
gcttatatgtacttttattttt

SEQ ID NO: 6272726 - DNA, 20 bp, Homo sapiens
gcttatattcaaccatggac

SEQ ID NO: 6272727 - DNA, 15 bp, Homo sapiens
gcttatattgttcac

SEQ ID NO: 6272728 - DNA, 13 bp, Homo sapiens
gcttatcaaaatc

SEQ ID NO: 6272729 - DNA, 20 bp, Homo sapiens
gcttatcaatttgtcatttt

SEQ ID NO: 6272730 - DNA, 23 bp, Homo sapiens
gcttatcagaactcctttctaag

SEQ ID NO: 6272731 - DNA, 15 bp, Homo sapiens
gcttatccataaaaa

SEQ ID NO: 6272732 - DNA, 16 bp, Homo sapiens
gcttatccataaaaaa

SEQ ID NO: 6272733 - DNA, 14 bp, Homo sapiens
gcttatcctgctag

SEQ ID NO: 6272734 - DNA, 15 bp, Homo sapiens
gcttatctcctcctc

SEQ ID NO: 6272735 - DNA, 14 bp, Homo sapiens
gcttatctgaaact

SEQ ID NO: 6272736 - DNA, 14 bp, Homo sapiens
gcttatctgcccct

SEQ ID NO: 6272737 - DNA, 20 bp, Homo sapiens
gcttatctgcccctccccca

SEQ ID NO: 6272738 - DNA, 21 bp, Homo sapiens
gcttatctttgcacatgttaa

SEQ ID NO: 6272739 - DNA, 17 bp, Homo sapiens
gcttatgaatatattta

SEQ ID NO: 6272740 - DNA, 16 bp, Homo sapiens
gcttatgaatatttat

SEQ ID NO: 6272741 - DNA, 17 bp, Homo sapiens
gcttatgagatactttg

SEQ ID NO: 6272742 - DNA, 22 bp, Homo sapiens
gcttatgagatctaatgtgaaa

SEQ ID NO: 6272743 - DNA, 18 bp, Homo sapiens
gcttatgatgggctcccc

SEQ ID NO: 6272744 - DNA, 18 bp, Homo sapiens
gcttatgcttaaattcaa

SEQ ID NO: 6272745 - DNA, 17 bp, Homo sapiens
gcttatgcttgtgtata

SEQ ID NO: 6272746 - DNA, 16 bp, Homo sapiens
gcttatgggtggcttt

SEQ ID NO: 6272747 - DNA, 22 bp, Homo sapiens
gcttatggttttaatgcaatga

SEQ ID NO: 6272748 - DNA, 12 bp, Homo sapiens
gcttatgttaac

SEQ ID NO: 6272749 - DNA, 20 bp, Homo sapiens
gcttattcatctgtttttct

SEQ ID NO: 6272750 - DNA, 15 bp, Homo sapiens
gcttattccatgact

SEQ ID NO: 6272751 - DNA, 16 bp, Homo sapiens
gcttattgatcccaca

SEQ ID NO: 6272752 - DNA, 19 bp, Homo sapiens
gcttattgatgaggtttat

SEQ ID NO: 6272753 - DNA, 18 bp, Homo sapiens
gcttattgcttagtaaaa

SEQ ID NO: 6272754 - DNA, 15 bp, Homo sapiens
gcttattggccactg

SEQ ID NO: 6272755 - DNA, 21 bp, Homo sapiens
gcttattgtgtgcgctgcctg

SEQ ID NO: 6272756 - DNA, 17 bp, Homo sapiens
gcttatttaatatgctt

SEQ ID NO: 6272757 - DNA, 14 bp, Homo sapiens
gcttatttagaaaa

SEQ ID NO: 6272758 - DNA, 22 bp, Homo sapiens
gcttatttatattcagagatgt

SEQ ID NO: 6272759 - DNA, 19 bp, Homo sapiens
gcttatttattaacaggat

SEQ ID NO: 6272760 - DNA, 20 bp, Homo sapiens
gcttatttattgtattctgg

SEQ ID NO: 6272761 - DNA, 13 bp, Homo sapiens
gcttatttccagt

SEQ ID NO: 6272762 - DNA, 11 bp, Homo sapiens
gcttatttcta

SEQ ID NO: 6272763 - DNA, 23 bp, Homo sapiens
gcttatttctatgacaaattcaa

SEQ ID NO: 6272764 - DNA, 17 bp, Homo sapiens
gcttattttaatgtgat

SEQ ID NO: 6272765 - DNA, 15 bp, Homo sapiens
gcttattttatgata

SEQ ID NO: 6272766 - DNA, 17 bp, Homo sapiens
gcttatttttaaaattt

SEQ ID NO: 6272767 - DNA, 12 bp, Homo sapiens
gcttatttttat

SEQ ID NO: 6272768 - DNA, 15 bp, Homo sapiens
gcttatttttataat

SEQ ID NO: 6272769 - DNA, 15 bp, Homo sapiens
gcttatttttatgtg

SEQ ID NO: 6272770 - DNA, 16 bp, Homo sapiens
gcttatttttctgtga

SEQ ID NO: 6272771 - DNA, 19 bp, Homo sapiens
gcttattttttaaaatatt

SEQ ID NO: 6272772 - DNA, 22 bp, Homo sapiens
gcttatttttttaagaaaaaag

SEQ ID NO: 6272773 - DNA, 16 bp, Homo sapiens
gcttcaaaaagccaca

SEQ ID NO: 6272774 - DNA, 18 bp, Homo sapiens
gcttcaaaaagccacagc

SEQ ID NO: 6272775 - DNA, 21 bp, Homo sapiens
gccacaggactgagccctctc

SEQ ID NO: 6272776 - DNA, 22 bp, Homo sapiens
gccacaggactgagccctctca

SEQ ID NO: 6272777 - DNA, 13 bp, Homo sapiens
gccacaggagaca

SEQ ID NO: 6272778 - DNA, 16 bp, Homo sapiens
gccacaggcaggggtg

SEQ ID NO: 6272779 - DNA, 21 bp, Homo sapiens
gccacaggcaggtcacagaaa

SEQ ID NO: 6272780 - DNA, 15 bp, Homo sapiens
gccacaggccaaatc

SEQ ID NO: 6272781 - DNA, 23 bp, Homo sapiens
gccacaggccactgcaaaccctg

SEQ ID NO: 6272782 - DNA, 22 bp, Homo sapiens
gccacaggcctgagatttcatc

SEQ ID NO: 6272783 - DNA, 16 bp, Homo sapiens
gccacaggcctggcct

SEQ ID NO: 6272784 - DNA, 17 bp, Homo sapiens
gccacaggcctggcctc

SEQ ID NO: 6272785 - DNA, 18 bp, Homo sapiens
gccacaggcctggcctca

SEQ ID NO: 6272786 - DNA, 20 bp, Homo sapiens
gccacagggtctgcctccag

SEQ ID NO: 6272787 - DNA, 18 bp, Homo sapiens
gccacagtatggatgggt

SEQ ID NO: 6272788 - DNA, 14 bp, Homo sapiens
gccacagtctcccc

SEQ ID NO: 6272789 - DNA, 11 bp, Homo sapiens
gccacagtggg

SEQ ID NO: 6272790 - DNA, 13 bp, Homo sapiens
gccacagtggggc

SEQ ID NO: 6272791 - DNA, 16 bp, Homo sapiens
gccacagtggggccca

SEQ ID NO: 6272792 - DNA, 21 bp, Homo sapiens
gccacagtggggcccatggcc

SEQ ID NO: 6272793 - DNA, 16 bp, Homo sapiens
gccacagtgtcactgg

SEQ ID NO: 6272794 - DNA, 16 bp, Homo sapiens
gccacatacaggtgct

SEQ ID NO: 6272795 - DNA, 17 bp, Homo sapiens
gccacatacttgcagct

SEQ ID NO: 6272796 - DNA, 15 bp, Homo sapiens
gccacatcaaacctt

SEQ ID NO: 6272797 - DNA, 17 bp, Homo sapiens
gccacatccccaagccc

SEQ ID NO: 6272798 - DNA, 14 bp, Homo sapiens
gccacatcccccaa

SEQ ID NO: 6272799 - DNA, 17 bp, Homo sapiens
gccacatccccgctggc

SEQ ID NO: 6272800 - DNA, 20 bp, Homo sapiens
gccacatccccgctggctgg

SEQ ID NO: 6272801 - DNA, 16 bp, Homo sapiens
gccacatcttaaactt

SEQ ID NO: 6272802 - DNA, 13 bp, Homo sapiens
gccacatcttgaa

SEQ ID NO: 6272803 - DNA, 23 bp, Homo sapiens
gccacatcttgatctgctcagcc

SEQ ID NO: 6272804 - DNA, 16 bp, Homo sapiens
gccacatgagtcccag

SEQ ID NO: 6272805 - DNA, 18 bp, Homo sapiens
gccacatgagtcccagtg

SEQ ID NO: 6272806 - DNA, 17 bp, Homo sapiens
gccacatgccgcgtccc

SEQ ID NO: 6272807 - DNA, 15 bp, Homo sapiens
gccacatggagcccc

SEQ ID NO: 6272808 - DNA, 18 bp, Homo sapiens
gccacatggccgctgccc

SEQ ID NO: 6272809 - DNA, 19 bp, Homo sapiens
gccacatggccgctgccca

SEQ ID NO: 6272810 - DNA, 22 bp, Homo sapiens
gccacatggccgctgcccacgt

SEQ ID NO: 6272811 - DNA, 21 bp, Homo sapiens
gccacatgggaggaaggccca

SEQ ID NO: 6272812 - DNA, 20 bp, Homo sapiens
gccacatggggctgggcagc

SEQ ID NO: 6272813 - DNA, 18 bp, Homo sapiens
gccacatggtgtctccca

SEQ ID NO: 6272814 - DNA, 22 bp, Homo sapiens
gccacatggtgtctcccaacat

SEQ ID NO: 6272815 - DNA, 16 bp, Homo sapiens
gccacattcctgatgc

SEQ ID NO: 6272816 - DNA, 18 bp, Homo sapiens
gccacattgacagtggtg

SEQ ID NO: 6272817 - DNA, 17 bp, Homo sapiens
gccacattgatttttct

SEQ ID NO: 6272818 - DNA, 18 bp, Homo sapiens
gccacattgctggctgcc

SEQ ID NO: 6272819 - DNA, 12 bp, Homo sapiens
gccacatttaat

SEQ ID NO: 6272820 - DNA, 14 bp, Homo sapiens
gccacatttacata

SEQ ID NO: 6272821 - DNA, 16 bp, Homo sapiens
gccacatttagtcctg

SEQ ID NO: 6272822 - DNA, 22 bp, Homo sapiens
gccacatttagtcctgtactgt

SEQ ID NO: 6272823 - DNA, 11 bp, Homo sapiens
gccacatttct

SEQ ID NO: 6272824 - DNA, 18 bp, Homo sapiens
gccacatttctgatcaga

SEQ ID NO: 6272825 - DNA, 20 bp, Homo sapiens
gccacatttctgatcagagg

SEQ ID NO: 6272826 - DNA, 20 bp, Homo sapiens
gccaccaaaagtgctcccca

SEQ ID NO: 6272827 - DNA, 18 bp, Homo sapiens
gccaccaaaggagacata

SEQ ID NO: 6272828 - DNA, 20 bp, Homo sapiens
gccaccaacatactcccatc

SEQ ID NO: 6272829 - DNA, 21 bp, Homo sapiens
gccaccaacatactcccatct

SEQ ID NO: 6272830 - DNA, 18 bp, Homo sapiens
gccaccaactggccctct

SEQ ID NO: 6272831 - DNA, 15 bp, Homo sapiens
gccaccaagctcaca

SEQ ID NO: 6272832 - DNA, 17 bp, Homo sapiens
gccaccaagctcacacc

SEQ ID NO: 6272833 - DNA, 14 bp, Homo sapiens
gccaccaaggctgc

SEQ ID NO: 6272834 - DNA, 18 bp, Homo sapiens
gccaccaataaaaatcct

SEQ ID NO: 6272835 - DNA, 12 bp, Homo sapiens
gccaccacacac

SEQ ID NO: 6272836 - DNA, 15 bp, Homo sapiens
gccaccacacacaca

SEQ ID NO: 6272837 - DNA, 14 bp, Homo sapiens
gccaccacacactg

SEQ ID NO: 6272838 - DNA, 18 bp, Homo sapiens
gccaccacacccagcctc

SEQ ID NO: 6272839 - DNA, 14 bp, Homo sapiens
gccaccacacctgg

SEQ ID NO: 6272840 - DNA, 16 bp, Homo sapiens
gccaccacactcagct

SEQ ID NO: 6272841 - DNA, 21 bp, Homo sapiens
gccaccaccactctcactcca

SEQ ID NO: 6272842 - DNA, 14 bp, Homo sapiens
gccaccaccactgt

SEQ ID NO: 6272843 - DNA, 17 bp, Homo sapiens
gccaccaccactgtccc

SEQ ID NO: 6272844 - DNA, 19 bp, Homo sapiens
gccaccaccagatgagaag

SEQ ID NO: 6272845 - DNA, 15 bp, Homo sapiens
gccaccacccaacct

SEQ ID NO: 6272846 - DNA, 14 bp, Homo sapiens
gccaccacccaccc

SEQ ID NO: 6272847 - DNA, 17 bp, Homo sapiens
gccaccaccctcaggtg

SEQ ID NO: 6272848 - DNA, 21 bp, Homo sapiens
gccaccaccctcaggtgcctc

SEQ ID NO: 6272849 - DNA, 22 bp, Homo sapiens
gccaccaccctcaggtgcctcc

SEQ ID NO: 6272850 - DNA, 14 bp, Homo sapiens
gccaccaccctgcc

SEQ ID NO: 6272851 - DNA, 16 bp, Homo sapiens
gccaccaccctgtctt

SEQ ID NO: 6272852 - DNA, 17 bp, Homo sapiens
gccaccaccctgtcttc

SEQ ID NO: 6272853 - DNA, 18 bp, Homo sapiens
gccaccaccctgtcttcc

SEQ ID NO: 6272854 - DNA, 23 bp, Homo sapiens
gccaccaccctgtcttcctctgc

SEQ ID NO: 6272855 - DNA, 24 bp, Homo sapiens
gccaccaccggggcactggctgct

SEQ ID NO: 6272856 - DNA, 12 bp, Homo sapiens
gccaccacctct

SEQ ID NO: 6272857 - DNA, 13 bp, Homo sapiens
gccaccacctgga

SEQ ID NO: 6272858 - DNA, 18 bp, Homo sapiens
gccaccacctttggctgg

SEQ ID NO: 6272859 - DNA, 13 bp, Homo sapiens
gccaccacgcccg

SEQ ID NO: 6272860 - DNA, 16 bp, Homo sapiens
gccaccacgtccagct

SEQ ID NO: 6272861 - DNA, 15 bp, Homo sapiens
gccaccacgtctgcc

SEQ ID NO: 6272862 - DNA, 20 bp, Homo sapiens
gccaccacgtctgccaggcc

SEQ ID NO: 6272863 - DNA, 22 bp, Homo sapiens
gccaccacgtctgccaggccca

SEQ ID NO: 6272864 - DNA, 12 bp, Homo sapiens
gccaccagacca

SEQ ID NO: 6272865 - DNA, 21 bp, Homo sapiens
gccaccagagaccgtcctcac

SEQ ID NO: 6272866 - DNA, 22 bp, Homo sapiens
gccaccagagaccgtcctcacc

SEQ ID NO: 6272867 - DNA, 14 bp, Homo sapiens
gccaccagatgctg

SEQ ID NO: 6272868 - DNA, 21 bp, Homo sapiens
gccaccagatgtgacagtgtt

SEQ ID NO: 6272869 - DNA, 18 bp, Homo sapiens
gccaccagcaatgccctg

SEQ ID NO: 6272870 - DNA, 21 bp, Homo sapiens
gccaccagcaatgccctgcct

SEQ ID NO: 6272871 - DNA, 12 bp, Homo sapiens
gccaccagcccc

SEQ ID NO: 6272872 - DNA, 13 bp, Homo sapiens
gccaccagccccc

SEQ ID NO: 6272873 - DNA, 22 bp, Homo sapiens
gccaccagcccccgccccagag

SEQ ID NO: 6272874 - DNA, 13 bp, Homo sapiens
gccaccagcccct

SEQ ID NO: 6272875 - DNA, 23 bp, Homo sapiens
gccaccagcccctccccagactc

SEQ ID NO: 6272876 - DNA, 20 bp, Homo sapiens
gccaccagcccgcaactctc

SEQ ID NO: 6272877 - DNA, 15 bp, Homo sapiens
gccaccagcgccccc

SEQ ID NO: 6272878 - DNA, 16 bp, Homo sapiens
gccaccagctccactg

SEQ ID NO: 6272879 - DNA, 17 bp, Homo sapiens
gccaccagctgctggat

SEQ ID NO: 6272880 - DNA, 18 bp, Homo sapiens
gccaccaggccacctccc

SEQ ID NO: 6272881 - DNA, 20 bp, Homo sapiens
gccaccaggccacctcccca

SEQ ID NO: 6272882 - DNA, 17 bp, Homo sapiens
gccaccaggctggcgca

SEQ ID NO: 6272883 - DNA, 18 bp, Homo sapiens
gccaccaggctggcgcag

SEQ ID NO: 6272884 - DNA, 19 bp, Homo sapiens
gccaccaggctggcgcagc

SEQ ID NO: 6272885 - DNA, 20 bp, Homo sapiens
gccaccaggctggcgcagcc

SEQ ID NO: 6272886 - DNA, 18 bp, Homo sapiens
gccaccagggagcttcct

SEQ ID NO: 6272887 - DNA, 14 bp, Homo sapiens
gccaccagggatca

SEQ ID NO: 6272888 - DNA, 21 bp, Homo sapiens
gccaccagggatcacagacca

SEQ ID NO: 6272889 - DNA, 19 bp, Homo sapiens
gccaccagtggacctagcc

SEQ ID NO: 6272890 - DNA, 22 bp, Homo sapiens
gccaccagtggacctagcctgg

SEQ ID NO: 6272891 - DNA, 23 bp, Homo sapiens
gccaccagtggacctagcctgga

SEQ ID NO: 6272892 - DNA, 14 bp, Homo sapiens
gccaccagtgtcct

SEQ ID NO: 6272893 - DNA, 23 bp, Homo sapiens
gccaccatattcagtgctgtggc

SEQ ID NO: 6272894 - DNA, 16 bp, Homo sapiens
gccaccatccaataaa

SEQ ID NO: 6272895 - DNA, 23 bp, Homo sapiens
gccaccatccctgatggcagaac

SEQ ID NO: 6272896 - DNA, 14 bp, Homo sapiens
gccaccatcctgct

SEQ ID NO: 6272897 - DNA, 20 bp, Homo sapiens
gccaccatgcactcaataaa

SEQ ID NO: 6272898 - DNA, 17 bp, Homo sapiens
gccaccatgcctaattt

SEQ ID NO: 6272899 - DNA, 14 bp, Homo sapiens
gccaccatgcttgc

SEQ ID NO: 6272900 - DNA, 21 bp, Homo sapiens
gccaccatgcttgcctgaagc

SEQ ID NO: 6272901 - DNA, 22 bp, Homo sapiens
gccaccatgcttgcctgaagct

SEQ ID NO: 6272902 - DNA, 14 bp, Homo sapiens
gccaccatggccag

SEQ ID NO: 6272903 - DNA, 14 bp, Homo sapiens
gccaccattcctgg

SEQ ID NO: 6272904 - DNA, 16 bp, Homo sapiens
gccacccaccagggct

SEQ ID NO: 6272905 - DNA, 22 bp, Homo sapiens
gccacccaccccaagctgctgc

SEQ ID NO: 6272906 - DNA, 15 bp, Homo sapiens
gccacccacccttct

SEQ ID NO: 6272907 - DNA, 20 bp, Homo sapiens
gccacccacccttctcccct

SEQ ID NO: 6272908 - DNA, 17 bp, Homo sapiens
gccacccacctccctgc

SEQ ID NO: 6272909 - DNA, 18 bp, Homo sapiens
gccacccacctccctgcc

SEQ ID NO: 6272910 - DNA, 21 bp, Homo sapiens
gccacccacctccctgcctcc

SEQ ID NO: 6272911 - DNA, 12 bp, Homo sapiens
gccacccactca

SEQ ID NO: 6272912 - DNA, 18 bp, Homo sapiens
gccacccactcaggattg

SEQ ID NO: 6272913 - DNA, 16 bp, Homo sapiens
gccacccagcaacaca

SEQ ID NO: 6272914 - DNA, 12 bp, Homo sapiens
gccacccaggat

SEQ ID NO: 6272915 - DNA, 19 bp, Homo sapiens
gccacccagtagcccagag

SEQ ID NO: 6272916 - DNA, 19 bp, Homo sapiens
gccacccatcgtccacccc

SEQ ID NO: 6272917 - DNA, 21 bp, Homo sapiens
gccacccatgcagctgctccc

SEQ ID NO: 6272918 - DNA, 16 bp, Homo sapiens
gccacccattcttccc

SEQ ID NO: 6272919 - DNA, 17 bp, Homo sapiens
gccacccattcttcccg

SEQ ID NO: 6272920 - DNA, 18 bp, Homo sapiens
gccaccccaaaccccagc

SEQ ID NO: 6272921 - DNA, 20 bp, Homo sapiens
gccaccccaccctccctgga

SEQ ID NO: 6272922 - DNA, 21 bp, Homo sapiens
gccaccccactgagagctgct

SEQ ID NO: 6272923 - DNA, 14 bp, Homo sapiens
gccaccccatgagc

SEQ ID NO: 6272924 - DNA, 15 bp, Homo sapiens
gccaccccatgagct

SEQ ID NO: 6272925 - DNA, 19 bp, Homo sapiens
gccaccccatgtgccttta

SEQ ID NO: 6272926 - DNA, 17 bp, Homo sapiens
gccacccccagccctgg

SEQ ID NO: 6272927 - DNA, 20 bp, Homo sapiens
gccacccccccaccccaggc

SEQ ID NO: 6272928 - DNA, 15 bp, Homo sapiens
gccacccccgccccc

SEQ ID NO: 6272929 - DNA, 23 bp, Homo sapiens
gccacccccgcccccaccgggct

SEQ ID NO: 6272930 - DNA, 14 bp, Homo sapiens
gccacccccttccc

SEQ ID NO: 6272931 - DNA, 15 bp, Homo sapiens
gccacccccttccct

SEQ ID NO: 6272932 - DNA, 17 bp, Homo sapiens
gccacccccttccctgg

SEQ ID NO: 6272933 - DNA, 23 bp, Homo sapiens
gccaccccgagggctgagcctgg

SEQ ID NO: 6272934 - DNA, 19 bp, Homo sapiens
gccaccccgggctctctgc

SEQ ID NO: 6272935 - DNA, 21 bp, Homo sapiens
gccaccccgggctctctgctg

SEQ ID NO: 6272936 - DNA, 18 bp, Homo sapiens
gccacccctaaactccag

SEQ ID NO: 6272937 - DNA, 20 bp, Homo sapiens
gccacccctaaactccaggg

SEQ ID NO: 6272938 - DNA, 14 bp, Homo sapiens
gccacccctcagat

SEQ ID NO: 6272939 - DNA, 16 bp, Homo sapiens
gccacccctccttcct

SEQ ID NO: 6272940 - DNA, 15 bp, Homo sapiens
gccacccctgccact

SEQ ID NO: 6272941 - DNA, 17 bp, Homo sapiens
gccacccctgccactca

SEQ ID NO: 6272942 - DNA, 13 bp, Homo sapiens
gccaccccttcct

SEQ ID NO: 6272943 - DNA, 21 bp, Homo sapiens
gccaccccttcctcagcctgg

SEQ ID NO: 6272944 - DNA, 16 bp, Homo sapiens
gccaccccttgctctc

SEQ ID NO: 6272945 - DNA, 18 bp, Homo sapiens
gccaccccttgctctctg

SEQ ID NO: 6272946 - DNA, 21 bp, Homo sapiens
gccaccccttgctctctgttc

SEQ ID NO: 6272947 - DNA, 17 bp, Homo sapiens
gccaccccttggcactg

SEQ ID NO: 6272948 - DNA, 22 bp, Homo sapiens
gccacccgccccgcgcacccca

SEQ ID NO: 6272949 - DNA, 22 bp, Homo sapiens
gccacccggatctccaggccca

SEQ ID NO: 6272950 - DNA, 15 bp, Homo sapiens
gccacccgggcaagg

SEQ ID NO: 6272951 - DNA, 22 bp, Homo sapiens
gccacccgtggggtgctgccct

SEQ ID NO: 6272952 - DNA, 19 bp, Homo sapiens
gccaccctaactgagctgc

SEQ ID NO: 6272953 - DNA, 19 bp, Homo sapiens
gcttcaaaaagccacagca

SEQ ID NO: 6272954 - DNA, 20 bp, Homo sapiens
gcttcaaaaagccacagcag

SEQ ID NO: 6272955 - DNA, 21 bp, Homo sapiens
gcttcaaactaacacattttt

SEQ ID NO: 6272956 - DNA, 19 bp, Homo sapiens
gcttcaaattatagaaaca

SEQ ID NO: 6272957 - DNA, 21 bp, Homo sapiens
gcttcaacaactttgtgcttt

SEQ ID NO: 6272958 - DNA, 14 bp, Homo sapiens
gcttcaacagccaa

SEQ ID NO: 6272959 - DNA, 16 bp, Homo sapiens
gcttcaacagccaagc

SEQ ID NO: 6272960 - DNA, 18 bp, Homo sapiens
gcttcaaccctcagcctt

SEQ ID NO: 6272961 - DNA, 19 bp, Homo sapiens
gcttcaaggatcctgagcc

SEQ ID NO: 6272962 - DNA, 19 bp, Homo sapiens
gcttcaaggatggagatgg

SEQ ID NO: 6272963 - DNA, 22 bp, Homo sapiens
gcttcaagtctgtgcctggagc

SEQ ID NO: 6272964 - DNA, 13 bp, Homo sapiens
gcttcaagtgcct

SEQ ID NO: 6272965 - DNA, 21 bp, Homo sapiens
gcttcaagtgttgctcttgga

SEQ ID NO: 6272966 - DNA, 19 bp, Homo sapiens
gcttcaagttgtaaaaatg

SEQ ID NO: 6272967 - DNA, 22 bp, Homo sapiens
gcttcaatacccaaatcctctc

SEQ ID NO: 6272968 - DNA, 16 bp, Homo sapiens
gcttcaatataagaag

SEQ ID NO: 6272969 - DNA, 18 bp, Homo sapiens
gcttcaatataagaagca

SEQ ID NO: 6272970 - DNA, 19 bp, Homo sapiens
gcttcaatataagaagcaa

SEQ ID NO: 6272971 - DNA, 13 bp, Homo sapiens
gcttcaatcactg

SEQ ID NO: 6272972 - DNA, 22 bp, Homo sapiens
gcttcaatcactgtaacctgat

SEQ ID NO: 6272973 - DNA, 22 bp, Homo sapiens
gcttcaatcggcttgtgggtga

SEQ ID NO: 6272974 - DNA, 15 bp, Homo sapiens
gcttcaatttatacc

SEQ ID NO: 6272975 - DNA, 20 bp, Homo sapiens
gcttcacaaaatgcacttct

SEQ ID NO: 6272976 - DNA, 10 bp, Homo sapiens
gcttcacaca

SEQ ID NO: 6272977 - DNA, 21 bp, Homo sapiens
gcttcacacccctcagcgctc

SEQ ID NO: 6272978 - DNA, 18 bp, Homo sapiens
gcttcacagtctggtgct

SEQ ID NO: 6272979 - DNA, 13 bp, Homo sapiens
gcttcacagtgat

SEQ ID NO: 6272980 - DNA, 16 bp, Homo sapiens
gcttcacatagcatgt

SEQ ID NO: 6272981 - DNA, 12 bp, Homo sapiens
gcttcacatttg

SEQ ID NO: 6272982 - DNA, 14 bp, Homo sapiens
gcttcaccacttgt

SEQ ID NO: 6272983 - DNA, 15 bp, Homo sapiens
gcttcaccacttgtc

SEQ ID NO: 6272984 - DNA, 15 bp, Homo sapiens
gcttcaccagagcat

SEQ ID NO: 6272985 - DNA, 17 bp, Homo sapiens
gcttcaccagtctgtct

SEQ ID NO: 6272986 - DNA, 21 bp, Homo sapiens
gcttcaccagtctgtctactg

SEQ ID NO: 6272987 - DNA, 20 bp, Homo sapiens
gcttcaccatggccttatga

SEQ ID NO: 6272988 - DNA, 22 bp, Homo sapiens
gcttcacccatgaaattaataa

SEQ ID NO: 6272989 - DNA, 15 bp, Homo sapiens
gcttcaccctgtcaa

SEQ ID NO: 6272990 - DNA, 16 bp, Homo sapiens
gcttcaccgcattcca

SEQ ID NO: 6272991 - DNA, 19 bp, Homo sapiens
gcttcaccgcattccaggg

SEQ ID NO: 6272992 - DNA, 19 bp, Homo sapiens
gcttcaccttggagcctga

SEQ ID NO: 6272993 - DNA, 18 bp, Homo sapiens
gcttcacggaagagcctt

SEQ ID NO: 6272994 - DNA, 20 bp, Homo sapiens
gcttcacggactctttgctg

SEQ ID NO: 6272995 - DNA, 21 bp, Homo sapiens
gcttcacggactctttgctgt

SEQ ID NO: 6272996 - DNA, 15 bp, Homo sapiens
gcttcactagggaat

SEQ ID NO: 6272997 - DNA, 23 bp, Homo sapiens
gcttcactcatgcaaactgcttt

SEQ ID NO: 6272998 - DNA, 17 bp, Homo sapiens
gcttcactcctgctgta

SEQ ID NO: 6272999 - DNA, 18 bp, Homo sapiens
gcttcactctatccaaag

SEQ ID NO: 6273000 - DNA, 13 bp, Homo sapiens
gcttcactgacca

SEQ ID NO: 6273001 - DNA, 20 bp, Homo sapiens
gcttcactgaccagcggctg

SEQ ID NO: 6273002 - DNA, 15 bp, Homo sapiens
gcttcactgccccct

SEQ ID NO: 6273003 - DNA, 21 bp, Homo sapiens
gcttcacttctgactcttccc

SEQ ID NO: 6273004 - DNA, 15 bp, Homo sapiens
gcttcagagcctagc

SEQ ID NO: 6273005 - DNA, 24 bp, Homo sapiens
gcttcagagcctagccacctccca

SEQ ID NO: 6273006 - DNA, 15 bp, Homo sapiens
gcttcagaggcctgg

SEQ ID NO: 6273007 - DNA, 18 bp, Homo sapiens
gcttcagagtttgtgtgt

SEQ ID NO: 6273008 - DNA, 17 bp, Homo sapiens
gcttcagcatatttata

SEQ ID NO: 6273009 - DNA, 19 bp, Homo sapiens
gcttcagccaggagctggg

SEQ ID NO: 6273010 - DNA, 14 bp, Homo sapiens
gcttcagccaggca

SEQ ID NO: 6273011 - DNA, 13 bp, Homo sapiens
gcttcagccaggt

SEQ ID NO: 6273012 - DNA, 16 bp, Homo sapiens
gcttcagccaggtctg

SEQ ID NO: 6273013 - DNA, 19 bp, Homo sapiens
gcttcagcctcccacagtg

SEQ ID NO: 6273014 - DNA, 12 bp, Homo sapiens
gcttcagctcca

SEQ ID NO: 6273015 - DNA, 13 bp, Homo sapiens
gcttcagctccag

SEQ ID NO: 6273016 - DNA, 15 bp, Homo sapiens
gcttcagctccagcc

SEQ ID NO: 6273017 - DNA, 13 bp, Homo sapiens
gcttcaggaacct

SEQ ID NO: 6273018 - DNA, 14 bp, Homo sapiens
gcttcaggaacctc

SEQ ID NO: 6273019 - DNA, 13 bp, Homo sapiens
gcttcaggcacca

SEQ ID NO: 6273020 - DNA, 16 bp, Homo sapiens
gcttcaggcaccagca

SEQ ID NO: 6273021 - DNA, 17 bp, Homo sapiens
gcttcaggccgagccag

SEQ ID NO: 6273022 - DNA, 16 bp, Homo sapiens
gcttcagggagctcgc

SEQ ID NO: 6273023 - DNA, 23 bp, Homo sapiens
gcttcagggagggttagcctgca

SEQ ID NO: 6273024 - DNA, 15 bp, Homo sapiens
gcttcagggctgggc

SEQ ID NO: 6273025 - DNA, 17 bp, Homo sapiens
gcttcagggctgggcag

SEQ ID NO: 6273026 - DNA, 20 bp, Homo sapiens
gcttcagggtatcccagacc

SEQ ID NO: 6273027 - DNA, 13 bp, Homo sapiens
gcttcaggtgagc

SEQ ID NO: 6273028 - DNA, 17 bp, Homo sapiens
gcttcaggttatcgaaa

SEQ ID NO: 6273029 - DNA, 23 bp, Homo sapiens
gcttcaggttatcgaaataacaa

SEQ ID NO: 6273030 - DNA, 14 bp, Homo sapiens
gcttcagtctctgc

SEQ ID NO: 6273031 - DNA, 14 bp, Homo sapiens
gcttcagtgaacat

SEQ ID NO: 6273032 - DNA, 17 bp, Homo sapiens
gcttcagtggcagctgc

SEQ ID NO: 6273033 - DNA, 15 bp, Homo sapiens
gcttcagttgttttc

SEQ ID NO: 6273034 - DNA, 14 bp, Homo sapiens
gcttcataaatgaa

SEQ ID NO: 6273035 - DNA, 10 bp, Homo sapiens
gcttcataca

SEQ ID NO: 6273036 - DNA, 11 bp, Homo sapiens
gcttcatacac

SEQ ID NO: 6273037 - DNA, 15 bp, Homo sapiens
gcttcataggcagag

SEQ ID NO: 6273038 - DNA, 17 bp, Homo sapiens
gcttcatagtattggag

SEQ ID NO: 6273039 - DNA, 13 bp, Homo sapiens
gcttcatatctaa

SEQ ID NO: 6273040 - DNA, 16 bp, Homo sapiens
gcttcatatctaattt

SEQ ID NO: 6273041 - DNA, 13 bp, Homo sapiens
gcttcatcaattt

SEQ ID NO: 6273042 - DNA, 22 bp, Homo sapiens
gcttcatcaatttttatacata

SEQ ID NO: 6273043 - DNA, 14 bp, Homo sapiens
gcttcatccacagc

SEQ ID NO: 6273044 - DNA, 15 bp, Homo sapiens
gcttcatcctcctca

SEQ ID NO: 6273045 - DNA, 16 bp, Homo sapiens
gcttcatctccttttg

SEQ ID NO: 6273046 - DNA, 15 bp, Homo sapiens
gcttcatctctttag

SEQ ID NO: 6273047 - DNA, 14 bp, Homo sapiens
gcttcatctggcaa

SEQ ID NO: 6273048 - DNA, 18 bp, Homo sapiens
gcttcatctgtcaagtgg

SEQ ID NO: 6273049 - DNA, 18 bp, Homo sapiens
gcttcatctgtgggatgc

SEQ ID NO: 6273050 - DNA, 21 bp, Homo sapiens
gcttcatctgtgggatgctga

SEQ ID NO: 6273051 - DNA, 18 bp, Homo sapiens
gcttcatgaaaatcctac

SEQ ID NO: 6273052 - DNA, 16 bp, Homo sapiens
gcttcatgacattcct

SEQ ID NO: 6273053 - DNA, 23 bp, Homo sapiens
gcttcatgcctcagtttccccat

SEQ ID NO: 6273054 - DNA, 16 bp, Homo sapiens
gcttcatgcctttgta

SEQ ID NO: 6273055 - DNA, 17 bp, Homo sapiens
gcttcatgcctttgtaa

SEQ ID NO: 6273056 - DNA, 15 bp, Homo sapiens
gcttcatgtgtccca

SEQ ID NO: 6273057 - DNA, 17 bp, Homo sapiens
gcttcatgtgtcccaga

SEQ ID NO: 6273058 - DNA, 22 bp, Homo sapiens
gcttcatgttcccaaaatcacc

SEQ ID NO: 6273059 - DNA, 15 bp, Homo sapiens
gcttcattaaaacaa

SEQ ID NO: 6273060 - DNA, 22 bp, Homo sapiens
gcttcattaaaacaagagacca

SEQ ID NO: 6273061 - DNA, 15 bp, Homo sapiens
gcttcattagagcag

SEQ ID NO: 6273062 - DNA, 20 bp, Homo sapiens
gcttcattccaaatgctttc

SEQ ID NO: 6273063 - DNA, 22 bp, Homo sapiens
gcttcattccaaatgctttcag

SEQ ID NO: 6273064 - DNA, 10 bp, Homo sapiens
gcttcattgt

SEQ ID NO: 6273065 - DNA, 16 bp, Homo sapiens
gcttcattgtttgatt

SEQ ID NO: 6273066 - DNA, 14 bp, Homo sapiens
gcttcatttcaatc

SEQ ID NO: 6273067 - DNA, 18 bp, Homo sapiens
gcttcattttatttttga

SEQ ID NO: 6273068 - DNA, 23 bp, Homo sapiens
gcttcattttatttttgacgtca

SEQ ID NO: 6273069 - DNA, 14 bp, Homo sapiens
gcttcattttggag

SEQ ID NO: 6273070 - DNA, 15 bp, Homo sapiens
gcttccaaatattgt

SEQ ID NO: 6273071 - DNA, 20 bp, Homo sapiens
gcttccaaatttgaatggat

SEQ ID NO: 6273072 - DNA, 12 bp, Homo sapiens
gcttccaagccc

SEQ ID NO: 6273073 - DNA, 16 bp, Homo sapiens
gcttccaaggtggtct

SEQ ID NO: 6273074 - DNA, 18 bp, Homo sapiens
gcttccaatcttgctttg

SEQ ID NO: 6273075 - DNA, 22 bp, Homo sapiens
gcttccacagtgtgaagacact

SEQ ID NO: 6273076 - DNA, 12 bp, Homo sapiens
gcttccacctca

SEQ ID NO: 6273077 - DNA, 16 bp, Homo sapiens
gcttccacctcacccc

SEQ ID NO: 6273078 - DNA, 14 bp, Homo sapiens
gcttccacctcatg

SEQ ID NO: 6273079 - DNA, 20 bp, Homo sapiens
gcttccactaccaaaagaca

SEQ ID NO: 6273080 - DNA, 14 bp, Homo sapiens
gcttccactcaggg

SEQ ID NO: 6273081 - DNA, 13 bp, Homo sapiens
gcttccactgtca

SEQ ID NO: 6273082 - DNA, 14 bp, Homo sapiens
gcttccagaccacc

SEQ ID NO: 6273083 - DNA, 15 bp, Homo sapiens
gcttccagaccacct

SEQ ID NO: 6273084 - DNA, 18 bp, Homo sapiens
gcttccagaccacctgcc

SEQ ID NO: 6273085 - DNA, 19 bp, Homo sapiens
gcttccagagagtcctctg

SEQ ID NO: 6273086 - DNA, 21 bp, Homo sapiens
gcttccagagagtcctctgga

SEQ ID NO: 6273087 - DNA, 15 bp, Homo sapiens
gcttccagagctctg

SEQ ID NO: 6273088 - DNA, 16 bp, Homo sapiens
gcttccagagctctga

SEQ ID NO: 6273089 - DNA, 19 bp, Homo sapiens
gcttccagagctctgaccc

SEQ ID NO: 6273090 - DNA, 12 bp, Homo sapiens
gcttccagcagg

SEQ ID NO: 6273091 - DNA, 15 bp, Homo sapiens
gcttccagcaggagg

SEQ ID NO: 6273092 - DNA, 20 bp, Homo sapiens
gcttccagcgggccctctgc

SEQ ID NO: 6273093 - DNA, 21 bp, Homo sapiens
gcttccagcgggccctctgcc

SEQ ID NO: 6273094 - DNA, 15 bp, Homo sapiens
gcttccagctcagtc

SEQ ID NO: 6273095 - DNA, 17 bp, Homo sapiens
gcttccagctcagtccc

SEQ ID NO: 6273096 - DNA, 23 bp, Homo sapiens
gcttccagctcagtcccacagcc

SEQ ID NO: 6273097 - DNA, 17 bp, Homo sapiens
gcttccagcttcaggca

SEQ ID NO: 6273098 - DNA, 19 bp, Homo sapiens
gcttccagcttcaggcacc

SEQ ID NO: 6273099 - DNA, 21 bp, Homo sapiens
gcttccaggctcttcctggac

SEQ ID NO: 6273100 - DNA, 19 bp, Homo sapiens
gcttccaggtatctccagg

SEQ ID NO: 6273101 - DNA, 20 bp, Homo sapiens
gcttccagtgaggctctgcc

SEQ ID NO: 6273102 - DNA, 21 bp, Homo sapiens
gcttccagtgaggctctgccc

SEQ ID NO: 6273103 - DNA, 18 bp, Homo sapiens
gcttccatagctgctgcc

SEQ ID NO: 6273104 - DNA, 23 bp, Homo sapiens
gcttccatcccaaccagtgccaa

SEQ ID NO: 6273105 - DNA, 21 bp, Homo sapiens
gcttccatggtggtttcagaa

SEQ ID NO: 6273106 - DNA, 23 bp, Homo sapiens
gcttccattattgagttcctcct

SEQ ID NO: 6273107 - DNA, 19 bp, Homo sapiens
gcttccattttaattttaa

SEQ ID NO: 6273108 - DNA, 18 bp, Homo sapiens
gcttcccaaactcccagg

SEQ ID NO: 6273109 - DNA, 22 bp, Homo sapiens
gcttcccaaactcccaggacct

SEQ ID NO: 6273110 - DNA, 15 bp, Homo sapiens
gcttcccacacctgc

SEQ ID NO: 6273111 - DNA, 22 bp, Homo sapiens
gcttcccacacctgcctgcgtt

SEQ ID NO: 6273112 - DNA, 13 bp, Homo sapiens
gcttcccacctcc

SEQ ID NO: 6273113 - DNA, 18 bp, Homo sapiens
gcttcccacctccctgcc

SEQ ID NO: 6273114 - DNA, 12 bp, Homo sapiens
gcttcccagagg

SEQ ID NO: 6273115 - DNA, 13 bp, Homo sapiens
gcttcccagaggg

SEQ ID NO: 6273116 - DNA, 23 bp, Homo sapiens
gcttcccagccatgcccaggacg

SEQ ID NO: 6273117 - DNA, 11 bp, Homo sapiens
gcttcccagga

SEQ ID NO: 6273118 - DNA, 20 bp, Homo sapiens
gcttcccaggaccctgggtc

SEQ ID NO: 6273119 - DNA, 21 bp, Homo sapiens
gcttcccatcaccggaggagc

SEQ ID NO: 6273120 - DNA, 16 bp, Homo sapiens
gcttcccatccccagc

SEQ ID NO: 6273121 - DNA, 18 bp, Homo sapiens
gcttcccatccccagcga

SEQ ID NO: 6273122 - DNA, 16 bp, Homo sapiens
gcttcccatctgaaga

SEQ ID NO: 6273123 - DNA, 23 bp, Homo sapiens
gcttcccatgccggtacacagcc

SEQ ID NO: 6273124 - DNA, 15 bp, Homo sapiens
gcttccccacagaac

SEQ ID NO: 6273125 - DNA, 15 bp, Homo sapiens
gcttccccagctcag

SEQ ID NO: 6273126 - DNA, 20 bp, Homo sapiens
gcttccccatcgccttctgg

SEQ ID NO: 6273127 - DNA, 14 bp, Homo sapiens
gcttccccattgcc

SEQ ID NO: 6273128 - DNA, 17 bp, Homo sapiens
gcttcccccacccctcc

SEQ ID NO: 6273129 - DNA, 18 bp, Homo sapiens
gcttcccccacccctcca

SEQ ID NO: 6273130 - DNA, 19 bp, Homo sapiens
gcttcccccacccctccac

SEQ ID NO: 6273131 - DNA, 15 bp, Homo sapiens
gcttcccccacttca

SEQ ID NO: 6273132 - DNA, 14 bp, Homo sapiens
gcttcccccatagc

SEQ ID NO: 6273133 - DNA, 21 bp, Homo sapiens
gccaccctaactgagctgcca

SEQ ID NO: 6273134 - DNA, 22 bp, Homo sapiens
gccaccctaactgagctgccag

SEQ ID NO: 6273135 - DNA, 13 bp, Homo sapiens
gccaccctacctg

SEQ ID NO: 6273136 - DNA, 12 bp, Homo sapiens
gccaccctagcc

SEQ ID NO: 6273137 - DNA, 13 bp, Homo sapiens
gccaccctcaccg

SEQ ID NO: 6273138 - DNA, 15 bp, Homo sapiens
gccaccctcatgctg

SEQ ID NO: 6273139 - DNA, 13 bp, Homo sapiens
gccaccctccacg

SEQ ID NO: 6273140 - DNA, 15 bp, Homo sapiens
gccaccctcccagct

SEQ ID NO: 6273141 - DNA, 22 bp, Homo sapiens
gccaccctcctccctccaagcc

SEQ ID NO: 6273142 - DNA, 16 bp, Homo sapiens
gccaccctctccatgc

SEQ ID NO: 6273143 - DNA, 16 bp, Homo sapiens
gccaccctctgcaggg

SEQ ID NO: 6273144 - DNA, 15 bp, Homo sapiens
gccaccctctgctgc

SEQ ID NO: 6273145 - DNA, 16 bp, Homo sapiens
gccaccctctgctgca

SEQ ID NO: 6273146 - DNA, 18 bp, Homo sapiens
gccaccctctgctgcaca

SEQ ID NO: 6273147 - DNA, 10 bp, Homo sapiens
gccaccctga

SEQ ID NO: 6273148 - DNA, 14 bp, Homo sapiens
gccaccctgaggag

SEQ ID NO: 6273149 - DNA, 20 bp, Homo sapiens
gccaccctgaggagtctgag

SEQ ID NO: 6273150 - DNA, 10 bp, Homo sapiens
gccaccctgc

SEQ ID NO: 6273151 - DNA, 14 bp, Homo sapiens
gccaccctgccatg

SEQ ID NO: 6273152 - DNA, 23 bp, Homo sapiens
gccaccctgcccagtctggaaga

SEQ ID NO: 6273153 - DNA, 23 bp, Homo sapiens
gccaccctgcccctaagttatta

SEQ ID NO: 6273154 - DNA, 19 bp, Homo sapiens
gccaccctgcctctaccca

SEQ ID NO: 6273155 - DNA, 12 bp, Homo sapiens
gccaccctgctg

SEQ ID NO: 6273156 - DNA, 14 bp, Homo sapiens
gccaccctgctgca

SEQ ID NO: 6273157 - DNA, 17 bp, Homo sapiens
gccaccctgctgcacta

SEQ ID NO: 6273158 - DNA, 13 bp, Homo sapiens
gccaccctggccc

SEQ ID NO: 6273159 - DNA, 23 bp, Homo sapiens
gccaccctggcccgcccctcgct

SEQ ID NO: 6273160 - DNA, 14 bp, Homo sapiens
gccaccctgggctc

SEQ ID NO: 6273161 - DNA, 18 bp, Homo sapiens
gccaccctgggctctgtg

SEQ ID NO: 6273162 - DNA, 19 bp, Homo sapiens
gccaccctggggagaaagt

SEQ ID NO: 6273163 - DNA, 23 bp, Homo sapiens
gccaccctgtctcagtacctccc

SEQ ID NO: 6273164 - DNA, 13 bp, Homo sapiens
gccaccctgtgca

SEQ ID NO: 6273165 - DNA, 12 bp, Homo sapiens
gccacccttccc

SEQ ID NO: 6273166 - DNA, 19 bp, Homo sapiens
gccaccctttctggcacga

SEQ ID NO: 6273167 - DNA, 18 bp, Homo sapiens
gccaccgactgcccagcc

SEQ ID NO: 6273168 - DNA, 14 bp, Homo sapiens
gccaccgcagctgc

SEQ ID NO: 6273169 - DNA, 15 bp, Homo sapiens
gccaccgcaggggac

SEQ ID NO: 6273170 - DNA, 23 bp, Homo sapiens
gccaccgcaggggactgtctcag

SEQ ID NO: 6273171 - DNA, 19 bp, Homo sapiens
gccaccgcctcctacagcc

SEQ ID NO: 6273172 - DNA, 17 bp, Homo sapiens
gccaccgcgagggcctg

SEQ ID NO: 6273173 - DNA, 19 bp, Homo sapiens
gccaccgcgccctcctgcc

SEQ ID NO: 6273174 - DNA, 18 bp, Homo sapiens
gccaccgcgcctggccca

SEQ ID NO: 6273175 - DNA, 17 bp, Homo sapiens
gccaccgcgcctggccg

SEQ ID NO: 6273176 - DNA, 23 bp, Homo sapiens
gccaccgctgccttttgctgctg

SEQ ID NO: 6273177 - DNA, 20 bp, Homo sapiens
gccaccggaggtcactccac

SEQ ID NO: 6273178 - DNA, 17 bp, Homo sapiens
gccaccgggacagacct

SEQ ID NO: 6273179 - DNA, 16 bp, Homo sapiens
gccaccggggcaagag

SEQ ID NO: 6273180 - DNA, 14 bp, Homo sapiens
gccaccgggggtgg

SEQ ID NO: 6273181 - DNA, 19 bp, Homo sapiens
gccaccggtgggcagtggg

SEQ ID NO: 6273182 - DNA, 20 bp, Homo sapiens
gccaccgtagggcctgactc

SEQ ID NO: 6273183 - DNA, 15 bp, Homo sapiens
gccaccgtgcctggc

SEQ ID NO: 6273184 - DNA, 13 bp, Homo sapiens
gccaccgtggggg

SEQ ID NO: 6273185 - DNA, 14 bp, Homo sapiens
gccaccgtggggga

SEQ ID NO: 6273186 - DNA, 17 bp, Homo sapiens
gccacctagactctccc

SEQ ID NO: 6273187 - DNA, 18 bp, Homo sapiens
gccacctagactctccct

SEQ ID NO: 6273188 - DNA, 16 bp, Homo sapiens
gccacctccacaccca

SEQ ID NO: 6273189 - DNA, 21 bp, Homo sapiens
gccacctccacccccaagaaa

SEQ ID NO: 6273190 - DNA, 23 bp, Homo sapiens
gccacctccacccccaagaaacc

SEQ ID NO: 6273191 - DNA, 15 bp, Homo sapiens
gccacctccagaaac

SEQ ID NO: 6273192 - DNA, 18 bp, Homo sapiens
gccacctcccaaggactt

SEQ ID NO: 6273193 - DNA, 12 bp, Homo sapiens
gccacctcccac

SEQ ID NO: 6273194 - DNA, 16 bp, Homo sapiens
gccacctcccacccca

SEQ ID NO: 6273195 - DNA, 19 bp, Homo sapiens
gccacctcccactcctgct

SEQ ID NO: 6273196 - DNA, 21 bp, Homo sapiens
gccacctcccactcctgctgc

SEQ ID NO: 6273197 - DNA, 17 bp, Homo sapiens
gccacctccccactcca

SEQ ID NO: 6273198 - DNA, 18 bp, Homo sapiens
gccacctccccactccag

SEQ ID NO: 6273199 - DNA, 21 bp, Homo sapiens
gccacctccccactccagcag

SEQ ID NO: 6273200 - DNA, 12 bp, Homo sapiens
gccacctcccct

SEQ ID NO: 6273201 - DNA, 22 bp, Homo sapiens
gccacctcccctatccacccag

SEQ ID NO: 6273202 - DNA, 18 bp, Homo sapiens
gccacctccccttgccag

SEQ ID NO: 6273203 - DNA, 20 bp, Homo sapiens
gccacctccccttgccagct

SEQ ID NO: 6273204 - DNA, 21 bp, Homo sapiens
gccacctccccttgccagctg

SEQ ID NO: 6273205 - DNA, 22 bp, Homo sapiens
gccacctcctaaaaggcccaga

SEQ ID NO: 6273206 - DNA, 13 bp, Homo sapiens
gccacctcctacc

SEQ ID NO: 6273207 - DNA, 14 bp, Homo sapiens
gccacctcctcccc

SEQ ID NO: 6273208 - DNA, 23 bp, Homo sapiens
gccacctcctctgttcttggaac

SEQ ID NO: 6273209 - DNA, 14 bp, Homo sapiens
gccacctccttggc

SEQ ID NO: 6273210 - DNA, 15 bp, Homo sapiens
gccacctccttggca

SEQ ID NO: 6273211 - DNA, 18 bp, Homo sapiens
gccacctctaacagcacc

SEQ ID NO: 6273212 - DNA, 15 bp, Homo sapiens
gccacctctccaagg

SEQ ID NO: 6273213 - DNA, 20 bp, Homo sapiens
gccacctctcccagccctca

SEQ ID NO: 6273214 - DNA, 15 bp, Homo sapiens
gccacctctccctca

SEQ ID NO: 6273215 - DNA, 13 bp, Homo sapiens
gccacctctctcc

SEQ ID NO: 6273216 - DNA, 16 bp, Homo sapiens
gccacctctctccttt

SEQ ID NO: 6273217 - DNA, 20 bp, Homo sapiens
gccacctctctgcctgttcc

SEQ ID NO: 6273218 - DNA, 11 bp, Homo sapiens
gccacctctgc

SEQ ID NO: 6273219 - DNA, 15 bp, Homo sapiens
gccacctctgcctct

SEQ ID NO: 6273220 - DNA, 14 bp, Homo sapiens
gccacctctgcgga

SEQ ID NO: 6273221 - DNA, 22 bp, Homo sapiens
gccacctctgcggaccccagct

SEQ ID NO: 6273222 - DNA, 22 bp, Homo sapiens
gccacctctggccaaatatgca

SEQ ID NO: 6273223 - DNA, 18 bp, Homo sapiens
gccacctcttcctggccg

SEQ ID NO: 6273224 - DNA, 17 bp, Homo sapiens
gccacctcttgggcatg

SEQ ID NO: 6273225 - DNA, 15 bp, Homo sapiens
gccacctgaggtggg

SEQ ID NO: 6273226 - DNA, 18 bp, Homo sapiens
gccacctgaggtgggccc

SEQ ID NO: 6273227 - DNA, 23 bp, Homo sapiens
gccacctgaggtgggctggggct

SEQ ID NO: 6273228 - DNA, 10 bp, Homo sapiens
gccacctgca

SEQ ID NO: 6273229 - DNA, 13 bp, Homo sapiens
gccacctgcaaga

SEQ ID NO: 6273230 - DNA, 17 bp, Homo sapiens
gccacctgcaagtgccc

SEQ ID NO: 6273231 - DNA, 12 bp, Homo sapiens
gccacctgcagc

SEQ ID NO: 6273232 - DNA, 10 bp, Homo sapiens
gccacctgcc

SEQ ID NO: 6273233 - DNA, 16 bp, Homo sapiens
gccacctgccaggcct

SEQ ID NO: 6273234 - DNA, 11 bp, Homo sapiens
gccacctgccc

SEQ ID NO: 6273235 - DNA, 11 bp, Homo sapiens
gccacctgcct

SEQ ID NO: 6273236 - DNA, 13 bp, Homo sapiens
gccacctgcctgc

SEQ ID NO: 6273237 - DNA, 21 bp, Homo sapiens
gccacctgcctgcgtcttccg

SEQ ID NO: 6273238 - DNA, 22 bp, Homo sapiens
gccacctgcctgcgtcttccgc

SEQ ID NO: 6273239 - DNA, 17 bp, Homo sapiens
gccacctgcctgttggg

SEQ ID NO: 6273240 - DNA, 12 bp, Homo sapiens
gccacctgctgc

SEQ ID NO: 6273241 - DNA, 23 bp, Homo sapiens
gccacctgctgcgggggagccag

SEQ ID NO: 6273242 - DNA, 12 bp, Homo sapiens
gccacctggacc

SEQ ID NO: 6273243 - DNA, 13 bp, Homo sapiens
gccacctggaccc

SEQ ID NO: 6273244 - DNA, 17 bp, Homo sapiens
gccacctgggaacacag

SEQ ID NO: 6273245 - DNA, 23 bp, Homo sapiens
gccacctgggaacacagttctgg

SEQ ID NO: 6273246 - DNA, 17 bp, Homo sapiens
gccacctggggcagtca

SEQ ID NO: 6273247 - DNA, 10 bp, Homo sapiens
gccacctgtc

SEQ ID NO: 6273248 - DNA, 15 bp, Homo sapiens
gccacctgtccggcc

SEQ ID NO: 6273249 - DNA, 14 bp, Homo sapiens
gccacctgtctgtc

SEQ ID NO: 6273250 - DNA, 14 bp, Homo sapiens
gccacctgtcttct

SEQ ID NO: 6273251 - DNA, 14 bp, Homo sapiens
gccaccttccagtg

SEQ ID NO: 6273252 - DNA, 14 bp, Homo sapiens
gccaccttgatttt

SEQ ID NO: 6273253 - DNA, 21 bp, Homo sapiens
gccaccttgattttcttcttt

SEQ ID NO: 6273254 - DNA, 16 bp, Homo sapiens
gccacctttcaccctc

SEQ ID NO: 6273255 - DNA, 23 bp, Homo sapiens
gccacctttcaccctcatgaaaa

SEQ ID NO: 6273256 - DNA, 15 bp, Homo sapiens
gccacctttcctgtt

SEQ ID NO: 6273257 - DNA, 22 bp, Homo sapiens
gccacgaacctcggggtggggg

SEQ ID NO: 6273258 - DNA, 15 bp, Homo sapiens
gccacgaccagcccc

SEQ ID NO: 6273259 - DNA, 21 bp, Homo sapiens
gccacgaccagccccttcctg

SEQ ID NO: 6273260 - DNA, 22 bp, Homo sapiens
gccacgaccagccccttcctgg

SEQ ID NO: 6273261 - DNA, 14 bp, Homo sapiens
gccacgactgccat

SEQ ID NO: 6273262 - DNA, 20 bp, Homo sapiens
gccacgaggtggtagctctg

SEQ ID NO: 6273263 - DNA, 15 bp, Homo sapiens
gccacgattggagaa

SEQ ID NO: 6273264 - DNA, 15 bp, Homo sapiens
gccacgcactgggcc

SEQ ID NO: 6273265 - DNA, 22 bp, Homo sapiens
gccacgcactgggccacggagg

SEQ ID NO: 6273266 - DNA, 22 bp, Homo sapiens
gccacgcacttcctctctcgga

SEQ ID NO: 6273267 - DNA, 14 bp, Homo sapiens
gccacgcagccagg

SEQ ID NO: 6273268 - DNA, 16 bp, Homo sapiens
gccacgcagccaggac

SEQ ID NO: 6273269 - DNA, 17 bp, Homo sapiens
gccacgcagccaggaca

SEQ ID NO: 6273270 - DNA, 18 bp, Homo sapiens
gccacgcagccaggacac

SEQ ID NO: 6273271 - DNA, 15 bp, Homo sapiens
gccacgcagtgcctg

SEQ ID NO: 6273272 - DNA, 16 bp, Homo sapiens
gccacgccccagcccg

SEQ ID NO: 6273273 - DNA, 17 bp, Homo sapiens
gccacgccctccctgct

SEQ ID NO: 6273274 - DNA, 15 bp, Homo sapiens
gccacgccggccaca

SEQ ID NO: 6273275 - DNA, 15 bp, Homo sapiens
gccacgcctctctca

SEQ ID NO: 6273276 - DNA, 14 bp, Homo sapiens
gccacgcctggaag

SEQ ID NO: 6273277 - DNA, 15 bp, Homo sapiens
gccacgcgctctgca

SEQ ID NO: 6273278 - DNA, 19 bp, Homo sapiens
gccacgcgctctgcatgct

SEQ ID NO: 6273279 - DNA, 20 bp, Homo sapiens
gccacgcgctctgcatgctc

SEQ ID NO: 6273280 - DNA, 13 bp, Homo sapiens
gccacgctgtcct

SEQ ID NO: 6273281 - DNA, 19 bp, Homo sapiens
gccacgctgtcctctcgag

SEQ ID NO: 6273282 - DNA, 22 bp, Homo sapiens
gccacgctgtcctctcgagccc

SEQ ID NO: 6273283 - DNA, 14 bp, Homo sapiens
gccacgctttgctg

SEQ ID NO: 6273284 - DNA, 19 bp, Homo sapiens
gccacgctttgctgctacc

SEQ ID NO: 6273285 - DNA, 21 bp, Homo sapiens
gccacggaccgcatcctccag

SEQ ID NO: 6273286 - DNA, 18 bp, Homo sapiens
gccacggacgctggctcc

SEQ ID NO: 6273287 - DNA, 17 bp, Homo sapiens
gccacggagcgggaggc

SEQ ID NO: 6273288 - DNA, 19 bp, Homo sapiens
gccacggagcgggaggcag

SEQ ID NO: 6273289 - DNA, 15 bp, Homo sapiens
gccacggaggaggga

SEQ ID NO: 6273290 - DNA, 17 bp, Homo sapiens
gccacggagggaggcac

SEQ ID NO: 6273291 - DNA, 18 bp, Homo sapiens
gccacggagggaggcacc

SEQ ID NO: 6273292 - DNA, 17 bp, Homo sapiens
gccacggcactccagcc

SEQ ID NO: 6273293 - DNA, 21 bp, Homo sapiens
gccacggcagccaccctgcca

SEQ ID NO: 6273294 - DNA, 13 bp, Homo sapiens
gccacggcagcct

SEQ ID NO: 6273295 - DNA, 14 bp, Homo sapiens
gccacggccaggcc

SEQ ID NO: 6273296 - DNA, 17 bp, Homo sapiens
gccacggccaggccaga

SEQ ID NO: 6273297 - DNA, 13 bp, Homo sapiens
gccacggcccagg

SEQ ID NO: 6273298 - DNA, 16 bp, Homo sapiens
gccacggcccagggag

SEQ ID NO: 6273299 - DNA, 17 bp, Homo sapiens
gccacggcccagggagg

SEQ ID NO: 6273300 - DNA, 17 bp, Homo sapiens
gccacggccccgggtcc

SEQ ID NO: 6273301 - DNA, 12 bp, Homo sapiens
gccacggcctgg

SEQ ID NO: 6273302 - DNA, 14 bp, Homo sapiens
gccacggcctggct

SEQ ID NO: 6273303 - DNA, 20 bp, Homo sapiens
gccacggcctggctggtggg

SEQ ID NO: 6273304 - DNA, 13 bp, Homo sapiens
gccacggcctggg

SEQ ID NO: 6273305 - DNA, 19 bp, Homo sapiens
gccacggctgagccttcag

SEQ ID NO: 6273306 - DNA, 17 bp, Homo sapiens
gccacggggagggggac

SEQ ID NO: 6273307 - DNA, 13 bp, Homo sapiens
gccacgggggcag

SEQ ID NO: 6273308 - DNA, 19 bp, Homo sapiens
gccacgggggcagtgtgag

SEQ ID NO: 6273309 - DNA, 23 bp, Homo sapiens
gccacgggtgccagaagctactg

SEQ ID NO: 6273310 - DNA, 23 bp, Homo sapiens
gccacggtggacttagctctgag

SEQ ID NO: 6273311 - DNA, 20 bp, Homo sapiens
gccacgtcatgtctctaaac

SEQ ID NO: 6273312 - DNA, 23 bp, Homo sapiens
gccacgtcccagcatccctggag

SEQ ID NO: 6273313 - DNA, 15 bp, Homo sapiens
gccacgtcccgctgc

SEQ ID NO: 6273314 - DNA, 14 bp, Homo sapiens
gcttcccccttgat

SEQ ID NO: 6273315 - DNA, 17 bp, Homo sapiens
gcttcccctccacccta

SEQ ID NO: 6273316 - DNA, 13 bp, Homo sapiens
gcttcccctccag

SEQ ID NO: 6273317 - DNA, 14 bp, Homo sapiens
gcttcccctccagg

SEQ ID NO: 6273318 - DNA, 12 bp, Homo sapiens
gcttcccctccc

SEQ ID NO: 6273319 - DNA, 18 bp, Homo sapiens
gcttcccctccctaccct

SEQ ID NO: 6273320 - DNA, 24 bp, Homo sapiens
gcttcccctccctaccctcggaaa

SEQ ID NO: 6273321 - DNA, 17 bp, Homo sapiens
gcttcccctcgctgtcc

SEQ ID NO: 6273322 - DNA, 20 bp, Homo sapiens
gcttccccttggcctctctg

SEQ ID NO: 6273323 - DNA, 22 bp, Homo sapiens
gcttccccttggcctctctgta

SEQ ID NO: 6273324 - DNA, 18 bp, Homo sapiens
gcttccccttttgccaat

SEQ ID NO: 6273325 - DNA, 13 bp, Homo sapiens
gcttcccgctgca

SEQ ID NO: 6273326 - DNA, 15 bp, Homo sapiens
gcttcccgctgcaca

SEQ ID NO: 6273327 - DNA, 18 bp, Homo sapiens
gcttcccgctgcacatgg

SEQ ID NO: 6273328 - DNA, 23 bp, Homo sapiens
gcttcccgggataaactgagcct

SEQ ID NO: 6273329 - DNA, 20 bp, Homo sapiens
gcttccctacacagggcctg

SEQ ID NO: 6273330 - DNA, 19 bp, Homo sapiens
gcttccctacccacagggc

SEQ ID NO: 6273331 - DNA, 18 bp, Homo sapiens
gcttccctaggctgagct

SEQ ID NO: 6273332 - DNA, 19 bp, Homo sapiens
gcttccctaggctgagctg

SEQ ID NO: 6273333 - DNA, 20 bp, Homo sapiens
gcttccctcccctctagttt

SEQ ID NO: 6273334 - DNA, 16 bp, Homo sapiens
gcttccctcctgcccg

SEQ ID NO: 6273335 - DNA, 12 bp, Homo sapiens
gcttccctcctt

SEQ ID NO: 6273336 - DNA, 16 bp, Homo sapiens
gcttccctccttcatg

SEQ ID NO: 6273337 - DNA, 12 bp, Homo sapiens
gcttccctctgc

SEQ ID NO: 6273338 - DNA, 16 bp, Homo sapiens
gcttccctctgcctga

SEQ ID NO: 6273339 - DNA, 23 bp, Homo sapiens
gcttccctctgcctgtccctctc

SEQ ID NO: 6273340 - DNA, 16 bp, Homo sapiens
gcttccctctgctcca

SEQ ID NO: 6273341 - DNA, 17 bp, Homo sapiens
gcttccctgaaagactg

SEQ ID NO: 6273342 - DNA, 16 bp, Homo sapiens
gcttccctgaagctcc

SEQ ID NO: 6273343 - DNA, 18 bp, Homo sapiens
gcttccctgactcattct

SEQ ID NO: 6273344 - DNA, 13 bp, Homo sapiens
gcttccctgcagc

SEQ ID NO: 6273345 - DNA, 14 bp, Homo sapiens
gcttccctgcagct

SEQ ID NO: 6273346 - DNA, 12 bp, Homo sapiens
gcttccctgccc

SEQ ID NO: 6273347 - DNA, 13 bp, Homo sapiens
gcttccctgccca

SEQ ID NO: 6273348 - DNA, 16 bp, Homo sapiens
gcttccctgcccaatc

SEQ ID NO: 6273349 - DNA, 17 bp, Homo sapiens
gcttccctgcccaatcc

SEQ ID NO: 6273350 - DNA, 20 bp, Homo sapiens
gcttccctggcctcccgcca

SEQ ID NO: 6273351 - DNA, 14 bp, Homo sapiens
gcttccctgggcct

SEQ ID NO: 6273352 - DNA, 16 bp, Homo sapiens
gcttccctgggcctca

SEQ ID NO: 6273353 - DNA, 14 bp, Homo sapiens
gcttccctggggcc

SEQ ID NO: 6273354 - DNA, 17 bp, Homo sapiens
gcttcccttctccccag

SEQ ID NO: 6273355 - DNA, 14 bp, Homo sapiens
gcttccctttcctg

SEQ ID NO: 6273356 - DNA, 19 bp, Homo sapiens
gcttcccttttttcctttc

SEQ ID NO: 6273357 - DNA, 14 bp, Homo sapiens
gcttccgccactca

SEQ ID NO: 6273358 - DNA, 12 bp, Homo sapiens
gcttccgcgccc

SEQ ID NO: 6273359 - DNA, 16 bp, Homo sapiens
gcttccggctgagctg

SEQ ID NO: 6273360 - DNA, 21 bp, Homo sapiens
gcttccggctgagctgtgcca

SEQ ID NO: 6273361 - DNA, 22 bp, Homo sapiens
gcttccggtagggaggcagcct

SEQ ID NO: 6273362 - DNA, 17 bp, Homo sapiens
gcttccgtgagacacaa

SEQ ID NO: 6273363 - DNA, 13 bp, Homo sapiens
gcttccgttcctc

SEQ ID NO: 6273364 - DNA, 21 bp, Homo sapiens
gcttcctagaaagttctgtgt

SEQ ID NO: 6273365 - DNA, 23 bp, Homo sapiens
gcttcctagcttatctccctgct

SEQ ID NO: 6273366 - DNA, 20 bp, Homo sapiens
gcttcctaggccccagagca

SEQ ID NO: 6273367 - DNA, 21 bp, Homo sapiens
gcttcctataacttcttcctg

SEQ ID NO: 6273368 - DNA, 22 bp, Homo sapiens
gcttcctataacttcttcctgc

SEQ ID NO: 6273369 - DNA, 17 bp, Homo sapiens
gcttcctataattttga

SEQ ID NO: 6273370 - DNA, 18 bp, Homo sapiens
gcttcctataattttgat

SEQ ID NO: 6273371 - DNA, 23 bp, Homo sapiens
gcttcctataattttgatagtgg

SEQ ID NO: 6273372 - DNA, 23 bp, Homo sapiens
gcttcctatttctagggctggga

SEQ ID NO: 6273373 - DNA, 23 bp, Homo sapiens
gcttcctcaaatacatgcacagt

SEQ ID NO: 6273374 - DNA, 17 bp, Homo sapiens
gcttcctcagcctccaa

SEQ ID NO: 6273375 - DNA, 20 bp, Homo sapiens
gcttcctcagggcccagcag

SEQ ID NO: 6273376 - DNA, 22 bp, Homo sapiens
gcttcctcattccttgtcttga

SEQ ID NO: 6273377 - DNA, 14 bp, Homo sapiens
gcttcctccagagg

SEQ ID NO: 6273378 - DNA, 18 bp, Homo sapiens
gcttcctccagaggaggg

SEQ ID NO: 6273379 - DNA, 12 bp, Homo sapiens
gcttcctccggc

SEQ ID NO: 6273380 - DNA, 20 bp, Homo sapiens
gcttcctccggctggacctg

SEQ ID NO: 6273381 - DNA, 11 bp, Homo sapiens
gcttcctcctg

SEQ ID NO: 6273382 - DNA, 12 bp, Homo sapiens
gcttcctcctgg

SEQ ID NO: 6273383 - DNA, 20 bp, Homo sapiens
gcttcctccttccagatgcc

SEQ ID NO: 6273384 - DNA, 20 bp, Homo sapiens
gcttcctctagaagccaagg

SEQ ID NO: 6273385 - DNA, 12 bp, Homo sapiens
gcttcctctgct

SEQ ID NO: 6273386 - DNA, 14 bp, Homo sapiens
gcttcctctgctgc

SEQ ID NO: 6273387 - DNA, 17 bp, Homo sapiens
gcttcctgaaagctgtt

SEQ ID NO: 6273388 - DNA, 16 bp, Homo sapiens
gcttcctgaaataaac

SEQ ID NO: 6273389 - DNA, 17 bp, Homo sapiens
gcttcctgaaataaaca

SEQ ID NO: 6273390 - DNA, 20 bp, Homo sapiens
gcttcctgaaataaacactg

SEQ ID NO: 6273391 - DNA, 22 bp, Homo sapiens
gcttcctgagaaagcccacctg

SEQ ID NO: 6273392 - DNA, 15 bp, Homo sapiens
gcttcctgagcagtc

SEQ ID NO: 6273393 - DNA, 22 bp, Homo sapiens
gcttcctgagcagtccctgctt

SEQ ID NO: 6273394 - DNA, 23 bp, Homo sapiens
gcttcctgaggggagacagagca

SEQ ID NO: 6273395 - DNA, 14 bp, Homo sapiens
gcttcctgcaggac

SEQ ID NO: 6273396 - DNA, 11 bp, Homo sapiens
gcttcctgccc

SEQ ID NO: 6273397 - DNA, 12 bp, Homo sapiens
gcttcctgccct

SEQ ID NO: 6273398 - DNA, 19 bp, Homo sapiens
gcttcctgcccttccctct

SEQ ID NO: 6273399 - DNA, 21 bp, Homo sapiens
gcttcctgcccttccctctgg

SEQ ID NO: 6273400 - DNA, 22 bp, Homo sapiens
gcttcctggacgtgcgcgccca

SEQ ID NO: 6273401 - DNA, 15 bp, Homo sapiens
gcttcctggagcaga

SEQ ID NO: 6273402 - DNA, 18 bp, Homo sapiens
gcttcctggagcagaagc

SEQ ID NO: 6273403 - DNA, 22 bp, Homo sapiens
gcttcctggagcagaagcagca

SEQ ID NO: 6273404 - DNA, 20 bp, Homo sapiens
gcttcctggcctcccttctc

SEQ ID NO: 6273405 - DNA, 15 bp, Homo sapiens
gcttcctggctctgg

SEQ ID NO: 6273406 - DNA, 13 bp, Homo sapiens
gcttcctgggcag

SEQ ID NO: 6273407 - DNA, 13 bp, Homo sapiens
gcttcctgggtcc

SEQ ID NO: 6273408 - DNA, 11 bp, Homo sapiens
gcttcctggtg

SEQ ID NO: 6273409 - DNA, 18 bp, Homo sapiens
gcttcctggtgagaactg

SEQ ID NO: 6273410 - DNA, 23 bp, Homo sapiens
gcttcctgtccactctcggggcc

SEQ ID NO: 6273411 - DNA, 16 bp, Homo sapiens
gcttcctgtcctccca

SEQ ID NO: 6273412 - DNA, 19 bp, Homo sapiens
gcttcctgtgtaacatctg

SEQ ID NO: 6273413 - DNA, 14 bp, Homo sapiens
gcttcctgtttgta

SEQ ID NO: 6273414 - DNA, 17 bp, Homo sapiens
gcttccttagccttgct

SEQ ID NO: 6273415 - DNA, 14 bp, Homo sapiens
gcttccttcagaga

SEQ ID NO: 6273416 - DNA, 23 bp, Homo sapiens
gcttccttcagtttgtaaagtcg

SEQ ID NO: 6273417 - DNA, 15 bp, Homo sapiens
gcttccttctgggac

SEQ ID NO: 6273418 - DNA, 23 bp, Homo sapiens
gcttccttgtagcgactaaacta

SEQ ID NO: 6273419 - DNA, 16 bp, Homo sapiens
gcttcctttcaggcca

SEQ ID NO: 6273420 - DNA, 24 bp, Homo sapiens
gcttcctttcccaagccttcgggc

SEQ ID NO: 6273421 - DNA, 19 bp, Homo sapiens
gcttcctttctctcctggc

SEQ ID NO: 6273422 - DNA, 22 bp, Homo sapiens
gcttcctttgtttttttttcct

SEQ ID NO: 6273423 - DNA, 15 bp, Homo sapiens
gcttcgactactgct

SEQ ID NO: 6273424 - DNA, 23 bp, Homo sapiens
gcttcgactactgctcctgtggc

SEQ ID NO: 6273425 - DNA, 24 bp, Homo sapiens
gcttcgactactgctcctgtggca

SEQ ID NO: 6273426 - DNA, 16 bp, Homo sapiens
gcttcgacttttctta

SEQ ID NO: 6273427 - DNA, 15 bp, Homo sapiens
gcttcgaggacagga

SEQ ID NO: 6273428 - DNA, 22 bp, Homo sapiens
gcttcgcttccttagccttgct

SEQ ID NO: 6273429 - DNA, 16 bp, Homo sapiens
gcttcggccacaggca

SEQ ID NO: 6273430 - DNA, 19 bp, Homo sapiens
gcttcggccacaggcaggt

SEQ ID NO: 6273431 - DNA, 19 bp, Homo sapiens
gcttcggccgcgccacccg

SEQ ID NO: 6273432 - DNA, 18 bp, Homo sapiens
gcttcgggcccttcccac

SEQ ID NO: 6273433 - DNA, 18 bp, Homo sapiens
gcttcggggcaagtgaga

SEQ ID NO: 6273434 - DNA, 23 bp, Homo sapiens
gcttcggtgtgcagatcatccgt

SEQ ID NO: 6273435 - DNA, 22 bp, Homo sapiens
gcttcggtttctaacttggagc

SEQ ID NO: 6273436 - DNA, 15 bp, Homo sapiens
gcttcgtctcagaag

SEQ ID NO: 6273437 - DNA, 17 bp, Homo sapiens
gcttcgtctcagaaggc

SEQ ID NO: 6273438 - DNA, 14 bp, Homo sapiens
gcttcgtgctggag

SEQ ID NO: 6273439 - DNA, 16 bp, Homo sapiens
gcttcgtgctggagga

SEQ ID NO: 6273440 - DNA, 18 bp, Homo sapiens
gcttcgtgctggaggaac

SEQ ID NO: 6273441 - DNA, 16 bp, Homo sapiens
gcttcgtttattttca

SEQ ID NO: 6273442 - DNA, 19 bp, Homo sapiens
gcttcgtttgcctccagaa

SEQ ID NO: 6273443 - DNA, 13 bp, Homo sapiens
gcttctaaaacaa

SEQ ID NO: 6273444 - DNA, 23 bp, Homo sapiens
gcttctaaactgaagctgctgta

SEQ ID NO: 6273445 - DNA, 21 bp, Homo sapiens
gcttctaagggatccagagac

SEQ ID NO: 6273446 - DNA, 15 bp, Homo sapiens
gcttctaatatttat

SEQ ID NO: 6273447 - DNA, 21 bp, Homo sapiens
gcttctaatatttattgcttt

SEQ ID NO: 6273448 - DNA, 19 bp, Homo sapiens
gcttctaatgacccagata

SEQ ID NO: 6273449 - DNA, 16 bp, Homo sapiens
gcttctaatgttcccc

SEQ ID NO: 6273450 - DNA, 18 bp, Homo sapiens
gcttctaccaactggaag

SEQ ID NO: 6273451 - DNA, 12 bp, Homo sapiens
gcttctacctgc

SEQ ID NO: 6273452 - DNA, 16 bp, Homo sapiens
gcttctacctgcaggc

SEQ ID NO: 6273453 - DNA, 18 bp, Homo sapiens
gcttctactcctgcctca

SEQ ID NO: 6273454 - DNA, 22 bp, Homo sapiens
gcttctactttcatcttaaact

SEQ ID NO: 6273455 - DNA, 19 bp, Homo sapiens
gcttctagaaactctggct

SEQ ID NO: 6273456 - DNA, 20 bp, Homo sapiens
gcttctagaaactctggctc

SEQ ID NO: 6273457 - DNA, 18 bp, Homo sapiens
gcttctagaaagcccctc

SEQ ID NO: 6273458 - DNA, 20 bp, Homo sapiens
gcttctagaaagcccctcac

SEQ ID NO: 6273459 - DNA, 15 bp, Homo sapiens
gcttctagaggctca

SEQ ID NO: 6273460 - DNA, 20 bp, Homo sapiens
gcttctagccatgtagtgct

SEQ ID NO: 6273461 - DNA, 23 bp, Homo sapiens
gcttctaggagtcaactggctgg

SEQ ID NO: 6273462 - DNA, 19 bp, Homo sapiens
gcttctagttctgccagga

SEQ ID NO: 6273463 - DNA, 20 bp, Homo sapiens
gcttctagttctgccaggag

SEQ ID NO: 6273464 - DNA, 23 bp, Homo sapiens
gcttctatcagactcagtttttt

SEQ ID NO: 6273465 - DNA, 12 bp, Homo sapiens
gcttctatccca

SEQ ID NO: 6273466 - DNA, 14 bp, Homo sapiens
gcttctatcccagg

SEQ ID NO: 6273467 - DNA, 20 bp, Homo sapiens
gcttctatcccaggaggtgg

SEQ ID NO: 6273468 - DNA, 13 bp, Homo sapiens
gcttctattaaat

SEQ ID NO: 6273469 - DNA, 23 bp, Homo sapiens
gcttctattacctattaggtgga

SEQ ID NO: 6273470 - DNA, 16 bp, Homo sapiens
gcttctattagccagt

SEQ ID NO: 6273471 - DNA, 19 bp, Homo sapiens
gcttctcaaagtactggga

SEQ ID NO: 6273472 - DNA, 19 bp, Homo sapiens
gcttctcaactaaagaata

SEQ ID NO: 6273473 - DNA, 20 bp, Homo sapiens
gcttctcaccgtgcagagct

SEQ ID NO: 6273474 - DNA, 21 bp, Homo sapiens
gcttctcacgctttgtttact

SEQ ID NO: 6273475 - DNA, 17 bp, Homo sapiens
gcttctcactgccatgc

SEQ ID NO: 6273476 - DNA, 13 bp, Homo sapiens
gcttctcagcccc

SEQ ID NO: 6273477 - DNA, 19 bp, Homo sapiens
gcttctcagtttctgcctg

SEQ ID NO: 6273478 - DNA, 16 bp, Homo sapiens
gcttctcatcctgcag

SEQ ID NO: 6273479 - DNA, 18 bp, Homo sapiens
gcttctcatcttgtgaaa

SEQ ID NO: 6273480 - DNA, 22 bp, Homo sapiens
gcttctcatgtgtgtagctaag

SEQ ID NO: 6273481 - DNA, 23 bp, Homo sapiens
gcttctccaaaaatctgcctggg

SEQ ID NO: 6273482 - DNA, 20 bp, Homo sapiens
gcttctccaaatacaagtac

SEQ ID NO: 6273483 - DNA, 16 bp, Homo sapiens
gcttctccaagcatca

SEQ ID NO: 6273484 - DNA, 13 bp, Homo sapiens
gcttctccacctc

SEQ ID NO: 6273485 - DNA, 21 bp, Homo sapiens
gcttctccagccaccaaggct

SEQ ID NO: 6273486 - DNA, 14 bp, Homo sapiens
gcttctccagcctg

SEQ ID NO: 6273487 - DNA, 12 bp, Homo sapiens
gcttctccagga

SEQ ID NO: 6273488 - DNA, 14 bp, Homo sapiens
gcttctccagggaa

SEQ ID NO: 6273489 - DNA, 22 bp, Homo sapiens
gcttctccagggaattcttaca

SEQ ID NO: 6273490 - DNA, 16 bp, Homo sapiens
gcttctccagtggtga

SEQ ID NO: 6273491 - DNA, 16 bp, Homo sapiens
gcttctcccaacactc

SEQ ID NO: 6273492 - DNA, 16 bp, Homo sapiens
gccacgtcccgctgcc

SEQ ID NO: 6273493 - DNA, 18 bp, Homo sapiens
gccacgtcccgctgcctc

SEQ ID NO: 6273494 - DNA, 13 bp, Homo sapiens
gccacgtgccagg

SEQ ID NO: 6273495 - DNA, 19 bp, Homo sapiens
gccacgtgccttaggaata

SEQ ID NO: 6273496 - DNA, 18 bp, Homo sapiens
gccacgtgctggagagta

SEQ ID NO: 6273497 - DNA, 15 bp, Homo sapiens
gccacgtggccgctg

SEQ ID NO: 6273498 - DNA, 23 bp, Homo sapiens
gccacgtggtcactgtgcactgc

SEQ ID NO: 6273499 - DNA, 23 bp, Homo sapiens
gccacgtgtttgtgctgtggtgt

SEQ ID NO: 6273500 - DNA, 15 bp, Homo sapiens
gccacgttaagtcca

SEQ ID NO: 6273501 - DNA, 20 bp, Homo sapiens
gccacgttactcccctggct

SEQ ID NO: 6273502 - DNA, 22 bp, Homo sapiens
gccacgttccttactgcagaat

SEQ ID NO: 6273503 - DNA, 22 bp, Homo sapiens
gccacgttcttactagtttccc

SEQ ID NO: 6273504 - DNA, 17 bp, Homo sapiens
gccacgttgcagaaaaa

SEQ ID NO: 6273505 - DNA, 18 bp, Homo sapiens
gccacgttgcagaaaaag

SEQ ID NO: 6273506 - DNA, 17 bp, Homo sapiens
gccactaaagcttcaga

SEQ ID NO: 6273507 - DNA, 22 bp, Homo sapiens
gccactaaagcttcagactcaa

SEQ ID NO: 6273508 - DNA, 23 bp, Homo sapiens
gccactaaagcttcagactcaag

SEQ ID NO: 6273509 - DNA, 23 bp, Homo sapiens
gccactaaccttgcctggtacag

SEQ ID NO: 6273510 - DNA, 18 bp, Homo sapiens
gccactaattttagtatt

SEQ ID NO: 6273511 - DNA, 23 bp, Homo sapiens
gccactaattttagtattcattc

SEQ ID NO: 6273512 - DNA, 17 bp, Homo sapiens
gccactacactccagcc

SEQ ID NO: 6273513 - DNA, 23 bp, Homo sapiens
gccactacatttgctccatcctc

SEQ ID NO: 6273514 - DNA, 22 bp, Homo sapiens
gccactacctttgtccaggcct

SEQ ID NO: 6273515 - DNA, 16 bp, Homo sapiens
gccactaggcccagac

SEQ ID NO: 6273516 - DNA, 15 bp, Homo sapiens
gccactaggctgggt

SEQ ID NO: 6273517 - DNA, 16 bp, Homo sapiens
gccactaggctgggtg

SEQ ID NO: 6273518 - DNA, 19 bp, Homo sapiens
gccactaggtgtccccaac

SEQ ID NO: 6273519 - DNA, 14 bp, Homo sapiens
gccactcacacagc

SEQ ID NO: 6273520 - DNA, 20 bp, Homo sapiens
gccactcacacagccaggtg

SEQ ID NO: 6273521 - DNA, 18 bp, Homo sapiens
gccactcacccttcctgg

SEQ ID NO: 6273522 - DNA, 16 bp, Homo sapiens
gccactcagaggcccc

SEQ ID NO: 6273523 - DNA, 20 bp, Homo sapiens
gccactcagccatttccccc

SEQ ID NO: 6273524 - DNA, 13 bp, Homo sapiens
gccactcagcttc

SEQ ID NO: 6273525 - DNA, 14 bp, Homo sapiens
gccactcaggccca

SEQ ID NO: 6273526 - DNA, 16 bp, Homo sapiens
gccactcatttcatct

SEQ ID NO: 6273527 - DNA, 20 bp, Homo sapiens
gccactcatttcatctcatt

SEQ ID NO: 6273528 - DNA, 21 bp, Homo sapiens
gccactccaagccccctggca

SEQ ID NO: 6273529 - DNA, 18 bp, Homo sapiens
gccactccagacccctgg

SEQ ID NO: 6273530 - DNA, 19 bp, Homo sapiens
gccactccagacccctggc

SEQ ID NO: 6273531 - DNA, 21 bp, Homo sapiens
gccactccagacccctggctt

SEQ ID NO: 6273532 - DNA, 22 bp, Homo sapiens
gccactccagacccctggcttt

SEQ ID NO: 6273533 - DNA, 15 bp, Homo sapiens
gccactccagtcctg

SEQ ID NO: 6273534 - DNA, 15 bp, Homo sapiens
gccactcccaggggc

SEQ ID NO: 6273535 - DNA, 16 bp, Homo sapiens
gccactccccagtgct

SEQ ID NO: 6273536 - DNA, 22 bp, Homo sapiens
gccactccccggcatgagactc

SEQ ID NO: 6273537 - DNA, 21 bp, Homo sapiens
gccactcccctaaactccagg

SEQ ID NO: 6273538 - DNA, 13 bp, Homo sapiens
gccactcccgcca

SEQ ID NO: 6273539 - DNA, 21 bp, Homo sapiens
gccactcccgccacacgctca

SEQ ID NO: 6273540 - DNA, 22 bp, Homo sapiens
gccactcccggcactccatgct

SEQ ID NO: 6273541 - DNA, 19 bp, Homo sapiens
gccactcccgggccaagac

SEQ ID NO: 6273542 - DNA, 12 bp, Homo sapiens
gccactccctcc

SEQ ID NO: 6273543 - DNA, 16 bp, Homo sapiens
gccactccctcccaga

SEQ ID NO: 6273544 - DNA, 13 bp, Homo sapiens
gccactccctgag

SEQ ID NO: 6273545 - DNA, 12 bp, Homo sapiens
gccactccctgc

SEQ ID NO: 6273546 - DNA, 15 bp, Homo sapiens
gccactccctgccaa

SEQ ID NO: 6273547 - DNA, 16 bp, Homo sapiens
gccactccctgccaac

SEQ ID NO: 6273548 - DNA, 20 bp, Homo sapiens
gccactccctgccaactcca

SEQ ID NO: 6273549 - DNA, 15 bp, Homo sapiens
gccactccctgggac

SEQ ID NO: 6273550 - DNA, 15 bp, Homo sapiens
gccactcctctgact

SEQ ID NO: 6273551 - DNA, 17 bp, Homo sapiens
gccactcctgtcccgcc

SEQ ID NO: 6273552 - DNA, 15 bp, Homo sapiens
gccactccttcctgc

SEQ ID NO: 6273553 - DNA, 22 bp, Homo sapiens
gccactccttccttcaggactc

SEQ ID NO: 6273554 - DNA, 12 bp, Homo sapiens
gccactccttgt

SEQ ID NO: 6273555 - DNA, 18 bp, Homo sapiens
gccactcgcagtcgcagg

SEQ ID NO: 6273556 - DNA, 22 bp, Homo sapiens
gccactcgcagtcgcaggatcc

SEQ ID NO: 6273557 - DNA, 16 bp, Homo sapiens
gccactcgccttctta

SEQ ID NO: 6273558 - DNA, 14 bp, Homo sapiens
gccactcgcttccc

SEQ ID NO: 6273559 - DNA, 18 bp, Homo sapiens
gccactcgcttcccccat

SEQ ID NO: 6273560 - DNA, 20 bp, Homo sapiens
gccactctaccagtgcaggc

SEQ ID NO: 6273561 - DNA, 22 bp, Homo sapiens
gccactctaccagtgcaggctg

SEQ ID NO: 6273562 - DNA, 13 bp, Homo sapiens
gccactctcagag

SEQ ID NO: 6273563 - DNA, 17 bp, Homo sapiens
gccactctcccctccct

SEQ ID NO: 6273564 - DNA, 13 bp, Homo sapiens
gccactctctgcc

SEQ ID NO: 6273565 - DNA, 14 bp, Homo sapiens
gccactctctgccc

SEQ ID NO: 6273566 - DNA, 19 bp, Homo sapiens
gccactctcttccctttcc

SEQ ID NO: 6273567 - DNA, 22 bp, Homo sapiens
gccactctgcctctgcctgcat

SEQ ID NO: 6273568 - DNA, 17 bp, Homo sapiens
gccactctgctctgcac

SEQ ID NO: 6273569 - DNA, 20 bp, Homo sapiens
gccactctgctctgcacatt

SEQ ID NO: 6273570 - DNA, 13 bp, Homo sapiens
gccactctgctgc

SEQ ID NO: 6273571 - DNA, 14 bp, Homo sapiens
gccactctgctgcc

SEQ ID NO: 6273572 - DNA, 16 bp, Homo sapiens
gccactctgctgcctg

SEQ ID NO: 6273573 - DNA, 22 bp, Homo sapiens
gccactctgctgcctgtacaga

SEQ ID NO: 6273574 - DNA, 13 bp, Homo sapiens
gccactctgttcc

SEQ ID NO: 6273575 - DNA, 13 bp, Homo sapiens
gccactcttccaa

SEQ ID NO: 6273576 - DNA, 20 bp, Homo sapiens
gccactgaaaagctttcctg

SEQ ID NO: 6273577 - DNA, 23 bp, Homo sapiens
gccactgaccgggatccagttcc

SEQ ID NO: 6273578 - DNA, 18 bp, Homo sapiens
gccactgacctcaccggc

SEQ ID NO: 6273579 - DNA, 16 bp, Homo sapiens
gccactgacttgctgt

SEQ ID NO: 6273580 - DNA, 18 bp, Homo sapiens
gccactgacttgctgtgt

SEQ ID NO: 6273581 - DNA, 15 bp, Homo sapiens
gccactgagcctggc

SEQ ID NO: 6273582 - DNA, 16 bp, Homo sapiens
gccactgagcctggcc

SEQ ID NO: 6273583 - DNA, 19 bp, Homo sapiens
gccactgagctggctgact

SEQ ID NO: 6273584 - DNA, 20 bp, Homo sapiens
gccactgagctggctgacta

SEQ ID NO: 6273585 - DNA, 19 bp, Homo sapiens
gccactgaggagacagaaa

SEQ ID NO: 6273586 - DNA, 22 bp, Homo sapiens
gccactgaggagacagaaagcc

SEQ ID NO: 6273587 - DNA, 15 bp, Homo sapiens
gccactgagtatgtt

SEQ ID NO: 6273588 - DNA, 19 bp, Homo sapiens
gccactgatggtgacaggt

SEQ ID NO: 6273589 - DNA, 13 bp, Homo sapiens
gccactgattctc

SEQ ID NO: 6273590 - DNA, 19 bp, Homo sapiens
gccactgcaaaccctgctg

SEQ ID NO: 6273591 - DNA, 22 bp, Homo sapiens
gccactgcacagagctctccag

SEQ ID NO: 6273592 - DNA, 17 bp, Homo sapiens
gccactgcaccgggcca

SEQ ID NO: 6273593 - DNA, 19 bp, Homo sapiens
gccactgcaccgggccaca

SEQ ID NO: 6273594 - DNA, 17 bp, Homo sapiens
gccactgcacctgacct

SEQ ID NO: 6273595 - DNA, 12 bp, Homo sapiens
gccactgcactc

SEQ ID NO: 6273596 - DNA, 19 bp, Homo sapiens
gccactgcactccaatctg

SEQ ID NO: 6273597 - DNA, 15 bp, Homo sapiens
gccactgcactccag

SEQ ID NO: 6273598 - DNA, 18 bp, Homo sapiens
gccactgcactccagcct

SEQ ID NO: 6273599 - DNA, 22 bp, Homo sapiens
gccactgcactccagcctgggc

SEQ ID NO: 6273600 - DNA, 19 bp, Homo sapiens
gccactgcactctagcctg

SEQ ID NO: 6273601 - DNA, 14 bp, Homo sapiens
gccactgcagcaca

SEQ ID NO: 6273602 - DNA, 15 bp, Homo sapiens
gccactgcagcacag

SEQ ID NO: 6273603 - DNA, 15 bp, Homo sapiens
gccactgcagtcacc

SEQ ID NO: 6273604 - DNA, 24 bp, Homo sapiens
gccactgcagtcacccctgtctgc

SEQ ID NO: 6273605 - DNA, 14 bp, Homo sapiens
gccactgccaagct

SEQ ID NO: 6273606 - DNA, 22 bp, Homo sapiens
gccactgccaagcttcctgtgc

SEQ ID NO: 6273607 - DNA, 13 bp, Homo sapiens
gccactgccactc

SEQ ID NO: 6273608 - DNA, 20 bp, Homo sapiens
gccactgccaggcacctggc

SEQ ID NO: 6273609 - DNA, 23 bp, Homo sapiens
gccactgccaggcacctggcctg

SEQ ID NO: 6273610 - DNA, 15 bp, Homo sapiens
gccactgccccccga

SEQ ID NO: 6273611 - DNA, 23 bp, Homo sapiens
gccactgccccccgaggctgcta

SEQ ID NO: 6273612 - DNA, 23 bp, Homo sapiens
gccactgccctctccacacccat

SEQ ID NO: 6273613 - DNA, 14 bp, Homo sapiens
gccactgccgccta

SEQ ID NO: 6273614 - DNA, 15 bp, Homo sapiens
gccactgcctctccc

SEQ ID NO: 6273615 - DNA, 13 bp, Homo sapiens
gccactgcctctt

SEQ ID NO: 6273616 - DNA, 20 bp, Homo sapiens
gccactgcctgcacctttcg

SEQ ID NO: 6273617 - DNA, 19 bp, Homo sapiens
gccactgcgcccagcctga

SEQ ID NO: 6273618 - DNA, 21 bp, Homo sapiens
gccactgcgggagctctgtat

SEQ ID NO: 6273619 - DNA, 22 bp, Homo sapiens
gccactgctccctaagccagcc

SEQ ID NO: 6273620 - DNA, 23 bp, Homo sapiens
gccactgctccctaagccagcct

SEQ ID NO: 6273621 - DNA, 13 bp, Homo sapiens
gccactgctgctt

SEQ ID NO: 6273622 - DNA, 15 bp, Homo sapiens
gccactgctggaggc

SEQ ID NO: 6273623 - DNA, 23 bp, Homo sapiens
gccactgcttttccctttgtgag

SEQ ID NO: 6273624 - DNA, 20 bp, Homo sapiens
gccactggaaacttttggga

SEQ ID NO: 6273625 - DNA, 23 bp, Homo sapiens
gccactggaaggaacatggagct

SEQ ID NO: 6273626 - DNA, 14 bp, Homo sapiens
gccactggaaggag

SEQ ID NO: 6273627 - DNA, 17 bp, Homo sapiens
gccactggccatctcca

SEQ ID NO: 6273628 - DNA, 11 bp, Homo sapiens
gccactggccc

SEQ ID NO: 6273629 - DNA, 15 bp, Homo sapiens
gccactggctgtgcc

SEQ ID NO: 6273630 - DNA, 19 bp, Homo sapiens
gccactgggacagctggct

SEQ ID NO: 6273631 - DNA, 19 bp, Homo sapiens
gccactgggacggctcctg

SEQ ID NO: 6273632 - DNA, 21 bp, Homo sapiens
gccactgggacggctcctgct

SEQ ID NO: 6273633 - DNA, 10 bp, Homo sapiens
gccactgggc

SEQ ID NO: 6273634 - DNA, 12 bp, Homo sapiens
gccactgggcac

SEQ ID NO: 6273635 - DNA, 15 bp, Homo sapiens
gccactgggcacctg

SEQ ID NO: 6273636 - DNA, 17 bp, Homo sapiens
gccactgggcacctgcg

SEQ ID NO: 6273637 - DNA, 22 bp, Homo sapiens
gccactgggcacctgcgcacag

SEQ ID NO: 6273638 - DNA, 18 bp, Homo sapiens
gccactgggccccattct

SEQ ID NO: 6273639 - DNA, 21 bp, Homo sapiens
gccactgggccccattctccc

SEQ ID NO: 6273640 - DNA, 17 bp, Homo sapiens
gccactgggcccctgtc

SEQ ID NO: 6273641 - DNA, 19 bp, Homo sapiens
gccactgggcccctgtccc

SEQ ID NO: 6273642 - DNA, 21 bp, Homo sapiens
gccactgggcccctgtcccca

SEQ ID NO: 6273643 - DNA, 23 bp, Homo sapiens
gccactgggcccctgtccccagt

SEQ ID NO: 6273644 - DNA, 18 bp, Homo sapiens
gccactgggctctggacc

SEQ ID NO: 6273645 - DNA, 18 bp, Homo sapiens
gccactggggctcagagc

SEQ ID NO: 6273646 - DNA, 18 bp, Homo sapiens
gccactggggtgggaggg

SEQ ID NO: 6273647 - DNA, 16 bp, Homo sapiens
gccactgtatttgtta

SEQ ID NO: 6273648 - DNA, 18 bp, Homo sapiens
gccactgtatttgttaat

SEQ ID NO: 6273649 - DNA, 14 bp, Homo sapiens
gccactgtcacagg

SEQ ID NO: 6273650 - DNA, 20 bp, Homo sapiens
gccactgtccctgtccttct

SEQ ID NO: 6273651 - DNA, 18 bp, Homo sapiens
gccactgtccgctgtctc

SEQ ID NO: 6273652 - DNA, 23 bp, Homo sapiens
gccactgtccgctgtctccctcc

SEQ ID NO: 6273653 - DNA, 20 bp, Homo sapiens
gccactgtgaaccggctccc

SEQ ID NO: 6273654 - DNA, 21 bp, Homo sapiens
gccactgtgaaccggctccca

SEQ ID NO: 6273655 - DNA, 18 bp, Homo sapiens
gccactgtgaagagaacc

SEQ ID NO: 6273656 - DNA, 12 bp, Homo sapiens
gccactgtgctt

SEQ ID NO: 6273657 - DNA, 13 bp, Homo sapiens
gccactgtggcca

SEQ ID NO: 6273658 - DNA, 19 bp, Homo sapiens
gccactgtggccagagctg

SEQ ID NO: 6273659 - DNA, 21 bp, Homo sapiens
gccactgtgtaacatagctga

SEQ ID NO: 6273660 - DNA, 14 bp, Homo sapiens
gccactgtgtgaat

SEQ ID NO: 6273661 - DNA, 15 bp, Homo sapiens
gccactgtgttcctt

SEQ ID NO: 6273662 - DNA, 20 bp, Homo sapiens
gccactgtgttccttccgct

SEQ ID NO: 6273663 - DNA, 19 bp, Homo sapiens
gccactgtgtttctgtgct

SEQ ID NO: 6273664 - DNA, 17 bp, Homo sapiens
gccactgttcagcggag

SEQ ID NO: 6273665 - DNA, 20 bp, Homo sapiens
gccactgttcagcggagctg

SEQ ID NO: 6273666 - DNA, 22 bp, Homo sapiens
gccactgttttgttggcccaca

SEQ ID NO: 6273667 - DNA, 17 bp, Homo sapiens
gccacttaaaaagactt

SEQ ID NO: 6273668 - DNA, 18 bp, Homo sapiens
gccacttaatgtatgtta

SEQ ID NO: 6273669 - DNA, 18 bp, Homo sapiens
gcttctcccacttggcca

SEQ ID NO: 6273670 - DNA, 19 bp, Homo sapiens
gcttctcccacttggccaa

SEQ ID NO: 6273671 - DNA, 15 bp, Homo sapiens
gcttctcccaggcaa

SEQ ID NO: 6273672 - DNA, 18 bp, Homo sapiens
gcttctcccaggcaaggc

SEQ ID NO: 6273673 - DNA, 23 bp, Homo sapiens
gcttctcccagtgtgagacccca

SEQ ID NO: 6273674 - DNA, 21 bp, Homo sapiens
gcttctcccatttcctgatct

SEQ ID NO: 6273675 - DNA, 15 bp, Homo sapiens
gcttctccccagaat

SEQ ID NO: 6273676 - DNA, 20 bp, Homo sapiens
gcttctccccagagctgcct

SEQ ID NO: 6273677 - DNA, 17 bp, Homo sapiens
gcttctccccccatccc

SEQ ID NO: 6273678 - DNA, 21 bp, Homo sapiens
gcttctccccccatcccaggg

SEQ ID NO: 6273679 - DNA, 16 bp, Homo sapiens
gcttctccccctcagc

SEQ ID NO: 6273680 - DNA, 13 bp, Homo sapiens
gcttctcccgcca

SEQ ID NO: 6273681 - DNA, 14 bp, Homo sapiens
gcttctcccgccat

SEQ ID NO: 6273682 - DNA, 18 bp, Homo sapiens
gcttctcccggacctgga

SEQ ID NO: 6273683 - DNA, 20 bp, Homo sapiens
gcttctcccggacctggact

SEQ ID NO: 6273684 - DNA, 15 bp, Homo sapiens
gcttctcccggggac

SEQ ID NO: 6273685 - DNA, 13 bp, Homo sapiens
gcttctccctggc

SEQ ID NO: 6273686 - DNA, 15 bp, Homo sapiens
gcttctccctgggga

SEQ ID NO: 6273687 - DNA, 16 bp, Homo sapiens
gcttctccctggggac

SEQ ID NO: 6273688 - DNA, 15 bp, Homo sapiens
gcttctccgccagcc

SEQ ID NO: 6273689 - DNA, 23 bp, Homo sapiens
gcttctccgccagcctcctctgg

SEQ ID NO: 6273690 - DNA, 24 bp, Homo sapiens
gcttctccgccagcctcctctgga

SEQ ID NO: 6273691 - DNA, 15 bp, Homo sapiens
gcttctcctcccagc

SEQ ID NO: 6273692 - DNA, 21 bp, Homo sapiens
gcttctcctctgctaggctac

SEQ ID NO: 6273693 - DNA, 12 bp, Homo sapiens
gcttctcctgac

SEQ ID NO: 6273694 - DNA, 13 bp, Homo sapiens
gcttctcctgcag

SEQ ID NO: 6273695 - DNA, 12 bp, Homo sapiens
gcttctcctgcg

SEQ ID NO: 6273696 - DNA, 13 bp, Homo sapiens
gcttctcctgcgc

SEQ ID NO: 6273697 - DNA, 20 bp, Homo sapiens
gcttctcctgcgccccgccc

SEQ ID NO: 6273698 - DNA, 15 bp, Homo sapiens
gcttctcctgtgacc

SEQ ID NO: 6273699 - DNA, 16 bp, Homo sapiens
gcttctcgacccacgc

SEQ ID NO: 6273700 - DNA, 16 bp, Homo sapiens
gcttctcggaggccag

SEQ ID NO: 6273701 - DNA, 19 bp, Homo sapiens
gcttctcggaggccaggcc

SEQ ID NO: 6273702 - DNA, 19 bp, Homo sapiens
gcttctcggggtccagtgc

SEQ ID NO: 6273703 - DNA, 23 bp, Homo sapiens
gcttctctatgataattacaata

SEQ ID NO: 6273704 - DNA, 14 bp, Homo sapiens
gcttctctcagcca

SEQ ID NO: 6273705 - DNA, 22 bp, Homo sapiens
gcttctctccgcgggtgggact

SEQ ID NO: 6273706 - DNA, 14 bp, Homo sapiens
gcttctctccttgc

SEQ ID NO: 6273707 - DNA, 17 bp, Homo sapiens
gcttctctctccctgtc

SEQ ID NO: 6273708 - DNA, 22 bp, Homo sapiens
gcttctctctccctgtcacaca

SEQ ID NO: 6273709 - DNA, 17 bp, Homo sapiens
gcttctctctctctcac

SEQ ID NO: 6273710 - DNA, 16 bp, Homo sapiens
gcttctctctgtggga

SEQ ID NO: 6273711 - DNA, 12 bp, Homo sapiens
gcttctctcttt

SEQ ID NO: 6273712 - DNA, 14 bp, Homo sapiens
gcttctctcttttc

SEQ ID NO: 6273713 - DNA, 21 bp, Homo sapiens
gcttctctgacttctgcctgg

SEQ ID NO: 6273714 - DNA, 11 bp, Homo sapiens
gcttctctgca

SEQ ID NO: 6273715 - DNA, 16 bp, Homo sapiens
gcttctctgcagtaaa

SEQ ID NO: 6273716 - DNA, 13 bp, Homo sapiens
gcttctctgggct

SEQ ID NO: 6273717 - DNA, 19 bp, Homo sapiens
gcttctctgtgactgatgt

SEQ ID NO: 6273718 - DNA, 15 bp, Homo sapiens
gcttctctgtgcagg

SEQ ID NO: 6273719 - DNA, 21 bp, Homo sapiens
gcttctctgtgcccctgtaaa

SEQ ID NO: 6273720 - DNA, 23 bp, Homo sapiens
gcttctctgtttttcttctgaaa

SEQ ID NO: 6273721 - DNA, 21 bp, Homo sapiens
gcttctcttctttattgcact

SEQ ID NO: 6273722 - DNA, 22 bp, Homo sapiens
gcttctcttctttattgcacta

SEQ ID NO: 6273723 - DNA, 16 bp, Homo sapiens
gcttctcttctttctg

SEQ ID NO: 6273724 - DNA, 21 bp, Homo sapiens
gcttctctttgtgcagtgtta

SEQ ID NO: 6273725 - DNA, 20 bp, Homo sapiens
gcttctcttttcctcgcaga

SEQ ID NO: 6273726 - DNA, 13 bp, Homo sapiens
gcttctcttttga

SEQ ID NO: 6273727 - DNA, 13 bp, Homo sapiens
gcttctgaactca

SEQ ID NO: 6273728 - DNA, 15 bp, Homo sapiens
gcttctgaagagcct

SEQ ID NO: 6273729 - DNA, 14 bp, Homo sapiens
gcttctgaatcact

SEQ ID NO: 6273730 - DNA, 17 bp, Homo sapiens
gcttctgaatgtgctga

SEQ ID NO: 6273731 - DNA, 15 bp, Homo sapiens
gcttctgacctcagc

SEQ ID NO: 6273732 - DNA, 16 bp, Homo sapiens
gcttctgacctcagca

SEQ ID NO: 6273733 - DNA, 21 bp, Homo sapiens
gcttctgagtttatattctga

SEQ ID NO: 6273734 - DNA, 18 bp, Homo sapiens
gcttctgatgaatcttgc

SEQ ID NO: 6273735 - DNA, 22 bp, Homo sapiens
gcttctgattatttgcagctgc

SEQ ID NO: 6273736 - DNA, 16 bp, Homo sapiens
gcttctgatttttctc

SEQ ID NO: 6273737 - DNA, 17 bp, Homo sapiens
gcttctgatttttctct

SEQ ID NO: 6273738 - DNA, 13 bp, Homo sapiens
gcttctgcaccct

SEQ ID NO: 6273739 - DNA, 15 bp, Homo sapiens
gcttctgcaccctcc

SEQ ID NO: 6273740 - DNA, 17 bp, Homo sapiens
gcttctgcaccctccac

SEQ ID NO: 6273741 - DNA, 18 bp, Homo sapiens
gcttctgccacttcccag

SEQ ID NO: 6273742 - DNA, 22 bp, Homo sapiens
gcttctgcccaccccgcctctg

SEQ ID NO: 6273743 - DNA, 18 bp, Homo sapiens
gcttctgcggggctgaga

SEQ ID NO: 6273744 - DNA, 22 bp, Homo sapiens
gcttctgcggtgaggcagggga

SEQ ID NO: 6273745 - DNA, 19 bp, Homo sapiens
gcttctgctcacattccct

SEQ ID NO: 6273746 - DNA, 15 bp, Homo sapiens
gcttctgctccagcc

SEQ ID NO: 6273747 - DNA, 11 bp, Homo sapiens
gcttctgctgc

SEQ ID NO: 6273748 - DNA, 16 bp, Homo sapiens
gcttctgctgcctagg

SEQ ID NO: 6273749 - DNA, 14 bp, Homo sapiens
gcttctgctgcctg

SEQ ID NO: 6273750 - DNA, 19 bp, Homo sapiens
gcttctgctgcctgtttgg

SEQ ID NO: 6273751 - DNA, 17 bp, Homo sapiens
gcttctgctgggctggg

SEQ ID NO: 6273752 - DNA, 22 bp, Homo sapiens
gcttctgctgggctggggcctg

SEQ ID NO: 6273753 - DNA, 15 bp, Homo sapiens
gcttctgctggggcc

SEQ ID NO: 6273754 - DNA, 18 bp, Homo sapiens
gcttctgctggggcctgg

SEQ ID NO: 6273755 - DNA, 22 bp, Homo sapiens
gcttctgctggggcctgggaca

SEQ ID NO: 6273756 - DNA, 13 bp, Homo sapiens
gcttctgcttcca

SEQ ID NO: 6273757 - DNA, 18 bp, Homo sapiens
gcttctggccaggaagct

SEQ ID NO: 6273758 - DNA, 18 bp, Homo sapiens
gcttctggctttgttctt

SEQ ID NO: 6273759 - DNA, 23 bp, Homo sapiens
gcttctgggtggctcctgccact

SEQ ID NO: 6273760 - DNA, 17 bp, Homo sapiens
gcttctggtactctcct

SEQ ID NO: 6273761 - DNA, 19 bp, Homo sapiens
gcttctggtactctcctag

SEQ ID NO: 6273762 - DNA, 20 bp, Homo sapiens
gcttctggttttcgaagact

SEQ ID NO: 6273763 - DNA, 14 bp, Homo sapiens
gcttctgtaccaca

SEQ ID NO: 6273764 - DNA, 19 bp, Homo sapiens
gcttctgtgaaaaacctga

SEQ ID NO: 6273765 - DNA, 18 bp, Homo sapiens
gcttctgtgatgagctga

SEQ ID NO: 6273766 - DNA, 17 bp, Homo sapiens
gcttctgtgcacctggg

SEQ ID NO: 6273767 - DNA, 20 bp, Homo sapiens
gcttctgtgcactagcctgt

SEQ ID NO: 6273768 - DNA, 17 bp, Homo sapiens
gcttctgtgtaccactt

SEQ ID NO: 6273769 - DNA, 22 bp, Homo sapiens
gcttctgtgtaccacttctgtg

SEQ ID NO: 6273770 - DNA, 12 bp, Homo sapiens
gcttctgtgtag

SEQ ID NO: 6273771 - DNA, 18 bp, Homo sapiens
gcttctgttctctgctga

SEQ ID NO: 6273772 - DNA, 18 bp, Homo sapiens
gcttctgttgctgcctca

SEQ ID NO: 6273773 - DNA, 15 bp, Homo sapiens
gcttctgttgtaata

SEQ ID NO: 6273774 - DNA, 17 bp, Homo sapiens
gcttcttaaaaactgtg

SEQ ID NO: 6273775 - DNA, 20 bp, Homo sapiens
gcttcttaaaaactgtgtat

SEQ ID NO: 6273776 - DNA, 24 bp, Homo sapiens
gcttcttaaaaactgtgtatcatt

SEQ ID NO: 6273777 - DNA, 14 bp, Homo sapiens
gcttcttaaatgag

SEQ ID NO: 6273778 - DNA, 19 bp, Homo sapiens
gcttcttaatataactgcc

SEQ ID NO: 6273779 - DNA, 19 bp, Homo sapiens
gcttcttaatcttttcaca

SEQ ID NO: 6273780 - DNA, 16 bp, Homo sapiens
gcttcttaattaattt

SEQ ID NO: 6273781 - DNA, 18 bp, Homo sapiens
gcttcttactattaagca

SEQ ID NO: 6273782 - DNA, 20 bp, Homo sapiens
gcttcttactattaagcagt

SEQ ID NO: 6273783 - DNA, 18 bp, Homo sapiens
gcttcttcaatggcacct

SEQ ID NO: 6273784 - DNA, 18 bp, Homo sapiens
gcttcttcacaggcactc

SEQ ID NO: 6273785 - DNA, 16 bp, Homo sapiens
gcttcttcagagactc

SEQ ID NO: 6273786 - DNA, 15 bp, Homo sapiens
gcttcttcagctgac

SEQ ID NO: 6273787 - DNA, 19 bp, Homo sapiens
gcttcttcatcttgacatg

SEQ ID NO: 6273788 - DNA, 15 bp, Homo sapiens
gcttcttccaggtgc

SEQ ID NO: 6273789 - DNA, 16 bp, Homo sapiens
gcttcttccaggtgcc

SEQ ID NO: 6273790 - DNA, 19 bp, Homo sapiens
gcttcttccaggtgcccag

SEQ ID NO: 6273791 - DNA, 13 bp, Homo sapiens
gcttcttccccag

SEQ ID NO: 6273792 - DNA, 15 bp, Homo sapiens
gcttcttcctaggtc

SEQ ID NO: 6273793 - DNA, 14 bp, Homo sapiens
gcttcttcctcctc

SEQ ID NO: 6273794 - DNA, 13 bp, Homo sapiens
gcttcttcctgga

SEQ ID NO: 6273795 - DNA, 15 bp, Homo sapiens
gcttcttcctggatg

SEQ ID NO: 6273796 - DNA, 14 bp, Homo sapiens
gcttcttccttctt

SEQ ID NO: 6273797 - DNA, 14 bp, Homo sapiens
gcttcttctcaggc

SEQ ID NO: 6273798 - DNA, 19 bp, Homo sapiens
gcttcttctcctatgtgta

SEQ ID NO: 6273799 - DNA, 15 bp, Homo sapiens
gcttcttctgaaaga

SEQ ID NO: 6273800 - DNA, 14 bp, Homo sapiens
gcttcttctgcccc

SEQ ID NO: 6273801 - DNA, 21 bp, Homo sapiens
gcttcttcttgtggagatttt

SEQ ID NO: 6273802 - DNA, 13 bp, Homo sapiens
gcttcttgcccct

SEQ ID NO: 6273803 - DNA, 17 bp, Homo sapiens
gcttcttgccccttggg

SEQ ID NO: 6273804 - DNA, 21 bp, Homo sapiens
gcttcttgccccttgggcctc

SEQ ID NO: 6273805 - DNA, 22 bp, Homo sapiens
gcttcttgccccttgggcctcc

SEQ ID NO: 6273806 - DNA, 23 bp, Homo sapiens
gcttcttgccccttgggcctccc

SEQ ID NO: 6273807 - DNA, 15 bp, Homo sapiens
gcttcttgcctctgt

SEQ ID NO: 6273808 - DNA, 16 bp, Homo sapiens
gcttcttgcctctgtg

SEQ ID NO: 6273809 - DNA, 17 bp, Homo sapiens
gcttcttgcctctgtgc

SEQ ID NO: 6273810 - DNA, 18 bp, Homo sapiens
gcttcttgcctctgtgct

SEQ ID NO: 6273811 - DNA, 14 bp, Homo sapiens
gcttcttggacctt

SEQ ID NO: 6273812 - DNA, 23 bp, Homo sapiens
gcttcttgggctgagtgcagcca

SEQ ID NO: 6273813 - DNA, 12 bp, Homo sapiens
gcttcttgtgaa

SEQ ID NO: 6273814 - DNA, 16 bp, Homo sapiens
gcttcttgtgtttgaa

SEQ ID NO: 6273815 - DNA, 22 bp, Homo sapiens
gcttctttactactgcaagttc

SEQ ID NO: 6273816 - DNA, 22 bp, Homo sapiens
gcttctttcaagggctttcctg

SEQ ID NO: 6273817 - DNA, 17 bp, Homo sapiens
gcttctttctcggtggc

SEQ ID NO: 6273818 - DNA, 16 bp, Homo sapiens
gcttctttctgctggc

SEQ ID NO: 6273819 - DNA, 12 bp, Homo sapiens
gcttctttcttt

SEQ ID NO: 6273820 - DNA, 18 bp, Homo sapiens
gcttctttctttgggaat

SEQ ID NO: 6273821 - DNA, 23 bp, Homo sapiens
gcttctttctttgggaatatttg

SEQ ID NO: 6273822 - DNA, 13 bp, Homo sapiens
gcttctttgccaa

SEQ ID NO: 6273823 - DNA, 17 bp, Homo sapiens
gcttctttgctttctcg

SEQ ID NO: 6273824 - DNA, 15 bp, Homo sapiens
gcttcttttagtcag

SEQ ID NO: 6273825 - DNA, 21 bp, Homo sapiens
gcttcttttagtcagaaatga

SEQ ID NO: 6273826 - DNA, 23 bp, Homo sapiens
gcttcttttagtcagaaatgatt

SEQ ID NO: 6273827 - DNA, 23 bp, Homo sapiens
gcttcttttagttgtatctcttt

SEQ ID NO: 6273828 - DNA, 23 bp, Homo sapiens
gcttcttttgccaactgaagcct

SEQ ID NO: 6273829 - DNA, 14 bp, Homo sapiens
gcttcttttggaaa

SEQ ID NO: 6273830 - DNA, 19 bp, Homo sapiens
gcttgaaaagctagtgtac

SEQ ID NO: 6273831 - DNA, 15 bp, Homo sapiens
gcttgaaattactgt

SEQ ID NO: 6273832 - DNA, 16 bp, Homo sapiens
gcttgaacacagtatt

SEQ ID NO: 6273833 - DNA, 23 bp, Homo sapiens
gcttgaacacagtattttcccaa

SEQ ID NO: 6273834 - DNA, 14 bp, Homo sapiens
gcttgaacccagga

SEQ ID NO: 6273835 - DNA, 15 bp, Homo sapiens
gcttgaacccaggag

SEQ ID NO: 6273836 - DNA, 20 bp, Homo sapiens
gcttgaacccaggaggtgga

SEQ ID NO: 6273837 - DNA, 15 bp, Homo sapiens
gcttgaacctgggaa

SEQ ID NO: 6273838 - DNA, 23 bp, Homo sapiens
gcttgaacctgggaggcagaggt

SEQ ID NO: 6273839 - DNA, 22 bp, Homo sapiens
gcttgaacttagatgttaaatg

SEQ ID NO: 6273840 - DNA, 21 bp, Homo sapiens
gcttgaagatcgttagtatct

SEQ ID NO: 6273841 - DNA, 22 bp, Homo sapiens
gcttgaagatcgttagtatcta

SEQ ID NO: 6273842 - DNA, 20 bp, Homo sapiens
gcttgaagccaaagaaaaat

SEQ ID NO: 6273843 - DNA, 18 bp, Homo sapiens
gcttgaaggaacagtgct

SEQ ID NO: 6273844 - DNA, 16 bp, Homo sapiens
gcttgaaggccctgct

SEQ ID NO: 6273845 - DNA, 18 bp, Homo sapiens
gcttgaagtaactgtgga

SEQ ID NO: 6273846 - DNA, 19 bp, Homo sapiens
gcttgaatcaggaggagat

SEQ ID NO: 6273847 - DNA, 19 bp, Homo sapiens
gccacttaatgtatgttac

SEQ ID NO: 6273848 - DNA, 21 bp, Homo sapiens
gccacttaccttcaataaagt

SEQ ID NO: 6273849 - DNA, 19 bp, Homo sapiens
gccacttcattccagcagc

SEQ ID NO: 6273850 - DNA, 20 bp, Homo sapiens
gccacttcattccagcagct

SEQ ID NO: 6273851 - DNA, 13 bp, Homo sapiens
gccacttcccagg

SEQ ID NO: 6273852 - DNA, 21 bp, Homo sapiens
gccacttccccctcttcttct

SEQ ID NO: 6273853 - DNA, 12 bp, Homo sapiens
gccacttccttt

SEQ ID NO: 6273854 - DNA, 16 bp, Homo sapiens
gccacttcggccaggt

SEQ ID NO: 6273855 - DNA, 13 bp, Homo sapiens
gccacttctaaga

SEQ ID NO: 6273856 - DNA, 21 bp, Homo sapiens
gccacttctcactcaccacta

SEQ ID NO: 6273857 - DNA, 24 bp, Homo sapiens
gccacttctcactcaccactacca

SEQ ID NO: 6273858 - DNA, 13 bp, Homo sapiens
gccacttctcccc

SEQ ID NO: 6273859 - DNA, 22 bp, Homo sapiens
gccacttctgcgggctccctcc

SEQ ID NO: 6273860 - DNA, 17 bp, Homo sapiens
gccacttctgtccatat

SEQ ID NO: 6273861 - DNA, 15 bp, Homo sapiens
gccacttgacattcc

SEQ ID NO: 6273862 - DNA, 17 bp, Homo sapiens
gccacttgacattcctt

SEQ ID NO: 6273863 - DNA, 20 bp, Homo sapiens
gccacttggccaccaggact

SEQ ID NO: 6273864 - DNA, 14 bp, Homo sapiens
gccacttggcccag

SEQ ID NO: 6273865 - DNA, 16 bp, Homo sapiens
gccacttggtttttgg

SEQ ID NO: 6273866 - DNA, 17 bp, Homo sapiens
gccactttaagagagaa

SEQ ID NO: 6273867 - DNA, 19 bp, Homo sapiens
gccactttacccacctaga

SEQ ID NO: 6273868 - DNA, 21 bp, Homo sapiens
gccactttcacgtggcctccg

SEQ ID NO: 6273869 - DNA, 17 bp, Homo sapiens
gccactttccaccaact

SEQ ID NO: 6273870 - DNA, 20 bp, Homo sapiens
gccactttgactcagaggct

SEQ ID NO: 6273871 - DNA, 21 bp, Homo sapiens
gccactttgactcagaggctg

SEQ ID NO: 6273872 - DNA, 23 bp, Homo sapiens
gccactttgcagacctgggactt

SEQ ID NO: 6273873 - DNA, 23 bp, Homo sapiens
gccacttttgactagggattcag

SEQ ID NO: 6273874 - DNA, 23 bp, Homo sapiens
gccacttttttttttaatctcca

SEQ ID NO: 6273875 - DNA, 20 bp, Homo sapiens
gccagaaaaacgtgttgcct

SEQ ID NO: 6273876 - DNA, 22 bp, Homo sapiens
gccagaaaaggcagccagatcc

SEQ ID NO: 6273877 - DNA, 22 bp, Homo sapiens
gccagaaacagtgggagccctg

SEQ ID NO: 6273878 - DNA, 20 bp, Homo sapiens
gccagaaaccttcctgctga

SEQ ID NO: 6273879 - DNA, 22 bp, Homo sapiens
gccagaaaggtgtgaggagaga

SEQ ID NO: 6273880 - DNA, 16 bp, Homo sapiens
gccagaaatgggcagt

SEQ ID NO: 6273881 - DNA, 22 bp, Homo sapiens
gccagaacacatggctgggcct

SEQ ID NO: 6273882 - DNA, 15 bp, Homo sapiens
gccagaaccccgagc

SEQ ID NO: 6273883 - DNA, 20 bp, Homo sapiens
gccagaacgtggctctgctg

SEQ ID NO: 6273884 - DNA, 16 bp, Homo sapiens
gccagaactctgtgtc

SEQ ID NO: 6273885 - DNA, 22 bp, Homo sapiens
gccagaagagcttgtcagcaag

SEQ ID NO: 6273886 - DNA, 20 bp, Homo sapiens
gccagaagatgaacagactg

SEQ ID NO: 6273887 - DNA, 21 bp, Homo sapiens
gccagaagctgagcaccaggg

SEQ ID NO: 6273888 - DNA, 13 bp, Homo sapiens
gccagaaggaagg

SEQ ID NO: 6273889 - DNA, 22 bp, Homo sapiens
gccagaaggagggcagagccat

SEQ ID NO: 6273890 - DNA, 23 bp, Homo sapiens
gccagaaggagggcagagccatg

SEQ ID NO: 6273891 - DNA, 17 bp, Homo sapiens
gccagaaggagggggac

SEQ ID NO: 6273892 - DNA, 24 bp, Homo sapiens
gccagaaggcaagatcagattaaa

SEQ ID NO: 6273893 - DNA, 19 bp, Homo sapiens
gccagaaggtgcaggggcc

SEQ ID NO: 6273894 - DNA, 21 bp, Homo sapiens
gccagaagtaccagactagat

SEQ ID NO: 6273895 - DNA, 18 bp, Homo sapiens
gccagaagtagctttgca

SEQ ID NO: 6273896 - DNA, 21 bp, Homo sapiens
gccagaagtttgtcaagtcaa

SEQ ID NO: 6273897 - DNA, 23 bp, Homo sapiens
gccagaatctcattactgcttca

SEQ ID NO: 6273898 - DNA, 22 bp, Homo sapiens
gccagaatcttcgtcctgcccc

SEQ ID NO: 6273899 - DNA, 16 bp, Homo sapiens
gccagaattctaccct

SEQ ID NO: 6273900 - DNA, 17 bp, Homo sapiens
gccagaattctaccctg

SEQ ID NO: 6273901 - DNA, 15 bp, Homo sapiens
gccagaatttcaaac

SEQ ID NO: 6273902 - DNA, 21 bp, Homo sapiens
gccagacaaataggagtgagt

SEQ ID NO: 6273903 - DNA, 16 bp, Homo sapiens
gccagacaacttctgt

SEQ ID NO: 6273904 - DNA, 17 bp, Homo sapiens
gccagacacaggccctc

SEQ ID NO: 6273905 - DNA, 17 bp, Homo sapiens
gccagacacaggccgtg

SEQ ID NO: 6273906 - DNA, 18 bp, Homo sapiens
gccagacacaggccgtgg

SEQ ID NO: 6273907 - DNA, 21 bp, Homo sapiens
gccagacacaggccgtgggac

SEQ ID NO: 6273908 - DNA, 12 bp, Homo sapiens
gccagacacatg

SEQ ID NO: 6273909 - DNA, 14 bp, Homo sapiens
gccagacacatggc

SEQ ID NO: 6273910 - DNA, 16 bp, Homo sapiens
gccagacacatggcta

SEQ ID NO: 6273911 - DNA, 15 bp, Homo sapiens
gccagacactctgct

SEQ ID NO: 6273912 - DNA, 19 bp, Homo sapiens
gccagacactctgctctgc

SEQ ID NO: 6273913 - DNA, 18 bp, Homo sapiens
gccagacagaccttcaca

SEQ ID NO: 6273914 - DNA, 21 bp, Homo sapiens
gccagaccaaggcgagtttcc

SEQ ID NO: 6273915 - DNA, 16 bp, Homo sapiens
gccagaccacgcccct

SEQ ID NO: 6273916 - DNA, 13 bp, Homo sapiens
gccagaccagagc

SEQ ID NO: 6273917 - DNA, 15 bp, Homo sapiens
gccagaccagagctc

SEQ ID NO: 6273918 - DNA, 17 bp, Homo sapiens
gccagaccagagctctg

SEQ ID NO: 6273919 - DNA, 19 bp, Homo sapiens
gccagaccagagctctgga

SEQ ID NO: 6273920 - DNA, 18 bp, Homo sapiens
gccagaccagcaggctgg

SEQ ID NO: 6273921 - DNA, 17 bp, Homo sapiens
gccagaccatggacact

SEQ ID NO: 6273922 - DNA, 15 bp, Homo sapiens
gccagacccactgaa

SEQ ID NO: 6273923 - DNA, 20 bp, Homo sapiens
gccagaccccacgctgacca

SEQ ID NO: 6273924 - DNA, 19 bp, Homo sapiens
gccagaccccgtggctctg

SEQ ID NO: 6273925 - DNA, 21 bp, Homo sapiens
gccagaccccgtggctctggg

SEQ ID NO: 6273926 - DNA, 13 bp, Homo sapiens
gccagaccgcaga

SEQ ID NO: 6273927 - DNA, 13 bp, Homo sapiens
gccagacctcaac

SEQ ID NO: 6273928 - DNA, 14 bp, Homo sapiens
gccagacctgcaga

SEQ ID NO: 6273929 - DNA, 19 bp, Homo sapiens
gccagaccttaataaaggc

SEQ ID NO: 6273930 - DNA, 22 bp, Homo sapiens
gccagacggcacccacccagca

SEQ ID NO: 6273931 - DNA, 14 bp, Homo sapiens
gccagactcccttg

SEQ ID NO: 6273932 - DNA, 17 bp, Homo sapiens
gccagactctaggttat

SEQ ID NO: 6273933 - DNA, 20 bp, Homo sapiens
gccagactctaggttataca

SEQ ID NO: 6273934 - DNA, 14 bp, Homo sapiens
gccagactggaaga

SEQ ID NO: 6273935 - DNA, 18 bp, Homo sapiens
gccagactggagtgcagt

SEQ ID NO: 6273936 - DNA, 18 bp, Homo sapiens
gccagactggcacagttt

SEQ ID NO: 6273937 - DNA, 21 bp, Homo sapiens
gccagactggctgcacagccc

SEQ ID NO: 6273938 - DNA, 23 bp, Homo sapiens
gccagactggctgcacagcccaa

SEQ ID NO: 6273939 - DNA, 13 bp, Homo sapiens
gccagactgtcca

SEQ ID NO: 6273940 - DNA, 17 bp, Homo sapiens
gccagactgtccaggga

SEQ ID NO: 6273941 - DNA, 21 bp, Homo sapiens
gccagacttcccacggctcct

SEQ ID NO: 6273942 - DNA, 14 bp, Homo sapiens
gccagacttctaaa

SEQ ID NO: 6273943 - DNA, 22 bp, Homo sapiens
gccagacttctaaaataaatgt

SEQ ID NO: 6273944 - DNA, 23 bp, Homo sapiens
gccagacttctaaaataaatgtt

SEQ ID NO: 6273945 - DNA, 22 bp, Homo sapiens
gccagacttgcttcctgcatgg

SEQ ID NO: 6273946 - DNA, 12 bp, Homo sapiens
gccagagaaact

SEQ ID NO: 6273947 - DNA, 21 bp, Homo sapiens
gccagagaaagttggtgctgc

SEQ ID NO: 6273948 - DNA, 18 bp, Homo sapiens
gccagagaacccagccca

SEQ ID NO: 6273949 - DNA, 16 bp, Homo sapiens
gccagagaagataatg

SEQ ID NO: 6273950 - DNA, 15 bp, Homo sapiens
gccagagaagtgaca

SEQ ID NO: 6273951 - DNA, 17 bp, Homo sapiens
gccagagaagtgacagg

SEQ ID NO: 6273952 - DNA, 23 bp, Homo sapiens
gccagagaatagatcagtatttc

SEQ ID NO: 6273953 - DNA, 19 bp, Homo sapiens
gccagagacacaagccttc

SEQ ID NO: 6273954 - DNA, 12 bp, Homo sapiens
gccagagacata

SEQ ID NO: 6273955 - DNA, 14 bp, Homo sapiens
gccagagagcaggg

SEQ ID NO: 6273956 - DNA, 19 bp, Homo sapiens
gccagagagcaggggagct

SEQ ID NO: 6273957 - DNA, 21 bp, Homo sapiens
gccagagagcctggtgctgct

SEQ ID NO: 6273958 - DNA, 12 bp, Homo sapiens
gccagagaggag

SEQ ID NO: 6273959 - DNA, 17 bp, Homo sapiens
gccagagaggagcacct

SEQ ID NO: 6273960 - DNA, 18 bp, Homo sapiens
gccagagaggagcacctg

SEQ ID NO: 6273961 - DNA, 15 bp, Homo sapiens
gccagagagggccca

SEQ ID NO: 6273962 - DNA, 22 bp, Homo sapiens
gccagagatccaaaagaagccc

SEQ ID NO: 6273963 - DNA, 18 bp, Homo sapiens
gccagagcaaacagaaaa

SEQ ID NO: 6273964 - DNA, 11 bp, Homo sapiens
gccagagcacc

SEQ ID NO: 6273965 - DNA, 17 bp, Homo sapiens
gccagagcacctcagga

SEQ ID NO: 6273966 - DNA, 14 bp, Homo sapiens
gccagagcagctcc

SEQ ID NO: 6273967 - DNA, 18 bp, Homo sapiens
gccagagcaggagcccct

SEQ ID NO: 6273968 - DNA, 22 bp, Homo sapiens
gccagagccaaggggcttcagg

SEQ ID NO: 6273969 - DNA, 19 bp, Homo sapiens
gccagagccatgccaggct

SEQ ID NO: 6273970 - DNA, 17 bp, Homo sapiens
gccagagcccaagtgcc

SEQ ID NO: 6273971 - DNA, 20 bp, Homo sapiens
gccagagcccaagtgccatc

SEQ ID NO: 6273972 - DNA, 21 bp, Homo sapiens
gccagagcccaagtgccatcc

SEQ ID NO: 6273973 - DNA, 24 bp, Homo sapiens
gccagagcccactccatctggtag

SEQ ID NO: 6273974 - DNA, 20 bp, Homo sapiens
gccagagcccttcactgcca

SEQ ID NO: 6273975 - DNA, 14 bp, Homo sapiens
gccagagcctctgg

SEQ ID NO: 6273976 - DNA, 15 bp, Homo sapiens
gccagagcctctggc

SEQ ID NO: 6273977 - DNA, 13 bp, Homo sapiens
gccagagcctggg

SEQ ID NO: 6273978 - DNA, 23 bp, Homo sapiens
gccagagcctgtggccccgaggc

SEQ ID NO: 6273979 - DNA, 15 bp, Homo sapiens
gccagagccttggag

SEQ ID NO: 6273980 - DNA, 15 bp, Homo sapiens
gccagagctagggct

SEQ ID NO: 6273981 - DNA, 17 bp, Homo sapiens
gccagagctagggctgc

SEQ ID NO: 6273982 - DNA, 16 bp, Homo sapiens
gccagagctcccagga

SEQ ID NO: 6273983 - DNA, 18 bp, Homo sapiens
gccagagctcccaggacg

SEQ ID NO: 6273984 - DNA, 19 bp, Homo sapiens
gccagagctgaaccttgag

SEQ ID NO: 6273985 - DNA, 14 bp, Homo sapiens
gccagagctggaag

SEQ ID NO: 6273986 - DNA, 17 bp, Homo sapiens
gccagagctggaaggca

SEQ ID NO: 6273987 - DNA, 20 bp, Homo sapiens
gccagagctggaaggcaggg

SEQ ID NO: 6273988 - DNA, 23 bp, Homo sapiens
gccagagctggaaggcagggcag

SEQ ID NO: 6273989 - DNA, 15 bp, Homo sapiens
gccagagctgggagg

SEQ ID NO: 6273990 - DNA, 14 bp, Homo sapiens
gccagagctgggtg

SEQ ID NO: 6273991 - DNA, 23 bp, Homo sapiens
gccagagctgtgcctgctcagca

SEQ ID NO: 6273992 - DNA, 20 bp, Homo sapiens
gccagaggaactgtccagag

SEQ ID NO: 6273993 - DNA, 21 bp, Homo sapiens
gccagaggaactgtccagaga

SEQ ID NO: 6273994 - DNA, 24 bp, Homo sapiens
gccagaggaactgtccagagagca

SEQ ID NO: 6273995 - DNA, 20 bp, Homo sapiens
gccagaggaagggaggcctg

SEQ ID NO: 6273996 - DNA, 21 bp, Homo sapiens
gccagaggaagggaggcctga

SEQ ID NO: 6273997 - DNA, 23 bp, Homo sapiens
gccagaggaagggaggcctgagg

SEQ ID NO: 6273998 - DNA, 24 bp, Homo sapiens
gccagaggaatcctggcagcccag

SEQ ID NO: 6273999 - DNA, 18 bp, Homo sapiens
gccagaggacaaggaagt

SEQ ID NO: 6274000 - DNA, 19 bp, Homo sapiens
gccagaggacaaggaagtg

SEQ ID NO: 6274001 - DNA, 12 bp, Homo sapiens
gccagaggacca

SEQ ID NO: 6274002 - DNA, 19 bp, Homo sapiens
gccagaggaccaatgcttg

SEQ ID NO: 6274003 - DNA, 10 bp, Homo sapiens
gccagaggag

SEQ ID NO: 6274004 - DNA, 13 bp, Homo sapiens
gccagaggagaga

SEQ ID NO: 6274005 - DNA, 17 bp, Homo sapiens
gccagaggagagaggac

SEQ ID NO: 6274006 - DNA, 15 bp, Homo sapiens
gccagaggatcacca

SEQ ID NO: 6274007 - DNA, 23 bp, Homo sapiens
gccagaggcagaaccctggtgag

SEQ ID NO: 6274008 - DNA, 15 bp, Homo sapiens
gccagaggcccccag

SEQ ID NO: 6274009 - DNA, 24 bp, Homo sapiens
gccagaggcccccagcccagggct

SEQ ID NO: 6274010 - DNA, 23 bp, Homo sapiens
gccagaggccctcggtcagcgac

SEQ ID NO: 6274011 - DNA, 17 bp, Homo sapiens
gccagaggccctggagg

SEQ ID NO: 6274012 - DNA, 13 bp, Homo sapiens
gccagaggcctgg

SEQ ID NO: 6274013 - DNA, 12 bp, Homo sapiens
gccagaggctgg

SEQ ID NO: 6274014 - DNA, 20 bp, Homo sapiens
gccagaggctgggagtccct

SEQ ID NO: 6274015 - DNA, 17 bp, Homo sapiens
gccagagggagtgacag

SEQ ID NO: 6274016 - DNA, 11 bp, Homo sapiens
gccagagggcc

SEQ ID NO: 6274017 - DNA, 14 bp, Homo sapiens
gccagagggccagc

SEQ ID NO: 6274018 - DNA, 19 bp, Homo sapiens
gccagagggccagcaggct

SEQ ID NO: 6274019 - DNA, 15 bp, Homo sapiens
gccagagggcccctc

SEQ ID NO: 6274020 - DNA, 19 bp, Homo sapiens
gccagagggcttgtgaaca

SEQ ID NO: 6274021 - DNA, 14 bp, Homo sapiens
gccagaggggaagg

SEQ ID NO: 6274022 - DNA, 13 bp, Homo sapiens
gccagagggtggg

SEQ ID NO: 6274023 - DNA, 11 bp, Homo sapiens
gcttgaatgct

SEQ ID NO: 6274024 - DNA, 20 bp, Homo sapiens
gcttgacacctgtcttgaat

SEQ ID NO: 6274025 - DNA, 15 bp, Homo sapiens
gcttgacaggacagc

SEQ ID NO: 6274026 - DNA, 12 bp, Homo sapiens
gcttgaccagac

SEQ ID NO: 6274027 - DNA, 21 bp, Homo sapiens
gcttgaccagacctagacctg

SEQ ID NO: 6274028 - DNA, 22 bp, Homo sapiens
gcttgaccagacctagacctgg

SEQ ID NO: 6274029 - DNA, 19 bp, Homo sapiens
gcttgaccagtataaaatt

SEQ ID NO: 6274030 - DNA, 19 bp, Homo sapiens
gcttgaccatgttgcactg

SEQ ID NO: 6274031 - DNA, 22 bp, Homo sapiens
gcttgaccgtactctcacatgt

SEQ ID NO: 6274032 - DNA, 16 bp, Homo sapiens
gcttgaccgtgaggcc

SEQ ID NO: 6274033 - DNA, 17 bp, Homo sapiens
gcttgaccgtgaggcca

SEQ ID NO: 6274034 - DNA, 19 bp, Homo sapiens
gcttgaccgtgaggccaga

SEQ ID NO: 6274035 - DNA, 20 bp, Homo sapiens
gcttgactatcacatacaat

SEQ ID NO: 6274036 - DNA, 14 bp, Homo sapiens
gcttgactctcact

SEQ ID NO: 6274037 - DNA, 18 bp, Homo sapiens
gcttgactttccagaatg

SEQ ID NO: 6274038 - DNA, 21 bp, Homo sapiens
gcttgagagccctgaggccta

SEQ ID NO: 6274039 - DNA, 14 bp, Homo sapiens
gcttgagagctcag

SEQ ID NO: 6274040 - DNA, 15 bp, Homo sapiens
gcttgagccaggagg

SEQ ID NO: 6274041 - DNA, 17 bp, Homo sapiens
gcttgagcccaggagtt

SEQ ID NO: 6274042 - DNA, 18 bp, Homo sapiens
gcttgagccgggcccctg

SEQ ID NO: 6274043 - DNA, 21 bp, Homo sapiens
gcttgagccgggcccctgggc

SEQ ID NO: 6274044 - DNA, 22 bp, Homo sapiens
gcttgagccgggcccctgggct

SEQ ID NO: 6274045 - DNA, 12 bp, Homo sapiens
gcttgagcctcc

SEQ ID NO: 6274046 - DNA, 18 bp, Homo sapiens
gcttgagcctggctgtcc

SEQ ID NO: 6274047 - DNA, 14 bp, Homo sapiens
gcttgagctagaga

SEQ ID NO: 6274048 - DNA, 13 bp, Homo sapiens
gcttgagctcagg

SEQ ID NO: 6274049 - DNA, 19 bp, Homo sapiens
gcttgagctcccctggagc

SEQ ID NO: 6274050 - DNA, 16 bp, Homo sapiens
gcttgagctttctgtg

SEQ ID NO: 6274051 - DNA, 15 bp, Homo sapiens
gcttgaggaggggca

SEQ ID NO: 6274052 - DNA, 23 bp, Homo sapiens
gcttgaggaggggcacctgccac

SEQ ID NO: 6274053 - DNA, 15 bp, Homo sapiens
gcttgaggctgaata

SEQ ID NO: 6274054 - DNA, 13 bp, Homo sapiens
gcttgagggacaa

SEQ ID NO: 6274055 - DNA, 19 bp, Homo sapiens
gcttgagggagggctgggc

SEQ ID NO: 6274056 - DNA, 14 bp, Homo sapiens
gcttgagtctcaag

SEQ ID NO: 6274057 - DNA, 14 bp, Homo sapiens
gcttgagtggacag

SEQ ID NO: 6274058 - DNA, 15 bp, Homo sapiens
gcttgagtggacagc

SEQ ID NO: 6274059 - DNA, 18 bp, Homo sapiens
gcttgagtggacagcagc

SEQ ID NO: 6274060 - DNA, 16 bp, Homo sapiens
gcttgagttctgcact

SEQ ID NO: 6274061 - DNA, 20 bp, Homo sapiens
gcttgatagaaatgccaagc

SEQ ID NO: 6274062 - DNA, 11 bp, Homo sapiens
gcttgatctat

SEQ ID NO: 6274063 - DNA, 16 bp, Homo sapiens
gcttgatctatctaca

SEQ ID NO: 6274064 - DNA, 19 bp, Homo sapiens
gcttgatctatctacaaag

SEQ ID NO: 6274065 - DNA, 13 bp, Homo sapiens
gcttgatctgtga

SEQ ID NO: 6274066 - DNA, 19 bp, Homo sapiens
gcttgatctgtgatttctt

SEQ ID NO: 6274067 - DNA, 14 bp, Homo sapiens
gcttgatgaagcaa

SEQ ID NO: 6274068 - DNA, 14 bp, Homo sapiens
gcttgatgctgttt

SEQ ID NO: 6274069 - DNA, 24 bp, Homo sapiens
gcttgatggaagtgggccagtcct

SEQ ID NO: 6274070 - DNA, 20 bp, Homo sapiens
gcttgatgggattctggaca

SEQ ID NO: 6274071 - DNA, 13 bp, Homo sapiens
gcttgattaaatc

SEQ ID NO: 6274072 - DNA, 18 bp, Homo sapiens
gcttgatttgatctttgt

SEQ ID NO: 6274073 - DNA, 13 bp, Homo sapiens
gcttgattttaat

SEQ ID NO: 6274074 - DNA, 22 bp, Homo sapiens
gcttgattttcctaatggtctc

SEQ ID NO: 6274075 - DNA, 12 bp, Homo sapiens
gcttgcaagaag

SEQ ID NO: 6274076 - DNA, 19 bp, Homo sapiens
gcttgcaatctaatctgaa

SEQ ID NO: 6274077 - DNA, 20 bp, Homo sapiens
gcttgcaatctaatctgaac

SEQ ID NO: 6274078 - DNA, 15 bp, Homo sapiens
gcttgcaccttttca

SEQ ID NO: 6274079 - DNA, 18 bp, Homo sapiens
gcttgcactctcttggct

SEQ ID NO: 6274080 - DNA, 19 bp, Homo sapiens
gcttgcactttgtaacatg

SEQ ID NO: 6274081 - DNA, 22 bp, Homo sapiens
gcttgcactttgtaacatgttt

SEQ ID NO: 6274082 - DNA, 14 bp, Homo sapiens
gcttgcagccagga

SEQ ID NO: 6274083 - DNA, 22 bp, Homo sapiens
gcttgcagccaggagaaggtca

SEQ ID NO: 6274084 - DNA, 22 bp, Homo sapiens
gcttgcaggaggccaaactgtc

SEQ ID NO: 6274085 - DNA, 13 bp, Homo sapiens
gcttgcagggaca

SEQ ID NO: 6274086 - DNA, 21 bp, Homo sapiens
gcttgcagtagattttcttta

SEQ ID NO: 6274087 - DNA, 18 bp, Homo sapiens
gcttgcatcacttggggt

SEQ ID NO: 6274088 - DNA, 16 bp, Homo sapiens
gcttgcatggagaatg

SEQ ID NO: 6274089 - DNA, 12 bp, Homo sapiens
gcttgcattaaa

SEQ ID NO: 6274090 - DNA, 16 bp, Homo sapiens
gcttgccacagagcgg

SEQ ID NO: 6274091 - DNA, 13 bp, Homo sapiens
gcttgccagaggc

SEQ ID NO: 6274092 - DNA, 13 bp, Homo sapiens
gcttgccagccag

SEQ ID NO: 6274093 - DNA, 14 bp, Homo sapiens
gcttgccagccagg

SEQ ID NO: 6274094 - DNA, 15 bp, Homo sapiens
gcttgccagccagga

SEQ ID NO: 6274095 - DNA, 19 bp, Homo sapiens
gcttgccagggatgggcag

SEQ ID NO: 6274096 - DNA, 18 bp, Homo sapiens
gcttgccatttttcaaaa

SEQ ID NO: 6274097 - DNA, 22 bp, Homo sapiens
gcttgcccaagtcacacagcta

SEQ ID NO: 6274098 - DNA, 13 bp, Homo sapiens
gcttgcccaggag

SEQ ID NO: 6274099 - DNA, 14 bp, Homo sapiens
gcttgcccaggagc

SEQ ID NO: 6274100 - DNA, 13 bp, Homo sapiens
gcttgcccccgct

SEQ ID NO: 6274101 - DNA, 12 bp, Homo sapiens
gcttgccccggc

SEQ ID NO: 6274102 - DNA, 14 bp, Homo sapiens
gcttgccccggccc

SEQ ID NO: 6274103 - DNA, 15 bp, Homo sapiens
gcttgcccctgtggc

SEQ ID NO: 6274104 - DNA, 23 bp, Homo sapiens
gcttgccctaagcagaaagtgcc

SEQ ID NO: 6274105 - DNA, 19 bp, Homo sapiens
gcttgccctggtgcctcac

SEQ ID NO: 6274106 - DNA, 20 bp, Homo sapiens
gcttgccgaaactggaagtt

SEQ ID NO: 6274107 - DNA, 18 bp, Homo sapiens
gcttgccgggcctgggcc

SEQ ID NO: 6274108 - DNA, 19 bp, Homo sapiens
gcttgcctcggctcctgct

SEQ ID NO: 6274109 - DNA, 20 bp, Homo sapiens
gcttgcctcggctcctgctg

SEQ ID NO: 6274110 - DNA, 22 bp, Homo sapiens
gcttgcctcggctcctgctgca

SEQ ID NO: 6274111 - DNA, 23 bp, Homo sapiens
gcttgcctcggctcctgctgcac

SEQ ID NO: 6274112 - DNA, 13 bp, Homo sapiens
gcttgcctgcagg

SEQ ID NO: 6274113 - DNA, 15 bp, Homo sapiens
gcttgcctgcctgcc

SEQ ID NO: 6274114 - DNA, 18 bp, Homo sapiens
gcttgcctgcctgcctgt

SEQ ID NO: 6274115 - DNA, 12 bp, Homo sapiens
gcttgcctggga

SEQ ID NO: 6274116 - DNA, 22 bp, Homo sapiens
gcttgcctgggacggctgagct

SEQ ID NO: 6274117 - DNA, 14 bp, Homo sapiens
gcttgcctgggctg

SEQ ID NO: 6274118 - DNA, 19 bp, Homo sapiens
gcttgcctgggctgggcag

SEQ ID NO: 6274119 - DNA, 20 bp, Homo sapiens
gcttgcctgggctgggcagc

SEQ ID NO: 6274120 - DNA, 21 bp, Homo sapiens
gcttgcctggtgggggaaggg

SEQ ID NO: 6274121 - DNA, 11 bp, Homo sapiens
gcttgcctgtt

SEQ ID NO: 6274122 - DNA, 16 bp, Homo sapiens
gcttgcgaactagaga

SEQ ID NO: 6274123 - DNA, 22 bp, Homo sapiens
gcttgcgccgagaccgcagagg

SEQ ID NO: 6274124 - DNA, 23 bp, Homo sapiens
gcttgcgccgagaccgcagaggg

SEQ ID NO: 6274125 - DNA, 18 bp, Homo sapiens
gcttgcggcaaaaggaaa

SEQ ID NO: 6274126 - DNA, 19 bp, Homo sapiens
gcttgcgtagaattgcagg

SEQ ID NO: 6274127 - DNA, 15 bp, Homo sapiens
gcttgcgtgctggga

SEQ ID NO: 6274128 - DNA, 16 bp, Homo sapiens
gcttgcgtgctgggac

SEQ ID NO: 6274129 - DNA, 16 bp, Homo sapiens
gcttgctagctatgtg

SEQ ID NO: 6274130 - DNA, 22 bp, Homo sapiens
gcttgctagctatgtgaccttg

SEQ ID NO: 6274131 - DNA, 20 bp, Homo sapiens
gcttgctattctgtccctag

SEQ ID NO: 6274132 - DNA, 14 bp, Homo sapiens
gcttgctcattttt

SEQ ID NO: 6274133 - DNA, 12 bp, Homo sapiens
gcttgctccaga

SEQ ID NO: 6274134 - DNA, 20 bp, Homo sapiens
gcttgctccagattctgatg

SEQ ID NO: 6274135 - DNA, 13 bp, Homo sapiens
gcttgctccaggg

SEQ ID NO: 6274136 - DNA, 14 bp, Homo sapiens
gcttgctccagggt

SEQ ID NO: 6274137 - DNA, 14 bp, Homo sapiens
gcttgctcccaagc

SEQ ID NO: 6274138 - DNA, 15 bp, Homo sapiens
gcttgctcccaagcc

SEQ ID NO: 6274139 - DNA, 21 bp, Homo sapiens
gcttgctcccaagcccctgac

SEQ ID NO: 6274140 - DNA, 15 bp, Homo sapiens
gcttgctcctaagca

SEQ ID NO: 6274141 - DNA, 15 bp, Homo sapiens
gcttgctcgcttgct

SEQ ID NO: 6274142 - DNA, 14 bp, Homo sapiens
gcttgctctcctgg

SEQ ID NO: 6274143 - DNA, 16 bp, Homo sapiens
gcttgctctcctggag

SEQ ID NO: 6274144 - DNA, 17 bp, Homo sapiens
gcttgctctcctggagc

SEQ ID NO: 6274145 - DNA, 20 bp, Homo sapiens
gcttgctctcctggagcaag

SEQ ID NO: 6274146 - DNA, 19 bp, Homo sapiens
gcttgctctgtttgtgggg

SEQ ID NO: 6274147 - DNA, 13 bp, Homo sapiens
gcttgctgagagg

SEQ ID NO: 6274148 - DNA, 23 bp, Homo sapiens
gcttgctgaggggcagggagagc

SEQ ID NO: 6274149 - DNA, 20 bp, Homo sapiens
gcttgctgatggctgctgga

SEQ ID NO: 6274150 - DNA, 12 bp, Homo sapiens
gcttgctgcacc

SEQ ID NO: 6274151 - DNA, 19 bp, Homo sapiens
gcttgctggaacacagggg

SEQ ID NO: 6274152 - DNA, 11 bp, Homo sapiens
gcttgctggcc

SEQ ID NO: 6274153 - DNA, 12 bp, Homo sapiens
gcttgctggctt

SEQ ID NO: 6274154 - DNA, 14 bp, Homo sapiens
gcttgctgggcttt

SEQ ID NO: 6274155 - DNA, 17 bp, Homo sapiens
gcttgctgggctttggg

SEQ ID NO: 6274156 - DNA, 21 bp, Homo sapiens
gcttgcttagagtgcccagca

SEQ ID NO: 6274157 - DNA, 22 bp, Homo sapiens
gcttgcttagagtgcccagcag

SEQ ID NO: 6274158 - DNA, 17 bp, Homo sapiens
gcttgcttatgtgtagg

SEQ ID NO: 6274159 - DNA, 20 bp, Homo sapiens
gcttgcttatgtgtaggtga

SEQ ID NO: 6274160 - DNA, 12 bp, Homo sapiens
gcttgcttgcag

SEQ ID NO: 6274161 - DNA, 14 bp, Homo sapiens
gcttgcttgtcttt

SEQ ID NO: 6274162 - DNA, 20 bp, Homo sapiens
gcttgctttcttctcctgtg

SEQ ID NO: 6274163 - DNA, 23 bp, Homo sapiens
gcttgcttttcatgcaaactctt

SEQ ID NO: 6274164 - DNA, 13 bp, Homo sapiens
gcttgcttttgcc

SEQ ID NO: 6274165 - DNA, 21 bp, Homo sapiens
gcttggaaagcatcacctcag

SEQ ID NO: 6274166 - DNA, 15 bp, Homo sapiens
gcttggaaccagtgt

SEQ ID NO: 6274167 - DNA, 15 bp, Homo sapiens
gcttggaatgggaga

SEQ ID NO: 6274168 - DNA, 16 bp, Homo sapiens
gcttggaccagatcta

SEQ ID NO: 6274169 - DNA, 16 bp, Homo sapiens
gcttggacggctgggc

SEQ ID NO: 6274170 - DNA, 15 bp, Homo sapiens
gcttggactacacaa

SEQ ID NO: 6274171 - DNA, 22 bp, Homo sapiens
gcttggactacctataaatgga

SEQ ID NO: 6274172 - DNA, 17 bp, Homo sapiens
gcttggacttcctgggg

SEQ ID NO: 6274173 - DNA, 23 bp, Homo sapiens
gcttggagacccacaaagagagt

SEQ ID NO: 6274174 - DNA, 21 bp, Homo sapiens
gcttggagaggtatgtgcccc

SEQ ID NO: 6274175 - DNA, 20 bp, Homo sapiens
gcttggagcagagacggcag

SEQ ID NO: 6274176 - DNA, 21 bp, Homo sapiens
gcttggagcagagacggcagc

SEQ ID NO: 6274177 - DNA, 12 bp, Homo sapiens
gcttggagcccc

SEQ ID NO: 6274178 - DNA, 17 bp, Homo sapiens
gcttggagccccctggc

SEQ ID NO: 6274179 - DNA, 20 bp, Homo sapiens
gcttggagccccctggcggc

SEQ ID NO: 6274180 - DNA, 22 bp, Homo sapiens
gcttggagccccctggcggcag

SEQ ID NO: 6274181 - DNA, 14 bp, Homo sapiens
gcttggaggaagga

SEQ ID NO: 6274182 - DNA, 15 bp, Homo sapiens
gcttggaggaaggaa

SEQ ID NO: 6274183 - DNA, 11 bp, Homo sapiens
gcttggaggag

SEQ ID NO: 6274184 - DNA, 12 bp, Homo sapiens
gcttggaggagg

SEQ ID NO: 6274185 - DNA, 13 bp, Homo sapiens
gcttggaggcctc

SEQ ID NO: 6274186 - DNA, 16 bp, Homo sapiens
gcttggaggcctcaga

SEQ ID NO: 6274187 - DNA, 18 bp, Homo sapiens
gcttggagggggaagaga

SEQ ID NO: 6274188 - DNA, 18 bp, Homo sapiens
gcttggaggtcacagctg

SEQ ID NO: 6274189 - DNA, 14 bp, Homo sapiens
gcttggagtgcccc

SEQ ID NO: 6274190 - DNA, 17 bp, Homo sapiens
gcttggagtgccccaag

SEQ ID NO: 6274191 - DNA, 23 bp, Homo sapiens
gcttggatttcgtgtgccgctgc

SEQ ID NO: 6274192 - DNA, 13 bp, Homo sapiens
gcttggcagccga

SEQ ID NO: 6274193 - DNA, 13 bp, Homo sapiens
gcttggcagctga

SEQ ID NO: 6274194 - DNA, 15 bp, Homo sapiens
gcttggcatctgtgt

SEQ ID NO: 6274195 - DNA, 16 bp, Homo sapiens
gcttggcatctgtgtg

SEQ ID NO: 6274196 - DNA, 20 bp, Homo sapiens
gcttggcatctgtgtgcgtg

SEQ ID NO: 6274197 - DNA, 13 bp, Homo sapiens
gcttggccagaag

SEQ ID NO: 6274198 - DNA, 18 bp, Homo sapiens
gcttggccagaagggggc

SEQ ID NO: 6274199 - DNA, 16 bp, Homo sapiens
gcttggccagcgctgt

SEQ ID NO: 6274200 - DNA, 22 bp, Homo sapiens
gcttggcccaggagtttggcca

SEQ ID NO: 6274201 - DNA, 14 bp, Homo sapiens
gcttggcccagggg

SEQ ID NO: 6274202 - DNA, 16 bp, Homo sapiens
gcttggcccgcggcct

SEQ ID NO: 6274203 - DNA, 17 bp, Homo sapiens
gcttggcccggccggcc

SEQ ID NO: 6274204 - DNA, 12 bp, Homo sapiens
gccagaggtggg

SEQ ID NO: 6274205 - DNA, 19 bp, Homo sapiens
gccagaggtgggcaggtgg

SEQ ID NO: 6274206 - DNA, 20 bp, Homo sapiens
gccagaggtgggcaggtggt

SEQ ID NO: 6274207 - DNA, 11 bp, Homo sapiens
gccagagtcaa

SEQ ID NO: 6274208 - DNA, 17 bp, Homo sapiens
gccagagtcctttccaa

SEQ ID NO: 6274209 - DNA, 14 bp, Homo sapiens
gccagagtctccca

SEQ ID NO: 6274210 - DNA, 19 bp, Homo sapiens
gccagagtggccacggccc

SEQ ID NO: 6274211 - DNA, 21 bp, Homo sapiens
gccagagtggccacggcccag

SEQ ID NO: 6274212 - DNA, 22 bp, Homo sapiens
gccagagtggccacggcccagg

SEQ ID NO: 6274213 - DNA, 13 bp, Homo sapiens
gccagagtggcct

SEQ ID NO: 6274214 - DNA, 23 bp, Homo sapiens
gccagagttaggttgtctccagg

SEQ ID NO: 6274215 - DNA, 22 bp, Homo sapiens
gccagagttcctgcggagtgaa

SEQ ID NO: 6274216 - DNA, 20 bp, Homo sapiens
gccagagttgttctcagggg

SEQ ID NO: 6274217 - DNA, 22 bp, Homo sapiens
gccagagttgttctcaggggtg

SEQ ID NO: 6274218 - DNA, 14 bp, Homo sapiens
gccagagtttgcct

SEQ ID NO: 6274219 - DNA, 20 bp, Homo sapiens
gccagagtttgcctccctgc

SEQ ID NO: 6274220 - DNA, 21 bp, Homo sapiens
gccagagtttttaaagccttc

SEQ ID NO: 6274221 - DNA, 15 bp, Homo sapiens
gccagataaaatgtt

SEQ ID NO: 6274222 - DNA, 22 bp, Homo sapiens
gccagatataactgtcttgttt

SEQ ID NO: 6274223 - DNA, 15 bp, Homo sapiens
gccagatccacccta

SEQ ID NO: 6274224 - DNA, 15 bp, Homo sapiens
gccagatccagcctg

SEQ ID NO: 6274225 - DNA, 15 bp, Homo sapiens
gccagatccccaggg

SEQ ID NO: 6274226 - DNA, 16 bp, Homo sapiens
gccagatccccagggc

SEQ ID NO: 6274227 - DNA, 22 bp, Homo sapiens
gccagatccccagggcagcctc

SEQ ID NO: 6274228 - DNA, 16 bp, Homo sapiens
gccagatcctcttggt

SEQ ID NO: 6274229 - DNA, 14 bp, Homo sapiens
gccagatcttaggt

SEQ ID NO: 6274230 - DNA, 17 bp, Homo sapiens
gccagatgacagggagc

SEQ ID NO: 6274231 - DNA, 15 bp, Homo sapiens
gccagatgcaccagc

SEQ ID NO: 6274232 - DNA, 18 bp, Homo sapiens
gccagatgcaccagccct

SEQ ID NO: 6274233 - DNA, 15 bp, Homo sapiens
gccagatgcaggaca

SEQ ID NO: 6274234 - DNA, 17 bp, Homo sapiens
gccagatgcaggacagg

SEQ ID NO: 6274235 - DNA, 14 bp, Homo sapiens
gccagatgcctccc

SEQ ID NO: 6274236 - DNA, 17 bp, Homo sapiens
gccagatgcctccccaa

SEQ ID NO: 6274237 - DNA, 18 bp, Homo sapiens
gccagatgcctccccaag

SEQ ID NO: 6274238 - DNA, 21 bp, Homo sapiens
gccagatgcggggacaggctg

SEQ ID NO: 6274239 - DNA, 16 bp, Homo sapiens
gccagatgctagagcc

SEQ ID NO: 6274240 - DNA, 22 bp, Homo sapiens
gccagatgctagagcctctgcc

SEQ ID NO: 6274241 - DNA, 20 bp, Homo sapiens
gccagatgctaggctgtctg

SEQ ID NO: 6274242 - DNA, 17 bp, Homo sapiens
gccagatgcttggcctg

SEQ ID NO: 6274243 - DNA, 21 bp, Homo sapiens
gccagatggcccctccactgg

SEQ ID NO: 6274244 - DNA, 15 bp, Homo sapiens
gccagatgtcctaat

SEQ ID NO: 6274245 - DNA, 15 bp, Homo sapiens
gccagattaggcctg

SEQ ID NO: 6274246 - DNA, 19 bp, Homo sapiens
gccagattaggcctggagt

SEQ ID NO: 6274247 - DNA, 21 bp, Homo sapiens
gccagattctcttgaataaag

SEQ ID NO: 6274248 - DNA, 16 bp, Homo sapiens
gccagattggccaatt

SEQ ID NO: 6274249 - DNA, 17 bp, Homo sapiens
gccagattggccaatta

SEQ ID NO: 6274250 - DNA, 20 bp, Homo sapiens
gccagattgtggggtgcagc

SEQ ID NO: 6274251 - DNA, 13 bp, Homo sapiens
gccagatttcact

SEQ ID NO: 6274252 - DNA, 18 bp, Homo sapiens
gccagatttcactctcct

SEQ ID NO: 6274253 - DNA, 14 bp, Homo sapiens
gccagatttgtctt

SEQ ID NO: 6274254 - DNA, 20 bp, Homo sapiens
gccagatttgtctttttgtt

SEQ ID NO: 6274255 - DNA, 19 bp, Homo sapiens
gccagattttcctgaaaac

SEQ ID NO: 6274256 - DNA, 16 bp, Homo sapiens
gccagattttttaaaa

SEQ ID NO: 6274257 - DNA, 22 bp, Homo sapiens
gccagcaaaaactgtgggaaga

SEQ ID NO: 6274258 - DNA, 16 bp, Homo sapiens
gccagcaaagccccat

SEQ ID NO: 6274259 - DNA, 12 bp, Homo sapiens
gccagcaacgct

SEQ ID NO: 6274260 - DNA, 13 bp, Homo sapiens
gccagcaacgctt

SEQ ID NO: 6274261 - DNA, 16 bp, Homo sapiens
gccagcaactgaataa

SEQ ID NO: 6274262 - DNA, 21 bp, Homo sapiens
gccagcaagaggaaggggtgc

SEQ ID NO: 6274263 - DNA, 15 bp, Homo sapiens
gccagcaaggcaggt

SEQ ID NO: 6274264 - DNA, 15 bp, Homo sapiens
gccagcaaggtggag

SEQ ID NO: 6274265 - DNA, 22 bp, Homo sapiens
gccagcaatgatgtccagaaga

SEQ ID NO: 6274266 - DNA, 12 bp, Homo sapiens
gccagcacacag

SEQ ID NO: 6274267 - DNA, 15 bp, Homo sapiens
gccagcacacagggc

SEQ ID NO: 6274268 - DNA, 18 bp, Homo sapiens
gccagcacacagggcagt

SEQ ID NO: 6274269 - DNA, 24 bp, Homo sapiens
gccagcacaggggccccagatctg

SEQ ID NO: 6274270 - DNA, 15 bp, Homo sapiens
gccagcacccaaagg

SEQ ID NO: 6274271 - DNA, 19 bp, Homo sapiens
gccagcacccaaagggtta

SEQ ID NO: 6274272 - DNA, 21 bp, Homo sapiens
gccagcacccagtcctctgcc

SEQ ID NO: 6274273 - DNA, 22 bp, Homo sapiens
gccagcacccagtcctctgcct

SEQ ID NO: 6274274 - DNA, 23 bp, Homo sapiens
gccagcacccagtcctctgcctc

SEQ ID NO: 6274275 - DNA, 17 bp, Homo sapiens
gccagcaccgccggctt

SEQ ID NO: 6274276 - DNA, 21 bp, Homo sapiens
gccagcaccgccggctttcag

SEQ ID NO: 6274277 - DNA, 22 bp, Homo sapiens
gccagcaccggaccagcctggc

SEQ ID NO: 6274278 - DNA, 16 bp, Homo sapiens
gccagcacctggttga

SEQ ID NO: 6274279 - DNA, 22 bp, Homo sapiens
gccagcacgttctccagactct

SEQ ID NO: 6274280 - DNA, 14 bp, Homo sapiens
gccagcactggagg

SEQ ID NO: 6274281 - DNA, 20 bp, Homo sapiens
gccagcactggaggggccca

SEQ ID NO: 6274282 - DNA, 23 bp, Homo sapiens
gccagcactggaggggcccaccc

SEQ ID NO: 6274283 - DNA, 19 bp, Homo sapiens
gccagcacttgtccagctg

SEQ ID NO: 6274284 - DNA, 12 bp, Homo sapiens
gccagcagaggg

SEQ ID NO: 6274285 - DNA, 16 bp, Homo sapiens
gccagcagcacctgcc

SEQ ID NO: 6274286 - DNA, 19 bp, Homo sapiens
gccagcagcagcaggtgat

SEQ ID NO: 6274287 - DNA, 14 bp, Homo sapiens
gccagcagcataga

SEQ ID NO: 6274288 - DNA, 13 bp, Homo sapiens
gccagcagccagc

SEQ ID NO: 6274289 - DNA, 15 bp, Homo sapiens
gccagcagccagctc

SEQ ID NO: 6274290 - DNA, 16 bp, Homo sapiens
gccagcagccagctct

SEQ ID NO: 6274291 - DNA, 13 bp, Homo sapiens
gccagcagccccg

SEQ ID NO: 6274292 - DNA, 19 bp, Homo sapiens
gccagcagcccttgtttat

SEQ ID NO: 6274293 - DNA, 13 bp, Homo sapiens
gccagcagcctcg

SEQ ID NO: 6274294 - DNA, 19 bp, Homo sapiens
gccagcagcctcgcacagg

SEQ ID NO: 6274295 - DNA, 16 bp, Homo sapiens
gccagcagcctctgat

SEQ ID NO: 6274296 - DNA, 19 bp, Homo sapiens
gccagcagcctctgatctg

SEQ ID NO: 6274297 - DNA, 13 bp, Homo sapiens
gccagcagccttc

SEQ ID NO: 6274298 - DNA, 14 bp, Homo sapiens
gccagcagccttcc

SEQ ID NO: 6274299 - DNA, 19 bp, Homo sapiens
gccagcagcgcgcaggcct

SEQ ID NO: 6274300 - DNA, 15 bp, Homo sapiens
gccagcaggaataaa

SEQ ID NO: 6274301 - DNA, 16 bp, Homo sapiens
gccagcaggaataaag

SEQ ID NO: 6274302 - DNA, 20 bp, Homo sapiens
gccagcaggcagcgcctgtc

SEQ ID NO: 6274303 - DNA, 21 bp, Homo sapiens
gccagcaggcagcgcctgtcc

SEQ ID NO: 6274304 - DNA, 13 bp, Homo sapiens
gccagcaggcctc

SEQ ID NO: 6274305 - DNA, 13 bp, Homo sapiens
gccagcagggcgg

SEQ ID NO: 6274306 - DNA, 23 bp, Homo sapiens
gccagcagggcgggccaggagaa

SEQ ID NO: 6274307 - DNA, 12 bp, Homo sapiens
gccagcagggct

SEQ ID NO: 6274308 - DNA, 16 bp, Homo sapiens
gccagcaggggggctg

SEQ ID NO: 6274309 - DNA, 21 bp, Homo sapiens
gccagcaggggggctgtgcca

SEQ ID NO: 6274310 - DNA, 21 bp, Homo sapiens
gccagcagttcagagctgccc

SEQ ID NO: 6274311 - DNA, 16 bp, Homo sapiens
gccagcatagggggga

SEQ ID NO: 6274312 - DNA, 14 bp, Homo sapiens
gccagcatctgggc

SEQ ID NO: 6274313 - DNA, 17 bp, Homo sapiens
gccagcatggttgcaga

SEQ ID NO: 6274314 - DNA, 13 bp, Homo sapiens
gccagcattcagc

SEQ ID NO: 6274315 - DNA, 17 bp, Homo sapiens
gccagcattcagcacac

SEQ ID NO: 6274316 - DNA, 14 bp, Homo sapiens
gccagcattccaga

SEQ ID NO: 6274317 - DNA, 17 bp, Homo sapiens
gccagcattccagactt

SEQ ID NO: 6274318 - DNA, 22 bp, Homo sapiens
gccagcattccagacttcaaaa

SEQ ID NO: 6274319 - DNA, 19 bp, Homo sapiens
gccagccaaacacacagaa

SEQ ID NO: 6274320 - DNA, 18 bp, Homo sapiens
gccagccaactctgggaa

SEQ ID NO: 6274321 - DNA, 16 bp, Homo sapiens
gccagccaagctctgc

SEQ ID NO: 6274322 - DNA, 22 bp, Homo sapiens
gccagccaagctttaaattatg

SEQ ID NO: 6274323 - DNA, 11 bp, Homo sapiens
gccagccacag

SEQ ID NO: 6274324 - DNA, 15 bp, Homo sapiens
gccagccacagaccc

SEQ ID NO: 6274325 - DNA, 16 bp, Homo sapiens
gccagccacagacccc

SEQ ID NO: 6274326 - DNA, 20 bp, Homo sapiens
gccagccacagacccctggg

SEQ ID NO: 6274327 - DNA, 16 bp, Homo sapiens
gccagccacaggacca

SEQ ID NO: 6274328 - DNA, 18 bp, Homo sapiens
gccagccacaggaccacc

SEQ ID NO: 6274329 - DNA, 21 bp, Homo sapiens
gccagccacaggaccacctcc

SEQ ID NO: 6274330 - DNA, 14 bp, Homo sapiens
gccagccacccctg

SEQ ID NO: 6274331 - DNA, 16 bp, Homo sapiens
gccagccacccctgcc

SEQ ID NO: 6274332 - DNA, 18 bp, Homo sapiens
gccagccacccctgccac

SEQ ID NO: 6274333 - DNA, 21 bp, Homo sapiens
gccagccacggggactcagcc

SEQ ID NO: 6274334 - DNA, 13 bp, Homo sapiens
gccagccagcagc

SEQ ID NO: 6274335 - DNA, 14 bp, Homo sapiens
gccagccagcagcc

SEQ ID NO: 6274336 - DNA, 16 bp, Homo sapiens
gccagccagcagccag

SEQ ID NO: 6274337 - DNA, 14 bp, Homo sapiens
gccagccagccact

SEQ ID NO: 6274338 - DNA, 15 bp, Homo sapiens
gccagccagccactc

SEQ ID NO: 6274339 - DNA, 21 bp, Homo sapiens
gccagccaggaactggctcct

SEQ ID NO: 6274340 - DNA, 17 bp, Homo sapiens
gccagccaggactcctt

SEQ ID NO: 6274341 - DNA, 16 bp, Homo sapiens
gccagccatcacaagg

SEQ ID NO: 6274342 - DNA, 22 bp, Homo sapiens
gccagccatgcccacgcccctc

SEQ ID NO: 6274343 - DNA, 10 bp, Homo sapiens
gccagcccaa

SEQ ID NO: 6274344 - DNA, 16 bp, Homo sapiens
gccagcccagaggccg

SEQ ID NO: 6274345 - DNA, 15 bp, Homo sapiens
gccagcccagatggc

SEQ ID NO: 6274346 - DNA, 23 bp, Homo sapiens
gccagcccagatggctccctggg

SEQ ID NO: 6274347 - DNA, 11 bp, Homo sapiens
gccagcccagc

SEQ ID NO: 6274348 - DNA, 15 bp, Homo sapiens
gccagcccagccagg

SEQ ID NO: 6274349 - DNA, 13 bp, Homo sapiens
gccagcccagctc

SEQ ID NO: 6274350 - DNA, 14 bp, Homo sapiens
gccagcccagctcc

SEQ ID NO: 6274351 - DNA, 21 bp, Homo sapiens
gccagcccagctggccggaag

SEQ ID NO: 6274352 - DNA, 22 bp, Homo sapiens
gccagcccagctggccggaagg

SEQ ID NO: 6274353 - DNA, 15 bp, Homo sapiens
gccagcccaggattg

SEQ ID NO: 6274354 - DNA, 18 bp, Homo sapiens
gccagcccatggccccca

SEQ ID NO: 6274355 - DNA, 21 bp, Homo sapiens
gccagcccatggcccccaata

SEQ ID NO: 6274356 - DNA, 22 bp, Homo sapiens
gccagccccacacagctacagc

SEQ ID NO: 6274357 - DNA, 14 bp, Homo sapiens
gccagccccacagc

SEQ ID NO: 6274358 - DNA, 15 bp, Homo sapiens
gccagccccacccag

SEQ ID NO: 6274359 - DNA, 18 bp, Homo sapiens
gccagccccacccaggag

SEQ ID NO: 6274360 - DNA, 11 bp, Homo sapiens
gccagccccat

SEQ ID NO: 6274361 - DNA, 22 bp, Homo sapiens
gccagcccccccacccaccccc

SEQ ID NO: 6274362 - DNA, 20 bp, Homo sapiens
gccagccccctccagctcat

SEQ ID NO: 6274363 - DNA, 10 bp, Homo sapiens
gccagcccct

SEQ ID NO: 6274364 - DNA, 21 bp, Homo sapiens
gccagcccctagatgaagaaa

SEQ ID NO: 6274365 - DNA, 11 bp, Homo sapiens
gccagcccctc

SEQ ID NO: 6274366 - DNA, 15 bp, Homo sapiens
gccagcccctccccg

SEQ ID NO: 6274367 - DNA, 21 bp, Homo sapiens
gccagcccctccccgcctcct

SEQ ID NO: 6274368 - DNA, 16 bp, Homo sapiens
gccagcccctgcctgg

SEQ ID NO: 6274369 - DNA, 17 bp, Homo sapiens
gccagcccctgcctggg

SEQ ID NO: 6274370 - DNA, 24 bp, Homo sapiens
gccagcccctgctggctggtgcct

SEQ ID NO: 6274371 - DNA, 20 bp, Homo sapiens
gccagcccctggccccagga

SEQ ID NO: 6274372 - DNA, 19 bp, Homo sapiens
gccagccccttagacagag

SEQ ID NO: 6274373 - DNA, 19 bp, Homo sapiens
gccagcccgcagaggtggg

SEQ ID NO: 6274374 - DNA, 18 bp, Homo sapiens
gccagcccggacctctgg

SEQ ID NO: 6274375 - DNA, 21 bp, Homo sapiens
gccagcccggctcggcccagc

SEQ ID NO: 6274376 - DNA, 22 bp, Homo sapiens
gccagcccggctcggcccagca

SEQ ID NO: 6274377 - DNA, 15 bp, Homo sapiens
gccagcccggctggt

SEQ ID NO: 6274378 - DNA, 10 bp, Homo sapiens
gccagcccta

SEQ ID NO: 6274379 - DNA, 18 bp, Homo sapiens
gccagccctacatcttca

SEQ ID NO: 6274380 - DNA, 20 bp, Homo sapiens
gccagccctacatcttcagc

SEQ ID NO: 6274381 - DNA, 14 bp, Homo sapiens
gccagccctaggct

SEQ ID NO: 6274382 - DNA, 10 bp, Homo sapiens
gccagccctc

SEQ ID NO: 6274383 - DNA, 16 bp, Homo sapiens
gccagccctcccagca

SEQ ID NO: 6274384 - DNA, 19 bp, Homo sapiens
gcttggcccggccggcctg

SEQ ID NO: 6274385 - DNA, 14 bp, Homo sapiens
gcttggccctgcgc

SEQ ID NO: 6274386 - DNA, 22 bp, Homo sapiens
gcttggccctgcgccctgtgca

SEQ ID NO: 6274387 - DNA, 24 bp, Homo sapiens
gcttggccctgcgccctgtgcagg

SEQ ID NO: 6274388 - DNA, 15 bp, Homo sapiens
gcttggccgccatcc

SEQ ID NO: 6274389 - DNA, 14 bp, Homo sapiens
gcttggcctgctgt

SEQ ID NO: 6274390 - DNA, 16 bp, Homo sapiens
gcttggcctgctgtga

SEQ ID NO: 6274391 - DNA, 15 bp, Homo sapiens
gcttggcctggagag

SEQ ID NO: 6274392 - DNA, 23 bp, Homo sapiens
gcttggccttatgaccagtgaga

SEQ ID NO: 6274393 - DNA, 11 bp, Homo sapiens
gcttggccttg

SEQ ID NO: 6274394 - DNA, 15 bp, Homo sapiens
gcttggccttgtgtc

SEQ ID NO: 6274395 - DNA, 20 bp, Homo sapiens
gcttggctcttggcttccag

SEQ ID NO: 6274396 - DNA, 21 bp, Homo sapiens
gcttggctcttggcttccaga

SEQ ID NO: 6274397 - DNA, 13 bp, Homo sapiens
gcttggctgagcc

SEQ ID NO: 6274398 - DNA, 19 bp, Homo sapiens
gcttggctgagccccctct

SEQ ID NO: 6274399 - DNA, 21 bp, Homo sapiens
gcttggctgagccccctctcc

SEQ ID NO: 6274400 - DNA, 13 bp, Homo sapiens
gcttggctgctca

SEQ ID NO: 6274401 - DNA, 14 bp, Homo sapiens
gcttggctgctcag

SEQ ID NO: 6274402 - DNA, 14 bp, Homo sapiens
gcttggctgtagga

SEQ ID NO: 6274403 - DNA, 19 bp, Homo sapiens
gcttggcttatgaaaacac

SEQ ID NO: 6274404 - DNA, 22 bp, Homo sapiens
gcttgggaaaggtggtgtttct

SEQ ID NO: 6274405 - DNA, 15 bp, Homo sapiens
gcttgggaattttat

SEQ ID NO: 6274406 - DNA, 14 bp, Homo sapiens
gcttgggacaaatc

SEQ ID NO: 6274407 - DNA, 20 bp, Homo sapiens
gcttgggagagtcaggcagg

SEQ ID NO: 6274408 - DNA, 17 bp, Homo sapiens
gcttgggaggggccgga

SEQ ID NO: 6274409 - DNA, 19 bp, Homo sapiens
gcttgggaggggccggagg

SEQ ID NO: 6274410 - DNA, 17 bp, Homo sapiens
gcttgggatttgctgtg

SEQ ID NO: 6274411 - DNA, 21 bp, Homo sapiens
gcttgggcagtgccccaggga

SEQ ID NO: 6274412 - DNA, 16 bp, Homo sapiens
gcttgggccactgccc

SEQ ID NO: 6274413 - DNA, 17 bp, Homo sapiens
gcttgggccactgccct

SEQ ID NO: 6274414 - DNA, 20 bp, Homo sapiens
gcttgggcccagctgggctc

SEQ ID NO: 6274415 - DNA, 18 bp, Homo sapiens
gcttgggcccagtagccc

SEQ ID NO: 6274416 - DNA, 14 bp, Homo sapiens
gcttgggccctgca

SEQ ID NO: 6274417 - DNA, 15 bp, Homo sapiens
gcttgggccctgcac

SEQ ID NO: 6274418 - DNA, 20 bp, Homo sapiens
gcttgggccctgcacagata

SEQ ID NO: 6274419 - DNA, 23 bp, Homo sapiens
gcttgggccctgcattggcctgg

SEQ ID NO: 6274420 - DNA, 21 bp, Homo sapiens
gcttgggcctaggctgcattg

SEQ ID NO: 6274421 - DNA, 16 bp, Homo sapiens
gcttgggcgccgtgct

SEQ ID NO: 6274422 - DNA, 14 bp, Homo sapiens
gcttgggctccacg

SEQ ID NO: 6274423 - DNA, 15 bp, Homo sapiens
gcttgggctccacgg

SEQ ID NO: 6274424 - DNA, 14 bp, Homo sapiens
gcttgggctcccac

SEQ ID NO: 6274425 - DNA, 12 bp, Homo sapiens
gcttgggctggc

SEQ ID NO: 6274426 - DNA, 13 bp, Homo sapiens
gcttgggctggcg

SEQ ID NO: 6274427 - DNA, 20 bp, Homo sapiens
gcttgggctggcgggccctg

SEQ ID NO: 6274428 - DNA, 15 bp, Homo sapiens
gcttgggctggtcag

SEQ ID NO: 6274429 - DNA, 16 bp, Homo sapiens
gcttgggcttcttcct

SEQ ID NO: 6274430 - DNA, 16 bp, Homo sapiens
gcttggggaccagagc

SEQ ID NO: 6274431 - DNA, 17 bp, Homo sapiens
gcttggggaccagagct

SEQ ID NO: 6274432 - DNA, 20 bp, Homo sapiens
gcttggggaccagagctgcc

SEQ ID NO: 6274433 - DNA, 14 bp, Homo sapiens
gcttggggacctga

SEQ ID NO: 6274434 - DNA, 22 bp, Homo sapiens
gcttggggagcagagtatagga

SEQ ID NO: 6274435 - DNA, 15 bp, Homo sapiens
gcttggggagcaggt

SEQ ID NO: 6274436 - DNA, 17 bp, Homo sapiens
gcttggggagcaggtct

SEQ ID NO: 6274437 - DNA, 19 bp, Homo sapiens
gcttggggccaccaaagct

SEQ ID NO: 6274438 - DNA, 13 bp, Homo sapiens
gcttggggccagg

SEQ ID NO: 6274439 - DNA, 24 bp, Homo sapiens
gcttgggggatgactagaggcagg

SEQ ID NO: 6274440 - DNA, 22 bp, Homo sapiens
gcttggggggtgatgagggcag

SEQ ID NO: 6274441 - DNA, 22 bp, Homo sapiens
gcttgggggtggggagaaaaga

SEQ ID NO: 6274442 - DNA, 14 bp, Homo sapiens
gcttggggtagaga

SEQ ID NO: 6274443 - DNA, 20 bp, Homo sapiens
gcttggggtagagaggacag

SEQ ID NO: 6274444 - DNA, 19 bp, Homo sapiens
gcttgggtcaggttcttgc

SEQ ID NO: 6274445 - DNA, 21 bp, Homo sapiens
gcttgggtcctactcctggag

SEQ ID NO: 6274446 - DNA, 22 bp, Homo sapiens
gcttgggtctctctcggcccct

SEQ ID NO: 6274447 - DNA, 18 bp, Homo sapiens
gcttgggtggagaagcca

SEQ ID NO: 6274448 - DNA, 20 bp, Homo sapiens
gcttgggtggagaagccatt

SEQ ID NO: 6274449 - DNA, 20 bp, Homo sapiens
gcttgggtggtgggtgctgg

SEQ ID NO: 6274450 - DNA, 19 bp, Homo sapiens
gcttgggtgtaacaggtct

SEQ ID NO: 6274451 - DNA, 21 bp, Homo sapiens
gcttgggtgtaacaggtctcc

SEQ ID NO: 6274452 - DNA, 18 bp, Homo sapiens
gcttgggttcctttttca

SEQ ID NO: 6274453 - DNA, 18 bp, Homo sapiens
gcttggtcaaatccccgg

SEQ ID NO: 6274454 - DNA, 18 bp, Homo sapiens
gcttggtgagtctgtgtg

SEQ ID NO: 6274455 - DNA, 19 bp, Homo sapiens
gcttggtgcacagattgct

SEQ ID NO: 6274456 - DNA, 19 bp, Homo sapiens
gcttggtgcggtaggtgct

SEQ ID NO: 6274457 - DNA, 15 bp, Homo sapiens
gcttggtgctggttt

SEQ ID NO: 6274458 - DNA, 16 bp, Homo sapiens
gcttggtgctggttta

SEQ ID NO: 6274459 - DNA, 19 bp, Homo sapiens
gcttggtggccaagcctgg

SEQ ID NO: 6274460 - DNA, 18 bp, Homo sapiens
gcttggtggggctcgtgg

SEQ ID NO: 6274461 - DNA, 18 bp, Homo sapiens
gcttggtgtcttggcact

SEQ ID NO: 6274462 - DNA, 19 bp, Homo sapiens
gcttggtgtcttggcactg

SEQ ID NO: 6274463 - DNA, 22 bp, Homo sapiens
gcttggtgtttgtaagaaaatg

SEQ ID NO: 6274464 - DNA, 17 bp, Homo sapiens
gcttggttccaggaatt

SEQ ID NO: 6274465 - DNA, 15 bp, Homo sapiens
gcttggttccttccc

SEQ ID NO: 6274466 - DNA, 16 bp, Homo sapiens
gcttggttccttccca

SEQ ID NO: 6274467 - DNA, 17 bp, Homo sapiens
gcttggttgactgatgt

SEQ ID NO: 6274468 - DNA, 15 bp, Homo sapiens
gcttggttggctggc

SEQ ID NO: 6274469 - DNA, 20 bp, Homo sapiens
gcttggtttcctcaccttga

SEQ ID NO: 6274470 - DNA, 15 bp, Homo sapiens
gcttgtaaaaatatg

SEQ ID NO: 6274471 - DNA, 15 bp, Homo sapiens
gcttgtaaataccag

SEQ ID NO: 6274472 - DNA, 13 bp, Homo sapiens
gcttgtaaatatg

SEQ ID NO: 6274473 - DNA, 24 bp, Homo sapiens
gcttgtaaatatggggatagtctg

SEQ ID NO: 6274474 - DNA, 14 bp, Homo sapiens
gcttgtaacaagaa

SEQ ID NO: 6274475 - DNA, 18 bp, Homo sapiens
gcttgtaacaagaaaaca

SEQ ID NO: 6274476 - DNA, 22 bp, Homo sapiens
gcttgtaactaaaataattttg

SEQ ID NO: 6274477 - DNA, 13 bp, Homo sapiens
gcttgtacatatt

SEQ ID NO: 6274478 - DNA, 18 bp, Homo sapiens
gcttgtacatattggaaa

SEQ ID NO: 6274479 - DNA, 11 bp, Homo sapiens
gcttgtacatt

SEQ ID NO: 6274480 - DNA, 13 bp, Homo sapiens
gcttgtacatttt

SEQ ID NO: 6274481 - DNA, 19 bp, Homo sapiens
gcttgtaccacttttgcaa

SEQ ID NO: 6274482 - DNA, 17 bp, Homo sapiens
gcttgtactaagccagg

SEQ ID NO: 6274483 - DNA, 23 bp, Homo sapiens
gcttgtagaactcactctgggct

SEQ ID NO: 6274484 - DNA, 14 bp, Homo sapiens
gcttgtaggagctg

SEQ ID NO: 6274485 - DNA, 22 bp, Homo sapiens
gcttgtaggagctgaggtttca

SEQ ID NO: 6274486 - DNA, 22 bp, Homo sapiens
gcttgtaggggaggggctcctt

SEQ ID NO: 6274487 - DNA, 20 bp, Homo sapiens
gcttgtagggtgaggcgtgg

SEQ ID NO: 6274488 - DNA, 22 bp, Homo sapiens
gcttgtaggtatgtctgtgcca

SEQ ID NO: 6274489 - DNA, 16 bp, Homo sapiens
gcttgtagttctttaa

SEQ ID NO: 6274490 - DNA, 16 bp, Homo sapiens
gcttgtatatacatat

SEQ ID NO: 6274491 - DNA, 14 bp, Homo sapiens
gcttgtattgtaaa

SEQ ID NO: 6274492 - DNA, 18 bp, Homo sapiens
gcttgtattgtaaatgtg

SEQ ID NO: 6274493 - DNA, 15 bp, Homo sapiens
gcttgtcagagctgg

SEQ ID NO: 6274494 - DNA, 17 bp, Homo sapiens
gcttgtcagagctggga

SEQ ID NO: 6274495 - DNA, 18 bp, Homo sapiens
gcttgtcagagctgggag

SEQ ID NO: 6274496 - DNA, 16 bp, Homo sapiens
gcttgtcatagccagt

SEQ ID NO: 6274497 - DNA, 22 bp, Homo sapiens
gcttgtcatccacacaacacca

SEQ ID NO: 6274498 - DNA, 17 bp, Homo sapiens
gcttgtcatctgccact

SEQ ID NO: 6274499 - DNA, 16 bp, Homo sapiens
gcttgtcattccagag

SEQ ID NO: 6274500 - DNA, 16 bp, Homo sapiens
gcttgtcccctcctca

SEQ ID NO: 6274501 - DNA, 16 bp, Homo sapiens
gcttgtcctcatctct

SEQ ID NO: 6274502 - DNA, 13 bp, Homo sapiens
gcttgtcctgctc

SEQ ID NO: 6274503 - DNA, 14 bp, Homo sapiens
gcttgtcctgtgct

SEQ ID NO: 6274504 - DNA, 19 bp, Homo sapiens
gcttgtccttgctcctgga

SEQ ID NO: 6274505 - DNA, 20 bp, Homo sapiens
gcttgtcgctttctcagtgt

SEQ ID NO: 6274506 - DNA, 21 bp, Homo sapiens
gcttgtcgctttctcagtgtg

SEQ ID NO: 6274507 - DNA, 16 bp, Homo sapiens
gcttgtctcttgcctg

SEQ ID NO: 6274508 - DNA, 21 bp, Homo sapiens
gcttgtctcttgcctgccact

SEQ ID NO: 6274509 - DNA, 14 bp, Homo sapiens
gcttgtcttttctg

SEQ ID NO: 6274510 - DNA, 16 bp, Homo sapiens
gcttgtcttttctgct

SEQ ID NO: 6274511 - DNA, 21 bp, Homo sapiens
gcttgtcttttctgctgagga

SEQ ID NO: 6274512 - DNA, 14 bp, Homo sapiens
gcttgtgaactgct

SEQ ID NO: 6274513 - DNA, 20 bp, Homo sapiens
gcttgtgaatgtatttttct

SEQ ID NO: 6274514 - DNA, 12 bp, Homo sapiens
gcttgtgacagt

SEQ ID NO: 6274515 - DNA, 13 bp, Homo sapiens
gcttgtgaccttg

SEQ ID NO: 6274516 - DNA, 16 bp, Homo sapiens
gcttgtgatctgggaa

SEQ ID NO: 6274517 - DNA, 23 bp, Homo sapiens
gcttgtgatttccatttctgatg

SEQ ID NO: 6274518 - DNA, 15 bp, Homo sapiens
gcttgtgcaacaata

SEQ ID NO: 6274519 - DNA, 22 bp, Homo sapiens
gcttgtgcagaaaacattgttc

SEQ ID NO: 6274520 - DNA, 21 bp, Homo sapiens
gcttgtgcctcccttcccagt

SEQ ID NO: 6274521 - DNA, 22 bp, Homo sapiens
gcttgtgcctcccttcccagtg

SEQ ID NO: 6274522 - DNA, 17 bp, Homo sapiens
gcttgtgctcatgtgtg

SEQ ID NO: 6274523 - DNA, 21 bp, Homo sapiens
gcttgtggaagacaagtctgt

SEQ ID NO: 6274524 - DNA, 19 bp, Homo sapiens
gcttgtggagccccacact

SEQ ID NO: 6274525 - DNA, 23 bp, Homo sapiens
gcttgtggattgagggtaggagg

SEQ ID NO: 6274526 - DNA, 16 bp, Homo sapiens
gcttgtggcagcctga

SEQ ID NO: 6274527 - DNA, 13 bp, Homo sapiens
gcttgtgggctgg

SEQ ID NO: 6274528 - DNA, 17 bp, Homo sapiens
gcttgtgggctggtgcc

SEQ ID NO: 6274529 - DNA, 17 bp, Homo sapiens
gcttgtggggacccagg

SEQ ID NO: 6274530 - DNA, 21 bp, Homo sapiens
gcttgtggggacccaggctcc

SEQ ID NO: 6274531 - DNA, 18 bp, Homo sapiens
gcttgtggtgttcctgaa

SEQ ID NO: 6274532 - DNA, 22 bp, Homo sapiens
gcttgtggtgttcctgaagcaa

SEQ ID NO: 6274533 - DNA, 13 bp, Homo sapiens
gcttgtgtacttg

SEQ ID NO: 6274534 - DNA, 11 bp, Homo sapiens
gcttgtgtatc

SEQ ID NO: 6274535 - DNA, 18 bp, Homo sapiens
gcttgtgtatccattatc

SEQ ID NO: 6274536 - DNA, 19 bp, Homo sapiens
gcttgtgtatccattatca

SEQ ID NO: 6274537 - DNA, 17 bp, Homo sapiens
gcttgtgtatcttgatt

SEQ ID NO: 6274538 - DNA, 17 bp, Homo sapiens
gcttgtgtgtatgtcta

SEQ ID NO: 6274539 - DNA, 19 bp, Homo sapiens
gcttgtgtgtatgtctatg

SEQ ID NO: 6274540 - DNA, 19 bp, Homo sapiens
gcttgtgtgtttcactttt

SEQ ID NO: 6274541 - DNA, 20 bp, Homo sapiens
gcttgtgtgtttcactttta

SEQ ID NO: 6274542 - DNA, 21 bp, Homo sapiens
gcttgtgtgtttcacttttag

SEQ ID NO: 6274543 - DNA, 20 bp, Homo sapiens
gcttgtgttctagtcattgt

SEQ ID NO: 6274544 - DNA, 19 bp, Homo sapiens
gcttgtgttgggccccagg

SEQ ID NO: 6274545 - DNA, 16 bp, Homo sapiens
gcttgttagagagaaa

SEQ ID NO: 6274546 - DNA, 17 bp, Homo sapiens
gcttgttatattaagca

SEQ ID NO: 6274547 - DNA, 18 bp, Homo sapiens
gcttgttcatcatccaga

SEQ ID NO: 6274548 - DNA, 21 bp, Homo sapiens
gcttgttcatcatccagatgt

SEQ ID NO: 6274549 - DNA, 14 bp, Homo sapiens
gcttgttctgggct

SEQ ID NO: 6274550 - DNA, 21 bp, Homo sapiens
gcttgttgaaaatatttctct

SEQ ID NO: 6274551 - DNA, 20 bp, Homo sapiens
gcttgttgcatttccagctg

SEQ ID NO: 6274552 - DNA, 20 bp, Homo sapiens
gcttgttgggattcctgacc

SEQ ID NO: 6274553 - DNA, 22 bp, Homo sapiens
gcttgttgggattcctgaccca

SEQ ID NO: 6274554 - DNA, 23 bp, Homo sapiens
gcttgttgggattcctgacccag

SEQ ID NO: 6274555 - DNA, 24 bp, Homo sapiens
gcttgttgggattcctgacccagg

SEQ ID NO: 6274556 - DNA, 22 bp, Homo sapiens
gcttgtttaacggcagtgtcat

SEQ ID NO: 6274557 - DNA, 21 bp, Homo sapiens
gcttgtttaaggttcttgctg

SEQ ID NO: 6274558 - DNA, 16 bp, Homo sapiens
gcttgtttacctttct

SEQ ID NO: 6274559 - DNA, 23 bp, Homo sapiens
gcttgtttcctagcacacacttt

SEQ ID NO: 6274560 - DNA, 19 bp, Homo sapiens
gcttgtttgatttcaacat

SEQ ID NO: 6274561 - DNA, 20 bp, Homo sapiens
gccagccctccctggctgtg

SEQ ID NO: 6274562 - DNA, 17 bp, Homo sapiens
gccagccctccctgtcc

SEQ ID NO: 6274563 - DNA, 22 bp, Homo sapiens
gccagccctccctgtcctcctc

SEQ ID NO: 6274564 - DNA, 20 bp, Homo sapiens
gccagccctcttctgacact

SEQ ID NO: 6274565 - DNA, 19 bp, Homo sapiens
gccagccctgcctggagga

SEQ ID NO: 6274566 - DNA, 23 bp, Homo sapiens
gccagccctggaggctggatggc

SEQ ID NO: 6274567 - DNA, 15 bp, Homo sapiens
gccagccctggcttc

SEQ ID NO: 6274568 - DNA, 14 bp, Homo sapiens
gccagccctggttc

SEQ ID NO: 6274569 - DNA, 10 bp, Homo sapiens
gccagccctt

SEQ ID NO: 6274570 - DNA, 12 bp, Homo sapiens
gccagcccttca

SEQ ID NO: 6274571 - DNA, 19 bp, Homo sapiens
gccagcccttcaggaagca

SEQ ID NO: 6274572 - DNA, 21 bp, Homo sapiens
gccagcccttcccaggccagc

SEQ ID NO: 6274573 - DNA, 15 bp, Homo sapiens
gccagcccttccctg

SEQ ID NO: 6274574 - DNA, 21 bp, Homo sapiens
gccagcccttccctggccccg

SEQ ID NO: 6274575 - DNA, 22 bp, Homo sapiens
gccagcccttcctctcactcct

SEQ ID NO: 6274576 - DNA, 19 bp, Homo sapiens
gccagccgaccctcctggc

SEQ ID NO: 6274577 - DNA, 21 bp, Homo sapiens
gccagccgagcaggaggccta

SEQ ID NO: 6274578 - DNA, 24 bp, Homo sapiens
gccagccgagcaggaggcctagga

SEQ ID NO: 6274579 - DNA, 19 bp, Homo sapiens
gccagccgagcgagaacca

SEQ ID NO: 6274580 - DNA, 19 bp, Homo sapiens
gccagccgcccacccccac

SEQ ID NO: 6274581 - DNA, 16 bp, Homo sapiens
gccagccgctggtgcc

SEQ ID NO: 6274582 - DNA, 21 bp, Homo sapiens
gccagccggacacaagcggcc

SEQ ID NO: 6274583 - DNA, 20 bp, Homo sapiens
gccagccgggtacctcagtt

SEQ ID NO: 6274584 - DNA, 22 bp, Homo sapiens
gccagccgggtacctcagtttc

SEQ ID NO: 6274585 - DNA, 16 bp, Homo sapiens
gccagcctacactgcc

SEQ ID NO: 6274586 - DNA, 19 bp, Homo sapiens
gccagcctacactgccagc

SEQ ID NO: 6274587 - DNA, 13 bp, Homo sapiens
gccagcctagccc

SEQ ID NO: 6274588 - DNA, 13 bp, Homo sapiens
gccagcctcagaa

SEQ ID NO: 6274589 - DNA, 20 bp, Homo sapiens
gccagcctcagaaggcccca

SEQ ID NO: 6274590 - DNA, 15 bp, Homo sapiens
gccagcctcagactg

SEQ ID NO: 6274591 - DNA, 19 bp, Homo sapiens
gccagcctcagctcagcct

SEQ ID NO: 6274592 - DNA, 12 bp, Homo sapiens
gccagcctcagt

SEQ ID NO: 6274593 - DNA, 17 bp, Homo sapiens
gccagcctcagtgccac

SEQ ID NO: 6274594 - DNA, 15 bp, Homo sapiens
gccagcctcctctgg

SEQ ID NO: 6274595 - DNA, 13 bp, Homo sapiens
gccagcctccttg

SEQ ID NO: 6274596 - DNA, 13 bp, Homo sapiens
gccagcctgaggc

SEQ ID NO: 6274597 - DNA, 15 bp, Homo sapiens
gccagcctgaggtgc

SEQ ID NO: 6274598 - DNA, 16 bp, Homo sapiens
gccagcctgaggtgcc

SEQ ID NO: 6274599 - DNA, 19 bp, Homo sapiens
gccagcctgaggtgcccac

SEQ ID NO: 6274600 - DNA, 22 bp, Homo sapiens
gccagcctgcgggaagctgacc

SEQ ID NO: 6274601 - DNA, 14 bp, Homo sapiens
gccagcctgcttcc

SEQ ID NO: 6274602 - DNA, 18 bp, Homo sapiens
gccagcctgcttcccaca

SEQ ID NO: 6274603 - DNA, 16 bp, Homo sapiens
gccagcctggcatcag

SEQ ID NO: 6274604 - DNA, 16 bp, Homo sapiens
gccagcctggcctcct

SEQ ID NO: 6274605 - DNA, 20 bp, Homo sapiens
gccagcctggcctcctgcct

SEQ ID NO: 6274606 - DNA, 23 bp, Homo sapiens
gccagcctggcctcctgcctcta

SEQ ID NO: 6274607 - DNA, 17 bp, Homo sapiens
gccagcctggctgggac

SEQ ID NO: 6274608 - DNA, 20 bp, Homo sapiens
gccagcctggcttctggagc

SEQ ID NO: 6274609 - DNA, 14 bp, Homo sapiens
gccagcctggggcc

SEQ ID NO: 6274610 - DNA, 15 bp, Homo sapiens
gccagcctggggcct

SEQ ID NO: 6274611 - DNA, 22 bp, Homo sapiens
gccagcctgggggctgggagga

SEQ ID NO: 6274612 - DNA, 21 bp, Homo sapiens
gccagcctggtccatgcaggg

SEQ ID NO: 6274613 - DNA, 13 bp, Homo sapiens
gccagccttcccc

SEQ ID NO: 6274614 - DNA, 16 bp, Homo sapiens
gccagccttcctctgc

SEQ ID NO: 6274615 - DNA, 17 bp, Homo sapiens
gccagccttcctctgca

SEQ ID NO: 6274616 - DNA, 19 bp, Homo sapiens
gccagccttcctctgcagc

SEQ ID NO: 6274617 - DNA, 12 bp, Homo sapiens
gccagccttctt

SEQ ID NO: 6274618 - DNA, 20 bp, Homo sapiens
gccagccttgaccattctcc

SEQ ID NO: 6274619 - DNA, 22 bp, Homo sapiens
gccagccttgagccctggctgt

SEQ ID NO: 6274620 - DNA, 17 bp, Homo sapiens
gccagccttgcactgtg

SEQ ID NO: 6274621 - DNA, 16 bp, Homo sapiens
gccagccttggaggat

SEQ ID NO: 6274622 - DNA, 12 bp, Homo sapiens
gccagccttggg

SEQ ID NO: 6274623 - DNA, 19 bp, Homo sapiens
gccagcgacctctctgcct

SEQ ID NO: 6274624 - DNA, 20 bp, Homo sapiens
gccagcgagcgcccagctcc

SEQ ID NO: 6274625 - DNA, 22 bp, Homo sapiens
gccagcgaggcgaggctgcctc

SEQ ID NO: 6274626 - DNA, 15 bp, Homo sapiens
gccagcgcatgtgtc

SEQ ID NO: 6274627 - DNA, 13 bp, Homo sapiens
gccagcgccaggg

SEQ ID NO: 6274628 - DNA, 19 bp, Homo sapiens
gccagcgccagggcccagg

SEQ ID NO: 6274629 - DNA, 15 bp, Homo sapiens
gccagcgcctccctc

SEQ ID NO: 6274630 - DNA, 22 bp, Homo sapiens
gccagcgcctccctccacccca

SEQ ID NO: 6274631 - DNA, 22 bp, Homo sapiens
gccagcgctgaacagaccgggg

SEQ ID NO: 6274632 - DNA, 13 bp, Homo sapiens
gccagcggccctc

SEQ ID NO: 6274633 - DNA, 16 bp, Homo sapiens
gccagcggccctccca

SEQ ID NO: 6274634 - DNA, 17 bp, Homo sapiens
gccagcggccctcccag

SEQ ID NO: 6274635 - DNA, 18 bp, Homo sapiens
gccagcggccctcccagg

SEQ ID NO: 6274636 - DNA, 19 bp, Homo sapiens
gccagcggccctcccaggc

SEQ ID NO: 6274637 - DNA, 15 bp, Homo sapiens
gccagcggctccaac

SEQ ID NO: 6274638 - DNA, 15 bp, Homo sapiens
gccagcgggcacagg

SEQ ID NO: 6274639 - DNA, 18 bp, Homo sapiens
gccagcgggcacagggca

SEQ ID NO: 6274640 - DNA, 20 bp, Homo sapiens
gccagcgggcacagggcacc

SEQ ID NO: 6274641 - DNA, 23 bp, Homo sapiens
gccagcgggcacagggcaccaga

SEQ ID NO: 6274642 - DNA, 22 bp, Homo sapiens
gccagcggtgaccagcctgtca

SEQ ID NO: 6274643 - DNA, 14 bp, Homo sapiens
gccagcgtcccagg

SEQ ID NO: 6274644 - DNA, 19 bp, Homo sapiens
gccagcgtcccagggtacc

SEQ ID NO: 6274645 - DNA, 15 bp, Homo sapiens
gccagcgtcccttgg

SEQ ID NO: 6274646 - DNA, 16 bp, Homo sapiens
gccagcgtcccttggt

SEQ ID NO: 6274647 - DNA, 22 bp, Homo sapiens
gccagcgtcctcctctgtgacc

SEQ ID NO: 6274648 - DNA, 18 bp, Homo sapiens
gccagcgtgtggagcaga

SEQ ID NO: 6274649 - DNA, 15 bp, Homo sapiens
gccagctaaggggtg

SEQ ID NO: 6274650 - DNA, 19 bp, Homo sapiens
gccagctaatttttgtatg

SEQ ID NO: 6274651 - DNA, 16 bp, Homo sapiens
gccagctactcaggag

SEQ ID NO: 6274652 - DNA, 23 bp, Homo sapiens
gccagctacttcctcctccccac

SEQ ID NO: 6274653 - DNA, 15 bp, Homo sapiens
gccagctatctgcct

SEQ ID NO: 6274654 - DNA, 19 bp, Homo sapiens
gccagctcacagtgctgtg

SEQ ID NO: 6274655 - DNA, 21 bp, Homo sapiens
gccagctcaggtgactggagc

SEQ ID NO: 6274656 - DNA, 16 bp, Homo sapiens
gccagctcagtcccat

SEQ ID NO: 6274657 - DNA, 14 bp, Homo sapiens
gccagctcatttca

SEQ ID NO: 6274658 - DNA, 15 bp, Homo sapiens
gccagctccacaggg

SEQ ID NO: 6274659 - DNA, 19 bp, Homo sapiens
gccagctccagtgccgctc

SEQ ID NO: 6274660 - DNA, 23 bp, Homo sapiens
gccagctccagtgccgctcctgc

SEQ ID NO: 6274661 - DNA, 16 bp, Homo sapiens
gccagctcctctctga

SEQ ID NO: 6274662 - DNA, 19 bp, Homo sapiens
gccagctccttagacacct

SEQ ID NO: 6274663 - DNA, 20 bp, Homo sapiens
gccagctcctttcccttttc

SEQ ID NO: 6274664 - DNA, 16 bp, Homo sapiens
gccagctccttttctg

SEQ ID NO: 6274665 - DNA, 18 bp, Homo sapiens
gccagctccttttctgtg

SEQ ID NO: 6274666 - DNA, 15 bp, Homo sapiens
gccagctctaccagt

SEQ ID NO: 6274667 - DNA, 16 bp, Homo sapiens
gccagctctagttttc

SEQ ID NO: 6274668 - DNA, 13 bp, Homo sapiens
gccagctctcagc

SEQ ID NO: 6274669 - DNA, 19 bp, Homo sapiens
gccagctctgaggggaggc

SEQ ID NO: 6274670 - DNA, 13 bp, Homo sapiens
gccagctctggag

SEQ ID NO: 6274671 - DNA, 13 bp, Homo sapiens
gccagctctgtca

SEQ ID NO: 6274672 - DNA, 16 bp, Homo sapiens
gccagctctgtcaccc

SEQ ID NO: 6274673 - DNA, 22 bp, Homo sapiens
gccagctctgtcaccctggcca

SEQ ID NO: 6274674 - DNA, 16 bp, Homo sapiens
gccagctgatgactca

SEQ ID NO: 6274675 - DNA, 14 bp, Homo sapiens
gccagctgcactga

SEQ ID NO: 6274676 - DNA, 20 bp, Homo sapiens
gccagctgcactgatgctgc

SEQ ID NO: 6274677 - DNA, 17 bp, Homo sapiens
gccagctgcagcctggt

SEQ ID NO: 6274678 - DNA, 14 bp, Homo sapiens
gccagctgcagctg

SEQ ID NO: 6274679 - DNA, 12 bp, Homo sapiens
gccagctgcagg

SEQ ID NO: 6274680 - DNA, 13 bp, Homo sapiens
gccagctgcaggg

SEQ ID NO: 6274681 - DNA, 14 bp, Homo sapiens
gccagctgcagggc

SEQ ID NO: 6274682 - DNA, 15 bp, Homo sapiens
gccagctgcagggca

SEQ ID NO: 6274683 - DNA, 16 bp, Homo sapiens
gccagctgcagggcac

SEQ ID NO: 6274684 - DNA, 18 bp, Homo sapiens
gccagctgcccacaagcc

SEQ ID NO: 6274685 - DNA, 12 bp, Homo sapiens
gccagctgcccc

SEQ ID NO: 6274686 - DNA, 19 bp, Homo sapiens
gccagctgcccccagagcc

SEQ ID NO: 6274687 - DNA, 14 bp, Homo sapiens
gccagctgcccctc

SEQ ID NO: 6274688 - DNA, 15 bp, Homo sapiens
gccagctgccctatg

SEQ ID NO: 6274689 - DNA, 22 bp, Homo sapiens
gccagctgccctatgggcctgc

SEQ ID NO: 6274690 - DNA, 19 bp, Homo sapiens
gccagctgcccttgcaggg

SEQ ID NO: 6274691 - DNA, 20 bp, Homo sapiens
gccagctgccgaccagagcc

SEQ ID NO: 6274692 - DNA, 12 bp, Homo sapiens
gccagctgccta

SEQ ID NO: 6274693 - DNA, 13 bp, Homo sapiens
gccagctgcctcc

SEQ ID NO: 6274694 - DNA, 13 bp, Homo sapiens
gccagctgccttc

SEQ ID NO: 6274695 - DNA, 14 bp, Homo sapiens
gccagctgccttcc

SEQ ID NO: 6274696 - DNA, 15 bp, Homo sapiens
gccagctgcggccag

SEQ ID NO: 6274697 - DNA, 16 bp, Homo sapiens
gccagctgcggccagg

SEQ ID NO: 6274698 - DNA, 18 bp, Homo sapiens
gccagctgcggccaggcc

SEQ ID NO: 6274699 - DNA, 14 bp, Homo sapiens
gccagctgctcccc

SEQ ID NO: 6274700 - DNA, 13 bp, Homo sapiens
gccagctgcttct

SEQ ID NO: 6274701 - DNA, 19 bp, Homo sapiens
gccagctgcttctgcccac

SEQ ID NO: 6274702 - DNA, 17 bp, Homo sapiens
gccagctgcttgggctt

SEQ ID NO: 6274703 - DNA, 13 bp, Homo sapiens
gccagctgctttt

SEQ ID NO: 6274704 - DNA, 13 bp, Homo sapiens
gccagctggagaa

SEQ ID NO: 6274705 - DNA, 18 bp, Homo sapiens
gccagctggatcgctgca

SEQ ID NO: 6274706 - DNA, 13 bp, Homo sapiens
gccagctggccca

SEQ ID NO: 6274707 - DNA, 14 bp, Homo sapiens
gccagctggcccag

SEQ ID NO: 6274708 - DNA, 13 bp, Homo sapiens
gccagctggcctt

SEQ ID NO: 6274709 - DNA, 14 bp, Homo sapiens
gccagctgggagca

SEQ ID NO: 6274710 - DNA, 11 bp, Homo sapiens
gccagctgggg

SEQ ID NO: 6274711 - DNA, 20 bp, Homo sapiens
gccagctgggtgccccaggg

SEQ ID NO: 6274712 - DNA, 23 bp, Homo sapiens
gccagctgggtttagcccgaggc

SEQ ID NO: 6274713 - DNA, 12 bp, Homo sapiens
gccagctggtgc

SEQ ID NO: 6274714 - DNA, 13 bp, Homo sapiens
gccagctggtgct

SEQ ID NO: 6274715 - DNA, 19 bp, Homo sapiens
gccagctggtgctgcaagg

SEQ ID NO: 6274716 - DNA, 20 bp, Homo sapiens
gccagctggtgctgcaagga

SEQ ID NO: 6274717 - DNA, 16 bp, Homo sapiens
gccagctgtactgagt

SEQ ID NO: 6274718 - DNA, 19 bp, Homo sapiens
gccagctgtgtccttcggg

SEQ ID NO: 6274719 - DNA, 12 bp, Homo sapiens
gccagctgttta

SEQ ID NO: 6274720 - DNA, 22 bp, Homo sapiens
gccagcttaaacccatacaatg

SEQ ID NO: 6274721 - DNA, 16 bp, Homo sapiens
gccagcttcctgtgca

SEQ ID NO: 6274722 - DNA, 17 bp, Homo sapiens
gccagcttcctgtgcag

SEQ ID NO: 6274723 - DNA, 17 bp, Homo sapiens
gccagcttcgagctaca

SEQ ID NO: 6274724 - DNA, 17 bp, Homo sapiens
gccagcttcgtgctgga

SEQ ID NO: 6274725 - DNA, 16 bp, Homo sapiens
gccagcttctcctgcg

SEQ ID NO: 6274726 - DNA, 13 bp, Homo sapiens
gccagcttctctc

SEQ ID NO: 6274727 - DNA, 14 bp, Homo sapiens
gccagcttctctct

SEQ ID NO: 6274728 - DNA, 15 bp, Homo sapiens
gccagcttctctctc

SEQ ID NO: 6274729 - DNA, 20 bp, Homo sapiens
gccagcttctctctccaggg

SEQ ID NO: 6274730 - DNA, 15 bp, Homo sapiens
gccagcttggcaggg

SEQ ID NO: 6274731 - DNA, 18 bp, Homo sapiens
gccagcttgttatttata

SEQ ID NO: 6274732 - DNA, 17 bp, Homo sapiens
gccagcttttcctccct

SEQ ID NO: 6274733 - DNA, 14 bp, Homo sapiens
gccaggaacaggga

SEQ ID NO: 6274734 - DNA, 21 bp, Homo sapiens
gccaggaacagggaccagctc

SEQ ID NO: 6274735 - DNA, 21 bp, Homo sapiens
gccaggaactggctcctttgc

SEQ ID NO: 6274736 - DNA, 13 bp, Homo sapiens
gccaggaagaatg

SEQ ID NO: 6274737 - DNA, 23 bp, Homo sapiens
gccaggaagaatggtgtgtttcc

SEQ ID NO: 6274738 - DNA, 13 bp, Homo sapiens
gccaggaagccag

SEQ ID NO: 6274739 - DNA, 16 bp, Homo sapiens
gccaggaagccagagc

SEQ ID NO: 6274740 - DNA, 17 bp, Homo sapiens
gccaggaagccagcagg

SEQ ID NO: 6274741 - DNA, 19 bp, Homo sapiens
gccaggaagccagcaggct

SEQ ID NO: 6274742 - DNA, 18 bp, Homo sapiens
gcttgtttgttttgaata

SEQ ID NO: 6274743 - DNA, 16 bp, Homo sapiens
gcttgttttattttgg

SEQ ID NO: 6274744 - DNA, 15 bp, Homo sapiens
gctttaaaaaataaa

SEQ ID NO: 6274745 - DNA, 15 bp, Homo sapiens
gctttaaaaactatt

SEQ ID NO: 6274746 - DNA, 15 bp, Homo sapiens
gctttaaaaagaaaa

SEQ ID NO: 6274747 - DNA, 20 bp, Homo sapiens
gctttaaaaagggaagaaac

SEQ ID NO: 6274748 - DNA, 18 bp, Homo sapiens
gctttaaaaatgcaatat

SEQ ID NO: 6274749 - DNA, 13 bp, Homo sapiens
gctttaaaacaaa

SEQ ID NO: 6274750 - DNA, 23 bp, Homo sapiens
gctttaaaaccacagctgggcag

SEQ ID NO: 6274751 - DNA, 15 bp, Homo sapiens
gctttaaaagaaaaa

SEQ ID NO: 6274752 - DNA, 22 bp, Homo sapiens
gctttaaactaccctccagagt

SEQ ID NO: 6274753 - DNA, 15 bp, Homo sapiens
gctttaaagtgtaat

SEQ ID NO: 6274754 - DNA, 12 bp, Homo sapiens
gctttaaataaa

SEQ ID NO: 6274755 - DNA, 15 bp, Homo sapiens
gctttaaataaatta

SEQ ID NO: 6274756 - DNA, 16 bp, Homo sapiens
gctttaaataaattaa

SEQ ID NO: 6274757 - DNA, 22 bp, Homo sapiens
gctttaaataaattaagatcct

SEQ ID NO: 6274758 - DNA, 13 bp, Homo sapiens
gctttaaatctta

SEQ ID NO: 6274759 - DNA, 14 bp, Homo sapiens
gctttaaatgacag

SEQ ID NO: 6274760 - DNA, 19 bp, Homo sapiens
gctttaaatgacagtaata

SEQ ID NO: 6274761 - DNA, 22 bp, Homo sapiens
gctttaacaaaacaagaaagaa

SEQ ID NO: 6274762 - DNA, 13 bp, Homo sapiens
gctttaacagtgg

SEQ ID NO: 6274763 - DNA, 21 bp, Homo sapiens
gctttaacctgaaccttgagc

SEQ ID NO: 6274764 - DNA, 22 bp, Homo sapiens
gctttaagaactaaaatgttct

SEQ ID NO: 6274765 - DNA, 19 bp, Homo sapiens
gctttaagatatctttgga

SEQ ID NO: 6274766 - DNA, 13 bp, Homo sapiens
gctttaatataaa

SEQ ID NO: 6274767 - DNA, 16 bp, Homo sapiens
gctttaatataaatgc

SEQ ID NO: 6274768 - DNA, 20 bp, Homo sapiens
gctttaatatcatcagtatt

SEQ ID NO: 6274769 - DNA, 22 bp, Homo sapiens
gctttaatatgagcttcaatat

SEQ ID NO: 6274770 - DNA, 23 bp, Homo sapiens
gctttaatatgagcttcaatata

SEQ ID NO: 6274771 - DNA, 15 bp, Homo sapiens
gctttaatcaatcat

SEQ ID NO: 6274772 - DNA, 11 bp, Homo sapiens
gctttaatgag

SEQ ID NO: 6274773 - DNA, 21 bp, Homo sapiens
gctttaatgagaatagaaacg

SEQ ID NO: 6274774 - DNA, 21 bp, Homo sapiens
gctttaatgagtgcacctgcc

SEQ ID NO: 6274775 - DNA, 23 bp, Homo sapiens
gctttaatgagtgcacctgcctc

SEQ ID NO: 6274776 - DNA, 23 bp, Homo sapiens
gctttaattaattaagtatctgg

SEQ ID NO: 6274777 - DNA, 23 bp, Homo sapiens
gctttaattcagctttagaaatt

SEQ ID NO: 6274778 - DNA, 20 bp, Homo sapiens
gctttaattccatgaatgtt

SEQ ID NO: 6274779 - DNA, 15 bp, Homo sapiens
gctttaattgcttta

SEQ ID NO: 6274780 - DNA, 13 bp, Homo sapiens
gctttaattgtat

SEQ ID NO: 6274781 - DNA, 21 bp, Homo sapiens
gctttaatttttttaaccaaa

SEQ ID NO: 6274782 - DNA, 15 bp, Homo sapiens
gctttacaaaaagac

SEQ ID NO: 6274783 - DNA, 12 bp, Homo sapiens
gctttacacaca

SEQ ID NO: 6274784 - DNA, 15 bp, Homo sapiens
gctttacactcattt

SEQ ID NO: 6274785 - DNA, 18 bp, Homo sapiens
gctttacaggatcatgta

SEQ ID NO: 6274786 - DNA, 18 bp, Homo sapiens
gctttacatattcctttg

SEQ ID NO: 6274787 - DNA, 15 bp, Homo sapiens
gctttacattttatt

SEQ ID NO: 6274788 - DNA, 22 bp, Homo sapiens
gctttacattttcagtaccaaa

SEQ ID NO: 6274789 - DNA, 23 bp, Homo sapiens
gctttacattttcagtaccaaag

SEQ ID NO: 6274790 - DNA, 22 bp, Homo sapiens
gctttaccaattgaagtaaaat

SEQ ID NO: 6274791 - DNA, 18 bp, Homo sapiens
gctttacctaagtgttga

SEQ ID NO: 6274792 - DNA, 15 bp, Homo sapiens
gctttaccttcctga

SEQ ID NO: 6274793 - DNA, 16 bp, Homo sapiens
gctttaccttcctgat

SEQ ID NO: 6274794 - DNA, 21 bp, Homo sapiens
gctttaccttttcagggctgg

SEQ ID NO: 6274795 - DNA, 20 bp, Homo sapiens
gctttacctttttgtatgtg

SEQ ID NO: 6274796 - DNA, 22 bp, Homo sapiens
gctttactctttcatgccattt

SEQ ID NO: 6274797 - DNA, 18 bp, Homo sapiens
gctttactgtttctcaag

SEQ ID NO: 6274798 - DNA, 16 bp, Homo sapiens
gctttacttagcttat

SEQ ID NO: 6274799 - DNA, 21 bp, Homo sapiens
gctttacttagcttatcaatt

SEQ ID NO: 6274800 - DNA, 20 bp, Homo sapiens
gctttagaaaggttttgagc

SEQ ID NO: 6274801 - DNA, 19 bp, Homo sapiens
gctttagaaccgtaggttt

SEQ ID NO: 6274802 - DNA, 14 bp, Homo sapiens
gctttagaccctgg

SEQ ID NO: 6274803 - DNA, 16 bp, Homo sapiens
gctttagaccctgggt

SEQ ID NO: 6274804 - DNA, 14 bp, Homo sapiens
gctttagacttgaa

SEQ ID NO: 6274805 - DNA, 15 bp, Homo sapiens
gctttagacttgaaa

SEQ ID NO: 6274806 - DNA, 17 bp, Homo sapiens
gctttagacttgaaaag

SEQ ID NO: 6274807 - DNA, 24 bp, Homo sapiens
gctttagacttgaaaagagacagg

SEQ ID NO: 6274808 - DNA, 16 bp, Homo sapiens
gctttagagaagccat

SEQ ID NO: 6274809 - DNA, 18 bp, Homo sapiens
gctttagagataattgct

SEQ ID NO: 6274810 - DNA, 20 bp, Homo sapiens
gctttagatgtgtatacaga

SEQ ID NO: 6274811 - DNA, 21 bp, Homo sapiens
gctttagatgtgtatacagaa

SEQ ID NO: 6274812 - DNA, 14 bp, Homo sapiens
gctttagattgaaa

SEQ ID NO: 6274813 - DNA, 16 bp, Homo sapiens
gctttagattgaaatt

SEQ ID NO: 6274814 - DNA, 22 bp, Homo sapiens
gctttaggactgacatttctat

SEQ ID NO: 6274815 - DNA, 17 bp, Homo sapiens
gctttaggattgaagtg

SEQ ID NO: 6274816 - DNA, 13 bp, Homo sapiens
gctttaggcagag

SEQ ID NO: 6274817 - DNA, 18 bp, Homo sapiens
gctttaggggaaggggga

SEQ ID NO: 6274818 - DNA, 18 bp, Homo sapiens
gctttagggtttaaaata

SEQ ID NO: 6274819 - DNA, 21 bp, Homo sapiens
gctttagtggccatcatttct

SEQ ID NO: 6274820 - DNA, 10 bp, Homo sapiens
gctttataaa

SEQ ID NO: 6274821 - DNA, 14 bp, Homo sapiens
gctttataaacttt

SEQ ID NO: 6274822 - DNA, 17 bp, Homo sapiens
gctttataaagcagtta

SEQ ID NO: 6274823 - DNA, 17 bp, Homo sapiens
gctttataccccatttg

SEQ ID NO: 6274824 - DNA, 23 bp, Homo sapiens
gctttataccccatttgatttcg

SEQ ID NO: 6274825 - DNA, 16 bp, Homo sapiens
gctttatatatggaca

SEQ ID NO: 6274826 - DNA, 18 bp, Homo sapiens
gctttatatatggacatg

SEQ ID NO: 6274827 - DNA, 22 bp, Homo sapiens
gctttatcagaagcaaggaagt

SEQ ID NO: 6274828 - DNA, 21 bp, Homo sapiens
gctttatccccgtttcttgca

SEQ ID NO: 6274829 - DNA, 15 bp, Homo sapiens
gctttatcctcttta

SEQ ID NO: 6274830 - DNA, 16 bp, Homo sapiens
gctttatcctctttag

SEQ ID NO: 6274831 - DNA, 17 bp, Homo sapiens
gctttatcctctttaga

SEQ ID NO: 6274832 - DNA, 20 bp, Homo sapiens
gctttatcctctttagagtt

SEQ ID NO: 6274833 - DNA, 20 bp, Homo sapiens
gctttatcgaacgtggtctg

SEQ ID NO: 6274834 - DNA, 17 bp, Homo sapiens
gctttatctttgtgtaa

SEQ ID NO: 6274835 - DNA, 17 bp, Homo sapiens
gctttatgaagttaaca

SEQ ID NO: 6274836 - DNA, 20 bp, Homo sapiens
gctttatgataatagattct

SEQ ID NO: 6274837 - DNA, 12 bp, Homo sapiens
gctttatgattt

SEQ ID NO: 6274838 - DNA, 16 bp, Homo sapiens
gctttatgattttcat

SEQ ID NO: 6274839 - DNA, 15 bp, Homo sapiens
gctttatgcaaatac

SEQ ID NO: 6274840 - DNA, 14 bp, Homo sapiens
gctttatgctgaaa

SEQ ID NO: 6274841 - DNA, 14 bp, Homo sapiens
gctttatgctgtgt

SEQ ID NO: 6274842 - DNA, 15 bp, Homo sapiens
gctttatgtaataat

SEQ ID NO: 6274843 - DNA, 12 bp, Homo sapiens
gctttatgttca

SEQ ID NO: 6274844 - DNA, 16 bp, Homo sapiens
gctttattatggcttg

SEQ ID NO: 6274845 - DNA, 21 bp, Homo sapiens
gctttattatggcttgtgaac

SEQ ID NO: 6274846 - DNA, 13 bp, Homo sapiens
gctttattcttca

SEQ ID NO: 6274847 - DNA, 19 bp, Homo sapiens
gctttattgaattagaaaa

SEQ ID NO: 6274848 - DNA, 21 bp, Homo sapiens
gctttattgcccatgggatat

SEQ ID NO: 6274849 - DNA, 18 bp, Homo sapiens
gctttatttataaaataa

SEQ ID NO: 6274850 - DNA, 18 bp, Homo sapiens
gctttattttgagatgta

SEQ ID NO: 6274851 - DNA, 20 bp, Homo sapiens
gctttatttttcttttcctg

SEQ ID NO: 6274852 - DNA, 19 bp, Homo sapiens
gctttattttttaagtatt

SEQ ID NO: 6274853 - DNA, 23 bp, Homo sapiens
gctttattttttaagtatttata

SEQ ID NO: 6274854 - DNA, 22 bp, Homo sapiens
gctttcaaaataaggatgactt

SEQ ID NO: 6274855 - DNA, 22 bp, Homo sapiens
gctttcaaagctaaaatatata

SEQ ID NO: 6274856 - DNA, 14 bp, Homo sapiens
gctttcaaatgtac

SEQ ID NO: 6274857 - DNA, 20 bp, Homo sapiens
gctttcaacttaaatcactg

SEQ ID NO: 6274858 - DNA, 17 bp, Homo sapiens
gctttcaaggctggggc

SEQ ID NO: 6274859 - DNA, 11 bp, Homo sapiens
gctttcaagtg

SEQ ID NO: 6274860 - DNA, 15 bp, Homo sapiens
gctttcaagtgcctt

SEQ ID NO: 6274861 - DNA, 21 bp, Homo sapiens
gctttcaattccgtagccagc

SEQ ID NO: 6274862 - DNA, 21 bp, Homo sapiens
gctttcaattgacaaatgatg

SEQ ID NO: 6274863 - DNA, 15 bp, Homo sapiens
gctttcaattgtatt

SEQ ID NO: 6274864 - DNA, 15 bp, Homo sapiens
gctttcaccagccac

SEQ ID NO: 6274865 - DNA, 19 bp, Homo sapiens
gctttcactatttccttta

SEQ ID NO: 6274866 - DNA, 18 bp, Homo sapiens
gctttcagatactggatt

SEQ ID NO: 6274867 - DNA, 19 bp, Homo sapiens
gctttcagatgcagttttc

SEQ ID NO: 6274868 - DNA, 15 bp, Homo sapiens
gctttcagcctctgg

SEQ ID NO: 6274869 - DNA, 20 bp, Homo sapiens
gctttcagcgcccccaggcc

SEQ ID NO: 6274870 - DNA, 21 bp, Homo sapiens
gctttcagcgcccccaggcct

SEQ ID NO: 6274871 - DNA, 13 bp, Homo sapiens
gctttcagctgtg

SEQ ID NO: 6274872 - DNA, 17 bp, Homo sapiens
gctttcagctgtgcttt

SEQ ID NO: 6274873 - DNA, 17 bp, Homo sapiens
gctttcagggcagcccc

SEQ ID NO: 6274874 - DNA, 20 bp, Homo sapiens
gctttcagggcagcccctgc

SEQ ID NO: 6274875 - DNA, 20 bp, Homo sapiens
gctttcagtgcctgctgttc

SEQ ID NO: 6274876 - DNA, 20 bp, Homo sapiens
gctttcataaatcatgttgt

SEQ ID NO: 6274877 - DNA, 22 bp, Homo sapiens
gctttcatcacaaatccaaagg

SEQ ID NO: 6274878 - DNA, 19 bp, Homo sapiens
gctttcatccaactggaag

SEQ ID NO: 6274879 - DNA, 13 bp, Homo sapiens
gctttcatcctgt

SEQ ID NO: 6274880 - DNA, 15 bp, Homo sapiens
gctttcatcctgtgt

SEQ ID NO: 6274881 - DNA, 22 bp, Homo sapiens
gctttcatcctgtgtcccctga

SEQ ID NO: 6274882 - DNA, 12 bp, Homo sapiens
gctttcatgtaa

SEQ ID NO: 6274883 - DNA, 21 bp, Homo sapiens
gctttcattttctctcaggtg

SEQ ID NO: 6274884 - DNA, 19 bp, Homo sapiens
gctttccaaaccttatctc

SEQ ID NO: 6274885 - DNA, 16 bp, Homo sapiens
gctttccaacacacaa

SEQ ID NO: 6274886 - DNA, 17 bp, Homo sapiens
gctttccaaggaagcag

SEQ ID NO: 6274887 - DNA, 23 bp, Homo sapiens
gctttccagaaggccacaggcca

SEQ ID NO: 6274888 - DNA, 14 bp, Homo sapiens
gctttccagctcac

SEQ ID NO: 6274889 - DNA, 18 bp, Homo sapiens
gctttccagggtctttac

SEQ ID NO: 6274890 - DNA, 16 bp, Homo sapiens
gctttccatctgagga

SEQ ID NO: 6274891 - DNA, 15 bp, Homo sapiens
gctttccatgggacc

SEQ ID NO: 6274892 - DNA, 22 bp, Homo sapiens
gctttccatttttttctttact

SEQ ID NO: 6274893 - DNA, 20 bp, Homo sapiens
gctttcccagaggacaccta

SEQ ID NO: 6274894 - DNA, 12 bp, Homo sapiens
gctttcccaggt

SEQ ID NO: 6274895 - DNA, 22 bp, Homo sapiens
gctttccccatgtctcgactca

SEQ ID NO: 6274896 - DNA, 19 bp, Homo sapiens
gctttcccccaactcagga

SEQ ID NO: 6274897 - DNA, 23 bp, Homo sapiens
gctttcccccacttttctctcta

SEQ ID NO: 6274898 - DNA, 19 bp, Homo sapiens
gctttcccccaggcgcctg

SEQ ID NO: 6274899 - DNA, 13 bp, Homo sapiens
gctttccctgagg

SEQ ID NO: 6274900 - DNA, 15 bp, Homo sapiens
gctttccctgcctct

SEQ ID NO: 6274901 - DNA, 12 bp, Homo sapiens
gctttccctggc

SEQ ID NO: 6274902 - DNA, 15 bp, Homo sapiens
gctttccctggctca

SEQ ID NO: 6274903 - DNA, 20 bp, Homo sapiens
gctttccctgtgccactttg

SEQ ID NO: 6274904 - DNA, 15 bp, Homo sapiens
gctttcccttggata

SEQ ID NO: 6274905 - DNA, 16 bp, Homo sapiens
gctttccggggaggag

SEQ ID NO: 6274906 - DNA, 18 bp, Homo sapiens
gctttcctatctagcatt

SEQ ID NO: 6274907 - DNA, 20 bp, Homo sapiens
gctttcctcaaaaagcagaa

SEQ ID NO: 6274908 - DNA, 24 bp, Homo sapiens
gctttcctcaaaaagcagaaggag

SEQ ID NO: 6274909 - DNA, 13 bp, Homo sapiens
gctttcctccctg

SEQ ID NO: 6274910 - DNA, 14 bp, Homo sapiens
gctttcctccctgg

SEQ ID NO: 6274911 - DNA, 13 bp, Homo sapiens
gctttcctgagcc

SEQ ID NO: 6274912 - DNA, 14 bp, Homo sapiens
gctttcctgcccca

SEQ ID NO: 6274913 - DNA, 17 bp, Homo sapiens
gctttcctgccccaggc

SEQ ID NO: 6274914 - DNA, 13 bp, Homo sapiens
gctttcctgcctc

SEQ ID NO: 6274915 - DNA, 17 bp, Homo sapiens
gctttcctgctggtccg

SEQ ID NO: 6274916 - DNA, 13 bp, Homo sapiens
gctttcctgctgt

SEQ ID NO: 6274917 - DNA, 14 bp, Homo sapiens
gctttcctgctgtc

SEQ ID NO: 6274918 - DNA, 19 bp, Homo sapiens
gctttcctgctgtcttctc

SEQ ID NO: 6274919 - DNA, 21 bp, Homo sapiens
gctttcctgctgtcttctccc

SEQ ID NO: 6274920 - DNA, 22 bp, Homo sapiens
gccaggaagctttggtgagaac

SEQ ID NO: 6274921 - DNA, 16 bp, Homo sapiens
gccaggaaggggacag

SEQ ID NO: 6274922 - DNA, 17 bp, Homo sapiens
gccaggaaggggacagg

SEQ ID NO: 6274923 - DNA, 19 bp, Homo sapiens
gccaggaagtagcacaggc

SEQ ID NO: 6274924 - DNA, 22 bp, Homo sapiens
gccaggaagtagcacaggctga

SEQ ID NO: 6274925 - DNA, 16 bp, Homo sapiens
gccaggaatctgccat

SEQ ID NO: 6274926 - DNA, 17 bp, Homo sapiens
gccaggaatttcccagg

SEQ ID NO: 6274927 - DNA, 22 bp, Homo sapiens
gccaggaatttcccaggaccct

SEQ ID NO: 6274928 - DNA, 18 bp, Homo sapiens
gccaggacaatgaaatac

SEQ ID NO: 6274929 - DNA, 10 bp, Homo sapiens
gccaggacac

SEQ ID NO: 6274930 - DNA, 15 bp, Homo sapiens
gccaggacacactga

SEQ ID NO: 6274931 - DNA, 14 bp, Homo sapiens
gccaggacacctgc

SEQ ID NO: 6274932 - DNA, 17 bp, Homo sapiens
gccaggacacctgcccc

SEQ ID NO: 6274933 - DNA, 15 bp, Homo sapiens
gccaggacagctgca

SEQ ID NO: 6274934 - DNA, 16 bp, Homo sapiens
gccaggacagctgcag

SEQ ID NO: 6274935 - DNA, 21 bp, Homo sapiens
gccaggacagctgcaggtgcc

SEQ ID NO: 6274936 - DNA, 23 bp, Homo sapiens
gccaggacagctgcaggtgccca

SEQ ID NO: 6274937 - DNA, 15 bp, Homo sapiens
gccaggacagctggc

SEQ ID NO: 6274938 - DNA, 16 bp, Homo sapiens
gccaggacagctggct

SEQ ID NO: 6274939 - DNA, 20 bp, Homo sapiens
gccaggacagctggctgctg

SEQ ID NO: 6274940 - DNA, 22 bp, Homo sapiens
gccaggacatgcaataaaattt

SEQ ID NO: 6274941 - DNA, 16 bp, Homo sapiens
gccaggaccacacagt

SEQ ID NO: 6274942 - DNA, 17 bp, Homo sapiens
gccaggaccacacagtc

SEQ ID NO: 6274943 - DNA, 23 bp, Homo sapiens
gccaggaccacacagtccccaga

SEQ ID NO: 6274944 - DNA, 15 bp, Homo sapiens
gccaggaccagcctg

SEQ ID NO: 6274945 - DNA, 16 bp, Homo sapiens
gccaggaccagcctgt

SEQ ID NO: 6274946 - DNA, 23 bp, Homo sapiens
gccaggaccccaggtcaggggct

SEQ ID NO: 6274947 - DNA, 24 bp, Homo sapiens
gccaggaccccaggtcaggggctc

SEQ ID NO: 6274948 - DNA, 19 bp, Homo sapiens
gccaggacccgccagcccc

SEQ ID NO: 6274949 - DNA, 22 bp, Homo sapiens
gccaggacccgccagccccgct

SEQ ID NO: 6274950 - DNA, 18 bp, Homo sapiens
gccaggaccctgacctcc

SEQ ID NO: 6274951 - DNA, 17 bp, Homo sapiens
gccaggaccgccaaaga

SEQ ID NO: 6274952 - DNA, 22 bp, Homo sapiens
gccaggacgtctggggtgtggg

SEQ ID NO: 6274953 - DNA, 13 bp, Homo sapiens
gccaggactccca

SEQ ID NO: 6274954 - DNA, 15 bp, Homo sapiens
gccaggactccccag

SEQ ID NO: 6274955 - DNA, 21 bp, Homo sapiens
gccaggactccccaggccagg

SEQ ID NO: 6274956 - DNA, 22 bp, Homo sapiens
gccaggactccccaggccaggc

SEQ ID NO: 6274957 - DNA, 12 bp, Homo sapiens
gccaggactctc

SEQ ID NO: 6274958 - DNA, 17 bp, Homo sapiens
gccaggactctgcagcc

SEQ ID NO: 6274959 - DNA, 21 bp, Homo sapiens
gccaggactctgcagcctcag

SEQ ID NO: 6274960 - DNA, 16 bp, Homo sapiens
gccaggactgagcccc

SEQ ID NO: 6274961 - DNA, 17 bp, Homo sapiens
gccaggactgagccccg

SEQ ID NO: 6274962 - DNA, 11 bp, Homo sapiens
gccaggactgt

SEQ ID NO: 6274963 - DNA, 12 bp, Homo sapiens
gccaggactgtg

SEQ ID NO: 6274964 - DNA, 23 bp, Homo sapiens
gccaggactgtgataatcagaag

SEQ ID NO: 6274965 - DNA, 9 bp, Homo sapiens
gccaggaga

SEQ ID NO: 6274966 - DNA, 18 bp, Homo sapiens
gccaggagaagttgaggg

SEQ ID NO: 6274967 - DNA, 19 bp, Homo sapiens
gccaggagaatctccgctt

SEQ ID NO: 6274968 - DNA, 11 bp, Homo sapiens
gccaggagacc

SEQ ID NO: 6274969 - DNA, 14 bp, Homo sapiens
gccaggagaccctg

SEQ ID NO: 6274970 - DNA, 16 bp, Homo sapiens
gccaggagaccctgtc

SEQ ID NO: 6274971 - DNA, 12 bp, Homo sapiens
gccaggagagag

SEQ ID NO: 6274972 - DNA, 14 bp, Homo sapiens
gccaggagatggcc

SEQ ID NO: 6274973 - DNA, 20 bp, Homo sapiens
gccaggagcaaatgtttctg

SEQ ID NO: 6274974 - DNA, 22 bp, Homo sapiens
gccaggagcaaatgtttctgca

SEQ ID NO: 6274975 - DNA, 15 bp, Homo sapiens
gccaggagcaatggg

SEQ ID NO: 6274976 - DNA, 21 bp, Homo sapiens
gccaggagcaatgggactgga

SEQ ID NO: 6274977 - DNA, 18 bp, Homo sapiens
gccaggagcacggctctg

SEQ ID NO: 6274978 - DNA, 19 bp, Homo sapiens
gccaggagcacggctctgt

SEQ ID NO: 6274979 - DNA, 16 bp, Homo sapiens
gccaggagcagccctg

SEQ ID NO: 6274980 - DNA, 19 bp, Homo sapiens
gccaggagcagcctccaag

SEQ ID NO: 6274981 - DNA, 14 bp, Homo sapiens
gccaggagccctgg

SEQ ID NO: 6274982 - DNA, 15 bp, Homo sapiens
gccaggagccctggc

SEQ ID NO: 6274983 - DNA, 17 bp, Homo sapiens
gccaggagccctggccc

SEQ ID NO: 6274984 - DNA, 19 bp, Homo sapiens
gccaggagccgggcctccc

SEQ ID NO: 6274985 - DNA, 21 bp, Homo sapiens
gccaggagcctcctgaccctg

SEQ ID NO: 6274986 - DNA, 17 bp, Homo sapiens
gccaggagcgcatctca

SEQ ID NO: 6274987 - DNA, 14 bp, Homo sapiens
gccaggagctcagc

SEQ ID NO: 6274988 - DNA, 22 bp, Homo sapiens
gccaggagctcttcaggcctcc

SEQ ID NO: 6274989 - DNA, 15 bp, Homo sapiens
gccaggagcttcttc

SEQ ID NO: 6274990 - DNA, 13 bp, Homo sapiens
gccaggaggctgc

SEQ ID NO: 6274991 - DNA, 12 bp, Homo sapiens
gccaggagggac

SEQ ID NO: 6274992 - DNA, 13 bp, Homo sapiens
gccaggagggaca

SEQ ID NO: 6274993 - DNA, 19 bp, Homo sapiens
gccaggagggacaaaggag

SEQ ID NO: 6274994 - DNA, 22 bp, Homo sapiens
gccaggagggacaaaggagcct

SEQ ID NO: 6274995 - DNA, 23 bp, Homo sapiens
gccaggagggacaaaggagcctg

SEQ ID NO: 6274996 - DNA, 17 bp, Homo sapiens
gccaggaggtagtttct

SEQ ID NO: 6274997 - DNA, 18 bp, Homo sapiens
gccaggaggtgccactgg

SEQ ID NO: 6274998 - DNA, 13 bp, Homo sapiens
gccaggagtaaga

SEQ ID NO: 6274999 - DNA, 16 bp, Homo sapiens
gccaggagtctgtgct

SEQ ID NO: 6275000 - DNA, 13 bp, Homo sapiens
gccaggagtgggt

SEQ ID NO: 6275001 - DNA, 16 bp, Homo sapiens
gccaggagtgggtggg

SEQ ID NO: 6275002 - DNA, 22 bp, Homo sapiens
gccaggagtgggtgggacacag

SEQ ID NO: 6275003 - DNA, 17 bp, Homo sapiens
gccaggatcatggtgta

SEQ ID NO: 6275004 - DNA, 24 bp, Homo sapiens
gccaggatcatggtgtaataagac

SEQ ID NO: 6275005 - DNA, 17 bp, Homo sapiens
gccaggatcccaagcgt

SEQ ID NO: 6275006 - DNA, 16 bp, Homo sapiens
gccaggatccccctct

SEQ ID NO: 6275007 - DNA, 19 bp, Homo sapiens
gccaggatccccctctttg

SEQ ID NO: 6275008 - DNA, 20 bp, Homo sapiens
gccaggatccccctctttgc

SEQ ID NO: 6275009 - DNA, 22 bp, Homo sapiens
gccaggatggaacacggccaca

SEQ ID NO: 6275010 - DNA, 14 bp, Homo sapiens
gccaggatggaatg

SEQ ID NO: 6275011 - DNA, 19 bp, Homo sapiens
gccaggattcaggcctctg

SEQ ID NO: 6275012 - DNA, 23 bp, Homo sapiens
gccaggattcaggcctctgagga

SEQ ID NO: 6275013 - DNA, 22 bp, Homo sapiens
gccaggcaacttcagtcctggg

SEQ ID NO: 6275014 - DNA, 17 bp, Homo sapiens
gccaggcacacactgtg

SEQ ID NO: 6275015 - DNA, 13 bp, Homo sapiens
gccaggcacaggc

SEQ ID NO: 6275016 - DNA, 15 bp, Homo sapiens
gccaggcacagggcc

SEQ ID NO: 6275017 - DNA, 16 bp, Homo sapiens
gccaggcacagggccc

SEQ ID NO: 6275018 - DNA, 18 bp, Homo sapiens
gccaggcaccacagcctc

SEQ ID NO: 6275019 - DNA, 20 bp, Homo sapiens
gccaggcaccacagcctcca

SEQ ID NO: 6275020 - DNA, 23 bp, Homo sapiens
gccaggcaccatctgccaatgcc

SEQ ID NO: 6275021 - DNA, 18 bp, Homo sapiens
gccaggcacccacatccc

SEQ ID NO: 6275022 - DNA, 19 bp, Homo sapiens
gccaggcacccatgtgggc

SEQ ID NO: 6275023 - DNA, 20 bp, Homo sapiens
gccaggcaccccctggagag

SEQ ID NO: 6275024 - DNA, 15 bp, Homo sapiens
gccaggcacctggcc

SEQ ID NO: 6275025 - DNA, 20 bp, Homo sapiens
gccaggcacctggcctgctg

SEQ ID NO: 6275026 - DNA, 23 bp, Homo sapiens
gccaggcacctggcctgctggga

SEQ ID NO: 6275027 - DNA, 12 bp, Homo sapiens
gccaggcactct

SEQ ID NO: 6275028 - DNA, 20 bp, Homo sapiens
gccaggcactgcccttttca

SEQ ID NO: 6275029 - DNA, 22 bp, Homo sapiens
gccaggcactgcccttttcagg

SEQ ID NO: 6275030 - DNA, 23 bp, Homo sapiens
gccaggcactgcccttttcagga

SEQ ID NO: 6275031 - DNA, 10 bp, Homo sapiens
gccaggcaga

SEQ ID NO: 6275032 - DNA, 19 bp, Homo sapiens
gccaggcagaatggctgca

SEQ ID NO: 6275033 - DNA, 14 bp, Homo sapiens
gccaggcagagctg

SEQ ID NO: 6275034 - DNA, 14 bp, Homo sapiens
gccaggcagaggtt

SEQ ID NO: 6275035 - DNA, 13 bp, Homo sapiens
gccaggcagatga

SEQ ID NO: 6275036 - DNA, 11 bp, Homo sapiens
gccaggcaggc

SEQ ID NO: 6275037 - DNA, 19 bp, Homo sapiens
gccaggcaggcgggcgcca

SEQ ID NO: 6275038 - DNA, 15 bp, Homo sapiens
gccaggcagggagag

SEQ ID NO: 6275039 - DNA, 23 bp, Homo sapiens
gccaggcagggagagagtagctg

SEQ ID NO: 6275040 - DNA, 21 bp, Homo sapiens
gccaggcagggagtgtctgca

SEQ ID NO: 6275041 - DNA, 22 bp, Homo sapiens
gccaggcagggagtgtctgcag

SEQ ID NO: 6275042 - DNA, 23 bp, Homo sapiens
gccaggcagtaaggtagaaatag

SEQ ID NO: 6275043 - DNA, 23 bp, Homo sapiens
gccaggcatggcccagcctggag

SEQ ID NO: 6275044 - DNA, 21 bp, Homo sapiens
gccaggcattcaatcctcagg

SEQ ID NO: 6275045 - DNA, 23 bp, Homo sapiens
gccaggccaatgttgctgatggc

SEQ ID NO: 6275046 - DNA, 12 bp, Homo sapiens
gccaggccagag

SEQ ID NO: 6275047 - DNA, 13 bp, Homo sapiens
gccaggccagcag

SEQ ID NO: 6275048 - DNA, 13 bp, Homo sapiens
gccaggccagcct

SEQ ID NO: 6275049 - DNA, 15 bp, Homo sapiens
gccaggccagcctcc

SEQ ID NO: 6275050 - DNA, 13 bp, Homo sapiens
gccaggccagctg

SEQ ID NO: 6275051 - DNA, 22 bp, Homo sapiens
gccaggccaggaccacacagtc

SEQ ID NO: 6275052 - DNA, 15 bp, Homo sapiens
gccaggccatggcca

SEQ ID NO: 6275053 - DNA, 17 bp, Homo sapiens
gccaggccatggccaag

SEQ ID NO: 6275054 - DNA, 14 bp, Homo sapiens
gccaggcccaggca

SEQ ID NO: 6275055 - DNA, 16 bp, Homo sapiens
gccaggcccaggcaga

SEQ ID NO: 6275056 - DNA, 15 bp, Homo sapiens
gccaggcccaggcca

SEQ ID NO: 6275057 - DNA, 21 bp, Homo sapiens
gccaggcccatctcaggtgcc

SEQ ID NO: 6275058 - DNA, 12 bp, Homo sapiens
gccaggccccac

SEQ ID NO: 6275059 - DNA, 15 bp, Homo sapiens
gccaggccccacccc

SEQ ID NO: 6275060 - DNA, 19 bp, Homo sapiens
gccaggcccccaagcctgc

SEQ ID NO: 6275061 - DNA, 23 bp, Homo sapiens
gccaggcccccaagcctgcagtc

SEQ ID NO: 6275062 - DNA, 18 bp, Homo sapiens
gccaggccctccagcagg

SEQ ID NO: 6275063 - DNA, 22 bp, Homo sapiens
gccaggccctcctgctggctga

SEQ ID NO: 6275064 - DNA, 16 bp, Homo sapiens
gccaggccctctctgc

SEQ ID NO: 6275065 - DNA, 20 bp, Homo sapiens
gccaggccctctctgcagtc

SEQ ID NO: 6275066 - DNA, 19 bp, Homo sapiens
gccaggccctctgcccact

SEQ ID NO: 6275067 - DNA, 19 bp, Homo sapiens
gccaggccctggagggcag

SEQ ID NO: 6275068 - DNA, 19 bp, Homo sapiens
gccaggccgcgcccagcag

SEQ ID NO: 6275069 - DNA, 13 bp, Homo sapiens
gccaggccgggaa

SEQ ID NO: 6275070 - DNA, 20 bp, Homo sapiens
gccaggcctcagggaccaag

SEQ ID NO: 6275071 - DNA, 15 bp, Homo sapiens
gccaggcctcgcctg

SEQ ID NO: 6275072 - DNA, 17 bp, Homo sapiens
gccaggcctcgcctgcc

SEQ ID NO: 6275073 - DNA, 20 bp, Homo sapiens
gccaggcctcgcctgccctc

SEQ ID NO: 6275074 - DNA, 22 bp, Homo sapiens
gccaggcctcgcctgccctcct

SEQ ID NO: 6275075 - DNA, 21 bp, Homo sapiens
gccaggcctctactaggtctg

SEQ ID NO: 6275076 - DNA, 14 bp, Homo sapiens
gccaggcctctccc

SEQ ID NO: 6275077 - DNA, 23 bp, Homo sapiens
gccaggcctctccctcctccagg

SEQ ID NO: 6275078 - DNA, 17 bp, Homo sapiens
gccaggcctctgctggc

SEQ ID NO: 6275079 - DNA, 19 bp, Homo sapiens
gccaggcctctgctggctc

SEQ ID NO: 6275080 - DNA, 15 bp, Homo sapiens
gccaggcctgcagac

SEQ ID NO: 6275081 - DNA, 15 bp, Homo sapiens
gccaggcctgccagc

SEQ ID NO: 6275082 - DNA, 15 bp, Homo sapiens
gccaggcctggctgg

SEQ ID NO: 6275083 - DNA, 21 bp, Homo sapiens
gccaggcctgggtctgtgtct

SEQ ID NO: 6275084 - DNA, 16 bp, Homo sapiens
gccaggcctgtatgag

SEQ ID NO: 6275085 - DNA, 22 bp, Homo sapiens
gccaggccttacatctggctgg

SEQ ID NO: 6275086 - DNA, 16 bp, Homo sapiens
gccaggcgagatgggg

SEQ ID NO: 6275087 - DNA, 20 bp, Homo sapiens
gccaggcgagcctgactctg

SEQ ID NO: 6275088 - DNA, 22 bp, Homo sapiens
gccaggcgcatgtctgcacctc

SEQ ID NO: 6275089 - DNA, 23 bp, Homo sapiens
gccaggcgcatgtctgcacctcc

SEQ ID NO: 6275090 - DNA, 22 bp, Homo sapiens
gccaggcggacaaagttcagtg

SEQ ID NO: 6275091 - DNA, 14 bp, Homo sapiens
gccaggcggccctg

SEQ ID NO: 6275092 - DNA, 18 bp, Homo sapiens
gccaggcggccctgggga

SEQ ID NO: 6275093 - DNA, 19 bp, Homo sapiens
gccaggcggccctggggag

SEQ ID NO: 6275094 - DNA, 19 bp, Homo sapiens
gccaggcggggcgccccaa

SEQ ID NO: 6275095 - DNA, 23 bp, Homo sapiens
gccaggcggggcgccccaagagc

SEQ ID NO: 6275096 - DNA, 20 bp, Homo sapiens
gccaggctatggttgccacc

SEQ ID NO: 6275097 - DNA, 12 bp, Homo sapiens
gctttcctgggc

SEQ ID NO: 6275098 - DNA, 15 bp, Homo sapiens
gctttcctggtccct

SEQ ID NO: 6275099 - DNA, 18 bp, Homo sapiens
gctttcctgtgccaggtg

SEQ ID NO: 6275100 - DNA, 17 bp, Homo sapiens
gctttcctgtttccagg

SEQ ID NO: 6275101 - DNA, 18 bp, Homo sapiens
gctttcctgtttctcagt

SEQ ID NO: 6275102 - DNA, 18 bp, Homo sapiens
gctttccttctccaggaa

SEQ ID NO: 6275103 - DNA, 22 bp, Homo sapiens
gctttcctttccttctggctcc

SEQ ID NO: 6275104 - DNA, 19 bp, Homo sapiens
gctttcctttctttactat

SEQ ID NO: 6275105 - DNA, 23 bp, Homo sapiens
gctttccttttattttttaaatg

SEQ ID NO: 6275106 - DNA, 16 bp, Homo sapiens
gctttccttttctctg

SEQ ID NO: 6275107 - DNA, 17 bp, Homo sapiens
gctttcggagctcctgt

SEQ ID NO: 6275108 - DNA, 19 bp, Homo sapiens
gctttcgtgtaaattatgt

SEQ ID NO: 6275109 - DNA, 21 bp, Homo sapiens
gctttctaccacacacagcct

SEQ ID NO: 6275110 - DNA, 14 bp, Homo sapiens
gctttctactcatt

SEQ ID NO: 6275111 - DNA, 15 bp, Homo sapiens
gctttctattgtaca

SEQ ID NO: 6275112 - DNA, 17 bp, Homo sapiens
gctttctattgtacaga

SEQ ID NO: 6275113 - DNA, 12 bp, Homo sapiens
gctttctcaggg

SEQ ID NO: 6275114 - DNA, 18 bp, Homo sapiens
gctttctcagtgtgtgtg

SEQ ID NO: 6275115 - DNA, 21 bp, Homo sapiens
gctttctccccaatgagactt

SEQ ID NO: 6275116 - DNA, 13 bp, Homo sapiens
gctttctccctca

SEQ ID NO: 6275117 - DNA, 21 bp, Homo sapiens
gctttctcctcatccatttct

SEQ ID NO: 6275118 - DNA, 13 bp, Homo sapiens
gctttctcctgga

SEQ ID NO: 6275119 - DNA, 14 bp, Homo sapiens
gctttctcctggag

SEQ ID NO: 6275120 - DNA, 12 bp, Homo sapiens
gctttctccttt

SEQ ID NO: 6275121 - DNA, 19 bp, Homo sapiens
gctttctcctttaattgta

SEQ ID NO: 6275122 - DNA, 14 bp, Homo sapiens
gctttctctccttg

SEQ ID NO: 6275123 - DNA, 15 bp, Homo sapiens
gctttctctctggct

SEQ ID NO: 6275124 - DNA, 16 bp, Homo sapiens
gctttctctctggctt

SEQ ID NO: 6275125 - DNA, 20 bp, Homo sapiens
gctttctctctggcttctct

SEQ ID NO: 6275126 - DNA, 22 bp, Homo sapiens
gctttctctctggcttctctct

SEQ ID NO: 6275127 - DNA, 19 bp, Homo sapiens
gctttctctgcctctgggc

SEQ ID NO: 6275128 - DNA, 20 bp, Homo sapiens
gctttctctgcctctgggca

SEQ ID NO: 6275129 - DNA, 21 bp, Homo sapiens
gctttctctgcctctgggcag

SEQ ID NO: 6275130 - DNA, 18 bp, Homo sapiens
gctttctctgcttcagct

SEQ ID NO: 6275131 - DNA, 20 bp, Homo sapiens
gctttctctgcttcagcttg

SEQ ID NO: 6275132 - DNA, 20 bp, Homo sapiens
gctttctctggacactgcca

SEQ ID NO: 6275133 - DNA, 14 bp, Homo sapiens
gctttctcttcata

SEQ ID NO: 6275134 - DNA, 19 bp, Homo sapiens
gctttctcttttctctttt

SEQ ID NO: 6275135 - DNA, 13 bp, Homo sapiens
gctttctgaaatt

SEQ ID NO: 6275136 - DNA, 19 bp, Homo sapiens
gctttctgaacagctggtg

SEQ ID NO: 6275137 - DNA, 17 bp, Homo sapiens
gctttctgccttagcct

SEQ ID NO: 6275138 - DNA, 14 bp, Homo sapiens
gctttctgggatgt

SEQ ID NO: 6275139 - DNA, 13 bp, Homo sapiens
gctttctgggctc

SEQ ID NO: 6275140 - DNA, 20 bp, Homo sapiens
gctttctgggctctggactc

SEQ ID NO: 6275141 - DNA, 17 bp, Homo sapiens
gctttctggggcctagc

SEQ ID NO: 6275142 - DNA, 16 bp, Homo sapiens
gctttctgtgcatgtg

SEQ ID NO: 6275143 - DNA, 13 bp, Homo sapiens
gctttctgttcat

SEQ ID NO: 6275144 - DNA, 18 bp, Homo sapiens
gctttctgttcatctctt

SEQ ID NO: 6275145 - DNA, 19 bp, Homo sapiens
gctttcttattttgtttga

SEQ ID NO: 6275146 - DNA, 14 bp, Homo sapiens
gctttcttcctgca

SEQ ID NO: 6275147 - DNA, 20 bp, Homo sapiens
gctttcttctacaaccagag

SEQ ID NO: 6275148 - DNA, 13 bp, Homo sapiens
gctttcttctctg

SEQ ID NO: 6275149 - DNA, 18 bp, Homo sapiens
gctttcttctctgcctcc

SEQ ID NO: 6275150 - DNA, 15 bp, Homo sapiens
gctttcttctttcct

SEQ ID NO: 6275151 - DNA, 15 bp, Homo sapiens
gctttcttgctccct

SEQ ID NO: 6275152 - DNA, 14 bp, Homo sapiens
gctttcttgctggt

SEQ ID NO: 6275153 - DNA, 17 bp, Homo sapiens
gctttcttgctggttgt

SEQ ID NO: 6275154 - DNA, 13 bp, Homo sapiens
gctttctttagaa

SEQ ID NO: 6275155 - DNA, 19 bp, Homo sapiens
gctttctttatcctaaaga

SEQ ID NO: 6275156 - DNA, 21 bp, Homo sapiens
gctttctttccgtcaccctgg

SEQ ID NO: 6275157 - DNA, 19 bp, Homo sapiens
gctttctttgattctcctt

SEQ ID NO: 6275158 - DNA, 21 bp, Homo sapiens
gctttctttggtaggtaaatc

SEQ ID NO: 6275159 - DNA, 23 bp, Homo sapiens
gctttctttggtaggtaaatcta

SEQ ID NO: 6275160 - DNA, 23 bp, Homo sapiens
gctttcttttctctatgaaaagc

SEQ ID NO: 6275161 - DNA, 18 bp, Homo sapiens
gctttctttttaaagctt

SEQ ID NO: 6275162 - DNA, 18 bp, Homo sapiens
gctttgaaaaaaagtttc

SEQ ID NO: 6275163 - DNA, 22 bp, Homo sapiens
gctttgaaaaaaagtttctatt

SEQ ID NO: 6275164 - DNA, 17 bp, Homo sapiens
gctttgaaagaagcaag

SEQ ID NO: 6275165 - DNA, 17 bp, Homo sapiens
gctttgaaattgaacct

SEQ ID NO: 6275166 - DNA, 15 bp, Homo sapiens
gctttgaacgtgcca

SEQ ID NO: 6275167 - DNA, 16 bp, Homo sapiens
gctttgaacgtgccag

SEQ ID NO: 6275168 - DNA, 20 bp, Homo sapiens
gctttgaacgtgccagcagc

SEQ ID NO: 6275169 - DNA, 19 bp, Homo sapiens
gctttgaaggaaccaagtg

SEQ ID NO: 6275170 - DNA, 17 bp, Homo sapiens
gctttgaatacccccag

SEQ ID NO: 6275171 - DNA, 20 bp, Homo sapiens
gctttgaatacccccagaga

SEQ ID NO: 6275172 - DNA, 15 bp, Homo sapiens
gctttgaatgcatgt

SEQ ID NO: 6275173 - DNA, 17 bp, Homo sapiens
gctttgacatgaaaaga

SEQ ID NO: 6275174 - DNA, 16 bp, Homo sapiens
gctttgacgggccagg

SEQ ID NO: 6275175 - DNA, 17 bp, Homo sapiens
gctttgacgggccaggc

SEQ ID NO: 6275176 - DNA, 18 bp, Homo sapiens
gctttgacgggccaggcc

SEQ ID NO: 6275177 - DNA, 20 bp, Homo sapiens
gctttgactcacctgttact

SEQ ID NO: 6275178 - DNA, 20 bp, Homo sapiens
gctttgactcaggagcctgt

SEQ ID NO: 6275179 - DNA, 15 bp, Homo sapiens
gctttgactgagcag

SEQ ID NO: 6275180 - DNA, 22 bp, Homo sapiens
gctttgactgagcagactggtg

SEQ ID NO: 6275181 - DNA, 14 bp, Homo sapiens
gctttgagaagaat

SEQ ID NO: 6275182 - DNA, 22 bp, Homo sapiens
gctttgagaagccttcagctcc

SEQ ID NO: 6275183 - DNA, 19 bp, Homo sapiens
gctttgagacaggtgcctg

SEQ ID NO: 6275184 - DNA, 23 bp, Homo sapiens
gctttgagacaggtgcctggggc

SEQ ID NO: 6275185 - DNA, 18 bp, Homo sapiens
gctttgagaccagaagaa

SEQ ID NO: 6275186 - DNA, 20 bp, Homo sapiens
gctttgagaccagaagaaaa

SEQ ID NO: 6275187 - DNA, 20 bp, Homo sapiens
gctttgagacctttcctctc

SEQ ID NO: 6275188 - DNA, 16 bp, Homo sapiens
gctttgagagagaaag

SEQ ID NO: 6275189 - DNA, 22 bp, Homo sapiens
gctttgagagagaaaggactcc

SEQ ID NO: 6275190 - DNA, 18 bp, Homo sapiens
gctttgagatttcagcta

SEQ ID NO: 6275191 - DNA, 15 bp, Homo sapiens
gctttgagcaactaa

SEQ ID NO: 6275192 - DNA, 22 bp, Homo sapiens
gctttgaggttgacctgtttct

SEQ ID NO: 6275193 - DNA, 17 bp, Homo sapiens
gctttgagtccacgccc

SEQ ID NO: 6275194 - DNA, 15 bp, Homo sapiens
gctttgagttgactt

SEQ ID NO: 6275195 - DNA, 16 bp, Homo sapiens
gctttgagttggaagc

SEQ ID NO: 6275196 - DNA, 12 bp, Homo sapiens
gctttgatatat

SEQ ID NO: 6275197 - DNA, 14 bp, Homo sapiens
gctttgatccctga

SEQ ID NO: 6275198 - DNA, 15 bp, Homo sapiens
gctttgatccctgac

SEQ ID NO: 6275199 - DNA, 14 bp, Homo sapiens
gctttgatcccttc

SEQ ID NO: 6275200 - DNA, 17 bp, Homo sapiens
gctttgatcccttctta

SEQ ID NO: 6275201 - DNA, 21 bp, Homo sapiens
gctttgatgttccttccagtg

SEQ ID NO: 6275202 - DNA, 20 bp, Homo sapiens
gctttgattcatagtaactt

SEQ ID NO: 6275203 - DNA, 17 bp, Homo sapiens
gctttgattccatctcc

SEQ ID NO: 6275204 - DNA, 19 bp, Homo sapiens
gctttgatttttgaagttg

SEQ ID NO: 6275205 - DNA, 14 bp, Homo sapiens
gctttgcaaagacc

SEQ ID NO: 6275206 - DNA, 21 bp, Homo sapiens
gctttgcaaccttgtacttta

SEQ ID NO: 6275207 - DNA, 22 bp, Homo sapiens
gctttgcaccgtggtcagaggg

SEQ ID NO: 6275208 - DNA, 17 bp, Homo sapiens
gctttgcaggctctggg

SEQ ID NO: 6275209 - DNA, 21 bp, Homo sapiens
gctttgcaggctctgggctca

SEQ ID NO: 6275210 - DNA, 14 bp, Homo sapiens
gctttgcagggaga

SEQ ID NO: 6275211 - DNA, 12 bp, Homo sapiens
gctttgcagtga

SEQ ID NO: 6275212 - DNA, 17 bp, Homo sapiens
gctttgcatgttccact

SEQ ID NO: 6275213 - DNA, 20 bp, Homo sapiens
gctttgcatgttccactaac

SEQ ID NO: 6275214 - DNA, 17 bp, Homo sapiens
gctttgcatttcttgtg

SEQ ID NO: 6275215 - DNA, 19 bp, Homo sapiens
gctttgccaagttgctgtc

SEQ ID NO: 6275216 - DNA, 15 bp, Homo sapiens
gctttgccagctgct

SEQ ID NO: 6275217 - DNA, 19 bp, Homo sapiens
gctttgccataaccacatt

SEQ ID NO: 6275218 - DNA, 16 bp, Homo sapiens
gctttgccatgtgctt

SEQ ID NO: 6275219 - DNA, 22 bp, Homo sapiens
gctttgcccaacaccagcccct

SEQ ID NO: 6275220 - DNA, 18 bp, Homo sapiens
gctttgcccaacctcagc

SEQ ID NO: 6275221 - DNA, 12 bp, Homo sapiens
gctttgcccagc

SEQ ID NO: 6275222 - DNA, 20 bp, Homo sapiens
gctttgccccactgggagag

SEQ ID NO: 6275223 - DNA, 18 bp, Homo sapiens
gctttgccctgctgccct

SEQ ID NO: 6275224 - DNA, 15 bp, Homo sapiens
gctttgccctggagc

SEQ ID NO: 6275225 - DNA, 22 bp, Homo sapiens
gctttgccctggagcagctatt

SEQ ID NO: 6275226 - DNA, 13 bp, Homo sapiens
gctttgcctctac

SEQ ID NO: 6275227 - DNA, 11 bp, Homo sapiens
gctttgcctgc

SEQ ID NO: 6275228 - DNA, 18 bp, Homo sapiens
gctttgccttccacgctg

SEQ ID NO: 6275229 - DNA, 22 bp, Homo sapiens
gctttgccttccacgctgtctc

SEQ ID NO: 6275230 - DNA, 13 bp, Homo sapiens
gctttgccttgca

SEQ ID NO: 6275231 - DNA, 12 bp, Homo sapiens
gctttgcgcact

SEQ ID NO: 6275232 - DNA, 22 bp, Homo sapiens
gctttgcggcatctccatttca

SEQ ID NO: 6275233 - DNA, 23 bp, Homo sapiens
gctttgctacaaatttatgcatt

SEQ ID NO: 6275234 - DNA, 16 bp, Homo sapiens
gctttgctccgctccc

SEQ ID NO: 6275235 - DNA, 20 bp, Homo sapiens
gctttgctccttcagttctg

SEQ ID NO: 6275236 - DNA, 15 bp, Homo sapiens
gctttgctctcaagg

SEQ ID NO: 6275237 - DNA, 16 bp, Homo sapiens
gctttgctctcaaggc

SEQ ID NO: 6275238 - DNA, 21 bp, Homo sapiens
gctttgctctcaaggcttgga

SEQ ID NO: 6275239 - DNA, 12 bp, Homo sapiens
gctttgctctgc

SEQ ID NO: 6275240 - DNA, 16 bp, Homo sapiens
gctttgctgcacagca

SEQ ID NO: 6275241 - DNA, 21 bp, Homo sapiens
gctttgctgcacagcaggacc

SEQ ID NO: 6275242 - DNA, 15 bp, Homo sapiens
gctttgctgctacag

SEQ ID NO: 6275243 - DNA, 14 bp, Homo sapiens
gctttgctgctatg

SEQ ID NO: 6275244 - DNA, 15 bp, Homo sapiens
gctttgctgctatga

SEQ ID NO: 6275245 - DNA, 14 bp, Homo sapiens
gctttgctttgtct

SEQ ID NO: 6275246 - DNA, 16 bp, Homo sapiens
gctttgctttgtctgg

SEQ ID NO: 6275247 - DNA, 15 bp, Homo sapiens
gctttggaaaaatct

SEQ ID NO: 6275248 - DNA, 21 bp, Homo sapiens
gctttggaaagttactgtaaa

SEQ ID NO: 6275249 - DNA, 22 bp, Homo sapiens
gctttggaaagttactgtaaat

SEQ ID NO: 6275250 - DNA, 20 bp, Homo sapiens
gctttggaagctctgttgca

SEQ ID NO: 6275251 - DNA, 16 bp, Homo sapiens
gctttggaatagatgg

SEQ ID NO: 6275252 - DNA, 23 bp, Homo sapiens
gctttggacacagtgttttatca

SEQ ID NO: 6275253 - DNA, 17 bp, Homo sapiens
gctttggacccaaggaa

SEQ ID NO: 6275254 - DNA, 18 bp, Homo sapiens
gctttggacccaaggaaa

SEQ ID NO: 6275255 - DNA, 19 bp, Homo sapiens
gctttggacccaaggaaaa

SEQ ID NO: 6275256 - DNA, 17 bp, Homo sapiens
gctttggatttgacatt

SEQ ID NO: 6275257 - DNA, 16 bp, Homo sapiens
gctttggcagtgccat

SEQ ID NO: 6275258 - DNA, 16 bp, Homo sapiens
gctttggcccaatgcc

SEQ ID NO: 6275259 - DNA, 16 bp, Homo sapiens
gctttggccctcagtg

SEQ ID NO: 6275260 - DNA, 14 bp, Homo sapiens
gctttggcctgagt

SEQ ID NO: 6275261 - DNA, 18 bp, Homo sapiens
gctttggcctgtgagcca

SEQ ID NO: 6275262 - DNA, 15 bp, Homo sapiens
gctttggcctttcct

SEQ ID NO: 6275263 - DNA, 16 bp, Homo sapiens
gctttggctctggctg

SEQ ID NO: 6275264 - DNA, 14 bp, Homo sapiens
gctttggctgaggg

SEQ ID NO: 6275265 - DNA, 20 bp, Homo sapiens
gctttggctgaggggcttgg

SEQ ID NO: 6275266 - DNA, 22 bp, Homo sapiens
gctttggctgaggggcttggga

SEQ ID NO: 6275267 - DNA, 22 bp, Homo sapiens
gctttggctgcacgtcaccctc

SEQ ID NO: 6275268 - DNA, 19 bp, Homo sapiens
gctttgggaaagcccagac

SEQ ID NO: 6275269 - DNA, 20 bp, Homo sapiens
gctttgggaaagcccagact

SEQ ID NO: 6275270 - DNA, 19 bp, Homo sapiens
gctttgggaaagctgcctc

SEQ ID NO: 6275271 - DNA, 19 bp, Homo sapiens
gctttgggaacactggcct

SEQ ID NO: 6275272 - DNA, 20 bp, Homo sapiens
gctttgggaagactgaggca

SEQ ID NO: 6275273 - DNA, 18 bp, Homo sapiens
gctttgggaagtttgctg

SEQ ID NO: 6275274 - DNA, 22 bp, Homo sapiens
gctttgggaagtttgctgtgct

SEQ ID NO: 6275275 - DNA, 17 bp, Homo sapiens
gccaggctcaggagaag

SEQ ID NO: 6275276 - DNA, 18 bp, Homo sapiens
gccaggctcaggccatgg

SEQ ID NO: 6275277 - DNA, 14 bp, Homo sapiens
gccaggctccctga

SEQ ID NO: 6275278 - DNA, 22 bp, Homo sapiens
gccaggctccctgaccaccctg

SEQ ID NO: 6275279 - DNA, 23 bp, Homo sapiens
gccaggctccctgaccaccctgc

SEQ ID NO: 6275280 - DNA, 22 bp, Homo sapiens
gccaggctcctacctgtctgct

SEQ ID NO: 6275281 - DNA, 18 bp, Homo sapiens
gccaggctccttcctgtc

SEQ ID NO: 6275282 - DNA, 19 bp, Homo sapiens
gccaggctccttcctgtct

SEQ ID NO: 6275283 - DNA, 13 bp, Homo sapiens
gccaggctctccc

SEQ ID NO: 6275284 - DNA, 14 bp, Homo sapiens
gccaggctctgcct

SEQ ID NO: 6275285 - DNA, 16 bp, Homo sapiens
gccaggctctgtgctg

SEQ ID NO: 6275286 - DNA, 15 bp, Homo sapiens
gccaggctgaccaca

SEQ ID NO: 6275287 - DNA, 13 bp, Homo sapiens
gccaggctgagcc

SEQ ID NO: 6275288 - DNA, 21 bp, Homo sapiens
gccaggctgagtgagccacag

SEQ ID NO: 6275289 - DNA, 15 bp, Homo sapiens
gccaggctgcacagc

SEQ ID NO: 6275290 - DNA, 16 bp, Homo sapiens
gccaggctgcacagca

SEQ ID NO: 6275291 - DNA, 12 bp, Homo sapiens
gccaggctgcag

SEQ ID NO: 6275292 - DNA, 16 bp, Homo sapiens
gccaggctgcctcctg

SEQ ID NO: 6275293 - DNA, 21 bp, Homo sapiens
gccaggctgcctcggactcca

SEQ ID NO: 6275294 - DNA, 14 bp, Homo sapiens
gccaggctgcggtg

SEQ ID NO: 6275295 - DNA, 22 bp, Homo sapiens
gccaggctgcggtgggcagcca

SEQ ID NO: 6275296 - DNA, 21 bp, Homo sapiens
gccaggctgctaacctggaaa

SEQ ID NO: 6275297 - DNA, 13 bp, Homo sapiens
gccaggctgctct

SEQ ID NO: 6275298 - DNA, 13 bp, Homo sapiens
gccaggctgggtc

SEQ ID NO: 6275299 - DNA, 17 bp, Homo sapiens
gccaggctggtccgagc

SEQ ID NO: 6275300 - DNA, 21 bp, Homo sapiens
gccaggctgtaagcattctga

SEQ ID NO: 6275301 - DNA, 13 bp, Homo sapiens
gccaggctgttct

SEQ ID NO: 6275302 - DNA, 14 bp, Homo sapiens
gccaggctgttgga

SEQ ID NO: 6275303 - DNA, 16 bp, Homo sapiens
gccaggcttgcctggg

SEQ ID NO: 6275304 - DNA, 21 bp, Homo sapiens
gccaggcttgcctgggctggg

SEQ ID NO: 6275305 - DNA, 14 bp, Homo sapiens
gccaggcttttctc

SEQ ID NO: 6275306 - DNA, 20 bp, Homo sapiens
gccagggaaagactggcaag

SEQ ID NO: 6275307 - DNA, 14 bp, Homo sapiens
gccagggaacagcc

SEQ ID NO: 6275308 - DNA, 15 bp, Homo sapiens
gccagggaagacaga

SEQ ID NO: 6275309 - DNA, 16 bp, Homo sapiens
gccagggaagacagag

SEQ ID NO: 6275310 - DNA, 20 bp, Homo sapiens
gccagggaagacagagcagg

SEQ ID NO: 6275311 - DNA, 13 bp, Homo sapiens
gccagggacagag

SEQ ID NO: 6275312 - DNA, 17 bp, Homo sapiens
gccagggacccaaagca

SEQ ID NO: 6275313 - DNA, 14 bp, Homo sapiens
gccagggacccagg

SEQ ID NO: 6275314 - DNA, 16 bp, Homo sapiens
gccagggaccccagaa

SEQ ID NO: 6275315 - DNA, 23 bp, Homo sapiens
gccagggactaagcagcccagaa

SEQ ID NO: 6275316 - DNA, 15 bp, Homo sapiens
gccagggagaagctc

SEQ ID NO: 6275317 - DNA, 20 bp, Homo sapiens
gccagggagaagctcctctc

SEQ ID NO: 6275318 - DNA, 18 bp, Homo sapiens
gccagggagacctggaca

SEQ ID NO: 6275319 - DNA, 15 bp, Homo sapiens
gccagggagagccca

SEQ ID NO: 6275320 - DNA, 20 bp, Homo sapiens
gccagggagagcccaggagc

SEQ ID NO: 6275321 - DNA, 17 bp, Homo sapiens
gccagggaggagcccca

SEQ ID NO: 6275322 - DNA, 13 bp, Homo sapiens
gccagggaggcag

SEQ ID NO: 6275323 - DNA, 20 bp, Homo sapiens
gccagggaggcagagcggga

SEQ ID NO: 6275324 - DNA, 23 bp, Homo sapiens
gccagggaggcagagcgggaggg

SEQ ID NO: 6275325 - DNA, 12 bp, Homo sapiens
gccagggaggcg

SEQ ID NO: 6275326 - DNA, 13 bp, Homo sapiens
gccagggaggcgc

SEQ ID NO: 6275327 - DNA, 16 bp, Homo sapiens
gccagggatggcagtg

SEQ ID NO: 6275328 - DNA, 15 bp, Homo sapiens
gccagggatggggcc

SEQ ID NO: 6275329 - DNA, 20 bp, Homo sapiens
gccagggatggggccacagc

SEQ ID NO: 6275330 - DNA, 18 bp, Homo sapiens
gccagggattgaggagga

SEQ ID NO: 6275331 - DNA, 20 bp, Homo sapiens
gccagggcaagagagcgaga

SEQ ID NO: 6275332 - DNA, 17 bp, Homo sapiens
gccagggcaatgccatc

SEQ ID NO: 6275333 - DNA, 19 bp, Homo sapiens
gccagggcaatgccatcag

SEQ ID NO: 6275334 - DNA, 22 bp, Homo sapiens
gccagggcaatgccatcagccc

SEQ ID NO: 6275335 - DNA, 23 bp, Homo sapiens
gccagggcaatgccatcagcccc

SEQ ID NO: 6275336 - DNA, 16 bp, Homo sapiens
gccagggcacagctgg

SEQ ID NO: 6275337 - DNA, 15 bp, Homo sapiens
gccagggcagagtga

SEQ ID NO: 6275338 - DNA, 11 bp, Homo sapiens
gccagggcagc

SEQ ID NO: 6275339 - DNA, 14 bp, Homo sapiens
gccagggcagggcc

SEQ ID NO: 6275340 - DNA, 23 bp, Homo sapiens
gccagggcagggccaccccactc

SEQ ID NO: 6275341 - DNA, 19 bp, Homo sapiens
gccagggcagggccccagg

SEQ ID NO: 6275342 - DNA, 19 bp, Homo sapiens
gccagggcagggtctgggc

SEQ ID NO: 6275343 - DNA, 15 bp, Homo sapiens
gccagggcagtgcta

SEQ ID NO: 6275344 - DNA, 10 bp, Homo sapiens
gccagggccc

SEQ ID NO: 6275345 - DNA, 13 bp, Homo sapiens
gccagggcccacc

SEQ ID NO: 6275346 - DNA, 20 bp, Homo sapiens
gccagggcccaccccagcct

SEQ ID NO: 6275347 - DNA, 23 bp, Homo sapiens
gccagggcccaccccagcctcgc

SEQ ID NO: 6275348 - DNA, 17 bp, Homo sapiens
gccagggcccagagccc

SEQ ID NO: 6275349 - DNA, 21 bp, Homo sapiens
gccagggcccagagcccttga

SEQ ID NO: 6275350 - DNA, 13 bp, Homo sapiens
gccagggcccagg

SEQ ID NO: 6275351 - DNA, 14 bp, Homo sapiens
gccagggcccagga

SEQ ID NO: 6275352 - DNA, 17 bp, Homo sapiens
gccagggcccaggccat

SEQ ID NO: 6275353 - DNA, 18 bp, Homo sapiens
gccagggcccaggccatg

SEQ ID NO: 6275354 - DNA, 19 bp, Homo sapiens
gccagggcccaggccatgt

SEQ ID NO: 6275355 - DNA, 13 bp, Homo sapiens
gccagggcccgca

SEQ ID NO: 6275356 - DNA, 13 bp, Homo sapiens
gccagggcctctc

SEQ ID NO: 6275357 - DNA, 22 bp, Homo sapiens
gccagggcctctccaaccactg

SEQ ID NO: 6275358 - DNA, 14 bp, Homo sapiens
gccagggcctgcga

SEQ ID NO: 6275359 - DNA, 22 bp, Homo sapiens
gccagggcctggaagacagaga

SEQ ID NO: 6275360 - DNA, 13 bp, Homo sapiens
gccagggcctggt

SEQ ID NO: 6275361 - DNA, 12 bp, Homo sapiens
gccagggcggcc

SEQ ID NO: 6275362 - DNA, 14 bp, Homo sapiens
gccagggcggccag

SEQ ID NO: 6275363 - DNA, 15 bp, Homo sapiens
gccagggcggccagg

SEQ ID NO: 6275364 - DNA, 17 bp, Homo sapiens
gccagggcggccaggga

SEQ ID NO: 6275365 - DNA, 20 bp, Homo sapiens
gccagggcggccagggaccc

SEQ ID NO: 6275366 - DNA, 20 bp, Homo sapiens
gccagggctcagatggggcc

SEQ ID NO: 6275367 - DNA, 22 bp, Homo sapiens
gccagggctcagatggggcctg

SEQ ID NO: 6275368 - DNA, 23 bp, Homo sapiens
gccagggctcagatggggcctgg

SEQ ID NO: 6275369 - DNA, 23 bp, Homo sapiens
gccagggctccacgggggcctag

SEQ ID NO: 6275370 - DNA, 20 bp, Homo sapiens
gccagggctcctgtggcagc

SEQ ID NO: 6275371 - DNA, 11 bp, Homo sapiens
gccagggctcg

SEQ ID NO: 6275372 - DNA, 13 bp, Homo sapiens
gccagggctctgg

SEQ ID NO: 6275373 - DNA, 10 bp, Homo sapiens
gccagggctg

SEQ ID NO: 6275374 - DNA, 15 bp, Homo sapiens
gccagggctgcccct

SEQ ID NO: 6275375 - DNA, 16 bp, Homo sapiens
gccagggctgccccta

SEQ ID NO: 6275376 - DNA, 17 bp, Homo sapiens
gccagggctgccctgag

SEQ ID NO: 6275377 - DNA, 14 bp, Homo sapiens
gccagggctggaga

SEQ ID NO: 6275378 - DNA, 13 bp, Homo sapiens
gccagggctggat

SEQ ID NO: 6275379 - DNA, 21 bp, Homo sapiens
gccagggctggatggacagac

SEQ ID NO: 6275380 - DNA, 23 bp, Homo sapiens
gccagggctggatggacagacac

SEQ ID NO: 6275381 - DNA, 12 bp, Homo sapiens
gccagggctggg

SEQ ID NO: 6275382 - DNA, 15 bp, Homo sapiens
gccagggctggggac

SEQ ID NO: 6275383 - DNA, 19 bp, Homo sapiens
gccagggctggggacagag

SEQ ID NO: 6275384 - DNA, 13 bp, Homo sapiens
gccagggctgggt

SEQ ID NO: 6275385 - DNA, 21 bp, Homo sapiens
gccagggctgggtcacaggaa

SEQ ID NO: 6275386 - DNA, 15 bp, Homo sapiens
gccagggctgtcctt

SEQ ID NO: 6275387 - DNA, 17 bp, Homo sapiens
gccagggcttccccatc

SEQ ID NO: 6275388 - DNA, 21 bp, Homo sapiens
gccaggggaaaatcagcctgc

SEQ ID NO: 6275389 - DNA, 17 bp, Homo sapiens
gccaggggacctcctgg

SEQ ID NO: 6275390 - DNA, 14 bp, Homo sapiens
gccaggggagcaga

SEQ ID NO: 6275391 - DNA, 20 bp, Homo sapiens
gccaggggagcagaggggca

SEQ ID NO: 6275392 - DNA, 13 bp, Homo sapiens
gccaggggcaggc

SEQ ID NO: 6275393 - DNA, 18 bp, Homo sapiens
gccaggggcaggcagggc

SEQ ID NO: 6275394 - DNA, 16 bp, Homo sapiens
gccaggggccaggagt

SEQ ID NO: 6275395 - DNA, 18 bp, Homo sapiens
gccaggggccaggagtgg

SEQ ID NO: 6275396 - DNA, 15 bp, Homo sapiens
gccaggggctctgtg

SEQ ID NO: 6275397 - DNA, 16 bp, Homo sapiens
gccaggggctctgtgg

SEQ ID NO: 6275398 - DNA, 19 bp, Homo sapiens
gccaggggctgctcatcac

SEQ ID NO: 6275399 - DNA, 20 bp, Homo sapiens
gccaggggctgctcatcacc

SEQ ID NO: 6275400 - DNA, 20 bp, Homo sapiens
gccaggggcttctccccctc

SEQ ID NO: 6275401 - DNA, 18 bp, Homo sapiens
gccaggggcttgagaagg

SEQ ID NO: 6275402 - DNA, 21 bp, Homo sapiens
gccaggggggtgaggagctgg

SEQ ID NO: 6275403 - DNA, 22 bp, Homo sapiens
gccagggggtttgaggaccctc

SEQ ID NO: 6275404 - DNA, 20 bp, Homo sapiens
gccaggggtgctcctgtgct

SEQ ID NO: 6275405 - DNA, 22 bp, Homo sapiens
gccaggggtgctcctgtgctca

SEQ ID NO: 6275406 - DNA, 13 bp, Homo sapiens
gccaggggtggga

SEQ ID NO: 6275407 - DNA, 18 bp, Homo sapiens
gccaggggtgggagcatc

SEQ ID NO: 6275408 - DNA, 20 bp, Homo sapiens
gccaggggtggtgagggcag

SEQ ID NO: 6275409 - DNA, 21 bp, Homo sapiens
gccaggggtggtgagggcagt

SEQ ID NO: 6275410 - DNA, 16 bp, Homo sapiens
gccaggggttctgaga

SEQ ID NO: 6275411 - DNA, 17 bp, Homo sapiens
gccagggtagacttgga

SEQ ID NO: 6275412 - DNA, 21 bp, Homo sapiens
gccagggtagacttggagctg

SEQ ID NO: 6275413 - DNA, 22 bp, Homo sapiens
gccagggtagacttggagctgt

SEQ ID NO: 6275414 - DNA, 15 bp, Homo sapiens
gccagggtctccaga

SEQ ID NO: 6275415 - DNA, 19 bp, Homo sapiens
gccagggtctctccctcag

SEQ ID NO: 6275416 - DNA, 18 bp, Homo sapiens
gccagggtctgtgtgaat

SEQ ID NO: 6275417 - DNA, 22 bp, Homo sapiens
gccagggtctgtgtgaatgtgg

SEQ ID NO: 6275418 - DNA, 16 bp, Homo sapiens
gccagggtgagagctg

SEQ ID NO: 6275419 - DNA, 23 bp, Homo sapiens
gccagggtgagagctgctctgga

SEQ ID NO: 6275420 - DNA, 18 bp, Homo sapiens
gccagggtgggctgggga

SEQ ID NO: 6275421 - DNA, 20 bp, Homo sapiens
gccagggtgtggccctgcca

SEQ ID NO: 6275422 - DNA, 15 bp, Homo sapiens
gccagggttccagac

SEQ ID NO: 6275423 - DNA, 23 bp, Homo sapiens
gccagggttccagacagggtggg

SEQ ID NO: 6275424 - DNA, 16 bp, Homo sapiens
gccaggtaatgaggga

SEQ ID NO: 6275425 - DNA, 15 bp, Homo sapiens
gccaggtaatgtgaa

SEQ ID NO: 6275426 - DNA, 21 bp, Homo sapiens
gccaggtaatgtgaataaatt

SEQ ID NO: 6275427 - DNA, 21 bp, Homo sapiens
gccaggtacaggagaggcagc

SEQ ID NO: 6275428 - DNA, 23 bp, Homo sapiens
gccaggtaccttctcacctgtga

SEQ ID NO: 6275429 - DNA, 21 bp, Homo sapiens
gccaggtactgcattctctcc

SEQ ID NO: 6275430 - DNA, 22 bp, Homo sapiens
gccaggtagttggaactttctg

SEQ ID NO: 6275431 - DNA, 22 bp, Homo sapiens
gccaggtcaccctttgctgtga

SEQ ID NO: 6275432 - DNA, 14 bp, Homo sapiens
gccaggtccctctc

SEQ ID NO: 6275433 - DNA, 19 bp, Homo sapiens
gccaggtccctggaccagc

SEQ ID NO: 6275434 - DNA, 21 bp, Homo sapiens
gccaggtccctggaccagcct

SEQ ID NO: 6275435 - DNA, 22 bp, Homo sapiens
gccaggtccctggaccagcctc

SEQ ID NO: 6275436 - DNA, 19 bp, Homo sapiens
gccaggtcctcacagcagt

SEQ ID NO: 6275437 - DNA, 21 bp, Homo sapiens
gccaggtcctcacagcagtca

SEQ ID NO: 6275438 - DNA, 19 bp, Homo sapiens
gccaggtctgactccaaag

SEQ ID NO: 6275439 - DNA, 23 bp, Homo sapiens
gccaggtctggcgccaggggcag

SEQ ID NO: 6275440 - DNA, 17 bp, Homo sapiens
gccaggtgagctctgac

SEQ ID NO: 6275441 - DNA, 23 bp, Homo sapiens
gccaggtgaggtccaccggcccc

SEQ ID NO: 6275442 - DNA, 18 bp, Homo sapiens
gccaggtgatctcctgtg

SEQ ID NO: 6275443 - DNA, 15 bp, Homo sapiens
gccaggtgcagacct

SEQ ID NO: 6275444 - DNA, 23 bp, Homo sapiens
gccaggtgcccgcgccaggccct

SEQ ID NO: 6275445 - DNA, 12 bp, Homo sapiens
gccaggtgcctt

SEQ ID NO: 6275446 - DNA, 13 bp, Homo sapiens
gccaggtgccttg

SEQ ID NO: 6275447 - DNA, 14 bp, Homo sapiens
gccaggtgccttgg

SEQ ID NO: 6275448 - DNA, 15 bp, Homo sapiens
gccaggtgcggcctg

SEQ ID NO: 6275449 - DNA, 16 bp, Homo sapiens
gccaggtgcggcctgg

SEQ ID NO: 6275450 - DNA, 21 bp, Homo sapiens
gccaggtgcggcctgggggga

SEQ ID NO: 6275451 - DNA, 15 bp, Homo sapiens
gccaggtggcacctg

SEQ ID NO: 6275452 - DNA, 13 bp, Homo sapiens
gccaggtggctca

SEQ ID NO: 6275453 - DNA, 17 bp, Homo sapiens
gctttgggcacatgtat

SEQ ID NO: 6275454 - DNA, 19 bp, Homo sapiens
gctttgggcagatttgcaa

SEQ ID NO: 6275455 - DNA, 18 bp, Homo sapiens
gctttgggcagttggcca

SEQ ID NO: 6275456 - DNA, 20 bp, Homo sapiens
gctttgggcagttggccagg

SEQ ID NO: 6275457 - DNA, 14 bp, Homo sapiens
gctttgggcccaag

SEQ ID NO: 6275458 - DNA, 22 bp, Homo sapiens
gctttgggcccaagaactgcag

SEQ ID NO: 6275459 - DNA, 19 bp, Homo sapiens
gctttgggctgccctggtg

SEQ ID NO: 6275460 - DNA, 12 bp, Homo sapiens
gctttgggctgg

SEQ ID NO: 6275461 - DNA, 15 bp, Homo sapiens
gctttgggctgggat

SEQ ID NO: 6275462 - DNA, 20 bp, Homo sapiens
gctttgggctttgcaggctc

SEQ ID NO: 6275463 - DNA, 13 bp, Homo sapiens
gctttggggaaaa

SEQ ID NO: 6275464 - DNA, 21 bp, Homo sapiens
gctttggggaaaaagaatgat

SEQ ID NO: 6275465 - DNA, 23 bp, Homo sapiens
gctttggggacagttggcagaga

SEQ ID NO: 6275466 - DNA, 13 bp, Homo sapiens
gctttggggctgg

SEQ ID NO: 6275467 - DNA, 18 bp, Homo sapiens
gctttggggctggtggga

SEQ ID NO: 6275468 - DNA, 20 bp, Homo sapiens
gctttgggggagtaagaatg

SEQ ID NO: 6275469 - DNA, 18 bp, Homo sapiens
gctttggggtgtcttttt

SEQ ID NO: 6275470 - DNA, 19 bp, Homo sapiens
gctttgggtgaccagccac

SEQ ID NO: 6275471 - DNA, 19 bp, Homo sapiens
gctttgggtgcctttgcca

SEQ ID NO: 6275472 - DNA, 22 bp, Homo sapiens
gctttgggtggctcactactga

SEQ ID NO: 6275473 - DNA, 22 bp, Homo sapiens
gctttggtaaaacagtttcatc

SEQ ID NO: 6275474 - DNA, 16 bp, Homo sapiens
gctttggtacccccaa

SEQ ID NO: 6275475 - DNA, 17 bp, Homo sapiens
gctttggtctcttgctt

SEQ ID NO: 6275476 - DNA, 17 bp, Homo sapiens
gctttggtgagaacctg

SEQ ID NO: 6275477 - DNA, 21 bp, Homo sapiens
gctttggtggccagggaggca

SEQ ID NO: 6275478 - DNA, 20 bp, Homo sapiens
gctttggttatatttagctc

SEQ ID NO: 6275479 - DNA, 15 bp, Homo sapiens
gctttggttccttct

SEQ ID NO: 6275480 - DNA, 17 bp, Homo sapiens
gctttggttccttctct

SEQ ID NO: 6275481 - DNA, 22 bp, Homo sapiens
gctttgtaatattctccccacc

SEQ ID NO: 6275482 - DNA, 20 bp, Homo sapiens
gctttgtacttgtgatgaga

SEQ ID NO: 6275483 - DNA, 17 bp, Homo sapiens
gctttgtagaaattaaa

SEQ ID NO: 6275484 - DNA, 13 bp, Homo sapiens
gctttgtagctta

SEQ ID NO: 6275485 - DNA, 18 bp, Homo sapiens
gctttgtagcttaaaaaa

SEQ ID NO: 6275486 - DNA, 21 bp, Homo sapiens
gctttgtagtttgcccagagt

SEQ ID NO: 6275487 - DNA, 13 bp, Homo sapiens
gctttgtatgttt

SEQ ID NO: 6275488 - DNA, 13 bp, Homo sapiens
gctttgtcacttg

SEQ ID NO: 6275489 - DNA, 20 bp, Homo sapiens
gctttgtcacttttcctttt

SEQ ID NO: 6275490 - DNA, 11 bp, Homo sapiens
gctttgtctcc

SEQ ID NO: 6275491 - DNA, 19 bp, Homo sapiens
gctttgtctccaaagaaga

SEQ ID NO: 6275492 - DNA, 18 bp, Homo sapiens
gctttgtctctagccggg

SEQ ID NO: 6275493 - DNA, 16 bp, Homo sapiens
gctttgtctggcctca

SEQ ID NO: 6275494 - DNA, 15 bp, Homo sapiens
gctttgtctgtccag

SEQ ID NO: 6275495 - DNA, 17 bp, Homo sapiens
gctttgtctgtccagcc

SEQ ID NO: 6275496 - DNA, 14 bp, Homo sapiens
gctttgtcttgaaa

SEQ ID NO: 6275497 - DNA, 17 bp, Homo sapiens
gctttgtgactattaaa

SEQ ID NO: 6275498 - DNA, 19 bp, Homo sapiens
gctttgtgattccatggat

SEQ ID NO: 6275499 - DNA, 15 bp, Homo sapiens
gctttgtgatttttg

SEQ ID NO: 6275500 - DNA, 12 bp, Homo sapiens
gctttgtgcctt

SEQ ID NO: 6275501 - DNA, 15 bp, Homo sapiens
gctttgtgctgctga

SEQ ID NO: 6275502 - DNA, 21 bp, Homo sapiens
gctttgtggttatcactttaa

SEQ ID NO: 6275503 - DNA, 16 bp, Homo sapiens
gctttgtgtgattgaa

SEQ ID NO: 6275504 - DNA, 19 bp, Homo sapiens
gctttgtgtttactttttg

SEQ ID NO: 6275505 - DNA, 15 bp, Homo sapiens
gctttgttaaaaaaa

SEQ ID NO: 6275506 - DNA, 17 bp, Homo sapiens
gctttgttactgaaatg

SEQ ID NO: 6275507 - DNA, 14 bp, Homo sapiens
gctttgttcttgtc

SEQ ID NO: 6275508 - DNA, 14 bp, Homo sapiens
gctttgttgaataa

SEQ ID NO: 6275509 - DNA, 16 bp, Homo sapiens
gctttgttgcactgaa

SEQ ID NO: 6275510 - DNA, 13 bp, Homo sapiens
gctttgttgctgg

SEQ ID NO: 6275511 - DNA, 19 bp, Homo sapiens
gctttgttgtgagaatggc

SEQ ID NO: 6275512 - DNA, 23 bp, Homo sapiens
gctttgttgtgagaatggcctgg

SEQ ID NO: 6275513 - DNA, 16 bp, Homo sapiens
gctttgtttactctct

SEQ ID NO: 6275514 - DNA, 18 bp, Homo sapiens
gctttgtttactctcttc

SEQ ID NO: 6275515 - DNA, 20 bp, Homo sapiens
gctttgtttggatgtaattt

SEQ ID NO: 6275516 - DNA, 21 bp, Homo sapiens
gctttgtttgttgtcagctga

SEQ ID NO: 6275517 - DNA, 14 bp, Homo sapiens
gctttgttttaata

SEQ ID NO: 6275518 - DNA, 14 bp, Homo sapiens
gctttgttttatat

SEQ ID NO: 6275519 - DNA, 15 bp, Homo sapiens
gctttgttttatata

SEQ ID NO: 6275520 - DNA, 22 bp, Homo sapiens
gctttgttttcccacacatatt

SEQ ID NO: 6275521 - DNA, 23 bp, Homo sapiens
gctttgttttcctcctgattctc

SEQ ID NO: 6275522 - DNA, 22 bp, Homo sapiens
gctttgttttgggggtcaggca

SEQ ID NO: 6275523 - DNA, 12 bp, Homo sapiens
gcttttaaaaaa

SEQ ID NO: 6275524 - DNA, 22 bp, Homo sapiens
gcttttaaaaaatattttaaga

SEQ ID NO: 6275525 - DNA, 22 bp, Homo sapiens
gcttttaaaaacaaatgagttt

SEQ ID NO: 6275526 - DNA, 16 bp, Homo sapiens
gcttttaaaaatgttt

SEQ ID NO: 6275527 - DNA, 17 bp, Homo sapiens
gcttttaaaaattttgt

SEQ ID NO: 6275528 - DNA, 21 bp, Homo sapiens
gcttttaaaaattttgtcctt

SEQ ID NO: 6275529 - DNA, 14 bp, Homo sapiens
gcttttaaaactac

SEQ ID NO: 6275530 - DNA, 20 bp, Homo sapiens
gcttttaaaactacttagca

SEQ ID NO: 6275531 - DNA, 15 bp, Homo sapiens
gcttttaaaaggaaa

SEQ ID NO: 6275532 - DNA, 18 bp, Homo sapiens
gcttttaaaaggaaaacc

SEQ ID NO: 6275533 - DNA, 15 bp, Homo sapiens
gcttttaaaatgtag

SEQ ID NO: 6275534 - DNA, 12 bp, Homo sapiens
gcttttaaaatt

SEQ ID NO: 6275535 - DNA, 23 bp, Homo sapiens
gcttttaaatgaccaaagatgac

SEQ ID NO: 6275536 - DNA, 17 bp, Homo sapiens
gcttttaagaaaaacaa

SEQ ID NO: 6275537 - DNA, 18 bp, Homo sapiens
gcttttaagaaaaacaaa

SEQ ID NO: 6275538 - DNA, 19 bp, Homo sapiens
gcttttaagaaaaacaaag

SEQ ID NO: 6275539 - DNA, 19 bp, Homo sapiens
gcttttaagattgtacttt

SEQ ID NO: 6275540 - DNA, 15 bp, Homo sapiens
gcttttaataaaatt

SEQ ID NO: 6275541 - DNA, 16 bp, Homo sapiens
gcttttaataaaattg

SEQ ID NO: 6275542 - DNA, 18 bp, Homo sapiens
gcttttaataaactgcaa

SEQ ID NO: 6275543 - DNA, 16 bp, Homo sapiens
gcttttaattctcatt

SEQ ID NO: 6275544 - DNA, 20 bp, Homo sapiens
gcttttaccatgcccctgag

SEQ ID NO: 6275545 - DNA, 17 bp, Homo sapiens
gcttttaccattagcat

SEQ ID NO: 6275546 - DNA, 19 bp, Homo sapiens
gcttttaccattagcataa

SEQ ID NO: 6275547 - DNA, 17 bp, Homo sapiens
gcttttacgtagtaaaa

SEQ ID NO: 6275548 - DNA, 21 bp, Homo sapiens
gcttttacgtagtaaaagtca

SEQ ID NO: 6275549 - DNA, 22 bp, Homo sapiens
gcttttacgtagtaaaagtcat

SEQ ID NO: 6275550 - DNA, 14 bp, Homo sapiens
gcttttactttatt

SEQ ID NO: 6275551 - DNA, 19 bp, Homo sapiens
gcttttagaaggtaatttg

SEQ ID NO: 6275552 - DNA, 15 bp, Homo sapiens
gcttttagcctggct

SEQ ID NO: 6275553 - DNA, 21 bp, Homo sapiens
gcttttaggagaattcacaga

SEQ ID NO: 6275554 - DNA, 21 bp, Homo sapiens
gcttttaggcttgaaatctcc

SEQ ID NO: 6275555 - DNA, 13 bp, Homo sapiens
gcttttagtaaaa

SEQ ID NO: 6275556 - DNA, 16 bp, Homo sapiens
gcttttatatctgtat

SEQ ID NO: 6275557 - DNA, 21 bp, Homo sapiens
gcttttatcagtgttaaagtg

SEQ ID NO: 6275558 - DNA, 13 bp, Homo sapiens
gcttttatggatg

SEQ ID NO: 6275559 - DNA, 20 bp, Homo sapiens
gcttttatgtgaaacatgtt

SEQ ID NO: 6275560 - DNA, 21 bp, Homo sapiens
gcttttatgtgaaacatgttt

SEQ ID NO: 6275561 - DNA, 17 bp, Homo sapiens
gcttttatgtgatatgt

SEQ ID NO: 6275562 - DNA, 21 bp, Homo sapiens
gcttttatgtgatatgtttta

SEQ ID NO: 6275563 - DNA, 18 bp, Homo sapiens
gcttttatgtttgtacac

SEQ ID NO: 6275564 - DNA, 15 bp, Homo sapiens
gcttttattaatgca

SEQ ID NO: 6275565 - DNA, 14 bp, Homo sapiens
gcttttattgcacc

SEQ ID NO: 6275566 - DNA, 20 bp, Homo sapiens
gcttttatttggtgtgttcg

SEQ ID NO: 6275567 - DNA, 19 bp, Homo sapiens
gcttttattttaatattga

SEQ ID NO: 6275568 - DNA, 15 bp, Homo sapiens
gcttttattttttct

SEQ ID NO: 6275569 - DNA, 18 bp, Homo sapiens
gcttttcaaacaagaatg

SEQ ID NO: 6275570 - DNA, 13 bp, Homo sapiens
gcttttcactgct

SEQ ID NO: 6275571 - DNA, 13 bp, Homo sapiens
gcttttcacttct

SEQ ID NO: 6275572 - DNA, 16 bp, Homo sapiens
gcttttcagtgttccc

SEQ ID NO: 6275573 - DNA, 16 bp, Homo sapiens
gcttttcatggaagtg

SEQ ID NO: 6275574 - DNA, 15 bp, Homo sapiens
gcttttcattttaat

SEQ ID NO: 6275575 - DNA, 20 bp, Homo sapiens
gcttttccaaacccaggcta

SEQ ID NO: 6275576 - DNA, 20 bp, Homo sapiens
gcttttccaggatcctgcag

SEQ ID NO: 6275577 - DNA, 12 bp, Homo sapiens
gcttttccagtg

SEQ ID NO: 6275578 - DNA, 15 bp, Homo sapiens
gcttttccagtgtgt

SEQ ID NO: 6275579 - DNA, 19 bp, Homo sapiens
gcttttccattctgggtgt

SEQ ID NO: 6275580 - DNA, 16 bp, Homo sapiens
gcttttcccaaaagcc

SEQ ID NO: 6275581 - DNA, 14 bp, Homo sapiens
gcttttccctcttt

SEQ ID NO: 6275582 - DNA, 15 bp, Homo sapiens
gcttttccctctttt

SEQ ID NO: 6275583 - DNA, 15 bp, Homo sapiens
gcttttccctgggtg

SEQ ID NO: 6275584 - DNA, 16 bp, Homo sapiens
gcttttccctttgtga

SEQ ID NO: 6275585 - DNA, 21 bp, Homo sapiens
gcttttccctttttttaagta

SEQ ID NO: 6275586 - DNA, 22 bp, Homo sapiens
gcttttcctatttgttttcatg

SEQ ID NO: 6275587 - DNA, 16 bp, Homo sapiens
gcttttcctcaagcaa

SEQ ID NO: 6275588 - DNA, 17 bp, Homo sapiens
gcttttcctcaagcaat

SEQ ID NO: 6275589 - DNA, 20 bp, Homo sapiens
gcttttcctgttaaggcaga

SEQ ID NO: 6275590 - DNA, 15 bp, Homo sapiens
gcttttccttggcat

SEQ ID NO: 6275591 - DNA, 12 bp, Homo sapiens
gcttttcctttt

SEQ ID NO: 6275592 - DNA, 17 bp, Homo sapiens
gcttttcgaactgtgct

SEQ ID NO: 6275593 - DNA, 13 bp, Homo sapiens
gcttttctcccag

SEQ ID NO: 6275594 - DNA, 14 bp, Homo sapiens
gcttttctcccaga

SEQ ID NO: 6275595 - DNA, 19 bp, Homo sapiens
gcttttctgaaagtatgag

SEQ ID NO: 6275596 - DNA, 16 bp, Homo sapiens
gcttttctgatccagt

SEQ ID NO: 6275597 - DNA, 17 bp, Homo sapiens
gcttttctgccctggct

SEQ ID NO: 6275598 - DNA, 19 bp, Homo sapiens
gcttttctgccctggctgc

SEQ ID NO: 6275599 - DNA, 22 bp, Homo sapiens
gcttttctgccctggctgctgc

SEQ ID NO: 6275600 - DNA, 14 bp, Homo sapiens
gcttttctgtattt

SEQ ID NO: 6275601 - DNA, 23 bp, Homo sapiens
gcttttctgtccctttgctcccg

SEQ ID NO: 6275602 - DNA, 16 bp, Homo sapiens
gcttttctgtcctggg

SEQ ID NO: 6275603 - DNA, 12 bp, Homo sapiens
gcttttctgttt

SEQ ID NO: 6275604 - DNA, 17 bp, Homo sapiens
gcttttcttgccagctc

SEQ ID NO: 6275605 - DNA, 23 bp, Homo sapiens
gcttttgaaaagttgaaatgtgt

SEQ ID NO: 6275606 - DNA, 13 bp, Homo sapiens
gcttttgaaatct

SEQ ID NO: 6275607 - DNA, 14 bp, Homo sapiens
gcttttgaattgca

SEQ ID NO: 6275608 - DNA, 15 bp, Homo sapiens
gcttttgagcctcag

SEQ ID NO: 6275609 - DNA, 16 bp, Homo sapiens
gcttttgagcctcaga

SEQ ID NO: 6275610 - DNA, 19 bp, Homo sapiens
gcttttgagtgggccctgc

SEQ ID NO: 6275611 - DNA, 15 bp, Homo sapiens
gcttttgatgatgtc

SEQ ID NO: 6275612 - DNA, 16 bp, Homo sapiens
gcttttgatgtctcca

SEQ ID NO: 6275613 - DNA, 13 bp, Homo sapiens
gcttttgcaaata

SEQ ID NO: 6275614 - DNA, 18 bp, Homo sapiens
gcttttgcaaataactta

SEQ ID NO: 6275615 - DNA, 21 bp, Homo sapiens
gcttttgcacaccttttcccc

SEQ ID NO: 6275616 - DNA, 18 bp, Homo sapiens
gcttttgccactccttgt

SEQ ID NO: 6275617 - DNA, 18 bp, Homo sapiens
gcttttgccactttggct

SEQ ID NO: 6275618 - DNA, 21 bp, Homo sapiens
gcttttgccactttggcttct

SEQ ID NO: 6275619 - DNA, 13 bp, Homo sapiens
gcttttgccatta

SEQ ID NO: 6275620 - DNA, 20 bp, Homo sapiens
gcttttgcccattttgaatc

SEQ ID NO: 6275621 - DNA, 15 bp, Homo sapiens
gcttttgcctgtaag

SEQ ID NO: 6275622 - DNA, 17 bp, Homo sapiens
gcttttgccttttcaaa

SEQ ID NO: 6275623 - DNA, 23 bp, Homo sapiens
gcttttgcggttcaggaaaattg

SEQ ID NO: 6275624 - DNA, 15 bp, Homo sapiens
gcttttgctagatgg

SEQ ID NO: 6275625 - DNA, 15 bp, Homo sapiens
gcttttgctgctgct

SEQ ID NO: 6275626 - DNA, 13 bp, Homo sapiens
gcttttgcttcta

SEQ ID NO: 6275627 - DNA, 14 bp, Homo sapiens
gcttttgcttgcaa

SEQ ID NO: 6275628 - DNA, 18 bp, Homo sapiens
gcttttggattggacaaa

SEQ ID NO: 6275629 - DNA, 12 bp, Homo sapiens
gcttttggcctg

SEQ ID NO: 6275630 - DNA, 22 bp, Homo sapiens
gcttttggcggggaggaggaaa

SEQ ID NO: 6275631 - DNA, 17 bp, Homo sapiens
gcttttggggctcttga

SEQ ID NO: 6275632 - DNA, 22 bp, Homo sapiens
gccaggtggctcagtgccacct

SEQ ID NO: 6275633 - DNA, 21 bp, Homo sapiens
gccaggtgggcggacaaaagg

SEQ ID NO: 6275634 - DNA, 22 bp, Homo sapiens
gccaggtggttgtcttattgca

SEQ ID NO: 6275635 - DNA, 17 bp, Homo sapiens
gccaggtgtcctgactg

SEQ ID NO: 6275636 - DNA, 23 bp, Homo sapiens
gccaggttagcctttgccctgtc

SEQ ID NO: 6275637 - DNA, 15 bp, Homo sapiens
gccaggttcctgtac

SEQ ID NO: 6275638 - DNA, 23 bp, Homo sapiens
gccaggttcctgtactactgcct

SEQ ID NO: 6275639 - DNA, 18 bp, Homo sapiens
gccaggttctatttggaa

SEQ ID NO: 6275640 - DNA, 18 bp, Homo sapiens
gccaggttgcagctgctc

SEQ ID NO: 6275641 - DNA, 14 bp, Homo sapiens
gccaggttgctaag

SEQ ID NO: 6275642 - DNA, 15 bp, Homo sapiens
gccaggttggaaaag

SEQ ID NO: 6275643 - DNA, 18 bp, Homo sapiens
gccaggttgggggcagtg

SEQ ID NO: 6275644 - DNA, 22 bp, Homo sapiens
gccaggtttctgcccacattgg

SEQ ID NO: 6275645 - DNA, 13 bp, Homo sapiens
gccaggtttgtta

SEQ ID NO: 6275646 - DNA, 16 bp, Homo sapiens
gccagtaacaggctca

SEQ ID NO: 6275647 - DNA, 20 bp, Homo sapiens
gccagtaacgcgtcttcctg

SEQ ID NO: 6275648 - DNA, 14 bp, Homo sapiens
gccagtaatcctgt

SEQ ID NO: 6275649 - DNA, 17 bp, Homo sapiens
gccagtagagagtgccc

SEQ ID NO: 6275650 - DNA, 22 bp, Homo sapiens
gccagtagcctaaatctccagt

SEQ ID NO: 6275651 - DNA, 15 bp, Homo sapiens
gccagtaggagacac

SEQ ID NO: 6275652 - DNA, 23 bp, Homo sapiens
gccagtagttttgacacttccca

SEQ ID NO: 6275653 - DNA, 22 bp, Homo sapiens
gccagtatctatatatgtgtat

SEQ ID NO: 6275654 - DNA, 17 bp, Homo sapiens
gccagtattagactgga

SEQ ID NO: 6275655 - DNA, 12 bp, Homo sapiens
gccagtatttta

SEQ ID NO: 6275656 - DNA, 14 bp, Homo sapiens
gccagtattttaaa

SEQ ID NO: 6275657 - DNA, 23 bp, Homo sapiens
gccagtcaacggggggctcctgc

SEQ ID NO: 6275658 - DNA, 11 bp, Homo sapiens
gccagtcaccc

SEQ ID NO: 6275659 - DNA, 20 bp, Homo sapiens
gccagtcaccccggccacct

SEQ ID NO: 6275660 - DNA, 14 bp, Homo sapiens
gccagtcactgctg

SEQ ID NO: 6275661 - DNA, 19 bp, Homo sapiens
gccagtccaccctgcctgc

SEQ ID NO: 6275662 - DNA, 14 bp, Homo sapiens
gccagtcccacggc

SEQ ID NO: 6275663 - DNA, 13 bp, Homo sapiens
gccagtcccaggg

SEQ ID NO: 6275664 - DNA, 15 bp, Homo sapiens
gccagtccccgagga

SEQ ID NO: 6275665 - DNA, 22 bp, Homo sapiens
gccagtccctgaggcaggtccc

SEQ ID NO: 6275666 - DNA, 18 bp, Homo sapiens
gccagtcctagagctcct

SEQ ID NO: 6275667 - DNA, 16 bp, Homo sapiens
gccagtcctagctgca

SEQ ID NO: 6275668 - DNA, 17 bp, Homo sapiens
gccagtcctcctgggag

SEQ ID NO: 6275669 - DNA, 18 bp, Homo sapiens
gccagtcctcctgggagc

SEQ ID NO: 6275670 - DNA, 20 bp, Homo sapiens
gccagtcctgcctggccagg

SEQ ID NO: 6275671 - DNA, 15 bp, Homo sapiens
gccagtcctgctacc

SEQ ID NO: 6275672 - DNA, 22 bp, Homo sapiens
gccagtcctgctacctcccttg

SEQ ID NO: 6275673 - DNA, 11 bp, Homo sapiens
gccagtcctgg

SEQ ID NO: 6275674 - DNA, 12 bp, Homo sapiens
gccagtcctggt

SEQ ID NO: 6275675 - DNA, 20 bp, Homo sapiens
gccagtcctggtcctggctg

SEQ ID NO: 6275676 - DNA, 21 bp, Homo sapiens
gccagtcctggtcctggctgc

SEQ ID NO: 6275677 - DNA, 20 bp, Homo sapiens
gccagtcctggttgtctgaa

SEQ ID NO: 6275678 - DNA, 14 bp, Homo sapiens
gccagtcgcgctgc

SEQ ID NO: 6275679 - DNA, 18 bp, Homo sapiens
gccagtcgcgctgcctgt

SEQ ID NO: 6275680 - DNA, 19 bp, Homo sapiens
gccagtcgggagagccagg

SEQ ID NO: 6275681 - DNA, 14 bp, Homo sapiens
gccagtctcagaga

SEQ ID NO: 6275682 - DNA, 18 bp, Homo sapiens
gccagtctcagagaccag

SEQ ID NO: 6275683 - DNA, 21 bp, Homo sapiens
gccagtctcagagaccagcac

SEQ ID NO: 6275684 - DNA, 23 bp, Homo sapiens
gccagtctcagagaccagcactc

SEQ ID NO: 6275685 - DNA, 21 bp, Homo sapiens
gccagtctcctatacccagca

SEQ ID NO: 6275686 - DNA, 23 bp, Homo sapiens
gccagtctcctatacccagcaga

SEQ ID NO: 6275687 - DNA, 12 bp, Homo sapiens
gccagtctgccc

SEQ ID NO: 6275688 - DNA, 20 bp, Homo sapiens
gccagtctgcgtcaggcacg

SEQ ID NO: 6275689 - DNA, 13 bp, Homo sapiens
gccagtctgggct

SEQ ID NO: 6275690 - DNA, 14 bp, Homo sapiens
gccagtctgggctg

SEQ ID NO: 6275691 - DNA, 16 bp, Homo sapiens
gccagtctgggctgcc

SEQ ID NO: 6275692 - DNA, 12 bp, Homo sapiens
gccagtctgtgg

SEQ ID NO: 6275693 - DNA, 13 bp, Homo sapiens
gccagtctgtgga

SEQ ID NO: 6275694 - DNA, 11 bp, Homo sapiens
gccagtcttaa

SEQ ID NO: 6275695 - DNA, 16 bp, Homo sapiens
gccagtcttccagaaa

SEQ ID NO: 6275696 - DNA, 15 bp, Homo sapiens
gccagtcttcctctt

SEQ ID NO: 6275697 - DNA, 22 bp, Homo sapiens
gccagtcttcctcttagcctct

SEQ ID NO: 6275698 - DNA, 23 bp, Homo sapiens
gccagtcttcctcttagcctctg

SEQ ID NO: 6275699 - DNA, 19 bp, Homo sapiens
gccagtcttgcctaggcca

SEQ ID NO: 6275700 - DNA, 13 bp, Homo sapiens
gccagtgaaatgt

SEQ ID NO: 6275701 - DNA, 15 bp, Homo sapiens
gccagtgaaatgtga

SEQ ID NO: 6275702 - DNA, 18 bp, Homo sapiens
gccagtgaaatgtgaagg

SEQ ID NO: 6275703 - DNA, 17 bp, Homo sapiens
gccagtgaagggttttg

SEQ ID NO: 6275704 - DNA, 22 bp, Homo sapiens
gccagtgaagggttttgtgtgt

SEQ ID NO: 6275705 - DNA, 20 bp, Homo sapiens
gccagtgacctgaggaagcg

SEQ ID NO: 6275706 - DNA, 15 bp, Homo sapiens
gccagtgacctttga

SEQ ID NO: 6275707 - DNA, 17 bp, Homo sapiens
gccagtgactccaggag

SEQ ID NO: 6275708 - DNA, 18 bp, Homo sapiens
gccagtgactccaggaga

SEQ ID NO: 6275709 - DNA, 15 bp, Homo sapiens
gccagtgactgctgc

SEQ ID NO: 6275710 - DNA, 17 bp, Homo sapiens
gccagtgactgctgcgc

SEQ ID NO: 6275711 - DNA, 15 bp, Homo sapiens
gccagtgagaagctg

SEQ ID NO: 6275712 - DNA, 15 bp, Homo sapiens
gccagtgagggctgg

SEQ ID NO: 6275713 - DNA, 23 bp, Homo sapiens
gccagtgaggttcttaaagtttg

SEQ ID NO: 6275714 - DNA, 17 bp, Homo sapiens
gccagtgataagagcag

SEQ ID NO: 6275715 - DNA, 13 bp, Homo sapiens
gccagtgatgatg

SEQ ID NO: 6275716 - DNA, 19 bp, Homo sapiens
gccagtgatgctaaaggtt

SEQ ID NO: 6275717 - DNA, 13 bp, Homo sapiens
gccagtgcatgcc

SEQ ID NO: 6275718 - DNA, 18 bp, Homo sapiens
gccagtgccaggacagct

SEQ ID NO: 6275719 - DNA, 22 bp, Homo sapiens
gccagtgccaggacagctggct

SEQ ID NO: 6275720 - DNA, 23 bp, Homo sapiens
gccagtgccaggacagctggctg

SEQ ID NO: 6275721 - DNA, 15 bp, Homo sapiens
gccagtgccagggtg

SEQ ID NO: 6275722 - DNA, 16 bp, Homo sapiens
gccagtgccagggtgg

SEQ ID NO: 6275723 - DNA, 14 bp, Homo sapiens
gccagtgccctgag

SEQ ID NO: 6275724 - DNA, 10 bp, Homo sapiens
gccagtgcct

SEQ ID NO: 6275725 - DNA, 13 bp, Homo sapiens
gccagtgcctggg

SEQ ID NO: 6275726 - DNA, 14 bp, Homo sapiens
gccagtgcctgggt

SEQ ID NO: 6275727 - DNA, 22 bp, Homo sapiens
gccagtgccttacctcctgccc

SEQ ID NO: 6275728 - DNA, 20 bp, Homo sapiens
gccagtgcggctgccaggtt

SEQ ID NO: 6275729 - DNA, 18 bp, Homo sapiens
gccagtgctaaactactg

SEQ ID NO: 6275730 - DNA, 15 bp, Homo sapiens
gccagtgctgcttct

SEQ ID NO: 6275731 - DNA, 16 bp, Homo sapiens
gccagtggaagaaaca

SEQ ID NO: 6275732 - DNA, 24 bp, Homo sapiens
gccagtggacagagggagaaggga

SEQ ID NO: 6275733 - DNA, 18 bp, Homo sapiens
gccagtggagctggtctg

SEQ ID NO: 6275734 - DNA, 12 bp, Homo sapiens
gccagtggatcc

SEQ ID NO: 6275735 - DNA, 17 bp, Homo sapiens
gccagtggatcccctgc

SEQ ID NO: 6275736 - DNA, 13 bp, Homo sapiens
gccagtggcactc

SEQ ID NO: 6275737 - DNA, 14 bp, Homo sapiens
gccagtggcactct

SEQ ID NO: 6275738 - DNA, 13 bp, Homo sapiens
gccagtggccccc

SEQ ID NO: 6275739 - DNA, 14 bp, Homo sapiens
gccagtggctggat

SEQ ID NO: 6275740 - DNA, 23 bp, Homo sapiens
gccagtggctggatctgtgaggg

SEQ ID NO: 6275741 - DNA, 17 bp, Homo sapiens
gccagtgggcctggtag

SEQ ID NO: 6275742 - DNA, 21 bp, Homo sapiens
gccagtggggatgaggtcacc

SEQ ID NO: 6275743 - DNA, 14 bp, Homo sapiens
gccagtggggcctg

SEQ ID NO: 6275744 - DNA, 21 bp, Homo sapiens
gccagtggggcctgtggaatg

SEQ ID NO: 6275745 - DNA, 22 bp, Homo sapiens
gccagtggggtcccccctgagt

SEQ ID NO: 6275746 - DNA, 20 bp, Homo sapiens
gccagtggtgatgtaaaaat

SEQ ID NO: 6275747 - DNA, 19 bp, Homo sapiens
gccagtggtggaggtgggt

SEQ ID NO: 6275748 - DNA, 18 bp, Homo sapiens
gccagtgtaatcccccag

SEQ ID NO: 6275749 - DNA, 19 bp, Homo sapiens
gccagtgtaatcccccagg

SEQ ID NO: 6275750 - DNA, 11 bp, Homo sapiens
gccagtgtcta

SEQ ID NO: 6275751 - DNA, 12 bp, Homo sapiens
gccagtgtctgg

SEQ ID NO: 6275752 - DNA, 18 bp, Homo sapiens
gccagtgtctttctttgg

SEQ ID NO: 6275753 - DNA, 19 bp, Homo sapiens
gccagtgtgcccaaaagcc

SEQ ID NO: 6275754 - DNA, 23 bp, Homo sapiens
gccagtgtgcccaaaagccatgt

SEQ ID NO: 6275755 - DNA, 15 bp, Homo sapiens
gccagtgttgcctaa

SEQ ID NO: 6275756 - DNA, 18 bp, Homo sapiens
gccagtgttgcctaagta

SEQ ID NO: 6275757 - DNA, 16 bp, Homo sapiens
gccagtgttgtgggct

SEQ ID NO: 6275758 - DNA, 11 bp, Homo sapiens
gccagtgtttc

SEQ ID NO: 6275759 - DNA, 13 bp, Homo sapiens
gccagtgtttctg

SEQ ID NO: 6275760 - DNA, 15 bp, Homo sapiens
gccagttaaggaaag

SEQ ID NO: 6275761 - DNA, 19 bp, Homo sapiens
gccagttacctttgctgtc

SEQ ID NO: 6275762 - DNA, 22 bp, Homo sapiens
gccagttcaaagtgtatattta

SEQ ID NO: 6275763 - DNA, 15 bp, Homo sapiens
gccagttcagtacct

SEQ ID NO: 6275764 - DNA, 13 bp, Homo sapiens
gccagttcatctt

SEQ ID NO: 6275765 - DNA, 19 bp, Homo sapiens
gccagttctctgtggaagc

SEQ ID NO: 6275766 - DNA, 20 bp, Homo sapiens
gccagttctctgtggaagca

SEQ ID NO: 6275767 - DNA, 14 bp, Homo sapiens
gccagttgacatcc

SEQ ID NO: 6275768 - DNA, 18 bp, Homo sapiens
gccagttgatctgctctg

SEQ ID NO: 6275769 - DNA, 13 bp, Homo sapiens
gccagttgcccag

SEQ ID NO: 6275770 - DNA, 19 bp, Homo sapiens
gccagttggacacaggtga

SEQ ID NO: 6275771 - DNA, 22 bp, Homo sapiens
gccagttgggctcgcactgccc

SEQ ID NO: 6275772 - DNA, 14 bp, Homo sapiens
gccagttggtgggg

SEQ ID NO: 6275773 - DNA, 19 bp, Homo sapiens
gccagttggtggggccagg

SEQ ID NO: 6275774 - DNA, 13 bp, Homo sapiens
gccagttgtcctc

SEQ ID NO: 6275775 - DNA, 19 bp, Homo sapiens
gccagttgtggcaaccctg

SEQ ID NO: 6275776 - DNA, 14 bp, Homo sapiens
gccagtttctctgc

SEQ ID NO: 6275777 - DNA, 21 bp, Homo sapiens
gccagtttctctgccttcttc

SEQ ID NO: 6275778 - DNA, 15 bp, Homo sapiens
gccagttttattttc

SEQ ID NO: 6275779 - DNA, 22 bp, Homo sapiens
gccataaaacaggtaatataaa

SEQ ID NO: 6275780 - DNA, 21 bp, Homo sapiens
gccataaacggttcctggtga

SEQ ID NO: 6275781 - DNA, 21 bp, Homo sapiens
gccataaatcagccgcaagga

SEQ ID NO: 6275782 - DNA, 19 bp, Homo sapiens
gccataaccatgagcacta

SEQ ID NO: 6275783 - DNA, 15 bp, Homo sapiens
gccataacgtgcccc

SEQ ID NO: 6275784 - DNA, 18 bp, Homo sapiens
gccataacttgtttgtaa

SEQ ID NO: 6275785 - DNA, 19 bp, Homo sapiens
gccataactttatgaagtg

SEQ ID NO: 6275786 - DNA, 16 bp, Homo sapiens
gccataagggggtggg

SEQ ID NO: 6275787 - DNA, 16 bp, Homo sapiens
gccataatatgatgca

SEQ ID NO: 6275788 - DNA, 19 bp, Homo sapiens
gccataatatgatgcaaac

SEQ ID NO: 6275789 - DNA, 22 bp, Homo sapiens
gccataattctaagttatttac

SEQ ID NO: 6275790 - DNA, 15 bp, Homo sapiens
gccataccaggtgct

SEQ ID NO: 6275791 - DNA, 19 bp, Homo sapiens
gccataccattcccatgga

SEQ ID NO: 6275792 - DNA, 20 bp, Homo sapiens
gccataccttctcccaggcc

SEQ ID NO: 6275793 - DNA, 14 bp, Homo sapiens
gccataccttgaga

SEQ ID NO: 6275794 - DNA, 23 bp, Homo sapiens
gccatactgcgtccaccctgagc

SEQ ID NO: 6275795 - DNA, 17 bp, Homo sapiens
gccatactggcctcgcc

SEQ ID NO: 6275796 - DNA, 19 bp, Homo sapiens
gccatactggcctcgcctg

SEQ ID NO: 6275797 - DNA, 20 bp, Homo sapiens
gccatactggcctcgcctgg

SEQ ID NO: 6275798 - DNA, 14 bp, Homo sapiens
gccatactgtgtcc

SEQ ID NO: 6275799 - DNA, 22 bp, Homo sapiens
gccatacttatctctctgtgct

SEQ ID NO: 6275800 - DNA, 11 bp, Homo sapiens
gccatacttcc

SEQ ID NO: 6275801 - DNA, 15 bp, Homo sapiens
gccatacttgtgaaa

SEQ ID NO: 6275802 - DNA, 20 bp, Homo sapiens
gccatagaaagtataatttc

SEQ ID NO: 6275803 - DNA, 19 bp, Homo sapiens
gccatagaatggcacatgt

SEQ ID NO: 6275804 - DNA, 21 bp, Homo sapiens
gccatagaccctgaggccctg

SEQ ID NO: 6275805 - DNA, 13 bp, Homo sapiens
gccatagaggccc

SEQ ID NO: 6275806 - DNA, 16 bp, Homo sapiens
gccatagaggcccagg

SEQ ID NO: 6275807 - DNA, 17 bp, Homo sapiens
gccatagaggcccaggc

SEQ ID NO: 6275808 - DNA, 19 bp, Homo sapiens
gccatagaggcccaggcac

SEQ ID NO: 6275809 - DNA, 22 bp, Homo sapiens
gccatagagtacactgcctgcc

SEQ ID NO: 6275810 - DNA, 17 bp, Homo sapiens
gccatagcataatatga

SEQ ID NO: 6275811 - DNA, 23 bp, Homo sapiens
gcttttggtatttgtttgtagct

SEQ ID NO: 6275812 - DNA, 15 bp, Homo sapiens
gcttttggtctgtgt

SEQ ID NO: 6275813 - DNA, 16 bp, Homo sapiens
gcttttgtaaaataaa

SEQ ID NO: 6275814 - DNA, 20 bp, Homo sapiens
gcttttgtacgttaattaaa

SEQ ID NO: 6275815 - DNA, 22 bp, Homo sapiens
gcttttgtagatggcgatgtgt

SEQ ID NO: 6275816 - DNA, 17 bp, Homo sapiens
gcttttgtatagaaaat

SEQ ID NO: 6275817 - DNA, 21 bp, Homo sapiens
gcttttgtctaattaaaacac

SEQ ID NO: 6275818 - DNA, 12 bp, Homo sapiens
gcttttgtgcat

SEQ ID NO: 6275819 - DNA, 13 bp, Homo sapiens
gcttttgttctga

SEQ ID NO: 6275820 - DNA, 14 bp, Homo sapiens
gcttttgttctgag

SEQ ID NO: 6275821 - DNA, 14 bp, Homo sapiens
gcttttgttttgct

SEQ ID NO: 6275822 - DNA, 14 bp, Homo sapiens
gcttttgttttttt

SEQ ID NO: 6275823 - DNA, 13 bp, Homo sapiens
gctttttaaaatt

SEQ ID NO: 6275824 - DNA, 18 bp, Homo sapiens
gctttttaagaatatttt

SEQ ID NO: 6275825 - DNA, 13 bp, Homo sapiens
gctttttaattaa

SEQ ID NO: 6275826 - DNA, 19 bp, Homo sapiens
gctttttaccgttcacttc

SEQ ID NO: 6275827 - DNA, 20 bp, Homo sapiens
gctttttaccgttcacttcc

SEQ ID NO: 6275828 - DNA, 11 bp, Homo sapiens
gctttttatcg

SEQ ID NO: 6275829 - DNA, 14 bp, Homo sapiens
gctttttattccct

SEQ ID NO: 6275830 - DNA, 22 bp, Homo sapiens
gctttttcagaaacagggcagc

SEQ ID NO: 6275831 - DNA, 16 bp, Homo sapiens
gctttttcagagtcat

SEQ ID NO: 6275832 - DNA, 13 bp, Homo sapiens
gctttttcatcct

SEQ ID NO: 6275833 - DNA, 20 bp, Homo sapiens
gctttttccaaatgcttcta

SEQ ID NO: 6275834 - DNA, 21 bp, Homo sapiens
gctttttccatatagtttgtt

SEQ ID NO: 6275835 - DNA, 18 bp, Homo sapiens
gctttttcctctgagccc

SEQ ID NO: 6275836 - DNA, 21 bp, Homo sapiens
gctttttccttttcatctgtt

SEQ ID NO: 6275837 - DNA, 23 bp, Homo sapiens
gctttttccttttcatctgttgt

SEQ ID NO: 6275838 - DNA, 24 bp, Homo sapiens
gctttttccttttcatctgttgtt

SEQ ID NO: 6275839 - DNA, 13 bp, Homo sapiens
gctttttctcaga

SEQ ID NO: 6275840 - DNA, 11 bp, Homo sapiens
gctttttctga

SEQ ID NO: 6275841 - DNA, 19 bp, Homo sapiens
gctttttctttttttgcat

SEQ ID NO: 6275842 - DNA, 14 bp, Homo sapiens
gctttttgaaaacc

SEQ ID NO: 6275843 - DNA, 13 bp, Homo sapiens
gctttttgaaatg

SEQ ID NO: 6275844 - DNA, 21 bp, Homo sapiens
gctttttgaggtggcactttt

SEQ ID NO: 6275845 - DNA, 17 bp, Homo sapiens
gctttttgtattaacaa

SEQ ID NO: 6275846 - DNA, 16 bp, Homo sapiens
gctttttgtcttttct

SEQ ID NO: 6275847 - DNA, 16 bp, Homo sapiens
gctttttgttcagaat

SEQ ID NO: 6275848 - DNA, 20 bp, Homo sapiens
gcttttttaggctacagtgt

SEQ ID NO: 6275849 - DNA, 20 bp, Homo sapiens
gcttttttatcatgtgaaat

SEQ ID NO: 6275850 - DNA, 22 bp, Homo sapiens
gcttttttatttaccttttaag

SEQ ID NO: 6275851 - DNA, 20 bp, Homo sapiens
gcttttttattttttataca

SEQ ID NO: 6275852 - DNA, 23 bp, Homo sapiens
gcttttttcacattgatcatttt

SEQ ID NO: 6275853 - DNA, 23 bp, Homo sapiens
gcttttttcctcctttctctgta

SEQ ID NO: 6275854 - DNA, 18 bp, Homo sapiens
gcttttttctcaataaaa

SEQ ID NO: 6275855 - DNA, 17 bp, Homo sapiens
gcttttttgcaataagg

SEQ ID NO: 6275856 - DNA, 17 bp, Homo sapiens
gcttttttgttttggct

SEQ ID NO: 6275857 - DNA, 18 bp, Homo sapiens
gcttttttgttttgtgct

SEQ ID NO: 6275858 - DNA, 20 bp, Homo sapiens
gctttttttcttgctagtat

SEQ ID NO: 6275859 - DNA, 13 bp, Homo sapiens
gctttttttgaaa

SEQ ID NO: 6275860 - DNA, 20 bp, Homo sapiens
gctttttttgaaactttgag

SEQ ID NO: 6275861 - DNA, 21 bp, Homo sapiens
gctttttttgaaactttgaga

SEQ ID NO: 6275862 - DNA, 23 bp, Homo sapiens
gctttttttgcctaccatttcac

SEQ ID NO: 6275863 - DNA, 17 bp, Homo sapiens
gctttttttgtgtgtat

SEQ ID NO: 6275864 - DNA, 18 bp, Homo sapiens
gcttttttttgagaatac

SEQ ID NO: 6275865 - DNA, 15 bp, Homo sapiens
gcttttttttttcca

SEQ ID NO: 6275866 - DNA, 16 bp, Homo sapiens
gcttttttttttccag

SEQ ID NO: 6275867 - DNA, 18 bp, Homo sapiens
gcttttttttttcttttg

SEQ ID NO: 6275868 - DNA, 21 bp, Homo sapiens
ggaaaaaaaaaaaaagaaatt

SEQ ID NO: 6275869 - DNA, 20 bp, Homo sapiens
ggaaaaaaaaaaaagaaaag

SEQ ID NO: 6275870 - DNA, 15 bp, Homo sapiens
ggaaaaaaaaaaaga

SEQ ID NO: 6275871 - DNA, 13 bp, Homo sapiens
ggaaaaaaaaatc

SEQ ID NO: 6275872 - DNA, 15 bp, Homo sapiens
ggaaaaaaaagaaaa

SEQ ID NO: 6275873 - DNA, 16 bp, Homo sapiens
ggaaaaaaaagaaaaa

SEQ ID NO: 6275874 - DNA, 15 bp, Homo sapiens
ggaaaaaaacaaaaa

SEQ ID NO: 6275875 - DNA, 21 bp, Homo sapiens
ggaaaaaaacataaaaagcag

SEQ ID NO: 6275876 - DNA, 12 bp, Homo sapiens
ggaaaaaaatta

SEQ ID NO: 6275877 - DNA, 22 bp, Homo sapiens
ggaaaaaactctgaaggagagg

SEQ ID NO: 6275878 - DNA, 16 bp, Homo sapiens
ggaaaaaagaaagaaa

SEQ ID NO: 6275879 - DNA, 18 bp, Homo sapiens
ggaaaaaagaaagaaaaa

SEQ ID NO: 6275880 - DNA, 17 bp, Homo sapiens
ggaaaaaagatttttaa

SEQ ID NO: 6275881 - DNA, 15 bp, Homo sapiens
ggaaaaaagcaaaaa

SEQ ID NO: 6275882 - DNA, 13 bp, Homo sapiens
ggaaaaaagcaca

SEQ ID NO: 6275883 - DNA, 23 bp, Homo sapiens
ggaaaaaaggaggatagaaaaag

SEQ ID NO: 6275884 - DNA, 21 bp, Homo sapiens
ggaaaaaataaaaatcaaaca

SEQ ID NO: 6275885 - DNA, 13 bp, Homo sapiens
ggaaaaacaacaa

SEQ ID NO: 6275886 - DNA, 18 bp, Homo sapiens
ggaaaaacagaacatttc

SEQ ID NO: 6275887 - DNA, 19 bp, Homo sapiens
ggaaaaaccacccccaaat

SEQ ID NO: 6275888 - DNA, 17 bp, Homo sapiens
ggaaaaaccgagatagg

SEQ ID NO: 6275889 - DNA, 19 bp, Homo sapiens
ggaaaaactgacagatgct

SEQ ID NO: 6275890 - DNA, 19 bp, Homo sapiens
ggaaaaactgagacaggca

SEQ ID NO: 6275891 - DNA, 20 bp, Homo sapiens
ggaaaaactgagacaggcag

SEQ ID NO: 6275892 - DNA, 17 bp, Homo sapiens
ggaaaaactttggaacc

SEQ ID NO: 6275893 - DNA, 12 bp, Homo sapiens
ggaaaaagaaaa

SEQ ID NO: 6275894 - DNA, 13 bp, Homo sapiens
ggaaaaagaaaga

SEQ ID NO: 6275895 - DNA, 22 bp, Homo sapiens
ggaaaaagacctcgtggagaat

SEQ ID NO: 6275896 - DNA, 14 bp, Homo sapiens
ggaaaaagagactc

SEQ ID NO: 6275897 - DNA, 19 bp, Homo sapiens
ggaaaaagatattgtatta

SEQ ID NO: 6275898 - DNA, 23 bp, Homo sapiens
ggaaaaagcaagttcgtctgttg

SEQ ID NO: 6275899 - DNA, 16 bp, Homo sapiens
ggaaaaagcacaagaa

SEQ ID NO: 6275900 - DNA, 13 bp, Homo sapiens
ggaaaaaggctgg

SEQ ID NO: 6275901 - DNA, 22 bp, Homo sapiens
ggaaaaagtattaattctcttt

SEQ ID NO: 6275902 - DNA, 15 bp, Homo sapiens
ggaaaaataaacaat

SEQ ID NO: 6275903 - DNA, 20 bp, Homo sapiens
ggaaaaataatcaagatttt

SEQ ID NO: 6275904 - DNA, 13 bp, Homo sapiens
ggaaaaatagcct

SEQ ID NO: 6275905 - DNA, 15 bp, Homo sapiens
ggaaaaatagcctgc

SEQ ID NO: 6275906 - DNA, 15 bp, Homo sapiens
ggaaaaatagtaaac

SEQ ID NO: 6275907 - DNA, 13 bp, Homo sapiens
ggaaaaatattta

SEQ ID NO: 6275908 - DNA, 17 bp, Homo sapiens
ggaaaaatcttgggcaa

SEQ ID NO: 6275909 - DNA, 22 bp, Homo sapiens
ggaaaaatgcaaaaaagaaaca

SEQ ID NO: 6275910 - DNA, 18 bp, Homo sapiens
ggaaaaatgccactccct

SEQ ID NO: 6275911 - DNA, 19 bp, Homo sapiens
ggaaaaatgggagccagga

SEQ ID NO: 6275912 - DNA, 15 bp, Homo sapiens
ggaaaaatggttgat

SEQ ID NO: 6275913 - DNA, 17 bp, Homo sapiens
ggaaaaatggttgatgg

SEQ ID NO: 6275914 - DNA, 15 bp, Homo sapiens
ggaaaaatgtatcca

SEQ ID NO: 6275915 - DNA, 11 bp, Homo sapiens
ggaaaaattca

SEQ ID NO: 6275916 - DNA, 15 bp, Homo sapiens
ggaaaacaatttgca

SEQ ID NO: 6275917 - DNA, 18 bp, Homo sapiens
ggaaaacaatttgcataa

SEQ ID NO: 6275918 - DNA, 16 bp, Homo sapiens
ggaaaacacagcctcc

SEQ ID NO: 6275919 - DNA, 16 bp, Homo sapiens
ggaaaacacggccctc

SEQ ID NO: 6275920 - DNA, 18 bp, Homo sapiens
ggaaaacacggccctcct

SEQ ID NO: 6275921 - DNA, 22 bp, Homo sapiens
ggaaaacagaacatcattagaa

SEQ ID NO: 6275922 - DNA, 15 bp, Homo sapiens
ggaaaacagaggaat

SEQ ID NO: 6275923 - DNA, 13 bp, Homo sapiens
ggaaaacagctat

SEQ ID NO: 6275924 - DNA, 13 bp, Homo sapiens
ggaaaacagtgaa

SEQ ID NO: 6275925 - DNA, 15 bp, Homo sapiens
ggaaaacattccatc

SEQ ID NO: 6275926 - DNA, 13 bp, Homo sapiens
ggaaaacatttgc

SEQ ID NO: 6275927 - DNA, 16 bp, Homo sapiens
ggaaaaccagtgggtc

SEQ ID NO: 6275928 - DNA, 18 bp, Homo sapiens
ggaaaaccatctctgtga

SEQ ID NO: 6275929 - DNA, 12 bp, Homo sapiens
ggaaaacctcag

SEQ ID NO: 6275930 - DNA, 16 bp, Homo sapiens
ggaaaacctgaagact

SEQ ID NO: 6275931 - DNA, 22 bp, Homo sapiens
ggaaaacctgaggccaaatatt

SEQ ID NO: 6275932 - DNA, 15 bp, Homo sapiens
ggaaaacctggggga

SEQ ID NO: 6275933 - DNA, 14 bp, Homo sapiens
ggaaaacgctctct

SEQ ID NO: 6275934 - DNA, 22 bp, Homo sapiens
ggaaaactacctgtatttaaaa

SEQ ID NO: 6275935 - DNA, 18 bp, Homo sapiens
ggaaaactcaccatttca

SEQ ID NO: 6275936 - DNA, 21 bp, Homo sapiens
ggaaaactcttggcctctgct

SEQ ID NO: 6275937 - DNA, 20 bp, Homo sapiens
ggaaaactgaatccatcttt

SEQ ID NO: 6275938 - DNA, 14 bp, Homo sapiens
ggaaaactgccaca

SEQ ID NO: 6275939 - DNA, 13 bp, Homo sapiens
ggaaaactgtgtt

SEQ ID NO: 6275940 - DNA, 14 bp, Homo sapiens
ggaaaactgtgttg

SEQ ID NO: 6275941 - DNA, 11 bp, Homo sapiens
ggaaaactgtt

SEQ ID NO: 6275942 - DNA, 23 bp, Homo sapiens
ggaaaacttattttatattttcc

SEQ ID NO: 6275943 - DNA, 21 bp, Homo sapiens
ggaaaacttttgttttttggg

SEQ ID NO: 6275944 - DNA, 22 bp, Homo sapiens
ggaaaagaaacaatatgcttta

SEQ ID NO: 6275945 - DNA, 14 bp, Homo sapiens
ggaaaagaaacctg

SEQ ID NO: 6275946 - DNA, 13 bp, Homo sapiens
ggaaaagaaatct

SEQ ID NO: 6275947 - DNA, 14 bp, Homo sapiens
ggaaaagaaatcta

SEQ ID NO: 6275948 - DNA, 18 bp, Homo sapiens
ggaaaagaatacagaaag

SEQ ID NO: 6275949 - DNA, 22 bp, Homo sapiens
ggaaaagagcgcatcaggcctg

SEQ ID NO: 6275950 - DNA, 20 bp, Homo sapiens
ggaaaagaggacagaaaaat

SEQ ID NO: 6275951 - DNA, 21 bp, Homo sapiens
ggaaaagagggagaagaaaga

SEQ ID NO: 6275952 - DNA, 17 bp, Homo sapiens
ggaaaagatatttttat

SEQ ID NO: 6275953 - DNA, 19 bp, Homo sapiens
ggaaaagcggacatcagct

SEQ ID NO: 6275954 - DNA, 10 bp, Homo sapiens
ggaaaagctt

SEQ ID NO: 6275955 - DNA, 11 bp, Homo sapiens
ggaaaaggaag

SEQ ID NO: 6275956 - DNA, 14 bp, Homo sapiens
ggaaaaggaggagg

SEQ ID NO: 6275957 - DNA, 15 bp, Homo sapiens
ggaaaaggcatatat

SEQ ID NO: 6275958 - DNA, 14 bp, Homo sapiens
ggaaaaggcccctg

SEQ ID NO: 6275959 - DNA, 15 bp, Homo sapiens
ggaaaaggcccctgc

SEQ ID NO: 6275960 - DNA, 16 bp, Homo sapiens
ggaaaaggcccctgca

SEQ ID NO: 6275961 - DNA, 12 bp, Homo sapiens
ggaaaaggcctg

SEQ ID NO: 6275962 - DNA, 13 bp, Homo sapiens
ggaaaaggcctgg

SEQ ID NO: 6275963 - DNA, 16 bp, Homo sapiens
ggaaaaggcctggggt

SEQ ID NO: 6275964 - DNA, 17 bp, Homo sapiens
ggaaaaggcctggggtg

SEQ ID NO: 6275965 - DNA, 16 bp, Homo sapiens
ggaaaaggctggtaca

SEQ ID NO: 6275966 - DNA, 20 bp, Homo sapiens
ggaaaaggcttgagtctgga

SEQ ID NO: 6275967 - DNA, 17 bp, Homo sapiens
ggaaaagggagaaaaag

SEQ ID NO: 6275968 - DNA, 14 bp, Homo sapiens
ggaaaagggagcta

SEQ ID NO: 6275969 - DNA, 23 bp, Homo sapiens
ggaaaagggcattttgtacaatg

SEQ ID NO: 6275970 - DNA, 22 bp, Homo sapiens
ggaaaagggctcagagctgctg

SEQ ID NO: 6275971 - DNA, 18 bp, Homo sapiens
ggaaaaggttttattttg

SEQ ID NO: 6275972 - DNA, 15 bp, Homo sapiens
ggaaaagtacattta

SEQ ID NO: 6275973 - DNA, 16 bp, Homo sapiens
ggaaaagtcacacaga

SEQ ID NO: 6275974 - DNA, 15 bp, Homo sapiens
ggaaaagtgttatta

SEQ ID NO: 6275975 - DNA, 15 bp, Homo sapiens
ggaaaagtgttcctt

SEQ ID NO: 6275976 - DNA, 19 bp, Homo sapiens
ggaaaagtttaatattaaa

SEQ ID NO: 6275977 - DNA, 17 bp, Homo sapiens
ggaaaataaaaaaagaa

SEQ ID NO: 6275978 - DNA, 12 bp, Homo sapiens
ggaaaataagtg

SEQ ID NO: 6275979 - DNA, 18 bp, Homo sapiens
ggaaaataataaaagaat

SEQ ID NO: 6275980 - DNA, 16 bp, Homo sapiens
ggaaaataatactgct

SEQ ID NO: 6275981 - DNA, 15 bp, Homo sapiens
ggaaaatactacctg

SEQ ID NO: 6275982 - DNA, 22 bp, Homo sapiens
ggaaaatatacaagtaaattct

SEQ ID NO: 6275983 - DNA, 17 bp, Homo sapiens
ggaaaatatttcctgac

SEQ ID NO: 6275984 - DNA, 18 bp, Homo sapiens
ggaaaatatttttttcct

SEQ ID NO: 6275985 - DNA, 23 bp, Homo sapiens
ggaaaatcagcctgctccagctg

SEQ ID NO: 6275986 - DNA, 22 bp, Homo sapiens
ggaaaatctatatttgtcttcc

SEQ ID NO: 6275987 - DNA, 17 bp, Homo sapiens
ggaaaatgacttgtaag

SEQ ID NO: 6275988 - DNA, 19 bp, Homo sapiens
ggaaaatgagaggagaaca

SEQ ID NO: 6275989 - DNA, 15 bp, Homo sapiens
ggaaaatgccaatct

SEQ ID NO: 6275990 - DNA, 21 bp, Homo sapiens
ggaaaatgctatcaaataact

SEQ ID NO: 6275991 - DNA, 15 bp, Homo sapiens
gccatagccaggagc

SEQ ID NO: 6275992 - DNA, 14 bp, Homo sapiens
gccatagccccagg

SEQ ID NO: 6275993 - DNA, 17 bp, Homo sapiens
gccatagccccaggccc

SEQ ID NO: 6275994 - DNA, 19 bp, Homo sapiens
gccatagccccaggcccgc

SEQ ID NO: 6275995 - DNA, 12 bp, Homo sapiens
gccatagctcct

SEQ ID NO: 6275996 - DNA, 19 bp, Homo sapiens
gccataggagaggagggtt

SEQ ID NO: 6275997 - DNA, 13 bp, Homo sapiens
gccataggccaag

SEQ ID NO: 6275998 - DNA, 15 bp, Homo sapiens
gccataggccaaggt

SEQ ID NO: 6275999 - DNA, 14 bp, Homo sapiens
gccatagggaccaa

SEQ ID NO: 6276000 - DNA, 13 bp, Homo sapiens
gccatagggggct

SEQ ID NO: 6276001 - DNA, 16 bp, Homo sapiens
gccatagggggctgca

SEQ ID NO: 6276002 - DNA, 17 bp, Homo sapiens
gccatagtcaaagagag

SEQ ID NO: 6276003 - DNA, 16 bp, Homo sapiens
gccatagtcattctgc

SEQ ID NO: 6276004 - DNA, 19 bp, Homo sapiens
gccatagtttgggtatttt

SEQ ID NO: 6276005 - DNA, 17 bp, Homo sapiens
gccatataagtttgaag

SEQ ID NO: 6276006 - DNA, 18 bp, Homo sapiens
gccatataagtttgaagg

SEQ ID NO: 6276007 - DNA, 19 bp, Homo sapiens
gccatatactcttcaagga

SEQ ID NO: 6276008 - DNA, 19 bp, Homo sapiens
gccatatataacagataca

SEQ ID NO: 6276009 - DNA, 20 bp, Homo sapiens
gccatatatgaccagaagcc

SEQ ID NO: 6276010 - DNA, 16 bp, Homo sapiens
gccatatatgctgtat

SEQ ID NO: 6276011 - DNA, 18 bp, Homo sapiens
gccatatatgctgtattt

SEQ ID NO: 6276012 - DNA, 19 bp, Homo sapiens
gccatatattttctgagta

SEQ ID NO: 6276013 - DNA, 16 bp, Homo sapiens
gccatatgaaaaggct

SEQ ID NO: 6276014 - DNA, 16 bp, Homo sapiens
gccatatgatttacat

SEQ ID NO: 6276015 - DNA, 20 bp, Homo sapiens
gccatatggacactgtgaca

SEQ ID NO: 6276016 - DNA, 21 bp, Homo sapiens
gccatatggacactgtgacaa

SEQ ID NO: 6276017 - DNA, 21 bp, Homo sapiens
gccatatggaggactgtgaca

SEQ ID NO: 6276018 - DNA, 15 bp, Homo sapiens
gccatatgtaacatc

SEQ ID NO: 6276019 - DNA, 20 bp, Homo sapiens
gccatattccgcactgggca

SEQ ID NO: 6276020 - DNA, 16 bp, Homo sapiens
gccatattgtgtaatt

SEQ ID NO: 6276021 - DNA, 18 bp, Homo sapiens
gccatatttacctcagcc

SEQ ID NO: 6276022 - DNA, 13 bp, Homo sapiens
gccatatttgtaa

SEQ ID NO: 6276023 - DNA, 18 bp, Homo sapiens
gccatatttgtaaaatga

SEQ ID NO: 6276024 - DNA, 13 bp, Homo sapiens
gccatattttaaa

SEQ ID NO: 6276025 - DNA, 15 bp, Homo sapiens
gccatattttaaaaa

SEQ ID NO: 6276026 - DNA, 20 bp, Homo sapiens
gccatattttaaaaaatcaa

SEQ ID NO: 6276027 - DNA, 21 bp, Homo sapiens
gccatattttaaaaaatcaaa

SEQ ID NO: 6276028 - DNA, 15 bp, Homo sapiens
gccatcaaaatgctt

SEQ ID NO: 6276029 - DNA, 17 bp, Homo sapiens
gccatcaacaagagttg

SEQ ID NO: 6276030 - DNA, 18 bp, Homo sapiens
gccatcaaggtccagtgg

SEQ ID NO: 6276031 - DNA, 15 bp, Homo sapiens
gccatcacaagggga

SEQ ID NO: 6276032 - DNA, 21 bp, Homo sapiens
gccatcacaaggggaacgcag

SEQ ID NO: 6276033 - DNA, 19 bp, Homo sapiens
gccatcacaggatgccagc

SEQ ID NO: 6276034 - DNA, 21 bp, Homo sapiens
gccatcacaggatgccagccc

SEQ ID NO: 6276035 - DNA, 19 bp, Homo sapiens
gccatcaccataacctctg

SEQ ID NO: 6276036 - DNA, 16 bp, Homo sapiens
gccatcaccgctgggt

SEQ ID NO: 6276037 - DNA, 18 bp, Homo sapiens
gccatcaccgctgggtgg

SEQ ID NO: 6276038 - DNA, 22 bp, Homo sapiens
gccatcacctaggactgactcg

SEQ ID NO: 6276039 - DNA, 19 bp, Homo sapiens
gccatcacctcagatggca

SEQ ID NO: 6276040 - DNA, 12 bp, Homo sapiens
gccatcacgctt

SEQ ID NO: 6276041 - DNA, 20 bp, Homo sapiens
gccatcactagaagaaaagc

SEQ ID NO: 6276042 - DNA, 16 bp, Homo sapiens
gccatcactcagcccc

SEQ ID NO: 6276043 - DNA, 16 bp, Homo sapiens
gccatcacttctcccc

SEQ ID NO: 6276044 - DNA, 17 bp, Homo sapiens
gccatcagaaattttct

SEQ ID NO: 6276045 - DNA, 20 bp, Homo sapiens
gccatcagaaattttctaca

SEQ ID NO: 6276046 - DNA, 20 bp, Homo sapiens
gccatcagcaccacgtgcca

SEQ ID NO: 6276047 - DNA, 12 bp, Homo sapiens
gccatcagccat

SEQ ID NO: 6276048 - DNA, 13 bp, Homo sapiens
gccatcagcccct

SEQ ID NO: 6276049 - DNA, 15 bp, Homo sapiens
gccatcagcccctgg

SEQ ID NO: 6276050 - DNA, 16 bp, Homo sapiens
gccatcagcccctggg

SEQ ID NO: 6276051 - DNA, 19 bp, Homo sapiens
gccatcaggactttccctg

SEQ ID NO: 6276052 - DNA, 12 bp, Homo sapiens
gccatcagggcc

SEQ ID NO: 6276053 - DNA, 14 bp, Homo sapiens
gccatcagggccct

SEQ ID NO: 6276054 - DNA, 13 bp, Homo sapiens
gccatcagggtgg

SEQ ID NO: 6276055 - DNA, 20 bp, Homo sapiens
gccatcatatcccctgtgcc

SEQ ID NO: 6276056 - DNA, 19 bp, Homo sapiens
gccatcatcagtggagcca

SEQ ID NO: 6276057 - DNA, 15 bp, Homo sapiens
gccatcatcctcccg

SEQ ID NO: 6276058 - DNA, 23 bp, Homo sapiens
gccatcatctcctgccttcctcc

SEQ ID NO: 6276059 - DNA, 20 bp, Homo sapiens
gccatcatgcctgactaatt

SEQ ID NO: 6276060 - DNA, 21 bp, Homo sapiens
gccatcatgtaaattaccagt

SEQ ID NO: 6276061 - DNA, 18 bp, Homo sapiens
gccatcatgtgcctggaa

SEQ ID NO: 6276062 - DNA, 21 bp, Homo sapiens
gccatcatgtttacagaggac

SEQ ID NO: 6276063 - DNA, 13 bp, Homo sapiens
gccatcatttcat

SEQ ID NO: 6276064 - DNA, 20 bp, Homo sapiens
gccatccaaataagaaacct

SEQ ID NO: 6276065 - DNA, 13 bp, Homo sapiens
gccatccaccctg

SEQ ID NO: 6276066 - DNA, 15 bp, Homo sapiens
gccatccactgtgac

SEQ ID NO: 6276067 - DNA, 12 bp, Homo sapiens
gccatccagggt

SEQ ID NO: 6276068 - DNA, 13 bp, Homo sapiens
gccatccagggtc

SEQ ID NO: 6276069 - DNA, 14 bp, Homo sapiens
gccatccagggtct

SEQ ID NO: 6276070 - DNA, 14 bp, Homo sapiens
gccatccaggttca

SEQ ID NO: 6276071 - DNA, 15 bp, Homo sapiens
gccatccattctgga

SEQ ID NO: 6276072 - DNA, 16 bp, Homo sapiens
gccatcccagccccaa

SEQ ID NO: 6276073 - DNA, 22 bp, Homo sapiens
gccatccccaccttcacctcgg

SEQ ID NO: 6276074 - DNA, 16 bp, Homo sapiens
gccatccccagggggc

SEQ ID NO: 6276075 - DNA, 19 bp, Homo sapiens
gccatccccctctcacgcc

SEQ ID NO: 6276076 - DNA, 15 bp, Homo sapiens
gccatcccctccccg

SEQ ID NO: 6276077 - DNA, 16 bp, Homo sapiens
gccatcccgcttagcc

SEQ ID NO: 6276078 - DNA, 17 bp, Homo sapiens
gccatcccgcttagcct

SEQ ID NO: 6276079 - DNA, 17 bp, Homo sapiens
gccatcccgtcttctcc

SEQ ID NO: 6276080 - DNA, 14 bp, Homo sapiens
gccatccctccctc

SEQ ID NO: 6276081 - DNA, 18 bp, Homo sapiens
gccatccctccctccacc

SEQ ID NO: 6276082 - DNA, 12 bp, Homo sapiens
gccatccctgag

SEQ ID NO: 6276083 - DNA, 13 bp, Homo sapiens
gccatccctgtga

SEQ ID NO: 6276084 - DNA, 15 bp, Homo sapiens
gccatccctgtgagg

SEQ ID NO: 6276085 - DNA, 15 bp, Homo sapiens
gccatcccttgggga

SEQ ID NO: 6276086 - DNA, 17 bp, Homo sapiens
gccatccgcacagaaaa

SEQ ID NO: 6276087 - DNA, 22 bp, Homo sapiens
gccatccggcccccagagcgcc

SEQ ID NO: 6276088 - DNA, 20 bp, Homo sapiens
gccatccgggacgcttccag

SEQ ID NO: 6276089 - DNA, 18 bp, Homo sapiens
gccatccgtcaccagaat

SEQ ID NO: 6276090 - DNA, 16 bp, Homo sapiens
gccatcctaaggtgct

SEQ ID NO: 6276091 - DNA, 23 bp, Homo sapiens
gccatcctacccagcgtggccca

SEQ ID NO: 6276092 - DNA, 18 bp, Homo sapiens
gccatcctcaaacactgc

SEQ ID NO: 6276093 - DNA, 23 bp, Homo sapiens
gccatcctcaaacactgcaggca

SEQ ID NO: 6276094 - DNA, 21 bp, Homo sapiens
gccatcctcaaacgacagagg

SEQ ID NO: 6276095 - DNA, 19 bp, Homo sapiens
gccatcctccctgttcccc

SEQ ID NO: 6276096 - DNA, 22 bp, Homo sapiens
gccatcctccctgttccccaca

SEQ ID NO: 6276097 - DNA, 16 bp, Homo sapiens
gccatcctctgcctca

SEQ ID NO: 6276098 - DNA, 20 bp, Homo sapiens
gccatcctgcccttctgacc

SEQ ID NO: 6276099 - DNA, 20 bp, Homo sapiens
gccatccttccgccaatctg

SEQ ID NO: 6276100 - DNA, 18 bp, Homo sapiens
gccatccttgctgcagct

SEQ ID NO: 6276101 - DNA, 15 bp, Homo sapiens
gccatcgggtgccaa

SEQ ID NO: 6276102 - DNA, 14 bp, Homo sapiens
gccatctaaagtaa

SEQ ID NO: 6276103 - DNA, 23 bp, Homo sapiens
gccatctagccagcccctcttcc

SEQ ID NO: 6276104 - DNA, 23 bp, Homo sapiens
gccatctcaagcaagtttaatca

SEQ ID NO: 6276105 - DNA, 23 bp, Homo sapiens
gccatctcaattgtgctttgtat

SEQ ID NO: 6276106 - DNA, 19 bp, Homo sapiens
gccatctcacctcctgctg

SEQ ID NO: 6276107 - DNA, 20 bp, Homo sapiens
gccatctcacctcctgctgg

SEQ ID NO: 6276108 - DNA, 15 bp, Homo sapiens
gccatctcagattct

SEQ ID NO: 6276109 - DNA, 17 bp, Homo sapiens
gccatctcagattctgt

SEQ ID NO: 6276110 - DNA, 17 bp, Homo sapiens
gccatctcaggagatgg

SEQ ID NO: 6276111 - DNA, 18 bp, Homo sapiens
gccatctcatgaggggag

SEQ ID NO: 6276112 - DNA, 21 bp, Homo sapiens
gccatctcatgaggggagagg

SEQ ID NO: 6276113 - DNA, 16 bp, Homo sapiens
gccatctccaccctga

SEQ ID NO: 6276114 - DNA, 14 bp, Homo sapiens
gccatctccctccc

SEQ ID NO: 6276115 - DNA, 16 bp, Homo sapiens
gccatctccctcccca

SEQ ID NO: 6276116 - DNA, 23 bp, Homo sapiens
gccatctccctccccagaaacag

SEQ ID NO: 6276117 - DNA, 11 bp, Homo sapiens
gccatctcctc

SEQ ID NO: 6276118 - DNA, 15 bp, Homo sapiens
gccatctctgctcca

SEQ ID NO: 6276119 - DNA, 12 bp, Homo sapiens
gccatctctgga

SEQ ID NO: 6276120 - DNA, 17 bp, Homo sapiens
gccatctgaagccacct

SEQ ID NO: 6276121 - DNA, 22 bp, Homo sapiens
gccatctgaagccacctctctg

SEQ ID NO: 6276122 - DNA, 13 bp, Homo sapiens
gccatctgacagc

SEQ ID NO: 6276123 - DNA, 15 bp, Homo sapiens
gccatctgacagcag

SEQ ID NO: 6276124 - DNA, 22 bp, Homo sapiens
gccatctgactgccaagccaga

SEQ ID NO: 6276125 - DNA, 13 bp, Homo sapiens
gccatctgatccc

SEQ ID NO: 6276126 - DNA, 19 bp, Homo sapiens
gccatctgcccaggggtgc

SEQ ID NO: 6276127 - DNA, 14 bp, Homo sapiens
gccatctggagagc

SEQ ID NO: 6276128 - DNA, 23 bp, Homo sapiens
gccatctggttaggatggcagga

SEQ ID NO: 6276129 - DNA, 21 bp, Homo sapiens
gccatctgtgcacactaagaa

SEQ ID NO: 6276130 - DNA, 12 bp, Homo sapiens
gccatctgtgtg

SEQ ID NO: 6276131 - DNA, 17 bp, Homo sapiens
gccatctgttcatttct

SEQ ID NO: 6276132 - DNA, 21 bp, Homo sapiens
gccatctgttcatttctaaat

SEQ ID NO: 6276133 - DNA, 19 bp, Homo sapiens
gccatcttaaaaagcgggt

SEQ ID NO: 6276134 - DNA, 18 bp, Homo sapiens
gccatcttcacattctga

SEQ ID NO: 6276135 - DNA, 14 bp, Homo sapiens
gccatcttcccagc

SEQ ID NO: 6276136 - DNA, 19 bp, Homo sapiens
gccatcttcccgcctcagc

SEQ ID NO: 6276137 - DNA, 21 bp, Homo sapiens
gccatcttcccgcctcagcct

SEQ ID NO: 6276138 - DNA, 22 bp, Homo sapiens
gccatcttcccgcctcagcctc

SEQ ID NO: 6276139 - DNA, 20 bp, Homo sapiens
gccatcttctccccgaggct

SEQ ID NO: 6276140 - DNA, 23 bp, Homo sapiens
gccatcttctccccgaggctgcc

SEQ ID NO: 6276141 - DNA, 16 bp, Homo sapiens
gccatcttggcagggt

SEQ ID NO: 6276142 - DNA, 15 bp, Homo sapiens
gccatcttggtaaat

SEQ ID NO: 6276143 - DNA, 23 bp, Homo sapiens
gccatctttttatgcaaaagtca

SEQ ID NO: 6276144 - DNA, 22 bp, Homo sapiens
gccatgaacaaattctttagta

SEQ ID NO: 6276145 - DNA, 17 bp, Homo sapiens
gccatgaaccatgctta

SEQ ID NO: 6276146 - DNA, 15 bp, Homo sapiens
gccatgaactggagg

SEQ ID NO: 6276147 - DNA, 17 bp, Homo sapiens
gccatgaaggcacctgc

SEQ ID NO: 6276148 - DNA, 15 bp, Homo sapiens
gccatgaagggaccc

SEQ ID NO: 6276149 - DNA, 16 bp, Homo sapiens
gccatgaagggaccct

SEQ ID NO: 6276150 - DNA, 20 bp, Homo sapiens
gccatgaagtcaccgggatg

SEQ ID NO: 6276151 - DNA, 15 bp, Homo sapiens
gccatgaatttctac

SEQ ID NO: 6276152 - DNA, 14 bp, Homo sapiens
gccatgacagaggc

SEQ ID NO: 6276153 - DNA, 15 bp, Homo sapiens
gccatgacatttcat

SEQ ID NO: 6276154 - DNA, 14 bp, Homo sapiens
gccatgaccctgcc

SEQ ID NO: 6276155 - DNA, 16 bp, Homo sapiens
gccatgaccctgcctc

SEQ ID NO: 6276156 - DNA, 21 bp, Homo sapiens
gccatgaccctgcctctccca

SEQ ID NO: 6276157 - DNA, 18 bp, Homo sapiens
gccatgaccttacatttc

SEQ ID NO: 6276158 - DNA, 17 bp, Homo sapiens
gccatgactagggtcct

SEQ ID NO: 6276159 - DNA, 14 bp, Homo sapiens
gccatgactgctca

SEQ ID NO: 6276160 - DNA, 15 bp, Homo sapiens
gccatgactgctcag

SEQ ID NO: 6276161 - DNA, 20 bp, Homo sapiens
gccatgactgctcaggcctc

SEQ ID NO: 6276162 - DNA, 20 bp, Homo sapiens
gccatgagaatgttttagca

SEQ ID NO: 6276163 - DNA, 22 bp, Homo sapiens
gccatgagaatgttttagcaca

SEQ ID NO: 6276164 - DNA, 14 bp, Homo sapiens
gccatgagctccag

SEQ ID NO: 6276165 - DNA, 22 bp, Homo sapiens
gccatgagctccagacccccag

SEQ ID NO: 6276166 - DNA, 16 bp, Homo sapiens
gccatgaggaggcaga

SEQ ID NO: 6276167 - DNA, 20 bp, Homo sapiens
gccatgaggagttgctgttt

SEQ ID NO: 6276168 - DNA, 19 bp, Homo sapiens
gccatgaggcctcagtgga

SEQ ID NO: 6276169 - DNA, 18 bp, Homo sapiens
gccatgagtccatgtcct

SEQ ID NO: 6276170 - DNA, 14 bp, Homo sapiens
ggaaaatggaagac

SEQ ID NO: 6276171 - DNA, 16 bp, Homo sapiens
ggaaaatggcagaaag

SEQ ID NO: 6276172 - DNA, 21 bp, Homo sapiens
ggaaaatggccatgcaggagg

SEQ ID NO: 6276173 - DNA, 22 bp, Homo sapiens
ggaaaatgtcccccacctcttt

SEQ ID NO: 6276174 - DNA, 16 bp, Homo sapiens
ggaaaatgtgagggga

SEQ ID NO: 6276175 - DNA, 21 bp, Homo sapiens
ggaaaatgttttgtaagaaac

SEQ ID NO: 6276176 - DNA, 21 bp, Homo sapiens
ggaaaattcagataatggtaa

SEQ ID NO: 6276177 - DNA, 14 bp, Homo sapiens
ggaaaattgcccca

SEQ ID NO: 6276178 - DNA, 15 bp, Homo sapiens
ggaaacaaaagattc

SEQ ID NO: 6276179 - DNA, 14 bp, Homo sapiens
ggaaacaaagctta

SEQ ID NO: 6276180 - DNA, 13 bp, Homo sapiens
ggaaacaaagtgg

SEQ ID NO: 6276181 - DNA, 22 bp, Homo sapiens
ggaaacaaagtggaaggaaaga

SEQ ID NO: 6276182 - DNA, 21 bp, Homo sapiens
ggaaacaaataatttgaactt

SEQ ID NO: 6276183 - DNA, 19 bp, Homo sapiens
ggaaacaagtgaccccagg

SEQ ID NO: 6276184 - DNA, 21 bp, Homo sapiens
ggaaacaagtgaccccagggc

SEQ ID NO: 6276185 - DNA, 15 bp, Homo sapiens
ggaaacaatcctgtt

SEQ ID NO: 6276186 - DNA, 13 bp, Homo sapiens
ggaaacaatgaaa

SEQ ID NO: 6276187 - DNA, 20 bp, Homo sapiens
ggaaacaattctttcaactg

SEQ ID NO: 6276188 - DNA, 21 bp, Homo sapiens
ggaaacacacacagacacaca

SEQ ID NO: 6276189 - DNA, 22 bp, Homo sapiens
ggaaacaccgagtctctgtata

SEQ ID NO: 6276190 - DNA, 23 bp, Homo sapiens
ggaaacactttgaggacatttat

SEQ ID NO: 6276191 - DNA, 19 bp, Homo sapiens
ggaaacagaaaagagaaga

SEQ ID NO: 6276192 - DNA, 20 bp, Homo sapiens
ggaaacagaaaagagaagaa

SEQ ID NO: 6276193 - DNA, 23 bp, Homo sapiens
ggaaacagaactcgatgcactga

SEQ ID NO: 6276194 - DNA, 23 bp, Homo sapiens
ggaaacagacaagcaacccaaac

SEQ ID NO: 6276195 - DNA, 17 bp, Homo sapiens
ggaaacagacagggaga

SEQ ID NO: 6276196 - DNA, 13 bp, Homo sapiens
ggaaacagactcg

SEQ ID NO: 6276197 - DNA, 13 bp, Homo sapiens
ggaaacagaggta

SEQ ID NO: 6276198 - DNA, 17 bp, Homo sapiens
ggaaacagcaaacagtg

SEQ ID NO: 6276199 - DNA, 11 bp, Homo sapiens
ggaaacagcat

SEQ ID NO: 6276200 - DNA, 12 bp, Homo sapiens
ggaaacagcatg

SEQ ID NO: 6276201 - DNA, 15 bp, Homo sapiens
ggaaacagcatgaat

SEQ ID NO: 6276202 - DNA, 16 bp, Homo sapiens
ggaaacagcatgaata

SEQ ID NO: 6276203 - DNA, 14 bp, Homo sapiens
ggaaacagcctcag

SEQ ID NO: 6276204 - DNA, 11 bp, Homo sapiens
ggaaacagctg

SEQ ID NO: 6276205 - DNA, 20 bp, Homo sapiens
ggaaacagctttaggggtgg

SEQ ID NO: 6276206 - DNA, 15 bp, Homo sapiens
ggaaacaggaccaca

SEQ ID NO: 6276207 - DNA, 13 bp, Homo sapiens
ggaaacagggcag

SEQ ID NO: 6276208 - DNA, 13 bp, Homo sapiens
ggaaacaggtgtg

SEQ ID NO: 6276209 - DNA, 20 bp, Homo sapiens
ggaaacaggtgtgtgtgaac

SEQ ID NO: 6276210 - DNA, 23 bp, Homo sapiens
ggaaacatacagaggatgccttt

SEQ ID NO: 6276211 - DNA, 16 bp, Homo sapiens
ggaaacatagaaagac

SEQ ID NO: 6276212 - DNA, 17 bp, Homo sapiens
ggaaacatagaaagaca

SEQ ID NO: 6276213 - DNA, 14 bp, Homo sapiens
ggaaacatctgatt

SEQ ID NO: 6276214 - DNA, 20 bp, Homo sapiens
ggaaacattggcataatttt

SEQ ID NO: 6276215 - DNA, 19 bp, Homo sapiens
ggaaaccaaggtcaggagg

SEQ ID NO: 6276216 - DNA, 19 bp, Homo sapiens
ggaaaccaagtcaggccag

SEQ ID NO: 6276217 - DNA, 18 bp, Homo sapiens
ggaaaccacagctgctgg

SEQ ID NO: 6276218 - DNA, 19 bp, Homo sapiens
ggaaaccacagtcagtgga

SEQ ID NO: 6276219 - DNA, 19 bp, Homo sapiens
ggaaaccaccttaaaacat

SEQ ID NO: 6276220 - DNA, 15 bp, Homo sapiens
ggaaacccagctctg

SEQ ID NO: 6276221 - DNA, 14 bp, Homo sapiens
ggaaacccgagggt

SEQ ID NO: 6276222 - DNA, 16 bp, Homo sapiens
ggaaaccctggagcca

SEQ ID NO: 6276223 - DNA, 17 bp, Homo sapiens
ggaaaccctggagccat

SEQ ID NO: 6276224 - DNA, 19 bp, Homo sapiens
ggaaaccctggagccatcc

SEQ ID NO: 6276225 - DNA, 17 bp, Homo sapiens
ggaaacctgagatctgt

SEQ ID NO: 6276226 - DNA, 18 bp, Homo sapiens
ggaaacctgccctgcctg

SEQ ID NO: 6276227 - DNA, 22 bp, Homo sapiens
ggaaacctgccctgcctgaggg

SEQ ID NO: 6276228 - DNA, 12 bp, Homo sapiens
ggaaacctgcct

SEQ ID NO: 6276229 - DNA, 14 bp, Homo sapiens
ggaaacctgtctga

SEQ ID NO: 6276230 - DNA, 18 bp, Homo sapiens
ggaaacctgttatgccaa

SEQ ID NO: 6276231 - DNA, 19 bp, Homo sapiens
ggaaaccttcacccagcac

SEQ ID NO: 6276232 - DNA, 18 bp, Homo sapiens
ggaaaccttccacccagt

SEQ ID NO: 6276233 - DNA, 15 bp, Homo sapiens
ggaaaccttgcagca

SEQ ID NO: 6276234 - DNA, 17 bp, Homo sapiens
ggaaacgcacttacaag

SEQ ID NO: 6276235 - DNA, 18 bp, Homo sapiens
ggaaactaataaaatatt

SEQ ID NO: 6276236 - DNA, 21 bp, Homo sapiens
ggaaactaggtgcatatttat

SEQ ID NO: 6276237 - DNA, 23 bp, Homo sapiens
ggaaactatgtgtttttctcata

SEQ ID NO: 6276238 - DNA, 15 bp, Homo sapiens
ggaaactcaaggagg

SEQ ID NO: 6276239 - DNA, 18 bp, Homo sapiens
ggaaactcacactcccct

SEQ ID NO: 6276240 - DNA, 13 bp, Homo sapiens
ggaaactcagccg

SEQ ID NO: 6276241 - DNA, 21 bp, Homo sapiens
ggaaactccacatctgcctta

SEQ ID NO: 6276242 - DNA, 12 bp, Homo sapiens
ggaaactctggt

SEQ ID NO: 6276243 - DNA, 14 bp, Homo sapiens
ggaaactgaagcat

SEQ ID NO: 6276244 - DNA, 21 bp, Homo sapiens
ggaaactggcgatctcccagg

SEQ ID NO: 6276245 - DNA, 22 bp, Homo sapiens
ggaaactggcgatctcccaggg

SEQ ID NO: 6276246 - DNA, 14 bp, Homo sapiens
ggaaactgggaaac

SEQ ID NO: 6276247 - DNA, 18 bp, Homo sapiens
ggaaacttagcttttgat

SEQ ID NO: 6276248 - DNA, 21 bp, Homo sapiens
ggaaacttccaagacctgact

SEQ ID NO: 6276249 - DNA, 23 bp, Homo sapiens
ggaaacttcctataccggagctc

SEQ ID NO: 6276250 - DNA, 15 bp, Homo sapiens
ggaaacttctgtaag

SEQ ID NO: 6276251 - DNA, 20 bp, Homo sapiens
ggaaacttgtcacttgcatg

SEQ ID NO: 6276252 - DNA, 12 bp, Homo sapiens
ggaaactttatt

SEQ ID NO: 6276253 - DNA, 22 bp, Homo sapiens
ggaaagaaagcacctgttttta

SEQ ID NO: 6276254 - DNA, 12 bp, Homo sapiens
ggaaagaagaaa

SEQ ID NO: 6276255 - DNA, 15 bp, Homo sapiens
ggaaagaagagccgg

SEQ ID NO: 6276256 - DNA, 18 bp, Homo sapiens
ggaaagaagagccggagc

SEQ ID NO: 6276257 - DNA, 14 bp, Homo sapiens
ggaaagaaggaaaa

SEQ ID NO: 6276258 - DNA, 17 bp, Homo sapiens
ggaaagaagggggccct

SEQ ID NO: 6276259 - DNA, 20 bp, Homo sapiens
ggaaagacactgcctgggct

SEQ ID NO: 6276260 - DNA, 17 bp, Homo sapiens
ggaaagacaggaagacc

SEQ ID NO: 6276261 - DNA, 19 bp, Homo sapiens
ggaaagacctgtgagggga

SEQ ID NO: 6276262 - DNA, 16 bp, Homo sapiens
ggaaagactgaaagaa

SEQ ID NO: 6276263 - DNA, 13 bp, Homo sapiens
ggaaagagaaatg

SEQ ID NO: 6276264 - DNA, 15 bp, Homo sapiens
ggaaagagagctgga

SEQ ID NO: 6276265 - DNA, 18 bp, Homo sapiens
ggaaagagagtttgtaag

SEQ ID NO: 6276266 - DNA, 19 bp, Homo sapiens
ggaaagaggagaaggagag

SEQ ID NO: 6276267 - DNA, 16 bp, Homo sapiens
ggaaagagtaggaaga

SEQ ID NO: 6276268 - DNA, 14 bp, Homo sapiens
ggaaagataataaa

SEQ ID NO: 6276269 - DNA, 23 bp, Homo sapiens
ggaaagataataaattgatttgt

SEQ ID NO: 6276270 - DNA, 15 bp, Homo sapiens
ggaaagatggggagc

SEQ ID NO: 6276271 - DNA, 14 bp, Homo sapiens
ggaaagatgtccca

SEQ ID NO: 6276272 - DNA, 16 bp, Homo sapiens
ggaaagatgtcccaca

SEQ ID NO: 6276273 - DNA, 19 bp, Homo sapiens
ggaaagatgttaagcattt

SEQ ID NO: 6276274 - DNA, 20 bp, Homo sapiens
ggaaagatgttaagcattta

SEQ ID NO: 6276275 - DNA, 14 bp, Homo sapiens
ggaaagattatatt

SEQ ID NO: 6276276 - DNA, 20 bp, Homo sapiens
ggaaagatttgtgaactgga

SEQ ID NO: 6276277 - DNA, 13 bp, Homo sapiens
ggaaagcaaagca

SEQ ID NO: 6276278 - DNA, 16 bp, Homo sapiens
ggaaagcaaagcacag

SEQ ID NO: 6276279 - DNA, 20 bp, Homo sapiens
ggaaagcaaagcacagagag

SEQ ID NO: 6276280 - DNA, 19 bp, Homo sapiens
ggaaagcaaaggagattgg

SEQ ID NO: 6276281 - DNA, 16 bp, Homo sapiens
ggaaagcaagaatcag

SEQ ID NO: 6276282 - DNA, 19 bp, Homo sapiens
ggaaagcaaggcagaaggc

SEQ ID NO: 6276283 - DNA, 17 bp, Homo sapiens
ggaaagcacaggtgggc

SEQ ID NO: 6276284 - DNA, 21 bp, Homo sapiens
ggaaagcaccgcagcatgtgg

SEQ ID NO: 6276285 - DNA, 13 bp, Homo sapiens
ggaaagcagaact

SEQ ID NO: 6276286 - DNA, 20 bp, Homo sapiens
ggaaagcagagcctcctggg

SEQ ID NO: 6276287 - DNA, 14 bp, Homo sapiens
ggaaagcagctcaa

SEQ ID NO: 6276288 - DNA, 15 bp, Homo sapiens
ggaaagcaggatgta

SEQ ID NO: 6276289 - DNA, 19 bp, Homo sapiens
ggaaagcaggtggcatctc

SEQ ID NO: 6276290 - DNA, 15 bp, Homo sapiens
ggaaagcagtgtgtc

SEQ ID NO: 6276291 - DNA, 19 bp, Homo sapiens
ggaaagcatcacctcaggc

SEQ ID NO: 6276292 - DNA, 19 bp, Homo sapiens
ggaaagccacacggagagg

SEQ ID NO: 6276293 - DNA, 20 bp, Homo sapiens
ggaaagccacacggagaggc

SEQ ID NO: 6276294 - DNA, 14 bp, Homo sapiens
ggaaagccacatct

SEQ ID NO: 6276295 - DNA, 12 bp, Homo sapiens
ggaaagccagcc

SEQ ID NO: 6276296 - DNA, 18 bp, Homo sapiens
ggaaagccagtgactcca

SEQ ID NO: 6276297 - DNA, 19 bp, Homo sapiens
ggaaagccagtgactccag

SEQ ID NO: 6276298 - DNA, 20 bp, Homo sapiens
ggaaagccattgaccaccca

SEQ ID NO: 6276299 - DNA, 16 bp, Homo sapiens
ggaaagcctctgctgc

SEQ ID NO: 6276300 - DNA, 15 bp, Homo sapiens
ggaaagcctctggcc

SEQ ID NO: 6276301 - DNA, 18 bp, Homo sapiens
ggaaagctgtgccttttt

SEQ ID NO: 6276302 - DNA, 19 bp, Homo sapiens
ggaaaggaaaaccagggat

SEQ ID NO: 6276303 - DNA, 13 bp, Homo sapiens
ggaaaggaaacat

SEQ ID NO: 6276304 - DNA, 17 bp, Homo sapiens
ggaaaggaatgcaaaga

SEQ ID NO: 6276305 - DNA, 15 bp, Homo sapiens
ggaaaggagaggaaa

SEQ ID NO: 6276306 - DNA, 11 bp, Homo sapiens
ggaaaggagga

SEQ ID NO: 6276307 - DNA, 21 bp, Homo sapiens
ggaaaggagtagaaaaagcag

SEQ ID NO: 6276308 - DNA, 19 bp, Homo sapiens
ggaaaggattttaccaaag

SEQ ID NO: 6276309 - DNA, 12 bp, Homo sapiens
ggaaaggcagaa

SEQ ID NO: 6276310 - DNA, 18 bp, Homo sapiens
ggaaaggcagggccctga

SEQ ID NO: 6276311 - DNA, 12 bp, Homo sapiens
ggaaaggccagc

SEQ ID NO: 6276312 - DNA, 19 bp, Homo sapiens
ggaaaggccagcagccttc

SEQ ID NO: 6276313 - DNA, 15 bp, Homo sapiens
ggaaaggccagctgg

SEQ ID NO: 6276314 - DNA, 20 bp, Homo sapiens
ggaaaggccagctggcagca

SEQ ID NO: 6276315 - DNA, 23 bp, Homo sapiens
ggaaaggctcagtctcaggagca

SEQ ID NO: 6276316 - DNA, 17 bp, Homo sapiens
ggaaaggctcatttaaa

SEQ ID NO: 6276317 - DNA, 13 bp, Homo sapiens
ggaaaggctccag

SEQ ID NO: 6276318 - DNA, 14 bp, Homo sapiens
ggaaaggctccagg

SEQ ID NO: 6276319 - DNA, 21 bp, Homo sapiens
ggaaaggctccaggagcagcc

SEQ ID NO: 6276320 - DNA, 19 bp, Homo sapiens
ggaaaggcttggctggtgt

SEQ ID NO: 6276321 - DNA, 16 bp, Homo sapiens
ggaaagggaagcctga

SEQ ID NO: 6276322 - DNA, 17 bp, Homo sapiens
ggaaagggaagcctgac

SEQ ID NO: 6276323 - DNA, 18 bp, Homo sapiens
ggaaagggagatgtcagg

SEQ ID NO: 6276324 - DNA, 13 bp, Homo sapiens
ggaaagggaggaa

SEQ ID NO: 6276325 - DNA, 17 bp, Homo sapiens
ggaaagggcctggccag

SEQ ID NO: 6276326 - DNA, 15 bp, Homo sapiens
ggaaagggctggctc

SEQ ID NO: 6276327 - DNA, 18 bp, Homo sapiens
ggaaaggggacaaggaag

SEQ ID NO: 6276328 - DNA, 11 bp, Homo sapiens
ggaaaggggag

SEQ ID NO: 6276329 - DNA, 19 bp, Homo sapiens
ggaaaggggagagcctgct

SEQ ID NO: 6276330 - DNA, 16 bp, Homo sapiens
ggaaagggggtgacct

SEQ ID NO: 6276331 - DNA, 13 bp, Homo sapiens
ggaaaggtgctca

SEQ ID NO: 6276332 - DNA, 14 bp, Homo sapiens
ggaaaggtgctcaa

SEQ ID NO: 6276333 - DNA, 15 bp, Homo sapiens
ggaaaggtgctcaaa

SEQ ID NO: 6276334 - DNA, 16 bp, Homo sapiens
ggaaaggtgctcaaag

SEQ ID NO: 6276335 - DNA, 20 bp, Homo sapiens
ggaaaggtgtgagactggga

SEQ ID NO: 6276336 - DNA, 15 bp, Homo sapiens
ggaaaggtgttgatt

SEQ ID NO: 6276337 - DNA, 20 bp, Homo sapiens
ggaaaggtttggaaaactaa

SEQ ID NO: 6276338 - DNA, 14 bp, Homo sapiens
ggaaaggttttgta

SEQ ID NO: 6276339 - DNA, 23 bp, Homo sapiens
ggaaagtattctcttttcaagaa

SEQ ID NO: 6276340 - DNA, 22 bp, Homo sapiens
ggaaagtcacccaaacacttct

SEQ ID NO: 6276341 - DNA, 21 bp, Homo sapiens
ggaaagtcattggctttatcc

SEQ ID NO: 6276342 - DNA, 13 bp, Homo sapiens
ggaaagtgaattt

SEQ ID NO: 6276343 - DNA, 19 bp, Homo sapiens
ggaaagtgaatttgaatga

SEQ ID NO: 6276344 - DNA, 22 bp, Homo sapiens
ggaaagtgaatttgaatgaaaa

SEQ ID NO: 6276345 - DNA, 20 bp, Homo sapiens
ggaaagtggcacctgtctgc

SEQ ID NO: 6276346 - DNA, 11 bp, Homo sapiens
ggaaagtggtg

SEQ ID NO: 6276347 - DNA, 16 bp, Homo sapiens
ggaaagtgtaaagcat

SEQ ID NO: 6276348 - DNA, 13 bp, Homo sapiens
ggaaagtgtgaag

SEQ ID NO: 6276349 - DNA, 16 bp, Homo sapiens
ggaaagtgtgaagacc

SEQ ID NO: 6276350 - DNA, 16 bp, Homo sapiens
gccatgagttttcaga

SEQ ID NO: 6276351 - DNA, 15 bp, Homo sapiens
gccatgatagctggg

SEQ ID NO: 6276352 - DNA, 16 bp, Homo sapiens
gccatgatcagacata

SEQ ID NO: 6276353 - DNA, 19 bp, Homo sapiens
gccatgatcagacatacag

SEQ ID NO: 6276354 - DNA, 22 bp, Homo sapiens
gccatgatctgtatttaatggt

SEQ ID NO: 6276355 - DNA, 22 bp, Homo sapiens
gccatgatggaaatatttattt

SEQ ID NO: 6276356 - DNA, 17 bp, Homo sapiens
gccatgatggcaacaga

SEQ ID NO: 6276357 - DNA, 21 bp, Homo sapiens
gccatgatggcaacagatctg

SEQ ID NO: 6276358 - DNA, 23 bp, Homo sapiens
gccatgatttcccactgcactcc

SEQ ID NO: 6276359 - DNA, 19 bp, Homo sapiens
gccatgattttggccactt

SEQ ID NO: 6276360 - DNA, 23 bp, Homo sapiens
gccatgatttttggtatttatgt

SEQ ID NO: 6276361 - DNA, 14 bp, Homo sapiens
gccatgcaattcat

SEQ ID NO: 6276362 - DNA, 15 bp, Homo sapiens
gccatgcagaaagca

SEQ ID NO: 6276363 - DNA, 18 bp, Homo sapiens
gccatgcaggaagaggcc

SEQ ID NO: 6276364 - DNA, 17 bp, Homo sapiens
gccatgcaggaggtgga

SEQ ID NO: 6276365 - DNA, 21 bp, Homo sapiens
gccatgcaggaggtggagaaa

SEQ ID NO: 6276366 - DNA, 20 bp, Homo sapiens
gccatgccaataaagtgatc

SEQ ID NO: 6276367 - DNA, 14 bp, Homo sapiens
gccatgccaccctg

SEQ ID NO: 6276368 - DNA, 12 bp, Homo sapiens
gccatgccactg

SEQ ID NO: 6276369 - DNA, 21 bp, Homo sapiens
gccatgccactgccaggcacc

SEQ ID NO: 6276370 - DNA, 14 bp, Homo sapiens
gccatgccagctgg

SEQ ID NO: 6276371 - DNA, 13 bp, Homo sapiens
gccatgccagctt

SEQ ID NO: 6276372 - DNA, 16 bp, Homo sapiens
gccatgccaggaacct

SEQ ID NO: 6276373 - DNA, 19 bp, Homo sapiens
gccatgcccacgcccctcc

SEQ ID NO: 6276374 - DNA, 21 bp, Homo sapiens
gccatgcccacgcccctcccc

SEQ ID NO: 6276375 - DNA, 23 bp, Homo sapiens
gccatgcccacgcccctccccag

SEQ ID NO: 6276376 - DNA, 12 bp, Homo sapiens
gccatgcccaga

SEQ ID NO: 6276377 - DNA, 13 bp, Homo sapiens
gccatgcccagga

SEQ ID NO: 6276378 - DNA, 15 bp, Homo sapiens
gccatgccccacccc

SEQ ID NO: 6276379 - DNA, 19 bp, Homo sapiens
gccatgccccacccccctc

SEQ ID NO: 6276380 - DNA, 18 bp, Homo sapiens
gccatgccgtctgccgga

SEQ ID NO: 6276381 - DNA, 14 bp, Homo sapiens
gccatgcctatggg

SEQ ID NO: 6276382 - DNA, 21 bp, Homo sapiens
gccatgcctatgggccagagt

SEQ ID NO: 6276383 - DNA, 17 bp, Homo sapiens
gccatgcctcagccctg

SEQ ID NO: 6276384 - DNA, 17 bp, Homo sapiens
gccatgcctcatgccac

SEQ ID NO: 6276385 - DNA, 14 bp, Homo sapiens
gccatgcctccctg

SEQ ID NO: 6276386 - DNA, 15 bp, Homo sapiens
gccatgcctgctccc

SEQ ID NO: 6276387 - DNA, 17 bp, Homo sapiens
gccatgcctgctccctg

SEQ ID NO: 6276388 - DNA, 20 bp, Homo sapiens
gccatgcctgctccctgtct

SEQ ID NO: 6276389 - DNA, 23 bp, Homo sapiens
gccatgcctgctccctgtctgtg

SEQ ID NO: 6276390 - DNA, 16 bp, Homo sapiens
gccatgcgcgcgctct

SEQ ID NO: 6276391 - DNA, 23 bp, Homo sapiens
gccatgcgcgcgctctctctctt

SEQ ID NO: 6276392 - DNA, 15 bp, Homo sapiens
gccatgctacagtta

SEQ ID NO: 6276393 - DNA, 18 bp, Homo sapiens
gccatgctcctcttcccc

SEQ ID NO: 6276394 - DNA, 21 bp, Homo sapiens
gccatgctcctcttccccaga

SEQ ID NO: 6276395 - DNA, 24 bp, Homo sapiens
gccatgctcctggcccactgcatc

SEQ ID NO: 6276396 - DNA, 13 bp, Homo sapiens
gccatgctgaggc

SEQ ID NO: 6276397 - DNA, 14 bp, Homo sapiens
gccatgctgaggcc

SEQ ID NO: 6276398 - DNA, 20 bp, Homo sapiens
gccatgctgaggcctgggcc

SEQ ID NO: 6276399 - DNA, 21 bp, Homo sapiens
gccatgctgaggcctgggccg

SEQ ID NO: 6276400 - DNA, 19 bp, Homo sapiens
gccatgctgctatgaagac

SEQ ID NO: 6276401 - DNA, 14 bp, Homo sapiens
gccatgctggctca

SEQ ID NO: 6276402 - DNA, 14 bp, Homo sapiens
gccatgctgtccct

SEQ ID NO: 6276403 - DNA, 17 bp, Homo sapiens
gccatgctgtccctgca

SEQ ID NO: 6276404 - DNA, 13 bp, Homo sapiens
gccatgcttcttg

SEQ ID NO: 6276405 - DNA, 22 bp, Homo sapiens
gccatgcttcttgccccttggg

SEQ ID NO: 6276406 - DNA, 12 bp, Homo sapiens
gccatgcttttt

SEQ ID NO: 6276407 - DNA, 17 bp, Homo sapiens
gccatgctttttggtga

SEQ ID NO: 6276408 - DNA, 22 bp, Homo sapiens
gccatggaagaggctacagggc

SEQ ID NO: 6276409 - DNA, 14 bp, Homo sapiens
gccatggaaggtgc

SEQ ID NO: 6276410 - DNA, 18 bp, Homo sapiens
gccatggaaggtgccaga

SEQ ID NO: 6276411 - DNA, 17 bp, Homo sapiens
gccatggaataaaccat

SEQ ID NO: 6276412 - DNA, 19 bp, Homo sapiens
gccatggacgaatatgaat

SEQ ID NO: 6276413 - DNA, 20 bp, Homo sapiens
gccatggactctgtcctgaa

SEQ ID NO: 6276414 - DNA, 21 bp, Homo sapiens
gccatggactctgtcctgaag

SEQ ID NO: 6276415 - DNA, 22 bp, Homo sapiens
gccatggactctgtcctgaagg

SEQ ID NO: 6276416 - DNA, 21 bp, Homo sapiens
gccatggagaaagctgacttg

SEQ ID NO: 6276417 - DNA, 20 bp, Homo sapiens
gccatggagagctggagcct

SEQ ID NO: 6276418 - DNA, 13 bp, Homo sapiens
gccatggaggcag

SEQ ID NO: 6276419 - DNA, 14 bp, Homo sapiens
gccatggagtgaga

SEQ ID NO: 6276420 - DNA, 14 bp, Homo sapiens
gccatggcatgctc

SEQ ID NO: 6276421 - DNA, 23 bp, Homo sapiens
gccatggccaaggggccagctgc

SEQ ID NO: 6276422 - DNA, 13 bp, Homo sapiens
gccatggccagga

SEQ ID NO: 6276423 - DNA, 19 bp, Homo sapiens
gccatggccccccactccc

SEQ ID NO: 6276424 - DNA, 23 bp, Homo sapiens
gccatggccctcccagtgcctcc

SEQ ID NO: 6276425 - DNA, 23 bp, Homo sapiens
gccatggcctgcaaactgggaac

SEQ ID NO: 6276426 - DNA, 20 bp, Homo sapiens
gccatggcgagatactgcat

SEQ ID NO: 6276427 - DNA, 13 bp, Homo sapiens
gccatggctcagg

SEQ ID NO: 6276428 - DNA, 21 bp, Homo sapiens
gccatggctcaggcaagcccc

SEQ ID NO: 6276429 - DNA, 23 bp, Homo sapiens
gccatggctcaggcaagcccctc

SEQ ID NO: 6276430 - DNA, 17 bp, Homo sapiens
gccatggctcagggtgg

SEQ ID NO: 6276431 - DNA, 19 bp, Homo sapiens
gccatggctggatgtgcat

SEQ ID NO: 6276432 - DNA, 12 bp, Homo sapiens
gccatggctggg

SEQ ID NO: 6276433 - DNA, 13 bp, Homo sapiens
gccatggctgggg

SEQ ID NO: 6276434 - DNA, 15 bp, Homo sapiens
gccatgggaacctca

SEQ ID NO: 6276435 - DNA, 19 bp, Homo sapiens
gccatgggacagggaggac

SEQ ID NO: 6276436 - DNA, 17 bp, Homo sapiens
gccatgggaccaaacct

SEQ ID NO: 6276437 - DNA, 17 bp, Homo sapiens
gccatgggacctcctcc

SEQ ID NO: 6276438 - DNA, 15 bp, Homo sapiens
gccatgggagagtcc

SEQ ID NO: 6276439 - DNA, 22 bp, Homo sapiens
gccatgggagagtccaggcctg

SEQ ID NO: 6276440 - DNA, 19 bp, Homo sapiens
gccatgggcactgtgggta

SEQ ID NO: 6276441 - DNA, 15 bp, Homo sapiens
gccatgggccagcct

SEQ ID NO: 6276442 - DNA, 16 bp, Homo sapiens
gccatgggccagccta

SEQ ID NO: 6276443 - DNA, 22 bp, Homo sapiens
gccatgggccagcctagccctt

SEQ ID NO: 6276444 - DNA, 15 bp, Homo sapiens
gccatgggcctcctg

SEQ ID NO: 6276445 - DNA, 12 bp, Homo sapiens
gccatgggcctg

SEQ ID NO: 6276446 - DNA, 13 bp, Homo sapiens
gccatgggcctgg

SEQ ID NO: 6276447 - DNA, 15 bp, Homo sapiens
gccatgggcctgggc

SEQ ID NO: 6276448 - DNA, 13 bp, Homo sapiens
gccatggggcagc

SEQ ID NO: 6276449 - DNA, 14 bp, Homo sapiens
gccatggggcagcc

SEQ ID NO: 6276450 - DNA, 16 bp, Homo sapiens
gccatggggccctccc

SEQ ID NO: 6276451 - DNA, 20 bp, Homo sapiens
gccatgggtagcctgggtgt

SEQ ID NO: 6276452 - DNA, 13 bp, Homo sapiens
gccatgggtcctc

SEQ ID NO: 6276453 - DNA, 23 bp, Homo sapiens
gccatgggtcctcggcccatctg

SEQ ID NO: 6276454 - DNA, 17 bp, Homo sapiens
gccatgggtgcagaccc

SEQ ID NO: 6276455 - DNA, 19 bp, Homo sapiens
gccatgggtggaaagtgct

SEQ ID NO: 6276456 - DNA, 19 bp, Homo sapiens
gccatggtcaccctcagga

SEQ ID NO: 6276457 - DNA, 23 bp, Homo sapiens
gccatggtgaactgataattttt

SEQ ID NO: 6276458 - DNA, 14 bp, Homo sapiens
gccatggtggaggg

SEQ ID NO: 6276459 - DNA, 19 bp, Homo sapiens
gccatggtggagggcactt
